United States Patent 7,374,927 (METHODS OF ANALYSIS OF DEGRADED NUCLEIC ACID SAMPLES) - sequence listing, part 9

SEQ ID NO: 320604 - DNA, 25 bp, Homo sapien
gatcctggttggagtaaaacattcc

SEQ ID NO: 320605 - DNA, 25 bp, Homo sapien
ggttggagtaaaacattccatggga

SEQ ID NO: 320606 - DNA, 25 bp, Homo sapien
gctgtgagaaatgtcctaaccacct

SEQ ID NO: 320607 - DNA, 25 bp, Homo sapien
gagaaatgtcctaaccacctgactg

SEQ ID NO: 320608 - DNA, 25 bp, Homo sapien
aaatgtcctaaccacctgactgcag

SEQ ID NO: 320609 - DNA, 25 bp, Homo sapien
aggcactgtgcacaccattggactg

SEQ ID NO: 320610 - DNA, 25 bp, Homo sapien
accattggactgctgaccacagtta

SEQ ID NO: 320611 - DNA, 25 bp, Homo sapien
gtaaaatttcgtaactggtcacagc

SEQ ID NO: 320612 - DNA, 25 bp, Homo sapien
gtaactggtcacagctcattcataa

SEQ ID NO: 320613 - DNA, 25 bp, Homo sapien
tcactgtattttttgaccctgataa

SEQ ID NO: 320614 - DNA, 25 bp, Homo sapien
gatggtgttctggtactgtaattgg

SEQ ID NO: 320615 - DNA, 25 bp, Homo sapien
gatggtgtccagagatacatcacac

SEQ ID NO: 320616 - DNA, 25 bp, Homo sapien
agatacatcacactttacatcctat

SEQ ID NO: 320617 - DNA, 25 bp, Homo sapien
tttacatcctatcttactgtcctct

SEQ ID NO: 320618 - DNA, 25 bp, Homo sapien
atcttactgtcctctgtttttctta

SEQ ID NO: 320619 - DNA, 25 bp, Homo sapien
tctgtttttcttaccctccttacat

SEQ ID NO: 320620 - DNA, 25 bp, Homo sapien
ttcatccatggaatcatactgtagt

SEQ ID NO: 320621 - DNA, 25 bp, Homo sapien
ggaatcatactgtagtttcaatgta

SEQ ID NO: 320622 - DNA, 25 bp, Homo sapien
agatgagttgatactcccagcgttc

SEQ ID NO: 320623 - DNA, 25 bp, Homo sapien
aacagccacttagatttgagaacta

SEQ ID NO: 320624 - DNA, 25 bp, Homo sapien
tcccagcgttcccaaatattgttag

SEQ ID NO: 320625 - DNA, 25 bp, Homo sapien
ttgagaactatgctaagtgctttgc

SEQ ID NO: 320626 - DNA, 25 bp, Homo sapien
aagtgctttgcaggcagtatctcgt

SEQ ID NO: 320627 - DNA, 25 bp, Homo sapien
ttgcaggcagtatctcgtcttgttt

SEQ ID NO: 320628 - DNA, 25 bp, Homo sapien
ggcagtatctcgtcttgtttcagaa

SEQ ID NO: 320629 - DNA, 25 bp, Homo sapien
gtatctcgtcttgtttcagaataaa

SEQ ID NO: 320630 - DNA, 25 bp, Homo sapien
aagactgtttctaattcatccatgg

SEQ ID NO: 320631 - DNA, 25 bp, Homo sapien
ctccgattattccactaaggcacat

SEQ ID NO: 320632 - DNA, 25 bp, Homo sapien
accagacatcacagatttctccatg

SEQ ID NO: 320633 - DNA, 25 bp, Homo sapien
agtcctaaatcttctttaaagtcag

SEQ ID NO: 320634 - DNA, 25 bp, Homo sapien
ataggtatcttagttactgacagta

SEQ ID NO: 320635 - DNA, 25 bp, Homo sapien
ttttttctcccttggtgatatgtca

SEQ ID NO: 320636 - DNA, 25 bp, Homo sapien
tcccttggtgatatgtcattccatc

SEQ ID NO: 320637 - DNA, 25 bp, Homo sapien
ggtaatacattatcatcaatcctta

SEQ ID NO: 320638 - DNA, 25 bp, Homo sapien
tcatcaatccttaaacagtaacagt

SEQ ID NO: 320639 - DNA, 25 bp, Homo sapien
acagtaacagtcttggcacttatca

SEQ ID NO: 320640 - DNA, 25 bp, Homo sapien
ttggcacttatcacaaaaccgaccc

SEQ ID NO: 320641 - DNA, 25 bp, Homo sapien
tcacaaaaccgacccatttcttata

SEQ ID NO: 320642 - DNA, 25 bp, Homo sapien
actgatccattaaaatttccacttg

SEQ ID NO: 320643 - DNA, 25 bp, Homo sapien
ttttgccattagtaatctcttaaac

SEQ ID NO: 320644 - DNA, 25 bp, Homo sapien
agtaatctcttaaacaagtccaagg

SEQ ID NO: 320645 - DNA, 25 bp, Homo sapien
gaatgcttttatactagtgctttca

SEQ ID NO: 320646 - DNA, 25 bp, Homo sapien
tagtgctttcaagagttcgtgttgc

SEQ ID NO: 320647 - DNA, 25 bp, Homo sapien
aagagttcgtgttgctgactccagt

SEQ ID NO: 320648 - DNA, 25 bp, Homo sapien
cgtgttgctgactccagtttttaaa

SEQ ID NO: 320649 - DNA, 25 bp, Homo sapien
aattattattctcatcttctgcaat

SEQ ID NO: 320650 - DNA, 25 bp, Homo sapien
cctcgaggcatgtttttagctgaat

SEQ ID NO: 320651 - DNA, 25 bp, Homo sapien
aataattatgggattgtgcaatact

SEQ ID NO: 320652 - DNA, 25 bp, Homo sapien
ctttacttagtctaggaaattcagt

SEQ ID NO: 320653 - DNA, 25 bp, Homo sapien
aatttcctataatcagcactcccat

SEQ ID NO: 320654 - DNA, 25 bp, Homo sapien
aatcagcactcccatatttaaaagt

SEQ ID NO: 320655 - DNA, 25 bp, Homo sapien
atctgtatcagactaactgctgttg

SEQ ID NO: 320656 - DNA, 25 bp, Homo sapien
tcagactaactgctgttgcattctt

SEQ ID NO: 320657 - DNA, 25 bp, Homo sapien
tcttttaataccagtgactactttg

SEQ ID NO: 320658 - DNA, 25 bp, Homo sapien
agtgactactttgattcgtgaaaca

SEQ ID NO: 320659 - DNA, 25 bp, Homo sapien
aacaatgtattttccttatgaatag

SEQ ID NO: 320660 - DNA, 25 bp, Homo sapien
gaatagtttttctcatggtgtattt

SEQ ID NO: 320661 - DNA, 25 bp, Homo sapien
tttctcatggtgtatttattctttt

SEQ ID NO: 320662 - DNA, 25 bp, Homo sapien
cactcctggccatgatagttatttt

SEQ ID NO: 320663 - DNA, 25 bp, Homo sapien
aatacctacctcttaatttgtctga

SEQ ID NO: 320664 - DNA, 25 bp, Homo sapien
gagctgcgtcagtccccactgggtt

SEQ ID NO: 320665 - DNA, 25 bp, Homo sapien
tttccgtgtcatttgcgccgtcggg

SEQ ID NO: 320666 - DNA, 25 bp, Homo sapien
acctccgccgcagcatataaagtaa

SEQ ID NO: 320667 - DNA, 25 bp, Homo sapien
gatgggaagaaacccgccgatacag

SEQ ID NO: 320668 - DNA, 25 bp, Homo sapien
gagaactaggccgcgcgggtactac

SEQ ID NO: 320669 - DNA, 25 bp, Homo sapien
gcgatcggccagaaagcccgggcca

SEQ ID NO: 320670 - DNA, 25 bp, Homo sapien
gcgccgtcgggccattgcaaatgtc

SEQ ID NO: 320671 - DNA, 25 bp, Homo sapien
ccattgcaaatgtccgcgctgagat

SEQ ID NO: 320672 - DNA, 25 bp, Homo sapien
aaatgtccgcgctgagatgcctacc

SEQ ID NO: 320673 - DNA, 25 bp, Homo sapien
tgagatgcctaccttgtcactcgac

SEQ ID NO: 320674 - DNA, 25 bp, Homo sapien
aaagctcacccggagctgcgtcagt

SEQ ID NO: 320675 - DNA, 25 bp, Homo sapien
gtcaggtcataccacaactctgatg

SEQ ID NO: 320676 - DNA, 25 bp, Homo sapien
gaaacccttctagtactttctcatt

SEQ ID NO: 320677 - DNA, 25 bp, Homo sapien
tggtctaaaccaccaccatttggac

SEQ ID NO: 320678 - DNA, 25 bp, Homo sapien
gtaaatatccttataatgcctctct

SEQ ID NO: 320679 - DNA, 25 bp, Homo sapien
gcctcttattctcacttttattcat

SEQ ID NO: 320680 - DNA, 25 bp, Homo sapien
ttttattcatcttcctctagccaca

SEQ ID NO: 320681 - DNA, 25 bp, Homo sapien
attcaaacctaacttgcttggccag

SEQ ID NO: 320682 - DNA, 25 bp, Homo sapien
acgtagtgtcattatgggactccat

SEQ ID NO: 320683 - DNA, 25 bp, Homo sapien
accatttggactatgcctcctaaat

SEQ ID NO: 320684 - DNA, 25 bp, Homo sapien
taaatgatctctttggctgctccct

SEQ ID NO: 320685 - DNA, 25 bp, Homo sapien
ctcttttatattttgcccacacagc

SEQ ID NO: 320686 - DNA, 25 bp, Homo sapien
tggaatgagcctgttgggatcgcat

SEQ ID NO: 320687 - DNA, 25 bp, Homo sapien
agcctgttgggatcgcattgcatac

SEQ ID NO: 320688 - DNA, 25 bp, Homo sapien
tgggatcgcattgcataccttcggg

SEQ ID NO: 320689 - DNA, 25 bp, Homo sapien
ttcggggtacaagtcagtttctaca

SEQ ID NO: 320690 - DNA, 25 bp, Homo sapien
agtttctacactgggtgctgatcct

SEQ ID NO: 320691 - DNA, 25 bp, Homo sapien
actgggtgctgatccttgcacgcgc

SEQ ID NO: 320692 - DNA, 25 bp, Homo sapien
gccctttctaccatctcacggtggg

SEQ ID NO: 320693 - DNA, 25 bp, Homo sapien
tggccgcagggctgtgcacccagaa

SEQ ID NO: 320694 - DNA, 25 bp, Homo sapien
aagatggctgttagcgtttcggcct

SEQ ID NO: 320695 - DNA, 25 bp, Homo sapien
ctgttagcgtttcggccttcataat

SEQ ID NO: 320696 - DNA, 25 bp, Homo sapien
ataatggcctgagactttctttctg

SEQ ID NO: 320697 - DNA, 25 bp, Homo sapien
gataagtgagtacttctcttggcca

SEQ ID NO: 320698 - DNA, 25 bp, Homo sapien
gtgagtacttctcttggccatgtcc

SEQ ID NO: 320699 - DNA, 25 bp, Homo sapien
ggccatgtcccaggatggagactca

SEQ ID NO: 320700 - DNA, 25 bp, Homo sapien
gtcccaggatggagactcagctata

SEQ ID NO: 320701 - DNA, 25 bp, Homo sapien
ggatggagactcagctataaatggg

SEQ ID NO: 320702 - DNA, 25 bp, Homo sapien
gggatattggattaacattttcttt

SEQ ID NO: 320703 - DNA, 25 bp, Homo sapien
tttctttttatgacccttagccaca

SEQ ID NO: 320704 - DNA, 25 bp, Homo sapien
cccttagccacaaaggtcttggtgt

SEQ ID NO: 320705 - DNA, 25 bp, Homo sapien
caaaggtcttggtgtgatgatgtca

SEQ ID NO: 320706 - DNA, 25 bp, Homo sapien
tcttggtgtgatgatgtcagcagga

SEQ ID NO: 320707 - DNA, 25 bp, Homo sapien
gtcagcaggagtaagattgtatttc

SEQ ID NO: 320708 - DNA, 25 bp, Homo sapien
accatggagaaggtaacccagaact

SEQ ID NO: 320709 - DNA, 25 bp, Homo sapien
gtaacccagaacttcaaacgtatca

SEQ ID NO: 320710 - DNA, 25 bp, Homo sapien
taacccagaacttcaaacgtatcaa

SEQ ID NO: 320711 - DNA, 25 bp, Homo sapien
cccagaacttcaaacgtatcaaact

SEQ ID NO: 320712 - DNA, 25 bp, Homo sapien
ccagaacttcaaacgtatcaaacta

SEQ ID NO: 320713 - DNA, 25 bp, Homo sapien
cagaacttcaaacgtatcaaactac

SEQ ID NO: 320714 - DNA, 25 bp, Homo sapien
gaacttcaaacgtatcaaactacaa

SEQ ID NO: 320715 - DNA, 25 bp, Homo sapien
acttcaaacgtatcaaactacaaga

SEQ ID NO: 320716 - DNA, 25 bp, Homo sapien
tcaaacgtatcaaactacaagaagt

SEQ ID NO: 320717 - DNA, 25 bp, Homo sapien
caagaagttttattggtagaactca

SEQ ID NO: 320718 - DNA, 25 bp, Homo sapien
aagaagttttattggtagaactcat

SEQ ID NO: 320719 - DNA, 25 bp, Homo sapien
aagcaggataacgttgcctggtgga

SEQ ID NO: 320720 - DNA, 25 bp, Homo sapien
acttcccctgggatgacgaggattt

SEQ ID NO: 320721 - DNA, 25 bp, Homo sapien
atgacgaggatttccgcagtctggc

SEQ ID NO: 320722 - DNA, 25 bp, Homo sapien
atttccgcagtctggcccttttggg

SEQ ID NO: 320723 - DNA, 25 bp, Homo sapien
ggaagagaaatcacgtggaagcact

SEQ ID NO: 320724 - DNA, 25 bp, Homo sapien
atcacgtggaagcactttgtacagt

SEQ ID NO: 320725 - DNA, 25 bp, Homo sapien
tttgtacagtattacctggccagag

SEQ ID NO: 320726 - DNA, 25 bp, Homo sapien
tggaccggctggaagtcgtgaacaa

SEQ ID NO: 320727 - DNA, 25 bp, Homo sapien
gctggaagtcgtgaacaaacaatct

SEQ ID NO: 320728 - DNA, 25 bp, Homo sapien
agagactggtgaactagagaatgct

SEQ ID NO: 320729 - DNA, 25 bp, Homo sapien
actagagaatgctgagtctggagga

SEQ ID NO: 320730 - DNA, 25 bp, Homo sapien
ctcccacaccatacgataaagcaag

SEQ ID NO: 320731 - DNA, 25 bp, Homo sapien
acaccatacgataaagcaagacatt

SEQ ID NO: 320732 - DNA, 25 bp, Homo sapien
aagacattttataacgataccagag

SEQ ID NO: 320733 - DNA, 25 bp, Homo sapien
ataacgataccagagtcactatgtg

SEQ ID NO: 320734 - DNA, 25 bp, Homo sapien
agagtcactatgtggtcctccctga

SEQ ID NO: 320735 - DNA, 25 bp, Homo sapien
atgtggtcctccctgaaataacgca

SEQ ID NO: 320736 - DNA, 25 bp, Homo sapien
gtcctccctgaaataacgcattcga

SEQ ID NO: 320737 - DNA, 25 bp, Homo sapien
cattcgaaatccatgcagtgcagta

SEQ ID NO: 320738 - DNA, 25 bp, Homo sapien
tagacacggttcactaaattgattt

SEQ ID NO: 320739 - DNA, 25 bp, Homo sapien
gaattcctagactgaaagaacctaa

SEQ ID NO: 320740 - DNA, 25 bp, Homo sapien
aatacatttcctattttcgcatttt

SEQ ID NO: 320741 - DNA, 25 bp, Homo sapien
aatttcaaacacctcagagaaatag

SEQ ID NO: 320742 - DNA, 25 bp, Homo sapien
acagacaaattttctggctgtcccc

SEQ ID NO: 320743 - DNA, 25 bp, Homo sapien
aaattttctggctgtccccatttct

SEQ ID NO: 320744 - DNA, 25 bp, Homo sapien
tctggctgtccccatttctcctggg

SEQ ID NO: 320745 - DNA, 25 bp, Homo sapien
gggactgagaaatttgagccaggta

SEQ ID NO: 320746 - DNA, 25 bp, Homo sapien
atttgagccaggtatccagagccac

SEQ ID NO: 320747 - DNA, 25 bp, Homo sapien
tgagccaggtatccagagccacagc

SEQ ID NO: 320748 - DNA, 25 bp, Homo sapien
ggtatccagagccacagcccatctt

SEQ ID NO: 320749 - DNA, 25 bp, Homo sapien
gccacagcccatcttgcttataaaa

SEQ ID NO: 320750 - DNA, 25 bp, Homo sapien
gcccatcttgcttataaaaattatc

SEQ ID NO: 320751 - DNA, 25 bp, Homo sapien
aattatcttctgctgtttgttttcc

SEQ ID NO: 320752 - DNA, 25 bp, Homo sapien
aatgcaagggcataatgttagctgt

SEQ ID NO: 320753 - DNA, 25 bp, Homo sapien
caagggcataatgttagctgtgaac

SEQ ID NO: 320754 - DNA, 25 bp, Homo sapien
gggacatgtccttggcgtgcttcct

SEQ ID NO: 320755 - DNA, 25 bp, Homo sapien
atgtccttggcgtgcttcctcagag

SEQ ID NO: 320756 - DNA, 25 bp, Homo sapien
ttggcgtgcttcctcagagtggctt

SEQ ID NO: 320757 - DNA, 25 bp, Homo sapien
gtgcttcctcagagtggcttttcct

SEQ ID NO: 320758 - DNA, 25 bp, Homo sapien
gtggcttttcctccattaatacata

SEQ ID NO: 320759 - DNA, 25 bp, Homo sapien
ggcttttcctccattaatacatata

SEQ ID NO: 320760 - DNA, 25 bp, Homo sapien
ctgctttgcagtggtttcagaggca

SEQ ID NO: 320761 - DNA, 25 bp, Homo sapien
gctttgcagtggtttcagaggcaga

SEQ ID NO: 320762 - DNA, 25 bp, Homo sapien
agtggtttcagaggcagatctgaga

SEQ ID NO: 320763 - DNA, 25 bp, Homo sapien
atggcactgacgtactgatgctcga

SEQ ID NO: 320764 - DNA, 25 bp, Homo sapien
tactgatgctcgaaggtggtcacct

SEQ ID NO: 320765 - DNA, 25 bp, Homo sapien
caacgtcggtcaggtagtacttggc

SEQ ID NO: 320766 - DNA, 25 bp, Homo sapien
gatcaggagcgcattggccttgttc

SEQ ID NO: 320767 - DNA, 25 bp, Homo sapien
gccttgttctgctcgtacttgtaga

SEQ ID NO: 320768 - DNA, 25 bp, Homo sapien
gtagaggatcttgagcgtctccatg

SEQ ID NO: 320769 - DNA, 25 bp, Homo sapien
atggcccggatcatggcctgcatgg

SEQ ID NO: 320770 - DNA, 25 bp, Homo sapien
agacgagcttggtgaagccgcgctt

SEQ ID NO: 320771 - DNA, 25 bp, Homo sapien
agtcggagagctggtactcgcgcct

SEQ ID NO: 320772 - DNA, 25 bp, Homo sapien
gcctgcggtcgtagcattcctggat

SEQ ID NO: 320773 - DNA, 25 bp, Homo sapien
tcccacagggtcttgatggcactga

SEQ ID NO: 320774 - DNA, 25 bp, Homo sapien
acctcccagacaccaaatgcctcat

SEQ ID NO: 320775 - DNA, 25 bp, Homo sapien
accaaatgcctcatccccaggcaac

SEQ ID NO: 320776 - DNA, 25 bp, Homo sapien
caatgggactgtgcaagcacccaag

SEQ ID NO: 320777 - DNA, 25 bp, Homo sapien
atgggactgtgcaagcacccaagca

SEQ ID NO: 320778 - DNA, 25 bp, Homo sapien
gggactgtgcaagcacccaagcaga

SEQ ID NO: 320779 - DNA, 25 bp, Homo sapien
ggactgtgcaagcacccaagcagaa

SEQ ID NO: 320780 - DNA, 25 bp, Homo sapien
actgtgcaagcacccaagcagaagg

SEQ ID NO: 320781 - DNA, 25 bp, Homo sapien
tgtgcaagcacccaagcagaaggga

SEQ ID NO: 320782 - DNA, 25 bp, Homo sapien
gcaagcacccaagcagaagggagac

SEQ ID NO: 320783 - DNA, 25 bp, Homo sapien
agcagaagggagactgagtgcctca

SEQ ID NO: 320784 - DNA, 25 bp, Homo sapien
ccatctctgctcctgtttgaatttt

SEQ ID NO: 320785 - DNA, 25 bp, Homo sapien
gggcctgacggtttgatcagctttt

SEQ ID NO: 320786 - DNA, 25 bp, Homo sapien
atcagcttttcatgggctatggcca

SEQ ID NO: 320787 - DNA, 25 bp, Homo sapien
tgcaggtgggagtttgttaacacaa

SEQ ID NO: 320788 - DNA, 25 bp, Homo sapien
gagcttcaggccctggtttggaaat

SEQ ID NO: 320789 - DNA, 25 bp, Homo sapien
tggaaatgttaactggccaaccagc

SEQ ID NO: 320790 - DNA, 25 bp, Homo sapien
ggccaaccagccacgggagttggaa

SEQ ID NO: 320791 - DNA, 25 bp, Homo sapien
gggagttggaattccctaactattg

SEQ ID NO: 320792 - DNA, 25 bp, Homo sapien
ttccctaactattgtcagagagagt

SEQ ID NO: 320793 - DNA, 25 bp, Homo sapien
gcaaagggatttgtctgattgaaca

SEQ ID NO: 320794 - DNA, 25 bp, Homo sapien
tgcatcccgcatggcagaggtggac

SEQ ID NO: 320795 - DNA, 25 bp, Homo sapien
ttggcagggcctgacggtttgatca

SEQ ID NO: 320796 - DNA, 25 bp, Homo sapien
gtatactctgtatgctgggattccg

SEQ ID NO: 320797 - DNA, 25 bp, Homo sapien
gtatgctgggattccgaggttccaa

SEQ ID NO: 320798 - DNA, 25 bp, Homo sapien
attccgaggttccaacacactgtta

SEQ ID NO: 320799 - DNA, 25 bp, Homo sapien
caacacactgttacaaatctgtggg

SEQ ID NO: 320800 - DNA, 25 bp, Homo sapien
ggtttctttcttctgataattctag

SEQ ID NO: 320801 - DNA, 25 bp, Homo sapien
tgataattctagagcctgttaccat

SEQ ID NO: 320802 - DNA, 25 bp, Homo sapien
gagcctgttaccatagaaaggcatt

SEQ ID NO: 320803 - DNA, 25 bp, Homo sapien
gaaaggcatttcttcaatggctggt

SEQ ID NO: 320804 - DNA, 25 bp, Homo sapien
caatggctggttgtagttagttcat

SEQ ID NO: 320805 - DNA, 25 bp, Homo sapien
agttagttcatgtttttcaatcaaa

SEQ ID NO: 320806 - DNA, 25 bp, Homo sapien
gttgctgtatagtgattgttttgca

SEQ ID NO: 320807 - DNA, 25 bp, Homo sapien
ggtttggagtctggaagcctcatcc

SEQ ID NO: 320808 - DNA, 25 bp, Homo sapien
tcatcccttcagcatcaagctggaa

SEQ ID NO: 320809 - DNA, 25 bp, Homo sapien
tcccttcagcatcaagctggaatgg

SEQ ID NO: 320810 - DNA, 25 bp, Homo sapien
gaagaatagagatgtggtgcccact

SEQ ID NO: 320811 - DNA, 25 bp, Homo sapien
tagagatgtggtgcccactaggcta

SEQ ID NO: 320812 - DNA, 25 bp, Homo sapien
agatgtggtgcccactaggctactg

SEQ ID NO: 320813 - DNA, 25 bp, Homo sapien
tggtgcccactaggctactgctgaa

SEQ ID NO: 320814 - DNA, 25 bp, Homo sapien
tgcccactaggctactgctgaaagg

SEQ ID NO: 320815 - DNA, 25 bp, Homo sapien
actaggctactgctgaaagggagct

SEQ ID NO: 320816 - DNA, 25 bp, Homo sapien
aaagggagctgaaatttcctccaca

SEQ ID NO: 320817 - DNA, 25 bp, Homo sapien
tttcctccacaagttggtattcaaa

SEQ ID NO: 320818 - DNA, 25 bp, Homo sapien
tgcctcatccaatttgaagacttcg

SEQ ID NO: 320819 - DNA, 25 bp, Homo sapien
atttgaagacttcgccaatgccaat

SEQ ID NO: 320820 - DNA, 25 bp, Homo sapien
gaagacttcgccaatgccaatgcct

SEQ ID NO: 320821 - DNA, 25 bp, Homo sapien
tcggcctgaaacaccagcgcgtgca

SEQ ID NO: 320822 - DNA, 25 bp, Homo sapien
cgcctgctcaacaaataccgtaaca

SEQ ID NO: 320823 - DNA, 25 bp, Homo sapien
aaataccgtaacaagtactgcatgt

SEQ ID NO: 320824 - DNA, 25 bp, Homo sapien
ctgcatgttcaatgatgacatccaa

SEQ ID NO: 320825 - DNA, 25 bp, Homo sapien
aaacaccagcgcgtgcacgggaagg

SEQ ID NO: 320826 - DNA, 25 bp, Homo sapien
accagcgcgtgcacgggaaggcata

SEQ ID NO: 320827 - DNA, 25 bp, Homo sapien
tgcacgggaaggcatacgatgactt

SEQ ID NO: 320828 - DNA, 25 bp, Homo sapien
gtttggaataaattgcctcatccaa

SEQ ID NO: 320829 - DNA, 25 bp, Homo sapien
tcccttcacgtagtctgcgttgaga

SEQ ID NO: 320830 - DNA, 25 bp, Homo sapien
tctgcgttgagaccctgctgaatgc

SEQ ID NO: 320831 - DNA, 25 bp, Homo sapien
agaacttcttctgctggtaggagat

SEQ ID NO: 320832 - DNA, 25 bp, Homo sapien
atgtagctggagacggcaccgatga

SEQ ID NO: 320833 - DNA, 25 bp, Homo sapien
aatggtgccaggctctgccaccatg

SEQ ID NO: 320834 - DNA, 25 bp, Homo sapien
accatgccagatccagggtcgtcat

SEQ ID NO: 320835 - DNA, 25 bp, Homo sapien
agggtcgtcattgctgccgtaccgg

SEQ ID NO: 320836 - DNA, 25 bp, Homo sapien
atcacctttacccttgtcaggtttg

SEQ ID NO: 320837 - DNA, 25 bp, Homo sapien
ccttgtcaggtttgtattctccacc

SEQ ID NO: 320838 - DNA, 25 bp, Homo sapien
cccctactatgtcttcaagatcctt

SEQ ID NO: 320839 - DNA, 25 bp, Homo sapien
agcaattggtttcctgcggccatca

SEQ ID NO: 320840 - DNA, 25 bp, Homo sapien
acatcgtcaccgagtatatgaacaa

SEQ ID NO: 320841 - DNA, 25 bp, Homo sapien
gtttactggatttcttaaaagatgg

SEQ ID NO: 320842 - DNA, 25 bp, Homo sapien
ggaagagctctgaaattaccaaatc

SEQ ID NO: 320843 - DNA, 25 bp, Homo sapien
ccaaatcttgtggacatggcagcac

SEQ ID NO: 320844 - DNA, 25 bp, Homo sapien
ggtggctgcaggaatggcttacatc

SEQ ID NO: 320845 - DNA, 25 bp, Homo sapien
tatatccatagagatctgcgatcag

SEQ ID NO: 320846 - DNA, 25 bp, Homo sapien
tgcgatcagcaaacattctagtggg

SEQ ID NO: 320847 - DNA, 25 bp, Homo sapien
aatggactcatatgcaagattgctg

SEQ ID NO: 320848 - DNA, 25 bp, Homo sapien
gattgctgacttcggattggcccga

SEQ ID NO: 320849 - DNA, 25 bp, Homo sapien
cggattggcccgattgatagaagac

SEQ ID NO: 320850 - DNA, 25 bp, Homo sapien
agacaaggtgcaaagttccccatca

SEQ ID NO: 320851 - DNA, 25 bp, Homo sapien
gcaacataaccccacattgagcaaa

SEQ ID NO: 320852 - DNA, 25 bp, Homo sapien
gacaagaccattattcttcacagtt

SEQ ID NO: 320853 - DNA, 25 bp, Homo sapien
gaaattataatctagcatcgccact

SEQ ID NO: 320854 - DNA, 25 bp, Homo sapien
gcatcgccactgatcagactgcaga

SEQ ID NO: 320855 - DNA, 25 bp, Homo sapien
gcctgtgcatttgaaccagagatct

SEQ ID NO: 320856 - DNA, 25 bp, Homo sapien
gagagtggcccacagaatggaccca

SEQ ID NO: 320857 - DNA, 25 bp, Homo sapien
acagaatggacccagaggcagcctt

SEQ ID NO: 320858 - DNA, 25 bp, Homo sapien
taacctcttgctgctttgtacctta

SEQ ID NO: 320859 - DNA, 25 bp, Homo sapien
cttgctgctttgtaccttaggagag

SEQ ID NO: 320860 - DNA, 25 bp, Homo sapien
gaaccagagatctgtgcaggcccta

SEQ ID NO: 320861 - DNA, 25 bp, Homo sapien
gagatctgtgcaggccctagaatca

SEQ ID NO: 320862 - DNA, 25 bp, Homo sapien
gataataccagcgtatcctgcctta

SEQ ID NO: 320863 - DNA, 25 bp, Homo sapien
taccagcgtatcctgccttatagaa

SEQ ID NO: 320864 - DNA, 25 bp, Homo sapien
agaattgaatagactctgagctaaa

SEQ ID NO: 320865 - DNA, 25 bp, Homo sapien
gatgttaacataatgcttagcggta

SEQ ID NO: 320866 - DNA, 25 bp, Homo sapien
ttagcggtaggaaccaggcctcttc

SEQ ID NO: 320867 - DNA, 25 bp, Homo sapien
caggcctcttccattttaatttcat

SEQ ID NO: 320868 - DNA, 25 bp, Homo sapien
ttaatttcatcccaaatgcatattt

SEQ ID NO: 320869 - DNA, 25 bp, Homo sapien
ggactgaacccctaacaaatctctt

SEQ ID NO: 320870 - DNA, 25 bp, Homo sapien
aaatctcttatctgaaggctccaat

SEQ ID NO: 320871 - DNA, 25 bp, Homo sapien
gaaggctccaattttccaatattaa

SEQ ID NO: 320872 - DNA, 25 bp, Homo sapien
tagctaatttaggtctaggcacaat

SEQ ID NO: 320873 - DNA, 25 bp, Homo sapien
aatttcaaacacctcagagaaatag

SEQ ID NO: 320874 - DNA, 25 bp, Homo sapien
gacaaggacagacaaattttctggc

SEQ ID NO: 320875 - DNA, 25 bp, Homo sapien
acagacaaattttctggctgtcccc

SEQ ID NO: 320876 - DNA, 25 bp, Homo sapien
tctggctgtccccatttctcctggg

SEQ ID NO: 320877 - DNA, 25 bp, Homo sapien
gggactgagaaatttgagccaggta

SEQ ID NO: 320878 - DNA, 25 bp, Homo sapien
atttgagccaggtatccagagccac

SEQ ID NO: 320879 - DNA, 25 bp, Homo sapien
ttgagccaggtatccagagccacag

SEQ ID NO: 320880 - DNA, 25 bp, Homo sapien
gagccaggtatccagagccacagcc

SEQ ID NO: 320881 - DNA, 25 bp, Homo sapien
gtatccagagccacagcccatcttg

SEQ ID NO: 320882 - DNA, 25 bp, Homo sapien
gccacagcccatcttgcttataaaa

SEQ ID NO: 320883 - DNA, 25 bp, Homo sapien
gcccatcttgcttataaaaattatc

SEQ ID NO: 320884 - DNA, 25 bp, Homo sapien
aaaaatatgatataggccagacacg

SEQ ID NO: 320885 - DNA, 25 bp, Homo sapien
aaaatatgatataggccagacacgg

SEQ ID NO: 320886 - DNA, 25 bp, Homo sapien
aaatatgatataggccagacacggt

SEQ ID NO: 320887 - DNA, 25 bp, Homo sapien
aatatgatataggccagacacggtg

SEQ ID NO: 320888 - DNA, 25 bp, Homo sapien
atatgatataggccagacacggtgg

SEQ ID NO: 320889 - DNA, 25 bp, Homo sapien
tatgatataggccagacacggtggc

SEQ ID NO: 320890 - DNA, 25 bp, Homo sapien
aattagctggacgtgatggcgcgcg

SEQ ID NO: 320891 - DNA, 25 bp, Homo sapien
attagctggacgtgatggcgcgcgc

SEQ ID NO: 320892 - DNA, 25 bp, Homo sapien
ttagctggacgtgatggcgcgcgcc

SEQ ID NO: 320893 - DNA, 25 bp, Homo sapien
tagctggacgtgatggcgcgcgcct

SEQ ID NO: 320894 - DNA, 25 bp, Homo sapien
agctggacgtgatggcgcgcgcctg

SEQ ID NO: 320895 - DNA, 25 bp, Homo sapien
tcaatttcttttagcgtctccccga

SEQ ID NO: 320896 - DNA, 25 bp, Homo sapien
agcgtctccccgaacctgaaacaat

SEQ ID NO: 320897 - DNA, 25 bp, Homo sapien
agtgcagagcctttccaggacttct

SEQ ID NO: 320898 - DNA, 25 bp, Homo sapien
ctttccaggacttctgttgtcagag

SEQ ID NO: 320899 - DNA, 25 bp, Homo sapien
tgtcagagaaccctggagttggtct

SEQ ID NO: 320900 - DNA, 25 bp, Homo sapien
gttggtctgtccctggctggtccaa

SEQ ID NO: 320901 - DNA, 25 bp, Homo sapien
tccctggctggtccaaggatttgta

SEQ ID NO: 320902 - DNA, 25 bp, Homo sapien
gtccaaggatttgtagctgttgtga

SEQ ID NO: 320903 - DNA, 25 bp, Homo sapien
gctgttgtgaaggtgtgagaccatc

SEQ ID NO: 320904 - DNA, 25 bp, Homo sapien
cagataggcaaaagaccccgttcgt

SEQ ID NO: 320905 - DNA, 25 bp, Homo sapien
gaccccgttcgttttctgatgaaat

SEQ ID NO: 320906 - DNA, 25 bp, Homo sapien
acagagtcaggatggctggagcatg

SEQ ID NO: 320907 - DNA, 25 bp, Homo sapien
gagcaaaaggttgggaccatgtgac

SEQ ID NO: 320908 - DNA, 25 bp, Homo sapien
gatgctggatggaggattctgaacc

SEQ ID NO: 320909 - DNA, 25 bp, Homo sapien
gattctgaacctcatttgtggacgg

SEQ ID NO: 320910 - DNA, 25 bp, Homo sapien
aggagagaggactcactggtcaaga

SEQ ID NO: 320911 - DNA, 25 bp, Homo sapien
ctcactggtcaagagtgtcggctgt

SEQ ID NO: 320912 - DNA, 25 bp, Homo sapien
tgtcggctgtgacacaagggccatc

SEQ ID NO: 320913 - DNA, 25 bp, Homo sapien
cggctgtgacacaagggccatcatc

SEQ ID NO: 320914 - DNA, 25 bp, Homo sapien
atcatccctgaatgcccaccatgtg

SEQ ID NO: 320915 - DNA, 25 bp, Homo sapien
cccgcactgtgctgatgatgataat

SEQ ID NO: 320916 - DNA, 25 bp, Homo sapien
ataactacgtccattgagcactctc

SEQ ID NO: 320917 - DNA, 25 bp, Homo sapien
gaattaacactttgactcctaaatg

SEQ ID NO: 320918 - DNA, 25 bp, Homo sapien
atgtgatactggtttgtagattccc

SEQ ID NO: 320919 - DNA, 25 bp, Homo sapien
ctggtttgtagattcccttagagca

SEQ ID NO: 320920 - DNA, 25 bp, Homo sapien
aatttgtatcgcttttgcttctctt

SEQ ID NO: 320921 - DNA, 25 bp, Homo sapien
cttctctttggtcttttgtgtctta

SEQ ID NO: 320922 - DNA, 25 bp, Homo sapien
tggttcatttctgttgctggtatga

SEQ ID NO: 320923 - DNA, 25 bp, Homo sapien
tttctgttgctggtatgaggatttc

SEQ ID NO: 320924 - DNA, 25 bp, Homo sapien
gttgctggtatgaggatttcgaata

SEQ ID NO: 320925 - DNA, 25 bp, Homo sapien
ggtatgaggatttcgaatacttagt

SEQ ID NO: 320926 - DNA, 25 bp, Homo sapien
gtaatcgaaaaccatatcctgtaat

SEQ ID NO: 320927 - DNA, 25 bp, Homo sapien
ctaggggctgtgtttctgcattaaa

SEQ ID NO: 320928 - DNA, 25 bp, Homo sapien
tcacaatttgcatggttgtcctcct

SEQ ID NO: 320929 - DNA, 25 bp, Homo sapien
ttgcatggttgtcctcctatcagag

SEQ ID NO: 320930 - DNA, 25 bp, Homo sapien
gtaatggcagacaatttagcacctc

SEQ ID NO: 320931 - DNA, 25 bp, Homo sapien
tggcagacaatttagcacctctgaa

SEQ ID NO: 320932 - DNA, 25 bp, Homo sapien
gatacacaaagggaagagaccattt

SEQ ID NO: 320933 - DNA, 25 bp, Homo sapien
caagaaaatgacaccaattgttgaa

SEQ ID NO: 320934 - DNA, 25 bp, Homo sapien
ttttttcacagtaaaattgcagaga

SEQ ID NO: 320935 - DNA, 25 bp, Homo sapien
gagaatacaaatacaaacactgaca

SEQ ID NO: 320936 - DNA, 25 bp, Homo sapien
aaacactgacagattactgcttaag

SEQ ID NO: 320937 - DNA, 25 bp, Homo sapien
gattactgcttaagatctatcctaa

SEQ ID NO: 320938 - DNA, 25 bp, Homo sapien
agatctatcctaacaaattcttttc

SEQ ID NO: 320939 - DNA, 25 bp, Homo sapien
ctgaaatattagacttgttctgaaa

SEQ ID NO: 320940 - DNA, 25 bp, Homo sapien
tctgaaataagcttacctaggatga

SEQ ID NO: 320941 - DNA, 25 bp, Homo sapien
agcttacctaggatgataccacttt

SEQ ID NO: 320942 - DNA, 25 bp, Homo sapien
cctaggatgataccactttcactta

SEQ ID NO: 320943 - DNA, 25 bp, Homo sapien
atttcccaactatttaacagtggca

SEQ ID NO: 320944 - DNA, 25 bp, Homo sapien
ggtagttaaaatacacagcagtcac

SEQ ID NO: 320945 - DNA, 25 bp, Homo sapien
aaatacacagcagtcacttcatatt

SEQ ID NO: 320946 - DNA, 25 bp, Homo sapien
agtcacttcatattactgcctccct

SEQ ID NO: 320947 - DNA, 25 bp, Homo sapien
tcaacccactcaacttctgaagaac

SEQ ID NO: 320948 - DNA, 25 bp, Homo sapien
tcaacttctgaagaacagggctttt

SEQ ID NO: 320949 - DNA, 25 bp, Homo sapien
ttctgaagaacagggctttttcaag

SEQ ID NO: 320950 - DNA, 25 bp, Homo sapien
gtcctctttgttttcgtggtgctga

SEQ ID NO: 320951 - DNA, 25 bp, Homo sapien
ttttctcataggttccattgctgtt

SEQ ID NO: 320952 - DNA, 25 bp, Homo sapien
gaaggttggtttctccatggcaaga

SEQ ID NO: 320953 - DNA, 25 bp, Homo sapien
aatccaggcgttattctgaattgtt

SEQ ID NO: 320954 - DNA, 25 bp, Homo sapien
ttgttttaagtctccttgtcctaag

SEQ ID NO: 320955 - DNA, 25 bp, Homo sapien
aaaagcgcagagctgttcactgatt

SEQ ID NO: 320956 - DNA, 25 bp, Homo sapien
gctgttcactgattttggcttctac

SEQ ID NO: 320957 - DNA, 25 bp, Homo sapien
tggcttctacaccaacagagaccag

SEQ ID NO: 320958 - DNA, 25 bp, Homo sapien
gagaccagggagtttgccgattcct

SEQ ID NO: 320959 - DNA, 25 bp, Homo sapien
gtttgccgattcctcagacacagat

SEQ ID NO: 320960 - DNA, 25 bp, Homo sapien
tagctgtttgctgttatccacttct

SEQ ID NO: 320961 - DNA, 25 bp, Homo sapien
tatcttgggcagctatcattttata

SEQ ID NO: 320962 - DNA, 25 bp, Homo sapien
ttagtatttctgcaggatgaattcc

SEQ ID NO: 320963 - DNA, 25 bp, Homo sapien
tctgcaggatgaattcctagaagta

SEQ ID NO: 320964 - DNA, 25 bp, Homo sapien
agtagaattgctctgtcaaagggtt

SEQ ID NO: 320965 - DNA, 25 bp, Homo sapien
gaattgctctgtcaaagggtttgtt

SEQ ID NO: 320966 - DNA, 25 bp, Homo sapien
tgctctgtcaaagggtttgttactc

SEQ ID NO: 320967 - DNA, 25 bp, Homo sapien
caaagggtttgttactcatctgaac

SEQ ID NO: 320968 - DNA, 25 bp, Homo sapien
catctgaaccttaaaaagactggtt

SEQ ID NO: 320969 - DNA, 25 bp, Homo sapien
aaactcagtctcttaaagcgaaaat

SEQ ID NO: 320970 - DNA, 25 bp, Homo sapien
aaaatgggattaggccaggaatggt

SEQ ID NO: 320971 - DNA, 25 bp, Homo sapien
caatgacactgggatgtttctgatc

SEQ ID NO: 320972 - DNA, 25 bp, Homo sapien
gaacttctattcaccgtttctggaa

SEQ ID NO: 320973 - DNA, 25 bp, Homo sapien
gtttctggaattctagccgccatga

SEQ ID NO: 320974 - DNA, 25 bp, Homo sapien
aattctagccgccatgatggtctgg

SEQ ID NO: 320975 - DNA, 25 bp, Homo sapien
gatggtctggtggtgactgataact

SEQ ID NO: 320976 - DNA, 25 bp, Homo sapien
gactgataactagttttattccaag

SEQ ID NO: 320977 - DNA, 25 bp, Homo sapien
ttccaagacatacctttacctcttt

SEQ ID NO: 320978 - DNA, 25 bp, Homo sapien
tctttaagtttcaatctcccatctc

SEQ ID NO: 320979 - DNA, 25 bp, Homo sapien
cttcagtccccaactgcagaggatg

SEQ ID NO: 320980 - DNA, 25 bp, Homo sapien
gcagaggatgacctccccagataga

SEQ ID NO: 320981 - DNA, 25 bp, Homo sapien
taaccaagtctttgtatccctagta

SEQ ID NO: 320982 - DNA, 25 bp, Homo sapien
gtatccctagtacaagacatagtat

SEQ ID NO: 320983 - DNA, 25 bp, Homo sapien
aatgtgctgggccttttataggtta

SEQ ID NO: 320984 - DNA, 25 bp, Homo sapien
ggccttttataggttaacactgaca

SEQ ID NO: 320985 - DNA, 25 bp, Homo sapien
aacactgacatctcaggctgaacta

SEQ ID NO: 320986 - DNA, 25 bp, Homo sapien
atacattttccttcacaaccatatc

SEQ ID NO: 320987 - DNA, 25 bp, Homo sapien
ccttcacaaccatatcaatccttat

SEQ ID NO: 320988 - DNA, 25 bp, Homo sapien
aactatggatttatgctccttaaaa

SEQ ID NO: 320989 - DNA, 25 bp, Homo sapien
atgctgatcactactataaatgcgt

SEQ ID NO: 320990 - DNA, 25 bp, Homo sapien
gttttaaccaactgtactgaaacag

SEQ ID NO: 320991 - DNA, 25 bp, Homo sapien
gaaacagctttgagtttatattctg

SEQ ID NO: 320992 - DNA, 25 bp, Homo sapien
agaaaacaacaagtgctctcaagag

SEQ ID NO: 320993 - DNA, 25 bp, Homo sapien
gagtatttgcttagaggccggctgt

SEQ ID NO: 320994 - DNA, 25 bp, Homo sapien
tggtagcacgcaatacccattgctt

SEQ ID NO: 320995 - DNA, 25 bp, Homo sapien
gcaatacccattgctttctattttt

SEQ ID NO: 320996 - DNA, 25 bp, Homo sapien
gtgtctgtacttaatgtgtctactt

SEQ ID NO: 320997 - DNA, 25 bp, Homo sapien
ttaacaatatcttggcaatctttct

SEQ ID NO: 320998 - DNA, 25 bp, Homo sapien
atcagtatataaagtgctattctct

SEQ ID NO: 320999 - DNA, 25 bp, Homo sapien
aaaagctgtatggatcttctataat

SEQ ID NO: 321000 - DNA, 25 bp, Homo sapien
tggatcttctataatttgtgtaacc

SEQ ID NO: 321001 - DNA, 25 bp, Homo sapien
ttgtgtaaccactaccatattgata

SEQ ID NO: 321002 - DNA, 25 bp, Homo sapien
gatagacattttacttttcgatttc

SEQ ID NO: 321003 - DNA, 25 bp, Homo sapien
tttcgatttcactaggcatgcctgg

SEQ ID NO: 321004 - DNA, 25 bp, Homo sapien
gtgtctactttgagtaatatttcat

SEQ ID NO: 321005 - DNA, 25 bp, Homo sapien
gggattaacataacttcatttcatt

SEQ ID NO: 321006 - DNA, 25 bp, Homo sapien
aacttcatttcattgccttatatta

SEQ ID NO: 321007 - DNA, 25 bp, Homo sapien
tcattgccttatattaacatcttat

SEQ ID NO: 321008 - DNA, 25 bp, Homo sapien
cagatggagctgtttattgagacaa

SEQ ID NO: 321009 - DNA, 25 bp, Homo sapien
agctgtttattgagacaactggtga

SEQ ID NO: 321010 - DNA, 25 bp, Homo sapien
actggtgaggaattatcatgtgttc

SEQ ID NO: 321011 - DNA, 25 bp, Homo sapien
tatcatgtgttcattcccattttag

SEQ ID NO: 321012 - DNA, 25 bp, Homo sapien
gtgttcattcccattttagagcgtg

SEQ ID NO: 321013 - DNA, 25 bp, Homo sapien
tcattcccattttagagcgtgaaac

SEQ ID NO: 321014 - DNA, 25 bp, Homo sapien
gagcgtgaaactcctacattagaat

SEQ ID NO: 321015 - DNA, 25 bp, Homo sapien
gatattttattacagcatttttgtg

SEQ ID NO: 321016 - DNA, 25 bp, Homo sapien
agctgcgccagcagaccgagtggca

SEQ ID NO: 321017 - DNA, 25 bp, Homo sapien
ctgggaactggcactgggtcgcttt

SEQ ID NO: 321018 - DNA, 25 bp, Homo sapien
cactgggtcgcttttgggattacct

SEQ ID NO: 321019 - DNA, 25 bp, Homo sapien
tttgggattacctgcgctgggtgca

SEQ ID NO: 321020 - DNA, 25 bp, Homo sapien
attacctgcgctgggtgcagacact

SEQ ID NO: 321021 - DNA, 25 bp, Homo sapien
tcccaggtcacccaggaactgaggg

SEQ ID NO: 321022 - DNA, 25 bp, Homo sapien
tcacccaggaactgagggcgctgat

SEQ ID NO: 321023 - DNA, 25 bp, Homo sapien
gaccatgaaggagttgaaggcctac

SEQ ID NO: 321024 - DNA, 25 bp, Homo sapien
gaaggcctacaaatcggaactggag

SEQ ID NO: 321025 - DNA, 25 bp, Homo sapien
atcggaactggaggaacaactgacc

SEQ ID NO: 321026 - DNA, 25 bp, Homo sapien
ggagacgcgggcacggctgtccaag

SEQ ID NO: 321027 - DNA, 25 bp, Homo sapien
acgctggggccgggcgtggtgctca

SEQ ID NO: 321028 - DNA, 25 bp, Homo sapien
cgctggggccgggcgtggtgctcac

SEQ ID NO: 321029 - DNA, 25 bp, Homo sapien
gctggggccgggcgtggtgctcaca

SEQ ID NO: 321030 - DNA, 25 bp, Homo sapien
aggcggattgcctgagctcaggatt

SEQ ID NO: 321031 - DNA, 25 bp, Homo sapien
tcaggatttcaagaccaccctgggt

SEQ ID NO: 321032 - DNA, 25 bp, Homo sapien
gatttcaagaccaccctgggtaaca

SEQ ID NO: 321033 - DNA, 25 bp, Homo sapien
atttcaagaccaccctgggtaacat

SEQ ID NO: 321034 - DNA, 25 bp, Homo sapien
tttcaagaccaccctgggtaacatg

SEQ ID NO: 321035 - DNA, 25 bp, Homo sapien
gggtgtggtggtacacgcctatagt

SEQ ID NO: 321036 - DNA, 25 bp, Homo sapien
ggtgtggtggtacacgcctatagtc

SEQ ID NO: 321037 - DNA, 25 bp, Homo sapien
gtgtggtggtacacgcctatagtcc

SEQ ID NO: 321038 - DNA, 25 bp, Homo sapien
cctcctgtcaggaagggccagacat

SEQ ID NO: 321039 - DNA, 25 bp, Homo sapien
gaagggccagacatcccagccatga

SEQ ID NO: 321040 - DNA, 25 bp, Homo sapien
atcccagccatgacccgagcaaagg

SEQ ID NO: 321041 - DNA, 25 bp, Homo sapien
aaaggcccgctggacttgggacagc

SEQ ID NO: 321042 - DNA, 25 bp, Homo sapien
gtcgggaagccctcaaatgccagga

SEQ ID NO: 321043 - DNA, 25 bp, Homo sapien
aaatgccaggagtccattccacttg

SEQ ID NO: 321044 - DNA, 25 bp, Homo sapien
aggagtccattccacttggccatga

SEQ ID NO: 321045 - DNA, 25 bp, Homo sapien
aggcagagctgactatggacacccc

SEQ ID NO: 321046 - DNA, 25 bp, Homo sapien
atggacaccccttccttgggcaaga

SEQ ID NO: 321047 - DNA, 25 bp, Homo sapien
catctctctgggtttcctcataaga

SEQ ID NO: 321048 - DNA, 25 bp, Homo sapien
aggaagacaagtttgtcccgcctca

SEQ ID NO: 321049 - DNA, 25 bp, Homo sapien
aaatctacggataattatttctaag

SEQ ID NO: 321050 - DNA, 25 bp, Homo sapien
aagcaatgtgttcttattccccagt

SEQ ID NO: 321051 - DNA, 25 bp, Homo sapien
tgtgttcttattccccagtaaccta

SEQ ID NO: 321052 - DNA, 25 bp, Homo sapien
tattccccagtaacctacactatat

SEQ ID NO: 321053 - DNA, 25 bp, Homo sapien
taacctacactatatctgataccat

SEQ ID NO: 321054 - DNA, 25 bp, Homo sapien
ctatatctgataccatttatgaaac

SEQ ID NO: 321055 - DNA, 25 bp, Homo sapien
ttcttgctgtaactaagtgcctccc

SEQ ID NO: 321056 - DNA, 25 bp, Homo sapien
agaccctgactgagtccccagcatg

SEQ ID NO: 321057 - DNA, 25 bp, Homo sapien
gactgagtccccagcatgtgctaca

SEQ ID NO: 321058 - DNA, 25 bp, Homo sapien
tttcgggcttttcaaatgtcggtag

SEQ ID NO: 321059 - DNA, 25 bp, Homo sapien
ggcttttcaaatgtcggtagtgttt

SEQ ID NO: 321060 - DNA, 25 bp, Homo sapien
aaagcgttgagtagctgcttacaga

SEQ ID NO: 321061 - DNA, 25 bp, Homo sapien
aagaatacaggagggctagcttaaa

SEQ ID NO: 321062 - DNA, 25 bp, Homo sapien
aaattagctggagtagcatcctact

SEQ ID NO: 321063 - DNA, 25 bp, Homo sapien
gcatcctactgcaacctttaaattt

SEQ ID NO: 321064 - DNA, 25 bp, Homo sapien
ggagaatatcttcctttttggccta

SEQ ID NO: 321065 - DNA, 25 bp, Homo sapien
ttggcctattcatttccccaaaatc

SEQ ID NO: 321066 - DNA, 25 bp, Homo sapien
gctgcttacagaatgcatgcaataa

SEQ ID NO: 321067 - DNA, 25 bp, Homo sapien
tttccccaaaatccactgttataga

SEQ ID NO: 321068 - DNA, 25 bp, Homo sapien
tccactgttatagatgaattcacac

SEQ ID NO: 321069 - DNA, 25 bp, Homo sapien
tgaattcacacataactgtcatatc

SEQ ID NO: 321070 - DNA, 25 bp, Homo sapien
gataataagttttcgaagtcagcat

SEQ ID NO: 321071 - DNA, 25 bp, Homo sapien
agcgtaaccacctgtttaagcaccg

SEQ ID NO: 321072 - DNA, 25 bp, Homo sapien
acctgtttaagcaccgtgggaccat

SEQ ID NO: 321073 - DNA, 25 bp, Homo sapien
gtgggaccatctcttattcgggtag

SEQ ID NO: 321074 - DNA, 25 bp, Homo sapien
tcttattcgggtagagcctggtcct

SEQ ID NO: 321075 - DNA, 25 bp, Homo sapien
gagcctggtcctggcgacacactaa

SEQ ID NO: 321076 - DNA, 25 bp, Homo sapien
tggcgacacactaacaggaaggcgt

SEQ ID NO: 321077 - DNA, 25 bp, Homo sapien
aacaggaaggcgtgctgtgttaccg

SEQ ID NO: 321078 - DNA, 25 bp, Homo sapien
ctgtgttaccgggaaggcgcctctg

SEQ ID NO: 321079 - DNA, 25 bp, Homo sapien
ttgcccttaaggaaacttgctatgt

SEQ ID NO: 321080 - DNA, 25 bp, Homo sapien
gaaacttgctatgtgtgttaaccca

SEQ ID NO: 321081 - DNA, 25 bp, Homo sapien
atatactttccacagttgtacttaa

SEQ ID NO: 321082 - DNA, 25 bp, Homo sapien
ggttagtagtgatcatgagctcatc

SEQ ID NO: 321083 - DNA, 25 bp, Homo sapien
ggtccatctgtacctgttttgccca

SEQ ID NO: 321084 - DNA, 25 bp, Homo sapien
tgttttgcccatcagataccaattg

SEQ ID NO: 321085 - DNA, 25 bp, Homo sapien
aattgggaactttatcttctcttga

SEQ ID NO: 321086 - DNA, 25 bp, Homo sapien
tcttctcttgaaaccatagcctata

SEQ ID NO: 321087 - DNA, 25 bp, Homo sapien
atagcctataaccaggtcaccatga

SEQ ID NO: 321088 - DNA, 25 bp, Homo sapien
tggaagaccaggtacctctagcagc

SEQ ID NO: 321089 - DNA, 25 bp, Homo sapien
ggtcaccatgattaatgtgcatata

SEQ ID NO: 321090 - DNA, 25 bp, Homo sapien
gagaagccatagaaattccctgtga

SEQ ID NO: 321091 - DNA, 25 bp, Homo sapien
cagacccatgtatagggcagctgat

SEQ ID NO: 321092 - DNA, 25 bp, Homo sapien
cagctgatagagtgccagtggccca

SEQ ID NO: 321093 - DNA, 25 bp, Homo sapien
tcacttaagccttgggtagaatggg

SEQ ID NO: 321094 - DNA, 25 bp, Homo sapien
taagccttgggtagaatgggaattc

SEQ ID NO: 321095 - DNA, 25 bp, Homo sapien
gccttgggtagaatgggaattcttt

SEQ ID NO: 321096 - DNA, 25 bp, Homo sapien
tggaacttaacttcggtttggactg

SEQ ID NO: 321097 - DNA, 25 bp, Homo sapien
tttggactgtggtcgtgctgaggca

SEQ ID NO: 321098 - DNA, 25 bp, Homo sapien
gggctgaatctccaggcctcacgag

SEQ ID NO: 321099 - DNA, 25 bp, Homo sapien
gctgaatctccaggcctcacgaggt

SEQ ID NO: 321100 - DNA, 25 bp, Homo sapien
gggatgctgctatttctaagatgca

SEQ ID NO: 321101 - DNA, 25 bp, Homo sapien
gatgctgctatttctaagatgcaaa

SEQ ID NO: 321102 - DNA, 25 bp, Homo sapien
gctgctatttctaagatgcaaattg

SEQ ID NO: 321103 - DNA, 25 bp, Homo sapien
ttttgtatctgtggatttggataag

SEQ ID NO: 321104 - DNA, 25 bp, Homo sapien
cattccgggcatttgcacttgggaa

SEQ ID NO: 321105 - DNA, 25 bp, Homo sapien
ccgggcatttgcacttgggaaactt

SEQ ID NO: 321106 - DNA, 25 bp, Homo sapien
tttgcacttgggaaacttgcctcac

SEQ ID NO: 321107 - DNA, 25 bp, Homo sapien
aaacttgcctcaccttcaggcttgt

SEQ ID NO: 321108 - DNA, 25 bp, Homo sapien
cgcctgttgctgctttgcaatgaat

SEQ ID NO: 321109 - DNA, 25 bp, Homo sapien
gctgctttgcaatgaatttccttta

SEQ ID NO: 321110 - DNA, 25 bp, Homo sapien
tgcaatgaatttcctttacctttct

SEQ ID NO: 321111 - DNA, 25 bp, Homo sapien
tgctgtgaaccaaactgatatcaag

SEQ ID NO: 321112 - DNA, 25 bp, Homo sapien
atcaagtgattagctcaccgggcct

SEQ ID NO: 321113 - DNA, 25 bp, Homo sapien
gtgattagctcaccgggccttggtt

SEQ ID NO: 321114 - DNA, 25 bp, Homo sapien
tcaccgggccttggttgcttttcaa

SEQ ID NO: 321115 - DNA, 25 bp, Homo sapien
ggaggtgttgccgtcactgtattaa

SEQ ID NO: 321116 - DNA, 25 bp, Homo sapien
gttgccgtcactgtattaagtcgat

SEQ ID NO: 321117 - DNA, 25 bp, Homo sapien
gccgtcactgtattaagtcgatgtt

SEQ ID NO: 321118 - DNA, 25 bp, Homo sapien
tattaagtcgatgttgggaaacgtt

SEQ ID NO: 321119 - DNA, 25 bp, Homo sapien
ggaaacgttttaacatctggagcct

SEQ ID NO: 321120 - DNA, 25 bp, Homo sapien
aacgttttaacatctggagcctttg

SEQ ID NO: 321121 - DNA, 25 bp, Homo sapien
catctggagcctttgtgggtggaaa

SEQ ID NO: 321122 - DNA, 25 bp, Homo sapien
tctggagcctttgtgggtggaaata

SEQ ID NO: 321123 - DNA, 25 bp, Homo sapien
aatatgtctccagttacaactccgc

SEQ ID NO: 321124 - DNA, 25 bp, Homo sapien
ccagttacaactccgcagtggatgt

SEQ ID NO: 321125 - DNA, 25 bp, Homo sapien
acaactccgcagtggatgtgaagaa

SEQ ID NO: 321126 - DNA, 25 bp, Homo sapien
aaacctgatgtaaagcaaaagtcca

SEQ ID NO: 321127 - DNA, 25 bp, Homo sapien
tccagcaggaagaaagtggtcgttc

SEQ ID NO: 321128 - DNA, 25 bp, Homo sapien
gtggtcgttccacagatcatcatca

SEQ ID NO: 321129 - DNA, 25 bp, Homo sapien
agatcatcatcacgcgagcgtcgaa

SEQ ID NO: 321130 - DNA, 25 bp, Homo sapien
gagacgctagtcagttgcagttcca

SEQ ID NO: 321131 - DNA, 25 bp, Homo sapien
agtcagttgcagttccagcgggagt

SEQ ID NO: 321132 - DNA, 25 bp, Homo sapien
ttccagcgggagtgaccagcagaga

SEQ ID NO: 321133 - DNA, 25 bp, Homo sapien
agcagagaaccattcgggagccgga

SEQ ID NO: 321134 - DNA, 25 bp, Homo sapien
taccggcggcacaggaaccccagta

SEQ ID NO: 321135 - DNA, 25 bp, Homo sapien
cccagtacagcagacgcctataatt

SEQ ID NO: 321136 - DNA, 25 bp, Homo sapien
gacgcctataattcacatctcaaag

SEQ ID NO: 321137 - DNA, 25 bp, Homo sapien
gtgcaggtatctgagcaccccggtc

SEQ ID NO: 321138 - DNA, 25 bp, Homo sapien
agcaccccggtctccacttgagaga

SEQ ID NO: 321139 - DNA, 25 bp, Homo sapien
tttcccctcttgtctgctgagccag

SEQ ID NO: 321140 - DNA, 25 bp, Homo sapien
agactacacacgctgtgtccacgtg

SEQ ID NO: 321141 - DNA, 25 bp, Homo sapien
tgtccacgtgtctcacattatctgt

SEQ ID NO: 321142 - DNA, 25 bp, Homo sapien
gtgtctcacattatctgtggcagag

SEQ ID NO: 321143 - DNA, 25 bp, Homo sapien
tgtggcagaggatccggcttctttc

SEQ ID NO: 321144 - DNA, 25 bp, Homo sapien
agaggatccggcttctttctcaatt

SEQ ID NO: 321145 - DNA, 25 bp, Homo sapien
aggatccggcttctttctcaatttc

SEQ ID NO: 321146 - DNA, 25 bp, Homo sapien
tctcaatttccagttcttcacaaag

SEQ ID NO: 321147 - DNA, 25 bp, Homo sapien
cagttcttcacaaagcaatgccttt

SEQ ID NO: 321148 - DNA, 25 bp, Homo sapien
tgctgccttagctgccgttgcatag

SEQ ID NO: 321149 - DNA, 25 bp, Homo sapien
tagctgccgttgcatagtgtcccct

SEQ ID NO: 321150 - DNA, 25 bp, Homo sapien
ctgtgcctgggagcttctagcccag

SEQ ID NO: 321151 - DNA, 25 bp, Homo sapien
agcccaggtgtggtgttctcaccca

SEQ ID NO: 321152 - DNA, 25 bp, Homo sapien
acccctgcagacttacagaacttgt

SEQ ID NO: 321153 - DNA, 25 bp, Homo sapien
gaacttgtaaatagacagcaccttg

SEQ ID NO: 321154 - DNA, 25 bp, Homo sapien
cagcaccttgagatttcatcacttt

SEQ ID NO: 321155 - DNA, 25 bp, Homo sapien
gagatttcatcactttatgcagatt

SEQ ID NO: 321156 - DNA, 25 bp, Homo sapien
agaggactgccttatgttgagaact

SEQ ID NO: 321157 - DNA, 25 bp, Homo sapien
tgagaactgaccagagattgtgctg

SEQ ID NO: 321158 - DNA, 25 bp, Homo sapien
agaaacagatgatgcaggtcgggat

SEQ ID NO: 321159 - DNA, 25 bp, Homo sapien
atggctgcaggcttcggcgttcagt

SEQ ID NO: 321160 - DNA, 25 bp, Homo sapien
gcaggcttcggcgttcagtgattgt

SEQ ID NO: 321161 - DNA, 25 bp, Homo sapien
aggcttcggcgttcagtgattgtcg

SEQ ID NO: 321162 - DNA, 25 bp, Homo sapien
ttcggcgttcagtgattgtcgctgg

SEQ ID NO: 321163 - DNA, 25 bp, Homo sapien
gcgttcagtgattgtcgctgggcac

SEQ ID NO: 321164 - DNA, 25 bp, Homo sapien
gttcagtgattgtcgctgggcacag

SEQ ID NO: 321165 - DNA, 25 bp, Homo sapien
tggcgctgcatgtcttccaccaggg

SEQ ID NO: 321166 - DNA, 25 bp, Homo sapien
gctcgaaccagctcttgaggcgggc

SEQ ID NO: 321167 - DNA, 25 bp, Homo sapien
cgaaccagctcttgaggcgggcctg

SEQ ID NO: 321168 - DNA, 25 bp, Homo sapien
aggcgtatctgctgggcctgctcct

SEQ ID NO: 321169 - DNA, 25 bp, Homo sapien
ttcacctcgtccaggcggtcgcggg

SEQ ID NO: 321170 - DNA, 25 bp, Homo sapien
atcagcgccctcagttcctgggtga

SEQ ID NO: 321171 - DNA, 25 bp, Homo sapien
aggtgggaggcgaggcgcacccgca

SEQ ID NO: 321172 - DNA, 25 bp, Homo sapien
gcagctcctcggtgctctggccgag

SEQ ID NO: 321173 - DNA, 25 bp, Homo sapien
gtgctctggccgagcatggcctgca

SEQ ID NO: 321174 - DNA, 25 bp, Homo sapien
gttcctccagttccgatttgtaggc

SEQ ID NO: 321175 - DNA, 25 bp, Homo sapien
ccagttccgatttgtaggccttcaa

SEQ ID NO: 321176 - DNA, 25 bp, Homo sapien
gttccgatttgtaggccttcaactc

SEQ ID NO: 321177 - DNA, 25 bp, Homo sapien
atttgtaggccttcaactccttcat

SEQ ID NO: 321178 - DNA, 25 bp, Homo sapien
taggccttcaactccttcatggtct

SEQ ID NO: 321179 - DNA, 25 bp, Homo sapien
ttcaactccttcatggtctcgtcca

SEQ ID NO: 321180 - DNA, 25 bp, Homo sapien
tccttcatggtctcgtccatcagcg

SEQ ID NO: 321181 - DNA, 25 bp, Homo sapien
accaaatcaaaacaccctctgtcat

SEQ ID NO: 321182 - DNA, 25 bp, Homo sapien
tacggcatttcctcttgaggtcaca

SEQ ID NO: 321183 - DNA, 25 bp, Homo sapien
ctggaaacctgtgttattctgtgtt

SEQ ID NO: 321184 - DNA, 25 bp, Homo sapien
agacgtaaatgtgaagccagttgga

SEQ ID NO: 321185 - DNA, 25 bp, Homo sapien
gccagttggagtttgtgctatgcag

SEQ ID NO: 321186 - DNA, 25 bp, Homo sapien
tgctatgcagcagtgttagccagga

SEQ ID NO: 321187 - DNA, 25 bp, Homo sapien
ttagccaggatctcatcagcgtgca

SEQ ID NO: 321188 - DNA, 25 bp, Homo sapien
gatctcatcagcgtgcaaacctagc

SEQ ID NO: 321189 - DNA, 25 bp, Homo sapien
gggtttctgtctaactcgaagtctt

SEQ ID NO: 321190 - DNA, 25 bp, Homo sapien
cgaagtcttgaatcctagctagttt

SEQ ID NO: 321191 - DNA, 25 bp, Homo sapien
gtagcaaagttgatctctccatgtc

SEQ ID NO: 321192 - DNA, 25 bp, Homo sapien
cttccccactgacaaacttatcaaa

SEQ ID NO: 321193 - DNA, 25 bp, Homo sapien
gacaaacttatcaaatccagaagct

SEQ ID NO: 321194 - DNA, 25 bp, Homo sapien
aacttatcaaatccagaagctttag

SEQ ID NO: 321195 - DNA, 25 bp, Homo sapien
tatcaaatccagaagctttagagtt

SEQ ID NO: 321196 - DNA, 25 bp, Homo sapien
aatccagaagctttagagtttcgtc

SEQ ID NO: 321197 - DNA, 25 bp, Homo sapien
tccagaagctttagagtttcgtctc

SEQ ID NO: 321198 - DNA, 25 bp, Homo sapien
cagaagctttagagtttcgtctcta

SEQ ID NO: 321199 - DNA, 25 bp, Homo sapien
gaagctttagagtttcgtctctaat

SEQ ID NO: 321200 - DNA, 25 bp, Homo sapien
gctttagagtttcgtctctaattat

SEQ ID NO: 321201 - DNA, 25 bp, Homo sapien
gtatttttagaattacggcagcata

SEQ ID NO: 321202 - DNA, 25 bp, Homo sapien
tttttagaattacggcagcatacga

SEQ ID NO: 321203 - DNA, 25 bp, Homo sapien
tccctgaacctatcccgggacaggg

SEQ ID NO: 321204 - DNA, 25 bp, Homo sapien
tggcagtggtgccacactgaacaga

SEQ ID NO: 321205 - DNA, 25 bp, Homo sapien
gtggaagacatatgccatgcagcta

SEQ ID NO: 321206 - DNA, 25 bp, Homo sapien
aagacatatgccatgcagctacacc

SEQ ID NO: 321207 - DNA, 25 bp, Homo sapien
acagggcattgtcctcagtcagata

SEQ ID NO: 321208 - DNA, 25 bp, Homo sapien
gtcctcagtcagatacaacagcatt

SEQ ID NO: 321209 - DNA, 25 bp, Homo sapien
gggccatggtacctgcacacctaaa

SEQ ID NO: 321210 - DNA, 25 bp, Homo sapien
ggtacctgcacacctaaaacactag

SEQ ID NO: 321211 - DNA, 25 bp, Homo sapien
aaaacactaggccacgcatctgatc

SEQ ID NO: 321212 - DNA, 25 bp, Homo sapien
aggccacgcatctgatctgtagtca

SEQ ID NO: 321213 - DNA, 25 bp, Homo sapien
acgcatctgatctgtagtcacatga

SEQ ID NO: 321214 - DNA, 25 bp, Homo sapien
gagtcccttaggattaacaggcctt

SEQ ID NO: 321215 - DNA, 25 bp, Homo sapien
ggattaacaggccttttgtttgcct

SEQ ID NO: 321216 - DNA, 25 bp, Homo sapien
gaaatattcttcaaattctgagtct

SEQ ID NO: 321217 - DNA, 25 bp, Homo sapien
gttcaagttgggtattgcccctgca

SEQ ID NO: 321218 - DNA, 25 bp, Homo sapien
gtactagtagcatctgtctgtgaac

SEQ ID NO: 321219 - DNA, 25 bp, Homo sapien
gaacacttaacctgatttctctcac

SEQ ID NO: 321220 - DNA, 25 bp, Homo sapien
gaagcaattattcctgcccaattat

SEQ ID NO: 321221 - DNA, 25 bp, Homo sapien
attcctgcccaattatatagtatac

SEQ ID NO: 321222 - DNA, 25 bp, Homo sapien
ttgcccctgcatgaatcacacggga

SEQ ID NO: 321223 - DNA, 25 bp, Homo sapien
aaagctggctaggtccattaccatg

SEQ ID NO: 321224 - DNA, 25 bp, Homo sapien
gtccattaccatgagagtcccttag

SEQ ID NO: 321225 - DNA, 25 bp, Homo sapien
gcagtttataagaccctggtgcacc

SEQ ID NO: 321226 - DNA, 25 bp, Homo sapien
ccctggtgcacctctctgagaaaca

SEQ ID NO: 321227 - DNA, 25 bp, Homo sapien
aaaggattcagcattccgtggaatt

SEQ ID NO: 321228 - DNA, 25 bp, Homo sapien
gatcagtgtgaatcccagtggcgta

SEQ ID NO: 321229 - DNA, 25 bp, Homo sapien
atcccagtggcgtaatccaagattt

SEQ ID NO: 321230 - DNA, 25 bp, Homo sapien
ttgtgatgccgttgcatcatggatt

SEQ ID NO: 321231 - DNA, 25 bp, Homo sapien
ggattaacccaaaagatgatctcag

SEQ ID NO: 321232 - DNA, 25 bp, Homo sapien
gatgatctcagagacatgttctgta

SEQ ID NO: 321233 - DNA, 25 bp, Homo sapien
atgttctgtaagatccttcatggat

SEQ ID NO: 321234 - DNA, 25 bp, Homo sapien
aaattggaggcgtttctctgaccag

SEQ ID NO: 321235 - DNA, 25 bp, Homo sapien
ttcccttaaaagagcgtcttgcagc

SEQ ID NO: 321236 - DNA, 25 bp, Homo sapien
tctagaagactagccgtgttttctc

SEQ ID NO: 321237 - DNA, 25 bp, Homo sapien
gccgtgttttctcagactccacctt

SEQ ID NO: 321238 - DNA, 25 bp, Homo sapien
gtttgcactctgttgcctgtgagga

SEQ ID NO: 321239 - DNA, 25 bp, Homo sapien
cctgtgaggagctttctggcatgtg

SEQ ID NO: 321240 - DNA, 25 bp, Homo sapien
ctggcatgtgattatttacttcaaa

SEQ ID NO: 321241 - DNA, 25 bp, Homo sapien
aaaactagagttccaagcacctaca

SEQ ID NO: 321242 - DNA, 25 bp, Homo sapien
gagttccaagcacctacattaatta

SEQ ID NO: 321243 - DNA, 25 bp, Homo sapien
gatacactgcacatattgcttttgc

SEQ ID NO: 321244 - DNA, 25 bp, Homo sapien
ttatattctttgagtgtgagctttg

SEQ ID NO: 321245 - DNA, 25 bp, Homo sapien
gtgtgagctttgaatagatggcatt

SEQ ID NO: 321246 - DNA, 25 bp, Homo sapien
agatggcattatcactttattgttt

SEQ ID NO: 321247 - DNA, 25 bp, Homo sapien
tgtgggactaggtaacactttaaat

SEQ ID NO: 321248 - DNA, 25 bp, Homo sapien
tacttttttactcaaagatttgcca

SEQ ID NO: 321249 - DNA, 25 bp, Homo sapien
gccaagaacacagcttattagtgaa

SEQ ID NO: 321250 - DNA, 25 bp, Homo sapien
attagtgaaagagacctgtggattg

SEQ ID NO: 321251 - DNA, 25 bp, Homo sapien
agacctgtggattgaaatggctgca

SEQ ID NO: 321252 - DNA, 25 bp, Homo sapien
tgaaatggctgcagatagatcccgc

SEQ ID NO: 321253 - DNA, 25 bp, Homo sapien
atggctgcagatagatcccgcagtc

SEQ ID NO: 321254 - DNA, 25 bp, Homo sapien
atcccgcagtcccttctgaaaggaa

SEQ ID NO: 321255 - DNA, 25 bp, Homo sapien
cgcagtcccttctgaaaggaactgt

SEQ ID NO: 321256 - DNA, 25 bp, Homo sapien
aaggcgatgtgcaaggccatcccag

SEQ ID NO: 321257 - DNA, 25 bp, Homo sapien
gatactaagcctcagcccaagaata

SEQ ID NO: 321258 - DNA, 25 bp, Homo sapien
atagggaaacctctcagctgtggca

SEQ ID NO: 321259 - DNA, 25 bp, Homo sapien
aaacctctcagctgtggcactgttg

SEQ ID NO: 321260 - DNA, 25 bp, Homo sapien
cactgttgtagctttggagtgcaga

SEQ ID NO: 321261 - DNA, 25 bp, Homo sapien
gctttggagtgcagagtgtaactct

SEQ ID NO: 321262 - DNA, 25 bp, Homo sapien
attctgtcatcttggcataagccat

SEQ ID NO: 321263 - DNA, 25 bp, Homo sapien
ggcataagccattaaaagcttggag

SEQ ID NO: 321264 - DNA, 25 bp, Homo sapien
gcttggagattactgtatttggcat

SEQ ID NO: 321265 - DNA, 25 bp, Homo sapien
aaatgtcacttaggtcagcactccc

SEQ ID NO: 321266 - DNA, 25 bp, Homo sapien
taggtcagcactcccagacgtagca

SEQ ID NO: 321267 - DNA, 25 bp, Homo sapien
agacgtagcacagaaaaaccctttg

SEQ ID NO: 321268 - DNA, 25 bp, Homo sapien
aaaaccctttgacacaaaccatgtg

SEQ ID NO: 321269 - DNA, 25 bp, Homo sapien
cgttcctttaacaaaatcagtgcag

SEQ ID NO: 321270 - DNA, 25 bp, Homo sapien
tgtgcactgccgttaacctgaggaa

SEQ ID NO: 321271 - DNA, 25 bp, Homo sapien
aagcagctgacatctcttgattacg

SEQ ID NO: 321272 - DNA, 25 bp, Homo sapien
ctgacatctcttgattacggctaga

SEQ ID NO: 321273 - DNA, 25 bp, Homo sapien
gtggaaggacccaaacttgcagcct

SEQ ID NO: 321274 - DNA, 25 bp, Homo sapien
gagagagtgttagtccagtccttta

SEQ ID NO: 321275 - DNA, 25 bp, Homo sapien
gtccagtcctttagagaggttcggt

SEQ ID NO: 321276 - DNA, 25 bp, Homo sapien
agaggttcggtttggctctctgtca

SEQ ID NO: 321277 - DNA, 25 bp, Homo sapien
tggctctctgtcatcaccgggacgc

SEQ ID NO: 321278 - DNA, 25 bp, Homo sapien
cactgaggtgaaaagtcgggtctgt

SEQ ID NO: 321279 - DNA, 25 bp, Homo sapien
gtctgtgagtagagcgactttcttt

SEQ ID NO: 321280 - DNA, 25 bp, Homo sapien
aacaacatggcggtaggaaacaaat

SEQ ID NO: 321281 - DNA, 25 bp, Homo sapien
caacatggcggtaggaaacaaatgc

SEQ ID NO: 321282 - DNA, 25 bp, Homo sapien
atggcggtaggaaacaaatgccaag

SEQ ID NO: 321283 - DNA, 25 bp, Homo sapien
atgccaagtggatgtgaaatagctc

SEQ ID NO: 321284 - DNA, 25 bp, Homo sapien
gccaagtggatgtgaaatagctctc

SEQ ID NO: 321285 - DNA, 25 bp, Homo sapien
gtgaaatagctctccatgataatag

SEQ ID NO: 321286 - DNA, 25 bp, Homo sapien
aatagctctccatgataatagcaga

SEQ ID NO: 321287 - DNA, 25 bp, Homo sapien
atagctctccatgataatagcagat

SEQ ID NO: 321288 - DNA, 25 bp, Homo sapien
agctctccatgataatagcagattg

SEQ ID NO: 321289 - DNA, 25 bp, Homo sapien
catgataatagcagattggcacttc

SEQ ID NO: 321290 - DNA, 25 bp, Homo sapien
tgataatagcagattggcacttctc

SEQ ID NO: 321291 - DNA, 25 bp, Homo sapien
acaataaaaatatgatataggccag

SEQ ID NO: 321292 - DNA, 25 bp, Homo sapien
caataaaaatatgatataggccaga

SEQ ID NO: 321293 - DNA, 25 bp, Homo sapien
aataaaaatatgatataggccagac

SEQ ID NO: 321294 - DNA, 25 bp, Homo sapien
ataaaaatatgatataggccagaca

SEQ ID NO: 321295 - DNA, 25 bp, Homo sapien
taaaaatatgatataggccagacac

SEQ ID NO: 321296 - DNA, 25 bp, Homo sapien
aaaaatatgatataggccagacacg

SEQ ID NO: 321297 - DNA, 25 bp, Homo sapien
aaaatatgatataggccagacacgg

SEQ ID NO: 321298 - DNA, 25 bp, Homo sapien
aaatatgatataggccagacacggt

SEQ ID NO: 321299 - DNA, 25 bp, Homo sapien
taatgtaagttacctctatgcacaa

SEQ ID NO: 321300 - DNA, 25 bp, Homo sapien
agttacctctatgcacaaacaagtg

SEQ ID NO: 321301 - DNA, 25 bp, Homo sapien
caaacaagtgtatctctgtcaggat

SEQ ID NO: 321302 - DNA, 25 bp, Homo sapien
atctctgtcaggatatcatgcagtg

SEQ ID NO: 321303 - DNA, 25 bp, Homo sapien
aggatatcatgcagtgccaacccct

SEQ ID NO: 321304 - DNA, 25 bp, Homo sapien
gtgccaaccccttcagagttttcaa

SEQ ID NO: 321305 - DNA, 25 bp, Homo sapien
gagttttcaactctgtaatatctag

SEQ ID NO: 321306 - DNA, 25 bp, Homo sapien
taatatctagaggagcagttaaggc

SEQ ID NO: 321307 - DNA, 25 bp, Homo sapien
gttccagaacaaacatactgcagag

SEQ ID NO: 321308 - DNA, 25 bp, Homo sapien
gaacaaacatactgcagagaatttt

SEQ ID NO: 321309 - DNA, 25 bp, Homo sapien
ttttgaatccaaacccgggcaagag

SEQ ID NO: 321310 - DNA, 25 bp, Homo sapien
aacactctactcatggacttcttga

SEQ ID NO: 321311 - DNA, 25 bp, Homo sapien
acttcttgagcccaacattgcaggt

SEQ ID NO: 321312 - DNA, 25 bp, Homo sapien
aacattgcaggttgccagccggaac

SEQ ID NO: 321313 - DNA, 25 bp, Homo sapien
gccggaacctatgctgtgtagatga

SEQ ID NO: 321314 - DNA, 25 bp, Homo sapien
caggagagccttgttcttttgatgt

SEQ ID NO: 321315 - DNA, 25 bp, Homo sapien
tgatgtggctatcattgctggtcgc

SEQ ID NO: 321316 - DNA, 25 bp, Homo sapien
tcgccttcggatgttgggtgaccag

SEQ ID NO: 321317 - DNA, 25 bp, Homo sapien
ttgggtgaccagttcaacggagaat

SEQ ID NO: 321318 - DNA, 25 bp, Homo sapien
ggaagcttctgccaaaaacgtcatt

SEQ ID NO: 321319 - DNA, 25 bp, Homo sapien
taagggacagacaggagctatactc

SEQ ID NO: 321320 - DNA, 25 bp, Homo sapien
ggagctatactccagaacactgtgg

SEQ ID NO: 321321 - DNA, 25 bp, Homo sapien
cctcagctcagcctggtatggaaag

SEQ ID NO: 321322 - DNA, 25 bp, Homo sapien
agctcagcctggtatggaaagcaag

SEQ ID NO: 321323 - DNA, 25 bp, Homo sapien
ggaaagcaaggtgcacgttggtctt

SEQ ID NO: 321324 - DNA, 25 bp, Homo sapien
gcaaggtgcacgttggtctttgatt

SEQ ID NO: 321325 - DNA, 25 bp, Homo sapien
gtgcacgttggtctttgattgttct

SEQ ID NO: 321326 - DNA, 25 bp, Homo sapien
cacgttggtctttgattgttctgtc

SEQ ID NO: 321327 - DNA, 25 bp, Homo sapien
ggtctttgattgttctgtcctcaca

SEQ ID NO: 321328 - DNA, 25 bp, Homo sapien
ctttgattgttctgtcctcacagca

SEQ ID NO: 321329 - DNA, 25 bp, Homo sapien
tatctttccaaattgtttccttgaa

SEQ ID NO: 321330 - DNA, 25 bp, Homo sapien
aaaccccaacaatatcttgctgtat

SEQ ID NO: 321331 - DNA, 25 bp, Homo sapien
acaatatcttgctgtattatcacat

SEQ ID NO: 321332 - DNA, 25 bp, Homo sapien
ggtaaggttcacaaataggttgatt

SEQ ID NO: 321333 - DNA, 25 bp, Homo sapien
tctttcttcagctttctgacatgtc

SEQ ID NO: 321334 - DNA, 25 bp, Homo sapien
tcagctttctgacatgtccagccca

SEQ ID NO: 321335 - DNA, 25 bp, Homo sapien
atgtccagcccatctctaatgagga

SEQ ID NO: 321336 - DNA, 25 bp, Homo sapien
atctctaatgaggactcccagatca

SEQ ID NO: 321337 - DNA, 25 bp, Homo sapien
ctaatgaggactcccagatcatcac

SEQ ID NO: 321338 - DNA, 25 bp, Homo sapien
agatcatcactttatggctgttagg

SEQ ID NO: 321339 - DNA, 25 bp, Homo sapien
ctttatggctgttaggtgtttccca

SEQ ID NO: 321340 - DNA, 25 bp, Homo sapien
ggctgttaggtgtttcccatatgaa

SEQ ID NO: 321341 - DNA, 25 bp, Homo sapien
ggtgtttcccatatgaaattagagg

SEQ ID NO: 321342 - DNA, 25 bp, Homo sapien
gctgggtcagggagacaaaagtctt

SEQ ID NO: 321343 - DNA, 25 bp, Homo sapien
aggtactcaagccttctcagacggg

SEQ ID NO: 321344 - DNA, 25 bp, Homo sapien
ggtactcaagccttctcagacgggg

SEQ ID NO: 321345 - DNA, 25 bp, Homo sapien
tactcaagccttctcagacggggca

SEQ ID NO: 321346 - DNA, 25 bp, Homo sapien
actcaagccttctcagacggggcac

SEQ ID NO: 321347 - DNA, 25 bp, Homo sapien
tcaagccttctcagacggggcactg

SEQ ID NO: 321348 - DNA, 25 bp, Homo sapien
aagccttctcagacggggcactggg

SEQ ID NO: 321349 - DNA, 25 bp, Homo sapien
cactgggagcaggatcagaagaagc

SEQ ID NO: 321350 - DNA, 25 bp, Homo sapien
actgggagcaggatcagaagaagca

SEQ ID NO: 321351 - DNA, 25 bp, Homo sapien
agcaggatcagaagaagcaggcttg

SEQ ID NO: 321352 - DNA, 25 bp, Homo sapien
gcaggatcagaagaagcaggcttgg

SEQ ID NO: 321353 - DNA, 25 bp, Homo sapien
agaagcaggcttgggggtgccatgc

SEQ ID NO: 321354 - DNA, 25 bp, Homo sapien
ctgcccgaagttcggctgttccggg

SEQ ID NO: 321355 - DNA, 25 bp, Homo sapien
cccatttctggcagccaagccatta

SEQ ID NO: 321356 - DNA, 25 bp, Homo sapien
ttctggcagccaagccattaatctg

SEQ ID NO: 321357 - DNA, 25 bp, Homo sapien
tggcagccaagccattaatctggag

SEQ ID NO: 321358 - DNA, 25 bp, Homo sapien
gccaagccattaatctggagacaga

SEQ ID NO: 321359 - DNA, 25 bp, Homo sapien
tatcgattctctggccactttttct

SEQ ID NO: 321360 - DNA, 25 bp, Homo sapien
ttttctttcattacaatttgtaccg

SEQ ID NO: 321361 - DNA, 25 bp, Homo sapien
acaatttgtaccgtgattcttctca

SEQ ID NO: 321362 - DNA, 25 bp, Homo sapien
atttgtaccgtgattcttctcaccc

SEQ ID NO: 321363 - DNA, 25 bp, Homo sapien
ttgtaccgtgattcttctcaccctt

SEQ ID NO: 321364 - DNA, 25 bp, Homo sapien
gtaccgtgattcttctcacccttct

SEQ ID NO: 321365 - DNA, 25 bp, Homo sapien
aaatcactgcaagagtacacgtcat

SEQ ID NO: 321366 - DNA, 25 bp, Homo sapien
gcaagagtacacgtcataagcaaaa

SEQ ID NO: 321367 - DNA, 25 bp, Homo sapien
gtacacgtcataagcaaaatactga

SEQ ID NO: 321368 - DNA, 25 bp, Homo sapien
tctgatgtccctgaggaattagact

SEQ ID NO: 321369 - DNA, 25 bp, Homo sapien
gtccctgaggaattagactttcttg

SEQ ID NO: 321370 - DNA, 25 bp, Homo sapien
agactttcttgtacctaaggctgga

SEQ ID NO: 321371 - DNA, 25 bp, Homo sapien
gtacctaaggctggattcttctgtc

SEQ ID NO: 321372 - DNA, 25 bp, Homo sapien
ctaaggctggattcttctgtccaat

SEQ ID NO: 321373 - DNA, 25 bp, Homo sapien
ggctggattcttctgtccaatttgt

SEQ ID NO: 321374 - DNA, 25 bp, Homo sapien
tgtccaatttgttccctcttctact

SEQ ID NO: 321375 - DNA, 25 bp, Homo sapien
caatttgttccctcttctactcagg

SEQ ID NO: 321376 - DNA, 25 bp, Homo sapien
caaacgtagaagtggcaatgctgta

SEQ ID NO: 321377 - DNA, 25 bp, Homo sapien
aatgctgtaacctggtgcctgctgc

SEQ ID NO: 321378 - DNA, 25 bp, Homo sapien
tgctgtgcagccacatacacacaat

SEQ ID NO: 321379 - DNA, 25 bp, Homo sapien
acacacaattgtagcctgattttta

SEQ ID NO: 321380 - DNA, 25 bp, Homo sapien
agcctgatttttagaagtgtgggta

SEQ ID NO: 321381 - DNA, 25 bp, Homo sapien
gaatttcctccttgagtagcagctg

SEQ ID NO: 321382 - DNA, 25 bp, Homo sapien
ctccttgagtagcagctgaggtcat

SEQ ID NO: 321383 - DNA, 25 bp, Homo sapien
cagctgaggtcattgacaactgaag

SEQ ID NO: 321384 - DNA, 25 bp, Homo sapien
ggagtaagtgatacactgctggaat

SEQ ID NO: 321385 - DNA, 25 bp, Homo sapien
actgctggaatttgtttcctgccta

SEQ ID NO: 321386 - DNA, 25 bp, Homo sapien
ggaatttgtttcctgcctatgaaat

SEQ ID NO: 321387 - DNA, 25 bp, Homo sapien
gggatcaaaaccacgattgtgtgcc

SEQ ID NO: 321388 - DNA, 25 bp, Homo sapien
caaaaccacgattgtgtgccccttt

SEQ ID NO: 321389 - DNA, 25 bp, Homo sapien
acttgtatatgccaaagttgttata

SEQ ID NO: 321390 - DNA, 25 bp, Homo sapien
agttgttatacttcatgatgtttct

SEQ ID NO: 321391 - DNA, 25 bp, Homo sapien
agctttttgcccctcaagacaggac

SEQ ID NO: 321392 - DNA, 25 bp, Homo sapien
ttgcccctcaagacaggactgctta

SEQ ID NO: 321393 - DNA, 25 bp, Homo sapien
gacaggactgcttatagctgactat

SEQ ID NO: 321394 - DNA, 25 bp, Homo sapien
atagctgactatttgggcatccttc

SEQ ID NO: 321395 - DNA, 25 bp, Homo sapien
gactatttgggcatccttcatgcaa

SEQ ID NO: 321396 - DNA, 25 bp, Homo sapien
tttgggcatccttcatgcaatggat

SEQ ID NO: 321397 - DNA, 25 bp, Homo sapien
atccttcatgcaatggatggctttg

SEQ ID NO: 321398 - DNA, 25 bp, Homo sapien
aagctgtcatatggtttcctcacaa

SEQ ID NO: 321399 - DNA, 25 bp, Homo sapien
agtttgccgttttactttcatccat

SEQ ID NO: 321400 - DNA, 25 bp, Homo sapien
ggaaattgtgcctcttgcagcctag

SEQ ID NO: 321401 - DNA, 25 bp, Homo sapien
tgcagcctaggcaaaggacatttag

SEQ ID NO: 321402 - DNA, 25 bp, Homo sapien
ttagtactatcgattctttccaccc

SEQ ID NO: 321403 - DNA, 25 bp, Homo sapien
tttccaccctcacgatgacttgcgg

SEQ ID NO: 321404 - DNA, 25 bp, Homo sapien
gacttgcggttctctctgtagaaaa

SEQ ID NO: 321405 - DNA, 25 bp, Homo sapien
aaaagccatttaaagccagcactag

SEQ ID NO: 321406 - DNA, 25 bp, Homo sapien
agccagcactagagggagtcagttc

SEQ ID NO: 321407 - DNA, 25 bp, Homo sapien
gagtcagttcagttccgtaaaggta

SEQ ID NO: 321408 - DNA, 25 bp, Homo sapien
gtaaaggtatgctcagatgccgcat

SEQ ID NO: 321409 - DNA, 25 bp, Homo sapien
tatttttcattatggaatctttcat

SEQ ID NO: 321410 - DNA, 25 bp, Homo sapien
ggaatctttcattatggatacatta

SEQ ID NO: 321411 - DNA, 25 bp, Homo sapien
gtcttatctttacagtgacatttga

SEQ ID NO: 321412 - DNA, 25 bp, Homo sapien
caaatatacccaactgctgagaatt

SEQ ID NO: 321413 - DNA, 25 bp, Homo sapien
tatacccaactgctgagaatttttt

SEQ ID NO: 321414 - DNA, 25 bp, Homo sapien
tattggccttggtaaataagatttt

SEQ ID NO: 321415 - DNA, 25 bp, Homo sapien
attagtagccaaattagccaagtga

SEQ ID NO: 321416 - DNA, 25 bp, Homo sapien
agtgctattaacttctgatgtgaac

SEQ ID NO: 321417 - DNA, 25 bp, Homo sapien
tctgatgtgaactatagcttttgac

SEQ ID NO: 321418 - DNA, 25 bp, Homo sapien
atagcttttgacaaagagtcttgat

SEQ ID NO: 321419 - DNA, 25 bp, Homo sapien
aagagtcttgatacataatctattt

SEQ ID NO: 321420 - DNA, 25 bp, Homo sapien
tagagttttacatattggcaggttg

SEQ ID NO: 321421 - DNA, 25 bp, Homo sapien
aacagtgtttgctaggacggcccag

SEQ ID NO: 321422 - DNA, 25 bp, Homo sapien
gctcatcactgcagttttattagag

SEQ ID NO: 321423 - DNA, 25 bp, Homo sapien
ttagagtgcttctttatctttaatg

SEQ ID NO: 321424 - DNA, 25 bp, Homo sapien
ctttgaggcctgtaacatcctagat

SEQ ID NO: 321425 - DNA, 25 bp, Homo sapien
gtaacatcctagatagttgccatca

SEQ ID NO: 321426 - DNA, 25 bp, Homo sapien
gttgccatcaaacaaggaccgtctc

SEQ ID NO: 321427 - DNA, 25 bp, Homo sapien
ggaccgtctcgcattgaaaacagat

SEQ ID NO: 321428 - DNA, 25 bp, Homo sapien
taagaatttctctttcaggcccaga

SEQ ID NO: 321429 - DNA, 25 bp, Homo sapien
caggcccagaatctgacagtgcttt

SEQ ID NO: 321430 - DNA, 25 bp, Homo sapien
cagtgctttggcttgggtcatgagc

SEQ ID NO: 321431 - DNA, 25 bp, Homo sapien
gatgacaaaggagtgatgcagctaa

SEQ ID NO: 321432 - DNA, 25 bp, Homo sapien
gcagctaagggcatccttggagtgt

SEQ ID NO: 321433 - DNA, 25 bp, Homo sapien
ggcatccttggagtgtcataaaaaa

SEQ ID NO: 321434 - DNA, 25 bp, Homo sapien
gaggttgaatgattagctgcgcagt

SEQ ID NO: 321435 - DNA, 25 bp, Homo sapien
ttagctgcgcagttagagtgataaa

SEQ ID NO: 321436 - DNA, 25 bp, Homo sapien
aggtaggccttctgattcaccatga

SEQ ID NO: 321437 - DNA, 25 bp, Homo sapien
gccttctgattcaccatgaccaagt

SEQ ID NO: 321438 - DNA, 25 bp, Homo sapien
gattcaccatgaccaagtcaggatt

SEQ ID NO: 321439 - DNA, 25 bp, Homo sapien
gaccaagtcaggatttcttaatatt

SEQ ID NO: 321440 - DNA, 25 bp, Homo sapien
taatatttcttttctggcagcatat

SEQ ID NO: 321441 - DNA, 25 bp, Homo sapien
tttctggcagcatatacaaaggcaa

SEQ ID NO: 321442 - DNA, 25 bp, Homo sapien
ctggtgttttgttagagaaacctgc

SEQ ID NO: 321443 - DNA, 25 bp, Homo sapien
tttctttggtgaagcttggctcagt

SEQ ID NO: 321444 - DNA, 25 bp, Homo sapien
tgaagcttggctcagttttcccagt

SEQ ID NO: 321445 - DNA, 25 bp, Homo sapien
tttctggagggcttgactctcgctc

SEQ ID NO: 321446 - DNA, 25 bp, Homo sapien
gcttgactctcgctcatcattagag

SEQ ID NO: 321447 - DNA, 25 bp, Homo sapien
ctcgctcatcattagagtcgctaaa

SEQ ID NO: 321448 - DNA, 25 bp, Homo sapien
catggtggtgcaccgagaagccaca

SEQ ID NO: 321449 - DNA, 25 bp, Homo sapien
gcaccgagaagccacaggacattta

SEQ ID NO: 321450 - DNA, 25 bp, Homo sapien
ggacatttacctgaaagcctgaacg

SEQ ID NO: 321451 - DNA, 25 bp, Homo sapien
aagcctgaacgatgacagtgccgaa

SEQ ID NO: 321452 - DNA, 25 bp, Homo sapien
gaacgatgacagtgccgaagaggat

SEQ ID NO: 321453 - DNA, 25 bp, Homo sapien
agaaggtaagcaagcctgttagact

SEQ ID NO: 321454 - DNA, 25 bp, Homo sapien
aagcctgttagactgggcaacttgg

SEQ ID NO: 321455 - DNA, 25 bp, Homo sapien
ggcaacttggacttgactttgctcc

SEQ ID NO: 321456 - DNA, 25 bp, Homo sapien
gactttgctccttcaacaatctaga

SEQ ID NO: 321457 - DNA, 25 bp, Homo sapien
gccagttggatgatatttctgcaca

SEQ ID NO: 321458 - DNA, 25 bp, Homo sapien
tctgcacaaaggtggttggttttac

SEQ ID NO: 321459 - DNA, 25 bp, Homo sapien
gttggttttacaggttgctcagtct

SEQ ID NO: 321460 - DNA, 25 bp, Homo sapien
ggttgctcagtctaagctgcttcta

SEQ ID NO: 321461 - DNA, 25 bp, Homo sapien
aagctgcttctagtcaaataacaaa

SEQ ID NO: 321462 - DNA, 25 bp, Homo sapien
agtcatggtcatctggaggtcaaat

SEQ ID NO: 321463 - DNA, 25 bp, Homo sapien
attcagatggcagactcaattcaga

SEQ ID NO: 321464 - DNA, 25 bp, Homo sapien
ttccaagtctctcatgtgcaagctt

SEQ ID NO: 321465 - DNA, 25 bp, Homo sapien
ggatgcactcttgccattttatgta

SEQ ID NO: 321466 - DNA, 25 bp, Homo sapien
ttatgtactggaagatcattggtca

SEQ ID NO: 321467 - DNA, 25 bp, Homo sapien
agatgaatactgtgtctgacaaaaa

SEQ ID NO: 321468 - DNA, 25 bp, Homo sapien
aaactgtataaactgaggaacctca

SEQ ID NO: 321469 - DNA, 25 bp, Homo sapien
gaggaacctcagctaatcagtatta

SEQ ID NO: 321470 - DNA, 25 bp, Homo sapien
ttactttgtagatcaccatgcccac

SEQ ID NO: 321471 - DNA, 25 bp, Homo sapien
atgcccaccacatttcaaactcaaa

SEQ ID NO: 321472 - DNA, 25 bp, Homo sapien
tgtttgagtttgtttgcagttccct

SEQ ID NO: 321473 - DNA, 25 bp, Homo sapien
tgcagttccctcagcttgctggtaa

SEQ ID NO: 321474 - DNA, 25 bp, Homo sapien
ctcagcttgctggtaattgtggtgt

SEQ ID NO: 321475 - DNA, 25 bp, Homo sapien
tagactattttagagcacgacaatg

SEQ ID NO: 321476 - DNA, 25 bp, Homo sapien
agcacgacaatgctcgttcccagag

SEQ ID NO: 321477 - DNA, 25 bp, Homo sapien
gctcgttcccagagtactcagttat

SEQ ID NO: 321478 - DNA, 25 bp, Homo sapien
actcaatatgtgtcttccaaagctg

SEQ ID NO: 321479 - DNA, 25 bp, Homo sapien
tacgcaagagttcaataccaacttt

SEQ ID NO: 321480 - DNA, 25 bp, Homo sapien
aacttttaacatcaggtcactctat

SEQ ID NO: 321481 - DNA, 25 bp, Homo sapien
aggtcactctattaagccatcaaag

SEQ ID NO: 321482 - DNA, 25 bp, Homo sapien
aaagtgtagctgaactacctagcaa

SEQ ID NO: 321483 - DNA, 25 bp, Homo sapien
gcatcttaatcaagctcagctgctg

SEQ ID NO: 321484 - DNA, 25 bp, Homo sapien
agctgctgactgatgtgagaaatcc

SEQ ID NO: 321485 - DNA, 25 bp, Homo sapien
gtgagaaatccattctagactattt

SEQ ID NO: 321486 - DNA, 25 bp, Homo sapien
tgctctccaagttgtgttctgggct

SEQ ID NO: 321487 - DNA, 25 bp, Homo sapien
atccacacccctcacggtgaggaag

SEQ ID NO: 321488 - DNA, 25 bp, Homo sapien
ggaaggagtgccttcttctaattca

SEQ ID NO: 321489 - DNA, 25 bp, Homo sapien
ctaattcataccaaggacctttatg

SEQ ID NO: 321490 - DNA, 25 bp, Homo sapien
ggacctttatggactagcaatgccc

SEQ ID NO: 321491 - DNA, 25 bp, Homo sapien
ttctgtgatcacctgctcacctgtg

SEQ ID NO: 321492 - DNA, 25 bp, Homo sapien
acctgtgccagcttgggcagaggca

SEQ ID NO: 321493 - DNA, 25 bp, Homo sapien
cagtgcactgttccttgagcccctt

SEQ ID NO: 321494 - DNA, 25 bp, Homo sapien
aactcctccaggatctctagacgga

SEQ ID NO: 321495 - DNA, 25 bp, Homo sapien
aggatctctagacggaccctcaggg

SEQ ID NO: 321496 - DNA, 25 bp, Homo sapien
agggcctgtacctctgaagcaagga

SEQ ID NO: 321497 - DNA, 25 bp, Homo sapien
ggtctatgtttcattcatctgcttt

SEQ ID NO: 321498 - DNA, 25 bp, Homo sapien
atgtttcattcatctgctttcaggc

SEQ ID NO: 321499 - DNA, 25 bp, Homo sapien
acatcacactgtttttgttagctgt

SEQ ID NO: 321500 - DNA, 25 bp, Homo sapien
atcacactgtttttgttagctgtgt

SEQ ID NO: 321501 - DNA, 25 bp, Homo sapien
ttcattcatctgctttcaggctgga

SEQ ID NO: 321502 - DNA, 25 bp, Homo sapien
tgtgtgtttcctgtgtatccaaaag

SEQ ID NO: 321503 - DNA, 25 bp, Homo sapien
gtgtttcctgtgtatccaaaagaca

SEQ ID NO: 321504 - DNA, 25 bp, Homo sapien
cattcatctgctttcaggctggatt

SEQ ID NO: 321505 - DNA, 25 bp, Homo sapien
ttcaggctggatttataacaagcag

SEQ ID NO: 321506 - DNA, 25 bp, Homo sapien
gcagaacttttaaaacggtatgatt

SEQ ID NO: 321507 - DNA, 25 bp, Homo sapien
attaaacacgctgagatctttccat

SEQ ID NO: 321508 - DNA, 25 bp, Homo sapien
ttccgtatcaataaaaccagtgctg

SEQ ID NO: 321509 - DNA, 25 bp, Homo sapien
ggcatgtacaggttactattggaac

SEQ ID NO: 321510 - DNA, 25 bp, Homo sapien
aagggccacttagtaccaaatgtag

SEQ ID NO: 321511 - DNA, 25 bp, Homo sapien
ggagctacttcaaaagatggcactt

SEQ ID NO: 321512 - DNA, 25 bp, Homo sapien
acttgagcagtactatggtgagcag

SEQ ID NO: 321513 - DNA, 25 bp, Homo sapien
actatggtgagcagggactggtcaa

SEQ ID NO: 321514 - DNA, 25 bp, Homo sapien
gggactggtcaaggaatgattctga

SEQ ID NO: 321515 - DNA, 25 bp, Homo sapien
atggttcagatcagaggaggcagca

SEQ ID NO: 321516 - DNA, 25 bp, Homo sapien
gaatggtagaggtaacgttcctagt

SEQ ID NO: 321517 - DNA, 25 bp, Homo sapien
taacgttcctagtaggtattgggat

SEQ ID NO: 321518 - DNA, 25 bp, Homo sapien
gttcttgtaagtagatacttccgta

SEQ ID NO: 321519 - DNA, 25 bp, Homo sapien
gtctccacacacgtgaccaaatggt

SEQ ID NO: 321520 - DNA, 25 bp, Homo sapien
gaaagcacccaaaacaccagcagtg

SEQ ID NO: 321521 - DNA, 25 bp, Homo sapien
cagtgcttccgaacttcttttgagt

SEQ ID NO: 321522 - DNA, 25 bp, Homo sapien
ttgagttcctgatttgattaagcac

SEQ ID NO: 321523 - DNA, 25 bp, Homo sapien
attaagcaccaggaactgtctctcc

SEQ ID NO: 321524 - DNA, 25 bp, Homo sapien
tctccccagacaaacaggcagtcat

SEQ ID NO: 321525 - DNA, 25 bp, Homo sapien
cataagtatatgtgcgtgtgcttgt

SEQ ID NO: 321526 - DNA, 25 bp, Homo sapien
gtgtgcgcctctgcatacatgtgag

SEQ ID NO: 321527 - DNA, 25 bp, Homo sapien
tacatgtgagacatctgggttcgaa

SEQ ID NO: 321528 - DNA, 25 bp, Homo sapien
atctgggttcgaaggtcgcctggaa

SEQ ID NO: 321529 - DNA, 25 bp, Homo sapien
ggttaaagatctgcctgcgagctcc

SEQ ID NO: 321530 - DNA, 25 bp, Homo sapien
tgcacatagtttgttgccccgaatg

SEQ ID NO: 321531 - DNA, 25 bp, Homo sapien
tcatgtatttacagtccggagcaca

SEQ ID NO: 321532 - DNA, 25 bp, Homo sapien
gtccggagcacaagattctcttctt

SEQ ID NO: 321533 - DNA, 25 bp, Homo sapien
gtaattcgctttactttacaacact

SEQ ID NO: 321534 - DNA, 25 bp, Homo sapien
ttacaacactaaatctgggctttga

SEQ ID NO: 321535 - DNA, 25 bp, Homo sapien
gaatttccagtgcattggactgatt

SEQ ID NO: 321536 - DNA, 25 bp, Homo sapien
ggagttagaggctgttccaaccatc

SEQ ID NO: 321537 - DNA, 25 bp, Homo sapien
gttccaaccatccttagtttgggag

SEQ ID NO: 321538 - DNA, 25 bp, Homo sapien
agtttgggagagtggctccttctgc

SEQ ID NO: 321539 - DNA, 25 bp, Homo sapien
cttgttttctaagcgtacagtcaac

SEQ ID NO: 321540 - DNA, 25 bp, Homo sapien
cagtcaacgggtgccatttgtggta

SEQ ID NO: 321541 - DNA, 25 bp, Homo sapien
cccagggaggcataggtgtccttca

SEQ ID NO: 321542 - DNA, 25 bp, Homo sapien
ataggtgtccttcaggtcctccttg

SEQ ID NO: 321543 - DNA, 25 bp, Homo sapien
aggtcctccttgtcaatgaagccat

SEQ ID NO: 321544 - DNA, 25 bp, Homo sapien
cttgtcaatgaagccatctcggttc

SEQ ID NO: 321545 - DNA, 25 bp, Homo sapien
agccatctcggttctgatccatgag

SEQ ID NO: 321546 - DNA, 25 bp, Homo sapien
gatccatgagtgtgaatgcctcctt

SEQ ID NO: 321547 - DNA, 25 bp, Homo sapien
gtgtgaatgcctccttgaactcctg

SEQ ID NO: 321548 - DNA, 25 bp, Homo sapien
aactcctggatctgagtctgctcaa

SEQ ID NO: 321549 - DNA, 25 bp, Homo sapien
gacattggatgaggctctctgggcc

SEQ ID NO: 321550 - DNA, 25 bp, Homo sapien
ttctgcctgctttgatgcgtctgcc

SEQ ID NO: 321551 - DNA, 25 bp, Homo sapien
aggtcttgcccatcttaagctcctg

SEQ ID NO: 321552 - DNA, 25 bp, Homo sapien
ctcccaactactacccaaaatgtga

SEQ ID NO: 321553 - DNA, 25 bp, Homo sapien
tgtgatttagtctatcctgcccaag

SEQ ID NO: 321554 - DNA, 25 bp, Homo sapien
tcttctcactggaaggcccaagtaa

SEQ ID NO: 321555 - DNA, 25 bp, Homo sapien
aaggcccaagtaatttccatagatg

SEQ ID NO: 321556 - DNA, 25 bp, Homo sapien
atttccatagatgttctctctgcct

SEQ ID NO: 321557 - DNA, 25 bp, Homo sapien
tcacctgcagcatactgaggaccta

SEQ ID NO: 321558 - DNA, 25 bp, Homo sapien
gacctaaatcctcaacggacaacca

SEQ ID NO: 321559 - DNA, 25 bp, Homo sapien
ggctaaaaatcagcaaccctaatag

SEQ ID NO: 321560 - DNA, 25 bp, Homo sapien
aacatcaatcttcttttgtcccagc

SEQ ID NO: 321561 - DNA, 25 bp, Homo sapien
ttgtcccagcaacagaaccatagcc

SEQ ID NO: 321562 - DNA, 25 bp, Homo sapien
gaaccatagccattaactaacccaa

SEQ ID NO: 321563 - DNA, 25 bp, Homo sapien
cctctcaagagaatacaggtttaga

SEQ ID NO: 321564 - DNA, 25 bp, Homo sapien
gaattaatctaggacttggcagaat

SEQ ID NO: 321565 - DNA, 25 bp, Homo sapien
aatctaggacttggcagaattctaa

SEQ ID NO: 321566 - DNA, 25 bp, Homo sapien
taaatcaatttctagagccagacat

SEQ ID NO: 321567 - DNA, 25 bp, Homo sapien
tagagccagacataaaccagatgaa

SEQ ID NO: 321568 - DNA, 25 bp, Homo sapien
taacttctatattcttatctactat

SEQ ID NO: 321569 - DNA, 25 bp, Homo sapien
gtttatctaatatttcctgccagaa

SEQ ID NO: 321570 - DNA, 25 bp, Homo sapien
ctaatatttcctgccagaatttatt

SEQ ID NO: 321571 - DNA, 25 bp, Homo sapien
ttattttttgtcatagcttcttgca

SEQ ID NO: 321572 - DNA, 25 bp, Homo sapien
ttgtcatagcttcttgcatgtatgc

SEQ ID NO: 321573 - DNA, 25 bp, Homo sapien
tgcatgtatgcaggccaggaaatga

SEQ ID NO: 321574 - DNA, 25 bp, Homo sapien
gggcatggcatcgaacagcatcttc

SEQ ID NO: 321575 - DNA, 25 bp, Homo sapien
ggcatggcatcgaacagcatcttcg

SEQ ID NO: 321576 - DNA, 25 bp, Homo sapien
gcatggcatcgaacagcatcttcga

SEQ ID NO: 321577 - DNA, 25 bp, Homo sapien
atggcatcgaacagcatcttcgact

SEQ ID NO: 321578 - DNA, 25 bp, Homo sapien
tggcatcgaacagcatcttcgactc

SEQ ID NO: 321579 - DNA, 25 bp, Homo sapien
ggcatcgaacagcatcttcgactcc

SEQ ID NO: 321580 - DNA, 25 bp, Homo sapien
gcatcgaacagcatcttcgactcct

SEQ ID NO: 321581 - DNA, 25 bp, Homo sapien
ggccctgcgcgggagctggttggct

SEQ ID NO: 321582 - DNA, 25 bp, Homo sapien
gctggttggctcctggtgctcccca

SEQ ID NO: 321583 - DNA, 25 bp, Homo sapien
gccctcgtacccaccagagcctggg

SEQ ID NO: 321584 - DNA, 25 bp, Homo sapien
gagcctgggctctgtcaaggagcgg

SEQ ID NO: 321585 - DNA, 25 bp, Homo sapien
ttgtgcaacttcaaacatattgggt

SEQ ID NO: 321586 - DNA, 25 bp, Homo sapien
acatattgggtgcttctgaattcct

SEQ ID NO: 321587 - DNA, 25 bp, Homo sapien
ggtgcttctgaattcctgatgattg

SEQ ID NO: 321588 - DNA, 25 bp, Homo sapien
cctgatgattggatttaagctattg

SEQ ID NO: 321589 - DNA, 25 bp, Homo sapien
ggttaatgcctataatctgttgctt

SEQ ID NO: 321590 - DNA, 25 bp, Homo sapien
gttgctttttctcaatatgtgtcct

SEQ ID NO: 321591 - DNA, 25 bp, Homo sapien
atgtgtcctattggaaattcctcaa

SEQ ID NO: 321592 - DNA, 25 bp, Homo sapien
attcctcaaatcgttggtgccatca

SEQ ID NO: 321593 - DNA, 25 bp, Homo sapien
caaatcgttggtgccatcagtgatt

SEQ ID NO: 321594 - DNA, 25 bp, Homo sapien
gatattgcagatgacttgcttactg

SEQ ID NO: 321595 - DNA, 25 bp, Homo sapien
gatgacttgcttactgtatttgcat

SEQ ID NO: 321596 - DNA, 25 bp, Homo sapien
gttctgtcctagacattttgcacta

SEQ ID NO: 321597 - DNA, 25 bp, Homo sapien
taaagtagccgaatccactctcatg

SEQ ID NO: 321598 - DNA, 25 bp, Homo sapien
tccactctcatgtcttttcgttaat

SEQ ID NO: 321599 - DNA, 25 bp, Homo sapien
tgtcttttcgttaatgtgctctgta

SEQ ID NO: 321600 - DNA, 25 bp, Homo sapien
gtaccactggtgagtgctccatagt

SEQ ID NO: 321601 - DNA, 25 bp, Homo sapien
acctgctgctacagaatgttatttt

SEQ ID NO: 321602 - DNA, 25 bp, Homo sapien
tttacatccctatggctattgccaa

SEQ ID NO: 321603 - DNA, 25 bp, Homo sapien
aacactaaccttttgactgctaatg

SEQ ID NO: 321604 - DNA, 25 bp, Homo sapien
tgactgctaatgtatgtttctgctt

SEQ ID NO: 321605 - DNA, 25 bp, Homo sapien
tgtttctgcttgctgtgccttgtta

SEQ ID NO: 321606 - DNA, 25 bp, Homo sapien
tgtgccttgttatggctgctttttt

SEQ ID NO: 321607 - DNA, 25 bp, Homo sapien
gaacatgataagacttccatttgct

SEQ ID NO: 321608 - DNA, 25 bp, Homo sapien
tgataagacttccatttgctgaact

SEQ ID NO: 321609 - DNA, 25 bp, Homo sapien
tcaggttttcctcagtcaagtatta

SEQ ID NO: 321610 - DNA, 25 bp, Homo sapien
gttttcctcagtcaagtattagttt

SEQ ID NO: 321611 - DNA, 25 bp, Homo sapien
aggttgttatcttatattttctgaa

SEQ ID NO: 321612 - DNA, 25 bp, Homo sapien
gttatcttatattttctgaatctga

SEQ ID NO: 321613 - DNA, 25 bp, Homo sapien
ctgaaaaaactattgctaagctatc

SEQ ID NO: 321614 - DNA, 25 bp, Homo sapien
ctaagctatcttgttggtttcgttt

SEQ ID NO: 321615 - DNA, 25 bp, Homo sapien
gctatcttgttggtttcgttttgaa

SEQ ID NO: 321616 - DNA, 25 bp, Homo sapien
tcttgttggtttcgttttgaataat

SEQ ID NO: 321617 - DNA, 25 bp, Homo sapien
tgaataatagattcttgtgttttcg

SEQ ID NO: 321618 - DNA, 25 bp, Homo sapien
gggcatggcatcgaacagcatcttc

SEQ ID NO: 321619 - DNA, 25 bp, Homo sapien
ggcatggcatcgaacagcatcttcg

SEQ ID NO: 321620 - DNA, 25 bp, Homo sapien
gcatggcatcgaacagcatcttcga

SEQ ID NO: 321621 - DNA, 25 bp, Homo sapien
catggcatcgaacagcatcttcgac

SEQ ID NO: 321622 - DNA, 25 bp, Homo sapien
atggcatcgaacagcatcttcgact

SEQ ID NO: 321623 - DNA, 25 bp, Homo sapien
tggcatcgaacagcatcttcgactc

SEQ ID NO: 321624 - DNA, 25 bp, Homo sapien
ggcatcgaacagcatcttcgactcc

SEQ ID NO: 321625 - DNA, 25 bp, Homo sapien
gcatcgaacagcatcttcgactcct

SEQ ID NO: 321626 - DNA, 25 bp, Homo sapien
aagactcaatcagtagggtaactaa

SEQ ID NO: 321627 - DNA, 25 bp, Homo sapien
ctgtgtcagcaattgcttttggttt

SEQ ID NO: 321628 - DNA, 25 bp, Homo sapien
aactttgtagtactctagctttgga

SEQ ID NO: 321629 - DNA, 25 bp, Homo sapien
tagtactctagctttggaaatctga

SEQ ID NO: 321630 - DNA, 25 bp, Homo sapien
ggaaatctgagaggcctatatagtt

SEQ ID NO: 321631 - DNA, 25 bp, Homo sapien
aggcctatatagttcatttgagtgt

SEQ ID NO: 321632 - DNA, 25 bp, Homo sapien
tcttattgagattacagcctgtgca

SEQ ID NO: 321633 - DNA, 25 bp, Homo sapien
agcctgtgcaaaatatttgtgatgc

SEQ ID NO: 321634 - DNA, 25 bp, Homo sapien
gtgatgcatttttaagtttacttaa

SEQ ID NO: 321635 - DNA, 25 bp, Homo sapien
taggttgctactacatggatgtgac

SEQ ID NO: 321636 - DNA, 25 bp, Homo sapien
tgggcatgatgtaaaagactcaatc

SEQ ID NO: 321637 - DNA, 25 bp, Homo sapien
tcctgggtagtctgtgcttgtaatc

SEQ ID NO: 321638 - DNA, 25 bp, Homo sapien
gcttgtaatccagcatgtttcacag

SEQ ID NO: 321639 - DNA, 25 bp, Homo sapien
gcatgtttcacagagtaagcctgtt

SEQ ID NO: 321640 - DNA, 25 bp, Homo sapien
aagcctgttgtgactttgcttttgg

SEQ ID NO: 321641 - DNA, 25 bp, Homo sapien
gggtctatgtcattggtttctgatg

SEQ ID NO: 321642 - DNA, 25 bp, Homo sapien
gtttctgatgcttgtacaaacacgc

SEQ ID NO: 321643 - DNA, 25 bp, Homo sapien
aatggataaaacagcacctctggct

SEQ ID NO: 321644 - DNA, 25 bp, Homo sapien
cacctctggctgttacattaccata

SEQ ID NO: 321645 - DNA, 25 bp, Homo sapien
aaaccatatcacatgcctacatttt

SEQ ID NO: 321646 - DNA, 25 bp, Homo sapien
tctcttagttcttctctaacatagt

SEQ ID NO: 321647 - DNA, 25 bp, Homo sapien
aacatagtactttctttccagcaaa

SEQ ID NO: 321648 - DNA, 25 bp, Homo sapien
tgaactttacgtattttacctactg

SEQ ID NO: 321649 - DNA, 25 bp, Homo sapien
taaactcaaaaggtccgcacttgga

SEQ ID NO: 321650 - DNA, 25 bp, Homo sapien
gcacttggagttcgttgtctcatta

SEQ ID NO: 321651 - DNA, 25 bp, Homo sapien
gttgtctcattaggcagtgcactga

SEQ ID NO: 321652 - DNA, 25 bp, Homo sapien
gtgcactgaagtttagtggacacta

SEQ ID NO: 321653 - DNA, 25 bp, Homo sapien
gtggacactatatcctgagatttca

SEQ ID NO: 321654 - DNA, 25 bp, Homo sapien
ctgtcttcttctgtaattcctgtat

SEQ ID NO: 321655 - DNA, 25 bp, Homo sapien
tgagatttcacacagatgccaagaa

SEQ ID NO: 321656 - DNA, 25 bp, Homo sapien
gaaatggagcacacatttagtgcat

SEQ ID NO: 321657 - DNA, 25 bp, Homo sapien
ttttcctccatctaaattgcgaggg

SEQ ID NO: 321658 - DNA, 25 bp, Homo sapien
attgcgagggtactgtgaactttac

SEQ ID NO: 321659 - DNA, 25 bp, Homo sapien
ggggccaaattcttccacagatgtg

SEQ ID NO: 321660 - DNA, 25 bp, Homo sapien
ctgtagtgtgtgtaaccttttgcgt

SEQ ID NO: 321661 - DNA, 25 bp, Homo sapien
tgttcttttttgtcctgtgtggtat

SEQ ID NO: 321662 - DNA, 25 bp, Homo sapien
aaaattgtttctgccagtacataaa

SEQ ID NO: 321663 - DNA, 25 bp, Homo sapien
gtgtgtgtaaccttttgcgtgtgta

SEQ ID NO: 321664 - DNA, 25 bp, Homo sapien
catttccatatgtcagtagtgtgct

SEQ ID NO: 321665 - DNA, 25 bp, Homo sapien
ccttttgcgtgtgtaggttaagcac

SEQ ID NO: 321666 - DNA, 25 bp, Homo sapien
gtcagtagtgtgctgcttttaggct

SEQ ID NO: 321667 - DNA, 25 bp, Homo sapien
gtgtaggttaagcacaacccagaaa

SEQ ID NO: 321668 - DNA, 25 bp, Homo sapien
gataagtaggtagattgcaggagta

SEQ ID NO: 321669 - DNA, 25 bp, Homo sapien
tgcaggagtagaaaactggtggctc

SEQ ID NO: 321670 - DNA, 25 bp, Homo sapien
gagatctgaagtctcctttctggag

SEQ ID NO: 321671 - DNA, 25 bp, Homo sapien
gtctcctttctggagttacaaccca

SEQ ID NO: 321672 - DNA, 25 bp, Homo sapien
gttacaacccaaaggatgttagcat

SEQ ID NO: 321673 - DNA, 25 bp, Homo sapien
gttagcatttctcaggtcatcccac

SEQ ID NO: 321674 - DNA, 25 bp, Homo sapien
tttctcaggtcatcccactgcaaag

SEQ ID NO: 321675 - DNA, 25 bp, Homo sapien
tgtctgaccgcctcagggcttgcta

SEQ ID NO: 321676 - DNA, 25 bp, Homo sapien
gcctcagggcttgctacgagggact

SEQ ID NO: 321677 - DNA, 25 bp, Homo sapien
ggccaagctgactaggaacagctct

SEQ ID NO: 321678 - DNA, 25 bp, Homo sapien
gaacagctctcgtgctcctgaggga

SEQ ID NO: 321679 - DNA, 25 bp, Homo sapien
gtttcgtcagcctcctccaagactg

SEQ ID NO: 321680 - DNA, 25 bp, Homo sapien
tgcctacactttagacttcagaagg

SEQ ID NO: 321681 - DNA, 25 bp, Homo sapien
aaagctcctgtgaggttagcctact

SEQ ID NO: 321682 - DNA, 25 bp, Homo sapien
actactctctgaagacgggaccacg

SEQ ID NO: 321683 - DNA, 25 bp, Homo sapien
gggaccacgcccaaatccaagaaga

SEQ ID NO: 321684 - DNA, 25 bp, Homo sapien
aagaagactcaagctggcctttccc

SEQ ID NO: 321685 - DNA, 25 bp, Homo sapien
gaaacccagttcctcaaaggacagt

SEQ ID NO: 321686 - DNA, 25 bp, Homo sapien
tttctacccagacgttacctgtgat

SEQ ID NO: 321687 - DNA, 25 bp, Homo sapien
ttacctgtgatcaagtgctctgggc

SEQ ID NO: 321688 - DNA, 25 bp, Homo sapien
tgctctgggcagacttcaagacttt

SEQ ID NO: 321689 - DNA, 25 bp, Homo sapien
agacttcaagactttctgcttcctc

SEQ ID NO: 321690 - DNA, 25 bp, Homo sapien
ttcctccactttccagtcaatcagt

SEQ ID NO: 321691 - DNA, 25 bp, Homo sapien
tggctgtgagcccataactggcctc

SEQ ID NO: 321692 - DNA, 25 bp, Homo sapien
tacttgcccaggtatcgaaatcgat

SEQ ID NO: 321693 - DNA, 25 bp, Homo sapien
gattatgtacataacactgtgggta

SEQ ID NO: 321694 - DNA, 25 bp, Homo sapien
gtaggagacgggatattagctgtaa

SEQ ID NO: 321695 - DNA, 25 bp, Homo sapien
gtaaggtgttgctagttcatggaac

SEQ ID NO: 321696 - DNA, 25 bp, Homo sapien
ttcatggaactttctcctgccgttt

SEQ ID NO: 321697 - DNA, 25 bp, Homo sapien
gaactttctcctgccgtttgggtca

SEQ ID NO: 321698 - DNA, 25 bp, Homo sapien
gtttgggtcaccaactcctgtaaag

SEQ ID NO: 321699 - DNA, 25 bp, Homo sapien
gtcaccaactcctgtaaagccgagg

SEQ ID NO: 321700 - DNA, 25 bp, Homo sapien
ctgtaaagccgaggaagcagacaat

SEQ ID NO: 321701 - DNA, 25 bp, Homo sapien
agcagacaatgtgagacagggctga

SEQ ID NO: 321702 - DNA, 25 bp, Homo sapien
acagtgcctttcaccaaggtagcca

SEQ ID NO: 321703 - DNA, 25 bp, Homo sapien
ggaaacagggagttatatctttgac

SEQ ID NO: 321704 - DNA, 25 bp, Homo sapien
atatctttgactttacaggagtgga

SEQ ID NO: 321705 - DNA, 25 bp, Homo sapien
acattgtggcagcttttgaaatttc

SEQ ID NO: 321706 - DNA, 25 bp, Homo sapien
gaataaggcttgatgaagacaggct

SEQ ID NO: 321707 - DNA, 25 bp, Homo sapien
aatttctgaggctatgattacatac

SEQ ID NO: 321708 - DNA, 25 bp, Homo sapien
gattacatactcctcatactaaaga

SEQ ID NO: 321709 - DNA, 25 bp, Homo sapien
ttcttagtatagcatcctttttgtg

SEQ ID NO: 321710 - DNA, 25 bp, Homo sapien
gaagcacatattgtatctcttgtaa

SEQ ID NO: 321711 - DNA, 25 bp, Homo sapien
gacaggctgccaatattagagccga

SEQ ID NO: 321712 - DNA, 25 bp, Homo sapien
tattagagccgatgaatgttaacca

SEQ ID NO: 321713 - DNA, 25 bp, Homo sapien
aatgattccagttgccatggcagga

SEQ ID NO: 321714 - DNA, 25 bp, Homo sapien
gtgtttgatgggaagcctcagcaca

SEQ ID NO: 321715 - DNA, 25 bp, Homo sapien
gggaagcctcagcacacaaatgtct

SEQ ID NO: 321716 - DNA, 25 bp, Homo sapien
aaatgtctgcttctggtacattcct

SEQ ID NO: 321717 - DNA, 25 bp, Homo sapien
tggtacattcctccaagcttgcgta

SEQ ID NO: 321718 - DNA, 25 bp, Homo sapien
ccaagcttgcgtactctggaagaca

SEQ ID NO: 321719 - DNA, 25 bp, Homo sapien
gaatgagtcgcctctcgaaggtggc

SEQ ID NO: 321720 - DNA, 25 bp, Homo sapien
gagtatggaaccacaatggtcagct

SEQ ID NO: 321721 - DNA, 25 bp, Homo sapien
aatggtcagctaccaacccttggga

SEQ ID NO: 321722 - DNA, 25 bp, Homo sapien
gacaaggtcaatttcttccgcatgg

SEQ ID NO: 321723 - DNA, 25 bp, Homo sapien
atttcttccgcatggtcatctcaaa

SEQ ID NO: 321724 - DNA, 25 bp, Homo sapien
atggtcatctcaaacccagcggcaa

SEQ ID NO: 321725 - DNA, 25 bp, Homo sapien
agtgggaagctctcaagtctgttga

SEQ ID NO: 321726 - DNA, 25 bp, Homo sapien
gaagctctcaagtctgttgagacta

SEQ ID NO: 321727 - DNA, 25 bp, Homo sapien
gtctgtatggctaacatttccaatg

SEQ ID NO: 321728 - DNA, 25 bp, Homo sapien
tttccaatgatcactggccatcttt

SEQ ID NO: 321729 - DNA, 25 bp, Homo sapien
atcactggccatctttggttcaaga

SEQ ID NO: 321730 - DNA, 25 bp, Homo sapien
ctttggttcaagaggctacaactga

SEQ ID NO: 321731 - DNA, 25 bp, Homo sapien
ggctacaactgaggccttgaagctt

SEQ ID NO: 321732 - DNA, 25 bp, Homo sapien
actggctgttcttttacaagctttg

SEQ ID NO: 321733 - DNA, 25 bp, Homo sapien
aagctttgttacaattcaaacgcaa

SEQ ID NO: 321734 - DNA, 25 bp, Homo sapien
ggcaagagagacacggcgtcttttg

SEQ ID NO: 321735 - DNA, 25 bp, Homo sapien
agacacggcgtcttttggaaagagt

SEQ ID NO: 321736 - DNA, 25 bp, Homo sapien
caaaggtagcaaccagaacagattt

SEQ ID NO: 321737 - DNA, 25 bp, Homo sapien
gaaatgacagttttttgggtcatgg

SEQ ID NO: 321738 - DNA, 25 bp, Homo sapien
gggtcatggttaacaaagctactat

SEQ ID NO: 321739 - DNA, 25 bp, Homo sapien
gacagaaggtcttcaaggattccag

SEQ ID NO: 321740 - DNA, 25 bp, Homo sapien
acaaagctactataactgatttaaa

SEQ ID NO: 321741 - DNA, 25 bp, Homo sapien
aactaataacaatttgcctcagagg

SEQ ID NO: 321742 - DNA, 25 bp, Homo sapien
ttgcctcagaggatatgcttctaca

SEQ ID NO: 321743 - DNA, 25 bp, Homo sapien
gatatgcttctacaaactaaccaac

SEQ ID NO: 321744 - DNA, 25 bp, Homo sapien
gcttctacaaactaaccaactaatg

SEQ ID NO: 321745 - DNA, 25 bp, Homo sapien
actaatgagggttccttacttctga

SEQ ID NO: 321746 - DNA, 25 bp, Homo sapien
taaaaggctcctacattcctagaaa

SEQ ID NO: 321747 - DNA, 25 bp, Homo sapien
atagaatccctacccctgcatttgt

SEQ ID NO: 321748 - DNA, 25 bp, Homo sapien
gtctgcctctttggtcagtttcagg

SEQ ID NO: 321749 - DNA, 25 bp, Homo sapien
tttggtcagtttcaggtccctgtag

SEQ ID NO: 321750 - DNA, 25 bp, Homo sapien
aggtccctgtagttcacactgtgtc

SEQ ID NO: 321751 - DNA, 25 bp, Homo sapien
ctgtagttcacactgtgtccccagg

SEQ ID NO: 321752 - DNA, 25 bp, Homo sapien
ttcctccttgtgctgggttctgtct

SEQ ID NO: 321753 - DNA, 25 bp, Homo sapien
tgtgctgggttctgtctcattatca

SEQ ID NO: 321754 - DNA, 25 bp, Homo sapien
gggttctgtctcattatcacctcat

SEQ ID NO: 321755 - DNA, 25 bp, Homo sapien
ttatcacctcatcagggaagtctgt

SEQ ID NO: 321756 - DNA, 25 bp, Homo sapien
cctcatcagggaagtctgtacagat

SEQ ID NO: 321757 - DNA, 25 bp, Homo sapien
tgtacagatagaatccctacccctg

SEQ ID NO: 321758 - DNA, 25 bp, Homo sapien
ccttcatggcttattgactgaatga

SEQ ID NO: 321759 - DNA, 25 bp, Homo sapien
tatggaagggctcagttgctgtcct

SEQ ID NO: 321760 - DNA, 25 bp, Homo sapien
aagggctcagttgctgtcctcattg

SEQ ID NO: 321761 - DNA, 25 bp, Homo sapien
tgctgtcctcattgtgtatgccatt

SEQ ID NO: 321762 - DNA, 25 bp, Homo sapien
attgtgtatgccatttcctgtttcc

SEQ ID NO: 321763 - DNA, 25 bp, Homo sapien
tgtatgccatttcctgtttccatgc

SEQ ID NO: 321764 - DNA, 25 bp, Homo sapien
gagaataatcatgatcccacgtaaa

SEQ ID NO: 321765 - DNA, 25 bp, Homo sapien
taatcatgatcccacgtaaacgttc

SEQ ID NO: 321766 - DNA, 25 bp, Homo sapien
tgatcccacgtaaacgttctgtaaa

SEQ ID NO: 321767 - DNA, 25 bp, Homo sapien
atacggttacttgatctgttggtct

SEQ ID NO: 321768 - DNA, 25 bp, Homo sapien
ggtctgagtcccaatatatgagttt

SEQ ID NO: 321769 - DNA, 25 bp, Homo sapien
agtgcctcacacagggtaagccctc

SEQ ID NO: 321770 - DNA, 25 bp, Homo sapien
cagggtaagccctcaataatgtcct

SEQ ID NO: 321771 - DNA, 25 bp, Homo sapien
taatgtccttgttattgatcagtag

SEQ ID NO: 321772 - DNA, 25 bp, Homo sapien
tgatcagtagtagccaagatgtcac

SEQ ID NO: 321773 - DNA, 25 bp, Homo sapien
aagatgtcacagcttactccctgtg

SEQ ID NO: 321774 - DNA, 25 bp, Homo sapien
gtgatctcaaatcaggactcaatcc

SEQ ID NO: 321775 - DNA, 25 bp, Homo sapien
aatcctgagaatctggcaattgctt

SEQ ID NO: 321776 - DNA, 25 bp, Homo sapien
gcttaaattgtagccttcgtctgcc

SEQ ID NO: 321777 - DNA, 25 bp, Homo sapien
gtagccttcgtctgccccatgtaaa

SEQ ID NO: 321778 - DNA, 25 bp, Homo sapien
gtaaactgccttaagaagagccaaa

SEQ ID NO: 321779 - DNA, 25 bp, Homo sapien
gacacatggcaggaaggatcatttt

SEQ ID NO: 321780 - DNA, 25 bp, Homo sapien
ggaggatccacttgactggacagtg

SEQ ID NO: 321781 - DNA, 25 bp, Homo sapien
ggatccacttgactggacagtgtct

SEQ ID NO: 321782 - DNA, 25 bp, Homo sapien
tccacttgactggacagtgtctctg

SEQ ID NO: 321783 - DNA, 25 bp, Homo sapien
acttgactggacagtgtctctgctg

SEQ ID NO: 321784 - DNA, 25 bp, Homo sapien
cttgactggacagtgtctctgctgc

SEQ ID NO: 321785 - DNA, 25 bp, Homo sapien
tgatggccggcctgtgcaccttctt

SEQ ID NO: 321786 - DNA, 25 bp, Homo sapien
ggcctgtgcaccttcttcagctgca

SEQ ID NO: 321787 - DNA, 25 bp, Homo sapien
tgcatcctggcggtcttcttccaca

SEQ ID NO: 321788 - DNA, 25 bp, Homo sapien
ggcgcagactcagggccgggtgtgg

SEQ ID NO: 321789 - DNA, 25 bp, Homo sapien
cagcacggcgactccggagtgcacg

SEQ ID NO: 321790 - DNA, 25 bp, Homo sapien
ggcgactccggagtgcacggcgagg

SEQ ID NO: 321791 - DNA, 25 bp, Homo sapien
tgaaaagtaaacctccagcttccac

SEQ ID NO: 321792 - DNA, 25 bp, Homo sapien
agcttccacagtatattacctgccg

SEQ ID NO: 321793 - DNA, 25 bp, Homo sapien
ttacctgccgttgcatgcatttgaa

SEQ ID NO: 321794 - DNA, 25 bp, Homo sapien
aatgatgggagctttccgagagcgt

SEQ ID NO: 321795 - DNA, 25 bp, Homo sapien
ttccgagagcgttcagtgtttcact

SEQ ID NO: 321796 - DNA, 25 bp, Homo sapien
gtgtttcactgaagacaggacccat

SEQ ID NO: 321797 - DNA, 25 bp, Homo sapien
gtctcctctggcatatggacacatt

SEQ ID NO: 321798 - DNA, 25 bp, Homo sapien
atggacacatttcctggcatttgcc

SEQ ID NO: 321799 - DNA, 25 bp, Homo sapien
atttgcctgagtctacaccactttt

SEQ ID NO: 321800 - DNA, 25 bp, Homo sapien
tacaccactttttgagaacctgaaa

SEQ ID NO: 321801 - DNA, 25 bp, Homo sapien
tgtggcccacagtctccatattggc

SEQ ID NO: 321802 - DNA, 25 bp, Homo sapien
ttttaggagctttgagaggacattc

SEQ ID NO: 321803 - DNA, 25 bp, Homo sapien
ggagctttgagaggacattcccagt

SEQ ID NO: 321804 - DNA, 25 bp, Homo sapien
agctttgagaggacattcccagtca

SEQ ID NO: 321805 - DNA, 25 bp, Homo sapien
ttgagaggacattcccagtcagcaa

SEQ ID NO: 321806 - DNA, 25 bp, Homo sapien
gaggacattcccagtcagcaataaa

SEQ ID NO: 321807 - DNA, 25 bp, Homo sapien
ggacattcccagtcagcaataaaga

SEQ ID NO: 321808 - DNA, 25 bp, Homo sapien
aggtggtattgggtatattttcata

SEQ ID NO: 321809 - DNA, 25 bp, Homo sapien
tattgggtatattttcatactaggc

SEQ ID NO: 321810 - DNA, 25 bp, Homo sapien
gggtataatcaaaatagtccagcta

SEQ ID NO: 321811 - DNA, 25 bp, Homo sapien
tcaaaatagtccagctagagaaagg

SEQ ID NO: 321812 - DNA, 25 bp, Homo sapien
gagacagtcaagaattttaggagct

SEQ ID NO: 321813 - DNA, 25 bp, Homo sapien
gcaaaaggctaattaacctcctaag

SEQ ID NO: 321814 - DNA, 25 bp, Homo sapien
taacctcctaagtaaagagctacaa

SEQ ID NO: 321815 - DNA, 25 bp, Homo sapien
gaaagatcaataacctcatagacac

SEQ ID NO: 321816 - DNA, 25 bp, Homo sapien
aataacctcatagacacatgggcaa

SEQ ID NO: 321817 - DNA, 25 bp, Homo sapien
gcaaaggatgtgaacaggacaggaa

SEQ ID NO: 321818 - DNA, 25 bp, Homo sapien
acaggacaggaaatgtagctaatgc

SEQ ID NO: 321819 - DNA, 25 bp, Homo sapien
gtagctaatgcttatatcccataaa

SEQ ID NO: 321820 - DNA, 25 bp, Homo sapien
atctcctcctagtaagaaaaatgca

SEQ ID NO: 321821 - DNA, 25 bp, Homo sapien
gaaaaatgcaccttagggctgaact

SEQ ID NO: 321822 - DNA, 25 bp, Homo sapien
gcaccttagggctgaactcatctgc

SEQ ID NO: 321823 - DNA, 25 bp, Homo sapien
ttagggctgaactcatctgccattt

SEQ ID NO: 321824 - DNA, 25 bp, Homo sapien
atagtccagacagaggcggtattgc

SEQ ID NO: 321825 - DNA, 25 bp, Homo sapien
gacagaggcggtattgcccgaaaaa

SEQ ID NO: 321826 - DNA, 25 bp, Homo sapien
aaatccagccaatggtctcttcttg

SEQ ID NO: 321827 - DNA, 25 bp, Homo sapien
gtattgcccgaaaaacctagaatat

SEQ ID NO: 321828 - DNA, 25 bp, Homo sapien
atccagccaatggtctcttcttgta

SEQ ID NO: 321829 - DNA, 25 bp, Homo sapien
atattcaccatctgagcttttacgg

SEQ ID NO: 321830 - DNA, 25 bp, Homo sapien
caccatctgagcttttacgggaaaa

SEQ ID NO: 321831 - DNA, 25 bp, Homo sapien
aatttgctaatatctgttctcatgc

SEQ ID NO: 321832 - DNA, 25 bp, Homo sapien
atatctgttctcatgcattaaatac

SEQ ID NO: 321833 - DNA, 25 bp, Homo sapien
atattgtctgatggctactgtcacg

SEQ ID NO: 321834 - DNA, 25 bp, Homo sapien
tctgatggctactgtcacgccacag

SEQ ID NO: 321835 - DNA, 25 bp, Homo sapien
gaaatgattttctcagctcatctct

SEQ ID NO: 321836 - DNA, 25 bp, Homo sapien
atctctctgtattccctgttttgga

SEQ ID NO: 321837 - DNA, 25 bp, Homo sapien
gttttggatcacagggcaatctgtt

SEQ ID NO: 321838 - DNA, 25 bp, Homo sapien
taaaggcaccaagcaaatgtcatct

SEQ ID NO: 321839 - DNA, 25 bp, Homo sapien
tgaatacacacatcccaagctttac

SEQ ID NO: 321840 - DNA, 25 bp, Homo sapien
caagctttacaaatcctgcctggct

SEQ ID NO: 321841 - DNA, 25 bp, Homo sapien
atcctgcctggcttgacagtgatga

SEQ ID NO: 321842 - DNA, 25 bp, Homo sapien
gatgaggccacttaacagtccagcg

SEQ ID NO: 321843 - DNA, 25 bp, Homo sapien
tccatccccacccaatgaaatatga

SEQ ID NO: 321844 - DNA, 25 bp, Homo sapien
aacagtccagcgcaggcggatgtta

SEQ ID NO: 321845 - DNA, 25 bp, Homo sapien
tatgatccagagagtcttgcaaaga

SEQ ID NO: 321846 - DNA, 25 bp, Homo sapien
gtcacagccccatcaaaagggagtt

SEQ ID NO: 321847 - DNA, 25 bp, Homo sapien
gagccaatcagcaagtggcgcgtcc

SEQ ID NO: 321848 - DNA, 25 bp, Homo sapien
acgccgtctgtcaaatgcatctggg

SEQ ID NO: 321849 - DNA, 25 bp, Homo sapien
gggttagctgtactcatacatcttg

SEQ ID NO: 321850 - DNA, 25 bp, Homo sapien
tacatcttgtgggtgactaggtgac

SEQ ID NO: 321851 - DNA, 25 bp, Homo sapien
gactaggtgacttccgtgttcaaga

SEQ ID NO: 321852 - DNA, 25 bp, Homo sapien
agacacaagcgagctaagcctggga

SEQ ID NO: 321853 - DNA, 25 bp, Homo sapien
aagcctgggatttcagtttgcacag

SEQ ID NO: 321854 - DNA, 25 bp, Homo sapien
ttcagtttgcacagcgctttgttaa

SEQ ID NO: 321855 - DNA, 25 bp, Homo sapien
gtgagtactcgaatcaacctcggac

SEQ ID NO: 321856 - DNA, 25 bp, Homo sapien
aacctcggactctccgggcgtgagg

SEQ ID NO: 321857 - DNA, 25 bp, Homo sapien
tgtctttttagggctttactgaaag

SEQ ID NO: 321858 - DNA, 25 bp, Homo sapien
tactgaaagtaaaatatcctgacat

SEQ ID NO: 321859 - DNA, 25 bp, Homo sapien
aaatatcctgacatttaaactgaca

SEQ ID NO: 321860 - DNA, 25 bp, Homo sapien
taaactgacagatgtaggaggtaaa

SEQ ID NO: 321861 - DNA, 25 bp, Homo sapien
tttgaatttatgtgacagctgaagt

SEQ ID NO: 321862 - DNA, 25 bp, Homo sapien
acagctgaagtcacgagatgaggga

SEQ ID NO: 321863 - DNA, 25 bp, Homo sapien
gtcacgagatgagggatgtatgtcc

SEQ ID NO: 321864 - DNA, 25 bp, Homo sapien
atgagggatgtatgtcccccaggga

SEQ ID NO: 321865 - DNA, 25 bp, Homo sapien
aaagggtactggaaacagcatgtca

SEQ ID NO: 321866 - DNA, 25 bp, Homo sapien
aaacagcatgtcagtggtgccagct

SEQ ID NO: 321867 - DNA, 25 bp, Homo sapien
cagcatgtcagtggtgccagctgag

SEQ ID NO: 321868 - DNA, 25 bp, Homo sapien
agaactggagcttagagccccacta

SEQ ID NO: 321869 - DNA, 25 bp, Homo sapien
ccactattctctaagccaggttcta

SEQ ID NO: 321870 - DNA, 25 bp, Homo sapien
aggttctagtgccttacactccaga

SEQ ID NO: 321871 - DNA, 25 bp, Homo sapien
agtgccttacactccagaatgtcag

SEQ ID NO: 321872 - DNA, 25 bp, Homo sapien
gaaaagttcatctcggtgtgtgggt

SEQ ID NO: 321873 - DNA, 25 bp, Homo sapien
tcatctcggtgtgtgggttcccatc

SEQ ID NO: 321874 - DNA, 25 bp, Homo sapien
atagcctctccttcttcggaacaat

SEQ ID NO: 321875 - DNA, 25 bp, Homo sapien
tccttcttcggaacaatgggcgtgg

SEQ ID NO: 321876 - DNA, 25 bp, Homo sapien
cagtgaagggtgttctagcagctca

SEQ ID NO: 321877 - DNA, 25 bp, Homo sapien
gttaacactttactctccagtcaac

SEQ ID NO: 321878 - DNA, 25 bp, Homo sapien
actctccagtcaacacttgggacat

SEQ ID NO: 321879 - DNA, 25 bp, Homo sapien
gtttgagtggttgaagacatctgca

SEQ ID NO: 321880 - DNA, 25 bp, Homo sapien
gacatctgcatgaaattgcacctag

SEQ ID NO: 321881 - DNA, 25 bp, Homo sapien
gcacctaggtgcattacttgatata

SEQ ID NO: 321882 - DNA, 25 bp, Homo sapien
gcattacttgatataactctcccct

SEQ ID NO: 321883 - DNA, 25 bp, Homo sapien
ttgatataactctcccctaaaactg

SEQ ID NO: 321884 - DNA, 25 bp, Homo sapien
ctctcccctaaaactgttgtaattg

SEQ ID NO: 321885 - DNA, 25 bp, Homo sapien
tcttggcacccctttagaaatgtac

SEQ ID NO: 321886 - DNA, 25 bp, Homo sapien
ggcacccctttagaaatgtactgaa

SEQ ID NO: 321887 - DNA, 25 bp, Homo sapien
gtactgaagtctcatttttcaccca

SEQ ID NO: 321888 - DNA, 25 bp, Homo sapien
acccatttcagccatgggacatttt

SEQ ID NO: 321889 - DNA, 25 bp, Homo sapien
aagatgtttgtgttactgtttataa

SEQ ID NO: 321890 - DNA, 25 bp, Homo sapien
gcaaaatagagcatcaaagctttga

SEQ ID NO: 321891 - DNA, 25 bp, Homo sapien
gctttgatttacttacatgttgcac

SEQ ID NO: 321892 - DNA, 25 bp, Homo sapien
acttacatgttgcactttggcggga

SEQ ID NO: 321893 - DNA, 25 bp, Homo sapien
catgttgcactttggcgggattctt

SEQ ID NO: 321894 - DNA, 25 bp, Homo sapien
gcactttggcgggattcttaatgaa

SEQ ID NO: 321895 - DNA, 25 bp, Homo sapien
atgtttatagtgagggacttactta

SEQ ID NO: 321896 - DNA, 25 bp, Homo sapien
gggaggccagtaatgaaactgaatc

SEQ ID NO: 321897 - DNA, 25 bp, Homo sapien
aactgaatcaactgggttcttcaag

SEQ ID NO: 321898 - DNA, 25 bp, Homo sapien
aatcaactgggttcttcaagatgga

SEQ ID NO: 321899 - DNA, 25 bp, Homo sapien
caatatggccatattcttgggccta

SEQ ID NO: 321900 - DNA, 25 bp, Homo sapien
tattcttgggcctaacattttgaaa

SEQ ID NO: 321901 - DNA, 25 bp, Homo sapien
gaaatatccgaccatgttgcagaaa

SEQ ID NO: 321902 - DNA, 25 bp, Homo sapien
gcaaaacctcatgtaagttaactat

SEQ ID NO: 321903 - DNA, 25 bp, Homo sapien
taactatgaaagatcctgtgagcac

SEQ ID NO: 321904 - DNA, 25 bp, Homo sapien
tcctgtgagcacattggcattgagt

SEQ ID NO: 321905 - DNA, 25 bp, Homo sapien
attggcattgagtgacagacaaact

SEQ ID NO: 321906 - DNA, 25 bp, Homo sapien
gggtcactctgtggcagtattctaa

SEQ ID NO: 321907 - DNA, 25 bp, Homo sapien
ttggattttcaagtagattaggctt

SEQ ID NO: 321908 - DNA, 25 bp, Homo sapien
taggctttttatttattcaacgctt

SEQ ID NO: 321909 - DNA, 25 bp, Homo sapien
ttgactccaaattattggtcagctt

SEQ ID NO: 321910 - DNA, 25 bp, Homo sapien
attggtcagctttcaaccttctcca

SEQ ID NO: 321911 - DNA, 25 bp, Homo sapien
tttcaaccttctccacatcagcaat

SEQ ID NO: 321912 - DNA, 25 bp, Homo sapien
gaattaaggtatattgactagtgaa

SEQ ID NO: 321913 - DNA, 25 bp, Homo sapien
ctagcttttgtacatagaaataaga

SEQ ID NO: 321914 - DNA, 25 bp, Homo sapien
aaattcagactgctaattatgagaa

SEQ ID NO: 321915 - DNA, 25 bp, Homo sapien
gagaaaaaacatgtatgcacaacca

SEQ ID NO: 321916 - DNA, 25 bp, Homo sapien
gtatgcacaaccaaacaaatcacaa

SEQ ID NO: 321917 - DNA, 25 bp, Homo sapien
agatgtctaaaaccatagaatagga

SEQ ID NO: 321918 - DNA, 25 bp, Homo sapien
taggaacaaatgtacctgtcatatt

SEQ ID NO: 321919 - DNA, 25 bp, Homo sapien
aagaaagtgacttatgttccattat

SEQ ID NO: 321920 - DNA, 25 bp, Homo sapien
aagtgacttatgttccattattaaa

SEQ ID NO: 321921 - DNA, 25 bp, Homo sapien
tagggaggacaggtaaattactaat

SEQ ID NO: 321922 - DNA, 25 bp, Homo sapien
aatttttcattgctcatagtagaga

SEQ ID NO: 321923 - DNA, 25 bp, Homo sapien
ctgctgtgtggagagacttgtcctc

SEQ ID NO: 321924 - DNA, 25 bp, Homo sapien
gctgtgtggagagacttgtcctctc

SEQ ID NO: 321925 - DNA, 25 bp, Homo sapien
tgcccacggtcaccagtgagcacca

SEQ ID NO: 321926 - DNA, 25 bp, Homo sapien
tggactttgaaaaggcacgactgtc

SEQ ID NO: 321927 - DNA, 25 bp, Homo sapien
tgaaaaggcacgactgtcctgtctg

SEQ ID NO: 321928 - DNA, 25 bp, Homo sapien
aaaaggcacgactgtcctgtctgat

SEQ ID NO: 321929 - DNA, 25 bp, Homo sapien
aaggcacgactgtcctgtctgatgg

SEQ ID NO: 321930 - DNA, 25 bp, Homo sapien
ggcacgactgtcctgtctgatggac

SEQ ID NO: 321931 - DNA, 25 bp, Homo sapien
ctgatggacaggatgcagaagcctt

SEQ ID NO: 321932 - DNA, 25 bp, Homo sapien
ggaatgggcattttgccagaataaa

SEQ ID NO: 321933 - DNA, 25 bp, Homo sapien
gggcattttgccagaataaataaaa

SEQ ID NO: 321934 - DNA, 25 bp, Homo sapien
gtgatgtgctccataatcgggtggg

SEQ ID NO: 321935 - DNA, 25 bp, Homo sapien
gtatgcatgcgtctggcacatggca

SEQ ID NO: 321936 - DNA, 25 bp, Homo sapien
gtagatgggcagctacactgccacc

SEQ ID NO: 321937 - DNA, 25 bp, Homo sapien
atgggcagctacactgccacccaag

SEQ ID NO: 321938 - DNA, 25 bp, Homo sapien
ggcagcctgccctgagctatcaaca

SEQ ID NO: 321939 - DNA, 25 bp, Homo sapien
tgccctgagctatcaacactggatt

SEQ ID NO: 321940 - DNA, 25 bp, Homo sapien
atcaacactggatttgttgtcttct

SEQ ID NO: 321941 - DNA, 25 bp, Homo sapien
tttgttgtcttctgcacagctactg

SEQ ID NO: 321942 - DNA, 25 bp, Homo sapien
gttgtcttctgcacagctactgtga

SEQ ID NO: 321943 - DNA, 25 bp, Homo sapien
cacagctactgtgaagataacgtaa

SEQ ID NO: 321944 - DNA, 25 bp, Homo sapien
gataacgtaaggagaagtggtcagt

SEQ ID NO: 321945 - DNA, 25 bp, Homo sapien
tttctcgggcttttcctcaacacca

SEQ ID NO: 321946 - DNA, 25 bp, Homo sapien
agggattatttcaatggtttctcca

SEQ ID NO: 321947 - DNA, 25 bp, Homo sapien
tatttcaatggtttctccatttcca

SEQ ID NO: 321948 - DNA, 25 bp, Homo sapien
aaagttaataattgcctctggacct

SEQ ID NO: 321949 - DNA, 25 bp, Homo sapien
gttaataattgcctctggaccttaa

SEQ ID NO: 321950 - DNA, 25 bp, Homo sapien
aataattgcctctggaccttaaaat

SEQ ID NO: 321951 - DNA, 25 bp, Homo sapien
taattgcctctggaccttaaaatta

SEQ ID NO: 321952 - DNA, 25 bp, Homo sapien
tgcctctggaccttaaaattaaaat

SEQ ID NO: 321953 - DNA, 25 bp, Homo sapien
ttttttgccaatattaaagagtaag

SEQ ID NO: 321954 - DNA, 25 bp, Homo sapien
gagtaagttttagtgcaagtaaaga

SEQ ID NO: 321955 - DNA, 25 bp, Homo sapien
ttgtatttttggtaatgtgctactc

SEQ ID NO: 321956 - DNA, 25 bp, Homo sapien
tgtccccagggatgaagtgggtccc

SEQ ID NO: 321957 - DNA, 25 bp, Homo sapien
gatgaagtgggtcccggcacggtgg

SEQ ID NO: 321958 - DNA, 25 bp, Homo sapien
ggcacggtgggcattctgtcatgaa

SEQ ID NO: 321959 - DNA, 25 bp, Homo sapien
gcacggtgggcattctgtcatgaat

SEQ ID NO: 321960 - DNA, 25 bp, Homo sapien
tgtcatgaatgaatggtccccttgt

SEQ ID NO: 321961 - DNA, 25 bp, Homo sapien
catgaatgaatggtccccttgtgta

SEQ ID NO: 321962 - DNA, 25 bp, Homo sapien
tgaatgaatggtccccttgtgtatg

SEQ ID NO: 321963 - DNA, 25 bp, Homo sapien
atgaatggtccccttgtgtatgcag

SEQ ID NO: 321964 - DNA, 25 bp, Homo sapien
tgaatggtccccttgtgtatgcagg

SEQ ID NO: 321965 - DNA, 25 bp, Homo sapien
atggtccccttgtgtatgcagggtt

SEQ ID NO: 321966 - DNA, 25 bp, Homo sapien
ccttgtgtatgcagggttcgcgctg

SEQ ID NO: 321967 - DNA, 25 bp, Homo sapien
ttgctgaggtttggcggatcagaca

SEQ ID NO: 321968 - DNA, 25 bp, Homo sapien
tgaggtttggcggatcagacagcgt

SEQ ID NO: 321969 - DNA, 25 bp, Homo sapien
aggtttggcggatcagacagcgtga

SEQ ID NO: 321970 - DNA, 25 bp, Homo sapien
ttggcggatcagacagcgtgaggct

SEQ ID NO: 321971 - DNA, 25 bp, Homo sapien
gcggatcagacagcgtgaggctggg

SEQ ID NO: 321972 - DNA, 25 bp, Homo sapien
gagcctacgggagggaactcctcca

SEQ ID NO: 321973 - DNA, 25 bp, Homo sapien
gcctacgggagggaactcctccagg

SEQ ID NO: 321974 - DNA, 25 bp, Homo sapien
ggagggaactcctccaggttgctga

SEQ ID NO: 321975 - DNA, 25 bp, Homo sapien
gagggaactcctccaggttgctgag

SEQ ID NO: 321976 - DNA, 25 bp, Homo sapien
agggaactcctccaggttgctgagg

SEQ ID NO: 321977 - DNA, 25 bp, Homo sapien
aactcctccaggttgctgaggtttg

SEQ ID NO: 321978 - DNA, 25 bp, Homo sapien
taggaaagtaatgctgtaagagtca

SEQ ID NO: 321979 - DNA, 25 bp, Homo sapien
gggctttgtcctagtcagcaacttg

SEQ ID NO: 321980 - DNA, 25 bp, Homo sapien
cagcctgagcaagaaaagatctgat

SEQ ID NO: 321981 - DNA, 25 bp, Homo sapien
gatctgatgctcagggaatccctca

SEQ ID NO: 321982 - DNA, 25 bp, Homo sapien
tcagggaatccctcattgggaaaat

SEQ ID NO: 321983 - DNA, 25 bp, Homo sapien
tcagatttgatttcttcttatgggt

SEQ ID NO: 321984 - DNA, 25 bp, Homo sapien
gatttcttcttatgggtttgctgga

SEQ ID NO: 321985 - DNA, 25 bp, Homo sapien
ttcttatgggtttgctggaagtaaa

SEQ ID NO: 321986 - DNA, 25 bp, Homo sapien
gtaaaaatcacattcacaaccactg

SEQ ID NO: 321987 - DNA, 25 bp, Homo sapien
ttcacaaccactgaagccagacatt

SEQ ID NO: 321988 - DNA, 25 bp, Homo sapien
gccagacatttgattactcttaaca

SEQ ID NO: 321989 - DNA, 25 bp, Homo sapien
agtttatttactgatacttggtgga

SEQ ID NO: 321990 - DNA, 25 bp, Homo sapien
taagacttctattaacagctgcaaa

SEQ ID NO: 321991 - DNA, 25 bp, Homo sapien
gtaagtgcactcacttttcctgtag

SEQ ID NO: 321992 - DNA, 25 bp, Homo sapien
gcactcacttttcctgtagtagtct

SEQ ID NO: 321993 - DNA, 25 bp, Homo sapien
tcctgtagtagtctgtcttttgaat

SEQ ID NO: 321994 - DNA, 25 bp, Homo sapien
tcacagcagttgtatccttgagtta

SEQ ID NO: 321995 - DNA, 25 bp, Homo sapien
gtatccttgagttactttgttaatg

SEQ ID NO: 321996 - DNA, 25 bp, Homo sapien
tatttttctcagtacatttaaccac

SEQ ID NO: 321997 - DNA, 25 bp, Homo sapien
ggaaatgaacccttgtacgaatgtg

SEQ ID NO: 321998 - DNA, 25 bp, Homo sapien
acccttgtacgaatgtgtttcttct

SEQ ID NO: 321999 - DNA, 25 bp, Homo sapien
tttcttcttctctgtaggaataaaa

SEQ ID NO: 322000 - DNA, 25 bp, Homo sapien
gaaccatttaagagaaccaagccaa

SEQ ID NO: 322001 - DNA, 25 bp, Homo sapien
agcaaaaatgcccagcctagcctta

SEQ ID NO: 322002 - DNA, 25 bp, Homo sapien
agcctagccttacccagaagttcaa

SEQ ID NO: 322003 - DNA, 25 bp, Homo sapien
ttacccagaagttcaaaagctcagc

SEQ ID NO: 322004 - DNA, 25 bp, Homo sapien
gctcagcctttgtcaccaggaaaaa

SEQ ID NO: 322005 - DNA, 25 bp, Homo sapien
gagcaaagccattattcggcacaac

SEQ ID NO: 322006 - DNA, 25 bp, Homo sapien
attcggcacaaccaggtattctgtt

SEQ ID NO: 322007 - DNA, 25 bp, Homo sapien
accaggtattctgttgtaaacatct

SEQ ID NO: 322008 - DNA, 25 bp, Homo sapien
cacgtttgagtgaaagagggctgct

SEQ ID NO: 322009 - DNA, 25 bp, Homo sapien
taaagagagtttaaaccaagccagg

SEQ ID NO: 322010 - DNA, 25 bp, Homo sapien
aataccaggtgccagaccaaccctt

SEQ ID NO: 322011 - DNA, 25 bp, Homo sapien
cattttactcaatgatggacacata

SEQ ID NO: 322012 - DNA, 25 bp, Homo sapien
caatgatggacacatatacaatggt

SEQ ID NO: 322013 - DNA, 25 bp, Homo sapien
aaaaattcctatcacttgtggacgt

SEQ ID NO: 322014 - DNA, 25 bp, Homo sapien
ttcctatcacttgtggacgttgtca

SEQ ID NO: 322015 - DNA, 25 bp, Homo sapien
tcacttgtggacgttgtcatgcaac

SEQ ID NO: 322016 - DNA, 25 bp, Homo sapien
gttgtcatgcaacatatcactcagg

SEQ ID NO: 322017 - DNA, 25 bp, Homo sapien
gtcatgcaacatatcactcaggtgt

SEQ ID NO: 322018 - DNA, 25 bp, Homo sapien
cactcaggtgtttgtggtgacgctg

SEQ ID NO: 322019 - DNA, 25 bp, Homo sapien
gtgacgctgctgtaaataaacctac

SEQ ID NO: 322020 - DNA, 25 bp, Homo sapien
tgctgtaaataaacctactgtgctt

SEQ ID NO: 322021 - DNA, 25 bp, Homo sapien
gcacatgcaattatgtatagtacgt

SEQ ID NO: 322022 - DNA, 25 bp, Homo sapien
cagtatttaccaggacagtggcagt

SEQ ID NO: 322023 - DNA, 25 bp, Homo sapien
cagtggcagtggagtgttcctcagc

SEQ ID NO: 322024 - DNA, 25 bp, Homo sapien
atacctgcaaccttctgaggttatt

SEQ ID NO: 322025 - DNA, 25 bp, Homo sapien
atttatcaaccagtggaaattgcac

SEQ ID NO: 322026 - DNA, 25 bp, Homo sapien
aggatggtggatgtgttcctcctcc

SEQ ID NO: 322027 - DNA, 25 bp, Homo sapien
attctgatcatggagttcaagcaac

SEQ ID NO: 322028 - DNA, 25 bp, Homo sapien
atcaccaggtttatgctccaagtgc

SEQ ID NO: 322029 - DNA, 25 bp, Homo sapien
ttatgctccaagtgccatcactatg

SEQ ID NO: 322030 - DNA, 25 bp, Homo sapien
catcactatgcctgcgcctgtgatg

SEQ ID NO: 322031 - DNA, 25 bp, Homo sapien
gcctgtgatgcagcctgagccaatt

SEQ ID NO: 322032 - DNA, 25 bp, Homo sapien
gatgcagcctgagccaattaaaaca

SEQ ID NO: 322033 - DNA, 25 bp, Homo sapien
ttttctcacgtgacgacaaggcagt

SEQ ID NO: 322034 - DNA, 25 bp, Homo sapien
gacaaggcagtgtgaaagttctcgt

SEQ ID NO: 322035 - DNA, 25 bp, Homo sapien
agtgtgaaagttctcgtgcagctca

SEQ ID NO: 322036 - DNA, 25 bp, Homo sapien
tgaaagttctcgtgcagctcacaca

SEQ ID NO: 322037 - DNA, 25 bp, Homo sapien
aagttctcgtgcagctcacacaggc

SEQ ID NO: 322038 - DNA, 25 bp, Homo sapien
acacaggccgcgctgctgtgtcgct

SEQ ID NO: 322039 - DNA, 25 bp, Homo sapien
tgtgtcgcttctcttaacgctctga

SEQ ID NO: 322040 - DNA, 25 bp, Homo sapien
gtcgcttctcttaacgctctgaatt

SEQ ID NO: 322041 - DNA, 25 bp, Homo sapien
ttctcttaacgctctgaattcagga

SEQ ID NO: 322042 - DNA, 25 bp, Homo sapien
ctgaattcaggagcgagggcggcaa

SEQ ID NO: 322043 - DNA, 25 bp, Homo sapien
ttgggatgaggagcagtctgcacac

SEQ ID NO: 322044 - DNA, 25 bp, Homo sapien
ccatgtacttagactcctttatttg

SEQ ID NO: 322045 - DNA, 25 bp, Homo sapien
actagagtattgtcttcttcattag

SEQ ID NO: 322046 - DNA, 25 bp, Homo sapien
aaggacctaggatgacaatgcggag

SEQ ID NO: 322047 - DNA, 25 bp, Homo sapien
gacaatgcggagagtcttggtctga

SEQ ID NO: 322048 - DNA, 25 bp, Homo sapien
gagtcttggtctgaatctagtgcga

SEQ ID NO: 322049 - DNA, 25 bp, Homo sapien
tgaatctagtgcgactaccacctgc

SEQ ID NO: 322050 - DNA, 25 bp, Homo sapien
aatactatctaaaagttggactgca

SEQ ID NO: 322051 - DNA, 25 bp, Homo sapien
gttggactgcatgggtcaaatcatt

SEQ ID NO: 322052 - DNA, 25 bp, Homo sapien
gcatgggtcaaatcattatgagact

SEQ ID NO: 322053 - DNA, 25 bp, Homo sapien
taaaactttagatacccatatagaa

SEQ ID NO: 322054 - DNA, 25 bp, Homo sapien
cctaaagaatgaaggctctttccct

SEQ ID NO: 322055 - DNA, 25 bp, Homo sapien
gatgggccctaattcggtcatgtca

SEQ ID NO: 322056 - DNA, 25 bp, Homo sapien
ggtcatgtcaacctatggcagccag

SEQ ID NO: 322057 - DNA, 25 bp, Homo sapien
gcagccaggcatctcataacaaaat

SEQ ID NO: 322058 - DNA, 25 bp, Homo sapien
aaaatgatgaatcccagctcccata

SEQ ID NO: 322059 - DNA, 25 bp, Homo sapien
gacatgctcagcagacatctgcagt

SEQ ID NO: 322060 - DNA, 25 bp, Homo sapien
cacacctcgggtatgaaccgcctga

SEQ ID NO: 322061 - DNA, 25 bp, Homo sapien
tgaaccgcctgacccaagtgaagac

SEQ ID NO: 322062 - DNA, 25 bp, Homo sapien
gaagacacctgtacaagtgcctctg

SEQ ID NO: 322063 - DNA, 25 bp, Homo sapien
caccccatgcagatgagtgccctgg

SEQ ID NO: 322064 - DNA, 25 bp, Homo sapien
ctccgtgagcagctgcaatggctat

SEQ ID NO: 322065 - DNA, 25 bp, Homo sapien
gctatggcagaatgggccttctcca

SEQ ID NO: 322066 - DNA, 25 bp, Homo sapien
tgtcagagttgcacaaatctaactg

SEQ ID NO: 322067 - DNA, 25 bp, Homo sapien
gtcagagttgcacaaatctaactgg

SEQ ID NO: 322068 - DNA, 25 bp, Homo sapien
tcagagttgcacaaatctaactggt

SEQ ID NO: 322069 - DNA, 25 bp, Homo sapien
cagagttgcacaaatctaactggta

SEQ ID NO: 322070 - DNA, 25 bp, Homo sapien
agagttgcacaaatctaactggtat

SEQ ID NO: 322071 - DNA, 25 bp, Homo sapien
gagttgcacaaatctaactggtatt

SEQ ID NO: 322072 - DNA, 25 bp, Homo sapien
agttgcacaaatctaactggtattt

SEQ ID NO: 322073 - DNA, 25 bp, Homo sapien
gttgcacaaatctaactggtatttt

SEQ ID NO: 322074 - DNA, 25 bp, Homo sapien
ttgcacaaatctaactggtattttg

SEQ ID NO: 322075 - DNA, 25 bp, Homo sapien
tgcacaaatctaactggtattttgt

SEQ ID NO: 322076 - DNA, 25 bp, Homo sapien
tgtccacataggtttagagataaga

SEQ ID NO: 322077 - DNA, 25 bp, Homo sapien
ttagagataagagttggctggtcaa

SEQ ID NO: 322078 - DNA, 25 bp, Homo sapien
tggctggtcaacttgagcatgttac

SEQ ID NO: 322079 - DNA, 25 bp, Homo sapien
aacttgagcatgttactgacagagg

SEQ ID NO: 322080 - DNA, 25 bp, Homo sapien
ttttctggtaggaatagcatgtcac

SEQ ID NO: 322081 - DNA, 25 bp, Homo sapien
tagcatgtcactaaagcaggccttt

SEQ ID NO: 322082 - DNA, 25 bp, Homo sapien
aaagcaggccttttgatattaaatt

SEQ ID NO: 322083 - DNA, 25 bp, Homo sapien
acagaattgcttgtttgcttcaact

SEQ ID NO: 322084 - DNA, 25 bp, Homo sapien
ctgtctcctacctctgctcttggag

SEQ ID NO: 322085 - DNA, 25 bp, Homo sapien
gggacagggctggagtcaaaacact

SEQ ID NO: 322086 - DNA, 25 bp, Homo sapien
ggctggagtcaaaacacttgtaatt

SEQ ID NO: 322087 - DNA, 25 bp, Homo sapien
cgctccatactatccttgatcttgg

SEQ ID NO: 322088 - DNA, 25 bp, Homo sapien
tactatccttgatcttggccaaaag

SEQ ID NO: 322089 - DNA, 25 bp, Homo sapien
ccactgaatgctccagaagttcaaa

SEQ ID NO: 322090 - DNA, 25 bp, Homo sapien
ggagaaacagcgaacttttccctgg

SEQ ID NO: 322091 - DNA, 25 bp, Homo sapien
ctggagccagaaggacgcaaaggtt

SEQ ID NO: 322092 - DNA, 25 bp, Homo sapien
gacgcaaaggttcgctagcggccca

SEQ ID NO: 322093 - DNA, 25 bp, Homo sapien
caaaggttcgctagcggcccagggc

SEQ ID NO: 322094 - DNA, 25 bp, Homo sapien
actgggcactgggactggctccgct

SEQ ID NO: 322095 - DNA, 25 bp, Homo sapien
acgcaacacgcgatcagaggcgttt

SEQ ID NO: 322096 - DNA, 25 bp, Homo sapien
atcagaggcgttttctgccagtgac

SEQ ID NO: 322097 - DNA, 25 bp, Homo sapien
ttctgccagtgacccgcgaactttg

SEQ ID NO: 322098 - DNA, 25 bp, Homo sapien
gtggattcggaaaccaacagcgccc

SEQ ID NO: 322099 - DNA, 25 bp, Homo sapien
aacagcgcccgggtcagaactctgg

SEQ ID NO: 322100 - DNA, 25 bp, Homo sapien
agaactctgggccagtccaaaacct

SEQ ID NO: 322101 - DNA, 25 bp, Homo sapien
agtccaaaacctgacaacatctgcg

SEQ ID NO: 322102 - DNA, 25 bp, Homo sapien
aacatctgcgttccttgcagctgtt

SEQ ID NO: 322103 - DNA, 25 bp, Homo sapien
ttccttgcagctgttttcgaacgta

SEQ ID NO: 322104 - DNA, 25 bp, Homo sapien
cagggctttcgcacggttgcaagcg

SEQ ID NO: 322105 - DNA, 25 bp, Homo sapien
tgttttcgaacgtaagcccgacgct

SEQ ID NO: 322106 - DNA, 25 bp, Homo sapien
taagcccgacgctaggcagtgctgt

SEQ ID NO: 322107 - DNA, 25 bp, Homo sapien
ttgcaagcgcacacctggccggatg

SEQ ID NO: 322108 - DNA, 25 bp, Homo sapien
tgcaccacacactgccaagtacaaa

SEQ ID NO: 322109 - DNA, 25 bp, Homo sapien
acatacatgctctagtttttggaac

SEQ ID NO: 322110 - DNA, 25 bp, Homo sapien
tacatctgttttgaacatggtattt

SEQ ID NO: 322111 - DNA, 25 bp, Homo sapien
attagcacgaattactactctacag

SEQ ID NO: 322112 - DNA, 25 bp, Homo sapien
attactactctacagtttcttctag

SEQ ID NO: 322113 - DNA, 25 bp, Homo sapien
aataaatataatggctgtttgcaga

SEQ ID NO: 322114 - DNA, 25 bp, Homo sapien
gtttgcagagcgactacagacttac

SEQ ID NO: 322115 - DNA, 25 bp, Homo sapien
gcgactacagacttacttagatgtt

SEQ ID NO: 322116 - DNA, 25 bp, Homo sapien
gaacgatttcacaattagatcaacc

SEQ ID NO: 322117 - DNA, 25 bp, Homo sapien
agatcaaccattgagttaacagcaa

SEQ ID NO: 322118 - DNA, 25 bp, Homo sapien
attgatggctgtaaagggacaactt

SEQ ID NO: 322119 - DNA, 25 bp, Homo sapien
tttaggtctgctgagatgatgcaca

SEQ ID NO: 322120 - DNA, 25 bp, Homo sapien
aatccagtacagtagagaatgcgaa

SEQ ID NO: 322121 - DNA, 25 bp, Homo sapien
atttcttatatctcatctatggctt

SEQ ID NO: 322122 - DNA, 25 bp, Homo sapien
ctcatctatggcttaactaactgat

SEQ ID NO: 322123 - DNA, 25 bp, Homo sapien
aagtcagttccactgactggctgca

SEQ ID NO: 322124 - DNA, 25 bp, Homo sapien
tgactggctgcaaatgtccgcacaa

SEQ ID NO: 322125 - DNA, 25 bp, Homo sapien
gtccgcacaagaatactgcatgtct

SEQ ID NO: 322126 - DNA, 25 bp, Homo sapien
caagaatactgcatgtctggaagcc

SEQ ID NO: 322127 - DNA, 25 bp, Homo sapien
ctggaagccagcacatatctatgct

SEQ ID NO: 322128 - DNA, 25 bp, Homo sapien
atatctatgctacttcgtgggtcaa

SEQ ID NO: 322129 - DNA, 25 bp, Homo sapien
acttcgtgggtcaaaatgcctccaa

SEQ ID NO: 322130 - DNA, 25 bp, Homo sapien
gatatctatttaacccatgttctag

SEQ ID NO: 322131 - DNA, 25 bp, Homo sapien
ggtaagtcaccgcagttacactggt

SEQ ID NO: 322132 - DNA, 25 bp, Homo sapien
gttacactggtggaggttgtcctca

SEQ ID NO: 322133 - DNA, 25 bp, Homo sapien
gtggaggttgtcctcagccagccac

SEQ ID NO: 322134 - DNA, 25 bp, Homo sapien
caccatgccaacttgctgctttaat

SEQ ID NO: 322135 - DNA, 25 bp, Homo sapien
aacttgctgctttaatcacaggaga

SEQ ID NO: 322136 - DNA, 25 bp, Homo sapien
agccaacatcagcagacctgctcag

SEQ ID NO: 322137 - DNA, 25 bp, Homo sapien
gctcagccaacccataaacagactg

SEQ ID NO: 322138 - DNA, 25 bp, Homo sapien
gccaacccataaacagactgaggag

SEQ ID NO: 322139 - DNA, 25 bp, Homo sapien
gaaagtatcatttttcagacactga

SEQ ID NO: 322140 - DNA, 25 bp, Homo sapien
tttttcagacactgagtttcaggag

SEQ ID NO: 322141 - DNA, 25 bp, Homo sapien
atgaagggtaagtcaccgcagttac

SEQ ID NO: 322142 - DNA, 25 bp, Homo sapien
aggaacaccatagcacccacaaata

SEQ ID NO: 322143 - DNA, 25 bp, Homo sapien
tagcacccacaaatacttctacttg

SEQ ID NO: 322144 - DNA, 25 bp, Homo sapien
gtggtagatttattcccttgtgtca

SEQ ID NO: 322145 - DNA, 25 bp, Homo sapien
aatcatattctgtgctttttcaatc

SEQ ID NO: 322146 - DNA, 25 bp, Homo sapien
gtgctttttcaatcactagtgcaga

SEQ ID NO: 322147 - DNA, 25 bp, Homo sapien
gaataggctgcatttgacacagact

SEQ ID NO: 322148 - DNA, 25 bp, Homo sapien
gacacagactgttaggcaatattga

SEQ ID NO: 322149 - DNA, 25 bp, Homo sapien
ttattcccttgtgtcaggccaaaga

SEQ ID NO: 322150 - DNA, 25 bp, Homo sapien
gagataacttatgttcaaggtgaga

SEQ ID NO: 322151 - DNA, 25 bp, Homo sapien
tacagtgggtagtgtctaaagcgac

SEQ ID NO: 322152 - DNA, 25 bp, Homo sapien
aaagcgacactttactcacagcctg

SEQ ID NO: 322153 - DNA, 25 bp, Homo sapien
gtggtcaggcgtgcaattttggtct

SEQ ID NO: 322154 - DNA, 25 bp, Homo sapien
tgcaattttggtctgcgccacataa

SEQ ID NO: 322155 - DNA, 25 bp, Homo sapien
gcgccacataaccattctgaagctt

SEQ ID NO: 322156 - DNA, 25 bp, Homo sapien
ggagtgttagaactgttcccaatta

SEQ ID NO: 322157 - DNA, 25 bp, Homo sapien
gagcgagaagacgtaccagcccatt

SEQ ID NO: 322158 - DNA, 25 bp, Homo sapien
cagcccatttggtgaaagacattcg

SEQ ID NO: 322159 - DNA, 25 bp, Homo sapien
aactattttcaagtgagcccggagt

SEQ ID NO: 322160 - DNA, 25 bp, Homo sapien
aagtgagcccggagtacttctccat

SEQ ID NO: 322161 - DNA, 25 bp, Homo sapien
tctccatgcttctagtcggaaaaga

SEQ ID NO: 322162 - DNA, 25 bp, Homo sapien
aaatcctggtatccttccccaatgt

SEQ ID NO: 322163 - DNA, 25 bp, Homo sapien
attgattcgatgcaacttcggagac

SEQ ID NO: 322164 - DNA, 25 bp, Homo sapien
atttttgttaacgtgctgctgtttc

SEQ ID NO: 322165 - DNA, 25 bp, Homo sapien
tgttaacgtgctgctgtttcctaca

SEQ ID NO: 322166 - DNA, 25 bp, Homo sapien
gtttcctacatctcattcaggcatt

SEQ ID NO: 322167 - DNA, 25 bp, Homo sapien
atctcattcaggcattagtttcaag

SEQ ID NO: 322168 - DNA, 25 bp, Homo sapien
caggcattagtttcaagttccattt

SEQ ID NO: 322169 - DNA, 25 bp, Homo sapien
atattcacagggttattgtttgtaa

SEQ ID NO: 322170 - DNA, 25 bp, Homo sapien
ttatttgctttattccatcaagtaa

SEQ ID NO: 322171 - DNA, 25 bp, Homo sapien
ttcttggaaatgtggctctacatat

SEQ ID NO: 322172 - DNA, 25 bp, Homo sapien
gctctacatatcgttagtacaagta

SEQ ID NO: 322173 - DNA, 25 bp, Homo sapien
tttgattgttgtttcctggaataac

SEQ ID NO: 322174 - DNA, 25 bp, Homo sapien
tgtttcctggaataacttgtattat

SEQ ID NO: 322175 - DNA, 25 bp, Homo sapien
ggaaatgagaacagacccttgttca

SEQ ID NO: 322176 - DNA, 25 bp, Homo sapien
agacccttgttcatgtttttgccat

SEQ ID NO: 322177 - DNA, 25 bp, Homo sapien
tgtttttgccatctttatcagcctg

SEQ ID NO: 322178 - DNA, 25 bp, Homo sapien
ttgccatctttatcagcctggaggc

SEQ ID NO: 322179 - DNA, 25 bp, Homo sapien
gcctggaggccgttactgtgacgaa

SEQ ID NO: 322180 - DNA, 25 bp, Homo sapien
gtgacgaatgaactcccacaatttt

SEQ ID NO: 322181 - DNA, 25 bp, Homo sapien
tgaactcccacaattttcagttttt

SEQ ID NO: 322182 - DNA, 25 bp, Homo sapien
gattgtatcatgtatcttccccttg

SEQ ID NO: 322183 - DNA, 25 bp, Homo sapien
gtatcttccccttggctagtggtgg

SEQ ID NO: 322184 - DNA, 25 bp, Homo sapien
agtggtggccagagcccctttagca

SEQ ID NO: 322185 - DNA, 25 bp, Homo sapien
gagcaggtctggtcccaggcaagca

SEQ ID NO: 322186 - DNA, 25 bp, Homo sapien
gaagcctttcacaagtagtgcgctg

SEQ ID NO: 322187 - DNA, 25 bp, Homo sapien
ttcacaagtagtgcgctgagctttt

SEQ ID NO: 322188 - DNA, 25 bp, Homo sapien
agtgcgctgagcttttcttattgaa

SEQ ID NO: 322189 - DNA, 25 bp, Homo sapien
gcgctgagcttttcttattgaagag

SEQ ID NO: 322190 - DNA, 25 bp, Homo sapien
gagtgaattagtttctgagaagtca

SEQ ID NO: 322191 - DNA, 25 bp, Homo sapien
gtttctgagaagtcaatctattgtg

SEQ ID NO: 322192 - DNA, 25 bp, Homo sapien
gtcaatctattgtgaaaagtttcag

SEQ ID NO: 322193 - DNA, 25 bp, Homo sapien
aagacaatgttttatttgccaccag

SEQ ID NO: 322194 - DNA, 25 bp, Homo sapien
caatgttttatttgccaccaggcag

SEQ ID NO: 322195 - DNA, 25 bp, Homo sapien
tttatttgccaccaggcagaacaga

SEQ ID NO: 322196 - DNA, 25 bp, Homo sapien
gtataccaatcgattgaagcctttc

SEQ ID NO: 322197 - DNA, 25 bp, Homo sapien
cctgctgcctgaagtggtagccccg

SEQ ID NO: 322198 - DNA, 25 bp, Homo sapien
tgctgcctgaagtggtagccccgcc

SEQ ID NO: 322199 - DNA, 25 bp, Homo sapien
gctgcctgaagtggtagccccgcct

SEQ ID NO: 322200 - DNA, 25 bp, Homo sapien
ctgcctgaagtggtagccccgcctg

SEQ ID NO: 322201 - DNA, 25 bp, Homo sapien
tgcctgaagtggtagccccgcctgc

SEQ ID NO: 322202 - DNA, 25 bp, Homo sapien
gcctgaagtggtagccccgcctgct

SEQ ID NO: 322203 - DNA, 25 bp, Homo sapien
ctgaagtggtagccccgcctgctgc

SEQ ID NO: 322204 - DNA, 25 bp, Homo sapien
tgaagtggtagccccgcctgctgct

SEQ ID NO: 322205 - DNA, 25 bp, Homo sapien
gaagtggtagccccgcctgctgctt

SEQ ID NO: 322206 - DNA, 25 bp, Homo sapien
aagtggtagccccgcctgctgcttc

SEQ ID NO: 322207 - DNA, 25 bp, Homo sapien
gtggtagccccgcctgctgcttctc

SEQ ID NO: 322208 - DNA, 25 bp, Homo sapien
gacatagggagaaagcagccaccat

SEQ ID NO: 322209 - DNA, 25 bp, Homo sapien
agcagccaccattggcaagccaaga

SEQ ID NO: 322210 - DNA, 25 bp, Homo sapien
gccctcaccaggaacgattggacca

SEQ ID NO: 322211 - DNA, 25 bp, Homo sapien
aggaacgattggaccagcaccttga

SEQ ID NO: 322212 - DNA, 25 bp, Homo sapien
gatattttgttacagcaaccctaat

SEQ ID NO: 322213 - DNA, 25 bp, Homo sapien
accctaatagactgagagagctcct

SEQ ID NO: 322214 - DNA, 25 bp, Homo sapien
agagagctcctgagagcttcactca

SEQ ID NO: 322215 - DNA, 25 bp, Homo sapien
gagcttcactcacagaatcaattgt

SEQ ID NO: 322216 - DNA, 25 bp, Homo sapien
tcaattgtattcttacctggtgaag

SEQ ID NO: 322217 - DNA, 25 bp, Homo sapien
gtgaagatccattctaagacttatt

SEQ ID NO: 322218 - DNA, 25 bp, Homo sapien
tctaagacttattggctgtttggaa

SEQ ID NO: 322219 - DNA, 25 bp, Homo sapien
gctctccctcattacattgttctga

SEQ ID NO: 322220 - DNA, 25 bp, Homo sapien
ttctgagaattggatgtggctgctt

SEQ ID NO: 322221 - DNA, 25 bp, Homo sapien
gagaattggatgtggctgcttgcat

SEQ ID NO: 322222 - DNA, 25 bp, Homo sapien
attggatgtggctgcttgcatggta

SEQ ID NO: 322223 - DNA, 25 bp, Homo sapien
atgtggctgcttgcatggtaatgag

SEQ ID NO: 322224 - DNA, 25 bp, Homo sapien
aacagaggctgttggtggtagtaat

SEQ ID NO: 322225 - DNA, 25 bp, Homo sapien
gaggctgttggtggtagtaataata

SEQ ID NO: 322226 - DNA, 25 bp, Homo sapien
aaaactacacagacaaacctatcag

SEQ ID NO: 322227 - DNA, 25 bp, Homo sapien
ctcttcaggatataactattaggtt

SEQ ID NO: 322228 - DNA, 25 bp, Homo sapien
aatatgactttcttttagtgttctt

SEQ ID NO: 322229 - DNA, 25 bp, Homo sapien
gactttcttttagtgttcttaggat

SEQ ID NO: 322230 - DNA, 25 bp, Homo sapien
tccgggacgctctccaagccctcga

SEQ ID NO: 322231 - DNA, 25 bp, Homo sapien
gtgctcctcctcgtcctggaaaggg

SEQ ID NO: 322232 - DNA, 25 bp, Homo sapien
gctcctcctcgtcctggaaagggta

SEQ ID NO: 322233 - DNA, 25 bp, Homo sapien
tcctcctcgtcctggaaagggtaca

SEQ ID NO: 322234 - DNA, 25 bp, Homo sapien
ctcctcgtcctggaaagggtacaga

SEQ ID NO: 322235 - DNA, 25 bp, Homo sapien
aactctttgtagtcagcgcggtcct

SEQ ID NO: 322236 - DNA, 25 bp, Homo sapien
actctttgtagtcagcgcggtcctc

SEQ ID NO: 322237 - DNA, 25 bp, Homo sapien
tctttgtagtcagcgcggtcctcct

SEQ ID NO: 322238 - DNA, 25 bp, Homo sapien
tttgtagtcagcgcggtcctcctcg

SEQ ID NO: 322239 - DNA, 25 bp, Homo sapien
tcctcgacctgtgcgcctaggagtg

SEQ ID NO: 322240 - DNA, 25 bp, Homo sapien
gcagcaccatgccagcggccggagg

SEQ ID NO: 322241 - DNA, 25 bp, Homo sapien
ggaatcttaacgcttccccaactga

SEQ ID NO: 322242 - DNA, 25 bp, Homo sapien
ttaacgcttccccaactgacaggaa

SEQ ID NO: 322243 - DNA, 25 bp, Homo sapien
gccccaaacctgacaagaacgtctt

SEQ ID NO: 322244 - DNA, 25 bp, Homo sapien
agaacgtcttcagtccagaatccta

SEQ ID NO: 322245 - DNA, 25 bp, Homo sapien
gtcttcagtccagaatcctacaggg

SEQ ID NO: 322246 - DNA, 25 bp, Homo sapien
tacagggacctcctcatgctttggg

SEQ ID NO: 322247 - DNA, 25 bp, Homo sapien
atgctttgggctgcaaggactccac

SEQ ID NO: 322248 - DNA, 25 bp, Homo sapien
tagctccgggactgcgaagcgcctc

SEQ ID NO: 322249 - DNA, 25 bp, Homo sapien
ttcgctcggccctggagcgttctgc

SEQ ID NO: 322250 - DNA, 25 bp, Homo sapien
ccggccaggttcgtcgtgtcaagag

SEQ ID NO: 322251 - DNA, 25 bp, Homo sapien
ggaggcggcagcacgcgtcctctct

SEQ ID NO: 322252 - DNA, 25 bp, Homo sapien
agtcctctaccatcctgcactgtga

SEQ ID NO: 322253 - DNA, 25 bp, Homo sapien
atcctgcactgtgagcagcactata

SEQ ID NO: 322254 - DNA, 25 bp, Homo sapien
gcactgtgagcagcactatacctgt

SEQ ID NO: 322255 - DNA, 25 bp, Homo sapien
gagcagcactatacctgtgcgttgt

SEQ ID NO: 322256 - DNA, 25 bp, Homo sapien
tcgtctggtagcctttgcatttaac

SEQ ID NO: 322257 - DNA, 25 bp, Homo sapien
ctggtagcctttgcatttaacaaac

SEQ ID NO: 322258 - DNA, 25 bp, Homo sapien
aaatgctacgtgatagacaatttca

SEQ ID NO: 322259 - DNA, 25 bp, Homo sapien
ttcagctagccacatattgtatgta

SEQ ID NO: 322260 - DNA, 25 bp, Homo sapien
agctagccacatattgtatgtatga

SEQ ID NO: 322261 - DNA, 25 bp, Homo sapien
tatgagattcataaagactttcaat

SEQ ID NO: 322262 - DNA, 25 bp, Homo sapien
aagactttcaatcatttcattttca

SEQ ID NO: 322263 - DNA, 25 bp, Homo sapien
tgcgcaaggtgcagtgccgtgacca

SEQ ID NO: 322264 - DNA, 25 bp, Homo sapien
gcgcaaggtgcagtgccgtgaccac

SEQ ID NO: 322265 - DNA, 25 bp, Homo sapien
gcaaggtgcagtgccgtgaccacga

SEQ ID NO: 322266 - DNA, 25 bp, Homo sapien
aggtgcagtgccgtgaccacgaggc

SEQ ID NO: 322267 - DNA, 25 bp, Homo sapien
tgcagtgccgtgaccacgaggcggt

SEQ ID NO: 322268 - DNA, 25 bp, Homo sapien
agtgccgtgaccacgaggcggtgcc

SEQ ID NO: 322269 - DNA, 25 bp, Homo sapien
gaggcggtgccgctgagcgtcttcc

SEQ ID NO: 322270 - DNA, 25 bp, Homo sapien
gggcacactcacctgcttcgtgctg

SEQ ID NO: 322271 - DNA, 25 bp, Homo sapien
gggccaggccgtgctggacaccctg

SEQ ID NO: 322272 - DNA, 25 bp, Homo sapien
tggacaccctggagggcgcgctgca

SEQ ID NO: 322273 - DNA, 25 bp, Homo sapien
gagggcgcgctgcaggccagcgacg

SEQ ID NO: 322274 - DNA, 25 bp, Homo sapien
atttcaaacacccacacaaaagaga

SEQ ID NO: 322275 - DNA, 25 bp, Homo sapien
gagaacagctcactgcaagaccgca

SEQ ID NO: 322276 - DNA, 25 bp, Homo sapien
tgcaagaccgcatgagcccataact

SEQ ID NO: 322277 - DNA, 25 bp, Homo sapien
gagcccataactcacctatgataat

SEQ ID NO: 322278 - DNA, 25 bp, Homo sapien
taatcattaattacggtcacccttc

SEQ ID NO: 322279 - DNA, 25 bp, Homo sapien
tccaccctccctatttgaaacaaat

SEQ ID NO: 322280 - DNA, 25 bp, Homo sapien
gacactattaacttactttggacag

SEQ ID NO: 322281 - DNA, 25 bp, Homo sapien
tattaacttactttggacaggacca

SEQ ID NO: 322282 - DNA, 25 bp, Homo sapien
aatggccagttttccttgatctctc

SEQ ID NO: 322283 - DNA, 25 bp, Homo sapien
cttgatctctcctagacgggctgat

SEQ ID NO: 322284 - DNA, 25 bp, Homo sapien
gggctgatccggagtgaatttcaca

SEQ ID NO: 322285 - DNA, 25 bp, Homo sapien
gctatgtagtcaaagaggatgccca

SEQ ID NO: 322286 - DNA, 25 bp, Homo sapien
aagaggatgcccattcttagatatc

SEQ ID NO: 322287 - DNA, 25 bp, Homo sapien
gaaagcatcgtctttccaaacctct

SEQ ID NO: 322288 - DNA, 25 bp, Homo sapien
aacctctctgacttcatattcgcaa

SEQ ID NO: 322289 - DNA, 25 bp, Homo sapien
atattcgcaattatcaagagtcaag

SEQ ID NO: 322290 - DNA, 25 bp, Homo sapien
aatgcaagcattcactcctatttaa

SEQ ID NO: 322291 - DNA, 25 bp, Homo sapien
ttcactcctatttaaatctgggcga

SEQ ID NO: 322292 - DNA, 25 bp, Homo sapien
ttaaatctgggcgagggttcttcca

SEQ ID NO: 322293 - DNA, 25 bp, Homo sapien
gagggttcttccaggtttttctcat

SEQ ID NO: 322294 - DNA, 25 bp, Homo sapien
ccaggtttttctcattccactaaga

SEQ ID NO: 322295 - DNA, 25 bp, Homo sapien
ttccactaagaacatgatacccaat

SEQ ID NO: 322296 - DNA, 25 bp, Homo sapien
gatggaacagctggtataacataag

SEQ ID NO: 322297 - DNA, 25 bp, Homo sapien
gagattggaaacttcttgccttgaa

SEQ ID NO: 322298 - DNA, 25 bp, Homo sapien
ttgccttgaacagaacttatatctt

SEQ ID NO: 322299 - DNA, 25 bp, Homo sapien
tatatcttagattctctctcacatt

SEQ ID NO: 322300 - DNA, 25 bp, Homo sapien
ggaaccagatgatgttcactgctga

SEQ ID NO: 322301 - DNA, 25 bp, Homo sapien
gttcactgctgaaattccataatgc

SEQ ID NO: 322302 - DNA, 25 bp, Homo sapien
aattccataatgcttcccattgaag

SEQ ID NO: 322303 - DNA, 25 bp, Homo sapien
cccattgaagggaagttgagaacca

SEQ ID NO: 322304 - DNA, 25 bp, Homo sapien
aaagctgctttcacgtcattgccat

SEQ ID NO: 322305 - DNA, 25 bp, Homo sapien
attgccatccagtactgacagggaa

SEQ ID NO: 322306 - DNA, 25 bp, Homo sapien
agatgtagttttccagtagtgatga

SEQ ID NO: 322307 - DNA, 25 bp, Homo sapien
caaggtgatcgaaaactgtggccat

SEQ ID NO: 322308 - DNA, 25 bp, Homo sapien
aaactgtggccatgtggaacccggt

SEQ ID NO: 322309 - DNA, 25 bp, Homo sapien
tggccatgtggaacccggtcttgtg

SEQ ID NO: 322310 - DNA, 25 bp, Homo sapien
actgtttctccatcttgactcagac

SEQ ID NO: 322311 - DNA, 25 bp, Homo sapien
ttctccatcttgactcagacagttc

SEQ ID NO: 322312 - DNA, 25 bp, Homo sapien
ctttagtagcttgggctgcagcctc

SEQ ID NO: 322313 - DNA, 25 bp, Homo sapien
gggctttttgtgtgatccctcttgg

SEQ ID NO: 322314 - DNA, 25 bp, Homo sapien
tgtgatccctcttggtgtgagtttt

SEQ ID NO: 322315 - DNA, 25 bp, Homo sapien
atccctcttggtgtgagttttctga

SEQ ID NO: 322316 - DNA, 25 bp, Homo sapien
ggtgtgagttttctgacccaaccag

SEQ ID NO: 322317 - DNA, 25 bp, Homo sapien
tgtgagttttctgacccaaccagcc

SEQ ID NO: 322318 - DNA, 25 bp, Homo sapien
gtatgttattactgatgcctcacat

SEQ ID NO: 322319 - DNA, 25 bp, Homo sapien
tttatgtcacactatttcagataag

SEQ ID NO: 322320 - DNA, 25 bp, Homo sapien
aaaaatcccataaagtgtgactaca

SEQ ID NO: 322321 - DNA, 25 bp, Homo sapien
gactacactgtatttctaatcttga

SEQ ID NO: 322322 - DNA, 25 bp, Homo sapien
gaaaatctttatcttacatccctgg

SEQ ID NO: 322323 - DNA, 25 bp, Homo sapien
tctttatcttacatccctggttaca

SEQ ID NO: 322324 - DNA, 25 bp, Homo sapien
catccctggttacattgtacctaga

SEQ ID NO: 322325 - DNA, 25 bp, Homo sapien
acattgtacctagaagtgaccctca

SEQ ID NO: 322326 - DNA, 25 bp, Homo sapien
gtacctagaagtgaccctcaaattt

SEQ ID NO: 322327 - DNA, 25 bp, Homo sapien
tagaagtgaccctcaaatttttaat

SEQ ID NO: 322328 - DNA, 25 bp, Homo sapien
tactgagtccctaaactataatatt

SEQ ID NO: 322329 - DNA, 25 bp, Homo sapien
atgaataatgcttcaatttcctaaa

SEQ ID NO: 322330 - DNA, 25 bp, Homo sapien
tcctaaatgccaaaatggtacacat

SEQ ID NO: 322331 - DNA, 25 bp, Homo sapien
atggtacacattagacatttgttta

SEQ ID NO: 322332 - DNA, 25 bp, Homo sapien
taaacttccttgaatgggtgttact

SEQ ID NO: 322333 - DNA, 25 bp, Homo sapien
agaggttaaggctaggcttctagag

SEQ ID NO: 322334 - DNA, 25 bp, Homo sapien
ttaaggctaggcttctagaggtgtt

SEQ ID NO: 322335 - DNA, 25 bp, Homo sapien
gctaggcttctagaggtgttaagtc

SEQ ID NO: 322336 - DNA, 25 bp, Homo sapien
ggcttctagaggtgttaagtcatct

SEQ ID NO: 322337 - DNA, 25 bp, Homo sapien
aggtgttaagtcatctctgatagca

SEQ ID NO: 322338 - DNA, 25 bp, Homo sapien
tgttaagtcatctctgatagcagtg

SEQ ID NO: 322339 - DNA, 25 bp, Homo sapien
agtcatctctgatagcagtgtatcc

SEQ ID NO: 322340 - DNA, 25 bp, Homo sapien
agtggaactgactttggtggtgcca

SEQ ID NO: 322341 - DNA, 25 bp, Homo sapien
ggtgccatcagttagttaagccata

SEQ ID NO: 322342 - DNA, 25 bp, Homo sapien
accttggaggcattttgacccacga

SEQ ID NO: 322343 - DNA, 25 bp, Homo sapien
atttcgcattctctactgtactgga

SEQ ID NO: 322344 - DNA, 25 bp, Homo sapien
ggcattttgacccacgaagtagcat

SEQ ID NO: 322345 - DNA, 25 bp, Homo sapien
ctataatttgattcttacgcatttt

SEQ ID NO: 322346 - DNA, 25 bp, Homo sapien
tactactttcaaatcacatcctctt

SEQ ID NO: 322347 - DNA, 25 bp, Homo sapien
gacccacgaagtagcatagatatgt

SEQ ID NO: 322348 - DNA, 25 bp, Homo sapien
cttccagacatgcagtattcttgtg

SEQ ID NO: 322349 - DNA, 25 bp, Homo sapien
attcttgtgcggacatttgcagcca

SEQ ID NO: 322350 - DNA, 25 bp, Homo sapien
acatttgcagccagtcagtggaact

SEQ ID NO: 322351 - DNA, 25 bp, Homo sapien
ataaaccacttagatcagcttagat

SEQ ID NO: 322352 - DNA, 25 bp, Homo sapien
gatggatataagtcaatcgacccaa

SEQ ID NO: 322353 - DNA, 25 bp, Homo sapien
cattattgcatatgtcctgtagaca

SEQ ID NO: 322354 - DNA, 25 bp, Homo sapien
gtcaatcgacccaaatggcaaatgt

SEQ ID NO: 322355 - DNA, 25 bp, Homo sapien
gtgaatcacacaggcatacagtgag

SEQ ID NO: 322356 - DNA, 25 bp, Homo sapien
gggccctgaaatgctaagctggaac

SEQ ID NO: 322357 - DNA, 25 bp, Homo sapien
actagagtctaagatggctttacca

SEQ ID NO: 322358 - DNA, 25 bp, Homo sapien
tatgtcctgtagacaagcctcagaa

SEQ ID NO: 322359 - DNA, 25 bp, Homo sapien
accaaaaacatacttcccaggccat

SEQ ID NO: 322360 - DNA, 25 bp, Homo sapien
cccaggccatgcacctatatgtgaa

SEQ ID NO: 322361 - DNA, 25 bp, Homo sapien
gtttaaacataaccttgtatggctg

SEQ ID NO: 322362 - DNA, 25 bp, Homo sapien
atatcaaattggttctataaatagt

SEQ ID NO: 322363 - DNA, 25 bp, Homo sapien
gaatatatccatacttaacatcata

SEQ ID NO: 322364 - DNA, 25 bp, Homo sapien
aatgataaatttcatctggatgtgt

SEQ ID NO: 322365 - DNA, 25 bp, Homo sapien
aaatttcatctggatgtgttattat

SEQ ID NO: 322366 - DNA, 25 bp, Homo sapien
aaaatatccatgtaacatagcttcc

SEQ ID NO: 322367 - DNA, 25 bp, Homo sapien
gtaacatagcttccattactccata

SEQ ID NO: 322368 - DNA, 25 bp, Homo sapien
acatagcttccattactccatattt

SEQ ID NO: 322369 - DNA, 25 bp, Homo sapien
tagcttccattactccatattttat

SEQ ID NO: 322370 - DNA, 25 bp, Homo sapien
gaaagattggaatagtaaccgtgta

SEQ ID NO: 322371 - DNA, 25 bp, Homo sapien
gattggaatagtaaccgtgtatgat

SEQ ID NO: 322372 - DNA, 25 bp, Homo sapien
aatagtaaccgtgtatgataaatgt

SEQ ID NO: 322373 - DNA, 25 bp, Homo sapien
aagtcttaaggctctgtgttagtga

SEQ ID NO: 322374 - DNA, 25 bp, Homo sapien
ctgtgttagtgatagatgtggccat

SEQ ID NO: 322375 - DNA, 25 bp, Homo sapien
ggtgtaggcagtgcaatgtcttcga

SEQ ID NO: 322376 - DNA, 25 bp, Homo sapien
tgcaatgtcttcgagtgagagtgaa

SEQ ID NO: 322377 - DNA, 25 bp, Homo sapien
gaaggtggtaactcattgcatggat

SEQ ID NO: 322378 - DNA, 25 bp, Homo sapien
cattgcatggattctagagttctgt

SEQ ID NO: 322379 - DNA, 25 bp, Homo sapien
gtttattctaatccaagttcttcca

SEQ ID NO: 322380 - DNA, 25 bp, Homo sapien
aaaacaatgttcttcctctcattga

SEQ ID NO: 322381 - DNA, 25 bp, Homo sapien
gagtctcattcctcatctataggat

SEQ ID NO: 322382 - DNA, 25 bp, Homo sapien
aataagagcatgtacctggcaggtt

SEQ ID NO: 322383 - DNA, 25 bp, Homo sapien
agtgcttgcaactttgaataccaaa

SEQ ID NO: 322384 - DNA, 25 bp, Homo sapien
gcttctagtagacctaatcttagca

SEQ ID NO: 322385 - DNA, 25 bp, Homo sapien
gacctaatcttagcatagttgaacc

SEQ ID NO: 322386 - DNA, 25 bp, Homo sapien
atagttgaacctcctgcacatggga

SEQ ID NO: 322387 - DNA, 25 bp, Homo sapien
tgaacctcctgcacatgggaagggt

SEQ ID NO: 322388 - DNA, 25 bp, Homo sapien
ggtgggtattttccccagacctgat

SEQ ID NO: 322389 - DNA, 25 bp, Homo sapien
ccagacctgattccttgcatgagat

SEQ ID NO: 322390 - DNA, 25 bp, Homo sapien
cctgattccttgcatgagatagaga

SEQ ID NO: 322391 - DNA, 25 bp, Homo sapien
atatatatcgtcatgtgggagcact

SEQ ID NO: 322392 - DNA, 25 bp, Homo sapien
atcgtcatgtgggagcactaagcag

SEQ ID NO: 322393 - DNA, 25 bp, Homo sapien
ggagcactaagcagggagagtatat

SEQ ID NO: 322394 - DNA, 25 bp, Homo sapien
gtatatgtgatcatacccaaacggt

SEQ ID NO: 322395 - DNA, 25 bp, Homo sapien
gtccgatgcccacacagtggctgtg

SEQ ID NO: 322396 - DNA, 25 bp, Homo sapien
gctgtgctgagtgacgtgttgtttt

SEQ ID NO: 322397 - DNA, 25 bp, Homo sapien
tgttgttttgaggatgtccctaccc

SEQ ID NO: 322398 - DNA, 25 bp, Homo sapien
tggtcttgccgtcggtctccagtac

SEQ ID NO: 322399 - DNA, 25 bp, Homo sapien
gtctccagtacccagcgaagcaagc

SEQ ID NO: 322400 - DNA, 25 bp, Homo sapien
ccagcgaagcaagctgtgggctctg

SEQ ID NO: 322401 - DNA, 25 bp, Homo sapien
tctgaggagctcacaccagggagga

SEQ ID NO: 322402 - DNA, 25 bp, Homo sapien
ggagctgccctggagtggagcaaca

SEQ ID NO: 322403 - DNA, 25 bp, Homo sapien
tcccctgtgtgactgcagtgctata

SEQ ID NO: 322404 - DNA, 25 bp, Homo sapien
gtgtgactgcagtgctataataata

SEQ ID NO: 322405 - DNA, 25 bp, Homo sapien
ggagtctgatcatctgtccgatgcc

SEQ ID NO: 322406 - DNA, 25 bp, Homo sapien
agcccaataggcaggtgctcacata

SEQ ID NO: 322407 - DNA, 25 bp, Homo sapien
aggcaggtgctcacatatttgctga

SEQ ID NO: 322408 - DNA, 25 bp, Homo sapien
aggtgctcacatatttgctgaagga

SEQ ID NO: 322409 - DNA, 25 bp, Homo sapien
gaaagacaaaagctcctctgaagtt

SEQ ID NO: 322410 - DNA, 25 bp, Homo sapien
agctcctctgaagttttagactata

SEQ ID NO: 322411 - DNA, 25 bp, Homo sapien
gagaaattctgttctagtcccagtg

SEQ ID NO: 322412 - DNA, 25 bp, Homo sapien
attctgttctagtcccagtgaagca

SEQ ID NO: 322413 - DNA, 25 bp, Homo sapien
ctgttctagtcccagtgaagcagga

SEQ ID NO: 322414 - DNA, 25 bp, Homo sapien
agggttgcaaacttgaggctggtaa

SEQ ID NO: 322415 - DNA, 25 bp, Homo sapien
gactcatctttgtgccacaacatgt

SEQ ID NO: 322416 - DNA, 25 bp, Homo sapien
gtgccacaacatgtaagcccaatag

SEQ ID NO: 322417 - DNA, 25 bp, Homo sapien
gaggctaaggtgtttggccacatat

SEQ ID NO: 322418 - DNA, 25 bp, Homo sapien
ggccacatattgctttaggttcatc

SEQ ID NO: 322419 - DNA, 25 bp, Homo sapien
taggttcatctccattggtctcagt

SEQ ID NO: 322420 - DNA, 25 bp, Homo sapien
gtctcagtgtggacataactcctgg

SEQ ID NO: 322421 - DNA, 25 bp, Homo sapien
aactcctggaattcactccagtgca

SEQ ID NO: 322422 - DNA, 25 bp, Homo sapien
gagaatgtacttgaaggtttcccaa

SEQ ID NO: 322423 - DNA, 25 bp, Homo sapien
tttctctaaagcagatcctttcagg

SEQ ID NO: 322424 - DNA, 25 bp, Homo sapien
gaaaaggtcccagctgagagaaaaa

SEQ ID NO: 322425 - DNA, 25 bp, Homo sapien
ggcagtttctctaatgcgagcagac

SEQ ID NO: 322426 - DNA, 25 bp, Homo sapien
taatgcgagcagacagaccctgtta

SEQ ID NO: 322427 - DNA, 25 bp, Homo sapien
gacagaccctgttaaccaaggagca

SEQ ID NO: 322428 - DNA, 25 bp, Homo sapien
tggtattgcacatttgcctgctcct

SEQ ID NO: 322429 - DNA, 25 bp, Homo sapien
gtattgcacatttgcctgctcctca

SEQ ID NO: 322430 - DNA, 25 bp, Homo sapien
gggactgactactgcggaagcacga

SEQ ID NO: 322431 - DNA, 25 bp, Homo sapien
tactgcggaagcacgacgccctggg

SEQ ID NO: 322432 - DNA, 25 bp, Homo sapien
ggcactgggcgctcgtacgcactaa

SEQ ID NO: 322433 - DNA, 25 bp, Homo sapien
tgggcgctcgtacgcactaatccgg

SEQ ID NO: 322434 - DNA, 25 bp, Homo sapien
gacggtgctcctggctgcgaaagca

SEQ ID NO: 322435 - DNA, 25 bp, Homo sapien
ggtgctcctggctgcgaaagcagca

SEQ ID NO: 322436 - DNA, 25 bp, Homo sapien
gaaagcagcaggatctcggtcagag

SEQ ID NO: 322437 - DNA, 25 bp, Homo sapien
gggctcggcttcttgctccatcttt

SEQ ID NO: 322438 - DNA, 25 bp, Homo sapien
tgctccatctttccgacacacaggg

SEQ ID NO: 322439 - DNA, 25 bp, Homo sapien
tgaagcttctactgccctggcagct

SEQ ID NO: 322440 - DNA, 25 bp, Homo sapien
gcctgggcccaactcagaaacagga

SEQ ID NO: 322441 - DNA, 25 bp, Homo sapien
aggagccagcagagcactctctcac

SEQ ID NO: 322442 - DNA, 25 bp, Homo sapien
gggcaccctgcttaagtcagtagaa

SEQ ID NO: 322443 - DNA, 25 bp, Homo sapien
aagtcagtagaagctcgctggcact

SEQ ID NO: 322444 - DNA, 25 bp, Homo sapien
gttcctacttttccgaagtactgcg

SEQ ID NO: 322445 - DNA, 25 bp, Homo sapien
gaagtactgcgtcactttgtcgtaa

SEQ ID NO: 322446 - DNA, 25 bp, Homo sapien
cactttgtcgtaagtaatggcccct

SEQ ID NO: 322447 - DNA, 25 bp, Homo sapien
gcagtcaagcttttgggagacctga

SEQ ID NO: 322448 - DNA, 25 bp, Homo sapien
attcacactgggtttctggactgta

SEQ ID NO: 322449 - DNA, 25 bp, Homo sapien
ctggactgtagtattggaagcctta

SEQ ID NO: 322450 - DNA, 25 bp, Homo sapien
agatatatgtttattgctatggata

SEQ ID NO: 322451 - DNA, 25 bp, Homo sapien
attgctatggatatatgttcccaaa

SEQ ID NO: 322452 - DNA, 25 bp, Homo sapien
gatatatgttcccaaaatattattg

SEQ ID NO: 322453 - DNA, 25 bp, Homo sapien
agactacaggatatatgttgaatat

SEQ ID NO: 322454 - DNA, 25 bp, Homo sapien
gaatatgagctcatttataacattg

SEQ ID NO: 322455 - DNA, 25 bp, Homo sapien
gagctcatttataacattgaatatt

SEQ ID NO: 322456 - DNA, 25 bp, Homo sapien
gtatgtttcatagagagatcttcac

SEQ ID NO: 322457 - DNA, 25 bp, Homo sapien
tagagagatcttcaccaaatgttaa

SEQ ID NO: 322458 - DNA, 25 bp, Homo sapien
gatcttcaccaaatgttaaggattt

SEQ ID NO: 322459 - DNA, 25 bp, Homo sapien
tatttgggtgatctttacattcttc

SEQ ID NO: 322460 - DNA, 25 bp, Homo sapien
ggtgatctttacattcttcagactc

SEQ ID NO: 322461 - DNA, 25 bp, Homo sapien
gtccgatgcccacacagtggctgtg

SEQ ID NO: 322462 - DNA, 25 bp, Homo sapien
gctgtgctgagtgacgtgttgtttt

SEQ ID NO: 322463 - DNA, 25 bp, Homo sapien
tgttttgaggatgtccctaccccct

SEQ ID NO: 322464 - DNA, 25 bp, Homo sapien
tggtcttgccgtcggtctccagtac

SEQ ID NO: 322465 - DNA, 25 bp, Homo sapien
gtctccagtacccagcgaagcaagc

SEQ ID NO: 322466 - DNA, 25 bp, Homo sapien
ccagcgaagcaagctgtgggctctg

SEQ ID NO: 322467 - DNA, 25 bp, Homo sapien
tctcccctgtgtgactgcagtgcta

SEQ ID NO: 322468 - DNA, 25 bp, Homo sapien
cccctgtgtgactgcagtgctataa

SEQ ID NO: 322469 - DNA, 25 bp, Homo sapien
gtgtgactgcagtgctataataata

SEQ ID NO: 322470 - DNA, 25 bp, Homo sapien
ggagtctgatcatctgtccgatgcc

SEQ ID NO: 322471 - DNA, 25 bp, Homo sapien
agtctgatcatctgtccgatgccca

SEQ ID NO: 322472 - DNA, 25 bp, Homo sapien
cacagcagtcctgcgggagttttaa

SEQ ID NO: 322473 - DNA, 25 bp, Homo sapien
gagttttaagggatgcacggagttt

SEQ ID NO: 322474 - DNA, 25 bp, Homo sapien
gaaaattgacattcatgtgacttag

SEQ ID NO: 322475 - DNA, 25 bp, Homo sapien
gtgacttagagtcctactacttgaa

SEQ ID NO: 322476 - DNA, 25 bp, Homo sapien
aaatggattccagctctcaacgaat

SEQ ID NO: 322477 - DNA, 25 bp, Homo sapien
ctcaacgaatttagagctttggcaa

SEQ ID NO: 322478 - DNA, 25 bp, Homo sapien
gatttctttgatgtccgatgtgctc

SEQ ID NO: 322479 - DNA, 25 bp, Homo sapien
ccgatgtgctcatttcttggtttgt

SEQ ID NO: 322480 - DNA, 25 bp, Homo sapien
cttggtttgttcttgagtattttgt

SEQ ID NO: 322481 - DNA, 25 bp, Homo sapien
aatgaatgggacactttcccataaa

SEQ ID NO: 322482 - DNA, 25 bp, Homo sapien
gttgtaattctgtattgctgtttta

SEQ ID NO: 322483 - DNA, 25 bp, Homo sapien
aggagtgcccctcccgttgtcacgt

SEQ ID NO: 322484 - DNA, 25 bp, Homo sapien
tgggtatctggagcagttgcagcct

SEQ ID NO: 322485 - DNA, 25 bp, Homo sapien
atctggagcagttgcagcctcgctt

SEQ ID NO: 322486 - DNA, 25 bp, Homo sapien
gttgcagcctcgcttccggaaggaa

SEQ ID NO: 322487 - DNA, 25 bp, Homo sapien
gcagcctcgcttccggaaggaaacg

SEQ ID NO: 322488 - DNA, 25 bp, Homo sapien
ggcacagggaccacctgccagtgcg

SEQ ID NO: 322489 - DNA, 25 bp, Homo sapien
ctgccagtgcgttccagccgggctg

SEQ ID NO: 322490 - DNA, 25 bp, Homo sapien
agccgggctgccatccacactggag

SEQ ID NO: 322491 - DNA, 25 bp, Homo sapien
ccgcggtcgggagtgaatggcgctc

SEQ ID NO: 322492 - DNA, 25 bp, Homo sapien
cgcacgtggtcctcgggctcggatt

SEQ ID NO: 322493 - DNA, 25 bp, Homo sapien
ggctcggattcagctgtcgcaggat

SEQ ID NO: 322494 - DNA, 25 bp, Homo sapien
cagtctgaggattttccctggatgt

SEQ ID NO: 322495 - DNA, 25 bp, Homo sapien
ctggatgtagcctctcagtgctaaa

SEQ ID NO: 322496 - DNA, 25 bp, Homo sapien
gttgacaagagctaacaccaggtgt

SEQ ID NO: 322497 - DNA, 25 bp, Homo sapien
gcctctcagtgctaaaatgggacag

SEQ ID NO: 322498 - DNA, 25 bp, Homo sapien
aggcaaaccaggtcagttggtcact

SEQ ID NO: 322499 - DNA, 25 bp, Homo sapien
ttggtcactctactcagtgagcccc

SEQ ID NO: 322500 - DNA, 25 bp, Homo sapien
ccccgtgctgtgttcaaattttcct

SEQ ID NO: 322501 - DNA, 25 bp, Homo sapien
gttcaaattttcctcttaacagatg

SEQ ID NO: 322502 - DNA, 25 bp, Homo sapien
ttagaaaccaccatttctctgtgcc

SEQ ID NO: 322503 - DNA, 25 bp, Homo sapien
ttaagcgaagacaccctgccagatg

SEQ ID NO: 322504 - DNA, 25 bp, Homo sapien
tgccagatgtgtcttgttcccttga

SEQ ID NO: 322505 - DNA, 25 bp, Homo sapien
gtgacggcaaactcgcggccagcca

SEQ ID NO: 322506 - DNA, 25 bp, Homo sapien
gccagccacgcggtagaagctgagc

SEQ ID NO: 322507 - DNA, 25 bp, Homo sapien
tggtcaggaaagaagccctcacccg

SEQ ID NO: 322508 - DNA, 25 bp, Homo sapien
atctcgtcccggaagcagctgacca

SEQ ID NO: 322509 - DNA, 25 bp, Homo sapien
gaagcagctgaccacatcccgcttg

SEQ ID NO: 322510 - DNA, 25 bp, Homo sapien
catcccgcttgtccagcagcagaaa

SEQ ID NO: 322511 - DNA, 25 bp, Homo sapien
agaaacggcacgatggccgcggcct

SEQ ID NO: 322512 - DNA, 25 bp, Homo sapien
atggccgcggcctgccacagcggat

SEQ ID NO: 322513 - DNA, 25 bp, Homo sapien
cacagcggatgctcccgggacagca

SEQ ID NO: 322514 - DNA, 25 bp, Homo sapien
actacaggaggttcaccgtggccac

SEQ ID NO: 322515 - DNA, 25 bp, Homo sapien
tgcttgcagccggtgacggcaaact

SEQ ID NO: 322516 - DNA, 25 bp, Homo sapien
ttttctcaagcctcaatcaagcgtc

SEQ ID NO: 322517 - DNA, 25 bp, Homo sapien
atcaagcgtccattctgttttttct

SEQ ID NO: 322518 - DNA, 25 bp, Homo sapien
ttgaatgctcattttctcacctggt

SEQ ID NO: 322519 - DNA, 25 bp, Homo sapien
ctcacctggtttcagttacaaactg

SEQ ID NO: 322520 - DNA, 25 bp, Homo sapien
aactggttttgatcattctgcaatc

SEQ ID NO: 322521 - DNA, 25 bp, Homo sapien
tctgcaatctacagttccatcatcc

SEQ ID NO: 322522 - DNA, 25 bp, Homo sapien
gatagaaaaatctctcctggcatgt

SEQ ID NO: 322523 - DNA, 25 bp, Homo sapien
cctggcatgttctcccaatattgga

SEQ ID NO: 322524 - DNA, 25 bp, Homo sapien
tgaggcatcgcaaaatgtcagcatt

SEQ ID NO: 322525 - DNA, 25 bp, Homo sapien
tgaggctgaaaagctcggctccact

SEQ ID NO: 322526 - DNA, 25 bp, Homo sapien
cacttatgccaccattttctcaagc

SEQ ID NO: 322527 - DNA, 25 bp, Homo sapien
gtgagaggacttatattcctacatc

SEQ ID NO: 322528 - DNA, 25 bp, Homo sapien
attcctacatcaagttactactgag

SEQ ID NO: 322529 - DNA, 25 bp, Homo sapien
tttgagttttatcccgtaagttctg

SEQ ID NO: 322530 - DNA, 25 bp, Homo sapien
taaatgttcatgttacataccaaat

SEQ ID NO: 322531 - DNA, 25 bp, Homo sapien
aatttgtcttttgctatattctcca

SEQ ID NO: 322532 - DNA, 25 bp, Homo sapien
gctatattctccaagattatctctt

SEQ ID NO: 322533 - DNA, 25 bp, Homo sapien
gattatctcttaagaccatatgccc

SEQ ID NO: 322534 - DNA, 25 bp, Homo sapien
atatgccccctgttttaatgtttct

SEQ ID NO: 322535 - DNA, 25 bp, Homo sapien
gtttcttacatcttgtttttactca

SEQ ID NO: 322536 - DNA, 25 bp, Homo sapien
gtttttactcatttctgactggaca

SEQ ID NO: 322537 - DNA, 25 bp, Homo sapien
tcatttctgactggacaaagttctt

SEQ ID NO: 322538 - DNA, 25 bp, Homo sapien
tggaaagaatggcttcttgcagagc

SEQ ID NO: 322539 - DNA, 25 bp, Homo sapien
ctccccttggagaagcacttgcaaa

SEQ ID NO: 322540 - DNA, 25 bp, Homo sapien
gaagcacttgcaaagcagagtttga

SEQ ID NO: 322541 - DNA, 25 bp, Homo sapien
cagagtttgaggactcagacaccga

SEQ ID NO: 322542 - DNA, 25 bp, Homo sapien
ctcagacaccgaaaccagtagcagt

SEQ ID NO: 322543 - DNA, 25 bp, Homo sapien
gaaacatcagatgacgatgcctgga

SEQ ID NO: 322544 - DNA, 25 bp, Homo sapien
gtaggcatataaatgctcacagtta

SEQ ID NO: 322545 - DNA, 25 bp, Homo sapien
tgctcacagttaaatctgacccagt

SEQ ID NO: 322546 - DNA, 25 bp, Homo sapien
ctgacccagtaaactctgtgtgttt

SEQ ID NO: 322547 - DNA, 25 bp, Homo sapien
tttcttatgttgttgaatacttcat

SEQ ID NO: 322548 - DNA, 25 bp, Homo sapien
gaatacttcattcacaagggaaata

SEQ ID NO: 322549 - DNA, 25 bp, Homo sapien
ccctgcgcgggagctggttggctcc

SEQ ID NO: 322550 - DNA, 25 bp, Homo sapien
gctggttggctcctggtgctcccca

SEQ ID NO: 322551 - DNA, 25 bp, Homo sapien
ctggttggctcctggtgctccccac

SEQ ID NO: 322552 - DNA, 25 bp, Homo sapien
tggttggctcctggtgctccccacc

SEQ ID NO: 322553 - DNA, 25 bp, Homo sapien
ggttggctcctggtgctccccaccc

SEQ ID NO: 322554 - DNA, 25 bp, Homo sapien
gttggctcctggtgctccccacccc

SEQ ID NO: 322555 - DNA, 25 bp, Homo sapien
ccggccgccctcgtacccaccagag

SEQ ID NO: 322556 - DNA, 25 bp, Homo sapien
ggccgccctcgtacccaccagagcc

SEQ ID NO: 322557 - DNA, 25 bp, Homo sapien
gccgccctcgtacccaccagagcct

SEQ ID NO: 322558 - DNA, 25 bp, Homo sapien
ctctgtcaaggagcggggcatggca

SEQ ID NO: 322559 - DNA, 25 bp, Homo sapien
tcaaggagcggggcatggcatcgaa

SEQ ID NO: 322560 - DNA, 25 bp, Homo sapien
cacccctgctgcctgaagtggtagc

SEQ ID NO: 322561 - DNA, 25 bp, Homo sapien
acccctgctgcctgaagtggtagcc

SEQ ID NO: 322562 - DNA, 25 bp, Homo sapien
cctgctgcctgaagtggtagccccg

SEQ ID NO: 322563 - DNA, 25 bp, Homo sapien
tgctgcctgaagtggtagccccgcc

SEQ ID NO: 322564 - DNA, 25 bp, Homo sapien
gctgcctgaagtggtagccccgcct

SEQ ID NO: 322565 - DNA, 25 bp, Homo sapien
tgcctgaagtggtagccccgcctgc

SEQ ID NO: 322566 - DNA, 25 bp, Homo sapien
gcctgaagtggtagccccgcctgct

SEQ ID NO: 322567 - DNA, 25 bp, Homo sapien
ctgaagtggtagccccgcctgctgc

SEQ ID NO: 322568 - DNA, 25 bp, Homo sapien
tgaagtggtagccccgcctgctgct

SEQ ID NO: 322569 - DNA, 25 bp, Homo sapien
gaagtggtagccccgcctgctgctt

SEQ ID NO: 322570 - DNA, 25 bp, Homo sapien
aagtggtagccccgcctgctgcttc

SEQ ID NO: 322571 - DNA, 25 bp, Homo sapien
agacactattttgcactgcctacca

SEQ ID NO: 322572 - DNA, 25 bp, Homo sapien
tgcctaccaaccctggcgaacagtt

SEQ ID NO: 322573 - DNA, 25 bp, Homo sapien
aaccctggcgaacagttctacatgt

SEQ ID NO: 322574 - DNA, 25 bp, Homo sapien
tggcgaacagttctacatgttttgt

SEQ ID NO: 322575 - DNA, 25 bp, Homo sapien
catgttttgtactcttgctgcttgg

SEQ ID NO: 322576 - DNA, 25 bp, Homo sapien
tttgtactcttgctgcttggttgat

SEQ ID NO: 322577 - DNA, 25 bp, Homo sapien
actcttgctgcttggttgattaata

SEQ ID NO: 322578 - DNA, 25 bp, Homo sapien
ttgattaataaagcgggacgtccct

SEQ ID NO: 322579 - DNA, 25 bp, Homo sapien
taaagcgggacgtccctttgagcag

SEQ ID NO: 322580 - DNA, 25 bp, Homo sapien
acgtccctttgagcagcctcaagaa

SEQ ID NO: 322581 - DNA, 25 bp, Homo sapien
gagcagcctcaagaatatgatgacc

SEQ ID NO: 322582 - DNA, 25 bp, Homo sapien
ccagccgtcgcttcaagagggtggt

SEQ ID NO: 322583 - DNA, 25 bp, Homo sapien
cttcaagagggtggtggagaccatc

SEQ ID NO: 322584 - DNA, 25 bp, Homo sapien
gggtgctgggcttaagggccagaag

SEQ ID NO: 322585 - DNA, 25 bp, Homo sapien
gggccagaaggtggccaccagctac

SEQ ID NO: 322586 - DNA, 25 bp, Homo sapien
gagagtagcctctgacgctggcaga

SEQ ID NO: 322587 - DNA, 25 bp, Homo sapien
gagtagcctctgacgctggcagaca

SEQ ID NO: 322588 - DNA, 25 bp, Homo sapien
tagcctctgacgctggcagacacca

SEQ ID NO: 322589 - DNA, 25 bp, Homo sapien
tctgacgctggcagacaccactaac

SEQ ID NO: 322590 - DNA, 25 bp, Homo sapien
gctggcagacaccactaactgtatg

SEQ ID NO: 322591 - DNA, 25 bp, Homo sapien
cagacaccactaactgtatggaaat

SEQ ID NO: 322592 - DNA, 25 bp, Homo sapien
ctaactgtatggaaatgatgacggg

SEQ ID NO: 322593 - DNA, 25 bp, Homo sapien
acccactggtgccaagtgagtttgc

SEQ ID NO: 322594 - DNA, 25 bp, Homo sapien
actggtgccaagtgagtttgccgtt

SEQ ID NO: 322595 - DNA, 25 bp, Homo sapien
tgccaagtgagtttgccgttctcat

SEQ ID NO: 322596 - DNA, 25 bp, Homo sapien
gagtttgccgttctcatggtaacag

SEQ ID NO: 322597 - DNA, 25 bp, Homo sapien
gccgttctcatggtaacagctggaa

SEQ ID NO: 322598 - DNA, 25 bp, Homo sapien
aacagctggaaattactgccccttt

SEQ ID NO: 322599 - DNA, 25 bp, Homo sapien
ataacctcctccttaatttgtatat

SEQ ID NO: 322600 - DNA, 25 bp, Homo sapien
acctcctccttaatttgtatatagt

SEQ ID NO: 322601 - DNA, 25 bp, Homo sapien
ataaggagcagtacctctgctgcca

SEQ ID NO: 322602 - DNA, 25 bp, Homo sapien
gagcagtacctctgctgccactgtg

SEQ ID NO: 322603 - DNA, 25 bp, Homo sapien
cactgtgcacagctgcttaaataaa

SEQ ID NO: 322604 - DNA, 25 bp, Homo sapien
cagttggcctaaggtggttgtgctc

SEQ ID NO: 322605 - DNA, 25 bp, Homo sapien
gttgtgctcggagggtttcttgttt

SEQ ID NO: 322606 - DNA, 25 bp, Homo sapien
aatagcttctaagagtccggcggca

SEQ ID NO: 322607 - DNA, 25 bp, Homo sapien
agagtccggcggcatctgtcttgtc

SEQ ID NO: 322608 - DNA, 25 bp, Homo sapien
tctgtcttgtccctattcctgcagc

SEQ ID NO: 322609 - DNA, 25 bp, Homo sapien
cctgcagcctgtgctgagggtagca

SEQ ID NO: 322610 - DNA, 25 bp, Homo sapien
cagtgtatgagctaccagcgtgcat

SEQ ID NO: 322611 - DNA, 25 bp, Homo sapien
gagctaccagcgtgcatgtcagcga

SEQ ID NO: 322612 - DNA, 25 bp, Homo sapien
atgtcagcgaccctggcccgacagg

SEQ ID NO: 322613 - DNA, 25 bp, Homo sapien
ccctgtcgtgttctgtgttagtgat

SEQ ID NO: 322614 - DNA, 25 bp, Homo sapien
gttagtgatcactgcctttaataca

SEQ ID NO: 322615 - DNA, 25 bp, Homo sapien
ccgtcgcttcaagagggtggtggag

SEQ ID NO: 322616 - DNA, 25 bp, Homo sapien
cgtcgcttcaagagggtggtggaga

SEQ ID NO: 322617 - DNA, 25 bp, Homo sapien
gcttcaagagggtggtggagaccat

SEQ ID NO: 322618 - DNA, 25 bp, Homo sapien
cagacaccactaactgtatggaaat

SEQ ID NO: 322619 - DNA, 25 bp, Homo sapien
agacaccactaactgtatggaaatg

SEQ ID NO: 322620 - DNA, 25 bp, Homo sapien
gacaccactaactgtatggaaatga

SEQ ID NO: 322621 - DNA, 25 bp, Homo sapien
acaccactaactgtatggaaatgat

SEQ ID NO: 322622 - DNA, 25 bp, Homo sapien
caccactaactgtatggaaatgatg

SEQ ID NO: 322623 - DNA, 25 bp, Homo sapien
cactaactgtatggaaatgatgacg

SEQ ID NO: 322624 - DNA, 25 bp, Homo sapien
actaactgtatggaaatgatgacgg

SEQ ID NO: 322625 - DNA, 25 bp, Homo sapien
ctaactgtatggaaatgatgacggg

SEQ ID NO: 322626 - DNA, 25 bp, Homo sapien
aaactcgtctgtggccggtatgagt

SEQ ID NO: 322627 - DNA, 25 bp, Homo sapien
gcccgccgggcgcacggaaataact

SEQ ID NO: 322628 - DNA, 25 bp, Homo sapien
gccgggcgcacggaaataactttga

SEQ ID NO: 322629 - DNA, 25 bp, Homo sapien
actttgaaactcaagcgcgttggga

SEQ ID NO: 322630 - DNA, 25 bp, Homo sapien
aaactcaagcgcgttgggaatcgga

SEQ ID NO: 322631 - DNA, 25 bp, Homo sapien
ctcaagcgcgttgggaatcggaagt

SEQ ID NO: 322632 - DNA, 25 bp, Homo sapien
gcgctgctctttgttcggcgccagg

SEQ ID NO: 322633 - DNA, 25 bp, Homo sapien
ggaggccggctcacggccctcgaaa

SEQ ID NO: 322634 - DNA, 25 bp, Homo sapien
tcacggccctcgaaactcgtctgtg

SEQ ID NO: 322635 - DNA, 25 bp, Homo sapien
ctcgaaactcgtctgtggccggtat

SEQ ID NO: 322636 - DNA, 25 bp, Homo sapien
cgaaactcgtctgtggccggtatga

SEQ ID NO: 322637 - DNA, 25 bp, Homo sapien
tcggggctgatctttgagttttcaa

SEQ ID NO: 322638 - DNA, 25 bp, Homo sapien
gggtgcagagacgtttaggtaaact

SEQ ID NO: 322639 - DNA, 25 bp, Homo sapien
taggtaaactcttaccgtcctctct

SEQ ID NO: 322640 - DNA, 25 bp, Homo sapien
cttcgtcagggcttcccaggaatca

SEQ ID NO: 322641 - DNA, 25 bp, Homo sapien
gattgtagaaatagcttaacccttt

SEQ ID NO: 322642 - DNA, 25 bp, Homo sapien
ctttcatttaccaacgtggaaattg

SEQ ID NO: 322643 - DNA, 25 bp, Homo sapien
ttaccaacgtggaaattgaagccca

SEQ ID NO: 322644 - DNA, 25 bp, Homo sapien
ggagagccatcagcagaaagagacc

SEQ ID NO: 322645 - DNA, 25 bp, Homo sapien
gaccctgagatcttcgcctgggatt

SEQ ID NO: 322646 - DNA, 25 bp, Homo sapien
ccaggaagtccagcccgagctgatt

SEQ ID NO: 322647 - DNA, 25 bp, Homo sapien
gtccagcccgagctgattcacagaa

SEQ ID NO: 322648 - DNA, 25 bp, Homo sapien
ttgctgaggtttggcggatcagaca

SEQ ID NO: 322649 - DNA, 25 bp, Homo sapien
tgaggtttggcggatcagacagcgt

SEQ ID NO: 322650 - DNA, 25 bp, Homo sapien
aggtttggcggatcagacagcgtga

SEQ ID NO: 322651 - DNA, 25 bp, Homo sapien
ttggcggatcagacagcgtgaggct

SEQ ID NO: 322652 - DNA, 25 bp, Homo sapien
gcggatcagacagcgtgaggctggg

SEQ ID NO: 322653 - DNA, 25 bp, Homo sapien
gagcctacgggagggaactcctcca

SEQ ID NO: 322654 - DNA, 25 bp, Homo sapien
gcctacgggagggaactcctccagg

SEQ ID NO: 322655 - DNA, 25 bp, Homo sapien
ggagggaactcctccaggttgctga

SEQ ID NO: 322656 - DNA, 25 bp, Homo sapien
gagggaactcctccaggttgctgag

SEQ ID NO: 322657 - DNA, 25 bp, Homo sapien
agggaactcctccaggttgctgagg

SEQ ID NO: 322658 - DNA, 25 bp, Homo sapien
caggttgctgaggtttggcggatca

SEQ ID NO: 322659 - DNA, 25 bp, Homo sapien
gctctgtaaatctctgcagtcttaa

SEQ ID NO: 322660 - DNA, 25 bp, Homo sapien
gtaaatctctgcagtcttaatgttg

SEQ ID NO: 322661 - DNA, 25 bp, Homo sapien
gacagcaatgccatatattactgga

SEQ ID NO: 322662 - DNA, 25 bp, Homo sapien
ttcttcccggtcatttaattctgtc

SEQ ID NO: 322663 - DNA, 25 bp, Homo sapien
taattctgtcacacataatgtcact

SEQ ID NO: 322664 - DNA, 25 bp, Homo sapien
agtgaatgtcatcttcttgcctgtc

SEQ ID NO: 322665 - DNA, 25 bp, Homo sapien
tcttcttgcctgtcaaattcactaa

SEQ ID NO: 322666 - DNA, 25 bp, Homo sapien
tgacaactgcctgtcgtcactgaag

SEQ ID NO: 322667 - DNA, 25 bp, Homo sapien
tccaacaaggtgtacttccagcctt

SEQ ID NO: 322668 - DNA, 25 bp, Homo sapien
ttccagccttccacattgagcgtgg

SEQ ID NO: 322669 - DNA, 25 bp, Homo sapien
gagcgtggtcagaaaaggattttat

SEQ ID NO: 322670 - DNA, 25 bp, Homo sapien
tgaaatttgtcacctttgtcttcac

SEQ ID NO: 322671 - DNA, 25 bp, Homo sapien
ttgtcttcaccattcttttctcttg

SEQ ID NO: 322672 - DNA, 25 bp, Homo sapien
cttttctcttggacagactgttagc

SEQ ID NO: 322673 - DNA, 25 bp, Homo sapien
gactgttagccccttaactcatgta

SEQ ID NO: 322674 - DNA, 25 bp, Homo sapien
aactcatgtacttgccttgacttaa

SEQ ID NO: 322675 - DNA, 25 bp, Homo sapien
gtacttgccttgacttaagttacca

SEQ ID NO: 322676 - DNA, 25 bp, Homo sapien
taagttaccagtctgtccaagagaa

SEQ ID NO: 322677 - DNA, 25 bp, Homo sapien
gatgagcttaaagtagccacacagc

SEQ ID NO: 322678 - DNA, 25 bp, Homo sapien
ggcagcctccactaactgattggaa

SEQ ID NO: 322679 - DNA, 25 bp, Homo sapien
aataagcctatttgccatatctccc

SEQ ID NO: 322680 - DNA, 25 bp, Homo sapien
ccatatctccctgaaactttctatt

SEQ ID NO: 322681 - DNA, 25 bp, Homo sapien
gtcttaaggatttgctttggaaacg

SEQ ID NO: 322682 - DNA, 25 bp, Homo sapien
gatttgctttggaaacgtggcgttt

SEQ ID NO: 322683 - DNA, 25 bp, Homo sapien
gaaacgtggcgtttactaggttatg

SEQ ID NO: 322684 - DNA, 25 bp, Homo sapien
agggtgaaaaggtacattgtttgag

SEQ ID NO: 322685 - DNA, 25 bp, Homo sapien
agtaatctttgacgtatgaacttag

SEQ ID NO: 322686 - DNA, 25 bp, Homo sapien
tgaacttagatgattagcaccctgt

SEQ ID NO: 322687 - DNA, 25 bp, Homo sapien
agatgattagcaccctgtttaagaa

SEQ ID NO: 322688 - DNA, 25 bp, Homo sapien
agcaccctgtttaagaagggtctga

SEQ ID NO: 322689 - DNA, 25 bp, Homo sapien
acttggatcaagtgtgagttgttat

SEQ ID NO: 322690 - DNA, 25 bp, Homo sapien
caagtgtgagttgttatttcatata

SEQ ID NO: 322691 - DNA, 25 bp, Homo sapien
atgatgtttgtaatgggtcttaagg

SEQ ID NO: 322692 - DNA, 25 bp, Homo sapien
tgtccctaccctggttttttgctgg

SEQ ID NO: 322693 - DNA, 25 bp, Homo sapien
aaccactggccttgttgagtatcga

SEQ ID NO: 322694 - DNA, 25 bp, Homo sapien
cttgttgagtatcgatgggccctga

SEQ ID NO: 322695 - DNA, 25 bp, Homo sapien
atgggccctgagctcttctgtttgc

SEQ ID NO: 322696 - DNA, 25 bp, Homo sapien
ttctgtttgcttttggagctcttca

SEQ ID NO: 322697 - DNA, 25 bp, Homo sapien
tttggagctcttcagatgctgtccc

SEQ ID NO: 322698 - DNA, 25 bp, Homo sapien
gagcagccaaaatcccaatacagta

SEQ ID NO: 322699 - DNA, 25 bp, Homo sapien
aatcttgttagcaacagtgacccag

SEQ ID NO: 322700 - DNA, 25 bp, Homo sapien
gagaagtccaatttcaccagaagag

SEQ ID NO: 322701 - DNA, 25 bp, Homo sapien
attttctacccagccattcttggca

SEQ ID NO: 322702 - DNA, 25 bp, Homo sapien
attcttggcattgcaacctccattt

SEQ ID NO: 322703 - DNA, 25 bp, Homo sapien
gaggtgatgaacttgctcactttct

SEQ ID NO: 322704 - DNA, 25 bp, Homo sapien
ctcactttcttttctgatttccctc

SEQ ID NO: 322705 - DNA, 25 bp, Homo sapien
cccaccgaaacccagatatcttata

SEQ ID NO: 322706 - DNA, 25 bp, Homo sapien
gatatcttatagtctaaggcttgta

SEQ ID NO: 322707 - DNA, 25 bp, Homo sapien
gttcacagaaaagctttctttggga

SEQ ID NO: 322708 - DNA, 25 bp, Homo sapien
tagggcttttaagtctaggtgaagt

SEQ ID NO: 322709 - DNA, 25 bp, Homo sapien
gtgaaagttcacacatgtgtttgtt

SEQ ID NO: 322710 - DNA, 25 bp, Homo sapien
atgtgtttgtttggttgctctgtaa

SEQ ID NO: 322711 - DNA, 25 bp, Homo sapien
ggttgctctgtaattagctactagt

SEQ ID NO: 322712 - DNA, 25 bp, Homo sapien
tagctactagtttttatccctagac

SEQ ID NO: 322713 - DNA, 25 bp, Homo sapien
ttttatccctagaccttctctgctc

SEQ ID NO: 322714 - DNA, 25 bp, Homo sapien
ggaaccccatggagaggagcacgtc

SEQ ID NO: 322715 - DNA, 25 bp, Homo sapien
gagaggagcacgtccagcgccgatc

SEQ ID NO: 322716 - DNA, 25 bp, Homo sapien
tccagcgccgatccatgcttgatgg

SEQ ID NO: 322717 - DNA, 25 bp, Homo sapien
tgactttgctgtacagctcctctct

SEQ ID NO: 322718 - DNA, 25 bp, Homo sapien
gtactgagccatggctcagcggcca

SEQ ID NO: 322719 - DNA, 25 bp, Homo sapien
tcagcggccagccatcgccagggaa

SEQ ID NO: 322720 - DNA, 25 bp, Homo sapien
gagcccgagccggatggttcgggaa

SEQ ID NO: 322721 - DNA, 25 bp, Homo sapien
gagaataaccagtcacatgctgcct

SEQ ID NO: 322722 - DNA, 25 bp, Homo sapien
ttcttcctcccgtggatgccaaggc

SEQ ID NO: 322723 - DNA, 25 bp, Homo sapien
tcccgtggatgccaaggctttttgt

SEQ ID NO: 322724 - DNA, 25 bp, Homo sapien
caaggctttttgtgcgcgggctctg

SEQ ID NO: 322725 - DNA, 25 bp, Homo sapien
agctttcctgaaacactccagatac

SEQ ID NO: 322726 - DNA, 25 bp, Homo sapien
gaaacactccagatactgcaaagct

SEQ ID NO: 322727 - DNA, 25 bp, Homo sapien
caaagctatctttattcctctctaa

SEQ ID NO: 322728 - DNA, 25 bp, Homo sapien
ttattcctctctaaaggctataatt

SEQ ID NO: 322729 - DNA, 25 bp, Homo sapien
ttttatcaacacaaagtcagccttt

SEQ ID NO: 322730 - DNA, 25 bp, Homo sapien
atttcctttcactaatacgggatag

SEQ ID NO: 322731 - DNA, 25 bp, Homo sapien
taatacgggatagggaggctccttg

SEQ ID NO: 322732 - DNA, 25 bp, Homo sapien
aggctccttgggtaatgctaaccta

SEQ ID NO: 322733 - DNA, 25 bp, Homo sapien
gggtaatgctaacctatgcaaagaa

SEQ ID NO: 322734 - DNA, 25 bp, Homo sapien
accaaatggtggtagttgctagaat

SEQ ID NO: 322735 - DNA, 25 bp, Homo sapien
gttgctagaattaaagacacgttct

SEQ ID NO: 322736 - DNA, 25 bp, Homo sapien
cttctccccagaaaaagagttctat

SEQ ID NO: 322737 - DNA, 25 bp, Homo sapien
atggctgtagaaataggcactgtcc

SEQ ID NO: 322738 - DNA, 25 bp, Homo sapien
taggcactgtccaggcagttgtttt

SEQ ID NO: 322739 - DNA, 25 bp, Homo sapien
ggtgttttccaagtcatctcagatg

SEQ ID NO: 322740 - DNA, 25 bp, Homo sapien
gtcatctcagatggtgcgtgaaaat

SEQ ID NO: 322741 - DNA, 25 bp, Homo sapien
gtaagcaaatctttcattccagcgc

SEQ ID NO: 322742 - DNA, 25 bp, Homo sapien
caaatctttcattccagcgcttaaa

SEQ ID NO: 322743 - DNA, 25 bp, Homo sapien
attccagcgcttaaaagttttgaga

SEQ ID NO: 322744 - DNA, 25 bp, Homo sapien
tactgattgaagcagccaactccaa

SEQ ID NO: 322745 - DNA, 25 bp, Homo sapien
agcagccaactccaaatataccatc

SEQ ID NO: 322746 - DNA, 25 bp, Homo sapien
taccatcttttagtattgacactta

SEQ ID NO: 322747 - DNA, 25 bp, Homo sapien
agcaatgcagcactctaggaagcct

SEQ ID NO: 322748 - DNA, 25 bp, Homo sapien
tgcagcactctaggaagcctgctag

SEQ ID NO: 322749 - DNA, 25 bp, Homo sapien
tctaggaagcctgctaggcgccctt

SEQ ID NO: 322750 - DNA, 25 bp, Homo sapien
agccctgcagtgtgagtgaacggtt

SEQ ID NO: 322751 - DNA, 25 bp, Homo sapien
tgaacggttatttaggactcacctg

SEQ ID NO: 322752 - DNA, 25 bp, Homo sapien
ggttatttaggactcacctggcact

SEQ ID NO: 322753 - DNA, 25 bp, Homo sapien
tatttaggactcacctggcacttgc

SEQ ID NO: 322754 - DNA, 25 bp, Homo sapien
tggcacttgccctgtggcttaagaa

SEQ ID NO: 322755 - DNA, 25 bp, Homo sapien
gaacaagtagaagcttaaacttctg

SEQ ID NO: 322756 - DNA, 25 bp, Homo sapien
gtatgtgtgcattttccacactttt

SEQ ID NO: 322757 - DNA, 25 bp, Homo sapien
tgcattttccacactttttaatttt

SEQ ID NO: 322758 - DNA, 25 bp, Homo sapien
attgttggtagagacggtgattcac

SEQ ID NO: 322759 - DNA, 25 bp, Homo sapien
tgttggtagagacggtgattcacta

SEQ ID NO: 322760 - DNA, 25 bp, Homo sapien
tatttattcctaaaatattaccttg

SEQ ID NO: 322761 - DNA, 25 bp, Homo sapien
ttaccttgaggccaaattttgcgct

SEQ ID NO: 322762 - DNA, 25 bp, Homo sapien
ccttgaggccaaattttgcgcttaa

SEQ ID NO: 322763 - DNA, 25 bp, Homo sapien
aggccaaattttgcgcttaaggaga

SEQ ID NO: 322764 - DNA, 25 bp, Homo sapien
ttttgcgcttaaggagaatgtgccc

SEQ ID NO: 322765 - DNA, 25 bp, Homo sapien
gctggttataaacgaggccccaaat

SEQ ID NO: 322766 - DNA, 25 bp, Homo sapien
ggttataaacgaggccccaaatcat

SEQ ID NO: 322767 - DNA, 25 bp, Homo sapien
taaacgaggccccaaatcatgcttg

SEQ ID NO: 322768 - DNA, 25 bp, Homo sapien
cgaggccccaaatcatgcttgttaa

SEQ ID NO: 322769 - DNA, 25 bp, Homo sapien
ggtaagcttctttccaacaaaattg

SEQ ID NO: 322770 - DNA, 25 bp, Homo sapien
ttctttccaacaaaattgcggtcaa

SEQ ID NO: 322771 - DNA, 25 bp, Homo sapien
gctgattttagcaaaagcttgtaga

SEQ ID NO: 322772 - DNA, 25 bp, Homo sapien
cttgtagaaaagagtggcctggcac

SEQ ID NO: 322773 - DNA, 25 bp, Homo sapien
gtggcctggcacatgagcttaaaaa

SEQ ID NO: 322774 - DNA, 25 bp, Homo sapien
ggctcttgaattttggcacagtgca

SEQ ID NO: 322775 - DNA, 25 bp, Homo sapien
tttggcacagtgcaacctgttccat

SEQ ID NO: 322776 - DNA, 25 bp, Homo sapien
tgcaacctgttccataccagacaaa

SEQ ID NO: 322777 - DNA, 25 bp, Homo sapien
taccagacaaatgaacaggcttaat

SEQ ID NO: 322778 - DNA, 25 bp, Homo sapien
agggactgcagatcttgttgttttg

SEQ ID NO: 322779 - DNA, 25 bp, Homo sapien
ctttcatggaactgtatgtaggttt

SEQ ID NO: 322780 - DNA, 25 bp, Homo sapien
cccaaagcttataacctgtcagtgt

SEQ ID NO: 322781 - DNA, 25 bp, Homo sapien
atattttaatggtggcaggccctgg

SEQ ID NO: 322782 - DNA, 25 bp, Homo sapien
ataacctgtcagtgtgcattatttt

SEQ ID NO: 322783 - DNA, 25 bp, Homo sapien
tgtgcattattttaccatgaaggtc

SEQ ID NO: 322784 - DNA, 25 bp, Homo sapien
ttaccatgaaggtcaaatgctttat

SEQ ID NO: 322785 - DNA, 25 bp, Homo sapien
ccatcctattatcccttagcattga

SEQ ID NO: 322786 - DNA, 25 bp, Homo sapien
atcccttagcattgaaaacattttt

SEQ ID NO: 322787 - DNA, 25 bp, Homo sapien
ttcattctgtcagactgcccagata

SEQ ID NO: 322788 - DNA, 25 bp, Homo sapien
agatactgcttccttcttgtccgtt

SEQ ID NO: 322789 - DNA, 25 bp, Homo sapien
actgcttccttcttgtccgttttgt

SEQ ID NO: 322790 - DNA, 25 bp, Homo sapien
tgtttaaactttccattcatatttt

SEQ ID NO: 322791 - DNA, 25 bp, Homo sapien
atatcatttagcaaggatgctcctt

SEQ ID NO: 322792 - DNA, 25 bp, Homo sapien
aaggatgctccttatcggaccgttg

SEQ ID NO: 322793 - DNA, 25 bp, Homo sapien
ttatcggaccgttgctgggaacaga

SEQ ID NO: 322794 - DNA, 25 bp, Homo sapien
atcttttccttgcttctggcatgag

SEQ ID NO: 322795 - DNA, 25 bp, Homo sapien
gagaacacgacagttccagactgtt

SEQ ID NO: 322796 - DNA, 25 bp, Homo sapien
agttccagactgtttccaagattgg

SEQ ID NO: 322797 - DNA, 25 bp, Homo sapien
gagattcaattgacaatgctgtgaa

SEQ ID NO: 322798 - DNA, 25 bp, Homo sapien
gcttctggcatgagttaccatctct

SEQ ID NO: 322799 - DNA, 25 bp, Homo sapien
aggtagtgttgacttccttgtgcaa

SEQ ID NO: 322800 - DNA, 25 bp, Homo sapien
gacttccttgtgcaatctaggattg

SEQ ID NO: 322801 - DNA, 25 bp, Homo sapien
atacacgtagctatacatactttaa

SEQ ID NO: 322802 - DNA, 25 bp, Homo sapien
atatggcattgctgtcaacattaag

SEQ ID NO: 322803 - DNA, 25 bp, Homo sapien
ttcgtgctgcgcgaactttagcagg

SEQ ID NO: 322804 - DNA, 25 bp, Homo sapien
cgcgaactttagcaggaggaccaat

SEQ ID NO: 322805 - DNA, 25 bp, Homo sapien
agcaggaggaccaatgattagcatt

SEQ ID NO: 322806 - DNA, 25 bp, Homo sapien
gaacaacttcgtataggaccgtact

SEQ ID NO: 322807 - DNA, 25 bp, Homo sapien
ataggaccgtactcctggacaccat

SEQ ID NO: 322808 - DNA, 25 bp, Homo sapien
tggacaccatttccacatgtggatt

SEQ ID NO: 322809 - DNA, 25 bp, Homo sapien
acatgtggatttctggttgcaccaa

SEQ ID NO: 322810 - DNA, 25 bp, Homo sapien
ttctggttgcaccaagatgacaagc

SEQ ID NO: 322811 - DNA, 25 bp, Homo sapien
tactagagaatctttccacttcgcc

SEQ ID NO: 322812 - DNA, 25 bp, Homo sapien
agccaccccactttgttgaacatat

SEQ ID NO: 322813 - DNA, 25 bp, Homo sapien
aagatgtcctccttgttctactcat

SEQ ID NO: 322814 - DNA, 25 bp, Homo sapien
gtcctccttgttctactcatatata

SEQ ID NO: 322815 - DNA, 25 bp, Homo sapien
gttctactcatatatatctatctta

SEQ ID NO: 322816 - DNA, 25 bp, Homo sapien
atgtgtgtgtatgctactacaaaaa

SEQ ID NO: 322817 - DNA, 25 bp, Homo sapien
attccatatattagcatttagtcca

SEQ ID NO: 322818 - DNA, 25 bp, Homo sapien
atttagtccaatgtctttttaagct

SEQ ID NO: 322819 - DNA, 25 bp, Homo sapien
tccagtgagcttatcatgctgtctt

SEQ ID NO: 322820 - DNA, 25 bp, Homo sapien
gcttatcatgctgtctttacatggg

SEQ ID NO: 322821 - DNA, 25 bp, Homo sapien
gggttttcaattttgcatgctcgat

SEQ ID NO: 322822 - DNA, 25 bp, Homo sapien
tttgcatgctcgattattccctgta

SEQ ID NO: 322823 - DNA, 25 bp, Homo sapien
tgctcgattattccctgtacaatat

SEQ ID NO: 322824 - DNA, 25 bp, Homo sapien
aagagcccggcccaggtcatgttcc

SEQ ID NO: 322825 - DNA, 25 bp, Homo sapien
ggcccaggtcatgttccagtgtctg

SEQ ID NO: 322826 - DNA, 25 bp, Homo sapien
caggtcatgttccagtgtctgtgga

SEQ ID NO: 322827 - DNA, 25 bp, Homo sapien
acggcgtcggcgatgcagagacaca

SEQ ID NO: 322828 - DNA, 25 bp, Homo sapien
gatgcagagacacatccgcctggtg

SEQ ID NO: 322829 - DNA, 25 bp, Homo sapien
gcagagacacatccgcctggtgcac

SEQ ID NO: 322830 - DNA, 25 bp, Homo sapien
gaggacttctactacacagagctgg

SEQ ID NO: 322831 - DNA, 25 bp, Homo sapien
gacttctactacacagagctggatg

SEQ ID NO: 322832 - DNA, 25 bp, Homo sapien
atgttggtgtggacacgctgaccga

SEQ ID NO: 322833 - DNA, 25 bp, Homo sapien
acacgctgaccgacgggctgtccag

SEQ ID NO: 322834 - DNA, 25 bp, Homo sapien
tgaccgacgggctgtccagcctgac

SEQ ID NO: 322835 - DNA, 25 bp, Homo sapien
gatcctgcaatttagatgaacagca

SEQ ID NO: 322836 - DNA, 25 bp, Homo sapien
gaatgtggagccaatccatgcagat

SEQ ID NO: 322837 - DNA, 25 bp, Homo sapien
gagccaatccatgcagatattttgt

SEQ ID NO: 322838 - DNA, 25 bp, Homo sapien
ggctgaatttcagagcatcccgcgg

SEQ ID NO: 322839 - DNA, 25 bp, Homo sapien
aatttcagagcatcccgcgggtgtt

SEQ ID NO: 322840 - DNA, 25 bp, Homo sapien
cgcgggtgttcagcaagtttcctat

SEQ ID NO: 322841 - DNA, 25 bp, Homo sapien
ggaagctcgaaagccctttaaccag

SEQ ID NO: 322842 - DNA, 25 bp, Homo sapien
atgttgacattcttccttatgatta

SEQ ID NO: 322843 - DNA, 25 bp, Homo sapien
ttcttccttatgattataaccgtgt

SEQ ID NO: 322844 - DNA, 25 bp, Homo sapien
ataaccgtgttgaactctctgagat

SEQ ID NO: 322845 - DNA, 25 bp, Homo sapien
ataaacggagatgcagggtcaaact

SEQ ID NO: 322846 - DNA, 25 bp, Homo sapien
gcaaataattgcttagggtgcttta

SEQ ID NO: 322847 - DNA, 25 bp, Homo sapien
aattgcttagggtgctttaaatagc

SEQ ID NO: 322848 - DNA, 25 bp, Homo sapien
tttgccagtttaaaagccgtgtttg

SEQ ID NO: 322849 - DNA, 25 bp, Homo sapien
gtagagtgtttacttgacatttgct

SEQ ID NO: 322850 - DNA, 25 bp, Homo sapien
tttgctatattgaacactaatactg

SEQ ID NO: 322851 - DNA, 25 bp, Homo sapien
tgaaacagattctttgaccacagag

SEQ ID NO: 322852 - DNA, 25 bp, Homo sapien
ttgaccacagagaatgccagtgtag

SEQ ID NO: 322853 - DNA, 25 bp, Homo sapien
taaaagccgtgtttgagtactctaa

SEQ ID NO: 322854 - DNA, 25 bp, Homo sapien
cggagaaggaaacggcaatacaatt

SEQ ID NO: 322855 - DNA, 25 bp, Homo sapien
ctaaagtacttttctgtgacagcta

SEQ ID NO: 322856 - DNA, 25 bp, Homo sapien
gctattactataggaattggcacca

SEQ ID NO: 322857 - DNA, 25 bp, Homo sapien
attgtatccctttgtcaaaccttgt

SEQ ID NO: 322858 - DNA, 25 bp, Homo sapien
actgttatatagattgccacattct

SEQ ID NO: 322859 - DNA, 25 bp, Homo sapien
gattgccacattctaaaattcaaat

SEQ ID NO: 322860 - DNA, 25 bp, Homo sapien
ttcaaatacggtgcttaaggtttca

SEQ ID NO: 322861 - DNA, 25 bp, Homo sapien
ggtgcttaaggtttcatgccatgct

SEQ ID NO: 322862 - DNA, 25 bp, Homo sapien
gtttcatgccatgcttatctgtaag

SEQ ID NO: 322863 - DNA, 25 bp, Homo sapien
ttatctgtaagtatcctatttaggg

SEQ ID NO: 322864 - DNA, 25 bp, Homo sapien
ggaagaagattaaactctcttttca

SEQ ID NO: 322865 - DNA, 25 bp, Homo sapien
aaaacaatgggctctcgtttgctag

SEQ ID NO: 322866 - DNA, 25 bp, Homo sapien
gggctctcgtttgctagggaatatt

SEQ ID NO: 322867 - DNA, 25 bp, Homo sapien
ctagggaatattttaacagctgttt

SEQ ID NO: 322868 - DNA, 25 bp, Homo sapien
gaagcacatctctgagacatgacag

SEQ ID NO: 322869 - DNA, 25 bp, Homo sapien
gagacatgacagttcagtcccaaag

SEQ ID NO: 322870 - DNA, 25 bp, Homo sapien
gttcagtcccaaaggccattaatag

SEQ ID NO: 322871 - DNA, 25 bp, Homo sapien
gccattaatagagggccagctcatc

SEQ ID NO: 322872 - DNA, 25 bp, Homo sapien
gctcatcaacacagctgcagaaaca

SEQ ID NO: 322873 - DNA, 25 bp, Homo sapien
tgcagcattccatctactctagcgc

SEQ ID NO: 322874 - DNA, 25 bp, Homo sapien
tatgaaggcggatttcactgttgac

SEQ ID NO: 322875 - DNA, 25 bp, Homo sapien
tactctagcgcccatgcaaattgaa

SEQ ID NO: 322876 - DNA, 25 bp, Homo sapien
ttcactgttgacaggttgtctttca

SEQ ID NO: 322877 - DNA, 25 bp, Homo sapien
ttgtctttcaagtgtgggtcctggc

SEQ ID NO: 322878 - DNA, 25 bp, Homo sapien
tgggtcctggcgtttatgaggcaat

SEQ ID NO: 322879 - DNA, 25 bp, Homo sapien
ctgaggctagatatgtctggctgaa

SEQ ID NO: 322880 - DNA, 25 bp, Homo sapien
gaagatttgatgtggttcctcctta

SEQ ID NO: 322881 - DNA, 25 bp, Homo sapien
tgtggttcctccttaagctatgcgt

SEQ ID NO: 322882 - DNA, 25 bp, Homo sapien
gggtaggacctatattttaatactg

SEQ ID NO: 322883 - DNA, 25 bp, Homo sapien
gttcctaacatttcattttactagc

SEQ ID NO: 322884 - DNA, 25 bp, Homo sapien
tttactagcgagaaatctttgattt

SEQ ID NO: 322885 - DNA, 25 bp, Homo sapien
tattctttgtaattctagacactag

SEQ ID NO: 322886 - DNA, 25 bp, Homo sapien
gacactagattgtagtttagccata

SEQ ID NO: 322887 - DNA, 25 bp, Homo sapien
gtagtttagccataactgatgtttt

SEQ ID NO: 322888 - DNA, 25 bp, Homo sapien
gggatatattttcttgcacagttgt

SEQ ID NO: 322889 - DNA, 25 bp, Homo sapien
aaaagagacaagtttcagtcctcaa

SEQ ID NO: 322890 - DNA, 25 bp, Homo sapien
tcttccctgaattgctgtctacgac

SEQ ID NO: 322891 - DNA, 25 bp, Homo sapien
gctgtctacgacagtgtagttccaa

SEQ ID NO: 322892 - DNA, 25 bp, Homo sapien
gacagtgtagttccaatgtaaacaa

SEQ ID NO: 322893 - DNA, 25 bp, Homo sapien
cccagaagtcctacccagggaagag

SEQ ID NO: 322894 - DNA, 25 bp, Homo sapien
tcctacccagggaagagagggccca

SEQ ID NO: 322895 - DNA, 25 bp, Homo sapien
gagggcccagaatctagttgcagca

SEQ ID NO: 322896 - DNA, 25 bp, Homo sapien
agaatctagttgcagcatttgccca

SEQ ID NO: 322897 - DNA, 25 bp, Homo sapien
cggcctttctttgtgtgttaggaag

SEQ ID NO: 322898 - DNA, 25 bp, Homo sapien
ggaaatgcaggctggtctccctttc

SEQ ID NO: 322899 - DNA, 25 bp, Homo sapien
aaccccgagctgtcagccatttgga

SEQ ID NO: 322900 - DNA, 25 bp, Homo sapien
cagtgttctaagtccttatttgatt

SEQ ID NO: 322901 - DNA, 25 bp, Homo sapien
tgtacaggacaagtgagaagctggt

SEQ ID NO: 322902 - DNA, 25 bp, Homo sapien
ccccgctgcctcctctgcatgtgtg

SEQ ID NO: 322903 - DNA, 25 bp, Homo sapien
gcatgtgtgccctggacgtcgacgc

SEQ ID NO: 322904 - DNA, 25 bp, Homo sapien
atgtgtgccctggacgtcgacgccg

SEQ ID NO: 322905 - DNA, 25 bp, Homo sapien
gtgccctggacgtcgacgccgctga

SEQ ID NO: 322906 - DNA, 25 bp, Homo sapien
cctggacgtcgacgccgctgacagt

SEQ ID NO: 322907 - DNA, 25 bp, Homo sapien
gacgccgctgacagtgccacggctt

SEQ ID NO: 322908 - DNA, 25 bp, Homo sapien
gccgctgacagtgccacggcttttg

SEQ ID NO: 322909 - DNA, 25 bp, Homo sapien
acagtgccacggcttttggggctca

SEQ ID NO: 322910 - DNA, 25 bp, Homo sapien
gtctctcccagatgcagtcacccat

SEQ ID NO: 322911 - DNA, 25 bp, Homo sapien
tgggctgggcccagcgctgcggcca

SEQ ID NO: 322912 - DNA, 25 bp, Homo sapien
agaatctttgtactcagaaaccatg

SEQ ID NO: 322913 - DNA, 25 bp, Homo sapien
gaagaagctgcactccttcagattc

SEQ ID NO: 322914 - DNA, 25 bp, Homo sapien
actccttcagattcctatatccttt

SEQ ID NO: 322915 - DNA, 25 bp, Homo sapien
atatcctttaaacaagtgcatgcta

SEQ ID NO: 322916 - DNA, 25 bp, Homo sapien
aagtgcatgctatgattacatctta

SEQ ID NO: 322917 - DNA, 25 bp, Homo sapien
catcttaacataaatcttctttcaa

SEQ ID NO: 322918 - DNA, 25 bp, Homo sapien
ttctttcaattcaaaatgtttcatg

SEQ ID NO: 322919 - DNA, 25 bp, Homo sapien
gtttcatgaatgagatccatgtcat

SEQ ID NO: 322920 - DNA, 25 bp, Homo sapien
gagatccatgtcatctaaaagcaga

SEQ ID NO: 322921 - DNA, 25 bp, Homo sapien
attcaaaacatacatactgctggac

SEQ ID NO: 322922 - DNA, 25 bp, Homo sapien
gacactgttaatgcataatttggga

SEQ ID NO: 322923 - DNA, 25 bp, Homo sapien
gatgagatcagtagctgaagtctct

SEQ ID NO: 322924 - DNA, 25 bp, Homo sapien
tgaagtctctaagctgggccattac

SEQ ID NO: 322925 - DNA, 25 bp, Homo sapien
gggccattactaaataccatagcca

SEQ ID NO: 322926 - DNA, 25 bp, Homo sapien
taccatagccatgttgatctggaaa

SEQ ID NO: 322927 - DNA, 25 bp, Homo sapien
aatttatccctctagtgtcttacct

SEQ ID NO: 322928 - DNA, 25 bp, Homo sapien
gtcttacctcacataagccatttgc

SEQ ID NO: 322929 - DNA, 25 bp, Homo sapien
agccatttgcccactgtgcaatata

SEQ ID NO: 322930 - DNA, 25 bp, Homo sapien
gtatttggccgtagattttcacatc

SEQ ID NO: 322931 - DNA, 25 bp, Homo sapien
ttcacatccatcataaggttggcat

SEQ ID NO: 322932 - DNA, 25 bp, Homo sapien
gttctaactccagtattaaattgta

SEQ ID NO: 322933 - DNA, 25 bp, Homo sapien
acactcagggacatgtttgttgcct

SEQ ID NO: 322934 - DNA, 25 bp, Homo sapien
tggttattaatgactctacaggtca

SEQ ID NO: 322935 - DNA, 25 bp, Homo sapien
gaaaagactgccatttttaaaagca

SEQ ID NO: 322936 - DNA, 25 bp, Homo sapien
tatagataaatgttggcccaaggtt

SEQ ID NO: 322937 - DNA, 25 bp, Homo sapien
gtttctttattatggccttagcgac

SEQ ID NO: 322938 - DNA, 25 bp, Homo sapien
tggccttagcgacattgaatggttt

SEQ ID NO: 322939 - DNA, 25 bp, Homo sapien
gactctacaggtcatgaaattactg

SEQ ID NO: 322940 - DNA, 25 bp, Homo sapien
atgaagtttttcctaaagttctgct

SEQ ID NO: 322941 - DNA, 25 bp, Homo sapien
gaaattactggaaatgtgtgttacc

SEQ ID NO: 322942 - DNA, 25 bp, Homo sapien
gaatttcatacagcttatcctcata

SEQ ID NO: 322943 - DNA, 25 bp, Homo sapien
ttcatacagcttatcctcatactga

SEQ ID NO: 322944 - DNA, 25 bp, Homo sapien
ctgaatcatcttttggtgtaatttt

SEQ ID NO: 322945 - DNA, 25 bp, Homo sapien
atgcacgtggatgtagtttggctca

SEQ ID NO: 322946 - DNA, 25 bp, Homo sapien
cacgtggatgtagtttggctcaggt

SEQ ID NO: 322947 - DNA, 25 bp, Homo sapien
tcaggtgtccctgcagttggcaagg

SEQ ID NO: 322948 - DNA, 25 bp, Homo sapien
gtgtccctgcagttggcaaggagtc

SEQ ID NO: 322949 - DNA, 25 bp, Homo sapien
gtccctgcagttggcaaggagtcag

SEQ ID NO: 322950 - DNA, 25 bp, Homo sapien
tgcagttggcaaggagtcagtactc

SEQ ID NO: 322951 - DNA, 25 bp, Homo sapien
gcaaggagtcagtactcagtccctg

SEQ ID NO: 322952 - DNA, 25 bp, Homo sapien
tacctcagtattcaagttcagtggg

SEQ ID NO: 322953 - DNA, 25 bp, Homo sapien
gtattcaagttcagtggggacacca

SEQ ID NO: 322954 - DNA, 25 bp, Homo sapien
tcctggtttcatgatatcttgagac

SEQ ID NO: 322955 - DNA, 25 bp, Homo sapien
gatggaggattccaaagagtttttg

SEQ ID NO: 322956 - DNA, 25 bp, Homo sapien
agatcttgagcagtgatggattact

SEQ ID NO: 322957 - DNA, 25 bp, Homo sapien
gattactgctaatgggtttctgtct

SEQ ID NO: 322958 - DNA, 25 bp, Homo sapien
ctaatgggtttctgtctgctactct

SEQ ID NO: 322959 - DNA, 25 bp, Homo sapien
tgctactctgagcacagttcaggct

SEQ ID NO: 322960 - DNA, 25 bp, Homo sapien
gttcaggctcaagaactgacatgaa

SEQ ID NO: 322961 - DNA, 25 bp, Homo sapien
ggaaatgtccctagtagagatattt

SEQ ID NO: 322962 - DNA, 25 bp, Homo sapien
aatctggaagtaggcaggtggtcac

SEQ ID NO: 322963 - DNA, 25 bp, Homo sapien
ggtggtcacaggctaagagttcata

SEQ ID NO: 322964 - DNA, 25 bp, Homo sapien
aagagttcataaccggatgcagtcg

SEQ ID NO: 322965 - DNA, 25 bp, Homo sapien
aaccggatgcagtcgttgaaggaca

SEQ ID NO: 322966 - DNA, 25 bp, Homo sapien
aagggataatcgacatatttcataa

SEQ ID NO: 322967 - DNA, 25 bp, Homo sapien
gggaatgtcctctcaaagctcctaa

SEQ ID NO: 322968 - DNA, 25 bp, Homo sapien
aatgtcctctcaaagctcctaaaat

SEQ ID NO: 322969 - DNA, 25 bp, Homo sapien
gtcctctcaaagctcctaaaattct

SEQ ID NO: 322970 - DNA, 25 bp, Homo sapien
agctcctaaaattcttgactgtctc

SEQ ID NO: 322971 - DNA, 25 bp, Homo sapien
cctttctctagctggactattttga

SEQ ID NO: 322972 - DNA, 25 bp, Homo sapien
gactattttgattatacccttctgt

SEQ ID NO: 322973 - DNA, 25 bp, Homo sapien
tattttgattatacccttctgtcgt

SEQ ID NO: 322974 - DNA, 25 bp, Homo sapien
ccaccttctttattgctgactggga

SEQ ID NO: 322975 - DNA, 25 bp, Homo sapien
accttctttattgctgactgggaat

SEQ ID NO: 322976 - DNA, 25 bp, Homo sapien
tgctgactgggaatgtcctctcaaa

SEQ ID NO: 322977 - DNA, 25 bp, Homo sapien
gactgggaatgtcctctcaaagctc

SEQ ID NO: 322978 - DNA, 25 bp, Homo sapien
gtcctcacaacaaccttgtgagaca

SEQ ID NO: 322979 - DNA, 25 bp, Homo sapien
agttggttgcaaaagaggtgtttct

SEQ ID NO: 322980 - DNA, 25 bp, Homo sapien
ggtgtttctgaattcaagggccata

SEQ ID NO: 322981 - DNA, 25 bp, Homo sapien
gaattcaagggccatactctctctc

SEQ ID NO: 322982 - DNA, 25 bp, Homo sapien
tctctctctgacaacatgctctaag

SEQ ID NO: 322983 - DNA, 25 bp, Homo sapien
tgacaacatgctctaagtccataga

SEQ ID NO: 322984 - DNA, 25 bp, Homo sapien
gagtaagcactctagtatgaaaaaa

SEQ ID NO: 322985 - DNA, 25 bp, Homo sapien
aaaagtttcaaggaacgaggccatg

SEQ ID NO: 322986 - DNA, 25 bp, Homo sapien
gaggccatgaaaatgagactatttg

SEQ ID NO: 322987 - DNA, 25 bp, Homo sapien
atttgacatctcagatctgtctggg

SEQ ID NO: 322988 - DNA, 25 bp, Homo sapien
atctcagatctgtctgggatgttat

SEQ ID NO: 322989 - DNA, 25 bp, Homo sapien
ctttcccctaggtggtctcataatt

SEQ ID NO: 322990 - DNA, 25 bp, Homo sapien
tggtctcataattccatttgtggag

SEQ ID NO: 322991 - DNA, 25 bp, Homo sapien
gggccagatagataggtcctagcag

SEQ ID NO: 322992 - DNA, 25 bp, Homo sapien
gataggtcctagcagaaggcattga

SEQ ID NO: 322993 - DNA, 25 bp, Homo sapien
aaggcattgaggtgagggatcattt

SEQ ID NO: 322994 - DNA, 25 bp, Homo sapien
agggatcattttgggtcagacatca

SEQ ID NO: 322995 - DNA, 25 bp, Homo sapien
atccagccaaatcttgcgactcctg

SEQ ID NO: 322996 - DNA, 25 bp, Homo sapien
aaatcttgcgactcctggcacacac

SEQ ID NO: 322997 - DNA, 25 bp, Homo sapien
acacacctgtctgtaacctgttttg

SEQ ID NO: 322998 - DNA, 25 bp, Homo sapien
gtaacctgttttgtgctctgaaagc

SEQ ID NO: 322999 - DNA, 25 bp, Homo sapien
gtgctctgaaagcaaatagtcctga

SEQ ID NO: 323000 - DNA, 25 bp, Homo sapien
caagttgatcttgcaaaaaccatga

SEQ ID NO: 323001 - DNA, 25 bp, Homo sapien
gaccaatttatcaccaaccattctt

SEQ ID NO: 323002 - DNA, 25 bp, Homo sapien
aaccattcttggcaatgcagttcag

SEQ ID NO: 323003 - DNA, 25 bp, Homo sapien
aatgcagttcagttgatctcttcag

SEQ ID NO: 323004 - DNA, 25 bp, Homo sapien
ttcagttgatctcttcagtccccaa

SEQ ID NO: 323005 - DNA, 25 bp, Homo sapien
gatgctaacattgcaggtttttctt

SEQ ID NO: 323006 - DNA, 25 bp, Homo sapien
tgcaggtttttctttaccaggacct

SEQ ID NO: 323007 - DNA, 25 bp, Homo sapien
ggacctcacagctctttcagggaaa

SEQ ID NO: 323008 - DNA, 25 bp, Homo sapien
gggaaagcacactttgtaagcaaga

SEQ ID NO: 323009 - DNA, 25 bp, Homo sapien
gataacatctagtaaaccttctgct

SEQ ID NO: 323010 - DNA, 25 bp, Homo sapien
atctagtaaaccttctgctgttgcc

SEQ ID NO: 323011 - DNA, 25 bp, Homo sapien
gtccatgcagttttcatctgcttca

SEQ ID NO: 323012 - DNA, 25 bp, Homo sapien
gtactaagattctctctcttctggt

SEQ ID NO: 323013 - DNA, 25 bp, Homo sapien
gggtcacacaggttacttagagtca

SEQ ID NO: 323014 - DNA, 25 bp, Homo sapien
atgtcatcagacagacgccgcgctt

SEQ ID NO: 323015 - DNA, 25 bp, Homo sapien
cactgtgtcagctcttggaacgcat

SEQ ID NO: 323016 - DNA, 25 bp, Homo sapien
aacgcatgctccattcggtgctata

SEQ ID NO: 323017 - DNA, 25 bp, Homo sapien
ggtgctataccatttggctccgcaa

SEQ ID NO: 323018 - DNA, 25 bp, Homo sapien
aggaatgctgactgggcggtctctc

SEQ ID NO: 323019 - DNA, 25 bp, Homo sapien
gggcggtctctccaggaaagaacat

SEQ ID NO: 323020 - DNA, 25 bp, Homo sapien
gggctcaactactgcaaaggtgtct

SEQ ID NO: 323021 - DNA, 25 bp, Homo sapien
aggtgtctgcattctttctaacaca

SEQ ID NO: 323022 - DNA, 25 bp, Homo sapien
cagtcttcctaccactatgggtgtg

SEQ ID NO: 323023 - DNA, 25 bp, Homo sapien
tggttgctgggatcttagtacaaaa

SEQ ID NO: 323024 - DNA, 25 bp, Homo sapien
ctgggatcttagtacaaaacgtgtt

SEQ ID NO: 323025 - DNA, 25 bp, Homo sapien
ttctgttaaattttggtactgttag

SEQ ID NO: 323026 - DNA, 25 bp, Homo sapien
ttaccttggatacaatgcaatgcag

SEQ ID NO: 323027 - DNA, 25 bp, Homo sapien
ttttttcctactatgtccatgaagc

SEQ ID NO: 323028 - DNA, 25 bp, Homo sapien
gtccatgaagccaaatcctcagtgt

SEQ ID NO: 323029 - DNA, 25 bp, Homo sapien
aagccaaatcctcagtgtgatgaca

SEQ ID NO: 323030 - DNA, 25 bp, Homo sapien
gaaaaaggtagcagcactgcctaaa

SEQ ID NO: 323031 - DNA, 25 bp, Homo sapien
gcagcactgcctaaacaagaggtta

SEQ ID NO: 323032 - DNA, 25 bp, Homo sapien
cgagaaggtgtttgtgcagccagtc

SEQ ID NO: 323033 - DNA, 25 bp, Homo sapien
gcatcagagatacaaaggccaattc

SEQ ID NO: 323034 - DNA, 25 bp, Homo sapien
aggccaattcaataagctccttgcc

SEQ ID NO: 323035 - DNA, 25 bp, Homo sapien
aattcaataagctccttgcccttat

SEQ ID NO: 323036 - DNA, 25 bp, Homo sapien
tcaataagctccttgcccttatggg

SEQ ID NO: 323037 - DNA, 25 bp, Homo sapien
gggaaactgatctgtagtgaagcaa

SEQ ID NO: 323038 - DNA, 25 bp, Homo sapien
aactgatctgtagtgaagcaatgat

SEQ ID NO: 323039 - DNA, 25 bp, Homo sapien
aagcaatgataatttctgggtggaa

SEQ ID NO: 323040 - DNA, 25 bp, Homo sapien
ggtgttttaagcagttagttgtggc

SEQ ID NO: 323041 - DNA, 25 bp, Homo sapien
gcagttagttgtggcattattcata

SEQ ID NO: 323042 - DNA, 25 bp, Homo sapien
ccatccactcattcatcatttattt

SEQ ID NO: 323043 - DNA, 25 bp, Homo sapien
tatttatagtctacaacatgttggg

SEQ ID NO: 323044 - DNA, 25 bp, Homo sapien
cagttctctgtgaccagacatgaga

SEQ ID NO: 323045 - DNA, 25 bp, Homo sapien
gaccagacatgagaaggttgccaat

SEQ ID NO: 323046 - DNA, 25 bp, Homo sapien
gacatgagaaggttgccaatgggct

SEQ ID NO: 323047 - DNA, 25 bp, Homo sapien
tgccaatgggctgttgggcgaccaa

SEQ ID NO: 323048 - DNA, 25 bp, Homo sapien
ttgggcgaccaaggccttcccggag

SEQ ID NO: 323049 - DNA, 25 bp, Homo sapien
gaccaaggccttcccggagtcttcg

SEQ ID NO: 323050 - DNA, 25 bp, Homo sapien
aaaattgatctagggaagacaacgt

SEQ ID NO: 323051 - DNA, 25 bp, Homo sapien
gaagacaacgtagtcaccctcggtg

SEQ ID NO: 323052 - DNA, 25 bp, Homo sapien
aacgtagtcaccctcggtgcttcct

SEQ ID NO: 323053 - DNA, 25 bp, Homo sapien
cccagccccaggttgataaatctat

SEQ ID NO: 323054 - DNA, 25 bp, Homo sapien
gccccaggttgataaatctattgat

SEQ ID NO: 323055 - DNA, 25 bp, Homo sapien
aggaacctcacctgtggctcagctc

SEQ ID NO: 323056 - DNA, 25 bp, Homo sapien
ccacatccgtttctcattacgtgta

SEQ ID NO: 323057 - DNA, 25 bp, Homo sapien
atccgtttctcattacgtgtaaata

SEQ ID NO: 323058 - DNA, 25 bp, Homo sapien
acgtgtaaataaactgtcagagctg

SEQ ID NO: 323059 - DNA, 25 bp, Homo sapien
tgatgttacagcttttacagtttaa

SEQ ID NO: 323060 - DNA, 25 bp, Homo sapien
tacatgttttgggcactttccctca

SEQ ID NO: 323061 - DNA, 25 bp, Homo sapien
aaatcagttcaattctaatgtggac

SEQ ID NO: 323062 - DNA, 25 bp, Homo sapien
ctaatgtggacatagtggcatgttc

SEQ ID NO: 323063 - DNA, 25 bp, Homo sapien
gtggcatgttcataattagacccat

SEQ ID NO: 323064 - DNA, 25 bp, Homo sapien
tgttcataattagacccatataggg

SEQ ID NO: 323065 - DNA, 25 bp, Homo sapien
gggacactgagctttaaatcgttga

SEQ ID NO: 323066 - DNA, 25 bp, Homo sapien
gagtgtgcctgtgccacgtgggcta

SEQ ID NO: 323067 - DNA, 25 bp, Homo sapien
gctatggcggtgaggactgcgggca

SEQ ID NO: 323068 - DNA, 25 bp, Homo sapien
ggactgcgggcaggaagagcctcca

SEQ ID NO: 323069 - DNA, 25 bp, Homo sapien
actgtgccgggcaggccagtgtgtg

SEQ ID NO: 323070 - DNA, 25 bp, Homo sapien
tgtgtgtgtagagggcttccgaggc

SEQ ID NO: 323071 - DNA, 25 bp, Homo sapien
cgaggccctgactgtgccatccaga

SEQ ID NO: 323072 - DNA, 25 bp, Homo sapien
actgtgccatccagacatgcccagg

SEQ ID NO: 323073 - DNA, 25 bp, Homo sapien
actgccgtggccgaggagagtgtca

SEQ ID NO: 323074 - DNA, 25 bp, Homo sapien
agagtgtcacgatggcagctgtgtc

SEQ ID NO: 323075 - DNA, 25 bp, Homo sapien
ctgtgtctgcaaagatgggtatgct

SEQ ID NO: 323076 - DNA, 25 bp, Homo sapien
aaagatgggtatgctggcgaagact

SEQ ID NO: 323077 - DNA, 25 bp, Homo sapien
aaggtgggctctccttctgcagact

SEQ ID NO: 323078 - DNA, 25 bp, Homo sapien
tgcagactcctcttgcaaggcgtac

SEQ ID NO: 323079 - DNA, 25 bp, Homo sapien
ttgcaaggcgtacctccaaacataa

SEQ ID NO: 323080 - DNA, 25 bp, Homo sapien
ggcgtacctccaaacataattgatt

SEQ ID NO: 323081 - DNA, 25 bp, Homo sapien
tatctgcgagacttacactcaagca

SEQ ID NO: 323082 - DNA, 25 bp, Homo sapien
gagacttacactcaagcaatcctga

SEQ ID NO: 323083 - DNA, 25 bp, Homo sapien
gcaatcctgaggaatactgagggag

SEQ ID NO: 323084 - DNA, 25 bp, Homo sapien
tggctactgtctctctgcactctgc

SEQ ID NO: 323085 - DNA, 25 bp, Homo sapien
gcactctgctgctttgaaatctggt

SEQ ID NO: 323086 - DNA, 25 bp, Homo sapien
ctgctgctttgaaatctggttgaaa

SEQ ID NO: 323087 - DNA, 25 bp, Homo sapien
gtttgcccagattgcttaattaaaa

SEQ ID NO: 323088 - DNA, 25 bp, Homo sapien
gatactaaaccgttgtttgggctct

SEQ ID NO: 323089 - DNA, 25 bp, Homo sapien
ttgggctcttataattaggtcctga

SEQ ID NO: 323090 - DNA, 25 bp, Homo sapien
gtctgtagctttttaggttcttcac

SEQ ID NO: 323091 - DNA, 25 bp, Homo sapien
ggttcttcactagagttggttgtac

SEQ ID NO: 323092 - DNA, 25 bp, Homo sapien
taaagtctggatttttccgctaata

SEQ ID NO: 323093 - DNA, 25 bp, Homo sapien
ggatttttccgctaatatgtacttt

SEQ ID NO: 323094 - DNA, 25 bp, Homo sapien
attttgttcatgcatacttccacgt

SEQ ID NO: 323095 - DNA, 25 bp, Homo sapien
catgcatacttccacgttaaattga

SEQ ID NO: 323096 - DNA, 25 bp, Homo sapien
aaatgtcttcagcttctcttggtaa

SEQ ID NO: 323097 - DNA, 25 bp, Homo sapien
gtcttcagcttctcttggtaaatgt

SEQ ID NO: 323098 - DNA, 25 bp, Homo sapien
gcttctcttggtaaatgtgaaccat

SEQ ID NO: 323099 - DNA, 25 bp, Homo sapien
ttaaacttcctctgagaattacagg

SEQ ID NO: 323100 - DNA, 25 bp, Homo sapien
gagaattacaggaattacaggacct

SEQ ID NO: 323101 - DNA, 25 bp, Homo sapien
aggacctgacaaagctatgaagatt

SEQ ID NO: 323102 - DNA, 25 bp, Homo sapien
gcagaattgggatctgactcacaga

SEQ ID NO: 323103 - DNA, 25 bp, Homo sapien
gaacttataattcttcacaggtcac

SEQ ID NO: 323104 - DNA, 25 bp, Homo sapien
ttcacaggtcacatagaagcatgag

SEQ ID NO: 323105 - DNA, 25 bp, Homo sapien
catggatctgggaaatacacctttt

SEQ ID NO: 323106 - DNA, 25 bp, Homo sapien
ggaaatacaccttttgctactcgtt

SEQ ID NO: 323107 - DNA, 25 bp, Homo sapien
ccttttgctactcgttcagttttag

SEQ ID NO: 323108 - DNA, 25 bp, Homo sapien
tcgttcagttttagcaaggaggttt

SEQ ID NO: 323109 - DNA, 25 bp, Homo sapien
aaggaggtttcttgcatggctaagc

SEQ ID NO: 323110 - DNA, 25 bp, Homo sapien
agtaataagtgtacctacctcccag

SEQ ID NO: 323111 - DNA, 25 bp, Homo sapien
taagtgtacctacctcccagggaag

SEQ ID NO: 323112 - DNA, 25 bp, Homo sapien
tacctcccagggaaggtgtgaggat

SEQ ID NO: 323113 - DNA, 25 bp, Homo sapien
aaatgcttcaaacagtatctggtgc

SEQ ID NO: 323114 - DNA, 25 bp, Homo sapien
caaacagtatctggtgcatggcaag

SEQ ID NO: 323115 - DNA, 25 bp, Homo sapien
tgcatggcaagcactcataaagttc

SEQ ID NO: 323116 - DNA, 25 bp, Homo sapien
tttaaaactttactgtggccctcat

SEQ ID NO: 323117 - DNA, 25 bp, Homo sapien
taaaactttactgtggccctcattc

SEQ ID NO: 323118 - DNA, 25 bp, Homo sapien
gtggccctcattcaatttgcagatg

SEQ ID NO: 323119 - DNA, 25 bp, Homo sapien
ttgtgcctcagatttatctgttaag

SEQ ID NO: 323120 - DNA, 25 bp, Homo sapien
cagatttatctgttaagtggcagta

SEQ ID NO: 323121 - DNA, 25 bp, Homo sapien
tagctctagcacttacagctgtgtg

SEQ ID NO: 323122 - DNA, 25 bp, Homo sapien
gctctagcacttacagctgtgtgat

SEQ ID NO: 323123 - DNA, 25 bp, Homo sapien
tctagcacttacagctgtgtgatct

SEQ ID NO: 323124 - DNA, 25 bp, Homo sapien
taataatacctgctgtacctacctc

SEQ ID NO: 323125 - DNA, 25 bp, Homo sapien
aatacctgctgtacctacctcacag

SEQ ID NO: 323126 - DNA, 25 bp, Homo sapien
tttgaaaattgtaaagcgctatgta

SEQ ID NO: 323127 - DNA, 25 bp, Homo sapien
aaagcgctatgtaaatgtaaggtat

SEQ ID NO: 323128 - DNA, 25 bp, Homo sapien
taacatatagtttcataccattcat

SEQ ID NO: 323129 - DNA, 25 bp, Homo sapien
ggaaaagtctgcttgtaagctggtt

SEQ ID NO: 323130 - DNA, 25 bp, Homo sapien
aagtctgcttgtaagctggttgaaa

SEQ ID NO: 323131 - DNA, 25 bp, Homo sapien
gctggttgaaaaagttaatcttgat

SEQ ID NO: 323132 - DNA, 25 bp, Homo sapien
gccacaacagtgactcggtccacgt

SEQ ID NO: 323133 - DNA, 25 bp, Homo sapien
tcccgggcggtaacagttgctgcaa

SEQ ID NO: 323134 - DNA, 25 bp, Homo sapien
agttgctgcaagacctatgaccacc

SEQ ID NO: 323135 - DNA, 25 bp, Homo sapien
acaaccactgaggtgatcactgcca

SEQ ID NO: 323136 - DNA, 25 bp, Homo sapien
atcactgccaggagaccctcagttt

SEQ ID NO: 323137 - DNA, 25 bp, Homo sapien
tctttaccctccatcccggaaggat

SEQ ID NO: 323138 - DNA, 25 bp, Homo sapien
tccatcccggaaggatcagcacagg

SEQ ID NO: 323139 - DNA, 25 bp, Homo sapien
gatcagcacagggagaggccacaga

SEQ ID NO: 323140 - DNA, 25 bp, Homo sapien
aggccacagacaaccaggaggccca

SEQ ID NO: 323141 - DNA, 25 bp, Homo sapien
agcaaggccaccagcttggagagct

SEQ ID NO: 323142 - DNA, 25 bp, Homo sapien
ttggagagcttcacaaatgcccctc

SEQ ID NO: 323143 - DNA, 25 bp, Homo sapien
ctgcccgaagttcggctgttccggg

SEQ ID NO: 323144 - DNA, 25 bp, Homo sapien
ggccagtgtgtcacctgccaacttc

SEQ ID NO: 323145 - DNA, 25 bp, Homo sapien
cccatttctggcagccaagccatta

SEQ ID NO: 323146 - DNA, 25 bp, Homo sapien
tctggcagccaagccattaatctgg

SEQ ID NO: 323147 - DNA, 25 bp, Homo sapien
gccaagccattaatctggagacaga

SEQ ID NO: 323148 - DNA, 25 bp, Homo sapien
tatcgattctctggccactttttct

SEQ ID NO: 323149 - DNA, 25 bp, Homo sapien
tctctggccactttttctttcatta

SEQ ID NO: 323150 - DNA, 25 bp, Homo sapien
ttttctttcattacaatttgtaccg

SEQ ID NO: 323151 - DNA, 25 bp, Homo sapien
acaatttgtaccgtgattcttctca

SEQ ID NO: 323152 - DNA, 25 bp, Homo sapien
ttgtaccgtgattcttctcaccctt

SEQ ID NO: 323153 - DNA, 25 bp, Homo sapien
cttctctgcgtccatgcatttaaag

SEQ ID NO: 323154 - DNA, 25 bp, Homo sapien
accctcctggccagactggagagat

SEQ ID NO: 323155 - DNA, 25 bp, Homo sapien
ttggcagctcggcttcggctcttag

SEQ ID NO: 323156 - DNA, 25 bp, Homo sapien
tcggctcttagcaaatttactgttg

SEQ ID NO: 323157 - DNA, 25 bp, Homo sapien
tttactgttgttgtccatggatgca

SEQ ID NO: 323158 - DNA, 25 bp, Homo sapien
gttgttgtccatggatgcagctctt

SEQ ID NO: 323159 - DNA, 25 bp, Homo sapien
ttctcctaggagatttcccgctctt

SEQ ID NO: 323160 - DNA, 25 bp, Homo sapien
cttgccaccctctggattgagcatc

SEQ ID NO: 323161 - DNA, 25 bp, Homo sapien
tctggattgagcatccaccaagaac

SEQ ID NO: 323162 - DNA, 25 bp, Homo sapien
cagttccttcattctgcacacgaat

SEQ ID NO: 323163 - DNA, 25 bp, Homo sapien
ttctgcacacgaatgaacttgctgt

SEQ ID NO: 323164 - DNA, 25 bp, Homo sapien
gaacttgctgtgtagggacagatta

SEQ ID NO: 323165 - DNA, 25 bp, Homo sapien
tggagttactatactttactgaaga

SEQ ID NO: 323166 - DNA, 25 bp, Homo sapien
gttactatactttactgaagagcaa

SEQ ID NO: 323167 - DNA, 25 bp, Homo sapien
gaagagcaaggcataaatttagact

SEQ ID NO: 323168 - DNA, 25 bp, Homo sapien
ttgattttcgaggtagtgagatgtc

SEQ ID NO: 323169 - DNA, 25 bp, Homo sapien
tgagatgtcggcaaggtttgtcctg

SEQ ID NO: 323170 - DNA, 25 bp, Homo sapien
gtcggcaaggtttgtcctgtatatt

SEQ ID NO: 323171 - DNA, 25 bp, Homo sapien
caaggtttgtcctgtatattaggaa

SEQ ID NO: 323172 - DNA, 25 bp, Homo sapien
gaaaagttctaaactgcctctgcaa

SEQ ID NO: 323173 - DNA, 25 bp, Homo sapien
gttctaaactgcctctgcaatgact

SEQ ID NO: 323174 - DNA, 25 bp, Homo sapien
actgcctctgcaatgacttgtagtc

SEQ ID NO: 323175 - DNA, 25 bp, Homo sapien
ctgcaatgacttgtagtcagtggaa

SEQ ID NO: 323176 - DNA, 25 bp, Homo sapien
accaaagaatccagcctgctgctta

SEQ ID NO: 323177 - DNA, 25 bp, Homo sapien
ccagcctgctgcttattcgagataa

SEQ ID NO: 323178 - DNA, 25 bp, Homo sapien
attgatacacacacagaacctgata

SEQ ID NO: 323179 - DNA, 25 bp, Homo sapien
gaacctgatacgtgacaaagcaatt

SEQ ID NO: 323180 - DNA, 25 bp, Homo sapien
caaagcaattctgttttggattgga

SEQ ID NO: 323181 - DNA, 25 bp, Homo sapien
acagctgtatttccatctcacagac

SEQ ID NO: 323182 - DNA, 25 bp, Homo sapien
atttccatctcacagacatctgtgt

SEQ ID NO: 323183 - DNA, 25 bp, Homo sapien
gacatctgtgtattctgagtactgt

SEQ ID NO: 323184 - DNA, 25 bp, Homo sapien
ctgtgtattctgagtactgtagtac

SEQ ID NO: 323185 - DNA, 25 bp, Homo sapien
acagaaatcagatggatctgccaaa

SEQ ID NO: 323186 - DNA, 25 bp, Homo sapien
gccaaaaagaactaacacctgtgag

SEQ ID NO: 323187 - DNA, 25 bp, Homo sapien
ctaaaccgtaaccatcgtccatgat

SEQ ID NO: 323188 - DNA, 25 bp, Homo sapien
ccatcgtccatgatgagaatgtgag

SEQ ID NO: 323189 - DNA, 25 bp, Homo sapien
aacaggcaaatgaatgtggctgaca

SEQ ID NO: 323190 - DNA, 25 bp, Homo sapien
gtggctgacatctgggaagtattaa

SEQ ID NO: 323191 - DNA, 25 bp, Homo sapien
ctgaacatcctgacagctaggacaa

SEQ ID NO: 323192 - DNA, 25 bp, Homo sapien
gatttgttttgatcttatccaatga

SEQ ID NO: 323193 - DNA, 25 bp, Homo sapien
agctagttagaaacatgctccataa

SEQ ID NO: 323194 - DNA, 25 bp, Homo sapien
acatgctccataaaggcaatacttt

SEQ ID NO: 323195 - DNA, 25 bp, Homo sapien
ggcaatacttttcacaaatttgctt

SEQ ID NO: 323196 - DNA, 25 bp, Homo sapien
aaatttgcttttcactagctacaag

SEQ ID NO: 323197 - DNA, 25 bp, Homo sapien
tagctacaagctaaaccgtaaccat

SEQ ID NO: 323198 - DNA, 25 bp, Homo sapien
gatctttccatagctttggcttctg

SEQ ID NO: 323199 - DNA, 25 bp, Homo sapien
atagctttggcttctgggagttgaa

SEQ ID NO: 323200 - DNA, 25 bp, Homo sapien
ggtctatgtttcattcatctgcttt

SEQ ID NO: 323201 - DNA, 25 bp, Homo sapien
atgtttcattcatctgctttcaggc

SEQ ID NO: 323202 - DNA, 25 bp, Homo sapien
gaaggagcaagattccaacatcaca

SEQ ID NO: 323203 - DNA, 25 bp, Homo sapien
acatcacactgtttttgttagctgt

SEQ ID NO: 323204 - DNA, 25 bp, Homo sapien
gtgtgtttcctgtgtatccaaaaga

SEQ ID NO: 323205 - DNA, 25 bp, Homo sapien
cattcatctgctttcaggctggatt

SEQ ID NO: 323206 - DNA, 25 bp, Homo sapien
ttcaggctggatttataacaagcag

SEQ ID NO: 323207 - DNA, 25 bp, Homo sapien
gcagaacttttaaaacggtatgatt

SEQ ID NO: 323208 - DNA, 25 bp, Homo sapien
attaaacacgctgagatctttccat

SEQ ID NO: 323209 - DNA, 25 bp, Homo sapien
ctttgtgattaatgagtgaccctct

SEQ ID NO: 323210 - DNA, 25 bp, Homo sapien
gtgaccctctgatagctactttaca

SEQ ID NO: 323211 - DNA, 25 bp, Homo sapien
gatagctactttacaggagcatcct

SEQ ID NO: 323212 - DNA, 25 bp, Homo sapien
ggagcatcctaaacatttctcagca

SEQ ID NO: 323213 - DNA, 25 bp, Homo sapien
aacatttctcagcattcatctcatc

SEQ ID NO: 323214 - DNA, 25 bp, Homo sapien
tctcatcacactttcgttcattcta

SEQ ID NO: 323215 - DNA, 25 bp, Homo sapien
gttcattctatgtaactgcagccaa

SEQ ID NO: 323216 - DNA, 25 bp, Homo sapien
actgcagccaatcttatattccaca

SEQ ID NO: 323217 - DNA, 25 bp, Homo sapien
atattccacagtcctttacaacaac

SEQ ID NO: 323218 - DNA, 25 bp, Homo sapien
aagagcgagccagggaacttccata

SEQ ID NO: 323219 - DNA, 25 bp, Homo sapien
acttccatattatcctttcaagaga

SEQ ID NO: 323220 - DNA, 25 bp, Homo sapien
aaggctacatacaagcttttccagg

SEQ ID NO: 323221 - DNA, 25 bp, Homo sapien
acatacaagcttttccaggtctcta

SEQ ID NO: 323222 - DNA, 25 bp, Homo sapien
acaagcttttccaggtctctactat

SEQ ID NO: 323223 - DNA, 25 bp, Homo sapien
ttttccaggtctctactatctgtta

SEQ ID NO: 323224 - DNA, 25 bp, Homo sapien
ggtctctactatctgttaactaact

SEQ ID NO: 323225 - DNA, 25 bp, Homo sapien
ataactcacaatatgcagtccccac

SEQ ID NO: 323226 - DNA, 25 bp, Homo sapien
tcacaatatgcagtccccactgagt

SEQ ID NO: 323227 - DNA, 25 bp, Homo sapien
tccccactgagtgttcaccataatt

SEQ ID NO: 323228 - DNA, 25 bp, Homo sapien
gtgttcaccataatttgagattctt

SEQ ID NO: 323229 - DNA, 25 bp, Homo sapien
agattcttggcatgttaacttttca

SEQ ID NO: 323230 - DNA, 25 bp, Homo sapien
ggcatgttaacttttcattatggaa

SEQ ID NO: 323231 - DNA, 25 bp, Homo sapien
ggagttgggcacaattcagtccaca

SEQ ID NO: 323232 - DNA, 25 bp, Homo sapien
ggcacaattcagtccacaacagtga

SEQ ID NO: 323233 - DNA, 25 bp, Homo sapien
aacagtgacttcactttatggttta

SEQ ID NO: 323234 - DNA, 25 bp, Homo sapien
ttatggtttaatccagcctccacat

SEQ ID NO: 323235 - DNA, 25 bp, Homo sapien
taatccagcctccacattttacaaa

SEQ ID NO: 323236 - DNA, 25 bp, Homo sapien
atgtgcccagcaaatcagtgacaga

SEQ ID NO: 323237 - DNA, 25 bp, Homo sapien
aggtctgtggccctggccctaatca

SEQ ID NO: 323238 - DNA, 25 bp, Homo sapien
ttaccttaatggactctctaaagac

SEQ ID NO: 323239 - DNA, 25 bp, Homo sapien
taatcatgccgtccttctgcctttc

SEQ ID NO: 323240 - DNA, 25 bp, Homo sapien
atggactctctaaagaccctatttc

SEQ ID NO: 323241 - DNA, 25 bp, Homo sapien
gaccctatttccaattacaggcaca

SEQ ID NO: 323242 - DNA, 25 bp, Homo sapien
gggacagcggtgtggtttggcttta

SEQ ID NO: 323243 - DNA, 25 bp, Homo sapien
gtgtggtttggctttagtgcaaaaa

SEQ ID NO: 323244 - DNA, 25 bp, Homo sapien
ctttagtgcaaaaagctggtttctt

SEQ ID NO: 323245 - DNA, 25 bp, Homo sapien
agctggtttctttagaggcactttg

SEQ ID NO: 323246 - DNA, 25 bp, Homo sapien
gctggtttctttagaggcactttga

SEQ ID NO: 323247 - DNA, 25 bp, Homo sapien
aggcactttgagtggtgggacccct

SEQ ID NO: 323248 - DNA, 25 bp, Homo sapien
gcactttgagtggtgggacccctcc

SEQ ID NO: 323249 - DNA, 25 bp, Homo sapien
ctggggctgtcctcgggctgtttca

SEQ ID NO: 323250 - DNA, 25 bp, Homo sapien
gtcctcgggctgtttcagccccggg

SEQ ID NO: 323251 - DNA, 25 bp, Homo sapien
gaaggtggtagcttatgttcttgaa

SEQ ID NO: 323252 - DNA, 25 bp, Homo sapien
ggtggtagcttatgttcttgaacga

SEQ ID NO: 323253 - DNA, 25 bp, Homo sapien
aaatgtgcactgttgtatcttttca

SEQ ID NO: 323254 - DNA, 25 bp, Homo sapien
atgtgcactgttgtatcttttcact

SEQ ID NO: 323255 - DNA, 25 bp, Homo sapien
tgcactgttgtatcttttcactttt

SEQ ID NO: 323256 - DNA, 25 bp, Homo sapien
tcttttcacttttgtatgtcagtgc

SEQ ID NO: 323257 - DNA, 25 bp, Homo sapien
acttttgtatgtcagtgctttgaaa

SEQ ID NO: 323258 - DNA, 25 bp, Homo sapien
ttttgtctgcttattaaaattttct

SEQ ID NO: 323259 - DNA, 25 bp, Homo sapien
gtattacatcaaaaagttactgtgt

SEQ ID NO: 323260 - DNA, 25 bp, Homo sapien
ttcttccatcaagaaataatgctga

SEQ ID NO: 323261 - DNA, 25 bp, Homo sapien
tggaggagtttttagacttcagtaa

SEQ ID NO: 323262 - DNA, 25 bp, Homo sapien
gacttcagtaaacataggtaccctg

SEQ ID NO: 323263 - DNA, 25 bp, Homo sapien
aacataggtaccctgaaaatgtgca

SEQ ID NO: 323264 - DNA, 25 bp, Homo sapien
tttcacatttaagttttcagtctac

SEQ ID NO: 323265 - DNA, 25 bp, Homo sapien
gttttcagtctacttagatcttatt

SEQ ID NO: 323266 - DNA, 25 bp, Homo sapien
ccttttccatctggatgccgttatc

SEQ ID NO: 323267 - DNA, 25 bp, Homo sapien
atgccgttatcccagagctacttat

SEQ ID NO: 323268 - DNA, 25 bp, Homo sapien
gagctacttattgagacattcagtc

SEQ ID NO: 323269 - DNA, 25 bp, Homo sapien
gatgtgccctatcttatatcataca

SEQ ID NO: 323270 - DNA, 25 bp, Homo sapien
atactgatatgtgtggatctatttc

SEQ ID NO: 323271 - DNA, 25 bp, Homo sapien
ggatctatttctgaacactctattc

SEQ ID NO: 323272 - DNA, 25 bp, Homo sapien
tgttccattggcctgtttatccttg

SEQ ID NO: 323273 - DNA, 25 bp, Homo sapien
gaagtttatcaatgtagtcagtttt

SEQ ID NO: 323274 - DNA, 25 bp, Homo sapien
tcttttacagtatcttctaacagtt

SEQ ID NO: 323275 - DNA, 25 bp, Homo sapien
gattcataaagttaattcactgctt

SEQ ID NO: 323276 - DNA, 25 bp, Homo sapien
cactgcttaagcatgtggctcatat

SEQ ID NO: 323277 - DNA, 25 bp, Homo sapien
gtggctcatatttaggaagctatat

SEQ ID NO: 323278 - DNA, 25 bp, Homo sapien
tcagtttttcatttaacatttgctc

SEQ ID NO: 323279 - DNA, 25 bp, Homo sapien
caagatgtgccaatatcataggtaa

SEQ ID NO: 323280 - DNA, 25 bp, Homo sapien
aatgtgggactttatggctgttttt

SEQ ID NO: 323281 - DNA, 25 bp, Homo sapien
tttaatttagtttcacccgatcttg

SEQ ID NO: 323282 - DNA, 25 bp, Homo sapien
agtttcacccgatcttgattcttga

SEQ ID NO: 323283 - DNA, 25 bp, Homo sapien
ttttttctggtgagattgcacctgg

SEQ ID NO: 323284 - DNA, 25 bp, Homo sapien
gattgcacctggataccaggctttt

SEQ ID NO: 323285 - DNA, 25 bp, Homo sapien
ggataccaggcttttgtaatagtta

SEQ ID NO: 323286 - DNA, 25 bp, Homo sapien
gacgaaatctactttgttgcacagg

SEQ ID NO: 323287 - DNA, 25 bp, Homo sapien
atgagctactgaccccagcctagat

SEQ ID NO: 323288 - DNA, 25 bp, Homo sapien
tgaccccagcctagatgacctttaa

SEQ ID NO: 323289 - DNA, 25 bp, Homo sapien
ccagcctagatgacctttaagcttg

SEQ ID NO: 323290 - DNA, 25 bp, Homo sapien
gacctttaagcttgctttcaacctg

SEQ ID NO: 323291 - DNA, 25 bp, Homo sapien
taagcttgctttcaacctgcattct

SEQ ID NO: 323292 - DNA, 25 bp, Homo sapien
ttgctttcaacctgcattctggagt

SEQ ID NO: 323293 - DNA, 25 bp, Homo sapien
gctttcaacctgcattctggagtta

SEQ ID NO: 323294 - DNA, 25 bp, Homo sapien
acctgcattctggagttattagctt

SEQ ID NO: 323295 - DNA, 25 bp, Homo sapien
gcattctggagttattagcttttca

SEQ ID NO: 323296 - DNA, 25 bp, Homo sapien
tctggagttattagcttttcagctg

SEQ ID NO: 323297 - DNA, 25 bp, Homo sapien
ggatttgccttctttcagtctgaca

SEQ ID NO: 323298 - DNA, 25 bp, Homo sapien
gacactgactaacaacctcgacaag

SEQ ID NO: 323299 - DNA, 25 bp, Homo sapien
aacaacctcgacaaggtgggcatat

SEQ ID NO: 323300 - DNA, 25 bp, Homo sapien
caaggtgggcatatacctggattat

SEQ ID NO: 323301 - DNA, 25 bp, Homo sapien
gaaggaggacagttgtccttctaca

SEQ ID NO: 323302 - DNA, 25 bp, Homo sapien
gtccttctacaatgctaaaaccatg

SEQ ID NO: 323303 - DNA, 25 bp, Homo sapien
catgactcacatttacaccttcagt

SEQ ID NO: 323304 - DNA, 25 bp, Homo sapien
acaccttcagtaacactttcatgga

SEQ ID NO: 323305 - DNA, 25 bp, Homo sapien
ggagaaactttatccctacttctgc

SEQ ID NO: 323306 - DNA, 25 bp, Homo sapien
ctgcccctgccttaatgatggtgga

SEQ ID NO: 323307 - DNA, 25 bp, Homo sapien
caaactgatctaaaggctctggatt

SEQ ID NO: 323308 - DNA, 25 bp, Homo sapien
ccacgggcaggtatttgctgacttg

SEQ ID NO: 323309 - DNA, 25 bp, Homo sapien
ttgctgacttgcctacaacctggag

SEQ ID NO: 323310 - DNA, 25 bp, Homo sapien
acaacctggagggttatgagctggc

SEQ ID NO: 323311 - DNA, 25 bp, Homo sapien
gagacatagacccaagcagcgagcc

SEQ ID NO: 323312 - DNA, 25 bp, Homo sapien
gggaaccaactgtgtgtgctgcggg

SEQ ID NO: 323313 - DNA, 25 bp, Homo sapien
ccttgccacccaaactgggatatag

SEQ ID NO: 323314 - DNA, 25 bp, Homo sapien
ggatataggctgctgttcgtacact

SEQ ID NO: 323315 - DNA, 25 bp, Homo sapien
ggctgctgttcgtacacttgcagaa

SEQ ID NO: 323316 - DNA, 25 bp, Homo sapien
gtacacttgcagaagtttctccctg

SEQ ID NO: 323317 - DNA, 25 bp, Homo sapien
tgcagctaccgccaccaataatatt

SEQ ID NO: 323318 - DNA, 25 bp, Homo sapien
accaataatattcacacagccttcc

SEQ ID NO: 323319 - DNA, 25 bp, Homo sapien
aaatgcattgggtttttactgtagc

SEQ ID NO: 323320 - DNA, 25 bp, Homo sapien
gggtttttactgtagcatttggcac

SEQ ID NO: 323321 - DNA, 25 bp, Homo sapien
gcatttggcactaaatggctttggg

SEQ ID NO: 323322 - DNA, 25 bp, Homo sapien
gaaggatacagcaggtggtacagta

SEQ ID NO: 323323 - DNA, 25 bp, Homo sapien
acagcaggtggtacagtagtcagga

SEQ ID NO: 323324 - DNA, 25 bp, Homo sapien
gtagtcaggaagtacctgccaccaa

SEQ ID NO: 323325 - DNA, 25 bp, Homo sapien
gaagtacctgccaccaatgagatgt

SEQ ID NO: 323326 - DNA, 25 bp, Homo sapien
ttgcctcttaccatgcctctgaatg

SEQ ID NO: 323327 - DNA, 25 bp, Homo sapien
cttaccatgcctctgaatgtctttg

SEQ ID NO: 323328 - DNA, 25 bp, Homo sapien
tgcctctgaatgtctttggatccaa

SEQ ID NO: 323329 - DNA, 25 bp, Homo sapien
tccaacccagatgagactgaaaaaa

SEQ ID NO: 323330 - DNA, 25 bp, Homo sapien
ggtagctgcgcgacacgagcagcat

SEQ ID NO: 323331 - DNA, 25 bp, Homo sapien
caggtacacgacgatgacgaccggg

SEQ ID NO: 323332 - DNA, 25 bp, Homo sapien
acacgagcagcatggccagtgcgtt

SEQ ID NO: 323333 - DNA, 25 bp, Homo sapien
agtgcgttgcccacgaaaccagtga

SEQ ID NO: 323334 - DNA, 25 bp, Homo sapien
gttgcccacgaaaccagtgagcagc

SEQ ID NO: 323335 - DNA, 25 bp, Homo sapien
atcgggaaggccacggacaccgatc

SEQ ID NO: 323336 - DNA, 25 bp, Homo sapien
cgggcgcccacatgcctgtgtagga

SEQ ID NO: 323337 - DNA, 25 bp, Homo sapien
tggtgagaagctgcccgaccaggtc

SEQ ID NO: 323338 - DNA, 25 bp, Homo sapien
accaggtcggtgagcgccagccagc

SEQ ID NO: 323339 - DNA, 25 bp, Homo sapien
gccagccagccgatgcacagcagga

SEQ ID NO: 323340 - DNA, 25 bp, Homo sapien
aggaaggacttcttgcgcttgctct

SEQ ID NO: 323341 - DNA, 25 bp, Homo sapien
acgctgctgaaccattttcatgtca

SEQ ID NO: 323342 - DNA, 25 bp, Homo sapien
cattttcatgtcaatcacaaaggaa

SEQ ID NO: 323343 - DNA, 25 bp, Homo sapien
gggaaatacctaggagtctattatc

SEQ ID NO: 323344 - DNA, 25 bp, Homo sapien
ggagtctattatcacatacatatta

SEQ ID NO: 323345 - DNA, 25 bp, Homo sapien
ttattttgcagactacgctttatag

SEQ ID NO: 323346 - DNA, 25 bp, Homo sapien
tacgctttatagtacctgtgtgacg

SEQ ID NO: 323347 - DNA, 25 bp, Homo sapien
agtacctgtgtgacgggacctagaa

SEQ ID NO: 323348 - DNA, 25 bp, Homo sapien
gggacctagaacactggatacaaat

SEQ ID NO: 323349 - DNA, 25 bp, Homo sapien
caaatagagctatgttggtttatca

SEQ ID NO: 323350 - DNA, 25 bp, Homo sapien
ataatatgtacgcagaaactttctt

SEQ ID NO: 323351 - DNA, 25 bp, Homo sapien
ctttctttttgtcatattatccttg

SEQ ID NO: 323352 - DNA, 25 bp, Homo sapien
catttctgaccataagtaattttaa

SEQ ID NO: 323353 - DNA, 25 bp, Homo sapien
gttttggttattcatgatcacttgg

SEQ ID NO: 323354 - DNA, 25 bp, Homo sapien
ggttattcatgatcacttgggcagt

SEQ ID NO: 323355 - DNA, 25 bp, Homo sapien
tcatgatcacttgggcagtataaga

SEQ ID NO: 323356 - DNA, 25 bp, Homo sapien
attggccacctctatgctgcatata

SEQ ID NO: 323357 - DNA, 25 bp, Homo sapien
ggccacctctatgctgcatatactt

SEQ ID NO: 323358 - DNA, 25 bp, Homo sapien
agacctttgtaaactgccattttgt

SEQ ID NO: 323359 - DNA, 25 bp, Homo sapien
tatggagtttggtatctagggagta

SEQ ID NO: 323360 - DNA, 25 bp, Homo sapien
ggtatctagggagtaggccttattt

SEQ ID NO: 323361 - DNA, 25 bp, Homo sapien
gagtaggccttatttagcaattcaa

SEQ ID NO: 323362 - DNA, 25 bp, Homo sapien
aacaatgtttggatgcaacgcagaa

SEQ ID NO: 323363 - DNA, 25 bp, Homo sapien
ggatcctagatgtttggaagccttg

SEQ ID NO: 323364 - DNA, 25 bp, Homo sapien
ggaagccttgaagcctggaaactgt

SEQ ID NO: 323365 - DNA, 25 bp, Homo sapien
aactgtggtgaatatgtggttcgat

SEQ ID NO: 323366 - DNA, 25 bp, Homo sapien
gtggttcgatggtattatgacaaac

SEQ ID NO: 323367 - DNA, 25 bp, Homo sapien
aaacaggtcaactcttgtgcccgat

SEQ ID NO: 323368 - DNA, 25 bp, Homo sapien
actcttgtgcccgattttggttcag

SEQ ID NO: 323369 - DNA, 25 bp, Homo sapien
cccgattttggttcagtggctgtaa

SEQ ID NO: 323370 - DNA, 25 bp, Homo sapien
gctccagagccaacgtgggctgatg

SEQ ID NO: 323371 - DNA, 25 bp, Homo sapien
gggctgatgatgtgcctgccactac

SEQ ID NO: 323372 - DNA, 25 bp, Homo sapien
gtgcctgccactacctcatctgagg

SEQ ID NO: 323373 - DNA, 25 bp, Homo sapien
cactgctcagcacccctgtggatgg

SEQ ID NO: 323374 - DNA, 25 bp, Homo sapien
agtctgtcagctcagtacctgtctg

SEQ ID NO: 323375 - DNA, 25 bp, Homo sapien
tcagctcagtacctgtctgtgcaca

SEQ ID NO: 323376 - DNA, 25 bp, Homo sapien
tcccactctgcctgtaacttagaaa

SEQ ID NO: 323377 - DNA, 25 bp, Homo sapien
gagggtctgcgagttaataccttga

SEQ ID NO: 323378 - DNA, 25 bp, Homo sapien
gagaatagtctacagtttttcatag

SEQ ID NO: 323379 - DNA, 25 bp, Homo sapien
cagaaattgacctttatttgttgta

SEQ ID NO: 323380 - DNA, 25 bp, Homo sapien
tttttcatagtttgtctgagctaga

SEQ ID NO: 323381 - DNA, 25 bp, Homo sapien
gtctgagctagaaaacttgtacctg

SEQ ID NO: 323382 - DNA, 25 bp, Homo sapien
attgaggactgaaacttgtctcttt

SEQ ID NO: 323383 - DNA, 25 bp, Homo sapien
tatttgttgtactaaagcctgttta

SEQ ID NO: 323384 - DNA, 25 bp, Homo sapien
agcctgtttaacttttgatacaaag

SEQ ID NO: 323385 - DNA, 25 bp, Homo sapien
taacataggagcctcttggccatct

SEQ ID NO: 323386 - DNA, 25 bp, Homo sapien
cttggccatcttgaggtgctgatga

SEQ ID NO: 323387 - DNA, 25 bp, Homo sapien
atgagatgaggatcggcctgaccct

SEQ ID NO: 323388 - DNA, 25 bp, Homo sapien
gaagcagatgacactgtcccaaatg

SEQ ID NO: 323389 - DNA, 25 bp, Homo sapien
gtcccaaatgtgtggccaccctgga

SEQ ID NO: 323390 - DNA, 25 bp, Homo sapien
tggagtcagctcagtccctgcacgg

SEQ ID NO: 323391 - DNA, 25 bp, Homo sapien
tactcggtctgcctggcggagcaaa

SEQ ID NO: 323392 - DNA, 25 bp, Homo sapien
agcaaagggtgagccctctagagga

SEQ ID NO: 323393 - DNA, 25 bp, Homo sapien
gaacctttgcccaattctgaagctg

SEQ ID NO: 323394 - DNA, 25 bp, Homo sapien
gaagccacacagagagcctccgaat

SEQ ID NO: 323395 - DNA, 25 bp, Homo sapien
cagagagcctccgaataacatagga

SEQ ID NO: 323396 - DNA, 25 bp, Homo sapien
taagctgtgttatggtgggttttca

SEQ ID NO: 323397 - DNA, 25 bp, Homo sapien
tttacccctttactctgcaagaatg

SEQ ID NO: 323398 - DNA, 25 bp, Homo sapien
tgcatactgcgaaaatgagtctttt

SEQ ID NO: 323399 - DNA, 25 bp, Homo sapien
tcttttaaattctgtctgcctacta

SEQ ID NO: 323400 - DNA, 25 bp, Homo sapien
attctgtctgcctactagttttaag

SEQ ID NO: 323401 - DNA, 25 bp, Homo sapien
gagacagcacaataaatgtacctta

SEQ ID NO: 323402 - DNA, 25 bp, Homo sapien
caataaatgtaccttatctccttag

SEQ ID NO: 323403 - DNA, 25 bp, Homo sapien
cttatctccttaggctgaaggccat

SEQ ID NO: 323404 - DNA, 25 bp, Homo sapien
ggctgaaggccataactacatagtg

SEQ ID NO: 323405 - DNA, 25 bp, Homo sapien
cccaaaaggttgctttttgatagca

SEQ ID NO: 323406 - DNA, 25 bp, Homo sapien
tgctttttgatagcaactggctaat

SEQ ID NO: 323407 - DNA, 25 bp, Homo sapien
ggacgttgttggagcccctagtgtt

SEQ ID NO: 323408 - DNA, 25 bp, Homo sapien
ccgtgttcatttggaaggacgagcc

SEQ ID NO: 323409 - DNA, 25 bp, Homo sapien
ttcatttggaaggacgagccgggtc

SEQ ID NO: 323410 - DNA, 25 bp, Homo sapien
tttggaaggacgagccgggtcctca

SEQ ID NO: 323411 - DNA, 25 bp, Homo sapien
gggaggttccaggactctgcccttg

SEQ ID NO: 323412 - DNA, 25 bp, Homo sapien
ttccaggactctgcccttggcgttg

SEQ ID NO: 323413 - DNA, 25 bp, Homo sapien
gactctgcccttggcgttgagggtt

SEQ ID NO: 323414 - DNA, 25 bp, Homo sapien
ctggagacgggcatgggttcttgga

SEQ ID NO: 323415 - DNA, 25 bp, Homo sapien
gacgggcatgggttcttggagagtg

SEQ ID NO: 323416 - DNA, 25 bp, Homo sapien
ggttcttggagagtggcatgagctg

SEQ ID NO: 323417 - DNA, 25 bp, Homo sapien
ggagagtggcatgagctggctctgc

SEQ ID NO: 323418 - DNA, 25 bp, Homo sapien
ttttacttgggttactagagatgct

SEQ ID NO: 323419 - DNA, 25 bp, Homo sapien
tacttgggttactagagatgcttct

SEQ ID NO: 323420 - DNA, 25 bp, Homo sapien
acttgggttactagagatgcttcta

SEQ ID NO: 323421 - DNA, 25 bp, Homo sapien
tactagagatgcttctagtagacct

SEQ ID NO: 323422 - DNA, 25 bp, Homo sapien
atatgcatatgatctttaattattg

SEQ ID NO: 323423 - DNA, 25 bp, Homo sapien
taaagtgaggacttaaaacaattca

SEQ ID NO: 323424 - DNA, 25 bp, Homo sapien
aaacaattcatgaaagtggaccttt

SEQ ID NO: 323425 - DNA, 25 bp, Homo sapien
aagtggacctttaaaagcttgtcag

SEQ ID NO: 323426 - DNA, 25 bp, Homo sapien
ggacctttaaaagcttgtcagagtt

SEQ ID NO: 323427 - DNA, 25 bp, Homo sapien
tttaaaagcttgtcagagttgcaca

SEQ ID NO: 323428 - DNA, 25 bp, Homo sapien
aagcttgtcagagttgcacaaatct

SEQ ID NO: 323429 - DNA, 25 bp, Homo sapien
gggtgctgggcttaagggccagaag

SEQ ID NO: 323430 - DNA, 25 bp, Homo sapien
tgctgggcttaagggccagaaggtg

SEQ ID NO: 323431 - DNA, 25 bp, Homo sapien
gagagtagcctctgacgctggcaga

SEQ ID NO: 323432 - DNA, 25 bp, Homo sapien
agagtagcctctgacgctggcagac

SEQ ID NO: 323433 - DNA, 25 bp, Homo sapien
gagtagcctctgacgctggcagaca

SEQ ID NO: 323434 - DNA, 25 bp, Homo sapien
agtagcctctgacgctggcagacac

SEQ ID NO: 323435 - DNA, 25 bp, Homo sapien
tagcctctgacgctggcagacacca

SEQ ID NO: 323436 - DNA, 25 bp, Homo sapien
ctctgacgctggcagacaccactaa

SEQ ID NO: 323437 - DNA, 25 bp, Homo sapien
tctgacgctggcagacaccactaac

SEQ ID NO: 323438 - DNA, 25 bp, Homo sapien
ctgacgctggcagacaccactaact

SEQ ID NO: 323439 - DNA, 25 bp, Homo sapien
ccagcacgcccgccaagcggagtgc

SEQ ID NO: 323440 - DNA, 25 bp, Homo sapien
aaaccagaagcttctttaaattatg

SEQ ID NO: 323441 - DNA, 25 bp, Homo sapien
taaattatgttgcaaactgatcttt

SEQ ID NO: 323442 - DNA, 25 bp, Homo sapien
gtgataagtttgaaacacacagctt

SEQ ID NO: 323443 - DNA, 25 bp, Homo sapien
gtttgaaacacacagctttaaatga

SEQ ID NO: 323444 - DNA, 25 bp, Homo sapien
tattgtgggattttgggtacagtta

SEQ ID NO: 323445 - DNA, 25 bp, Homo sapien
aagggaatcattgtgtttaaacata

SEQ ID NO: 323446 - DNA, 25 bp, Homo sapien
atctagagtcattgaaacaaatcat

SEQ ID NO: 323447 - DNA, 25 bp, Homo sapien
aatattaatgcagtcttgtttacag

SEQ ID NO: 323448 - DNA, 25 bp, Homo sapien
atgcagtcttgtttacagtatgtac

SEQ ID NO: 323449 - DNA, 25 bp, Homo sapien
cttgtttacagtatgtacagtgaca

SEQ ID NO: 323450 - DNA, 25 bp, Homo sapien
gtgacataacatagaacatgagctt

SEQ ID NO: 323451 - DNA, 25 bp, Homo sapien
gggtaatcaagtcttcgctacagaa

SEQ ID NO: 323452 - DNA, 25 bp, Homo sapien
aaatgtaggacagcggcgttgtgac

SEQ ID NO: 323453 - DNA, 25 bp, Homo sapien
ggcgttgtgacgatattcccaccac

SEQ ID NO: 323454 - DNA, 25 bp, Homo sapien
gaactccgaggttattctgtgtaaa

SEQ ID NO: 323455 - DNA, 25 bp, Homo sapien
tcagggaccgccctttggtgcttcc

SEQ ID NO: 323456 - DNA, 25 bp, Homo sapien
tggtgcttccgcgacgctggaaacc

SEQ ID NO: 323457 - DNA, 25 bp, Homo sapien
gcgacgctggaaaccggcagagatt

SEQ ID NO: 323458 - DNA, 25 bp, Homo sapien
ggcagagattcctaccaccgtattg

SEQ ID NO: 323459 - DNA, 25 bp, Homo sapien
gcagcctccagtcctttttcgggtt

SEQ ID NO: 323460 - DNA, 25 bp, Homo sapien
aatttttctcaactagactttggct

SEQ ID NO: 323461 - DNA, 25 bp, Homo sapien
ccagtctcctgcacgggtaatagct

SEQ ID NO: 323462 - DNA, 25 bp, Homo sapien
ggcgccttcggagccctggacaagg

SEQ ID NO: 323463 - DNA, 25 bp, Homo sapien
gctgctgtttcgaggacgatgagac

SEQ ID NO: 323464 - DNA, 25 bp, Homo sapien
gggtgcgctgctgtcgggagccgaa

SEQ ID NO: 323465 - DNA, 25 bp, Homo sapien
gggacgtgcgcgaggccacccgcga

SEQ ID NO: 323466 - DNA, 25 bp, Homo sapien
cgcgatctactcagcttcattgact

SEQ ID NO: 323467 - DNA, 25 bp, Homo sapien
gatctactcagcttcattgactcgg

SEQ ID NO: 323468 - DNA, 25 bp, Homo sapien
tactcagcttcattgactcggcgtc

SEQ ID NO: 323469 - DNA, 25 bp, Homo sapien
gcttcattgactcggcgtccagcaa

SEQ ID NO: 323470 - DNA, 25 bp, Homo sapien
tgactcggcgtccagcaacatcaag

SEQ ID NO: 323471 - DNA, 25 bp, Homo sapien
agcaacatcaagctggcgctggaca

SEQ ID NO: 323472 - DNA, 25 bp, Homo sapien
caacatcaagctggcgctggacaag

SEQ ID NO: 323473 - DNA, 25 bp, Homo sapien
gaagctctatagttcatgagctact

SEQ ID NO: 323474 - DNA, 25 bp, Homo sapien
tggtgtttagtctcaaaaatttgtt

SEQ ID NO: 323475 - DNA, 25 bp, Homo sapien
tcaccttagtgattcttaggtacaa

SEQ ID NO: 323476 - DNA, 25 bp, Homo sapien
ttaggtacaaagtcttcatcactca

SEQ ID NO: 323477 - DNA, 25 bp, Homo sapien
ggtacaaagtcttcatcactcaatt

SEQ ID NO: 323478 - DNA, 25 bp, Homo sapien
gtcttcatcactcaattttaacaaa

SEQ ID NO: 323479 - DNA, 25 bp, Homo sapien
gttcatgagctacttgatattttct

SEQ ID NO: 323480 - DNA, 25 bp, Homo sapien
aaagttatacttttgaagcatgagt

SEQ ID NO: 323481 - DNA, 25 bp, Homo sapien
gagctacttgatattttctagagat

SEQ ID NO: 323482 - DNA, 25 bp, Homo sapien
ctagagatcattttatgttaagcta

SEQ ID NO: 323483 - DNA, 25 bp, Homo sapien
gttaagctattatacattgttgatg

SEQ ID NO: 323484 - DNA, 25 bp, Homo sapien
ggcttgctatgtgcagtgccctgag

SEQ ID NO: 323485 - DNA, 25 bp, Homo sapien
gtgccctgagccaagtgttccacag

SEQ ID NO: 323486 - DNA, 25 bp, Homo sapien
tatctcatttgaaccccatagcagc

SEQ ID NO: 323487 - DNA, 25 bp, Homo sapien
tcagtgccaagatgtgagccccgga

SEQ ID NO: 323488 - DNA, 25 bp, Homo sapien
cactgccgcttgacagtcgttttaa

SEQ ID NO: 323489 - DNA, 25 bp, Homo sapien
gtcgttttaatcactacctgggctg

SEQ ID NO: 323490 - DNA, 25 bp, Homo sapien
tacctgggctgtggcgaacaatgcc

SEQ ID NO: 323491 - DNA, 25 bp, Homo sapien
acaatgccaggctctgatagatcct

SEQ ID NO: 323492 - DNA, 25 bp, Homo sapien
tctgatagatcctgctgtctcattt

SEQ ID NO: 323493 - DNA, 25 bp, Homo sapien
ctgtctcatttctcaacctagtttc

SEQ ID NO: 323494 - DNA, 25 bp, Homo sapien
tcatttctcaacctagtttccctta

SEQ ID NO: 323495 - DNA, 25 bp, Homo sapien
taaaaatcaggctacaattgtgtgt

SEQ ID NO: 323496 - DNA, 25 bp, Homo sapien
attgtgtgtatgtggctgcacagca

SEQ ID NO: 323497 - DNA, 25 bp, Homo sapien
cacagcagcaggcaccaggttacag

SEQ ID NO: 323498 - DNA, 25 bp, Homo sapien
gcaccaggttacagcattgccactt

SEQ ID NO: 323499 - DNA, 25 bp, Homo sapien
tacagcattgccacttctacgtttg

SEQ ID NO: 323500 - DNA, 25 bp, Homo sapien
gccacttctacgtttgtcattttta

SEQ ID NO: 323501 - DNA, 25 bp, Homo sapien
aattagtcacttagccccttcccag

SEQ ID NO: 323502 - DNA, 25 bp, Homo sapien
cacaccatcacttcagttgtcaatg

SEQ ID NO: 323503 - DNA, 25 bp, Homo sapien
atcacttcagttgtcaatgacctca

SEQ ID NO: 323504 - DNA, 25 bp, Homo sapien
atgacctcagctgctactcaaggag

SEQ ID NO: 323505 - DNA, 25 bp, Homo sapien
attacccacacttctaaaaatcagg

SEQ ID NO: 323506 - DNA, 25 bp, Homo sapien
taatcttgtacctgcggaccacata

SEQ ID NO: 323507 - DNA, 25 bp, Homo sapien
acatacatgcgccagtacttttgaa

SEQ ID NO: 323508 - DNA, 25 bp, Homo sapien
tgaatgatggttgctgccttggttc

SEQ ID NO: 323509 - DNA, 25 bp, Homo sapien
aacttagcatagcatcgggcctggt

SEQ ID NO: 323510 - DNA, 25 bp, Homo sapien
cacgtatctctgcatggtgatggct

SEQ ID NO: 323511 - DNA, 25 bp, Homo sapien
gcatgcgtaggtacttctttctcag

SEQ ID NO: 323512 - DNA, 25 bp, Homo sapien
gatggtcttctggatccggatgcag

SEQ ID NO: 323513 - DNA, 25 bp, Homo sapien
atgcaggcagctctcagtttgtcag

SEQ ID NO: 323514 - DNA, 25 bp, Homo sapien
gtttgtcagctctcaatttttctag

SEQ ID NO: 323515 - DNA, 25 bp, Homo sapien
ataggccacttgaccggcacggaaa

SEQ ID NO: 323516 - DNA, 25 bp, Homo sapien
agatctttgtcttaccaaactggta

SEQ ID NO: 323517 - DNA, 25 bp, Homo sapien
gaatatctggtattgatatctttga

SEQ ID NO: 323518 - DNA, 25 bp, Homo sapien
atatctttgatatacagctttggga

SEQ ID NO: 323519 - DNA, 25 bp, Homo sapien
ggagaggggccttttgcattgccac

SEQ ID NO: 323520 - DNA, 25 bp, Homo sapien
gcattgccactgctattgattggta

SEQ ID NO: 323521 - DNA, 25 bp, Homo sapien
cactgctattgattggtaaatggta

SEQ ID NO: 323522 - DNA, 25 bp, Homo sapien
gagttatgtaacacatggaccatta

SEQ ID NO: 323523 - DNA, 25 bp, Homo sapien
acaggttgggagaattttcacaaag

SEQ ID NO: 323524 - DNA, 25 bp, Homo sapien
gtgaacataagctctttaattaaat

SEQ ID NO: 323525 - DNA, 25 bp, Homo sapien
gaccattagctgcaaatgttttcac

SEQ ID NO: 323526 - DNA, 25 bp, Homo sapien
taatttcagaccttaaacacatcat

SEQ ID NO: 323527 - DNA, 25 bp, Homo sapien
gaccttaaacacatcattctactaa

SEQ ID NO: 323528 - DNA, 25 bp, Homo sapien
gttatatgggttccttactcagcct

SEQ ID NO: 323529 - DNA, 25 bp, Homo sapien
tgggttccttactcagcctttaagt

SEQ ID NO: 323530 - DNA, 25 bp, Homo sapien
aagtggacttgcagctactgctctc

SEQ ID NO: 323531 - DNA, 25 bp, Homo sapien
acactgctaccaccatctgaagaac

SEQ ID NO: 323532 - DNA, 25 bp, Homo sapien
accatctgaagaaccctacagtagg

SEQ ID NO: 323533 - DNA, 25 bp, Homo sapien
tacagtaggagacacttggcccaga

SEQ ID NO: 323534 - DNA, 25 bp, Homo sapien
gacacttggcccagataatcacaaa

SEQ ID NO: 323535 - DNA, 25 bp, Homo sapien
gaaggacaagtctcataaccacatg

SEQ ID NO: 323536 - DNA, 25 bp, Homo sapien
cagcctccagagttttcaaatttag

SEQ ID NO: 323537 - DNA, 25 bp, Homo sapien
aatttaggctggtctgcgatttgct

SEQ ID NO: 323538 - DNA, 25 bp, Homo sapien
tggtctgcgatttgctttggctgac

SEQ ID NO: 323539 - DNA, 25 bp, Homo sapien
ttggttggtgatgtctgcctagtag

SEQ ID NO: 323540 - DNA, 25 bp, Homo sapien
gatgtctgcctagtagagtttttgt

SEQ ID NO: 323541 - DNA, 25 bp, Homo sapien
tctgattgatttgtaatggctgcct

SEQ ID NO: 323542 - DNA, 25 bp, Homo sapien
tagtctctgggtccagtctgttaga

SEQ ID NO: 323543 - DNA, 25 bp, Homo sapien
gtccagtctgttagaatcctgaaga

SEQ ID NO: 323544 - DNA, 25 bp, Homo sapien
atcctgaagaaatctgaggcctgcc

SEQ ID NO: 323545 - DNA, 25 bp, Homo sapien
gaggcctgccagagataggctatct

SEQ ID NO: 323546 - DNA, 25 bp, Homo sapien
gataggctatctcaatctgcaactg

SEQ ID NO: 323547 - DNA, 25 bp, Homo sapien
caactgaatgtatgggttcttttcc

SEQ ID NO: 323548 - DNA, 25 bp, Homo sapien
ctctccagctaaactctctgagtga

SEQ ID NO: 323549 - DNA, 25 bp, Homo sapien
tgagtgatcaaccatctcattagcc

SEQ ID NO: 323550 - DNA, 25 bp, Homo sapien
gacccgacccaaagaggaagaacat

SEQ ID NO: 323551 - DNA, 25 bp, Homo sapien
gaagaacatttctgggtgcgcgccc

SEQ ID NO: 323552 - DNA, 25 bp, Homo sapien
gccccaggtctttgcttgcagacgg

SEQ ID NO: 323553 - DNA, 25 bp, Homo sapien
agacccaggagggactccgagaagc

SEQ ID NO: 323554 - DNA, 25 bp, Homo sapien
agggactccgagaagccggccccag

SEQ ID NO: 323555 - DNA, 25 bp, Homo sapien
agcacctggaggtttctttcgcccg

SEQ ID NO: 323556 - DNA, 25 bp, Homo sapien
gcgttctacttcacccggtggtcca

SEQ ID NO: 323557 - DNA, 25 bp, Homo sapien
ccggtggtccagtggcgcctcctga

SEQ ID NO: 323558 - DNA, 25 bp, Homo sapien
tctgagcgcagcacgcgggtcagaa

SEQ ID NO: 323559 - DNA, 25 bp, Homo sapien
gcgggtcagaaggagcaaccgacct

SEQ ID NO: 323560 - DNA, 25 bp, Homo sapien
gctggtgaccagagaacggagattt

SEQ ID NO: 323561 - DNA, 25 bp, Homo sapien
gttgaggccaggcaataataacacc

SEQ ID NO: 323562 - DNA, 25 bp, Homo sapien
ggcaataataacacctccactacca

SEQ ID NO: 323563 - DNA, 25 bp, Homo sapien
gctcagctttcctggagtcatggat

SEQ ID NO: 323564 - DNA, 25 bp, Homo sapien
tttcctggagtcatggatcctctgt

SEQ ID NO: 323565 - DNA, 25 bp, Homo sapien
gagtcatggatcctctgtctgagac

SEQ ID NO: 323566 - DNA, 25 bp, Homo sapien
ggatcctctgtctgagacatgcact

SEQ ID NO: 323567 - DNA, 25 bp, Homo sapien
tgtctgagacatgcactctgcctgg

SEQ ID NO: 323568 - DNA, 25 bp, Homo sapien
gttaccttgcctctcacccagggtg

SEQ ID NO: 323569 - DNA, 25 bp, Homo sapien
tgacttgcatctctcacctactttc

SEQ ID NO: 323570 - DNA, 25 bp, Homo sapien
acttctgaaactgtcccctcaggtt

SEQ ID NO: 323571 - DNA, 25 bp, Homo sapien
tgtcccctcaggttcaaaccatggg

SEQ ID NO: 323572 - DNA, 25 bp, Homo sapien
gccaccccatgctccaaagtagaga

SEQ ID NO: 323573 - DNA, 25 bp, Homo sapien
gtagagaccaaagttatatacactt

SEQ ID NO: 323574 - DNA, 25 bp, Homo sapien
gccagaactgcatccaaaatgattc

SEQ ID NO: 323575 - DNA, 25 bp, Homo sapien
tcagtgctgtttcccaaggtttcaa

SEQ ID NO: 323576 - DNA, 25 bp, Homo sapien
tccccagcctaaccaggatacttga

SEQ ID NO: 323577 - DNA, 25 bp, Homo sapien
gcctaaccaggatacttgaaacttt

SEQ ID NO: 323578 - DNA, 25 bp, Homo sapien
acagtcactatgaatgtttccccag

SEQ ID NO: 323579 - DNA, 25 bp, Homo sapien
cactatgaatgtttccccaggtgat

SEQ ID NO: 323580 - DNA, 25 bp, Homo sapien
ggtctgcttgttctgaaggatacaa

SEQ ID NO: 323581 - DNA, 25 bp, Homo sapien
aggatacaagcagaggcacaagcct

SEQ ID NO: 323582 - DNA, 25 bp, Homo sapien
acaagcctcatgcattttccaagcc

SEQ ID NO: 323583 - DNA, 25 bp, Homo sapien
atggcaacagcaagcctgcatctaa

SEQ ID NO: 323584 - DNA, 25 bp, Homo sapien
ggtgctgtctaaatgctcctgaaat

SEQ ID NO: 323585 - DNA, 25 bp, Homo sapien
ggccaagttagacaattctctgcgt

SEQ ID NO: 323586 - DNA, 25 bp, Homo sapien
acaattctctgcgtttttaaagaca

SEQ ID NO: 323587 - DNA, 25 bp, Homo sapien
atgtattccgccactcattacacat

SEQ ID NO: 323588 - DNA, 25 bp, Homo sapien
gtgctaccttcacagactcattgaa

SEQ ID NO: 323589 - DNA, 25 bp, Homo sapien
cactaagtgtcatttctacatgctg

SEQ ID NO: 323590 - DNA, 25 bp, Homo sapien
atgctggacacaaaaccaggccctc

SEQ ID NO: 323591 - DNA, 25 bp, Homo sapien
ccaggccctcaggatacaactgtga

SEQ ID NO: 323592 - DNA, 25 bp, Homo sapien
aactgtgagcaagatataatccctg

SEQ ID NO: 323593 - DNA, 25 bp, Homo sapien
atccctgacctcgagatacatacgg

SEQ ID NO: 323594 - DNA, 25 bp, Homo sapien
tctccccagtaattccttaattact

SEQ ID NO: 323595 - DNA, 25 bp, Homo sapien
aattccttaattactctttctacat

SEQ ID NO: 323596 - DNA, 25 bp, Homo sapien
gttctaaaattgctagtgcgagtgt

SEQ ID NO: 323597 - DNA, 25 bp, Homo sapien
attgctagtgcgagtgtgttttcct

SEQ ID NO: 323598 - DNA, 25 bp, Homo sapien
gttttttattctgggaaatcatatt

SEQ ID NO: 323599 - DNA, 25 bp, Homo sapien
gaaatcatatttcactataattact

SEQ ID NO: 323600 - DNA, 25 bp, Homo sapien
gataaaaccctgtttggatgttaga

SEQ ID NO: 323601 - DNA, 25 bp, Homo sapien
aaccctgtttggatgttagaacact

SEQ ID NO: 323602 - DNA, 25 bp, Homo sapien
tggatgttagaacactttggaagct

SEQ ID NO: 323603 - DNA, 25 bp, Homo sapien
aagtgttgatatgtgacatcctaaa

SEQ ID NO: 323604 - DNA, 25 bp, Homo sapien
tgtgacatcctaaaaagagcctagt

SEQ ID NO: 323605 - DNA, 25 bp, Homo sapien
gatactgcaaatcaattgccctcca

SEQ ID NO: 323606 - DNA, 25 bp, Homo sapien
ggaccacaccaatttatacgcttat

SEQ ID NO: 323607 - DNA, 25 bp, Homo sapien
aagcctgtgagtgtttcttacctga

SEQ ID NO: 323608 - DNA, 25 bp, Homo sapien
agtgtttcttacctgacaccctcag

SEQ ID NO: 323609 - DNA, 25 bp, Homo sapien
atgatatcccattattgaagcattc

SEQ ID NO: 323610 - DNA, 25 bp, Homo sapien
ctcagtcccactggatactttaaaa

SEQ ID NO: 323611 - DNA, 25 bp, Homo sapien
taaaactctttcatccttaccaatc

SEQ ID NO: 323612 - DNA, 25 bp, Homo sapien
tctcctgttgatgagtgtgctataa

SEQ ID NO: 323613 - DNA, 25 bp, Homo sapien
acaaggttgcaacatcttggttctt

SEQ ID NO: 323614 - DNA, 25 bp, Homo sapien
atcttggttcttgggtctttgtgcg

SEQ ID NO: 323615 - DNA, 25 bp, Homo sapien
ttgggtctttgtgcgtgtttttatc

SEQ ID NO: 323616 - DNA, 25 bp, Homo sapien
caatattgcgggtgagaaaagctac

SEQ ID NO: 323617 - DNA, 25 bp, Homo sapien
ggtgctgacagaggacttggcccca

SEQ ID NO: 323618 - DNA, 25 bp, Homo sapien
ctgagggccctgtaagaaagtgaca

SEQ ID NO: 323619 - DNA, 25 bp, Homo sapien
gaaagtgacagcacaagcttttatc

SEQ ID NO: 323620 - DNA, 25 bp, Homo sapien
agcttttatcattgcttccaagaat

SEQ ID NO: 323621 - DNA, 25 bp, Homo sapien
gaattcaacaggaaccaccatgact

SEQ ID NO: 323622 - DNA, 25 bp, Homo sapien
ggaaccaccatgacttactcaagga

SEQ ID NO: 323623 - DNA, 25 bp, Homo sapien
ggacatcatgggtctacataggcca

SEQ ID NO: 323624 - DNA, 25 bp, Homo sapien
gtctacataggccatctgaggagtc

SEQ ID NO: 323625 - DNA, 25 bp, Homo sapien
tgaaaagaggcagctttccgacgct

SEQ ID NO: 323626 - DNA, 25 bp, Homo sapien
aggcagctttccgacgctggtgaga

SEQ ID NO: 323627 - DNA, 25 bp, Homo sapien
tttaatcaccttcagctccctggtc

SEQ ID NO: 323628 - DNA, 25 bp, Homo sapien
tggtctcctagagccacgggtcagc

SEQ ID NO: 323629 - DNA, 25 bp, Homo sapien
tcctccaaagacaagtctgctcaga

SEQ ID NO: 323630 - DNA, 25 bp, Homo sapien
aagtctgctcagaatgtcactgaaa

SEQ ID NO: 323631 - DNA, 25 bp, Homo sapien
gaatgtcactgaaactctgagcatc

SEQ ID NO: 323632 - DNA, 25 bp, Homo sapien
aaactctgagcatccactcaacaag

SEQ ID NO: 323633 - DNA, 25 bp, Homo sapien
tcaacaagcctccatcttcttactt

SEQ ID NO: 323634 - DNA, 25 bp, Homo sapien
ccatcttcttactttctcatctttt

SEQ ID NO: 323635 - DNA, 25 bp, Homo sapien
catcttttctcttttaggcctgaag

SEQ ID NO: 323636 - DNA, 25 bp, Homo sapien
ggtggctgaggaaaacatcctgatt

SEQ ID NO: 323637 - DNA, 25 bp, Homo sapien
aacatcctgattttgcttgctttta

SEQ ID NO: 323638 - DNA, 25 bp, Homo sapien
atttggctccagaaagaccccagtg

SEQ ID NO: 323639 - DNA, 25 bp, Homo sapien
ccagtgccttttgacaatggccagg

SEQ ID NO: 323640 - DNA, 25 bp, Homo sapien
tgacaatggccagggttttacctac

SEQ ID NO: 323641 - DNA, 25 bp, Homo sapien
ttttacctacttcctgccagtcttt

SEQ ID NO: 323642 - DNA, 25 bp, Homo sapien
tcctgccagtctttcccaaaggaaa

SEQ ID NO: 323643 - DNA, 25 bp, Homo sapien
cccctggagtccgagaaggaaaatg

SEQ ID NO: 323644 - DNA, 25 bp, Homo sapien
tctggttcatactgtggtcccttgt

SEQ ID NO: 323645 - DNA, 25 bp, Homo sapien
atactgtggtcccttgtaacctcag

SEQ ID NO: 323646 - DNA, 25 bp, Homo sapien
tggtcccttgtaacctcaggtcttt

SEQ ID NO: 323647 - DNA, 25 bp, Homo sapien
acctcaggtctttaatgtgatcact

SEQ ID NO: 323648 - DNA, 25 bp, Homo sapien
aaatacctgaattcttaacactgtt

SEQ ID NO: 323649 - DNA, 25 bp, Homo sapien
cgagagagctggtccctgcccgcgg

SEQ ID NO: 323650 - DNA, 25 bp, Homo sapien
tgcccgcggccggaggagggctaga

SEQ ID NO: 323651 - DNA, 25 bp, Homo sapien
gacgccgggcactgtcaccacgggt

SEQ ID NO: 323652 - DNA, 25 bp, Homo sapien
tgtcaccacgggtgcgccgagcgca

SEQ ID NO: 323653 - DNA, 25 bp, Homo sapien
tgcaatagaaatccgggcagcccga

SEQ ID NO: 323654 - DNA, 25 bp, Homo sapien
gcaccgacccgggacacgggcagct

SEQ ID NO: 323655 - DNA, 25 bp, Homo sapien
agaaatccgggcagcccgaagaggc

SEQ ID NO: 323656 - DNA, 25 bp, Homo sapien
agcccgaagaggcacccagcgctcc

SEQ ID NO: 323657 - DNA, 25 bp, Homo sapien
gggagtccctggctctagaccagcc

SEQ ID NO: 323658 - DNA, 25 bp, Homo sapien
ggagtccctggctctagaccagccg

SEQ ID NO: 323659 - DNA, 25 bp, Homo sapien
cctggctctagaccagccgcgagga

SEQ ID NO: 323660 - DNA, 25 bp, Homo sapien
tcttgggtacatacttcctggtcag

SEQ ID NO: 323661 - DNA, 25 bp, Homo sapien
ggtacatacttcctggtcagtaaga

SEQ ID NO: 323662 - DNA, 25 bp, Homo sapien
accttgggcattcctacttataagc

SEQ ID NO: 323663 - DNA, 25 bp, Homo sapien
gggcattcctacttataagctgcaa

SEQ ID NO: 323664 - DNA, 25 bp, Homo sapien
tcctacttataagctgcaaaacctg

SEQ ID NO: 323665 - DNA, 25 bp, Homo sapien
tcttaaagggtaacacagccctgga

SEQ ID NO: 323666 - DNA, 25 bp, Homo sapien
ggattctcccagatatttaacccct

SEQ ID NO: 323667 - DNA, 25 bp, Homo sapien
gattctcccagatatttaacccctg

SEQ ID NO: 323668 - DNA, 25 bp, Homo sapien
acctctgtcataaagaatgcacagc

SEQ ID NO: 323669 - DNA, 25 bp, Homo sapien
gaatgcacagctaagtggtttaatc

SEQ ID NO: 323670 - DNA, 25 bp, Homo sapien
ctaagtggtttaatcattgcacctg

SEQ ID NO: 323671 - DNA, 25 bp, Homo sapien
aagtgtcaatagctttctaaataaa

SEQ ID NO: 323672 - DNA, 25 bp, Homo sapien
aatattaaatatctactgtcctgta

SEQ ID NO: 323673 - DNA, 25 bp, Homo sapien
aaatatctactgtcctgtagtgaag

SEQ ID NO: 323674 - DNA, 25 bp, Homo sapien
atctactgtcctgtagtgaaggagt

SEQ ID NO: 323675 - DNA, 25 bp, Homo sapien
actgtcctgtagtgaaggagtaatt

SEQ ID NO: 323676 - DNA, 25 bp, Homo sapien
tacaaagtctccagtgtttccaggt

SEQ ID NO: 323677 - DNA, 25 bp, Homo sapien
gaaacaaaatacagcaaactacatt

SEQ ID NO: 323678 - DNA, 25 bp, Homo sapien
aactacattgttacttcagtgtatt

SEQ ID NO: 323679 - DNA, 25 bp, Homo sapien
gttacttcagtgtattgttgccaaa

SEQ ID NO: 323680 - DNA, 25 bp, Homo sapien
cttcagtgtattgttgccaaaaatg

SEQ ID NO: 323681 - DNA, 25 bp, Homo sapien
gttgccaaaaatgacaagatattat

SEQ ID NO: 323682 - DNA, 25 bp, Homo sapien
gaaagtgatggatctgtacattcat

SEQ ID NO: 323683 - DNA, 25 bp, Homo sapien
tcgttaattaagccccgggaatcag

SEQ ID NO: 323684 - DNA, 25 bp, Homo sapien
gggaatcagggacctttcctggcac

SEQ ID NO: 323685 - DNA, 25 bp, Homo sapien
ctggcaccctctacagtgttagtgg

SEQ ID NO: 323686 - DNA, 25 bp, Homo sapien
gtgttagtggcctttgtggtaaaag

SEQ ID NO: 323687 - DNA, 25 bp, Homo sapien
atactcatttcatgcaattacaggc

SEQ ID NO: 323688 - DNA, 25 bp, Homo sapien
atatagcttcaaaaggacatgtatg

SEQ ID NO: 323689 - DNA, 25 bp, Homo sapien
gtatgaagaaagatgtctcagcaca

SEQ ID NO: 323690 - DNA, 25 bp, Homo sapien
agatgtctcagcacataggtagtta

SEQ ID NO: 323691 - DNA, 25 bp, Homo sapien
gtctcagcacataggtagttataaa

SEQ ID NO: 323692 - DNA, 25 bp, Homo sapien
accaagggtttgagagactgacttt

SEQ ID NO: 323693 - DNA, 25 bp, Homo sapien
agaatatctatctgtctaacccatt

SEQ ID NO: 323694 - DNA, 25 bp, Homo sapien
atatctatctgtctaacccatttcc

SEQ ID NO: 323695 - DNA, 25 bp, Homo sapien
cagtgatgggcttgtttttgtaaaa

SEQ ID NO: 323696 - DNA, 25 bp, Homo sapien
ttaccagaaaactcagtggagattt

SEQ ID NO: 323697 - DNA, 25 bp, Homo sapien
agtggagatttactgaaaaactcag

SEQ ID NO: 323698 - DNA, 25 bp, Homo sapien
acaaaaagtagggttctgtcccatg

SEQ ID NO: 323699 - DNA, 25 bp, Homo sapien
aaagtagggttctgtcccatgtgtc

SEQ ID NO: 323700 - DNA, 25 bp, Homo sapien
agggttctgtcccatgtgtctctga

SEQ ID NO: 323701 - DNA, 25 bp, Homo sapien
ttctgtcccatgtgtctctgacaca

SEQ ID NO: 323702 - DNA, 25 bp, Homo sapien
gtcccatgtgtctctgacacattta

SEQ ID NO: 323703 - DNA, 25 bp, Homo sapien
attttggtcaaattatgagtggttg

SEQ ID NO: 323704 - DNA, 25 bp, Homo sapien
ttcggagtgctttgtgaagatttca

SEQ ID NO: 323705 - DNA, 25 bp, Homo sapien
agatttcaattgtctgtctctttct

SEQ ID NO: 323706 - DNA, 25 bp, Homo sapien
ttctctctttgacttgtatgaagga

SEQ ID NO: 323707 - DNA, 25 bp, Homo sapien
attgtacattgcctgatatctcttt

SEQ ID NO: 323708 - DNA, 25 bp, Homo sapien
acattgcctgatatctctttgtaaa

SEQ ID NO: 323709 - DNA, 25 bp, Homo sapien
ctaacatccaagcattctgaagtct

SEQ ID NO: 323710 - DNA, 25 bp, Homo sapien
aagtcttgcttatccttctgagttt

SEQ ID NO: 323711 - DNA, 25 bp, Homo sapien
tgcttatccttctgagtttagttct

SEQ ID NO: 323712 - DNA, 25 bp, Homo sapien
tagagttttgcaacagagttcttgt

SEQ ID NO: 323713 - DNA, 25 bp, Homo sapien
tgcaacagagttcttgtttgaagcc

SEQ ID NO: 323714 - DNA, 25 bp, Homo sapien
gaagcctctaaagactacctgtaaa

SEQ ID NO: 323715 - DNA, 25 bp, Homo sapien
ggaagcagacttctaaaaataatat

SEQ ID NO: 323716 - DNA, 25 bp, Homo sapien
tattctgatgatgccttatcaaagg

SEQ ID NO: 323717 - DNA, 25 bp, Homo sapien
gatgatgccttatcaaaggagaaca

SEQ ID NO: 323718 - DNA, 25 bp, Homo sapien
gatgccttatcaaaggagaacaggg

SEQ ID NO: 323719 - DNA, 25 bp, Homo sapien
gtctgtgagacggaagttttactaa

SEQ ID NO: 323720 - DNA, 25 bp, Homo sapien
agttttactaaaagagctggagcaa

SEQ ID NO: 323721 - DNA, 25 bp, Homo sapien
tgcagcaagcactgcaacccacagc

SEQ ID NO: 323722 - DNA, 25 bp, Homo sapien
ctgcaacccacagccacacctgatg

SEQ ID NO: 323723 - DNA, 25 bp, Homo sapien
acacctgatgaatcagaagaaggac

SEQ ID NO: 323724 - DNA, 25 bp, Homo sapien
gaaaagttatctaaatgcagcccag

SEQ ID NO: 323725 - DNA, 25 bp, Homo sapien
aaagttatctaaatgcagcccagaa

SEQ ID NO: 323726 - DNA, 25 bp, Homo sapien
acgcccaccaccatgagctggagtg

SEQ ID NO: 323727 - DNA, 25 bp, Homo sapien
ttcaggatttttcttctcacagctc

SEQ ID NO: 323728 - DNA, 25 bp, Homo sapien
tttgtgttgggtcctcagccaacac

SEQ ID NO: 323729 - DNA, 25 bp, Homo sapien
tgggtcctcagccaacactcaaggg

SEQ ID NO: 323730 - DNA, 25 bp, Homo sapien
gaaacctgtagtgacagtgtgccct

SEQ ID NO: 323731 - DNA, 25 bp, Homo sapien
tgtagtgacagtgtgccctggtcat

SEQ ID NO: 323732 - DNA, 25 bp, Homo sapien
gtgccctggtcatccttaaaataac

SEQ ID NO: 323733 - DNA, 25 bp, Homo sapien
ttaaaataacctgcatctcccctgt

SEQ ID NO: 323734 - DNA, 25 bp, Homo sapien
ccctgtcctggtgtgggagtaagct

SEQ ID NO: 323735 - DNA, 25 bp, Homo sapien
gagtaagctgacagtttctctgcag

SEQ ID NO: 323736 - DNA, 25 bp, Homo sapien
ggtcctgtcaactttagcatgctat

SEQ ID NO: 323737 - DNA, 25 bp, Homo sapien
gaaagtgatggatctgtacattcat

SEQ ID NO: 323738 - DNA, 25 bp, Homo sapien
tcgttaattaagccccgggaatcag

SEQ ID NO: 323739 - DNA, 25 bp, Homo sapien
gtgttagtggcctttgtggtaaaag

SEQ ID NO: 323740 - DNA, 25 bp, Homo sapien
ctcagatactcatttcatgcaatta

SEQ ID NO: 323741 - DNA, 25 bp, Homo sapien
atactcatttcatgcaattacaggc

SEQ ID NO: 323742 - DNA, 25 bp, Homo sapien
catttcatgcaattacaggcaaact

SEQ ID NO: 323743 - DNA, 25 bp, Homo sapien
atatagcttcaaaaggacatgtatg

SEQ ID NO: 323744 - DNA, 25 bp, Homo sapien
gtatgaagaaagatgtctcagcaca

SEQ ID NO: 323745 - DNA, 25 bp, Homo sapien
agatgtctcagcacataggtagtta

SEQ ID NO: 323746 - DNA, 25 bp, Homo sapien
gtctcagcacataggtagttataaa

SEQ ID NO: 323747 - DNA, 25 bp, Homo sapien
accaagggtttgagagactgacttt

SEQ ID NO: 323748 - DNA, 25 bp, Homo sapien
gagacggcaaggatggtgacaccca

SEQ ID NO: 323749 - DNA, 25 bp, Homo sapien
atggtgacacccagaccgatgccgg

SEQ ID NO: 323750 - DNA, 25 bp, Homo sapien
agaacccgattctctcgggcagcag

SEQ ID NO: 323751 - DNA, 25 bp, Homo sapien
ctccctacgagtgggacctggacaa

SEQ ID NO: 323752 - DNA, 25 bp, Homo sapien
ttggttccccaagattactgaagat

SEQ ID NO: 323753 - DNA, 25 bp, Homo sapien
gatttcattgctacatatcaggcca

SEQ ID NO: 323754 - DNA, 25 bp, Homo sapien
ggccaattatggcttctctaacgat

SEQ ID NO: 323755 - DNA, 25 bp, Homo sapien
gcttctctaacgatggcgcatctag

SEQ ID NO: 323756 - DNA, 25 bp, Homo sapien
gcgcatctagttctaccgcaaatgt

SEQ ID NO: 323757 - DNA, 25 bp, Homo sapien
gaagatgtccatgctaggactgcag

SEQ ID NO: 323758 - DNA, 25 bp, Homo sapien
ggactgcagaggaacctccacaaga

SEQ ID NO: 323759 - DNA, 25 bp, Homo sapien
ttttatataacctctgtagtcctaa

SEQ ID NO: 323760 - DNA, 25 bp, Homo sapien
aacctctgtagtcctaacatatcaa

SEQ ID NO: 323761 - DNA, 25 bp, Homo sapien
gtagtcctaacatatcaaacattaa

SEQ ID NO: 323762 - DNA, 25 bp, Homo sapien
gcatggtatagggaaaaaacccact

SEQ ID NO: 323763 - DNA, 25 bp, Homo sapien
cccactccagttttgtagttactca

SEQ ID NO: 323764 - DNA, 25 bp, Homo sapien
ccagttttgtagttactcattgctg

SEQ ID NO: 323765 - DNA, 25 bp, Homo sapien
gctgagatagaattctggctccaat

SEQ ID NO: 323766 - DNA, 25 bp, Homo sapien
attctggctccaatgtttactagtt

SEQ ID NO: 323767 - DNA, 25 bp, Homo sapien
tgtttactagttagtgggccctaga

SEQ ID NO: 323768 - DNA, 25 bp, Homo sapien
gggccctagaggaaatatgacttta

SEQ ID NO: 323769 - DNA, 25 bp, Homo sapien
aactgagcatatgatgttaaattgt

SEQ ID NO: 323770 - DNA, 25 bp, Homo sapien
gtagctctatcaatctgttttccag

SEQ ID NO: 323771 - DNA, 25 bp, Homo sapien
tgttttccagatccggcatgcttag

SEQ ID NO: 323772 - DNA, 25 bp, Homo sapien
gatccggcatgcttaggtttctagc

SEQ ID NO: 323773 - DNA, 25 bp, Homo sapien
ttaggtttctagcagcaaagcacat

SEQ ID NO: 323774 - DNA, 25 bp, Homo sapien
gtgctgttctggtgttttggcgaac

SEQ ID NO: 323775 - DNA, 25 bp, Homo sapien
ttttggcgaaccagagtcctcactg

SEQ ID NO: 323776 - DNA, 25 bp, Homo sapien
actgccactaaagcttggtgactgg

SEQ ID NO: 323777 - DNA, 25 bp, Homo sapien
cttcccacggcagatctgatactaa

SEQ ID NO: 323778 - DNA, 25 bp, Homo sapien
tacgaaccaggagtgtgctgtggct

SEQ ID NO: 323779 - DNA, 25 bp, Homo sapien
ctgtatctttgcagcgtaggatcaa

SEQ ID NO: 323780 - DNA, 25 bp, Homo sapien
ggatcaacgtgttcctgctatcagg

SEQ ID NO: 323781 - DNA, 25 bp, Homo sapien
ggactgcctgtatttggaagattta

SEQ ID NO: 323782 - DNA, 25 bp, Homo sapien
taaaaacctagcatcctgttctcac

SEQ ID NO: 323783 - DNA, 25 bp, Homo sapien
tcaccctctaagctgcattgagaaa

SEQ ID NO: 323784 - DNA, 25 bp, Homo sapien
gagaaatgactcgtctctgtatttg

SEQ ID NO: 323785 - DNA, 25 bp, Homo sapien
gtctctgtatttgtattaagcctta

SEQ ID NO: 323786 - DNA, 25 bp, Homo sapien
acttttcttaagtgcattcggtgcc

SEQ ID NO: 323787 - DNA, 25 bp, Homo sapien
gcattcggtgccaacattttttaga

SEQ ID NO: 323788 - DNA, 25 bp, Homo sapien
gtgccaacattttttagagctgtac

SEQ ID NO: 323789 - DNA, 25 bp, Homo sapien
aagcctgtactcacatcacaatgtc

SEQ ID NO: 323790 - DNA, 25 bp, Homo sapien
cacaatgtcattttgataggagcgt

SEQ ID NO: 323791 - DNA, 25 bp, Homo sapien
tgataggagcgttttgttattttta

SEQ ID NO: 323792 - DNA, 25 bp, Homo sapien
ggtctgtagtctttgggtctttggg

SEQ ID NO: 323793 - DNA, 25 bp, Homo sapien
agcctagacaacatactacgaccct

SEQ ID NO: 323794 - DNA, 25 bp, Homo sapien
gcctagacaacatactacgaccctg

SEQ ID NO: 323795 - DNA, 25 bp, Homo sapien
tagacaacatactacgaccctgtct

SEQ ID NO: 323796 - DNA, 25 bp, Homo sapien
agacaacatactacgaccctgtcta

SEQ ID NO: 323797 - DNA, 25 bp, Homo sapien
caacatactacgaccctgtctatac

SEQ ID NO: 323798 - DNA, 25 bp, Homo sapien
aacatactacgaccctgtctataca

SEQ ID NO: 323799 - DNA, 25 bp, Homo sapien
aaaacttctctaaattagccggatg

SEQ ID NO: 323800 - DNA, 25 bp, Homo sapien
aaacttctctaaattagccggatgt

SEQ ID NO: 323801 - DNA, 25 bp, Homo sapien
ccatacttttacattagtctgagaa

SEQ ID NO: 323802 - DNA, 25 bp, Homo sapien
gaaatcagacgcaccggcctttatt

SEQ ID NO: 323803 - DNA, 25 bp, Homo sapien
aatggcgtcattattcttgactttt

SEQ ID NO: 323804 - DNA, 25 bp, Homo sapien
gacgcaccggcctttattattatat

SEQ ID NO: 323805 - DNA, 25 bp, Homo sapien
aagactgtattagttctcagagcaa

SEQ ID NO: 323806 - DNA, 25 bp, Homo sapien
agttctcagagcaaggcatcatcta

SEQ ID NO: 323807 - DNA, 25 bp, Homo sapien
agagcaaggcatcatctactcccct

SEQ ID NO: 323808 - DNA, 25 bp, Homo sapien
tactcccctgcacctgagagtctgg

SEQ ID NO: 323809 - DNA, 25 bp, Homo sapien
tgcacctgagagtctggccccagat

SEQ ID NO: 323810 - DNA, 25 bp, Homo sapien
tatatatgctacatctgttgagtat

SEQ ID NO: 323811 - DNA, 25 bp, Homo sapien
ttatttcataaaccacttcttccct

SEQ ID NO: 323812 - DNA, 25 bp, Homo sapien
ccagtgggctttgaggattcttatg

SEQ ID NO: 323813 - DNA, 25 bp, Homo sapien
tgaggattcttatgggcaggagccc

SEQ ID NO: 323814 - DNA, 25 bp, Homo sapien
tccactgcatgtagcactggcacta

SEQ ID NO: 323815 - DNA, 25 bp, Homo sapien
ttgggcccacagactccaatgggaa

SEQ ID NO: 323816 - DNA, 25 bp, Homo sapien
tttgggcggtccttttgctgccagc

SEQ ID NO: 323817 - DNA, 25 bp, Homo sapien
cagctgttgccctggtccttgggtt

SEQ ID NO: 323818 - DNA, 25 bp, Homo sapien
tttggtgtctttgtgggcctgagcc

SEQ ID NO: 323819 - DNA, 25 bp, Homo sapien
ggcactacaagacagcgacgatcct

SEQ ID NO: 323820 - DNA, 25 bp, Homo sapien
gacgatcctcaggtcaccgtaatga

SEQ ID NO: 323821 - DNA, 25 bp, Homo sapien
ggtcaccgtaatgacactgccaggc

SEQ ID NO: 323822 - DNA, 25 bp, Homo sapien
aggccccaggacatcgtgagctctc

SEQ ID NO: 323823 - DNA, 25 bp, Homo sapien
gtacttaccctcataagcattaaaa

SEQ ID NO: 323824 - DNA, 25 bp, Homo sapien
gaaattccatagaaatgtgcctatc

SEQ ID NO: 323825 - DNA, 25 bp, Homo sapien
gtgcctatcatgttatactgactca

SEQ ID NO: 323826 - DNA, 25 bp, Homo sapien
gactcaaaccagaagacctagagta

SEQ ID NO: 323827 - DNA, 25 bp, Homo sapien
gaagacctagagtatgatattgcta

SEQ ID NO: 323828 - DNA, 25 bp, Homo sapien
tgctaatataatacatgtggtgggt

SEQ ID NO: 323829 - DNA, 25 bp, Homo sapien
gtgtgtgagatttatcattgccata

SEQ ID NO: 323830 - DNA, 25 bp, Homo sapien
tgagatttatcattgccatagtgta

SEQ ID NO: 323831 - DNA, 25 bp, Homo sapien
gaaatggcacattttctggatgtga

SEQ ID NO: 323832 - DNA, 25 bp, Homo sapien
attttctggatgtgagagttggtca

SEQ ID NO: 323833 - DNA, 25 bp, Homo sapien
gagagttggtcaaaagatcacaaaa

SEQ ID NO: 323834 - DNA, 25 bp, Homo sapien
tgagggagagaagaccttgggccaa

SEQ ID NO: 323835 - DNA, 25 bp, Homo sapien
gggagagaagaccttgggccaagat

SEQ ID NO: 323836 - DNA, 25 bp, Homo sapien
agcaggacagaggatttgctctgga

SEQ ID NO: 323837 - DNA, 25 bp, Homo sapien
gcaggacagaggatttgctctggac

SEQ ID NO: 323838 - DNA, 25 bp, Homo sapien
caggacagaggatttgctctggaca

SEQ ID NO: 323839 - DNA, 25 bp, Homo sapien
aggacagaggatttgctctggacag

SEQ ID NO: 323840 - DNA, 25 bp, Homo sapien
ggacagaggatttgctctggacaga

SEQ ID NO: 323841 - DNA, 25 bp, Homo sapien
gacagaggatttgctctggacagag

SEQ ID NO: 323842 - DNA, 25 bp, Homo sapien
acagaggatttgctctggacagaga

SEQ ID NO: 323843 - DNA, 25 bp, Homo sapien
cagaggatttgctctggacagagat

SEQ ID NO: 323844 - DNA, 25 bp, Homo sapien
aggatttgctctggacagagatgga

SEQ ID NO: 323845 - DNA, 25 bp, Homo sapien
ggagaaattgatctgcctattcttt

SEQ ID NO: 323846 - DNA, 25 bp, Homo sapien
ttgatctgcctattcttttcaaagc

SEQ ID NO: 323847 - DNA, 25 bp, Homo sapien
tcaaagcctatcttactaatgtttg

SEQ ID NO: 323848 - DNA, 25 bp, Homo sapien
aattcttgagtatgttaggtccttc

SEQ ID NO: 323849 - DNA, 25 bp, Homo sapien
gagtatgttaggtccttctttaagg

SEQ ID NO: 323850 - DNA, 25 bp, Homo sapien
tttgcacaagcacaggacaccatga

SEQ ID NO: 323851 - DNA, 25 bp, Homo sapien
gcacaggacaccatgatttgtgtgt

SEQ ID NO: 323852 - DNA, 25 bp, Homo sapien
agtgtgttcagctttaagctttgca

SEQ ID NO: 323853 - DNA, 25 bp, Homo sapien
aagctttgcaatcccttaggacact

SEQ ID NO: 323854 - DNA, 25 bp, Homo sapien
attcgctaggcccacacagtaactc

SEQ ID NO: 323855 - DNA, 25 bp, Homo sapien
gtaactcacctgtagacctgctgaa

SEQ ID NO: 323856 - DNA, 25 bp, Homo sapien
aggtaaccatctttttgggtgcctg

SEQ ID NO: 323857 - DNA, 25 bp, Homo sapien
tttttgggtgcctgggcatggtcat

SEQ ID NO: 323858 - DNA, 25 bp, Homo sapien
gcatggtcattgtcccagagtttta

SEQ ID NO: 323859 - DNA, 25 bp, Homo sapien
tgtcccagagttttaacataagtct

SEQ ID NO: 323860 - DNA, 25 bp, Homo sapien
aagtctctactaaagtatcctgatt

SEQ ID NO: 323861 - DNA, 25 bp, Homo sapien
tatcctgatttgcaagggaggtcat

SEQ ID NO: 323862 - DNA, 25 bp, Homo sapien
gatttgcaagggaggtcatggacca

SEQ ID NO: 323863 - DNA, 25 bp, Homo sapien
gtcatggaccaagtacaaagcggca

SEQ ID NO: 323864 - DNA, 25 bp, Homo sapien
attaaggtacctgacattgttgaac

SEQ ID NO: 323865 - DNA, 25 bp, Homo sapien
ttgaactttctctgtgctctttaga

SEQ ID NO: 323866 - DNA, 25 bp, Homo sapien
gtgctctttagaaaaccgtcgaata

SEQ ID NO: 323867 - DNA, 25 bp, Homo sapien
ccttgggccaagatgctaaatggga

SEQ ID NO: 323868 - DNA, 25 bp, Homo sapien
cttgggccaagatgctaaatgggaa

SEQ ID NO: 323869 - DNA, 25 bp, Homo sapien
ttgggccaagatgctaaatgggaat

SEQ ID NO: 323870 - DNA, 25 bp, Homo sapien
gggccaagatgctaaatgggaatgc

SEQ ID NO: 323871 - DNA, 25 bp, Homo sapien
ggccaagatgctaaatgggaatgca

SEQ ID NO: 323872 - DNA, 25 bp, Homo sapien
gccaagatgctaaatgggaatgcaa

SEQ ID NO: 323873 - DNA, 25 bp, Homo sapien
ccaagatgctaaatgggaatgcaaa

SEQ ID NO: 323874 - DNA, 25 bp, Homo sapien
gatgctaaatgggaatgcaaagctt

SEQ ID NO: 323875 - DNA, 25 bp, Homo sapien
tgctaaatgggaatgcaaagcttga

SEQ ID NO: 323876 - DNA, 25 bp, Homo sapien
gctaaatgggaatgcaaagcttgag

SEQ ID NO: 323877 - DNA, 25 bp, Homo sapien
tggcaggggcaaagggctcaagggt

SEQ ID NO: 323878 - DNA, 25 bp, Homo sapien
ggctggactcccatccaaccctcta

SEQ ID NO: 323879 - DNA, 25 bp, Homo sapien
ggagaagccaggcacaattgcaagc

SEQ ID NO: 323880 - DNA, 25 bp, Homo sapien
gagaagccaggcacaattgcaagcc

SEQ ID NO: 323881 - DNA, 25 bp, Homo sapien
agaagccaggcacaattgcaagccc

SEQ ID NO: 323882 - DNA, 25 bp, Homo sapien
gaagccaggcacaattgcaagcccc

SEQ ID NO: 323883 - DNA, 25 bp, Homo sapien
aagccaggcacaattgcaagccccg

SEQ ID NO: 323884 - DNA, 25 bp, Homo sapien
agccaggcacaattgcaagccccgc

SEQ ID NO: 323885 - DNA, 25 bp, Homo sapien
gccaggcacaattgcaagccccgcc

SEQ ID NO: 323886 - DNA, 25 bp, Homo sapien
caggcacaattgcaagccccgcccg

SEQ ID NO: 323887 - DNA, 25 bp, Homo sapien
ggcacaattgcaagccccgcccgct

SEQ ID NO: 323888 - DNA, 25 bp, Homo sapien
aattgcaagccccgcccgctacctg

SEQ ID NO: 323889 - DNA, 25 bp, Homo sapien
atggtgaccctttatttcatctgta

SEQ ID NO: 323890 - DNA, 25 bp, Homo sapien
tgtatttaaacctctctattccctg

SEQ ID NO: 323891 - DNA, 25 bp, Homo sapien
acatcttttgccacgtatagctgga

SEQ ID NO: 323892 - DNA, 25 bp, Homo sapien
aattaagtgttgtcttggagctgtt

SEQ ID NO: 323893 - DNA, 25 bp, Homo sapien
gaaaaatcttacagtggctcatcat

SEQ ID NO: 323894 - DNA, 25 bp, Homo sapien
agtggctcatcatctctttagttgt

SEQ ID NO: 323895 - DNA, 25 bp, Homo sapien
ggctcatcatctctttagttgtttt

SEQ ID NO: 323896 - DNA, 25 bp, Homo sapien
agctcagaatcttgccagagtctgt

SEQ ID NO: 323897 - DNA, 25 bp, Homo sapien
cagagtctgttctttggtccttgtt

SEQ ID NO: 323898 - DNA, 25 bp, Homo sapien
gtctgttctttggtccttgttctac

SEQ ID NO: 323899 - DNA, 25 bp, Homo sapien
tgttctaccctaaactttgtatcac

SEQ ID NO: 323900 - DNA, 25 bp, Homo sapien
gagatggtgaccctttatttcatct

SEQ ID NO: 323901 - DNA, 25 bp, Homo sapien
atggtgaccctttatttcatctgta

SEQ ID NO: 323902 - DNA, 25 bp, Homo sapien
atttcatctgtatttaaacctctct

SEQ ID NO: 323903 - DNA, 25 bp, Homo sapien
tgtatttaaacctctctattccctg

SEQ ID NO: 323904 - DNA, 25 bp, Homo sapien
taaacctctctattccctgccataa

SEQ ID NO: 323905 - DNA, 25 bp, Homo sapien
tctctattccctgccataacatctt

SEQ ID NO: 323906 - DNA, 25 bp, Homo sapien
aacatcttttgccacgtatagctgg

SEQ ID NO: 323907 - DNA, 25 bp, Homo sapien
atcttttgccacgtatagctggaat

SEQ ID NO: 323908 - DNA, 25 bp, Homo sapien
ttttgccacgtatagctggaattaa

SEQ ID NO: 323909 - DNA, 25 bp, Homo sapien
gtatagctggaattaagtgttgtct

SEQ ID NO: 323910 - DNA, 25 bp, Homo sapien
aattaagtgttgtcttggagctgtt

SEQ ID NO: 323911 - DNA, 25 bp, Homo sapien
tgagtgagttaagcgccaacccggc

SEQ ID NO: 323912 - DNA, 25 bp, Homo sapien
cggcacttctcagcgggcaaacgga

SEQ ID NO: 323913 - DNA, 25 bp, Homo sapien
ggcaaacggagacagacccactcga

SEQ ID NO: 323914 - DNA, 25 bp, Homo sapien
tctccctcaagttcttagtgtcagc

SEQ ID NO: 323915 - DNA, 25 bp, Homo sapien
tagtgtcagcttatcgggccgaggt

SEQ ID NO: 323916 - DNA, 25 bp, Homo sapien
ggcttcataggcagctgctttttac

SEQ ID NO: 323917 - DNA, 25 bp, Homo sapien
gcagctgctttttactcaatctcag

SEQ ID NO: 323918 - DNA, 25 bp, Homo sapien
aatctcagccgagtcttccctaggg

SEQ ID NO: 323919 - DNA, 25 bp, Homo sapien
gcccaacttttcctgcaagaagcat

SEQ ID NO: 323920 - DNA, 25 bp, Homo sapien
aagaagcatccgtttttccacactg

SEQ ID NO: 323921 - DNA, 25 bp, Homo sapien
ttttccacactgaaagctccagaaa

SEQ ID NO: 323922 - DNA, 25 bp, Homo sapien
tatttcctgcttcatgagcaagaaa

SEQ ID NO: 323923 - DNA, 25 bp, Homo sapien
gaaacaacaagctttaccttcacag

SEQ ID NO: 323924 - DNA, 25 bp, Homo sapien
aacaagctttaccttcacagtagaa

SEQ ID NO: 323925 - DNA, 25 bp, Homo sapien
gaagcagagggagtgaatctaaacc

SEQ ID NO: 323926 - DNA, 25 bp, Homo sapien
aaacctatggacagattcatcttgg

SEQ ID NO: 323927 - DNA, 25 bp, Homo sapien
gacagattcatcttggaaaccctaa

SEQ ID NO: 323928 - DNA, 25 bp, Homo sapien
tcttggaaaccctaagtgaggctaa

SEQ ID NO: 323929 - DNA, 25 bp, Homo sapien
tggaacccatttcttcagggcccct

SEQ ID NO: 323930 - DNA, 25 bp, Homo sapien
tggccttgcaggtaatgttatcaca

SEQ ID NO: 323931 - DNA, 25 bp, Homo sapien
ggtaatgttatcacagctgtagctg

SEQ ID NO: 323932 - DNA, 25 bp, Homo sapien
cagctgtagctggactttggagtga

SEQ ID NO: 323933 - DNA, 25 bp, Homo sapien
acagccttctctaggcttcccagtg

SEQ ID NO: 323934 - DNA, 25 bp, Homo sapien
cttcccagtgcctccaggacagagt

SEQ ID NO: 323935 - DNA, 25 bp, Homo sapien
ggacagagtgggttatgttttcagc

SEQ ID NO: 323936 - DNA, 25 bp, Homo sapien
gttatgttttcagctccatccttgc

SEQ ID NO: 323937 - DNA, 25 bp, Homo sapien
agctccatccttgctgtgagtgtct

SEQ ID NO: 323938 - DNA, 25 bp, Homo sapien
tgagtgtctggtgcgttgtgcctcc

SEQ ID NO: 323939 - DNA, 25 bp, Homo sapien
gtctggtgcgttgtgcctccagctt

SEQ ID NO: 323940 - DNA, 25 bp, Homo sapien
cagcttctgctcagtgcttcatgga

SEQ ID NO: 323941 - DNA, 25 bp, Homo sapien
tgctcagtgcttcatggacagtgtc

SEQ ID NO: 323942 - DNA, 25 bp, Homo sapien
agtgtccagcacatgtcactctcca

SEQ ID NO: 323943 - DNA, 25 bp, Homo sapien
gtcactctccactctctcagtgtgg

SEQ ID NO: 323944 - DNA, 25 bp, Homo sapien
ttagattagatttccgacatccctt

SEQ ID NO: 323945 - DNA, 25 bp, Homo sapien
tagatttccgacatcccttccattt

SEQ ID NO: 323946 - DNA, 25 bp, Homo sapien
gtagttcttgtctggaattctgctt

SEQ ID NO: 323947 - DNA, 25 bp, Homo sapien
gtctggaattctgctttgttataaa

SEQ ID NO: 323948 - DNA, 25 bp, Homo sapien
ctaaggagtttgttgtgatagcaca

SEQ ID NO: 323949 - DNA, 25 bp, Homo sapien
tcattttgtaaagattccctgcgta

SEQ ID NO: 323950 - DNA, 25 bp, Homo sapien
aagattccctgcgtataaagtgatg

SEQ ID NO: 323951 - DNA, 25 bp, Homo sapien
gtgatgccctacatatgtgattttg

SEQ ID NO: 323952 - DNA, 25 bp, Homo sapien
aaaatataagtaccatccgcccaga

SEQ ID NO: 323953 - DNA, 25 bp, Homo sapien
atccgcccagaaataacatgtgtta

SEQ ID NO: 323954 - DNA, 25 bp, Homo sapien
aatgttttgtcatatgtgctttata

SEQ ID NO: 323955 - DNA, 25 bp, Homo sapien
tcagtgcttctgttactcaggaagg

SEQ ID NO: 323956 - DNA, 25 bp, Homo sapien
agaatgccccgtgcagagcagccag

SEQ ID NO: 323957 - DNA, 25 bp, Homo sapien
gtagcaccttcatgccaggtgctga

SEQ ID NO: 323958 - DNA, 25 bp, Homo sapien
gagaatgggaaattcttcctcccca

SEQ ID NO: 323959 - DNA, 25 bp, Homo sapien
cattgacctgagtcccagagactta

SEQ ID NO: 323960 - DNA, 25 bp, Homo sapien
agacttagggacacagacttcaggt

SEQ ID NO: 323961 - DNA, 25 bp, Homo sapien
agacttcaggtgaggctgcggacct

SEQ ID NO: 323962 - DNA, 25 bp, Homo sapien
gcggacctcagaagcagtggataat

SEQ ID NO: 323963 - DNA, 25 bp, Homo sapien
ggcattaaaagcttttgaggcaggg

SEQ ID NO: 323964 - DNA, 25 bp, Homo sapien
ggctcatgttttgactgcagggagt

SEQ ID NO: 323965 - DNA, 25 bp, Homo sapien
ttgactgcagggagttatgctgagc

SEQ ID NO: 323966 - DNA, 25 bp, Homo sapien
atctgttacaagctgccatattggc

SEQ ID NO: 323967 - DNA, 25 bp, Homo sapien
atattggcctgcttccgtccctgaa

SEQ ID NO: 323968 - DNA, 25 bp, Homo sapien
ccttccaacctgtgctttagtgaac

SEQ ID NO: 323969 - DNA, 25 bp, Homo sapien
tagtgaacgttgctctgtaaccctt

SEQ ID NO: 323970 - DNA, 25 bp, Homo sapien
gctctgtaacccttgttggttgaaa

SEQ ID NO: 323971 - DNA, 25 bp, Homo sapien
tctttgtctgatgttagtgatgcac

SEQ ID NO: 323972 - DNA, 25 bp, Homo sapien
agtgatgcacatgtgtaacagcccc

SEQ ID NO: 323973 - DNA, 25 bp, Homo sapien
catacccctgtatatcttagcagca

SEQ ID NO: 323974 - DNA, 25 bp, Homo sapien
tatatcttagcagcactgagtccag

SEQ ID NO: 323975 - DNA, 25 bp, Homo sapien
cactgagtccagtgcgagcacacac

SEQ ID NO: 323976 - DNA, 25 bp, Homo sapien
gagcacacacccactatacaagagt

SEQ ID NO: 323977 - DNA, 25 bp, Homo sapien
gaaagacgctataaatacacccaat

SEQ ID NO: 323978 - DNA, 25 bp, Homo sapien
tacacccaatgttactagtttatga

SEQ ID NO: 323979 - DNA, 25 bp, Homo sapien
tagtttatgaccacggagcattccg

SEQ ID NO: 323980 - DNA, 25 bp, Homo sapien
ggagcattccgtggaaccactgtca

SEQ ID NO: 323981 - DNA, 25 bp, Homo sapien
gtggaaccactgtcactgcgtcggg

SEQ ID NO: 323982 - DNA, 25 bp, Homo sapien
aggttgatggcatagaccttcctgg

SEQ ID NO: 323983 - DNA, 25 bp, Homo sapien
tcatcaccctaaaagctaggctggg

SEQ ID NO: 323984 - DNA, 25 bp, Homo sapien
caaagtgtagcgaaaccccacgtga

SEQ ID NO: 323985 - DNA, 25 bp, Homo sapien
gccttcctccgagtggcgaggcaat

SEQ ID NO: 323986 - DNA, 25 bp, Homo sapien
gagtggcgaggcaatcctgcacaag

SEQ ID NO: 323987 - DNA, 25 bp, Homo sapien
gaggcaatcctgcacaagagtttgt

SEQ ID NO: 323988 - DNA, 25 bp, Homo sapien
cccaaagtctggatgcccggtgttg

SEQ ID NO: 323989 - DNA, 25 bp, Homo sapien
tggatgcccggtgttgtgtttacat

SEQ ID NO: 323990 - DNA, 25 bp, Homo sapien
ttacatgtgattgtgcctaggagtc

SEQ ID NO: 323991 - DNA, 25 bp, Homo sapien
gtgattgtgcctaggagtctgttca

SEQ ID NO: 323992 - DNA, 25 bp, Homo sapien
gtgcctaggagtctgttcacataga

SEQ ID NO: 323993 - DNA, 25 bp, Homo sapien
tctgttcacatagagacacctgtaa

SEQ ID NO: 323994 - DNA, 25 bp, Homo sapien
agagacacctgtaagtatttattac

SEQ ID NO: 323995 - DNA, 25 bp, Homo sapien
tcctccatgagcacttacagaattg

SEQ ID NO: 323996 - DNA, 25 bp, Homo sapien
aacagtggtaagcatgggcacccga

SEQ ID NO: 323997 - DNA, 25 bp, Homo sapien
gtaagcatgggcacccgatttcagc

SEQ ID NO: 323998 - DNA, 25 bp, Homo sapien
tgggcacccgatttcagctgtcctg

SEQ ID NO: 323999 - DNA, 25 bp, Homo sapien
caggtccagaaagtgatgcgcaata

SEQ ID NO: 324000 - DNA, 25 bp, Homo sapien
tgatgcgcaataccagttcactggt

SEQ ID NO: 324001 - DNA, 25 bp, Homo sapien
atttcaactcttatactctcacagg

SEQ ID NO: 324002 - DNA, 25 bp, Homo sapien
gaatgaactgtgtactggccacata

SEQ ID NO: 324003 - DNA, 25 bp, Homo sapien
gtactggccacatatggaagcattg

SEQ ID NO: 324004 - DNA, 25 bp, Homo sapien
ggaagcattgcattgattgtcttat

SEQ ID NO: 324005 - DNA, 25 bp, Homo sapien
aaaactccagctgtgaaagcaacat

SEQ ID NO: 324006 - DNA, 25 bp, Homo sapien
aactgtctacggttcttaacctcat

SEQ ID NO: 324007 - DNA, 25 bp, Homo sapien
aacctcatctgttaagttcccatgc

SEQ ID NO: 324008 - DNA, 25 bp, Homo sapien
gttcccatgcctggagaagctaatg

SEQ ID NO: 324009 - DNA, 25 bp, Homo sapien
gaagctaatgccaactcatcatgtg

SEQ ID NO: 324010 - DNA, 25 bp, Homo sapien
agtgaccagttttcttacaatttag

SEQ ID NO: 324011 - DNA, 25 bp, Homo sapien
gttcttcaagggaatttaattgttg

SEQ ID NO: 324012 - DNA, 25 bp, Homo sapien
aattgttgagcaccattatctatag

SEQ ID NO: 324013 - DNA, 25 bp, Homo sapien
gagcaccattatctatagacacata

SEQ ID NO: 324014 - DNA, 25 bp, Homo sapien
tagacacatatactcttacatattg

SEQ ID NO: 324015 - DNA, 25 bp, Homo sapien
atactcttacatattgtgctatatt

SEQ ID NO: 324016 - DNA, 25 bp, Homo sapien
gtaacttagtaataatgctggaatt

SEQ ID NO: 324017 - DNA, 25 bp, Homo sapien
tgctatattatgtagattcagccat

SEQ ID NO: 324018 - DNA, 25 bp, Homo sapien
cagccataaatagtgcttaatctta

SEQ ID NO: 324019 - DNA, 25 bp, Homo sapien
atataaatgtatgcgattcctgtaa

SEQ ID NO: 324020 - DNA, 25 bp, Homo sapien
aaatgtatgcgattcctgtaaaatt

SEQ ID NO: 324021 - DNA, 25 bp, Homo sapien
gaaatccatgtacagagtcgtgcac

SEQ ID NO: 324022 - DNA, 25 bp, Homo sapien
agtcgtgcacttcattggctgtaac

SEQ ID NO: 324023 - DNA, 25 bp, Homo sapien
gctgtaactgtcaaacttgccttgt

SEQ ID NO: 324024 - DNA, 25 bp, Homo sapien
gtattagaagttaaatcccatcgta

SEQ ID NO: 324025 - DNA, 25 bp, Homo sapien
gtaaatacatcacgaggccagctgt

SEQ ID NO: 324026 - DNA, 25 bp, Homo sapien
agctgtgtgatttctgagacctaga

SEQ ID NO: 324027 - DNA, 25 bp, Homo sapien
tgagagtccatttacttcagccttt

SEQ ID NO: 324028 - DNA, 25 bp, Homo sapien
acttcagcctttgattcagtaaatg

SEQ ID NO: 324029 - DNA, 25 bp, Homo sapien
tgttaagcagcagaagacttcgaat

SEQ ID NO: 324030 - DNA, 25 bp, Homo sapien
ctgcaatggttgctaagtctattcc

SEQ ID NO: 324031 - DNA, 25 bp, Homo sapien
aagtctattccatgttaacactgtg

SEQ ID NO: 324032 - DNA, 25 bp, Homo sapien
aacgccctgaagctcttcatggaga

SEQ ID NO: 324033 - DNA, 25 bp, Homo sapien
ttcatggagatgaaccaaaagctat

SEQ ID NO: 324034 - DNA, 25 bp, Homo sapien
aaaagctatttgatgactgtacaca

SEQ ID NO: 324035 - DNA, 25 bp, Homo sapien
gtacacaacagttcaaagcagagaa

SEQ ID NO: 324036 - DNA, 25 bp, Homo sapien
gaagcatgggttaaaatagaaaatc

SEQ ID NO: 324037 - DNA, 25 bp, Homo sapien
atagaaaatctagccaaagccaatc

SEQ ID NO: 324038 - DNA, 25 bp, Homo sapien
aaatctagccaaagccaatccccag

SEQ ID NO: 324039 - DNA, 25 bp, Homo sapien
gccaaagccaatccccaggtactaa

SEQ ID NO: 324040 - DNA, 25 bp, Homo sapien
gaataacatgaaaacgcccagggtt

SEQ ID NO: 324041 - DNA, 25 bp, Homo sapien
tgaaaacgcccagggttacttgaat

SEQ ID NO: 324042 - DNA, 25 bp, Homo sapien
tctcgatttcactaacgttgtatat

SEQ ID NO: 324043 - DNA, 25 bp, Homo sapien
gggagagaagaccttgggccaagat

SEQ ID NO: 324044 - DNA, 25 bp, Homo sapien
gcaggacagaggatttgctctggac

SEQ ID NO: 324045 - DNA, 25 bp, Homo sapien
ggacagaggatttgctctggacaga

SEQ ID NO: 324046 - DNA, 25 bp, Homo sapien
cagaggatttgctctggacagagat

SEQ ID NO: 324047 - DNA, 25 bp, Homo sapien
aggatttgctctggacagagatgga

SEQ ID NO: 324048 - DNA, 25 bp, Homo sapien
gggtgaggaggccagtgggacccca

SEQ ID NO: 324049 - DNA, 25 bp, Homo sapien
aacattggttgctttggtggcacgt

SEQ ID NO: 324050 - DNA, 25 bp, Homo sapien
tggtggcacgtaagctccttgtctg

SEQ ID NO: 324051 - DNA, 25 bp, Homo sapien
ttgtctgtctccagcacccagaatc

SEQ ID NO: 324052 - DNA, 25 bp, Homo sapien
tccagcacccagaatctcattaaag

SEQ ID NO: 324053 - DNA, 25 bp, Homo sapien
aatctcattaaagcttatttattgt

SEQ ID NO: 324054 - DNA, 25 bp, Homo sapien
cctgggagacataattcaaatctat

SEQ ID NO: 324055 - DNA, 25 bp, Homo sapien
tgggagacataattcaaatctattt

SEQ ID NO: 324056 - DNA, 25 bp, Homo sapien
attttggtcttatatcttcttatgt

SEQ ID NO: 324057 - DNA, 25 bp, Homo sapien
ttttggtcttatatcttcttatgtt

SEQ ID NO: 324058 - DNA, 25 bp, Homo sapien
tttggtcttatatcttcttatgttt

SEQ ID NO: 324059 - DNA, 25 bp, Homo sapien
ttggtcttatatcttcttatgtttg

SEQ ID NO: 324060 - DNA, 25 bp, Homo sapien
tggtcttatatcttcttatgtttgt

SEQ ID NO: 324061 - DNA, 25 bp, Homo sapien
atttcatgtgtgccagtttctcttt

SEQ ID NO: 324062 - DNA, 25 bp, Homo sapien
ttcatgtgtgccagtttctcttttt

SEQ ID NO: 324063 - DNA, 25 bp, Homo sapien
acaacaatttatcaatttgtggcaa

SEQ ID NO: 324064 - DNA, 25 bp, Homo sapien
caacaatttatcaatttgtggcaat

SEQ ID NO: 324065 - DNA, 25 bp, Homo sapien
attccttgagaatgtatttatctga

SEQ ID NO: 324066 - DNA, 25 bp, Homo sapien
gagaatgtatttatctgaagatcaa

SEQ ID NO: 324067 - DNA, 25 bp, Homo sapien
gatcaaaacaaacaatccagatgta

SEQ ID NO: 324068 - DNA, 25 bp, Homo sapien
aatccagatgtataagtactaggca

SEQ ID NO: 324069 - DNA, 25 bp, Homo sapien
atgtataagtactaggcagaagcca

SEQ ID NO: 324070 - DNA, 25 bp, Homo sapien
gtactaggcagaagccaattttaaa

SEQ ID NO: 324071 - DNA, 25 bp, Homo sapien
aaaatttccttgaataatccatgaa

SEQ ID NO: 324072 - DNA, 25 bp, Homo sapien
tacagataaacagagttggcagtat

SEQ ID NO: 324073 - DNA, 25 bp, Homo sapien
taatgaccagcttttggtatttcat

SEQ ID NO: 324074 - DNA, 25 bp, Homo sapien
tatttcattgttaccaagttctatt

SEQ ID NO: 324075 - DNA, 25 bp, Homo sapien
cattgttaccaagttctatttttag

SEQ ID NO: 324076 - DNA, 25 bp, Homo sapien
atatcagacggtgatggtgtcacag

SEQ ID NO: 324077 - DNA, 25 bp, Homo sapien
ggtgtcacagatgcgtttcatgcga

SEQ ID NO: 324078 - DNA, 25 bp, Homo sapien
tgcgtttcatgcgatgggctcaatt

SEQ ID NO: 324079 - DNA, 25 bp, Homo sapien
gggctcaattaatggcctccatgtt

SEQ ID NO: 324080 - DNA, 25 bp, Homo sapien
ttaatggcctccatgtttcaccctt

SEQ ID NO: 324081 - DNA, 25 bp, Homo sapien
cttctctttcttgggactggcttgc

SEQ ID NO: 324082 - DNA, 25 bp, Homo sapien
cttgcctgctggaaggtgaggaaac

SEQ ID NO: 324083 - DNA, 25 bp, Homo sapien
ggtgaggaaacagcctgtcatccca

SEQ ID NO: 324084 - DNA, 25 bp, Homo sapien
gccatcctagatcagccaactgtca

SEQ ID NO: 324085 - DNA, 25 bp, Homo sapien
ctagatcagccaactgtcagctgct

SEQ ID NO: 324086 - DNA, 25 bp, Homo sapien
ttgtgtgtcagtgaacccccagcaa

SEQ ID NO: 324087 - DNA, 25 bp, Homo sapien
atcctattagatttgtatcaactag

SEQ ID NO: 324088 - DNA, 25 bp, Homo sapien
gtatcaactagttacatgttctatt

SEQ ID NO: 324089 - DNA, 25 bp, Homo sapien
aactagttacatgttctattcatag

SEQ ID NO: 324090 - DNA, 25 bp, Homo sapien
gttacatgttctattcatagtcttt

SEQ ID NO: 324091 - DNA, 25 bp, Homo sapien
agatggcctattttgagcctttgta

SEQ ID NO: 324092 - DNA, 25 bp, Homo sapien
gagcctttgtataggtacattcctg

SEQ ID NO: 324093 - DNA, 25 bp, Homo sapien
aaggtggacatttagcgttcagtgc

SEQ ID NO: 324094 - DNA, 25 bp, Homo sapien
ggtggacatttagcgttcagtgcag

SEQ ID NO: 324095 - DNA, 25 bp, Homo sapien
ggacatttagcgttcagtgcagttt

SEQ ID NO: 324096 - DNA, 25 bp, Homo sapien
tttagcgttcagtgcagttttcaat

SEQ ID NO: 324097 - DNA, 25 bp, Homo sapien
tagcgttcagtgcagttttcaataa

SEQ ID NO: 324098 - DNA, 25 bp, Homo sapien
cagtctcacatcatctgcatcaaca

SEQ ID NO: 324099 - DNA, 25 bp, Homo sapien
cattaggtttcttagcatggctcga

SEQ ID NO: 324100 - DNA, 25 bp, Homo sapien
taatcgtggaactagtctcccttgg

SEQ ID NO: 324101 - DNA, 25 bp, Homo sapien
tggaactagtctcccttggttaggt

SEQ ID NO: 324102 - DNA, 25 bp, Homo sapien
aggacttcagcctatagtttggagc

SEQ ID NO: 324103 - DNA, 25 bp, Homo sapien
agcagtatctatcaggtggcagtct

SEQ ID NO: 324104 - DNA, 25 bp, Homo sapien
gtctaggtcctgcatatggcttaat

SEQ ID NO: 324105 - DNA, 25 bp, Homo sapien
ggtttgatttttctgccttgcgata

SEQ ID NO: 324106 - DNA, 25 bp, Homo sapien
tttctgccttgcgatatccagtaaa

SEQ ID NO: 324107 - DNA, 25 bp, Homo sapien
aagattggtcagcacgacactggat

SEQ ID NO: 324108 - DNA, 25 bp, Homo sapien
acgacactggattgccagtctcaca

SEQ ID NO: 324109 - DNA, 25 bp, Homo sapien
tcgtatcctctgtccgcatgtgtgg

SEQ ID NO: 324110 - DNA, 25 bp, Homo sapien
tctgtccgcatgtgtggccaggcct

SEQ ID NO: 324111 - DNA, 25 bp, Homo sapien
gtgtggccaggcctgacaaacacct

SEQ ID NO: 324112 - DNA, 25 bp, Homo sapien
tgacaaacacctgcagatggctgct

SEQ ID NO: 324113 - DNA, 25 bp, Homo sapien
gggtggtgtttctcctctagggtat

SEQ ID NO: 324114 - DNA, 25 bp, Homo sapien
gtgtttctcctctagggtattggga

SEQ ID NO: 324115 - DNA, 25 bp, Homo sapien
tctcctctagggtattgggatgcat

SEQ ID NO: 324116 - DNA, 25 bp, Homo sapien
ttgggatgcatgttctgcactgcca

SEQ ID NO: 324117 - DNA, 25 bp, Homo sapien
tgcatgttctgcactgccagcagag

SEQ ID NO: 324118 - DNA, 25 bp, Homo sapien
tgtacactctgtcatttcctttcta

SEQ ID NO: 324119 - DNA, 25 bp, Homo sapien
tacactctgtcatttcctttctagc

SEQ ID NO: 324120 - DNA, 25 bp, Homo sapien
cccagcccagggtggacttagaaag

SEQ ID NO: 324121 - DNA, 25 bp, Homo sapien
ccagcccagggtggacttagaaagc

SEQ ID NO: 324122 - DNA, 25 bp, Homo sapien
cagcccagggtggacttagaaagca

SEQ ID NO: 324123 - DNA, 25 bp, Homo sapien
agcccagggtggacttagaaagcag

SEQ ID NO: 324124 - DNA, 25 bp, Homo sapien
gtggacttagaaagcaggggctaca

SEQ ID NO: 324125 - DNA, 25 bp, Homo sapien
tggacttagaaagcaggggctacaa

SEQ ID NO: 324126 - DNA, 25 bp, Homo sapien
ggacttagaaagcaggggctacaag

SEQ ID NO: 324127 - DNA, 25 bp, Homo sapien
gacttagaaagcaggggctacaaga

SEQ ID NO: 324128 - DNA, 25 bp, Homo sapien
agggaatccccgaaggtgctggagg

SEQ ID NO: 324129 - DNA, 25 bp, Homo sapien
gggaatccccgaaggtgctggaggt

SEQ ID NO: 324130 - DNA, 25 bp, Homo sapien
tggtctcttactttcctttccccag

SEQ ID NO: 324131 - DNA, 25 bp, Homo sapien
aaaacctcacacaagtccatcatta

SEQ ID NO: 324132 - DNA, 25 bp, Homo sapien
aagtccatcattatcacgtcatgcc

SEQ ID NO: 324133 - DNA, 25 bp, Homo sapien
acgtcatgccgtccttaagatgcaa

SEQ ID NO: 324134 - DNA, 25 bp, Homo sapien
ccgtccttaagatgcaatggtgggt

SEQ ID NO: 324135 - DNA, 25 bp, Homo sapien
gggttagtgctaaatcaattcaaaa

SEQ ID NO: 324136 - DNA, 25 bp, Homo sapien
gagttctgactttaatctaccccaa

SEQ ID NO: 324137 - DNA, 25 bp, Homo sapien
ccaaagcaaaatgacctggacctgg

SEQ ID NO: 324138 - DNA, 25 bp, Homo sapien
gtgaaccttgaaactgttttgccaa

SEQ ID NO: 324139 - DNA, 25 bp, Homo sapien
gaagtgttgcaaatagtcccatgag

SEQ ID NO: 324140 - DNA, 25 bp, Homo sapien
tagtcccatgagttaagagcttgat

SEQ ID NO: 324141 - DNA, 25 bp, Homo sapien
gagcttgatttaatggatcttcttt

SEQ ID NO: 324142 - DNA, 25 bp, Homo sapien
ggaaactatcacctttgaaagcata

SEQ ID NO: 324143 - DNA, 25 bp, Homo sapien
ggaggtctaggcttgtgttgtcaca

SEQ ID NO: 324144 - DNA, 25 bp, Homo sapien
acaccttttagataatccttacctg

SEQ ID NO: 324145 - DNA, 25 bp, Homo sapien
aatccttacctgtacagatttttat

SEQ ID NO: 324146 - DNA, 25 bp, Homo sapien
gttgttatcataagagaatggctac

SEQ ID NO: 324147 - DNA, 25 bp, Homo sapien
gaatggctacatcattatcctgcct

SEQ ID NO: 324148 - DNA, 25 bp, Homo sapien
cattatcctgccttttctgggtgtt

SEQ ID NO: 324149 - DNA, 25 bp, Homo sapien
gtagttggcttactttggaacacac

SEQ ID NO: 324150 - DNA, 25 bp, Homo sapien
gttggcttactttggaacacacagt

SEQ ID NO: 324151 - DNA, 25 bp, Homo sapien
tgaactaatactttaaaattgccgt

SEQ ID NO: 324152 - DNA, 25 bp, Homo sapien
aaattgccgtataatgatgtcattg

SEQ ID NO: 324153 - DNA, 25 bp, Homo sapien
caatgcctccgtttctccagaaaag

SEQ ID NO: 324154 - DNA, 25 bp, Homo sapien
aatgcctccgtttctccagaaaagc

SEQ ID NO: 324155 - DNA, 25 bp, Homo sapien
tctccagaaaagctagaggaacctt

SEQ ID NO: 324156 - DNA, 25 bp, Homo sapien
tagaggaaccttttcctcatcccct

SEQ ID NO: 324157 - DNA, 25 bp, Homo sapien
aaaagatgagtgaggatctccgcgt

SEQ ID NO: 324158 - DNA, 25 bp, Homo sapien
aagatgagtgaggatctccgcgttg

SEQ ID NO: 324159 - DNA, 25 bp, Homo sapien
gaggatctccgcgttggaggaagag

SEQ ID NO: 324160 - DNA, 25 bp, Homo sapien
gagggagtcgaaagaggcttccact

SEQ ID NO: 324161 - DNA, 25 bp, Homo sapien
ggagtcgaaagaggcttccactctt

SEQ ID NO: 324162 - DNA, 25 bp, Homo sapien
gaaagaggcttccactctttgaaaa

SEQ ID NO: 324163 - DNA, 25 bp, Homo sapien
gaggcttccactctttgaaaaagac

SEQ ID NO: 324164 - DNA, 25 bp, Homo sapien
gagttttttgtaaaacctcaggctg

SEQ ID NO: 324165 - DNA, 25 bp, Homo sapien
ttgtaaaacctcaggctggagaact

SEQ ID NO: 324166 - DNA, 25 bp, Homo sapien
ttttaacacaaacggaactctcatc

SEQ ID NO: 324167 - DNA, 25 bp, Homo sapien
aaacggaactctcatcactgtagga

SEQ ID NO: 324168 - DNA, 25 bp, Homo sapien
ggaactctcatcactgtaggattta

SEQ ID NO: 324169 - DNA, 25 bp, Homo sapien
gtatgagatcaatggattaactcca

SEQ ID NO: 324170 - DNA, 25 bp, Homo sapien
tggattaactccaactaccgtgcca

SEQ ID NO: 324171 - DNA, 25 bp, Homo sapien
tctgtttttgaacttaggctgaaaa

SEQ ID NO: 324172 - DNA, 25 bp, Homo sapien
agacaagaaatcctgagccgttcac

SEQ ID NO: 324173 - DNA, 25 bp, Homo sapien
aagaaatcctgagccgttcaccgca

SEQ ID NO: 324174 - DNA, 25 bp, Homo sapien
acacttcctacctggcagcgatctg

SEQ ID NO: 324175 - DNA, 25 bp, Homo sapien
aatccctcactgtctggctaagaga

SEQ ID NO: 324176 - DNA, 25 bp, Homo sapien
gagattgagccattccactttacag

SEQ ID NO: 324177 - DNA, 25 bp, Homo sapien
cttcttcccaactgcagcaacattt

SEQ ID NO: 324178 - DNA, 25 bp, Homo sapien
aactgcagcaacatttccaacaggg

SEQ ID NO: 324179 - DNA, 25 bp, Homo sapien
aaccacttcagtattgggatcaata

SEQ ID NO: 324180 - DNA, 25 bp, Homo sapien
caagaggtagttcataatgacctta

SEQ ID NO: 324181 - DNA, 25 bp, Homo sapien
aatggaaatactctacacttctggc

SEQ ID NO: 324182 - DNA, 25 bp, Homo sapien
aatactctacacttctggcatgctt

SEQ ID NO: 324183 - DNA, 25 bp, Homo sapien
ttctggcatgcttctctcccaaata

SEQ ID NO: 324184 - DNA, 25 bp, Homo sapien
aaaactttgctgactgagctgatca

SEQ ID NO: 324185 - DNA, 25 bp, Homo sapien
tgctgactgagctgatcaatggaat

SEQ ID NO: 324186 - DNA, 25 bp, Homo sapien
aaacatttaatttggcagccttctc

SEQ ID NO: 324187 - DNA, 25 bp, Homo sapien
aacatttaatttggcagccttctcc

SEQ ID NO: 324188 - DNA, 25 bp, Homo sapien
tctccacccacttttcaattaaccg

SEQ ID NO: 324189 - DNA, 25 bp, Homo sapien
attaaccgggtttatgcagatactt

SEQ ID NO: 324190 - DNA, 25 bp, Homo sapien
aaccgggtttatgcagatactttag

SEQ ID NO: 324191 - DNA, 25 bp, Homo sapien
gggtttatgcagatactttaggtct

SEQ ID NO: 324192 - DNA, 25 bp, Homo sapien
gatactttaggtctgtaataaactt

SEQ ID NO: 324193 - DNA, 25 bp, Homo sapien
ataaactttattgctaagagtacag

SEQ ID NO: 324194 - DNA, 25 bp, Homo sapien
ttgctaagagtacagtttatgaaac

SEQ ID NO: 324195 - DNA, 25 bp, Homo sapien
ggttttccatccatttaggaaagca

SEQ ID NO: 324196 - DNA, 25 bp, Homo sapien
atccatttaggaaagcacattgtga

SEQ ID NO: 324197 - DNA, 25 bp, Homo sapien
tgcagctccaagttgcaggagactg

SEQ ID NO: 324198 - DNA, 25 bp, Homo sapien
gactgagtcactaagtccatggcag

SEQ ID NO: 324199 - DNA, 25 bp, Homo sapien
aagtccatggcagaattggagcctg

SEQ ID NO: 324200 - DNA, 25 bp, Homo sapien
agcccaggtttcttcatccgacaaa

SEQ ID NO: 324201 - DNA, 25 bp, Homo sapien
aggtttcttcatccgacaaatattt

SEQ ID NO: 324202 - DNA, 25 bp, Homo sapien
tattgagtgccttccatgcaaagca

SEQ ID NO: 324203 - DNA, 25 bp, Homo sapien
gtctaagaaactgtccctgacatga

SEQ ID NO: 324204 - DNA, 25 bp, Homo sapien
gaagattttaataggttcctcctca

SEQ ID NO: 324205 - DNA, 25 bp, Homo sapien
ttcctcctcacccataattgatttc

SEQ ID NO: 324206 - DNA, 25 bp, Homo sapien
ttcaaatgttccctgaagttgccca

SEQ ID NO: 324207 - DNA, 25 bp, Homo sapien
tgcccagctgagtaaccacctgcag

SEQ ID NO: 324208 - DNA, 25 bp, Homo sapien
aaagctgttccaacacacggactat

SEQ ID NO: 324209 - DNA, 25 bp, Homo sapien
caacacacggactatttttgtacta

SEQ ID NO: 324210 - DNA, 25 bp, Homo sapien
gtaatattgaatttcctttggccga

SEQ ID NO: 324211 - DNA, 25 bp, Homo sapien
tgaatttcctttggccgataatcag

SEQ ID NO: 324212 - DNA, 25 bp, Homo sapien
ggccgataatcaggatttccctata

SEQ ID NO: 324213 - DNA, 25 bp, Homo sapien
ggatttccctataagtcacttggac

SEQ ID NO: 324214 - DNA, 25 bp, Homo sapien
gtcacttggacattggtcacttgta

SEQ ID NO: 324215 - DNA, 25 bp, Homo sapien
gacattggtcacttgtaggaaattt

SEQ ID NO: 324216 - DNA, 25 bp, Homo sapien
aactctaattatgacagctacactg

SEQ ID NO: 324217 - DNA, 25 bp, Homo sapien
gtactgaaattaacttgtctatctt

SEQ ID NO: 324218 - DNA, 25 bp, Homo sapien
gtgggcgatttcttttgtaagtgta

SEQ ID NO: 324219 - DNA, 25 bp, Homo sapien
agtggttttgcctaggtccagtgta

SEQ ID NO: 324220 - DNA, 25 bp, Homo sapien
gcctaggtccagtgtaattacttat

SEQ ID NO: 324221 - DNA, 25 bp, Homo sapien
ggtccagtgtaattacttatcaaaa

SEQ ID NO: 324222 - DNA, 25 bp, Homo sapien
gagttatcaacttggaatacaatac

SEQ ID NO: 324223 - DNA, 25 bp, Homo sapien
atataactgacccaaaactacctgt

SEQ ID NO: 324224 - DNA, 25 bp, Homo sapien
actacctgtcaaaagcacagtaaag

SEQ ID NO: 324225 - DNA, 25 bp, Homo sapien
gcacagtaaagcttaacaggcataa

SEQ ID NO: 324226 - DNA, 25 bp, Homo sapien
gggtaaaacccaactgctctgacat

SEQ ID NO: 324227 - DNA, 25 bp, Homo sapien
aaaacccaactgctctgacataaga

SEQ ID NO: 324228 - DNA, 25 bp, Homo sapien
acagcaaatgcaaaccatcaggtta

SEQ ID NO: 324229 - DNA, 25 bp, Homo sapien
gaacacttgttcttcagtggttttg

SEQ ID NO: 324230 - DNA, 25 bp, Homo sapien
tgcgctttcccgagatgaacatacc

SEQ ID NO: 324231 - DNA, 25 bp, Homo sapien
gatgacacggtcacttattcagcat

SEQ ID NO: 324232 - DNA, 25 bp, Homo sapien
gacacggtcacttattcagcattgc

SEQ ID NO: 324233 - DNA, 25 bp, Homo sapien
cggtcacttattcagcattgcacaa

SEQ ID NO: 324234 - DNA, 25 bp, Homo sapien
attcagcattgcacaagcgccaagt

SEQ ID NO: 324235 - DNA, 25 bp, Homo sapien
agcattgcacaagcgccaagtgggc

SEQ ID NO: 324236 - DNA, 25 bp, Homo sapien
gagaacgtcattccagattttccag

SEQ ID NO: 324237 - DNA, 25 bp, Homo sapien
attactcagagctgatccagtttgg

SEQ ID NO: 324238 - DNA, 25 bp, Homo sapien
aaatgtggactatgtgatcctcaaa

SEQ ID NO: 324239 - DNA, 25 bp, Homo sapien
gtggactatgtgatcctcaaacatt

SEQ ID NO: 324240 - DNA, 25 bp, Homo sapien
aaacattgacactggatgggctgca

SEQ ID NO: 324241 - DNA, 25 bp, Homo sapien
ggcgtggatatcaaggagaaccttc

SEQ ID NO: 324242 - DNA, 25 bp, Homo sapien
gaaccttcaagaccagatccggcat

SEQ ID NO: 324243 - DNA, 25 bp, Homo sapien
cagatccggcattggttcatcgaat

SEQ ID NO: 324244 - DNA, 25 bp, Homo sapien
tccggcattggttcatcgaatgcag

SEQ ID NO: 324245 - DNA, 25 bp, Homo sapien
tcgaatgcagaaatttaaccgggac

SEQ ID NO: 324246 - DNA, 25 bp, Homo sapien
atgcagaaatttaaccgggacattt

SEQ ID NO: 324247 - DNA, 25 bp, Homo sapien
tcctgactaccctgacgttgaagaa

SEQ ID NO: 324248 - DNA, 25 bp, Homo sapien
cgttgaagaaggagggtcagctatt

SEQ ID NO: 324249 - DNA, 25 bp, Homo sapien
tttctgacaagaccatacaacaggt

SEQ ID NO: 324250 - DNA, 25 bp, Homo sapien
tacaacaggttattgaggatatcat

SEQ ID NO: 324251 - DNA, 25 bp, Homo sapien
gaggatatcatagcaaaccaagagg

SEQ ID NO: 324252 - DNA, 25 bp, Homo sapien
gcctggggaacacatcctgtctcta

SEQ ID NO: 324253 - DNA, 25 bp, Homo sapien
cctggggaacacatcctgtctctac

SEQ ID NO: 324254 - DNA, 25 bp, Homo sapien
agaacgtgggaaatatgaacctttg

SEQ ID NO: 324255 - DNA, 25 bp, Homo sapien
gaacgtgggaaatatgaacctttga

SEQ ID NO: 324256 - DNA, 25 bp, Homo sapien
atgaacctttgaaagttaatctgtg

SEQ ID NO: 324257 - DNA, 25 bp, Homo sapien
tgaacctttgaaagttaatctgtga

SEQ ID NO: 324258 - DNA, 25 bp, Homo sapien
gaacctttgaaagttaatctgtgaa

SEQ ID NO: 324259 - DNA, 25 bp, Homo sapien
agttaatctgtgaattgaaagttta

SEQ ID NO: 324260 - DNA, 25 bp, Homo sapien
gttaatctgtgaattgaaagtttaa

SEQ ID NO: 324261 - DNA, 25 bp, Homo sapien
ttaatctgtgaattgaaagtttaac

SEQ ID NO: 324262 - DNA, 25 bp, Homo sapien
taatctgtgaattgaaagtttaaca

SEQ ID NO: 324263 - DNA, 25 bp, Homo sapien
aattactctgccattgtttccagct

SEQ ID NO: 324264 - DNA, 25 bp, Homo sapien
cagcttccctcctacaatagaatga

SEQ ID NO: 324265 - DNA, 25 bp, Homo sapien
tttttgatggcttgagatggctcac

SEQ ID NO: 324266 - DNA, 25 bp, Homo sapien
gtaatcttgttttctcttcacattc

SEQ ID NO: 324267 - DNA, 25 bp, Homo sapien
ttctcttcacattcactgagttgtt

SEQ ID NO: 324268 - DNA, 25 bp, Homo sapien
gagttgttcaggctcagatcatccc

SEQ ID NO: 324269 - DNA, 25 bp, Homo sapien
aggctcagatcatcccttgacagta

SEQ ID NO: 324270 - DNA, 25 bp, Homo sapien
atcatcccttgacagtagtttgcct

SEQ ID NO: 324271 - DNA, 25 bp, Homo sapien
ccttgacagtagtttgccttcatct

SEQ ID NO: 324272 - DNA, 25 bp, Homo sapien
atctcacctttcatttgtcccaaat

SEQ ID NO: 324273 - DNA, 25 bp, Homo sapien
ttgtcccaaattcaccttatttaat

SEQ ID NO: 324274 - DNA, 25 bp, Homo sapien
cacaacttcaagatatcatgcattt

SEQ ID NO: 324275 - DNA, 25 bp, Homo sapien
agatatcatgcattttacccataag

SEQ ID NO: 324276 - DNA, 25 bp, Homo sapien
gcattttacccataagtacttctgt

SEQ ID NO: 324277 - DNA, 25 bp, Homo sapien
agtacttctgtatgcatctctgaca

SEQ ID NO: 324278 - DNA, 25 bp, Homo sapien
gtatgcatctctgacatgaactggt

SEQ ID NO: 324279 - DNA, 25 bp, Homo sapien
atctctgacatgaactggtgtcccg

SEQ ID NO: 324280 - DNA, 25 bp, Homo sapien
atccagctgtaaccattttattaat

SEQ ID NO: 324281 - DNA, 25 bp, Homo sapien
attaatattgtgtcatctaactctt

SEQ ID NO: 324282 - DNA, 25 bp, Homo sapien
gtgtcatctaactcttccacatttt

SEQ ID NO: 324283 - DNA, 25 bp, Homo sapien
cttccacattttttgacagaatatt

SEQ ID NO: 324284 - DNA, 25 bp, Homo sapien
gacagaatattttaacacaacttca

SEQ ID NO: 324285 - DNA, 25 bp, Homo sapien
ttcagcaggctgaaggaaatggttc

SEQ ID NO: 324286 - DNA, 25 bp, Homo sapien
ataatgtgggctggtatcctctaga

SEQ ID NO: 324287 - DNA, 25 bp, Homo sapien
ggctggtatcctctagagtacctgg

SEQ ID NO: 324288 - DNA, 25 bp, Homo sapien
gagtacctgggtacataaacagaaa

SEQ ID NO: 324289 - DNA, 25 bp, Homo sapien
cataaacagaaactcctgtaggtaa

SEQ ID NO: 324290 - DNA, 25 bp, Homo sapien
gtaatttgtgccattagtctttcta

SEQ ID NO: 324291 - DNA, 25 bp, Homo sapien
ttgtgccattagtctttctatgttt

SEQ ID NO: 324292 - DNA, 25 bp, Homo sapien
tctttctatgtttctgcatccagat

SEQ ID NO: 324293 - DNA, 25 bp, Homo sapien
tccagatagagtgcagttcatgagg

SEQ ID NO: 324294 - DNA, 25 bp, Homo sapien
gaaagggcgttaaagtgatacattt

SEQ ID NO: 324295 - DNA, 25 bp, Homo sapien
ttctttgtgaaactaattcagcagg

SEQ ID NO: 324296 - DNA, 25 bp, Homo sapien
ctttctttcgctctttccggcttgc

SEQ ID NO: 324297 - DNA, 25 bp, Homo sapien
cttcttctccttcaggtccttggcg

SEQ ID NO: 324298 - DNA, 25 bp, Homo sapien
tctccttcaggtccttggcgctcaa

SEQ ID NO: 324299 - DNA, 25 bp, Homo sapien
tccttcaggtccttggcgctcaact

SEQ ID NO: 324300 - DNA, 25 bp, Homo sapien
aggtccttggcgctcaactcggccg

SEQ ID NO: 324301 - DNA, 25 bp, Homo sapien
ttggcgctcaactcggccgctgcct

SEQ ID NO: 324302 - DNA, 25 bp, Homo sapien
ctccacgcttttctccgacatggtg

SEQ ID NO: 324303 - DNA, 25 bp, Homo sapien
tccacgcttttctccgacatggtgc

SEQ ID NO: 324304 - DNA, 25 bp, Homo sapien
acgcttttctccgacatggtgccgg

SEQ ID NO: 324305 - DNA, 25 bp, Homo sapien
cgcttttctccgacatggtgccggg

SEQ ID NO: 324306 - DNA, 25 bp, Homo sapien
gcggccggaacctggcgcggtggcg

SEQ ID NO: 324307 - DNA, 25 bp, Homo sapien
attgaacaaagcaaagtccctcttc

SEQ ID NO: 324308 - DNA, 25 bp, Homo sapien
gggattttctattacttactgccat

SEQ ID NO: 324309 - DNA, 25 bp, Homo sapien
ttactgccatcttacccttgctgat

SEQ ID NO: 324310 - DNA, 25 bp, Homo sapien
attgccattatactgcccaaaaccc

SEQ ID NO: 324311 - DNA, 25 bp, Homo sapien
ttacccttgctgatgaatgcctatc

SEQ ID NO: 324312 - DNA, 25 bp, Homo sapien
gctgatgaatgcctatcataattta

SEQ ID NO: 324313 - DNA, 25 bp, Homo sapien
tgcccaaaacccagaaatcctattc

SEQ ID NO: 324314 - DNA, 25 bp, Homo sapien
atcctattctttcatttagcagtta

SEQ ID NO: 324315 - DNA, 25 bp, Homo sapien
aagcacctattgtatcccaagtacc

SEQ ID NO: 324316 - DNA, 25 bp, Homo sapien
ttgtatcccaagtaccatttcaggt

SEQ ID NO: 324317 - DNA, 25 bp, Homo sapien
gtaccatttcaggtgctgtaaatat

SEQ ID NO: 324318 - DNA, 25 bp, Homo sapien
gtgcatgagatcttcaaacgcatct

SEQ ID NO: 324319 - DNA, 25 bp, Homo sapien
atccggcgttctggcctagagctgt

SEQ ID NO: 324320 - DNA, 25 bp, Homo sapien
tccgtgcggcctgctgttgtgatgc

SEQ ID NO: 324321 - DNA, 25 bp, Homo sapien
tctggcctagagctgtatgcggaat

SEQ ID NO: 324322 - DNA, 25 bp, Homo sapien
tgttgtgatgcagggctctgcccgt

SEQ ID NO: 324323 - DNA, 25 bp, Homo sapien
atgcagggctctgcccgtaaccagg

SEQ ID NO: 324324 - DNA, 25 bp, Homo sapien
gctgtatgcggaatggaagcacgtt

SEQ ID NO: 324325 - DNA, 25 bp, Homo sapien
ggaagcacgttaatgaggactctca

SEQ ID NO: 324326 - DNA, 25 bp, Homo sapien
ggagaagaagatcctgctgagtcca

SEQ ID NO: 324327 - DNA, 25 bp, Homo sapien
agaagatcctgctgagtccagagcg

SEQ ID NO: 324328 - DNA, 25 bp, Homo sapien
gtccagagcgagtgcatgagatctt

SEQ ID NO: 324329 - DNA, 25 bp, Homo sapien
atgcattactttcacttaacactag

SEQ ID NO: 324330 - DNA, 25 bp, Homo sapien
tcacttaacactagacaccaggtcg

SEQ ID NO: 324331 - DNA, 25 bp, Homo sapien
agacaccaggtcgaaaattttcaag

SEQ ID NO: 324332 - DNA, 25 bp, Homo sapien
ttatttcaacaattcttagagatgc

SEQ ID NO: 324333 - DNA, 25 bp, Homo sapien
tagagatgctagctagtgttgaagc

SEQ ID NO: 324334 - DNA, 25 bp, Homo sapien
aaatagctttatttatgctgaattg

SEQ ID NO: 324335 - DNA, 25 bp, Homo sapien
tagttctaatcattgatgatagctt

SEQ ID NO: 324336 - DNA, 25 bp, Homo sapien
tatgccatggcatttgacagttcat

SEQ ID NO: 324337 - DNA, 25 bp, Homo sapien
atggcatttgacagttcattattcc

SEQ ID NO: 324338 - DNA, 25 bp, Homo sapien
atggtggtgttgagctgattattaa

SEQ ID NO: 324339 - DNA, 25 bp, Homo sapien
gagctgattattaacagttactgaa

SEQ ID NO: 324340 - DNA, 25 bp, Homo sapien
accaaacttgtgattctctgttcat

SEQ ID NO: 324341 - DNA, 25 bp, Homo sapien
tctctgttcatgtggcataaaccag

SEQ ID NO: 324342 - DNA, 25 bp, Homo sapien
aaaccagttttgtacataacatgta

SEQ ID NO: 324343 - DNA, 25 bp, Homo sapien
attgtttcctgtttaatgcatgggc

SEQ ID NO: 324344 - DNA, 25 bp, Homo sapien
ttcctgtttaatgcatgggctgaaa

SEQ ID NO: 324345 - DNA, 25 bp, Homo sapien
gcatgggctgaaatcactaggatca

SEQ ID NO: 324346 - DNA, 25 bp, Homo sapien
gggctgaaatcactaggatcaattt

SEQ ID NO: 324347 - DNA, 25 bp, Homo sapien
atggtttgatacagaacagctttct

SEQ ID NO: 324348 - DNA, 25 bp, Homo sapien
tacagaacagctttcttctcattct

SEQ ID NO: 324349 - DNA, 25 bp, Homo sapien
tctcattctgaatttggaagttcta

SEQ ID NO: 324350 - DNA, 25 bp, Homo sapien
gaatttggaagttctatacaactga

SEQ ID NO: 324351 - DNA, 25 bp, Homo sapien
gaaagatggcaaagcttttgagaat

SEQ ID NO: 324352 - DNA, 25 bp, Homo sapien
ttttgagaatataaacacacctgtt

SEQ ID NO: 324353 - DNA, 25 bp, Homo sapien
tcttaagttcaacatacttttgtag

SEQ ID NO: 324354 - DNA, 25 bp, Homo sapien
atttatagccaaggatcctcaaaac

SEQ ID NO: 324355 - DNA, 25 bp, Homo sapien
gccaaggatcctcaaaacagaagtt

SEQ ID NO: 324356 - DNA, 25 bp, Homo sapien
aacagaagtttcatcttaggatagt

SEQ ID NO: 324357 - DNA, 25 bp, Homo sapien
gaaagtccagtaacagagaagaaat

SEQ ID NO: 324358 - DNA, 25 bp, Homo sapien
gaaatgtctcaaatgtctcgtatca

SEQ ID NO: 324359 - DNA, 25 bp, Homo sapien
gtctcaaatgtctcgtatcagtttt

SEQ ID NO: 324360 - DNA, 25 bp, Homo sapien
gtctcgtatcagttttagtgttttt

SEQ ID NO: 324361 - DNA, 25 bp, Homo sapien
atagacctgatcaacatcataggag

SEQ ID NO: 324362 - DNA, 25 bp, Homo sapien
cttccagcaggcctaataggatggc

SEQ ID NO: 324363 - DNA, 25 bp, Homo sapien
tccagcaggcctaataggatggcat

SEQ ID NO: 324364 - DNA, 25 bp, Homo sapien
gcaggcctaataggatggcatctaa

SEQ ID NO: 324365 - DNA, 25 bp, Homo sapien
ggatggcatctaatatttttggacc

SEQ ID NO: 324366 - DNA, 25 bp, Homo sapien
tttggaccaacagaagaacctcaga

SEQ ID NO: 324367 - DNA, 25 bp, Homo sapien
gaccaacagaagaacctcagaacat

SEQ ID NO: 324368 - DNA, 25 bp, Homo sapien
gaacctcagaacatacccaagagga

SEQ ID NO: 324369 - DNA, 25 bp, Homo sapien
agaatcgagcaatctttttggaagt

SEQ ID NO: 324370 - DNA, 25 bp, Homo sapien
aatcgagcaatctttttggaagtcc

SEQ ID NO: 324371 - DNA, 25 bp, Homo sapien
cgagcaatctttttggaagtccaga

SEQ ID NO: 324372 - DNA, 25 bp, Homo sapien
agcaatctttttggaagtccagaag

SEQ ID NO: 324373 - DNA, 25 bp, Homo sapien
agcatgttcagcattcaggtgatca

SEQ ID NO: 324374 - DNA, 25 bp, Homo sapien
aggtgatcagcaggactgtctccag

SEQ ID NO: 324375 - DNA, 25 bp, Homo sapien
gactgtctccagcacggagctgaca

SEQ ID NO: 324376 - DNA, 25 bp, Homo sapien
gagctgacactgttcagctgcctca

SEQ ID NO: 324377 - DNA, 25 bp, Homo sapien
agctgcctcaactggtagacgctcc

SEQ ID NO: 324378 - DNA, 25 bp, Homo sapien
ggtagacgctcccaagaagtcagag

SEQ ID NO: 324379 - DNA, 25 bp, Homo sapien
tctccctcaagaacacaaacgtttt

SEQ ID NO: 324380 - DNA, 25 bp, Homo sapien
cccctattgtatgacctttgctgag

SEQ ID NO: 324381 - DNA, 25 bp, Homo sapien
gacctttgctgagggtatgtcctgc

SEQ ID NO: 324382 - DNA, 25 bp, Homo sapien
tgagggtatgtcctgctcctttcca

SEQ ID NO: 324383 - DNA, 25 bp, Homo sapien
ttccaccagtgatttgtattaagac

SEQ ID NO: 324384 - DNA, 25 bp, Homo sapien
cgagatgaacataccacgaactgga

SEQ ID NO: 324385 - DNA, 25 bp, Homo sapien
gagatgaacataccacgaactggag

SEQ ID NO: 324386 - DNA, 25 bp, Homo sapien
gatgaacataccacgaactggagat

SEQ ID NO: 324387 - DNA, 25 bp, Homo sapien
tgaacataccacgaactggagatgc

SEQ ID NO: 324388 - DNA, 25 bp, Homo sapien
aacataccacgaactggagatgcag

SEQ ID NO: 324389 - DNA, 25 bp, Homo sapien
actggagatgcagagtcctcagaga

SEQ ID NO: 324390 - DNA, 25 bp, Homo sapien
ctggagatgcagagtcctcagagat

SEQ ID NO: 324391 - DNA, 25 bp, Homo sapien
ggagatgcagagtcctcagagatgc

SEQ ID NO: 324392 - DNA, 25 bp, Homo sapien
gagatgcagagtcctcagagatgca

SEQ ID NO: 324393 - DNA, 25 bp, Homo sapien
gatgcagagtcctcagagatgcaga

SEQ ID NO: 324394 - DNA, 25 bp, Homo sapien
atgcagagtcctcagagatgcagag

SEQ ID NO: 324395 - DNA, 25 bp, Homo sapien
gcatcccgggtggtaagaatatccc

SEQ ID NO: 324396 - DNA, 25 bp, Homo sapien
atatcccacagatgaatatggccag

SEQ ID NO: 324397 - DNA, 25 bp, Homo sapien
gatgttttctaggaaccgaggccca

SEQ ID NO: 324398 - DNA, 25 bp, Homo sapien
aaccgaggcccaacctgctgtgatt

SEQ ID NO: 324399 - DNA, 25 bp, Homo sapien
tgctgtgattttcctcccacgacca

SEQ ID NO: 324400 - DNA, 25 bp, Homo sapien
gaccaccagagtaccgagcgcagat

SEQ ID NO: 324401 - DNA, 25 bp, Homo sapien
ccttcccattgatcggcactgtaat

SEQ ID NO: 324402 - DNA, 25 bp, Homo sapien
aggacagcataacacttgacccagc

SEQ ID NO: 324403 - DNA, 25 bp, Homo sapien
taaatagctctctgcaggcctcctc

SEQ ID NO: 324404 - DNA, 25 bp, Homo sapien
ggtgcagaaaacaccctgtaatgtt

SEQ ID NO: 324405 - DNA, 25 bp, Homo sapien
taatgtttcccctgtgcatcccggg

SEQ ID NO: 324406 - DNA, 25 bp, Homo sapien
cacttgcttcttcagaagagtggat

SEQ ID NO: 324407 - DNA, 25 bp, Homo sapien
ttcagtcagagcttgtaatgtgtag

SEQ ID NO: 324408 - DNA, 25 bp, Homo sapien
tggatccaaaagttgacctcttccc

SEQ ID NO: 324409 - DNA, 25 bp, Homo sapien
tcttccccagactgagtcagcatgg

SEQ ID NO: 324410 - DNA, 25 bp, Homo sapien
gagcttgtaatgtgtaggacgtgac

SEQ ID NO: 324411 - DNA, 25 bp, Homo sapien
ttttctgtagctttcactgtttctt

SEQ ID NO: 324412 - DNA, 25 bp, Homo sapien
gaaggagttctcaggtcctcagtca

SEQ ID NO: 324413 - DNA, 25 bp, Homo sapien
tcaggtcctcagtcactggagtaaa

SEQ ID NO: 324414 - DNA, 25 bp, Homo sapien
attagggagtgaagagctttcctct

SEQ ID NO: 324415 - DNA, 25 bp, Homo sapien
gctttcctcttcactgattcaagat

SEQ ID NO: 324416 - DNA, 25 bp, Homo sapien
attcaagatagccagtgccgggtga

SEQ ID NO: 324417 - DNA, 25 bp, Homo sapien
tctgtagtctttgggtctttgggag

SEQ ID NO: 324418 - DNA, 25 bp, Homo sapien
agtctttgggtctttgggaggccag

SEQ ID NO: 324419 - DNA, 25 bp, Homo sapien
agcctagacaacatactacgaccct

SEQ ID NO: 324420 - DNA, 25 bp, Homo sapien
gcctagacaacatactacgaccctg

SEQ ID NO: 324421 - DNA, 25 bp, Homo sapien
tagacaacatactacgaccctgtct

SEQ ID NO: 324422 - DNA, 25 bp, Homo sapien
agacaacatactacgaccctgtcta

SEQ ID NO: 324423 - DNA, 25 bp, Homo sapien
caacatactacgaccctgtctatac

SEQ ID NO: 324424 - DNA, 25 bp, Homo sapien
aacatactacgaccctgtctataca

SEQ ID NO: 324425 - DNA, 25 bp, Homo sapien
aaaacttctctaaattagccggatg

SEQ ID NO: 324426 - DNA, 25 bp, Homo sapien
aaacttctctaaattagccggatgt

SEQ ID NO: 324427 - DNA, 25 bp, Homo sapien
gttgtggctgtagtgagtgatgatc

SEQ ID NO: 324428 - DNA, 25 bp, Homo sapien
caaaacgcactgaagaatccaacca

SEQ ID NO: 324429 - DNA, 25 bp, Homo sapien
gaagaatccaaccaggaaacctcct

SEQ ID NO: 324430 - DNA, 25 bp, Homo sapien
gaatccaaccaggaaacctcctgaa

SEQ ID NO: 324431 - DNA, 25 bp, Homo sapien
aggaaacctcctgaacacaccactt

SEQ ID NO: 324432 - DNA, 25 bp, Homo sapien
ggaggcagaggtattcaagcgggat

SEQ ID NO: 324433 - DNA, 25 bp, Homo sapien
agggaggaacacttgctattagaat

SEQ ID NO: 324434 - DNA, 25 bp, Homo sapien
ggaacacttgctattagaattacaa

SEQ ID NO: 324435 - DNA, 25 bp, Homo sapien
agaattacaatcaaggctatttggg

SEQ ID NO: 324436 - DNA, 25 bp, Homo sapien
tgggctctctgtgccaaaggactgc

SEQ ID NO: 324437 - DNA, 25 bp, Homo sapien
tctctgtgccaaaggactgccgaaa

SEQ ID NO: 324438 - DNA, 25 bp, Homo sapien
gtgccaaaggactgccgaaaagaat

SEQ ID NO: 324439 - DNA, 25 bp, Homo sapien
tagcatttcattagtacttcacatg

SEQ ID NO: 324440 - DNA, 25 bp, Homo sapien
cacatgcttttgatgtactcttgag

SEQ ID NO: 324441 - DNA, 25 bp, Homo sapien
gtactcttgagattgctttaaattt

SEQ ID NO: 324442 - DNA, 25 bp, Homo sapien
gaaacaacaatacattttgcactgt

SEQ ID NO: 324443 - DNA, 25 bp, Homo sapien
tttgcactgtagtaatgggagcact

SEQ ID NO: 324444 - DNA, 25 bp, Homo sapien
gggagcactaactcttacaacagtt

SEQ ID NO: 324445 - DNA, 25 bp, Homo sapien
gtcagttgttcagttacttgaagca

SEQ ID NO: 324446 - DNA, 25 bp, Homo sapien
agtcaaatcactgcagtcatgaaat

SEQ ID NO: 324447 - DNA, 25 bp, Homo sapien
aatactgaacaattgccttaagtct

SEQ ID NO: 324448 - DNA, 25 bp, Homo sapien
gactcactgggatagactgaggctt

SEQ ID NO: 324449 - DNA, 25 bp, Homo sapien
gggtgtgtctgtattagcatttcat

SEQ ID NO: 324450 - DNA, 25 bp, Homo sapien
gaagcctcaacgtagattcctgaac

SEQ ID NO: 324451 - DNA, 25 bp, Homo sapien
gattcctgaactcaaggtaccagca

SEQ ID NO: 324452 - DNA, 25 bp, Homo sapien
aggtaccagcaagaatgccttctcc

SEQ ID NO: 324453 - DNA, 25 bp, Homo sapien
taggcacagctttcataacccagtt

SEQ ID NO: 324454 - DNA, 25 bp, Homo sapien
cacagctttcataacccagtttctt

SEQ ID NO: 324455 - DNA, 25 bp, Homo sapien
tatctcatttattaagtctcagaac

SEQ ID NO: 324456 - DNA, 25 bp, Homo sapien
tacaaccaaccagtttcttttctag

SEQ ID NO: 324457 - DNA, 25 bp, Homo sapien
aaccagtttcttttctagccaatca

SEQ ID NO: 324458 - DNA, 25 bp, Homo sapien
gtttcttttctagccaatcatctct

SEQ ID NO: 324459 - DNA, 25 bp, Homo sapien
ttctagccaatcatctctgaagagt

SEQ ID NO: 324460 - DNA, 25 bp, Homo sapien
atcatctctgaagagttgctgtttc

SEQ ID NO: 324461 - DNA, 25 bp, Homo sapien
actggtatcttgaaggagttctttt

SEQ ID NO: 324462 - DNA, 25 bp, Homo sapien
gagttcttttcctctggcagtagac

SEQ ID NO: 324463 - DNA, 25 bp, Homo sapien
ctctggcagtagacctctggtttta

SEQ ID NO: 324464 - DNA, 25 bp, Homo sapien
gacctctggttttataatggaaatc

SEQ ID NO: 324465 - DNA, 25 bp, Homo sapien
gatctgcttagatttacattcatct

SEQ ID NO: 324466 - DNA, 25 bp, Homo sapien
tctttggtagagtaaacctcatctc

SEQ ID NO: 324467 - DNA, 25 bp, Homo sapien
gtaatttcttacctttatgattaga

SEQ ID NO: 324468 - DNA, 25 bp, Homo sapien
ccacatgtcagtttttaaagcttaa

SEQ ID NO: 324469 - DNA, 25 bp, Homo sapien
agagcaatacttttaccttcacagg

SEQ ID NO: 324470 - DNA, 25 bp, Homo sapien
taccttcacaggtttgagcctgttg

SEQ ID NO: 324471 - DNA, 25 bp, Homo sapien
gagcctgttgtttgctatattttat

SEQ ID NO: 324472 - DNA, 25 bp, Homo sapien
attggcattccctaagtcagagagc

SEQ ID NO: 324473 - DNA, 25 bp, Homo sapien
agagcctgcttcctacctagaccga

SEQ ID NO: 324474 - DNA, 25 bp, Homo sapien
tagaccgaaccagtacgctttgaaa

SEQ ID NO: 324475 - DNA, 25 bp, Homo sapien
gtacgctttgaaaaccattcggagt

SEQ ID NO: 324476 - DNA, 25 bp, Homo sapien
accattcggagtgagatgttctcgg

SEQ ID NO: 324477 - DNA, 25 bp, Homo sapien
aaagggagttttggccagacaggct

SEQ ID NO: 324478 - DNA, 25 bp, Homo sapien
acaccatgtgtattcattagctctt

SEQ ID NO: 324479 - DNA, 25 bp, Homo sapien
tagctcttatttatggtctctgccc

SEQ ID NO: 324480 - DNA, 25 bp, Homo sapien
cttatttatggtctctgccctactt

SEQ ID NO: 324481 - DNA, 25 bp, Homo sapien
tgttttgattgtttcgggtatttat

SEQ ID NO: 324482 - DNA, 25 bp, Homo sapien
tgtttcgggtatttattggcattcc

SEQ ID NO: 324483 - DNA, 25 bp, Homo sapien
ctgtagctgccaggcgaggatgtgt

SEQ ID NO: 324484 - DNA, 25 bp, Homo sapien
ggtaaatgagaggtctcgggcccca

SEQ ID NO: 324485 - DNA, 25 bp, Homo sapien
aaatgagaggtctcgggccccagga

SEQ ID NO: 324486 - DNA, 25 bp, Homo sapien
ggccagttccgaccgtgacaggcca

SEQ ID NO: 324487 - DNA, 25 bp, Homo sapien
ttccgtgcagaagcagctgctcctt

SEQ ID NO: 324488 - DNA, 25 bp, Homo sapien
gtgcagaagcagctgctcctttccg

SEQ ID NO: 324489 - DNA, 25 bp, Homo sapien
tggagaccatgaggttccgcatcta

SEQ ID NO: 324490 - DNA, 25 bp, Homo sapien
gaccatgaggttccgcatctacaaa

SEQ ID NO: 324491 - DNA, 25 bp, Homo sapien
ccgcatctacaaacggaaggtgcta

SEQ ID NO: 324492 - DNA, 25 bp, Homo sapien
gaaggtgctaatcctgacgctcgtg

SEQ ID NO: 324493 - DNA, 25 bp, Homo sapien
taatcctgacgctcgtggtggccgc

SEQ ID NO: 324494 - DNA, 25 bp, Homo sapien
ctaagcttcctcactctagtggagt

SEQ ID NO: 324495 - DNA, 25 bp, Homo sapien
tcctcactctagtggagtattcaga

SEQ ID NO: 324496 - DNA, 25 bp, Homo sapien
ttcagatactttgatcacctgctat

SEQ ID NO: 324497 - DNA, 25 bp, Homo sapien
gatactttgatcacctgctatttcg

SEQ ID NO: 324498 - DNA, 25 bp, Homo sapien
tttgatcacctgctatttcgagccc

SEQ ID NO: 324499 - DNA, 25 bp, Homo sapien
tatttcgagccctccagaacatcaa

SEQ ID NO: 324500 - DNA, 25 bp, Homo sapien
cgagccctccagaacatcaaattgt

SEQ ID NO: 324501 - DNA, 25 bp, Homo sapien
atcaaattgtcttctactaaaggaa

SEQ ID NO: 324502 - DNA, 25 bp, Homo sapien
gaaggtttccatgaacctgctgaga

SEQ ID NO: 324503 - DNA, 25 bp, Homo sapien
acctgctgagaaaaggtagcatctt

SEQ ID NO: 324504 - DNA, 25 bp, Homo sapien
ggtagcatcttctataaaggttatc

SEQ ID NO: 324505 - DNA, 25 bp, Homo sapien
gccaggaactgaccagctcagcgag

SEQ ID NO: 324506 - DNA, 25 bp, Homo sapien
cagcgaggagccataatgtgcatat

SEQ ID NO: 324507 - DNA, 25 bp, Homo sapien
gtgcatatgtgcacaagcagggttg

SEQ ID NO: 324508 - DNA, 25 bp, Homo sapien
ggttgtgcccaggtgttgcccccta

SEQ ID NO: 324509 - DNA, 25 bp, Homo sapien
gcagggacagtctccagggtcagtc

SEQ ID NO: 324510 - DNA, 25 bp, Homo sapien
ggacagtctccagggtcagtccctg

SEQ ID NO: 324511 - DNA, 25 bp, Homo sapien
tcagtccctggatgggtggttacct

SEQ ID NO: 324512 - DNA, 25 bp, Homo sapien
gtgggagccctcctagtgggtttgg

SEQ ID NO: 324513 - DNA, 25 bp, Homo sapien
gggttgggttcctgaatgcaccata

SEQ ID NO: 324514 - DNA, 25 bp, Homo sapien
gttcctgaatgcaccataatcgctg

SEQ ID NO: 324515 - DNA, 25 bp, Homo sapien
cctgaatgcaccataatcgctgtat

SEQ ID NO: 324516 - DNA, 25 bp, Homo sapien
gtatatgcatgctcaggcagggcta

SEQ ID NO: 324517 - DNA, 25 bp, Homo sapien
gctagagtttgacctcaccacctca

SEQ ID NO: 324518 - DNA, 25 bp, Homo sapien
caccacctcaccagtcatattttaa

SEQ ID NO: 324519 - DNA, 25 bp, Homo sapien
tttgatctaacaatcctcacaaccc

SEQ ID NO: 324520 - DNA, 25 bp, Homo sapien
tcctcacaaccctatgagggcaagt

SEQ ID NO: 324521 - DNA, 25 bp, Homo sapien
gggcaagtgacttcctcaggataac

SEQ ID NO: 324522 - DNA, 25 bp, Homo sapien
aacccaggcaaccagactgcagatt

SEQ ID NO: 324523 - DNA, 25 bp, Homo sapien
ccagactgcagattcatgctttcaa

SEQ ID NO: 324524 - DNA, 25 bp, Homo sapien
ttcaaacaactatgctactctcctt

SEQ ID NO: 324525 - DNA, 25 bp, Homo sapien
tcagcattttaacaggtctccatca

SEQ ID NO: 324526 - DNA, 25 bp, Homo sapien
aggtctccatcaaaaactgccacca

SEQ ID NO: 324527 - DNA, 25 bp, Homo sapien
cttgtgagatcccagagcagtttta

SEQ ID NO: 324528 - DNA, 25 bp, Homo sapien
ggataaatcaagtccagtgagctta

SEQ ID NO: 324529 - DNA, 25 bp, Homo sapien
gtccagtgagcttagtgattgccta

SEQ ID NO: 324530 - DNA, 25 bp, Homo sapien
agcttagtgattgcctagacacagt

SEQ ID NO: 324531 - DNA, 25 bp, Homo sapien
agacacagtaggatgccgttattca

SEQ ID NO: 324532 - DNA, 25 bp, Homo sapien
ccgttattcagcctcctgggagata

SEQ ID NO: 324533 - DNA, 25 bp, Homo sapien
aagaatgttctatcgctctggagcc

SEQ ID NO: 324534 - DNA, 25 bp, Homo sapien
gttctatcgctctggagccagcatg

SEQ ID NO: 324535 - DNA, 25 bp, Homo sapien
agccagcatggcttcagctcaggtg

SEQ ID NO: 324536 - DNA, 25 bp, Homo sapien
tgaatagtaagccagcctgtgtcct

SEQ ID NO: 324537 - DNA, 25 bp, Homo sapien
gtcctgtgtcctttgtgcaaattgg

SEQ ID NO: 324538 - DNA, 25 bp, Homo sapien
gggccttcgtgattgtcaggagcaa

SEQ ID NO: 324539 - DNA, 25 bp, Homo sapien
gagcaagacctgagatgctccctgc

SEQ ID NO: 324540 - DNA, 25 bp, Homo sapien
gcatctcccctttctaatgaagatc

SEQ ID NO: 324541 - DNA, 25 bp, Homo sapien
ggaactcacatgttttatctgccct

SEQ ID NO: 324542 - DNA, 25 bp, Homo sapien
gttttatctgccctatcaatttttt

SEQ ID NO: 324543 - DNA, 25 bp, Homo sapien
caaaatctgtccttgtaaattactt

SEQ ID NO: 324544 - DNA, 25 bp, Homo sapien
ttactttttcttacagtgtcttggc

SEQ ID NO: 324545 - DNA, 25 bp, Homo sapien
gtgtcttggcatactatatcaactt

SEQ ID NO: 324546 - DNA, 25 bp, Homo sapien
atcaactttgattctttgttacaac

SEQ ID NO: 324547 - DNA, 25 bp, Homo sapien
ttttcttactcttttatcaccaaag

SEQ ID NO: 324548 - DNA, 25 bp, Homo sapien
tcaccaaagtggcttttattctctt

SEQ ID NO: 324549 - DNA, 25 bp, Homo sapien
gggctgccactgtcaacaccctaag

SEQ ID NO: 324550 - DNA, 25 bp, Homo sapien
ctcctgcagggcatttgcatgtgtg

SEQ ID NO: 324551 - DNA, 25 bp, Homo sapien
tgtgtgtgcgccctactgtacgcgc

SEQ ID NO: 324552 - DNA, 25 bp, Homo sapien
actgtacgcgcccaagagccagtgg

SEQ ID NO: 324553 - DNA, 25 bp, Homo sapien
gaaatgccggcggtggcagttcaca

SEQ ID NO: 324554 - DNA, 25 bp, Homo sapien
aatgccggcggtggcagttcacacg

SEQ ID NO: 324555 - DNA, 25 bp, Homo sapien
ggcactgctgcacaaagccccaagg

SEQ ID NO: 324556 - DNA, 25 bp, Homo sapien
aagccccaaggccaagcggcacggt

SEQ ID NO: 324557 - DNA, 25 bp, Homo sapien
ggcacggtggccctggctggcgaat

SEQ ID NO: 324558 - DNA, 25 bp, Homo sapien
cccgttgttctgcagctgataaccg

SEQ ID NO: 324559 - DNA, 25 bp, Homo sapien
tgataaccggattaggcagcagaat

SEQ ID NO: 324560 - DNA, 25 bp, Homo sapien
gagcaaacccatggagaaccccgcg

SEQ ID NO: 324561 - DNA, 25 bp, Homo sapien
cgacctgccaaccttagcctaaaat

SEQ ID NO: 324562 - DNA, 25 bp, Homo sapien
accttagcctaaaatcagagctgct

SEQ ID NO: 324563 - DNA, 25 bp, Homo sapien
gagctgctagaatcacacacactgt

SEQ ID NO: 324564 - DNA, 25 bp, Homo sapien
gaatcacacacactgtcgtagctgg

SEQ ID NO: 324565 - DNA, 25 bp, Homo sapien
acacacactgtcgtagctggttttg

SEQ ID NO: 324566 - DNA, 25 bp, Homo sapien
ctgtcgtagctggttttgtattgta

SEQ ID NO: 324567 - DNA, 25 bp, Homo sapien
aaatgagtcattctgttattttgga

SEQ ID NO: 324568 - DNA, 25 bp, Homo sapien
attttggaaacttatgtctcatgcc

SEQ ID NO: 324569 - DNA, 25 bp, Homo sapien
gtctcatgccaggatctgcagatag

SEQ ID NO: 324570 - DNA, 25 bp, Homo sapien
gccaggatctgcagatagttctttt

SEQ ID NO: 324571 - DNA, 25 bp, Homo sapien
ttcctgcggtgtttaaaaatctgcc

SEQ ID NO: 324572 - DNA, 25 bp, Homo sapien
atctgccacatagaggattcattca

SEQ ID NO: 324573 - DNA, 25 bp, Homo sapien
gaggattcattcatgtatgcaagta

SEQ ID NO: 324574 - DNA, 25 bp, Homo sapien
tattaaacgtctacatgtgccaggc

SEQ ID NO: 324575 - DNA, 25 bp, Homo sapien
ttgttctggacacttgggatacccc

SEQ ID NO: 324576 - DNA, 25 bp, Homo sapien
tgggataccccacagcacaaagtag

SEQ ID NO: 324577 - DNA, 25 bp, Homo sapien
gagtgggtgctgtaagatttcacac

SEQ ID NO: 324578 - DNA, 25 bp, Homo sapien
gatttcacactaaatgattccagta

SEQ ID NO: 324579 - DNA, 25 bp, Homo sapien
gattccagtaacactttctatttgc

SEQ ID NO: 324580 - DNA, 25 bp, Homo sapien
ttctatttgctaggctcttacagtg

SEQ ID NO: 324581 - DNA, 25 bp, Homo sapien
agtgcaccgggatgcatgtgccaaa

SEQ ID NO: 324582 - DNA, 25 bp, Homo sapien
ggctgctctctgtcccgtgaggtga

SEQ ID NO: 324583 - DNA, 25 bp, Homo sapien
tgaggtgaggtctagcacttcgccc

SEQ ID NO: 324584 - DNA, 25 bp, Homo sapien
gcatccgactgactgtctgtgctat

SEQ ID NO: 324585 - DNA, 25 bp, Homo sapien
gactgtctgtgctatcatgggatcc

SEQ ID NO: 324586 - DNA, 25 bp, Homo sapien
atgggatccaacatcactctctttt

SEQ ID NO: 324587 - DNA, 25 bp, Homo sapien
gataagcccgtttcttctcagggaa

SEQ ID NO: 324588 - DNA, 25 bp, Homo sapien
cagggaacaggtggtaactccgtgt

SEQ ID NO: 324589 - DNA, 25 bp, Homo sapien
aactccgtgtttgcgcaactggtgg

SEQ ID NO: 324590 - DNA, 25 bp, Homo sapien
ggtggcgcacacagttagatttggt

SEQ ID NO: 324591 - DNA, 25 bp, Homo sapien
agaaggcatcgcatttgtgacaagg

SEQ ID NO: 324592 - DNA, 25 bp, Homo sapien
ggttctgaccagtgtgtgtgagcat

SEQ ID NO: 324593 - DNA, 25 bp, Homo sapien
agggctttcagcaatcgtgagaccg

SEQ ID NO: 324594 - DNA, 25 bp, Homo sapien
gggctttcagcaatcgtgagaccgt

SEQ ID NO: 324595 - DNA, 25 bp, Homo sapien
gctttcagcaatcgtgagaccgtct

SEQ ID NO: 324596 - DNA, 25 bp, Homo sapien
ctttcagcaatcgtgagaccgtcta

SEQ ID NO: 324597 - DNA, 25 bp, Homo sapien
ttcagcaatcgtgagaccgtctagt

SEQ ID NO: 324598 - DNA, 25 bp, Homo sapien
tcagcaatcgtgagaccgtctagta

SEQ ID NO: 324599 - DNA, 25 bp, Homo sapien
gcaatcgtgagaccgtctagtataa

SEQ ID NO: 324600 - DNA, 25 bp, Homo sapien
tcgtgagaccgtctagtataagaca

SEQ ID NO: 324601 - DNA, 25 bp, Homo sapien
gaccgtctagtataagacagagcac

SEQ ID NO: 324602 - DNA, 25 bp, Homo sapien
gacagagcacgaaaggcatttttac

SEQ ID NO: 324603 - DNA, 25 bp, Homo sapien
gcacgaaaggcatttttactgctgg

SEQ ID NO: 324604 - DNA, 25 bp, Homo sapien
ttgagtactagactttcctcttcgg

SEQ ID NO: 324605 - DNA, 25 bp, Homo sapien
ttcctcttcggcttctgaaagtatt

SEQ ID NO: 324606 - DNA, 25 bp, Homo sapien
attctgattacgttgtctgatgtta

SEQ ID NO: 324607 - DNA, 25 bp, Homo sapien
gtctgatgttaacagcactacgtgg

SEQ ID NO: 324608 - DNA, 25 bp, Homo sapien
ggatttcacttggataccatgcagc

SEQ ID NO: 324609 - DNA, 25 bp, Homo sapien
taccatgcagcatgctttagagtca

SEQ ID NO: 324610 - DNA, 25 bp, Homo sapien
gaactggtgaaaaatctctccgcaa

SEQ ID NO: 324611 - DNA, 25 bp, Homo sapien
aaatctctccgcaactggagtggta

SEQ ID NO: 324612 - DNA, 25 bp, Homo sapien
aactggagtggtactacaattcact

SEQ ID NO: 324613 - DNA, 25 bp, Homo sapien
attcactgttgattttccaccttca

SEQ ID NO: 324614 - DNA, 25 bp, Homo sapien
taccataagtccttttattcctata

SEQ ID NO: 324615 - DNA, 25 bp, Homo sapien
taacactgtaaggattgttccaaat

SEQ ID NO: 324616 - DNA, 25 bp, Homo sapien
ggattgttccaaatactagttgcac

SEQ ID NO: 324617 - DNA, 25 bp, Homo sapien
ccaaatactagttgcactgctctgt

SEQ ID NO: 324618 - DNA, 25 bp, Homo sapien
gttgcactgctctgtttataattgt

SEQ ID NO: 324619 - DNA, 25 bp, Homo sapien
aacagtagacaaatgcagcagcaag

SEQ ID NO: 324620 - DNA, 25 bp, Homo sapien
gtattagcagaatattgtcctcatt

SEQ ID NO: 324621 - DNA, 25 bp, Homo sapien
agaatattgtcctcattgcatgtgt

SEQ ID NO: 324622 - DNA, 25 bp, Homo sapien
tattgtcctcattgcatgtgtagtt

SEQ ID NO: 324623 - DNA, 25 bp, Homo sapien
cttacggccaagtttcttctagtat

SEQ ID NO: 324624 - DNA, 25 bp, Homo sapien
acggccaagtttcttctagtatgat

SEQ ID NO: 324625 - DNA, 25 bp, Homo sapien
ccaagtttcttctagtatgatggaa

SEQ ID NO: 324626 - DNA, 25 bp, Homo sapien
aaatgtcagacctgcgagcgaacct

SEQ ID NO: 324627 - DNA, 25 bp, Homo sapien
gcgagcgaaccttcaccttgaagca

SEQ ID NO: 324628 - DNA, 25 bp, Homo sapien
tgaagcacagcctggttcgccacca

SEQ ID NO: 324629 - DNA, 25 bp, Homo sapien
agcggatccaccagaaagccaggca

SEQ ID NO: 324630 - DNA, 25 bp, Homo sapien
aggcatgccaaacaccacgggaagg

SEQ ID NO: 324631 - DNA, 25 bp, Homo sapien
aacaccacgggaaggacagcgacaa

SEQ ID NO: 324632 - DNA, 25 bp, Homo sapien
acagcgagaatgagtccacccacag

SEQ ID NO: 324633 - DNA, 25 bp, Homo sapien
atgagtccacccacagcggcaacaa

SEQ ID NO: 324634 - DNA, 25 bp, Homo sapien
gcaacaacgccgtctcagagaacga

SEQ ID NO: 324635 - DNA, 25 bp, Homo sapien
gagaacgaggctgagctggctccca

SEQ ID NO: 324636 - DNA, 25 bp, Homo sapien
acatggctgtcacccggagccggaa

SEQ ID NO: 324637 - DNA, 25 bp, Homo sapien
gtatgtggtgactttttcaaaatac

SEQ ID NO: 324638 - DNA, 25 bp, Homo sapien
ttttgtacatgaaaccccagataga

SEQ ID NO: 324639 - DNA, 25 bp, Homo sapien
atgaaaccccagatagactataaat

SEQ ID NO: 324640 - DNA, 25 bp, Homo sapien
gtagatatgtatgtaattgctttta

SEQ ID NO: 324641 - DNA, 25 bp, Homo sapien
atgcctttgtttttggactgtgcaa

SEQ ID NO: 324642 - DNA, 25 bp, Homo sapien
gtttttggactgtgcaaaggttgga

SEQ ID NO: 324643 - DNA, 25 bp, Homo sapien
tggaagtgggtttgcatttctaaaa

SEQ ID NO: 324644 - DNA, 25 bp, Homo sapien
ggtgacttttattctgcaagagttc

SEQ ID NO: 324645 - DNA, 25 bp, Homo sapien
gtaacttcttgagtgtggtagactt

SEQ ID NO: 324646 - DNA, 25 bp, Homo sapien
gtggtagactttggaacatgtaaat

SEQ ID NO: 324647 - DNA, 25 bp, Homo sapien
ttgcttgtaatgttatcctgtggta

SEQ ID NO: 324648 - DNA, 25 bp, Homo sapien
gatggacagtttgaacatccacaag

SEQ ID NO: 324649 - DNA, 25 bp, Homo sapien
acaaggacgctaactgcatcagata

SEQ ID NO: 324650 - DNA, 25 bp, Homo sapien
gcatcagatatgtttaatgggttca

SEQ ID NO: 324651 - DNA, 25 bp, Homo sapien
aaactcagtaatcatctttatagga

SEQ ID NO: 324652 - DNA, 25 bp, Homo sapien
ggatacttgggaacagactcatttt

SEQ ID NO: 324653 - DNA, 25 bp, Homo sapien
gaacagactcattttcaaattggta

SEQ ID NO: 324654 - DNA, 25 bp, Homo sapien
gtgggaacatggtcatatcaaagat

SEQ ID NO: 324655 - DNA, 25 bp, Homo sapien
gataaggattactagggccatgtca

SEQ ID NO: 324656 - DNA, 25 bp, Homo sapien
ttactagggccatgtcagaactcaa

SEQ ID NO: 324657 - DNA, 25 bp, Homo sapien
aacatgaaaaggctcctgcttgcaa

SEQ ID NO: 324658 - DNA, 25 bp, Homo sapien
gaaaaggctcctgcttgcaaaagat

SEQ ID NO: 324659 - DNA, 25 bp, Homo sapien
tggtcacattctgatcctttggtaa

SEQ ID NO: 324660 - DNA, 25 bp, Homo sapien
ggtaagccgatctgtcttgcaatat

SEQ ID NO: 324661 - DNA, 25 bp, Homo sapien
cttgcaatatacatgtcccgacgat

SEQ ID NO: 324662 - DNA, 25 bp, Homo sapien
ggaaagcgagctgaatcaccaaact

SEQ ID NO: 324663 - DNA, 25 bp, Homo sapien
atatcatcgtggcttttctgcttat

SEQ ID NO: 324664 - DNA, 25 bp, Homo sapien
tatgaaacactccacccgataagat

SEQ ID NO: 324665 - DNA, 25 bp, Homo sapien
ataagatttgatccccttctgcaag

SEQ ID NO: 324666 - DNA, 25 bp, Homo sapien
aagcttgctgagatcaacacaacat

SEQ ID NO: 324667 - DNA, 25 bp, Homo sapien
caacacaacatttcgcaagcaggca

SEQ ID NO: 324668 - DNA, 25 bp, Homo sapien
aaggatttcaacgaaggctcttttg

SEQ ID NO: 324669 - DNA, 25 bp, Homo sapien
aaggctcttttggtcacattctgat

SEQ ID NO: 324670 - DNA, 25 bp, Homo sapien
ttttctttactgacccctcattcaa

SEQ ID NO: 324671 - DNA, 25 bp, Homo sapien
tgacccctcattcaagtggagactt

SEQ ID NO: 324672 - DNA, 25 bp, Homo sapien
agtggagactttgcgtaactctaac

SEQ ID NO: 324673 - DNA, 25 bp, Homo sapien
ctgtgaacacgcagacaaagctaga

SEQ ID NO: 324674 - DNA, 25 bp, Homo sapien
gtgtgcttcaagatgcgcatgtctt

SEQ ID NO: 324675 - DNA, 25 bp, Homo sapien
gatgcgcatgtctttcatggagtat

SEQ ID NO: 324676 - DNA, 25 bp, Homo sapien
gtatgaacagtaacatttcttggat

SEQ ID NO: 324677 - DNA, 25 bp, Homo sapien
gatgatggataccaagaatcagtgt

SEQ ID NO: 324678 - DNA, 25 bp, Homo sapien
taaatggctacaacagccgtcctgg

SEQ ID NO: 324679 - DNA, 25 bp, Homo sapien
gccgtcctgggaggtgcttaagcaa

SEQ ID NO: 324680 - DNA, 25 bp, Homo sapien
ggaggtgcttaagcaatcccttttc

SEQ ID NO: 324681 - DNA, 25 bp, Homo sapien
gttactacttacaatatatgcataa

SEQ ID NO: 324682 - DNA, 25 bp, Homo sapien
aagttacagcttacatttacctcgt

SEQ ID NO: 324683 - DNA, 25 bp, Homo sapien
gaggtaaatgtaaactctgtggttt

SEQ ID NO: 324684 - DNA, 25 bp, Homo sapien
tcatttattcacaattgctcttaat

SEQ ID NO: 324685 - DNA, 25 bp, Homo sapien
ggtatagtttgcctcctacatgatg

SEQ ID NO: 324686 - DNA, 25 bp, Homo sapien
gcctcctacatgatgcaattcagtg

SEQ ID NO: 324687 - DNA, 25 bp, Homo sapien
aattcagtgaaattcccaggagaca

SEQ ID NO: 324688 - DNA, 25 bp, Homo sapien
acctgaataaaccacttattgttgt

SEQ ID NO: 324689 - DNA, 25 bp, Homo sapien
agtgagtttattcttcctggcacac

SEQ ID NO: 324690 - DNA, 25 bp, Homo sapien
ggcacacttccaggtaatatccatt

SEQ ID NO: 324691 - DNA, 25 bp, Homo sapien
tccaggtaatatccattaggctaag

SEQ ID NO: 324692 - DNA, 25 bp, Homo sapien
gtggcgattcaaagatgccggcgtc

SEQ ID NO: 324693 - DNA, 25 bp, Homo sapien
aaagatgccggcgtcccgcagtgtg

SEQ ID NO: 324694 - DNA, 25 bp, Homo sapien
gcagtgtgcggttcgtgcccttaac

SEQ ID NO: 324695 - DNA, 25 bp, Homo sapien
tctgctttcgcaggagctcttgtgc

SEQ ID NO: 324696 - DNA, 25 bp, Homo sapien
gcaggagctcttgtgcttgagttca

SEQ ID NO: 324697 - DNA, 25 bp, Homo sapien
gctcttgtgcttgagttcagtgtta

SEQ ID NO: 324698 - DNA, 25 bp, Homo sapien
ttcagtgttagtggtagcgtggctc

SEQ ID NO: 324699 - DNA, 25 bp, Homo sapien
agcgtggctcactccacttggaggt

SEQ ID NO: 324700 - DNA, 25 bp, Homo sapien
cgtctgaccgtgtgttactgctttg

SEQ ID NO: 324701 - DNA, 25 bp, Homo sapien
ggccctgatgcgtgtacactctgcg

SEQ ID NO: 324702 - DNA, 25 bp, Homo sapien
atgcgtgtacactctgcgggctgca

SEQ ID NO: 324703 - DNA, 25 bp, Homo sapien
tgagaggctgcggtccaaatggaat

SEQ ID NO: 324704 - DNA, 25 bp, Homo sapien
ggtccaaatggaatgcagtttgcct

SEQ ID NO: 324705 - DNA, 25 bp, Homo sapien
gtcctctatcagcatcaatgcatca

SEQ ID NO: 324706 - DNA, 25 bp, Homo sapien
ccccgatttttacctcatgatatat

SEQ ID NO: 324707 - DNA, 25 bp, Homo sapien
gcatttaacgcatgtttattgagtg

SEQ ID NO: 324708 - DNA, 25 bp, Homo sapien
ttttctttgtcctttcaactcctct

SEQ ID NO: 324709 - DNA, 25 bp, Homo sapien
tttcaactcctctctctggatttgc

SEQ ID NO: 324710 - DNA, 25 bp, Homo sapien
ccttgtccctgcacttgagatgaaa

SEQ ID NO: 324711 - DNA, 25 bp, Homo sapien
gcacttgagatgaaagctaaccaat

SEQ ID NO: 324712 - DNA, 25 bp, Homo sapien
accaataccacggattttctagcca

SEQ ID NO: 324713 - DNA, 25 bp, Homo sapien
acggattttctagccactctgagcc

SEQ ID NO: 324714 - DNA, 25 bp, Homo sapien
tgattcctcgccagtgttgctaccg

SEQ ID NO: 324715 - DNA, 25 bp, Homo sapien
ttggctcttcttgcatggctggctc

SEQ ID NO: 324716 - DNA, 25 bp, Homo sapien
ctgatggaggcaacgtgagaagcac

SEQ ID NO: 324717 - DNA, 25 bp, Homo sapien
aacgtgagaagcacatggacatccg

SEQ ID NO: 324718 - DNA, 25 bp, Homo sapien
agaggcctgagttctagttacagcc

SEQ ID NO: 324719 - DNA, 25 bp, Homo sapien
tgagttctagttacagccccagcag

SEQ ID NO: 324720 - DNA, 25 bp, Homo sapien
tagttacagccccagcagtaccagt

SEQ ID NO: 324721 - DNA, 25 bp, Homo sapien
ccagcagtaccagttgtgtggactg

SEQ ID NO: 324722 - DNA, 25 bp, Homo sapien
atactccaagcctccaagcctgttt

SEQ ID NO: 324723 - DNA, 25 bp, Homo sapien
tgtttccccttctgacacaggatct

SEQ ID NO: 324724 - DNA, 25 bp, Homo sapien
tccccttctgacacaggatcttttg

SEQ ID NO: 324725 - DNA, 25 bp, Homo sapien
tccctgattttctccgtggctttgg

SEQ ID NO: 324726 - DNA, 25 bp, Homo sapien
gtaggtctcatctcttggatcatct

SEQ ID NO: 324727 - DNA, 25 bp, Homo sapien
gatcatctttgaatggtatctcctc

SEQ ID NO: 324728 - DNA, 25 bp, Homo sapien
atggtatctcctcttcactgattaa

SEQ ID NO: 324729 - DNA, 25 bp, Homo sapien
cactgattaacatctcttcttcctc

SEQ ID NO: 324730 - DNA, 25 bp, Homo sapien
aatgccacctggagactgatgctct

SEQ ID NO: 324731 - DNA, 25 bp, Homo sapien
ggtctgtatttggttctgacttgca

SEQ ID NO: 324732 - DNA, 25 bp, Homo sapien
aaatgagctgcaatgaaccggtctt

SEQ ID NO: 324733 - DNA, 25 bp, Homo sapien
aaccggtcttggaccgagagcttcg

SEQ ID NO: 324734 - DNA, 25 bp, Homo sapien
agagcttcgggtgttctctgtatca

SEQ ID NO: 324735 - DNA, 25 bp, Homo sapien
gtgttctctgtatcacgatggcgag

SEQ ID NO: 324736 - DNA, 25 bp, Homo sapien
actttctgcctttccaggggcaagg

SEQ ID NO: 324737 - DNA, 25 bp, Homo sapien
gggtcgaggccaactctaagcctct

SEQ ID NO: 324738 - DNA, 25 bp, Homo sapien
gtcgaggccaactctaagcctcttc

SEQ ID NO: 324739 - DNA, 25 bp, Homo sapien
aggccaactctaagcctcttccaat

SEQ ID NO: 324740 - DNA, 25 bp, Homo sapien
aactctaagcctcttccaatcctac

SEQ ID NO: 324741 - DNA, 25 bp, Homo sapien
gggacttgcagcactaccaaaataa

SEQ ID NO: 324742 - DNA, 25 bp, Homo sapien
gacttgcagcactaccaaaataaaa

SEQ ID NO: 324743 - DNA, 25 bp, Homo sapien
agcactaccaaaataaaacctgtgt

SEQ ID NO: 324744 - DNA, 25 bp, Homo sapien
tccccagatgggtggcgctgtcagt

SEQ ID NO: 324745 - DNA, 25 bp, Homo sapien
ccccagatgggtggcgctgtcagtc

SEQ ID NO: 324746 - DNA, 25 bp, Homo sapien
ggtggcgctgtcagtccccggcttc

SEQ ID NO: 324747 - DNA, 25 bp, Homo sapien
gaaagcacagcatacttaaagtagt

SEQ ID NO: 324748 - DNA, 25 bp, Homo sapien
aacagttgctaaatgtaggacatct

SEQ ID NO: 324749 - DNA, 25 bp, Homo sapien
gtaggacatcttttgaggaattagt

SEQ ID NO: 324750 - DNA, 25 bp, Homo sapien
cttgtttttactatcctgttagaag

SEQ ID NO: 324751 - DNA, 25 bp, Homo sapien
ctgttagaagtatttgtttatcctg

SEQ ID NO: 324752 - DNA, 25 bp, Homo sapien
tatcctgataattttaagccaacat

SEQ ID NO: 324753 - DNA, 25 bp, Homo sapien
aagccaacatagtagtcttaaatta

SEQ ID NO: 324754 - DNA, 25 bp, Homo sapien
aatttctaatctgtgaaggcagtaa

SEQ ID NO: 324755 - DNA, 25 bp, Homo sapien
gaaatatctgttctgcaactgttga

SEQ ID NO: 324756 - DNA, 25 bp, Homo sapien
aaacaaataattggctacattgacc

SEQ ID NO: 324757 - DNA, 25 bp, Homo sapien
ggctacattgaccataattaaagtt

SEQ ID NO: 324758 - DNA, 25 bp, Homo sapien
catatgctcagtttttgtaaacata

SEQ ID NO: 324759 - DNA, 25 bp, Homo sapien
taaagtcatatttcctctagggccc

SEQ ID NO: 324760 - DNA, 25 bp, Homo sapien
tcatatttcctctagggcccactaa

SEQ ID NO: 324761 - DNA, 25 bp, Homo sapien
tagggcccactaactagtaaacatt

SEQ ID NO: 324762 - DNA, 25 bp, Homo sapien
aactagtaaacattggagccagaat

SEQ ID NO: 324763 - DNA, 25 bp, Homo sapien
gccagaattctatctcagcaatgag

SEQ ID NO: 324764 - DNA, 25 bp, Homo sapien
gagtaactacaaaactggagtgggt

SEQ ID NO: 324765 - DNA, 25 bp, Homo sapien
tgggttttttccctataccatgctt

SEQ ID NO: 324766 - DNA, 25 bp, Homo sapien
ttccctataccatgctttcttgtta

SEQ ID NO: 324767 - DNA, 25 bp, Homo sapien
taccatgctttcttgttaatgtttg

SEQ ID NO: 324768 - DNA, 25 bp, Homo sapien
gatatgttaggactacagaggttat

SEQ ID NO: 324769 - DNA, 25 bp, Homo sapien
atggacatgatgctgagattcaatc

SEQ ID NO: 324770 - DNA, 25 bp, Homo sapien
gatgctgagattcaatcactacatg

SEQ ID NO: 324771 - DNA, 25 bp, Homo sapien
tcactacatgaaacacctggctgtg

SEQ ID NO: 324772 - DNA, 25 bp, Homo sapien
acatgaaacacctggctgtgaaaac

SEQ ID NO: 324773 - DNA, 25 bp, Homo sapien
cacctggctgtgaaaacaaaacaac

SEQ ID NO: 324774 - DNA, 25 bp, Homo sapien
aaacaacccagagggctgtgttcca

SEQ ID NO: 324775 - DNA, 25 bp, Homo sapien
ggaagctacgtaacagtcggatgcc

SEQ ID NO: 324776 - DNA, 25 bp, Homo sapien
gctacgtaacagtcggatgccagtt

SEQ ID NO: 324777 - DNA, 25 bp, Homo sapien
taacagtcggatgccagttttggaa

SEQ ID NO: 324778 - DNA, 25 bp, Homo sapien
gttttggaagattcaccatgcgttc

SEQ ID NO: 324779 - DNA, 25 bp, Homo sapien
ggaagattcaccatgcgttctgacc

SEQ ID NO: 324780 - DNA, 25 bp, Homo sapien
atggagtgcggtgccgtcatcatga

SEQ ID NO: 324781 - DNA, 25 bp, Homo sapien
tgcggtgccgtcatcatgaatggat

SEQ ID NO: 324782 - DNA, 25 bp, Homo sapien
tatttatgtcactggaggatactcc

SEQ ID NO: 324783 - DNA, 25 bp, Homo sapien
ggaggatactcctactcaaagggaa

SEQ ID NO: 324784 - DNA, 25 bp, Homo sapien
ctcctactcaaagggaacgtatctt

SEQ ID NO: 324785 - DNA, 25 bp, Homo sapien
gggtaatcttcccagtgccatgcgg

SEQ ID NO: 324786 - DNA, 25 bp, Homo sapien
tgccatgcggtctcatgggtgtgtt

SEQ ID NO: 324787 - DNA, 25 bp, Homo sapien
gtataatgtctaattgaatctgcag

SEQ ID NO: 324788 - DNA, 25 bp, Homo sapien
gaatctgcagaaatgaccaagcaat

SEQ ID NO: 324789 - DNA, 25 bp, Homo sapien
atgcagggtttgaagttccttacct

SEQ ID NO: 324790 - DNA, 25 bp, Homo sapien
cagggtttgaagttccttacctgat

SEQ ID NO: 324791 - DNA, 25 bp, Homo sapien
agcccattggtcactacaccttttg

SEQ ID NO: 324792 - DNA, 25 bp, Homo sapien
tacaccttttgcaagacagcgaaac

SEQ ID NO: 324793 - DNA, 25 bp, Homo sapien
gacagcgaaacggatgcatcaaatt

SEQ ID NO: 324794 - DNA, 25 bp, Homo sapien
attgcattgatacatcatcaccatc

SEQ ID NO: 324795 - DNA, 25 bp, Homo sapien
catcaccatcaatcttttgcactga

SEQ ID NO: 324796 - DNA, 25 bp, Homo sapien
tttgcactgatttttagacttaatc

SEQ ID NO: 324797 - DNA, 25 bp, Homo sapien
gaatgaatacactctctgtcttaaa

SEQ ID NO: 324798 - DNA, 25 bp, Homo sapien
ctctgtcttaaatccgctcttaaca

SEQ ID NO: 324799 - DNA, 25 bp, Homo sapien
tccgctcttaacaaatgatctcttc

SEQ ID NO: 324800 - DNA, 25 bp, Homo sapien
gatctcttctcagaatactacatct

SEQ ID NO: 324801 - DNA, 25 bp, Homo sapien
atactacatctgtattgagagtaca

SEQ ID NO: 324802 - DNA, 25 bp, Homo sapien
aagtggctcatgatcccgactgtgg

SEQ ID NO: 324803 - DNA, 25 bp, Homo sapien
gtggtgcgactagggctttcagcaa

SEQ ID NO: 324804 - DNA, 25 bp, Homo sapien
tagggctttcagcaatcgtgagacc

SEQ ID NO: 324805 - DNA, 25 bp, Homo sapien
tcagcaatcgtgagaccgtctagta

SEQ ID NO: 324806 - DNA, 25 bp, Homo sapien
gacagagcacgaaaggcatttttac

SEQ ID NO: 324807 - DNA, 25 bp, Homo sapien
ggcatttttactgctggcctgaaga

SEQ ID NO: 324808 - DNA, 25 bp, Homo sapien
gctggcctgaagaagtcagtgattt

SEQ ID NO: 324809 - DNA, 25 bp, Homo sapien
gatttatagttcactaaaactgcac

SEQ ID NO: 324810 - DNA, 25 bp, Homo sapien
ggtggctgaggaaaacatcctgatt

SEQ ID NO: 324811 - DNA, 25 bp, Homo sapien
aaacatcctgattttgcttgctttt

SEQ ID NO: 324812 - DNA, 25 bp, Homo sapien
catcctgattttgcttgcttttata

SEQ ID NO: 324813 - DNA, 25 bp, Homo sapien
tgagggctgccactgtcaacaccct

SEQ ID NO: 324814 - DNA, 25 bp, Homo sapien
gggctgccactgtcaacaccctaag

SEQ ID NO: 324815 - DNA, 25 bp, Homo sapien
ctcctgcagggcatttgcatgtgtg

SEQ ID NO: 324816 - DNA, 25 bp, Homo sapien
tgtgtgtgcgccctactgtacgcgc

SEQ ID NO: 324817 - DNA, 25 bp, Homo sapien
tactgtacgcgcccaagagccagtg

SEQ ID NO: 324818 - DNA, 25 bp, Homo sapien
gaaatgccggcggtggcagttcaca

SEQ ID NO: 324819 - DNA, 25 bp, Homo sapien
aatgccggcggtggcagttcacacg

SEQ ID NO: 324820 - DNA, 25 bp, Homo sapien
ggcactgctgcacaaagccccaagg

SEQ ID NO: 324821 - DNA, 25 bp, Homo sapien
aagccccaaggccaagcggcacggt

SEQ ID NO: 324822 - DNA, 25 bp, Homo sapien
ggcacggtggccctggctggcgaat

SEQ ID NO: 324823 - DNA, 25 bp, Homo sapien
tgataaccggattaggcagcagaat

SEQ ID NO: 324824 - DNA, 25 bp, Homo sapien
gaagacatagacacttacagagacc

SEQ ID NO: 324825 - DNA, 25 bp, Homo sapien
tacagagacccacatgagctggcac

SEQ ID NO: 324826 - DNA, 25 bp, Homo sapien
tgagctggcactttctgagccttta

SEQ ID NO: 324827 - DNA, 25 bp, Homo sapien
ctttctgagcctttacagcctttaa

SEQ ID NO: 324828 - DNA, 25 bp, Homo sapien
acagcctttaagactcggaggttga

SEQ ID NO: 324829 - DNA, 25 bp, Homo sapien
attctatactgttctacgtcaacca

SEQ ID NO: 324830 - DNA, 25 bp, Homo sapien
gttctacgtcaaccatttctacaaa

SEQ ID NO: 324831 - DNA, 25 bp, Homo sapien
tttctacaaagttgtccagacacct

SEQ ID NO: 324832 - DNA, 25 bp, Homo sapien
aagcagctttcttggttatccagat

SEQ ID NO: 324833 - DNA, 25 bp, Homo sapien
ccagatgccagaatcaaccttgtat

SEQ ID NO: 324834 - DNA, 25 bp, Homo sapien
gtatctgacaatgcacatctgttga

SEQ ID NO: 324835 - DNA, 25 bp, Homo sapien
tgttttgaactatacgatttgaaac

SEQ ID NO: 324836 - DNA, 25 bp, Homo sapien
gactatggaaacattctcaacaggg

SEQ ID NO: 324837 - DNA, 25 bp, Homo sapien
atggaaacattctcaacagggaaac

SEQ ID NO: 324838 - DNA, 25 bp, Homo sapien
tcaacagggaaaccctactagactt

SEQ ID NO: 324839 - DNA, 25 bp, Homo sapien
ccctactagactttgtaaagcaaat

SEQ ID NO: 324840 - DNA, 25 bp, Homo sapien
ataaatgctaaaattctgttttgtg

SEQ ID NO: 324841 - DNA, 25 bp, Homo sapien
aacatttatgggaattatcactgac

SEQ ID NO: 324842 - DNA, 25 bp, Homo sapien
tatcactgacagtttttgtacactt

SEQ ID NO: 324843 - DNA, 25 bp, Homo sapien
gtgttaaagcagcaactccatgttg

SEQ ID NO: 324844 - DNA, 25 bp, Homo sapien
aaagcagcaactccatgttgtaaat

SEQ ID NO: 324845 - DNA, 25 bp, Homo sapien
gcaactccatgttgtaaatgcacaa

SEQ ID NO: 324846 - DNA, 25 bp, Homo sapien
cacaacttcaagatatcatgcattt

SEQ ID NO: 324847 - DNA, 25 bp, Homo sapien
agatatcatgcattttacccataag

SEQ ID NO: 324848 - DNA, 25 bp, Homo sapien
gcattttacccataagtacttctgt

SEQ ID NO: 324849 - DNA, 25 bp, Homo sapien
aagtacttctgtatgcatctctgac

SEQ ID NO: 324850 - DNA, 25 bp, Homo sapien
gtacttctgtatgcatctctgacat

SEQ ID NO: 324851 - DNA, 25 bp, Homo sapien
acttctgtatgcatctctgacatga

SEQ ID NO: 324852 - DNA, 25 bp, Homo sapien
gtatgcatctctgacatgaactggt

SEQ ID NO: 324853 - DNA, 25 bp, Homo sapien
atctctgacatgaactggtgtcccg

SEQ ID NO: 324854 - DNA, 25 bp, Homo sapien
attaatattgtgtcatctaactctt

SEQ ID NO: 324855 - DNA, 25 bp, Homo sapien
cttccacattttttgacagaatatt

SEQ ID NO: 324856 - DNA, 25 bp, Homo sapien
gacagaatattttaacacaacttca

SEQ ID NO: 324857 - DNA, 25 bp, Homo sapien
gaagtcagtgatttatagttcacta

SEQ ID NO: 324858 - DNA, 25 bp, Homo sapien
gtgatttatagttcactaaaactgc

SEQ ID NO: 324859 - DNA, 25 bp, Homo sapien
gatttatagttcactaaaactgcac

SEQ ID NO: 324860 - DNA, 25 bp, Homo sapien
ttatagttcactaaaactgcacaaa

SEQ ID NO: 324861 - DNA, 25 bp, Homo sapien
cacaaaatgtggaaagggtggctga

SEQ ID NO: 324862 - DNA, 25 bp, Homo sapien
ggtggctgaggaaaacatcctgatt

SEQ ID NO: 324863 - DNA, 25 bp, Homo sapien
gtggctgaggaaaacatcctgattt

SEQ ID NO: 324864 - DNA, 25 bp, Homo sapien
tggctgaggaaaacatcctgatttt

SEQ ID NO: 324865 - DNA, 25 bp, Homo sapien
acatcctgattttgcttgcttttat

SEQ ID NO: 324866 - DNA, 25 bp, Homo sapien
catcctgattttgcttgcttttata

SEQ ID NO: 324867 - DNA, 25 bp, Homo sapien
gtagatgaataaagtgtttgatcct

SEQ ID NO: 324868 - DNA, 25 bp, Homo sapien
gtgagcgctcggtggctgaggctgg

SEQ ID NO: 324869 - DNA, 25 bp, Homo sapien
gtggctgaggctggtccgtgagggc

SEQ ID NO: 324870 - DNA, 25 bp, Homo sapien
gtgagggccccaagtctaaccccat

SEQ ID NO: 324871 - DNA, 25 bp, Homo sapien
ccgtccttggctctgcagcgcagga

SEQ ID NO: 324872 - DNA, 25 bp, Homo sapien
gctctgcagcgcaggaccaggcctg

SEQ ID NO: 324873 - DNA, 25 bp, Homo sapien
aggtaggtatcacccacccctcaga

SEQ ID NO: 324874 - DNA, 25 bp, Homo sapien
cacaggccaggagagtcgctcgcag

SEQ ID NO: 324875 - DNA, 25 bp, Homo sapien
agagtcgctcgcaggttttgggtca

SEQ ID NO: 324876 - DNA, 25 bp, Homo sapien
agtcgctcgcaggttttgggtcata

SEQ ID NO: 324877 - DNA, 25 bp, Homo sapien
cgctcgcaggttttgggtcatagat

SEQ ID NO: 324878 - DNA, 25 bp, Homo sapien
tttgggtcatagatggcagccctgg

SEQ ID NO: 324879 - DNA, 25 bp, Homo sapien
gaagagggtcttctaatctgccatc

SEQ ID NO: 324880 - DNA, 25 bp, Homo sapien
tctaatctgccatcttaaggaggta

SEQ ID NO: 324881 - DNA, 25 bp, Homo sapien
aaagggcttgattgggtaactcatt

SEQ ID NO: 324882 - DNA, 25 bp, Homo sapien
gtaactcattgcaatgggcacgtat

SEQ ID NO: 324883 - DNA, 25 bp, Homo sapien
ggcacgtatttattactgtctcccg

SEQ ID NO: 324884 - DNA, 25 bp, Homo sapien
gctgtttgtctgctggaattaccac

SEQ ID NO: 324885 - DNA, 25 bp, Homo sapien
gaattaccactagtgccaggccatt

SEQ ID NO: 324886 - DNA, 25 bp, Homo sapien
gaccatttgtcttagaattctctga

SEQ ID NO: 324887 - DNA, 25 bp, Homo sapien
gtttttcatacctttactatgtact

SEQ ID NO: 324888 - DNA, 25 bp, Homo sapien
gttgcatgttggtttgtactctctc

SEQ ID NO: 324889 - DNA, 25 bp, Homo sapien
gtactctctcctgcacataaaaaat

SEQ ID NO: 324890 - DNA, 25 bp, Homo sapien
tggttgctgtagctgtctcattgga

SEQ ID NO: 324891 - DNA, 25 bp, Homo sapien
tagctgtctcattggagcagtgcct

SEQ ID NO: 324892 - DNA, 25 bp, Homo sapien
agcagtgcctctccaagtttgagga

SEQ ID NO: 324893 - DNA, 25 bp, Homo sapien
gaactgggactggtgacttgttaat

SEQ ID NO: 324894 - DNA, 25 bp, Homo sapien
agagggccatcatctcagcttgtgg

SEQ ID NO: 324895 - DNA, 25 bp, Homo sapien
tcagcttgtggagacctttctttcc

SEQ ID NO: 324896 - DNA, 25 bp, Homo sapien
ctggatgctgcttctcagctaactc

SEQ ID NO: 324897 - DNA, 25 bp, Homo sapien
aactccctctctcttcgtgtgtgta

SEQ ID NO: 324898 - DNA, 25 bp, Homo sapien
gtgtactcggccttcagggtttcca

SEQ ID NO: 324899 - DNA, 25 bp, Homo sapien
ttcccaccacgatagcttggcttta

SEQ ID NO: 324900 - DNA, 25 bp, Homo sapien
gatagcttggctttaatgtggaatt

SEQ ID NO: 324901 - DNA, 25 bp, Homo sapien
ttgaaggcccttatacaatccttct

SEQ ID NO: 324902 - DNA, 25 bp, Homo sapien
gaaggcccttatacaatccttctat

SEQ ID NO: 324903 - DNA, 25 bp, Homo sapien
aggcccttatacaatccttctataa

SEQ ID NO: 324904 - DNA, 25 bp, Homo sapien
ggcccttatacaatccttctataaa

SEQ ID NO: 324905 - DNA, 25 bp, Homo sapien
tacaatccttctataaatcacccag

SEQ ID NO: 324906 - DNA, 25 bp, Homo sapien
atccttctataaatcacccaggcag

SEQ ID NO: 324907 - DNA, 25 bp, Homo sapien
cttctataaatcacccaggcaggaa

SEQ ID NO: 324908 - DNA, 25 bp, Homo sapien
ttctataaatcacccaggcaggaag

SEQ ID NO: 324909 - DNA, 25 bp, Homo sapien
gaagccatttgatttctattatttt

SEQ ID NO: 324910 - DNA, 25 bp, Homo sapien
tgatttctattattttcctgacttt

SEQ ID NO: 324911 - DNA, 25 bp, Homo sapien
caaaagacttaaaatcttatgctaa

SEQ ID NO: 324912 - DNA, 25 bp, Homo sapien
aaccgcgaagaagccgaggagcccg

SEQ ID NO: 324913 - DNA, 25 bp, Homo sapien
ctctctcagtccaaaagcggctttt

SEQ ID NO: 324914 - DNA, 25 bp, Homo sapien
caaaagcggcttttggttcggcgca

SEQ ID NO: 324915 - DNA, 25 bp, Homo sapien
aaagcggcttttggttcggcgcaga

SEQ ID NO: 324916 - DNA, 25 bp, Homo sapien
tttggttcggcgcagagagacccgg

SEQ ID NO: 324917 - DNA, 25 bp, Homo sapien
gggtctagcttttcctcgaaaagcg

SEQ ID NO: 324918 - DNA, 25 bp, Homo sapien
ccttggccccgagaacagacaaaga

SEQ ID NO: 324919 - DNA, 25 bp, Homo sapien
gagaacagacaaagagcaccgcagg

SEQ ID NO: 324920 - DNA, 25 bp, Homo sapien
agacaaagagcaccgcagggccgat

SEQ ID NO: 324921 - DNA, 25 bp, Homo sapien
aaagagcaccgcagggccgatcacg

SEQ ID NO: 324922 - DNA, 25 bp, Homo sapien
gctgaggccggccatggtcatggaa

SEQ ID NO: 324923 - DNA, 25 bp, Homo sapien
ccatggacctgctgtatcggtgtca

SEQ ID NO: 324924 - DNA, 25 bp, Homo sapien
tatcggtgtcatgtggaggtctgat

SEQ ID NO: 324925 - DNA, 25 bp, Homo sapien
gtctgatgaatcctttaaaacctaa

SEQ ID NO: 324926 - DNA, 25 bp, Homo sapien
aaaacctaactgtgatgtcgtaaat

SEQ ID NO: 324927 - DNA, 25 bp, Homo sapien
gtcgtaaatgtaactgtgctacctt

SEQ ID NO: 324928 - DNA, 25 bp, Homo sapien
actgtgctacctttatatctactga

SEQ ID NO: 324929 - DNA, 25 bp, Homo sapien
atatctactgaagggcagcgtctgc

SEQ ID NO: 324930 - DNA, 25 bp, Homo sapien
ggcagcgtctgcatccgagggaaat

SEQ ID NO: 324931 - DNA, 25 bp, Homo sapien
aaccatcgttttagttgcactcagt

SEQ ID NO: 324932 - DNA, 25 bp, Homo sapien
agttgcactcagtctgtccatatga

SEQ ID NO: 324933 - DNA, 25 bp, Homo sapien
gtttccttatgttttcaggtctaca

SEQ ID NO: 324934 - DNA, 25 bp, Homo sapien
aagtcatgcagccagcgtgagacct

SEQ ID NO: 324935 - DNA, 25 bp, Homo sapien
tgagacctgcagttcacctaagcac

SEQ ID NO: 324936 - DNA, 25 bp, Homo sapien
atctcagtatgcctccatgtaaaca

SEQ ID NO: 324937 - DNA, 25 bp, Homo sapien
aacagattcacataggcctccaatt

SEQ ID NO: 324938 - DNA, 25 bp, Homo sapien
ggcctccaatttcaatgagaccttt

SEQ ID NO: 324939 - DNA, 25 bp, Homo sapien
aaagcccttatgttctaacccatga

SEQ ID NO: 324940 - DNA, 25 bp, Homo sapien
acccatgagaaccattttacctgcc

SEQ ID NO: 324941 - DNA, 25 bp, Homo sapien
tctaagggccaccagcttcgacctg

SEQ ID NO: 324942 - DNA, 25 bp, Homo sapien
agcagcacagaccagtggctccctg

SEQ ID NO: 324943 - DNA, 25 bp, Homo sapien
tgtccaaggccgcagagcagacgcc

SEQ ID NO: 324944 - DNA, 25 bp, Homo sapien
gccatcccactgtacaatcgaattt

SEQ ID NO: 324945 - DNA, 25 bp, Homo sapien
agccttatataacctcccatttaga

SEQ ID NO: 324946 - DNA, 25 bp, Homo sapien
ctacacggatctggtcatgctgtgg

SEQ ID NO: 324947 - DNA, 25 bp, Homo sapien
gtgatggacctcaatgaaataacat

SEQ ID NO: 324948 - DNA, 25 bp, Homo sapien
acatgtagttctatgcttcaagtaa

SEQ ID NO: 324949 - DNA, 25 bp, Homo sapien
gctatttctttaacctttggcccat

SEQ ID NO: 324950 - DNA, 25 bp, Homo sapien
gtcatgctgtggttcagctcttgac

SEQ ID NO: 324951 - DNA, 25 bp, Homo sapien
cctttggcccatctcttttataata

SEQ ID NO: 324952 - DNA, 25 bp, Homo sapien
cagctcttgacccagagaatatgag

SEQ ID NO: 324953 - DNA, 25 bp, Homo sapien
agaatatgagcacatgtaaccacaa

SEQ ID NO: 324954 - DNA, 25 bp, Homo sapien
gtaatggagttctaggtcctgccct

SEQ ID NO: 324955 - DNA, 25 bp, Homo sapien
taggtcctgccctagccttatataa

SEQ ID NO: 324956 - DNA, 25 bp, Homo sapien
atgcctatgttcaaccactggtgtt

SEQ ID NO: 324957 - DNA, 25 bp, Homo sapien
aacaaagatactgtgcgtctctggg

SEQ ID NO: 324958 - DNA, 25 bp, Homo sapien
aagacgcacctaggtggcggccact

SEQ ID NO: 324959 - DNA, 25 bp, Homo sapien
catggccttgtctagggctcagaga

SEQ ID NO: 324960 - DNA, 25 bp, Homo sapien
agaccactcggctctgagcttccag

SEQ ID NO: 324961 - DNA, 25 bp, Homo sapien
aggcgcctcgtctgtgtgcatctca

SEQ ID NO: 324962 - DNA, 25 bp, Homo sapien
ccgacgtggcttctgaaacgtgcat

SEQ ID NO: 324963 - DNA, 25 bp, Homo sapien
aaacgtgcattcaacctcaaacttt

SEQ ID NO: 324964 - DNA, 25 bp, Homo sapien
tagaatgaatcgttttgctctgatg

SEQ ID NO: 324965 - DNA, 25 bp, Homo sapien
gtatataagactgttcctgccttcg

SEQ ID NO: 324966 - DNA, 25 bp, Homo sapien
ttcctgccttcggtctgtcattttc

SEQ ID NO: 324967 - DNA, 25 bp, Homo sapien
aaggactaagatattttcttcttga

SEQ ID NO: 324968 - DNA, 25 bp, Homo sapien
gaagagacttttcgattagtcctca

SEQ ID NO: 324969 - DNA, 25 bp, Homo sapien
gattagtcctcatatatttatctac

SEQ ID NO: 324970 - DNA, 25 bp, Homo sapien
gagtgtttaccatgaacagtgtgtt

SEQ ID NO: 324971 - DNA, 25 bp, Homo sapien
gaacagtgtgttgcttcagactatt

SEQ ID NO: 324972 - DNA, 25 bp, Homo sapien
gttgcttcagactattacaaagaca

SEQ ID NO: 324973 - DNA, 25 bp, Homo sapien
gcaggtactctaatataaaggacag

SEQ ID NO: 324974 - DNA, 25 bp, Homo sapien
taaaggacaggtggtgtttctaaat

SEQ ID NO: 324975 - DNA, 25 bp, Homo sapien
ggtgtttctaaataattggctgcta

SEQ ID NO: 324976 - DNA, 25 bp, Homo sapien
aattggctgctatggttctgtaaaa

SEQ ID NO: 324977 - DNA, 25 bp, Homo sapien
ggtttttggcaaagcacatcaatgt

SEQ ID NO: 324978 - DNA, 25 bp, Homo sapien
aagaagcttgactcagggtcaccat

SEQ ID NO: 324979 - DNA, 25 bp, Homo sapien
atggagaactcctcatcccagagat

SEQ ID NO: 324980 - DNA, 25 bp, Homo sapien
ttcaccaaccactgagcttgatact

SEQ ID NO: 324981 - DNA, 25 bp, Homo sapien
actctttcagaggtggtttgtgcta

SEQ ID NO: 324982 - DNA, 25 bp, Homo sapien
agaaacacccagcagtctttcaaga

SEQ ID NO: 324983 - DNA, 25 bp, Homo sapien
aagaacgttctcttctgtagctttg

SEQ ID NO: 324984 - DNA, 25 bp, Homo sapien
tagctttgcctgctacacagctgaa

SEQ ID NO: 324985 - DNA, 25 bp, Homo sapien
agctgaagtctgtccctataagaat

SEQ ID NO: 324986 - DNA, 25 bp, Homo sapien
aaaagggtttgtttgcagatgggca

SEQ ID NO: 324987 - DNA, 25 bp, Homo sapien
gatgggcagttcagttaagtcctca

SEQ ID NO: 324988 - DNA, 25 bp, Homo sapien
ttaagtcctcattaaccaggcagag

SEQ ID NO: 324989 - DNA, 25 bp, Homo sapien
agcacttggcatgcattatgcttaa

SEQ ID NO: 324990 - DNA, 25 bp, Homo sapien
taatacatggtcactattgtcacaa

SEQ ID NO: 324991 - DNA, 25 bp, Homo sapien
attgtcacaaatcaccagtgccacc

SEQ ID NO: 324992 - DNA, 25 bp, Homo sapien
agtgccacccttgctgatttgggtt

SEQ ID NO: 324993 - DNA, 25 bp, Homo sapien
gctgatttgggttcatacttggagt

SEQ ID NO: 324994 - DNA, 25 bp, Homo sapien
ctgtatgggagaatccagtgaaatc

SEQ ID NO: 324995 - DNA, 25 bp, Homo sapien
ttccttctctgtaatcttctgagtg

SEQ ID NO: 324996 - DNA, 25 bp, Homo sapien
aatcttctgagtggtggcagtgacc

SEQ ID NO: 324997 - DNA, 25 bp, Homo sapien
gtggcagtgaccacccttgtggata

SEQ ID NO: 324998 - DNA, 25 bp, Homo sapien
cacccttgtggatatagtactgagc

SEQ ID NO: 324999 - DNA, 25 bp, Homo sapien
atatagtactgagcacttgggactg

SEQ ID NO: 325000 - DNA, 25 bp, Homo sapien
tttttaataactcttcccactgcat

SEQ ID NO: 325001 - DNA, 25 bp, Homo sapien
cccactgcatatttccatcttgaat

SEQ ID NO: 325002 - DNA, 25 bp, Homo sapien
ggagatgtgcatccctcttctttgt

SEQ ID NO: 325003 - DNA, 25 bp, Homo sapien
tcttctttgtggttgcccaaggttg

SEQ ID NO: 325004 - DNA, 25 bp, Homo sapien
gcccaaggttgttttgcgtaactga

SEQ ID NO: 325005 - DNA, 25 bp, Homo sapien
gttttgcgtaactgagactccttga

SEQ ID NO: 325006 - DNA, 25 bp, Homo sapien
gagactccttgatatgcttcagaga

SEQ ID NO: 325007 - DNA, 25 bp, Homo sapien
ttaggcaaacactggccatggccgt

SEQ ID NO: 325008 - DNA, 25 bp, Homo sapien
tatcgaggtatagactagcatccac

SEQ ID NO: 325009 - DNA, 25 bp, Homo sapien
gactagcatccacatagagcacttg

SEQ ID NO: 325010 - DNA, 25 bp, Homo sapien
acatagagcacttgaacctcctttg

SEQ ID NO: 325011 - DNA, 25 bp, Homo sapien
ggaagtatgattttacatcaaccag

SEQ ID NO: 325012 - DNA, 25 bp, Homo sapien
ggaaacactatgtccccataatgat

SEQ ID NO: 325013 - DNA, 25 bp, Homo sapien
gtccccataatgatgctataattct

SEQ ID NO: 325014 - DNA, 25 bp, Homo sapien
aattctaatatatctagtccccata

SEQ ID NO: 325015 - DNA, 25 bp, Homo sapien
tatctagtccccataaacagtaagt

SEQ ID NO: 325016 - DNA, 25 bp, Homo sapien
aagcatttttacacttcctggaatg

SEQ ID NO: 325017 - DNA, 25 bp, Homo sapien
acacttcctggaatgagtatattat

SEQ ID NO: 325018 - DNA, 25 bp, Homo sapien
gagtatattatcagcaatcttttgt

SEQ ID NO: 325019 - DNA, 25 bp, Homo sapien
atcttttgtcaaatgccagccgtat

SEQ ID NO: 325020 - DNA, 25 bp, Homo sapien
atgccagccgtataaatgttacttc

SEQ ID NO: 325021 - DNA, 25 bp, Homo sapien
gttacttctgctctttgtaaacctc

SEQ ID NO: 325022 - DNA, 25 bp, Homo sapien
aaaagccgattaagcactggccgcc

SEQ ID NO: 325023 - DNA, 25 bp, Homo sapien
aatgcccgagtcactgtggcagcat

SEQ ID NO: 325024 - DNA, 25 bp, Homo sapien
gagtcactgtggcagcattcgcact

SEQ ID NO: 325025 - DNA, 25 bp, Homo sapien
ctgtggcagcattcgcactggtgtg

SEQ ID NO: 325026 - DNA, 25 bp, Homo sapien
agtcctttcaactcaaggaggctgg

SEQ ID NO: 325027 - DNA, 25 bp, Homo sapien
tcaactcaaggaggctgggtttctg

SEQ ID NO: 325028 - DNA, 25 bp, Homo sapien
gaagttttctggatgtctttttatc

SEQ ID NO: 325029 - DNA, 25 bp, Homo sapien
gtgaactgcactacaaaagagacca

SEQ ID NO: 325030 - DNA, 25 bp, Homo sapien
gccagccagacacctgggtcttgag

SEQ ID NO: 325031 - DNA, 25 bp, Homo sapien
gacacctgggtcttgagccataaac

SEQ ID NO: 325032 - DNA, 25 bp, Homo sapien
gtcttgagccataaactggcgtagt

SEQ ID NO: 325033 - DNA, 25 bp, Homo sapien
gtgtataacatgctaaagtacttta

SEQ ID NO: 325034 - DNA, 25 bp, Homo sapien
gctaaagtactttaactgtgatctt

SEQ ID NO: 325035 - DNA, 25 bp, Homo sapien
gttgacagtttcagcatgactgaat

SEQ ID NO: 325036 - DNA, 25 bp, Homo sapien
agcatgactgaatcgctcatttttt

SEQ ID NO: 325037 - DNA, 25 bp, Homo sapien
gaaattggcttggttctctttagag

SEQ ID NO: 325038 - DNA, 25 bp, Homo sapien
gcttggttctctttagagttggtgt

SEQ ID NO: 325039 - DNA, 25 bp, Homo sapien
gagttggtgtaaacatgccatgtaa

SEQ ID NO: 325040 - DNA, 25 bp, Homo sapien
gatttccacttaatggtacaacaga

SEQ ID NO: 325041 - DNA, 25 bp, Homo sapien
gaattattgctttcttagatgtatg

SEQ ID NO: 325042 - DNA, 25 bp, Homo sapien
gctttcttagatgtatgtgtagtaa

SEQ ID NO: 325043 - DNA, 25 bp, Homo sapien
tctaaaaattgcacatgtaagtcat

SEQ ID NO: 325044 - DNA, 25 bp, Homo sapien
gcaggtagccctcaagccaataagc

SEQ ID NO: 325045 - DNA, 25 bp, Homo sapien
tagccctcaagccaataagccaaac

SEQ ID NO: 325046 - DNA, 25 bp, Homo sapien
aagccaataagccaaacagatctgc

SEQ ID NO: 325047 - DNA, 25 bp, Homo sapien
ggtgttctgtaagggttttgcagac

SEQ ID NO: 325048 - DNA, 25 bp, Homo sapien
gggttttgcagacaaattcctctga

SEQ ID NO: 325049 - DNA, 25 bp, Homo sapien
caaattcctctgagcttagctagga

SEQ ID NO: 325050 - DNA, 25 bp, Homo sapien
ctgagcttagctaggagttcattat

SEQ ID NO: 325051 - DNA, 25 bp, Homo sapien
gagttcattatgcttcctgtttagc

SEQ ID NO: 325052 - DNA, 25 bp, Homo sapien
attatgcttcctgtttagctggtct

SEQ ID NO: 325053 - DNA, 25 bp, Homo sapien
atgcttcctgtttagctggtcttct

SEQ ID NO: 325054 - DNA, 25 bp, Homo sapien
gtttagctggtcttctttcttctac

SEQ ID NO: 325055 - DNA, 25 bp, Homo sapien
gactagcactagacatgtcatggtc

SEQ ID NO: 325056 - DNA, 25 bp, Homo sapien
tagacatgtcatggtcctcatggtg

SEQ ID NO: 325057 - DNA, 25 bp, Homo sapien
tggtcctcatggtgcatataaatat

SEQ ID NO: 325058 - DNA, 25 bp, Homo sapien
attcaccttttcttcaaaatcgata

SEQ ID NO: 325059 - DNA, 25 bp, Homo sapien
aaatcgatatggtggctgcaaaact

SEQ ID NO: 325060 - DNA, 25 bp, Homo sapien
aaactagaattgttgcatccctcaa

SEQ ID NO: 325061 - DNA, 25 bp, Homo sapien
ttgttgcatccctcaattgaatgag

SEQ ID NO: 325062 - DNA, 25 bp, Homo sapien
gaatgagggccatatccctgtggta

SEQ ID NO: 325063 - DNA, 25 bp, Homo sapien
atatccctgtggtattcctttcctg

SEQ ID NO: 325064 - DNA, 25 bp, Homo sapien
gttccaaatccacagcttttacgta

SEQ ID NO: 325065 - DNA, 25 bp, Homo sapien
caaatccacagcttttacgtagtaa

SEQ ID NO: 325066 - DNA, 25 bp, Homo sapien
aaatgggagcaaaagaggcattcca

SEQ ID NO: 325067 - DNA, 25 bp, Homo sapien
gcagggcaagaggagacagcacctt

SEQ ID NO: 325068 - DNA, 25 bp, Homo sapien
gagacagcaccttgttgccagagat

SEQ ID NO: 325069 - DNA, 25 bp, Homo sapien
gcaccttgttgccagagattctaca

SEQ ID NO: 325070 - DNA, 25 bp, Homo sapien
gccagagattctacacaaaggtgtg

SEQ ID NO: 325071 - DNA, 25 bp, Homo sapien
tgtgatggacactgatgctctatta

SEQ ID NO: 325072 - DNA, 25 bp, Homo sapien
tggacactgatgctctattaagaag

SEQ ID NO: 325073 - DNA, 25 bp, Homo sapien
attaagaagcttttgtggtgtgtgt

SEQ ID NO: 325074 - DNA, 25 bp, Homo sapien
ataattaaggcttctgataagacag

SEQ ID NO: 325075 - DNA, 25 bp, Homo sapien
aattgtcactgatcgtatttctact

SEQ ID NO: 325076 - DNA, 25 bp, Homo sapien
gtcactgatcgtatttctacttgtt

SEQ ID NO: 325077 - DNA, 25 bp, Homo sapien
tatggagaaaactcaatagggttca

SEQ ID NO: 325078 - DNA, 25 bp, Homo sapien
actcaatagggttcagggaggttct

SEQ ID NO: 325079 - DNA, 25 bp, Homo sapien
gttctggcagtgtgcagtgtgaaat

SEQ ID NO: 325080 - DNA, 25 bp, Homo sapien
gcagtgtgcagtgtgaaataatcct

SEQ ID NO: 325081 - DNA, 25 bp, Homo sapien
tgtgcagtgtgaaataatcctgagt

SEQ ID NO: 325082 - DNA, 25 bp, Homo sapien
cttgctgaacacaactgtaggcttg

SEQ ID NO: 325083 - DNA, 25 bp, Homo sapien
gaacacaactgtaggcttgagttat

SEQ ID NO: 325084 - DNA, 25 bp, Homo sapien
tgtaggcttgagttataaagcacat

SEQ ID NO: 325085 - DNA, 25 bp, Homo sapien
ttgaatcctgtggttctatccctct

SEQ ID NO: 325086 - DNA, 25 bp, Homo sapien
gatgaaccacaccaaaggtcatcaa

SEQ ID NO: 325087 - DNA, 25 bp, Homo sapien
tgaatcctgtggttctatccctctt

SEQ ID NO: 325088 - DNA, 25 bp, Homo sapien
atggactgaacaggagacccttcta

SEQ ID NO: 325089 - DNA, 25 bp, Homo sapien
acaggagacccttctactcctggag

SEQ ID NO: 325090 - DNA, 25 bp, Homo sapien
ggaacatgttggaagtcgtactcag

SEQ ID NO: 325091 - DNA, 25 bp, Homo sapien
aggatgaatgcatcctccacttttt

SEQ ID NO: 325092 - DNA, 25 bp, Homo sapien
ccactttttgagacttcccattgag

SEQ ID NO: 325093 - DNA, 25 bp, Homo sapien
tgagacttcccattgaggacccata

SEQ ID NO: 325094 - DNA, 25 bp, Homo sapien
gaggacccataccttgagaattcag

SEQ ID NO: 325095 - DNA, 25 bp, Homo sapien
gagaattcagatgcttcccttgggc

SEQ ID NO: 325096 - DNA, 25 bp, Homo sapien
ccttcagtcagtcaggaaatccagt

SEQ ID NO: 325097 - DNA, 25 bp, Homo sapien
gagtactgttgcttttttggcatct

SEQ ID NO: 325098 - DNA, 25 bp, Homo sapien
tgtggtggaccctcgcgtggcatct

SEQ ID NO: 325099 - DNA, 25 bp, Homo sapien
gtctgagaagcagcgacccaaggag

SEQ ID NO: 325100 - DNA, 25 bp, Homo sapien
atccctggaccagcttcgagctgaa

SEQ ID NO: 325101 - DNA, 25 bp, Homo sapien
tggaccagcttcgagctgaacgtct

SEQ ID NO: 325102 - DNA, 25 bp, Homo sapien
agcttcgagctgaacgtctgcggag

SEQ ID NO: 325103 - DNA, 25 bp, Homo sapien
aacgtctgcggagggaagcagctga

SEQ ID NO: 325104 - DNA, 25 bp, Homo sapien
cactacaggagggtcagccggaaga

SEQ ID NO: 325105 - DNA, 25 bp, Homo sapien
tcagccggaagaagacgagacggat

SEQ ID NO: 325106 - DNA, 25 bp, Homo sapien
acgagacggatgaccggcggcggcg

SEQ ID NO: 325107 - DNA, 25 bp, Homo sapien
gcggcggcggtacaactcccaattc

SEQ ID NO: 325108 - DNA, 25 bp, Homo sapien
gcggcggtacaactcccaattcaac

SEQ ID NO: 325109 - DNA, 25 bp, Homo sapien
tcaccttactcactgactcctgagg

SEQ ID NO: 325110 - DNA, 25 bp, Homo sapien
tttaatcaccttcagctccctggtc

SEQ ID NO: 325111 - DNA, 25 bp, Homo sapien
tccctggtctcctagagccacgggt

SEQ ID NO: 325112 - DNA, 25 bp, Homo sapien
tggtctcctagagccacgggtcagc

SEQ ID NO: 325113 - DNA, 25 bp, Homo sapien
tcctccaaagacaagtctgctcaga

SEQ ID NO: 325114 - DNA, 25 bp, Homo sapien
aagtctgctcagaatgtcactgaaa

SEQ ID NO: 325115 - DNA, 25 bp, Homo sapien
agaatgtcactgaaactctgagcat

SEQ ID NO: 325116 - DNA, 25 bp, Homo sapien
aatgtcactgaaactctgagcatcc

SEQ ID NO: 325117 - DNA, 25 bp, Homo sapien
gaaactctgagcatccactcaacaa

SEQ ID NO: 325118 - DNA, 25 bp, Homo sapien
aactctgagcatccactcaacaagc

SEQ ID NO: 325119 - DNA, 25 bp, Homo sapien
tccatcttcttactttctcatcttt

SEQ ID NO: 325120 - DNA, 25 bp, Homo sapien
ccatcttcttactttctcatctttt

SEQ ID NO: 325121 - DNA, 25 bp, Homo sapien
gccccacctacgttaacatgacggt

SEQ ID NO: 325122 - DNA, 25 bp, Homo sapien
tacgttaacatgacggtcggctcct

SEQ ID NO: 325123 - DNA, 25 bp, Homo sapien
atgacggtcggctccttcgtgtgta

SEQ ID NO: 325124 - DNA, 25 bp, Homo sapien
ttcgtgtgtacctcctgctccggca

SEQ ID NO: 325125 - DNA, 25 bp, Homo sapien
ggcagcctgcgaggattaaatccac

SEQ ID NO: 325126 - DNA, 25 bp, Homo sapien
gaggattaaatccaccacacagggt

SEQ ID NO: 325127 - DNA, 25 bp, Homo sapien
ggtgaaatctatctccatgacaaca

SEQ ID NO: 325128 - DNA, 25 bp, Homo sapien
ctatctccatgacaacattcacaca

SEQ ID NO: 325129 - DNA, 25 bp, Homo sapien
aacagatttggctaggattatttga

SEQ ID NO: 325130 - DNA, 25 bp, Homo sapien
gatcttcagcaattccagacttcag

SEQ ID NO: 325131 - DNA, 25 bp, Homo sapien
cagacttcagggatccacaaaaagt

SEQ ID NO: 325132 - DNA, 25 bp, Homo sapien
tccagaatcagtgatgccgtgtcat

SEQ ID NO: 325133 - DNA, 25 bp, Homo sapien
tgccgtgtcatctgttcatcttaaa

SEQ ID NO: 325134 - DNA, 25 bp, Homo sapien
taaacacttcttactttatgggatg

SEQ ID NO: 325135 - DNA, 25 bp, Homo sapien
acgtgtttgttaattctaattgtca

SEQ ID NO: 325136 - DNA, 25 bp, Homo sapien
gttgaagttggcacctttgtagtaa

SEQ ID NO: 325137 - DNA, 25 bp, Homo sapien
gttggcacctttgtagtaatcagaa

SEQ ID NO: 325138 - DNA, 25 bp, Homo sapien
gtagtaatcagaattcttgcagaga

SEQ ID NO: 325139 - DNA, 25 bp, Homo sapien
gagtatactttacaaagctcgaagg

SEQ ID NO: 325140 - DNA, 25 bp, Homo sapien
ctcgaaggagacttgaggtgtcgtt

SEQ ID NO: 325141 - DNA, 25 bp, Homo sapien
ggtgtcgtttgtgctggtgttcctc

SEQ ID NO: 325142 - DNA, 25 bp, Homo sapien
tgctggtgttcctctagccacaggg

SEQ ID NO: 325143 - DNA, 25 bp, Homo sapien
tatgcctctaggtaattaagtaaag

SEQ ID NO: 325144 - DNA, 25 bp, Homo sapien
ggtgaaattgcatacacagatatgt

SEQ ID NO: 325145 - DNA, 25 bp, Homo sapien
aacattttattcatgttgaatgcct

SEQ ID NO: 325146 - DNA, 25 bp, Homo sapien
tgttgaatgcctttttgcaatgatg

SEQ ID NO: 325147 - DNA, 25 bp, Homo sapien
ttgcaatgatgactgagttgttatc

SEQ ID NO: 325148 - DNA, 25 bp, Homo sapien
gactgagttgttatcatagtatttt

SEQ ID NO: 325149 - DNA, 25 bp, Homo sapien
aacctgtatagtgttttagacttgt

SEQ ID NO: 325150 - DNA, 25 bp, Homo sapien
ttagacttgttaaaacattgctgtc

SEQ ID NO: 325151 - DNA, 25 bp, Homo sapien
aacattgctgtctagtgtacatcta

SEQ ID NO: 325152 - DNA, 25 bp, Homo sapien
gtacatctagctaaaagtgtggttt

SEQ ID NO: 325153 - DNA, 25 bp, Homo sapien
aaccgttttaataagcaagatgact

SEQ ID NO: 325154 - DNA, 25 bp, Homo sapien
gcagcaagaaggtagcacagcccca

SEQ ID NO: 325155 - DNA, 25 bp, Homo sapien
aagaaggtagcacagccccactctc

SEQ ID NO: 325156 - DNA, 25 bp, Homo sapien
cactctcggcgcaggctaccggcag

SEQ ID NO: 325157 - DNA, 25 bp, Homo sapien
gccagcccaccaggaaggctgggaa

SEQ ID NO: 325158 - DNA, 25 bp, Homo sapien
ggcggcccgccttcacacaggagga

SEQ ID NO: 325159 - DNA, 25 bp, Homo sapien
gcccgccttcacacaggaggaggag

SEQ ID NO: 325160 - DNA, 25 bp, Homo sapien
tgcaggagcttctgagcacacgccc

SEQ ID NO: 325161 - DNA, 25 bp, Homo sapien
catccaaccctctaaagttgggaag

SEQ ID NO: 325162 - DNA, 25 bp, Homo sapien
tgggctcggagaagccaggcacaat

SEQ ID NO: 325163 - DNA, 25 bp, Homo sapien
gagaagccaggcacaattgcaagcc

SEQ ID NO: 325164 - DNA, 25 bp, Homo sapien
aagccaggcacaattgcaagccccg

SEQ ID NO: 325165 - DNA, 25 bp, Homo sapien
gcagcatcaaatggctatggcagca

SEQ ID NO: 325166 - DNA, 25 bp, Homo sapien
agcagcacaaacagctcagctacat

SEQ ID NO: 325167 - DNA, 25 bp, Homo sapien
agctacatcatcatcggcatacagg

SEQ ID NO: 325168 - DNA, 25 bp, Homo sapien
tcatcggcatacaggcagccagtca

SEQ ID NO: 325169 - DNA, 25 bp, Homo sapien
caggcagccagtcaaaaagtaaaat

SEQ ID NO: 325170 - DNA, 25 bp, Homo sapien
gccaaccactccaaaattttgagtc

SEQ ID NO: 325171 - DNA, 25 bp, Homo sapien
gagtcttgcattactttttgttcct

SEQ ID NO: 325172 - DNA, 25 bp, Homo sapien
aaaaacacaagagcactgaatcaaa

SEQ ID NO: 325173 - DNA, 25 bp, Homo sapien
gtgtcagtattttacattgctagat

SEQ ID NO: 325174 - DNA, 25 bp, Homo sapien
gtacaaactttatacagaagcacaa

SEQ ID NO: 325175 - DNA, 25 bp, Homo sapien
acagaagcacaaccttatcattttt

SEQ ID NO: 325176 - DNA, 25 bp, Homo sapien
agatctgtggatttacttgtcgaca

SEQ ID NO: 325177 - DNA, 25 bp, Homo sapien
aaaaggcatctcttaattggcacat

SEQ ID NO: 325178 - DNA, 25 bp, Homo sapien
gaaacatgatgcagactccttctac

SEQ ID NO: 325179 - DNA, 25 bp, Homo sapien
tccttctaccagttttcttgcaata

SEQ ID NO: 325180 - DNA, 25 bp, Homo sapien
agaaggacagcgtagtggcacacaa

SEQ ID NO: 325181 - DNA, 25 bp, Homo sapien
acaaggcaaaaagccaccctgaggt

SEQ ID NO: 325182 - DNA, 25 bp, Homo sapien
ctgaggtgctgattgcagaagctct

SEQ ID NO: 325183 - DNA, 25 bp, Homo sapien
agaagctctggctgccaatgcaggc

SEQ ID NO: 325184 - DNA, 25 bp, Homo sapien
gcacagatatcttgggcactaaccc

SEQ ID NO: 325185 - DNA, 25 bp, Homo sapien
gggcactaacccagagtccctgacg

SEQ ID NO: 325186 - DNA, 25 bp, Homo sapien
gcagccttcagatggtcagggtctt

SEQ ID NO: 325187 - DNA, 25 bp, Homo sapien
atcctattagatttgtatcaactag

SEQ ID NO: 325188 - DNA, 25 bp, Homo sapien
gtatcaactagttacatgttctatt

SEQ ID NO: 325189 - DNA, 25 bp, Homo sapien
gttacatgttctattcatagtcttt

SEQ ID NO: 325190 - DNA, 25 bp, Homo sapien
catagtcttttgtgaatcattgcct

SEQ ID NO: 325191 - DNA, 25 bp, Homo sapien
agatggcctattttgagcctttgta

SEQ ID NO: 325192 - DNA, 25 bp, Homo sapien
gagcctttgtataggtacattcctg

SEQ ID NO: 325193 - DNA, 25 bp, Homo sapien
gtgagttaccgttactgtatttgtt

SEQ ID NO: 325194 - DNA, 25 bp, Homo sapien
aaggtggacatttagcgttcagtgc

SEQ ID NO: 325195 - DNA, 25 bp, Homo sapien
ggacatttagcgttcagtgcagttt

SEQ ID NO: 325196 - DNA, 25 bp, Homo sapien
tttagcgttcagtgcagttttcaat

SEQ ID NO: 325197 - DNA, 25 bp, Homo sapien
tagcgttcagtgcagttttcaataa

SEQ ID NO: 325198 - DNA, 25 bp, Homo sapien
gtccatagtctagaaagccagtgct

SEQ ID NO: 325199 - DNA, 25 bp, Homo sapien
gccagtgcttctaatccttaagcca

SEQ ID NO: 325200 - DNA, 25 bp, Homo sapien
tctaatccttaagccagatctttga

SEQ ID NO: 325201 - DNA, 25 bp, Homo sapien
gatctttgactaccttttcagttgc

SEQ ID NO: 325202 - DNA, 25 bp, Homo sapien
gcttctctgtgtgtcctagtttaaa

SEQ ID NO: 325203 - DNA, 25 bp, Homo sapien
tttcctctccagcaaaagtgagctt

SEQ ID NO: 325204 - DNA, 25 bp, Homo sapien
atttctccaaactaaagctctcatg

SEQ ID NO: 325205 - DNA, 25 bp, Homo sapien
ctcatgtttttggaagggctgcctt

SEQ ID NO: 325206 - DNA, 25 bp, Homo sapien
ctgcctttgcaagtgaggtttctga

SEQ ID NO: 325207 - DNA, 25 bp, Homo sapien
gagaaatgactgttgttcccaaaac

SEQ ID NO: 325208 - DNA, 25 bp, Homo sapien
gggctggaagcaccactattcttct

SEQ ID NO: 325209 - DNA, 25 bp, Homo sapien
aattacttgcgtagctctgcacaca

SEQ ID NO: 325210 - DNA, 25 bp, Homo sapien
tgcacacaggaagggctgctctgaa

SEQ ID NO: 325211 - DNA, 25 bp, Homo sapien
tcttttccatggacactcagcgctg

SEQ ID NO: 325212 - DNA, 25 bp, Homo sapien
agcgctgccggaactgattttgaag

SEQ ID NO: 325213 - DNA, 25 bp, Homo sapien
ctctgagggcctagggtatgtgtct

SEQ ID NO: 325214 - DNA, 25 bp, Homo sapien
atgtgtcttaggatctcctgtgtgc

SEQ ID NO: 325215 - DNA, 25 bp, Homo sapien
tcctgtgtgcacaaagtgtcactga

SEQ ID NO: 325216 - DNA, 25 bp, Homo sapien
tgtcactgacagaacacagcaggat

SEQ ID NO: 325217 - DNA, 25 bp, Homo sapien
aagcctcacaagtctttcctcagat

SEQ ID NO: 325218 - DNA, 25 bp, Homo sapien
gacagatttcaacagcgacttcacc

SEQ ID NO: 325219 - DNA, 25 bp, Homo sapien
agcgacttcaccatgcgaccttgga

SEQ ID NO: 325220 - DNA, 25 bp, Homo sapien
ctccttagatgtgtttactcgcatt

SEQ ID NO: 325221 - DNA, 25 bp, Homo sapien
tgtgtttactcgcattcacaggcca

SEQ ID NO: 325222 - DNA, 25 bp, Homo sapien
acctgttggtttgagtttcatgtgt

SEQ ID NO: 325223 - DNA, 25 bp, Homo sapien
ttgagtttcatgtgtctccttccct

SEQ ID NO: 325224 - DNA, 25 bp, Homo sapien
tggcctaggttgacttgagcacaca

SEQ ID NO: 325225 - DNA, 25 bp, Homo sapien
tgagcacacaactcgatctttcttc

SEQ ID NO: 325226 - DNA, 25 bp, Homo sapien
gggaatgacatttcttgtacatact

SEQ ID NO: 325227 - DNA, 25 bp, Homo sapien
tgtacatacttagcacagcacctag

SEQ ID NO: 325228 - DNA, 25 bp, Homo sapien
gcacagcacctagagtatgaacttg

SEQ ID NO: 325229 - DNA, 25 bp, Homo sapien
aacttgtactattgttctgtaaaga

SEQ ID NO: 325230 - DNA, 25 bp, Homo sapien
gagcttattgtaaagtgtcgggaga

SEQ ID NO: 325231 - DNA, 25 bp, Homo sapien
tagatagatagatagccttgttcag

SEQ ID NO: 325232 - DNA, 25 bp, Homo sapien
agatagatagccttgttcagtgaac

SEQ ID NO: 325233 - DNA, 25 bp, Homo sapien
atagatagccttgttcagtgaacaa

SEQ ID NO: 325234 - DNA, 25 bp, Homo sapien
attcatggcccccttttatcagcaa

SEQ ID NO: 325235 - DNA, 25 bp, Homo sapien
gcccccttttatcagcaagctgaga

SEQ ID NO: 325236 - DNA, 25 bp, Homo sapien
gcaagctgagataaatggtgatttt

SEQ ID NO: 325237 - DNA, 25 bp, Homo sapien
ggtgattttgctgaatcggtataga

SEQ ID NO: 325238 - DNA, 25 bp, Homo sapien
tttgctgaatcggtatagaacctgt

SEQ ID NO: 325239 - DNA, 25 bp, Homo sapien
ctgaatcggtatagaacctgttata

SEQ ID NO: 325240 - DNA, 25 bp, Homo sapien
tatagaacctgttatacacaaggga

SEQ ID NO: 325241 - DNA, 25 bp, Homo sapien
tagaacctgttatacacaagggaaa

SEQ ID NO: 325242 - DNA, 25 bp, Homo sapien
gattagccagagtatagtatgagtc

SEQ ID NO: 325243 - DNA, 25 bp, Homo sapien
gccagagtatagtatgagtcttcac

SEQ ID NO: 325244 - DNA, 25 bp, Homo sapien
tcactgagaaatatggtgacccatt

SEQ ID NO: 325245 - DNA, 25 bp, Homo sapien
gagaaatatggtgacccattttctt

SEQ ID NO: 325246 - DNA, 25 bp, Homo sapien
ttctttgtgaaaacctgggaaaatg

SEQ ID NO: 325247 - DNA, 25 bp, Homo sapien
aaatgcaagtgtgggtatgaagtgt

SEQ ID NO: 325248 - DNA, 25 bp, Homo sapien
gaagtgtgtgttctgtttgcattga

SEQ ID NO: 325249 - DNA, 25 bp, Homo sapien
gtgtgttctgtttgcattgaaacaa

SEQ ID NO: 325250 - DNA, 25 bp, Homo sapien
tttttgctttaactgacttatttca

SEQ ID NO: 325251 - DNA, 25 bp, Homo sapien
gctttaactgacttatttcagaaat

SEQ ID NO: 325252 - DNA, 25 bp, Homo sapien
tttctgttaatatatttgcaattca

SEQ ID NO: 325253 - DNA, 25 bp, Homo sapien
acagatactgctttcacttaaatgg

SEQ ID NO: 325254 - DNA, 25 bp, Homo sapien
ggaaacaattctccgataatgcttt

SEQ ID NO: 325255 - DNA, 25 bp, Homo sapien
attctccgataatgctttgcttttt

SEQ ID NO: 325256 - DNA, 25 bp, Homo sapien
ttttcttatgtcactcttgtgtact

SEQ ID NO: 325257 - DNA, 25 bp, Homo sapien
gtcactcttgtgtactatctatttt

SEQ ID NO: 325258 - DNA, 25 bp, Homo sapien
gtgtactatctatttttctcctctc

SEQ ID NO: 325259 - DNA, 25 bp, Homo sapien
tatctatttttctcctctctgggac

SEQ ID NO: 325260 - DNA, 25 bp, Homo sapien
ttttctcctctctgggaccaagttt

SEQ ID NO: 325261 - DNA, 25 bp, Homo sapien
tataaagcaataatatctctgtttt

SEQ ID NO: 325262 - DNA, 25 bp, Homo sapien
tctctgttttcatttcagaacattg

SEQ ID NO: 325263 - DNA, 25 bp, Homo sapien
ttttcatttcagaacattgtgctgt

SEQ ID NO: 325264 - DNA, 25 bp, Homo sapien
agctctatctggtgactcaaagttt

SEQ ID NO: 325265 - DNA, 25 bp, Homo sapien
gctctatctggtgactcaaagttta

SEQ ID NO: 325266 - DNA, 25 bp, Homo sapien
ctctatctggtgactcaaagtttat

SEQ ID NO: 325267 - DNA, 25 bp, Homo sapien
ctatctggtgactcaaagtttatgg

SEQ ID NO: 325268 - DNA, 25 bp, Homo sapien
atctggtgactcaaagtttatggat

SEQ ID NO: 325269 - DNA, 25 bp, Homo sapien
tctggtgactcaaagtttatggatc

SEQ ID NO: 325270 - DNA, 25 bp, Homo sapien
ctggtgactcaaagtttatggatct

SEQ ID NO: 325271 - DNA, 25 bp, Homo sapien
tggtgactcaaagtttatggatctt

SEQ ID NO: 325272 - DNA, 25 bp, Homo sapien
gtgactcaaagtttatggatctttt

SEQ ID NO: 325273 - DNA, 25 bp, Homo sapien
caaagtttatggatcttttggccgg

SEQ ID NO: 325274 - DNA, 25 bp, Homo sapien
agtttatggatcttttggccgggcg

SEQ ID NO: 325275 - DNA, 25 bp, Homo sapien
gtggatatggtaatggatgtgtttc

SEQ ID NO: 325276 - DNA, 25 bp, Homo sapien
ggatgtgtttcttgaattgtggtaa

SEQ ID NO: 325277 - DNA, 25 bp, Homo sapien
ggtaaatgtacctcataaaatggat

SEQ ID NO: 325278 - DNA, 25 bp, Homo sapien
gggctatattctcaggcttcctggg

SEQ ID NO: 325279 - DNA, 25 bp, Homo sapien
tatattctcaggcttcctgggctct

SEQ ID NO: 325280 - DNA, 25 bp, Homo sapien
cctgggctctgttggcattgggcaa

SEQ ID NO: 325281 - DNA, 25 bp, Homo sapien
ctctgttggcattgggcaagcacgt

SEQ ID NO: 325282 - DNA, 25 bp, Homo sapien
gcaagcacgtaatgcctggtttgag

SEQ ID NO: 325283 - DNA, 25 bp, Homo sapien
cctggtttgaggctagaagccaaag

SEQ ID NO: 325284 - DNA, 25 bp, Homo sapien
gaagccaaagccacaaccttcttgc

SEQ ID NO: 325285 - DNA, 25 bp, Homo sapien
agccacaaccttcttgcagtaccaa

SEQ ID NO: 325286 - DNA, 25 bp, Homo sapien
gctagttgcttattaatttcactct

SEQ ID NO: 325287 - DNA, 25 bp, Homo sapien
atttccattgcctaatgctcaacag

SEQ ID NO: 325288 - DNA, 25 bp, Homo sapien
cacattcacagatcgggtgctacca

SEQ ID NO: 325289 - DNA, 25 bp, Homo sapien
caggtaaaggtggagatgtctttct

SEQ ID NO: 325290 - DNA, 25 bp, Homo sapien
tctttctttctcagcgtaggaacca

SEQ ID NO: 325291 - DNA, 25 bp, Homo sapien
aatgctcaacagtgcttccagaaca

SEQ ID NO: 325292 - DNA, 25 bp, Homo sapien
ctcagcgtaggaaccaggagttcta

SEQ ID NO: 325293 - DNA, 25 bp, Homo sapien
gagttctagttccatgggttaccag

SEQ ID NO: 325294 - DNA, 25 bp, Homo sapien
tccatgggttaccagcatgcccttg

SEQ ID NO: 325295 - DNA, 25 bp, Homo sapien
cagtgcttccagaacaatagtgtga

SEQ ID NO: 325296 - DNA, 25 bp, Homo sapien
atagtgtgagaagcaccgctgcctt

SEQ ID NO: 325297 - DNA, 25 bp, Homo sapien
gtcctggagatggatcctatttaca

SEQ ID NO: 325298 - DNA, 25 bp, Homo sapien
aactacactaatacacctcctgtaa

SEQ ID NO: 325299 - DNA, 25 bp, Homo sapien
taattgatgtgccatccaccggagc

SEQ ID NO: 325300 - DNA, 25 bp, Homo sapien
ggagccccttcaaaaaagtctgttg

SEQ ID NO: 325301 - DNA, 25 bp, Homo sapien
aagtctgttgccagaatcggccaaa

SEQ ID NO: 325302 - DNA, 25 bp, Homo sapien
ggaacaaagtctgtcttctcacaga

SEQ ID NO: 325303 - DNA, 25 bp, Homo sapien
gaggtaactccaattcttgcacaaa

SEQ ID NO: 325304 - DNA, 25 bp, Homo sapien
ttctggtccacaaacaagtacaaca

SEQ ID NO: 325305 - DNA, 25 bp, Homo sapien
ggtattgagccccactattacatct

SEQ ID NO: 325306 - DNA, 25 bp, Homo sapien
gaagaagttcacgactctttactag

SEQ ID NO: 325307 - DNA, 25 bp, Homo sapien
gactctttactagtgacagctccac

SEQ ID NO: 325308 - DNA, 25 bp, Homo sapien
tctactctaggaagatggcccacct

SEQ ID NO: 325309 - DNA, 25 bp, Homo sapien
atggcccacctggatgatggttcca

SEQ ID NO: 325310 - DNA, 25 bp, Homo sapien
gccagctcccttattgctttgcttt

SEQ ID NO: 325311 - DNA, 25 bp, Homo sapien
gggaactgatcacaaagagcctttt

SEQ ID NO: 325312 - DNA, 25 bp, Homo sapien
gggtgatggaaagctacccctccat

SEQ ID NO: 325313 - DNA, 25 bp, Homo sapien
aagatgacacttggctaaatgctca

SEQ ID NO: 325314 - DNA, 25 bp, Homo sapien
cacttggctaaatgctcagggtatt

SEQ ID NO: 325315 - DNA, 25 bp, Homo sapien
ataaactatcaacttgttactgtta

SEQ ID NO: 325316 - DNA, 25 bp, Homo sapien
atccagtgatttctcaaagagcact

SEQ ID NO: 325317 - DNA, 25 bp, Homo sapien
aaagagcactctttgctagcttctt

SEQ ID NO: 325318 - DNA, 25 bp, Homo sapien
tctttgctagcttcttcctaaacaa

SEQ ID NO: 325319 - DNA, 25 bp, Homo sapien
tttcctcttattcaagccatgcacc

SEQ ID NO: 325320 - DNA, 25 bp, Homo sapien
ttcctcttattcaagccatgcaccc

SEQ ID NO: 325321 - DNA, 25 bp, Homo sapien
tcttattcaagccatgcaccctact

SEQ ID NO: 325322 - DNA, 25 bp, Homo sapien
ttattcaagccatgcaccctactct

SEQ ID NO: 325323 - DNA, 25 bp, Homo sapien
attcaagccatgcaccctactcttg

SEQ ID NO: 325324 - DNA, 25 bp, Homo sapien
ttcaagccatgcaccctactcttgc

SEQ ID NO: 325325 - DNA, 25 bp, Homo sapien
tgttgttggagattgataattcaga

SEQ ID NO: 325326 - DNA, 25 bp, Homo sapien
ttgttggagattgataattcagaac

SEQ ID NO: 325327 - DNA, 25 bp, Homo sapien
tgttggagattgataattcagaact

SEQ ID NO: 325328 - DNA, 25 bp, Homo sapien
gttggagattgataattcagaactt

SEQ ID NO: 325329 - DNA, 25 bp, Homo sapien
ttggagattgataattcagaacttc

SEQ ID NO: 325330 - DNA, 25 bp, Homo sapien
aattcaaggcactaagacaaccagg

SEQ ID NO: 325331 - DNA, 25 bp, Homo sapien
gacaaccaggaacagttttaccaag

SEQ ID NO: 325332 - DNA, 25 bp, Homo sapien
aggcaagtggaagctgctaggctca

SEQ ID NO: 325333 - DNA, 25 bp, Homo sapien
aagctgctaggctcagtggttgcat

SEQ ID NO: 325334 - DNA, 25 bp, Homo sapien
gctcagtggttgcatgcctatagat

SEQ ID NO: 325335 - DNA, 25 bp, Homo sapien
gggtaaatcatcctggtgcaaatat

SEQ ID NO: 325336 - DNA, 25 bp, Homo sapien
atgtgtagtgcaagtttcctctgtg

SEQ ID NO: 325337 - DNA, 25 bp, Homo sapien
agctgaagccccagtttagcttatt

SEQ ID NO: 325338 - DNA, 25 bp, Homo sapien
cccagtttagcttattctccataca

SEQ ID NO: 325339 - DNA, 25 bp, Homo sapien
aaatttgcagtttggctagactttg

SEQ ID NO: 325340 - DNA, 25 bp, Homo sapien
ggctagactttgtgactggatgtac

SEQ ID NO: 325341 - DNA, 25 bp, Homo sapien
aggactgtggcgtgtccccacgtta

SEQ ID NO: 325342 - DNA, 25 bp, Homo sapien
gagcctgtcctgaaaatatagttat

SEQ ID NO: 325343 - DNA, 25 bp, Homo sapien
tttactactctttacctagcaaagg

SEQ ID NO: 325344 - DNA, 25 bp, Homo sapien
tctttacctagcaaagggtgggcat

SEQ ID NO: 325345 - DNA, 25 bp, Homo sapien
agggtgggcatgagaaacctggtca

SEQ ID NO: 325346 - DNA, 25 bp, Homo sapien
gaagagaaagccattttgcaacagt

SEQ ID NO: 325347 - DNA, 25 bp, Homo sapien
gagagtaaaatttcctggttcctgg

SEQ ID NO: 325348 - DNA, 25 bp, Homo sapien
ggaagctaagcccattggtaggacc

SEQ ID NO: 325349 - DNA, 25 bp, Homo sapien
agctaagcccattggtaggaccaga

SEQ ID NO: 325350 - DNA, 25 bp, Homo sapien
agcccattggtaggaccagactttt

SEQ ID NO: 325351 - DNA, 25 bp, Homo sapien
attggtaggaccagacttttgtatg

SEQ ID NO: 325352 - DNA, 25 bp, Homo sapien
attttttaagcactgcctgccagag

SEQ ID NO: 325353 - DNA, 25 bp, Homo sapien
tgatgaggaccttagcgctgctcgt

SEQ ID NO: 325354 - DNA, 25 bp, Homo sapien
tgctcgttctccttttctgttcatg

SEQ ID NO: 325355 - DNA, 25 bp, Homo sapien
ttttctgttcatgcacacattcctc

SEQ ID NO: 325356 - DNA, 25 bp, Homo sapien
gttcatgcacacattcctccatggg

SEQ ID NO: 325357 - DNA, 25 bp, Homo sapien
tggccctcggagaagttaggagtcc

SEQ ID NO: 325358 - DNA, 25 bp, Homo sapien
ccccagctcaagatacagtggcaaa

SEQ ID NO: 325359 - DNA, 25 bp, Homo sapien
gtggcaaagacctagtggtccccta

SEQ ID NO: 325360 - DNA, 25 bp, Homo sapien
ttctctcagttcctggcatgaggag

SEQ ID NO: 325361 - DNA, 25 bp, Homo sapien
agagaagaccctgctctggtggagc

SEQ ID NO: 325362 - DNA, 25 bp, Homo sapien
ctctggtggagctgacaacctttga

SEQ ID NO: 325363 - DNA, 25 bp, Homo sapien
aacagtggtgctgacacaggaccta

SEQ ID NO: 325364 - DNA, 25 bp, Homo sapien
tgacacaggacctagggtagggcct

SEQ ID NO: 325365 - DNA, 25 bp, Homo sapien
cacaagtgagaaaccctagatgggc

SEQ ID NO: 325366 - DNA, 25 bp, Homo sapien
tagatgggcactgccacctgacaca

SEQ ID NO: 325367 - DNA, 25 bp, Homo sapien
tgccacctgacacagctatacagca

SEQ ID NO: 325368 - DNA, 25 bp, Homo sapien
gacacagctatacagcaggacctga

SEQ ID NO: 325369 - DNA, 25 bp, Homo sapien
ggatcacactgcatcctaggacaaa

SEQ ID NO: 325370 - DNA, 25 bp, Homo sapien
gcatcctaggacaaagctcaaaagt

SEQ ID NO: 325371 - DNA, 25 bp, Homo sapien
actgatcagcgcatgtgtgtaagga

SEQ ID NO: 325372 - DNA, 25 bp, Homo sapien
gtgtgtaaggaaccacctcaggcca

SEQ ID NO: 325373 - DNA, 25 bp, Homo sapien
gtaaggaaccacctcaggccagaga

SEQ ID NO: 325374 - DNA, 25 bp, Homo sapien
aatagggaccgcagcagggaccgca

SEQ ID NO: 325375 - DNA, 25 bp, Homo sapien
atagggaccgcagcagggaccgcag

SEQ ID NO: 325376 - DNA, 25 bp, Homo sapien
tagggaccgcagcagggaccgcagc

SEQ ID NO: 325377 - DNA, 25 bp, Homo sapien
agggaccgcagcagggaccgcagcc

SEQ ID NO: 325378 - DNA, 25 bp, Homo sapien
gggaccgcagcagggaccgcagccg

SEQ ID NO: 325379 - DNA, 25 bp, Homo sapien
ggaccgcagcagggaccgcagccgg

SEQ ID NO: 325380 - DNA, 25 bp, Homo sapien
gaccgcagcagggaccgcagccggg

SEQ ID NO: 325381 - DNA, 25 bp, Homo sapien
accgcagcagggaccgcagccgggg

SEQ ID NO: 325382 - DNA, 25 bp, Homo sapien
caaattgtttacctcagagttgggt

SEQ ID NO: 325383 - DNA, 25 bp, Homo sapien
ttgtttacctcagagttgggtgtca

SEQ ID NO: 325384 - DNA, 25 bp, Homo sapien
acagaacatgttgaaggagaccctt

SEQ ID NO: 325385 - DNA, 25 bp, Homo sapien
gaaggagacccttgcaaatttgcac

SEQ ID NO: 325386 - DNA, 25 bp, Homo sapien
gagacccttgcaaatttgcactgtg

SEQ ID NO: 325387 - DNA, 25 bp, Homo sapien
ccttgcaaatttgcactgtgggtgg

SEQ ID NO: 325388 - DNA, 25 bp, Homo sapien
gggagaacaccaacttcagataata

SEQ ID NO: 325389 - DNA, 25 bp, Homo sapien
ttgtccttaaggcttccagcataga

SEQ ID NO: 325390 - DNA, 25 bp, Homo sapien
tccttaaggcttccagcatagagaa

SEQ ID NO: 325391 - DNA, 25 bp, Homo sapien
caagcaggactggataaagcatatc

SEQ ID NO: 325392 - DNA, 25 bp, Homo sapien
ctggataaagcatatccgcgaagtc

SEQ ID NO: 325393 - DNA, 25 bp, Homo sapien
gcatcacaacagcaggccgcacgga

SEQ ID NO: 325394 - DNA, 25 bp, Homo sapien
gcacgggcagcactgtgacaatcat

SEQ ID NO: 325395 - DNA, 25 bp, Homo sapien
aatcatcgactctggccgtgcatag

SEQ ID NO: 325396 - DNA, 25 bp, Homo sapien
gggctcgatgcccagcacaaaacac

SEQ ID NO: 325397 - DNA, 25 bp, Homo sapien
aaaacactcctcatctgagatgcgt

SEQ ID NO: 325398 - DNA, 25 bp, Homo sapien
gtttgaagatctcatgcactcgctc

SEQ ID NO: 325399 - DNA, 25 bp, Homo sapien
gcactcgctctggactcagcaggat

SEQ ID NO: 325400 - DNA, 25 bp, Homo sapien
agcaggatcttcttctcctgagagt

SEQ ID NO: 325401 - DNA, 25 bp, Homo sapien
agagtcctcattaacgtgcttccat

SEQ ID NO: 325402 - DNA, 25 bp, Homo sapien
gctaagaggcagagccctggagcca

SEQ ID NO: 325403 - DNA, 25 bp, Homo sapien
gagccactgacctggttacgggcag

SEQ ID NO: 325404 - DNA, 25 bp, Homo sapien
aatatatttttaatctactacttca

SEQ ID NO: 325405 - DNA, 25 bp, Homo sapien
tatgaattttagacttccttataaa

SEQ ID NO: 325406 - DNA, 25 bp, Homo sapien
gtattgagaattgattgtgtcattt

SEQ ID NO: 325407 - DNA, 25 bp, Homo sapien
aaatacaaagtaccttggcctatag

SEQ ID NO: 325408 - DNA, 25 bp, Homo sapien
acaaagtaccttggcctatagtgga

SEQ ID NO: 325409 - DNA, 25 bp, Homo sapien
gtaccttggcctatagtggatgctt

SEQ ID NO: 325410 - DNA, 25 bp, Homo sapien
accttggcctatagtggatgcttat

SEQ ID NO: 325411 - DNA, 25 bp, Homo sapien
tggcctatagtggatgcttatgcct

SEQ ID NO: 325412 - DNA, 25 bp, Homo sapien
ctatagtggatgcttatgcctgtaa

SEQ ID NO: 325413 - DNA, 25 bp, Homo sapien
ggaagatctcttgaggtaagaattt

SEQ ID NO: 325414 - DNA, 25 bp, Homo sapien
tgattgtgtcatttaggacaagtca

SEQ ID NO: 325415 - DNA, 25 bp, Homo sapien
gagactttgccttgtcagttgtttt

SEQ ID NO: 325416 - DNA, 25 bp, Homo sapien
tttgccttgtcagttgttttcttca

SEQ ID NO: 325417 - DNA, 25 bp, Homo sapien
cttcatatttaactcttccttcact

SEQ ID NO: 325418 - DNA, 25 bp, Homo sapien
atatttaactcttccttcactccaa

SEQ ID NO: 325419 - DNA, 25 bp, Homo sapien
tcttccttcactccaacttaggaat

SEQ ID NO: 325420 - DNA, 25 bp, Homo sapien
tagaggcaaggcctcgctttgttgc

SEQ ID NO: 325421 - DNA, 25 bp, Homo sapien
acttaggaatgtactcagatctctc

SEQ ID NO: 325422 - DNA, 25 bp, Homo sapien
ggaatgtactcagatctctcctctc

SEQ ID NO: 325423 - DNA, 25 bp, Homo sapien
caagcttctgctcgaataccttttt

SEQ ID NO: 325424 - DNA, 25 bp, Homo sapien
gctcgaatacctttttctaccaaga

SEQ ID NO: 325425 - DNA, 25 bp, Homo sapien
tacctttttctaccaagattactga

SEQ ID NO: 325426 - DNA, 25 bp, Homo sapien
gtgtggcctcagatggtaaagtcag

SEQ ID NO: 325427 - DNA, 25 bp, Homo sapien
ggtaaagtcagcagcctttcttatt

SEQ ID NO: 325428 - DNA, 25 bp, Homo sapien
acccctgccattgagatgtctgtag

SEQ ID NO: 325429 - DNA, 25 bp, Homo sapien
gatgtctgtagtctttctttgctgc

SEQ ID NO: 325430 - DNA, 25 bp, Homo sapien
tttctttgctgcactgagtactcag

SEQ ID NO: 325431 - DNA, 25 bp, Homo sapien
gagtactcagaaagtgccgtcgatg

SEQ ID NO: 325432 - DNA, 25 bp, Homo sapien
aaagtgccgtcgatggtgatccagc

SEQ ID NO: 325433 - DNA, 25 bp, Homo sapien
gtgatccagccctgtgtcactgagg

SEQ ID NO: 325434 - DNA, 25 bp, Homo sapien
tgaggagactcacagcggactagct

SEQ ID NO: 325435 - DNA, 25 bp, Homo sapien
cggactagctcttcacttatttatc

SEQ ID NO: 325436 - DNA, 25 bp, Homo sapien
gtgttgtaattcctctgtatcatca

SEQ ID NO: 325437 - DNA, 25 bp, Homo sapien
ccagcattcttgatggagtctatga

SEQ ID NO: 325438 - DNA, 25 bp, Homo sapien
agtctatgaagtcaatggcctcgtt

SEQ ID NO: 325439 - DNA, 25 bp, Homo sapien
tggcctcgttgaaccaggagctgat

SEQ ID NO: 325440 - DNA, 25 bp, Homo sapien
tgatgtctgccttgtggttgtcctc

SEQ ID NO: 325441 - DNA, 25 bp, Homo sapien
ttgtcctccacagggatgctcttgt

SEQ ID NO: 325442 - DNA, 25 bp, Homo sapien
atgctcttgtactggtagtgaccct

SEQ ID NO: 325443 - DNA, 25 bp, Homo sapien
gacaattggctgagacgttgatcaa

SEQ ID NO: 325444 - DNA, 25 bp, Homo sapien
tcaaggcagttatgcccaaggcatc

SEQ ID NO: 325445 - DNA, 25 bp, Homo sapien
aaggcatccagcatgtccttgcggg

SEQ ID NO: 325446 - DNA, 25 bp, Homo sapien
atgtccttgcgggaagcgtgatacg

SEQ ID NO: 325447 - DNA, 25 bp, Homo sapien
gtgatacgcactgcccaggtacaga

SEQ ID NO: 325448 - DNA, 25 bp, Homo sapien
tttagctgctaacaagactggctct

SEQ ID NO: 325449 - DNA, 25 bp, Homo sapien
gctgctaacaagactggctctttta

SEQ ID NO: 325450 - DNA, 25 bp, Homo sapien
aagactggctcttttaccagtatga

SEQ ID NO: 325451 - DNA, 25 bp, Homo sapien
ggctcttttaccagtatgaatgaca

SEQ ID NO: 325452 - DNA, 25 bp, Homo sapien
tctttaatctccctttgttggaaag

SEQ ID NO: 325453 - DNA, 25 bp, Homo sapien
tctccctttgttggaaagtatcatg

SEQ ID NO: 325454 - DNA, 25 bp, Homo sapien
gatgaaccagagtttcttggttgct

SEQ ID NO: 325455 - DNA, 25 bp, Homo sapien
ccagagtttcttggttgctttttca

SEQ ID NO: 325456 - DNA, 25 bp, Homo sapien
gataaacagagtaactgaccttcat

SEQ ID NO: 325457 - DNA, 25 bp, Homo sapien
tggtgtttgcaagtgccagatggaa

SEQ ID NO: 325458 - DNA, 25 bp, Homo sapien
gtttgcaagtgccagatggaacaat

SEQ ID NO: 325459 - DNA, 25 bp, Homo sapien
acagcctctcagtcttactatttaa

SEQ ID NO: 325460 - DNA, 25 bp, Homo sapien
ggttttgtgactctgaatcccatgt

SEQ ID NO: 325461 - DNA, 25 bp, Homo sapien
aatcccatgttctcaaactacgctg

SEQ ID NO: 325462 - DNA, 25 bp, Homo sapien
ccttccgaagtctggcatttgttag

SEQ ID NO: 325463 - DNA, 25 bp, Homo sapien
atttgttagctcatgcttccttgta

SEQ ID NO: 325464 - DNA, 25 bp, Homo sapien
gcttccttgtagtccagcttcttat

SEQ ID NO: 325465 - DNA, 25 bp, Homo sapien
tcttatgtgcctgttatattctcca

SEQ ID NO: 325466 - DNA, 25 bp, Homo sapien
tctccagtaagattgtaagcccctt

SEQ ID NO: 325467 - DNA, 25 bp, Homo sapien
aagggcagggacgtctttgcatctc

SEQ ID NO: 325468 - DNA, 25 bp, Homo sapien
tttgcatctctagcactgctatagt

SEQ ID NO: 325469 - DNA, 25 bp, Homo sapien
actgctatagtgttctatccttagt

SEQ ID NO: 325470 - DNA, 25 bp, Homo sapien
tgatgagccctcctcttcagctagg

SEQ ID NO: 325471 - DNA, 25 bp, Homo sapien
ttcagctaggaaaatgacggtgttc

SEQ ID NO: 325472 - DNA, 25 bp, Homo sapien
gttaaaacttcttcgctggaaggat

SEQ ID NO: 325473 - DNA, 25 bp, Homo sapien
ggaagagcattcaccacatgtgttc

SEQ ID NO: 325474 - DNA, 25 bp, Homo sapien
acatgtgttctgttttgggttgaca

SEQ ID NO: 325475 - DNA, 25 bp, Homo sapien
ttgggttgacatttagcttttgttt

SEQ ID NO: 325476 - DNA, 25 bp, Homo sapien
ggaagactctggtagcagtccttga

SEQ ID NO: 325477 - DNA, 25 bp, Homo sapien
gcagtccttgaaatcttgatgccat

SEQ ID NO: 325478 - DNA, 25 bp, Homo sapien
atcttgatgccattgctattttctg

SEQ ID NO: 325479 - DNA, 25 bp, Homo sapien
gtatcttcgttttagtagtgctcca

SEQ ID NO: 325480 - DNA, 25 bp, Homo sapien
tagtgctccaataaaaagacctgct

SEQ ID NO: 325481 - DNA, 25 bp, Homo sapien
ggaaatgtctagacctccattcttg

SEQ ID NO: 325482 - DNA, 25 bp, Homo sapien
aatgtctagacctccattcttggat

SEQ ID NO: 325483 - DNA, 25 bp, Homo sapien
tagacctccattcttggattccctt

SEQ ID NO: 325484 - DNA, 25 bp, Homo sapien
agaacagtacccctcttttaagatg

SEQ ID NO: 325485 - DNA, 25 bp, Homo sapien
acagtacccctcttttaagatgctg

SEQ ID NO: 325486 - DNA, 25 bp, Homo sapien
gaaggtatgagttgcactgaggatt

SEQ ID NO: 325487 - DNA, 25 bp, Homo sapien
ctgaggattagaatagtggtgcgtt

SEQ ID NO: 325488 - DNA, 25 bp, Homo sapien
gtggtgcgttagtggcattatctat

SEQ ID NO: 325489 - DNA, 25 bp, Homo sapien
gtggcattatctataaatacactca

SEQ ID NO: 325490 - DNA, 25 bp, Homo sapien
aatacactcacctaaattgaaagct

SEQ ID NO: 325491 - DNA, 25 bp, Homo sapien
ctgcagattctaataaacaaggact

SEQ ID NO: 325492 - DNA, 25 bp, Homo sapien
gcctggggaacacatcctgtctcta

SEQ ID NO: 325493 - DNA, 25 bp, Homo sapien
cctggggaacacatcctgtctctac

SEQ ID NO: 325494 - DNA, 25 bp, Homo sapien
tggggaacacatcctgtctctacaa

SEQ ID NO: 325495 - DNA, 25 bp, Homo sapien
agaattttttgagcccaggatgcag

SEQ ID NO: 325496 - DNA, 25 bp, Homo sapien
attttttgagcccaggatgcagagg

SEQ ID NO: 325497 - DNA, 25 bp, Homo sapien
agaacgtgggaaatatgaacctttg

SEQ ID NO: 325498 - DNA, 25 bp, Homo sapien
gaacgtgggaaatatgaacctttga

SEQ ID NO: 325499 - DNA, 25 bp, Homo sapien
gaacctttgaaagttaatctgtgaa

SEQ ID NO: 325500 - DNA, 25 bp, Homo sapien
acctttgaaagttaatctgtgaatt

SEQ ID NO: 325501 - DNA, 25 bp, Homo sapien
agttaatctgtgaattgaaagttta

SEQ ID NO: 325502 - DNA, 25 bp, Homo sapien
taatctgtgaattgaaagtttaaca

SEQ ID NO: 325503 - DNA, 25 bp, Homo sapien
cacattgtttttcctgcctttttat

SEQ ID NO: 325504 - DNA, 25 bp, Homo sapien
cattgtttttcctgcctttttatgg

SEQ ID NO: 325505 - DNA, 25 bp, Homo sapien
gcctttttatggctgtctaaagtct

SEQ ID NO: 325506 - DNA, 25 bp, Homo sapien
tatggctgtctaaagtctagggaaa

SEQ ID NO: 325507 - DNA, 25 bp, Homo sapien
cttgtaagctaatcattcactgact

SEQ ID NO: 325508 - DNA, 25 bp, Homo sapien
aagctaatcattcactgacttattt

SEQ ID NO: 325509 - DNA, 25 bp, Homo sapien
gaaaattgtgtcagtgctcttagtt

SEQ ID NO: 325510 - DNA, 25 bp, Homo sapien
gtgtcagtgctcttagttattttca

SEQ ID NO: 325511 - DNA, 25 bp, Homo sapien
agtgctcttagttattttcatctta

SEQ ID NO: 325512 - DNA, 25 bp, Homo sapien
agacattgacttgagatgatactaa

SEQ ID NO: 325513 - DNA, 25 bp, Homo sapien
gatactaaggaagctttggctcact

SEQ ID NO: 325514 - DNA, 25 bp, Homo sapien
agcttttatctcagaaccccatggg

SEQ ID NO: 325515 - DNA, 25 bp, Homo sapien
ccatgggttccagaccaagagtaca

SEQ ID NO: 325516 - DNA, 25 bp, Homo sapien
caaattgttgtcctgtctgtctata

SEQ ID NO: 325517 - DNA, 25 bp, Homo sapien
tcctgtctgtctatagcttggaaca

SEQ ID NO: 325518 - DNA, 25 bp, Homo sapien
gctttgattactgactccggttcca

SEQ ID NO: 325519 - DNA, 25 bp, Homo sapien
actccggttccacacactgtaagat

SEQ ID NO: 325520 - DNA, 25 bp, Homo sapien
ttcatagggatggtggctcaacaaa

SEQ ID NO: 325521 - DNA, 25 bp, Homo sapien
aaatcaagcaaactggaatcaaggg

SEQ ID NO: 325522 - DNA, 25 bp, Homo sapien
aagggaggctgattcccttcccctg

SEQ ID NO: 325523 - DNA, 25 bp, Homo sapien
taaagccagtgctctaagacctcag

SEQ ID NO: 325524 - DNA, 25 bp, Homo sapien
gtgctctaagacctcagcttttatc

SEQ ID NO: 325525 - DNA, 25 bp, Homo sapien
aaatgtttccctttgcaactcatgc

SEQ ID NO: 325526 - DNA, 25 bp, Homo sapien
gcaactcatgctttgtgttttgttt

SEQ ID NO: 325527 - DNA, 25 bp, Homo sapien
tgttttgatgacctactcgctcgta

SEQ ID NO: 325528 - DNA, 25 bp, Homo sapien
actcgctcgtaatgttttgtaaggc

SEQ ID NO: 325529 - DNA, 25 bp, Homo sapien
gaagacagatgcatcatcctggcct

SEQ ID NO: 325530 - DNA, 25 bp, Homo sapien
ctggcctccatcaaataacactatc

SEQ ID NO: 325531 - DNA, 25 bp, Homo sapien
taacactatccaaggtggcacctct

SEQ ID NO: 325532 - DNA, 25 bp, Homo sapien
aaggtggcacctcttctgcaatgtt

SEQ ID NO: 325533 - DNA, 25 bp, Homo sapien
aatgtttaaccctgctgttgtccat

SEQ ID NO: 325534 - DNA, 25 bp, Homo sapien
tttgcttcatgagtgcaggaaccat

SEQ ID NO: 325535 - DNA, 25 bp, Homo sapien
tgggtccacctagcctgtaagtgcc

SEQ ID NO: 325536 - DNA, 25 bp, Homo sapien
tggaggtaatgggactatcactgag

SEQ ID NO: 325537 - DNA, 25 bp, Homo sapien
gggttcagcctatccaggtaggcta

SEQ ID NO: 325538 - DNA, 25 bp, Homo sapien
aggtaggctaccgttctagtcatac

SEQ ID NO: 325539 - DNA, 25 bp, Homo sapien
gttctagtcatacccatcacttaaa

SEQ ID NO: 325540 - DNA, 25 bp, Homo sapien
atcacttaaattctgccacagtctg

SEQ ID NO: 325541 - DNA, 25 bp, Homo sapien
gccacagtctgcacagacggttggt

SEQ ID NO: 325542 - DNA, 25 bp, Homo sapien
agacggttggtcctccaggcatatt

SEQ ID NO: 325543 - DNA, 25 bp, Homo sapien
caggcatattgtcctattaagccaa

SEQ ID NO: 325544 - DNA, 25 bp, Homo sapien
gccaaataggtggacatcatgggat

SEQ ID NO: 325545 - DNA, 25 bp, Homo sapien
tgcatggtgggcttgagactctctt

SEQ ID NO: 325546 - DNA, 25 bp, Homo sapien
gagactctcttgtaatggaggtaat

SEQ ID NO: 325547 - DNA, 25 bp, Homo sapien
gagccaaaccatataaggcacactt

SEQ ID NO: 325548 - DNA, 25 bp, Homo sapien
aaggcacacttatctctaacattag

SEQ ID NO: 325549 - DNA, 25 bp, Homo sapien
cattaggtagagttcatacatttct

SEQ ID NO: 325550 - DNA, 25 bp, Homo sapien
atacatttctttctctcagcaatgg

SEQ ID NO: 325551 - DNA, 25 bp, Homo sapien
tttctctcagcaatggacaatggat

SEQ ID NO: 325552 - DNA, 25 bp, Homo sapien
gattgctgcaatgctaaccagctaa

SEQ ID NO: 325553 - DNA, 25 bp, Homo sapien
ggatgagagtccaggcaattgccta

SEQ ID NO: 325554 - DNA, 25 bp, Homo sapien
aggcaattgcctaatgagccccgct

SEQ ID NO: 325555 - DNA, 25 bp, Homo sapien
gagccccgctatacatatttgcaaa

SEQ ID NO: 325556 - DNA, 25 bp, Homo sapien
catgatccgattacttccacctggt

SEQ ID NO: 325557 - DNA, 25 bp, Homo sapien
atccgattacttccacctggtcttg

SEQ ID NO: 325558 - DNA, 25 bp, Homo sapien
atccctgaagtctggaattgctgaa

SEQ ID NO: 325559 - DNA, 25 bp, Homo sapien
taatcctagccaaatctgtttacag

SEQ ID NO: 325560 - DNA, 25 bp, Homo sapien
gtttacagacttcatttccatgttt

SEQ ID NO: 325561 - DNA, 25 bp, Homo sapien
atttcctgttgtgtgaatgttgtca

SEQ ID NO: 325562 - DNA, 25 bp, Homo sapien
acgactttggcttgttctggcggga

SEQ ID NO: 325563 - DNA, 25 bp, Homo sapien
tggagatagatttcaccctgtgtgg

SEQ ID NO: 325564 - DNA, 25 bp, Homo sapien
gtggatttaatcctcgcaggctgcc

SEQ ID NO: 325565 - DNA, 25 bp, Homo sapien
ctgccggagcaggaggtacacacga

SEQ ID NO: 325566 - DNA, 25 bp, Homo sapien
aggagccgaccgtcatgttaacgta

SEQ ID NO: 325567 - DNA, 25 bp, Homo sapien
ggcgggacataccatcttttctttt

SEQ ID NO: 325568 - DNA, 25 bp, Homo sapien
ctttcactttttgtggatccctgaa

SEQ ID NO: 325569 - DNA, 25 bp, Homo sapien
agaacattgtgctgtctgtcagcat

SEQ ID NO: 325570 - DNA, 25 bp, Homo sapien
aacattgtgctgtctgtcagcatat

SEQ ID NO: 325571 - DNA, 25 bp, Homo sapien
attgtgctgtctgtcagcatatgta

SEQ ID NO: 325572 - DNA, 25 bp, Homo sapien
gctgtctgtcagcatatgtatatca

SEQ ID NO: 325573 - DNA, 25 bp, Homo sapien
gtctgtcagcatatgtatatcagct

SEQ ID NO: 325574 - DNA, 25 bp, Homo sapien
gtcagcatatgtatatcagctacaa

SEQ ID NO: 325575 - DNA, 25 bp, Homo sapien
gcatatgtatatcagctacaaaata

SEQ ID NO: 325576 - DNA, 25 bp, Homo sapien
atatattcaactttgacttcttttg

SEQ ID NO: 325577 - DNA, 25 bp, Homo sapien
tttttaatatgactgtgaccttgac

SEQ ID NO: 325578 - DNA, 25 bp, Homo sapien
tttaatatgactgtgaccttgactg

SEQ ID NO: 325579 - DNA, 25 bp, Homo sapien
taatatgactgtgaccttgactgat

SEQ ID NO: 325580 - DNA, 25 bp, Homo sapien
ggaagcagacttctaaaaataatat

SEQ ID NO: 325581 - DNA, 25 bp, Homo sapien
tgaaaagaagaagcccaaatttaga

SEQ ID NO: 325582 - DNA, 25 bp, Homo sapien
tattctgatgatgccttatcaaagg

SEQ ID NO: 325583 - DNA, 25 bp, Homo sapien
gatgatgccttatcaaaggagaaca

SEQ ID NO: 325584 - DNA, 25 bp, Homo sapien
gtctgtgagacggaagttttactaa

SEQ ID NO: 325585 - DNA, 25 bp, Homo sapien
agttttactaaaagagctggagcaa

SEQ ID NO: 325586 - DNA, 25 bp, Homo sapien
tgcagcaagcactgcaacccacagc

SEQ ID NO: 325587 - DNA, 25 bp, Homo sapien
ccacagccacacctgatgaatcaga

SEQ ID NO: 325588 - DNA, 25 bp, Homo sapien
gaaaagttatctaaatgcagcccag

SEQ ID NO: 325589 - DNA, 25 bp, Homo sapien
aaagttatctaaatgcagcccagaa

SEQ ID NO: 325590 - DNA, 25 bp, Homo sapien
tatctaaatgcagcccagaagctcc

SEQ ID NO: 325591 - DNA, 25 bp, Homo sapien
aaggacttcagtctgctgtacgagg

SEQ ID NO: 325592 - DNA, 25 bp, Homo sapien
ttcagtctgctgtacgaggaggcgc

SEQ ID NO: 325593 - DNA, 25 bp, Homo sapien
gctgtacgaggaggcgcgctactat

SEQ ID NO: 325594 - DNA, 25 bp, Homo sapien
ggaggcgcgctactatcagctccag

SEQ ID NO: 325595 - DNA, 25 bp, Homo sapien
agctccagcccatggtgcgcgagct

SEQ ID NO: 325596 - DNA, 25 bp, Homo sapien
actgcctggtggtgcgcgtcacgcc

SEQ ID NO: 325597 - DNA, 25 bp, Homo sapien
tggtggtgcgcgtcacgcccgactt

SEQ ID NO: 325598 - DNA, 25 bp, Homo sapien
ccgacttgggcgagcggatcgcact

SEQ ID NO: 325599 - DNA, 25 bp, Homo sapien
agcggatcgcactcagcggcgagaa

SEQ ID NO: 325600 - DNA, 25 bp, Homo sapien
ggagattttccgctacgtcctgagc

SEQ ID NO: 325601 - DNA, 25 bp, Homo sapien
tttccgctacgtcctgagcttcctg

SEQ ID NO: 325602 - DNA, 25 bp, Homo sapien
tctgccccgcgtggagagggataaa

SEQ ID NO: 325603 - DNA, 25 bp, Homo sapien
gaagcattggtccttgtcagcctct

SEQ ID NO: 325604 - DNA, 25 bp, Homo sapien
gagagggataaacagctcctctgaa

SEQ ID NO: 325605 - DNA, 25 bp, Homo sapien
gctcctctgaagtagctgcagacgg

SEQ ID NO: 325606 - DNA, 25 bp, Homo sapien
aagtagctgcagacggctcttccaa

SEQ ID NO: 325607 - DNA, 25 bp, Homo sapien
gagatcccaccgctgtatctttggg

SEQ ID NO: 325608 - DNA, 25 bp, Homo sapien
gtatctttgggtcgcatcaacagtc

SEQ ID NO: 325609 - DNA, 25 bp, Homo sapien
gtcgcatcaacagtccttctgcagg

SEQ ID NO: 325610 - DNA, 25 bp, Homo sapien
cagttagggctgcatccattttaaa

SEQ ID NO: 325611 - DNA, 25 bp, Homo sapien
agccatctctcggacgctaggagac

SEQ ID NO: 325612 - DNA, 25 bp, Homo sapien
ggacgctaggagacccgccagagtc

SEQ ID NO: 325613 - DNA, 25 bp, Homo sapien
acatgcacacaagtaatttagttct

SEQ ID NO: 325614 - DNA, 25 bp, Homo sapien
gcacacaagtaatttagttctattt

SEQ ID NO: 325615 - DNA, 25 bp, Homo sapien
tttaaagtcacagtgggaattcctt

SEQ ID NO: 325616 - DNA, 25 bp, Homo sapien
aagtcacagtgggaattccttagtg

SEQ ID NO: 325617 - DNA, 25 bp, Homo sapien
cacagtgggaattccttagtgagga

SEQ ID NO: 325618 - DNA, 25 bp, Homo sapien
gaacatctagatttattattttctc

SEQ ID NO: 325619 - DNA, 25 bp, Homo sapien
tctctattttacttcccaacttaca

SEQ ID NO: 325620 - DNA, 25 bp, Homo sapien
ctctattttacttcccaacttacag

SEQ ID NO: 325621 - DNA, 25 bp, Homo sapien
tattttacttcccaacttacagaat

SEQ ID NO: 325622 - DNA, 25 bp, Homo sapien
acttcccaacttacagaataaactg

SEQ ID NO: 325623 - DNA, 25 bp, Homo sapien
atacagacatatacatgcacacaag

SEQ ID NO: 325624 - DNA, 25 bp, Homo sapien
tacctcctacttcaaaagttaagcg

SEQ ID NO: 325625 - DNA, 25 bp, Homo sapien
ctacttcaaaagttaagcgcaattt

SEQ ID NO: 325626 - DNA, 25 bp, Homo sapien
agttaagcgcaattttgtgaagaca

SEQ ID NO: 325627 - DNA, 25 bp, Homo sapien
gacatgaaatcataagagtacttaa

SEQ ID NO: 325628 - DNA, 25 bp, Homo sapien
aaaagactgcatattaactctaaag

SEQ ID NO: 325629 - DNA, 25 bp, Homo sapien
gactgcatattaactctaaagaaaa

SEQ ID NO: 325630 - DNA, 25 bp, Homo sapien
ggtatttttatttctgcgagttgga

SEQ ID NO: 325631 - DNA, 25 bp, Homo sapien
ttttatttctgcgagttggatgtgg

SEQ ID NO: 325632 - DNA, 25 bp, Homo sapien
tatttctgcgagttggatgtggtaa

SEQ ID NO: 325633 - DNA, 25 bp, Homo sapien
tttctgcgagttggatgtggtaagt

SEQ ID NO: 325634 - DNA, 25 bp, Homo sapien
ggatgtggtaagtgaggagtgctca

SEQ ID NO: 325635 - DNA, 25 bp, Homo sapien
aatacacagtatcttcacccttgca

SEQ ID NO: 325636 - DNA, 25 bp, Homo sapien
cttgaattctagtttgcatacagta

SEQ ID NO: 325637 - DNA, 25 bp, Homo sapien
gccatatctacatttcttttgttag

SEQ ID NO: 325638 - DNA, 25 bp, Homo sapien
tttgttagccaagacctattttatt

SEQ ID NO: 325639 - DNA, 25 bp, Homo sapien
tcctgtttatttcaaccattggtgt

SEQ ID NO: 325640 - DNA, 25 bp, Homo sapien
gattgtcttctataacagcattaag

SEQ ID NO: 325641 - DNA, 25 bp, Homo sapien
gtgaattttataactctgcttttgc

SEQ ID NO: 325642 - DNA, 25 bp, Homo sapien
tataactctgcttttgctttaatca

SEQ ID NO: 325643 - DNA, 25 bp, Homo sapien
gaagccacttagcatcacagaggtt

SEQ ID NO: 325644 - DNA, 25 bp, Homo sapien
gcatcacagaggttcatggctatta

SEQ ID NO: 325645 - DNA, 25 bp, Homo sapien
ggctattatgctgtatcttctttat

SEQ ID NO: 325646 - DNA, 25 bp, Homo sapien
gaagtgctggtatcccacctcagtg

SEQ ID NO: 325647 - DNA, 25 bp, Homo sapien
atcccacctcagtgccagtgctata

SEQ ID NO: 325648 - DNA, 25 bp, Homo sapien
tcagtgccagtgctatacccaggcc

SEQ ID NO: 325649 - DNA, 25 bp, Homo sapien
tgccagtgctatacccaggcctcaa

SEQ ID NO: 325650 - DNA, 25 bp, Homo sapien
ctctctagcttcatgaacccagaca

SEQ ID NO: 325651 - DNA, 25 bp, Homo sapien
atgaacccagacaagatctcggctc

SEQ ID NO: 325652 - DNA, 25 bp, Homo sapien
atccgtccgtcgactcttctgtctt

SEQ ID NO: 325653 - DNA, 25 bp, Homo sapien
tctgtcttgctccaagctctgaagc

SEQ ID NO: 325654 - DNA, 25 bp, Homo sapien
ttgctccaagctctgaagccaatcc

SEQ ID NO: 325655 - DNA, 25 bp, Homo sapien
agactaaactctctaggggatcctg

SEQ ID NO: 325656 - DNA, 25 bp, Homo sapien
cttcctcgctacttcctaaaaagca

SEQ ID NO: 325657 - DNA, 25 bp, Homo sapien
gggcaatggagaaaccctgaaaaca

SEQ ID NO: 325658 - DNA, 25 bp, Homo sapien
tgaaaacacttaaggaaaacctgag

SEQ ID NO: 325659 - DNA, 25 bp, Homo sapien
ttaaggaaaacctgaggccttctat

SEQ ID NO: 325660 - DNA, 25 bp, Homo sapien
taaggaaaacctgaggccttctata

SEQ ID NO: 325661 - DNA, 25 bp, Homo sapien
tttataaatctctttcctgggtgga

SEQ ID NO: 325662 - DNA, 25 bp, Homo sapien
ttataaatctctttcctgggtggat

SEQ ID NO: 325663 - DNA, 25 bp, Homo sapien
tataaatctctttcctgggtggata

SEQ ID NO: 325664 - DNA, 25 bp, Homo sapien
ataaatctctttcctgggtggatat

SEQ ID NO: 325665 - DNA, 25 bp, Homo sapien
taaatctctttcctgggtggatatg

SEQ ID NO: 325666 - DNA, 25 bp, Homo sapien
tcggacaacccccattgcaatgagc

SEQ ID NO: 325667 - DNA, 25 bp, Homo sapien
cattgcaatgagctttgcacagttt

SEQ ID NO: 325668 - DNA, 25 bp, Homo sapien
aaatgtacatactgaagacttgctc

SEQ ID NO: 325669 - DNA, 25 bp, Homo sapien
gaagacttgctcagaaacccatcct

SEQ ID NO: 325670 - DNA, 25 bp, Homo sapien
gctcagaaacccatcctatattcaa

SEQ ID NO: 325671 - DNA, 25 bp, Homo sapien
aacccatcctatattcaagaggcaa

SEQ ID NO: 325672 - DNA, 25 bp, Homo sapien
gaggcaaaagctaagggactagtca

SEQ ID NO: 325673 - DNA, 25 bp, Homo sapien
aagggactagtcatattctgctggg

SEQ ID NO: 325674 - DNA, 25 bp, Homo sapien
gggtgatgataccaatgatcctgaa

SEQ ID NO: 325675 - DNA, 25 bp, Homo sapien
gataccaatgatcctgaaaacagaa

SEQ ID NO: 325676 - DNA, 25 bp, Homo sapien
ggagttaatggtctaatttatgata

SEQ ID NO: 325677 - DNA, 25 bp, Homo sapien
aattcagtgcatgctttaggtgtta

SEQ ID NO: 325678 - DNA, 25 bp, Homo sapien
acatgtttactgttaggtccttgca

SEQ ID NO: 325679 - DNA, 25 bp, Homo sapien
tactgttaggtccttgcatctgtgg

SEQ ID NO: 325680 - DNA, 25 bp, Homo sapien
tccttgcatctgtggtgctaggtga

SEQ ID NO: 325681 - DNA, 25 bp, Homo sapien
ggactggacgtattttgttgcctaa

SEQ ID NO: 325682 - DNA, 25 bp, Homo sapien
ctgtttgtaggcgttttaaatatgc

SEQ ID NO: 325683 - DNA, 25 bp, Homo sapien
gtgtgtctctcactacctattacac

SEQ ID NO: 325684 - DNA, 25 bp, Homo sapien
tctcactacctattacacactgttg

SEQ ID NO: 325685 - DNA, 25 bp, Homo sapien
cacactgttgctttgtgggtttgtt

SEQ ID NO: 325686 - DNA, 25 bp, Homo sapien
gtttgttttgtatgtgcgtgtgtta

SEQ ID NO: 325687 - DNA, 25 bp, Homo sapien
tacagtagttaaatttccatgcaga

SEQ ID NO: 325688 - DNA, 25 bp, Homo sapien
aaagttagctggactggtggtacat

SEQ ID NO: 325689 - DNA, 25 bp, Homo sapien
gctggactggtggtacatgcctata

SEQ ID NO: 325690 - DNA, 25 bp, Homo sapien
ctggactggtggtacatgcctatag

SEQ ID NO: 325691 - DNA, 25 bp, Homo sapien
agaccccatctcaaatcataatgat

SEQ ID NO: 325692 - DNA, 25 bp, Homo sapien
gaccccatctcaaatcataatgatg

SEQ ID NO: 325693 - DNA, 25 bp, Homo sapien
accccatctcaaatcataatgatga

SEQ ID NO: 325694 - DNA, 25 bp, Homo sapien
ccccatctcaaatcataatgatgat

SEQ ID NO: 325695 - DNA, 25 bp, Homo sapien
ccatctcaaatcataatgatgatga

SEQ ID NO: 325696 - DNA, 25 bp, Homo sapien
ataatgatgatgagtggatattttc

SEQ ID NO: 325697 - DNA, 25 bp, Homo sapien
ggcaacacagacctcatttctacca

SEQ ID NO: 325698 - DNA, 25 bp, Homo sapien
acacagacctcatttctaccaaaaa

SEQ ID NO: 325699 - DNA, 25 bp, Homo sapien
tggccgggcccgagtttcgcggcgg

SEQ ID NO: 325700 - DNA, 25 bp, Homo sapien
gagtttcgcggcggccccagagtgc

SEQ ID NO: 325701 - DNA, 25 bp, Homo sapien
ggcgtcaatcagaacatcccaaagc

SEQ ID NO: 325702 - DNA, 25 bp, Homo sapien
gcgtcaatcagaacatcccaaagcg

SEQ ID NO: 325703 - DNA, 25 bp, Homo sapien
gtcaatcagaacatcccaaagcggg

SEQ ID NO: 325704 - DNA, 25 bp, Homo sapien
tcaatcagaacatcccaaagcgggc

SEQ ID NO: 325705 - DNA, 25 bp, Homo sapien
caatcagaacatcccaaagcgggcc

SEQ ID NO: 325706 - DNA, 25 bp, Homo sapien
aaggcggccgtcttctggccctgcg

SEQ ID NO: 325707 - DNA, 25 bp, Homo sapien
gaacatcccaaagcgggccaagagg

SEQ ID NO: 325708 - DNA, 25 bp, Homo sapien
gggctaggcgcgtcctcggccacca

SEQ ID NO: 325709 - DNA, 25 bp, Homo sapien
aagttgcttactggccgggcccgag

SEQ ID NO: 325710 - DNA, 25 bp, Homo sapien
acacaaactgtagattttagcagcc

SEQ ID NO: 325711 - DNA, 25 bp, Homo sapien
cctggcccaaaggaatttgattact

SEQ ID NO: 325712 - DNA, 25 bp, Homo sapien
gggacactataattacaaaaacatc

SEQ ID NO: 325713 - DNA, 25 bp, Homo sapien
aacatccttaactgatttgagttgt

SEQ ID NO: 325714 - DNA, 25 bp, Homo sapien
tcttttagtggtttcttagcctctc

SEQ ID NO: 325715 - DNA, 25 bp, Homo sapien
tagtggtttcttagcctctcttaca

SEQ ID NO: 325716 - DNA, 25 bp, Homo sapien
tggtttcttagcctctcttacagcc

SEQ ID NO: 325717 - DNA, 25 bp, Homo sapien
gatagtactgtacatcaataccttc

SEQ ID NO: 325718 - DNA, 25 bp, Homo sapien
gtactgtacatcaataccttcatat

SEQ ID NO: 325719 - DNA, 25 bp, Homo sapien
gtacatcaataccttcatatgaaat

SEQ ID NO: 325720 - DNA, 25 bp, Homo sapien
aaataaaagcatgggttgattctgc

SEQ ID NO: 325721 - DNA, 25 bp, Homo sapien
gccctgttggcacactcaagcggga

SEQ ID NO: 325722 - DNA, 25 bp, Homo sapien
ttggcacactcaagcgggagtccac

SEQ ID NO: 325723 - DNA, 25 bp, Homo sapien
ctgcctcagtggtgggccagtctcg

SEQ ID NO: 325724 - DNA, 25 bp, Homo sapien
ggtgggccagtctcggtttgcattc

SEQ ID NO: 325725 - DNA, 25 bp, Homo sapien
tctcggtttgcattcttgtgctttt

SEQ ID NO: 325726 - DNA, 25 bp, Homo sapien
gttgttgctggcaaagccagaggtc

SEQ ID NO: 325727 - DNA, 25 bp, Homo sapien
gccagaggtcacagtggcctgatct

SEQ ID NO: 325728 - DNA, 25 bp, Homo sapien
tgatctgggccctcccaaagctgag

SEQ ID NO: 325729 - DNA, 25 bp, Homo sapien
agagctgaaagctgcggcgccactg

SEQ ID NO: 325730 - DNA, 25 bp, Homo sapien
tgccagagtcagatgtcacagatgt

SEQ ID NO: 325731 - DNA, 25 bp, Homo sapien
atgtgttgtgtaaacagttggctgt

SEQ ID NO: 325732 - DNA, 25 bp, Homo sapien
ttccagttccattctgtttatgaaa

SEQ ID NO: 325733 - DNA, 25 bp, Homo sapien
gaaaggattctgctgtactgctgat

SEQ ID NO: 325734 - DNA, 25 bp, Homo sapien
tcccattagatccttgttcaggtgt

SEQ ID NO: 325735 - DNA, 25 bp, Homo sapien
gtactgctgatctgcgttatgccat

SEQ ID NO: 325736 - DNA, 25 bp, Homo sapien
gttatgccattttcccctgtggcaa

SEQ ID NO: 325737 - DNA, 25 bp, Homo sapien
attttcccctgtggcaacagttgct

SEQ ID NO: 325738 - DNA, 25 bp, Homo sapien
aacagttgctactgaagggtcagga

SEQ ID NO: 325739 - DNA, 25 bp, Homo sapien
gttcaggtgttcttaaactatcgtt

SEQ ID NO: 325740 - DNA, 25 bp, Homo sapien
taaactatcgttggctccagagctt

SEQ ID NO: 325741 - DNA, 25 bp, Homo sapien
catcctcactggtgtttgtttccac

SEQ ID NO: 325742 - DNA, 25 bp, Homo sapien
ttgtttccacctgaggtgttccagt

SEQ ID NO: 325743 - DNA, 25 bp, Homo sapien
agggccaacagaggcatccttcagc

SEQ ID NO: 325744 - DNA, 25 bp, Homo sapien
ggcatccttcagcaggagcgacaac

SEQ ID NO: 325745 - DNA, 25 bp, Homo sapien
tccttcagcaggagcgacaacggct

SEQ ID NO: 325746 - DNA, 25 bp, Homo sapien
ttcagcaggagcgacaacggctagg

SEQ ID NO: 325747 - DNA, 25 bp, Homo sapien
cgacaacggctagggcagcggcagc

SEQ ID NO: 325748 - DNA, 25 bp, Homo sapien
gagccaacccaaggccccgagatcg

SEQ ID NO: 325749 - DNA, 25 bp, Homo sapien
caaggccccgagatcgtgccccggg

SEQ ID NO: 325750 - DNA, 25 bp, Homo sapien
agtgcgttcccgctttgcttccttc

SEQ ID NO: 325751 - DNA, 25 bp, Homo sapien
ccgaaacgcgcgcaataaagtgatt

SEQ ID NO: 325752 - DNA, 25 bp, Homo sapien
gaaacgcgcgcaataaagtgattcg

SEQ ID NO: 325753 - DNA, 25 bp, Homo sapien
acgcgcgcaataaagtgattcgcag

SEQ ID NO: 325754 - DNA, 25 bp, Homo sapien
tctctataactatctcatgctctgc

SEQ ID NO: 325755 - DNA, 25 bp, Homo sapien
ctataactatctcatgctctgcagg

SEQ ID NO: 325756 - DNA, 25 bp, Homo sapien
tataactatctcatgctctgcagga

SEQ ID NO: 325757 - DNA, 25 bp, Homo sapien
atgctctgcaggaacctctaccctt

SEQ ID NO: 325758 - DNA, 25 bp, Homo sapien
gcaggaacctctacccttctgtcgt

SEQ ID NO: 325759 - DNA, 25 bp, Homo sapien
tcagttggattgtccactgcaatta

SEQ ID NO: 325760 - DNA, 25 bp, Homo sapien
gttggattgtccactgcaattaagc

SEQ ID NO: 325761 - DNA, 25 bp, Homo sapien
ggattgtccactgcaattaagctgt

SEQ ID NO: 325762 - DNA, 25 bp, Homo sapien
attgtccactgcaattaagctgtgc

SEQ ID NO: 325763 - DNA, 25 bp, Homo sapien
gtccactgcaattaagctgtgcaag

SEQ ID NO: 325764 - DNA, 25 bp, Homo sapien
gcaattaagctgtgcaagagcaaaa

SEQ ID NO: 325765 - DNA, 25 bp, Homo sapien
taagaatctgacttacacccagcca

SEQ ID NO: 325766 - DNA, 25 bp, Homo sapien
cagccagactcatttaaacctctca

SEQ ID NO: 325767 - DNA, 25 bp, Homo sapien
gactcatttaaacctctcacatata

SEQ ID NO: 325768 - DNA, 25 bp, Homo sapien
aaacctctcacatataacctagaag

SEQ ID NO: 325769 - DNA, 25 bp, Homo sapien
aacctagaagctgatagttctgaga

SEQ ID NO: 325770 - DNA, 25 bp, Homo sapien
gagaataatgactttaacacgctta

SEQ ID NO: 325771 - DNA, 25 bp, Homo sapien
ctttaacacgcttagtgggatgcta

SEQ ID NO: 325772 - DNA, 25 bp, Homo sapien
atggaatttttggtactgtgctgtt

SEQ ID NO: 325773 - DNA, 25 bp, Homo sapien
ggtactgtgctgtttacttattata

SEQ ID NO: 325774 - DNA, 25 bp, Homo sapien
atatgtagctcatacttcatagaag

SEQ ID NO: 325775 - DNA, 25 bp, Homo sapien
tacttcatagaagctgttattttgc

SEQ ID NO: 325776 - DNA, 25 bp, Homo sapien
ctcctatgtcttctttcttaaatcc

SEQ ID NO: 325777 - DNA, 25 bp, Homo sapien
cttctttcttaaatccagttgctga

SEQ ID NO: 325778 - DNA, 25 bp, Homo sapien
tacagttgtgataaagcagcattac

SEQ ID NO: 325779 - DNA, 25 bp, Homo sapien
gaaaaagctatattccaactggtgt

SEQ ID NO: 325780 - DNA, 25 bp, Homo sapien
ccaactggtgttaaatgtattcaac

SEQ ID NO: 325781 - DNA, 25 bp, Homo sapien
ggtagatatctcaagccttttgtct

SEQ ID NO: 325782 - DNA, 25 bp, Homo sapien
ttacacaatggtgctctatcctatt

SEQ ID NO: 325783 - DNA, 25 bp, Homo sapien
aatggtgctctatcctattgttttc

SEQ ID NO: 325784 - DNA, 25 bp, Homo sapien
agaagcatctgaacacttgcatttc

SEQ ID NO: 325785 - DNA, 25 bp, Homo sapien
atttctattttcctatccaaaggca

SEQ ID NO: 325786 - DNA, 25 bp, Homo sapien
tttcctatccaaaggcatccacatc

SEQ ID NO: 325787 - DNA, 25 bp, Homo sapien
ctgggcttcaccagcaaggacccgt

SEQ ID NO: 325788 - DNA, 25 bp, Homo sapien
gacctggtgtcccagagtggcttct

SEQ ID NO: 325789 - DNA, 25 bp, Homo sapien
aggcgctgcctgaggagtttgccaa

SEQ ID NO: 325790 - DNA, 25 bp, Homo sapien
gccaatgagggcaacatcatcgcat

SEQ ID NO: 325791 - DNA, 25 bp, Homo sapien
gagggcaacatcatcgcattctggg

SEQ ID NO: 325792 - DNA, 25 bp, Homo sapien
aacatcatcgcattctgggtggaca

SEQ ID NO: 325793 - DNA, 25 bp, Homo sapien
atcatcgcattctgggtggacaaga

SEQ ID NO: 325794 - DNA, 25 bp, Homo sapien
agggccgtgtcttccaccgcatcaa

SEQ ID NO: 325795 - DNA, 25 bp, Homo sapien
accgcatcaacgactcggctgttat

SEQ ID NO: 325796 - DNA, 25 bp, Homo sapien
gactcggctgttatgctgttcttca

SEQ ID NO: 325797 - DNA, 25 bp, Homo sapien
ggctgttatgctgttcttcagcggg

SEQ ID NO: 325798 - DNA, 25 bp, Homo sapien
gaagaacgactattgggaggaggta

SEQ ID NO: 325799 - DNA, 25 bp, Homo sapien
tgcagcctgctacctcacttttggc

SEQ ID NO: 325800 - DNA, 25 bp, Homo sapien
agttagcaccttacatatttgatgc

SEQ ID NO: 325801 - DNA, 25 bp, Homo sapien
gcaccttacatatttgatgctcagg

SEQ ID NO: 325802 - DNA, 25 bp, Homo sapien
accttacatatttgatgctcaggaa

SEQ ID NO: 325803 - DNA, 25 bp, Homo sapien
aagatccctaatagaacattaaaga

SEQ ID NO: 325804 - DNA, 25 bp, Homo sapien
cacccttacatctccatagttggta

SEQ ID NO: 325805 - DNA, 25 bp, Homo sapien
cttacatctccatagttggtacagt

SEQ ID NO: 325806 - DNA, 25 bp, Homo sapien
ctccatagttggtacagttagcttg

SEQ ID NO: 325807 - DNA, 25 bp, Homo sapien
ggtacagttagcttgtagcagctga

SEQ ID NO: 325808 - DNA, 25 bp, Homo sapien
gttagcttgtagcagctgaagctga

SEQ ID NO: 325809 - DNA, 25 bp, Homo sapien
atcgcacggctgcactccagaggca

SEQ ID NO: 325810 - DNA, 25 bp, Homo sapien
cacggctgcactccagaggcaggca

SEQ ID NO: 325811 - DNA, 25 bp, Homo sapien
gggcaggcggagaacaggcggatca

SEQ ID NO: 325812 - DNA, 25 bp, Homo sapien
gcaggcggagaacaggcggatcacc

SEQ ID NO: 325813 - DNA, 25 bp, Homo sapien
agaacaggcggatcaccgtgaggtt

SEQ ID NO: 325814 - DNA, 25 bp, Homo sapien
ggcggatcaccgtgaggttgcagtt

SEQ ID NO: 325815 - DNA, 25 bp, Homo sapien
gcggatcaccgtgaggttgcagttg

SEQ ID NO: 325816 - DNA, 25 bp, Homo sapien
atcaccgtgaggttgcagttggaga

SEQ ID NO: 325817 - DNA, 25 bp, Homo sapien
tcaccgtgaggttgcagttggagac

SEQ ID NO: 325818 - DNA, 25 bp, Homo sapien
caccgtgaggttgcagttggagacc

SEQ ID NO: 325819 - DNA, 25 bp, Homo sapien
gagaatcacttaacccagaaggggg

SEQ ID NO: 325820 - DNA, 25 bp, Homo sapien
aaagggagacctgtcagttgaagaa

SEQ ID NO: 325821 - DNA, 25 bp, Homo sapien
gacctgtcagttgaagaagtcatga

SEQ ID NO: 325822 - DNA, 25 bp, Homo sapien
taaaggctgccaaagcagatgaaga

SEQ ID NO: 325823 - DNA, 25 bp, Homo sapien
tgaagaaccaactccagccgatgga

SEQ ID NO: 325824 - DNA, 25 bp, Homo sapien
tatcgaaaaccagtcaagcatccct

SEQ ID NO: 325825 - DNA, 25 bp, Homo sapien
aaaccagtcaagcatccctcagatg

SEQ ID NO: 325826 - DNA, 25 bp, Homo sapien
attcaggtttaacagcaagctcaaa

SEQ ID NO: 325827 - DNA, 25 bp, Homo sapien
gatgaagtaaatcaggactcggtca

SEQ ID NO: 325828 - DNA, 25 bp, Homo sapien
ggactcggtcaaaaagaactcacaa

SEQ ID NO: 325829 - DNA, 25 bp, Homo sapien
aatagtagcctcctttcttttgaca

SEQ ID NO: 325830 - DNA, 25 bp, Homo sapien
agcctcctttcttttgacaacgaag

SEQ ID NO: 325831 - DNA, 25 bp, Homo sapien
ttttttcatcctggtgccaggaata

SEQ ID NO: 325832 - DNA, 25 bp, Homo sapien
agagtggatatatttaaccataaca

SEQ ID NO: 325833 - DNA, 25 bp, Homo sapien
atcaaattgctacttttgttgtgga

SEQ ID NO: 325834 - DNA, 25 bp, Homo sapien
tgctacttttgttgtggaagacaaa

SEQ ID NO: 325835 - DNA, 25 bp, Homo sapien
gacaaaagcatttccatttcaacga

SEQ ID NO: 325836 - DNA, 25 bp, Homo sapien
aagcatttccatttcaacgagtttg

SEQ ID NO: 325837 - DNA, 25 bp, Homo sapien
gcatttccatttcaacgagtttgtc

SEQ ID NO: 325838 - DNA, 25 bp, Homo sapien
acagatctatagttttgggacaaaa

SEQ ID NO: 325839 - DNA, 25 bp, Homo sapien
aaaatgaaatgtgtaggtaacctat

SEQ ID NO: 325840 - DNA, 25 bp, Homo sapien
gtaggtaacctatttatatactgct

SEQ ID NO: 325841 - DNA, 25 bp, Homo sapien
ggtaacctatttatatactgctata

SEQ ID NO: 325842 - DNA, 25 bp, Homo sapien
tgaagtgaccttagcagaccagaga

SEQ ID NO: 325843 - DNA, 25 bp, Homo sapien
gtgaccttagcagaccagagatttt

SEQ ID NO: 325844 - DNA, 25 bp, Homo sapien
ccttagcagaccagagattttattt

SEQ ID NO: 325845 - DNA, 25 bp, Homo sapien
aattaaatctagttcaccttgctca

SEQ ID NO: 325846 - DNA, 25 bp, Homo sapien
ttaaatctagttcaccttgctcacc

SEQ ID NO: 325847 - DNA, 25 bp, Homo sapien
gtgacagggacagctcaggctcttg

SEQ ID NO: 325848 - DNA, 25 bp, Homo sapien
tcaggctcttggtgactgtggcagc

SEQ ID NO: 325849 - DNA, 25 bp, Homo sapien
gtgactgtggcagcgggagttcccg

SEQ ID NO: 325850 - DNA, 25 bp, Homo sapien
cacgacttggcttccttgtgcctta

SEQ ID NO: 325851 - DNA, 25 bp, Homo sapien
tccttgtgccttaaaaaacctgcct

SEQ ID NO: 325852 - DNA, 25 bp, Homo sapien
taaaaaacctgccttcctgcagcca

SEQ ID NO: 325853 - DNA, 25 bp, Homo sapien
gaagtcacaatcgttatgttctcaa

SEQ ID NO: 325854 - DNA, 25 bp, Homo sapien
aatcgttatgttctcaattgttttc

SEQ ID NO: 325855 - DNA, 25 bp, Homo sapien
tcaattgttttcctcctcttacttt

SEQ ID NO: 325856 - DNA, 25 bp, Homo sapien
tttctctcctgcctcgtttggacag

SEQ ID NO: 325857 - DNA, 25 bp, Homo sapien
tgcctcgtttggacaggccagtggc

SEQ ID NO: 325858 - DNA, 25 bp, Homo sapien
aggccagtggcattcgcccttgagg

SEQ ID NO: 325859 - DNA, 25 bp, Homo sapien
tggcttcctctgtgcatcctgtgaa

SEQ ID NO: 325860 - DNA, 25 bp, Homo sapien
ctgtgcatcctgtgaagtctgtttc

SEQ ID NO: 325861 - DNA, 25 bp, Homo sapien
aagtctgtttctgatgcgttggcgt

SEQ ID NO: 325862 - DNA, 25 bp, Homo sapien
aaacgaaatggccagtttccagagg

SEQ ID NO: 325863 - DNA, 25 bp, Homo sapien
gggaacggctgacgaagtcacaatc

SEQ ID NO: 325864 - DNA, 25 bp, Homo sapien
aaagggagacctgtcagttgaagaa

SEQ ID NO: 325865 - DNA, 25 bp, Homo sapien
gagacctgtcagttgaagaagtcat

SEQ ID NO: 325866 - DNA, 25 bp, Homo sapien
acctgtcagttgaagaagtcatgaa

SEQ ID NO: 325867 - DNA, 25 bp, Homo sapien
atgaagaaccaactccagccgatgg

SEQ ID NO: 325868 - DNA, 25 bp, Homo sapien
tgaagaaccaactccagccgatgga

SEQ ID NO: 325869 - DNA, 25 bp, Homo sapien
tatcgaaaaccagtcaagcatccct

SEQ ID NO: 325870 - DNA, 25 bp, Homo sapien
gaaaaccagtcaagcatccctcaga

SEQ ID NO: 325871 - DNA, 25 bp, Homo sapien
aaaccagtcaagcatccctcagatg

SEQ ID NO: 325872 - DNA, 25 bp, Homo sapien
aatagtagcctcctttcttttgaca

SEQ ID NO: 325873 - DNA, 25 bp, Homo sapien
tagtagcctcctttcttttgacaac

SEQ ID NO: 325874 - DNA, 25 bp, Homo sapien
gtagcctcctttcttttgacaacga

SEQ ID NO: 325875 - DNA, 25 bp, Homo sapien
aaattaaatctagttcaccttgctc

SEQ ID NO: 325876 - DNA, 25 bp, Homo sapien
aattaaatctagttcaccttgctca

SEQ ID NO: 325877 - DNA, 25 bp, Homo sapien
attaaatctagttcaccttgctcac

SEQ ID NO: 325878 - DNA, 25 bp, Homo sapien
ttaaatctagttcaccttgctcacc

SEQ ID NO: 325879 - DNA, 25 bp, Homo sapien
tcttggtgactgtggcagcgggagt

SEQ ID NO: 325880 - DNA, 25 bp, Homo sapien
tggtgactgtggcagcgggagttcc

SEQ ID NO: 325881 - DNA, 25 bp, Homo sapien
gtgactgtggcagcgggagttcccg

SEQ ID NO: 325882 - DNA, 25 bp, Homo sapien
tgtggcagcgggagttcccggccct

SEQ ID NO: 325883 - DNA, 25 bp, Homo sapien
ggcagcgggagttcccggccctcca

SEQ ID NO: 325884 - DNA, 25 bp, Homo sapien
accacgacttggcttccttgtgcct

SEQ ID NO: 325885 - DNA, 25 bp, Homo sapien
cacgacttggcttccttgtgcctta

SEQ ID NO: 325886 - DNA, 25 bp, Homo sapien
gagagtcagttaacagaggtattac

SEQ ID NO: 325887 - DNA, 25 bp, Homo sapien
gaccaatatccacaacagtcgcttg

SEQ ID NO: 325888 - DNA, 25 bp, Homo sapien
tatccacaacagtcgcttgaacaga

SEQ ID NO: 325889 - DNA, 25 bp, Homo sapien
acagtcgcttgaacagattggcacc

SEQ ID NO: 325890 - DNA, 25 bp, Homo sapien
aacagattggcacccgaattgccaa

SEQ ID NO: 325891 - DNA, 25 bp, Homo sapien
ggcacccgaattgccaaagttttgg

SEQ ID NO: 325892 - DNA, 25 bp, Homo sapien
ctctactggagggtgaaaggccaag

SEQ ID NO: 325893 - DNA, 25 bp, Homo sapien
aaagaaggcaatcgactgcctccgc

SEQ ID NO: 325894 - DNA, 25 bp, Homo sapien
tgcactatgcgccacaccagatgaa

SEQ ID NO: 325895 - DNA, 25 bp, Homo sapien
tatgcgccacaccagatgaaggatg

SEQ ID NO: 325896 - DNA, 25 bp, Homo sapien
caccagatgaaggatgtgcccctga

SEQ ID NO: 325897 - DNA, 25 bp, Homo sapien
ggaaacgcggctctgaatcagccca

SEQ ID NO: 325898 - DNA, 25 bp, Homo sapien
gaatcagcccagaacgagccttcgg

SEQ ID NO: 325899 - DNA, 25 bp, Homo sapien
ctccgatctcggtgtgattgttgtg

SEQ ID NO: 325900 - DNA, 25 bp, Homo sapien
tgattgttgtgatttcctgtctcgt

SEQ ID NO: 325901 - DNA, 25 bp, Homo sapien
cgtttgccttgaccgccatgtgaaa

SEQ ID NO: 325902 - DNA, 25 bp, Homo sapien
atgtgaaagaatctgttccccagct

SEQ ID NO: 325903 - DNA, 25 bp, Homo sapien
aaaattcacaggtgggctgtctgta

SEQ ID NO: 325904 - DNA, 25 bp, Homo sapien
tggctgattaaaggcttctcgtccc

SEQ ID NO: 325905 - DNA, 25 bp, Homo sapien
tctcgtcccgattttgtgatagcca

SEQ ID NO: 325906 - DNA, 25 bp, Homo sapien
agtgcttggcctggtcgacggtctt

SEQ ID NO: 325907 - DNA, 25 bp, Homo sapien
gacggtctttgctcctttacaaata

SEQ ID NO: 325908 - DNA, 25 bp, Homo sapien
ctggtgcccgtcagtgagaagcaac

SEQ ID NO: 325909 - DNA, 25 bp, Homo sapien
agtgagaagcaacgttctgcgctct

SEQ ID NO: 325910 - DNA, 25 bp, Homo sapien
aacgttctgcgctctctccgttaga

SEQ ID NO: 325911 - DNA, 25 bp, Homo sapien
tctctccgttagacctccatgctgt

SEQ ID NO: 325912 - DNA, 25 bp, Homo sapien
catgctgtccccagtcttgtccatt

SEQ ID NO: 325913 - DNA, 25 bp, Homo sapien
ttgtccattccatgctgctgtgtta

SEQ ID NO: 325914 - DNA, 25 bp, Homo sapien
ttccatgctgctgtgttacaaactc

SEQ ID NO: 325915 - DNA, 25 bp, Homo sapien
tgctgctgtgttacaaactctcaga

SEQ ID NO: 325916 - DNA, 25 bp, Homo sapien
aattcttaggatcacctgacctttg

SEQ ID NO: 325917 - DNA, 25 bp, Homo sapien
ggatcacctgacctttgtaatgtta

SEQ ID NO: 325918 - DNA, 25 bp, Homo sapien
gtgtgcaacatctttataatttgta

SEQ ID NO: 325919 - DNA, 25 bp, Homo sapien
attggaacattcatagctaagactc

SEQ ID NO: 325920 - DNA, 25 bp, Homo sapien
ccaggacacccacaaagccgagaaa

SEQ ID NO: 325921 - DNA, 25 bp, Homo sapien
ccacaaagccgagaaatgctgagtt

SEQ ID NO: 325922 - DNA, 25 bp, Homo sapien
gcctcatcggagtcggccggaaatg

SEQ ID NO: 325923 - DNA, 25 bp, Homo sapien
ggaccgagtctgtgagcctgagccc

SEQ ID NO: 325924 - DNA, 25 bp, Homo sapien
tgcagggtacccaggcgtcctgtac

SEQ ID NO: 325925 - DNA, 25 bp, Homo sapien
aggcgtcctgtaccgtttcagcaca

SEQ ID NO: 325926 - DNA, 25 bp, Homo sapien
gtaccgtttcagcacagcggctttg

SEQ ID NO: 325927 - DNA, 25 bp, Homo sapien
agcctgtagccctctttgcgcagct

SEQ ID NO: 325928 - DNA, 25 bp, Homo sapien
gtcgccctgtgacctactggtattg

SEQ ID NO: 325929 - DNA, 25 bp, Homo sapien
gacctactggtattggaacattcat

SEQ ID NO: 325930 - DNA, 25 bp, Homo sapien
agccaggcctactctgctgaggtgg

SEQ ID NO: 325931 - DNA, 25 bp, Homo sapien
ccaggcctactctgctgaggtggcg

SEQ ID NO: 325932 - DNA, 25 bp, Homo sapien
caggcctactctgctgaggtggcgc

SEQ ID NO: 325933 - DNA, 25 bp, Homo sapien
ggcctactctgctgaggtggcgctt

SEQ ID NO: 325934 - DNA, 25 bp, Homo sapien
gcctactctgctgaggtggcgcttc

SEQ ID NO: 325935 - DNA, 25 bp, Homo sapien
cctactctgctgaggtggcgcttcc

SEQ ID NO: 325936 - DNA, 25 bp, Homo sapien
ctactctgctgaggtggcgcttcct

SEQ ID NO: 325937 - DNA, 25 bp, Homo sapien
tactctgctgaggtggcgcttcctg

SEQ ID NO: 325938 - DNA, 25 bp, Homo sapien
actctgctgaggtggcgcttcctgc

SEQ ID NO: 325939 - DNA, 25 bp, Homo sapien
ctctgctgaggtggcgcttcctgct

SEQ ID NO: 325940 - DNA, 25 bp, Homo sapien
tgctgaggtggcgcttcctgctaag

SEQ ID NO: 325941 - DNA, 25 bp, Homo sapien
cttagcagactttggagttccccat

SEQ ID NO: 325942 - DNA, 25 bp, Homo sapien
ttggagttccccattctgccacatt

SEQ ID NO: 325943 - DNA, 25 bp, Homo sapien
ttctgccacattctgaccatgagac

SEQ ID NO: 325944 - DNA, 25 bp, Homo sapien
acattctgaccatgagacgcggctt

SEQ ID NO: 325945 - DNA, 25 bp, Homo sapien
ctgaccatgagacgcggcttgcagt

SEQ ID NO: 325946 - DNA, 25 bp, Homo sapien
tgctctactctctgctttctattta

SEQ ID NO: 325947 - DNA, 25 bp, Homo sapien
ctctactctctgctttctatttatt

SEQ ID NO: 325948 - DNA, 25 bp, Homo sapien
tactctctgctttctatttatttat

SEQ ID NO: 325949 - DNA, 25 bp, Homo sapien
tttgcctgtggaaaggagggtccct

SEQ ID NO: 325950 - DNA, 25 bp, Homo sapien
ggcaatgtttacaagactggtggac

SEQ ID NO: 325951 - DNA, 25 bp, Homo sapien
atgaggaatctcttagcagactttg

SEQ ID NO: 325952 - DNA, 25 bp, Homo sapien
gtacagtaagtgtccatgtatgcaa

SEQ ID NO: 325953 - DNA, 25 bp, Homo sapien
gtaagtgtccatgtatgcaaaaggg

SEQ ID NO: 325954 - DNA, 25 bp, Homo sapien
agcctagtctgtttgttcccctcca

SEQ ID NO: 325955 - DNA, 25 bp, Homo sapien
tctcattcctgatgagccctctcat

SEQ ID NO: 325956 - DNA, 25 bp, Homo sapien
catgtccctggacccttaagatatc

SEQ ID NO: 325957 - DNA, 25 bp, Homo sapien
ggacccttaagatatccccttggca

SEQ ID NO: 325958 - DNA, 25 bp, Homo sapien
taagatatccccttggcaccctggt

SEQ ID NO: 325959 - DNA, 25 bp, Homo sapien
ccctggtcagagactctgtgtctga

SEQ ID NO: 325960 - DNA, 25 bp, Homo sapien
agagactctgtgtctgactcaggtg

SEQ ID NO: 325961 - DNA, 25 bp, Homo sapien
gtctgactcaggtggtccctgcaga

SEQ ID NO: 325962 - DNA, 25 bp, Homo sapien
tcaggtggtccctgcagagtgccct

SEQ ID NO: 325963 - DNA, 25 bp, Homo sapien
agctcagggccggtggacatgttca

SEQ ID NO: 325964 - DNA, 25 bp, Homo sapien
gtggacatgttcactggtggaccag

SEQ ID NO: 325965 - DNA, 25 bp, Homo sapien
ggaccagttggcattgacctaaacg

SEQ ID NO: 325966 - DNA, 25 bp, Homo sapien
atgcacatggaggagaactacgttg

SEQ ID NO: 325967 - DNA, 25 bp, Homo sapien
gaaatcaagatcctatgtctgttgt

SEQ ID NO: 325968 - DNA, 25 bp, Homo sapien
gtattttctctttgcctggagtaaa

SEQ ID NO: 325969 - DNA, 25 bp, Homo sapien
atagcattataagtcattccaccct

SEQ ID NO: 325970 - DNA, 25 bp, Homo sapien
gtcattccacccttattagataacc

SEQ ID NO: 325971 - DNA, 25 bp, Homo sapien
ttggtctcaatagctttctcctgaa

SEQ ID NO: 325972 - DNA, 25 bp, Homo sapien
gattgaatcttacctgtagcagttc

SEQ ID NO: 325973 - DNA, 25 bp, Homo sapien
gtagcagttcactcttaaggttgaa

SEQ ID NO: 325974 - DNA, 25 bp, Homo sapien
tcaccctccgaaagcgatacacctt

SEQ ID NO: 325975 - DNA, 25 bp, Homo sapien
tccgaaagcgatacaccttctcccc

SEQ ID NO: 325976 - DNA, 25 bp, Homo sapien
ctccagcgctgggtgaacccggttg

SEQ ID NO: 325977 - DNA, 25 bp, Homo sapien
tgaggaggctccagtgcgcaggctc

SEQ ID NO: 325978 - DNA, 25 bp, Homo sapien
ggaggctccagtgcgcaggctccgg

SEQ ID NO: 325979 - DNA, 25 bp, Homo sapien
caggctccgggcaccggataaaagc

SEQ ID NO: 325980 - DNA, 25 bp, Homo sapien
ccgggcaccggataaaagcggagct

SEQ ID NO: 325981 - DNA, 25 bp, Homo sapien
gataaaagcggagctggcgagtcta

SEQ ID NO: 325982 - DNA, 25 bp, Homo sapien
taaaagcggagctggcgagtctagt

SEQ ID NO: 325983 - DNA, 25 bp, Homo sapien
gcggagctggcgagtctagtgctgt

SEQ ID NO: 325984 - DNA, 25 bp, Homo sapien
ctcgatggaggagcaagaaacggaa

SEQ ID NO: 325985 - DNA, 25 bp, Homo sapien
ggcaaaggtgtttaagctttgtcac

SEQ ID NO: 325986 - DNA, 25 bp, Homo sapien
cagctttgtggccacattcatattt

SEQ ID NO: 325987 - DNA, 25 bp, Homo sapien
tttagataagctcggactctgctcc

SEQ ID NO: 325988 - DNA, 25 bp, Homo sapien
actctgctcccctcttctggagatg

SEQ ID NO: 325989 - DNA, 25 bp, Homo sapien
gaggcaagtgtgtatgtgttgtcat

SEQ ID NO: 325990 - DNA, 25 bp, Homo sapien
gtatgtgttgtcatacttactgcat

SEQ ID NO: 325991 - DNA, 25 bp, Homo sapien
cttactgcattaattcttcactcga

SEQ ID NO: 325992 - DNA, 25 bp, Homo sapien
ttcttcactcgaaccgtttacatca

SEQ ID NO: 325993 - DNA, 25 bp, Homo sapien
atcagcgaataaacccattgttcaa

SEQ ID NO: 325994 - DNA, 25 bp, Homo sapien
taaactggactagacccatcacatc

SEQ ID NO: 325995 - DNA, 25 bp, Homo sapien
gacccatcacatccaacaggatcta

SEQ ID NO: 325996 - DNA, 25 bp, Homo sapien
aaagctgaagggtacgaccatgcac

SEQ ID NO: 325997 - DNA, 25 bp, Homo sapien
gggtacgaccatgcacatatgtgac

SEQ ID NO: 325998 - DNA, 25 bp, Homo sapien
gaccatgcacatatgtgacctggaa

SEQ ID NO: 325999 - DNA, 25 bp, Homo sapien
gacctggaaaatgcaaatttagatc

SEQ ID NO: 326000 - DNA, 25 bp, Homo sapien
tattgtttcccatagaagttccctc

SEQ ID NO: 326001 - DNA, 25 bp, Homo sapien
tcccatagaagttccctccctttga

SEQ ID NO: 326002 - DNA, 25 bp, Homo sapien
gtataaattctgcactgagccatgg

SEQ ID NO: 326003 - DNA, 25 bp, Homo sapien
gcagcccctaggttagagtggagac

SEQ ID NO: 326004 - DNA, 25 bp, Homo sapien
tcacagcttagcttgtgcttctcaa

SEQ ID NO: 326005 - DNA, 25 bp, Homo sapien
cttagcttgtgcttctcaacaccaa

SEQ ID NO: 326006 - DNA, 25 bp, Homo sapien
gtgcttctcaacaccaagtctttaa

SEQ ID NO: 326007 - DNA, 25 bp, Homo sapien
ttgttacatccaaggtgaagagggc

SEQ ID NO: 326008 - DNA, 25 bp, Homo sapien
gtgaagagggcaacacatctgtgta

SEQ ID NO: 326009 - DNA, 25 bp, Homo sapien
ggcaacacatctgtgtaagctgctt

SEQ ID NO: 326010 - DNA, 25 bp, Homo sapien
agtgtgtttatctgaaggccgtttt

SEQ ID NO: 326011 - DNA, 25 bp, Homo sapien
aggccgttttccattttgcttaatg

SEQ ID NO: 326012 - DNA, 25 bp, Homo sapien
gtaactacagacattatccagaaaa

SEQ ID NO: 326013 - DNA, 25 bp, Homo sapien
tctatcaaatggagccacattcggg

SEQ ID NO: 326014 - DNA, 25 bp, Homo sapien
attgagttgttcctgctgtttttta

SEQ ID NO: 326015 - DNA, 25 bp, Homo sapien
ttcttctctgtatgctgttgaccta

SEQ ID NO: 326016 - DNA, 25 bp, Homo sapien
atgctgttgacctaatgatttatgc

SEQ ID NO: 326017 - DNA, 25 bp, Homo sapien
tatgcaatctctgtaatttcttatg

SEQ ID NO: 326018 - DNA, 25 bp, Homo sapien
aaacagcttgaggtgctttccgaat

SEQ ID NO: 326019 - DNA, 25 bp, Homo sapien
tgctttccgaatttgcactcttttc

SEQ ID NO: 326020 - DNA, 25 bp, Homo sapien
ctacatatggtccaccgggtttgat

SEQ ID NO: 326021 - DNA, 25 bp, Homo sapien
gggtttgataacttttgtgcttcgg

SEQ ID NO: 326022 - DNA, 25 bp, Homo sapien
ttgtgcttcggttgcgggattcctc

SEQ ID NO: 326023 - DNA, 25 bp, Homo sapien
cattctttctcgtgtcatctgatac

SEQ ID NO: 326024 - DNA, 25 bp, Homo sapien
gatacgagtcgtttgttgcacacac

SEQ ID NO: 326025 - DNA, 25 bp, Homo sapien
tgtataaatcccaggcaattgagct

SEQ ID NO: 326026 - DNA, 25 bp, Homo sapien
aattgagctgggaggctccagagct

SEQ ID NO: 326027 - DNA, 25 bp, Homo sapien
tgctggatgcagtcaaagctgccct

SEQ ID NO: 326028 - DNA, 25 bp, Homo sapien
agggttgtctttgcccacatttgac

SEQ ID NO: 326029 - DNA, 25 bp, Homo sapien
gattatgacaatcatttcacattgt

SEQ ID NO: 326030 - DNA, 25 bp, Homo sapien
atgtatcatcacactgtacatctca

SEQ ID NO: 326031 - DNA, 25 bp, Homo sapien
gtatcatcacactgtacatctcaaa

SEQ ID NO: 326032 - DNA, 25 bp, Homo sapien
tatcatcacactgtacatctcaaat

SEQ ID NO: 326033 - DNA, 25 bp, Homo sapien
atcatcacactgtacatctcaaata

SEQ ID NO: 326034 - DNA, 25 bp, Homo sapien
tcatcacactgtacatctcaaatat

SEQ ID NO: 326035 - DNA, 25 bp, Homo sapien
acactgtacatctcaaatatatgca

SEQ ID NO: 326036 - DNA, 25 bp, Homo sapien
gcaagttttatttgtcaatcatact

SEQ ID NO: 326037 - DNA, 25 bp, Homo sapien
atcatacttcagtatagctgagaac

SEQ ID NO: 326038 - DNA, 25 bp, Homo sapien
catacttcagtatagctgagaacaa

SEQ ID NO: 326039 - DNA, 25 bp, Homo sapien
cagtatagctgagaacaagttaaat

SEQ ID NO: 326040 - DNA, 25 bp, Homo sapien
tggaagcatgatcttcactcccttc

SEQ ID NO: 326041 - DNA, 25 bp, Homo sapien
ggctgcaaaacgaccctgaggaatg

SEQ ID NO: 326042 - DNA, 25 bp, Homo sapien
gtgtctgacgccacggaggacccat

SEQ ID NO: 326043 - DNA, 25 bp, Homo sapien
aggacccatccggtggcacaggctt

SEQ ID NO: 326044 - DNA, 25 bp, Homo sapien
ctgctcttctgcgagggtcttggag

SEQ ID NO: 326045 - DNA, 25 bp, Homo sapien
tttgcacccggcagagtgacgagct

SEQ ID NO: 326046 - DNA, 25 bp, Homo sapien
gaggagccggttccagagagccctg

SEQ ID NO: 326047 - DNA, 25 bp, Homo sapien
agagtgacgagcttcgccggtgtct

SEQ ID NO: 326048 - DNA, 25 bp, Homo sapien
gccggtgtcttcaacgaagtcctgt

SEQ ID NO: 326049 - DNA, 25 bp, Homo sapien
ttcaacgaagtcctgtcggtcccta

SEQ ID NO: 326050 - DNA, 25 bp, Homo sapien
acacactcctggaagcatgatcttc

SEQ ID NO: 326051 - DNA, 25 bp, Homo sapien
gagcccgtgctgtcagctctggaaa

SEQ ID NO: 326052 - DNA, 25 bp, Homo sapien
cccgtgctgtcagctctggaaaaga

SEQ ID NO: 326053 - DNA, 25 bp, Homo sapien
gaacaggtaaagtgcaaggagaatc

SEQ ID NO: 326054 - DNA, 25 bp, Homo sapien
gtgcaaggagaatccagtaagtaaa

SEQ ID NO: 326055 - DNA, 25 bp, Homo sapien
gactttgtcaaatacacagctgctg

SEQ ID NO: 326056 - DNA, 25 bp, Homo sapien
tttgtcaaatacacagctgctggct

SEQ ID NO: 326057 - DNA, 25 bp, Homo sapien
tacacagctgctggctgtcaggagc

SEQ ID NO: 326058 - DNA, 25 bp, Homo sapien
caccctgggaagtgttgggcgacac

SEQ ID NO: 326059 - DNA, 25 bp, Homo sapien
gacacagcagagagacaacggaaat

SEQ ID NO: 326060 - DNA, 25 bp, Homo sapien
tagaatgggtgagtcctaccccagc

SEQ ID NO: 326061 - DNA, 25 bp, Homo sapien
gaagggaagccaagccaggcacact

SEQ ID NO: 326062 - DNA, 25 bp, Homo sapien
ccgggccctggcgaggcaggaatgg

SEQ ID NO: 326063 - DNA, 25 bp, Homo sapien
gcgccccaggaatcagtgacattca

SEQ ID NO: 326064 - DNA, 25 bp, Homo sapien
acattcaaagatgtgtctgtggact

SEQ ID NO: 326065 - DNA, 25 bp, Homo sapien
ggaagaatggtaccatgtcgaccct

SEQ ID NO: 326066 - DNA, 25 bp, Homo sapien
agaatggtaccatgtcgaccctgct

SEQ ID NO: 326067 - DNA, 25 bp, Homo sapien
gtaccatgtcgaccctgctcagagg

SEQ ID NO: 326068 - DNA, 25 bp, Homo sapien
gctcagaggagcttatacagggatg

SEQ ID NO: 326069 - DNA, 25 bp, Homo sapien
gccacctggtttctcttggatatca

SEQ ID NO: 326070 - DNA, 25 bp, Homo sapien
cacctggtttctcttggatatcaag

SEQ ID NO: 326071 - DNA, 25 bp, Homo sapien
gatatcaagtttccaagccagaggt

SEQ ID NO: 326072 - DNA, 25 bp, Homo sapien
agtttccaagccagaggtgatcttc

SEQ ID NO: 326073 - DNA, 25 bp, Homo sapien
gagattgtttctgagccatgtgctt

SEQ ID NO: 326074 - DNA, 25 bp, Homo sapien
gagccatgtgcttcaacatcggatt

SEQ ID NO: 326075 - DNA, 25 bp, Homo sapien
cactgtgattccatttagcttccaa

SEQ ID NO: 326076 - DNA, 25 bp, Homo sapien
gcttccaaatgtgtctctgctaaga

SEQ ID NO: 326077 - DNA, 25 bp, Homo sapien
aaagcactcataaatagcacgtgtg

SEQ ID NO: 326078 - DNA, 25 bp, Homo sapien
atagcacgtgtgtcttctttgcagt

SEQ ID NO: 326079 - DNA, 25 bp, Homo sapien
cgtgtgtcttctttgcagtgtttgc

SEQ ID NO: 326080 - DNA, 25 bp, Homo sapien
cagtgtttgctaattttgagtcaca

SEQ ID NO: 326081 - DNA, 25 bp, Homo sapien
ttgagtcacatctttttagaaaatc

SEQ ID NO: 326082 - DNA, 25 bp, Homo sapien
gatttggtgtcacagagactggaat

SEQ ID NO: 326083 - DNA, 25 bp, Homo sapien
ttggtgaagatttcctttagctgtt

SEQ ID NO: 326084 - DNA, 25 bp, Homo sapien
atcagcacagcacagggtacaggac

SEQ ID NO: 326085 - DNA, 25 bp, Homo sapien
gcacagcacagggtacaggacgcct

SEQ ID NO: 326086 - DNA, 25 bp, Homo sapien
ccttgtccagaattgcgggaggagt

SEQ ID NO: 326087 - DNA, 25 bp, Homo sapien
ccagaattgcgggaggagtcatgtt

SEQ ID NO: 326088 - DNA, 25 bp, Homo sapien
atgttggacttgctgagcattttct

SEQ ID NO: 326089 - DNA, 25 bp, Homo sapien
acttgctgagcattttctgattgag

SEQ ID NO: 326090 - DNA, 25 bp, Homo sapien
gagcattttctgattgagtgctagc

SEQ ID NO: 326091 - DNA, 25 bp, Homo sapien
ggtgctctgggtgggctcggagcca

SEQ ID NO: 326092 - DNA, 25 bp, Homo sapien
ctcggagccagcattgcacagggag

SEQ ID NO: 326093 - DNA, 25 bp, Homo sapien
cagcattgcacagggaggcaggcac

SEQ ID NO: 326094 - DNA, 25 bp, Homo sapien
ggacccgcagatcagcacagcacag

SEQ ID NO: 326095 - DNA, 25 bp, Homo sapien
aaacccagatgcctacgttgagtag

SEQ ID NO: 326096 - DNA, 25 bp, Homo sapien
tacgttgagtagtctgtctggtcca

SEQ ID NO: 326097 - DNA, 25 bp, Homo sapien
cgttgagtagtctgtctggtccatc

SEQ ID NO: 326098 - DNA, 25 bp, Homo sapien
actttgaactgataacagccacctc

SEQ ID NO: 326099 - DNA, 25 bp, Homo sapien
acctcatcccacagattctcaggtg

SEQ ID NO: 326100 - DNA, 25 bp, Homo sapien
gattctcaggtgaaaaatactcatt

SEQ ID NO: 326101 - DNA, 25 bp, Homo sapien
gtgaaaaatactcattagccataat

SEQ ID NO: 326102 - DNA, 25 bp, Homo sapien
attagccataataagcagcttgatc

SEQ ID NO: 326103 - DNA, 25 bp, Homo sapien
caaaatatcaggataaactgcccca

SEQ ID NO: 326104 - DNA, 25 bp, Homo sapien
taaactgccccaggtgagcaccagg

SEQ ID NO: 326105 - DNA, 25 bp, Homo sapien
aggtgagcaccaggcctcctggagc

SEQ ID NO: 326106 - DNA, 25 bp, Homo sapien
gtggagattttgctaaacagactaa

SEQ ID NO: 326107 - DNA, 25 bp, Homo sapien
gactaagacccatgatttagctttg

SEQ ID NO: 326108 - DNA, 25 bp, Homo sapien
ttagcatgagttgaggtaccaggta

SEQ ID NO: 326109 - DNA, 25 bp, Homo sapien
aagtaggttcatcacgctctaaggc

SEQ ID NO: 326110 - DNA, 25 bp, Homo sapien
tcatcacgctctaaggccgtttttt

SEQ ID NO: 326111 - DNA, 25 bp, Homo sapien
ttttccttagccagacccctgttga

SEQ ID NO: 326112 - DNA, 25 bp, Homo sapien
agacccctgttgatagaccagatac

SEQ ID NO: 326113 - DNA, 25 bp, Homo sapien
gatagaccagatacttgagggcaaa

SEQ ID NO: 326114 - DNA, 25 bp, Homo sapien
tgagggcaaactgtttgctcctcct

SEQ ID NO: 326115 - DNA, 25 bp, Homo sapien
gtaaagctgtattttctggaaggaa

SEQ ID NO: 326116 - DNA, 25 bp, Homo sapien
gactgtatcttctggaatagttttc

SEQ ID NO: 326117 - DNA, 25 bp, Homo sapien
tgagccatcaggacaatcatacccc

SEQ ID NO: 326118 - DNA, 25 bp, Homo sapien
gacctaggcagcattagaatcactt

SEQ ID NO: 326119 - DNA, 25 bp, Homo sapien
ggcagcattagaatcacttatttat

SEQ ID NO: 326120 - DNA, 25 bp, Homo sapien
acctgttccctgactgcgtgaaatg

SEQ ID NO: 326121 - DNA, 25 bp, Homo sapien
tgttccctgactgcgtgaaatgttc

SEQ ID NO: 326122 - DNA, 25 bp, Homo sapien
actgcgtgaaatgttcagggaggtc

SEQ ID NO: 326123 - DNA, 25 bp, Homo sapien
gaggtcagttgatttccccaggtac

SEQ ID NO: 326124 - DNA, 25 bp, Homo sapien
agttgatttccccaggtacattcat

SEQ ID NO: 326125 - DNA, 25 bp, Homo sapien
gatttccccaggtacattcatggtg

SEQ ID NO: 326126 - DNA, 25 bp, Homo sapien
aggtacattcatggtgtgacagaca

SEQ ID NO: 326127 - DNA, 25 bp, Homo sapien
gtgacagacacatgggtacaaataa

SEQ ID NO: 326128 - DNA, 25 bp, Homo sapien
aggaatacacattgcttgcgagaac

SEQ ID NO: 326129 - DNA, 25 bp, Homo sapien
cacattgcttgcgagaactggttat

SEQ ID NO: 326130 - DNA, 25 bp, Homo sapien
gaaaactcccacttgtgaatatttt

SEQ ID NO: 326131 - DNA, 25 bp, Homo sapien
gacattggaatacttcttgctgcta

SEQ ID NO: 326132 - DNA, 25 bp, Homo sapien
ttcttgctgctacatgtcatcttaa

SEQ ID NO: 326133 - DNA, 25 bp, Homo sapien
gctacatgtcatcttaattttggat

SEQ ID NO: 326134 - DNA, 25 bp, Homo sapien
tggatggcatgggttttgtaaaact

SEQ ID NO: 326135 - DNA, 25 bp, Homo sapien
gtaaaacttattctgccccagccaa

SEQ ID NO: 326136 - DNA, 25 bp, Homo sapien
aatagtctaccttaattcagcctag

SEQ ID NO: 326137 - DNA, 25 bp, Homo sapien
ttcagcctagaagagtacattgatt

SEQ ID NO: 326138 - DNA, 25 bp, Homo sapien
tacacttagtaaattcttccagatt

SEQ ID NO: 326139 - DNA, 25 bp, Homo sapien
ggacgtgttcctcatgatccggcgc

SEQ ID NO: 326140 - DNA, 25 bp, Homo sapien
gttcctcatgatccggcgccacaag

SEQ ID NO: 326141 - DNA, 25 bp, Homo sapien
accatcttcacggacgccaaggagt

SEQ ID NO: 326142 - DNA, 25 bp, Homo sapien
gagtccagcacggtgttcgaactga

SEQ ID NO: 326143 - DNA, 25 bp, Homo sapien
tgttcgaactgaagcgcatcgtcga

SEQ ID NO: 326144 - DNA, 25 bp, Homo sapien
tgaagcgcatcgtcgagggcatcct

SEQ ID NO: 326145 - DNA, 25 bp, Homo sapien
atcgtcgagggcatcctcaagcggc

SEQ ID NO: 326146 - DNA, 25 bp, Homo sapien
tcaagcggcctcctgacgagcagcg

SEQ ID NO: 326147 - DNA, 25 bp, Homo sapien
tcctgacgagcagcggctgtacaag

SEQ ID NO: 326148 - DNA, 25 bp, Homo sapien
ggctgtacaaggatgaccaactctt

SEQ ID NO: 326149 - DNA, 25 bp, Homo sapien
atgaccaactcttggatgatggcaa

SEQ ID NO: 326150 - DNA, 25 bp, Homo sapien
aagttacctccaccttctagctcag

SEQ ID NO: 326151 - DNA, 25 bp, Homo sapien
gaggactaatttggcgcagatgaca

SEQ ID NO: 326152 - DNA, 25 bp, Homo sapien
atgggaatattcagcagaggacagt

SEQ ID NO: 326153 - DNA, 25 bp, Homo sapien
gaggacagtgttgccaaaacttgtt

SEQ ID NO: 326154 - DNA, 25 bp, Homo sapien
aaacttgttagctgagctcacgtcc

SEQ ID NO: 326155 - DNA, 25 bp, Homo sapien
gtcccctgatgctggtaacctgaaa

SEQ ID NO: 326156 - DNA, 25 bp, Homo sapien
tgaaagatacgacattgctgagcct

SEQ ID NO: 326157 - DNA, 25 bp, Homo sapien
cattgctgagccttactgggttgaa

SEQ ID NO: 326158 - DNA, 25 bp, Homo sapien
gtagctcagacctgtttttatttgc

SEQ ID NO: 326159 - DNA, 25 bp, Homo sapien
ttgctcaataactctactcatttgt

SEQ ID NO: 326160 - DNA, 25 bp, Homo sapien
gtatcttttcagcacttaattttaa

SEQ ID NO: 326161 - DNA, 25 bp, Homo sapien
gaacagcgtggcctacatggaccag

SEQ ID NO: 326162 - DNA, 25 bp, Homo sapien
gtggcctacatggaccagcagactg

SEQ ID NO: 326163 - DNA, 25 bp, Homo sapien
gaccagcagactggcaacctcaaga

SEQ ID NO: 326164 - DNA, 25 bp, Homo sapien
agggctccaacgagatcgagatccg

SEQ ID NO: 326165 - DNA, 25 bp, Homo sapien
aacgagatcgagatccgcgccgagg

SEQ ID NO: 326166 - DNA, 25 bp, Homo sapien
agatccgcgccgagggcaacagccg

SEQ ID NO: 326167 - DNA, 25 bp, Homo sapien
ttcacctacagcgtcactgtcgatg

SEQ ID NO: 326168 - DNA, 25 bp, Homo sapien
gtcactgtcgatggctgcacgagtc

SEQ ID NO: 326169 - DNA, 25 bp, Homo sapien
tgcacgagtcacaccggagcctggg

SEQ ID NO: 326170 - DNA, 25 bp, Homo sapien
gggcaagacagtgattgaatacaaa

SEQ ID NO: 326171 - DNA, 25 bp, Homo sapien
cttggacgttggtgccccagaccag

SEQ ID NO: 326172 - DNA, 25 bp, Homo sapien
gcctcatttggtgatcagtcagtca

SEQ ID NO: 326173 - DNA, 25 bp, Homo sapien
gtcagtcacacataagttccttgta

SEQ ID NO: 326174 - DNA, 25 bp, Homo sapien
atgcacttctcccagatgctatagg

SEQ ID NO: 326175 - DNA, 25 bp, Homo sapien
gatgctatagggttttctctcactg

SEQ ID NO: 326176 - DNA, 25 bp, Homo sapien
ttttctctcactgttgccaatggat

SEQ ID NO: 326177 - DNA, 25 bp, Homo sapien
cactgttgccaatggatgtcatcca

SEQ ID NO: 326178 - DNA, 25 bp, Homo sapien
tgtcatccagacagtgggctcatat

SEQ ID NO: 326179 - DNA, 25 bp, Homo sapien
cagtgggctcatatcttacggtttt

SEQ ID NO: 326180 - DNA, 25 bp, Homo sapien
ttacggttttgtgcaatcattgtcg

SEQ ID NO: 326181 - DNA, 25 bp, Homo sapien
atcattgtcgtattgtagtcttaag

SEQ ID NO: 326182 - DNA, 25 bp, Homo sapien
gagcatgttgcagcaaatctattgt

SEQ ID NO: 326183 - DNA, 25 bp, Homo sapien
gtggagaagtttccagcgtgcaccc

SEQ ID NO: 326184 - DNA, 25 bp, Homo sapien
gcaccctccagtaggagttgaagtc

SEQ ID NO: 326185 - DNA, 25 bp, Homo sapien
cctccagtaggagttgaagtcgtac

SEQ ID NO: 326186 - DNA, 25 bp, Homo sapien
cagtaggagttgaagtcgtacaggc

SEQ ID NO: 326187 - DNA, 25 bp, Homo sapien
tcgtacaggcgggtggtgtcaggtc

SEQ ID NO: 326188 - DNA, 25 bp, Homo sapien
agtgaggaaagaaacgcggctcggg

SEQ ID NO: 326189 - DNA, 25 bp, Homo sapien
ggtgaaagacttttcccaccgacat

SEQ ID NO: 326190 - DNA, 25 bp, Homo sapien
tgaaagacttttcccaccgacatgg

SEQ ID NO: 326191 - DNA, 25 bp, Homo sapien
aagacttttcccaccgacatggtca

SEQ ID NO: 326192 - DNA, 25 bp, Homo sapien
ttttcccaccgacatggtcacatag

SEQ ID NO: 326193 - DNA, 25 bp, Homo sapien
gacatggtcacatagccattctcct

SEQ ID NO: 326194 - DNA, 25 bp, Homo sapien
gtaattaggcattgcctcctggcga

SEQ ID NO: 326195 - DNA, 25 bp, Homo sapien
ctcctggcgaggttcttgatgcatg

SEQ ID NO: 326196 - DNA, 25 bp, Homo sapien
gaggttcttgatgcatgacttcgat

SEQ ID NO: 326197 - DNA, 25 bp, Homo sapien
atgacttcgatgctggctgctgact

SEQ ID NO: 326198 - DNA, 25 bp, Homo sapien
ttcgatgctggctgctgactgaggt

SEQ ID NO: 326199 - DNA, 25 bp, Homo sapien
ctgctgactgaggtgaccactgtca

SEQ ID NO: 326200 - DNA, 25 bp, Homo sapien
accactgtcagtattgtactttggc

SEQ ID NO: 326201 - DNA, 25 bp, Homo sapien
ttgtactttggcatatgttgttttt

SEQ ID NO: 326202 - DNA, 25 bp, Homo sapien
gcattcttagattaacttactgttt

SEQ ID NO: 326203 - DNA, 25 bp, Homo sapien
atgccaaatatttatacactacaaa

SEQ ID NO: 326204 - DNA, 25 bp, Homo sapien
cagttatgattttaatagcgtctaa

SEQ ID NO: 326205 - DNA, 25 bp, Homo sapien
gagaaggaagtgagcccactgctct

SEQ ID NO: 326206 - DNA, 25 bp, Homo sapien
gagcaatgtgggtgagtccaccaga

SEQ ID NO: 326207 - DNA, 25 bp, Homo sapien
tgagtccaccagaggccctgctgtg

SEQ ID NO: 326208 - DNA, 25 bp, Homo sapien
gctgtgtgtggccaataaattttag

SEQ ID NO: 326209 - DNA, 25 bp, Homo sapien
cccagccctcgaggcagtgtgtgtg

SEQ ID NO: 326210 - DNA, 25 bp, Homo sapien
gtggatgtatgcgtgtggatattta

SEQ ID NO: 326211 - DNA, 25 bp, Homo sapien
gatatttatatatgtaccctgcact

SEQ ID NO: 326212 - DNA, 25 bp, Homo sapien
atgtaccctgcactcatgaatgtat

SEQ ID NO: 326213 - DNA, 25 bp, Homo sapien
ttactacagtggaagggttcttaat

SEQ ID NO: 326214 - DNA, 25 bp, Homo sapien
caaggtctacctagcatgaagtatt

SEQ ID NO: 326215 - DNA, 25 bp, Homo sapien
gaagtatttaacattctcccatccc

SEQ ID NO: 326216 - DNA, 25 bp, Homo sapien
cagaccccgaagccagcgctgggaa

SEQ ID NO: 326217 - DNA, 25 bp, Homo sapien
gccagcgctgggaagggctgcggat

SEQ ID NO: 326218 - DNA, 25 bp, Homo sapien
ggcaggtccaaggacacgcgggtct

SEQ ID NO: 326219 - DNA, 25 bp, Homo sapien
acgcgggtctggtcctgggcaagaa

SEQ ID NO: 326220 - DNA, 25 bp, Homo sapien
cttcagtcttcctttgcagaacaac

SEQ ID NO: 326221 - DNA, 25 bp, Homo sapien
tcagtcttcctttgcagaacaacgg

SEQ ID NO: 326222 - DNA, 25 bp, Homo sapien
agtcttcctttgcagaacaacgggc

SEQ ID NO: 326223 - DNA, 25 bp, Homo sapien
tcttcctttgcagaacaacgggcca

SEQ ID NO: 326224 - DNA, 25 bp, Homo sapien
ttcctttgcagaacaacgggccagg

SEQ ID NO: 326225 - DNA, 25 bp, Homo sapien
ctttgcagaacaacgggccaggccc

SEQ ID NO: 326226 - DNA, 25 bp, Homo sapien
cccgggtgcttgaagtctagcccca

SEQ ID NO: 326227 - DNA, 25 bp, Homo sapien
gatattgtgaattctgacttatact

SEQ ID NO: 326228 - DNA, 25 bp, Homo sapien
ggatgtgatgggtctagtccagttt

SEQ ID NO: 326229 - DNA, 25 bp, Homo sapien
gtctagtccagtttatttaagttca

SEQ ID NO: 326230 - DNA, 25 bp, Homo sapien
gttcatgtttcactgtttgcacttt

SEQ ID NO: 326231 - DNA, 25 bp, Homo sapien
tttgcactttgcattgaacaatggg

SEQ ID NO: 326232 - DNA, 25 bp, Homo sapien
gaacaatgggtttattcgctgatgt

SEQ ID NO: 326233 - DNA, 25 bp, Homo sapien
cgctgatgtaaacggttcgagtgaa

SEQ ID NO: 326234 - DNA, 25 bp, Homo sapien
tgacaacacatacacacttgcctct

SEQ ID NO: 326235 - DNA, 25 bp, Homo sapien
ggagcagagtccgagcttatctaaa

SEQ ID NO: 326236 - DNA, 25 bp, Homo sapien
atctaaatatgaatgtggccacaaa

SEQ ID NO: 326237 - DNA, 25 bp, Homo sapien
ggtgacaaagcttaaacacctttgc

SEQ ID NO: 326238 - DNA, 25 bp, Homo sapien
gcaggagggtaacccaggccacccg

SEQ ID NO: 326239 - DNA, 25 bp, Homo sapien
gggctccaggcgacccctagcccaa

SEQ ID NO: 326240 - DNA, 25 bp, Homo sapien
aggcgacccctagcccaattctgcc

SEQ ID NO: 326241 - DNA, 25 bp, Homo sapien
ccctccatcccaaggggcagagaaa

SEQ ID NO: 326242 - DNA, 25 bp, Homo sapien
gggcagagaaattgtctttctttgc

SEQ ID NO: 326243 - DNA, 25 bp, Homo sapien
agtcccctagcttggggtccagaca

SEQ ID NO: 326244 - DNA, 25 bp, Homo sapien
tagcttggggtccagacagcccagt

SEQ ID NO: 326245 - DNA, 25 bp, Homo sapien
gtccagacagcccagtggacccagg

SEQ ID NO: 326246 - DNA, 25 bp, Homo sapien
ctgagcaggagggtaacccaggcca

SEQ ID NO: 326247 - DNA, 25 bp, Homo sapien
tgagcaggagggtaacccaggccac

SEQ ID NO: 326248 - DNA, 25 bp, Homo sapien
gagcaggagggtaacccaggccacc

SEQ ID NO: 326249 - DNA, 25 bp, Homo sapien
ataggagctttctccaagtacccac

SEQ ID NO: 326250 - DNA, 25 bp, Homo sapien
tttctccaagtacccactttatagg

SEQ ID NO: 326251 - DNA, 25 bp, Homo sapien
gtaggttctcgtcatcaggagcatg

SEQ ID NO: 326252 - DNA, 25 bp, Homo sapien
agggctagagacagaactaaccaca

SEQ ID NO: 326253 - DNA, 25 bp, Homo sapien
aactaaccacaatcagggcagtccc

SEQ ID NO: 326254 - DNA, 25 bp, Homo sapien
aatcagggcagtccctgctgtagct

SEQ ID NO: 326255 - DNA, 25 bp, Homo sapien
caggagcatgacgtacagatttggt

SEQ ID NO: 326256 - DNA, 25 bp, Homo sapien
gacgtacagatttggtgtgagtgca

SEQ ID NO: 326257 - DNA, 25 bp, Homo sapien
gtgagtgcagtcctgctaacctgct

SEQ ID NO: 326258 - DNA, 25 bp, Homo sapien
gggatccgagtacccgctttatagg

SEQ ID NO: 326259 - DNA, 25 bp, Homo sapien
cgagtacccgctttataggagcttt

SEQ ID NO: 326260 - DNA, 25 bp, Homo sapien
cataacagcatatgcatttccccac

SEQ ID NO: 326261 - DNA, 25 bp, Homo sapien
caccgcgttgtgtctgcagcttctt

SEQ ID NO: 326262 - DNA, 25 bp, Homo sapien
cagcttctttgccaatatagtaatg

SEQ ID NO: 326263 - DNA, 25 bp, Homo sapien
gatagtatcagttttggattcttat

SEQ ID NO: 326264 - DNA, 25 bp, Homo sapien
ggattcttattgttatcacctatgt

SEQ ID NO: 326265 - DNA, 25 bp, Homo sapien
tttaagcacaaacctgctgctcatc

SEQ ID NO: 326266 - DNA, 25 bp, Homo sapien
gctgctcatctaacgttggtacata

SEQ ID NO: 326267 - DNA, 25 bp, Homo sapien
acgttggtacataatctcaaatcaa

SEQ ID NO: 326268 - DNA, 25 bp, Homo sapien
agggatcacaaaagtgtcacatatt

SEQ ID NO: 326269 - DNA, 25 bp, Homo sapien
gaatgctgacctttcatatggatta

SEQ ID NO: 326270 - DNA, 25 bp, Homo sapien
gtgagtcatcagagtttattataac

SEQ ID NO: 326271 - DNA, 25 bp, Homo sapien
tcccggacaggtaaggtttagcaag

SEQ ID NO: 326272 - DNA, 25 bp, Homo sapien
gtttagcaagtcatgcttgaccctg

SEQ ID NO: 326273 - DNA, 25 bp, Homo sapien
aagtcatgcttgaccctgttagtgc

SEQ ID NO: 326274 - DNA, 25 bp, Homo sapien
tattcctacatcatattgaggaagg

SEQ ID NO: 326275 - DNA, 25 bp, Homo sapien
gaagatgttttcctggtgatgcatt

SEQ ID NO: 326276 - DNA, 25 bp, Homo sapien
gttttcctggtgatgcattcacact

SEQ ID NO: 326277 - DNA, 25 bp, Homo sapien
tgatgcattcacactttcaactggc

SEQ ID NO: 326278 - DNA, 25 bp, Homo sapien
cttcctagatcaaagttagtgcctt

SEQ ID NO: 326279 - DNA, 25 bp, Homo sapien
aagttagtgcctttgtgagatggtg

SEQ ID NO: 326280 - DNA, 25 bp, Homo sapien
ctttgtgagatggtggcctgccaga

SEQ ID NO: 326281 - DNA, 25 bp, Homo sapien
ctgccagagtgtggtttgtggtccc

SEQ ID NO: 326282 - DNA, 25 bp, Homo sapien
tgctccacaagttttgcttccagaa

SEQ ID NO: 326283 - DNA, 25 bp, Homo sapien
ccacaagttttgcttccagaagaag

SEQ ID NO: 326284 - DNA, 25 bp, Homo sapien
gaaaagagtcttgtggataccgtat

SEQ ID NO: 326285 - DNA, 25 bp, Homo sapien
gtggataccgtatatgcattaaagg

SEQ ID NO: 326286 - DNA, 25 bp, Homo sapien
gaagaacagagagcccgcaaagacc

SEQ ID NO: 326287 - DNA, 25 bp, Homo sapien
agaagctggtgaggaaagtcctgaa

SEQ ID NO: 326288 - DNA, 25 bp, Homo sapien
agaacatgaatgatcctgcctggga

SEQ ID NO: 326289 - DNA, 25 bp, Homo sapien
cctgcctgggatgagaccaatctat

SEQ ID NO: 326290 - DNA, 25 bp, Homo sapien
gaccaatctataagggacgtcctca

SEQ ID NO: 326291 - DNA, 25 bp, Homo sapien
gacgtcctcagttctttctgttgaa

SEQ ID NO: 326292 - DNA, 25 bp, Homo sapien
cctcagttctttctgttgaagacca

SEQ ID NO: 326293 - DNA, 25 bp, Homo sapien
gaatgcttagggtattgctgcttat

SEQ ID NO: 326294 - DNA, 25 bp, Homo sapien
ggtattgctgcttatttcttactgt

SEQ ID NO: 326295 - DNA, 25 bp, Homo sapien
ttcttactgtactgtggtgtcaaca

SEQ ID NO: 326296 - DNA, 25 bp, Homo sapien
ctgtggtgtcaacatttctaagtgt

SEQ ID NO: 326297 - DNA, 25 bp, Homo sapien
gtgtccataggacttctttgggcct

SEQ ID NO: 326298 - DNA, 25 bp, Homo sapien
taggacttctttgggcctgaatata

SEQ ID NO: 326299 - DNA, 25 bp, Homo sapien
atgtgtttttattctaccagttcta

SEQ ID NO: 326300 - DNA, 25 bp, Homo sapien
ctaccagttctatttgttaactcaa

SEQ ID NO: 326301 - DNA, 25 bp, Homo sapien
gactttcatttactttagagttctt

SEQ ID NO: 326302 - DNA, 25 bp, Homo sapien
atggcctgcctaggagtctttagca

SEQ ID NO: 326303 - DNA, 25 bp, Homo sapien
ctgcctaggagtctttagcatgtag

SEQ ID NO: 326304 - DNA, 25 bp, Homo sapien
tcttgccttcttatcttaatctgcc

SEQ ID NO: 326305 - DNA, 25 bp, Homo sapien
gccttcttatcttaatctgccttta

SEQ ID NO: 326306 - DNA, 25 bp, Homo sapien
agataactcaaagaactgcatcagt

SEQ ID NO: 326307 - DNA, 25 bp, Homo sapien
ttttactcattattaccttagtgta

SEQ ID NO: 326308 - DNA, 25 bp, Homo sapien
agcatgactctaaaggactatatcc

SEQ ID NO: 326309 - DNA, 25 bp, Homo sapien
atatcctttttattagcatggccat

SEQ ID NO: 326310 - DNA, 25 bp, Homo sapien
tggccatataatttttagctacaaa

SEQ ID NO: 326311 - DNA, 25 bp, Homo sapien
aacaaactctgcaatgatgtggaat

SEQ ID NO: 326312 - DNA, 25 bp, Homo sapien
agcagaaaagatcctttgcaggcaa

SEQ ID NO: 326313 - DNA, 25 bp, Homo sapien
atcctttgcaggcaagagactctag

SEQ ID NO: 326314 - DNA, 25 bp, Homo sapien
gagactctagcatatttacctatgt

SEQ ID NO: 326315 - DNA, 25 bp, Homo sapien
gctctcggagtctcaggcagcagga

SEQ ID NO: 326316 - DNA, 25 bp, Homo sapien
cgtgtgagctgtgggcgtcccttta

SEQ ID NO: 326317 - DNA, 25 bp, Homo sapien
gagctgtgggcgtccctttaagagc

SEQ ID NO: 326318 - DNA, 25 bp, Homo sapien
tgtgggcgtccctttaagagcggct

SEQ ID NO: 326319 - DNA, 25 bp, Homo sapien
gcgtccctttaagagcggctggcca

SEQ ID NO: 326320 - DNA, 25 bp, Homo sapien
tcaagcggcgctagctctctggctg

SEQ ID NO: 326321 - DNA, 25 bp, Homo sapien
tcagtacgcggagcgccggcggtca

SEQ ID NO: 326322 - DNA, 25 bp, Homo sapien
ggagcggccagatcgcggcggagtc

SEQ ID NO: 326323 - DNA, 25 bp, Homo sapien
gagtcggcgcgcttccccgagggaa

SEQ ID NO: 326324 - DNA, 25 bp, Homo sapien
gacccggacgcgaggtgccccgaag

SEQ ID NO: 326325 - DNA, 25 bp, Homo sapien
agcggctctcggagtctcaggcagc

SEQ ID NO: 326326 - DNA, 25 bp, Homo sapien
gccagaacacgctgcggagctgtga

SEQ ID NO: 326327 - DNA, 25 bp, Homo sapien
gaacacgctgcggagctgtgatccg

SEQ ID NO: 326328 - DNA, 25 bp, Homo sapien
acacgctgcggagctgtgatccggt

SEQ ID NO: 326329 - DNA, 25 bp, Homo sapien
tgcggagctgtgatccggtgttcta

SEQ ID NO: 326330 - DNA, 25 bp, Homo sapien
cggagctgtgatccggtgttctata

SEQ ID NO: 326331 - DNA, 25 bp, Homo sapien
agctgtgatccggtgttctataggc

SEQ ID NO: 326332 - DNA, 25 bp, Homo sapien
tgtgatccggtgttctataggcagg

SEQ ID NO: 326333 - DNA, 25 bp, Homo sapien
gatccggtgttctataggcaggtgt

SEQ ID NO: 326334 - DNA, 25 bp, Homo sapien
tccggtgttctataggcaggtgttg

SEQ ID NO: 326335 - DNA, 25 bp, Homo sapien
tgttgggtgcagagagcgcccctcc

SEQ ID NO: 326336 - DNA, 25 bp, Homo sapien
ttgggtgcagagagcgcccctcccg

SEQ ID NO: 326337 - DNA, 25 bp, Homo sapien
gtaagttatggttgctcttattctc

SEQ ID NO: 326338 - DNA, 25 bp, Homo sapien
tattctctgaacgtaacagcagctg

SEQ ID NO: 326339 - DNA, 25 bp, Homo sapien
taacagcagctgaagtgaactctaa

SEQ ID NO: 326340 - DNA, 25 bp, Homo sapien
gaactctaattttaggtctgcagtt

SEQ ID NO: 326341 - DNA, 25 bp, Homo sapien
ggtctgcagttttaacatcttccat

SEQ ID NO: 326342 - DNA, 25 bp, Homo sapien
ctaacttcattatagccccagtgtc

SEQ ID NO: 326343 - DNA, 25 bp, Homo sapien
gccccagtgtccaaaggctgaagct

SEQ ID NO: 326344 - DNA, 25 bp, Homo sapien
ggctgaagctaacaactaagtttct

SEQ ID NO: 326345 - DNA, 25 bp, Homo sapien
atgacatactaccagataacaattc

SEQ ID NO: 326346 - DNA, 25 bp, Homo sapien
ctgacattaatcacccagaagtaaa

SEQ ID NO: 326347 - DNA, 25 bp, Homo sapien
tgattagtattcatctgccatcttt

SEQ ID NO: 326348 - DNA, 25 bp, Homo sapien
atctaagatcccaaccagtataaaa

SEQ ID NO: 326349 - DNA, 25 bp, Homo sapien
tatactttgggagccagaacagctg

SEQ ID NO: 326350 - DNA, 25 bp, Homo sapien
gaacagctgtgaggtttaagccaat

SEQ ID NO: 326351 - DNA, 25 bp, Homo sapien
gaaggaaatgacacctcatgcaggc

SEQ ID NO: 326352 - DNA, 25 bp, Homo sapien
catttaatgtcttggtgcctcgatt

SEQ ID NO: 326353 - DNA, 25 bp, Homo sapien
gtgcctcgatttaagaactacccaa

SEQ ID NO: 326354 - DNA, 25 bp, Homo sapien
gaactacccaaaggacacttactat

SEQ ID NO: 326355 - DNA, 25 bp, Homo sapien
aaaggacacttactatcccagccct

SEQ ID NO: 326356 - DNA, 25 bp, Homo sapien
cagccctggtgcatacaacccagag

SEQ ID NO: 326357 - DNA, 25 bp, Homo sapien
agaagccaccgccaaaaattgcctg

SEQ ID NO: 326358 - DNA, 25 bp, Homo sapien
aaatttggatctccagactgggctc

SEQ ID NO: 326359 - DNA, 25 bp, Homo sapien
gaatactttggcctttagaagctta

SEQ ID NO: 326360 - DNA, 25 bp, Homo sapien
ttggcctttagaagcttagtgattt

SEQ ID NO: 326361 - DNA, 25 bp, Homo sapien
tccttggccagaagtatgctttagg

SEQ ID NO: 326362 - DNA, 25 bp, Homo sapien
gtatgctttaggaacttaatcctta

SEQ ID NO: 326363 - DNA, 25 bp, Homo sapien
taatccttattttttagcctctggt

SEQ ID NO: 326364 - DNA, 25 bp, Homo sapien
tttgtgccctgagctactgaaacag

SEQ ID NO: 326365 - DNA, 25 bp, Homo sapien
ggttttgctatacgttgtttcactt

SEQ ID NO: 326366 - DNA, 25 bp, Homo sapien
gttgtttcacttaaaagtcctgatt

SEQ ID NO: 326367 - DNA, 25 bp, Homo sapien
gaaacaggcttcagctacacatgac

SEQ ID NO: 326368 - DNA, 25 bp, Homo sapien
ggcttcagctacacatgacccagaa

SEQ ID NO: 326369 - DNA, 25 bp, Homo sapien
tcagctacacatgacccagaactgg

SEQ ID NO: 326370 - DNA, 25 bp, Homo sapien
atgtatgttcaagtattcaggcgcc

SEQ ID NO: 326371 - DNA, 25 bp, Homo sapien
tgttcaagtattcaggcgccatgtc

SEQ ID NO: 326372 - DNA, 25 bp, Homo sapien
gtattcaggcgccatgtcttatata

SEQ ID NO: 326373 - DNA, 25 bp, Homo sapien
aggcgccatgtcttatatactgaag

SEQ ID NO: 326374 - DNA, 25 bp, Homo sapien
gtataatgactactatggcttcaat

SEQ ID NO: 326375 - DNA, 25 bp, Homo sapien
cttcatttcaccaagcctttactta

SEQ ID NO: 326376 - DNA, 25 bp, Homo sapien
aagcctttacttaaaatcttcagtg

SEQ ID NO: 326377 - DNA, 25 bp, Homo sapien
gtgtcttgtcaaatctagctctgta

SEQ ID NO: 326378 - DNA, 25 bp, Homo sapien
gtcaaatctagctctgtatcagatg

SEQ ID NO: 326379 - DNA, 25 bp, Homo sapien
gtatcagatgctggaatattcctaa

SEQ ID NO: 326380 - DNA, 25 bp, Homo sapien
gaatattcctaacatttgacaaact

SEQ ID NO: 326381 - DNA, 25 bp, Homo sapien
gacctggaacactttaacagaagga

SEQ ID NO: 326382 - DNA, 25 bp, Homo sapien
aaggaaatgccgaagcagcttgcac

SEQ ID NO: 326383 - DNA, 25 bp, Homo sapien
gcagcttgcacagttgctttacaga

SEQ ID NO: 326384 - DNA, 25 bp, Homo sapien
acagttgctttacagacttccaaga

SEQ ID NO: 326385 - DNA, 25 bp, Homo sapien
acttccaagaggctgattctggctt

SEQ ID NO: 326386 - DNA, 25 bp, Homo sapien
gattctggcttcaagatggagcctt

SEQ ID NO: 326387 - DNA, 25 bp, Homo sapien
ttttcttccctcaaagaacctgcgg

SEQ ID NO: 326388 - DNA, 25 bp, Homo sapien
aagaacctgcggttgcgctttgtgt

SEQ ID NO: 326389 - DNA, 25 bp, Homo sapien
gggccccatgggaaagagcttctga

SEQ ID NO: 326390 - DNA, 25 bp, Homo sapien
tttcctttatgaactcccactgtgt

SEQ ID NO: 326391 - DNA, 25 bp, Homo sapien
ccactgtgttcctataaaggccctt

SEQ ID NO: 326392 - DNA, 25 bp, Homo sapien
ggaaaagaccagctatacggagaat

SEQ ID NO: 326393 - DNA, 25 bp, Homo sapien
aagaccagctatacggagaatcatc

SEQ ID NO: 326394 - DNA, 25 bp, Homo sapien
ccagctatacggagaatcatcggta

SEQ ID NO: 326395 - DNA, 25 bp, Homo sapien
tgcgcaaaggcattctggaagagga

SEQ ID NO: 326396 - DNA, 25 bp, Homo sapien
caaaggcattctggaagaggaggct

SEQ ID NO: 326397 - DNA, 25 bp, Homo sapien
ctgtgggatgccagttggtcaatat

SEQ ID NO: 326398 - DNA, 25 bp, Homo sapien
gtgggatgccagttggtcaatattt

SEQ ID NO: 326399 - DNA, 25 bp, Homo sapien
gggatgccagttggtcaatatttgg

SEQ ID NO: 326400 - DNA, 25 bp, Homo sapien
tacggagaatcatcggtatggttag

SEQ ID NO: 326401 - DNA, 25 bp, Homo sapien
gagaatcatcggtatggttagaaga

SEQ ID NO: 326402 - DNA, 25 bp, Homo sapien
atcatcggtatggttagaagatatc

SEQ ID NO: 326403 - DNA, 25 bp, Homo sapien
tgcaccgccatctgttctcatggtg

SEQ ID NO: 326404 - DNA, 25 bp, Homo sapien
gtgctcgtacacgtggatcgtaggc

SEQ ID NO: 326405 - DNA, 25 bp, Homo sapien
acgcagtccatcgtaaacttggtgt

SEQ ID NO: 326406 - DNA, 25 bp, Homo sapien
gtgttgtctaccatgatgagcgcag

SEQ ID NO: 326407 - DNA, 25 bp, Homo sapien
atgagcgcagtgtcgctgaagccct

SEQ ID NO: 326408 - DNA, 25 bp, Homo sapien
cgctgaagccctcggcgattctgga

SEQ ID NO: 326409 - DNA, 25 bp, Homo sapien
aacctggtttggactggcatccttt

SEQ ID NO: 326410 - DNA, 25 bp, Homo sapien
atcctttactcgctcattagcttga

SEQ ID NO: 326411 - DNA, 25 bp, Homo sapien
taaccagcaatcacgtagctatgat

SEQ ID NO: 326412 - DNA, 25 bp, Homo sapien
gtagctatgatctttgcaccatgaa

SEQ ID NO: 326413 - DNA, 25 bp, Homo sapien
caatcagggtgagagccacctccag

SEQ ID NO: 326414 - DNA, 25 bp, Homo sapien
aaacttcttacacctaaaattcatg

SEQ ID NO: 326415 - DNA, 25 bp, Homo sapien
aacttcttacacctaaaattcatgc

SEQ ID NO: 326416 - DNA, 25 bp, Homo sapien
acttcttacacctaaaattcatgca

SEQ ID NO: 326417 - DNA, 25 bp, Homo sapien
cttcttacacctaaaattcatgcag

SEQ ID NO: 326418 - DNA, 25 bp, Homo sapien
ttcttacacctaaaattcatgcagg

SEQ ID NO: 326419 - DNA, 25 bp, Homo sapien
tcttacacctaaaattcatgcagga

SEQ ID NO: 326420 - DNA, 25 bp, Homo sapien
cttacacctaaaattcatgcaggag

SEQ ID NO: 326421 - DNA, 25 bp, Homo sapien
ttacacctaaaattcatgcaggaga

SEQ ID NO: 326422 - DNA, 25 bp, Homo sapien
tactgaaaatgttacaaaccagaaa

SEQ ID NO: 326423 - DNA, 25 bp, Homo sapien
tgtgaaaatgattttaacaaaacct

SEQ ID NO: 326424 - DNA, 25 bp, Homo sapien
cctggagtgcacacagcccagtcgg

SEQ ID NO: 326425 - DNA, 25 bp, Homo sapien
ctggagtgcacacagcccagtcggc

SEQ ID NO: 326426 - DNA, 25 bp, Homo sapien
tggagtgcacacagcccagtcggca

SEQ ID NO: 326427 - DNA, 25 bp, Homo sapien
ggagtgcacacagcccagtcggcac

SEQ ID NO: 326428 - DNA, 25 bp, Homo sapien
acacagcccagtcggcacctggtgg

SEQ ID NO: 326429 - DNA, 25 bp, Homo sapien
agcccagtcggcacctggtggctgg

SEQ ID NO: 326430 - DNA, 25 bp, Homo sapien
gcccagtcggcacctggtggctgga

SEQ ID NO: 326431 - DNA, 25 bp, Homo sapien
cccagtcggcacctggtggctggaa

SEQ ID NO: 326432 - DNA, 25 bp, Homo sapien
cagtcggcacctggtggctggaagc

SEQ ID NO: 326433 - DNA, 25 bp, Homo sapien
agtcggcacctggtggctggaagcc

SEQ ID NO: 326434 - DNA, 25 bp, Homo sapien
tcggcacctggtggctggaagccac

SEQ ID NO: 326435 - DNA, 25 bp, Homo sapien
tggaggcttgtaggacacctactgt

SEQ ID NO: 326436 - DNA, 25 bp, Homo sapien
taggacacctactgtgatggcaaat

SEQ ID NO: 326437 - DNA, 25 bp, Homo sapien
ttgtttctagcaggagagattttaa

SEQ ID NO: 326438 - DNA, 25 bp, Homo sapien
gtgagactatgatattctcccatat

SEQ ID NO: 326439 - DNA, 25 bp, Homo sapien
ttctcccatattatcaaaaacactg

SEQ ID NO: 326440 - DNA, 25 bp, Homo sapien
aaacactgattttcctcaatgtagg

SEQ ID NO: 326441 - DNA, 25 bp, Homo sapien
ggaatagtgcaagcctgtcgaccca

SEQ ID NO: 326442 - DNA, 25 bp, Homo sapien
agcctgtcgacccagctattttaga

SEQ ID NO: 326443 - DNA, 25 bp, Homo sapien
tgtcgacccagctattttagaggct

SEQ ID NO: 326444 - DNA, 25 bp, Homo sapien
gaagtgggagcatcacatgggccca

SEQ ID NO: 326445 - DNA, 25 bp, Homo sapien
tcaagaccaggctttaagagagcct

SEQ ID NO: 326446 - DNA, 25 bp, Homo sapien
ctgtaagatagccagtaacgttgct

SEQ ID NO: 326447 - DNA, 25 bp, Homo sapien
actgaacacttggttgagacttggc

SEQ ID NO: 326448 - DNA, 25 bp, Homo sapien
gagacttggcatcagctaattttcc

SEQ ID NO: 326449 - DNA, 25 bp, Homo sapien
ggcatcagctaattttccagtaatt

SEQ ID NO: 326450 - DNA, 25 bp, Homo sapien
ttccagtaattaaaacagtgtcttc

SEQ ID NO: 326451 - DNA, 25 bp, Homo sapien
cagtgtcttcaaatagccatatatt

SEQ ID NO: 326452 - DNA, 25 bp, Homo sapien
atatttgcttggctttgcgggaaca

SEQ ID NO: 326453 - DNA, 25 bp, Homo sapien
atatattggcattcttctggttttc

SEQ ID NO: 326454 - DNA, 25 bp, Homo sapien
gcattcttctggttttccaaggcag

SEQ ID NO: 326455 - DNA, 25 bp, Homo sapien
gggtcaacacgtagccatctttgta

SEQ ID NO: 326456 - DNA, 25 bp, Homo sapien
cacgtagccatctttgtaagcaata

SEQ ID NO: 326457 - DNA, 25 bp, Homo sapien
ttttttcccaaagcgcatgtctacg

SEQ ID NO: 326458 - DNA, 25 bp, Homo sapien
aaagcgcatgtctacgccaggcaga

SEQ ID NO: 326459 - DNA, 25 bp, Homo sapien
catgtctacgccaggcagaggagta

SEQ ID NO: 326460 - DNA, 25 bp, Homo sapien
gcagaggagtaattattcagccaat

SEQ ID NO: 326461 - DNA, 25 bp, Homo sapien
cagccaatttcatggatgtaacgat

SEQ ID NO: 326462 - DNA, 25 bp, Homo sapien
attgatagcacctagaggcttccag

SEQ ID NO: 326463 - DNA, 25 bp, Homo sapien
gcacctagaggcttccagtttgggt

SEQ ID NO: 326464 - DNA, 25 bp, Homo sapien
gggaactcactcacttgagaaatga

SEQ ID NO: 326465 - DNA, 25 bp, Homo sapien
gttctcttctatgaaactattacta

SEQ ID NO: 326466 - DNA, 25 bp, Homo sapien
aactattactatttagttctctgga

SEQ ID NO: 326467 - DNA, 25 bp, Homo sapien
tagttctctggaaaacttaagtgta

SEQ ID NO: 326468 - DNA, 25 bp, Homo sapien
tctggtactaccttgcggttgccac

SEQ ID NO: 326469 - DNA, 25 bp, Homo sapien
gccaccactgcaacctgaggaggat

SEQ ID NO: 326470 - DNA, 25 bp, Homo sapien
tgatgacttatctcagggctatgat

SEQ ID NO: 326471 - DNA, 25 bp, Homo sapien
ggctatgatagctcagaaagggact

SEQ ID NO: 326472 - DNA, 25 bp, Homo sapien
gaaagggacttctcactcattgatg

SEQ ID NO: 326473 - DNA, 25 bp, Homo sapien
gacttctcactcattgatgatccta

SEQ ID NO: 326474 - DNA, 25 bp, Homo sapien
gatgatcctatgatgccagctaact

SEQ ID NO: 326475 - DNA, 25 bp, Homo sapien
tgccagctaactcagactccagtga

SEQ ID NO: 326476 - DNA, 25 bp, Homo sapien
catgggccccattgcttgggcggct

SEQ ID NO: 326477 - DNA, 25 bp, Homo sapien
gcttgggcggctgctgtattttcat

SEQ ID NO: 326478 - DNA, 25 bp, Homo sapien
tactctggcccttggactatggaaa

SEQ ID NO: 326479 - DNA, 25 bp, Homo sapien
tttgctctccacctaacaagggaca

SEQ ID NO: 326480 - DNA, 25 bp, Homo sapien
atagattgtcttcctattaagtatg

SEQ ID NO: 326481 - DNA, 25 bp, Homo sapien
gataatatgagacccaaccctaact

SEQ ID NO: 326482 - DNA, 25 bp, Homo sapien
caaccctaacttgccagaagagtaa

SEQ ID NO: 326483 - DNA, 25 bp, Homo sapien
gaagagtaatcagttcatgaaccat

SEQ ID NO: 326484 - DNA, 25 bp, Homo sapien
catgaaccattgatatttcctgtat

SEQ ID NO: 326485 - DNA, 25 bp, Homo sapien
gatatttcctgtatatttcatgaat

SEQ ID NO: 326486 - DNA, 25 bp, Homo sapien
gtgacttcagtcattctagtgttaa

SEQ ID NO: 326487 - DNA, 25 bp, Homo sapien
gttaatactgtggaatgtcattggt

SEQ ID NO: 326488 - DNA, 25 bp, Homo sapien
gtcattggtgtagcaacgtgggttc

SEQ ID NO: 326489 - DNA, 25 bp, Homo sapien
gcaacgtgggttcaccaaaacacct

SEQ ID NO: 326490 - DNA, 25 bp, Homo sapien
ggcctgtggtcacccatccatcata

SEQ ID NO: 326491 - DNA, 25 bp, Homo sapien
atccatcataggtctggtctgcata

SEQ ID NO: 326492 - DNA, 25 bp, Homo sapien
gtctgcatagcctccattttcaatg

SEQ ID NO: 326493 - DNA, 25 bp, Homo sapien
ttttcaatgagtccatcatggtcct

SEQ ID NO: 326494 - DNA, 25 bp, Homo sapien
tgctcccatgccgtgtaatagacaa

SEQ ID NO: 326495 - DNA, 25 bp, Homo sapien
atgagtccatcatggtccttgtcaa

SEQ ID NO: 326496 - DNA, 25 bp, Homo sapien
tggtccttgtcaaacttcatttcag

SEQ ID NO: 326497 - DNA, 25 bp, Homo sapien
tcatttcagattccatcacagccta

SEQ ID NO: 326498 - DNA, 25 bp, Homo sapien
caagatgttgaagacctaggtaccg

SEQ ID NO: 326499 - DNA, 25 bp, Homo sapien
gtcattctttcttgagccctacaat

SEQ ID NO: 326500 - DNA, 25 bp, Homo sapien
tcttgagccctacaatcccttgttg

SEQ ID NO: 326501 - DNA, 25 bp, Homo sapien
ggcccaaaaaacatgcagacctctg

SEQ ID NO: 326502 - DNA, 25 bp, Homo sapien
atgcagacctctggccggctgagca

SEQ ID NO: 326503 - DNA, 25 bp, Homo sapien
tgcattctccggaagaatcctccat

SEQ ID NO: 326504 - DNA, 25 bp, Homo sapien
atcagcccgaaatggcggccatgag

SEQ ID NO: 326505 - DNA, 25 bp, Homo sapien
gagactgatgcccaaattcttgaac

SEQ ID NO: 326506 - DNA, 25 bp, Homo sapien
ttcttgaactcaaccaacagctggt

SEQ ID NO: 326507 - DNA, 25 bp, Homo sapien
aaggaacgtgacttctacttcagca

SEQ ID NO: 326508 - DNA, 25 bp, Homo sapien
gacttctacttcagcaaacttcgtg

SEQ ID NO: 326509 - DNA, 25 bp, Homo sapien
aacttcgtgacatcgagctcatctg

SEQ ID NO: 326510 - DNA, 25 bp, Homo sapien
aaaacagccctgttatctcaggcat

SEQ ID NO: 326511 - DNA, 25 bp, Homo sapien
tcaggcatcattggcatcctctatg

SEQ ID NO: 326512 - DNA, 25 bp, Homo sapien
cttaaagattgcactgagcttgtct

SEQ ID NO: 326513 - DNA, 25 bp, Homo sapien
gcactgagcttgtcttaaagcaact

SEQ ID NO: 326514 - DNA, 25 bp, Homo sapien
ggaaatgaaacctaccgtcagtctg

SEQ ID NO: 326515 - DNA, 25 bp, Homo sapien
tgaaacctaccgtcagtctgaaaaa

SEQ ID NO: 326516 - DNA, 25 bp, Homo sapien
cattcaaatgatccagatatgtctg

SEQ ID NO: 326517 - DNA, 25 bp, Homo sapien
agatatcagtataggtaaagccaca

SEQ ID NO: 326518 - DNA, 25 bp, Homo sapien
aaagccacaggcagaggtcagtact

SEQ ID NO: 326519 - DNA, 25 bp, Homo sapien
cacaggcagaggtcagtactgataa

SEQ ID NO: 326520 - DNA, 25 bp, Homo sapien
ggaagccatcaagcatgctagaatt

SEQ ID NO: 326521 - DNA, 25 bp, Homo sapien
gcatgctagaattgtgaaactttca

SEQ ID NO: 326522 - DNA, 25 bp, Homo sapien
gttgacatgaattaacctggccaaa

SEQ ID NO: 326523 - DNA, 25 bp, Homo sapien
tgtgtcactgaggtgcagccccagt

SEQ ID NO: 326524 - DNA, 25 bp, Homo sapien
gcagccccagtgaaatgaactcaga

SEQ ID NO: 326525 - DNA, 25 bp, Homo sapien
aagcctccagtgtttataccactga

SEQ ID NO: 326526 - DNA, 25 bp, Homo sapien
gtctggagtgctgcatgtaaagcta

SEQ ID NO: 326527 - DNA, 25 bp, Homo sapien
catgtaaagctaggcactccccagt

SEQ ID NO: 326528 - DNA, 25 bp, Homo sapien
tccccagtgatggagcttccagctg

SEQ ID NO: 326529 - DNA, 25 bp, Homo sapien
taccattcggtgcacaagtgtccct

SEQ ID NO: 326530 - DNA, 25 bp, Homo sapien
acaagtgtccctgaacttcggtgaa

SEQ ID NO: 326531 - DNA, 25 bp, Homo sapien
acttcggtgaagtatgagccaccaa

SEQ ID NO: 326532 - DNA, 25 bp, Homo sapien
tccgcccaagggtgaccacagaagt

SEQ ID NO: 326533 - DNA, 25 bp, Homo sapien
gaaccagaaacatcaaccagcaacc

SEQ ID NO: 326534 - DNA, 25 bp, Homo sapien
gtgcaatattttgcaaacagctctt

SEQ ID NO: 326535 - DNA, 25 bp, Homo sapien
gcaaacagctcttcttagggaaatc

SEQ ID NO: 326536 - DNA, 25 bp, Homo sapien
gctcttcttagggaaatctcctgaa

SEQ ID NO: 326537 - DNA, 25 bp, Homo sapien
agaatgttccatagtctgagagaat

SEQ ID NO: 326538 - DNA, 25 bp, Homo sapien
aatggaatcgttgagcatttagtac

SEQ ID NO: 326539 - DNA, 25 bp, Homo sapien
tagtacaagtccagtgtgtgtgagc

SEQ ID NO: 326540 - DNA, 25 bp, Homo sapien
gagcgggacttaggcagctcaagct

SEQ ID NO: 326541 - DNA, 25 bp, Homo sapien
ttaggcagctcaagcttgctttttt

SEQ ID NO: 326542 - DNA, 25 bp, Homo sapien
aagcgtacaattgagtggttttagt

SEQ ID NO: 326543 - DNA, 25 bp, Homo sapien
tatctaattccagactcacgctttt

SEQ ID NO: 326544 - DNA, 25 bp, Homo sapien
tccagactcacgcttttttaaacaa

SEQ ID NO: 326545 - DNA, 25 bp, Homo sapien
ggttattccaggagagttgatgacc

SEQ ID NO: 326546 - DNA, 25 bp, Homo sapien
gatgaccttcatttaaagtccaact

SEQ ID NO: 326547 - DNA, 25 bp, Homo sapien
gaaaacatctttgcaatatttactt

SEQ ID NO: 326548 - DNA, 25 bp, Homo sapien
ttctgtttgccgtaaatagtaacat

SEQ ID NO: 326549 - DNA, 25 bp, Homo sapien
gttataaaacagttgcattcacaat

SEQ ID NO: 326550 - DNA, 25 bp, Homo sapien
gcattcacaatattattggcctgag

SEQ ID NO: 326551 - DNA, 25 bp, Homo sapien
tattggcctgagatattgatgatat

SEQ ID NO: 326552 - DNA, 25 bp, Homo sapien
aaatgtgtacattccctgtgcaaca

SEQ ID NO: 326553 - DNA, 25 bp, Homo sapien
gtacattccctgtgcaacatcagat

SEQ ID NO: 326554 - DNA, 25 bp, Homo sapien
gaagcacttactgaaatcgctggta

SEQ ID NO: 326555 - DNA, 25 bp, Homo sapien
gaaatcgctggtactctgaataaat

SEQ ID NO: 326556 - DNA, 25 bp, Homo sapien
ggctgaggcctctgctactggctgc

SEQ ID NO: 326557 - DNA, 25 bp, Homo sapien
cctttccatccagtggctgctgttt

SEQ ID NO: 326558 - DNA, 25 bp, Homo sapien
aaatgcttgggacaggagtgttaca

SEQ ID NO: 326559 - DNA, 25 bp, Homo sapien
gcttgggacaggagtgttacagatt

SEQ ID NO: 326560 - DNA, 25 bp, Homo sapien
caggagtgttacagattttggattt

SEQ ID NO: 326561 - DNA, 25 bp, Homo sapien
aggtatcttggtaggtctcatgtct

SEQ ID NO: 326562 - DNA, 25 bp, Homo sapien
gtatcttggtaggtctcatgtctaa

SEQ ID NO: 326563 - DNA, 25 bp, Homo sapien
cttggtaggtctcatgtctaaacat

SEQ ID NO: 326564 - DNA, 25 bp, Homo sapien
ggtaggtctcatgtctaaacatgaa

SEQ ID NO: 326565 - DNA, 25 bp, Homo sapien
tataccttatacatgtagcctgaag

SEQ ID NO: 326566 - DNA, 25 bp, Homo sapien
agcctgaaggtaactctatacagta

SEQ ID NO: 326567 - DNA, 25 bp, Homo sapien
ttattttgctcttgcacagcttaat

SEQ ID NO: 326568 - DNA, 25 bp, Homo sapien
ttttgctcttgcacagcttaattgc

SEQ ID NO: 326569 - DNA, 25 bp, Homo sapien
ttgctcttgcacagcttaattgcag

SEQ ID NO: 326570 - DNA, 25 bp, Homo sapien
gctcttgcacagcttaattgcagtg

SEQ ID NO: 326571 - DNA, 25 bp, Homo sapien
cttgcacagcttaattgcagtggac

SEQ ID NO: 326572 - DNA, 25 bp, Homo sapien
gcacagcttaattgcagtggacaat

SEQ ID NO: 326573 - DNA, 25 bp, Homo sapien
acagcttaattgcagtggacaatcc

SEQ ID NO: 326574 - DNA, 25 bp, Homo sapien
acagaagggtagaggttcctgcaga

SEQ ID NO: 326575 - DNA, 25 bp, Homo sapien
aagggtagaggttcctgcagagcat

SEQ ID NO: 326576 - DNA, 25 bp, Homo sapien
ggttcctgcagagcatgagatagtt

SEQ ID NO: 326577 - DNA, 25 bp, Homo sapien
tcctgcagagcatgagatagttata

SEQ ID NO: 326578 - DNA, 25 bp, Homo sapien
aagtcatccatgctacataccaacc

SEQ ID NO: 326579 - DNA, 25 bp, Homo sapien
ttcctccagtgtatgctgagtccta

SEQ ID NO: 326580 - DNA, 25 bp, Homo sapien
gagtcctacaatctgagcactgctt

SEQ ID NO: 326581 - DNA, 25 bp, Homo sapien
gagcactgcttcaagaggatgcctt

SEQ ID NO: 326582 - DNA, 25 bp, Homo sapien
agaggatgccttgagtcatttttcc

SEQ ID NO: 326583 - DNA, 25 bp, Homo sapien
aatttgcttatgcttctaacctcca

SEQ ID NO: 326584 - DNA, 25 bp, Homo sapien
acacataattccttgttgtcccctt

SEQ ID NO: 326585 - DNA, 25 bp, Homo sapien
tacagtccccgttacactgggaatg

SEQ ID NO: 326586 - DNA, 25 bp, Homo sapien
ttgtccccttcctgagttaatagtt

SEQ ID NO: 326587 - DNA, 25 bp, Homo sapien
aatttgtagtttcctgagccacaga

SEQ ID NO: 326588 - DNA, 25 bp, Homo sapien
gagccacagacttcacttggaatga

SEQ ID NO: 326589 - DNA, 25 bp, Homo sapien
agatccgctgcttctgtggaagtga

SEQ ID NO: 326590 - DNA, 25 bp, Homo sapien
agcgggtgctgcttctagtggcctt

SEQ ID NO: 326591 - DNA, 25 bp, Homo sapien
cagaggctgccaaaatcctgacaat

SEQ ID NO: 326592 - DNA, 25 bp, Homo sapien
atcctgacaatatctacactgggtg

SEQ ID NO: 326593 - DNA, 25 bp, Homo sapien
acactgggtggaagccattacctac

SEQ ID NO: 326594 - DNA, 25 bp, Homo sapien
cattacctactgttggaccgggtgt

SEQ ID NO: 326595 - DNA, 25 bp, Homo sapien
accgggtgtctcagattcttcaaga

SEQ ID NO: 326596 - DNA, 25 bp, Homo sapien
gtgactatgcttcatcagagtggaa

SEQ ID NO: 326597 - DNA, 25 bp, Homo sapien
agccagtgcctttggagtactgagg

SEQ ID NO: 326598 - DNA, 25 bp, Homo sapien
tactgaggcgcgcacagagtcctta

SEQ ID NO: 326599 - DNA, 25 bp, Homo sapien
acagagtccttagcccggcgcaggg

SEQ ID NO: 326600 - DNA, 25 bp, Homo sapien
tacctcggatcatgggtgggctcta

SEQ ID NO: 326601 - DNA, 25 bp, Homo sapien
gagaatgggccaaatacagcaattt

SEQ ID NO: 326602 - DNA, 25 bp, Homo sapien
attttgatgttgctacccatgttcc

SEQ ID NO: 326603 - DNA, 25 bp, Homo sapien
atgttcccctgatattctatgttcc

SEQ ID NO: 326604 - DNA, 25 bp, Homo sapien
tctatgttcctggaaggacggcttc

SEQ ID NO: 326605 - DNA, 25 bp, Homo sapien
aaggacggcttcacttccggaggca

SEQ ID NO: 326606 - DNA, 25 bp, Homo sapien
aggcaggcgagaagcttttccctta

SEQ ID NO: 326607 - DNA, 25 bp, Homo sapien
tgattccgcctcacagttgatggag

SEQ ID NO: 326608 - DNA, 25 bp, Homo sapien
caggcaggcaatccatggaccttgt

SEQ ID NO: 326609 - DNA, 25 bp, Homo sapien
ggaccttgtggaacttgtgtctctt

SEQ ID NO: 326610 - DNA, 25 bp, Homo sapien
tcccacgctggctggacttgcagga

SEQ ID NO: 326611 - DNA, 25 bp, Homo sapien
tttggaaaacaatcggctaaccttg

SEQ ID NO: 326612 - DNA, 25 bp, Homo sapien
acaatcggctaaccttgacatttct

SEQ ID NO: 326613 - DNA, 25 bp, Homo sapien
ttcatatgccactatctcggtagtt

SEQ ID NO: 326614 - DNA, 25 bp, Homo sapien
atgccactatctcggtagttcaaaa

SEQ ID NO: 326615 - DNA, 25 bp, Homo sapien
taaattgccttgaagtttaccttgt

SEQ ID NO: 326616 - DNA, 25 bp, Homo sapien
ccttgtgctggagagccttatgata

SEQ ID NO: 326617 - DNA, 25 bp, Homo sapien
gagagccttatgataactccaaaga

SEQ ID NO: 326618 - DNA, 25 bp, Homo sapien
gataactccaaagactttcttacgg

SEQ ID NO: 326619 - DNA, 25 bp, Homo sapien
gactttcttacggtataatacatgt

SEQ ID NO: 326620 - DNA, 25 bp, Homo sapien
catgttgtttaggattgtgtttctt

SEQ ID NO: 326621 - DNA, 25 bp, Homo sapien
taggattgtgtttcttagtcactga

SEQ ID NO: 326622 - DNA, 25 bp, Homo sapien
atttgggagtctgcctggttgctgc

SEQ ID NO: 326623 - DNA, 25 bp, Homo sapien
tgggagtctgcctggttgctgcctc

SEQ ID NO: 326624 - DNA, 25 bp, Homo sapien
gatgggtcccactccctgtgggctc

SEQ ID NO: 326625 - DNA, 25 bp, Homo sapien
gcttgtgcttggcagttcctgtgct

SEQ ID NO: 326626 - DNA, 25 bp, Homo sapien
tggcagttcctgtgctgtcctgtct

SEQ ID NO: 326627 - DNA, 25 bp, Homo sapien
gttcctgtgctgtcctgtctcccag

SEQ ID NO: 326628 - DNA, 25 bp, Homo sapien
gatcctgagaccctggctgagaact

SEQ ID NO: 326629 - DNA, 25 bp, Homo sapien
ctgagaccctggctgagaacttggc

SEQ ID NO: 326630 - DNA, 25 bp, Homo sapien
agaccctggctgagaacttggccca

SEQ ID NO: 326631 - DNA, 25 bp, Homo sapien
tgggttgccctcagacccaagccat

SEQ ID NO: 326632 - DNA, 25 bp, Homo sapien
tcagacccaagccattgttagcagc

SEQ ID NO: 326633 - DNA, 25 bp, Homo sapien
gccttcacctgcagtcgcctagaaa

SEQ ID NO: 326634 - DNA, 25 bp, Homo sapien
cagtcgcctagaaaacttgctctca

SEQ ID NO: 326635 - DNA, 25 bp, Homo sapien
gtcgcctagaaaacttgctctcaaa

SEQ ID NO: 326636 - DNA, 25 bp, Homo sapien
gaaaacttgctctcaaacttcaggg

SEQ ID NO: 326637 - DNA, 25 bp, Homo sapien
aaacttgctctcaaacttcagggtt

SEQ ID NO: 326638 - DNA, 25 bp, Homo sapien
tttggaccaaagtctcatttctgtg

SEQ ID NO: 326639 - DNA, 25 bp, Homo sapien
ggaccaaagtctcatttctgtgttt

SEQ ID NO: 326640 - DNA, 25 bp, Homo sapien
gttttgcctgcctctgatgctggga

SEQ ID NO: 326641 - DNA, 25 bp, Homo sapien
ctgcctctgatgctgggacccggaa

SEQ ID NO: 326642 - DNA, 25 bp, Homo sapien
tccgtaaaagcgtgtaacaagggtg

SEQ ID NO: 326643 - DNA, 25 bp, Homo sapien
aagcgtgtaacaagggtgtaaatat

SEQ ID NO: 326644 - DNA, 25 bp, Homo sapien
attcattatgcgttgtgaagtcaga

SEQ ID NO: 326645 - DNA, 25 bp, Homo sapien
tcattatgcgttgtgaagtcagaaa

SEQ ID NO: 326646 - DNA, 25 bp, Homo sapien
ttatgcgttgtgaagtcagaaagta

SEQ ID NO: 326647 - DNA, 25 bp, Homo sapien
gaagtattcgaagtatagttccatt

SEQ ID NO: 326648 - DNA, 25 bp, Homo sapien
gtattcgaagtatagttccattttt

SEQ ID NO: 326649 - DNA, 25 bp, Homo sapien
tcgaagtatagttccattttttgag

SEQ ID NO: 326650 - DNA, 25 bp, Homo sapien
ggagttatagatatccagatagaaa

SEQ ID NO: 326651 - DNA, 25 bp, Homo sapien
gatatccagatagaaacagtagtta

SEQ ID NO: 326652 - DNA, 25 bp, Homo sapien
gaaacagtagttatctttgggtaga

SEQ ID NO: 326653 - DNA, 25 bp, Homo sapien
taatgagtgatctttacttttttac

SEQ ID NO: 326654 - DNA, 25 bp, Homo sapien
gcaagtgattgattggaaaacatac

SEQ ID NO: 326655 - DNA, 25 bp, Homo sapien
tttgtttgtgttgctgctgcctcaa

SEQ ID NO: 326656 - DNA, 25 bp, Homo sapien
ttgtgttgctgctgcctcaactggg

SEQ ID NO: 326657 - DNA, 25 bp, Homo sapien
gtggcctcacgctgtgaaactggga

SEQ ID NO: 326658 - DNA, 25 bp, Homo sapien
tcacgctgtgaaactgggaccagta

SEQ ID NO: 326659 - DNA, 25 bp, Homo sapien
aactgggaccagtactgtgcgttgg

SEQ ID NO: 326660 - DNA, 25 bp, Homo sapien
tttggtgggcagacttgtcatggac

SEQ ID NO: 326661 - DNA, 25 bp, Homo sapien
cttgtcatggactgtggttcgtgga

SEQ ID NO: 326662 - DNA, 25 bp, Homo sapien
atggactgtggttcgtggagacttt

SEQ ID NO: 326663 - DNA, 25 bp, Homo sapien
actacctgagcggagctggtcatca

SEQ ID NO: 326664 - DNA, 25 bp, Homo sapien
gagcggagctggtcatcatagctgc

SEQ ID NO: 326665 - DNA, 25 bp, Homo sapien
agcatgaggaggaggcagtacccca

SEQ ID NO: 326666 - DNA, 25 bp, Homo sapien
gtcaaagaccttggtgtctgcctta

SEQ ID NO: 326667 - DNA, 25 bp, Homo sapien
ttggtgtctgccttaggtccactgc

SEQ ID NO: 326668 - DNA, 25 bp, Homo sapien
ttaggtccactgctctttgcgccat

SEQ ID NO: 326669 - DNA, 25 bp, Homo sapien
ctttgcgccattcaaagctgtgggc

SEQ ID NO: 326670 - DNA, 25 bp, Homo sapien
gtgggctgataaccacagcacaagc

SEQ ID NO: 326671 - DNA, 25 bp, Homo sapien
gataaccacagcacaagctgctgag

SEQ ID NO: 326672 - DNA, 25 bp, Homo sapien
atagttctctccacctcgttatggt

SEQ ID NO: 326673 - DNA, 25 bp, Homo sapien
gttatggtccctgtccctagggcat

SEQ ID NO: 326674 - DNA, 25 bp, Homo sapien
tgagcctacacctcggcggcgttgg

SEQ ID NO: 326675 - DNA, 25 bp, Homo sapien
gcggcgttgggatgaactgacaatt

SEQ ID NO: 326676 - DNA, 25 bp, Homo sapien
tgaactgacaattataccaggaggg

SEQ ID NO: 326677 - DNA, 25 bp, Homo sapien
gcggtttctcccttggaagtggaag

SEQ ID NO: 326678 - DNA, 25 bp, Homo sapien
aaagagggccttgcacgccaagcgg

SEQ ID NO: 326679 - DNA, 25 bp, Homo sapien
gatctgcttccaggttcccggtcta

SEQ ID NO: 326680 - DNA, 25 bp, Homo sapien
tgcttccaggttcccggtctagggc

SEQ ID NO: 326681 - DNA, 25 bp, Homo sapien
tctagggccggtctagggcagctaa

SEQ ID NO: 326682 - DNA, 25 bp, Homo sapien
tctagggcagctaagcctgcctgct

SEQ ID NO: 326683 - DNA, 25 bp, Homo sapien
tcctttccatcctccctggtcaggg

SEQ ID NO: 326684 - DNA, 25 bp, Homo sapien
gagcccaacagcaacgcgagggcac

SEQ ID NO: 326685 - DNA, 25 bp, Homo sapien
aacagcaacgcgagggcacccgacc

SEQ ID NO: 326686 - DNA, 25 bp, Homo sapien
gcggaccacgcggaaacctagctgg

SEQ ID NO: 326687 - DNA, 25 bp, Homo sapien
ggaccacgcggaaacctagctgggc

SEQ ID NO: 326688 - DNA, 25 bp, Homo sapien
tgagtgacccagtagtgaccgggat

SEQ ID NO: 326689 - DNA, 25 bp, Homo sapien
gtgacccagtagtgaccgggataga

SEQ ID NO: 326690 - DNA, 25 bp, Homo sapien
ttgcgcaccagatcgtgcgccacga

SEQ ID NO: 326691 - DNA, 25 bp, Homo sapien
acgacgacctcctgctgggcgacta

SEQ ID NO: 326692 - DNA, 25 bp, Homo sapien
agccgaacgaggaggcctgacgccc

SEQ ID NO: 326693 - DNA, 25 bp, Homo sapien
atagaggtctgagcctggaaaggca

SEQ ID NO: 326694 - DNA, 25 bp, Homo sapien
tctgagcctggaaaggcagctgtga

SEQ ID NO: 326695 - DNA, 25 bp, Homo sapien
gagactgagcacatagtggctcatc

SEQ ID NO: 326696 - DNA, 25 bp, Homo sapien
agcacatagtggctcatcgcggtca

SEQ ID NO: 326697 - DNA, 25 bp, Homo sapien
atagtggctcatcgcggtcacggac

SEQ ID NO: 326698 - DNA, 25 bp, Homo sapien
gctcatcgcggtcacggacttccag

SEQ ID NO: 326699 - DNA, 25 bp, Homo sapien
accccattcccgaggagctttatga

SEQ ID NO: 326700 - DNA, 25 bp, Homo sapien
cccattcccgaggagctttatgaga

SEQ ID NO: 326701 - DNA, 25 bp, Homo sapien
attcccgaggagctttatgagatgc

SEQ ID NO: 326702 - DNA, 25 bp, Homo sapien
cccgaggagctttatgagatgctga

SEQ ID NO: 326703 - DNA, 25 bp, Homo sapien
gctttatgagatgctgagtgaccac

SEQ ID NO: 326704 - DNA, 25 bp, Homo sapien
ctttatgagatgctgagtgaccact

SEQ ID NO: 326705 - DNA, 25 bp, Homo sapien
tatgagatgctgagtgaccactcga

SEQ ID NO: 326706 - DNA, 25 bp, Homo sapien
agatgctgagtgaccactcgatccg

SEQ ID NO: 326707 - DNA, 25 bp, Homo sapien
atgctgagtgaccactcgatccgct

SEQ ID NO: 326708 - DNA, 25 bp, Homo sapien
tgagtgaccactcgatccgctcctt

SEQ ID NO: 326709 - DNA, 25 bp, Homo sapien
gtgaccactcgatccgctcctttga

SEQ ID NO: 326710 - DNA, 25 bp, Homo sapien
tgctaagtgtatgcaggttctaggc

SEQ ID NO: 326711 - DNA, 25 bp, Homo sapien
agatcaaatctggaatgcaaactgt

SEQ ID NO: 326712 - DNA, 25 bp, Homo sapien
atctggaatgcaaactgtgggacac

SEQ ID NO: 326713 - DNA, 25 bp, Homo sapien
gaatgcaaactgtgggacacaaacc

SEQ ID NO: 326714 - DNA, 25 bp, Homo sapien
gacacaaaccacaaatgatgcccag

SEQ ID NO: 326715 - DNA, 25 bp, Homo sapien
aaaccacaaatgatgcccagccttt

SEQ ID NO: 326716 - DNA, 25 bp, Homo sapien
aaatgatgcccagcctttaatactt

SEQ ID NO: 326717 - DNA, 25 bp, Homo sapien
gatgcccagcctttaatactttctt

SEQ ID NO: 326718 - DNA, 25 bp, Homo sapien
gcccagcctttaatactttctttca

SEQ ID NO: 326719 - DNA, 25 bp, Homo sapien
ctttaatactttctttcattgtttg

SEQ ID NO: 326720 - DNA, 25 bp, Homo sapien
ctttcattgtttgtcatatagaaga

SEQ ID NO: 326721 - DNA, 25 bp, Homo sapien
cctgacaccctgaaaagggcgccgg

SEQ ID NO: 326722 - DNA, 25 bp, Homo sapien
tgacaccctgaaaagggcgccggcc

SEQ ID NO: 326723 - DNA, 25 bp, Homo sapien
ttctcgacacactcggcctgggtgg

SEQ ID NO: 326724 - DNA, 25 bp, Homo sapien
gtagacaggagggtgcgcaggtcct

SEQ ID NO: 326725 - DNA, 25 bp, Homo sapien
gcgtttctggcttcggtctgctgga

SEQ ID NO: 326726 - DNA, 25 bp, Homo sapien
tttctggcttcggtctgctggagcg

SEQ ID NO: 326727 - DNA, 25 bp, Homo sapien
ttcggtctgctggagcggaacgccc

SEQ ID NO: 326728 - DNA, 25 bp, Homo sapien
cgcaggtcctggagggcaaagcact

SEQ ID NO: 326729 - DNA, 25 bp, Homo sapien
gtcctggagggcaaagcactcctgt

SEQ ID NO: 326730 - DNA, 25 bp, Homo sapien
tggagggcaaagcactcctgtcccg

SEQ ID NO: 326731 - DNA, 25 bp, Homo sapien
agggcaaagcactcctgtcccgctg

SEQ ID NO: 326732 - DNA, 25 bp, Homo sapien
tgcagagttggaaacccaaggtcca

SEQ ID NO: 326733 - DNA, 25 bp, Homo sapien
cagtaagcactgttagagcccatca

SEQ ID NO: 326734 - DNA, 25 bp, Homo sapien
tagagcccatcagatcttcctaaat

SEQ ID NO: 326735 - DNA, 25 bp, Homo sapien
gaaatctgggacatgtctctcccaa

SEQ ID NO: 326736 - DNA, 25 bp, Homo sapien
acatgtctctcccaattatctcgtt

SEQ ID NO: 326737 - DNA, 25 bp, Homo sapien
ctcccaattatctcgttcactgaaa

SEQ ID NO: 326738 - DNA, 25 bp, Homo sapien
agtgattagtgacctctgagtgatt

SEQ ID NO: 326739 - DNA, 25 bp, Homo sapien
gtgacctctgagtgattagccatat

SEQ ID NO: 326740 - DNA, 25 bp, Homo sapien
gtgattagccatatgatgcccaacg

SEQ ID NO: 326741 - DNA, 25 bp, Homo sapien
atatgatgcccaacgctgagctcta

SEQ ID NO: 326742 - DNA, 25 bp, Homo sapien
aacgctgagctctacctcagacatt

SEQ ID NO: 326743 - DNA, 25 bp, Homo sapien
ccagcgacgtctgcagatgtacggt

SEQ ID NO: 326744 - DNA, 25 bp, Homo sapien
gtctgcagatgtacggtgaccacct

SEQ ID NO: 326745 - DNA, 25 bp, Homo sapien
tgtacggtgaccacctggcccttga

SEQ ID NO: 326746 - DNA, 25 bp, Homo sapien
agtgggacactgagatccagggcct

SEQ ID NO: 326747 - DNA, 25 bp, Homo sapien
cagaatgtccagccactcttctggg

SEQ ID NO: 326748 - DNA, 25 bp, Homo sapien
ctcgggctccatggcagcaaggaac

SEQ ID NO: 326749 - DNA, 25 bp, Homo sapien
gggctccatggcagcaaggaactct

SEQ ID NO: 326750 - DNA, 25 bp, Homo sapien
gatccagggcctgtatgacgtcaca

SEQ ID NO: 326751 - DNA, 25 bp, Homo sapien
agggcctgtatgacgtcacagtcac

SEQ ID NO: 326752 - DNA, 25 bp, Homo sapien
tgacgtcacagtcacccagagtgaa

SEQ ID NO: 326753 - DNA, 25 bp, Homo sapien
agtcacccagagtgaacaccagctc

SEQ ID NO: 326754 - DNA, 25 bp, Homo sapien
ttgtataatgtggttgcaaactctt

SEQ ID NO: 326755 - DNA, 25 bp, Homo sapien
gtataatgtggttgcaaactcttaa

SEQ ID NO: 326756 - DNA, 25 bp, Homo sapien
taatgtggttgcaaactcttaattt

SEQ ID NO: 326757 - DNA, 25 bp, Homo sapien
gtggttgcaaactcttaatttatac

SEQ ID NO: 326758 - DNA, 25 bp, Homo sapien
ggttgcaaactcttaatttatacta

SEQ ID NO: 326759 - DNA, 25 bp, Homo sapien
aactcttaatttatactattgcact

SEQ ID NO: 326760 - DNA, 25 bp, Homo sapien
cttaatttatactattgcactttta

SEQ ID NO: 326761 - DNA, 25 bp, Homo sapien
tactattgcacttttagtattttgt

SEQ ID NO: 326762 - DNA, 25 bp, Homo sapien
ttagggaggtttgtctataatttga

SEQ ID NO: 326763 - DNA, 25 bp, Homo sapien
tataaatagtacttcagtttaagga

SEQ ID NO: 326764 - DNA, 25 bp, Homo sapien
tagtacttcagtttaaggaaaatgg

SEQ ID NO: 326765 - DNA, 25 bp, Homo sapien
gaaatccgcaaagtgttggacgcca

SEQ ID NO: 326766 - DNA, 25 bp, Homo sapien
gttggacgccaataactgcgactat

SEQ ID NO: 326767 - DNA, 25 bp, Homo sapien
aactgcgactatgagcagagggagc

SEQ ID NO: 326768 - DNA, 25 bp, Homo sapien
agagggagcgcttcttgctcttctg

SEQ ID NO: 326769 - DNA, 25 bp, Homo sapien
tcttctgcgtccacggagatgggca

SEQ ID NO: 326770 - DNA, 25 bp, Homo sapien
atgggcacgcggagaacctcgtgca

SEQ ID NO: 326771 - DNA, 25 bp, Homo sapien
cggagaacctcgtgcagtgggaaat

SEQ ID NO: 326772 - DNA, 25 bp, Homo sapien
gggacatccatagccttcaaaaata

SEQ ID NO: 326773 - DNA, 25 bp, Homo sapien
aaaatattgcttccaaaattgccaa

SEQ ID NO: 326774 - DNA, 25 bp, Homo sapien
gcttccaaaattgccaatgagctaa

SEQ ID NO: 326775 - DNA, 25 bp, Homo sapien
gagctaaagctgtaacccagtgatt

SEQ ID NO: 326776 - DNA, 25 bp, Homo sapien
gagtacagagctttgcatgccagga

SEQ ID NO: 326777 - DNA, 25 bp, Homo sapien
catgccaggatggagactgtagcta

SEQ ID NO: 326778 - DNA, 25 bp, Homo sapien
tagatgcacaaagaaagcgcctttc

SEQ ID NO: 326779 - DNA, 25 bp, Homo sapien
gcgcctttctccaggctcaaaagag

SEQ ID NO: 326780 - DNA, 25 bp, Homo sapien
gaagataaagcagtctagtcccaat

SEQ ID NO: 326781 - DNA, 25 bp, Homo sapien
gcagtctagtcccaattaccatgaa

SEQ ID NO: 326782 - DNA, 25 bp, Homo sapien
gaatatcttcataacaagctggctc

SEQ ID NO: 326783 - DNA, 25 bp, Homo sapien
caagctggctcacatcaaaaggcta

SEQ ID NO: 326784 - DNA, 25 bp, Homo sapien
gaatttgaccaacagcaagcagagt

SEQ ID NO: 326785 - DNA, 25 bp, Homo sapien
gcaagcagagtcatggtcctagaac

SEQ ID NO: 326786 - DNA, 25 bp, Homo sapien
tcatggtcctagaactctgcttgga

SEQ ID NO: 326787 - DNA, 25 bp, Homo sapien
gtggaagcggctccccatttttata

SEQ ID NO: 326788 - DNA, 25 bp, Homo sapien
gcggctccccatttttataccaaag

SEQ ID NO: 326789 - DNA, 25 bp, Homo sapien
gctccccatttttataccaaaggtg

SEQ ID NO: 326790 - DNA, 25 bp, Homo sapien
ataccaaaggtgctacatctatgtg

SEQ ID NO: 326791 - DNA, 25 bp, Homo sapien
ccaaaggtgctacatctatgtgatg

SEQ ID NO: 326792 - DNA, 25 bp, Homo sapien
aatcactggtgctatagaaattgag

SEQ ID NO: 326793 - DNA, 25 bp, Homo sapien
tggtgctatagaaattgagatgccc

SEQ ID NO: 326794 - DNA, 25 bp, Homo sapien
ccaggccagcaaatgttcctttttg

SEQ ID NO: 326795 - DNA, 25 bp, Homo sapien
gcaaatgttcctttttgttcaaagt

SEQ ID NO: 326796 - DNA, 25 bp, Homo sapien
tgttcctttttgttcaaagtctatt

SEQ ID NO: 326797 - DNA, 25 bp, Homo sapien
aaaggtgctatttaacatgggagga

SEQ ID NO: 326798 - DNA, 25 bp, Homo sapien
caacagtgttaaaatgagcctcaaa

SEQ ID NO: 326799 - DNA, 25 bp, Homo sapien
caaatgtatgtggatgagatctcta

SEQ ID NO: 326800 - DNA, 25 bp, Homo sapien
gatctctaagaagagggtcttctgg

SEQ ID NO: 326801 - DNA, 25 bp, Homo sapien
gctatttaaattggagcccagttgt

SEQ ID NO: 326802 - DNA, 25 bp, Homo sapien
attggagcccagttgtaacttggta

SEQ ID NO: 326803 - DNA, 25 bp, Homo sapien
taacttggtaaaggcaagcttctgt

SEQ ID NO: 326804 - DNA, 25 bp, Homo sapien
ggcaagcttctgtacctttgttata

SEQ ID NO: 326805 - DNA, 25 bp, Homo sapien
attaattgtatacctgtgtatgtaa

SEQ ID NO: 326806 - DNA, 25 bp, Homo sapien
aatataaggcattcctattttgcag

SEQ ID NO: 326807 - DNA, 25 bp, Homo sapien
ggcattcctattttgcagttcagaa

SEQ ID NO: 326808 - DNA, 25 bp, Homo sapien
attcctattttgcagttcagaacaa

SEQ ID NO: 326809 - DNA, 25 bp, Homo sapien
acataattttgtgttgaatgagcac

SEQ ID NO: 326810 - DNA, 25 bp, Homo sapien
gcacaacataatttgaagcattgca

SEQ ID NO: 326811 - DNA, 25 bp, Homo sapien
gaattaaatggtcctgtctttttca

SEQ ID NO: 326812 - DNA, 25 bp, Homo sapien
atttattgtcatacatgggtttcat

SEQ ID NO: 326813 - DNA, 25 bp, Homo sapien
gggtttcatatttataacggcatca

SEQ ID NO: 326814 - DNA, 25 bp, Homo sapien
tatttataacggcatcatgagctca

SEQ ID NO: 326815 - DNA, 25 bp, Homo sapien
atgagctcattgcacttaatacctg

SEQ ID NO: 326816 - DNA, 25 bp, Homo sapien
gcacttaatacctgcaatgtttgct

SEQ ID NO: 326817 - DNA, 25 bp, Homo sapien
gcaatgtttgctactgtaccacaat

SEQ ID NO: 326818 - DNA, 25 bp, Homo sapien
gctactgtaccacaattgattttca

SEQ ID NO: 326819 - DNA, 25 bp, Homo sapien
ttattaacaatgcttctggaaatga

SEQ ID NO: 326820 - DNA, 25 bp, Homo sapien
agaccttgtgatgttcctacatgcc

SEQ ID NO: 326821 - DNA, 25 bp, Homo sapien
ttcctacatgccctacgctataaag

SEQ ID NO: 326822 - DNA, 25 bp, Homo sapien
agggccaggctttgagtacttttca

SEQ ID NO: 326823 - DNA, 25 bp, Homo sapien
ttgagtacttttcaccaatgcctgc

SEQ ID NO: 326824 - DNA, 25 bp, Homo sapien
gcctgggcacaggatgactggcaaa

SEQ ID NO: 326825 - DNA, 25 bp, Homo sapien
agggattgcttcttgggttgtgaca

SEQ ID NO: 326826 - DNA, 25 bp, Homo sapien
gctatagggcaagggctgaccccat

SEQ ID NO: 326827 - DNA, 25 bp, Homo sapien
gggctgaccccatgggctagtactt

SEQ ID NO: 326828 - DNA, 25 bp, Homo sapien
ggacgggcttctaaagagacctgct

SEQ ID NO: 326829 - DNA, 25 bp, Homo sapien
gagacctgctcatacttgctacctc

SEQ ID NO: 326830 - DNA, 25 bp, Homo sapien
gctacctccttccagtgggaatttg

SEQ ID NO: 326831 - DNA, 25 bp, Homo sapien
ggcttgagcattgctgtagaatatg

SEQ ID NO: 326832 - DNA, 25 bp, Homo sapien
gctgtagaatatgttatctgttcaa

SEQ ID NO: 326833 - DNA, 25 bp, Homo sapien
gttcaaaacttagcagagcacgcat

SEQ ID NO: 326834 - DNA, 25 bp, Homo sapien
tagcagagcacgcatgcatcacatg

SEQ ID NO: 326835 - DNA, 25 bp, Homo sapien
ccaatggtttttgatggttgccgta

SEQ ID NO: 326836 - DNA, 25 bp, Homo sapien
atggttgccgtaacagaagatctgt

SEQ ID NO: 326837 - DNA, 25 bp, Homo sapien
ggtggtttgcacctgttcctgaagt

SEQ ID NO: 326838 - DNA, 25 bp, Homo sapien
gcacctgttcctgaagtcaaactgg

SEQ ID NO: 326839 - DNA, 25 bp, Homo sapien
ctgaagtcaaactggaaaaggttgc

SEQ ID NO: 326840 - DNA, 25 bp, Homo sapien
caattttctcaatcattttgcataa

SEQ ID NO: 326841 - DNA, 25 bp, Homo sapien
ttgagtagtaatagttctaaacctg

SEQ ID NO: 326842 - DNA, 25 bp, Homo sapien
gcggtggccgacgacttctgcaaag

SEQ ID NO: 326843 - DNA, 25 bp, Homo sapien
gtggccgacgacttctgcaaagtgc

SEQ ID NO: 326844 - DNA, 25 bp, Homo sapien
ggccgacgacttctgcaaagtgcat

SEQ ID NO: 326845 - DNA, 25 bp, Homo sapien
gacgacttctgcaaagtgcatctct

SEQ ID NO: 326846 - DNA, 25 bp, Homo sapien
tctgcaaagtgcatctcttccagta

SEQ ID NO: 326847 - DNA, 25 bp, Homo sapien
tgcaaagtgcatctcttccagtacc

SEQ ID NO: 326848 - DNA, 25 bp, Homo sapien
aaagtgcatctcttccagtacccgt

SEQ ID NO: 326849 - DNA, 25 bp, Homo sapien
gtgcatctcttccagtacccgtgcg

SEQ ID NO: 326850 - DNA, 25 bp, Homo sapien
agcgtccgattcacgcacgacgact

SEQ ID NO: 326851 - DNA, 25 bp, Homo sapien
gcaaggacgccagcatcttccagtg

SEQ ID NO: 326852 - DNA, 25 bp, Homo sapien
cttccagtggcgagtgctgggcgct

SEQ ID NO: 326853 - DNA, 25 bp, Homo sapien
aaatgtttattggacacactcagag

SEQ ID NO: 326854 - DNA, 25 bp, Homo sapien
tttattggacacactcagagagagg

SEQ ID NO: 326855 - DNA, 25 bp, Homo sapien
acacgtgcgtgtgtgttgctatcca

SEQ ID NO: 326856 - DNA, 25 bp, Homo sapien
ttgctatccagcacgtggaccgggc

SEQ ID NO: 326857 - DNA, 25 bp, Homo sapien
gaccgggctcccagaagagctggca

SEQ ID NO: 326858 - DNA, 25 bp, Homo sapien
agagctggcattgtgtctgagcaga

SEQ ID NO: 326859 - DNA, 25 bp, Homo sapien
ttgtgtctgagcagagctgggtccc

SEQ ID NO: 326860 - DNA, 25 bp, Homo sapien
ttctgggttctgaaggtgccggaga

SEQ ID NO: 326861 - DNA, 25 bp, Homo sapien
ggtctgcggccctttctcagggaca

SEQ ID NO: 326862 - DNA, 25 bp, Homo sapien
agggacacaccctgatagcacaatc

SEQ ID NO: 326863 - DNA, 25 bp, Homo sapien
accctgatagcacaatctccttggg

SEQ ID NO: 326864 - DNA, 25 bp, Homo sapien
atcatcatcgccactgaaaaccagg

SEQ ID NO: 326865 - DNA, 25 bp, Homo sapien
accaggccctgttgccttttaagca

SEQ ID NO: 326866 - DNA, 25 bp, Homo sapien
ttttaagcatgtaccgctccctcag

SEQ ID NO: 326867 - DNA, 25 bp, Homo sapien
ggcgtgtgatgagccattcatgtgt

SEQ ID NO: 326868 - DNA, 25 bp, Homo sapien
attcatgtgttccaaactccatctg

SEQ ID NO: 326869 - DNA, 25 bp, Homo sapien
tggcagggtagacccaggcctctaa

SEQ ID NO: 326870 - DNA, 25 bp, Homo sapien
caggcctctaaccatctgacagaga

SEQ ID NO: 326871 - DNA, 25 bp, Homo sapien
gagactcggcctggacaccatgcga

SEQ ID NO: 326872 - DNA, 25 bp, Homo sapien
tggacaccatgcgatgcactctggc

SEQ ID NO: 326873 - DNA, 25 bp, Homo sapien
gcactctggcaccaaggctttatgt

SEQ ID NO: 326874 - DNA, 25 bp, Homo sapien
tttatgtgcccatcactctcagaga

SEQ ID NO: 326875 - DNA, 25 bp, Homo sapien
agaacctggatcaaactcttcattg

SEQ ID NO: 326876 - DNA, 25 bp, Homo sapien
tcttcattgaagtactcatcaggcg

SEQ ID NO: 326877 - DNA, 25 bp, Homo sapien
tactcatcaggcgtgatggctgtgg

SEQ ID NO: 326878 - DNA, 25 bp, Homo sapien
ttgcagtagcacattccgtggtgag

SEQ ID NO: 326879 - DNA, 25 bp, Homo sapien
tagcacattccgtggtgaggtcctg

SEQ ID NO: 326880 - DNA, 25 bp, Homo sapien
gtgaggtcctgctgagccagaactc

SEQ ID NO: 326881 - DNA, 25 bp, Homo sapien
aactcaggagagtcagaaatgccaa

SEQ ID NO: 326882 - DNA, 25 bp, Homo sapien
cagcgttaccgtggctgtaccttgg

SEQ ID NO: 326883 - DNA, 25 bp, Homo sapien
gaaatgccaaatgatgttcacaagt

SEQ ID NO: 326884 - DNA, 25 bp, Homo sapien
ttcacaagtgaaggcctgtggcact

SEQ ID NO: 326885 - DNA, 25 bp, Homo sapien
cctgtggcactcagtgtctgaggtg

SEQ ID NO: 326886 - DNA, 25 bp, Homo sapien
gtggagggagatttgtttaaacaag

SEQ ID NO: 326887 - DNA, 25 bp, Homo sapien
aaatatgtacatagttctggaaatt

SEQ ID NO: 326888 - DNA, 25 bp, Homo sapien
tccagttgcatttctcagacaataa

SEQ ID NO: 326889 - DNA, 25 bp, Homo sapien
gcatttctcagacaataaagtggtg

SEQ ID NO: 326890 - DNA, 25 bp, Homo sapien
taaagtggtgcatccatgctacctc

SEQ ID NO: 326891 - DNA, 25 bp, Homo sapien
atgctacctcctactttgtcaacaa

SEQ ID NO: 326892 - DNA, 25 bp, Homo sapien
gtcaacaaagatgctatttaccctt

SEQ ID NO: 326893 - DNA, 25 bp, Homo sapien
aagatgctatttaccctttacattt

SEQ ID NO: 326894 - DNA, 25 bp, Homo sapien
ttaccctttacatttttgtatcata

SEQ ID NO: 326895 - DNA, 25 bp, Homo sapien
atgttctttattgcaagacattctt

SEQ ID NO: 326896 - DNA, 25 bp, Homo sapien
ctttattgcaagacattcttttgtt

SEQ ID NO: 326897 - DNA, 25 bp, Homo sapien
aatcagttcccattttttctcatta

SEQ ID NO: 326898 - DNA, 25 bp, Homo sapien
ttttctcattatcatactgccgcag

SEQ ID NO: 326899 - DNA, 25 bp, Homo sapien
atactgccgcagtaacctggctttg

SEQ ID NO: 326900 - DNA, 25 bp, Homo sapien
gaggtaggttcatagcgttcagcac

SEQ ID NO: 326901 - DNA, 25 bp, Homo sapien
atagcgttcagcacgatggcaaatc

SEQ ID NO: 326902 - DNA, 25 bp, Homo sapien
gatggcaaatcgctcctccagttca

SEQ ID NO: 326903 - DNA, 25 bp, Homo sapien
gcatcggcagcttcaaaggcacgtt

SEQ ID NO: 326904 - DNA, 25 bp, Homo sapien
aaaggcacgttgtgcgccctgaaat

SEQ ID NO: 326905 - DNA, 25 bp, Homo sapien
ttgtgcgccctgaaatcggtctgct

SEQ ID NO: 326906 - DNA, 25 bp, Homo sapien
aaatcggtctgctgcgaatccatgc

SEQ ID NO: 326907 - DNA, 25 bp, Homo sapien
ctagcgtgcgcgtcggaaatcagaa

SEQ ID NO: 326908 - DNA, 25 bp, Homo sapien
ggtgcagatgggtcttggaaccaaa

SEQ ID NO: 326909 - DNA, 25 bp, Homo sapien
tcttggaaccaaagtgagggcacct

SEQ ID NO: 326910 - DNA, 25 bp, Homo sapien
aaagtgagggcacctggtccctcac

SEQ ID NO: 326911 - DNA, 25 bp, Homo sapien
gtccctcacctctgtagctctatga

SEQ ID NO: 326912 - DNA, 25 bp, Homo sapien
tagctctatgacttagtaaccacac

SEQ ID NO: 326913 - DNA, 25 bp, Homo sapien
atgacttagtaaccacacctctact

SEQ ID NO: 326914 - DNA, 25 bp, Homo sapien
taaccacacctctactggacagaat

SEQ ID NO: 326915 - DNA, 25 bp, Homo sapien
tactggacagaatgaggcctgcctt

SEQ ID NO: 326916 - DNA, 25 bp, Homo sapien
aatgaggcctgccttgaagggtcac

SEQ ID NO: 326917 - DNA, 25 bp, Homo sapien
ctgccttgaagggtcaccgtgagca

SEQ ID NO: 326918 - DNA, 25 bp, Homo sapien
aagggtcaccgtgagcagcggccac

SEQ ID NO: 326919 - DNA, 25 bp, Homo sapien
gtgtctgagatattcagaccctcgc

SEQ ID NO: 326920 - DNA, 25 bp, Homo sapien
tgagatattcagaccctcgccgtcc

SEQ ID NO: 326921 - DNA, 25 bp, Homo sapien
gagatgtggataattcctaacacgg

SEQ ID NO: 326922 - DNA, 25 bp, Homo sapien
taagatattcagaccctcgccgtcc

SEQ ID NO: 326923 - DNA, 25 bp, Homo sapien
aaaatattcagtcccgtgcagtaga

SEQ ID NO: 326924 - DNA, 25 bp, Homo sapien
ttcagtcccgtgcagtagacacggt

SEQ ID NO: 326925 - DNA, 25 bp, Homo sapien
tcctaacacggatcaaaggtgagct

SEQ ID NO: 326926 - DNA, 25 bp, Homo sapien
gacctgcaccatcctgagcagtagc

SEQ ID NO: 326927 - DNA, 25 bp, Homo sapien
tgagctgtgtctaagacagtcagac

SEQ ID NO: 326928 - DNA, 25 bp, Homo sapien
tctaagacagtcagacctgcaccgt

SEQ ID NO: 326929 - DNA, 25 bp, Homo sapien
gacctgcaccgtcccgtgcagtaga

SEQ ID NO: 326930 - DNA, 25 bp, Homo sapien
gctgatggctctcctggcaaagatg

SEQ ID NO: 326931 - DNA, 25 bp, Homo sapien
tcctggcaaagatggcgtccgtggt

SEQ ID NO: 326932 - DNA, 25 bp, Homo sapien
cctggcaaagatggcgtccgtggtc

SEQ ID NO: 326933 - DNA, 25 bp, Homo sapien
ctggcaaagatggcgtccgtggtct

SEQ ID NO: 326934 - DNA, 25 bp, Homo sapien
agatggcgtccgtggtctgaccggc

SEQ ID NO: 326935 - DNA, 25 bp, Homo sapien
gatggcgtccgtggtctgaccggcc

SEQ ID NO: 326936 - DNA, 25 bp, Homo sapien
atggcgtccgtggtctgaccggccc

SEQ ID NO: 326937 - DNA, 25 bp, Homo sapien
gtccgtggtctgaccggccccattg

SEQ ID NO: 326938 - DNA, 25 bp, Homo sapien
tccgtggtctgaccggccccattgg

SEQ ID NO: 326939 - DNA, 25 bp, Homo sapien
ccgtggtctgaccggccccattggt

SEQ ID NO: 326940 - DNA, 25 bp, Homo sapien
cgtggtctgaccggccccattggtc

SEQ ID NO: 326941 - DNA, 25 bp, Homo sapien
cagtgaacacagtaagaagagacaa

SEQ ID NO: 326942 - DNA, 25 bp, Homo sapien
gtcgacgtcaaaatatcagatttta

SEQ ID NO: 326943 - DNA, 25 bp, Homo sapien
ggaaatagacaactgtgaaaatgta

SEQ ID NO: 326944 - DNA, 25 bp, Homo sapien
gtaaggtataatagagacaggcata

SEQ ID NO: 326945 - DNA, 25 bp, Homo sapien
gagacaggcatagtagcttgcacct

SEQ ID NO: 326946 - DNA, 25 bp, Homo sapien
caggcatagtagcttgcacctgtgg

SEQ ID NO: 326947 - DNA, 25 bp, Homo sapien
gcaatctataaaaccgataaagact

SEQ ID NO: 326948 - DNA, 25 bp, Homo sapien
tctataaaaccgataaagactttgg

SEQ ID NO: 326949 - DNA, 25 bp, Homo sapien
agactttggaataaggcgaggaata

SEQ ID NO: 326950 - DNA, 25 bp, Homo sapien
taaaacaagtgggtacagtgaacac

SEQ ID NO: 326951 - DNA, 25 bp, Homo sapien
caagtgggtacagtgaacacagtaa

SEQ ID NO: 326952 - DNA, 25 bp, Homo sapien
agccagagacagagcccctcgagag

SEQ ID NO: 326953 - DNA, 25 bp, Homo sapien
gacagagcccctcgagagggatcct

SEQ ID NO: 326954 - DNA, 25 bp, Homo sapien
agagcccctcgagagggatccttgg

SEQ ID NO: 326955 - DNA, 25 bp, Homo sapien
agcccctcgagagggatccttggct

SEQ ID NO: 326956 - DNA, 25 bp, Homo sapien
tcgagagggatccttggctgcttca

SEQ ID NO: 326957 - DNA, 25 bp, Homo sapien
tggctgcttcattgtcttcccccca

SEQ ID NO: 326958 - DNA, 25 bp, Homo sapien
gggtcttggtatggtccccgctcac

SEQ ID NO: 326959 - DNA, 25 bp, Homo sapien
gtcttggtatggtccccgctcacct

SEQ ID NO: 326960 - DNA, 25 bp, Homo sapien
ccttccagagtcctgagtggtgtgg

SEQ ID NO: 326961 - DNA, 25 bp, Homo sapien
tccagagtcctgagtggtgtgggtg

SEQ ID NO: 326962 - DNA, 25 bp, Homo sapien
gggatacggtctgtgactctggact

SEQ ID NO: 326963 - DNA, 25 bp, Homo sapien
gatcctatctataacttaggtactt

SEQ ID NO: 326964 - DNA, 25 bp, Homo sapien
agataacattaagaacctgctgttt

SEQ ID NO: 326965 - DNA, 25 bp, Homo sapien
cggcaagaaagtgccttcctgcttt

SEQ ID NO: 326966 - DNA, 25 bp, Homo sapien
gttttttcctctatagaatctggca

SEQ ID NO: 326967 - DNA, 25 bp, Homo sapien
gaatctggcatttacagcactttct

SEQ ID NO: 326968 - DNA, 25 bp, Homo sapien
ttacagcactttctcatcgatcaca

SEQ ID NO: 326969 - DNA, 25 bp, Homo sapien
gtgccttcctgctttccaaagaagt

SEQ ID NO: 326970 - DNA, 25 bp, Homo sapien
catagccatggcagtttataactca

SEQ ID NO: 326971 - DNA, 25 bp, Homo sapien
caaagaagtccttttcaaggtggcg

SEQ ID NO: 326972 - DNA, 25 bp, Homo sapien
aggtggcggagcactgaatagtaca

SEQ ID NO: 326973 - DNA, 25 bp, Homo sapien
gtatattgagttcagatcctatcta

SEQ ID NO: 326974 - DNA, 25 bp, Homo sapien
aaaagtacgctggtagatcctgcta

SEQ ID NO: 326975 - DNA, 25 bp, Homo sapien
tagatcctgctacctcatagataac

SEQ ID NO: 326976 - DNA, 25 bp, Homo sapien
aatgcctgggcaaagctgctgccca

SEQ ID NO: 326977 - DNA, 25 bp, Homo sapien
aagagtttactgcttattaaatgga

SEQ ID NO: 326978 - DNA, 25 bp, Homo sapien
gaaactatgaagtctaaggccaact

SEQ ID NO: 326979 - DNA, 25 bp, Homo sapien
gtctaaggccaactgtgcccagaat

SEQ ID NO: 326980 - DNA, 25 bp, Homo sapien
aactgtgcccagaatccaaattgta

SEQ ID NO: 326981 - DNA, 25 bp, Homo sapien
aaagctgctgcccagagtggaatct

SEQ ID NO: 326982 - DNA, 25 bp, Homo sapien
gatatttcatccaaccaaagaagag

SEQ ID NO: 326983 - DNA, 25 bp, Homo sapien
gcccagagtggaatctccctagtga

SEQ ID NO: 326984 - DNA, 25 bp, Homo sapien
tccctagtgaataaacaagcccaag

SEQ ID NO: 326985 - DNA, 25 bp, Homo sapien
agcatcatcatcacccaactagggc

SEQ ID NO: 326986 - DNA, 25 bp, Homo sapien
aactagggcagctgacccgcgtctt

SEQ ID NO: 326987 - DNA, 25 bp, Homo sapien
gaatggtttgagtcaagggttttca

SEQ ID NO: 326988 - DNA, 25 bp, Homo sapien
caagggttttcatggccatgagcca

SEQ ID NO: 326989 - DNA, 25 bp, Homo sapien
gtttcctgtgagaaatcttcaacca

SEQ ID NO: 326990 - DNA, 25 bp, Homo sapien
tgagaaatcttcaaccagcgccact

SEQ ID NO: 326991 - DNA, 25 bp, Homo sapien
tctgccagcgcttctgtggctgcac

SEQ ID NO: 326992 - DNA, 25 bp, Homo sapien
tgtggctgcacctgcattcgtgggc

SEQ ID NO: 326993 - DNA, 25 bp, Homo sapien
acctgcattcgtgggctgtggctgc

SEQ ID NO: 326994 - DNA, 25 bp, Homo sapien
gtggctgcgaagcacaggaataatt

SEQ ID NO: 326995 - DNA, 25 bp, Homo sapien
gcacaggaataattgatggctctgg

SEQ ID NO: 326996 - DNA, 25 bp, Homo sapien
gccagggcgccgtggacgttcggaa

SEQ ID NO: 326997 - DNA, 25 bp, Homo sapien
cagggcgccgtggacgttcggaacg

SEQ ID NO: 326998 - DNA, 25 bp, Homo sapien
tggacgttcggaacggaaaggcctg

SEQ ID NO: 326999 - DNA, 25 bp, Homo sapien
ggaggtgagatgagcggcggcgccc

SEQ ID NO: 327000 - DNA, 25 bp, Homo sapien
gaccagcaatacagaatttcctgcc

SEQ ID NO: 327001 - DNA, 25 bp, Homo sapien
ccgactccaccgcagagtgggagag

SEQ ID NO: 327002 - DNA, 25 bp, Homo sapien
cagagtgggagaggccgacgctccc

SEQ ID NO: 327003 - DNA, 25 bp, Homo sapien
cgtcctcatgcaccgaggagccgag

SEQ ID NO: 327004 - DNA, 25 bp, Homo sapien
ctggccctaccctgggtgcctgtgg

SEQ ID NO: 327005 - DNA, 25 bp, Homo sapien
gccaggcccgggatggcgatccgac

SEQ ID NO: 327006 - DNA, 25 bp, Homo sapien
atggcgatccgacctgccgccgcag

SEQ ID NO: 327007 - DNA, 25 bp, Homo sapien
acatgtgagggccaaataacctgct

SEQ ID NO: 327008 - DNA, 25 bp, Homo sapien
atgtgagggccaaataacctgctag

SEQ ID NO: 327009 - DNA, 25 bp, Homo sapien
gtgagggccaaataacctgctagct

SEQ ID NO: 327010 - DNA, 25 bp, Homo sapien
gagggccaaataacctgctagctag

SEQ ID NO: 327011 - DNA, 25 bp, Homo sapien
agggccaaataacctgctagctagg

SEQ ID NO: 327012 - DNA, 25 bp, Homo sapien
ggccaaataacctgctagctaggca

SEQ ID NO: 327013 - DNA, 25 bp, Homo sapien
aaataacctgctagctaggcagtaa

SEQ ID NO: 327014 - DNA, 25 bp, Homo sapien
taacctgctagctaggcagtaataa

SEQ ID NO: 327015 - DNA, 25 bp, Homo sapien
tgctagctaggcagtaataaactct

SEQ ID NO: 327016 - DNA, 25 bp, Homo sapien
gctaggcagtaataaactctgttac

SEQ ID NO: 327017 - DNA, 25 bp, Homo sapien
ggcagtaataaactctgttacagaa

SEQ ID NO: 327018 - DNA, 25 bp, Homo sapien
acagcaaaaggactgggactgattt

SEQ ID NO: 327019 - DNA, 25 bp, Homo sapien
aaaggactgggactgatttctccca

SEQ ID NO: 327020 - DNA, 25 bp, Homo sapien
gaacatgggcagattgctgactgaa

SEQ ID NO: 327021 - DNA, 25 bp, Homo sapien
ggcagattgctgactgaaccagtgc

SEQ ID NO: 327022 - DNA, 25 bp, Homo sapien
ttgctgactgaaccagtgcactgga

SEQ ID NO: 327023 - DNA, 25 bp, Homo sapien
aaccagtgcactggatagcattcag

SEQ ID NO: 327024 - DNA, 25 bp, Homo sapien
agcctcatcacaggagagtatgtgt

SEQ ID NO: 327025 - DNA, 25 bp, Homo sapien
gttttcccacagttaagaagactat

SEQ ID NO: 327026 - DNA, 25 bp, Homo sapien
aggaataacttccttatgtggaggg

SEQ ID NO: 327027 - DNA, 25 bp, Homo sapien
gggaccccataggaaatgattctgt

SEQ ID NO: 327028 - DNA, 25 bp, Homo sapien
tgattctgtttgtaacagttgaagc

SEQ ID NO: 327029 - DNA, 25 bp, Homo sapien
ccgggccctggcgaggcaggaatgg

SEQ ID NO: 327030 - DNA, 25 bp, Homo sapien
ggaatggccccgaggcctccgaccg

SEQ ID NO: 327031 - DNA, 25 bp, Homo sapien
ggaagaatggtaccatgtcgaccct

SEQ ID NO: 327032 - DNA, 25 bp, Homo sapien
agaatggtaccatgtcgaccctgct

SEQ ID NO: 327033 - DNA, 25 bp, Homo sapien
aatggtaccatgtcgaccctgctca

SEQ ID NO: 327034 - DNA, 25 bp, Homo sapien
gtaccatgtcgaccctgctcagagg

SEQ ID NO: 327035 - DNA, 25 bp, Homo sapien
gccacctggtttctcttggatatca

SEQ ID NO: 327036 - DNA, 25 bp, Homo sapien
cacctggtttctcttggatatcaag

SEQ ID NO: 327037 - DNA, 25 bp, Homo sapien
gtttctcttggatatcaagtttcca

SEQ ID NO: 327038 - DNA, 25 bp, Homo sapien
ggatatcaagtttccaagccagagg

SEQ ID NO: 327039 - DNA, 25 bp, Homo sapien
atatcaagtttccaagccagaggtg

SEQ ID NO: 327040 - DNA, 25 bp, Homo sapien
aagattctgttgttggctgatccac

SEQ ID NO: 327041 - DNA, 25 bp, Homo sapien
gtgggattcttagcatgtgctacat

SEQ ID NO: 327042 - DNA, 25 bp, Homo sapien
gatccacaggctgtccagtggttaa

SEQ ID NO: 327043 - DNA, 25 bp, Homo sapien
gtggttaatgaaacactgcctttat

SEQ ID NO: 327044 - DNA, 25 bp, Homo sapien
aactggtccattaacagcagctcct

SEQ ID NO: 327045 - DNA, 25 bp, Homo sapien
cagcagctcctttaggcaagataaa

SEQ ID NO: 327046 - DNA, 25 bp, Homo sapien
gcatgtgctacatctgataacaaaa

SEQ ID NO: 327047 - DNA, 25 bp, Homo sapien
ggagcaccagcatgtataaatagac

SEQ ID NO: 327048 - DNA, 25 bp, Homo sapien
tataaatagactagactggcctcca

SEQ ID NO: 327049 - DNA, 25 bp, Homo sapien
aacttggtgttgacttgctttctgt

SEQ ID NO: 327050 - DNA, 25 bp, Homo sapien
agatcagctgctaccttcaaagttg

SEQ ID NO: 327051 - DNA, 25 bp, Homo sapien
ttaagctccatctggtcctcataac

SEQ ID NO: 327052 - DNA, 25 bp, Homo sapien
atctggtcctcataacctgcaagat

SEQ ID NO: 327053 - DNA, 25 bp, Homo sapien
ggtcctcataacctgcaagattttt

SEQ ID NO: 327054 - DNA, 25 bp, Homo sapien
cctcataacctgcaagatttttctt

SEQ ID NO: 327055 - DNA, 25 bp, Homo sapien
tttcttaaaacctttcagctgaaag

SEQ ID NO: 327056 - DNA, 25 bp, Homo sapien
aaaggtggagtaatctgtggatttg

SEQ ID NO: 327057 - DNA, 25 bp, Homo sapien
accaccagatacagaaatgtgcttt

SEQ ID NO: 327058 - DNA, 25 bp, Homo sapien
acatcagttgaaacctaaattttct

SEQ ID NO: 327059 - DNA, 25 bp, Homo sapien
attttcttatgttgtggtgattgta

SEQ ID NO: 327060 - DNA, 25 bp, Homo sapien
gaagagtgtcaaacatggttaaata

SEQ ID NO: 327061 - DNA, 25 bp, Homo sapien
gtactcatttatgttgaatacgtat

SEQ ID NO: 327062 - DNA, 25 bp, Homo sapien
tttaagtacctataaagaacactga

SEQ ID NO: 327063 - DNA, 25 bp, Homo sapien
aagtacctataaagaacactgaaag

SEQ ID NO: 327064 - DNA, 25 bp, Homo sapien
aacactgaaaggtgatgtgtgtgga

SEQ ID NO: 327065 - DNA, 25 bp, Homo sapien
tgtggatgagctaggaagacctgaa

SEQ ID NO: 327066 - DNA, 25 bp, Homo sapien
gtggatgagctaggaagacctgaaa

SEQ ID NO: 327067 - DNA, 25 bp, Homo sapien
tggatgagctaggaagacctgaaat

SEQ ID NO: 327068 - DNA, 25 bp, Homo sapien
ggatgagctaggaagacctgaaata

SEQ ID NO: 327069 - DNA, 25 bp, Homo sapien
gatgagctaggaagacctgaaatag

SEQ ID NO: 327070 - DNA, 25 bp, Homo sapien
tgagctaggaagacctgaaataggc

SEQ ID NO: 327071 - DNA, 25 bp, Homo sapien
agctaggaagacctgaaataggctc

SEQ ID NO: 327072 - DNA, 25 bp, Homo sapien
gctaggaagacctgaaataggctct

SEQ ID NO: 327073 - DNA, 25 bp, Homo sapien
aagggtccccgccttagatcaatca

SEQ ID NO: 327074 - DNA, 25 bp, Homo sapien
gatcaatcacgtggacactaaggca

SEQ ID NO: 327075 - DNA, 25 bp, Homo sapien
aaggcacgttttagagtctcttgtc

SEQ ID NO: 327076 - DNA, 25 bp, Homo sapien
ttaatgattatgtccatccgtctgt

SEQ ID NO: 327077 - DNA, 25 bp, Homo sapien
atccgtctgtccgtccatttgtgtt

SEQ ID NO: 327078 - DNA, 25 bp, Homo sapien
catttgtgttttctgcgtcgtgtca

SEQ ID NO: 327079 - DNA, 25 bp, Homo sapien
gcgtcgtgtcattggatataatcct

SEQ ID NO: 327080 - DNA, 25 bp, Homo sapien
actagcctctgacaaccatgaagca

SEQ ID NO: 327081 - DNA, 25 bp, Homo sapien
aaatccgttacatgtgggtctgaac

SEQ ID NO: 327082 - DNA, 25 bp, Homo sapien
gggtctgaacttgtagactcggtca

SEQ ID NO: 327083 - DNA, 25 bp, Homo sapien
gtagactcggtcacagtatcaaata

SEQ ID NO: 327084 - DNA, 25 bp, Homo sapien
ttacctaacaataagtcttaaacat

SEQ ID NO: 327085 - DNA, 25 bp, Homo sapien
ttttatttatgtgctactttgtctt

SEQ ID NO: 327086 - DNA, 25 bp, Homo sapien
tttatttatgtgctactttgtcttt

SEQ ID NO: 327087 - DNA, 25 bp, Homo sapien
ttatttatgtgctactttgtctttc

SEQ ID NO: 327088 - DNA, 25 bp, Homo sapien
atttatgtgctactttgtctttctc

SEQ ID NO: 327089 - DNA, 25 bp, Homo sapien
tttatgtgctactttgtctttctcc

SEQ ID NO: 327090 - DNA, 25 bp, Homo sapien
ttatgtgctactttgtctttctccc

SEQ ID NO: 327091 - DNA, 25 bp, Homo sapien
tatgtgctactttgtctttctccct

SEQ ID NO: 327092 - DNA, 25 bp, Homo sapien
atgtgctactttgtctttctccctc

SEQ ID NO: 327093 - DNA, 25 bp, Homo sapien
gtctttctccctctctgtgtatata

SEQ ID NO: 327094 - DNA, 25 bp, Homo sapien
ttctccctctctgtgtatatacaca

SEQ ID NO: 327095 - DNA, 25 bp, Homo sapien
cttcatccgccgaaagtcatgtggg

SEQ ID NO: 327096 - DNA, 25 bp, Homo sapien
tgtgggatgatgctaccagagccat

SEQ ID NO: 327097 - DNA, 25 bp, Homo sapien
aatgtcactatcctcttgaggacac

SEQ ID NO: 327098 - DNA, 25 bp, Homo sapien
ttgaggacaccctcggagggcctct

SEQ ID NO: 327099 - DNA, 25 bp, Homo sapien
gctgctgccgtaggttggatccaaa

SEQ ID NO: 327100 - DNA, 25 bp, Homo sapien
ggatccaaacaggaagcagagccct

SEQ ID NO: 327101 - DNA, 25 bp, Homo sapien
agcagagccctttcacatacgtgtt

SEQ ID NO: 327102 - DNA, 25 bp, Homo sapien
atacgtgttctcactgcaagtctgg

SEQ ID NO: 327103 - DNA, 25 bp, Homo sapien
ctcactgcaagtctggtgcacggtg

SEQ ID NO: 327104 - DNA, 25 bp, Homo sapien
agggacaggcccagggacatgttca

SEQ ID NO: 327105 - DNA, 25 bp, Homo sapien
agggacatgttcacggcctccacgg

SEQ ID NO: 327106 - DNA, 25 bp, Homo sapien
attgagacagtcagcaggctccttg

SEQ ID NO: 327107 - DNA, 25 bp, Homo sapien
ggtcaagctcaaaggctggcagtca

SEQ ID NO: 327108 - DNA, 25 bp, Homo sapien
gctggcagtcacgaaggcagttcaa

SEQ ID NO: 327109 - DNA, 25 bp, Homo sapien
ggcagttcaatagcacctcagcagt

SEQ ID NO: 327110 - DNA, 25 bp, Homo sapien
tagcacctcagcagttatgttacag

SEQ ID NO: 327111 - DNA, 25 bp, Homo sapien
ggtctgttctactctgggactgaat

SEQ ID NO: 327112 - DNA, 25 bp, Homo sapien
aggagccccatcctcgatgtgaagg

SEQ ID NO: 327113 - DNA, 25 bp, Homo sapien
aagggcgcttgctcaggttgctgca

SEQ ID NO: 327114 - DNA, 25 bp, Homo sapien
aggttgctgcaacaagccctggcgt

SEQ ID NO: 327115 - DNA, 25 bp, Homo sapien
tggcgtttgagcagggccaaagttt

SEQ ID NO: 327116 - DNA, 25 bp, Homo sapien
gtgtcagaagtctcctctagccaag

SEQ ID NO: 327117 - DNA, 25 bp, Homo sapien
ctccattgacgagatatccatgttt

SEQ ID NO: 327118 - DNA, 25 bp, Homo sapien
gtacatatttgtgtcttcattagtg

SEQ ID NO: 327119 - DNA, 25 bp, Homo sapien
gtcttcattagtgatgctacctctg

SEQ ID NO: 327120 - DNA, 25 bp, Homo sapien
ttagtgatgctacctctgctttcct

SEQ ID NO: 327121 - DNA, 25 bp, Homo sapien
gctttcctcgctttgttctggcatt

SEQ ID NO: 327122 - DNA, 25 bp, Homo sapien
tgaccccattttccagccgtctaat

SEQ ID NO: 327123 - DNA, 25 bp, Homo sapien
ggaaaggctggagtgtgtttttcca

SEQ ID NO: 327124 - DNA, 25 bp, Homo sapien
gtgtgtttttccatgtaggtctata

SEQ ID NO: 327125 - DNA, 25 bp, Homo sapien
gtaggtctatatagcacacatccaa

SEQ ID NO: 327126 - DNA, 25 bp, Homo sapien
gggtttggttgaaggcactctccat

SEQ ID NO: 327127 - DNA, 25 bp, Homo sapien
gaaggcactctccattgacgagata

SEQ ID NO: 327128 - DNA, 25 bp, Homo sapien
gggtggcctgggttaccctcctgct

SEQ ID NO: 327129 - DNA, 25 bp, Homo sapien
tggcctgggttaccctcctgctcag

SEQ ID NO: 327130 - DNA, 25 bp, Homo sapien
cctgggtccactgggctgtctggac

SEQ ID NO: 327131 - DNA, 25 bp, Homo sapien
ggtccactgggctgtctggacccca

SEQ ID NO: 327132 - DNA, 25 bp, Homo sapien
tgggctgtctggaccccaagctagg

SEQ ID NO: 327133 - DNA, 25 bp, Homo sapien
tgtctggaccccaagctaggggact

SEQ ID NO: 327134 - DNA, 25 bp, Homo sapien
gtaggagtcagcaaagaaagacaat

SEQ ID NO: 327135 - DNA, 25 bp, Homo sapien
agaaagacaatttctctgccccttg

SEQ ID NO: 327136 - DNA, 25 bp, Homo sapien
gaaagacaatttctctgccccttgg

SEQ ID NO: 327137 - DNA, 25 bp, Homo sapien
aaagacaatttctctgccccttggg

SEQ ID NO: 327138 - DNA, 25 bp, Homo sapien
atttctctgccccttgggatggagg

SEQ ID NO: 327139 - DNA, 25 bp, Homo sapien
atgtatcatcacactgtacatctca

SEQ ID NO: 327140 - DNA, 25 bp, Homo sapien
tgtatcatcacactgtacatctcaa

SEQ ID NO: 327141 - DNA, 25 bp, Homo sapien
gtatcatcacactgtacatctcaaa

SEQ ID NO: 327142 - DNA, 25 bp, Homo sapien
tatcatcacactgtacatctcaaat

SEQ ID NO: 327143 - DNA, 25 bp, Homo sapien
atcatcacactgtacatctcaaata

SEQ ID NO: 327144 - DNA, 25 bp, Homo sapien
tcatcacactgtacatctcaaatat

SEQ ID NO: 327145 - DNA, 25 bp, Homo sapien
atcatacttcagtatagctgagaac

SEQ ID NO: 327146 - DNA, 25 bp, Homo sapien
catacttcagtatagctgagaacaa

SEQ ID NO: 327147 - DNA, 25 bp, Homo sapien
tacttcagtatagctgagaacaagt

SEQ ID NO: 327148 - DNA, 25 bp, Homo sapien
cagtatagctgagaacaagttaaat

SEQ ID NO: 327149 - DNA, 25 bp, Homo sapien
ctgagaacaagttaaatggaacaaa

SEQ ID NO: 327150 - DNA, 25 bp, Homo sapien
ctgaccttaaatccctatcctataa

SEQ ID NO: 327151 - DNA, 25 bp, Homo sapien
atcctataataaagagttgggcaca

SEQ ID NO: 327152 - DNA, 25 bp, Homo sapien
gaagtattctgcaaattgttttcca

SEQ ID NO: 327153 - DNA, 25 bp, Homo sapien
ttgttttccataacagtgcagagga

SEQ ID NO: 327154 - DNA, 25 bp, Homo sapien
gtgcagaggacacactttgcaatgt

SEQ ID NO: 327155 - DNA, 25 bp, Homo sapien
gtaatttgtgcagtatgacatgcat

SEQ ID NO: 327156 - DNA, 25 bp, Homo sapien
catttgggtgtgtctggtcaggtac

SEQ ID NO: 327157 - DNA, 25 bp, Homo sapien
gtgtctggtcaggtacatcatgtgg

SEQ ID NO: 327158 - DNA, 25 bp, Homo sapien
ggtacatcatgtggtgtccctgtta

SEQ ID NO: 327159 - DNA, 25 bp, Homo sapien
tggtgtccctgttatgcattttgca

SEQ ID NO: 327160 - DNA, 25 bp, Homo sapien
aggctgatacaacaccccagggaac

SEQ ID NO: 327161 - DNA, 25 bp, Homo sapien
agccaaacacctaagtgctcctttc

SEQ ID NO: 327162 - DNA, 25 bp, Homo sapien
aagtgctcctttctatgaccaaaga

SEQ ID NO: 327163 - DNA, 25 bp, Homo sapien
gtgctcctttctatgaccaaagaat

SEQ ID NO: 327164 - DNA, 25 bp, Homo sapien
gaccaaagaattcctcactgattaa

SEQ ID NO: 327165 - DNA, 25 bp, Homo sapien
gagaagcatggcctctcgagacaaa

SEQ ID NO: 327166 - DNA, 25 bp, Homo sapien
tggcctctcgagacaaacccaggct

SEQ ID NO: 327167 - DNA, 25 bp, Homo sapien
cccaggctgctaagaatgtaagctc

SEQ ID NO: 327168 - DNA, 25 bp, Homo sapien
gaatgtaagctctggtctcactttg

SEQ ID NO: 327169 - DNA, 25 bp, Homo sapien
taagctctggtctcactttgcgttc

SEQ ID NO: 327170 - DNA, 25 bp, Homo sapien
tggtctcactttgcgttccagccaa

SEQ ID NO: 327171 - DNA, 25 bp, Homo sapien
ttgcgttccagccaaacacctaagt

SEQ ID NO: 327172 - DNA, 25 bp, Homo sapien
gggtggcctgggttaccctcctgct

SEQ ID NO: 327173 - DNA, 25 bp, Homo sapien
ggtggcctgggttaccctcctgctc

SEQ ID NO: 327174 - DNA, 25 bp, Homo sapien
gtggcctgggttaccctcctgctca

SEQ ID NO: 327175 - DNA, 25 bp, Homo sapien
tggcctgggttaccctcctgctcag

SEQ ID NO: 327176 - DNA, 25 bp, Homo sapien
ggcctgggttaccctcctgctcagg

SEQ ID NO: 327177 - DNA, 25 bp, Homo sapien
ccctcctgctcaggcgcctgggtcc

SEQ ID NO: 327178 - DNA, 25 bp, Homo sapien
cctcctgctcaggcgcctgggtcca

SEQ ID NO: 327179 - DNA, 25 bp, Homo sapien
cctgggtccactgggctgtctggac

SEQ ID NO: 327180 - DNA, 25 bp, Homo sapien
ctgggtccactgggctgtctggacc

SEQ ID NO: 327181 - DNA, 25 bp, Homo sapien
ggtccactgggctgtctggacccca

SEQ ID NO: 327182 - DNA, 25 bp, Homo sapien
tgtctggaccccaagctaggggact

SEQ ID NO: 327183 - DNA, 25 bp, Homo sapien
agagcccagctctcatggctgtgat

SEQ ID NO: 327184 - DNA, 25 bp, Homo sapien
gagcccagctctcatggctgtgatt

SEQ ID NO: 327185 - DNA, 25 bp, Homo sapien
agcccagctctcatggctgtgattt

SEQ ID NO: 327186 - DNA, 25 bp, Homo sapien
gctgtgatttgtaatcatcagcttt

SEQ ID NO: 327187 - DNA, 25 bp, Homo sapien
gatttgtaatcatcagctttcactc

SEQ ID NO: 327188 - DNA, 25 bp, Homo sapien
atttgtaatcatcagctttcactct

SEQ ID NO: 327189 - DNA, 25 bp, Homo sapien
tttgtaatcatcagctttcactctc

SEQ ID NO: 327190 - DNA, 25 bp, Homo sapien
ttgtaatcatcagctttcactctct

SEQ ID NO: 327191 - DNA, 25 bp, Homo sapien
tgtaatcatcagctttcactctctg

SEQ ID NO: 327192 - DNA, 25 bp, Homo sapien
gtaatcatcagctttcactctctgg

SEQ ID NO: 327193 - DNA, 25 bp, Homo sapien
taatcatcagctttcactctctggc

SEQ ID NO: 327194 - DNA, 25 bp, Homo sapien
gcagaattgggctaggggtcgcctg

SEQ ID NO: 327195 - DNA, 25 bp, Homo sapien
agaattgggctaggggtcgcctgga

SEQ ID NO: 327196 - DNA, 25 bp, Homo sapien
aattgggctaggggtcgcctggagc

SEQ ID NO: 327197 - DNA, 25 bp, Homo sapien
attgggctaggggtcgcctggagcc

SEQ ID NO: 327198 - DNA, 25 bp, Homo sapien
ggctaggggtcgcctggagcccacc

SEQ ID NO: 327199 - DNA, 25 bp, Homo sapien
gctaggggtcgcctggagcccaccc

SEQ ID NO: 327200 - DNA, 25 bp, Homo sapien
aaagaaagacaatttctctgcccct

SEQ ID NO: 327201 - DNA, 25 bp, Homo sapien
aagaaagacaatttctctgcccctt

SEQ ID NO: 327202 - DNA, 25 bp, Homo sapien
agaaagacaatttctctgccccttg

SEQ ID NO: 327203 - DNA, 25 bp, Homo sapien
gaaagacaatttctctgccccttgg

SEQ ID NO: 327204 - DNA, 25 bp, Homo sapien
aaagacaatttctctgccccttggg

SEQ ID NO: 327205 - DNA, 25 bp, Homo sapien
gagcgcaacccaaggtgttctagct

SEQ ID NO: 327206 - DNA, 25 bp, Homo sapien
acccaaggtgttctagctgagcgtt

SEQ ID NO: 327207 - DNA, 25 bp, Homo sapien
caaggtgttctagctgagcgtttaa

SEQ ID NO: 327208 - DNA, 25 bp, Homo sapien
agctgagcgtttaagagcatggact

SEQ ID NO: 327209 - DNA, 25 bp, Homo sapien
gactctggaaccagactttgaatcc

SEQ ID NO: 327210 - DNA, 25 bp, Homo sapien
gaccttgagcaagctatctaaatat

SEQ ID NO: 327211 - DNA, 25 bp, Homo sapien
aatattctgtgcctttgttttgtca

SEQ ID NO: 327212 - DNA, 25 bp, Homo sapien
attctgtgcctttgttttgtcatct

SEQ ID NO: 327213 - DNA, 25 bp, Homo sapien
gagatgatgatggtatcaccttcat

SEQ ID NO: 327214 - DNA, 25 bp, Homo sapien
atgatgatggtatcaccttcatggg

SEQ ID NO: 327215 - DNA, 25 bp, Homo sapien
tcataaggattatgggacttaacat

SEQ ID NO: 327216 - DNA, 25 bp, Homo sapien
gggcaggcggagaacaggcggatca

SEQ ID NO: 327217 - DNA, 25 bp, Homo sapien
ggcaggcggagaacaggcggatcac

SEQ ID NO: 327218 - DNA, 25 bp, Homo sapien
gcaggcggagaacaggcggatcacc

SEQ ID NO: 327219 - DNA, 25 bp, Homo sapien
aggcggagaacaggcggatcaccgt

SEQ ID NO: 327220 - DNA, 25 bp, Homo sapien
agaacaggcggatcaccgtgaggtt

SEQ ID NO: 327221 - DNA, 25 bp, Homo sapien
ggcggatcaccgtgaggttgcagtt

SEQ ID NO: 327222 - DNA, 25 bp, Homo sapien
gcggatcaccgtgaggttgcagttg

SEQ ID NO: 327223 - DNA, 25 bp, Homo sapien
cggatcaccgtgaggttgcagttgg

SEQ ID NO: 327224 - DNA, 25 bp, Homo sapien
atcaccgtgaggttgcagttggaga

SEQ ID NO: 327225 - DNA, 25 bp, Homo sapien
tcaccgtgaggttgcagttggagac

SEQ ID NO: 327226 - DNA, 25 bp, Homo sapien
caccgtgaggttgcagttggagacc

SEQ ID NO: 327227 - DNA, 25 bp, Homo sapien
ggtgaaggctcgtgagactctcaga

SEQ ID NO: 327228 - DNA, 25 bp, Homo sapien
acggctgatgcggttgtgtgacctt

SEQ ID NO: 327229 - DNA, 25 bp, Homo sapien
agactctcagagctagcgttaccgt

SEQ ID NO: 327230 - DNA, 25 bp, Homo sapien
ccctctaacttctgttgttcctata

SEQ ID NO: 327231 - DNA, 25 bp, Homo sapien
tctgttgttcctataatgttactat

SEQ ID NO: 327232 - DNA, 25 bp, Homo sapien
gttactataatgttgcttatttccc

SEQ ID NO: 327233 - DNA, 25 bp, Homo sapien
ccccaaccagatctgcaagggtggt

SEQ ID NO: 327234 - DNA, 25 bp, Homo sapien
agatctgcaagggtggtttcatcac

SEQ ID NO: 327235 - DNA, 25 bp, Homo sapien
tgggtgtccactgtgtcatctataa

SEQ ID NO: 327236 - DNA, 25 bp, Homo sapien
ctgtgtcatctataaaaggagcgtg

SEQ ID NO: 327237 - DNA, 25 bp, Homo sapien
gtgacaatgacgttgcgggcctcgt

SEQ ID NO: 327238 - DNA, 25 bp, Homo sapien
gaaactaagctactttctaaagtga

SEQ ID NO: 327239 - DNA, 25 bp, Homo sapien
gacactgtatcagaataatccagat

SEQ ID NO: 327240 - DNA, 25 bp, Homo sapien
aatataacattttgccaccaactga

SEQ ID NO: 327241 - DNA, 25 bp, Homo sapien
acattttgccaccaactgacattta

SEQ ID NO: 327242 - DNA, 25 bp, Homo sapien
gacatttagatgaaggactgcctct

SEQ ID NO: 327243 - DNA, 25 bp, Homo sapien
tagatgaaggactgcctctctgaaa

SEQ ID NO: 327244 - DNA, 25 bp, Homo sapien
ggactgcctctctgaaagagttcag

SEQ ID NO: 327245 - DNA, 25 bp, Homo sapien
atattttcccactttgcacaaatct

SEQ ID NO: 327246 - DNA, 25 bp, Homo sapien
tttcccactttgcacaaatctgtaa

SEQ ID NO: 327247 - DNA, 25 bp, Homo sapien
tgtaaactacacctttgtttataga

SEQ ID NO: 327248 - DNA, 25 bp, Homo sapien
aaaatgcttgtaatagtcactgtaa

SEQ ID NO: 327249 - DNA, 25 bp, Homo sapien
agggatcagttccaagaagagataa

SEQ ID NO: 327250 - DNA, 25 bp, Homo sapien
ccaagaactgggatgcttcgtcttt

SEQ ID NO: 327251 - DNA, 25 bp, Homo sapien
gggatgcttcgtctttggtttcttc

SEQ ID NO: 327252 - DNA, 25 bp, Homo sapien
tcttctggatcctccctaaattttg

SEQ ID NO: 327253 - DNA, 25 bp, Homo sapien
ggatcctccctaaattttggctaag

SEQ ID NO: 327254 - DNA, 25 bp, Homo sapien
ggctaagaaatctgagtctccattt

SEQ ID NO: 327255 - DNA, 25 bp, Homo sapien
gagtctccatttaagagtgttccca

SEQ ID NO: 327256 - DNA, 25 bp, Homo sapien
ctccatttaagagtgttcccagaaa

SEQ ID NO: 327257 - DNA, 25 bp, Homo sapien
gtgttcccagaaatgatgacatcca

SEQ ID NO: 327258 - DNA, 25 bp, Homo sapien
tgtgaaaatccaagcaagaagaact

SEQ ID NO: 327259 - DNA, 25 bp, Homo sapien
aggggaagcaactcaacatctaaga

SEQ ID NO: 327260 - DNA, 25 bp, Homo sapien
gaaatctatttcaagctacaccatt

SEQ ID NO: 327261 - DNA, 25 bp, Homo sapien
tacaccattgagattaagtctgagg

SEQ ID NO: 327262 - DNA, 25 bp, Homo sapien
aagtctgaggcagttcattgaggca

SEQ ID NO: 327263 - DNA, 25 bp, Homo sapien
ggcagttcattgaggcagctctact

SEQ ID NO: 327264 - DNA, 25 bp, Homo sapien
ggcagctctactataaaagcttact

SEQ ID NO: 327265 - DNA, 25 bp, Homo sapien
aacttattcttcgtctttttgcttg

SEQ ID NO: 327266 - DNA, 25 bp, Homo sapien
tcttcgtctttttgcttggatatga

SEQ ID NO: 327267 - DNA, 25 bp, Homo sapien
gaatttaaggtcttcatgtttaaag

SEQ ID NO: 327268 - DNA, 25 bp, Homo sapien
tttagtgacacatttccatcctatt

SEQ ID NO: 327269 - DNA, 25 bp, Homo sapien
acagaaccttaagtttatgtttgag

SEQ ID NO: 327270 - DNA, 25 bp, Homo sapien
ttgaggtatgtactgcataggaacc

SEQ ID NO: 327271 - DNA, 25 bp, Homo sapien
gtagacacgggaacattggaacatt

SEQ ID NO: 327272 - DNA, 25 bp, Homo sapien
gaacattcaaagtactccaggtctt

SEQ ID NO: 327273 - DNA, 25 bp, Homo sapien
agctgatttctgaccacatgacgtg

SEQ ID NO: 327274 - DNA, 25 bp, Homo sapien
acgtggatgccagtttctcctcatc

SEQ ID NO: 327275 - DNA, 25 bp, Homo sapien
agtttctcctcatcagtagcatggc

SEQ ID NO: 327276 - DNA, 25 bp, Homo sapien
gtagcatggccatccctattagaaa

SEQ ID NO: 327277 - DNA, 25 bp, Homo sapien
gaacatgcatccagggcgagagact

SEQ ID NO: 327278 - DNA, 25 bp, Homo sapien
gagactgagtttcatgcttcttcac

SEQ ID NO: 327279 - DNA, 25 bp, Homo sapien
agtttcatgcttcttcaccttacag

SEQ ID NO: 327280 - DNA, 25 bp, Homo sapien
accttacagccactcaacagaaaac

SEQ ID NO: 327281 - DNA, 25 bp, Homo sapien
gaaatttcacttgttcagtagtcgt

SEQ ID NO: 327282 - DNA, 25 bp, Homo sapien
gaagatttcttgattaagcccagtg

SEQ ID NO: 327283 - DNA, 25 bp, Homo sapien
aatcttatagtttgtggccgagctg

SEQ ID NO: 327284 - DNA, 25 bp, Homo sapien
gagctgaacaggaccagtgcaattt

SEQ ID NO: 327285 - DNA, 25 bp, Homo sapien
gaagactctttttatgtacaccatg

SEQ ID NO: 327286 - DNA, 25 bp, Homo sapien
gtacaccatgatatactcttgtctg

SEQ ID NO: 327287 - DNA, 25 bp, Homo sapien
tcttgtctgcatatcctctgagtgt

SEQ ID NO: 327288 - DNA, 25 bp, Homo sapien
gaattttgatcctagcccagatgat

SEQ ID NO: 327289 - DNA, 25 bp, Homo sapien
ttgctgtaggaaacatgacccctgt

SEQ ID NO: 327290 - DNA, 25 bp, Homo sapien
acatgacccctgttattgaagtgtg

SEQ ID NO: 327291 - DNA, 25 bp, Homo sapien
gggaccttgatatagtggactcttt

SEQ ID NO: 327292 - DNA, 25 bp, Homo sapien
ttagagccagtcttcacactcggaa

SEQ ID NO: 327293 - DNA, 25 bp, Homo sapien
tgaacagggattgccatgccccagt

SEQ ID NO: 327294 - DNA, 25 bp, Homo sapien
acagggattgccatgccccagtctt

SEQ ID NO: 327295 - DNA, 25 bp, Homo sapien
taactcacagcacaaaccctgcaaa

SEQ ID NO: 327296 - DNA, 25 bp, Homo sapien
gcacaaaccctgcaaacccaaagag

SEQ ID NO: 327297 - DNA, 25 bp, Homo sapien
accctgcaaacccaaagagaatatt

SEQ ID NO: 327298 - DNA, 25 bp, Homo sapien
acttgaagcaagaagggtgcatgcc

SEQ ID NO: 327299 - DNA, 25 bp, Homo sapien
gcatgccagtccttctccgacatgg

SEQ ID NO: 327300 - DNA, 25 bp, Homo sapien
ggtaccaggccttgtgcgcctggcc

SEQ ID NO: 327301 - DNA, 25 bp, Homo sapien
gagggcctttcccttgagctactga

SEQ ID NO: 327302 - DNA, 25 bp, Homo sapien
tttcccttgagctactgagctgctt

SEQ ID NO: 327303 - DNA, 25 bp, Homo sapien
cccttgagctactgagctgctttgt

SEQ ID NO: 327304 - DNA, 25 bp, Homo sapien
gccagtgttttaggtttttggcact

SEQ ID NO: 327305 - DNA, 25 bp, Homo sapien
gtttttggcactgagtagctatcct

SEQ ID NO: 327306 - DNA, 25 bp, Homo sapien
ggcactgagtagctatcctcccatt

SEQ ID NO: 327307 - DNA, 25 bp, Homo sapien
tcggcacgagggtatttttagtaga

SEQ ID NO: 327308 - DNA, 25 bp, Homo sapien
ctcccattttaaagtacaaagcact

SEQ ID NO: 327309 - DNA, 25 bp, Homo sapien
caaagcactatgagcaaactgttct

SEQ ID NO: 327310 - DNA, 25 bp, Homo sapien
gagcaaactgttcttgttgatctct

SEQ ID NO: 327311 - DNA, 25 bp, Homo sapien
ctgttcttgttgatctctttgcata

SEQ ID NO: 327312 - DNA, 25 bp, Homo sapien
gatctctttgcataaatctgttaaa

SEQ ID NO: 327313 - DNA, 25 bp, Homo sapien
aagacttccttctaaggattcttga

SEQ ID NO: 327314 - DNA, 25 bp, Homo sapien
ggattcttgatactgctttgccatt

SEQ ID NO: 327315 - DNA, 25 bp, Homo sapien
atacagacatttctaccctcagttt

SEQ ID NO: 327316 - DNA, 25 bp, Homo sapien
gacatttctaccctcagtttctaaa

SEQ ID NO: 327317 - DNA, 25 bp, Homo sapien
taccctcagtttctaaatgtagact

SEQ ID NO: 327318 - DNA, 25 bp, Homo sapien
gtagactatttgttggctagtactt

SEQ ID NO: 327319 - DNA, 25 bp, Homo sapien
ggctagtacttgatagattccttgt

SEQ ID NO: 327320 - DNA, 25 bp, Homo sapien
gtacttgatagattccttgtaagaa

SEQ ID NO: 327321 - DNA, 25 bp, Homo sapien
aatgctgggtaatgtacctggtaac

SEQ ID NO: 327322 - DNA, 25 bp, Homo sapien
aatgtacctggtaacaagcctgtta

SEQ ID NO: 327323 - DNA, 25 bp, Homo sapien
taacttctatagttactccttctaa

SEQ ID NO: 327324 - DNA, 25 bp, Homo sapien
ctatagttactccttctaaaatatt

SEQ ID NO: 327325 - DNA, 25 bp, Homo sapien
aaatggtttgtcttaattataggag

SEQ ID NO: 327326 - DNA, 25 bp, Homo sapien
aacctatagaagttagcattactgc

SEQ ID NO: 327327 - DNA, 25 bp, Homo sapien
agcattactgctaaaatcccagatg

SEQ ID NO: 327328 - DNA, 25 bp, Homo sapien
cccagatgttgtaggactgtacttt

SEQ ID NO: 327329 - DNA, 25 bp, Homo sapien
gtaggactgtacttttgtagagttt

SEQ ID NO: 327330 - DNA, 25 bp, Homo sapien
gagtttagacagagcatcaatccct

SEQ ID NO: 327331 - DNA, 25 bp, Homo sapien
tttagacagagcatcaatcccttct

SEQ ID NO: 327332 - DNA, 25 bp, Homo sapien
ttctccccgcgagtgcagtcggatg

SEQ ID NO: 327333 - DNA, 25 bp, Homo sapien
gagtgcagtcggatgccgttgtccc

SEQ ID NO: 327334 - DNA, 25 bp, Homo sapien
agtcggatgccgttgtccccaaggg

SEQ ID NO: 327335 - DNA, 25 bp, Homo sapien
gcctggctgccgacgccggtggagg

SEQ ID NO: 327336 - DNA, 25 bp, Homo sapien
gaggccacgccgtcggtcgggaacg

SEQ ID NO: 327337 - DNA, 25 bp, Homo sapien
tgcttctgtcgtctgccagaaactg

SEQ ID NO: 327338 - DNA, 25 bp, Homo sapien
ctgtcgtctgccagaaactggctga

SEQ ID NO: 327339 - DNA, 25 bp, Homo sapien
gaaactggctgagccaagtgcactt

SEQ ID NO: 327340 - DNA, 25 bp, Homo sapien
agccaagtgcacttgcagacgccat

SEQ ID NO: 327341 - DNA, 25 bp, Homo sapien
gcagacgccatctgttctccctggg

SEQ ID NO: 327342 - DNA, 25 bp, Homo sapien
tggagcgagggaactccggccccac

SEQ ID NO: 327343 - DNA, 25 bp, Homo sapien
tccggccccacaaaggccagggaat

SEQ ID NO: 327344 - DNA, 25 bp, Homo sapien
cacaaaggccagggaatcctccagt

SEQ ID NO: 327345 - DNA, 25 bp, Homo sapien
gatagaaagtaacagggcatccctc

SEQ ID NO: 327346 - DNA, 25 bp, Homo sapien
agggcatccctcctgagtaaaacaa

SEQ ID NO: 327347 - DNA, 25 bp, Homo sapien
tccctcctgagtaaaacaatcctgc

SEQ ID NO: 327348 - DNA, 25 bp, Homo sapien
taatccatcttctctaaccatggac

SEQ ID NO: 327349 - DNA, 25 bp, Homo sapien
cttctctaaccatggactcaatcca

SEQ ID NO: 327350 - DNA, 25 bp, Homo sapien
atggactcaatccacatcccagcgt

SEQ ID NO: 327351 - DNA, 25 bp, Homo sapien
aatccacatcccagcgtgtctcaat

SEQ ID NO: 327352 - DNA, 25 bp, Homo sapien
atctggaattcctcaatgaagtctg

SEQ ID NO: 327353 - DNA, 25 bp, Homo sapien
tggaattcctcaatgaagtctgaag

SEQ ID NO: 327354 - DNA, 25 bp, Homo sapien
aagtctgaagatgcatgtttccagc

SEQ ID NO: 327355 - DNA, 25 bp, Homo sapien
gaagatgcatgtttccagcattagt

SEQ ID NO: 327356 - DNA, 25 bp, Homo sapien
gtttccagcattagtttgattccca

SEQ ID NO: 327357 - DNA, 25 bp, Homo sapien
gtttgattcccaatgtgagcaagaa

SEQ ID NO: 327358 - DNA, 25 bp, Homo sapien
gaattagacacaactatgtcattat

SEQ ID NO: 327359 - DNA, 25 bp, Homo sapien
ttcgccgctcattctgcttttcttc

SEQ ID NO: 327360 - DNA, 25 bp, Homo sapien
aggtctcgctgcaatctgctttatc

SEQ ID NO: 327361 - DNA, 25 bp, Homo sapien
tatgcctctctgtgcaatcttgcca

SEQ ID NO: 327362 - DNA, 25 bp, Homo sapien
aatcttgccacattgcacagtgctt

SEQ ID NO: 327363 - DNA, 25 bp, Homo sapien
gcacagtgcttgagttagcgcaata

SEQ ID NO: 327364 - DNA, 25 bp, Homo sapien
gtcattgaagtctttaactctagcc

SEQ ID NO: 327365 - DNA, 25 bp, Homo sapien
gtctttaactctagcctgactctaa

SEQ ID NO: 327366 - DNA, 25 bp, Homo sapien
tgactctaaggccagggttcaccta

SEQ ID NO: 327367 - DNA, 25 bp, Homo sapien
agggttcacctaatctccccatagc

SEQ ID NO: 327368 - DNA, 25 bp, Homo sapien
tggcccctagtcaaagccccataaa

SEQ ID NO: 327369 - DNA, 25 bp, Homo sapien
aagccccataaagagttgttgaaag

SEQ ID NO: 327370 - DNA, 25 bp, Homo sapien
atacagatgaaccaagtgtctaaaa

SEQ ID NO: 327371 - DNA, 25 bp, Homo sapien
aatacttgagaaatttgtggttgca

SEQ ID NO: 327372 - DNA, 25 bp, Homo sapien
gaaatttgtggttgcatgtctgttt

SEQ ID NO: 327373 - DNA, 25 bp, Homo sapien
gccagaatattctaacctactaagt

SEQ ID NO: 327374 - DNA, 25 bp, Homo sapien
gaatattctaacctactaagtctgt

SEQ ID NO: 327375 - DNA, 25 bp, Homo sapien
tctaacctactaagtctgtgtcctt

SEQ ID NO: 327376 - DNA, 25 bp, Homo sapien
tctgtgtcctttgctccttttgtag

SEQ ID NO: 327377 - DNA, 25 bp, Homo sapien
tgtcctttgctccttttgtagtata

SEQ ID NO: 327378 - DNA, 25 bp, Homo sapien
tcctttgctccttttgtagtatact

SEQ ID NO: 327379 - DNA, 25 bp, Homo sapien
tttgctccttttgtagtatactttc

SEQ ID NO: 327380 - DNA, 25 bp, Homo sapien
tactttcatctaaattactgatccc

SEQ ID NO: 327381 - DNA, 25 bp, Homo sapien
gggctaaagatagaaactgcagctt

SEQ ID NO: 327382 - DNA, 25 bp, Homo sapien
ctgcagcttacatgggaaatttggc

SEQ ID NO: 327383 - DNA, 25 bp, Homo sapien
aagtttgttaactagctcacctcct

SEQ ID NO: 327384 - DNA, 25 bp, Homo sapien
actagctcacctcctatacataata

SEQ ID NO: 327385 - DNA, 25 bp, Homo sapien
actgactgcaggctgagatacttct

SEQ ID NO: 327386 - DNA, 25 bp, Homo sapien
gagatacttctgtcgggtttcatca

SEQ ID NO: 327387 - DNA, 25 bp, Homo sapien
tgtcgggtttcatcattctcacatc

SEQ ID NO: 327388 - DNA, 25 bp, Homo sapien
attctcacatcccatttccgctgaa

SEQ ID NO: 327389 - DNA, 25 bp, Homo sapien
tttccgctgaaccagatgcttgcta

SEQ ID NO: 327390 - DNA, 25 bp, Homo sapien
accagatgcttgctagcgacaggca

SEQ ID NO: 327391 - DNA, 25 bp, Homo sapien
aacccaccgaaaatcagcagttcca

SEQ ID NO: 327392 - DNA, 25 bp, Homo sapien
actttttcacaattcttgactctga

SEQ ID NO: 327393 - DNA, 25 bp, Homo sapien
aaagcagcactgtagggacctgaac

SEQ ID NO: 327394 - DNA, 25 bp, Homo sapien
gtagggacctgaactctccattcta

SEQ ID NO: 327395 - DNA, 25 bp, Homo sapien
tgaactctccattctaccagttcac

SEQ ID NO: 327396 - DNA, 25 bp, Homo sapien
agttcacccttctgacctgttctgc

SEQ ID NO: 327397 - DNA, 25 bp, Homo sapien
aatggatgactgttggccttttctc

SEQ ID NO: 327398 - DNA, 25 bp, Homo sapien
ggccttttctccaatctcaaagtga

SEQ ID NO: 327399 - DNA, 25 bp, Homo sapien
agtgacagatttgggctgattcttt

SEQ ID NO: 327400 - DNA, 25 bp, Homo sapien
ttttggtaccccattcctgttgaat

SEQ ID NO: 327401 - DNA, 25 bp, Homo sapien
gaatgggctcagtcttgacaaacca

SEQ ID NO: 327402 - DNA, 25 bp, Homo sapien
tgacaaaccaattccctgtaacttt

SEQ ID NO: 327403 - DNA, 25 bp, Homo sapien
ttgccttttgttcctccggaggaag

SEQ ID NO: 327404 - DNA, 25 bp, Homo sapien
atgggagtttccaagtatggcataa

SEQ ID NO: 327405 - DNA, 25 bp, Homo sapien
ggcataaaagtatcaacatcagatc

SEQ ID NO: 327406 - DNA, 25 bp, Homo sapien
atgttggtgccattgagaaactgaa

SEQ ID NO: 327407 - DNA, 25 bp, Homo sapien
gagaaactgaaactctccgagggaa

SEQ ID NO: 327408 - DNA, 25 bp, Homo sapien
ctctccgagggaaaaggccttgaag

SEQ ID NO: 327409 - DNA, 25 bp, Homo sapien
gccttgaagggccattagacctgat

SEQ ID NO: 327410 - DNA, 25 bp, Homo sapien
gggccattagacctgataaattata

SEQ ID NO: 327411 - DNA, 25 bp, Homo sapien
aattatatagacgttgcccagcaag

SEQ ID NO: 327412 - DNA, 25 bp, Homo sapien
atagacgttgcccagcaagatggaa

SEQ ID NO: 327413 - DNA, 25 bp, Homo sapien
tgcccagcaagatggaaagttgcct

SEQ ID NO: 327414 - DNA, 25 bp, Homo sapien
gtcgaccagcctccttaggttcaag

SEQ ID NO: 327415 - DNA, 25 bp, Homo sapien
cgaccagcctccttaggttcaagca

SEQ ID NO: 327416 - DNA, 25 bp, Homo sapien
accgtgctcagcctataatgtattt

SEQ ID NO: 327417 - DNA, 25 bp, Homo sapien
gctcagcctataatgtatttttact

SEQ ID NO: 327418 - DNA, 25 bp, Homo sapien
tatttttactccaacaaacaacctg

SEQ ID NO: 327419 - DNA, 25 bp, Homo sapien
ttttactccaacaaacaacctgcct

SEQ ID NO: 327420 - DNA, 25 bp, Homo sapien
tttactccaacaaacaacctgcctt

SEQ ID NO: 327421 - DNA, 25 bp, Homo sapien
ttactccaacaaacaacctgcctta

SEQ ID NO: 327422 - DNA, 25 bp, Homo sapien
tactccaacaaacaacctgccttat

SEQ ID NO: 327423 - DNA, 25 bp, Homo sapien
tgccttatccccatttcccaaagat

SEQ ID NO: 327424 - DNA, 25 bp, Homo sapien
gccttatccccatttcccaaagatt

SEQ ID NO: 327425 - DNA, 25 bp, Homo sapien
agccagagacagagcccctcgagag

SEQ ID NO: 327426 - DNA, 25 bp, Homo sapien
agacagagcccctcgagagggatcc

SEQ ID NO: 327427 - DNA, 25 bp, Homo sapien
gacagagcccctcgagagggatcct

SEQ ID NO: 327428 - DNA, 25 bp, Homo sapien
agagcccctcgagagggatccttgg

SEQ ID NO: 327429 - DNA, 25 bp, Homo sapien
gagcccctcgagagggatccttggc

SEQ ID NO: 327430 - DNA, 25 bp, Homo sapien
agcccctcgagagggatccttggct

SEQ ID NO: 327431 - DNA, 25 bp, Homo sapien
tggctgcttcattgtcttcccccca

SEQ ID NO: 327432 - DNA, 25 bp, Homo sapien
gggtcttggtatggtccccgctcac

SEQ ID NO: 327433 - DNA, 25 bp, Homo sapien
gtcttggtatggtccccgctcacct

SEQ ID NO: 327434 - DNA, 25 bp, Homo sapien
ccttccagagtcctgagtggtgtgg

SEQ ID NO: 327435 - DNA, 25 bp, Homo sapien
tccagagtcctgagtggtgtgggtg

SEQ ID NO: 327436 - DNA, 25 bp, Homo sapien
ctgttttttgtttgtcacctctatt

SEQ ID NO: 327437 - DNA, 25 bp, Homo sapien
gtcacctctatttagttgttacctg

SEQ ID NO: 327438 - DNA, 25 bp, Homo sapien
ttagttgttacctgtttctctcttc

SEQ ID NO: 327439 - DNA, 25 bp, Homo sapien
tccacccttttaagagttacgctag

SEQ ID NO: 327440 - DNA, 25 bp, Homo sapien
gttacgctagcagatcttactccac

SEQ ID NO: 327441 - DNA, 25 bp, Homo sapien
gatcttactccacgtatactttttg

SEQ ID NO: 327442 - DNA, 25 bp, Homo sapien
actttttggtttgtgaaggcatcgg

SEQ ID NO: 327443 - DNA, 25 bp, Homo sapien
aaggcatcggttaagggcacaaaga

SEQ ID NO: 327444 - DNA, 25 bp, Homo sapien
aaatacgtctctaattgccacactg

SEQ ID NO: 327445 - DNA, 25 bp, Homo sapien
gtagtattttcccagtcagctttgc

SEQ ID NO: 327446 - DNA, 25 bp, Homo sapien
gctttgccatactgacgtcaatcat

SEQ ID NO: 327447 - DNA, 25 bp, Homo sapien
aaagggtttgcctgcttggtacctg

SEQ ID NO: 327448 - DNA, 25 bp, Homo sapien
tggtacctgctctggaacttcgaga

SEQ ID NO: 327449 - DNA, 25 bp, Homo sapien
gaacttcgagatactaatctggagt

SEQ ID NO: 327450 - DNA, 25 bp, Homo sapien
tgtcaggcttgctgttaaccgagaa

SEQ ID NO: 327451 - DNA, 25 bp, Homo sapien
tgttaaccgagaacggctgaaggct

SEQ ID NO: 327452 - DNA, 25 bp, Homo sapien
aaggctgggcgagacgcgggccaat

SEQ ID NO: 327453 - DNA, 25 bp, Homo sapien
actgtcgggctcatgtgcatttttt

SEQ ID NO: 327454 - DNA, 25 bp, Homo sapien
ggccaatgcgtctgcccgttcgggc

SEQ ID NO: 327455 - DNA, 25 bp, Homo sapien
acgaggagtgtttgggcagcctaat

SEQ ID NO: 327456 - DNA, 25 bp, Homo sapien
ggcagcctaatccttattcatcgat

SEQ ID NO: 327457 - DNA, 25 bp, Homo sapien
gagagaggcctagcgtctgttatgg

SEQ ID NO: 327458 - DNA, 25 bp, Homo sapien
taatactactaataatgtgggcaat

SEQ ID NO: 327459 - DNA, 25 bp, Homo sapien
gctggggcctgtgatagtttttaga

SEQ ID NO: 327460 - DNA, 25 bp, Homo sapien
gtgtattttacactagtcaagtaat

SEQ ID NO: 327461 - DNA, 25 bp, Homo sapien
gtcaagtaatcctagatatccgtgg

SEQ ID NO: 327462 - DNA, 25 bp, Homo sapien
aatcctagatatccgtggtttttct

SEQ ID NO: 327463 - DNA, 25 bp, Homo sapien
tagatatccgtggtttttcttaaga

SEQ ID NO: 327464 - DNA, 25 bp, Homo sapien
tttcttaagaaagttggctcgtaat

SEQ ID NO: 327465 - DNA, 25 bp, Homo sapien
aagttggctcgtaatatgatttaat

SEQ ID NO: 327466 - DNA, 25 bp, Homo sapien
tccggctcccatgatgctgtgcata

SEQ ID NO: 327467 - DNA, 25 bp, Homo sapien
gatgctgtgcatatacctagcaaaa

SEQ ID NO: 327468 - DNA, 25 bp, Homo sapien
caattattggacacattggagtgca

SEQ ID NO: 327469 - DNA, 25 bp, Homo sapien
gacttccttaagaggtgtttcctga

SEQ ID NO: 327470 - DNA, 25 bp, Homo sapien
gtttcctgaacctaattctcataat

SEQ ID NO: 327471 - DNA, 25 bp, Homo sapien
tataccttatcctaaagagctcata

SEQ ID NO: 327472 - DNA, 25 bp, Homo sapien
aacaaataagttacctccactctat

SEQ ID NO: 327473 - DNA, 25 bp, Homo sapien
gttacctccactctataaactcaga

SEQ ID NO: 327474 - DNA, 25 bp, Homo sapien
taaactcagacctactttttgaaga

SEQ ID NO: 327475 - DNA, 25 bp, Homo sapien
gacctactttttgaagataactgct

SEQ ID NO: 327476 - DNA, 25 bp, Homo sapien
agataactgcttttaacctctcctt

SEQ ID NO: 327477 - DNA, 25 bp, Homo sapien
taacctctccttacaagatttttgt

SEQ ID NO: 327478 - DNA, 25 bp, Homo sapien
attttagcccatgtctcaattctca

SEQ ID NO: 327479 - DNA, 25 bp, Homo sapien
ttagcccatgtctcaattctcattt

SEQ ID NO: 327480 - DNA, 25 bp, Homo sapien
tcagggaaaggtgggctgccttttc

SEQ ID NO: 327481 - DNA, 25 bp, Homo sapien
tttccccttgtccttatttagcgat

SEQ ID NO: 327482 - DNA, 25 bp, Homo sapien
ttgtccttatttagcgatgccgccg

SEQ ID NO: 327483 - DNA, 25 bp, Homo sapien
cttatttagcgatgccgccgggcat

SEQ ID NO: 327484 - DNA, 25 bp, Homo sapien
gccgggcatttaacacccacctgga

SEQ ID NO: 327485 - DNA, 25 bp, Homo sapien
ggcgaaccagccatgggacggtcac

SEQ ID NO: 327486 - DNA, 25 bp, Homo sapien
gccatgggacggtcacccagcagtg

SEQ ID NO: 327487 - DNA, 25 bp, Homo sapien
ctgcggtgcggtccacgggagagca

SEQ ID NO: 327488 - DNA, 25 bp, Homo sapien
ctccagctggaaaggccaggcctgg

SEQ ID NO: 327489 - DNA, 25 bp, Homo sapien
ggagcttgcctcttcagtatttgtg

SEQ ID NO: 327490 - DNA, 25 bp, Homo sapien
cctcttcagtatttgtggcagtttt

SEQ ID NO: 327491 - DNA, 25 bp, Homo sapien
cctggctttcttggctgtgagagag

SEQ ID NO: 327492 - DNA, 25 bp, Homo sapien
ggaaagacaaccgtcactctgttac

SEQ ID NO: 327493 - DNA, 25 bp, Homo sapien
acaaccgtcactctgttacaagcag

SEQ ID NO: 327494 - DNA, 25 bp, Homo sapien
tgttacaagcagagaccaaggactt

SEQ ID NO: 327495 - DNA, 25 bp, Homo sapien
gaccaaggacttggaacgtcctcca

SEQ ID NO: 327496 - DNA, 25 bp, Homo sapien
cttggaacgtcctccaaactctggg

SEQ ID NO: 327497 - DNA, 25 bp, Homo sapien
atgaaggccgaagtcgctgctgaga

SEQ ID NO: 327498 - DNA, 25 bp, Homo sapien
aaaagcgcctcacgcattctgttcc

SEQ ID NO: 327499 - DNA, 25 bp, Homo sapien
acgcattctgttccttgttgcttct

SEQ ID NO: 327500 - DNA, 25 bp, Homo sapien
cttgttgcttctcggtttgtagata

SEQ ID NO: 327501 - DNA, 25 bp, Homo sapien
gcttctcggtttgtagataaacatg

SEQ ID NO: 327502 - DNA, 25 bp, Homo sapien
aaacgagtttataatcctataatga

SEQ ID NO: 327503 - DNA, 25 bp, Homo sapien
tataatgaagaatactggcacaggc

SEQ ID NO: 327504 - DNA, 25 bp, Homo sapien
aatactggcacaggcaatgctcact

SEQ ID NO: 327505 - DNA, 25 bp, Homo sapien
tggcacaggcaatgctcactcgaaa

SEQ ID NO: 327506 - DNA, 25 bp, Homo sapien
tcaagtaatttctagttggttttgg

SEQ ID NO: 327507 - DNA, 25 bp, Homo sapien
tagttggttttggaatgcttgataa

SEQ ID NO: 327508 - DNA, 25 bp, Homo sapien
tagctaatgaactcatcaccaggac

SEQ ID NO: 327509 - DNA, 25 bp, Homo sapien
taggccgaggttaaatggtccacgt

SEQ ID NO: 327510 - DNA, 25 bp, Homo sapien
taaatggtccacgtttcaaaaatgt

SEQ ID NO: 327511 - DNA, 25 bp, Homo sapien
ggtccacgtttcaaaaatgttaatg

SEQ ID NO: 327512 - DNA, 25 bp, Homo sapien
gttaatggctaatccataattaaag

SEQ ID NO: 327513 - DNA, 25 bp, Homo sapien
acatttggtaaggttactcctcatt

SEQ ID NO: 327514 - DNA, 25 bp, Homo sapien
aaggttactcctcatttctctacat

SEQ ID NO: 327515 - DNA, 25 bp, Homo sapien
tctctacatcatgagaggcagtgta

SEQ ID NO: 327516 - DNA, 25 bp, Homo sapien
agcagctttgcccaagtcttagttt

SEQ ID NO: 327517 - DNA, 25 bp, Homo sapien
gcccaagtcttagtttctgaaaccg

SEQ ID NO: 327518 - DNA, 25 bp, Homo sapien
tctgaaaccgtgatcttagactcat

SEQ ID NO: 327519 - DNA, 25 bp, Homo sapien
agactcatcatttaactagccgttt

SEQ ID NO: 327520 - DNA, 25 bp, Homo sapien
ctagccgtttaaatgtccacttgtt

SEQ ID NO: 327521 - DNA, 25 bp, Homo sapien
taaatgtccacttgttaaactgtaa

SEQ ID NO: 327522 - DNA, 25 bp, Homo sapien
ggtttctgacctacccaccttacag

SEQ ID NO: 327523 - DNA, 25 bp, Homo sapien
ccaccttacaggctcattctaaaga

SEQ ID NO: 327524 - DNA, 25 bp, Homo sapien
ttatcatggtaagggtgtggtcagc

SEQ ID NO: 327525 - DNA, 25 bp, Homo sapien
tatgatctcagcagaagtccctcta

SEQ ID NO: 327526 - DNA, 25 bp, Homo sapien
taccaccccatagcttagtaatttt

SEQ ID NO: 327527 - DNA, 25 bp, Homo sapien
attttcttaccaacagctagctgag

SEQ ID NO: 327528 - DNA, 25 bp, Homo sapien
gctagctgaggtagtgtgcatccca

SEQ ID NO: 327529 - DNA, 25 bp, Homo sapien
gctgaggtagtgtgcatcccagacg

SEQ ID NO: 327530 - DNA, 25 bp, Homo sapien
ttttctcccttcttcacttacaatt

SEQ ID NO: 327531 - DNA, 25 bp, Homo sapien
ccttcttcacttacaattctttctt

SEQ ID NO: 327532 - DNA, 25 bp, Homo sapien
tacaattctttctttcaaccactgg

SEQ ID NO: 327533 - DNA, 25 bp, Homo sapien
tctttcaaccactggtagcactggg

SEQ ID NO: 327534 - DNA, 25 bp, Homo sapien
atgtctggtaaagatctgatgtcaa

SEQ ID NO: 327535 - DNA, 25 bp, Homo sapien
gcccagcccctattttttctgaaat

SEQ ID NO: 327536 - DNA, 25 bp, Homo sapien
cagcccctattttttctgaaataat

SEQ ID NO: 327537 - DNA, 25 bp, Homo sapien
ctgaaataatttttcggatatactt

SEQ ID NO: 327538 - DNA, 25 bp, Homo sapien
tgaaataatttttcggatatacttt

SEQ ID NO: 327539 - DNA, 25 bp, Homo sapien
taatttttcggatatacttttatat

SEQ ID NO: 327540 - DNA, 25 bp, Homo sapien
tttttcggatatacttttatatttg

SEQ ID NO: 327541 - DNA, 25 bp, Homo sapien
ttttcggatatacttttatatttga

SEQ ID NO: 327542 - DNA, 25 bp, Homo sapien
tttcggatatacttttatatttgaa

SEQ ID NO: 327543 - DNA, 25 bp, Homo sapien
ttcggatatacttttatatttgaaa

SEQ ID NO: 327544 - DNA, 25 bp, Homo sapien
tcggatatacttttatatttgaaat

SEQ ID NO: 327545 - DNA, 25 bp, Homo sapien
cggatatacttttatatttgaaatt

SEQ ID NO: 327546 - DNA, 25 bp, Homo sapien
gcaggagggtaacccaggccacccg

SEQ ID NO: 327547 - DNA, 25 bp, Homo sapien
gggctccaggcgacccctagcccaa

SEQ ID NO: 327548 - DNA, 25 bp, Homo sapien
aggcgacccctagcccaattctgcc

SEQ ID NO: 327549 - DNA, 25 bp, Homo sapien
gggcagagaaattgtctttctttgc

SEQ ID NO: 327550 - DNA, 25 bp, Homo sapien
gaaattgtctttctttgctgactcc

SEQ ID NO: 327551 - DNA, 25 bp, Homo sapien
attgtctttctttgctgactcctac

SEQ ID NO: 327552 - DNA, 25 bp, Homo sapien
agtcccctagcttggggtccagaca

SEQ ID NO: 327553 - DNA, 25 bp, Homo sapien
gtccagacagcccagtggacccagg

SEQ ID NO: 327554 - DNA, 25 bp, Homo sapien
ccagtggacccaggcgcctgagcag

SEQ ID NO: 327555 - DNA, 25 bp, Homo sapien
tgagcaggagggtaacccaggccac

SEQ ID NO: 327556 - DNA, 25 bp, Homo sapien
gagcaggagggtaacccaggccacc

SEQ ID NO: 327557 - DNA, 25 bp, Homo sapien
gatatggtaaggtacttgagaccct

SEQ ID NO: 327558 - DNA, 25 bp, Homo sapien
ttgagacccttcaccagaatgtcaa

SEQ ID NO: 327559 - DNA, 25 bp, Homo sapien
cttcaccagaatgtcaatctttttt

SEQ ID NO: 327560 - DNA, 25 bp, Homo sapien
ttctgtgtaacatggaaacttgtgt

SEQ ID NO: 327561 - DNA, 25 bp, Homo sapien
tggaaacttgtgtgaccattagcat

SEQ ID NO: 327562 - DNA, 25 bp, Homo sapien
gtgaccattagcattgttatcagct

SEQ ID NO: 327563 - DNA, 25 bp, Homo sapien
gttatcagcttgtactggtctcata

SEQ ID NO: 327564 - DNA, 25 bp, Homo sapien
agcttgtactggtctcataactctg

SEQ ID NO: 327565 - DNA, 25 bp, Homo sapien
gtactggtctcataactctggtttt

SEQ ID NO: 327566 - DNA, 25 bp, Homo sapien
actggtctcataactctggttttgg

SEQ ID NO: 327567 - DNA, 25 bp, Homo sapien
atttggaaattgttgctgtgttctg

SEQ ID NO: 327568 - DNA, 25 bp, Homo sapien
gggtacgaggattaccggcacgcac

SEQ ID NO: 327569 - DNA, 25 bp, Homo sapien
gaggacgcggactcctcctacgtgc

SEQ ID NO: 327570 - DNA, 25 bp, Homo sapien
cctacgtgcgcttcgccaagggcga

SEQ ID NO: 327571 - DNA, 25 bp, Homo sapien
caagggcgaggtccccaagcatgac

SEQ ID NO: 327572 - DNA, 25 bp, Homo sapien
aggtccccaagcatgactacaacta

SEQ ID NO: 327573 - DNA, 25 bp, Homo sapien
atgactacaactacccctacgtgga

SEQ ID NO: 327574 - DNA, 25 bp, Homo sapien
ctacgtggactcctcagactttggc

SEQ ID NO: 327575 - DNA, 25 bp, Homo sapien
actcctcagactttggcctaggcga

SEQ ID NO: 327576 - DNA, 25 bp, Homo sapien
ttggcctaggcgaggaccccaaagg

SEQ ID NO: 327577 - DNA, 25 bp, Homo sapien
tgcgtgtactgcagggacatgttca

SEQ ID NO: 327578 - DNA, 25 bp, Homo sapien
tgtactgcagggacatgttcaacca

SEQ ID NO: 327579 - DNA, 25 bp, Homo sapien
cttttaagccataagttcttactgt

SEQ ID NO: 327580 - DNA, 25 bp, Homo sapien
tcagcttcacttgcactgcaagtac

SEQ ID NO: 327581 - DNA, 25 bp, Homo sapien
cttgcactgcaagtactaggagttt

SEQ ID NO: 327582 - DNA, 25 bp, Homo sapien
acatgtgtccacttaagggctttct

SEQ ID NO: 327583 - DNA, 25 bp, Homo sapien
atgtgtccacttaagggctttctgt

SEQ ID NO: 327584 - DNA, 25 bp, Homo sapien
tgtgagcaggtctggccaaggttct

SEQ ID NO: 327585 - DNA, 25 bp, Homo sapien
aggtctggccaaggttctcagtcag

SEQ ID NO: 327586 - DNA, 25 bp, Homo sapien
aggttctcagtcagtgtcttggtta

SEQ ID NO: 327587 - DNA, 25 bp, Homo sapien
gttctcagtcagtgtcttggttaag

SEQ ID NO: 327588 - DNA, 25 bp, Homo sapien
tgtcttggttaagatgctttcagcc

SEQ ID NO: 327589 - DNA, 25 bp, Homo sapien
aaaaaagatcaactcagcatagtaa

SEQ ID NO: 327590 - DNA, 25 bp, Homo sapien
cagtattaggtatattcagatgctt

SEQ ID NO: 327591 - DNA, 25 bp, Homo sapien
ttcagatgcttacaaagacattttt

SEQ ID NO: 327592 - DNA, 25 bp, Homo sapien
tgagcatcaggatttatcacatagg

SEQ ID NO: 327593 - DNA, 25 bp, Homo sapien
tcaggatttatcacataggtcaaaa

SEQ ID NO: 327594 - DNA, 25 bp, Homo sapien
agtggctatattatgtggcccatgt

SEQ ID NO: 327595 - DNA, 25 bp, Homo sapien
gctatattatgtggcccatgtgtgg

SEQ ID NO: 327596 - DNA, 25 bp, Homo sapien
ttttgcttttgttcagtaacagatg

SEQ ID NO: 327597 - DNA, 25 bp, Homo sapien
gatgaattaagagccttgcccagga

SEQ ID NO: 327598 - DNA, 25 bp, Homo sapien
aagagccttgcccaggaatcttggt

SEQ ID NO: 327599 - DNA, 25 bp, Homo sapien
gccttgcccaggaatcttggttcag

SEQ ID NO: 327600 - DNA, 25 bp, Homo sapien
gcccaggaatcttggttcaggatgg

SEQ ID NO: 327601 - DNA, 25 bp, Homo sapien
cagtacctgagccaagcagttgtag

SEQ ID NO: 327602 - DNA, 25 bp, Homo sapien
ctgagccaagcagttgtagaagtgt

SEQ ID NO: 327603 - DNA, 25 bp, Homo sapien
gtgtttgtaaactacacgaagacaa

SEQ ID NO: 327604 - DNA, 25 bp, Homo sapien
tacacgaagacaaattccacagtaa

SEQ ID NO: 327605 - DNA, 25 bp, Homo sapien
gagcagtgctgataaaagtacccta

SEQ ID NO: 327606 - DNA, 25 bp, Homo sapien
ttattgcttacaaagatggctacgt

SEQ ID NO: 327607 - DNA, 25 bp, Homo sapien
aaagatggctacgtgttgacccctc

SEQ ID NO: 327608 - DNA, 25 bp, Homo sapien
gtgttgacccctctgccttggaaaa

SEQ ID NO: 327609 - DNA, 25 bp, Homo sapien
gaaaaccagaagaatgccaatatat

SEQ ID NO: 327610 - DNA, 25 bp, Homo sapien
atcagttacactttcactgttcccg

SEQ ID NO: 327611 - DNA, 25 bp, Homo sapien
actttcactgttcccgcaaagccaa

SEQ ID NO: 327612 - DNA, 25 bp, Homo sapien
agaacgactattgggaggaggtaca

SEQ ID NO: 327613 - DNA, 25 bp, Homo sapien
tgcagcctgctacctcacttttggc

SEQ ID NO: 327614 - DNA, 25 bp, Homo sapien
agttagcaccttacatatttgatgc

SEQ ID NO: 327615 - DNA, 25 bp, Homo sapien
gcaccttacatatttgatgctcagg

SEQ ID NO: 327616 - DNA, 25 bp, Homo sapien
aagaaagtgcaagaagatccctaat

SEQ ID NO: 327617 - DNA, 25 bp, Homo sapien
aagtttttgaagtaggctgcttggg

SEQ ID NO: 327618 - DNA, 25 bp, Homo sapien
cacccttacatctccatagttggta

SEQ ID NO: 327619 - DNA, 25 bp, Homo sapien
ctccatagttggtacagttagcttg

SEQ ID NO: 327620 - DNA, 25 bp, Homo sapien
ggtacagttagcttgtagcagctga

SEQ ID NO: 327621 - DNA, 25 bp, Homo sapien
gttagcttgtagcagctgaagctga

SEQ ID NO: 327622 - DNA, 25 bp, Homo sapien
agctgatgcctggagatcactgtct

SEQ ID NO: 327623 - DNA, 25 bp, Homo sapien
gccaactgctcccaaatgtacatag

SEQ ID NO: 327624 - DNA, 25 bp, Homo sapien
gtacataggtggtgctacttgatcc

SEQ ID NO: 327625 - DNA, 25 bp, Homo sapien
ggtgctacttgatccattaacttca

SEQ ID NO: 327626 - DNA, 25 bp, Homo sapien
agagtctgagcttcatctcgaacct

SEQ ID NO: 327627 - DNA, 25 bp, Homo sapien
atctcgaaccttgtctttggcatct

SEQ ID NO: 327628 - DNA, 25 bp, Homo sapien
tggcatctcccattctgtctattaa

SEQ ID NO: 327629 - DNA, 25 bp, Homo sapien
acaataaccattgctacataggatt

SEQ ID NO: 327630 - DNA, 25 bp, Homo sapien
aagcgtgttgataatctgtccacaa

SEQ ID NO: 327631 - DNA, 25 bp, Homo sapien
gataatctgtccacaaaggcactta

SEQ ID NO: 327632 - DNA, 25 bp, Homo sapien
atttccaatcccattaatgataccc

SEQ ID NO: 327633 - DNA, 25 bp, Homo sapien
aataagacacagacacacgccttct

SEQ ID NO: 327634 - DNA, 25 bp, Homo sapien
aatcacgtattttagtctgatgctg

SEQ ID NO: 327635 - DNA, 25 bp, Homo sapien
cgtattttagtctgatgctgttgta

SEQ ID NO: 327636 - DNA, 25 bp, Homo sapien
tagtctgatgctgttgtattttttc

SEQ ID NO: 327637 - DNA, 25 bp, Homo sapien
aacactacttacttcttattctctt

SEQ ID NO: 327638 - DNA, 25 bp, Homo sapien
tacttacttcttattctcttaacaa

SEQ ID NO: 327639 - DNA, 25 bp, Homo sapien
gtttcttaaagagtacagaggccat

SEQ ID NO: 327640 - DNA, 25 bp, Homo sapien
agaggccattgaagccttttgctcc

SEQ ID NO: 327641 - DNA, 25 bp, Homo sapien
cattgaagccttttgctcctcttac

SEQ ID NO: 327642 - DNA, 25 bp, Homo sapien
ttttgctcctcttaccgtgaaaatg

SEQ ID NO: 327643 - DNA, 25 bp, Homo sapien
aatgttagccattgtatggctagga

SEQ ID NO: 327644 - DNA, 25 bp, Homo sapien
gtatggctaggaaccaatgcacttg

SEQ ID NO: 327645 - DNA, 25 bp, Homo sapien
gccagggcgccgtggacgttcggaa

SEQ ID NO: 327646 - DNA, 25 bp, Homo sapien
cagggcgccgtggacgttcggaacg

SEQ ID NO: 327647 - DNA, 25 bp, Homo sapien
tggacgttcggaacggaaaggcctg

SEQ ID NO: 327648 - DNA, 25 bp, Homo sapien
ggaggtgagatgagcggcggcgccc

SEQ ID NO: 327649 - DNA, 25 bp, Homo sapien
ccgactccaccgcagagtgggagag

SEQ ID NO: 327650 - DNA, 25 bp, Homo sapien
cagagtgggagaggccgacgctccc

SEQ ID NO: 327651 - DNA, 25 bp, Homo sapien
gcaatacagaatttcctgcccccgc

SEQ ID NO: 327652 - DNA, 25 bp, Homo sapien
cgtcctcatgcaccgaggagccgag

SEQ ID NO: 327653 - DNA, 25 bp, Homo sapien
ctggccctaccctgggtgcctgtgg

SEQ ID NO: 327654 - DNA, 25 bp, Homo sapien
gccaggcccgggatggcgatccgac

SEQ ID NO: 327655 - DNA, 25 bp, Homo sapien
atggcgatccgacctgccgccgcag

SEQ ID NO: 327656 - DNA, 25 bp, Homo sapien
gttgactattctagatttgtgcttc

SEQ ID NO: 327657 - DNA, 25 bp, Homo sapien
agatttgtgcttcttactttataga

SEQ ID NO: 327658 - DNA, 25 bp, Homo sapien
ctttatagaagttatgccctcagta

SEQ ID NO: 327659 - DNA, 25 bp, Homo sapien
agttatgccctcagtaaacattttg

SEQ ID NO: 327660 - DNA, 25 bp, Homo sapien
aacataaagaccaggcagaggcagg

SEQ ID NO: 327661 - DNA, 25 bp, Homo sapien
aagtaggcaggtgtgcggcctgtat

SEQ ID NO: 327662 - DNA, 25 bp, Homo sapien
tgcggcctgtattggtagcagagtc

SEQ ID NO: 327663 - DNA, 25 bp, Homo sapien
gtattggtagcagagtcctccctga

SEQ ID NO: 327664 - DNA, 25 bp, Homo sapien
tcaggaatgctggaacgttctgtct

SEQ ID NO: 327665 - DNA, 25 bp, Homo sapien
atgctggaacgttctgtcttgatct

SEQ ID NO: 327666 - DNA, 25 bp, Homo sapien
ggaacgttctgtcttgatctggtta

SEQ ID NO: 327667 - DNA, 25 bp, Homo sapien
taagggacccacagcttgagtgtac

SEQ ID NO: 327668 - DNA, 25 bp, Homo sapien
tgatcacagcgccacgatctgctgt

SEQ ID NO: 327669 - DNA, 25 bp, Homo sapien
gccacgatctgctgtggtctctgat

SEQ ID NO: 327670 - DNA, 25 bp, Homo sapien
cagctgcacgctggtcaaaggcgga

SEQ ID NO: 327671 - DNA, 25 bp, Homo sapien
tcaaaggcggagctcggtgactcct

SEQ ID NO: 327672 - DNA, 25 bp, Homo sapien
gagctcggtgactcctctgcattgc

SEQ ID NO: 327673 - DNA, 25 bp, Homo sapien
ggacgcgcttactgaagccgagaac

SEQ ID NO: 327674 - DNA, 25 bp, Homo sapien
gaggtgacaccccaacagcgattcc

SEQ ID NO: 327675 - DNA, 25 bp, Homo sapien
aacagcgattcccatgtaccaaacg

SEQ ID NO: 327676 - DNA, 25 bp, Homo sapien
catgcacggtgctaggtgcacagat

SEQ ID NO: 327677 - DNA, 25 bp, Homo sapien
gtgctaggtgcacagatccctctca

SEQ ID NO: 327678 - DNA, 25 bp, Homo sapien
gccctagctacccaggatgctgagg

SEQ ID NO: 327679 - DNA, 25 bp, Homo sapien
tgggtgggttgcttggccccaggaa

SEQ ID NO: 327680 - DNA, 25 bp, Homo sapien
agttaggtcagtgtctcagctgctc

SEQ ID NO: 327681 - DNA, 25 bp, Homo sapien
tcagctgctctatcgggcctatagg

SEQ ID NO: 327682 - DNA, 25 bp, Homo sapien
ctctatcgggcctataggtttctta

SEQ ID NO: 327683 - DNA, 25 bp, Homo sapien
ctataggtttcttaggcatgtttaa

SEQ ID NO: 327684 - DNA, 25 bp, Homo sapien
gcatgtttaagaagctgccactaag

SEQ ID NO: 327685 - DNA, 25 bp, Homo sapien
gaagctgccactaaggatatggata

SEQ ID NO: 327686 - DNA, 25 bp, Homo sapien
aggatatggatatgctgaacagctt

SEQ ID NO: 327687 - DNA, 25 bp, Homo sapien
gaacagcttagagcttctcattgaa

SEQ ID NO: 327688 - DNA, 25 bp, Homo sapien
cattgaaatttaaccctaacagctc

SEQ ID NO: 327689 - DNA, 25 bp, Homo sapien
gattacctggtcaagtatggacttt

SEQ ID NO: 327690 - DNA, 25 bp, Homo sapien
tcaagtatggactttctttgaatct

SEQ ID NO: 327691 - DNA, 25 bp, Homo sapien
gaatctttcttttcacaaattggac

SEQ ID NO: 327692 - DNA, 25 bp, Homo sapien
cacaaattggactgcctgtaatacc

SEQ ID NO: 327693 - DNA, 25 bp, Homo sapien
tgcctgtaataccaataacattgtt

SEQ ID NO: 327694 - DNA, 25 bp, Homo sapien
tatacacacataccctcaattctct

SEQ ID NO: 327695 - DNA, 25 bp, Homo sapien
acacataccctcaattctcttgctt

SEQ ID NO: 327696 - DNA, 25 bp, Homo sapien
gacctttggtttggccatatatcac

SEQ ID NO: 327697 - DNA, 25 bp, Homo sapien
gaggaatggctagtgacccaactct

SEQ ID NO: 327698 - DNA, 25 bp, Homo sapien
gacccaactctccaaatgtctaagt

SEQ ID NO: 327699 - DNA, 25 bp, Homo sapien
gtctaagttagtagttacagctgat

SEQ ID NO: 327700 - DNA, 25 bp, Homo sapien
tcatcccaccccaaatacttaaaat

SEQ ID NO: 327701 - DNA, 25 bp, Homo sapien
ttaaaatgacactacacccagacgg

SEQ ID NO: 327702 - DNA, 25 bp, Homo sapien
aaatgacactacacccagacggcgc

SEQ ID NO: 327703 - DNA, 25 bp, Homo sapien
ggctgcagcacttgtagcatgcaca

SEQ ID NO: 327704 - DNA, 25 bp, Homo sapien
gcagcacttgtagcatgcacatgac

SEQ ID NO: 327705 - DNA, 25 bp, Homo sapien
atgcacatgactctggtagtaacca

SEQ ID NO: 327706 - DNA, 25 bp, Homo sapien
atgactctggtagtaaccaacaaaa

SEQ ID NO: 327707 - DNA, 25 bp, Homo sapien
gttttatggattcctcgtttactga

SEQ ID NO: 327708 - DNA, 25 bp, Homo sapien
actgaggaaagggaacatgctggtt

SEQ ID NO: 327709 - DNA, 25 bp, Homo sapien
aaagggaacatgctggttctggaaa

SEQ ID NO: 327710 - DNA, 25 bp, Homo sapien
ggaaaagccacaatattgaatctaa

SEQ ID NO: 327711 - DNA, 25 bp, Homo sapien
attatttcctgtgtagctttctctt

SEQ ID NO: 327712 - DNA, 25 bp, Homo sapien
gtagctttctcttatgcccaaattc

SEQ ID NO: 327713 - DNA, 25 bp, Homo sapien
aaattccactggatatcatccactt

SEQ ID NO: 327714 - DNA, 25 bp, Homo sapien
ggatatcatccacttctggttactt

SEQ ID NO: 327715 - DNA, 25 bp, Homo sapien
cttctggttacttctggtttgggat

SEQ ID NO: 327716 - DNA, 25 bp, Homo sapien
ggaatagttttggatcctcctttat

SEQ ID NO: 327717 - DNA, 25 bp, Homo sapien
tttggatcctcctttattacctgtt

SEQ ID NO: 327718 - DNA, 25 bp, Homo sapien
attggacaataactaaacttgcttt

SEQ ID NO: 327719 - DNA, 25 bp, Homo sapien
ggtttttggtcattgtttagccata

SEQ ID NO: 327720 - DNA, 25 bp, Homo sapien
gtttagccatatacaatattgtctt

SEQ ID NO: 327721 - DNA, 25 bp, Homo sapien
caatattgtcttaccttctgcattt

SEQ ID NO: 327722 - DNA, 25 bp, Homo sapien
gagggaagtgctaacagcccagcct

SEQ ID NO: 327723 - DNA, 25 bp, Homo sapien
agggaagtgctaacagcccagcctc

SEQ ID NO: 327724 - DNA, 25 bp, Homo sapien
gggaagtgctaacagcccagcctcc

SEQ ID NO: 327725 - DNA, 25 bp, Homo sapien
cctccttcccctctgaacctcctgc

SEQ ID NO: 327726 - DNA, 25 bp, Homo sapien
ctccttcccctctgaacctcctgca

SEQ ID NO: 327727 - DNA, 25 bp, Homo sapien
tccttcccctctgaacctcctgcaa

SEQ ID NO: 327728 - DNA, 25 bp, Homo sapien
cccctctgaacctcctgcaaccctg

SEQ ID NO: 327729 - DNA, 25 bp, Homo sapien
ccctctgaacctcctgcaaccctga

SEQ ID NO: 327730 - DNA, 25 bp, Homo sapien
cctctgaacctcctgcaaccctgag

SEQ ID NO: 327731 - DNA, 25 bp, Homo sapien
ctctgaacctcctgcaaccctgagc

SEQ ID NO: 327732 - DNA, 25 bp, Homo sapien
aatcctgatttagaaatcctcttat

SEQ ID NO: 327733 - DNA, 25 bp, Homo sapien
gaaatcctcttatatgaaaccactg

SEQ ID NO: 327734 - DNA, 25 bp, Homo sapien
aatcctcttatatgaaaccactgta

SEQ ID NO: 327735 - DNA, 25 bp, Homo sapien
tcctcttatatgaaaccactgtaat

SEQ ID NO: 327736 - DNA, 25 bp, Homo sapien
ttatatgaaaccactgtaatccaca

SEQ ID NO: 327737 - DNA, 25 bp, Homo sapien
atgaaaccactgtaatccacatctg

SEQ ID NO: 327738 - DNA, 25 bp, Homo sapien
gaaaccactgtaatccacatctggt

SEQ ID NO: 327739 - DNA, 25 bp, Homo sapien
accactgtaatccacatctggttag

SEQ ID NO: 327740 - DNA, 25 bp, Homo sapien
cactgtaatccacatctggttagac

SEQ ID NO: 327741 - DNA, 25 bp, Homo sapien
ctgtaatccacatctggttagacaa

SEQ ID NO: 327742 - DNA, 25 bp, Homo sapien
gttagacaattggaaaagttcattg

SEQ ID NO: 327743 - DNA, 25 bp, Homo sapien
ttgaaagttgtcagccaccagtcat

SEQ ID NO: 327744 - DNA, 25 bp, Homo sapien
agtcatccagaatttccttcctgaa

SEQ ID NO: 327745 - DNA, 25 bp, Homo sapien
agaatttccttcctgaatctccatg

SEQ ID NO: 327746 - DNA, 25 bp, Homo sapien
gaatctccatgctcatatgcaatgt

SEQ ID NO: 327747 - DNA, 25 bp, Homo sapien
tctacatcaaggtcttcttaatgac

SEQ ID NO: 327748 - DNA, 25 bp, Homo sapien
cttaatgactattattctcagggtt

SEQ ID NO: 327749 - DNA, 25 bp, Homo sapien
tttggtctgacatttttgtagcctt

SEQ ID NO: 327750 - DNA, 25 bp, Homo sapien
ttgtagccttctgttattattggaa

SEQ ID NO: 327751 - DNA, 25 bp, Homo sapien
gtctcttacataagctgatttcgag

SEQ ID NO: 327752 - DNA, 25 bp, Homo sapien
gaactttcaaaatctcacatagcta

SEQ ID NO: 327753 - DNA, 25 bp, Homo sapien
tagctaatggaagttgctttctgct

SEQ ID NO: 327754 - DNA, 25 bp, Homo sapien
ggcttgagcattgctgtagaatatg

SEQ ID NO: 327755 - DNA, 25 bp, Homo sapien
gctgtagaatatgttatctgttcaa

SEQ ID NO: 327756 - DNA, 25 bp, Homo sapien
atatgttatctgttcaaaacttagc

SEQ ID NO: 327757 - DNA, 25 bp, Homo sapien
gttcaaaacttagcagagcacgcat

SEQ ID NO: 327758 - DNA, 25 bp, Homo sapien
tagcagagcacgcatgcatcacatg

SEQ ID NO: 327759 - DNA, 25 bp, Homo sapien
ccaatggtttttgatggttgccgta

SEQ ID NO: 327760 - DNA, 25 bp, Homo sapien
ggtttttgatggttgccgtaacaga

SEQ ID NO: 327761 - DNA, 25 bp, Homo sapien
atggttgccgtaacagaagatctgt

SEQ ID NO: 327762 - DNA, 25 bp, Homo sapien
ctgaagtcaaactggaaaaggttgc

SEQ ID NO: 327763 - DNA, 25 bp, Homo sapien
caattttctcaatcattttgcataa

SEQ ID NO: 327764 - DNA, 25 bp, Homo sapien
ttgagtagtaatagttctaaacctg

SEQ ID NO: 327765 - DNA, 25 bp, Homo sapien
gtcgaccagcctccttaggttcaag

SEQ ID NO: 327766 - DNA, 25 bp, Homo sapien
tatttttactccaacaaacaacctg

SEQ ID NO: 327767 - DNA, 25 bp, Homo sapien
ttttactccaacaaacaacctgcct

SEQ ID NO: 327768 - DNA, 25 bp, Homo sapien
tttactccaacaaacaacctgcctt

SEQ ID NO: 327769 - DNA, 25 bp, Homo sapien
ttactccaacaaacaacctgcctta

SEQ ID NO: 327770 - DNA, 25 bp, Homo sapien
tactccaacaaacaacctgccttat

SEQ ID NO: 327771 - DNA, 25 bp, Homo sapien
cctgccttatccccatttcccaaag

SEQ ID NO: 327772 - DNA, 25 bp, Homo sapien
ctgccttatccccatttcccaaaga

SEQ ID NO: 327773 - DNA, 25 bp, Homo sapien
tgccttatccccatttcccaaagat

SEQ ID NO: 327774 - DNA, 25 bp, Homo sapien
gccttatccccatttcccaaagatt

SEQ ID NO: 327775 - DNA, 25 bp, Homo sapien
aaattatatgaacttttgctattaa

SEQ ID NO: 327776 - DNA, 25 bp, Homo sapien
ttatatgaacttttgctattaatgt

SEQ ID NO: 327777 - DNA, 25 bp, Homo sapien
atatgaacttttgctattaatgttt

SEQ ID NO: 327778 - DNA, 25 bp, Homo sapien
gaacttttgctattaatgtttattt

SEQ ID NO: 327779 - DNA, 25 bp, Homo sapien
taatgtttatttgtaggctatttat

SEQ ID NO: 327780 - DNA, 25 bp, Homo sapien
atttgtaggctatttatatcacttc

SEQ ID NO: 327781 - DNA, 25 bp, Homo sapien
tttgtaggctatttatatcacttca

SEQ ID NO: 327782 - DNA, 25 bp, Homo sapien
ttgtaggctatttatatcacttcat

SEQ ID NO: 327783 - DNA, 25 bp, Homo sapien
tgtaggctatttatatcacttcata

SEQ ID NO: 327784 - DNA, 25 bp, Homo sapien
gtaggctatttatatcacttcataa

SEQ ID NO: 327785 - DNA, 25 bp, Homo sapien
taggctatttatatcacttcataaa

SEQ ID NO: 327786 - DNA, 25 bp, Homo sapien
atatattttttatctctgactctgt

SEQ ID NO: 327787 - DNA, 25 bp, Homo sapien
aaaaaaacgtcgtgagccactgcaa

SEQ ID NO: 327788 - DNA, 25 bp, Homo sapien
cactgcaactggctcttttaaatgt

SEQ ID NO: 327789 - DNA, 25 bp, Homo sapien
gcaactggctcttttaaatgtaatt

SEQ ID NO: 327790 - DNA, 25 bp, Homo sapien
atttttgagcctgttttgcagcctt

SEQ ID NO: 327791 - DNA, 25 bp, Homo sapien
gagcctgttttgcagcctttacaaa

SEQ ID NO: 327792 - DNA, 25 bp, Homo sapien
tgcagcctttacaaaaatcagggtt

SEQ ID NO: 327793 - DNA, 25 bp, Homo sapien
gataataaggtcacaatcacgcaac

SEQ ID NO: 327794 - DNA, 25 bp, Homo sapien
aatcagggttttcccacaagatcat

SEQ ID NO: 327795 - DNA, 25 bp, Homo sapien
gtcacaatcacgcaaccatatcaag

SEQ ID NO: 327796 - DNA, 25 bp, Homo sapien
caatcacgcaaccatatcaagctga

SEQ ID NO: 327797 - DNA, 25 bp, Homo sapien
tgctgccgccgctgcgggtgcacct

SEQ ID NO: 327798 - DNA, 25 bp, Homo sapien
gctgcgggtgcacctttccctcgat

SEQ ID NO: 327799 - DNA, 25 bp, Homo sapien
tcgatcaccaccgcggcgcgctgag

SEQ ID NO: 327800 - DNA, 25 bp, Homo sapien
gcgctgagctagctcctgcaccgat

SEQ ID NO: 327801 - DNA, 25 bp, Homo sapien
tgagctagctcctgcaccgatccca

SEQ ID NO: 327802 - DNA, 25 bp, Homo sapien
tcctgcaccgatcccacgctgggcg

SEQ ID NO: 327803 - DNA, 25 bp, Homo sapien
gggacgagtagcacaccgaggcccc

SEQ ID NO: 327804 - DNA, 25 bp, Homo sapien
gtagcacaccgaggcccccgcggga

SEQ ID NO: 327805 - DNA, 25 bp, Homo sapien
gcgggagccgcctcgttgccggccg

SEQ ID NO: 327806 - DNA, 25 bp, Homo sapien
ccagggccgcggtccccagcagcag

SEQ ID NO: 327807 - DNA, 25 bp, Homo sapien
cagcggcggcgacgagcgggcggcg

SEQ ID NO: 327808 - DNA, 25 bp, Homo sapien
tgggtttttatcgagcaacaactta

SEQ ID NO: 327809 - DNA, 25 bp, Homo sapien
gagcaacaacttagacacgtgactg

SEQ ID NO: 327810 - DNA, 25 bp, Homo sapien
gacacgtgactgtaatatgctgcaa

SEQ ID NO: 327811 - DNA, 25 bp, Homo sapien
aatatgctgcaactgtgtgtactga

SEQ ID NO: 327812 - DNA, 25 bp, Homo sapien
gctgcaactgtgtgtactgaaaata

SEQ ID NO: 327813 - DNA, 25 bp, Homo sapien
aatatgttctagtggattttaatcc

SEQ ID NO: 327814 - DNA, 25 bp, Homo sapien
tttaatcctagtggccagttctatg

SEQ ID NO: 327815 - DNA, 25 bp, Homo sapien
gtggccagttctatgatactgtatg

SEQ ID NO: 327816 - DNA, 25 bp, Homo sapien
atgtattatacagctgatgacagga

SEQ ID NO: 327817 - DNA, 25 bp, Homo sapien
gactgtttagtgaatatctgttaaa

SEQ ID NO: 327818 - DNA, 25 bp, Homo sapien
tgttgtggccagagataatttcaga

SEQ ID NO: 327819 - DNA, 25 bp, Homo sapien
agaaactcgttagccagtccactgc

SEQ ID NO: 327820 - DNA, 25 bp, Homo sapien
agtccactgcctttctgacaatgtg

SEQ ID NO: 327821 - DNA, 25 bp, Homo sapien
gtgtggagtcacgtatgcttggtat

SEQ ID NO: 327822 - DNA, 25 bp, Homo sapien
tgcttggtatatgcctttactactt

SEQ ID NO: 327823 - DNA, 25 bp, Homo sapien
gttctacagtttattacttgcccaa

SEQ ID NO: 327824 - DNA, 25 bp, Homo sapien
acttgcccaagtgttactaaatcct

SEQ ID NO: 327825 - DNA, 25 bp, Homo sapien
ccttttcttatgtgtactggatgga

SEQ ID NO: 327826 - DNA, 25 bp, Homo sapien
aaaattatagccagcactttgagag

SEQ ID NO: 327827 - DNA, 25 bp, Homo sapien
tggtccatcaattcagacactctgc

SEQ ID NO: 327828 - DNA, 25 bp, Homo sapien
gatgccttacccttttcattagtgc

SEQ ID NO: 327829 - DNA, 25 bp, Homo sapien
tcattagtgcattctttgcttctga

SEQ ID NO: 327830 - DNA, 25 bp, Homo sapien
catgcaggcacaaagttggagttac

SEQ ID NO: 327831 - DNA, 25 bp, Homo sapien
agatgggttgacagcaggcaaactt

SEQ ID NO: 327832 - DNA, 25 bp, Homo sapien
gcaaacttggcctatgtattataac

SEQ ID NO: 327833 - DNA, 25 bp, Homo sapien
tcaagttcttacctcatgtgaatat

SEQ ID NO: 327834 - DNA, 25 bp, Homo sapien
gaatattcaccctttctttagtctt

SEQ ID NO: 327835 - DNA, 25 bp, Homo sapien
agcaaggtcttgatatggcatagca

SEQ ID NO: 327836 - DNA, 25 bp, Homo sapien
tatggcatagcagatctccctagac

SEQ ID NO: 327837 - DNA, 25 bp, Homo sapien
gatctccctagacacagatcatgag

SEQ ID NO: 327838 - DNA, 25 bp, Homo sapien
gagacttagggattcaggcatcaga

SEQ ID NO: 327839 - DNA, 25 bp, Homo sapien
gatgaagttggcttttcccttttat

SEQ ID NO: 327840 - DNA, 25 bp, Homo sapien
tatttaccctgtctaatacactaag

SEQ ID NO: 327841 - DNA, 25 bp, Homo sapien
atttatctcccctcctaagtttgag

SEQ ID NO: 327842 - DNA, 25 bp, Homo sapien
ttatctcccctcctaagtttgagga

SEQ ID NO: 327843 - DNA, 25 bp, Homo sapien
tctcccctcctaagtttgaggagtt

SEQ ID NO: 327844 - DNA, 25 bp, Homo sapien
cctaagtttgaggagttttatatat

SEQ ID NO: 327845 - DNA, 25 bp, Homo sapien
tattaaggctatttcttcatttgta

SEQ ID NO: 327846 - DNA, 25 bp, Homo sapien
aaatgaagtatgctatttgcaaagc

SEQ ID NO: 327847 - DNA, 25 bp, Homo sapien
tttgcaaagcaaaagcccatgaaaa

SEQ ID NO: 327848 - DNA, 25 bp, Homo sapien
aaagcccatgaaaagccccaaatca

SEQ ID NO: 327849 - DNA, 25 bp, Homo sapien
gccccaaatcatttaagtaaagctt

SEQ ID NO: 327850 - DNA, 25 bp, Homo sapien
aaagcttactgaattgttttcaatt

SEQ ID NO: 327851 - DNA, 25 bp, Homo sapien
ggagaaatgtaactaattataagca

SEQ ID NO: 327852 - DNA, 25 bp, Homo sapien
cttataatcctcaaaacttcttaca

SEQ ID NO: 327853 - DNA, 25 bp, Homo sapien
aaacttcttacacctaaaattcatg

SEQ ID NO: 327854 - DNA, 25 bp, Homo sapien
aacttcttacacctaaaattcatgc

SEQ ID NO: 327855 - DNA, 25 bp, Homo sapien
acttcttacacctaaaattcatgca

SEQ ID NO: 327856 - DNA, 25 bp, Homo sapien
cttcttacacctaaaattcatgcag

SEQ ID NO: 327857 - DNA, 25 bp, Homo sapien
ttcttacacctaaaattcatgcagg

SEQ ID NO: 327858 - DNA, 25 bp, Homo sapien
tcttacacctaaaattcatgcagga

SEQ ID NO: 327859 - DNA, 25 bp, Homo sapien
cttacacctaaaattcatgcaggag

SEQ ID NO: 327860 - DNA, 25 bp, Homo sapien
ttacacctaaaattcatgcaggaga

SEQ ID NO: 327861 - DNA, 25 bp, Homo sapien
tactgaaaatgttacaaaccagaaa

SEQ ID NO: 327862 - DNA, 25 bp, Homo sapien
ggaaatcatactggtaagaaattat

SEQ ID NO: 327863 - DNA, 25 bp, Homo sapien
gtcttgaaaccagagccggaaaaag

SEQ ID NO: 327864 - DNA, 25 bp, Homo sapien
gtcctttgtgagatgccactatcgg

SEQ ID NO: 327865 - DNA, 25 bp, Homo sapien
aatgcctgtgtttcgaagttccttc

SEQ ID NO: 327866 - DNA, 25 bp, Homo sapien
tgtttcgaagttccttcttaggacg

SEQ ID NO: 327867 - DNA, 25 bp, Homo sapien
tcttaggacgaaaccagctgaagct

SEQ ID NO: 327868 - DNA, 25 bp, Homo sapien
aagctggcgaaatccaagatggcgc

SEQ ID NO: 327869 - DNA, 25 bp, Homo sapien
cctctggctttatcatcatcctgtt

SEQ ID NO: 327870 - DNA, 25 bp, Homo sapien
accagcgccgtgacaactgacggtc

SEQ ID NO: 327871 - DNA, 25 bp, Homo sapien
tgacaactgacggtcgccatgacaa

SEQ ID NO: 327872 - DNA, 25 bp, Homo sapien
gacggtcgccatgacaacgactgga

SEQ ID NO: 327873 - DNA, 25 bp, Homo sapien
gggaaaccggatggctccacagaaa

SEQ ID NO: 327874 - DNA, 25 bp, Homo sapien
gggccggtcagaccacggacgccat

SEQ ID NO: 327875 - DNA, 25 bp, Homo sapien
acggacgccatctttgccaggagag

SEQ ID NO: 327876 - DNA, 25 bp, Homo sapien
tcaaaggagcggatcgagtggtcac

SEQ ID NO: 327877 - DNA, 25 bp, Homo sapien
gacgccatctttgccaggagagcca

SEQ ID NO: 327878 - DNA, 25 bp, Homo sapien
gccatctttgccaggagagccatca

SEQ ID NO: 327879 - DNA, 25 bp, Homo sapien
tctttgccaggagagccatcagcac

SEQ ID NO: 327880 - DNA, 25 bp, Homo sapien
aaggagcggatcgagtggtcactca

SEQ ID NO: 327881 - DNA, 25 bp, Homo sapien
gagtggtcactcagcatctcataaa

SEQ ID NO: 327882 - DNA, 25 bp, Homo sapien
gtggtcactcagcatctcataaagc

SEQ ID NO: 327883 - DNA, 25 bp, Homo sapien
gcatctcataaagctcctcgggaat

SEQ ID NO: 327884 - DNA, 25 bp, Homo sapien
tctcataaagctcctcgggaatggg

SEQ ID NO: 327885 - DNA, 25 bp, Homo sapien
aaacacagaaatgagactttggtcc

SEQ ID NO: 327886 - DNA, 25 bp, Homo sapien
agttttctaggcgactgcaggtgaa

SEQ ID NO: 327887 - DNA, 25 bp, Homo sapien
tttctaggcgactgcaggtgaaggc

SEQ ID NO: 327888 - DNA, 25 bp, Homo sapien
ggtgaaggcgtggtgtaaggcaacc

SEQ ID NO: 327889 - DNA, 25 bp, Homo sapien
taaggcaaccggaggcgatgccaga

SEQ ID NO: 327890 - DNA, 25 bp, Homo sapien
gaggcgatgccagaggcggcgacac

SEQ ID NO: 327891 - DNA, 25 bp, Homo sapien
agctcaggggctctaagataggacc

SEQ ID NO: 327892 - DNA, 25 bp, Homo sapien
cctgctctctggaaactgggtcctg

SEQ ID NO: 327893 - DNA, 25 bp, Homo sapien
tctctggaaactgggtcctgcctgt

SEQ ID NO: 327894 - DNA, 25 bp, Homo sapien
ggtcctgcctgtgacttaattacaa

SEQ ID NO: 327895 - DNA, 25 bp, Homo sapien
ctgcctgtgacttaattacaaggaa

SEQ ID NO: 327896 - DNA, 25 bp, Homo sapien
aagaagtgatggcttttctctgtcc

SEQ ID NO: 327897 - DNA, 25 bp, Homo sapien
agaagtgatggcttttctctgtccc

SEQ ID NO: 327898 - DNA, 25 bp, Homo sapien
gaagtgatggcttttctctgtcccc

SEQ ID NO: 327899 - DNA, 25 bp, Homo sapien
aagtgatggcttttctctgtcccct

SEQ ID NO: 327900 - DNA, 25 bp, Homo sapien
agtgatggcttttctctgtcccctg

SEQ ID NO: 327901 - DNA, 25 bp, Homo sapien
gggtgggtctcctgagccactcaga

SEQ ID NO: 327902 - DNA, 25 bp, Homo sapien
ggtgggtctcctgagccactcagat

SEQ ID NO: 327903 - DNA, 25 bp, Homo sapien
ctcagatgggaaagtcccttactcg

SEQ ID NO: 327904 - DNA, 25 bp, Homo sapien
tcagatgggaaagtcccttactcgg

SEQ ID NO: 327905 - DNA, 25 bp, Homo sapien
cagatgggaaagtcccttactcggc

SEQ ID NO: 327906 - DNA, 25 bp, Homo sapien
tgcctttactccttttaaacaccag

SEQ ID NO: 327907 - DNA, 25 bp, Homo sapien
taaaaccaaccaccagcatttcact

SEQ ID NO: 327908 - DNA, 25 bp, Homo sapien
accagcatttcactacaggaccaaa

SEQ ID NO: 327909 - DNA, 25 bp, Homo sapien
aacaggaaaccaaggtctgacctag

SEQ ID NO: 327910 - DNA, 25 bp, Homo sapien
tgacctagggttccctcccagtctt

SEQ ID NO: 327911 - DNA, 25 bp, Homo sapien
agtcttcacatcactctggcctcat

SEQ ID NO: 327912 - DNA, 25 bp, Homo sapien
acacacactccttggaatgggtcct

SEQ ID NO: 327913 - DNA, 25 bp, Homo sapien
cactccttggaatgggtcctgttat

SEQ ID NO: 327914 - DNA, 25 bp, Homo sapien
atgggtcctgttatttatgcttgct

SEQ ID NO: 327915 - DNA, 25 bp, Homo sapien
gtcctgttatttatgcttgctgcac

SEQ ID NO: 327916 - DNA, 25 bp, Homo sapien
gttatttatgcttgctgcacagaca

SEQ ID NO: 327917 - DNA, 25 bp, Homo sapien
aggagtcatctgaaatcagagtctt

SEQ ID NO: 327918 - DNA, 25 bp, Homo sapien
aaacaaagaggaagcatgggccgtc

SEQ ID NO: 327919 - DNA, 25 bp, Homo sapien
aagcatgggccgtcgagtagcagca

SEQ ID NO: 327920 - DNA, 25 bp, Homo sapien
ggccgtcgagtagcagcaggtctga

SEQ ID NO: 327921 - DNA, 25 bp, Homo sapien
aggacaaaccttccagaggcgttgg

SEQ ID NO: 327922 - DNA, 25 bp, Homo sapien
caaaccttccagaggcgttggaggc

SEQ ID NO: 327923 - DNA, 25 bp, Homo sapien
aaaggaatctgaggaaccgaatcaa

SEQ ID NO: 327924 - DNA, 25 bp, Homo sapien
gaatctgaggaaccgaatcaaggaa

SEQ ID NO: 327925 - DNA, 25 bp, Homo sapien
gaatcaaggaaataatgctgcagct

SEQ ID NO: 327926 - DNA, 25 bp, Homo sapien
aatgctgcagctgatactggacatc

SEQ ID NO: 327927 - DNA, 25 bp, Homo sapien
gcagctgatactggacatcgctttg

SEQ ID NO: 327928 - DNA, 25 bp, Homo sapien
cttcctgtcgagtgccccctgctgc

SEQ ID NO: 327929 - DNA, 25 bp, Homo sapien
tgctgccgccgctgcgggtgcacct

SEQ ID NO: 327930 - DNA, 25 bp, Homo sapien
gctgcgggtgcacctttccctcgat

SEQ ID NO: 327931 - DNA, 25 bp, Homo sapien
ctttccctcgatcaccaccgcggcg

SEQ ID NO: 327932 - DNA, 25 bp, Homo sapien
gatcaccaccgcggcgcgctgagct

SEQ ID NO: 327933 - DNA, 25 bp, Homo sapien
gcgctgagctagctcctgcaccgat

SEQ ID NO: 327934 - DNA, 25 bp, Homo sapien
tgagctagctcctgcaccgatccca

SEQ ID NO: 327935 - DNA, 25 bp, Homo sapien
tcctgcaccgatcccacgctgggcg

SEQ ID NO: 327936 - DNA, 25 bp, Homo sapien
gggacgagtagcacaccgaggcccc

SEQ ID NO: 327937 - DNA, 25 bp, Homo sapien
gtagcacaccgaggcccccgcggga

SEQ ID NO: 327938 - DNA, 25 bp, Homo sapien
gcgggagccgcctcgttgccggccg

SEQ ID NO: 327939 - DNA, 25 bp, Homo sapien
aagtcttgttaatggtgctttaagt

SEQ ID NO: 327940 - DNA, 25 bp, Homo sapien
atggtgctttaagtgtcaatgtagc

SEQ ID NO: 327941 - DNA, 25 bp, Homo sapien
gtcaatgtagcatgtaaaaggcttt

SEQ ID NO: 327942 - DNA, 25 bp, Homo sapien
aaggctttgtacagacaggtaaaag

SEQ ID NO: 327943 - DNA, 25 bp, Homo sapien
tacagacaggtaaaagttccatttc

SEQ ID NO: 327944 - DNA, 25 bp, Homo sapien
atgtaacacttcttcatctttaact

SEQ ID NO: 327945 - DNA, 25 bp, Homo sapien
ggactagaagactctaaattggctt

SEQ ID NO: 327946 - DNA, 25 bp, Homo sapien
ctctaaattggcttctacagatcaa

SEQ ID NO: 327947 - DNA, 25 bp, Homo sapien
attggcttctacagatcaataattt

SEQ ID NO: 327948 - DNA, 25 bp, Homo sapien
aatgtaactagttgggattttatag

SEQ ID NO: 327949 - DNA, 25 bp, Homo sapien
gtgtatataacataactaatctgta

SEQ ID NO: 327950 - DNA, 25 bp, Homo sapien
atccaccctgacctgagcaggtgag

SEQ ID NO: 327951 - DNA, 25 bp, Homo sapien
aggtgaggtcacagaaaggcttgct

SEQ ID NO: 327952 - DNA, 25 bp, Homo sapien
gggacaggattacagcctgctcaga

SEQ ID NO: 327953 - DNA, 25 bp, Homo sapien
cctgctcagaagcatgttgtggtcc

SEQ ID NO: 327954 - DNA, 25 bp, Homo sapien
tggtccagctcttgtgtcacttaaa

SEQ ID NO: 327955 - DNA, 25 bp, Homo sapien
gactccagctcttctctaatattga

SEQ ID NO: 327956 - DNA, 25 bp, Homo sapien
tctagacaaacacactgccatcagt

SEQ ID NO: 327957 - DNA, 25 bp, Homo sapien
gttcagaagcagatttaggccaatt

SEQ ID NO: 327958 - DNA, 25 bp, Homo sapien
gatttaggccaattgccatacctta

SEQ ID NO: 327959 - DNA, 25 bp, Homo sapien
attgccataccttacgttctggagg

SEQ ID NO: 327960 - DNA, 25 bp, Homo sapien
ttacgttctggagggatccaccctg

SEQ ID NO: 327961 - DNA, 25 bp, Homo sapien
accttggatgtgtgatgtgagagaa

SEQ ID NO: 327962 - DNA, 25 bp, Homo sapien
ggctaagccttatcaaggatttctt

SEQ ID NO: 327963 - DNA, 25 bp, Homo sapien
aggatttctttcaaatgtctttagt

SEQ ID NO: 327964 - DNA, 25 bp, Homo sapien
aggaggctgggcattcctttctcaa

SEQ ID NO: 327965 - DNA, 25 bp, Homo sapien
ggcattcctttctcaatactttcag

SEQ ID NO: 327966 - DNA, 25 bp, Homo sapien
ctttcagagcagtttgtccataccc

SEQ ID NO: 327967 - DNA, 25 bp, Homo sapien
agtttgtccatacccctaatatagt

SEQ ID NO: 327968 - DNA, 25 bp, Homo sapien
cccctaatatagtgcttgtctcatt

SEQ ID NO: 327969 - DNA, 25 bp, Homo sapien
gtctcatttcaattatattcactcg

SEQ ID NO: 327970 - DNA, 25 bp, Homo sapien
gaggccaggatttcagatatattta

SEQ ID NO: 327971 - DNA, 25 bp, Homo sapien
cagcttttgttgagaccttggatgt

SEQ ID NO: 327972 - DNA, 25 bp, Homo sapien
ttctccctctttttgatgctgtaat

SEQ ID NO: 327973 - DNA, 25 bp, Homo sapien
tgctgtaatttttgttcatcatgtt

SEQ ID NO: 327974 - DNA, 25 bp, Homo sapien
atcatgttttgctgtgatgttacat

SEQ ID NO: 327975 - DNA, 25 bp, Homo sapien
tagttttaatgtcacctataacaaa

SEQ ID NO: 327976 - DNA, 25 bp, Homo sapien
gtagcagattgtccagaaagcattt

SEQ ID NO: 327977 - DNA, 25 bp, Homo sapien
gtatattagattactcttaaacgaa

SEQ ID NO: 327978 - DNA, 25 bp, Homo sapien
taaacgaaaaaccagctgccgcttt

SEQ ID NO: 327979 - DNA, 25 bp, Homo sapien
cagctgccgcttttatgtacacata

SEQ ID NO: 327980 - DNA, 25 bp, Homo sapien
gtacacatattacatacgagtaggc

SEQ ID NO: 327981 - DNA, 25 bp, Homo sapien
catacgagtaggcagcagactttaa

SEQ ID NO: 327982 - DNA, 25 bp, Homo sapien
ttcagtgccattgtagttgacatga

SEQ ID NO: 327983 - DNA, 25 bp, Homo sapien
taggaccgggtcacgaaggtatgcc

SEQ ID NO: 327984 - DNA, 25 bp, Homo sapien
gggtcacgaaggtatgccaccagtt

SEQ ID NO: 327985 - DNA, 25 bp, Homo sapien
aggtatgccaccagttaacaaagac

SEQ ID NO: 327986 - DNA, 25 bp, Homo sapien
tgccaccagttaacaaagacactct

SEQ ID NO: 327987 - DNA, 25 bp, Homo sapien
aagacactctcaaaacaggaaggat

SEQ ID NO: 327988 - DNA, 25 bp, Homo sapien
gaaggatggcaagtcgttaaaataa

SEQ ID NO: 327989 - DNA, 25 bp, Homo sapien
atccagggctccatttttacctgaa

SEQ ID NO: 327990 - DNA, 25 bp, Homo sapien
ggctccatttttacctgaagaagaa

SEQ ID NO: 327991 - DNA, 25 bp, Homo sapien
taagaatgagtttgcgctggtccga

SEQ ID NO: 327992 - DNA, 25 bp, Homo sapien
atgagtttgcgctggtccgagtgca

SEQ ID NO: 327993 - DNA, 25 bp, Homo sapien
gatcacaactagttacagattattt

SEQ ID NO: 327994 - DNA, 25 bp, Homo sapien
tgactttccttgactggtgggtttt

SEQ ID NO: 327995 - DNA, 25 bp, Homo sapien
tttttccttgatctcttcttcctca

SEQ ID NO: 327996 - DNA, 25 bp, Homo sapien
actggcattttcctgaaacctcgtc

SEQ ID NO: 327997 - DNA, 25 bp, Homo sapien
tcttcctcaggtaatccaggatcct

SEQ ID NO: 327998 - DNA, 25 bp, Homo sapien
gggcacatagacttcttgctgcgat

SEQ ID NO: 327999 - DNA, 25 bp, Homo sapien
acttcttgctgcgatacagttggaa

SEQ ID NO: 328000 - DNA, 25 bp, Homo sapien
agaatgtttcagtttcccagcaatt

SEQ ID NO: 328001 - DNA, 25 bp, Homo sapien
agcaattccaggtctaaggcgcaca

SEQ ID NO: 328002 - DNA, 25 bp, Homo sapien
taaggcgcacagttcccttttaggg

SEQ ID NO: 328003 - DNA, 25 bp, Homo sapien
tagacatttccttcttgctacttga

SEQ ID NO: 328004 - DNA, 25 bp, Homo sapien
cttcttgctacttgactttccttga

SEQ ID NO: 328005 - DNA, 25 bp, Homo sapien
cacaaagtaaatggtgggcatccat

SEQ ID NO: 328006 - DNA, 25 bp, Homo sapien
tggtgggcatccatgtttacattgc

SEQ ID NO: 328007 - DNA, 25 bp, Homo sapien
gggcatccatgtttacattgcacct

SEQ ID NO: 328008 - DNA, 25 bp, Homo sapien
accttcccgtgctgtaattggcttg

SEQ ID NO: 328009 - DNA, 25 bp, Homo sapien
tcccgtgctgtaattggcttgacaa

SEQ ID NO: 328010 - DNA, 25 bp, Homo sapien
gctgtaattggcttgacaaagacaa

SEQ ID NO: 328011 - DNA, 25 bp, Homo sapien
aaattgtacagcaaggtgctctaag

SEQ ID NO: 328012 - DNA, 25 bp, Homo sapien
gcaaggtgctctaagtaatattcga

SEQ ID NO: 328013 - DNA, 25 bp, Homo sapien
agaaatttgcgtttgatattcatga

SEQ ID NO: 328014 - DNA, 25 bp, Homo sapien
attgtgtaacactatggcattgctt

SEQ ID NO: 328015 - DNA, 25 bp, Homo sapien
acactatggcattgcttctatagcc

SEQ ID NO: 328016 - DNA, 25 bp, Homo sapien
gactctgtagcaaggaaacatactt

SEQ ID NO: 328017 - DNA, 25 bp, Homo sapien
ttggtcttcttcctttgaccgccag

SEQ ID NO: 328018 - DNA, 25 bp, Homo sapien
accgccagtcattatttgtcttcat

SEQ ID NO: 328019 - DNA, 25 bp, Homo sapien
agggcagttatttccaatccattcc

SEQ ID NO: 328020 - DNA, 25 bp, Homo sapien
gaatctgaaaccatagctgctgtgg

SEQ ID NO: 328021 - DNA, 25 bp, Homo sapien
gtggaataatcctgagctgctgcca

SEQ ID NO: 328022 - DNA, 25 bp, Homo sapien
agctgctgccactgtgtgagttgga

SEQ ID NO: 328023 - DNA, 25 bp, Homo sapien
gcctgatcaggtggtctccggataa

SEQ ID NO: 328024 - DNA, 25 bp, Homo sapien
aaggccagttcttgtctgtgcattt

SEQ ID NO: 328025 - DNA, 25 bp, Homo sapien
ctgtgcatttgacttcgtatgtgat

SEQ ID NO: 328026 - DNA, 25 bp, Homo sapien
gtatgtgatatactgactctgtagc

SEQ ID NO: 328027 - DNA, 25 bp, Homo sapien
gccaaaattctgtatattagattac

SEQ ID NO: 328028 - DNA, 25 bp, Homo sapien
aattctgtatattagattactctta

SEQ ID NO: 328029 - DNA, 25 bp, Homo sapien
gtatattagattactcttaaacgaa

SEQ ID NO: 328030 - DNA, 25 bp, Homo sapien
gtacacatattacatacgagtaggc

SEQ ID NO: 328031 - DNA, 25 bp, Homo sapien
cacatattacatacgagtaggcagc

SEQ ID NO: 328032 - DNA, 25 bp, Homo sapien
catattacatacgagtaggcagcag

SEQ ID NO: 328033 - DNA, 25 bp, Homo sapien
attacatacgagtaggcagcagact

SEQ ID NO: 328034 - DNA, 25 bp, Homo sapien
tacatacgagtaggcagcagacttt

SEQ ID NO: 328035 - DNA, 25 bp, Homo sapien
catacgagtaggcagcagactttaa

SEQ ID NO: 328036 - DNA, 25 bp, Homo sapien
tacgagtaggcagcagactttaaaa

SEQ ID NO: 328037 - DNA, 25 bp, Homo sapien
ttcagtgccattgtagttgacatga

SEQ ID NO: 328038 - DNA, 25 bp, Homo sapien
tctctagacccaccgggctcaggag

SEQ ID NO: 328039 - DNA, 25 bp, Homo sapien
tcaggagaggaggaaactcgcccat

SEQ ID NO: 328040 - DNA, 25 bp, Homo sapien
aggagaggaggaaactcgcccatgt

SEQ ID NO: 328041 - DNA, 25 bp, Homo sapien
tgagtcatgtgccatgctggccatc

SEQ ID NO: 328042 - DNA, 25 bp, Homo sapien
actgccctgtctcagacccagtggc

SEQ ID NO: 328043 - DNA, 25 bp, Homo sapien
atgtgccatgctggccatcactgct

SEQ ID NO: 328044 - DNA, 25 bp, Homo sapien
ggtctttccagcgttgtgggccacg

SEQ ID NO: 328045 - DNA, 25 bp, Homo sapien
ttccagcgttgtgggccacgtggtc

SEQ ID NO: 328046 - DNA, 25 bp, Homo sapien
ctgtgtggaagcagcacgaaacagg

SEQ ID NO: 328047 - DNA, 25 bp, Homo sapien
atgcagagctgcgatggagggtgct

SEQ ID NO: 328048 - DNA, 25 bp, Homo sapien
gggaagtctggctctctagacccac

SEQ ID NO: 328049 - DNA, 25 bp, Homo sapien
actcagaagagttgtattgcctcaa

SEQ ID NO: 328050 - DNA, 25 bp, Homo sapien
gtattgcctcaatttgtaaagctta

SEQ ID NO: 328051 - DNA, 25 bp, Homo sapien
ataatttaagaacaccttggctagg

SEQ ID NO: 328052 - DNA, 25 bp, Homo sapien
agtttttacttcttgtgagcggtag

SEQ ID NO: 328053 - DNA, 25 bp, Homo sapien
tacttcttgtgagcggtaggccaca

SEQ ID NO: 328054 - DNA, 25 bp, Homo sapien
taggccacaggagtatggtaagaga

SEQ ID NO: 328055 - DNA, 25 bp, Homo sapien
agcaacaggacaaagagcttgatct

SEQ ID NO: 328056 - DNA, 25 bp, Homo sapien
aagagcttgatcttgttctcctttg

SEQ ID NO: 328057 - DNA, 25 bp, Homo sapien
tgatcttgttctcctttgttgtgga

SEQ ID NO: 328058 - DNA, 25 bp, Homo sapien
gttgtggagcccttacatgttttaa

SEQ ID NO: 328059 - DNA, 25 bp, Homo sapien
gaactacttagcaacaattccatgt

SEQ ID NO: 328060 - DNA, 25 bp, Homo sapien
cttggtgctctggtattctaggaca

SEQ ID NO: 328061 - DNA, 25 bp, Homo sapien
tggtattctaggacagtggcttcca

SEQ ID NO: 328062 - DNA, 25 bp, Homo sapien
atcactctgctcttgtacacaggag

SEQ ID NO: 328063 - DNA, 25 bp, Homo sapien
atcaggatcctgtacacatatgtgc

SEQ ID NO: 328064 - DNA, 25 bp, Homo sapien
gtaatactatgtgtgctatgcttaa

SEQ ID NO: 328065 - DNA, 25 bp, Homo sapien
tcttgtacacaggagcgaattagga

SEQ ID NO: 328066 - DNA, 25 bp, Homo sapien
gagcgaattaggaactgatcccatt

SEQ ID NO: 328067 - DNA, 25 bp, Homo sapien
ggaactgatcccattcaataccaaa

SEQ ID NO: 328068 - DNA, 25 bp, Homo sapien
ataccaaatttgatgctccttctga

SEQ ID NO: 328069 - DNA, 25 bp, Homo sapien
gatgctccttctgatacacaatgta

SEQ ID NO: 328070 - DNA, 25 bp, Homo sapien
acacaatgtattcttggtgctctgg

SEQ ID NO: 328071 - DNA, 25 bp, Homo sapien
gctcagctcgcccatcagtgtgcca

SEQ ID NO: 328072 - DNA, 25 bp, Homo sapien
tcagctcgcccatcagtgtgccact

SEQ ID NO: 328073 - DNA, 25 bp, Homo sapien
agctcgcccatcagtgtgccactgc

SEQ ID NO: 328074 - DNA, 25 bp, Homo sapien
cagtgtgccactgcctctccgtcct

SEQ ID NO: 328075 - DNA, 25 bp, Homo sapien
gggaggcggcgtagtccgcgccacg

SEQ ID NO: 328076 - DNA, 25 bp, Homo sapien
gaggcggcgtagtccgcgccacgtt

SEQ ID NO: 328077 - DNA, 25 bp, Homo sapien
ccgggtgcaggtgcgtggcgagctc

SEQ ID NO: 328078 - DNA, 25 bp, Homo sapien
gggtgcaggtgcgtggcgagctcct

SEQ ID NO: 328079 - DNA, 25 bp, Homo sapien
ggtgcaggtgcgtggcgagctcctg

SEQ ID NO: 328080 - DNA, 25 bp, Homo sapien
aggtgcgtggcgagctcctgcagca

SEQ ID NO: 328081 - DNA, 25 bp, Homo sapien
gtgcgtggcgagctcctgcagcacg

SEQ ID NO: 328082 - DNA, 25 bp, Homo sapien
aatattcctgttagccctaaaggct

SEQ ID NO: 328083 - DNA, 25 bp, Homo sapien
atattcctgttagccctaaaggctt

SEQ ID NO: 328084 - DNA, 25 bp, Homo sapien
tcctgttagccctaaaggctttaca

SEQ ID NO: 328085 - DNA, 25 bp, Homo sapien
ctgttagccctaaaggctttacatg

SEQ ID NO: 328086 - DNA, 25 bp, Homo sapien
gttagccctaaaggctttacatgag

SEQ ID NO: 328087 - DNA, 25 bp, Homo sapien
tagccctaaaggctttacatgagga

SEQ ID NO: 328088 - DNA, 25 bp, Homo sapien
ccctaaaggctttacatgaggaatg

SEQ ID NO: 328089 - DNA, 25 bp, Homo sapien
aaggctttacatgaggaatggtaga

SEQ ID NO: 328090 - DNA, 25 bp, Homo sapien
catgaggaatggtagaagtggtctt

SEQ ID NO: 328091 - DNA, 25 bp, Homo sapien
ggaatggtagaagtggtcttttgtt

SEQ ID NO: 328092 - DNA, 25 bp, Homo sapien
ttaaattagttgcattcagcatata

SEQ ID NO: 328093 - DNA, 25 bp, Homo sapien
gtggcattaagtactatcataatat

SEQ ID NO: 328094 - DNA, 25 bp, Homo sapien
atattttaatccttctcatcactgg

SEQ ID NO: 328095 - DNA, 25 bp, Homo sapien
aatccttctcatcactggtggacat

SEQ ID NO: 328096 - DNA, 25 bp, Homo sapien
atccttctcatcactggtggacatt

SEQ ID NO: 328097 - DNA, 25 bp, Homo sapien
ccttctcatcactggtggacattaa

SEQ ID NO: 328098 - DNA, 25 bp, Homo sapien
ctcatcactggtggacattaaggag

SEQ ID NO: 328099 - DNA, 25 bp, Homo sapien
aagttcaaacaaatgtctttgtact

SEQ ID NO: 328100 - DNA, 25 bp, Homo sapien
gtctttgtactagcatattatggca

SEQ ID NO: 328101 - DNA, 25 bp, Homo sapien
tattttaaaagtctctatagtagtg

SEQ ID NO: 328102 - DNA, 25 bp, Homo sapien
gtactagcatattatggcactcctg

SEQ ID NO: 328103 - DNA, 25 bp, Homo sapien
agcatattatggcactcctgctgga

SEQ ID NO: 328104 - DNA, 25 bp, Homo sapien
tgggaaattcttcagtgagagctca

SEQ ID NO: 328105 - DNA, 25 bp, Homo sapien
gaaattcttcagtgagagctcagcc

SEQ ID NO: 328106 - DNA, 25 bp, Homo sapien
aattcttcagtgagagctcagccct

SEQ ID NO: 328107 - DNA, 25 bp, Homo sapien
cattcggcatcatataatccacacc

SEQ ID NO: 328108 - DNA, 25 bp, Homo sapien
ggcatcatataatccacaccggaga

SEQ ID NO: 328109 - DNA, 25 bp, Homo sapien
cttcagccagagtaccaatctcata

SEQ ID NO: 328110 - DNA, 25 bp, Homo sapien
tcagccagagtaccaatctcataat

SEQ ID NO: 328111 - DNA, 25 bp, Homo sapien
gccagagtaccaatctcataatcca

SEQ ID NO: 328112 - DNA, 25 bp, Homo sapien
agtaccaatctcataatccaccaaa

SEQ ID NO: 328113 - DNA, 25 bp, Homo sapien
gtaccaatctcataatccaccaaaa

SEQ ID NO: 328114 - DNA, 25 bp, Homo sapien
tctcataatccaccaaaagacccac

SEQ ID NO: 328115 - DNA, 25 bp, Homo sapien
aaaggtaatgacctctgtcttgaat

SEQ ID NO: 328116 - DNA, 25 bp, Homo sapien
agaggtgagtgggttggtgacaact

SEQ ID NO: 328117 - DNA, 25 bp, Homo sapien
ggtgacaactggtttggaggctttt

SEQ ID NO: 328118 - DNA, 25 bp, Homo sapien
acaactggtttggaggcttttgtgg

SEQ ID NO: 328119 - DNA, 25 bp, Homo sapien
gactgtggtgtcttttggattgtgt

SEQ ID NO: 328120 - DNA, 25 bp, Homo sapien
gtggtgtcttttggattgtgtcatc

SEQ ID NO: 328121 - DNA, 25 bp, Homo sapien
tgtcttttggattgtgtcatcagct

SEQ ID NO: 328122 - DNA, 25 bp, Homo sapien
ccaaagctttgccactagatattca

SEQ ID NO: 328123 - DNA, 25 bp, Homo sapien
gctttgccactagatattcaaatca

SEQ ID NO: 328124 - DNA, 25 bp, Homo sapien
attgtcatgtaagccagtcttccag

SEQ ID NO: 328125 - DNA, 25 bp, Homo sapien
tgtcatgtaagccagtcttccagaa

SEQ ID NO: 328126 - DNA, 25 bp, Homo sapien
ttccctggggctgaagagctggctg

SEQ ID NO: 328127 - DNA, 25 bp, Homo sapien
ggccttggccctgctactcacccaa

SEQ ID NO: 328128 - DNA, 25 bp, Homo sapien
gctactcacccaacattcccatcct

SEQ ID NO: 328129 - DNA, 25 bp, Homo sapien
atgcagctacccctacaacctgggg

SEQ ID NO: 328130 - DNA, 25 bp, Homo sapien
tacaacctggggttccttctcaggg

SEQ ID NO: 328131 - DNA, 25 bp, Homo sapien
gggttccttctcagggcctcacctg

SEQ ID NO: 328132 - DNA, 25 bp, Homo sapien
tcagggcctcacctggtccccacat

SEQ ID NO: 328133 - DNA, 25 bp, Homo sapien
caaagtccatgtctgcctccatcag

SEQ ID NO: 328134 - DNA, 25 bp, Homo sapien
aaagtccatgtctgcctccatcagc

SEQ ID NO: 328135 - DNA, 25 bp, Homo sapien
tccatcagccacacacacgcaggga

SEQ ID NO: 328136 - DNA, 25 bp, Homo sapien
acacacgcagggacgcccgttcctt

SEQ ID NO: 328137 - DNA, 25 bp, Homo sapien
gcgcgtgccaccataccgagctagt

SEQ ID NO: 328138 - DNA, 25 bp, Homo sapien
ggctggaatgcttgcattttcttgc

SEQ ID NO: 328139 - DNA, 25 bp, Homo sapien
ggaatgcttgcattttcttgcctga

SEQ ID NO: 328140 - DNA, 25 bp, Homo sapien
aatgcttgcattttcttgcctgatt

SEQ ID NO: 328141 - DNA, 25 bp, Homo sapien
tgcttgcattttcttgcctgatttc

SEQ ID NO: 328142 - DNA, 25 bp, Homo sapien
cttgcattttcttgcctgatttccc

SEQ ID NO: 328143 - DNA, 25 bp, Homo sapien
ggagcaccccccttaacactgaatg

SEQ ID NO: 328144 - DNA, 25 bp, Homo sapien
ggagctggtgagagcaaatatcctt

SEQ ID NO: 328145 - DNA, 25 bp, Homo sapien
gctggtgagagcaaatatccttgtt

SEQ ID NO: 328146 - DNA, 25 bp, Homo sapien
ggtgagagcaaatatccttgtttct

SEQ ID NO: 328147 - DNA, 25 bp, Homo sapien
tgagagcaaatatccttgtttctga

SEQ ID NO: 328148 - DNA, 25 bp, Homo sapien
aaatgtttctattcttcagcgcagc

SEQ ID NO: 328149 - DNA, 25 bp, Homo sapien
tttctattcttcagcgcagcccagg

SEQ ID NO: 328150 - DNA, 25 bp, Homo sapien
agcgcagcccaggaattctacctaa

SEQ ID NO: 328151 - DNA, 25 bp, Homo sapien
gcagcccaggaattctacctaaagt

SEQ ID NO: 328152 - DNA, 25 bp, Homo sapien
tacctaaagtaacatatcctaaggc

SEQ ID NO: 328153 - DNA, 25 bp, Homo sapien
tcctaaggcaacaaccaagaagtgt

SEQ ID NO: 328154 - DNA, 25 bp, Homo sapien
caagaagtgtggaagaatgcatgta

SEQ ID NO: 328155 - DNA, 25 bp, Homo sapien
atagcattttcatacgagtactatg

SEQ ID NO: 328156 - DNA, 25 bp, Homo sapien
catacgagtactatgtagtcattta

SEQ ID NO: 328157 - DNA, 25 bp, Homo sapien
aaaattatgtctttcagtacctagt

SEQ ID NO: 328158 - DNA, 25 bp, Homo sapien
atgtctttcagtacctagtaatggg

SEQ ID NO: 328159 - DNA, 25 bp, Homo sapien
gtggccgtggccaggtgagaagccc

SEQ ID NO: 328160 - DNA, 25 bp, Homo sapien
gtgagaagccccattcgcgcaggaa

SEQ ID NO: 328161 - DNA, 25 bp, Homo sapien
agaagccccattcgcgcaggaaaga

SEQ ID NO: 328162 - DNA, 25 bp, Homo sapien
gccccattcgcgcaggaaagactgg

SEQ ID NO: 328163 - DNA, 25 bp, Homo sapien
gaaagactggccacctgggaaccca

SEQ ID NO: 328164 - DNA, 25 bp, Homo sapien
tccacggagggacttgccggccaca

SEQ ID NO: 328165 - DNA, 25 bp, Homo sapien
tgcctgctgattggcagctccggat

SEQ ID NO: 328166 - DNA, 25 bp, Homo sapien
tgattggcagctccggatcaggccc

SEQ ID NO: 328167 - DNA, 25 bp, Homo sapien
tggcagctcctctgtatcagaacca

SEQ ID NO: 328168 - DNA, 25 bp, Homo sapien
gtatcagaaccaataaagtgcactt

SEQ ID NO: 328169 - DNA, 25 bp, Homo sapien
accaataaagtgcacttgttctcgg

SEQ ID NO: 328170 - DNA, 25 bp, Homo sapien
atgtaatctgatctctgtcacaatg

SEQ ID NO: 328171 - DNA, 25 bp, Homo sapien
ctgatctctgtcacaatgatattaa

SEQ ID NO: 328172 - DNA, 25 bp, Homo sapien
aagaactatctcactttcatatgtt

SEQ ID NO: 328173 - DNA, 25 bp, Homo sapien
atctcactttcatatgtttgcttca

SEQ ID NO: 328174 - DNA, 25 bp, Homo sapien
aaggatatggaatgtacacatcagc

SEQ ID NO: 328175 - DNA, 25 bp, Homo sapien
tggtataaacttcccaagtatttag

SEQ ID NO: 328176 - DNA, 25 bp, Homo sapien
gtattgagtgatgtcctttcaacct

SEQ ID NO: 328177 - DNA, 25 bp, Homo sapien
tgtcctttcaacctaggactagtga

SEQ ID NO: 328178 - DNA, 25 bp, Homo sapien
ggactagtgacaaccttcatttttt

SEQ ID NO: 328179 - DNA, 25 bp, Homo sapien
gacaaccttcattttttcagagctg

SEQ ID NO: 328180 - DNA, 25 bp, Homo sapien
agagctgaagaaaaaaccgtgaatt

SEQ ID NO: 328181 - DNA, 25 bp, Homo sapien
ttttgtgtggttgtgcagcaggcaa

SEQ ID NO: 328182 - DNA, 25 bp, Homo sapien
gcagcaggcaatgaaatgagcttac

SEQ ID NO: 328183 - DNA, 25 bp, Homo sapien
tgagcttacattcaagcttccgtgt

SEQ ID NO: 328184 - DNA, 25 bp, Homo sapien
tcacgatacagcctctgcttgaaag

SEQ ID NO: 328185 - DNA, 25 bp, Homo sapien
caagcttccgtgttttactgaaaca

SEQ ID NO: 328186 - DNA, 25 bp, Homo sapien
ctgaaacaacagtcacagatgcagt

SEQ ID NO: 328187 - DNA, 25 bp, Homo sapien
tacagcctctgcttgaaaggaatta

SEQ ID NO: 328188 - DNA, 25 bp, Homo sapien
ttgttgtggtggcagaaacagcccc

SEQ ID NO: 328189 - DNA, 25 bp, Homo sapien
aacaggtacaagcatggaaggagac

SEQ ID NO: 328190 - DNA, 25 bp, Homo sapien
tggaaggagacgttgctatcatatt

SEQ ID NO: 328191 - DNA, 25 bp, Homo sapien
aaaatgctgttttgtgtggttgtgc

SEQ ID NO: 328192 - DNA, 25 bp, Homo sapien
caggatcatctggaaatgactatga

SEQ ID NO: 328193 - DNA, 25 bp, Homo sapien
taatggctcagccaatcactcctgg

SEQ ID NO: 328194 - DNA, 25 bp, Homo sapien
gattccacgactcttctttgcggga

SEQ ID NO: 328195 - DNA, 25 bp, Homo sapien
acgactcttctttgcgggagaacat

SEQ ID NO: 328196 - DNA, 25 bp, Homo sapien
agaacatacgatccgtaactaccca

SEQ ID NO: 328197 - DNA, 25 bp, Homo sapien
taactacccagccacagtgcatggt

SEQ ID NO: 328198 - DNA, 25 bp, Homo sapien
gccacagtgcatggtgctctgctga

SEQ ID NO: 328199 - DNA, 25 bp, Homo sapien
aagcgggaagaattgcagaccagtt

SEQ ID NO: 328200 - DNA, 25 bp, Homo sapien
gggccatgtatacgctgcctcgcca

SEQ ID NO: 328201 - DNA, 25 bp, Homo sapien
acaccaggtgttcctgcacagcagt

SEQ ID NO: 328202 - DNA, 25 bp, Homo sapien
catgtgagacagatgcattctaagg

SEQ ID NO: 328203 - DNA, 25 bp, Homo sapien
aactgtacatattgtcaccttttag

SEQ ID NO: 328204 - DNA, 25 bp, Homo sapien
caccttttagttcatctctggcaaa

SEQ ID NO: 328205 - DNA, 25 bp, Homo sapien
cttgcaaggttactactggacccca

SEQ ID NO: 328206 - DNA, 25 bp, Homo sapien
aaccagctagggacacatgagacaa

SEQ ID NO: 328207 - DNA, 25 bp, Homo sapien
gacaacaaacctcttcacatattcc

SEQ ID NO: 328208 - DNA, 25 bp, Homo sapien
aagctatccacccttgtggagcata

SEQ ID NO: 328209 - DNA, 25 bp, Homo sapien
tggagcatatgcttcgccacatgat

SEQ ID NO: 328210 - DNA, 25 bp, Homo sapien
gccacatgatcctgctttgactata

SEQ ID NO: 328211 - DNA, 25 bp, Homo sapien
gaatgcagcttagcaaggtcttcct

SEQ ID NO: 328212 - DNA, 25 bp, Homo sapien
caaggtcttccttgccaggaattgg

SEQ ID NO: 328213 - DNA, 25 bp, Homo sapien
gatcttgaaaggtctcgagggttac

SEQ ID NO: 328214 - DNA, 25 bp, Homo sapien
ggaatgtatcccctgtgaataatgg

SEQ ID NO: 328215 - DNA, 25 bp, Homo sapien
gggctactgtacatctaccatatat

SEQ ID NO: 328216 - DNA, 25 bp, Homo sapien
gggctgtactatgtaacagtgatat

SEQ ID NO: 328217 - DNA, 25 bp, Homo sapien
gtgaaatatatgacagctgtgctgt

SEQ ID NO: 328218 - DNA, 25 bp, Homo sapien
tgtgctgtgtagctgtgtacactaa

SEQ ID NO: 328219 - DNA, 25 bp, Homo sapien
gtgtacactaaatgggtcaagtttt

SEQ ID NO: 328220 - DNA, 25 bp, Homo sapien
atgggtcaagttttgctgccatctg

SEQ ID NO: 328221 - DNA, 25 bp, Homo sapien
ctgccatctgagtttttagagcttt

SEQ ID NO: 328222 - DNA, 25 bp, Homo sapien
tatagggtaggtaccgtccgcagtt

SEQ ID NO: 328223 - DNA, 25 bp, Homo sapien
aggtaccgtccgcagttttaggcat

SEQ ID NO: 328224 - DNA, 25 bp, Homo sapien
tttaggcatccacttacataatggg

SEQ ID NO: 328225 - DNA, 25 bp, Homo sapien
tgacctggcgaaaggcctagtcctg

SEQ ID NO: 328226 - DNA, 25 bp, Homo sapien
tgggcctttcctgctgagaggaagt

SEQ ID NO: 328227 - DNA, 25 bp, Homo sapien
gcctttcctgctgagaggaagtgac

SEQ ID NO: 328228 - DNA, 25 bp, Homo sapien
aggaagtgactttttacagaagcca

SEQ ID NO: 328229 - DNA, 25 bp, Homo sapien
gtgactttttacagaagccactgaa

SEQ ID NO: 328230 - DNA, 25 bp, Homo sapien
cagaagccactgaacctggttattt

SEQ ID NO: 328231 - DNA, 25 bp, Homo sapien
actgaacctggttattttggcaaat

SEQ ID NO: 328232 - DNA, 25 bp, Homo sapien
ttattttggcaaatcgtccgtctcg

SEQ ID NO: 328233 - DNA, 25 bp, Homo sapien
attttggcaaatcgtccgtctcgag

SEQ ID NO: 328234 - DNA, 25 bp, Homo sapien
ttggcaaatcgtccgtctcgagggc

SEQ ID NO: 328235 - DNA, 25 bp, Homo sapien
aaatcgtccgtctcgagggccttgg

SEQ ID NO: 328236 - DNA, 25 bp, Homo sapien
taagcattttcggtttctagggttg

SEQ ID NO: 328237 - DNA, 25 bp, Homo sapien
acgcaccgggtgttgatggtcgaga

SEQ ID NO: 328238 - DNA, 25 bp, Homo sapien
gcagaacttcgatgtgaggcctcag

SEQ ID NO: 328239 - DNA, 25 bp, Homo sapien
acttcgatgtgaggcctcagtctgg

SEQ ID NO: 328240 - DNA, 25 bp, Homo sapien
gggcaaatgggcttcccaaacactc

SEQ ID NO: 328241 - DNA, 25 bp, Homo sapien
ggcttcccaaacactcctactggtt

SEQ ID NO: 328242 - DNA, 25 bp, Homo sapien
ctactggttggacctctggcttttc

SEQ ID NO: 328243 - DNA, 25 bp, Homo sapien
tggcttttcatccttttcgatgtgg

SEQ ID NO: 328244 - DNA, 25 bp, Homo sapien
cttttcgatgtggtggtgtttctct

SEQ ID NO: 328245 - DNA, 25 bp, Homo sapien
gctcagtttccggtgcggcgaacac

SEQ ID NO: 328246 - DNA, 25 bp, Homo sapien
tgcggcgaacaccaaagtccgggaa

SEQ ID NO: 328247 - DNA, 25 bp, Homo sapien
gctttttgctgctatgttctgcatt

SEQ ID NO: 328248 - DNA, 25 bp, Homo sapien
gctatgttctgcattgagcctagtt

SEQ ID NO: 328249 - DNA, 25 bp, Homo sapien
ctgcattgagcctagttttgccatt

SEQ ID NO: 328250 - DNA, 25 bp, Homo sapien
tagttttgccattgtcccctgaatg

SEQ ID NO: 328251 - DNA, 25 bp, Homo sapien
ttgtcccctgaatgtagtattatct

SEQ ID NO: 328252 - DNA, 25 bp, Homo sapien
taactacatctattgcttttggtgg

SEQ ID NO: 328253 - DNA, 25 bp, Homo sapien
catctattgcttttggtggtaaatc

SEQ ID NO: 328254 - DNA, 25 bp, Homo sapien
gatttagttgtaattttccagctgt

SEQ ID NO: 328255 - DNA, 25 bp, Homo sapien
tccagctgtgaaaatgttgccttgt

SEQ ID NO: 328256 - DNA, 25 bp, Homo sapien
gaaaatgttgccttgtatttaaaag

SEQ ID NO: 328257 - DNA, 25 bp, Homo sapien
taccatccccggaagggtgcttatt

SEQ ID NO: 328258 - DNA, 25 bp, Homo sapien
aaatgcttccttcagagccagtact

SEQ ID NO: 328259 - DNA, 25 bp, Homo sapien
tccttcagagccagtactcctagaa

SEQ ID NO: 328260 - DNA, 25 bp, Homo sapien
gagccagtactcctagaagaaataa

SEQ ID NO: 328261 - DNA, 25 bp, Homo sapien
ataacaaatttgtcatcccaggtgg

SEQ ID NO: 328262 - DNA, 25 bp, Homo sapien
ggaagaaaactggacccatttgcaa

SEQ ID NO: 328263 - DNA, 25 bp, Homo sapien
aaactggacccatttgcaatcactc

SEQ ID NO: 328264 - DNA, 25 bp, Homo sapien
gacccatttgcaatcactcttcaat

SEQ ID NO: 328265 - DNA, 25 bp, Homo sapien
ctcttcaatcaaagcatgtgtattt

SEQ ID NO: 328266 - DNA, 25 bp, Homo sapien
aagactttcatattaaatgggttca

SEQ ID NO: 328267 - DNA, 25 bp, Homo sapien
ggttcaattgaactcatttcttatt

SEQ ID NO: 328268 - DNA, 25 bp, Homo sapien
atctccactttaaatgctaaatact

SEQ ID NO: 328269 - DNA, 25 bp, Homo sapien
agcaaagacagagcacacaagtgca

SEQ ID NO: 328270 - DNA, 25 bp, Homo sapien
agcacacaagtgcataaggctgttg

SEQ ID NO: 328271 - DNA, 25 bp, Homo sapien
gcataaggctgttgtcttcggcttg

SEQ ID NO: 328272 - DNA, 25 bp, Homo sapien
gttgtcttcggcttgggtgaaatga

SEQ ID NO: 328273 - DNA, 25 bp, Homo sapien
gggtgaaatgacagttcctcttcat

SEQ ID NO: 328274 - DNA, 25 bp, Homo sapien
atgacagttcctcttcattctaaag

SEQ ID NO: 328275 - DNA, 25 bp, Homo sapien
tcttcattctaaaggtttactccat

SEQ ID NO: 328276 - DNA, 25 bp, Homo sapien
ggtttactccattgaatttaaggca

SEQ ID NO: 328277 - DNA, 25 bp, Homo sapien
taaggcatttgttcattccagtgtt

SEQ ID NO: 328278 - DNA, 25 bp, Homo sapien
attccagtgttgagatgctttgcat

SEQ ID NO: 328279 - DNA, 25 bp, Homo sapien
atctggaaatacttttagctatcat

SEQ ID NO: 328280 - DNA, 25 bp, Homo sapien
ttccttttaaactcttgagcctcct

SEQ ID NO: 328281 - DNA, 25 bp, Homo sapien
aactcttgagcctcctataacgaag

SEQ ID NO: 328282 - DNA, 25 bp, Homo sapien
gtgcccaaaatatttacttgtataa

SEQ ID NO: 328283 - DNA, 25 bp, Homo sapien
aaatacttcagcaaagtcagcatat

SEQ ID NO: 328284 - DNA, 25 bp, Homo sapien
gtcagcatatttactcattcaacaa

SEQ ID NO: 328285 - DNA, 25 bp, Homo sapien
ttgagccaggcattattttagacac

SEQ ID NO: 328286 - DNA, 25 bp, Homo sapien
ggcattattttagacacagcagtga

SEQ ID NO: 328287 - DNA, 25 bp, Homo sapien
gatacagtcttagaaaaagcaggta

SEQ ID NO: 328288 - DNA, 25 bp, Homo sapien
attggaaagctagcatgcatgccct

SEQ ID NO: 328289 - DNA, 25 bp, Homo sapien
atgcatgccctcttacctgggtatc

SEQ ID NO: 328290 - DNA, 25 bp, Homo sapien
atgccctcttacctgggtatcttcc

SEQ ID NO: 328291 - DNA, 25 bp, Homo sapien
gtagaagtgccaataggagctctat

SEQ ID NO: 328292 - DNA, 25 bp, Homo sapien
aggagctctatgaagggcgtgaaac

SEQ ID NO: 328293 - DNA, 25 bp, Homo sapien
gacactctgtggattgtgacctgtt

SEQ ID NO: 328294 - DNA, 25 bp, Homo sapien
attgtgacctgttggtgggccatga

SEQ ID NO: 328295 - DNA, 25 bp, Homo sapien
gttggtgggccatgaaatcaatttg

SEQ ID NO: 328296 - DNA, 25 bp, Homo sapien
gaatcatctgcaataaggaacccat

SEQ ID NO: 328297 - DNA, 25 bp, Homo sapien
ggaacccatggatgaataccatctg

SEQ ID NO: 328298 - DNA, 25 bp, Homo sapien
ggatgaataccatctggtcctggtg

SEQ ID NO: 328299 - DNA, 25 bp, Homo sapien
taatccccatcttcaaggaactcac

SEQ ID NO: 328300 - DNA, 25 bp, Homo sapien
ggaactcacagtcaggaagaacaga

SEQ ID NO: 328301 - DNA, 25 bp, Homo sapien
acagagcctgcaacacaaataattg

SEQ ID NO: 328302 - DNA, 25 bp, Homo sapien
tcaggcacagtgaagatcgtctcag

SEQ ID NO: 328303 - DNA, 25 bp, Homo sapien
aagatcgtctcagtgtcttctcatc

SEQ ID NO: 328304 - DNA, 25 bp, Homo sapien
tctcatctccgtcatcaaaaactac

SEQ ID NO: 328305 - DNA, 25 bp, Homo sapien
aactacagtgtaccaactcgcatct

SEQ ID NO: 328306 - DNA, 25 bp, Homo sapien
gtaccaactcgcatctgttagttta

SEQ ID NO: 328307 - DNA, 25 bp, Homo sapien
gcaccatcaagattcttcacttcca

SEQ ID NO: 328308 - DNA, 25 bp, Homo sapien
caatagctcctacctttagtgggcc

SEQ ID NO: 328309 - DNA, 25 bp, Homo sapien
tcctacctttagtgggccctttatg

SEQ ID NO: 328310 - DNA, 25 bp, Homo sapien
ctccttcctctggtatatgattaga

SEQ ID NO: 328311 - DNA, 25 bp, Homo sapien
tatgattagatcttcttcctctatt

SEQ ID NO: 328312 - DNA, 25 bp, Homo sapien
tcctatgactggagtgccaaaatgc

SEQ ID NO: 328313 - DNA, 25 bp, Homo sapien
gagctgatcaggaagagggaactac

SEQ ID NO: 328314 - DNA, 25 bp, Homo sapien
acggcgagagaggtttacacatgag

SEQ ID NO: 328315 - DNA, 25 bp, Homo sapien
acacatgaggtggacttcgacgatt

SEQ ID NO: 328316 - DNA, 25 bp, Homo sapien
ttcgacgattttatgatgccttttc

SEQ ID NO: 328317 - DNA, 25 bp, Homo sapien
aagctcgagcactggaagctgcctt

SEQ ID NO: 328318 - DNA, 25 bp, Homo sapien
aagctgccttgaagacctaagtcat

SEQ ID NO: 328319 - DNA, 25 bp, Homo sapien
gacctaagtcatagcagttatttct

SEQ ID NO: 328320 - DNA, 25 bp, Homo sapien
taaatgctttgaggcccagggacca

SEQ ID NO: 328321 - DNA, 25 bp, Homo sapien
ggcccagggaccaatctttggagaa

SEQ ID NO: 328322 - DNA, 25 bp, Homo sapien
aagtagatatttccatcaaagccaa

SEQ ID NO: 328323 - DNA, 25 bp, Homo sapien
aagccaaagcaatccatacaccaag

SEQ ID NO: 328324 - DNA, 25 bp, Homo sapien
atgcatagcaagctgtaatgctctt

SEQ ID NO: 328325 - DNA, 25 bp, Homo sapien
gcaagctgtaatgctctttgtgttt

SEQ ID NO: 328326 - DNA, 25 bp, Homo sapien
gtagaggtctggaaagttgtttgct

SEQ ID NO: 328327 - DNA, 25 bp, Homo sapien
gctgtgttacctctgaagggaattg

SEQ ID NO: 328328 - DNA, 25 bp, Homo sapien
gagttagaaggaatattcggctttt

SEQ ID NO: 328329 - DNA, 25 bp, Homo sapien
agaaggaatattcggcttttctatt

SEQ ID NO: 328330 - DNA, 25 bp, Homo sapien
ggcttttctattttatatcctccta

SEQ ID NO: 328331 - DNA, 25 bp, Homo sapien
ttctattttatatcctcctaggtga

SEQ ID NO: 328332 - DNA, 25 bp, Homo sapien
tattttatatcctcctaggtgaaat

SEQ ID NO: 328333 - DNA, 25 bp, Homo sapien
tatcctcctaggtgaaatttttaca

SEQ ID NO: 328334 - DNA, 25 bp, Homo sapien
acaacaaacatgtactggtgtattt

SEQ ID NO: 328335 - DNA, 25 bp, Homo sapien
taaatatactgcatctttttaagat

SEQ ID NO: 328336 - DNA, 25 bp, Homo sapien
gtattatatgactttaagagcccac

SEQ ID NO: 328337 - DNA, 25 bp, Homo sapien
atgactttaagagcccacattaggt

SEQ ID NO: 328338 - DNA, 25 bp, Homo sapien
gagcccacattaggttttatgattc

SEQ ID NO: 328339 - DNA, 25 bp, Homo sapien
ttatgattcatttgccaggttttta

SEQ ID NO: 328340 - DNA, 25 bp, Homo sapien
ttcacaaaactgttacgggacttca

SEQ ID NO: 328341 - DNA, 25 bp, Homo sapien
ctgttacgggacttcaactagaaat

SEQ ID NO: 328342 - DNA, 25 bp, Homo sapien
gaccttgctatctctaaattatgga

SEQ ID NO: 328343 - DNA, 25 bp, Homo sapien
tatttcttatactctgttttctttt

SEQ ID NO: 328344 - DNA, 25 bp, Homo sapien
tttatattgatatcttgcccacatt

SEQ ID NO: 328345 - DNA, 25 bp, Homo sapien
tattgatatcttgcccacattttaa

SEQ ID NO: 328346 - DNA, 25 bp, Homo sapien
ggttaagccgcgataaagaccttgc

SEQ ID NO: 328347 - DNA, 25 bp, Homo sapien
gaccttgcttagctagcagtgcgta

SEQ ID NO: 328348 - DNA, 25 bp, Homo sapien
agcagtgcgtattgtgtaaggtaac

SEQ ID NO: 328349 - DNA, 25 bp, Homo sapien
gtaactaggatttctacctcaaccg

SEQ ID NO: 328350 - DNA, 25 bp, Homo sapien
taggatttctacctcaaccgcgaga

SEQ ID NO: 328351 - DNA, 25 bp, Homo sapien
ctcaaccgcgagacctatgcaagga

SEQ ID NO: 328352 - DNA, 25 bp, Homo sapien
aaggacggtgtggaccaactcgcgc

SEQ ID NO: 328353 - DNA, 25 bp, Homo sapien
acggacgggagctccactgtgaatc

SEQ ID NO: 328354 - DNA, 25 bp, Homo sapien
aggctgggactggtccagtttgtac

SEQ ID NO: 328355 - DNA, 25 bp, Homo sapien
gactggtccagtttgtactgtcgat

SEQ ID NO: 328356 - DNA, 25 bp, Homo sapien
cagtttgtactgtcgatagttttag

SEQ ID NO: 328357 - DNA, 25 bp, Homo sapien
gaaattcttcagtgagagctcagcc

SEQ ID NO: 328358 - DNA, 25 bp, Homo sapien
tcagccctcattcggcatcatataa

SEQ ID NO: 328359 - DNA, 25 bp, Homo sapien
ggcatcatataatccacaccggaga

SEQ ID NO: 328360 - DNA, 25 bp, Homo sapien
ggtaaagcgtttaaccagagctcat

SEQ ID NO: 328361 - DNA, 25 bp, Homo sapien
taaagcgtttaaccagagctcatcc

SEQ ID NO: 328362 - DNA, 25 bp, Homo sapien
agagctcatcccttagtcagcatca

SEQ ID NO: 328363 - DNA, 25 bp, Homo sapien
tcatcccttagtcagcatcagagaa

SEQ ID NO: 328364 - DNA, 25 bp, Homo sapien
tccacacaggcgtgaaaccctacga

SEQ ID NO: 328365 - DNA, 25 bp, Homo sapien
ttccggtgcagctctgccttcgtta

SEQ ID NO: 328366 - DNA, 25 bp, Homo sapien
ccggtgcagctctgccttcgttaga

SEQ ID NO: 328367 - DNA, 25 bp, Homo sapien
agtaccaatctcataatccaccaaa

SEQ ID NO: 328368 - DNA, 25 bp, Homo sapien
gtcaaaagaaagacatgttggctat

SEQ ID NO: 328369 - DNA, 25 bp, Homo sapien
aagaaagacatgttggctataggcg

SEQ ID NO: 328370 - DNA, 25 bp, Homo sapien
agaaagacatgttggctataggcgt

SEQ ID NO: 328371 - DNA, 25 bp, Homo sapien
gaaagacatgttggctataggcgtg

SEQ ID NO: 328372 - DNA, 25 bp, Homo sapien
gacatgttggctataggcgtggtgg

SEQ ID NO: 328373 - DNA, 25 bp, Homo sapien
gaggatcaccagaggccagcaggtc

SEQ ID NO: 328374 - DNA, 25 bp, Homo sapien
cagaggccagcaggtccacaccagc

SEQ ID NO: 328375 - DNA, 25 bp, Homo sapien
gcaacacagcaagacaccgcatcta

SEQ ID NO: 328376 - DNA, 25 bp, Homo sapien
cacagcaagacaccgcatctacaga

SEQ ID NO: 328377 - DNA, 25 bp, Homo sapien
tgtgtacctgtaggcctagctgctc

SEQ ID NO: 328378 - DNA, 25 bp, Homo sapien
ttgagcctgagttcaacactgcagt

SEQ ID NO: 328379 - DNA, 25 bp, Homo sapien
agcctggccagccatgcaggctttt

SEQ ID NO: 328380 - DNA, 25 bp, Homo sapien
tgtgtccacaatagcatccccacag

SEQ ID NO: 328381 - DNA, 25 bp, Homo sapien
ggatccatcattcccagcattatga

SEQ ID NO: 328382 - DNA, 25 bp, Homo sapien
tggaagagcccaaaacccacagctg

SEQ ID NO: 328383 - DNA, 25 bp, Homo sapien
aaaacccacagctgaggcctcaggg

SEQ ID NO: 328384 - DNA, 25 bp, Homo sapien
gcctcagggcttttctaatgtgctt

SEQ ID NO: 328385 - DNA, 25 bp, Homo sapien
ggaaacctgtattcttgctcagtca

SEQ ID NO: 328386 - DNA, 25 bp, Homo sapien
tgctcagtcactgcttagtcagcat

SEQ ID NO: 328387 - DNA, 25 bp, Homo sapien
gtcagcataaatcactccagaggat

SEQ ID NO: 328388 - DNA, 25 bp, Homo sapien
ggatagtttgttactgacctcaaag

SEQ ID NO: 328389 - DNA, 25 bp, Homo sapien
gacctcaaagactcagttacaaaga

SEQ ID NO: 328390 - DNA, 25 bp, Homo sapien
tggtaaagcgtttaaccagagctca

SEQ ID NO: 328391 - DNA, 25 bp, Homo sapien
ggtaaagcgtttaaccagagctcat

SEQ ID NO: 328392 - DNA, 25 bp, Homo sapien
gtaaagcgtttaaccagagctcatc

SEQ ID NO: 328393 - DNA, 25 bp, Homo sapien
taaagcgtttaaccagagctcatcc

SEQ ID NO: 328394 - DNA, 25 bp, Homo sapien
ggccttccggtgcagctctgccttc

SEQ ID NO: 328395 - DNA, 25 bp, Homo sapien
gccttccggtgcagctctgccttcg

SEQ ID NO: 328396 - DNA, 25 bp, Homo sapien
ccttccggtgcagctctgccttcgt

SEQ ID NO: 328397 - DNA, 25 bp, Homo sapien
cttccggtgcagctctgccttcgtt

SEQ ID NO: 328398 - DNA, 25 bp, Homo sapien
ttccggtgcagctctgccttcgtta

SEQ ID NO: 328399 - DNA, 25 bp, Homo sapien
tccggtgcagctctgccttcgttag

SEQ ID NO: 328400 - DNA, 25 bp, Homo sapien
ccggtgcagctctgccttcgttaga

SEQ ID NO: 328401 - DNA, 25 bp, Homo sapien
aaactgttaaggcaagaagtgtcaa

SEQ ID NO: 328402 - DNA, 25 bp, Homo sapien
gaagtgtcaaatgctttagagttaa

SEQ ID NO: 328403 - DNA, 25 bp, Homo sapien
acagatcactgatttcaaagacttg

SEQ ID NO: 328404 - DNA, 25 bp, Homo sapien
gggtaataaagactgcaacattctc

SEQ ID NO: 328405 - DNA, 25 bp, Homo sapien
aagactgcaacattctcaggaccaa

SEQ ID NO: 328406 - DNA, 25 bp, Homo sapien
gcaacattctcaggaccaaattaaa

SEQ ID NO: 328407 - DNA, 25 bp, Homo sapien
acagaactataattacagagatcag

SEQ ID NO: 328408 - DNA, 25 bp, Homo sapien
cagagatcagatcagataggtaaac

SEQ ID NO: 328409 - DNA, 25 bp, Homo sapien
gatagataggatgaaacttttggcc

SEQ ID NO: 328410 - DNA, 25 bp, Homo sapien
gaaacttttggcctactgtattact

SEQ ID NO: 328411 - DNA, 25 bp, Homo sapien
ggcctactgtattacttacagagtt

SEQ ID NO: 328412 - DNA, 25 bp, Homo sapien
atgctaactataacattttttgtga

SEQ ID NO: 328413 - DNA, 25 bp, Homo sapien
aatgtttcctaacagttgtgatgtt

SEQ ID NO: 328414 - DNA, 25 bp, Homo sapien
gttgtgatgttactgttccgtttta

SEQ ID NO: 328415 - DNA, 25 bp, Homo sapien
gttactgttccgttttatgctctta

SEQ ID NO: 328416 - DNA, 25 bp, Homo sapien
gttccgttttatgctcttattccaa

SEQ ID NO: 328417 - DNA, 25 bp, Homo sapien
gttttatgctcttattccaagttca

SEQ ID NO: 328418 - DNA, 25 bp, Homo sapien
tcatttttaatggtttggaagccat

SEQ ID NO: 328419 - DNA, 25 bp, Homo sapien
aaatgttcatgctgtacagtatctg

SEQ ID NO: 328420 - DNA, 25 bp, Homo sapien
tacagtatctgtagcatgccgttct

SEQ ID NO: 328421 - DNA, 25 bp, Homo sapien
tatctgtagcatgccgttctggatt

SEQ ID NO: 328422 - DNA, 25 bp, Homo sapien
gtagcatgccgttctggattaataa

SEQ ID NO: 328423 - DNA, 25 bp, Homo sapien
aaagaaagacatgttggctataggc

SEQ ID NO: 328424 - DNA, 25 bp, Homo sapien
aagaaagacatgttggctataggcg

SEQ ID NO: 328425 - DNA, 25 bp, Homo sapien
agaaagacatgttggctataggcgt

SEQ ID NO: 328426 - DNA, 25 bp, Homo sapien
gaaagacatgttggctataggcgtg

SEQ ID NO: 328427 - DNA, 25 bp, Homo sapien
aagacatgttggctataggcgtggt

SEQ ID NO: 328428 - DNA, 25 bp, Homo sapien
gacatgttggctataggcgtggtgg

SEQ ID NO: 328429 - DNA, 25 bp, Homo sapien
aagccggggtaggaggatcaccaga

SEQ ID NO: 328430 - DNA, 25 bp, Homo sapien
ccagaggccagcaggtccacaccag

SEQ ID NO: 328431 - DNA, 25 bp, Homo sapien
cagaggccagcaggtccacaccagc

SEQ ID NO: 328432 - DNA, 25 bp, Homo sapien
gcaacacagcaagacaccgcatcta

SEQ ID NO: 328433 - DNA, 25 bp, Homo sapien
caacacagcaagacaccgcatctac

SEQ ID NO: 328434 - DNA, 25 bp, Homo sapien
atttttgcctagttcatgttgccaa

SEQ ID NO: 328435 - DNA, 25 bp, Homo sapien
gcctagttcatgttgccaagcaatg

SEQ ID NO: 328436 - DNA, 25 bp, Homo sapien
gaagatgctgttctttgcaagtgta

SEQ ID NO: 328437 - DNA, 25 bp, Homo sapien
tctttgcaagtgtacagttttcaaa

SEQ ID NO: 328438 - DNA, 25 bp, Homo sapien
tacagttttcaaatgttgttaccag

SEQ ID NO: 328439 - DNA, 25 bp, Homo sapien
gttgttaccagtgaaacacccttgt

SEQ ID NO: 328440 - DNA, 25 bp, Homo sapien
taccagtgaaacacccttgtggttt

SEQ ID NO: 328441 - DNA, 25 bp, Homo sapien
gtggtttaaacttgctacaatgtat

SEQ ID NO: 328442 - DNA, 25 bp, Homo sapien
tcatttcctcccatgtaactaagaa

SEQ ID NO: 328443 - DNA, 25 bp, Homo sapien
gtaactaagaatcatggctatattt

SEQ ID NO: 328444 - DNA, 25 bp, Homo sapien
catggctatatttcatatcaacgtt

SEQ ID NO: 328445 - DNA, 25 bp, Homo sapien
caccagatattatgggatagaagat

SEQ ID NO: 328446 - DNA, 25 bp, Homo sapien
agatgaaaagcacacactcccaggt

SEQ ID NO: 328447 - DNA, 25 bp, Homo sapien
actcccaggtccacttgacctgttg

SEQ ID NO: 328448 - DNA, 25 bp, Homo sapien
acctgttgcagtggaacctccgggc

SEQ ID NO: 328449 - DNA, 25 bp, Homo sapien
tgttgcagtggaacctccgggcatg

SEQ ID NO: 328450 - DNA, 25 bp, Homo sapien
cagcgtgggtgaatggcgcccacca

SEQ ID NO: 328451 - DNA, 25 bp, Homo sapien
tgaatggcgcccaccagacggagca

SEQ ID NO: 328452 - DNA, 25 bp, Homo sapien
accagacggagcagggcctgctact

SEQ ID NO: 328453 - DNA, 25 bp, Homo sapien
cggagcagggcctgctactctcctg

SEQ ID NO: 328454 - DNA, 25 bp, Homo sapien
ctgcccttggcaccttgagaggaga

SEQ ID NO: 328455 - DNA, 25 bp, Homo sapien
caccttgagaggagaatttgagtac

SEQ ID NO: 328456 - DNA, 25 bp, Homo sapien
agaccagaggaacagcctcaagttc

SEQ ID NO: 328457 - DNA, 25 bp, Homo sapien
acagcctcaagttcaagtcggacct

SEQ ID NO: 328458 - DNA, 25 bp, Homo sapien
agcctcaagttcaagtcggaccttt

SEQ ID NO: 328459 - DNA, 25 bp, Homo sapien
tcaagttcaagtcggacctttctaa

SEQ ID NO: 328460 - DNA, 25 bp, Homo sapien
ggaggttttgttggaattccacaag

SEQ ID NO: 328461 - DNA, 25 bp, Homo sapien
gttggaattccacaagaccctagtt

SEQ ID NO: 328462 - DNA, 25 bp, Homo sapien
tggaattccacaagaccctagttct

SEQ ID NO: 328463 - DNA, 25 bp, Homo sapien
gaattccacaagaccctagttctga

SEQ ID NO: 328464 - DNA, 25 bp, Homo sapien
ttccacaagaccctagttctgaagg

SEQ ID NO: 328465 - DNA, 25 bp, Homo sapien
cacaagaccctagttctgaaggtag

SEQ ID NO: 328466 - DNA, 25 bp, Homo sapien
gaccctagttctgaaggtaggacaa

SEQ ID NO: 328467 - DNA, 25 bp, Homo sapien
tattgcacacctaaatcctgattat

SEQ ID NO: 328468 - DNA, 25 bp, Homo sapien
ataggcttttcatttctccgcaaag

SEQ ID NO: 328469 - DNA, 25 bp, Homo sapien
tccgcaaagcctttattttggcagt

SEQ ID NO: 328470 - DNA, 25 bp, Homo sapien
ggcagttaagccaaatgtgttttcc

SEQ ID NO: 328471 - DNA, 25 bp, Homo sapien
agccaaatgtgttttccagaaagtt

SEQ ID NO: 328472 - DNA, 25 bp, Homo sapien
cagaaagttagttattttctcctct

SEQ ID NO: 328473 - DNA, 25 bp, Homo sapien
gtctgaccccaaacgttattgtcca

SEQ ID NO: 328474 - DNA, 25 bp, Homo sapien
aacgttattgtccaaacatgactgg

SEQ ID NO: 328475 - DNA, 25 bp, Homo sapien
catgactggacagcagcttttgttt

SEQ ID NO: 328476 - DNA, 25 bp, Homo sapien
cttttgtttcttgaccctgtaatat

SEQ ID NO: 328477 - DNA, 25 bp, Homo sapien
gaccctgtaatatgacagtctgcta

SEQ ID NO: 328478 - DNA, 25 bp, Homo sapien
gggcctacttcattaggtgtggttc

SEQ ID NO: 328479 - DNA, 25 bp, Homo sapien
ctacttcattaggtgtggttcattc

SEQ ID NO: 328480 - DNA, 25 bp, Homo sapien
aggtgtggttcattcctattcatgc

SEQ ID NO: 328481 - DNA, 25 bp, Homo sapien
gtgtggttcattcctattcatgctc

SEQ ID NO: 328482 - DNA, 25 bp, Homo sapien
gtggttcattcctattcatgctccc

SEQ ID NO: 328483 - DNA, 25 bp, Homo sapien
ttcattcctattcatgctccctgga

SEQ ID NO: 328484 - DNA, 25 bp, Homo sapien
attcctattcatgctccctggaaga

SEQ ID NO: 328485 - DNA, 25 bp, Homo sapien
tcctattcatgctccctggaagaac

SEQ ID NO: 328486 - DNA, 25 bp, Homo sapien
attcatgctccctggaagaacaaga

SEQ ID NO: 328487 - DNA, 25 bp, Homo sapien
gtatgaattagcatcagggagaggt

SEQ ID NO: 328488 - DNA, 25 bp, Homo sapien
aaaactaaaagtcatgcttattgtg

SEQ ID NO: 328489 - DNA, 25 bp, Homo sapien
gatatatccccgtattacccactat

SEQ ID NO: 328490 - DNA, 25 bp, Homo sapien
tatcgcctggcaccgtaggacaaat

SEQ ID NO: 328491 - DNA, 25 bp, Homo sapien
catccgctaggatggttagtaccac

SEQ ID NO: 328492 - DNA, 25 bp, Homo sapien
agcaaggtcaaccagtgtacccaat

SEQ ID NO: 328493 - DNA, 25 bp, Homo sapien
gtgtacccaatcacgacaggaggat

SEQ ID NO: 328494 - DNA, 25 bp, Homo sapien
gacaggaggattcagacacccctac

SEQ ID NO: 328495 - DNA, 25 bp, Homo sapien
atatggtcccaccacatcatacgct

SEQ ID NO: 328496 - DNA, 25 bp, Homo sapien
atcatacgctacacacgacgggcat

SEQ ID NO: 328497 - DNA, 25 bp, Homo sapien
ggccatagtcacaccaacagtcaaa

SEQ ID NO: 328498 - DNA, 25 bp, Homo sapien
aacagtcaaacaggaatcgtcccag

SEQ ID NO: 328499 - DNA, 25 bp, Homo sapien
gaatcgtcccagagtgatgtcggct

SEQ ID NO: 328500 - DNA, 25 bp, Homo sapien
caaggtcccactctaggtgatagac

SEQ ID NO: 328501 - DNA, 25 bp, Homo sapien
taggtgatagacagggaccccttct

SEQ ID NO: 328502 - DNA, 25 bp, Homo sapien
gaccccttctactgaacctttgagg

SEQ ID NO: 328503 - DNA, 25 bp, Homo sapien
agaaatgcgtttagatcttggatgc

SEQ ID NO: 328504 - DNA, 25 bp, Homo sapien
agatcttggatgcagacctttcaaa

SEQ ID NO: 328505 - DNA, 25 bp, Homo sapien
gtaaccatatggatcaaccacatgc

SEQ ID NO: 328506 - DNA, 25 bp, Homo sapien
cacatgcacatccttactacagaat

SEQ ID NO: 328507 - DNA, 25 bp, Homo sapien
atccttactacagaatccgtccttt

SEQ ID NO: 328508 - DNA, 25 bp, Homo sapien
gaatccgtcctttcatttcaactta

SEQ ID NO: 328509 - DNA, 25 bp, Homo sapien
tcatttcaacttatagcaagctatg

SEQ ID NO: 328510 - DNA, 25 bp, Homo sapien
gaaacaatttagctatatccactat

SEQ ID NO: 328511 - DNA, 25 bp, Homo sapien
ttgggaggccgaggatcacctgagg

SEQ ID NO: 328512 - DNA, 25 bp, Homo sapien
atggtggtagtacctgtaatttcag

SEQ ID NO: 328513 - DNA, 25 bp, Homo sapien
tggtggtagtacctgtaatttcagc

SEQ ID NO: 328514 - DNA, 25 bp, Homo sapien
ggtggtagtacctgtaatttcagct

SEQ ID NO: 328515 - DNA, 25 bp, Homo sapien
gtggtagtacctgtaatttcagcta

SEQ ID NO: 328516 - DNA, 25 bp, Homo sapien
tggtagtacctgtaatttcagctac

SEQ ID NO: 328517 - DNA, 25 bp, Homo sapien
ggtagtacctgtaatttcagctact

SEQ ID NO: 328518 - DNA, 25 bp, Homo sapien
tagtacctgtaatttcagctactcg

SEQ ID NO: 328519 - DNA, 25 bp, Homo sapien
gccgagaccgcaccactgtactgca

SEQ ID NO: 328520 - DNA, 25 bp, Homo sapien
ccgagaccgcaccactgtactgcag

SEQ ID NO: 328521 - DNA, 25 bp, Homo sapien
cgagaccgcaccactgtactgcagc

SEQ ID NO: 328522 - DNA, 25 bp, Homo sapien
aactcctccacaaggcagtgagctt

SEQ ID NO: 328523 - DNA, 25 bp, Homo sapien
agtgagcttcctcttgaacacggtc

SEQ ID NO: 328524 - DNA, 25 bp, Homo sapien
cccaaaattccgcaaggttgtgagg

SEQ ID NO: 328525 - DNA, 25 bp, Homo sapien
aaattccgcaaggttgtgagggaga

SEQ ID NO: 328526 - DNA, 25 bp, Homo sapien
tccatctctttccattgctggaaat

SEQ ID NO: 328527 - DNA, 25 bp, Homo sapien
tgctggaaatgattccaagtccttt

SEQ ID NO: 328528 - DNA, 25 bp, Homo sapien
atattggggaattgcctcttccaga

SEQ ID NO: 328529 - DNA, 25 bp, Homo sapien
ccttcactgcctcatatccatgaaa

SEQ ID NO: 328530 - DNA, 25 bp, Homo sapien
atccatgaaacaccactatgggatt

SEQ ID NO: 328531 - DNA, 25 bp, Homo sapien
gaaacaccactatgggattcatgcc

SEQ ID NO: 328532 - DNA, 25 bp, Homo sapien
aaacaccactatgggattcatgcca

SEQ ID NO: 328533 - DNA, 25 bp, Homo sapien
gggaaaaccatctcagtaagaccta

SEQ ID NO: 328534 - DNA, 25 bp, Homo sapien
atctggaattgggaggagcctccac

SEQ ID NO: 328535 - DNA, 25 bp, Homo sapien
tgactcctccttatgaagccagctg

SEQ ID NO: 328536 - DNA, 25 bp, Homo sapien
cctccttatgaagccagctgctgaa

SEQ ID NO: 328537 - DNA, 25 bp, Homo sapien
gctgctgaaattagctactcaccaa

SEQ ID NO: 328538 - DNA, 25 bp, Homo sapien
gaaattagctactcaccaagagtga

SEQ ID NO: 328539 - DNA, 25 bp, Homo sapien
gggcagagacttccagtcactgagt

SEQ ID NO: 328540 - DNA, 25 bp, Homo sapien
acttccagtcactgagtctcccagg

SEQ ID NO: 328541 - DNA, 25 bp, Homo sapien
agctccctgtattgatataacctgt

SEQ ID NO: 328542 - DNA, 25 bp, Homo sapien
atataacctgtcaggctggcttggt

SEQ ID NO: 328543 - DNA, 25 bp, Homo sapien
caggctggcttggttaggttttact

SEQ ID NO: 328544 - DNA, 25 bp, Homo sapien
atgcagttgtaagtaatgccaggat

SEQ ID NO: 328545 - DNA, 25 bp, Homo sapien
tatcaagcaagccacgtaaacagtg

SEQ ID NO: 328546 - DNA, 25 bp, Homo sapien
ttccatttgtttggtaagcagccat

SEQ ID NO: 328547 - DNA, 25 bp, Homo sapien
aagcagccattttactcttgcactg

SEQ ID NO: 328548 - DNA, 25 bp, Homo sapien
tactcttgcactgtaatgaactgaa

SEQ ID NO: 328549 - DNA, 25 bp, Homo sapien
cccatattgctattcaactacctct

SEQ ID NO: 328550 - DNA, 25 bp, Homo sapien
aactacctctatatgcttgatttct

SEQ ID NO: 328551 - DNA, 25 bp, Homo sapien
gcaaataggccaatgtggcaccata

SEQ ID NO: 328552 - DNA, 25 bp, Homo sapien
ggcaccataggcttattttaggtaa

SEQ ID NO: 328553 - DNA, 25 bp, Homo sapien
ggtaaattagttccatcatcttatg

SEQ ID NO: 328554 - DNA, 25 bp, Homo sapien
agttccatcatcttatgcagttgta

SEQ ID NO: 328555 - DNA, 25 bp, Homo sapien
cttaatttatctgcccccaggatgc

SEQ ID NO: 328556 - DNA, 25 bp, Homo sapien
ccaggatgcgtcagtctgttcagtg

SEQ ID NO: 328557 - DNA, 25 bp, Homo sapien
gcgtcagtctgttcagtggtcagca

SEQ ID NO: 328558 - DNA, 25 bp, Homo sapien
agtctgttcagtggtcagcaggccc

SEQ ID NO: 328559 - DNA, 25 bp, Homo sapien
aacacaacacgctgctggtctgtgt

SEQ ID NO: 328560 - DNA, 25 bp, Homo sapien
tgctggtctgtgtcagcctttgtaa

SEQ ID NO: 328561 - DNA, 25 bp, Homo sapien
ctgtgtcagcctttgtaacgtggga

SEQ ID NO: 328562 - DNA, 25 bp, Homo sapien
cgtgtcttccgggtgaactgtattt

SEQ ID NO: 328563 - DNA, 25 bp, Homo sapien
gaactgtatttggattgcgcgcatt

SEQ ID NO: 328564 - DNA, 25 bp, Homo sapien
ggattgcgcgcattgtcacggtccg

SEQ ID NO: 328565 - DNA, 25 bp, Homo sapien
cacctctagacgctgtaataaacag

SEQ ID NO: 328566 - DNA, 25 bp, Homo sapien
ttccattgctggaaatgattccaag

SEQ ID NO: 328567 - DNA, 25 bp, Homo sapien
tccattgctggaaatgattccaagt

SEQ ID NO: 328568 - DNA, 25 bp, Homo sapien
ccattgctggaaatgattccaagtc

SEQ ID NO: 328569 - DNA, 25 bp, Homo sapien
cattgctggaaatgattccaagtcc

SEQ ID NO: 328570 - DNA, 25 bp, Homo sapien
attgctggaaatgattccaagtcct

SEQ ID NO: 328571 - DNA, 25 bp, Homo sapien
ttgctggaaatgattccaagtcctt

SEQ ID NO: 328572 - DNA, 25 bp, Homo sapien
tgctggaaatgattccaagtccttt

SEQ ID NO: 328573 - DNA, 25 bp, Homo sapien
gatattggggaattgcctcttccag

SEQ ID NO: 328574 - DNA, 25 bp, Homo sapien
atattggggaattgcctcttccaga

SEQ ID NO: 328575 - DNA, 25 bp, Homo sapien
ccttcactgcctcatatccatgaaa

SEQ ID NO: 328576 - DNA, 25 bp, Homo sapien
cttcactgcctcatatccatgaaac

SEQ ID NO: 328577 - DNA, 25 bp, Homo sapien
aatgaacatatgaataccacctaaa

SEQ ID NO: 328578 - DNA, 25 bp, Homo sapien
aaagtacaccatatagcattatttt

SEQ ID NO: 328579 - DNA, 25 bp, Homo sapien
atgtcccttaaatattctttgttag

SEQ ID NO: 328580 - DNA, 25 bp, Homo sapien
ggacagtttatgttaagcacttagc

SEQ ID NO: 328581 - DNA, 25 bp, Homo sapien
agcacttagcttaaacaatccgttt

SEQ ID NO: 328582 - DNA, 25 bp, Homo sapien
aaacaatccgtttatattagcactg

SEQ ID NO: 328583 - DNA, 25 bp, Homo sapien
attagcactgtatcccttgtgccat

SEQ ID NO: 328584 - DNA, 25 bp, Homo sapien
cttgtgccatccaacattttgtatg

SEQ ID NO: 328585 - DNA, 25 bp, Homo sapien
tacatttctgtactgctttctttaa

SEQ ID NO: 328586 - DNA, 25 bp, Homo sapien
gtactgctttctttaatgtatacat

SEQ ID NO: 328587 - DNA, 25 bp, Homo sapien
gtatacatgccttgtttaacttgga

SEQ ID NO: 328588 - DNA, 25 bp, Homo sapien
gaagtttcttggaaaggctacacta

SEQ ID NO: 328589 - DNA, 25 bp, Homo sapien
gaaaggctacactactattactggt

SEQ ID NO: 328590 - DNA, 25 bp, Homo sapien
gctacactactattactggtttccg

SEQ ID NO: 328591 - DNA, 25 bp, Homo sapien
tactattactggtttccgtctgatg

SEQ ID NO: 328592 - DNA, 25 bp, Homo sapien
tactggtttccgtctgatgtttgag

SEQ ID NO: 328593 - DNA, 25 bp, Homo sapien
ttccgtctgatgtttgagatctgtt

SEQ ID NO: 328594 - DNA, 25 bp, Homo sapien
ttgagatctgttgattttatgcttt

SEQ ID NO: 328595 - DNA, 25 bp, Homo sapien
tttatgcttttcttacaggcctttc

SEQ ID NO: 328596 - DNA, 25 bp, Homo sapien
gcttttcttacaggcctttcattat

SEQ ID NO: 328597 - DNA, 25 bp, Homo sapien
tacaggcctttcattatgatctttg

SEQ ID NO: 328598 - DNA, 25 bp, Homo sapien
tcaataaaatgatagggcctacttc

SEQ ID NO: 328599 - DNA, 25 bp, Homo sapien
ttggctttgctatctacttcggcta

SEQ ID NO: 328600 - DNA, 25 bp, Homo sapien
tacttcggctatgggatccagcaca

SEQ ID NO: 328601 - DNA, 25 bp, Homo sapien
ttaagagtaaccaaccctcacgcaa

SEQ ID NO: 328602 - DNA, 25 bp, Homo sapien
tcacgcaagtctagagccaaaactg

SEQ ID NO: 328603 - DNA, 25 bp, Homo sapien
aaaactgtagaccttgatcccggca

SEQ ID NO: 328604 - DNA, 25 bp, Homo sapien
cactctctatgtccactcagtttga

SEQ ID NO: 328605 - DNA, 25 bp, Homo sapien
tgtccactcagtttgacatcgtcac

SEQ ID NO: 328606 - DNA, 25 bp, Homo sapien
atcgtcacacctaaatgctgtctgg

SEQ ID NO: 328607 - DNA, 25 bp, Homo sapien
tctggtcccctgcacaataatggag

SEQ ID NO: 328608 - DNA, 25 bp, Homo sapien
tggagagtactcctgaccccagtga

SEQ ID NO: 328609 - DNA, 25 bp, Homo sapien
tgagcatcttttgtgaatatttacc

SEQ ID NO: 328610 - DNA, 25 bp, Homo sapien
tcaggacacagggaaatcagggtta

SEQ ID NO: 328611 - DNA, 25 bp, Homo sapien
cacagggaaatcagggttacaaatc

SEQ ID NO: 328612 - DNA, 25 bp, Homo sapien
gggttacaaatcttcttgatccact

SEQ ID NO: 328613 - DNA, 25 bp, Homo sapien
tacaaatcttcttgatccacttctc

SEQ ID NO: 328614 - DNA, 25 bp, Homo sapien
aaatcttcttgatccacttctctca

SEQ ID NO: 328615 - DNA, 25 bp, Homo sapien
ttcttgatccacttctctcaggatc

SEQ ID NO: 328616 - DNA, 25 bp, Homo sapien
ctcctgtctttaaagcctgcctctt

SEQ ID NO: 328617 - DNA, 25 bp, Homo sapien
tctttaaagcctgcctcttccagga

SEQ ID NO: 328618 - DNA, 25 bp, Homo sapien
aggaagacccccctattgctgctgg

SEQ ID NO: 328619 - DNA, 25 bp, Homo sapien
ggctccccatttgcttactttgcat

SEQ ID NO: 328620 - DNA, 25 bp, Homo sapien
atttgcttactttgcatttgtgccc

SEQ ID NO: 328621 - DNA, 25 bp, Homo sapien
gaaggatatttcagctaggcagtgg

SEQ ID NO: 328622 - DNA, 25 bp, Homo sapien
tcagctaggcagtgggacagaaata

SEQ ID NO: 328623 - DNA, 25 bp, Homo sapien
gagaatctgaattcaccagttttaa

SEQ ID NO: 328624 - DNA, 25 bp, Homo sapien
cagttttaagttgcctgactgccgc

SEQ ID NO: 328625 - DNA, 25 bp, Homo sapien
agttgcctgactgccgccacgtggg

SEQ ID NO: 328626 - DNA, 25 bp, Homo sapien
gggcatattgcttaaaacttctctt

SEQ ID NO: 328627 - DNA, 25 bp, Homo sapien
ttgcttaaaacttctcttgagggtg

SEQ ID NO: 328628 - DNA, 25 bp, Homo sapien
cttctcttgagggtgattatatcta

SEQ ID NO: 328629 - DNA, 25 bp, Homo sapien
gggaatgtctagagacactgttgtt

SEQ ID NO: 328630 - DNA, 25 bp, Homo sapien
gacactgttgtttgtcagtattggg

SEQ ID NO: 328631 - DNA, 25 bp, Homo sapien
cacagaaacagcatttgagaatcat

SEQ ID NO: 328632 - DNA, 25 bp, Homo sapien
gaaattgagcgaacatccacaccag

SEQ ID NO: 328633 - DNA, 25 bp, Homo sapien
acaccagaaccatacactcaaacaa

SEQ ID NO: 328634 - DNA, 25 bp, Homo sapien
gggcagggaaactccatcacatcat

SEQ ID NO: 328635 - DNA, 25 bp, Homo sapien
aactccatcacatcatggtgaggca

SEQ ID NO: 328636 - DNA, 25 bp, Homo sapien
agatgcttctcatccacacctgtgg

SEQ ID NO: 328637 - DNA, 25 bp, Homo sapien
agaggtggcaccattttactatgtg

SEQ ID NO: 328638 - DNA, 25 bp, Homo sapien
attttactatgtgtcctccctgcac

SEQ ID NO: 328639 - DNA, 25 bp, Homo sapien
cctgcactcagtgaagtctgtgaag

SEQ ID NO: 328640 - DNA, 25 bp, Homo sapien
tgtggacctcaggaaaccaaaggtg

SEQ ID NO: 328641 - DNA, 25 bp, Homo sapien
aaaggtgacctctgttggcatggcc

SEQ ID NO: 328642 - DNA, 25 bp, Homo sapien
ctttccaccaatgcccatgagatgt

SEQ ID NO: 328643 - DNA, 25 bp, Homo sapien
tgagttaattgcacccacagtcact

SEQ ID NO: 328644 - DNA, 25 bp, Homo sapien
agtcactgcactgtgttgaaaaatc

SEQ ID NO: 328645 - DNA, 25 bp, Homo sapien
gcatctgtgtggttgctcaaatctt

SEQ ID NO: 328646 - DNA, 25 bp, Homo sapien
ttagcagatttcctagacagtgact

SEQ ID NO: 328647 - DNA, 25 bp, Homo sapien
gtgactagactgaccttttatatgt

SEQ ID NO: 328648 - DNA, 25 bp, Homo sapien
aaacacatttaagccgtgatggaat

SEQ ID NO: 328649 - DNA, 25 bp, Homo sapien
gatggaatcgaagtgctagctcaga

SEQ ID NO: 328650 - DNA, 25 bp, Homo sapien
gttgctcaaatcttaagtaccttta

SEQ ID NO: 328651 - DNA, 25 bp, Homo sapien
tatagctcttgctgttggcaacagg

SEQ ID NO: 328652 - DNA, 25 bp, Homo sapien
gaggttgtactgctgagttgcctat

SEQ ID NO: 328653 - DNA, 25 bp, Homo sapien
gagttgcctatggttctgagttaat

SEQ ID NO: 328654 - DNA, 25 bp, Homo sapien
tgagtttgactgatgtcttctgtgt

SEQ ID NO: 328655 - DNA, 25 bp, Homo sapien
atgtcttctgtgtggtgtccgctaa

SEQ ID NO: 328656 - DNA, 25 bp, Homo sapien
ttctgtgtggtgtccgctaaatccc

SEQ ID NO: 328657 - DNA, 25 bp, Homo sapien
tgtccgctaaatcccacagcatata

SEQ ID NO: 328658 - DNA, 25 bp, Homo sapien
cacagcatataggatcagtcgcatt

SEQ ID NO: 328659 - DNA, 25 bp, Homo sapien
atataggatcagtcgcattggttat

SEQ ID NO: 328660 - DNA, 25 bp, Homo sapien
gatcagtcgcattggttataaggtt

SEQ ID NO: 328661 - DNA, 25 bp, Homo sapien
tggttataaggtttgcttctggctg

SEQ ID NO: 328662 - DNA, 25 bp, Homo sapien
ataaggtttgcttctggctgggtgc

SEQ ID NO: 328663 - DNA, 25 bp, Homo sapien
gagtccagccactgtctgggtactg

SEQ ID NO: 328664 - DNA, 25 bp, Homo sapien
ccagccactgtctgggtactgccag

SEQ ID NO: 328665 - DNA, 25 bp, Homo sapien
tgccctgtgcagagttcagctttgt

SEQ ID NO: 328666 - DNA, 25 bp, Homo sapien
gagggagataccgaacagatagaca

SEQ ID NO: 328667 - DNA, 25 bp, Homo sapien
gatagacagaaaacgttgtacggaa

SEQ ID NO: 328668 - DNA, 25 bp, Homo sapien
tttccgggagaacccgcttacacag

SEQ ID NO: 328669 - DNA, 25 bp, Homo sapien
ccgcttacacagctctgtttgtaat

SEQ ID NO: 328670 - DNA, 25 bp, Homo sapien
ttcatgctaaaatcacacggcctat

SEQ ID NO: 328671 - DNA, 25 bp, Homo sapien
tcacacggcctatttgttgatgtaa

SEQ ID NO: 328672 - DNA, 25 bp, Homo sapien
gttgatgtaagttgcctgaattccg

SEQ ID NO: 328673 - DNA, 25 bp, Homo sapien
aagttgcctgaattccgtggtatgc

SEQ ID NO: 328674 - DNA, 25 bp, Homo sapien
aattccgtggtatgctatcttcttt

SEQ ID NO: 328675 - DNA, 25 bp, Homo sapien
ccgtggtatgctatcttctttttta

SEQ ID NO: 328676 - DNA, 25 bp, Homo sapien
taaaggtggcccagacttgcaattg

SEQ ID NO: 328677 - DNA, 25 bp, Homo sapien
agacttgcaattggcctctgaagtg

SEQ ID NO: 328678 - DNA, 25 bp, Homo sapien
atgtttccctgaattccatgagcca

SEQ ID NO: 328679 - DNA, 25 bp, Homo sapien
cacaaccactgggatctgatgctat

SEQ ID NO: 328680 - DNA, 25 bp, Homo sapien
ctgggatctgatgctatatccaggt

SEQ ID NO: 328681 - DNA, 25 bp, Homo sapien
gaattggattctaggatacccagag

SEQ ID NO: 328682 - DNA, 25 bp, Homo sapien
taggatacccagagagggtctgctg

SEQ ID NO: 328683 - DNA, 25 bp, Homo sapien
ggaaaaacacacatctggtctaaga

SEQ ID NO: 328684 - DNA, 25 bp, Homo sapien
atctggtctaagaagtgttctgtat

SEQ ID NO: 328685 - DNA, 25 bp, Homo sapien
tccatgagccatcccagcaaattaa

SEQ ID NO: 328686 - DNA, 25 bp, Homo sapien
gaatctcagtttatagccggttggt

SEQ ID NO: 328687 - DNA, 25 bp, Homo sapien
attttagggattggtctggtgtcag

SEQ ID NO: 328688 - DNA, 25 bp, Homo sapien
ttttagggattggtctggtgtcagc

SEQ ID NO: 328689 - DNA, 25 bp, Homo sapien
tttagggattggtctggtgtcagct

SEQ ID NO: 328690 - DNA, 25 bp, Homo sapien
ttagggattggtctggtgtcagctg

SEQ ID NO: 328691 - DNA, 25 bp, Homo sapien
tagggattggtctggtgtcagctgt

SEQ ID NO: 328692 - DNA, 25 bp, Homo sapien
agggattggtctggtgtcagctgtg

SEQ ID NO: 328693 - DNA, 25 bp, Homo sapien
gggattggtctggtgtcagctgtgt

SEQ ID NO: 328694 - DNA, 25 bp, Homo sapien
aaatccggatggattttagggattg

SEQ ID NO: 328695 - DNA, 25 bp, Homo sapien
atccggatggattttagggattggt

SEQ ID NO: 328696 - DNA, 25 bp, Homo sapien
tccggatggattttagggattggtc

SEQ ID NO: 328697 - DNA, 25 bp, Homo sapien
ccggatggattttagggattggtct

SEQ ID NO: 328698 - DNA, 25 bp, Homo sapien
ccattagcaagtccatataagttta

SEQ ID NO: 328699 - DNA, 25 bp, Homo sapien
cctgatatgttattgtttactaagt

SEQ ID NO: 328700 - DNA, 25 bp, Homo sapien
gaagcaataacaactgcattatgac

SEQ ID NO: 328701 - DNA, 25 bp, Homo sapien
actgcattatgacctgagcttttta

SEQ ID NO: 328702 - DNA, 25 bp, Homo sapien
ttgctattatagaactcatcagaaa

SEQ ID NO: 328703 - DNA, 25 bp, Homo sapien
gaactcatcagaaaccaactgtaat

SEQ ID NO: 328704 - DNA, 25 bp, Homo sapien
agaaaccaactgtaatagctacgtt

SEQ ID NO: 328705 - DNA, 25 bp, Homo sapien
gtaatagctacgttttctcaccatg

SEQ ID NO: 328706 - DNA, 25 bp, Homo sapien
tagctacgttttctcaccatggaag

SEQ ID NO: 328707 - DNA, 25 bp, Homo sapien
gttttctcaccatggaagacttccg

SEQ ID NO: 328708 - DNA, 25 bp, Homo sapien
tttctcaccatggaagacttccgag

SEQ ID NO: 328709 - DNA, 25 bp, Homo sapien
tgtcctgggaaccagtgaggctctc

SEQ ID NO: 328710 - DNA, 25 bp, Homo sapien
gaggctctcgcttaaatctatgtgt

SEQ ID NO: 328711 - DNA, 25 bp, Homo sapien
acatcctgagtgatgcccaatttaa

SEQ ID NO: 328712 - DNA, 25 bp, Homo sapien
gtagcttgtatcatatgttgtttca

SEQ ID NO: 328713 - DNA, 25 bp, Homo sapien
atgttgtttcaaagtagtgtccaaa

SEQ ID NO: 328714 - DNA, 25 bp, Homo sapien
aagggtttgggctgcacgatattcc

SEQ ID NO: 328715 - DNA, 25 bp, Homo sapien
ctgcacgatattcctcaggtcatat

SEQ ID NO: 328716 - DNA, 25 bp, Homo sapien
gatgcccaatttaaggctttgaata

SEQ ID NO: 328717 - DNA, 25 bp, Homo sapien
aggtcatatctttcctggttccagt

SEQ ID NO: 328718 - DNA, 25 bp, Homo sapien
tgcccatcagggtacggtttgaata

SEQ ID NO: 328719 - DNA, 25 bp, Homo sapien
gaggatccagttcaggttgatgtcc

SEQ ID NO: 328720 - DNA, 25 bp, Homo sapien
gatgagcagtcacacagactttggt

SEQ ID NO: 328721 - DNA, 25 bp, Homo sapien
gactttggtaatattaacggctgct

SEQ ID NO: 328722 - DNA, 25 bp, Homo sapien
aacggctgctatttgaactattact

SEQ ID NO: 328723 - DNA, 25 bp, Homo sapien
tattcaaggagctaccctcctgctt

SEQ ID NO: 328724 - DNA, 25 bp, Homo sapien
atatgaccatcatcgagaccatcag

SEQ ID NO: 328725 - DNA, 25 bp, Homo sapien
gagaccatcagcgatcaagagccaa

SEQ ID NO: 328726 - DNA, 25 bp, Homo sapien
gatcaagagccaatggcgtgcccac

SEQ ID NO: 328727 - DNA, 25 bp, Homo sapien
tcctgaggccatgtgcggtttctga

SEQ ID NO: 328728 - DNA, 25 bp, Homo sapien
gaggctgacatgtcagtaactgact

SEQ ID NO: 328729 - DNA, 25 bp, Homo sapien
caggcaagactttaaattcccataa

SEQ ID NO: 328730 - DNA, 25 bp, Homo sapien
attcccataaaatgtctgacttcac

SEQ ID NO: 328731 - DNA, 25 bp, Homo sapien
agcttggcggcagtccccacattag

SEQ ID NO: 328732 - DNA, 25 bp, Homo sapien
agtccccacattagagcctctgact

SEQ ID NO: 328733 - DNA, 25 bp, Homo sapien
gcctatgatgtctgctttggtcacc

SEQ ID NO: 328734 - DNA, 25 bp, Homo sapien
gctttggtcaccctgatgatgatag

SEQ ID NO: 328735 - DNA, 25 bp, Homo sapien
ttttatgaggacaactgggcacccc

SEQ ID NO: 328736 - DNA, 25 bp, Homo sapien
aatgactctcccaagatttctcttc

SEQ ID NO: 328737 - DNA, 25 bp, Homo sapien
accagacctcgttcatttgactaac

SEQ ID NO: 328738 - DNA, 25 bp, Homo sapien
tttgactaacattttccagcgccta

SEQ ID NO: 328739 - DNA, 25 bp, Homo sapien
attttccagcgcctactatgtgtca

SEQ ID NO: 328740 - DNA, 25 bp, Homo sapien
gtgtttctgcctggacatcataaat

SEQ ID NO: 328741 - DNA, 25 bp, Homo sapien
gagagtcaggccacggtaagccctt

SEQ ID NO: 328742 - DNA, 25 bp, Homo sapien
ccagctgtcaaccatctgtacattt

SEQ ID NO: 328743 - DNA, 25 bp, Homo sapien
tctgtacatttgtcatacttgccaa

SEQ ID NO: 328744 - DNA, 25 bp, Homo sapien
tattcgggtaaaaaagtgatgcttt

SEQ ID NO: 328745 - DNA, 25 bp, Homo sapien
gatgcttttcaaattgatctaggat

SEQ ID NO: 328746 - DNA, 25 bp, Homo sapien
aagacctgacaattatcagagttat

SEQ ID NO: 328747 - DNA, 25 bp, Homo sapien
gagtcgtaatagatttcaagtgttc

SEQ ID NO: 328748 - DNA, 25 bp, Homo sapien
tcaagtgttctaggtgcataatggt

SEQ ID NO: 328749 - DNA, 25 bp, Homo sapien
cataatggtgaatgacctcaggcag

SEQ ID NO: 328750 - DNA, 25 bp, Homo sapien
aggcagttcactacagttctgttga

SEQ ID NO: 328751 - DNA, 25 bp, Homo sapien
gttctgttgagttatgttctccctt

SEQ ID NO: 328752 - DNA, 25 bp, Homo sapien
gttgagttatgttctccctttgtgt

SEQ ID NO: 328753 - DNA, 25 bp, Homo sapien
catggtcagatgctgcaaggatttt

SEQ ID NO: 328754 - DNA, 25 bp, Homo sapien
gctgcaaggattttacataaatgcc

SEQ ID NO: 328755 - DNA, 25 bp, Homo sapien
ggtttccttcctgagaacaatcttg

SEQ ID NO: 328756 - DNA, 25 bp, Homo sapien
tcctgagaacaatcttgctcttgcc

SEQ ID NO: 328757 - DNA, 25 bp, Homo sapien
agaacaatcttgctcttgccatgtt

SEQ ID NO: 328758 - DNA, 25 bp, Homo sapien
aatcttgctcttgccatgttctttg

SEQ ID NO: 328759 - DNA, 25 bp, Homo sapien
catgttctttgatttaggctggtag

SEQ ID NO: 328760 - DNA, 25 bp, Homo sapien
ttaggctggtagtaaacacatttca

SEQ ID NO: 328761 - DNA, 25 bp, Homo sapien
aaccatcaacattacttttctttct

SEQ ID NO: 328762 - DNA, 25 bp, Homo sapien
gagtcatttgagaccatgtgtccca

SEQ ID NO: 328763 - DNA, 25 bp, Homo sapien
atgtgtcccatctcaagccacagag

SEQ ID NO: 328764 - DNA, 25 bp, Homo sapien
aaggaacaagtaatctctctggagc

SEQ ID NO: 328765 - DNA, 25 bp, Homo sapien
acaagtaatctctctggagcctctt

SEQ ID NO: 328766 - DNA, 25 bp, Homo sapien
taatctctctggagcctcttttaaa

SEQ ID NO: 328767 - DNA, 25 bp, Homo sapien
tggagcctcttttaaaagcccacca

SEQ ID NO: 328768 - DNA, 25 bp, Homo sapien
gagcctcttttaaaagcccaccaat

SEQ ID NO: 328769 - DNA, 25 bp, Homo sapien
attcattgaggattccaccccagtg

SEQ ID NO: 328770 - DNA, 25 bp, Homo sapien
ttgaggattccaccccagtgaccta

SEQ ID NO: 328771 - DNA, 25 bp, Homo sapien
ggattccaccccagtgacctaatca

SEQ ID NO: 328772 - DNA, 25 bp, Homo sapien
gacagaaacattcagcccatagcag

SEQ ID NO: 328773 - DNA, 25 bp, Homo sapien
aacattcagcccatagcaggatgag

SEQ ID NO: 328774 - DNA, 25 bp, Homo sapien
ttcagcccatagcaggatgagaaaa

SEQ ID NO: 328775 - DNA, 25 bp, Homo sapien
actccagagctcaaagtcttctacc

SEQ ID NO: 328776 - DNA, 25 bp, Homo sapien
tttttccagcatcctttgtagactg

SEQ ID NO: 328777 - DNA, 25 bp, Homo sapien
ttccaggtaaccattgccagttccc

SEQ ID NO: 328778 - DNA, 25 bp, Homo sapien
agcatcctttgtagactgtcttcca

SEQ ID NO: 328779 - DNA, 25 bp, Homo sapien
aagagggctctctggcttcgtgtag

SEQ ID NO: 328780 - DNA, 25 bp, Homo sapien
ggctctctggcttcgtgtaggatga

SEQ ID NO: 328781 - DNA, 25 bp, Homo sapien
gtagactgtcttccaaaggcgttga

SEQ ID NO: 328782 - DNA, 25 bp, Homo sapien
aaggcgttgacatcaagaaggtctg

SEQ ID NO: 328783 - DNA, 25 bp, Homo sapien
gaaggtctggtctgacatcatctcc

SEQ ID NO: 328784 - DNA, 25 bp, Homo sapien
gacatcatctccgtggtgattaaga

SEQ ID NO: 328785 - DNA, 25 bp, Homo sapien
gattaagacggtcatcgcgctgact

SEQ ID NO: 328786 - DNA, 25 bp, Homo sapien
tggagctggaacgaagccccttgga

SEQ ID NO: 328787 - DNA, 25 bp, Homo sapien
ctgacatcagaggtgacgttagtct

SEQ ID NO: 328788 - DNA, 25 bp, Homo sapien
gtgacgttagtcttcgcaggcaatg

SEQ ID NO: 328789 - DNA, 25 bp, Homo sapien
agtcttcgcaggcaatgactcggcg

SEQ ID NO: 328790 - DNA, 25 bp, Homo sapien
atgactcggcggaatgtgatgccac

SEQ ID NO: 328791 - DNA, 25 bp, Homo sapien
acccgtgtccggactggcagagtgt

SEQ ID NO: 328792 - DNA, 25 bp, Homo sapien
caccaggtggtctggctgctttgat

SEQ ID NO: 328793 - DNA, 25 bp, Homo sapien
tggctgctttgatggatctcctaac

SEQ ID NO: 328794 - DNA, 25 bp, Homo sapien
tgatggatctcctaacttctctgca

SEQ ID NO: 328795 - DNA, 25 bp, Homo sapien
tcagtgctggccagaccttcactca

SEQ ID NO: 328796 - DNA, 25 bp, Homo sapien
cagtcatttccacagcgatcttggg

SEQ ID NO: 328797 - DNA, 25 bp, Homo sapien
gtaggtgaagatgagttcacaggta

SEQ ID NO: 328798 - DNA, 25 bp, Homo sapien
tgaagatgagttcacaggtaagaaa

SEQ ID NO: 328799 - DNA, 25 bp, Homo sapien
gaagatgagttcacaggtaagaaag

SEQ ID NO: 328800 - DNA, 25 bp, Homo sapien
acaggtaagaaagtgcaagcagagc

SEQ ID NO: 328801 - DNA, 25 bp, Homo sapien
caggtaagaaagtgcaagcagagcc

SEQ ID NO: 328802 - DNA, 25 bp, Homo sapien
aggtaagaaagtgcaagcagagcca

SEQ ID NO: 328803 - DNA, 25 bp, Homo sapien
gtaagaaagtgcaagcagagccagg

SEQ ID NO: 328804 - DNA, 25 bp, Homo sapien
taagaaagtgcaagcagagccaggc

SEQ ID NO: 328805 - DNA, 25 bp, Homo sapien
aagaaagtgcaagcagagccaggcg

SEQ ID NO: 328806 - DNA, 25 bp, Homo sapien
gaaagtgcaagcagagccaggcgcg

SEQ ID NO: 328807 - DNA, 25 bp, Homo sapien
agtgcaagcagagccaggcgcggtg

SEQ ID NO: 328808 - DNA, 25 bp, Homo sapien
ccagctgtcaaccatctgtacattt

SEQ ID NO: 328809 - DNA, 25 bp, Homo sapien
agctgtcaaccatctgtacatttgt

SEQ ID NO: 328810 - DNA, 25 bp, Homo sapien
gctgtcaaccatctgtacatttgtc

SEQ ID NO: 328811 - DNA, 25 bp, Homo sapien
gtcaaccatctgtacatttgtcata

SEQ ID NO: 328812 - DNA, 25 bp, Homo sapien
aaccatctgtacatttgtcatactt

SEQ ID NO: 328813 - DNA, 25 bp, Homo sapien
atctgtacatttgtcatacttgcca

SEQ ID NO: 328814 - DNA, 25 bp, Homo sapien
ctgtacatttgtcatacttgccaaa

SEQ ID NO: 328815 - DNA, 25 bp, Homo sapien
tttgtcatacttgccaaattgaggc

SEQ ID NO: 328816 - DNA, 25 bp, Homo sapien
gtcatacttgccaaattgaggcgga

SEQ ID NO: 328817 - DNA, 25 bp, Homo sapien
atacttgccaaattgaggcggagaa

SEQ ID NO: 328818 - DNA, 25 bp, Homo sapien
ttgccaaattgaggcggagaaaatt

SEQ ID NO: 328819 - DNA, 25 bp, Homo sapien
tatgtacagtacgttggcaatgaat

SEQ ID NO: 328820 - DNA, 25 bp, Homo sapien
ggcaatgaatacattaagcttcaaa

SEQ ID NO: 328821 - DNA, 25 bp, Homo sapien
cttcaaaatttggtagtgctctcga

SEQ ID NO: 328822 - DNA, 25 bp, Homo sapien
aaatttggtagtgctctcgaatatg

SEQ ID NO: 328823 - DNA, 25 bp, Homo sapien
ggtagtgctctcgaatatgtatatt

SEQ ID NO: 328824 - DNA, 25 bp, Homo sapien
tgtatttttcaagcgaagttctctt

SEQ ID NO: 328825 - DNA, 25 bp, Homo sapien
aagcgaagttctcttattcacatat

SEQ ID NO: 328826 - DNA, 25 bp, Homo sapien
taaagtgggttggtactgatatcaa

SEQ ID NO: 328827 - DNA, 25 bp, Homo sapien
gaacagacatttcagtcactgcatt

SEQ ID NO: 328828 - DNA, 25 bp, Homo sapien
gtcactgcattcttaggtattccaa

SEQ ID NO: 328829 - DNA, 25 bp, Homo sapien
gatgacatcaatagattgcatttta

SEQ ID NO: 328830 - DNA, 25 bp, Homo sapien
agaagtagtttctgatttccctgaa

SEQ ID NO: 328831 - DNA, 25 bp, Homo sapien
gtagtttctgatttccctgaatgaa

SEQ ID NO: 328832 - DNA, 25 bp, Homo sapien
taaaattcctcatctcaaggccacc

SEQ ID NO: 328833 - DNA, 25 bp, Homo sapien
cagttatcacccttggaaatcctct

SEQ ID NO: 328834 - DNA, 25 bp, Homo sapien
ggaaatcctctgtttagcttagttg

SEQ ID NO: 328835 - DNA, 25 bp, Homo sapien
cctctgtttagcttagttgcacaaa

SEQ ID NO: 328836 - DNA, 25 bp, Homo sapien
aaaggtagtatgtccagtggctaga

SEQ ID NO: 328837 - DNA, 25 bp, Homo sapien
tcaggaattccctggtttccactgg

SEQ ID NO: 328838 - DNA, 25 bp, Homo sapien
ccacttgctggacagtctgagccaa

SEQ ID NO: 328839 - DNA, 25 bp, Homo sapien
tgagccaagtccctcctgctggaga

SEQ ID NO: 328840 - DNA, 25 bp, Homo sapien
cctcctgctggagaaaagcctggaa

SEQ ID NO: 328841 - DNA, 25 bp, Homo sapien
tgggttgaaagctgttaaagttctt

SEQ ID NO: 328842 - DNA, 25 bp, Homo sapien
aaatgcctcgtaataaattgtcatg

SEQ ID NO: 328843 - DNA, 25 bp, Homo sapien
gtatcatgcttgttttgctctacat

SEQ ID NO: 328844 - DNA, 25 bp, Homo sapien
catgcttgttttgctctacatagtt

SEQ ID NO: 328845 - DNA, 25 bp, Homo sapien
gctctacatagttttttggtactac

SEQ ID NO: 328846 - DNA, 25 bp, Homo sapien
actgtagacttaagtatctttttgg

SEQ ID NO: 328847 - DNA, 25 bp, Homo sapien
taatgttaggtctggtattcgttcc

SEQ ID NO: 328848 - DNA, 25 bp, Homo sapien
gtattcgttccattaagttccactt

SEQ ID NO: 328849 - DNA, 25 bp, Homo sapien
atctgctttaaacaatgaatggtac

SEQ ID NO: 328850 - DNA, 25 bp, Homo sapien
gaatggtactgcaatagtcctgtaa

SEQ ID NO: 328851 - DNA, 25 bp, Homo sapien
ggtactgcaatagtcctgtaaagaa

SEQ ID NO: 328852 - DNA, 25 bp, Homo sapien
atgaggcctccagccggtggtcagt

SEQ ID NO: 328853 - DNA, 25 bp, Homo sapien
tcagtgagggagttaagtggcttct

SEQ ID NO: 328854 - DNA, 25 bp, Homo sapien
gagttaagtggcttctccgtggaaa

SEQ ID NO: 328855 - DNA, 25 bp, Homo sapien
gttaagtggcttctccgtggaaaca

SEQ ID NO: 328856 - DNA, 25 bp, Homo sapien
agtggcttctccgtggaaacacagc

SEQ ID NO: 328857 - DNA, 25 bp, Homo sapien
ggcttctccgtggaaacacagcctt

SEQ ID NO: 328858 - DNA, 25 bp, Homo sapien
agaggctcacccagcgtgaactgcc

SEQ ID NO: 328859 - DNA, 25 bp, Homo sapien
gtgaactgcccccagggaacactgg

SEQ ID NO: 328860 - DNA, 25 bp, Homo sapien
cccagggaacactgggcgatgcctg

SEQ ID NO: 328861 - DNA, 25 bp, Homo sapien
gggacattgtggttgtcacgatggg

SEQ ID NO: 328862 - DNA, 25 bp, Homo sapien
ggaggccagagacactgctcagcag

SEQ ID NO: 328863 - DNA, 25 bp, Homo sapien
tcagctccacagctttacccagaag

SEQ ID NO: 328864 - DNA, 25 bp, Homo sapien
tacccagaagccctgtaagcctggc

SEQ ID NO: 328865 - DNA, 25 bp, Homo sapien
agaagccctgtaagcctggcccctg

SEQ ID NO: 328866 - DNA, 25 bp, Homo sapien
tcatccctgaccgactccacttaac

SEQ ID NO: 328867 - DNA, 25 bp, Homo sapien
ggccagcctgagatgcccgtgaaac

SEQ ID NO: 328868 - DNA, 25 bp, Homo sapien
gccagcctgagatgcccgtgaaact

SEQ ID NO: 328869 - DNA, 25 bp, Homo sapien
agcctgagatgcccgtgaaactcct

SEQ ID NO: 328870 - DNA, 25 bp, Homo sapien
agagctaaccaccatccatggtcaa

SEQ ID NO: 328871 - DNA, 25 bp, Homo sapien
agctaaccaccatccatggtcaaga

SEQ ID NO: 328872 - DNA, 25 bp, Homo sapien
taaccaccatccatggtcaagacct

SEQ ID NO: 328873 - DNA, 25 bp, Homo sapien
acctctcctagctccacacaagcag

SEQ ID NO: 328874 - DNA, 25 bp, Homo sapien
gttatgataggaaataccttctcca

SEQ ID NO: 328875 - DNA, 25 bp, Homo sapien
aggaaataccttctccataggacat

SEQ ID NO: 328876 - DNA, 25 bp, Homo sapien
tccataggacataggccaagcaaat

SEQ ID NO: 328877 - DNA, 25 bp, Homo sapien
acataggccaagcaaatgactttgt

SEQ ID NO: 328878 - DNA, 25 bp, Homo sapien
atctgcataacgtgtgccccaagta

SEQ ID NO: 328879 - DNA, 25 bp, Homo sapien
agagggtgtttaaactctcagaagt

SEQ ID NO: 328880 - DNA, 25 bp, Homo sapien
aagttctgtaacaggctctccatct

SEQ ID NO: 328881 - DNA, 25 bp, Homo sapien
tgtaacaggctctccatctacataa

SEQ ID NO: 328882 - DNA, 25 bp, Homo sapien
aggctctccatctacataacgtgtg

SEQ ID NO: 328883 - DNA, 25 bp, Homo sapien
catctacataacgtgtgccccaagt

SEQ ID NO: 328884 - DNA, 25 bp, Homo sapien
tctacataacgtgtgccccaagtaa

SEQ ID NO: 328885 - DNA, 25 bp, Homo sapien
tcagactacagccaggcctcatttc

SEQ ID NO: 328886 - DNA, 25 bp, Homo sapien
tgaactgtgcagataaggaactaag

SEQ ID NO: 328887 - DNA, 25 bp, Homo sapien
aatatgctagcatttactctataat

SEQ ID NO: 328888 - DNA, 25 bp, Homo sapien
gttggttttggctttaagcaccaga

SEQ ID NO: 328889 - DNA, 25 bp, Homo sapien
gtgagaaaaattgtctctgtgtttg

SEQ ID NO: 328890 - DNA, 25 bp, Homo sapien
ggttttggctttaagcaccagaact

SEQ ID NO: 328891 - DNA, 25 bp, Homo sapien
ttggctttaagcaccagaactataa

SEQ ID NO: 328892 - DNA, 25 bp, Homo sapien
aagcaccagaactataatccacata

SEQ ID NO: 328893 - DNA, 25 bp, Homo sapien
gaagtcagaatttggcacatgtcag

SEQ ID NO: 328894 - DNA, 25 bp, Homo sapien
gtcagaatttggcacatgtcagata

SEQ ID NO: 328895 - DNA, 25 bp, Homo sapien
cagaatttggcacatgtcagataac

SEQ ID NO: 328896 - DNA, 25 bp, Homo sapien
gcggcagccttcgagggtgtgtgct

SEQ ID NO: 328897 - DNA, 25 bp, Homo sapien
ttagtaaaagtctgccgtggagaca

SEQ ID NO: 328898 - DNA, 25 bp, Homo sapien
taaagcgacaggcaagcccgcagat

SEQ ID NO: 328899 - DNA, 25 bp, Homo sapien
gtatccttcgggacagacattgtat

SEQ ID NO: 328900 - DNA, 25 bp, Homo sapien
agacattgtatgagttcccacagaa

SEQ ID NO: 328901 - DNA, 25 bp, Homo sapien
gttcccacagaatcagagagggtga

SEQ ID NO: 328902 - DNA, 25 bp, Homo sapien
gagggtgactggagccactgaattt

SEQ ID NO: 328903 - DNA, 25 bp, Homo sapien
tgactggagccactgaatttggagt

SEQ ID NO: 328904 - DNA, 25 bp, Homo sapien
tctgccgtggagacacgaaggtgct

SEQ ID NO: 328905 - DNA, 25 bp, Homo sapien
gaacgtgcgttttcagtcgtggcag

SEQ ID NO: 328906 - DNA, 25 bp, Homo sapien
tctgtaatggaagccgcgtggaaag

SEQ ID NO: 328907 - DNA, 25 bp, Homo sapien
gaagaagtcgggtcccaggctctag

SEQ ID NO: 328908 - DNA, 25 bp, Homo sapien
tagttgctggttcttacatgccacc

SEQ ID NO: 328909 - DNA, 25 bp, Homo sapien
atccacagtccttcagcagattgat

SEQ ID NO: 328910 - DNA, 25 bp, Homo sapien
gattcagtggctaatgctgatatca

SEQ ID NO: 328911 - DNA, 25 bp, Homo sapien
gaagtttgtttctggccagaagtca

SEQ ID NO: 328912 - DNA, 25 bp, Homo sapien
gtggaaatttgggacatacaccttt

SEQ ID NO: 328913 - DNA, 25 bp, Homo sapien
ggacatacaccttttgttgatgagt

SEQ ID NO: 328914 - DNA, 25 bp, Homo sapien
gatgagttgtaatactgatgcacac

SEQ ID NO: 328915 - DNA, 25 bp, Homo sapien
tgatgcacacattacaggagagagc

SEQ ID NO: 328916 - DNA, 25 bp, Homo sapien
atacctaatgtcagtggagtcttct

SEQ ID NO: 328917 - DNA, 25 bp, Homo sapien
ggagtcttctgagtgtttcctggaa

SEQ ID NO: 328918 - DNA, 25 bp, Homo sapien
gaagagccctgtaatcctgaggagg

SEQ ID NO: 328919 - DNA, 25 bp, Homo sapien
aagagccctgtaatcctgaggaggg

SEQ ID NO: 328920 - DNA, 25 bp, Homo sapien
agaggctccgggtcctgtggacaca

SEQ ID NO: 328921 - DNA, 25 bp, Homo sapien
aggctccgggtcctgtggacacaca

SEQ ID NO: 328922 - DNA, 25 bp, Homo sapien
ggtcctgtggacacacacgggttgc

SEQ ID NO: 328923 - DNA, 25 bp, Homo sapien
ctgtggacacacacgggttgcctgc

SEQ ID NO: 328924 - DNA, 25 bp, Homo sapien
ggacacacacgggttgcctgcttca

SEQ ID NO: 328925 - DNA, 25 bp, Homo sapien
ttgcctgcttcaccccatctaggag

SEQ ID NO: 328926 - DNA, 25 bp, Homo sapien
gcttcaccccatctaggagctgctt

SEQ ID NO: 328927 - DNA, 25 bp, Homo sapien
accccatctaggagctgcttcctga

SEQ ID NO: 328928 - DNA, 25 bp, Homo sapien
ctgcttcctgaagccttcaggaggc

SEQ ID NO: 328929 - DNA, 25 bp, Homo sapien
ctcccctcagctggtaatgatggta

SEQ ID NO: 328930 - DNA, 25 bp, Homo sapien
gaagttgcctatgtatgtcatatca

SEQ ID NO: 328931 - DNA, 25 bp, Homo sapien
catatcaattcaatagctgcctggg

SEQ ID NO: 328932 - DNA, 25 bp, Homo sapien
tgtacattccattactgtaaatgat

SEQ ID NO: 328933 - DNA, 25 bp, Homo sapien
atgattgagagctggtttgtggtat

SEQ ID NO: 328934 - DNA, 25 bp, Homo sapien
atggttggctttgcctaagcatttt

SEQ ID NO: 328935 - DNA, 25 bp, Homo sapien
ttgaagatgaacagcatgtgcagcc

SEQ ID NO: 328936 - DNA, 25 bp, Homo sapien
gcatgtgcagccaaagaactaattt

SEQ ID NO: 328937 - DNA, 25 bp, Homo sapien
aaggtggaacaatcattctgaatga

SEQ ID NO: 328938 - DNA, 25 bp, Homo sapien
atataatcagagtactccgcagttt

SEQ ID NO: 328939 - DNA, 25 bp, Homo sapien
gagtactccgcagtttgttaagaag

SEQ ID NO: 328940 - DNA, 25 bp, Homo sapien
agtcgtggcagaacggagcatcagc

SEQ ID NO: 328941 - DNA, 25 bp, Homo sapien
ggagcatcagccagaccctgttgtg

SEQ ID NO: 328942 - DNA, 25 bp, Homo sapien
agccagaccctgttgtgggcgttgt

SEQ ID NO: 328943 - DNA, 25 bp, Homo sapien
cctgttgtgggcgttgtcatcaagg

SEQ ID NO: 328944 - DNA, 25 bp, Homo sapien
ggcgttgtcatcaagggagcttgaa

SEQ ID NO: 328945 - DNA, 25 bp, Homo sapien
gtctggtgtcagatacagccgactc

SEQ ID NO: 328946 - DNA, 25 bp, Homo sapien
ggtgtcagatacagccgactccagc

SEQ ID NO: 328947 - DNA, 25 bp, Homo sapien
atgatgctgtgtgacccactgggca

SEQ ID NO: 328948 - DNA, 25 bp, Homo sapien
ggcactctggtgagggagctttcca

SEQ ID NO: 328949 - DNA, 25 bp, Homo sapien
gggagctttccagacatcaacagcc

SEQ ID NO: 328950 - DNA, 25 bp, Homo sapien
ctgcctagtgttggagggtagacca

SEQ ID NO: 328951 - DNA, 25 bp, Homo sapien
tttccagtatggatggcgatgcacc

SEQ ID NO: 328952 - DNA, 25 bp, Homo sapien
ggcgatgcaccactaatgagaatac

SEQ ID NO: 328953 - DNA, 25 bp, Homo sapien
gaatacctattcaaaccgtaccctg

SEQ ID NO: 328954 - DNA, 25 bp, Homo sapien
aaccgtaccctgatgggcaactgga

SEQ ID NO: 328955 - DNA, 25 bp, Homo sapien
gaggaatatcgtgcagcccaaaccc

SEQ ID NO: 328956 - DNA, 25 bp, Homo sapien
cttcccagtttggacactactttga

SEQ ID NO: 328957 - DNA, 25 bp, Homo sapien
aaaatgccactttcaacacatagat

SEQ ID NO: 328958 - DNA, 25 bp, Homo sapien
acacatagatttaagcgagagcctc

SEQ ID NO: 328959 - DNA, 25 bp, Homo sapien
agagcctcactggttcccaggacat

SEQ ID NO: 328960 - DNA, 25 bp, Homo sapien
ggacatcaacctgaactggatcctc

SEQ ID NO: 328961 - DNA, 25 bp, Homo sapien
tcctccccgatacaaatgcacagaa

SEQ ID NO: 328962 - DNA, 25 bp, Homo sapien
gcacgcgtgctcatcttgtgtaaaa

SEQ ID NO: 328963 - DNA, 25 bp, Homo sapien
aagttgctcatgtcattagctcggc

SEQ ID NO: 328964 - DNA, 25 bp, Homo sapien
tagctcggctctgagtttgcatgag

SEQ ID NO: 328965 - DNA, 25 bp, Homo sapien
tgagtttgcatgagaaaccagcgca

SEQ ID NO: 328966 - DNA, 25 bp, Homo sapien
gccacgggagaaaacacgatctgct

SEQ ID NO: 328967 - DNA, 25 bp, Homo sapien
aaactgtagcagtgactcgagacct

SEQ ID NO: 328968 - DNA, 25 bp, Homo sapien
agcagtgactcgagacctgtcctct

SEQ ID NO: 328969 - DNA, 25 bp, Homo sapien
tcccgctttatttaggatccgcttt

SEQ ID NO: 328970 - DNA, 25 bp, Homo sapien
ttaggatccgcttttccgagagcag

SEQ ID NO: 328971 - DNA, 25 bp, Homo sapien
ttttccgagagcagccactcaggca

SEQ ID NO: 328972 - DNA, 25 bp, Homo sapien
taggagtttctccttgaaacgcttt

SEQ ID NO: 328973 - DNA, 25 bp, Homo sapien
gaaaactcagagtcatgcgttctgt

SEQ ID NO: 328974 - DNA, 25 bp, Homo sapien
gagtcatgcgttctgttaataaaga

SEQ ID NO: 328975 - DNA, 25 bp, Homo sapien
gaagaatgtcagtaaacctaagcag

SEQ ID NO: 328976 - DNA, 25 bp, Homo sapien
gtcagtaaacctaagcagggactta

SEQ ID NO: 328977 - DNA, 25 bp, Homo sapien
ccaaaactgcagaaggacatcctaa

SEQ ID NO: 328978 - DNA, 25 bp, Homo sapien
gaaggacatcctaaaagcttattta

SEQ ID NO: 328979 - DNA, 25 bp, Homo sapien
gacagaagaaaagtggacgccctaa

SEQ ID NO: 328980 - DNA, 25 bp, Homo sapien
agtggacgccctaagaaacagagaa

SEQ ID NO: 328981 - DNA, 25 bp, Homo sapien
agaaataacaaccaggaactgcttt

SEQ ID NO: 328982 - DNA, 25 bp, Homo sapien
cttttcctgctgagtactgctaata

SEQ ID NO: 328983 - DNA, 25 bp, Homo sapien
tcctgctgagtactgctaataaaag

SEQ ID NO: 328984 - DNA, 25 bp, Homo sapien
agacctacaccatcacggaaggctc

SEQ ID NO: 328985 - DNA, 25 bp, Homo sapien
atcacggaaggctccttgagagcag

SEQ ID NO: 328986 - DNA, 25 bp, Homo sapien
accaaacgtggcctaaaagtctgtg

SEQ ID NO: 328987 - DNA, 25 bp, Homo sapien
cgtggcctaaaagtctgtgctgatc

SEQ ID NO: 328988 - DNA, 25 bp, Homo sapien
ggtcaggagcatggacaggaaatcc

SEQ ID NO: 328989 - DNA, 25 bp, Homo sapien
ggaaatccaacaccagaaataacat

SEQ ID NO: 328990 - DNA, 25 bp, Homo sapien
aacatgatccagaccaagccaacag

SEQ ID NO: 328991 - DNA, 25 bp, Homo sapien
acaggaacccagcaatcgaccaata

SEQ ID NO: 328992 - DNA, 25 bp, Homo sapien
agcaatcgaccaatacagctgtgac

SEQ ID NO: 328993 - DNA, 25 bp, Homo sapien
ctgactggctagtagtctctggcac

SEQ ID NO: 328994 - DNA, 25 bp, Homo sapien
gccagccagctcatttcactttaca

SEQ ID NO: 328995 - DNA, 25 bp, Homo sapien
cacgctgctcgttcctgaggtatgg

SEQ ID NO: 328996 - DNA, 25 bp, Homo sapien
cctgaggtatgggaactggccttta

SEQ ID NO: 328997 - DNA, 25 bp, Homo sapien
atgggaactggcctttagtgaagct

SEQ ID NO: 328998 - DNA, 25 bp, Homo sapien
atagccactggtaaagggaggaaat

SEQ ID NO: 328999 - DNA, 25 bp, Homo sapien
gaatttccagatacttattaccaag

SEQ ID NO: 329000 - DNA, 25 bp, Homo sapien
aggtaaggtcagaagctggagttca

SEQ ID NO: 329001 - DNA, 25 bp, Homo sapien
gtgtctacagcttctctgactctta

SEQ ID NO: 329002 - DNA, 25 bp, Homo sapien
gcttctctgactcttataggtttac

SEQ ID NO: 329003 - DNA, 25 bp, Homo sapien
gatgaaagttaccactgaaccttac

SEQ ID NO: 329004 - DNA, 25 bp, Homo sapien
ttaccactgaaccttaccactatgt

SEQ ID NO: 329005 - DNA, 25 bp, Homo sapien
gaaccttaccactatgtatatatgt

SEQ ID NO: 329006 - DNA, 25 bp, Homo sapien
agtcgtggcagaacggagcatcagc

SEQ ID NO: 329007 - DNA, 25 bp, Homo sapien
agaacggagcatcagccagaccctg

SEQ ID NO: 329008 - DNA, 25 bp, Homo sapien
agcatcagccagaccctgttgtggg

SEQ ID NO: 329009 - DNA, 25 bp, Homo sapien
agaccctgttgtgggcgttgtcatc

SEQ ID NO: 329010 - DNA, 25 bp, Homo sapien
cctgttgtgggcgttgtcatcaagg

SEQ ID NO: 329011 - DNA, 25 bp, Homo sapien
ggcgttgtcatcaagggagcttgaa

SEQ ID NO: 329012 - DNA, 25 bp, Homo sapien
gtctggtgtcagatacagccgactc

SEQ ID NO: 329013 - DNA, 25 bp, Homo sapien
ggtgtcagatacagccgactccagc

SEQ ID NO: 329014 - DNA, 25 bp, Homo sapien
gctcatcccccatgatgctgtgtga

SEQ ID NO: 329015 - DNA, 25 bp, Homo sapien
cactctggtgagggagctttccaga

SEQ ID NO: 329016 - DNA, 25 bp, Homo sapien
ctgcctagtgttggagggtagacca

SEQ ID NO: 329017 - DNA, 25 bp, Homo sapien
aaatgctgcattttgagtggacttg

SEQ ID NO: 329018 - DNA, 25 bp, Homo sapien
gagtggacttgattttctcagtgaa

SEQ ID NO: 329019 - DNA, 25 bp, Homo sapien
agttcaagttctggacttcagccgc

SEQ ID NO: 329020 - DNA, 25 bp, Homo sapien
ttcagccgctattgcaagatgccca

SEQ ID NO: 329021 - DNA, 25 bp, Homo sapien
gatgcccaaggattgggtgctgcta

SEQ ID NO: 329022 - DNA, 25 bp, Homo sapien
agtccttgaggaaagtggctattac

SEQ ID NO: 329023 - DNA, 25 bp, Homo sapien
gggtcctgtgctggagtatatgaca

SEQ ID NO: 329024 - DNA, 25 bp, Homo sapien
acagctgcggtacttgagggcttca

SEQ ID NO: 329025 - DNA, 25 bp, Homo sapien
aagtggctattacaattttacatct

SEQ ID NO: 329026 - DNA, 25 bp, Homo sapien
ctaacaggtatcattcctatccatg

SEQ ID NO: 329027 - DNA, 25 bp, Homo sapien
ggaccaagaatcacccaaccaaaag

SEQ ID NO: 329028 - DNA, 25 bp, Homo sapien
cccctgtttggttttgatatccaga

SEQ ID NO: 329029 - DNA, 25 bp, Homo sapien
ttggttttgatatccagacaagggt

SEQ ID NO: 329030 - DNA, 25 bp, Homo sapien
tttgatatccagacaagggtagctt

SEQ ID NO: 329031 - DNA, 25 bp, Homo sapien
gatatccagacaagggtagctttct

SEQ ID NO: 329032 - DNA, 25 bp, Homo sapien
tccagacaagggtagctttctggtt

SEQ ID NO: 329033 - DNA, 25 bp, Homo sapien
agctttctggttgtttatgacagta

SEQ ID NO: 329034 - DNA, 25 bp, Homo sapien
ggttgtttatgacagtagcagtgtt

SEQ ID NO: 329035 - DNA, 25 bp, Homo sapien
cagtagcagtgttgacaaacaacta

SEQ ID NO: 329036 - DNA, 25 bp, Homo sapien
agagagctctattggctaaggaaaa

SEQ ID NO: 329037 - DNA, 25 bp, Homo sapien
gctctattggctaaggaaaaatgta

SEQ ID NO: 329038 - DNA, 25 bp, Homo sapien
gacaagatcgcactatattgcccag

SEQ ID NO: 329039 - DNA, 25 bp, Homo sapien
accctgtcctggctcagtgtgcaca

SEQ ID NO: 329040 - DNA, 25 bp, Homo sapien
ctgtcctggctcagtgtgcacacag

SEQ ID NO: 329041 - DNA, 25 bp, Homo sapien
gtcctggctcagtgtgcacacagct

SEQ ID NO: 329042 - DNA, 25 bp, Homo sapien
gggcttgagcgcaacagcgtcctaa

SEQ ID NO: 329043 - DNA, 25 bp, Homo sapien
gcttgagcgcaacagcgtcctaacc

SEQ ID NO: 329044 - DNA, 25 bp, Homo sapien
aaattatatggctgattacatcacc

SEQ ID NO: 329045 - DNA, 25 bp, Homo sapien
atatggctgattacatcacctaagg

SEQ ID NO: 329046 - DNA, 25 bp, Homo sapien
atggctgattacatcacctaagggt

SEQ ID NO: 329047 - DNA, 25 bp, Homo sapien
ggctgattacatcacctaagggtat

SEQ ID NO: 329048 - DNA, 25 bp, Homo sapien
gattacatcacctaagggtatgaga

SEQ ID NO: 329049 - DNA, 25 bp, Homo sapien
cctaagggtatgagaaagtttcata

SEQ ID NO: 329050 - DNA, 25 bp, Homo sapien
tttgttttgtactctcttaattttg

SEQ ID NO: 329051 - DNA, 25 bp, Homo sapien
ttttgtactctcttaattttgtgcc

SEQ ID NO: 329052 - DNA, 25 bp, Homo sapien
gtgccatgtggctacattagttgat

SEQ ID NO: 329053 - DNA, 25 bp, Homo sapien
gtggctacattagttgatgtttatc

SEQ ID NO: 329054 - DNA, 25 bp, Homo sapien
gatgtttatcgagttcattggtcaa

SEQ ID NO: 329055 - DNA, 25 bp, Homo sapien
gtttatcgagttcattggtcaatat

SEQ ID NO: 329056 - DNA, 25 bp, Homo sapien
gtcaatatttgacccattcttattt

SEQ ID NO: 329057 - DNA, 25 bp, Homo sapien
ttgacccattcttatttcaatttct

SEQ ID NO: 329058 - DNA, 25 bp, Homo sapien
ttatcaacagctgtttaaagtcttt

SEQ ID NO: 329059 - DNA, 25 bp, Homo sapien
actgttatgtagttcggatagctta

SEQ ID NO: 329060 - DNA, 25 bp, Homo sapien
tgtagttcggatagcttagttttaa

SEQ ID NO: 329061 - DNA, 25 bp, Homo sapien
gtaaggtctggtttccagtacaaag

SEQ ID NO: 329062 - DNA, 25 bp, Homo sapien
aaggcaaaggcaaatgaggattatt

SEQ ID NO: 329063 - DNA, 25 bp, Homo sapien
gattattagtattccattttgccct

SEQ ID NO: 329064 - DNA, 25 bp, Homo sapien
attttgccctatggatattctcagt

SEQ ID NO: 329065 - DNA, 25 bp, Homo sapien
cctatggatattctcagtgctttct

SEQ ID NO: 329066 - DNA, 25 bp, Homo sapien
agtgctttctactggaaactcacaa

SEQ ID NO: 329067 - DNA, 25 bp, Homo sapien
tggaaactcacaaccaattctgaat

SEQ ID NO: 329068 - DNA, 25 bp, Homo sapien
aattctgaatatgccacatactgtg

SEQ ID NO: 329069 - DNA, 25 bp, Homo sapien
acatactgtgtgatttgcccttgct

SEQ ID NO: 329070 - DNA, 25 bp, Homo sapien
gtgtgatttgcccttgctgtccaac

SEQ ID NO: 329071 - DNA, 25 bp, Homo sapien
tgttcttgctgccatttaaaaacaa

SEQ ID NO: 329072 - DNA, 25 bp, Homo sapien
tgacacaaaaattcacatggaaatg

SEQ ID NO: 329073 - DNA, 25 bp, Homo sapien
ggtctgttttgacagaaactgacag

SEQ ID NO: 329074 - DNA, 25 bp, Homo sapien
gaaactgacaggaatcaatcaaaac

SEQ ID NO: 329075 - DNA, 25 bp, Homo sapien
ggaatcaatcaaaacaatcgaattt

SEQ ID NO: 329076 - DNA, 25 bp, Homo sapien
cgaattttgaattgagtaaagtgca

SEQ ID NO: 329077 - DNA, 25 bp, Homo sapien
aaagtgcaatttcattggatagcta

SEQ ID NO: 329078 - DNA, 25 bp, Homo sapien
gtgcaatttcattggatagctaaat

SEQ ID NO: 329079 - DNA, 25 bp, Homo sapien
cattggatagctaaatatctttgta

SEQ ID NO: 329080 - DNA, 25 bp, Homo sapien
tgtttttctagtcctttcaccccag

SEQ ID NO: 329081 - DNA, 25 bp, Homo sapien
tttcaccccaggactctaaattatt

SEQ ID NO: 329082 - DNA, 25 bp, Homo sapien
tcaccccaggactctaaattattgg

SEQ ID NO: 329083 - DNA, 25 bp, Homo sapien
gaagggctcctcttagagaagcagt

SEQ ID NO: 329084 - DNA, 25 bp, Homo sapien
gaagcagtcaaactgtgaagcacta

SEQ ID NO: 329085 - DNA, 25 bp, Homo sapien
tgtgaagcactaagctgaccctgct

SEQ ID NO: 329086 - DNA, 25 bp, Homo sapien
taagctgaccctgcttcaagcaatt

SEQ ID NO: 329087 - DNA, 25 bp, Homo sapien
gaccctgcttcaagcaattttgttt

SEQ ID NO: 329088 - DNA, 25 bp, Homo sapien
tgtttttacaactgttcctttcaca

SEQ ID NO: 329089 - DNA, 25 bp, Homo sapien
actgttcctttcacaagcaagcctt

SEQ ID NO: 329090 - DNA, 25 bp, Homo sapien
accccatttttcttagcagactgca

SEQ ID NO: 329091 - DNA, 25 bp, Homo sapien
cttagcagactgcagtcaatccaca

SEQ ID NO: 329092 - DNA, 25 bp, Homo sapien
ataatgcccatttttatatgcacgt

SEQ ID NO: 329093 - DNA, 25 bp, Homo sapien
tatgcacgtttttaaacttccaagt

SEQ ID NO: 329094 - DNA, 25 bp, Homo sapien
gggttttgaagccaggctcaccttc

SEQ ID NO: 329095 - DNA, 25 bp, Homo sapien
ttgaagccaggctcaccttccgcag

SEQ ID NO: 329096 - DNA, 25 bp, Homo sapien
aaaacaatagcccatctacccagtg

SEQ ID NO: 329097 - DNA, 25 bp, Homo sapien
atagcccatctacccagtgagtcat

SEQ ID NO: 329098 - DNA, 25 bp, Homo sapien
acccagtgagtcatggtgatctagt

SEQ ID NO: 329099 - DNA, 25 bp, Homo sapien
ggtgaggaccgtggaatcccttggg

SEQ ID NO: 329100 - DNA, 25 bp, Homo sapien
agatgggaaggttttgaaggtcaca

SEQ ID NO: 329101 - DNA, 25 bp, Homo sapien
ttgaaggtcacaggtcatggccagt

SEQ ID NO: 329102 - DNA, 25 bp, Homo sapien
caggtcatggccagtgatgggcttt

SEQ ID NO: 329103 - DNA, 25 bp, Homo sapien
ttttagccccaagaagacttatttg

SEQ ID NO: 329104 - DNA, 25 bp, Homo sapien
tgggcaccagagtggagagaaaccc

SEQ ID NO: 329105 - DNA, 25 bp, Homo sapien
gaaaggcacaatcactgtttcagat

SEQ ID NO: 329106 - DNA, 25 bp, Homo sapien
ggcacaatcactgtttcagatttaa

SEQ ID NO: 329107 - DNA, 25 bp, Homo sapien
attattagtgtgtttgtttggtcca

SEQ ID NO: 329108 - DNA, 25 bp, Homo sapien
ttagtgtgtttgtttggtccagaaa

SEQ ID NO: 329109 - DNA, 25 bp, Homo sapien
gtttgtttggtccagaaactgagac

SEQ ID NO: 329110 - DNA, 25 bp, Homo sapien
cagaaactgagacaatcacatgaca

SEQ ID NO: 329111 - DNA, 25 bp, Homo sapien
gacaatcacatgacagtcaccacga

SEQ ID NO: 329112 - DNA, 25 bp, Homo sapien
atacatgtatgaattgttcatcgag

SEQ ID NO: 329113 - DNA, 25 bp, Homo sapien
atgaattgttcatcgagtttttata

SEQ ID NO: 329114 - DNA, 25 bp, Homo sapien
tgctgctaagcaaagactagggaca

SEQ ID NO: 329115 - DNA, 25 bp, Homo sapien
agactagggacaggcaaagataatt

SEQ ID NO: 329116 - DNA, 25 bp, Homo sapien
tttaatagtgtaagggatctgtcca

SEQ ID NO: 329117 - DNA, 25 bp, Homo sapien
gtgtaagggatctgtccagtaaaca

SEQ ID NO: 329118 - DNA, 25 bp, Homo sapien
ggatctgtccagtaaacagacccaa

SEQ ID NO: 329119 - DNA, 25 bp, Homo sapien
tcctttaatatgctcaagaaatttc

SEQ ID NO: 329120 - DNA, 25 bp, Homo sapien
ggagatcatatataccaagggtgtg

SEQ ID NO: 329121 - DNA, 25 bp, Homo sapien
accaagggtgtgattattggcctgt

SEQ ID NO: 329122 - DNA, 25 bp, Homo sapien
agggtgtgattattggcctgtaatt

SEQ ID NO: 329123 - DNA, 25 bp, Homo sapien
atattctaggatcccatttgtcata

SEQ ID NO: 329124 - DNA, 25 bp, Homo sapien
ttctaggatcccatttgtcatacca

SEQ ID NO: 329125 - DNA, 25 bp, Homo sapien
ccacattacacttagttgtcataag

SEQ ID NO: 329126 - DNA, 25 bp, Homo sapien
attacacttagttgtcataagacaa

SEQ ID NO: 329127 - DNA, 25 bp, Homo sapien
tcagactacagccaggcctcatttc

SEQ ID NO: 329128 - DNA, 25 bp, Homo sapien
ttcatcgtttttgttggttttggct

SEQ ID NO: 329129 - DNA, 25 bp, Homo sapien
aacttccttttgaactgtgcagata

SEQ ID NO: 329130 - DNA, 25 bp, Homo sapien
tgaactgtgcagataaggaactaag

SEQ ID NO: 329131 - DNA, 25 bp, Homo sapien
aatatgctagcatttactctataat

SEQ ID NO: 329132 - DNA, 25 bp, Homo sapien
gttggttttggctttaagcaccaga

SEQ ID NO: 329133 - DNA, 25 bp, Homo sapien
ttgtctctgtgtttgaagaatgcca

SEQ ID NO: 329134 - DNA, 25 bp, Homo sapien
ttggctttaagcaccagaactataa

SEQ ID NO: 329135 - DNA, 25 bp, Homo sapien
aagcaccagaactataatccacata

SEQ ID NO: 329136 - DNA, 25 bp, Homo sapien
gaagtcagaatttggcacatgtcag

SEQ ID NO: 329137 - DNA, 25 bp, Homo sapien
cagaatttggcacatgtcagataac

SEQ ID NO: 329138 - DNA, 25 bp, Homo sapien
aagcacttgagcatcttcctgagag

SEQ ID NO: 329139 - DNA, 25 bp, Homo sapien
cttcctgagagctttcttgggcaat

SEQ ID NO: 329140 - DNA, 25 bp, Homo sapien
atgggaaccaggcttggcccaatca

SEQ ID NO: 329141 - DNA, 25 bp, Homo sapien
gaaggcattgtccaaggagcagtct

SEQ ID NO: 329142 - DNA, 25 bp, Homo sapien
accccgcaagtgagacaactctgaa

SEQ ID NO: 329143 - DNA, 25 bp, Homo sapien
gtgttctacactctcttccaaaggt

SEQ ID NO: 329144 - DNA, 25 bp, Homo sapien
aaggtccccagttggatggagctct

SEQ ID NO: 329145 - DNA, 25 bp, Homo sapien
gatggagctctagctgctcatgtga

SEQ ID NO: 329146 - DNA, 25 bp, Homo sapien
gctgctcatgtgataagctgcctat

SEQ ID NO: 329147 - DNA, 25 bp, Homo sapien
acacaaaagattgcctttcctcctt

SEQ ID NO: 329148 - DNA, 25 bp, Homo sapien
ctgctctcctactaatgtttcctgg

SEQ ID NO: 329149 - DNA, 25 bp, Homo sapien
ttttcttgtactttagcctggctga

SEQ ID NO: 329150 - DNA, 25 bp, Homo sapien
gtactttagcctggctgaacatgaa

SEQ ID NO: 329151 - DNA, 25 bp, Homo sapien
acatgaactttgtgtttacctggaa

SEQ ID NO: 329152 - DNA, 25 bp, Homo sapien
gggagagattctcatctttagttct

SEQ ID NO: 329153 - DNA, 25 bp, Homo sapien
tcatctttagttctggtgcccaaaa

SEQ ID NO: 329154 - DNA, 25 bp, Homo sapien
gttctggtgcccaaaatctttggta

SEQ ID NO: 329155 - DNA, 25 bp, Homo sapien
gatgtggtaaaggtctatttctgta

SEQ ID NO: 329156 - DNA, 25 bp, Homo sapien
aaaggtctatttctgtagtgtggca

SEQ ID NO: 329157 - DNA, 25 bp, Homo sapien
agtgtggcagagatgtgtttttcta

SEQ ID NO: 329158 - DNA, 25 bp, Homo sapien
agatgtgtttttctaaagtgtttgc

SEQ ID NO: 329159 - DNA, 25 bp, Homo sapien
tttttccctcttacctcagattaag

SEQ ID NO: 329160 - DNA, 25 bp, Homo sapien
ttcacaagcggtttcaacgcagctg

SEQ ID NO: 329161 - DNA, 25 bp, Homo sapien
aacgcagctgctttggactacgagg

SEQ ID NO: 329162 - DNA, 25 bp, Homo sapien
atgggagcaccaacaacgggatctt

SEQ ID NO: 329163 - DNA, 25 bp, Homo sapien
tcaacagccggaggtggtgcagcaa

SEQ ID NO: 329164 - DNA, 25 bp, Homo sapien
gccggatgtactgctcagatttgtt

SEQ ID NO: 329165 - DNA, 25 bp, Homo sapien
ggccaagctctacggtcgttgtgaa

SEQ ID NO: 329166 - DNA, 25 bp, Homo sapien
aatctcaaggataccgttatctgtg

SEQ ID NO: 329167 - DNA, 25 bp, Homo sapien
ctacggtcgttgtgaactggccaga

SEQ ID NO: 329168 - DNA, 25 bp, Homo sapien
gaactggccagagtgctacatgact

SEQ ID NO: 329169 - DNA, 25 bp, Homo sapien
gtgctacatgacttcgggctggacg

SEQ ID NO: 329170 - DNA, 25 bp, Homo sapien
atacagcctggctgactgggtctgc

SEQ ID NO: 329171 - DNA, 25 bp, Homo sapien
gcagagtgtggtggccacgccacac

SEQ ID NO: 329172 - DNA, 25 bp, Homo sapien
cgcatcatcgagctgctcaccgagg

SEQ ID NO: 329173 - DNA, 25 bp, Homo sapien
accgaggcctatggcgaggtgcata

SEQ ID NO: 329174 - DNA, 25 bp, Homo sapien
aggcctatggcgaggtgcatatcaa

SEQ ID NO: 329175 - DNA, 25 bp, Homo sapien
atggcgaggtgcatatcaagacgat

SEQ ID NO: 329176 - DNA, 25 bp, Homo sapien
atatcaagacgatgccagctgccac

SEQ ID NO: 329177 - DNA, 25 bp, Homo sapien
agacgatgccagctgccacatatcg

SEQ ID NO: 329178 - DNA, 25 bp, Homo sapien
acatatcgcctccttacaggccagg

SEQ ID NO: 329179 - DNA, 25 bp, Homo sapien
ggccaggaccccagcggttcttggt

SEQ ID NO: 329180 - DNA, 25 bp, Homo sapien
ccagcggttcttggtcctgtatgat

SEQ ID NO: 329181 - DNA, 25 bp, Homo sapien
ttcttggtcctgtatgatttcctaa

SEQ ID NO: 329182 - DNA, 25 bp, Homo sapien
ggctagacagccttacgtggtgttc

SEQ ID NO: 329183 - DNA, 25 bp, Homo sapien
tacgtggtgttcacagtgtctgttg

SEQ ID NO: 329184 - DNA, 25 bp, Homo sapien
gtctgttgtagttagtcacctctgc

SEQ ID NO: 329185 - DNA, 25 bp, Homo sapien
tagtcacctctgctgtggtattgta

SEQ ID NO: 329186 - DNA, 25 bp, Homo sapien
ctgtggtattgtaagagcagctata

SEQ ID NO: 329187 - DNA, 25 bp, Homo sapien
gctatagacaatactgtacgtgaac

SEQ ID NO: 329188 - DNA, 25 bp, Homo sapien
catgggtcatgagttattagctttc

SEQ ID NO: 329189 - DNA, 25 bp, Homo sapien
catgagttattagctttctttttgt

SEQ ID NO: 329190 - DNA, 25 bp, Homo sapien
gaaaccattattagctactgggctg

SEQ ID NO: 329191 - DNA, 25 bp, Homo sapien
tactgggctgtacaaaaacgggcaa

SEQ ID NO: 329192 - DNA, 25 bp, Homo sapien
aaacgggcaaaggagaccaggcatg

SEQ ID NO: 329193 - DNA, 25 bp, Homo sapien
ttttgaatgaactctgagtcagttg

SEQ ID NO: 329194 - DNA, 25 bp, Homo sapien
gagtcagttgaaatagggtaccatc

SEQ ID NO: 329195 - DNA, 25 bp, Homo sapien
tagggtaccatctaggtcagtttaa

SEQ ID NO: 329196 - DNA, 25 bp, Homo sapien
gtcagtttaagaagagtcagctcag

SEQ ID NO: 329197 - DNA, 25 bp, Homo sapien
gaagagtcagctcagagaaagcaag

SEQ ID NO: 329198 - DNA, 25 bp, Homo sapien
tgtcacgtaaactagatcagggaac

SEQ ID NO: 329199 - DNA, 25 bp, Homo sapien
gggaacaaaatcctctccttgtgga

SEQ ID NO: 329200 - DNA, 25 bp, Homo sapien
atcctctccttgtggaaatatccca

SEQ ID NO: 329201 - DNA, 25 bp, Homo sapien
ggaaatatcccatgcagtttgttga

SEQ ID NO: 329202 - DNA, 25 bp, Homo sapien
acaacttagtatcttattgcctaaa

SEQ ID NO: 329203 - DNA, 25 bp, Homo sapien
gaaaatttttgttgtccaggcaaat

SEQ ID NO: 329204 - DNA, 25 bp, Homo sapien
cagggtgtgcaagtcatcctggacc

SEQ ID NO: 329205 - DNA, 25 bp, Homo sapien
tggacccagtgcacagcgttcggct

SEQ ID NO: 329206 - DNA, 25 bp, Homo sapien
acagcgttcggctctttgactggtg

SEQ ID NO: 329207 - DNA, 25 bp, Homo sapien
tctttgactggtggcatcctcagta

SEQ ID NO: 329208 - DNA, 25 bp, Homo sapien
agtacccattctccctgagagcgta

SEQ ID NO: 329209 - DNA, 25 bp, Homo sapien
tgagagcgtagttactgcttcccat

SEQ ID NO: 329210 - DNA, 25 bp, Homo sapien
gcagcctcgagtgtagtccattagt

SEQ ID NO: 329211 - DNA, 25 bp, Homo sapien
aatcagattccagtttggacagggt

SEQ ID NO: 329212 - DNA, 25 bp, Homo sapien
acagggtggctggattgtatatctc

SEQ ID NO: 329213 - DNA, 25 bp, Homo sapien
gtaatgtacatgctcttcaggttct

SEQ ID NO: 329214 - DNA, 25 bp, Homo sapien
gctcttcaggttctagggctcctgt

SEQ ID NO: 329215 - DNA, 25 bp, Homo sapien
gagcatgaagtgtggaatgtgtcac

SEQ ID NO: 329216 - DNA, 25 bp, Homo sapien
gaatgtgtcactacgattgttgata

SEQ ID NO: 329217 - DNA, 25 bp, Homo sapien
gtgtcactacgattgttgataaagc

SEQ ID NO: 329218 - DNA, 25 bp, Homo sapien
gttgataaagctgaggccacttgca

SEQ ID NO: 329219 - DNA, 25 bp, Homo sapien
ttgaataatatagtatgcactgcta

SEQ ID NO: 329220 - DNA, 25 bp, Homo sapien
atgcactgctatttgcttgattatg

SEQ ID NO: 329221 - DNA, 25 bp, Homo sapien
cactgctatttgcttgattatgtaa

SEQ ID NO: 329222 - DNA, 25 bp, Homo sapien
aaacatactggattacattgaggat

SEQ ID NO: 329223 - DNA, 25 bp, Homo sapien
cattgaggatgttgaatagcattca

SEQ ID NO: 329224 - DNA, 25 bp, Homo sapien
aatagcattcatgatggctttgttt

SEQ ID NO: 329225 - DNA, 25 bp, Homo sapien
gggcagctgtcaccagctaaagcaa

SEQ ID NO: 329226 - DNA, 25 bp, Homo sapien
taacagctaaccttatcccacgttg

SEQ ID NO: 329227 - DNA, 25 bp, Homo sapien
ccttatcccacgttgagggtggtat

SEQ ID NO: 329228 - DNA, 25 bp, Homo sapien
actgttcacacagagtgagcctggg

SEQ ID NO: 329229 - DNA, 25 bp, Homo sapien
gagtgagcctgggtcagtcaaaaac

SEQ ID NO: 329230 - DNA, 25 bp, Homo sapien
gaatttgggcatttgagtgataaca

SEQ ID NO: 329231 - DNA, 25 bp, Homo sapien
gagtgataacagacaacctaaggac

SEQ ID NO: 329232 - DNA, 25 bp, Homo sapien
acctaaggacaatgagcactttgca

SEQ ID NO: 329233 - DNA, 25 bp, Homo sapien
cactttgcagatctctacaattaaa

SEQ ID NO: 329234 - DNA, 25 bp, Homo sapien
gtccctgccaggttgcctgaactaa

SEQ ID NO: 329235 - DNA, 25 bp, Homo sapien
tgtcttggtgcattgttccccgctt

SEQ ID NO: 329236 - DNA, 25 bp, Homo sapien
cattgttccccgcttaggagtacct

SEQ ID NO: 329237 - DNA, 25 bp, Homo sapien
gtgtttccatggtagcgtgagcatt

SEQ ID NO: 329238 - DNA, 25 bp, Homo sapien
acgtggctagcggaggactaccctt

SEQ ID NO: 329239 - DNA, 25 bp, Homo sapien
gaggactacccttgctcactgactt

SEQ ID NO: 329240 - DNA, 25 bp, Homo sapien
gacttcctgttgtaacacactttcc

SEQ ID NO: 329241 - DNA, 25 bp, Homo sapien
taacacactttccttacggagcctg

SEQ ID NO: 329242 - DNA, 25 bp, Homo sapien
acggagcctggctgtttcacagtat

SEQ ID NO: 329243 - DNA, 25 bp, Homo sapien
ttcatgaatttacccacacaggtgt

SEQ ID NO: 329244 - DNA, 25 bp, Homo sapien
aggtgtgatcctccttgagcattga

SEQ ID NO: 329245 - DNA, 25 bp, Homo sapien
tcttttgtagtagctgagatctgca

SEQ ID NO: 329246 - DNA, 25 bp, Homo sapien
gagatctgcaatatataacgggaca

SEQ ID NO: 329247 - DNA, 25 bp, Homo sapien
aacgggacagtcaaagggcaatgtt

SEQ ID NO: 329248 - DNA, 25 bp, Homo sapien
ttatctgaaatgttattgctcctga

SEQ ID NO: 329249 - DNA, 25 bp, Homo sapien
tctgaaatgttattgctcctgactt

SEQ ID NO: 329250 - DNA, 25 bp, Homo sapien
gaaatgttattgctcctgacttaga

SEQ ID NO: 329251 - DNA, 25 bp, Homo sapien
gaaaatattcgtatttgtttatggt

SEQ ID NO: 329252 - DNA, 25 bp, Homo sapien
tacatgtgttgatatcttgccagca

SEQ ID NO: 329253 - DNA, 25 bp, Homo sapien
catgtgttgatatcttgccagcaaa

SEQ ID NO: 329254 - DNA, 25 bp, Homo sapien
tgtgttgatatcttgccagcaaacc

SEQ ID NO: 329255 - DNA, 25 bp, Homo sapien
tgttgatatcttgccagcaaaccag

SEQ ID NO: 329256 - DNA, 25 bp, Homo sapien
gatatcttgccagcaaaccagtaat

SEQ ID NO: 329257 - DNA, 25 bp, Homo sapien
atcttgccagcaaaccagtaatttc

SEQ ID NO: 329258 - DNA, 25 bp, Homo sapien
cttgccagcaaaccagtaatttcaa

SEQ ID NO: 329259 - DNA, 25 bp, Homo sapien
aggcttcaggaagcagctcctagat

SEQ ID NO: 329260 - DNA, 25 bp, Homo sapien
gggtgaagcaggcaacccgtgtgtg

SEQ ID NO: 329261 - DNA, 25 bp, Homo sapien
ggagcctctctctccttggattagg

SEQ ID NO: 329262 - DNA, 25 bp, Homo sapien
cctcctcaggattacagggctcttc

SEQ ID NO: 329263 - DNA, 25 bp, Homo sapien
cagttttctcaacatgctactatac

SEQ ID NO: 329264 - DNA, 25 bp, Homo sapien
gctactatacatgagacccttcctg

SEQ ID NO: 329265 - DNA, 25 bp, Homo sapien
ggtcatgaatgtttttctccctgtc

SEQ ID NO: 329266 - DNA, 25 bp, Homo sapien
atgaatgtttttctccctgtccgga

SEQ ID NO: 329267 - DNA, 25 bp, Homo sapien
ttttctccctgtccggatgtgatta

SEQ ID NO: 329268 - DNA, 25 bp, Homo sapien
tccctgtccggatgtgattagattg

SEQ ID NO: 329269 - DNA, 25 bp, Homo sapien
atgtgattagattgtcctgagaaac

SEQ ID NO: 329270 - DNA, 25 bp, Homo sapien
agaccttccctgattggtgtctcag

SEQ ID NO: 329271 - DNA, 25 bp, Homo sapien
atgtctacagtggacgccctgttgg

SEQ ID NO: 329272 - DNA, 25 bp, Homo sapien
ttggtgtctcagcatttattttcct

SEQ ID NO: 329273 - DNA, 25 bp, Homo sapien
agcatttattttcctgtctcttcca

SEQ ID NO: 329274 - DNA, 25 bp, Homo sapien
gccagctgtagctttatctcgtaaa

SEQ ID NO: 329275 - DNA, 25 bp, Homo sapien
atctcgtaaaagttacccatcttct

SEQ ID NO: 329276 - DNA, 25 bp, Homo sapien
agtggacgccctgttggtttggctt

SEQ ID NO: 329277 - DNA, 25 bp, Homo sapien
ttcaccccagattcaagttttcctc

SEQ ID NO: 329278 - DNA, 25 bp, Homo sapien
agttttcctccttgtaggcatttca

SEQ ID NO: 329279 - DNA, 25 bp, Homo sapien
gggatttttatttggccagcagtct

SEQ ID NO: 329280 - DNA, 25 bp, Homo sapien
tttttatttggccagcagtctcacc

SEQ ID NO: 329281 - DNA, 25 bp, Homo sapien
tgagataaacattcctttttaagga

SEQ ID NO: 329282 - DNA, 25 bp, Homo sapien
acacaccgttaagccagaggttctg

SEQ ID NO: 329283 - DNA, 25 bp, Homo sapien
aagccagaggttctgacttcgctaa

SEQ ID NO: 329284 - DNA, 25 bp, Homo sapien
gaggttctgacttcgctaaaggaaa

SEQ ID NO: 329285 - DNA, 25 bp, Homo sapien
ggaacacatgatccaacagactatg

SEQ ID NO: 329286 - DNA, 25 bp, Homo sapien
gaaatctctcccttcatttactttt

SEQ ID NO: 329287 - DNA, 25 bp, Homo sapien
gcctatatttaggtttcttttctat

SEQ ID NO: 329288 - DNA, 25 bp, Homo sapien
ttttctcccatttggatcctttgag

SEQ ID NO: 329289 - DNA, 25 bp, Homo sapien
ctcccatttggatcctttgaggtaa

SEQ ID NO: 329290 - DNA, 25 bp, Homo sapien
aaaacataatgtcttcagcctcata

SEQ ID NO: 329291 - DNA, 25 bp, Homo sapien
atgtcttcagcctcataataaagga

SEQ ID NO: 329292 - DNA, 25 bp, Homo sapien
tggaataaatcctgcttggtcatgg

SEQ ID NO: 329293 - DNA, 25 bp, Homo sapien
aatcctgcttggtcatggtatataa

SEQ ID NO: 329294 - DNA, 25 bp, Homo sapien
tgcttggtcatggtatataattctt

SEQ ID NO: 329295 - DNA, 25 bp, Homo sapien
tatattccgaagagatcttggcctc

SEQ ID NO: 329296 - DNA, 25 bp, Homo sapien
cgaagagatcttggcctctactttt

SEQ ID NO: 329297 - DNA, 25 bp, Homo sapien
gcctctacttttcttatgaaatatg

SEQ ID NO: 329298 - DNA, 25 bp, Homo sapien
atgtgtctgactttggtatcagggt

SEQ ID NO: 329299 - DNA, 25 bp, Homo sapien
ggtaatgcttacctcatagaatatt

SEQ ID NO: 329300 - DNA, 25 bp, Homo sapien
ggattcacattaattcttctttagt

SEQ ID NO: 329301 - DNA, 25 bp, Homo sapien
aattcttctttagttgtttgataga

SEQ ID NO: 329302 - DNA, 25 bp, Homo sapien
gttgtttgatagaatcaccagtgaa

SEQ ID NO: 329303 - DNA, 25 bp, Homo sapien
catgggatctggctggctcaaaagg

SEQ ID NO: 329304 - DNA, 25 bp, Homo sapien
agagtgaggccattggaattttccc

SEQ ID NO: 329305 - DNA, 25 bp, Homo sapien
ttggaattttcccaggagtgagtct

SEQ ID NO: 329306 - DNA, 25 bp, Homo sapien
gaattttcccaggagtgagtctgaa

SEQ ID NO: 329307 - DNA, 25 bp, Homo sapien
ttcccaggagtgagtctgaagcttg

SEQ ID NO: 329308 - DNA, 25 bp, Homo sapien
caggagtgagtctgaagcttggaat

SEQ ID NO: 329309 - DNA, 25 bp, Homo sapien
cctgaagctaggaggcgatgcagac

SEQ ID NO: 329310 - DNA, 25 bp, Homo sapien
gctgagacattatttggggccattt

SEQ ID NO: 329311 - DNA, 25 bp, Homo sapien
gggccatttgcaaagagggatactc

SEQ ID NO: 329312 - DNA, 25 bp, Homo sapien
gagggatactcaggcagtgacccca

SEQ ID NO: 329313 - DNA, 25 bp, Homo sapien
ggatactcaggcagtgaccccaagg

SEQ ID NO: 329314 - DNA, 25 bp, Homo sapien
gaagccggggtaggaggatcaccag

SEQ ID NO: 329315 - DNA, 25 bp, Homo sapien
aagccggggtaggaggatcaccaga

SEQ ID NO: 329316 - DNA, 25 bp, Homo sapien
agccggggtaggaggatcaccagag

SEQ ID NO: 329317 - DNA, 25 bp, Homo sapien
ggggtaggaggatcaccagaggcca

SEQ ID NO: 329318 - DNA, 25 bp, Homo sapien
ccagaggccagcaggtccacaccag

SEQ ID NO: 329319 - DNA, 25 bp, Homo sapien
cagaggccagcaggtccacaccagc

SEQ ID NO: 329320 - DNA, 25 bp, Homo sapien
gcaacacagcaagacaccgcatcta

SEQ ID NO: 329321 - DNA, 25 bp, Homo sapien
caacacagcaagacaccgcatctac

SEQ ID NO: 329322 - DNA, 25 bp, Homo sapien
cctctcttcatactatggttttcgt

SEQ ID NO: 329323 - DNA, 25 bp, Homo sapien
atggttttcgtaaaggatctgttgt

SEQ ID NO: 329324 - DNA, 25 bp, Homo sapien
gagacactgagggaaacaagggttt

SEQ ID NO: 329325 - DNA, 25 bp, Homo sapien
gtgtccttggctgccttttacggga

SEQ ID NO: 329326 - DNA, 25 bp, Homo sapien
tgccttttacgggatgggagccttc

SEQ ID NO: 329327 - DNA, 25 bp, Homo sapien
ggatgggagccttctccggatcttt

SEQ ID NO: 329328 - DNA, 25 bp, Homo sapien
tttgttcttctgcacctcttgtagc

SEQ ID NO: 329329 - DNA, 25 bp, Homo sapien
cctcttgtagctactgccggtgcaa

SEQ ID NO: 329330 - DNA, 25 bp, Homo sapien
tagctactgccggtgcaaggttgta

SEQ ID NO: 329331 - DNA, 25 bp, Homo sapien
gccggtgcaaggttgtagatgttat

SEQ ID NO: 329332 - DNA, 25 bp, Homo sapien
aaagcatgcaaccagaaggcgggca

SEQ ID NO: 329333 - DNA, 25 bp, Homo sapien
aagtatttaaggaattctcagatgc

SEQ ID NO: 329334 - DNA, 25 bp, Homo sapien
attctcagatgccttatggacctct

SEQ ID NO: 329335 - DNA, 25 bp, Homo sapien
tcagatgccttatggacctcttcaa

SEQ ID NO: 329336 - DNA, 25 bp, Homo sapien
agatgccttatggacctcttcaaga

SEQ ID NO: 329337 - DNA, 25 bp, Homo sapien
ggacctcttcaagaatgtggttagc

SEQ ID NO: 329338 - DNA, 25 bp, Homo sapien
ctcttcaagaatgtggttagccaat

SEQ ID NO: 329339 - DNA, 25 bp, Homo sapien
gtggttagccaattgattcaacttt

SEQ ID NO: 329340 - DNA, 25 bp, Homo sapien
acttttataggtttatatgctctca

SEQ ID NO: 329341 - DNA, 25 bp, Homo sapien
tataggtttatatgctctcatgtaa

SEQ ID NO: 329342 - DNA, 25 bp, Homo sapien
atgctctcatgtaaacctatttgtt

SEQ ID NO: 329343 - DNA, 25 bp, Homo sapien
aacctatttgtttccgagatcagac

SEQ ID NO: 329344 - DNA, 25 bp, Homo sapien
tgccatcacctgcattcagtcacag

SEQ ID NO: 329345 - DNA, 25 bp, Homo sapien
atcacctgcattcagtcacagtgga

SEQ ID NO: 329346 - DNA, 25 bp, Homo sapien
acctgcattcagtcacagtggagag

SEQ ID NO: 329347 - DNA, 25 bp, Homo sapien
gtcacagtggagaggatacaagcag

SEQ ID NO: 329348 - DNA, 25 bp, Homo sapien
aggctcgctgccgtggatacttagt

SEQ ID NO: 329349 - DNA, 25 bp, Homo sapien
gctgccgtggatacttagttcgaca

SEQ ID NO: 329350 - DNA, 25 bp, Homo sapien
gatacttagttcgacaggaattccg

SEQ ID NO: 329351 - DNA, 25 bp, Homo sapien
gttcgacaggaattccgatccagga

SEQ ID NO: 329352 - DNA, 25 bp, Homo sapien
acaggaattccgatccaggatgaat

SEQ ID NO: 329353 - DNA, 25 bp, Homo sapien
tttcctgaagaaacaaatccctgcc

SEQ ID NO: 329354 - DNA, 25 bp, Homo sapien
gaagaaacaaatccctgccatcacc

SEQ ID NO: 329355 - DNA, 25 bp, Homo sapien
taacagtatcagaaccactggctcc

SEQ ID NO: 329356 - DNA, 25 bp, Homo sapien
actggctccaaaccaagaagaggtt

SEQ ID NO: 329357 - DNA, 25 bp, Homo sapien
aagaggttcgaagtatcaagagtga

SEQ ID NO: 329358 - DNA, 25 bp, Homo sapien
cacaattgaggtggatagtgttgct

SEQ ID NO: 329359 - DNA, 25 bp, Homo sapien
gagctccaagacctccagtctgaag

SEQ ID NO: 329360 - DNA, 25 bp, Homo sapien
ccagtctgaagggaatagctcgcca

SEQ ID NO: 329361 - DNA, 25 bp, Homo sapien
gaatagctcgccagcaggttttgat

SEQ ID NO: 329362 - DNA, 25 bp, Homo sapien
aggttttgatgccagtgtgagctca

SEQ ID NO: 329363 - DNA, 25 bp, Homo sapien
tgccagtgtgagctcaagcagtagt

SEQ ID NO: 329364 - DNA, 25 bp, Homo sapien
aagcagtagtaatcagccagaacca

SEQ ID NO: 329365 - DNA, 25 bp, Homo sapien
agccagaaccagaacatcctgaaaa

SEQ ID NO: 329366 - DNA, 25 bp, Homo sapien
aacactcggagtttgcagagtgcta

SEQ ID NO: 329367 - DNA, 25 bp, Homo sapien
agtgctaggagtgtctttgtcgttc

SEQ ID NO: 329368 - DNA, 25 bp, Homo sapien
gtctttgtcgttcctagtgatccac

SEQ ID NO: 329369 - DNA, 25 bp, Homo sapien
accacacctgagtttgttctactgt

SEQ ID NO: 329370 - DNA, 25 bp, Homo sapien
gtttgttctactgtgaggtgatttt

SEQ ID NO: 329371 - DNA, 25 bp, Homo sapien
gggcccctagatagcctcatagttg

SEQ ID NO: 329372 - DNA, 25 bp, Homo sapien
agcctcatagttggtttagtcagaa

SEQ ID NO: 329373 - DNA, 25 bp, Homo sapien
aaggccaatcacttgatttgagggt

SEQ ID NO: 329374 - DNA, 25 bp, Homo sapien
ggttaaaacttgtcagcccacttgc

SEQ ID NO: 329375 - DNA, 25 bp, Homo sapien
gtctttgtcccagttcttggcacag

SEQ ID NO: 329376 - DNA, 25 bp, Homo sapien
acagagctctccaaaaacactcgga

SEQ ID NO: 329377 - DNA, 25 bp, Homo sapien
ctttcactgccaggcggatgttcaa

SEQ ID NO: 329378 - DNA, 25 bp, Homo sapien
agaagatgcgactcctttcgacgtc

SEQ ID NO: 329379 - DNA, 25 bp, Homo sapien
tttcgacgtccttcggacccttgat

SEQ ID NO: 329380 - DNA, 25 bp, Homo sapien
ttctccattttcagtgctgtctcaa

SEQ ID NO: 329381 - DNA, 25 bp, Homo sapien
gacccttgatgtgcctgactttgga

SEQ ID NO: 329382 - DNA, 25 bp, Homo sapien
gacagccgcggtaaagtgcagcgtc

SEQ ID NO: 329383 - DNA, 25 bp, Homo sapien
gtaaagtgcagcgtcctgcccggag

SEQ ID NO: 329384 - DNA, 25 bp, Homo sapien
gctgtctcaatcgttgacttgggca

SEQ ID NO: 329385 - DNA, 25 bp, Homo sapien
tgggcatatgtttgctgcgacacac

SEQ ID NO: 329386 - DNA, 25 bp, Homo sapien
gctgcgacacacctctaagatattg

SEQ ID NO: 329387 - DNA, 25 bp, Homo sapien
ccaggttgctgttgtgctcagggtt

SEQ ID NO: 329388 - DNA, 25 bp, Homo sapien
ccctggggctgaagagctggctgtg

SEQ ID NO: 329389 - DNA, 25 bp, Homo sapien
ggccttggccctgctactcacccaa

SEQ ID NO: 329390 - DNA, 25 bp, Homo sapien
gctactcacccaacattcccatcct

SEQ ID NO: 329391 - DNA, 25 bp, Homo sapien
atgcagctacccctacaacctgggg

SEQ ID NO: 329392 - DNA, 25 bp, Homo sapien
tacaacctggggttccttctcaggg

SEQ ID NO: 329393 - DNA, 25 bp, Homo sapien
tcagggcctcacctggtccccacat

SEQ ID NO: 329394 - DNA, 25 bp, Homo sapien
caaagtccatgtctgcctccatcag

SEQ ID NO: 329395 - DNA, 25 bp, Homo sapien
aaagtccatgtctgcctccatcagc

SEQ ID NO: 329396 - DNA, 25 bp, Homo sapien
gccacacacacgcagggacgcccgt

SEQ ID NO: 329397 - DNA, 25 bp, Homo sapien
acacacgcagggacgcccgttcctt

SEQ ID NO: 329398 - DNA, 25 bp, Homo sapien
gcagggacgcccgttccttgccctc

SEQ ID NO: 329399 - DNA, 25 bp, Homo sapien
tgtcttggtcgggtgggcgcacgca

SEQ ID NO: 329400 - DNA, 25 bp, Homo sapien
tcgtgcaccgtcagctcatggaagg

SEQ ID NO: 329401 - DNA, 25 bp, Homo sapien
ttctggtgcctctccaggagggagc

SEQ ID NO: 329402 - DNA, 25 bp, Homo sapien
gaaactggcgcaggcagaagccaca

SEQ ID NO: 329403 - DNA, 25 bp, Homo sapien
ggcgcaggcagaagccacactctga

SEQ ID NO: 329404 - DNA, 25 bp, Homo sapien
acactctgaaggcagctcgctcacg

SEQ ID NO: 329405 - DNA, 25 bp, Homo sapien
gaaggcagctcgctcacggctttct

SEQ ID NO: 329406 - DNA, 25 bp, Homo sapien
tttctccacggccaggttccggcag

SEQ ID NO: 329407 - DNA, 25 bp, Homo sapien
aggttccggcagcagaggctcttac

SEQ ID NO: 329408 - DNA, 25 bp, Homo sapien
agaggctcttactgatctcacaacg

SEQ ID NO: 329409 - DNA, 25 bp, Homo sapien
tactgatctcacaacgacaattggg

SEQ ID NO: 329410 - DNA, 25 bp, Homo sapien
taccaaagccaaaaactagtgttct

SEQ ID NO: 329411 - DNA, 25 bp, Homo sapien
aactagtgttctcaacgtttgtgaa

SEQ ID NO: 329412 - DNA, 25 bp, Homo sapien
ttctcaacgtttgtgaaatgcccaa

SEQ ID NO: 329413 - DNA, 25 bp, Homo sapien
gtaacatgacaaatctattcagctt

SEQ ID NO: 329414 - DNA, 25 bp, Homo sapien
aatctattcagcttaaagttctagt

SEQ ID NO: 329415 - DNA, 25 bp, Homo sapien
tctagtaaaatttgtgaatcccatc

SEQ ID NO: 329416 - DNA, 25 bp, Homo sapien
gaatcccatcatagaagtactcctg

SEQ ID NO: 329417 - DNA, 25 bp, Homo sapien
catagaagtactcctgacagcagca

SEQ ID NO: 329418 - DNA, 25 bp, Homo sapien
agtactcctgacagcagcagaaata

SEQ ID NO: 329419 - DNA, 25 bp, Homo sapien
gctgtaattcatcaaaatttcctta

SEQ ID NO: 329420 - DNA, 25 bp, Homo sapien
gatatttgcaatcattaccaaagcc

SEQ ID NO: 329421 - DNA, 25 bp, Homo sapien
tgatcttcatacaagcaatctttgc

SEQ ID NO: 329422 - DNA, 25 bp, Homo sapien
agcaatctttgctcacatacatcaa

SEQ ID NO: 329423 - DNA, 25 bp, Homo sapien
gaaacaagacaagctgccgtcagct

SEQ ID NO: 329424 - DNA, 25 bp, Homo sapien
gccgtcagctagatacgtttcgatt

SEQ ID NO: 329425 - DNA, 25 bp, Homo sapien
ggaactttgattggcatcctgcttg

SEQ ID NO: 329426 - DNA, 25 bp, Homo sapien
gattggcatcctgcttgtctacctt

SEQ ID NO: 329427 - DNA, 25 bp, Homo sapien
agtggtagctctgatcattgttgtc

SEQ ID NO: 329428 - DNA, 25 bp, Homo sapien
agtgttttctgacccctcagatctg

SEQ ID NO: 329429 - DNA, 25 bp, Homo sapien
tctggtctttgcctatcatgtctga

SEQ ID NO: 329430 - DNA, 25 bp, Homo sapien
gtctgatgtaggcacttggttcgat

SEQ ID NO: 329431 - DNA, 25 bp, Homo sapien
ggttcgattaccttgatttgcaggt

SEQ ID NO: 329432 - DNA, 25 bp, Homo sapien
gacgcctctagttatgtatggctat

SEQ ID NO: 329433 - DNA, 25 bp, Homo sapien
tagccacattctgcatgttcaacca

SEQ ID NO: 329434 - DNA, 25 bp, Homo sapien
gttcaaccatcacatttgtctagtg

SEQ ID NO: 329435 - DNA, 25 bp, Homo sapien
cacatttgtctagtggctaccacgt

SEQ ID NO: 329436 - DNA, 25 bp, Homo sapien
ggctaccacgtagaacagtgcagat

SEQ ID NO: 329437 - DNA, 25 bp, Homo sapien
atgtagaacacttccatcaccacat

SEQ ID NO: 329438 - DNA, 25 bp, Homo sapien
cttccatcaccacataaagtcctat

SEQ ID NO: 329439 - DNA, 25 bp, Homo sapien
agtcctattggactgcaccactatt

SEQ ID NO: 329440 - DNA, 25 bp, Homo sapien
gcaccactatttaaagatctgagct

SEQ ID NO: 329441 - DNA, 25 bp, Homo sapien
ataattttccaaatgtctcagggat

SEQ ID NO: 329442 - DNA, 25 bp, Homo sapien
gacttgcactattatgacgcctcta

SEQ ID NO: 329443 - DNA, 25 bp, Homo sapien
gcttcaaatccatagccggtggtgt

SEQ ID NO: 329444 - DNA, 25 bp, Homo sapien
gatcatattcattcaaaggcctaca

SEQ ID NO: 329445 - DNA, 25 bp, Homo sapien
acagtacaaatgagcacgctgccat

SEQ ID NO: 329446 - DNA, 25 bp, Homo sapien
gcacgctgccatgtactggtttgag

SEQ ID NO: 329447 - DNA, 25 bp, Homo sapien
ggacttacactgcatgattccctcg

SEQ ID NO: 329448 - DNA, 25 bp, Homo sapien
tgattccctcgctgtatatcctcaa

SEQ ID NO: 329449 - DNA, 25 bp, Homo sapien
aaccctcccataatgcaaggccttg

SEQ ID NO: 329450 - DNA, 25 bp, Homo sapien
gcaaggccttgttcattgatgtgct

SEQ ID NO: 329451 - DNA, 25 bp, Homo sapien
cattgatgtgctttcgtcggctgtc

SEQ ID NO: 329452 - DNA, 25 bp, Homo sapien
ttcgtcggctgtcggaaagttctga

SEQ ID NO: 329453 - DNA, 25 bp, Homo sapien
gaccaccttgtcttgctacttggaa

SEQ ID NO: 329454 - DNA, 25 bp, Homo sapien
ggtgtttaatagctgctgctcttta

SEQ ID NO: 329455 - DNA, 25 bp, Homo sapien
ggtcaaaaactgctttttcacgtca

SEQ ID NO: 329456 - DNA, 25 bp, Homo sapien
aaaaactgctttttcacgtcaaatg

SEQ ID NO: 329457 - DNA, 25 bp, Homo sapien
aagcactgtccacttcttatggact

SEQ ID NO: 329458 - DNA, 25 bp, Homo sapien
cacttcttatggacttcttggccat

SEQ ID NO: 329459 - DNA, 25 bp, Homo sapien
tatggacttcttggccatttcctct

SEQ ID NO: 329460 - DNA, 25 bp, Homo sapien
ctttctcttcccctaaatgggaatg

SEQ ID NO: 329461 - DNA, 25 bp, Homo sapien
gggaatggactgtaggtagacctca

SEQ ID NO: 329462 - DNA, 25 bp, Homo sapien
gactgtaggtagacctcatgagtat

SEQ ID NO: 329463 - DNA, 25 bp, Homo sapien
catgagtataagtctcagatgtcca

SEQ ID NO: 329464 - DNA, 25 bp, Homo sapien
atttattactttccagcagctaata

SEQ ID NO: 329465 - DNA, 25 bp, Homo sapien
atctagagcctggaagtcttggtca

SEQ ID NO: 329466 - DNA, 25 bp, Homo sapien
agtcttggtcaaggattctccctaa

SEQ ID NO: 329467 - DNA, 25 bp, Homo sapien
caaggattctccctaacatctcagt

SEQ ID NO: 329468 - DNA, 25 bp, Homo sapien
catctcatgtgtgtgtcaagcagat

SEQ ID NO: 329469 - DNA, 25 bp, Homo sapien
gtgtcaagcagatatgcatcctcta

SEQ ID NO: 329470 - DNA, 25 bp, Homo sapien
atatgcatcctctatttaccactag

SEQ ID NO: 329471 - DNA, 25 bp, Homo sapien
gagagcaagtgggaatgcagcacta

SEQ ID NO: 329472 - DNA, 25 bp, Homo sapien
aagtccctgaacatagcactttgtt

SEQ ID NO: 329473 - DNA, 25 bp, Homo sapien
tgaacatagcactttgttcctggca

SEQ ID NO: 329474 - DNA, 25 bp, Homo sapien
tccttaattagagctagacacacct

SEQ ID NO: 329475 - DNA, 25 bp, Homo sapien
agacacacctagtatctagagcctg

SEQ ID NO: 329476 - DNA, 25 bp, Homo sapien
tattcgggtaaaaaagtgatgcttt

SEQ ID NO: 329477 - DNA, 25 bp, Homo sapien
gatgcttttcaaattgatctaggat

SEQ ID NO: 329478 - DNA, 25 bp, Homo sapien
aagacctgacaattatcagagttat

SEQ ID NO: 329479 - DNA, 25 bp, Homo sapien
gagtcgtaatagatttcaagtgttc

SEQ ID NO: 329480 - DNA, 25 bp, Homo sapien
gatttcaagtgttctaggtgcataa

SEQ ID NO: 329481 - DNA, 25 bp, Homo sapien
caagtgttctaggtgcataatggtg

SEQ ID NO: 329482 - DNA, 25 bp, Homo sapien
cataatggtgaatgacctcaggcag

SEQ ID NO: 329483 - DNA, 25 bp, Homo sapien
ctcaggcagttcactacagttctgt

SEQ ID NO: 329484 - DNA, 25 bp, Homo sapien
aggcagttcactacagttctgttga

SEQ ID NO: 329485 - DNA, 25 bp, Homo sapien
gttctgttgagttatgttctccctt

SEQ ID NO: 329486 - DNA, 25 bp, Homo sapien
gttgagttatgttctccctttgtgt

SEQ ID NO: 329487 - DNA, 25 bp, Homo sapien
caggacccatcacgcctgtgcagtg

SEQ ID NO: 329488 - DNA, 25 bp, Homo sapien
tgcagtggcccccacagaaagactg

SEQ ID NO: 329489 - DNA, 25 bp, Homo sapien
aagactgagctcaaggtgggaacca

SEQ ID NO: 329490 - DNA, 25 bp, Homo sapien
aggtgggaaccacgtctgctaactt

SEQ ID NO: 329491 - DNA, 25 bp, Homo sapien
gggaaccacgtctgctaacttggag

SEQ ID NO: 329492 - DNA, 25 bp, Homo sapien
gaaccacgtctgctaacttggagcc

SEQ ID NO: 329493 - DNA, 25 bp, Homo sapien
gtctgctaacttggagccccagtgc

SEQ ID NO: 329494 - DNA, 25 bp, Homo sapien
aacttggagccccagtgccaagcac

SEQ ID NO: 329495 - DNA, 25 bp, Homo sapien
acagtgcctgcatgtatttatccaa

SEQ ID NO: 329496 - DNA, 25 bp, Homo sapien
gtgcctgcatgtatttatccaataa

SEQ ID NO: 329497 - DNA, 25 bp, Homo sapien
atccaataaatgtgaaattctgtcc

SEQ ID NO: 329498 - DNA, 25 bp, Homo sapien
tgaccgtacgcatgaccgttcagaa

SEQ ID NO: 329499 - DNA, 25 bp, Homo sapien
gtctggtttttcaacttcagattga

SEQ ID NO: 329500 - DNA, 25 bp, Homo sapien
atggaattgcagtctccatggccgt

SEQ ID NO: 329501 - DNA, 25 bp, Homo sapien
ccatggccgtgcttggagtatgagt

SEQ ID NO: 329502 - DNA, 25 bp, Homo sapien
gagtatgagtcccattctgcagtga

SEQ ID NO: 329503 - DNA, 25 bp, Homo sapien
gaacctatgctttccttttggcaaa

SEQ ID NO: 329504 - DNA, 25 bp, Homo sapien
ttttggcaaaattctacgacagcat

SEQ ID NO: 329505 - DNA, 25 bp, Homo sapien
gcatagagaccaaagctttcataga

SEQ ID NO: 329506 - DNA, 25 bp, Homo sapien
aaaaacttacactttctgcataaca

SEQ ID NO: 329507 - DNA, 25 bp, Homo sapien
agctgcttgtttgaacgtggcaact

SEQ ID NO: 329508 - DNA, 25 bp, Homo sapien
gtggcaactgattacttgaccgtac

SEQ ID NO: 329509 - DNA, 25 bp, Homo sapien
aaggaaaacctcatctacacctgag

SEQ ID NO: 329510 - DNA, 25 bp, Homo sapien
gaaaacctcatctacacctgagtag

SEQ ID NO: 329511 - DNA, 25 bp, Homo sapien
cctgagtagcaaaggatcaaaggtg

SEQ ID NO: 329512 - DNA, 25 bp, Homo sapien
aaggatcaaaggtgactgttgctac

SEQ ID NO: 329513 - DNA, 25 bp, Homo sapien
gatcaaaggtgactgttgctacaac

SEQ ID NO: 329514 - DNA, 25 bp, Homo sapien
aaaggtgactgttgctacaaccctc

SEQ ID NO: 329515 - DNA, 25 bp, Homo sapien
aggtgactgttgctacaaccctctc

SEQ ID NO: 329516 - DNA, 25 bp, Homo sapien
actgttgctacaaccctctcctttg

SEQ ID NO: 329517 - DNA, 25 bp, Homo sapien
tctcctttgcaccagttctctgata

SEQ ID NO: 329518 - DNA, 25 bp, Homo sapien
gccaattcgtgctgaattcctaaag

SEQ ID NO: 329519 - DNA, 25 bp, Homo sapien
ccaattcgtgctgaattcctaaaga

SEQ ID NO: 329520 - DNA, 25 bp, Homo sapien
aagaaacaaaagctgctgtccagtc

SEQ ID NO: 329521 - DNA, 25 bp, Homo sapien
acaaaagctgctgtccagtcatgtt

SEQ ID NO: 329522 - DNA, 25 bp, Homo sapien
aagctgctgtccagtcatgtttgga

SEQ ID NO: 329523 - DNA, 25 bp, Homo sapien
cagtcatgtttggacaataacgttt

SEQ ID NO: 329524 - DNA, 25 bp, Homo sapien
ggcttaactgccaaaataaaggctt

SEQ ID NO: 329525 - DNA, 25 bp, Homo sapien
aataaaggctttgcggagaaatgaa

SEQ ID NO: 329526 - DNA, 25 bp, Homo sapien
ataatcaggatttaggtgtgcaata

SEQ ID NO: 329527 - DNA, 25 bp, Homo sapien
aaaacacagctgacaccagaccaat

SEQ ID NO: 329528 - DNA, 25 bp, Homo sapien
tgacaccagaccaatccctaaaatc

SEQ ID NO: 329529 - DNA, 25 bp, Homo sapien
gaccaatccctaaaatccatccgga

SEQ ID NO: 329530 - DNA, 25 bp, Homo sapien
agggggaagtgtgatccttgctttc

SEQ ID NO: 329531 - DNA, 25 bp, Homo sapien
gcccgcttcacttggcgaggagccc

SEQ ID NO: 329532 - DNA, 25 bp, Homo sapien
ctcctgcagttcaccttgatcatga

SEQ ID NO: 329533 - DNA, 25 bp, Homo sapien
gttcaccttgatcatgatggccttc

SEQ ID NO: 329534 - DNA, 25 bp, Homo sapien
gatcatgatggccttctacacggga

SEQ ID NO: 329535 - DNA, 25 bp, Homo sapien
atgatggccttctacacgggactgt

SEQ ID NO: 329536 - DNA, 25 bp, Homo sapien
acacgggactgtctcgcgtatcaga

SEQ ID NO: 329537 - DNA, 25 bp, Homo sapien
tgtctcgcgtatcagaccacaagca

SEQ ID NO: 329538 - DNA, 25 bp, Homo sapien
accacaagcaccatcccagtgatgt

SEQ ID NO: 329539 - DNA, 25 bp, Homo sapien
tcccagtgatgttctggcaggattt

SEQ ID NO: 329540 - DNA, 25 bp, Homo sapien
atgttctggcaggatttgctcaagg

SEQ ID NO: 329541 - DNA, 25 bp, Homo sapien
tggcaggatttgctcaaggagccct

SEQ ID NO: 329542 - DNA, 25 bp, Homo sapien
atcttatttctatctgattcctttt

SEQ ID NO: 329543 - DNA, 25 bp, Homo sapien
ttgctatccatttgaagatgagatt

SEQ ID NO: 329544 - DNA, 25 bp, Homo sapien
tctcagaagggtgaatgcttcatta

SEQ ID NO: 329545 - DNA, 25 bp, Homo sapien
tgaatgcttcattagagggtaggtg

SEQ ID NO: 329546 - DNA, 25 bp, Homo sapien
ttcattagagggtaggtgagcttgc

SEQ ID NO: 329547 - DNA, 25 bp, Homo sapien
ttgaagaagtcatcagtgtctgaac

SEQ ID NO: 329548 - DNA, 25 bp, Homo sapien
gaagtcatcagtgtctgaacttgag

SEQ ID NO: 329549 - DNA, 25 bp, Homo sapien
catcagtgtctgaacttgagctatt

SEQ ID NO: 329550 - DNA, 25 bp, Homo sapien
gtgtctgaacttgagctatttagtc

SEQ ID NO: 329551 - DNA, 25 bp, Homo sapien
gtctgaacttgagctatttagtctc

SEQ ID NO: 329552 - DNA, 25 bp, Homo sapien
tgaacttgagctatttagtctcaaa

SEQ ID NO: 329553 - DNA, 25 bp, Homo sapien
gaggatgactaaaaggtcccttggg

SEQ ID NO: 329554 - DNA, 25 bp, Homo sapien
tcccttgggtgggtgctaatgagca

SEQ ID NO: 329555 - DNA, 25 bp, Homo sapien
gagagccctcttgcatgagtttcgg

SEQ ID NO: 329556 - DNA, 25 bp, Homo sapien
ccagggacttgaggacagctattga

SEQ ID NO: 329557 - DNA, 25 bp, Homo sapien
gacagctattgagttatggttacgt

SEQ ID NO: 329558 - DNA, 25 bp, Homo sapien
atggttacgtgactgccacattggg

SEQ ID NO: 329559 - DNA, 25 bp, Homo sapien
ttgggaatgggctggcaccacacta

SEQ ID NO: 329560 - DNA, 25 bp, Homo sapien
gcaccacactaattaggccacgatg

SEQ ID NO: 329561 - DNA, 25 bp, Homo sapien
ggccacgatgatccagtttgactca

SEQ ID NO: 329562 - DNA, 25 bp, Homo sapien
gatccagtttgactcagggaaaccc

SEQ ID NO: 329563 - DNA, 25 bp, Homo sapien
gaagtcatagtgctctttgcagaat

SEQ ID NO: 329564 - DNA, 25 bp, Homo sapien
atgttcttatccagccaatactggg

SEQ ID NO: 329565 - DNA, 25 bp, Homo sapien
ttatccagccaatactgggagtgct

SEQ ID NO: 329566 - DNA, 25 bp, Homo sapien
tgggagtgctgtctccacaatttca

SEQ ID NO: 329567 - DNA, 25 bp, Homo sapien
gtgctgtctccacaatttcagggca

SEQ ID NO: 329568 - DNA, 25 bp, Homo sapien
tcagggcatctgaatgtttgatgtg

SEQ ID NO: 329569 - DNA, 25 bp, Homo sapien
caatgtaatctgctgaggacctttt

SEQ ID NO: 329570 - DNA, 25 bp, Homo sapien
aatctgctgaggaccttttgtctaa

SEQ ID NO: 329571 - DNA, 25 bp, Homo sapien
ggaccttttgtctaagattcagtag

SEQ ID NO: 329572 - DNA, 25 bp, Homo sapien
tgttttaaggttctgatatcgaatt

SEQ ID NO: 329573 - DNA, 25 bp, Homo sapien
ttgttgatggtggtgaaacaccgta

SEQ ID NO: 329574 - DNA, 25 bp, Homo sapien
acaccgtagggcatgtggttcaaag

SEQ ID NO: 329575 - DNA, 25 bp, Homo sapien
gtatattagattactcttaaacgaa

SEQ ID NO: 329576 - DNA, 25 bp, Homo sapien
gaaaaaccacgtgccgcttttatgt

SEQ ID NO: 329577 - DNA, 25 bp, Homo sapien
cacgtgccgcttttatgtacacata

SEQ ID NO: 329578 - DNA, 25 bp, Homo sapien
gtacacatattacatacgagtaggc

SEQ ID NO: 329579 - DNA, 25 bp, Homo sapien
catacgagtaggcagcagactttaa

SEQ ID NO: 329580 - DNA, 25 bp, Homo sapien
aaacctaggcatgttgatgttgcaa

SEQ ID NO: 329581 - DNA, 25 bp, Homo sapien
gatgttgcaaaatgctgtataaagc

SEQ ID NO: 329582 - DNA, 25 bp, Homo sapien
gtataaagctgaaacctgttcattc

SEQ ID NO: 329583 - DNA, 25 bp, Homo sapien
gaaacctgttcattcagtgccattg

SEQ ID NO: 329584 - DNA, 25 bp, Homo sapien
ttcagtgccattgtagttgacatga

SEQ ID NO: 329585 - DNA, 25 bp, Homo sapien
agcgattgtaaaactgtctccgatt

SEQ ID NO: 329586 - DNA, 25 bp, Homo sapien
gagaagctgcttttattggaaaact

SEQ ID NO: 329587 - DNA, 25 bp, Homo sapien
tttttatgtcatgtctttggttaac

SEQ ID NO: 329588 - DNA, 25 bp, Homo sapien
tgtctttggttaacacaggaggccc

SEQ ID NO: 329589 - DNA, 25 bp, Homo sapien
ctaacattggctgtgacctgacttg

SEQ ID NO: 329590 - DNA, 25 bp, Homo sapien
acattggctgtgacctgacttggct

SEQ ID NO: 329591 - DNA, 25 bp, Homo sapien
gctgtgacctgacttggcttgttca

SEQ ID NO: 329592 - DNA, 25 bp, Homo sapien
gacctgacttggcttgttcatttca

SEQ ID NO: 329593 - DNA, 25 bp, Homo sapien
gacttggcttgttcatttcagaaat

SEQ ID NO: 329594 - DNA, 25 bp, Homo sapien
tgttcatttcagaaatagccacttt

SEQ ID NO: 329595 - DNA, 25 bp, Homo sapien
agtaccatgacaaataccacatggg

SEQ ID NO: 329596 - DNA, 25 bp, Homo sapien
acaaataccacatgggagaagctgc

SEQ ID NO: 329597 - DNA, 25 bp, Homo sapien
gattattttttctatcacagtgtta

SEQ ID NO: 329598 - DNA, 25 bp, Homo sapien
ctatcacagtgttaacagatggatt

SEQ ID NO: 329599 - DNA, 25 bp, Homo sapien
gtagtattcttatgtcacctggcct

SEQ ID NO: 329600 - DNA, 25 bp, Homo sapien
tattcttatgtcacctggccttttg

SEQ ID NO: 329601 - DNA, 25 bp, Homo sapien
acctggccttttgcgtgagattatt

SEQ ID NO: 329602 - DNA, 25 bp, Homo sapien
ggccttttgcgtgagattatttatt

SEQ ID NO: 329603 - DNA, 25 bp, Homo sapien
atttattatttctagcaaggctttc

SEQ ID NO: 329604 - DNA, 25 bp, Homo sapien
tttctagcaaggctttcttcctttc

SEQ ID NO: 329605 - DNA, 25 bp, Homo sapien
ttcttcctttcttattgcccagaga

SEQ ID NO: 329606 - DNA, 25 bp, Homo sapien
tcctttcttattgcccagagactga

SEQ ID NO: 329607 - DNA, 25 bp, Homo sapien
gagactgactgatacatcttttgtt

SEQ ID NO: 329608 - DNA, 25 bp, Homo sapien
gaacatcttggaattttacactctt

SEQ ID NO: 329609 - DNA, 25 bp, Homo sapien
aacatcttggaattttacactcttg

SEQ ID NO: 329610 - DNA, 25 bp, Homo sapien
aatcatagtcgtagaatcctttttt

SEQ ID NO: 329611 - DNA, 25 bp, Homo sapien
tagtcgtagaatcctttttttgaga

SEQ ID NO: 329612 - DNA, 25 bp, Homo sapien
gtagctggaattccaggctgtactc

SEQ ID NO: 329613 - DNA, 25 bp, Homo sapien
gctggaattccaggctgtactcact

SEQ ID NO: 329614 - DNA, 25 bp, Homo sapien
tggaattccaggctgtactcactgc

SEQ ID NO: 329615 - DNA, 25 bp, Homo sapien
gaattccaggctgtactcactgctt

SEQ ID NO: 329616 - DNA, 25 bp, Homo sapien
cccagtcttgaccattctactaatt

SEQ ID NO: 329617 - DNA, 25 bp, Homo sapien
gtcttgaccattctactaattttaa

SEQ ID NO: 329618 - DNA, 25 bp, Homo sapien
ttgaccattctactaattttaaaga

SEQ ID NO: 329619 - DNA, 25 bp, Homo sapien
accaccctggatgagatctggcttc

SEQ ID NO: 329620 - DNA, 25 bp, Homo sapien
tcctggaccccaaagactcagacaa

SEQ ID NO: 329621 - DNA, 25 bp, Homo sapien
gacaagggcaaatacactctggaaa

SEQ ID NO: 329622 - DNA, 25 bp, Homo sapien
aaggaagtccggcagctctcaacag

SEQ ID NO: 329623 - DNA, 25 bp, Homo sapien
gcagctctcaacagatctctcaggg

SEQ ID NO: 329624 - DNA, 25 bp, Homo sapien
atctctcagggcaagcttttgagga

SEQ ID NO: 329625 - DNA, 25 bp, Homo sapien
tttgaggatgcaatggctgaacacc

SEQ ID NO: 329626 - DNA, 25 bp, Homo sapien
gaaaaccttggccatcatcgagaag

SEQ ID NO: 329627 - DNA, 25 bp, Homo sapien
ggagtacatgaaaaccacctggttc

SEQ ID NO: 329628 - DNA, 25 bp, Homo sapien
ctggttccacaaagacaaacgtctg

SEQ ID NO: 329629 - DNA, 25 bp, Homo sapien
gatcggataaggacgggcaccaccc

SEQ ID NO: 329630 - DNA, 25 bp, Homo sapien
gaaaggacccttcagcaaggctgta

SEQ ID NO: 329631 - DNA, 25 bp, Homo sapien
aaggctgtaccctcaatgcagttga

SEQ ID NO: 329632 - DNA, 25 bp, Homo sapien
aatgcagttgatggcctgtcttcac

SEQ ID NO: 329633 - DNA, 25 bp, Homo sapien
atggcctgtcttcacggatttacag

SEQ ID NO: 329634 - DNA, 25 bp, Homo sapien
gatttacagacttggcctgatgccc

SEQ ID NO: 329635 - DNA, 25 bp, Homo sapien
gatgcccatgtaaattcaagctttg

SEQ ID NO: 329636 - DNA, 25 bp, Homo sapien
aagctttggcttgtggtaacaacca

SEQ ID NO: 329637 - DNA, 25 bp, Homo sapien
acaagcatctgtggtgcggaggcaa

SEQ ID NO: 329638 - DNA, 25 bp, Homo sapien
cttagttaactgtctttctctggag

SEQ ID NO: 329639 - DNA, 25 bp, Homo sapien
ctttctctggagctctgttattttg

SEQ ID NO: 329640 - DNA, 25 bp, Homo sapien
gagtataatatttccacgacactta

SEQ ID NO: 329641 - DNA, 25 bp, Homo sapien
taaagagatgagacactgccccaat

SEQ ID NO: 329642 - DNA, 25 bp, Homo sapien
gagatgagacactgccccaatccta

SEQ ID NO: 329643 - DNA, 25 bp, Homo sapien
tgccccaatcctaaagaggccagaa

SEQ ID NO: 329644 - DNA, 25 bp, Homo sapien
gaggccagaactgaagtgctacatt

SEQ ID NO: 329645 - DNA, 25 bp, Homo sapien
gaactgaagtgctacattgtgggag

SEQ ID NO: 329646 - DNA, 25 bp, Homo sapien
ctgaagtgctacattgtgggagtta

SEQ ID NO: 329647 - DNA, 25 bp, Homo sapien
ttaggggatgcttcttttttccagc

SEQ ID NO: 329648 - DNA, 25 bp, Homo sapien
ttttccagctcttttttctagaatc

SEQ ID NO: 329649 - DNA, 25 bp, Homo sapien
tccagctcttttttctagaatcctc

SEQ ID NO: 329650 - DNA, 25 bp, Homo sapien
ggtaggaaaacaatagaactcataa

SEQ ID NO: 329651 - DNA, 25 bp, Homo sapien
cttacatgagattcaaagtttttca

SEQ ID NO: 329652 - DNA, 25 bp, Homo sapien
gtgattgtcaaattccactttgcat

SEQ ID NO: 329653 - DNA, 25 bp, Homo sapien
ggaagacagcacagaaccctgctct

SEQ ID NO: 329654 - DNA, 25 bp, Homo sapien
accctgctctgcgtcagctggagag

SEQ ID NO: 329655 - DNA, 25 bp, Homo sapien
tgtaataccagaagacgtcccacca

SEQ ID NO: 329656 - DNA, 25 bp, Homo sapien
agacgtcccaccatggttttaagat

SEQ ID NO: 329657 - DNA, 25 bp, Homo sapien
agcattttagctcagttagtgtaat

SEQ ID NO: 329658 - DNA, 25 bp, Homo sapien
cagttagtgtaatcatgactttccc

SEQ ID NO: 329659 - DNA, 25 bp, Homo sapien
gaggatgtgttcatgctggctttca

SEQ ID NO: 329660 - DNA, 25 bp, Homo sapien
atgctggctttcaggatgtcccaag

SEQ ID NO: 329661 - DNA, 25 bp, Homo sapien
aggatgtcccaaggcacggcacagt

SEQ ID NO: 329662 - DNA, 25 bp, Homo sapien
aaggcacggcacagtgattgtcaaa

SEQ ID NO: 329663 - DNA, 25 bp, Homo sapien
gggtgacgtcctggcctcgctgcct

SEQ ID NO: 329664 - DNA, 25 bp, Homo sapien
ccacccaagtcggaatccgagtgaa

SEQ ID NO: 329665 - DNA, 25 bp, Homo sapien
ccacgtctccggctgagcacacgga

SEQ ID NO: 329666 - DNA, 25 bp, Homo sapien
cccaagtcggaatccgagtgaaata

SEQ ID NO: 329667 - DNA, 25 bp, Homo sapien
ctgagggaaggcaccgcacccagga

SEQ ID NO: 329668 - DNA, 25 bp, Homo sapien
gaaggcaccgcacccaggactggga

SEQ ID NO: 329669 - DNA, 25 bp, Homo sapien
gagtgaaataaatagcatcgcccgc

SEQ ID NO: 329670 - DNA, 25 bp, Homo sapien
gtgaaataaatagcatcgcccgcca

SEQ ID NO: 329671 - DNA, 25 bp, Homo sapien
gaaataaatagcatcgcccgccaac

SEQ ID NO: 329672 - DNA, 25 bp, Homo sapien
aataaatagcatcgcccgccaacta

SEQ ID NO: 329673 - DNA, 25 bp, Homo sapien
acccaggggatatcgcagtctccgt

SEQ ID NO: 329674 - DNA, 25 bp, Homo sapien
aggaccacacatcttaaactgctgt

SEQ ID NO: 329675 - DNA, 25 bp, Homo sapien
atcttaaactgctgttcctaccatg

SEQ ID NO: 329676 - DNA, 25 bp, Homo sapien
gttcctaccatgcactaaactgttt

SEQ ID NO: 329677 - DNA, 25 bp, Homo sapien
ttttaaaccacaccctaggctccag

SEQ ID NO: 329678 - DNA, 25 bp, Homo sapien
taggctccaggagtgttcaggaaag

SEQ ID NO: 329679 - DNA, 25 bp, Homo sapien
gatggtgtttgtaggtctccatgct

SEQ ID NO: 329680 - DNA, 25 bp, Homo sapien
aggtctccatgctgtttggcgttgg

SEQ ID NO: 329681 - DNA, 25 bp, Homo sapien
tgtggagggatcatccgtcgacttt

SEQ ID NO: 329682 - DNA, 25 bp, Homo sapien
gatcatccgtcgactttctgaattt

SEQ ID NO: 329683 - DNA, 25 bp, Homo sapien
accatgattgtcttaaatgccttaa

SEQ ID NO: 329684 - DNA, 25 bp, Homo sapien
taacatgtgttaggtttgatcaccc

SEQ ID NO: 329685 - DNA, 25 bp, Homo sapien
gggagttctaaagccttggtgcact

SEQ ID NO: 329686 - DNA, 25 bp, Homo sapien
agccttggtgcacttgaatggataa

SEQ ID NO: 329687 - DNA, 25 bp, Homo sapien
gaatggataaacttcccaggagcag

SEQ ID NO: 329688 - DNA, 25 bp, Homo sapien
ggagcagagttttccaagcatggct

SEQ ID NO: 329689 - DNA, 25 bp, Homo sapien
aagcatggctccctgtggttcacct

SEQ ID NO: 329690 - DNA, 25 bp, Homo sapien
tgtggttcacctctaccaagcttaa

SEQ ID NO: 329691 - DNA, 25 bp, Homo sapien
ttaacctaccttctgcttaggcaga

SEQ ID NO: 329692 - DNA, 25 bp, Homo sapien
ttaggcagagcgaagaggcacctca

SEQ ID NO: 329693 - DNA, 25 bp, Homo sapien
gaggcacctcagcataactcagatc

SEQ ID NO: 329694 - DNA, 25 bp, Homo sapien
ggtttaaaaacgtctctgagcttga

SEQ ID NO: 329695 - DNA, 25 bp, Homo sapien
acgtctctgagcttgatggaaggaa

SEQ ID NO: 329696 - DNA, 25 bp, Homo sapien
gtgcctttcctacatgttacatttt

SEQ ID NO: 329697 - DNA, 25 bp, Homo sapien
gatctgagaaaaccgttatcagcgt

SEQ ID NO: 329698 - DNA, 25 bp, Homo sapien
accgttatcagcgttaacatctcta

SEQ ID NO: 329699 - DNA, 25 bp, Homo sapien
gttaacatctctaattttactctaa

SEQ ID NO: 329700 - DNA, 25 bp, Homo sapien
aatatctcattaggcatcatctccg

SEQ ID NO: 329701 - DNA, 25 bp, Homo sapien
gccaaggttcccactaggcaggaaa

SEQ ID NO: 329702 - DNA, 25 bp, Homo sapien
cactaggcaggaaaggatttttatc

SEQ ID NO: 329703 - DNA, 25 bp, Homo sapien
agcctttcacgctcagcttctttca

SEQ ID NO: 329704 - DNA, 25 bp, Homo sapien
ttctttcatgtcagcccgagccttt

SEQ ID NO: 329705 - DNA, 25 bp, Homo sapien
gtcagcccgagcctttgcagcaaga

SEQ ID NO: 329706 - DNA, 25 bp, Homo sapien
tttgcagcaagacgtgcctttccta

SEQ ID NO: 329707 - DNA, 25 bp, Homo sapien
ttgagcccaggagacagaatttgct

SEQ ID NO: 329708 - DNA, 25 bp, Homo sapien
gagacagaatttgctgtgagccaag

SEQ ID NO: 329709 - DNA, 25 bp, Homo sapien
gcattaatttacttgcatggtgaag

SEQ ID NO: 329710 - DNA, 25 bp, Homo sapien
ttacttgcatggtgaagtccaacat

SEQ ID NO: 329711 - DNA, 25 bp, Homo sapien
ggtgaagtccaacatgtcaaaaatg

SEQ ID NO: 329712 - DNA, 25 bp, Homo sapien
gaaatgatgagctgtattgtcccta

SEQ ID NO: 329713 - DNA, 25 bp, Homo sapien
aatgatgagctgtattgtccctatg

SEQ ID NO: 329714 - DNA, 25 bp, Homo sapien
gatgagctgtattgtccctatgtct

SEQ ID NO: 329715 - DNA, 25 bp, Homo sapien
gtccctatgtctacccagtctacta

SEQ ID NO: 329716 - DNA, 25 bp, Homo sapien
ttagctgagcatagaggtatgcatc

SEQ ID NO: 329717 - DNA, 25 bp, Homo sapien
gcatagaggtatgcatcttagtccc

SEQ ID NO: 329718 - DNA, 25 bp, Homo sapien
ttttaattgcagtcttgattgttct

SEQ ID NO: 329719 - DNA, 25 bp, Homo sapien
caaattagcttttcagcctcctgcc

SEQ ID NO: 329720 - DNA, 25 bp, Homo sapien
gccctctgcctgaaccaagttcagt

SEQ ID NO: 329721 - DNA, 25 bp, Homo sapien
aagttcagtattcaggttcttccct

SEQ ID NO: 329722 - DNA, 25 bp, Homo sapien
ggttcttccctatagccagaagtgg

SEQ ID NO: 329723 - DNA, 25 bp, Homo sapien
agggtccccagagcaaagagctgca

SEQ ID NO: 329724 - DNA, 25 bp, Homo sapien
agagctgcattctgtgcatgtgctt

SEQ ID NO: 329725 - DNA, 25 bp, Homo sapien
gctttctgggatttaccactctcta

SEQ ID NO: 329726 - DNA, 25 bp, Homo sapien
gggatttaccactctctagaatttt

SEQ ID NO: 329727 - DNA, 25 bp, Homo sapien
ctcctgccctatgcagcatgagata

SEQ ID NO: 329728 - DNA, 25 bp, Homo sapien
gaagcccctaatgtatccatttttt

SEQ ID NO: 329729 - DNA, 25 bp, Homo sapien
tcttttgtacttgcagctttgcagg

SEQ ID NO: 329730 - DNA, 25 bp, Homo sapien
tttgtacttgcagctttgcaggtgc

SEQ ID NO: 329731 - DNA, 25 bp, Homo sapien
gctttgcaggtgcaaaatcttcatc

SEQ ID NO: 329732 - DNA, 25 bp, Homo sapien
caaaatcttcatcaagggctaagca

SEQ ID NO: 329733 - DNA, 25 bp, Homo sapien
gtctgtttttagtacatggtaatga

SEQ ID NO: 329734 - DNA, 25 bp, Homo sapien
ttttagtacatggtaatgaactcca

SEQ ID NO: 329735 - DNA, 25 bp, Homo sapien
tagacctcaggccaatctggaagtt

SEQ ID NO: 329736 - DNA, 25 bp, Homo sapien
acctcaggccaatctggaagttgaa

SEQ ID NO: 329737 - DNA, 25 bp, Homo sapien
gttttcaggtaataataaatcacat

SEQ ID NO: 329738 - DNA, 25 bp, Homo sapien
taaaatcttttgtacttgcagcttt

SEQ ID NO: 329739 - DNA, 25 bp, Homo sapien
aatcttttgtacttgcagctttgca

SEQ ID NO: 329740 - DNA, 25 bp, Homo sapien
agaataattcagacttacaaataca

SEQ ID NO: 329741 - DNA, 25 bp, Homo sapien
aaaaaggttgtggttctctctctgt

SEQ ID NO: 329742 - DNA, 25 bp, Homo sapien
aggttgtggttctctctctgtgatc

SEQ ID NO: 329743 - DNA, 25 bp, Homo sapien
gtggttctctctctgtgatccagtg

SEQ ID NO: 329744 - DNA, 25 bp, Homo sapien
gtgatccagtgtgcacataaacctt

SEQ ID NO: 329745 - DNA, 25 bp, Homo sapien
agtgtgcacataaacctttctctga

SEQ ID NO: 329746 - DNA, 25 bp, Homo sapien
gtgcacataaacctttctctgatct

SEQ ID NO: 329747 - DNA, 25 bp, Homo sapien
actgccatcctctggattatgtctt

SEQ ID NO: 329748 - DNA, 25 bp, Homo sapien
atcctctggattatgtcttctgacc

SEQ ID NO: 329749 - DNA, 25 bp, Homo sapien
ttttgacccattaactggaaagttg

SEQ ID NO: 329750 - DNA, 25 bp, Homo sapien
tacattactttggagaataaaaccg

SEQ ID NO: 329751 - DNA, 25 bp, Homo sapien
cgcgccacgttgctgtcgccctcct

SEQ ID NO: 329752 - DNA, 25 bp, Homo sapien
gcgccacgttgctgtcgccctcctc

SEQ ID NO: 329753 - DNA, 25 bp, Homo sapien
cgccacgttgctgtcgccctcctcc

SEQ ID NO: 329754 - DNA, 25 bp, Homo sapien
gccacgttgctgtcgccctcctccg

SEQ ID NO: 329755 - DNA, 25 bp, Homo sapien
ccacgttgctgtcgccctcctccgg

SEQ ID NO: 329756 - DNA, 25 bp, Homo sapien
acgttgctgtcgccctcctccggct

SEQ ID NO: 329757 - DNA, 25 bp, Homo sapien
gttgctgtcgccctcctccggctcc

SEQ ID NO: 329758 - DNA, 25 bp, Homo sapien
ttgctgtcgccctcctccggctccg

SEQ ID NO: 329759 - DNA, 25 bp, Homo sapien
tgctgtcgccctcctccggctccgc

SEQ ID NO: 329760 - DNA, 25 bp, Homo sapien
cctcctccggctccgccgggtgcag

SEQ ID NO: 329761 - DNA, 25 bp, Homo sapien
tcctccggctccgccgggtgcaggt

SEQ ID NO: 329762 - DNA, 25 bp, Homo sapien
catgaaattgttgtgcctggctaat

SEQ ID NO: 329763 - DNA, 25 bp, Homo sapien
tgtgcctggctaattggcaaattaa

SEQ ID NO: 329764 - DNA, 25 bp, Homo sapien
ataataagtgtagcgccttgtttga

SEQ ID NO: 329765 - DNA, 25 bp, Homo sapien
tagcgccttgtttgaataccctttt

SEQ ID NO: 329766 - DNA, 25 bp, Homo sapien
atgggcaagggtgtcagcatctctt

SEQ ID NO: 329767 - DNA, 25 bp, Homo sapien
cagcatctcttcttcttaataatta

SEQ ID NO: 329768 - DNA, 25 bp, Homo sapien
ttgttttcagttttggttcacgaag

SEQ ID NO: 329769 - DNA, 25 bp, Homo sapien
gcttagttaatctgtaatgttgcct

SEQ ID NO: 329770 - DNA, 25 bp, Homo sapien
aatgttgcctagagctgtatttatc

SEQ ID NO: 329771 - DNA, 25 bp, Homo sapien
actagtgtagtaaagctgcatatca

SEQ ID NO: 329772 - DNA, 25 bp, Homo sapien
aaacgactactgtgatgagttaatc

SEQ ID NO: 329773 - DNA, 25 bp, Homo sapien
caccagatattatgggatagaagat

SEQ ID NO: 329774 - DNA, 25 bp, Homo sapien
agatgaaaagcacacactcccaggt

SEQ ID NO: 329775 - DNA, 25 bp, Homo sapien
tgaaaagcacacactcccaggtcca

SEQ ID NO: 329776 - DNA, 25 bp, Homo sapien
aggtccacttgacctgttgcagtgg

SEQ ID NO: 329777 - DNA, 25 bp, Homo sapien
tgttgcagtggaacctccgggcatg

SEQ ID NO: 329778 - DNA, 25 bp, Homo sapien
cagcgtgggtgaatggcgcccacca

SEQ ID NO: 329779 - DNA, 25 bp, Homo sapien
tgaatggcgcccaccagacggagca

SEQ ID NO: 329780 - DNA, 25 bp, Homo sapien
accagacggagcagggcctgctact

SEQ ID NO: 329781 - DNA, 25 bp, Homo sapien
ctgcccttggcaccttgagaggaga

SEQ ID NO: 329782 - DNA, 25 bp, Homo sapien
caccttgagaggagaatttgagtac

SEQ ID NO: 329783 - DNA, 25 bp, Homo sapien
gaatttgcatctgggagtgtccacc

SEQ ID NO: 329784 - DNA, 25 bp, Homo sapien
aggaatcttctaccatcgagctttg

SEQ ID NO: 329785 - DNA, 25 bp, Homo sapien
agctttgcttttcaaggctctggct

SEQ ID NO: 329786 - DNA, 25 bp, Homo sapien
aaggctctggctgatagaattggca

SEQ ID NO: 329787 - DNA, 25 bp, Homo sapien
agaattggcattggttgctccctag

SEQ ID NO: 329788 - DNA, 25 bp, Homo sapien
gttgctccctagttcgcggagagta

SEQ ID NO: 329789 - DNA, 25 bp, Homo sapien
catgctgcagaatgactctcggaag

SEQ ID NO: 329790 - DNA, 25 bp, Homo sapien
cccgctcctgagatgtacgtgattg

SEQ ID NO: 329791 - DNA, 25 bp, Homo sapien
gtacgtgattgacctcatgttccat

SEQ ID NO: 329792 - DNA, 25 bp, Homo sapien
ctcatgttccatccaggtggactga

SEQ ID NO: 329793 - DNA, 25 bp, Homo sapien
acctgatttcagctgggaacttcac

SEQ ID NO: 329794 - DNA, 25 bp, Homo sapien
tgttataccgattggacatgtcaaa

SEQ ID NO: 329795 - DNA, 25 bp, Homo sapien
accctgtcctggctcagtgtgcaca

SEQ ID NO: 329796 - DNA, 25 bp, Homo sapien
gtcctggctcagtgtgcacacagct

SEQ ID NO: 329797 - DNA, 25 bp, Homo sapien
gggcttgagcgcaacagcgtcctaa

SEQ ID NO: 329798 - DNA, 25 bp, Homo sapien
gcttgagcgcaacagcgtcctaacc

SEQ ID NO: 329799 - DNA, 25 bp, Homo sapien
tctccaagggagtttacattcgtaa

SEQ ID NO: 329800 - DNA, 25 bp, Homo sapien
ttgggattccttccctgggaaatca

SEQ ID NO: 329801 - DNA, 25 bp, Homo sapien
aaattatatggctgattacatcacc

SEQ ID NO: 329802 - DNA, 25 bp, Homo sapien
ggctgattacatcacctaagggtat

SEQ ID NO: 329803 - DNA, 25 bp, Homo sapien
gattacatcacctaagggtatgaga

SEQ ID NO: 329804 - DNA, 25 bp, Homo sapien
agaggcaggttctgtcttgctagac

SEQ ID NO: 329805 - DNA, 25 bp, Homo sapien
gctagacggccttttgttgctgttc

SEQ ID NO: 329806 - DNA, 25 bp, Homo sapien
gatgcaccgatggtagccaaggaat

SEQ ID NO: 329807 - DNA, 25 bp, Homo sapien
accgatggtagccaaggaatctgtt

SEQ ID NO: 329808 - DNA, 25 bp, Homo sapien
atattatggtgttcagagattaagc

SEQ ID NO: 329809 - DNA, 25 bp, Homo sapien
gagattaagctgacttggatacaat

SEQ ID NO: 329810 - DNA, 25 bp, Homo sapien
aaatgttgcaccagttatgcttcat

SEQ ID NO: 329811 - DNA, 25 bp, Homo sapien
gcaccagttatgcttcatgcatcgt

SEQ ID NO: 329812 - DNA, 25 bp, Homo sapien
atgcttcatgcatcgttacatcttc

SEQ ID NO: 329813 - DNA, 25 bp, Homo sapien
gcatcgttacatcttcatcaggtta

SEQ ID NO: 329814 - DNA, 25 bp, Homo sapien
tcgttacatcttcatcaggttaatg

SEQ ID NO: 329815 - DNA, 25 bp, Homo sapien
ggttaatgtaatgtctagttccttt

SEQ ID NO: 329816 - DNA, 25 bp, Homo sapien
tgtaatgtctagttcctttgcaata

SEQ ID NO: 329817 - DNA, 25 bp, Homo sapien
atttttcattatcctaaagtgataa

SEQ ID NO: 329818 - DNA, 25 bp, Homo sapien
gtaagctggaaacccacaggtaatg

SEQ ID NO: 329819 - DNA, 25 bp, Homo sapien
gatcaagaagatcagaacaggctta

SEQ ID NO: 329820 - DNA, 25 bp, Homo sapien
aagctggaaacccacaggtaatgtg

SEQ ID NO: 329821 - DNA, 25 bp, Homo sapien
cagaacaggcttaaattgatgctat

SEQ ID NO: 329822 - DNA, 25 bp, Homo sapien
gatgctataaaaccaattactctgt

SEQ ID NO: 329823 - DNA, 25 bp, Homo sapien
ggaaacccacaggtaatgtgcccac

SEQ ID NO: 329824 - DNA, 25 bp, Homo sapien
gaaacccacaggtaatgtgcccacc

SEQ ID NO: 329825 - DNA, 25 bp, Homo sapien
gtagaagatgggttttcgcctatgt

SEQ ID NO: 329826 - DNA, 25 bp, Homo sapien
tagaagatgggttttcgcctatgtt

SEQ ID NO: 329827 - DNA, 25 bp, Homo sapien
gggttttcgcctatgttgccccagg

SEQ ID NO: 329828 - DNA, 25 bp, Homo sapien
gcttttcttatagaaccccttctga

SEQ ID NO: 329829 - DNA, 25 bp, Homo sapien
gaaccccttctgactgagcaatatg

SEQ ID NO: 329830 - DNA, 25 bp, Homo sapien
gactgagcaatatgcctccttgtat

SEQ ID NO: 329831 - DNA, 25 bp, Homo sapien
tgtcgattagtaaaagtgctttcca

SEQ ID NO: 329832 - DNA, 25 bp, Homo sapien
gtgctttccatgttactttattcag

SEQ ID NO: 329833 - DNA, 25 bp, Homo sapien
ttcagagctaataagtgctttcctt

SEQ ID NO: 329834 - DNA, 25 bp, Homo sapien
taagtgctttccttagttttctagt

SEQ ID NO: 329835 - DNA, 25 bp, Homo sapien
aaatcatgtgttgcagctttatagt

SEQ ID NO: 329836 - DNA, 25 bp, Homo sapien
gaaccttcttaacatcactgtcttg

SEQ ID NO: 329837 - DNA, 25 bp, Homo sapien
tgtcttgccagattaccgacactgt

SEQ ID NO: 329838 - DNA, 25 bp, Homo sapien
taccgacactgtcacttgaccaata

SEQ ID NO: 329839 - DNA, 25 bp, Homo sapien
aatagtcaaactttcagcctttcag

SEQ ID NO: 329840 - DNA, 25 bp, Homo sapien
aaactttcagcctttcagatttcgg

SEQ ID NO: 329841 - DNA, 25 bp, Homo sapien
ttcagatttcggatgtgatacatac

SEQ ID NO: 329842 - DNA, 25 bp, Homo sapien
gtgatacatacacataaacgttgtg

SEQ ID NO: 329843 - DNA, 25 bp, Homo sapien
gatagacatgagatactttgctgcc

SEQ ID NO: 329844 - DNA, 25 bp, Homo sapien
gagatactttgctgccatattttta

SEQ ID NO: 329845 - DNA, 25 bp, Homo sapien
catatttttaggttagtggctagat

SEQ ID NO: 329846 - DNA, 25 bp, Homo sapien
gaagaaatactttccctatctcagt

SEQ ID NO: 329847 - DNA, 25 bp, Homo sapien
aatactttccctatctcagtggagc

SEQ ID NO: 329848 - DNA, 25 bp, Homo sapien
ttccctatctcagtggagccagaat

SEQ ID NO: 329849 - DNA, 25 bp, Homo sapien
ataagaaattcattccctgtgtttt

SEQ ID NO: 329850 - DNA, 25 bp, Homo sapien
aagtcctcggccattgaagcttcga

SEQ ID NO: 329851 - DNA, 25 bp, Homo sapien
gaagcttcgaagcattcttgacatg

SEQ ID NO: 329852 - DNA, 25 bp, Homo sapien
gaagcattcttgacatgagcccttt

SEQ ID NO: 329853 - DNA, 25 bp, Homo sapien
acatgagcccttttacagtgacaga

SEQ ID NO: 329854 - DNA, 25 bp, Homo sapien
gactgaggcagtgccttgtaactca

SEQ ID NO: 329855 - DNA, 25 bp, Homo sapien
ttgtaactcacaatgggcgcctcct

SEQ ID NO: 329856 - DNA, 25 bp, Homo sapien
gggcgcctccttggcattataacaa

SEQ ID NO: 329857 - DNA, 25 bp, Homo sapien
aaaagatatcctccggcatatggcc

SEQ ID NO: 329858 - DNA, 25 bp, Homo sapien
atcctccggcatatggcccagacgg

SEQ ID NO: 329859 - DNA, 25 bp, Homo sapien
aatgttcaactgaatctcacagatg

SEQ ID NO: 329860 - DNA, 25 bp, Homo sapien
tgaatagcacaactctttaacctga

SEQ ID NO: 329861 - DNA, 25 bp, Homo sapien
gcttcctttagctgctgtgagaatt

SEQ ID NO: 329862 - DNA, 25 bp, Homo sapien
agctgctgtgagaatttgtcttcct

SEQ ID NO: 329863 - DNA, 25 bp, Homo sapien
gtgctttagagcaacttcccgcaaa

SEQ ID NO: 329864 - DNA, 25 bp, Homo sapien
gcaacttcccgcaaatcagaaactc

SEQ ID NO: 329865 - DNA, 25 bp, Homo sapien
aaactcactgtgattccaaaaatgt

SEQ ID NO: 329866 - DNA, 25 bp, Homo sapien
caaaaatgtttctgagccctggacc

SEQ ID NO: 329867 - DNA, 25 bp, Homo sapien
aaacctcctttaaaggagcatgcat

SEQ ID NO: 329868 - DNA, 25 bp, Homo sapien
ggagcatgcataacagtgtgctgaa

SEQ ID NO: 329869 - DNA, 25 bp, Homo sapien
gtgctgaaagacagttgttggtttt

SEQ ID NO: 329870 - DNA, 25 bp, Homo sapien
gttggttttttgattttagcatatt

SEQ ID NO: 329871 - DNA, 25 bp, Homo sapien
ttagcatattatttcctgtatgaaa

SEQ ID NO: 329872 - DNA, 25 bp, Homo sapien
tcacttcagcacaacactctgtaca

SEQ ID NO: 329873 - DNA, 25 bp, Homo sapien
cagcacaacactctgtacatttcag

SEQ ID NO: 329874 - DNA, 25 bp, Homo sapien
cagtctgatattctactttgccatt

SEQ ID NO: 329875 - DNA, 25 bp, Homo sapien
tcatagagattttcagtgacattgg

SEQ ID NO: 329876 - DNA, 25 bp, Homo sapien
gattttcagtgacattggagtattg

SEQ ID NO: 329877 - DNA, 25 bp, Homo sapien
taggatgattaaaccaatgagaaga

SEQ ID NO: 329878 - DNA, 25 bp, Homo sapien
gaaatgcttcttgccaatttctagt

SEQ ID NO: 329879 - DNA, 25 bp, Homo sapien
gcttcttgccaatttctagttttag

SEQ ID NO: 329880 - DNA, 25 bp, Homo sapien
gtttttggattgctacataagactt

SEQ ID NO: 329881 - DNA, 25 bp, Homo sapien
ggattgctacataagactttctttc

SEQ ID NO: 329882 - DNA, 25 bp, Homo sapien
gctacataagactttctttccattt

SEQ ID NO: 329883 - DNA, 25 bp, Homo sapien
aggaagagagcccactacagccgcc

SEQ ID NO: 329884 - DNA, 25 bp, Homo sapien
ggaagagagcccactacagccgccg

SEQ ID NO: 329885 - DNA, 25 bp, Homo sapien
agagagcccactacagccgccgcag

SEQ ID NO: 329886 - DNA, 25 bp, Homo sapien
ttcttatcgcgctcgccagcatgct

SEQ ID NO: 329887 - DNA, 25 bp, Homo sapien
tatcgcgctcgccagcatgcttctt

SEQ ID NO: 329888 - DNA, 25 bp, Homo sapien
tcgccagcatgcttcttggccatgg

SEQ ID NO: 329889 - DNA, 25 bp, Homo sapien
cagcatgcttcttggccatgggacc

SEQ ID NO: 329890 - DNA, 25 bp, Homo sapien
tagaaaaacaaatccaggtcccagt

SEQ ID NO: 329891 - DNA, 25 bp, Homo sapien
agaaaaacaaatccaggtcccagtg

SEQ ID NO: 329892 - DNA, 25 bp, Homo sapien
gaaaaacaaatccaggtcccagtgc

SEQ ID NO: 329893 - DNA, 25 bp, Homo sapien
aataacttagagacagagttggagg

SEQ ID NO: 329894 - DNA, 25 bp, Homo sapien
cctgggagtggttcatttgccgaca

SEQ ID NO: 329895 - DNA, 25 bp, Homo sapien
ttcatttgccgacagtgcggtggct

SEQ ID NO: 329896 - DNA, 25 bp, Homo sapien
ggtggctcccttggccctggaaatc

SEQ ID NO: 329897 - DNA, 25 bp, Homo sapien
tggaaatcctccaagccgttgggca

SEQ ID NO: 329898 - DNA, 25 bp, Homo sapien
aagccgttgggcactaggcaagaag

SEQ ID NO: 329899 - DNA, 25 bp, Homo sapien
agaaggtgcttagcacaagcccgcc

SEQ ID NO: 329900 - DNA, 25 bp, Homo sapien
cccagccctcggatgcataagcaag

SEQ ID NO: 329901 - DNA, 25 bp, Homo sapien
gcataagcaaggtcagctcccagac

SEQ ID NO: 329902 - DNA, 25 bp, Homo sapien
aaggtcagctcccagacacctttgc

SEQ ID NO: 329903 - DNA, 25 bp, Homo sapien
ctcacagctgtctttggacctaata

SEQ ID NO: 329904 - DNA, 25 bp, Homo sapien
taataaagtcagcttaacccagaaa

SEQ ID NO: 329905 - DNA, 25 bp, Homo sapien
gttattacagtttgtcattcacctg

SEQ ID NO: 329906 - DNA, 25 bp, Homo sapien
ttacagtttgtcattcacctgaaag

SEQ ID NO: 329907 - DNA, 25 bp, Homo sapien
tacgaaaggtttctctgcttgggaa

SEQ ID NO: 329908 - DNA, 25 bp, Homo sapien
gtttctctgcttgggaaaaggtgaa

SEQ ID NO: 329909 - DNA, 25 bp, Homo sapien
atatcaagaacgattacacacatgg

SEQ ID NO: 329910 - DNA, 25 bp, Homo sapien
gattgaagaagtctgatgctcctga

SEQ ID NO: 329911 - DNA, 25 bp, Homo sapien
gaagaagtctgatgctcctgaaaaa

SEQ ID NO: 329912 - DNA, 25 bp, Homo sapien
gtctgatgctcctgaaaaatcttaa

SEQ ID NO: 329913 - DNA, 25 bp, Homo sapien
aaatatctgacttgtattgaagaaa

SEQ ID NO: 329914 - DNA, 25 bp, Homo sapien
gtaatgtacatatgcatattgtcta

SEQ ID NO: 329915 - DNA, 25 bp, Homo sapien
ttgtctatgtactatatacacattg

SEQ ID NO: 329916 - DNA, 25 bp, Homo sapien
ggtgcgctcccagcacgtgttgagc

SEQ ID NO: 329917 - DNA, 25 bp, Homo sapien
cagagtcagtcgtctcaggtaaggc

SEQ ID NO: 329918 - DNA, 25 bp, Homo sapien
tcagtcgtctcaggtaaggcaggga

SEQ ID NO: 329919 - DNA, 25 bp, Homo sapien
gtcgtctcaggtaaggcagggattt

SEQ ID NO: 329920 - DNA, 25 bp, Homo sapien
ctcaggtaaggcagggattttcagt

SEQ ID NO: 329921 - DNA, 25 bp, Homo sapien
ggcagggattttcagtagcaccgca

SEQ ID NO: 329922 - DNA, 25 bp, Homo sapien
agggattttcagtagcaccgcacgg

SEQ ID NO: 329923 - DNA, 25 bp, Homo sapien
gattttcagtagcaccgcacggctc

SEQ ID NO: 329924 - DNA, 25 bp, Homo sapien
tgggagtgtataacccgcctctctg

SEQ ID NO: 329925 - DNA, 25 bp, Homo sapien
cattttctgttctgatgtctgttcc

SEQ ID NO: 329926 - DNA, 25 bp, Homo sapien
ttttctgttctgatgtctgttcccc

SEQ ID NO: 329927 - DNA, 25 bp, Homo sapien
ggagaggttggggtcacggtggaag

SEQ ID NO: 329928 - DNA, 25 bp, Homo sapien
aggaagagagcccactacagccgcc

SEQ ID NO: 329929 - DNA, 25 bp, Homo sapien
ggaagagagcccactacagccgccg

SEQ ID NO: 329930 - DNA, 25 bp, Homo sapien
gaagagagcccactacagccgccgc

SEQ ID NO: 329931 - DNA, 25 bp, Homo sapien
aagagagcccactacagccgccgca

SEQ ID NO: 329932 - DNA, 25 bp, Homo sapien
agagagcccactacagccgccgcag

SEQ ID NO: 329933 - DNA, 25 bp, Homo sapien
gagagcccactacagccgccgcagc

SEQ ID NO: 329934 - DNA, 25 bp, Homo sapien
tagaaaaacaaatccaggtcccagt

SEQ ID NO: 329935 - DNA, 25 bp, Homo sapien
agaaaaacaaatccaggtcccagtg

SEQ ID NO: 329936 - DNA, 25 bp, Homo sapien
gaaaaacaaatccaggtcccagtgc

SEQ ID NO: 329937 - DNA, 25 bp, Homo sapien
aatccaggtcccagtgccccctgta

SEQ ID NO: 329938 - DNA, 25 bp, Homo sapien
caagacgtgtgggttattatggaag

SEQ ID NO: 329939 - DNA, 25 bp, Homo sapien
gaagaaattcacaaccaaacttggg

SEQ ID NO: 329940 - DNA, 25 bp, Homo sapien
tgttttccaagaactctatgtggac

SEQ ID NO: 329941 - DNA, 25 bp, Homo sapien
agaactctatgtggacagtgacaaa

SEQ ID NO: 329942 - DNA, 25 bp, Homo sapien
ggacagtgacaaaaaacagacctaa

SEQ ID NO: 329943 - DNA, 25 bp, Homo sapien
acctaagaactagcagactgggcaa

SEQ ID NO: 329944 - DNA, 25 bp, Homo sapien
tcaggaaaaaatggtcaatgggtca

SEQ ID NO: 329945 - DNA, 25 bp, Homo sapien
caatgggtcattgtgtgtagacaaa

SEQ ID NO: 329946 - DNA, 25 bp, Homo sapien
agacaaaactacaagttctgctcca

SEQ ID NO: 329947 - DNA, 25 bp, Homo sapien
atcttcaagctgtggccattctgta

SEQ ID NO: 329948 - DNA, 25 bp, Homo sapien
ggacacagcaagcaacttacatgta

SEQ ID NO: 329949 - DNA, 25 bp, Homo sapien
aaaataagcaacctggaccagagat

SEQ ID NO: 329950 - DNA, 25 bp, Homo sapien
cagagattaaactccaggtctgaga

SEQ ID NO: 329951 - DNA, 25 bp, Homo sapien
ggtctgagagccagataacagccct

SEQ ID NO: 329952 - DNA, 25 bp, Homo sapien
agataacagccctcctcaagataac

SEQ ID NO: 329953 - DNA, 25 bp, Homo sapien
gccctcctcaagataaccagtcaag

SEQ ID NO: 329954 - DNA, 25 bp, Homo sapien
accagtcaagtttggcactgcaggc

SEQ ID NO: 329955 - DNA, 25 bp, Homo sapien
tgcaggccctgagccattttggtcc

SEQ ID NO: 329956 - DNA, 25 bp, Homo sapien
gtgaagccaccccagaagaaaacca

SEQ ID NO: 329957 - DNA, 25 bp, Homo sapien
ccagaagaaaaccactattcgttca

SEQ ID NO: 329958 - DNA, 25 bp, Homo sapien
gggaactagcccacttctgatgctg

SEQ ID NO: 329959 - DNA, 25 bp, Homo sapien
cacttctgatgctgcatgactgaga

SEQ ID NO: 329960 - DNA, 25 bp, Homo sapien
gatgttgcaaaatgctgtataaagc

SEQ ID NO: 329961 - DNA, 25 bp, Homo sapien
gtataaagctgaaacctgttcattc

SEQ ID NO: 329962 - DNA, 25 bp, Homo sapien
aagctgaaacctgttcattcagtgc

SEQ ID NO: 329963 - DNA, 25 bp, Homo sapien
gctgaaacctgttcattcagtgcca

SEQ ID NO: 329964 - DNA, 25 bp, Homo sapien
tgaaacctgttcattcagtgccatt

SEQ ID NO: 329965 - DNA, 25 bp, Homo sapien
gaaacctgttcattcagtgccattg

SEQ ID NO: 329966 - DNA, 25 bp, Homo sapien
aaacctgttcattcagtgccattgt

SEQ ID NO: 329967 - DNA, 25 bp, Homo sapien
aacctgttcattcagtgccattgta

SEQ ID NO: 329968 - DNA, 25 bp, Homo sapien
gattgtaaaactgtctccgattttt

SEQ ID NO: 329969 - DNA, 25 bp, Homo sapien
gtaaaactgtctccgatttttctct

SEQ ID NO: 329970 - DNA, 25 bp, Homo sapien
ttctctggtttattaaaatgctaac

SEQ ID NO: 329971 - DNA, 25 bp, Homo sapien
gagaatagcaaatacgcatgttgat

SEQ ID NO: 329972 - DNA, 25 bp, Homo sapien
ttgattgcgagtgtgtggagacaaa

SEQ ID NO: 329973 - DNA, 25 bp, Homo sapien
tggagacaaaggcagttcccaccac

SEQ ID NO: 329974 - DNA, 25 bp, Homo sapien
agttcccaccacagttaggtcctgg

SEQ ID NO: 329975 - DNA, 25 bp, Homo sapien
gccttctgctgggtcaaaggtggcc

SEQ ID NO: 329976 - DNA, 25 bp, Homo sapien
tctccagccttgaattgttccctgt

SEQ ID NO: 329977 - DNA, 25 bp, Homo sapien
tgaattgttccctgttggcttccca

SEQ ID NO: 329978 - DNA, 25 bp, Homo sapien
tgttggcttcccaagggcccatctg

SEQ ID NO: 329979 - DNA, 25 bp, Homo sapien
agggcccatctgctggtacagtcca

SEQ ID NO: 329980 - DNA, 25 bp, Homo sapien
atctgctggtacagtccacacttcc

SEQ ID NO: 329981 - DNA, 25 bp, Homo sapien
caagacccgagagggctttcactgc

SEQ ID NO: 329982 - DNA, 25 bp, Homo sapien
agagttcttttgcataccctttact

SEQ ID NO: 329983 - DNA, 25 bp, Homo sapien
ttttgcataccctttactcaggtcc

SEQ ID NO: 329984 - DNA, 25 bp, Homo sapien
tactcaggtcctctcatgttaacgt

SEQ ID NO: 329985 - DNA, 25 bp, Homo sapien
ggtcctctcatgttaacgttttaca

SEQ ID NO: 329986 - DNA, 25 bp, Homo sapien
atgttaacgttttacataactgtag

SEQ ID NO: 329987 - DNA, 25 bp, Homo sapien
gatattagcccagaacaatactact

SEQ ID NO: 329988 - DNA, 25 bp, Homo sapien
agcccagaacaatactactaactga

SEQ ID NO: 329989 - DNA, 25 bp, Homo sapien
attttccttttgtgtgctctgttta

SEQ ID NO: 329990 - DNA, 25 bp, Homo sapien
gtgtgctctgtttataccatgatcc

SEQ ID NO: 329991 - DNA, 25 bp, Homo sapien
gctctgtttataccatgatccatga

SEQ ID NO: 329992 - DNA, 25 bp, Homo sapien
tgtcttttaaagatctgtgtgtctc

SEQ ID NO: 329993 - DNA, 25 bp, Homo sapien
agaagtagcctaacagtcctccctg

SEQ ID NO: 329994 - DNA, 25 bp, Homo sapien
tccctggtcatactcgtttcaaaca

SEQ ID NO: 329995 - DNA, 25 bp, Homo sapien
tactcgtttcaaacaggtctgcctg

SEQ ID NO: 329996 - DNA, 25 bp, Homo sapien
ttcaaacaggtctgcctgtctagac

SEQ ID NO: 329997 - DNA, 25 bp, Homo sapien
gtctagacatattcaggcaggaggt

SEQ ID NO: 329998 - DNA, 25 bp, Homo sapien
gctgctatcttgaaaaccactggaa

SEQ ID NO: 329999 - DNA, 25 bp, Homo sapien
gacctcagagcccatattcatatgg

SEQ ID NO: 330000 - DNA, 25 bp, Homo sapien
tatggaagcccacccatataagcct

SEQ ID NO: 330001 - DNA, 25 bp, Homo sapien
gcctcacagagcaaatcacagcaat

SEQ ID NO: 330002 - DNA, 25 bp, Homo sapien
gaagttgttattttcaagtgcttat

SEQ ID NO: 330003 - DNA, 25 bp, Homo sapien
aagtgcttatttcacgacattaaaa

SEQ ID NO: 330004 - DNA, 25 bp, Homo sapien
aaccaccacgtaatcatcttctgca

SEQ ID NO: 330005 - DNA, 25 bp, Homo sapien
cgtaatcatcttctgcaaacaaggg

SEQ ID NO: 330006 - DNA, 25 bp, Homo sapien
aaggggtgccagtgttgcctaacag

SEQ ID NO: 330007 - DNA, 25 bp, Homo sapien
taataaagcaaatcctctgcttcaa

SEQ ID NO: 330008 - DNA, 25 bp, Homo sapien
tcctctgcttcaaaggtttttgaaa

SEQ ID NO: 330009 - DNA, 25 bp, Homo sapien
aagatgagtttaactgtgtccaggt

SEQ ID NO: 330010 - DNA, 25 bp, Homo sapien
agtttaactgtgtccaggtggagta

SEQ ID NO: 330011 - DNA, 25 bp, Homo sapien
ccaggtggagtaatagtactgctgt

SEQ ID NO: 330012 - DNA, 25 bp, Homo sapien
gtgatgaggttggtatgacttcttt

SEQ ID NO: 330013 - DNA, 25 bp, Homo sapien
gtatgacttctttagtgacctttta

SEQ ID NO: 330014 - DNA, 25 bp, Homo sapien
tgacttctttagtgaccttttaggg

SEQ ID NO: 330015 - DNA, 25 bp, Homo sapien
gtaatgtaagacagttttggccttt

SEQ ID NO: 330016 - DNA, 25 bp, Homo sapien
actctacagtatactacaatagtga

SEQ ID NO: 330017 - DNA, 25 bp, Homo sapien
actattatcatgagagatccttctg

SEQ ID NO: 330018 - DNA, 25 bp, Homo sapien
tatcatgagagatccttctgaatag

SEQ ID NO: 330019 - DNA, 25 bp, Homo sapien
ccttctgaataggatgtctttctga

SEQ ID NO: 330020 - DNA, 25 bp, Homo sapien
tgaataggatgtctttctgagttcc

SEQ ID NO: 330021 - DNA, 25 bp, Homo sapien
tctttctgagttccactattcagtt

SEQ ID NO: 330022 - DNA, 25 bp, Homo sapien
gagttccactattcagttacaaaac

SEQ ID NO: 330023 - DNA, 25 bp, Homo sapien
cagttacaaaactccttaatgctta

SEQ ID NO: 330024 - DNA, 25 bp, Homo sapien
aaactccttaatgcttaaaattcat

SEQ ID NO: 330025 - DNA, 25 bp, Homo sapien
tactgtgtaccttttatatttaata

SEQ ID NO: 330026 - DNA, 25 bp, Homo sapien
cccaaaattccgcaaggttgtgagg

SEQ ID NO: 330027 - DNA, 25 bp, Homo sapien
ccaaaattccgcaaggttgtgaggg

SEQ ID NO: 330028 - DNA, 25 bp, Homo sapien
caaaattccgcaaggttgtgaggga

SEQ ID NO: 330029 - DNA, 25 bp, Homo sapien
aaaattccgcaaggttgtgagggag

SEQ ID NO: 330030 - DNA, 25 bp, Homo sapien
aaattccgcaaggttgtgagggaga

SEQ ID NO: 330031 - DNA, 25 bp, Homo sapien
atccatgaaacaccactatgggatt

SEQ ID NO: 330032 - DNA, 25 bp, Homo sapien
ccatgaaacaccactatgggattca

SEQ ID NO: 330033 - DNA, 25 bp, Homo sapien
tgaaacaccactatgggattcatgc

SEQ ID NO: 330034 - DNA, 25 bp, Homo sapien
gaaacaccactatgggattcatgcc

SEQ ID NO: 330035 - DNA, 25 bp, Homo sapien
aaacaccactatgggattcatgcca

SEQ ID NO: 330036 - DNA, 25 bp, Homo sapien
aacaccactatgggattcatgccaa

SEQ ID NO: 330037 - DNA, 25 bp, Homo sapien
atcacactggttgttttgatcttct

SEQ ID NO: 330038 - DNA, 25 bp, Homo sapien
tgatcttctttacaaattgcttttg

SEQ ID NO: 330039 - DNA, 25 bp, Homo sapien
attgcttttgagtcctaagtcatga

SEQ ID NO: 330040 - DNA, 25 bp, Homo sapien
gagtcctaagtcatgaatttcaatt

SEQ ID NO: 330041 - DNA, 25 bp, Homo sapien
tgtttctcttaacccttttctatct

SEQ ID NO: 330042 - DNA, 25 bp, Homo sapien
cccttttctatctgtgtctaattct

SEQ ID NO: 330043 - DNA, 25 bp, Homo sapien
atctgtgtctaattctagtcaacat

SEQ ID NO: 330044 - DNA, 25 bp, Homo sapien
ggcaatactgctttatctcaacatt

SEQ ID NO: 330045 - DNA, 25 bp, Homo sapien
tcaacattaatatgggccctctcat

SEQ ID NO: 330046 - DNA, 25 bp, Homo sapien
gggccctctcattcaaatagactca

SEQ ID NO: 330047 - DNA, 25 bp, Homo sapien
tgcaaaatttcaaatccctatagta

SEQ ID NO: 330048 - DNA, 25 bp, Homo sapien
gtctgccgttgctcaggcgatctgt

SEQ ID NO: 330049 - DNA, 25 bp, Homo sapien
ttgctcaggcgatctgtggctaatc

SEQ ID NO: 330050 - DNA, 25 bp, Homo sapien
caggcgatctgtggctaatctggga

SEQ ID NO: 330051 - DNA, 25 bp, Homo sapien
gaagcctctcatgaaatcattgcaa

SEQ ID NO: 330052 - DNA, 25 bp, Homo sapien
gcctctcatgaaatcattgcaagtt

SEQ ID NO: 330053 - DNA, 25 bp, Homo sapien
gtttattaacaacagctgtggccac

SEQ ID NO: 330054 - DNA, 25 bp, Homo sapien
attaacaacagctgtggccacacat

SEQ ID NO: 330055 - DNA, 25 bp, Homo sapien
aacaacagctgtggccacacatgac

SEQ ID NO: 330056 - DNA, 25 bp, Homo sapien
agccacagtgcgcagcatgtgccac

SEQ ID NO: 330057 - DNA, 25 bp, Homo sapien
agtgcgcagcatgtgccactccaag

SEQ ID NO: 330058 - DNA, 25 bp, Homo sapien
atgtgccactccaagctctgctgct

SEQ ID NO: 330059 - DNA, 25 bp, Homo sapien
gccattgtgttaacattgtactcag

SEQ ID NO: 330060 - DNA, 25 bp, Homo sapien
taacacgctgtacaggtctgtgtat

SEQ ID NO: 330061 - DNA, 25 bp, Homo sapien
gctgtacaggtctgtgtattttcta

SEQ ID NO: 330062 - DNA, 25 bp, Homo sapien
gtattttctatgatgctcacatgca

SEQ ID NO: 330063 - DNA, 25 bp, Homo sapien
tgatgctcacatgcaatcacccaaa

SEQ ID NO: 330064 - DNA, 25 bp, Homo sapien
gcaatcacccaaactgcatttctca

SEQ ID NO: 330065 - DNA, 25 bp, Homo sapien
ctgcatttctcagaactctgtcatt

SEQ ID NO: 330066 - DNA, 25 bp, Homo sapien
aacacatgactgcacatcagctcaa

SEQ ID NO: 330067 - DNA, 25 bp, Homo sapien
gacagtcatgtaacacgtaacattt

SEQ ID NO: 330068 - DNA, 25 bp, Homo sapien
aatgtgcatatatggtaagcctgaa

SEQ ID NO: 330069 - DNA, 25 bp, Homo sapien
taagcctgaaagattataccactat

SEQ ID NO: 330070 - DNA, 25 bp, Homo sapien
taagagctagtcattcttgccagcc

SEQ ID NO: 330071 - DNA, 25 bp, Homo sapien
acagtgtgagatctgcagcagtgtt

SEQ ID NO: 330072 - DNA, 25 bp, Homo sapien
gcagcagtgtttactagttcatttt

SEQ ID NO: 330073 - DNA, 25 bp, Homo sapien
gtgaagtcagtccttgataatttgt

SEQ ID NO: 330074 - DNA, 25 bp, Homo sapien
tcagtccttgataatttgtggtaca

SEQ ID NO: 330075 - DNA, 25 bp, Homo sapien
gtctgacagtaatcttcctaccttt

SEQ ID NO: 330076 - DNA, 25 bp, Homo sapien
tacctttgtagagactccatcatcc

SEQ ID NO: 330077 - DNA, 25 bp, Homo sapien
agagactccatcatcccttctgaat

SEQ ID NO: 330078 - DNA, 25 bp, Homo sapien
gcacttcctgcgcttggagacattg

SEQ ID NO: 330079 - DNA, 25 bp, Homo sapien
ttggagacattggagagcccacatt

SEQ ID NO: 330080 - DNA, 25 bp, Homo sapien
attggagagcccacattgaaaatct

SEQ ID NO: 330081 - DNA, 25 bp, Homo sapien
cttcaaaatttggtagtgctctcga

SEQ ID NO: 330082 - DNA, 25 bp, Homo sapien
aaatttggtagtgctctcgaatatg

SEQ ID NO: 330083 - DNA, 25 bp, Homo sapien
ggtagtgctctcgaatatgtatatt

SEQ ID NO: 330084 - DNA, 25 bp, Homo sapien
agtgctctcgaatatgtatatttgt

SEQ ID NO: 330085 - DNA, 25 bp, Homo sapien
tgtatttttcaagcgaagttctctt

SEQ ID NO: 330086 - DNA, 25 bp, Homo sapien
tcaagcgaagttctcttattcacat

SEQ ID NO: 330087 - DNA, 25 bp, Homo sapien
aagcgaagttctcttattcacatat

SEQ ID NO: 330088 - DNA, 25 bp, Homo sapien
taaagtgggttggtactgatatcaa

SEQ ID NO: 330089 - DNA, 25 bp, Homo sapien
gtgggttggtactgatatcaaaaaa

SEQ ID NO: 330090 - DNA, 25 bp, Homo sapien
gaacagacatttcagtcactgcatt

SEQ ID NO: 330091 - DNA, 25 bp, Homo sapien
gatgacatcaatagattgcatttta

SEQ ID NO: 330092 - DNA, 25 bp, Homo sapien
tgaaaacgaagatggtgacaccacg

SEQ ID NO: 330093 - DNA, 25 bp, Homo sapien
gatggtgacaccacgattggtcaaa

SEQ ID NO: 330094 - DNA, 25 bp, Homo sapien
ccacgattggtcaaagatgtgcttt

SEQ ID NO: 330095 - DNA, 25 bp, Homo sapien
gatgtgctttggttatttgcgacca

SEQ ID NO: 330096 - DNA, 25 bp, Homo sapien
ggttatttgcgaccaactgtggtga

SEQ ID NO: 330097 - DNA, 25 bp, Homo sapien
gcgaccaactgtggtgaacccagat

SEQ ID NO: 330098 - DNA, 25 bp, Homo sapien
aactgtggtgaacccagattactgg

SEQ ID NO: 330099 - DNA, 25 bp, Homo sapien
gattactgggtaaaatcccgaccag

SEQ ID NO: 330100 - DNA, 25 bp, Homo sapien
tcccgaccagtaccaccatttatta

SEQ ID NO: 330101 - DNA, 25 bp, Homo sapien
gaacccaatataataacccgtggct

SEQ ID NO: 330102 - DNA, 25 bp, Homo sapien
ataataacccgtggctgtgaaaagc

SEQ ID NO: 330103 - DNA, 25 bp, Homo sapien
cgtcttttcactggactaatgaaga

SEQ ID NO: 330104 - DNA, 25 bp, Homo sapien
ggaatggtttcacagcatgcccaac

SEQ ID NO: 330105 - DNA, 25 bp, Homo sapien
acctcatgaggcttgttgggtcaga

SEQ ID NO: 330106 - DNA, 25 bp, Homo sapien
gcttgttgggtcagagcttgtgcca

SEQ ID NO: 330107 - DNA, 25 bp, Homo sapien
gggtcagagcttgtgccagatgcca

SEQ ID NO: 330108 - DNA, 25 bp, Homo sapien
gtgccagatgccagtcttctgcctt

SEQ ID NO: 330109 - DNA, 25 bp, Homo sapien
tctgccttccagtcttatagttgtt

SEQ ID NO: 330110 - DNA, 25 bp, Homo sapien
cttccagtcttatagttgttacgct

SEQ ID NO: 330111 - DNA, 25 bp, Homo sapien
agttgttacgctatagccttctgca

SEQ ID NO: 330112 - DNA, 25 bp, Homo sapien
tacgctatagccttctgcagtggat

SEQ ID NO: 330113 - DNA, 25 bp, Homo sapien
ctatagccttctgcagtggatggta

SEQ ID NO: 330114 - DNA, 25 bp, Homo sapien
ccgaacctgacatcaacaacaggct

SEQ ID NO: 330115 - DNA, 25 bp, Homo sapien
aacaggctggagtcgttgtgcctca

SEQ ID NO: 330116 - DNA, 25 bp, Homo sapien
gctggagtcgttgtgcctcagtatg

SEQ ID NO: 330117 - DNA, 25 bp, Homo sapien
gtatgaccgaacacgccctgggaga

SEQ ID NO: 330118 - DNA, 25 bp, Homo sapien
gagtgaccgcgctggccgtgaaatc

SEQ ID NO: 330119 - DNA, 25 bp, Homo sapien
gctggccgtgaaatcgactgctgcg

SEQ ID NO: 330120 - DNA, 25 bp, Homo sapien
gtgaaatcgactgctgcgggtccag

SEQ ID NO: 330121 - DNA, 25 bp, Homo sapien
aaatcgactgctgcgggtccagtgt

SEQ ID NO: 330122 - DNA, 25 bp, Homo sapien
actgctgcgggtccagtgtccgcca

SEQ ID NO: 330123 - DNA, 25 bp, Homo sapien
ttcagggttgcacagaatcctccaa

SEQ ID NO: 330124 - DNA, 25 bp, Homo sapien
tccctctcccgttttgattttgtga

SEQ ID NO: 330125 - DNA, 25 bp, Homo sapien
atttgcaatgatgtctgagtactgt

SEQ ID NO: 330126 - DNA, 25 bp, Homo sapien
atgtctgagtactgtattttttctg

SEQ ID NO: 330127 - DNA, 25 bp, Homo sapien
ttctgtgcattaccttagtgtcaga

SEQ ID NO: 330128 - DNA, 25 bp, Homo sapien
ccttagtgtcagaatgttggtcttt

SEQ ID NO: 330129 - DNA, 25 bp, Homo sapien
gtcagaatgttggtctttattttaa

SEQ ID NO: 330130 - DNA, 25 bp, Homo sapien
ttaaagtcatatgcatgttctcctg

SEQ ID NO: 330131 - DNA, 25 bp, Homo sapien
gttctcctgccaaggaacctttaca

SEQ ID NO: 330132 - DNA, 25 bp, Homo sapien
aatcaaatgccttcaatttctgaga

SEQ ID NO: 330133 - DNA, 25 bp, Homo sapien
gagattttcaggacacagacatatg

SEQ ID NO: 330134 - DNA, 25 bp, Homo sapien
agacatatgatgtgaatgcctacaa

SEQ ID NO: 330135 - DNA, 25 bp, Homo sapien
cataggaacagtgggcctgggtaaa

SEQ ID NO: 330136 - DNA, 25 bp, Homo sapien
gcctgacgctgtcttacgacgagga

SEQ ID NO: 330137 - DNA, 25 bp, Homo sapien
acgtcatgggtcagcttgtttgcca

SEQ ID NO: 330138 - DNA, 25 bp, Homo sapien
gtttgccatgaactgattcctggag

SEQ ID NO: 330139 - DNA, 25 bp, Homo sapien
ctggagggaagaccattcctgttac

SEQ ID NO: 330140 - DNA, 25 bp, Homo sapien
attagctacatccatctgatggcac

SEQ ID NO: 330141 - DNA, 25 bp, Homo sapien
gatggcacattttcgaatgcacact

SEQ ID NO: 330142 - DNA, 25 bp, Homo sapien
aaacagctgccctcattagcggatt

SEQ ID NO: 330143 - DNA, 25 bp, Homo sapien
tagcggattccgttccattatcaaa

SEQ ID NO: 330144 - DNA, 25 bp, Homo sapien
aaacccgagtggatccgaatgttct

SEQ ID NO: 330145 - DNA, 25 bp, Homo sapien
aatgttctcaactcctgaactgcag

SEQ ID NO: 330146 - DNA, 25 bp, Homo sapien
agcgtctcatctctggcgacaatgc

SEQ ID NO: 330147 - DNA, 25 bp, Homo sapien
gggtacaacagagtcacgttccctt

SEQ ID NO: 330148 - DNA, 25 bp, Homo sapien
agtcacgttccctttgaatctccat

SEQ ID NO: 330149 - DNA, 25 bp, Homo sapien
tcctccaccagccagagggtatctg

SEQ ID NO: 330150 - DNA, 25 bp, Homo sapien
atctggcaccagataaggatggctg

SEQ ID NO: 330151 - DNA, 25 bp, Homo sapien
ataaggatggctggtagcctcctcc

SEQ ID NO: 330152 - DNA, 25 bp, Homo sapien
tcctctctcagcactttgaatgcaa

SEQ ID NO: 330153 - DNA, 25 bp, Homo sapien
ttgaatgcaagacagaagagccctc

SEQ ID NO: 330154 - DNA, 25 bp, Homo sapien
gggctgggtaggaatacctcatcct

SEQ ID NO: 330155 - DNA, 25 bp, Homo sapien
tacctcatcctctggttgggtagga

SEQ ID NO: 330156 - DNA, 25 bp, Homo sapien
gggtaggaatactccatcctgtagt

SEQ ID NO: 330157 - DNA, 25 bp, Homo sapien
gtggaggaaaataagatcccctagg

SEQ ID NO: 330158 - DNA, 25 bp, Homo sapien
aagtggtgacttcagcccgggcaga

SEQ ID NO: 330159 - DNA, 25 bp, Homo sapien
ttcagcccgggcagacgtcaacagc

SEQ ID NO: 330160 - DNA, 25 bp, Homo sapien
ggcagacgtcaacagcctgggtcat

SEQ ID NO: 330161 - DNA, 25 bp, Homo sapien
tcaacagcctgggtcatggagctaa

SEQ ID NO: 330162 - DNA, 25 bp, Homo sapien
gtcatggagctaataccgaggcact

SEQ ID NO: 330163 - DNA, 25 bp, Homo sapien
gagctaataccgaggcactgccgct

SEQ ID NO: 330164 - DNA, 25 bp, Homo sapien
tgcagcaggtcccttagcctctctg

SEQ ID NO: 330165 - DNA, 25 bp, Homo sapien
tcagtctcctcacctagagacaggg

SEQ ID NO: 330166 - DNA, 25 bp, Homo sapien
gacagtcccaccttggcagggttat

SEQ ID NO: 330167 - DNA, 25 bp, Homo sapien
ggttattctatggagtatatgggtt

SEQ ID NO: 330168 - DNA, 25 bp, Homo sapien
taaaacaaggatttggccaggtgcg

SEQ ID NO: 330169 - DNA, 25 bp, Homo sapien
ccagcccagtgagccgtgatgttct

SEQ ID NO: 330170 - DNA, 25 bp, Homo sapien
gtgatgttctctcactgctcggtcc

SEQ ID NO: 330171 - DNA, 25 bp, Homo sapien
ctctgccatctacagcgacataggt

SEQ ID NO: 330172 - DNA, 25 bp, Homo sapien
agcgacataggttgggtctgttccc

SEQ ID NO: 330173 - DNA, 25 bp, Homo sapien
ataggttgggtctgttcccctggca

SEQ ID NO: 330174 - DNA, 25 bp, Homo sapien
tgttcccctggcagacagcaggcct

SEQ ID NO: 330175 - DNA, 25 bp, Homo sapien
gccaggcctggatagccctagttct

SEQ ID NO: 330176 - DNA, 25 bp, Homo sapien
ccctagttctctcccatttcttggt

SEQ ID NO: 330177 - DNA, 25 bp, Homo sapien
ttgtgagcagatgcctgtcagggac

SEQ ID NO: 330178 - DNA, 25 bp, Homo sapien
tgtcagggacagctctatcagaaca

SEQ ID NO: 330179 - DNA, 25 bp, Homo sapien
tatcagaacagaccgagtccagccc

SEQ ID NO: 330180 - DNA, 25 bp, Homo sapien
ctttggggtcacagttctattttgt

SEQ ID NO: 330181 - DNA, 25 bp, Homo sapien
cagaatagaagtggagcagtgatca

SEQ ID NO: 330182 - DNA, 25 bp, Homo sapien
gagcagtgatcattattctccgctt

SEQ ID NO: 330183 - DNA, 25 bp, Homo sapien
cagtgatcattattctccgctttct

SEQ ID NO: 330184 - DNA, 25 bp, Homo sapien
tgatcattattctccgctttctctt

SEQ ID NO: 330185 - DNA, 25 bp, Homo sapien
attattctccgctttctctttctaa

SEQ ID NO: 330186 - DNA, 25 bp, Homo sapien
tattctccgctttctctttctaatc

SEQ ID NO: 330187 - DNA, 25 bp, Homo sapien
ttctctttctaatcaacacttgaaa

SEQ ID NO: 330188 - DNA, 25 bp, Homo sapien
aaaagcaaagtgtcttttcagcctt

SEQ ID NO: 330189 - DNA, 25 bp, Homo sapien
aaaaaagccgtccagcttatcccat

SEQ ID NO: 330190 - DNA, 25 bp, Homo sapien
ctctgattgtcttctgacttaaggg

SEQ ID NO: 330191 - DNA, 25 bp, Homo sapien
tctctctgggcatcatagtctagta

SEQ ID NO: 330192 - DNA, 25 bp, Homo sapien
ctctgggcatcatagtctagtaggg

SEQ ID NO: 330193 - DNA, 25 bp, Homo sapien
gggaagaggcatgtaaacaaataaa

SEQ ID NO: 330194 - DNA, 25 bp, Homo sapien
gagatgtatattgtgatcctaagga

SEQ ID NO: 330195 - DNA, 25 bp, Homo sapien
tagaataccatatctacctggaagt

SEQ ID NO: 330196 - DNA, 25 bp, Homo sapien
gaataccatatctacctggaagtta

SEQ ID NO: 330197 - DNA, 25 bp, Homo sapien
ataccatatctacctggaagttagg

SEQ ID NO: 330198 - DNA, 25 bp, Homo sapien
aggtaacatttgcttgatgttgaag

SEQ ID NO: 330199 - DNA, 25 bp, Homo sapien
acatttgcttgatgttgaagaacaa

SEQ ID NO: 330200 - DNA, 25 bp, Homo sapien
gaagcaaaatgtcctggcacatagt

SEQ ID NO: 330201 - DNA, 25 bp, Homo sapien
taaataataattcctgctctctctg

SEQ ID NO: 330202 - DNA, 25 bp, Homo sapien
gttttttgcctcaactgacctgtaa

SEQ ID NO: 330203 - DNA, 25 bp, Homo sapien
aagtccacctatatcaactttctgc

SEQ ID NO: 330204 - DNA, 25 bp, Homo sapien
atatcaactttctgccaatctggag

SEQ ID NO: 330205 - DNA, 25 bp, Homo sapien
ctgttttctttgatctgacgtcatg

SEQ ID NO: 330206 - DNA, 25 bp, Homo sapien
tgatctgacgtcatgtgttcacaag

SEQ ID NO: 330207 - DNA, 25 bp, Homo sapien
gctggatggtttttgccttaaccca

SEQ ID NO: 330208 - DNA, 25 bp, Homo sapien
cttaacccatattcttccattcatt

SEQ ID NO: 330209 - DNA, 25 bp, Homo sapien
attcattccaaatactatctccagt

SEQ ID NO: 330210 - DNA, 25 bp, Homo sapien
tagagttttcccacttcctgtatga

SEQ ID NO: 330211 - DNA, 25 bp, Homo sapien
gatttcacaatctggagctaatagc

SEQ ID NO: 330212 - DNA, 25 bp, Homo sapien
ctaattaagcccagagtcactttaa

SEQ ID NO: 330213 - DNA, 25 bp, Homo sapien
aaggtagggcttacagcagcagagt

SEQ ID NO: 330214 - DNA, 25 bp, Homo sapien
aggctgggtcacttatgggcataaa

SEQ ID NO: 330215 - DNA, 25 bp, Homo sapien
atgggcataaaaacctgggcctctg

SEQ ID NO: 330216 - DNA, 25 bp, Homo sapien
tgggcctctgggttaaagctgtttt

SEQ ID NO: 330217 - DNA, 25 bp, Homo sapien
gttaaagctgtttttgatctcctta

SEQ ID NO: 330218 - DNA, 25 bp, Homo sapien
ttatccaactcacatccattttcat

SEQ ID NO: 330219 - DNA, 25 bp, Homo sapien
attatcatccacgtaaagcaccttc

SEQ ID NO: 330220 - DNA, 25 bp, Homo sapien
taaagcaccttcactggtccctttt

SEQ ID NO: 330221 - DNA, 25 bp, Homo sapien
gaaacctcaaatgggtcgatccaaa

SEQ ID NO: 330222 - DNA, 25 bp, Homo sapien
actaagatcctgtggcagattgcca

SEQ ID NO: 330223 - DNA, 25 bp, Homo sapien
ggcagattgccacgaacatcatcaa

SEQ ID NO: 330224 - DNA, 25 bp, Homo sapien
attgatttccaagggtgtccatcgc

SEQ ID NO: 330225 - DNA, 25 bp, Homo sapien
aagggtgtccatcgcgcttccttca

SEQ ID NO: 330226 - DNA, 25 bp, Homo sapien
ttccttcactgccttgatcatgtcg

SEQ ID NO: 330227 - DNA, 25 bp, Homo sapien
tgcagaccctgactcaacgacggat

SEQ ID NO: 330228 - DNA, 25 bp, Homo sapien
gaccctgactcaacgacggatgaat

SEQ ID NO: 330229 - DNA, 25 bp, Homo sapien
caacgacggatgaataatgtacact

SEQ ID NO: 330230 - DNA, 25 bp, Homo sapien
acactgacacagatcttatgcttgt

SEQ ID NO: 330231 - DNA, 25 bp, Homo sapien
agatcttatgcttgtcagtcctgct

SEQ ID NO: 330232 - DNA, 25 bp, Homo sapien
tatgcttgtcagtcctgctgagcat

SEQ ID NO: 330233 - DNA, 25 bp, Homo sapien
tccaagaagagtcctgtcagccacg

SEQ ID NO: 330234 - DNA, 25 bp, Homo sapien
gtcagccacggctctgacttgttgg

SEQ ID NO: 330235 - DNA, 25 bp, Homo sapien
tggcgtgtgtggcagccggctcgct

SEQ ID NO: 330236 - DNA, 25 bp, Homo sapien
ggcgtgtgtggcagccggctcgctc

SEQ ID NO: 330237 - DNA, 25 bp, Homo sapien
tgtggcagccggctcgctccctctc

SEQ ID NO: 330238 - DNA, 25 bp, Homo sapien
tctctgcttgctatccctgaccttt

SEQ ID NO: 330239 - DNA, 25 bp, Homo sapien
tctgcttgctatccctgacctttct

SEQ ID NO: 330240 - DNA, 25 bp, Homo sapien
tgcttgctatccctgacctttcttt

SEQ ID NO: 330241 - DNA, 25 bp, Homo sapien
gcttgctatccctgacctttctttc

SEQ ID NO: 330242 - DNA, 25 bp, Homo sapien
ttgctatccctgacctttctttctt

SEQ ID NO: 330243 - DNA, 25 bp, Homo sapien
tttaaactggaagaggatgcacagg

SEQ ID NO: 330244 - DNA, 25 bp, Homo sapien
ttaaactggaagaggatgcacaggg

SEQ ID NO: 330245 - DNA, 25 bp, Homo sapien
cttttgtttacctggcgtgtgtggc

SEQ ID NO: 330246 - DNA, 25 bp, Homo sapien
cccctgagaaggactatttaaatga

SEQ ID NO: 330247 - DNA, 25 bp, Homo sapien
gtacattgtggttagtttgttttca

SEQ ID NO: 330248 - DNA, 25 bp, Homo sapien
gtttgttttcagattctgcaccctt

SEQ ID NO: 330249 - DNA, 25 bp, Homo sapien
ttttcagattctgcacccttttaaa

SEQ ID NO: 330250 - DNA, 25 bp, Homo sapien
aaattcattgcttttctctttactg

SEQ ID NO: 330251 - DNA, 25 bp, Homo sapien
tcattgcttttctctttactggagt

SEQ ID NO: 330252 - DNA, 25 bp, Homo sapien
tttctctttactggagtttcctctt

SEQ ID NO: 330253 - DNA, 25 bp, Homo sapien
agtttcctcttgtccatttctgata

SEQ ID NO: 330254 - DNA, 25 bp, Homo sapien
tcctcttgtccatttctgatactga

SEQ ID NO: 330255 - DNA, 25 bp, Homo sapien
caaatacgattaattatgaccagaa

SEQ ID NO: 330256 - DNA, 25 bp, Homo sapien
tgtagagttgtatttcatatcacat

SEQ ID NO: 330257 - DNA, 25 bp, Homo sapien
atccaagggctacttttgattaaag

SEQ ID NO: 330258 - DNA, 25 bp, Homo sapien
ggatcaaggaattcacattgctttt

SEQ ID NO: 330259 - DNA, 25 bp, Homo sapien
catgatggtatgtacccgtagtccc

SEQ ID NO: 330260 - DNA, 25 bp, Homo sapien
gaaaagacaaacctatctcagagat

SEQ ID NO: 330261 - DNA, 25 bp, Homo sapien
aacctatctcagagatttgagccaa

SEQ ID NO: 330262 - DNA, 25 bp, Homo sapien
tcagagatttgagccaatgtagcaa

SEQ ID NO: 330263 - DNA, 25 bp, Homo sapien
ttgagccaatgtagcaaagtgggat

SEQ ID NO: 330264 - DNA, 25 bp, Homo sapien
atgtgggagaatcagcgtgacctac

SEQ ID NO: 330265 - DNA, 25 bp, Homo sapien
gactgaggcgggaagggattattta

SEQ ID NO: 330266 - DNA, 25 bp, Homo sapien
gattatttaagtttaagagtgccac

SEQ ID NO: 330267 - DNA, 25 bp, Homo sapien
taagtttaagagtgccactgtactc

SEQ ID NO: 330268 - DNA, 25 bp, Homo sapien
tagtggagcaccagggccagcgcga

SEQ ID NO: 330269 - DNA, 25 bp, Homo sapien
agcgcgacggagaccagcaccagca

SEQ ID NO: 330270 - DNA, 25 bp, Homo sapien
ccggcggccattacgtaataccagt

SEQ ID NO: 330271 - DNA, 25 bp, Homo sapien
ggccattacgtaataccagtaggct

SEQ ID NO: 330272 - DNA, 25 bp, Homo sapien
ccagtaggctgggatgggctgcatg

SEQ ID NO: 330273 - DNA, 25 bp, Homo sapien
ggctgcatgggcaccgtgtccactg

SEQ ID NO: 330274 - DNA, 25 bp, Homo sapien
atgggcaccgtgtccactgtgggct

SEQ ID NO: 330275 - DNA, 25 bp, Homo sapien
agggtgccccctgcaaaagccgaga

SEQ ID NO: 330276 - DNA, 25 bp, Homo sapien
aggtgatggagtgatcggtcttctt

SEQ ID NO: 330277 - DNA, 25 bp, Homo sapien
agtgatcggtcttcttggccgcata

SEQ ID NO: 330278 - DNA, 25 bp, Homo sapien
tcttggccgcatagcggaaccggtg

SEQ ID NO: 330279 - DNA, 25 bp, Homo sapien
tacttcccagcctgcggcgtagggc

SEQ ID NO: 330280 - DNA, 25 bp, Homo sapien
agcaagggcctgacgcttagcgagc

SEQ ID NO: 330281 - DNA, 25 bp, Homo sapien
agcggctgtcgcctggagggcacgt

SEQ ID NO: 330282 - DNA, 25 bp, Homo sapien
gagggcacgttcaggcagaagctcc

SEQ ID NO: 330283 - DNA, 25 bp, Homo sapien
ggcacgttcaggcagaagctcctca

SEQ ID NO: 330284 - DNA, 25 bp, Homo sapien
tcctcagtggccacaagtccgctag

SEQ ID NO: 330285 - DNA, 25 bp, Homo sapien
gtggccacaagtccgctagctccgg

SEQ ID NO: 330286 - DNA, 25 bp, Homo sapien
gccgccgacaccaataagctacaag

SEQ ID NO: 330287 - DNA, 25 bp, Homo sapien
ggaggagctttaccgctgcctgtac

SEQ ID NO: 330288 - DNA, 25 bp, Homo sapien
tttaccgctgcctgtactactactg

SEQ ID NO: 330289 - DNA, 25 bp, Homo sapien
tgcctgtactactactgcctgcgct

SEQ ID NO: 330290 - DNA, 25 bp, Homo sapien
ttagtgcgagttaccgttactgtat

SEQ ID NO: 330291 - DNA, 25 bp, Homo sapien
gcgagttaccgttactgtatttgtg

SEQ ID NO: 330292 - DNA, 25 bp, Homo sapien
ctttgtataagtacattcctgtttt

SEQ ID NO: 330293 - DNA, 25 bp, Homo sapien
aaaggtggacattctaattacatta

SEQ ID NO: 330294 - DNA, 25 bp, Homo sapien
aaaagtgcttaatgaacaaaaacag

SEQ ID NO: 330295 - DNA, 25 bp, Homo sapien
aacagaacatagacaacaaaagaat

SEQ ID NO: 330296 - DNA, 25 bp, Homo sapien
aagaatattagaagtgatgcatgaa

SEQ ID NO: 330297 - DNA, 25 bp, Homo sapien
gtgatgcatgaagaaaacgagatat

SEQ ID NO: 330298 - DNA, 25 bp, Homo sapien
tacattcctgtttttgtgacaaaag

SEQ ID NO: 330299 - DNA, 25 bp, Homo sapien
ataatggctatcagaagtatgcttt

SEQ ID NO: 330300 - DNA, 25 bp, Homo sapien
atgctttgttttagtgcgagttacc

SEQ ID NO: 330301 - DNA, 25 bp, Homo sapien
agcgcgacggagaccagcaccagca

SEQ ID NO: 330302 - DNA, 25 bp, Homo sapien
ccggcggccattacgtaataccagt

SEQ ID NO: 330303 - DNA, 25 bp, Homo sapien
gccattacgtaataccagtaggctg

SEQ ID NO: 330304 - DNA, 25 bp, Homo sapien
atgggcaccgtgtccactgtgggct

SEQ ID NO: 330305 - DNA, 25 bp, Homo sapien
ctgcaaaagccgagatgggttccat

SEQ ID NO: 330306 - DNA, 25 bp, Homo sapien
atgggttccatgcagttctccagtg

SEQ ID NO: 330307 - DNA, 25 bp, Homo sapien
tctccagtgggacatcagtgcttat

SEQ ID NO: 330308 - DNA, 25 bp, Homo sapien
gtgggacatcagtgcttatccgaat

SEQ ID NO: 330309 - DNA, 25 bp, Homo sapien
aggtgatggagtgatcggtcttctt

SEQ ID NO: 330310 - DNA, 25 bp, Homo sapien
agtgatcggtcttcttggccgcata

SEQ ID NO: 330311 - DNA, 25 bp, Homo sapien
tcttggccgcatagcggaaccggtg

SEQ ID NO: 330312 - DNA, 25 bp, Homo sapien
acacgcagtaatgacctgtgcccgt

SEQ ID NO: 330313 - DNA, 25 bp, Homo sapien
agtaatgacctgtgcccgttcgcct

SEQ ID NO: 330314 - DNA, 25 bp, Homo sapien
ttttcttctaattctgtactcacaa

SEQ ID NO: 330315 - DNA, 25 bp, Homo sapien
tctttcttccattcccttaaattct

SEQ ID NO: 330316 - DNA, 25 bp, Homo sapien
attcccttaaattctgagtactgta

SEQ ID NO: 330317 - DNA, 25 bp, Homo sapien
tgagtactgtacatatatttctggg

SEQ ID NO: 330318 - DNA, 25 bp, Homo sapien
ttctgggttcccacgatgatgtgaa

SEQ ID NO: 330319 - DNA, 25 bp, Homo sapien
atgatgtgaaaaactaccagactgt

SEQ ID NO: 330320 - DNA, 25 bp, Homo sapien
tgttttttgtcttctcacaaagaca

SEQ ID NO: 330321 - DNA, 25 bp, Homo sapien
aatcagggcattttgtgagtgcctt

SEQ ID NO: 330322 - DNA, 25 bp, Homo sapien
gtgagtgccttaagatcaaactaac

SEQ ID NO: 330323 - DNA, 25 bp, Homo sapien
ctagaaactcactcagtcctgtggt

SEQ ID NO: 330324 - DNA, 25 bp, Homo sapien
gggctggagccaattgcgttaaact

SEQ ID NO: 330325 - DNA, 25 bp, Homo sapien
ggagccaattgcgttaaactaacta

SEQ ID NO: 330326 - DNA, 25 bp, Homo sapien
actcactcagtcctgtggttgccaa

SEQ ID NO: 330327 - DNA, 25 bp, Homo sapien
ttactctaataaaaatgactcctgg

SEQ ID NO: 330328 - DNA, 25 bp, Homo sapien
atgactcctggaactgcagtactat

SEQ ID NO: 330329 - DNA, 25 bp, Homo sapien
gcagtactatattcttggaacccca

SEQ ID NO: 330330 - DNA, 25 bp, Homo sapien
gaaaccaggtgacaacccataaatt

SEQ ID NO: 330331 - DNA, 25 bp, Homo sapien
tgtggttgccaacctttctccatct

SEQ ID NO: 330332 - DNA, 25 bp, Homo sapien
cagacgttttactgcatgccagata

SEQ ID NO: 330333 - DNA, 25 bp, Homo sapien
tactgcatgccagataccatgtgca

SEQ ID NO: 330334 - DNA, 25 bp, Homo sapien
gtatttcaaatgtagtgcccgtttc

SEQ ID NO: 330335 - DNA, 25 bp, Homo sapien
tgtagtgcccgtttctttatttctt

SEQ ID NO: 330336 - DNA, 25 bp, Homo sapien
atttctttctggtactttccactgg

SEQ ID NO: 330337 - DNA, 25 bp, Homo sapien
ggtactttccactggtttgtgttga

SEQ ID NO: 330338 - DNA, 25 bp, Homo sapien
cactggtttgtgttgataatatgat

SEQ ID NO: 330339 - DNA, 25 bp, Homo sapien
gataatatgatctggaaggtagcga

SEQ ID NO: 330340 - DNA, 25 bp, Homo sapien
ggtagcgataatgcatgggaattta

SEQ ID NO: 330341 - DNA, 25 bp, Homo sapien
aaaatactttgtcacaggaaatctg

SEQ ID NO: 330342 - DNA, 25 bp, Homo sapien
aatgactttggcatatgtataagag

SEQ ID NO: 330343 - DNA, 25 bp, Homo sapien
gagaagtatctctaactgttaagtc

SEQ ID NO: 330344 - DNA, 25 bp, Homo sapien
gatttgttttctcaggtgtagttgt

SEQ ID NO: 330345 - DNA, 25 bp, Homo sapien
ttcagcaaaatctaggactcccgag

SEQ ID NO: 330346 - DNA, 25 bp, Homo sapien
aaaatctaggactcccgagtggctt

SEQ ID NO: 330347 - DNA, 25 bp, Homo sapien
taggactcccgagtggcttccaggg

SEQ ID NO: 330348 - DNA, 25 bp, Homo sapien
cgggcggcggtgtctgtatgtatgt

SEQ ID NO: 330349 - DNA, 25 bp, Homo sapien
atatgcacatagaccttagagtgta

SEQ ID NO: 330350 - DNA, 25 bp, Homo sapien
gcacatagaccttagagtgtatagt

SEQ ID NO: 330351 - DNA, 25 bp, Homo sapien
gagtgtatagttaacaaacgcccat

SEQ ID NO: 330352 - DNA, 25 bp, Homo sapien
atagttaacaaacgcccatctgctc

SEQ ID NO: 330353 - DNA, 25 bp, Homo sapien
aggcgggtgtgtgaatagcatatat

SEQ ID NO: 330354 - DNA, 25 bp, Homo sapien
catgtactatatctaggtgtgtgta

SEQ ID NO: 330355 - DNA, 25 bp, Homo sapien
actatatctaggtgtgtgtacaagt

SEQ ID NO: 330356 - DNA, 25 bp, Homo sapien
ctgcaaaagccgagatgggttccat

SEQ ID NO: 330357 - DNA, 25 bp, Homo sapien
aaaagccgagatgggttccatgcag

SEQ ID NO: 330358 - DNA, 25 bp, Homo sapien
gatgggttccatgcagttctccagt

SEQ ID NO: 330359 - DNA, 25 bp, Homo sapien
ggttccatgcagttctccagtggga

SEQ ID NO: 330360 - DNA, 25 bp, Homo sapien
ttccatgcagttctccagtgggaca

SEQ ID NO: 330361 - DNA, 25 bp, Homo sapien
catgcagttctccagtgggacatca

SEQ ID NO: 330362 - DNA, 25 bp, Homo sapien
tgcagttctccagtgggacatcagt

SEQ ID NO: 330363 - DNA, 25 bp, Homo sapien
gttctccagtgggacatcagtgctt

SEQ ID NO: 330364 - DNA, 25 bp, Homo sapien
tctccagtgggacatcagtgcttat

SEQ ID NO: 330365 - DNA, 25 bp, Homo sapien
ctccagtgggacatcagtgcttatc

SEQ ID NO: 330366 - DNA, 25 bp, Homo sapien
gtgggacatcagtgcttatccgaat

SEQ ID NO: 330367 - DNA, 25 bp, Homo sapien
caaagggaaaacagttatcacttct

SEQ ID NO: 330368 - DNA, 25 bp, Homo sapien
gaaaattgcgtgtcagcatcggagc

SEQ ID NO: 330369 - DNA, 25 bp, Homo sapien
gtgtcagcatcggagcatgtcagat

SEQ ID NO: 330370 - DNA, 25 bp, Homo sapien
gagcatgtcagattgggagcagcaa

SEQ ID NO: 330371 - DNA, 25 bp, Homo sapien
agcaagagagatttagcccagccct

SEQ ID NO: 330372 - DNA, 25 bp, Homo sapien
agagatttagcccagccctcatctt

SEQ ID NO: 330373 - DNA, 25 bp, Homo sapien
gacccagttgggaaaaggatgttct

SEQ ID NO: 330374 - DNA, 25 bp, Homo sapien
aaggatgttctaaggagggttctga

SEQ ID NO: 330375 - DNA, 25 bp, Homo sapien
tctgcagtgccttggtatctgttat

SEQ ID NO: 330376 - DNA, 25 bp, Homo sapien
agtgccttggtatctgttatttatt

SEQ ID NO: 330377 - DNA, 25 bp, Homo sapien
taccaagtcttaagttcctttagtg

SEQ ID NO: 330378 - DNA, 25 bp, Homo sapien
gaatacttcatgcaggtaaccagac

SEQ ID NO: 330379 - DNA, 25 bp, Homo sapien
gacaatatcgagagatgcggacttc

SEQ ID NO: 330380 - DNA, 25 bp, Homo sapien
gatgcggacttctactcaacgagag

SEQ ID NO: 330381 - DNA, 25 bp, Homo sapien
atgaatcctggatgcgcttgatttc

SEQ ID NO: 330382 - DNA, 25 bp, Homo sapien
gatgcgcttgatttcttgtttcccg

SEQ ID NO: 330383 - DNA, 25 bp, Homo sapien
gccgctcgtcagttaattgcgatca

SEQ ID NO: 330384 - DNA, 25 bp, Homo sapien
ttgtttcccgcatgttgttagacct

SEQ ID NO: 330385 - DNA, 25 bp, Homo sapien
gttgttagacctctccctaaagcca

SEQ ID NO: 330386 - DNA, 25 bp, Homo sapien
attttgagcgattctgttattgtac

SEQ ID NO: 330387 - DNA, 25 bp, Homo sapien
gatcacttactcaaatggccaactg

SEQ ID NO: 330388 - DNA, 25 bp, Homo sapien
gaagccagagtgcacatgaatgtcc

SEQ ID NO: 330389 - DNA, 25 bp, Homo sapien
gggctttggatccttgtgaatttca

SEQ ID NO: 330390 - DNA, 25 bp, Homo sapien
atccttgtgaatttcagctcctcca

SEQ ID NO: 330391 - DNA, 25 bp, Homo sapien
ctccaaggcttgaggaaagaattca

SEQ ID NO: 330392 - DNA, 25 bp, Homo sapien
aaaggtccagtggagcctcgtggaa

SEQ ID NO: 330393 - DNA, 25 bp, Homo sapien
tcgtggaagcgcagagcagtgctcc

SEQ ID NO: 330394 - DNA, 25 bp, Homo sapien
agtgctccagcaggaggaccctcag

SEQ ID NO: 330395 - DNA, 25 bp, Homo sapien
agagccctcggcaacaaggatgaga

SEQ ID NO: 330396 - DNA, 25 bp, Homo sapien
ggatgagactggaacaatagagaca

SEQ ID NO: 330397 - DNA, 25 bp, Homo sapien
tctgcctgagaagccgtaagctcac

SEQ ID NO: 330398 - DNA, 25 bp, Homo sapien
aagccgtaagctcacgtccctaaag

SEQ ID NO: 330399 - DNA, 25 bp, Homo sapien
acgtccctaaagctccgcagcaggg

SEQ ID NO: 330400 - DNA, 25 bp, Homo sapien
gggctccgggtatccaaagaatggt

SEQ ID NO: 330401 - DNA, 25 bp, Homo sapien
agaatggtctagaggtgggaacaca

SEQ ID NO: 330402 - DNA, 25 bp, Homo sapien
gggaacacaggctcttgccttgctt

SEQ ID NO: 330403 - DNA, 25 bp, Homo sapien
cttgccttgcttctgcagactactt

SEQ ID NO: 330404 - DNA, 25 bp, Homo sapien
cccaagcaggctctctaaggctgag

SEQ ID NO: 330405 - DNA, 25 bp, Homo sapien
agcaggctctctaaggctgaggcca

SEQ ID NO: 330406 - DNA, 25 bp, Homo sapien
cctcagtgcgcatgtctaaggcgta

SEQ ID NO: 330407 - DNA, 25 bp, Homo sapien
catgtctaaggcgtaactgcagaaa

SEQ ID NO: 330408 - DNA, 25 bp, Homo sapien
ggaggagattaaggcagagtcatta

SEQ ID NO: 330409 - DNA, 25 bp, Homo sapien
agtcattaagactgcctagttcatt

SEQ ID NO: 330410 - DNA, 25 bp, Homo sapien
ttaagactgcctagttcattttggg

SEQ ID NO: 330411 - DNA, 25 bp, Homo sapien
ggctatctaatttgtagaactctga

SEQ ID NO: 330412 - DNA, 25 bp, Homo sapien
agaactctgagtggtttaattgaga

SEQ ID NO: 330413 - DNA, 25 bp, Homo sapien
aaatttcattatatgggactggcac

SEQ ID NO: 330414 - DNA, 25 bp, Homo sapien
ggactggcacagaattgatgttcaa

SEQ ID NO: 330415 - DNA, 25 bp, Homo sapien
gttcaatatgtgttagtttcagttc

SEQ ID NO: 330416 - DNA, 25 bp, Homo sapien
gttctatttatccaacatctgtgag

SEQ ID NO: 330417 - DNA, 25 bp, Homo sapien
gtgacgattatgtgcatctccatcc

SEQ ID NO: 330418 - DNA, 25 bp, Homo sapien
atctccatccagtcagccttaatga

SEQ ID NO: 330419 - DNA, 25 bp, Homo sapien
catccagtcagccttaatgagtaag

SEQ ID NO: 330420 - DNA, 25 bp, Homo sapien
gctcttgtatcccttcatgtcagaa

SEQ ID NO: 330421 - DNA, 25 bp, Homo sapien
gtatcccttcatgtcagaacaataa

SEQ ID NO: 330422 - DNA, 25 bp, Homo sapien
tggaagaacttaaccagctggaaaa

SEQ ID NO: 330423 - DNA, 25 bp, Homo sapien
gattctgagacgtcctatgctgtag

SEQ ID NO: 330424 - DNA, 25 bp, Homo sapien
acgtcctatgctgtagatggtctat

SEQ ID NO: 330425 - DNA, 25 bp, Homo sapien
tagatggtctattctcttctcatcc

SEQ ID NO: 330426 - DNA, 25 bp, Homo sapien
attctcttctcatcctagcaaacga

SEQ ID NO: 330427 - DNA, 25 bp, Homo sapien
cttctcatcctagcaaacgagcttg

SEQ ID NO: 330428 - DNA, 25 bp, Homo sapien
ctagcaaacgagcttgctttggaaa

SEQ ID NO: 330429 - DNA, 25 bp, Homo sapien
gtttaaagctttttctctggatgca

SEQ ID NO: 330430 - DNA, 25 bp, Homo sapien
taaagctttttctctggatgcaaaa

SEQ ID NO: 330431 - DNA, 25 bp, Homo sapien
atatgtatctactcactctgctgta

SEQ ID NO: 330432 - DNA, 25 bp, Homo sapien
tatctactcactctgctgtaggcag

SEQ ID NO: 330433 - DNA, 25 bp, Homo sapien
tttagtgagcagtgattggccttca

SEQ ID NO: 330434 - DNA, 25 bp, Homo sapien
attggccttcaatacttgtgctgag

SEQ ID NO: 330435 - DNA, 25 bp, Homo sapien
taagaaaatgttcccattcaggaga

SEQ ID NO: 330436 - DNA, 25 bp, Homo sapien
ttgtgttggagtttctttcttcctc

SEQ ID NO: 330437 - DNA, 25 bp, Homo sapien
tttgtggtgtccacctttaaccacg

SEQ ID NO: 330438 - DNA, 25 bp, Homo sapien
gtgtccacctttaaccacgtttcat

SEQ ID NO: 330439 - DNA, 25 bp, Homo sapien
gtttcatccaaaacgatgatgcagc

SEQ ID NO: 330440 - DNA, 25 bp, Homo sapien
agagccgagggtctgccctgtccta

SEQ ID NO: 330441 - DNA, 25 bp, Homo sapien
tgccctgtcctaggttaggtcttca

SEQ ID NO: 330442 - DNA, 25 bp, Homo sapien
tcctaggttaggtcttcatggttta

SEQ ID NO: 330443 - DNA, 25 bp, Homo sapien
ccgtgagggatgttaattatgggca

SEQ ID NO: 330444 - DNA, 25 bp, Homo sapien
tgctgtcatttgaaatgactccctc

SEQ ID NO: 330445 - DNA, 25 bp, Homo sapien
aacctagttttattagccagctgcc

SEQ ID NO: 330446 - DNA, 25 bp, Homo sapien
gttttattagccagctgcctctgct

SEQ ID NO: 330447 - DNA, 25 bp, Homo sapien
tgcctctgctgtagtacatggccaa

SEQ ID NO: 330448 - DNA, 25 bp, Homo sapien
gctgtagtacatggccaacttcaac

SEQ ID NO: 330449 - DNA, 25 bp, Homo sapien
ggtgcatacccccaacataagttac

SEQ ID NO: 330450 - DNA, 25 bp, Homo sapien
aagttacacagtcccacatccaggt

SEQ ID NO: 330451 - DNA, 25 bp, Homo sapien
acagtcccacatccaggtgcacaga

SEQ ID NO: 330452 - DNA, 25 bp, Homo sapien
cagagtgcgagtgcactccgcgagt

SEQ ID NO: 330453 - DNA, 25 bp, Homo sapien
agcagagaccgcagcacagaaatgc

SEQ ID NO: 330454 - DNA, 25 bp, Homo sapien
agaccgcagcacagaaatgcaaggt

SEQ ID NO: 330455 - DNA, 25 bp, Homo sapien
agttgtttactgctagaaattttat

SEQ ID NO: 330456 - DNA, 25 bp, Homo sapien
aattagttgatactcttggttaggt

SEQ ID NO: 330457 - DNA, 25 bp, Homo sapien
aatggttttatctccattatgctgt

SEQ ID NO: 330458 - DNA, 25 bp, Homo sapien
ccattatgctgtgatagggaagagt

SEQ ID NO: 330459 - DNA, 25 bp, Homo sapien
atggcaaaggcatacctgacaatta

SEQ ID NO: 330460 - DNA, 25 bp, Homo sapien
aaggctaatacttcctgaacacaag

SEQ ID NO: 330461 - DNA, 25 bp, Homo sapien
cctgaacacaagaagacaagtctct

SEQ ID NO: 330462 - DNA, 25 bp, Homo sapien
aagtctctacttgatactactctcc

SEQ ID NO: 330463 - DNA, 25 bp, Homo sapien
acttgatactactctccacagttaa

SEQ ID NO: 330464 - DNA, 25 bp, Homo sapien
actctccacagttaaatcattgata

SEQ ID NO: 330465 - DNA, 25 bp, Homo sapien
atcattgatactttgtgccatacag

SEQ ID NO: 330466 - DNA, 25 bp, Homo sapien
agcacgagtcccagatggacagtgt

SEQ ID NO: 330467 - DNA, 25 bp, Homo sapien
agtcccagatggacagtgtggtcaa

SEQ ID NO: 330468 - DNA, 25 bp, Homo sapien
gatggacagtgtggtcaaggacctt

SEQ ID NO: 330469 - DNA, 25 bp, Homo sapien
ggacagtgtggtcaaggaccttaaa

SEQ ID NO: 330470 - DNA, 25 bp, Homo sapien
gtgtggtcaaggaccttaaagacaa

SEQ ID NO: 330471 - DNA, 25 bp, Homo sapien
aaagagactgcagatgccatcacta

SEQ ID NO: 330472 - DNA, 25 bp, Homo sapien
gagactgcagatgccatcactaaag

SEQ ID NO: 330473 - DNA, 25 bp, Homo sapien
tgcagatgccatcactaaagaagcg

SEQ ID NO: 330474 - DNA, 25 bp, Homo sapien
gatgccatcactaaagaagcgaaga

SEQ ID NO: 330475 - DNA, 25 bp, Homo sapien
gaagcgaagaaagctaccgtgaatt

SEQ ID NO: 330476 - DNA, 25 bp, Homo sapien
aagaaagctaccgtgaatttactgg

SEQ ID NO: 330477 - DNA, 25 bp, Homo sapien
gtccatgatttggaatcgtggccca

SEQ ID NO: 330478 - DNA, 25 bp, Homo sapien
ggaatcgtggcccaatacttcctgg

SEQ ID NO: 330479 - DNA, 25 bp, Homo sapien
actcaaagtgccaactcatttcctt

SEQ ID NO: 330480 - DNA, 25 bp, Homo sapien
atttccttcccagaattaatcactt

SEQ ID NO: 330481 - DNA, 25 bp, Homo sapien
acttcccaaaatgtatgactgtgtg

SEQ ID NO: 330482 - DNA, 25 bp, Homo sapien
ctcaggctgtcatcttaccctatga

SEQ ID NO: 330483 - DNA, 25 bp, Homo sapien
tatgaccccaacctgacaatcatgc

SEQ ID NO: 330484 - DNA, 25 bp, Homo sapien
gacaatcatgcaacagcccattatt

SEQ ID NO: 330485 - DNA, 25 bp, Homo sapien
cagcccattattggtaccttttcca

SEQ ID NO: 330486 - DNA, 25 bp, Homo sapien
gtttaggtgactcattcttatctac

SEQ ID NO: 330487 - DNA, 25 bp, Homo sapien
acaatcactttgttgttctaggaaa

SEQ ID NO: 330488 - DNA, 25 bp, Homo sapien
tctggttggcctctcacttggtgtc

SEQ ID NO: 330489 - DNA, 25 bp, Homo sapien
aaggtggctctttccagagctgggt

SEQ ID NO: 330490 - DNA, 25 bp, Homo sapien
ccagagctgggttcgtaggtttctt

SEQ ID NO: 330491 - DNA, 25 bp, Homo sapien
tattttcctccttacaacgtcttat

SEQ ID NO: 330492 - DNA, 25 bp, Homo sapien
acaacgtcttatgcagaggtttcta

SEQ ID NO: 330493 - DNA, 25 bp, Homo sapien
gaggtttctaatggtcagcgtttcc

SEQ ID NO: 330494 - DNA, 25 bp, Homo sapien
tggtggcttgtcttcacctctattc

SEQ ID NO: 330495 - DNA, 25 bp, Homo sapien
tcacctctattcttgctggaatttc

SEQ ID NO: 330496 - DNA, 25 bp, Homo sapien
ttgctggaatttccacctcaccagg

SEQ ID NO: 330497 - DNA, 25 bp, Homo sapien
ggagagtagctcctgaaatcagcaa

SEQ ID NO: 330498 - DNA, 25 bp, Homo sapien
cacggtgggtctggttggcctctca

SEQ ID NO: 330499 - DNA, 25 bp, Homo sapien
ggactctgccttgctgctaagtgtc

SEQ ID NO: 330500 - DNA, 25 bp, Homo sapien
tgccttgctgctaagtgtctgactt

SEQ ID NO: 330501 - DNA, 25 bp, Homo sapien
cttgctgctaagtgtctgacttgag

SEQ ID NO: 330502 - DNA, 25 bp, Homo sapien
tctgacttgagacatgctatcgagt

SEQ ID NO: 330503 - DNA, 25 bp, Homo sapien
acttgagacatgctatcgagtttct

SEQ ID NO: 330504 - DNA, 25 bp, Homo sapien
atctcttccttgtgtaaaatgtggt

SEQ ID NO: 330505 - DNA, 25 bp, Homo sapien
cttccttgtgtaaaatgtggttgtc

SEQ ID NO: 330506 - DNA, 25 bp, Homo sapien
tgtggttgtcgatgattaccttaca

SEQ ID NO: 330507 - DNA, 25 bp, Homo sapien
ggttgtcgatgattaccttacaggg

SEQ ID NO: 330508 - DNA, 25 bp, Homo sapien
agactaaatgagatcgtgtacatta

SEQ ID NO: 330509 - DNA, 25 bp, Homo sapien
atcgtgtacattaaatacaggcact

SEQ ID NO: 330510 - DNA, 25 bp, Homo sapien
gtatgttacgtttatgttcccctgc

SEQ ID NO: 330511 - DNA, 25 bp, Homo sapien
tttatgttcccctgctttctacaat

SEQ ID NO: 330512 - DNA, 25 bp, Homo sapien
agagttgctgacttaaccacagaga

SEQ ID NO: 330513 - DNA, 25 bp, Homo sapien
cttgagcaatcatagtccatccact

SEQ ID NO: 330514 - DNA, 25 bp, Homo sapien
catccacttcattgtctcatcaaaa

SEQ ID NO: 330515 - DNA, 25 bp, Homo sapien
aaaaccaaaggtccagtgaagctct

SEQ ID NO: 330516 - DNA, 25 bp, Homo sapien
gaagctctggaactcaacgctgtaa

SEQ ID NO: 330517 - DNA, 25 bp, Homo sapien
aggagcttctatacagagcctggat

SEQ ID NO: 330518 - DNA, 25 bp, Homo sapien
tggatgcctgtctccttattctact

SEQ ID NO: 330519 - DNA, 25 bp, Homo sapien
ccttattctacttcagtggacttga

SEQ ID NO: 330520 - DNA, 25 bp, Homo sapien
gtggacttgactgcaatccggatta

SEQ ID NO: 330521 - DNA, 25 bp, Homo sapien
tggctctccttgtagcagattcagt

SEQ ID NO: 330522 - DNA, 25 bp, Homo sapien
tgtagcagattcagtccacagacct

SEQ ID NO: 330523 - DNA, 25 bp, Homo sapien
gacaagtatgctgtgaattcaacct

SEQ ID NO: 330524 - DNA, 25 bp, Homo sapien
gaattcaacctttggacttgctgcc

SEQ ID NO: 330525 - DNA, 25 bp, Homo sapien
gttgctgccctgactattgtaagag

SEQ ID NO: 330526 - DNA, 25 bp, Homo sapien
acttacctggtttgtttgagaatga

SEQ ID NO: 330527 - DNA, 25 bp, Homo sapien
gagaatgaccattttcctaatgtga

SEQ ID NO: 330528 - DNA, 25 bp, Homo sapien
ttcctaatgtgaaaaccatctctct

SEQ ID NO: 330529 - DNA, 25 bp, Homo sapien
ttttccgttataaatggttgagcaa

SEQ ID NO: 330530 - DNA, 25 bp, Homo sapien
taacacagtgtcattatcttgcaat

SEQ ID NO: 330531 - DNA, 25 bp, Homo sapien
atataaactggtaacctcacaactc

SEQ ID NO: 330532 - DNA, 25 bp, Homo sapien
tagaccatttggcatcggctcctgt

SEQ ID NO: 330533 - DNA, 25 bp, Homo sapien
tttccattgcctgccttagaaactg

SEQ ID NO: 330534 - DNA, 25 bp, Homo sapien
gaaactggctggtccaatgggattt

SEQ ID NO: 330535 - DNA, 25 bp, Homo sapien
ggtccaatgggatttacagcaacat

SEQ ID NO: 330536 - DNA, 25 bp, Homo sapien
aacattttccattgctgaagtgagg

SEQ ID NO: 330537 - DNA, 25 bp, Homo sapien
aagtgaggtagcagctctcttctgt

SEQ ID NO: 330538 - DNA, 25 bp, Homo sapien
gctctcttctgtcagctgaatgtta

SEQ ID NO: 330539 - DNA, 25 bp, Homo sapien
aagtttgctcttaatcgtatggaag

SEQ ID NO: 330540 - DNA, 25 bp, Homo sapien
ttgagctatgtgttggaagtgccct

SEQ ID NO: 330541 - DNA, 25 bp, Homo sapien
taatccatacacaaagacggtacat

SEQ ID NO: 330542 - DNA, 25 bp, Homo sapien
gtttggaattctttgctctactgtt

SEQ ID NO: 330543 - DNA, 25 bp, Homo sapien
ttactggttttcacccacgcttttg

SEQ ID NO: 330544 - DNA, 25 bp, Homo sapien
tttcacccacgcttttgtgggagag

SEQ ID NO: 330545 - DNA, 25 bp, Homo sapien
gtaattgctacagttccataattaa

SEQ ID NO: 330546 - DNA, 25 bp, Homo sapien
gttccataattaactggaggtcagc

SEQ ID NO: 330547 - DNA, 25 bp, Homo sapien
ggaggtcagcagtaaaataatttgt

SEQ ID NO: 330548 - DNA, 25 bp, Homo sapien
ataacagtaagccaggttcaccaga

SEQ ID NO: 330549 - DNA, 25 bp, Homo sapien
gtaagccaggttcaccagaggaaat

SEQ ID NO: 330550 - DNA, 25 bp, Homo sapien
aatacctaagtataaagcagcaaag

SEQ ID NO: 330551 - DNA, 25 bp, Homo sapien
gcagcaaagaaatgtcacctgtagt

SEQ ID NO: 330552 - DNA, 25 bp, Homo sapien
acctgtagtcccattattcagcggg

SEQ ID NO: 330553 - DNA, 25 bp, Homo sapien
tcccattattcagcgggtgagtata

SEQ ID NO: 330554 - DNA, 25 bp, Homo sapien
taactttggcccacgctgccagcct

SEQ ID NO: 330555 - DNA, 25 bp, Homo sapien
tcctgaggagcggaacagcagtctc

SEQ ID NO: 330556 - DNA, 25 bp, Homo sapien
gagcggaacagcagtctccaggacg

SEQ ID NO: 330557 - DNA, 25 bp, Homo sapien
ggaacagcagtctccaggacgcgag

SEQ ID NO: 330558 - DNA, 25 bp, Homo sapien
agcagtctccaggacgcgaggcctt

SEQ ID NO: 330559 - DNA, 25 bp, Homo sapien
tacgtggagccctacgcagcggccg

SEQ ID NO: 330560 - DNA, 25 bp, Homo sapien
gtggtggcccaggacgaaaaaccat

SEQ ID NO: 330561 - DNA, 25 bp, Homo sapien
gacgaaaaaccatgggcaagcttga

SEQ ID NO: 330562 - DNA, 25 bp, Homo sapien
cactggccccgatgtgagtcaggag

SEQ ID NO: 330563 - DNA, 25 bp, Homo sapien
cgatgtgagtcaggagggccccacc

SEQ ID NO: 330564 - DNA, 25 bp, Homo sapien
ggccctgcccttgatgatcccaggg

SEQ ID NO: 330565 - DNA, 25 bp, Homo sapien
ttctcccagcatgttagctgagaat

SEQ ID NO: 330566 - DNA, 25 bp, Homo sapien
atgaagtaggttggtctctctgctt

SEQ ID NO: 330567 - DNA, 25 bp, Homo sapien
tgcttctctataccaggacttctta

SEQ ID NO: 330568 - DNA, 25 bp, Homo sapien
ggacttcttagctcagtatcatctc

SEQ ID NO: 330569 - DNA, 25 bp, Homo sapien
gtatcatctcccttcatgtaagcag

SEQ ID NO: 330570 - DNA, 25 bp, Homo sapien
catgtaagcagcacgttttaactct

SEQ ID NO: 330571 - DNA, 25 bp, Homo sapien
gcacgttttaactcttaggaagctg

SEQ ID NO: 330572 - DNA, 25 bp, Homo sapien
gaagctgaatgttgtgttatcacta

SEQ ID NO: 330573 - DNA, 25 bp, Homo sapien
taatactttgtacaggtcacctgcc

SEQ ID NO: 330574 - DNA, 25 bp, Homo sapien
acctgcctactctaattgtccttag

SEQ ID NO: 330575 - DNA, 25 bp, Homo sapien
tccttagtacttggacaggctttat

SEQ ID NO: 330576 - DNA, 25 bp, Homo sapien
tgtgctgttgctggaaagaatgaga

SEQ ID NO: 330577 - DNA, 25 bp, Homo sapien
aaaccgtgtctagggaaggcgatgc

SEQ ID NO: 330578 - DNA, 25 bp, Homo sapien
aaaaggaagcactctgcttgcccag

SEQ ID NO: 330579 - DNA, 25 bp, Homo sapien
tctgcttgcccagaggctggaagga

SEQ ID NO: 330580 - DNA, 25 bp, Homo sapien
tgcctggctaagacctgcggtattc

SEQ ID NO: 330581 - DNA, 25 bp, Homo sapien
aagacctgcggtattcgggagcgtc

SEQ ID NO: 330582 - DNA, 25 bp, Homo sapien
tattcgggagcgtctgcacgcaagt

SEQ ID NO: 330583 - DNA, 25 bp, Homo sapien
gcgtctgcacgcaagtgttcagtgt

SEQ ID NO: 330584 - DNA, 25 bp, Homo sapien
cagcacaacggcagcgcaagcaggc

SEQ ID NO: 330585 - DNA, 25 bp, Homo sapien
aagcaggctcgctgtcttgtgggcc

SEQ ID NO: 330586 - DNA, 25 bp, Homo sapien
acacacagccagtctgagctctgtc

SEQ ID NO: 330587 - DNA, 25 bp, Homo sapien
tcatgctcaccaactcgctggagga

SEQ ID NO: 330588 - DNA, 25 bp, Homo sapien
accaactcgctggaggagatgaagc

SEQ ID NO: 330589 - DNA, 25 bp, Homo sapien
aactcgctggaggagatgaagcgac

SEQ ID NO: 330590 - DNA, 25 bp, Homo sapien
atgaagcgactggtgagcgagatct

SEQ ID NO: 330591 - DNA, 25 bp, Homo sapien
tgaagcgactggtgagcgagatcta

SEQ ID NO: 330592 - DNA, 25 bp, Homo sapien
gaagcgactggtgagcgagatctac

SEQ ID NO: 330593 - DNA, 25 bp, Homo sapien
aagcgactggtgagcgagatctacg

SEQ ID NO: 330594 - DNA, 25 bp, Homo sapien
tgcagccgcggctgtgtccagcgcc

SEQ ID NO: 330595 - DNA, 25 bp, Homo sapien
gcggctgtgtccagcgcctctctgc

SEQ ID NO: 330596 - DNA, 25 bp, Homo sapien
ccggatccgggctgccgtcggtcgg

SEQ ID NO: 330597 - DNA, 25 bp, Homo sapien
gctgccgtcggtcggctccatccgt

SEQ ID NO: 330598 - DNA, 25 bp, Homo sapien
cttttttggtggttcgagaatgtca

SEQ ID NO: 330599 - DNA, 25 bp, Homo sapien
tttggtggttcgagaatgtcaagcc

SEQ ID NO: 330600 - DNA, 25 bp, Homo sapien
ggttcgagaatgtcaagccagattt

SEQ ID NO: 330601 - DNA, 25 bp, Homo sapien
gaatgtcaagccagattttgttcag

SEQ ID NO: 330602 - DNA, 25 bp, Homo sapien
gtcaagccagattttgttcagccca

SEQ ID NO: 330603 - DNA, 25 bp, Homo sapien
caagccagattttgttcagcccagg

SEQ ID NO: 330604 - DNA, 25 bp, Homo sapien
agccagattttgttcagcccaggga

SEQ ID NO: 330605 - DNA, 25 bp, Homo sapien
ccagattttgttcagcccagggatg

SEQ ID NO: 330606 - DNA, 25 bp, Homo sapien
agattttgttcagcccagggatgtt

SEQ ID NO: 330607 - DNA, 25 bp, Homo sapien
ttttgttcagcccagggatgttcag

SEQ ID NO: 330608 - DNA, 25 bp, Homo sapien
ttgttcagcccagggatgttcagga

SEQ ID NO: 330609 - DNA, 25 bp, Homo sapien
agtactaggtcaggtggtgctcccg

SEQ ID NO: 330610 - DNA, 25 bp, Homo sapien
tgctcccgggtgaggagctgctcct

SEQ ID NO: 330611 - DNA, 25 bp, Homo sapien
tgctcctgccggaacaggaggacgc

SEQ ID NO: 330612 - DNA, 25 bp, Homo sapien
agtggagcgaccgttgagcctgaat

SEQ ID NO: 330613 - DNA, 25 bp, Homo sapien
agcctgaatgctagagcgtgctcgc

SEQ ID NO: 330614 - DNA, 25 bp, Homo sapien
cgtttgtatgcggtccgggccttcg

SEQ ID NO: 330615 - DNA, 25 bp, Homo sapien
tggagcccgcgatggccgaacctgc

SEQ ID NO: 330616 - DNA, 25 bp, Homo sapien
gaacctgcgtctgtcgcggctgaat

SEQ ID NO: 330617 - DNA, 25 bp, Homo sapien
cggctgaatctctcgcgggcagcag

SEQ ID NO: 330618 - DNA, 25 bp, Homo sapien
cagggcgcgcgctgcacgcacagta

SEQ ID NO: 330619 - DNA, 25 bp, Homo sapien
gcgctgcacgcacagtactaggtca

SEQ ID NO: 330620 - DNA, 25 bp, Homo sapien
ttcctgatttggtttcatatgctcc

SEQ ID NO: 330621 - DNA, 25 bp, Homo sapien
gatttggtttcatatgctcctcaca

SEQ ID NO: 330622 - DNA, 25 bp, Homo sapien
ggtttcatatgctcctcacaacaac

SEQ ID NO: 330623 - DNA, 25 bp, Homo sapien
aaccctgtgaggtggtccgttggca

SEQ ID NO: 330624 - DNA, 25 bp, Homo sapien
gtccgttggcagaagctggtatgac

SEQ ID NO: 330625 - DNA, 25 bp, Homo sapien
gcagaagctggtatgactggcagtt

SEQ ID NO: 330626 - DNA, 25 bp, Homo sapien
tatgactggcagttgtctcgctaga

SEQ ID NO: 330627 - DNA, 25 bp, Homo sapien
gactggcagttgtctcgctagagga

SEQ ID NO: 330628 - DNA, 25 bp, Homo sapien
gttgtctcgctagaggaaccttcta

SEQ ID NO: 330629 - DNA, 25 bp, Homo sapien
ctcgctagaggaaccttctacttca

SEQ ID NO: 330630 - DNA, 25 bp, Homo sapien
aaccttctacttcataccataatta

SEQ ID NO: 330631 - DNA, 25 bp, Homo sapien
tctcaggactcttctggccgtaggt

SEQ ID NO: 330632 - DNA, 25 bp, Homo sapien
actcttctggccgtaggttccagga

SEQ ID NO: 330633 - DNA, 25 bp, Homo sapien
gttccaggaaagctcgtggaagctt

SEQ ID NO: 330634 - DNA, 25 bp, Homo sapien
aaatcatgtgactgtcacgtgctgg

SEQ ID NO: 330635 - DNA, 25 bp, Homo sapien
gtgactgtcacgtgctggaaaataa

SEQ ID NO: 330636 - DNA, 25 bp, Homo sapien
gccatcactctttttggatcattta

SEQ ID NO: 330637 - DNA, 25 bp, Homo sapien
actctttttggatcatttaggtctc

SEQ ID NO: 330638 - DNA, 25 bp, Homo sapien
gatcatttaggtctcttgtatcctt

SEQ ID NO: 330639 - DNA, 25 bp, Homo sapien
aggtctcttgtatcctttgttttag

SEQ ID NO: 330640 - DNA, 25 bp, Homo sapien
gaaccagtttcattaaagttgcctt

SEQ ID NO: 330641 - DNA, 25 bp, Homo sapien
agtttcattaaagttgccttcctgg

SEQ ID NO: 330642 - DNA, 25 bp, Homo sapien
acagtactaggtcaggtggtgctcc

SEQ ID NO: 330643 - DNA, 25 bp, Homo sapien
cagtactaggtcaggtggtgctccc

SEQ ID NO: 330644 - DNA, 25 bp, Homo sapien
agtactaggtcaggtggtgctcccg

SEQ ID NO: 330645 - DNA, 25 bp, Homo sapien
tgctcctgccggaacaggaggacgc

SEQ ID NO: 330646 - DNA, 25 bp, Homo sapien
agtggagcgaccgttgagcctgaat

SEQ ID NO: 330647 - DNA, 25 bp, Homo sapien
tggagcgaccgttgagcctgaatgc

SEQ ID NO: 330648 - DNA, 25 bp, Homo sapien
ggagcgaccgttgagcctgaatgct

SEQ ID NO: 330649 - DNA, 25 bp, Homo sapien
agcctgaatgctagagcgtgctcgc

SEQ ID NO: 330650 - DNA, 25 bp, Homo sapien
gcctgaatgctagagcgtgctcgcg

SEQ ID NO: 330651 - DNA, 25 bp, Homo sapien
cctgaatgctagagcgtgctcgcgg

SEQ ID NO: 330652 - DNA, 25 bp, Homo sapien
ctagagcgtgctcgcgggtgcgcgt

SEQ ID NO: 330653 - DNA, 25 bp, Homo sapien
agtagccgctgtgacagtgctcact

SEQ ID NO: 330654 - DNA, 25 bp, Homo sapien
agtgctcactgctggcagtttccaa

SEQ ID NO: 330655 - DNA, 25 bp, Homo sapien
gcagtttccaaatctccagaggagt

SEQ ID NO: 330656 - DNA, 25 bp, Homo sapien
gaggagttccttagatccttcaaag

SEQ ID NO: 330657 - DNA, 25 bp, Homo sapien
ggaaccttccagtgtgttcttcaca

SEQ ID NO: 330658 - DNA, 25 bp, Homo sapien
gtgttcttcacacctgatgtgcgtc

SEQ ID NO: 330659 - DNA, 25 bp, Homo sapien
atgtgcgtcctcacacctgatgagt

SEQ ID NO: 330660 - DNA, 25 bp, Homo sapien
ctgtgctttggtgttagaggactca

SEQ ID NO: 330661 - DNA, 25 bp, Homo sapien
gggctggacctgagtgtttttctaa

SEQ ID NO: 330662 - DNA, 25 bp, Homo sapien
tctaagtgtggctaccgctgacggg

SEQ ID NO: 330663 - DNA, 25 bp, Homo sapien
tcccacggagcagcaaggccagtag

SEQ ID NO: 330664 - DNA, 25 bp, Homo sapien
tgcatggtttgacccgcaggactat

SEQ ID NO: 330665 - DNA, 25 bp, Homo sapien
aggactattactttctctgttctga

SEQ ID NO: 330666 - DNA, 25 bp, Homo sapien
ctgaactggagttgcatcacactgt

SEQ ID NO: 330667 - DNA, 25 bp, Homo sapien
gcatcacactgttgactcatatgga

SEQ ID NO: 330668 - DNA, 25 bp, Homo sapien
tttgacgtggtctactgatggtggt

SEQ ID NO: 330669 - DNA, 25 bp, Homo sapien
atggtggtgagtcatctttctccca

SEQ ID NO: 330670 - DNA, 25 bp, Homo sapien
tgtactcagtacttaagccaagatg

SEQ ID NO: 330671 - DNA, 25 bp, Homo sapien
actgtctctcattattctagctgct

SEQ ID NO: 330672 - DNA, 25 bp, Homo sapien
cattattctagctgctttcctgtgg

SEQ ID NO: 330673 - DNA, 25 bp, Homo sapien
caccctctcttaaaggatggccaat

SEQ ID NO: 330674 - DNA, 25 bp, Homo sapien
gctggatcacaaatctcctgcatgg

SEQ ID NO: 330675 - DNA, 25 bp, Homo sapien
gctttaactgtggtcatacatgtat

SEQ ID NO: 330676 - DNA, 25 bp, Homo sapien
tgcagcctactcttttactaacctt

SEQ ID NO: 330677 - DNA, 25 bp, Homo sapien
actttagtgtgagctgttggtttta

SEQ ID NO: 330678 - DNA, 25 bp, Homo sapien
atattattctatgcacttttgtaag

SEQ ID NO: 330679 - DNA, 25 bp, Homo sapien
atgagcagattggtcaactgacatt

SEQ ID NO: 330680 - DNA, 25 bp, Homo sapien
ggtcaactgacatttttgattattt

SEQ ID NO: 330681 - DNA, 25 bp, Homo sapien
gtaatacatgtgttgcttggaataa

SEQ ID NO: 330682 - DNA, 25 bp, Homo sapien
ttactaacctttctggactagatct

SEQ ID NO: 330683 - DNA, 25 bp, Homo sapien
ggactagatctttgaagtgcgtctt

SEQ ID NO: 330684 - DNA, 25 bp, Homo sapien
ttgaagtgcgtcttagctttcctcc

SEQ ID NO: 330685 - DNA, 25 bp, Homo sapien
gatagtgctgctttaactgtggtca

SEQ ID NO: 330686 - DNA, 25 bp, Homo sapien
taggcacccctaggctactttgatc

SEQ ID NO: 330687 - DNA, 25 bp, Homo sapien
tactttgatctctgtagacttgcct

SEQ ID NO: 330688 - DNA, 25 bp, Homo sapien
tctctgtagacttgcctcttctgga

SEQ ID NO: 330689 - DNA, 25 bp, Homo sapien
gcctcttctggacatgacatagaga

SEQ ID NO: 330690 - DNA, 25 bp, Homo sapien
gtcataaattctccaaggtgtctgt

SEQ ID NO: 330691 - DNA, 25 bp, Homo sapien
aattctccaaggtgtctgtttcttc

SEQ ID NO: 330692 - DNA, 25 bp, Homo sapien
tgggcccagtctcacactggtcctt

SEQ ID NO: 330693 - DNA, 25 bp, Homo sapien
ggtccttgcttaccctaaatgctat

SEQ ID NO: 330694 - DNA, 25 bp, Homo sapien
gcttaccctaaatgctattaattcc

SEQ ID NO: 330695 - DNA, 25 bp, Homo sapien
atcagcacagtcagtcttagagttt

SEQ ID NO: 330696 - DNA, 25 bp, Homo sapien
cagtcagtcttagagtttactaccc

SEQ ID NO: 330697 - DNA, 25 bp, Homo sapien
gacattattacttccatgttacaga

SEQ ID NO: 330698 - DNA, 25 bp, Homo sapien
ggagtggcaaagtgacttccctcag

SEQ ID NO: 330699 - DNA, 25 bp, Homo sapien
aaagtgacttccctcagggcactgg

SEQ ID NO: 330700 - DNA, 25 bp, Homo sapien
tggccggtatctgcacccagctttg

SEQ ID NO: 330701 - DNA, 25 bp, Homo sapien
tgttggccatgctcctgtctaaccg

SEQ ID NO: 330702 - DNA, 25 bp, Homo sapien
gaaatgcaggccaggcaccctccta

SEQ ID NO: 330703 - DNA, 25 bp, Homo sapien
taccagactcttttgcaatactgtg

SEQ ID NO: 330704 - DNA, 25 bp, Homo sapien
gcaatactgtggtgccaggcagcaa

SEQ ID NO: 330705 - DNA, 25 bp, Homo sapien
caggcagcaaatatccggcaaatgt

SEQ ID NO: 330706 - DNA, 25 bp, Homo sapien
gcaaatgtagactgcattgatcctc

SEQ ID NO: 330707 - DNA, 25 bp, Homo sapien
ttgatcctcctgaccttagtgacat

SEQ ID NO: 330708 - DNA, 25 bp, Homo sapien
atatctcagtctctagtccagcgtg

SEQ ID NO: 330709 - DNA, 25 bp, Homo sapien
caagtgatccatcatacagcacctc

SEQ ID NO: 330710 - DNA, 25 bp, Homo sapien
acagcacctccagttccaaagaata

SEQ ID NO: 330711 - DNA, 25 bp, Homo sapien
gacttacttcagctgtactggtctg

SEQ ID NO: 330712 - DNA, 25 bp, Homo sapien
tactggtctggagctgcacattctt

SEQ ID NO: 330713 - DNA, 25 bp, Homo sapien
cattcttttcagacaactcttgttc

SEQ ID NO: 330714 - DNA, 25 bp, Homo sapien
ctgtaacagagcctccttcttagaa

SEQ ID NO: 330715 - DNA, 25 bp, Homo sapien
tccttcttagaaactatggcctccc

SEQ ID NO: 330716 - DNA, 25 bp, Homo sapien
ccagcgtggtttatggtgccaaata

SEQ ID NO: 330717 - DNA, 25 bp, Homo sapien
ggtgccaaataagtgccaggtgaac

SEQ ID NO: 330718 - DNA, 25 bp, Homo sapien
aggtgaactcactacatctgacaaa

SEQ ID NO: 330719 - DNA, 25 bp, Homo sapien
ctcacttgatcagtaacttgtgtta

SEQ ID NO: 330720 - DNA, 25 bp, Homo sapien
gtaacttgtgttagaaactcagtgg

SEQ ID NO: 330721 - DNA, 25 bp, Homo sapien
cttttttgcttttctcgagtcactc

SEQ ID NO: 330722 - DNA, 25 bp, Homo sapien
ttttgcttttctcgagtcactctgt

SEQ ID NO: 330723 - DNA, 25 bp, Homo sapien
gcttttctcgagtcactctgtgtgg

SEQ ID NO: 330724 - DNA, 25 bp, Homo sapien
tctcgagtcactctgtgtggtgctt

SEQ ID NO: 330725 - DNA, 25 bp, Homo sapien
cgagtcactctgtgtggtgcttgtg

SEQ ID NO: 330726 - DNA, 25 bp, Homo sapien
tggatgtgttctgcatgttcctttc

SEQ ID NO: 330727 - DNA, 25 bp, Homo sapien
atgtgttctgcatgttcctttctgt

SEQ ID NO: 330728 - DNA, 25 bp, Homo sapien
tgttctgcatgttcctttctgtaca

SEQ ID NO: 330729 - DNA, 25 bp, Homo sapien
tctgcatgttcctttctgtacagta

SEQ ID NO: 330730 - DNA, 25 bp, Homo sapien
attgtttagttcacatggccatcag

SEQ ID NO: 330731 - DNA, 25 bp, Homo sapien
tcacatggccatcagtagaactaca

SEQ ID NO: 330732 - DNA, 25 bp, Homo sapien
gtagaactacatttcatatgatgag

SEQ ID NO: 330733 - DNA, 25 bp, Homo sapien
tttacacttgagtcagggagactga

SEQ ID NO: 330734 - DNA, 25 bp, Homo sapien
tcagggagactgacaaaggataggt

SEQ ID NO: 330735 - DNA, 25 bp, Homo sapien
taggtatggaaaatggcttgctatt

SEQ ID NO: 330736 - DNA, 25 bp, Homo sapien
ttgctattttcatggccaccctgtc

SEQ ID NO: 330737 - DNA, 25 bp, Homo sapien
gggacattccaatgacttactgctg

SEQ ID NO: 330738 - DNA, 25 bp, Homo sapien
tccaatgacttactgctgcatgaca

SEQ ID NO: 330739 - DNA, 25 bp, Homo sapien
tactgctgcatgacaaagcaccaaa

SEQ ID NO: 330740 - DNA, 25 bp, Homo sapien
agcaccaaaacatagtggcttaaat

SEQ ID NO: 330741 - DNA, 25 bp, Homo sapien
gcccgcggtgaggaactcggatctt

SEQ ID NO: 330742 - DNA, 25 bp, Homo sapien
gtgaggaactcggatcttccctcct

SEQ ID NO: 330743 - DNA, 25 bp, Homo sapien
tgggacctttcccagcaccctttgg

SEQ ID NO: 330744 - DNA, 25 bp, Homo sapien
agcaccctttgggacgcttctagaa

SEQ ID NO: 330745 - DNA, 25 bp, Homo sapien
gggacgcttctagaactgttctcag

SEQ ID NO: 330746 - DNA, 25 bp, Homo sapien
tagaactgttctcagcccttcagag

SEQ ID NO: 330747 - DNA, 25 bp, Homo sapien
cagcccttcagagccttaaggaatc

SEQ ID NO: 330748 - DNA, 25 bp, Homo sapien
cagagccttaaggaatccaccggtc

SEQ ID NO: 330749 - DNA, 25 bp, Homo sapien
accacgggtccgctgaggtccagtc

SEQ ID NO: 330750 - DNA, 25 bp, Homo sapien
ggtccgctgaggtccagtccactag

SEQ ID NO: 330751 - DNA, 25 bp, Homo sapien
tgaggtccagtccactagcgcgcct

SEQ ID NO: 330752 - DNA, 25 bp, Homo sapien
gggaaagctagtgttgatgaaactt

SEQ ID NO: 330753 - DNA, 25 bp, Homo sapien
ttgtaaaacattgcccatctgtctt

SEQ ID NO: 330754 - DNA, 25 bp, Homo sapien
acatctgcatcccttgatccactgg

SEQ ID NO: 330755 - DNA, 25 bp, Homo sapien
atcccttgatccactggcatttgct

SEQ ID NO: 330756 - DNA, 25 bp, Homo sapien
actggcatttgctgccctcttgtcc

SEQ ID NO: 330757 - DNA, 25 bp, Homo sapien
tcttgtcccttatctgtcttatgct

SEQ ID NO: 330758 - DNA, 25 bp, Homo sapien
tcccttatctgtcttatgctggtta

SEQ ID NO: 330759 - DNA, 25 bp, Homo sapien
tatgctggttatttcactgcttcac

SEQ ID NO: 330760 - DNA, 25 bp, Homo sapien
tgcttcaccttccaggcttgactta

SEQ ID NO: 330761 - DNA, 25 bp, Homo sapien
caccttccaggcttgacttaacaaa

SEQ ID NO: 330762 - DNA, 25 bp, Homo sapien
tccaggcttgacttaacaaatgtag

SEQ ID NO: 330763 - DNA, 25 bp, Homo sapien
ggatccacatccctgtatttttatg

SEQ ID NO: 330764 - DNA, 25 bp, Homo sapien
aatagcaaaactcccccagtaatgg

SEQ ID NO: 330765 - DNA, 25 bp, Homo sapien
ccccagtaatggattaagcactaag

SEQ ID NO: 330766 - DNA, 25 bp, Homo sapien
agcactaaggattattccctcacaa

SEQ ID NO: 330767 - DNA, 25 bp, Homo sapien
caaaacaagcctggcgagggcagct

SEQ ID NO: 330768 - DNA, 25 bp, Homo sapien
gggtcagggcctcagtgattctcct

SEQ ID NO: 330769 - DNA, 25 bp, Homo sapien
actgggatccccattgttagtccac

SEQ ID NO: 330770 - DNA, 25 bp, Homo sapien
cattgttagtccactgttgcgcagg

SEQ ID NO: 330771 - DNA, 25 bp, Homo sapien
ttagtccactgttgcgcaggcttac

SEQ ID NO: 330772 - DNA, 25 bp, Homo sapien
gttgcgcaggcttaccctagataga

SEQ ID NO: 330773 - DNA, 25 bp, Homo sapien
caggcttaccctagatagagtacag

SEQ ID NO: 330774 - DNA, 25 bp, Homo sapien
ggatataagaccaaagtgtccataa

SEQ ID NO: 330775 - DNA, 25 bp, Homo sapien
gggtaagagatctttcaattgaaac

SEQ ID NO: 330776 - DNA, 25 bp, Homo sapien
agaatacttcttaggccaggcaatt

SEQ ID NO: 330777 - DNA, 25 bp, Homo sapien
cttaggccaggcaatttgaattgat

SEQ ID NO: 330778 - DNA, 25 bp, Homo sapien
caatgccatcatcaagggagccaat

SEQ ID NO: 330779 - DNA, 25 bp, Homo sapien
tgccatcatcaagggagccaatctt

SEQ ID NO: 330780 - DNA, 25 bp, Homo sapien
gaaaggaagtggttccagtctacca

SEQ ID NO: 330781 - DNA, 25 bp, Homo sapien
aagtggttccagtctaccatgagca

SEQ ID NO: 330782 - DNA, 25 bp, Homo sapien
ttccagtctaccatgagcagctcat

SEQ ID NO: 330783 - DNA, 25 bp, Homo sapien
gagcagctcataggctagatgaact

SEQ ID NO: 330784 - DNA, 25 bp, Homo sapien
gaactgaacatagcttttggtttgt

SEQ ID NO: 330785 - DNA, 25 bp, Homo sapien
gtgaccacttggatgtcaccactgt

SEQ ID NO: 330786 - DNA, 25 bp, Homo sapien
ttgatgtccccatttagccatctcc

SEQ ID NO: 330787 - DNA, 25 bp, Homo sapien
atttagccatctccatggagctcct

SEQ ID NO: 330788 - DNA, 25 bp, Homo sapien
tggagggccctgaaccctgcactgc

SEQ ID NO: 330789 - DNA, 25 bp, Homo sapien
tcctgtcctgggaggaggcctcctg

SEQ ID NO: 330790 - DNA, 25 bp, Homo sapien
tgggtgtcctcatctggtgtgtcta

SEQ ID NO: 330791 - DNA, 25 bp, Homo sapien
atctggtgtgtctactggagggtcc

SEQ ID NO: 330792 - DNA, 25 bp, Homo sapien
gtgtgtctactggagggtcccacag

SEQ ID NO: 330793 - DNA, 25 bp, Homo sapien
tctactggagggtcccacaggagag

SEQ ID NO: 330794 - DNA, 25 bp, Homo sapien
gttctagcctgttgaatatacccca

SEQ ID NO: 330795 - DNA, 25 bp, Homo sapien
cctgttgaatataccccacctggtg

SEQ ID NO: 330796 - DNA, 25 bp, Homo sapien
ccaggagcccactgacgttggagtg

SEQ ID NO: 330797 - DNA, 25 bp, Homo sapien
gagcccactgacgttggagtgctaa

SEQ ID NO: 330798 - DNA, 25 bp, Homo sapien
gacgttggagtgctaaaaatgcccc

SEQ ID NO: 330799 - DNA, 25 bp, Homo sapien
gggaaaactgcattttctcttccaa

SEQ ID NO: 330800 - DNA, 25 bp, Homo sapien
aaggttcttccaggcgagaaacctg

SEQ ID NO: 330801 - DNA, 25 bp, Homo sapien
ttccaggcgagaaacctgtggtcta

SEQ ID NO: 330802 - DNA, 25 bp, Homo sapien
aagaggaggcatgctggcctgcacc

SEQ ID NO: 330803 - DNA, 25 bp, Homo sapien
atgctggcctgcaccggaagactca

SEQ ID NO: 330804 - DNA, 25 bp, Homo sapien
ctgcaccggaagactcactttgtct

SEQ ID NO: 330805 - DNA, 25 bp, Homo sapien
gcagttcccgtttccgccatggatg

SEQ ID NO: 330806 - DNA, 25 bp, Homo sapien
atggatgcctcatcaccaaccctga

SEQ ID NO: 330807 - DNA, 25 bp, Homo sapien
ggttcgagaatgtcaagccagattt

SEQ ID NO: 330808 - DNA, 25 bp, Homo sapien
agccagattttgttcagcccaggga

SEQ ID NO: 330809 - DNA, 25 bp, Homo sapien
agcccagggatgttcaggagctgaa

SEQ ID NO: 330810 - DNA, 25 bp, Homo sapien
aataacgaattaatttggcatgcag

SEQ ID NO: 330811 - DNA, 25 bp, Homo sapien
aacgaattaatttggcatgcagttt

SEQ ID NO: 330812 - DNA, 25 bp, Homo sapien
gcagttttaaaaccatgtgtgaata

SEQ ID NO: 330813 - DNA, 25 bp, Homo sapien
ccatgtgtgaataaactgcttatca

SEQ ID NO: 330814 - DNA, 25 bp, Homo sapien
gaataaactgcttatcatactttgg

SEQ ID NO: 330815 - DNA, 25 bp, Homo sapien
ataaactgcttatcatactttggtt

SEQ ID NO: 330816 - DNA, 25 bp, Homo sapien
aactgcttatcatactttggttttt

SEQ ID NO: 330817 - DNA, 25 bp, Homo sapien
ctgcttatcatactttggttttttg

SEQ ID NO: 330818 - DNA, 25 bp, Homo sapien
ttgttcatccaagaagggtttttgt

SEQ ID NO: 330819 - DNA, 25 bp, Homo sapien
gaagggtttttgtgactgaatcagc

SEQ ID NO: 330820 - DNA, 25 bp, Homo sapien
tgtgactgaatcagcagtgcctgcc

SEQ ID NO: 330821 - DNA, 25 bp, Homo sapien
tgaatcagcagtgcctgccctagtc

SEQ ID NO: 330822 - DNA, 25 bp, Homo sapien
gccctagtcatagctgtgcttcaaa

SEQ ID NO: 330823 - DNA, 25 bp, Homo sapien
gtcatagctgtgcttcaaaaacctc

SEQ ID NO: 330824 - DNA, 25 bp, Homo sapien
atagctgtgcttcaaaaacctcagc

SEQ ID NO: 330825 - DNA, 25 bp, Homo sapien
aaacctcagcatgattagtgttgga

SEQ ID NO: 330826 - DNA, 25 bp, Homo sapien
cagcatgattagtgttggagcaaaa

SEQ ID NO: 330827 - DNA, 25 bp, Homo sapien
tttttgaaattctatctgttgcttg

SEQ ID NO: 330828 - DNA, 25 bp, Homo sapien
tgaaattctatctgttgcttgaact

SEQ ID NO: 330829 - DNA, 25 bp, Homo sapien
catcagtaatgtattctatctctct

SEQ ID NO: 330830 - DNA, 25 bp, Homo sapien
tacattttggtctctatactacatt

SEQ ID NO: 330831 - DNA, 25 bp, Homo sapien
tttagctgtatcaaactagtgcatg

SEQ ID NO: 330832 - DNA, 25 bp, Homo sapien
gtgcatgaatagattctctcctgat

SEQ ID NO: 330833 - DNA, 25 bp, Homo sapien
gattatttatcacatagccccttag

SEQ ID NO: 330834 - DNA, 25 bp, Homo sapien
tagccccttagccagttgtatatta

SEQ ID NO: 330835 - DNA, 25 bp, Homo sapien
atattattcttgtggtttgtgaccc

SEQ ID NO: 330836 - DNA, 25 bp, Homo sapien
taagtcctactttacatatgcttta

SEQ ID NO: 330837 - DNA, 25 bp, Homo sapien
gatgcttcatgtgaacgtgggagtt

SEQ ID NO: 330838 - DNA, 25 bp, Homo sapien
aacgtgggagttcagctgcttctct

SEQ ID NO: 330839 - DNA, 25 bp, Homo sapien
tattcctttcctgatcactatgcat

SEQ ID NO: 330840 - DNA, 25 bp, Homo sapien
acacatgctttccacattgttctgg

SEQ ID NO: 330841 - DNA, 25 bp, Homo sapien
acatctgagaaagacacatcattga

SEQ ID NO: 330842 - DNA, 25 bp, Homo sapien
gacacatcattgaaacaacttccat

SEQ ID NO: 330843 - DNA, 25 bp, Homo sapien
tgaaacaacttccatccattgcatg

SEQ ID NO: 330844 - DNA, 25 bp, Homo sapien
acttccatccattgcatgggtagaa

SEQ ID NO: 330845 - DNA, 25 bp, Homo sapien
gggtagaaattactctggctgctat

SEQ ID NO: 330846 - DNA, 25 bp, Homo sapien
tattttggatgtcactggatgcccc

SEQ ID NO: 330847 - DNA, 25 bp, Homo sapien
gatgtcactggatgcccctgttgga

SEQ ID NO: 330848 - DNA, 25 bp, Homo sapien
ggagcactgtgtttcaaagctgggt

SEQ ID NO: 330849 - DNA, 25 bp, Homo sapien
actgatgcttttgtacaattcacac

SEQ ID NO: 330850 - DNA, 25 bp, Homo sapien
gtacaattcacacatgctttccaca

SEQ ID NO: 330851 - DNA, 25 bp, Homo sapien
ggaatgtattccatcccattcatgg

SEQ ID NO: 330852 - DNA, 25 bp, Homo sapien
tattccatcccattcatggatcctg

SEQ ID NO: 330853 - DNA, 25 bp, Homo sapien
ggatcctgcccatactcaagggaag

SEQ ID NO: 330854 - DNA, 25 bp, Homo sapien
caagggaaggccataatacaagcat

SEQ ID NO: 330855 - DNA, 25 bp, Homo sapien
gggccatcttagtcactactgttcg

SEQ ID NO: 330856 - DNA, 25 bp, Homo sapien
tactgttcgtggattgttctccagc

SEQ ID NO: 330857 - DNA, 25 bp, Homo sapien
aaaaggtaggtcttgtgagtagcag

SEQ ID NO: 330858 - DNA, 25 bp, Homo sapien
ggctacttaagatgcctagtgggtc

SEQ ID NO: 330859 - DNA, 25 bp, Homo sapien
gatgcctagtgggtctaaatgtcaa

SEQ ID NO: 330860 - DNA, 25 bp, Homo sapien
aaatgctattggcagattttccgtg

SEQ ID NO: 330861 - DNA, 25 bp, Homo sapien
agattttccgtgcaaggtatgacca

SEQ ID NO: 330862 - DNA, 25 bp, Homo sapien
atcaccctgtacctcacgatgcttg

SEQ ID NO: 330863 - DNA, 25 bp, Homo sapien
accctgtacctcacgatgcttgtca

SEQ ID NO: 330864 - DNA, 25 bp, Homo sapien
tcacgatgcttgtcaccttcacaga

SEQ ID NO: 330865 - DNA, 25 bp, Homo sapien
cacgatgcttgtcaccttcacagac

SEQ ID NO: 330866 - DNA, 25 bp, Homo sapien
tcaccttcacagacacttcaacgtg

SEQ ID NO: 330867 - DNA, 25 bp, Homo sapien
accttcacagacacttcaacgtgga

SEQ ID NO: 330868 - DNA, 25 bp, Homo sapien
ttcacagacacttcaacgtggaaaa

SEQ ID NO: 330869 - DNA, 25 bp, Homo sapien
gacacttcaacgtggaaaattcttc

SEQ ID NO: 330870 - DNA, 25 bp, Homo sapien
gggacatctcaaccagcatggattt

SEQ ID NO: 330871 - DNA, 25 bp, Homo sapien
gacatctcaaccagcatggatttta

SEQ ID NO: 330872 - DNA, 25 bp, Homo sapien
tcaaccagcatggattttattctgt

SEQ ID NO: 330873 - DNA, 25 bp, Homo sapien
aatataatttccttcagtgaataca

SEQ ID NO: 330874 - DNA, 25 bp, Homo sapien
cataggtgatgtacaatttagtttt

SEQ ID NO: 330875 - DNA, 25 bp, Homo sapien
gagttattatgttatcactgtgtct

SEQ ID NO: 330876 - DNA, 25 bp, Homo sapien
tcactgtgtctgatgttatctactt

SEQ ID NO: 330877 - DNA, 25 bp, Homo sapien
ctgtgtctgatgttatctactttga

SEQ ID NO: 330878 - DNA, 25 bp, Homo sapien
aaggcagtccagaaaagtgttctaa

SEQ ID NO: 330879 - DNA, 25 bp, Homo sapien
aaagtgttctaagtgaactcttaag

SEQ ID NO: 330880 - DNA, 25 bp, Homo sapien
gtgaactcttaagatctattttaga

SEQ ID NO: 330881 - DNA, 25 bp, Homo sapien
attaaataacctgttttactgcctg

SEQ ID NO: 330882 - DNA, 25 bp, Homo sapien
tgttttactgcctgtacattccaca

SEQ ID NO: 330883 - DNA, 25 bp, Homo sapien
ttttactgcctgtacattccacatt

SEQ ID NO: 330884 - DNA, 25 bp, Homo sapien
aataacgaattaatttggcatgcag

SEQ ID NO: 330885 - DNA, 25 bp, Homo sapien
aacgaattaatttggcatgcagttt

SEQ ID NO: 330886 - DNA, 25 bp, Homo sapien
ccatgtgtgaataaactgcttatca

SEQ ID NO: 330887 - DNA, 25 bp, Homo sapien
gtgtgaataaactgcttatcatact

SEQ ID NO: 330888 - DNA, 25 bp, Homo sapien
gtgaataaactgcttatcatacttt

SEQ ID NO: 330889 - DNA, 25 bp, Homo sapien
gaataaactgcttatcatactttgg

SEQ ID NO: 330890 - DNA, 25 bp, Homo sapien
ataaactgcttatcatactttggtt

SEQ ID NO: 330891 - DNA, 25 bp, Homo sapien
aaactgcttatcatactttggtttt

SEQ ID NO: 330892 - DNA, 25 bp, Homo sapien
aactgcttatcatactttggttttt

SEQ ID NO: 330893 - DNA, 25 bp, Homo sapien
actgcttatcatactttggtttttt

SEQ ID NO: 330894 - DNA, 25 bp, Homo sapien
ctgcttatcatactttggttttttg

SEQ ID NO: 330895 - DNA, 25 bp, Homo sapien
tccctaatgcccaggatcaagaaaa

SEQ ID NO: 330896 - DNA, 25 bp, Homo sapien
tggcattacaatggcctcatcctgc

SEQ ID NO: 330897 - DNA, 25 bp, Homo sapien
tcatcctgcatgtgggcaagtcagc

SEQ ID NO: 330898 - DNA, 25 bp, Homo sapien
ggcaagtcagctctctgatggatgg

SEQ ID NO: 330899 - DNA, 25 bp, Homo sapien
gggcctttaaagctattgaggagcc

SEQ ID NO: 330900 - DNA, 25 bp, Homo sapien
aaagctattgaggagccagtgaatg

SEQ ID NO: 330901 - DNA, 25 bp, Homo sapien
atggagaattcgacaacgcctggca

SEQ ID NO: 330902 - DNA, 25 bp, Homo sapien
gagggtgacacatcacggcagatga

SEQ ID NO: 330903 - DNA, 25 bp, Homo sapien
aaagaatgtggccaccttccaaggc

SEQ ID NO: 330904 - DNA, 25 bp, Homo sapien
accttccaaggctcagagtagctgt

SEQ ID NO: 330905 - DNA, 25 bp, Homo sapien
aggctcagagtagctgtgcaatgac

SEQ ID NO: 330906 - DNA, 25 bp, Homo sapien
tgtttagtcaaggtaattaagtaat

SEQ ID NO: 330907 - DNA, 25 bp, Homo sapien
tttgaataacttggtgtgtcttgag

SEQ ID NO: 330908 - DNA, 25 bp, Homo sapien
gaataacttggtgtgtcttgagtgt

SEQ ID NO: 330909 - DNA, 25 bp, Homo sapien
taacttggtgtgtcttgagtgttgt

SEQ ID NO: 330910 - DNA, 25 bp, Homo sapien
gtgtcttgagtgttgtggtatgaaa

SEQ ID NO: 330911 - DNA, 25 bp, Homo sapien
ggtatgaaaagcattgtggtctttc

SEQ ID NO: 330912 - DNA, 25 bp, Homo sapien
cattgtggtctttctacactaatga

SEQ ID NO: 330913 - DNA, 25 bp, Homo sapien
tgtggtctttctacactaatgaagt

SEQ ID NO: 330914 - DNA, 25 bp, Homo sapien
gtctttctacactaatgaagtgcaa

SEQ ID NO: 330915 - DNA, 25 bp, Homo sapien
aagcttattctgattaagcctagac

SEQ ID NO: 330916 - DNA, 25 bp, Homo sapien
gcttattctgattaagcctagactg

SEQ ID NO: 330917 - DNA, 25 bp, Homo sapien
ctgcacagatacatctcccataaag

SEQ ID NO: 330918 - DNA, 25 bp, Homo sapien
tttacagggcactgttgcagaccca

SEQ ID NO: 330919 - DNA, 25 bp, Homo sapien
gttgcagacccacttcagctggaag

SEQ ID NO: 330920 - DNA, 25 bp, Homo sapien
ggaacatggacaaggagcctctcta

SEQ ID NO: 330921 - DNA, 25 bp, Homo sapien
ggagcctctctaccaccaagggaga

SEQ ID NO: 330922 - DNA, 25 bp, Homo sapien
agaggaatgtgctcttgtcctggca

SEQ ID NO: 330923 - DNA, 25 bp, Homo sapien
tgaaggtcagtaaccccatacccca

SEQ ID NO: 330924 - DNA, 25 bp, Homo sapien
cccataccccaattaacagtgctta

SEQ ID NO: 330925 - DNA, 25 bp, Homo sapien
cagtgcttaagtgtgaggctccctc

SEQ ID NO: 330926 - DNA, 25 bp, Homo sapien
gaggctccctcagaacatcagagat

SEQ ID NO: 330927 - DNA, 25 bp, Homo sapien
gaacatcagagatatcctcactccc

SEQ ID NO: 330928 - DNA, 25 bp, Homo sapien
actgggcccggcttcagaggtactc

SEQ ID NO: 330929 - DNA, 25 bp, Homo sapien
ggcttcagaggtactccttgtcgct

SEQ ID NO: 330930 - DNA, 25 bp, Homo sapien
actccttgtcgctccagagagagaa

SEQ ID NO: 330931 - DNA, 25 bp, Homo sapien
gaacttcaagaagtgaggctgccac

SEQ ID NO: 330932 - DNA, 25 bp, Homo sapien
accgccctgggatctctgaaaagga

SEQ ID NO: 330933 - DNA, 25 bp, Homo sapien
aaaggaggtttcagccacgaggcag

SEQ ID NO: 330934 - DNA, 25 bp, Homo sapien
tgctcccaggacactgaggccaaga

SEQ ID NO: 330935 - DNA, 25 bp, Homo sapien
atgtaacagagccacagctccacag

SEQ ID NO: 330936 - DNA, 25 bp, Homo sapien
ccacaggcctgcactcggagtctgg

SEQ ID NO: 330937 - DNA, 25 bp, Homo sapien
ttcaaccactaagcctcttgtcaga

SEQ ID NO: 330938 - DNA, 25 bp, Homo sapien
cttgtcagagccctcaggcaggcag

SEQ ID NO: 330939 - DNA, 25 bp, Homo sapien
accaactcgctggaggagatgaagc

SEQ ID NO: 330940 - DNA, 25 bp, Homo sapien
aactcgctggaggagatgaagcgac

SEQ ID NO: 330941 - DNA, 25 bp, Homo sapien
atgaagcgactggtgagcgagatct

SEQ ID NO: 330942 - DNA, 25 bp, Homo sapien
tgaagcgactggtgagcgagatcta

SEQ ID NO: 330943 - DNA, 25 bp, Homo sapien
gaagcgactggtgagcgagatctac

SEQ ID NO: 330944 - DNA, 25 bp, Homo sapien
aagcgactggtgagcgagatctacg

SEQ ID NO: 330945 - DNA, 25 bp, Homo sapien
agcgactggtgagcgagatctacgg

SEQ ID NO: 330946 - DNA, 25 bp, Homo sapien
tgcagccgcggctgtgtccagcgcc

SEQ ID NO: 330947 - DNA, 25 bp, Homo sapien
gcggctgtgtccagcgcctctctgc

SEQ ID NO: 330948 - DNA, 25 bp, Homo sapien
ccggatccgggctgccgtcggtcgg

SEQ ID NO: 330949 - DNA, 25 bp, Homo sapien
gctgccgtcggtcggctccatccgt

SEQ ID NO: 330950 - DNA, 25 bp, Homo sapien
ttgtttccaccttgctattcaggag

SEQ ID NO: 330951 - DNA, 25 bp, Homo sapien
caccttgctattcaggagggcctgt

SEQ ID NO: 330952 - DNA, 25 bp, Homo sapien
gcctgtaagggtatctggattcctt

SEQ ID NO: 330953 - DNA, 25 bp, Homo sapien
tctggattccttgagctgtagatgc

SEQ ID NO: 330954 - DNA, 25 bp, Homo sapien
gaggtagttctctggtctaatttca

SEQ ID NO: 330955 - DNA, 25 bp, Homo sapien
tcctaactgagggtacatgccttcc

SEQ ID NO: 330956 - DNA, 25 bp, Homo sapien
atgccttccctgaatgatcatcatc

SEQ ID NO: 330957 - DNA, 25 bp, Homo sapien
tcatcaaaaatatccagcccttcat

SEQ ID NO: 330958 - DNA, 25 bp, Homo sapien
atatccagcccttcatggaagacac

SEQ ID NO: 330959 - DNA, 25 bp, Homo sapien
gatgagtccctgagcttatgatctc

SEQ ID NO: 330960 - DNA, 25 bp, Homo sapien
ggaaatccttatcagaatacaacag

SEQ ID NO: 330961 - DNA, 25 bp, Homo sapien
gaaagaaaggtcagggatagcaagc

SEQ ID NO: 330962 - DNA, 25 bp, Homo sapien
agaaaggtcagggatagcaagcaga

SEQ ID NO: 330963 - DNA, 25 bp, Homo sapien
aaaggtcagggatagcaagcagaga

SEQ ID NO: 330964 - DNA, 25 bp, Homo sapien
aggtcagggatagcaagcagagaga

SEQ ID NO: 330965 - DNA, 25 bp, Homo sapien
gagagggagcgagccggctgccaca

SEQ ID NO: 330966 - DNA, 25 bp, Homo sapien
ggctgccacacacgccaggtaaaca

SEQ ID NO: 330967 - DNA, 25 bp, Homo sapien
tgccacacacgccaggtaaacaaaa

SEQ ID NO: 330968 - DNA, 25 bp, Homo sapien
gccacacacgccaggtaaacaaaag

SEQ ID NO: 330969 - DNA, 25 bp, Homo sapien
acacacgccaggtaaacaaaagcca

SEQ ID NO: 330970 - DNA, 25 bp, Homo sapien
cacacgccaggtaaacaaaagccaa

SEQ ID NO: 330971 - DNA, 25 bp, Homo sapien
cacgccaggtaaacaaaagccaaca

SEQ ID NO: 330972 - DNA, 25 bp, Homo sapien
atatccatcttaaagacatcaacta

SEQ ID NO: 330973 - DNA, 25 bp, Homo sapien
aaaaattgtgtacaggatattcctt

SEQ ID NO: 330974 - DNA, 25 bp, Homo sapien
gtgtacaggatattcctttagtggt

SEQ ID NO: 330975 - DNA, 25 bp, Homo sapien
acaggatattcctttagtggtggaa

SEQ ID NO: 330976 - DNA, 25 bp, Homo sapien
ttcctttagtggtggaattaaaatg

SEQ ID NO: 330977 - DNA, 25 bp, Homo sapien
aaatgtacgaatacttgctttttca

SEQ ID NO: 330978 - DNA, 25 bp, Homo sapien
tgtacgaatacttgctttttcaaaa

SEQ ID NO: 330979 - DNA, 25 bp, Homo sapien
attttgtacctatattgtgcaatac

SEQ ID NO: 330980 - DNA, 25 bp, Homo sapien
gtacctatattgtgcaatacttgaa

SEQ ID NO: 330981 - DNA, 25 bp, Homo sapien
tataaaagtattttgagtcagtgtc

SEQ ID NO: 330982 - DNA, 25 bp, Homo sapien
ttgagtcagtgtcttacatgttaag

SEQ ID NO: 330983 - DNA, 25 bp, Homo sapien
tgtttgctcacgtgactgccagccc

SEQ ID NO: 330984 - DNA, 25 bp, Homo sapien
actgccagccccatcggagtctaag

SEQ ID NO: 330985 - DNA, 25 bp, Homo sapien
ccatcggagtctaagccggctttcc

SEQ ID NO: 330986 - DNA, 25 bp, Homo sapien
aaatggtaaactcctccacgtgctt

SEQ ID NO: 330987 - DNA, 25 bp, Homo sapien
acgtgcttcctgcgttccgtgcaag

SEQ ID NO: 330988 - DNA, 25 bp, Homo sapien
gctgcctgcgttgcaaactgggctt

SEQ ID NO: 330989 - DNA, 25 bp, Homo sapien
cctgcgttgcaaactgggctttgta

SEQ ID NO: 330990 - DNA, 25 bp, Homo sapien
aaactgggctttgtagcgtctgccg

SEQ ID NO: 330991 - DNA, 25 bp, Homo sapien
tttgtagcgtctgccgtgtaacacc

SEQ ID NO: 330992 - DNA, 25 bp, Homo sapien
gtgtaacacccttcctctgatcgca

SEQ ID NO: 330993 - DNA, 25 bp, Homo sapien
cgcagagagtgtatcatctgtttta

SEQ ID NO: 330994 - DNA, 25 bp, Homo sapien
gggactacatggtgactgccagtgc

SEQ ID NO: 330995 - DNA, 25 bp, Homo sapien
gactacatggtgactgccagtgccg

SEQ ID NO: 330996 - DNA, 25 bp, Homo sapien
tacatggtgactgccagtgccgagg

SEQ ID NO: 330997 - DNA, 25 bp, Homo sapien
gtgactgccagtgccgagggctacc

SEQ ID NO: 330998 - DNA, 25 bp, Homo sapien
agtgccgagggctaccattcagtga

SEQ ID NO: 330999 - DNA, 25 bp, Homo sapien
tgccgagggctaccattcagtgaca

SEQ ID NO: 331000 - DNA, 25 bp, Homo sapien
gagggctaccattcagtgacacgga

SEQ ID NO: 331001 - DNA, 25 bp, Homo sapien
gggctaccattcagtgacacggaac

SEQ ID NO: 331002 - DNA, 25 bp, Homo sapien
gctaccattcagtgacacggaactg

SEQ ID NO: 331003 - DNA, 25 bp, Homo sapien
tcagtgacacggaactgtcgggtca

SEQ ID NO: 331004 - DNA, 25 bp, Homo sapien
caaacagaggctgcgcgagctgctg

SEQ ID NO: 331005 - DNA, 25 bp, Homo sapien
gttctcttgtgcaatatacagacgt

SEQ ID NO: 331006 - DNA, 25 bp, Homo sapien
tatacagacgtgtgaatattcctaa

SEQ ID NO: 331007 - DNA, 25 bp, Homo sapien
tattcctaacagtaaccaaatgggt

SEQ ID NO: 331008 - DNA, 25 bp, Homo sapien
aaccaaatgggtgcactctctgtga

SEQ ID NO: 331009 - DNA, 25 bp, Homo sapien
gcactctctgtgaaaacgcatcttt

SEQ ID NO: 331010 - DNA, 25 bp, Homo sapien
acaaaggagactcctgggcctttag

SEQ ID NO: 331011 - DNA, 25 bp, Homo sapien
aactgcaaaaacaatctccaacctc

SEQ ID NO: 331012 - DNA, 25 bp, Homo sapien
tcccacttctgtaattctcatctgt

SEQ ID NO: 331013 - DNA, 25 bp, Homo sapien
aattctcatctgttgtcttactaga

SEQ ID NO: 331014 - DNA, 25 bp, Homo sapien
gttaaaagggatttcataaggtctg

SEQ ID NO: 331015 - DNA, 25 bp, Homo sapien
gagaactttcccaagaatactgcat

SEQ ID NO: 331016 - DNA, 25 bp, Homo sapien
gcttagtaagtcttgtctttctctc

SEQ ID NO: 331017 - DNA, 25 bp, Homo sapien
attaatgtgcctgtctttcttctca

SEQ ID NO: 331018 - DNA, 25 bp, Homo sapien
aaaagctttgggaatcagacagatc

SEQ ID NO: 331019 - DNA, 25 bp, Homo sapien
agatctgtgttctgatcctgtctta

SEQ ID NO: 331020 - DNA, 25 bp, Homo sapien
gtgttctgatcctgtcttatggtat

SEQ ID NO: 331021 - DNA, 25 bp, Homo sapien
cctgtcttatggtatctgtcttgtt

SEQ ID NO: 331022 - DNA, 25 bp, Homo sapien
ctgtcttgtttgtctcggcttaaaa

SEQ ID NO: 331023 - DNA, 25 bp, Homo sapien
gggataatatctacctctcagtttt

SEQ ID NO: 331024 - DNA, 25 bp, Homo sapien
atatctacctctcagttttgttggc

SEQ ID NO: 331025 - DNA, 25 bp, Homo sapien
ttctctctgctttgacctgtcagta

SEQ ID NO: 331026 - DNA, 25 bp, Homo sapien
acctgtcagtattccaacttcctta

SEQ ID NO: 331027 - DNA, 25 bp, Homo sapien
accggcagcgtttagagttgggata

SEQ ID NO: 331028 - DNA, 25 bp, Homo sapien
ttgggatatacatttaaacattttc

SEQ ID NO: 331029 - DNA, 25 bp, Homo sapien
ttcctggttaaggttcccaagagag

SEQ ID NO: 331030 - DNA, 25 bp, Homo sapien
aaatatcttgcatctttatggaagt

SEQ ID NO: 331031 - DNA, 25 bp, Homo sapien
aagcatgtttgcaaatattgcagcc

SEQ ID NO: 331032 - DNA, 25 bp, Homo sapien
aagaatttgcatgtacaggaaagtt

SEQ ID NO: 331033 - DNA, 25 bp, Homo sapien
gacggtttgtggaattttaagtgct

SEQ ID NO: 331034 - DNA, 25 bp, Homo sapien
ttttaagtgctcattgtagtaaact

SEQ ID NO: 331035 - DNA, 25 bp, Homo sapien
gtagtaaacttttgctttgtagatt

SEQ ID NO: 331036 - DNA, 25 bp, Homo sapien
gaaggtacagacttatacaggcaag

SEQ ID NO: 331037 - DNA, 25 bp, Homo sapien
atacaggcaagttcacaaaatcatg

SEQ ID NO: 331038 - DNA, 25 bp, Homo sapien
attgacttaagccaactatcccttc

SEQ ID NO: 331039 - DNA, 25 bp, Homo sapien
gccaactatcccttcagttacaata

SEQ ID NO: 331040 - DNA, 25 bp, Homo sapien
ggccaaatatgcgtactaacttgta

SEQ ID NO: 331041 - DNA, 25 bp, Homo sapien
taacttgtagcaaccacgtgtccgt

SEQ ID NO: 331042 - DNA, 25 bp, Homo sapien
tccgtgcagtgccacaggagctaga

SEQ ID NO: 331043 - DNA, 25 bp, Homo sapien
aacagggcagtgtagcaggtgcttc

SEQ ID NO: 331044 - DNA, 25 bp, Homo sapien
ttcatgttcaccttttcaacctttt

SEQ ID NO: 331045 - DNA, 25 bp, Homo sapien
cacaactcggaggtggattctgtta

SEQ ID NO: 331046 - DNA, 25 bp, Homo sapien
attctgttagggacaggctgcccca

SEQ ID NO: 331047 - DNA, 25 bp, Homo sapien
gctaactcaatgcagctgaccctta

SEQ ID NO: 331048 - DNA, 25 bp, Homo sapien
tgacccttaccctgaatactctgca

SEQ ID NO: 331049 - DNA, 25 bp, Homo sapien
atatgtcgattcttgtatatgggac

SEQ ID NO: 331050 - DNA, 25 bp, Homo sapien
tatgggacaatattagctgctgtga

SEQ ID NO: 331051 - DNA, 25 bp, Homo sapien
tagctgctgtgatttttaatactag

SEQ ID NO: 331052 - DNA, 25 bp, Homo sapien
gaatctttttattactgtgatattg

SEQ ID NO: 331053 - DNA, 25 bp, Homo sapien
ctgatgctctttgtctacaaacaag

SEQ ID NO: 331054 - DNA, 25 bp, Homo sapien
caagagggtaaggagctggatccaa

SEQ ID NO: 331055 - DNA, 25 bp, Homo sapien
ggagctggatccaattgaattgaat

SEQ ID NO: 331056 - DNA, 25 bp, Homo sapien
ttttcttccattcagtgcctttcaa

SEQ ID NO: 331057 - DNA, 25 bp, Homo sapien
cttccattcagtgcctttcaaactg

SEQ ID NO: 331058 - DNA, 25 bp, Homo sapien
tcagtgcctttcaaactgtttttta

SEQ ID NO: 331059 - DNA, 25 bp, Homo sapien
ctggatgaagaaactcaaccaagaa

SEQ ID NO: 331060 - DNA, 25 bp, Homo sapien
gctgtgtgtgctggcggtgcgctgc

SEQ ID NO: 331061 - DNA, 25 bp, Homo sapien
tggcggtgcgctgccttagtgcggg

SEQ ID NO: 331062 - DNA, 25 bp, Homo sapien
gaaagtggagggaacggtcctgcgg

SEQ ID NO: 331063 - DNA, 25 bp, Homo sapien
tgcggggcgttctgtccaagaaaaa

SEQ ID NO: 331064 - DNA, 25 bp, Homo sapien
caagaaaaaggactgcagcctcggg

SEQ ID NO: 331065 - DNA, 25 bp, Homo sapien
agacgagctgccaacgccgcggagc

SEQ ID NO: 331066 - DNA, 25 bp, Homo sapien
ccaacgccgcggagccatttctgtt

SEQ ID NO: 331067 - DNA, 25 bp, Homo sapien
gagccatttctgttccaccctaggg

SEQ ID NO: 331068 - DNA, 25 bp, Homo sapien
agtaggttagtaaggccatttgtgg

SEQ ID NO: 331069 - DNA, 25 bp, Homo sapien
tcaagccggagacgcgtgtggtgcg

SEQ ID NO: 331070 - DNA, 25 bp, Homo sapien
gatgcgggcgccagcgctgtgtgtg

SEQ ID NO: 331071 - DNA, 25 bp, Homo sapien
aaattatatcagttattaggctggg

SEQ ID NO: 331072 - DNA, 25 bp, Homo sapien
aattatatcagttattaggctgggt

SEQ ID NO: 331073 - DNA, 25 bp, Homo sapien
attatatcagttattaggctgggtg

SEQ ID NO: 331074 - DNA, 25 bp, Homo sapien
ttatatcagttattaggctgggtgc

SEQ ID NO: 331075 - DNA, 25 bp, Homo sapien
tatatcagttattaggctgggtgca

SEQ ID NO: 331076 - DNA, 25 bp, Homo sapien
atatcagttattaggctgggtgcag

SEQ ID NO: 331077 - DNA, 25 bp, Homo sapien
gtggattaccagagttcgggagttt

SEQ ID NO: 331078 - DNA, 25 bp, Homo sapien
tggattaccagagttcgggagtttg

SEQ ID NO: 331079 - DNA, 25 bp, Homo sapien
ggattaccagagttcgggagtttga

SEQ ID NO: 331080 - DNA, 25 bp, Homo sapien
attaccagagttcgggagtttgaga

SEQ ID NO: 331081 - DNA, 25 bp, Homo sapien
atcgcttgaaaacccaggagacaga

SEQ ID NO: 331082 - DNA, 25 bp, Homo sapien
atggtgacggtagtggtcccaggga

SEQ ID NO: 331083 - DNA, 25 bp, Homo sapien
gggaggagctttaacctgagcacca

SEQ ID NO: 331084 - DNA, 25 bp, Homo sapien
ggagctttaacctgagcaccaccca

SEQ ID NO: 331085 - DNA, 25 bp, Homo sapien
ctcccagccgcagtgcaaatgaatg

SEQ ID NO: 331086 - DNA, 25 bp, Homo sapien
cgcagtgcaaatgaatgttggcccc

SEQ ID NO: 331087 - DNA, 25 bp, Homo sapien
accagaacaccatttcctgcagcct

SEQ ID NO: 331088 - DNA, 25 bp, Homo sapien
ctccaggcctactacagatgggtta

SEQ ID NO: 331089 - DNA, 25 bp, Homo sapien
caggcctactacagatgggttaccc

SEQ ID NO: 331090 - DNA, 25 bp, Homo sapien
ctacagatgggttaccctgactcca

SEQ ID NO: 331091 - DNA, 25 bp, Homo sapien
ataattgtttggcagcaagaggcca

SEQ ID NO: 331092 - DNA, 25 bp, Homo sapien
ggaaactagagatatggtgacggta

SEQ ID NO: 331093 - DNA, 25 bp, Homo sapien
gaacttctggaagttattgactctg

SEQ ID NO: 331094 - DNA, 25 bp, Homo sapien
acttctggaagttattgactctgga

SEQ ID NO: 331095 - DNA, 25 bp, Homo sapien
aaagatttcaaaacagtactctgga

SEQ ID NO: 331096 - DNA, 25 bp, Homo sapien
gatttcaaaacagtactctggattt

SEQ ID NO: 331097 - DNA, 25 bp, Homo sapien
tttcaaaacagtactctggatttgt

SEQ ID NO: 331098 - DNA, 25 bp, Homo sapien
aaacagtactctggatttgtaaggg

SEQ ID NO: 331099 - DNA, 25 bp, Homo sapien
gggaatattaaccaatggtgagaaa

SEQ ID NO: 331100 - DNA, 25 bp, Homo sapien
aaatttgggatccagtttccatttg

SEQ ID NO: 331101 - DNA, 25 bp, Homo sapien
aatttgggatccagtttccatttga

SEQ ID NO: 331102 - DNA, 25 bp, Homo sapien
atttgggatccagtttccatttgat

SEQ ID NO: 331103 - DNA, 25 bp, Homo sapien
tttccatttgatcttgatgttaaaa

SEQ ID NO: 331104 - DNA, 25 bp, Homo sapien
agtttttctcttgtacctggtgtgt

SEQ ID NO: 331105 - DNA, 25 bp, Homo sapien
gtacctggtgtgtctttatttcagt

SEQ ID NO: 331106 - DNA, 25 bp, Homo sapien
cagtaggtattcttttatgtgcttt

SEQ ID NO: 331107 - DNA, 25 bp, Homo sapien
tatgtgctttagtaagtctttatat

SEQ ID NO: 331108 - DNA, 25 bp, Homo sapien
atttctagatacttaatggcttttg

SEQ ID NO: 331109 - DNA, 25 bp, Homo sapien
aatagaggagtttcaatatttctcc

SEQ ID NO: 331110 - DNA, 25 bp, Homo sapien
attactatgtactaaactgttggtt

SEQ ID NO: 331111 - DNA, 25 bp, Homo sapien
atatttctcctctgccatagtatta

SEQ ID NO: 331112 - DNA, 25 bp, Homo sapien
tctcctctgccatagtattagaaag

SEQ ID NO: 331113 - DNA, 25 bp, Homo sapien
aatcattattgacatctttacgaca

SEQ ID NO: 331114 - DNA, 25 bp, Homo sapien
atctttacgacattgagtttttctc

SEQ ID NO: 331115 - DNA, 25 bp, Homo sapien
tggacccgcacgtcctgttcaaaag

SEQ ID NO: 331116 - DNA, 25 bp, Homo sapien
cgcacgtcctgttcaaaagcagact

SEQ ID NO: 331117 - DNA, 25 bp, Homo sapien
tcctgttcaaaagcagactcgggaa

SEQ ID NO: 331118 - DNA, 25 bp, Homo sapien
aagcagactcgggaactgcctgaat

SEQ ID NO: 331119 - DNA, 25 bp, Homo sapien
aactgcctgaatgtggtttgggaca

SEQ ID NO: 331120 - DNA, 25 bp, Homo sapien
atgtggtttgggacacgagacctca

SEQ ID NO: 331121 - DNA, 25 bp, Homo sapien
ggtttgggacacgagacctcatcat

SEQ ID NO: 331122 - DNA, 25 bp, Homo sapien
ttgggacacgagacctcatcatatt

SEQ ID NO: 331123 - DNA, 25 bp, Homo sapien
gacacgagacctcatcatattgatg

SEQ ID NO: 331124 - DNA, 25 bp, Homo sapien
tattgatgagcgaacaaacaagaac

SEQ ID NO: 331125 - DNA, 25 bp, Homo sapien
gaacaaacaagaacatttcctccct

SEQ ID NO: 331126 - DNA, 25 bp, Homo sapien
tttcagtttgtcttgatgtttgtgg

SEQ ID NO: 331127 - DNA, 25 bp, Homo sapien
tcagtttgtcttgatgtttgtggat

SEQ ID NO: 331128 - DNA, 25 bp, Homo sapien
aaatctcatttctaagcagttttat

SEQ ID NO: 331129 - DNA, 25 bp, Homo sapien
ctcatttctaagcagttttatttaa

SEQ ID NO: 331130 - DNA, 25 bp, Homo sapien
atttaattatgtatggttcatcaaa

SEQ ID NO: 331131 - DNA, 25 bp, Homo sapien
actgaggaaaattaattgccatttg

SEQ ID NO: 331132 - DNA, 25 bp, Homo sapien
ccttagtaccagattatcgttgatt

SEQ ID NO: 331133 - DNA, 25 bp, Homo sapien
gtaccagattatcgttgattatgtg

SEQ ID NO: 331134 - DNA, 25 bp, Homo sapien
ccagattatcgttgattatgtgtaa

SEQ ID NO: 331135 - DNA, 25 bp, Homo sapien
tttatgctgccggtttggatctttt

SEQ ID NO: 331136 - DNA, 25 bp, Homo sapien
tatgctgccggtttggatctttttt

SEQ ID NO: 331137 - DNA, 25 bp, Homo sapien
ggtgcgccaggtggcgagggtgcca

SEQ ID NO: 331138 - DNA, 25 bp, Homo sapien
gcgagggtgccaggcgcggccaagt

SEQ ID NO: 331139 - DNA, 25 bp, Homo sapien
aagtcgcggcggtctgagtcagtca

SEQ ID NO: 331140 - DNA, 25 bp, Homo sapien
ccaggaggagccaacacaaggtcct

SEQ ID NO: 331141 - DNA, 25 bp, Homo sapien
gcggcggtctgagtcagtcacccaa

SEQ ID NO: 331142 - DNA, 25 bp, Homo sapien
ggtctgagtcagtcacccaactatg

SEQ ID NO: 331143 - DNA, 25 bp, Homo sapien
tctgagtcagtcacccaactatgct

SEQ ID NO: 331144 - DNA, 25 bp, Homo sapien
acccaactatgctgcggaaccaggg

SEQ ID NO: 331145 - DNA, 25 bp, Homo sapien
actatgctgcggaaccagggaggcc

SEQ ID NO: 331146 - DNA, 25 bp, Homo sapien
gaaggtgggtaatgcccctgtcgct

SEQ ID NO: 331147 - DNA, 25 bp, Homo sapien
ggtaatgcccctgtcgctctgggct

SEQ ID NO: 331148 - DNA, 25 bp, Homo sapien
ttgtagcaaagtagccagtcctgta

SEQ ID NO: 331149 - DNA, 25 bp, Homo sapien
aaagtagccagtcctgtagccccag

SEQ ID NO: 331150 - DNA, 25 bp, Homo sapien
tgcaccagacctccacagaagttca

SEQ ID NO: 331151 - DNA, 25 bp, Homo sapien
tggacctcctggtgaggcagcttgc

SEQ ID NO: 331152 - DNA, 25 bp, Homo sapien
agacctccacagaagttcagacagt

SEQ ID NO: 331153 - DNA, 25 bp, Homo sapien
ggctgtctccctttgattcacttag

SEQ ID NO: 331154 - DNA, 25 bp, Homo sapien
tttgattcacttagccctctttctt

SEQ ID NO: 331155 - DNA, 25 bp, Homo sapien
ctttcttctttacacatttgcaaaa

SEQ ID NO: 331156 - DNA, 25 bp, Homo sapien
gtgacagtagtcatattactattca

SEQ ID NO: 331157 - DNA, 25 bp, Homo sapien
agttcagacagtggctctacaaccc

SEQ ID NO: 331158 - DNA, 25 bp, Homo sapien
tactggcccctatcaatgacttctg

SEQ ID NO: 331159 - DNA, 25 bp, Homo sapien
gagtcacaggaacagataacttaca

SEQ ID NO: 331160 - DNA, 25 bp, Homo sapien
gtcacaggaacagataacttacata

SEQ ID NO: 331161 - DNA, 25 bp, Homo sapien
cacaggaacagataacttacatacg

SEQ ID NO: 331162 - DNA, 25 bp, Homo sapien
acaggaacagataacttacatacga

SEQ ID NO: 331163 - DNA, 25 bp, Homo sapien
caggaacagataacttacatacgac

SEQ ID NO: 331164 - DNA, 25 bp, Homo sapien
aggaacagataacttacatacgaca

SEQ ID NO: 331165 - DNA, 25 bp, Homo sapien
ggaacagataacttacatacgacaa

SEQ ID NO: 331166 - DNA, 25 bp, Homo sapien
gaacagataacttacatacgacaag

SEQ ID NO: 331167 - DNA, 25 bp, Homo sapien
aacagataacttacatacgacaaga

SEQ ID NO: 331168 - DNA, 25 bp, Homo sapien
cagataacttacatacgacaagaat

SEQ ID NO: 331169 - DNA, 25 bp, Homo sapien
gataacttacatacgacaagaatat

SEQ ID NO: 331170 - DNA, 25 bp, Homo sapien
cccggcctttgttcattcagtaaat

SEQ ID NO: 331171 - DNA, 25 bp, Homo sapien
aaggcgcaagggtaactcgaggcct

SEQ ID NO: 331172 - DNA, 25 bp, Homo sapien
gaggccgcaagagtcaccgcagaga

SEQ ID NO: 331173 - DNA, 25 bp, Homo sapien
tcaccgcagagaagagggattggct

SEQ ID NO: 331174 - DNA, 25 bp, Homo sapien
ggattggctgtcttggaccctccga

SEQ ID NO: 331175 - DNA, 25 bp, Homo sapien
aaggactgcaggagagcggattctt

SEQ ID NO: 331176 - DNA, 25 bp, Homo sapien
gcttcacaggatgcgcaggagctct

SEQ ID NO: 331177 - DNA, 25 bp, Homo sapien
gagctctccaggctacagagcgcat

SEQ ID NO: 331178 - DNA, 25 bp, Homo sapien
ggctacagagcgcatttcaggaact

SEQ ID NO: 331179 - DNA, 25 bp, Homo sapien
ggactgggatgtacagaggcaccat

SEQ ID NO: 331180 - DNA, 25 bp, Homo sapien
ttgctcaagccctgcctgattccag

SEQ ID NO: 331181 - DNA, 25 bp, Homo sapien
ggggacatgactataatcccagcat

SEQ ID NO: 331182 - DNA, 25 bp, Homo sapien
gcatttggggagaccgaggctggca

SEQ ID NO: 331183 - DNA, 25 bp, Homo sapien
gttgtagtgagtcgtgatcacacaa

SEQ ID NO: 331184 - DNA, 25 bp, Homo sapien
gtagtgagtcgtgatcacacaactg

SEQ ID NO: 331185 - DNA, 25 bp, Homo sapien
tgggcaacagaacaatactccattc

SEQ ID NO: 331186 - DNA, 25 bp, Homo sapien
gggcaacagaacaatactccattcc

SEQ ID NO: 331187 - DNA, 25 bp, Homo sapien
gcaacagaacaatactccattccct

SEQ ID NO: 331188 - DNA, 25 bp, Homo sapien
caacagaacaatactccattccctc

SEQ ID NO: 331189 - DNA, 25 bp, Homo sapien
aacagaacaatactccattccctcc

SEQ ID NO: 331190 - DNA, 25 bp, Homo sapien
acagaacaatactccattccctccc

SEQ ID NO: 331191 - DNA, 25 bp, Homo sapien
cagaacaatactccattccctcccc

SEQ ID NO: 331192 - DNA, 25 bp, Homo sapien
atataatgaggatttcctgactctt

SEQ ID NO: 331193 - DNA, 25 bp, Homo sapien
ataatgaggatttcctgactctttt

SEQ ID NO: 331194 - DNA, 25 bp, Homo sapien
aatgaggatttcctgactctttttc

SEQ ID NO: 331195 - DNA, 25 bp, Homo sapien
atgaggatttcctgactctttttct

SEQ ID NO: 331196 - DNA, 25 bp, Homo sapien
tgaggatttcctgactctttttctt

SEQ ID NO: 331197 - DNA, 25 bp, Homo sapien
gaggatttcctgactctttttcttt

SEQ ID NO: 331198 - DNA, 25 bp, Homo sapien
aacaaacaacttgccatttaaaatg

SEQ ID NO: 331199 - DNA, 25 bp, Homo sapien
taacatctttgttaagaggccaatt

SEQ ID NO: 331200 - DNA, 25 bp, Homo sapien
acatctttgttaagaggccaattaa

SEQ ID NO: 331201 - DNA, 25 bp, Homo sapien
ttaagaggccaattaatttccaact

SEQ ID NO: 331202 - DNA, 25 bp, Homo sapien
agaggccaattaatttccaactcac

SEQ ID NO: 331203 - DNA, 25 bp, Homo sapien
tctggtggtggttttgccttttctt

SEQ ID NO: 331204 - DNA, 25 bp, Homo sapien
ttccctcctccatgttcttctaaaa

SEQ ID NO: 331205 - DNA, 25 bp, Homo sapien
acacatacacatattcttcaggtct

SEQ ID NO: 331206 - DNA, 25 bp, Homo sapien
acatattcttcaggtctctaagccc

SEQ ID NO: 331207 - DNA, 25 bp, Homo sapien
taagcccctggaagcagcattgtgt

SEQ ID NO: 331208 - DNA, 25 bp, Homo sapien
ttggtatgttctccccatcagcgag

SEQ ID NO: 331209 - DNA, 25 bp, Homo sapien
ttctccccatcagcgagttattgta

SEQ ID NO: 331210 - DNA, 25 bp, Homo sapien
gagttattgtaactggtcaccactg

SEQ ID NO: 331211 - DNA, 25 bp, Homo sapien
taactggtcaccactggacgggaag

SEQ ID NO: 331212 - DNA, 25 bp, Homo sapien
aagcccaacctctgtgatcatatga

SEQ ID NO: 331213 - DNA, 25 bp, Homo sapien
ctgtgatcatatgagggccaaggct

SEQ ID NO: 331214 - DNA, 25 bp, Homo sapien
tgaagctggctaccgacgaaggatt

SEQ ID NO: 331215 - DNA, 25 bp, Homo sapien
gcatcacttccttcattttggataa

SEQ ID NO: 331216 - DNA, 25 bp, Homo sapien
aaatgactatcctgagcttgctgag

SEQ ID NO: 331217 - DNA, 25 bp, Homo sapien
tatcctgagcttgctgagattgctt

SEQ ID NO: 331218 - DNA, 25 bp, Homo sapien
gattgctttaaaattgctgcttctt

SEQ ID NO: 331219 - DNA, 25 bp, Homo sapien
tgctgcttcttttcccctcaacata

SEQ ID NO: 331220 - DNA, 25 bp, Homo sapien
acatacctctgtgagaccggattct

SEQ ID NO: 331221 - DNA, 25 bp, Homo sapien
gagaccggattctctactttaagtg

SEQ ID NO: 331222 - DNA, 25 bp, Homo sapien
aatatacattatcccctgagggtag

SEQ ID NO: 331223 - DNA, 25 bp, Homo sapien
tcccctgagggtagcattgtcatca

SEQ ID NO: 331224 - DNA, 25 bp, Homo sapien
agcattgtcatcaatccaacctaga

SEQ ID NO: 331225 - DNA, 25 bp, Homo sapien
gaaagaaaggtcagggatagcaagc

SEQ ID NO: 331226 - DNA, 25 bp, Homo sapien
agaaaggtcagggatagcaagcaga

SEQ ID NO: 331227 - DNA, 25 bp, Homo sapien
aaaggtcagggatagcaagcagaga

SEQ ID NO: 331228 - DNA, 25 bp, Homo sapien
aggtcagggatagcaagcagagaga

SEQ ID NO: 331229 - DNA, 25 bp, Homo sapien
agggagcgagccggctgccacacac

SEQ ID NO: 331230 - DNA, 25 bp, Homo sapien
ggctgccacacacgccaggtaaaca

SEQ ID NO: 331231 - DNA, 25 bp, Homo sapien
tgccacacacgccaggtaaacaaaa

SEQ ID NO: 331232 - DNA, 25 bp, Homo sapien
gccacacacgccaggtaaacaaaag

SEQ ID NO: 331233 - DNA, 25 bp, Homo sapien
acacacgccaggtaaacaaaagcca

SEQ ID NO: 331234 - DNA, 25 bp, Homo sapien
cacacgccaggtaaacaaaagccaa

SEQ ID NO: 331235 - DNA, 25 bp, Homo sapien
cacgccaggtaaacaaaagccaaca

SEQ ID NO: 331236 - DNA, 25 bp, Homo sapien
agcagagtcacatattcattctttc

SEQ ID NO: 331237 - DNA, 25 bp, Homo sapien
atggagtacccactatgttctaggc

SEQ ID NO: 331238 - DNA, 25 bp, Homo sapien
ccactatgttctaggcacttttcta

SEQ ID NO: 331239 - DNA, 25 bp, Homo sapien
ttttctaggtgttgggactacagca

SEQ ID NO: 331240 - DNA, 25 bp, Homo sapien
aggtgttgggactacagcagtgaac

SEQ ID NO: 331241 - DNA, 25 bp, Homo sapien
acagcagtgaacgagagagaccaaa

SEQ ID NO: 331242 - DNA, 25 bp, Homo sapien
tataagctgggtccttatgatggag

SEQ ID NO: 331243 - DNA, 25 bp, Homo sapien
gaccaaaaagtctctgccttctggc

SEQ ID NO: 331244 - DNA, 25 bp, Homo sapien
aaaagtctctgccttctggccagga

SEQ ID NO: 331245 - DNA, 25 bp, Homo sapien
gtgcttccagcaacaaacaggtcat

SEQ ID NO: 331246 - DNA, 25 bp, Homo sapien
aattgagtggcatctatccaggtga

SEQ ID NO: 331247 - DNA, 25 bp, Homo sapien
ttgggcctaaggagtgagaactaca

SEQ ID NO: 331248 - DNA, 25 bp, Homo sapien
aaatgcttgtccaggactcagccat

SEQ ID NO: 331249 - DNA, 25 bp, Homo sapien
gactcagccatgcacaccttgagca

SEQ ID NO: 331250 - DNA, 25 bp, Homo sapien
acaccttgagcagcgccggcaggag

SEQ ID NO: 331251 - DNA, 25 bp, Homo sapien
aaggaactgtgctccgttctcctca

SEQ ID NO: 331252 - DNA, 25 bp, Homo sapien
tcctcactgtcatggtgccaccagt

SEQ ID NO: 331253 - DNA, 25 bp, Homo sapien
agagtgacccagactgcaggcagta

SEQ ID NO: 331254 - DNA, 25 bp, Homo sapien
agtaactgacttcacacagtccctg

SEQ ID NO: 331255 - DNA, 25 bp, Homo sapien
gtccctggcatttagtcatctgtga

SEQ ID NO: 331256 - DNA, 25 bp, Homo sapien
gtgattgttttatcactctggactg

SEQ ID NO: 331257 - DNA, 25 bp, Homo sapien
gatctgcattccgactgcctatgaa

SEQ ID NO: 331258 - DNA, 25 bp, Homo sapien
aaatacattcttgcctttctaccta

SEQ ID NO: 331259 - DNA, 25 bp, Homo sapien
ctttctacctagagtcagtcttggg

SEQ ID NO: 331260 - DNA, 25 bp, Homo sapien
gcttgtttccagcatcagcagttta

SEQ ID NO: 331261 - DNA, 25 bp, Homo sapien
attttgtctgtatatgtcttttcca

SEQ ID NO: 331262 - DNA, 25 bp, Homo sapien
tatgtcttttccatagtctagtatg

SEQ ID NO: 331263 - DNA, 25 bp, Homo sapien
gtatggttactcaatatcctatcta

SEQ ID NO: 331264 - DNA, 25 bp, Homo sapien
gtatacacctagaattatccaagtt

SEQ ID NO: 331265 - DNA, 25 bp, Homo sapien
tccaagttaggacatcagagtgtac

SEQ ID NO: 331266 - DNA, 25 bp, Homo sapien
gagtgtacttctaacctcaaaaggc

SEQ ID NO: 331267 - DNA, 25 bp, Homo sapien
agagactcgattagcaatttggtat

SEQ ID NO: 331268 - DNA, 25 bp, Homo sapien
tatctttagagttttcacccgttag

SEQ ID NO: 331269 - DNA, 25 bp, Homo sapien
gaagagagcagtaaacatgtccata

SEQ ID NO: 331270 - DNA, 25 bp, Homo sapien
gtaaacatgtccatataccatatgt

SEQ ID NO: 331271 - DNA, 25 bp, Homo sapien
ttttgcctaattatatctcttcctt

SEQ ID NO: 331272 - DNA, 25 bp, Homo sapien
ccttcagatccctttagaagtacat

SEQ ID NO: 331273 - DNA, 25 bp, Homo sapien
tagaagtacattttcagtcaaaagg

SEQ ID NO: 331274 - DNA, 25 bp, Homo sapien
gatggtttgaattgtttccaagctt

SEQ ID NO: 331275 - DNA, 25 bp, Homo sapien
tttccaagcttaggcttatatttaa

SEQ ID NO: 331276 - DNA, 25 bp, Homo sapien
aactgtagggttgacttgagaataa

SEQ ID NO: 331277 - DNA, 25 bp, Homo sapien
tgagaaaaatgctaactcttatgtg

SEQ ID NO: 331278 - DNA, 25 bp, Homo sapien
atgtgatatgtatttcctcaaatca

SEQ ID NO: 331279 - DNA, 25 bp, Homo sapien
gtatttcctcaaatcactttctaaa

SEQ ID NO: 331280 - DNA, 25 bp, Homo sapien
taaattttacccattcccacctgat

SEQ ID NO: 331281 - DNA, 25 bp, Homo sapien
attcccacctgatagtactgtttat

SEQ ID NO: 331282 - DNA, 25 bp, Homo sapien
ctgtttattactttgctatgcagga

SEQ ID NO: 331283 - DNA, 25 bp, Homo sapien
tatttgtgtgtatactctgaagtca

SEQ ID NO: 331284 - DNA, 25 bp, Homo sapien
tctgaagtcaatgtgcatgggttaa

SEQ ID NO: 331285 - DNA, 25 bp, Homo sapien
atgtgcatgggttaaatcccacctc

SEQ ID NO: 331286 - DNA, 25 bp, Homo sapien
tttggacaagttcctaagccctctg

SEQ ID NO: 331287 - DNA, 25 bp, Homo sapien
agttcctaagccctctgtgtcaggc

SEQ ID NO: 331288 - DNA, 25 bp, Homo sapien
gtgtcaggcccctcattaacaaaat

SEQ ID NO: 331289 - DNA, 25 bp, Homo sapien
ggagtttatgatggcatctacctca

SEQ ID NO: 331290 - DNA, 25 bp, Homo sapien
acctcacatggttattgtgtggttg

SEQ ID NO: 331291 - DNA, 25 bp, Homo sapien
aaagacccagttcagagcatctgct

SEQ ID NO: 331292 - DNA, 25 bp, Homo sapien
gagcatctgctataaagccattctt

SEQ ID NO: 331293 - DNA, 25 bp, Homo sapien
ttcttgcaaagtgtccattctcccg

SEQ ID NO: 331294 - DNA, 25 bp, Homo sapien
cccgcaacttgctgtgtgcaactaa

SEQ ID NO: 331295 - DNA, 25 bp, Homo sapien
gtgcaactaattcagctggatccgg

SEQ ID NO: 331296 - DNA, 25 bp, Homo sapien
agctggatccggaaaaggaccctca

SEQ ID NO: 331297 - DNA, 25 bp, Homo sapien
aggaccctcagcctaggatatgttg

SEQ ID NO: 331298 - DNA, 25 bp, Homo sapien
gatatgttggcttttctacaggaga

SEQ ID NO: 331299 - DNA, 25 bp, Homo sapien
ggaaacatctcaaaggtcatctagt

SEQ ID NO: 331300 - DNA, 25 bp, Homo sapien
aaggtcatctagtaagctcattgtt

SEQ ID NO: 331301 - DNA, 25 bp, Homo sapien
agttgttcatcctgctagacctgtt

SEQ ID NO: 331302 - DNA, 25 bp, Homo sapien
ggaactgaccattatatgccttcac

SEQ ID NO: 331303 - DNA, 25 bp, Homo sapien
cattatatgccttcactggcttctt

SEQ ID NO: 331304 - DNA, 25 bp, Homo sapien
actggcttcttgtgcaataatatga

SEQ ID NO: 331305 - DNA, 25 bp, Homo sapien
taatatgatgttttaagtgtgcaaa

SEQ ID NO: 331306 - DNA, 25 bp, Homo sapien
gcaaacaagttagagctggcagctg

SEQ ID NO: 331307 - DNA, 25 bp, Homo sapien
gagctggcagctgaatgatagacaa

SEQ ID NO: 331308 - DNA, 25 bp, Homo sapien
gtgcaaatttgccagcttggagata

SEQ ID NO: 331309 - DNA, 25 bp, Homo sapien
tatatcaaatactttccttcccacc

SEQ ID NO: 331310 - DNA, 25 bp, Homo sapien
gatttgattctggttacagtgccat

SEQ ID NO: 331311 - DNA, 25 bp, Homo sapien
gttacagtgccataaaccttgttac

SEQ ID NO: 331312 - DNA, 25 bp, Homo sapien
gtgccataaaccttgttacatatgt

SEQ ID NO: 331313 - DNA, 25 bp, Homo sapien
agatggtccccgagttcgctgccag

SEQ ID NO: 331314 - DNA, 25 bp, Homo sapien
cgagttcgctgccagccccaagaag

SEQ ID NO: 331315 - DNA, 25 bp, Homo sapien
cagccccaagaaggagaccctcatc

SEQ ID NO: 331316 - DNA, 25 bp, Homo sapien
caggtcggaatgtacggattgtttc

SEQ ID NO: 331317 - DNA, 25 bp, Homo sapien
gaatgtacggattgtttcattttgg

SEQ ID NO: 331318 - DNA, 25 bp, Homo sapien
aagccttacccgtgctgacgaatct

SEQ ID NO: 331319 - DNA, 25 bp, Homo sapien
cgtgctgacgaatctccatgtgatc

SEQ ID NO: 331320 - DNA, 25 bp, Homo sapien
gaatctccatgtgatcgtgtccttt

SEQ ID NO: 331321 - DNA, 25 bp, Homo sapien
atgtgatcgtgtcctttctccatgt

SEQ ID NO: 331322 - DNA, 25 bp, Homo sapien
ttctccatgtgctgcccacagaaag

SEQ ID NO: 331323 - DNA, 25 bp, Homo sapien
tgcccacagaaagcagcgagactgc

SEQ ID NO: 331324 - DNA, 25 bp, Homo sapien
gggacgggcagacgaccgggagcac

SEQ ID NO: 331325 - DNA, 25 bp, Homo sapien
ggacgggcagacgaccgggagcaca

SEQ ID NO: 331326 - DNA, 25 bp, Homo sapien
gacgggcagacgaccgggagcacat

SEQ ID NO: 331327 - DNA, 25 bp, Homo sapien
acgggcagacgaccgggagcacata

SEQ ID NO: 331328 - DNA, 25 bp, Homo sapien
cagacgaccgggagcacatagcggc

SEQ ID NO: 331329 - DNA, 25 bp, Homo sapien
agacgaccgggagcacatagcggcc

SEQ ID NO: 331330 - DNA, 25 bp, Homo sapien
gacgaccgggagcacatagcggccg

SEQ ID NO: 331331 - DNA, 25 bp, Homo sapien
acgaccgggagcacatagcggccgg

SEQ ID NO: 331332 - DNA, 25 bp, Homo sapien
gaccgggagcacatagcggccggga

SEQ ID NO: 331333 - DNA, 25 bp, Homo sapien
accgggagcacatagcggccgggag

SEQ ID NO: 331334 - DNA, 25 bp, Homo sapien
cgggagcacatagcggccgggagcc

SEQ ID NO: 331335 - DNA, 25 bp, Homo sapien
agttcagactccctttgacgacaca

SEQ ID NO: 331336 - DNA, 25 bp, Homo sapien
gactccctttgacgacacataacaa

SEQ ID NO: 331337 - DNA, 25 bp, Homo sapien
cctgtgtccagcactcttttgagaa

SEQ ID NO: 331338 - DNA, 25 bp, Homo sapien
ccagcactcttttgagaatttctct

SEQ ID NO: 331339 - DNA, 25 bp, Homo sapien
ccaaccagtaggaatgtgccctaga

SEQ ID NO: 331340 - DNA, 25 bp, Homo sapien
gaatgtgccctagaaactatgtttt

SEQ ID NO: 331341 - DNA, 25 bp, Homo sapien
ctagaaactatgttttacagctcag

SEQ ID NO: 331342 - DNA, 25 bp, Homo sapien
tacagctcagtccacatcttttcac

SEQ ID NO: 331343 - DNA, 25 bp, Homo sapien
gtccacatcttttcaccttacaaat

SEQ ID NO: 331344 - DNA, 25 bp, Homo sapien
tcttttcaccttacaaattacttat

SEQ ID NO: 331345 - DNA, 25 bp, Homo sapien
tggtggtattgaagactgtgctgct

SEQ ID NO: 331346 - DNA, 25 bp, Homo sapien
gccgcactgaatactctggagtcaa

SEQ ID NO: 331347 - DNA, 25 bp, Homo sapien
aatactctggagtcaaatgtgagaa

SEQ ID NO: 331348 - DNA, 25 bp, Homo sapien
aaatacagataagacgccattgagt

SEQ ID NO: 331349 - DNA, 25 bp, Homo sapien
gacgccattgagtagcatcaagtat

SEQ ID NO: 331350 - DNA, 25 bp, Homo sapien
caagtatatgaattacaagcctgta

SEQ ID NO: 331351 - DNA, 25 bp, Homo sapien
acaagcctgtatcttaagaatggaa

SEQ ID NO: 331352 - DNA, 25 bp, Homo sapien
gtgtattgcagcaatttgcaaccca

SEQ ID NO: 331353 - DNA, 25 bp, Homo sapien
gcagcaatttgcaacccaaaatgtc

SEQ ID NO: 331354 - DNA, 25 bp, Homo sapien
aaatgtctttatggaggcagatgca

SEQ ID NO: 331355 - DNA, 25 bp, Homo sapien
ggcagatgcatatttcccaatgtgt

SEQ ID NO: 331356 - DNA, 25 bp, Homo sapien
aatgtgtgttcctgccgcactgaat

SEQ ID NO: 331357 - DNA, 25 bp, Homo sapien
gtgagattgaattaagagcctatat

SEQ ID NO: 331358 - DNA, 25 bp, Homo sapien
gagcctatatagttcaccttgccat

SEQ ID NO: 331359 - DNA, 25 bp, Homo sapien
atagttcaccttgccattcgatata

SEQ ID NO: 331360 - DNA, 25 bp, Homo sapien
gccattcgatatactttcactgtga

SEQ ID NO: 331361 - DNA, 25 bp, Homo sapien
tttcactgtgatctgtaagcatatt

SEQ ID NO: 331362 - DNA, 25 bp, Homo sapien
ttgttacccaaagccacatgcagtg

SEQ ID NO: 331363 - DNA, 25 bp, Homo sapien
ctagtgagatcttggattgctgcaa

SEQ ID NO: 331364 - DNA, 25 bp, Homo sapien
gcaaggtggtaacagattctctgct

SEQ ID NO: 331365 - DNA, 25 bp, Homo sapien
gtaacagattctctgctttgcttca

SEQ ID NO: 331366 - DNA, 25 bp, Homo sapien
ttgcttcaggtgttagtggatcttt

SEQ ID NO: 331367 - DNA, 25 bp, Homo sapien
gttagtggatctttgagtaattcct

SEQ ID NO: 331368 - DNA, 25 bp, Homo sapien
gaagtacgagtccaaagaggtttct

SEQ ID NO: 331369 - DNA, 25 bp, Homo sapien
caaagaggtttctaccctggaatct

SEQ ID NO: 331370 - DNA, 25 bp, Homo sapien
tggaatctcactgagtgccccagga

SEQ ID NO: 331371 - DNA, 25 bp, Homo sapien
aatctcactgagtgccccaggagag

SEQ ID NO: 331372 - DNA, 25 bp, Homo sapien
tggacctgagctattctcactcgga

SEQ ID NO: 331373 - DNA, 25 bp, Homo sapien
tgagctattctcactcggacctggg

SEQ ID NO: 331374 - DNA, 25 bp, Homo sapien
gggaaacggcccaccaaggacagct

SEQ ID NO: 331375 - DNA, 25 bp, Homo sapien
aaggacagctacacgctgacggagg

SEQ ID NO: 331376 - DNA, 25 bp, Homo sapien
acacgctgacggaggagctagctga

SEQ ID NO: 331377 - DNA, 25 bp, Homo sapien
gctgagtatgctgaaatccgggtca

SEQ ID NO: 331378 - DNA, 25 bp, Homo sapien
aaatccgggtcaagtgaaggagctg

SEQ ID NO: 331379 - DNA, 25 bp, Homo sapien
tctacattctggtgagcggcccgag

SEQ ID NO: 331380 - DNA, 25 bp, Homo sapien
cggcccgaggctgggagctctgggc

SEQ ID NO: 331381 - DNA, 25 bp, Homo sapien
agaacagggctgtggctggacccca

SEQ ID NO: 331382 - DNA, 25 bp, Homo sapien
gaacagggctgtggctggaccccag

SEQ ID NO: 331383 - DNA, 25 bp, Homo sapien
acagggctgtggctggaccccagca

SEQ ID NO: 331384 - DNA, 25 bp, Homo sapien
cccagcactggtgacacgctgggtg

SEQ ID NO: 331385 - DNA, 25 bp, Homo sapien
agcactggtgacacgctgggtggga

SEQ ID NO: 331386 - DNA, 25 bp, Homo sapien
ctggtgacacgctgggtgggagcat

SEQ ID NO: 331387 - DNA, 25 bp, Homo sapien
gtgacacgctgggtgggagcatgag

SEQ ID NO: 331388 - DNA, 25 bp, Homo sapien
acgctgggtgggagcatgaggcccc

SEQ ID NO: 331389 - DNA, 25 bp, Homo sapien
gctggaggtcctcgcccggggaggt

SEQ ID NO: 331390 - DNA, 25 bp, Homo sapien
agagctgtgtttctgtccatcacct

SEQ ID NO: 331391 - DNA, 25 bp, Homo sapien
tgtttctgtccatcacctgtgtatt

SEQ ID NO: 331392 - DNA, 25 bp, Homo sapien
atcacctgtgtattggccctgtgtt

SEQ ID NO: 331393 - DNA, 25 bp, Homo sapien
attggccctgtgtttaccactctgg

SEQ ID NO: 331394 - DNA, 25 bp, Homo sapien
ttgctcccctggtcttctggagttt

SEQ ID NO: 331395 - DNA, 25 bp, Homo sapien
tggatggtgttctcttgagagcaag

SEQ ID NO: 331396 - DNA, 25 bp, Homo sapien
taagttccaactatacagttttcta

SEQ ID NO: 331397 - DNA, 25 bp, Homo sapien
tagctataaggtccttgttgctgtt

SEQ ID NO: 331398 - DNA, 25 bp, Homo sapien
gttgctgtttgtgataactgataga

SEQ ID NO: 331399 - DNA, 25 bp, Homo sapien
aactcattggaaacgtgcatacatt

SEQ ID NO: 331400 - DNA, 25 bp, Homo sapien
agatgaaattatggtttgcactgtc

SEQ ID NO: 331401 - DNA, 25 bp, Homo sapien
agcgagaggcgcctgggatctgaga

SEQ ID NO: 331402 - DNA, 25 bp, Homo sapien
gctggacctgagctattctcactcg

SEQ ID NO: 331403 - DNA, 25 bp, Homo sapien
tggacctgagctattctcactcgga

SEQ ID NO: 331404 - DNA, 25 bp, Homo sapien
tgagctattctcactcggacctggg

SEQ ID NO: 331405 - DNA, 25 bp, Homo sapien
caccaaggacagctacacgctgacg

SEQ ID NO: 331406 - DNA, 25 bp, Homo sapien
aaggacagctacacgctgacggagg

SEQ ID NO: 331407 - DNA, 25 bp, Homo sapien
gaggagctagctgagtatgctgaaa

SEQ ID NO: 331408 - DNA, 25 bp, Homo sapien
gctgagtatgctgaaatccgggtca

SEQ ID NO: 331409 - DNA, 25 bp, Homo sapien
gagtatgctgaaatccgggtcaagt

SEQ ID NO: 331410 - DNA, 25 bp, Homo sapien
gtatgctgaaatccgggtcaagtga

SEQ ID NO: 331411 - DNA, 25 bp, Homo sapien
aaatccgggtcaagtgaaggagctg

SEQ ID NO: 331412 - DNA, 25 bp, Homo sapien
cttttctgtatgtcttgggcaggca

SEQ ID NO: 331413 - DNA, 25 bp, Homo sapien
gcatgttgctaaagagggcctctac

SEQ ID NO: 331414 - DNA, 25 bp, Homo sapien
ggcctctaccctttaatgaaactgt

SEQ ID NO: 331415 - DNA, 25 bp, Homo sapien
gaaaccactgttccgatactgcttt

SEQ ID NO: 331416 - DNA, 25 bp, Homo sapien
actgttttacctgaataagctttga

SEQ ID NO: 331417 - DNA, 25 bp, Homo sapien
tgaatattatgctgtcccatctcct

SEQ ID NO: 331418 - DNA, 25 bp, Homo sapien
tcagctactctccacaactttaaaa

SEQ ID NO: 331419 - DNA, 25 bp, Homo sapien
ctgctttcctttgctaagtttaaat

SEQ ID NO: 331420 - DNA, 25 bp, Homo sapien
attccagcctcctaattctaatgtt

SEQ ID NO: 331421 - DNA, 25 bp, Homo sapien
taatgttttcgtgggaccttctaca

SEQ ID NO: 331422 - DNA, 25 bp, Homo sapien
accttctacaatccttcttttctgt

SEQ ID NO: 331423 - DNA, 25 bp, Homo sapien
gagtaggctgtgaagaagatagaaa

SEQ ID NO: 331424 - DNA, 25 bp, Homo sapien
gatagaaaacaacagcctacttgtg

SEQ ID NO: 331425 - DNA, 25 bp, Homo sapien
tagaaaacaacagcctacttgtgtt

SEQ ID NO: 331426 - DNA, 25 bp, Homo sapien
acaacagcctacttgtgttcactgt

SEQ ID NO: 331427 - DNA, 25 bp, Homo sapien
caacagcctacttgtgttcactgtg

SEQ ID NO: 331428 - DNA, 25 bp, Homo sapien
aagtcaacactctgattcagtctga

SEQ ID NO: 331429 - DNA, 25 bp, Homo sapien
gtcaacactctgattcagtctgatg

SEQ ID NO: 331430 - DNA, 25 bp, Homo sapien
caacactctgattcagtctgatgga

SEQ ID NO: 331431 - DNA, 25 bp, Homo sapien
acactctgattcagtctgatggaga

SEQ ID NO: 331432 - DNA, 25 bp, Homo sapien
actctgattcagtctgatggagaga

SEQ ID NO: 331433 - DNA, 25 bp, Homo sapien
ctgattcagtctgatggagagagga

SEQ ID NO: 331434 - DNA, 25 bp, Homo sapien
tggcgtgtgtggcagccggctcgct

SEQ ID NO: 331435 - DNA, 25 bp, Homo sapien
tctctgcttgctatccctgaccttt

SEQ ID NO: 331436 - DNA, 25 bp, Homo sapien
tctgcttgctatccctgacctttct

SEQ ID NO: 331437 - DNA, 25 bp, Homo sapien
tgcttgctatccctgacctttcttt

SEQ ID NO: 331438 - DNA, 25 bp, Homo sapien
ttgctatccctgacctttctttctt

SEQ ID NO: 331439 - DNA, 25 bp, Homo sapien
tgctatccctgacctttctttcttt

SEQ ID NO: 331440 - DNA, 25 bp, Homo sapien
tttaaactggaagaggatgcacagg

SEQ ID NO: 331441 - DNA, 25 bp, Homo sapien
ttaaactggaagaggatgcacaggg

SEQ ID NO: 331442 - DNA, 25 bp, Homo sapien
tggcttttgtttacctggcgtgtgt

SEQ ID NO: 331443 - DNA, 25 bp, Homo sapien
cttttgtttacctggcgtgtgtggc

SEQ ID NO: 331444 - DNA, 25 bp, Homo sapien
tgtttacctggcgtgtgtggcagcc

SEQ ID NO: 331445 - DNA, 25 bp, Homo sapien
acggagtaaataatagtgcctttct

SEQ ID NO: 331446 - DNA, 25 bp, Homo sapien
gtgcctttctaggatggatgccaat

SEQ ID NO: 331447 - DNA, 25 bp, Homo sapien
gatgccaatgttgtttggattcaac

SEQ ID NO: 331448 - DNA, 25 bp, Homo sapien
gggtgtaacgcggtgcctgatacat

SEQ ID NO: 331449 - DNA, 25 bp, Homo sapien
cgcggtgcctgatacatgaaagtta

SEQ ID NO: 331450 - DNA, 25 bp, Homo sapien
aagcatgagctcttgggtttttgtt

SEQ ID NO: 331451 - DNA, 25 bp, Homo sapien
agatttcttctctcttggtggctct

SEQ ID NO: 331452 - DNA, 25 bp, Homo sapien
ctcttggtggctctttaatgaatag

SEQ ID NO: 331453 - DNA, 25 bp, Homo sapien
caccccttgctagctgtgtaaagtt

SEQ ID NO: 331454 - DNA, 25 bp, Homo sapien
taaagttaaccactgtgactctcag

SEQ ID NO: 331455 - DNA, 25 bp, Homo sapien
gtttcctcgtctgccaaacggagta

SEQ ID NO: 331456 - DNA, 25 bp, Homo sapien
gctagtggactggacctcagcggac

SEQ ID NO: 331457 - DNA, 25 bp, Homo sapien
gactggacctcagcggacccgtggt

SEQ ID NO: 331458 - DNA, 25 bp, Homo sapien
ggaccggtggattccttaaggctct

SEQ ID NO: 331459 - DNA, 25 bp, Homo sapien
ccggtggattccttaaggctctgaa

SEQ ID NO: 331460 - DNA, 25 bp, Homo sapien
tggattccttaaggctctgaagggc

SEQ ID NO: 331461 - DNA, 25 bp, Homo sapien
gagaacagttctagaagcgtcccaa

SEQ ID NO: 331462 - DNA, 25 bp, Homo sapien
gttctagaagcgtcccaaagggtgc

SEQ ID NO: 331463 - DNA, 25 bp, Homo sapien
tgggaaaggtcccagcgtgggttga

SEQ ID NO: 331464 - DNA, 25 bp, Homo sapien
aggagggaagatccgagttcctcac

SEQ ID NO: 331465 - DNA, 25 bp, Homo sapien
gaagatccgagttcctcaccgcggg

SEQ ID NO: 331466 - DNA, 25 bp, Homo sapien
aggcgcgctagtggactggacctca

SEQ ID NO: 331467 - DNA, 25 bp, Homo sapien
ggagacagctggcactattctcata

SEQ ID NO: 331468 - DNA, 25 bp, Homo sapien
gctggcactattctcatagccttaa

SEQ ID NO: 331469 - DNA, 25 bp, Homo sapien
tctcatagccttaaatgcttttatt

SEQ ID NO: 331470 - DNA, 25 bp, Homo sapien
aataaactaagcattcagcctgagt

SEQ ID NO: 331471 - DNA, 25 bp, Homo sapien
tttgatcaccatgcagtaaacctcg

SEQ ID NO: 331472 - DNA, 25 bp, Homo sapien
atgcagtaaacctcgccaaaatatt

SEQ ID NO: 331473 - DNA, 25 bp, Homo sapien
taaacctcgccaaaatattgtaaat

SEQ ID NO: 331474 - DNA, 25 bp, Homo sapien
gcacttaaattgctattggttcaag

SEQ ID NO: 331475 - DNA, 25 bp, Homo sapien
tagaatgccacatacccaaacctat

SEQ ID NO: 331476 - DNA, 25 bp, Homo sapien
gaatgccacatacccaaacctatgg

SEQ ID NO: 331477 - DNA, 25 bp, Homo sapien
aaacctatgggagacagctggcact

SEQ ID NO: 331478 - DNA, 25 bp, Homo sapien
ggaagtggacgggccgcacaaccaa

SEQ ID NO: 331479 - DNA, 25 bp, Homo sapien
tcatgaggacaaccatgtcttcggg

SEQ ID NO: 331480 - DNA, 25 bp, Homo sapien
atagagaagctgaattctcctgttt

SEQ ID NO: 331481 - DNA, 25 bp, Homo sapien
gtgcacagacagctccatagtcctg

SEQ ID NO: 331482 - DNA, 25 bp, Homo sapien
tccaatgtcccaacactgcattgtc

SEQ ID NO: 331483 - DNA, 25 bp, Homo sapien
cacttagcagccctgcagggtgaga

SEQ ID NO: 331484 - DNA, 25 bp, Homo sapien
tagcagccctgcagggtgagacttg

SEQ ID NO: 331485 - DNA, 25 bp, Homo sapien
gaggatcctgaaatgattgtattta

SEQ ID NO: 331486 - DNA, 25 bp, Homo sapien
ctgtttttctgaaaagggcatggga

SEQ ID NO: 331487 - DNA, 25 bp, Homo sapien
cagacctggtgggcctgagagtctc

SEQ ID NO: 331488 - DNA, 25 bp, Homo sapien
gagagtctcaatcgtcaggtaagga

SEQ ID NO: 331489 - DNA, 25 bp, Homo sapien
gttgctgccttttcactaatgtatc

SEQ ID NO: 331490 - DNA, 25 bp, Homo sapien
aatgtatccctgagctgcacagagc

SEQ ID NO: 331491 - DNA, 25 bp, Homo sapien
gttcatccatacaatgatgctctga

SEQ ID NO: 331492 - DNA, 25 bp, Homo sapien
gtgagccttaaatgatcaccaacaa

SEQ ID NO: 331493 - DNA, 25 bp, Homo sapien
gatcaccaacaaacaacagggcctg

SEQ ID NO: 331494 - DNA, 25 bp, Homo sapien
gggcttacaccacgacatgtggtcc

SEQ ID NO: 331495 - DNA, 25 bp, Homo sapien
gacatgtggtcctcgcagcaccatt

SEQ ID NO: 331496 - DNA, 25 bp, Homo sapien
tcgcagcaccattgctcagaggaag

SEQ ID NO: 331497 - DNA, 25 bp, Homo sapien
gatgctctgaggagcacacaaggaa

SEQ ID NO: 331498 - DNA, 25 bp, Homo sapien
gcatgatgtaaggagcataaacccc

SEQ ID NO: 331499 - DNA, 25 bp, Homo sapien
cccctcaggaaagagttgctgcctt

SEQ ID NO: 331500 - DNA, 25 bp, Homo sapien
ctccagaatgaaacagtgtacttat

SEQ ID NO: 331501 - DNA, 25 bp, Homo sapien
gggaaaaaagcaaactcacacatta

SEQ ID NO: 331502 - DNA, 25 bp, Homo sapien
aaaaagcaaactcacacattatttt

SEQ ID NO: 331503 - DNA, 25 bp, Homo sapien
taagttaaacctttgagagatgcca

SEQ ID NO: 331504 - DNA, 25 bp, Homo sapien
gttaaacctttgagagatgccaaaa

SEQ ID NO: 331505 - DNA, 25 bp, Homo sapien
agggttaataggatacaaagtgcaa

SEQ ID NO: 331506 - DNA, 25 bp, Homo sapien
aaaagaggtgattcaaactgttgag

SEQ ID NO: 331507 - DNA, 25 bp, Homo sapien
ttcaaactgttgagagaagtccatt

SEQ ID NO: 331508 - DNA, 25 bp, Homo sapien
ctgttgagagaagtccattgttttc

SEQ ID NO: 331509 - DNA, 25 bp, Homo sapien
agagaagtccattgttttctaaggg

SEQ ID NO: 331510 - DNA, 25 bp, Homo sapien
atagaactccagaatgaaacagtgt

SEQ ID NO: 331511 - DNA, 25 bp, Homo sapien
ttggtttctttcattacagggcaaa

SEQ ID NO: 331512 - DNA, 25 bp, Homo sapien
gggcaaagttctccctgtggactga

SEQ ID NO: 331513 - DNA, 25 bp, Homo sapien
aaagttctccctgtggactgagaaa

SEQ ID NO: 331514 - DNA, 25 bp, Homo sapien
ctccctgtggactgagaaataaaca

SEQ ID NO: 331515 - DNA, 25 bp, Homo sapien
ataaaagttacatatgctcatagaa

SEQ ID NO: 331516 - DNA, 25 bp, Homo sapien
gaggtaaccatttttgagttgatgc

SEQ ID NO: 331517 - DNA, 25 bp, Homo sapien
gagttgatgcgtatccttcgcctga

SEQ ID NO: 331518 - DNA, 25 bp, Homo sapien
gtatccttcgcctgagagctatctt

SEQ ID NO: 331519 - DNA, 25 bp, Homo sapien
cttcgcctgagagctatctttgtaa

SEQ ID NO: 331520 - DNA, 25 bp, Homo sapien
gagagctatctttgtaatcatcctt

SEQ ID NO: 331521 - DNA, 25 bp, Homo sapien
tgtaatcatcctttttggtttcttt

SEQ ID NO: 331522 - DNA, 25 bp, Homo sapien
gtggcagccagttcggcaggaaatt

SEQ ID NO: 331523 - DNA, 25 bp, Homo sapien
ggaacttcacaggaaaagtctggag

SEQ ID NO: 331524 - DNA, 25 bp, Homo sapien
tttatgtgtgggaagcaatgcgact

SEQ ID NO: 331525 - DNA, 25 bp, Homo sapien
gaagcaatgcgactttactgttatt

SEQ ID NO: 331526 - DNA, 25 bp, Homo sapien
gcgactttactgttattgacccttt

SEQ ID NO: 331527 - DNA, 25 bp, Homo sapien
ttgaccctttacaatatcccctgta

SEQ ID NO: 331528 - DNA, 25 bp, Homo sapien
agctagtggcaatacattccttctc

SEQ ID NO: 331529 - DNA, 25 bp, Homo sapien
attccttctcctcagagttgaaggc

SEQ ID NO: 331530 - DNA, 25 bp, Homo sapien
gttgaaggcaagttctccctgaagc

SEQ ID NO: 331531 - DNA, 25 bp, Homo sapien
agcctgggtgacacatgtccttttc

SEQ ID NO: 331532 - DNA, 25 bp, Homo sapien
gtgacacatgtccttttcctaagac

SEQ ID NO: 331533 - DNA, 25 bp, Homo sapien
agggaagagctctctctcacctgaa

SEQ ID NO: 331534 - DNA, 25 bp, Homo sapien
aaaagacccattttggccgtgatct

SEQ ID NO: 331535 - DNA, 25 bp, Homo sapien
agggtctgaattggaggcacctccc

SEQ ID NO: 331536 - DNA, 25 bp, Homo sapien
gaggcacctccccaaagatcaaaag

SEQ ID NO: 331537 - DNA, 25 bp, Homo sapien
aagatcaaaagttatgctccaccaa

SEQ ID NO: 331538 - DNA, 25 bp, Homo sapien
aagttatgctccaccaacacagaga

SEQ ID NO: 331539 - DNA, 25 bp, Homo sapien
atgctccaccaacacagagacactg

SEQ ID NO: 331540 - DNA, 25 bp, Homo sapien
ttttggccgtgatctaaaagggcat

SEQ ID NO: 331541 - DNA, 25 bp, Homo sapien
cactgagaaatggttgaatgtgttc

SEQ ID NO: 331542 - DNA, 25 bp, Homo sapien
aaaagggcattagctgatggttagt

SEQ ID NO: 331543 - DNA, 25 bp, Homo sapien
gcattagctgatggttagtatacac

SEQ ID NO: 331544 - DNA, 25 bp, Homo sapien
tggcctgacttgctcagccagcaat

SEQ ID NO: 331545 - DNA, 25 bp, Homo sapien
aactatttgccccagacaactgttt

SEQ ID NO: 331546 - DNA, 25 bp, Homo sapien
agcaatgcggtgcaggctcctagct

SEQ ID NO: 331547 - DNA, 25 bp, Homo sapien
atatggctgcttggacttcctcata

SEQ ID NO: 331548 - DNA, 25 bp, Homo sapien
ggacttcctcatagcatggcagatg

SEQ ID NO: 331549 - DNA, 25 bp, Homo sapien
gattacgagaaggagcattcccaaa

SEQ ID NO: 331550 - DNA, 25 bp, Homo sapien
aaggaccacataagctagatctctg

SEQ ID NO: 331551 - DNA, 25 bp, Homo sapien
tagatctctggagggctagcctcag

SEQ ID NO: 331552 - DNA, 25 bp, Homo sapien
ttccttctatggattgaccagccag

SEQ ID NO: 331553 - DNA, 25 bp, Homo sapien
cagccagttctgctttagatggtat

SEQ ID NO: 331554 - DNA, 25 bp, Homo sapien
atggtattggatggagccctggaat

SEQ ID NO: 331555 - DNA, 25 bp, Homo sapien
agacctaaacaacggtgtgacaccg

SEQ ID NO: 331556 - DNA, 25 bp, Homo sapien
cggtgtgacaccgagaatccttaca

SEQ ID NO: 331557 - DNA, 25 bp, Homo sapien
gacaccgagaatccttacaccaaag

SEQ ID NO: 331558 - DNA, 25 bp, Homo sapien
gagaatccttacaccaaagctgatg

SEQ ID NO: 331559 - DNA, 25 bp, Homo sapien
tccttacaccaaagctgatgggcgt

SEQ ID NO: 331560 - DNA, 25 bp, Homo sapien
caccaaagctgatgggcgtggagac

SEQ ID NO: 331561 - DNA, 25 bp, Homo sapien
ggcgtggagacggttgtgtgacaat

SEQ ID NO: 331562 - DNA, 25 bp, Homo sapien
aaggattgctgctctccattaggag

SEQ ID NO: 331563 - DNA, 25 bp, Homo sapien
gctgctctccattaggagacaatga

SEQ ID NO: 331564 - DNA, 25 bp, Homo sapien
aacttttgatgccattgagattcac

SEQ ID NO: 331565 - DNA, 25 bp, Homo sapien
ttgagattcacctcccacaaactga

SEQ ID NO: 331566 - DNA, 25 bp, Homo sapien
aattgtgtacttcctccatgtttat

SEQ ID NO: 331567 - DNA, 25 bp, Homo sapien
atgtttatctctcttctatcacttc

SEQ ID NO: 331568 - DNA, 25 bp, Homo sapien
tatcacttcctctagtacaagccag

SEQ ID NO: 331569 - DNA, 25 bp, Homo sapien
gcacataccacatagctccatggag

SEQ ID NO: 331570 - DNA, 25 bp, Homo sapien
gagatgcccatgtgactgtgatgaa

SEQ ID NO: 331571 - DNA, 25 bp, Homo sapien
gagctaagacttcctgtcagtggcc

SEQ ID NO: 331572 - DNA, 25 bp, Homo sapien
ggccgtgtgagtgacccatgttaga

SEQ ID NO: 331573 - DNA, 25 bp, Homo sapien
atgttagagacagatccgccagccc

SEQ ID NO: 331574 - DNA, 25 bp, Homo sapien
gcccaaacagaaccttcagacaact

SEQ ID NO: 331575 - DNA, 25 bp, Homo sapien
atgagcgattctaagcccaccgaag

SEQ ID NO: 331576 - DNA, 25 bp, Homo sapien
cccaccgaagctgctcttgaattat

SEQ ID NO: 331577 - DNA, 25 bp, Homo sapien
aatagcatagacatttggtgtgaag

SEQ ID NO: 331578 - DNA, 25 bp, Homo sapien
taaaaagatctctcactgggaaaag

SEQ ID NO: 331579 - DNA, 25 bp, Homo sapien
gttttccttgtactttattaatctg

SEQ ID NO: 331580 - DNA, 25 bp, Homo sapien
ttaatctgaatctaatggcacttcc

SEQ ID NO: 331581 - DNA, 25 bp, Homo sapien
ctaatggcacttccttacgagggtt

SEQ ID NO: 331582 - DNA, 25 bp, Homo sapien
ggcacttccttacgagggttttcag

SEQ ID NO: 331583 - DNA, 25 bp, Homo sapien
ccttacgagggttttcagatgtgct

SEQ ID NO: 331584 - DNA, 25 bp, Homo sapien
ttcagatgtgcttgtagttaatggc

SEQ ID NO: 331585 - DNA, 25 bp, Homo sapien
gtgcttgtagttaatggcaacatta

SEQ ID NO: 331586 - DNA, 25 bp, Homo sapien
ggcaacattatcagaatgactacac

SEQ ID NO: 331587 - DNA, 25 bp, Homo sapien
atgactacacagacagtcctactct

SEQ ID NO: 331588 - DNA, 25 bp, Homo sapien
atttcctcccagaaattatcatctt

SEQ ID NO: 331589 - DNA, 25 bp, Homo sapien
tatcatcttggtatcactgagacaa

SEQ ID NO: 331590 - DNA, 25 bp, Homo sapien
gaaattaggattatgtctgtccaca

SEQ ID NO: 331591 - DNA, 25 bp, Homo sapien
atgtctgtccacataaatcgcaagg

SEQ ID NO: 331592 - DNA, 25 bp, Homo sapien
atcgcaaggaagaaggtattctgtt

SEQ ID NO: 331593 - DNA, 25 bp, Homo sapien
ttctgtttatttcctgtccactgac

SEQ ID NO: 331594 - DNA, 25 bp, Homo sapien
tttatttcctgtccactgactgatg

SEQ ID NO: 331595 - DNA, 25 bp, Homo sapien
tgtccactgactgatgctttcgtat

SEQ ID NO: 331596 - DNA, 25 bp, Homo sapien
gactgatgctttcgtatcaccatgt

SEQ ID NO: 331597 - DNA, 25 bp, Homo sapien
tttcgtatcaccatgtagctgcaca

SEQ ID NO: 331598 - DNA, 25 bp, Homo sapien
atcaccatgtagctgcacatactaa

SEQ ID NO: 331599 - DNA, 25 bp, Homo sapien
gctggttttcaattctctgaagcct

SEQ ID NO: 331600 - DNA, 25 bp, Homo sapien
gggttcctcaggtcatttcctaata

SEQ ID NO: 331601 - DNA, 25 bp, Homo sapien
tcaattctctgaagccttgtgtagc

SEQ ID NO: 331602 - DNA, 25 bp, Homo sapien
aagccttgtgtagctttcagagcac

SEQ ID NO: 331603 - DNA, 25 bp, Homo sapien
agctttcagagcacacgtatcctaa

SEQ ID NO: 331604 - DNA, 25 bp, Homo sapien
agagcacacgtatcctaattaccct

SEQ ID NO: 331605 - DNA, 25 bp, Homo sapien
tcttcctcagcagaacccatttgag

SEQ ID NO: 331606 - DNA, 25 bp, Homo sapien
gcagaacccatttgagattctaaat

SEQ ID NO: 331607 - DNA, 25 bp, Homo sapien
atactcttagtctctaaagttgcag

SEQ ID NO: 331608 - DNA, 25 bp, Homo sapien
ggtcatttcctaatatctgtcccta

SEQ ID NO: 331609 - DNA, 25 bp, Homo sapien
tcctaatatctgtccctatccaatg

SEQ ID NO: 331610 - DNA, 25 bp, Homo sapien
ttctagtatttaggtaacattaccg

SEQ ID NO: 331611 - DNA, 25 bp, Homo sapien
gtaacattaccggatggcatttccc

SEQ ID NO: 331612 - DNA, 25 bp, Homo sapien
aacattaccggatggcatttccctt

SEQ ID NO: 331613 - DNA, 25 bp, Homo sapien
acattaccggatggcatttccctta

SEQ ID NO: 331614 - DNA, 25 bp, Homo sapien
taccggatggcatttcccttaaatt

SEQ ID NO: 331615 - DNA, 25 bp, Homo sapien
cggatggcatttcccttaaattcca

SEQ ID NO: 331616 - DNA, 25 bp, Homo sapien
gatggcatttcccttaaattccacc

SEQ ID NO: 331617 - DNA, 25 bp, Homo sapien
tggcatttcccttaaattccaccaa

SEQ ID NO: 331618 - DNA, 25 bp, Homo sapien
taaattccaccaactcttaatcttt

SEQ ID NO: 331619 - DNA, 25 bp, Homo sapien
aattccaccaactcttaatctttat

SEQ ID NO: 331620 - DNA, 25 bp, Homo sapien
ttccaccaactcttaatctttattt

SEQ ID NO: 331621 - DNA, 25 bp, Homo sapien
gttattcacagtacactccactgtc

SEQ ID NO: 331622 - DNA, 25 bp, Homo sapien
cacgagttgtaagttctctttctgt

SEQ ID NO: 331623 - DNA, 25 bp, Homo sapien
tttcctgggtttgcaaatcagctta

SEQ ID NO: 331624 - DNA, 25 bp, Homo sapien
gcaaatcagcttaggctcgtcatag

SEQ ID NO: 331625 - DNA, 25 bp, Homo sapien
aggctcgtcatagcttctgagttag

SEQ ID NO: 331626 - DNA, 25 bp, Homo sapien
agcatagggttgttgtttgtcagca

SEQ ID NO: 331627 - DNA, 25 bp, Homo sapien
gttgtttgtcagcagtcttgagaag

SEQ ID NO: 331628 - DNA, 25 bp, Homo sapien
gacaaatgtcttttcaaggattgtg

SEQ ID NO: 331629 - DNA, 25 bp, Homo sapien
caaggattgtgttttcagcctgtag

SEQ ID NO: 331630 - DNA, 25 bp, Homo sapien
gttttcagcctgtaggatcccagcc

SEQ ID NO: 331631 - DNA, 25 bp, Homo sapien
gatcccagcctggttgctatagtta

SEQ ID NO: 331632 - DNA, 25 bp, Homo sapien
tggagtctgccctgatgccccactg

SEQ ID NO: 331633 - DNA, 25 bp, Homo sapien
gctgactgttgcatggagcccccga

SEQ ID NO: 331634 - DNA, 25 bp, Homo sapien
cctgagccgcgatccatgtagcact

SEQ ID NO: 331635 - DNA, 25 bp, Homo sapien
gagccgcgatccatgtagcactcct

SEQ ID NO: 331636 - DNA, 25 bp, Homo sapien
ttctgtaaataactggtgtgcacct

SEQ ID NO: 331637 - DNA, 25 bp, Homo sapien
ataactggtgtgcacctgcgtacta

SEQ ID NO: 331638 - DNA, 25 bp, Homo sapien
tggtgtgcacctgcgtactaatctc

SEQ ID NO: 331639 - DNA, 25 bp, Homo sapien
gtgcacctgcgtactaatctcacga

SEQ ID NO: 331640 - DNA, 25 bp, Homo sapien
acctgcgtactaatctcacgactgt

SEQ ID NO: 331641 - DNA, 25 bp, Homo sapien
gcgtactaatctcacgactgttaac

SEQ ID NO: 331642 - DNA, 25 bp, Homo sapien
tactaatctcacgactgttaacttc

SEQ ID NO: 331643 - DNA, 25 bp, Homo sapien
gaaaagcaaggccaaccacttcctg

SEQ ID NO: 331644 - DNA, 25 bp, Homo sapien
ttcctgatcctctttcgcgactcga

SEQ ID NO: 331645 - DNA, 25 bp, Homo sapien
tctttcgcgactcgagctgccagtt

SEQ ID NO: 331646 - DNA, 25 bp, Homo sapien
agttccgggcgctctacacgctgtc

SEQ ID NO: 331647 - DNA, 25 bp, Homo sapien
cccgccatggtggaaggcatctaca

SEQ ID NO: 331648 - DNA, 25 bp, Homo sapien
gaaggcatctacaagtacaactcgg

SEQ ID NO: 331649 - DNA, 25 bp, Homo sapien
agtacaactcggaccgcaagcgctt

SEQ ID NO: 331650 - DNA, 25 bp, Homo sapien
gccaagaccatgtccatgagcgtcg

SEQ ID NO: 331651 - DNA, 25 bp, Homo sapien
atgtccatgagcgtcgatgccttca

SEQ ID NO: 331652 - DNA, 25 bp, Homo sapien
cagggacacctctggcagggcaaga

SEQ ID NO: 331653 - DNA, 25 bp, Homo sapien
tggcagggcaagaaacccaccactc

SEQ ID NO: 331654 - DNA, 25 bp, Homo sapien
atggttggtaatgatactctgtata

SEQ ID NO: 331655 - DNA, 25 bp, Homo sapien
acaaatatatttgtacctgaggtac

SEQ ID NO: 331656 - DNA, 25 bp, Homo sapien
cctgaggtacagattagaggtgcta

SEQ ID NO: 331657 - DNA, 25 bp, Homo sapien
attagaggtgctagtaattccttga

SEQ ID NO: 331658 - DNA, 25 bp, Homo sapien
ctctcacatcaggtatttccagtgt

SEQ ID NO: 331659 - DNA, 25 bp, Homo sapien
tttccagtgttttcaagcatgtata

SEQ ID NO: 331660 - DNA, 25 bp, Homo sapien
tgttgtttaaaatcccctcaatcgg

SEQ ID NO: 331661 - DNA, 25 bp, Homo sapien
ttaaaatcccctcaatcggtatctc

SEQ ID NO: 331662 - DNA, 25 bp, Homo sapien
aatcccctcaatcggtatctcctga

SEQ ID NO: 331663 - DNA, 25 bp, Homo sapien
aatcggtatctcctgattgagaaaa

SEQ ID NO: 331664 - DNA, 25 bp, Homo sapien
tgattgagaaaatacacagtgacca

SEQ ID NO: 331665 - DNA, 25 bp, Homo sapien
catataaatttcttaaagtcgagga

SEQ ID NO: 331666 - DNA, 25 bp, Homo sapien
aagtcgaggaccttataagggtgca

SEQ ID NO: 331667 - DNA, 25 bp, Homo sapien
gtcgaggaccttataagggtgcaat

SEQ ID NO: 331668 - DNA, 25 bp, Homo sapien
ccttataagggtgcaatggatgttt

SEQ ID NO: 331669 - DNA, 25 bp, Homo sapien
ataagggtgcaatggatgtttgcta

SEQ ID NO: 331670 - DNA, 25 bp, Homo sapien
tttgctaaatatgaaaaactgactt

SEQ ID NO: 331671 - DNA, 25 bp, Homo sapien
cttggatgaagggattaaactgagc

SEQ ID NO: 331672 - DNA, 25 bp, Homo sapien
gatgaagggattaaactgagcaaat

SEQ ID NO: 331673 - DNA, 25 bp, Homo sapien
aaactgagcaaatcactagaagtat

SEQ ID NO: 331674 - DNA, 25 bp, Homo sapien
aatcactagaagtatgccctgtccc

SEQ ID NO: 331675 - DNA, 25 bp, Homo sapien
tcactagaagtatgccctgtcccct

SEQ ID NO: 331676 - DNA, 25 bp, Homo sapien
taaactagtaaccatcccctcctca

SEQ ID NO: 331677 - DNA, 25 bp, Homo sapien
aggtttgcatcttttgcctgcttta

SEQ ID NO: 331678 - DNA, 25 bp, Homo sapien
ttgcctgctttaccgttcctgagga

SEQ ID NO: 331679 - DNA, 25 bp, Homo sapien
tttaccgttcctgaggatcctcttt

SEQ ID NO: 331680 - DNA, 25 bp, Homo sapien
ctgaggatcctctttcacttctgga

SEQ ID NO: 331681 - DNA, 25 bp, Homo sapien
ttcacttctggaaatcagtagatac

SEQ ID NO: 331682 - DNA, 25 bp, Homo sapien
agtagatacagttttccaatctctc

SEQ ID NO: 331683 - DNA, 25 bp, Homo sapien
cagtgtttatttggcagcaatttta

SEQ ID NO: 331684 - DNA, 25 bp, Homo sapien
atttggcagcaattttatcaggaac

SEQ ID NO: 331685 - DNA, 25 bp, Homo sapien
atcaggaacataatctaaactcagc

SEQ ID NO: 331686 - DNA, 25 bp, Homo sapien
tcagctttttaaccagaaaaatcag

SEQ ID NO: 331687 - DNA, 25 bp, Homo sapien
gtccttcagagtttcagctgcatcc

SEQ ID NO: 331688 - DNA, 25 bp, Homo sapien
gtgtgtgctctactttgatggaaac

SEQ ID NO: 331689 - DNA, 25 bp, Homo sapien
gaaggtgtgttcgtaacctctgatt

SEQ ID NO: 331690 - DNA, 25 bp, Homo sapien
gtaacctctgattctgtggacttgc

SEQ ID NO: 331691 - DNA, 25 bp, Homo sapien
tgtggacttgccactttctccaaac

SEQ ID NO: 331692 - DNA, 25 bp, Homo sapien
tccaaacgctcggttcctttgaaga

SEQ ID NO: 331693 - DNA, 25 bp, Homo sapien
gctcggttcctttgaagatttcttc

SEQ ID NO: 331694 - DNA, 25 bp, Homo sapien
atttcttctgaacgtgtgtgcgcac

SEQ ID NO: 331695 - DNA, 25 bp, Homo sapien
acgctgggcgggttcgtgcatacat

SEQ ID NO: 331696 - DNA, 25 bp, Homo sapien
gaccccagactgtcagcacagggaa

SEQ ID NO: 331697 - DNA, 25 bp, Homo sapien
gggaagatggatcccatcctaattt

SEQ ID NO: 331698 - DNA, 25 bp, Homo sapien
cagcagaaactcttggatagctcta

SEQ ID NO: 331699 - DNA, 25 bp, Homo sapien
ctcttggatagctctatgccatttt

SEQ ID NO: 331700 - DNA, 25 bp, Homo sapien
tgccatttttgttcagttcccatac

SEQ ID NO: 331701 - DNA, 25 bp, Homo sapien
ttgttcagttcccatacgttgctat

SEQ ID NO: 331702 - DNA, 25 bp, Homo sapien
gttcccatacgttgctatttaatcc

SEQ ID NO: 331703 - DNA, 25 bp, Homo sapien
atccaataaaagtctgattcacagt

SEQ ID NO: 331704 - DNA, 25 bp, Homo sapien
ctgattcacagtttttacacattta

SEQ ID NO: 331705 - DNA, 25 bp, Homo sapien
taattattttaatcacaagagcccc

SEQ ID NO: 331706 - DNA, 25 bp, Homo sapien
cacaagagcccccttttaattgatt

SEQ ID NO: 331707 - DNA, 25 bp, Homo sapien
ttacatacagtaaatcatctgcaga

SEQ ID NO: 331708 - DNA, 25 bp, Homo sapien
catctgcagattacaccaatcgtgt

SEQ ID NO: 331709 - DNA, 25 bp, Homo sapien
ctgcaaaagccgagatgggttccat

SEQ ID NO: 331710 - DNA, 25 bp, Homo sapien
atgggttccatgcagttctccagtg

SEQ ID NO: 331711 - DNA, 25 bp, Homo sapien
tctccagtgggacatcagtgcttat

SEQ ID NO: 331712 - DNA, 25 bp, Homo sapien
cagtgcttatccgaatgtcatcaat

SEQ ID NO: 331713 - DNA, 25 bp, Homo sapien
tgtcatcaatggcaatctctccgga

SEQ ID NO: 331714 - DNA, 25 bp, Homo sapien
atggcaatctctccggaacgtcctt

SEQ ID NO: 331715 - DNA, 25 bp, Homo sapien
atcactccctcgaacacaatctggt

SEQ ID NO: 331716 - DNA, 25 bp, Homo sapien
ctcgaacacaatctggtactccatg

SEQ ID NO: 331717 - DNA, 25 bp, Homo sapien
aatctggtactccatgtcgtagctg

SEQ ID NO: 331718 - DNA, 25 bp, Homo sapien
actccatgtcgtagctgggcaggat

SEQ ID NO: 331719 - DNA, 25 bp, Homo sapien
tgggcaggatgatccgcccgtgctt

SEQ ID NO: 331720 - DNA, 25 bp, Homo sapien
agctgattagagataatgaccaagc

SEQ ID NO: 331721 - DNA, 25 bp, Homo sapien
atgaccaagcaatcaaggttttaca

SEQ ID NO: 331722 - DNA, 25 bp, Homo sapien
gaccaagcaatcaaggttttacaag

SEQ ID NO: 331723 - DNA, 25 bp, Homo sapien
gaaaaccgttctaatcaggtgcgat

SEQ ID NO: 331724 - DNA, 25 bp, Homo sapien
aaaccgttctaatcaggtgcgatgt

SEQ ID NO: 331725 - DNA, 25 bp, Homo sapien
ccgttctaatcaggtgcgatgtgca

SEQ ID NO: 331726 - DNA, 25 bp, Homo sapien
gttctaatcaggtgcgatgtgcaga

SEQ ID NO: 331727 - DNA, 25 bp, Homo sapien
ctaatcaggtgcgatgtgcagagaa

SEQ ID NO: 331728 - DNA, 25 bp, Homo sapien
aatcaggtgcgatgtgcagagaaaa

SEQ ID NO: 331729 - DNA, 25 bp, Homo sapien
ttacaacacaaagaattggagtcac

SEQ ID NO: 331730 - DNA, 25 bp, Homo sapien
acacaaagaattggagtcacaggaa

SEQ ID NO: 331731 - DNA, 25 bp, Homo sapien
aagtcccacacctcttcggcggtga

SEQ ID NO: 331732 - DNA, 25 bp, Homo sapien
gaccgccgctggattgcgcgatgaa

SEQ ID NO: 331733 - DNA, 25 bp, Homo sapien
gcgcgatgaacatgaccgtttgcat

SEQ ID NO: 331734 - DNA, 25 bp, Homo sapien
accgtttgcatggtcatcgcggcca

SEQ ID NO: 331735 - DNA, 25 bp, Homo sapien
aaacagcgtgcggtatttgctcaac

SEQ ID NO: 331736 - DNA, 25 bp, Homo sapien
cggccacccgcttcgggttgatggt

SEQ ID NO: 331737 - DNA, 25 bp, Homo sapien
cgtgcggtatttgctcaacccggga

SEQ ID NO: 331738 - DNA, 25 bp, Homo sapien
atcagctccgtcagcaacgcgagca

SEQ ID NO: 331739 - DNA, 25 bp, Homo sapien
gtcagcaacgcgagcaagggcgcat

SEQ ID NO: 331740 - DNA, 25 bp, Homo sapien
gcatgcgcgaccttgacctcagcgg

SEQ ID NO: 331741 - DNA, 25 bp, Homo sapien
aagccgcgcgagcagaagtcccaca

SEQ ID NO: 331742 - DNA, 25 bp, Homo sapien
ctctgggcatcatagtctagtaggg

SEQ ID NO: 331743 - DNA, 25 bp, Homo sapien
gggaagaggcatgtaaacaaataaa

SEQ ID NO: 331744 - DNA, 25 bp, Homo sapien
tagaataccatatctacctggaagt

SEQ ID NO: 331745 - DNA, 25 bp, Homo sapien
agaataccatatctacctggaagtt

SEQ ID NO: 331746 - DNA, 25 bp, Homo sapien
gaataccatatctacctggaagtta

SEQ ID NO: 331747 - DNA, 25 bp, Homo sapien
aataccatatctacctggaagttag

SEQ ID NO: 331748 - DNA, 25 bp, Homo sapien
ataccatatctacctggaagttagg

SEQ ID NO: 331749 - DNA, 25 bp, Homo sapien
aggtaacatttgcttgatgttgaag

SEQ ID NO: 331750 - DNA, 25 bp, Homo sapien
acatttgcttgatgttgaagaacaa

SEQ ID NO: 331751 - DNA, 25 bp, Homo sapien
agaagcaaaatgtcctggcacatag

SEQ ID NO: 331752 - DNA, 25 bp, Homo sapien
gaagcaaaatgtcctggcacatagt

SEQ ID NO: 331753 - DNA, 25 bp, Homo sapien
tagagaggaaactccccaagttcct

SEQ ID NO: 331754 - DNA, 25 bp, Homo sapien
cacctccacctaatcatacagagaa

SEQ ID NO: 331755 - DNA, 25 bp, Homo sapien
gttcctctgaccagacaggagagtg

SEQ ID NO: 331756 - DNA, 25 bp, Homo sapien
agaaaattccacttcagcacacaca

SEQ ID NO: 331757 - DNA, 25 bp, Homo sapien
agcacacacacctggagcctgaggc

SEQ ID NO: 331758 - DNA, 25 bp, Homo sapien
gcctgaggctgaaagctggaatccc

SEQ ID NO: 331759 - DNA, 25 bp, Homo sapien
aagctggaatcccagactttgacac

SEQ ID NO: 331760 - DNA, 25 bp, Homo sapien
gagggcagtgctatgtccaagctct

SEQ ID NO: 331761 - DNA, 25 bp, Homo sapien
gtccaagctctcagcaagcagtagg

SEQ ID NO: 331762 - DNA, 25 bp, Homo sapien
tcagcaagcagtaggcagagcccag

SEQ ID NO: 331763 - DNA, 25 bp, Homo sapien
agcagtaggcagagcccaggcccct

SEQ ID NO: 331764 - DNA, 25 bp, Homo sapien
ataggccaagaactcattgcaaaac

SEQ ID NO: 331765 - DNA, 25 bp, Homo sapien
catttttgcaaggatgaatgcctgt

SEQ ID NO: 331766 - DNA, 25 bp, Homo sapien
aatgcctgtatttggtctaggaaca

SEQ ID NO: 331767 - DNA, 25 bp, Homo sapien
ggaacagtacattttagtctgattt

SEQ ID NO: 331768 - DNA, 25 bp, Homo sapien
gtctgatttagaattactggtagct

SEQ ID NO: 331769 - DNA, 25 bp, Homo sapien
aaaagcagctgagctcaagtttgct

SEQ ID NO: 331770 - DNA, 25 bp, Homo sapien
gctcaagtttgctgtctttagaatg

SEQ ID NO: 331771 - DNA, 25 bp, Homo sapien
tataaaggtgttttcattttcctgt

SEQ ID NO: 331772 - DNA, 25 bp, Homo sapien
ttttcctgttcttacctattattgt

SEQ ID NO: 331773 - DNA, 25 bp, Homo sapien
agagctattcatgccattttttggg

SEQ ID NO: 331774 - DNA, 25 bp, Homo sapien
aattgccccaaatactgacattgag

SEQ ID NO: 331775 - DNA, 25 bp, Homo sapien
agagatgttaatatcatgtttttca

SEQ ID NO: 331776 - DNA, 25 bp, Homo sapien
gaatactttattacttacaaactca

SEQ ID NO: 331777 - DNA, 25 bp, Homo sapien
aaatacgaacagaaatacagcagac

SEQ ID NO: 331778 - DNA, 25 bp, Homo sapien
tacagcagacgaacatatttattgg

SEQ ID NO: 331779 - DNA, 25 bp, Homo sapien
aattagaatgttcatgtcaggcaca

SEQ ID NO: 331780 - DNA, 25 bp, Homo sapien
atgttcatgtcaggcacaagggttt

SEQ ID NO: 331781 - DNA, 25 bp, Homo sapien
gtgcaagctaatttggccacatttg

SEQ ID NO: 331782 - DNA, 25 bp, Homo sapien
gcaagctaatttggccacatttggc

SEQ ID NO: 331783 - DNA, 25 bp, Homo sapien
gcctggtgacagaactgttcataag

SEQ ID NO: 331784 - DNA, 25 bp, Homo sapien
gacagaactgttcataaggaagtaa

SEQ ID NO: 331785 - DNA, 25 bp, Homo sapien
ataaggtaggtagatatcagttgaa

SEQ ID NO: 331786 - DNA, 25 bp, Homo sapien
ttgcgtatattctccaaacggcata

SEQ ID NO: 331787 - DNA, 25 bp, Homo sapien
aaacggcatacagccacgttacagg

SEQ ID NO: 331788 - DNA, 25 bp, Homo sapien
acgttacaggctcctccaagcttgg

SEQ ID NO: 331789 - DNA, 25 bp, Homo sapien
caagcttgggttaagaacctccgtg

SEQ ID NO: 331790 - DNA, 25 bp, Homo sapien
taagaacctccgtgttagtataggg

SEQ ID NO: 331791 - DNA, 25 bp, Homo sapien
gggagagcgcgccaaagctacctta

SEQ ID NO: 331792 - DNA, 25 bp, Homo sapien
caaagctaccttaccttactgctta

SEQ ID NO: 331793 - DNA, 25 bp, Homo sapien
ttactgcttaccagcgtcacaagct

SEQ ID NO: 331794 - DNA, 25 bp, Homo sapien
acaagctgcttttcccaaggtagag

SEQ ID NO: 331795 - DNA, 25 bp, Homo sapien
ggactttaattgacatcctggtgtg

SEQ ID NO: 331796 - DNA, 25 bp, Homo sapien
ggaatataggttgcgtgactgtttc

SEQ ID NO: 331797 - DNA, 25 bp, Homo sapien
aaacactctgtacctttgtaatgat

SEQ ID NO: 331798 - DNA, 25 bp, Homo sapien
tttgaataacttggtgtgtcttgag

SEQ ID NO: 331799 - DNA, 25 bp, Homo sapien
gaataacttggtgtgtcttgagtgt

SEQ ID NO: 331800 - DNA, 25 bp, Homo sapien
taacttggtgtgtcttgagtgttgt

SEQ ID NO: 331801 - DNA, 25 bp, Homo sapien
gtgtcttgagtgttgtggtatgaaa

SEQ ID NO: 331802 - DNA, 25 bp, Homo sapien
ggtatgaaaagcattgtggtctttc

SEQ ID NO: 331803 - DNA, 25 bp, Homo sapien
cattgtggtctttctacactaatga

SEQ ID NO: 331804 - DNA, 25 bp, Homo sapien
tgtggtctttctacactaatgaagt

SEQ ID NO: 331805 - DNA, 25 bp, Homo sapien
gtctttctacactaatgaagtgcaa

SEQ ID NO: 331806 - DNA, 25 bp, Homo sapien
ttctttacggtgaagcttattctga

SEQ ID NO: 331807 - DNA, 25 bp, Homo sapien
gcttattctgattaagcctagactg

SEQ ID NO: 331808 - DNA, 25 bp, Homo sapien
atttttaagtagatatggcacctga

SEQ ID NO: 331809 - DNA, 25 bp, Homo sapien
atggcacctgatttgaactcaactg

SEQ ID NO: 331810 - DNA, 25 bp, Homo sapien
actggagtgggatatactgcctttt

SEQ ID NO: 331811 - DNA, 25 bp, Homo sapien
cattactatgtcaaaaggcatcttg

SEQ ID NO: 331812 - DNA, 25 bp, Homo sapien
tgcagctactgaaggaagtccgtgt

SEQ ID NO: 331813 - DNA, 25 bp, Homo sapien
aggaagtccgtgtgtgtgcctctta

SEQ ID NO: 331814 - DNA, 25 bp, Homo sapien
gtgtgcctcttacctcacaatacaa

SEQ ID NO: 331815 - DNA, 25 bp, Homo sapien
tcacaatacaacctctttcttttct

SEQ ID NO: 331816 - DNA, 25 bp, Homo sapien
tagaaagtttcactaccgagaaagt

SEQ ID NO: 331817 - DNA, 25 bp, Homo sapien
gtcatttgagttgccattctatctg

SEQ ID NO: 331818 - DNA, 25 bp, Homo sapien
ccattctatctgaggctatttttaa

SEQ ID NO: 331819 - DNA, 25 bp, Homo sapien
agcggctgtcgcctggagggcacgt

SEQ ID NO: 331820 - DNA, 25 bp, Homo sapien
gagggcacgttcaggcagaagctcc

SEQ ID NO: 331821 - DNA, 25 bp, Homo sapien
ggcacgttcaggcagaagctcctca

SEQ ID NO: 331822 - DNA, 25 bp, Homo sapien
tcctcagtggccacaagtccgctag

SEQ ID NO: 331823 - DNA, 25 bp, Homo sapien
gtggccacaagtccgctagctccgg

SEQ ID NO: 331824 - DNA, 25 bp, Homo sapien
tgggttagggccgcagcccagacca

SEQ ID NO: 331825 - DNA, 25 bp, Homo sapien
gccgccgacaccaataagctacaag

SEQ ID NO: 331826 - DNA, 25 bp, Homo sapien
gccgacaccaataagctacaaggag

SEQ ID NO: 331827 - DNA, 25 bp, Homo sapien
ggaggagctttaccgctgcctgtac

SEQ ID NO: 331828 - DNA, 25 bp, Homo sapien
tttaccgctgcctgtactactactg

SEQ ID NO: 331829 - DNA, 25 bp, Homo sapien
tgcctgtactactactgcctgcgct

SEQ ID NO: 331830 - DNA, 25 bp, Homo sapien
gcctgcagctgttcacccaaggagt

SEQ ID NO: 331831 - DNA, 25 bp, Homo sapien
tgcagctgttcacccaaggagtgcc

SEQ ID NO: 331832 - DNA, 25 bp, Homo sapien
agctgttcacccaaggagtgcctga

SEQ ID NO: 331833 - DNA, 25 bp, Homo sapien
tgttcacccaaggagtgcctgagca

SEQ ID NO: 331834 - DNA, 25 bp, Homo sapien
gttcacccaaggagtgcctgagcat

SEQ ID NO: 331835 - DNA, 25 bp, Homo sapien
taggggctgacctgttccccttgtt

SEQ ID NO: 331836 - DNA, 25 bp, Homo sapien
ctgagtcatcagtattctgttacag

SEQ ID NO: 331837 - DNA, 25 bp, Homo sapien
gtattctgttacagttcattgaaag

SEQ ID NO: 331838 - DNA, 25 bp, Homo sapien
tgcggccagatggacaatagtgaga

SEQ ID NO: 331839 - DNA, 25 bp, Homo sapien
gcaaacttactacttgcaacccggt

SEQ ID NO: 331840 - DNA, 25 bp, Homo sapien
ttactacttgcaacccggttgtcct

SEQ ID NO: 331841 - DNA, 25 bp, Homo sapien
aaataggccaagttgaccgagcact

SEQ ID NO: 331842 - DNA, 25 bp, Homo sapien
ttgaccgagcactttgtacataggg

SEQ ID NO: 331843 - DNA, 25 bp, Homo sapien
ggtattatacgactgcaaattgtgt

SEQ ID NO: 331844 - DNA, 25 bp, Homo sapien
agagatactcgttttaagcactttt

SEQ ID NO: 331845 - DNA, 25 bp, Homo sapien
gcacttttagcctaatgtactggaa

SEQ ID NO: 331846 - DNA, 25 bp, Homo sapien
ggatttttatactctattggaaaca

SEQ ID NO: 331847 - DNA, 25 bp, Homo sapien
tttccatattggtgaaatgccactc

SEQ ID NO: 331848 - DNA, 25 bp, Homo sapien
aatgccactcattcctttttctgag

SEQ ID NO: 331849 - DNA, 25 bp, Homo sapien
ctcccagataattgagaagtggcct

SEQ ID NO: 331850 - DNA, 25 bp, Homo sapien
gaagtggccttgactgtaccaggtc

SEQ ID NO: 331851 - DNA, 25 bp, Homo sapien
gactgtaccaggtcacacatggaaa

SEQ ID NO: 331852 - DNA, 25 bp, Homo sapien
ccaggattggaatacttaagtcaga

SEQ ID NO: 331853 - DNA, 25 bp, Homo sapien
gatatgatactaattcatcagcaaa

SEQ ID NO: 331854 - DNA, 25 bp, Homo sapien
acagctggcattcctgttcaaaatc

SEQ ID NO: 331855 - DNA, 25 bp, Homo sapien
ggcattcctgttcaaaatcagccag

SEQ ID NO: 331856 - DNA, 25 bp, Homo sapien
tgttcaaaatcagccaggtagacct

SEQ ID NO: 331857 - DNA, 25 bp, Homo sapien
aaatcagccaggtagacctgaaggg

SEQ ID NO: 331858 - DNA, 25 bp, Homo sapien
accaccattaaactgtccgccagga

SEQ ID NO: 331859 - DNA, 25 bp, Homo sapien
accattaaactgtccgccaggattg

SEQ ID NO: 331860 - DNA, 25 bp, Homo sapien
taaactgtccgccaggattggaata

SEQ ID NO: 331861 - DNA, 25 bp, Homo sapien
actgtccgccaggattggaatactt

SEQ ID NO: 331862 - DNA, 25 bp, Homo sapien
gtccgccaggattggaatacttaag

SEQ ID NO: 331863 - DNA, 25 bp, Homo sapien
tccatggccagctaagccaacacct

SEQ ID NO: 331864 - DNA, 25 bp, Homo sapien
catggctgtcacagccctttcttgg

SEQ ID NO: 331865 - DNA, 25 bp, Homo sapien
ctttcttgggctctcaatggtatca

SEQ ID NO: 331866 - DNA, 25 bp, Homo sapien
gggctctcaatggtatcattgtcac

SEQ ID NO: 331867 - DNA, 25 bp, Homo sapien
ctcaatggtatcattgtcacctgtg

SEQ ID NO: 331868 - DNA, 25 bp, Homo sapien
cacctgtgtgctcatgagcctctgc

SEQ ID NO: 331869 - DNA, 25 bp, Homo sapien
cactcaactccaagcacatcaaata

SEQ ID NO: 331870 - DNA, 25 bp, Homo sapien
aagagctcaaaacatatcggatact

SEQ ID NO: 331871 - DNA, 25 bp, Homo sapien
ttgctgggctcactgtgtgaaattc

SEQ ID NO: 331872 - DNA, 25 bp, Homo sapien
ctgggctcactgtgtgaaattccct

SEQ ID NO: 331873 - DNA, 25 bp, Homo sapien
accttccctatgctgaactgccact

SEQ ID NO: 331874 - DNA, 25 bp, Homo sapien
tgctgcaaaaaccactctagactct

SEQ ID NO: 331875 - DNA, 25 bp, Homo sapien
cactctagactcttggaactcctgg

SEQ ID NO: 331876 - DNA, 25 bp, Homo sapien
aactcctgggacttgttcatacaca

SEQ ID NO: 331877 - DNA, 25 bp, Homo sapien
tacacagctcactcagacggctaag

SEQ ID NO: 331878 - DNA, 25 bp, Homo sapien
actagctaaaagaagcccctctgcc

SEQ ID NO: 331879 - DNA, 25 bp, Homo sapien
tcaccaggaagaatggacccgtgtt

SEQ ID NO: 331880 - DNA, 25 bp, Homo sapien
tggaggtttattttctgcagccctg

SEQ ID NO: 331881 - DNA, 25 bp, Homo sapien
gcttggcgaggcttacctgagtaag

SEQ ID NO: 331882 - DNA, 25 bp, Homo sapien
tgtgccttgggcatcacctggagat

SEQ ID NO: 331883 - DNA, 25 bp, Homo sapien
gaggatctcacgcacagtaggcttt

SEQ ID NO: 331884 - DNA, 25 bp, Homo sapien
agtaggctttgtacactcaacccat

SEQ ID NO: 331885 - DNA, 25 bp, Homo sapien
agctttaccgtaatccagccttgga

SEQ ID NO: 331886 - DNA, 25 bp, Homo sapien
atccagccttggaaattcaggaatg

SEQ ID NO: 331887 - DNA, 25 bp, Homo sapien
caggaatgagagagatgttctcccc

SEQ ID NO: 331888 - DNA, 25 bp, Homo sapien
ctgttgagtgccatccctaagctaa

SEQ ID NO: 331889 - DNA, 25 bp, Homo sapien
gagtgccatccctaagctaactaaa

SEQ ID NO: 331890 - DNA, 25 bp, Homo sapien
gattccattatgcttagaaagccag

SEQ ID NO: 331891 - DNA, 25 bp, Homo sapien
gaattccaataatttgctggtagga

SEQ ID NO: 331892 - DNA, 25 bp, Homo sapien
aagactttgcaagtttatgcaggtt

SEQ ID NO: 331893 - DNA, 25 bp, Homo sapien
ataacccactatgggagtgtcctgg

SEQ ID NO: 331894 - DNA, 25 bp, Homo sapien
tcctgggaaacctcaattactgtga

SEQ ID NO: 331895 - DNA, 25 bp, Homo sapien
aattactgtgatctccacagcttta

SEQ ID NO: 331896 - DNA, 25 bp, Homo sapien
agcaggcatgatggagatcccttgc

SEQ ID NO: 331897 - DNA, 25 bp, Homo sapien
gaaagtgttccttggtgaaatcatg

SEQ ID NO: 331898 - DNA, 25 bp, Homo sapien
gaaatcatgaatctgctatctagga

SEQ ID NO: 331899 - DNA, 25 bp, Homo sapien
gagaaactcccttgtccattgtctt

SEQ ID NO: 331900 - DNA, 25 bp, Homo sapien
gtggccactagtttgacctctagga

SEQ ID NO: 331901 - DNA, 25 bp, Homo sapien
acctctaggaaagtcttgctcgtca

SEQ ID NO: 331902 - DNA, 25 bp, Homo sapien
aaagtcttgctcgtcagcttctgtg

SEQ ID NO: 331903 - DNA, 25 bp, Homo sapien
ctgtggccccgtctgaaacttttga

SEQ ID NO: 331904 - DNA, 25 bp, Homo sapien
ttttgagggacatcgcagcttttgc

SEQ ID NO: 331905 - DNA, 25 bp, Homo sapien
tgcttgctggtgcagacttttagac

SEQ ID NO: 331906 - DNA, 25 bp, Homo sapien
gacttttagacctagattgccttag

SEQ ID NO: 331907 - DNA, 25 bp, Homo sapien
gagaatagtctttcttccaacctgc

SEQ ID NO: 331908 - DNA, 25 bp, Homo sapien
tgcctaaaatagacctgactccaat

SEQ ID NO: 331909 - DNA, 25 bp, Homo sapien
tccaatccaagggatgggtcacctt

SEQ ID NO: 331910 - DNA, 25 bp, Homo sapien
gatgggtcacctttgggatgagccc

SEQ ID NO: 331911 - DNA, 25 bp, Homo sapien
acttttcctccatctacatgtgttt

SEQ ID NO: 331912 - DNA, 25 bp, Homo sapien
ctacatgtgtttatctgcttcaggg

SEQ ID NO: 331913 - DNA, 25 bp, Homo sapien
aagaatgtccacttccccaagggct

SEQ ID NO: 331914 - DNA, 25 bp, Homo sapien
ttccccaagggctttggtcagagct

SEQ ID NO: 331915 - DNA, 25 bp, Homo sapien
tggtcagagctgcttctacgtccaa

SEQ ID NO: 331916 - DNA, 25 bp, Homo sapien
gctgcttctacgtccaactaaaggg

SEQ ID NO: 331917 - DNA, 25 bp, Homo sapien
aaggtcagccatgttagctatgaga

SEQ ID NO: 331918 - DNA, 25 bp, Homo sapien
cagctccttcacttgacccggattt

SEQ ID NO: 331919 - DNA, 25 bp, Homo sapien
ttgacccggatttcagcatactcag

SEQ ID NO: 331920 - DNA, 25 bp, Homo sapien
atttcagcatactcagctagctcct

SEQ ID NO: 331921 - DNA, 25 bp, Homo sapien
gcccagcccccgatacttttgggag

SEQ ID NO: 331922 - DNA, 25 bp, Homo sapien
tagctcctccgtcagcgtgtagctg

SEQ ID NO: 331923 - DNA, 25 bp, Homo sapien
cgtcagcgtgtagctgtccttggtg

SEQ ID NO: 331924 - DNA, 25 bp, Homo sapien
gtttccccaggtccgagtgagaata

SEQ ID NO: 331925 - DNA, 25 bp, Homo sapien
tccccaggtccgagtgagaatagct

SEQ ID NO: 331926 - DNA, 25 bp, Homo sapien
gtgagaatagctcaggtccagctct

SEQ ID NO: 331927 - DNA, 25 bp, Homo sapien
agaatagctcaggtccagctctggg

SEQ ID NO: 331928 - DNA, 25 bp, Homo sapien
gcactcagtgagattccagggtaga

SEQ ID NO: 331929 - DNA, 25 bp, Homo sapien
caggtagttgagatgaaacacttca

SEQ ID NO: 331930 - DNA, 25 bp, Homo sapien
aaaaccctggttatagatgtactgt

SEQ ID NO: 331931 - DNA, 25 bp, Homo sapien
gtactgtttggatgtagcatagtct

SEQ ID NO: 331932 - DNA, 25 bp, Homo sapien
agcatagtcttgagtctagcgtcca

SEQ ID NO: 331933 - DNA, 25 bp, Homo sapien
agtcttgagtctagcgtccacaaag

SEQ ID NO: 331934 - DNA, 25 bp, Homo sapien
gagtctagcgtccacaaagaattat

SEQ ID NO: 331935 - DNA, 25 bp, Homo sapien
tattacattgaatggagtcccttgg

SEQ ID NO: 331936 - DNA, 25 bp, Homo sapien
tgaatggagtcccttggatattttg

SEQ ID NO: 331937 - DNA, 25 bp, Homo sapien
ttaatagccataaagtcctagactt

SEQ ID NO: 331938 - DNA, 25 bp, Homo sapien
aaagtcctagacttcttatttgaag

SEQ ID NO: 331939 - DNA, 25 bp, Homo sapien
atgagctttgaagattgctaaatta

SEQ ID NO: 331940 - DNA, 25 bp, Homo sapien
tgtgtgctggcggtgcgctgcctta

SEQ ID NO: 331941 - DNA, 25 bp, Homo sapien
tgcggggcgttctgtccaagaaaaa

SEQ ID NO: 331942 - DNA, 25 bp, Homo sapien
caagaaaaaggactgcagcctcggg

SEQ ID NO: 331943 - DNA, 25 bp, Homo sapien
agacgagctgccaacgccgcggagc

SEQ ID NO: 331944 - DNA, 25 bp, Homo sapien
ccaacgccgcggagccatttctgtt

SEQ ID NO: 331945 - DNA, 25 bp, Homo sapien
gagccatttctgttccaccctaggg

SEQ ID NO: 331946 - DNA, 25 bp, Homo sapien
aagtaggttagtaaggccatttgtg

SEQ ID NO: 331947 - DNA, 25 bp, Homo sapien
gccatttgtggttgctgtttcagta

SEQ ID NO: 331948 - DNA, 25 bp, Homo sapien
gtgactggctcctcaagccggagac

SEQ ID NO: 331949 - DNA, 25 bp, Homo sapien
tcctcaagccggagacgcgtgtggt

SEQ ID NO: 331950 - DNA, 25 bp, Homo sapien
gatgcgggcgccagcgctgtgtgtg

SEQ ID NO: 331951 - DNA, 25 bp, Homo sapien
agggcatgagctcaacttccagcaa

SEQ ID NO: 331952 - DNA, 25 bp, Homo sapien
ggcatgagctcaacttccagcaagg

SEQ ID NO: 331953 - DNA, 25 bp, Homo sapien
agcccaagtctcagcaaaactgagg

SEQ ID NO: 331954 - DNA, 25 bp, Homo sapien
gcaaaactgaggttgatcaggacct

SEQ ID NO: 331955 - DNA, 25 bp, Homo sapien
aggttgatcaggacctcacctacta

SEQ ID NO: 331956 - DNA, 25 bp, Homo sapien
aggacctcacctactatgaagctgt

SEQ ID NO: 331957 - DNA, 25 bp, Homo sapien
acctcacctactatgaagctgtctg

SEQ ID NO: 331958 - DNA, 25 bp, Homo sapien
ctactatgaagctgtctgaagggac

SEQ ID NO: 331959 - DNA, 25 bp, Homo sapien
cttccagagcaattaaaagtcttag

SEQ ID NO: 331960 - DNA, 25 bp, Homo sapien
aaagtcttagcaacagtcctctggt

SEQ ID NO: 331961 - DNA, 25 bp, Homo sapien
cagctgagtttattatacttgtttt

SEQ ID NO: 331962 - DNA, 25 bp, Homo sapien
tgccgctgccattctagtgaccttt

SEQ ID NO: 331963 - DNA, 25 bp, Homo sapien
ttctagtgacctttccacagagctg

SEQ ID NO: 331964 - DNA, 25 bp, Homo sapien
tgcgccttcctcacgtgtgtgaaag

SEQ ID NO: 331965 - DNA, 25 bp, Homo sapien
gtgtgtgaaaggttttccccttcag

SEQ ID NO: 331966 - DNA, 25 bp, Homo sapien
tccccttcagccctcaggtagatgg

SEQ ID NO: 331967 - DNA, 25 bp, Homo sapien
gatggaagctgcatctgcccacgat

SEQ ID NO: 331968 - DNA, 25 bp, Homo sapien
cgatggcagtgcagtcatcatcttc

SEQ ID NO: 331969 - DNA, 25 bp, Homo sapien
cttcaggatgtttcttcaggacttc

SEQ ID NO: 331970 - DNA, 25 bp, Homo sapien
gaattttggtccctgcctaggaccg

SEQ ID NO: 331971 - DNA, 25 bp, Homo sapien
aagagcctggagattctttcctgaa

SEQ ID NO: 331972 - DNA, 25 bp, Homo sapien
ctttcctgaacactgactgcactta

SEQ ID NO: 331973 - DNA, 25 bp, Homo sapien
gcccaggaaacccactgtcacagaa

SEQ ID NO: 331974 - DNA, 25 bp, Homo sapien
tgtcacagaacaacagtcttaggag

SEQ ID NO: 331975 - DNA, 25 bp, Homo sapien
aacaacagtcttaggagctttctta

SEQ ID NO: 331976 - DNA, 25 bp, Homo sapien
aggagctttcttatcgagacagtag

SEQ ID NO: 331977 - DNA, 25 bp, Homo sapien
gagacagtaggaagcttttaaacac

SEQ ID NO: 331978 - DNA, 25 bp, Homo sapien
tctactcattgaacactgtacactt

SEQ ID NO: 331979 - DNA, 25 bp, Homo sapien
aacactgtacacttgattgagagca

SEQ ID NO: 331980 - DNA, 25 bp, Homo sapien
gggcaaccagaactctccatcaggg

SEQ ID NO: 331981 - DNA, 25 bp, Homo sapien
agaactctccatcagggcattgcag

SEQ ID NO: 331982 - DNA, 25 bp, Homo sapien
tccatcagggcattgcagcctttaa

SEQ ID NO: 331983 - DNA, 25 bp, Homo sapien
cagggcattgcagcctttaagagaa

SEQ ID NO: 331984 - DNA, 25 bp, Homo sapien
tagggaaggatggtttccagcagtc

SEQ ID NO: 331985 - DNA, 25 bp, Homo sapien
tttcctccttcgtgggatccagtta

SEQ ID NO: 331986 - DNA, 25 bp, Homo sapien
tccttcgtgggatccagttacaccc

SEQ ID NO: 331987 - DNA, 25 bp, Homo sapien
ttacacccagcagacttcagtttga

SEQ ID NO: 331988 - DNA, 25 bp, Homo sapien
aatggatgacaagccattaacatgg

SEQ ID NO: 331989 - DNA, 25 bp, Homo sapien
gcttttaacatccagctacagggag

SEQ ID NO: 331990 - DNA, 25 bp, Homo sapien
acagggaggctctcgctcaccggga

SEQ ID NO: 331991 - DNA, 25 bp, Homo sapien
aggctctcgctcaccgggagattaa

SEQ ID NO: 331992 - DNA, 25 bp, Homo sapien
accgggagattaacccgccaggctg

SEQ ID NO: 331993 - DNA, 25 bp, Homo sapien
gaagaagaggcatccaaagtgttgg

SEQ ID NO: 331994 - DNA, 25 bp, Homo sapien
atcgcccttgccttggaggaagctc

SEQ ID NO: 331995 - DNA, 25 bp, Homo sapien
gggtttcccactaaatggagagact

SEQ ID NO: 331996 - DNA, 25 bp, Homo sapien
cccactaaatggagagactgactct

SEQ ID NO: 331997 - DNA, 25 bp, Homo sapien
gactgactctctccataagtatttg

SEQ ID NO: 331998 - DNA, 25 bp, Homo sapien
gactctctccataagtatttgattt

SEQ ID NO: 331999 - DNA, 25 bp, Homo sapien
gcaccacccagcttgggtatctggt

SEQ ID NO: 332000 - DNA, 25 bp, Homo sapien
gtgtaagtgcagtttgtctctactg

SEQ ID NO: 332001 - DNA, 25 bp, Homo sapien
agtgcagtttgtctctactgggtga

SEQ ID NO: 332002 - DNA, 25 bp, Homo sapien
gtttgtctctactgggtgatgcatg

SEQ ID NO: 332003 - DNA, 25 bp, Homo sapien
tgtctctactgggtgatgcatgcag

SEQ ID NO: 332004 - DNA, 25 bp, Homo sapien
cacccagcttgggtatctggtgaat

SEQ ID NO: 332005 - DNA, 25 bp, Homo sapien
cttgggtatctggtgaattctgtgg

SEQ ID NO: 332006 - DNA, 25 bp, Homo sapien
acagctggcattcctgttcaaaatc

SEQ ID NO: 332007 - DNA, 25 bp, Homo sapien
acttctggaagttattgactctgga

SEQ ID NO: 332008 - DNA, 25 bp, Homo sapien
aaagatttcaaaacagtactctgga

SEQ ID NO: 332009 - DNA, 25 bp, Homo sapien
aaacagtactctggatttgtaaggg

SEQ ID NO: 332010 - DNA, 25 bp, Homo sapien
gggaatattaaccaatggtgagaaa

SEQ ID NO: 332011 - DNA, 25 bp, Homo sapien
aaatttgggatccagtttccatttg

SEQ ID NO: 332012 - DNA, 25 bp, Homo sapien
atttgggatccagtttccatttgat

SEQ ID NO: 332013 - DNA, 25 bp, Homo sapien
tttccatttgatcttgatgttaaaa

SEQ ID NO: 332014 - DNA, 25 bp, Homo sapien
tgttcaaaatcagccaggtagacct

SEQ ID NO: 332015 - DNA, 25 bp, Homo sapien
caccattaaactgtccgccaggatt

SEQ ID NO: 332016 - DNA, 25 bp, Homo sapien
actgtccgccaggattggaatactt

SEQ ID NO: 332017 - DNA, 25 bp, Homo sapien
tgacccagcagaaagcgcccgggcg

SEQ ID NO: 332018 - DNA, 25 bp, Homo sapien
aagcgcccgggcgtgtccagataaa

SEQ ID NO: 332019 - DNA, 25 bp, Homo sapien
gtgtccagataaaccgcgccttaat

SEQ ID NO: 332020 - DNA, 25 bp, Homo sapien
gataaaccgcgccttaatcgaggcg

SEQ ID NO: 332021 - DNA, 25 bp, Homo sapien
gcgccttaatcgaggcgccattccg

SEQ ID NO: 332022 - DNA, 25 bp, Homo sapien
gcccagggtgcagagtggacactcc

SEQ ID NO: 332023 - DNA, 25 bp, Homo sapien
tgcagagtggacactcccaggtgtc

SEQ ID NO: 332024 - DNA, 25 bp, Homo sapien
actcccaggtgtccaagccggcgag

SEQ ID NO: 332025 - DNA, 25 bp, Homo sapien
aagccggcgagctcgggtcccgcag

SEQ ID NO: 332026 - DNA, 25 bp, Homo sapien
acgtgggcgttggtcggtcttgcgg

SEQ ID NO: 332027 - DNA, 25 bp, Homo sapien
gaggaggtgccgtgctctccccact

SEQ ID NO: 332028 - DNA, 25 bp, Homo sapien
ttagctatgaactcataagccagca

SEQ ID NO: 332029 - DNA, 25 bp, Homo sapien
taagccagcaggagagtttgctctc

SEQ ID NO: 332030 - DNA, 25 bp, Homo sapien
gagagtttgctctctccggtgagac

SEQ ID NO: 332031 - DNA, 25 bp, Homo sapien
agtttgctctctccggtgagactca

SEQ ID NO: 332032 - DNA, 25 bp, Homo sapien
tctctccggtgagactcagtgaaag

SEQ ID NO: 332033 - DNA, 25 bp, Homo sapien
ccggtgagactcagtgaaagccatc

SEQ ID NO: 332034 - DNA, 25 bp, Homo sapien
aaaactacagtaatgcggcactatc

SEQ ID NO: 332035 - DNA, 25 bp, Homo sapien
acagtaatgcggcactatcaccacc

SEQ ID NO: 332036 - DNA, 25 bp, Homo sapien
cactatcaccaccaaaagtgaaaga

SEQ ID NO: 332037 - DNA, 25 bp, Homo sapien
aaatgtagtggtagtcttgatatga

SEQ ID NO: 332038 - DNA, 25 bp, Homo sapien
ggtagtcttgatatgatgtaatgag

SEQ ID NO: 332039 - DNA, 25 bp, Homo sapien
attcagaaatgtttgggcacctaac

SEQ ID NO: 332040 - DNA, 25 bp, Homo sapien
gggcacctaacagtttttacagcat

SEQ ID NO: 332041 - DNA, 25 bp, Homo sapien
acagcattctactttttgtcaattg

SEQ ID NO: 332042 - DNA, 25 bp, Homo sapien
aattggttaaccagtaattcgctgt

SEQ ID NO: 332043 - DNA, 25 bp, Homo sapien
taattcgctgtgaaccggaaggccc

SEQ ID NO: 332044 - DNA, 25 bp, Homo sapien
gtgatgccaccttgtacaggaagct

SEQ ID NO: 332045 - DNA, 25 bp, Homo sapien
agcttacttagtgcaggaattctct

SEQ ID NO: 332046 - DNA, 25 bp, Homo sapien
aggaattctctgtgcaggccccagg

SEQ ID NO: 332047 - DNA, 25 bp, Homo sapien
tacaggaagctacacagtcctcggc

SEQ ID NO: 332048 - DNA, 25 bp, Homo sapien
ctcggcctccatgcttaagggaaag

SEQ ID NO: 332049 - DNA, 25 bp, Homo sapien
aaagttggcccaagtcatggtctgc

SEQ ID NO: 332050 - DNA, 25 bp, Homo sapien
gtgcccagagcgcataatatgtact

SEQ ID NO: 332051 - DNA, 25 bp, Homo sapien
ataatatgtactcactcgatcccac

SEQ ID NO: 332052 - DNA, 25 bp, Homo sapien
tcactcgatcccactttacaaggag

SEQ ID NO: 332053 - DNA, 25 bp, Homo sapien
tttacaaggagcagagcacttcaac

SEQ ID NO: 332054 - DNA, 25 bp, Homo sapien
tcaactttagcaaggccgggaccca

SEQ ID NO: 332055 - DNA, 25 bp, Homo sapien
tgtggcagcatcacactgctcatga

SEQ ID NO: 332056 - DNA, 25 bp, Homo sapien
actgctcatgacaacagcattctgc

SEQ ID NO: 332057 - DNA, 25 bp, Homo sapien
gatccaggacttggcatctggccac

SEQ ID NO: 332058 - DNA, 25 bp, Homo sapien
atctggccacacttttatgactcat

SEQ ID NO: 332059 - DNA, 25 bp, Homo sapien
ttatgactcatctttacccatctgt

SEQ ID NO: 332060 - DNA, 25 bp, Homo sapien
atctgtggccacagactcaggagct

SEQ ID NO: 332061 - DNA, 25 bp, Homo sapien
gacactgaagtgagagatcttttgt

SEQ ID NO: 332062 - DNA, 25 bp, Homo sapien
gatcttttgttctcgtggcattgga

SEQ ID NO: 332063 - DNA, 25 bp, Homo sapien
aaaggctttagcagggaccaggtgc

SEQ ID NO: 332064 - DNA, 25 bp, Homo sapien
accaggtgcgtccactttgcaagtg

SEQ ID NO: 332065 - DNA, 25 bp, Homo sapien
ctttgcaagtggatttggagagaac

SEQ ID NO: 332066 - DNA, 25 bp, Homo sapien
aagcagtgttcacatatcagtccag

SEQ ID NO: 332067 - DNA, 25 bp, Homo sapien
gtgttcacatatcagtccagcaatg

SEQ ID NO: 332068 - DNA, 25 bp, Homo sapien
gactccttcctggaacagtcatcag

SEQ ID NO: 332069 - DNA, 25 bp, Homo sapien
gaacagtcatcagtttaatccagtg

SEQ ID NO: 332070 - DNA, 25 bp, Homo sapien
gtcatcagtttaatccagtgaggat

SEQ ID NO: 332071 - DNA, 25 bp, Homo sapien
agaaataggttcagtagattcttcc

SEQ ID NO: 332072 - DNA, 25 bp, Homo sapien
aggaaggtcacccagcctgcaccag

SEQ ID NO: 332073 - DNA, 25 bp, Homo sapien
agcctgcaccagatatttgcactgc

SEQ ID NO: 332074 - DNA, 25 bp, Homo sapien
agatatttgcactgccagagcacct

SEQ ID NO: 332075 - DNA, 25 bp, Homo sapien
tgcttaatgatacctgtgcctgctc

SEQ ID NO: 332076 - DNA, 25 bp, Homo sapien
gagcacctctcaagaatgcagattt

SEQ ID NO: 332077 - DNA, 25 bp, Homo sapien
acctgtcatccctggactttgtgca

SEQ ID NO: 332078 - DNA, 25 bp, Homo sapien
ctggactttgtgcagccaagacggc

SEQ ID NO: 332079 - DNA, 25 bp, Homo sapien
agccaagacggctggaccactcaag

SEQ ID NO: 332080 - DNA, 25 bp, Homo sapien
aagggcccggtcaacagctctcaga

SEQ ID NO: 332081 - DNA, 25 bp, Homo sapien
ggtcaacagctctcagatgaataga

SEQ ID NO: 332082 - DNA, 25 bp, Homo sapien
agaagatgatatgcctataacaagg

SEQ ID NO: 332083 - DNA, 25 bp, Homo sapien
tgagctgtcggtttcaggagccctt

SEQ ID NO: 332084 - DNA, 25 bp, Homo sapien
gtcggtttcaggagcccttcgtgac

SEQ ID NO: 332085 - DNA, 25 bp, Homo sapien
tccagcactctagaaggatcgggtg

SEQ ID NO: 332086 - DNA, 25 bp, Homo sapien
ggtggaaggctccaacccgcccaat

SEQ ID NO: 332087 - DNA, 25 bp, Homo sapien
aatctgagcccgaggcctgctgaga

SEQ ID NO: 332088 - DNA, 25 bp, Homo sapien
gagcccgaggcctgctgagaagcat

SEQ ID NO: 332089 - DNA, 25 bp, Homo sapien
gggccttgggatagttccagaatga

SEQ ID NO: 332090 - DNA, 25 bp, Homo sapien
tgaggatgtgcgtttctagctgctt

SEQ ID NO: 332091 - DNA, 25 bp, Homo sapien
gatgtgcgtttctagctgctttgcg

SEQ ID NO: 332092 - DNA, 25 bp, Homo sapien
tgcgtttctagctgctttgcgccct

SEQ ID NO: 332093 - DNA, 25 bp, Homo sapien
ccaaaaatctgctaccacaattcca

SEQ ID NO: 332094 - DNA, 25 bp, Homo sapien
caggtttttagaacgactgttcgag

SEQ ID NO: 332095 - DNA, 25 bp, Homo sapien
gaacgactgttcgagcgacatataa

SEQ ID NO: 332096 - DNA, 25 bp, Homo sapien
cacctgctgcatgtcctgaaagtag

SEQ ID NO: 332097 - DNA, 25 bp, Homo sapien
gaaagtagacttaggctgcacatcg

SEQ ID NO: 332098 - DNA, 25 bp, Homo sapien
taggctgcacatcggaggaaaactc

SEQ ID NO: 332099 - DNA, 25 bp, Homo sapien
gttctccagtgtcaaaggcgacaat

SEQ ID NO: 332100 - DNA, 25 bp, Homo sapien
aaggcgacaataatcatgacatgga

SEQ ID NO: 332101 - DNA, 25 bp, Homo sapien
gagttatcaactcttaaaatcatgg

SEQ ID NO: 332102 - DNA, 25 bp, Homo sapien
atgagcattgaggactgccctttgg

SEQ ID NO: 332103 - DNA, 25 bp, Homo sapien
ggactgccctttggatgtttaatct

SEQ ID NO: 332104 - DNA, 25 bp, Homo sapien
agaagaactgttgtatctgagtttc

SEQ ID NO: 332105 - DNA, 25 bp, Homo sapien
aaatctgattcttcttattagaaag

SEQ ID NO: 332106 - DNA, 25 bp, Homo sapien
gatcaggtcataggtattctcacaa

SEQ ID NO: 332107 - DNA, 25 bp, Homo sapien
gaagcatttgcttgactttatttca

SEQ ID NO: 332108 - DNA, 25 bp, Homo sapien
gcttgactttatttcacctgttgaa

SEQ ID NO: 332109 - DNA, 25 bp, Homo sapien
aaagcagttctcagtatccaagttt

SEQ ID NO: 332110 - DNA, 25 bp, Homo sapien
gtatccaagtttattgctttactaa

SEQ ID NO: 332111 - DNA, 25 bp, Homo sapien
gctttactaaccaatgtctctgttt

SEQ ID NO: 332112 - DNA, 25 bp, Homo sapien
acaaacatggtattggttctcacaa

SEQ ID NO: 332113 - DNA, 25 bp, Homo sapien
gtattggttctcacaaattagttca

SEQ ID NO: 332114 - DNA, 25 bp, Homo sapien
aattagttcaacttcccggtgcatt

SEQ ID NO: 332115 - DNA, 25 bp, Homo sapien
tcaacttcccggtgcattcataaac

SEQ ID NO: 332116 - DNA, 25 bp, Homo sapien
tgggctcggccggagagtaattcat

SEQ ID NO: 332117 - DNA, 25 bp, Homo sapien
aattcatggtctgattggaggcatc

SEQ ID NO: 332118 - DNA, 25 bp, Homo sapien
gaactggttttgctgcgtctctctc

SEQ ID NO: 332119 - DNA, 25 bp, Homo sapien
atcaggtgtacccttggcacagaag

SEQ ID NO: 332120 - DNA, 25 bp, Homo sapien
aagggcgaacatggctcaaggatca

SEQ ID NO: 332121 - DNA, 25 bp, Homo sapien
gggcacctgttagaacaccaacgtc

SEQ ID NO: 332122 - DNA, 25 bp, Homo sapien
gtctcctacaaatgtgtccccaaga

SEQ ID NO: 332123 - DNA, 25 bp, Homo sapien
atgtgtccccaagaatgccagcaag

SEQ ID NO: 332124 - DNA, 25 bp, Homo sapien
gtataacatcaatctgggcgagtca

SEQ ID NO: 332125 - DNA, 25 bp, Homo sapien
tctctcctctttggtaaatcgcgga

SEQ ID NO: 332126 - DNA, 25 bp, Homo sapien
aaatcgcggagatgcacggcgcact

SEQ ID NO: 332127 - DNA, 25 bp, Homo sapien
gttttgtttttactacggtgctgat

SEQ ID NO: 332128 - DNA, 25 bp, Homo sapien
tttactacggtgctgatgtatatgt

SEQ ID NO: 332129 - DNA, 25 bp, Homo sapien
cataagtttttacaatactgcagat

SEQ ID NO: 332130 - DNA, 25 bp, Homo sapien
tactgcagatatcactgggtctact

SEQ ID NO: 332131 - DNA, 25 bp, Homo sapien
atatcactgggtctactatctgtaa

SEQ ID NO: 332132 - DNA, 25 bp, Homo sapien
atcactgggtctactatctgtaaaa

SEQ ID NO: 332133 - DNA, 25 bp, Homo sapien
atttcattccttaactcatcatcac

SEQ ID NO: 332134 - DNA, 25 bp, Homo sapien
attccttaactcatcatcacagcag

SEQ ID NO: 332135 - DNA, 25 bp, Homo sapien
tccttaactcatcatcacagcagtg

SEQ ID NO: 332136 - DNA, 25 bp, Homo sapien
acagcagtggtattgcacttcagat

SEQ ID NO: 332137 - DNA, 25 bp, Homo sapien
gtagattttaatatggtggttttgt

SEQ ID NO: 332138 - DNA, 25 bp, Homo sapien
tctcctggaggtcgtctcctggcat

SEQ ID NO: 332139 - DNA, 25 bp, Homo sapien
gaggtcgtctcctggcatcctcggg

SEQ ID NO: 332140 - DNA, 25 bp, Homo sapien
ccggagccctggtgggcggcctgag

SEQ ID NO: 332141 - DNA, 25 bp, Homo sapien
gcggcctgaggtgagagcccgaccg

SEQ ID NO: 332142 - DNA, 25 bp, Homo sapien
gtgagagcccgaccggcccctttgg

SEQ ID NO: 332143 - DNA, 25 bp, Homo sapien
atatggcgaccggtggctaccggac

SEQ ID NO: 332144 - DNA, 25 bp, Homo sapien
cgaccggtggctaccggaccagcag

SEQ ID NO: 332145 - DNA, 25 bp, Homo sapien
gtggctaccggaccagcagcggcct

SEQ ID NO: 332146 - DNA, 25 bp, Homo sapien
ggcctcggcggcagcaccacagact

SEQ ID NO: 332147 - DNA, 25 bp, Homo sapien
cgaaacgcgagaagatgcgcgccaa

SEQ ID NO: 332148 - DNA, 25 bp, Homo sapien
acgcgagaagatgcgcgccaagcag

SEQ ID NO: 332149 - DNA, 25 bp, Homo sapien
agtgtccttcaggaggtggctgtgc

SEQ ID NO: 332150 - DNA, 25 bp, Homo sapien
aacatgtgtgagctgatgtaccacc

SEQ ID NO: 332151 - DNA, 25 bp, Homo sapien
gtgtgagctgatgtaccacctagga

SEQ ID NO: 332152 - DNA, 25 bp, Homo sapien
tgatgtaccacctaggagagcccag

SEQ ID NO: 332153 - DNA, 25 bp, Homo sapien
gtaccacctaggagagcccagcctg

SEQ ID NO: 332154 - DNA, 25 bp, Homo sapien
acctcatccaggacgacatgctctg

SEQ ID NO: 332155 - DNA, 25 bp, Homo sapien
aggacgacatgctctgtgctggctc

SEQ ID NO: 332156 - DNA, 25 bp, Homo sapien
gtgctggctctgtccagggcaagaa

SEQ ID NO: 332157 - DNA, 25 bp, Homo sapien
tggtctgccccatcaatgatacgtg

SEQ ID NO: 332158 - DNA, 25 bp, Homo sapien
aatgatacgtggatccaggccggca

SEQ ID NO: 332159 - DNA, 25 bp, Homo sapien
tacgtggatccaggccggcattgtg

SEQ ID NO: 332160 - DNA, 25 bp, Homo sapien
aagaagccagccaaatccaagccgg

SEQ ID NO: 332161 - DNA, 25 bp, Homo sapien
aatccaagccggcagtgagccgcga

SEQ ID NO: 332162 - DNA, 25 bp, Homo sapien
caagccggcagtgagccgcgacaag

SEQ ID NO: 332163 - DNA, 25 bp, Homo sapien
agacgccagcgacaagcagcgccag

SEQ ID NO: 332164 - DNA, 25 bp, Homo sapien
ccgcaagagactcctggcggccaag

SEQ ID NO: 332165 - DNA, 25 bp, Homo sapien
tgtgcggcagaactcagccaccgag

SEQ ID NO: 332166 - DNA, 25 bp, Homo sapien
actcagccaccgagagcgcagacag

SEQ ID NO: 332167 - DNA, 25 bp, Homo sapien
gagcgcagacagcatcgagatttat

SEQ ID NO: 332168 - DNA, 25 bp, Homo sapien
acagcatcgagatttatgtcccgga

SEQ ID NO: 332169 - DNA, 25 bp, Homo sapien
tcgagatttatgtcccggaggccca

SEQ ID NO: 332170 - DNA, 25 bp, Homo sapien
gaccaggctctgagaccatgcagga

SEQ ID NO: 332171 - DNA, 25 bp, Homo sapien
gtgttccacatgcacatacaagatc

SEQ ID NO: 332172 - DNA, 25 bp, Homo sapien
atgcacatacaagatccagagtctc

SEQ ID NO: 332173 - DNA, 25 bp, Homo sapien
gttaaaatcacttacatacccagaa

SEQ ID NO: 332174 - DNA, 25 bp, Homo sapien
ttacatacccagaaagaccaccact

SEQ ID NO: 332175 - DNA, 25 bp, Homo sapien
gaaagaccaccactttgcaggtata

SEQ ID NO: 332176 - DNA, 25 bp, Homo sapien
taatccaaacacatgtacaccaaag

SEQ ID NO: 332177 - DNA, 25 bp, Homo sapien
gaacacataagatgccttcttccat

SEQ ID NO: 332178 - DNA, 25 bp, Homo sapien
cttcttccatcaaatgcacttgctt

SEQ ID NO: 332179 - DNA, 25 bp, Homo sapien
cacttgcttgtgaattaatggactt

SEQ ID NO: 332180 - DNA, 25 bp, Homo sapien
gaaacaatgcaatcagtcttttata

SEQ ID NO: 332181 - DNA, 25 bp, Homo sapien
gattcaagtatttctatttcttgga

SEQ ID NO: 332182 - DNA, 25 bp, Homo sapien
gacaacaaaagaatattagaagtga

SEQ ID NO: 332183 - DNA, 25 bp, Homo sapien
aacaaaagaatattagaagtgatgc

SEQ ID NO: 332184 - DNA, 25 bp, Homo sapien
caaaagaatattagaagtgatgcat

SEQ ID NO: 332185 - DNA, 25 bp, Homo sapien
aaaagaatattagaagtgatgcatg

SEQ ID NO: 332186 - DNA, 25 bp, Homo sapien
aaagaatattagaagtgatgcatga

SEQ ID NO: 332187 - DNA, 25 bp, Homo sapien
aagaatattagaagtgatgcatgaa

SEQ ID NO: 332188 - DNA, 25 bp, Homo sapien
gaatattagaagtgatgcatgaaga

SEQ ID NO: 332189 - DNA, 25 bp, Homo sapien
aatattagaagtgatgcatgaagaa

SEQ ID NO: 332190 - DNA, 25 bp, Homo sapien
tgcatgaagaaaacgagatatcaat

SEQ ID NO: 332191 - DNA, 25 bp, Homo sapien
gcatgaagaaaacgagatatcaata

SEQ ID NO: 332192 - DNA, 25 bp, Homo sapien
catgaagaaaacgagatatcaataa

SEQ ID NO: 332193 - DNA, 25 bp, Homo sapien
cgttgtatagctacttattcagata

SEQ ID NO: 332194 - DNA, 25 bp, Homo sapien
gatactgaagaccaacggactgaaa

SEQ ID NO: 332195 - DNA, 25 bp, Homo sapien
gctattttatgctgcaagaaccagg

SEQ ID NO: 332196 - DNA, 25 bp, Homo sapien
gaaccaggacacacaattcgccaat

SEQ ID NO: 332197 - DNA, 25 bp, Homo sapien
aattcgccaatcatcccaccatata

SEQ ID NO: 332198 - DNA, 25 bp, Homo sapien
atcccaccatataaccttcgattgt

SEQ ID NO: 332199 - DNA, 25 bp, Homo sapien
ataaccttcgattgtgcttctcaac

SEQ ID NO: 332200 - DNA, 25 bp, Homo sapien
tcccagagaccatctatcacctttt

SEQ ID NO: 332201 - DNA, 25 bp, Homo sapien
aaccagttgcaccttaaaccatgga

SEQ ID NO: 332202 - DNA, 25 bp, Homo sapien
gggctttaaatagtttcctatgcaa

SEQ ID NO: 332203 - DNA, 25 bp, Homo sapien
ctatgcaacgtgtcttgtagcacaa

SEQ ID NO: 332204 - DNA, 25 bp, Homo sapien
gccactgcagtaaattaggtacgta

SEQ ID NO: 332205 - DNA, 25 bp, Homo sapien
ctcagttggattatttcagcatttt

SEQ ID NO: 332206 - DNA, 25 bp, Homo sapien
tatttcagcattttatttctaaatc

SEQ ID NO: 332207 - DNA, 25 bp, Homo sapien
atttctaaatctgtagtgtgatcag

SEQ ID NO: 332208 - DNA, 25 bp, Homo sapien
acagagagaggcctactaatcaatg

SEQ ID NO: 332209 - DNA, 25 bp, Homo sapien
agaggcctactaatcaatgtgctta

SEQ ID NO: 332210 - DNA, 25 bp, Homo sapien
ggcctactaatcaatgtgcttagag

SEQ ID NO: 332211 - DNA, 25 bp, Homo sapien
gagaaacaaactacctttacattca

SEQ ID NO: 332212 - DNA, 25 bp, Homo sapien
ctacctttacattcaattaacaaca

SEQ ID NO: 332213 - DNA, 25 bp, Homo sapien
agtactttattcctgcagagcgcct

SEQ ID NO: 332214 - DNA, 25 bp, Homo sapien
actttattcctgcagagcgcctcag

SEQ ID NO: 332215 - DNA, 25 bp, Homo sapien
tgactttgaaagtttgtacccctgt

SEQ ID NO: 332216 - DNA, 25 bp, Homo sapien
ttccctttacgccactagtgtgtag

SEQ ID NO: 332217 - DNA, 25 bp, Homo sapien
ttacgccactagtgtgtaggcagat

SEQ ID NO: 332218 - DNA, 25 bp, Homo sapien
cactagtgtgtaggcagatgtctga

SEQ ID NO: 332219 - DNA, 25 bp, Homo sapien
atgtctgagtccctaggtggtttct

SEQ ID NO: 332220 - DNA, 25 bp, Homo sapien
ggtggtttctaggattgatagcaat

SEQ ID NO: 332221 - DNA, 25 bp, Homo sapien
gatagcaattagctttgatgaaccc

SEQ ID NO: 332222 - DNA, 25 bp, Homo sapien
acagcctccctgtatgcctgtgctt

SEQ ID NO: 332223 - DNA, 25 bp, Homo sapien
atgcctgtgcttggtctactgataa

SEQ ID NO: 332224 - DNA, 25 bp, Homo sapien
ttggtctactgataagccctctaca

SEQ ID NO: 332225 - DNA, 25 bp, Homo sapien
gtctactgataagccctctacaaaa

SEQ ID NO: 332226 - DNA, 25 bp, Homo sapien
tgaaaggacgcgatcaatgatgacc

SEQ ID NO: 332227 - DNA, 25 bp, Homo sapien
ggacgcgatcaatgatgacctattg

SEQ ID NO: 332228 - DNA, 25 bp, Homo sapien
aatgatgacctattgcactcacagg

SEQ ID NO: 332229 - DNA, 25 bp, Homo sapien
gatgacctattgcactcacaggtaa

SEQ ID NO: 332230 - DNA, 25 bp, Homo sapien
tattgcactcacaggtaacattgac

SEQ ID NO: 332231 - DNA, 25 bp, Homo sapien
gcactcacaggtaacattgactcaa

SEQ ID NO: 332232 - DNA, 25 bp, Homo sapien
caggtaacattgactcaaattttgg

SEQ ID NO: 332233 - DNA, 25 bp, Homo sapien
gatgtttttatgtcactatcaacat

SEQ ID NO: 332234 - DNA, 25 bp, Homo sapien
tgttaaacaactatgaaactttcaa

SEQ ID NO: 332235 - DNA, 25 bp, Homo sapien
gtttgcatataactgtatgggcact

SEQ ID NO: 332236 - DNA, 25 bp, Homo sapien
actctcatttcactgcatacataca

SEQ ID NO: 332237 - DNA, 25 bp, Homo sapien
aaaatacatccctatgccttcatac

SEQ ID NO: 332238 - DNA, 25 bp, Homo sapien
gccttcataccattctcagctggat

SEQ ID NO: 332239 - DNA, 25 bp, Homo sapien
tctcagctggattaaggaactgcat

SEQ ID NO: 332240 - DNA, 25 bp, Homo sapien
attgagtgtaaagtggcagtggcat

SEQ ID NO: 332241 - DNA, 25 bp, Homo sapien
gtggcagtggcattaactctgctcc

SEQ ID NO: 332242 - DNA, 25 bp, Homo sapien
attaactctgctccgcttcaagctg

SEQ ID NO: 332243 - DNA, 25 bp, Homo sapien
ttcaagctggctccagaccactcaa

SEQ ID NO: 332244 - DNA, 25 bp, Homo sapien
agcctgttcgtcaagttgtcctcaa

SEQ ID NO: 332245 - DNA, 25 bp, Homo sapien
gtcaagttgtcctcaagtccaagaa

SEQ ID NO: 332246 - DNA, 25 bp, Homo sapien
aatggaatccatgtgtttgcaaaaa

SEQ ID NO: 332247 - DNA, 25 bp, Homo sapien
tgctaattttaagtcctttcgtata

SEQ ID NO: 332248 - DNA, 25 bp, Homo sapien
ccattctctgtctctttcagcggcc

SEQ ID NO: 332249 - DNA, 25 bp, Homo sapien
tttcagcggccccatccttatctac

SEQ ID NO: 332250 - DNA, 25 bp, Homo sapien
tcccagaaaaacatctgtcccttcc

SEQ ID NO: 332251 - DNA, 25 bp, Homo sapien
tttccactccccaagggttctcaat

SEQ ID NO: 332252 - DNA, 25 bp, Homo sapien
actccccaagggttctcaattctct

SEQ ID NO: 332253 - DNA, 25 bp, Homo sapien
tccccaagggttctcaattctcttt

SEQ ID NO: 332254 - DNA, 25 bp, Homo sapien
ttcccaggctcgtccatgactgttt

SEQ ID NO: 332255 - DNA, 25 bp, Homo sapien
caggctcgtccatgactgtttcttg

SEQ ID NO: 332256 - DNA, 25 bp, Homo sapien
ggctcgtccatgactgtttcttgtc

SEQ ID NO: 332257 - DNA, 25 bp, Homo sapien
tcgtccatgactgtttcttgtcctc

SEQ ID NO: 332258 - DNA, 25 bp, Homo sapien
tccatgactgtttcttgtcctcaga

SEQ ID NO: 332259 - DNA, 25 bp, Homo sapien
gggatctcttgatttgcctgacatt

SEQ ID NO: 332260 - DNA, 25 bp, Homo sapien
ggatctcttgatttgcctgacattg

SEQ ID NO: 332261 - DNA, 25 bp, Homo sapien
ttagccaaatagtctgaatttccag

SEQ ID NO: 332262 - DNA, 25 bp, Homo sapien
gccaaatagtctgaatttccagaaa

SEQ ID NO: 332263 - DNA, 25 bp, Homo sapien
gaaaacaaggcagaatgatcattcc

SEQ ID NO: 332264 - DNA, 25 bp, Homo sapien
aaggcagaatgatcattcccagaaa

SEQ ID NO: 332265 - DNA, 25 bp, Homo sapien
ggcagaatgatcattcccagaaaca

SEQ ID NO: 332266 - DNA, 25 bp, Homo sapien
gatcattcccagaaacatttcccag

SEQ ID NO: 332267 - DNA, 25 bp, Homo sapien
tcattcccagaaacatttcccagaa

SEQ ID NO: 332268 - DNA, 25 bp, Homo sapien
agtgaagcaaaggacacaacttttt

SEQ ID NO: 332269 - DNA, 25 bp, Homo sapien
gaagcaaaggacacaactttttatt

SEQ ID NO: 332270 - DNA, 25 bp, Homo sapien
gccacgattttcattaaagcaaggg

SEQ ID NO: 332271 - DNA, 25 bp, Homo sapien
atcccaagacgttatgtcatgcctt

SEQ ID NO: 332272 - DNA, 25 bp, Homo sapien
gcaagcagaagtgtgtgggatccat

SEQ ID NO: 332273 - DNA, 25 bp, Homo sapien
tgggatccatactggccctttagaa

SEQ ID NO: 332274 - DNA, 25 bp, Homo sapien
aagatacttgtcctactttgcctaa

SEQ ID NO: 332275 - DNA, 25 bp, Homo sapien
atactggccctttagaagactctct

SEQ ID NO: 332276 - DNA, 25 bp, Homo sapien
gaagactctctgtttttgaatcaca

SEQ ID NO: 332277 - DNA, 25 bp, Homo sapien
gaagatcgtaaagttgtcttccaaa

SEQ ID NO: 332278 - DNA, 25 bp, Homo sapien
gtcctactttgcctaaactcactaa

SEQ ID NO: 332279 - DNA, 25 bp, Homo sapien
caactgctctgatgagagtctctat

SEQ ID NO: 332280 - DNA, 25 bp, Homo sapien
gaagagattcatttgccacgatttt

SEQ ID NO: 332281 - DNA, 25 bp, Homo sapien
agcttcattctgtatagtgttctgt

SEQ ID NO: 332282 - DNA, 25 bp, Homo sapien
tgtgtaattgcatcttctcgtttcc

SEQ ID NO: 332283 - DNA, 25 bp, Homo sapien
cttcatcatcttcgtactcatctaa

SEQ ID NO: 332284 - DNA, 25 bp, Homo sapien
tactcatctaagcactctgcggcag

SEQ ID NO: 332285 - DNA, 25 bp, Homo sapien
cttcagagacactggttgtgctttt

SEQ ID NO: 332286 - DNA, 25 bp, Homo sapien
ctctgcggcagggatgttgaccacg

SEQ ID NO: 332287 - DNA, 25 bp, Homo sapien
gcttttatatctgcctgaaactgtt

SEQ ID NO: 332288 - DNA, 25 bp, Homo sapien
ctgaaactgttctaggtggctcctg

SEQ ID NO: 332289 - DNA, 25 bp, Homo sapien
gtggctcctgtagcagataggaact

SEQ ID NO: 332290 - DNA, 25 bp, Homo sapien
taggaactgcctggatctagtaagt

SEQ ID NO: 332291 - DNA, 25 bp, Homo sapien
ggatctagtaagtttacagcttcat

SEQ ID NO: 332292 - DNA, 25 bp, Homo sapien
atccaagggctacttttgattaaag

SEQ ID NO: 332293 - DNA, 25 bp, Homo sapien
atggatcaaggaattcacattgctt

SEQ ID NO: 332294 - DNA, 25 bp, Homo sapien
gatcaaggaattcacattgctttta

SEQ ID NO: 332295 - DNA, 25 bp, Homo sapien
gaaaagacaaacctatctcagagat

SEQ ID NO: 332296 - DNA, 25 bp, Homo sapien
aagacaaacctatctcagagatttg

SEQ ID NO: 332297 - DNA, 25 bp, Homo sapien
aacctatctcagagatttgagccaa

SEQ ID NO: 332298 - DNA, 25 bp, Homo sapien
tcagagatttgagccaatgtagcaa

SEQ ID NO: 332299 - DNA, 25 bp, Homo sapien
agatttgagccaatgtagcaaagtg

SEQ ID NO: 332300 - DNA, 25 bp, Homo sapien
atgtgggagaatcagcgtgacctac

SEQ ID NO: 332301 - DNA, 25 bp, Homo sapien
gactgaggcgggaagggattattta

SEQ ID NO: 332302 - DNA, 25 bp, Homo sapien
gattatttaagtttaagagtgccac

SEQ ID NO: 332303 - DNA, 25 bp, Homo sapien
aaaaagtccgtcgagagagcaggtg

SEQ ID NO: 332304 - DNA, 25 bp, Homo sapien
gagagagcaggtggcggatgcagct

SEQ ID NO: 332305 - DNA, 25 bp, Homo sapien
cggatgcagctgagagctccaggaa

SEQ ID NO: 332306 - DNA, 25 bp, Homo sapien
gatgcagctgagagctccaggaatg

SEQ ID NO: 332307 - DNA, 25 bp, Homo sapien
ccactggcagccttgactgaaagat

SEQ ID NO: 332308 - DNA, 25 bp, Homo sapien
ctggcagccttgactgaaagatgaa

SEQ ID NO: 332309 - DNA, 25 bp, Homo sapien
ggaggagttgcatcccagcaggctc

SEQ ID NO: 332310 - DNA, 25 bp, Homo sapien
gagttgcatcccagcaggctcagct

SEQ ID NO: 332311 - DNA, 25 bp, Homo sapien
gaggcccagtggctgcaatattctt

SEQ ID NO: 332312 - DNA, 25 bp, Homo sapien
ggcccagtggctgcaatattcttct

SEQ ID NO: 332313 - DNA, 25 bp, Homo sapien
cccagtggctgcaatattcttcttt

SEQ ID NO: 332314 - DNA, 25 bp, Homo sapien
gggactacatggtgactgccagtgc

SEQ ID NO: 332315 - DNA, 25 bp, Homo sapien
tacatggtgactgccagtgccgagg

SEQ ID NO: 332316 - DNA, 25 bp, Homo sapien
gtgactgccagtgccgagggctacc

SEQ ID NO: 332317 - DNA, 25 bp, Homo sapien
agtgccgagggctaccattcagtga

SEQ ID NO: 332318 - DNA, 25 bp, Homo sapien
tgccgagggctaccattcagtgaca

SEQ ID NO: 332319 - DNA, 25 bp, Homo sapien
gagggctaccattcagtgacacgga

SEQ ID NO: 332320 - DNA, 25 bp, Homo sapien
gggctaccattcagtgacacggaac

SEQ ID NO: 332321 - DNA, 25 bp, Homo sapien
tcagtgacacggaactgtcgggtca

SEQ ID NO: 332322 - DNA, 25 bp, Homo sapien
aactgtcgggtcacctttgaagagg

SEQ ID NO: 332323 - DNA, 25 bp, Homo sapien
tgcaatttcgtgctcaccaagactc

SEQ ID NO: 332324 - DNA, 25 bp, Homo sapien
caaacagaggctgcgcgagctgctg

SEQ ID NO: 332325 - DNA, 25 bp, Homo sapien
gggctacatgtagataccacaccaa

SEQ ID NO: 332326 - DNA, 25 bp, Homo sapien
gaaagaaagacgctgggcccaattt

SEQ ID NO: 332327 - DNA, 25 bp, Homo sapien
tgggcccaattttgacttggccagg

SEQ ID NO: 332328 - DNA, 25 bp, Homo sapien
caccttggtgtgtttgttatcttta

SEQ ID NO: 332329 - DNA, 25 bp, Homo sapien
atctttatctgtgggtaggctagct

SEQ ID NO: 332330 - DNA, 25 bp, Homo sapien
taggctagctgacccatctccttga

SEQ ID NO: 332331 - DNA, 25 bp, Homo sapien
tccttgagtcattccctttgggaaa

SEQ ID NO: 332332 - DNA, 25 bp, Homo sapien
gggaaaccccactgccagtattgat

SEQ ID NO: 332333 - DNA, 25 bp, Homo sapien
tattgatctcctttttgccttgtac

SEQ ID NO: 332334 - DNA, 25 bp, Homo sapien
tgaatgacacattacctccacactc

SEQ ID NO: 332335 - DNA, 25 bp, Homo sapien
acactctcccggactaggtggtcaa

SEQ ID NO: 332336 - DNA, 25 bp, Homo sapien
ctgcctgggacacagtcttataaga

SEQ ID NO: 332337 - DNA, 25 bp, Homo sapien
gaatgttggcaggtgactttgtatc

SEQ ID NO: 332338 - DNA, 25 bp, Homo sapien
ggtgactttgtatcagatgttgctt

SEQ ID NO: 332339 - DNA, 25 bp, Homo sapien
tcttttctctgtacacagattgaga

SEQ ID NO: 332340 - DNA, 25 bp, Homo sapien
cagattgagagttaccacagtggcc

SEQ ID NO: 332341 - DNA, 25 bp, Homo sapien
gagttaccacagtggcctgtcgggt

SEQ ID NO: 332342 - DNA, 25 bp, Homo sapien
gggtccaccctgtgggtgcagcaca

SEQ ID NO: 332343 - DNA, 25 bp, Homo sapien
tgtgggtgcagcacagctctctgaa

SEQ ID NO: 332344 - DNA, 25 bp, Homo sapien
gaaagcaagaaccttcctacctatt

SEQ ID NO: 332345 - DNA, 25 bp, Homo sapien
tattctaacgtttttgccctctaag

SEQ ID NO: 332346 - DNA, 25 bp, Homo sapien
aatggcctcaggtatggtatagaca

SEQ ID NO: 332347 - DNA, 25 bp, Homo sapien
ggagaagttctgaaggactctgatt

SEQ ID NO: 332348 - DNA, 25 bp, Homo sapien
gattagagcaagtttcatgttcatg

SEQ ID NO: 332349 - DNA, 25 bp, Homo sapien
gagagcaaacctcatgccaatgcag

SEQ ID NO: 332350 - DNA, 25 bp, Homo sapien
atgccaatgcagtttctgggtccac

SEQ ID NO: 332351 - DNA, 25 bp, Homo sapien
ctgggtccacttccaaagggtgtgt

SEQ ID NO: 332352 - DNA, 25 bp, Homo sapien
cttgttcttcttgctgaatctttca

SEQ ID NO: 332353 - DNA, 25 bp, Homo sapien
agggaggaacttctcaggctctgtc

SEQ ID NO: 332354 - DNA, 25 bp, Homo sapien
aggctctgtccagtactttgggtca

SEQ ID NO: 332355 - DNA, 25 bp, Homo sapien
gaacatcccattgatctcaacatct

SEQ ID NO: 332356 - DNA, 25 bp, Homo sapien
atcttttttgcagaccctctcaagt

SEQ ID NO: 332357 - DNA, 25 bp, Homo sapien
accctctcaagtctcatagcaattg

SEQ ID NO: 332358 - DNA, 25 bp, Homo sapien
aaatattatttatgccccgaaatat

SEQ ID NO: 332359 - DNA, 25 bp, Homo sapien
atttatgccccgaaatatgctaata

SEQ ID NO: 332360 - DNA, 25 bp, Homo sapien
aagattgtgtattatgcctagattc

SEQ ID NO: 332361 - DNA, 25 bp, Homo sapien
ttatgcctagattcaaagtttttgg

SEQ ID NO: 332362 - DNA, 25 bp, Homo sapien
caaatacttttgattgacatgtaca

SEQ ID NO: 332363 - DNA, 25 bp, Homo sapien
tgacatgtacattagcagttattag

SEQ ID NO: 332364 - DNA, 25 bp, Homo sapien
tagcagttattagttgacttttact

SEQ ID NO: 332365 - DNA, 25 bp, Homo sapien
ctaaaacatgcacctttacgatggt

SEQ ID NO: 332366 - DNA, 25 bp, Homo sapien
acatgcacctttacgatggtgtttt

SEQ ID NO: 332367 - DNA, 25 bp, Homo sapien
gcacctttacgatggtgtttttgta

SEQ ID NO: 332368 - DNA, 25 bp, Homo sapien
cacacatacacagctaaattagaaa

SEQ ID NO: 332369 - DNA, 25 bp, Homo sapien
gaaaagctgcctaaccagttctggg

SEQ ID NO: 332370 - DNA, 25 bp, Homo sapien
agttctgggccctggctagttacaa

SEQ ID NO: 332371 - DNA, 25 bp, Homo sapien
ggctagttacaaccatgtgtgagtt

SEQ ID NO: 332372 - DNA, 25 bp, Homo sapien
tttacagtacgcacaggtatgggct

SEQ ID NO: 332373 - DNA, 25 bp, Homo sapien
gaaaggcttgctgaaattgctatgg

SEQ ID NO: 332374 - DNA, 25 bp, Homo sapien
aattgctatgggagggccccaccct

SEQ ID NO: 332375 - DNA, 25 bp, Homo sapien
accccgctcggtttcagtttctgca

SEQ ID NO: 332376 - DNA, 25 bp, Homo sapien
tctgcagcttggttatgcgacattc

SEQ ID NO: 332377 - DNA, 25 bp, Homo sapien
gcgacattctcttaatccttttttg

SEQ ID NO: 332378 - DNA, 25 bp, Homo sapien
aatccttttttgaatctggtctcta

SEQ ID NO: 332379 - DNA, 25 bp, Homo sapien
gaatctggtctctacttaagcactc

SEQ ID NO: 332380 - DNA, 25 bp, Homo sapien
tgtttctgttgcagtggcaaaggta

SEQ ID NO: 332381 - DNA, 25 bp, Homo sapien
gcagtggcaaaggtaacatgtcaga

SEQ ID NO: 332382 - DNA, 25 bp, Homo sapien
gtcagaaaattcagagggttgcata

SEQ ID NO: 332383 - DNA, 25 bp, Homo sapien
agagggttgcataccaataatcctt

SEQ ID NO: 332384 - DNA, 25 bp, Homo sapien
ttggaaactggatgtcttactgggt

SEQ ID NO: 332385 - DNA, 25 bp, Homo sapien
aaactggatgtcttactgggtgcta

SEQ ID NO: 332386 - DNA, 25 bp, Homo sapien
ctggatgtcttactgggtgctagaa

SEQ ID NO: 332387 - DNA, 25 bp, Homo sapien
gtcttactgggtgctagaatgaaaa

SEQ ID NO: 332388 - DNA, 25 bp, Homo sapien
gtaggtatttattgtcagatgatga

SEQ ID NO: 332389 - DNA, 25 bp, Homo sapien
gaaatatcactgtccaatgtgttca

SEQ ID NO: 332390 - DNA, 25 bp, Homo sapien
tcactgtccaatgtgttcacttatg

SEQ ID NO: 332391 - DNA, 25 bp, Homo sapien
ctatatgattttaaatgcttctctt

SEQ ID NO: 332392 - DNA, 25 bp, Homo sapien
aaatgcttctcttaagctggtaaac

SEQ ID NO: 332393 - DNA, 25 bp, Homo sapien
gcttctcttaagctggtaaacagat

SEQ ID NO: 332394 - DNA, 25 bp, Homo sapien
tctcttaagctggtaaacagatttg

SEQ ID NO: 332395 - DNA, 25 bp, Homo sapien
aacagatttgagttatgagttcatt

SEQ ID NO: 332396 - DNA, 25 bp, Homo sapien
ttattgctgcttactaactacaaaa

SEQ ID NO: 332397 - DNA, 25 bp, Homo sapien
gctgcttactaactacaaaatactg

SEQ ID NO: 332398 - DNA, 25 bp, Homo sapien
acaaaatactgtagatggcatctgt

SEQ ID NO: 332399 - DNA, 25 bp, Homo sapien
agatggcatctgtatgattaaacat

SEQ ID NO: 332400 - DNA, 25 bp, Homo sapien
gtaaaacaggtctgagggctttgta

SEQ ID NO: 332401 - DNA, 25 bp, Homo sapien
gggctttgtagatgattaaagtctc

SEQ ID NO: 332402 - DNA, 25 bp, Homo sapien
gggattctcttaaattgatatgact

SEQ ID NO: 332403 - DNA, 25 bp, Homo sapien
aaattgatatgactgtgaggactac

SEQ ID NO: 332404 - DNA, 25 bp, Homo sapien
gaggactacagaattgcattgcttt

SEQ ID NO: 332405 - DNA, 25 bp, Homo sapien
gaattgcattgctttccagaaacat

SEQ ID NO: 332406 - DNA, 25 bp, Homo sapien
gctttccagaaacatgttgccttgt

SEQ ID NO: 332407 - DNA, 25 bp, Homo sapien
tgttgccttgtttctgaaaaacttt

SEQ ID NO: 332408 - DNA, 25 bp, Homo sapien
gagagttttacttaaatcctatata

SEQ ID NO: 332409 - DNA, 25 bp, Homo sapien
aatatgttcctaggtaatacagaca

SEQ ID NO: 332410 - DNA, 25 bp, Homo sapien
taatgtaaaccctctccttgatctt

SEQ ID NO: 332411 - DNA, 25 bp, Homo sapien
atttttaccaatattctgacgattc

SEQ ID NO: 332412 - DNA, 25 bp, Homo sapien
tattctgacgattctgacatgttta

SEQ ID NO: 332413 - DNA, 25 bp, Homo sapien
agtaccgggcgctcacggtgcccga

SEQ ID NO: 332414 - DNA, 25 bp, Homo sapien
aacgaggccctgtatgacatctgct

SEQ ID NO: 332415 - DNA, 25 bp, Homo sapien
acgaggccctgtatgacatctgctt

SEQ ID NO: 332416 - DNA, 25 bp, Homo sapien
ggccctgtatgacatctgcttccgc

SEQ ID NO: 332417 - DNA, 25 bp, Homo sapien
tgacatctgcttccgcaccctgaag

SEQ ID NO: 332418 - DNA, 25 bp, Homo sapien
ttccgcaccctgaagctgaccaccc

SEQ ID NO: 332419 - DNA, 25 bp, Homo sapien
gggacctcaaccacctggtgtcggc

SEQ ID NO: 332420 - DNA, 25 bp, Homo sapien
gcttcccgggccagctgaacgcaga

SEQ ID NO: 332421 - DNA, 25 bp, Homo sapien
cttcccgggccagctgaacgcagac

SEQ ID NO: 332422 - DNA, 25 bp, Homo sapien
gctgaacgcagacctgcgcaagctg

SEQ ID NO: 332423 - DNA, 25 bp, Homo sapien
cggtgaacatggtgcccttccctcg

SEQ ID NO: 332424 - DNA, 25 bp, Homo sapien
gaaaaacctcgagtcatggtgaatg

SEQ ID NO: 332425 - DNA, 25 bp, Homo sapien
tgaatgagtgtctcggagttgctcg

SEQ ID NO: 332426 - DNA, 25 bp, Homo sapien
gtgtgtacacctgcgtgcgtgtgtg

SEQ ID NO: 332427 - DNA, 25 bp, Homo sapien
tgtgcattttgcaaagggtggacat

SEQ ID NO: 332428 - DNA, 25 bp, Homo sapien
agtgtatctcccagaaaggtgatga

SEQ ID NO: 332429 - DNA, 25 bp, Homo sapien
gaataggactgagagtcacagtgaa

SEQ ID NO: 332430 - DNA, 25 bp, Homo sapien
gtcacagtgaatgtggcatgcatgc

SEQ ID NO: 332431 - DNA, 25 bp, Homo sapien
gtgtcatgtgacatatgtgagtctc

SEQ ID NO: 332432 - DNA, 25 bp, Homo sapien
atatgtgagtctcggcatgtcacgg

SEQ ID NO: 332433 - DNA, 25 bp, Homo sapien
tgtgtctgagcacctccagcagatg

SEQ ID NO: 332434 - DNA, 25 bp, Homo sapien
agcacctccagcagatgtcactctg

SEQ ID NO: 332435 - DNA, 25 bp, Homo sapien
tggattcatggattggctttctgtg

SEQ ID NO: 332436 - DNA, 25 bp, Homo sapien
tcatggattggctttctgtgataga

SEQ ID NO: 332437 - DNA, 25 bp, Homo sapien
gggtcttaaacgtgcatgggaaata

SEQ ID NO: 332438 - DNA, 25 bp, Homo sapien
aacgtgcatgggaaataccattcta

SEQ ID NO: 332439 - DNA, 25 bp, Homo sapien
cattctaacacactgcttgcttcta

SEQ ID NO: 332440 - DNA, 25 bp, Homo sapien
acacactgcttgcttctaaggtaag

SEQ ID NO: 332441 - DNA, 25 bp, Homo sapien
ggaaacacaggaaagttgccccatt

SEQ ID NO: 332442 - DNA, 25 bp, Homo sapien
acacaggaaagttgccccattgagt

SEQ ID NO: 332443 - DNA, 25 bp, Homo sapien
ccccattgagtgacatttaagacgt

SEQ ID NO: 332444 - DNA, 25 bp, Homo sapien
atggacagtgtctagcaacatcaaa

SEQ ID NO: 332445 - DNA, 25 bp, Homo sapien
gatgcaattatgctttgtgggtttt

SEQ ID NO: 332446 - DNA, 25 bp, Homo sapien
cctggtggtcctatagtaagagttc

SEQ ID NO: 332447 - DNA, 25 bp, Homo sapien
tcctcatttggtttccctacaatta

SEQ ID NO: 332448 - DNA, 25 bp, Homo sapien
gatctgtgatatacaaaaaccggca

SEQ ID NO: 332449 - DNA, 25 bp, Homo sapien
aaaaaccggcacaatctcactctta

SEQ ID NO: 332450 - DNA, 25 bp, Homo sapien
ccggcacaatctcactcttaataag

SEQ ID NO: 332451 - DNA, 25 bp, Homo sapien
ttttttcctcagaatggcaaagatc

SEQ ID NO: 332452 - DNA, 25 bp, Homo sapien
gttggaaagtatgcagaccgatatt

SEQ ID NO: 332453 - DNA, 25 bp, Homo sapien
gcagaccgatattctcatattcatt

SEQ ID NO: 332454 - DNA, 25 bp, Homo sapien
tttctctgctgcaactcctactttt

SEQ ID NO: 332455 - DNA, 25 bp, Homo sapien
ctgcaactcctactttttcagtgta

SEQ ID NO: 332456 - DNA, 25 bp, Homo sapien
aacaggaaatcagacctggtggtcc

SEQ ID NO: 332457 - DNA, 25 bp, Homo sapien
cagagccgacatgaagagtttagtt

SEQ ID NO: 332458 - DNA, 25 bp, Homo sapien
atgccagctgcattagatgtaacta

SEQ ID NO: 332459 - DNA, 25 bp, Homo sapien
atatatttcactttgactttagacc

SEQ ID NO: 332460 - DNA, 25 bp, Homo sapien
gttttgaaatacagtctccacttac

SEQ ID NO: 332461 - DNA, 25 bp, Homo sapien
tttgaaatacagtctccacttacga

SEQ ID NO: 332462 - DNA, 25 bp, Homo sapien
tgaaatacagtctccacttacgaat

SEQ ID NO: 332463 - DNA, 25 bp, Homo sapien
gaaatacagtctccacttacgaatg

SEQ ID NO: 332464 - DNA, 25 bp, Homo sapien
aatacagtctccacttacgaatgtc

SEQ ID NO: 332465 - DNA, 25 bp, Homo sapien
atacagtctccacttacgaatgtca

SEQ ID NO: 332466 - DNA, 25 bp, Homo sapien
tacagtctccacttacgaatgtcat

SEQ ID NO: 332467 - DNA, 25 bp, Homo sapien
acagtctccacttacgaatgtcata

SEQ ID NO: 332468 - DNA, 25 bp, Homo sapien
tgacagtcaagtgccatctggatct

SEQ ID NO: 332469 - DNA, 25 bp, Homo sapien
ggatcttaaggagcttccatttctc

SEQ ID NO: 332470 - DNA, 25 bp, Homo sapien
aggagcttccatttctccagctcag

SEQ ID NO: 332471 - DNA, 25 bp, Homo sapien
atcatttatttaagcagcctatcag

SEQ ID NO: 332472 - DNA, 25 bp, Homo sapien
ttaagcagcctatcagtgattgcca

SEQ ID NO: 332473 - DNA, 25 bp, Homo sapien
agtgattgccattagactgttgaat

SEQ ID NO: 332474 - DNA, 25 bp, Homo sapien
gactgttgaatactgttacttttat

SEQ ID NO: 332475 - DNA, 25 bp, Homo sapien
ggaatgccttcctgtcatattttag

SEQ ID NO: 332476 - DNA, 25 bp, Homo sapien
aatgccttcctgtcatattttagcc

SEQ ID NO: 332477 - DNA, 25 bp, Homo sapien
atgtgaatagcttagaatactgcaa

SEQ ID NO: 332478 - DNA, 25 bp, Homo sapien
gaatactgcaaaggataagctaatt

SEQ ID NO: 332479 - DNA, 25 bp, Homo sapien
tgaactgacagtttctcctaacttt

SEQ ID NO: 332480 - DNA, 25 bp, Homo sapien
ttctcctaactttctgctttagcgt

SEQ ID NO: 332481 - DNA, 25 bp, Homo sapien
aactttctgctttagcgtaattgct

SEQ ID NO: 332482 - DNA, 25 bp, Homo sapien
ctgctttagcgtaattgctcagagt

SEQ ID NO: 332483 - DNA, 25 bp, Homo sapien
gtaattgctcagagtagagagcccc

SEQ ID NO: 332484 - DNA, 25 bp, Homo sapien
ctagcagcaatccaccagtttttct

SEQ ID NO: 332485 - DNA, 25 bp, Homo sapien
gcagcaatccaccagtttttctaag

SEQ ID NO: 332486 - DNA, 25 bp, Homo sapien
gcaatccaccagtttttctaagcta

SEQ ID NO: 332487 - DNA, 25 bp, Homo sapien
aatccaccagtttttctaagctaga

SEQ ID NO: 332488 - DNA, 25 bp, Homo sapien
tctaagctagaacctttgagtcccc

SEQ ID NO: 332489 - DNA, 25 bp, Homo sapien
tttgagtcccccaaactgcctgaag

SEQ ID NO: 332490 - DNA, 25 bp, Homo sapien
ggccatgctgaacctctactacatc

SEQ ID NO: 332491 - DNA, 25 bp, Homo sapien
cctgcatctgcgaggcttccattgg

SEQ ID NO: 332492 - DNA, 25 bp, Homo sapien
gggagaagcaagtgacagcatttca

SEQ ID NO: 332493 - DNA, 25 bp, Homo sapien
cagcatttcacaacacatctctgtt

SEQ ID NO: 332494 - DNA, 25 bp, Homo sapien
gaagtcaggataacacaactgttgc

SEQ ID NO: 332495 - DNA, 25 bp, Homo sapien
gttgccagcaacatagactttactc

SEQ ID NO: 332496 - DNA, 25 bp, Homo sapien
atagactttactccagacgacttga

SEQ ID NO: 332497 - DNA, 25 bp, Homo sapien
tccagacgacttgagatgcaaatta

SEQ ID NO: 332498 - DNA, 25 bp, Homo sapien
gcaaattaagtgtgcttttctgtga

SEQ ID NO: 332499 - DNA, 25 bp, Homo sapien
aaatgcaccttacttcctctgttat

SEQ ID NO: 332500 - DNA, 25 bp, Homo sapien
acttcctctgttatgccagatatgg

SEQ ID NO: 332501 - DNA, 25 bp, Homo sapien
aggccacaccagagatcccattggg

SEQ ID NO: 332502 - DNA, 25 bp, Homo sapien
agctgcacactgtccttgtccagga

SEQ ID NO: 332503 - DNA, 25 bp, Homo sapien
cactgtccttgtccaggagattcag

SEQ ID NO: 332504 - DNA, 25 bp, Homo sapien
ggagctcattgaggcacagacacgt

SEQ ID NO: 332505 - DNA, 25 bp, Homo sapien
gtccatgtgcagaagtaagagcact

SEQ ID NO: 332506 - DNA, 25 bp, Homo sapien
gaagaggcccctccagagagagcac

SEQ ID NO: 332507 - DNA, 25 bp, Homo sapien
ggagctccagccaaggaccagacca

SEQ ID NO: 332508 - DNA, 25 bp, Homo sapien
agccaaggaccagaccaacgaggag

SEQ ID NO: 332509 - DNA, 25 bp, Homo sapien
gaccaacgaggagctgcctgaaatc

SEQ ID NO: 332510 - DNA, 25 bp, Homo sapien
agctgcctgaaatcacggaggtgcc

SEQ ID NO: 332511 - DNA, 25 bp, Homo sapien
acggaggtgccggagagcattaaaa

SEQ ID NO: 332512 - DNA, 25 bp, Homo sapien
tgcagccaccactcctgggttcgag

SEQ ID NO: 332513 - DNA, 25 bp, Homo sapien
gcagccaccactcctgggttcgagc

SEQ ID NO: 332514 - DNA, 25 bp, Homo sapien
tttttactagagatgaggatttccc

SEQ ID NO: 332515 - DNA, 25 bp, Homo sapien
ttttactagagatgaggatttccca

SEQ ID NO: 332516 - DNA, 25 bp, Homo sapien
tttactagagatgaggatttcccat

SEQ ID NO: 332517 - DNA, 25 bp, Homo sapien
ttactagagatgaggatttcccatg

SEQ ID NO: 332518 - DNA, 25 bp, Homo sapien
tactagagatgaggatttcccatgt

SEQ ID NO: 332519 - DNA, 25 bp, Homo sapien
actagagatgaggatttcccatgtt

SEQ ID NO: 332520 - DNA, 25 bp, Homo sapien
ctagagatgaggatttcccatgttg

SEQ ID NO: 332521 - DNA, 25 bp, Homo sapien
ttatctgaaggttaaagggcaagtg

SEQ ID NO: 332522 - DNA, 25 bp, Homo sapien
ggcaagtgtttggtatagaagagca

SEQ ID NO: 332523 - DNA, 25 bp, Homo sapien
aaaaatattggttcgcgtagagtgc

SEQ ID NO: 332524 - DNA, 25 bp, Homo sapien
attggttcgcgtagagtgcaaatta

SEQ ID NO: 332525 - DNA, 25 bp, Homo sapien
acgattatcattttgagatgtgtta

SEQ ID NO: 332526 - DNA, 25 bp, Homo sapien
aatgtattagtgtttctgcattgcc

SEQ ID NO: 332527 - DNA, 25 bp, Homo sapien
tctgcattgccatagggcctggtta

SEQ ID NO: 332528 - DNA, 25 bp, Homo sapien
tgccatagggcctggttaaaacttt

SEQ ID NO: 332529 - DNA, 25 bp, Homo sapien
ggaagactgtcacatacagtaagct

SEQ ID NO: 332530 - DNA, 25 bp, Homo sapien
acagtaagcttttttccttctgact

SEQ ID NO: 332531 - DNA, 25 bp, Homo sapien
agcttttttccttctgacttataat

SEQ ID NO: 332532 - DNA, 25 bp, Homo sapien
gaattctccctgatcaatgtgcaaa

SEQ ID NO: 332533 - DNA, 25 bp, Homo sapien
tgtgcaaatccggaatgtcaatgtg

SEQ ID NO: 332534 - DNA, 25 bp, Homo sapien
gcacagtgtctgtgcactgcagcaa

SEQ ID NO: 332535 - DNA, 25 bp, Homo sapien
actgcagcaaccatcgtgtcaagat

SEQ ID NO: 332536 - DNA, 25 bp, Homo sapien
gcaaccatcgtgtcaagatgctggt

SEQ ID NO: 332537 - DNA, 25 bp, Homo sapien
agatgctggtgaagttccctgcaca

SEQ ID NO: 332538 - DNA, 25 bp, Homo sapien
tgaagttccctgcacagtacccaaa

SEQ ID NO: 332539 - DNA, 25 bp, Homo sapien
tccagtttattaaccccacaaccat

SEQ ID NO: 332540 - DNA, 25 bp, Homo sapien
tttattaaccccacaaccatcacat

SEQ ID NO: 332541 - DNA, 25 bp, Homo sapien
accatcacatccaccatgaaagcta

SEQ ID NO: 332542 - DNA, 25 bp, Homo sapien
catccaccatgaaagctaagctgct

SEQ ID NO: 332543 - DNA, 25 bp, Homo sapien
aaaagcaaggcattcgtggaccaaa

SEQ ID NO: 332544 - DNA, 25 bp, Homo sapien
cgtggaccaaagaccggcgtgcgat

SEQ ID NO: 332545 - DNA, 25 bp, Homo sapien
gcgtgcgatgagagtgatgtctatt

SEQ ID NO: 332546 - DNA, 25 bp, Homo sapien
gaagtggatgaacatccgtcctctc

SEQ ID NO: 332547 - DNA, 25 bp, Homo sapien
acaaatgcctttacagtttgatctg

SEQ ID NO: 332548 - DNA, 25 bp, Homo sapien
tacagtttgatctgtgcaaccatat

SEQ ID NO: 332549 - DNA, 25 bp, Homo sapien
gtgcaaccatattgcttctgggaaa

SEQ ID NO: 332550 - DNA, 25 bp, Homo sapien
ggaaactgttcctttgctcatagtc

SEQ ID NO: 332551 - DNA, 25 bp, Homo sapien
gttcctttgctcatagtcctgagga

SEQ ID NO: 332552 - DNA, 25 bp, Homo sapien
gaagtttggacttacatgaaggaga

SEQ ID NO: 332553 - DNA, 25 bp, Homo sapien
gcaattttacgaactatggctcaag

SEQ ID NO: 332554 - DNA, 25 bp, Homo sapien
tccaaagctcggatgtgctcctcaa

SEQ ID NO: 332555 - DNA, 25 bp, Homo sapien
tgtgctcctcaaaacagatcagtgc

SEQ ID NO: 332556 - DNA, 25 bp, Homo sapien
agatcagtgcatcttccttgtccat

SEQ ID NO: 332557 - DNA, 25 bp, Homo sapien
tccttgtccatgtctaaagacaggc

SEQ ID NO: 332558 - DNA, 25 bp, Homo sapien
ggttccgcgggcattgtcccagcag

SEQ ID NO: 332559 - DNA, 25 bp, Homo sapien
gggcattgtcccagcaggataccct

SEQ ID NO: 332560 - DNA, 25 bp, Homo sapien
cagcacccctaatgtttcaacgatg

SEQ ID NO: 332561 - DNA, 25 bp, Homo sapien
taatgtttcaacgatgctgtcctac

SEQ ID NO: 332562 - DNA, 25 bp, Homo sapien
aacgatgctgtcctacaggtgctag

SEQ ID NO: 332563 - DNA, 25 bp, Homo sapien
gtcctacaggtgctagggataccca

SEQ ID NO: 332564 - DNA, 25 bp, Homo sapien
gcagccactgcaatggtagttctta

SEQ ID NO: 332565 - DNA, 25 bp, Homo sapien
tatcccacctgacatgtccttctga

SEQ ID NO: 332566 - DNA, 25 bp, Homo sapien
atgtccttctgagcccggtaagagc

SEQ ID NO: 332567 - DNA, 25 bp, Homo sapien
gtttagcccctgaaagccatggaga

SEQ ID NO: 332568 - DNA, 25 bp, Homo sapien
ggagattctcataacttgagaccta

SEQ ID NO: 332569 - DNA, 25 bp, Homo sapien
gagacctaatctctgtaaagctaaa

SEQ ID NO: 332570 - DNA, 25 bp, Homo sapien
ggctgaggatacgacagtacactgt

SEQ ID NO: 332571 - DNA, 25 bp, Homo sapien
agtacactgtcagcagggactgtaa

SEQ ID NO: 332572 - DNA, 25 bp, Homo sapien
gaacacattgagttggaatcactgt

SEQ ID NO: 332573 - DNA, 25 bp, Homo sapien
ggaatcactgtttagaacacacaca

SEQ ID NO: 332574 - DNA, 25 bp, Homo sapien
cacttactttttctggtctctacca

SEQ ID NO: 332575 - DNA, 25 bp, Homo sapien
gtctctaccactgctgatattttct

SEQ ID NO: 332576 - DNA, 25 bp, Homo sapien
ctgtgcaaccatattgcttctggga

SEQ ID NO: 332577 - DNA, 25 bp, Homo sapien
gcaaccatattgcttctgggaaaaa

SEQ ID NO: 332578 - DNA, 25 bp, Homo sapien
ggaaactgttcctttgctcatagtc

SEQ ID NO: 332579 - DNA, 25 bp, Homo sapien
aactgttcctttgctcatagtcctg

SEQ ID NO: 332580 - DNA, 25 bp, Homo sapien
gttcctttgctcatagtcctgagga

SEQ ID NO: 332581 - DNA, 25 bp, Homo sapien
ctttgctcatagtcctgaggaaaga

SEQ ID NO: 332582 - DNA, 25 bp, Homo sapien
gaagtttggacttacatgaaggaga

SEQ ID NO: 332583 - DNA, 25 bp, Homo sapien
aatgggatacaagatatggagcaat

SEQ ID NO: 332584 - DNA, 25 bp, Homo sapien
atggagcaattttacgaactatggc

SEQ ID NO: 332585 - DNA, 25 bp, Homo sapien
gcaattttacgaactatggctcaag

SEQ ID NO: 332586 - DNA, 25 bp, Homo sapien
attttacgaactatggctcaagagt

SEQ ID NO: 332587 - DNA, 25 bp, Homo sapien
gtacagcacaggaacctgacacata

SEQ ID NO: 332588 - DNA, 25 bp, Homo sapien
catagtaggcacacagtaaacgttt

SEQ ID NO: 332589 - DNA, 25 bp, Homo sapien
agtcatccagtcctgactcttctgt

SEQ ID NO: 332590 - DNA, 25 bp, Homo sapien
ttctgtctcttgaggtcccttgaat

SEQ ID NO: 332591 - DNA, 25 bp, Homo sapien
ttgaggtcccttgaatcttccgctt

SEQ ID NO: 332592 - DNA, 25 bp, Homo sapien
gatttcagcgtgtccacatcacagc

SEQ ID NO: 332593 - DNA, 25 bp, Homo sapien
tgcaagagcttcttagcagttcctg

SEQ ID NO: 332594 - DNA, 25 bp, Homo sapien
gcttcttagcagttcctggtctgaa

SEQ ID NO: 332595 - DNA, 25 bp, Homo sapien
tcatcttccaccctaaaactagagt

SEQ ID NO: 332596 - DNA, 25 bp, Homo sapien
cacttaacccctcagctatgaaaag

SEQ ID NO: 332597 - DNA, 25 bp, Homo sapien
aaaggcttccaggagtttccatgaa

SEQ ID NO: 332598 - DNA, 25 bp, Homo sapien
gcagtgatatcacttgaacttcagt

SEQ ID NO: 332599 - DNA, 25 bp, Homo sapien
tatcacttgaacttcagtgccctca

SEQ ID NO: 332600 - DNA, 25 bp, Homo sapien
agtgccctcactgtagaatttaaaa

SEQ ID NO: 332601 - DNA, 25 bp, Homo sapien
cctcactgtagaatttaaaagcctt

SEQ ID NO: 332602 - DNA, 25 bp, Homo sapien
taaaagccttactgttgattgccca

SEQ ID NO: 332603 - DNA, 25 bp, Homo sapien
ctgttgattgcccatgttggacttg

SEQ ID NO: 332604 - DNA, 25 bp, Homo sapien
gttgattgcccatgttggacttgat

SEQ ID NO: 332605 - DNA, 25 bp, Homo sapien
gattgcccatgttggacttgatgga

SEQ ID NO: 332606 - DNA, 25 bp, Homo sapien
gcccatgttggacttgatggagaaa

SEQ ID NO: 332607 - DNA, 25 bp, Homo sapien
aaatatctttcattatgctttacaa

SEQ ID NO: 332608 - DNA, 25 bp, Homo sapien
aagttacatttaatctatgcatttt

SEQ ID NO: 332609 - DNA, 25 bp, Homo sapien
tgacctaggtgtgaccaccagcgtg

SEQ ID NO: 332610 - DNA, 25 bp, Homo sapien
ccagcgtgccggaggtgcccatgat

SEQ ID NO: 332611 - DNA, 25 bp, Homo sapien
gaagttcaccagcatgcacaaggcc

SEQ ID NO: 332612 - DNA, 25 bp, Homo sapien
gcacaaggcctactcacctgagaag

SEQ ID NO: 332613 - DNA, 25 bp, Homo sapien
agaagatctccatcctgctcaagac

SEQ ID NO: 332614 - DNA, 25 bp, Homo sapien
tgctcaagacctgcaaactcatcta

SEQ ID NO: 332615 - DNA, 25 bp, Homo sapien
tgcaaactcatctacgactccatgg

SEQ ID NO: 332616 - DNA, 25 bp, Homo sapien
tgctcatgtatgtgctggcccgcag

SEQ ID NO: 332617 - DNA, 25 bp, Homo sapien
gcagcaacctcacggagatgcttct

SEQ ID NO: 332618 - DNA, 25 bp, Homo sapien
gagatgcttctcaatgtggagtaca

SEQ ID NO: 332619 - DNA, 25 bp, Homo sapien
acatgatggagctcatggaccccgc

SEQ ID NO: 332620 - DNA, 25 bp, Homo sapien
gctgcttgtaaacccaagccaagct

SEQ ID NO: 332621 - DNA, 25 bp, Homo sapien
aagccaagctttgtcccacgtaggg

SEQ ID NO: 332622 - DNA, 25 bp, Homo sapien
aagctttgtcccacgtagggagaat

SEQ ID NO: 332623 - DNA, 25 bp, Homo sapien
atctccccattctgtggttctttgg

SEQ ID NO: 332624 - DNA, 25 bp, Homo sapien
gggttcctgcttccctcaaactgaa

SEQ ID NO: 332625 - DNA, 25 bp, Homo sapien
gatggcttaattattgcctggaatt

SEQ ID NO: 332626 - DNA, 25 bp, Homo sapien
aattattgcctggaattgcccggcc

SEQ ID NO: 332627 - DNA, 25 bp, Homo sapien
aattgcccggcctccgatgctggaa

SEQ ID NO: 332628 - DNA, 25 bp, Homo sapien
gcctccgatgctggaatcaaagatt

SEQ ID NO: 332629 - DNA, 25 bp, Homo sapien
gggaggattgcagcatctagtgcct

SEQ ID NO: 332630 - DNA, 25 bp, Homo sapien
agtgccttccaaggctgttcctgga

SEQ ID NO: 332631 - DNA, 25 bp, Homo sapien
aaaagatgcgaaaacctgatgaggg

SEQ ID NO: 332632 - DNA, 25 bp, Homo sapien
gatgagggcaaaccagttaaaccta

SEQ ID NO: 332633 - DNA, 25 bp, Homo sapien
ttaaacctaacaccctgccttgtct

SEQ ID NO: 332634 - DNA, 25 bp, Homo sapien
tccctatcccagactaactttactg

SEQ ID NO: 332635 - DNA, 25 bp, Homo sapien
agactaactttactgtgaaatccta

SEQ ID NO: 332636 - DNA, 25 bp, Homo sapien
ccatgtctgaatttttggattcggg

SEQ ID NO: 332637 - DNA, 25 bp, Homo sapien
gtggattttcgttgtccgtggaaga

SEQ ID NO: 332638 - DNA, 25 bp, Homo sapien
gtccgtggaagaacacatggatctc

SEQ ID NO: 332639 - DNA, 25 bp, Homo sapien
tctctggctttctcacccaagttgg

SEQ ID NO: 332640 - DNA, 25 bp, Homo sapien
acccaagttggccacttacgctaat

SEQ ID NO: 332641 - DNA, 25 bp, Homo sapien
tgccccttaaccttgacgaggatac

SEQ ID NO: 332642 - DNA, 25 bp, Homo sapien
aataggagcacgacgcatgattggt

SEQ ID NO: 332643 - DNA, 25 bp, Homo sapien
attggtgtttgaggcgtttgccagc

SEQ ID NO: 332644 - DNA, 25 bp, Homo sapien
ttgccagctgggacaaactgcgttt

SEQ ID NO: 332645 - DNA, 25 bp, Homo sapien
aaactgcgtttggagctgtggttaa

SEQ ID NO: 332646 - DNA, 25 bp, Homo sapien
gcggtggctctttcttaacattccc

SEQ ID NO: 332647 - DNA, 25 bp, Homo sapien
gcccagggctgttcatgcaagattt

SEQ ID NO: 332648 - DNA, 25 bp, Homo sapien
taatggtgacttgtcctggcttact

SEQ ID NO: 332649 - DNA, 25 bp, Homo sapien
tcctggcttactgggacagtctgta

SEQ ID NO: 332650 - DNA, 25 bp, Homo sapien
tgtatgaggcatgtcaccacactgt

SEQ ID NO: 332651 - DNA, 25 bp, Homo sapien
actgtcgcctcatagctgcaagaga

SEQ ID NO: 332652 - DNA, 25 bp, Homo sapien
gctgaagttcccctgactgaagaga

SEQ ID NO: 332653 - DNA, 25 bp, Homo sapien
gagtacagcagtgcattcgcggcta

SEQ ID NO: 332654 - DNA, 25 bp, Homo sapien
tacagcagtgcattcgcggctaact

SEQ ID NO: 332655 - DNA, 25 bp, Homo sapien
gtgcattcgcggctaactgcagcct

SEQ ID NO: 332656 - DNA, 25 bp, Homo sapien
caagcactggggctcaagcaaacct

SEQ ID NO: 332657 - DNA, 25 bp, Homo sapien
aaaaacttgataccatagagccttg

SEQ ID NO: 332658 - DNA, 25 bp, Homo sapien
aacttgataccatagagccttgaat

SEQ ID NO: 332659 - DNA, 25 bp, Homo sapien
tgataccatagagccttgaatataa

SEQ ID NO: 332660 - DNA, 25 bp, Homo sapien
tataaatatcctgatgttaacctac

SEQ ID NO: 332661 - DNA, 25 bp, Homo sapien
tcctgatgttaacctactgcttttg

SEQ ID NO: 332662 - DNA, 25 bp, Homo sapien
tgatgttaacctactgcttttgctg

SEQ ID NO: 332663 - DNA, 25 bp, Homo sapien
gtgagttttaaatctcaggctagat

SEQ ID NO: 332664 - DNA, 25 bp, Homo sapien
gagagagttgaaatgaggcacagct

SEQ ID NO: 332665 - DNA, 25 bp, Homo sapien
gaggcacagctgaagtttcaccact

SEQ ID NO: 332666 - DNA, 25 bp, Homo sapien
agctgaagtttcaccactccattat

SEQ ID NO: 332667 - DNA, 25 bp, Homo sapien
gaagtttcaccactccattattctg

SEQ ID NO: 332668 - DNA, 25 bp, Homo sapien
gtttcaccactccattattctgcca

SEQ ID NO: 332669 - DNA, 25 bp, Homo sapien
catctctcaaatgctgcagccccat

SEQ ID NO: 332670 - DNA, 25 bp, Homo sapien
aaaatacattcatgggaattgcaca

SEQ ID NO: 332671 - DNA, 25 bp, Homo sapien
gggaattgcacaaagtttacaacac

SEQ ID NO: 332672 - DNA, 25 bp, Homo sapien
gtttacaacacatgcaaattccaag

SEQ ID NO: 332673 - DNA, 25 bp, Homo sapien
gtcgtcgggtgaagtgaaaatacct

SEQ ID NO: 332674 - DNA, 25 bp, Homo sapien
tgaagtgaaaatacctaactctgca

SEQ ID NO: 332675 - DNA, 25 bp, Homo sapien
cagaatcttcttctcctggggtctg

SEQ ID NO: 332676 - DNA, 25 bp, Homo sapien
caaaatgcctaacccaggaccttgg

SEQ ID NO: 332677 - DNA, 25 bp, Homo sapien
ccaggaccttggaaattctactcat

SEQ ID NO: 332678 - DNA, 25 bp, Homo sapien
gaccttggaaattctactcatccca

SEQ ID NO: 332679 - DNA, 25 bp, Homo sapien
tggaaattctactcatcccaaatga

SEQ ID NO: 332680 - DNA, 25 bp, Homo sapien
tactcatcccaaatgataattccaa

SEQ ID NO: 332681 - DNA, 25 bp, Homo sapien
gataattccaaatgctgttacccaa

SEQ ID NO: 332682 - DNA, 25 bp, Homo sapien
taattccaaatgctgttacccaagg

SEQ ID NO: 332683 - DNA, 25 bp, Homo sapien
gctgttacccaaggttagggtgttg

SEQ ID NO: 332684 - DNA, 25 bp, Homo sapien
gggcttcaggtctcaacggcttccc

SEQ ID NO: 332685 - DNA, 25 bp, Homo sapien
ttcaggtctcaacggcttccctaac

SEQ ID NO: 332686 - DNA, 25 bp, Homo sapien
gcccaatgacaccttgaagtcacca

SEQ ID NO: 332687 - DNA, 25 bp, Homo sapien
tgaagtcaccacttttcctttcttg

SEQ ID NO: 332688 - DNA, 25 bp, Homo sapien
tttcttgcccgctaataaaacctat

SEQ ID NO: 332689 - DNA, 25 bp, Homo sapien
tccttggcattttgttgttccgatc

SEQ ID NO: 332690 - DNA, 25 bp, Homo sapien
ggcattttgttgttccgatcacaga

SEQ ID NO: 332691 - DNA, 25 bp, Homo sapien
tgttgttccgatcacagatttccct

SEQ ID NO: 332692 - DNA, 25 bp, Homo sapien
gatcacagatttccctgccagggtg

SEQ ID NO: 332693 - DNA, 25 bp, Homo sapien
agggtgtctgtggttatcagctgca

SEQ ID NO: 332694 - DNA, 25 bp, Homo sapien
tctgtggttatcagctgcaggctca

SEQ ID NO: 332695 - DNA, 25 bp, Homo sapien
ttatcagctgcaggctcagcttggg

SEQ ID NO: 332696 - DNA, 25 bp, Homo sapien
gtgccctaccttagtgacgggagta

SEQ ID NO: 332697 - DNA, 25 bp, Homo sapien
taacaatacaccacataggtccagt

SEQ ID NO: 332698 - DNA, 25 bp, Homo sapien
taggtccagtaataccctgggaatt

SEQ ID NO: 332699 - DNA, 25 bp, Homo sapien
gggaatttcccaatgcaatcaccaa

SEQ ID NO: 332700 - DNA, 25 bp, Homo sapien
ttcccaatgcaatcaccaacttttt

SEQ ID NO: 332701 - DNA, 25 bp, Homo sapien
gtcagcaaaaccagcattatgatgt

SEQ ID NO: 332702 - DNA, 25 bp, Homo sapien
gatgtagcaaacagagtataactct

SEQ ID NO: 332703 - DNA, 25 bp, Homo sapien
gtaaaagccttatcagaccatccat

SEQ ID NO: 332704 - DNA, 25 bp, Homo sapien
gccttatcagaccatccatagtttt

SEQ ID NO: 332705 - DNA, 25 bp, Homo sapien
catagttttacaatgtgatctgctc

SEQ ID NO: 332706 - DNA, 25 bp, Homo sapien
gctcttcctcagaccactaatatag

SEQ ID NO: 332707 - DNA, 25 bp, Homo sapien
gaaaaatacgtcactccttagaata

SEQ ID NO: 332708 - DNA, 25 bp, Homo sapien
ggaagctccagcctgaaccatgttt

SEQ ID NO: 332709 - DNA, 25 bp, Homo sapien
aagctccagcctgaaccatgttttt

SEQ ID NO: 332710 - DNA, 25 bp, Homo sapien
gctccagcctgaaccatgtttttca

SEQ ID NO: 332711 - DNA, 25 bp, Homo sapien
ctccagcctgaaccatgtttttcac

SEQ ID NO: 332712 - DNA, 25 bp, Homo sapien
ccatgtttttcacttgtggcccaaa

SEQ ID NO: 332713 - DNA, 25 bp, Homo sapien
atgtttttcacttgtggcccaaatg

SEQ ID NO: 332714 - DNA, 25 bp, Homo sapien
gtttttcacttgtggcccaaatgag

SEQ ID NO: 332715 - DNA, 25 bp, Homo sapien
tttttcacttgtggcccaaatgagg

SEQ ID NO: 332716 - DNA, 25 bp, Homo sapien
aagccccccagtcatggtggctgga

SEQ ID NO: 332717 - DNA, 25 bp, Homo sapien
tcatggtggctggagggcgtgtctt

SEQ ID NO: 332718 - DNA, 25 bp, Homo sapien
gaaagctggtctgcgagcggcccct

SEQ ID NO: 332719 - DNA, 25 bp, Homo sapien
attcatactgttccccaaccagatt

SEQ ID NO: 332720 - DNA, 25 bp, Homo sapien
catactgttccccaaccagattaag

SEQ ID NO: 332721 - DNA, 25 bp, Homo sapien
atactgttccccaaccagattaaga

SEQ ID NO: 332722 - DNA, 25 bp, Homo sapien
tactgttccccaaccagattaagaa

SEQ ID NO: 332723 - DNA, 25 bp, Homo sapien
ctgttccccaaccagattaagaaat

SEQ ID NO: 332724 - DNA, 25 bp, Homo sapien
tgttccccaaccagattaagaaata

SEQ ID NO: 332725 - DNA, 25 bp, Homo sapien
gttccccaaccagattaagaaatag

SEQ ID NO: 332726 - DNA, 25 bp, Homo sapien
tccccaaccagattaagaaatagat

SEQ ID NO: 332727 - DNA, 25 bp, Homo sapien
gaaatagattttgagccgggctcag

SEQ ID NO: 332728 - DNA, 25 bp, Homo sapien
aaatagattttgagccgggctcagt

SEQ ID NO: 332729 - DNA, 25 bp, Homo sapien
aatagattttgagccgggctcagtg

SEQ ID NO: 332730 - DNA, 25 bp, Homo sapien
atgcctggacaagccatgcaagttg

SEQ ID NO: 332731 - DNA, 25 bp, Homo sapien
aagccatgcaagttgtctccggact

SEQ ID NO: 332732 - DNA, 25 bp, Homo sapien
gctcctagttctgatgcaaaattga

SEQ ID NO: 332733 - DNA, 25 bp, Homo sapien
ttgtctccggacttgaaccacgtat

SEQ ID NO: 332734 - DNA, 25 bp, Homo sapien
aaccacgtatcagaggagctatttg

SEQ ID NO: 332735 - DNA, 25 bp, Homo sapien
gctatttgaggagccacatcagcat

SEQ ID NO: 332736 - DNA, 25 bp, Homo sapien
acatcagcatacctgcttctgtggg

SEQ ID NO: 332737 - DNA, 25 bp, Homo sapien
aagccaaagctttgagcatctcctc

SEQ ID NO: 332738 - DNA, 25 bp, Homo sapien
gctttgagcatctcctcccatgtag

SEQ ID NO: 332739 - DNA, 25 bp, Homo sapien
gaaaagagtgcactgggtcttcaaa

SEQ ID NO: 332740 - DNA, 25 bp, Homo sapien
gcactgggtcttcaaatggcatatt

SEQ ID NO: 332741 - DNA, 25 bp, Homo sapien
aatttgagggattttagggacatct

SEQ ID NO: 332742 - DNA, 25 bp, Homo sapien
ttgagggattttagggacatcttac

SEQ ID NO: 332743 - DNA, 25 bp, Homo sapien
agggattttagggacatcttacatg

SEQ ID NO: 332744 - DNA, 25 bp, Homo sapien
ggacatcttacatgggcctaggcta

SEQ ID NO: 332745 - DNA, 25 bp, Homo sapien
gacatcttacatgggcctaggctaa

SEQ ID NO: 332746 - DNA, 25 bp, Homo sapien
tcttacatgggcctaggctaaaata

SEQ ID NO: 332747 - DNA, 25 bp, Homo sapien
tacatgggcctaggctaaaatagtc

SEQ ID NO: 332748 - DNA, 25 bp, Homo sapien
atgggcctaggctaaaatagtcatt

SEQ ID NO: 332749 - DNA, 25 bp, Homo sapien
gggcctaggctaaaatagtcattgt

SEQ ID NO: 332750 - DNA, 25 bp, Homo sapien
taattactataaaactaccaagaga

SEQ ID NO: 332751 - DNA, 25 bp, Homo sapien
gtaagtaaacatatctatatggcac

SEQ ID NO: 332752 - DNA, 25 bp, Homo sapien
ccagctttggctatgagggccttga

SEQ ID NO: 332753 - DNA, 25 bp, Homo sapien
ctttggctatgagggccttgagtcc

SEQ ID NO: 332754 - DNA, 25 bp, Homo sapien
aggcccaaagcctcgacacagagtg

SEQ ID NO: 332755 - DNA, 25 bp, Homo sapien
gacacagagtggactgttccctgag

SEQ ID NO: 332756 - DNA, 25 bp, Homo sapien
acagagtggactgttccctgaggtg

SEQ ID NO: 332757 - DNA, 25 bp, Homo sapien
agatgtggaaaagccaagaggctgc

SEQ ID NO: 332758 - DNA, 25 bp, Homo sapien
tggagtgtggcagtttggcaaactc

SEQ ID NO: 332759 - DNA, 25 bp, Homo sapien
aaactctccaccacacgtaatgaaa

SEQ ID NO: 332760 - DNA, 25 bp, Homo sapien
ctctccaccacacgtaatgaaactt

SEQ ID NO: 332761 - DNA, 25 bp, Homo sapien
acacgtaatgaaacttggatttgct

SEQ ID NO: 332762 - DNA, 25 bp, Homo sapien
agcaggtccccagctttggctatga

SEQ ID NO: 332763 - DNA, 25 bp, Homo sapien
agaggaccaggctaatgacttgtgt

SEQ ID NO: 332764 - DNA, 25 bp, Homo sapien
acttgtgtgtgctgatgtgtttcca

SEQ ID NO: 332765 - DNA, 25 bp, Homo sapien
atttaatgtgtgtagaccctcctct

SEQ ID NO: 332766 - DNA, 25 bp, Homo sapien
ccctcctctgttcatcaatcaaaaa

SEQ ID NO: 332767 - DNA, 25 bp, Homo sapien
aatcaaaaagcatttcctaggcagc

SEQ ID NO: 332768 - DNA, 25 bp, Homo sapien
gaaacagggacatctccatcattac

SEQ ID NO: 332769 - DNA, 25 bp, Homo sapien
gacatctccatcattactggcttag

SEQ ID NO: 332770 - DNA, 25 bp, Homo sapien
cattactggcttagttttgctttcc

SEQ ID NO: 332771 - DNA, 25 bp, Homo sapien
ttttgctttcctttgacacagtaag

SEQ ID NO: 332772 - DNA, 25 bp, Homo sapien
aaggcaaaggccaagctttcaaaag

SEQ ID NO: 332773 - DNA, 25 bp, Homo sapien
tttcccttcatatggatatgattcc

SEQ ID NO: 332774 - DNA, 25 bp, Homo sapien
tgtgcactttacctgaatcgatcct

SEQ ID NO: 332775 - DNA, 25 bp, Homo sapien
actttacctgaatcgatcctcacat

SEQ ID NO: 332776 - DNA, 25 bp, Homo sapien
tgaatcgatcctcacatcctatgag

SEQ ID NO: 332777 - DNA, 25 bp, Homo sapien
atcgatcctcacatcctatgaggta

SEQ ID NO: 332778 - DNA, 25 bp, Homo sapien
gtttgacaccagtgcccactctctt

SEQ ID NO: 332779 - DNA, 25 bp, Homo sapien
tctcttcaccactaccatttgggag

SEQ ID NO: 332780 - DNA, 25 bp, Homo sapien
ttcaccactaccatttgggagtact

SEQ ID NO: 332781 - DNA, 25 bp, Homo sapien
accactaccatttgggagtactgtc

SEQ ID NO: 332782 - DNA, 25 bp, Homo sapien
agcaacaagtgccaaaatttgaggt

SEQ ID NO: 332783 - DNA, 25 bp, Homo sapien
tgccaaaatttgaggtcttactatg

SEQ ID NO: 332784 - DNA, 25 bp, Homo sapien
ctatgtgcactttacctgaatcgat

SEQ ID NO: 332785 - DNA, 25 bp, Homo sapien
aatgcaggtgttggtgtcatcttac

SEQ ID NO: 332786 - DNA, 25 bp, Homo sapien
ataccctctgtcagtttgttcaaga

SEQ ID NO: 332787 - DNA, 25 bp, Homo sapien
cacatttgccttgctaattgctcat

SEQ ID NO: 332788 - DNA, 25 bp, Homo sapien
ttgctaattgctcatatttggctgc

SEQ ID NO: 332789 - DNA, 25 bp, Homo sapien
atttggctgcattttcctgcagttg

SEQ ID NO: 332790 - DNA, 25 bp, Homo sapien
tagtgcacaagattcaggctcctga

SEQ ID NO: 332791 - DNA, 25 bp, Homo sapien
aggctcctgagggtccttgttgtac

SEQ ID NO: 332792 - DNA, 25 bp, Homo sapien
cttgttgtaccctaagcaccaaaat

SEQ ID NO: 332793 - DNA, 25 bp, Homo sapien
ggactgttttttcctagaatcaaag

SEQ ID NO: 332794 - DNA, 25 bp, Homo sapien
agcaggtgcatacacttgccagtga

SEQ ID NO: 332795 - DNA, 25 bp, Homo sapien
aaagtccatggtttagctaatgcag

SEQ ID NO: 332796 - DNA, 25 bp, Homo sapien
aaagtgtcaaacagcatgatgccgc

SEQ ID NO: 332797 - DNA, 25 bp, Homo sapien
gcatgatgccgccagcctgctgaag

SEQ ID NO: 332798 - DNA, 25 bp, Homo sapien
ttcattcgggagttgccccagccac

SEQ ID NO: 332799 - DNA, 25 bp, Homo sapien
actgctcagtgtggagtatctcaaa

SEQ ID NO: 332800 - DNA, 25 bp, Homo sapien
ggagtatctcaaagcctttcaggct

SEQ ID NO: 332801 - DNA, 25 bp, Homo sapien
aggctgtccagaatcttccaaccaa

SEQ ID NO: 332802 - DNA, 25 bp, Homo sapien
gcagcaactacaggctttgaacctt

SEQ ID NO: 332803 - DNA, 25 bp, Homo sapien
tttgaaccttcttgtcatcctccta

SEQ ID NO: 332804 - DNA, 25 bp, Homo sapien
atcctcctacctgatgcaaacaggg

SEQ ID NO: 332805 - DNA, 25 bp, Homo sapien
agggacacactgaaggcccttcttg

SEQ ID NO: 332806 - DNA, 25 bp, Homo sapien
actgaaggcccttcttgaatttctc

SEQ ID NO: 332807 - DNA, 25 bp, Homo sapien
gttttcccttcaagtcaagcgtctt

SEQ ID NO: 332808 - DNA, 25 bp, Homo sapien
ttttcccttcaagtcaagcgtcttg

SEQ ID NO: 332809 - DNA, 25 bp, Homo sapien
ccttcaagtcaagcgtcttgttgtt

SEQ ID NO: 332810 - DNA, 25 bp, Homo sapien
tgctccattcagctcttaaatcttt

SEQ ID NO: 332811 - DNA, 25 bp, Homo sapien
gctccattcagctcttaaatcttta

SEQ ID NO: 332812 - DNA, 25 bp, Homo sapien
ttcagctcttaaatctttatattcc

SEQ ID NO: 332813 - DNA, 25 bp, Homo sapien
tattccaaggtaagttaattttgct

SEQ ID NO: 332814 - DNA, 25 bp, Homo sapien
taattttgctctcactgttttaaca

SEQ ID NO: 332815 - DNA, 25 bp, Homo sapien
aacataaaaatccttgcataccttg

SEQ ID NO: 332816 - DNA, 25 bp, Homo sapien
aaaatccttgcataccttgttcaat

SEQ ID NO: 332817 - DNA, 25 bp, Homo sapien
gtacgtagctgttacatgtagggca

SEQ ID NO: 332818 - DNA, 25 bp, Homo sapien
gttaatatttgtcagtctgtaaaaa

SEQ ID NO: 332819 - DNA, 25 bp, Homo sapien
tttgtcagtctgtaaaaattagtaa

SEQ ID NO: 332820 - DNA, 25 bp, Homo sapien
gttggaattaattgcatattacata

SEQ ID NO: 332821 - DNA, 25 bp, Homo sapien
gttttcaaagcgctatgttttgctt

SEQ ID NO: 332822 - DNA, 25 bp, Homo sapien
caaagcgctatgttttgcttaaatt

SEQ ID NO: 332823 - DNA, 25 bp, Homo sapien
gcttaaattttcattaatagtgtgg

SEQ ID NO: 332824 - DNA, 25 bp, Homo sapien
atgtaactgtatagtgactctggct

SEQ ID NO: 332825 - DNA, 25 bp, Homo sapien
taactgtatagtgactctggctgag

SEQ ID NO: 332826 - DNA, 25 bp, Homo sapien
aagccttattgttatgaaatgttaa

SEQ ID NO: 332827 - DNA, 25 bp, Homo sapien
aaaatttattgttcatattatgcta

SEQ ID NO: 332828 - DNA, 25 bp, Homo sapien
tgttcatattatgctaatttttcta

SEQ ID NO: 332829 - DNA, 25 bp, Homo sapien
tggtccctctttgcagatgacatgc

SEQ ID NO: 332830 - DNA, 25 bp, Homo sapien
ccctctttgcagatgacatgctttt

SEQ ID NO: 332831 - DNA, 25 bp, Homo sapien
tgcagatgacatgctttttttttag

SEQ ID NO: 332832 - DNA, 25 bp, Homo sapien
tgcagccaccactcctgggttcgag

SEQ ID NO: 332833 - DNA, 25 bp, Homo sapien
tttttactagagatgaggatttccc

SEQ ID NO: 332834 - DNA, 25 bp, Homo sapien
ttttactagagatgaggatttccca

SEQ ID NO: 332835 - DNA, 25 bp, Homo sapien
tttactagagatgaggatttcccat

SEQ ID NO: 332836 - DNA, 25 bp, Homo sapien
ttactagagatgaggatttcccatg

SEQ ID NO: 332837 - DNA, 25 bp, Homo sapien
actagagatgaggatttcccatgtt

SEQ ID NO: 332838 - DNA, 25 bp, Homo sapien
ctagagatgaggatttcccatgttg

SEQ ID NO: 332839 - DNA, 25 bp, Homo sapien
gagatgaggatttcccatgttggcc

SEQ ID NO: 332840 - DNA, 25 bp, Homo sapien
aatattgggagcgagccttcctcac

SEQ ID NO: 332841 - DNA, 25 bp, Homo sapien
cctcactagccatgtccaaataatg

SEQ ID NO: 332842 - DNA, 25 bp, Homo sapien
gccatgtccaaataatgagcgtatt

SEQ ID NO: 332843 - DNA, 25 bp, Homo sapien
gagcgtattttcatgtggtcttcac

SEQ ID NO: 332844 - DNA, 25 bp, Homo sapien
gtattttcatgtggtcttcactgca

SEQ ID NO: 332845 - DNA, 25 bp, Homo sapien
tttcatgttcctttgaggtacagtc

SEQ ID NO: 332846 - DNA, 25 bp, Homo sapien
gttcctttgaggtacagtcagatga

SEQ ID NO: 332847 - DNA, 25 bp, Homo sapien
tgctgagttctgagagagttccaat

SEQ ID NO: 332848 - DNA, 25 bp, Homo sapien
aggagctgcctttcagctttggaaa

SEQ ID NO: 332849 - DNA, 25 bp, Homo sapien
acattattgtaatctgacacaggca

SEQ ID NO: 332850 - DNA, 25 bp, Homo sapien
cacaggcaaaattatggttcccaca

SEQ ID NO: 332851 - DNA, 25 bp, Homo sapien
ggacaagtttggctttccccatctg

SEQ ID NO: 332852 - DNA, 25 bp, Homo sapien
acaagtttggctttccccatctgta

SEQ ID NO: 332853 - DNA, 25 bp, Homo sapien
gtagataaggatggacccacctccc

SEQ ID NO: 332854 - DNA, 25 bp, Homo sapien
caagatcctgcctatctgtgagagt

SEQ ID NO: 332855 - DNA, 25 bp, Homo sapien
atcctgcctatctgtgagagtccat

SEQ ID NO: 332856 - DNA, 25 bp, Homo sapien
gcctatctgtgagagtccatgacta

SEQ ID NO: 332857 - DNA, 25 bp, Homo sapien
gagagtccatgactaagtgggccat

SEQ ID NO: 332858 - DNA, 25 bp, Homo sapien
tccatgactaagtgggccatgggct

SEQ ID NO: 332859 - DNA, 25 bp, Homo sapien
aagtatgggagcagttccatcctca

SEQ ID NO: 332860 - DNA, 25 bp, Homo sapien
tgggagcagttccatcctcaaggtt

SEQ ID NO: 332861 - DNA, 25 bp, Homo sapien
tggttcccaggacagaaatttgagt

SEQ ID NO: 332862 - DNA, 25 bp, Homo sapien
tctctgaccctgtggcccattcagg

SEQ ID NO: 332863 - DNA, 25 bp, Homo sapien
aagagcccctgagcttttaacgtga

SEQ ID NO: 332864 - DNA, 25 bp, Homo sapien
gagcttttaacgtgagggtctttat

SEQ ID NO: 332865 - DNA, 25 bp, Homo sapien
gtctttattggataggactactccc

SEQ ID NO: 332866 - DNA, 25 bp, Homo sapien
tactccctatttcttgcctagagaa

SEQ ID NO: 332867 - DNA, 25 bp, Homo sapien
gagaacacacatgggctttggagcc

SEQ ID NO: 332868 - DNA, 25 bp, Homo sapien
tttggagcccgacagacctgggctt

SEQ ID NO: 332869 - DNA, 25 bp, Homo sapien
agacctgggcttgaatcccggctcg

SEQ ID NO: 332870 - DNA, 25 bp, Homo sapien
ttgaatcccggctcgtgttcttgct

SEQ ID NO: 332871 - DNA, 25 bp, Homo sapien
agaaacttcacctctgctgagccct

SEQ ID NO: 332872 - DNA, 25 bp, Homo sapien
aatgggacaacgcaacctacctcac

SEQ ID NO: 332873 - DNA, 25 bp, Homo sapien
gagctaaagccgatgctgaagaaaa

SEQ ID NO: 332874 - DNA, 25 bp, Homo sapien
aaaggtgactggtctcatgagccct

SEQ ID NO: 332875 - DNA, 25 bp, Homo sapien
ctggtctcatgagccctgaagaatg

SEQ ID NO: 332876 - DNA, 25 bp, Homo sapien
aggttgtttacatgaggttctccca

SEQ ID NO: 332877 - DNA, 25 bp, Homo sapien
gtttacatgaggttctcccactcac

SEQ ID NO: 332878 - DNA, 25 bp, Homo sapien
ccactcaccagctgttgagagtctg

SEQ ID NO: 332879 - DNA, 25 bp, Homo sapien
agctgttgagagtctgcgattatga

SEQ ID NO: 332880 - DNA, 25 bp, Homo sapien
gagcaggatcttattacttcaatga

SEQ ID NO: 332881 - DNA, 25 bp, Homo sapien
ttctcaaaccaccaacagccaagtg

SEQ ID NO: 332882 - DNA, 25 bp, Homo sapien
gatttggtacagtgcggctgtctaa

SEQ ID NO: 332883 - DNA, 25 bp, Homo sapien
agtgcggctgtctaataaataatca

SEQ ID NO: 332884 - DNA, 25 bp, Homo sapien
ggacccactgggtgaagcacagcca

SEQ ID NO: 332885 - DNA, 25 bp, Homo sapien
gggtgaagcacagccacagatctga

SEQ ID NO: 332886 - DNA, 25 bp, Homo sapien
acagccacagatctgagccaggatg

SEQ ID NO: 332887 - DNA, 25 bp, Homo sapien
tgcctttccactgccgggagtgctg

SEQ ID NO: 332888 - DNA, 25 bp, Homo sapien
acagccaagtgtcgtccacatactc

SEQ ID NO: 332889 - DNA, 25 bp, Homo sapien
tcccagagtgagctctaaccaggct

SEQ ID NO: 332890 - DNA, 25 bp, Homo sapien
gagtgagctctaaccaggctcattt

SEQ ID NO: 332891 - DNA, 25 bp, Homo sapien
aggctcatttgctctctccactact

SEQ ID NO: 332892 - DNA, 25 bp, Homo sapien
tctccactactcatctctggaatta

SEQ ID NO: 332893 - DNA, 25 bp, Homo sapien
tcatctctggaattagccgcttaaa

SEQ ID NO: 332894 - DNA, 25 bp, Homo sapien
tagccgcttaaatacaggtttttgt

SEQ ID NO: 332895 - DNA, 25 bp, Homo sapien
ctccggtgcagaggtcctgtgacac

SEQ ID NO: 332896 - DNA, 25 bp, Homo sapien
gtgcagaggtcctgtgacaccagtg

SEQ ID NO: 332897 - DNA, 25 bp, Homo sapien
tgcagaggtcctgtgacaccagtgg

SEQ ID NO: 332898 - DNA, 25 bp, Homo sapien
gcagaggtcctgtgacaccagtggc

SEQ ID NO: 332899 - DNA, 25 bp, Homo sapien
cagaggtcctgtgacaccagtggca

SEQ ID NO: 332900 - DNA, 25 bp, Homo sapien
aagggcacaggcagcgtggtcttcc

SEQ ID NO: 332901 - DNA, 25 bp, Homo sapien
agggcacaggcagcgtggtcttccc

SEQ ID NO: 332902 - DNA, 25 bp, Homo sapien
ggcacaggcagcgtggtcttccccg

SEQ ID NO: 332903 - DNA, 25 bp, Homo sapien
ccccaacaggcacgaagcatcaatg

SEQ ID NO: 332904 - DNA, 25 bp, Homo sapien
aggcacgaagcatcaatgttcacaa

SEQ ID NO: 332905 - DNA, 25 bp, Homo sapien
acgaagcatcaatgttcacaagcag

SEQ ID NO: 332906 - DNA, 25 bp, Homo sapien
aaaggtgatgtaaatgaatgctgca

SEQ ID NO: 332907 - DNA, 25 bp, Homo sapien
aatgctgcacaaacggtgttcatga

SEQ ID NO: 332908 - DNA, 25 bp, Homo sapien
gcacaaacggtgttcatgatacttt

SEQ ID NO: 332909 - DNA, 25 bp, Homo sapien
acggtgttcatgatacttttagtag

SEQ ID NO: 332910 - DNA, 25 bp, Homo sapien
gaaaaactacacattctcagaagct

SEQ ID NO: 332911 - DNA, 25 bp, Homo sapien
attctcagaagctcttgatgtctct

SEQ ID NO: 332912 - DNA, 25 bp, Homo sapien
gaagctcttgatgtctctaatgaag

SEQ ID NO: 332913 - DNA, 25 bp, Homo sapien
ataattacaagaacagcctgtggat

SEQ ID NO: 332914 - DNA, 25 bp, Homo sapien
cagcctgtggatatgatcacttaaa

SEQ ID NO: 332915 - DNA, 25 bp, Homo sapien
atgattttgtggtgattcgtgccat

SEQ ID NO: 332916 - DNA, 25 bp, Homo sapien
gtgattcgtgccattgcttttttat

SEQ ID NO: 332917 - DNA, 25 bp, Homo sapien
gttttcccttcaagtcaagcgtctt

SEQ ID NO: 332918 - DNA, 25 bp, Homo sapien
ttttcccttcaagtcaagcgtcttg

SEQ ID NO: 332919 - DNA, 25 bp, Homo sapien
aacataaaaatccttgcataccttg

SEQ ID NO: 332920 - DNA, 25 bp, Homo sapien
acataaaaatccttgcataccttgt

SEQ ID NO: 332921 - DNA, 25 bp, Homo sapien
cataaaaatccttgcataccttgtt

SEQ ID NO: 332922 - DNA, 25 bp, Homo sapien
ataaaaatccttgcataccttgttc

SEQ ID NO: 332923 - DNA, 25 bp, Homo sapien
taaaaatccttgcataccttgttca

SEQ ID NO: 332924 - DNA, 25 bp, Homo sapien
aaaaatccttgcataccttgttcaa

SEQ ID NO: 332925 - DNA, 25 bp, Homo sapien
aaaatccttgcataccttgttcaat

SEQ ID NO: 332926 - DNA, 25 bp, Homo sapien
ttttggtttgtttctactgacctga

SEQ ID NO: 332927 - DNA, 25 bp, Homo sapien
actgacctgaatgtgttggatctac

SEQ ID NO: 332928 - DNA, 25 bp, Homo sapien
gttggatctacacgtgttgttttgt

SEQ ID NO: 332929 - DNA, 25 bp, Homo sapien
gtttttgctttattgatgcacggat

SEQ ID NO: 332930 - DNA, 25 bp, Homo sapien
tattgatgcacggatgcttttgaac

SEQ ID NO: 332931 - DNA, 25 bp, Homo sapien
gcttttgaacagtagagcgaaatgc

SEQ ID NO: 332932 - DNA, 25 bp, Homo sapien
gcgaaatgctagacatggagaatct

SEQ ID NO: 332933 - DNA, 25 bp, Homo sapien
agaatctgctctgtttgtcctttat

SEQ ID NO: 332934 - DNA, 25 bp, Homo sapien
gctctgtttgtcctttatacatttc

SEQ ID NO: 332935 - DNA, 25 bp, Homo sapien
gtaatgtgccttggagcttagtaac

SEQ ID NO: 332936 - DNA, 25 bp, Homo sapien
gtgccttggagcttagtaacttgta

SEQ ID NO: 332937 - DNA, 25 bp, Homo sapien
ggatcccagcagtgcaaacagactt

SEQ ID NO: 332938 - DNA, 25 bp, Homo sapien
agtgcaaacagacttcggagtacct

SEQ ID NO: 332939 - DNA, 25 bp, Homo sapien
ggagtacctgcgctatgaagacacg

SEQ ID NO: 332940 - DNA, 25 bp, Homo sapien
tgaagacacgcttcttctggaagac

SEQ ID NO: 332941 - DNA, 25 bp, Homo sapien
gagatggtgatcatgagacctggaa

SEQ ID NO: 332942 - DNA, 25 bp, Homo sapien
gtacaagttcggctttgagcttcct

SEQ ID NO: 332943 - DNA, 25 bp, Homo sapien
gtagactactgggtgaaggcttttc

SEQ ID NO: 332944 - DNA, 25 bp, Homo sapien
tgaaggcttttcttgaccgcccgag

SEQ ID NO: 332945 - DNA, 25 bp, Homo sapien
gagccagccaactcaagagacaaag

SEQ ID NO: 332946 - DNA, 25 bp, Homo sapien
ggatctggtggatgtcaatacccct

SEQ ID NO: 332947 - DNA, 25 bp, Homo sapien
tgtcaatacccctgatttaatggca

SEQ ID NO: 332948 - DNA, 25 bp, Homo sapien
ataagtgcaaagtcagagagcgctg

SEQ ID NO: 332949 - DNA, 25 bp, Homo sapien
gagagcgctgctctcatgcactgag

SEQ ID NO: 332950 - DNA, 25 bp, Homo sapien
atgcactgagcctgagcactcttct

SEQ ID NO: 332951 - DNA, 25 bp, Homo sapien
ggagaatcctgggttgggtgccctt

SEQ ID NO: 332952 - DNA, 25 bp, Homo sapien
tgcccttcgccttctggcggcagaa

SEQ ID NO: 332953 - DNA, 25 bp, Homo sapien
agagccaggctctaagcacctgcac

SEQ ID NO: 332954 - DNA, 25 bp, Homo sapien
ctgcgctggagaatagaagggctaa

SEQ ID NO: 332955 - DNA, 25 bp, Homo sapien
aaaccactgaagtccaatttctggg

SEQ ID NO: 332956 - DNA, 25 bp, Homo sapien
agtccaatttctgggagctcagcca

SEQ ID NO: 332957 - DNA, 25 bp, Homo sapien
agctcagccagggaatgtgtatttt

SEQ ID NO: 332958 - DNA, 25 bp, Homo sapien
cccctaggttactctgataagtgca

SEQ ID NO: 332959 - DNA, 25 bp, Homo sapien
cccctccggtgcagaggtcctgtga

SEQ ID NO: 332960 - DNA, 25 bp, Homo sapien
cctccggtgcagaggtcctgtgaca

SEQ ID NO: 332961 - DNA, 25 bp, Homo sapien
ctccggtgcagaggtcctgtgacac

SEQ ID NO: 332962 - DNA, 25 bp, Homo sapien
tccggtgcagaggtcctgtgacacc

SEQ ID NO: 332963 - DNA, 25 bp, Homo sapien
ccggtgcagaggtcctgtgacacca

SEQ ID NO: 332964 - DNA, 25 bp, Homo sapien
cggtgcagaggtcctgtgacaccag

SEQ ID NO: 332965 - DNA, 25 bp, Homo sapien
ggtgcagaggtcctgtgacaccagt

SEQ ID NO: 332966 - DNA, 25 bp, Homo sapien
gtgcagaggtcctgtgacaccagtg

SEQ ID NO: 332967 - DNA, 25 bp, Homo sapien
tgcagaggtcctgtgacaccagtgg

SEQ ID NO: 332968 - DNA, 25 bp, Homo sapien
gcagaggtcctgtgacaccagtggc

SEQ ID NO: 332969 - DNA, 25 bp, Homo sapien
cagaggtcctgtgacaccagtggca

SEQ ID NO: 332970 - DNA, 25 bp, Homo sapien
gaattggctaatgttttgatcctcc

SEQ ID NO: 332971 - DNA, 25 bp, Homo sapien
ggctaatgttttgatcctccagtgt

SEQ ID NO: 332972 - DNA, 25 bp, Homo sapien
taatgttttgatcctccagtgtgac

SEQ ID NO: 332973 - DNA, 25 bp, Homo sapien
tgttttgatcctccagtgtgactgt

SEQ ID NO: 332974 - DNA, 25 bp, Homo sapien
gatcctccagtgtgactgttgtttt

SEQ ID NO: 332975 - DNA, 25 bp, Homo sapien
accagatatgaatggctaatactcc

SEQ ID NO: 332976 - DNA, 25 bp, Homo sapien
tgaatggctaatactccattgttct

SEQ ID NO: 332977 - DNA, 25 bp, Homo sapien
actccattgttctgcttgttgtaat

SEQ ID NO: 332978 - DNA, 25 bp, Homo sapien
tcatgatctgtttatgcgataactc

SEQ ID NO: 332979 - DNA, 25 bp, Homo sapien
tgatctgtttatgcgataactcctt

SEQ ID NO: 332980 - DNA, 25 bp, Homo sapien
tgtttatgcgataactcctttttgt

SEQ ID NO: 332981 - DNA, 25 bp, Homo sapien
cagatgactctggttttgtttggtt

SEQ ID NO: 332982 - DNA, 25 bp, Homo sapien
tttgtttggtttgccgccaggagtg

SEQ ID NO: 332983 - DNA, 25 bp, Homo sapien
gtttgccgccaggagtgactgtgtt

SEQ ID NO: 332984 - DNA, 25 bp, Homo sapien
tttgccgccaggagtgactgtgttg

SEQ ID NO: 332985 - DNA, 25 bp, Homo sapien
ttgccgccaggagtgactgtgttgt

SEQ ID NO: 332986 - DNA, 25 bp, Homo sapien
gttgttctttgctttatatacataa

SEQ ID NO: 332987 - DNA, 25 bp, Homo sapien
ttgttctttgctttatatacataag

SEQ ID NO: 332988 - DNA, 25 bp, Homo sapien
tatacataagcgcatctcttaccgc

SEQ ID NO: 332989 - DNA, 25 bp, Homo sapien
atacataagcgcatctcttaccgcc

SEQ ID NO: 332990 - DNA, 25 bp, Homo sapien
tacataagcgcatctcttaccgcca

SEQ ID NO: 332991 - DNA, 25 bp, Homo sapien
acataagcgcatctcttaccgccat

SEQ ID NO: 332992 - DNA, 25 bp, Homo sapien
accacaaatgcatttggtttttggg

SEQ ID NO: 332993 - DNA, 25 bp, Homo sapien
gtattcattaatgcagcgtttgtga

SEQ ID NO: 332994 - DNA, 25 bp, Homo sapien
gattggaagctgtttaaatgacacc

SEQ ID NO: 332995 - DNA, 25 bp, Homo sapien
aaatgacaccatatcagggttctgg

SEQ ID NO: 332996 - DNA, 25 bp, Homo sapien
catatcagggttctggttccctaaa

SEQ ID NO: 332997 - DNA, 25 bp, Homo sapien
tctggttccctaaattgtggtatat

SEQ ID NO: 332998 - DNA, 25 bp, Homo sapien
ggtatattcatacagcctactcctg

SEQ ID NO: 332999 - DNA, 25 bp, Homo sapien
atacagcctactcctgggtagacaa

SEQ ID NO: 333000 - DNA, 25 bp, Homo sapien
tactcctgggtagacaacaatgaat

SEQ ID NO: 333001 - DNA, 25 bp, Homo sapien
tatgtagtgatgtgggataaccttc

SEQ ID NO: 333002 - DNA, 25 bp, Homo sapien
tgtgggataaccttcagtttatgtt

SEQ ID NO: 333003 - DNA, 25 bp, Homo sapien
gggtgtttctcaggatttcagagtc

SEQ ID NO: 333004 - DNA, 25 bp, Homo sapien
aggatttcagagtcatcagctgctt

SEQ ID NO: 333005 - DNA, 25 bp, Homo sapien
agctgctttgaaggtgtgcttcctt

SEQ ID NO: 333006 - DNA, 25 bp, Homo sapien
gtgcttccttcacctgtgttttaac

SEQ ID NO: 333007 - DNA, 25 bp, Homo sapien
gtctcccttgggtacagtgccctgt

SEQ ID NO: 333008 - DNA, 25 bp, Homo sapien
accttgggtgctctagttccaggtt

SEQ ID NO: 333009 - DNA, 25 bp, Homo sapien
tctagttccaggtttgcctcgcttc

SEQ ID NO: 333010 - DNA, 25 bp, Homo sapien
ttaaattgacgggtcccatcctctg

SEQ ID NO: 333011 - DNA, 25 bp, Homo sapien
ccagttctagactttatttcaagaa

SEQ ID NO: 333012 - DNA, 25 bp, Homo sapien
gaatcaccagtgcaactatatatac

SEQ ID NO: 333013 - DNA, 25 bp, Homo sapien
atatatacatcttcaggttgctgtt

SEQ ID NO: 333014 - DNA, 25 bp, Homo sapien
tggttaattgttgctgcttcaaaaa

SEQ ID NO: 333015 - DNA, 25 bp, Homo sapien
tgttgctgcttcaaaaataagtata

SEQ ID NO: 333016 - DNA, 25 bp, Homo sapien
attaatatgtaaggaagcccattct

SEQ ID NO: 333017 - DNA, 25 bp, Homo sapien
aaaatttcttgatcattgaatgtga

SEQ ID NO: 333018 - DNA, 25 bp, Homo sapien
gatcattgaatgtgagacccttcta

SEQ ID NO: 333019 - DNA, 25 bp, Homo sapien
gaatgtgagacccttctaacatgat

SEQ ID NO: 333020 - DNA, 25 bp, Homo sapien
tctaacatgatttgagaagctgtac

SEQ ID NO: 333021 - DNA, 25 bp, Homo sapien
gaagctgtacaagtataggcagagt

SEQ ID NO: 333022 - DNA, 25 bp, Homo sapien
aattggtaggtgtctaattactgtt

SEQ ID NO: 333023 - DNA, 25 bp, Homo sapien
aattactgtttacttcattgttata

SEQ ID NO: 333024 - DNA, 25 bp, Homo sapien
gtttacttcattgttatattgcagt

SEQ ID NO: 333025 - DNA, 25 bp, Homo sapien
caagtatttgttggaaggtgccaca

SEQ ID NO: 333026 - DNA, 25 bp, Homo sapien
ggaaggtgccacattatttaacaaa

SEQ ID NO: 333027 - DNA, 25 bp, Homo sapien
gaggaacatcattattctgcagctt

SEQ ID NO: 333028 - DNA, 25 bp, Homo sapien
tctgcagctttccagattggtggac

SEQ ID NO: 333029 - DNA, 25 bp, Homo sapien
gattggtggacattggatgcactat

SEQ ID NO: 333030 - DNA, 25 bp, Homo sapien
ggatgcactatgatgggctcagaaa

SEQ ID NO: 333031 - DNA, 25 bp, Homo sapien
gtggcttaagagaattttcccaacg

SEQ ID NO: 333032 - DNA, 25 bp, Homo sapien
ttttcccaacgaattttctgccatg

SEQ ID NO: 333033 - DNA, 25 bp, Homo sapien
gaagatctggcgtatgtaccctatt

SEQ ID NO: 333034 - DNA, 25 bp, Homo sapien
ggcgtatgtaccctattacttggat

SEQ ID NO: 333035 - DNA, 25 bp, Homo sapien
tattacttggatttgtctgatcaca

SEQ ID NO: 333036 - DNA, 25 bp, Homo sapien
gacattccaggagctagcaatttta

SEQ ID NO: 333037 - DNA, 25 bp, Homo sapien
gctagcaattttaagaggtgtccct

SEQ ID NO: 333038 - DNA, 25 bp, Homo sapien
agaggtgtccctccaaagtgacctg

SEQ ID NO: 333039 - DNA, 25 bp, Homo sapien
ctgatggaagtcctgaacttggaaa

SEQ ID NO: 333040 - DNA, 25 bp, Homo sapien
ttaggttctactcacttggacatcc

SEQ ID NO: 333041 - DNA, 25 bp, Homo sapien
tggacatccctgcatcatggactgt

SEQ ID NO: 333042 - DNA, 25 bp, Homo sapien
actgttgctgctccctgttccatat

SEQ ID NO: 333043 - DNA, 25 bp, Homo sapien
tgttccatatgctcgcaatctcagc

SEQ ID NO: 333044 - DNA, 25 bp, Homo sapien
atctcagctatttggaagctaccag

SEQ ID NO: 333045 - DNA, 25 bp, Homo sapien
gctaccaggaatgctttctaattat

SEQ ID NO: 333046 - DNA, 25 bp, Homo sapien
gccattttatataacaggtcctgtt

SEQ ID NO: 333047 - DNA, 25 bp, Homo sapien
ctgtggaaggatgtgtggcctcaaa

SEQ ID NO: 333048 - DNA, 25 bp, Homo sapien
tcaaatgaggacagggctcccgcct

SEQ ID NO: 333049 - DNA, 25 bp, Homo sapien
aatcctggcctgcatcagggcagga

SEQ ID NO: 333050 - DNA, 25 bp, Homo sapien
tacgtctctgtaccgagcctctggg

SEQ ID NO: 333051 - DNA, 25 bp, Homo sapien
gggccagatataagagtgcctctct

SEQ ID NO: 333052 - DNA, 25 bp, Homo sapien
agatataagagtgcctctctgagtc

SEQ ID NO: 333053 - DNA, 25 bp, Homo sapien
tccatgaaatgagagctgactgcct

SEQ ID NO: 333054 - DNA, 25 bp, Homo sapien
tgactgcctagctcccagggctttg

SEQ ID NO: 333055 - DNA, 25 bp, Homo sapien
ggctttgtgcagacggcctgagctc

SEQ ID NO: 333056 - DNA, 25 bp, Homo sapien
gcagacggcctgagctcatgtaata

SEQ ID NO: 333057 - DNA, 25 bp, Homo sapien
gacggcctgagctcatgtaataaag

SEQ ID NO: 333058 - DNA, 25 bp, Homo sapien
cccctttctccattagtggcatgct

SEQ ID NO: 333059 - DNA, 25 bp, Homo sapien
cctttctccattagtggcatgctca

SEQ ID NO: 333060 - DNA, 25 bp, Homo sapien
tttctccattagtggcatgctcatt

SEQ ID NO: 333061 - DNA, 25 bp, Homo sapien
ttctccattagtggcatgctcattc

SEQ ID NO: 333062 - DNA, 25 bp, Homo sapien
attccagtaagttattttgctctca

SEQ ID NO: 333063 - DNA, 25 bp, Homo sapien
aacataaaaatccttgcataccttg

SEQ ID NO: 333064 - DNA, 25 bp, Homo sapien
aaaatccttgcataccttgttcaat

SEQ ID NO: 333065 - DNA, 25 bp, Homo sapien
gtacgtagctgttacatgtagggca

SEQ ID NO: 333066 - DNA, 25 bp, Homo sapien
gttttcccttcaagtcaagcgtctt

SEQ ID NO: 333067 - DNA, 25 bp, Homo sapien
ttttcccttcaagtcaagcgtcttg

SEQ ID NO: 333068 - DNA, 25 bp, Homo sapien
ccttcaagtcaagcgtcttgttgtt

SEQ ID NO: 333069 - DNA, 25 bp, Homo sapien
taagcagatttggtgatgtcatcaa

SEQ ID NO: 333070 - DNA, 25 bp, Homo sapien
ggtgatgtcatcaatatctatgata

SEQ ID NO: 333071 - DNA, 25 bp, Homo sapien
tatcgattggtaaaaggtctttctt

SEQ ID NO: 333072 - DNA, 25 bp, Homo sapien
ttctttgttgaggatttgagctctc

SEQ ID NO: 333073 - DNA, 25 bp, Homo sapien
gaggatttgagctctctttttaaga

SEQ ID NO: 333074 - DNA, 25 bp, Homo sapien
ttgaataacaattctctgggcatgt

SEQ ID NO: 333075 - DNA, 25 bp, Homo sapien
aattctctgggcatgtttaactaac

SEQ ID NO: 333076 - DNA, 25 bp, Homo sapien
gcatgtttaactaacctaggtggga

SEQ ID NO: 333077 - DNA, 25 bp, Homo sapien
accatggtgctgtttaattgtaaat

SEQ ID NO: 333078 - DNA, 25 bp, Homo sapien
agattggaccagtacttgatgtgta

SEQ ID NO: 333079 - DNA, 25 bp, Homo sapien
agtatgtagggtttatgtgcttttt

SEQ ID NO: 333080 - DNA, 25 bp, Homo sapien
gagcccctgctagttgactggaatt

SEQ ID NO: 333081 - DNA, 25 bp, Homo sapien
ggaagtccatagaggtttctgcaac

SEQ ID NO: 333082 - DNA, 25 bp, Homo sapien
gtcagttcctagaatgcctgtccat

SEQ ID NO: 333083 - DNA, 25 bp, Homo sapien
tgtccattctttgcactgtatgtag

SEQ ID NO: 333084 - DNA, 25 bp, Homo sapien
tgtatgtagttccagtgcgtagtga

SEQ ID NO: 333085 - DNA, 25 bp, Homo sapien
gtgcgtagtgaagtgtctgacatgt

SEQ ID NO: 333086 - DNA, 25 bp, Homo sapien
ggtttctgcaacataaggcccatga

SEQ ID NO: 333087 - DNA, 25 bp, Homo sapien
atgtgttatgttctttgttctccca

SEQ ID NO: 333088 - DNA, 25 bp, Homo sapien
ctttgttctcccatttttaatgagg

SEQ ID NO: 333089 - DNA, 25 bp, Homo sapien
cagtgacttgatttactgtctggct

SEQ ID NO: 333090 - DNA, 25 bp, Homo sapien
actgtctggcttaacagcaagtctt

SEQ ID NO: 333091 - DNA, 25 bp, Homo sapien
aacataaaaatccttgcataccttg

SEQ ID NO: 333092 - DNA, 25 bp, Homo sapien
acataaaaatccttgcataccttgt

SEQ ID NO: 333093 - DNA, 25 bp, Homo sapien
cataaaaatccttgcataccttgtt

SEQ ID NO: 333094 - DNA, 25 bp, Homo sapien
ataaaaatccttgcataccttgttc

SEQ ID NO: 333095 - DNA, 25 bp, Homo sapien
taaaaatccttgcataccttgttca

SEQ ID NO: 333096 - DNA, 25 bp, Homo sapien
aaaaatccttgcataccttgttcaa

SEQ ID NO: 333097 - DNA, 25 bp, Homo sapien
aaaatccttgcataccttgttcaat

SEQ ID NO: 333098 - DNA, 25 bp, Homo sapien
gttttcccttcaagtcaagcgtctt

SEQ ID NO: 333099 - DNA, 25 bp, Homo sapien
ttttcccttcaagtcaagcgtcttg

SEQ ID NO: 333100 - DNA, 25 bp, Homo sapien
agagaccagtgcagggctgttaaca

SEQ ID NO: 333101 - DNA, 25 bp, Homo sapien
tagactaggactccagtgccctcct

SEQ ID NO: 333102 - DNA, 25 bp, Homo sapien
tcctctcccaagagacaaaggccat

SEQ ID NO: 333103 - DNA, 25 bp, Homo sapien
gattagattctgaacatatgtaatt

SEQ ID NO: 333104 - DNA, 25 bp, Homo sapien
caatttaatgtcctagtgttttact

SEQ ID NO: 333105 - DNA, 25 bp, Homo sapien
aatgtcctagtgttttacttaatag

SEQ ID NO: 333106 - DNA, 25 bp, Homo sapien
gtcctagtgttttacttaatagtgt

SEQ ID NO: 333107 - DNA, 25 bp, Homo sapien
tacttaatagtgtatcatgttttcc

SEQ ID NO: 333108 - DNA, 25 bp, Homo sapien
tagtgtatcatgttttccctgttgg

SEQ ID NO: 333109 - DNA, 25 bp, Homo sapien
ccctgttggtatgtagcctggataa

SEQ ID NO: 333110 - DNA, 25 bp, Homo sapien
gtagcctggataaatgctcttaatt

SEQ ID NO: 333111 - DNA, 25 bp, Homo sapien
ctgcattgcctaagattgccccctg

SEQ ID NO: 333112 - DNA, 25 bp, Homo sapien
agtcagcaccactcacgttatctgt

SEQ ID NO: 333113 - DNA, 25 bp, Homo sapien
tcacgttatctgtctcatcatccat

SEQ ID NO: 333114 - DNA, 25 bp, Homo sapien
gttatctgtctcatcatccatgtgc

SEQ ID NO: 333115 - DNA, 25 bp, Homo sapien
gtctcatcatccatgtgccgtgtgt

SEQ ID NO: 333116 - DNA, 25 bp, Homo sapien
gacactgctaggctggctaccgcaa

SEQ ID NO: 333117 - DNA, 25 bp, Homo sapien
ggctggctaccgcaatgaccaagaa

SEQ ID NO: 333118 - DNA, 25 bp, Homo sapien
ctggctaccgcaatgaccaagaagt

SEQ ID NO: 333119 - DNA, 25 bp, Homo sapien
tgccaggaatgctgtctccacctct

SEQ ID NO: 333120 - DNA, 25 bp, Homo sapien
cttagccatccttcaaggccagctt

SEQ ID NO: 333121 - DNA, 25 bp, Homo sapien
agccatccttcaaggccagcttcaa

SEQ ID NO: 333122 - DNA, 25 bp, Homo sapien
gaattggctaatgttttgatcctcc

SEQ ID NO: 333123 - DNA, 25 bp, Homo sapien
attggctaatgttttgatcctccag

SEQ ID NO: 333124 - DNA, 25 bp, Homo sapien
ggctaatgttttgatcctccagtgt

SEQ ID NO: 333125 - DNA, 25 bp, Homo sapien
gctaatgttttgatcctccagtgtg

SEQ ID NO: 333126 - DNA, 25 bp, Homo sapien
taatgttttgatcctccagtgtgac

SEQ ID NO: 333127 - DNA, 25 bp, Homo sapien
accagatatgaatggctaatactcc

SEQ ID NO: 333128 - DNA, 25 bp, Homo sapien
tgaatggctaatactccattgttct

SEQ ID NO: 333129 - DNA, 25 bp, Homo sapien
tcatgatctgtttatgcgataactc

SEQ ID NO: 333130 - DNA, 25 bp, Homo sapien
tgatctgtttatgcgataactcctt

SEQ ID NO: 333131 - DNA, 25 bp, Homo sapien
atctgtttatgcgataactcctttt

SEQ ID NO: 333132 - DNA, 25 bp, Homo sapien
tgtttatgcgataactcctttttgt

SEQ ID NO: 333133 - DNA, 25 bp, Homo sapien
ctaactctgcattctgtgaaaggga

SEQ ID NO: 333134 - DNA, 25 bp, Homo sapien
gagagagttgaaatgaggcacagct

SEQ ID NO: 333135 - DNA, 25 bp, Homo sapien
gaggcacagctgaagtttcaccact

SEQ ID NO: 333136 - DNA, 25 bp, Homo sapien
tgaagtttcaccactccattattct

SEQ ID NO: 333137 - DNA, 25 bp, Homo sapien
gtttcaccactccattattctgcca

SEQ ID NO: 333138 - DNA, 25 bp, Homo sapien
agctcccatctctcaaatgctgcag

SEQ ID NO: 333139 - DNA, 25 bp, Homo sapien
aaaatacattcatgggaattgcaca

SEQ ID NO: 333140 - DNA, 25 bp, Homo sapien
gggaattgcacaaagtttacaacac

SEQ ID NO: 333141 - DNA, 25 bp, Homo sapien
gtttacaacacatgcaaattccaag

SEQ ID NO: 333142 - DNA, 25 bp, Homo sapien
gtgatcatcgatctctcagggtcgt

SEQ ID NO: 333143 - DNA, 25 bp, Homo sapien
gtgaagtgaaaatacctaactctgc

SEQ ID NO: 333144 - DNA, 25 bp, Homo sapien
ggacaggattcatacgccatctttt

SEQ ID NO: 333145 - DNA, 25 bp, Homo sapien
ttcatacgccatcttttctgtgtct

SEQ ID NO: 333146 - DNA, 25 bp, Homo sapien
atccttcccagatattagaggccaa

SEQ ID NO: 333147 - DNA, 25 bp, Homo sapien
aagacttgcattttttctcagtctg

SEQ ID NO: 333148 - DNA, 25 bp, Homo sapien
ttctcagtctgaaggtctcctgcta

SEQ ID NO: 333149 - DNA, 25 bp, Homo sapien
aggtctcctgctaactaagctgagc

SEQ ID NO: 333150 - DNA, 25 bp, Homo sapien
gggaatcagatgtacccatccattt

SEQ ID NO: 333151 - DNA, 25 bp, Homo sapien
tcttgggtctgtttgctattttgca

SEQ ID NO: 333152 - DNA, 25 bp, Homo sapien
attttgcatggtgggatctctggcc

SEQ ID NO: 333153 - DNA, 25 bp, Homo sapien
tggcccctcagggacttgagattat

SEQ ID NO: 333154 - DNA, 25 bp, Homo sapien
agtactagttcctaacacgttctgg

SEQ ID NO: 333155 - DNA, 25 bp, Homo sapien
cactctctctgttgctaagaccata

SEQ ID NO: 333156 - DNA, 25 bp, Homo sapien
tagcttgtgtcttatctgtacctca

SEQ ID NO: 333157 - DNA, 25 bp, Homo sapien
aggtaaccctgtacatgcgtaccat

SEQ ID NO: 333158 - DNA, 25 bp, Homo sapien
gggactgacctggaatgcagcttca

SEQ ID NO: 333159 - DNA, 25 bp, Homo sapien
atgcagcttcattttgcctacacta

SEQ ID NO: 333160 - DNA, 25 bp, Homo sapien
tgcctacactagttccacatcaaga

SEQ ID NO: 333161 - DNA, 25 bp, Homo sapien
gcccagtctctgtaagtgttgcttc

SEQ ID NO: 333162 - DNA, 25 bp, Homo sapien
acatgcgtaccatttgcatcttcaa

SEQ ID NO: 333163 - DNA, 25 bp, Homo sapien
gttgcttctgcatttatctgttaac

SEQ ID NO: 333164 - DNA, 25 bp, Homo sapien
ttaccttacctggtcaccaacatag

SEQ ID NO: 333165 - DNA, 25 bp, Homo sapien
aacatagctgctatttccactctct

SEQ ID NO: 333166 - DNA, 25 bp, Homo sapien
gattctgactttttctaacctctta

SEQ ID NO: 333167 - DNA, 25 bp, Homo sapien
ttctaacctcttatagacatgccaa

SEQ ID NO: 333168 - DNA, 25 bp, Homo sapien
gcaaaatccttttaaacacagaaat

SEQ ID NO: 333169 - DNA, 25 bp, Homo sapien
aacacagaaatcctgagttcttctc

SEQ ID NO: 333170 - DNA, 25 bp, Homo sapien
gaaatcctgagttcttctcattggt

SEQ ID NO: 333171 - DNA, 25 bp, Homo sapien
agttcttctcattggtggactcaag

SEQ ID NO: 333172 - DNA, 25 bp, Homo sapien
ttctcattggtggactcaagcaatt

SEQ ID NO: 333173 - DNA, 25 bp, Homo sapien
aatatagcattctgacctaaaaaag

SEQ ID NO: 333174 - DNA, 25 bp, Homo sapien
gttttcaactcaggacctatccaaa

SEQ ID NO: 333175 - DNA, 25 bp, Homo sapien
ggacctatccaaatgaggaattttt

SEQ ID NO: 333176 - DNA, 25 bp, Homo sapien
gacatcaattctatagattctgact

SEQ ID NO: 333177 - DNA, 25 bp, Homo sapien
caagtctgagtggagcgtgtatgct

SEQ ID NO: 333178 - DNA, 25 bp, Homo sapien
gcgtgtatgctttgcgttatctgca

SEQ ID NO: 333179 - DNA, 25 bp, Homo sapien
atctgcagtgcggcctgaggttacg

SEQ ID NO: 333180 - DNA, 25 bp, Homo sapien
aaatggcactgtgtattgcttgaat

SEQ ID NO: 333181 - DNA, 25 bp, Homo sapien
ttgcttgaatgctcagggctgcgtt

SEQ ID NO: 333182 - DNA, 25 bp, Homo sapien
aatgctcagggctgcgttcaactaa

SEQ ID NO: 333183 - DNA, 25 bp, Homo sapien
aatgatcaggtagagggcaggaaat

SEQ ID NO: 333184 - DNA, 25 bp, Homo sapien
gaatggcttgaacaactacctcatg

SEQ ID NO: 333185 - DNA, 25 bp, Homo sapien
gaacaactacctcatgaaaacatgc

SEQ ID NO: 333186 - DNA, 25 bp, Homo sapien
agaatgaacttctagcctgctttat

SEQ ID NO: 333187 - DNA, 25 bp, Homo sapien
ttctagcctgctttataatcaatca

SEQ ID NO: 333188 - DNA, 25 bp, Homo sapien
aagattgcttcggaatttggcacga

SEQ ID NO: 333189 - DNA, 25 bp, Homo sapien
gaatttggcacgaaccatgccactg

SEQ ID NO: 333190 - DNA, 25 bp, Homo sapien
gaaccatgccactgtttccatgggc

SEQ ID NO: 333191 - DNA, 25 bp, Homo sapien
ccgagttacttttccccagatgact

SEQ ID NO: 333192 - DNA, 25 bp, Homo sapien
cagatgactctggttttgtttggtt

SEQ ID NO: 333193 - DNA, 25 bp, Homo sapien
tttgtttggtttgccgccaggagtg

SEQ ID NO: 333194 - DNA, 25 bp, Homo sapien
gtttgccgccaggagtgactgtgtt

SEQ ID NO: 333195 - DNA, 25 bp, Homo sapien
aggagtgactgtgttgttctttgct

SEQ ID NO: 333196 - DNA, 25 bp, Homo sapien
gttgttctttgctttatatacataa

SEQ ID NO: 333197 - DNA, 25 bp, Homo sapien
tatacataagcgcatctcttaccgc

SEQ ID NO: 333198 - DNA, 25 bp, Homo sapien
acataagcgcatctcttaccgccat

SEQ ID NO: 333199 - DNA, 25 bp, Homo sapien
aaaaaggtatatgctacaagccagc

SEQ ID NO: 333200 - DNA, 25 bp, Homo sapien
ggagcagttaaatcattgtggacaa

SEQ ID NO: 333201 - DNA, 25 bp, Homo sapien
aagcagcaaagaagagtcactccct

SEQ ID NO: 333202 - DNA, 25 bp, Homo sapien
aactaagctaggatcctcttccgaa

SEQ ID NO: 333203 - DNA, 25 bp, Homo sapien
agctaggatcctcttccgaaataga

SEQ ID NO: 333204 - DNA, 25 bp, Homo sapien
aaacaactcacgtcttgaaacactc

SEQ ID NO: 333205 - DNA, 25 bp, Homo sapien
gtcttgaaacactcagtgcccttgc

SEQ ID NO: 333206 - DNA, 25 bp, Homo sapien
gtgcccttgccaacagaactcagct

SEQ ID NO: 333207 - DNA, 25 bp, Homo sapien
agaatccacttcaggtgcaacccag

SEQ ID NO: 333208 - DNA, 25 bp, Homo sapien
caggtgcaacccagtttatgcctga

SEQ ID NO: 333209 - DNA, 25 bp, Homo sapien
ccaagctcatggatcacgggcagtc

SEQ ID NO: 333210 - DNA, 25 bp, Homo sapien
cagtagatacatgtgaagttgataa

SEQ ID NO: 333211 - DNA, 25 bp, Homo sapien
gaattagaggcataaacatttagaa

SEQ ID NO: 333212 - DNA, 25 bp, Homo sapien
catttagaactatagaggtaacttc

SEQ ID NO: 333213 - DNA, 25 bp, Homo sapien
gaactatagaggtaacttctagaaa

SEQ ID NO: 333214 - DNA, 25 bp, Homo sapien
ggagaatagtttttcatcgtaagtt

SEQ ID NO: 333215 - DNA, 25 bp, Homo sapien
atagtttttcatcgtaagttctttg

SEQ ID NO: 333216 - DNA, 25 bp, Homo sapien
gtttttcatcgtaagttctttgata

SEQ ID NO: 333217 - DNA, 25 bp, Homo sapien
ttttcatcgtaagttctttgatact

SEQ ID NO: 333218 - DNA, 25 bp, Homo sapien
catcgtaagttctttgatacttttt

SEQ ID NO: 333219 - DNA, 25 bp, Homo sapien
taataaaaagatgctccccttccct

SEQ ID NO: 333220 - DNA, 25 bp, Homo sapien
ataaaaagatgctccccttccctct

SEQ ID NO: 333221 - DNA, 25 bp, Homo sapien
tgtgcaacctttgggaactcaagtt

SEQ ID NO: 333222 - DNA, 25 bp, Homo sapien
gaactcaagttgctgagtcgccgct

SEQ ID NO: 333223 - DNA, 25 bp, Homo sapien
aagttgctgagtcgccgcttcccca

SEQ ID NO: 333224 - DNA, 25 bp, Homo sapien
cccagaccagcaaggcggcagggct

SEQ ID NO: 333225 - DNA, 25 bp, Homo sapien
gggcctctcctagagactgggctct

SEQ ID NO: 333226 - DNA, 25 bp, Homo sapien
ctcctagagactgggctctgtgtgt

SEQ ID NO: 333227 - DNA, 25 bp, Homo sapien
gactttagtaaagggatcagccttc

SEQ ID NO: 333228 - DNA, 25 bp, Homo sapien
aaagggatcagccttcatggccatc

SEQ ID NO: 333229 - DNA, 25 bp, Homo sapien
gatcagccttcatggccatcataga

SEQ ID NO: 333230 - DNA, 25 bp, Homo sapien
ccttcatggccatcatagaccggga

SEQ ID NO: 333231 - DNA, 25 bp, Homo sapien
agctacaccaagctaataaactgcg

SEQ ID NO: 333232 - DNA, 25 bp, Homo sapien
gagtaaagctgccaagagttaggtt

SEQ ID NO: 333233 - DNA, 25 bp, Homo sapien
gagttaggttgaatttggagccttt

SEQ ID NO: 333234 - DNA, 25 bp, Homo sapien
aagttggttccataagtgagaaggg

SEQ ID NO: 333235 - DNA, 25 bp, Homo sapien
ggctaacatgtgaccactgtgcccc

SEQ ID NO: 333236 - DNA, 25 bp, Homo sapien
actgtgcccctgagaatccatgaga

SEQ ID NO: 333237 - DNA, 25 bp, Homo sapien
gaaggcacttaacgctgttctcagt

SEQ ID NO: 333238 - DNA, 25 bp, Homo sapien
acttaacgctgttctcagttggaaa

SEQ ID NO: 333239 - DNA, 25 bp, Homo sapien
agttggaaaatgtcagccctccaca

SEQ ID NO: 333240 - DNA, 25 bp, Homo sapien
agccctccacacctgtttggatgtg

SEQ ID NO: 333241 - DNA, 25 bp, Homo sapien
cctgtttggatgtgaagtgcattat

SEQ ID NO: 333242 - DNA, 25 bp, Homo sapien
gtattgaatttcctattgcctgatt

SEQ ID NO: 333243 - DNA, 25 bp, Homo sapien
gatagaaagactgagctttcagagc

SEQ ID NO: 333244 - DNA, 25 bp, Homo sapien
gtgtggatcccgtgtcctccaggaa

SEQ ID NO: 333245 - DNA, 25 bp, Homo sapien
gtgtcctccaggaatgccattggtg

SEQ ID NO: 333246 - DNA, 25 bp, Homo sapien
gtcctccaggaatgccattggtgga

SEQ ID NO: 333247 - DNA, 25 bp, Homo sapien
tggccatcagaaacgcaagcctgac

SEQ ID NO: 333248 - DNA, 25 bp, Homo sapien
cgcaagcctgacataatgcttcctc

SEQ ID NO: 333249 - DNA, 25 bp, Homo sapien
cttcctctgtttgctaggccaggga

SEQ ID NO: 333250 - DNA, 25 bp, Homo sapien
ctctgtttgctaggccagggatgta

SEQ ID NO: 333251 - DNA, 25 bp, Homo sapien
agggatgtaccctgacccccacagt

SEQ ID NO: 333252 - DNA, 25 bp, Homo sapien
tccaatccctggccgcggaggtgtc

SEQ ID NO: 333253 - DNA, 25 bp, Homo sapien
tatagcccatcaccaggcctgagcc

SEQ ID NO: 333254 - DNA, 25 bp, Homo sapien
tgagtacaccccacagagctaatct

SEQ ID NO: 333255 - DNA, 25 bp, Homo sapien
agagctaatctaaatcttgtgctag

SEQ ID NO: 333256 - DNA, 25 bp, Homo sapien
atcttgtgctagaaaaagcattctc

SEQ ID NO: 333257 - DNA, 25 bp, Homo sapien
taccccaccctacaaaatgcatatg

SEQ ID NO: 333258 - DNA, 25 bp, Homo sapien
aaatgcatatggaggtaggctgaaa

SEQ ID NO: 333259 - DNA, 25 bp, Homo sapien
acagatttgagctatcagaccaaca

SEQ ID NO: 333260 - DNA, 25 bp, Homo sapien
cccctgaaaagtgagcagcaacgta

SEQ ID NO: 333261 - DNA, 25 bp, Homo sapien
aaaaacgtatgtgaagcctctcttg

SEQ ID NO: 333262 - DNA, 25 bp, Homo sapien
aagcctctcttgaatttctagttag

SEQ ID NO: 333263 - DNA, 25 bp, Homo sapien
agttagcaatcttaaggctctttaa

SEQ ID NO: 333264 - DNA, 25 bp, Homo sapien
ccaaagaagtcctgctatgttaaaa

SEQ ID NO: 333265 - DNA, 25 bp, Homo sapien
cattgagaagtccaagtggaccctc

SEQ ID NO: 333266 - DNA, 25 bp, Homo sapien
aagtccaagtggaccctcttctccg

SEQ ID NO: 333267 - DNA, 25 bp, Homo sapien
tactctccagtcctacgtgcagctg

SEQ ID NO: 333268 - DNA, 25 bp, Homo sapien
cgtgcagctgcatcttccagatcca

SEQ ID NO: 333269 - DNA, 25 bp, Homo sapien
agctgcatcttccagatccacctgg

SEQ ID NO: 333270 - DNA, 25 bp, Homo sapien
ttctgcctcaatgcctgggattcag

SEQ ID NO: 333271 - DNA, 25 bp, Homo sapien
aatgcctgggattcaggaccttgat

SEQ ID NO: 333272 - DNA, 25 bp, Homo sapien
cctgggattcaggaccttgatcaca

SEQ ID NO: 333273 - DNA, 25 bp, Homo sapien
gattcaggaccttgatcacagctgg

SEQ ID NO: 333274 - DNA, 25 bp, Homo sapien
accaccatctcctagtctcttgaga

SEQ ID NO: 333275 - DNA, 25 bp, Homo sapien
atctcctagtctcttgagactggcc

SEQ ID NO: 333276 - DNA, 25 bp, Homo sapien
tgcccagccaagttcacaacttctg

SEQ ID NO: 333277 - DNA, 25 bp, Homo sapien
cccagccaagttcacaacttctgat

SEQ ID NO: 333278 - DNA, 25 bp, Homo sapien
agccaagttcacaacttctgatatc

SEQ ID NO: 333279 - DNA, 25 bp, Homo sapien
aagttcacaacttctgatatcaagt

SEQ ID NO: 333280 - DNA, 25 bp, Homo sapien
ggacacttcttaagtagagaaggac

SEQ ID NO: 333281 - DNA, 25 bp, Homo sapien
agagaaggactgtgacatcccctcc

SEQ ID NO: 333282 - DNA, 25 bp, Homo sapien
agaaggactgtgacatcccctccaa

SEQ ID NO: 333283 - DNA, 25 bp, Homo sapien
tccaaacctccatgtaacactaaca

SEQ ID NO: 333284 - DNA, 25 bp, Homo sapien
aacctccatgtaacactaacaaatg

SEQ ID NO: 333285 - DNA, 25 bp, Homo sapien
tccatgtaacactaacaaatggcct

SEQ ID NO: 333286 - DNA, 25 bp, Homo sapien
aaatggtatcgtcaataaatgcaaa

SEQ ID NO: 333287 - DNA, 25 bp, Homo sapien
atatgttcttttctgtacgtaatgg

SEQ ID NO: 333288 - DNA, 25 bp, Homo sapien
atagtcctagttctacaatttgtta

SEQ ID NO: 333289 - DNA, 25 bp, Homo sapien
attattttttatcgtcattgtgaag

SEQ ID NO: 333290 - DNA, 25 bp, Homo sapien
aaagtccatgttcctttgtggtgaa

SEQ ID NO: 333291 - DNA, 25 bp, Homo sapien
tgtggtgaaataacctccaaatagt

SEQ ID NO: 333292 - DNA, 25 bp, Homo sapien
tagtttgagaagttgccaagacgaa

SEQ ID NO: 333293 - DNA, 25 bp, Homo sapien
agcaaaaccccagtagcagagcatg

SEQ ID NO: 333294 - DNA, 25 bp, Homo sapien
tctgtgttgtttcccattctgtctt

SEQ ID NO: 333295 - DNA, 25 bp, Homo sapien
ttgtttcccattctgtctttgactg

SEQ ID NO: 333296 - DNA, 25 bp, Homo sapien
gtctttgactgcctcattcaataaa

SEQ ID NO: 333297 - DNA, 25 bp, Homo sapien
gactgcctcattcaataaatagtta

SEQ ID NO: 333298 - DNA, 25 bp, Homo sapien
gatcacgaaggccaccctagaatgc

SEQ ID NO: 333299 - DNA, 25 bp, Homo sapien
ggccaccctagaatgcaggcagagt

SEQ ID NO: 333300 - DNA, 25 bp, Homo sapien
attttgaaattgcttgaggcactac

SEQ ID NO: 333301 - DNA, 25 bp, Homo sapien
gaggcactacttatagctctctgca

SEQ ID NO: 333302 - DNA, 25 bp, Homo sapien
cttatagctctctgcatttgtaaaa

SEQ ID NO: 333303 - DNA, 25 bp, Homo sapien
tgtaaaagcgattcctttgtgaccc

SEQ ID NO: 333304 - DNA, 25 bp, Homo sapien
tacatcgttgcagatactctacctc

SEQ ID NO: 333305 - DNA, 25 bp, Homo sapien
gttgcagatactctacctcaatcat

SEQ ID NO: 333306 - DNA, 25 bp, Homo sapien
acctcaatcattattggtccttagg

SEQ ID NO: 333307 - DNA, 25 bp, Homo sapien
tggtccttaggagtgcacagtatat

SEQ ID NO: 333308 - DNA, 25 bp, Homo sapien
ggagtgcacagtatatggatagtat

SEQ ID NO: 333309 - DNA, 25 bp, Homo sapien
ggagaagttatcaactggtgttttc

SEQ ID NO: 333310 - DNA, 25 bp, Homo sapien
atcaactggtgttttcagacctcag

SEQ ID NO: 333311 - DNA, 25 bp, Homo sapien
ctggtgttttcagacctcagttgga

SEQ ID NO: 333312 - DNA, 25 bp, Homo sapien
gtgttttcagacctcagttggatga

SEQ ID NO: 333313 - DNA, 25 bp, Homo sapien
gacctcagttggatgaacccattcc

SEQ ID NO: 333314 - DNA, 25 bp, Homo sapien
gttggatgaacccattccactgtat

SEQ ID NO: 333315 - DNA, 25 bp, Homo sapien
gatgaacccattccactgtatgagg

SEQ ID NO: 333316 - DNA, 25 bp, Homo sapien
gaacccattccactgtatgaggcaa

SEQ ID NO: 333317 - DNA, 25 bp, Homo sapien
acccattccactgtatgaggcaaaa

SEQ ID NO: 333318 - DNA, 25 bp, Homo sapien
tgaggcaaaagtttccatggaagct

SEQ ID NO: 333319 - DNA, 25 bp, Homo sapien
aaaagtttccatggaagctgttcag

SEQ ID NO: 333320 - DNA, 25 bp, Homo sapien
ttttcattggctttaagttgagggt

SEQ ID NO: 333321 - DNA, 25 bp, Homo sapien
tttcattggctttaagttgagggtt

SEQ ID NO: 333322 - DNA, 25 bp, Homo sapien
ttcattggctttaagttgagggttt

SEQ ID NO: 333323 - DNA, 25 bp, Homo sapien
ggatagataatggtacttctggctt

SEQ ID NO: 333324 - DNA, 25 bp, Homo sapien
gatagataatggtacttctggcttt

SEQ ID NO: 333325 - DNA, 25 bp, Homo sapien
atagataatggtacttctggcttta

SEQ ID NO: 333326 - DNA, 25 bp, Homo sapien
tagataatggtacttctggctttat

SEQ ID NO: 333327 - DNA, 25 bp, Homo sapien
agataatggtacttctggctttatt

SEQ ID NO: 333328 - DNA, 25 bp, Homo sapien
gataatggtacttctggctttattt

SEQ ID NO: 333329 - DNA, 25 bp, Homo sapien
ataatggtacttctggctttattta

SEQ ID NO: 333330 - DNA, 25 bp, Homo sapien
taatggtacttctggctttatttaa

SEQ ID NO: 333331 - DNA, 25 bp, Homo sapien
aaatgacacgtgttatgtattttct

SEQ ID NO: 333332 - DNA, 25 bp, Homo sapien
tgtattttctggtcacctgagaata

SEQ ID NO: 333333 - DNA, 25 bp, Homo sapien
ttttctggtcacctgagaatagtca

SEQ ID NO: 333334 - DNA, 25 bp, Homo sapien
gagaatagtcagaaccattagcatt

SEQ ID NO: 333335 - DNA, 25 bp, Homo sapien
gtcagaaccattagcattgaaagcc

SEQ ID NO: 333336 - DNA, 25 bp, Homo sapien
agcattgaaagccatgagtgccttg

SEQ ID NO: 333337 - DNA, 25 bp, Homo sapien
gagtgccttgggtcaagagtagctt

SEQ ID NO: 333338 - DNA, 25 bp, Homo sapien
gccttgggtcaagagtagcttatga

SEQ ID NO: 333339 - DNA, 25 bp, Homo sapien
gagtagcttatgatgacatttattt

SEQ ID NO: 333340 - DNA, 25 bp, Homo sapien
ggttacaggtaagtgtaaacacatt

SEQ ID NO: 333341 - DNA, 25 bp, Homo sapien
aagaggcttttcttgcttgaaaaca

SEQ ID NO: 333342 - DNA, 25 bp, Homo sapien
ggtcacctctttgttacaacctgga

SEQ ID NO: 333343 - DNA, 25 bp, Homo sapien
tacaacctggatatgatgcccacat

SEQ ID NO: 333344 - DNA, 25 bp, Homo sapien
cctggatatgatgcccacatgcgtg

SEQ ID NO: 333345 - DNA, 25 bp, Homo sapien
gacatgcttgggatagataagcctg

SEQ ID NO: 333346 - DNA, 25 bp, Homo sapien
gataagcctgtggacttcagacggt

SEQ ID NO: 333347 - DNA, 25 bp, Homo sapien
gcctgtggacttcagacggtatttt

SEQ ID NO: 333348 - DNA, 25 bp, Homo sapien
tttttcttctttctcgtcctcatct

SEQ ID NO: 333349 - DNA, 25 bp, Homo sapien
tttctactctctctagtgtctcact

SEQ ID NO: 333350 - DNA, 25 bp, Homo sapien
actctctctagtgtctcacttgaga

SEQ ID NO: 333351 - DNA, 25 bp, Homo sapien
gtctcacttgagaaagacctagatt

SEQ ID NO: 333352 - DNA, 25 bp, Homo sapien
tgtacttgaagaatacagatcgact

SEQ ID NO: 333353 - DNA, 25 bp, Homo sapien
cagcaagttgctcggatggaaaaac

SEQ ID NO: 333354 - DNA, 25 bp, Homo sapien
tgacgagtggcggtttaagcccatc

SEQ ID NO: 333355 - DNA, 25 bp, Homo sapien
gtttaagcccatcgagcagctgctg

SEQ ID NO: 333356 - DNA, 25 bp, Homo sapien
atcgagcagctgctgggattcaccc

SEQ ID NO: 333357 - DNA, 25 bp, Homo sapien
ggttgatactgcctggatggtcacc

SEQ ID NO: 333358 - DNA, 25 bp, Homo sapien
gatggtcacctctggtgcgcagcaa

SEQ ID NO: 333359 - DNA, 25 bp, Homo sapien
ggtgcgcagcaagtgcaaagccagt

SEQ ID NO: 333360 - DNA, 25 bp, Homo sapien
gggactttctcacagcttacatagc

SEQ ID NO: 333361 - DNA, 25 bp, Homo sapien
agcttacatagccatccagagatcc

SEQ ID NO: 333362 - DNA, 25 bp, Homo sapien
agagatccacagctacgtcactgaa

SEQ ID NO: 333363 - DNA, 25 bp, Homo sapien
tacgtcactgaattgttaatgcaca

SEQ ID NO: 333364 - DNA, 25 bp, Homo sapien
gtataactggagtgccaaggctaaa

SEQ ID NO: 333365 - DNA, 25 bp, Homo sapien
ggaactggtcgaatgaggcacctaa

SEQ ID NO: 333366 - DNA, 25 bp, Homo sapien
aggcacctaaaaattgtataccgca

SEQ ID NO: 333367 - DNA, 25 bp, Homo sapien
aattgtataccgcagattcaggcat

SEQ ID NO: 333368 - DNA, 25 bp, Homo sapien
gcagattcaggcatggattccgtga

SEQ ID NO: 333369 - DNA, 25 bp, Homo sapien
gattccgtgaaggaacaacacctaa

SEQ ID NO: 333370 - DNA, 25 bp, Homo sapien
ctaaacccaagagggcagctgttgc

SEQ ID NO: 333371 - DNA, 25 bp, Homo sapien
agctgttgcagcatccagttcatct

SEQ ID NO: 333372 - DNA, 25 bp, Homo sapien
gaatgtcaacgattagtcatgcaat

SEQ ID NO: 333373 - DNA, 25 bp, Homo sapien
gtcgcaataagacgcacacgttgtg

SEQ ID NO: 333374 - DNA, 25 bp, Homo sapien
ataagacgcacacgttgtgccgccg

SEQ ID NO: 333375 - DNA, 25 bp, Homo sapien
ctaagcctccagaaacgtcttctta

SEQ ID NO: 333376 - DNA, 25 bp, Homo sapien
tccagaaacgtcttcttaatcccca

SEQ ID NO: 333377 - DNA, 25 bp, Homo sapien
tccaggctattaaagtcactaaatt

SEQ ID NO: 333378 - DNA, 25 bp, Homo sapien
gtcactaaatttctaagtatgtcca

SEQ ID NO: 333379 - DNA, 25 bp, Homo sapien
tctaagtatgtccatttcccatctc

SEQ ID NO: 333380 - DNA, 25 bp, Homo sapien
cttcaagggaggtgtcagcagtatt

SEQ ID NO: 333381 - DNA, 25 bp, Homo sapien
gaggtgtcagcagtattatctccac

SEQ ID NO: 333382 - DNA, 25 bp, Homo sapien
gtcagcagtattatctccactttca

SEQ ID NO: 333383 - DNA, 25 bp, Homo sapien
agcagtattatctccactttcaatc

SEQ ID NO: 333384 - DNA, 25 bp, Homo sapien
agtattatctccactttcaatctcc

SEQ ID NO: 333385 - DNA, 25 bp, Homo sapien
agctcctttcccctgatcagagaaa

SEQ ID NO: 333386 - DNA, 25 bp, Homo sapien
ttactgttgtaatggctaaaatcac

SEQ ID NO: 333387 - DNA, 25 bp, Homo sapien
aaatcacataaacgtttgtgtcgga

SEQ ID NO: 333388 - DNA, 25 bp, Homo sapien
ttgtgtcggaatggtgtcctctctt

SEQ ID NO: 333389 - DNA, 25 bp, Homo sapien
cggaatggtgtcctctctttctctt

SEQ ID NO: 333390 - DNA, 25 bp, Homo sapien
gtaactttctgaacacattgcattg

SEQ ID NO: 333391 - DNA, 25 bp, Homo sapien
gaacacattgcattgaattcttcct

SEQ ID NO: 333392 - DNA, 25 bp, Homo sapien
gcattgaattcttcctttaacaaaa

SEQ ID NO: 333393 - DNA, 25 bp, Homo sapien
aaaggcgtaggtaaaagctcaaatg

SEQ ID NO: 333394 - DNA, 25 bp, Homo sapien
tgaatttattctttcggtatggtaa

SEQ ID NO: 333395 - DNA, 25 bp, Homo sapien
ggtaaaattgaaccaatcacagtta

SEQ ID NO: 333396 - DNA, 25 bp, Homo sapien
gatgagagatcaacctgagttttaa

SEQ ID NO: 333397 - DNA, 25 bp, Homo sapien
tgttttcatacgcacatgtctgcct

SEQ ID NO: 333398 - DNA, 25 bp, Homo sapien
atgtctgcctcactcatagttttat

SEQ ID NO: 333399 - DNA, 25 bp, Homo sapien
ttttataaattcaagcacacagtag

SEQ ID NO: 333400 - DNA, 25 bp, Homo sapien
caagcacacagtagagactctcttt

SEQ ID NO: 333401 - DNA, 25 bp, Homo sapien
acagtagagactctctttctgactt

SEQ ID NO: 333402 - DNA, 25 bp, Homo sapien
acagccaatggttttgcttccctag

SEQ ID NO: 333403 - DNA, 25 bp, Homo sapien
aatggttttgcttccctagtgccaa

SEQ ID NO: 333404 - DNA, 25 bp, Homo sapien
tccctagtgccaagtgttcattcct

SEQ ID NO: 333405 - DNA, 25 bp, Homo sapien
gttcattcctgatccaagtagctgt

SEQ ID NO: 333406 - DNA, 25 bp, Homo sapien
tcctgatccaagtagctgtggtcaa

SEQ ID NO: 333407 - DNA, 25 bp, Homo sapien
aaaatgttctgttttcatacgcaca

SEQ ID NO: 333408 - DNA, 25 bp, Homo sapien
tgatgccttcagtgtatattcctct

SEQ ID NO: 333409 - DNA, 25 bp, Homo sapien
agtgtatattcctctgttgttccta

SEQ ID NO: 333410 - DNA, 25 bp, Homo sapien
tcctctgttgttcctaatgctcaaa

SEQ ID NO: 333411 - DNA, 25 bp, Homo sapien
aatgctcaaaatcaagggacctctg

SEQ ID NO: 333412 - DNA, 25 bp, Homo sapien
gacctctgaaggtgtacttggctaa

SEQ ID NO: 333413 - DNA, 25 bp, Homo sapien
aagacatctggcatcatttgcagca

SEQ ID NO: 333414 - DNA, 25 bp, Homo sapien
atttgcagcactgtaacaccttcag

SEQ ID NO: 333415 - DNA, 25 bp, Homo sapien
aacaccttcagtctcagttgtgcaa

SEQ ID NO: 333416 - DNA, 25 bp, Homo sapien
gtctcagttgtgcaattacttctgt

SEQ ID NO: 333417 - DNA, 25 bp, Homo sapien
gtttctttagtcagggtctttgcag

SEQ ID NO: 333418 - DNA, 25 bp, Homo sapien
ggacaaattttgttaagatcccatt

SEQ ID NO: 333419 - DNA, 25 bp, Homo sapien
gtaactttctgaacacattgcattg

SEQ ID NO: 333420 - DNA, 25 bp, Homo sapien
aactttctgaacacattgcattgaa

SEQ ID NO: 333421 - DNA, 25 bp, Homo sapien
tgaacacattgcattgaattcttcc

SEQ ID NO: 333422 - DNA, 25 bp, Homo sapien
gcaaaggcgtaggtaaaagctcaaa

SEQ ID NO: 333423 - DNA, 25 bp, Homo sapien
aggcgtaggtaaaagctcaaatgaa

SEQ ID NO: 333424 - DNA, 25 bp, Homo sapien
tgaatttattctttcggtatggtaa

SEQ ID NO: 333425 - DNA, 25 bp, Homo sapien
tattctttcggtatggtaaaattga

SEQ ID NO: 333426 - DNA, 25 bp, Homo sapien
atggtaaaattgaaccaatcacagt

SEQ ID NO: 333427 - DNA, 25 bp, Homo sapien
tcacagttaagatgagagatcaacc

SEQ ID NO: 333428 - DNA, 25 bp, Homo sapien
agatgagagatcaacctgagtttta

SEQ ID NO: 333429 - DNA, 25 bp, Homo sapien
atgagagatcaacctgagttttaaa

SEQ ID NO: 333430 - DNA, 25 bp, Homo sapien
gtgctggattactcaaaactcttgg

SEQ ID NO: 333431 - DNA, 25 bp, Homo sapien
aaactcttggcagtcaattcacttt

SEQ ID NO: 333432 - DNA, 25 bp, Homo sapien
ggcagtcaattcactttcagaatgc

SEQ ID NO: 333433 - DNA, 25 bp, Homo sapien
tttactgggaatattacctctcaat

SEQ ID NO: 333434 - DNA, 25 bp, Homo sapien
aatattacctctcaattggctccaa

SEQ ID NO: 333435 - DNA, 25 bp, Homo sapien
ctccaacccaagttcttatgaggaa

SEQ ID NO: 333436 - DNA, 25 bp, Homo sapien
aaactgaggcacgagaaagtcgatt

SEQ ID NO: 333437 - DNA, 25 bp, Homo sapien
gaaagtcgattgtctggtcagtcac

SEQ ID NO: 333438 - DNA, 25 bp, Homo sapien
ggtcagtcactgatggaccacagcc

SEQ ID NO: 333439 - DNA, 25 bp, Homo sapien
ggaccacagccctcaaataagcaag

SEQ ID NO: 333440 - DNA, 25 bp, Homo sapien
ggatttagcaagacgtttctgttag

SEQ ID NO: 333441 - DNA, 25 bp, Homo sapien
ttacattggccagtattaggttcct

SEQ ID NO: 333442 - DNA, 25 bp, Homo sapien
ggccagtattaggttcctgatacgt

SEQ ID NO: 333443 - DNA, 25 bp, Homo sapien
ggttcctgatacgtatttggtgttt

SEQ ID NO: 333444 - DNA, 25 bp, Homo sapien
gggttttttctctccagtattggat

SEQ ID NO: 333445 - DNA, 25 bp, Homo sapien
ctccagtattggatgcgttaacggg

SEQ ID NO: 333446 - DNA, 25 bp, Homo sapien
gggagccttgagaagttatgaattt

SEQ ID NO: 333447 - DNA, 25 bp, Homo sapien
tggtttgttcggaattgctttttat

SEQ ID NO: 333448 - DNA, 25 bp, Homo sapien
tttataagttttctgtgacctcatg

SEQ ID NO: 333449 - DNA, 25 bp, Homo sapien
gtgacctcatgcactaaatactgat

SEQ ID NO: 333450 - DNA, 25 bp, Homo sapien
taaatactgatgctaccacactcct

SEQ ID NO: 333451 - DNA, 25 bp, Homo sapien
taccacactcctgcaagtatgaaat

SEQ ID NO: 333452 - DNA, 25 bp, Homo sapien
gcactgattcaggaacttaatttca

SEQ ID NO: 333453 - DNA, 25 bp, Homo sapien
gaaggaaaggtctgtatgtacacat

SEQ ID NO: 333454 - DNA, 25 bp, Homo sapien
tggtttaattcacccactttagatg

SEQ ID NO: 333455 - DNA, 25 bp, Homo sapien
actttactttctctttgcactgcca

SEQ ID NO: 333456 - DNA, 25 bp, Homo sapien
ttgcactgccagcacgtgagatact

SEQ ID NO: 333457 - DNA, 25 bp, Homo sapien
gcacgtgagatactaactttttaac

SEQ ID NO: 333458 - DNA, 25 bp, Homo sapien
tagttgttcttctctagtctctacg

SEQ ID NO: 333459 - DNA, 25 bp, Homo sapien
tcttctctagtctctacgttattag

SEQ ID NO: 333460 - DNA, 25 bp, Homo sapien
agaattttttgctttcataatgtga

SEQ ID NO: 333461 - DNA, 25 bp, Homo sapien
aatgttatggtgtgtgaaatatctc

SEQ ID NO: 333462 - DNA, 25 bp, Homo sapien
aaagagctggaatgcactgattcag

SEQ ID NO: 333463 - DNA, 25 bp, Homo sapien
ttcctgggcattggagcggatccat

SEQ ID NO: 333464 - DNA, 25 bp, Homo sapien
ggagcggatccatagtgttagatat

SEQ ID NO: 333465 - DNA, 25 bp, Homo sapien
ttagatatgcagtgggaatggcccc

SEQ ID NO: 333466 - DNA, 25 bp, Homo sapien
gatggcagcaccctgctagtcctca

SEQ ID NO: 333467 - DNA, 25 bp, Homo sapien
ctagtcctcacatggagccctggag

SEQ ID NO: 333468 - DNA, 25 bp, Homo sapien
tgaatcaatagcctcacacctggta

SEQ ID NO: 333469 - DNA, 25 bp, Homo sapien
atagcctcacacctggtatgcacat

SEQ ID NO: 333470 - DNA, 25 bp, Homo sapien
tggtatgcacatccaggccaagtgt

SEQ ID NO: 333471 - DNA, 25 bp, Homo sapien
acatccaggccaagtgtggctgaat

SEQ ID NO: 333472 - DNA, 25 bp, Homo sapien
gtcccttcgggcactgatttatggc

SEQ ID NO: 333473 - DNA, 25 bp, Homo sapien
ggcactgatttatggcacacagcag

SEQ ID NO: 333474 - DNA, 25 bp, Homo sapien
taggagcctaaggtgggacaaccac

SEQ ID NO: 333475 - DNA, 25 bp, Homo sapien
gcagacactcatgcctctagtatga

SEQ ID NO: 333476 - DNA, 25 bp, Homo sapien
gtatgattcagttcagctcctcatt

SEQ ID NO: 333477 - DNA, 25 bp, Homo sapien
ttcagctcctcattgaaccagggaa

SEQ ID NO: 333478 - DNA, 25 bp, Homo sapien
gaagagaccgacagacttcacacca

SEQ ID NO: 333479 - DNA, 25 bp, Homo sapien
ctgttcctgtaattctccactgtgc

SEQ ID NO: 333480 - DNA, 25 bp, Homo sapien
tccactgtgcagcttgggatttcct

SEQ ID NO: 333481 - DNA, 25 bp, Homo sapien
gggatttcctggagatgtttccata

SEQ ID NO: 333482 - DNA, 25 bp, Homo sapien
atcatcactgtcgtcactgtcactg

SEQ ID NO: 333483 - DNA, 25 bp, Homo sapien
gtcactgtcactgctgtacaataat

SEQ ID NO: 333484 - DNA, 25 bp, Homo sapien
aaggtgctaggatgccttcctgtaa

SEQ ID NO: 333485 - DNA, 25 bp, Homo sapien
cctggaatcatctatgcctggaaac

SEQ ID NO: 333486 - DNA, 25 bp, Homo sapien
ctatgcctggaaacatcaatgtctt

SEQ ID NO: 333487 - DNA, 25 bp, Homo sapien
atcaatgtcttctggccagacaaag

SEQ ID NO: 333488 - DNA, 25 bp, Homo sapien
gagtgaaaggcgctatgcccagcaa

SEQ ID NO: 333489 - DNA, 25 bp, Homo sapien
ggcgctatgcccagcaagaaaaact

SEQ ID NO: 333490 - DNA, 25 bp, Homo sapien
ggtcagaatgtccaaacctcagcat

SEQ ID NO: 333491 - DNA, 25 bp, Homo sapien
cagcatcgttacaggaggttcaaag

SEQ ID NO: 333492 - DNA, 25 bp, Homo sapien
caggaggttcaaagtgccttttcct

SEQ ID NO: 333493 - DNA, 25 bp, Homo sapien
ctctgactcagaagcacctggtatt

SEQ ID NO: 333494 - DNA, 25 bp, Homo sapien
caagcaccaggagagtgctctttct

SEQ ID NO: 333495 - DNA, 25 bp, Homo sapien
ctctttctttagcagcctggaatca

SEQ ID NO: 333496 - DNA, 25 bp, Homo sapien
atgtttgagtggagatttgattgac

SEQ ID NO: 333497 - DNA, 25 bp, Homo sapien
ttgattgacaagaagccagccatgc

SEQ ID NO: 333498 - DNA, 25 bp, Homo sapien
gaaaatattaagtacgactgcaaga

SEQ ID NO: 333499 - DNA, 25 bp, Homo sapien
aagtacgactgcaagaagtaggaat

SEQ ID NO: 333500 - DNA, 25 bp, Homo sapien
agaagtaggaataaactcagtacat

SEQ ID NO: 333501 - DNA, 25 bp, Homo sapien
aaggctagtggctggagtgtggaga

SEQ ID NO: 333502 - DNA, 25 bp, Homo sapien
agagaggacatagtgccagacccat

SEQ ID NO: 333503 - DNA, 25 bp, Homo sapien
catagtgccagacccatgtccaaga

SEQ ID NO: 333504 - DNA, 25 bp, Homo sapien
gtgccagacccatgtccaagacctt

SEQ ID NO: 333505 - DNA, 25 bp, Homo sapien
aagacctttgtgcttgtctataagg

SEQ ID NO: 333506 - DNA, 25 bp, Homo sapien
agttatagtgtttggcttgaggtga

SEQ ID NO: 333507 - DNA, 25 bp, Homo sapien
aaaggctagcctgattcttcttgta

SEQ ID NO: 333508 - DNA, 25 bp, Homo sapien
gcctgattcttcttgtagttttgta

SEQ ID NO: 333509 - DNA, 25 bp, Homo sapien
aacactttgtatcgagagttctctg

SEQ ID NO: 333510 - DNA, 25 bp, Homo sapien
gtggtattacagaataatctgcccc

SEQ ID NO: 333511 - DNA, 25 bp, Homo sapien
tcctgattttgttaaagtgatacct

SEQ ID NO: 333512 - DNA, 25 bp, Homo sapien
tgtcttccatcatctatatgtctga

SEQ ID NO: 333513 - DNA, 25 bp, Homo sapien
acttgtttaagtggtcctggattca

SEQ ID NO: 333514 - DNA, 25 bp, Homo sapien
ggtcctggattcaccaaattttata

SEQ ID NO: 333515 - DNA, 25 bp, Homo sapien
aattttatagagctctgcctctgcc

SEQ ID NO: 333516 - DNA, 25 bp, Homo sapien
tgcctctgcctttattgggtaggcc

SEQ ID NO: 333517 - DNA, 25 bp, Homo sapien
gggtaggcctgatttttgatgatgt

SEQ ID NO: 333518 - DNA, 25 bp, Homo sapien
aaatattcagggtgagggtccatga

SEQ ID NO: 333519 - DNA, 25 bp, Homo sapien
gggtccatgagagtgctggctaata

SEQ ID NO: 333520 - DNA, 25 bp, Homo sapien
tggagacacacgacggaccttctag

SEQ ID NO: 333521 - DNA, 25 bp, Homo sapien
gaccttctagaaaagacattccctg

SEQ ID NO: 333522 - DNA, 25 bp, Homo sapien
ttccctgataaaaagcaatggtgcc

SEQ ID NO: 333523 - DNA, 25 bp, Homo sapien
aatggtgcccattgatgcttctgct

SEQ ID NO: 333524 - DNA, 25 bp, Homo sapien
tgatgcttctgctctttgttctacc

SEQ ID NO: 333525 - DNA, 25 bp, Homo sapien
tgccttcctgcctcgaatgagaata

SEQ ID NO: 333526 - DNA, 25 bp, Homo sapien
tgagaatatcaagaggcccctggca

SEQ ID NO: 333527 - DNA, 25 bp, Homo sapien
gaactcaatcatttccaactgtgtg

SEQ ID NO: 333528 - DNA, 25 bp, Homo sapien
atttccaactgtgtgaagggccaag

SEQ ID NO: 333529 - DNA, 25 bp, Homo sapien
ccaaatatgcacaaccgaagagagt

SEQ ID NO: 333530 - DNA, 25 bp, Homo sapien
gaagagagtacgacagagccttacg

SEQ ID NO: 333531 - DNA, 25 bp, Homo sapien
gagccttacgtgactcttaccttga

SEQ ID NO: 333532 - DNA, 25 bp, Homo sapien
actcttaccttgactctgtactgta

SEQ ID NO: 333533 - DNA, 25 bp, Homo sapien
tgtactgtagtttttcatcattcct

SEQ ID NO: 333534 - DNA, 25 bp, Homo sapien
atcattccttcgtcacttgcaaatt

SEQ ID NO: 333535 - DNA, 25 bp, Homo sapien
attccttcgtcacttgcaaattcaa

SEQ ID NO: 333536 - DNA, 25 bp, Homo sapien
attcaagtatttttcccagccatta

SEQ ID NO: 333537 - DNA, 25 bp, Homo sapien
gtatttttcccagccattaattgag

SEQ ID NO: 333538 - DNA, 25 bp, Homo sapien
cccagccattaattgagtttttgaa

SEQ ID NO: 333539 - DNA, 25 bp, Homo sapien
gtgcttattagccatttacttattt

SEQ ID NO: 333540 - DNA, 25 bp, Homo sapien
aaatgttctcttcctggtcttcaga

SEQ ID NO: 333541 - DNA, 25 bp, Homo sapien
gtcttcagagtacttgcagctgcct

SEQ ID NO: 333542 - DNA, 25 bp, Homo sapien
ctactctttctataactctacttgg

SEQ ID NO: 333543 - DNA, 25 bp, Homo sapien
actctacttggcttcagtactcaga

SEQ ID NO: 333544 - DNA, 25 bp, Homo sapien
agtactcagaaagcctttcccttgg

SEQ ID NO: 333545 - DNA, 25 bp, Homo sapien
agttctctctgtacgctgtgttgtt

SEQ ID NO: 333546 - DNA, 25 bp, Homo sapien
ctgtgttgtttgtctgcagcacaat

SEQ ID NO: 333547 - DNA, 25 bp, Homo sapien
ctatgtggttgctaaggctgggtcc

SEQ ID NO: 333548 - DNA, 25 bp, Homo sapien
gggattcttcacctattattctcag

SEQ ID NO: 333549 - DNA, 25 bp, Homo sapien
agttaatgtctaggccaaggcttcc

SEQ ID NO: 333550 - DNA, 25 bp, Homo sapien
ttcctagctgccatttggtccagat

SEQ ID NO: 333551 - DNA, 25 bp, Homo sapien
aaaacagtaggaaagcaatgaaaga

SEQ ID NO: 333552 - DNA, 25 bp, Homo sapien
aagaagctggtaagggaggcgtcgc

SEQ ID NO: 333553 - DNA, 25 bp, Homo sapien
aagctggtaagggaggcgtcgctga

SEQ ID NO: 333554 - DNA, 25 bp, Homo sapien
agctggtaagggaggcgtcgctgat

SEQ ID NO: 333555 - DNA, 25 bp, Homo sapien
gctggtaagggaggcgtcgctgatt

SEQ ID NO: 333556 - DNA, 25 bp, Homo sapien
gaggcgtcgctgattccagagagct

SEQ ID NO: 333557 - DNA, 25 bp, Homo sapien
aggcgtcgctgattccagagagcta

SEQ ID NO: 333558 - DNA, 25 bp, Homo sapien
ggcgtcgctgattccagagagctaa

SEQ ID NO: 333559 - DNA, 25 bp, Homo sapien
gcgtcgctgattccagagagctaaa

SEQ ID NO: 333560 - DNA, 25 bp, Homo sapien
cgtcgctgattccagagagctaaag

SEQ ID NO: 333561 - DNA, 25 bp, Homo sapien
tgattccagagagctaaagccgatg

SEQ ID NO: 333562 - DNA, 25 bp, Homo sapien
ataatggatgggttactatgagcaa

SEQ ID NO: 333563 - DNA, 25 bp, Homo sapien
atgggttactatgagcaatttcgct

SEQ ID NO: 333564 - DNA, 25 bp, Homo sapien
tgagcaatttcgctttcagaacccc

SEQ ID NO: 333565 - DNA, 25 bp, Homo sapien
cagaacccccttgttttagtatatg

SEQ ID NO: 333566 - DNA, 25 bp, Homo sapien
atatgaaaaagcctaatgcgcatta

SEQ ID NO: 333567 - DNA, 25 bp, Homo sapien
cctaatgcgcattaatgaggttgaa

SEQ ID NO: 333568 - DNA, 25 bp, Homo sapien
aacagctttgcttgtattgtgaaga

SEQ ID NO: 333569 - DNA, 25 bp, Homo sapien
gtaactattaacacagttttaacat

SEQ ID NO: 333570 - DNA, 25 bp, Homo sapien
taacataagttatcccactgggttt

SEQ ID NO: 333571 - DNA, 25 bp, Homo sapien
cccactgggtttaagagcatcttga

SEQ ID NO: 333572 - DNA, 25 bp, Homo sapien
gcatcttgaatgtataatccttttt

SEQ ID NO: 333573 - DNA, 25 bp, Homo sapien
tgaactgacagtttctcctaacttt

SEQ ID NO: 333574 - DNA, 25 bp, Homo sapien
ttctcctaactttctgctttagcgt

SEQ ID NO: 333575 - DNA, 25 bp, Homo sapien
ctgctttagcgtaattgctcagagt

SEQ ID NO: 333576 - DNA, 25 bp, Homo sapien
gtaattgctcagagtagagagcccc

SEQ ID NO: 333577 - DNA, 25 bp, Homo sapien
agcagcaatccaccagtttttctaa

SEQ ID NO: 333578 - DNA, 25 bp, Homo sapien
aatccaccagtttttctaagctaga

SEQ ID NO: 333579 - DNA, 25 bp, Homo sapien
tctaagctagaacctttgagtcccc

SEQ ID NO: 333580 - DNA, 25 bp, Homo sapien
gggcactggaagtcactttgataga

SEQ ID NO: 333581 - DNA, 25 bp, Homo sapien
cctgggacggtttctatctatcaaa

SEQ ID NO: 333582 - DNA, 25 bp, Homo sapien
atcaaaggaaggttttcacctgtag

SEQ ID NO: 333583 - DNA, 25 bp, Homo sapien
gccaaatagtcccatgctgactttc

SEQ ID NO: 333584 - DNA, 25 bp, Homo sapien
tgtaagaagcccctgctgtgttctg

SEQ ID NO: 333585 - DNA, 25 bp, Homo sapien
caaagcagtttcctgtgttacctaa

SEQ ID NO: 333586 - DNA, 25 bp, Homo sapien
ctgtgttacctaaatgttgatatca

SEQ ID NO: 333587 - DNA, 25 bp, Homo sapien
gttgatatcatcctagaccatgcca

SEQ ID NO: 333588 - DNA, 25 bp, Homo sapien
tatcatcctagaccatgccacagaa

SEQ ID NO: 333589 - DNA, 25 bp, Homo sapien
gccacagaagcctgtttatgtttaa

SEQ ID NO: 333590 - DNA, 25 bp, Homo sapien
aatactgatgagtttgacactgata

SEQ ID NO: 333591 - DNA, 25 bp, Homo sapien
gcattttgttatattactagccctg

SEQ ID NO: 333592 - DNA, 25 bp, Homo sapien
gcatcttgactgctctacagacttg

SEQ ID NO: 333593 - DNA, 25 bp, Homo sapien
tctacagacttgcatctgcgaccct

SEQ ID NO: 333594 - DNA, 25 bp, Homo sapien
atctgcgacccttctagtcataaat

SEQ ID NO: 333595 - DNA, 25 bp, Homo sapien
ttggcttggtttcttgcctcctttt

SEQ ID NO: 333596 - DNA, 25 bp, Homo sapien
tccttttttggcagccttcatcttc

SEQ ID NO: 333597 - DNA, 25 bp, Homo sapien
tcttttaaaactgggactgatactt

SEQ ID NO: 333598 - DNA, 25 bp, Homo sapien
cttttttgagagagtatcgtgtcga

SEQ ID NO: 333599 - DNA, 25 bp, Homo sapien
tatcgtgtcgaaagtgtgatgttct

SEQ ID NO: 333600 - DNA, 25 bp, Homo sapien
aagtgtgatgttctaccactttacc

SEQ ID NO: 333601 - DNA, 25 bp, Homo sapien
atacacattgtcctctcgatttttg

SEQ ID NO: 333602 - DNA, 25 bp, Homo sapien
tgtcctctcgatttttggaccaaac

SEQ ID NO: 333603 - DNA, 25 bp, Homo sapien
ttggaccaaacagacgctcacagtg

SEQ ID NO: 333604 - DNA, 25 bp, Homo sapien
gacgctcacagtggaggcttatcaa

SEQ ID NO: 333605 - DNA, 25 bp, Homo sapien
tggaggcttatcaagggttgcattg

SEQ ID NO: 333606 - DNA, 25 bp, Homo sapien
gctcatccttgcttttggtttctca

SEQ ID NO: 333607 - DNA, 25 bp, Homo sapien
ttgcttttggtttctcaggtctcca

SEQ ID NO: 333608 - DNA, 25 bp, Homo sapien
tttctcaggtctccatgccagtgaa

SEQ ID NO: 333609 - DNA, 25 bp, Homo sapien
ctcaggtctccatgccagtgaaatg

SEQ ID NO: 333610 - DNA, 25 bp, Homo sapien
ccaccgtccctgtgtgtcaggcaag

SEQ ID NO: 333611 - DNA, 25 bp, Homo sapien
gtccctgtgtgtcaggcaagcccga

SEQ ID NO: 333612 - DNA, 25 bp, Homo sapien
gagtcttgaaagtccttaaaccacg

SEQ ID NO: 333613 - DNA, 25 bp, Homo sapien
aaaccacgggagactatctggcaca

SEQ ID NO: 333614 - DNA, 25 bp, Homo sapien
gggagactatctggcacatgacacg

SEQ ID NO: 333615 - DNA, 25 bp, Homo sapien
gactatctggcacatgacacgggat

SEQ ID NO: 333616 - DNA, 25 bp, Homo sapien
cacatgacacgggatgagacttggt

SEQ ID NO: 333617 - DNA, 25 bp, Homo sapien
cactggaagtcactttgatagatgg

SEQ ID NO: 333618 - DNA, 25 bp, Homo sapien
ctggaagtcactttgatagatggat

SEQ ID NO: 333619 - DNA, 25 bp, Homo sapien
tggaagtcactttgatagatggatt

SEQ ID NO: 333620 - DNA, 25 bp, Homo sapien
tatctatcaaaggaaggttttcacc

SEQ ID NO: 333621 - DNA, 25 bp, Homo sapien
tctatcaaaggaaggttttcacctg

SEQ ID NO: 333622 - DNA, 25 bp, Homo sapien
tcaaaggaaggttttcacctgtaga

SEQ ID NO: 333623 - DNA, 25 bp, Homo sapien
gttttcacctgtagaaagccccctg

SEQ ID NO: 333624 - DNA, 25 bp, Homo sapien
ctccagccaaatagtcccatgctga

SEQ ID NO: 333625 - DNA, 25 bp, Homo sapien
cagccaaatagtcccatgctgactt

SEQ ID NO: 333626 - DNA, 25 bp, Homo sapien
gccaaatagtcccatgctgactttc

SEQ ID NO: 333627 - DNA, 25 bp, Homo sapien
caaatagtcccatgctgactttcta

SEQ ID NO: 333628 - DNA, 25 bp, Homo sapien
ggaagcatcttctgtaactttttct

SEQ ID NO: 333629 - DNA, 25 bp, Homo sapien
cttctgtaactttttctctcctata

SEQ ID NO: 333630 - DNA, 25 bp, Homo sapien
gaagcactgctgaagcatttctttt

SEQ ID NO: 333631 - DNA, 25 bp, Homo sapien
aaactaactggtttcaatgacacag

SEQ ID NO: 333632 - DNA, 25 bp, Homo sapien
aatgacacagtcaggtccagtccac

SEQ ID NO: 333633 - DNA, 25 bp, Homo sapien
accttcttcaaggtcactgtgctct

SEQ ID NO: 333634 - DNA, 25 bp, Homo sapien
gtgctctgccaagaataattctttt

SEQ ID NO: 333635 - DNA, 25 bp, Homo sapien
tatatttagtttcctgctgcaagga

SEQ ID NO: 333636 - DNA, 25 bp, Homo sapien
acaggagctctaactgttcctggca

SEQ ID NO: 333637 - DNA, 25 bp, Homo sapien
taatttcttctattgaacagttctt

SEQ ID NO: 333638 - DNA, 25 bp, Homo sapien
gaacagttctttaacacatcaggaa

SEQ ID NO: 333639 - DNA, 25 bp, Homo sapien
ttccatttttgcctagtgaatttag

SEQ ID NO: 333640 - DNA, 25 bp, Homo sapien
aaagtccttccagtaataaagctgc

SEQ ID NO: 333641 - DNA, 25 bp, Homo sapien
aactttattggaatcttctgcacga

SEQ ID NO: 333642 - DNA, 25 bp, Homo sapien
ggaatcttctgcacgaaccatatta

SEQ ID NO: 333643 - DNA, 25 bp, Homo sapien
aataggattccatatggctctcata

SEQ ID NO: 333644 - DNA, 25 bp, Homo sapien
atggctctcatatcattccattcca

SEQ ID NO: 333645 - DNA, 25 bp, Homo sapien
attccattccatctctgccaagatt

SEQ ID NO: 333646 - DNA, 25 bp, Homo sapien
ctctgccaagatttggataccgcaa

SEQ ID NO: 333647 - DNA, 25 bp, Homo sapien
gtttgtggaagattctgtctgaact

SEQ ID NO: 333648 - DNA, 25 bp, Homo sapien
gaactctttcattcaaggaactact

SEQ ID NO: 333649 - DNA, 25 bp, Homo sapien
aggaactactaccatgaatctgcat

SEQ ID NO: 333650 - DNA, 25 bp, Homo sapien
tacattgaagcagaggttactattt

SEQ ID NO: 333651 - DNA, 25 bp, Homo sapien
ttgaagcagaggttactattttatt

SEQ ID NO: 333652 - DNA, 25 bp, Homo sapien
cttatatcagtattgcagcattcac

SEQ ID NO: 333653 - DNA, 25 bp, Homo sapien
gtattgcagcattcactgtagtgat

SEQ ID NO: 333654 - DNA, 25 bp, Homo sapien
gcagcattcactgtagtgatagaaa

SEQ ID NO: 333655 - DNA, 25 bp, Homo sapien
agttaggaacatagccaattaggac

SEQ ID NO: 333656 - DNA, 25 bp, Homo sapien
tagccaattaggacaaggaggattt

SEQ ID NO: 333657 - DNA, 25 bp, Homo sapien
ttttacaagctgatgattgttgcat

SEQ ID NO: 333658 - DNA, 25 bp, Homo sapien
caagctgatgattgttgcattttgg

SEQ ID NO: 333659 - DNA, 25 bp, Homo sapien
tgcattttggagttgcaacaacatt

SEQ ID NO: 333660 - DNA, 25 bp, Homo sapien
gagttgcaacaacattaaaacagtt

SEQ ID NO: 333661 - DNA, 25 bp, Homo sapien
agccagcgcccatgttgtgatacag

SEQ ID NO: 333662 - DNA, 25 bp, Homo sapien
tagaaaaactcaggcccatccattt

SEQ ID NO: 333663 - DNA, 25 bp, Homo sapien
atccattttctcagatctccttgaa

SEQ ID NO: 333664 - DNA, 25 bp, Homo sapien
aattgaggccttttcgatagtttcg

SEQ ID NO: 333665 - DNA, 25 bp, Homo sapien
tcgggtcaggtaaaaatggcctcct

SEQ ID NO: 333666 - DNA, 25 bp, Homo sapien
aaatggcctcctggcgtaagctttt

SEQ ID NO: 333667 - DNA, 25 bp, Homo sapien
tcctggcgtaagcttttcaaggttt

SEQ ID NO: 333668 - DNA, 25 bp, Homo sapien
gataggaactttggaccttgaactt

SEQ ID NO: 333669 - DNA, 25 bp, Homo sapien
ggaccttgaacttacgtatcatgtg

SEQ ID NO: 333670 - DNA, 25 bp, Homo sapien
acttacgtatcatgtggagaagagc

SEQ ID NO: 333671 - DNA, 25 bp, Homo sapien
gaagagccaatttaacaaactagga

SEQ ID NO: 333672 - DNA, 25 bp, Homo sapien
tgagagtctcactttataaaatggg

SEQ ID NO: 333673 - DNA, 25 bp, Homo sapien
aaatgggaacaatgattgccttaaa

SEQ ID NO: 333674 - DNA, 25 bp, Homo sapien
gattgccttaaagggtggttgtcaa

SEQ ID NO: 333675 - DNA, 25 bp, Homo sapien
gtagcaaagcttacaatgcatttta

SEQ ID NO: 333676 - DNA, 25 bp, Homo sapien
gagttacctatcttacctgttatct

SEQ ID NO: 333677 - DNA, 25 bp, Homo sapien
atcttacctgttatcttctgctgtc

SEQ ID NO: 333678 - DNA, 25 bp, Homo sapien
gtccttattcccagcaagggtttgg

SEQ ID NO: 333679 - DNA, 25 bp, Homo sapien
tcccagcaagggtttggcaaattac

SEQ ID NO: 333680 - DNA, 25 bp, Homo sapien
aaaacacaggctttaaagtcagaga

SEQ ID NO: 333681 - DNA, 25 bp, Homo sapien
gtccaagttgaaatgccagttctgc

SEQ ID NO: 333682 - DNA, 25 bp, Homo sapien
tctcagccacctaacttttgagagt

SEQ ID NO: 333683 - DNA, 25 bp, Homo sapien
gtagcacttataactttagcattat

SEQ ID NO: 333684 - DNA, 25 bp, Homo sapien
agcattattgcctaacacaacagtt

SEQ ID NO: 333685 - DNA, 25 bp, Homo sapien
acaacagttctaccattaatcatac

SEQ ID NO: 333686 - DNA, 25 bp, Homo sapien
aatcatactacatgttcatccttct

SEQ ID NO: 333687 - DNA, 25 bp, Homo sapien
gttcatccttctaaatgtcattatc

SEQ ID NO: 333688 - DNA, 25 bp, Homo sapien
gtcattatcaatttaggtagcctgt

SEQ ID NO: 333689 - DNA, 25 bp, Homo sapien
ggtagcctgtaagagtattgaattt

SEQ ID NO: 333690 - DNA, 25 bp, Homo sapien
tgttgggcattttatcccctggtag

SEQ ID NO: 333691 - DNA, 25 bp, Homo sapien
gcattttatcccctggtagtgatat

SEQ ID NO: 333692 - DNA, 25 bp, Homo sapien
aatcctccaaatccttcatattctc

SEQ ID NO: 333693 - DNA, 25 bp, Homo sapien
caaatccttcatattctcaagtagc

SEQ ID NO: 333694 - DNA, 25 bp, Homo sapien
gaaatgattagattctgaacatatg

SEQ ID NO: 333695 - DNA, 25 bp, Homo sapien
gattagattctgaacatatgtaatt

SEQ ID NO: 333696 - DNA, 25 bp, Homo sapien
tcagtctttttcaaagatacaaata

SEQ ID NO: 333697 - DNA, 25 bp, Homo sapien
tatacaatttaatgtcctagtgttt

SEQ ID NO: 333698 - DNA, 25 bp, Homo sapien
caatttaatgtcctagtgttttact

SEQ ID NO: 333699 - DNA, 25 bp, Homo sapien
ttaatgtcctagtgttttacttaat

SEQ ID NO: 333700 - DNA, 25 bp, Homo sapien
aatgtcctagtgttttacttaatag

SEQ ID NO: 333701 - DNA, 25 bp, Homo sapien
atgtcctagtgttttacttaatagt

SEQ ID NO: 333702 - DNA, 25 bp, Homo sapien
gtcctagtgttttacttaatagtgt

SEQ ID NO: 333703 - DNA, 25 bp, Homo sapien
ctagtgttttacttaatagtgtatc

SEQ ID NO: 333704 - DNA, 25 bp, Homo sapien
tacttaatagtgtatcatgttttcc

SEQ ID NO: 333705 - DNA, 25 bp, Homo sapien
ttttcattggctttaagttgagggt

SEQ ID NO: 333706 - DNA, 25 bp, Homo sapien
ttcattggctttaagttgagggttt

SEQ ID NO: 333707 - DNA, 25 bp, Homo sapien
ggatagataatggtacttctggctt

SEQ ID NO: 333708 - DNA, 25 bp, Homo sapien
atagataatggtacttctggcttta

SEQ ID NO: 333709 - DNA, 25 bp, Homo sapien
tagataatggtacttctggctttat

SEQ ID NO: 333710 - DNA, 25 bp, Homo sapien
gataatggtacttctggctttattt

SEQ ID NO: 333711 - DNA, 25 bp, Homo sapien
taatggtacttctggctttatttaa

SEQ ID NO: 333712 - DNA, 25 bp, Homo sapien
ttagggaaaccattgtatttataca

SEQ ID NO: 333713 - DNA, 25 bp, Homo sapien
ggaaaccattgtatttatacatgca

SEQ ID NO: 333714 - DNA, 25 bp, Homo sapien
ttttgtattggagatgggttcttac

SEQ ID NO: 333715 - DNA, 25 bp, Homo sapien
tattggagatgggttcttactatgt

SEQ ID NO: 333716 - DNA, 25 bp, Homo sapien
ccggcctccccgtgctgagcagaga

SEQ ID NO: 333717 - DNA, 25 bp, Homo sapien
tagctgcaggagtgtgccccgatgc

SEQ ID NO: 333718 - DNA, 25 bp, Homo sapien
agctgcaggagtgtgccccgatgcg

SEQ ID NO: 333719 - DNA, 25 bp, Homo sapien
gctgcaggagtgtgccccgatgcgc

SEQ ID NO: 333720 - DNA, 25 bp, Homo sapien
ctgcaggagtgtgccccgatgcgca

SEQ ID NO: 333721 - DNA, 25 bp, Homo sapien
caggagtgtgccccgatgcgcacct

SEQ ID NO: 333722 - DNA, 25 bp, Homo sapien
gagtgtgccccgatgcgcacctgcc

SEQ ID NO: 333723 - DNA, 25 bp, Homo sapien
gtgtgccccgatgcgcacctgccga

SEQ ID NO: 333724 - DNA, 25 bp, Homo sapien
cgatgcgcacctgccgactttcctt

SEQ ID NO: 333725 - DNA, 25 bp, Homo sapien
tgcgcacctgccgactttccttctg

SEQ ID NO: 333726 - DNA, 25 bp, Homo sapien
gcgcacctgccgactttccttctga

SEQ ID NO: 333727 - DNA, 25 bp, Homo sapien
gcaagagcgcttcccattccggaga

SEQ ID NO: 333728 - DNA, 25 bp, Homo sapien
attccggagacgtttcaaccctgca

SEQ ID NO: 333729 - DNA, 25 bp, Homo sapien
tttcaaccctgcagcgggaaaggct

SEQ ID NO: 333730 - DNA, 25 bp, Homo sapien
atccattttgggtgggcaatttcct

SEQ ID NO: 333731 - DNA, 25 bp, Homo sapien
gcaatttccttcaacgaagccggaa

SEQ ID NO: 333732 - DNA, 25 bp, Homo sapien
cggttttcaggaatctaaactctca

SEQ ID NO: 333733 - DNA, 25 bp, Homo sapien
actctcatcttgtgcaatttatcag

SEQ ID NO: 333734 - DNA, 25 bp, Homo sapien
tgtggaactgttctactgtgcgtgt

SEQ ID NO: 333735 - DNA, 25 bp, Homo sapien
gaatatttcacatccatccagagct

SEQ ID NO: 333736 - DNA, 25 bp, Homo sapien
agagctcggaatctacagcgtccag

SEQ ID NO: 333737 - DNA, 25 bp, Homo sapien
agcgtccagccatttccagcaagag

SEQ ID NO: 333738 - DNA, 25 bp, Homo sapien
atatatttcactttgactttagacc

SEQ ID NO: 333739 - DNA, 25 bp, Homo sapien
gttttgaaatacagtctccacttac

SEQ ID NO: 333740 - DNA, 25 bp, Homo sapien
tttgaaatacagtctccacttacga

SEQ ID NO: 333741 - DNA, 25 bp, Homo sapien
ttgaaatacagtctccacttacgaa

SEQ ID NO: 333742 - DNA, 25 bp, Homo sapien
tgaaatacagtctccacttacgaat

SEQ ID NO: 333743 - DNA, 25 bp, Homo sapien
gaaatacagtctccacttacgaatg

SEQ ID NO: 333744 - DNA, 25 bp, Homo sapien
aaatacagtctccacttacgaatgt

SEQ ID NO: 333745 - DNA, 25 bp, Homo sapien
aatacagtctccacttacgaatgtc

SEQ ID NO: 333746 - DNA, 25 bp, Homo sapien
atacagtctccacttacgaatgtca

SEQ ID NO: 333747 - DNA, 25 bp, Homo sapien
tacagtctccacttacgaatgtcat

SEQ ID NO: 333748 - DNA, 25 bp, Homo sapien
acagtctccacttacgaatgtcata

SEQ ID NO: 333749 - DNA, 25 bp, Homo sapien
tcagggtttgagagccatagccagc

SEQ ID NO: 333750 - DNA, 25 bp, Homo sapien
ggtttgagagccatagccagctctg

SEQ ID NO: 333751 - DNA, 25 bp, Homo sapien
gatgccccagcctgtggttttcaca

SEQ ID NO: 333752 - DNA, 25 bp, Homo sapien
cagcctgtggttttcacagagttat

SEQ ID NO: 333753 - DNA, 25 bp, Homo sapien
tgtaaaagccataggcgtccccatt

SEQ ID NO: 333754 - DNA, 25 bp, Homo sapien
ataggcgtccccattcttgtccatt

SEQ ID NO: 333755 - DNA, 25 bp, Homo sapien
ccccattcttgtccattacattttt

SEQ ID NO: 333756 - DNA, 25 bp, Homo sapien
gacttgtactgtcttttcagcaggc

SEQ ID NO: 333757 - DNA, 25 bp, Homo sapien
gtcttttcagcaggcatccagtatg

SEQ ID NO: 333758 - DNA, 25 bp, Homo sapien
tatgcagttgcatagtagactcctg

SEQ ID NO: 333759 - DNA, 25 bp, Homo sapien
atagtagactcctgcaggtttcggc

SEQ ID NO: 333760 - DNA, 25 bp, Homo sapien
aatcccaggtcctgtagcagcagct

SEQ ID NO: 333761 - DNA, 25 bp, Homo sapien
atgccgtgcagagcctgaactcagg

SEQ ID NO: 333762 - DNA, 25 bp, Homo sapien
gaactcaggatgacacctgcacctg

SEQ ID NO: 333763 - DNA, 25 bp, Homo sapien
tgggctctggcacaggaagccctca

SEQ ID NO: 333764 - DNA, 25 bp, Homo sapien
gcacagccatgccatagccagacaa

SEQ ID NO: 333765 - DNA, 25 bp, Homo sapien
atagccagacaacagctcgctgtac

SEQ ID NO: 333766 - DNA, 25 bp, Homo sapien
tcgctgtaccacaccatcatgggag

SEQ ID NO: 333767 - DNA, 25 bp, Homo sapien
caccatcatgggagacagcagttat

SEQ ID NO: 333768 - DNA, 25 bp, Homo sapien
cagcagttattctgagcatctcact

SEQ ID NO: 333769 - DNA, 25 bp, Homo sapien
ggctcagagaggaccatgcatgcac

SEQ ID NO: 333770 - DNA, 25 bp, Homo sapien
gtgggagtcccaggcaatcccaggt

SEQ ID NO: 333771 - DNA, 25 bp, Homo sapien
aaaaaccaaccctggcatttgcaca

SEQ ID NO: 333772 - DNA, 25 bp, Homo sapien
aaaaccaaccctggcatttgcacaa

SEQ ID NO: 333773 - DNA, 25 bp, Homo sapien
atgcaaatggagtgatatggccttt

SEQ ID NO: 333774 - DNA, 25 bp, Homo sapien
gcaaatggagtgatatggcctttaa

SEQ ID NO: 333775 - DNA, 25 bp, Homo sapien
atggagtgatatggcctttaaggaa

SEQ ID NO: 333776 - DNA, 25 bp, Homo sapien
tggcctttaaggaaggagttagtag

SEQ ID NO: 333777 - DNA, 25 bp, Homo sapien
gaaaatccagagaaaatgatgtact

SEQ ID NO: 333778 - DNA, 25 bp, Homo sapien
aaatgatgtactaatttctttcttt

SEQ ID NO: 333779 - DNA, 25 bp, Homo sapien
aacataaatatgtttgggtgactgg

SEQ ID NO: 333780 - DNA, 25 bp, Homo sapien
ggattatacattcaagatgctctta

SEQ ID NO: 333781 - DNA, 25 bp, Homo sapien
acattcaagatgctcttaaacccag

SEQ ID NO: 333782 - DNA, 25 bp, Homo sapien
gattgccctacatgtaacagctacg

SEQ ID NO: 333783 - DNA, 25 bp, Homo sapien
ttgccctacatgtaacagctacgta

SEQ ID NO: 333784 - DNA, 25 bp, Homo sapien
gccctacatgtaacagctacgtaca

SEQ ID NO: 333785 - DNA, 25 bp, Homo sapien
tacatgtaacagctacgtacaaaaa

SEQ ID NO: 333786 - DNA, 25 bp, Homo sapien
aattctccaattgaacaaggtatgc

SEQ ID NO: 333787 - DNA, 25 bp, Homo sapien
gaacaaggtatgcaaggatttttat

SEQ ID NO: 333788 - DNA, 25 bp, Homo sapien
tgagagcaaaataacttactggaat

SEQ ID NO: 333789 - DNA, 25 bp, Homo sapien
gagcaaaataacttactggaatata

SEQ ID NO: 333790 - DNA, 25 bp, Homo sapien
gtttatttaaacaacaagacgcttg

SEQ ID NO: 333791 - DNA, 25 bp, Homo sapien
caacaagacgcttgacttgaaggga

SEQ ID NO: 333792 - DNA, 25 bp, Homo sapien
caagacgcttgacttgaagggaaaa

SEQ ID NO: 333793 - DNA, 25 bp, Homo sapien
agcagaccgcactgcggaccactgt

SEQ ID NO: 333794 - DNA, 25 bp, Homo sapien
gcactgcggaccactgtgctttccg

SEQ ID NO: 333795 - DNA, 25 bp, Homo sapien
ggaccactgtgctttccgcaacctg

SEQ ID NO: 333796 - DNA, 25 bp, Homo sapien
tgctttccgcaacctgctgctggta

SEQ ID NO: 333797 - DNA, 25 bp, Homo sapien
ttccgcaacctgctgctggtacggc

SEQ ID NO: 333798 - DNA, 25 bp, Homo sapien
ccaggccagcattcggctctggaaa

SEQ ID NO: 333799 - DNA, 25 bp, Homo sapien
cagcattcggctctggaaacaactg

SEQ ID NO: 333800 - DNA, 25 bp, Homo sapien
attcggctctggaaacaactgcaag

SEQ ID NO: 333801 - DNA, 25 bp, Homo sapien
gtgtggcacccttcccctttgagga

SEQ ID NO: 333802 - DNA, 25 bp, Homo sapien
actggcctttgcatccgagccctgg

SEQ ID NO: 333803 - DNA, 25 bp, Homo sapien
tggcctttgcatccgagccctgggc

SEQ ID NO: 333804 - DNA, 25 bp, Homo sapien
tttctcatttgtgttattctcctat

SEQ ID NO: 333805 - DNA, 25 bp, Homo sapien
atttgtgttattctcctatttgata

SEQ ID NO: 333806 - DNA, 25 bp, Homo sapien
atatagtgactatctctttatgggt

SEQ ID NO: 333807 - DNA, 25 bp, Homo sapien
ggccagaattcaagatctgccccta

SEQ ID NO: 333808 - DNA, 25 bp, Homo sapien
gaattcaagatctgcccctaactaa

SEQ ID NO: 333809 - DNA, 25 bp, Homo sapien
ctaactaatcctacttctcccagta

SEQ ID NO: 333810 - DNA, 25 bp, Homo sapien
ttacagcactcctaccctactagta

SEQ ID NO: 333811 - DNA, 25 bp, Homo sapien
ctcctaccctactagtaactctgat

SEQ ID NO: 333812 - DNA, 25 bp, Homo sapien
gtaactctgatatctcatagtcctc

SEQ ID NO: 333813 - DNA, 25 bp, Homo sapien
gatatctcatagtcctcagatttat

SEQ ID NO: 333814 - DNA, 25 bp, Homo sapien
acgaaactgaatgagcactactata

SEQ ID NO: 333815 - DNA, 25 bp, Homo sapien
gtttgaataattgcagggccagcct

SEQ ID NO: 333816 - DNA, 25 bp, Homo sapien
tcccattcagcaatcaaccagacta

SEQ ID NO: 333817 - DNA, 25 bp, Homo sapien
accagactaaggagttttgatccct

SEQ ID NO: 333818 - DNA, 25 bp, Homo sapien
gagttttgatccctagtgattacag

SEQ ID NO: 333819 - DNA, 25 bp, Homo sapien
ctagtgattacagccctgaagaaaa

SEQ ID NO: 333820 - DNA, 25 bp, Homo sapien
aattaattttacatggccttcgtga

SEQ ID NO: 333821 - DNA, 25 bp, Homo sapien
ttacatggccttcgtgatctttctg

SEQ ID NO: 333822 - DNA, 25 bp, Homo sapien
gccttcgtgatctttctgctgttct

SEQ ID NO: 333823 - DNA, 25 bp, Homo sapien
gttcttactttttcgaatgtagttg

SEQ ID NO: 333824 - DNA, 25 bp, Homo sapien
cattttgcacatacatgtattgtac

SEQ ID NO: 333825 - DNA, 25 bp, Homo sapien
gtattgtacaacagtaagatcctct

SEQ ID NO: 333826 - DNA, 25 bp, Homo sapien
ggtttgttggactttcataaattga

SEQ ID NO: 333827 - DNA, 25 bp, Homo sapien
aattgagtacaatctttgcatcaaa

SEQ ID NO: 333828 - DNA, 25 bp, Homo sapien
aatctttgcatcaaactacctgcta

SEQ ID NO: 333829 - DNA, 25 bp, Homo sapien
aactacctgctacaataatgacttt

SEQ ID NO: 333830 - DNA, 25 bp, Homo sapien
aaaaatgtagaaggttgcaccaaca

SEQ ID NO: 333831 - DNA, 25 bp, Homo sapien
ttattcttagaacactttcaatggg

SEQ ID NO: 333832 - DNA, 25 bp, Homo sapien
gggttgcattgtccttttagtgcct

SEQ ID NO: 333833 - DNA, 25 bp, Homo sapien
gcattgtccttttagtgccttaatt

SEQ ID NO: 333834 - DNA, 25 bp, Homo sapien
ccttttagtgccttaatttgagata

SEQ ID NO: 333835 - DNA, 25 bp, Homo sapien
gagataattattttactgccatgag

SEQ ID NO: 333836 - DNA, 25 bp, Homo sapien
gtgtgtcagtgagtttttcattgat

SEQ ID NO: 333837 - DNA, 25 bp, Homo sapien
gttaacaccaatggacattttagga

SEQ ID NO: 333838 - DNA, 25 bp, Homo sapien
tataggccggacttattactaacca

SEQ ID NO: 333839 - DNA, 25 bp, Homo sapien
ggccggacttattactaaccacctg

SEQ ID NO: 333840 - DNA, 25 bp, Homo sapien
acttattactaaccacctgcctcag

SEQ ID NO: 333841 - DNA, 25 bp, Homo sapien
cagcaattacctacattcaattgct

SEQ ID NO: 333842 - DNA, 25 bp, Homo sapien
attcaattgctttgcataacctctg

SEQ ID NO: 333843 - DNA, 25 bp, Homo sapien
aattgctttgcataacctctgcctt

SEQ ID NO: 333844 - DNA, 25 bp, Homo sapien
tagggtacaaggcctttaatgttgt

SEQ ID NO: 333845 - DNA, 25 bp, Homo sapien
aatgttgtccacgttaagcaatgag

SEQ ID NO: 333846 - DNA, 25 bp, Homo sapien
gtccacgttaagcaatgaggatcat

SEQ ID NO: 333847 - DNA, 25 bp, Homo sapien
aagcaatgaggatcatgacaggaaa

SEQ ID NO: 333848 - DNA, 25 bp, Homo sapien
tctctgggctttttggaaattacta

SEQ ID NO: 333849 - DNA, 25 bp, Homo sapien
tgggaaaccttgtggaggagaaata

SEQ ID NO: 333850 - DNA, 25 bp, Homo sapien
aatgatagttaatgcttattgtagc

SEQ ID NO: 333851 - DNA, 25 bp, Homo sapien
ttgaatttctttgggttgatctttt

SEQ ID NO: 333852 - DNA, 25 bp, Homo sapien
cattttctaccgtgttgcctatggg

SEQ ID NO: 333853 - DNA, 25 bp, Homo sapien
ttctaccgtgttgcctatgggttta

SEQ ID NO: 333854 - DNA, 25 bp, Homo sapien
accgtgttgcctatgggtttaggag

SEQ ID NO: 333855 - DNA, 25 bp, Homo sapien
tttatgcttgggtatttgttatctc

SEQ ID NO: 333856 - DNA, 25 bp, Homo sapien
cttgggtatttgttatctctgggct

SEQ ID NO: 333857 - DNA, 25 bp, Homo sapien
ggtatttgttatctctgggcttttt

SEQ ID NO: 333858 - DNA, 25 bp, Homo sapien
tttgttatctctgggctttttggaa

SEQ ID NO: 333859 - DNA, 25 bp, Homo sapien
gaacactagagattccagactccct

SEQ ID NO: 333860 - DNA, 25 bp, Homo sapien
aaaatatgttcgactgacttccagg

SEQ ID NO: 333861 - DNA, 25 bp, Homo sapien
cttccaggagttccgaaaggcagaa

SEQ ID NO: 333862 - DNA, 25 bp, Homo sapien
tgaggctaggccatatgtgcattgt

SEQ ID NO: 333863 - DNA, 25 bp, Homo sapien
aagcaatgtcatcaactgtcaggtt

SEQ ID NO: 333864 - DNA, 25 bp, Homo sapien
tttcacagtgacatctcatcagctc

SEQ ID NO: 333865 - DNA, 25 bp, Homo sapien
tcatcagctccctattgtcaagaag

SEQ ID NO: 333866 - DNA, 25 bp, Homo sapien
gtagctccaaagtctttgagccctt

SEQ ID NO: 333867 - DNA, 25 bp, Homo sapien
tttgagccctttcccagtcaaatgc

SEQ ID NO: 333868 - DNA, 25 bp, Homo sapien
cagtcaaatgctcccaacagggcat

SEQ ID NO: 333869 - DNA, 25 bp, Homo sapien
ggcatcccttattctgacctcagag

SEQ ID NO: 333870 - DNA, 25 bp, Homo sapien
cccctccggtgcagaggtcctgtga

SEQ ID NO: 333871 - DNA, 25 bp, Homo sapien
cctccggtgcagaggtcctgtgaca

SEQ ID NO: 333872 - DNA, 25 bp, Homo sapien
ctccggtgcagaggtcctgtgacac

SEQ ID NO: 333873 - DNA, 25 bp, Homo sapien
tccggtgcagaggtcctgtgacacc

SEQ ID NO: 333874 - DNA, 25 bp, Homo sapien
ccggtgcagaggtcctgtgacacca

SEQ ID NO: 333875 - DNA, 25 bp, Homo sapien
cggtgcagaggtcctgtgacaccag

SEQ ID NO: 333876 - DNA, 25 bp, Homo sapien
ggtgcagaggtcctgtgacaccagt

SEQ ID NO: 333877 - DNA, 25 bp, Homo sapien
gtgcagaggtcctgtgacaccagtg

SEQ ID NO: 333878 - DNA, 25 bp, Homo sapien
tgcagaggtcctgtgacaccagtgg

SEQ ID NO: 333879 - DNA, 25 bp, Homo sapien
gcagaggtcctgtgacaccagtggc

SEQ ID NO: 333880 - DNA, 25 bp, Homo sapien
cagaggtcctgtgacaccagtggca

SEQ ID NO: 333881 - DNA, 25 bp, Homo sapien
agtgcccagtcctgcttataaacct

SEQ ID NO: 333882 - DNA, 25 bp, Homo sapien
tgcttataaacctgaggcctgctcc

SEQ ID NO: 333883 - DNA, 25 bp, Homo sapien
aagtgccagccgttattccaggcag

SEQ ID NO: 333884 - DNA, 25 bp, Homo sapien
aggcagcccaatgttgttgaggcca

SEQ ID NO: 333885 - DNA, 25 bp, Homo sapien
caatgttgttgaggccagatggatt

SEQ ID NO: 333886 - DNA, 25 bp, Homo sapien
agctggcccatggatgtgagtcatc

SEQ ID NO: 333887 - DNA, 25 bp, Homo sapien
gaggtcttaacctaatgcgcataga

SEQ ID NO: 333888 - DNA, 25 bp, Homo sapien
gttctcattgtaaacatacccctgt

SEQ ID NO: 333889 - DNA, 25 bp, Homo sapien
atacccctgtccttagctgatctag

SEQ ID NO: 333890 - DNA, 25 bp, Homo sapien
ttagctgatctaggtggaagcccag

SEQ ID NO: 333891 - DNA, 25 bp, Homo sapien
ggtggaagcccagcttcatgtgcta

SEQ ID NO: 333892 - DNA, 25 bp, Homo sapien
attagggcaaaatccctcaatgatg

SEQ ID NO: 333893 - DNA, 25 bp, Homo sapien
aaagtaagtttcaacctcattctgt

SEQ ID NO: 333894 - DNA, 25 bp, Homo sapien
aagtttcaacctcattctgtatatc

SEQ ID NO: 333895 - DNA, 25 bp, Homo sapien
acctcattctgtatatctttatgca

SEQ ID NO: 333896 - DNA, 25 bp, Homo sapien
atctttatgcatgtaggtcttttta

SEQ ID NO: 333897 - DNA, 25 bp, Homo sapien
aaatgatgatcacaagtccacacaa

SEQ ID NO: 333898 - DNA, 25 bp, Homo sapien
tgatgatcacaagtccacacaatgg

SEQ ID NO: 333899 - DNA, 25 bp, Homo sapien
cacacaatggacacagtttatacac

SEQ ID NO: 333900 - DNA, 25 bp, Homo sapien
atggacacagtttatacacatccat

SEQ ID NO: 333901 - DNA, 25 bp, Homo sapien
acacatccatagtggtgtacactta

SEQ ID NO: 333902 - DNA, 25 bp, Homo sapien
catagtggtgtacacttaactacta

SEQ ID NO: 333903 - DNA, 25 bp, Homo sapien
gaaacaggaaacttggctatattag

SEQ ID NO: 333904 - DNA, 25 bp, Homo sapien
ggcactcacgaacgctcactctggg

SEQ ID NO: 333905 - DNA, 25 bp, Homo sapien
agctggttgccatgtaaaagtacta

SEQ ID NO: 333906 - DNA, 25 bp, Homo sapien
taaaagtactactgccctgagacca

SEQ ID NO: 333907 - DNA, 25 bp, Homo sapien
ggaagcccaagctactcatgtataa

SEQ ID NO: 333908 - DNA, 25 bp, Homo sapien
gagatagagccccagatgtttcagc

SEQ ID NO: 333909 - DNA, 25 bp, Homo sapien
atagagccccagatgtttcagccat

SEQ ID NO: 333910 - DNA, 25 bp, Homo sapien
gccccagatgtttcagccatctcag

SEQ ID NO: 333911 - DNA, 25 bp, Homo sapien
gcccaggcaccagacaagtgggtga

SEQ ID NO: 333912 - DNA, 25 bp, Homo sapien
gtgaagaagccaccttggacatgta

SEQ ID NO: 333913 - DNA, 25 bp, Homo sapien
agaagccaccttggacatgtagccc

SEQ ID NO: 333914 - DNA, 25 bp, Homo sapien
aaacagtttccaatgactctttctt

SEQ ID NO: 333915 - DNA, 25 bp, Homo sapien
gtttccaatgactctttctttaact

SEQ ID NO: 333916 - DNA, 25 bp, Homo sapien
tcctgaagttcctgagagtggagat

SEQ ID NO: 333917 - DNA, 25 bp, Homo sapien
ctgaagctatccttgctgcagactt

SEQ ID NO: 333918 - DNA, 25 bp, Homo sapien
cttgctgcagacttcgaaattggtc

SEQ ID NO: 333919 - DNA, 25 bp, Homo sapien
gcagacttcgaaattggtcactttt

SEQ ID NO: 333920 - DNA, 25 bp, Homo sapien
attggtcactttttacgtgagcgta

SEQ ID NO: 333921 - DNA, 25 bp, Homo sapien
tacgtgagcgtataatcccaagatc

SEQ ID NO: 333922 - DNA, 25 bp, Homo sapien
gtgagcgtataatcccaagatcagt

SEQ ID NO: 333923 - DNA, 25 bp, Homo sapien
tcccaagatcagtgttatattttac

SEQ ID NO: 333924 - DNA, 25 bp, Homo sapien
atattttactggagaagctattgaa

SEQ ID NO: 333925 - DNA, 25 bp, Homo sapien
tgttaactgtgtcatcaacttatcc

SEQ ID NO: 333926 - DNA, 25 bp, Homo sapien
catcaacttatcctagtacctcagt

SEQ ID NO: 333927 - DNA, 25 bp, Homo sapien
agtacctcagtgttcattcctgtta

SEQ ID NO: 333928 - DNA, 25 bp, Homo sapien
ctcagtgttcattcctgttacctgc

SEQ ID NO: 333929 - DNA, 25 bp, Homo sapien
gttacctgcatatcttcttaaaaga

SEQ ID NO: 333930 - DNA, 25 bp, Homo sapien
agaaatagctgttattaatgccttt

SEQ ID NO: 333931 - DNA, 25 bp, Homo sapien
tgttttccattgagtgtacactact

SEQ ID NO: 333932 - DNA, 25 bp, Homo sapien
tatgtttaccatgtgagtcctgcaa

SEQ ID NO: 333933 - DNA, 25 bp, Homo sapien
gtgagtcctgcaacactaaagatat

SEQ ID NO: 333934 - DNA, 25 bp, Homo sapien
agtcatgatggcaatttctgtataa

SEQ ID NO: 333935 - DNA, 25 bp, Homo sapien
tgttttgagatcaaactccccaccc

SEQ ID NO: 333936 - DNA, 25 bp, Homo sapien
ggtgcacaccatcatacacgggaca

SEQ ID NO: 333937 - DNA, 25 bp, Homo sapien
tcatacacgggacagggtctcgcta

SEQ ID NO: 333938 - DNA, 25 bp, Homo sapien
gttgctcagactggaaagttcagat

SEQ ID NO: 333939 - DNA, 25 bp, Homo sapien
aggtcttgggactccagattctgtt

SEQ ID NO: 333940 - DNA, 25 bp, Homo sapien
tgtttttccacagagtcaccatcta

SEQ ID NO: 333941 - DNA, 25 bp, Homo sapien
gacaatgctccatttcatgctgttt

SEQ ID NO: 333942 - DNA, 25 bp, Homo sapien
tgtttttcctcaccttcaatactgc

SEQ ID NO: 333943 - DNA, 25 bp, Homo sapien
ccacctctaggtgtgaaggttacca

SEQ ID NO: 333944 - DNA, 25 bp, Homo sapien
caggagagacctgagctcgctggct

SEQ ID NO: 333945 - DNA, 25 bp, Homo sapien
tcgctggctctgactccaaggtggc

SEQ ID NO: 333946 - DNA, 25 bp, Homo sapien
acgtgagcctcccaagactacaggt

SEQ ID NO: 333947 - DNA, 25 bp, Homo sapien
ttgtttttaattctggtctcggtgc

SEQ ID NO: 333948 - DNA, 25 bp, Homo sapien
ttaattctggtctcggtgcaaatgt

SEQ ID NO: 333949 - DNA, 25 bp, Homo sapien
ctggtctcggtgcaaatgttagtta

SEQ ID NO: 333950 - DNA, 25 bp, Homo sapien
gcaaatgttagttatgccttattca

SEQ ID NO: 333951 - DNA, 25 bp, Homo sapien
atgccttattcatatcacagttaga

SEQ ID NO: 333952 - DNA, 25 bp, Homo sapien
tatcacagttagatcaccatgctgc

SEQ ID NO: 333953 - DNA, 25 bp, Homo sapien
gatcaccatgctgcaacatggttta

SEQ ID NO: 333954 - DNA, 25 bp, Homo sapien
tggtttatattcatgctgccctaga

SEQ ID NO: 333955 - DNA, 25 bp, Homo sapien
tttatattcatgctgccctagaaac

SEQ ID NO: 333956 - DNA, 25 bp, Homo sapien
gttgcaaatttgtgactgtccttat

SEQ ID NO: 333957 - DNA, 25 bp, Homo sapien
gtgactgtccttattaactttcttt

SEQ ID NO: 333958 - DNA, 25 bp, Homo sapien
aagagaaacatagcaggcctttttt

SEQ ID NO: 333959 - DNA, 25 bp, Homo sapien
aacatagcaggccttttttaccagg

SEQ ID NO: 333960 - DNA, 25 bp, Homo sapien
tagcaggccttttttaccaggcttt

SEQ ID NO: 333961 - DNA, 25 bp, Homo sapien
ttgtttgtttggagcatgttaagat

SEQ ID NO: 333962 - DNA, 25 bp, Homo sapien
tgtttggagcatgttaagatttttt

SEQ ID NO: 333963 - DNA, 25 bp, Homo sapien
ttagttatatccaccctatttcagg

SEQ ID NO: 333964 - DNA, 25 bp, Homo sapien
gttatatccaccctatttcaggtta

SEQ ID NO: 333965 - DNA, 25 bp, Homo sapien
atatccaccctatttcaggttattt

SEQ ID NO: 333966 - DNA, 25 bp, Homo sapien
caggttatttttgttggtgtcaagt

SEQ ID NO: 333967 - DNA, 25 bp, Homo sapien
gttggtgtcaagtatgtataggaca

SEQ ID NO: 333968 - DNA, 25 bp, Homo sapien
taggacatgtgaatggttcttttta

SEQ ID NO: 333969 - DNA, 25 bp, Homo sapien
aaaggacgatttcaagtggagcctg

SEQ ID NO: 333970 - DNA, 25 bp, Homo sapien
aggaggcggcaaatagctcagtccg

SEQ ID NO: 333971 - DNA, 25 bp, Homo sapien
aggcggcaaatagctcagtccgcac

SEQ ID NO: 333972 - DNA, 25 bp, Homo sapien
ttcccagccgtctggtggaaggtga

SEQ ID NO: 333973 - DNA, 25 bp, Homo sapien
gcaaaagctcatgctgctgaggcct

SEQ ID NO: 333974 - DNA, 25 bp, Homo sapien
ggcctccccgtgctgagcagagaca

SEQ ID NO: 333975 - DNA, 25 bp, Homo sapien
agcagccccctagctgcaggagtgt

SEQ ID NO: 333976 - DNA, 25 bp, Homo sapien
ctagctgcaggagtgtgccccgatg

SEQ ID NO: 333977 - DNA, 25 bp, Homo sapien
acctgccgactttccttctgatgca

SEQ ID NO: 333978 - DNA, 25 bp, Homo sapien
ttctgatgcagacatggtccccact

SEQ ID NO: 333979 - DNA, 25 bp, Homo sapien
tgatgcagacatggtccccactggg

SEQ ID NO: 333980 - DNA, 25 bp, Homo sapien
gctcaaatgaaattctactttagga

SEQ ID NO: 333981 - DNA, 25 bp, Homo sapien
ggattggaacagcatgtcacaaggc

SEQ ID NO: 333982 - DNA, 25 bp, Homo sapien
catgtcacaaggctgttaattaaca

SEQ ID NO: 333983 - DNA, 25 bp, Homo sapien
tgttaattaacagagagaccttatt

SEQ ID NO: 333984 - DNA, 25 bp, Homo sapien
gagaccttattggatggagatcaca

SEQ ID NO: 333985 - DNA, 25 bp, Homo sapien
ggagatcacatctgttaaatagaat

SEQ ID NO: 333986 - DNA, 25 bp, Homo sapien
aatagaatacctcaactctacgttg

SEQ ID NO: 333987 - DNA, 25 bp, Homo sapien
caactctacgttgttttcttggaga

SEQ ID NO: 333988 - DNA, 25 bp, Homo sapien
tttacctaattacctgaaagcaaat

SEQ ID NO: 333989 - DNA, 25 bp, Homo sapien
aaataccaaaggctgatgtctgtat

SEQ ID NO: 333990 - DNA, 25 bp, Homo sapien
cagtgttttttttctaccagctatt

SEQ ID NO: 333991 - DNA, 25 bp, Homo sapien
ttgagcttctaattgctgccacttg

SEQ ID NO: 333992 - DNA, 25 bp, Homo sapien
aattgctgccacttggagatgtcca

SEQ ID NO: 333993 - DNA, 25 bp, Homo sapien
gatgtccaagtaagaaggccttctt

SEQ ID NO: 333994 - DNA, 25 bp, Homo sapien
aggccttctttttacatgggatgaa

SEQ ID NO: 333995 - DNA, 25 bp, Homo sapien
aattgtgcacttctactgatgatga

SEQ ID NO: 333996 - DNA, 25 bp, Homo sapien
gttatacgtacaggcacttacactc

SEQ ID NO: 333997 - DNA, 25 bp, Homo sapien
tcacatattcacacgtgtgcacatc

SEQ ID NO: 333998 - DNA, 25 bp, Homo sapien
atctactctagatcgtttcctgaca

SEQ ID NO: 333999 - DNA, 25 bp, Homo sapien
gtttcctgacagagaagccttcttc

SEQ ID NO: 334000 - DNA, 25 bp, Homo sapien
ttcttccaggccactaaggtagcat

SEQ ID NO: 334001 - DNA, 25 bp, Homo sapien
aaggtagcatgttatccactgtggc

SEQ ID NO: 334002 - DNA, 25 bp, Homo sapien
gtgtgccaggatcccagtggccaaa

SEQ ID NO: 334003 - DNA, 25 bp, Homo sapien
caggatcccagtggccaaagggcag

SEQ ID NO: 334004 - DNA, 25 bp, Homo sapien
tgccccatgtccttctgcagaataa

SEQ ID NO: 334005 - DNA, 25 bp, Homo sapien
catgtccttctgcagaataagagta

SEQ ID NO: 334006 - DNA, 25 bp, Homo sapien
gagtaaacaggccttctctagccat

SEQ ID NO: 334007 - DNA, 25 bp, Homo sapien
aaacaggccttctctagccatgttt

SEQ ID NO: 334008 - DNA, 25 bp, Homo sapien
gccttctctagccatgtttgatgca

SEQ ID NO: 334009 - DNA, 25 bp, Homo sapien
ctctagccatgtttgatgcaagatg

SEQ ID NO: 334010 - DNA, 25 bp, Homo sapien
atgcaagatggcccacagctgtgac

SEQ ID NO: 334011 - DNA, 25 bp, Homo sapien
catatatttactggaattaacccaa

SEQ ID NO: 334012 - DNA, 25 bp, Homo sapien
tggaattaacccaaacactacagaa

SEQ ID NO: 334013 - DNA, 25 bp, Homo sapien
tttccccactgctctatgaaatttg

SEQ ID NO: 334014 - DNA, 25 bp, Homo sapien
aatttggctgggtgatacttctgct

SEQ ID NO: 334015 - DNA, 25 bp, Homo sapien
atacttctgctggtttctttacctt

SEQ ID NO: 334016 - DNA, 25 bp, Homo sapien
ttaccttctgtgttacagttctgca

SEQ ID NO: 334017 - DNA, 25 bp, Homo sapien
gttacagttctgcatgtcctacttt

SEQ ID NO: 334018 - DNA, 25 bp, Homo sapien
gtcctacttttactcagttctgttt

SEQ ID NO: 334019 - DNA, 25 bp, Homo sapien
tttgcattttctttgccctagagac

SEQ ID NO: 334020 - DNA, 25 bp, Homo sapien
agacacaagtgtaatctctcccttt

SEQ ID NO: 334021 - DNA, 25 bp, Homo sapien
acctcagagtagattgtagcctgcc

SEQ ID NO: 334022 - DNA, 25 bp, Homo sapien
tgtagcctgccaaaggattccttcc

SEQ ID NO: 334023 - DNA, 25 bp, Homo sapien
attccttccctcatcctattgaagt

SEQ ID NO: 334024 - DNA, 25 bp, Homo sapien
gaatccctaagagatactcaaatga

SEQ ID NO: 334025 - DNA, 25 bp, Homo sapien
gaggcataaacttagacacagtctt

SEQ ID NO: 334026 - DNA, 25 bp, Homo sapien
acttagacacagtcttgcatttttg

SEQ ID NO: 334027 - DNA, 25 bp, Homo sapien
gtcttgcatttttgtctttcctgaa

SEQ ID NO: 334028 - DNA, 25 bp, Homo sapien
tgcatttttgtctttcctgaactct

SEQ ID NO: 334029 - DNA, 25 bp, Homo sapien
tttttgtctttcctgaactcttctg

SEQ ID NO: 334030 - DNA, 25 bp, Homo sapien
tttcctccttcactcgtcctgaaaa

SEQ ID NO: 334031 - DNA, 25 bp, Homo sapien
tcactcgtcctgaaaatctgcaagt

SEQ ID NO: 334032 - DNA, 25 bp, Homo sapien
gtcctgaaaatctgcaagttacata

SEQ ID NO: 334033 - DNA, 25 bp, Homo sapien
gacaaagtgtaattactcaactgaa

SEQ ID NO: 334034 - DNA, 25 bp, Homo sapien
ggaatcatgaatcctggtaaacaat

SEQ ID NO: 334035 - DNA, 25 bp, Homo sapien
aactcacggctgctttgtccacttc

SEQ ID NO: 334036 - DNA, 25 bp, Homo sapien
tggcatctcccattaagtcacataa

SEQ ID NO: 334037 - DNA, 25 bp, Homo sapien
gtcacataatgagggcagagagcag

SEQ ID NO: 334038 - DNA, 25 bp, Homo sapien
agcaaggcgccggatcagatcagtt

SEQ ID NO: 334039 - DNA, 25 bp, Homo sapien
aaggcgccggatcagatcagttcca

SEQ ID NO: 334040 - DNA, 25 bp, Homo sapien
gcgccggatcagatcagttccagaa

SEQ ID NO: 334041 - DNA, 25 bp, Homo sapien
gttctatcttgaaagatctcacttc

SEQ ID NO: 334042 - DNA, 25 bp, Homo sapien
atctcacttccaacacacatgctgt

SEQ ID NO: 334043 - DNA, 25 bp, Homo sapien
atgctgtctagcaacactaagtaga

SEQ ID NO: 334044 - DNA, 25 bp, Homo sapien
gtagaggggaccattcttcccaact

SEQ ID NO: 334045 - DNA, 25 bp, Homo sapien
attcttcccaactcacggctgcttt

SEQ ID NO: 334046 - DNA, 25 bp, Homo sapien
tagtgaactataacccaatgattaa

SEQ ID NO: 334047 - DNA, 25 bp, Homo sapien
aacctactcttgtaccagtcaccaa

SEQ ID NO: 334048 - DNA, 25 bp, Homo sapien
taccagtcaccaagtttcagccaat

SEQ ID NO: 334049 - DNA, 25 bp, Homo sapien
agccaatcagaggtggccaactgtt

SEQ ID NO: 334050 - DNA, 25 bp, Homo sapien
caaaccatgctcaaataagggaaat

SEQ ID NO: 334051 - DNA, 25 bp, Homo sapien
gtcatggtgtaactaatccagctgt

SEQ ID NO: 334052 - DNA, 25 bp, Homo sapien
taatccagctgtttctataccttac

SEQ ID NO: 334053 - DNA, 25 bp, Homo sapien
ccgactctgtgtatcacccataata

SEQ ID NO: 334054 - DNA, 25 bp, Homo sapien
taaactacttacagcttcctagtgt

SEQ ID NO: 334055 - DNA, 25 bp, Homo sapien
tacagcttcctagtgttaaatttac

SEQ ID NO: 334056 - DNA, 25 bp, Homo sapien
aacctaaaggttcttcatacatagt

SEQ ID NO: 334057 - DNA, 25 bp, Homo sapien
caccgtgagaatacagctcggcaga

SEQ ID NO: 334058 - DNA, 25 bp, Homo sapien
tgagaatacagctcggcagagaggc

SEQ ID NO: 334059 - DNA, 25 bp, Homo sapien
agggcagacgacttccaggaggtca

SEQ ID NO: 334060 - DNA, 25 bp, Homo sapien
gcagacgacttccaggaggtcacct

SEQ ID NO: 334061 - DNA, 25 bp, Homo sapien
gaagcgagtcgctcaagggcgcacc

SEQ ID NO: 334062 - DNA, 25 bp, Homo sapien
gctcaagggcgcaccgagtcatatc

SEQ ID NO: 334063 - DNA, 25 bp, Homo sapien
ggcgcaccgagtcatatcccaagat

SEQ ID NO: 334064 - DNA, 25 bp, Homo sapien
gagtcatatcccaagatctttgaag

SEQ ID NO: 334065 - DNA, 25 bp, Homo sapien
cccaagatctttgaaggaggtccag

SEQ ID NO: 334066 - DNA, 25 bp, Homo sapien
gaaggaggtccagggatccgcggag

SEQ ID NO: 334067 - DNA, 25 bp, Homo sapien
gatccgcggagccaccgtgagaata

SEQ ID NO: 334068 - DNA, 25 bp, Homo sapien
gtacctattagtgatactctcctcc

SEQ ID NO: 334069 - DNA, 25 bp, Homo sapien
tcccgttggcagtgcttccactgtg

SEQ ID NO: 334070 - DNA, 25 bp, Homo sapien
cttccactgtgttttctgcatgtaa

SEQ ID NO: 334071 - DNA, 25 bp, Homo sapien
aaggatggcactgttttttgcatag

SEQ ID NO: 334072 - DNA, 25 bp, Homo sapien
cactgttttttgcataggtctttcc

SEQ ID NO: 334073 - DNA, 25 bp, Homo sapien
ttttatttcccagaagtgccctact

SEQ ID NO: 334074 - DNA, 25 bp, Homo sapien
aggtctttcctaatagctgagcact

SEQ ID NO: 334075 - DNA, 25 bp, Homo sapien
atagctgagcactcttggagtgtag

SEQ ID NO: 334076 - DNA, 25 bp, Homo sapien
tcaaccttatgcctctttggacaca

SEQ ID NO: 334077 - DNA, 25 bp, Homo sapien
ggctggcatataggagctgctcaat

SEQ ID NO: 334078 - DNA, 25 bp, Homo sapien
cctttggtgacctcttagtctggaa

SEQ ID NO: 334079 - DNA, 25 bp, Homo sapien
agttccccagttctggcagattctg

SEQ ID NO: 334080 - DNA, 25 bp, Homo sapien
ggcagattctggaaactgtacattg

SEQ ID NO: 334081 - DNA, 25 bp, Homo sapien
acattgaagcagaggttactatttt

SEQ ID NO: 334082 - DNA, 25 bp, Homo sapien
cttatatcagtattgcagcattcac

SEQ ID NO: 334083 - DNA, 25 bp, Homo sapien
gtattgcagcattcactgtagtgat

SEQ ID NO: 334084 - DNA, 25 bp, Homo sapien
agttaggaacatagccaattaggac

SEQ ID NO: 334085 - DNA, 25 bp, Homo sapien
tagccaattaggacaaggaggattt

SEQ ID NO: 334086 - DNA, 25 bp, Homo sapien
gaaatttgggtcttttacaagctga

SEQ ID NO: 334087 - DNA, 25 bp, Homo sapien
caagctgatgattgttgcattttgg

SEQ ID NO: 334088 - DNA, 25 bp, Homo sapien
tgcattttggagttgcaacaacatt

SEQ ID NO: 334089 - DNA, 25 bp, Homo sapien
gagttgcaacaacattaaaacagtt

SEQ ID NO: 334090 - DNA, 25 bp, Homo sapien
attgttgctgtaacgatggactact

SEQ ID NO: 334091 - DNA, 25 bp, Homo sapien
gagacaatttctctggcacatcttc

SEQ ID NO: 334092 - DNA, 25 bp, Homo sapien
tcccttttcaatttacatagagtca

SEQ ID NO: 334093 - DNA, 25 bp, Homo sapien
acatcttcccacgttttagcaacat

SEQ ID NO: 334094 - DNA, 25 bp, Homo sapien
ttagcaacatgttcatggagagcca

SEQ ID NO: 334095 - DNA, 25 bp, Homo sapien
catggagagccaatattcagtaatt

SEQ ID NO: 334096 - DNA, 25 bp, Homo sapien
attcagtaattacagcccaattcct

SEQ ID NO: 334097 - DNA, 25 bp, Homo sapien
cccaattcctcacaatttcacaatt

SEQ ID NO: 334098 - DNA, 25 bp, Homo sapien
ttcacaattcgctaacaatatgcat

SEQ ID NO: 334099 - DNA, 25 bp, Homo sapien
gagtcatagattctgctggcatata

SEQ ID NO: 334100 - DNA, 25 bp, Homo sapien
aaatggttccacatctcatctgatt

SEQ ID NO: 334101 - DNA, 25 bp, Homo sapien
gccaaaaggcctggcttctgatagg

SEQ ID NO: 334102 - DNA, 25 bp, Homo sapien
tggcttctgataggaaactggtaag

SEQ ID NO: 334103 - DNA, 25 bp, Homo sapien
aaaacacatcactaatattcgctat

SEQ ID NO: 334104 - DNA, 25 bp, Homo sapien
aatattcgctattactctcctggtc

SEQ ID NO: 334105 - DNA, 25 bp, Homo sapien
attactctcctggtctgaagtcagc

SEQ ID NO: 334106 - DNA, 25 bp, Homo sapien
ctgaagtcagcttttctgaaccatt

SEQ ID NO: 334107 - DNA, 25 bp, Homo sapien
aaccattaaggtatttcatcacaag

SEQ ID NO: 334108 - DNA, 25 bp, Homo sapien
gtttaagaggcttttattcatgtga

SEQ ID NO: 334109 - DNA, 25 bp, Homo sapien
acagttttagccacatatcagatat

SEQ ID NO: 334110 - DNA, 25 bp, Homo sapien
ctatatctaattatcctttatggct

SEQ ID NO: 334111 - DNA, 25 bp, Homo sapien
ctttatggctaacattctgcctcca

SEQ ID NO: 334112 - DNA, 25 bp, Homo sapien
gagaaagcagagcagcctcctggaa

SEQ ID NO: 334113 - DNA, 25 bp, Homo sapien
aagcagagcagcctcctggaagaag

SEQ ID NO: 334114 - DNA, 25 bp, Homo sapien
ctcctggaagaaggccttgtcagct

SEQ ID NO: 334115 - DNA, 25 bp, Homo sapien
aaggccttgtcagctttgtctgtgc

SEQ ID NO: 334116 - DNA, 25 bp, Homo sapien
agctttgtctgtgcctcgcaaatca

SEQ ID NO: 334117 - DNA, 25 bp, Homo sapien
gtctgtgcctcgcaaatcagaggca

SEQ ID NO: 334118 - DNA, 25 bp, Homo sapien
gaatgtacatttgatctgccccagc

SEQ ID NO: 334119 - DNA, 25 bp, Homo sapien
tttgatctgccccagccacggaagt

SEQ ID NO: 334120 - DNA, 25 bp, Homo sapien
ccagccacggaagtcagagtaggat

SEQ ID NO: 334121 - DNA, 25 bp, Homo sapien
aagtttctggagttcagatactctc

SEQ ID NO: 334122 - DNA, 25 bp, Homo sapien
agatactctctgttgggaacaggac

SEQ ID NO: 334123 - DNA, 25 bp, Homo sapien
tgcccagttccccagttctggcaga

SEQ ID NO: 334124 - DNA, 25 bp, Homo sapien
gcccagttccccagttctggcagat

SEQ ID NO: 334125 - DNA, 25 bp, Homo sapien
cagttccccagttctggcagattct

SEQ ID NO: 334126 - DNA, 25 bp, Homo sapien
agttccccagttctggcagattctg

SEQ ID NO: 334127 - DNA, 25 bp, Homo sapien
gttccccagttctggcagattctgg

SEQ ID NO: 334128 - DNA, 25 bp, Homo sapien
ttccccagttctggcagattctgga

SEQ ID NO: 334129 - DNA, 25 bp, Homo sapien
ccccagttctggcagattctggaaa

SEQ ID NO: 334130 - DNA, 25 bp, Homo sapien
ccagttctggcagattctggaaact

SEQ ID NO: 334131 - DNA, 25 bp, Homo sapien
agttctggcagattctggaaactgt

SEQ ID NO: 334132 - DNA, 25 bp, Homo sapien
gttctggcagattctggaaactgta

SEQ ID NO: 334133 - DNA, 25 bp, Homo sapien
ctggaaactgtacattgaagcagag

SEQ ID NO: 334134 - DNA, 25 bp, Homo sapien
gctgcctttcttacatgatccaggc

SEQ ID NO: 334135 - DNA, 25 bp, Homo sapien
cagaacccaaactcaggcactgtat

SEQ ID NO: 334136 - DNA, 25 bp, Homo sapien
caggcactgtatagatgaccacttt

SEQ ID NO: 334137 - DNA, 25 bp, Homo sapien
gaccactttcgtaaactactgacct

SEQ ID NO: 334138 - DNA, 25 bp, Homo sapien
tactgacctagcttgttgccaattg

SEQ ID NO: 334139 - DNA, 25 bp, Homo sapien
gattgaacttcccataactccactt

SEQ ID NO: 334140 - DNA, 25 bp, Homo sapien
acttcgtgtctgttcctctgtatac

SEQ ID NO: 334141 - DNA, 25 bp, Homo sapien
gtcatgagcctttaggtctccattt

SEQ ID NO: 334142 - DNA, 25 bp, Homo sapien
ttaggtctccatttgcatattgcaa

SEQ ID NO: 334143 - DNA, 25 bp, Homo sapien
gttccatgtaggtagctcattcagg

SEQ ID NO: 334144 - DNA, 25 bp, Homo sapien
ggactggctgtcaatttgtgttgct

SEQ ID NO: 334145 - DNA, 25 bp, Homo sapien
gccttggtttcttcagcagtgagat

SEQ ID NO: 334146 - DNA, 25 bp, Homo sapien
tcagaataactgctgtctcccatga

SEQ ID NO: 334147 - DNA, 25 bp, Homo sapien
ctcccatgatggtgtggtacagcga

SEQ ID NO: 334148 - DNA, 25 bp, Homo sapien
gtacagcgagctgttgtctggctat

SEQ ID NO: 334149 - DNA, 25 bp, Homo sapien
ttgtctggctatggcatggctgtgc

SEQ ID NO: 334150 - DNA, 25 bp, Homo sapien
tgcaggtgtcatcctgagttcaggc

SEQ ID NO: 334151 - DNA, 25 bp, Homo sapien
gagttcaggctctgcacggcatgga

SEQ ID NO: 334152 - DNA, 25 bp, Homo sapien
cagctgctgctacaggacctgggat

SEQ ID NO: 334153 - DNA, 25 bp, Homo sapien
tgctacaggacctgggattgcctgg

SEQ ID NO: 334154 - DNA, 25 bp, Homo sapien
accttcctatcaattctcatggtag

SEQ ID NO: 334155 - DNA, 25 bp, Homo sapien
ggtagtccaaactgcagactctcaa

SEQ ID NO: 334156 - DNA, 25 bp, Homo sapien
aaaatgcgttttcacacccctagct

SEQ ID NO: 334157 - DNA, 25 bp, Homo sapien
aatgcgttttcacacccctagctgt

SEQ ID NO: 334158 - DNA, 25 bp, Homo sapien
gttttcacacccctagctgtggttt

SEQ ID NO: 334159 - DNA, 25 bp, Homo sapien
ttcacacccctagctgtggttttaa

SEQ ID NO: 334160 - DNA, 25 bp, Homo sapien
tcacacccctagctgtggttttaaa

SEQ ID NO: 334161 - DNA, 25 bp, Homo sapien
tatccattgcattcatttttctccc

SEQ ID NO: 334162 - DNA, 25 bp, Homo sapien
gggaaccttatctggtcctgtgtgt

SEQ ID NO: 334163 - DNA, 25 bp, Homo sapien
accttatctggtcctgtgtgtttgt

SEQ ID NO: 334164 - DNA, 25 bp, Homo sapien
cttatctggtcctgtgtgtttgttt

SEQ ID NO: 334165 - DNA, 25 bp, Homo sapien
gaagcctcttgttttgcaaacctct

SEQ ID NO: 334166 - DNA, 25 bp, Homo sapien
tgcaaacctctttgcatttctaatg

SEQ ID NO: 334167 - DNA, 25 bp, Homo sapien
aacttggaaacaggtatctgaccta

SEQ ID NO: 334168 - DNA, 25 bp, Homo sapien
ggtatctgacctattcttatttagt

SEQ ID NO: 334169 - DNA, 25 bp, Homo sapien
aattccttattgaatcttatgtgat

SEQ ID NO: 334170 - DNA, 25 bp, Homo sapien
atgtgatatgattttctggatttac

SEQ ID NO: 334171 - DNA, 25 bp, Homo sapien
ctggatttacagaacattagcacat

SEQ ID NO: 334172 - DNA, 25 bp, Homo sapien
attagcacatgtaccttgtgcctcc

SEQ ID NO: 334173 - DNA, 25 bp, Homo sapien
ttgtgcctcccattcaagtgaagtt

SEQ ID NO: 334174 - DNA, 25 bp, Homo sapien
gttataatttacactgagggtttca

SEQ ID NO: 334175 - DNA, 25 bp, Homo sapien
ctgagggtttcaaaattcgactaga

SEQ ID NO: 334176 - DNA, 25 bp, Homo sapien
attatttatttatgcactgtactgt

SEQ ID NO: 334177 - DNA, 25 bp, Homo sapien
agctgtgcctcacttattaaagcac

SEQ ID NO: 334178 - DNA, 25 bp, Homo sapien
gggtcatagacttcctttgaattct

SEQ ID NO: 334179 - DNA, 25 bp, Homo sapien
gaaaattatggacccttcctcagaa

SEQ ID NO: 334180 - DNA, 25 bp, Homo sapien
tgatttgagaaatattgcctgtaaa

SEQ ID NO: 334181 - DNA, 25 bp, Homo sapien
gtgaattgcatagaatctgcccaca

SEQ ID NO: 334182 - DNA, 25 bp, Homo sapien
tctgcccacagatctcattaatact

SEQ ID NO: 334183 - DNA, 25 bp, Homo sapien
actatgcattcatctccggttagga

SEQ ID NO: 334184 - DNA, 25 bp, Homo sapien
gttaggagatttgcaatccaatttc

SEQ ID NO: 334185 - DNA, 25 bp, Homo sapien
atccaatttcatttagcagcccagg

SEQ ID NO: 334186 - DNA, 25 bp, Homo sapien
atttagcagcccaggttaggagccc

SEQ ID NO: 334187 - DNA, 25 bp, Homo sapien
agccctgcagtccaatttcatttac

SEQ ID NO: 334188 - DNA, 25 bp, Homo sapien
tgcagtccaatttcatttacctgaa

SEQ ID NO: 334189 - DNA, 25 bp, Homo sapien
agcagaccgcactgcggaccactgt

SEQ ID NO: 334190 - DNA, 25 bp, Homo sapien
gcactgcggaccactgtgctttccg

SEQ ID NO: 334191 - DNA, 25 bp, Homo sapien
ggaccactgtgctttccgcaacctg

SEQ ID NO: 334192 - DNA, 25 bp, Homo sapien
tttccgcaacctgctgctggtacgg

SEQ ID NO: 334193 - DNA, 25 bp, Homo sapien
ccaggccagcattcggctctggaaa

SEQ ID NO: 334194 - DNA, 25 bp, Homo sapien
cagcattcggctctggaaacaactg

SEQ ID NO: 334195 - DNA, 25 bp, Homo sapien
attcggctctggaaacaactgcaag

SEQ ID NO: 334196 - DNA, 25 bp, Homo sapien
aactgcaagacccaaggctccagtg

SEQ ID NO: 334197 - DNA, 25 bp, Homo sapien
aagacccaaggctccagtgctgact

SEQ ID NO: 334198 - DNA, 25 bp, Homo sapien
gtgtggcacccttcccctttgagga

SEQ ID NO: 334199 - DNA, 25 bp, Homo sapien
actggcctttgcatccgagccctgg

SEQ ID NO: 334200 - DNA, 25 bp, Homo sapien
ttgtgatgcaaccaagtctcattta

SEQ ID NO: 334201 - DNA, 25 bp, Homo sapien
gcaaccaagtctcatttaggtcaag

SEQ ID NO: 334202 - DNA, 25 bp, Homo sapien
gggtgtgactcaagcaggataatat

SEQ ID NO: 334203 - DNA, 25 bp, Homo sapien
tgataaagagcatatcacatgcctg

SEQ ID NO: 334204 - DNA, 25 bp, Homo sapien
catgcctgttttcttgccagataaa

SEQ ID NO: 334205 - DNA, 25 bp, Homo sapien
gcacatgcctgttttcttatatact

SEQ ID NO: 334206 - DNA, 25 bp, Homo sapien
atatactagaataaaggctctccta

SEQ ID NO: 334207 - DNA, 25 bp, Homo sapien
aggctctcctaggaaagatttttct

SEQ ID NO: 334208 - DNA, 25 bp, Homo sapien
gaaaatgtgagacaaggccttcaag

SEQ ID NO: 334209 - DNA, 25 bp, Homo sapien
ggccttcaaggagactacccaggaa

SEQ ID NO: 334210 - DNA, 25 bp, Homo sapien
atgttggctatacagctctcaatag

SEQ ID NO: 334211 - DNA, 25 bp, Homo sapien
tggacagcatctaagtctgcccagg

SEQ ID NO: 334212 - DNA, 25 bp, Homo sapien
ggctcctgaatatcagtcactgttc

SEQ ID NO: 334213 - DNA, 25 bp, Homo sapien
atatcagtcactgttcgtcactcaa

SEQ ID NO: 334214 - DNA, 25 bp, Homo sapien
gtcactgttcgtcactcaaatgaat

SEQ ID NO: 334215 - DNA, 25 bp, Homo sapien
gaatttgctaaatacaacactgata

SEQ ID NO: 334216 - DNA, 25 bp, Homo sapien
acactgatactagattccacaggga

SEQ ID NO: 334217 - DNA, 25 bp, Homo sapien
ggaaatgggcagactgaaccagtcc

SEQ ID NO: 334218 - DNA, 25 bp, Homo sapien
ccagtccaggtggtgaattttccaa

SEQ ID NO: 334219 - DNA, 25 bp, Homo sapien
ggtgaattttccaagaacatagttt

SEQ ID NO: 334220 - DNA, 25 bp, Homo sapien
tgcttttagaatgcaggagcctact

SEQ ID NO: 334221 - DNA, 25 bp, Homo sapien
aggagcctacttctagctgtatttt

SEQ ID NO: 334222 - DNA, 25 bp, Homo sapien
actatgagtattgggcaagcacgca

SEQ ID NO: 334223 - DNA, 25 bp, Homo sapien
gcacgcaagatggtggaacagctta

SEQ ID NO: 334224 - DNA, 25 bp, Homo sapien
ttgaagccagcttgtgtcggataaa

SEQ ID NO: 334225 - DNA, 25 bp, Homo sapien
agcttgtgtcggataaaggtgtcca

SEQ ID NO: 334226 - DNA, 25 bp, Homo sapien
aaggcagcagcagacctgatgactt

SEQ ID NO: 334227 - DNA, 25 bp, Homo sapien
ctgatgacttactgtgatgcccacg

SEQ ID NO: 334228 - DNA, 25 bp, Homo sapien
tactgtgatgcccacgcctgtgagg

SEQ ID NO: 334229 - DNA, 25 bp, Homo sapien
ttcttctgtgctctcctctgagctc

SEQ ID NO: 334230 - DNA, 25 bp, Homo sapien
tgggcccttccttaggtcagtaatt

SEQ ID NO: 334231 - DNA, 25 bp, Homo sapien
gtcagtaattgttgtgagcccctta

SEQ ID NO: 334232 - DNA, 25 bp, Homo sapien
tgtgagccccttaggctccttgcat

SEQ ID NO: 334233 - DNA, 25 bp, Homo sapien
ttattaatgggtgtagagtttctgt

SEQ ID NO: 334234 - DNA, 25 bp, Homo sapien
agtttctgttacacaggatgcaaag

SEQ ID NO: 334235 - DNA, 25 bp, Homo sapien
tgttacacaggatgcaaagtggcct

SEQ ID NO: 334236 - DNA, 25 bp, Homo sapien
tacacaggatgcaaagtggcctgaa

SEQ ID NO: 334237 - DNA, 25 bp, Homo sapien
acaggatgcaaagtggcctgaagat

SEQ ID NO: 334238 - DNA, 25 bp, Homo sapien
tggttgcacagcaatgtgaatttaa

SEQ ID NO: 334239 - DNA, 25 bp, Homo sapien
gcaatgtgaatttaatgacactgaa

SEQ ID NO: 334240 - DNA, 25 bp, Homo sapien
aaatgctaaattttgtatgtgtttt

SEQ ID NO: 334241 - DNA, 25 bp, Homo sapien
taaagtacctagattagtcagattc

SEQ ID NO: 334242 - DNA, 25 bp, Homo sapien
agtacctagattagtcagattcata

SEQ ID NO: 334243 - DNA, 25 bp, Homo sapien
aatggtggttgctagacgctggagg

SEQ ID NO: 334244 - DNA, 25 bp, Homo sapien
aaaatgcgttttcacacccctagct

SEQ ID NO: 334245 - DNA, 25 bp, Homo sapien
aaatgcgttttcacacccctagctg

SEQ ID NO: 334246 - DNA, 25 bp, Homo sapien
atgcgttttcacacccctagctgtg

SEQ ID NO: 334247 - DNA, 25 bp, Homo sapien
gttttcacacccctagctgtggttt

SEQ ID NO: 334248 - DNA, 25 bp, Homo sapien
tttcacacccctagctgtggtttta

SEQ ID NO: 334249 - DNA, 25 bp, Homo sapien
ttcacacccctagctgtggttttaa

SEQ ID NO: 334250 - DNA, 25 bp, Homo sapien
tcacacccctagctgtggttttaaa

SEQ ID NO: 334251 - DNA, 25 bp, Homo sapien
gggaaccttatctggtcctgtgtgt

SEQ ID NO: 334252 - DNA, 25 bp, Homo sapien
accttatctggtcctgtgtgtttgt

SEQ ID NO: 334253 - DNA, 25 bp, Homo sapien
ccttatctggtcctgtgtgtttgtt

SEQ ID NO: 334254 - DNA, 25 bp, Homo sapien
cttatctggtcctgtgtgtttgttt

SEQ ID NO: 334255 - DNA, 25 bp, Homo sapien
tgtatccgggcccaacctgaaaaca

SEQ ID NO: 334256 - DNA, 25 bp, Homo sapien
aacctgaaaacatcccagccaagaa

SEQ ID NO: 334257 - DNA, 25 bp, Homo sapien
gaactggtataggagctccaaggac

SEQ ID NO: 334258 - DNA, 25 bp, Homo sapien
ggacaagaaacacgtctggctagga

SEQ ID NO: 334259 - DNA, 25 bp, Homo sapien
aacacgtctggctaggagaaactat

SEQ ID NO: 334260 - DNA, 25 bp, Homo sapien
gagaaactatcaatgctggcagcca

SEQ ID NO: 334261 - DNA, 25 bp, Homo sapien
gacttccaaggaaatggctacccaa

SEQ ID NO: 334262 - DNA, 25 bp, Homo sapien
aaatggctacccaacttgccttcat

SEQ ID NO: 334263 - DNA, 25 bp, Homo sapien
ttcatgcgcctgctggccaactatg

SEQ ID NO: 334264 - DNA, 25 bp, Homo sapien
tgctggccaactatgcctctcagaa

SEQ ID NO: 334265 - DNA, 25 bp, Homo sapien
actatgcctctcagaacatcaccta

SEQ ID NO: 334266 - DNA, 25 bp, Homo sapien
cattccgtcactgtgaagctgcaat

SEQ ID NO: 334267 - DNA, 25 bp, Homo sapien
gaaactgtttgcacattatggcaag

SEQ ID NO: 334268 - DNA, 25 bp, Homo sapien
aagaagggcgctgttttcgacaggt

SEQ ID NO: 334269 - DNA, 25 bp, Homo sapien
ttcgacaggtgtgcaggtttcggca

SEQ ID NO: 334270 - DNA, 25 bp, Homo sapien
gcaggtttcggcacatggagattga

SEQ ID NO: 334271 - DNA, 25 bp, Homo sapien
ggaaaatcagccaacaggatgtcaa

SEQ ID NO: 334272 - DNA, 25 bp, Homo sapien
taaactgcgctttccatcacaatag

SEQ ID NO: 334273 - DNA, 25 bp, Homo sapien
gacgatatgttgatggccttttcct

SEQ ID NO: 334274 - DNA, 25 bp, Homo sapien
cctacctccgagcaaaactgtgttg

SEQ ID NO: 334275 - DNA, 25 bp, Homo sapien
ccactgtgcctgagtcaccagaaga

SEQ ID NO: 334276 - DNA, 25 bp, Homo sapien
aagtgaaggctagccaactttcagt

SEQ ID NO: 334277 - DNA, 25 bp, Homo sapien
ttcagaatgcagaataaattgcctt

SEQ ID NO: 334278 - DNA, 25 bp, Homo sapien
ccaaataggtgtgatgtactttaga

SEQ ID NO: 334279 - DNA, 25 bp, Homo sapien
gtaaacaaagatgttcacccatgat

SEQ ID NO: 334280 - DNA, 25 bp, Homo sapien
gatgttcacccatgataatggatgt

SEQ ID NO: 334281 - DNA, 25 bp, Homo sapien
taatggatgttaaagctcctgcagt

SEQ ID NO: 334282 - DNA, 25 bp, Homo sapien
aaagctcctgcagttgttcttttcg

SEQ ID NO: 334283 - DNA, 25 bp, Homo sapien
ctgcagttgttcttttcgtgtttaa

SEQ ID NO: 334284 - DNA, 25 bp, Homo sapien
gggtatattctaatagtggaagcat

SEQ ID NO: 334285 - DNA, 25 bp, Homo sapien
gtggaagcatcaaacatgtcagtga

SEQ ID NO: 334286 - DNA, 25 bp, Homo sapien
catgtcagtgatttcatctcattca

SEQ ID NO: 334287 - DNA, 25 bp, Homo sapien
agtgatttcatctcattcagaaata

SEQ ID NO: 334288 - DNA, 25 bp, Homo sapien
ttgggtaacaattatcagggccttt

SEQ ID NO: 334289 - DNA, 25 bp, Homo sapien
cagggcctttattatagctttatgt

SEQ ID NO: 334290 - DNA, 25 bp, Homo sapien
tgcaagagtcaaatgttactgtcat

SEQ ID NO: 334291 - DNA, 25 bp, Homo sapien
gaatattttagacttgaaacgtgtt

SEQ ID NO: 334292 - DNA, 25 bp, Homo sapien
gaaacgtgtttatcatagagcgaag

SEQ ID NO: 334293 - DNA, 25 bp, Homo sapien
cagataagactctgttaacccactg

SEQ ID NO: 334294 - DNA, 25 bp, Homo sapien
tgttaacccactgtcagcatacgtg

SEQ ID NO: 334295 - DNA, 25 bp, Homo sapien
gtcagcatacgtgggatttcttttc

SEQ ID NO: 334296 - DNA, 25 bp, Homo sapien
gtggagatttgttttcatccatcta

SEQ ID NO: 334297 - DNA, 25 bp, Homo sapien
ttgttttcatccatctaccaccttg

SEQ ID NO: 334298 - DNA, 25 bp, Homo sapien
accttgccagtaccctagcttgtga

SEQ ID NO: 334299 - DNA, 25 bp, Homo sapien
atttaatagccaacattgggcactt

SEQ ID NO: 334300 - DNA, 25 bp, Homo sapien
attgggcacttattcattctctgag

SEQ ID NO: 334301 - DNA, 25 bp, Homo sapien
ggcacttattcattctctgagtaaa

SEQ ID NO: 334302 - DNA, 25 bp, Homo sapien
tattgcatgcttatcttgtatcaag

SEQ ID NO: 334303 - DNA, 25 bp, Homo sapien
atcttgtatcaagcattgtgatgaa

SEQ ID NO: 334304 - DNA, 25 bp, Homo sapien
gaaacacagattttgtagggagcgt

SEQ ID NO: 334305 - DNA, 25 bp, Homo sapien
aagaatcatattccttcactagcag

SEQ ID NO: 334306 - DNA, 25 bp, Homo sapien
caggttcaggttagtaagggcgctc

SEQ ID NO: 334307 - DNA, 25 bp, Homo sapien
atcatattccttcactagcaggatc

SEQ ID NO: 334308 - DNA, 25 bp, Homo sapien
tcaggttagtaagggcgctcatatt

SEQ ID NO: 334309 - DNA, 25 bp, Homo sapien
atcttcacttcttgaaggattggta

SEQ ID NO: 334310 - DNA, 25 bp, Homo sapien
agactcgggcgggtgttctgcggcc

SEQ ID NO: 334311 - DNA, 25 bp, Homo sapien
gacaatggctgaccgtaacctggac

SEQ ID NO: 334312 - DNA, 25 bp, Homo sapien
ggctgaccgtaacctggaccagctg

SEQ ID NO: 334313 - DNA, 25 bp, Homo sapien
gctgcttagcaatctggaagacctc

SEQ ID NO: 334314 - DNA, 25 bp, Homo sapien
atctggaagacctcagtaattctat

SEQ ID NO: 334315 - DNA, 25 bp, Homo sapien
agaagctgcacctggccgagaacgc

SEQ ID NO: 334316 - DNA, 25 bp, Homo sapien
acctggccgagaacgccgagcctga

SEQ ID NO: 334317 - DNA, 25 bp, Homo sapien
agcctgaggagcagtccgctgcgta

SEQ ID NO: 334318 - DNA, 25 bp, Homo sapien
ctcattctcttcaaactgtgacttt

SEQ ID NO: 334319 - DNA, 25 bp, Homo sapien
gtgactttttacagactcgggcggg

SEQ ID NO: 334320 - DNA, 25 bp, Homo sapien
gactttttacagactcgggcgggtg

SEQ ID NO: 334321 - DNA, 25 bp, Homo sapien
caaaaaggcagatacaaacaggaat

SEQ ID NO: 334322 - DNA, 25 bp, Homo sapien
aaacaggaatccagtgagtcacata

SEQ ID NO: 334323 - DNA, 25 bp, Homo sapien
aattactgagcatgaggttgcccaa

SEQ ID NO: 334324 - DNA, 25 bp, Homo sapien
gagcatgaggttgcccaagatgatc

SEQ ID NO: 334325 - DNA, 25 bp, Homo sapien
ggttgcccaagatgatcatttgaca

SEQ ID NO: 334326 - DNA, 25 bp, Homo sapien
gatgatcatttgacacaacaatata

SEQ ID NO: 334327 - DNA, 25 bp, Homo sapien
tgaagacagaaatccaatatctaca

SEQ ID NO: 334328 - DNA, 25 bp, Homo sapien
tttctgagaggcagactcccatgtg

SEQ ID NO: 334329 - DNA, 25 bp, Homo sapien
tcccatgtggtcccagatccttggt

SEQ ID NO: 334330 - DNA, 25 bp, Homo sapien
atgcttccttgcattaggctttcta

SEQ ID NO: 334331 - DNA, 25 bp, Homo sapien
gcattaggctttctaaacccggagc

SEQ ID NO: 334332 - DNA, 25 bp, Homo sapien
aagcacaacaagaagcgcagccggt

SEQ ID NO: 334333 - DNA, 25 bp, Homo sapien
aacaagaagcgcagccggtcccggt

SEQ ID NO: 334334 - DNA, 25 bp, Homo sapien
aagcgcagccggtcccggtcgcgat

SEQ ID NO: 334335 - DNA, 25 bp, Homo sapien
gcgatcccgggacaaggagcgcgtg

SEQ ID NO: 334336 - DNA, 25 bp, Homo sapien
gagcgcgtgcggaagcgttccaaat

SEQ ID NO: 334337 - DNA, 25 bp, Homo sapien
gtgcggaagcgttccaaatctcggg

SEQ ID NO: 334338 - DNA, 25 bp, Homo sapien
gaagcgttccaaatctcgggaaagt

SEQ ID NO: 334339 - DNA, 25 bp, Homo sapien
gaccgcatcgacatcttcgggcgca

SEQ ID NO: 334340 - DNA, 25 bp, Homo sapien
atcttcgggcgcacggtgagcaagc

SEQ ID NO: 334341 - DNA, 25 bp, Homo sapien
gcacggtgagcaagcgcagcagcct

SEQ ID NO: 334342 - DNA, 25 bp, Homo sapien
gcaagcgcagcagcctggacgagaa

SEQ ID NO: 334343 - DNA, 25 bp, Homo sapien
tatgcctctttctgtagatcaaatg

SEQ ID NO: 334344 - DNA, 25 bp, Homo sapien
tagatcaaatgaaatatggcccaat

SEQ ID NO: 334345 - DNA, 25 bp, Homo sapien
gaaatatggcccaatttacaagggt

SEQ ID NO: 334346 - DNA, 25 bp, Homo sapien
ttacaagggtatacaccttcatggt

SEQ ID NO: 334347 - DNA, 25 bp, Homo sapien
gggtatacaccttcatggtagatga

SEQ ID NO: 334348 - DNA, 25 bp, Homo sapien
gatttaattgtagtttctgctgcca

SEQ ID NO: 334349 - DNA, 25 bp, Homo sapien
gccaaaaagtctccataattatttt

SEQ ID NO: 334350 - DNA, 25 bp, Homo sapien
ataacttataactaccttgatcttt

SEQ ID NO: 334351 - DNA, 25 bp, Homo sapien
accttgatctttacctgtacacaca

SEQ ID NO: 334352 - DNA, 25 bp, Homo sapien
gtaatttcacttagaatcctggtca

SEQ ID NO: 334353 - DNA, 25 bp, Homo sapien
tagaatcctggtcaaaaattttctt

SEQ ID NO: 334354 - DNA, 25 bp, Homo sapien
gaaatgactgtagaagtggccccaa

SEQ ID NO: 334355 - DNA, 25 bp, Homo sapien
atgactgtagaagtggccccaaaat

SEQ ID NO: 334356 - DNA, 25 bp, Homo sapien
tggccccaaaattatgaaccttcgt

SEQ ID NO: 334357 - DNA, 25 bp, Homo sapien
aattatgaaccttcgtagctgtgaa

SEQ ID NO: 334358 - DNA, 25 bp, Homo sapien
tcgtagctgtgaatatgatgccata

SEQ ID NO: 334359 - DNA, 25 bp, Homo sapien
gaatatgatgccataaatctctttt

SEQ ID NO: 334360 - DNA, 25 bp, Homo sapien
atctcttttaaagctcaagatagac

SEQ ID NO: 334361 - DNA, 25 bp, Homo sapien
tacatagttacctaatcatgagact

SEQ ID NO: 334362 - DNA, 25 bp, Homo sapien
atgagactaaattcacctgggtgac

SEQ ID NO: 334363 - DNA, 25 bp, Homo sapien
gggtgacaaggctaacgttcaagct

SEQ ID NO: 334364 - DNA, 25 bp, Homo sapien
ggctaacgttcaagctacttaagat

SEQ ID NO: 334365 - DNA, 25 bp, Homo sapien
aatgaagaacatgccgtctcggtgt

SEQ ID NO: 334366 - DNA, 25 bp, Homo sapien
cgtctcggtgtctcagggctattag

SEQ ID NO: 334367 - DNA, 25 bp, Homo sapien
gtgtctcagggctattaggacttgc

SEQ ID NO: 334368 - DNA, 25 bp, Homo sapien
ttaggacttgccctcaggaagtggc

SEQ ID NO: 334369 - DNA, 25 bp, Homo sapien
gccctcaggaagtggccttggacga

SEQ ID NO: 334370 - DNA, 25 bp, Homo sapien
tggacgagcgtcatgttattttcac

SEQ ID NO: 334371 - DNA, 25 bp, Homo sapien
gttattttcacaactgtcctgcgac

SEQ ID NO: 334372 - DNA, 25 bp, Homo sapien
aactgtcctgcgacgttggcctggg

SEQ ID NO: 334373 - DNA, 25 bp, Homo sapien
gggcacgtcatggaatggcccatgt

SEQ ID NO: 334374 - DNA, 25 bp, Homo sapien
atgtccctctgctgcgtggacgtcg

SEQ ID NO: 334375 - DNA, 25 bp, Homo sapien
cagtttccctttccgtctaatgaag

SEQ ID NO: 334376 - DNA, 25 bp, Homo sapien
ccagaacttggaacctcccaggaat

SEQ ID NO: 334377 - DNA, 25 bp, Homo sapien
aacttggaacctcccaggaatgctg

SEQ ID NO: 334378 - DNA, 25 bp, Homo sapien
tggaacctcccaggaatgctgcctt

SEQ ID NO: 334379 - DNA, 25 bp, Homo sapien
tccagtcctgggttccctcaggaat

SEQ ID NO: 334380 - DNA, 25 bp, Homo sapien
gttccctcaggaattcgaagacctt

SEQ ID NO: 334381 - DNA, 25 bp, Homo sapien
aggaattcgaagaccttggctaggt

SEQ ID NO: 334382 - DNA, 25 bp, Homo sapien
aagaccttggctaggtggtgagctt

SEQ ID NO: 334383 - DNA, 25 bp, Homo sapien
tctaacctctttccttactccttat

SEQ ID NO: 334384 - DNA, 25 bp, Homo sapien
ttatcccatcccatttgagttcagg

SEQ ID NO: 334385 - DNA, 25 bp, Homo sapien
gtgaatgaaagtagctctggagcct

SEQ ID NO: 334386 - DNA, 25 bp, Homo sapien
aagtagctctggagcctctccctta

SEQ ID NO: 334387 - DNA, 25 bp, Homo sapien
agaggctatcttcaaaatggagtcc

SEQ ID NO: 334388 - DNA, 25 bp, Homo sapien
aatggagtcctaaagtatatctgat

SEQ ID NO: 334389 - DNA, 25 bp, Homo sapien
aattcttaacactgtatataccctg

SEQ ID NO: 334390 - DNA, 25 bp, Homo sapien
aacactgtatataccctgtggtcaa

SEQ ID NO: 334391 - DNA, 25 bp, Homo sapien
ctgtggtcaaaagcatcaacgtaaa

SEQ ID NO: 334392 - DNA, 25 bp, Homo sapien
aacttgatgtttatcagattactta

SEQ ID NO: 334393 - DNA, 25 bp, Homo sapien
gattacttatgtttcaattttcctg

SEQ ID NO: 334394 - DNA, 25 bp, Homo sapien
tatgtttcaattttcctgtggttag

SEQ ID NO: 334395 - DNA, 25 bp, Homo sapien
gacagaagtaagctattaacggtat

SEQ ID NO: 334396 - DNA, 25 bp, Homo sapien
agctattaacggtatttgcttgtaa

SEQ ID NO: 334397 - DNA, 25 bp, Homo sapien
ggtatttgcttgtaagagtaacgtt

SEQ ID NO: 334398 - DNA, 25 bp, Homo sapien
tccggaaagtacttcgatggactca

SEQ ID NO: 334399 - DNA, 25 bp, Homo sapien
gatggactcaaacagaaggccccgg

SEQ ID NO: 334400 - DNA, 25 bp, Homo sapien
tttgggctgaaagtgcccgcctggt

SEQ ID NO: 334401 - DNA, 25 bp, Homo sapien
aaagtgcccgcctggtgggcttaga

SEQ ID NO: 334402 - DNA, 25 bp, Homo sapien
tggtgggcttagaggctccctctgt

SEQ ID NO: 334403 - DNA, 25 bp, Homo sapien
gataacctctggagcagatttgaaa

SEQ ID NO: 334404 - DNA, 25 bp, Homo sapien
ttgaaagccaggatggcgcctccag

SEQ ID NO: 334405 - DNA, 25 bp, Homo sapien
gatggcgcctccagaccgaggacag

SEQ ID NO: 334406 - DNA, 25 bp, Homo sapien
agaccgaggacagctgtccgccatg

SEQ ID NO: 334407 - DNA, 25 bp, Homo sapien
gctgctggtcaagagccccgagctg

SEQ ID NO: 334408 - DNA, 25 bp, Homo sapien
gaactggcggatgtttccggaaagt

SEQ ID NO: 334409 - DNA, 25 bp, Homo sapien
gatgtcatgcaagtttgtatgccag

SEQ ID NO: 334410 - DNA, 25 bp, Homo sapien
aaaggtactggtcttcttggacatt

SEQ ID NO: 334411 - DNA, 25 bp, Homo sapien
ggtcttcttggacattaatctttga

SEQ ID NO: 334412 - DNA, 25 bp, Homo sapien
atctttgaatacttgctgactgcta

SEQ ID NO: 334413 - DNA, 25 bp, Homo sapien
tgaatacttgctgactgctaagaaa

SEQ ID NO: 334414 - DNA, 25 bp, Homo sapien
gaggagtttgacatgttagggcatt

SEQ ID NO: 334415 - DNA, 25 bp, Homo sapien
ttagggcattaaagcaaaggtggat

SEQ ID NO: 334416 - DNA, 25 bp, Homo sapien
gaattaaaccattacatgccccttc

SEQ ID NO: 334417 - DNA, 25 bp, Homo sapien
atgccccttccaaaaggcagaaatc

SEQ ID NO: 334418 - DNA, 25 bp, Homo sapien
atccattcaaacgtgactgtcccaa

SEQ ID NO: 334419 - DNA, 25 bp, Homo sapien
gactgtcccaaatgccttatgtcaa

SEQ ID NO: 334420 - DNA, 25 bp, Homo sapien
gatgtaggccgaggttccagagtgt

SEQ ID NO: 334421 - DNA, 25 bp, Homo sapien
tcaggcctgaactttcccaatcagt

SEQ ID NO: 334422 - DNA, 25 bp, Homo sapien
aactttcccaatcagtaacccagtg

SEQ ID NO: 334423 - DNA, 25 bp, Homo sapien
caatcagtaacccagtggagcctgg

SEQ ID NO: 334424 - DNA, 25 bp, Homo sapien
tcctgacccctcatatctgagagtg

SEQ ID NO: 334425 - DNA, 25 bp, Homo sapien
atatctgagagtggctccctgagct

SEQ ID NO: 334426 - DNA, 25 bp, Homo sapien
aggtcagtgtgccattcctgtcgca

SEQ ID NO: 334427 - DNA, 25 bp, Homo sapien
tgtgccattcctgtcgcatcagctg

SEQ ID NO: 334428 - DNA, 25 bp, Homo sapien
catcagctgcatcagtgcagacaga

SEQ ID NO: 334429 - DNA, 25 bp, Homo sapien
gtgcagacagaggtgaccactctct

SEQ ID NO: 334430 - DNA, 25 bp, Homo sapien
agaggtgaccactctcttggcagac

SEQ ID NO: 334431 - DNA, 25 bp, Homo sapien
gagcatagaacttatcccaatcaga

SEQ ID NO: 334432 - DNA, 25 bp, Homo sapien
acttatcccaatcagatttgatgga

SEQ ID NO: 334433 - DNA, 25 bp, Homo sapien
gaggaaaaccatgagcaatgggata

SEQ ID NO: 334434 - DNA, 25 bp, Homo sapien
gaataaatgtttaccaaattgctaa

SEQ ID NO: 334435 - DNA, 25 bp, Homo sapien
gaataggctctgtacttggccttgg

SEQ ID NO: 334436 - DNA, 25 bp, Homo sapien
ggctctgtacttggccttgggcaaa

SEQ ID NO: 334437 - DNA, 25 bp, Homo sapien
ctgtacttggccttgggcaaacaat

SEQ ID NO: 334438 - DNA, 25 bp, Homo sapien
ggccttgggcaaacaatagtgtaaa

SEQ ID NO: 334439 - DNA, 25 bp, Homo sapien
aactgtctttcacaaagccagtccc

SEQ ID NO: 334440 - DNA, 25 bp, Homo sapien
gccaaaaaggttggtgactgcttaa

SEQ ID NO: 334441 - DNA, 25 bp, Homo sapien
tggtgactgcttaattagaaagtga

SEQ ID NO: 334442 - DNA, 25 bp, Homo sapien
taaactatggtttgatatgctctaa

SEQ ID NO: 334443 - DNA, 25 bp, Homo sapien
aaaagtgtactgatatggcaaaatg

SEQ ID NO: 334444 - DNA, 25 bp, Homo sapien
actgatatggcaaaatgtatgactt

SEQ ID NO: 334445 - DNA, 25 bp, Homo sapien
ggcaaaatgtatgacttatagttaa

SEQ ID NO: 334446 - DNA, 25 bp, Homo sapien
aagcaggttagatgttgatagatac

SEQ ID NO: 334447 - DNA, 25 bp, Homo sapien
atgctgacatttaaatctggatatt

SEQ ID NO: 334448 - DNA, 25 bp, Homo sapien
aatctggatatttatgagtgttttt

SEQ ID NO: 334449 - DNA, 25 bp, Homo sapien
ttatttcaatctttgtacatgcatg

SEQ ID NO: 334450 - DNA, 25 bp, Homo sapien
tttcaatctttgtacatgcatgtat

SEQ ID NO: 334451 - DNA, 25 bp, Homo sapien
tgtacatgcatgtattttctagaaa

SEQ ID NO: 334452 - DNA, 25 bp, Homo sapien
agaaattgtattactatctttgtaa

SEQ ID NO: 334453 - DNA, 25 bp, Homo sapien
tttctctctgactgtgttccagcca

SEQ ID NO: 334454 - DNA, 25 bp, Homo sapien
gtgttccagccacagtgatcttagt

SEQ ID NO: 334455 - DNA, 25 bp, Homo sapien
agatgttctcccactggttcctcat

SEQ ID NO: 334456 - DNA, 25 bp, Homo sapien
tggttcctcatcaggtagctcgtag

SEQ ID NO: 334457 - DNA, 25 bp, Homo sapien
tagctcgtagcttgcctggtatctc

SEQ ID NO: 334458 - DNA, 25 bp, Homo sapien
ttgcctggtatctcaaggaagcctt

SEQ ID NO: 334459 - DNA, 25 bp, Homo sapien
aaggaagccttcctgcctataccgc

SEQ ID NO: 334460 - DNA, 25 bp, Homo sapien
ctataccgccgcatctgaagaggtt

SEQ ID NO: 334461 - DNA, 25 bp, Homo sapien
tgaagaggttactgtgtccaccctg

SEQ ID NO: 334462 - DNA, 25 bp, Homo sapien
tagcacttgtcactacctgaaatac

SEQ ID NO: 334463 - DNA, 25 bp, Homo sapien
gaaatacttatgtgctatctccctc

SEQ ID NO: 334464 - DNA, 25 bp, Homo sapien
ctaagatttcttcacataggttata

SEQ ID NO: 334465 - DNA, 25 bp, Homo sapien
catctgtatgttcaagcttttatgt

SEQ ID NO: 334466 - DNA, 25 bp, Homo sapien
tatagtgccttcagttttaacatag

SEQ ID NO: 334467 - DNA, 25 bp, Homo sapien
atagtttcacatgttctcagaactg

SEQ ID NO: 334468 - DNA, 25 bp, Homo sapien
gaactgctaaattcagtgctaccag

SEQ ID NO: 334469 - DNA, 25 bp, Homo sapien
ttcagtgctaccagtaaggcttaat

SEQ ID NO: 334470 - DNA, 25 bp, Homo sapien
gcttaataagtagttcattgaccct

SEQ ID NO: 334471 - DNA, 25 bp, Homo sapien
cattgaccctgtaagataggagcac

SEQ ID NO: 334472 - DNA, 25 bp, Homo sapien
ataggagcactcagctctgtcacaa

SEQ ID NO: 334473 - DNA, 25 bp, Homo sapien
agctctgtcacaatttgttgttaaa

SEQ ID NO: 334474 - DNA, 25 bp, Homo sapien
gttgttaaacacatcactcaatgta

SEQ ID NO: 334475 - DNA, 25 bp, Homo sapien
aaaatttagccagatgcgatggtat

SEQ ID NO: 334476 - DNA, 25 bp, Homo sapien
tgtgaggcccagctacccacgaaat

SEQ ID NO: 334477 - DNA, 25 bp, Homo sapien
gcccagctacccacgaaattgaggt

SEQ ID NO: 334478 - DNA, 25 bp, Homo sapien
cacgaaattgaggtgggagattgct

SEQ ID NO: 334479 - DNA, 25 bp, Homo sapien
gaattgcaggccaacacgggaggat

SEQ ID NO: 334480 - DNA, 25 bp, Homo sapien
attgcaggccaacacgggaggatca

SEQ ID NO: 334481 - DNA, 25 bp, Homo sapien
gctgagacgggccatgatcacacca

SEQ ID NO: 334482 - DNA, 25 bp, Homo sapien
gtctactaacaaaacgaaaatactg

SEQ ID NO: 334483 - DNA, 25 bp, Homo sapien
cctggagtttgaaatcggcctggga

SEQ ID NO: 334484 - DNA, 25 bp, Homo sapien
aaatcggcctgggagatgtaccaag

SEQ ID NO: 334485 - DNA, 25 bp, Homo sapien
ggcctgggagatgtaccaagacccc

SEQ ID NO: 334486 - DNA, 25 bp, Homo sapien
aaaggacgatttcaagtggagcctg

SEQ ID NO: 334487 - DNA, 25 bp, Homo sapien
aggaggcggcaaatagctcagtccg

SEQ ID NO: 334488 - DNA, 25 bp, Homo sapien
ggaggcggcaaatagctcagtccgc

SEQ ID NO: 334489 - DNA, 25 bp, Homo sapien
gaggcggcaaatagctcagtccgca

SEQ ID NO: 334490 - DNA, 25 bp, Homo sapien
aggcggcaaatagctcagtccgcac

SEQ ID NO: 334491 - DNA, 25 bp, Homo sapien
agtccgcactcaactcccttcccag

SEQ ID NO: 334492 - DNA, 25 bp, Homo sapien
gacagcagccccctagctgcaggag

SEQ ID NO: 334493 - DNA, 25 bp, Homo sapien
agcagccccctagctgcaggagtgt

SEQ ID NO: 334494 - DNA, 25 bp, Homo sapien
gatgcagacatggtccccactgggg

SEQ ID NO: 334495 - DNA, 25 bp, Homo sapien
tgcagacatggtccccactggggca

SEQ ID NO: 334496 - DNA, 25 bp, Homo sapien
gacatggtccccactggggcaaggc

SEQ ID NO: 334497 - DNA, 25 bp, Homo sapien
gccacctgaagctgataggccaggt

SEQ ID NO: 334498 - DNA, 25 bp, Homo sapien
ctgaagctgataggccaggtcagcc

SEQ ID NO: 334499 - DNA, 25 bp, Homo sapien
aggtcagcctgtgctcggcgggtgt

SEQ ID NO: 334500 - DNA, 25 bp, Homo sapien
cgggtgttgacctcgatgtcatagg

SEQ ID NO: 334501 - DNA, 25 bp, Homo sapien
tgacctcgatgtcataggcggcctt

SEQ ID NO: 334502 - DNA, 25 bp, Homo sapien
ataggcggccttcttcagttcgtaa

SEQ ID NO: 334503 - DNA, 25 bp, Homo sapien
tcttcagttcgtaatctctctgtgc

SEQ ID NO: 334504 - DNA, 25 bp, Homo sapien
ctctctgtgccttggccatctcgat

SEQ ID NO: 334505 - DNA, 25 bp, Homo sapien
tggccatctcgatctcactcaggta

SEQ ID NO: 334506 - DNA, 25 bp, Homo sapien
atctcgatctcactcaggtactgag

SEQ ID NO: 334507 - DNA, 25 bp, Homo sapien
caggtactgagcagacaccttttcc

SEQ ID NO: 334508 - DNA, 25 bp, Homo sapien
atcagcatcgtcatcccggctcgga

SEQ ID NO: 334509 - DNA, 25 bp, Homo sapien
aggccgccggagtccgcgaataccg

SEQ ID NO: 334510 - DNA, 25 bp, Homo sapien
cggccgaccgcgagttcctggagca

SEQ ID NO: 334511 - DNA, 25 bp, Homo sapien
gagcagcagcctccaaggttcccaa

SEQ ID NO: 334512 - DNA, 25 bp, Homo sapien
aaggttcccaaagcccacgattcag

SEQ ID NO: 334513 - DNA, 25 bp, Homo sapien
aaagcccacgattcaggcgagcggt

SEQ ID NO: 334514 - DNA, 25 bp, Homo sapien
acgattcaggcgagcggtgccgacc

SEQ ID NO: 334515 - DNA, 25 bp, Homo sapien
cgggccgtggactgtggcattttaa

SEQ ID NO: 334516 - DNA, 25 bp, Homo sapien
tacagaagtctcactgcacgactgg

SEQ ID NO: 334517 - DNA, 25 bp, Homo sapien
tcactgcacgactggcgcggccgag

SEQ ID NO: 334518 - DNA, 25 bp, Homo sapien
gcccaggagaccctccaagagattc

SEQ ID NO: 334519 - DNA, 25 bp, Homo sapien
tcacccgatgcagaccttgactttg

SEQ ID NO: 334520 - DNA, 25 bp, Homo sapien
gaccttgactttgatgttgaaatga

SEQ ID NO: 334521 - DNA, 25 bp, Homo sapien
acacttgttttacccaagtctggtg

SEQ ID NO: 334522 - DNA, 25 bp, Homo sapien
aagtctggtggaacaaatgcccaat

SEQ ID NO: 334523 - DNA, 25 bp, Homo sapien
aatgcccaatcatgtgaccttaaag

SEQ ID NO: 334524 - DNA, 25 bp, Homo sapien
aaagtgtactgcaaagctgtagctt

SEQ ID NO: 334525 - DNA, 25 bp, Homo sapien
taagtaattgctgttctgccactgc

SEQ ID NO: 334526 - DNA, 25 bp, Homo sapien
gttctgccactgcttactctgaaat

SEQ ID NO: 334527 - DNA, 25 bp, Homo sapien
gcttactctgaaatctaccatcaaa

SEQ ID NO: 334528 - DNA, 25 bp, Homo sapien
gggctgagccttggaatatatggtt

SEQ ID NO: 334529 - DNA, 25 bp, Homo sapien
ggcagcttgaactgtacggtccgtc

SEQ ID NO: 334530 - DNA, 25 bp, Homo sapien
tggaatcttactgtgttacccagga

SEQ ID NO: 334531 - DNA, 25 bp, Homo sapien
ggaatcttactgtgttacccaggat

SEQ ID NO: 334532 - DNA, 25 bp, Homo sapien
gtgttacccaggatgtgggccaagt

SEQ ID NO: 334533 - DNA, 25 bp, Homo sapien
gttacccaggatgtgggccaagttt

SEQ ID NO: 334534 - DNA, 25 bp, Homo sapien
tacccaggatgtgggccaagtttct

SEQ ID NO: 334535 - DNA, 25 bp, Homo sapien
caggatgtgggccaagtttcttcaa

SEQ ID NO: 334536 - DNA, 25 bp, Homo sapien
ggatgtgggccaagtttcttcaagg

SEQ ID NO: 334537 - DNA, 25 bp, Homo sapien
atgtgggccaagtttcttcaaggca

SEQ ID NO: 334538 - DNA, 25 bp, Homo sapien
tgtgggccaagtttcttcaaggcat

SEQ ID NO: 334539 - DNA, 25 bp, Homo sapien
tgggccaagtttcttcaaggcattg

SEQ ID NO: 334540 - DNA, 25 bp, Homo sapien
ggccaagtttcttcaaggcattggt

SEQ ID NO: 334541 - DNA, 25 bp, Homo sapien
aataaggctccttcatgtggcgtat

SEQ ID NO: 334542 - DNA, 25 bp, Homo sapien
ggcgtattgggccatagcctataat

SEQ ID NO: 334543 - DNA, 25 bp, Homo sapien
tggttagaacctcctattttaattg

SEQ ID NO: 334544 - DNA, 25 bp, Homo sapien
aattctggatctttcggactgaggc

SEQ ID NO: 334545 - DNA, 25 bp, Homo sapien
gaggccttctcaaactttactctaa

SEQ ID NO: 334546 - DNA, 25 bp, Homo sapien
ttactctaagtctccaagaatacag

SEQ ID NO: 334547 - DNA, 25 bp, Homo sapien
agaaaatgcttttccgcggcacgaa

SEQ ID NO: 334548 - DNA, 25 bp, Homo sapien
gcggcacgaatcagactcatctaca

SEQ ID NO: 334549 - DNA, 25 bp, Homo sapien
tcagactcatctacacagcagtatg

SEQ ID NO: 334550 - DNA, 25 bp, Homo sapien
tagaatgattccctcttgctattgg

SEQ ID NO: 334551 - DNA, 25 bp, Homo sapien
ccctcttgctattggaatgtggtcc

SEQ ID NO: 334552 - DNA, 25 bp, Homo sapien
tgaatgttcccacatgccctcaagt

SEQ ID NO: 334553 - DNA, 25 bp, Homo sapien
aagtacttaccacccaactctgtag

SEQ ID NO: 334554 - DNA, 25 bp, Homo sapien
aactctgtagcagtgcacagtggac

SEQ ID NO: 334555 - DNA, 25 bp, Homo sapien
tgttggcagtctcagtcctatttaa

SEQ ID NO: 334556 - DNA, 25 bp, Homo sapien
ttaatgatggccagagatacctcct

SEQ ID NO: 334557 - DNA, 25 bp, Homo sapien
gcgcagtagctcttcctgtagtgaa

SEQ ID NO: 334558 - DNA, 25 bp, Homo sapien
actgttcttcttatcattgttgact

SEQ ID NO: 334559 - DNA, 25 bp, Homo sapien
ggaagttgtctcactagccatatga

SEQ ID NO: 334560 - DNA, 25 bp, Homo sapien
ctagccatatgagccacagctgtct

SEQ ID NO: 334561 - DNA, 25 bp, Homo sapien
cccagagtgagatcggcagccttta

SEQ ID NO: 334562 - DNA, 25 bp, Homo sapien
gcctttaaggtattcatccagctga

SEQ ID NO: 334563 - DNA, 25 bp, Homo sapien
tgtgtctgtcaccacatcttgtctt

SEQ ID NO: 334564 - DNA, 25 bp, Homo sapien
ggaagaaggcaagccaaccttagct

SEQ ID NO: 334565 - DNA, 25 bp, Homo sapien
accttagctacaatcctaccttttg

SEQ ID NO: 334566 - DNA, 25 bp, Homo sapien
ccttagctacaatcctaccttttga

SEQ ID NO: 334567 - DNA, 25 bp, Homo sapien
cttagctacaatcctaccttttgat

SEQ ID NO: 334568 - DNA, 25 bp, Homo sapien
ttagctacaatcctaccttttgata

SEQ ID NO: 334569 - DNA, 25 bp, Homo sapien
agctacaatcctaccttttgataaa

SEQ ID NO: 334570 - DNA, 25 bp, Homo sapien
atgttccttttgacaatatacacgg

SEQ ID NO: 334571 - DNA, 25 bp, Homo sapien
gttccttttgacaatatacacggat

SEQ ID NO: 334572 - DNA, 25 bp, Homo sapien
ccttttgacaatatacacggattat

SEQ ID NO: 334573 - DNA, 25 bp, Homo sapien
atacacggattattatttgtacttt

SEQ ID NO: 334574 - DNA, 25 bp, Homo sapien
tatgcctttctaattaaatgattgg

SEQ ID NO: 334575 - DNA, 25 bp, Homo sapien
ggacttcattattgactcctgctgg

SEQ ID NO: 334576 - DNA, 25 bp, Homo sapien
acttcattattgactcctgctggcc

SEQ ID NO: 334577 - DNA, 25 bp, Homo sapien
ctgctggccgacatgacactaaaat

SEQ ID NO: 334578 - DNA, 25 bp, Homo sapien
atgacactaaaatgatatgcatctc

SEQ ID NO: 334579 - DNA, 25 bp, Homo sapien
atctcaatctgcatactccaagcca

SEQ ID NO: 334580 - DNA, 25 bp, Homo sapien
ctcaatctgcatactccaagccaaa

SEQ ID NO: 334581 - DNA, 25 bp, Homo sapien
aagccaaaacccaacatgccatatg

SEQ ID NO: 334582 - DNA, 25 bp, Homo sapien
aaaacccaacatgccatatgcattg

SEQ ID NO: 334583 - DNA, 25 bp, Homo sapien
atatgcattgcacatgtccttccaa

SEQ ID NO: 334584 - DNA, 25 bp, Homo sapien
tgcattgcacatgtccttccaaagg

SEQ ID NO: 334585 - DNA, 25 bp, Homo sapien
gatcttaggtcgtaaaacagtggta

SEQ ID NO: 334586 - DNA, 25 bp, Homo sapien
gtggtatattgcattcaaaagcatg

SEQ ID NO: 334587 - DNA, 25 bp, Homo sapien
caaaagcatgttgaggtgagggcaa

SEQ ID NO: 334588 - DNA, 25 bp, Homo sapien
aattggctgtgttttgctccacatc

SEQ ID NO: 334589 - DNA, 25 bp, Homo sapien
tggctgtgttttgctccacatctcc

SEQ ID NO: 334590 - DNA, 25 bp, Homo sapien
atctccctgctgtggttttgcactt

SEQ ID NO: 334591 - DNA, 25 bp, Homo sapien
ctgtggttttgcacttcggtgtgga

SEQ ID NO: 334592 - DNA, 25 bp, Homo sapien
ggacacattagttctgtggactgct

SEQ ID NO: 334593 - DNA, 25 bp, Homo sapien
ctgtggactgctggtaacacttcca

SEQ ID NO: 334594 - DNA, 25 bp, Homo sapien
aacacttccagtgaaacagcatata

SEQ ID NO: 334595 - DNA, 25 bp, Homo sapien
aaggtgtgtagatcttaggtcgtaa

SEQ ID NO: 334596 - DNA, 25 bp, Homo sapien
aagtgacttctacccgggagccgtg

SEQ ID NO: 334597 - DNA, 25 bp, Homo sapien
cttctacccgggagccgtgacagtg

SEQ ID NO: 334598 - DNA, 25 bp, Homo sapien
ttctacccgggagccgtgacagtgg

SEQ ID NO: 334599 - DNA, 25 bp, Homo sapien
acagtggcctggaaggcagatagca

SEQ ID NO: 334600 - DNA, 25 bp, Homo sapien
aaggcagatagcagccccgtcaagg

SEQ ID NO: 334601 - DNA, 25 bp, Homo sapien
aggcagatagcagccccgtcaaggc

SEQ ID NO: 334602 - DNA, 25 bp, Homo sapien
gcagatagcagccccgtcaaggcgg

SEQ ID NO: 334603 - DNA, 25 bp, Homo sapien
atagcagccccgtcaaggcgggagt

SEQ ID NO: 334604 - DNA, 25 bp, Homo sapien
gcagccccgtcaaggcgggagtgga

SEQ ID NO: 334605 - DNA, 25 bp, Homo sapien
gcgggagtggagaccaccacaccct

SEQ ID NO: 334606 - DNA, 25 bp, Homo sapien
aggtcacgcatgaagggagcaccgt

SEQ ID NO: 334607 - DNA, 25 bp, Homo sapien
gatgggacacaacctcagaatggca

SEQ ID NO: 334608 - DNA, 25 bp, Homo sapien
agaatggcagccatggcctctgatc

SEQ ID NO: 334609 - DNA, 25 bp, Homo sapien
ggcctctgatcacctagttcaacaa

SEQ ID NO: 334610 - DNA, 25 bp, Homo sapien
tttcagaagatctcagtccacgtcc

SEQ ID NO: 334611 - DNA, 25 bp, Homo sapien
aaccttgaccaaaatgtgaacccag

SEQ ID NO: 334612 - DNA, 25 bp, Homo sapien
ttaaaagatccaccggctactgact

SEQ ID NO: 334613 - DNA, 25 bp, Homo sapien
tgactcacttgctactcacagtact

SEQ ID NO: 334614 - DNA, 25 bp, Homo sapien
gtacttgctctcagcctttggataa

SEQ ID NO: 334615 - DNA, 25 bp, Homo sapien
gagtggtcactagtgcccttcccaa

SEQ ID NO: 334616 - DNA, 25 bp, Homo sapien
gcaagtcactagttttcccacccaa

SEQ ID NO: 334617 - DNA, 25 bp, Homo sapien
tcccacccaagtcactgtcaaagaa

SEQ ID NO: 334618 - DNA, 25 bp, Homo sapien
agttgcgtagacagtggcctcgaga

SEQ ID NO: 334619 - DNA, 25 bp, Homo sapien
gaggaggcctcggttggatgcgaag

SEQ ID NO: 334620 - DNA, 25 bp, Homo sapien
atgccaactggcaagcagctagctg

SEQ ID NO: 334621 - DNA, 25 bp, Homo sapien
aagcagctagctgacattggctata

SEQ ID NO: 334622 - DNA, 25 bp, Homo sapien
cattggctataagaccttctctacc

SEQ ID NO: 334623 - DNA, 25 bp, Homo sapien
tataagaccttctctacctccatga

SEQ ID NO: 334624 - DNA, 25 bp, Homo sapien
tacctccatgatgcttctcactgtg

SEQ ID NO: 334625 - DNA, 25 bp, Homo sapien
catgatgcttctcactgtgtatggg

SEQ ID NO: 334626 - DNA, 25 bp, Homo sapien
gtacctctgcagtgtccgagtctac

SEQ ID NO: 334627 - DNA, 25 bp, Homo sapien
gcagtgtccgagtctaccactattt

SEQ ID NO: 334628 - DNA, 25 bp, Homo sapien
taccactatttccagtggcgcaggg

SEQ ID NO: 334629 - DNA, 25 bp, Homo sapien
gtagccatccgccagcgcgggcgcc

SEQ ID NO: 334630 - DNA, 25 bp, Homo sapien
ccatccgccgcctacttacgcttca

SEQ ID NO: 334631 - DNA, 25 bp, Homo sapien
cctacttacgcttcacctctgccga

SEQ ID NO: 334632 - DNA, 25 bp, Homo sapien
gacccggcgcgctcggctgcgggcg

SEQ ID NO: 334633 - DNA, 25 bp, Homo sapien
ttcggctcctcctcggaatagctcg

SEQ ID NO: 334634 - DNA, 25 bp, Homo sapien
tcctcggaatagctcgcggcctgta

SEQ ID NO: 334635 - DNA, 25 bp, Homo sapien
cctcggaatagctcgcggcctgtag

SEQ ID NO: 334636 - DNA, 25 bp, Homo sapien
ctcggaatagctcgcggcctgtagc

SEQ ID NO: 334637 - DNA, 25 bp, Homo sapien
tcggaatagctcgcggcctgtagcc

SEQ ID NO: 334638 - DNA, 25 bp, Homo sapien
atagctcgcggcctgtagcccctgg

SEQ ID NO: 334639 - DNA, 25 bp, Homo sapien
cccccggtgtggacaggcagcggcg

SEQ ID NO: 334640 - DNA, 25 bp, Homo sapien
gttcacataaacaggcagtccaccc

SEQ ID NO: 334641 - DNA, 25 bp, Homo sapien
ataaacaggcagtccacccatgaag

SEQ ID NO: 334642 - DNA, 25 bp, Homo sapien
aggcagtccacccatgaagctatag

SEQ ID NO: 334643 - DNA, 25 bp, Homo sapien
agtccacccatgaagctatagcttg

SEQ ID NO: 334644 - DNA, 25 bp, Homo sapien
tgaagctatagcttgctgacccctt

SEQ ID NO: 334645 - DNA, 25 bp, Homo sapien
tatagcttgctgaccccttgtttaa

SEQ ID NO: 334646 - DNA, 25 bp, Homo sapien
cttgctgaccccttgtttaaacaat

SEQ ID NO: 334647 - DNA, 25 bp, Homo sapien
gaccccttgtttaaacaatcaattg

SEQ ID NO: 334648 - DNA, 25 bp, Homo sapien
taaccatgttgataccatttccagt

SEQ ID NO: 334649 - DNA, 25 bp, Homo sapien
tgttgataccatttccagtgctttt

SEQ ID NO: 334650 - DNA, 25 bp, Homo sapien
tttacttctgcctgaaacattttct

SEQ ID NO: 334651 - DNA, 25 bp, Homo sapien
acaagcgattgtccatctgttgcct

SEQ ID NO: 334652 - DNA, 25 bp, Homo sapien
tgtccatctgttgcctagagctata

SEQ ID NO: 334653 - DNA, 25 bp, Homo sapien
ctagagctatagtacatgtgtgtta

SEQ ID NO: 334654 - DNA, 25 bp, Homo sapien
agcatgttccatacccctgctttag

SEQ ID NO: 334655 - DNA, 25 bp, Homo sapien
cctgctttagccatctgtgggaaac

SEQ ID NO: 334656 - DNA, 25 bp, Homo sapien
gccatctgtgggaaaccagcaaact

SEQ ID NO: 334657 - DNA, 25 bp, Homo sapien
gacacctctgcaaaatgtgcctcaa

SEQ ID NO: 334658 - DNA, 25 bp, Homo sapien
gtgcctcaagtccatttcttgggat

SEQ ID NO: 334659 - DNA, 25 bp, Homo sapien
tcttgggatcgctcgtttggtgcac

SEQ ID NO: 334660 - DNA, 25 bp, Homo sapien
tttggtgcactctcgtgggagacaa

SEQ ID NO: 334661 - DNA, 25 bp, Homo sapien
aacatatacttgtgccttattttca

SEQ ID NO: 334662 - DNA, 25 bp, Homo sapien
attttaagaacactcgggaaatgag

SEQ ID NO: 334663 - DNA, 25 bp, Homo sapien
aaattgctgctagtcaaatcttttg

SEQ ID NO: 334664 - DNA, 25 bp, Homo sapien
aagaatttctggaagtggtcacttt

SEQ ID NO: 334665 - DNA, 25 bp, Homo sapien
ggcagttctatagtagtccagactt

SEQ ID NO: 334666 - DNA, 25 bp, Homo sapien
tagtccagactttagaaaccaaaca

SEQ ID NO: 334667 - DNA, 25 bp, Homo sapien
atggcttgttgccaatatggccaca

SEQ ID NO: 334668 - DNA, 25 bp, Homo sapien
aatatggccacaacattgccagcaa

SEQ ID NO: 334669 - DNA, 25 bp, Homo sapien
ttgccagcaaatactgccttggcat

SEQ ID NO: 334670 - DNA, 25 bp, Homo sapien
tgccttggcatcactcagcagaggt

SEQ ID NO: 334671 - DNA, 25 bp, Homo sapien
gcatcactcagcagaggtttttgtt

SEQ ID NO: 334672 - DNA, 25 bp, Homo sapien
gatgaagtcttgaatactgttcaat

SEQ ID NO: 334673 - DNA, 25 bp, Homo sapien
cctggcctgggtgtttatttgggca

SEQ ID NO: 334674 - DNA, 25 bp, Homo sapien
cctgggtgtttatttgggcaatgca

SEQ ID NO: 334675 - DNA, 25 bp, Homo sapien
tttgggcaatgcaagctgacattgt

SEQ ID NO: 334676 - DNA, 25 bp, Homo sapien
agctgacattgtgaggtgttgccga

SEQ ID NO: 334677 - DNA, 25 bp, Homo sapien
cattgtgaggtgttgccgatgccca

SEQ ID NO: 334678 - DNA, 25 bp, Homo sapien
tgaggtgttgccgatgcccaggcca

SEQ ID NO: 334679 - DNA, 25 bp, Homo sapien
atgcccaggccagctagcagggagc

SEQ ID NO: 334680 - DNA, 25 bp, Homo sapien
tcccagggctggtagaaacctatgt

SEQ ID NO: 334681 - DNA, 25 bp, Homo sapien
gacatgtaaaacagcaatctctatt

SEQ ID NO: 334682 - DNA, 25 bp, Homo sapien
tgttgaacatgcttgtatactcttc

SEQ ID NO: 334683 - DNA, 25 bp, Homo sapien
gcttgtatactcttcattaaccatt

SEQ ID NO: 334684 - DNA, 25 bp, Homo sapien
aaaggagcatccttacctccaaaag

SEQ ID NO: 334685 - DNA, 25 bp, Homo sapien
aaagcacagggacacaaagaggaat

SEQ ID NO: 334686 - DNA, 25 bp, Homo sapien
tttagcttgttcacactttgcccta

SEQ ID NO: 334687 - DNA, 25 bp, Homo sapien
acactttgccctatgacatttctac

SEQ ID NO: 334688 - DNA, 25 bp, Homo sapien
tgacatttctacatcactggctgct

SEQ ID NO: 334689 - DNA, 25 bp, Homo sapien
tacatcactggctgctcttcatcaa

SEQ ID NO: 334690 - DNA, 25 bp, Homo sapien
cactggctgctcttcatcaaaccta

SEQ ID NO: 334691 - DNA, 25 bp, Homo sapien
ttcaactgtttctttgggcctttat

SEQ ID NO: 334692 - DNA, 25 bp, Homo sapien
tttgggcctttatttccttatggag

SEQ ID NO: 334693 - DNA, 25 bp, Homo sapien
tatggaggccctcgtgtcgtgtaaa

SEQ ID NO: 334694 - DNA, 25 bp, Homo sapien
ggccctcgtgtcgtgtaaaacttat

SEQ ID NO: 334695 - DNA, 25 bp, Homo sapien
ttttacattctgttccccagttaca

SEQ ID NO: 334696 - DNA, 25 bp, Homo sapien
attctgttccccagttacaggaagg

SEQ ID NO: 334697 - DNA, 25 bp, Homo sapien
tccccagttacaggaaggagtccct

SEQ ID NO: 334698 - DNA, 25 bp, Homo sapien
gaaggagtccctttggtgtgtgaat

SEQ ID NO: 334699 - DNA, 25 bp, Homo sapien
gagtccctttggtgtgtgaatatgt

SEQ ID NO: 334700 - DNA, 25 bp, Homo sapien
ggcatgcacatgagttgaaattctt

SEQ ID NO: 334701 - DNA, 25 bp, Homo sapien
gggatgtcagtttcctatggaagag

SEQ ID NO: 334702 - DNA, 25 bp, Homo sapien
tatggaagagacacctctgacccgt

SEQ ID NO: 334703 - DNA, 25 bp, Homo sapien
acctctgacccgttattcttataat

SEQ ID NO: 334704 - DNA, 25 bp, Homo sapien
ttccccactcgttgggttcaactag

SEQ ID NO: 334705 - DNA, 25 bp, Homo sapien
cactcgttgggttcaactagattaa

SEQ ID NO: 334706 - DNA, 25 bp, Homo sapien
gaaatgtgtggcatgcacatgagtt

SEQ ID NO: 334707 - DNA, 25 bp, Homo sapien
ggcatgcacatgagttgaaattctt

SEQ ID NO: 334708 - DNA, 25 bp, Homo sapien
catgcacatgagttgaaattctttt

SEQ ID NO: 334709 - DNA, 25 bp, Homo sapien
gggatgtcagtttcctatggaagag

SEQ ID NO: 334710 - DNA, 25 bp, Homo sapien
gaagagacacctctgacccgttatt

SEQ ID NO: 334711 - DNA, 25 bp, Homo sapien
acctctgacccgttattcttataat

SEQ ID NO: 334712 - DNA, 25 bp, Homo sapien
tctgacccgttattcttataatcaa

SEQ ID NO: 334713 - DNA, 25 bp, Homo sapien
gacccgttattcttataatcaaaat

SEQ ID NO: 334714 - DNA, 25 bp, Homo sapien
ttccccactcgttgggttcaactag

SEQ ID NO: 334715 - DNA, 25 bp, Homo sapien
cccactcgttgggttcaactagatt

SEQ ID NO: 334716 - DNA, 25 bp, Homo sapien
cactcgttgggttcaactagattaa

SEQ ID NO: 334717 - DNA, 25 bp, Homo sapien
tgagatgggagaaaaaccgccctat

SEQ ID NO: 334718 - DNA, 25 bp, Homo sapien
agatgggagaaaaaccgccctatgg

SEQ ID NO: 334719 - DNA, 25 bp, Homo sapien
gaggcgagacatgtttacagcaatg

SEQ ID NO: 334720 - DNA, 25 bp, Homo sapien
aatctggcttacatgcacgtccagt

SEQ ID NO: 334721 - DNA, 25 bp, Homo sapien
tggcttacatgcacgtccagtcata

SEQ ID NO: 334722 - DNA, 25 bp, Homo sapien
gcttacatgcacgtccagtcatagt

SEQ ID NO: 334723 - DNA, 25 bp, Homo sapien
ttacatgcacgtccagtcatagtac

SEQ ID NO: 334724 - DNA, 25 bp, Homo sapien
catagattctattgctcacgtttgt

SEQ ID NO: 334725 - DNA, 25 bp, Homo sapien
tagattctattgctcacgtttgttg

SEQ ID NO: 334726 - DNA, 25 bp, Homo sapien
gattctattgctcacgtttgttgct

SEQ ID NO: 334727 - DNA, 25 bp, Homo sapien
tctattgctcacgtttgttgctgac

SEQ ID NO: 334728 - DNA, 25 bp, Homo sapien
ttcccttcaaagtggcattcagcag

SEQ ID NO: 334729 - DNA, 25 bp, Homo sapien
agtggcattcagcagaggagtattc

SEQ ID NO: 334730 - DNA, 25 bp, Homo sapien
tcagcagaggagtattctctcaaaa

SEQ ID NO: 334731 - DNA, 25 bp, Homo sapien
tcaaaaatgctcagtctctcccatc

SEQ ID NO: 334732 - DNA, 25 bp, Homo sapien
gcctcttactacttggagttctcaa

SEQ ID NO: 334733 - DNA, 25 bp, Homo sapien
ggagttctcaacctagagactatgt

SEQ ID NO: 334734 - DNA, 25 bp, Homo sapien
ataatcagatttcagttttccctat

SEQ ID NO: 334735 - DNA, 25 bp, Homo sapien
gaaactctgaggcagccacttatct

SEQ ID NO: 334736 - DNA, 25 bp, Homo sapien
gaggcagccacttatcttggctaaa

SEQ ID NO: 334737 - DNA, 25 bp, Homo sapien
cacttatcttggctaaatagaacct

SEQ ID NO: 334738 - DNA, 25 bp, Homo sapien
acctcacctgctcatgaccagagag

SEQ ID NO: 334739 - DNA, 25 bp, Homo sapien
gcgtgaaccccagggaacagcgggt

SEQ ID NO: 334740 - DNA, 25 bp, Homo sapien
atttattcaacagacaatgacagct

SEQ ID NO: 334741 - DNA, 25 bp, Homo sapien
tttattcaacagacaatgacagctg

SEQ ID NO: 334742 - DNA, 25 bp, Homo sapien
tattcaacagacaatgacagctgat

SEQ ID NO: 334743 - DNA, 25 bp, Homo sapien
attcaacagacaatgacagctgata

SEQ ID NO: 334744 - DNA, 25 bp, Homo sapien
ttcaacagacaatgacagctgatat

SEQ ID NO: 334745 - DNA, 25 bp, Homo sapien
tcaacagacaatgacagctgatatt

SEQ ID NO: 334746 - DNA, 25 bp, Homo sapien
caacagacaatgacagctgatattt

SEQ ID NO: 334747 - DNA, 25 bp, Homo sapien
acagacaatgacagctgatatttat

SEQ ID NO: 334748 - DNA, 25 bp, Homo sapien
acatagccctagcaggagctcccag

SEQ ID NO: 334749 - DNA, 25 bp, Homo sapien
catagccctagcaggagctcccagc

SEQ ID NO: 334750 - DNA, 25 bp, Homo sapien
tgttgttcagccctctctcttgttc

SEQ ID NO: 334751 - DNA, 25 bp, Homo sapien
ttgttccctttctgagcatgtggtc

SEQ ID NO: 334752 - DNA, 25 bp, Homo sapien
ttccccaggctgtgggacagctgcc

SEQ ID NO: 334753 - DNA, 25 bp, Homo sapien
agctgccttcccacgaaagtgtaaa

SEQ ID NO: 334754 - DNA, 25 bp, Homo sapien
taagatcattactgcatgtgcccta

SEQ ID NO: 334755 - DNA, 25 bp, Homo sapien
attactgcatgtgccctaaaaaccc

SEQ ID NO: 334756 - DNA, 25 bp, Homo sapien
ttctattcccttaggacagaaaatt

SEQ ID NO: 334757 - DNA, 25 bp, Homo sapien
taatcgagtttcagtgacccacgtc

SEQ ID NO: 334758 - DNA, 25 bp, Homo sapien
gacccacgtcagttacacattaaag

SEQ ID NO: 334759 - DNA, 25 bp, Homo sapien
acacattaaagccagaccccatgat

SEQ ID NO: 334760 - DNA, 25 bp, Homo sapien
aagccagaccccatgataaaattcc

SEQ ID NO: 334761 - DNA, 25 bp, Homo sapien
agagaaacacttctgctgtcacctt

SEQ ID NO: 334762 - DNA, 25 bp, Homo sapien
ctgctgtcaccttgaatgaactcag

SEQ ID NO: 334763 - DNA, 25 bp, Homo sapien
tgaactcaggaatagcttccctctg

SEQ ID NO: 334764 - DNA, 25 bp, Homo sapien
aatagcttccctctggactgtagag

SEQ ID NO: 334765 - DNA, 25 bp, Homo sapien
ctggctgttgattttgtctggttcc

SEQ ID NO: 334766 - DNA, 25 bp, Homo sapien
tgtctggttcctttgccaacatctg

SEQ ID NO: 334767 - DNA, 25 bp, Homo sapien
acaccctttgcccagacacgagtgg

SEQ ID NO: 334768 - DNA, 25 bp, Homo sapien
ttctcctcagtttccaaagtaaatg

SEQ ID NO: 334769 - DNA, 25 bp, Homo sapien
ttctactagcaaatgaccctaccat

SEQ ID NO: 334770 - DNA, 25 bp, Homo sapien
gaccctaccatttatttctgccttt

SEQ ID NO: 334771 - DNA, 25 bp, Homo sapien
tctgcctttttcttccgttcattgt

SEQ ID NO: 334772 - DNA, 25 bp, Homo sapien
ggaggatctgcagactttcacggat

SEQ ID NO: 334773 - DNA, 25 bp, Homo sapien
gactttcacggattcatggaacaag

SEQ ID NO: 334774 - DNA, 25 bp, Homo sapien
cataggtacttttaggtgccattag

SEQ ID NO: 334775 - DNA, 25 bp, Homo sapien
ggtgccattaggtattgatcagtga

SEQ ID NO: 334776 - DNA, 25 bp, Homo sapien
gatcagtgaaatcctagggtgctct

SEQ ID NO: 334777 - DNA, 25 bp, Homo sapien
gtgctctatgagattgtactaggcc

SEQ ID NO: 334778 - DNA, 25 bp, Homo sapien
gtactaggcctatgaagagtggtaa

SEQ ID NO: 334779 - DNA, 25 bp, Homo sapien
aagccaaataggtctccatgggaga

SEQ ID NO: 334780 - DNA, 25 bp, Homo sapien
gtttgctggttcctgttggtgtctc

SEQ ID NO: 334781 - DNA, 25 bp, Homo sapien
gttggtgtctccacaagtaggtaaa

SEQ ID NO: 334782 - DNA, 25 bp, Homo sapien
gttagactttttaaactcaaggatg

SEQ ID NO: 334783 - DNA, 25 bp, Homo sapien
cacataaatgattttggcataccat

SEQ ID NO: 334784 - DNA, 25 bp, Homo sapien
gcataccattagagaaaccatttgt

SEQ ID NO: 334785 - DNA, 25 bp, Homo sapien
aatgaccacataaagcttatcaagg

SEQ ID NO: 334786 - DNA, 25 bp, Homo sapien
caaggagtctagattggttttgttt

SEQ ID NO: 334787 - DNA, 25 bp, Homo sapien
aactcattgagggtgctcttgccag

SEQ ID NO: 334788 - DNA, 25 bp, Homo sapien
gagggtgctcttgccagctgctgaa

SEQ ID NO: 334789 - DNA, 25 bp, Homo sapien
gaaaatagaagttggctactctcag

SEQ ID NO: 334790 - DNA, 25 bp, Homo sapien
agttggctactctcagaatttggtt

SEQ ID NO: 334791 - DNA, 25 bp, Homo sapien
gaatttggtttaaagctggacagat

SEQ ID NO: 334792 - DNA, 25 bp, Homo sapien
gctggacagatttgctttgttatag

SEQ ID NO: 334793 - DNA, 25 bp, Homo sapien
tttgttatagggtaaagctttgtct

SEQ ID NO: 334794 - DNA, 25 bp, Homo sapien
tattttttaaaccatgctctggcat

SEQ ID NO: 334795 - DNA, 25 bp, Homo sapien
atgttgaatatttttgtgcacctaa

SEQ ID NO: 334796 - DNA, 25 bp, Homo sapien
gtgcacctaaaacttaagccaattt

SEQ ID NO: 334797 - DNA, 25 bp, Homo sapien
cttatttgtgattacctttctcctt

SEQ ID NO: 334798 - DNA, 25 bp, Homo sapien
tccttcccaaaaagctttatctatt

SEQ ID NO: 334799 - DNA, 25 bp, Homo sapien
tcaaccctcctaaaagttcaacctg

SEQ ID NO: 334800 - DNA, 25 bp, Homo sapien
gttcaacctgttcatcttgaacttg

SEQ ID NO: 334801 - DNA, 25 bp, Homo sapien
cttgaacttggcctgagaacatttt

SEQ ID NO: 334802 - DNA, 25 bp, Homo sapien
ggcctgagaacattttctgggaaga

SEQ ID NO: 334803 - DNA, 25 bp, Homo sapien
ggaacatcagaaacgtatcttgctt

SEQ ID NO: 334804 - DNA, 25 bp, Homo sapien
gaaacgtatcttgcttgctaattat

SEQ ID NO: 334805 - DNA, 25 bp, Homo sapien
cagagggtcccgatgagctgcttcc

SEQ ID NO: 334806 - DNA, 25 bp, Homo sapien
gcttggttcagtgcctgctcgggaa

SEQ ID NO: 334807 - DNA, 25 bp, Homo sapien
tcgggaacctgctcgcttgacaatg

SEQ ID NO: 334808 - DNA, 25 bp, Homo sapien
ttgacaatggcctcgcccagggagg

SEQ ID NO: 334809 - DNA, 25 bp, Homo sapien
gggaagtagcccacccggtcattgc

SEQ ID NO: 334810 - DNA, 25 bp, Homo sapien
attgcccgtccggttgtcatggatg

SEQ ID NO: 334811 - DNA, 25 bp, Homo sapien
ggccatccggatgctgctcgaggac

SEQ ID NO: 334812 - DNA, 25 bp, Homo sapien
gatgctgctcgaggactgtgatgat

SEQ ID NO: 334813 - DNA, 25 bp, Homo sapien
actgtgatgatgtcccctgccttca

SEQ ID NO: 334814 - DNA, 25 bp, Homo sapien
gctggtcaggtcgtaattgttgcaa

SEQ ID NO: 334815 - DNA, 25 bp, Homo sapien
aattgttgcaataatccttggtcgc

SEQ ID NO: 334816 - DNA, 25 bp, Homo sapien
gtaggcctgaagactgttctttccc

SEQ ID NO: 334817 - DNA, 25 bp, Homo sapien
tttcccctctcaactttgaataaat

SEQ ID NO: 334818 - DNA, 25 bp, Homo sapien
tcccaactctacatattgcctcaaa

SEQ ID NO: 334819 - DNA, 25 bp, Homo sapien
ttgatgttgcattctctgttccttt

SEQ ID NO: 334820 - DNA, 25 bp, Homo sapien
cccagtgtctgcagaagagtagtgt

SEQ ID NO: 334821 - DNA, 25 bp, Homo sapien
gtgtataagggcttctgctcttgat

SEQ ID NO: 334822 - DNA, 25 bp, Homo sapien
gcttctgctcttgatggtgtatttc

SEQ ID NO: 334823 - DNA, 25 bp, Homo sapien
ttgatttttcctctcaagctgccta

SEQ ID NO: 334824 - DNA, 25 bp, Homo sapien
tcctttttaatagcagaggccttgg

SEQ ID NO: 334825 - DNA, 25 bp, Homo sapien
tgggagaacctgtctaagaaaacct

SEQ ID NO: 334826 - DNA, 25 bp, Homo sapien
ctttagctctttgttgtaggcctga

SEQ ID NO: 334827 - DNA, 25 bp, Homo sapien
ttttaactttccattcctggcagtg

SEQ ID NO: 334828 - DNA, 25 bp, Homo sapien
gtgacgccaggagctttaagtgatg

SEQ ID NO: 334829 - DNA, 25 bp, Homo sapien
gaaatatgcgagtcaatcagtggat

SEQ ID NO: 334830 - DNA, 25 bp, Homo sapien
atggagtaacttggctagaatatgg

SEQ ID NO: 334831 - DNA, 25 bp, Homo sapien
gaatatggcagtaactacaaggcat

SEQ ID NO: 334832 - DNA, 25 bp, Homo sapien
tacaaggcatgttctgctctggcac

SEQ ID NO: 334833 - DNA, 25 bp, Homo sapien
catgttctgctctggcacgaagaca

SEQ ID NO: 334834 - DNA, 25 bp, Homo sapien
tggcacgaagacaacccacctgagg

SEQ ID NO: 334835 - DNA, 25 bp, Homo sapien
cacctgaggcaccagacacatgagt

SEQ ID NO: 334836 - DNA, 25 bp, Homo sapien
gatccaggcagaaccttacagagct

SEQ ID NO: 334837 - DNA, 25 bp, Homo sapien
ttacagagctgggagttttttaact

SEQ ID NO: 334838 - DNA, 25 bp, Homo sapien
gaatggaatgcaagccttttctcaa

SEQ ID NO: 334839 - DNA, 25 bp, Homo sapien
aagccttttctcaaggtcttaatga

SEQ ID NO: 334840 - DNA, 25 bp, Homo sapien
caaggtcttaatgagcaacagcaac

SEQ ID NO: 334841 - DNA, 25 bp, Homo sapien
acagcaacagcagtctccagttaag

SEQ ID NO: 334842 - DNA, 25 bp, Homo sapien
cagagatttcctgttgaagctctca

SEQ ID NO: 334843 - DNA, 25 bp, Homo sapien
gaagctctcaagtgtttccatctgc

SEQ ID NO: 334844 - DNA, 25 bp, Homo sapien
ctcaagtgtttccatctgcagaaaa

SEQ ID NO: 334845 - DNA, 25 bp, Homo sapien
aaaccagactttctgcctgatcatc

SEQ ID NO: 334846 - DNA, 25 bp, Homo sapien
cctgatcatcccattgtactgcaaa

SEQ ID NO: 334847 - DNA, 25 bp, Homo sapien
gacatctgcaaatgaggtggatcta

SEQ ID NO: 334848 - DNA, 25 bp, Homo sapien
ggtggatctagcaacaataactgta

SEQ ID NO: 334849 - DNA, 25 bp, Homo sapien
gggcataggtggacaggctctggca

SEQ ID NO: 334850 - DNA, 25 bp, Homo sapien
tctgggtgccaggtacgacgcttgc

SEQ ID NO: 334851 - DNA, 25 bp, Homo sapien
gtgccaggtacgacgcttgccccgg

SEQ ID NO: 334852 - DNA, 25 bp, Homo sapien
atccccaccctagatggagcgaggg

SEQ ID NO: 334853 - DNA, 25 bp, Homo sapien
tggagcgagggcctttttactcacc

SEQ ID NO: 334854 - DNA, 25 bp, Homo sapien
gagcgagggcctttttactcacctt

SEQ ID NO: 334855 - DNA, 25 bp, Homo sapien
ttttctaccgtttttagactgtatg

SEQ ID NO: 334856 - DNA, 25 bp, Homo sapien
taccgtttttagactgtatgtagat

SEQ ID NO: 334857 - DNA, 25 bp, Homo sapien
ctgtatgtagatttggttacctcct

SEQ ID NO: 334858 - DNA, 25 bp, Homo sapien
gtagatttggttacctcctggttga

SEQ ID NO: 334859 - DNA, 25 bp, Homo sapien
gatttggttacctcctggttgaaat

SEQ ID NO: 334860 - DNA, 25 bp, Homo sapien
ggccagaagaacactatgccatggt

SEQ ID NO: 334861 - DNA, 25 bp, Homo sapien
cactatgccatggttgcactgaatt

SEQ ID NO: 334862 - DNA, 25 bp, Homo sapien
actgaattttgtgcctactctaggg

SEQ ID NO: 334863 - DNA, 25 bp, Homo sapien
gtgcctactctagggcaaacagaat

SEQ ID NO: 334864 - DNA, 25 bp, Homo sapien
gaaggagttcctatctatctgtaaa

SEQ ID NO: 334865 - DNA, 25 bp, Homo sapien
gagaacatgaaattctgttggcaga

SEQ ID NO: 334866 - DNA, 25 bp, Homo sapien
ttctgttggcagaagcagcattttg

SEQ ID NO: 334867 - DNA, 25 bp, Homo sapien
gaagaaataaaaggttcactgcagc

SEQ ID NO: 334868 - DNA, 25 bp, Homo sapien
agctgacccccctaaatggttgaat

SEQ ID NO: 334869 - DNA, 25 bp, Homo sapien
aaagtgtcacatttacctcttccct

SEQ ID NO: 334870 - DNA, 25 bp, Homo sapien
catttacctcttccctatcttttgt

SEQ ID NO: 334871 - DNA, 25 bp, Homo sapien
cctagaataatggaacactctggaa

SEQ ID NO: 334872 - DNA, 25 bp, Homo sapien
aacactctggaaatgggctagaatg

SEQ ID NO: 334873 - DNA, 25 bp, Homo sapien
gggctagaatgttgagcagcagcct

SEQ ID NO: 334874 - DNA, 25 bp, Homo sapien
agcctcccaaatcacagtatgcata

SEQ ID NO: 334875 - DNA, 25 bp, Homo sapien
gccaaaacagatgacagagctcagt

SEQ ID NO: 334876 - DNA, 25 bp, Homo sapien
aaggaagaccttactatttgtgaca

SEQ ID NO: 334877 - DNA, 25 bp, Homo sapien
agaccttactatttgtgacatccat

SEQ ID NO: 334878 - DNA, 25 bp, Homo sapien
tgacatccatcagaattttaacttg

SEQ ID NO: 334879 - DNA, 25 bp, Homo sapien
aaaacactatttcaggctttggtct

SEQ ID NO: 334880 - DNA, 25 bp, Homo sapien
ttcaggctttggtctgacttactgg

SEQ ID NO: 334881 - DNA, 25 bp, Homo sapien
ctgacttactggttcgtgggcataa

SEQ ID NO: 334882 - DNA, 25 bp, Homo sapien
ggaattctctagatatactcagcct

SEQ ID NO: 334883 - DNA, 25 bp, Homo sapien
tagatatactcagcctaacccagtg

SEQ ID NO: 334884 - DNA, 25 bp, Homo sapien
tttttcttgtggcatcttccagcaa

SEQ ID NO: 334885 - DNA, 25 bp, Homo sapien
cagcaagttagaagtctcatgggat

SEQ ID NO: 334886 - DNA, 25 bp, Homo sapien
tgggataagactgcagttcccctgg

SEQ ID NO: 334887 - DNA, 25 bp, Homo sapien
agttcccctggttcaatagctggaa

SEQ ID NO: 334888 - DNA, 25 bp, Homo sapien
ctttttctggatcccttgtaaacat

SEQ ID NO: 334889 - DNA, 25 bp, Homo sapien
ggatcccttgtaaacatgaaatcat

SEQ ID NO: 334890 - DNA, 25 bp, Homo sapien
atcattccatggatggctgccttat

SEQ ID NO: 334891 - DNA, 25 bp, Homo sapien
taattttgtctctttccactttaat

SEQ ID NO: 334892 - DNA, 25 bp, Homo sapien
gtctctttccactttaattgtgaat

SEQ ID NO: 334893 - DNA, 25 bp, Homo sapien
attgcagtaggaggaaatatattta

SEQ ID NO: 334894 - DNA, 25 bp, Homo sapien
tttatagcaaatagagactcgttat

SEQ ID NO: 334895 - DNA, 25 bp, Homo sapien
gcaaatagagactcgttatttaaag

SEQ ID NO: 334896 - DNA, 25 bp, Homo sapien
tttttgccagtttagggcagtagct

SEQ ID NO: 334897 - DNA, 25 bp, Homo sapien
gggcagtagctgcttttgtcataaa

SEQ ID NO: 334898 - DNA, 25 bp, Homo sapien
gcagtagctgcttttgtcataaata

SEQ ID NO: 334899 - DNA, 25 bp, Homo sapien
gtcataaatatcttcctaccacatc

SEQ ID NO: 334900 - DNA, 25 bp, Homo sapien
ggaattttctctctataagtttctg

SEQ ID NO: 334901 - DNA, 25 bp, Homo sapien
gaattttctctctataagtttctgt

SEQ ID NO: 334902 - DNA, 25 bp, Homo sapien
tttctctctataagtttctgtcatt

SEQ ID NO: 334903 - DNA, 25 bp, Homo sapien
tctctctataagtttctgtcattga

SEQ ID NO: 334904 - DNA, 25 bp, Homo sapien
aatcagaactgaggtagcttagaga

SEQ ID NO: 334905 - DNA, 25 bp, Homo sapien
agaactgaggtagcttagagatgta

SEQ ID NO: 334906 - DNA, 25 bp, Homo sapien
gtagcttagagatgtagcgatgtaa

SEQ ID NO: 334907 - DNA, 25 bp, Homo sapien
gatgtagcgatgtaagtgtcgatgt

SEQ ID NO: 334908 - DNA, 25 bp, Homo sapien
agcgatgtaagtgtcgatgtttttt

SEQ ID NO: 334909 - DNA, 25 bp, Homo sapien
ttattttagtagctgatgctggcac

SEQ ID NO: 334910 - DNA, 25 bp, Homo sapien
ttttagtagctgatgctggcacatc

SEQ ID NO: 334911 - DNA, 25 bp, Homo sapien
agtagctgatgctggcacatcattt

SEQ ID NO: 334912 - DNA, 25 bp, Homo sapien
ctggcacatcattttgctggagagt

SEQ ID NO: 334913 - DNA, 25 bp, Homo sapien
gagttttttatatactgtagcctga

SEQ ID NO: 334914 - DNA, 25 bp, Homo sapien
tttttatatactgtagcctgatttc

SEQ ID NO: 334915 - DNA, 25 bp, Homo sapien
gggctgttttcatgacacatcttgt

SEQ ID NO: 334916 - DNA, 25 bp, Homo sapien
tcatgacacatcttgttttgaaatg

SEQ ID NO: 334917 - DNA, 25 bp, Homo sapien
gcatgtgaaatgttagtccgaacct

SEQ ID NO: 334918 - DNA, 25 bp, Homo sapien
aatgttagtccgaacctctgtaaag

SEQ ID NO: 334919 - DNA, 25 bp, Homo sapien
tagtccgaacctctgtaaaggaagt

SEQ ID NO: 334920 - DNA, 25 bp, Homo sapien
gaagtttttgcgtatgtagttagac

SEQ ID NO: 334921 - DNA, 25 bp, Homo sapien
gtagttagacattaatacacatgct

SEQ ID NO: 334922 - DNA, 25 bp, Homo sapien
tcatttataggcctgcatgcatact

SEQ ID NO: 334923 - DNA, 25 bp, Homo sapien
ggcctgcatgcatacttccaaaaca

SEQ ID NO: 334924 - DNA, 25 bp, Homo sapien
tcctggaggcatcaacggctcttta

SEQ ID NO: 334925 - DNA, 25 bp, Homo sapien
ggcatcaacggctctttaaataaat

SEQ ID NO: 334926 - DNA, 25 bp, Homo sapien
aactgacacaagttcttgtcctcta

SEQ ID NO: 334927 - DNA, 25 bp, Homo sapien
gttcttgtcctctacacttgagaga

SEQ ID NO: 334928 - DNA, 25 bp, Homo sapien
gagagaactagctgtttaacgcata

SEQ ID NO: 334929 - DNA, 25 bp, Homo sapien
ttcagtgtcactatataacatgctg

SEQ ID NO: 334930 - DNA, 25 bp, Homo sapien
taacatgctgtcttacttgattctg

SEQ ID NO: 334931 - DNA, 25 bp, Homo sapien
tctgtttttcagacttcattctagt

SEQ ID NO: 334932 - DNA, 25 bp, Homo sapien
agacttcattctagtttctctttgt

SEQ ID NO: 334933 - DNA, 25 bp, Homo sapien
gagtctcagagataatgtgtgcttt

SEQ ID NO: 334934 - DNA, 25 bp, Homo sapien
aatttacaactctctctaggtaggt

SEQ ID NO: 334935 - DNA, 25 bp, Homo sapien
actctctctaggtaggtgattacat

SEQ ID NO: 334936 - DNA, 25 bp, Homo sapien
atgccagctaagatttatggattca

SEQ ID NO: 334937 - DNA, 25 bp, Homo sapien
gaatgggaagaagccttgcacagaa

SEQ ID NO: 334938 - DNA, 25 bp, Homo sapien
tgcacagaacaccagtgggtcaagg

SEQ ID NO: 334939 - DNA, 25 bp, Homo sapien
tcaaggacagcagaggcccgggacc

SEQ ID NO: 334940 - DNA, 25 bp, Homo sapien
cgggacccccaacaggaaagcagat

SEQ ID NO: 334941 - DNA, 25 bp, Homo sapien
atgaaactggcccacagccagcctg

SEQ ID NO: 334942 - DNA, 25 bp, Homo sapien
tccctgaggcctgaggaggatagct

SEQ ID NO: 334943 - DNA, 25 bp, Homo sapien
aaggctgggtcagtcctgtttccac

SEQ ID NO: 334944 - DNA, 25 bp, Homo sapien
ggaagtgatcagagctgcctcatga

SEQ ID NO: 334945 - DNA, 25 bp, Homo sapien
agagctgcctcatgactggcacagt

SEQ ID NO: 334946 - DNA, 25 bp, Homo sapien
tggcacagtgccagcacagggccag

SEQ ID NO: 334947 - DNA, 25 bp, Homo sapien
gggtctctgtgaaggcctccacgag

SEQ ID NO: 334948 - DNA, 25 bp, Homo sapien
attttgtgctttctgtaacagtgca

SEQ ID NO: 334949 - DNA, 25 bp, Homo sapien
gtaacagtgcatgcttcagcacaga

SEQ ID NO: 334950 - DNA, 25 bp, Homo sapien
gcacagaaaactcagcattgattat

SEQ ID NO: 334951 - DNA, 25 bp, Homo sapien
tgtggtgagacgtcatagtcttcat

SEQ ID NO: 334952 - DNA, 25 bp, Homo sapien
gtcatagtcttcatgagaacgtggg

SEQ ID NO: 334953 - DNA, 25 bp, Homo sapien
gaactatagttatttctaccgacac

SEQ ID NO: 334954 - DNA, 25 bp, Homo sapien
tatccttgtttgtatatgtcctgtc

SEQ ID NO: 334955 - DNA, 25 bp, Homo sapien
gtttgtatatgtcctgtcacagagt

SEQ ID NO: 334956 - DNA, 25 bp, Homo sapien
gtcacagagtgtcctcttggtgtat

SEQ ID NO: 334957 - DNA, 25 bp, Homo sapien
gagtgtcctcttggtgtattctaaa

SEQ ID NO: 334958 - DNA, 25 bp, Homo sapien
ggtgtattctaaaacgagcattctt

SEQ ID NO: 334959 - DNA, 25 bp, Homo sapien
tcagactgctgtatatgaggagctt

SEQ ID NO: 334960 - DNA, 25 bp, Homo sapien
gaaacacgaagactctgtgatgtca

SEQ ID NO: 334961 - DNA, 25 bp, Homo sapien
tgtgatgtcagaccttttcttccag

SEQ ID NO: 334962 - DNA, 25 bp, Homo sapien
atgtcagaccttttcttccagttct

SEQ ID NO: 334963 - DNA, 25 bp, Homo sapien
ttcttccagttctcaaattagtgac

SEQ ID NO: 334964 - DNA, 25 bp, Homo sapien
tagtgacaagaagttgtgacccagg

SEQ ID NO: 334965 - DNA, 25 bp, Homo sapien
aagcagatgttatggaagcaagttc

SEQ ID NO: 334966 - DNA, 25 bp, Homo sapien
ggaagcaagttcacaattacccaat

SEQ ID NO: 334967 - DNA, 25 bp, Homo sapien
attacccaatgttcaacctccttat

SEQ ID NO: 334968 - DNA, 25 bp, Homo sapien
caatgttcaacctccttatggatat

SEQ ID NO: 334969 - DNA, 25 bp, Homo sapien
gtttgcatgtgtgaatcagactgct

SEQ ID NO: 334970 - DNA, 25 bp, Homo sapien
gatattgtgccttttggtgccaggt

SEQ ID NO: 334971 - DNA, 25 bp, Homo sapien
gttcaaagtcaagtgccgatctatg

SEQ ID NO: 334972 - DNA, 25 bp, Homo sapien
agtgccgatctatgaaccagtgtac

SEQ ID NO: 334973 - DNA, 25 bp, Homo sapien
caagccttccattcctaagtgggat

SEQ ID NO: 334974 - DNA, 25 bp, Homo sapien
tcctaagtgggattggctcagtttt

SEQ ID NO: 334975 - DNA, 25 bp, Homo sapien
attggctcagttttgcccatccata

SEQ ID NO: 334976 - DNA, 25 bp, Homo sapien
agttttgcccatccatatggcagca

SEQ ID NO: 334977 - DNA, 25 bp, Homo sapien
ccatccatatggcagcatctctaat

SEQ ID NO: 334978 - DNA, 25 bp, Homo sapien
ggcagcatctctaatagctcttgta

SEQ ID NO: 334979 - DNA, 25 bp, Homo sapien
aatagctcttgtacagggtatcaga

SEQ ID NO: 334980 - DNA, 25 bp, Homo sapien
gggtatcagatattgtgccttttgg

SEQ ID NO: 334981 - DNA, 25 bp, Homo sapien
caatctagcaggttgctccaggcag

SEQ ID NO: 334982 - DNA, 25 bp, Homo sapien
tattccaagaaaacctgcccctggg

SEQ ID NO: 334983 - DNA, 25 bp, Homo sapien
aggtcacagctttgttgtcctggga

SEQ ID NO: 334984 - DNA, 25 bp, Homo sapien
tcacagctttgttgtcctgggacaa

SEQ ID NO: 334985 - DNA, 25 bp, Homo sapien
agtgtctggtgattaggcagcccca

SEQ ID NO: 334986 - DNA, 25 bp, Homo sapien
gtcctagccaactggaagaagggct

SEQ ID NO: 334987 - DNA, 25 bp, Homo sapien
ggaaacacagtcctgggctatttta

SEQ ID NO: 334988 - DNA, 25 bp, Homo sapien
gtcctgggctattttatatgtgtca

SEQ ID NO: 334989 - DNA, 25 bp, Homo sapien
taactggtacaggtttactggtgtc

SEQ ID NO: 334990 - DNA, 25 bp, Homo sapien
acaggtttactggtgtctacactgg

SEQ ID NO: 334991 - DNA, 25 bp, Homo sapien
ttcccttcgtggcaatctagcaggt

SEQ ID NO: 334992 - DNA, 25 bp, Homo sapien
gaaactctacagcttttgtgtgaaa

SEQ ID NO: 334993 - DNA, 25 bp, Homo sapien
aaacaggacaaactccgtgggcagg

SEQ ID NO: 334994 - DNA, 25 bp, Homo sapien
gctccacctgactagaggattccaa

SEQ ID NO: 334995 - DNA, 25 bp, Homo sapien
gaaggactcaaactggacaccaaat

SEQ ID NO: 334996 - DNA, 25 bp, Homo sapien
aaatccacatagttctgcctggcag

SEQ ID NO: 334997 - DNA, 25 bp, Homo sapien
gaatgctcaactctgttgtatgaag

SEQ ID NO: 334998 - DNA, 25 bp, Homo sapien
tggcagcttcctgaacggacgatga

SEQ ID NO: 334999 - DNA, 25 bp, Homo sapien
ggacgatgacaaacaacctcagccc

SEQ ID NO: 335000 - DNA, 25 bp, Homo sapien
aacctcagcccatggtcaatgaata

SEQ ID NO: 335001 - DNA, 25 bp, Homo sapien
tgaagtagccacaattaccaacctt

SEQ ID NO: 335002 - DNA, 25 bp, Homo sapien
caaccttcctgcacaaatcaaacaa

SEQ ID NO: 335003 - DNA, 25 bp, Homo sapien
cacggatcccatacgtgagatcctt

SEQ ID NO: 335004 - DNA, 25 bp, Homo sapien
ccctgggcgtccatggaagtcgttc

SEQ ID NO: 335005 - DNA, 25 bp, Homo sapien
atcccatacgtgagatccttttcaa

SEQ ID NO: 335006 - DNA, 25 bp, Homo sapien
catacgtgagatccttttcaagcat

SEQ ID NO: 335007 - DNA, 25 bp, Homo sapien
aggaagacattaacctttaggctga

SEQ ID NO: 335008 - DNA, 25 bp, Homo sapien
ttaacctttaggctgaagaaaatgt

SEQ ID NO: 335009 - DNA, 25 bp, Homo sapien
gttttagtacacagcaataacttat

SEQ ID NO: 335010 - DNA, 25 bp, Homo sapien
aacttatttgtctttatccaacagc

SEQ ID NO: 335011 - DNA, 25 bp, Homo sapien
atttgtctttatccaacagccataa

SEQ ID NO: 335012 - DNA, 25 bp, Homo sapien
ccttttcaagcatattgggagccag

SEQ ID NO: 335013 - DNA, 25 bp, Homo sapien
taactgtgtgtgcttcttgccccgg

SEQ ID NO: 335014 - DNA, 25 bp, Homo sapien
gcaaaacccctgtggacgacccgat

SEQ ID NO: 335015 - DNA, 25 bp, Homo sapien
aaacccctgtggacgacccgatgag

SEQ ID NO: 335016 - DNA, 25 bp, Homo sapien
tgtggacgacccgatgagcctgcta

SEQ ID NO: 335017 - DNA, 25 bp, Homo sapien
tggacgacccgatgagcctgctata

SEQ ID NO: 335018 - DNA, 25 bp, Homo sapien
acgacccgatgagcctgctatacaa

SEQ ID NO: 335019 - DNA, 25 bp, Homo sapien
gacccgatgagcctgctatacaaca

SEQ ID NO: 335020 - DNA, 25 bp, Homo sapien
ccgatgagcctgctatacaacatga

SEQ ID NO: 335021 - DNA, 25 bp, Homo sapien
tgagcctgctatacaacatgaacga

SEQ ID NO: 335022 - DNA, 25 bp, Homo sapien
gcctgctatacaacatgaacgactg

SEQ ID NO: 335023 - DNA, 25 bp, Homo sapien
tgctatacaacatgaacgactgcta

SEQ ID NO: 335024 - DNA, 25 bp, Homo sapien
tatacaacatgaacgactgctactc

SEQ ID NO: 335025 - DNA, 25 bp, Homo sapien
attttcttgttgacaccctaggctt

SEQ ID NO: 335026 - DNA, 25 bp, Homo sapien
ttcttgttgacaccctaggcttagg

SEQ ID NO: 335027 - DNA, 25 bp, Homo sapien
aaagtggtcactgagatagtcttga

SEQ ID NO: 335028 - DNA, 25 bp, Homo sapien
agtcttgaggatgtgctatgcagta

SEQ ID NO: 335029 - DNA, 25 bp, Homo sapien
atgtgctatgcagtagccaagccct

SEQ ID NO: 335030 - DNA, 25 bp, Homo sapien
tagccaagccctcttacggtgtgtt

SEQ ID NO: 335031 - DNA, 25 bp, Homo sapien
ttacggtgtgttcctctcttagtgc

SEQ ID NO: 335032 - DNA, 25 bp, Homo sapien
ttcttcccttgcagtggtgtattag

SEQ ID NO: 335033 - DNA, 25 bp, Homo sapien
gcagtggtgtattagccttggacat

SEQ ID NO: 335034 - DNA, 25 bp, Homo sapien
tagccttggacattaaaacatttgc

SEQ ID NO: 335035 - DNA, 25 bp, Homo sapien
ggaggcattctgattaaacagctga

SEQ ID NO: 335036 - DNA, 25 bp, Homo sapien
gagaggcaagagttgttcctgccct

SEQ ID NO: 335037 - DNA, 25 bp, Homo sapien
agaggcaagagttgttcctgccctt

SEQ ID NO: 335038 - DNA, 25 bp, Homo sapien
aggcaagagttgttcctgcccttcc

SEQ ID NO: 335039 - DNA, 25 bp, Homo sapien
gtgacttgaagaaccctgactttgt

SEQ ID NO: 335040 - DNA, 25 bp, Homo sapien
tgacttgaagaaccctgactttgtt

SEQ ID NO: 335041 - DNA, 25 bp, Homo sapien
cttgaagaaccctgactttgtttct

SEQ ID NO: 335042 - DNA, 25 bp, Homo sapien
tgaagaaccctgactttgtttctgc

SEQ ID NO: 335043 - DNA, 25 bp, Homo sapien
cctgcatgtgtctgtgttcgtgtag

SEQ ID NO: 335044 - DNA, 25 bp, Homo sapien
tgcatgtgtctgtgttcgtgtaggc

SEQ ID NO: 335045 - DNA, 25 bp, Homo sapien
gtgtctgtgttcgtgtaggcataat

SEQ ID NO: 335046 - DNA, 25 bp, Homo sapien
ctgtgttcgtgtaggcataatgtga

SEQ ID NO: 335047 - DNA, 25 bp, Homo sapien
ttcacgattctttgggttgactgga

SEQ ID NO: 335048 - DNA, 25 bp, Homo sapien
ttgactggatggatcctttgctcca

SEQ ID NO: 335049 - DNA, 25 bp, Homo sapien
gatggatcctttgctccatggtggg

SEQ ID NO: 335050 - DNA, 25 bp, Homo sapien
gggattgctgggttcatcatgcaga

SEQ ID NO: 335051 - DNA, 25 bp, Homo sapien
tcatcatgcagatgcactcaggagt

SEQ ID NO: 335052 - DNA, 25 bp, Homo sapien
ctcaggagtgagtttggctgtgact

SEQ ID NO: 335053 - DNA, 25 bp, Homo sapien
ttggctgtgactgggatgtccaaga

SEQ ID NO: 335054 - DNA, 25 bp, Homo sapien
tctggtgcctcaggtgggttgtctt

SEQ ID NO: 335055 - DNA, 25 bp, Homo sapien
gggttgtcttcgtgccagagcagaa

SEQ ID NO: 335056 - DNA, 25 bp, Homo sapien
ttcgtgccagagcagaacatgcctt

SEQ ID NO: 335057 - DNA, 25 bp, Homo sapien
cagagcagaacatgccttgtagtta

SEQ ID NO: 335058 - DNA, 25 bp, Homo sapien
caccatgaccctcttcccacgctga

SEQ ID NO: 335059 - DNA, 25 bp, Homo sapien
accatgaccctcttcccacgctgac

SEQ ID NO: 335060 - DNA, 25 bp, Homo sapien
ccatgaccctcttcccacgctgacc

SEQ ID NO: 335061 - DNA, 25 bp, Homo sapien
catgaccctcttcccacgctgacct

SEQ ID NO: 335062 - DNA, 25 bp, Homo sapien
atgaccctcttcccacgctgacctg

SEQ ID NO: 335063 - DNA, 25 bp, Homo sapien
tgaccctcttcccacgctgacctgt

SEQ ID NO: 335064 - DNA, 25 bp, Homo sapien
gaccctcttcccacgctgacctgtg

SEQ ID NO: 335065 - DNA, 25 bp, Homo sapien
accctcttcccacgctgacctgtgc

SEQ ID NO: 335066 - DNA, 25 bp, Homo sapien
tcttcccacgctgacctgtgctccc

SEQ ID NO: 335067 - DNA, 25 bp, Homo sapien
cttcccacgctgacctgtgctccct

SEQ ID NO: 335068 - DNA, 25 bp, Homo sapien
ttcccacgctgacctgtgctccctc

SEQ ID NO: 335069 - DNA, 25 bp, Homo sapien
tgatcaacgtgactattccaacaat

SEQ ID NO: 335070 - DNA, 25 bp, Homo sapien
gtgactattccaacaatacagagaa

SEQ ID NO: 335071 - DNA, 25 bp, Homo sapien
agaagacaaccaaagatgagctgtt

SEQ ID NO: 335072 - DNA, 25 bp, Homo sapien
aagatgagctgttgaatttactaaa

SEQ ID NO: 335073 - DNA, 25 bp, Homo sapien
aatttactaaaaactcttgatgagg

SEQ ID NO: 335074 - DNA, 25 bp, Homo sapien
tgaggattcaaaactttctgccaaa

SEQ ID NO: 335075 - DNA, 25 bp, Homo sapien
gctaggtcaattctataagtgtcac

SEQ ID NO: 335076 - DNA, 25 bp, Homo sapien
ttctataagtgtcacccagacatct

SEQ ID NO: 335077 - DNA, 25 bp, Homo sapien
gagcattttggagactgagttttta

SEQ ID NO: 335078 - DNA, 25 bp, Homo sapien
gtatcctaaatatccaatcacattt

SEQ ID NO: 335079 - DNA, 25 bp, Homo sapien
gtggaagctctaaatttgaaactgt

SEQ ID NO: 335080 - DNA, 25 bp, Homo sapien
aaagcctgttagaatgggtctcttg

SEQ ID NO: 335081 - DNA, 25 bp, Homo sapien
gaatgggtctcttgtgtgctctaac

SEQ ID NO: 335082 - DNA, 25 bp, Homo sapien
gtgctctaacattgtgtattagttt

SEQ ID NO: 335083 - DNA, 25 bp, Homo sapien
tgtgtattagttttggtctacccaa

SEQ ID NO: 335084 - DNA, 25 bp, Homo sapien
tacccaagaagcctggaacttgaga

SEQ ID NO: 335085 - DNA, 25 bp, Homo sapien
gaagaggcggaatgagtcaccccaa

SEQ ID NO: 335086 - DNA, 25 bp, Homo sapien
gcggaatgagtcaccccaaacattt

SEQ ID NO: 335087 - DNA, 25 bp, Homo sapien
aacagagtaagacagaatgccttcc

SEQ ID NO: 335088 - DNA, 25 bp, Homo sapien
aaataaccttttttgctggatactg

SEQ ID NO: 335089 - DNA, 25 bp, Homo sapien
accttttttgctggatactgtctaa

SEQ ID NO: 335090 - DNA, 25 bp, Homo sapien
gctggatactgtctaactatactaa

SEQ ID NO: 335091 - DNA, 25 bp, Homo sapien
actttagcttatggcatcaatttac

SEQ ID NO: 335092 - DNA, 25 bp, Homo sapien
atttactaaggaacaacaggctcac

SEQ ID NO: 335093 - DNA, 25 bp, Homo sapien
acaggctcaccaactgatgtcaaac

SEQ ID NO: 335094 - DNA, 25 bp, Homo sapien
catcagtctgatacgatatggtact

SEQ ID NO: 335095 - DNA, 25 bp, Homo sapien
ggtactactttgaatctgttactag

SEQ ID NO: 335096 - DNA, 25 bp, Homo sapien
gttactagtaccatcttgacagagg

SEQ ID NO: 335097 - DNA, 25 bp, Homo sapien
ttgacagaggatacatgctcccaaa

SEQ ID NO: 335098 - DNA, 25 bp, Homo sapien
tgctcccaaaacgtttgttaccaca

SEQ ID NO: 335099 - DNA, 25 bp, Homo sapien
gttaccacacttaaaaatcactgcc

SEQ ID NO: 335100 - DNA, 25 bp, Homo sapien
aatcactgccatcattaagcatcag

SEQ ID NO: 335101 - DNA, 25 bp, Homo sapien
agccattcatgatttactttttcca

SEQ ID NO: 335102 - DNA, 25 bp, Homo sapien
tgcaaggagcctattatgccagccc

SEQ ID NO: 335103 - DNA, 25 bp, Homo sapien
aggagactgtccgtattgtggcttt

SEQ ID NO: 335104 - DNA, 25 bp, Homo sapien
gatcgagatttccatgttcactgct

SEQ ID NO: 335105 - DNA, 25 bp, Homo sapien
tgttcactgctaccgatgcgaggat

SEQ ID NO: 335106 - DNA, 25 bp, Homo sapien
attgcggtggtctcctgtctgaagg

SEQ ID NO: 335107 - DNA, 25 bp, Homo sapien
gaaggagataaccaaggctgctacc

SEQ ID NO: 335108 - DNA, 25 bp, Homo sapien
ttggatgggcacatcctctgcaaga

SEQ ID NO: 335109 - DNA, 25 bp, Homo sapien
aactctgcccgcatcagggtgttga

SEQ ID NO: 335110 - DNA, 25 bp, Homo sapien
atcagggtgttgaccgccaaggcga

SEQ ID NO: 335111 - DNA, 25 bp, Homo sapien
aggcgagcactgacctttagattca

SEQ ID NO: 335112 - DNA, 25 bp, Homo sapien
ttagattcagtcacctgttcagccg

SEQ ID NO: 335113 - DNA, 25 bp, Homo sapien
acaaaatcaagtcacggcgcctaca

SEQ ID NO: 335114 - DNA, 25 bp, Homo sapien
aagtcacggcgcctacaaagatgag

SEQ ID NO: 335115 - DNA, 25 bp, Homo sapien
attctggctgccttttaatttcgtc

SEQ ID NO: 335116 - DNA, 25 bp, Homo sapien
ggctgccttttaatttcgtccttca

SEQ ID NO: 335117 - DNA, 25 bp, Homo sapien
ttaatttcgtccttcacctgatatc

SEQ ID NO: 335118 - DNA, 25 bp, Homo sapien
cttcacctgatatctgtgccagaga

SEQ ID NO: 335119 - DNA, 25 bp, Homo sapien
aggagttctgctacagagaagagag

SEQ ID NO: 335120 - DNA, 25 bp, Homo sapien
agagaagagagtaacccccatccat

SEQ ID NO: 335121 - DNA, 25 bp, Homo sapien
cgctctggatccagcccgacaaatg

SEQ ID NO: 335122 - DNA, 25 bp, Homo sapien
aagccggatggcaaaagagcccaga

SEQ ID NO: 335123 - DNA, 25 bp, Homo sapien
agagcccagaacctattggaactga

SEQ ID NO: 335124 - DNA, 25 bp, Homo sapien
tgctgcctaagagaaagtggcccaa

SEQ ID NO: 335125 - DNA, 25 bp, Homo sapien
aagtggcccaagaagcactggcccg

SEQ ID NO: 335126 - DNA, 25 bp, Homo sapien
aggagccctctgctactgcctgaca

SEQ ID NO: 335127 - DNA, 25 bp, Homo sapien
tactgcctgacacaagcatcctgcg

SEQ ID NO: 335128 - DNA, 25 bp, Homo sapien
gaaagcgtgggccacaggtaccact

SEQ ID NO: 335129 - DNA, 25 bp, Homo sapien
aggtaccactccctatgccactgag

SEQ ID NO: 335130 - DNA, 25 bp, Homo sapien
gggtcaaggaacaagcctctactca

SEQ ID NO: 335131 - DNA, 25 bp, Homo sapien
aagcctctactcacatgcatgtggg

SEQ ID NO: 335132 - DNA, 25 bp, Homo sapien
gggcaaatgaagtcacagaacaaat

SEQ ID NO: 335133 - DNA, 25 bp, Homo sapien
agaacaaataacctaccctgcatcc

SEQ ID NO: 335134 - DNA, 25 bp, Homo sapien
aaataacctaccctgcatccaggca

SEQ ID NO: 335135 - DNA, 25 bp, Homo sapien
aatgtagagttacgatatgatccag

SEQ ID NO: 335136 - DNA, 25 bp, Homo sapien
aaagtggaaacaatcccagttccag

SEQ ID NO: 335137 - DNA, 25 bp, Homo sapien
taatgtgtattagctattgtgtgct

SEQ ID NO: 335138 - DNA, 25 bp, Homo sapien
tagctattgtgtgctaagcattcaa

SEQ ID NO: 335139 - DNA, 25 bp, Homo sapien
gtgtgctaagcattcaactagatta

SEQ ID NO: 335140 - DNA, 25 bp, Homo sapien
gtgctaagcattcaactagattatt

SEQ ID NO: 335141 - DNA, 25 bp, Homo sapien
gcattcaactagattatttacaaac

SEQ ID NO: 335142 - DNA, 25 bp, Homo sapien
tatttacaaaccttgtatcatctca

SEQ ID NO: 335143 - DNA, 25 bp, Homo sapien
gtatcatctcaactctttaaagact

SEQ ID NO: 335144 - DNA, 25 bp, Homo sapien
aaagactgtattgcaatgttttgaa

SEQ ID NO: 335145 - DNA, 25 bp, Homo sapien
attgcaatgttttgaatattcagag

SEQ ID NO: 335146 - DNA, 25 bp, Homo sapien
agccggaacacggttctgtccagga

SEQ ID NO: 335147 - DNA, 25 bp, Homo sapien
gaacacggttctgtccaggagagcc

SEQ ID NO: 335148 - DNA, 25 bp, Homo sapien
tccaggagagccaggtatcggagca

SEQ ID NO: 335149 - DNA, 25 bp, Homo sapien
agccaggtatcggagcagccggcca

SEQ ID NO: 335150 - DNA, 25 bp, Homo sapien
agcaggagagaaccccctggagttc

SEQ ID NO: 335151 - DNA, 25 bp, Homo sapien
cagttccagaacatgcggcaggtga

SEQ ID NO: 335152 - DNA, 25 bp, Homo sapien
aacatgcggcaggtgattcagcaga

SEQ ID NO: 335153 - DNA, 25 bp, Homo sapien
aggtgattcagcagaaccctgcgct

SEQ ID NO: 335154 - DNA, 25 bp, Homo sapien
aggagaaccctcagcttttacagca

SEQ ID NO: 335155 - DNA, 25 bp, Homo sapien
ttttacagcaaatcagccggcacca

SEQ ID NO: 335156 - DNA, 25 bp, Homo sapien
aaatcagccggcaccaggagcagtt

SEQ ID NO: 335157 - DNA, 25 bp, Homo sapien
tcggaagcggctgtgaccgggcaga

SEQ ID NO: 335158 - DNA, 25 bp, Homo sapien
ctgtgaccgggcagaggtgctatct

SEQ ID NO: 335159 - DNA, 25 bp, Homo sapien
ggtgctatctgggactctgggttct

SEQ ID NO: 335160 - DNA, 25 bp, Homo sapien
gtgctatctgggactctgggttctc

SEQ ID NO: 335161 - DNA, 25 bp, Homo sapien
actctgggttctcagcccggggaca

SEQ ID NO: 335162 - DNA, 25 bp, Homo sapien
tccatctggacttcttcccggggct

SEQ ID NO: 335163 - DNA, 25 bp, Homo sapien
aaccgaggggcagatgatccatcag

SEQ ID NO: 335164 - DNA, 25 bp, Homo sapien
gatccatcagaaaagagccggcact

SEQ ID NO: 335165 - DNA, 25 bp, Homo sapien
ccatcagaaaagagccggcactgcc

SEQ ID NO: 335166 - DNA, 25 bp, Homo sapien
tcagaaaagagccggcactgcccag

SEQ ID NO: 335167 - DNA, 25 bp, Homo sapien
tacggccgcttgaccccatctttga

SEQ ID NO: 335168 - DNA, 25 bp, Homo sapien
ggaaattatttctgtaaatccagtt

SEQ ID NO: 335169 - DNA, 25 bp, Homo sapien
gtaaatccagttgcattttataata

SEQ ID NO: 335170 - DNA, 25 bp, Homo sapien
tgcattttataatacttgagtgact

SEQ ID NO: 335171 - DNA, 25 bp, Homo sapien
gagtgactaactgaattgaaaccta

SEQ ID NO: 335172 - DNA, 25 bp, Homo sapien
attacaattaatagggttctcaaag

SEQ ID NO: 335173 - DNA, 25 bp, Homo sapien
agggttctcaaaggcctattcctat

SEQ ID NO: 335174 - DNA, 25 bp, Homo sapien
aaggcctattcctattagaagaaat

SEQ ID NO: 335175 - DNA, 25 bp, Homo sapien
tgaaaaaatttaccacagccttgtc

SEQ ID NO: 335176 - DNA, 25 bp, Homo sapien
atttaccacagccttgtctgatttt

SEQ ID NO: 335177 - DNA, 25 bp, Homo sapien
cacagccttgtctgattttaagaat

SEQ ID NO: 335178 - DNA, 25 bp, Homo sapien
atttctgttggtaacctctgtgttt

SEQ ID NO: 335179 - DNA, 25 bp, Homo sapien
tctgtgcctcttacgcatatgttac

SEQ ID NO: 335180 - DNA, 25 bp, Homo sapien
caaattatctggagttcctaatcaa

SEQ ID NO: 335181 - DNA, 25 bp, Homo sapien
tcctaatcaatgcagagttcccctc

SEQ ID NO: 335182 - DNA, 25 bp, Homo sapien
ctcccctccgattgttctaaataat

SEQ ID NO: 335183 - DNA, 25 bp, Homo sapien
aattgaaagatgtctgctgtggaaa

SEQ ID NO: 335184 - DNA, 25 bp, Homo sapien
aatctgtatgattctcaaccatctt

SEQ ID NO: 335185 - DNA, 25 bp, Homo sapien
gattctcaaccatctttagttggga

SEQ ID NO: 335186 - DNA, 25 bp, Homo sapien
gggaaaggtccttgaaagccaatgg

SEQ ID NO: 335187 - DNA, 25 bp, Homo sapien
ttttcttggcactaatcaagtgagt

SEQ ID NO: 335188 - DNA, 25 bp, Homo sapien
gagtgttaccttttcacttagtagg

SEQ ID NO: 335189 - DNA, 25 bp, Homo sapien
gtaggatgtgttgttacgctagtaa

SEQ ID NO: 335190 - DNA, 25 bp, Homo sapien
ttccagtcccatatgccctctatag

SEQ ID NO: 335191 - DNA, 25 bp, Homo sapien
ccatatgccctctatagctgtcatt

SEQ ID NO: 335192 - DNA, 25 bp, Homo sapien
atatgccctctatagctgtcattcc

SEQ ID NO: 335193 - DNA, 25 bp, Homo sapien
atgccctctatagctgtcattcctt

SEQ ID NO: 335194 - DNA, 25 bp, Homo sapien
ccctctatagctgtcattcctttaa

SEQ ID NO: 335195 - DNA, 25 bp, Homo sapien
cctctatagctgtcattcctttaag

SEQ ID NO: 335196 - DNA, 25 bp, Homo sapien
tctatagctgtcattcctttaagtg

SEQ ID NO: 335197 - DNA, 25 bp, Homo sapien
tatagctgtcattcctttaagtgca

SEQ ID NO: 335198 - DNA, 25 bp, Homo sapien
atagctgtcattcctttaagtgcag

SEQ ID NO: 335199 - DNA, 25 bp, Homo sapien
agctgtcattcctttaagtgcagca

SEQ ID NO: 335200 - DNA, 25 bp, Homo sapien
tgtcattcctttaagtgcagcaaga

SEQ ID NO: 335201 - DNA, 25 bp, Homo sapien
aatacaaaaatacatcacagccttc

SEQ ID NO: 335202 - DNA, 25 bp, Homo sapien
gtatattgccatatcgtctggtgaa

SEQ ID NO: 335203 - DNA, 25 bp, Homo sapien
catatcgtctggtgaaagggttaaa

SEQ ID NO: 335204 - DNA, 25 bp, Homo sapien
aattacttcacctcttgcactttta

SEQ ID NO: 335205 - DNA, 25 bp, Homo sapien
acttcacctcttgcacttttagatg

SEQ ID NO: 335206 - DNA, 25 bp, Homo sapien
gcacttttagatgcaaatcagtttt

SEQ ID NO: 335207 - DNA, 25 bp, Homo sapien
tattcacgtatttttacatcatttg

SEQ ID NO: 335208 - DNA, 25 bp, Homo sapien
tacatcatttgtttttcctgaccag

SEQ ID NO: 335209 - DNA, 25 bp, Homo sapien
ggatattctgaaaaatggccaacaa

SEQ ID NO: 335210 - DNA, 25 bp, Homo sapien
tagaagtagcatcccaagcagcgtg

SEQ ID NO: 335211 - DNA, 25 bp, Homo sapien
agcagcgtgcctaaacattacattg

SEQ ID NO: 335212 - DNA, 25 bp, Homo sapien
gcggatacatttcacgtcctcaaga

SEQ ID NO: 335213 - DNA, 25 bp, Homo sapien
acaaccctggcgacaggtctggatt

SEQ ID NO: 335214 - DNA, 25 bp, Homo sapien
gctaaattcctgcactgaggttcta

SEQ ID NO: 335215 - DNA, 25 bp, Homo sapien
tgaggttctacctcggctgaactga

SEQ ID NO: 335216 - DNA, 25 bp, Homo sapien
tcggctgaactgactcgtggatggt

SEQ ID NO: 335217 - DNA, 25 bp, Homo sapien
tggaacccatttactaagcctctaa

SEQ ID NO: 335218 - DNA, 25 bp, Homo sapien
aagcctctaattggtttcattttgg

SEQ ID NO: 335219 - DNA, 25 bp, Homo sapien
ggctcaagttgcatggtttcccgaa

SEQ ID NO: 335220 - DNA, 25 bp, Homo sapien
gtttcccgaatctatgcacctggag

SEQ ID NO: 335221 - DNA, 25 bp, Homo sapien
taagcacttttctggttgccactga

SEQ ID NO: 335222 - DNA, 25 bp, Homo sapien
aaagcatgccggcaaacgctgctct

SEQ ID NO: 335223 - DNA, 25 bp, Homo sapien
gaagtactgtgctcaaattttacat

SEQ ID NO: 335224 - DNA, 25 bp, Homo sapien
aattctgtaatttcactcaacgatt

SEQ ID NO: 335225 - DNA, 25 bp, Homo sapien
ttcactcaacgattaagtctaccaa

SEQ ID NO: 335226 - DNA, 25 bp, Homo sapien
gtctaccaaagaacacactgcatgt

SEQ ID NO: 335227 - DNA, 25 bp, Homo sapien
gatgtattacaatctcaaagccagt

SEQ ID NO: 335228 - DNA, 25 bp, Homo sapien
agaaatcttgcttcactgttcacct

SEQ ID NO: 335229 - DNA, 25 bp, Homo sapien
tcactgttcacctgctacaagtaag

SEQ ID NO: 335230 - DNA, 25 bp, Homo sapien
tggtgctggtagaaacatttgactc

SEQ ID NO: 335231 - DNA, 25 bp, Homo sapien
gtctattttattctacataagagcc

SEQ ID NO: 335232 - DNA, 25 bp, Homo sapien
aatgtactgtaacaaaggagcttct

SEQ ID NO: 335233 - DNA, 25 bp, Homo sapien
ggagcttcttgtccccttggtcttt

SEQ ID NO: 335234 - DNA, 25 bp, Homo sapien
tggcctgggactgagtccacacgga

SEQ ID NO: 335235 - DNA, 25 bp, Homo sapien
gagtccacacggatagatttttcct

SEQ ID NO: 335236 - DNA, 25 bp, Homo sapien
gatttttccttgtaaccttgagacg

SEQ ID NO: 335237 - DNA, 25 bp, Homo sapien
ttgtaaccttgagacgagaattcca

SEQ ID NO: 335238 - DNA, 25 bp, Homo sapien
gaattccaaggagtgtcaccatcag

SEQ ID NO: 335239 - DNA, 25 bp, Homo sapien
aggagtgtcaccatcagaggcttct

SEQ ID NO: 335240 - DNA, 25 bp, Homo sapien
agaggcttctcttcattgtgtcaaa

SEQ ID NO: 335241 - DNA, 25 bp, Homo sapien
attgtgtcaaagaagcccctagctg

SEQ ID NO: 335242 - DNA, 25 bp, Homo sapien
ttcacctgtgaaatgcctttgcttt

SEQ ID NO: 335243 - DNA, 25 bp, Homo sapien
aatgcctttgctttgcatattgtgt

SEQ ID NO: 335244 - DNA, 25 bp, Homo sapien
ctttgctttgcatattgtgtgtgga

SEQ ID NO: 335245 - DNA, 25 bp, Homo sapien
agcctgcctaatcgcagacactaga

SEQ ID NO: 335246 - DNA, 25 bp, Homo sapien
gacactagatctgtgacttcttgga

SEQ ID NO: 335247 - DNA, 25 bp, Homo sapien
ttcttggaagccacctaaccatgga

SEQ ID NO: 335248 - DNA, 25 bp, Homo sapien
aaccatggatggagacgcccctgcc

SEQ ID NO: 335249 - DNA, 25 bp, Homo sapien
aaggctggctcacacacacgtctgt

SEQ ID NO: 335250 - DNA, 25 bp, Homo sapien
acacatagctgttccaatcacacac

SEQ ID NO: 335251 - DNA, 25 bp, Homo sapien
cacacgtctgttttctctcctatgg

SEQ ID NO: 335252 - DNA, 25 bp, Homo sapien
gggtgagatgctgtgcccaaatccc

SEQ ID NO: 335253 - DNA, 25 bp, Homo sapien
gtgcccaaatccctactttcttagg

SEQ ID NO: 335254 - DNA, 25 bp, Homo sapien
gggattatgggctctttaaactcca

SEQ ID NO: 335255 - DNA, 25 bp, Homo sapien
agagccacagcctgcctaatcgcag

SEQ ID NO: 335256 - DNA, 25 bp, Homo sapien
atgtgtacatgaatctaaactgtct

SEQ ID NO: 335257 - DNA, 25 bp, Homo sapien
gtgtacatgaatctaaactgtcttc

SEQ ID NO: 335258 - DNA, 25 bp, Homo sapien
gtacatgaatctaaactgtcttctt

SEQ ID NO: 335259 - DNA, 25 bp, Homo sapien
tacatgaatctaaactgtcttcttc

SEQ ID NO: 335260 - DNA, 25 bp, Homo sapien
acatgaatctaaactgtcttcttct

SEQ ID NO: 335261 - DNA, 25 bp, Homo sapien
tctgttcctcattttgctttactta

SEQ ID NO: 335262 - DNA, 25 bp, Homo sapien
ctgttcctcattttgctttacttaa

SEQ ID NO: 335263 - DNA, 25 bp, Homo sapien
tgttcctcattttgctttacttaaa

SEQ ID NO: 335264 - DNA, 25 bp, Homo sapien
gttcctcattttgctttacttaaat

SEQ ID NO: 335265 - DNA, 25 bp, Homo sapien
ttcctcattttgctttacttaaata

SEQ ID NO: 335266 - DNA, 25 bp, Homo sapien
cctcattttgctttacttaaataat

SEQ ID NO: 335267 - DNA, 25 bp, Homo sapien
tcggccgcctcagttgtaatgttat

SEQ ID NO: 335268 - DNA, 25 bp, Homo sapien
gccgcctcagttgtaatgttatgct

SEQ ID NO: 335269 - DNA, 25 bp, Homo sapien
tcagttgtaatgttatgcttttctc

SEQ ID NO: 335270 - DNA, 25 bp, Homo sapien
atttttaagaagttcagtcctcagc

SEQ ID NO: 335271 - DNA, 25 bp, Homo sapien
aagttcagtcctcagctgtctgacc

SEQ ID NO: 335272 - DNA, 25 bp, Homo sapien
tgacccctccacagttggctttata

SEQ ID NO: 335273 - DNA, 25 bp, Homo sapien
ctccacagttggctttatattcaga

SEQ ID NO: 335274 - DNA, 25 bp, Homo sapien
ccacagttggctttatattcagaaa

SEQ ID NO: 335275 - DNA, 25 bp, Homo sapien
aattacttaaggcagcttggaagtg

SEQ ID NO: 335276 - DNA, 25 bp, Homo sapien
tggaagtgaggcctgggaactactg

SEQ ID NO: 335277 - DNA, 25 bp, Homo sapien
gggcaactagtatgaacagcactat

SEQ ID NO: 335278 - DNA, 25 bp, Homo sapien
cactgcgcccgggcaagaccttttt

SEQ ID NO: 335279 - DNA, 25 bp, Homo sapien
ttcttcctccagtctgttctcacat

SEQ ID NO: 335280 - DNA, 25 bp, Homo sapien
cttcctccagtctgttctcacataa

SEQ ID NO: 335281 - DNA, 25 bp, Homo sapien
tcctccagtctgttctcacataaca

SEQ ID NO: 335282 - DNA, 25 bp, Homo sapien
cctccagtctgttctcacataacag

SEQ ID NO: 335283 - DNA, 25 bp, Homo sapien
ctgttctcacataacagagtagttt

SEQ ID NO: 335284 - DNA, 25 bp, Homo sapien
tgttctcacataacagagtagtttt

SEQ ID NO: 335285 - DNA, 25 bp, Homo sapien
gttctcacataacagagtagttttg

SEQ ID NO: 335286 - DNA, 25 bp, Homo sapien
tctcacataacagagtagttttggt

SEQ ID NO: 335287 - DNA, 25 bp, Homo sapien
tcacataacagagtagttttggttt

SEQ ID NO: 335288 - DNA, 25 bp, Homo sapien
cacataacagagtagttttggtttt

SEQ ID NO: 335289 - DNA, 25 bp, Homo sapien
ttcttgatagtccttcacccctgaa

SEQ ID NO: 335290 - DNA, 25 bp, Homo sapien
gatttagctcttagttcttcaagta

SEQ ID NO: 335291 - DNA, 25 bp, Homo sapien
aagtctcttgtgtaagagccaacac

SEQ ID NO: 335292 - DNA, 25 bp, Homo sapien
tggacagccttctactgcctgggaa

SEQ ID NO: 335293 - DNA, 25 bp, Homo sapien
cagccttctactgcctgggaagtga

SEQ ID NO: 335294 - DNA, 25 bp, Homo sapien
ctactgcctgggaagtgatggaaca

SEQ ID NO: 335295 - DNA, 25 bp, Homo sapien
gaacaggaactcagggtgcccttac

SEQ ID NO: 335296 - DNA, 25 bp, Homo sapien
ctttctttgactgacagagcaccat

SEQ ID NO: 335297 - DNA, 25 bp, Homo sapien
gacagagcaccatccaggcaaaatt

SEQ ID NO: 335298 - DNA, 25 bp, Homo sapien
gcaccatccaggcaaaattagagcg

SEQ ID NO: 335299 - DNA, 25 bp, Homo sapien
ttagagcgccaaatggttttcttct

SEQ ID NO: 335300 - DNA, 25 bp, Homo sapien
gggttagcgtccgtttctcctccag

SEQ ID NO: 335301 - DNA, 25 bp, Homo sapien
ggttagcgtccgtttctcctccagt

SEQ ID NO: 335302 - DNA, 25 bp, Homo sapien
gttagcgtccgtttctcctccagtc

SEQ ID NO: 335303 - DNA, 25 bp, Homo sapien
agtccacctcaccttgtcgctgctt

SEQ ID NO: 335304 - DNA, 25 bp, Homo sapien
gctgcttccagggtccgcaagcagg

SEQ ID NO: 335305 - DNA, 25 bp, Homo sapien
ccagggtccgcaagcaggtggtgaa

SEQ ID NO: 335306 - DNA, 25 bp, Homo sapien
cattgtccgcctggattcccagaag

SEQ ID NO: 335307 - DNA, 25 bp, Homo sapien
ccagaagcacatcgacttctctctg

SEQ ID NO: 335308 - DNA, 25 bp, Homo sapien
aggaggattaagtccacctgtccct

SEQ ID NO: 335309 - DNA, 25 bp, Homo sapien
tggattgtctcgttttcctgccaaa

SEQ ID NO: 335310 - DNA, 25 bp, Homo sapien
attgtctcgttttcctgccaaataa

SEQ ID NO: 335311 - DNA, 25 bp, Homo sapien
tacccacctgatgtaggtcttattc

SEQ ID NO: 335312 - DNA, 25 bp, Homo sapien
acctgatgtaggtcttattccttta

SEQ ID NO: 335313 - DNA, 25 bp, Homo sapien
gtaggtcttattcctttagtatgga

SEQ ID NO: 335314 - DNA, 25 bp, Homo sapien
gtcttattcctttagtatggactta

SEQ ID NO: 335315 - DNA, 25 bp, Homo sapien
aagtacttattcatataccttgtaa

SEQ ID NO: 335316 - DNA, 25 bp, Homo sapien
gtacttattcatataccttgtaact

SEQ ID NO: 335317 - DNA, 25 bp, Homo sapien
ctaaaaattagaacagctccctaga

SEQ ID NO: 335318 - DNA, 25 bp, Homo sapien
agaacagctccctagaattatgaac

SEQ ID NO: 335319 - DNA, 25 bp, Homo sapien
aacagctccctagaattatgaactt

SEQ ID NO: 335320 - DNA, 25 bp, Homo sapien
tgaacttttaagagtctgactagaa

SEQ ID NO: 335321 - DNA, 25 bp, Homo sapien
aaatataagttagggctaggcacag

SEQ ID NO: 335322 - DNA, 25 bp, Homo sapien
aggaagcccgaaagatgagatcaat

SEQ ID NO: 335323 - DNA, 25 bp, Homo sapien
gaataagttgttacagaggtttcct

SEQ ID NO: 335324 - DNA, 25 bp, Homo sapien
tttcctaacaaaccttacctcagct

SEQ ID NO: 335325 - DNA, 25 bp, Homo sapien
ctaacaaaccttacctcagctgaaa

SEQ ID NO: 335326 - DNA, 25 bp, Homo sapien
ttacctcagctgaaaatggacaagt

SEQ ID NO: 335327 - DNA, 25 bp, Homo sapien
gactgaaatatagcttctgacaact

SEQ ID NO: 335328 - DNA, 25 bp, Homo sapien
aaatatagcttctgacaactatgca

SEQ ID NO: 335329 - DNA, 25 bp, Homo sapien
gaggcattttagagacattggcatt

SEQ ID NO: 335330 - DNA, 25 bp, Homo sapien
gccatgccctctttggagggtagaa

SEQ ID NO: 335331 - DNA, 25 bp, Homo sapien
tagaagaggcaaaacacttttttca

SEQ ID NO: 335332 - DNA, 25 bp, Homo sapien
cttttttcaccctttggaatcatag

SEQ ID NO: 335333 - DNA, 25 bp, Homo sapien
ccatatgccctctatagctgtcatt

SEQ ID NO: 335334 - DNA, 25 bp, Homo sapien
aataaaatccctctgagtcccagtt

SEQ ID NO: 335335 - DNA, 25 bp, Homo sapien
gtcccagttccagaaattatattaa

SEQ ID NO: 335336 - DNA, 25 bp, Homo sapien
cccagttccagaaattatattaatg

SEQ ID NO: 335337 - DNA, 25 bp, Homo sapien
attaatgcaaggcatgttcacggca

SEQ ID NO: 335338 - DNA, 25 bp, Homo sapien
taatgcaaggcatgttcacggcagg

SEQ ID NO: 335339 - DNA, 25 bp, Homo sapien
aatgcaaggcatgttcacggcaggt

SEQ ID NO: 335340 - DNA, 25 bp, Homo sapien
atgcaaggcatgttcacggcaggtg

SEQ ID NO: 335341 - DNA, 25 bp, Homo sapien
caaggcatgttcacggcaggtggta

SEQ ID NO: 335342 - DNA, 25 bp, Homo sapien
tatagctgtcattcctttaagtgca

SEQ ID NO: 335343 - DNA, 25 bp, Homo sapien
tgtcattcctttaagtgcagcaaga

SEQ ID NO: 335344 - DNA, 25 bp, Homo sapien
tgaaacacccaattactatcccatt

SEQ ID NO: 335345 - DNA, 25 bp, Homo sapien
tactatcccattgtttgcttcaaaa

SEQ ID NO: 335346 - DNA, 25 bp, Homo sapien
ttgtttgaccccaactagttctagt

SEQ ID NO: 335347 - DNA, 25 bp, Homo sapien
gttctagtcaagtttttgctcgatg

SEQ ID NO: 335348 - DNA, 25 bp, Homo sapien
agtttttgctcgatggaccacgtga

SEQ ID NO: 335349 - DNA, 25 bp, Homo sapien
tgtctctatataatgcatgatcagg

SEQ ID NO: 335350 - DNA, 25 bp, Homo sapien
gtgaaatcagggtgctgttaccaaa

SEQ ID NO: 335351 - DNA, 25 bp, Homo sapien
gaacaaaatccaaatgctcacataa

SEQ ID NO: 335352 - DNA, 25 bp, Homo sapien
aatgggattaggtttcataagccac

SEQ ID NO: 335353 - DNA, 25 bp, Homo sapien
aagaagctatgctggcaggcaaaaa

SEQ ID NO: 335354 - DNA, 25 bp, Homo sapien
ttcccatagggcaaaacctgaaaca

SEQ ID NO: 335355 - DNA, 25 bp, Homo sapien
gtgttttgtcttaaaccctactgct

SEQ ID NO: 335356 - DNA, 25 bp, Homo sapien
taaaccctactgctggaaacaattt

SEQ ID NO: 335357 - DNA, 25 bp, Homo sapien
aagcaatgggcccaaaagtctagga

SEQ ID NO: 335358 - DNA, 25 bp, Homo sapien
atttgtatgcaacagagatgctgca

SEQ ID NO: 335359 - DNA, 25 bp, Homo sapien
gcagctgatgcctttaaaaggtatt

SEQ ID NO: 335360 - DNA, 25 bp, Homo sapien
aaggtattcatcatggaagagctga

SEQ ID NO: 335361 - DNA, 25 bp, Homo sapien
ttggtgttccagagcccagggttga

SEQ ID NO: 335362 - DNA, 25 bp, Homo sapien
gagcatcctgaaggagccactgcag

SEQ ID NO: 335363 - DNA, 25 bp, Homo sapien
gagcctgtggagatagagcctgttt

SEQ ID NO: 335364 - DNA, 25 bp, Homo sapien
agatagagcctgtttgctgcttttt

SEQ ID NO: 335365 - DNA, 25 bp, Homo sapien
ttttcttcccgctcttaagacatgg

SEQ ID NO: 335366 - DNA, 25 bp, Homo sapien
actgttttgcttagtactggttaca

SEQ ID NO: 335367 - DNA, 25 bp, Homo sapien
tagtactggttacagctgtagctgg

SEQ ID NO: 335368 - DNA, 25 bp, Homo sapien
catttttgttattaccttgtggatt

SEQ ID NO: 335369 - DNA, 25 bp, Homo sapien
ttatccatcttgtctaatcttgttc

SEQ ID NO: 335370 - DNA, 25 bp, Homo sapien
taatcttgttctctgtcatcctaga

SEQ ID NO: 335371 - DNA, 25 bp, Homo sapien
tcagcaaccccactaatcaattatt

SEQ ID NO: 335372 - DNA, 25 bp, Homo sapien
ttgttctctgtcatcctagataatg

SEQ ID NO: 335373 - DNA, 25 bp, Homo sapien
ataaatgtttgcacttggcccagta

SEQ ID NO: 335374 - DNA, 25 bp, Homo sapien
atgtttgcacttggcccagtatatt

SEQ ID NO: 335375 - DNA, 25 bp, Homo sapien
tcaattattagatcctgccccaagg

SEQ ID NO: 335376 - DNA, 25 bp, Homo sapien
attattagatcctgccccaaggagc

SEQ ID NO: 335377 - DNA, 25 bp, Homo sapien
ccagcctttgctgaggttgatctat

SEQ ID NO: 335378 - DNA, 25 bp, Homo sapien
aggttgatctattgtccctccttgt

SEQ ID NO: 335379 - DNA, 25 bp, Homo sapien
ttgtccccatcaaaatatccagcac

SEQ ID NO: 335380 - DNA, 25 bp, Homo sapien
atcaaaatatccagcactccacctt

SEQ ID NO: 335381 - DNA, 25 bp, Homo sapien
cagcactccaccttcagggagtaga

SEQ ID NO: 335382 - DNA, 25 bp, Homo sapien
ggagtagacttgaccctcaaatagc

SEQ ID NO: 335383 - DNA, 25 bp, Homo sapien
aaatagcaagttcagccttcccagg

SEQ ID NO: 335384 - DNA, 25 bp, Homo sapien
gtctaggttccctgggaggtcaaga

SEQ ID NO: 335385 - DNA, 25 bp, Homo sapien
ttccctgggaggtcaagattcgtct

SEQ ID NO: 335386 - DNA, 25 bp, Homo sapien
aagattcgtctggttccttagtaca

SEQ ID NO: 335387 - DNA, 25 bp, Homo sapien
ggttccttagtacagagggctagct

SEQ ID NO: 335388 - DNA, 25 bp, Homo sapien
acaaggactggcagcggcgcgtggc

SEQ ID NO: 335389 - DNA, 25 bp, Homo sapien
gcgcgtggccacgtggttcaaccag

SEQ ID NO: 335390 - DNA, 25 bp, Homo sapien
gtggccacgtggttcaaccagccgg

SEQ ID NO: 335391 - DNA, 25 bp, Homo sapien
gtggttcaaccagccggcccgtaag

SEQ ID NO: 335392 - DNA, 25 bp, Homo sapien
accagccggcccgtaagatccgcag

SEQ ID NO: 335393 - DNA, 25 bp, Homo sapien
taaggcccggcaagccaaggcgcgc

SEQ ID NO: 335394 - DNA, 25 bp, Homo sapien
tcgtgcgctgccccacggttcggta

SEQ ID NO: 335395 - DNA, 25 bp, Homo sapien
ggaatggcatggtcttgaagcccca

SEQ ID NO: 335396 - DNA, 25 bp, Homo sapien
aatggcatggtcttgaagccccact

SEQ ID NO: 335397 - DNA, 25 bp, Homo sapien
atggcatggtcttgaagccccactt

SEQ ID NO: 335398 - DNA, 25 bp, Homo sapien
gcatggtcttgaagccccacttcca

SEQ ID NO: 335399 - DNA, 25 bp, Homo sapien
gtcacatgtgttatggaattccttc

SEQ ID NO: 335400 - DNA, 25 bp, Homo sapien
ggaattccttctcagtgacacattc

SEQ ID NO: 335401 - DNA, 25 bp, Homo sapien
gtgacacattcatctgtgctcagtt

SEQ ID NO: 335402 - DNA, 25 bp, Homo sapien
atctgtgctcagttgtcccagcaag

SEQ ID NO: 335403 - DNA, 25 bp, Homo sapien
tcagttgtcccagcaagggtcagcc

SEQ ID NO: 335404 - DNA, 25 bp, Homo sapien
ttttctcttcccaaggctacctctg

SEQ ID NO: 335405 - DNA, 25 bp, Homo sapien
tcccaaggctacctctggccatggt

SEQ ID NO: 335406 - DNA, 25 bp, Homo sapien
gagcctgaattcattggcacaaaag

SEQ ID NO: 335407 - DNA, 25 bp, Homo sapien
tcattggcacaaaaggcagcagcat

SEQ ID NO: 335408 - DNA, 25 bp, Homo sapien
atcctcactgtatctgcagtccatt

SEQ ID NO: 335409 - DNA, 25 bp, Homo sapien
aaactttgaaagtcacatgtgttat

SEQ ID NO: 335410 - DNA, 25 bp, Homo sapien
acctaacattatacttcatggtgat

SEQ ID NO: 335411 - DNA, 25 bp, Homo sapien
attatacttcatggtgatagactga

SEQ ID NO: 335412 - DNA, 25 bp, Homo sapien
gactgaaggctgaatgttttcccct

SEQ ID NO: 335413 - DNA, 25 bp, Homo sapien
ggacaaggatgttcactcggcacta

SEQ ID NO: 335414 - DNA, 25 bp, Homo sapien
aaggatgttcactcggcactacttc

SEQ ID NO: 335415 - DNA, 25 bp, Homo sapien
tcggcactacttctattcagcattg

SEQ ID NO: 335416 - DNA, 25 bp, Homo sapien
tacttctattcagcattgtacttga

SEQ ID NO: 335417 - DNA, 25 bp, Homo sapien
tctagccacagcagttaggttagga

SEQ ID NO: 335418 - DNA, 25 bp, Homo sapien
gccacagcagttaggttaggaattc

SEQ ID NO: 335419 - DNA, 25 bp, Homo sapien
ttaggaattcaaggtttgttcaaca

SEQ ID NO: 335420 - DNA, 25 bp, Homo sapien
gaaaagaggtttatactgcaaaaga

SEQ ID NO: 335421 - DNA, 25 bp, Homo sapien
ttattttgacatgacgtggtaaaat

SEQ ID NO: 335422 - DNA, 25 bp, Homo sapien
gaaaaactaatgtgtctcaggctca

SEQ ID NO: 335423 - DNA, 25 bp, Homo sapien
aaaactaatgtgtctcaggctcaag

SEQ ID NO: 335424 - DNA, 25 bp, Homo sapien
ctaatgtgtctcaggctcaagtttt

SEQ ID NO: 335425 - DNA, 25 bp, Homo sapien
atgtgtctcaggctcaagtttttat

SEQ ID NO: 335426 - DNA, 25 bp, Homo sapien
tgtctcaggctcaagtttttatagt

SEQ ID NO: 335427 - DNA, 25 bp, Homo sapien
tagaccaattactgcactcttaaac

SEQ ID NO: 335428 - DNA, 25 bp, Homo sapien
attactgcactcttaaacagcacca

SEQ ID NO: 335429 - DNA, 25 bp, Homo sapien
tgcactcttaaacagcaccaccatt

SEQ ID NO: 335430 - DNA, 25 bp, Homo sapien
aaacagcaccaccatttaatttcat

SEQ ID NO: 335431 - DNA, 25 bp, Homo sapien
atctaacttcgaatatatctgtaaa

SEQ ID NO: 335432 - DNA, 25 bp, Homo sapien
aaatgacagcgtttctgggttatgc

SEQ ID NO: 335433 - DNA, 25 bp, Homo sapien
cagcgtttctgggttatgcataact

SEQ ID NO: 335434 - DNA, 25 bp, Homo sapien
gttatgcataacttctcactggtca

SEQ ID NO: 335435 - DNA, 25 bp, Homo sapien
tcactggtcagagacaccggtgtgt

SEQ ID NO: 335436 - DNA, 25 bp, Homo sapien
gacaccggtgtgtcaagcatggata

SEQ ID NO: 335437 - DNA, 25 bp, Homo sapien
ttgcattgcaagacttgaatctata

SEQ ID NO: 335438 - DNA, 25 bp, Homo sapien
aaattagaatcacacagtcagtact

SEQ ID NO: 335439 - DNA, 25 bp, Homo sapien
tcacacagtcagtactacaagcaaa

SEQ ID NO: 335440 - DNA, 25 bp, Homo sapien
gtttgtgatatttcagtgattccaa

SEQ ID NO: 335441 - DNA, 25 bp, Homo sapien
tccaaagaacattctaggttttttg

SEQ ID NO: 335442 - DNA, 25 bp, Homo sapien
aaattggtggtattttcacattcat

SEQ ID NO: 335443 - DNA, 25 bp, Homo sapien
ataatgttgaagtatgggtctcatc

SEQ ID NO: 335444 - DNA, 25 bp, Homo sapien
gaagtatgggtctcatcattcccat

SEQ ID NO: 335445 - DNA, 25 bp, Homo sapien
aatgtttcctcaagataggttttag

SEQ ID NO: 335446 - DNA, 25 bp, Homo sapien
cctcaagataggttttagtgtaagc

SEQ ID NO: 335447 - DNA, 25 bp, Homo sapien
gttttagtgtaagctagtattctgt

SEQ ID NO: 335448 - DNA, 25 bp, Homo sapien
tctgtgtgttcgtagaaatgattca

SEQ ID NO: 335449 - DNA, 25 bp, Homo sapien
gaaatgattcaatacctgcagctgg

SEQ ID NO: 335450 - DNA, 25 bp, Homo sapien
gattcaatacctgcagctggtgaat

SEQ ID NO: 335451 - DNA, 25 bp, Homo sapien
ctgcagctggtgaattaggaattgt

SEQ ID NO: 335452 - DNA, 25 bp, Homo sapien
ttaggaattgtatttgttgcctttt

SEQ ID NO: 335453 - DNA, 25 bp, Homo sapien
aattttaatgctagtcagtatgcac

SEQ ID NO: 335454 - DNA, 25 bp, Homo sapien
agaattgagtaaggccaactgaggt

SEQ ID NO: 335455 - DNA, 25 bp, Homo sapien
ccaactgaggttgggcctggctctc

SEQ ID NO: 335456 - DNA, 25 bp, Homo sapien
tcccttactctcataccagtagact

SEQ ID NO: 335457 - DNA, 25 bp, Homo sapien
actctcataccagtagactttcaaa

SEQ ID NO: 335458 - DNA, 25 bp, Homo sapien
gcagtgttgctgacaggcccagggt

SEQ ID NO: 335459 - DNA, 25 bp, Homo sapien
aaggaagggatttctgcttaggagc

SEQ ID NO: 335460 - DNA, 25 bp, Homo sapien
tgagtatggttttcactggaggtcc

SEQ ID NO: 335461 - DNA, 25 bp, Homo sapien
ttttcactggaggtccaggtctcct

SEQ ID NO: 335462 - DNA, 25 bp, Homo sapien
aggtctcctgcttaggaactcaaga

SEQ ID NO: 335463 - DNA, 25 bp, Homo sapien
ataattaatctagtactgtccccag

SEQ ID NO: 335464 - DNA, 25 bp, Homo sapien
tactgtccccagaaaatgaaagaat

SEQ ID NO: 335465 - DNA, 25 bp, Homo sapien
gactatgtcttcatcaaaagtgtta

SEQ ID NO: 335466 - DNA, 25 bp, Homo sapien
caaaagtgttaatccctctcagggt

SEQ ID NO: 335467 - DNA, 25 bp, Homo sapien
tgttaatccctctcagggtctctgg

SEQ ID NO: 335468 - DNA, 25 bp, Homo sapien
gtgaagaccttcaagagtttggttt

SEQ ID NO: 335469 - DNA, 25 bp, Homo sapien
tttctcccaggaaattggaaggtag

SEQ ID NO: 335470 - DNA, 25 bp, Homo sapien
tttataatggtgtacctcagcagct

SEQ ID NO: 335471 - DNA, 25 bp, Homo sapien
ctcagcagctgcctttcaatttatg

SEQ ID NO: 335472 - DNA, 25 bp, Homo sapien
gcagctgcctttcaatttatgccaa

SEQ ID NO: 335473 - DNA, 25 bp, Homo sapien
gcctttcaatttatgccaagtcctt

SEQ ID NO: 335474 - DNA, 25 bp, Homo sapien
gtcttctgagttttacagtgtctta

SEQ ID NO: 335475 - DNA, 25 bp, Homo sapien
cagtgtcttaaactcaatgcacatt

SEQ ID NO: 335476 - DNA, 25 bp, Homo sapien
aaatgtagtatttctaacttgtgaa

SEQ ID NO: 335477 - DNA, 25 bp, Homo sapien
tgtagtatttctaacttgtgaagac

SEQ ID NO: 335478 - DNA, 25 bp, Homo sapien
tgtgaagacagattggtaggcagcc

SEQ ID NO: 335479 - DNA, 25 bp, Homo sapien
gaagacagattggtaggcagccatt

SEQ ID NO: 335480 - DNA, 25 bp, Homo sapien
agacagattggtaggcagccatttt

SEQ ID NO: 335481 - DNA, 25 bp, Homo sapien
gacagattggtaggcagccattttt

SEQ ID NO: 335482 - DNA, 25 bp, Homo sapien
agtgattgctattattgaatgttgc

SEQ ID NO: 335483 - DNA, 25 bp, Homo sapien
gctattattgaatgttgcaggtgag

SEQ ID NO: 335484 - DNA, 25 bp, Homo sapien
aatgttgcaggtgagatgtggttat

SEQ ID NO: 335485 - DNA, 25 bp, Homo sapien
gttgcaggtgagatgtggttatttt

SEQ ID NO: 335486 - DNA, 25 bp, Homo sapien
taagaggtttataattgatgtagtt

SEQ ID NO: 335487 - DNA, 25 bp, Homo sapien
gatggatacaaatctttctcttcct

SEQ ID NO: 335488 - DNA, 25 bp, Homo sapien
ctcttccttatcttaatgatggtac

SEQ ID NO: 335489 - DNA, 25 bp, Homo sapien
gatggtactcttttcaatttctgaa

SEQ ID NO: 335490 - DNA, 25 bp, Homo sapien
tgaaaacagtaacaggcccaacttc

SEQ ID NO: 335491 - DNA, 25 bp, Homo sapien
taacaggcccaacttccttcttact

SEQ ID NO: 335492 - DNA, 25 bp, Homo sapien
ttccttcttactacagtcatattaa

SEQ ID NO: 335493 - DNA, 25 bp, Homo sapien
tgtggttggagagcatcttggcatt

SEQ ID NO: 335494 - DNA, 25 bp, Homo sapien
gagcatcttggcatttgtgcttttt

SEQ ID NO: 335495 - DNA, 25 bp, Homo sapien
ttcttgagggattgttctgcttcct

SEQ ID NO: 335496 - DNA, 25 bp, Homo sapien
tcctggctgtatgatgggtatatca

SEQ ID NO: 335497 - DNA, 25 bp, Homo sapien
atcattaaagtttggagtcctatat

SEQ ID NO: 335498 - DNA, 25 bp, Homo sapien
gggttagcgtccgtttctcctccag

SEQ ID NO: 335499 - DNA, 25 bp, Homo sapien
ggttagcgtccgtttctcctccagt

SEQ ID NO: 335500 - DNA, 25 bp, Homo sapien
gttagcgtccgtttctcctccagtc

SEQ ID NO: 335501 - DNA, 25 bp, Homo sapien
ttagcgtccgtttctcctccagtcc

SEQ ID NO: 335502 - DNA, 25 bp, Homo sapien
tagcgtccgtttctcctccagtcca

SEQ ID NO: 335503 - DNA, 25 bp, Homo sapien
agcgtccgtttctcctccagtccac

SEQ ID NO: 335504 - DNA, 25 bp, Homo sapien
cgtccgtttctcctccagtccacct

SEQ ID NO: 335505 - DNA, 25 bp, Homo sapien
tccagtccacctcaccttgtcgctg

SEQ ID NO: 335506 - DNA, 25 bp, Homo sapien
cagtccacctcaccttgtcgctgct

SEQ ID NO: 335507 - DNA, 25 bp, Homo sapien
agtccacctcaccttgtcgctgctt

SEQ ID NO: 335508 - DNA, 25 bp, Homo sapien
gtccacctcaccttgtcgctgcttc

SEQ ID NO: 335509 - DNA, 25 bp, Homo sapien
aatgacatgctgttcctcagaaaaa

SEQ ID NO: 335510 - DNA, 25 bp, Homo sapien
catgctgttcctcagaaaaatggcc

SEQ ID NO: 335511 - DNA, 25 bp, Homo sapien
aaatggcctttaatcagttgctaca

SEQ ID NO: 335512 - DNA, 25 bp, Homo sapien
ggcctttaatcagttgctacatttt

SEQ ID NO: 335513 - DNA, 25 bp, Homo sapien
tacatttttctacctttcctcattt

SEQ ID NO: 335514 - DNA, 25 bp, Homo sapien
gccatcattggtcttaaatggaaca

SEQ ID NO: 335515 - DNA, 25 bp, Homo sapien
cttgtaggcaagatagttcatcacc

SEQ ID NO: 335516 - DNA, 25 bp, Homo sapien
agcagtagtgacagcaaccagtcat

SEQ ID NO: 335517 - DNA, 25 bp, Homo sapien
gcaaccagtcatagagtaactacat

SEQ ID NO: 335518 - DNA, 25 bp, Homo sapien
gatgatgggttttggattttaggaa

SEQ ID NO: 335519 - DNA, 25 bp, Homo sapien
gtgaaatgacatgctgttcctcaga

SEQ ID NO: 335520 - DNA, 25 bp, Homo sapien
cctactcctcaccagaattgtcagt

SEQ ID NO: 335521 - DNA, 25 bp, Homo sapien
caccagaattgtcagtggcctttca

SEQ ID NO: 335522 - DNA, 25 bp, Homo sapien
agtggcctttcaccacagtggtcct

SEQ ID NO: 335523 - DNA, 25 bp, Homo sapien
gcactgtcccagaccacacagaagt

SEQ ID NO: 335524 - DNA, 25 bp, Homo sapien
gaagtctggtcacctctgggcgcct

SEQ ID NO: 335525 - DNA, 25 bp, Homo sapien
cgcctgggatggtcaccgaagagaa

SEQ ID NO: 335526 - DNA, 25 bp, Homo sapien
gtcaccgaagagaagcacgctgtcc

SEQ ID NO: 335527 - DNA, 25 bp, Homo sapien
ggcttctgccagaaaatcgaacaag

SEQ ID NO: 335528 - DNA, 25 bp, Homo sapien
taacacactgttactgccgaagcct

SEQ ID NO: 335529 - DNA, 25 bp, Homo sapien
gaaactcccaggacttgtccttgat

SEQ ID NO: 335530 - DNA, 25 bp, Homo sapien
aaaccaccaggtccggcacttggag

SEQ ID NO: 335531 - DNA, 25 bp, Homo sapien
tgttgcccaggacaaccacaccagt

SEQ ID NO: 335532 - DNA, 25 bp, Homo sapien
ccacaccagttcacaagaaatccgt

SEQ ID NO: 335533 - DNA, 25 bp, Homo sapien
gaaatccgtgaagagagagcatctc

SEQ ID NO: 335534 - DNA, 25 bp, Homo sapien
tgcttactttgactgtcctcgggtc

SEQ ID NO: 335535 - DNA, 25 bp, Homo sapien
agagcatctctcaaggtgaaaacat

SEQ ID NO: 335536 - DNA, 25 bp, Homo sapien
gggttacgtgcaagaactctggaac

SEQ ID NO: 335537 - DNA, 25 bp, Homo sapien
agaactctggaactcgactacctga

SEQ ID NO: 335538 - DNA, 25 bp, Homo sapien
ctggaactcgactacctgaattgaa

SEQ ID NO: 335539 - DNA, 25 bp, Homo sapien
tgcaagctcaggcattggttaggct

SEQ ID NO: 335540 - DNA, 25 bp, Homo sapien
tcgggtcccgagtcttctggtggtt

SEQ ID NO: 335541 - DNA, 25 bp, Homo sapien
gatgataattgctgttgcccaggac

SEQ ID NO: 335542 - DNA, 25 bp, Homo sapien
gagctgatgttaaaactcatttggt

SEQ ID NO: 335543 - DNA, 25 bp, Homo sapien
catttggtgaggtcaacgttgtcac

SEQ ID NO: 335544 - DNA, 25 bp, Homo sapien
acgttgtcacataccttcacataag

SEQ ID NO: 335545 - DNA, 25 bp, Homo sapien
gatagtatattttgggttgcagtca

SEQ ID NO: 335546 - DNA, 25 bp, Homo sapien
tcaaacttgtgctcagactggtgaa

SEQ ID NO: 335547 - DNA, 25 bp, Homo sapien
ctgagagtcaggcttttacatttta

SEQ ID NO: 335548 - DNA, 25 bp, Homo sapien
gttttcattctaattcaggtgtcta

SEQ ID NO: 335549 - DNA, 25 bp, Homo sapien
tcaggtgtctacttattttatgtaa

SEQ ID NO: 335550 - DNA, 25 bp, Homo sapien
tttatgctgtaacttacccccaatc

SEQ ID NO: 335551 - DNA, 25 bp, Homo sapien
ccccaatctttatctctggattttt

SEQ ID NO: 335552 - DNA, 25 bp, Homo sapien
ttatctctggatttttactctttaa

SEQ ID NO: 335553 - DNA, 25 bp, Homo sapien
tggagcaaaagatagcttgtacttg

SEQ ID NO: 335554 - DNA, 25 bp, Homo sapien
atgactaatattcttggttagcaag

SEQ ID NO: 335555 - DNA, 25 bp, Homo sapien
gcaagactggaaagaggtgtttttt

SEQ ID NO: 335556 - DNA, 25 bp, Homo sapien
gaacaaagaacatacagctctctga

SEQ ID NO: 335557 - DNA, 25 bp, Homo sapien
ttttatgtttggacctggtaataca

SEQ ID NO: 335558 - DNA, 25 bp, Homo sapien
gtttggacctggtaatacagataca

SEQ ID NO: 335559 - DNA, 25 bp, Homo sapien
aaaactttaatgaggtagcaatgaa

SEQ ID NO: 335560 - DNA, 25 bp, Homo sapien
gaatattcaactgtttgactgctaa

SEQ ID NO: 335561 - DNA, 25 bp, Homo sapien
gtttgactgctaagtgtatctgtcc

SEQ ID NO: 335562 - DNA, 25 bp, Homo sapien
aagtgtatctgtccatattttagca

SEQ ID NO: 335563 - DNA, 25 bp, Homo sapien
gtatctgtccatattttagcaagtt

SEQ ID NO: 335564 - DNA, 25 bp, Homo sapien
agaagagatcatcgtgctctcagac

SEQ ID NO: 335565 - DNA, 25 bp, Homo sapien
gaagagatcatcgtgctctcagact

SEQ ID NO: 335566 - DNA, 25 bp, Homo sapien
aagagatcatcgtgctctcagactc

SEQ ID NO: 335567 - DNA, 25 bp, Homo sapien
agagatcatcgtgctctcagactct

SEQ ID NO: 335568 - DNA, 25 bp, Homo sapien
gagatcatcgtgctctcagactctg

SEQ ID NO: 335569 - DNA, 25 bp, Homo sapien
agatcatcgtgctctcagactctga

SEQ ID NO: 335570 - DNA, 25 bp, Homo sapien
gatcatcgtgctctcagactctgat

SEQ ID NO: 335571 - DNA, 25 bp, Homo sapien
atcatcgtgctctcagactctgatt

SEQ ID NO: 335572 - DNA, 25 bp, Homo sapien
atcatgaaaccccacttaataaatg

SEQ ID NO: 335573 - DNA, 25 bp, Homo sapien
atgaaaccccacttaataaatgaat

SEQ ID NO: 335574 - DNA, 25 bp, Homo sapien
gaatgaacgactaagtcttgctcaa

SEQ ID NO: 335575 - DNA, 25 bp, Homo sapien
aacgactaagtcttgctcaaatgtt

SEQ ID NO: 335576 - DNA, 25 bp, Homo sapien
aagtcttgctcaaatgttattatga

SEQ ID NO: 335577 - DNA, 25 bp, Homo sapien
ttatgaggtactatgagtgacttac

SEQ ID NO: 335578 - DNA, 25 bp, Homo sapien
aaaatgtcagtgtgtttcccagagg

SEQ ID NO: 335579 - DNA, 25 bp, Homo sapien
gatttgtttttgttagatgatttgc

SEQ ID NO: 335580 - DNA, 25 bp, Homo sapien
ctggaattccatgccagcctatgca

SEQ ID NO: 335581 - DNA, 25 bp, Homo sapien
aattccatgccagcctatgcaacat

SEQ ID NO: 335582 - DNA, 25 bp, Homo sapien
tgccagcctatgcaacatcatgaaa

SEQ ID NO: 335583 - DNA, 25 bp, Homo sapien
acttggtgttgtctgtgcacttgtt

SEQ ID NO: 335584 - DNA, 25 bp, Homo sapien
ttccctctggtgactttggtggaga

SEQ ID NO: 335585 - DNA, 25 bp, Homo sapien
agatagatcaagtgcaccttcccca

SEQ ID NO: 335586 - DNA, 25 bp, Homo sapien
tttctttctgttgacagcgcctgat

SEQ ID NO: 335587 - DNA, 25 bp, Homo sapien
acagcgcctgatcacttctaataat

SEQ ID NO: 335588 - DNA, 25 bp, Homo sapien
taataagggtccacccacagtacct

SEQ ID NO: 335589 - DNA, 25 bp, Homo sapien
gtaccttctgcttcaattataccta

SEQ ID NO: 335590 - DNA, 25 bp, Homo sapien
attatacctaaatctcgggctaaat

SEQ ID NO: 335591 - DNA, 25 bp, Homo sapien
gggctaaattctctcgaccttcgag

SEQ ID NO: 335592 - DNA, 25 bp, Homo sapien
accttcgagaccttgcagtgtgcta

SEQ ID NO: 335593 - DNA, 25 bp, Homo sapien
gcagtgtgctagtttcaggttgaaa

SEQ ID NO: 335594 - DNA, 25 bp, Homo sapien
gactttgtttctgcaaaggcacctg

SEQ ID NO: 335595 - DNA, 25 bp, Homo sapien
aaaggcacctgcatgtgtctgtgtt

SEQ ID NO: 335596 - DNA, 25 bp, Homo sapien
cctgcatgtgtctgtgttcgtgtag

SEQ ID NO: 335597 - DNA, 25 bp, Homo sapien
tgcatgtgtctgtgttcgtgtaggc

SEQ ID NO: 335598 - DNA, 25 bp, Homo sapien
gagaggcaagagttgttcctgccct

SEQ ID NO: 335599 - DNA, 25 bp, Homo sapien
agaggcaagagttgttcctgccctt

SEQ ID NO: 335600 - DNA, 25 bp, Homo sapien
aggcaagagttgttcctgcccttcc

SEQ ID NO: 335601 - DNA, 25 bp, Homo sapien
ttgttcctgcccttccctttgtgac

SEQ ID NO: 335602 - DNA, 25 bp, Homo sapien
gtgacttgaagaaccctgactttgt

SEQ ID NO: 335603 - DNA, 25 bp, Homo sapien
cttgaagaaccctgactttgtttct

SEQ ID NO: 335604 - DNA, 25 bp, Homo sapien
tgaagaaccctgactttgtttctgc

SEQ ID NO: 335605 - DNA, 25 bp, Homo sapien
ctgccggcagctgatttggtacaat

SEQ ID NO: 335606 - DNA, 25 bp, Homo sapien
ggtacaatgccagaagtaagcctca

SEQ ID NO: 335607 - DNA, 25 bp, Homo sapien
gaagtaagcctcacatacacccatg

SEQ ID NO: 335608 - DNA, 25 bp, Homo sapien
tcacatacacccatgctggaaagaa

SEQ ID NO: 335609 - DNA, 25 bp, Homo sapien
gctgcctcctgaaaagcaagtcttt

SEQ ID NO: 335610 - DNA, 25 bp, Homo sapien
ggattttttgctgcagctagtttca

SEQ ID NO: 335611 - DNA, 25 bp, Homo sapien
gtttcatgtcatatcaacaatgtga

SEQ ID NO: 335612 - DNA, 25 bp, Homo sapien
caatgtgagttcaattttggagcaa

SEQ ID NO: 335613 - DNA, 25 bp, Homo sapien
gcaaaaccattcaaatacccaccat

SEQ ID NO: 335614 - DNA, 25 bp, Homo sapien
aatacccaccatctatgaaatttag

SEQ ID NO: 335615 - DNA, 25 bp, Homo sapien
aaatttagcacttttaatgactacg

SEQ ID NO: 335616 - DNA, 25 bp, Homo sapien
gaggccgagccttgggcctctgtcc

SEQ ID NO: 335617 - DNA, 25 bp, Homo sapien
agcctgcccagcaaattcaggtggt

SEQ ID NO: 335618 - DNA, 25 bp, Homo sapien
cagcaaattcaggtggtaggacgtg

SEQ ID NO: 335619 - DNA, 25 bp, Homo sapien
acagatgagagctactcagggccat

SEQ ID NO: 335620 - DNA, 25 bp, Homo sapien
gagagctactcagggccatgtttgc

SEQ ID NO: 335621 - DNA, 25 bp, Homo sapien
gctactcagggccatgtttgcaagt

SEQ ID NO: 335622 - DNA, 25 bp, Homo sapien
ctcagggccatgtttgcaagttggg

SEQ ID NO: 335623 - DNA, 25 bp, Homo sapien
gggagttgtcctttctaaagcaaag

SEQ ID NO: 335624 - DNA, 25 bp, Homo sapien
taaagcaaaggtgaatcccagctac

SEQ ID NO: 335625 - DNA, 25 bp, Homo sapien
aggttgcggcaagctgagaatgcac

SEQ ID NO: 335626 - DNA, 25 bp, Homo sapien
gcggcaagctgagaatgcaccattg

SEQ ID NO: 335627 - DNA, 25 bp, Homo sapien
ctactctaaggctgagtggagcgac

SEQ ID NO: 335628 - DNA, 25 bp, Homo sapien
ctctaaggctgagtggagcgacagt

SEQ ID NO: 335629 - DNA, 25 bp, Homo sapien
aaggctgagtggagcgacagtgccc

SEQ ID NO: 335630 - DNA, 25 bp, Homo sapien
agtgcccaggggtctgagtctcaca

SEQ ID NO: 335631 - DNA, 25 bp, Homo sapien
tgcgactgagatgcacagctgcctt

SEQ ID NO: 335632 - DNA, 25 bp, Homo sapien
actgagatgcacagctgccttgtgt

SEQ ID NO: 335633 - DNA, 25 bp, Homo sapien
tgccttgtgtgcgactgagatgcag

SEQ ID NO: 335634 - DNA, 25 bp, Homo sapien
tcacgcctcccctatgtgtcttagg

SEQ ID NO: 335635 - DNA, 25 bp, Homo sapien
gcttctctttttgcaagggcctctg

SEQ ID NO: 335636 - DNA, 25 bp, Homo sapien
cttctctttttgcaagggcctctga

SEQ ID NO: 335637 - DNA, 25 bp, Homo sapien
aagggcctctgaatctgtctgtgtc

SEQ ID NO: 335638 - DNA, 25 bp, Homo sapien
ggtgggccccacttcaggcaaactt

SEQ ID NO: 335639 - DNA, 25 bp, Homo sapien
ggccccacttcaggcaaacttagat

SEQ ID NO: 335640 - DNA, 25 bp, Homo sapien
cttcaggcaaacttagatggcaaaa

SEQ ID NO: 335641 - DNA, 25 bp, Homo sapien
gcaaaagagcaatctggatccgcct

SEQ ID NO: 335642 - DNA, 25 bp, Homo sapien
aagagcaatctggatccgccttagc

SEQ ID NO: 335643 - DNA, 25 bp, Homo sapien
ggatccgccttagccagatacataa

SEQ ID NO: 335644 - DNA, 25 bp, Homo sapien
cttagccagatacataagggtattt

SEQ ID NO: 335645 - DNA, 25 bp, Homo sapien
aagggtatttgccttcactttcagc

SEQ ID NO: 335646 - DNA, 25 bp, Homo sapien
ggtatttgccttcactttcagccag

SEQ ID NO: 335647 - DNA, 25 bp, Homo sapien
tttgccttcactttcagccagcatt

SEQ ID NO: 335648 - DNA, 25 bp, Homo sapien
cccagcgatcctagccagatattac

SEQ ID NO: 335649 - DNA, 25 bp, Homo sapien
cacatcctggcccacttcaagaggg

SEQ ID NO: 335650 - DNA, 25 bp, Homo sapien
gggtctcaggctggcgattcacccc

SEQ ID NO: 335651 - DNA, 25 bp, Homo sapien
cacccacctgggaaatgctctgcgg

SEQ ID NO: 335652 - DNA, 25 bp, Homo sapien
acccacctgggaaatgctctgcggc

SEQ ID NO: 335653 - DNA, 25 bp, Homo sapien
acctgggaaatgctctgcggcccct

SEQ ID NO: 335654 - DNA, 25 bp, Homo sapien
gaggcgggatcactcaggctccagc

SEQ ID NO: 335655 - DNA, 25 bp, Homo sapien
tgctgtgcactgcagccgttcccag

SEQ ID NO: 335656 - DNA, 25 bp, Homo sapien
gagggcacaccacccaaccagcagg

SEQ ID NO: 335657 - DNA, 25 bp, Homo sapien
aggcaaccccgaagagccggtgacg

SEQ ID NO: 335658 - DNA, 25 bp, Homo sapien
gaagagccggtgacgggcacatcct

SEQ ID NO: 335659 - DNA, 25 bp, Homo sapien
ggtgacgggcacatcctggcccact

SEQ ID NO: 335660 - DNA, 25 bp, Homo sapien
aataatatgtccactcatgtgccta

SEQ ID NO: 335661 - DNA, 25 bp, Homo sapien
aatatgtccactcatgtgcctacca

SEQ ID NO: 335662 - DNA, 25 bp, Homo sapien
gattggaattaattgctccttgaat

SEQ ID NO: 335663 - DNA, 25 bp, Homo sapien
ggaattaattgctccttgaatgttt

SEQ ID NO: 335664 - DNA, 25 bp, Homo sapien
attgctccttgaatgtttggtagac

SEQ ID NO: 335665 - DNA, 25 bp, Homo sapien
gctccttgaatgtttggtagactca

SEQ ID NO: 335666 - DNA, 25 bp, Homo sapien
gaatgtttggtagactcatctgtaa

SEQ ID NO: 335667 - DNA, 25 bp, Homo sapien
ggtagactcatctgtaataccattt

SEQ ID NO: 335668 - DNA, 25 bp, Homo sapien
catctgtaataccatttgagcctag

SEQ ID NO: 335669 - DNA, 25 bp, Homo sapien
ctgtaataccatttgagcctagaat

SEQ ID NO: 335670 - DNA, 25 bp, Homo sapien
taccatttgagcctagaatattctg

SEQ ID NO: 335671 - DNA, 25 bp, Homo sapien
gttaaacttttatcagcatgttgct

SEQ ID NO: 335672 - DNA, 25 bp, Homo sapien
gcatgttgctgtttaaaaggcgttc

SEQ ID NO: 335673 - DNA, 25 bp, Homo sapien
tgttgctgtttaaaaggcgttcttt

SEQ ID NO: 335674 - DNA, 25 bp, Homo sapien
tgaagattggttttagaagctatag

SEQ ID NO: 335675 - DNA, 25 bp, Homo sapien
aagctatagttttttagagattggc

SEQ ID NO: 335676 - DNA, 25 bp, Homo sapien
ccatgtttgctagagtgggtcataa

SEQ ID NO: 335677 - DNA, 25 bp, Homo sapien
acatattccatgaagttctgtacag

SEQ ID NO: 335678 - DNA, 25 bp, Homo sapien
tctgtacagaacaaacaccgtttat

SEQ ID NO: 335679 - DNA, 25 bp, Homo sapien
ggactcagctaagttctaagccctg

SEQ ID NO: 335680 - DNA, 25 bp, Homo sapien
gctaagttctaagccctggaggtta

SEQ ID NO: 335681 - DNA, 25 bp, Homo sapien
ctaagccctggaggttatattaaat

SEQ ID NO: 335682 - DNA, 25 bp, Homo sapien
caccatgaccctcttcccacgctga

SEQ ID NO: 335683 - DNA, 25 bp, Homo sapien
accatgaccctcttcccacgctgac

SEQ ID NO: 335684 - DNA, 25 bp, Homo sapien
ccatgaccctcttcccacgctgacc

SEQ ID NO: 335685 - DNA, 25 bp, Homo sapien
catgaccctcttcccacgctgacct

SEQ ID NO: 335686 - DNA, 25 bp, Homo sapien
atgaccctcttcccacgctgacctg

SEQ ID NO: 335687 - DNA, 25 bp, Homo sapien
tgaccctcttcccacgctgacctgt

SEQ ID NO: 335688 - DNA, 25 bp, Homo sapien
gaccctcttcccacgctgacctgtg

SEQ ID NO: 335689 - DNA, 25 bp, Homo sapien
accctcttcccacgctgacctgtgc

SEQ ID NO: 335690 - DNA, 25 bp, Homo sapien
tcttcccacgctgacctgtgctccc

SEQ ID NO: 335691 - DNA, 25 bp, Homo sapien
cttcccacgctgacctgtgctccct

SEQ ID NO: 335692 - DNA, 25 bp, Homo sapien
ttcccacgctgacctgtgctccctc

SEQ ID NO: 335693 - DNA, 25 bp, Homo sapien
tactctaaggctgagtggagcgaca

SEQ ID NO: 335694 - DNA, 25 bp, Homo sapien
actctaaggctgagtggagcgacag

SEQ ID NO: 335695 - DNA, 25 bp, Homo sapien
ctctaaggctgagtggagcgacagt

SEQ ID NO: 335696 - DNA, 25 bp, Homo sapien
ctaaggctgagtggagcgacagtgc

SEQ ID NO: 335697 - DNA, 25 bp, Homo sapien
taaggctgagtggagcgacagtgcc

SEQ ID NO: 335698 - DNA, 25 bp, Homo sapien
gtgcccaggggtctgagtctcacag

SEQ ID NO: 335699 - DNA, 25 bp, Homo sapien
tcacgcctcccctatgtgtcttagg

SEQ ID NO: 335700 - DNA, 25 bp, Homo sapien
cacgcctcccctatgtgtcttaggg

SEQ ID NO: 335701 - DNA, 25 bp, Homo sapien
acgcctcccctatgtgtcttagggg

SEQ ID NO: 335702 - DNA, 25 bp, Homo sapien
gcttctctttttgcaagggcctctg

SEQ ID NO: 335703 - DNA, 25 bp, Homo sapien
cttctctttttgcaagggcctctga

SEQ ID NO: 335704 - DNA, 25 bp, Homo sapien
atcagctggtcacatgccaacacgt

SEQ ID NO: 335705 - DNA, 25 bp, Homo sapien
cacctgctcctgaggtgggtcccta

SEQ ID NO: 335706 - DNA, 25 bp, Homo sapien
tgaggtgggtccctaccctgctgct

SEQ ID NO: 335707 - DNA, 25 bp, Homo sapien
tcttcatcctttcccttttgtcctg

SEQ ID NO: 335708 - DNA, 25 bp, Homo sapien
cttttgtcctgaaagggaggagcaa

SEQ ID NO: 335709 - DNA, 25 bp, Homo sapien
gaggagcaatggtccaggcattaat

SEQ ID NO: 335710 - DNA, 25 bp, Homo sapien
aggcattaattccacccagggaatt

SEQ ID NO: 335711 - DNA, 25 bp, Homo sapien
tccacccagggaattttagctatgc

SEQ ID NO: 335712 - DNA, 25 bp, Homo sapien
gaattttagctatgccctcatgtcc

SEQ ID NO: 335713 - DNA, 25 bp, Homo sapien
gagccacacgcctgttttccattta

SEQ ID NO: 335714 - DNA, 25 bp, Homo sapien
gcaagattgtttgcatacttttgta

SEQ ID NO: 335715 - DNA, 25 bp, Homo sapien
ggacctgagggcactcgctttgctc

SEQ ID NO: 335716 - DNA, 25 bp, Homo sapien
gagggcactcgctttgctcctgtca

SEQ ID NO: 335717 - DNA, 25 bp, Homo sapien
ctcgctttgctcctgtcagtacaca

SEQ ID NO: 335718 - DNA, 25 bp, Homo sapien
ctgtcagtacacactcccaaacagt

SEQ ID NO: 335719 - DNA, 25 bp, Homo sapien
tcccaaacagttaaacccagctcta

SEQ ID NO: 335720 - DNA, 25 bp, Homo sapien
cagctctaattccaactctgcaaga

SEQ ID NO: 335721 - DNA, 25 bp, Homo sapien
aattccaactctgcaagagctttta

SEQ ID NO: 335722 - DNA, 25 bp, Homo sapien
gagcttttaagcaaatgcaggactt

SEQ ID NO: 335723 - DNA, 25 bp, Homo sapien
aatgcaggacttgtctgcaacagag

SEQ ID NO: 335724 - DNA, 25 bp, Homo sapien
gtctgcaacagagaaactcactcca

SEQ ID NO: 335725 - DNA, 25 bp, Homo sapien
gagaaactcactccaagagcaagaa

SEQ ID NO: 335726 - DNA, 25 bp, Homo sapien
caggttggtcttgacctaagggcct

SEQ ID NO: 335727 - DNA, 25 bp, Homo sapien
ttggtcttgacctaagggcctcaag

SEQ ID NO: 335728 - DNA, 25 bp, Homo sapien
cctcctaaagcactgtgaatttcag

SEQ ID NO: 335729 - DNA, 25 bp, Homo sapien
ctgtgaatttcaggcatgagcttga

SEQ ID NO: 335730 - DNA, 25 bp, Homo sapien
tgagttcttattaactgtcagcctg

SEQ ID NO: 335731 - DNA, 25 bp, Homo sapien
tgtcagcctgactggctctttccta

SEQ ID NO: 335732 - DNA, 25 bp, Homo sapien
ggctctttcctagctaggctagtca

SEQ ID NO: 335733 - DNA, 25 bp, Homo sapien
tagctaggctagtcagctcggctga

SEQ ID NO: 335734 - DNA, 25 bp, Homo sapien
gagtcaagggaggacaggcttatta

SEQ ID NO: 335735 - DNA, 25 bp, Homo sapien
ggaggacaggcttattactatggaa

SEQ ID NO: 335736 - DNA, 25 bp, Homo sapien
gagtgtttatcaatgctcaaacctg

SEQ ID NO: 335737 - DNA, 25 bp, Homo sapien
gaacattttacattggtctgctcag

SEQ ID NO: 335738 - DNA, 25 bp, Homo sapien
attttacattggtctgctcagcaca

SEQ ID NO: 335739 - DNA, 25 bp, Homo sapien
tggtctgctcagcacatggctggat

SEQ ID NO: 335740 - DNA, 25 bp, Homo sapien
acatggctggatgcggatatttcta

SEQ ID NO: 335741 - DNA, 25 bp, Homo sapien
atgcggatatttctataattccaga

SEQ ID NO: 335742 - DNA, 25 bp, Homo sapien
agaaagtcacacagctcctctgtat

SEQ ID NO: 335743 - DNA, 25 bp, Homo sapien
acagctcctctgtatgagaccagtg

SEQ ID NO: 335744 - DNA, 25 bp, Homo sapien
gtatgagaccagtgggcgccattta

SEQ ID NO: 335745 - DNA, 25 bp, Homo sapien
gtgggcgccatttaaaagaacagga

SEQ ID NO: 335746 - DNA, 25 bp, Homo sapien
gcacacacaaaaggcagattctcgt

SEQ ID NO: 335747 - DNA, 25 bp, Homo sapien
ggagctgctctgagattttgagttc

SEQ ID NO: 335748 - DNA, 25 bp, Homo sapien
tcaagcaacattggaacaggttttt

SEQ ID NO: 335749 - DNA, 25 bp, Homo sapien
cattggaacaggtttttgtagaact

SEQ ID NO: 335750 - DNA, 25 bp, Homo sapien
ggaactttaaacagcacactttggt

SEQ ID NO: 335751 - DNA, 25 bp, Homo sapien
gcacactttggtgggaacgaacaca

SEQ ID NO: 335752 - DNA, 25 bp, Homo sapien
gaatttgtattgttcggtctgctta

SEQ ID NO: 335753 - DNA, 25 bp, Homo sapien
tattgttcggtctgcttactgggac

SEQ ID NO: 335754 - DNA, 25 bp, Homo sapien
tgcttactgggacttctttcttttt

SEQ ID NO: 335755 - DNA, 25 bp, Homo sapien
taactggagaaccaagaacgcactt

SEQ ID NO: 335756 - DNA, 25 bp, Homo sapien
ttgaaatttttctaagctccttaat

SEQ ID NO: 335757 - DNA, 25 bp, Homo sapien
gctccttaattgaaatgctgtggtt

SEQ ID NO: 335758 - DNA, 25 bp, Homo sapien
attgaaatgctgtggttgtgtgttt

SEQ ID NO: 335759 - DNA, 25 bp, Homo sapien
ttctctctccttttgatacattgga

SEQ ID NO: 335760 - DNA, 25 bp, Homo sapien
gatacattggattcttctgggcaag

SEQ ID NO: 335761 - DNA, 25 bp, Homo sapien
attcttctgggcaagtttttcagga

SEQ ID NO: 335762 - DNA, 25 bp, Homo sapien
atctagttgttcaagtggttccaca

SEQ ID NO: 335763 - DNA, 25 bp, Homo sapien
aagaaaacaccttcactgcatcgtt

SEQ ID NO: 335764 - DNA, 25 bp, Homo sapien
gttcaaatgcctttcttgctgctgg

SEQ ID NO: 335765 - DNA, 25 bp, Homo sapien
aaattcaacaatgcctttccctgta

SEQ ID NO: 335766 - DNA, 25 bp, Homo sapien
tgtagatcttccacgatcatccact

SEQ ID NO: 335767 - DNA, 25 bp, Homo sapien
atcatccactattacaacagccctt

SEQ ID NO: 335768 - DNA, 25 bp, Homo sapien
aacagccctttcaataggaccaaat

SEQ ID NO: 335769 - DNA, 25 bp, Homo sapien
ggctaaaggcttcttccaacagttc

SEQ ID NO: 335770 - DNA, 25 bp, Homo sapien
cgtttgtgggattatccgcgtctat

SEQ ID NO: 335771 - DNA, 25 bp, Homo sapien
ggattatccgcgtctataacttcgt

SEQ ID NO: 335772 - DNA, 25 bp, Homo sapien
tccgcgtctataacttcgtgatgag

SEQ ID NO: 335773 - DNA, 25 bp, Homo sapien
ttcgtgatgagttcctgatctccgt

SEQ ID NO: 335774 - DNA, 25 bp, Homo sapien
tgatgagttcctgatctccgtcttc

SEQ ID NO: 335775 - DNA, 25 bp, Homo sapien
gatctccgtcttccaaaacttggga

SEQ ID NO: 335776 - DNA, 25 bp, Homo sapien
acttgggaagtcatccgagggtttg

SEQ ID NO: 335777 - DNA, 25 bp, Homo sapien
gaagtcatccgagggtttgttccag

SEQ ID NO: 335778 - DNA, 25 bp, Homo sapien
gtcatccgagggtttgttccagatt

SEQ ID NO: 335779 - DNA, 25 bp, Homo sapien
tccgagggtttgttccagattgttt

SEQ ID NO: 335780 - DNA, 25 bp, Homo sapien
tttgttccagattgttttgggtaat

SEQ ID NO: 335781 - DNA, 25 bp, Homo sapien
tcacgatgcacccttgaggctaggc

SEQ ID NO: 335782 - DNA, 25 bp, Homo sapien
tgaggctaggcacgctgattcaaca

SEQ ID NO: 335783 - DNA, 25 bp, Homo sapien
ggcacgctgattcaacacacttgga

SEQ ID NO: 335784 - DNA, 25 bp, Homo sapien
aacacacttggagagcttcaccgaa

SEQ ID NO: 335785 - DNA, 25 bp, Homo sapien
agcttcaccgaaacacactaaacac

SEQ ID NO: 335786 - DNA, 25 bp, Homo sapien
cagtgatgaactgtgccctggcaga

SEQ ID NO: 335787 - DNA, 25 bp, Homo sapien
gccctggcagagatgacctggcaaa

SEQ ID NO: 335788 - DNA, 25 bp, Homo sapien
gatgacctggcaaaattctcaactt

SEQ ID NO: 335789 - DNA, 25 bp, Homo sapien
tgaggcagtgcacccgcagttctcg

SEQ ID NO: 335790 - DNA, 25 bp, Homo sapien
aagtcccgagccttcagaacggcag

SEQ ID NO: 335791 - DNA, 25 bp, Homo sapien
ggactggccaggctcttccattaac

SEQ ID NO: 335792 - DNA, 25 bp, Homo sapien
gaagagatcatcgtgctctcagact

SEQ ID NO: 335793 - DNA, 25 bp, Homo sapien
agatcatcgtgctctcagactctga

SEQ ID NO: 335794 - DNA, 25 bp, Homo sapien
atcatcgtgctctcagactctgatt

SEQ ID NO: 335795 - DNA, 25 bp, Homo sapien
agactctgatttagctgcctcccct

SEQ ID NO: 335796 - DNA, 25 bp, Homo sapien
gaatgtttctgggattaccatttgg

SEQ ID NO: 335797 - DNA, 25 bp, Homo sapien
aatgtttctgggattaccatttgga

SEQ ID NO: 335798 - DNA, 25 bp, Homo sapien
atgtttctgggattaccatttggag

SEQ ID NO: 335799 - DNA, 25 bp, Homo sapien
tgtttctgggattaccatttggagg

SEQ ID NO: 335800 - DNA, 25 bp, Homo sapien
gtttctgggattaccatttggagga

SEQ ID NO: 335801 - DNA, 25 bp, Homo sapien
ctgggattaccatttggaggaaggt

SEQ ID NO: 335802 - DNA, 25 bp, Homo sapien
gatggactaagcttatccccttttg

SEQ ID NO: 335803 - DNA, 25 bp, Homo sapien
taaagtagtattttcagctccctga

SEQ ID NO: 335804 - DNA, 25 bp, Homo sapien
tcagctccctgaaaaaccattcctg

SEQ ID NO: 335805 - DNA, 25 bp, Homo sapien
gctgaaactgctgtagaaattgtga

SEQ ID NO: 335806 - DNA, 25 bp, Homo sapien
aagctgcatgagtggagagtattga

SEQ ID NO: 335807 - DNA, 25 bp, Homo sapien
aatctgtggttatagtagttttctc

SEQ ID NO: 335808 - DNA, 25 bp, Homo sapien
ttctcaggtttgtttatcttgatgt

SEQ ID NO: 335809 - DNA, 25 bp, Homo sapien
tcttgatgtttgatgcactgtgttt

SEQ ID NO: 335810 - DNA, 25 bp, Homo sapien
gatgcactgtgttttatagttatta

SEQ ID NO: 335811 - DNA, 25 bp, Homo sapien
gcagtgttatgtgtcattggccttt

SEQ ID NO: 335812 - DNA, 25 bp, Homo sapien
gtgtcattggccttttgtgaatgtg

SEQ ID NO: 335813 - DNA, 25 bp, Homo sapien
aaacattttgtcctctaattgttat

SEQ ID NO: 335814 - DNA, 25 bp, Homo sapien
agctggagctatgaggatctgagtc

SEQ ID NO: 335815 - DNA, 25 bp, Homo sapien
gggccctcattcactagcagtaaga

SEQ ID NO: 335816 - DNA, 25 bp, Homo sapien
gcatggcacatagcactgtactaga

SEQ ID NO: 335817 - DNA, 25 bp, Homo sapien
tagcactgtactagattctgcaggg

SEQ ID NO: 335818 - DNA, 25 bp, Homo sapien
aaacatagagccaaacactctccct

SEQ ID NO: 335819 - DNA, 25 bp, Homo sapien
ctcttggagaatttcagacccagaa

SEQ ID NO: 335820 - DNA, 25 bp, Homo sapien
aaggccacgcagttctaacttttgt

SEQ ID NO: 335821 - DNA, 25 bp, Homo sapien
cttttgtcatcggttccttttgcta

SEQ ID NO: 335822 - DNA, 25 bp, Homo sapien
tatgttccttgcctattgtccaaca

SEQ ID NO: 335823 - DNA, 25 bp, Homo sapien
ataccccttccaagattgtgagaag

SEQ ID NO: 335824 - DNA, 25 bp, Homo sapien
gggtagctgggcatcaataaatatt

SEQ ID NO: 335825 - DNA, 25 bp, Homo sapien
aggctatgagatacacctgctctca

SEQ ID NO: 335826 - DNA, 25 bp, Homo sapien
atacacctgctctcaaccatgttaa

SEQ ID NO: 335827 - DNA, 25 bp, Homo sapien
acctgctctcaaccatgttaatttt

SEQ ID NO: 335828 - DNA, 25 bp, Homo sapien
gagaaacaaagcatccacaggccaa

SEQ ID NO: 335829 - DNA, 25 bp, Homo sapien
aaagcatccacaggccaaatcttct

SEQ ID NO: 335830 - DNA, 25 bp, Homo sapien
atattaatgcgttgtattctagaaa

SEQ ID NO: 335831 - DNA, 25 bp, Homo sapien
gtagaattgtcttaagtagctttgt

SEQ ID NO: 335832 - DNA, 25 bp, Homo sapien
atataaagtcatctatcagcccatt

SEQ ID NO: 335833 - DNA, 25 bp, Homo sapien
aaagtcatctatcagcccattacac

SEQ ID NO: 335834 - DNA, 25 bp, Homo sapien
atctatcagcccattacacctatta

SEQ ID NO: 335835 - DNA, 25 bp, Homo sapien
atcagcccattacacctattagaat

SEQ ID NO: 335836 - DNA, 25 bp, Homo sapien
gtctctctgaccagggtggagccac

SEQ ID NO: 335837 - DNA, 25 bp, Homo sapien
tctctgaccagggtggagccactgg

SEQ ID NO: 335838 - DNA, 25 bp, Homo sapien
ctgaccagggtggagccactggcca

SEQ ID NO: 335839 - DNA, 25 bp, Homo sapien
ccagggctctggagcacttgggatt

SEQ ID NO: 335840 - DNA, 25 bp, Homo sapien
cagggctctggagcacttgggattt

SEQ ID NO: 335841 - DNA, 25 bp, Homo sapien
caaaacctgctgcaagtgcaaagtt

SEQ ID NO: 335842 - DNA, 25 bp, Homo sapien
acctgctgcaagtgcaaagttcaca

SEQ ID NO: 335843 - DNA, 25 bp, Homo sapien
tgcaaagttcacacctgatttttaa

SEQ ID NO: 335844 - DNA, 25 bp, Homo sapien
aagttcacacctgatttttaagact

SEQ ID NO: 335845 - DNA, 25 bp, Homo sapien
gttcacacctgatttttaagactta

SEQ ID NO: 335846 - DNA, 25 bp, Homo sapien
acacctgatttttaagacttagaat

SEQ ID NO: 335847 - DNA, 25 bp, Homo sapien
gactgtggcgtgcatggtgctggcg

SEQ ID NO: 335848 - DNA, 25 bp, Homo sapien
tgctggcggtgggtgtcggcgtggt

SEQ ID NO: 335849 - DNA, 25 bp, Homo sapien
gcatggtgatgggactgcggattcg

SEQ ID NO: 335850 - DNA, 25 bp, Homo sapien
aactactggacccgccaacaagagg

SEQ ID NO: 335851 - DNA, 25 bp, Homo sapien
tgctgaccgccttgataggctacac

SEQ ID NO: 335852 - DNA, 25 bp, Homo sapien
gccttgataggctacaccgtgaaga

SEQ ID NO: 335853 - DNA, 25 bp, Homo sapien
ataggctacaccgtgaagaatgcgt

SEQ ID NO: 335854 - DNA, 25 bp, Homo sapien
gctacaccgtgaagaatgcgtggaa

SEQ ID NO: 335855 - DNA, 25 bp, Homo sapien
accgtgaagaatgcgtggaagaaca

SEQ ID NO: 335856 - DNA, 25 bp, Homo sapien
tggcaggaatgcaaccacggcatct

SEQ ID NO: 335857 - DNA, 25 bp, Homo sapien
aggaatgcaaccacggcatctgctc

SEQ ID NO: 335858 - DNA, 25 bp, Homo sapien
acacatctacctttgcttattactc

SEQ ID NO: 335859 - DNA, 25 bp, Homo sapien
cacatctacctttgcttattactct

SEQ ID NO: 335860 - DNA, 25 bp, Homo sapien
acatctacctttgcttattactctt

SEQ ID NO: 335861 - DNA, 25 bp, Homo sapien
catctacctttgcttattactctta

SEQ ID NO: 335862 - DNA, 25 bp, Homo sapien
atctacctttgcttattactcttaa

SEQ ID NO: 335863 - DNA, 25 bp, Homo sapien
tctacctttgcttattactcttaaa

SEQ ID NO: 335864 - DNA, 25 bp, Homo sapien
acttttaggccggatgtggtggcac

SEQ ID NO: 335865 - DNA, 25 bp, Homo sapien
gtgtggttgcatgcctgtactctca

SEQ ID NO: 335866 - DNA, 25 bp, Homo sapien
tgtggttgcatgcctgtactctcag

SEQ ID NO: 335867 - DNA, 25 bp, Homo sapien
gtggttgcatgcctgtactctcagc

SEQ ID NO: 335868 - DNA, 25 bp, Homo sapien
gttgggggatggctggagcccagga

SEQ ID NO: 335869 - DNA, 25 bp, Homo sapien
cccagctcaatctccttgttacagt

SEQ ID NO: 335870 - DNA, 25 bp, Homo sapien
tgttacagtaaccagtcagatgacg

SEQ ID NO: 335871 - DNA, 25 bp, Homo sapien
gtcagatgacggctcagatacagag

SEQ ID NO: 335872 - DNA, 25 bp, Homo sapien
acagagatggcttctggttctaaca

SEQ ID NO: 335873 - DNA, 25 bp, Homo sapien
tctaacagaacaccagttttttcct

SEQ ID NO: 335874 - DNA, 25 bp, Homo sapien
acagaagatatgttgtgggatcatc

SEQ ID NO: 335875 - DNA, 25 bp, Homo sapien
gggatcatctataaaggccgttttg

SEQ ID NO: 335876 - DNA, 25 bp, Homo sapien
gggaagtcctcattgacacacatct

SEQ ID NO: 335877 - DNA, 25 bp, Homo sapien
ttgacacacatctcttcaagccttg

SEQ ID NO: 335878 - DNA, 25 bp, Homo sapien
ctcttcaagccttgctgcagcaata

SEQ ID NO: 335879 - DNA, 25 bp, Homo sapien
gagtggtgactgaggtttttatgta

SEQ ID NO: 335880 - DNA, 25 bp, Homo sapien
tgtgccttcattcatgggttaatgg

SEQ ID NO: 335881 - DNA, 25 bp, Homo sapien
taatgggttatcacaggaatgggac

SEQ ID NO: 335882 - DNA, 25 bp, Homo sapien
aaagagaactgagctagcatgccca

SEQ ID NO: 335883 - DNA, 25 bp, Homo sapien
agctagcatgcccagcccacagaga

SEQ ID NO: 335884 - DNA, 25 bp, Homo sapien
cacagagagcctccactagagtgat

SEQ ID NO: 335885 - DNA, 25 bp, Homo sapien
gagcctccactagagtgatgctaag

SEQ ID NO: 335886 - DNA, 25 bp, Homo sapien
gtctagtgtctagtggatccaggcc

SEQ ID NO: 335887 - DNA, 25 bp, Homo sapien
gatccaggccacaggagagagtgcc

SEQ ID NO: 335888 - DNA, 25 bp, Homo sapien
tgggagcaggacctgaccaccacca

SEQ ID NO: 335889 - DNA, 25 bp, Homo sapien
ccccagaactgtggagtcagtggca

SEQ ID NO: 335890 - DNA, 25 bp, Homo sapien
gagtcagtggcagcatgcagcgccc

SEQ ID NO: 335891 - DNA, 25 bp, Homo sapien
tatatttcccttagtgacactcatt

SEQ ID NO: 335892 - DNA, 25 bp, Homo sapien
gacactcatttatcttacagctcac

SEQ ID NO: 335893 - DNA, 25 bp, Homo sapien
tcatttatcttacagctcacccctt

SEQ ID NO: 335894 - DNA, 25 bp, Homo sapien
taaagtatccagcaagaatagcagg

SEQ ID NO: 335895 - DNA, 25 bp, Homo sapien
gcaggaaaaattagctaaaggcacc

SEQ ID NO: 335896 - DNA, 25 bp, Homo sapien
ctttgctccagaaataatcgacaga

SEQ ID NO: 335897 - DNA, 25 bp, Homo sapien
atcaaagtgcggaataattacaagt

SEQ ID NO: 335898 - DNA, 25 bp, Homo sapien
tcaaccagtttttaactacaacaat

SEQ ID NO: 335899 - DNA, 25 bp, Homo sapien
ggttttaattgacctattcagcgat

SEQ ID NO: 335900 - DNA, 25 bp, Homo sapien
taattgacctattcagcgatttctg

SEQ ID NO: 335901 - DNA, 25 bp, Homo sapien
gacctattcagcgatttctgattat

SEQ ID NO: 335902 - DNA, 25 bp, Homo sapien
agtcaccccggtcttgccagaagaa

SEQ ID NO: 335903 - DNA, 25 bp, Homo sapien
tcaccccggtcttgccagaagaaac

SEQ ID NO: 335904 - DNA, 25 bp, Homo sapien
tttcccgtggctcctgtgttcagaa

SEQ ID NO: 335905 - DNA, 25 bp, Homo sapien
ccgtggctcctgtgttcagaatgtg

SEQ ID NO: 335906 - DNA, 25 bp, Homo sapien
ggctcctgtgttcagaatgtggtat

SEQ ID NO: 335907 - DNA, 25 bp, Homo sapien
ctgtgttcagaatgtggtattggct

SEQ ID NO: 335908 - DNA, 25 bp, Homo sapien
tgcctctttccataatccgtggttt

SEQ ID NO: 335909 - DNA, 25 bp, Homo sapien
ctctttccataatccgtggtttcag

SEQ ID NO: 335910 - DNA, 25 bp, Homo sapien
ataatccgtggtttcagtttgactt

SEQ ID NO: 335911 - DNA, 25 bp, Homo sapien
ccgtggtttcagtttgactttgtat

SEQ ID NO: 335912 - DNA, 25 bp, Homo sapien
ggtttcagtttgactttgtatataa

SEQ ID NO: 335913 - DNA, 25 bp, Homo sapien
gcagcctaggccagagcactttact

SEQ ID NO: 335914 - DNA, 25 bp, Homo sapien
gcagatcccaggctgtggattacgt

SEQ ID NO: 335915 - DNA, 25 bp, Homo sapien
gatcccaggctgtggattacgtcac

SEQ ID NO: 335916 - DNA, 25 bp, Homo sapien
tcccaggctgtggattacgtcactg

SEQ ID NO: 335917 - DNA, 25 bp, Homo sapien
caggctgtggattacgtcactgcag

SEQ ID NO: 335918 - DNA, 25 bp, Homo sapien
gctgtggattacgtcactgcaggaa

SEQ ID NO: 335919 - DNA, 25 bp, Homo sapien
tggattacgtcactgcaggaactgc

SEQ ID NO: 335920 - DNA, 25 bp, Homo sapien
gattacgtcactgcaggaactgctt

SEQ ID NO: 335921 - DNA, 25 bp, Homo sapien
ttacgtcactgcaggaactgcttct

SEQ ID NO: 335922 - DNA, 25 bp, Homo sapien
acgtcactgcaggaactgcttctga

SEQ ID NO: 335923 - DNA, 25 bp, Homo sapien
gtcactgcaggaactgcttctgaaa

SEQ ID NO: 335924 - DNA, 25 bp, Homo sapien
agtcttgtaagtctggttccatagt

SEQ ID NO: 335925 - DNA, 25 bp, Homo sapien
gtaactacttccatctgaaggtcca

SEQ ID NO: 335926 - DNA, 25 bp, Homo sapien
gaaggtccaacaatctgcattgaaa

SEQ ID NO: 335927 - DNA, 25 bp, Homo sapien
aaatcaattaggctcccaattccac

SEQ ID NO: 335928 - DNA, 25 bp, Homo sapien
caattccacaaaaccctacagtgca

SEQ ID NO: 335929 - DNA, 25 bp, Homo sapien
caaagcagggtatccaaggtaaaat

SEQ ID NO: 335930 - DNA, 25 bp, Homo sapien
aaggtaaaatcgatctgctcccaac

SEQ ID NO: 335931 - DNA, 25 bp, Homo sapien
ctgctcccaaccatccaagaaaaag

SEQ ID NO: 335932 - DNA, 25 bp, Homo sapien
gagacaatgcgactgccactttgta

SEQ ID NO: 335933 - DNA, 25 bp, Homo sapien
gtaggaatagccatttacatttcgg

SEQ ID NO: 335934 - DNA, 25 bp, Homo sapien
ttacatttcggcaagatatgggctt

SEQ ID NO: 335935 - DNA, 25 bp, Homo sapien
aaggtcatcagtattatgttctaaa

SEQ ID NO: 335936 - DNA, 25 bp, Homo sapien
taaacttatggccatacatgagaaa

SEQ ID NO: 335937 - DNA, 25 bp, Homo sapien
cagctgaatggctaggtcatatggt

SEQ ID NO: 335938 - DNA, 25 bp, Homo sapien
aatggctaggtcatatggtgatcta

SEQ ID NO: 335939 - DNA, 25 bp, Homo sapien
atggtgatctagtatgtaactggaa

SEQ ID NO: 335940 - DNA, 25 bp, Homo sapien
ttatgttatacattgcccttcctct

SEQ ID NO: 335941 - DNA, 25 bp, Homo sapien
tgcccttcctctcccataagatgga

SEQ ID NO: 335942 - DNA, 25 bp, Homo sapien
gatggacaaaagtgtttctgtatca

SEQ ID NO: 335943 - DNA, 25 bp, Homo sapien
tgtttctgtatcactgtgtcccaga

SEQ ID NO: 335944 - DNA, 25 bp, Homo sapien
gtgtcccagacaatatttagaatta

SEQ ID NO: 335945 - DNA, 25 bp, Homo sapien
tagaattacccagctttccagtttt

SEQ ID NO: 335946 - DNA, 25 bp, Homo sapien
cttgaaaggaagttacagggacagt

SEQ ID NO: 335947 - DNA, 25 bp, Homo sapien
gcctacgatgccgtggtaatgatgt

SEQ ID NO: 335948 - DNA, 25 bp, Homo sapien
gatgccgtggtaatgatgtgtccgt

SEQ ID NO: 335949 - DNA, 25 bp, Homo sapien
tgatgtgtccgtgttaatttcctga

SEQ ID NO: 335950 - DNA, 25 bp, Homo sapien
tttcatggttgcctgttaagttaca

SEQ ID NO: 335951 - DNA, 25 bp, Homo sapien
ggttgcctgttaagttacatcagag

SEQ ID NO: 335952 - DNA, 25 bp, Homo sapien
acatcagaggatgttcttgtttgct

SEQ ID NO: 335953 - DNA, 25 bp, Homo sapien
ggatgttcttgtttgctggaaagta

SEQ ID NO: 335954 - DNA, 25 bp, Homo sapien
gggataaggcatcaaatggtcacct

SEQ ID NO: 335955 - DNA, 25 bp, Homo sapien
caaatggtcaccttaatttcaaatt

SEQ ID NO: 335956 - DNA, 25 bp, Homo sapien
aaaatgtttctctctgtacttaata

SEQ ID NO: 335957 - DNA, 25 bp, Homo sapien
tctattagttttttcgaggcaccta

SEQ ID NO: 335958 - DNA, 25 bp, Homo sapien
aaatattgactcctatctggccttc

SEQ ID NO: 335959 - DNA, 25 bp, Homo sapien
tggccttcatcaactgacctcgaaa

SEQ ID NO: 335960 - DNA, 25 bp, Homo sapien
aactgacctcgaaaagcctcatgag

SEQ ID NO: 335961 - DNA, 25 bp, Homo sapien
aatgtgattttgttcagcctcactg

SEQ ID NO: 335962 - DNA, 25 bp, Homo sapien
tcagcctcactgtttttaccttaat

SEQ ID NO: 335963 - DNA, 25 bp, Homo sapien
tttaccttaatttcaactgcccaca

SEQ ID NO: 335964 - DNA, 25 bp, Homo sapien
acacacttgaccgtgcagtcaggag

SEQ ID NO: 335965 - DNA, 25 bp, Homo sapien
agtcaggagtgactggcttctcctt

SEQ ID NO: 335966 - DNA, 25 bp, Homo sapien
ttctccttgtcctcatttatgcatg

SEQ ID NO: 335967 - DNA, 25 bp, Homo sapien
ggagctgattcctgaactcatattt

SEQ ID NO: 335968 - DNA, 25 bp, Homo sapien
accctgagaagttccttgctactta

SEQ ID NO: 335969 - DNA, 25 bp, Homo sapien
gagaagttccttgctacttataaag

SEQ ID NO: 335970 - DNA, 25 bp, Homo sapien
tataaagccttttcttgacctgtca

SEQ ID NO: 335971 - DNA, 25 bp, Homo sapien
gacctgtcagacctaatgtttgatg

SEQ ID NO: 335972 - DNA, 25 bp, Homo sapien
actatcgtcgaatttatgttatgca

SEQ ID NO: 335973 - DNA, 25 bp, Homo sapien
ttttctatgcacatactcttactgg

SEQ ID NO: 335974 - DNA, 25 bp, Homo sapien
atgcacatactcttactggaaaaaa

SEQ ID NO: 335975 - DNA, 25 bp, Homo sapien
ggctaagttatggtacatgcatgta

SEQ ID NO: 335976 - DNA, 25 bp, Homo sapien
gaatactatagagcagactgagcaa

SEQ ID NO: 335977 - DNA, 25 bp, Homo sapien
caaatccagcccatggtaagtattt

SEQ ID NO: 335978 - DNA, 25 bp, Homo sapien
ccagcccatggtaagtatttgtaaa

SEQ ID NO: 335979 - DNA, 25 bp, Homo sapien
cagaccgtagcccattggccttatg

SEQ ID NO: 335980 - DNA, 25 bp, Homo sapien
agaccgtagcccattggccttatgt

SEQ ID NO: 335981 - DNA, 25 bp, Homo sapien
tgtcactgctggtgggccggagtga

SEQ ID NO: 335982 - DNA, 25 bp, Homo sapien
gtcactgctggtgggccggagtgat

SEQ ID NO: 335983 - DNA, 25 bp, Homo sapien
tcactgctggtgggccggagtgatg

SEQ ID NO: 335984 - DNA, 25 bp, Homo sapien
gctggtgggccggagtgatgtggtg

SEQ ID NO: 335985 - DNA, 25 bp, Homo sapien
ctggtgggccggagtgatgtggtgg

SEQ ID NO: 335986 - DNA, 25 bp, Homo sapien
tggtgggccggagtgatgtggtggg

SEQ ID NO: 335987 - DNA, 25 bp, Homo sapien
ggtgggccggagtgatgtggtggga

SEQ ID NO: 335988 - DNA, 25 bp, Homo sapien
catcagccagtgctctgaggtatca

SEQ ID NO: 335989 - DNA, 25 bp, Homo sapien
gtgctctgaggtatcaagtctaaat

SEQ ID NO: 335990 - DNA, 25 bp, Homo sapien
gtccttagtttctttgctatctaat

SEQ ID NO: 335991 - DNA, 25 bp, Homo sapien
agtctaagatttgctggatgacaga

SEQ ID NO: 335992 - DNA, 25 bp, Homo sapien
aaggtacttgaattggccatagaca

SEQ ID NO: 335993 - DNA, 25 bp, Homo sapien
atagatggccaatagatgccctgat

SEQ ID NO: 335994 - DNA, 25 bp, Homo sapien
gatgccctgataatgaaagttgaca

SEQ ID NO: 335995 - DNA, 25 bp, Homo sapien
gttgacacctgtaagatttaccagt

SEQ ID NO: 335996 - DNA, 25 bp, Homo sapien
tgaattggccatagacaagtctgta

SEQ ID NO: 335997 - DNA, 25 bp, Homo sapien
tgaagtgttatcgttttccctcatc

SEQ ID NO: 335998 - DNA, 25 bp, Homo sapien
gttttccctcatctgagtctgaatt

SEQ ID NO: 335999 - DNA, 25 bp, Homo sapien
ggctaggtgtcgtccaccctgtatc

SEQ ID NO: 336000 - DNA, 25 bp, Homo sapien
accctgtatcctgtgtctgagtgtg

SEQ ID NO: 336001 - DNA, 25 bp, Homo sapien
ctgtatcctgtgtctgagtgtgtgt

SEQ ID NO: 336002 - DNA, 25 bp, Homo sapien
tgtactaatttccatggccggtggc

SEQ ID NO: 336003 - DNA, 25 bp, Homo sapien
atggccggtggcttttccttccatg

SEQ ID NO: 336004 - DNA, 25 bp, Homo sapien
gtggcttttccttccatgcatcact

SEQ ID NO: 336005 - DNA, 25 bp, Homo sapien
gctgtcctgtggtcttgagattttt

SEQ ID NO: 336006 - DNA, 25 bp, Homo sapien
tttgcatatgtaatccattctgtac

SEQ ID NO: 336007 - DNA, 25 bp, Homo sapien
aatccattctgtacaggtagctaac

SEQ ID NO: 336008 - DNA, 25 bp, Homo sapien
ggtagctaactttgtaaacgctgtg

SEQ ID NO: 336009 - DNA, 25 bp, Homo sapien
ttgtaaacgctgtgtattccctctg

SEQ ID NO: 336010 - DNA, 25 bp, Homo sapien
atcagactgctgagaaggaagaatt

SEQ ID NO: 336011 - DNA, 25 bp, Homo sapien
taagccaaccaagtgtagatgtagc

SEQ ID NO: 336012 - DNA, 25 bp, Homo sapien
gtagatgtagcattgttccacacat

SEQ ID NO: 336013 - DNA, 25 bp, Homo sapien
agatgtagcattgttccacacattt

SEQ ID NO: 336014 - DNA, 25 bp, Homo sapien
tgttccacacatttaaaacatttga

SEQ ID NO: 336015 - DNA, 25 bp, Homo sapien
tgaaggacctaaattcgtagcaaat

SEQ ID NO: 336016 - DNA, 25 bp, Homo sapien
cctaaattcgtagcaaattctgtgg

SEQ ID NO: 336017 - DNA, 25 bp, Homo sapien
atttgaacatcaacagaaagagctg

SEQ ID NO: 336018 - DNA, 25 bp, Homo sapien
agagctggagaaagtttgcaacccc

SEQ ID NO: 336019 - DNA, 25 bp, Homo sapien
agctggagaaagtttgcaaccccat

SEQ ID NO: 336020 - DNA, 25 bp, Homo sapien
caccaagctgtaccagagtgcagga

SEQ ID NO: 336021 - DNA, 25 bp, Homo sapien
ataaattaatacatgcctgtgtgca

SEQ ID NO: 336022 - DNA, 25 bp, Homo sapien
tacaggtaataaacatccccaaggt

SEQ ID NO: 336023 - DNA, 25 bp, Homo sapien
ccccaaggtttgtggctggccatac

SEQ ID NO: 336024 - DNA, 25 bp, Homo sapien
gtggctggccatacacataggcatc

SEQ ID NO: 336025 - DNA, 25 bp, Homo sapien
tacacataggcatcagtttaacaac

SEQ ID NO: 336026 - DNA, 25 bp, Homo sapien
tcagtttaacaaccatcagacctca

SEQ ID NO: 336027 - DNA, 25 bp, Homo sapien
agacctcagctgtacaataacaggt

SEQ ID NO: 336028 - DNA, 25 bp, Homo sapien
gttctgcagcatttagacatttgtc

SEQ ID NO: 336029 - DNA, 25 bp, Homo sapien
catttcattagctttgacaaccata

SEQ ID NO: 336030 - DNA, 25 bp, Homo sapien
agctttgacaaccatactgtaacat

SEQ ID NO: 336031 - DNA, 25 bp, Homo sapien
gtaacattaaacctagcattccaca

SEQ ID NO: 336032 - DNA, 25 bp, Homo sapien
ggactttccaattttgaaattatgg

SEQ ID NO: 336033 - DNA, 25 bp, Homo sapien
ttctatagtggcttcttttctgtct

SEQ ID NO: 336034 - DNA, 25 bp, Homo sapien
aaagccatatcctgtctttggtggt

SEQ ID NO: 336035 - DNA, 25 bp, Homo sapien
atatcctgtctttggtggtggcctg

SEQ ID NO: 336036 - DNA, 25 bp, Homo sapien
tggcctggtaggaatggcttgtcct

SEQ ID NO: 336037 - DNA, 25 bp, Homo sapien
taggaatggcttgtcctagttcttc

SEQ ID NO: 336038 - DNA, 25 bp, Homo sapien
tgtcctagttcttcaaaggtaagat

SEQ ID NO: 336039 - DNA, 25 bp, Homo sapien
caaagcaagttctcattggtggtct

SEQ ID NO: 336040 - DNA, 25 bp, Homo sapien
gttctcattggtggtctgtgtttac

SEQ ID NO: 336041 - DNA, 25 bp, Homo sapien
ctgtgtttacatcttccgtgtcaag

SEQ ID NO: 336042 - DNA, 25 bp, Homo sapien
ccgtgtcaagatattttaaagcatg

SEQ ID NO: 336043 - DNA, 25 bp, Homo sapien
tggcttgtttttcttgcatggtttg

SEQ ID NO: 336044 - DNA, 25 bp, Homo sapien
gcatggtttggagctgatcgcttct

SEQ ID NO: 336045 - DNA, 25 bp, Homo sapien
ggtttggagctgatcgcttctcccc

SEQ ID NO: 336046 - DNA, 25 bp, Homo sapien
gggcccaagatctctgctcagagaa

SEQ ID NO: 336047 - DNA, 25 bp, Homo sapien
agctcactctccctgaggactggct

SEQ ID NO: 336048 - DNA, 25 bp, Homo sapien
tcactctccctgaggactggcttga

SEQ ID NO: 336049 - DNA, 25 bp, Homo sapien
actctccctgaggactggcttgaca

SEQ ID NO: 336050 - DNA, 25 bp, Homo sapien
tctccctgaggactggcttgacagg

SEQ ID NO: 336051 - DNA, 25 bp, Homo sapien
ttgacaggggctatgggtttgcttt

SEQ ID NO: 336052 - DNA, 25 bp, Homo sapien
tttgaaaaaacgactgcccatcccg

SEQ ID NO: 336053 - DNA, 25 bp, Homo sapien
tgaaaaaacgactgcccatcccggg

SEQ ID NO: 336054 - DNA, 25 bp, Homo sapien
gagcagtctacttctgtgtctgtca

SEQ ID NO: 336055 - DNA, 25 bp, Homo sapien
tgtgtctgtcaccacatcttgtctt

SEQ ID NO: 336056 - DNA, 25 bp, Homo sapien
catcttgtcttttcccctcattgca

SEQ ID NO: 336057 - DNA, 25 bp, Homo sapien
ggaagaaggcaagccaaccttagct

SEQ ID NO: 336058 - DNA, 25 bp, Homo sapien
gaaggcaagccaaccttagctacaa

SEQ ID NO: 336059 - DNA, 25 bp, Homo sapien
accttagctacaatcctaccttttg

SEQ ID NO: 336060 - DNA, 25 bp, Homo sapien
cttagctacaatcctaccttttgat

SEQ ID NO: 336061 - DNA, 25 bp, Homo sapien
agctacaatcctaccttttgataaa

SEQ ID NO: 336062 - DNA, 25 bp, Homo sapien
atgttccttttgacaatatacacgg

SEQ ID NO: 336063 - DNA, 25 bp, Homo sapien
ccttttgacaatatacacggattat

SEQ ID NO: 336064 - DNA, 25 bp, Homo sapien
atacacggattattatttgtacttt

SEQ ID NO: 336065 - DNA, 25 bp, Homo sapien
tggcttgtttttcttgcatggtttg

SEQ ID NO: 336066 - DNA, 25 bp, Homo sapien
ggcttgtttttcttgcatggtttgg

SEQ ID NO: 336067 - DNA, 25 bp, Homo sapien
gcttgtttttcttgcatggtttgga

SEQ ID NO: 336068 - DNA, 25 bp, Homo sapien
cttgtttttcttgcatggtttggag

SEQ ID NO: 336069 - DNA, 25 bp, Homo sapien
tgcatggtttggagctgatcgcttc

SEQ ID NO: 336070 - DNA, 25 bp, Homo sapien
gcatggtttggagctgatcgcttct

SEQ ID NO: 336071 - DNA, 25 bp, Homo sapien
catggtttggagctgatcgcttctc

SEQ ID NO: 336072 - DNA, 25 bp, Homo sapien
atggtttggagctgatcgcttctcc

SEQ ID NO: 336073 - DNA, 25 bp, Homo sapien
tggtttggagctgatcgcttctccc

SEQ ID NO: 336074 - DNA, 25 bp, Homo sapien
ggtttggagctgatcgcttctcccc

SEQ ID NO: 336075 - DNA, 25 bp, Homo sapien
tttggagctgatcgcttctccccca

SEQ ID NO: 336076 - DNA, 25 bp, Homo sapien
gacacaaggtggacactctctacag

SEQ ID NO: 336077 - DNA, 25 bp, Homo sapien
gtggacactctctacagatcactga

SEQ ID NO: 336078 - DNA, 25 bp, Homo sapien
atcactgaggataagctggagccac

SEQ ID NO: 336079 - DNA, 25 bp, Homo sapien
taagctggagccacaatgcatgagg

SEQ ID NO: 336080 - DNA, 25 bp, Homo sapien
caatgcatgaggcacacacacagca

SEQ ID NO: 336081 - DNA, 25 bp, Homo sapien
tgtaaacatagcccacgctgtcctg

SEQ ID NO: 336082 - DNA, 25 bp, Homo sapien
cctatgttgttgaaggagggactag

SEQ ID NO: 336083 - DNA, 25 bp, Homo sapien
taattacaggaggtttgttcaggtc

SEQ ID NO: 336084 - DNA, 25 bp, Homo sapien
caaaccaccgtcagatttgatgatt

SEQ ID NO: 336085 - DNA, 25 bp, Homo sapien
gatgatttcctagcaggacttacag

SEQ ID NO: 336086 - DNA, 25 bp, Homo sapien
tcctagcaggacttacagaaataaa

SEQ ID NO: 336087 - DNA, 25 bp, Homo sapien
gggaaggaggacacaacctcaagaa

SEQ ID NO: 336088 - DNA, 25 bp, Homo sapien
gcgtgaaccccagggaacagcgggt

SEQ ID NO: 336089 - DNA, 25 bp, Homo sapien
aagccacctcagcttgtggctcttg

SEQ ID NO: 336090 - DNA, 25 bp, Homo sapien
caacccacctgttcatttattcaac

SEQ ID NO: 336091 - DNA, 25 bp, Homo sapien
tttattcaacagacaatgacagctg

SEQ ID NO: 336092 - DNA, 25 bp, Homo sapien
tattcaacagacaatgacagctgat

SEQ ID NO: 336093 - DNA, 25 bp, Homo sapien
ttcaacagacaatgacagctgatat

SEQ ID NO: 336094 - DNA, 25 bp, Homo sapien
acagacaatgacagctgatatttat

SEQ ID NO: 336095 - DNA, 25 bp, Homo sapien
acatagccctagcaggagctcccag

SEQ ID NO: 336096 - DNA, 25 bp, Homo sapien
ttggcactctgacacacaagtacac

SEQ ID NO: 336097 - DNA, 25 bp, Homo sapien
gcccgctttgccacgaagagctggg

SEQ ID NO: 336098 - DNA, 25 bp, Homo sapien
taaggccttgcaagtgaactgcgtg

SEQ ID NO: 336099 - DNA, 25 bp, Homo sapien
tgcaggctgcctttgagcacacgac

SEQ ID NO: 336100 - DNA, 25 bp, Homo sapien
gcgtcctcggactcagagtctggaa

SEQ ID NO: 336101 - DNA, 25 bp, Homo sapien
ctcagagtctggaacagttttgcca

SEQ ID NO: 336102 - DNA, 25 bp, Homo sapien
gaactgcgtggtaaggaagctcctg

SEQ ID NO: 336103 - DNA, 25 bp, Homo sapien
ttgccagagcaagaaactcccagag

SEQ ID NO: 336104 - DNA, 25 bp, Homo sapien
tggtaaggaagctcctggtacagct

SEQ ID NO: 336105 - DNA, 25 bp, Homo sapien
ctcctggtacagctgagacgtctgt

SEQ ID NO: 336106 - DNA, 25 bp, Homo sapien
acagctgagacgtctgtattggtgg

SEQ ID NO: 336107 - DNA, 25 bp, Homo sapien
tgggtggagactatgactgccctca

SEQ ID NO: 336108 - DNA, 25 bp, Homo sapien
gtggagactatgactgccctcacct

SEQ ID NO: 336109 - DNA, 25 bp, Homo sapien
gaagttctgcgcatgcgtggcacca

SEQ ID NO: 336110 - DNA, 25 bp, Homo sapien
aagttctgcgcatgcgtggcaccat

SEQ ID NO: 336111 - DNA, 25 bp, Homo sapien
agttctgcgcatgcgtggcaccatt

SEQ ID NO: 336112 - DNA, 25 bp, Homo sapien
gttctgcgcatgcgtggcaccattt

SEQ ID NO: 336113 - DNA, 25 bp, Homo sapien
ttctgcgcatgcgtggcaccatttc

SEQ ID NO: 336114 - DNA, 25 bp, Homo sapien
ctactcagcctgaggttgcagactg

SEQ ID NO: 336115 - DNA, 25 bp, Homo sapien
ctgcgcatgcgtggcaccatttccc

SEQ ID NO: 336116 - DNA, 25 bp, Homo sapien
tctgaaggtgtacaggtgccctctg

SEQ ID NO: 336117 - DNA, 25 bp, Homo sapien
gcgcatgcgtggcaccatttcccgt

SEQ ID NO: 336118 - DNA, 25 bp, Homo sapien
gcatgcgtggcaccatttcccgtga

SEQ ID NO: 336119 - DNA, 25 bp, Homo sapien
cctgccacggaagactggtctgcag

SEQ ID NO: 336120 - DNA, 25 bp, Homo sapien
gtaactttgccaagtaagcatcttt

SEQ ID NO: 336121 - DNA, 25 bp, Homo sapien
aactttgccaagtaagcatctttac

SEQ ID NO: 336122 - DNA, 25 bp, Homo sapien
ttgccaagtaagcatctttacacct

SEQ ID NO: 336123 - DNA, 25 bp, Homo sapien
gtaagcatctttacacctaatccca

SEQ ID NO: 336124 - DNA, 25 bp, Homo sapien
aagcatctttacacctaatcccaaa

SEQ ID NO: 336125 - DNA, 25 bp, Homo sapien
gcatctttacacctaatcccaaagg

SEQ ID NO: 336126 - DNA, 25 bp, Homo sapien
tctttacacctaatcccaaaggctc

SEQ ID NO: 336127 - DNA, 25 bp, Homo sapien
tacacctaatcccaaaggctctttt

SEQ ID NO: 336128 - DNA, 25 bp, Homo sapien
tcttttaagagccacgcatgttttc

SEQ ID NO: 336129 - DNA, 25 bp, Homo sapien
ttttaagagccacgcatgttttcaa

SEQ ID NO: 336130 - DNA, 25 bp, Homo sapien
taagagccacgcatgttttcaataa

SEQ ID NO: 336131 - DNA, 25 bp, Homo sapien
tttttctaagtgcatgtgatgtgat

SEQ ID NO: 336132 - DNA, 25 bp, Homo sapien
ttttctaagtgcatgtgatgtgata

SEQ ID NO: 336133 - DNA, 25 bp, Homo sapien
tttctaagtgcatgtgatgtgatag

SEQ ID NO: 336134 - DNA, 25 bp, Homo sapien
ctaagtgcatgtgatgtgatagagt

SEQ ID NO: 336135 - DNA, 25 bp, Homo sapien
aagtgcatgtgatgtgatagagtgt

SEQ ID NO: 336136 - DNA, 25 bp, Homo sapien
gagctggcattccagcgggcccctc

SEQ ID NO: 336137 - DNA, 25 bp, Homo sapien
cagcgggcccctctctttacctttg

SEQ ID NO: 336138 - DNA, 25 bp, Homo sapien
gtgtgcgtgcgagtgtgtcactgct

SEQ ID NO: 336139 - DNA, 25 bp, Homo sapien
gtgcgtgcgagtgtgtcactgctgg

SEQ ID NO: 336140 - DNA, 25 bp, Homo sapien
gcgtgcgagtgtgtcactgctggtg

SEQ ID NO: 336141 - DNA, 25 bp, Homo sapien
cgtgcgagtgtgtcactgctggtgg

SEQ ID NO: 336142 - DNA, 25 bp, Homo sapien
gttcagtggacttctgataacgtct

SEQ ID NO: 336143 - DNA, 25 bp, Homo sapien
aacgtctaatttcacggagcgccac

SEQ ID NO: 336144 - DNA, 25 bp, Homo sapien
gtaacgatgaggtttcttcacccct

SEQ ID NO: 336145 - DNA, 25 bp, Homo sapien
tgaggtttcttcacccctccagtag

SEQ ID NO: 336146 - DNA, 25 bp, Homo sapien
gcactcttgcgagcggcttttgtag

SEQ ID NO: 336147 - DNA, 25 bp, Homo sapien
ggcttttgtagccagttgcttcctg

SEQ ID NO: 336148 - DNA, 25 bp, Homo sapien
ttgcttcctgggtgctttaccaccg

SEQ ID NO: 336149 - DNA, 25 bp, Homo sapien
tttaccaccggtcgatttgcgggca

SEQ ID NO: 336150 - DNA, 25 bp, Homo sapien
gatttgcgggcagtctgctttgtac

SEQ ID NO: 336151 - DNA, 25 bp, Homo sapien
agtctgctttgtacgagccatggta

SEQ ID NO: 336152 - DNA, 25 bp, Homo sapien
atggtacagagacctccttacttac

SEQ ID NO: 336153 - DNA, 25 bp, Homo sapien
gccaggcctgagatggagttgtcca

SEQ ID NO: 336154 - DNA, 25 bp, Homo sapien
gacacactcatcacctcagaggcaa

SEQ ID NO: 336155 - DNA, 25 bp, Homo sapien
cagtccttctccacatcgtaaatgt

SEQ ID NO: 336156 - DNA, 25 bp, Homo sapien
catcgtaaatgtgcacgtagcctgt

SEQ ID NO: 336157 - DNA, 25 bp, Homo sapien
aaatgtgcacgtagcctgtgcggct

SEQ ID NO: 336158 - DNA, 25 bp, Homo sapien
cgcggttgtgtgagcggccacctaa

SEQ ID NO: 336159 - DNA, 25 bp, Homo sapien
gtgagcggccacctaacacatagat

SEQ ID NO: 336160 - DNA, 25 bp, Homo sapien
acacatagatcctgttgtccagcac

SEQ ID NO: 336161 - DNA, 25 bp, Homo sapien
tagatcctgttgtccagcacagcaa

SEQ ID NO: 336162 - DNA, 25 bp, Homo sapien
ttgtccagcacagcaatgccaggct

SEQ ID NO: 336163 - DNA, 25 bp, Homo sapien
tcagaggcaaagtccgggtcggcct

SEQ ID NO: 336164 - DNA, 25 bp, Homo sapien
gccagaacaccacttggttttattt

SEQ ID NO: 336165 - DNA, 25 bp, Homo sapien
tttttctaagtgcatgtgatgtgat

SEQ ID NO: 336166 - DNA, 25 bp, Homo sapien
ctaagtgcatgtgatgtgatagagt

SEQ ID NO: 336167 - DNA, 25 bp, Homo sapien
cttccctgggagctggcattccagc

SEQ ID NO: 336168 - DNA, 25 bp, Homo sapien
gaggcaagagagaaattccttcttc

SEQ ID NO: 336169 - DNA, 25 bp, Homo sapien
aaattccttcttcccagccagagag

SEQ ID NO: 336170 - DNA, 25 bp, Homo sapien
ggcagaagcagaccgtagcccattg

SEQ ID NO: 336171 - DNA, 25 bp, Homo sapien
tagcccattggccttatgtgcgtgt

SEQ ID NO: 336172 - DNA, 25 bp, Homo sapien
gtgtgcgtgcgagtgtgtcactgct

SEQ ID NO: 336173 - DNA, 25 bp, Homo sapien
cgtgcgagtgtgtcactgctggtgg

SEQ ID NO: 336174 - DNA, 25 bp, Homo sapien
gaatgtatccttttcagacaaaatt

SEQ ID NO: 336175 - DNA, 25 bp, Homo sapien
taacagcttttgcttatcctggctc

SEQ ID NO: 336176 - DNA, 25 bp, Homo sapien
cctggctccaccattggagaagttg

SEQ ID NO: 336177 - DNA, 25 bp, Homo sapien
gagaagttgagctgacttatctttt

SEQ ID NO: 336178 - DNA, 25 bp, Homo sapien
attcattgccagaatggtggtccca

SEQ ID NO: 336179 - DNA, 25 bp, Homo sapien
cagaatggtggtcccagtcctttct

SEQ ID NO: 336180 - DNA, 25 bp, Homo sapien
gttctgattgaactagtgagcatgt

SEQ ID NO: 336181 - DNA, 25 bp, Homo sapien
gcatgtattagtagaggccagcctc

SEQ ID NO: 336182 - DNA, 25 bp, Homo sapien
tatgacacatgtagaataaactcct

SEQ ID NO: 336183 - DNA, 25 bp, Homo sapien
aactccttagttgggtatctcatat

SEQ ID NO: 336184 - DNA, 25 bp, Homo sapien
gggtatctcatatcgatggtaggaa

SEQ ID NO: 336185 - DNA, 25 bp, Homo sapien
gaaggtctgagtaacagcttttgct

SEQ ID NO: 336186 - DNA, 25 bp, Homo sapien
ggtatttctacactttaaggccatt

SEQ ID NO: 336187 - DNA, 25 bp, Homo sapien
aaggccatttggtgcaatttagaaa

SEQ ID NO: 336188 - DNA, 25 bp, Homo sapien
caatttagaaagtgttggcctccct

SEQ ID NO: 336189 - DNA, 25 bp, Homo sapien
cttccgctagccacattcaaaatta

SEQ ID NO: 336190 - DNA, 25 bp, Homo sapien
caaaacctcaggaacagtacaaaga

SEQ ID NO: 336191 - DNA, 25 bp, Homo sapien
gaaaccctcaatatggcagcacagc

SEQ ID NO: 336192 - DNA, 25 bp, Homo sapien
caatatggcagcacagccggctgta

SEQ ID NO: 336193 - DNA, 25 bp, Homo sapien
cacagccggctgtagtgtatattta

SEQ ID NO: 336194 - DNA, 25 bp, Homo sapien
gggtacaccaaatcaggtattcctg

SEQ ID NO: 336195 - DNA, 25 bp, Homo sapien
tggtcttgtgcactttaatttctgt

SEQ ID NO: 336196 - DNA, 25 bp, Homo sapien
ttaacacttactgcagaaatgtctg

SEQ ID NO: 336197 - DNA, 25 bp, Homo sapien
ttccaaactattgtgatgctcatgc

SEQ ID NO: 336198 - DNA, 25 bp, Homo sapien
tgctcatgcttgacttcccaaggaa

SEQ ID NO: 336199 - DNA, 25 bp, Homo sapien
ggatgtggcacgaagctgcatctgc

SEQ ID NO: 336200 - DNA, 25 bp, Homo sapien
ttttttcttaatgccctacttcgtg

SEQ ID NO: 336201 - DNA, 25 bp, Homo sapien
ttaatgccctacttcgtgcaacata

SEQ ID NO: 336202 - DNA, 25 bp, Homo sapien
ttcgtgcaacatacatccaatcagt

SEQ ID NO: 336203 - DNA, 25 bp, Homo sapien
tacatccaatcagtcatatcctatt

SEQ ID NO: 336204 - DNA, 25 bp, Homo sapien
atatcctattgacgctacccctaaa

SEQ ID NO: 336205 - DNA, 25 bp, Homo sapien
tacccctaaatatctctgggcctgg

SEQ ID NO: 336206 - DNA, 25 bp, Homo sapien
aactggaaactcacttgctgggtgc

SEQ ID NO: 336207 - DNA, 25 bp, Homo sapien
ctgggtgcagatagcttccaaacta

SEQ ID NO: 336208 - DNA, 25 bp, Homo sapien
agaagctctccacccacttggtatt

SEQ ID NO: 336209 - DNA, 25 bp, Homo sapien
tctccacccacttggtatttcaaga

SEQ ID NO: 336210 - DNA, 25 bp, Homo sapien
gatttgtatgttaaagtgactgcac

SEQ ID NO: 336211 - DNA, 25 bp, Homo sapien
gtgactgcacaagtaaaagtccaat

SEQ ID NO: 336212 - DNA, 25 bp, Homo sapien
aaaagtccaatgttgtgtgcatgaa

SEQ ID NO: 336213 - DNA, 25 bp, Homo sapien
gttgtgtgcatgaaaaggattcctt

SEQ ID NO: 336214 - DNA, 25 bp, Homo sapien
aggattccttggttatgtgcaggga

SEQ ID NO: 336215 - DNA, 25 bp, Homo sapien
gtgcagggaatcatctcacatgctg

SEQ ID NO: 336216 - DNA, 25 bp, Homo sapien
ggaatcatctcacatgctgtttttc

SEQ ID NO: 336217 - DNA, 25 bp, Homo sapien
agaaacaggctgacactattctctt

SEQ ID NO: 336218 - DNA, 25 bp, Homo sapien
gacactattctctttgattagaaaa

SEQ ID NO: 336219 - DNA, 25 bp, Homo sapien
tggtctcgcaagttgtaaagaggac

SEQ ID NO: 336220 - DNA, 25 bp, Homo sapien
aggacagtcgcaattttgctggact

SEQ ID NO: 336221 - DNA, 25 bp, Homo sapien
ttgctggacttcaacctgggtagaa

SEQ ID NO: 336222 - DNA, 25 bp, Homo sapien
gagggaactctgtcactgaatcacg

SEQ ID NO: 336223 - DNA, 25 bp, Homo sapien
gtcactgaatcacggcagagttcaa

SEQ ID NO: 336224 - DNA, 25 bp, Homo sapien
agagttcaaggccacttgtagacta

SEQ ID NO: 336225 - DNA, 25 bp, Homo sapien
ggccacttgtagactatttcatgtt

SEQ ID NO: 336226 - DNA, 25 bp, Homo sapien
ttcatgttacagaaggtagccttta

SEQ ID NO: 336227 - DNA, 25 bp, Homo sapien
gaggagccatctcactattgactgg

SEQ ID NO: 336228 - DNA, 25 bp, Homo sapien
atctcactattgactggctagtgcc

SEQ ID NO: 336229 - DNA, 25 bp, Homo sapien
tggctagtgccaggtatggccacca

SEQ ID NO: 336230 - DNA, 25 bp, Homo sapien
cctgtcataggaacatgcttatata

SEQ ID NO: 336231 - DNA, 25 bp, Homo sapien
tataaacatagtcacctgtccttga

SEQ ID NO: 336232 - DNA, 25 bp, Homo sapien
cacctgtccttgactatcaccaggg

SEQ ID NO: 336233 - DNA, 25 bp, Homo sapien
atcaccagggctgtcagttgattct

SEQ ID NO: 336234 - DNA, 25 bp, Homo sapien
ctgtcagttgattctgggctcctgg

SEQ ID NO: 336235 - DNA, 25 bp, Homo sapien
gtgttaagttttgaggcatgtgcca

SEQ ID NO: 336236 - DNA, 25 bp, Homo sapien
gccataggtgatgtgtcctgctaac

SEQ ID NO: 336237 - DNA, 25 bp, Homo sapien
gatgctgctccaaaaagtcagttga

SEQ ID NO: 336238 - DNA, 25 bp, Homo sapien
aagtcagttgatatgacacagtcac

SEQ ID NO: 336239 - DNA, 25 bp, Homo sapien
gatatgacacagtcacagacagaac

SEQ ID NO: 336240 - DNA, 25 bp, Homo sapien
gggacattcctgtcataggaacatg

SEQ ID NO: 336241 - DNA, 25 bp, Homo sapien
ccaacgtgcagcggctgaaggagta

SEQ ID NO: 336242 - DNA, 25 bp, Homo sapien
caagaagggagacagttctgctgaa

SEQ ID NO: 336243 - DNA, 25 bp, Homo sapien
agggagacagttctgctgaagaact

SEQ ID NO: 336244 - DNA, 25 bp, Homo sapien
ggccacccagctgaccggaccggtc

SEQ ID NO: 336245 - DNA, 25 bp, Homo sapien
ctgaccggaccggtcatgcccgtcc

SEQ ID NO: 336246 - DNA, 25 bp, Homo sapien
cgtccggaacgtctataagaaggag

SEQ ID NO: 336247 - DNA, 25 bp, Homo sapien
cgtctataagaaggagaaagctcga

SEQ ID NO: 336248 - DNA, 25 bp, Homo sapien
agctcgagtcatcactgaggaagag

SEQ ID NO: 336249 - DNA, 25 bp, Homo sapien
ccaaggaagccgcagaacaggatgt

SEQ ID NO: 336250 - DNA, 25 bp, Homo sapien
aaggaagccgcagaacaggatgttg

SEQ ID NO: 336251 - DNA, 25 bp, Homo sapien
agccgcagaacaggatgttgaaaag

SEQ ID NO: 336252 - DNA, 25 bp, Homo sapien
aggcttatctccacactgtaatggt

SEQ ID NO: 336253 - DNA, 25 bp, Homo sapien
ggatattcatctagcatggaaggga

SEQ ID NO: 336254 - DNA, 25 bp, Homo sapien
agggttcggatgttgcctgcactga

SEQ ID NO: 336255 - DNA, 25 bp, Homo sapien
ctgcactgaaggcatttgtaatcat

SEQ ID NO: 336256 - DNA, 25 bp, Homo sapien
atgatgaacacggtaggctcacatt

SEQ ID NO: 336257 - DNA, 25 bp, Homo sapien
gtaggctcacattaagtttcccagt

SEQ ID NO: 336258 - DNA, 25 bp, Homo sapien
gtttcccagttatttctactacatg

SEQ ID NO: 336259 - DNA, 25 bp, Homo sapien
gttatttctactacatggctgactt

SEQ ID NO: 336260 - DNA, 25 bp, Homo sapien
aaggattattgatttctgcaggtga

SEQ ID NO: 336261 - DNA, 25 bp, Homo sapien
gatttctgcaggtgatgactcttgt

SEQ ID NO: 336262 - DNA, 25 bp, Homo sapien
gactcttgtgttcatcactgtgaag

SEQ ID NO: 336263 - DNA, 25 bp, Homo sapien
aacagcagcgctgttagtgagctaa

SEQ ID NO: 336264 - DNA, 25 bp, Homo sapien
gtaagcactgacttcgtagaaaacc

SEQ ID NO: 336265 - DNA, 25 bp, Homo sapien
gaaaaccataacatcggccatcttg

SEQ ID NO: 336266 - DNA, 25 bp, Homo sapien
gaaagaaagttatctcttcccagga

SEQ ID NO: 336267 - DNA, 25 bp, Homo sapien
gttatctcttcccaggagaggctag

SEQ ID NO: 336268 - DNA, 25 bp, Homo sapien
cttcccaggagaggctagaagtagc

SEQ ID NO: 336269 - DNA, 25 bp, Homo sapien
aggctagaagtagcttttctgtctt

SEQ ID NO: 336270 - DNA, 25 bp, Homo sapien
gtcttttggccagtgccgagtggaa

SEQ ID NO: 336271 - DNA, 25 bp, Homo sapien
cagtgccgagtggaatgcctggttt

SEQ ID NO: 336272 - DNA, 25 bp, Homo sapien
aggagggactgggttcagctgtggt

SEQ ID NO: 336273 - DNA, 25 bp, Homo sapien
acattgaaaatcctgccacagcagc

SEQ ID NO: 336274 - DNA, 25 bp, Homo sapien
aggctgcccggctgacaagtaccta

SEQ ID NO: 336275 - DNA, 25 bp, Homo sapien
cggctgacaagtacctaaagcaggt

SEQ ID NO: 336276 - DNA, 25 bp, Homo sapien
aaagcaggtagacttcagccgctat

SEQ ID NO: 336277 - DNA, 25 bp, Homo sapien
aggtagacttcagccgctatgactt

SEQ ID NO: 336278 - DNA, 25 bp, Homo sapien
tcagccgctatgacttcttcctgct

SEQ ID NO: 336279 - DNA, 25 bp, Homo sapien
ctggccgctgagatcctgtgccagg

SEQ ID NO: 336280 - DNA, 25 bp, Homo sapien
tgtgccagggcaagaagttctactt

SEQ ID NO: 336281 - DNA, 25 bp, Homo sapien
agaagttctactttgtgcgcaccaa

SEQ ID NO: 336282 - DNA, 25 bp, Homo sapien
ctactttgtgcgcaccaaggtggac

SEQ ID NO: 336283 - DNA, 25 bp, Homo sapien
tgcgcaccaaggtggacgaggacct

SEQ ID NO: 336284 - DNA, 25 bp, Homo sapien
acccagcggccgtcgggcttcagag

SEQ ID NO: 336285 - DNA, 25 bp, Homo sapien
ggagtagaagattctttggagagtt

SEQ ID NO: 336286 - DNA, 25 bp, Homo sapien
agattctttggagagttataattac

SEQ ID NO: 336287 - DNA, 25 bp, Homo sapien
tcttgaaaaaattatggcttatttg

SEQ ID NO: 336288 - DNA, 25 bp, Homo sapien
aattactttatttcattcctattgt

SEQ ID NO: 336289 - DNA, 25 bp, Homo sapien
actttatttcattcctattgtattc

SEQ ID NO: 336290 - DNA, 25 bp, Homo sapien
atgtgataaattgttgctgtgtcag

SEQ ID NO: 336291 - DNA, 25 bp, Homo sapien
taaattgttgctgtgtcagatatag

SEQ ID NO: 336292 - DNA, 25 bp, Homo sapien
aaattgttgctgtgtcagatatagg

SEQ ID NO: 336293 - DNA, 25 bp, Homo sapien
attgttgctgtgtcagatataggag

SEQ ID NO: 336294 - DNA, 25 bp, Homo sapien
ttgttgctgtgtcagatataggaga

SEQ ID NO: 336295 - DNA, 25 bp, Homo sapien
cagatataggagagattctttttta

SEQ ID NO: 336296 - DNA, 25 bp, Homo sapien
aggcttatctccacactgtaatggt

SEQ ID NO: 336297 - DNA, 25 bp, Homo sapien
atctccacactgtaatggtagtgat

SEQ ID NO: 336298 - DNA, 25 bp, Homo sapien
ggatattcatctagcatggaaggga

SEQ ID NO: 336299 - DNA, 25 bp, Homo sapien
atggaagggagtgaaacaggttctc

SEQ ID NO: 336300 - DNA, 25 bp, Homo sapien
ttctcgggagggttcggatgttgcc

SEQ ID NO: 336301 - DNA, 25 bp, Homo sapien
atgttgcctgcactgaaggcatttg

SEQ ID NO: 336302 - DNA, 25 bp, Homo sapien
ctgcactgaaggcatttgtaatcat

SEQ ID NO: 336303 - DNA, 25 bp, Homo sapien
catttgtaatcatgatgaacacggt

SEQ ID NO: 336304 - DNA, 25 bp, Homo sapien
actcttgtgttcatcactgtgaaga

SEQ ID NO: 336305 - DNA, 25 bp, Homo sapien
gatgatggtgatagttgtgttgaat

SEQ ID NO: 336306 - DNA, 25 bp, Homo sapien
gatagttgtgttgaatgttgggcaa

SEQ ID NO: 336307 - DNA, 25 bp, Homo sapien
agaggctagaagtagcttttctgtc

SEQ ID NO: 336308 - DNA, 25 bp, Homo sapien
gaggctagaagtagcttttctgtct

SEQ ID NO: 336309 - DNA, 25 bp, Homo sapien
aggctagaagtagcttttctgtctt

SEQ ID NO: 336310 - DNA, 25 bp, Homo sapien
ccagtgccgagtggaatgcctggtt

SEQ ID NO: 336311 - DNA, 25 bp, Homo sapien
cagtgccgagtggaatgcctggttt

SEQ ID NO: 336312 - DNA, 25 bp, Homo sapien
ggaggagggactgggttcagctgtg

SEQ ID NO: 336313 - DNA, 25 bp, Homo sapien
aggagggactgggttcagctgtggt

SEQ ID NO: 336314 - DNA, 25 bp, Homo sapien
ggagggactgggttcagctgtggtg

SEQ ID NO: 336315 - DNA, 25 bp, Homo sapien
gtcccagttccagaaattatattaa

SEQ ID NO: 336316 - DNA, 25 bp, Homo sapien
tcccagttccagaaattatattaat

SEQ ID NO: 336317 - DNA, 25 bp, Homo sapien
cccagttccagaaattatattaatg

SEQ ID NO: 336318 - DNA, 25 bp, Homo sapien
atattaatgcaaggcatgttcacgg

SEQ ID NO: 336319 - DNA, 25 bp, Homo sapien
attaatgcaaggcatgttcacggca

SEQ ID NO: 336320 - DNA, 25 bp, Homo sapien
ttaatgcaaggcatgttcacggcag

SEQ ID NO: 336321 - DNA, 25 bp, Homo sapien
taatgcaaggcatgttcacggcagg

SEQ ID NO: 336322 - DNA, 25 bp, Homo sapien
aatgcaaggcatgttcacggcaggt

SEQ ID NO: 336323 - DNA, 25 bp, Homo sapien
atgcaaggcatgttcacggcaggtg

SEQ ID NO: 336324 - DNA, 25 bp, Homo sapien
caaggcatgttcacggcaggtggta

SEQ ID NO: 336325 - DNA, 25 bp, Homo sapien
aaggcatgttcacggcaggtggtag

SEQ ID NO: 336326 - DNA, 25 bp, Homo sapien
gggctttcttcgttgtagatcagaa

SEQ ID NO: 336327 - DNA, 25 bp, Homo sapien
tcgttgtagatcagaatttcaccag

SEQ ID NO: 336328 - DNA, 25 bp, Homo sapien
ttagatgcaactgttcccatgtctg

SEQ ID NO: 336329 - DNA, 25 bp, Homo sapien
aactgttcccatgtctgagtactta

SEQ ID NO: 336330 - DNA, 25 bp, Homo sapien
gttcccatgtctgagtacttattta

SEQ ID NO: 336331 - DNA, 25 bp, Homo sapien
gaaaggtaaagattggcctgttaga

SEQ ID NO: 336332 - DNA, 25 bp, Homo sapien
gtgagctttggattactggattttt

SEQ ID NO: 336333 - DNA, 25 bp, Homo sapien
tttttaaacacacctggagaggaca

SEQ ID NO: 336334 - DNA, 25 bp, Homo sapien
cctggagaggacatttgaaaacact

SEQ ID NO: 336335 - DNA, 25 bp, Homo sapien
tgttcttaccctcgaaccctgatgt

SEQ ID NO: 336336 - DNA, 25 bp, Homo sapien
gaaccctgatgtggttccattatgt

SEQ ID NO: 336337 - DNA, 25 bp, Homo sapien
aaagatccactattttctgctcaaa

SEQ ID NO: 336338 - DNA, 25 bp, Homo sapien
attttctgctcaaaggtttcgccta

SEQ ID NO: 336339 - DNA, 25 bp, Homo sapien
gtttcgcctacctaaagtggaacat

SEQ ID NO: 336340 - DNA, 25 bp, Homo sapien
aaatctatgtgaccatcactggaca

SEQ ID NO: 336341 - DNA, 25 bp, Homo sapien
catcactggacagctttctctcaaa

SEQ ID NO: 336342 - DNA, 25 bp, Homo sapien
ttctctcaaaactttccttcaacgc

SEQ ID NO: 336343 - DNA, 25 bp, Homo sapien
aaaactttccttcaacgccatggat

SEQ ID NO: 336344 - DNA, 25 bp, Homo sapien
aacgccatggattagcaccagtttt

SEQ ID NO: 336345 - DNA, 25 bp, Homo sapien
tagcaccagttttgtttactttaag

SEQ ID NO: 336346 - DNA, 25 bp, Homo sapien
taaggtacttttcccattcatcatc

SEQ ID NO: 336347 - DNA, 25 bp, Homo sapien
ttcccattcatcatctggttataat

SEQ ID NO: 336348 - DNA, 25 bp, Homo sapien
attttgccataattgtacgacctgt

SEQ ID NO: 336349 - DNA, 25 bp, Homo sapien
tacgacctgttgtaattgctcctca

SEQ ID NO: 336350 - DNA, 25 bp, Homo sapien
ttgctcctcatgtccgtgaaacaag

SEQ ID NO: 336351 - DNA, 25 bp, Homo sapien
agtatgatcctgtcgataccttgcc

SEQ ID NO: 336352 - DNA, 25 bp, Homo sapien
gataccttgccgtaggttatgtaac

SEQ ID NO: 336353 - DNA, 25 bp, Homo sapien
atgattggagcgcaaccagctgttc

SEQ ID NO: 336354 - DNA, 25 bp, Homo sapien
gctgttctcttgcacagatcgagag

SEQ ID NO: 336355 - DNA, 25 bp, Homo sapien
tgacattacacagcatcaggagcct

SEQ ID NO: 336356 - DNA, 25 bp, Homo sapien
atcaggagcctggtgcctcatcagg

SEQ ID NO: 336357 - DNA, 25 bp, Homo sapien
ggtgcctcatcaggtgtaagttctt

SEQ ID NO: 336358 - DNA, 25 bp, Homo sapien
gtaagttcttataaccactcttggc

SEQ ID NO: 336359 - DNA, 25 bp, Homo sapien
gacttccagtgcgttgtgggcttcg

SEQ ID NO: 336360 - DNA, 25 bp, Homo sapien
cagcgaccaggccaagtatctaaac

SEQ ID NO: 336361 - DNA, 25 bp, Homo sapien
ggccaagtatctaaaccccttactg

SEQ ID NO: 336362 - DNA, 25 bp, Homo sapien
tctaaaccccttactgggagagtgg

SEQ ID NO: 336363 - DNA, 25 bp, Homo sapien
gagtggaagcacttcactgcctccc

SEQ ID NO: 336364 - DNA, 25 bp, Homo sapien
gcatgtccaaccagggcatcgcggt

SEQ ID NO: 336365 - DNA, 25 bp, Homo sapien
agctggaccccagccctttgaggga

SEQ ID NO: 336366 - DNA, 25 bp, Homo sapien
tttgagggacacagtggccagcgcc

SEQ ID NO: 336367 - DNA, 25 bp, Homo sapien
atgtaccaccggaacgagagcctac

SEQ ID NO: 336368 - DNA, 25 bp, Homo sapien
tgcagagcccgcaaacggagctgcg

SEQ ID NO: 336369 - DNA, 25 bp, Homo sapien
aacggagctgcggtcggacttccag

SEQ ID NO: 336370 - DNA, 25 bp, Homo sapien
aggaaaagcgctccctctaccggcg

SEQ ID NO: 336371 - DNA, 25 bp, Homo sapien
cggtgctggtttttcgctcgtcgac

SEQ ID NO: 336372 - DNA, 25 bp, Homo sapien
gtgctggtttttcgctcgtcgactg

SEQ ID NO: 336373 - DNA, 25 bp, Homo sapien
gaccgtggcgcttcgagagattcgt

SEQ ID NO: 336374 - DNA, 25 bp, Homo sapien
ggcgcttcgagagattcgtcgttat

SEQ ID NO: 336375 - DNA, 25 bp, Homo sapien
gagagattcgtcgttatcagaagtc

SEQ ID NO: 336376 - DNA, 25 bp, Homo sapien
tggtttttcgctcgtcgactgcggc

SEQ ID NO: 336377 - DNA, 25 bp, Homo sapien
ttttcgctcgtcgactgcggctctt

SEQ ID NO: 336378 - DNA, 25 bp, Homo sapien
tcttcctcgggcagcggaagcggcg

SEQ ID NO: 336379 - DNA, 25 bp, Homo sapien
gagaagtggcctaaaacttcggcgt

SEQ ID NO: 336380 - DNA, 25 bp, Homo sapien
gaagtggcctaaaacttcggcgttg

SEQ ID NO: 336381 - DNA, 25 bp, Homo sapien
gatggtggcgctgggctcggggtga

SEQ ID NO: 336382 - DNA, 25 bp, Homo sapien
tggcgctgggctcggggtgactaca

SEQ ID NO: 336383 - DNA, 25 bp, Homo sapien
tgactacaggagacgacggggcctt

SEQ ID NO: 336384 - DNA, 25 bp, Homo sapien
gactacaggagacgacggggccttt

SEQ ID NO: 336385 - DNA, 25 bp, Homo sapien
tttcccttcgccaggacccgacaca

SEQ ID NO: 336386 - DNA, 25 bp, Homo sapien
tcgccaggacccgacacaccaggct

SEQ ID NO: 336387 - DNA, 25 bp, Homo sapien
aggacccgacacaccaggcttcgct

SEQ ID NO: 336388 - DNA, 25 bp, Homo sapien
gacccgacacaccaggcttcgctcg

SEQ ID NO: 336389 - DNA, 25 bp, Homo sapien
cgacacaccaggcttcgctcgctcg

SEQ ID NO: 336390 - DNA, 25 bp, Homo sapien
acacaccaggcttcgctcgctcgcg

SEQ ID NO: 336391 - DNA, 25 bp, Homo sapien
aggcttcgctcgctcgcgcacccct

SEQ ID NO: 336392 - DNA, 25 bp, Homo sapien
gacatcaagttatgtgtagcttcac

SEQ ID NO: 336393 - DNA, 25 bp, Homo sapien
gtgtagcttcacaatggttcaagtg

SEQ ID NO: 336394 - DNA, 25 bp, Homo sapien
ggttcaagtggcttacttcaagaaa

SEQ ID NO: 336395 - DNA, 25 bp, Homo sapien
aaatcttatacttgacagtacacca

SEQ ID NO: 336396 - DNA, 25 bp, Homo sapien
gacagtacaccaattttattgacta

SEQ ID NO: 336397 - DNA, 25 bp, Homo sapien
atggatgaactttcctaaagattca

SEQ ID NO: 336398 - DNA, 25 bp, Homo sapien
ttcaaagggcccatcttagtatcac

SEQ ID NO: 336399 - DNA, 25 bp, Homo sapien
tagtatcacgcagctgactgagccc

SEQ ID NO: 336400 - DNA, 25 bp, Homo sapien
ctgagcccttcaaaactgacatctt

SEQ ID NO: 336401 - DNA, 25 bp, Homo sapien
ttaaggcccaatcaagatccacata

SEQ ID NO: 336402 - DNA, 25 bp, Homo sapien
gatccacatatcctgattttgaact

SEQ ID NO: 336403 - DNA, 25 bp, Homo sapien
aggaagaattaagacgcatggaaga

SEQ ID NO: 336404 - DNA, 25 bp, Homo sapien
aagagatgatgattcgtcaacgtga

SEQ ID NO: 336405 - DNA, 25 bp, Homo sapien
attcgtcaacgtgagatggaagaac

SEQ ID NO: 336406 - DNA, 25 bp, Homo sapien
ggaagaacaaatgaggcgccaaaga

SEQ ID NO: 336407 - DNA, 25 bp, Homo sapien
aaagttacagccgaatgggctacat

SEQ ID NO: 336408 - DNA, 25 bp, Homo sapien
aatgggctacatggatccacgggaa

SEQ ID NO: 336409 - DNA, 25 bp, Homo sapien
gatccacgggaaagagacatgcgaa

SEQ ID NO: 336410 - DNA, 25 bp, Homo sapien
aatgaacatgggagatccctatggt

SEQ ID NO: 336411 - DNA, 25 bp, Homo sapien
gatccctatggttcaggaggccaga

SEQ ID NO: 336412 - DNA, 25 bp, Homo sapien
ggaggccagaaatttccacctctag

SEQ ID NO: 336413 - DNA, 25 bp, Homo sapien
ccagaaatttccacctctaggaggt

SEQ ID NO: 336414 - DNA, 25 bp, Homo sapien
gaagaagatgcatacgaacgaagaa

SEQ ID NO: 336415 - DNA, 25 bp, Homo sapien
gatgcatacgaacgaagaaaacttg

SEQ ID NO: 336416 - DNA, 25 bp, Homo sapien
cttgaaagaaaactccgagagaaag

SEQ ID NO: 336417 - DNA, 25 bp, Homo sapien
agaagctgcttatcaagagcgcctt

SEQ ID NO: 336418 - DNA, 25 bp, Homo sapien
aagctgcttatcaagagcgccttaa

SEQ ID NO: 336419 - DNA, 25 bp, Homo sapien
gctgcttatcaagagcgccttaaga

SEQ ID NO: 336420 - DNA, 25 bp, Homo sapien
tgcttatcaagagcgccttaagaat

SEQ ID NO: 336421 - DNA, 25 bp, Homo sapien
tcaagagcgccttaagaattgggaa

SEQ ID NO: 336422 - DNA, 25 bp, Homo sapien
agagcgccttaagaattgggaaatc

SEQ ID NO: 336423 - DNA, 25 bp, Homo sapien
gcgccttaagaattgggaaatcaga

SEQ ID NO: 336424 - DNA, 25 bp, Homo sapien
agaattgggaaatcagagaacgaaa

SEQ ID NO: 336425 - DNA, 25 bp, Homo sapien
gaattagcactttgactctcactta

SEQ ID NO: 336426 - DNA, 25 bp, Homo sapien
attagcactttgactctcacttaat

SEQ ID NO: 336427 - DNA, 25 bp, Homo sapien
agcactttgactctcacttaattca

SEQ ID NO: 336428 - DNA, 25 bp, Homo sapien
gactctcacttaattcaacgatttt

SEQ ID NO: 336429 - DNA, 25 bp, Homo sapien
caacgattttctttcctagattggc

SEQ ID NO: 336430 - DNA, 25 bp, Homo sapien
cgattttctttcctagattggcttt

SEQ ID NO: 336431 - DNA, 25 bp, Homo sapien
cctagattggcttttcttactcttt

SEQ ID NO: 336432 - DNA, 25 bp, Homo sapien
tatttataaacaccacaagaagatc

SEQ ID NO: 336433 - DNA, 25 bp, Homo sapien
aacaccacaagaagatctcttggga

SEQ ID NO: 336434 - DNA, 25 bp, Homo sapien
cacaagaagatctcttgggatcaga

SEQ ID NO: 336435 - DNA, 25 bp, Homo sapien
atgaccactgaagattcattctgat

SEQ ID NO: 336436 - DNA, 25 bp, Homo sapien
ggaggccgacaacagctgcatctat

SEQ ID NO: 336437 - DNA, 25 bp, Homo sapien
ggccgacaacagctgcatctatgtc

SEQ ID NO: 336438 - DNA, 25 bp, Homo sapien
gccgacaacagctgcatctatgtca

SEQ ID NO: 336439 - DNA, 25 bp, Homo sapien
ccgacaacagctgcatctatgtcaa

SEQ ID NO: 336440 - DNA, 25 bp, Homo sapien
cgacaacagctgcatctatgtcaac

SEQ ID NO: 336441 - DNA, 25 bp, Homo sapien
gacaacagctgcatctatgtcaaca

SEQ ID NO: 336442 - DNA, 25 bp, Homo sapien
acaacagctgcatctatgtcaacaa

SEQ ID NO: 336443 - DNA, 25 bp, Homo sapien
acagccccacactgcggccaccgct

SEQ ID NO: 336444 - DNA, 25 bp, Homo sapien
cagccccacactgcggccaccgctg

SEQ ID NO: 336445 - DNA, 25 bp, Homo sapien
gccccacactgcggccaccgctgga

SEQ ID NO: 336446 - DNA, 25 bp, Homo sapien
ccacactgcggccaccgctggaccg

SEQ ID NO: 336447 - DNA, 25 bp, Homo sapien
tcagatttcttctttgccacccttt

SEQ ID NO: 336448 - DNA, 25 bp, Homo sapien
gtgaattttttggtcctctaatttg

SEQ ID NO: 336449 - DNA, 25 bp, Homo sapien
tcctctaatttgttgttgccctgtg

SEQ ID NO: 336450 - DNA, 25 bp, Homo sapien
cctgtgtactcccttggttgtaaag

SEQ ID NO: 336451 - DNA, 25 bp, Homo sapien
ggttgtaaagtcatctgaatccttg

SEQ ID NO: 336452 - DNA, 25 bp, Homo sapien
aatccttggttctctttatactcac

SEQ ID NO: 336453 - DNA, 25 bp, Homo sapien
ggttctctttatactcaccaggtac

SEQ ID NO: 336454 - DNA, 25 bp, Homo sapien
ggtatgttttataagccgcagctac

SEQ ID NO: 336455 - DNA, 25 bp, Homo sapien
tataagccgcagctactgtacacag

SEQ ID NO: 336456 - DNA, 25 bp, Homo sapien
gctactgtacacagcctatctgata

SEQ ID NO: 336457 - DNA, 25 bp, Homo sapien
agcctatctgatataatcttgttct

SEQ ID NO: 336458 - DNA, 25 bp, Homo sapien
cagtagaacactgcgttccagtcac

SEQ ID NO: 336459 - DNA, 25 bp, Homo sapien
gtcaccccggtcttgccagaagaaa

SEQ ID NO: 336460 - DNA, 25 bp, Homo sapien
tttcccgtggctcctgtgttcagaa

SEQ ID NO: 336461 - DNA, 25 bp, Homo sapien
gtggctcctgtgttcagaatgtggt

SEQ ID NO: 336462 - DNA, 25 bp, Homo sapien
ctgtgttcagaatgtggtattggct

SEQ ID NO: 336463 - DNA, 25 bp, Homo sapien
tgttacccataattcttgcctcttt

SEQ ID NO: 336464 - DNA, 25 bp, Homo sapien
tgcctctttccataatccgtggttt

SEQ ID NO: 336465 - DNA, 25 bp, Homo sapien
ctctttccataatccgtggtttcag

SEQ ID NO: 336466 - DNA, 25 bp, Homo sapien
ataatccgtggtttcagtttgactt

SEQ ID NO: 336467 - DNA, 25 bp, Homo sapien
ccgtggtttcagtttgactttgtat

SEQ ID NO: 336468 - DNA, 25 bp, Homo sapien
ggtttcagtttgactttgtatataa

SEQ ID NO: 336469 - DNA, 25 bp, Homo sapien
ggtcccacagtcagtatctctgcgg

SEQ ID NO: 336470 - DNA, 25 bp, Homo sapien
acagtcagtatctctgcgggaacag

SEQ ID NO: 336471 - DNA, 25 bp, Homo sapien
ctctgcgggaacagagtagccgtgt

SEQ ID NO: 336472 - DNA, 25 bp, Homo sapien
agtctaggcatggttggcagtagaa

SEQ ID NO: 336473 - DNA, 25 bp, Homo sapien
gtagaagggtgaactgctgacacat

SEQ ID NO: 336474 - DNA, 25 bp, Homo sapien
aactgctgacacattggctgacctg

SEQ ID NO: 336475 - DNA, 25 bp, Homo sapien
attggctgacctggcactccacaaa

SEQ ID NO: 336476 - DNA, 25 bp, Homo sapien
tggcttacagccacagcgggtgtcg

SEQ ID NO: 336477 - DNA, 25 bp, Homo sapien
agccacagcgggtgtcggccactgc

SEQ ID NO: 336478 - DNA, 25 bp, Homo sapien
tggcagcgggcacattcagaattat

SEQ ID NO: 336479 - DNA, 25 bp, Homo sapien
agaattatggtggttctcccaggcc

SEQ ID NO: 336480 - DNA, 25 bp, Homo sapien
aggttagtgactctgcaggacttca

SEQ ID NO: 336481 - DNA, 25 bp, Homo sapien
acttcacagagagagctgtgcccat

SEQ ID NO: 336482 - DNA, 25 bp, Homo sapien
ctgtgcccatcattcagtccaagtg

SEQ ID NO: 336483 - DNA, 25 bp, Homo sapien
atcattcagtccaagtgctttctct

SEQ ID NO: 336484 - DNA, 25 bp, Homo sapien
ttctctgcccagacagcacagaact

SEQ ID NO: 336485 - DNA, 25 bp, Homo sapien
agccccgctacttacatggatcatc

SEQ ID NO: 336486 - DNA, 25 bp, Homo sapien
atggatcatcgagtttccacctaaa

SEQ ID NO: 336487 - DNA, 25 bp, Homo sapien
gagtcactgttaccaaattagaact

SEQ ID NO: 336488 - DNA, 25 bp, Homo sapien
taaaaagttattgtgactccactta

SEQ ID NO: 336489 - DNA, 25 bp, Homo sapien
ccaacctataccacatccaaaatta

SEQ ID NO: 336490 - DNA, 25 bp, Homo sapien
atgtatctattacagcccctagaag

SEQ ID NO: 336491 - DNA, 25 bp, Homo sapien
ttattagtttcccagagcatggtgt

SEQ ID NO: 336492 - DNA, 25 bp, Homo sapien
agtttcccagagcatggtgttctcg

SEQ ID NO: 336493 - DNA, 25 bp, Homo sapien
agagcatggtgttctcgtgtcgtga

SEQ ID NO: 336494 - DNA, 25 bp, Homo sapien
catggtgttctcgtgtcgtgagcaa

SEQ ID NO: 336495 - DNA, 25 bp, Homo sapien
tctcgtgtcgtgagcaatgtggttt

SEQ ID NO: 336496 - DNA, 25 bp, Homo sapien
gagcaatgtggtttgctaactggat

SEQ ID NO: 336497 - DNA, 25 bp, Homo sapien
gaatgtggatcatagtgatttttcc

SEQ ID NO: 336498 - DNA, 25 bp, Homo sapien
gaggcatatcctaaaaatcctggag

SEQ ID NO: 336499 - DNA, 25 bp, Homo sapien
ctaaaaatcctggagagctgtattt

SEQ ID NO: 336500 - DNA, 25 bp, Homo sapien
gcatttttgcactaattggtcctta

SEQ ID NO: 336501 - DNA, 25 bp, Homo sapien
attggtccttagtttaattctattg

SEQ ID NO: 336502 - DNA, 25 bp, Homo sapien
taaagacagtctggttactgccaaa

SEQ ID NO: 336503 - DNA, 25 bp, Homo sapien
ggttactgccaaagatatgctttca

SEQ ID NO: 336504 - DNA, 25 bp, Homo sapien
agatgccttttttcagcagtggagt

SEQ ID NO: 336505 - DNA, 25 bp, Homo sapien
gtctagaccagtagatgtacgcatc

SEQ ID NO: 336506 - DNA, 25 bp, Homo sapien
tgtacgcatctaagtgaattcatca

SEQ ID NO: 336507 - DNA, 25 bp, Homo sapien
caatttccagaaacttcctgacctc

SEQ ID NO: 336508 - DNA, 25 bp, Homo sapien
ttcctgacctccagattgcagcttc

SEQ ID NO: 336509 - DNA, 25 bp, Homo sapien
gattgcagcttcattagtgtgagtt

SEQ ID NO: 336510 - DNA, 25 bp, Homo sapien
gggctggaaacctaacaatttcact

SEQ ID NO: 336511 - DNA, 25 bp, Homo sapien
aacaatttcacttcctagacaactt

SEQ ID NO: 336512 - DNA, 25 bp, Homo sapien
gacaacttgctaaaagtcacctaaa

SEQ ID NO: 336513 - DNA, 25 bp, Homo sapien
atgggtatacagcattaaaacctta

SEQ ID NO: 336514 - DNA, 25 bp, Homo sapien
cagcattaaaaccttagactgattt

SEQ ID NO: 336515 - DNA, 25 bp, Homo sapien
gtagcacttactagcatttctgaag

SEQ ID NO: 336516 - DNA, 25 bp, Homo sapien
gcacttactagcatttctgaaggtt

SEQ ID NO: 336517 - DNA, 25 bp, Homo sapien
tactagcatttctgaaggttggtct

SEQ ID NO: 336518 - DNA, 25 bp, Homo sapien
gcatttctgaaggttggtcttgaga

SEQ ID NO: 336519 - DNA, 25 bp, Homo sapien
tctgaaggttggtcttgagataaga

SEQ ID NO: 336520 - DNA, 25 bp, Homo sapien
aaatgacagttgttgattttctgag

SEQ ID NO: 336521 - DNA, 25 bp, Homo sapien
gacagttgttgattttctgaggtaa

SEQ ID NO: 336522 - DNA, 25 bp, Homo sapien
gttgattttctgaggtaatataccc

SEQ ID NO: 336523 - DNA, 25 bp, Homo sapien
gattttctgaggtaatatacccaaa

SEQ ID NO: 336524 - DNA, 25 bp, Homo sapien
cttcctaccttgatgccagtaatct

SEQ ID NO: 336525 - DNA, 25 bp, Homo sapien
ctaccttgatgccagtaatctataa

SEQ ID NO: 336526 - DNA, 25 bp, Homo sapien
gccagtaatctataagggatcttta

SEQ ID NO: 336527 - DNA, 25 bp, Homo sapien
aagggatctttatagtttgaatgta

SEQ ID NO: 336528 - DNA, 25 bp, Homo sapien
cttcagtatactttagttctacttt

SEQ ID NO: 336529 - DNA, 25 bp, Homo sapien
tatttgactcacaaccattcttagg

SEQ ID NO: 336530 - DNA, 25 bp, Homo sapien
gactcacaaccattcttaggtctca

SEQ ID NO: 336531 - DNA, 25 bp, Homo sapien
acaaccattcttaggtctcaagtat

SEQ ID NO: 336532 - DNA, 25 bp, Homo sapien
ttcttaggtctcaagtattcccatg

SEQ ID NO: 336533 - DNA, 25 bp, Homo sapien
cttaggtctcaagtattcccatgtg

SEQ ID NO: 336534 - DNA, 25 bp, Homo sapien
tgtgttttaaaagcctgaagtcagt

SEQ ID NO: 336535 - DNA, 25 bp, Homo sapien
agtcttgtcattaaggtgtgtgtaa

SEQ ID NO: 336536 - DNA, 25 bp, Homo sapien
ggttttcttctgactgcacttgttc

SEQ ID NO: 336537 - DNA, 25 bp, Homo sapien
gactgcacttgttctcatagtagta

SEQ ID NO: 336538 - DNA, 25 bp, Homo sapien
atgctatgcgcatttataccttgca

SEQ ID NO: 336539 - DNA, 25 bp, Homo sapien
taccttgcataagtcctcattctac

SEQ ID NO: 336540 - DNA, 25 bp, Homo sapien
attctaccacatgttaaccctctag

SEQ ID NO: 336541 - DNA, 25 bp, Homo sapien
gttaaccctctagctgataatgcaa

SEQ ID NO: 336542 - DNA, 25 bp, Homo sapien
acgagttattcacaccagcatcatc

SEQ ID NO: 336543 - DNA, 25 bp, Homo sapien
caccagcatcatcttaactaacatt

SEQ ID NO: 336544 - DNA, 25 bp, Homo sapien
gaactagttagtgcagcttttcatt

SEQ ID NO: 336545 - DNA, 25 bp, Homo sapien
tttcattgtgttgtgtggttggtct

SEQ ID NO: 336546 - DNA, 25 bp, Homo sapien
cggcccgtaagatccgcagacgtaa

SEQ ID NO: 336547 - DNA, 25 bp, Homo sapien
gtaagatccgcagacgtaaggcccg

SEQ ID NO: 336548 - DNA, 25 bp, Homo sapien
atccgcagacgtaaggcccggcaag

SEQ ID NO: 336549 - DNA, 25 bp, Homo sapien
taaggcccggcaagccaaggcgcgc

SEQ ID NO: 336550 - DNA, 25 bp, Homo sapien
aggagctcagggtggccggcattca

SEQ ID NO: 336551 - DNA, 25 bp, Homo sapien
ccggcattcacaagaaggtggcccg

SEQ ID NO: 336552 - DNA, 25 bp, Homo sapien
aaggtggcccggaccatcggcattt

SEQ ID NO: 336553 - DNA, 25 bp, Homo sapien
ggaccatcggcatttctgtggatcc

SEQ ID NO: 336554 - DNA, 25 bp, Homo sapien
atcggcatttctgtggatccgagga

SEQ ID NO: 336555 - DNA, 25 bp, Homo sapien
tccgaggaggcggaacaagtccacg

SEQ ID NO: 336556 - DNA, 25 bp, Homo sapien
aacaagtccacggagtccctgcagg

SEQ ID NO: 336557 - DNA, 25 bp, Homo sapien
gctttcatttaatatggctgtctgg

SEQ ID NO: 336558 - DNA, 25 bp, Homo sapien
tgtctgggaagaacagggttgccta

SEQ ID NO: 336559 - DNA, 25 bp, Homo sapien
gttgcctagccctgtacaatgtaat

SEQ ID NO: 336560 - DNA, 25 bp, Homo sapien
actgtgtatgatatggtgtcctctg

SEQ ID NO: 336561 - DNA, 25 bp, Homo sapien
ctctgtgccagttttgtaccttata

SEQ ID NO: 336562 - DNA, 25 bp, Homo sapien
tgtaccttatagaggcagattgcct

SEQ ID NO: 336563 - DNA, 25 bp, Homo sapien
aggcagattgcctccgatcgctgtg

SEQ ID NO: 336564 - DNA, 25 bp, Homo sapien
cgatcgctgtggttcttattatcaa

SEQ ID NO: 336565 - DNA, 25 bp, Homo sapien
tatacggaacaaccacaagaaattt

SEQ ID NO: 336566 - DNA, 25 bp, Homo sapien
aagaatcctctttagctgtggcctg

SEQ ID NO: 336567 - DNA, 25 bp, Homo sapien
gtggcctggcagtatataaatggtg

SEQ ID NO: 336568 - DNA, 25 bp, Homo sapien
tgaggaagcgacaaaggccccttct

SEQ ID NO: 336569 - DNA, 25 bp, Homo sapien
gagacttcacgccaatggagcacca

SEQ ID NO: 336570 - DNA, 25 bp, Homo sapien
tgtcctcgcaatagcccgagtgcag

SEQ ID NO: 336571 - DNA, 25 bp, Homo sapien
gcaggcagaacgcagtcatttgtgt

SEQ ID NO: 336572 - DNA, 25 bp, Homo sapien
tataaatagtttcaggccccgctgc

SEQ ID NO: 336573 - DNA, 25 bp, Homo sapien
tcctgattgagctgcttccgggcgg

SEQ ID NO: 336574 - DNA, 25 bp, Homo sapien
ttccgggcgggctttcttcttgttg

SEQ ID NO: 336575 - DNA, 25 bp, Homo sapien
tcttgttggcggtcccatgctgtgt

SEQ ID NO: 336576 - DNA, 25 bp, Homo sapien
gctgtgttcagatgggctctgtgac

SEQ ID NO: 336577 - DNA, 25 bp, Homo sapien
ggctctgtgacaggtttggatgttt

SEQ ID NO: 336578 - DNA, 25 bp, Homo sapien
ttggatgttttctatcactgaataa

SEQ ID NO: 336579 - DNA, 25 bp, Homo sapien
agaagtgtgatgtggtatgattacc

SEQ ID NO: 336580 - DNA, 25 bp, Homo sapien
ctagaagtcttgtgatgaaaatggc

SEQ ID NO: 336581 - DNA, 25 bp, Homo sapien
cttttacaagggaacagggcatcct

SEQ ID NO: 336582 - DNA, 25 bp, Homo sapien
gcatcctgaattttagagcctttca

SEQ ID NO: 336583 - DNA, 25 bp, Homo sapien
tgttggtgagctttgatcctctttt

SEQ ID NO: 336584 - DNA, 25 bp, Homo sapien
tgatcctcttttggttttgcagttg

SEQ ID NO: 336585 - DNA, 25 bp, Homo sapien
gttgttaggagtttttgctggcatt

SEQ ID NO: 336586 - DNA, 25 bp, Homo sapien
tgctggcattttgaatatgctgctt

SEQ ID NO: 336587 - DNA, 25 bp, Homo sapien
ttttccactgaagttgaaggttaat

SEQ ID NO: 336588 - DNA, 25 bp, Homo sapien
taaaatggtgtcaaacgtcccctgg

SEQ ID NO: 336589 - DNA, 25 bp, Homo sapien
tggtgtcaaacgtcccctggtcaca

SEQ ID NO: 336590 - DNA, 25 bp, Homo sapien
gtaggtatctttcaggtcgtgataa

SEQ ID NO: 336591 - DNA, 25 bp, Homo sapien
ggtcgtgataatgagctcctatgaa

SEQ ID NO: 336592 - DNA, 25 bp, Homo sapien
gcaatataatgacccgcttttctag

SEQ ID NO: 336593 - DNA, 25 bp, Homo sapien
agaaagttcataatcagctctggaa

SEQ ID NO: 336594 - DNA, 25 bp, Homo sapien
ctctggaacaagcacacttgattcc

SEQ ID NO: 336595 - DNA, 25 bp, Homo sapien
gattcctcactgtgcttcagaatga

SEQ ID NO: 336596 - DNA, 25 bp, Homo sapien
agatgttggaacgtgctatgctgta

SEQ ID NO: 336597 - DNA, 25 bp, Homo sapien
ctatgctgtagcgtgtctggaaaca

SEQ ID NO: 336598 - DNA, 25 bp, Homo sapien
agtacacaaacctggctacggtgat

SEQ ID NO: 336599 - DNA, 25 bp, Homo sapien
tacggtgatgagttagcttctgctt

SEQ ID NO: 336600 - DNA, 25 bp, Homo sapien
atgagttagcttctgcttactacct

SEQ ID NO: 336601 - DNA, 25 bp, Homo sapien
taccatggctcgtacaaagcagact

SEQ ID NO: 336602 - DNA, 25 bp, Homo sapien
gtacaaagcagactgcccgcaaatc

SEQ ID NO: 336603 - DNA, 25 bp, Homo sapien
tgcccgcaaatcgaccggtggtaaa

SEQ ID NO: 336604 - DNA, 25 bp, Homo sapien
tcgaccggtggtaaagcacccagga

SEQ ID NO: 336605 - DNA, 25 bp, Homo sapien
aactggctacaaaagccgctcgcaa

SEQ ID NO: 336606 - DNA, 25 bp, Homo sapien
aaagccgctcgcaagagtgcgccct

SEQ ID NO: 336607 - DNA, 25 bp, Homo sapien
gaagaaacctcatcgttacaggcct

SEQ ID NO: 336608 - DNA, 25 bp, Homo sapien
aacctcatcgttacaggcctggtac

SEQ ID NO: 336609 - DNA, 25 bp, Homo sapien
ggtactgtggcgctccgtgaaatta

SEQ ID NO: 336610 - DNA, 25 bp, Homo sapien
ggcgctccgtgaaattagacgttat

SEQ ID NO: 336611 - DNA, 25 bp, Homo sapien
agtccactgaacttctgattcgcaa

SEQ ID NO: 336612 - DNA, 25 bp, Homo sapien
gaaggtggcccggaccatcggcatt

SEQ ID NO: 336613 - DNA, 25 bp, Homo sapien
aggtggcccggaccatcggcatttc

SEQ ID NO: 336614 - DNA, 25 bp, Homo sapien
tggcccggaccatcggcatttctgt

SEQ ID NO: 336615 - DNA, 25 bp, Homo sapien
ccggaccatcggcatttctgtggat

SEQ ID NO: 336616 - DNA, 25 bp, Homo sapien
cggaccatcggcatttctgtggatc

SEQ ID NO: 336617 - DNA, 25 bp, Homo sapien
ggaccatcggcatttctgtggatcc

SEQ ID NO: 336618 - DNA, 25 bp, Homo sapien
accatcggcatttctgtggatccga

SEQ ID NO: 336619 - DNA, 25 bp, Homo sapien
ccatcggcatttctgtggatccgag

SEQ ID NO: 336620 - DNA, 25 bp, Homo sapien
atcggcatttctgtggatccgagga

SEQ ID NO: 336621 - DNA, 25 bp, Homo sapien
tcggcatttctgtggatccgaggag

SEQ ID NO: 336622 - DNA, 25 bp, Homo sapien
ttctgtggatccgaggaggcggaac

SEQ ID NO: 336623 - DNA, 25 bp, Homo sapien
ttaggaattgtatttgttgcctttt

SEQ ID NO: 336624 - DNA, 25 bp, Homo sapien
aatgctagtcagtatgcaccaccac

SEQ ID NO: 336625 - DNA, 25 bp, Homo sapien
accaccacaggaaagttagatccca

SEQ ID NO: 336626 - DNA, 25 bp, Homo sapien
agttagatcccattagcacttgaaa

SEQ ID NO: 336627 - DNA, 25 bp, Homo sapien
gatcccattagcacttgaaactaca

SEQ ID NO: 336628 - DNA, 25 bp, Homo sapien
tggatttgttacttgattcacctac

SEQ ID NO: 336629 - DNA, 25 bp, Homo sapien
ttacttgattcacctactgaccttt

SEQ ID NO: 336630 - DNA, 25 bp, Homo sapien
cttttgtttgaagtgcttatcagca

SEQ ID NO: 336631 - DNA, 25 bp, Homo sapien
agtgcttatcagcataatgagctaa

SEQ ID NO: 336632 - DNA, 25 bp, Homo sapien
gtcatgcatatttgtgaagaaacac

SEQ ID NO: 336633 - DNA, 25 bp, Homo sapien
tactccttgatctttatgaatgaca

SEQ ID NO: 336634 - DNA, 25 bp, Homo sapien
gtaagaatccagtcatgctttctcc

SEQ ID NO: 336635 - DNA, 25 bp, Homo sapien
tttctccttccctgatctcactaag

SEQ ID NO: 336636 - DNA, 25 bp, Homo sapien
gggcttacaaaccagttcttattgc

SEQ ID NO: 336637 - DNA, 25 bp, Homo sapien
aaaccagttcttattgccaagccct

SEQ ID NO: 336638 - DNA, 25 bp, Homo sapien
agttcttattgccaagccctctact

SEQ ID NO: 336639 - DNA, 25 bp, Homo sapien
tactctaccctatcctttcatgaat

SEQ ID NO: 336640 - DNA, 25 bp, Homo sapien
tttcatgaatcggagcctagcctct

SEQ ID NO: 336641 - DNA, 25 bp, Homo sapien
gagcctagcctctgataacataaat

SEQ ID NO: 336642 - DNA, 25 bp, Homo sapien
aagagatgacgttgttaccctgagt

SEQ ID NO: 336643 - DNA, 25 bp, Homo sapien
cgttgttaccctgagtgacagtcac

SEQ ID NO: 336644 - DNA, 25 bp, Homo sapien
gacagtcacgacagaacaaaaccac

SEQ ID NO: 336645 - DNA, 25 bp, Homo sapien
aggatgcggaccaagccccagcgac

SEQ ID NO: 336646 - DNA, 25 bp, Homo sapien
gcgacccagggcaactcggagctac

SEQ ID NO: 336647 - DNA, 25 bp, Homo sapien
agggcaactcggagctacctcgggc

SEQ ID NO: 336648 - DNA, 25 bp, Homo sapien
gcaactcggagctacctcgggcagc

SEQ ID NO: 336649 - DNA, 25 bp, Homo sapien
catgggagagggtggccttttccct

SEQ ID NO: 336650 - DNA, 25 bp, Homo sapien
gagagggtggccttttccctgttca

SEQ ID NO: 336651 - DNA, 25 bp, Homo sapien
gagggtggccttttccctgttcaca

SEQ ID NO: 336652 - DNA, 25 bp, Homo sapien
actggccgggacagttgacacccat

SEQ ID NO: 336653 - DNA, 25 bp, Homo sapien
ggccgggacagttgacacccatctt

SEQ ID NO: 336654 - DNA, 25 bp, Homo sapien
gggacagttgacacccatcttcctt

SEQ ID NO: 336655 - DNA, 25 bp, Homo sapien
ctgctccttccagtcattctacacc

SEQ ID NO: 336656 - DNA, 25 bp, Homo sapien
agaagtgtgatgtggtatgattacc

SEQ ID NO: 336657 - DNA, 25 bp, Homo sapien
aagtgtgatgtggtatgattaccat

SEQ ID NO: 336658 - DNA, 25 bp, Homo sapien
ctagaagtcttgtgatgaaaatggc

SEQ ID NO: 336659 - DNA, 25 bp, Homo sapien
tgaaaatggcacttggaaaaggttt

SEQ ID NO: 336660 - DNA, 25 bp, Homo sapien
ttttccactgaagttgaaggttaat

SEQ ID NO: 336661 - DNA, 25 bp, Homo sapien
tccactgaagttgaaggttaataaa

SEQ ID NO: 336662 - DNA, 25 bp, Homo sapien
taaaatggtgtcaaacgtcccctgg

SEQ ID NO: 336663 - DNA, 25 bp, Homo sapien
aatggtgtcaaacgtcccctggtca

SEQ ID NO: 336664 - DNA, 25 bp, Homo sapien
tggtgtcaaacgtcccctggtcaca

SEQ ID NO: 336665 - DNA, 25 bp, Homo sapien
ggtgtcaaacgtcccctggtcacac

SEQ ID NO: 336666 - DNA, 25 bp, Homo sapien
caaacgtcccctggtcacacacttg

SEQ ID NO: 336667 - DNA, 25 bp, Homo sapien
agcccatgcaggtttcttcgtcgaa

SEQ ID NO: 336668 - DNA, 25 bp, Homo sapien
ccatgcaggtttcttcgtcgaagac

SEQ ID NO: 336669 - DNA, 25 bp, Homo sapien
gacaattttatggttggtcctcagc

SEQ ID NO: 336670 - DNA, 25 bp, Homo sapien
ggttttggcaggtatcgtccccgtg

SEQ ID NO: 336671 - DNA, 25 bp, Homo sapien
agcggcctcgaccttcaaagagaag

SEQ ID NO: 336672 - DNA, 25 bp, Homo sapien
agatgcctgtttttcctcagaccat

SEQ ID NO: 336673 - DNA, 25 bp, Homo sapien
gtttttcctcagaccatactttcca

SEQ ID NO: 336674 - DNA, 25 bp, Homo sapien
accatactttccagtcggatcaatt

SEQ ID NO: 336675 - DNA, 25 bp, Homo sapien
tttccagtcggatcaattctattgc

SEQ ID NO: 336676 - DNA, 25 bp, Homo sapien
attctattgccattcagatgtcccc

SEQ ID NO: 336677 - DNA, 25 bp, Homo sapien
tattgccattcagatgtcccctcat

SEQ ID NO: 336678 - DNA, 25 bp, Homo sapien
agctcacagccacgcgtaagaccaa

SEQ ID NO: 336679 - DNA, 25 bp, Homo sapien
acgcgtaagaccaaaagctgccatg

SEQ ID NO: 336680 - DNA, 25 bp, Homo sapien
cgcgcggagacctcagagccgaaga

SEQ ID NO: 336681 - DNA, 25 bp, Homo sapien
agaagtccccgcgtcagaaacgctg

SEQ ID NO: 336682 - DNA, 25 bp, Homo sapien
aaacgctgcggatgccaggtcttga

SEQ ID NO: 336683 - DNA, 25 bp, Homo sapien
gaaaatgctgacttctgaggctaag

SEQ ID NO: 336684 - DNA, 25 bp, Homo sapien
aaaagactggtgaggaggccttccg

SEQ ID NO: 336685 - DNA, 25 bp, Homo sapien
aggccttccggtgcaagggcgccta

SEQ ID NO: 336686 - DNA, 25 bp, Homo sapien
ggcgcctatccgctaattttggatg

SEQ ID NO: 336687 - DNA, 25 bp, Homo sapien
gtttaaattcaatcgcgagcaccaa

SEQ ID NO: 336688 - DNA, 25 bp, Homo sapien
aatcgcgagcaccaagtcggactgg

SEQ ID NO: 336689 - DNA, 25 bp, Homo sapien
aagactgggtaataatccattatgt

SEQ ID NO: 336690 - DNA, 25 bp, Homo sapien
gttgctattaatatatagtgctgca

SEQ ID NO: 336691 - DNA, 25 bp, Homo sapien
ggagtgccactctcttggacaaact

SEQ ID NO: 336692 - DNA, 25 bp, Homo sapien
gtgccactctcttggacaaactgat

SEQ ID NO: 336693 - DNA, 25 bp, Homo sapien
gccactctcttggacaaactgattt

SEQ ID NO: 336694 - DNA, 25 bp, Homo sapien
gtggtattactgaatctaacatgtc

SEQ ID NO: 336695 - DNA, 25 bp, Homo sapien
tactgaatctaacatgtcttctatt

SEQ ID NO: 336696 - DNA, 25 bp, Homo sapien
ttctatttgacttttggccctatgg

SEQ ID NO: 336697 - DNA, 25 bp, Homo sapien
ttggccctatggtagtaggacatca

SEQ ID NO: 336698 - DNA, 25 bp, Homo sapien
ggtagtaggacatcacagaagttgg

SEQ ID NO: 336699 - DNA, 25 bp, Homo sapien
ggaaagttagcttaagatcatacat

SEQ ID NO: 336700 - DNA, 25 bp, Homo sapien
gtagccatccgccagcgcgggcgcc

SEQ ID NO: 336701 - DNA, 25 bp, Homo sapien
cctacttacgcttcacctctgccga

SEQ ID NO: 336702 - DNA, 25 bp, Homo sapien
aggccaagatggtggcgctgggctc

SEQ ID NO: 336703 - DNA, 25 bp, Homo sapien
gacccggcgcgctcggctgcgggcg

SEQ ID NO: 336704 - DNA, 25 bp, Homo sapien
ttcggctcctcctcggaatagctcg

SEQ ID NO: 336705 - DNA, 25 bp, Homo sapien
tcctcggaatagctcgcggcctgta

SEQ ID NO: 336706 - DNA, 25 bp, Homo sapien
cctcggaatagctcgcggcctgtag

SEQ ID NO: 336707 - DNA, 25 bp, Homo sapien
ctcggaatagctcgcggcctgtagc

SEQ ID NO: 336708 - DNA, 25 bp, Homo sapien
tcggaatagctcgcggcctgtagcc

SEQ ID NO: 336709 - DNA, 25 bp, Homo sapien
atagctcgcggcctgtagcccctgg

SEQ ID NO: 336710 - DNA, 25 bp, Homo sapien
cccggtgtggacaggcagcggcggc

SEQ ID NO: 336711 - DNA, 25 bp, Homo sapien
tgatcccttatccactcatcactaa

SEQ ID NO: 336712 - DNA, 25 bp, Homo sapien
cttatccactcatcactaaggagga

SEQ ID NO: 336713 - DNA, 25 bp, Homo sapien
ccactcatcactaaggaggatataa

SEQ ID NO: 336714 - DNA, 25 bp, Homo sapien
aagagacctgatatctcgagagatc

SEQ ID NO: 336715 - DNA, 25 bp, Homo sapien
atatctcgagagatcagcaaattca

SEQ ID NO: 336716 - DNA, 25 bp, Homo sapien
gggctattgaagttttaattcgtga

SEQ ID NO: 336717 - DNA, 25 bp, Homo sapien
ttaattcgtgaatactccagtgagc

SEQ ID NO: 336718 - DNA, 25 bp, Homo sapien
aatactccagtgagctaaatgcccc

SEQ ID NO: 336719 - DNA, 25 bp, Homo sapien
aatctgattctcaccccaggaagaa

SEQ ID NO: 336720 - DNA, 25 bp, Homo sapien
ggaggacattttccgcagatttcca

SEQ ID NO: 336721 - DNA, 25 bp, Homo sapien
acattttccgcagatttccagtggc

SEQ ID NO: 336722 - DNA, 25 bp, Homo sapien
gttgatgtcggcctccacgctcatg

SEQ ID NO: 336723 - DNA, 25 bp, Homo sapien
acgctcatgcgcagagcctgttccg

SEQ ID NO: 336724 - DNA, 25 bp, Homo sapien
agcctgttccgtctcaaacttggtt

SEQ ID NO: 336725 - DNA, 25 bp, Homo sapien
cgtctcaaacttggttcggaagtca

SEQ ID NO: 336726 - DNA, 25 bp, Homo sapien
agttctcaatggtggcaccaagaat

SEQ ID NO: 336727 - DNA, 25 bp, Homo sapien
gtggcaccaagaatcttgtcccgca

SEQ ID NO: 336728 - DNA, 25 bp, Homo sapien
aatcttgtcccgcaggtcctggatg

SEQ ID NO: 336729 - DNA, 25 bp, Homo sapien
gtcgtgtagtagtggctgtagtcgc

SEQ ID NO: 336730 - DNA, 25 bp, Homo sapien
cttccttcaggccttcgatctgcat

SEQ ID NO: 336731 - DNA, 25 bp, Homo sapien
ttcgatctgcatctccaggtcggtc

SEQ ID NO: 336732 - DNA, 25 bp, Homo sapien
atctccaggtcggtcctggccaggg

SEQ ID NO: 336733 - DNA, 25 bp, Homo sapien
cctgtgaacgaatgatccgggcttt

SEQ ID NO: 336734 - DNA, 25 bp, Homo sapien
gatccgggctttagaattggaccca

SEQ ID NO: 336735 - DNA, 25 bp, Homo sapien
gaattggacccaaacttgtacagaa

SEQ ID NO: 336736 - DNA, 25 bp, Homo sapien
agctggagttctggcacacttagag

SEQ ID NO: 336737 - DNA, 25 bp, Homo sapien
gatatcattatcttcttccaggccg

SEQ ID NO: 336738 - DNA, 25 bp, Homo sapien
ttccaggccgtttgcagaggttacc

SEQ ID NO: 336739 - DNA, 25 bp, Homo sapien
gaagcagcagcaactaagtgcctta

SEQ ID NO: 336740 - DNA, 25 bp, Homo sapien
aaaggtcttgcagcggaactgtgcc

SEQ ID NO: 336741 - DNA, 25 bp, Homo sapien
gaactgtgccgcgtacctgaaatta

SEQ ID NO: 336742 - DNA, 25 bp, Homo sapien
ctgaaattacggcactggcagtggt

SEQ ID NO: 336743 - DNA, 25 bp, Homo sapien
ggcagtggtggcgagtcttcacaaa

SEQ ID NO: 336744 - DNA, 25 bp, Homo sapien
gggcccaggcatactacacttgtgc

SEQ ID NO: 336745 - DNA, 25 bp, Homo sapien
catactacacttgtgctgttcaggg

SEQ ID NO: 336746 - DNA, 25 bp, Homo sapien
gctccgccgagaagcactgatatgc

SEQ ID NO: 336747 - DNA, 25 bp, Homo sapien
gcagagctaagcagctttgtttcca

SEQ ID NO: 336748 - DNA, 25 bp, Homo sapien
tttgtttccacgtggatcctgcgta

SEQ ID NO: 336749 - DNA, 25 bp, Homo sapien
atcctgcgtaggttttcttggtcca

SEQ ID NO: 336750 - DNA, 25 bp, Homo sapien
gttttcttggtccatccgtagacac

SEQ ID NO: 336751 - DNA, 25 bp, Homo sapien
tagacaccgcactcctgcagaggat

SEQ ID NO: 336752 - DNA, 25 bp, Homo sapien
tgcagaggatcttctcgggatgccc

SEQ ID NO: 336753 - DNA, 25 bp, Homo sapien
tgtctctgttttccctcttcactga

SEQ ID NO: 336754 - DNA, 25 bp, Homo sapien
cctcttcactgaacactcagtcggg

SEQ ID NO: 336755 - DNA, 25 bp, Homo sapien
gacaggtgcttggttatcttcaatt

SEQ ID NO: 336756 - DNA, 25 bp, Homo sapien
aatttaatctctacctttcaatggg

SEQ ID NO: 336757 - DNA, 25 bp, Homo sapien
gggctagtgcaagctagggccattt

SEQ ID NO: 336758 - DNA, 25 bp, Homo sapien
tagggccattttactgcacccaaag

SEQ ID NO: 336759 - DNA, 25 bp, Homo sapien
tactgcacccaaaggaatttaagac

SEQ ID NO: 336760 - DNA, 25 bp, Homo sapien
aagacatttctattatctctaaaga

SEQ ID NO: 336761 - DNA, 25 bp, Homo sapien
gaatccagattaacatgccttcttg

SEQ ID NO: 336762 - DNA, 25 bp, Homo sapien
aacatgccttcttggtgggcaggga

SEQ ID NO: 336763 - DNA, 25 bp, Homo sapien
gggagaccagctatgaattctagga

SEQ ID NO: 336764 - DNA, 25 bp, Homo sapien
tctaggatctcaattcaaatgcttt

SEQ ID NO: 336765 - DNA, 25 bp, Homo sapien
atttctttgtagtgatccagaaggc

SEQ ID NO: 336766 - DNA, 25 bp, Homo sapien
cacagttctgaaggctgagtcagcc

SEQ ID NO: 336767 - DNA, 25 bp, Homo sapien
cccactccacagttaggccaagaat

SEQ ID NO: 336768 - DNA, 25 bp, Homo sapien
atctgtctgtcccagttaactgtta

SEQ ID NO: 336769 - DNA, 25 bp, Homo sapien
gcctcatcctccactgaagagtatg

SEQ ID NO: 336770 - DNA, 25 bp, Homo sapien
gtgtgattgtgaacttggtgcctaa

SEQ ID NO: 336771 - DNA, 25 bp, Homo sapien
ggtgcctaatgttccatgtctgaag

SEQ ID NO: 336772 - DNA, 25 bp, Homo sapien
tttgccccagtgctacacgttggag

SEQ ID NO: 336773 - DNA, 25 bp, Homo sapien
gctacacgttggagtatacctatgt

SEQ ID NO: 336774 - DNA, 25 bp, Homo sapien
ctatgtgtgtgctttgccactgaag

SEQ ID NO: 336775 - DNA, 25 bp, Homo sapien
gattttgcctgtatggtactgtttt

SEQ ID NO: 336776 - DNA, 25 bp, Homo sapien
gtttgttaataaagtgcactgccac

SEQ ID NO: 336777 - DNA, 25 bp, Homo sapien
cattttactgttcccctacttgtga

SEQ ID NO: 336778 - DNA, 25 bp, Homo sapien
attcattttagttcttcagggccca

SEQ ID NO: 336779 - DNA, 25 bp, Homo sapien
tcagggcccatctgaaatgccagct

SEQ ID NO: 336780 - DNA, 25 bp, Homo sapien
gcttctctctgaaggttttccttta

SEQ ID NO: 336781 - DNA, 25 bp, Homo sapien
ttttcctttagaccttggctggaag

SEQ ID NO: 336782 - DNA, 25 bp, Homo sapien
ggctggaagatatctctttctcttt

SEQ ID NO: 336783 - DNA, 25 bp, Homo sapien
ttctctttggaaactctataacttg

SEQ ID NO: 336784 - DNA, 25 bp, Homo sapien
gtggtttgcaagtattttatggctt

SEQ ID NO: 336785 - DNA, 25 bp, Homo sapien
catagctgggaagttgactgcatgg

SEQ ID NO: 336786 - DNA, 25 bp, Homo sapien
gactgcatgggttgtcatatctaaa

SEQ ID NO: 336787 - DNA, 25 bp, Homo sapien
agcatgggcgaagttgagatctcag

SEQ ID NO: 336788 - DNA, 25 bp, Homo sapien
caaggagaagaatcatttgtttaca

SEQ ID NO: 336789 - DNA, 25 bp, Homo sapien
ttacaaactgatgagcagatcccag

SEQ ID NO: 336790 - DNA, 25 bp, Homo sapien
tgatgagcagatcccagaccttctc

SEQ ID NO: 336791 - DNA, 25 bp, Homo sapien
agaccttctctaccttcaggaatgg

SEQ ID NO: 336792 - DNA, 25 bp, Homo sapien
gccagggcagagcttgaggtgttct

SEQ ID NO: 336793 - DNA, 25 bp, Homo sapien
gtgcccctccacttgttctggaaaa

SEQ ID NO: 336794 - DNA, 25 bp, Homo sapien
ggaaaactcaccacttgacttcaga

SEQ ID NO: 336795 - DNA, 25 bp, Homo sapien
accacttgacttcagagctttctct

SEQ ID NO: 336796 - DNA, 25 bp, Homo sapien
agctttctctccaaagactaagatg

SEQ ID NO: 336797 - DNA, 25 bp, Homo sapien
agactaagatgaagacgtggcccaa

SEQ ID NO: 336798 - DNA, 25 bp, Homo sapien
taagatgaagacgtggcccaaggta

SEQ ID NO: 336799 - DNA, 25 bp, Homo sapien
tggtcaaagggatacccttcccact

SEQ ID NO: 336800 - DNA, 25 bp, Homo sapien
ttcccactaaggacttggtttctca

SEQ ID NO: 336801 - DNA, 25 bp, Homo sapien
tatgtacagtgcttgctggcagtta

SEQ ID NO: 336802 - DNA, 25 bp, Homo sapien
tgcccaccttaacagacctctaggg

SEQ ID NO: 336803 - DNA, 25 bp, Homo sapien
gtgaggaggtactgcttgtagcata

SEQ ID NO: 336804 - DNA, 25 bp, Homo sapien
gggttcttaacccagcaatcaagtt

SEQ ID NO: 336805 - DNA, 25 bp, Homo sapien
gtttgcctatcctagaggtggcgga

SEQ ID NO: 336806 - DNA, 25 bp, Homo sapien
cttgtagcatatagagcctctccct

SEQ ID NO: 336807 - DNA, 25 bp, Homo sapien
gcctctccctagctttggttatgga

SEQ ID NO: 336808 - DNA, 25 bp, Homo sapien
tggaggctttgaggttttgcaaacc

SEQ ID NO: 336809 - DNA, 25 bp, Homo sapien
gcaaacctgaccaatttaagccata

SEQ ID NO: 336810 - DNA, 25 bp, Homo sapien
gaggctacgtgaagggctgccaaca

SEQ ID NO: 336811 - DNA, 25 bp, Homo sapien
acatcgtcttttcccaaatctccat

SEQ ID NO: 336812 - DNA, 25 bp, Homo sapien
aaatctccatctacgagttgcctca

SEQ ID NO: 336813 - DNA, 25 bp, Homo sapien
tccatctacgagttgcctcaactgt

SEQ ID NO: 336814 - DNA, 25 bp, Homo sapien
caactgtccccgtgatactatatag

SEQ ID NO: 336815 - DNA, 25 bp, Homo sapien
gatactatataggtgcttgcccaac

SEQ ID NO: 336816 - DNA, 25 bp, Homo sapien
aggtgcttgcccaaccacctttaga

SEQ ID NO: 336817 - DNA, 25 bp, Homo sapien
tttagagaagcctcagcaagcctcc

SEQ ID NO: 336818 - DNA, 25 bp, Homo sapien
gcctccctcaactaggacacagaga

SEQ ID NO: 336819 - DNA, 25 bp, Homo sapien
gtgcccactgcggactggatggcaa

SEQ ID NO: 336820 - DNA, 25 bp, Homo sapien
ccactgcggactggatggcaacggc

SEQ ID NO: 336821 - DNA, 25 bp, Homo sapien
ctcttgacaaatgattaccttttaa

SEQ ID NO: 336822 - DNA, 25 bp, Homo sapien
tcttgacaaatgattaccttttaaa

SEQ ID NO: 336823 - DNA, 25 bp, Homo sapien
cttgacaaatgattaccttttaaag

SEQ ID NO: 336824 - DNA, 25 bp, Homo sapien
ttgacaaatgattaccttttaaaga

SEQ ID NO: 336825 - DNA, 25 bp, Homo sapien
tgacaaatgattaccttttaaagaa

SEQ ID NO: 336826 - DNA, 25 bp, Homo sapien
aagaaataaccggccgggcacagtg

SEQ ID NO: 336827 - DNA, 25 bp, Homo sapien
agaaataaccggccgggcacagtgg

SEQ ID NO: 336828 - DNA, 25 bp, Homo sapien
gaaataaccggccgggcacagtggc

SEQ ID NO: 336829 - DNA, 25 bp, Homo sapien
gaccctttcatcctatgcagcttga

SEQ ID NO: 336830 - DNA, 25 bp, Homo sapien
tatgcagcttgatgtggtcttgggt

SEQ ID NO: 336831 - DNA, 25 bp, Homo sapien
gtggagcaactgaaggagcctgtaa

SEQ ID NO: 336832 - DNA, 25 bp, Homo sapien
gaaggagcctgtaatcaccaaagag

SEQ ID NO: 336833 - DNA, 25 bp, Homo sapien
acatgttggttgacaggcgagcaga

SEQ ID NO: 336834 - DNA, 25 bp, Homo sapien
aagggacagcaccagactattctct

SEQ ID NO: 336835 - DNA, 25 bp, Homo sapien
agactattctctgcgtgttgcactg

SEQ ID NO: 336836 - DNA, 25 bp, Homo sapien
tgttgcactgcatagtgaacctgca

SEQ ID NO: 336837 - DNA, 25 bp, Homo sapien
aacctgcagacaattcccgtggatg

SEQ ID NO: 336838 - DNA, 25 bp, Homo sapien
tgccattaaggcattcactaaggtt

SEQ ID NO: 336839 - DNA, 25 bp, Homo sapien
gaaaatggaccaacagtttacaaca

SEQ ID NO: 336840 - DNA, 25 bp, Homo sapien
actaggtttaaaataagtgtgcact

SEQ ID NO: 336841 - DNA, 25 bp, Homo sapien
aagtgtgcacttggacataaagact

SEQ ID NO: 336842 - DNA, 25 bp, Homo sapien
gcacttggacataaagactggagaa

SEQ ID NO: 336843 - DNA, 25 bp, Homo sapien
ataaacactgaggactccaaaaggg

SEQ ID NO: 336844 - DNA, 25 bp, Homo sapien
aaaagctacctattgaatactatgt

SEQ ID NO: 336845 - DNA, 25 bp, Homo sapien
gaatactatgttccctatttgggtg

SEQ ID NO: 336846 - DNA, 25 bp, Homo sapien
ttccctatttgggtgatgggttcgt

SEQ ID NO: 336847 - DNA, 25 bp, Homo sapien
tgatgggttcgttagaagtccaaac

SEQ ID NO: 336848 - DNA, 25 bp, Homo sapien
gttcgttagaagtccaaacctcagc

SEQ ID NO: 336849 - DNA, 25 bp, Homo sapien
ttagaagtccaaacctcagcagcac

SEQ ID NO: 336850 - DNA, 25 bp, Homo sapien
gaagtccaaacctcagcagcacaca

SEQ ID NO: 336851 - DNA, 25 bp, Homo sapien
ttttttgtggaaatttgctttctct

SEQ ID NO: 336852 - DNA, 25 bp, Homo sapien
gctttctctcattatgtaagtacgt

SEQ ID NO: 336853 - DNA, 25 bp, Homo sapien
gtaagtacgtatattacatcttcaa

SEQ ID NO: 336854 - DNA, 25 bp, Homo sapien
tacatcttcaattttgtcacagcac

SEQ ID NO: 336855 - DNA, 25 bp, Homo sapien
tcttcaattttgtcacagcacctaa

SEQ ID NO: 336856 - DNA, 25 bp, Homo sapien
aattttgtcacagcacctaaaagat

SEQ ID NO: 336857 - DNA, 25 bp, Homo sapien
ttactacttgactctttacagaata

SEQ ID NO: 336858 - DNA, 25 bp, Homo sapien
gactctttacagaataagtttgttg

SEQ ID NO: 336859 - DNA, 25 bp, Homo sapien
ataattatattcttagtggtaaact

SEQ ID NO: 336860 - DNA, 25 bp, Homo sapien
aatagaatggatacaacttggtcat

SEQ ID NO: 336861 - DNA, 25 bp, Homo sapien
ttagtattagcatatttaacatttc

SEQ ID NO: 336862 - DNA, 25 bp, Homo sapien
aattccagcattagactaaatgagc

SEQ ID NO: 336863 - DNA, 25 bp, Homo sapien
gtaaatgtacaaactaggtaagtat

SEQ ID NO: 336864 - DNA, 25 bp, Homo sapien
aaaccacaggttaacaatattggag

SEQ ID NO: 336865 - DNA, 25 bp, Homo sapien
aacaatattggagtacttttagaat

SEQ ID NO: 336866 - DNA, 25 bp, Homo sapien
ctgtcttaaatgtcctatcccaaat

SEQ ID NO: 336867 - DNA, 25 bp, Homo sapien
taaatgtcctatcccaaatctaaaa

SEQ ID NO: 336868 - DNA, 25 bp, Homo sapien
aaaatggcaggctgagataatacag

SEQ ID NO: 336869 - DNA, 25 bp, Homo sapien
ctttgtaccagtgtctatatggaaa

SEQ ID NO: 336870 - DNA, 25 bp, Homo sapien
gtaccagtgtctatatggaaagaag

SEQ ID NO: 336871 - DNA, 25 bp, Homo sapien
gaagtagatgctgaatacctcaaga

SEQ ID NO: 336872 - DNA, 25 bp, Homo sapien
gatgctgaatacctcaagatgccaa

SEQ ID NO: 336873 - DNA, 25 bp, Homo sapien
gtgtctcagacgcccaccagtgtgg

SEQ ID NO: 336874 - DNA, 25 bp, Homo sapien
cggcaagtgctttggcaagagctct

SEQ ID NO: 336875 - DNA, 25 bp, Homo sapien
tgctttggcaagagctctacgctga

SEQ ID NO: 336876 - DNA, 25 bp, Homo sapien
tggcaagagctctacgctgacgcga

SEQ ID NO: 336877 - DNA, 25 bp, Homo sapien
tacgctgacgcgacacctgcagacg

SEQ ID NO: 336878 - DNA, 25 bp, Homo sapien
gaagccgtacgcatgtggcgactgt

SEQ ID NO: 336879 - DNA, 25 bp, Homo sapien
tacgcatgtggcgactgtggacgct

SEQ ID NO: 336880 - DNA, 25 bp, Homo sapien
tggcgactgtggacgctgcttcagc

SEQ ID NO: 336881 - DNA, 25 bp, Homo sapien
gctgcttcagcgagagttccacgct

SEQ ID NO: 336882 - DNA, 25 bp, Homo sapien
gcgagagttccacgctgctgcgcca

SEQ ID NO: 336883 - DNA, 25 bp, Homo sapien
atcggcgcagccatcagggcgagcg

SEQ ID NO: 336884 - DNA, 25 bp, Homo sapien
gtggacactggtatttatttatgtt

SEQ ID NO: 336885 - DNA, 25 bp, Homo sapien
atttatgttagctccaagcggaccg

SEQ ID NO: 336886 - DNA, 25 bp, Homo sapien
agctccaagcggaccggtggttcaa

SEQ ID NO: 336887 - DNA, 25 bp, Homo sapien
gaccggtggttcaaaagtgcattat

SEQ ID NO: 336888 - DNA, 25 bp, Homo sapien
gtgcattatttagtttgagctctgt

SEQ ID NO: 336889 - DNA, 25 bp, Homo sapien
tatttagtttgagctctgtaggtaa

SEQ ID NO: 336890 - DNA, 25 bp, Homo sapien
cctcccatcccttgtagattataaa

SEQ ID NO: 336891 - DNA, 25 bp, Homo sapien
aagcaaaaccgccacagaactagag

SEQ ID NO: 336892 - DNA, 25 bp, Homo sapien
accgccacagaactagaggtcttct

SEQ ID NO: 336893 - DNA, 25 bp, Homo sapien
gaggtcttctctttaatgttacttt

SEQ ID NO: 336894 - DNA, 25 bp, Homo sapien
gtacgttatttaatgtctgattgaa

SEQ ID NO: 336895 - DNA, 25 bp, Homo sapien
tttagtttccacgtaggcaggtcgc

SEQ ID NO: 336896 - DNA, 25 bp, Homo sapien
gctttgtgcctctgagtgcgctgct

SEQ ID NO: 336897 - DNA, 25 bp, Homo sapien
tgagtgcgctgctgtgtgttctctc

SEQ ID NO: 336898 - DNA, 25 bp, Homo sapien
gtgttctctctatagttctgtgtca

SEQ ID NO: 336899 - DNA, 25 bp, Homo sapien
tggccactcttgatgtgaggcgtgt

SEQ ID NO: 336900 - DNA, 25 bp, Homo sapien
agtggcccgaggtcatgcttgcttc

SEQ ID NO: 336901 - DNA, 25 bp, Homo sapien
acctgcaggtgcatttggtcctttc

SEQ ID NO: 336902 - DNA, 25 bp, Homo sapien
atttggtcctttccatggccaggaa

SEQ ID NO: 336903 - DNA, 25 bp, Homo sapien
tgtgggctgcactttttatgcttgc

SEQ ID NO: 336904 - DNA, 25 bp, Homo sapien
aagagactccagagtcctcaccggt

SEQ ID NO: 336905 - DNA, 25 bp, Homo sapien
agtcctcaccggtgcagagttggca

SEQ ID NO: 336906 - DNA, 25 bp, Homo sapien
gaacgtgcttctttgtaatgaccaa

SEQ ID NO: 336907 - DNA, 25 bp, Homo sapien
cgtgcttctttgtaatgaccaaggt

SEQ ID NO: 336908 - DNA, 25 bp, Homo sapien
ttgacaattttgtcttaagtgtttc

SEQ ID NO: 336909 - DNA, 25 bp, Homo sapien
taagtgtttctcaaaagaggttact

SEQ ID NO: 336910 - DNA, 25 bp, Homo sapien
aatgaccaaggtaccgatttctgct

SEQ ID NO: 336911 - DNA, 25 bp, Homo sapien
accaaggtaccgatttctgctaagt

SEQ ID NO: 336912 - DNA, 25 bp, Homo sapien
ggtaccgatttctgctaagttctcc

SEQ ID NO: 336913 - DNA, 25 bp, Homo sapien
cgatttctgctaagttctcccaaca

SEQ ID NO: 336914 - DNA, 25 bp, Homo sapien
acatgaaactgcctattcacgccgt

SEQ ID NO: 336915 - DNA, 25 bp, Homo sapien
gaaactgcctattcacgccgtaatt

SEQ ID NO: 336916 - DNA, 25 bp, Homo sapien
tattcacgccgtaattctttctgtc

SEQ ID NO: 336917 - DNA, 25 bp, Homo sapien
tggtgtgggcgttcctcccagcaag

SEQ ID NO: 336918 - DNA, 25 bp, Homo sapien
ccaggtccatccctgtggagagaag

SEQ ID NO: 336919 - DNA, 25 bp, Homo sapien
cagctgcctagacttgggcttaatg

SEQ ID NO: 336920 - DNA, 25 bp, Homo sapien
gagcttctgccctgttgagagcata

SEQ ID NO: 336921 - DNA, 25 bp, Homo sapien
gcatagcctgggttttcatctttta

SEQ ID NO: 336922 - DNA, 25 bp, Homo sapien
catcttttatgtttcttcagtgact

SEQ ID NO: 336923 - DNA, 25 bp, Homo sapien
gtgactatctacaggcaccatgaca

SEQ ID NO: 336924 - DNA, 25 bp, Homo sapien
gcaccatgacagtgttcccaacaag

SEQ ID NO: 336925 - DNA, 25 bp, Homo sapien
ggttgactgcccgtgacatgacaaa

SEQ ID NO: 336926 - DNA, 25 bp, Homo sapien
aaaacattggcagtggtggcgcaga

SEQ ID NO: 336927 - DNA, 25 bp, Homo sapien
tggcgcagagatgcaactcgagtgt

SEQ ID NO: 336928 - DNA, 25 bp, Homo sapien
atgttgaatctttgcaacgtggtag

SEQ ID NO: 336929 - DNA, 25 bp, Homo sapien
gaggcaatgtattgagtatgctgat

SEQ ID NO: 336930 - DNA, 25 bp, Homo sapien
agtatgctgatagaggtggagttca

SEQ ID NO: 336931 - DNA, 25 bp, Homo sapien
aggtggagttcagagacaggcaagc

SEQ ID NO: 336932 - DNA, 25 bp, Homo sapien
acaggcaagcatacataagagtcag

SEQ ID NO: 336933 - DNA, 25 bp, Homo sapien
taagagtcaggatgtttttcagtat

SEQ ID NO: 336934 - DNA, 25 bp, Homo sapien
tgtttttcagtattatctttacaaa

SEQ ID NO: 336935 - DNA, 25 bp, Homo sapien
tacaaatgagtttcttacagtggtc

SEQ ID NO: 336936 - DNA, 25 bp, Homo sapien
gagtttcttacagtggtcaatgaca

SEQ ID NO: 336937 - DNA, 25 bp, Homo sapien
ccaatttcattcaaagcttgcttca

SEQ ID NO: 336938 - DNA, 25 bp, Homo sapien
gcaatggtttgatgccaatatgtta

SEQ ID NO: 336939 - DNA, 25 bp, Homo sapien
atccccttctgctgtaacctctgag

SEQ ID NO: 336940 - DNA, 25 bp, Homo sapien
taacctctgagggagctggctgaaa

SEQ ID NO: 336941 - DNA, 25 bp, Homo sapien
aagggcaaaatgcaggtgttttctc

SEQ ID NO: 336942 - DNA, 25 bp, Homo sapien
aaatgcaggtgttttctcagtatca

SEQ ID NO: 336943 - DNA, 25 bp, Homo sapien
ttcccttttgccttaagtcacccat

SEQ ID NO: 336944 - DNA, 25 bp, Homo sapien
ttaagtcacccatcttccagtaagc

SEQ ID NO: 336945 - DNA, 25 bp, Homo sapien
cacccatcttccagtaagcagttta

SEQ ID NO: 336946 - DNA, 25 bp, Homo sapien
taagcagtttattctgagccccggg

SEQ ID NO: 336947 - DNA, 25 bp, Homo sapien
tactcttcccacaagttcccttaag

SEQ ID NO: 336948 - DNA, 25 bp, Homo sapien
caagttcccttaagtcttgccctag

SEQ ID NO: 336949 - DNA, 25 bp, Homo sapien
tcccttaagtcttgccctagctgtg

SEQ ID NO: 336950 - DNA, 25 bp, Homo sapien
atggacctgggctgcgacggcgagc

SEQ ID NO: 336951 - DNA, 25 bp, Homo sapien
ccagcgtggtgcagttctgtgagtt

SEQ ID NO: 336952 - DNA, 25 bp, Homo sapien
ggtgcagttctgtgagttcgtatct

SEQ ID NO: 336953 - DNA, 25 bp, Homo sapien
tgtgagttcgtatctgccccagagg

SEQ ID NO: 336954 - DNA, 25 bp, Homo sapien
gtatctgccccagaggtgagccgct

SEQ ID NO: 336955 - DNA, 25 bp, Homo sapien
atcatcgatgtcctcctggactacg

SEQ ID NO: 336956 - DNA, 25 bp, Homo sapien
tcctggactacgtgggcaacgtgca

SEQ ID NO: 336957 - DNA, 25 bp, Homo sapien
tacgtgggcaacgtgcagctctgct

SEQ ID NO: 336958 - DNA, 25 bp, Homo sapien
aacgtgcagctctgctcgcggctga

SEQ ID NO: 336959 - DNA, 25 bp, Homo sapien
tctgctcgcggctgaaggaacacat

SEQ ID NO: 336960 - DNA, 25 bp, Homo sapien
tgaaggaacacatcgacagctttga

SEQ ID NO: 336961 - DNA, 25 bp, Homo sapien
atgggaggcggccaaaccagcatct

SEQ ID NO: 336962 - DNA, 25 bp, Homo sapien
ggcggccaaaccagcatctgaggtg

SEQ ID NO: 336963 - DNA, 25 bp, Homo sapien
gcaacagggtgccaggttctacctg

SEQ ID NO: 336964 - DNA, 25 bp, Homo sapien
gcacagcagtgctaggccaggatga

SEQ ID NO: 336965 - DNA, 25 bp, Homo sapien
accatctctgcaggatcctgagcag

SEQ ID NO: 336966 - DNA, 25 bp, Homo sapien
tgcaggatcctgagcagcttctgct

SEQ ID NO: 336967 - DNA, 25 bp, Homo sapien
gcacgaggaggctggatgtcatcaa

SEQ ID NO: 336968 - DNA, 25 bp, Homo sapien
tggatgtcatcaacactgagccctc

SEQ ID NO: 336969 - DNA, 25 bp, Homo sapien
cggtgttttaagacagacctgccaa

SEQ ID NO: 336970 - DNA, 25 bp, Homo sapien
ttaagacagacctgccaaggccctg

SEQ ID NO: 336971 - DNA, 25 bp, Homo sapien
aaggccctgctcttgaaggactgag

SEQ ID NO: 336972 - DNA, 25 bp, Homo sapien
ccttttttcatcctactcattacag

SEQ ID NO: 336973 - DNA, 25 bp, Homo sapien
caggcaaaactcatgtcttatttat

SEQ ID NO: 336974 - DNA, 25 bp, Homo sapien
atcattttctgtaacaggtgacaaa

SEQ ID NO: 336975 - DNA, 25 bp, Homo sapien
gaagaggctgaagtatgaactaccc

SEQ ID NO: 336976 - DNA, 25 bp, Homo sapien
aagtatgaactacccttggagccca

SEQ ID NO: 336977 - DNA, 25 bp, Homo sapien
ccttggagcccatatacatgatata

SEQ ID NO: 336978 - DNA, 25 bp, Homo sapien
aatactacccacttgatgttttcta

SEQ ID NO: 336979 - DNA, 25 bp, Homo sapien
gttttctaatctgatgtgagctcat

SEQ ID NO: 336980 - DNA, 25 bp, Homo sapien
gtgagctcatgttacacagactttt

SEQ ID NO: 336981 - DNA, 25 bp, Homo sapien
taacccgtgactagaaaataaactg

SEQ ID NO: 336982 - DNA, 25 bp, Homo sapien
aactggatgcttaggagagagtgtc

SEQ ID NO: 336983 - DNA, 25 bp, Homo sapien
attgtaatctttgtgctgtatgggt

SEQ ID NO: 336984 - DNA, 25 bp, Homo sapien
tgtgctgtatgggttgagcatcatt

SEQ ID NO: 336985 - DNA, 25 bp, Homo sapien
gtgctgtatgggttgagcatcatta

SEQ ID NO: 336986 - DNA, 25 bp, Homo sapien
gctgtatgggttgagcatcattata

SEQ ID NO: 336987 - DNA, 25 bp, Homo sapien
ctgtatgggttgagcatcattatat

SEQ ID NO: 336988 - DNA, 25 bp, Homo sapien
gtatgggttgagcatcattatatat

SEQ ID NO: 336989 - DNA, 25 bp, Homo sapien
atgggttgagcatcattatatattt

SEQ ID NO: 336990 - DNA, 25 bp, Homo sapien
gtatgtgtacataaatagcaaagtg

SEQ ID NO: 336991 - DNA, 25 bp, Homo sapien
gtgtacataaatagcaaagtggcaa

SEQ ID NO: 336992 - DNA, 25 bp, Homo sapien
gtacataaatagcaaagtggcaaaa

SEQ ID NO: 336993 - DNA, 25 bp, Homo sapien
tcctgcataagtataaaatgtgttg

SEQ ID NO: 336994 - DNA, 25 bp, Homo sapien
tggacctgaaagctggcggcttctc

SEQ ID NO: 336995 - DNA, 25 bp, Homo sapien
cttctccatccgcaatcagaaggga

SEQ ID NO: 336996 - DNA, 25 bp, Homo sapien
agaagggagagcaggtcttccgcct

SEQ ID NO: 336997 - DNA, 25 bp, Homo sapien
ggcgcgctggaccttgactcctgca

SEQ ID NO: 336998 - DNA, 25 bp, Homo sapien
cttgactcctgcagccgcgatggcg

SEQ ID NO: 336999 - DNA, 25 bp, Homo sapien
acgggctgccgctgcacttcttcat

SEQ ID NO: 337000 - DNA, 25 bp, Homo sapien
ttcatccagactgtgcggcccaagg

SEQ ID NO: 337001 - DNA, 25 bp, Homo sapien
tgcggcccaaggacacggtcatgtg

SEQ ID NO: 337002 - DNA, 25 bp, Homo sapien
tggcctggtgctactacagcgtctc

SEQ ID NO: 337003 - DNA, 25 bp, Homo sapien
acagcgtctccctacgcaaggcgga

SEQ ID NO: 337004 - DNA, 25 bp, Homo sapien
tacgcaaggcggagcgacttcgcgc

SEQ ID NO: 337005 - DNA, 25 bp, Homo sapien
tgctgtgtaataaagtggttcaacc

SEQ ID NO: 337006 - DNA, 25 bp, Homo sapien
ggttcaaccatgattaggaactgaa

SEQ ID NO: 337007 - DNA, 25 bp, Homo sapien
caaaccccggtaatagagcacttgg

SEQ ID NO: 337008 - DNA, 25 bp, Homo sapien
attgattaaatgctcctaaccctgt

SEQ ID NO: 337009 - DNA, 25 bp, Homo sapien
gattaaatgctcctaaccctgtaat

SEQ ID NO: 337010 - DNA, 25 bp, Homo sapien
attttgtgcatagagcaccctatgc

SEQ ID NO: 337011 - DNA, 25 bp, Homo sapien
catagagcaccctatgctgtggaaa

SEQ ID NO: 337012 - DNA, 25 bp, Homo sapien
ctgttcttagatttcattgtaactg

SEQ ID NO: 337013 - DNA, 25 bp, Homo sapien
gtaactggactgttcaggttgccca

SEQ ID NO: 337014 - DNA, 25 bp, Homo sapien
gactgttcaggttgcccagagggaa

SEQ ID NO: 337015 - DNA, 25 bp, Homo sapien
gggaaagaacattcctaattctaat

SEQ ID NO: 337016 - DNA, 25 bp, Homo sapien
gcctttggtctgctttttaatatat

SEQ ID NO: 337017 - DNA, 25 bp, Homo sapien
agaaagtctcaagggtttctgtgtt

SEQ ID NO: 337018 - DNA, 25 bp, Homo sapien
aaatatgtgacatacatgtgtacat

SEQ ID NO: 337019 - DNA, 25 bp, Homo sapien
agagacaaggtgagcctgcttttcc

SEQ ID NO: 337020 - DNA, 25 bp, Homo sapien
acatgtgtacatagatcacagagcc

SEQ ID NO: 337021 - DNA, 25 bp, Homo sapien
gacaaggtgagcctgcttttcccaa

SEQ ID NO: 337022 - DNA, 25 bp, Homo sapien
aaggtgagcctgcttttcccaatac

SEQ ID NO: 337023 - DNA, 25 bp, Homo sapien
ccccgccatcataatattgtgaatg

SEQ ID NO: 337024 - DNA, 25 bp, Homo sapien
gagcctgcttttcccaatactggga

SEQ ID NO: 337025 - DNA, 25 bp, Homo sapien
gcctgcttttcccaatactgggaaa

SEQ ID NO: 337026 - DNA, 25 bp, Homo sapien
cttgcctttggtctgctttttaata

SEQ ID NO: 337027 - DNA, 25 bp, Homo sapien
ttcgcccctgaatgaagcccgcagg

SEQ ID NO: 337028 - DNA, 25 bp, Homo sapien
gagagccgggaatggccgccgtgcc

SEQ ID NO: 337029 - DNA, 25 bp, Homo sapien
gacgtgcggttctgcggccacctgc

SEQ ID NO: 337030 - DNA, 25 bp, Homo sapien
cgccgcgtcccgagtgttccgagag

SEQ ID NO: 337031 - DNA, 25 bp, Homo sapien
cgtcccgagtgttccgagagcgagc

SEQ ID NO: 337032 - DNA, 25 bp, Homo sapien
ccgagtgttccgagagcgagcagaa

SEQ ID NO: 337033 - DNA, 25 bp, Homo sapien
tgttccgagagcgagcagaagtttc

SEQ ID NO: 337034 - DNA, 25 bp, Homo sapien
cgagcagaagtttcgcgcgtgccga

SEQ ID NO: 337035 - DNA, 25 bp, Homo sapien
tggcgggtgcgtgcaccaccagcaa

SEQ ID NO: 337036 - DNA, 25 bp, Homo sapien
gtgcaccaccagcaagtgcgcagat

SEQ ID NO: 337037 - DNA, 25 bp, Homo sapien
agcaagtgcgcagatgcgcgccagc

SEQ ID NO: 337038 - DNA, 25 bp, Homo sapien
tttaaatatactgtcacactgaagc

SEQ ID NO: 337039 - DNA, 25 bp, Homo sapien
tgttttaccagttatttgcaagcaa

SEQ ID NO: 337040 - DNA, 25 bp, Homo sapien
gttttaccagttatttgcaagcaaa

SEQ ID NO: 337041 - DNA, 25 bp, Homo sapien
tttaccagttatttgcaagcaaaat

SEQ ID NO: 337042 - DNA, 25 bp, Homo sapien
tagatgatttctaatgtctcctgac

SEQ ID NO: 337043 - DNA, 25 bp, Homo sapien
gatgatttctaatgtctcctgacaa

SEQ ID NO: 337044 - DNA, 25 bp, Homo sapien
gatttctaatgtctcctgacaaact

SEQ ID NO: 337045 - DNA, 25 bp, Homo sapien
ttctaatgtctcctgacaaactgta

SEQ ID NO: 337046 - DNA, 25 bp, Homo sapien
atgtctcctgacaaactgtaaatac

SEQ ID NO: 337047 - DNA, 25 bp, Homo sapien
gtctcctgacaaactgtaaatactg

SEQ ID NO: 337048 - DNA, 25 bp, Homo sapien
gacaaactgtaaatactgcatttct

SEQ ID NO: 337049 - DNA, 25 bp, Homo sapien
gacctcagtgatgtggagcttgatg

SEQ ID NO: 337050 - DNA, 25 bp, Homo sapien
ttgtgagagccacaacagaggcttc

SEQ ID NO: 337051 - DNA, 25 bp, Homo sapien
cagaggcttcagaccattttctttt

SEQ ID NO: 337052 - DNA, 25 bp, Homo sapien
gtgaagggacattctctacactcag

SEQ ID NO: 337053 - DNA, 25 bp, Homo sapien
tctacactcagatgactctaccagt

SEQ ID NO: 337054 - DNA, 25 bp, Homo sapien
atgactctaccagtggccttttaac

SEQ ID NO: 337055 - DNA, 25 bp, Homo sapien
agtagtacttgattggtcatttgaa

SEQ ID NO: 337056 - DNA, 25 bp, Homo sapien
aacagtgaacttttgcatctcaaga

SEQ ID NO: 337057 - DNA, 25 bp, Homo sapien
ctatgaattgttgtagccggtgaat

SEQ ID NO: 337058 - DNA, 25 bp, Homo sapien
tgtagccggtgaattgagtcgtatt

SEQ ID NO: 337059 - DNA, 25 bp, Homo sapien
gagtcgtattctgtcacataatatt

SEQ ID NO: 337060 - DNA, 25 bp, Homo sapien
ttttgtaatcagctactgtatgttt

SEQ ID NO: 337061 - DNA, 25 bp, Homo sapien
tcagctactgtatgttttattttag

SEQ ID NO: 337062 - DNA, 25 bp, Homo sapien
ttttctgctctggaggtatatgcac

SEQ ID NO: 337063 - DNA, 25 bp, Homo sapien
ggtatatgcactaacaaaacatttt

SEQ ID NO: 337064 - DNA, 25 bp, Homo sapien
attttcctcctttcatatacgcatg

SEQ ID NO: 337065 - DNA, 25 bp, Homo sapien
ttcctcctttcatatacgcatgtta

SEQ ID NO: 337066 - DNA, 25 bp, Homo sapien
tgtgagcaatatttcctaccatact

SEQ ID NO: 337067 - DNA, 25 bp, Homo sapien
gcaatatttcctaccatacttcact

SEQ ID NO: 337068 - DNA, 25 bp, Homo sapien
accatacttcactcccaatattttt

SEQ ID NO: 337069 - DNA, 25 bp, Homo sapien
tcactcccaatattttttgagatgt

SEQ ID NO: 337070 - DNA, 25 bp, Homo sapien
tgtatatgaaccacagaggagccca

SEQ ID NO: 337071 - DNA, 25 bp, Homo sapien
aaatgccaaaatgtacttaaatgag

SEQ ID NO: 337072 - DNA, 25 bp, Homo sapien
aatgagttacttagaatgccataaa

SEQ ID NO: 337073 - DNA, 25 bp, Homo sapien
aaaattgcagtttcatgtatgtata

SEQ ID NO: 337074 - DNA, 25 bp, Homo sapien
gtatgtatataatcatgctcatgta

SEQ ID NO: 337075 - DNA, 25 bp, Homo sapien
gctcatgtatatttagttacgtata

SEQ ID NO: 337076 - DNA, 25 bp, Homo sapien
gttacgtataatgctttctgagtga

SEQ ID NO: 337077 - DNA, 25 bp, Homo sapien
ataatgctttctgagtgagttttac

SEQ ID NO: 337078 - DNA, 25 bp, Homo sapien
ggttaaatcatttggcttgctgttt

SEQ ID NO: 337079 - DNA, 25 bp, Homo sapien
atcatttggcttgctgtttactccc

SEQ ID NO: 337080 - DNA, 25 bp, Homo sapien
gctgtttactcccttctgtagtttt

SEQ ID NO: 337081 - DNA, 25 bp, Homo sapien
aagctttatctttgtgtaatctaag

SEQ ID NO: 337082 - DNA, 25 bp, Homo sapien
gaatttatctaaaaagtccaacatc

SEQ ID NO: 337083 - DNA, 25 bp, Homo sapien
aaaagtgtctagaacttcagagcaa

SEQ ID NO: 337084 - DNA, 25 bp, Homo sapien
acttcagagcaagagtttctagatt

SEQ ID NO: 337085 - DNA, 25 bp, Homo sapien
attgaaagggcctgagtacccacca

SEQ ID NO: 337086 - DNA, 25 bp, Homo sapien
gagtacccaccacaatgaatggaaa

SEQ ID NO: 337087 - DNA, 25 bp, Homo sapien
aaagctgtaccagggcacattatca

SEQ ID NO: 337088 - DNA, 25 bp, Homo sapien
gggcacattatcatacaatttcaga

SEQ ID NO: 337089 - DNA, 25 bp, Homo sapien
gaaaacaacctaaaagctctgaagg

SEQ ID NO: 337090 - DNA, 25 bp, Homo sapien
agctctgaagggaatatctctgggt

SEQ ID NO: 337091 - DNA, 25 bp, Homo sapien
gtccaacatctgactagtggtagtt

SEQ ID NO: 337092 - DNA, 25 bp, Homo sapien
agtggtagttctagagaggccagaa

SEQ ID NO: 337093 - DNA, 25 bp, Homo sapien
cctgctccgtggctcgtgcttttag

SEQ ID NO: 337094 - DNA, 25 bp, Homo sapien
gctccgtggctcgtgcttttagcca

SEQ ID NO: 337095 - DNA, 25 bp, Homo sapien
tggctcgtgcttttagccactaggc

SEQ ID NO: 337096 - DNA, 25 bp, Homo sapien
gctcgtgcttttagccactaggctt

SEQ ID NO: 337097 - DNA, 25 bp, Homo sapien
gtgcttttagccactaggctttgct

SEQ ID NO: 337098 - DNA, 25 bp, Homo sapien
gcttttagccactaggctttgctgt

SEQ ID NO: 337099 - DNA, 25 bp, Homo sapien
tagccactaggctttgctgtgtaaa

SEQ ID NO: 337100 - DNA, 25 bp, Homo sapien
agccactaggctttgctgtgtaaat

SEQ ID NO: 337101 - DNA, 25 bp, Homo sapien
gtaaatatgacacaaactgataaac

SEQ ID NO: 337102 - DNA, 25 bp, Homo sapien
caaactgataaacaagagggcaaaa

SEQ ID NO: 337103 - DNA, 25 bp, Homo sapien
aaaaagaaagcgttgcaggctgggc

SEQ ID NO: 337104 - DNA, 25 bp, Homo sapien
gaggttcaggggatacatatatatt

SEQ ID NO: 337105 - DNA, 25 bp, Homo sapien
gaactcttgggctcatgctgtccta

SEQ ID NO: 337106 - DNA, 25 bp, Homo sapien
aactcttgggctcatgctgtcctac

SEQ ID NO: 337107 - DNA, 25 bp, Homo sapien
actcttgggctcatgctgtcctacc

SEQ ID NO: 337108 - DNA, 25 bp, Homo sapien
cttgggctcatgctgtcctacctca

SEQ ID NO: 337109 - DNA, 25 bp, Homo sapien
ttgggctcatgctgtcctacctcag

SEQ ID NO: 337110 - DNA, 25 bp, Homo sapien
gctcatgctgtcctacctcagactt

SEQ ID NO: 337111 - DNA, 25 bp, Homo sapien
gagccatgtgcccagtctagaagat

SEQ ID NO: 337112 - DNA, 25 bp, Homo sapien
agccatgtgcccagtctagaagatc

SEQ ID NO: 337113 - DNA, 25 bp, Homo sapien
gccatgtgcccagtctagaagatct

SEQ ID NO: 337114 - DNA, 25 bp, Homo sapien
ccatgtgcccagtctagaagatctt

SEQ ID NO: 337115 - DNA, 25 bp, Homo sapien
aaatcagtaccccaatgttcttgcc

SEQ ID NO: 337116 - DNA, 25 bp, Homo sapien
ttctgcccaagtttcatatcctgga

SEQ ID NO: 337117 - DNA, 25 bp, Homo sapien
tatcctggaaggtcttcacatgctc

SEQ ID NO: 337118 - DNA, 25 bp, Homo sapien
atgctccagccacctgtaagctatg

SEQ ID NO: 337119 - DNA, 25 bp, Homo sapien
gtaagctatgtctaatgtgccagaa

SEQ ID NO: 337120 - DNA, 25 bp, Homo sapien
taatgtgccagaaactcgtccagcc

SEQ ID NO: 337121 - DNA, 25 bp, Homo sapien
cagtgagctgcatccaatggcgtgt

SEQ ID NO: 337122 - DNA, 25 bp, Homo sapien
tggcgtgtacccatgtattgcacaa

SEQ ID NO: 337123 - DNA, 25 bp, Homo sapien
gagtgtatcaaattctgggcccaga

SEQ ID NO: 337124 - DNA, 25 bp, Homo sapien
gcccagaccaacacaaatgacactt

SEQ ID NO: 337125 - DNA, 25 bp, Homo sapien
aactcttaaatgacggacctgactg

SEQ ID NO: 337126 - DNA, 25 bp, Homo sapien
agaacccaagtgattattgatctgg

SEQ ID NO: 337127 - DNA, 25 bp, Homo sapien
gattattgatctgggttttattcct

SEQ ID NO: 337128 - DNA, 25 bp, Homo sapien
tattcctttatagcccaaccatatg

SEQ ID NO: 337129 - DNA, 25 bp, Homo sapien
tagcccaaccatatgatggaatact

SEQ ID NO: 337130 - DNA, 25 bp, Homo sapien
tatgaattggtgtggaaacatcgcc

SEQ ID NO: 337131 - DNA, 25 bp, Homo sapien
aacatcgccaagatatgaaagccaa

SEQ ID NO: 337132 - DNA, 25 bp, Homo sapien
gtaattccacccctaggaatccagc

SEQ ID NO: 337133 - DNA, 25 bp, Homo sapien
atgtggtatgctattatctatgtga

SEQ ID NO: 337134 - DNA, 25 bp, Homo sapien
ggaatccagcttacacacacaagaa

SEQ ID NO: 337135 - DNA, 25 bp, Homo sapien
gtacaaggttagtcactgcacagtg

SEQ ID NO: 337136 - DNA, 25 bp, Homo sapien
gtcactgcacagtgagacagcaaaa

SEQ ID NO: 337137 - DNA, 25 bp, Homo sapien
ccggataggtaacttggtggcaact

SEQ ID NO: 337138 - DNA, 25 bp, Homo sapien
aacttggtggcaactctagtctctc

SEQ ID NO: 337139 - DNA, 25 bp, Homo sapien
aactctagtctctcatcatgtacag

SEQ ID NO: 337140 - DNA, 25 bp, Homo sapien
gggtaaaccagttcatgcgaagatc

SEQ ID NO: 337141 - DNA, 25 bp, Homo sapien
gaagatcatgtattaagctgcctaa

SEQ ID NO: 337142 - DNA, 25 bp, Homo sapien
acaaaaacactgctaggtcctgagg

SEQ ID NO: 337143 - DNA, 25 bp, Homo sapien
aacactgctaggtcctgaggaaaca

SEQ ID NO: 337144 - DNA, 25 bp, Homo sapien
aaattacagtcttcctctgaggagt

SEQ ID NO: 337145 - DNA, 25 bp, Homo sapien
tcctctgaggagtttgaaattagca

SEQ ID NO: 337146 - DNA, 25 bp, Homo sapien
aacactacagtgagatatgctataa

SEQ ID NO: 337147 - DNA, 25 bp, Homo sapien
tatgctataaacaaacctgggagga

SEQ ID NO: 337148 - DNA, 25 bp, Homo sapien
gacagaaagaattacggcgtgaata

SEQ ID NO: 337149 - DNA, 25 bp, Homo sapien
gaattacggcgtgaataggcagttt

SEQ ID NO: 337150 - DNA, 25 bp, Homo sapien
aataggcagtttcatgttgttggga

SEQ ID NO: 337151 - DNA, 25 bp, Homo sapien
ggcagtttcatgttgttgggagaac

SEQ ID NO: 337152 - DNA, 25 bp, Homo sapien
gagaacttagcagaaatcggtacct

SEQ ID NO: 337153 - DNA, 25 bp, Homo sapien
agcagaaatcggtaccttggtcatt

SEQ ID NO: 337154 - DNA, 25 bp, Homo sapien
gaaatcggtaccttggtcattacaa

SEQ ID NO: 337155 - DNA, 25 bp, Homo sapien
atcggtaccttggtcattacaaaga

SEQ ID NO: 337156 - DNA, 25 bp, Homo sapien
tggtcattacaaagaagcacgttca

SEQ ID NO: 337157 - DNA, 25 bp, Homo sapien
ttacaaagaagcacgttcaaaggaa

SEQ ID NO: 337158 - DNA, 25 bp, Homo sapien
agacaattgcacaaggaggcttttt

SEQ ID NO: 337159 - DNA, 25 bp, Homo sapien
ggtctcagagttgctttcacctaga

SEQ ID NO: 337160 - DNA, 25 bp, Homo sapien
ttcacctagagctgatgcttccaca

SEQ ID NO: 337161 - DNA, 25 bp, Homo sapien
tgaacagcgttgacacagccgtgac

SEQ ID NO: 337162 - DNA, 25 bp, Homo sapien
gacacagccgtgacttacaattaaa

SEQ ID NO: 337163 - DNA, 25 bp, Homo sapien
cagattctgtgtgctacttgatgag

SEQ ID NO: 337164 - DNA, 25 bp, Homo sapien
tacttgatgagatgttacccaaggc

SEQ ID NO: 337165 - DNA, 25 bp, Homo sapien
aggccagtttggacttactgctttt

SEQ ID NO: 337166 - DNA, 25 bp, Homo sapien
gattctgctctcaaagttatgcttc

SEQ ID NO: 337167 - DNA, 25 bp, Homo sapien
gaaaggtgtcatgtcgggcacttgt

SEQ ID NO: 337168 - DNA, 25 bp, Homo sapien
tcgggcacttgtgttgggtgactat

SEQ ID NO: 337169 - DNA, 25 bp, Homo sapien
cagcagtgctggtcaggtctcagag

SEQ ID NO: 337170 - DNA, 25 bp, Homo sapien
gaaaatcttcattacagtggagcac

SEQ ID NO: 337171 - DNA, 25 bp, Homo sapien
gagcacaaatgttccatacaagaca

SEQ ID NO: 337172 - DNA, 25 bp, Homo sapien
catacaagacatcattgaggagcca

SEQ ID NO: 337173 - DNA, 25 bp, Homo sapien
tgtccccttctaacctgaaacacat

SEQ ID NO: 337174 - DNA, 25 bp, Homo sapien
tgaaacacattctttcccatcctgg

SEQ ID NO: 337175 - DNA, 25 bp, Homo sapien
ttcccatcctggttgggcttctgta

SEQ ID NO: 337176 - DNA, 25 bp, Homo sapien
gcttctgtacctccttattaattta

SEQ ID NO: 337177 - DNA, 25 bp, Homo sapien
gaacctgaagttgcttgaagtgttt

SEQ ID NO: 337178 - DNA, 25 bp, Homo sapien
gcttgaagtgttttgggcttaataa

SEQ ID NO: 337179 - DNA, 25 bp, Homo sapien
ggtagcagtaacacctacatgaaac

SEQ ID NO: 337180 - DNA, 25 bp, Homo sapien
gaaacaatacaccttggatctttta

SEQ ID NO: 337181 - DNA, 25 bp, Homo sapien
tacacatacagatacacccacacac

SEQ ID NO: 337182 - DNA, 25 bp, Homo sapien
acagactgactctctttctctcata

SEQ ID NO: 337183 - DNA, 25 bp, Homo sapien
tcataccccaaggtcatgagtgaat

SEQ ID NO: 337184 - DNA, 25 bp, Homo sapien
tcatgagtgaatgatgcttagttcc

SEQ ID NO: 337185 - DNA, 25 bp, Homo sapien
tgatgcttagttccttgtaaagaaa

SEQ ID NO: 337186 - DNA, 25 bp, Homo sapien
cagcaagaggattcaacaaacgaaa

SEQ ID NO: 337187 - DNA, 25 bp, Homo sapien
gaggacaacacagtatttttcaaaa

SEQ ID NO: 337188 - DNA, 25 bp, Homo sapien
gtatatagcgcatatgcatggacaa

SEQ ID NO: 337189 - DNA, 25 bp, Homo sapien
catggacaaagcaagcgtggcacgt

SEQ ID NO: 337190 - DNA, 25 bp, Homo sapien
caagcgtggcacgtgtttgcataat

SEQ ID NO: 337191 - DNA, 25 bp, Homo sapien
gcacgtgtttgcataatgtttaatt

SEQ ID NO: 337192 - DNA, 25 bp, Homo sapien
acagcatgagtgcccagctaaatgt

SEQ ID NO: 337193 - DNA, 25 bp, Homo sapien
gcccagctaaatgtttattcttaac

SEQ ID NO: 337194 - DNA, 25 bp, Homo sapien
agctaaatgtttattcttaaccagg

SEQ ID NO: 337195 - DNA, 25 bp, Homo sapien
ctaaatgtttattcttaaccaggat

SEQ ID NO: 337196 - DNA, 25 bp, Homo sapien
gttaataacttaatttactgtcata

SEQ ID NO: 337197 - DNA, 25 bp, Homo sapien
acttaatttactgtcatagagttaa

SEQ ID NO: 337198 - DNA, 25 bp, Homo sapien
tactgtcatagagttaaaagtttgg

SEQ ID NO: 337199 - DNA, 25 bp, Homo sapien
taaaagtttggaacagtagagagcc

SEQ ID NO: 337200 - DNA, 25 bp, Homo sapien
ggccccagactggaatttttggtgt

SEQ ID NO: 337201 - DNA, 25 bp, Homo sapien
ccccagactggaatttttggtgtgt

SEQ ID NO: 337202 - DNA, 25 bp, Homo sapien
ccagactggaatttttggtgtgtgt

SEQ ID NO: 337203 - DNA, 25 bp, Homo sapien
gatcaactttacctgtaccttttct

SEQ ID NO: 337204 - DNA, 25 bp, Homo sapien
gccacctcaggtgcaaatctgaact

SEQ ID NO: 337205 - DNA, 25 bp, Homo sapien
aatctgaactcagtgtctgcttctt

SEQ ID NO: 337206 - DNA, 25 bp, Homo sapien
tcagtgtctgcttcttccattttct

SEQ ID NO: 337207 - DNA, 25 bp, Homo sapien
gcttcttccattttctcgtctctct

SEQ ID NO: 337208 - DNA, 25 bp, Homo sapien
aagcctgaataagttcctttccctg

SEQ ID NO: 337209 - DNA, 25 bp, Homo sapien
tttccctggtaactttgaaaagcag

SEQ ID NO: 337210 - DNA, 25 bp, Homo sapien
gcagtcagagttgctatatagatat

SEQ ID NO: 337211 - DNA, 25 bp, Homo sapien
tatagatatatgtggctcctttaaa

SEQ ID NO: 337212 - DNA, 25 bp, Homo sapien
atgtggctcctttaaaatgctttgt

SEQ ID NO: 337213 - DNA, 25 bp, Homo sapien
taaaatgctttgtgtatgtgtggtg

SEQ ID NO: 337214 - DNA, 25 bp, Homo sapien
gtgatataatggactatgcagactc

SEQ ID NO: 337215 - DNA, 25 bp, Homo sapien
tgatataatggactatgcagactcc

SEQ ID NO: 337216 - DNA, 25 bp, Homo sapien
atataatggactatgcagactccaa

SEQ ID NO: 337217 - DNA, 25 bp, Homo sapien
taatggactatgcagactccaaatg

SEQ ID NO: 337218 - DNA, 25 bp, Homo sapien
atggactatgcagactccaaatggg

SEQ ID NO: 337219 - DNA, 25 bp, Homo sapien
tatgcagactccaaatggggagggt

SEQ ID NO: 337220 - DNA, 25 bp, Homo sapien
taagggataaaaagctacaagttgg

SEQ ID NO: 337221 - DNA, 25 bp, Homo sapien
taaaaagctacaagttgggtacaat

SEQ ID NO: 337222 - DNA, 25 bp, Homo sapien
aaaaagctacaagttgggtacaatg

SEQ ID NO: 337223 - DNA, 25 bp, Homo sapien
aaaagctacaagttgggtacaatgt

SEQ ID NO: 337224 - DNA, 25 bp, Homo sapien
aaagctacaagttgggtacaatgta

SEQ ID NO: 337225 - DNA, 25 bp, Homo sapien
aggaaataaaagactgtgtgtgtgt

SEQ ID NO: 337226 - DNA, 25 bp, Homo sapien
gtgtgttcaagtgcctaaatcttgt

SEQ ID NO: 337227 - DNA, 25 bp, Homo sapien
agtgcctaaatcttgtttacctatc

SEQ ID NO: 337228 - DNA, 25 bp, Homo sapien
gcctaaatcttgtttacctatcact

SEQ ID NO: 337229 - DNA, 25 bp, Homo sapien
ctaaatcttgtttacctatcacttt

SEQ ID NO: 337230 - DNA, 25 bp, Homo sapien
gcctgggctagtgagagttggtgca

SEQ ID NO: 337231 - DNA, 25 bp, Homo sapien
gagttggtgcaaattcttgtgtgtg

SEQ ID NO: 337232 - DNA, 25 bp, Homo sapien
gtttgcataggaaggtgagatgacc

SEQ ID NO: 337233 - DNA, 25 bp, Homo sapien
gagatgaccatctactaaagaggaa

SEQ ID NO: 337234 - DNA, 25 bp, Homo sapien
gatgaccatctactaaagaggaagt

SEQ ID NO: 337235 - DNA, 25 bp, Homo sapien
aatacagatctgtgggtgtttttaa

SEQ ID NO: 337236 - DNA, 25 bp, Homo sapien
tgtgacccacagcaggttcctagtt

SEQ ID NO: 337237 - DNA, 25 bp, Homo sapien
cagcaggttcctagttgttgttttg

SEQ ID NO: 337238 - DNA, 25 bp, Homo sapien
ctagttgttgttttggaccaggctg

SEQ ID NO: 337239 - DNA, 25 bp, Homo sapien
accaggctgctggtcatggcccttg

SEQ ID NO: 337240 - DNA, 25 bp, Homo sapien
tggtcatggcccttgtccaactttc

SEQ ID NO: 337241 - DNA, 25 bp, Homo sapien
tgtccaactttctgagatctcaaaa

SEQ ID NO: 337242 - DNA, 25 bp, Homo sapien
gtcagggaaggcactgtcaatgctg

SEQ ID NO: 337243 - DNA, 25 bp, Homo sapien
tgagatctcaaaaagcagcagccca

SEQ ID NO: 337244 - DNA, 25 bp, Homo sapien
gaaggcactgtcaatgctgttttga

SEQ ID NO: 337245 - DNA, 25 bp, Homo sapien
gcactgtcaatgctgttttgaaact

SEQ ID NO: 337246 - DNA, 25 bp, Homo sapien
cccactgttcagctcacaaaagtat

SEQ ID NO: 337247 - DNA, 25 bp, Homo sapien
ttaagaagtaagaatttggctgggc

SEQ ID NO: 337248 - DNA, 25 bp, Homo sapien
taagaagtaagaatttggctgggcg

SEQ ID NO: 337249 - DNA, 25 bp, Homo sapien
aagaagtaagaatttggctgggcgc

SEQ ID NO: 337250 - DNA, 25 bp, Homo sapien
agaagtaagaatttggctgggcgcg

SEQ ID NO: 337251 - DNA, 25 bp, Homo sapien
gaagtaagaatttggctgggcgcgg

SEQ ID NO: 337252 - DNA, 25 bp, Homo sapien
aagtaagaatttggctgggcgcggt

SEQ ID NO: 337253 - DNA, 25 bp, Homo sapien
cctggcacttcaggaggccgagaca

SEQ ID NO: 337254 - DNA, 25 bp, Homo sapien
ctggcacttcaggaggccgagacag

SEQ ID NO: 337255 - DNA, 25 bp, Homo sapien
aatctcagctatcaggagtctgagg

SEQ ID NO: 337256 - DNA, 25 bp, Homo sapien
atctcagctatcaggagtctgaggc

SEQ ID NO: 337257 - DNA, 25 bp, Homo sapien
tcagctatcaggagtctgaggcatg

SEQ ID NO: 337258 - DNA, 25 bp, Homo sapien
tgctttggagctatcagatttgcat

SEQ ID NO: 337259 - DNA, 25 bp, Homo sapien
gcatgttagagaaatgactctggtc

SEQ ID NO: 337260 - DNA, 25 bp, Homo sapien
gttagagaaatgactctggtctcag

SEQ ID NO: 337261 - DNA, 25 bp, Homo sapien
agaaatgactctggtctcagtggag

SEQ ID NO: 337262 - DNA, 25 bp, Homo sapien
agagtggactgaagagggcaagaat

SEQ ID NO: 337263 - DNA, 25 bp, Homo sapien
tggaagccgggaagagtgaacagaa

SEQ ID NO: 337264 - DNA, 25 bp, Homo sapien
gaacagaagaaatcttgggctttga

SEQ ID NO: 337265 - DNA, 25 bp, Homo sapien
gaaatcttgggctttgattgggtcg

SEQ ID NO: 337266 - DNA, 25 bp, Homo sapien
aatcttgggctttgattgggtcgga

SEQ ID NO: 337267 - DNA, 25 bp, Homo sapien
tcttgggctttgattgggtcggaaa

SEQ ID NO: 337268 - DNA, 25 bp, Homo sapien
tgggtcggaaagaaagtgtggccct

SEQ ID NO: 337269 - DNA, 25 bp, Homo sapien
aggaactgaacccaggagatccatc

SEQ ID NO: 337270 - DNA, 25 bp, Homo sapien
ggaactgaacccaggagatccatcc

SEQ ID NO: 337271 - DNA, 25 bp, Homo sapien
gaactgaacccaggagatccatcca

SEQ ID NO: 337272 - DNA, 25 bp, Homo sapien
caggagatccatccacctattagcc

SEQ ID NO: 337273 - DNA, 25 bp, Homo sapien
aggagatccatccacctattagccc

SEQ ID NO: 337274 - DNA, 25 bp, Homo sapien
ggagatccatccacctattagccct

SEQ ID NO: 337275 - DNA, 25 bp, Homo sapien
agatccatccacctattagccctgg

SEQ ID NO: 337276 - DNA, 25 bp, Homo sapien
gatccatccacctattagccctggg

SEQ ID NO: 337277 - DNA, 25 bp, Homo sapien
tgcgatttcccactcctttcttagt

SEQ ID NO: 337278 - DNA, 25 bp, Homo sapien
cttagtcttcttccagaaacagaga

SEQ ID NO: 337279 - DNA, 25 bp, Homo sapien
tgtgcctgggagaggctctgtctcc

SEQ ID NO: 337280 - DNA, 25 bp, Homo sapien
cagccacagcaaatgataaaaaacg

SEQ ID NO: 337281 - DNA, 25 bp, Homo sapien
aatgataaaaaacgtcagttctcct

SEQ ID NO: 337282 - DNA, 25 bp, Homo sapien
agaagttagaaatctctggcattga

SEQ ID NO: 337283 - DNA, 25 bp, Homo sapien
gaagttagaaatctctggcattgaa

SEQ ID NO: 337284 - DNA, 25 bp, Homo sapien
agttagaaatctctggcattgaaga

SEQ ID NO: 337285 - DNA, 25 bp, Homo sapien
ttagaaatctctggcattgaagagg

SEQ ID NO: 337286 - DNA, 25 bp, Homo sapien
ggcaaaagtgcccattggtggaact

SEQ ID NO: 337287 - DNA, 25 bp, Homo sapien
aagtgcccattggtggaactgctca

SEQ ID NO: 337288 - DNA, 25 bp, Homo sapien
cattggtggaactgctcacagaaag

SEQ ID NO: 337289 - DNA, 25 bp, Homo sapien
tcacagaaagaaggtggttcacaga

SEQ ID NO: 337290 - DNA, 25 bp, Homo sapien
agaaagaaggtggttcacagaacag

SEQ ID NO: 337291 - DNA, 25 bp, Homo sapien
agcgtgcagctgtaactcacagacg

SEQ ID NO: 337292 - DNA, 25 bp, Homo sapien
gtaactcacagacgagacatccctg

SEQ ID NO: 337293 - DNA, 25 bp, Homo sapien
cagacgagacatccctgagctacca

SEQ ID NO: 337294 - DNA, 25 bp, Homo sapien
gtggtcctgtactagtcctggcaaa

SEQ ID NO: 337295 - DNA, 25 bp, Homo sapien
tactagtcctggcaaaggttccggt

SEQ ID NO: 337296 - DNA, 25 bp, Homo sapien
aaaggttccggtaactgcagcaaca

SEQ ID NO: 337297 - DNA, 25 bp, Homo sapien
gttccggtaactgcagcaacagata

SEQ ID NO: 337298 - DNA, 25 bp, Homo sapien
tgcacagctgtggtcgatcgcagga

SEQ ID NO: 337299 - DNA, 25 bp, Homo sapien
agctgtggtcgatcgcaggacagcc

SEQ ID NO: 337300 - DNA, 25 bp, Homo sapien
caggacagccgcaggtgatgaaaaa

SEQ ID NO: 337301 - DNA, 25 bp, Homo sapien
tgatgaaaaaccgtgaacccaggac

SEQ ID NO: 337302 - DNA, 25 bp, Homo sapien
gaaatccaagtatggtgtttgtatt

SEQ ID NO: 337303 - DNA, 25 bp, Homo sapien
gtgtttgtattgaagtcagacagtc

SEQ ID NO: 337304 - DNA, 25 bp, Homo sapien
gtcagacagtcatacttgtgctttt

SEQ ID NO: 337305 - DNA, 25 bp, Homo sapien
agtcatacttgtgcttttacatgaa

SEQ ID NO: 337306 - DNA, 25 bp, Homo sapien
catgcttcaacatagaagtagcagc

SEQ ID NO: 337307 - DNA, 25 bp, Homo sapien
agaagtagcagcaatgtaattattt

SEQ ID NO: 337308 - DNA, 25 bp, Homo sapien
gaagtaacacttaacacactccgct

SEQ ID NO: 337309 - DNA, 25 bp, Homo sapien
acttaacacactccgctgcattgaa

SEQ ID NO: 337310 - DNA, 25 bp, Homo sapien
aacacactccgctgcattgaatgca

SEQ ID NO: 337311 - DNA, 25 bp, Homo sapien
gaatgcagtggattgatcagaatgt

SEQ ID NO: 337312 - DNA, 25 bp, Homo sapien
tgttaagactgacatttccaaggtt

SEQ ID NO: 337313 - DNA, 25 bp, Homo sapien
gaatatatgcaacttgtcacaggca

SEQ ID NO: 337314 - DNA, 25 bp, Homo sapien
ggcaaaaggctaatttccgtaatat

SEQ ID NO: 337315 - DNA, 25 bp, Homo sapien
ttccgtaatatatacagcattccta

SEQ ID NO: 337316 - DNA, 25 bp, Homo sapien
tacagcattcctacaaactaacaag

SEQ ID NO: 337317 - DNA, 25 bp, Homo sapien
tttgtgcattgctagtgagaaggta

SEQ ID NO: 337318 - DNA, 25 bp, Homo sapien
aaagtagtgcgatctttgcagcaac

SEQ ID NO: 337319 - DNA, 25 bp, Homo sapien
gcgatctttgcagcaacaatttgta

SEQ ID NO: 337320 - DNA, 25 bp, Homo sapien
aatgcacatgccctttgacttagga

SEQ ID NO: 337321 - DNA, 25 bp, Homo sapien
tgccctttgacttaggaattttact

SEQ ID NO: 337322 - DNA, 25 bp, Homo sapien
agaattgtgaatgtacagcttattc

SEQ ID NO: 337323 - DNA, 25 bp, Homo sapien
aaatctatcagtagggactaattaa

SEQ ID NO: 337324 - DNA, 25 bp, Homo sapien
tttgccggtaaaagcagactcaaat

SEQ ID NO: 337325 - DNA, 25 bp, Homo sapien
agcagactcaaatataaaggttttt

SEQ ID NO: 337326 - DNA, 25 bp, Homo sapien
atagttgctctatgtttgtaaacag

SEQ ID NO: 337327 - DNA, 25 bp, Homo sapien
gacaatctctaatgtctgattattt

SEQ ID NO: 337328 - DNA, 25 bp, Homo sapien
taatgtctgattatttgtatcacag

SEQ ID NO: 337329 - DNA, 25 bp, Homo sapien
agctgccttggacttgaatccatgc

SEQ ID NO: 337330 - DNA, 25 bp, Homo sapien
cttgaatccatgcaatgtttagagt

SEQ ID NO: 337331 - DNA, 25 bp, Homo sapien
aagtcagttacttgttgatgttttc

SEQ ID NO: 337332 - DNA, 25 bp, Homo sapien
aaatacatattgtcatgtcagttct

SEQ ID NO: 337333 - DNA, 25 bp, Homo sapien
gtcagttcttgccaggaacttctca

SEQ ID NO: 337334 - DNA, 25 bp, Homo sapien
ttgccaggaacttctcaacaaaatg

SEQ ID NO: 337335 - DNA, 25 bp, Homo sapien
agacagcagcatggtcagagtggta

SEQ ID NO: 337336 - DNA, 25 bp, Homo sapien
tcagagtggtaggagctggccatca

SEQ ID NO: 337337 - DNA, 25 bp, Homo sapien
tggccatcagtgagagctgctccgt

SEQ ID NO: 337338 - DNA, 25 bp, Homo sapien
atcagtgagagctgctccgtgcctg

SEQ ID NO: 337339 - DNA, 25 bp, Homo sapien
gagagctgctccgtgcctggctgct

SEQ ID NO: 337340 - DNA, 25 bp, Homo sapien
ctgggtgctagagcctgtggaccac

SEQ ID NO: 337341 - DNA, 25 bp, Homo sapien
gtggaccactggtttgcctcactgg

SEQ ID NO: 337342 - DNA, 25 bp, Homo sapien
ctggtttgcctcactggttggtggt

SEQ ID NO: 337343 - DNA, 25 bp, Homo sapien
caagggccaaccaccgcaaggagct

SEQ ID NO: 337344 - DNA, 25 bp, Homo sapien
cgccggcgtcggtgccgtcaaagaa

SEQ ID NO: 337345 - DNA, 25 bp, Homo sapien
ccgtcaaagaagatggccagggaga

SEQ ID NO: 337346 - DNA, 25 bp, Homo sapien
atccatactggtgtaaacccgtatc

SEQ ID NO: 337347 - DNA, 25 bp, Homo sapien
aaacccgtatccagattgactcttc

SEQ ID NO: 337348 - DNA, 25 bp, Homo sapien
gattgactcttctcttaacaaggac

SEQ ID NO: 337349 - DNA, 25 bp, Homo sapien
taacaaggacacacttggcgttagt

SEQ ID NO: 337350 - DNA, 25 bp, Homo sapien
cacacttggcgttagtatggatcta

SEQ ID NO: 337351 - DNA, 25 bp, Homo sapien
tatggatctagcctcaaagaccctc

SEQ ID NO: 337352 - DNA, 25 bp, Homo sapien
aagaccctcgtcacagatgaagcag

SEQ ID NO: 337353 - DNA, 25 bp, Homo sapien
gatgaagcagcccatcgtgaccagt

SEQ ID NO: 337354 - DNA, 25 bp, Homo sapien
atcgtgaccagtcgaggccttagga

SEQ ID NO: 337355 - DNA, 25 bp, Homo sapien
cagtcgaggccttaggaccgcagga

SEQ ID NO: 337356 - DNA, 25 bp, Homo sapien
taggaccgcaggaggaatgtctcag

SEQ ID NO: 337357 - DNA, 25 bp, Homo sapien
caaagtttgaattaaggcctatggt

SEQ ID NO: 337358 - DNA, 25 bp, Homo sapien
aggtaacattgctttgttgtacttt

SEQ ID NO: 337359 - DNA, 25 bp, Homo sapien
gtacttttgaacaagagctcctcct

SEQ ID NO: 337360 - DNA, 25 bp, Homo sapien
gctcctcctgatcactattacatat

SEQ ID NO: 337361 - DNA, 25 bp, Homo sapien
gcaattgaatcttctagctttagca

SEQ ID NO: 337362 - DNA, 25 bp, Homo sapien
gaaagccacgaagaatgcagaagtc

SEQ ID NO: 337363 - DNA, 25 bp, Homo sapien
tgcagaagtcaaaccctcatgacaa

SEQ ID NO: 337364 - DNA, 25 bp, Homo sapien
ggcacaagtctacaataagctaaat

SEQ ID NO: 337365 - DNA, 25 bp, Homo sapien
caaatacaagtgtcccaggtagcat

SEQ ID NO: 337366 - DNA, 25 bp, Homo sapien
aagtgtcccaggtagcattgactcc

SEQ ID NO: 337367 - DNA, 25 bp, Homo sapien
gcattgactcccgtcattggagtga

SEQ ID NO: 337368 - DNA, 25 bp, Homo sapien
ttattttttagataggtagcctgca

SEQ ID NO: 337369 - DNA, 25 bp, Homo sapien
ataggtagcctgcaacataaaatat

SEQ ID NO: 337370 - DNA, 25 bp, Homo sapien
tcacatttagtgactcagatccctt

SEQ ID NO: 337371 - DNA, 25 bp, Homo sapien
actcagatccctttgtgtaagtcct

SEQ ID NO: 337372 - DNA, 25 bp, Homo sapien
agatccctttgtgtaagtcctttgc

SEQ ID NO: 337373 - DNA, 25 bp, Homo sapien
tccctttgtgtaagtcctttgcgtt

SEQ ID NO: 337374 - DNA, 25 bp, Homo sapien
ttgcgttgtgcaaagaggtttttct

SEQ ID NO: 337375 - DNA, 25 bp, Homo sapien
gcaaagaggtttttctatgagatga

SEQ ID NO: 337376 - DNA, 25 bp, Homo sapien
gaacacttcatataggtaaattcca

SEQ ID NO: 337377 - DNA, 25 bp, Homo sapien
ggtaaattccataggttgagctggg

SEQ ID NO: 337378 - DNA, 25 bp, Homo sapien
gcagaaattaatggctcctggagat

SEQ ID NO: 337379 - DNA, 25 bp, Homo sapien
tagtgatgtgtcactgtgggttcag

SEQ ID NO: 337380 - DNA, 25 bp, Homo sapien
atgtgtcactgtgggttcagggatt

SEQ ID NO: 337381 - DNA, 25 bp, Homo sapien
tgtcactgtgggttcagggattgta

SEQ ID NO: 337382 - DNA, 25 bp, Homo sapien
gggattgtaataaatctaccactgt

SEQ ID NO: 337383 - DNA, 25 bp, Homo sapien
aataaatctaccactgtagtgtggg

SEQ ID NO: 337384 - DNA, 25 bp, Homo sapien
gacacatgagaactctaccttctgc

SEQ ID NO: 337385 - DNA, 25 bp, Homo sapien
aaactactctgcctgatgctgtgat

SEQ ID NO: 337386 - DNA, 25 bp, Homo sapien
tactctgcctgatgctgtgatggtg

SEQ ID NO: 337387 - DNA, 25 bp, Homo sapien
cctgatgctgtgatggtggagacat

SEQ ID NO: 337388 - DNA, 25 bp, Homo sapien
gagacatcattacacatttatccaa

SEQ ID NO: 337389 - DNA, 25 bp, Homo sapien
gacatcattacacatttatccaaac

SEQ ID NO: 337390 - DNA, 25 bp, Homo sapien
tttccagccttacctctagtggctc

SEQ ID NO: 337391 - DNA, 25 bp, Homo sapien
atgccccttggcaggtcagagcaca

SEQ ID NO: 337392 - DNA, 25 bp, Homo sapien
ttggcaggtcagagcacactcagct

SEQ ID NO: 337393 - DNA, 25 bp, Homo sapien
aggtcagagcacactcagctttttc

SEQ ID NO: 337394 - DNA, 25 bp, Homo sapien
gagcacactcagctttttcccactt

SEQ ID NO: 337395 - DNA, 25 bp, Homo sapien
cacagacttcctccagccagagtgg

SEQ ID NO: 337396 - DNA, 25 bp, Homo sapien
tccagccagagtggcagaagacaga

SEQ ID NO: 337397 - DNA, 25 bp, Homo sapien
acagagaagcatgtccaggatttgg

SEQ ID NO: 337398 - DNA, 25 bp, Homo sapien
gcatgtccaggatttggaccagact

SEQ ID NO: 337399 - DNA, 25 bp, Homo sapien
aggaaagtcagcctcatctgcaaag

SEQ ID NO: 337400 - DNA, 25 bp, Homo sapien
ggaaagtcagcctcatctgcaaagc

SEQ ID NO: 337401 - DNA, 25 bp, Homo sapien
gaagcttattggagagtgagtgcca

SEQ ID NO: 337402 - DNA, 25 bp, Homo sapien
gagtgagtgccaatggaactccata

SEQ ID NO: 337403 - DNA, 25 bp, Homo sapien
tggaactccataggtgacaccataa

SEQ ID NO: 337404 - DNA, 25 bp, Homo sapien
gagatctaggaagggcagctactgc

SEQ ID NO: 337405 - DNA, 25 bp, Homo sapien
tgctatgcctgcagtgtctctctag

SEQ ID NO: 337406 - DNA, 25 bp, Homo sapien
atgcctgcagtgtctctctagtgcc

SEQ ID NO: 337407 - DNA, 25 bp, Homo sapien
tagtgccctctgctgataagcctaa

SEQ ID NO: 337408 - DNA, 25 bp, Homo sapien
gctgataagcctaacattgcaccag

SEQ ID NO: 337409 - DNA, 25 bp, Homo sapien
atgagaaatgttcatgggatccaga

SEQ ID NO: 337410 - DNA, 25 bp, Homo sapien
gaaagattgctttggactaaggagc

SEQ ID NO: 337411 - DNA, 25 bp, Homo sapien
ttgataactggcacagtgttaccct

SEQ ID NO: 337412 - DNA, 25 bp, Homo sapien
gtttgttttcaagcatttttaacag

SEQ ID NO: 337413 - DNA, 25 bp, Homo sapien
gcatttttaacagttttacacactt

SEQ ID NO: 337414 - DNA, 25 bp, Homo sapien
taacagttttacacacttacataca

SEQ ID NO: 337415 - DNA, 25 bp, Homo sapien
ctaatttgacaaatcatgacactag

SEQ ID NO: 337416 - DNA, 25 bp, Homo sapien
aatcatgacactagaaaacgccaat

SEQ ID NO: 337417 - DNA, 25 bp, Homo sapien
gaaaacgccaatgttttatgtcttt

SEQ ID NO: 337418 - DNA, 25 bp, Homo sapien
tatgtctttgcccatctcaaaagct

SEQ ID NO: 337419 - DNA, 25 bp, Homo sapien
gtctttgcccatctcaaaagctaat

SEQ ID NO: 337420 - DNA, 25 bp, Homo sapien
ttgcccatctcaaaagctaatattg

SEQ ID NO: 337421 - DNA, 25 bp, Homo sapien
ccatcagctttcattgttaagtaga

SEQ ID NO: 337422 - DNA, 25 bp, Homo sapien
gaatatgtatgttgcattttatcca

SEQ ID NO: 337423 - DNA, 25 bp, Homo sapien
aatttatgatgttgctttccactcg

SEQ ID NO: 337424 - DNA, 25 bp, Homo sapien
gatgttgctttccactcgtcaaaag

SEQ ID NO: 337425 - DNA, 25 bp, Homo sapien
gagctgatgctcttgccaaagtatt

SEQ ID NO: 337426 - DNA, 25 bp, Homo sapien
gcatcgtaacaagatttgcttggac

SEQ ID NO: 337427 - DNA, 25 bp, Homo sapien
gaaagagggtctgcatcactgccat

SEQ ID NO: 337428 - DNA, 25 bp, Homo sapien
gcatcactgccatcagaaaggttac

SEQ ID NO: 337429 - DNA, 25 bp, Homo sapien
gaaaggttactgatatgacactaca

SEQ ID NO: 337430 - DNA, 25 bp, Homo sapien
tatgacactacatgtgatctgcctg

SEQ ID NO: 337431 - DNA, 25 bp, Homo sapien
gatctgcctggtgaaggctatctgg

SEQ ID NO: 337432 - DNA, 25 bp, Homo sapien
ggaaatcacatcttaatgtcaagct

SEQ ID NO: 337433 - DNA, 25 bp, Homo sapien
tgtcaagctcattaagttaactgta

SEQ ID NO: 337434 - DNA, 25 bp, Homo sapien
gcaccaggttcaaggtacccggctg

SEQ ID NO: 337435 - DNA, 25 bp, Homo sapien
aggttcaaggtacccggctgtcctg

SEQ ID NO: 337436 - DNA, 25 bp, Homo sapien
tgcgctgggcttgccgggactctct

SEQ ID NO: 337437 - DNA, 25 bp, Homo sapien
ggactctctcggctctgcatagttg

SEQ ID NO: 337438 - DNA, 25 bp, Homo sapien
tctcggctctgcatagttgcacttg

SEQ ID NO: 337439 - DNA, 25 bp, Homo sapien
ggctctgcatagttgcacttggctt

SEQ ID NO: 337440 - DNA, 25 bp, Homo sapien
ctgcatagttgcacttggcttcacc

SEQ ID NO: 337441 - DNA, 25 bp, Homo sapien
atagttgcacttggcttcacccgtg

SEQ ID NO: 337442 - DNA, 25 bp, Homo sapien
gttgcacttggcttcacccgtgtga

SEQ ID NO: 337443 - DNA, 25 bp, Homo sapien
ggcttcacccgtgtgactttcgtaa

SEQ ID NO: 337444 - DNA, 25 bp, Homo sapien
ttcacccgtgtgactttcgtaacgg

SEQ ID NO: 337445 - DNA, 25 bp, Homo sapien
gcagggaacatagagctatcagcaa

SEQ ID NO: 337446 - DNA, 25 bp, Homo sapien
tagagctatcagcaaatatttgtga

SEQ ID NO: 337447 - DNA, 25 bp, Homo sapien
ggataggttgctagtcttcttcacc

SEQ ID NO: 337448 - DNA, 25 bp, Homo sapien
tcttcaccaccatttaaacggtatt

SEQ ID NO: 337449 - DNA, 25 bp, Homo sapien
taaacggtatttactgccagaatta

SEQ ID NO: 337450 - DNA, 25 bp, Homo sapien
taatgctgctactaaacactaagtg

SEQ ID NO: 337451 - DNA, 25 bp, Homo sapien
aacactaagtgttcgtcagattgca

SEQ ID NO: 337452 - DNA, 25 bp, Homo sapien
gttcgtcagattgcacaaagacatt

SEQ ID NO: 337453 - DNA, 25 bp, Homo sapien
caaagacattagattctgttcactt

SEQ ID NO: 337454 - DNA, 25 bp, Homo sapien
tctgttcacttagtgcctctggaac

SEQ ID NO: 337455 - DNA, 25 bp, Homo sapien
agtgcctctggaacatcttataata

SEQ ID NO: 337456 - DNA, 25 bp, Homo sapien
ctaccctggtggtcataaaataggc

SEQ ID NO: 337457 - DNA, 25 bp, Homo sapien
aggccttttactcttccatctcgtc

SEQ ID NO: 337458 - DNA, 25 bp, Homo sapien
agccccgagttgacccacgttgctg

SEQ ID NO: 337459 - DNA, 25 bp, Homo sapien
ttgctgctcctcacaccatggtgat

SEQ ID NO: 337460 - DNA, 25 bp, Homo sapien
acaccatggtgatgcaggtctcgta

SEQ ID NO: 337461 - DNA, 25 bp, Homo sapien
atgcaggtctcgtagtgtgggcaca

SEQ ID NO: 337462 - DNA, 25 bp, Homo sapien
tacctcatctttttagtgcctctct

SEQ ID NO: 337463 - DNA, 25 bp, Homo sapien
agctggccccgtagttgagcatgtg

SEQ ID NO: 337464 - DNA, 25 bp, Homo sapien
agttgagcatgtgtggttatcctgt

SEQ ID NO: 337465 - DNA, 25 bp, Homo sapien
gttatcctgtagagcttttcccaag

SEQ ID NO: 337466 - DNA, 25 bp, Homo sapien
gggtgtttgaacttagagtcttaat

SEQ ID NO: 337467 - DNA, 25 bp, Homo sapien
gtatttgtagaagattatgtgttgt

SEQ ID NO: 337468 - DNA, 25 bp, Homo sapien
agaatatgacctatttatctgaagt

SEQ ID NO: 337469 - DNA, 25 bp, Homo sapien
aatatgacctatttatctgaagttt

SEQ ID NO: 337470 - DNA, 25 bp, Homo sapien
attgtttatacctaatacagttctt

SEQ ID NO: 337471 - DNA, 25 bp, Homo sapien
ttatacctaatacagttctttttgg

SEQ ID NO: 337472 - DNA, 25 bp, Homo sapien
cagttctttttggagtaagaatgat

SEQ ID NO: 337473 - DNA, 25 bp, Homo sapien
gattatataatcgttatccatttgg

SEQ ID NO: 337474 - DNA, 25 bp, Homo sapien
atataatcgttatccatttgggtat

SEQ ID NO: 337475 - DNA, 25 bp, Homo sapien
taatcgttatccatttgggtataaa

SEQ ID NO: 337476 - DNA, 25 bp, Homo sapien
tttttccctttgattagtatgtgtt

SEQ ID NO: 337477 - DNA, 25 bp, Homo sapien
tttccctttgattagtatgtgttac

SEQ ID NO: 337478 - DNA, 25 bp, Homo sapien
tgccctgtatctttgcctctggtgt

SEQ ID NO: 337479 - DNA, 25 bp, Homo sapien
gtatctttgcctctggtgtttcgtt

SEQ ID NO: 337480 - DNA, 25 bp, Homo sapien
gcctctggtgtttcgttgttgttgt

SEQ ID NO: 337481 - DNA, 25 bp, Homo sapien
caaagaagttggagttaaggacaca

SEQ ID NO: 337482 - DNA, 25 bp, Homo sapien
aggacacaatatatttgtaccccta

SEQ ID NO: 337483 - DNA, 25 bp, Homo sapien
gtacccctagactgaatgggtgagt

SEQ ID NO: 337484 - DNA, 25 bp, Homo sapien
gactgaatgggtgagtattccatat

SEQ ID NO: 337485 - DNA, 25 bp, Homo sapien
gagtattccatatgaggatctgggt

SEQ ID NO: 337486 - DNA, 25 bp, Homo sapien
ggatctgggtaatcctctttgcaac

SEQ ID NO: 337487 - DNA, 25 bp, Homo sapien
taatcctctttgcaacccacatttg

SEQ ID NO: 337488 - DNA, 25 bp, Homo sapien
ctctttgcaacccacatttggtctt

SEQ ID NO: 337489 - DNA, 25 bp, Homo sapien
gaaagctgctattttcatcctcctt

SEQ ID NO: 337490 - DNA, 25 bp, Homo sapien
aagctgctattttcatcctccttgt

SEQ ID NO: 337491 - DNA, 25 bp, Homo sapien
ttcttgtttctcttccattgtacat

SEQ ID NO: 337492 - DNA, 25 bp, Homo sapien
ttgtttctcttccattgtacatgtg

SEQ ID NO: 337493 - DNA, 25 bp, Homo sapien
tttctcttccattgtacatgtgggt

SEQ ID NO: 337494 - DNA, 25 bp, Homo sapien
gggttatataccatatgttaaatat

SEQ ID NO: 337495 - DNA, 25 bp, Homo sapien
ttgcagtttaagcacaatgtgcaca

SEQ ID NO: 337496 - DNA, 25 bp, Homo sapien
aacttgattttttgcagatggaaag

SEQ ID NO: 337497 - DNA, 25 bp, Homo sapien
gtaaatggattgtttgtgcttaatg

SEQ ID NO: 337498 - DNA, 25 bp, Homo sapien
gtttgtgcttaatgtaaagccgctt

SEQ ID NO: 337499 - DNA, 25 bp, Homo sapien
tgtaaagccgctttataaaactgta

SEQ ID NO: 337500 - DNA, 25 bp, Homo sapien
gggttacaggcatgcgctaccacac

SEQ ID NO: 337501 - DNA, 25 bp, Homo sapien
cacctggctagttttttattgttgt

SEQ ID NO: 337502 - DNA, 25 bp, Homo sapien
ttttagtggtgacggggtttgctct

SEQ ID NO: 337503 - DNA, 25 bp, Homo sapien
tttagtggtgacggggtttgctctg

SEQ ID NO: 337504 - DNA, 25 bp, Homo sapien
ttagtggtgacggggtttgctctgt

SEQ ID NO: 337505 - DNA, 25 bp, Homo sapien
tagtggtgacggggtttgctctgtt

SEQ ID NO: 337506 - DNA, 25 bp, Homo sapien
agtggtgacggggtttgctctgttg

SEQ ID NO: 337507 - DNA, 25 bp, Homo sapien
gtggtgacggggtttgctctgttgg

SEQ ID NO: 337508 - DNA, 25 bp, Homo sapien
tggtgacggggtttgctctgttggc

SEQ ID NO: 337509 - DNA, 25 bp, Homo sapien
ggtgacggggtttgctctgttggcc

SEQ ID NO: 337510 - DNA, 25 bp, Homo sapien
gtgacggggtttgctctgttggcca

SEQ ID NO: 337511 - DNA, 25 bp, Homo sapien
aagtctagatatcgagccatcccag

SEQ ID NO: 337512 - DNA, 25 bp, Homo sapien
atatcgagccatcccaggtgttggg

SEQ ID NO: 337513 - DNA, 25 bp, Homo sapien
ggttgtggcaagattgtcttttcaa

SEQ ID NO: 337514 - DNA, 25 bp, Homo sapien
ttttcctgtggctacaaggcaagta

SEQ ID NO: 337515 - DNA, 25 bp, Homo sapien
tgactgtaagcgttggacaccttca

SEQ ID NO: 337516 - DNA, 25 bp, Homo sapien
ggacaccttcatagtgtagtgtttt

SEQ ID NO: 337517 - DNA, 25 bp, Homo sapien
atacggttcttgtaaattagatacg

SEQ ID NO: 337518 - DNA, 25 bp, Homo sapien
tagatacgtgtagtggtgtttcaga

SEQ ID NO: 337519 - DNA, 25 bp, Homo sapien
atgtttgtttatgcactagttcaga

SEQ ID NO: 337520 - DNA, 25 bp, Homo sapien
gcactagttcagacaactttccctg

SEQ ID NO: 337521 - DNA, 25 bp, Homo sapien
actttccctgttacttgttcttgat

SEQ ID NO: 337522 - DNA, 25 bp, Homo sapien
gagacccacggcaggcctgaagaag

SEQ ID NO: 337523 - DNA, 25 bp, Homo sapien
tgcaccatgctcatagaggatgtgg

SEQ ID NO: 337524 - DNA, 25 bp, Homo sapien
atgtggatgccctcaagtcctggct

SEQ ID NO: 337525 - DNA, 25 bp, Homo sapien
gccctcaagtcctggctggccaagt

SEQ ID NO: 337526 - DNA, 25 bp, Homo sapien
caagttactggagccgatatgtgat

SEQ ID NO: 337527 - DNA, 25 bp, Homo sapien
gccgatatgtgatgctgatccttca

SEQ ID NO: 337528 - DNA, 25 bp, Homo sapien
tgatccttcagccttagccaactat

SEQ ID NO: 337529 - DNA, 25 bp, Homo sapien
ttcagccttagccaactatgttgta

SEQ ID NO: 337530 - DNA, 25 bp, Homo sapien
gccaactatgttgtagcactggtca

SEQ ID NO: 337531 - DNA, 25 bp, Homo sapien
gaagtctcctaagatgcccggtggg

SEQ ID NO: 337532 - DNA, 25 bp, Homo sapien
gtctcctaagatgcccggtgggctg

SEQ ID NO: 337533 - DNA, 25 bp, Homo sapien
ttgccaacatccagagcgacatcgg

SEQ ID NO: 337534 - DNA, 25 bp, Homo sapien
agcgacatcggagccagcgagaact

SEQ ID NO: 337535 - DNA, 25 bp, Homo sapien
gcgagaactcagatggcgacatggt

SEQ ID NO: 337536 - DNA, 25 bp, Homo sapien
gcgacatggtggtcagctgctcagc

SEQ ID NO: 337537 - DNA, 25 bp, Homo sapien
gacatcgtcttcaccatcaatggag

SEQ ID NO: 337538 - DNA, 25 bp, Homo sapien
atcaatggagtccagtaccccgtgc

SEQ ID NO: 337539 - DNA, 25 bp, Homo sapien
gagctgcatcagtggcttccagggc

SEQ ID NO: 337540 - DNA, 25 bp, Homo sapien
ggacagcatcaccatgaacggagag

SEQ ID NO: 337541 - DNA, 25 bp, Homo sapien
aacggagaggccatcgcctgcgctg

SEQ ID NO: 337542 - DNA, 25 bp, Homo sapien
tgccaggccattgttgacaccggca

SEQ ID NO: 337543 - DNA, 25 bp, Homo sapien
gttgacaccggcacctctctgctga

SEQ ID NO: 337544 - DNA, 25 bp, Homo sapien
tccctgtagcaacacctctgggtgt

SEQ ID NO: 337545 - DNA, 25 bp, Homo sapien
acctctgggtgtttggagtttagct

SEQ ID NO: 337546 - DNA, 25 bp, Homo sapien
agcttttgtgggtttgctctcccta

SEQ ID NO: 337547 - DNA, 25 bp, Homo sapien
tatcccatctcctgtactacacagt

SEQ ID NO: 337548 - DNA, 25 bp, Homo sapien
tgtactacacagttcatggcagggt

SEQ ID NO: 337549 - DNA, 25 bp, Homo sapien
agggtctttttcctctgtgtgcgat

SEQ ID NO: 337550 - DNA, 25 bp, Homo sapien
ttttcctctgtgtgcgatgttgtta

SEQ ID NO: 337551 - DNA, 25 bp, Homo sapien
ctgtgtgcgatgttgttatctgaca

SEQ ID NO: 337552 - DNA, 25 bp, Homo sapien
gttatctgacagttctccgtcccta

SEQ ID NO: 337553 - DNA, 25 bp, Homo sapien
tttctcctcgtcttcatatttgtac

SEQ ID NO: 337554 - DNA, 25 bp, Homo sapien
tcgtcttcatatttgtacggtacaa

SEQ ID NO: 337555 - DNA, 25 bp, Homo sapien
aaagctcacatagatatgacttggg

SEQ ID NO: 337556 - DNA, 25 bp, Homo sapien
tatgacttgggaagtgacaccagtt

SEQ ID NO: 337557 - DNA, 25 bp, Homo sapien
cccaataaattgttgtgtgtgcttt

SEQ ID NO: 337558 - DNA, 25 bp, Homo sapien
ttgttgtgtgtgctttctaaataat

SEQ ID NO: 337559 - DNA, 25 bp, Homo sapien
attacttgctcccattgccaaaggt

SEQ ID NO: 337560 - DNA, 25 bp, Homo sapien
tgctcccattgccaaaggtgtgttt

SEQ ID NO: 337561 - DNA, 25 bp, Homo sapien
aaggtgtgtttgctgtatgtcgtca

SEQ ID NO: 337562 - DNA, 25 bp, Homo sapien
gtttgctgtatgtcgtcagttgtgc

SEQ ID NO: 337563 - DNA, 25 bp, Homo sapien
gtcgtcagttgtgcagtttgctatt

SEQ ID NO: 337564 - DNA, 25 bp, Homo sapien
gacaaacatagtcattttgggctga

SEQ ID NO: 337565 - DNA, 25 bp, Homo sapien
acatagtcattttgggctgagtttt

SEQ ID NO: 337566 - DNA, 25 bp, Homo sapien
acttctgcttttccctatcttgaag

SEQ ID NO: 337567 - DNA, 25 bp, Homo sapien
ttctgcttttccctatcttgaagta

SEQ ID NO: 337568 - DNA, 25 bp, Homo sapien
ctgcttttccctatcttgaagtaaa

SEQ ID NO: 337569 - DNA, 25 bp, Homo sapien
gcttttccctatcttgaagtaaaat

SEQ ID NO: 337570 - DNA, 25 bp, Homo sapien
tttccctatcttgaagtaaaatgca

SEQ ID NO: 337571 - DNA, 25 bp, Homo sapien
gcatatgtatagttaatttatcgaa

SEQ ID NO: 337572 - DNA, 25 bp, Homo sapien
aatttatcgaaaacacaggacagtg

SEQ ID NO: 337573 - DNA, 25 bp, Homo sapien
cacaggacagtgtagtgttctagga

SEQ ID NO: 337574 - DNA, 25 bp, Homo sapien
caggacagtgtagtgttctaggaat

SEQ ID NO: 337575 - DNA, 25 bp, Homo sapien
acagtgtagtgttctaggaatgagc

SEQ ID NO: 337576 - DNA, 25 bp, Homo sapien
gtgtagtgttctaggaatgagctat

SEQ ID NO: 337577 - DNA, 25 bp, Homo sapien
gttaccaacaagacagatcctcgct

SEQ ID NO: 337578 - DNA, 25 bp, Homo sapien
aagacagatcctcgctccatgaact

SEQ ID NO: 337579 - DNA, 25 bp, Homo sapien
atgaactcccgtgtattcattggga

SEQ ID NO: 337580 - DNA, 25 bp, Homo sapien
gggaatctcaacactcttgtggtca

SEQ ID NO: 337581 - DNA, 25 bp, Homo sapien
ggtcaagaaatctgatgtggaggca

SEQ ID NO: 337582 - DNA, 25 bp, Homo sapien
ctgatgtggaggcaatcttttcgaa

SEQ ID NO: 337583 - DNA, 25 bp, Homo sapien
aaattgtgggctgctctgttcataa

SEQ ID NO: 337584 - DNA, 25 bp, Homo sapien
ctttgccttcgttcagtatgttaat

SEQ ID NO: 337585 - DNA, 25 bp, Homo sapien
gcagaatgattgctggccaggtttt

SEQ ID NO: 337586 - DNA, 25 bp, Homo sapien
tagatattaacctggctgcagagcc

SEQ ID NO: 337587 - DNA, 25 bp, Homo sapien
caggtgtgaaacgatctgcagcgga

SEQ ID NO: 337588 - DNA, 25 bp, Homo sapien
cagaggagccccaccagggagcagc

SEQ ID NO: 337589 - DNA, 25 bp, Homo sapien
agacctgcagagtcaaccaagcaca

SEQ ID NO: 337590 - DNA, 25 bp, Homo sapien
caagcacaggttagagtcccaggac

SEQ ID NO: 337591 - DNA, 25 bp, Homo sapien
gtcccaggaccggaaaccaactgtg

SEQ ID NO: 337592 - DNA, 25 bp, Homo sapien
actgtgggctttctgtacttctcat

SEQ ID NO: 337593 - DNA, 25 bp, Homo sapien
tttctgtacttctcatagctttgga

SEQ ID NO: 337594 - DNA, 25 bp, Homo sapien
catagctttggagtctggctgtcca

SEQ ID NO: 337595 - DNA, 25 bp, Homo sapien
tggctgtccatcaggaggtcccgag

SEQ ID NO: 337596 - DNA, 25 bp, Homo sapien
tggcctcaataaaaccaggtgcatg

SEQ ID NO: 337597 - DNA, 25 bp, Homo sapien
aggtgcatgcctgttcttccatcca

SEQ ID NO: 337598 - DNA, 25 bp, Homo sapien
agctgacaggcaccatcaactggca

SEQ ID NO: 337599 - DNA, 25 bp, Homo sapien
tgagatcctgccatgcagtgttgcg

SEQ ID NO: 337600 - DNA, 25 bp, Homo sapien
ccatgcagtgttgcggtggcactga

SEQ ID NO: 337601 - DNA, 25 bp, Homo sapien
gtgaggagccactaaacctttccgt

SEQ ID NO: 337602 - DNA, 25 bp, Homo sapien
gccactaaacctttccgtgcctaga

SEQ ID NO: 337603 - DNA, 25 bp, Homo sapien
ctagacctccccatctgtggaatgg

SEQ ID NO: 337604 - DNA, 25 bp, Homo sapien
ggaatggggtcaataccacctacct

SEQ ID NO: 337605 - DNA, 25 bp, Homo sapien
taatactcagatgtgggagcgacat

SEQ ID NO: 337606 - DNA, 25 bp, Homo sapien
tgtgggagcgacatcaatgaaatct

SEQ ID NO: 337607 - DNA, 25 bp, Homo sapien
gcgacatcaatgaaatctgtactgt

SEQ ID NO: 337608 - DNA, 25 bp, Homo sapien
atctgtactgtatgaaagctacaca

SEQ ID NO: 337609 - DNA, 25 bp, Homo sapien
aagctacacaaaaatgggcagacat

SEQ ID NO: 337610 - DNA, 25 bp, Homo sapien
attgtaatctttgtgctgtatgggt

SEQ ID NO: 337611 - DNA, 25 bp, Homo sapien
gtaatctttgtgctgtatgggttga

SEQ ID NO: 337612 - DNA, 25 bp, Homo sapien
tgtgctgtatgggttgagcatcatt

SEQ ID NO: 337613 - DNA, 25 bp, Homo sapien
gctgtatgggttgagcatcattata

SEQ ID NO: 337614 - DNA, 25 bp, Homo sapien
gtatgggttgagcatcattatatat

SEQ ID NO: 337615 - DNA, 25 bp, Homo sapien
atgggttgagcatcattatatattt

SEQ ID NO: 337616 - DNA, 25 bp, Homo sapien
gtatgtgtacataaatagcaaagtg

SEQ ID NO: 337617 - DNA, 25 bp, Homo sapien
gtgtacataaatagcaaagtggcaa

SEQ ID NO: 337618 - DNA, 25 bp, Homo sapien
aagttcatcctgcataagtataaaa

SEQ ID NO: 337619 - DNA, 25 bp, Homo sapien
tcctgcataagtataaaatgtgttg

SEQ ID NO: 337620 - DNA, 25 bp, Homo sapien
tatttaaaacttgccttttgtgagg

SEQ ID NO: 337621 - DNA, 25 bp, Homo sapien
gtggaatgcccagccgtaagtgaca

SEQ ID NO: 337622 - DNA, 25 bp, Homo sapien
gaatgcccagccgtaagtgacattt

SEQ ID NO: 337623 - DNA, 25 bp, Homo sapien
gcccagccgtaagtgacattttcat

SEQ ID NO: 337624 - DNA, 25 bp, Homo sapien
cagccgtaagtgacattttcattgt

SEQ ID NO: 337625 - DNA, 25 bp, Homo sapien
gtgacattttcattgttacagtagg

SEQ ID NO: 337626 - DNA, 25 bp, Homo sapien
cccagtgtattcacagagataagct

SEQ ID NO: 337627 - DNA, 25 bp, Homo sapien
tcacagagataagctgggaagtttt

SEQ ID NO: 337628 - DNA, 25 bp, Homo sapien
gaagttttggaaatggttactggtg

SEQ ID NO: 337629 - DNA, 25 bp, Homo sapien
tttttctttcccacagagttaagca

SEQ ID NO: 337630 - DNA, 25 bp, Homo sapien
ttctttcccacagagttaagcacaa

SEQ ID NO: 337631 - DNA, 25 bp, Homo sapien
tttcccacagagttaagcacaaagg

SEQ ID NO: 337632 - DNA, 25 bp, Homo sapien
acgttaccaacaagacagatcctcg

SEQ ID NO: 337633 - DNA, 25 bp, Homo sapien
gttaccaacaagacagatcctcgct

SEQ ID NO: 337634 - DNA, 25 bp, Homo sapien
ttaccaacaagacagatcctcgctc

SEQ ID NO: 337635 - DNA, 25 bp, Homo sapien
caacaagacagatcctcgctccatg

SEQ ID NO: 337636 - DNA, 25 bp, Homo sapien
aacaagacagatcctcgctccatga

SEQ ID NO: 337637 - DNA, 25 bp, Homo sapien
acaagacagatcctcgctccatgaa

SEQ ID NO: 337638 - DNA, 25 bp, Homo sapien
caagacagatcctcgctccatgaac

SEQ ID NO: 337639 - DNA, 25 bp, Homo sapien
aagacagatcctcgctccatgaact

SEQ ID NO: 337640 - DNA, 25 bp, Homo sapien
atctgatgtggaggcaatcttttcg

SEQ ID NO: 337641 - DNA, 25 bp, Homo sapien
ctgatgtggaggcaatcttttcgaa

SEQ ID NO: 337642 - DNA, 25 bp, Homo sapien
tgatgtggaggcaatcttttcgaag

SEQ ID NO: 337643 - DNA, 25 bp, Homo sapien
cagccacagcaaatgataaaaaacg

SEQ ID NO: 337644 - DNA, 25 bp, Homo sapien
gccacagcaaatgataaaaaacgtc

SEQ ID NO: 337645 - DNA, 25 bp, Homo sapien
aatgataaaaaacgtcagttctcct

SEQ ID NO: 337646 - DNA, 25 bp, Homo sapien
agaagttagaaatctctggcattga

SEQ ID NO: 337647 - DNA, 25 bp, Homo sapien
gaagttagaaatctctggcattgaa

SEQ ID NO: 337648 - DNA, 25 bp, Homo sapien
aagttagaaatctctggcattgaag

SEQ ID NO: 337649 - DNA, 25 bp, Homo sapien
agttagaaatctctggcattgaaga

SEQ ID NO: 337650 - DNA, 25 bp, Homo sapien
tcacagaaagaaggtggttcacaga

SEQ ID NO: 337651 - DNA, 25 bp, Homo sapien
acagaaagaaggtggttcacagaac

SEQ ID NO: 337652 - DNA, 25 bp, Homo sapien
cagaaagaaggtggttcacagaaca

SEQ ID NO: 337653 - DNA, 25 bp, Homo sapien
agaaagaaggtggttcacagaacag

SEQ ID NO: 337654 - DNA, 25 bp, Homo sapien
tgatccatagtattttagtaacaga

SEQ ID NO: 337655 - DNA, 25 bp, Homo sapien
gtaacagatttcctaatatcgaatg

SEQ ID NO: 337656 - DNA, 25 bp, Homo sapien
atcgaatgatctaggcattgattct

SEQ ID NO: 337657 - DNA, 25 bp, Homo sapien
ggcattgattctagcagattatgtc

SEQ ID NO: 337658 - DNA, 25 bp, Homo sapien
ctagcagattatgtctatgggtatt

SEQ ID NO: 337659 - DNA, 25 bp, Homo sapien
atggtctatgggtttgcttttttgt

SEQ ID NO: 337660 - DNA, 25 bp, Homo sapien
gcttttttgtgtgctatgtttgcag

SEQ ID NO: 337661 - DNA, 25 bp, Homo sapien
gtttgcagagtgtttgtagtttaca

SEQ ID NO: 337662 - DNA, 25 bp, Homo sapien
gatttttgcaaacttctatttatga

SEQ ID NO: 337663 - DNA, 25 bp, Homo sapien
aaaaccttctcattacagaacatat

SEQ ID NO: 337664 - DNA, 25 bp, Homo sapien
actgctgaataaaacgaggcaacca

SEQ ID NO: 337665 - DNA, 25 bp, Homo sapien
atgccctttttcttaactccatttg

SEQ ID NO: 337666 - DNA, 25 bp, Homo sapien
ttaactccatttgaaccagctcaca

SEQ ID NO: 337667 - DNA, 25 bp, Homo sapien
tccatttgaaccagctcacatcgat

SEQ ID NO: 337668 - DNA, 25 bp, Homo sapien
gaaccagctcacatcgatgggcaca

SEQ ID NO: 337669 - DNA, 25 bp, Homo sapien
gctcacatcgatgggcacaagcgtc

SEQ ID NO: 337670 - DNA, 25 bp, Homo sapien
atgggcacaagcgtcgccaggaaat

SEQ ID NO: 337671 - DNA, 25 bp, Homo sapien
aagcgtcgccaggaaattcagtgtg

SEQ ID NO: 337672 - DNA, 25 bp, Homo sapien
attcagtgtggtaagcttggcacct

SEQ ID NO: 337673 - DNA, 25 bp, Homo sapien
agtgtggtaagcttggcacctactc

SEQ ID NO: 337674 - DNA, 25 bp, Homo sapien
ggtaagcttggcacctactcatggc

SEQ ID NO: 337675 - DNA, 25 bp, Homo sapien
tactcatggccaccgtgtcctgaac

SEQ ID NO: 337676 - DNA, 25 bp, Homo sapien
acctggagctgacctgtggtgacca

SEQ ID NO: 337677 - DNA, 25 bp, Homo sapien
ctgtggtgaccaggtgtgccgtcaa

SEQ ID NO: 337678 - DNA, 25 bp, Homo sapien
accaggtgtgccgtcaagtgttcaa

SEQ ID NO: 337679 - DNA, 25 bp, Homo sapien
cgtgggaggcctgccaagcacaagc

SEQ ID NO: 337680 - DNA, 25 bp, Homo sapien
gggaccttcccactcttgacagagc

SEQ ID NO: 337681 - DNA, 25 bp, Homo sapien
ttgacagagccccattaaggcatct

SEQ ID NO: 337682 - DNA, 25 bp, Homo sapien
cattaaggcatctgggtgggtttta

SEQ ID NO: 337683 - DNA, 25 bp, Homo sapien
aacagaatgcctatgtagcagtgat

SEQ ID NO: 337684 - DNA, 25 bp, Homo sapien
agcagtgatagacatattcccctcc

SEQ ID NO: 337685 - DNA, 25 bp, Homo sapien
tgatagacatattcccctcctttga

SEQ ID NO: 337686 - DNA, 25 bp, Homo sapien
tcccctcctttgaaacctagcatta

SEQ ID NO: 337687 - DNA, 25 bp, Homo sapien
actctgcacagctattgactctatt

SEQ ID NO: 337688 - DNA, 25 bp, Homo sapien
tgtatggactgctcggcagacacca

SEQ ID NO: 337689 - DNA, 25 bp, Homo sapien
tgaccaaccgccttctccaaaggag

SEQ ID NO: 337690 - DNA, 25 bp, Homo sapien
ttctccaaaggagccggagcagcct

SEQ ID NO: 337691 - DNA, 25 bp, Homo sapien
gagcagcctgcctgtggacgacacc

SEQ ID NO: 337692 - DNA, 25 bp, Homo sapien
gtggacgacaccaccaagaccatcg

SEQ ID NO: 337693 - DNA, 25 bp, Homo sapien
agaccatcgccaagcgcctagaagc

SEQ ID NO: 337694 - DNA, 25 bp, Homo sapien
tagaagcctactaccgagcgtccat

SEQ ID NO: 337695 - DNA, 25 bp, Homo sapien
ccgtgatcgcctactacgagacaaa

SEQ ID NO: 337696 - DNA, 25 bp, Homo sapien
gaacaccagaggacgtttttcttca

SEQ ID NO: 337697 - DNA, 25 bp, Homo sapien
tttttcttcaactctgcacagctat

SEQ ID NO: 337698 - DNA, 25 bp, Homo sapien
atcctgtcatattttggtgaataga

SEQ ID NO: 337699 - DNA, 25 bp, Homo sapien
atgagttggtatatcacttttaggg

SEQ ID NO: 337700 - DNA, 25 bp, Homo sapien
ggtatatcacttttagggggccatt

SEQ ID NO: 337701 - DNA, 25 bp, Homo sapien
acttcagtttgttcgtataacctgt

SEQ ID NO: 337702 - DNA, 25 bp, Homo sapien
gtttgttcgtataacctgtcattca

SEQ ID NO: 337703 - DNA, 25 bp, Homo sapien
gttcgtataacctgtcattcacata

SEQ ID NO: 337704 - DNA, 25 bp, Homo sapien
ataacctgtcattcacatattgagt

SEQ ID NO: 337705 - DNA, 25 bp, Homo sapien
gtcattcacatattgagtgcctact

SEQ ID NO: 337706 - DNA, 25 bp, Homo sapien
gagtgcctactatgtcctaaatatt

SEQ ID NO: 337707 - DNA, 25 bp, Homo sapien
gtgcctactatgtcctaaatattgg

SEQ ID NO: 337708 - DNA, 25 bp, Homo sapien
aacatgaaacaccttgaaccccatt

SEQ ID NO: 337709 - DNA, 25 bp, Homo sapien
ggtttgaatcctgctgtatgactga

SEQ ID NO: 337710 - DNA, 25 bp, Homo sapien
gaatcctgctgtatgactgatgtta

SEQ ID NO: 337711 - DNA, 25 bp, Homo sapien
atgactgatgttatcctggattcct

SEQ ID NO: 337712 - DNA, 25 bp, Homo sapien
gatgttatcctggattcctgatcct

SEQ ID NO: 337713 - DNA, 25 bp, Homo sapien
tatcctggattcctgatccttttag

SEQ ID NO: 337714 - DNA, 25 bp, Homo sapien
gattcctgatccttttagttctgct

SEQ ID NO: 337715 - DNA, 25 bp, Homo sapien
ttttagttctgctctgctcttttct

SEQ ID NO: 337716 - DNA, 25 bp, Homo sapien
ttctgctctgctcttttctggtaaa

SEQ ID NO: 337717 - DNA, 25 bp, Homo sapien
tgctctgctcttttctggtaaatat

SEQ ID NO: 337718 - DNA, 25 bp, Homo sapien
gaaagtaggatgctaccagccctct

SEQ ID NO: 337719 - DNA, 25 bp, Homo sapien
atgctaccagccctcttaaataaag

SEQ ID NO: 337720 - DNA, 25 bp, Homo sapien
aggagtatgtttaactgaaaagctc

SEQ ID NO: 337721 - DNA, 25 bp, Homo sapien
actgaaaagctcatattttctttca

SEQ ID NO: 337722 - DNA, 25 bp, Homo sapien
tcatttttgggcaattcttaaggta

SEQ ID NO: 337723 - DNA, 25 bp, Homo sapien
taatgttgcatgataaagcccccat

SEQ ID NO: 337724 - DNA, 25 bp, Homo sapien
taaagcccccatcaagtatctcata

SEQ ID NO: 337725 - DNA, 25 bp, Homo sapien
gcaaagacctcaaatcattgtggct

SEQ ID NO: 337726 - DNA, 25 bp, Homo sapien
cattgtggctttattgcagctttcc

SEQ ID NO: 337727 - DNA, 25 bp, Homo sapien
ggctttattgcagctttccttcaaa

SEQ ID NO: 337728 - DNA, 25 bp, Homo sapien
ttattgcagctttccttcaaaatat

SEQ ID NO: 337729 - DNA, 25 bp, Homo sapien
ggcctcttttacttcgcttaaatgt

SEQ ID NO: 337730 - DNA, 25 bp, Homo sapien
acttcgcttaaatgtccaattttag

SEQ ID NO: 337731 - DNA, 25 bp, Homo sapien
aaccctgagctttttgctcgtcttg

SEQ ID NO: 337732 - DNA, 25 bp, Homo sapien
agctttttgctcgtcttggtagcag

SEQ ID NO: 337733 - DNA, 25 bp, Homo sapien
ttgctcgtcttggtagcagatatct

SEQ ID NO: 337734 - DNA, 25 bp, Homo sapien
gtgattttacttcattgttcttgca

SEQ ID NO: 337735 - DNA, 25 bp, Homo sapien
acttcattgttcttgcatccttgag

SEQ ID NO: 337736 - DNA, 25 bp, Homo sapien
gcatccttgaggctacagtataaat

SEQ ID NO: 337737 - DNA, 25 bp, Homo sapien
aggctacagtataaatcatctccaa

SEQ ID NO: 337738 - DNA, 25 bp, Homo sapien
tcatctccaaacttgactactattg

SEQ ID NO: 337739 - DNA, 25 bp, Homo sapien
actactattgggaagatgtgtataa

SEQ ID NO: 337740 - DNA, 25 bp, Homo sapien
taaaagcatcgctttgggaattttt

SEQ ID NO: 337741 - DNA, 25 bp, Homo sapien
acacccaaaaatgcagttctaaaat

SEQ ID NO: 337742 - DNA, 25 bp, Homo sapien
tactcgcccctactgagcgtcaaga

SEQ ID NO: 337743 - DNA, 25 bp, Homo sapien
gatccctcattctagcttgggtgtc

SEQ ID NO: 337744 - DNA, 25 bp, Homo sapien
tagcttgggtgtcccctctactgag

SEQ ID NO: 337745 - DNA, 25 bp, Homo sapien
gggtgtcccctctactgaggactct

SEQ ID NO: 337746 - DNA, 25 bp, Homo sapien
aacaatgaacagctgtcttcatact

SEQ ID NO: 337747 - DNA, 25 bp, Homo sapien
tgaacagctgtcttcatacttaaaa

SEQ ID NO: 337748 - DNA, 25 bp, Homo sapien
aaggatcacagcagtactcatgatg

SEQ ID NO: 337749 - DNA, 25 bp, Homo sapien
atgagaaggatcctttggctgcccc

SEQ ID NO: 337750 - DNA, 25 bp, Homo sapien
tttcagagccttcacgcacttcacg

SEQ ID NO: 337751 - DNA, 25 bp, Homo sapien
acttcacgcggacttctcggtgctg

SEQ ID NO: 337752 - DNA, 25 bp, Homo sapien
cacgcggacttctcggtgctggtga

SEQ ID NO: 337753 - DNA, 25 bp, Homo sapien
actaactcgcacaaggttcgaggcc

SEQ ID NO: 337754 - DNA, 25 bp, Homo sapien
ctaactcgcacaaggttcgaggccg

SEQ ID NO: 337755 - DNA, 25 bp, Homo sapien
taactcgcacaaggttcgaggccga

SEQ ID NO: 337756 - DNA, 25 bp, Homo sapien
aactcgcacaaggttcgaggccgag

SEQ ID NO: 337757 - DNA, 25 bp, Homo sapien
actcgcacaaggttcgaggccgagc

SEQ ID NO: 337758 - DNA, 25 bp, Homo sapien
agagcttgtggaccactggcttgct

SEQ ID NO: 337759 - DNA, 25 bp, Homo sapien
gagcttgtggaccactggcttgctc

SEQ ID NO: 337760 - DNA, 25 bp, Homo sapien
agcttgtggaccactggcttgctca

SEQ ID NO: 337761 - DNA, 25 bp, Homo sapien
gcttgtggaccactggcttgctcac

SEQ ID NO: 337762 - DNA, 25 bp, Homo sapien
cttgtggaccactggcttgctcact

SEQ ID NO: 337763 - DNA, 25 bp, Homo sapien
ttgtggaccactggcttgctcactg

SEQ ID NO: 337764 - DNA, 25 bp, Homo sapien
tgctttggagctatcagatttgcat

SEQ ID NO: 337765 - DNA, 25 bp, Homo sapien
gttagagaaatgactctggtctcag

SEQ ID NO: 337766 - DNA, 25 bp, Homo sapien
agaaatgactctggtctcagtggag

SEQ ID NO: 337767 - DNA, 25 bp, Homo sapien
agagtggactgaagagggcaagaat

SEQ ID NO: 337768 - DNA, 25 bp, Homo sapien
tggaagccgggaagagtgaacagaa

SEQ ID NO: 337769 - DNA, 25 bp, Homo sapien
gaacagaagaaatcttgggctttga

SEQ ID NO: 337770 - DNA, 25 bp, Homo sapien
aatcttgggctttgattgggtcgga

SEQ ID NO: 337771 - DNA, 25 bp, Homo sapien
tcttgggctttgattgggtcggaaa

SEQ ID NO: 337772 - DNA, 25 bp, Homo sapien
tgggtcggaaagaaagtgtggccct

SEQ ID NO: 337773 - DNA, 25 bp, Homo sapien
tctccgcacctgtgcctaagaagct

SEQ ID NO: 337774 - DNA, 25 bp, Homo sapien
acctgtgcctaagaagctgctcatg

SEQ ID NO: 337775 - DNA, 25 bp, Homo sapien
catcgtcatcccagtgctgatcttc

SEQ ID NO: 337776 - DNA, 25 bp, Homo sapien
tcatcccagtgctgatcttccaggc

SEQ ID NO: 337777 - DNA, 25 bp, Homo sapien
atcccagtgctgatcttccaggcct

SEQ ID NO: 337778 - DNA, 25 bp, Homo sapien
ccagtgctgatcttccaggcctatg

SEQ ID NO: 337779 - DNA, 25 bp, Homo sapien
agtgctgatcttccaggcctatgga

SEQ ID NO: 337780 - DNA, 25 bp, Homo sapien
tgctgatcttccaggcctatggata

SEQ ID NO: 337781 - DNA, 25 bp, Homo sapien
gctgatcttccaggcctatggatag

SEQ ID NO: 337782 - DNA, 25 bp, Homo sapien
gatcttccaggcctatggatagatc

SEQ ID NO: 337783 - DNA, 25 bp, Homo sapien
tcttccaggcctatggatagatcag

SEQ ID NO: 337784 - DNA, 25 bp, Homo sapien
ccaggcctatggatagatcaggagg

SEQ ID NO: 337785 - DNA, 25 bp, Homo sapien
ccccggagccgagtcctgtatcagc

SEQ ID NO: 337786 - DNA, 25 bp, Homo sapien
gaccatgtcaagatttatgcctgtg

SEQ ID NO: 337787 - DNA, 25 bp, Homo sapien
tatgcctgtgagatgggttgcagaa

SEQ ID NO: 337788 - DNA, 25 bp, Homo sapien
gttgcagaattgacctgagcagacc

SEQ ID NO: 337789 - DNA, 25 bp, Homo sapien
gcagaccaggcttccgagggtcaaa

SEQ ID NO: 337790 - DNA, 25 bp, Homo sapien
cttccgagggtcaaaaaagcgtctg

SEQ ID NO: 337791 - DNA, 25 bp, Homo sapien
aaagcgtctgaaggagagacactga

SEQ ID NO: 337792 - DNA, 25 bp, Homo sapien
agacactgagtgcattctgggttca

SEQ ID NO: 337793 - DNA, 25 bp, Homo sapien
agtgcattctgggttcacattcccc

SEQ ID NO: 337794 - DNA, 25 bp, Homo sapien
ctcctctactgcattcctgaatttt

SEQ ID NO: 337795 - DNA, 25 bp, Homo sapien
gcctcacagcggcatctgaagcagt

SEQ ID NO: 337796 - DNA, 25 bp, Homo sapien
actgcaactcattcatacgagaaac

SEQ ID NO: 337797 - DNA, 25 bp, Homo sapien
tctccgcacctgtgcctaagaagct

SEQ ID NO: 337798 - DNA, 25 bp, Homo sapien
ctccgcacctgtgcctaagaagctg

SEQ ID NO: 337799 - DNA, 25 bp, Homo sapien
tccgcacctgtgcctaagaagctgc

SEQ ID NO: 337800 - DNA, 25 bp, Homo sapien
ccgcacctgtgcctaagaagctgct

SEQ ID NO: 337801 - DNA, 25 bp, Homo sapien
cgcacctgtgcctaagaagctgctc

SEQ ID NO: 337802 - DNA, 25 bp, Homo sapien
gcacctgtgcctaagaagctgctca

SEQ ID NO: 337803 - DNA, 25 bp, Homo sapien
cacctgtgcctaagaagctgctcat

SEQ ID NO: 337804 - DNA, 25 bp, Homo sapien
acctgtgcctaagaagctgctcatg

SEQ ID NO: 337805 - DNA, 25 bp, Homo sapien
aagtgaggccctacctgacccagaa

SEQ ID NO: 337806 - DNA, 25 bp, Homo sapien
ggtccgcccgttatgccgtggccca

SEQ ID NO: 337807 - DNA, 25 bp, Homo sapien
ctttggatcaccagcagtcacagac

SEQ ID NO: 337808 - DNA, 25 bp, Homo sapien
gcagtcacagacaacaggcaggcga

SEQ ID NO: 337809 - DNA, 25 bp, Homo sapien
agtcacagacaacaggcaggcgaaa

SEQ ID NO: 337810 - DNA, 25 bp, Homo sapien
tcacagacaacaggcaggcgaaact

SEQ ID NO: 337811 - DNA, 25 bp, Homo sapien
ccagcggaccctccagagcaaaaga

SEQ ID NO: 337812 - DNA, 25 bp, Homo sapien
cagagcaaaagaggcccccggcgag

SEQ ID NO: 337813 - DNA, 25 bp, Homo sapien
cgaggccacctgtcggcaggcatgc

SEQ ID NO: 337814 - DNA, 25 bp, Homo sapien
ggcaggcatgccgaggtcaaacagc

SEQ ID NO: 337815 - DNA, 25 bp, Homo sapien
aggcatgccgaggtcaaacagccgg

SEQ ID NO: 337816 - DNA, 25 bp, Homo sapien
gatacttttaaagcgtctgaagcgg

SEQ ID NO: 337817 - DNA, 25 bp, Homo sapien
ttaaagcgtctgaagcgggatgaag

SEQ ID NO: 337818 - DNA, 25 bp, Homo sapien
aaggatctgatctctgaagctgcgg

SEQ ID NO: 337819 - DNA, 25 bp, Homo sapien
tgatctctgaagctgcggtcaccac

SEQ ID NO: 337820 - DNA, 25 bp, Homo sapien
accacccacaagttgtggccttgga

SEQ ID NO: 337821 - DNA, 25 bp, Homo sapien
tggccttggataccacactgcagtt

SEQ ID NO: 337822 - DNA, 25 bp, Homo sapien
gaccgggcagccagaaaaatcattt

SEQ ID NO: 337823 - DNA, 25 bp, Homo sapien
ttttccttatctttaccgactgtgt

SEQ ID NO: 337824 - DNA, 25 bp, Homo sapien
ttatctttaccgactgtgttaattg

SEQ ID NO: 337825 - DNA, 25 bp, Homo sapien
taccgactgtgttaattgataattt

SEQ ID NO: 337826 - DNA, 25 bp, Homo sapien
gaaggtgaacatttgtagcattgat

SEQ ID NO: 337827 - DNA, 25 bp, Homo sapien
gcggtcggaccgtccagattctgga

SEQ ID NO: 337828 - DNA, 25 bp, Homo sapien
gaagacaccaaacgttctcagaatg

SEQ ID NO: 337829 - DNA, 25 bp, Homo sapien
tcagaatgccgaacgcgggcgccac

SEQ ID NO: 337830 - DNA, 25 bp, Homo sapien
ccacctggtgggactagaacgctta

SEQ ID NO: 337831 - DNA, 25 bp, Homo sapien
gaacgcttattgtcccaaatcagca

SEQ ID NO: 337832 - DNA, 25 bp, Homo sapien
aatcagcatagcacacagttcccat

SEQ ID NO: 337833 - DNA, 25 bp, Homo sapien
gcacacagttcccataaatcttaaa

SEQ ID NO: 337834 - DNA, 25 bp, Homo sapien
aaaaattcccatccaaggctcattt

SEQ ID NO: 337835 - DNA, 25 bp, Homo sapien
caaggctcatttccgtgtgactaaa

SEQ ID NO: 337836 - DNA, 25 bp, Homo sapien
aaagtcatattctctgttctcgtga

SEQ ID NO: 337837 - DNA, 25 bp, Homo sapien
aatttcctgttagatgggtggtaag

SEQ ID NO: 337838 - DNA, 25 bp, Homo sapien
acccaccgtgtgacaggtgttattt

SEQ ID NO: 337839 - DNA, 25 bp, Homo sapien
caggtgttatttgttggcggaacca

SEQ ID NO: 337840 - DNA, 25 bp, Homo sapien
ggcggaaccaggcatcatcagcaaa

SEQ ID NO: 337841 - DNA, 25 bp, Homo sapien
tgccctctgtggaaggcatctgagg

SEQ ID NO: 337842 - DNA, 25 bp, Homo sapien
actggattttgtagcaacatgttat

SEQ ID NO: 337843 - DNA, 25 bp, Homo sapien
gcaacatgttattctcattataaac

SEQ ID NO: 337844 - DNA, 25 bp, Homo sapien
gaatactaaagccaaatcatccccc

SEQ ID NO: 337845 - DNA, 25 bp, Homo sapien
tccttgatcaggatacccacttaat

SEQ ID NO: 337846 - DNA, 25 bp, Homo sapien
ggatacccacttaatctaggcagct

SEQ ID NO: 337847 - DNA, 25 bp, Homo sapien
aatctaggcagctacacaattgtga

SEQ ID NO: 337848 - DNA, 25 bp, Homo sapien
gcagctacacaattgtgagagcctt

SEQ ID NO: 337849 - DNA, 25 bp, Homo sapien
gagcataggatggagcaattcaacg

SEQ ID NO: 337850 - DNA, 25 bp, Homo sapien
ggatggagcaattcaacgactatag

SEQ ID NO: 337851 - DNA, 25 bp, Homo sapien
attcaacgactataggtcgcccttt

SEQ ID NO: 337852 - DNA, 25 bp, Homo sapien
aacgactataggtcgccctttcagt

SEQ ID NO: 337853 - DNA, 25 bp, Homo sapien
tataggtcgccctttcagtaaagct

SEQ ID NO: 337854 - DNA, 25 bp, Homo sapien
aggtcgccctttcagtaaagctctg

SEQ ID NO: 337855 - DNA, 25 bp, Homo sapien
gccctttcagtaaagctctgtgtca

SEQ ID NO: 337856 - DNA, 25 bp, Homo sapien
tgcaacctcccttctaggagatggc

SEQ ID NO: 337857 - DNA, 25 bp, Homo sapien
tcaaaagaaggacatgggcaggtac

SEQ ID NO: 337858 - DNA, 25 bp, Homo sapien
gatgcccaccatggagtgatacttt

SEQ ID NO: 337859 - DNA, 25 bp, Homo sapien
ccaccatggagtgatactttgcagg

SEQ ID NO: 337860 - DNA, 25 bp, Homo sapien
atctggcagaattgttgctgcaccc

SEQ ID NO: 337861 - DNA, 25 bp, Homo sapien
ggcagaattgttgctgcacccttat

SEQ ID NO: 337862 - DNA, 25 bp, Homo sapien
cagaattgttgctgcacccttatcc

SEQ ID NO: 337863 - DNA, 25 bp, Homo sapien
ctgcacccttatcccagttataaga

SEQ ID NO: 337864 - DNA, 25 bp, Homo sapien
gcacccttatcccagttataagaca

SEQ ID NO: 337865 - DNA, 25 bp, Homo sapien
atcccagttataagacagtcaaaat

SEQ ID NO: 337866 - DNA, 25 bp, Homo sapien
gtcaaaatgactatttcctaaatat

SEQ ID NO: 337867 - DNA, 25 bp, Homo sapien
tcctaaatattgtgagtgtatgaaa

SEQ ID NO: 337868 - DNA, 25 bp, Homo sapien
aagcaaaaactggagacttttaatg

SEQ ID NO: 337869 - DNA, 25 bp, Homo sapien
aacactgttctaaaaagcaaggagt

SEQ ID NO: 337870 - DNA, 25 bp, Homo sapien
ctgttctaaaaagcaaggagtcaag

SEQ ID NO: 337871 - DNA, 25 bp, Homo sapien
attttctgccaaggaggccttccgg

SEQ ID NO: 337872 - DNA, 25 bp, Homo sapien
ctactacacctacctcaacgaggga

SEQ ID NO: 337873 - DNA, 25 bp, Homo sapien
acctcaacgagggatttctcagctt

SEQ ID NO: 337874 - DNA, 25 bp, Homo sapien
atttctcagcttgtggcgcgggaac

SEQ ID NO: 337875 - DNA, 25 bp, Homo sapien
aactcggccaccatggtgcgcgtgg

SEQ ID NO: 337876 - DNA, 25 bp, Homo sapien
accatggtgcgcgtggtgccctacg

SEQ ID NO: 337877 - DNA, 25 bp, Homo sapien
agttcagcgcacacgaggagtacaa

SEQ ID NO: 337878 - DNA, 25 bp, Homo sapien
gagtacaagcgcatcctgggcagct

SEQ ID NO: 337879 - DNA, 25 bp, Homo sapien
atcctgggcagctactatggcttcc

SEQ ID NO: 337880 - DNA, 25 bp, Homo sapien
cagctactatggcttccgtggagaa

SEQ ID NO: 337881 - DNA, 25 bp, Homo sapien
aaaacagcggtcatgcccctggacc

SEQ ID NO: 337882 - DNA, 25 bp, Homo sapien
tttacctaggcgcttgtctaagatc

SEQ ID NO: 337883 - DNA, 25 bp, Homo sapien
ttacctaggcgcttgtctaagatca

SEQ ID NO: 337884 - DNA, 25 bp, Homo sapien
tacctaggcgcttgtctaagatcaa

SEQ ID NO: 337885 - DNA, 25 bp, Homo sapien
acctaggcgcttgtctaagatcaaa

SEQ ID NO: 337886 - DNA, 25 bp, Homo sapien
cctaggcgcttgtctaagatcaaat

SEQ ID NO: 337887 - DNA, 25 bp, Homo sapien
ctaggcgcttgtctaagatcaaatt

SEQ ID NO: 337888 - DNA, 25 bp, Homo sapien
taggcgcttgtctaagatcaaattt

SEQ ID NO: 337889 - DNA, 25 bp, Homo sapien
aggcgcttgtctaagatcaaatttt

SEQ ID NO: 337890 - DNA, 25 bp, Homo sapien
ccgatctggacgtccctgaagcagg

SEQ ID NO: 337891 - DNA, 25 bp, Homo sapien
agacatgttcttgtggcgcttctcg

SEQ ID NO: 337892 - DNA, 25 bp, Homo sapien
ttgtggcgcttctcgaagcggttgt

SEQ ID NO: 337893 - DNA, 25 bp, Homo sapien
ttctcgaagcggttgtacttgcgga

SEQ ID NO: 337894 - DNA, 25 bp, Homo sapien
aagcggttgtacttgcggatgtagt

SEQ ID NO: 337895 - DNA, 25 bp, Homo sapien
ttgtacttgcggatgtagtgcagat

SEQ ID NO: 337896 - DNA, 25 bp, Homo sapien
tgtagtgcagatagtctcggcggat

SEQ ID NO: 337897 - DNA, 25 bp, Homo sapien
agtctcggcggatgacaatggtcct

SEQ ID NO: 337898 - DNA, 25 bp, Homo sapien
ggcggatgacaatggtcctctgcat

SEQ ID NO: 337899 - DNA, 25 bp, Homo sapien
atgacaatggtcctctgcatcttca

SEQ ID NO: 337900 - DNA, 25 bp, Homo sapien
aatggtcctctgcatcttcatcttg

SEQ ID NO: 337901 - DNA, 25 bp, Homo sapien
aaagatcatgtatacccagcgggcc

SEQ ID NO: 337902 - DNA, 25 bp, Homo sapien
gagcgcacagcagcagtgttctgta

SEQ ID NO: 337903 - DNA, 25 bp, Homo sapien
cagtgttctgtagctggactgcctg

SEQ ID NO: 337904 - DNA, 25 bp, Homo sapien
gaatccaggtctagcacttaactct

SEQ ID NO: 337905 - DNA, 25 bp, Homo sapien
tagcacttaactctgcagccttgag

SEQ ID NO: 337906 - DNA, 25 bp, Homo sapien
agccttgagcaattacctttctgtg

SEQ ID NO: 337907 - DNA, 25 bp, Homo sapien
aacagtaccacctagattgtagtgt

SEQ ID NO: 337908 - DNA, 25 bp, Homo sapien
tgacaatttgaagaatccacctaag

SEQ ID NO: 337909 - DNA, 25 bp, Homo sapien
gaatccacctaagtacaagtttgta

SEQ ID NO: 337910 - DNA, 25 bp, Homo sapien
caagtttgtaccacactggtgacta

SEQ ID NO: 337911 - DNA, 25 bp, Homo sapien
cacactggtgactagtgtttttccc

SEQ ID NO: 337912 - DNA, 25 bp, Homo sapien
catgtggaacaacttgtccaaaatc

SEQ ID NO: 337913 - DNA, 25 bp, Homo sapien
agcccattactcaaagtttgcacct

SEQ ID NO: 337914 - DNA, 25 bp, Homo sapien
aaagtttgcacctgctatcatgcag

SEQ ID NO: 337915 - DNA, 25 bp, Homo sapien
tgctatcatgcaggctttaaagatt

SEQ ID NO: 337916 - DNA, 25 bp, Homo sapien
tcaatgagacttcatcaagtcagct

SEQ ID NO: 337917 - DNA, 25 bp, Homo sapien
aagtcagctctatttgctgggttca

SEQ ID NO: 337918 - DNA, 25 bp, Homo sapien
gctgggttcatacaatgcattacct

SEQ ID NO: 337919 - DNA, 25 bp, Homo sapien
atacaatgcattacctccactgcat

SEQ ID NO: 337920 - DNA, 25 bp, Homo sapien
tccactgcatgaggctttattagag

SEQ ID NO: 337921 - DNA, 25 bp, Homo sapien
agatggagtaccaggtctgtgcagc

SEQ ID NO: 337922 - DNA, 25 bp, Homo sapien
accaggtctgtgcagctgatatgaa

SEQ ID NO: 337923 - DNA, 25 bp, Homo sapien
ttttcggccacacccaaaagagaca

SEQ ID NO: 337924 - DNA, 25 bp, Homo sapien
ggccacacccaaaagagacattcaa

SEQ ID NO: 337925 - DNA, 25 bp, Homo sapien
tttcttggaggttgtgcagccttct

SEQ ID NO: 337926 - DNA, 25 bp, Homo sapien
tggaggttgtgcagccttctcaatc

SEQ ID NO: 337927 - DNA, 25 bp, Homo sapien
gttgtgcagccttctcaatcctcat

SEQ ID NO: 337928 - DNA, 25 bp, Homo sapien
aatcctcatcctctaggcgattgga

SEQ ID NO: 337929 - DNA, 25 bp, Homo sapien
atcctctaggcgattggagacccaa

SEQ ID NO: 337930 - DNA, 25 bp, Homo sapien
ttggagacccaaggaatattttaag

SEQ ID NO: 337931 - DNA, 25 bp, Homo sapien
acagacacttctggaacctgggctt

SEQ ID NO: 337932 - DNA, 25 bp, Homo sapien
tggcttcaccctctgctaggttctt

SEQ ID NO: 337933 - DNA, 25 bp, Homo sapien
caccctctgctaggttctttcattt

SEQ ID NO: 337934 - DNA, 25 bp, Homo sapien
tgacctatgaccacatcactgtacg

SEQ ID NO: 337935 - DNA, 25 bp, Homo sapien
tatgaccacatcactgtacgccagc

SEQ ID NO: 337936 - DNA, 25 bp, Homo sapien
gtgttcggtgaaacaagtgggattt

SEQ ID NO: 337937 - DNA, 25 bp, Homo sapien
caagtgggattttctgggccagcaa

SEQ ID NO: 337938 - DNA, 25 bp, Homo sapien
tttctgggccagcaagtcttccaaa

SEQ ID NO: 337939 - DNA, 25 bp, Homo sapien
ctgtatatgatgcatcctgtctcca

SEQ ID NO: 337940 - DNA, 25 bp, Homo sapien
atatgatgcatcctgtctccatgtg

SEQ ID NO: 337941 - DNA, 25 bp, Homo sapien
tgatgcatcctgtctccatgtgtaa

SEQ ID NO: 337942 - DNA, 25 bp, Homo sapien
atgcatcctgtctccatgtgtaata

SEQ ID NO: 337943 - DNA, 25 bp, Homo sapien
gcatcctgtctccatgtgtaatata

SEQ ID NO: 337944 - DNA, 25 bp, Homo sapien
tcctgtctccatgtgtaatatattt

SEQ ID NO: 337945 - DNA, 25 bp, Homo sapien
tagagggcacgtgggaaattttcca

SEQ ID NO: 337946 - DNA, 25 bp, Homo sapien
gggaaattttccagcaatcaatgcc

SEQ ID NO: 337947 - DNA, 25 bp, Homo sapien
tttccagcaatcaatgccttgagaa

SEQ ID NO: 337948 - DNA, 25 bp, Homo sapien
gtgattttcaaaagatgggcttcaa

SEQ ID NO: 337949 - DNA, 25 bp, Homo sapien
taacatgttagtacttctacgactt

SEQ ID NO: 337950 - DNA, 25 bp, Homo sapien
tacttctacgactttggagccactg

SEQ ID NO: 337951 - DNA, 25 bp, Homo sapien
ggagccactgatgggtccactcatg

SEQ ID NO: 337952 - DNA, 25 bp, Homo sapien
gggtccactcatggcctcagctgag

SEQ ID NO: 337953 - DNA, 25 bp, Homo sapien
gagacgatgaacgtgtagctgacat

SEQ ID NO: 337954 - DNA, 25 bp, Homo sapien
gtagctgacatgcacgaagtttaat

SEQ ID NO: 337955 - DNA, 25 bp, Homo sapien
agtttaatttactcatgtccacggg

SEQ ID NO: 337956 - DNA, 25 bp, Homo sapien
gctggttacaaaactcgaggaataa

SEQ ID NO: 337957 - DNA, 25 bp, Homo sapien
aaggagatttagaagcagagctgcc

SEQ ID NO: 337958 - DNA, 25 bp, Homo sapien
ggagatttagaagcagagctgcccg

SEQ ID NO: 337959 - DNA, 25 bp, Homo sapien
agatttagaagcagagctgcccgca

SEQ ID NO: 337960 - DNA, 25 bp, Homo sapien
agcagagctgcccgcagcgaatact

SEQ ID NO: 337961 - DNA, 25 bp, Homo sapien
gttacaaaactcgaggaataagaag

SEQ ID NO: 337962 - DNA, 25 bp, Homo sapien
tgcaaatccggagaccttgcggcct

SEQ ID NO: 337963 - DNA, 25 bp, Homo sapien
gcaaatccggagaccttgcggcctc

SEQ ID NO: 337964 - DNA, 25 bp, Homo sapien
caaatccggagaccttgcggcctca

SEQ ID NO: 337965 - DNA, 25 bp, Homo sapien
aaatccggagaccttgcggcctcac

SEQ ID NO: 337966 - DNA, 25 bp, Homo sapien
atccggagaccttgcggcctcactg

SEQ ID NO: 337967 - DNA, 25 bp, Homo sapien
aaatctcaaaagtcaagtaagttag

SEQ ID NO: 337968 - DNA, 25 bp, Homo sapien
atttgctaaagtcatgtagctgaca

SEQ ID NO: 337969 - DNA, 25 bp, Homo sapien
atgtagctgacaatatagtgatgaa

SEQ ID NO: 337970 - DNA, 25 bp, Homo sapien
gtccacatccaaaactgaacttctg

SEQ ID NO: 337971 - DNA, 25 bp, Homo sapien
tgaacttctgtctaactaccctagt

SEQ ID NO: 337972 - DNA, 25 bp, Homo sapien
tctgtctaactaccctagtgggcct

SEQ ID NO: 337973 - DNA, 25 bp, Homo sapien
ctgcacctcttattcactatgctga

SEQ ID NO: 337974 - DNA, 25 bp, Homo sapien
cacctcttattcactatgctgacta

SEQ ID NO: 337975 - DNA, 25 bp, Homo sapien
tatgctgactaatggcatcatccac

SEQ ID NO: 337976 - DNA, 25 bp, Homo sapien
gttctgcagaattataggctaggct

SEQ ID NO: 337977 - DNA, 25 bp, Homo sapien
taggctaggctaaaaatctcaaaag

SEQ ID NO: 337978 - DNA, 25 bp, Homo sapien
tcagagtggtaggagctggccatca

SEQ ID NO: 337979 - DNA, 25 bp, Homo sapien
taggagctggccatcagtgagagct

SEQ ID NO: 337980 - DNA, 25 bp, Homo sapien
tggccatcagtgagagctgctccgt

SEQ ID NO: 337981 - DNA, 25 bp, Homo sapien
atcagtgagagctgctccgtgcctg

SEQ ID NO: 337982 - DNA, 25 bp, Homo sapien
gagagctgctccgtgcctggctgct

SEQ ID NO: 337983 - DNA, 25 bp, Homo sapien
gtggaccactggtttgcctcactgg

SEQ ID NO: 337984 - DNA, 25 bp, Homo sapien
ctggtttgcctcactggttggtggt

SEQ ID NO: 337985 - DNA, 25 bp, Homo sapien
caagggccaaccaccgcaaggagct

SEQ ID NO: 337986 - DNA, 25 bp, Homo sapien
cgccggcgtcggtgccgtcaaagaa

SEQ ID NO: 337987 - DNA, 25 bp, Homo sapien
gtcggtgccgtcaaagaagatggcc

SEQ ID NO: 337988 - DNA, 25 bp, Homo sapien
ccgtcaaagaagatggccagggaga

SEQ ID NO: 337989 - DNA, 25 bp, Homo sapien
atggcacgccctggttattctgtac

SEQ ID NO: 337990 - DNA, 25 bp, Homo sapien
tattctgtacccgtgatttgtggcg

SEQ ID NO: 337991 - DNA, 25 bp, Homo sapien
agacgttaagttgggtgacaccgag

SEQ ID NO: 337992 - DNA, 25 bp, Homo sapien
tgacaccgaggtgagccacggtcct

SEQ ID NO: 337993 - DNA, 25 bp, Homo sapien
acggtcctcggcaccagatgaggaa

SEQ ID NO: 337994 - DNA, 25 bp, Homo sapien
tccggttcatggattgtgacaacgc

SEQ ID NO: 337995 - DNA, 25 bp, Homo sapien
tgtgacaacgcacgctgacatcaag

SEQ ID NO: 337996 - DNA, 25 bp, Homo sapien
atcaagcagaccctgccgtcaggta

SEQ ID NO: 337997 - DNA, 25 bp, Homo sapien
gagggcaccacagtgaccaggaact

SEQ ID NO: 337998 - DNA, 25 bp, Homo sapien
gaccaggaactgctgtcctttcata

SEQ ID NO: 337999 - DNA, 25 bp, Homo sapien
gctgtcctttcataccaggttttag

SEQ ID NO: 338000 - DNA, 25 bp, Homo sapien
gatgaaacatgacctgatggccact

SEQ ID NO: 338001 - DNA, 25 bp, Homo sapien
agtccatcctagctgtccaggatga

SEQ ID NO: 338002 - DNA, 25 bp, Homo sapien
gcacttgagagctataatcacggga

SEQ ID NO: 338003 - DNA, 25 bp, Homo sapien
tggcctctttcctgatgggctaatt

SEQ ID NO: 338004 - DNA, 25 bp, Homo sapien
ttcctgatgggctaattgtcttggt

SEQ ID NO: 338005 - DNA, 25 bp, Homo sapien
gctaattgtcttggtttggtgtctc

SEQ ID NO: 338006 - DNA, 25 bp, Homo sapien
attgtcttggtttggtgtctcaggc

SEQ ID NO: 338007 - DNA, 25 bp, Homo sapien
cttggtttggtgtctcaggcccagg

SEQ ID NO: 338008 - DNA, 25 bp, Homo sapien
aaccatttattgttggaaagaccat

SEQ ID NO: 338009 - DNA, 25 bp, Homo sapien
ggaaagaccatctgtgcaacttgaa

SEQ ID NO: 338010 - DNA, 25 bp, Homo sapien
agaccatctgtgcaacttgaataca

SEQ ID NO: 338011 - DNA, 25 bp, Homo sapien
atctttctcgttgaccaatgggctt

SEQ ID NO: 338012 - DNA, 25 bp, Homo sapien
ttgaagcattaaggccacgccccta

SEQ ID NO: 338013 - DNA, 25 bp, Homo sapien
tattctgcattctactgtggccctg

SEQ ID NO: 338014 - DNA, 25 bp, Homo sapien
tgtggccctggttacgctgcctctg

SEQ ID NO: 338015 - DNA, 25 bp, Homo sapien
tctgggtcagttacgcagctgtctt

SEQ ID NO: 338016 - DNA, 25 bp, Homo sapien
gactggacgtgttgatcagcgctcg

SEQ ID NO: 338017 - DNA, 25 bp, Homo sapien
tcagcgctcgctgggatttggctga

SEQ ID NO: 338018 - DNA, 25 bp, Homo sapien
ctgggatttggctgacgtggcccca

SEQ ID NO: 338019 - DNA, 25 bp, Homo sapien
gacagagtaaattagctgcagccaa

SEQ ID NO: 338020 - DNA, 25 bp, Homo sapien
tattggcagagaaaccgccctggtg

SEQ ID NO: 338021 - DNA, 25 bp, Homo sapien
agaaaccgccctggtgttccagcag

SEQ ID NO: 338022 - DNA, 25 bp, Homo sapien
aattgaacttggtagaaatgcccac

SEQ ID NO: 338023 - DNA, 25 bp, Homo sapien
ttgaacttggtagaaatgcccacaa

SEQ ID NO: 338024 - DNA, 25 bp, Homo sapien
aacttggtagaaatgcccacaagaa

SEQ ID NO: 338025 - DNA, 25 bp, Homo sapien
gaaatgcccacaagaaaaatgcaga

SEQ ID NO: 338026 - DNA, 25 bp, Homo sapien
gcagaggcagaaggttaaatagtaa

SEQ ID NO: 338027 - DNA, 25 bp, Homo sapien
gaaggttaaatagtaaaactccatg

SEQ ID NO: 338028 - DNA, 25 bp, Homo sapien
aaaatgatgactgaactgaatctct

SEQ ID NO: 338029 - DNA, 25 bp, Homo sapien
gaactgaatctctgttgtaaaattg

SEQ ID NO: 338030 - DNA, 25 bp, Homo sapien
aactgaatctctgttgtaaaattga

SEQ ID NO: 338031 - DNA, 25 bp, Homo sapien
agcagattttatttagttcacggtg

SEQ ID NO: 338032 - DNA, 25 bp, Homo sapien
cagattttatttagttcacggtgaa

SEQ ID NO: 338033 - DNA, 25 bp, Homo sapien
ctatgcagactccaaatggggaggg

SEQ ID NO: 338034 - DNA, 25 bp, Homo sapien
tatgcagactccaaatggggagggt

SEQ ID NO: 338035 - DNA, 25 bp, Homo sapien
atgcagactccaaatggggagggtg

SEQ ID NO: 338036 - DNA, 25 bp, Homo sapien
gtaagggataaaaagctacaagttg

SEQ ID NO: 338037 - DNA, 25 bp, Homo sapien
taagggataaaaagctacaagttgg

SEQ ID NO: 338038 - DNA, 25 bp, Homo sapien
taaaaagctacaagttgggtacaat

SEQ ID NO: 338039 - DNA, 25 bp, Homo sapien
aaaaagctacaagttgggtacaatg

SEQ ID NO: 338040 - DNA, 25 bp, Homo sapien
aaaagctacaagttgggtacaatgt

SEQ ID NO: 338041 - DNA, 25 bp, Homo sapien
aaagctacaagttgggtacaatgta

SEQ ID NO: 338042 - DNA, 25 bp, Homo sapien
gggaccccgagcaaacacagtcctg

SEQ ID NO: 338043 - DNA, 25 bp, Homo sapien
gagcaaacacagtcctggagcgtgt

SEQ ID NO: 338044 - DNA, 25 bp, Homo sapien
gcaggagcagcggaagacagtcttc

SEQ ID NO: 338045 - DNA, 25 bp, Homo sapien
gaagacagtcttcgatcggcacaag

SEQ ID NO: 338046 - DNA, 25 bp, Homo sapien
gatcggcacaagatgctcagctaga

SEQ ID NO: 338047 - DNA, 25 bp, Homo sapien
aagatgctcagctagatgggctggt

SEQ ID NO: 338048 - DNA, 25 bp, Homo sapien
tgtggttgggtcaaggccccaacac

SEQ ID NO: 338049 - DNA, 25 bp, Homo sapien
ggtcaaggccccaacaccatggctg

SEQ ID NO: 338050 - DNA, 25 bp, Homo sapien
tgccagcttccaggctggacaaagc

SEQ ID NO: 338051 - DNA, 25 bp, Homo sapien
tcttccctttaaaagcctgtggcat

SEQ ID NO: 338052 - DNA, 25 bp, Homo sapien
tccttctccctaactttagaaatgt

SEQ ID NO: 338053 - DNA, 25 bp, Homo sapien
atcaactgtgggtacatatgcccag

SEQ ID NO: 338054 - DNA, 25 bp, Homo sapien
catatgcccagataatgactgtagt

SEQ ID NO: 338055 - DNA, 25 bp, Homo sapien
actgtagtaattagctgtctggttg

SEQ ID NO: 338056 - DNA, 25 bp, Homo sapien
tgtctggttggaagaatgtggctct

SEQ ID NO: 338057 - DNA, 25 bp, Homo sapien
ggctcttggaaatatttatggctgc

SEQ ID NO: 338058 - DNA, 25 bp, Homo sapien
ttatggctgcagtttcaactttgaa

SEQ ID NO: 338059 - DNA, 25 bp, Homo sapien
gaagctactaaagtgctgttccgaa

SEQ ID NO: 338060 - DNA, 25 bp, Homo sapien
gtgctgttccgaagaataggctgaa

SEQ ID NO: 338061 - DNA, 25 bp, Homo sapien
attattagctactttgttgggcaat

SEQ ID NO: 338062 - DNA, 25 bp, Homo sapien
tgttgggcaataggcaaaagtctat

SEQ ID NO: 338063 - DNA, 25 bp, Homo sapien
ggcaaaagtctatagcattttcatg

SEQ ID NO: 338064 - DNA, 25 bp, Homo sapien
ggtaccacaagtctggcaattctcc

SEQ ID NO: 338065 - DNA, 25 bp, Homo sapien
gcaattctccagttggtctaatcca

SEQ ID NO: 338066 - DNA, 25 bp, Homo sapien
atgtcacaatgtatagtcatgctag

SEQ ID NO: 338067 - DNA, 25 bp, Homo sapien
gtcatgctaggatccaagctgtgtc

SEQ ID NO: 338068 - DNA, 25 bp, Homo sapien
agctgtgtctctgaagcagcggttt

SEQ ID NO: 338069 - DNA, 25 bp, Homo sapien
aagcagcggtttcccctcgaacttg

SEQ ID NO: 338070 - DNA, 25 bp, Homo sapien
ttggccgacaccaccaggactcgga

SEQ ID NO: 338071 - DNA, 25 bp, Homo sapien
aggactcggaagctacaggagcaac

SEQ ID NO: 338072 - DNA, 25 bp, Homo sapien
caacggttgagggtcgtgtcctcca

SEQ ID NO: 338073 - DNA, 25 bp, Homo sapien
cacctcctaccgagcggaagaatat

SEQ ID NO: 338074 - DNA, 25 bp, Homo sapien
tatctgttcaacaatcagcgtgagt

SEQ ID NO: 338075 - DNA, 25 bp, Homo sapien
cctgtttgggctgttgccacttaaa

SEQ ID NO: 338076 - DNA, 25 bp, Homo sapien
ttcatgaccacaaatgtccacagtg

SEQ ID NO: 338077 - DNA, 25 bp, Homo sapien
ttcctctgaggaaactcgaatcctg

SEQ ID NO: 338078 - DNA, 25 bp, Homo sapien
gataactggcttatgacaccttgaa

SEQ ID NO: 338079 - DNA, 25 bp, Homo sapien
gtgctcatataacacaccacactga

SEQ ID NO: 338080 - DNA, 25 bp, Homo sapien
cccctttcctacagcaatatgttca

SEQ ID NO: 338081 - DNA, 25 bp, Homo sapien
gcaatatgttcactatgttaccaat

SEQ ID NO: 338082 - DNA, 25 bp, Homo sapien
gtgagacacacatcatttggcattt

SEQ ID NO: 338083 - DNA, 25 bp, Homo sapien
tcacagtaatgctgccgttgttcgg

SEQ ID NO: 338084 - DNA, 25 bp, Homo sapien
gttgttcgggacttaaagacacttg

SEQ ID NO: 338085 - DNA, 25 bp, Homo sapien
aagacacttgacctgtttgggctgt

SEQ ID NO: 338086 - DNA, 25 bp, Homo sapien
tgtgtgtagtaatacctcattgtgg

SEQ ID NO: 338087 - DNA, 25 bp, Homo sapien
gattctgttaccttcaggtaatcac

SEQ ID NO: 338088 - DNA, 25 bp, Homo sapien
ttctgttaccttcaggtaatcactg

SEQ ID NO: 338089 - DNA, 25 bp, Homo sapien
tgttaccttcaggtaatcactgtta

SEQ ID NO: 338090 - DNA, 25 bp, Homo sapien
atcactgttaaatttggtgcatttt

SEQ ID NO: 338091 - DNA, 25 bp, Homo sapien
atttggtgcattttatcctaacctg

SEQ ID NO: 338092 - DNA, 25 bp, Homo sapien
ttatcctaacctgtaaagttatgtt

SEQ ID NO: 338093 - DNA, 25 bp, Homo sapien
tcctaacctgtaaagttatgttatt

SEQ ID NO: 338094 - DNA, 25 bp, Homo sapien
aatttgtatttatctaatggctgtt

SEQ ID NO: 338095 - DNA, 25 bp, Homo sapien
tttgtatttatctaatggctgttga

SEQ ID NO: 338096 - DNA, 25 bp, Homo sapien
gtatttatctaatggctgttgatgg

SEQ ID NO: 338097 - DNA, 25 bp, Homo sapien
tgattttaccgaaaaagtccaggat

SEQ ID NO: 338098 - DNA, 25 bp, Homo sapien
gtccaggatacaagtaacacaggtt

SEQ ID NO: 338099 - DNA, 25 bp, Homo sapien
acacaggtttaggagaagacattat

SEQ ID NO: 338100 - DNA, 25 bp, Homo sapien
ggagaagacattatacatcagttgt

SEQ ID NO: 338101 - DNA, 25 bp, Homo sapien
gaaaatagactacagctggatagct

SEQ ID NO: 338102 - DNA, 25 bp, Homo sapien
agctggatagctgccctttaagcct

SEQ ID NO: 338103 - DNA, 25 bp, Homo sapien
ggatagctgccctttaagccttgga

SEQ ID NO: 338104 - DNA, 25 bp, Homo sapien
atagctgccctttaagccttggaga

SEQ ID NO: 338105 - DNA, 25 bp, Homo sapien
gctgccctttaagccttggagatgg

SEQ ID NO: 338106 - DNA, 25 bp, Homo sapien
gggaggatccttggactttgtgttt

SEQ ID NO: 338107 - DNA, 25 bp, Homo sapien
ggactttgtgtttttgattgtatgt

SEQ ID NO: 338108 - DNA, 25 bp, Homo sapien
ctttaattttcttgtcactcagatt

SEQ ID NO: 338109 - DNA, 25 bp, Homo sapien
ttaattttcttgtcactcagattct

SEQ ID NO: 338110 - DNA, 25 bp, Homo sapien
taattttcttgtcactcagattctg

SEQ ID NO: 338111 - DNA, 25 bp, Homo sapien
tcactcagattctgacagataaagt

SEQ ID NO: 338112 - DNA, 25 bp, Homo sapien
gattctgacagataaagtatcattt

SEQ ID NO: 338113 - DNA, 25 bp, Homo sapien
ttatcactttcatgaataagtgttt

SEQ ID NO: 338114 - DNA, 25 bp, Homo sapien
ttgtagaaacagagtgcccctgttt

SEQ ID NO: 338115 - DNA, 25 bp, Homo sapien
cagaccaatattcaatagttggata

SEQ ID NO: 338116 - DNA, 25 bp, Homo sapien
gtagaaacagagtgcccctgttttg

SEQ ID NO: 338117 - DNA, 25 bp, Homo sapien
aacagagtgcccctgttttgcccag

SEQ ID NO: 338118 - DNA, 25 bp, Homo sapien
acagagtgcccctgttttgcccagg

SEQ ID NO: 338119 - DNA, 25 bp, Homo sapien
accggtccgcttggagctaacataa

SEQ ID NO: 338120 - DNA, 25 bp, Homo sapien
tccgcttggagctaacataaataaa

SEQ ID NO: 338121 - DNA, 25 bp, Homo sapien
cgatgcagtcctcagatgaacactt

SEQ ID NO: 338122 - DNA, 25 bp, Homo sapien
atgcagtcctcagatgaacactttc

SEQ ID NO: 338123 - DNA, 25 bp, Homo sapien
agtcaaatgatattttttcaacttt

SEQ ID NO: 338124 - DNA, 25 bp, Homo sapien
ctcggtcgctgctgtcgggtagata

SEQ ID NO: 338125 - DNA, 25 bp, Homo sapien
cgctgctgtcgggtagatagatacg

SEQ ID NO: 338126 - DNA, 25 bp, Homo sapien
gctgtcgggtagatagatacggtat

SEQ ID NO: 338127 - DNA, 25 bp, Homo sapien
agatacggtatacatttctttcctt

SEQ ID NO: 338128 - DNA, 25 bp, Homo sapien
tctttcctttcgtggcccgagtcct

SEQ ID NO: 338129 - DNA, 25 bp, Homo sapien
cacgcgcgggtgtcagcagcctggg

SEQ ID NO: 338130 - DNA, 25 bp, Homo sapien
attttaggtatctggcacaattaac

SEQ ID NO: 338131 - DNA, 25 bp, Homo sapien
acaattaaccaaatgtctgcccatt

SEQ ID NO: 338132 - DNA, 25 bp, Homo sapien
tctgcccatttttgtgtagctttca

SEQ ID NO: 338133 - DNA, 25 bp, Homo sapien
gtagctttcatacagtacagatttc

SEQ ID NO: 338134 - DNA, 25 bp, Homo sapien
acagatttcattgatgtcgctccca

SEQ ID NO: 338135 - DNA, 25 bp, Homo sapien
gtcgctcccacatctgagtattaaa

SEQ ID NO: 338136 - DNA, 25 bp, Homo sapien
ttgacattgttcttctcagtcctca

SEQ ID NO: 338137 - DNA, 25 bp, Homo sapien
attgttcttctcagtcctcacaaca

SEQ ID NO: 338138 - DNA, 25 bp, Homo sapien
ggtaggtggtattgaccccattcca

SEQ ID NO: 338139 - DNA, 25 bp, Homo sapien
gtattgaccccattccacagatggg

SEQ ID NO: 338140 - DNA, 25 bp, Homo sapien
ggcacggaaaggtttagtggctcct

SEQ ID NO: 338141 - DNA, 25 bp, Homo sapien
tattgaatatatacagtgtcctgtt

SEQ ID NO: 338142 - DNA, 25 bp, Homo sapien
acagtgtcctgtttctttttgttct

SEQ ID NO: 338143 - DNA, 25 bp, Homo sapien
atttcttcttatccagttcaatatt

SEQ ID NO: 338144 - DNA, 25 bp, Homo sapien
gttcaatattcaaccatgttccagt

SEQ ID NO: 338145 - DNA, 25 bp, Homo sapien
tcaaccatgttccagttacaataac

SEQ ID NO: 338146 - DNA, 25 bp, Homo sapien
aattctgagagtctgtattcgtaac

SEQ ID NO: 338147 - DNA, 25 bp, Homo sapien
gagagtctgtattcgtaactaatta

SEQ ID NO: 338148 - DNA, 25 bp, Homo sapien
tgtatgtgtcatagtttctcagaaa

SEQ ID NO: 338149 - DNA, 25 bp, Homo sapien
gtttctcagaaaggtatgatattca

SEQ ID NO: 338150 - DNA, 25 bp, Homo sapien
atctaggtattaattctttagttga

SEQ ID NO: 338151 - DNA, 25 bp, Homo sapien
gaatttatgacattaccatatctta

SEQ ID NO: 338152 - DNA, 25 bp, Homo sapien
ttttacatggaaaccgggctcagtg

SEQ ID NO: 338153 - DNA, 25 bp, Homo sapien
agtgagaactgatttcctgcccaat

SEQ ID NO: 338154 - DNA, 25 bp, Homo sapien
gatttcctgcccaatatttgtcttt

SEQ ID NO: 338155 - DNA, 25 bp, Homo sapien
aatatttgtctttgggctgtctcta

SEQ ID NO: 338156 - DNA, 25 bp, Homo sapien
tgggctgtctctagtgactaattat

SEQ ID NO: 338157 - DNA, 25 bp, Homo sapien
gaatctagctggttatacagttcaa

SEQ ID NO: 338158 - DNA, 25 bp, Homo sapien
agttcaaggctttctatgttgttaa

SEQ ID NO: 338159 - DNA, 25 bp, Homo sapien
gttaatgaacctcaaaatagccgtt

SEQ ID NO: 338160 - DNA, 25 bp, Homo sapien
atagccgttaagacatgaaatacag

SEQ ID NO: 338161 - DNA, 25 bp, Homo sapien
tacagcagcaggttaccaatgcgaa

SEQ ID NO: 338162 - DNA, 25 bp, Homo sapien
gaacaggtagttcgcatttatgtaa

SEQ ID NO: 338163 - DNA, 25 bp, Homo sapien
gtgttggtaacagtattttaagcat

SEQ ID NO: 338164 - DNA, 25 bp, Homo sapien
cagtattttaagcatttttgttcac

SEQ ID NO: 338165 - DNA, 25 bp, Homo sapien
tttgttcacttttaaggactatttg

SEQ ID NO: 338166 - DNA, 25 bp, Homo sapien
taaggactatttgtttagtgcatct

SEQ ID NO: 338167 - DNA, 25 bp, Homo sapien
gtgcatcttacaaactataaatctt

SEQ ID NO: 338168 - DNA, 25 bp, Homo sapien
gaaatggtcgtgtaaatttttgcct

SEQ ID NO: 338169 - DNA, 25 bp, Homo sapien
ggtcgtgtaaatttttgccttatat

SEQ ID NO: 338170 - DNA, 25 bp, Homo sapien
gtaaatttttgccttatatatcatg

SEQ ID NO: 338171 - DNA, 25 bp, Homo sapien
gggtcctaccatttctgttcaggaa

SEQ ID NO: 338172 - DNA, 25 bp, Homo sapien
tctgttcaggaaatcttgtagttta

SEQ ID NO: 338173 - DNA, 25 bp, Homo sapien
caggaaatcttgtagtttattgttg

SEQ ID NO: 338174 - DNA, 25 bp, Homo sapien
tgtggacaactcgaataagtttgac

SEQ ID NO: 338175 - DNA, 25 bp, Homo sapien
tggacaactcgaataagtttgactt

SEQ ID NO: 338176 - DNA, 25 bp, Homo sapien
gacaactcgaataagtttgacttgt

SEQ ID NO: 338177 - DNA, 25 bp, Homo sapien
caactcgaataagtttgacttgtgt

SEQ ID NO: 338178 - DNA, 25 bp, Homo sapien
actcgaataagtttgacttgtgttt

SEQ ID NO: 338179 - DNA, 25 bp, Homo sapien
taaccaccagatcattccttctgta

SEQ ID NO: 338180 - DNA, 25 bp, Homo sapien
aaccaccagatcattccttctgtag

SEQ ID NO: 338181 - DNA, 25 bp, Homo sapien
accaccagatcattccttctgtagc

SEQ ID NO: 338182 - DNA, 25 bp, Homo sapien
ccaccagatcattccttctgtagct

SEQ ID NO: 338183 - DNA, 25 bp, Homo sapien
caccagatcattccttctgtagctc

SEQ ID NO: 338184 - DNA, 25 bp, Homo sapien
accagatcattccttctgtagctca

SEQ ID NO: 338185 - DNA, 25 bp, Homo sapien
gtcatcttcttctgggttactgagc

SEQ ID NO: 338186 - DNA, 25 bp, Homo sapien
gggttactgagcagcttcttttaaa

SEQ ID NO: 338187 - DNA, 25 bp, Homo sapien
aatagcaacaccgaggaaggccccg

SEQ ID NO: 338188 - DNA, 25 bp, Homo sapien
aggaaggccccgaagcccagtcttg

SEQ ID NO: 338189 - DNA, 25 bp, Homo sapien
cagtcttgcacctcgtggtgtgaag

SEQ ID NO: 338190 - DNA, 25 bp, Homo sapien
ggtgtgaagtcgtttaatcctgccc

SEQ ID NO: 338191 - DNA, 25 bp, Homo sapien
aatcctgcccgctaatgcgtaagga

SEQ ID NO: 338192 - DNA, 25 bp, Homo sapien
aatgcgtaaggactttccaccgtgt

SEQ ID NO: 338193 - DNA, 25 bp, Homo sapien
aaggactttccaccgtgtgcaggac

SEQ ID NO: 338194 - DNA, 25 bp, Homo sapien
gcagggtttgaaccgacctccgcct

SEQ ID NO: 338195 - DNA, 25 bp, Homo sapien
ccctgcgggttcacaggcctgcgag

SEQ ID NO: 338196 - DNA, 25 bp, Homo sapien
gaccggacagtccaagatccaggaa

SEQ ID NO: 338197 - DNA, 25 bp, Homo sapien
atggtgctttgaacactggagggca

SEQ ID NO: 338198 - DNA, 25 bp, Homo sapien
acactggagggcaagagaggcacaa

SEQ ID NO: 338199 - DNA, 25 bp, Homo sapien
gcacaagcgggctggacttaccctt

SEQ ID NO: 338200 - DNA, 25 bp, Homo sapien
gctggacttaccctttcataacatt

SEQ ID NO: 338201 - DNA, 25 bp, Homo sapien
tttcataacattaactccgcccttg

SEQ ID NO: 338202 - DNA, 25 bp, Homo sapien
ataacattaactccgcccttggaga

SEQ ID NO: 338203 - DNA, 25 bp, Homo sapien
taactccgcccttggagagtggagc

SEQ ID NO: 338204 - DNA, 25 bp, Homo sapien
agagtggagccctcacagcctaatc

SEQ ID NO: 338205 - DNA, 25 bp, Homo sapien
ggcaattcaatttcaacatgaagtt

SEQ ID NO: 338206 - DNA, 25 bp, Homo sapien
ttcaacatgaagttagcacagtgcc

SEQ ID NO: 338207 - DNA, 25 bp, Homo sapien
tcggcggagattccaggccctatag

SEQ ID NO: 338208 - DNA, 25 bp, Homo sapien
gattccaggccctatagaaaccagg

SEQ ID NO: 338209 - DNA, 25 bp, Homo sapien
caggccctatagaaaccaggacgtc

SEQ ID NO: 338210 - DNA, 25 bp, Homo sapien
ctcacatgccagtgctgccgggaac

SEQ ID NO: 338211 - DNA, 25 bp, Homo sapien
agtgctgccgggaacccagcgatat

SEQ ID NO: 338212 - DNA, 25 bp, Homo sapien
gggaacccagcgatatccgcaccag

SEQ ID NO: 338213 - DNA, 25 bp, Homo sapien
cagcgatatccgcaccagcggagaa

SEQ ID NO: 338214 - DNA, 25 bp, Homo sapien
gcaccagcggagaaggttccaggct

SEQ ID NO: 338215 - DNA, 25 bp, Homo sapien
ggcgtggcgtggtcaggctccgaga

SEQ ID NO: 338216 - DNA, 25 bp, Homo sapien
ctccctccaagtccagtaagaagtt

SEQ ID NO: 338217 - DNA, 25 bp, Homo sapien
gtccagtaagaagttgggccaagct

SEQ ID NO: 338218 - DNA, 25 bp, Homo sapien
gtggtcactgaagtccttacatgcc

SEQ ID NO: 338219 - DNA, 25 bp, Homo sapien
tacatgccccatgaagacttgtgtg

SEQ ID NO: 338220 - DNA, 25 bp, Homo sapien
agacttgtgtgtggatttgctgcct

SEQ ID NO: 338221 - DNA, 25 bp, Homo sapien
atttgctgcctgcactgagctaaca

SEQ ID NO: 338222 - DNA, 25 bp, Homo sapien
tgagctaacacgttcctgtcctgaa

SEQ ID NO: 338223 - DNA, 25 bp, Homo sapien
tgtcctgaaggcttcttccacagtg

SEQ ID NO: 338224 - DNA, 25 bp, Homo sapien
agtgagctcatcacagcaccctgtg

SEQ ID NO: 338225 - DNA, 25 bp, Homo sapien
gcaccctgtggaatggtgcttctca

SEQ ID NO: 338226 - DNA, 25 bp, Homo sapien
gttccttcatgatggttctttctag

SEQ ID NO: 338227 - DNA, 25 bp, Homo sapien
gtgcaggagtctgggcttttgtcaa

SEQ ID NO: 338228 - DNA, 25 bp, Homo sapien
gcttttgtcaagctcctcaggagat

SEQ ID NO: 338229 - DNA, 25 bp, Homo sapien
gaggagatactctccttctccacct

SEQ ID NO: 338230 - DNA, 25 bp, Homo sapien
tcctaaacgaagagcatcaccatct

SEQ ID NO: 338231 - DNA, 25 bp, Homo sapien
aaacaaagaagctccccagtcacca

SEQ ID NO: 338232 - DNA, 25 bp, Homo sapien
agtcaccaagagacgttcaccttca

SEQ ID NO: 338233 - DNA, 25 bp, Homo sapien
agagacgttcaccttcattatcatc

SEQ ID NO: 338234 - DNA, 25 bp, Homo sapien
gttcaccttcattatcatccaagca

SEQ ID NO: 338235 - DNA, 25 bp, Homo sapien
accttcattatcatccaagcatagg

SEQ ID NO: 338236 - DNA, 25 bp, Homo sapien
tcatccaagcataggaaagggtctt

SEQ ID NO: 338237 - DNA, 25 bp, Homo sapien
gcataggaaagggtcttccccaagc

SEQ ID NO: 338238 - DNA, 25 bp, Homo sapien
gggaggcccgatcaccacaaccaaa

SEQ ID NO: 338239 - DNA, 25 bp, Homo sapien
cacaaccaaacaaacggcattcgcc

SEQ ID NO: 338240 - DNA, 25 bp, Homo sapien
tgacctatgaccacatcactgtacg

SEQ ID NO: 338241 - DNA, 25 bp, Homo sapien
gaaaaaatgagtgttcggtgaaaca

SEQ ID NO: 338242 - DNA, 25 bp, Homo sapien
ttcggtgaaacaagtgggattttct

SEQ ID NO: 338243 - DNA, 25 bp, Homo sapien
aactgtatatgatgcatcctgtctc

SEQ ID NO: 338244 - DNA, 25 bp, Homo sapien
ctgtatatgatgcatcctgtctcca

SEQ ID NO: 338245 - DNA, 25 bp, Homo sapien
gtatatgatgcatcctgtctccatg

SEQ ID NO: 338246 - DNA, 25 bp, Homo sapien
atatgatgcatcctgtctccatgtg

SEQ ID NO: 338247 - DNA, 25 bp, Homo sapien
tgatgcatcctgtctccatgtgtaa

SEQ ID NO: 338248 - DNA, 25 bp, Homo sapien
atgcatcctgtctccatgtgtaata

SEQ ID NO: 338249 - DNA, 25 bp, Homo sapien
gcatcctgtctccatgtgtaatata

SEQ ID NO: 338250 - DNA, 25 bp, Homo sapien
tcctgtctccatgtgtaatatattt

SEQ ID NO: 338251 - DNA, 25 bp, Homo sapien
gcatttattttcacatgattaactg

SEQ ID NO: 338252 - DNA, 25 bp, Homo sapien
gtaagacatttagcagaataattca

SEQ ID NO: 338253 - DNA, 25 bp, Homo sapien
aaaaatctaggttgtctatccagta

SEQ ID NO: 338254 - DNA, 25 bp, Homo sapien
ctaggttgtctatccagtatgtgaa

SEQ ID NO: 338255 - DNA, 25 bp, Homo sapien
gttgtctatccagtatgtgaatgct

SEQ ID NO: 338256 - DNA, 25 bp, Homo sapien
tatccagtatgtgaatgcttaatta

SEQ ID NO: 338257 - DNA, 25 bp, Homo sapien
ttaagagtaagtcaccaggtacaca

SEQ ID NO: 338258 - DNA, 25 bp, Homo sapien
tttgtttaataatccttggctaaat

SEQ ID NO: 338259 - DNA, 25 bp, Homo sapien
aatccttggctaaattcacatgtat

SEQ ID NO: 338260 - DNA, 25 bp, Homo sapien
ggctaaattcacatgtatctaaagt

SEQ ID NO: 338261 - DNA, 25 bp, Homo sapien
agctgagttactgaattctataagg

SEQ ID NO: 338262 - DNA, 25 bp, Homo sapien
gacaagaatcccttcaaggagaaag

SEQ ID NO: 338263 - DNA, 25 bp, Homo sapien
caaggagaaaggtggctgtctgata

SEQ ID NO: 338264 - DNA, 25 bp, Homo sapien
tggctgtctgataagctgatggcat

SEQ ID NO: 338265 - DNA, 25 bp, Homo sapien
ataagctgatggcatggagccctgc

SEQ ID NO: 338266 - DNA, 25 bp, Homo sapien
ctgagtgtctgtccctcttcagcca

SEQ ID NO: 338267 - DNA, 25 bp, Homo sapien
ttcagccaagcccaagtctcctaga

SEQ ID NO: 338268 - DNA, 25 bp, Homo sapien
agccagtgaactgtcaccttctctt

SEQ ID NO: 338269 - DNA, 25 bp, Homo sapien
gtcaccttctcttcatcacagaatg

SEQ ID NO: 338270 - DNA, 25 bp, Homo sapien
gtaaagatccctgaacaaatgcatt

SEQ ID NO: 338271 - DNA, 25 bp, Homo sapien
aaatgcattgtgaacccattcccca

SEQ ID NO: 338272 - DNA, 25 bp, Homo sapien
gaccttgctgggaacactctgagga

SEQ ID NO: 338273 - DNA, 25 bp, Homo sapien
gtattcccagcagttcgagatcagc

SEQ ID NO: 338274 - DNA, 25 bp, Homo sapien
tattcccagcagttcgagatcagcc

SEQ ID NO: 338275 - DNA, 25 bp, Homo sapien
ccccattggaacagccttcttggca

SEQ ID NO: 338276 - DNA, 25 bp, Homo sapien
attggaacagccttcttggcacgcc

SEQ ID NO: 338277 - DNA, 25 bp, Homo sapien
tggaacagccttcttggcacgccac

SEQ ID NO: 338278 - DNA, 25 bp, Homo sapien
ctgggcactgtgctttctgccttta

SEQ ID NO: 338279 - DNA, 25 bp, Homo sapien
cactgtgctttctgcctttaccgtt

SEQ ID NO: 338280 - DNA, 25 bp, Homo sapien
tgtgctttctgcctttaccgttctg

SEQ ID NO: 338281 - DNA, 25 bp, Homo sapien
tgcctttaccgttctgccgtgatgt

SEQ ID NO: 338282 - DNA, 25 bp, Homo sapien
ctttaccgttctgccgtgatgttgc

SEQ ID NO: 338283 - DNA, 25 bp, Homo sapien
accgttctgccgtgatgttgccaaa

SEQ ID NO: 338284 - DNA, 25 bp, Homo sapien
tttgcctgcatcctctggaaggtaa

SEQ ID NO: 338285 - DNA, 25 bp, Homo sapien
ggtaaagaagatctcctctctctta

SEQ ID NO: 338286 - DNA, 25 bp, Homo sapien
gatctcctctctcttagaacttaat

SEQ ID NO: 338287 - DNA, 25 bp, Homo sapien
gaacttaatcaaactcttggcatcc

SEQ ID NO: 338288 - DNA, 25 bp, Homo sapien
tcttggcatccacagaaggctagga

SEQ ID NO: 338289 - DNA, 25 bp, Homo sapien
aatgaatacttaccatttttgtgga

SEQ ID NO: 338290 - DNA, 25 bp, Homo sapien
gtggaagcccacaaccttttgaatg

SEQ ID NO: 338291 - DNA, 25 bp, Homo sapien
caaccttttgaatggcctttctata

SEQ ID NO: 338292 - DNA, 25 bp, Homo sapien
ggcctttctatactttagtgaacct

SEQ ID NO: 338293 - DNA, 25 bp, Homo sapien
gtgaacctccatgttatgaacctta

SEQ ID NO: 338294 - DNA, 25 bp, Homo sapien
atgaaccttacttcctcaagtctct

SEQ ID NO: 338295 - DNA, 25 bp, Homo sapien
aagaaccgtgagagaagttggcaca

SEQ ID NO: 338296 - DNA, 25 bp, Homo sapien
gaaccgtgagagaagttggcacaaa

SEQ ID NO: 338297 - DNA, 25 bp, Homo sapien
gttggcacaaaggagttatgggaca

SEQ ID NO: 338298 - DNA, 25 bp, Homo sapien
ggcacaaaggagttatgggacaaag

SEQ ID NO: 338299 - DNA, 25 bp, Homo sapien
gacaaagggtccaagataggcagaa

SEQ ID NO: 338300 - DNA, 25 bp, Homo sapien
aagggtccaagataggcagaaaaga

SEQ ID NO: 338301 - DNA, 25 bp, Homo sapien
aaaagaaaatgttgccagttgatgg

SEQ ID NO: 338302 - DNA, 25 bp, Homo sapien
aaggaagtcggagggctcagacact

SEQ ID NO: 338303 - DNA, 25 bp, Homo sapien
ctgaaggatctggaggtaggaggct

SEQ ID NO: 338304 - DNA, 25 bp, Homo sapien
ctggaggtaggaggctctgggcgga

SEQ ID NO: 338305 - DNA, 25 bp, Homo sapien
ggaggtgcagtgaccccgcaggcca

SEQ ID NO: 338306 - DNA, 25 bp, Homo sapien
aaatttcaggcatcgctggcagtga

SEQ ID NO: 338307 - DNA, 25 bp, Homo sapien
gtgaacactttcaccataacaggtc

SEQ ID NO: 338308 - DNA, 25 bp, Homo sapien
accataacaggtcatgctgaggcaa

SEQ ID NO: 338309 - DNA, 25 bp, Homo sapien
tcatgctgaggcaaagcaggtgaca

SEQ ID NO: 338310 - DNA, 25 bp, Homo sapien
agtgtcttaagccagcttggtgcag

SEQ ID NO: 338311 - DNA, 25 bp, Homo sapien
taagccagcttggtgcagacagtct

SEQ ID NO: 338312 - DNA, 25 bp, Homo sapien
agccagcttggtgcagacagtctga

SEQ ID NO: 338313 - DNA, 25 bp, Homo sapien
ctggctgaagttctgcccaaacaac

SEQ ID NO: 338314 - DNA, 25 bp, Homo sapien
tgaagttctgcccaaacaacctgtg

SEQ ID NO: 338315 - DNA, 25 bp, Homo sapien
ccaggaatgaggcaagctgaattga

SEQ ID NO: 338316 - DNA, 25 bp, Homo sapien
gaattgagtcgacttctgaagaaga

SEQ ID NO: 338317 - DNA, 25 bp, Homo sapien
gatgtcacatctgctaaagcactgt

SEQ ID NO: 338318 - DNA, 25 bp, Homo sapien
agcactgtatgaacatttgactgca

SEQ ID NO: 338319 - DNA, 25 bp, Homo sapien
ggatgatctgtttctaaagcgttac

SEQ ID NO: 338320 - DNA, 25 bp, Homo sapien
aaagcgttacgcatctttgctgaag

SEQ ID NO: 338321 - DNA, 25 bp, Homo sapien
catctttgctgaagtatgctggaga

SEQ ID NO: 338322 - DNA, 25 bp, Homo sapien
tggagagcctgtccctttcattgaa

SEQ ID NO: 338323 - DNA, 25 bp, Homo sapien
cattgaaccccctgaaagctttgaa

SEQ ID NO: 338324 - DNA, 25 bp, Homo sapien
gctttgaattttatgcacagcagct

SEQ ID NO: 338325 - DNA, 25 bp, Homo sapien
tcttcttgaaataaccaggcgatac

SEQ ID NO: 338326 - DNA, 25 bp, Homo sapien
taaccaggcgatactttgttttgta

SEQ ID NO: 338327 - DNA, 25 bp, Homo sapien
atttgtgattctgtgtctacatgtt

SEQ ID NO: 338328 - DNA, 25 bp, Homo sapien
cctgggaactggtccttgtttgccg

SEQ ID NO: 338329 - DNA, 25 bp, Homo sapien
ctgggaactggtccttgtttgccgg

SEQ ID NO: 338330 - DNA, 25 bp, Homo sapien
caggtggtcttgtggctgtctttcg

SEQ ID NO: 338331 - DNA, 25 bp, Homo sapien
tggtcttgtggctgtctttcggaaa

SEQ ID NO: 338332 - DNA, 25 bp, Homo sapien
ggtcttgtggctgtctttcggaaaa

SEQ ID NO: 338333 - DNA, 25 bp, Homo sapien
gtcttgtggctgtctttcggaaaat

SEQ ID NO: 338334 - DNA, 25 bp, Homo sapien
tcttgtggctgtctttcggaaaatg

SEQ ID NO: 338335 - DNA, 25 bp, Homo sapien
cttgtggctgtctttcggaaaatgg

SEQ ID NO: 338336 - DNA, 25 bp, Homo sapien
ttgtggctgtctttcggaaaatggt

SEQ ID NO: 338337 - DNA, 25 bp, Homo sapien
tgtggctgtctttcggaaaatggtt

SEQ ID NO: 338338 - DNA, 25 bp, Homo sapien
gtggctgtctttcggaaaatggtta

SEQ ID NO: 338339 - DNA, 25 bp, Homo sapien
cgaatccgggttcatccgacaccag

SEQ ID NO: 338340 - DNA, 25 bp, Homo sapien
gaatccgggttcatccgacaccagc

SEQ ID NO: 338341 - DNA, 25 bp, Homo sapien
cgccgaagttcgaccccaacgagat

SEQ ID NO: 338342 - DNA, 25 bp, Homo sapien
gaagttcgaccccaacgagatcaaa

SEQ ID NO: 338343 - DNA, 25 bp, Homo sapien
gttcgaccccaacgagatcaaagtc

SEQ ID NO: 338344 - DNA, 25 bp, Homo sapien
ttcgaccccaacgagatcaaagtcg

SEQ ID NO: 338345 - DNA, 25 bp, Homo sapien
acgagatcaaagtcgtatacctgag

SEQ ID NO: 338346 - DNA, 25 bp, Homo sapien
tggtgatgacattgccaaggcaacg

SEQ ID NO: 338347 - DNA, 25 bp, Homo sapien
attgccaaggcaacgggtgactgga

SEQ ID NO: 338348 - DNA, 25 bp, Homo sapien
gggcctgaggattacagtgaaactg

SEQ ID NO: 338349 - DNA, 25 bp, Homo sapien
accattcagaacagacaggcccaga

SEQ ID NO: 338350 - DNA, 25 bp, Homo sapien
tagggtaactggttccccaagcgca

SEQ ID NO: 338351 - DNA, 25 bp, Homo sapien
agggtaactggttccccaagcgcag

SEQ ID NO: 338352 - DNA, 25 bp, Homo sapien
gggtaactggttccccaagcgcaga

SEQ ID NO: 338353 - DNA, 25 bp, Homo sapien
taactggttccccaagcgcagagct

SEQ ID NO: 338354 - DNA, 25 bp, Homo sapien
ctaagccatgccctctgtactctga

SEQ ID NO: 338355 - DNA, 25 bp, Homo sapien
taagccatgccctctgtactctgac

SEQ ID NO: 338356 - DNA, 25 bp, Homo sapien
agccatgccctctgtactctgactt

SEQ ID NO: 338357 - DNA, 25 bp, Homo sapien
tctgtactctgacttgccccaaata

SEQ ID NO: 338358 - DNA, 25 bp, Homo sapien
ctgtactctgacttgccccaaatag

SEQ ID NO: 338359 - DNA, 25 bp, Homo sapien
tgccccaaatagacagatgctcaat

SEQ ID NO: 338360 - DNA, 25 bp, Homo sapien
ccccaaatagacagatgctcaataa

SEQ ID NO: 338361 - DNA, 25 bp, Homo sapien
cgaatccgggttcatccgacaccag

SEQ ID NO: 338362 - DNA, 25 bp, Homo sapien
gaatccgggttcatccgacaccagc

SEQ ID NO: 338363 - DNA, 25 bp, Homo sapien
aatccgggttcatccgacaccagcc

SEQ ID NO: 338364 - DNA, 25 bp, Homo sapien
atccgggttcatccgacaccagccg

SEQ ID NO: 338365 - DNA, 25 bp, Homo sapien
cgggttcatccgacaccagccgcct

SEQ ID NO: 338366 - DNA, 25 bp, Homo sapien
gggttcatccgacaccagccgcctc

SEQ ID NO: 338367 - DNA, 25 bp, Homo sapien
ggttcatccgacaccagccgcctcc

SEQ ID NO: 338368 - DNA, 25 bp, Homo sapien
gttcatccgacaccagccgcctcca

SEQ ID NO: 338369 - DNA, 25 bp, Homo sapien
gcctccaccatgccgccgaagttcg

SEQ ID NO: 338370 - DNA, 25 bp, Homo sapien
cctccaccatgccgccgaagttcga

SEQ ID NO: 338371 - DNA, 25 bp, Homo sapien
ctccaccatgccgccgaagttcgac

SEQ ID NO: 338372 - DNA, 25 bp, Homo sapien
actcttccttccgagggagtcagga

SEQ ID NO: 338373 - DNA, 25 bp, Homo sapien
gagtcaggatgggacagacacccat

SEQ ID NO: 338374 - DNA, 25 bp, Homo sapien
gatgggacagacacccattttccaa

SEQ ID NO: 338375 - DNA, 25 bp, Homo sapien
ttttccaaaaggctccttgcctcct

SEQ ID NO: 338376 - DNA, 25 bp, Homo sapien
ctgaagccaagtcccaggtgtcctg

SEQ ID NO: 338377 - DNA, 25 bp, Homo sapien
ggtgggatttttgcataagcacttt

SEQ ID NO: 338378 - DNA, 25 bp, Homo sapien
gccctccagtggctgcttgaggaaa

SEQ ID NO: 338379 - DNA, 25 bp, Homo sapien
tccagtggctgcttgaggaaacgca

SEQ ID NO: 338380 - DNA, 25 bp, Homo sapien
gcagggcctggtttgggagagtcac

SEQ ID NO: 338381 - DNA, 25 bp, Homo sapien
tttgggagagtcaccgagggcccat

SEQ ID NO: 338382 - DNA, 25 bp, Homo sapien
ggatctggcccgagctctcctcaga

SEQ ID NO: 338383 - DNA, 25 bp, Homo sapien
gggtgtgcgtgtttctctaactgtc

SEQ ID NO: 338384 - DNA, 25 bp, Homo sapien
tgtgcgtgtttctctaactgtctac

SEQ ID NO: 338385 - DNA, 25 bp, Homo sapien
tgcgtgtttctctaactgtctacac

SEQ ID NO: 338386 - DNA, 25 bp, Homo sapien
gattagaacagtccaacacagtccg

SEQ ID NO: 338387 - DNA, 25 bp, Homo sapien
agaacagtccaacacagtccgacct

SEQ ID NO: 338388 - DNA, 25 bp, Homo sapien
aacacagtccgacctcactcaatac

SEQ ID NO: 338389 - DNA, 25 bp, Homo sapien
caatacccacaaccatcgaaaatgg

SEQ ID NO: 338390 - DNA, 25 bp, Homo sapien
gaaaatggattcttagtaccagaca

SEQ ID NO: 338391 - DNA, 25 bp, Homo sapien
tggattcttagtaccagacaatccc

SEQ ID NO: 338392 - DNA, 25 bp, Homo sapien
taatgaaggtttagtttccttgaag

SEQ ID NO: 338393 - DNA, 25 bp, Homo sapien
ggaatggtacttaggtgtttggtat

SEQ ID NO: 338394 - DNA, 25 bp, Homo sapien
gaggagacacctagagcctgcgaca

SEQ ID NO: 338395 - DNA, 25 bp, Homo sapien
acacctagagcctgcgacaccatgg

SEQ ID NO: 338396 - DNA, 25 bp, Homo sapien
tagagcctgcgacaccatggctcgc

SEQ ID NO: 338397 - DNA, 25 bp, Homo sapien
aggttctacccatgtaacagatgag

SEQ ID NO: 338398 - DNA, 25 bp, Homo sapien
gttctacccatgtaacagatgagga

SEQ ID NO: 338399 - DNA, 25 bp, Homo sapien
tgaggaaaccaaggagcacagttat

SEQ ID NO: 338400 - DNA, 25 bp, Homo sapien
ggagcacagttatttactaactcgc

SEQ ID NO: 338401 - DNA, 25 bp, Homo sapien
acagttatttactaactcgcacaag

SEQ ID NO: 338402 - DNA, 25 bp, Homo sapien
gacagagtgtgcagcacgaccagag

SEQ ID NO: 338403 - DNA, 25 bp, Homo sapien
tgtgcagcacgaccagagtggcttt

SEQ ID NO: 338404 - DNA, 25 bp, Homo sapien
gcagcacgaccagagtggcttttct

SEQ ID NO: 338405 - DNA, 25 bp, Homo sapien
gaaggtgttcagcttctcagaggat

SEQ ID NO: 338406 - DNA, 25 bp, Homo sapien
tggttgcagctaaaaatcagtctct

SEQ ID NO: 338407 - DNA, 25 bp, Homo sapien
aaaatcagtctctgaagtctctctc

SEQ ID NO: 338408 - DNA, 25 bp, Homo sapien
aagtctctctcccttctagaggtta

SEQ ID NO: 338409 - DNA, 25 bp, Homo sapien
tctcccttctagaggttaggacttg

SEQ ID NO: 338410 - DNA, 25 bp, Homo sapien
gttaggacttggtgaacatgtttgt

SEQ ID NO: 338411 - DNA, 25 bp, Homo sapien
gggaaggttgattattttctcagtc

SEQ ID NO: 338412 - DNA, 25 bp, Homo sapien
ttctcagtcatcctggcagccaaaa

SEQ ID NO: 338413 - DNA, 25 bp, Homo sapien
gcagccaaaaatgtgccaggaaaag

SEQ ID NO: 338414 - DNA, 25 bp, Homo sapien
agaatgtggagcacgcgtggctcct

SEQ ID NO: 338415 - DNA, 25 bp, Homo sapien
ggaggacttggagatgcatgcacat

SEQ ID NO: 338416 - DNA, 25 bp, Homo sapien
aggacagccgggtaccttgaacctg

SEQ ID NO: 338417 - DNA, 25 bp, Homo sapien
acagccgggtaccttgaacctggtg

SEQ ID NO: 338418 - DNA, 25 bp, Homo sapien
cgggtaccttgaacctggtgcgctg

SEQ ID NO: 338419 - DNA, 25 bp, Homo sapien
tgcgctggccggcacgggtctgctt

SEQ ID NO: 338420 - DNA, 25 bp, Homo sapien
tcaaaacctcatccttgagagaggc

SEQ ID NO: 338421 - DNA, 25 bp, Homo sapien
gttacgaaagtcacacgggtgaagc

SEQ ID NO: 338422 - DNA, 25 bp, Homo sapien
gtcacacgggtgaagccaagtgcaa

SEQ ID NO: 338423 - DNA, 25 bp, Homo sapien
gggtgaagccaagtgcaactatgca

SEQ ID NO: 338424 - DNA, 25 bp, Homo sapien
tgcaactatgcagagccgagagagt

SEQ ID NO: 338425 - DNA, 25 bp, Homo sapien
tgcagagccgagagagtcccggcaa

SEQ ID NO: 338426 - DNA, 25 bp, Homo sapien
agccgagagagtcccggcaagccca

SEQ ID NO: 338427 - DNA, 25 bp, Homo sapien
ggaattgtttctgtgttgagattat

SEQ ID NO: 338428 - DNA, 25 bp, Homo sapien
gcatccattctctatgtagtggtca

SEQ ID NO: 338429 - DNA, 25 bp, Homo sapien
ttctctatgtagtggtcaccttctg

SEQ ID NO: 338430 - DNA, 25 bp, Homo sapien
ttctgtctgtcatggtgggcttaat

SEQ ID NO: 338431 - DNA, 25 bp, Homo sapien
gtaaagccattggttctctgccact

SEQ ID NO: 338432 - DNA, 25 bp, Homo sapien
tccttcttcagaatggtacctactg

SEQ ID NO: 338433 - DNA, 25 bp, Homo sapien
ggtacctactgatatcatcgaggaa

SEQ ID NO: 338434 - DNA, 25 bp, Homo sapien
gaaaatgttacaaatcagacctagg

SEQ ID NO: 338435 - DNA, 25 bp, Homo sapien
aaattgaggcatttcccgtcatttg

SEQ ID NO: 338436 - DNA, 25 bp, Homo sapien
gcatttcccgtcatttggccttttt

SEQ ID NO: 338437 - DNA, 25 bp, Homo sapien
tggcctttttaccaacaagatgtga

SEQ ID NO: 338438 - DNA, 25 bp, Homo sapien
tttccactagcgtaaccctaaagca

SEQ ID NO: 338439 - DNA, 25 bp, Homo sapien
ccactagcgtaaccctaaagcagag

SEQ ID NO: 338440 - DNA, 25 bp, Homo sapien
gcaaaatcagaatcagcctaccact

SEQ ID NO: 338441 - DNA, 25 bp, Homo sapien
tcagaatcagcctaccactgacatg

SEQ ID NO: 338442 - DNA, 25 bp, Homo sapien
tatgccaccacaaaggagcaccatg

SEQ ID NO: 338443 - DNA, 25 bp, Homo sapien
aggagcaccatgttcatcacgtggc

SEQ ID NO: 338444 - DNA, 25 bp, Homo sapien
atgttcatcacgtggctgctcagtt

SEQ ID NO: 338445 - DNA, 25 bp, Homo sapien
catcacgtggctgctcagttttctc

SEQ ID NO: 338446 - DNA, 25 bp, Homo sapien
ggaggcaagtccttgagctacacac

SEQ ID NO: 338447 - DNA, 25 bp, Homo sapien
aagtccttgagctacacacactggc

SEQ ID NO: 338448 - DNA, 25 bp, Homo sapien
gctacacacactggctgtagtgcaa

SEQ ID NO: 338449 - DNA, 25 bp, Homo sapien
gcaggtgcctgggattttctcaaac

SEQ ID NO: 338450 - DNA, 25 bp, Homo sapien
gcctgggattttctcaaactttgtc

SEQ ID NO: 338451 - DNA, 25 bp, Homo sapien
aactttgtcccaaacttcagctgtg

SEQ ID NO: 338452 - DNA, 25 bp, Homo sapien
aaacaggcctctcccagaattgtga

SEQ ID NO: 338453 - DNA, 25 bp, Homo sapien
gaattgtgaaagagatcgccctggt

SEQ ID NO: 338454 - DNA, 25 bp, Homo sapien
gagatcgccctggtggatgaaacaa

SEQ ID NO: 338455 - DNA, 25 bp, Homo sapien
aaacaaatgcacttgacttccaccg

SEQ ID NO: 338456 - DNA, 25 bp, Homo sapien
cgtgtcacgcgggtttaatgtatgt

SEQ ID NO: 338457 - DNA, 25 bp, Homo sapien
gtattttcttctaagggcctggaca

SEQ ID NO: 338458 - DNA, 25 bp, Homo sapien
tctaagggcctggacacatttcttt

SEQ ID NO: 338459 - DNA, 25 bp, Homo sapien
ttcttttctccctgtatcgtgaatt

SEQ ID NO: 338460 - DNA, 25 bp, Homo sapien
ggagaaccctggactattcgatcaa

SEQ ID NO: 338461 - DNA, 25 bp, Homo sapien
gactattcgatcaagcagcaaggct

SEQ ID NO: 338462 - DNA, 25 bp, Homo sapien
aaggctatatgttcacttatgcaga

SEQ ID NO: 338463 - DNA, 25 bp, Homo sapien
actagtgtaggctgacaacccaaat

SEQ ID NO: 338464 - DNA, 25 bp, Homo sapien
tttgttgtgcaagcgaaggctcact

SEQ ID NO: 338465 - DNA, 25 bp, Homo sapien
ttggaaggaaatactcagcccctct

SEQ ID NO: 338466 - DNA, 25 bp, Homo sapien
ctgggcagcatttgagttccttatg

SEQ ID NO: 338467 - DNA, 25 bp, Homo sapien
ttccttatggatgccgagtcgcgaa

SEQ ID NO: 338468 - DNA, 25 bp, Homo sapien
gagatcaaacagaactgctgctggg

SEQ ID NO: 338469 - DNA, 25 bp, Homo sapien
tggttgtcaggagctgctacacgga

SEQ ID NO: 338470 - DNA, 25 bp, Homo sapien
tgctacacggagaaccctggactat

SEQ ID NO: 338471 - DNA, 25 bp, Homo sapien
gaccagctggagttgatcaaggatg

SEQ ID NO: 338472 - DNA, 25 bp, Homo sapien
agaggatgacagagacagcgccaat

SEQ ID NO: 338473 - DNA, 25 bp, Homo sapien
atgacagagacagcgccaatggcga

SEQ ID NO: 338474 - DNA, 25 bp, Homo sapien
gcgccaatggcgaggatgactctta

SEQ ID NO: 338475 - DNA, 25 bp, Homo sapien
aacaagcagtagagatgaagaatga

SEQ ID NO: 338476 - DNA, 25 bp, Homo sapien
aagtcagaagaggagcagagcagca

SEQ ID NO: 338477 - DNA, 25 bp, Homo sapien
gctccgtgaagaaagatgagactaa

SEQ ID NO: 338478 - DNA, 25 bp, Homo sapien
aagatgagactaatgtgaagatgga

SEQ ID NO: 338479 - DNA, 25 bp, Homo sapien
gggtgcagatgactctgctgaggag

SEQ ID NO: 338480 - DNA, 25 bp, Homo sapien
actctgctgaggagggggacctact

SEQ ID NO: 338481 - DNA, 25 bp, Homo sapien
gggacctactggatgatgatgataa

SEQ ID NO: 338482 - DNA, 25 bp, Homo sapien
gggagaagtgtgcatcacccttggg

SEQ ID NO: 338483 - DNA, 25 bp, Homo sapien
gttaagggacagttgtctgctaggt

SEQ ID NO: 338484 - DNA, 25 bp, Homo sapien
acagttgtctgctaggtgttgcttc

SEQ ID NO: 338485 - DNA, 25 bp, Homo sapien
ctaggtgttgcttcctggagatggc

SEQ ID NO: 338486 - DNA, 25 bp, Homo sapien
ggctgaaaagccagtccagtctgca

SEQ ID NO: 338487 - DNA, 25 bp, Homo sapien
accacccacctgatgtgggagcatt

SEQ ID NO: 338488 - DNA, 25 bp, Homo sapien
gctgaggctggtgttctgagtagtg

SEQ ID NO: 338489 - DNA, 25 bp, Homo sapien
tgagtagtggcagagctgagccaca

SEQ ID NO: 338490 - DNA, 25 bp, Homo sapien
gagccacagggcatgtctgaggtca

SEQ ID NO: 338491 - DNA, 25 bp, Homo sapien
aggtcagccccgagcaaaatggaat

SEQ ID NO: 338492 - DNA, 25 bp, Homo sapien
agcaaaatggaatagggactcaggg

SEQ ID NO: 338493 - DNA, 25 bp, Homo sapien
agtgtgtcctcctgctgcgtgggct

SEQ ID NO: 338494 - DNA, 25 bp, Homo sapien
gcacaggaaagggagttcaggacac

SEQ ID NO: 338495 - DNA, 25 bp, Homo sapien
gttcaggacacggtggccatgagta

SEQ ID NO: 338496 - DNA, 25 bp, Homo sapien
cacggtggccatgagtaggtgccaa

SEQ ID NO: 338497 - DNA, 25 bp, Homo sapien
gagtaggtgccaagcttaccacact

SEQ ID NO: 338498 - DNA, 25 bp, Homo sapien
gtgccaagcttaccacactgaattt

SEQ ID NO: 338499 - DNA, 25 bp, Homo sapien
caagcttaccacactgaatttcctg

SEQ ID NO: 338500 - DNA, 25 bp, Homo sapien
taccacactgaatttcctggcgacg

SEQ ID NO: 338501 - DNA, 25 bp, Homo sapien
actgaatttcctggcgacgcttgtg

SEQ ID NO: 338502 - DNA, 25 bp, Homo sapien
gacgcttgtgcccatcgatgtgagc

SEQ ID NO: 338503 - DNA, 25 bp, Homo sapien
ccatcgatgtgagctggttcaaatg

SEQ ID NO: 338504 - DNA, 25 bp, Homo sapien
tgccctcatcaatagaccatgtaac

SEQ ID NO: 338505 - DNA, 25 bp, Homo sapien
tgtaactacattggatagagcttgt

SEQ ID NO: 338506 - DNA, 25 bp, Homo sapien
agagcttgtaataggttttgtgtcc

SEQ ID NO: 338507 - DNA, 25 bp, Homo sapien
ataggttttgtgtccttttctgtgg

SEQ ID NO: 338508 - DNA, 25 bp, Homo sapien
tgtggaatatctgctttgaagtatc

SEQ ID NO: 338509 - DNA, 25 bp, Homo sapien
atatctgctttgaagtatcaactga

SEQ ID NO: 338510 - DNA, 25 bp, Homo sapien
gtatcaactgagatatttcctgctt

SEQ ID NO: 338511 - DNA, 25 bp, Homo sapien
caactgagatatttcctgcttctta

SEQ ID NO: 338512 - DNA, 25 bp, Homo sapien
tttcctgcttcttaacaagatttct

SEQ ID NO: 338513 - DNA, 25 bp, Homo sapien
acaagatttcttagtcctcagtatt

SEQ ID NO: 338514 - DNA, 25 bp, Homo sapien
taaaaatccaaacagctttgacaac

SEQ ID NO: 338515 - DNA, 25 bp, Homo sapien
gccacactgtctccccaggggcgtc

SEQ ID NO: 338516 - DNA, 25 bp, Homo sapien
ccacactgtctccccaggggcgtcg

SEQ ID NO: 338517 - DNA, 25 bp, Homo sapien
cacactgtctccccaggggcgtcga

SEQ ID NO: 338518 - DNA, 25 bp, Homo sapien
acactgtctccccaggggcgtcgac

SEQ ID NO: 338519 - DNA, 25 bp, Homo sapien
cactgtctccccaggggcgtcgacc

SEQ ID NO: 338520 - DNA, 25 bp, Homo sapien
actgtctccccaggggcgtcgacct

SEQ ID NO: 338521 - DNA, 25 bp, Homo sapien
atggaataaaatagccagggccaca

SEQ ID NO: 338522 - DNA, 25 bp, Homo sapien
tggaataaaatagccagggccacac

SEQ ID NO: 338523 - DNA, 25 bp, Homo sapien
ggaataaaatagccagggccacact

SEQ ID NO: 338524 - DNA, 25 bp, Homo sapien
gaataaaatagccagggccacactc

SEQ ID NO: 338525 - DNA, 25 bp, Homo sapien
aggagttcactgaccacctcgtcaa

SEQ ID NO: 338526 - DNA, 25 bp, Homo sapien
ggagttcactgaccacctcgtcaag

SEQ ID NO: 338527 - DNA, 25 bp, Homo sapien
gagttcactgaccacctcgtcaaga

SEQ ID NO: 338528 - DNA, 25 bp, Homo sapien
agttcactgaccacctcgtcaagac

SEQ ID NO: 338529 - DNA, 25 bp, Homo sapien
gttcactgaccacctcgtcaagacc

SEQ ID NO: 338530 - DNA, 25 bp, Homo sapien
cacaccagagtctccgtgcagcgga

SEQ ID NO: 338531 - DNA, 25 bp, Homo sapien
acaccagagtctccgtgcagcggac

SEQ ID NO: 338532 - DNA, 25 bp, Homo sapien
cagagtctccgtgcagcggactcag

SEQ ID NO: 338533 - DNA, 25 bp, Homo sapien
gactcaggctccagctgtggctaca

SEQ ID NO: 338534 - DNA, 25 bp, Homo sapien
tctggaaggagactgtattcaccaa

SEQ ID NO: 338535 - DNA, 25 bp, Homo sapien
tattcaccaagtctccctatcagga

SEQ ID NO: 338536 - DNA, 25 bp, Homo sapien
atacagcaacagttcctcgagtgtg

SEQ ID NO: 338537 - DNA, 25 bp, Homo sapien
gttcctcgagtgtggtacgtgcgac

SEQ ID NO: 338538 - DNA, 25 bp, Homo sapien
tacgtgcgaccacttcgttggaaaa

SEQ ID NO: 338539 - DNA, 25 bp, Homo sapien
agtgccttcgaggttcctttcccat

SEQ ID NO: 338540 - DNA, 25 bp, Homo sapien
gcagcaaattccttcggtgtcgcct

SEQ ID NO: 338541 - DNA, 25 bp, Homo sapien
gaaagtctttggctcgtagatggcc

SEQ ID NO: 338542 - DNA, 25 bp, Homo sapien
tagatggccagatccgctaggactt

SEQ ID NO: 338543 - DNA, 25 bp, Homo sapien
gctaggactttcctgttgagctcca

SEQ ID NO: 338544 - DNA, 25 bp, Homo sapien
gctccacctggcacttaactaaatt

SEQ ID NO: 338545 - DNA, 25 bp, Homo sapien
ctaaattcccaatgagcgctggata

SEQ ID NO: 338546 - DNA, 25 bp, Homo sapien
gagcgctggatacttcagtccatgt

SEQ ID NO: 338547 - DNA, 25 bp, Homo sapien
atacatgtgtgtgcagttcaccaaa

SEQ ID NO: 338548 - DNA, 25 bp, Homo sapien
atgtgtgtgcagttcaccaaagaca

SEQ ID NO: 338549 - DNA, 25 bp, Homo sapien
gcaaaattaatgtttccatattgta

SEQ ID NO: 338550 - DNA, 25 bp, Homo sapien
atcatgttaccattaattgctttct

SEQ ID NO: 338551 - DNA, 25 bp, Homo sapien
attgctttctatattgttgtattta

SEQ ID NO: 338552 - DNA, 25 bp, Homo sapien
gatttaaccagtgtttatccacctg

SEQ ID NO: 338553 - DNA, 25 bp, Homo sapien
cattaataatttgcctttttacatc

SEQ ID NO: 338554 - DNA, 25 bp, Homo sapien
gtgtttatccacctgttaagacctg

SEQ ID NO: 338555 - DNA, 25 bp, Homo sapien
tccacctgttaagacctgtaatcca

SEQ ID NO: 338556 - DNA, 25 bp, Homo sapien
ctgtaatccagtcagggtggctcat

SEQ ID NO: 338557 - DNA, 25 bp, Homo sapien
acatctcttaggagtgaatcattat

SEQ ID NO: 338558 - DNA, 25 bp, Homo sapien
gtgaacactttcaccataacaggtc

SEQ ID NO: 338559 - DNA, 25 bp, Homo sapien
ttcaccataacaggtcatgctgagg

SEQ ID NO: 338560 - DNA, 25 bp, Homo sapien
cataacaggtcatgctgaggcaaag

SEQ ID NO: 338561 - DNA, 25 bp, Homo sapien
agtgtcttaagccagcttggtgcag

SEQ ID NO: 338562 - DNA, 25 bp, Homo sapien
gtcttaagccagcttggtgcagaca

SEQ ID NO: 338563 - DNA, 25 bp, Homo sapien
taagccagcttggtgcagacagtct

SEQ ID NO: 338564 - DNA, 25 bp, Homo sapien
agccagcttggtgcagacagtctga

SEQ ID NO: 338565 - DNA, 25 bp, Homo sapien
ctggctgaagttctgcccaaacaac

SEQ ID NO: 338566 - DNA, 25 bp, Homo sapien
tgaagttctgcccaaacaacctgtg

SEQ ID NO: 338567 - DNA, 25 bp, Homo sapien
ccaggaatgaggcaagctgaattga

SEQ ID NO: 338568 - DNA, 25 bp, Homo sapien
gaattgagtcgacttctgaagaaga

SEQ ID NO: 338569 - DNA, 25 bp, Homo sapien
gctggttacaaaactcgaggaataa

SEQ ID NO: 338570 - DNA, 25 bp, Homo sapien
aaggagatttagaagcagagctgcc

SEQ ID NO: 338571 - DNA, 25 bp, Homo sapien
agatttagaagcagagctgcccgca

SEQ ID NO: 338572 - DNA, 25 bp, Homo sapien
agcagagctgcccgcagcgaatact

SEQ ID NO: 338573 - DNA, 25 bp, Homo sapien
gcgaatacttttaatgcccgggccg

SEQ ID NO: 338574 - DNA, 25 bp, Homo sapien
gttacaaaactcgaggaataagaag

SEQ ID NO: 338575 - DNA, 25 bp, Homo sapien
ttaggatctgatcccgctgagtaga

SEQ ID NO: 338576 - DNA, 25 bp, Homo sapien
gaagtttaatatttattggtctgca

SEQ ID NO: 338577 - DNA, 25 bp, Homo sapien
tgcaaatccggagaccttgcggcct

SEQ ID NO: 338578 - DNA, 25 bp, Homo sapien
aaatccggagaccttgcggcctcac

SEQ ID NO: 338579 - DNA, 25 bp, Homo sapien
atccggagaccttgcggcctcactg

SEQ ID NO: 338580 - DNA, 25 bp, Homo sapien
aagtggtaggcaagagtctctgtgt

SEQ ID NO: 338581 - DNA, 25 bp, Homo sapien
aagagtctctgtgttaccatgggaa

SEQ ID NO: 338582 - DNA, 25 bp, Homo sapien
tctgtgttaccatgggaacgattaa

SEQ ID NO: 338583 - DNA, 25 bp, Homo sapien
gaacgattaagttttccaaggtgca

SEQ ID NO: 338584 - DNA, 25 bp, Homo sapien
aaggtgcaaaccagcctcattccag

SEQ ID NO: 338585 - DNA, 25 bp, Homo sapien
gcctcattccagcttcagggtcaat

SEQ ID NO: 338586 - DNA, 25 bp, Homo sapien
attccagcttcagggtcaatgactt

SEQ ID NO: 338587 - DNA, 25 bp, Homo sapien
agggtcaatgacttactagctcaga

SEQ ID NO: 338588 - DNA, 25 bp, Homo sapien
aatgacttactagctcagagggaaa

SEQ ID NO: 338589 - DNA, 25 bp, Homo sapien
cacaagaatggctgaggttaggaat

SEQ ID NO: 338590 - DNA, 25 bp, Homo sapien
atttgtgccctgaaaattgtatcaa

SEQ ID NO: 338591 - DNA, 25 bp, Homo sapien
tgtaattttcctacttctttgataa

SEQ ID NO: 338592 - DNA, 25 bp, Homo sapien
agtcagattgttaactccaagattg

SEQ ID NO: 338593 - DNA, 25 bp, Homo sapien
gggttctgggcacagacatctaacc

SEQ ID NO: 338594 - DNA, 25 bp, Homo sapien
gcacagacatctaacctggtattgt

SEQ ID NO: 338595 - DNA, 25 bp, Homo sapien
gtattgtaaggcagaggctcccatt

SEQ ID NO: 338596 - DNA, 25 bp, Homo sapien
cagaggctcccattggaatggtagt

SEQ ID NO: 338597 - DNA, 25 bp, Homo sapien
gtagtggtccgggtcagttgttcat

SEQ ID NO: 338598 - DNA, 25 bp, Homo sapien
tccgggtcagttgttcatggtgtaa

SEQ ID NO: 338599 - DNA, 25 bp, Homo sapien
ggtgtaagctttgcacagtgtatta

SEQ ID NO: 338600 - DNA, 25 bp, Homo sapien
tgtattaacattgggagggtctggc

SEQ ID NO: 338601 - DNA, 25 bp, Homo sapien
ggcttgaaaatttggccaccctcag

SEQ ID NO: 338602 - DNA, 25 bp, Homo sapien
accctgagattatgcggctcttccc

SEQ ID NO: 338603 - DNA, 25 bp, Homo sapien
ttccctcgggcccagatgcagacgg

SEQ ID NO: 338604 - DNA, 25 bp, Homo sapien
cagatgcagacggtgccgaacgctg

SEQ ID NO: 338605 - DNA, 25 bp, Homo sapien
ggtgccgaacgctggccactggatc

SEQ ID NO: 338606 - DNA, 25 bp, Homo sapien
gctgaccgcccacaggacttcatag

SEQ ID NO: 338607 - DNA, 25 bp, Homo sapien
aggacttcatagctgccatccgagg

SEQ ID NO: 338608 - DNA, 25 bp, Homo sapien
catccgaggcttcctggtctaagag

SEQ ID NO: 338609 - DNA, 25 bp, Homo sapien
gaggcttcctggtctaagagttgct

SEQ ID NO: 338610 - DNA, 25 bp, Homo sapien
cttcctggtctaagagttgctggca

SEQ ID NO: 338611 - DNA, 25 bp, Homo sapien
ctggtctaagagttgctggcaagaa

SEQ ID NO: 338612 - DNA, 25 bp, Homo sapien
accaccctgagattatgcggctctt

SEQ ID NO: 338613 - DNA, 25 bp, Homo sapien
tgccctagggaaggatggacgcact

SEQ ID NO: 338614 - DNA, 25 bp, Homo sapien
gaaggatggacgcactgcctacaag

SEQ ID NO: 338615 - DNA, 25 bp, Homo sapien
gatggacgcactgcctacaaggaga

SEQ ID NO: 338616 - DNA, 25 bp, Homo sapien
acgcactgcctacaaggagacgcaa

SEQ ID NO: 338617 - DNA, 25 bp, Homo sapien
ggagacgcaaagtgggacctcgctc

SEQ ID NO: 338618 - DNA, 25 bp, Homo sapien
gcaaagtgggacctcgctccatttg

SEQ ID NO: 338619 - DNA, 25 bp, Homo sapien
tgggacctcgctccatttgcccagg

SEQ ID NO: 338620 - DNA, 25 bp, Homo sapien
atggtccgcaccaccagggaaagct

SEQ ID NO: 338621 - DNA, 25 bp, Homo sapien
cagggaaagctggtcaagaaagttg

SEQ ID NO: 338622 - DNA, 25 bp, Homo sapien
aagaaagttgatgacggaaattcgg

SEQ ID NO: 338623 - DNA, 25 bp, Homo sapien
aaacatgaggccctcccaggaaagt

SEQ ID NO: 338624 - DNA, 25 bp, Homo sapien
tagggtaactggttccccaagcgca

SEQ ID NO: 338625 - DNA, 25 bp, Homo sapien
gggtaactggttccccaagcgcaga

SEQ ID NO: 338626 - DNA, 25 bp, Homo sapien
tttgtatctctcacttggcacccat

SEQ ID NO: 338627 - DNA, 25 bp, Homo sapien
taactggttccccaagcgcagagct

SEQ ID NO: 338628 - DNA, 25 bp, Homo sapien
atcacaaactccgtctgagctattc

SEQ ID NO: 338629 - DNA, 25 bp, Homo sapien
tgagctattcctttctaagccatgc

SEQ ID NO: 338630 - DNA, 25 bp, Homo sapien
taagccatgccctctgtactctgac

SEQ ID NO: 338631 - DNA, 25 bp, Homo sapien
tctgtactctgacttgccccaaata

SEQ ID NO: 338632 - DNA, 25 bp, Homo sapien
ctgtactctgacttgccccaaatag

SEQ ID NO: 338633 - DNA, 25 bp, Homo sapien
tgccccaaatagacagatgctcaat

SEQ ID NO: 338634 - DNA, 25 bp, Homo sapien
ccccaaatagacagatgctcaataa

SEQ ID NO: 338635 - DNA, 25 bp, Homo sapien
aaggcaaggtgaccgtgttcaatgc

SEQ ID NO: 338636 - DNA, 25 bp, Homo sapien
tcaatgcttcttcatggaccatcca

SEQ ID NO: 338637 - DNA, 25 bp, Homo sapien
agcactcctttaaagtgggcactgc

SEQ ID NO: 338638 - DNA, 25 bp, Homo sapien
gtgaactgcatggtgatggccgacc

SEQ ID NO: 338639 - DNA, 25 bp, Homo sapien
gaagactccgtcatctacatcatca

SEQ ID NO: 338640 - DNA, 25 bp, Homo sapien
tacatcatcaacgtccacagcatgt

SEQ ID NO: 338641 - DNA, 25 bp, Homo sapien
atgtcctgcaacaagcagctcacag

SEQ ID NO: 338642 - DNA, 25 bp, Homo sapien
actgctccagtgtcacggatttgat

SEQ ID NO: 338643 - DNA, 25 bp, Homo sapien
aggacggacaggaggcacccagcaa

SEQ ID NO: 338644 - DNA, 25 bp, Homo sapien
aggcacccagcaacgtgtactcgtg

SEQ ID NO: 338645 - DNA, 25 bp, Homo sapien
tgtactcgtgcagcatggacggcat

SEQ ID NO: 338646 - DNA, 25 bp, Homo sapien
agccagtatgtgcccctcacccagg

SEQ ID NO: 338647 - DNA, 25 bp, Homo sapien
gggccctggagagtcctgtttgcac

SEQ ID NO: 338648 - DNA, 25 bp, Homo sapien
ggccctggagagtcctgtttgcaca

SEQ ID NO: 338649 - DNA, 25 bp, Homo sapien
cctggagagtcctgtttgcacagcc

SEQ ID NO: 338650 - DNA, 25 bp, Homo sapien
ctggagagtcctgtttgcacagccc

SEQ ID NO: 338651 - DNA, 25 bp, Homo sapien
tggagagtcctgtttgcacagccca

SEQ ID NO: 338652 - DNA, 25 bp, Homo sapien
ggagagtcctgtttgcacagcccag

SEQ ID NO: 338653 - DNA, 25 bp, Homo sapien
gagagtcctgtttgcacagcccagg

SEQ ID NO: 338654 - DNA, 25 bp, Homo sapien
acagcccaggggtgtccggcctctg

SEQ ID NO: 338655 - DNA, 25 bp, Homo sapien
agcccaggggtgtccggcctctggc

SEQ ID NO: 338656 - DNA, 25 bp, Homo sapien
ggccaagccccgagggcccctgcaa

SEQ ID NO: 338657 - DNA, 25 bp, Homo sapien
gtacatatgacaagtcttttgcaaa

SEQ ID NO: 338658 - DNA, 25 bp, Homo sapien
tgcaaaactgtgtgatctttgtgaa

SEQ ID NO: 338659 - DNA, 25 bp, Homo sapien
ctgtcacactgaagcactggttggg

SEQ ID NO: 338660 - DNA, 25 bp, Homo sapien
tcacactgaagcactggttgggcat

SEQ ID NO: 338661 - DNA, 25 bp, Homo sapien
actgaagcactggttgggcatttta

SEQ ID NO: 338662 - DNA, 25 bp, Homo sapien
gaagcactggttgggcattttaatt

SEQ ID NO: 338663 - DNA, 25 bp, Homo sapien
cactggttgggcattttaattcatg

SEQ ID NO: 338664 - DNA, 25 bp, Homo sapien
ttgcgtatataattgcttacagctt

SEQ ID NO: 338665 - DNA, 25 bp, Homo sapien
tatataattgcttacagcttttctc

SEQ ID NO: 338666 - DNA, 25 bp, Homo sapien
tctcatttgatatatagcattgtac

SEQ ID NO: 338667 - DNA, 25 bp, Homo sapien
gatatatagcattgtacatatgaca

SEQ ID NO: 338668 - DNA, 25 bp, Homo sapien
aaatggtcctaatcctgagtcgtca

SEQ ID NO: 338669 - DNA, 25 bp, Homo sapien
gagtcgtcacccttggattttatgg

SEQ ID NO: 338670 - DNA, 25 bp, Homo sapien
tggatcacggagctgaccatcttta

SEQ ID NO: 338671 - DNA, 25 bp, Homo sapien
accatctttacctggtcctggaact

SEQ ID NO: 338672 - DNA, 25 bp, Homo sapien
gaaaatgagcctttggaccagtctt

SEQ ID NO: 338673 - DNA, 25 bp, Homo sapien
gagcctttggaccagtctttattaa

SEQ ID NO: 338674 - DNA, 25 bp, Homo sapien
aaacatgagtagtctgcatatcgaa

SEQ ID NO: 338675 - DNA, 25 bp, Homo sapien
gcatatcgaatatctagagctctaa

SEQ ID NO: 338676 - DNA, 25 bp, Homo sapien
gtcctgtggtttcattagtctgata

SEQ ID NO: 338677 - DNA, 25 bp, Homo sapien
agggatttcctcagtcacagatgat

SEQ ID NO: 338678 - DNA, 25 bp, Homo sapien
ggaaagctgcaataaagccacaatg

SEQ ID NO: 338679 - DNA, 25 bp, Homo sapien
tctctctggcatccacctgtctggg

SEQ ID NO: 338680 - DNA, 25 bp, Homo sapien
gggtgaccactctggcctgcgtact

SEQ ID NO: 338681 - DNA, 25 bp, Homo sapien
tgcgtactcctcactcagaaacaag

SEQ ID NO: 338682 - DNA, 25 bp, Homo sapien
gtactcctcactcagaaacaagaac

SEQ ID NO: 338683 - DNA, 25 bp, Homo sapien
tcgagcagatgacacgagctagtcc

SEQ ID NO: 338684 - DNA, 25 bp, Homo sapien
atgacacgagctagtccacgttgac

SEQ ID NO: 338685 - DNA, 25 bp, Homo sapien
gagctagtccacgttgacagcttaa

SEQ ID NO: 338686 - DNA, 25 bp, Homo sapien
gtccacgttgacagcttaagacagt

SEQ ID NO: 338687 - DNA, 25 bp, Homo sapien
cagcttaagacagtgctagctctgc

SEQ ID NO: 338688 - DNA, 25 bp, Homo sapien
tgccctggctctcctagaaggtgga

SEQ ID NO: 338689 - DNA, 25 bp, Homo sapien
tggctctcctagaaggtggaggaca

SEQ ID NO: 338690 - DNA, 25 bp, Homo sapien
gcattttggagagtccacaccacgg

SEQ ID NO: 338691 - DNA, 25 bp, Homo sapien
gagtccacaccacggaccaggtttt

SEQ ID NO: 338692 - DNA, 25 bp, Homo sapien
cccaaggcttggctttgtgtagcta

SEQ ID NO: 338693 - DNA, 25 bp, Homo sapien
gctttgtgtagctactaacttcttg

SEQ ID NO: 338694 - DNA, 25 bp, Homo sapien
agagaattatgtggcctcatcctcc

SEQ ID NO: 338695 - DNA, 25 bp, Homo sapien
aaggctgtgcttgcagcccgggcac

SEQ ID NO: 338696 - DNA, 25 bp, Homo sapien
ttcccactttctagctctggagagg

SEQ ID NO: 338697 - DNA, 25 bp, Homo sapien
ttggattttgcttttgtaaacacat

SEQ ID NO: 338698 - DNA, 25 bp, Homo sapien
ttaatgccagtcctcatgtaacctc

SEQ ID NO: 338699 - DNA, 25 bp, Homo sapien
taacctcaggtatcttcagcttgtg

SEQ ID NO: 338700 - DNA, 25 bp, Homo sapien
caggtatcttcagcttgtggagaat

SEQ ID NO: 338701 - DNA, 25 bp, Homo sapien
gcacatgttcagtgtgttacttcta

SEQ ID NO: 338702 - DNA, 25 bp, Homo sapien
gatgcttctttattgcttctatttg

SEQ ID NO: 338703 - DNA, 25 bp, Homo sapien
tattgcttctatttggacctgtatc

SEQ ID NO: 338704 - DNA, 25 bp, Homo sapien
ctatttggacctgtatctgctgata

SEQ ID NO: 338705 - DNA, 25 bp, Homo sapien
ggacctgtatctgctgataaaactg

SEQ ID NO: 338706 - DNA, 25 bp, Homo sapien
aactgcatgtctgttttagaatgac

SEQ ID NO: 338707 - DNA, 25 bp, Homo sapien
ggagcttctagctcaagaaggagga

SEQ ID NO: 338708 - DNA, 25 bp, Homo sapien
gaaagaacagacacagcttcgccgt

SEQ ID NO: 338709 - DNA, 25 bp, Homo sapien
acagcttcgccgtgggtggtcgaca

SEQ ID NO: 338710 - DNA, 25 bp, Homo sapien
gtggtcgacacctacatgtttgtat

SEQ ID NO: 338711 - DNA, 25 bp, Homo sapien
cacctacatgtttgtatctgcacat

SEQ ID NO: 338712 - DNA, 25 bp, Homo sapien
ttttttcagagcatgtatacacttt

SEQ ID NO: 338713 - DNA, 25 bp, Homo sapien
gtttctgatggcatagctgaagtca

SEQ ID NO: 338714 - DNA, 25 bp, Homo sapien
agctgaagtcatgttgtggctttat

SEQ ID NO: 338715 - DNA, 25 bp, Homo sapien
ttgtggctttattagtttcaggaac

SEQ ID NO: 338716 - DNA, 25 bp, Homo sapien
ttcaggaacttggatgtctgtttta

SEQ ID NO: 338717 - DNA, 25 bp, Homo sapien
gtctgttttaaaccttagctatcat

SEQ ID NO: 338718 - DNA, 25 bp, Homo sapien
cttagctatcattttagtcatccca

SEQ ID NO: 338719 - DNA, 25 bp, Homo sapien
ggaagtttgacttgactattcttat

SEQ ID NO: 338720 - DNA, 25 bp, Homo sapien
aaaaggaaggactagctgagctgac

SEQ ID NO: 338721 - DNA, 25 bp, Homo sapien
ctgacggaagttaagcttgctttct

SEQ ID NO: 338722 - DNA, 25 bp, Homo sapien
ttgctttcttaaccgcaaggcttag

SEQ ID NO: 338723 - DNA, 25 bp, Homo sapien
ccagcaagggagttgtgacgtgcat

SEQ ID NO: 338724 - DNA, 25 bp, Homo sapien
cccagagagcatcttcgagatgatg

SEQ ID NO: 338725 - DNA, 25 bp, Homo sapien
ttcgagatgatggagactggcaagc

SEQ ID NO: 338726 - DNA, 25 bp, Homo sapien
gtgtgggcaaggtactgcatgcctc

SEQ ID NO: 338727 - DNA, 25 bp, Homo sapien
aaggtactgcatgcctccttgcaga

SEQ ID NO: 338728 - DNA, 25 bp, Homo sapien
actgcatgcctccttgcagagtgtt

SEQ ID NO: 338729 - DNA, 25 bp, Homo sapien
gagacagaaagttggattcctggga

SEQ ID NO: 338730 - DNA, 25 bp, Homo sapien
ggattcctgggatgatttgcacatc

SEQ ID NO: 338731 - DNA, 25 bp, Homo sapien
gggatgatttgcacatcaactgctc

SEQ ID NO: 338732 - DNA, 25 bp, Homo sapien
atttgcacatcaactgctcaactgt

SEQ ID NO: 338733 - DNA, 25 bp, Homo sapien
gctcaactgtggattgttttttact

SEQ ID NO: 338734 - DNA, 25 bp, Homo sapien
gatgatcattccagttagtttggca

SEQ ID NO: 338735 - DNA, 25 bp, Homo sapien
ggcattttttgtcgtttgtgcacat

SEQ ID NO: 338736 - DNA, 25 bp, Homo sapien
gtcgtttgtgcacataacttggtgt

SEQ ID NO: 338737 - DNA, 25 bp, Homo sapien
aacttggtgttatccttatgtcatc

SEQ ID NO: 338738 - DNA, 25 bp, Homo sapien
ttatgtcatcagattcctcctaggg

SEQ ID NO: 338739 - DNA, 25 bp, Homo sapien
gggaaaccagattgtcgggactatg

SEQ ID NO: 338740 - DNA, 25 bp, Homo sapien
gggactatgacctttttctccagta

SEQ ID NO: 338741 - DNA, 25 bp, Homo sapien
ttctccagtatgctacctgatttgt

SEQ ID NO: 338742 - DNA, 25 bp, Homo sapien
gatttgtttggctggccactaggtg

SEQ ID NO: 338743 - DNA, 25 bp, Homo sapien
cactaggtggcagcattggttctac

SEQ ID NO: 338744 - DNA, 25 bp, Homo sapien
tggttctacttctctgctttttaag

SEQ ID NO: 338745 - DNA, 25 bp, Homo sapien
gcaccaggttcaaggtacccggctg

SEQ ID NO: 338746 - DNA, 25 bp, Homo sapien
aggttcaaggtacccggctgtcctg

SEQ ID NO: 338747 - DNA, 25 bp, Homo sapien
tgcgctgggcttgccgggactctct

SEQ ID NO: 338748 - DNA, 25 bp, Homo sapien
tcagagatcattgatttcttcctgg

SEQ ID NO: 338749 - DNA, 25 bp, Homo sapien
ggactctctcggctctgcatagttg

SEQ ID NO: 338750 - DNA, 25 bp, Homo sapien
ggctctgcatagttgcacttggctt

SEQ ID NO: 338751 - DNA, 25 bp, Homo sapien
atagttgcacttggcttcacccgtg

SEQ ID NO: 338752 - DNA, 25 bp, Homo sapien
ggcttcacccgtgtgactttcgtaa

SEQ ID NO: 338753 - DNA, 25 bp, Homo sapien
ttcacccgtgtgactttcgtaacgg

SEQ ID NO: 338754 - DNA, 25 bp, Homo sapien
tatgccagtgcagaagcagacccgt

SEQ ID NO: 338755 - DNA, 25 bp, Homo sapien
agtgcagaagcagacccgtgccggc

SEQ ID NO: 338756 - DNA, 25 bp, Homo sapien
cgagcgggaattgctttcctggttc

SEQ ID NO: 338757 - DNA, 25 bp, Homo sapien
tgctttcctggttcgatccgctgcc

SEQ ID NO: 338758 - DNA, 25 bp, Homo sapien
gatccgctgccgctgtgagggccga

SEQ ID NO: 338759 - DNA, 25 bp, Homo sapien
ctgtgagggccgagcggaaacccgt

SEQ ID NO: 338760 - DNA, 25 bp, Homo sapien
gctccggcctccgagagaaagcagt

SEQ ID NO: 338761 - DNA, 25 bp, Homo sapien
ggcctccgagagaaagcagtcccca

SEQ ID NO: 338762 - DNA, 25 bp, Homo sapien
cacggccgctgctatcgctactgag

SEQ ID NO: 338763 - DNA, 25 bp, Homo sapien
gctgctatcgctactgagccaacaa

SEQ ID NO: 338764 - DNA, 25 bp, Homo sapien
ctatcgctactgagccaacaaaggg

SEQ ID NO: 338765 - DNA, 25 bp, Homo sapien
gtcgtcgcgtcactcctctttgcgt

SEQ ID NO: 338766 - DNA, 25 bp, Homo sapien
ggagccgagcgggaattgctttcct

SEQ ID NO: 338767 - DNA, 25 bp, Homo sapien
gggccctggagagtcctgtttgcac

SEQ ID NO: 338768 - DNA, 25 bp, Homo sapien
ggccctggagagtcctgtttgcaca

SEQ ID NO: 338769 - DNA, 25 bp, Homo sapien
cctggagagtcctgtttgcacagcc

SEQ ID NO: 338770 - DNA, 25 bp, Homo sapien
tggagagtcctgtttgcacagccca

SEQ ID NO: 338771 - DNA, 25 bp, Homo sapien
ggagagtcctgtttgcacagcccag

SEQ ID NO: 338772 - DNA, 25 bp, Homo sapien
gagagtcctgtttgcacagcccagg

SEQ ID NO: 338773 - DNA, 25 bp, Homo sapien
agagtcctgtttgcacagcccaggg

SEQ ID NO: 338774 - DNA, 25 bp, Homo sapien
acagcccaggggtgtccggcctctg

SEQ ID NO: 338775 - DNA, 25 bp, Homo sapien
tggcccgccccggagcagggagggt

SEQ ID NO: 338776 - DNA, 25 bp, Homo sapien
ggccaagccccgagggcccctgcaa

SEQ ID NO: 338777 - DNA, 25 bp, Homo sapien
tgcaccccaaagaagccactgaggc

SEQ ID NO: 338778 - DNA, 25 bp, Homo sapien
aaagctgctattttcatcctccttg

SEQ ID NO: 338779 - DNA, 25 bp, Homo sapien
atcctccttgtggttgcttttcttg

SEQ ID NO: 338780 - DNA, 25 bp, Homo sapien
ttcttgtttctcttccattgtacat

SEQ ID NO: 338781 - DNA, 25 bp, Homo sapien
gtttctcttccattgtacatgtggg

SEQ ID NO: 338782 - DNA, 25 bp, Homo sapien
ggtagtcctttgtaaagctgtacag

SEQ ID NO: 338783 - DNA, 25 bp, Homo sapien
agctgtacagactttgcagtttaag

SEQ ID NO: 338784 - DNA, 25 bp, Homo sapien
ttgcagtttaagcacaatgtgcaca

SEQ ID NO: 338785 - DNA, 25 bp, Homo sapien
aacttgattttttgcagatggaaag

SEQ ID NO: 338786 - DNA, 25 bp, Homo sapien
gtaaatggattgtttgtgcttaatg

SEQ ID NO: 338787 - DNA, 25 bp, Homo sapien
gtttgtgcttaatgtaaagccgctt

SEQ ID NO: 338788 - DNA, 25 bp, Homo sapien
tgtaaagccgctttataaaactgta

SEQ ID NO: 338789 - DNA, 25 bp, Homo sapien
gtgcccaaactttatatacttcagt

SEQ ID NO: 338790 - DNA, 25 bp, Homo sapien
ttcagaaatataagagcggcagcca

SEQ ID NO: 338791 - DNA, 25 bp, Homo sapien
gcggcagccagaccaaccagttttt

SEQ ID NO: 338792 - DNA, 25 bp, Homo sapien
agtttttccagatatcttgatgtga

SEQ ID NO: 338793 - DNA, 25 bp, Homo sapien
tcttgatgtgaacctgaccctactc

SEQ ID NO: 338794 - DNA, 25 bp, Homo sapien
ctgaccctactcctttagaagacag

SEQ ID NO: 338795 - DNA, 25 bp, Homo sapien
ctcctttagaagacagcctgttcat

SEQ ID NO: 338796 - DNA, 25 bp, Homo sapien
aacccaaactgttctatgaccattg

SEQ ID NO: 338797 - DNA, 25 bp, Homo sapien
atgaccattgtttcaagagacatta

SEQ ID NO: 338798 - DNA, 25 bp, Homo sapien
aagagacattaacacagttctgtaa

SEQ ID NO: 338799 - DNA, 25 bp, Homo sapien
tggcatactgtatccttttcttaac

SEQ ID NO: 338800 - DNA, 25 bp, Homo sapien
atcagagatcattgatttcttcctg

SEQ ID NO: 338801 - DNA, 25 bp, Homo sapien
tcagagatcattgatttcttcctgg

SEQ ID NO: 338802 - DNA, 25 bp, Homo sapien
tgaagattatgccagtgcagaagca

SEQ ID NO: 338803 - DNA, 25 bp, Homo sapien
gattatgccagtgcagaagcagacc

SEQ ID NO: 338804 - DNA, 25 bp, Homo sapien
ttatgccagtgcagaagcagacccg

SEQ ID NO: 338805 - DNA, 25 bp, Homo sapien
tatgccagtgcagaagcagacccgt

SEQ ID NO: 338806 - DNA, 25 bp, Homo sapien
atgccagtgcagaagcagacccgtg

SEQ ID NO: 338807 - DNA, 25 bp, Homo sapien
tgccagtgcagaagcagacccgtgc

SEQ ID NO: 338808 - DNA, 25 bp, Homo sapien
agtgcagaagcagacccgtgccggc

SEQ ID NO: 338809 - DNA, 25 bp, Homo sapien
tgcagaagcagacccgtgccggcca

SEQ ID NO: 338810 - DNA, 25 bp, Homo sapien
agaagcagacccgtgccggccagcg

SEQ ID NO: 338811 - DNA, 25 bp, Homo sapien
tctcagttcatgttctcttccataa

SEQ ID NO: 338812 - DNA, 25 bp, Homo sapien
gttcatgttctcttccataattgga

SEQ ID NO: 338813 - DNA, 25 bp, Homo sapien
taattggaaaggacctttgtctgtt

SEQ ID NO: 338814 - DNA, 25 bp, Homo sapien
tgtttttcctcttgggtgccttcca

SEQ ID NO: 338815 - DNA, 25 bp, Homo sapien
gtgccttccagaacgcatctcatgt

SEQ ID NO: 338816 - DNA, 25 bp, Homo sapien
tgctgtggctgcgatggtcacccag

SEQ ID NO: 338817 - DNA, 25 bp, Homo sapien
tgtggctgcgatggtcacccagctg

SEQ ID NO: 338818 - DNA, 25 bp, Homo sapien
tcactggagtgacaatttgacctgt

SEQ ID NO: 338819 - DNA, 25 bp, Homo sapien
gacaatttgacctgtcacctgagaa

SEQ ID NO: 338820 - DNA, 25 bp, Homo sapien
atttgacctgtcacctgagaaggat

SEQ ID NO: 338821 - DNA, 25 bp, Homo sapien
gtcacctgagaaggatggtccctca

SEQ ID NO: 338822 - DNA, 25 bp, Homo sapien
ctttaattttcttgtcactcagatt

SEQ ID NO: 338823 - DNA, 25 bp, Homo sapien
taattttcttgtcactcagattctg

SEQ ID NO: 338824 - DNA, 25 bp, Homo sapien
tcactcagattctgacagataaagt

SEQ ID NO: 338825 - DNA, 25 bp, Homo sapien
gacagataaagtatcatttcagtag

SEQ ID NO: 338826 - DNA, 25 bp, Homo sapien
tgtctgcccatctgataaccgaaaa

SEQ ID NO: 338827 - DNA, 25 bp, Homo sapien
ttgtagaaacagagtgcccctgttt

SEQ ID NO: 338828 - DNA, 25 bp, Homo sapien
cagaccaatattcaatagttggata

SEQ ID NO: 338829 - DNA, 25 bp, Homo sapien
gtagaaacagagtgcccctgttttg

SEQ ID NO: 338830 - DNA, 25 bp, Homo sapien
aacagagtgcccctgttttgcccag

SEQ ID NO: 338831 - DNA, 25 bp, Homo sapien
acagagtgcccctgttttgcccagg

SEQ ID NO: 338832 - DNA, 25 bp, Homo sapien
gtgcccctgttttgcccaggcttgt

SEQ ID NO: 338833 - DNA, 25 bp, Homo sapien
ccccttccaaattctgtaacacatt

SEQ ID NO: 338834 - DNA, 25 bp, Homo sapien
ggaaactctgcaaggctaaactgtc

SEQ ID NO: 338835 - DNA, 25 bp, Homo sapien
tgcaaggctaaactgtcattcacaa

SEQ ID NO: 338836 - DNA, 25 bp, Homo sapien
gctaaactgtcattcacaacttggc

SEQ ID NO: 338837 - DNA, 25 bp, Homo sapien
cagttttgtctccagaaccttaggc

SEQ ID NO: 338838 - DNA, 25 bp, Homo sapien
tttgtctccagaaccttaggctttt

SEQ ID NO: 338839 - DNA, 25 bp, Homo sapien
tccagaaccttaggcttttgtattt

SEQ ID NO: 338840 - DNA, 25 bp, Homo sapien
ttcactgttaatccttattgtcttt

SEQ ID NO: 338841 - DNA, 25 bp, Homo sapien
aaagcaggaggtagttgtgcctcaa

SEQ ID NO: 338842 - DNA, 25 bp, Homo sapien
ggtagttgtgcctcaattattgcaa

SEQ ID NO: 338843 - DNA, 25 bp, Homo sapien
gttgtgcctcaattattgcaaaaat

SEQ ID NO: 338844 - DNA, 25 bp, Homo sapien
ggaaatgtgagctacaaagcatctt

SEQ ID NO: 338845 - DNA, 25 bp, Homo sapien
ggttgttttgaggaactacccatca

SEQ ID NO: 338846 - DNA, 25 bp, Homo sapien
tacccatcatttatagccttactct

SEQ ID NO: 338847 - DNA, 25 bp, Homo sapien
ttacaaaatgcagttcaggttctag

SEQ ID NO: 338848 - DNA, 25 bp, Homo sapien
gttcaggttctagattgccaccatt

SEQ ID NO: 338849 - DNA, 25 bp, Homo sapien
tagattgccaccattctagagtgtg

SEQ ID NO: 338850 - DNA, 25 bp, Homo sapien
accattctagagtgtggcacacacc

SEQ ID NO: 338851 - DNA, 25 bp, Homo sapien
ggcgtgattcatttggatgttggaa

SEQ ID NO: 338852 - DNA, 25 bp, Homo sapien
gatgttggaaactcaatgtctgttg

SEQ ID NO: 338853 - DNA, 25 bp, Homo sapien
atgttctgttagttagaaatcttac

SEQ ID NO: 338854 - DNA, 25 bp, Homo sapien
taatcaacatttttggttattcagt

SEQ ID NO: 338855 - DNA, 25 bp, Homo sapien
cagccataccatgggctcatatttt

SEQ ID NO: 338856 - DNA, 25 bp, Homo sapien
cataccatgggctcatattttagaa

SEQ ID NO: 338857 - DNA, 25 bp, Homo sapien
ctcatattttagaaaccactcttgg

SEQ ID NO: 338858 - DNA, 25 bp, Homo sapien
tcatattttagaaaccactcttggc

SEQ ID NO: 338859 - DNA, 25 bp, Homo sapien
catattttagaaaccactcttggcc

SEQ ID NO: 338860 - DNA, 25 bp, Homo sapien
atattttagaaaccactcttggcca

SEQ ID NO: 338861 - DNA, 25 bp, Homo sapien
tattttagaaaccactcttggccag

SEQ ID NO: 338862 - DNA, 25 bp, Homo sapien
attttagaaaccactcttggccagg

SEQ ID NO: 338863 - DNA, 25 bp, Homo sapien
ttttagaaaccactcttggccaggc

SEQ ID NO: 338864 - DNA, 25 bp, Homo sapien
tttagaaaccactcttggccaggca

SEQ ID NO: 338865 - DNA, 25 bp, Homo sapien
ttagaaaccactcttggccaggcat

SEQ ID NO: 338866 - DNA, 25 bp, Homo sapien
caggaccatctcctttcggatgaaa

SEQ ID NO: 338867 - DNA, 25 bp, Homo sapien
atctcctttcggatgaaacccaaga

SEQ ID NO: 338868 - DNA, 25 bp, Homo sapien
tcggaaacaaccctaactcgcagtg

SEQ ID NO: 338869 - DNA, 25 bp, Homo sapien
aactcgcagtgccagcatgaagctc

SEQ ID NO: 338870 - DNA, 25 bp, Homo sapien
cagcatgaagctcccagacaacaca

SEQ ID NO: 338871 - DNA, 25 bp, Homo sapien
aagctggagagataccacacggcca

SEQ ID NO: 338872 - DNA, 25 bp, Homo sapien
agagataccacacggccatacggag

SEQ ID NO: 338873 - DNA, 25 bp, Homo sapien
cacggccatacggagatcagaatct

SEQ ID NO: 338874 - DNA, 25 bp, Homo sapien
agatcagaatctgtcaagtctcggg

SEQ ID NO: 338875 - DNA, 25 bp, Homo sapien
gaagaacctgccctctttggcaaag

SEQ ID NO: 338876 - DNA, 25 bp, Homo sapien
gggcttcagaccctccgactgtggc

SEQ ID NO: 338877 - DNA, 25 bp, Homo sapien
aactgctatattaacgtcttaaaat

SEQ ID NO: 338878 - DNA, 25 bp, Homo sapien
tttaccgatttatgaattcttatac

SEQ ID NO: 338879 - DNA, 25 bp, Homo sapien
taccgatttatgaattcttatacac

SEQ ID NO: 338880 - DNA, 25 bp, Homo sapien
ccgatttatgaattcttatacacag

SEQ ID NO: 338881 - DNA, 25 bp, Homo sapien
gaattcttatacacagaatgcataa

SEQ ID NO: 338882 - DNA, 25 bp, Homo sapien
ttcttatacacagaatgcataatgg

SEQ ID NO: 338883 - DNA, 25 bp, Homo sapien
tatacacagaatgcataatggaaat

SEQ ID NO: 338884 - DNA, 25 bp, Homo sapien
atactgatttttgtctaaagtggca

SEQ ID NO: 338885 - DNA, 25 bp, Homo sapien
tactgatttttgtctaaagtggcat

SEQ ID NO: 338886 - DNA, 25 bp, Homo sapien
ctgatttttgtctaaagtggcatta

SEQ ID NO: 338887 - DNA, 25 bp, Homo sapien
tgatttttgtctaaagtggcattat

SEQ ID NO: 338888 - DNA, 25 bp, Homo sapien
caagaatttattcaccagttcctct

SEQ ID NO: 338889 - DNA, 25 bp, Homo sapien
tctctcctcctattttacttgaggc

SEQ ID NO: 338890 - DNA, 25 bp, Homo sapien
tttacttgaggctgccaattaccag

SEQ ID NO: 338891 - DNA, 25 bp, Homo sapien
acctgtttcagctcaagagatgcct

SEQ ID NO: 338892 - DNA, 25 bp, Homo sapien
attatgtgaggccacttggtagcaa

SEQ ID NO: 338893 - DNA, 25 bp, Homo sapien
ggcagctatttcctgagcctagtac

SEQ ID NO: 338894 - DNA, 25 bp, Homo sapien
tcctgagcctagtaccccaattaag

SEQ ID NO: 338895 - DNA, 25 bp, Homo sapien
aattaagcccaccattggttagcac

SEQ ID NO: 338896 - DNA, 25 bp, Homo sapien
attggttagcacactcagcgctgtg

SEQ ID NO: 338897 - DNA, 25 bp, Homo sapien
tcagcgctgtgagtcgtgaagacac

SEQ ID NO: 338898 - DNA, 25 bp, Homo sapien
gaagacacgggagaaaatccaccat

SEQ ID NO: 338899 - DNA, 25 bp, Homo sapien
gacctgctaatttgtgccctgactt

SEQ ID NO: 338900 - DNA, 25 bp, Homo sapien
ctatctcaagaagacctgcaaggaa

SEQ ID NO: 338901 - DNA, 25 bp, Homo sapien
ctgctaatttgtgccctgacttatc

SEQ ID NO: 338902 - DNA, 25 bp, Homo sapien
tgcaaggaattaaccccctcttcat

SEQ ID NO: 338903 - DNA, 25 bp, Homo sapien
cctcttcatatccagcatatagcca

SEQ ID NO: 338904 - DNA, 25 bp, Homo sapien
tatccagcatatagccaactttggc

SEQ ID NO: 338905 - DNA, 25 bp, Homo sapien
ctaatttgtgccctgacttatcagc

SEQ ID NO: 338906 - DNA, 25 bp, Homo sapien
atatagccaactttggcccccatac

SEQ ID NO: 338907 - DNA, 25 bp, Homo sapien
accacaaccttccagtttcattaat

SEQ ID NO: 338908 - DNA, 25 bp, Homo sapien
caaccttccagtttcattaattcca

SEQ ID NO: 338909 - DNA, 25 bp, Homo sapien
tccagtttcattaattccacccctt

SEQ ID NO: 338910 - DNA, 25 bp, Homo sapien
ttctgactcattgtgaaggtgacca

SEQ ID NO: 338911 - DNA, 25 bp, Homo sapien
gaaggtgaccagatatgaaggcata

SEQ ID NO: 338912 - DNA, 25 bp, Homo sapien
ggcatatatatgactactcctctgt

SEQ ID NO: 338913 - DNA, 25 bp, Homo sapien
actcctctgtcccttaggtgtataa

SEQ ID NO: 338914 - DNA, 25 bp, Homo sapien
gtataagacttagctggaatccaac

SEQ ID NO: 338915 - DNA, 25 bp, Homo sapien
aaagatttgggctggtctctccatc

SEQ ID NO: 338916 - DNA, 25 bp, Homo sapien
tggtctctccatcttaacgttgatg

SEQ ID NO: 338917 - DNA, 25 bp, Homo sapien
aacgttgatgggattcaggacacat

SEQ ID NO: 338918 - DNA, 25 bp, Homo sapien
ggattcaggacacataaccccaaaa

SEQ ID NO: 338919 - DNA, 25 bp, Homo sapien
actgcagaagcaaggtttctcatac

SEQ ID NO: 338920 - DNA, 25 bp, Homo sapien
agaagcaaggtttctcataccttcc

SEQ ID NO: 338921 - DNA, 25 bp, Homo sapien
aaaagtaaggatgtcttctggcaat

SEQ ID NO: 338922 - DNA, 25 bp, Homo sapien
gatgtcttctggcaatttcatataa

SEQ ID NO: 338923 - DNA, 25 bp, Homo sapien
attgtcatgaaaagcagtgcacatc

SEQ ID NO: 338924 - DNA, 25 bp, Homo sapien
agtgcacatcacatcaacctctggt

SEQ ID NO: 338925 - DNA, 25 bp, Homo sapien
tctttgtgttgcaagaagcattcat

SEQ ID NO: 338926 - DNA, 25 bp, Homo sapien
agcattcatttctctcaggttcttg

SEQ ID NO: 338927 - DNA, 25 bp, Homo sapien
tctctcaggttcttgttttgcacag

SEQ ID NO: 338928 - DNA, 25 bp, Homo sapien
aggttcttgttttgcacagcagtca

SEQ ID NO: 338929 - DNA, 25 bp, Homo sapien
cacgaagagttgcaactgtgcataa

SEQ ID NO: 338930 - DNA, 25 bp, Homo sapien
aactgtgcataatttgtctcccaaa

SEQ ID NO: 338931 - DNA, 25 bp, Homo sapien
taatttgtctcccaaaaagggtatg

SEQ ID NO: 338932 - DNA, 25 bp, Homo sapien
tgatatccccgcactagtgaaagga

SEQ ID NO: 338933 - DNA, 25 bp, Homo sapien
gtgaaaggaacgctgccccaggaaa

SEQ ID NO: 338934 - DNA, 25 bp, Homo sapien
aggaaagggtcaccaagcttgcacc

SEQ ID NO: 338935 - DNA, 25 bp, Homo sapien
actgaaagaattaccgctggccatt

SEQ ID NO: 338936 - DNA, 25 bp, Homo sapien
accgctggccattgtagtgctgaga

SEQ ID NO: 338937 - DNA, 25 bp, Homo sapien
gcaagagctgatctagctagggctt

SEQ ID NO: 338938 - DNA, 25 bp, Homo sapien
tagctagggctttgtcttttcatct

SEQ ID NO: 338939 - DNA, 25 bp, Homo sapien
catctttgtgcataacttacctgtt

SEQ ID NO: 338940 - DNA, 25 bp, Homo sapien
ttacctgttaccagtataggtggga

SEQ ID NO: 338941 - DNA, 25 bp, Homo sapien
atttatcttgcaggaaattccccaa

SEQ ID NO: 338942 - DNA, 25 bp, Homo sapien
aaattccccaaagctcagagtccag

SEQ ID NO: 338943 - DNA, 25 bp, Homo sapien
gcttagcagccttgtacaaccacca

SEQ ID NO: 338944 - DNA, 25 bp, Homo sapien
aaccaccacactgggacattcaaga

SEQ ID NO: 338945 - DNA, 25 bp, Homo sapien
gttaaaccagaaaaccacgcaggat

SEQ ID NO: 338946 - DNA, 25 bp, Homo sapien
cgcaggatacctatagaaccaagat

SEQ ID NO: 338947 - DNA, 25 bp, Homo sapien
gaaccaagatccaattccctggaga

SEQ ID NO: 338948 - DNA, 25 bp, Homo sapien
tttcctggctaacatcagacactgg

SEQ ID NO: 338949 - DNA, 25 bp, Homo sapien
tcagacactggatcaaccctaaaaa

SEQ ID NO: 338950 - DNA, 25 bp, Homo sapien
attacttccatgaggcgggatgcct

SEQ ID NO: 338951 - DNA, 25 bp, Homo sapien
gatgcctactattttgatcccgaga

SEQ ID NO: 338952 - DNA, 25 bp, Homo sapien
tttgatcccgagataccaaaggatg

SEQ ID NO: 338953 - DNA, 25 bp, Homo sapien
ggatgacctggacttccgcttagca

SEQ ID NO: 338954 - DNA, 25 bp, Homo sapien
actctttcctcactgggagccaact

SEQ ID NO: 338955 - DNA, 25 bp, Homo sapien
gtgaatggaatttgcaacactgtca

SEQ ID NO: 338956 - DNA, 25 bp, Homo sapien
ggaatttgcaacactgtcaagacta

SEQ ID NO: 338957 - DNA, 25 bp, Homo sapien
aaaggaactgcattctccaaagggt

SEQ ID NO: 338958 - DNA, 25 bp, Homo sapien
aactgcattctccaaagggtacgaa

SEQ ID NO: 338959 - DNA, 25 bp, Homo sapien
tctccaaagggtacgaaatgacact

SEQ ID NO: 338960 - DNA, 25 bp, Homo sapien
accatcaccatgacggtagcccgag

SEQ ID NO: 338961 - DNA, 25 bp, Homo sapien
accatgacggtagcccgaggacgat

SEQ ID NO: 338962 - DNA, 25 bp, Homo sapien
gaggacgatgaaacaggttacccac

SEQ ID NO: 338963 - DNA, 25 bp, Homo sapien
tgaaacaggttacccactgcgagtc

SEQ ID NO: 338964 - DNA, 25 bp, Homo sapien
ttacccactgcgagtcctggccaag

SEQ ID NO: 338965 - DNA, 25 bp, Homo sapien
tgtcttccttgtgagttgctctaaa

SEQ ID NO: 338966 - DNA, 25 bp, Homo sapien
aaagtgtgtgattttctagtgtaaa

SEQ ID NO: 338967 - DNA, 25 bp, Homo sapien
aatggactttgaggcacttgtaaac

SEQ ID NO: 338968 - DNA, 25 bp, Homo sapien
ggttcttactgtttccattactgca

SEQ ID NO: 338969 - DNA, 25 bp, Homo sapien
tccattactgcatttacttcacctt

SEQ ID NO: 338970 - DNA, 25 bp, Homo sapien
gacaaggtacaattttcaaggacaa

SEQ ID NO: 338971 - DNA, 25 bp, Homo sapien
gtagttctaatatccacttgagagt

SEQ ID NO: 338972 - DNA, 25 bp, Homo sapien
atactcaagattgattttcatggcc

SEQ ID NO: 338973 - DNA, 25 bp, Homo sapien
atggccatttggcatgattgcatga

SEQ ID NO: 338974 - DNA, 25 bp, Homo sapien
gattgcatgaattctctattctttt

SEQ ID NO: 338975 - DNA, 25 bp, Homo sapien
ttttatgtgcagtttttctatagaa

SEQ ID NO: 338976 - DNA, 25 bp, Homo sapien
gcataacttctatcttcattctctg

SEQ ID NO: 338977 - DNA, 25 bp, Homo sapien
gaagttgcctagagcaccatcacag

SEQ ID NO: 338978 - DNA, 25 bp, Homo sapien
gagcaccatcacagctaggaagctt

SEQ ID NO: 338979 - DNA, 25 bp, Homo sapien
catcacagctaggaagcttccatca

SEQ ID NO: 338980 - DNA, 25 bp, Homo sapien
gaagcttccatcatgaattacctta

SEQ ID NO: 338981 - DNA, 25 bp, Homo sapien
tttccaaaagcaagtactcaaataa

SEQ ID NO: 338982 - DNA, 25 bp, Homo sapien
gaaggacaaaactgttacaagctga

SEQ ID NO: 338983 - DNA, 25 bp, Homo sapien
gtttgacttgactagggaaccacaa

SEQ ID NO: 338984 - DNA, 25 bp, Homo sapien
gggaaccacaagttttcatataatg

SEQ ID NO: 338985 - DNA, 25 bp, Homo sapien
tataatgcctgatttagccctgtgc

SEQ ID NO: 338986 - DNA, 25 bp, Homo sapien
taatgcctgatttagccctgtgcct

SEQ ID NO: 338987 - DNA, 25 bp, Homo sapien
caggttcacagtgggcctcaaactc

SEQ ID NO: 338988 - DNA, 25 bp, Homo sapien
cagtgggcctcaaactcaagggtga

SEQ ID NO: 338989 - DNA, 25 bp, Homo sapien
agtggatcaggctttggtcaataac

SEQ ID NO: 338990 - DNA, 25 bp, Homo sapien
gcatccactgctgatcaaaagtgtc

SEQ ID NO: 338991 - DNA, 25 bp, Homo sapien
aaaagtgtcatcgtctagggcagga

SEQ ID NO: 338992 - DNA, 25 bp, Homo sapien
agaactgggtttgcatttatgctct

SEQ ID NO: 338993 - DNA, 25 bp, Homo sapien
tttatgctctgccacataccagcta

SEQ ID NO: 338994 - DNA, 25 bp, Homo sapien
gggtcttgggcaagcaacttcacca

SEQ ID NO: 338995 - DNA, 25 bp, Homo sapien
aagcaacttcaccactttgtgcctt

SEQ ID NO: 338996 - DNA, 25 bp, Homo sapien
ttccatttcctctgtgcatagggtt

SEQ ID NO: 338997 - DNA, 25 bp, Homo sapien
agttattgggtagctcagggcctag

SEQ ID NO: 338998 - DNA, 25 bp, Homo sapien
gaaacaattctaactgactcctata

SEQ ID NO: 338999 - DNA, 25 bp, Homo sapien
tctaactgactcctatatgcagcca

SEQ ID NO: 339000 - DNA, 25 bp, Homo sapien
tatgcagccagttggaatcatgcct

SEQ ID NO: 339001 - DNA, 25 bp, Homo sapien
tggaatcatgcctaaagctttgggt

SEQ ID NO: 339002 - DNA, 25 bp, Homo sapien
cacctgccttgggaaacagcgagga

SEQ ID NO: 339003 - DNA, 25 bp, Homo sapien
aaacagcgaggatggtgcagagctt

SEQ ID NO: 339004 - DNA, 25 bp, Homo sapien
ggtgcagagctttattgagactcca

SEQ ID NO: 339005 - DNA, 25 bp, Homo sapien
tttattgagactccagtggcccatc

SEQ ID NO: 339006 - DNA, 25 bp, Homo sapien
agtggcccatccagttcatctccag

SEQ ID NO: 339007 - DNA, 25 bp, Homo sapien
ggcactgttcttagcaatttctgga

SEQ ID NO: 339008 - DNA, 25 bp, Homo sapien
atttctggacattcaacaacgtggg

SEQ ID NO: 339009 - DNA, 25 bp, Homo sapien
atgtaatgattctactcgcagtgca

SEQ ID NO: 339010 - DNA, 25 bp, Homo sapien
gattctactcgcagtgcataacagc

SEQ ID NO: 339011 - DNA, 25 bp, Homo sapien
cgcagtgcataacagcacatatttt

SEQ ID NO: 339012 - DNA, 25 bp, Homo sapien
gcaattacctttccttaaggtatct

SEQ ID NO: 339013 - DNA, 25 bp, Homo sapien
ctttccttaaggtatctgatacagt

SEQ ID NO: 339014 - DNA, 25 bp, Homo sapien
gaatcacttatatcagtaatagcac

SEQ ID NO: 339015 - DNA, 25 bp, Homo sapien
tcagtaatagcacttgagagatagc

SEQ ID NO: 339016 - DNA, 25 bp, Homo sapien
gagagatagcaagtcaccaagaaac

SEQ ID NO: 339017 - DNA, 25 bp, Homo sapien
gcaagtcaccaagaaacttaatttt

SEQ ID NO: 339018 - DNA, 25 bp, Homo sapien
gaataaggtcaatctacaatcccag

SEQ ID NO: 339019 - DNA, 25 bp, Homo sapien
ggtcaatctacaatcccagataact

SEQ ID NO: 339020 - DNA, 25 bp, Homo sapien
tgccccattactgatgtgcagatat

SEQ ID NO: 339021 - DNA, 25 bp, Homo sapien
gcagatattgagttcactttcattt

SEQ ID NO: 339022 - DNA, 25 bp, Homo sapien
ttgccagatttctttgcactacttt

SEQ ID NO: 339023 - DNA, 25 bp, Homo sapien
aatctatttttctttgacatcctag

SEQ ID NO: 339024 - DNA, 25 bp, Homo sapien
acatcctagtttgcgtcagtgacag

SEQ ID NO: 339025 - DNA, 25 bp, Homo sapien
gcgtcagtgacagaacttactgctt

SEQ ID NO: 339026 - DNA, 25 bp, Homo sapien
gaacttactgcttagtctttgtact

SEQ ID NO: 339027 - DNA, 25 bp, Homo sapien
actgtccaagtgaaatgtcctagtt

SEQ ID NO: 339028 - DNA, 25 bp, Homo sapien
atgtcctagttgtcattgtgattaa

SEQ ID NO: 339029 - DNA, 25 bp, Homo sapien
aactttccaggcagctagcagagat

SEQ ID NO: 339030 - DNA, 25 bp, Homo sapien
aatttgtattccttcgcccacgcat

SEQ ID NO: 339031 - DNA, 25 bp, Homo sapien
tctgaccttgaaatagcctgctggt

SEQ ID NO: 339032 - DNA, 25 bp, Homo sapien
tgactggcattaacatacataacta

SEQ ID NO: 339033 - DNA, 25 bp, Homo sapien
tccattattaatgttgctgctgcta

SEQ ID NO: 339034 - DNA, 25 bp, Homo sapien
gctgctgctacctttgggcctaaaa

SEQ ID NO: 339035 - DNA, 25 bp, Homo sapien
aaaaccaagtcacctgttgtgtatc

SEQ ID NO: 339036 - DNA, 25 bp, Homo sapien
gttgtgtatcaattaccttctttga

SEQ ID NO: 339037 - DNA, 25 bp, Homo sapien
tcacccaatttggtatattaacagc

SEQ ID NO: 339038 - DNA, 25 bp, Homo sapien
tattaacagcacatactcaaggttc

SEQ ID NO: 339039 - DNA, 25 bp, Homo sapien
cacatactcaaggttcactacaaaa

SEQ ID NO: 339040 - DNA, 25 bp, Homo sapien
acagttcctggtaatgatttaaatg

SEQ ID NO: 339041 - DNA, 25 bp, Homo sapien
tatggagtcattacttctgaccttg

SEQ ID NO: 339042 - DNA, 25 bp, Homo sapien
caaggtggtggatggagtctggtca

SEQ ID NO: 339043 - DNA, 25 bp, Homo sapien
ccagtggtgctggtgggtcctccaa

SEQ ID NO: 339044 - DNA, 25 bp, Homo sapien
gagattcccagctagctggaagtca

SEQ ID NO: 339045 - DNA, 25 bp, Homo sapien
agctagctggaagtcaaactctcga

SEQ ID NO: 339046 - DNA, 25 bp, Homo sapien
ggaagtcaaactctcgagcccaaga

SEQ ID NO: 339047 - DNA, 25 bp, Homo sapien
gtcaaactctcgagcccaagagttt

SEQ ID NO: 339048 - DNA, 25 bp, Homo sapien
aacctgggtgctggcctgggtaact

SEQ ID NO: 339049 - DNA, 25 bp, Homo sapien
ggcatacgcctagagtcctagctac

SEQ ID NO: 339050 - DNA, 25 bp, Homo sapien
ggtaactggaggacgatggatcttt

SEQ ID NO: 339051 - DNA, 25 bp, Homo sapien
gacgatggatcttttgctgagctga

SEQ ID NO: 339052 - DNA, 25 bp, Homo sapien
gatggatcttttgctgagctgatgg

SEQ ID NO: 339053 - DNA, 25 bp, Homo sapien
gacgcagtaaaacgcaggactcttc

SEQ ID NO: 339054 - DNA, 25 bp, Homo sapien
gcagtaaaacgcaggactcttcccg

SEQ ID NO: 339055 - DNA, 25 bp, Homo sapien
agtaaaacgcaggactcttcccgct

SEQ ID NO: 339056 - DNA, 25 bp, Homo sapien
taaaacgcaggactcttcccgcttg

SEQ ID NO: 339057 - DNA, 25 bp, Homo sapien
aacgcaggactcttcccgcttggat

SEQ ID NO: 339058 - DNA, 25 bp, Homo sapien
gactcttcccgcttggattcgcgaa

SEQ ID NO: 339059 - DNA, 25 bp, Homo sapien
ttcccgcttggattcgcgaaggtct

SEQ ID NO: 339060 - DNA, 25 bp, Homo sapien
cccgcttggattcgcgaaggtcttg

SEQ ID NO: 339061 - DNA, 25 bp, Homo sapien
gcttggattcgcgaaggtcttgaaa

SEQ ID NO: 339062 - DNA, 25 bp, Homo sapien
tggattcgcgaaggtcttgaaaaaa

SEQ ID NO: 339063 - DNA, 25 bp, Homo sapien
tggaacaacaacgttcacaattgtc

SEQ ID NO: 339064 - DNA, 25 bp, Homo sapien
tgcattttttagctctgaagattcc

SEQ ID NO: 339065 - DNA, 25 bp, Homo sapien
gaagattccttaggtatccctgaag

SEQ ID NO: 339066 - DNA, 25 bp, Homo sapien
taggtatccctgaagacagctcgct

SEQ ID NO: 339067 - DNA, 25 bp, Homo sapien
gacagctcgctcagatgatcagcat

SEQ ID NO: 339068 - DNA, 25 bp, Homo sapien
tagagtgaaaacaagggcccttcat

SEQ ID NO: 339069 - DNA, 25 bp, Homo sapien
aagggcccttcatgggtgaacatta

SEQ ID NO: 339070 - DNA, 25 bp, Homo sapien
agctggcgaatggatgacgcaccct

SEQ ID NO: 339071 - DNA, 25 bp, Homo sapien
atggatgacgcaccctagccactgg

SEQ ID NO: 339072 - DNA, 25 bp, Homo sapien
ctgtttcatgtatttccaaaagttg

SEQ ID NO: 339073 - DNA, 25 bp, Homo sapien
tgatttttcgtaagtcaggtttcta

SEQ ID NO: 339074 - DNA, 25 bp, Homo sapien
ggtttctaagtgagctccctgaggt

SEQ ID NO: 339075 - DNA, 25 bp, Homo sapien
aacgtctgcctgttctcgatggtga

SEQ ID NO: 339076 - DNA, 25 bp, Homo sapien
tttcctaagccctttctaacgagag

SEQ ID NO: 339077 - DNA, 25 bp, Homo sapien
tcaaacaagcggaggcgagggccaa

SEQ ID NO: 339078 - DNA, 25 bp, Homo sapien
gagggccaattcaaccccattcttt

SEQ ID NO: 339079 - DNA, 25 bp, Homo sapien
tgagaaccaggaacgcaccctctct

SEQ ID NO: 339080 - DNA, 25 bp, Homo sapien
ctctctgtggagctctgactggtgt

SEQ ID NO: 339081 - DNA, 25 bp, Homo sapien
aacttgcaaacggacgaagagcctg

SEQ ID NO: 339082 - DNA, 25 bp, Homo sapien
gaagagcctgccgtgtgttaatcat

SEQ ID NO: 339083 - DNA, 25 bp, Homo sapien
gccgtgtgttaatcatttgccttac

SEQ ID NO: 339084 - DNA, 25 bp, Homo sapien
gccttacaagatgtaccagacggtt

SEQ ID NO: 339085 - DNA, 25 bp, Homo sapien
cagacggtttccagtactaacaaag

SEQ ID NO: 339086 - DNA, 25 bp, Homo sapien
aagttttatactctacatccacagt

SEQ ID NO: 339087 - DNA, 25 bp, Homo sapien
atactctacatccacagtacgtcag

SEQ ID NO: 339088 - DNA, 25 bp, Homo sapien
atccacagtacgtcagcagttcttg

SEQ ID NO: 339089 - DNA, 25 bp, Homo sapien
gtacgtcagcagttcttgaatgttt

SEQ ID NO: 339090 - DNA, 25 bp, Homo sapien
gcagatgtttataactacaatggta

SEQ ID NO: 339091 - DNA, 25 bp, Homo sapien
aagcaaacatgttcatgtgcaggga

SEQ ID NO: 339092 - DNA, 25 bp, Homo sapien
gtgcagggaatgtggttcaagtctt

SEQ ID NO: 339093 - DNA, 25 bp, Homo sapien
aatgtggttcaagtctttggattta

SEQ ID NO: 339094 - DNA, 25 bp, Homo sapien
taaaaacaagttccccagagaagct

SEQ ID NO: 339095 - DNA, 25 bp, Homo sapien
agagaagctggcacttcctttgccc

SEQ ID NO: 339096 - DNA, 25 bp, Homo sapien
gacctgaaaagtcccaatccaaact

SEQ ID NO: 339097 - DNA, 25 bp, Homo sapien
aaatagttatatgtgtgtcattgga

SEQ ID NO: 339098 - DNA, 25 bp, Homo sapien
agctgtcttggactttccctctctt

SEQ ID NO: 339099 - DNA, 25 bp, Homo sapien
tggactttccctctcttaacactga

SEQ ID NO: 339100 - DNA, 25 bp, Homo sapien
ctttccctctcttaacactgactgg

SEQ ID NO: 339101 - DNA, 25 bp, Homo sapien
attgtttgttatcatctctttagac

SEQ ID NO: 339102 - DNA, 25 bp, Homo sapien
gtttgttatcatctctttagacaga

SEQ ID NO: 339103 - DNA, 25 bp, Homo sapien
gttgacttgtgtatgagctactctt

SEQ ID NO: 339104 - DNA, 25 bp, Homo sapien
atgagctactcttggattcttgtta

SEQ ID NO: 339105 - DNA, 25 bp, Homo sapien
gctactcttggattcttgttattat

SEQ ID NO: 339106 - DNA, 25 bp, Homo sapien
gacttgtatttagttcatattttgt

SEQ ID NO: 339107 - DNA, 25 bp, Homo sapien
atttagttcatattttgtcaaaagc

SEQ ID NO: 339108 - DNA, 25 bp, Homo sapien
gtattttattacctcctattctaga

SEQ ID NO: 339109 - DNA, 25 bp, Homo sapien
cagagaggccccaaacaggattgtt

SEQ ID NO: 339110 - DNA, 25 bp, Homo sapien
gcccttctgcccatctgagattgag

SEQ ID NO: 339111 - DNA, 25 bp, Homo sapien
gagattgagggagcatcgtccactt

SEQ ID NO: 339112 - DNA, 25 bp, Homo sapien
ggagcatcgtccacttgagatcagg

SEQ ID NO: 339113 - DNA, 25 bp, Homo sapien
gtggagaatgggtcatgtcatgtaa

SEQ ID NO: 339114 - DNA, 25 bp, Homo sapien
agaaaagccctcttcgggatcatga

SEQ ID NO: 339115 - DNA, 25 bp, Homo sapien
cttcgggatcatgagacttggttct

SEQ ID NO: 339116 - DNA, 25 bp, Homo sapien
gagacttggttctagtccaatttct

SEQ ID NO: 339117 - DNA, 25 bp, Homo sapien
tctgccactgaggatgaatgtaact

SEQ ID NO: 339118 - DNA, 25 bp, Homo sapien
gaatgtaactgtgggcaaactattt

SEQ ID NO: 339119 - DNA, 25 bp, Homo sapien
cgagatgagctcatagcaccagcct

SEQ ID NO: 339120 - DNA, 25 bp, Homo sapien
aggctcaatcaaaggtttgcaataa

SEQ ID NO: 339121 - DNA, 25 bp, Homo sapien
tgtcttttgtggacccgcacaatga

SEQ ID NO: 339122 - DNA, 25 bp, Homo sapien
gtggacccgcacaatgatccctgag

SEQ ID NO: 339123 - DNA, 25 bp, Homo sapien
agccagactggattaggatgcctcg

SEQ ID NO: 339124 - DNA, 25 bp, Homo sapien
actggattaggatgcctcgcgacta

SEQ ID NO: 339125 - DNA, 25 bp, Homo sapien
aaatgatgcatcagatttacagctg

SEQ ID NO: 339126 - DNA, 25 bp, Homo sapien
gatttacagctgcagtgacgagaac

SEQ ID NO: 339127 - DNA, 25 bp, Homo sapien
gaacatagaagttttcaccaccgtg

SEQ ID NO: 339128 - DNA, 25 bp, Homo sapien
atagaagttttcaccaccgtgattc

SEQ ID NO: 339129 - DNA, 25 bp, Homo sapien
gtgaagactggaacgagatgagctc

SEQ ID NO: 339130 - DNA, 25 bp, Homo sapien
ttgagatgagccaccgcaggtgtgc

SEQ ID NO: 339131 - DNA, 25 bp, Homo sapien
gcaggtgtgctcaccttggctacat

SEQ ID NO: 339132 - DNA, 25 bp, Homo sapien
caccttggctacatgttgaaatcat

SEQ ID NO: 339133 - DNA, 25 bp, Homo sapien
ttgggaaatctactgatgccccgct

SEQ ID NO: 339134 - DNA, 25 bp, Homo sapien
tgtgcctcccagaccgattaagtca

SEQ ID NO: 339135 - DNA, 25 bp, Homo sapien
agaccgattaagtcagaacctctgg

SEQ ID NO: 339136 - DNA, 25 bp, Homo sapien
gtcgcaggcatcagtgcgtgcccga

SEQ ID NO: 339137 - DNA, 25 bp, Homo sapien
cctccgcgtgtttgggtgtgcagcc

SEQ ID NO: 339138 - DNA, 25 bp, Homo sapien
tggtgagctgtcgagccacagtgca

SEQ ID NO: 339139 - DNA, 25 bp, Homo sapien
tgtcgagccacagtgcagttctctt

SEQ ID NO: 339140 - DNA, 25 bp, Homo sapien
ttccatgttctttcctttaccagaa

SEQ ID NO: 339141 - DNA, 25 bp, Homo sapien
taccattttcaggtactgtgcaatg

SEQ ID NO: 339142 - DNA, 25 bp, Homo sapien
caggtactgtgcaatgtgaatcatt

SEQ ID NO: 339143 - DNA, 25 bp, Homo sapien
atcatttaagtttttggtgacccat

SEQ ID NO: 339144 - DNA, 25 bp, Homo sapien
tttggtgacccatgtagaaaggaac

SEQ ID NO: 339145 - DNA, 25 bp, Homo sapien
tgacccatgtagaaaggaactgatc

SEQ ID NO: 339146 - DNA, 25 bp, Homo sapien
agtctaaacatggaactatctctta

SEQ ID NO: 339147 - DNA, 25 bp, Homo sapien
acatggaactatctcttaaatcaag

SEQ ID NO: 339148 - DNA, 25 bp, Homo sapien
gtaatcatatagatgcttttcctga

SEQ ID NO: 339149 - DNA, 25 bp, Homo sapien
gatgcttttcctgagttagttgttt

SEQ ID NO: 339150 - DNA, 25 bp, Homo sapien
gtttcgttttggttgggtcatacag

SEQ ID NO: 339151 - DNA, 25 bp, Homo sapien
gttttggttgggtcatacagtattt

SEQ ID NO: 339152 - DNA, 25 bp, Homo sapien
taatcaacctggtcaaaacctttca

SEQ ID NO: 339153 - DNA, 25 bp, Homo sapien
tgagtcagtcgccttgattcagaat

SEQ ID NO: 339154 - DNA, 25 bp, Homo sapien
gattcagaatgtcacgagccttatg

SEQ ID NO: 339155 - DNA, 25 bp, Homo sapien
atgatatcatgctgaggcgccttgc

SEQ ID NO: 339156 - DNA, 25 bp, Homo sapien
ggcgccttgcaaatccgacaattaa

SEQ ID NO: 339157 - DNA, 25 bp, Homo sapien
gacaattaagatcctcctagacctt

SEQ ID NO: 339158 - DNA, 25 bp, Homo sapien
tagaccttgaggtgatcagcataag

SEQ ID NO: 339159 - DNA, 25 bp, Homo sapien
atcagcataagaggccagatcccct

SEQ ID NO: 339160 - DNA, 25 bp, Homo sapien
tcgagtcatctacacctagcttcac

SEQ ID NO: 339161 - DNA, 25 bp, Homo sapien
cacctagcttcaccttattctttaa

SEQ ID NO: 339162 - DNA, 25 bp, Homo sapien
ggtgatcgccgtaacagtaaatttg

SEQ ID NO: 339163 - DNA, 25 bp, Homo sapien
ataaattgcatgtgaacttttcaac

SEQ ID NO: 339164 - DNA, 25 bp, Homo sapien
tgttaaatactatcatgaattcaat

SEQ ID NO: 339165 - DNA, 25 bp, Homo sapien
tgccagtaactttaacctattccac

SEQ ID NO: 339166 - DNA, 25 bp, Homo sapien
tacactatttggtaagataatggac

SEQ ID NO: 339167 - DNA, 25 bp, Homo sapien
gataatggactgacatctctagtga

SEQ ID NO: 339168 - DNA, 25 bp, Homo sapien
ataatggactgacatctctagtgat

SEQ ID NO: 339169 - DNA, 25 bp, Homo sapien
taatggactgacatctctagtgatt

SEQ ID NO: 339170 - DNA, 25 bp, Homo sapien
atggactgacatctctagtgatttt

SEQ ID NO: 339171 - DNA, 25 bp, Homo sapien
tttttgccagtgagttttaattgcc

SEQ ID NO: 339172 - DNA, 25 bp, Homo sapien
tttgccagtgagttttaattgccat

SEQ ID NO: 339173 - DNA, 25 bp, Homo sapien
gccagtgagttttaattgccattaa

SEQ ID NO: 339174 - DNA, 25 bp, Homo sapien
gaaagctgcaggctgtgacttcact

SEQ ID NO: 339175 - DNA, 25 bp, Homo sapien
ggctgtgacttcactaacgtggtga

SEQ ID NO: 339176 - DNA, 25 bp, Homo sapien
tggtgaaaacaactgttcttctggc

SEQ ID NO: 339177 - DNA, 25 bp, Homo sapien
gttcttctggctgacataaatgact

SEQ ID NO: 339178 - DNA, 25 bp, Homo sapien
aagagtaattttcctgctagagctg

SEQ ID NO: 339179 - DNA, 25 bp, Homo sapien
agagctgcttaccaagttgctgctt

SEQ ID NO: 339180 - DNA, 25 bp, Homo sapien
caagttgctgctttacccaaaggca

SEQ ID NO: 339181 - DNA, 25 bp, Homo sapien
gcagtagctatccaaggaccactga

SEQ ID NO: 339182 - DNA, 25 bp, Homo sapien
ggaccactgacaacggcatcactat

SEQ ID NO: 339183 - DNA, 25 bp, Homo sapien
gcatcactataagtgggcccagtgc

SEQ ID NO: 339184 - DNA, 25 bp, Homo sapien
ggcccagtgctgtgtagtctggaat

SEQ ID NO: 339185 - DNA, 25 bp, Homo sapien
ttaagaattctgtgccattatgtct

SEQ ID NO: 339186 - DNA, 25 bp, Homo sapien
gtgttaattgtgtgatacagtcttc

SEQ ID NO: 339187 - DNA, 25 bp, Homo sapien
gatacagtcttctttgtggaaccca

SEQ ID NO: 339188 - DNA, 25 bp, Homo sapien
ttctttgtggaacccaaaatcctct

SEQ ID NO: 339189 - DNA, 25 bp, Homo sapien
ataaactgccagattgtacaacttt

SEQ ID NO: 339190 - DNA, 25 bp, Homo sapien
atgtgcatttttaaagcttgaagac

SEQ ID NO: 339191 - DNA, 25 bp, Homo sapien
atgagggtcattatctaagttaaac

SEQ ID NO: 339192 - DNA, 25 bp, Homo sapien
taaacagcctatttttgtgcctcct

SEQ ID NO: 339193 - DNA, 25 bp, Homo sapien
gttttataattctgctgatggcggc

SEQ ID NO: 339194 - DNA, 25 bp, Homo sapien
tgatggcggcatcttatgtcgagcc

SEQ ID NO: 339195 - DNA, 25 bp, Homo sapien
atcttatgtcgagccaaccacaata

SEQ ID NO: 339196 - DNA, 25 bp, Homo sapien
gcagaatcatgcgtgaacagacatc

SEQ ID NO: 339197 - DNA, 25 bp, Homo sapien
atgcgtgaacagacatcagatgcct

SEQ ID NO: 339198 - DNA, 25 bp, Homo sapien
ttcaggacatggacttaaaccattg

SEQ ID NO: 339199 - DNA, 25 bp, Homo sapien
agtatcaccccacttattgccaaag

SEQ ID NO: 339200 - DNA, 25 bp, Homo sapien
agacacactcacaccagaggaatgc

SEQ ID NO: 339201 - DNA, 25 bp, Homo sapien
tcacaccagaggaatgccaacagtt

SEQ ID NO: 339202 - DNA, 25 bp, Homo sapien
tgataaggtaacttttccggtcaca

SEQ ID NO: 339203 - DNA, 25 bp, Homo sapien
taacttttccggtcacacacaacag

SEQ ID NO: 339204 - DNA, 25 bp, Homo sapien
ttccggtcacacacaacagactgat

SEQ ID NO: 339205 - DNA, 25 bp, Homo sapien
cggtcacacacaacagactgatttt

SEQ ID NO: 339206 - DNA, 25 bp, Homo sapien
cacacacaacagactgattttcctg

SEQ ID NO: 339207 - DNA, 25 bp, Homo sapien
gatacttggaggtgtcagtcaggta

SEQ ID NO: 339208 - DNA, 25 bp, Homo sapien
gtcagtcaggtattggatggtccct

SEQ ID NO: 339209 - DNA, 25 bp, Homo sapien
tgtgttgttgatggcgatagtgatt

SEQ ID NO: 339210 - DNA, 25 bp, Homo sapien
acctggaccaggttgctgatgtcgg

SEQ ID NO: 339211 - DNA, 25 bp, Homo sapien
caggttgctgatgtcggcctcgaag

SEQ ID NO: 339212 - DNA, 25 bp, Homo sapien
catgctctagcgtgtcgaccccatt

SEQ ID NO: 339213 - DNA, 25 bp, Homo sapien
cattcacccacacgatggcatagga

SEQ ID NO: 339214 - DNA, 25 bp, Homo sapien
gtacagaagtacagaccgctgcagt

SEQ ID NO: 339215 - DNA, 25 bp, Homo sapien
ccgctgcagtccagcgtagttgaaa

SEQ ID NO: 339216 - DNA, 25 bp, Homo sapien
gtgttctggacaaagtaacccttgg

SEQ ID NO: 339217 - DNA, 25 bp, Homo sapien
gtaacccttgggatacttggaggtg

SEQ ID NO: 339218 - DNA, 25 bp, Homo sapien
aatgatctccttgttagtggtggta

SEQ ID NO: 339219 - DNA, 25 bp, Homo sapien
gacaaggatggcaactatttctgta

SEQ ID NO: 339220 - DNA, 25 bp, Homo sapien
atttctgtatcttacatacctttta

SEQ ID NO: 339221 - DNA, 25 bp, Homo sapien
gaggccctgtcaatgttttatataa

SEQ ID NO: 339222 - DNA, 25 bp, Homo sapien
aaaacaaacttaacagtctgtcaag

SEQ ID NO: 339223 - DNA, 25 bp, Homo sapien
gtcaagttggtgatataaccccaca

SEQ ID NO: 339224 - DNA, 25 bp, Homo sapien
gttggtgatataaccccacagaaga

SEQ ID NO: 339225 - DNA, 25 bp, Homo sapien
agaagacttacttcaagtgacttga

SEQ ID NO: 339226 - DNA, 25 bp, Homo sapien
gtattttgtctgtactttgctaatg

SEQ ID NO: 339227 - DNA, 25 bp, Homo sapien
gtctgtactttgctaatggaatata

SEQ ID NO: 339228 - DNA, 25 bp, Homo sapien
tatcctacagaccaaacaaccacaa

SEQ ID NO: 339229 - DNA, 25 bp, Homo sapien
gtgggaacagagttgtcacctacct

SEQ ID NO: 339230 - DNA, 25 bp, Homo sapien
ggaacagagttgtcacctacctaac

SEQ ID NO: 339231 - DNA, 25 bp, Homo sapien
aacagagttgtcacctacctaacag

SEQ ID NO: 339232 - DNA, 25 bp, Homo sapien
gagttgtcacctacctaacagggct

SEQ ID NO: 339233 - DNA, 25 bp, Homo sapien
gtcacctacctaacagggctctgag

SEQ ID NO: 339234 - DNA, 25 bp, Homo sapien
acctacctaacagggctctgagaga

SEQ ID NO: 339235 - DNA, 25 bp, Homo sapien
ggaaaaatcctgtcttgggctcaag

SEQ ID NO: 339236 - DNA, 25 bp, Homo sapien
tgtcttgggctcaaggtcacagagt

SEQ ID NO: 339237 - DNA, 25 bp, Homo sapien
gccttgccaggcttcagtctccagt

SEQ ID NO: 339238 - DNA, 25 bp, Homo sapien
tcagtctccagtgccaaaggaggaa

SEQ ID NO: 339239 - DNA, 25 bp, Homo sapien
gaggaaatgcccaggctgtcagcat

SEQ ID NO: 339240 - DNA, 25 bp, Homo sapien
ggactcgggcaagggtgccgaagat

SEQ ID NO: 339241 - DNA, 25 bp, Homo sapien
gcaagggtgccgaagatagacaaga

SEQ ID NO: 339242 - DNA, 25 bp, Homo sapien
caagggtgccgaagatagacaagag

SEQ ID NO: 339243 - DNA, 25 bp, Homo sapien
aagatagacaagaggcacacagaga

SEQ ID NO: 339244 - DNA, 25 bp, Homo sapien
agatagacaagaggcacacagagac

SEQ ID NO: 339245 - DNA, 25 bp, Homo sapien
atagacaagaggcacacagagacag

SEQ ID NO: 339246 - DNA, 25 bp, Homo sapien
tagacaagaggcacacagagacaga

SEQ ID NO: 339247 - DNA, 25 bp, Homo sapien
aggcacacagagacagaccaactgg

SEQ ID NO: 339248 - DNA, 25 bp, Homo sapien
gcacacagagacagaccaactggca

SEQ ID NO: 339249 - DNA, 25 bp, Homo sapien
cacacagagacagaccaactggcag

SEQ ID NO: 339250 - DNA, 25 bp, Homo sapien
agacagaccaactggcagccaggca

SEQ ID NO: 339251 - DNA, 25 bp, Homo sapien
ctgtgttcttagattacagaatatc

SEQ ID NO: 339252 - DNA, 25 bp, Homo sapien
atagaatatggtttcttactgtgtg

SEQ ID NO: 339253 - DNA, 25 bp, Homo sapien
gtgcccaaatacatagttttcatat

SEQ ID NO: 339254 - DNA, 25 bp, Homo sapien
acttaatgccgaatccgtctcttgc

SEQ ID NO: 339255 - DNA, 25 bp, Homo sapien
gaatccgtctcttgctcaagtgaaa

SEQ ID NO: 339256 - DNA, 25 bp, Homo sapien
ccgtctcttgctcaagtgaaaattg

SEQ ID NO: 339257 - DNA, 25 bp, Homo sapien
gcaaagcgagaactagatagcattg

SEQ ID NO: 339258 - DNA, 25 bp, Homo sapien
atagcattgaagctgaacttacaag

SEQ ID NO: 339259 - DNA, 25 bp, Homo sapien
gtagacatgatggaactgtgacaaa

SEQ ID NO: 339260 - DNA, 25 bp, Homo sapien
ttgaataggactttacagagttctt

SEQ ID NO: 339261 - DNA, 25 bp, Homo sapien
ataacaaaactttctgtgttcttag

SEQ ID NO: 339262 - DNA, 25 bp, Homo sapien
tgggattccaccttgctatctctgc

SEQ ID NO: 339263 - DNA, 25 bp, Homo sapien
agactctgaacaccagatcctcata

SEQ ID NO: 339264 - DNA, 25 bp, Homo sapien
gatcctcatatctgaaagtgatttg

SEQ ID NO: 339265 - DNA, 25 bp, Homo sapien
aagtgatttggagacctgggcatca

SEQ ID NO: 339266 - DNA, 25 bp, Homo sapien
gacctgggcatcaagtgctctttta

SEQ ID NO: 339267 - DNA, 25 bp, Homo sapien
gggctatcccagaggactgttcaaa

SEQ ID NO: 339268 - DNA, 25 bp, Homo sapien
cattcaatagagatgttggagtcca

SEQ ID NO: 339269 - DNA, 25 bp, Homo sapien
gttagggagcaaaccagtaacctat

SEQ ID NO: 339270 - DNA, 25 bp, Homo sapien
agtaacctatgctggtcgtaacaga

SEQ ID NO: 339271 - DNA, 25 bp, Homo sapien
ctggtcgtaacagaggatcctacaa

SEQ ID NO: 339272 - DNA, 25 bp, Homo sapien
gaggatcctacaattacgtttgttt

SEQ ID NO: 339273 - DNA, 25 bp, Homo sapien
gaatctgaatctcggatcccaggca

SEQ ID NO: 339274 - DNA, 25 bp, Homo sapien
ggcagggttcacatttccaaacctt

SEQ ID NO: 339275 - DNA, 25 bp, Homo sapien
ttttgatttcccctgacctctaatg

SEQ ID NO: 339276 - DNA, 25 bp, Homo sapien
gacctctaatggctggatcctattt

SEQ ID NO: 339277 - DNA, 25 bp, Homo sapien
tggatcctatttttctacaaccttt

SEQ ID NO: 339278 - DNA, 25 bp, Homo sapien
cagtgacatcgttcaggtttctttc

SEQ ID NO: 339279 - DNA, 25 bp, Homo sapien
ttttctcacttgtaagtcaccgcca

SEQ ID NO: 339280 - DNA, 25 bp, Homo sapien
agtcaccgccagtacctaagttagg

SEQ ID NO: 339281 - DNA, 25 bp, Homo sapien
gttaggctaacggagactttgacag

SEQ ID NO: 339282 - DNA, 25 bp, Homo sapien
caaacttcgcaagacagccctgaag

SEQ ID NO: 339283 - DNA, 25 bp, Homo sapien
agccctgaagtcacaagtgctttct

SEQ ID NO: 339284 - DNA, 25 bp, Homo sapien
tgcacaaaacctgcacacagggcgt

SEQ ID NO: 339285 - DNA, 25 bp, Homo sapien
gcacaaaacctgcacacagggcgtg

SEQ ID NO: 339286 - DNA, 25 bp, Homo sapien
cacaaaacctgcacacagggcgtgc

SEQ ID NO: 339287 - DNA, 25 bp, Homo sapien
acaaaacctgcacacagggcgtgcg

SEQ ID NO: 339288 - DNA, 25 bp, Homo sapien
caaaacctgcacacagggcgtgcga

SEQ ID NO: 339289 - DNA, 25 bp, Homo sapien
aaaacctgcacacagggcgtgcgag

SEQ ID NO: 339290 - DNA, 25 bp, Homo sapien
aaacctgcacacagggcgtgcgagg

SEQ ID NO: 339291 - DNA, 25 bp, Homo sapien
aacctgcacacagggcgtgcgaggg

SEQ ID NO: 339292 - DNA, 25 bp, Homo sapien
cacacagggcgtgcgagggtgggta

SEQ ID NO: 339293 - DNA, 25 bp, Homo sapien
cacagggcgtgcgagggtgggtaga

SEQ ID NO: 339294 - DNA, 25 bp, Homo sapien
gcgtgcgagggtgggtagagctgag

SEQ ID NO: 339295 - DNA, 25 bp, Homo sapien
gtgacaaaacacaatcccctgtagg

SEQ ID NO: 339296 - DNA, 25 bp, Homo sapien
tcccctgtaggatttggtataaata

SEQ ID NO: 339297 - DNA, 25 bp, Homo sapien
caagtgaagaatccatgtactgacc

SEQ ID NO: 339298 - DNA, 25 bp, Homo sapien
tgtactgaccaggagggatagaatc

SEQ ID NO: 339299 - DNA, 25 bp, Homo sapien
tgagatataacctggaatcctgcat

SEQ ID NO: 339300 - DNA, 25 bp, Homo sapien
ggaatcctgcataagcacatcctga

SEQ ID NO: 339301 - DNA, 25 bp, Homo sapien
taagcacatcctgaagactgactat

SEQ ID NO: 339302 - DNA, 25 bp, Homo sapien
atcagccagtttaattgttcctttg

SEQ ID NO: 339303 - DNA, 25 bp, Homo sapien
ttgttcctttgtcatcaatcaagag

SEQ ID NO: 339304 - DNA, 25 bp, Homo sapien
gaggttttaagtctctgtgaagaac

SEQ ID NO: 339305 - DNA, 25 bp, Homo sapien
gaagaactcttctagagtgacaaaa

SEQ ID NO: 339306 - DNA, 25 bp, Homo sapien
agcctcttgttaatctgatctagtt

SEQ ID NO: 339307 - DNA, 25 bp, Homo sapien
gaaaaagcccatggagaaccttatc

SEQ ID NO: 339308 - DNA, 25 bp, Homo sapien
gaaccttatctttaacaagctccca

SEQ ID NO: 339309 - DNA, 25 bp, Homo sapien
gtggtgaccttttagcaaagcttct

SEQ ID NO: 339310 - DNA, 25 bp, Homo sapien
gcaaagcttctgtaacagttcgaat

SEQ ID NO: 339311 - DNA, 25 bp, Homo sapien
aatgagttgcagaacattccactcc

SEQ ID NO: 339312 - DNA, 25 bp, Homo sapien
aacaaatcacttcaagagaggcttg

SEQ ID NO: 339313 - DNA, 25 bp, Homo sapien
aggcttggttttgtgtggcacagat

SEQ ID NO: 339314 - DNA, 25 bp, Homo sapien
ggcacagatggacccaagctttcat

SEQ ID NO: 339315 - DNA, 25 bp, Homo sapien
tggacccaagctttcatgctgtgca

SEQ ID NO: 339316 - DNA, 25 bp, Homo sapien
catgctgtgcactgagatagaaact

SEQ ID NO: 339317 - DNA, 25 bp, Homo sapien
acacgctgtaatctactccatggga

SEQ ID NO: 339318 - DNA, 25 bp, Homo sapien
tactccatgggaactgactgtcctg

SEQ ID NO: 339319 - DNA, 25 bp, Homo sapien
atgggaactgactgtcctgcttttc

SEQ ID NO: 339320 - DNA, 25 bp, Homo sapien
tgactgtcctgcttttcacaacatt

SEQ ID NO: 339321 - DNA, 25 bp, Homo sapien
tcacaacattgagaaacaggcccag

SEQ ID NO: 339322 - DNA, 25 bp, Homo sapien
gaaacaggcccagagcctgtctcat

SEQ ID NO: 339323 - DNA, 25 bp, Homo sapien
gagcctgtctcatgtgccaggtgca

SEQ ID NO: 339324 - DNA, 25 bp, Homo sapien
aataaagtggcttctgacaaatcag

SEQ ID NO: 339325 - DNA, 25 bp, Homo sapien
ttttcatttcttccaacaaccctca

SEQ ID NO: 339326 - DNA, 25 bp, Homo sapien
gggaatgtccttgtccaacacgctg

SEQ ID NO: 339327 - DNA, 25 bp, Homo sapien
ttgtccaacacgctgtaatctactc

SEQ ID NO: 339328 - DNA, 25 bp, Homo sapien
gggtggtaagtctatggattttgat

SEQ ID NO: 339329 - DNA, 25 bp, Homo sapien
ggtggtaagtctatggattttgatt

SEQ ID NO: 339330 - DNA, 25 bp, Homo sapien
tggtaagtctatggattttgatttc

SEQ ID NO: 339331 - DNA, 25 bp, Homo sapien
gtaagtctatggattttgatttcct

SEQ ID NO: 339332 - DNA, 25 bp, Homo sapien
aagtctatggattttgatttccttt

SEQ ID NO: 339333 - DNA, 25 bp, Homo sapien
agtctatggattttgatttcctttt

SEQ ID NO: 339334 - DNA, 25 bp, Homo sapien
gtctatggattttgatttccttttt

SEQ ID NO: 339335 - DNA, 25 bp, Homo sapien
ctatggattttgatttcctttttgc

SEQ ID NO: 339336 - DNA, 25 bp, Homo sapien
tatggattttgatttcctttttgct

SEQ ID NO: 339337 - DNA, 25 bp, Homo sapien
aacatgtttatgtaacttcattttt

SEQ ID NO: 339338 - DNA, 25 bp, Homo sapien
ggggtggtagcccacacttgtagtc

SEQ ID NO: 339339 - DNA, 25 bp, Homo sapien
gtcccctgtggaatggcttgctcag

SEQ ID NO: 339340 - DNA, 25 bp, Homo sapien
ggcctcctgagcacatagcactcat

SEQ ID NO: 339341 - DNA, 25 bp, Homo sapien
tgagcacatagcactcatcgtccgt

SEQ ID NO: 339342 - DNA, 25 bp, Homo sapien
atagcactcatcgtccgtcatcttt

SEQ ID NO: 339343 - DNA, 25 bp, Homo sapien
gggcctttcctcagcagcgttcgcg

SEQ ID NO: 339344 - DNA, 25 bp, Homo sapien
gctgacccctgtgtgtcctctgtgg

SEQ ID NO: 339345 - DNA, 25 bp, Homo sapien
tgtggccaccccatggcgctgaatc

SEQ ID NO: 339346 - DNA, 25 bp, Homo sapien
ctcctgcaagccgactttggacaaa

SEQ ID NO: 339347 - DNA, 25 bp, Homo sapien
acaaaagctgtgtccggtctcaccg

SEQ ID NO: 339348 - DNA, 25 bp, Homo sapien
ggtctcaccgtctgatttgtcttgt

SEQ ID NO: 339349 - DNA, 25 bp, Homo sapien
gtctgatttgtcttgttctctgtta

SEQ ID NO: 339350 - DNA, 25 bp, Homo sapien
tcaaagggctgatcatacatggtgc

SEQ ID NO: 339351 - DNA, 25 bp, Homo sapien
gctatttttagtcagccatgcattt

SEQ ID NO: 339352 - DNA, 25 bp, Homo sapien
agtcagccatgcatttggattttac

SEQ ID NO: 339353 - DNA, 25 bp, Homo sapien
tattttttccagtaagcctttcact

SEQ ID NO: 339354 - DNA, 25 bp, Homo sapien
gatatctgtgaccaatgtttaccta

SEQ ID NO: 339355 - DNA, 25 bp, Homo sapien
gtgaccaatgtttacctacgcaatg

SEQ ID NO: 339356 - DNA, 25 bp, Homo sapien
acctacgcaatgtttttgtatctga

SEQ ID NO: 339357 - DNA, 25 bp, Homo sapien
atctgaattgcttatgtacgttttt

SEQ ID NO: 339358 - DNA, 25 bp, Homo sapien
gaagatcaacttatgctggtatggt

SEQ ID NO: 339359 - DNA, 25 bp, Homo sapien
caacttatgctggtatggtgatggt

SEQ ID NO: 339360 - DNA, 25 bp, Homo sapien
ttgctatggcaaaatcaaagggctg

SEQ ID NO: 339361 - DNA, 25 bp, Homo sapien
cttgggaagcgtgctcgtgcccgta

SEQ ID NO: 339362 - DNA, 25 bp, Homo sapien
tgggaagcgtgctcgtgcccgtatt

SEQ ID NO: 339363 - DNA, 25 bp, Homo sapien
ggaagcgtgctcgtgcccgtattgc

SEQ ID NO: 339364 - DNA, 25 bp, Homo sapien
gaagcgtgctcgtgcccgtattgcc

SEQ ID NO: 339365 - DNA, 25 bp, Homo sapien
aagcgtgctcgtgcccgtattgcca

SEQ ID NO: 339366 - DNA, 25 bp, Homo sapien
agcgtgctcgtgcccgtattgccaa

SEQ ID NO: 339367 - DNA, 25 bp, Homo sapien
gcgtgctcgtgcccgtattgccaag

SEQ ID NO: 339368 - DNA, 25 bp, Homo sapien
cgtgctcgtgcccgtattgccaagg

SEQ ID NO: 339369 - DNA, 25 bp, Homo sapien
tgctcgtgcccgtattgccaagggg

SEQ ID NO: 339370 - DNA, 25 bp, Homo sapien
gctcgtgcccgtattgccaaggggc

SEQ ID NO: 339371 - DNA, 25 bp, Homo sapien
cgtgcccgtattgccaaggggctca

SEQ ID NO: 339372 - DNA, 25 bp, Homo sapien
gcagttgtgttgtaagcgtccttat

SEQ ID NO: 339373 - DNA, 25 bp, Homo sapien
gttgtgttgtaagcgtccttatctt

SEQ ID NO: 339374 - DNA, 25 bp, Homo sapien
gtgttgtaagcgtccttatctttca

SEQ ID NO: 339375 - DNA, 25 bp, Homo sapien
gttgtaagcgtccttatctttcaga

SEQ ID NO: 339376 - DNA, 25 bp, Homo sapien
gtaagcgtccttatctttcagagct

SEQ ID NO: 339377 - DNA, 25 bp, Homo sapien
gcgtccttatctttcagagctacat

SEQ ID NO: 339378 - DNA, 25 bp, Homo sapien
gtccttatctttcagagctacatag

SEQ ID NO: 339379 - DNA, 25 bp, Homo sapien
ttatctttcagagctacatagtgga

SEQ ID NO: 339380 - DNA, 25 bp, Homo sapien
cagagctacatagtggaatgtttat

SEQ ID NO: 339381 - DNA, 25 bp, Homo sapien
atgatataggcatttgggatttgct

SEQ ID NO: 339382 - DNA, 25 bp, Homo sapien
gatttgctgcaaaatgacccagagg

SEQ ID NO: 339383 - DNA, 25 bp, Homo sapien
gcagttgtgttgtaagcgtccttat

SEQ ID NO: 339384 - DNA, 25 bp, Homo sapien
gtgttgtaagcgtccttatctttca

SEQ ID NO: 339385 - DNA, 25 bp, Homo sapien
gtaagcgtccttatctttcagagct

SEQ ID NO: 339386 - DNA, 25 bp, Homo sapien
gcgtccttatctttcagagctacat

SEQ ID NO: 339387 - DNA, 25 bp, Homo sapien
gtccttatctttcagagctacatag

SEQ ID NO: 339388 - DNA, 25 bp, Homo sapien
ttatctttcagagctacatagtgga

SEQ ID NO: 339389 - DNA, 25 bp, Homo sapien
cagagctacatagtggaatgtttat

SEQ ID NO: 339390 - DNA, 25 bp, Homo sapien
atgatataggcatttgggatttgct

SEQ ID NO: 339391 - DNA, 25 bp, Homo sapien
gatttgctgcaaaatgacccagagg

SEQ ID NO: 339392 - DNA, 25 bp, Homo sapien
gtagaggtagccacgagctgataat

SEQ ID NO: 339393 - DNA, 25 bp, Homo sapien
gggctcattatcctgcatagtctat

SEQ ID NO: 339394 - DNA, 25 bp, Homo sapien
ccagttcacagccagagttgcctct

SEQ ID NO: 339395 - DNA, 25 bp, Homo sapien
gttcacagccagagttgcctctcct

SEQ ID NO: 339396 - DNA, 25 bp, Homo sapien
tgttgttagagggcccagagttcct

SEQ ID NO: 339397 - DNA, 25 bp, Homo sapien
cgctctctctctcttggcctgagat

SEQ ID NO: 339398 - DNA, 25 bp, Homo sapien
tctctcttggcctgagatctctgtg

SEQ ID NO: 339399 - DNA, 25 bp, Homo sapien
ctctcttggcctgagatctctgtgc

SEQ ID NO: 339400 - DNA, 25 bp, Homo sapien
tgagatctctgtgcaggaaccaaga

SEQ ID NO: 339401 - DNA, 25 bp, Homo sapien
agatctctgtgcaggaaccaagatg

SEQ ID NO: 339402 - DNA, 25 bp, Homo sapien
atctctgtgcaggaaccaagatggg

SEQ ID NO: 339403 - DNA, 25 bp, Homo sapien
ctgaagcctctggaggcagttggtt

SEQ ID NO: 339404 - DNA, 25 bp, Homo sapien
ctcagcccggcaacttctgggttcc

SEQ ID NO: 339405 - DNA, 25 bp, Homo sapien
aatgtctttcttcatgaatgcttca

SEQ ID NO: 339406 - DNA, 25 bp, Homo sapien
atgaatgcttcatggggctccagga

SEQ ID NO: 339407 - DNA, 25 bp, Homo sapien
gggctccaggaagcctgtatcacct

SEQ ID NO: 339408 - DNA, 25 bp, Homo sapien
aggaagcctgtatcacctgtgtaag

SEQ ID NO: 339409 - DNA, 25 bp, Homo sapien
gcctgtatcacctgtgtaagttggt

SEQ ID NO: 339410 - DNA, 25 bp, Homo sapien
cacctgtgtaagttggtatttgggc

SEQ ID NO: 339411 - DNA, 25 bp, Homo sapien
gttggtatttgggcactttatattt

SEQ ID NO: 339412 - DNA, 25 bp, Homo sapien
aaacgtgttttggatcctgtactct

SEQ ID NO: 339413 - DNA, 25 bp, Homo sapien
cgtgttttggatcctgtactctaat

SEQ ID NO: 339414 - DNA, 25 bp, Homo sapien
ataaacgttgaactttcacaatgtt

SEQ ID NO: 339415 - DNA, 25 bp, Homo sapien
tatttggatatagcaacttcttttc

SEQ ID NO: 339416 - DNA, 25 bp, Homo sapien
atttcctcaagtgtgcatagatctg

SEQ ID NO: 339417 - DNA, 25 bp, Homo sapien
gagtcgagactcgagattccatcat

SEQ ID NO: 339418 - DNA, 25 bp, Homo sapien
gagactcgagattccatcatagcgt

SEQ ID NO: 339419 - DNA, 25 bp, Homo sapien
gattccatcatagcgtaggtgtgtg

SEQ ID NO: 339420 - DNA, 25 bp, Homo sapien
cccctgatgggcttgtctgtgtttg

SEQ ID NO: 339421 - DNA, 25 bp, Homo sapien
gatgggcttgtctgtgtttgcacct

SEQ ID NO: 339422 - DNA, 25 bp, Homo sapien
gtttgcaccttgtcctgtgtctgag

SEQ ID NO: 339423 - DNA, 25 bp, Homo sapien
tgtcctgtgtctgaggtcctgtgac

SEQ ID NO: 339424 - DNA, 25 bp, Homo sapien
tgaggtcctgtgactgtaccctcct

SEQ ID NO: 339425 - DNA, 25 bp, Homo sapien
tgtaccctcctttgccctgggacat

SEQ ID NO: 339426 - DNA, 25 bp, Homo sapien
gggacatctgtatctcttggctttg

SEQ ID NO: 339427 - DNA, 25 bp, Homo sapien
cacgcctgttattgttcccggaagt

SEQ ID NO: 339428 - DNA, 25 bp, Homo sapien
gaagtccaccggtcactgtcccggg

SEQ ID NO: 339429 - DNA, 25 bp, Homo sapien
gaaacttctcaggactgacaaactg

SEQ ID NO: 339430 - DNA, 25 bp, Homo sapien
aggactgacaaactggaggtatgca

SEQ ID NO: 339431 - DNA, 25 bp, Homo sapien
ttccagcgaggaaactgtgcccggg

SEQ ID NO: 339432 - DNA, 25 bp, Homo sapien
ggagagaccgactgccgctttgcac

SEQ ID NO: 339433 - DNA, 25 bp, Homo sapien
agacagcaccatgatcgacacaagt

SEQ ID NO: 339434 - DNA, 25 bp, Homo sapien
gatcgacacaagtgacaacaccgta

SEQ ID NO: 339435 - DNA, 25 bp, Homo sapien
gtgacaacaccgtaaccgtttgtat

SEQ ID NO: 339436 - DNA, 25 bp, Homo sapien
ccgtaaccgtttgtatggattacat

SEQ ID NO: 339437 - DNA, 25 bp, Homo sapien
caggccaaaatcaaagctgcgcagc

SEQ ID NO: 339438 - DNA, 25 bp, Homo sapien
tggcgaaaagccctgtgagtgcagt

SEQ ID NO: 339439 - DNA, 25 bp, Homo sapien
gggaaatgctttagacaccgcacca

SEQ ID NO: 339440 - DNA, 25 bp, Homo sapien
aatgctttagacaccgcaccagcct

SEQ ID NO: 339441 - DNA, 25 bp, Homo sapien
ggagagaggccttataactgcactg

SEQ ID NO: 339442 - DNA, 25 bp, Homo sapien
agaggccttataactgcactgcatg

SEQ ID NO: 339443 - DNA, 25 bp, Homo sapien
aggccttataactgcactgcatgtg

SEQ ID NO: 339444 - DNA, 25 bp, Homo sapien
tgtgagaaggcctttatctataaaa

SEQ ID NO: 339445 - DNA, 25 bp, Homo sapien
aaacaaacttgttgagcatcagcga

SEQ ID NO: 339446 - DNA, 25 bp, Homo sapien
aaacttgttgagcatcagcgaatcc

SEQ ID NO: 339447 - DNA, 25 bp, Homo sapien
ggaaagccttcaacaaaagatattc

SEQ ID NO: 339448 - DNA, 25 bp, Homo sapien
acaaaagatattcccttgtcaggca

SEQ ID NO: 339449 - DNA, 25 bp, Homo sapien
aatagagtgattcacaatctttggg

SEQ ID NO: 339450 - DNA, 25 bp, Homo sapien
ttggggttttctcctcatcaaaagc

SEQ ID NO: 339451 - DNA, 25 bp, Homo sapien
agcatttcttaagtgcctatctaaa

SEQ ID NO: 339452 - DNA, 25 bp, Homo sapien
aagcaattaaagactgtgtctgccc

SEQ ID NO: 339453 - DNA, 25 bp, Homo sapien
ctgtgtctgccctttagaagctaag

SEQ ID NO: 339454 - DNA, 25 bp, Homo sapien
gtctgccctttagaagctaagaatt

SEQ ID NO: 339455 - DNA, 25 bp, Homo sapien
tgattcatgatgcaaattaactaga

SEQ ID NO: 339456 - DNA, 25 bp, Homo sapien
gataatttgcaaagtacccttgaga

SEQ ID NO: 339457 - DNA, 25 bp, Homo sapien
aagtacccttgagattgaattttct

SEQ ID NO: 339458 - DNA, 25 bp, Homo sapien
tatatttcccatatttcaggtgaat

SEQ ID NO: 339459 - DNA, 25 bp, Homo sapien
gacaaaaccctatctagtcaactgg

SEQ ID NO: 339460 - DNA, 25 bp, Homo sapien
ggaaccggagggtgacccatttcag

SEQ ID NO: 339461 - DNA, 25 bp, Homo sapien
gaaccggagggtgacccatttcagg

SEQ ID NO: 339462 - DNA, 25 bp, Homo sapien
ccatttcaggaggtgccggtaccag

SEQ ID NO: 339463 - DNA, 25 bp, Homo sapien
gtgccggtaccagcctgactaggta

SEQ ID NO: 339464 - DNA, 25 bp, Homo sapien
gtaccagcctgactaggtacaggca

SEQ ID NO: 339465 - DNA, 25 bp, Homo sapien
tgactaggtacaggcaagcttgtgt

SEQ ID NO: 339466 - DNA, 25 bp, Homo sapien
gtacaggcaagcttgtgtgggccca

SEQ ID NO: 339467 - DNA, 25 bp, Homo sapien
acaggcaagcttgtgtgggcccaac

SEQ ID NO: 339468 - DNA, 25 bp, Homo sapien
aggcaagcttgtgtgggcccaacag

SEQ ID NO: 339469 - DNA, 25 bp, Homo sapien
gcaagcttgtgtgggcccaacaggc

SEQ ID NO: 339470 - DNA, 25 bp, Homo sapien
agagctggtgccagatgtgggctca

SEQ ID NO: 339471 - DNA, 25 bp, Homo sapien
gacaatgaaggtaaatgacctccga

SEQ ID NO: 339472 - DNA, 25 bp, Homo sapien
atgacctccgaaaagaattagaaag

SEQ ID NO: 339473 - DNA, 25 bp, Homo sapien
tagaaagtcgagctcttagttccaa

SEQ ID NO: 339474 - DNA, 25 bp, Homo sapien
aaagtcgagctcttagttccaaagg

SEQ ID NO: 339475 - DNA, 25 bp, Homo sapien
gtcgagctcttagttccaaaggatt

SEQ ID NO: 339476 - DNA, 25 bp, Homo sapien
gagctcttagttccaaaggattaaa

SEQ ID NO: 339477 - DNA, 25 bp, Homo sapien
ttaaaatcccagttaatagcccgat

SEQ ID NO: 339478 - DNA, 25 bp, Homo sapien
aaatcccagttaatagcccgattga

SEQ ID NO: 339479 - DNA, 25 bp, Homo sapien
tcccagttaatagcccgattgacaa

SEQ ID NO: 339480 - DNA, 25 bp, Homo sapien
ttaatagcccgattgacaaaacagc

SEQ ID NO: 339481 - DNA, 25 bp, Homo sapien
gcccgattgacaaaacagcttaaag

SEQ ID NO: 339482 - DNA, 25 bp, Homo sapien
aattcccactgtcaaattctcactg

SEQ ID NO: 339483 - DNA, 25 bp, Homo sapien
aattctcactgacttatgagtgtga

SEQ ID NO: 339484 - DNA, 25 bp, Homo sapien
agttatcttttgtttgaattctgat

SEQ ID NO: 339485 - DNA, 25 bp, Homo sapien
gatagaacagtttaactcctttcta

SEQ ID NO: 339486 - DNA, 25 bp, Homo sapien
aagtgtgtatatttcaaagactctc

SEQ ID NO: 339487 - DNA, 25 bp, Homo sapien
aaagactctcaattatctggactga

SEQ ID NO: 339488 - DNA, 25 bp, Homo sapien
atctggactgaaggcactgttctca

SEQ ID NO: 339489 - DNA, 25 bp, Homo sapien
aaggcactgttctcactatggccag

SEQ ID NO: 339490 - DNA, 25 bp, Homo sapien
tgttctcactatggccagatgaatg

SEQ ID NO: 339491 - DNA, 25 bp, Homo sapien
gagtattctgtacatgaatcatgct

SEQ ID NO: 339492 - DNA, 25 bp, Homo sapien
aaatcaggacatcacttaagtatta

SEQ ID NO: 339493 - DNA, 25 bp, Homo sapien
aatcttaatgaaacaaacgcttaga

SEQ ID NO: 339494 - DNA, 25 bp, Homo sapien
taaatatgagacacttgggactact

SEQ ID NO: 339495 - DNA, 25 bp, Homo sapien
gagacacttgggactactagagata

SEQ ID NO: 339496 - DNA, 25 bp, Homo sapien
cacttgggactactagagatatttt

SEQ ID NO: 339497 - DNA, 25 bp, Homo sapien
aatataattcagcaattgtctagaa

SEQ ID NO: 339498 - DNA, 25 bp, Homo sapien
gtaatcatgaggctactgagtttgg

SEQ ID NO: 339499 - DNA, 25 bp, Homo sapien
atgaggctactgagtttggtgttca

SEQ ID NO: 339500 - DNA, 25 bp, Homo sapien
gagtttggtgttcagttactgagtt

SEQ ID NO: 339501 - DNA, 25 bp, Homo sapien
gttcagttactgagtttcaaaaatg

SEQ ID NO: 339502 - DNA, 25 bp, Homo sapien
aaatgttttggtggcatgaggacaa

SEQ ID NO: 339503 - DNA, 25 bp, Homo sapien
ggtggcatgaggacaaaatttcatt

SEQ ID NO: 339504 - DNA, 25 bp, Homo sapien
aatgtggtttggctgccggtgagca

SEQ ID NO: 339505 - DNA, 25 bp, Homo sapien
ttttttgtggagtttcccattatat

SEQ ID NO: 339506 - DNA, 25 bp, Homo sapien
tgtggagtttcccattatatgtgta

SEQ ID NO: 339507 - DNA, 25 bp, Homo sapien
tggagtttcccattatatgtgtagt

SEQ ID NO: 339508 - DNA, 25 bp, Homo sapien
gagtttcccattatatgtgtagtga

SEQ ID NO: 339509 - DNA, 25 bp, Homo sapien
gtttcccattatatgtgtagtgata

SEQ ID NO: 339510 - DNA, 25 bp, Homo sapien
gtgataatttttacagtcattctat

SEQ ID NO: 339511 - DNA, 25 bp, Homo sapien
aatttttacagtcattctatctaga

SEQ ID NO: 339512 - DNA, 25 bp, Homo sapien
agtcattctatctagactgacaaaa

SEQ ID NO: 339513 - DNA, 25 bp, Homo sapien
ttctatctagactgacaaaattctt

SEQ ID NO: 339514 - DNA, 25 bp, Homo sapien
ctagactgacaaaattctttatgga

SEQ ID NO: 339515 - DNA, 25 bp, Homo sapien
aagttttatgaatgtgagtttctgc

SEQ ID NO: 339516 - DNA, 25 bp, Homo sapien
gagtttctgcttttgaaaattgctt

SEQ ID NO: 339517 - DNA, 25 bp, Homo sapien
gaaaattgcttgtaattcctagcct

SEQ ID NO: 339518 - DNA, 25 bp, Homo sapien
attgcttgtaattcctagccttcaa

SEQ ID NO: 339519 - DNA, 25 bp, Homo sapien
gcttgtaattcctagccttcaaatt

SEQ ID NO: 339520 - DNA, 25 bp, Homo sapien
gtaattcctagccttcaaattatta

SEQ ID NO: 339521 - DNA, 25 bp, Homo sapien
caaattattaaacactccttgagtg

SEQ ID NO: 339522 - DNA, 25 bp, Homo sapien
actccttgagtgaaataattttgca

SEQ ID NO: 339523 - DNA, 25 bp, Homo sapien
tttgcattgcaaagtgttttaggat

SEQ ID NO: 339524 - DNA, 25 bp, Homo sapien
cattgcaaagtgttttaggatgaac

SEQ ID NO: 339525 - DNA, 25 bp, Homo sapien
actccaataaagttcatcagtttaa

SEQ ID NO: 339526 - DNA, 25 bp, Homo sapien
gttttctccccagtcatcttatttg

SEQ ID NO: 339527 - DNA, 25 bp, Homo sapien
cccagtcatcttatttggctatgtt

SEQ ID NO: 339528 - DNA, 25 bp, Homo sapien
tcagacccccagtttcaggaattga

SEQ ID NO: 339529 - DNA, 25 bp, Homo sapien
tgcttcttgtcaccctgggacagta

SEQ ID NO: 339530 - DNA, 25 bp, Homo sapien
accctgggacagtaatgccttatag

SEQ ID NO: 339531 - DNA, 25 bp, Homo sapien
gtggcactagtcaccttaagtagat

SEQ ID NO: 339532 - DNA, 25 bp, Homo sapien
gcatgggaatttgctttcgtgatat

SEQ ID NO: 339533 - DNA, 25 bp, Homo sapien
aaccatcggttctatatatctagct

SEQ ID NO: 339534 - DNA, 25 bp, Homo sapien
agctttaggaagttgcccttacagg

SEQ ID NO: 339535 - DNA, 25 bp, Homo sapien
tgcccttacaggtgggaccttttgt

SEQ ID NO: 339536 - DNA, 25 bp, Homo sapien
gtgggaccttttgtgttaatctgtt

SEQ ID NO: 339537 - DNA, 25 bp, Homo sapien
agaagctggtatttgtgacagacaa

SEQ ID NO: 339538 - DNA, 25 bp, Homo sapien
agacaagggccgctatctgtctttt

SEQ ID NO: 339539 - DNA, 25 bp, Homo sapien
ggccgctatctgtcttttgggaaag

SEQ ID NO: 339540 - DNA, 25 bp, Homo sapien
gaaagacagtggcacaagtttcaat

SEQ ID NO: 339541 - DNA, 25 bp, Homo sapien
tgctccgcttcatcagtggccggtc

SEQ ID NO: 339542 - DNA, 25 bp, Homo sapien
atcagtggccggtctggttctctca

SEQ ID NO: 339543 - DNA, 25 bp, Homo sapien
ggttctctcatcgatgccattggcc

SEQ ID NO: 339544 - DNA, 25 bp, Homo sapien
gccattggcctgcactgggatgttt

SEQ ID NO: 339545 - DNA, 25 bp, Homo sapien
tgcactgggatgtttaccccactag

SEQ ID NO: 339546 - DNA, 25 bp, Homo sapien
ttaccccactagctgcagcagatgc

SEQ ID NO: 339547 - DNA, 25 bp, Homo sapien
ggagtaagaactcccttatcactaa

SEQ ID NO: 339548 - DNA, 25 bp, Homo sapien
catccatcagctcccttttcttttt

SEQ ID NO: 339549 - DNA, 25 bp, Homo sapien
ttttcccttgaactgttctggcctc

SEQ ID NO: 339550 - DNA, 25 bp, Homo sapien
tcagaccaactctctcctgtataat

SEQ ID NO: 339551 - DNA, 25 bp, Homo sapien
agaccaactctctcctgtataatct

SEQ ID NO: 339552 - DNA, 25 bp, Homo sapien
aactctctcctgtataatctctctc

SEQ ID NO: 339553 - DNA, 25 bp, Homo sapien
gtataatctctctcctgtataaccc

SEQ ID NO: 339554 - DNA, 25 bp, Homo sapien
ataatctctctcctgtataacccca

SEQ ID NO: 339555 - DNA, 25 bp, Homo sapien
tgtataaccccaccttgccaagctt

SEQ ID NO: 339556 - DNA, 25 bp, Homo sapien
caccttgccaagctttcttctacaa

SEQ ID NO: 339557 - DNA, 25 bp, Homo sapien
ttgccaagctttcttctacaaccag

SEQ ID NO: 339558 - DNA, 25 bp, Homo sapien
tgccaagctttcttctacaaccaga

SEQ ID NO: 339559 - DNA, 25 bp, Homo sapien
gaggagcgtgcagaactgaatcagt

SEQ ID NO: 339560 - DNA, 25 bp, Homo sapien
gaactgaatcagtcggaggaacctg

SEQ ID NO: 339561 - DNA, 25 bp, Homo sapien
aatcagtcggaggaacctgaggcag

SEQ ID NO: 339562 - DNA, 25 bp, Homo sapien
catccatcagctcccttttcttttt

SEQ ID NO: 339563 - DNA, 25 bp, Homo sapien
ttttcccttgaactgttctggcctc

SEQ ID NO: 339564 - DNA, 25 bp, Homo sapien
tcagaccaactctctcctgtataat

SEQ ID NO: 339565 - DNA, 25 bp, Homo sapien
aactctctcctgtataatctctctc

SEQ ID NO: 339566 - DNA, 25 bp, Homo sapien
gtataatctctctcctgtataaccc

SEQ ID NO: 339567 - DNA, 25 bp, Homo sapien
tgtataaccccaccttgccaagctt

SEQ ID NO: 339568 - DNA, 25 bp, Homo sapien
tgccaagctttcttctacaaccaga

SEQ ID NO: 339569 - DNA, 25 bp, Homo sapien
tcatcttgtggcaaaggcggcaacg

SEQ ID NO: 339570 - DNA, 25 bp, Homo sapien
ggttattttggatcttttctgcttt

SEQ ID NO: 339571 - DNA, 25 bp, Homo sapien
gagtcatttttaccacacagtccag

SEQ ID NO: 339572 - DNA, 25 bp, Homo sapien
ttaccacacagtccagtttgcatgt

SEQ ID NO: 339573 - DNA, 25 bp, Homo sapien
ccagtttgcatgtatagctaggaaa

SEQ ID NO: 339574 - DNA, 25 bp, Homo sapien
ggaaacatgtattgctctagattgg

SEQ ID NO: 339575 - DNA, 25 bp, Homo sapien
tctagattgggcagtttaagtcatt

SEQ ID NO: 339576 - DNA, 25 bp, Homo sapien
gaaagttagttcatagttgttgcct

SEQ ID NO: 339577 - DNA, 25 bp, Homo sapien
gttgttgccttttaactcatagtca

SEQ ID NO: 339578 - DNA, 25 bp, Homo sapien
taactcatagtcaagcttcagtctt

SEQ ID NO: 339579 - DNA, 25 bp, Homo sapien
ggagatccttgtgggcattattcta

SEQ ID NO: 339580 - DNA, 25 bp, Homo sapien
actgatacgtagacacttacttgga

SEQ ID NO: 339581 - DNA, 25 bp, Homo sapien
gattttatatcatgtcgggtccctc

SEQ ID NO: 339582 - DNA, 25 bp, Homo sapien
ttttcggcttgtatttccttagatt

SEQ ID NO: 339583 - DNA, 25 bp, Homo sapien
ttttccttccaatcatttgcttcag

SEQ ID NO: 339584 - DNA, 25 bp, Homo sapien
atttgcttcagagactcctttctgg

SEQ ID NO: 339585 - DNA, 25 bp, Homo sapien
agagactcctttctggcctaacagc

SEQ ID NO: 339586 - DNA, 25 bp, Homo sapien
gcctaacagcgcattcctttgattg

SEQ ID NO: 339587 - DNA, 25 bp, Homo sapien
gcattcctttgattggtccttgagt

SEQ ID NO: 339588 - DNA, 25 bp, Homo sapien
gtccttgagtgaccagagacttagt

SEQ ID NO: 339589 - DNA, 25 bp, Homo sapien
gaccagagacttagtgcccttgtaa

SEQ ID NO: 339590 - DNA, 25 bp, Homo sapien
tgtaagtctgtcttctgttgctact

SEQ ID NO: 339591 - DNA, 25 bp, Homo sapien
aatgtaaaacttcttgtggtcatct

SEQ ID NO: 339592 - DNA, 25 bp, Homo sapien
cactgcaccacacctgggattgtga

SEQ ID NO: 339593 - DNA, 25 bp, Homo sapien
actgcaccacacctgggattgtgac

SEQ ID NO: 339594 - DNA, 25 bp, Homo sapien
ctgcaccacacctgggattgtgaca

SEQ ID NO: 339595 - DNA, 25 bp, Homo sapien
tgcaccacacctgggattgtgacaa

SEQ ID NO: 339596 - DNA, 25 bp, Homo sapien
caccacacctgggattgtgacaatt

SEQ ID NO: 339597 - DNA, 25 bp, Homo sapien
accacacctgggattgtgacaatta

SEQ ID NO: 339598 - DNA, 25 bp, Homo sapien
ccacacctgggattgtgacaattaa

SEQ ID NO: 339599 - DNA, 25 bp, Homo sapien
cacacctgggattgtgacaattaac

SEQ ID NO: 339600 - DNA, 25 bp, Homo sapien
cacctgggattgtgacaattaactt

SEQ ID NO: 339601 - DNA, 25 bp, Homo sapien
cctgggattgtgacaattaacttga

SEQ ID NO: 339602 - DNA, 25 bp, Homo sapien
ggattgtgacaattaacttgataaa

SEQ ID NO: 339603 - DNA, 25 bp, Homo sapien
ggtggcatttgcgtcacgtggacca

SEQ ID NO: 339604 - DNA, 25 bp, Homo sapien
catttgcgtcacgtggaccagggac

SEQ ID NO: 339605 - DNA, 25 bp, Homo sapien
atcagcagtgctcagaaacaattta

SEQ ID NO: 339606 - DNA, 25 bp, Homo sapien
ttttcctgctgtataactccttgcc

SEQ ID NO: 339607 - DNA, 25 bp, Homo sapien
gctgtataactccttgccatgcaaa

SEQ ID NO: 339608 - DNA, 25 bp, Homo sapien
gccatgcaaactctcaagaggccaa

SEQ ID NO: 339609 - DNA, 25 bp, Homo sapien
gaggccaatatattcctggccatgt

SEQ ID NO: 339610 - DNA, 25 bp, Homo sapien
gccatgtttgaatgagcctcttaaa

SEQ ID NO: 339611 - DNA, 25 bp, Homo sapien
gaatgagcctcttaaaataaactta

SEQ ID NO: 339612 - DNA, 25 bp, Homo sapien
aacttagagccatgcaaatgccagc

SEQ ID NO: 339613 - DNA, 25 bp, Homo sapien
aaatgccagcagcttaatggatttc

SEQ ID NO: 339614 - DNA, 25 bp, Homo sapien
gggtggtaagtctatggattttgat

SEQ ID NO: 339615 - DNA, 25 bp, Homo sapien
tggtaagtctatggattttgatttc

SEQ ID NO: 339616 - DNA, 25 bp, Homo sapien
gtaagtctatggattttgatttcct

SEQ ID NO: 339617 - DNA, 25 bp, Homo sapien
aagtctatggattttgatttccttt

SEQ ID NO: 339618 - DNA, 25 bp, Homo sapien
agtctatggattttgatttcctttt

SEQ ID NO: 339619 - DNA, 25 bp, Homo sapien
gtctatggattttgatttccttttt

SEQ ID NO: 339620 - DNA, 25 bp, Homo sapien
ctatggattttgatttcctttttgc

SEQ ID NO: 339621 - DNA, 25 bp, Homo sapien
tatggattttgatttcctttttgct

SEQ ID NO: 339622 - DNA, 25 bp, Homo sapien
ggattttgatttcctttttgctgtt

SEQ ID NO: 339623 - DNA, 25 bp, Homo sapien
aacatgtttatgtaacttcattttt

SEQ ID NO: 339624 - DNA, 25 bp, Homo sapien
gggtggtagcccacacttgtagtcc

SEQ ID NO: 339625 - DNA, 25 bp, Homo sapien
aagctttgtcccctctcgctgtggg

SEQ ID NO: 339626 - DNA, 25 bp, Homo sapien
gggctagtgattctcctccgacctg

SEQ ID NO: 339627 - DNA, 25 bp, Homo sapien
tgattctcctccgacctgacgattg

SEQ ID NO: 339628 - DNA, 25 bp, Homo sapien
ccgacctgacgattgcttggttttt

SEQ ID NO: 339629 - DNA, 25 bp, Homo sapien
tgacgattgcttggttttttcaaaa

SEQ ID NO: 339630 - DNA, 25 bp, Homo sapien
ttttgtgcggtgagaagtgtgtttc

SEQ ID NO: 339631 - DNA, 25 bp, Homo sapien
tttctgtgtggctaactctgggcta

SEQ ID NO: 339632 - DNA, 25 bp, Homo sapien
tgtggctaactctgggctagcgtgc

SEQ ID NO: 339633 - DNA, 25 bp, Homo sapien
taactctgggctagcgtgccgtggc

SEQ ID NO: 339634 - DNA, 25 bp, Homo sapien
gtcgggaaggatcccttccatctct

SEQ ID NO: 339635 - DNA, 25 bp, Homo sapien
cttccatctctcagccgcagaggag

SEQ ID NO: 339636 - DNA, 25 bp, Homo sapien
aaatgcaccaggcaggtactagcaa

SEQ ID NO: 339637 - DNA, 25 bp, Homo sapien
aagagcacgtctacatttgagtaaa

SEQ ID NO: 339638 - DNA, 25 bp, Homo sapien
gacatttcaaacatacctgaagtct

SEQ ID NO: 339639 - DNA, 25 bp, Homo sapien
gaagtctttttactcattatcttgt

SEQ ID NO: 339640 - DNA, 25 bp, Homo sapien
tcactgaggtgcatgatttctacac

SEQ ID NO: 339641 - DNA, 25 bp, Homo sapien
atttctacacatcgtgactgctctg

SEQ ID NO: 339642 - DNA, 25 bp, Homo sapien
actgctctgctctgcgtttacaaaa

SEQ ID NO: 339643 - DNA, 25 bp, Homo sapien
tgcgtttacaaaaccaacagcccgc

SEQ ID NO: 339644 - DNA, 25 bp, Homo sapien
aacagcccgcgcaggtacctagcta

SEQ ID NO: 339645 - DNA, 25 bp, Homo sapien
tacctagctacctgcattcatgtga

SEQ ID NO: 339646 - DNA, 25 bp, Homo sapien
gctacctgcattcatgtgacatgtc

SEQ ID NO: 339647 - DNA, 25 bp, Homo sapien
aaaagtcttatggaggtgttagcac

SEQ ID NO: 339648 - DNA, 25 bp, Homo sapien
gtgttagcactctttctactgatga

SEQ ID NO: 339649 - DNA, 25 bp, Homo sapien
tgaggtacttcataaaaccacttac

SEQ ID NO: 339650 - DNA, 25 bp, Homo sapien
aaccacttacccaaggtgtcttgag

SEQ ID NO: 339651 - DNA, 25 bp, Homo sapien
caaggtgtcttgagtctggtacaac

SEQ ID NO: 339652 - DNA, 25 bp, Homo sapien
gtctggtacaactggcattcaaatc

SEQ ID NO: 339653 - DNA, 25 bp, Homo sapien
attcaaatctaggtcagtctgcccc

SEQ ID NO: 339654 - DNA, 25 bp, Homo sapien
ttatattgttgagcccatgacccca

SEQ ID NO: 339655 - DNA, 25 bp, Homo sapien
cccaaactgctctttccaatttgaa

SEQ ID NO: 339656 - DNA, 25 bp, Homo sapien
tgctctttccaatttgaacttccag

SEQ ID NO: 339657 - DNA, 25 bp, Homo sapien
gtttttaatggcaacgccgtctgtc

SEQ ID NO: 339658 - DNA, 25 bp, Homo sapien
cgaggatgaacctgcagactgccac

SEQ ID NO: 339659 - DNA, 25 bp, Homo sapien
gactgccacagccacatgctttgat

SEQ ID NO: 339660 - DNA, 25 bp, Homo sapien
ccacatgctttgatgcggctcaggg

SEQ ID NO: 339661 - DNA, 25 bp, Homo sapien
cacgcttcctgaagtcgcctgctta

SEQ ID NO: 339662 - DNA, 25 bp, Homo sapien
aagtcgcctgcttaccgggacctgg

SEQ ID NO: 339663 - DNA, 25 bp, Homo sapien
tggacgagccctcacacacctgagt

SEQ ID NO: 339664 - DNA, 25 bp, Homo sapien
acacctgagtctccacggcagtgag

SEQ ID NO: 339665 - DNA, 25 bp, Homo sapien
cctgagtctccacggcagtgaggaa

SEQ ID NO: 339666 - DNA, 25 bp, Homo sapien
ggaagagaggttgagtcacccatcc

SEQ ID NO: 339667 - DNA, 25 bp, Homo sapien
gttgagtcacccatccccgaggtgg

SEQ ID NO: 339668 - DNA, 25 bp, Homo sapien
ggcaggttctgcaaagcaagtgcaa

SEQ ID NO: 339669 - DNA, 25 bp, Homo sapien
tggccagcaaggtagggtcatcgtc

SEQ ID NO: 339670 - DNA, 25 bp, Homo sapien
cagcaaggtagggtcatcgtccgtg

SEQ ID NO: 339671 - DNA, 25 bp, Homo sapien
ggtcatggccttcaggcatcacctg

SEQ ID NO: 339672 - DNA, 25 bp, Homo sapien
atggccttcaggcatcacctgggag

SEQ ID NO: 339673 - DNA, 25 bp, Homo sapien
cagcctcaggagcaaggaccacagc

SEQ ID NO: 339674 - DNA, 25 bp, Homo sapien
gaccacagccttgtcctagagagag

SEQ ID NO: 339675 - DNA, 25 bp, Homo sapien
agccttgtcctagagagagggcact

SEQ ID NO: 339676 - DNA, 25 bp, Homo sapien
ttgtcctagagagagggcactggat

SEQ ID NO: 339677 - DNA, 25 bp, Homo sapien
atggtggctccagctctaacggtca

SEQ ID NO: 339678 - DNA, 25 bp, Homo sapien
ctctaacggtcacccttttctgtgg

SEQ ID NO: 339679 - DNA, 25 bp, Homo sapien
ttctgtggctccagcgtggtgtcca

SEQ ID NO: 339680 - DNA, 25 bp, Homo sapien
cagatgtgccaagtgattgaagaaa

SEQ ID NO: 339681 - DNA, 25 bp, Homo sapien
gtgattgaagaaagatataccccaa

SEQ ID NO: 339682 - DNA, 25 bp, Homo sapien
gatataccccaatatcaagtgataa

SEQ ID NO: 339683 - DNA, 25 bp, Homo sapien
attttcctacagactgaatttgctt

SEQ ID NO: 339684 - DNA, 25 bp, Homo sapien
acagactgaatttgctttatttgaa

SEQ ID NO: 339685 - DNA, 25 bp, Homo sapien
agttagattttaccctgaggtatag

SEQ ID NO: 339686 - DNA, 25 bp, Homo sapien
taccctgaggtatagtatatgtaat

SEQ ID NO: 339687 - DNA, 25 bp, Homo sapien
gaagggaagttcacaatcctcacat

SEQ ID NO: 339688 - DNA, 25 bp, Homo sapien
aatctagtacagcatttgatctttg

SEQ ID NO: 339689 - DNA, 25 bp, Homo sapien
catttgatctttgttatgcacagca

SEQ ID NO: 339690 - DNA, 25 bp, Homo sapien
gatctttgttatgcacagcatactt

SEQ ID NO: 339691 - DNA, 25 bp, Homo sapien
gctggacgagcacatcagagttcac

SEQ ID NO: 339692 - DNA, 25 bp, Homo sapien
gaagcccttttcgtgtcccgagtgt

SEQ ID NO: 339693 - DNA, 25 bp, Homo sapien
tcgtgtcccgagtgtaacaaaagtt

SEQ ID NO: 339694 - DNA, 25 bp, Homo sapien
aagtttccgcctcaagagaagcctg

SEQ ID NO: 339695 - DNA, 25 bp, Homo sapien
gagaagcctgaaagcccacgggctg

SEQ ID NO: 339696 - DNA, 25 bp, Homo sapien
gggcttcttctggaggaacgccatg

SEQ ID NO: 339697 - DNA, 25 bp, Homo sapien
tcttctggaggaacgccatgcgcgc

SEQ ID NO: 339698 - DNA, 25 bp, Homo sapien
gacgcacagcgaggaaaagccgttt

SEQ ID NO: 339699 - DNA, 25 bp, Homo sapien
aaagccgttttcttgtggtgaatgt

SEQ ID NO: 339700 - DNA, 25 bp, Homo sapien
gtggcaggaaattcatctacaagat

SEQ ID NO: 339701 - DNA, 25 bp, Homo sapien
atctacaagattaagctggacgagc

SEQ ID NO: 339702 - DNA, 25 bp, Homo sapien
gtgtaaactgaaacatgcacatttt

SEQ ID NO: 339703 - DNA, 25 bp, Homo sapien
tgaaacatgcacattttgtacattg

SEQ ID NO: 339704 - DNA, 25 bp, Homo sapien
acattttgtacattgtgctttcttt

SEQ ID NO: 339705 - DNA, 25 bp, Homo sapien
catttggttgcgctgacctaggaat

SEQ ID NO: 339706 - DNA, 25 bp, Homo sapien
gttgcgctgacctaggaatgttggt

SEQ ID NO: 339707 - DNA, 25 bp, Homo sapien
cctaggaatgttggtcatatcaaac

SEQ ID NO: 339708 - DNA, 25 bp, Homo sapien
aggagtatgtgctgtgaagtgatct

SEQ ID NO: 339709 - DNA, 25 bp, Homo sapien
ttttgtcatgaactgtactactcct

SEQ ID NO: 339710 - DNA, 25 bp, Homo sapien
gtcatgaactgtactactcctaatt

SEQ ID NO: 339711 - DNA, 25 bp, Homo sapien
gaactgtactactcctaattattgt

SEQ ID NO: 339712 - DNA, 25 bp, Homo sapien
gtactactcctaattattgtaatgt

SEQ ID NO: 339713 - DNA, 25 bp, Homo sapien
atgatggctaataatgctgtcctta

SEQ ID NO: 339714 - DNA, 25 bp, Homo sapien
taatgctgtccttatactccacgaa

SEQ ID NO: 339715 - DNA, 25 bp, Homo sapien
ttatactccacgaaggctgccaagt

SEQ ID NO: 339716 - DNA, 25 bp, Homo sapien
gaaggctgccaagtttcaggatgat

SEQ ID NO: 339717 - DNA, 25 bp, Homo sapien
gagatgctcaaacagattttcttgc

SEQ ID NO: 339718 - DNA, 25 bp, Homo sapien
ggagaataatgcttggtggtttcat

SEQ ID NO: 339719 - DNA, 25 bp, Homo sapien
ggtttcatgggatactctggtggca

SEQ ID NO: 339720 - DNA, 25 bp, Homo sapien
atactctggtggcagtactatccgc

SEQ ID NO: 339721 - DNA, 25 bp, Homo sapien
tggcagtactatccgcccgtgataa

SEQ ID NO: 339722 - DNA, 25 bp, Homo sapien
cccgtgataaactcctccatcaaaa

SEQ ID NO: 339723 - DNA, 25 bp, Homo sapien
cttctttcctcaggagtgtaatcta

SEQ ID NO: 339724 - DNA, 25 bp, Homo sapien
gagaaggactcctggcgcaaagctt

SEQ ID NO: 339725 - DNA, 25 bp, Homo sapien
cagctgctgagtcagctctcaaaaa

SEQ ID NO: 339726 - DNA, 25 bp, Homo sapien
gagtcagctctcaaaaacgaagggc

SEQ ID NO: 339727 - DNA, 25 bp, Homo sapien
gctcagatgaggaattcgacagtgt

SEQ ID NO: 339728 - DNA, 25 bp, Homo sapien
aattcgacagtgtctacgatccctc

SEQ ID NO: 339729 - DNA, 25 bp, Homo sapien
ttacggagagcaacctacagaccag

SEQ ID NO: 339730 - DNA, 25 bp, Homo sapien
tacagaccagctcctgttagctcgt

SEQ ID NO: 339731 - DNA, 25 bp, Homo sapien
ctgttagctcgtggtcctcaaggac

SEQ ID NO: 339732 - DNA, 25 bp, Homo sapien
tcagaaaccaggctcgaggcctatc

SEQ ID NO: 339733 - DNA, 25 bp, Homo sapien
ttctgcattcctatgggtgacccaa

SEQ ID NO: 339734 - DNA, 25 bp, Homo sapien
gggtgacccaattattcagacctaa

SEQ ID NO: 339735 - DNA, 25 bp, Homo sapien
atgcttccaagcaggcttcatccgt

SEQ ID NO: 339736 - DNA, 25 bp, Homo sapien
tggaccctcatctcttaagacctgc

SEQ ID NO: 339737 - DNA, 25 bp, Homo sapien
aagacctgccgcctataaaaaggat

SEQ ID NO: 339738 - DNA, 25 bp, Homo sapien
tatatcttgagaccctatcctctaa

SEQ ID NO: 339739 - DNA, 25 bp, Homo sapien
ctctgggtcaaaagtctaaaacgct

SEQ ID NO: 339740 - DNA, 25 bp, Homo sapien
aaaacgcttaggctggcaaccatca

SEQ ID NO: 339741 - DNA, 25 bp, Homo sapien
agatccttgcccatggtgtcctcaa

SEQ ID NO: 339742 - DNA, 25 bp, Homo sapien
tcctcaagcctactctcatgaaatg

SEQ ID NO: 339743 - DNA, 25 bp, Homo sapien
atggacaacagtacacgcatatggg

SEQ ID NO: 339744 - DNA, 25 bp, Homo sapien
gggccagttccacatatttggcaac

SEQ ID NO: 339745 - DNA, 25 bp, Homo sapien
tatttggcaaccagaccagcatcca

SEQ ID NO: 339746 - DNA, 25 bp, Homo sapien
atgcagaatcatgcgtgaacagaca

SEQ ID NO: 339747 - DNA, 25 bp, Homo sapien
gaatcatgcgtgaacagacatcaga

SEQ ID NO: 339748 - DNA, 25 bp, Homo sapien
atgcgtgaacagacatcagatgcct

SEQ ID NO: 339749 - DNA, 25 bp, Homo sapien
tgcgtgaacagacatcagatgcctg

SEQ ID NO: 339750 - DNA, 25 bp, Homo sapien
tgataaggtaacttttccggtcaca

SEQ ID NO: 339751 - DNA, 25 bp, Homo sapien
gtaacttttccggtcacacacaaca

SEQ ID NO: 339752 - DNA, 25 bp, Homo sapien
aacttttccggtcacacacaacaga

SEQ ID NO: 339753 - DNA, 25 bp, Homo sapien
ttttccggtcacacacaacagactg

SEQ ID NO: 339754 - DNA, 25 bp, Homo sapien
ttccggtcacacacaacagactgat

SEQ ID NO: 339755 - DNA, 25 bp, Homo sapien
cggtcacacacaacagactgatttt

SEQ ID NO: 339756 - DNA, 25 bp, Homo sapien
cacacacaacagactgattttcctg

SEQ ID NO: 339757 - DNA, 25 bp, Homo sapien
ggcagcgtcccccacaagaagaggc

SEQ ID NO: 339758 - DNA, 25 bp, Homo sapien
agaggccccccaaggtggccagcaa

SEQ ID NO: 339759 - DNA, 25 bp, Homo sapien
ttcctgcagggaaccatcattgccc

SEQ ID NO: 339760 - DNA, 25 bp, Homo sapien
tgcagggaaccatcattgccctggt

SEQ ID NO: 339761 - DNA, 25 bp, Homo sapien
cagggaaccatcattgccctggtgg

SEQ ID NO: 339762 - DNA, 25 bp, Homo sapien
ccctggtggtggtcatggccttcag

SEQ ID NO: 339763 - DNA, 25 bp, Homo sapien
agcgtggtgtccatgtccacactgt

SEQ ID NO: 339764 - DNA, 25 bp, Homo sapien
gtggtgtccatgtccacactgtacg

SEQ ID NO: 339765 - DNA, 25 bp, Homo sapien
ggtgtccatgtccacactgtacgtg

SEQ ID NO: 339766 - DNA, 25 bp, Homo sapien
tccatgtccacactgtacgtgctga

SEQ ID NO: 339767 - DNA, 25 bp, Homo sapien
tgtccacactgtacgtgctgagcct

SEQ ID NO: 339768 - DNA, 25 bp, Homo sapien
acagtgcccggcctagtacattgtt

SEQ ID NO: 339769 - DNA, 25 bp, Homo sapien
tgcccggcctagtacattgtttaaa

SEQ ID NO: 339770 - DNA, 25 bp, Homo sapien
ggtgcatgtaaaacctcatggtact

SEQ ID NO: 339771 - DNA, 25 bp, Homo sapien
tcatggtactacaactgcctggtga

SEQ ID NO: 339772 - DNA, 25 bp, Homo sapien
gtgacagactcaccagagtaaataa

SEQ ID NO: 339773 - DNA, 25 bp, Homo sapien
aaataactatcctgctgttctccaa

SEQ ID NO: 339774 - DNA, 25 bp, Homo sapien
tgctgttctccaaccacatgggatt

SEQ ID NO: 339775 - DNA, 25 bp, Homo sapien
atgggattccccaaacaaagatttg

SEQ ID NO: 339776 - DNA, 25 bp, Homo sapien
agatttgttgagtccaagatgcatc

SEQ ID NO: 339777 - DNA, 25 bp, Homo sapien
gttgagtccaagatgcatcatgcca

SEQ ID NO: 339778 - DNA, 25 bp, Homo sapien
gatgcatcatgccagaactcttgca

SEQ ID NO: 339779 - DNA, 25 bp, Homo sapien
tttttctgggagacggattgagacc

SEQ ID NO: 339780 - DNA, 25 bp, Homo sapien
tctgggagacggattgagaccctgt

SEQ ID NO: 339781 - DNA, 25 bp, Homo sapien
agctgctcatctctgtaatgctggt

SEQ ID NO: 339782 - DNA, 25 bp, Homo sapien
gctgctcatctctgtaatgctggtt

SEQ ID NO: 339783 - DNA, 25 bp, Homo sapien
ctgctcatctctgtaatgctggttg

SEQ ID NO: 339784 - DNA, 25 bp, Homo sapien
tgctcatctctgtaatgctggttgc

SEQ ID NO: 339785 - DNA, 25 bp, Homo sapien
gctcatctctgtaatgctggttgct

SEQ ID NO: 339786 - DNA, 25 bp, Homo sapien
ctcatctctgtaatgctggttgctt

SEQ ID NO: 339787 - DNA, 25 bp, Homo sapien
tctctgtaatgctggttgcttggga

SEQ ID NO: 339788 - DNA, 25 bp, Homo sapien
ctctgtaatgctggttgcttgggag

SEQ ID NO: 339789 - DNA, 25 bp, Homo sapien
taatgctggttgcttgggaggttga

SEQ ID NO: 339790 - DNA, 25 bp, Homo sapien
caaggtctagactcaaagcctctcc

SEQ ID NO: 339791 - DNA, 25 bp, Homo sapien
actcggatgaactgaggcgcagcct

SEQ ID NO: 339792 - DNA, 25 bp, Homo sapien
aactgaggcgcagcctacgccattg

SEQ ID NO: 339793 - DNA, 25 bp, Homo sapien
tacgccattgccttggacaggactc

SEQ ID NO: 339794 - DNA, 25 bp, Homo sapien
tggacaggactctggccacaggcag

SEQ ID NO: 339795 - DNA, 25 bp, Homo sapien
ggcgggtctgtgtcccatgtgtcct

SEQ ID NO: 339796 - DNA, 25 bp, Homo sapien
atgtgtcctgtcagtcccctgagta

SEQ ID NO: 339797 - DNA, 25 bp, Homo sapien
gtcagtcccctgagtatgtgtgtgg

SEQ ID NO: 339798 - DNA, 25 bp, Homo sapien
tggcgcatgtgcaggtctgtgcctc

SEQ ID NO: 339799 - DNA, 25 bp, Homo sapien
gatttgggttttaacgtcttctgct

SEQ ID NO: 339800 - DNA, 25 bp, Homo sapien
gttttaacgtcttctgctggcccag

SEQ ID NO: 339801 - DNA, 25 bp, Homo sapien
caaaataagcaagttggtctctttt

SEQ ID NO: 339802 - DNA, 25 bp, Homo sapien
aaatctgacattaacagaagcctta

SEQ ID NO: 339803 - DNA, 25 bp, Homo sapien
gaaaactggtatgggaactcaggaa

SEQ ID NO: 339804 - DNA, 25 bp, Homo sapien
gagtgaaaacatgctcctcacctat

SEQ ID NO: 339805 - DNA, 25 bp, Homo sapien
aggacaatcaagttcgatctcatgc

SEQ ID NO: 339806 - DNA, 25 bp, Homo sapien
gttcgatctcatgccatattgggtc

SEQ ID NO: 339807 - DNA, 25 bp, Homo sapien
atattgggtcactgatggcccatca

SEQ ID NO: 339808 - DNA, 25 bp, Homo sapien
gatggcccatcatgcatggactgta

SEQ ID NO: 339809 - DNA, 25 bp, Homo sapien
atcatgcatggactgtaggactcac

SEQ ID NO: 339810 - DNA, 25 bp, Homo sapien
gtaggactcacaaataaatctggac

SEQ ID NO: 339811 - DNA, 25 bp, Homo sapien
tctggacacaaaagttcttatgtat

SEQ ID NO: 339812 - DNA, 25 bp, Homo sapien
gggaagctgctaaatcgttacctta

SEQ ID NO: 339813 - DNA, 25 bp, Homo sapien
gttaccttattatagcacttctcaa

SEQ ID NO: 339814 - DNA, 25 bp, Homo sapien
atagcacttctcaatgccacacctg

SEQ ID NO: 339815 - DNA, 25 bp, Homo sapien
cctgggccagatgtggttaaaaagt

SEQ ID NO: 339816 - DNA, 25 bp, Homo sapien
gtgcaaccaggtagcagcatgtcta

SEQ ID NO: 339817 - DNA, 25 bp, Homo sapien
attctgccatgaggacatctattcc

SEQ ID NO: 339818 - DNA, 25 bp, Homo sapien
gaggacatctattccacagctagaa

SEQ ID NO: 339819 - DNA, 25 bp, Homo sapien
attccacagctagaaaacttcattc

SEQ ID NO: 339820 - DNA, 25 bp, Homo sapien
tgcagtctgcacataaattatctag

SEQ ID NO: 339821 - DNA, 25 bp, Homo sapien
gaatcaagcagaatccttcatagga

SEQ ID NO: 339822 - DNA, 25 bp, Homo sapien
atccttcataggagagcatcaccta

SEQ ID NO: 339823 - DNA, 25 bp, Homo sapien
tggccccggacctagtgggccttct

SEQ ID NO: 339824 - DNA, 25 bp, Homo sapien
ttctcctggctgctgagatgtcgtc

SEQ ID NO: 339825 - DNA, 25 bp, Homo sapien
ctgagatgtcgtctgtgactggcct

SEQ ID NO: 339826 - DNA, 25 bp, Homo sapien
aggcagggtccccaatgtccgagct

SEQ ID NO: 339827 - DNA, 25 bp, Homo sapien
aatgtccgagctgcatctggacgct

SEQ ID NO: 339828 - DNA, 25 bp, Homo sapien
tctggacgctgctcttaaaggacct

SEQ ID NO: 339829 - DNA, 25 bp, Homo sapien
acgctgctcttaaaggacctcctgg

SEQ ID NO: 339830 - DNA, 25 bp, Homo sapien
gggcagatgctgtatgacctccctg

SEQ ID NO: 339831 - DNA, 25 bp, Homo sapien
agatgctgtatgacctccctgagca

SEQ ID NO: 339832 - DNA, 25 bp, Homo sapien
gtatgacctccctgagcacccgtga

SEQ ID NO: 339833 - DNA, 25 bp, Homo sapien
atgctttcccctttgtgctctgtgt

SEQ ID NO: 339834 - DNA, 25 bp, Homo sapien
gaattttagacgagtagtctgtcct

SEQ ID NO: 339835 - DNA, 25 bp, Homo sapien
gacgagtagtctgtcctaaatctta

SEQ ID NO: 339836 - DNA, 25 bp, Homo sapien
gtagtctgtcctaaatcttaaatag

SEQ ID NO: 339837 - DNA, 25 bp, Homo sapien
aagcgatttgcttaagccattgtac

SEQ ID NO: 339838 - DNA, 25 bp, Homo sapien
gcttaagccattgtacattataaag

SEQ ID NO: 339839 - DNA, 25 bp, Homo sapien
tagggtagtgttggattctggtttt

SEQ ID NO: 339840 - DNA, 25 bp, Homo sapien
ggattctggttttatgtaactctaa

SEQ ID NO: 339841 - DNA, 25 bp, Homo sapien
tctttaatatctcagttgtagggat

SEQ ID NO: 339842 - DNA, 25 bp, Homo sapien
aatatctcagttgtagggattttgt

SEQ ID NO: 339843 - DNA, 25 bp, Homo sapien
gtcaataccaaagcagactgagttg

SEQ ID NO: 339844 - DNA, 25 bp, Homo sapien
gcagactgagttgtggttttgtaaa

SEQ ID NO: 339845 - DNA, 25 bp, Homo sapien
taaaatgacattcctactgattgat

SEQ ID NO: 339846 - DNA, 25 bp, Homo sapien
tcctactgattgatttttatcttgc

SEQ ID NO: 339847 - DNA, 25 bp, Homo sapien
tcttgctataagttcgatgacaccg

SEQ ID NO: 339848 - DNA, 25 bp, Homo sapien
ataagttcgatgacaccgtgaatct

SEQ ID NO: 339849 - DNA, 25 bp, Homo sapien
gacaccgtgaatctaataaggttca

SEQ ID NO: 339850 - DNA, 25 bp, Homo sapien
ctgttgacacagtacaagttacata

SEQ ID NO: 339851 - DNA, 25 bp, Homo sapien
agtttattttctattgtgcaatatc

SEQ ID NO: 339852 - DNA, 25 bp, Homo sapien
gaagcaaccacctttgggaaagtgt

SEQ ID NO: 339853 - DNA, 25 bp, Homo sapien
gggaaagtgtatctgctgctcctag

SEQ ID NO: 339854 - DNA, 25 bp, Homo sapien
aaagtgtatctgctgctcctagggc

SEQ ID NO: 339855 - DNA, 25 bp, Homo sapien
ctcctagggccatgcttgtatacat

SEQ ID NO: 339856 - DNA, 25 bp, Homo sapien
aagctctcaagttcaccctttaggg

SEQ ID NO: 339857 - DNA, 25 bp, Homo sapien
agctctcaagttcaccctttaggga

SEQ ID NO: 339858 - DNA, 25 bp, Homo sapien
gctctcaagttcaccctttagggaa

SEQ ID NO: 339859 - DNA, 25 bp, Homo sapien
aagggatttgtgatgtctgtaaagt

SEQ ID NO: 339860 - DNA, 25 bp, Homo sapien
acctaggaaagataattcaaccatc

SEQ ID NO: 339861 - DNA, 25 bp, Homo sapien
ctaggaaagataattcaaccatcta

SEQ ID NO: 339862 - DNA, 25 bp, Homo sapien
aggaaagataattcaaccatctaat

SEQ ID NO: 339863 - DNA, 25 bp, Homo sapien
ggaaagataattcaaccatctaatc

SEQ ID NO: 339864 - DNA, 25 bp, Homo sapien
gaaagataattcaaccatctaatca

SEQ ID NO: 339865 - DNA, 25 bp, Homo sapien
aagataattcaaccatctaatcaaa

SEQ ID NO: 339866 - DNA, 25 bp, Homo sapien
agataattcaaccatctaatcaaaa

SEQ ID NO: 339867 - DNA, 25 bp, Homo sapien
aaatggccaaattagatgtgtgctg

SEQ ID NO: 339868 - DNA, 25 bp, Homo sapien
gccaaattagatgtgtgctgaagac

SEQ ID NO: 339869 - DNA, 25 bp, Homo sapien
gaagacaatcagtcactgggtctat

SEQ ID NO: 339870 - DNA, 25 bp, Homo sapien
atcagtcactgggtctatattaaac

SEQ ID NO: 339871 - DNA, 25 bp, Homo sapien
gggtctatattaaacagcaaccaga

SEQ ID NO: 339872 - DNA, 25 bp, Homo sapien
cagcaaccagagcaacaaatggcaa

SEQ ID NO: 339873 - DNA, 25 bp, Homo sapien
aatggcaaacaatttctattttcaa

SEQ ID NO: 339874 - DNA, 25 bp, Homo sapien
ttttttctaacactagtgtctacag

SEQ ID NO: 339875 - DNA, 25 bp, Homo sapien
ttctaacactagtgtctacagcagc

SEQ ID NO: 339876 - DNA, 25 bp, Homo sapien
gtgtctacagcagcattcaaaaaaa

SEQ ID NO: 339877 - DNA, 25 bp, Homo sapien
cttattgtatacctgattgaagctg

SEQ ID NO: 339878 - DNA, 25 bp, Homo sapien
tattgagaaagcttcgtactctgag

SEQ ID NO: 339879 - DNA, 25 bp, Homo sapien
agaaagcttcgtactctgagtgtga

SEQ ID NO: 339880 - DNA, 25 bp, Homo sapien
gcttcgtactctgagtgtgattgtc

SEQ ID NO: 339881 - DNA, 25 bp, Homo sapien
gtcgctgtagcataacaatgctttt

SEQ ID NO: 339882 - DNA, 25 bp, Homo sapien
tgtaagaaaatgacctttcccagga

SEQ ID NO: 339883 - DNA, 25 bp, Homo sapien
ggaacttaacctatactactacatg

SEQ ID NO: 339884 - DNA, 25 bp, Homo sapien
aacctatactactacatgcagacct

SEQ ID NO: 339885 - DNA, 25 bp, Homo sapien
atactactacatgcagacctataat

SEQ ID NO: 339886 - DNA, 25 bp, Homo sapien
actacatgcagacctataatactat

SEQ ID NO: 339887 - DNA, 25 bp, Homo sapien
gcagacctataatactatatggagt

SEQ ID NO: 339888 - DNA, 25 bp, Homo sapien
ctaacttaagatattgggccaggta

SEQ ID NO: 339889 - DNA, 25 bp, Homo sapien
aaagctaacatgagagcatgccaaa

SEQ ID NO: 339890 - DNA, 25 bp, Homo sapien
tacaaagatcaagggctgtccgcaa

SEQ ID NO: 339891 - DNA, 25 bp, Homo sapien
agggctgtccgcaacagggaagaac

SEQ ID NO: 339892 - DNA, 25 bp, Homo sapien
gaaagctttttgtctaagtgaattc

SEQ ID NO: 339893 - DNA, 25 bp, Homo sapien
aagtgaattcttatgccttggtcag

SEQ ID NO: 339894 - DNA, 25 bp, Homo sapien
ttcttatgccttggtcagagtaata

SEQ ID NO: 339895 - DNA, 25 bp, Homo sapien
tgcttatcttggctttcgagtctga

SEQ ID NO: 339896 - DNA, 25 bp, Homo sapien
atcttggctttcgagtctgagttta

SEQ ID NO: 339897 - DNA, 25 bp, Homo sapien
ggctttcgagtctgagtttaaaact

SEQ ID NO: 339898 - DNA, 25 bp, Homo sapien
gacatagtgtttattagcagccatc

SEQ ID NO: 339899 - DNA, 25 bp, Homo sapien
gccatctaaaaaggctctaatgtat

SEQ ID NO: 339900 - DNA, 25 bp, Homo sapien
acttcacatctgactccaggatgaa

SEQ ID NO: 339901 - DNA, 25 bp, Homo sapien
gactccaggatgaatagcagcagaa

SEQ ID NO: 339902 - DNA, 25 bp, Homo sapien
gatattggttaagacttgtcctcaa

SEQ ID NO: 339903 - DNA, 25 bp, Homo sapien
aagacttgtcctcaacaacatctta

SEQ ID NO: 339904 - DNA, 25 bp, Homo sapien
caacatcttaaaggtcagctggtgt

SEQ ID NO: 339905 - DNA, 25 bp, Homo sapien
aggtcagctggtgtgatgtaaagta

SEQ ID NO: 339906 - DNA, 25 bp, Homo sapien
aaagtaaagctctgaaactcaaagt

SEQ ID NO: 339907 - DNA, 25 bp, Homo sapien
aactcaaagttttacttcagatggc

SEQ ID NO: 339908 - DNA, 25 bp, Homo sapien
agatgcttttagaatgttgtggaat

SEQ ID NO: 339909 - DNA, 25 bp, Homo sapien
ttatttctagtcatctatccgaagg

SEQ ID NO: 339910 - DNA, 25 bp, Homo sapien
gtcatctatccgaaggcattttgta

SEQ ID NO: 339911 - DNA, 25 bp, Homo sapien
gcccggattccggttgaatctcttt

SEQ ID NO: 339912 - DNA, 25 bp, Homo sapien
ggttgaatctctttaccaccgatga

SEQ ID NO: 339913 - DNA, 25 bp, Homo sapien
gaatctctttaccaccgatgaagaa

SEQ ID NO: 339914 - DNA, 25 bp, Homo sapien
ctttaccaccgatgaagaagaggaa

SEQ ID NO: 339915 - DNA, 25 bp, Homo sapien
aagaagaggaacaagcagcgctaac

SEQ ID NO: 339916 - DNA, 25 bp, Homo sapien
aagcagcgctaaccaggccagaaga

SEQ ID NO: 339917 - DNA, 25 bp, Homo sapien
cagcgctaaccaggccagaagagtt

SEQ ID NO: 339918 - DNA, 25 bp, Homo sapien
aaccaggccagaagagttatcctat

SEQ ID NO: 339919 - DNA, 25 bp, Homo sapien
gaagagttatcctatgaagttatca

SEQ ID NO: 339920 - DNA, 25 bp, Homo sapien
gaagttatcaacatacaagccaccc

SEQ ID NO: 339921 - DNA, 25 bp, Homo sapien
cccaggaccagcaacggagcgagga

SEQ ID NO: 339922 - DNA, 25 bp, Homo sapien
gcagtgctctgagtccaagaagctg

SEQ ID NO: 339923 - DNA, 25 bp, Homo sapien
gctctgagtccaagaagctgggcag

SEQ ID NO: 339924 - DNA, 25 bp, Homo sapien
gagttggtgccctgattccattttt

SEQ ID NO: 339925 - DNA, 25 bp, Homo sapien
tgccctgattccatttttctcaagt

SEQ ID NO: 339926 - DNA, 25 bp, Homo sapien
gattccatttttctcaagttgtaga

SEQ ID NO: 339927 - DNA, 25 bp, Homo sapien
accagttacctctggttggtggaga

SEQ ID NO: 339928 - DNA, 25 bp, Homo sapien
ggaaatattttgtaccttgctttag

SEQ ID NO: 339929 - DNA, 25 bp, Homo sapien
ccttgctttagatgttggtcagatg

SEQ ID NO: 339930 - DNA, 25 bp, Homo sapien
tggtcagatggaatatacgtttgtg

SEQ ID NO: 339931 - DNA, 25 bp, Homo sapien
tatacgtttgtggaaacctgccaaa

SEQ ID NO: 339932 - DNA, 25 bp, Homo sapien
gccaaactgtacattgaatatctgt

SEQ ID NO: 339933 - DNA, 25 bp, Homo sapien
aaagtggacaggtatccaaagttca

SEQ ID NO: 339934 - DNA, 25 bp, Homo sapien
ttctgtgactcatcaaagtgacaaa

SEQ ID NO: 339935 - DNA, 25 bp, Homo sapien
gacttgtaacaactttgcctggact

SEQ ID NO: 339936 - DNA, 25 bp, Homo sapien
ttacaacagttcatccattcacaat

SEQ ID NO: 339937 - DNA, 25 bp, Homo sapien
cattcacaatgattttgttctctgc

SEQ ID NO: 339938 - DNA, 25 bp, Homo sapien
tgttctctgctccatattttttaat

SEQ ID NO: 339939 - DNA, 25 bp, Homo sapien
tttttaatcccttaagcatttgatg

SEQ ID NO: 339940 - DNA, 25 bp, Homo sapien
gcatttgatgaaacactctttagtg

SEQ ID NO: 339941 - DNA, 25 bp, Homo sapien
acactctttagtgctatatgcattt

SEQ ID NO: 339942 - DNA, 25 bp, Homo sapien
agattgaacaagttcactttccagc

SEQ ID NO: 339943 - DNA, 25 bp, Homo sapien
tttccagcttataggcaactttata

SEQ ID NO: 339944 - DNA, 25 bp, Homo sapien
ggctgatctgtctggcatgtcagga

SEQ ID NO: 339945 - DNA, 25 bp, Homo sapien
catgtcaggagccagagatattttt

SEQ ID NO: 339946 - DNA, 25 bp, Homo sapien
tcaaaaattgtccacaagtcatttg

SEQ ID NO: 339947 - DNA, 25 bp, Homo sapien
agcaggcatcgcaactttctgcatg

SEQ ID NO: 339948 - DNA, 25 bp, Homo sapien
aactttctgcatgttgatgcccgaa

SEQ ID NO: 339949 - DNA, 25 bp, Homo sapien
gttgatgcccgaagaaaatttcact

SEQ ID NO: 339950 - DNA, 25 bp, Homo sapien
gaaaatttcactgccgaccatccat

SEQ ID NO: 339951 - DNA, 25 bp, Homo sapien
cattccttttctttattcggcataa

SEQ ID NO: 339952 - DNA, 25 bp, Homo sapien
tattcggcataattcctcaggtagc

SEQ ID NO: 339953 - DNA, 25 bp, Homo sapien
cctcaggtagcatcctattcttggg

SEQ ID NO: 339954 - DNA, 25 bp, Homo sapien
agcttagtgctttattacctgagtt

SEQ ID NO: 339955 - DNA, 25 bp, Homo sapien
gttgatccaactaatttaccattta

SEQ ID NO: 339956 - DNA, 25 bp, Homo sapien
tagggatttattcttttacatgatt

SEQ ID NO: 339957 - DNA, 25 bp, Homo sapien
tttactaatgttttaagccgagcaa

SEQ ID NO: 339958 - DNA, 25 bp, Homo sapien
ctaatgttttaagccgagcaaattt

SEQ ID NO: 339959 - DNA, 25 bp, Homo sapien
aagccgagcaaatttttgcattagg

SEQ ID NO: 339960 - DNA, 25 bp, Homo sapien
acttttcttcatgttatcttaataa

SEQ ID NO: 339961 - DNA, 25 bp, Homo sapien
gaacttgtaagtattttgacagagt

SEQ ID NO: 339962 - DNA, 25 bp, Homo sapien
gacagagtacattacttcttctcat

SEQ ID NO: 339963 - DNA, 25 bp, Homo sapien
agtacattacttcttctcattaaag

SEQ ID NO: 339964 - DNA, 25 bp, Homo sapien
cttcttctcattaaagtaggtagac

SEQ ID NO: 339965 - DNA, 25 bp, Homo sapien
taaagtaggtagacgaacagaggtt

SEQ ID NO: 339966 - DNA, 25 bp, Homo sapien
gaagtgagaagctggtctcccggct

SEQ ID NO: 339967 - DNA, 25 bp, Homo sapien
gagaagctggtctcccggctccgag

SEQ ID NO: 339968 - DNA, 25 bp, Homo sapien
gagcagccggaatgaagagagccat

SEQ ID NO: 339969 - DNA, 25 bp, Homo sapien
atgtcactcaacacactgaacgtgg

SEQ ID NO: 339970 - DNA, 25 bp, Homo sapien
aacacactgaacgtggatgctccaa

SEQ ID NO: 339971 - DNA, 25 bp, Homo sapien
tgagcccccactaacgtccagtgaa

SEQ ID NO: 339972 - DNA, 25 bp, Homo sapien
aggcacagctggtgacgcagaacag

SEQ ID NO: 339973 - DNA, 25 bp, Homo sapien
tggtgacgcagaacaggcccttcgc

SEQ ID NO: 339974 - DNA, 25 bp, Homo sapien
tcactctccaagatccgtgagtcta

SEQ ID NO: 339975 - DNA, 25 bp, Homo sapien
aagatccgtgagtctatcaggcgag

SEQ ID NO: 339976 - DNA, 25 bp, Homo sapien
agtctatcaggcgaggaagtgagaa

SEQ ID NO: 339977 - DNA, 25 bp, Homo sapien
aatagttcaactcatcctttccatt

SEQ ID NO: 339978 - DNA, 25 bp, Homo sapien
caactcatcctttccattggagaat

SEQ ID NO: 339979 - DNA, 25 bp, Homo sapien
tgatggatctaccttctgtgaactt

SEQ ID NO: 339980 - DNA, 25 bp, Homo sapien
gaagaatctgctattacatttccaa

SEQ ID NO: 339981 - DNA, 25 bp, Homo sapien
caatttgtcaacatgctgagcttta

SEQ ID NO: 339982 - DNA, 25 bp, Homo sapien
ataggacttatcttcttatgacaac

SEQ ID NO: 339983 - DNA, 25 bp, Homo sapien
aacatttattggtgtgtccccttgc

SEQ ID NO: 339984 - DNA, 25 bp, Homo sapien
ccttgcctagcccaacagaagaatt

SEQ ID NO: 339985 - DNA, 25 bp, Homo sapien
gaagaattcagcagccgtaagtcta

SEQ ID NO: 339986 - DNA, 25 bp, Homo sapien
gccgtaagtctaggacaggcttaaa

SEQ ID NO: 339987 - DNA, 25 bp, Homo sapien
gcttaaattgttttcactggtgtaa

SEQ ID NO: 339988 - DNA, 25 bp, Homo sapien
aagaaaatttcactgccgaccatcc

SEQ ID NO: 339989 - DNA, 25 bp, Homo sapien
gaaaatttcactgccgaccatccat

SEQ ID NO: 339990 - DNA, 25 bp, Homo sapien
cattccttttctttattcggcataa

SEQ ID NO: 339991 - DNA, 25 bp, Homo sapien
tattcggcataattcctcaggtagc

SEQ ID NO: 339992 - DNA, 25 bp, Homo sapien
ggcataattcctcaggtagcatcct

SEQ ID NO: 339993 - DNA, 25 bp, Homo sapien
attcctcaggtagcatcctattctt

SEQ ID NO: 339994 - DNA, 25 bp, Homo sapien
cctcaggtagcatcctattcttggg

SEQ ID NO: 339995 - DNA, 25 bp, Homo sapien
ttcttccccttagaagaaagagact

SEQ ID NO: 339996 - DNA, 25 bp, Homo sapien
gaagaaagagactgtagcaatacaa

SEQ ID NO: 339997 - DNA, 25 bp, Homo sapien
aagcttagtgctttattacctgagt

SEQ ID NO: 339998 - DNA, 25 bp, Homo sapien
tagtgctttattacctgagttttta

SEQ ID NO: 339999 - DNA, 25 bp, Homo sapien
tgaaggaattctggagctttttgac

SEQ ID NO: 340000 - DNA, 25 bp, Homo sapien
ctattaccacatttagcagttaaat

SEQ ID NO: 340001 - DNA, 25 bp, Homo sapien
cagttaaatggctataggtgggaag

SEQ ID NO: 340002 - DNA, 25 bp, Homo sapien
aaaagccccttgaaacttgcaggat

SEQ ID NO: 340003 - DNA, 25 bp, Homo sapien
gaaacttgcaggatttacttaataa

SEQ ID NO: 340004 - DNA, 25 bp, Homo sapien
aaaaatacacgctatgagtcataat

SEQ ID NO: 340005 - DNA, 25 bp, Homo sapien
gctatgagtcataattgtgccaagt

SEQ ID NO: 340006 - DNA, 25 bp, Homo sapien
gtgccaagttgtttcatgcagtcct

SEQ ID NO: 340007 - DNA, 25 bp, Homo sapien
aagttgtttcatgcagtcctcaaaa

SEQ ID NO: 340008 - DNA, 25 bp, Homo sapien
gtttcatgcagtcctcaaaaattag

SEQ ID NO: 340009 - DNA, 25 bp, Homo sapien
agatgtaattgagctttgtgtaata

SEQ ID NO: 340010 - DNA, 25 bp, Homo sapien
gaattatctatctggatattactag

SEQ ID NO: 340011 - DNA, 25 bp, Homo sapien
ctatctggatattactagagttgta

SEQ ID NO: 340012 - DNA, 25 bp, Homo sapien
taaaacacaacttggaaactggaat

SEQ ID NO: 340013 - DNA, 25 bp, Homo sapien
gaaccaaacaacttaaaccagcatc

SEQ ID NO: 340014 - DNA, 25 bp, Homo sapien
taaaccagcatcacttttgtcttca

SEQ ID NO: 340015 - DNA, 25 bp, Homo sapien
ttgtcttcaatttgccttccagtga

SEQ ID NO: 340016 - DNA, 25 bp, Homo sapien
tgtcttcaatttgccttccagtgat

SEQ ID NO: 340017 - DNA, 25 bp, Homo sapien
gtgattttagtttacaacctgcgtt

SEQ ID NO: 340018 - DNA, 25 bp, Homo sapien
tacaacctgcgttttgttatttgaa

SEQ ID NO: 340019 - DNA, 25 bp, Homo sapien
ctgcgttttgttatttgaaacacac

SEQ ID NO: 340020 - DNA, 25 bp, Homo sapien
cacacacttatatataaacacatgt

SEQ ID NO: 340021 - DNA, 25 bp, Homo sapien
gcgcctggctggagtagaatgaata

SEQ ID NO: 340022 - DNA, 25 bp, Homo sapien
gcaagtgttttctgatgttaggcca

SEQ ID NO: 340023 - DNA, 25 bp, Homo sapien
atgttaggccatccttctcttggta

SEQ ID NO: 340024 - DNA, 25 bp, Homo sapien
ttctcttggtactttggctagcgga

SEQ ID NO: 340025 - DNA, 25 bp, Homo sapien
ggcatgttctctgggtgttaattag

SEQ ID NO: 340026 - DNA, 25 bp, Homo sapien
ttggctagcggagttgggcttttct

SEQ ID NO: 340027 - DNA, 25 bp, Homo sapien
gctgctctggtcctgttggctgttc

SEQ ID NO: 340028 - DNA, 25 bp, Homo sapien
ttggctgttccaggttggaggcttc

SEQ ID NO: 340029 - DNA, 25 bp, Homo sapien
aattagaccagtgggcacagcttct

SEQ ID NO: 340030 - DNA, 25 bp, Homo sapien
tgggcacagcttctcttcctgagga

SEQ ID NO: 340031 - DNA, 25 bp, Homo sapien
tgggagagcctattcgcactgggct

SEQ ID NO: 340032 - DNA, 25 bp, Homo sapien
aggacaaggtggtcaccccacggtg

SEQ ID NO: 340033 - DNA, 25 bp, Homo sapien
actgtccctggtgtgtacagctcag

SEQ ID NO: 340034 - DNA, 25 bp, Homo sapien
gagactatggctcagggcttagaac

SEQ ID NO: 340035 - DNA, 25 bp, Homo sapien
ttagaacccaaaggcctgaacaaat

SEQ ID NO: 340036 - DNA, 25 bp, Homo sapien
agactttctttgacagagtaaccag

SEQ ID NO: 340037 - DNA, 25 bp, Homo sapien
aatttctgagcattccaggagcgct

SEQ ID NO: 340038 - DNA, 25 bp, Homo sapien
ttccaggagcgctgtgcagaatcac

SEQ ID NO: 340039 - DNA, 25 bp, Homo sapien
acagctcagtgcaccgagatgacca

SEQ ID NO: 340040 - DNA, 25 bp, Homo sapien
atgaccaaccgcctgggtttgcttt

SEQ ID NO: 340041 - DNA, 25 bp, Homo sapien
ggtttgctttactgtcactgctaaa

SEQ ID NO: 340042 - DNA, 25 bp, Homo sapien
aaggcagctgccaaaccaggacaag

SEQ ID NO: 340043 - DNA, 25 bp, Homo sapien
gaataaatcactcactccaatggaa

SEQ ID NO: 340044 - DNA, 25 bp, Homo sapien
taaatcactcactccaatggaatag

SEQ ID NO: 340045 - DNA, 25 bp, Homo sapien
atttggaatgagagtcctataaaat

SEQ ID NO: 340046 - DNA, 25 bp, Homo sapien
cattaagtagcaatctttctttttt

SEQ ID NO: 340047 - DNA, 25 bp, Homo sapien
tttttgttttataggagactggctt

SEQ ID NO: 340048 - DNA, 25 bp, Homo sapien
gttttataggagactggcttaggaa

SEQ ID NO: 340049 - DNA, 25 bp, Homo sapien
atagagattagttccttccagttct

SEQ ID NO: 340050 - DNA, 25 bp, Homo sapien
gattagttccttccagttctagtac

SEQ ID NO: 340051 - DNA, 25 bp, Homo sapien
ttccttccagttctagtactctatg

SEQ ID NO: 340052 - DNA, 25 bp, Homo sapien
tagtactctatgtttctttctatga

SEQ ID NO: 340053 - DNA, 25 bp, Homo sapien
ttctttctatgatcatcacttagac

SEQ ID NO: 340054 - DNA, 25 bp, Homo sapien
gaaactagtattaagggaagcgcaa

SEQ ID NO: 340055 - DNA, 25 bp, Homo sapien
aagggaagcgcaaacacatttattt

SEQ ID NO: 340056 - DNA, 25 bp, Homo sapien
ttttgtactgcagaaaaattgcttt

SEQ ID NO: 340057 - DNA, 25 bp, Homo sapien
aaaactgccaaatgcttacctggta

SEQ ID NO: 340058 - DNA, 25 bp, Homo sapien
gcttacctggtattttattagatgc

SEQ ID NO: 340059 - DNA, 25 bp, Homo sapien
gcagaaacagattggaaacagctaa

SEQ ID NO: 340060 - DNA, 25 bp, Homo sapien
attacaacttttacatatggctctg

SEQ ID NO: 340061 - DNA, 25 bp, Homo sapien
tatggctctgtcttattgtttcttc

SEQ ID NO: 340062 - DNA, 25 bp, Homo sapien
ggctctgtcttattgtttcttcata

SEQ ID NO: 340063 - DNA, 25 bp, Homo sapien
ttattgtttcttcatactgtgtctg

SEQ ID NO: 340064 - DNA, 25 bp, Homo sapien
tttttatggaacctgttgcgcctat

SEQ ID NO: 340065 - DNA, 25 bp, Homo sapien
taatctccagggtgtgactcacggg

SEQ ID NO: 340066 - DNA, 25 bp, Homo sapien
ccgcataaagctggttctcctgtct

SEQ ID NO: 340067 - DNA, 25 bp, Homo sapien
tctcctgtctgctcattgaacggtt

SEQ ID NO: 340068 - DNA, 25 bp, Homo sapien
attgaacggttccactgcgcatcac

SEQ ID NO: 340069 - DNA, 25 bp, Homo sapien
cactgcgcatcacagcatctacatg

SEQ ID NO: 340070 - DNA, 25 bp, Homo sapien
acagcatctacatgcctaaaccaac

SEQ ID NO: 340071 - DNA, 25 bp, Homo sapien
aacaccccagcattggcaacagata

SEQ ID NO: 340072 - DNA, 25 bp, Homo sapien
attggcaacagatatcttcctctcc

SEQ ID NO: 340073 - DNA, 25 bp, Homo sapien
gacagggaagaaacatgcttgccct

SEQ ID NO: 340074 - DNA, 25 bp, Homo sapien
ggttcttcagtcattttaagcccaa

SEQ ID NO: 340075 - DNA, 25 bp, Homo sapien
gtttaaacttataatctccagggtg

SEQ ID NO: 340076 - DNA, 25 bp, Homo sapien
gcctgcagggcctctgtcaattgta

SEQ ID NO: 340077 - DNA, 25 bp, Homo sapien
gcagggcctctgtcaattgtacgcg

SEQ ID NO: 340078 - DNA, 25 bp, Homo sapien
tctgtcaattgtacgcgccaccgag

SEQ ID NO: 340079 - DNA, 25 bp, Homo sapien
aattgtacgcgccaccgagtgcctt

SEQ ID NO: 340080 - DNA, 25 bp, Homo sapien
tgcctgccactgtgtgaatcggcga

SEQ ID NO: 340081 - DNA, 25 bp, Homo sapien
gaatcggcgacggagcactgcacct

SEQ ID NO: 340082 - DNA, 25 bp, Homo sapien
tgggtcctcctttctgagggcccgt

SEQ ID NO: 340083 - DNA, 25 bp, Homo sapien
tctgagggcccgtgtaaatatgtac

SEQ ID NO: 340084 - DNA, 25 bp, Homo sapien
gggctgcccgagtctgtttttcatg

SEQ ID NO: 340085 - DNA, 25 bp, Homo sapien
cccgagtctgtttttcatgcgatga

SEQ ID NO: 340086 - DNA, 25 bp, Homo sapien
ttcatgcgatgacacttgtacaatt

SEQ ID NO: 340087 - DNA, 25 bp, Homo sapien
ttaccaacatccaaaagcgtttctt

SEQ ID NO: 340088 - DNA, 25 bp, Homo sapien
ttcccctttctacgtgtgcactaaa

SEQ ID NO: 340089 - DNA, 25 bp, Homo sapien
tttctacgtgtgcactaaattctaa

SEQ ID NO: 340090 - DNA, 25 bp, Homo sapien
gataatttgtcactagctggttgaa

SEQ ID NO: 340091 - DNA, 25 bp, Homo sapien
gtcactagctggttgaataatgcac

SEQ ID NO: 340092 - DNA, 25 bp, Homo sapien
tgcacagtttttgtttaaggttaca

SEQ ID NO: 340093 - DNA, 25 bp, Homo sapien
tatgcctggattaaataacaatagt

SEQ ID NO: 340094 - DNA, 25 bp, Homo sapien
gacaagtcttttgaaaaacagctgc

SEQ ID NO: 340095 - DNA, 25 bp, Homo sapien
gctgctaaacatattgctttctgga

SEQ ID NO: 340096 - DNA, 25 bp, Homo sapien
attgctttctggaatgtaatcatta

SEQ ID NO: 340097 - DNA, 25 bp, Homo sapien
tcattagcaacaaatattctcttat

SEQ ID NO: 340098 - DNA, 25 bp, Homo sapien
tgtgagtagcacagacaggacccct

SEQ ID NO: 340099 - DNA, 25 bp, Homo sapien
tgccccgtggcgtggacattcttgt

SEQ ID NO: 340100 - DNA, 25 bp, Homo sapien
gggccgggtcaaagagacagtcaac

SEQ ID NO: 340101 - DNA, 25 bp, Homo sapien
acagtcaacaggtgaactctgtcct

SEQ ID NO: 340102 - DNA, 25 bp, Homo sapien
aggtgaactctgtcctgcgtctagc

SEQ ID NO: 340103 - DNA, 25 bp, Homo sapien
ctgcgtctagcggtgctaagtcaac

SEQ ID NO: 340104 - DNA, 25 bp, Homo sapien
agcggtgctaagtcaacaccaagaa

SEQ ID NO: 340105 - DNA, 25 bp, Homo sapien
gtgaggcagcattaggtgctgattt

SEQ ID NO: 340106 - DNA, 25 bp, Homo sapien
gctgatttaactaaggcacgtggat

SEQ ID NO: 340107 - DNA, 25 bp, Homo sapien
taactaaggcacgtggatactcggg

SEQ ID NO: 340108 - DNA, 25 bp, Homo sapien
cggcctggcacagcgttcaggtgtt

SEQ ID NO: 340109 - DNA, 25 bp, Homo sapien
tcagtcttcctaacttaaaagggca

SEQ ID NO: 340110 - DNA, 25 bp, Homo sapien
taaaagggcaaatttccaacagaag

SEQ ID NO: 340111 - DNA, 25 bp, Homo sapien
gcaaatttccaacagaagccatcct

SEQ ID NO: 340112 - DNA, 25 bp, Homo sapien
ccagtcattacagtaggtaaaatgt

SEQ ID NO: 340113 - DNA, 25 bp, Homo sapien
tgaatggattacttgaatgggaacc

SEQ ID NO: 340114 - DNA, 25 bp, Homo sapien
gaatgggaaccaatctatctcatgg

SEQ ID NO: 340115 - DNA, 25 bp, Homo sapien
ccaatctatctcatggttcagaagt

SEQ ID NO: 340116 - DNA, 25 bp, Homo sapien
ctatctcatggttcagaagtttaat

SEQ ID NO: 340117 - DNA, 25 bp, Homo sapien
ttaaactttaatctgtacataatga

SEQ ID NO: 340118 - DNA, 25 bp, Homo sapien
gtacataatgatatccaggaactat

SEQ ID NO: 340119 - DNA, 25 bp, Homo sapien
caggaactatcctaaagcactttaa

SEQ ID NO: 340120 - DNA, 25 bp, Homo sapien
aggtcaccctcacagccagataatg

SEQ ID NO: 340121 - DNA, 25 bp, Homo sapien
accctcacagccagataatgtggag

SEQ ID NO: 340122 - DNA, 25 bp, Homo sapien
ccagataatgtggaggtcagaaccc

SEQ ID NO: 340123 - DNA, 25 bp, Homo sapien
tcagaacccaaggaagggagtgaga

SEQ ID NO: 340124 - DNA, 25 bp, Homo sapien
aagggagtgagacctccactcccag

SEQ ID NO: 340125 - DNA, 25 bp, Homo sapien
ggacctgagaaagcgtacttcacct

SEQ ID NO: 340126 - DNA, 25 bp, Homo sapien
ctgagaaagcgtacttcaccttggg

SEQ ID NO: 340127 - DNA, 25 bp, Homo sapien
ggcagagccacctgcagcaatggta

SEQ ID NO: 340128 - DNA, 25 bp, Homo sapien
gagccacctgcagcaatggtatctg

SEQ ID NO: 340129 - DNA, 25 bp, Homo sapien
acctgcagcaatggtatctgcatat

SEQ ID NO: 340130 - DNA, 25 bp, Homo sapien
ttctttctcccgctgaatcatttcc

SEQ ID NO: 340131 - DNA, 25 bp, Homo sapien
atataggtttgcatggatggtgtcc

SEQ ID NO: 340132 - DNA, 25 bp, Homo sapien
ggatggtgtccacaatacaaatgta

SEQ ID NO: 340133 - DNA, 25 bp, Homo sapien
aaacttggacaggaataggataaat

SEQ ID NO: 340134 - DNA, 25 bp, Homo sapien
taaattgctttcatcataaaggcca

SEQ ID NO: 340135 - DNA, 25 bp, Homo sapien
tcataaaggccaatcatccatttct

SEQ ID NO: 340136 - DNA, 25 bp, Homo sapien
catccatttcttagtccaaggagat

SEQ ID NO: 340137 - DNA, 25 bp, Homo sapien
ataaataggacacccctgagatttc

SEQ ID NO: 340138 - DNA, 25 bp, Homo sapien
aggacacccctgagatttccagtaa

SEQ ID NO: 340139 - DNA, 25 bp, Homo sapien
acccctgagatttccagtaaggtat

SEQ ID NO: 340140 - DNA, 25 bp, Homo sapien
ggtatttgaaaggattccactggga

SEQ ID NO: 340141 - DNA, 25 bp, Homo sapien
gagcatccagtttgtacccagtttt

SEQ ID NO: 340142 - DNA, 25 bp, Homo sapien
agctatatccagaggtgccacccga

SEQ ID NO: 340143 - DNA, 25 bp, Homo sapien
agttccgcccctttctggcaaagat

SEQ ID NO: 340144 - DNA, 25 bp, Homo sapien
gattcttaagtctattgcgtctgca

SEQ ID NO: 340145 - DNA, 25 bp, Homo sapien
tgcgtctgcagacatggatttcaac

SEQ ID NO: 340146 - DNA, 25 bp, Homo sapien
tttcaaccagctggaggcattcttg

SEQ ID NO: 340147 - DNA, 25 bp, Homo sapien
gaggcattcttgactgctcaaacca

SEQ ID NO: 340148 - DNA, 25 bp, Homo sapien
ggatcacatctgaccaagctgctgt

SEQ ID NO: 340149 - DNA, 25 bp, Homo sapien
gacaaaaatccgtgagagcctcatg

SEQ ID NO: 340150 - DNA, 25 bp, Homo sapien
tcatgaaccagagccgctggaatag

SEQ ID NO: 340151 - DNA, 25 bp, Homo sapien
gatggcaagtctcagtcaaggcact

SEQ ID NO: 340152 - DNA, 25 bp, Homo sapien
tctcagtcaaggcactcagctcaaa

SEQ ID NO: 340153 - DNA, 25 bp, Homo sapien
cagccgctgaggacggtgctgggtt

SEQ ID NO: 340154 - DNA, 25 bp, Homo sapien
ggttgggtttcgaacaggcagcctt

SEQ ID NO: 340155 - DNA, 25 bp, Homo sapien
aggcagcctttgatgttgggcgcat

SEQ ID NO: 340156 - DNA, 25 bp, Homo sapien
atgttgggcgcatcacagaggtgct

SEQ ID NO: 340157 - DNA, 25 bp, Homo sapien
gcatcacagaggtgctggcctcctt

SEQ ID NO: 340158 - DNA, 25 bp, Homo sapien
gcgcaccccgacttccagagagtgg

SEQ ID NO: 340159 - DNA, 25 bp, Homo sapien
gagagtggacaccagcgcgttctca

SEQ ID NO: 340160 - DNA, 25 bp, Homo sapien
acagcccaaagagctgctgcagcag

SEQ ID NO: 340161 - DNA, 25 bp, Homo sapien
ggccccatagcacctgtcgtgagga

SEQ ID NO: 340162 - DNA, 25 bp, Homo sapien
atagcacctgtcgtgaggatagaag

SEQ ID NO: 340163 - DNA, 25 bp, Homo sapien
agaaataaagaccgccctccctgtg

SEQ ID NO: 340164 - DNA, 25 bp, Homo sapien
ggaaagacggcttgatagctatgaa

SEQ ID NO: 340165 - DNA, 25 bp, Homo sapien
cggcttgatagctatgaatgcatga

SEQ ID NO: 340166 - DNA, 25 bp, Homo sapien
tgcatgaggagcgaaatgttgactc

SEQ ID NO: 340167 - DNA, 25 bp, Homo sapien
cagttatctagatcatggtctccaa

SEQ ID NO: 340168 - DNA, 25 bp, Homo sapien
gatcatggtctccaaacctgatgct

SEQ ID NO: 340169 - DNA, 25 bp, Homo sapien
tccaaacctgatgctatttccttac

SEQ ID NO: 340170 - DNA, 25 bp, Homo sapien
acctgatgctatttccttacaaaaa

SEQ ID NO: 340171 - DNA, 25 bp, Homo sapien
atttgttgagcatgtgtccataatt

SEQ ID NO: 340172 - DNA, 25 bp, Homo sapien
gttgagcatgtgtccataattatat

SEQ ID NO: 340173 - DNA, 25 bp, Homo sapien
tatgtgtcaacaaatgtactgctac

SEQ ID NO: 340174 - DNA, 25 bp, Homo sapien
gtactgctacactaatgtgaacatt

SEQ ID NO: 340175 - DNA, 25 bp, Homo sapien
gatgtagatttcttgatgctaattc

SEQ ID NO: 340176 - DNA, 25 bp, Homo sapien
gatgctaattcagtcttccatggct

SEQ ID NO: 340177 - DNA, 25 bp, Homo sapien
attcagtcttccatggcttgtgtta

SEQ ID NO: 340178 - DNA, 25 bp, Homo sapien
ccatggcttgtgttattccttttta

SEQ ID NO: 340179 - DNA, 25 bp, Homo sapien
tattcctttttaatagtcacttgaa

SEQ ID NO: 340180 - DNA, 25 bp, Homo sapien
gtcacttgaaactatggaggaatca

SEQ ID NO: 340181 - DNA, 25 bp, Homo sapien
aggaatcagcctctcatttgggtat

SEQ ID NO: 340182 - DNA, 25 bp, Homo sapien
agcctctcatttgggtatgctgatg

SEQ ID NO: 340183 - DNA, 25 bp, Homo sapien
gatggtgaagtcataacctcctttc

SEQ ID NO: 340184 - DNA, 25 bp, Homo sapien
gaagtcataacctcctttccctatt

SEQ ID NO: 340185 - DNA, 25 bp, Homo sapien
aatggagacctcagtcgagaccagc

SEQ ID NO: 340186 - DNA, 25 bp, Homo sapien
aattcagtgctgtggtcagagacct

SEQ ID NO: 340187 - DNA, 25 bp, Homo sapien
gagacctggagatccacaagaagct

SEQ ID NO: 340188 - DNA, 25 bp, Homo sapien
caagaagctggtcctcatcgtatga

SEQ ID NO: 340189 - DNA, 25 bp, Homo sapien
catcgtatgagcctttttcttacaa

SEQ ID NO: 340190 - DNA, 25 bp, Homo sapien
ttttcttacaagcaccacccaacaa

SEQ ID NO: 340191 - DNA, 25 bp, Homo sapien
ttccctatctctttcaagatttgct

SEQ ID NO: 340192 - DNA, 25 bp, Homo sapien
agatttgctcaagacgtccaactgt

SEQ ID NO: 340193 - DNA, 25 bp, Homo sapien
caactgtctctctgacttatctgga

SEQ ID NO: 340194 - DNA, 25 bp, Homo sapien
tgtgaagccatatgtcctaacagga

SEQ ID NO: 340195 - DNA, 25 bp, Homo sapien
gtcctaacaggagcttcatcaccaa

SEQ ID NO: 340196 - DNA, 25 bp, Homo sapien
agcagctggtcgacaaaaccatcat

SEQ ID NO: 340197 - DNA, 25 bp, Homo sapien
agcatctttcatatggtaggaacca

SEQ ID NO: 340198 - DNA, 25 bp, Homo sapien
ttacactttatggtaagtagcaggg

SEQ ID NO: 340199 - DNA, 25 bp, Homo sapien
gcatttatagatcatttctaggcaa

SEQ ID NO: 340200 - DNA, 25 bp, Homo sapien
ggcaaaattgtgaagctaatgacca

SEQ ID NO: 340201 - DNA, 25 bp, Homo sapien
aatgaccaacctgtttctacctata

SEQ ID NO: 340202 - DNA, 25 bp, Homo sapien
gtttctacctatatgcagtctcttt

SEQ ID NO: 340203 - DNA, 25 bp, Homo sapien
atgcagtctctttattttactagaa

SEQ ID NO: 340204 - DNA, 25 bp, Homo sapien
gaaatgggaatcatggcctcttgaa

SEQ ID NO: 340205 - DNA, 25 bp, Homo sapien
gggaatcatggcctcttgaagagaa

SEQ ID NO: 340206 - DNA, 25 bp, Homo sapien
aaagtcaccattctgcatttagctg

SEQ ID NO: 340207 - DNA, 25 bp, Homo sapien
attctgcatttagctgtattcatat

SEQ ID NO: 340208 - DNA, 25 bp, Homo sapien
atgaatgcttcatggggctccagga

SEQ ID NO: 340209 - DNA, 25 bp, Homo sapien
gggctccaggaagcctgtatcacct

SEQ ID NO: 340210 - DNA, 25 bp, Homo sapien
aggaagcctgtatcacctgtgtaag

SEQ ID NO: 340211 - DNA, 25 bp, Homo sapien
gaagcctgtatcacctgtgtaagtt

SEQ ID NO: 340212 - DNA, 25 bp, Homo sapien
gcctgtatcacctgtgtaagttggt

SEQ ID NO: 340213 - DNA, 25 bp, Homo sapien
cacctgtgtaagttggtatttgggc

SEQ ID NO: 340214 - DNA, 25 bp, Homo sapien
gttggtatttgggcactttatattt

SEQ ID NO: 340215 - DNA, 25 bp, Homo sapien
aaacgtgttttggatcctgtactct

SEQ ID NO: 340216 - DNA, 25 bp, Homo sapien
cgtgttttggatcctgtactctaat

SEQ ID NO: 340217 - DNA, 25 bp, Homo sapien
ctgttataaacgttgaactttcaca

SEQ ID NO: 340218 - DNA, 25 bp, Homo sapien
ataaacgttgaactttcacaatgtt

SEQ ID NO: 340219 - DNA, 25 bp, Homo sapien
tagaatggttcctgcccaattctcc

SEQ ID NO: 340220 - DNA, 25 bp, Homo sapien
caattctccctttctggatatgtga

SEQ ID NO: 340221 - DNA, 25 bp, Homo sapien
tctccctttctggatatgtgaatta

SEQ ID NO: 340222 - DNA, 25 bp, Homo sapien
gggatggatgcttagccctctagga

SEQ ID NO: 340223 - DNA, 25 bp, Homo sapien
gatggatgcttagccctctaggagt

SEQ ID NO: 340224 - DNA, 25 bp, Homo sapien
tttggcacaagagatgcatcctgtc

SEQ ID NO: 340225 - DNA, 25 bp, Homo sapien
ggcacaagagatgcatcctgtcatt

SEQ ID NO: 340226 - DNA, 25 bp, Homo sapien
agagatgcatcctgtcattcactgg

SEQ ID NO: 340227 - DNA, 25 bp, Homo sapien
gatgcatcctgtcattcactggaaa

SEQ ID NO: 340228 - DNA, 25 bp, Homo sapien
gcatcctgtcattcactggaaaacc

SEQ ID NO: 340229 - DNA, 25 bp, Homo sapien
ctgtcattcactggaaaaccttaaa

SEQ ID NO: 340230 - DNA, 25 bp, Homo sapien
tcaacgccattctgagatcacctca

SEQ ID NO: 340231 - DNA, 25 bp, Homo sapien
agatcacctcactgcctctcatttg

SEQ ID NO: 340232 - DNA, 25 bp, Homo sapien
ccccttgaaaacctgactgaggaga

SEQ ID NO: 340233 - DNA, 25 bp, Homo sapien
acctgactgaggagacattctggaa

SEQ ID NO: 340234 - DNA, 25 bp, Homo sapien
attctggaaggttccggtcccactg

SEQ ID NO: 340235 - DNA, 25 bp, Homo sapien
gaaggttccggtcccactgtgtgtc

SEQ ID NO: 340236 - DNA, 25 bp, Homo sapien
ggcgctcttgcccatagagagccag

SEQ ID NO: 340237 - DNA, 25 bp, Homo sapien
agagagccagacaccaatcctcaat

SEQ ID NO: 340238 - DNA, 25 bp, Homo sapien
aatcctcaatggcaccttggtggct

SEQ ID NO: 340239 - DNA, 25 bp, Homo sapien
aatggcaccttggtggcttccctct

SEQ ID NO: 340240 - DNA, 25 bp, Homo sapien
atgacagcccctaggccaggaacca

SEQ ID NO: 340241 - DNA, 25 bp, Homo sapien
gaggaagacattctttctgcaagga

SEQ ID NO: 340242 - DNA, 25 bp, Homo sapien
taaattctgaactgctactacacac

SEQ ID NO: 340243 - DNA, 25 bp, Homo sapien
tgaactgctactacacacaagtgaa

SEQ ID NO: 340244 - DNA, 25 bp, Homo sapien
cacaagtgaaagtcaaccctatgta

SEQ ID NO: 340245 - DNA, 25 bp, Homo sapien
ctatgtaaactggtgtcctctctct

SEQ ID NO: 340246 - DNA, 25 bp, Homo sapien
gtagagagcctgaaaaactgcccca

SEQ ID NO: 340247 - DNA, 25 bp, Homo sapien
aactgccccaatgccacggtaaagg

SEQ ID NO: 340248 - DNA, 25 bp, Homo sapien
gaagtcttggctggcgttgctgact

SEQ ID NO: 340249 - DNA, 25 bp, Homo sapien
ggcgttgctgactcacagtcgccat

SEQ ID NO: 340250 - DNA, 25 bp, Homo sapien
agtcgccatccatctggacacaaag

SEQ ID NO: 340251 - DNA, 25 bp, Homo sapien
catctggacacaaagagagacctgt

SEQ ID NO: 340252 - DNA, 25 bp, Homo sapien
aggactatccatctataaacatctg

SEQ ID NO: 340253 - DNA, 25 bp, Homo sapien
catctataaacatctggtacctgca

SEQ ID NO: 340254 - DNA, 25 bp, Homo sapien
acttgttatttattcgtctgctagg

SEQ ID NO: 340255 - DNA, 25 bp, Homo sapien
gtctgctaggctctttttgtttcaa

SEQ ID NO: 340256 - DNA, 25 bp, Homo sapien
gtttcaaatttgttctcagaccact

SEQ ID NO: 340257 - DNA, 25 bp, Homo sapien
ggctctggttgccaacaaacagcat

SEQ ID NO: 340258 - DNA, 25 bp, Homo sapien
atttgtaaatggtctattagccttc

SEQ ID NO: 340259 - DNA, 25 bp, Homo sapien
ggtctattagccttcatttatactg

SEQ ID NO: 340260 - DNA, 25 bp, Homo sapien
agccttcatttatactgcctaacaa

SEQ ID NO: 340261 - DNA, 25 bp, Homo sapien
tgggagctttcctgtttaatatgtg

SEQ ID NO: 340262 - DNA, 25 bp, Homo sapien
gctttcctgtttaatatgtggcaaa

SEQ ID NO: 340263 - DNA, 25 bp, Homo sapien
tgtatgaaataacaagcctagagga

SEQ ID NO: 340264 - DNA, 25 bp, Homo sapien
gttaatagtacactttgagtatctt

SEQ ID NO: 340265 - DNA, 25 bp, Homo sapien
ctttgagtatctttttccacattaa

SEQ ID NO: 340266 - DNA, 25 bp, Homo sapien
ttgagtatctttttccacattaaaa

SEQ ID NO: 340267 - DNA, 25 bp, Homo sapien
aagagtgaaacatactttataccag

SEQ ID NO: 340268 - DNA, 25 bp, Homo sapien
ttataccagaggagcagtggagcct

SEQ ID NO: 340269 - DNA, 25 bp, Homo sapien
cagtggagcctcatgcagcacatta

SEQ ID NO: 340270 - DNA, 25 bp, Homo sapien
ggagcctcatgcagcacattatcat

SEQ ID NO: 340271 - DNA, 25 bp, Homo sapien
catgcagcacattatcatttgttat

SEQ ID NO: 340272 - DNA, 25 bp, Homo sapien
tgacatcttttcactcatacacaaa

SEQ ID NO: 340273 - DNA, 25 bp, Homo sapien
ttactgttgatttcatcctcctgtg

SEQ ID NO: 340274 - DNA, 25 bp, Homo sapien
tagggagatcaaaaccaaattcaca

SEQ ID NO: 340275 - DNA, 25 bp, Homo sapien
ggagatcaaaaccaaattcacacag

SEQ ID NO: 340276 - DNA, 25 bp, Homo sapien
gaaaagttgatttatgacagatgat

SEQ ID NO: 340277 - DNA, 25 bp, Homo sapien
atgacagatgatgttgcagtccctg

SEQ ID NO: 340278 - DNA, 25 bp, Homo sapien
gacagatgatgttgcagtccctggg

SEQ ID NO: 340279 - DNA, 25 bp, Homo sapien
agaatggaaatggtgctagaataat

SEQ ID NO: 340280 - DNA, 25 bp, Homo sapien
aatggtgctagaataattggtttct

SEQ ID NO: 340281 - DNA, 25 bp, Homo sapien
tgccattacattaaagtcaatgcct

SEQ ID NO: 340282 - DNA, 25 bp, Homo sapien
aagtcaatgcctatggagtttggga

SEQ ID NO: 340283 - DNA, 25 bp, Homo sapien
tcaatgcctatggagtttgggagga

SEQ ID NO: 340284 - DNA, 25 bp, Homo sapien
tgggaggagtgatcaaaatgttctg

SEQ ID NO: 340285 - DNA, 25 bp, Homo sapien
gtgaaatacgaagtccttggtctga

SEQ ID NO: 340286 - DNA, 25 bp, Homo sapien
gtccttggtctgatataaagcccct

SEQ ID NO: 340287 - DNA, 25 bp, Homo sapien
aaagcccctattggattcttcggat

SEQ ID NO: 340288 - DNA, 25 bp, Homo sapien
cctattggattcttcggatgcgtaa

SEQ ID NO: 340289 - DNA, 25 bp, Homo sapien
ggatgcgtaaaagaaattgcctgtt

SEQ ID NO: 340290 - DNA, 25 bp, Homo sapien
ggtgaaaacacatacatcagactat

SEQ ID NO: 340291 - DNA, 25 bp, Homo sapien
actatgttgtgagccaggttgattt

SEQ ID NO: 340292 - DNA, 25 bp, Homo sapien
aaaattccaatttgttttcattcag

SEQ ID NO: 340293 - DNA, 25 bp, Homo sapien
tatagcaaaccccatccaggtgcta

SEQ ID NO: 340294 - DNA, 25 bp, Homo sapien
atccaggtgctatcagatgaccagt

SEQ ID NO: 340295 - DNA, 25 bp, Homo sapien
gatgaccagttactgcttagttaac

SEQ ID NO: 340296 - DNA, 25 bp, Homo sapien
aggttactgcattccggatctctgt

SEQ ID NO: 340297 - DNA, 25 bp, Homo sapien
tttccagcctcatttatagtaaaca

SEQ ID NO: 340298 - DNA, 25 bp, Homo sapien
aattgttctaatccatttactgcag

SEQ ID NO: 340299 - DNA, 25 bp, Homo sapien
atccatttactgcagatttcaccct

SEQ ID NO: 340300 - DNA, 25 bp, Homo sapien
ttactgcagatttcacccttataag

SEQ ID NO: 340301 - DNA, 25 bp, Homo sapien
agatttcacccttataagtttagag

SEQ ID NO: 340302 - DNA, 25 bp, Homo sapien
ggagatacagattggcatagaagaa

SEQ ID NO: 340303 - DNA, 25 bp, Homo sapien
aagcagggcctaggagacacgtgaa

SEQ ID NO: 340304 - DNA, 25 bp, Homo sapien
atccagagtcagatgaggctgcagt

SEQ ID NO: 340305 - DNA, 25 bp, Homo sapien
tgcagtccagggttgaaattatcac

SEQ ID NO: 340306 - DNA, 25 bp, Homo sapien
ttctgggcaaggttactgcattccg

SEQ ID NO: 340307 - DNA, 25 bp, Homo sapien
ggatgcatttcccaaaacgtgtgaa

SEQ ID NO: 340308 - DNA, 25 bp, Homo sapien
gaaagcactaacagcttatattgct

SEQ ID NO: 340309 - DNA, 25 bp, Homo sapien
agaatctcctgggtgtaatttagcc

SEQ ID NO: 340310 - DNA, 25 bp, Homo sapien
taatttagccacttagggaactgcg

SEQ ID NO: 340311 - DNA, 25 bp, Homo sapien
agggaactgcgtgaacactcccagg

SEQ ID NO: 340312 - DNA, 25 bp, Homo sapien
tgaacactcccaggccattatgatg

SEQ ID NO: 340313 - DNA, 25 bp, Homo sapien
ggccattatgatgctgttacagctt

SEQ ID NO: 340314 - DNA, 25 bp, Homo sapien
taaatgcatgagtattctttctgtt

SEQ ID NO: 340315 - DNA, 25 bp, Homo sapien
tgttttgtgctctcttgtacattta

SEQ ID NO: 340316 - DNA, 25 bp, Homo sapien
gctctcttgtacatttatttaccct

SEQ ID NO: 340317 - DNA, 25 bp, Homo sapien
tttaccctttacagaatatttcttg

SEQ ID NO: 340318 - DNA, 25 bp, Homo sapien
taacttagtgctagctagcgccaca

SEQ ID NO: 340319 - DNA, 25 bp, Homo sapien
tagcgccacagactctagtagataa

SEQ ID NO: 340320 - DNA, 25 bp, Homo sapien
tatcatcataatggctggtgaaacc

SEQ ID NO: 340321 - DNA, 25 bp, Homo sapien
atggctggtgaaaccatataatcac

SEQ ID NO: 340322 - DNA, 25 bp, Homo sapien
attgccttcagcatgttcagttcgc

SEQ ID NO: 340323 - DNA, 25 bp, Homo sapien
ttcagcatgttcagttcgcagcact

SEQ ID NO: 340324 - DNA, 25 bp, Homo sapien
ttcgcagcactgagggcactcttga

SEQ ID NO: 340325 - DNA, 25 bp, Homo sapien
agggcactcttgagggtgttgttaa

SEQ ID NO: 340326 - DNA, 25 bp, Homo sapien
ataggttatgctccaaaagtgttat

SEQ ID NO: 340327 - DNA, 25 bp, Homo sapien
atttaggttctagatcggtccacga

SEQ ID NO: 340328 - DNA, 25 bp, Homo sapien
ggttctagatcggtccacgaaagtt

SEQ ID NO: 340329 - DNA, 25 bp, Homo sapien
atggtcctgtcgactaatacagctt

SEQ ID NO: 340330 - DNA, 25 bp, Homo sapien
aatacagcttgactgtagggtccaa

SEQ ID NO: 340331 - DNA, 25 bp, Homo sapien
tgactgtagggtccaatggcccctg

SEQ ID NO: 340332 - DNA, 25 bp, Homo sapien
gggctttcgcggtgctgatcaccct

SEQ ID NO: 340333 - DNA, 25 bp, Homo sapien
atcacccttctgatcaaggacgaca

SEQ ID NO: 340334 - DNA, 25 bp, Homo sapien
tgtttagcttcttctgctacccctc

SEQ ID NO: 340335 - DNA, 25 bp, Homo sapien
tgacacaagctgtccacttgaaggg

SEQ ID NO: 340336 - DNA, 25 bp, Homo sapien
aagctgtccacttgaagggtccatg

SEQ ID NO: 340337 - DNA, 25 bp, Homo sapien
acttgaagggtccatgcctatctgt

SEQ ID NO: 340338 - DNA, 25 bp, Homo sapien
gtccatgcctatctgtcctgaaatg

SEQ ID NO: 340339 - DNA, 25 bp, Homo sapien
gtcctgaaatgtaaatggtcctgtc

SEQ ID NO: 340340 - DNA, 25 bp, Homo sapien
gtgggaacagagttgtcacctacct

SEQ ID NO: 340341 - DNA, 25 bp, Homo sapien
ggaacagagttgtcacctacctaac

SEQ ID NO: 340342 - DNA, 25 bp, Homo sapien
aacagagttgtcacctacctaacag

SEQ ID NO: 340343 - DNA, 25 bp, Homo sapien
agagttgtcacctacctaacagggc

SEQ ID NO: 340344 - DNA, 25 bp, Homo sapien
agttgtcacctacctaacagggctc

SEQ ID NO: 340345 - DNA, 25 bp, Homo sapien
tgtcacctacctaacagggctctga

SEQ ID NO: 340346 - DNA, 25 bp, Homo sapien
tcacctacctaacagggctctgaga

SEQ ID NO: 340347 - DNA, 25 bp, Homo sapien
acctacctaacagggctctgagaga

SEQ ID NO: 340348 - DNA, 25 bp, Homo sapien
acctaacagggctctgagagagccg

SEQ ID NO: 340349 - DNA, 25 bp, Homo sapien
gccttgccaggcttcagtctccagt

SEQ ID NO: 340350 - DNA, 25 bp, Homo sapien
cagtctccagtgccaaaggaggaaa

SEQ ID NO: 340351 - DNA, 25 bp, Homo sapien
ggagttcagcaacctaatgatctct

SEQ ID NO: 340352 - DNA, 25 bp, Homo sapien
gatctctatctctgaacatctcttc

SEQ ID NO: 340353 - DNA, 25 bp, Homo sapien
tctgaacatctcttcatcccatgct

SEQ ID NO: 340354 - DNA, 25 bp, Homo sapien
aagtccagcaacctgcaccctggaa

SEQ ID NO: 340355 - DNA, 25 bp, Homo sapien
tggaaccaggagtggaccctacccg

SEQ ID NO: 340356 - DNA, 25 bp, Homo sapien
tggaccctacccgagctgtctgtat

SEQ ID NO: 340357 - DNA, 25 bp, Homo sapien
accaccaatcttaaaaagccctctg

SEQ ID NO: 340358 - DNA, 25 bp, Homo sapien
taaaccccagttaggtacccatgct

SEQ ID NO: 340359 - DNA, 25 bp, Homo sapien
cccatgctgggcaggtcagttaaca

SEQ ID NO: 340360 - DNA, 25 bp, Homo sapien
caatttatgcacaggtactagtttt

SEQ ID NO: 340361 - DNA, 25 bp, Homo sapien
gtattaccgttccagggtagctttg

SEQ ID NO: 340362 - DNA, 25 bp, Homo sapien
gaatgaatttatccataaagagcaa

SEQ ID NO: 340363 - DNA, 25 bp, Homo sapien
agtttatcactactagaagcaagag

SEQ ID NO: 340364 - DNA, 25 bp, Homo sapien
tatcactactagaagcaagagaagc

SEQ ID NO: 340365 - DNA, 25 bp, Homo sapien
aagcagacggtgatgtggttaatga

SEQ ID NO: 340366 - DNA, 25 bp, Homo sapien
aagagaactccaaatgaaaccacat

SEQ ID NO: 340367 - DNA, 25 bp, Homo sapien
gagtgacagaggatctgagtcatct

SEQ ID NO: 340368 - DNA, 25 bp, Homo sapien
gaggatctgagtcatctgacactga

SEQ ID NO: 340369 - DNA, 25 bp, Homo sapien
gagtcatctgacactgatgatgaag

SEQ ID NO: 340370 - DNA, 25 bp, Homo sapien
aagaattacggcatcgaatccggca

SEQ ID NO: 340371 - DNA, 25 bp, Homo sapien
gaatccggcaaaaacaggaagcttt

SEQ ID NO: 340372 - DNA, 25 bp, Homo sapien
aacagcagctattacatgataaaca

SEQ ID NO: 340373 - DNA, 25 bp, Homo sapien
tgctattagtttccactgttggtga

SEQ ID NO: 340374 - DNA, 25 bp, Homo sapien
ttcctcctattgaaatgatactttc

SEQ ID NO: 340375 - DNA, 25 bp, Homo sapien
tttcatacttataaagctgtcgtca

SEQ ID NO: 340376 - DNA, 25 bp, Homo sapien
aaagctgtcgtcaatatttatttca

SEQ ID NO: 340377 - DNA, 25 bp, Homo sapien
taaattgaaatgcttatcttgtgtt

SEQ ID NO: 340378 - DNA, 25 bp, Homo sapien
tgttcaagcacagcactgattttaa

SEQ ID NO: 340379 - DNA, 25 bp, Homo sapien
gcactgattttaacaacctgcattt

SEQ ID NO: 340380 - DNA, 25 bp, Homo sapien
cctgcatttaatgtgaagtaaccga

SEQ ID NO: 340381 - DNA, 25 bp, Homo sapien
gaagtaggatactgtaactgtgtaa

SEQ ID NO: 340382 - DNA, 25 bp, Homo sapien
gtaatcttgtaacattgaaccattg

SEQ ID NO: 340383 - DNA, 25 bp, Homo sapien
gaaccattgaaatgttcagttcttt

SEQ ID NO: 340384 - DNA, 25 bp, Homo sapien
gaaggaggaggaagcccatagaccc

SEQ ID NO: 340385 - DNA, 25 bp, Homo sapien
gaggaggaagcccatagacccccaa

SEQ ID NO: 340386 - DNA, 25 bp, Homo sapien
aggaggaagcccatagacccccaag

SEQ ID NO: 340387 - DNA, 25 bp, Homo sapien
ggaggaagcccatagacccccaagc

SEQ ID NO: 340388 - DNA, 25 bp, Homo sapien
aagccccactgaggcccctactgag

SEQ ID NO: 340389 - DNA, 25 bp, Homo sapien
gccgcggaccctggcagcgatgggt

SEQ ID NO: 340390 - DNA, 25 bp, Homo sapien
agcgatgggtctccaggcaagtccc

SEQ ID NO: 340391 - DNA, 25 bp, Homo sapien
gcgatgggtctccaggcaagtcccc

SEQ ID NO: 340392 - DNA, 25 bp, Homo sapien
cgatgggtctccaggcaagtccccg

SEQ ID NO: 340393 - DNA, 25 bp, Homo sapien
gatgggtctccaggcaagtccccgt

SEQ ID NO: 340394 - DNA, 25 bp, Homo sapien
tctccaggcaagtccccgtccaaaa

SEQ ID NO: 340395 - DNA, 25 bp, Homo sapien
gggctgcttttggtccaccgcaagg

SEQ ID NO: 340396 - DNA, 25 bp, Homo sapien
tccaccgcaaggtggatttcatcct

SEQ ID NO: 340397 - DNA, 25 bp, Homo sapien
atttcatcctccttattggcaacca

SEQ ID NO: 340398 - DNA, 25 bp, Homo sapien
agcacctccccagaatcgaagagaa

SEQ ID NO: 340399 - DNA, 25 bp, Homo sapien
atcgaagagaaaggccatcatcatt

SEQ ID NO: 340400 - DNA, 25 bp, Homo sapien
ggccatcatcattcagggatcgtca

SEQ ID NO: 340401 - DNA, 25 bp, Homo sapien
atcattcagggatcgtcagcgttca

SEQ ID NO: 340402 - DNA, 25 bp, Homo sapien
ggatcgtcagcgttcacctattgca

SEQ ID NO: 340403 - DNA, 25 bp, Homo sapien
acctattgcacttcctgtgaagcag

SEQ ID NO: 340404 - DNA, 25 bp, Homo sapien
tgtgaagcaggagcctccacaaatt

SEQ ID NO: 340405 - DNA, 25 bp, Homo sapien
gcctccacaaattgacgcagtaaaa

SEQ ID NO: 340406 - DNA, 25 bp, Homo sapien
gagtgacagaggatctgagtcatct

SEQ ID NO: 340407 - DNA, 25 bp, Homo sapien
gtgacagaggatctgagtcatctga

SEQ ID NO: 340408 - DNA, 25 bp, Homo sapien
gacagaggatctgagtcatctgaca

SEQ ID NO: 340409 - DNA, 25 bp, Homo sapien
cagaggatctgagtcatctgacact

SEQ ID NO: 340410 - DNA, 25 bp, Homo sapien
agaggatctgagtcatctgacactg

SEQ ID NO: 340411 - DNA, 25 bp, Homo sapien
gaggatctgagtcatctgacactga

SEQ ID NO: 340412 - DNA, 25 bp, Homo sapien
aggatctgagtcatctgacactgat

SEQ ID NO: 340413 - DNA, 25 bp, Homo sapien
ggatctgagtcatctgacactgatg

SEQ ID NO: 340414 - DNA, 25 bp, Homo sapien
atctgagtcatctgacactgatgat

SEQ ID NO: 340415 - DNA, 25 bp, Homo sapien
actgatgatgaagaattacggcatc

SEQ ID NO: 340416 - DNA, 25 bp, Homo sapien
gatgaagaattacggcatcgaatcc

SEQ ID NO: 340417 - DNA, 25 bp, Homo sapien
tgaaaagcccgtcactccctaagag

SEQ ID NO: 340418 - DNA, 25 bp, Homo sapien
cgtcactccctaagaggaccctgat

SEQ ID NO: 340419 - DNA, 25 bp, Homo sapien
acccaacctgaactaatcgtccaag

SEQ ID NO: 340420 - DNA, 25 bp, Homo sapien
gaactaatcgtccaaggagtcctgt

SEQ ID NO: 340421 - DNA, 25 bp, Homo sapien
atcgtccaaggagtcctgtttggtc

SEQ ID NO: 340422 - DNA, 25 bp, Homo sapien
caaggagtcctgtttggtcccacga

SEQ ID NO: 340423 - DNA, 25 bp, Homo sapien
gagtcctgtttggtcccacgaaagg

SEQ ID NO: 340424 - DNA, 25 bp, Homo sapien
gtttggtcccacgaaaggcagattt

SEQ ID NO: 340425 - DNA, 25 bp, Homo sapien
aaggcagatttccatccacaccagt

SEQ ID NO: 340426 - DNA, 25 bp, Homo sapien
agatttccatccacaccagtgaggg

SEQ ID NO: 340427 - DNA, 25 bp, Homo sapien
ccaactcgaagccaggcgggcctgt

SEQ ID NO: 340428 - DNA, 25 bp, Homo sapien
gtctctaaagacagcagttttattg

SEQ ID NO: 340429 - DNA, 25 bp, Homo sapien
agacagcagttttattgcatcacta

SEQ ID NO: 340430 - DNA, 25 bp, Homo sapien
tggcatgtgggatccaggcgttctt

SEQ ID NO: 340431 - DNA, 25 bp, Homo sapien
atgtgggatccaggcgttctttagg

SEQ ID NO: 340432 - DNA, 25 bp, Homo sapien
atccaggcgttctttaggatccttg

SEQ ID NO: 340433 - DNA, 25 bp, Homo sapien
caggcgttctttaggatccttggat

SEQ ID NO: 340434 - DNA, 25 bp, Homo sapien
ggcgttctttaggatccttggatac

SEQ ID NO: 340435 - DNA, 25 bp, Homo sapien
gttctttaggatccttggataccac

SEQ ID NO: 340436 - DNA, 25 bp, Homo sapien
gtaagcatctcatatatttcagcca

SEQ ID NO: 340437 - DNA, 25 bp, Homo sapien
agcatctcatatatttcagccaaat

SEQ ID NO: 340438 - DNA, 25 bp, Homo sapien
atatttcagccaaataaatgggcca

SEQ ID NO: 340439 - DNA, 25 bp, Homo sapien
acagtgctagcctctgttttttcag

SEQ ID NO: 340440 - DNA, 25 bp, Homo sapien
gttttttcagtgttgtctgccatct

SEQ ID NO: 340441 - DNA, 25 bp, Homo sapien
tgccatctatgcctcacagactgag

SEQ ID NO: 340442 - DNA, 25 bp, Homo sapien
agatcttcctctaattgacagcctc

SEQ ID NO: 340443 - DNA, 25 bp, Homo sapien
aattgacagcctcattcgggtctta

SEQ ID NO: 340444 - DNA, 25 bp, Homo sapien
gcctcattcgggtcttacaaaatat

SEQ ID NO: 340445 - DNA, 25 bp, Homo sapien
aaaccagagaactcggcagagtcta

SEQ ID NO: 340446 - DNA, 25 bp, Homo sapien
gatttaacccaagatgatttccact

SEQ ID NO: 340447 - DNA, 25 bp, Homo sapien
ttactttttgacctggtctgccatg

SEQ ID NO: 340448 - DNA, 25 bp, Homo sapien
gtctgccatgaattctgccagtctg

SEQ ID NO: 340449 - DNA, 25 bp, Homo sapien
tgatccacccatcattcttcaagaa

SEQ ID NO: 340450 - DNA, 25 bp, Homo sapien
tgggcgcgggcagcatgaggtagcg

SEQ ID NO: 340451 - DNA, 25 bp, Homo sapien
ggcaggcagcgctggcagaaagagt

SEQ ID NO: 340452 - DNA, 25 bp, Homo sapien
cagaaagagtgcaggcagggcagca

SEQ ID NO: 340453 - DNA, 25 bp, Homo sapien
agggcagcagcttgggcgcccggct

SEQ ID NO: 340454 - DNA, 25 bp, Homo sapien
gcgcccggctctggatgttctggtg

SEQ ID NO: 340455 - DNA, 25 bp, Homo sapien
tgttctggtggcacacggcgcaagt

SEQ ID NO: 340456 - DNA, 25 bp, Homo sapien
ttctggtggcacacggcgcaagtgt

SEQ ID NO: 340457 - DNA, 25 bp, Homo sapien
tggcacacggcgcaagtgtccaaca

SEQ ID NO: 340458 - DNA, 25 bp, Homo sapien
acggcgcaagtgtccaacaggttga

SEQ ID NO: 340459 - DNA, 25 bp, Homo sapien
agtgtccaacaggttgagccgggcc

SEQ ID NO: 340460 - DNA, 25 bp, Homo sapien
tccaacaggttgagccgggccgcct

SEQ ID NO: 340461 - DNA, 25 bp, Homo sapien
ggcaagaatgccatgatgttcttta

SEQ ID NO: 340462 - DNA, 25 bp, Homo sapien
tccatgagttttaagggcttgtctc

SEQ ID NO: 340463 - DNA, 25 bp, Homo sapien
gggcttgtctcattatagaggcaca

SEQ ID NO: 340464 - DNA, 25 bp, Homo sapien
gcacattgtggctgtgtaggtgaaa

SEQ ID NO: 340465 - DNA, 25 bp, Homo sapien
ataggtgtactttttccaatgctgc

SEQ ID NO: 340466 - DNA, 25 bp, Homo sapien
tttccaatgctgctccaagttactt

SEQ ID NO: 340467 - DNA, 25 bp, Homo sapien
gctgctccaagttacttaataggat

SEQ ID NO: 340468 - DNA, 25 bp, Homo sapien
taaacatgccattctctttcagctg

SEQ ID NO: 340469 - DNA, 25 bp, Homo sapien
ttctctttcagctgtaatgttctta

SEQ ID NO: 340470 - DNA, 25 bp, Homo sapien
ttattcttgaatgtactgtgatgtc

SEQ ID NO: 340471 - DNA, 25 bp, Homo sapien
gtgatgtcaataaagctctttagtt

SEQ ID NO: 340472 - DNA, 25 bp, Homo sapien
agtctccaaaatcccaacatgcact

SEQ ID NO: 340473 - DNA, 25 bp, Homo sapien
aaaatcccaacatgcactcttctgt

SEQ ID NO: 340474 - DNA, 25 bp, Homo sapien
ccaacatgcactcttctgtatacgt

SEQ ID NO: 340475 - DNA, 25 bp, Homo sapien
acatgcactcttctgtatacgtttt

SEQ ID NO: 340476 - DNA, 25 bp, Homo sapien
agtagtcttggaagcaacatactgc

SEQ ID NO: 340477 - DNA, 25 bp, Homo sapien
gcaacatactgcagattaaatacct

SEQ ID NO: 340478 - DNA, 25 bp, Homo sapien
gcagattaaataccttagtagccta

SEQ ID NO: 340479 - DNA, 25 bp, Homo sapien
aataccttagtagcctatgttcttg

SEQ ID NO: 340480 - DNA, 25 bp, Homo sapien
accttagtagcctatgttcttgaat

SEQ ID NO: 340481 - DNA, 25 bp, Homo sapien
ctatgttcttgaatgcggacataaa

SEQ ID NO: 340482 - DNA, 25 bp, Homo sapien
gttgttgagtgtagttgtcaaagca

SEQ ID NO: 340483 - DNA, 25 bp, Homo sapien
aggagatcatgtcgctgaccagccc

SEQ ID NO: 340484 - DNA, 25 bp, Homo sapien
atctagaacgacactcgcctatggg

SEQ ID NO: 340485 - DNA, 25 bp, Homo sapien
gaaccacgagtggatcggcaacgag

SEQ ID NO: 340486 - DNA, 25 bp, Homo sapien
ggatcggcaacgagtggctccccag

SEQ ID NO: 340487 - DNA, 25 bp, Homo sapien
ttcatggagtgccttgtagacgcca

SEQ ID NO: 340488 - DNA, 25 bp, Homo sapien
agtgccttgtagacgccaggatgct

SEQ ID NO: 340489 - DNA, 25 bp, Homo sapien
gccaggatgctggaccacttgacca

SEQ ID NO: 340490 - DNA, 25 bp, Homo sapien
cacttgaccaagaaagaccttcgag

SEQ ID NO: 340491 - DNA, 25 bp, Homo sapien
agaaagaccttcgagggcagctgaa

SEQ ID NO: 340492 - DNA, 25 bp, Homo sapien
aaatggtcgacagttttcacagaaa

SEQ ID NO: 340493 - DNA, 25 bp, Homo sapien
acagaaacagtttccagtgtggaat

SEQ ID NO: 340494 - DNA, 25 bp, Homo sapien
ttagacattcccacggccttggtct

SEQ ID NO: 340495 - DNA, 25 bp, Homo sapien
ttggtctccagctcttcgatatcat

SEQ ID NO: 340496 - DNA, 25 bp, Homo sapien
agctcttcgatatcatcctgctgct

SEQ ID NO: 340497 - DNA, 25 bp, Homo sapien
ttccacggtggtttcagtgtccaga

SEQ ID NO: 340498 - DNA, 25 bp, Homo sapien
tttgctccccacaaggctaggctgg

SEQ ID NO: 340499 - DNA, 25 bp, Homo sapien
acactgggcggtctttgctggtact

SEQ ID NO: 340500 - DNA, 25 bp, Homo sapien
agtgtccagacctttgtagaccgtc

SEQ ID NO: 340501 - DNA, 25 bp, Homo sapien
gtagaccgtcttaaaggagcctctg

SEQ ID NO: 340502 - DNA, 25 bp, Homo sapien
taaaggagcctctgccgatttcgat

SEQ ID NO: 340503 - DNA, 25 bp, Homo sapien
gccgatttcgatgtcaaacttgaga

SEQ ID NO: 340504 - DNA, 25 bp, Homo sapien
gaaagcggccatcgttagacattcc

SEQ ID NO: 340505 - DNA, 25 bp, Homo sapien
tggggagaactcagccgggaccaca

SEQ ID NO: 340506 - DNA, 25 bp, Homo sapien
gaccacaggcgtggctactgcggct

SEQ ID NO: 340507 - DNA, 25 bp, Homo sapien
tggctactgcggctggagctgcgat

SEQ ID NO: 340508 - DNA, 25 bp, Homo sapien
ctggagctgcgatgagactcggaac

SEQ ID NO: 340509 - DNA, 25 bp, Homo sapien
agctgcgatgagactcggaactcct

SEQ ID NO: 340510 - DNA, 25 bp, Homo sapien
tgcgatgagactcggaactcctcgt

SEQ ID NO: 340511 - DNA, 25 bp, Homo sapien
atgagactcggaactcctcgtctta

SEQ ID NO: 340512 - DNA, 25 bp, Homo sapien
ggaactcctcgtcttactttgtgct

SEQ ID NO: 340513 - DNA, 25 bp, Homo sapien
tcgtcttactttgtgctccatgttt

SEQ ID NO: 340514 - DNA, 25 bp, Homo sapien
tcttactttgtgctccatgttttgt

SEQ ID NO: 340515 - DNA, 25 bp, Homo sapien
tactttgtgctccatgttttgtttt

SEQ ID NO: 340516 - DNA, 25 bp, Homo sapien
atgcatgtttaccaaaatggctgtt

SEQ ID NO: 340517 - DNA, 25 bp, Homo sapien
caaaatggctgtttacagtgcattt

SEQ ID NO: 340518 - DNA, 25 bp, Homo sapien
acagtgcatttagttctgatattta

SEQ ID NO: 340519 - DNA, 25 bp, Homo sapien
aaagatgacatttcacagaataact

SEQ ID NO: 340520 - DNA, 25 bp, Homo sapien
atatagtttagacatcgatcacatc

SEQ ID NO: 340521 - DNA, 25 bp, Homo sapien
ttagacatcgatcacatctggagac

SEQ ID NO: 340522 - DNA, 25 bp, Homo sapien
caatattttttatgtaggcgagcta

SEQ ID NO: 340523 - DNA, 25 bp, Homo sapien
gtaggcgagctaacacagtgtacct

SEQ ID NO: 340524 - DNA, 25 bp, Homo sapien
acacagtgtacctaattgcagaatt

SEQ ID NO: 340525 - DNA, 25 bp, Homo sapien
gtacctaattgcagaattatctgat

SEQ ID NO: 340526 - DNA, 25 bp, Homo sapien
agttgtataacattttcatatctta

SEQ ID NO: 340527 - DNA, 25 bp, Homo sapien
atagtcctgtatctttcctggcctg

SEQ ID NO: 340528 - DNA, 25 bp, Homo sapien
gtgtcccaaatctgaagcttgattc

SEQ ID NO: 340529 - DNA, 25 bp, Homo sapien
accaatcttgtactgcattgaagga

SEQ ID NO: 340530 - DNA, 25 bp, Homo sapien
atctgaagcttgattctcttttcat

SEQ ID NO: 340531 - DNA, 25 bp, Homo sapien
tgaaatcgatcccaactgtgctgac

SEQ ID NO: 340532 - DNA, 25 bp, Homo sapien
atcccaactgtgctgacgaatgcag

SEQ ID NO: 340533 - DNA, 25 bp, Homo sapien
aaaggagtcatctgcataacggaat

SEQ ID NO: 340534 - DNA, 25 bp, Homo sapien
cccacactgctattgccgatgatga

SEQ ID NO: 340535 - DNA, 25 bp, Homo sapien
aaataaagcccatggctccacgata

SEQ ID NO: 340536 - DNA, 25 bp, Homo sapien
ccatggctccacgataataggctgt

SEQ ID NO: 340537 - DNA, 25 bp, Homo sapien
taggctgtggtgatagtcctgtatc

SEQ ID NO: 340538 - DNA, 25 bp, Homo sapien
actgggaatgtaatggttgctgcgt

SEQ ID NO: 340539 - DNA, 25 bp, Homo sapien
atggttgctgcgtcaggactctgga

SEQ ID NO: 340540 - DNA, 25 bp, Homo sapien
gagccgctactcgtttttgaagttc

SEQ ID NO: 340541 - DNA, 25 bp, Homo sapien
tttttgaagttcctatgcagccctc

SEQ ID NO: 340542 - DNA, 25 bp, Homo sapien
agccctctcccgacatgttcgagaa

SEQ ID NO: 340543 - DNA, 25 bp, Homo sapien
tgttcgagaatcttgccggactggg

SEQ ID NO: 340544 - DNA, 25 bp, Homo sapien
ggatttgcagcctccgtgtttgccc

SEQ ID NO: 340545 - DNA, 25 bp, Homo sapien
tcctggcctgtgttctgtcgtggga

SEQ ID NO: 340546 - DNA, 25 bp, Homo sapien
ctgtcgtgggatttctccagagcac

SEQ ID NO: 340547 - DNA, 25 bp, Homo sapien
tttctccagagcacggactgactta

SEQ ID NO: 340548 - DNA, 25 bp, Homo sapien
gactgacttaacatttccattactg

SEQ ID NO: 340549 - DNA, 25 bp, Homo sapien
aggcctctgggttcacgcagcgcta

SEQ ID NO: 340550 - DNA, 25 bp, Homo sapien
ttcacgcagcgctagggaaggcagc

SEQ ID NO: 340551 - DNA, 25 bp, Homo sapien
aacactgcagccatgcgaagacaat

SEQ ID NO: 340552 - DNA, 25 bp, Homo sapien
tgcacaagtgccagtctttgaggta

SEQ ID NO: 340553 - DNA, 25 bp, Homo sapien
tttgaggtagagacagcccctggga

SEQ ID NO: 340554 - DNA, 25 bp, Homo sapien
ggagtagcccgcctgtatgtactct

SEQ ID NO: 340555 - DNA, 25 bp, Homo sapien
gcctgtatgtactctttccagtagg

SEQ ID NO: 340556 - DNA, 25 bp, Homo sapien
ctttccagtaggtgatgtagtctct

SEQ ID NO: 340557 - DNA, 25 bp, Homo sapien
agtctctgagagtcatgtgctcttt

SEQ ID NO: 340558 - DNA, 25 bp, Homo sapien
taaactgattaaagtgcctcacggg

SEQ ID NO: 340559 - DNA, 25 bp, Homo sapien
aaaaatagctccgttgtgcacccag

SEQ ID NO: 340560 - DNA, 25 bp, Homo sapien
tctgtttcacctgtaactgtttaag

SEQ ID NO: 340561 - DNA, 25 bp, Homo sapien
gtttcacctgtaactgtttaagcca

SEQ ID NO: 340562 - DNA, 25 bp, Homo sapien
cacctgtaactgtttaagccaataa

SEQ ID NO: 340563 - DNA, 25 bp, Homo sapien
tatgtagcactttacgttttcatgc

SEQ ID NO: 340564 - DNA, 25 bp, Homo sapien
cactttacgttttcatgctgcttat

SEQ ID NO: 340565 - DNA, 25 bp, Homo sapien
ttcaagattctcaacttttttaatt

SEQ ID NO: 340566 - DNA, 25 bp, Homo sapien
tcctattttgggagaataagaactc

SEQ ID NO: 340567 - DNA, 25 bp, Homo sapien
gaataagaactctttttgtcatttt

SEQ ID NO: 340568 - DNA, 25 bp, Homo sapien
ctttttgtcatttttggctatgaat

SEQ ID NO: 340569 - DNA, 25 bp, Homo sapien
ctatgaataaactttctggtctttt

SEQ ID NO: 340570 - DNA, 25 bp, Homo sapien
gtcttttgagaccacccatttttat

SEQ ID NO: 340571 - DNA, 25 bp, Homo sapien
cacggccgccaagatcatgggtgtg

SEQ ID NO: 340572 - DNA, 25 bp, Homo sapien
cgcctgcaacatcatgctgctcggg

SEQ ID NO: 340573 - DNA, 25 bp, Homo sapien
accatcatggtcgtcagcgtcaccg

SEQ ID NO: 340574 - DNA, 25 bp, Homo sapien
tggaggaggcctgcgacatggcgct

SEQ ID NO: 340575 - DNA, 25 bp, Homo sapien
gacatggcgctggagctgaacgcct

SEQ ID NO: 340576 - DNA, 25 bp, Homo sapien
tggcgctggagctgaacgcctccaa

SEQ ID NO: 340577 - DNA, 25 bp, Homo sapien
gctggagctgaacgcctccaagcac

SEQ ID NO: 340578 - DNA, 25 bp, Homo sapien
tccaagcaccgcatctacgagtatg

SEQ ID NO: 340579 - DNA, 25 bp, Homo sapien
aagcaccgcatctacgagtatgtgg

SEQ ID NO: 340580 - DNA, 25 bp, Homo sapien
caccgcatctacgagtatgtggagt

SEQ ID NO: 340581 - DNA, 25 bp, Homo sapien
atcgcacccaacctgtccatcatta

SEQ ID NO: 340582 - DNA, 25 bp, Homo sapien
gaaaacacctgtaccatggtttcag

SEQ ID NO: 340583 - DNA, 25 bp, Homo sapien
ttccctcagccgaaaacagacagct

SEQ ID NO: 340584 - DNA, 25 bp, Homo sapien
agacagctttgctggtcatctgttc

SEQ ID NO: 340585 - DNA, 25 bp, Homo sapien
tcatctgttctccactgcgaggacg

SEQ ID NO: 340586 - DNA, 25 bp, Homo sapien
tgcgaggacgctgccactcagtgtg

SEQ ID NO: 340587 - DNA, 25 bp, Homo sapien
ctatggtgcaagaaggtcggactcg

SEQ ID NO: 340588 - DNA, 25 bp, Homo sapien
gtcggactcggcagttaatactctt

SEQ ID NO: 340589 - DNA, 25 bp, Homo sapien
aattgcaacagccagttcaaccttc

SEQ ID NO: 340590 - DNA, 25 bp, Homo sapien
agcaaccaccatactgatcagtagt

SEQ ID NO: 340591 - DNA, 25 bp, Homo sapien
gatcagtagtcatcaacattgagac

SEQ ID NO: 340592 - DNA, 25 bp, Homo sapien
cattgagacgagactgtacaccagc

SEQ ID NO: 340593 - DNA, 25 bp, Homo sapien
gaatgaatttatccataaagagcaa

SEQ ID NO: 340594 - DNA, 25 bp, Homo sapien
agtttatcactactagaagcaagag

SEQ ID NO: 340595 - DNA, 25 bp, Homo sapien
tatcactactagaagcaagagaagc

SEQ ID NO: 340596 - DNA, 25 bp, Homo sapien
aagcagacggtgatgtggttaatga

SEQ ID NO: 340597 - DNA, 25 bp, Homo sapien
aagagaactccaaatgaaaccacat

SEQ ID NO: 340598 - DNA, 25 bp, Homo sapien
catcgaatccggcaaaaacaggaag

SEQ ID NO: 340599 - DNA, 25 bp, Homo sapien
gaatccggcaaaaacaggaagcttt

SEQ ID NO: 340600 - DNA, 25 bp, Homo sapien
tccggcaaaaacaggaagctttttg

SEQ ID NO: 340601 - DNA, 25 bp, Homo sapien
aacagcagctattacatgataaaca

SEQ ID NO: 340602 - DNA, 25 bp, Homo sapien
agcagctattacatgataaacagat

SEQ ID NO: 340603 - DNA, 25 bp, Homo sapien
cagcaaacagaaagggttacaaaag

SEQ ID NO: 340604 - DNA, 25 bp, Homo sapien
tcccgtggtggcaactgaggcttct

SEQ ID NO: 340605 - DNA, 25 bp, Homo sapien
cccgtggtggcaactgaggcttctc

SEQ ID NO: 340606 - DNA, 25 bp, Homo sapien
gtggtggcaactgaggcttctcggg

SEQ ID NO: 340607 - DNA, 25 bp, Homo sapien
caactgaggcttctcgggggcatca

SEQ ID NO: 340608 - DNA, 25 bp, Homo sapien
gggcatcagcctcagattacctgag

SEQ ID NO: 340609 - DNA, 25 bp, Homo sapien
gcatcagcctcagattacctgagaa

SEQ ID NO: 340610 - DNA, 25 bp, Homo sapien
atcagcctcagattacctgagaact

SEQ ID NO: 340611 - DNA, 25 bp, Homo sapien
gcctcagattacctgagaactgggc

SEQ ID NO: 340612 - DNA, 25 bp, Homo sapien
gcctcgtcctgagaatgacggagaa

SEQ ID NO: 340613 - DNA, 25 bp, Homo sapien
gggctagggaatccctgattcaatc

SEQ ID NO: 340614 - DNA, 25 bp, Homo sapien
agcccctgaaaatcctcacccaggg

SEQ ID NO: 340615 - DNA, 25 bp, Homo sapien
acgtctggccccactttctaatgtg

SEQ ID NO: 340616 - DNA, 25 bp, Homo sapien
tttctaatgtgctgacctggccgta

SEQ ID NO: 340617 - DNA, 25 bp, Homo sapien
aatgtgctgacctggccgtatcctt

SEQ ID NO: 340618 - DNA, 25 bp, Homo sapien
agtgggtttggagctcggccttact

SEQ ID NO: 340619 - DNA, 25 bp, Homo sapien
agcctcctgtttctgagcctgtctg

SEQ ID NO: 340620 - DNA, 25 bp, Homo sapien
ttctgagcctgtctgctgtactttg

SEQ ID NO: 340621 - DNA, 25 bp, Homo sapien
cctgtctgctgtactttgggctggt

SEQ ID NO: 340622 - DNA, 25 bp, Homo sapien
ggcatggcctcggtgcctcagtctt

SEQ ID NO: 340623 - DNA, 25 bp, Homo sapien
tcagtcttcccacacgcaaagtgga

SEQ ID NO: 340624 - DNA, 25 bp, Homo sapien
aaagtggagcgacagctcccacctc

SEQ ID NO: 340625 - DNA, 25 bp, Homo sapien
tcccacctcatagggacgctataag

SEQ ID NO: 340626 - DNA, 25 bp, Homo sapien
actgtcctcccttaaaagcatcatt

SEQ ID NO: 340627 - DNA, 25 bp, Homo sapien
ggttagggaattttcctctctctct

SEQ ID NO: 340628 - DNA, 25 bp, Homo sapien
ctcctctctctttctgttcaaagaa

SEQ ID NO: 340629 - DNA, 25 bp, Homo sapien
acttcaaacatttgggaccacctgg

SEQ ID NO: 340630 - DNA, 25 bp, Homo sapien
gaccacctggtattctgtattttca

SEQ ID NO: 340631 - DNA, 25 bp, Homo sapien
ctgtattttcactggccatattgga

SEQ ID NO: 340632 - DNA, 25 bp, Homo sapien
ggccatattggaagcagttctagtt

SEQ ID NO: 340633 - DNA, 25 bp, Homo sapien
cattgtattgagttgtgctggcagt

SEQ ID NO: 340634 - DNA, 25 bp, Homo sapien
tgtgctggcagtagtttccatgcct

SEQ ID NO: 340635 - DNA, 25 bp, Homo sapien
ttccatgcctgtcaatgtatcatag

SEQ ID NO: 340636 - DNA, 25 bp, Homo sapien
gtatcatagtcctttgttgcccaga

SEQ ID NO: 340637 - DNA, 25 bp, Homo sapien
atatgagtctgcatggcctcaggaa

SEQ ID NO: 340638 - DNA, 25 bp, Homo sapien
gggtttcaacaaggtactgatgtct

SEQ ID NO: 340639 - DNA, 25 bp, Homo sapien
aaggtactgatgtcttctgcccttg

SEQ ID NO: 340640 - DNA, 25 bp, Homo sapien
ttgcctcttcgacaggcaagtaata

SEQ ID NO: 340641 - DNA, 25 bp, Homo sapien
gaagagaattctttaggcacacaaa

SEQ ID NO: 340642 - DNA, 25 bp, Homo sapien
tctttaggcacacaaattcacattt

SEQ ID NO: 340643 - DNA, 25 bp, Homo sapien
tttgatgtaatctcattatacttcc

SEQ ID NO: 340644 - DNA, 25 bp, Homo sapien
attatacttcctgatctgtgattga

SEQ ID NO: 340645 - DNA, 25 bp, Homo sapien
tgaaaactttcatttcgtaactagt

SEQ ID NO: 340646 - DNA, 25 bp, Homo sapien
tcgtaactagtatgtctgtcccacc

SEQ ID NO: 340647 - DNA, 25 bp, Homo sapien
gtatgtctgtcccacctttaaaaag

SEQ ID NO: 340648 - DNA, 25 bp, Homo sapien
agcccaagccttgttggttacgtca

SEQ ID NO: 340649 - DNA, 25 bp, Homo sapien
aagccttgttggttacgtcagccgg

SEQ ID NO: 340650 - DNA, 25 bp, Homo sapien
ttgttggttacgtcagccggtccat

SEQ ID NO: 340651 - DNA, 25 bp, Homo sapien
ttacgtcagccggtccatggcggtg

SEQ ID NO: 340652 - DNA, 25 bp, Homo sapien
tcagccggtccatggcggtgtcctg

SEQ ID NO: 340653 - DNA, 25 bp, Homo sapien
ggaagggcgcaagtcaaagagcact

SEQ ID NO: 340654 - DNA, 25 bp, Homo sapien
aaagagcactggaggcaccgccggc

SEQ ID NO: 340655 - DNA, 25 bp, Homo sapien
caccgccggcgatggacgtccaggt

SEQ ID NO: 340656 - DNA, 25 bp, Homo sapien
tcccggctcctgtgctggaaagcgt

SEQ ID NO: 340657 - DNA, 25 bp, Homo sapien
ggctcctgtgctggaaagcgttgat

SEQ ID NO: 340658 - DNA, 25 bp, Homo sapien
tcggcgctgaccacacgcgggagct

SEQ ID NO: 340659 - DNA, 25 bp, Homo sapien
gaatgtatcagaaattgttcctatg

SEQ ID NO: 340660 - DNA, 25 bp, Homo sapien
atcagaaattgttcctatgtaggta

SEQ ID NO: 340661 - DNA, 25 bp, Homo sapien
tcctatgtaggtattctgtgaaact

SEQ ID NO: 340662 - DNA, 25 bp, Homo sapien
aggtattctgtgaaactggtttcta

SEQ ID NO: 340663 - DNA, 25 bp, Homo sapien
aatatgtttatgttcatgtgttcat

SEQ ID NO: 340664 - DNA, 25 bp, Homo sapien
tcatgtgttcataatacgttccttt

SEQ ID NO: 340665 - DNA, 25 bp, Homo sapien
cataatacgttcctttttctctctg

SEQ ID NO: 340666 - DNA, 25 bp, Homo sapien
tgtgtgtgtataaaagtgccttgct

SEQ ID NO: 340667 - DNA, 25 bp, Homo sapien
agtgccttgctcatgaatgcatttt

SEQ ID NO: 340668 - DNA, 25 bp, Homo sapien
atgcatttttgctattcacttcgaa

SEQ ID NO: 340669 - DNA, 25 bp, Homo sapien
gctattcacttcgaaaggaagcctt

SEQ ID NO: 340670 - DNA, 25 bp, Homo sapien
ataacacctcttaagtctagcacac

SEQ ID NO: 340671 - DNA, 25 bp, Homo sapien
agtctagcacactgcagtgaggcca

SEQ ID NO: 340672 - DNA, 25 bp, Homo sapien
tgcagtgaggccaggcacctcagtg

SEQ ID NO: 340673 - DNA, 25 bp, Homo sapien
ggcatcagaaggtgctaagccctct

SEQ ID NO: 340674 - DNA, 25 bp, Homo sapien
aatgccaagacggagaccacagcct

SEQ ID NO: 340675 - DNA, 25 bp, Homo sapien
tacaccaaatccagcccttgatttc

SEQ ID NO: 340676 - DNA, 25 bp, Homo sapien
ctgctgcctccataaacagaaagag

SEQ ID NO: 340677 - DNA, 25 bp, Homo sapien
aaagaggtctgctggatccgctaag

SEQ ID NO: 340678 - DNA, 25 bp, Homo sapien
agtgctcctactggttcccaagcta

SEQ ID NO: 340679 - DNA, 25 bp, Homo sapien
ctactggttcccaagctacaggtgg

SEQ ID NO: 340680 - DNA, 25 bp, Homo sapien
gaaaggctttatcaggtatcatcaa

SEQ ID NO: 340681 - DNA, 25 bp, Homo sapien
gcttatcttaaatagttcaattcag

SEQ ID NO: 340682 - DNA, 25 bp, Homo sapien
aaatagttcaattcagtgctaagct

SEQ ID NO: 340683 - DNA, 25 bp, Homo sapien
tcagtgctaagctgattccctttat

SEQ ID NO: 340684 - DNA, 25 bp, Homo sapien
ctgaagtctggaagtctggtatctt

SEQ ID NO: 340685 - DNA, 25 bp, Homo sapien
gtctggaagtctggtatcttctaca

SEQ ID NO: 340686 - DNA, 25 bp, Homo sapien
aagtctggtatcttctacattttta

SEQ ID NO: 340687 - DNA, 25 bp, Homo sapien
ttatgtcatccctcatagagacaat

SEQ ID NO: 340688 - DNA, 25 bp, Homo sapien
atccctcatagagacaatttttgga

SEQ ID NO: 340689 - DNA, 25 bp, Homo sapien
gacaatttttggagtagatttcatt

SEQ ID NO: 340690 - DNA, 25 bp, Homo sapien
ggcaagatgtcagcctggcagggac

SEQ ID NO: 340691 - DNA, 25 bp, Homo sapien
gcagggaccgtggtcttgagtcaaa

SEQ ID NO: 340692 - DNA, 25 bp, Homo sapien
agcctgtttcctcaaaagactgaca

SEQ ID NO: 340693 - DNA, 25 bp, Homo sapien
tcttcttcccaatgtgtctgcagat

SEQ ID NO: 340694 - DNA, 25 bp, Homo sapien
gtgtctgcagatactctttaacatt

SEQ ID NO: 340695 - DNA, 25 bp, Homo sapien
ttaacattttcttcgatgtaaggaa

SEQ ID NO: 340696 - DNA, 25 bp, Homo sapien
ggaaataaaatgtccttcacgaaag

SEQ ID NO: 340697 - DNA, 25 bp, Homo sapien
aatgtccttcacgaaagcaatcggg

SEQ ID NO: 340698 - DNA, 25 bp, Homo sapien
ggttgtggtaccttcgatatctaac

SEQ ID NO: 340699 - DNA, 25 bp, Homo sapien
gatatctaacaggatcacggtgact

SEQ ID NO: 340700 - DNA, 25 bp, Homo sapien
aacaggatcacggtgacttcggcgg

SEQ ID NO: 340701 - DNA, 25 bp, Homo sapien
gatcatctgttgcagatcatccact

SEQ ID NO: 340702 - DNA, 25 bp, Homo sapien
agggataggaacagccccatccagg

SEQ ID NO: 340703 - DNA, 25 bp, Homo sapien
taaccggacaccttagacggaggtg

SEQ ID NO: 340704 - DNA, 25 bp, Homo sapien
gtgggatttgcagggtcattatcag

SEQ ID NO: 340705 - DNA, 25 bp, Homo sapien
atttgcagggtcattatcagaacat

SEQ ID NO: 340706 - DNA, 25 bp, Homo sapien
aacatgaggataacttccttgcccc

SEQ ID NO: 340707 - DNA, 25 bp, Homo sapien
cttggcaccggcctctatttgtcat

SEQ ID NO: 340708 - DNA, 25 bp, Homo sapien
ctatttgtcataaggcggcgtgggc

SEQ ID NO: 340709 - DNA, 25 bp, Homo sapien
tgacacaggccagccttggcacgag

SEQ ID NO: 340710 - DNA, 25 bp, Homo sapien
ttctgagaagcgctgccctgtgaga

SEQ ID NO: 340711 - DNA, 25 bp, Homo sapien
tctccatctctggttgacgggctgt

SEQ ID NO: 340712 - DNA, 25 bp, Homo sapien
catctctggttgacgggctgtccgt

SEQ ID NO: 340713 - DNA, 25 bp, Homo sapien
tgtgtgtctgcagacaagtcttgct

SEQ ID NO: 340714 - DNA, 25 bp, Homo sapien
gcctttgcactgtccatgctctcag

SEQ ID NO: 340715 - DNA, 25 bp, Homo sapien
agtggctaacactggagacgaagac

SEQ ID NO: 340716 - DNA, 25 bp, Homo sapien
ggagacgaagaccaagacaccaccg

SEQ ID NO: 340717 - DNA, 25 bp, Homo sapien
tccagtacctctcaaatcagcacag

SEQ ID NO: 340718 - DNA, 25 bp, Homo sapien
aggacaaaggcctcaatccacaact

SEQ ID NO: 340719 - DNA, 25 bp, Homo sapien
gcctcaatccacaactgctgaagat

SEQ ID NO: 340720 - DNA, 25 bp, Homo sapien
aactgctgaagatggaccctggcca

SEQ ID NO: 340721 - DNA, 25 bp, Homo sapien
acatgggatggtcagacacgcctgc

SEQ ID NO: 340722 - DNA, 25 bp, Homo sapien
tgcccagctatctgcaggcgaagag

SEQ ID NO: 340723 - DNA, 25 bp, Homo sapien
acatcttgcttccatgtccatatga

SEQ ID NO: 340724 - DNA, 25 bp, Homo sapien
cttccatgtccatatgagcaggcta

SEQ ID NO: 340725 - DNA, 25 bp, Homo sapien
gcccatgtatccaggtgcatcaaac

SEQ ID NO: 340726 - DNA, 25 bp, Homo sapien
gctaagttcaaaagtgcgtctgttt

SEQ ID NO: 340727 - DNA, 25 bp, Homo sapien
gtgcgtctgttttgaagatttcatc

SEQ ID NO: 340728 - DNA, 25 bp, Homo sapien
tacactttcattactaccagtttgc

SEQ ID NO: 340729 - DNA, 25 bp, Homo sapien
gagactctttaaactcttctggata

SEQ ID NO: 340730 - DNA, 25 bp, Homo sapien
gtgtgtaaacacagtccggatgaac

SEQ ID NO: 340731 - DNA, 25 bp, Homo sapien
gtccggatgaactttactactgata

SEQ ID NO: 340732 - DNA, 25 bp, Homo sapien
tttactactgatacctcacttgagg

SEQ ID NO: 340733 - DNA, 25 bp, Homo sapien
agcagttagtgcctatggtcatgta

SEQ ID NO: 340734 - DNA, 25 bp, Homo sapien
tacactaagtcaatacctgtggagt

SEQ ID NO: 340735 - DNA, 25 bp, Homo sapien
tacctgtggagtgaaatccggtctc

SEQ ID NO: 340736 - DNA, 25 bp, Homo sapien
caaccttaagcatgttcctttcatc

SEQ ID NO: 340737 - DNA, 25 bp, Homo sapien
tttcatctctgacatggccattctg

SEQ ID NO: 340738 - DNA, 25 bp, Homo sapien
tggccattctgaaagatctctcgaa

SEQ ID NO: 340739 - DNA, 25 bp, Homo sapien
tcgaacagaatccaactcccagagg

SEQ ID NO: 340740 - DNA, 25 bp, Homo sapien
gtcattgaagtccaaggctgtcatc

SEQ ID NO: 340741 - DNA, 25 bp, Homo sapien
ttttgtttcactttgcagttcttgt

SEQ ID NO: 340742 - DNA, 25 bp, Homo sapien
tttttccaaatgcaggtagttccca

SEQ ID NO: 340743 - DNA, 25 bp, Homo sapien
atagataagacctcctttgctggct

SEQ ID NO: 340744 - DNA, 25 bp, Homo sapien
ttgctggctctattcacaccagttt

SEQ ID NO: 340745 - DNA, 25 bp, Homo sapien
ggctgtcatcgtctccagaatggaa

SEQ ID NO: 340746 - DNA, 25 bp, Homo sapien
tcaggatcactgacactcggtgcat

SEQ ID NO: 340747 - DNA, 25 bp, Homo sapien
caaggtggtggatggagtctggtca

SEQ ID NO: 340748 - DNA, 25 bp, Homo sapien
agtggtgctggtgggtcctccaagg

SEQ ID NO: 340749 - DNA, 25 bp, Homo sapien
gagattcccagctagctggaagtca

SEQ ID NO: 340750 - DNA, 25 bp, Homo sapien
agctagctggaagtcaaactctcga

SEQ ID NO: 340751 - DNA, 25 bp, Homo sapien
ggaagtcaaactctcgagcccaaga

SEQ ID NO: 340752 - DNA, 25 bp, Homo sapien
gtcaaactctcgagcccaagagttt

SEQ ID NO: 340753 - DNA, 25 bp, Homo sapien
ctgggtgctggcctgggtaactgga

SEQ ID NO: 340754 - DNA, 25 bp, Homo sapien
ggcatacgcctagagtcctagctac

SEQ ID NO: 340755 - DNA, 25 bp, Homo sapien
ggtaactggaggacgatggatcttt

SEQ ID NO: 340756 - DNA, 25 bp, Homo sapien
gacgatggatcttttgctgagctga

SEQ ID NO: 340757 - DNA, 25 bp, Homo sapien
gatggatcttttgctgagctgatgg

SEQ ID NO: 340758 - DNA, 25 bp, Homo sapien
cagccggatatccatctctccaaat

SEQ ID NO: 340759 - DNA, 25 bp, Homo sapien
tctccaaatgaggaccagtaactga

SEQ ID NO: 340760 - DNA, 25 bp, Homo sapien
tcacatttacccacattctgaggcc

SEQ ID NO: 340761 - DNA, 25 bp, Homo sapien
gcaatgccaaagtgacatgggtcct

SEQ ID NO: 340762 - DNA, 25 bp, Homo sapien
aaagtgacatgggtccttggtgatg

SEQ ID NO: 340763 - DNA, 25 bp, Homo sapien
aagaatccagggttgtcatcaccac

SEQ ID NO: 340764 - DNA, 25 bp, Homo sapien
gtcatcaccactgagtatggatttc

SEQ ID NO: 340765 - DNA, 25 bp, Homo sapien
tggatttcacattctaacacattag

SEQ ID NO: 340766 - DNA, 25 bp, Homo sapien
ctaacacattagaagctgcaggatg

SEQ ID NO: 340767 - DNA, 25 bp, Homo sapien
gtccacatgtagaccctgagctgta

SEQ ID NO: 340768 - DNA, 25 bp, Homo sapien
atgtagaccctgagctgtagaccca

SEQ ID NO: 340769 - DNA, 25 bp, Homo sapien
ttccacttcacactgaaagagatgc

SEQ ID NO: 340770 - DNA, 25 bp, Homo sapien
gagatgcaacaagaaatagtcaaga

SEQ ID NO: 340771 - DNA, 25 bp, Homo sapien
aacagttccagagtaaaatccattc

SEQ ID NO: 340772 - DNA, 25 bp, Homo sapien
gttccagagtaaaatccattctaga

SEQ ID NO: 340773 - DNA, 25 bp, Homo sapien
tccattctagaattggtagcttttt

SEQ ID NO: 340774 - DNA, 25 bp, Homo sapien
gtagctttttgaaacctaggcctca

SEQ ID NO: 340775 - DNA, 25 bp, Homo sapien
gctttttgaaacctaggcctcataa

SEQ ID NO: 340776 - DNA, 25 bp, Homo sapien
gaaacctaggcctcataatattaag

SEQ ID NO: 340777 - DNA, 25 bp, Homo sapien
ggcctcataatattaaggactcctt

SEQ ID NO: 340778 - DNA, 25 bp, Homo sapien
attaaggactccttcagtgggcctt

SEQ ID NO: 340779 - DNA, 25 bp, Homo sapien
ggactccttcagtgggccttcaact

SEQ ID NO: 340780 - DNA, 25 bp, Homo sapien
atgagctccttaatatcgacactgt

SEQ ID NO: 340781 - DNA, 25 bp, Homo sapien
gctccttaatatcgacactgtttat

SEQ ID NO: 340782 - DNA, 25 bp, Homo sapien
tcattttagacgtctcctgaaagct

SEQ ID NO: 340783 - DNA, 25 bp, Homo sapien
gaattaatcttctgaatcaaggacg

SEQ ID NO: 340784 - DNA, 25 bp, Homo sapien
aatcaaggacgtatccctgaatctg

SEQ ID NO: 340785 - DNA, 25 bp, Homo sapien
ttagacgtctcctgaaagctgagca

SEQ ID NO: 340786 - DNA, 25 bp, Homo sapien
aaaatatacatgctggaaccctacc

SEQ ID NO: 340787 - DNA, 25 bp, Homo sapien
atacatgctggaaccctaccaaagg

SEQ ID NO: 340788 - DNA, 25 bp, Homo sapien
gctggaaccctaccaaaggaataat

SEQ ID NO: 340789 - DNA, 25 bp, Homo sapien
ataaatctggaatgaggctctgact

SEQ ID NO: 340790 - DNA, 25 bp, Homo sapien
gatcttccaaaattaatgagctcct

SEQ ID NO: 340791 - DNA, 25 bp, Homo sapien
tttcattgtgtcctggcagattgta

SEQ ID NO: 340792 - DNA, 25 bp, Homo sapien
ttgtgtcctggcagattgtaagcac

SEQ ID NO: 340793 - DNA, 25 bp, Homo sapien
gtaagcactagagcagtggtccctg

SEQ ID NO: 340794 - DNA, 25 bp, Homo sapien
cagtggtccctgctgttactaaaag

SEQ ID NO: 340795 - DNA, 25 bp, Homo sapien
ggtccctgctgttactaaaagtgat

SEQ ID NO: 340796 - DNA, 25 bp, Homo sapien
ttaaatttactcacaagtttgtaga

SEQ ID NO: 340797 - DNA, 25 bp, Homo sapien
atattttacttaactgacttgcgta

SEQ ID NO: 340798 - DNA, 25 bp, Homo sapien
aactgacttgcgtatatttttccca

SEQ ID NO: 340799 - DNA, 25 bp, Homo sapien
gacttgcgtatatttttcccacgtg

SEQ ID NO: 340800 - DNA, 25 bp, Homo sapien
gcgtatatttttcccacgtgaaaca

SEQ ID NO: 340801 - DNA, 25 bp, Homo sapien
ttttcccacgtgaaacagacgcagt

SEQ ID NO: 340802 - DNA, 25 bp, Homo sapien
gccctccaggatttccaaagtactc

SEQ ID NO: 340803 - DNA, 25 bp, Homo sapien
gatttccaaagtactccagttgaga

SEQ ID NO: 340804 - DNA, 25 bp, Homo sapien
gagaactactggcttaatgctagtc

SEQ ID NO: 340805 - DNA, 25 bp, Homo sapien
aatgctagtcaagattcatccttgg

SEQ ID NO: 340806 - DNA, 25 bp, Homo sapien
attcatccttgggatcagagagagg

SEQ ID NO: 340807 - DNA, 25 bp, Homo sapien
agagaggagccaaatgcccaagcca

SEQ ID NO: 340808 - DNA, 25 bp, Homo sapien
aatgcccaagccaaatatatatttg

SEQ ID NO: 340809 - DNA, 25 bp, Homo sapien
aagttgcttgggtatgggtggacac

SEQ ID NO: 340810 - DNA, 25 bp, Homo sapien
atgggtggacacagtatttcagtca

SEQ ID NO: 340811 - DNA, 25 bp, Homo sapien
agaaggtatatggagatttcctaca

SEQ ID NO: 340812 - DNA, 25 bp, Homo sapien
ggagatttcctacagccaataggat

SEQ ID NO: 340813 - DNA, 25 bp, Homo sapien
tgagaactcatccaggcacaagtat

SEQ ID NO: 340814 - DNA, 25 bp, Homo sapien
ctcatccaggcacaagtatataaat

SEQ ID NO: 340815 - DNA, 25 bp, Homo sapien
aagacatcaggtcctaatccatgaa

SEQ ID NO: 340816 - DNA, 25 bp, Homo sapien
ggtcctaatccatgaaccctatgtt

SEQ ID NO: 340817 - DNA, 25 bp, Homo sapien
atgaaccctatgttaccttacgtgg

SEQ ID NO: 340818 - DNA, 25 bp, Homo sapien
ccctatgttaccttacgtggaaatg

SEQ ID NO: 340819 - DNA, 25 bp, Homo sapien
gggagattttcttggattatctagg

SEQ ID NO: 340820 - DNA, 25 bp, Homo sapien
ttggattatctaggtaggtcctaaa

SEQ ID NO: 340821 - DNA, 25 bp, Homo sapien
ggtaggtcctaaatgcaatcacaag

SEQ ID NO: 340822 - DNA, 25 bp, Homo sapien
atcacaagtgtctttaatcagaggc

SEQ ID NO: 340823 - DNA, 25 bp, Homo sapien
tgtctttaatcagaggcagggagat

SEQ ID NO: 340824 - DNA, 25 bp, Homo sapien
aaacctatttagttcagtagggcag

SEQ ID NO: 340825 - DNA, 25 bp, Homo sapien
agtagggcagctcagggatttttta

SEQ ID NO: 340826 - DNA, 25 bp, Homo sapien
tacacaacatgtatatcttcccatt

SEQ ID NO: 340827 - DNA, 25 bp, Homo sapien
tggtatacataaacagctggcactg

SEQ ID NO: 340828 - DNA, 25 bp, Homo sapien
aacagctggcactgatagctaaatt

SEQ ID NO: 340829 - DNA, 25 bp, Homo sapien
caattagttttgttggtatctgaat

SEQ ID NO: 340830 - DNA, 25 bp, Homo sapien
aatagcgttgtttcatagctctgta

SEQ ID NO: 340831 - DNA, 25 bp, Homo sapien
gtttcatagctctgtatttcctaag

SEQ ID NO: 340832 - DNA, 25 bp, Homo sapien
tgatcggtagtatagctaaattgct

SEQ ID NO: 340833 - DNA, 25 bp, Homo sapien
aagttgctgatactttctccgtatg

SEQ ID NO: 340834 - DNA, 25 bp, Homo sapien
gatactttctccgtatgaacagaag

SEQ ID NO: 340835 - DNA, 25 bp, Homo sapien
atctataaaattgctatatcctcct

SEQ ID NO: 340836 - DNA, 25 bp, Homo sapien
ctatatcctcctgatagccatggga

SEQ ID NO: 340837 - DNA, 25 bp, Homo sapien
atcctcctgatagccatgggaaaac

SEQ ID NO: 340838 - DNA, 25 bp, Homo sapien
tagacagacaccctgactgttgaag

SEQ ID NO: 340839 - DNA, 25 bp, Homo sapien
agacaccctgactgttgaagggagg

SEQ ID NO: 340840 - DNA, 25 bp, Homo sapien
agacaagcttgcctcgcctgacttt

SEQ ID NO: 340841 - DNA, 25 bp, Homo sapien
tgacttttctgtcccttgttctgca

SEQ ID NO: 340842 - DNA, 25 bp, Homo sapien
tgtcccttgttctgcaggattagta

SEQ ID NO: 340843 - DNA, 25 bp, Homo sapien
ttctgcaggattagtattctgttac

SEQ ID NO: 340844 - DNA, 25 bp, Homo sapien
attctgttacagacctctagttttt

SEQ ID NO: 340845 - DNA, 25 bp, Homo sapien
gacctctagtttttagactcttcaa

SEQ ID NO: 340846 - DNA, 25 bp, Homo sapien
tatccaccccattttcagaaatctg

SEQ ID NO: 340847 - DNA, 25 bp, Homo sapien
tcagaaatctgggaagatctttttt

SEQ ID NO: 340848 - DNA, 25 bp, Homo sapien
gttacaaacatggatgaagttcacc

SEQ ID NO: 340849 - DNA, 25 bp, Homo sapien
agttcaccagaacagatccagggtt

SEQ ID NO: 340850 - DNA, 25 bp, Homo sapien
cagaacagatccagggttaaccttt

SEQ ID NO: 340851 - DNA, 25 bp, Homo sapien
aagtcattagatatggctccagtaa

SEQ ID NO: 340852 - DNA, 25 bp, Homo sapien
gatatggctccagtaaaaggcatga

SEQ ID NO: 340853 - DNA, 25 bp, Homo sapien
aaaaggcatgagaaggcacccgtga

SEQ ID NO: 340854 - DNA, 25 bp, Homo sapien
gagaaggcacccgtgagaccctgca

SEQ ID NO: 340855 - DNA, 25 bp, Homo sapien
cagagaatactttctctatccaaaa

SEQ ID NO: 340856 - DNA, 25 bp, Homo sapien
gaatgtaggtcagtatccaccccat

SEQ ID NO: 340857 - DNA, 25 bp, Homo sapien
attgtgtaagttgcagatgtggctt

SEQ ID NO: 340858 - DNA, 25 bp, Homo sapien
tgcagatgtggcttttactttttaa

SEQ ID NO: 340859 - DNA, 25 bp, Homo sapien
tattaacaagccagcaaagtgtgtc

SEQ ID NO: 340860 - DNA, 25 bp, Homo sapien
aaagtgtgtcagaccatggcgtggt

SEQ ID NO: 340861 - DNA, 25 bp, Homo sapien
catggcgtggtatttattgtgcagc

SEQ ID NO: 340862 - DNA, 25 bp, Homo sapien
acagaggcagcctgtcttttcagtt

SEQ ID NO: 340863 - DNA, 25 bp, Homo sapien
gcttttaatttacttgtacaattca

SEQ ID NO: 340864 - DNA, 25 bp, Homo sapien
tgtttttctattaatcttttgtcaa

SEQ ID NO: 340865 - DNA, 25 bp, Homo sapien
atcttttgtcaacttcctgattatg

SEQ ID NO: 340866 - DNA, 25 bp, Homo sapien
gtatgtacagtctacttttgaacta

SEQ ID NO: 340867 - DNA, 25 bp, Homo sapien
gtacagtctacttttgaactatttt

SEQ ID NO: 340868 - DNA, 25 bp, Homo sapien
ggatccccagaagtgcagagctgag

SEQ ID NO: 340869 - DNA, 25 bp, Homo sapien
agctgagcaggcttgggcctgtcat

SEQ ID NO: 340870 - DNA, 25 bp, Homo sapien
catggctggccggaagtgtccccag

SEQ ID NO: 340871 - DNA, 25 bp, Homo sapien
tacagacgctgtagccatcactgcc

SEQ ID NO: 340872 - DNA, 25 bp, Homo sapien
tgtagccatcactgcctctccaggg

SEQ ID NO: 340873 - DNA, 25 bp, Homo sapien
agacccagccagaaccactgctagg

SEQ ID NO: 340874 - DNA, 25 bp, Homo sapien
agccagaaccactgctaggatgggc

SEQ ID NO: 340875 - DNA, 25 bp, Homo sapien
gaaccactgctaggatgggccgcac

SEQ ID NO: 340876 - DNA, 25 bp, Homo sapien
tggcctccagggacctagagaatgg

SEQ ID NO: 340877 - DNA, 25 bp, Homo sapien
acagggctgtgctgttgccaacagt

SEQ ID NO: 340878 - DNA, 25 bp, Homo sapien
ctgttgccaacagtaaacctgctct

SEQ ID NO: 340879 - DNA, 25 bp, Homo sapien
gagacaggcctttcaactgcttagt

SEQ ID NO: 340880 - DNA, 25 bp, Homo sapien
ggcctttcaactgcttagtgttagt

SEQ ID NO: 340881 - DNA, 25 bp, Homo sapien
agtgttagtatgtccttgcttatga

SEQ ID NO: 340882 - DNA, 25 bp, Homo sapien
gggacactcatcagtacgttaacta

SEQ ID NO: 340883 - DNA, 25 bp, Homo sapien
gtatgttctgttgttcctaaggctt

SEQ ID NO: 340884 - DNA, 25 bp, Homo sapien
ctaaggctttgataatatcctgtac

SEQ ID NO: 340885 - DNA, 25 bp, Homo sapien
tatcctgtacagattttggtttagt

SEQ ID NO: 340886 - DNA, 25 bp, Homo sapien
attgctaataggtcactcttataga

SEQ ID NO: 340887 - DNA, 25 bp, Homo sapien
tcttatagattattgcttggccctt

SEQ ID NO: 340888 - DNA, 25 bp, Homo sapien
tgcttggcccttcaaactcagtaca

SEQ ID NO: 340889 - DNA, 25 bp, Homo sapien
gaggccctttgacctagtgttttat

SEQ ID NO: 340890 - DNA, 25 bp, Homo sapien
atatcctgaatcatactgagactga

SEQ ID NO: 340891 - DNA, 25 bp, Homo sapien
ggtagcttttttgttcagatcttat

SEQ ID NO: 340892 - DNA, 25 bp, Homo sapien
gatcttatgacacactactcttctc

SEQ ID NO: 340893 - DNA, 25 bp, Homo sapien
gagattttctcagccagtgatagta

SEQ ID NO: 340894 - DNA, 25 bp, Homo sapien
gtacattctgaaatgctggcaccag

SEQ ID NO: 340895 - DNA, 25 bp, Homo sapien
tggcaccaggagacggccacagaca

SEQ ID NO: 340896 - DNA, 25 bp, Homo sapien
gaagtagagtgtagctgccagcgta

SEQ ID NO: 340897 - DNA, 25 bp, Homo sapien
attcctgggagcactgggtgtagca

SEQ ID NO: 340898 - DNA, 25 bp, Homo sapien
gggtgtagcaaaacaaagccactct

SEQ ID NO: 340899 - DNA, 25 bp, Homo sapien
tgcttcagtcgcaccatttgctaat

SEQ ID NO: 340900 - DNA, 25 bp, Homo sapien
gtcgcaccatttgctaattgaaaat

SEQ ID NO: 340901 - DNA, 25 bp, Homo sapien
aaagctgcacttgggatttttacct

SEQ ID NO: 340902 - DNA, 25 bp, Homo sapien
tgcacttgggatttttacctaacgc

SEQ ID NO: 340903 - DNA, 25 bp, Homo sapien
tacctaacgctttactgattctctc

SEQ ID NO: 340904 - DNA, 25 bp, Homo sapien
gattctctcaagcacatggcaaagt

SEQ ID NO: 340905 - DNA, 25 bp, Homo sapien
aaagtttgatttgcactccgttcat

SEQ ID NO: 340906 - DNA, 25 bp, Homo sapien
atttgcactccgttcatttctgaca

SEQ ID NO: 340907 - DNA, 25 bp, Homo sapien
ttcatttctgacacgttttgctgcc

SEQ ID NO: 340908 - DNA, 25 bp, Homo sapien
ttttgctgcctcctacctttctaag

SEQ ID NO: 340909 - DNA, 25 bp, Homo sapien
cctacctttctaagcgtcatgcaaa

SEQ ID NO: 340910 - DNA, 25 bp, Homo sapien
ctaagcgtcatgcaaattcgagaat

SEQ ID NO: 340911 - DNA, 25 bp, Homo sapien
attcgagaatggagaaggacgctgc

SEQ ID NO: 340912 - DNA, 25 bp, Homo sapien
agaagtgcagagctgagcaggcttg

SEQ ID NO: 340913 - DNA, 25 bp, Homo sapien
tgcagagctgagcaggcttgggcct

SEQ ID NO: 340914 - DNA, 25 bp, Homo sapien
caggcttgggcctgtcatggctggc

SEQ ID NO: 340915 - DNA, 25 bp, Homo sapien
agacccagccagaaccactgctagg

SEQ ID NO: 340916 - DNA, 25 bp, Homo sapien
acccagccagaaccactgctaggat

SEQ ID NO: 340917 - DNA, 25 bp, Homo sapien
cagccagaaccactgctaggatggg

SEQ ID NO: 340918 - DNA, 25 bp, Homo sapien
gccagaaccactgctaggatgggcc

SEQ ID NO: 340919 - DNA, 25 bp, Homo sapien
cctccagggacctagagaatgggag

SEQ ID NO: 340920 - DNA, 25 bp, Homo sapien
acccgctacccttgggtgccacagg

SEQ ID NO: 340921 - DNA, 25 bp, Homo sapien
cacagggctgtgctgttgccaacag

SEQ ID NO: 340922 - DNA, 25 bp, Homo sapien
acagggctgtgctgttgccaacagt

SEQ ID NO: 340923 - DNA, 25 bp, Homo sapien
gacctcggcaaaacctgagtcctgt

SEQ ID NO: 340924 - DNA, 25 bp, Homo sapien
gcaaaacctgagtcctgtcctctcg

SEQ ID NO: 340925 - DNA, 25 bp, Homo sapien
ggatctgtccagtcgcccagctaaa

SEQ ID NO: 340926 - DNA, 25 bp, Homo sapien
tgtccagtcgcccagctaaagtgct

SEQ ID NO: 340927 - DNA, 25 bp, Homo sapien
agtcgcccagctaaagtgctcagca

SEQ ID NO: 340928 - DNA, 25 bp, Homo sapien
gcccagctaaagtgctcagcaggtc

SEQ ID NO: 340929 - DNA, 25 bp, Homo sapien
aaagtgctcagcaggtcagcagcgc

SEQ ID NO: 340930 - DNA, 25 bp, Homo sapien
agcaggtcagcagcgcggcgagctt

SEQ ID NO: 340931 - DNA, 25 bp, Homo sapien
gtctggggctcctggatctctgtgt

SEQ ID NO: 340932 - DNA, 25 bp, Homo sapien
tgcttagaacccacgcagcgtctcg

SEQ ID NO: 340933 - DNA, 25 bp, Homo sapien
ttagaacccacgcagcgtctcgggc

SEQ ID NO: 340934 - DNA, 25 bp, Homo sapien
ttaggccagtgcaaattatgcagta

SEQ ID NO: 340935 - DNA, 25 bp, Homo sapien
atgcttaatccctcatattcaattt

SEQ ID NO: 340936 - DNA, 25 bp, Homo sapien
tattcaatttcatcaagccttgtat

SEQ ID NO: 340937 - DNA, 25 bp, Homo sapien
gccttgtatacttctgcttaaatgt

SEQ ID NO: 340938 - DNA, 25 bp, Homo sapien
gcttaaatgtaattcaatccttggt

SEQ ID NO: 340939 - DNA, 25 bp, Homo sapien
tcaatccttggttgttatggcaaac

SEQ ID NO: 340940 - DNA, 25 bp, Homo sapien
agacagactctggtactatggtaac

SEQ ID NO: 340941 - DNA, 25 bp, Homo sapien
gccactttatcatttggtcaaaatt

SEQ ID NO: 340942 - DNA, 25 bp, Homo sapien
gattagctttgtagaactgacctgt

SEQ ID NO: 340943 - DNA, 25 bp, Homo sapien
ctgacctgtttatttggcaatgctg

SEQ ID NO: 340944 - DNA, 25 bp, Homo sapien
ggatcatttcggtttcagacttcaa

SEQ ID NO: 340945 - DNA, 25 bp, Homo sapien
gtgaactttgtgaatggatttttcc

SEQ ID NO: 340946 - DNA, 25 bp, Homo sapien
ggatttttccatactcatctacaat

SEQ ID NO: 340947 - DNA, 25 bp, Homo sapien
atactcatctacaattcctccattt

SEQ ID NO: 340948 - DNA, 25 bp, Homo sapien
ctcatctacaattcctccattttaa

SEQ ID NO: 340949 - DNA, 25 bp, Homo sapien
tctacaattcctccattttaaatga

SEQ ID NO: 340950 - DNA, 25 bp, Homo sapien
aaaaatctacttcagtatcatgagt

SEQ ID NO: 340951 - DNA, 25 bp, Homo sapien
ttcagtatcatgagtaggtcttaca

SEQ ID NO: 340952 - DNA, 25 bp, Homo sapien
gtagtgagacatacaaatctgatgt

SEQ ID NO: 340953 - DNA, 25 bp, Homo sapien
atctgatgttaatgtttgctcttag

SEQ ID NO: 340954 - DNA, 25 bp, Homo sapien
cttagaagtcatactccatggtctt

SEQ ID NO: 340955 - DNA, 25 bp, Homo sapien
agtcatactccatggtcttcaaaga

SEQ ID NO: 340956 - DNA, 25 bp, Homo sapien
ccagttcacagccagagttgcctct

SEQ ID NO: 340957 - DNA, 25 bp, Homo sapien
tgttgttagagggcccagagttcct

SEQ ID NO: 340958 - DNA, 25 bp, Homo sapien
gttgttagagggcccagagttcctt

SEQ ID NO: 340959 - DNA, 25 bp, Homo sapien
cgctctctctctcttggcctgagat

SEQ ID NO: 340960 - DNA, 25 bp, Homo sapien
gctctctctctcttggcctgagatc

SEQ ID NO: 340961 - DNA, 25 bp, Homo sapien
tctctcttggcctgagatctctgtg

SEQ ID NO: 340962 - DNA, 25 bp, Homo sapien
ctctcttggcctgagatctctgtgc

SEQ ID NO: 340963 - DNA, 25 bp, Homo sapien
tgagatctctgtgcaggaaccaaga

SEQ ID NO: 340964 - DNA, 25 bp, Homo sapien
gatggggctgaagcctctggaggca

SEQ ID NO: 340965 - DNA, 25 bp, Homo sapien
ccctcagcccggcaacttctgggtt

SEQ ID NO: 340966 - DNA, 25 bp, Homo sapien
ctcagcccggcaacttctgggttcc

SEQ ID NO: 340967 - DNA, 25 bp, Homo sapien
ttttttcctgctccatgcagactgt

SEQ ID NO: 340968 - DNA, 25 bp, Homo sapien
tgctccatgcagactgttagctttt

SEQ ID NO: 340969 - DNA, 25 bp, Homo sapien
tgcagactgttagcttttaccttaa

SEQ ID NO: 340970 - DNA, 25 bp, Homo sapien
gactgttagcttttaccttaaatgc

SEQ ID NO: 340971 - DNA, 25 bp, Homo sapien
gccagtattcccagagttttggttt

SEQ ID NO: 340972 - DNA, 25 bp, Homo sapien
ttgaactagcaatgcctgtgaaaaa

SEQ ID NO: 340973 - DNA, 25 bp, Homo sapien
gaatacctaagatttctgtcttggg

SEQ ID NO: 340974 - DNA, 25 bp, Homo sapien
ggtttttggtgcatgcagttgatta

SEQ ID NO: 340975 - DNA, 25 bp, Homo sapien
gtgcatgcagttgattacttcttat

SEQ ID NO: 340976 - DNA, 25 bp, Homo sapien
aggcatactagtacaagtggtaatt

SEQ ID NO: 340977 - DNA, 25 bp, Homo sapien
ttagcatttgttttagcattaccta

SEQ ID NO: 340978 - DNA, 25 bp, Homo sapien
tcaaacccatctgtaatttcgagtg

SEQ ID NO: 340979 - DNA, 25 bp, Homo sapien
gtaatttcgagtgggtggagctctt

SEQ ID NO: 340980 - DNA, 25 bp, Homo sapien
ggagctcttgcttttggtacatgcc

SEQ ID NO: 340981 - DNA, 25 bp, Homo sapien
ttgcttttggtacatgccctgaatc

SEQ ID NO: 340982 - DNA, 25 bp, Homo sapien
ttggtacatgccctgaatccctcac

SEQ ID NO: 340983 - DNA, 25 bp, Homo sapien
tccctcaagaatccgaaccacagga

SEQ ID NO: 340984 - DNA, 25 bp, Homo sapien
ggacaaaaaccacctactgggctct

SEQ ID NO: 340985 - DNA, 25 bp, Homo sapien
ttctttgctctttagaacccagtga

SEQ ID NO: 340986 - DNA, 25 bp, Homo sapien
tttagaacccagtgaaaaataccag

SEQ ID NO: 340987 - DNA, 25 bp, Homo sapien
gataggtcattagtgctttaagcaa

SEQ ID NO: 340988 - DNA, 25 bp, Homo sapien
gcaaaagatattagcagctttgact

SEQ ID NO: 340989 - DNA, 25 bp, Homo sapien
tacaatcgccgcattctttctagct

SEQ ID NO: 340990 - DNA, 25 bp, Homo sapien
ttctagctgcagctggtttcttcaa

SEQ ID NO: 340991 - DNA, 25 bp, Homo sapien
tcaaggctcctgcttaaagtccaca

SEQ ID NO: 340992 - DNA, 25 bp, Homo sapien
aaagtccacacgttattatggccga

SEQ ID NO: 340993 - DNA, 25 bp, Homo sapien
attatggccgaaagcaacctggtgc

SEQ ID NO: 340994 - DNA, 25 bp, Homo sapien
aacctggtgcttcggcctggataag

SEQ ID NO: 340995 - DNA, 25 bp, Homo sapien
atcttattcacagcttgcagcctca

SEQ ID NO: 340996 - DNA, 25 bp, Homo sapien
ggagaggtcattaccttgatcctgc

SEQ ID NO: 340997 - DNA, 25 bp, Homo sapien
aaacccagactcgttgagcagcaac

SEQ ID NO: 340998 - DNA, 25 bp, Homo sapien
atcccactgcccaatctagaatatg

SEQ ID NO: 340999 - DNA, 25 bp, Homo sapien
atctagaatatgtctgctctccttt

SEQ ID NO: 341000 - DNA, 25 bp, Homo sapien
aagccaaggtgaggcaagtcccagt

SEQ ID NO: 341001 - DNA, 25 bp, Homo sapien
aagtcccagttgaatgtcatcccgt

SEQ ID NO: 341002 - DNA, 25 bp, Homo sapien
tctcgcccttaaaggtgcgttgacg

SEQ ID NO: 341003 - DNA, 25 bp, Homo sapien
gaatgtctctttgcgtgacagtgcc

SEQ ID NO: 341004 - DNA, 25 bp, Homo sapien
tgacagtgcctcagcgcacgggcga

SEQ ID NO: 341005 - DNA, 25 bp, Homo sapien
gctcgctctctagctggattcaggt

SEQ ID NO: 341006 - DNA, 25 bp, Homo sapien
ggtggaacggaggaccatgaaccct

SEQ ID NO: 341007 - DNA, 25 bp, Homo sapien
ccatgaaccctctggaccttttctg

SEQ ID NO: 341008 - DNA, 25 bp, Homo sapien
tttctgccttggtcctatgcttgta

SEQ ID NO: 341009 - DNA, 25 bp, Homo sapien
taagaggcccatcgactccttctgc

SEQ ID NO: 341010 - DNA, 25 bp, Homo sapien
tccttctgccttctttcagttgatt

SEQ ID NO: 341011 - DNA, 25 bp, Homo sapien
tgtatgaaataacaagcctagagga

SEQ ID NO: 341012 - DNA, 25 bp, Homo sapien
gttaatagtacactttgagtatctt

SEQ ID NO: 341013 - DNA, 25 bp, Homo sapien
ctttgagtatctttttccacattaa

SEQ ID NO: 341014 - DNA, 25 bp, Homo sapien
ttgagtatctttttccacattaaaa

SEQ ID NO: 341015 - DNA, 25 bp, Homo sapien
tgagtagctgagaaaggggccaccc

SEQ ID NO: 341016 - DNA, 25 bp, Homo sapien
aagagtgaaacatactttataccag

SEQ ID NO: 341017 - DNA, 25 bp, Homo sapien
atactttataccagaggagcagtgg

SEQ ID NO: 341018 - DNA, 25 bp, Homo sapien
ttataccagaggagcagtggagcct

SEQ ID NO: 341019 - DNA, 25 bp, Homo sapien
cagtggagcctcatgcagcacatta

SEQ ID NO: 341020 - DNA, 25 bp, Homo sapien
catgcagcacattatcatttgttat

SEQ ID NO: 341021 - DNA, 25 bp, Homo sapien
gggtttaataataattttgacatct

SEQ ID NO: 341022 - DNA, 25 bp, Homo sapien
gtatgtaatgaattccactgattgt

SEQ ID NO: 341023 - DNA, 25 bp, Homo sapien
tatgtaatgaattccactgattgtc

SEQ ID NO: 341024 - DNA, 25 bp, Homo sapien
gtgttctgtgatattatgtattgtg

SEQ ID NO: 341025 - DNA, 25 bp, Homo sapien
ttccactgattgtcaaaaagaatat

SEQ ID NO: 341026 - DNA, 25 bp, Homo sapien
attcctaggcttgtcaattaagtca

SEQ ID NO: 341027 - DNA, 25 bp, Homo sapien
cctaggcttgtcaattaagtcaaga

SEQ ID NO: 341028 - DNA, 25 bp, Homo sapien
gtcaagaaattgctgagttctactt

SEQ ID NO: 341029 - DNA, 25 bp, Homo sapien
aaattgctgagttctacttattggc

SEQ ID NO: 341030 - DNA, 25 bp, Homo sapien
attgctgagttctacttattggcag

SEQ ID NO: 341031 - DNA, 25 bp, Homo sapien
ctacttattggcagccttcttttaa

SEQ ID NO: 341032 - DNA, 25 bp, Homo sapien
tacttattggcagccttcttttaaa

SEQ ID NO: 341033 - DNA, 25 bp, Homo sapien
cggcgggacatctcctcctggctgg

SEQ ID NO: 341034 - DNA, 25 bp, Homo sapien
tggctggcccagtggttccctagaa

SEQ ID NO: 341035 - DNA, 25 bp, Homo sapien
tagaaccccagccaggtccgtggtg

SEQ ID NO: 341036 - DNA, 25 bp, Homo sapien
caggtccgtggtggccctgaagacc

SEQ ID NO: 341037 - DNA, 25 bp, Homo sapien
ctggtggcagggaaaacctacaggt

SEQ ID NO: 341038 - DNA, 25 bp, Homo sapien
aagaagcagcccttctgtgacggct

SEQ ID NO: 341039 - DNA, 25 bp, Homo sapien
tggcctatctccactcaagttcaag

SEQ ID NO: 341040 - DNA, 25 bp, Homo sapien
aagttcaaggcccaagagacccgca

SEQ ID NO: 341041 - DNA, 25 bp, Homo sapien
gagacccgcatggtggcactctgta

SEQ ID NO: 341042 - DNA, 25 bp, Homo sapien
atggtggcactctgtacctgcaagg

SEQ ID NO: 341043 - DNA, 25 bp, Homo sapien
ctgtacctgcaaggccactcagagg

SEQ ID NO: 341044 - DNA, 25 bp, Homo sapien
attataaattgcatgtgaacttttc

SEQ ID NO: 341045 - DNA, 25 bp, Homo sapien
ataaattgcatgtgaacttttcaac

SEQ ID NO: 341046 - DNA, 25 bp, Homo sapien
atgttaaatactatcatgaattcaa

SEQ ID NO: 341047 - DNA, 25 bp, Homo sapien
tgttaaatactatcatgaattcaat

SEQ ID NO: 341048 - DNA, 25 bp, Homo sapien
gttaaatactatcatgaattcaatg

SEQ ID NO: 341049 - DNA, 25 bp, Homo sapien
tttggtaagataatggactgacatc

SEQ ID NO: 341050 - DNA, 25 bp, Homo sapien
gataatggactgacatctctagtga

SEQ ID NO: 341051 - DNA, 25 bp, Homo sapien
ataatggactgacatctctagtgat

SEQ ID NO: 341052 - DNA, 25 bp, Homo sapien
taatggactgacatctctagtgatt

SEQ ID NO: 341053 - DNA, 25 bp, Homo sapien
tttttgccagtgagttttaattgcc

SEQ ID NO: 341054 - DNA, 25 bp, Homo sapien
tttgccagtgagttttaattgccat

SEQ ID NO: 341055 - DNA, 25 bp, Homo sapien
accaagtgaaacatccaattcctag

SEQ ID NO: 341056 - DNA, 25 bp, Homo sapien
cacctccactaagcaatattggcaa

SEQ ID NO: 341057 - DNA, 25 bp, Homo sapien
gaaagccacacgaagagatgagaat

SEQ ID NO: 341058 - DNA, 25 bp, Homo sapien
gatgagaatgcagccctccgtaata

SEQ ID NO: 341059 - DNA, 25 bp, Homo sapien
atgcagccctccgtaatattgttag

SEQ ID NO: 341060 - DNA, 25 bp, Homo sapien
cagccctccgtaatattgttagtgg

SEQ ID NO: 341061 - DNA, 25 bp, Homo sapien
gtaatattgttagtggaagggctct

SEQ ID NO: 341062 - DNA, 25 bp, Homo sapien
gaagggctctaaaatttgttccctg

SEQ ID NO: 341063 - DNA, 25 bp, Homo sapien
tttgcttttaaacattcgtaggcat

SEQ ID NO: 341064 - DNA, 25 bp, Homo sapien
gtaggcatagctattctttccatca

SEQ ID NO: 341065 - DNA, 25 bp, Homo sapien
atagctattctttccatcagagtgg

SEQ ID NO: 341066 - DNA, 25 bp, Homo sapien
caattagataaaaggaggctgcaca

SEQ ID NO: 341067 - DNA, 25 bp, Homo sapien
aattagataaaaggaggctgcacag

SEQ ID NO: 341068 - DNA, 25 bp, Homo sapien
attagataaaaggaggctgcacagt

SEQ ID NO: 341069 - DNA, 25 bp, Homo sapien
ttagataaaaggaggctgcacagtg

SEQ ID NO: 341070 - DNA, 25 bp, Homo sapien
tagataaaaggaggctgcacagtgg

SEQ ID NO: 341071 - DNA, 25 bp, Homo sapien
gataaaaggaggctgcacagtggct

SEQ ID NO: 341072 - DNA, 25 bp, Homo sapien
ataaaaggaggctgcacagtggctc

SEQ ID NO: 341073 - DNA, 25 bp, Homo sapien
ctggctactcaagaatctgaggcag

SEQ ID NO: 341074 - DNA, 25 bp, Homo sapien
tgtactttagcctggacgacaaagg

SEQ ID NO: 341075 - DNA, 25 bp, Homo sapien
gtactttagcctggacgacaaaggg

SEQ ID NO: 341076 - DNA, 25 bp, Homo sapien
ttagcctggacgacaaagggagact

SEQ ID NO: 341077 - DNA, 25 bp, Homo sapien
aggaacatcatgaaagatacagcaa

SEQ ID NO: 341078 - DNA, 25 bp, Homo sapien
gatacagcaaaatgttttaccccag

SEQ ID NO: 341079 - DNA, 25 bp, Homo sapien
caaaatgttttaccccagcccactg

SEQ ID NO: 341080 - DNA, 25 bp, Homo sapien
cactgcaccacacctgggattgtga

SEQ ID NO: 341081 - DNA, 25 bp, Homo sapien
actgcaccacacctgggattgtgac

SEQ ID NO: 341082 - DNA, 25 bp, Homo sapien
tgcaccacacctgggattgtgacaa

SEQ ID NO: 341083 - DNA, 25 bp, Homo sapien
caccacacctgggattgtgacaatt

SEQ ID NO: 341084 - DNA, 25 bp, Homo sapien
ccacacctgggattgtgacaattaa

SEQ ID NO: 341085 - DNA, 25 bp, Homo sapien
acacctgggattgtgacaattaact

SEQ ID NO: 341086 - DNA, 25 bp, Homo sapien
cctgggattgtgacaattaacttga

SEQ ID NO: 341087 - DNA, 25 bp, Homo sapien
ggattgtgacaattaacttgataaa

SEQ ID NO: 341088 - DNA, 25 bp, Homo sapien
gacctattccatcctggtacatgaa

SEQ ID NO: 341089 - DNA, 25 bp, Homo sapien
caggaattgtttgcttctcgttttt

SEQ ID NO: 341090 - DNA, 25 bp, Homo sapien
tctcgttttttacacagctcaatct

SEQ ID NO: 341091 - DNA, 25 bp, Homo sapien
tacacagctcaatctttgaacaaga

SEQ ID NO: 341092 - DNA, 25 bp, Homo sapien
gattccaagcgattgcagcatctag

SEQ ID NO: 341093 - DNA, 25 bp, Homo sapien
tctgacttcatttctggtaggatct

SEQ ID NO: 341094 - DNA, 25 bp, Homo sapien
ggtaggatctatgggaagcagacat

SEQ ID NO: 341095 - DNA, 25 bp, Homo sapien
aagcagacatctgagggagcaaaca

SEQ ID NO: 341096 - DNA, 25 bp, Homo sapien
tgagggagcaaacagcacaactgat

SEQ ID NO: 341097 - DNA, 25 bp, Homo sapien
gattccattcaagaaccagtagttc

SEQ ID NO: 341098 - DNA, 25 bp, Homo sapien
accagtagttctgttccatagcaga

SEQ ID NO: 341099 - DNA, 25 bp, Homo sapien
tcttccaagaggaaacaggagtacg

SEQ ID NO: 341100 - DNA, 25 bp, Homo sapien
gagtacgggtagaattagcagaaga

SEQ ID NO: 341101 - DNA, 25 bp, Homo sapien
aaaattatggctacgtattgaagat

SEQ ID NO: 341102 - DNA, 25 bp, Homo sapien
tatggctacgtattgaagatattaa

SEQ ID NO: 341103 - DNA, 25 bp, Homo sapien
gtcccagaagatgttgcacaagaaa

SEQ ID NO: 341104 - DNA, 25 bp, Homo sapien
atgttgcacaagaaatggtagagtc

SEQ ID NO: 341105 - DNA, 25 bp, Homo sapien
aatggtagagtctgggtatgtctgt

SEQ ID NO: 341106 - DNA, 25 bp, Homo sapien
gaaggtgatcacaagaccatggcta

SEQ ID NO: 341107 - DNA, 25 bp, Homo sapien
gatcacaagaccatggctaaagcta

SEQ ID NO: 341108 - DNA, 25 bp, Homo sapien
catggctaaagctatcaaagacaga

SEQ ID NO: 341109 - DNA, 25 bp, Homo sapien
ttaagaggaaacgagagcagcggca

SEQ ID NO: 341110 - DNA, 25 bp, Homo sapien
tagtctaccagcctccttaaacctg

SEQ ID NO: 341111 - DNA, 25 bp, Homo sapien
aggcccttgtgcgtttgcacaatgt

SEQ ID NO: 341112 - DNA, 25 bp, Homo sapien
tccttgcactcatcactgctaatga

SEQ ID NO: 341113 - DNA, 25 bp, Homo sapien
acaatgtttgtgtgctggaaactga

SEQ ID NO: 341114 - DNA, 25 bp, Homo sapien
ggctagaagtccataggctttgtaa

SEQ ID NO: 341115 - DNA, 25 bp, Homo sapien
gctttgtaaagagtgtcagtgccaa

SEQ ID NO: 341116 - DNA, 25 bp, Homo sapien
gtgtcagtgccaatcaggacccatg

SEQ ID NO: 341117 - DNA, 25 bp, Homo sapien
gacccatgccttcctctggaggaga

SEQ ID NO: 341118 - DNA, 25 bp, Homo sapien
gaaagcaacgtgactgtttctacag

SEQ ID NO: 341119 - DNA, 25 bp, Homo sapien
ctgtttctacaggtcatctaagaga

SEQ ID NO: 341120 - DNA, 25 bp, Homo sapien
attttggtgaccaggtaatccagat

SEQ ID NO: 341121 - DNA, 25 bp, Homo sapien
cctcctctagggaggtgatgaggaa

SEQ ID NO: 341122 - DNA, 25 bp, Homo sapien
gcgggaatgcgcagccagggctgag

SEQ ID NO: 341123 - DNA, 25 bp, Homo sapien
tgagagcagccaaggcacagaggat

SEQ ID NO: 341124 - DNA, 25 bp, Homo sapien
aagtgatcacactgacgcaaggcct

SEQ ID NO: 341125 - DNA, 25 bp, Homo sapien
atcacactgacgcaaggcctggaac

SEQ ID NO: 341126 - DNA, 25 bp, Homo sapien
aaggcctggaacctgggtcagtctt

SEQ ID NO: 341127 - DNA, 25 bp, Homo sapien
aacctgggtcagtcttgcttcaaat

SEQ ID NO: 341128 - DNA, 25 bp, Homo sapien
gggtcagtcttgcttcaaatctagg

SEQ ID NO: 341129 - DNA, 25 bp, Homo sapien
gtcttgcttcaaatctagggctctt

SEQ ID NO: 341130 - DNA, 25 bp, Homo sapien
tgcttcaaatctagggctctttcca

SEQ ID NO: 341131 - DNA, 25 bp, Homo sapien
aaatctagggctctttccacgctgc

SEQ ID NO: 341132 - DNA, 25 bp, Homo sapien
cctttggaaacacaatatggtacta

SEQ ID NO: 341133 - DNA, 25 bp, Homo sapien
ttggaaacacaatatggtactacat

SEQ ID NO: 341134 - DNA, 25 bp, Homo sapien
gaaacacaatatggtactacatagc

SEQ ID NO: 341135 - DNA, 25 bp, Homo sapien
aatatggtactacatagcaagggct

SEQ ID NO: 341136 - DNA, 25 bp, Homo sapien
tatggtactacatagcaagggctgt

SEQ ID NO: 341137 - DNA, 25 bp, Homo sapien
atggtactacatagcaagggctgta

SEQ ID NO: 341138 - DNA, 25 bp, Homo sapien
tggtactacatagcaagggctgtaa

SEQ ID NO: 341139 - DNA, 25 bp, Homo sapien
ggtactacatagcaagggctgtaaa

SEQ ID NO: 341140 - DNA, 25 bp, Homo sapien
tactacatagcaagggctgtaaaaa

SEQ ID NO: 341141 - DNA, 25 bp, Homo sapien
tagcaagggctgtaaaaatgaccat

SEQ ID NO: 341142 - DNA, 25 bp, Homo sapien
gcaagggctgtaaaaatgaccatat

SEQ ID NO: 341143 - DNA, 25 bp, Homo sapien
gacctggaaacagatattagacctg

SEQ ID NO: 341144 - DNA, 25 bp, Homo sapien
gatattagacctgcactaagcatgt

SEQ ID NO: 341145 - DNA, 25 bp, Homo sapien
gacctgcactaagcatgtgtggtta

SEQ ID NO: 341146 - DNA, 25 bp, Homo sapien
aagcatgtgtggttattgaacagta

SEQ ID NO: 341147 - DNA, 25 bp, Homo sapien
aaaaatgccaccacaaattgcgata

SEQ ID NO: 341148 - DNA, 25 bp, Homo sapien
gccaccacaaattgcgatatgatgt

SEQ ID NO: 341149 - DNA, 25 bp, Homo sapien
gtaaaatgcgtactggctattgaag

SEQ ID NO: 341150 - DNA, 25 bp, Homo sapien
gtactggctattgaagacttggcac

SEQ ID NO: 341151 - DNA, 25 bp, Homo sapien
tgaagacttggcacagaaaaataat

SEQ ID NO: 341152 - DNA, 25 bp, Homo sapien
ggttttatattgattacgcattgaa

SEQ ID NO: 341153 - DNA, 25 bp, Homo sapien
taatactattttggacagattgggt

SEQ ID NO: 341154 - DNA, 25 bp, Homo sapien
gctgcggaggcaacagcaacaactt

SEQ ID NO: 341155 - DNA, 25 bp, Homo sapien
gcaagttcacctgattttctaacaa

SEQ ID NO: 341156 - DNA, 25 bp, Homo sapien
tttctaacaagaacacagccctcca

SEQ ID NO: 341157 - DNA, 25 bp, Homo sapien
aagaacacagccctccatggattcg

SEQ ID NO: 341158 - DNA, 25 bp, Homo sapien
agccctccatggattcgggattgct

SEQ ID NO: 341159 - DNA, 25 bp, Homo sapien
gaacaagaggttcattcctctaccc

SEQ ID NO: 341160 - DNA, 25 bp, Homo sapien
tgatgtgctcctacaagtgcttcat

SEQ ID NO: 341161 - DNA, 25 bp, Homo sapien
ctcctacaagtgcttcatctctgtg

SEQ ID NO: 341162 - DNA, 25 bp, Homo sapien
gggcccttgtcaaacctacatgacg

SEQ ID NO: 341163 - DNA, 25 bp, Homo sapien
gtcaaacctacatgacgcgatggtt

SEQ ID NO: 341164 - DNA, 25 bp, Homo sapien
catgacgcgatggtttttcaacttt

SEQ ID NO: 341165 - DNA, 25 bp, Homo sapien
aagactccagatggagccatccgca

SEQ ID NO: 341166 - DNA, 25 bp, Homo sapien
tccgcatggtaggtgagtggcatct

SEQ ID NO: 341167 - DNA, 25 bp, Homo sapien
ctcccaaggtatgcaaagccatcat

SEQ ID NO: 341168 - DNA, 25 bp, Homo sapien
gagggcctagggtaccgctgctccc

SEQ ID NO: 341169 - DNA, 25 bp, Homo sapien
gagctctggagcactgatcaggagt

SEQ ID NO: 341170 - DNA, 25 bp, Homo sapien
tgatcaggagtgtcgcatgtgtccg

SEQ ID NO: 341171 - DNA, 25 bp, Homo sapien
atgtgtccggttgctttcgaatgca

SEQ ID NO: 341172 - DNA, 25 bp, Homo sapien
tgctttcgaatgcaggaggcgacaa

SEQ ID NO: 341173 - DNA, 25 bp, Homo sapien
gcgacaagtactagtggctcactca

SEQ ID NO: 341174 - DNA, 25 bp, Homo sapien
actcagagacccttggcactttctt

SEQ ID NO: 341175 - DNA, 25 bp, Homo sapien
ccttggcactttcttcagggaagct

SEQ ID NO: 341176 - DNA, 25 bp, Homo sapien
actgaagcggcgactgcgatcgtca

SEQ ID NO: 341177 - DNA, 25 bp, Homo sapien
gactgcgatcgtcactgactctatc

SEQ ID NO: 341178 - DNA, 25 bp, Homo sapien
actctatccccgaagtcactagttc

SEQ ID NO: 341179 - DNA, 25 bp, Homo sapien
gaagtcactagttcgcgggtcccga

SEQ ID NO: 341180 - DNA, 25 bp, Homo sapien
tcgcgggtcccgaatgtcactgact

SEQ ID NO: 341181 - DNA, 25 bp, Homo sapien
ccaaggaccactgaggcggaggcct

SEQ ID NO: 341182 - DNA, 25 bp, Homo sapien
gagtcggtagtttggtggcctccaa

SEQ ID NO: 341183 - DNA, 25 bp, Homo sapien
gtttggtggcctccaacttcactaa

SEQ ID NO: 341184 - DNA, 25 bp, Homo sapien
attcacgtcgctgctgcagaaggtg

SEQ ID NO: 341185 - DNA, 25 bp, Homo sapien
tgcagaaggtgctgtctcccctaac

SEQ ID NO: 341186 - DNA, 25 bp, Homo sapien
tgactgtggccactatctcccctaa

SEQ ID NO: 341187 - DNA, 25 bp, Homo sapien
agtttagcttatttctggtaggcat

SEQ ID NO: 341188 - DNA, 25 bp, Homo sapien
aactaaggttattttgacaatgctg

SEQ ID NO: 341189 - DNA, 25 bp, Homo sapien
ggaagagagacactttactacaggt

SEQ ID NO: 341190 - DNA, 25 bp, Homo sapien
gagacactttactacaggtaataat

SEQ ID NO: 341191 - DNA, 25 bp, Homo sapien
gtaataatttaaaggccttccatgt

SEQ ID NO: 341192 - DNA, 25 bp, Homo sapien
ccatgtacagtcattgtgccagaaa

SEQ ID NO: 341193 - DNA, 25 bp, Homo sapien
gaatataatacaatgccacaccttt

SEQ ID NO: 341194 - DNA, 25 bp, Homo sapien
atacaatgccacacctttggtcttg

SEQ ID NO: 341195 - DNA, 25 bp, Homo sapien
aatgccacacctttggtcttgtagt

SEQ ID NO: 341196 - DNA, 25 bp, Homo sapien
cacacctttggtcttgtagtctata

SEQ ID NO: 341197 - DNA, 25 bp, Homo sapien
acctttggtcttgtagtctataatg

SEQ ID NO: 341198 - DNA, 25 bp, Homo sapien
ttcagaggcccatgttgcagttcat

SEQ ID NO: 341199 - DNA, 25 bp, Homo sapien
gcagttcatggcaaagttttaccca

SEQ ID NO: 341200 - DNA, 25 bp, Homo sapien
aacatttagtcatagcaagccatat

SEQ ID NO: 341201 - DNA, 25 bp, Homo sapien
aaattattgtctgcaactggtatca

SEQ ID NO: 341202 - DNA, 25 bp, Homo sapien
gactgtagaccccaatggtgcatct

SEQ ID NO: 341203 - DNA, 25 bp, Homo sapien
ggtgcatctgtttacaatctttctt

SEQ ID NO: 341204 - DNA, 25 bp, Homo sapien
tccaaggttttaaggttcatgaata

SEQ ID NO: 341205 - DNA, 25 bp, Homo sapien
gggagagctaccacatcagtacttt

SEQ ID NO: 341206 - DNA, 25 bp, Homo sapien
acatcagtactttggcacgcattaa

SEQ ID NO: 341207 - DNA, 25 bp, Homo sapien
tggcacgcattaactgttccacagg

SEQ ID NO: 341208 - DNA, 25 bp, Homo sapien
aactagggttgcttcagggctattt

SEQ ID NO: 341209 - DNA, 25 bp, Homo sapien
tgttgtgcagcttctcttttcacat

SEQ ID NO: 341210 - DNA, 25 bp, Homo sapien
tgagtacgtaagatgggcacctgag

SEQ ID NO: 341211 - DNA, 25 bp, Homo sapien
tcccggccaatgttattctttcctc

SEQ ID NO: 341212 - DNA, 25 bp, Homo sapien
ggcacctgagtagtttgctgttaca

SEQ ID NO: 341213 - DNA, 25 bp, Homo sapien
tgctgttacagaccacgtaggcaat

SEQ ID NO: 341214 - DNA, 25 bp, Homo sapien
agaccacgtaggcaatggccgcctg

SEQ ID NO: 341215 - DNA, 25 bp, Homo sapien
tggccgcctgcacagattatttgca

SEQ ID NO: 341216 - DNA, 25 bp, Homo sapien
ttatttgcacaggtgggagtatcat

SEQ ID NO: 341217 - DNA, 25 bp, Homo sapien
ggagtatcattagatgtttctggaa

SEQ ID NO: 341218 - DNA, 25 bp, Homo sapien
ataagcccttccagagcacaaacac

SEQ ID NO: 341219 - DNA, 25 bp, Homo sapien
caagcacgtatgtttgtcttctttt

SEQ ID NO: 341220 - DNA, 25 bp, Homo sapien
gttcttgtgtccatgggagatgcaa

SEQ ID NO: 341221 - DNA, 25 bp, Homo sapien
gacccttgggagatggctcctgtga

SEQ ID NO: 341222 - DNA, 25 bp, Homo sapien
gctcctgtgactgtgatgttggctg

SEQ ID NO: 341223 - DNA, 25 bp, Homo sapien
ctggcgaggagtgcattgtgacaat

SEQ ID NO: 341224 - DNA, 25 bp, Homo sapien
gacaatggtaagagtgaggcctcca

SEQ ID NO: 341225 - DNA, 25 bp, Homo sapien
gtgaggcctccagtatttataatct

SEQ ID NO: 341226 - DNA, 25 bp, Homo sapien
tttataatctgctctaagctttgct

SEQ ID NO: 341227 - DNA, 25 bp, Homo sapien
aagctttgcttctcagcagctacat

SEQ ID NO: 341228 - DNA, 25 bp, Homo sapien
tacttcttctggcaataaacatgat

SEQ ID NO: 341229 - DNA, 25 bp, Homo sapien
gaacatgggttagaatctgacgatt

SEQ ID NO: 341230 - DNA, 25 bp, Homo sapien
gaatctgacgatttgcaggtgattt

SEQ ID NO: 341231 - DNA, 25 bp, Homo sapien
gaagcatatcaatcgatgtctttgt

SEQ ID NO: 341232 - DNA, 25 bp, Homo sapien
gatgtctttgtcagtcattctgtga

SEQ ID NO: 341233 - DNA, 25 bp, Homo sapien
cattctgtgaccaaccaggagcggg

SEQ ID NO: 341234 - DNA, 25 bp, Homo sapien
ggatggctttgctctagattctggc

SEQ ID NO: 341235 - DNA, 25 bp, Homo sapien
gctttgctctagattctggcagcca

SEQ ID NO: 341236 - DNA, 25 bp, Homo sapien
tggcagccagtagaaaccatctcta

SEQ ID NO: 341237 - DNA, 25 bp, Homo sapien
aaccatctctagaaaccatctcatc

SEQ ID NO: 341238 - DNA, 25 bp, Homo sapien
gaaaccatctcatctttatccataa

SEQ ID NO: 341239 - DNA, 25 bp, Homo sapien
gagcacagtgttctctagacatgta

SEQ ID NO: 341240 - DNA, 25 bp, Homo sapien
ctctagacatgtagatctgccacat

SEQ ID NO: 341241 - DNA, 25 bp, Homo sapien
ctgccacatggcaaagctatatcat

SEQ ID NO: 341242 - DNA, 25 bp, Homo sapien
aaccacaatgcatggccgggcgtgg

SEQ ID NO: 341243 - DNA, 25 bp, Homo sapien
accacaatgcatggccgggcgtggt

SEQ ID NO: 341244 - DNA, 25 bp, Homo sapien
ccacaatgcatggccgggcgtggtg

SEQ ID NO: 341245 - DNA, 25 bp, Homo sapien
cacaatgcatggccgggcgtggtgg

SEQ ID NO: 341246 - DNA, 25 bp, Homo sapien
aaaatatgtaaattagtcgggcgtg

SEQ ID NO: 341247 - DNA, 25 bp, Homo sapien
agtcgggcgtggtgtcacgtgcctg

SEQ ID NO: 341248 - DNA, 25 bp, Homo sapien
gtcgggcgtggtgtcacgtgcctgt

SEQ ID NO: 341249 - DNA, 25 bp, Homo sapien
tcgggcgtggtgtcacgtgcctgta

SEQ ID NO: 341250 - DNA, 25 bp, Homo sapien
cgggcgtggtgtcacgtgcctgtaa

SEQ ID NO: 341251 - DNA, 25 bp, Homo sapien
gggcgtggtgtcacgtgcctgtaat

SEQ ID NO: 341252 - DNA, 25 bp, Homo sapien
ggcgtggtgtcacgtgcctgtaatc

SEQ ID NO: 341253 - DNA, 25 bp, Homo sapien
ctaagacagcacaagtttacctttg

SEQ ID NO: 341254 - DNA, 25 bp, Homo sapien
aaattttttattgagcagcacttaa

SEQ ID NO: 341255 - DNA, 25 bp, Homo sapien
gaaccaaaaagcaaatacatgcctc

SEQ ID NO: 341256 - DNA, 25 bp, Homo sapien
atgcctcaaaaaatcactgaatcta

SEQ ID NO: 341257 - DNA, 25 bp, Homo sapien
gttttgaagaaattagcagttctct

SEQ ID NO: 341258 - DNA, 25 bp, Homo sapien
gttctctaatattcaagcaactatg

SEQ ID NO: 341259 - DNA, 25 bp, Homo sapien
tattcaagcaactatgcccaaatca

SEQ ID NO: 341260 - DNA, 25 bp, Homo sapien
tgcccaaatcagcattagcccattt

SEQ ID NO: 341261 - DNA, 25 bp, Homo sapien
gcattagcccatttaaatatccctg

SEQ ID NO: 341262 - DNA, 25 bp, Homo sapien
agcccatttaaatatccctgatcag

SEQ ID NO: 341263 - DNA, 25 bp, Homo sapien
ttaaatatccctgatcagctggatt

SEQ ID NO: 341264 - DNA, 25 bp, Homo sapien
gggtgcttattgctgctccatacag

SEQ ID NO: 341265 - DNA, 25 bp, Homo sapien
atacagctgtacgtcagccccttgg

SEQ ID NO: 341266 - DNA, 25 bp, Homo sapien
ttctctgtaggttcttggcagcaat

SEQ ID NO: 341267 - DNA, 25 bp, Homo sapien
ttggcagcaatgagcagctttcact

SEQ ID NO: 341268 - DNA, 25 bp, Homo sapien
gagcagctttcactcagtgacacaa

SEQ ID NO: 341269 - DNA, 25 bp, Homo sapien
aattactgagtcctaatttgatagc

SEQ ID NO: 341270 - DNA, 25 bp, Homo sapien
atttgatagccaccaactgtacctg

SEQ ID NO: 341271 - DNA, 25 bp, Homo sapien
atagccaccaactgtacctgggtag

SEQ ID NO: 341272 - DNA, 25 bp, Homo sapien
tacctgggtaggcaaagtcagattt

SEQ ID NO: 341273 - DNA, 25 bp, Homo sapien
ttttatgctttcctctgtcttgtaa

SEQ ID NO: 341274 - DNA, 25 bp, Homo sapien
ctgtcttgtaatcttttctcttctt

SEQ ID NO: 341275 - DNA, 25 bp, Homo sapien
tgtgggatggtacagccagctcact

SEQ ID NO: 341276 - DNA, 25 bp, Homo sapien
ggtacagccagctcactgaagcaaa

SEQ ID NO: 341277 - DNA, 25 bp, Homo sapien
gaagcaaaatatcctttgtcggaaa

SEQ ID NO: 341278 - DNA, 25 bp, Homo sapien
tcctttgtcggaaaactttccacag

SEQ ID NO: 341279 - DNA, 25 bp, Homo sapien
agggaataacagacctgcgcagtag

SEQ ID NO: 341280 - DNA, 25 bp, Homo sapien
agacctgcgcagtagatttcacttt

SEQ ID NO: 341281 - DNA, 25 bp, Homo sapien
gatttcactttgatatggcccctgt

SEQ ID NO: 341282 - DNA, 25 bp, Homo sapien
tgctggcccagtatggactgcaggt

SEQ ID NO: 341283 - DNA, 25 bp, Homo sapien
ccagtatggactgcaggttgacttt

SEQ ID NO: 341284 - DNA, 25 bp, Homo sapien
caggttgactttgcaggattccaga

SEQ ID NO: 341285 - DNA, 25 bp, Homo sapien
ttgcaggattccagatgacagtcat

SEQ ID NO: 341286 - DNA, 25 bp, Homo sapien
gaacgtgtcaagaatgaccccaggt

SEQ ID NO: 341287 - DNA, 25 bp, Homo sapien
ttctcttcaacacccaagccaaaag

SEQ ID NO: 341288 - DNA, 25 bp, Homo sapien
ccaagccaaaagctactttgagcct

SEQ ID NO: 341289 - DNA, 25 bp, Homo sapien
tgcagctgggccttgatgagcacaa

SEQ ID NO: 341290 - DNA, 25 bp, Homo sapien
tgggccttgatgagcacaacagagt

SEQ ID NO: 341291 - DNA, 25 bp, Homo sapien
cacaacagagtgaaggtgtatcgct

SEQ ID NO: 341292 - DNA, 25 bp, Homo sapien
gaaggtgtatcgcttctgaggccct

SEQ ID NO: 341293 - DNA, 25 bp, Homo sapien
ttccatctgagaaagcaccctcctt

SEQ ID NO: 341294 - DNA, 25 bp, Homo sapien
ctttgacttgcaggagccaccaggg

SEQ ID NO: 341295 - DNA, 25 bp, Homo sapien
ggttgagtggaacagtaaagccaca

SEQ ID NO: 341296 - DNA, 25 bp, Homo sapien
gtaaagccacacattctgtgactat

SEQ ID NO: 341297 - DNA, 25 bp, Homo sapien
gacccaaacaaatttgtgtccacat

SEQ ID NO: 341298 - DNA, 25 bp, Homo sapien
ttgtgtccacattctgattctgcca

SEQ ID NO: 341299 - DNA, 25 bp, Homo sapien
tgattctgccatttactctccatgc

SEQ ID NO: 341300 - DNA, 25 bp, Homo sapien
atgtgcccctgggtgcgtttcttaa

SEQ ID NO: 341301 - DNA, 25 bp, Homo sapien
ctgggtgcgtttcttaaccactctg

SEQ ID NO: 341302 - DNA, 25 bp, Homo sapien
ctagatctattcacttgtaacaaat

SEQ ID NO: 341303 - DNA, 25 bp, Homo sapien
tgaacttcggttcttaatgcttaaa

SEQ ID NO: 341304 - DNA, 25 bp, Homo sapien
tatagaatctttgggagtattacac

SEQ ID NO: 341305 - DNA, 25 bp, Homo sapien
gtctggagcctagaaaacgctcact

SEQ ID NO: 341306 - DNA, 25 bp, Homo sapien
aaggaggccagacactcgatacaat

SEQ ID NO: 341307 - DNA, 25 bp, Homo sapien
agaacacaggattcagacccaaaca

SEQ ID NO: 341308 - DNA, 25 bp, Homo sapien
tgtctcccaattactgccctttgtt

SEQ ID NO: 341309 - DNA, 25 bp, Homo sapien
ttgcttgagggttttacttggagaa

SEQ ID NO: 341310 - DNA, 25 bp, Homo sapien
acttggagaattacctccctggcac

SEQ ID NO: 341311 - DNA, 25 bp, Homo sapien
atactcaggctgaacatgcttctct

SEQ ID NO: 341312 - DNA, 25 bp, Homo sapien
ctgaacatgcttctctggccagaga

SEQ ID NO: 341313 - DNA, 25 bp, Homo sapien
ttcaggcagagaaactcaggaactt

SEQ ID NO: 341314 - DNA, 25 bp, Homo sapien
aaaccatatgagaactgtccaccaa

SEQ ID NO: 341315 - DNA, 25 bp, Homo sapien
tgtccaccaaagctgccatagaact

SEQ ID NO: 341316 - DNA, 25 bp, Homo sapien
ccatagaactttggcttgggctaag

SEQ ID NO: 341317 - DNA, 25 bp, Homo sapien
gaagttacaaaccttatgtgcataa

SEQ ID NO: 341318 - DNA, 25 bp, Homo sapien
aagcactgacatctcagatcagaaa

SEQ ID NO: 341319 - DNA, 25 bp, Homo sapien
gacttaccctgcttcttatatttta

SEQ ID NO: 341320 - DNA, 25 bp, Homo sapien
taacatcatttgtctctcaagttga

SEQ ID NO: 341321 - DNA, 25 bp, Homo sapien
tgttacttacctttgtaggccctct

SEQ ID NO: 341322 - DNA, 25 bp, Homo sapien
tttgtaggccctctagtaactagct

SEQ ID NO: 341323 - DNA, 25 bp, Homo sapien
gtaactagcttgtcagtgttgaaat

SEQ ID NO: 341324 - DNA, 25 bp, Homo sapien
taaaatctctcacactttaacgttt

SEQ ID NO: 341325 - DNA, 25 bp, Homo sapien
ttatcacacctcaatctttagccat

SEQ ID NO: 341326 - DNA, 25 bp, Homo sapien
ataagtgtggaccttgctctgatgc

SEQ ID NO: 341327 - DNA, 25 bp, Homo sapien
gaccttgctctgatgccaaagtttg

SEQ ID NO: 341328 - DNA, 25 bp, Homo sapien
ttagccatactaacctgtcattcct

SEQ ID NO: 341329 - DNA, 25 bp, Homo sapien
aaatcacaaacctgacttaccctgc

SEQ ID NO: 341330 - DNA, 25 bp, Homo sapien
gcagcatgacattaacattaggatt

SEQ ID NO: 341331 - DNA, 25 bp, Homo sapien
acattaggattgatagcactagtct

SEQ ID NO: 341332 - DNA, 25 bp, Homo sapien
gatgttggtttttacacagctcatt

SEQ ID NO: 341333 - DNA, 25 bp, Homo sapien
ttacacagctcatttcatttttcac

SEQ ID NO: 341334 - DNA, 25 bp, Homo sapien
ttcatttttcactagaaagccagtt

SEQ ID NO: 341335 - DNA, 25 bp, Homo sapien
tgaaagagagctggcctaggcatcc

SEQ ID NO: 341336 - DNA, 25 bp, Homo sapien
caactggaaaaccttaggctggtgt

SEQ ID NO: 341337 - DNA, 25 bp, Homo sapien
ttaggctggtgtttacacatccctg

SEQ ID NO: 341338 - DNA, 25 bp, Homo sapien
ctggtgtttacacatccctgagcct

SEQ ID NO: 341339 - DNA, 25 bp, Homo sapien
atctgcaaaacggtgtgaatagtaa

SEQ ID NO: 341340 - DNA, 25 bp, Homo sapien
gaatagtaatccctgtgctgcttat

SEQ ID NO: 341341 - DNA, 25 bp, Homo sapien
tgaaaccccatctctgtattttgta

SEQ ID NO: 341342 - DNA, 25 bp, Homo sapien
gaaaccccatctctgtattttgtat

SEQ ID NO: 341343 - DNA, 25 bp, Homo sapien
aaaccccatctctgtattttgtatt

SEQ ID NO: 341344 - DNA, 25 bp, Homo sapien
aaccccatctctgtattttgtattt

SEQ ID NO: 341345 - DNA, 25 bp, Homo sapien
accccatctctgtattttgtatttg

SEQ ID NO: 341346 - DNA, 25 bp, Homo sapien
ccccatctctgtattttgtatttgt

SEQ ID NO: 341347 - DNA, 25 bp, Homo sapien
cccatctctgtattttgtatttgta

SEQ ID NO: 341348 - DNA, 25 bp, Homo sapien
ccatctctgtattttgtatttgtaa

SEQ ID NO: 341349 - DNA, 25 bp, Homo sapien
aaaattacctgagcgtggtggcacg

SEQ ID NO: 341350 - DNA, 25 bp, Homo sapien
aaattacctgagcgtggtggcacgc

SEQ ID NO: 341351 - DNA, 25 bp, Homo sapien
aattacctgagcgtggtggcacgca

SEQ ID NO: 341352 - DNA, 25 bp, Homo sapien
agggccaggcatgtattcctcagag

SEQ ID NO: 341353 - DNA, 25 bp, Homo sapien
caggcatgtattcctcagaggcgaa

SEQ ID NO: 341354 - DNA, 25 bp, Homo sapien
gcatgtattcctcagaggcgaaact

SEQ ID NO: 341355 - DNA, 25 bp, Homo sapien
aggcgaaactgccaaactctttctc

SEQ ID NO: 341356 - DNA, 25 bp, Homo sapien
gaaactgccaaactctttctcctgt

SEQ ID NO: 341357 - DNA, 25 bp, Homo sapien
aaactctttctcctgtcttgggttg

SEQ ID NO: 341358 - DNA, 25 bp, Homo sapien
ttctcctgtcttgggttggctggca

SEQ ID NO: 341359 - DNA, 25 bp, Homo sapien
gggcgggcatctagggtacagcctc

SEQ ID NO: 341360 - DNA, 25 bp, Homo sapien
tctgctcatggcactgggcctccag

SEQ ID NO: 341361 - DNA, 25 bp, Homo sapien
ctccagttcttccacatgtgtgcac

SEQ ID NO: 341362 - DNA, 25 bp, Homo sapien
agccctcagacttcggagcctgcgc

SEQ ID NO: 341363 - DNA, 25 bp, Homo sapien
ctgttcactgaatttgactgactaa

SEQ ID NO: 341364 - DNA, 25 bp, Homo sapien
agaagtatgaactcagcaactgcct

SEQ ID NO: 341365 - DNA, 25 bp, Homo sapien
agtatgaactcagcaactgcctact

SEQ ID NO: 341366 - DNA, 25 bp, Homo sapien
gcaactgcctactgtgtaataggac

SEQ ID NO: 341367 - DNA, 25 bp, Homo sapien
gcctactgtgtaataggacctttaa

SEQ ID NO: 341368 - DNA, 25 bp, Homo sapien
ggacctttaactaaatcacatacaa

SEQ ID NO: 341369 - DNA, 25 bp, Homo sapien
taaactttgcttgaagtggatgaat

SEQ ID NO: 341370 - DNA, 25 bp, Homo sapien
taaacaaattccatggctgtttcaa

SEQ ID NO: 341371 - DNA, 25 bp, Homo sapien
gggagaagtattagttcaggagcta

SEQ ID NO: 341372 - DNA, 25 bp, Homo sapien
ttcaggagctagaaattgcacagat

SEQ ID NO: 341373 - DNA, 25 bp, Homo sapien
tgcacagatatttagatcctaagtt

SEQ ID NO: 341374 - DNA, 25 bp, Homo sapien
tgcccaagtcatctgggaggcagct

SEQ ID NO: 341375 - DNA, 25 bp, Homo sapien
aggcagctggccatctacgtctgaa

SEQ ID NO: 341376 - DNA, 25 bp, Homo sapien
tggccatctacgtctgaagtgcagg

SEQ ID NO: 341377 - DNA, 25 bp, Homo sapien
agggagactcagaccccgggaatat

SEQ ID NO: 341378 - DNA, 25 bp, Homo sapien
aatatctccggagccatcagctgaa

SEQ ID NO: 341379 - DNA, 25 bp, Homo sapien
agagggtgaaccctccagtaaatgg

SEQ ID NO: 341380 - DNA, 25 bp, Homo sapien
gttgagtccctcatgtttccctgtc

SEQ ID NO: 341381 - DNA, 25 bp, Homo sapien
cctgtccttagtgtgccgtgaagtc

SEQ ID NO: 341382 - DNA, 25 bp, Homo sapien
tagtgtgccgtgaagtccttcccag

SEQ ID NO: 341383 - DNA, 25 bp, Homo sapien
tcacatgaagcctttctcgttttat

SEQ ID NO: 341384 - DNA, 25 bp, Homo sapien
tattttactcccttcgtgtctccca

SEQ ID NO: 341385 - DNA, 25 bp, Homo sapien
ggcccctgggtttcaaaagactgtg

SEQ ID NO: 341386 - DNA, 25 bp, Homo sapien
gtttcaaaagactgtgacttccacc

SEQ ID NO: 341387 - DNA, 25 bp, Homo sapien
ttgtggtttccccactcactgacta

SEQ ID NO: 341388 - DNA, 25 bp, Homo sapien
gctcggtctgatgaaggaactttga

SEQ ID NO: 341389 - DNA, 25 bp, Homo sapien
ctgtgaactttgctgtgagctgccc

SEQ ID NO: 341390 - DNA, 25 bp, Homo sapien
tttgctgtgagctgccctgtgatgg

SEQ ID NO: 341391 - DNA, 25 bp, Homo sapien
tggaggacctcaatgctgccaacgt

SEQ ID NO: 341392 - DNA, 25 bp, Homo sapien
aatgctgccaacgtgtgaccagatg

SEQ ID NO: 341393 - DNA, 25 bp, Homo sapien
gtgtgaccagatgcagatccttctc

SEQ ID NO: 341394 - DNA, 25 bp, Homo sapien
gaagaatctttgcatctgtagctca

SEQ ID NO: 341395 - DNA, 25 bp, Homo sapien
atctgtagctcaacaggcttctctc

SEQ ID NO: 341396 - DNA, 25 bp, Homo sapien
agcctggaactggactccaagggag

SEQ ID NO: 341397 - DNA, 25 bp, Homo sapien
gactccaagggaggcaggaccatgt

SEQ ID NO: 341398 - DNA, 25 bp, Homo sapien
catgtggctaagtgcaagtatcccc

SEQ ID NO: 341399 - DNA, 25 bp, Homo sapien
gggacctttctcactgtaacaggga

SEQ ID NO: 341400 - DNA, 25 bp, Homo sapien
taacagggaccggagctggtgctcc

SEQ ID NO: 341401 - DNA, 25 bp, Homo sapien
caaggtgtctgtccctcagcatttc

SEQ ID NO: 341402 - DNA, 25 bp, Homo sapien
gcatttcctcaaacgccacacggga

SEQ ID NO: 341403 - DNA, 25 bp, Homo sapien
ccacacgggacatgctgcgcggcag

SEQ ID NO: 341404 - DNA, 25 bp, Homo sapien
tcctctcagttttacggtttttgtg

SEQ ID NO: 341405 - DNA, 25 bp, Homo sapien
ggtttttgtgaacttgtctcaccca

SEQ ID NO: 341406 - DNA, 25 bp, Homo sapien
ttgtctcacccactcagtaagggag

SEQ ID NO: 341407 - DNA, 25 bp, Homo sapien
ggtgggagctgggaatgttattctg

SEQ ID NO: 341408 - DNA, 25 bp, Homo sapien
gtgggagctgggaatgttattctgg

SEQ ID NO: 341409 - DNA, 25 bp, Homo sapien
aaagcaatccttgctaagaagaact

SEQ ID NO: 341410 - DNA, 25 bp, Homo sapien
aagcaatccttgctaagaagaactt

SEQ ID NO: 341411 - DNA, 25 bp, Homo sapien
agcaatccttgctaagaagaacttg

SEQ ID NO: 341412 - DNA, 25 bp, Homo sapien
gcaatccttgctaagaagaacttga

SEQ ID NO: 341413 - DNA, 25 bp, Homo sapien
caatccttgctaagaagaacttgat

SEQ ID NO: 341414 - DNA, 25 bp, Homo sapien
aatccttgctaagaagaacttgatt

SEQ ID NO: 341415 - DNA, 25 bp, Homo sapien
atacagttgcttctcaagaaaacca

SEQ ID NO: 341416 - DNA, 25 bp, Homo sapien
taattattgtagcttcatgagaggt

SEQ ID NO: 341417 - DNA, 25 bp, Homo sapien
ttgtagcttcatgagaggtttgttc

SEQ ID NO: 341418 - DNA, 25 bp, Homo sapien
aaagagaagacaacagaattacaga

SEQ ID NO: 341419 - DNA, 25 bp, Homo sapien
tcatgagaggtttgttcatgttcct

SEQ ID NO: 341420 - DNA, 25 bp, Homo sapien
gttcatgttccttaatttgtagagt

SEQ ID NO: 341421 - DNA, 25 bp, Homo sapien
tgttccttaatttgtagagtttcta

SEQ ID NO: 341422 - DNA, 25 bp, Homo sapien
gtttctaattgtcttgagtctctcg

SEQ ID NO: 341423 - DNA, 25 bp, Homo sapien
aattgtcttgagtctctcgggtaca

SEQ ID NO: 341424 - DNA, 25 bp, Homo sapien
tgagtctctcgggtacaggcttaag

SEQ ID NO: 341425 - DNA, 25 bp, Homo sapien
gtctctcgggtacaggcttaaggat

SEQ ID NO: 341426 - DNA, 25 bp, Homo sapien
ctcgggtacaggcttaaggattgat

SEQ ID NO: 341427 - DNA, 25 bp, Homo sapien
gctggcggcgctgacacacatgcat

SEQ ID NO: 341428 - DNA, 25 bp, Homo sapien
acacatgcatggcagactatccctg

SEQ ID NO: 341429 - DNA, 25 bp, Homo sapien
atggcagactatccctggctctatc

SEQ ID NO: 341430 - DNA, 25 bp, Homo sapien
aaaattccatgtttcctaatttgca

SEQ ID NO: 341431 - DNA, 25 bp, Homo sapien
aatttgcacgaaattttctaccaca

SEQ ID NO: 341432 - DNA, 25 bp, Homo sapien
ttctaccacaagatgtgccttgcct

SEQ ID NO: 341433 - DNA, 25 bp, Homo sapien
gtgccttgccttccgagaataagta

SEQ ID NO: 341434 - DNA, 25 bp, Homo sapien
gccttccgagaataagtattacctt

SEQ ID NO: 341435 - DNA, 25 bp, Homo sapien
ttaaacaatatcagcgcacacacat

SEQ ID NO: 341436 - DNA, 25 bp, Homo sapien
agcgcacacacatagctgcatgttc

SEQ ID NO: 341437 - DNA, 25 bp, Homo sapien
tgcatgttctgctcgtgtagtttaa

SEQ ID NO: 341438 - DNA, 25 bp, Homo sapien
gtatgtgtgcatatagcagctactc

SEQ ID NO: 341439 - DNA, 25 bp, Homo sapien
atagcagctactctgtagcagaggt

SEQ ID NO: 341440 - DNA, 25 bp, Homo sapien
gcatgcagatgtcacatcggcctct

SEQ ID NO: 341441 - DNA, 25 bp, Homo sapien
atcggcctctgcaaaaactgtactg

SEQ ID NO: 341442 - DNA, 25 bp, Homo sapien
tgtactgtcttgtttctgcattaga

SEQ ID NO: 341443 - DNA, 25 bp, Homo sapien
gtttctgcattagacttaagtagtc

SEQ ID NO: 341444 - DNA, 25 bp, Homo sapien
gtagtcatgtgaatatactgctatg

SEQ ID NO: 341445 - DNA, 25 bp, Homo sapien
gaatatactgctatgtcacttttaa

SEQ ID NO: 341446 - DNA, 25 bp, Homo sapien
ggtacttgcttcttttaaatctctg

SEQ ID NO: 341447 - DNA, 25 bp, Homo sapien
ttaaatctctgtcttctctaacctc

SEQ ID NO: 341448 - DNA, 25 bp, Homo sapien
tcccttcctaatttcagcaataatc

SEQ ID NO: 341449 - DNA, 25 bp, Homo sapien
gctgtgccaaccctatcctatatgc

SEQ ID NO: 341450 - DNA, 25 bp, Homo sapien
tcctatatgccttcttgtctgacaa

SEQ ID NO: 341451 - DNA, 25 bp, Homo sapien
gccttcttgtctgacaacttcaaga

SEQ ID NO: 341452 - DNA, 25 bp, Homo sapien
tccagaatgtcctctgcttggtcaa

SEQ ID NO: 341453 - DNA, 25 bp, Homo sapien
aagtctggagaagagggatcatgcc

SEQ ID NO: 341454 - DNA, 25 bp, Homo sapien
agtctgagaagaaggtcacccgaat

SEQ ID NO: 341455 - DNA, 25 bp, Homo sapien
tcacccgaatggtgtccatcgtggt

SEQ ID NO: 341456 - DNA, 25 bp, Homo sapien
tggcttcccttctacatattcaacg

SEQ ID NO: 341457 - DNA, 25 bp, Homo sapien
acatattcaacgtttcttccgtctc

SEQ ID NO: 341458 - DNA, 25 bp, Homo sapien
accccagcccttaaaggcatgtttg

SEQ ID NO: 341459 - DNA, 25 bp, Homo sapien
ggtcctcacctatgctaacagctgt

SEQ ID NO: 341460 - DNA, 25 bp, Homo sapien
agtcagctttggtttaggctctgcc

SEQ ID NO: 341461 - DNA, 25 bp, Homo sapien
taggctctgccaccaattatgtgac

SEQ ID NO: 341462 - DNA, 25 bp, Homo sapien
caagcccactttcctaaactgcaaa

SEQ ID NO: 341463 - DNA, 25 bp, Homo sapien
gtggtggacccttagtcctcagcag

SEQ ID NO: 341464 - DNA, 25 bp, Homo sapien
gtggacccttagtcctcagcagagt

SEQ ID NO: 341465 - DNA, 25 bp, Homo sapien
cgttggtctccctctgtaagtctga

SEQ ID NO: 341466 - DNA, 25 bp, Homo sapien
gtaagtctgaccttgggcagcacgg

SEQ ID NO: 341467 - DNA, 25 bp, Homo sapien
tgaccttgggcagcacggtgtcttt

SEQ ID NO: 341468 - DNA, 25 bp, Homo sapien
gcagcacggtgtctttgcccagagc

SEQ ID NO: 341469 - DNA, 25 bp, Homo sapien
gcttttaaaattaccccatgccact

SEQ ID NO: 341470 - DNA, 25 bp, Homo sapien
gggcactgcattgaaagtcagcttt

SEQ ID NO: 341471 - DNA, 25 bp, Homo sapien
gtcacctgggtgaataggcaactta

SEQ ID NO: 341472 - DNA, 25 bp, Homo sapien
aggcaacttagatgggcctccctgt

SEQ ID NO: 341473 - DNA, 25 bp, Homo sapien
cctgtgttcctgtcatgcctccaat

SEQ ID NO: 341474 - DNA, 25 bp, Homo sapien
atgcctccaattctgcgtccaggtg

SEQ ID NO: 341475 - DNA, 25 bp, Homo sapien
aattctgcgtccaggtgtccggaac

SEQ ID NO: 341476 - DNA, 25 bp, Homo sapien
tccaggtgtccggaacacatttttt

SEQ ID NO: 341477 - DNA, 25 bp, Homo sapien
tttttctgcctttgaaaccttccag

SEQ ID NO: 341478 - DNA, 25 bp, Homo sapien
aaccttccagtacctctggcagaga

SEQ ID NO: 341479 - DNA, 25 bp, Homo sapien
agagatataccataccctccttgtt

SEQ ID NO: 341480 - DNA, 25 bp, Homo sapien
gaacttgcgctggaggaacacccct

SEQ ID NO: 341481 - DNA, 25 bp, Homo sapien
gggcgagaagaggaccctttccttg

SEQ ID NO: 341482 - DNA, 25 bp, Homo sapien
attttggaatctgctatcttggaat

SEQ ID NO: 341483 - DNA, 25 bp, Homo sapien
gaatctgctatcttggaattagacc

SEQ ID NO: 341484 - DNA, 25 bp, Homo sapien
gctatcttggaattagaccttctga

SEQ ID NO: 341485 - DNA, 25 bp, Homo sapien
accttctgattcatcttaagtggga

SEQ ID NO: 341486 - DNA, 25 bp, Homo sapien
attcatcttaagtgggataccttcc

SEQ ID NO: 341487 - DNA, 25 bp, Homo sapien
taagtgggataccttccatccttgt

SEQ ID NO: 341488 - DNA, 25 bp, Homo sapien
accttccatccttgtctgtgtataa

SEQ ID NO: 341489 - DNA, 25 bp, Homo sapien
tccatccttgtctgtgtataacctt

SEQ ID NO: 341490 - DNA, 25 bp, Homo sapien
tccttgtctgtgtataacctttcct

SEQ ID NO: 341491 - DNA, 25 bp, Homo sapien
tgtctgtgtataacctttcctcagg

SEQ ID NO: 341492 - DNA, 25 bp, Homo sapien
tttctctttcagatgggtttcagcc

SEQ ID NO: 341493 - DNA, 25 bp, Homo sapien
ttcctcgctgggtgctggacccctt

SEQ ID NO: 341494 - DNA, 25 bp, Homo sapien
gctgggtgctggaccccttttgcag

SEQ ID NO: 341495 - DNA, 25 bp, Homo sapien
ggtgctggaccccttttgcagcctg

SEQ ID NO: 341496 - DNA, 25 bp, Homo sapien
tgggctctgccttgcactatttccc

SEQ ID NO: 341497 - DNA, 25 bp, Homo sapien
atgcccatttgcacagctgcccagg

SEQ ID NO: 341498 - DNA, 25 bp, Homo sapien
gcccatttgcacagctgcccaggta

SEQ ID NO: 341499 - DNA, 25 bp, Homo sapien
gctgcccaggtacccctaacagtgg

SEQ ID NO: 341500 - DNA, 25 bp, Homo sapien
ggtagcgggaccagtccctgttatc

SEQ ID NO: 341501 - DNA, 25 bp, Homo sapien
gggaccagtccctgttatctattta

SEQ ID NO: 341502 - DNA, 25 bp, Homo sapien
gaccagtccctgttatctatttaaa

SEQ ID NO: 341503 - DNA, 25 bp, Homo sapien
gggagatcgggttgtcctgggcctc

SEQ ID NO: 341504 - DNA, 25 bp, Homo sapien
tataggtcttattcccctttcctca

SEQ ID NO: 341505 - DNA, 25 bp, Homo sapien
ctttcctcagtcctttgaagagaag

SEQ ID NO: 341506 - DNA, 25 bp, Homo sapien
gaagtacagtctcttgcgattttgt

SEQ ID NO: 341507 - DNA, 25 bp, Homo sapien
atatatcgtgttcgacacagccgct

SEQ ID NO: 341508 - DNA, 25 bp, Homo sapien
ctctgtcctgtaaatagggaactaa

SEQ ID NO: 341509 - DNA, 25 bp, Homo sapien
ggctgtatgatttctcaagtgctga

SEQ ID NO: 341510 - DNA, 25 bp, Homo sapien
agtgctgagttacacagtcctgagt

SEQ ID NO: 341511 - DNA, 25 bp, Homo sapien
agtcctgagtgagctttctgttacc

SEQ ID NO: 341512 - DNA, 25 bp, Homo sapien
gagctttctgttaccatactttcac

SEQ ID NO: 341513 - DNA, 25 bp, Homo sapien
gttaccatactttcacacgtgggct

SEQ ID NO: 341514 - DNA, 25 bp, Homo sapien
actttcacacgtgggctttatttct

SEQ ID NO: 341515 - DNA, 25 bp, Homo sapien
gggatagtgttaattgccctaccta

SEQ ID NO: 341516 - DNA, 25 bp, Homo sapien
gatagtgttaattgccctacctacc

SEQ ID NO: 341517 - DNA, 25 bp, Homo sapien
gagacaatgaattcaaagcaagttg

SEQ ID NO: 341518 - DNA, 25 bp, Homo sapien
caagttgacaagtaagtgctatgca

SEQ ID NO: 341519 - DNA, 25 bp, Homo sapien
gggttaatggattgtccagcccttt

SEQ ID NO: 341520 - DNA, 25 bp, Homo sapien
gattgtccagccctttctctgtgtg

SEQ ID NO: 341521 - DNA, 25 bp, Homo sapien
ctttctctgtgtggcttaaacccag

SEQ ID NO: 341522 - DNA, 25 bp, Homo sapien
tctgtgtggcttaaacccaggtcgc

SEQ ID NO: 341523 - DNA, 25 bp, Homo sapien
ttaaacccaggtcgccattgcttta

SEQ ID NO: 341524 - DNA, 25 bp, Homo sapien
caggtcgccattgctttatacattt

SEQ ID NO: 341525 - DNA, 25 bp, Homo sapien
tcacttagcacagatttgtaattat

SEQ ID NO: 341526 - DNA, 25 bp, Homo sapien
gagaaggtcagtctctttcccccgg

SEQ ID NO: 341527 - DNA, 25 bp, Homo sapien
agacagaaggcgctgagggcactga

SEQ ID NO: 341528 - DNA, 25 bp, Homo sapien
gctgagggcactgaggcgaggcgcg

SEQ ID NO: 341529 - DNA, 25 bp, Homo sapien
taggaccactgcctgcacgccttgg

SEQ ID NO: 341530 - DNA, 25 bp, Homo sapien
aaagccacacaccagagcctctgtg

SEQ ID NO: 341531 - DNA, 25 bp, Homo sapien
acctctagtgatgcgtgctacacat

SEQ ID NO: 341532 - DNA, 25 bp, Homo sapien
gtgatgcgtgctacacatagtgctg

SEQ ID NO: 341533 - DNA, 25 bp, Homo sapien
tgcgtgctacacatagtgctggcca

SEQ ID NO: 341534 - DNA, 25 bp, Homo sapien
gtgctacacatagtgctggccagag

SEQ ID NO: 341535 - DNA, 25 bp, Homo sapien
catagtgctggccagagagtcaact

SEQ ID NO: 341536 - DNA, 25 bp, Homo sapien
tgctggccagagagtcaactgccaa

SEQ ID NO: 341537 - DNA, 25 bp, Homo sapien
agctgttttaggatcctatgtggag

SEQ ID NO: 341538 - DNA, 25 bp, Homo sapien
gaggatgttgaatcagtttctggct

SEQ ID NO: 341539 - DNA, 25 bp, Homo sapien
atcagtttctggcttaggcatcaac

SEQ ID NO: 341540 - DNA, 25 bp, Homo sapien
ctggcttaggcatcaactttttctc

SEQ ID NO: 341541 - DNA, 25 bp, Homo sapien
tcaattctatttgcctttttgtcaa

SEQ ID NO: 341542 - DNA, 25 bp, Homo sapien
tgttccagggtcagaagcccctgtg

SEQ ID NO: 341543 - DNA, 25 bp, Homo sapien
gacaataaactttcttctctcatga

SEQ ID NO: 341544 - DNA, 25 bp, Homo sapien
tcttctctcatgagttgagtcacat

SEQ ID NO: 341545 - DNA, 25 bp, Homo sapien
taaaaatatgtttcaccagatgggt

SEQ ID NO: 341546 - DNA, 25 bp, Homo sapien
ctgtggtccccatgcaatcccagga

SEQ ID NO: 341547 - DNA, 25 bp, Homo sapien
ttatttctctttgttcacagcttag

SEQ ID NO: 341548 - DNA, 25 bp, Homo sapien
ttccaccctctgagaagcctcagct

SEQ ID NO: 341549 - DNA, 25 bp, Homo sapien
tatccttgacaccacggactcgact

SEQ ID NO: 341550 - DNA, 25 bp, Homo sapien
ggactcgactcaccactttcagcct

SEQ ID NO: 341551 - DNA, 25 bp, Homo sapien
gtggagtcgggacactggtgggcca

SEQ ID NO: 341552 - DNA, 25 bp, Homo sapien
agtcgggacactggtgggccagggc

SEQ ID NO: 341553 - DNA, 25 bp, Homo sapien
ggccagggcgtgaaaaggtcatcat

SEQ ID NO: 341554 - DNA, 25 bp, Homo sapien
cagggcgtgaaaaggtcatcatctt

SEQ ID NO: 341555 - DNA, 25 bp, Homo sapien
gggcgtgaaaaggtcatcatctttt

SEQ ID NO: 341556 - DNA, 25 bp, Homo sapien
gcgtgaaaaggtcatcatctttttt

SEQ ID NO: 341557 - DNA, 25 bp, Homo sapien
ttttttcctctgcaggtgtgagaac

SEQ ID NO: 341558 - DNA, 25 bp, Homo sapien
ttttcctctgcaggtgtgagaacca

SEQ ID NO: 341559 - DNA, 25 bp, Homo sapien
ttttacggcatatgtctaggacccc

SEQ ID NO: 341560 - DNA, 25 bp, Homo sapien
ggagccaaagtttcagagagcccag

SEQ ID NO: 341561 - DNA, 25 bp, Homo sapien
gcccagcaactatgtaactccatgg

SEQ ID NO: 341562 - DNA, 25 bp, Homo sapien
gaggcatgatattactctctgttca

SEQ ID NO: 341563 - DNA, 25 bp, Homo sapien
attactctctgttcacaggagcgta

SEQ ID NO: 341564 - DNA, 25 bp, Homo sapien
aggagcgtacgcacagatcttttct

SEQ ID NO: 341565 - DNA, 25 bp, Homo sapien
ttttctcctcctcatggtcagtttt

SEQ ID NO: 341566 - DNA, 25 bp, Homo sapien
tagtaattagcttctcttggtacgc

SEQ ID NO: 341567 - DNA, 25 bp, Homo sapien
tcttggtacgctacgatctattaca

SEQ ID NO: 341568 - DNA, 25 bp, Homo sapien
atactccaccctgcattcaagtttt

SEQ ID NO: 341569 - DNA, 25 bp, Homo sapien
gttttcctggcacaggtatctatgt

SEQ ID NO: 341570 - DNA, 25 bp, Homo sapien
gaaatgaaacttgcgtgagtcccat

SEQ ID NO: 341571 - DNA, 25 bp, Homo sapien
gagtcccattattttacgcatgtat

SEQ ID NO: 341572 - DNA, 25 bp, Homo sapien
gtatgtgcagatacgttctacccac

SEQ ID NO: 341573 - DNA, 25 bp, Homo sapien
gtgcgtgcaccaaagatggactgct

SEQ ID NO: 341574 - DNA, 25 bp, Homo sapien
actgctttccatgtgtccttttgac

SEQ ID NO: 341575 - DNA, 25 bp, Homo sapien
ggtgcagtctcttagcagacttcag

SEQ ID NO: 341576 - DNA, 25 bp, Homo sapien
gacttcaggcccaaactgtattctt

SEQ ID NO: 341577 - DNA, 25 bp, Homo sapien
tgtattcttcactcaggcaaaattg

SEQ ID NO: 341578 - DNA, 25 bp, Homo sapien
tctaggttatacttttacctccctg

SEQ ID NO: 341579 - DNA, 25 bp, Homo sapien
tacctccctgaaattgtagttgtca

SEQ ID NO: 341580 - DNA, 25 bp, Homo sapien
gtagttgtcacttggagggcaaaat

SEQ ID NO: 341581 - DNA, 25 bp, Homo sapien
gtcaccctcgtctatccctgcgcct

SEQ ID NO: 341582 - DNA, 25 bp, Homo sapien
tcgtctatccctgcgcctgggggct

SEQ ID NO: 341583 - DNA, 25 bp, Homo sapien
caggccctaggccacctcgcggaag

SEQ ID NO: 341584 - DNA, 25 bp, Homo sapien
aggccctaggccacctcgcggaagc

SEQ ID NO: 341585 - DNA, 25 bp, Homo sapien
ggccctaggccacctcgcggaagcc

SEQ ID NO: 341586 - DNA, 25 bp, Homo sapien
gccctaggccacctcgcggaagcct

SEQ ID NO: 341587 - DNA, 25 bp, Homo sapien
ccctaggccacctcgcggaagcctt

SEQ ID NO: 341588 - DNA, 25 bp, Homo sapien
cctaggccacctcgcggaagccttc

SEQ ID NO: 341589 - DNA, 25 bp, Homo sapien
tcccagtgcttccacgtctccaaaa

SEQ ID NO: 341590 - DNA, 25 bp, Homo sapien
ttcctgtcaccctcgtctatccctg

SEQ ID NO: 341591 - DNA, 25 bp, Homo sapien
ctgtcaccctcgtctatccctgcgc

SEQ ID NO: 341592 - DNA, 25 bp, Homo sapien
tcatgcctgctttggtcactttctc

SEQ ID NO: 341593 - DNA, 25 bp, Homo sapien
gctttggtcactttctcttggaaac

SEQ ID NO: 341594 - DNA, 25 bp, Homo sapien
cttggaaacttcacgcatttgactt

SEQ ID NO: 341595 - DNA, 25 bp, Homo sapien
tatcacatgactgcaaaatacactg

SEQ ID NO: 341596 - DNA, 25 bp, Homo sapien
aatacactgcagcaaactttctagc

SEQ ID NO: 341597 - DNA, 25 bp, Homo sapien
aactttctagcatctgatattggat

SEQ ID NO: 341598 - DNA, 25 bp, Homo sapien
agccatcaattcctgtgcagggtgg

SEQ ID NO: 341599 - DNA, 25 bp, Homo sapien
gggtggagtcagacccagtgacttc

SEQ ID NO: 341600 - DNA, 25 bp, Homo sapien
gacccagtgacttccttttcaatgt

SEQ ID NO: 341601 - DNA, 25 bp, Homo sapien
tttcaatgtcagcaagagttttctc

SEQ ID NO: 341602 - DNA, 25 bp, Homo sapien
cagcaagagttttctcatgcctgct

SEQ ID NO: 341603 - DNA, 25 bp, Homo sapien
catcgtgacaacaggctatgagcca

SEQ ID NO: 341604 - DNA, 25 bp, Homo sapien
ggcactgatgccaacgtcttcgtga

SEQ ID NO: 341605 - DNA, 25 bp, Homo sapien
caacgtcttcgtgaccatctttggg

SEQ ID NO: 341606 - DNA, 25 bp, Homo sapien
gaaaatgcgcaacctcttcgagcgg

SEQ ID NO: 341607 - DNA, 25 bp, Homo sapien
gaagtacttcaaggtattcgaggtt

SEQ ID NO: 341608 - DNA, 25 bp, Homo sapien
tgaccaggctgggacttgctgcaga

SEQ ID NO: 341609 - DNA, 25 bp, Homo sapien
gtattcgaggttaccaagacgacag

SEQ ID NO: 341610 - DNA, 25 bp, Homo sapien
aagacgacagagagctttgccagca

SEQ ID NO: 341611 - DNA, 25 bp, Homo sapien
tttgccagcaaggtccagagcctgg

SEQ ID NO: 341612 - DNA, 25 bp, Homo sapien
agcctggtgcccgtcaagtacgaag

SEQ ID NO: 341613 - DNA, 25 bp, Homo sapien
tgcccgtcaagtacgaagtcatcgt

SEQ ID NO: 341614 - DNA, 25 bp, Homo sapien
ttcctaagccttcatatttttgtac

SEQ ID NO: 341615 - DNA, 25 bp, Homo sapien
agaattagtcttttgcagttatatt

SEQ ID NO: 341616 - DNA, 25 bp, Homo sapien
gtatagcagctatcatttccacaat

SEQ ID NO: 341617 - DNA, 25 bp, Homo sapien
gcagctatcatttccacaatcattt

SEQ ID NO: 341618 - DNA, 25 bp, Homo sapien
atttccacaatcatttcttcctctt

SEQ ID NO: 341619 - DNA, 25 bp, Homo sapien
acaatcatttcttcctcttcatttc

SEQ ID NO: 341620 - DNA, 25 bp, Homo sapien
gggattcatttcactcactgttatg

SEQ ID NO: 341621 - DNA, 25 bp, Homo sapien
gataacatttttagtttgctagaga

SEQ ID NO: 341622 - DNA, 25 bp, Homo sapien
agtttgctagagagtttctctgaaa

SEQ ID NO: 341623 - DNA, 25 bp, Homo sapien
tataaaccacttctaatcagcccgg

SEQ ID NO: 341624 - DNA, 25 bp, Homo sapien
aaccacttctaatcagcccgggcga

SEQ ID NO: 341625 - DNA, 25 bp, Homo sapien
gacatgggacatatatttttcttat

SEQ ID NO: 341626 - DNA, 25 bp, Homo sapien
aaattgcttcactttgtatttaaag

SEQ ID NO: 341627 - DNA, 25 bp, Homo sapien
atttttcatttgctattgtactttc

SEQ ID NO: 341628 - DNA, 25 bp, Homo sapien
tttcatttgctattgtactttcatt

SEQ ID NO: 341629 - DNA, 25 bp, Homo sapien
gttgtcattcaattgacattcctgt

SEQ ID NO: 341630 - DNA, 25 bp, Homo sapien
cattcaattgacattcctgtgtact

SEQ ID NO: 341631 - DNA, 25 bp, Homo sapien
ttcaattgacattcctgtgtactgt

SEQ ID NO: 341632 - DNA, 25 bp, Homo sapien
tactactgtttttataacatgagag

SEQ ID NO: 341633 - DNA, 25 bp, Homo sapien
ttctgtttcatgatccttatgtaat

SEQ ID NO: 341634 - DNA, 25 bp, Homo sapien
gtttcatgatccttatgtaattcag

SEQ ID NO: 341635 - DNA, 25 bp, Homo sapien
catgatccttatgtaattcagaaat

SEQ ID NO: 341636 - DNA, 25 bp, Homo sapien
aggagtcctgcctttgtgctcagtt

SEQ ID NO: 341637 - DNA, 25 bp, Homo sapien
gctcagtttgtagggacctgcctag

SEQ ID NO: 341638 - DNA, 25 bp, Homo sapien
gacctgcctagggagggcctctctg

SEQ ID NO: 341639 - DNA, 25 bp, Homo sapien
aggccctggtgaccgccataaagac

SEQ ID NO: 341640 - DNA, 25 bp, Homo sapien
ccgctcatctgggaggtgactgaga

SEQ ID NO: 341641 - DNA, 25 bp, Homo sapien
gtgaccgccataaagacccagcaaa

SEQ ID NO: 341642 - DNA, 25 bp, Homo sapien
ttcagattccctggcatctcagtgt

SEQ ID NO: 341643 - DNA, 25 bp, Homo sapien
atctcagtgtcatcttgccatgctt

SEQ ID NO: 341644 - DNA, 25 bp, Homo sapien
gtgtcatcttgccatgcttggagat

SEQ ID NO: 341645 - DNA, 25 bp, Homo sapien
agttctaggacagtgcttggctcag

SEQ ID NO: 341646 - DNA, 25 bp, Homo sapien
gctcagggtgcccacactcttgact

SEQ ID NO: 341647 - DNA, 25 bp, Homo sapien
tccaggccactagagcagatagata

SEQ ID NO: 341648 - DNA, 25 bp, Homo sapien
aatgtaggacagaatgaccaggcct

SEQ ID NO: 341649 - DNA, 25 bp, Homo sapien
gaatgaccaggcctatgatggcaaa

SEQ ID NO: 341650 - DNA, 25 bp, Homo sapien
ccagcattgtggattcctaggccga

SEQ ID NO: 341651 - DNA, 25 bp, Homo sapien
ttgtggattcctaggccgaccaagc

SEQ ID NO: 341652 - DNA, 25 bp, Homo sapien
gcccctggattctggtgaaccgtga

SEQ ID NO: 341653 - DNA, 25 bp, Homo sapien
ttctggtgaaccgtgagctgtgagc

SEQ ID NO: 341654 - DNA, 25 bp, Homo sapien
gtcggtggagagaaatggctcccct

SEQ ID NO: 341655 - DNA, 25 bp, Homo sapien
cagcagaagcaaaaatccaccggtg

SEQ ID NO: 341656 - DNA, 25 bp, Homo sapien
aaatccaccggtgcgtcagcaagca

SEQ ID NO: 341657 - DNA, 25 bp, Homo sapien
agcaagcagggcactcggccattca

SEQ ID NO: 341658 - DNA, 25 bp, Homo sapien
gattctgggctttactaagacttcc

SEQ ID NO: 341659 - DNA, 25 bp, Homo sapien
cttcctactctcagaatctctggac

SEQ ID NO: 341660 - DNA, 25 bp, Homo sapien
agaatctctggactataaacgctgg

SEQ ID NO: 341661 - DNA, 25 bp, Homo sapien
gaatctctggactataaacgctggg

SEQ ID NO: 341662 - DNA, 25 bp, Homo sapien
taagactccagttagaagatttttg

SEQ ID NO: 341663 - DNA, 25 bp, Homo sapien
aagactccagttagaagatttttga

SEQ ID NO: 341664 - DNA, 25 bp, Homo sapien
agactccagttagaagatttttgaa

SEQ ID NO: 341665 - DNA, 25 bp, Homo sapien
gactccagttagaagatttttgaaa

SEQ ID NO: 341666 - DNA, 25 bp, Homo sapien
ctccagttagaagatttttgaaaat

SEQ ID NO: 341667 - DNA, 25 bp, Homo sapien
ggcagaacatgactggccttcattc

SEQ ID NO: 341668 - DNA, 25 bp, Homo sapien
cagtcccttaaatacagttgcttct

SEQ ID NO: 341669 - DNA, 25 bp, Homo sapien
cggccggcacgcatgtggtctacac

SEQ ID NO: 341670 - DNA, 25 bp, Homo sapien
gcacgcatgtggtctacacccgaga

SEQ ID NO: 341671 - DNA, 25 bp, Homo sapien
atgtggtctacacccgagacacagg

SEQ ID NO: 341672 - DNA, 25 bp, Homo sapien
acagggccccaggagacattgcaag

SEQ ID NO: 341673 - DNA, 25 bp, Homo sapien
gggccccaggagacattgcaagcag

SEQ ID NO: 341674 - DNA, 25 bp, Homo sapien
gagacattgcaagcagccgggccca

SEQ ID NO: 341675 - DNA, 25 bp, Homo sapien
tgctcctacaggtcctcctgcagga

SEQ ID NO: 341676 - DNA, 25 bp, Homo sapien
aggagcccaaccctggcatcgagtt

SEQ ID NO: 341677 - DNA, 25 bp, Homo sapien
aaccctggcatcgagtttgagttct

SEQ ID NO: 341678 - DNA, 25 bp, Homo sapien
ctggcatcgagtttgagttctggct

SEQ ID NO: 341679 - DNA, 25 bp, Homo sapien
catcgagtttgagttctggctccct

SEQ ID NO: 341680 - DNA, 25 bp, Homo sapien
cataaacacgagctcaggcctcaga

SEQ ID NO: 341681 - DNA, 25 bp, Homo sapien
ataaacacgagctcaggcctcagag

SEQ ID NO: 341682 - DNA, 25 bp, Homo sapien
taaacacgagctcaggcctcagagc

SEQ ID NO: 341683 - DNA, 25 bp, Homo sapien
aaacacgagctcaggcctcagagca

SEQ ID NO: 341684 - DNA, 25 bp, Homo sapien
aacacgagctcaggcctcagagcat

SEQ ID NO: 341685 - DNA, 25 bp, Homo sapien
aggcctcagagcatctgtctgcttc

SEQ ID NO: 341686 - DNA, 25 bp, Homo sapien
gcctcagagcatctgtctgcttcca

SEQ ID NO: 341687 - DNA, 25 bp, Homo sapien
tctgtctgcttccaagaacactgtt

SEQ ID NO: 341688 - DNA, 25 bp, Homo sapien
ctgtctgcttccaagaacactgttt

SEQ ID NO: 341689 - DNA, 25 bp, Homo sapien
tgtctgcttccaagaacactgtttc

SEQ ID NO: 341690 - DNA, 25 bp, Homo sapien
tgcttccaagaacactgtttctaaa

SEQ ID NO: 341691 - DNA, 25 bp, Homo sapien
ccctttcctgaaggctaacaatgca

SEQ ID NO: 341692 - DNA, 25 bp, Homo sapien
ttcctgaaggctaacaatgcagttc

SEQ ID NO: 341693 - DNA, 25 bp, Homo sapien
gaaggctaacaatgcagttcaaatt

SEQ ID NO: 341694 - DNA, 25 bp, Homo sapien
cagttcaaattatatgcttatgcat

SEQ ID NO: 341695 - DNA, 25 bp, Homo sapien
tatgcttatgcatgttcagaacaca

SEQ ID NO: 341696 - DNA, 25 bp, Homo sapien
gcttatgcatgttcagaacacagta

SEQ ID NO: 341697 - DNA, 25 bp, Homo sapien
aacacagtagacatcatgtgtcggt

SEQ ID NO: 341698 - DNA, 25 bp, Homo sapien
tagacatcatgtgtcggtgggtgtt

SEQ ID NO: 341699 - DNA, 25 bp, Homo sapien
gttgctcttaaggagtgatacagcc

SEQ ID NO: 341700 - DNA, 25 bp, Homo sapien
taaggagtgatacagccatcctccc

SEQ ID NO: 341701 - DNA, 25 bp, Homo sapien
agagggaggctgagctcagtagctc

SEQ ID NO: 341702 - DNA, 25 bp, Homo sapien
tctactcaggtcttctattgattgg

SEQ ID NO: 341703 - DNA, 25 bp, Homo sapien
atacatcatggagggcaatcttctt

SEQ ID NO: 341704 - DNA, 25 bp, Homo sapien
tactcagaggacatcagtgtcaatg

SEQ ID NO: 341705 - DNA, 25 bp, Homo sapien
agtgtcaatgttattcccatccaga

SEQ ID NO: 341706 - DNA, 25 bp, Homo sapien
agaaacaccttccaagttgacacat

SEQ ID NO: 341707 - DNA, 25 bp, Homo sapien
taacaatacacttttcctcatctca

SEQ ID NO: 341708 - DNA, 25 bp, Homo sapien
ttcctcatctcacccaaatttaggt

SEQ ID NO: 341709 - DNA, 25 bp, Homo sapien
agctgatggtgcagttccagtctca

SEQ ID NO: 341710 - DNA, 25 bp, Homo sapien
aagagttctggatacctgaattaat

SEQ ID NO: 341711 - DNA, 25 bp, Homo sapien
gttccagtctcacagaagtctgctg

SEQ ID NO: 341712 - DNA, 25 bp, Homo sapien
aaggtggtcttttcattctactcag

SEQ ID NO: 341713 - DNA, 25 bp, Homo sapien
ttaatagtgcgcctgttactaatgg

SEQ ID NO: 341714 - DNA, 25 bp, Homo sapien
aatagtgcgcctgttactaatggaa

SEQ ID NO: 341715 - DNA, 25 bp, Homo sapien
tagtgcgcctgttactaatggaatt

SEQ ID NO: 341716 - DNA, 25 bp, Homo sapien
gtgcgcctgttactaatggaattta

SEQ ID NO: 341717 - DNA, 25 bp, Homo sapien
gcgcctgttactaatggaatttact

SEQ ID NO: 341718 - DNA, 25 bp, Homo sapien
gcctgttactaatggaatttactta

SEQ ID NO: 341719 - DNA, 25 bp, Homo sapien
aagtaagtttgccatatgaaagggt

SEQ ID NO: 341720 - DNA, 25 bp, Homo sapien
gtttgccatatgaaagggtattaat

SEQ ID NO: 341721 - DNA, 25 bp, Homo sapien
ccttttcaagcataacatacaaatg

SEQ ID NO: 341722 - DNA, 25 bp, Homo sapien
agatatttgctacataggaaaaatg

SEQ ID NO: 341723 - DNA, 25 bp, Homo sapien
taaaaaatttgtctggggtgcctgt

SEQ ID NO: 341724 - DNA, 25 bp, Homo sapien
aaaaaattcttatcccttgctgctc

SEQ ID NO: 341725 - DNA, 25 bp, Homo sapien
acaccagttcactaaaagcaccgaa

SEQ ID NO: 341726 - DNA, 25 bp, Homo sapien
accgaaatctgcaaagcctgtcttc

SEQ ID NO: 341727 - DNA, 25 bp, Homo sapien
tgtcttccgctagaacaacgtctac

SEQ ID NO: 341728 - DNA, 25 bp, Homo sapien
aagatgatgacttctggcacgcggt

SEQ ID NO: 341729 - DNA, 25 bp, Homo sapien
ggaatggcactaggagctgatgttt

SEQ ID NO: 341730 - DNA, 25 bp, Homo sapien
taggagctgatgtttgcctcattta

SEQ ID NO: 341731 - DNA, 25 bp, Homo sapien
agtaggcaagccgagccaactgcag

SEQ ID NO: 341732 - DNA, 25 bp, Homo sapien
ccaactgcagccatcattcattaag

SEQ ID NO: 341733 - DNA, 25 bp, Homo sapien
tcattaagttttgggtagtgctcta

SEQ ID NO: 341734 - DNA, 25 bp, Homo sapien
gtgctctaatggtttgttcacttta

SEQ ID NO: 341735 - DNA, 25 bp, Homo sapien
actgaacttgattcaggcagaggac

SEQ ID NO: 341736 - DNA, 25 bp, Homo sapien
gaagaacaatcaagactgcaatgaa

SEQ ID NO: 341737 - DNA, 25 bp, Homo sapien
aatggatacattaggagcttcaaac

SEQ ID NO: 341738 - DNA, 25 bp, Homo sapien
gatacattaggagcttcaaacacat

SEQ ID NO: 341739 - DNA, 25 bp, Homo sapien
gcttcaaacacatataatttctcaa

SEQ ID NO: 341740 - DNA, 25 bp, Homo sapien
atttctcaagaaatttccagatgtc

SEQ ID NO: 341741 - DNA, 25 bp, Homo sapien
tttccagatgtctcatgctgcatag

SEQ ID NO: 341742 - DNA, 25 bp, Homo sapien
tttgcattttgcagtacaaaggaga

SEQ ID NO: 341743 - DNA, 25 bp, Homo sapien
ggccctttccacttctggctatagg

SEQ ID NO: 341744 - DNA, 25 bp, Homo sapien
tccacttctggctatagggaagaac

SEQ ID NO: 341745 - DNA, 25 bp, Homo sapien
tctggctatagggaagaacctgaat

SEQ ID NO: 341746 - DNA, 25 bp, Homo sapien
aaagaggcatggctcatttctctcc

SEQ ID NO: 341747 - DNA, 25 bp, Homo sapien
tatactactggtgttcatttttgtc

SEQ ID NO: 341748 - DNA, 25 bp, Homo sapien
ttcatttttgtcctgcagtgttgct

SEQ ID NO: 341749 - DNA, 25 bp, Homo sapien
gtcctgcagtgttgctttctcaaag

SEQ ID NO: 341750 - DNA, 25 bp, Homo sapien
taatggctgcgttttgatcgtctac

SEQ ID NO: 341751 - DNA, 25 bp, Homo sapien
ggctgcgttttgatcgtctacaaca

SEQ ID NO: 341752 - DNA, 25 bp, Homo sapien
gttttgatcgtctacaacaaggtta

SEQ ID NO: 341753 - DNA, 25 bp, Homo sapien
aacaaggttacagtgccctctggtg

SEQ ID NO: 341754 - DNA, 25 bp, Homo sapien
gccctctggtggcagtcatcaaaat

SEQ ID NO: 341755 - DNA, 25 bp, Homo sapien
gtggcagtcatcaaaatcgcttcta

SEQ ID NO: 341756 - DNA, 25 bp, Homo sapien
aaatcgcttctagacttgtttttat

SEQ ID NO: 341757 - DNA, 25 bp, Homo sapien
catgctacagttcagtttcctcgtc

SEQ ID NO: 341758 - DNA, 25 bp, Homo sapien
gataatggtacctaccttgcagtgt

SEQ ID NO: 341759 - DNA, 25 bp, Homo sapien
gtacctaccttgcagtgttgttata

SEQ ID NO: 341760 - DNA, 25 bp, Homo sapien
aaggccttggttggtgaagagccca

SEQ ID NO: 341761 - DNA, 25 bp, Homo sapien
ggttggtgaagagcccaacctcgga

SEQ ID NO: 341762 - DNA, 25 bp, Homo sapien
gggatcctccttatcttgactggga

SEQ ID NO: 341763 - DNA, 25 bp, Homo sapien
ccttatcttgactgggatgtccctg

SEQ ID NO: 341764 - DNA, 25 bp, Homo sapien
ttgaacatggccaaggaaagtgaaa

SEQ ID NO: 341765 - DNA, 25 bp, Homo sapien
cttccccttgatgcctgggaatagg

SEQ ID NO: 341766 - DNA, 25 bp, Homo sapien
gatgcctgggaataggttttgccaa

SEQ ID NO: 341767 - DNA, 25 bp, Homo sapien
taggttttgccaataaacgtatctg

SEQ ID NO: 341768 - DNA, 25 bp, Homo sapien
gcaaaattaactgacccatccttct

SEQ ID NO: 341769 - DNA, 25 bp, Homo sapien
acccatccttctatctgatgcctgt

SEQ ID NO: 341770 - DNA, 25 bp, Homo sapien
tcttctctctcattagggagttctg

SEQ ID NO: 341771 - DNA, 25 bp, Homo sapien
agttctgggtccagcttttagccca

SEQ ID NO: 341772 - DNA, 25 bp, Homo sapien
ttttagcccacttatctgcctccag

SEQ ID NO: 341773 - DNA, 25 bp, Homo sapien
agctttcagcctacttatctgcctt

SEQ ID NO: 341774 - DNA, 25 bp, Homo sapien
agttcccagagtctgtctacacaac

SEQ ID NO: 341775 - DNA, 25 bp, Homo sapien
tctgtctacacaactccctgtatgt

SEQ ID NO: 341776 - DNA, 25 bp, Homo sapien
cctgtatgtccttggcctaggaatt

SEQ ID NO: 341777 - DNA, 25 bp, Homo sapien
tgtttctctaaccagctccttagaa

SEQ ID NO: 341778 - DNA, 25 bp, Homo sapien
gaacctggaacttgtttccatggtc

SEQ ID NO: 341779 - DNA, 25 bp, Homo sapien
gcctagggccttactaacttgatag

SEQ ID NO: 341780 - DNA, 25 bp, Homo sapien
actaacttgatagaccctgaggtat

SEQ ID NO: 341781 - DNA, 25 bp, Homo sapien
agaccctgaggtatccatgtagact

SEQ ID NO: 341782 - DNA, 25 bp, Homo sapien
ggtatccatgtagactccaaagcag

SEQ ID NO: 341783 - DNA, 25 bp, Homo sapien
gtagactccaaagcagagttttcaa

SEQ ID NO: 341784 - DNA, 25 bp, Homo sapien
agataattcaccttctaactgtaga

SEQ ID NO: 341785 - DNA, 25 bp, Homo sapien
atgggagcctttttattagacagtc

SEQ ID NO: 341786 - DNA, 25 bp, Homo sapien
gacagtcttgcatagtcatctttga

SEQ ID NO: 341787 - DNA, 25 bp, Homo sapien
gtcatctttgactgtatcttctttg

SEQ ID NO: 341788 - DNA, 25 bp, Homo sapien
atcttctttggacttatttatcata

SEQ ID NO: 341789 - DNA, 25 bp, Homo sapien
aaaaacatgcatgccaagtgtgtaa

SEQ ID NO: 341790 - DNA, 25 bp, Homo sapien
tcagctgcctaagtaagctaggact

SEQ ID NO: 341791 - DNA, 25 bp, Homo sapien
agctgcctaagtaagctaggactac

SEQ ID NO: 341792 - DNA, 25 bp, Homo sapien
gctgcctaagtaagctaggactaca

SEQ ID NO: 341793 - DNA, 25 bp, Homo sapien
ctgcctaagtaagctaggactacag

SEQ ID NO: 341794 - DNA, 25 bp, Homo sapien
aaagaatatgacgattttatgatta

SEQ ID NO: 341795 - DNA, 25 bp, Homo sapien
aagtgacctgcctcagctgcctaag

SEQ ID NO: 341796 - DNA, 25 bp, Homo sapien
agtgacctgcctcagctgcctaagt

SEQ ID NO: 341797 - DNA, 25 bp, Homo sapien
tgcctcagctgcctaagtaagctag

SEQ ID NO: 341798 - DNA, 25 bp, Homo sapien
gcctcagctgcctaagtaagctagg

SEQ ID NO: 341799 - DNA, 25 bp, Homo sapien
cctcagctgcctaagtaagctagga

SEQ ID NO: 341800 - DNA, 25 bp, Homo sapien
ctcagctgcctaagtaagctaggac

SEQ ID NO: 341801 - DNA, 25 bp, Homo sapien
gaaatatagtctgtatcggatgctg

SEQ ID NO: 341802 - DNA, 25 bp, Homo sapien
gtctgtatcggatgctgtaatccta

SEQ ID NO: 341803 - DNA, 25 bp, Homo sapien
gatgctgtaatcctaaacccagacc

SEQ ID NO: 341804 - DNA, 25 bp, Homo sapien
taaacccagacctcagttgtgacag

SEQ ID NO: 341805 - DNA, 25 bp, Homo sapien
ccagacctcagttgtgacaggtgaa

SEQ ID NO: 341806 - DNA, 25 bp, Homo sapien
tccatttccagcatcactactttta

SEQ ID NO: 341807 - DNA, 25 bp, Homo sapien
tcactacttttatgtgtacaaggat

SEQ ID NO: 341808 - DNA, 25 bp, Homo sapien
tgcattcagtaacccctgtgtgttt

SEQ ID NO: 341809 - DNA, 25 bp, Homo sapien
aacccctgtgtgtttactttgatgt

SEQ ID NO: 341810 - DNA, 25 bp, Homo sapien
gtttactttgatgtcccagcactaa

SEQ ID NO: 341811 - DNA, 25 bp, Homo sapien
ttactttgatgtcccagcactaaga

SEQ ID NO: 341812 - DNA, 25 bp, Homo sapien
agcacagccgcatgggagcgcctca

SEQ ID NO: 341813 - DNA, 25 bp, Homo sapien
ggagccggtctatggactttccgaa

SEQ ID NO: 341814 - DNA, 25 bp, Homo sapien
tatggactttccgaagacgagcccg

SEQ ID NO: 341815 - DNA, 25 bp, Homo sapien
agacgagcccgggagtccatgatgc

SEQ ID NO: 341816 - DNA, 25 bp, Homo sapien
agcccgggagtccatgatgcatgtc

SEQ ID NO: 341817 - DNA, 25 bp, Homo sapien
atgatgcatgtcacgtctgggtcgc

SEQ ID NO: 341818 - DNA, 25 bp, Homo sapien
catgtcacgtctgggtcgcgcggct

SEQ ID NO: 341819 - DNA, 25 bp, Homo sapien
tgcggagaagccggatcgtttcccc

SEQ ID NO: 341820 - DNA, 25 bp, Homo sapien
ctttctctctcatgattgtgtggat

SEQ ID NO: 341821 - DNA, 25 bp, Homo sapien
ttgtgtggatcagcaggcgctcaga

SEQ ID NO: 341822 - DNA, 25 bp, Homo sapien
agcaggcgctcagaagcctgtgcgt

SEQ ID NO: 341823 - DNA, 25 bp, Homo sapien
accattgatttttctggagtttaat

SEQ ID NO: 341824 - DNA, 25 bp, Homo sapien
atataagccctaatttctgtgtatg

SEQ ID NO: 341825 - DNA, 25 bp, Homo sapien
gtgtatgtgagtaaaactgcagcct

SEQ ID NO: 341826 - DNA, 25 bp, Homo sapien
gtgagtaaaactgcagcctgagtca

SEQ ID NO: 341827 - DNA, 25 bp, Homo sapien
gcagcctgagtcatttaggaagtaa

SEQ ID NO: 341828 - DNA, 25 bp, Homo sapien
ataaaacagcactccctaacaatta

SEQ ID NO: 341829 - DNA, 25 bp, Homo sapien
cagcactccctaacaattaaaaaag

SEQ ID NO: 341830 - DNA, 25 bp, Homo sapien
ggagtttaattacattattaccatg

SEQ ID NO: 341831 - DNA, 25 bp, Homo sapien
attaccatgtattcttattggcctg

SEQ ID NO: 341832 - DNA, 25 bp, Homo sapien
catgtattcttattggcctgtagag

SEQ ID NO: 341833 - DNA, 25 bp, Homo sapien
attcttattggcctgtagaggaaaa

SEQ ID NO: 341834 - DNA, 25 bp, Homo sapien
tgaaataatatgcagtctattttta

SEQ ID NO: 341835 - DNA, 25 bp, Homo sapien
gaaataatatgcagtctatttttaa

SEQ ID NO: 341836 - DNA, 25 bp, Homo sapien
aaataatatgcagtctatttttaaa

SEQ ID NO: 341837 - DNA, 25 bp, Homo sapien
aataatatgcagtctatttttaaat

SEQ ID NO: 341838 - DNA, 25 bp, Homo sapien
gtgaacttagcttttcaattcaaca

SEQ ID NO: 341839 - DNA, 25 bp, Homo sapien
tgccagtaactttaagctattccct

SEQ ID NO: 341840 - DNA, 25 bp, Homo sapien
gccagtaactttaagctattccctt

SEQ ID NO: 341841 - DNA, 25 bp, Homo sapien
taactttaagctattcccttactca

SEQ ID NO: 341842 - DNA, 25 bp, Homo sapien
actttaagctattcccttactcaag

SEQ ID NO: 341843 - DNA, 25 bp, Homo sapien
ctttaagctattcccttactcaagg

SEQ ID NO: 341844 - DNA, 25 bp, Homo sapien
agaatattgttcctatgggttaaat

SEQ ID NO: 341845 - DNA, 25 bp, Homo sapien
caagccctgtagagacacatttctg

SEQ ID NO: 341846 - DNA, 25 bp, Homo sapien
acatttctggcatttggaggagtgc

SEQ ID NO: 341847 - DNA, 25 bp, Homo sapien
ttggaggagtgcagacgttcaaaat

SEQ ID NO: 341848 - DNA, 25 bp, Homo sapien
gggacgtgaactgtacactgagtca

SEQ ID NO: 341849 - DNA, 25 bp, Homo sapien
tagggccccttgttctaaaggatgc

SEQ ID NO: 341850 - DNA, 25 bp, Homo sapien
aggatgcagccagcaaactaaactg

SEQ ID NO: 341851 - DNA, 25 bp, Homo sapien
aactaaactgctctgatcatctaaa

SEQ ID NO: 341852 - DNA, 25 bp, Homo sapien
gtacagaaaatctcagaatggcttc

SEQ ID NO: 341853 - DNA, 25 bp, Homo sapien
atggcttcacctcccatcaggaaag

SEQ ID NO: 341854 - DNA, 25 bp, Homo sapien
atcaggaaagcctcccgtgtaccaa

SEQ ID NO: 341855 - DNA, 25 bp, Homo sapien
tcccgtgtaccaagccctgtagaga

SEQ ID NO: 341856 - DNA, 25 bp, Homo sapien
aagagtggaagccagcatccagata

SEQ ID NO: 341857 - DNA, 25 bp, Homo sapien
gccagcatccagataggagactcct

SEQ ID NO: 341858 - DNA, 25 bp, Homo sapien
agactcctagagtggtcccaatgga

SEQ ID NO: 341859 - DNA, 25 bp, Homo sapien
accaatgagggcttgggatgcagca

SEQ ID NO: 341860 - DNA, 25 bp, Homo sapien
gagaagatggtagattctccagata

SEQ ID NO: 341861 - DNA, 25 bp, Homo sapien
ttaaagatgactcccagacttcctg

SEQ ID NO: 341862 - DNA, 25 bp, Homo sapien
agacttcctgctagggccttagtat

SEQ ID NO: 341863 - DNA, 25 bp, Homo sapien
gctagggccttagtatgataccatt

SEQ ID NO: 341864 - DNA, 25 bp, Homo sapien
tgataccatttactcccatttacca

SEQ ID NO: 341865 - DNA, 25 bp, Homo sapien
ggctgaggcaggacattccacgcat

SEQ ID NO: 341866 - DNA, 25 bp, Homo sapien
gacattccacgcatgtccaaaggtc

SEQ ID NO: 341867 - DNA, 25 bp, Homo sapien
gttctggacacactgaccctttcaa

SEQ ID NO: 341868 - DNA, 25 bp, Homo sapien
tggacacactgaccctttcaaacgt

SEQ ID NO: 341869 - DNA, 25 bp, Homo sapien
gacacactgaccctttcaaacgttt

SEQ ID NO: 341870 - DNA, 25 bp, Homo sapien
tgaccctttcaaacgtttaccagct

SEQ ID NO: 341871 - DNA, 25 bp, Homo sapien
tttcaaacgtttaccagctaatggg

SEQ ID NO: 341872 - DNA, 25 bp, Homo sapien
aaacgtttaccagctaatgggcaag

SEQ ID NO: 341873 - DNA, 25 bp, Homo sapien
ggctgcgagtggtaatataaacacc

SEQ ID NO: 341874 - DNA, 25 bp, Homo sapien
atacacaagacctgtaggctatgtg

SEQ ID NO: 341875 - DNA, 25 bp, Homo sapien
aagacctgtaggctatgtgtcttct

SEQ ID NO: 341876 - DNA, 25 bp, Homo sapien
gacaggttgtgttagtgaattttaa

SEQ ID NO: 341877 - DNA, 25 bp, Homo sapien
gttcatattcttctgatacagtaaa

SEQ ID NO: 341878 - DNA, 25 bp, Homo sapien
gacttggccaaatagctgctcgaga

SEQ ID NO: 341879 - DNA, 25 bp, Homo sapien
gctgctcgagataatcaatcactgg

SEQ ID NO: 341880 - DNA, 25 bp, Homo sapien
atcactggtggacaagtttctgctg

SEQ ID NO: 341881 - DNA, 25 bp, Homo sapien
ttctgctgagtgaggtttctgctga

SEQ ID NO: 341882 - DNA, 25 bp, Homo sapien
gcgactcaaggcacggtcacgtagg

SEQ ID NO: 341883 - DNA, 25 bp, Homo sapien
ggtcacgtaggcagcacctgtacac

SEQ ID NO: 341884 - DNA, 25 bp, Homo sapien
tgtacaccgcatcctcatacagctg

SEQ ID NO: 341885 - DNA, 25 bp, Homo sapien
atcctcatacagctgcgggaccgtg

SEQ ID NO: 341886 - DNA, 25 bp, Homo sapien
accgtgcctctgactgtgtgcgtgt

SEQ ID NO: 341887 - DNA, 25 bp, Homo sapien
tctaagtgtgagatgcatccgggca

SEQ ID NO: 341888 - DNA, 25 bp, Homo sapien
gtgtgagatgcatccgggcatgtca

SEQ ID NO: 341889 - DNA, 25 bp, Homo sapien
tcgtctatccctgcgcctgggggct

SEQ ID NO: 341890 - DNA, 25 bp, Homo sapien
agctggggaaacaggctccgagaaa

SEQ ID NO: 341891 - DNA, 25 bp, Homo sapien
caggccctaggccacctcgcggaag

SEQ ID NO: 341892 - DNA, 25 bp, Homo sapien
aggccctaggccacctcgcggaagc

SEQ ID NO: 341893 - DNA, 25 bp, Homo sapien
gccctaggccacctcgcggaagcct

SEQ ID NO: 341894 - DNA, 25 bp, Homo sapien
cctaggccacctcgcggaagccttc

SEQ ID NO: 341895 - DNA, 25 bp, Homo sapien
tcccagtgcttccacgtctccaaaa

SEQ ID NO: 341896 - DNA, 25 bp, Homo sapien
agtgcttccacgtctccaaaagcgc

SEQ ID NO: 341897 - DNA, 25 bp, Homo sapien
gcttccacgtctccaaaagcgcctt

SEQ ID NO: 341898 - DNA, 25 bp, Homo sapien
acgtctccaaaagcgccttcctgtc

SEQ ID NO: 341899 - DNA, 25 bp, Homo sapien
ttcctgtcaccctcgtctatccctg

SEQ ID NO: 341900 - DNA, 25 bp, Homo sapien
cggtgttctctctcccatgagacaa

SEQ ID NO: 341901 - DNA, 25 bp, Homo sapien
gagacaagccgttatatagacttaa

SEQ ID NO: 341902 - DNA, 25 bp, Homo sapien
atgacagggatccttagggccacct

SEQ ID NO: 341903 - DNA, 25 bp, Homo sapien
ggccacctctccctagtggaggcat

SEQ ID NO: 341904 - DNA, 25 bp, Homo sapien
gaggcatcatcacttcatcttactc

SEQ ID NO: 341905 - DNA, 25 bp, Homo sapien
acttcatcttactctttcttagcag

SEQ ID NO: 341906 - DNA, 25 bp, Homo sapien
tttcttagcagttacaataccccta

SEQ ID NO: 341907 - DNA, 25 bp, Homo sapien
atacccctaatattttgtgtcactc

SEQ ID NO: 341908 - DNA, 25 bp, Homo sapien
agcaacactctgtggcagatgatca

SEQ ID NO: 341909 - DNA, 25 bp, Homo sapien
gatgatcaaaactgtctgacacaat

SEQ ID NO: 341910 - DNA, 25 bp, Homo sapien
agtctaacctattccggtgttctct

SEQ ID NO: 341911 - DNA, 25 bp, Homo sapien
ttccaccctctgagaagcctcagct

SEQ ID NO: 341912 - DNA, 25 bp, Homo sapien
tatccttgacaccacggactcgact

SEQ ID NO: 341913 - DNA, 25 bp, Homo sapien
ggactcgactcaccactttcagcct

SEQ ID NO: 341914 - DNA, 25 bp, Homo sapien
gtggagtcgggacactggtgggcca

SEQ ID NO: 341915 - DNA, 25 bp, Homo sapien
ggccagggcgtgaaaaggtcatcat

SEQ ID NO: 341916 - DNA, 25 bp, Homo sapien
tgggaagggtaacaacccactgcgt

SEQ ID NO: 341917 - DNA, 25 bp, Homo sapien
cagggcgtgaaaaggtcatcatctt

SEQ ID NO: 341918 - DNA, 25 bp, Homo sapien
gcgtgaaaaggtcatcatctttttt

SEQ ID NO: 341919 - DNA, 25 bp, Homo sapien
ttttttcctctgcaggtgtgagaac

SEQ ID NO: 341920 - DNA, 25 bp, Homo sapien
ttttcctctgcaggtgtgagaacca

SEQ ID NO: 341921 - DNA, 25 bp, Homo sapien
gcaaggcagggcacttccagaatac

SEQ ID NO: 341922 - DNA, 25 bp, Homo sapien
atatggcagctgaaacagccaagga

SEQ ID NO: 341923 - DNA, 25 bp, Homo sapien
agccaaggaactgactcctttcctg

SEQ ID NO: 341924 - DNA, 25 bp, Homo sapien
ctgactcctttcctgctgaaatcaa

SEQ ID NO: 341925 - DNA, 25 bp, Homo sapien
aatcaaagattttatctcccagtgg

SEQ ID NO: 341926 - DNA, 25 bp, Homo sapien
ggccatcaaccaagagatgtttaaa

SEQ ID NO: 341927 - DNA, 25 bp, Homo sapien
gagatgtttaaactctcatccatgg

SEQ ID NO: 341928 - DNA, 25 bp, Homo sapien
atgttacccatgctcacttggtgaa

SEQ ID NO: 341929 - DNA, 25 bp, Homo sapien
gctcacttggtgaataaattctggc

SEQ ID NO: 341930 - DNA, 25 bp, Homo sapien
atgagaggagccagagattcattga

SEQ ID NO: 341931 - DNA, 25 bp, Homo sapien
cctgtgtgctgggatctaatggacc

SEQ ID NO: 341932 - DNA, 25 bp, Homo sapien
gggatctaatggaccagactggaga

SEQ ID NO: 341933 - DNA, 25 bp, Homo sapien
tacctatttggccaactaacttgta

SEQ ID NO: 341934 - DNA, 25 bp, Homo sapien
ggccaactaacttgtaattggtaat

SEQ ID NO: 341935 - DNA, 25 bp, Homo sapien
ggtaatcttacatgtaattccgaag

SEQ ID NO: 341936 - DNA, 25 bp, Homo sapien
gtaattccgaagacagtgccctaat

SEQ ID NO: 341937 - DNA, 25 bp, Homo sapien
gaagacagtgccctaatgctcatga

SEQ ID NO: 341938 - DNA, 25 bp, Homo sapien
gacagtgccctaatgctcatgacat

SEQ ID NO: 341939 - DNA, 25 bp, Homo sapien
gtgccctaatgctcatgacatttta

SEQ ID NO: 341940 - DNA, 25 bp, Homo sapien
agtatttgagtgtttttaaggtgat

SEQ ID NO: 341941 - DNA, 25 bp, Homo sapien
aagtccatttcatttggagtcaatg

SEQ ID NO: 341942 - DNA, 25 bp, Homo sapien
taaatgaatttaaactgcactccag

SEQ ID NO: 341943 - DNA, 25 bp, Homo sapien
ttgagtacctatttggccaactaac

SEQ ID NO: 341944 - DNA, 25 bp, Homo sapien
tgggctaaaaagaccccatgaataa

SEQ ID NO: 341945 - DNA, 25 bp, Homo sapien
gaccccatgaataaatagcaggttc

SEQ ID NO: 341946 - DNA, 25 bp, Homo sapien
atagcaggttcagtagttgaggagt

SEQ ID NO: 341947 - DNA, 25 bp, Homo sapien
aaattagataacatgtggaggtcac

SEQ ID NO: 341948 - DNA, 25 bp, Homo sapien
gtggaggtcacagcattttggaaat

SEQ ID NO: 341949 - DNA, 25 bp, Homo sapien
aggtcacagcattttggaaattgag

SEQ ID NO: 341950 - DNA, 25 bp, Homo sapien
tgagtgtccccaagtgagctttgtt

SEQ ID NO: 341951 - DNA, 25 bp, Homo sapien
atgtcggaagtggacaggtttgtta

SEQ ID NO: 341952 - DNA, 25 bp, Homo sapien
aggtttgttaaatcttgtctgccag

SEQ ID NO: 341953 - DNA, 25 bp, Homo sapien
ttgttaaatcttgtctgccagcacc

SEQ ID NO: 341954 - DNA, 25 bp, Homo sapien
taaatcttgtctgccagcacccttt

SEQ ID NO: 341955 - DNA, 25 bp, Homo sapien
tcagctgcctaagtaagctaggact

SEQ ID NO: 341956 - DNA, 25 bp, Homo sapien
agctgcctaagtaagctaggactac

SEQ ID NO: 341957 - DNA, 25 bp, Homo sapien
ctgcctaagtaagctaggactacag

SEQ ID NO: 341958 - DNA, 25 bp, Homo sapien
ttctcctgcctctgttttgttttgt

SEQ ID NO: 341959 - DNA, 25 bp, Homo sapien
aaactgtcagaattggaatttttag

SEQ ID NO: 341960 - DNA, 25 bp, Homo sapien
aaagaatatgacgattttatgatta

SEQ ID NO: 341961 - DNA, 25 bp, Homo sapien
aagtgacctgcctcagctgcctaag

SEQ ID NO: 341962 - DNA, 25 bp, Homo sapien
agtgacctgcctcagctgcctaagt

SEQ ID NO: 341963 - DNA, 25 bp, Homo sapien
tgcctcagctgcctaagtaagctag

SEQ ID NO: 341964 - DNA, 25 bp, Homo sapien
gcctcagctgcctaagtaagctagg

SEQ ID NO: 341965 - DNA, 25 bp, Homo sapien
cctcagctgcctaagtaagctagga

SEQ ID NO: 341966 - DNA, 25 bp, Homo sapien
atatggcagctgaaacagccaagga

SEQ ID NO: 341967 - DNA, 25 bp, Homo sapien
tggcagctgaaacagccaaggaact

SEQ ID NO: 341968 - DNA, 25 bp, Homo sapien
agccaaggaactgactcctttcctg

SEQ ID NO: 341969 - DNA, 25 bp, Homo sapien
aactgactcctttcctgctgaaatc

SEQ ID NO: 341970 - DNA, 25 bp, Homo sapien
ctgactcctttcctgctgaaatcaa

SEQ ID NO: 341971 - DNA, 25 bp, Homo sapien
ctttcctgctgaaatcaaagatttt

SEQ ID NO: 341972 - DNA, 25 bp, Homo sapien
aatcaaagattttatctcccagtgg

SEQ ID NO: 341973 - DNA, 25 bp, Homo sapien
atgttacccatgctcacttggtgaa

SEQ ID NO: 341974 - DNA, 25 bp, Homo sapien
tgttacccatgctcacttggtgaat

SEQ ID NO: 341975 - DNA, 25 bp, Homo sapien
ttacccatgctcacttggtgaataa

SEQ ID NO: 341976 - DNA, 25 bp, Homo sapien
gctcacttggtgaataaattctggc

SEQ ID NO: 341977 - DNA, 25 bp, Homo sapien
agagtagctttctccaagtcctgaa

SEQ ID NO: 341978 - DNA, 25 bp, Homo sapien
tttctccaagtcctgaagcttcaga

SEQ ID NO: 341979 - DNA, 25 bp, Homo sapien
tagggaaactgatggtataactctc

SEQ ID NO: 341980 - DNA, 25 bp, Homo sapien
actctcagtcagaggccaatggact

SEQ ID NO: 341981 - DNA, 25 bp, Homo sapien
agaactcagacagccactttgcaac

SEQ ID NO: 341982 - DNA, 25 bp, Homo sapien
acagccactttgcaactcctggaat

SEQ ID NO: 341983 - DNA, 25 bp, Homo sapien
aactcctggaatcccaaggccagag

SEQ ID NO: 341984 - DNA, 25 bp, Homo sapien
tttggatgtccaaaagcaccagaag

SEQ ID NO: 341985 - DNA, 25 bp, Homo sapien
ccagaaggagggtgtcttaggtcca

SEQ ID NO: 341986 - DNA, 25 bp, Homo sapien
ttaggtccaggagagagtgagcttt

SEQ ID NO: 341987 - DNA, 25 bp, Homo sapien
gtgggtgtccctctattaaatattt

SEQ ID NO: 341988 - DNA, 25 bp, Homo sapien
agcctgacccaagcccagggcgact

SEQ ID NO: 341989 - DNA, 25 bp, Homo sapien
atgctgggcagcaccggtgcccaaa

SEQ ID NO: 341990 - DNA, 25 bp, Homo sapien
tgggcagcaccggtgcccaaatctg

SEQ ID NO: 341991 - DNA, 25 bp, Homo sapien
gcacctggagagttggagagctttt

SEQ ID NO: 341992 - DNA, 25 bp, Homo sapien
taaaaagacatctctcagcacttcc

SEQ ID NO: 341993 - DNA, 25 bp, Homo sapien
aaaagacatctctcagcacttccct

SEQ ID NO: 341994 - DNA, 25 bp, Homo sapien
cagattctgactcagtaagtgaggg

SEQ ID NO: 341995 - DNA, 25 bp, Homo sapien
acagtcatttttctctattctgaag

SEQ ID NO: 341996 - DNA, 25 bp, Homo sapien
ttttctctattctgaagctctccca

SEQ ID NO: 341997 - DNA, 25 bp, Homo sapien
tgttttcaatgtttaaccaactggg

SEQ ID NO: 341998 - DNA, 25 bp, Homo sapien
gggacccctgctctttaagtatatt

SEQ ID NO: 341999 - DNA, 25 bp, Homo sapien
tacttactcaaatcttaggaattct

SEQ ID NO: 342000 - DNA, 25 bp, Homo sapien
gatgttaatgttatggtgccaccag

SEQ ID NO: 342001 - DNA, 25 bp, Homo sapien
cataaagtttctgtgtggttctggc

SEQ ID NO: 342002 - DNA, 25 bp, Homo sapien
gtggttctggcttatgtaatggtat

SEQ ID NO: 342003 - DNA, 25 bp, Homo sapien
gcttatgtaatggtatgtgccaggc

SEQ ID NO: 342004 - DNA, 25 bp, Homo sapien
tgtgccaggcagaaaggcttgcttt

SEQ ID NO: 342005 - DNA, 25 bp, Homo sapien
aaaggcttgcttttctaacactcac

SEQ ID NO: 342006 - DNA, 25 bp, Homo sapien
gcttttctaacactcacaaactcat

SEQ ID NO: 342007 - DNA, 25 bp, Homo sapien
actcatttatatttgtccttggttg

SEQ ID NO: 342008 - DNA, 25 bp, Homo sapien
aaatggaagctttctttatgaagac

SEQ ID NO: 342009 - DNA, 25 bp, Homo sapien
gaagacatatgctcaactctatact

SEQ ID NO: 342010 - DNA, 25 bp, Homo sapien
catccgatgacaaccccatgaatga

SEQ ID NO: 342011 - DNA, 25 bp, Homo sapien
gatgacaaccccatgaatgaccctc

SEQ ID NO: 342012 - DNA, 25 bp, Homo sapien
aatgaccctcagcaagaactaccta

SEQ ID NO: 342013 - DNA, 25 bp, Homo sapien
gcaagaactacctagctgaatccag

SEQ ID NO: 342014 - DNA, 25 bp, Homo sapien
tagctgaatccagccaaactccaga

SEQ ID NO: 342015 - DNA, 25 bp, Homo sapien
gccaaactccagacccatgagagag

SEQ ID NO: 342016 - DNA, 25 bp, Homo sapien
gttgtttgagtcactaaatacggag

SEQ ID NO: 342017 - DNA, 25 bp, Homo sapien
aacagataactggaaccacaagtgt

SEQ ID NO: 342018 - DNA, 25 bp, Homo sapien
cttctgccacattccataattgact

SEQ ID NO: 342019 - DNA, 25 bp, Homo sapien
taattgacttttgttcatgaaccta

SEQ ID NO: 342020 - DNA, 25 bp, Homo sapien
tcatgaacctattggcaagtttgcc

SEQ ID NO: 342021 - DNA, 25 bp, Homo sapien
tgctccaagggctattcacagactg

SEQ ID NO: 342022 - DNA, 25 bp, Homo sapien
gggctattcacagactgtcagagtt

SEQ ID NO: 342023 - DNA, 25 bp, Homo sapien
ggttttgatagttcccggtctgctc

SEQ ID NO: 342024 - DNA, 25 bp, Homo sapien
tcccggtctgctcctaatagtgaga

SEQ ID NO: 342025 - DNA, 25 bp, Homo sapien
cctaatagtgagacccgggcagtca

SEQ ID NO: 342026 - DNA, 25 bp, Homo sapien
cgggcagtcagtcatggctcatctt

SEQ ID NO: 342027 - DNA, 25 bp, Homo sapien
tcatggctcatctttgtggttcagt

SEQ ID NO: 342028 - DNA, 25 bp, Homo sapien
tcatctttgtggttcagtttttctc

SEQ ID NO: 342029 - DNA, 25 bp, Homo sapien
atttcacatggccaaatgatgtgtt

SEQ ID NO: 342030 - DNA, 25 bp, Homo sapien
aatgatgtgttggtagtggttcctt

SEQ ID NO: 342031 - DNA, 25 bp, Homo sapien
tagtggttccttgaggtgctgtgct

SEQ ID NO: 342032 - DNA, 25 bp, Homo sapien
gtaacgctagaactgttggaccaaa

SEQ ID NO: 342033 - DNA, 25 bp, Homo sapien
actgttggaccaaatcaagtatatg

SEQ ID NO: 342034 - DNA, 25 bp, Homo sapien
ttatcttcagacactataggtttta

SEQ ID NO: 342035 - DNA, 25 bp, Homo sapien
gtttcttttatgtaggttaatcaca

SEQ ID NO: 342036 - DNA, 25 bp, Homo sapien
gtaaatctgcacactgtactttgtt

SEQ ID NO: 342037 - DNA, 25 bp, Homo sapien
cactgtactttgttaaatgtcggta

SEQ ID NO: 342038 - DNA, 25 bp, Homo sapien
aatgtcggtattttcccagtataat

SEQ ID NO: 342039 - DNA, 25 bp, Homo sapien
gtattttcccagtataatgcgatga

SEQ ID NO: 342040 - DNA, 25 bp, Homo sapien
gcgatgaagcttaatctgaatactt

SEQ ID NO: 342041 - DNA, 25 bp, Homo sapien
gaatacttggtatgctattgagttt

SEQ ID NO: 342042 - DNA, 25 bp, Homo sapien
atgctattgagtttactttcctatg

SEQ ID NO: 342043 - DNA, 25 bp, Homo sapien
tgtgaccgcaggttgctttcccacc

SEQ ID NO: 342044 - DNA, 25 bp, Homo sapien
tgctttcccaccctgggcaatgcag

SEQ ID NO: 342045 - DNA, 25 bp, Homo sapien
tgggcaatgcagtgcagcatgggaa

SEQ ID NO: 342046 - DNA, 25 bp, Homo sapien
tgcagtgcagcatgggaaaggaata

SEQ ID NO: 342047 - DNA, 25 bp, Homo sapien
aacaaggtgcacagacctcagagat

SEQ ID NO: 342048 - DNA, 25 bp, Homo sapien
cagagatggcttccttgtttatggg

SEQ ID NO: 342049 - DNA, 25 bp, Homo sapien
ggcttccttgtttatggggctctca

SEQ ID NO: 342050 - DNA, 25 bp, Homo sapien
ttgtttatggggctctcacagatac

SEQ ID NO: 342051 - DNA, 25 bp, Homo sapien
ggctctcacagatacccatccaact

SEQ ID NO: 342052 - DNA, 25 bp, Homo sapien
atccaactcctctagtcagcactag

SEQ ID NO: 342053 - DNA, 25 bp, Homo sapien
caactcctctagtcagcactagatc

SEQ ID NO: 342054 - DNA, 25 bp, Homo sapien
agtgctttgatacttgcgttaaaca

SEQ ID NO: 342055 - DNA, 25 bp, Homo sapien
acttgcgttaaacaagctcctgttt

SEQ ID NO: 342056 - DNA, 25 bp, Homo sapien
gctcctgtttataaagacttggtgg

SEQ ID NO: 342057 - DNA, 25 bp, Homo sapien
ggtggccatgtaatgagattgttct

SEQ ID NO: 342058 - DNA, 25 bp, Homo sapien
atgagattgttctaattacctaatt

SEQ ID NO: 342059 - DNA, 25 bp, Homo sapien
tgcttctcttgccacaacggttaag

SEQ ID NO: 342060 - DNA, 25 bp, Homo sapien
gaaatactctttccttctacaatat

SEQ ID NO: 342061 - DNA, 25 bp, Homo sapien
tgccacaacggttaagtttcacaaa

SEQ ID NO: 342062 - DNA, 25 bp, Homo sapien
tcacaaaactttacccttttgagag

SEQ ID NO: 342063 - DNA, 25 bp, Homo sapien
gggcataatgctaataacctcacct

SEQ ID NO: 342064 - DNA, 25 bp, Homo sapien
gctaataacctcacctaccataaaa

SEQ ID NO: 342065 - DNA, 25 bp, Homo sapien
acattttgtggccttttgattaggg

SEQ ID NO: 342066 - DNA, 25 bp, Homo sapien
gtggccttttgattagggtagtgtt

SEQ ID NO: 342067 - DNA, 25 bp, Homo sapien
gggtagtgttttccttagatctcta

SEQ ID NO: 342068 - DNA, 25 bp, Homo sapien
gtagtgttttccttagatctctaat

SEQ ID NO: 342069 - DNA, 25 bp, Homo sapien
gatctctaattttgtggatgttaat

SEQ ID NO: 342070 - DNA, 25 bp, Homo sapien
agttccatggtaaatcaatttggga

SEQ ID NO: 342071 - DNA, 25 bp, Homo sapien
gaccatggttcactggagcctccat

SEQ ID NO: 342072 - DNA, 25 bp, Homo sapien
ttcactggagcctccatcaaacgag

SEQ ID NO: 342073 - DNA, 25 bp, Homo sapien
tccatcaaacgagcctcctgagtag

SEQ ID NO: 342074 - DNA, 25 bp, Homo sapien
attacgggcgcttgccactacgcct

SEQ ID NO: 342075 - DNA, 25 bp, Homo sapien
gacttctagtgtagatgaggtcttg

SEQ ID NO: 342076 - DNA, 25 bp, Homo sapien
agcagctcagtctcacctgtgagtg

SEQ ID NO: 342077 - DNA, 25 bp, Homo sapien
gctttggaccccagcgctaaggtgg

SEQ ID NO: 342078 - DNA, 25 bp, Homo sapien
ctaaggtgggctacgtggagctccc

SEQ ID NO: 342079 - DNA, 25 bp, Homo sapien
gccccagtgagcctgctgaaattgt

SEQ ID NO: 342080 - DNA, 25 bp, Homo sapien
gctgaaattgtagcagagactgtaa

SEQ ID NO: 342081 - DNA, 25 bp, Homo sapien
caagacataaatttgctgtgtgttc

SEQ ID NO: 342082 - DNA, 25 bp, Homo sapien
ccatgctccgtgcaggatgtcctgt

SEQ ID NO: 342083 - DNA, 25 bp, Homo sapien
gcaggatgtcctgtgttcacgccag

SEQ ID NO: 342084 - DNA, 25 bp, Homo sapien
tgtgttcacgccagggcaggcacaa

SEQ ID NO: 342085 - DNA, 25 bp, Homo sapien
gccagggcaggcacaaggaaagtca

SEQ ID NO: 342086 - DNA, 25 bp, Homo sapien
aggaaagtcagcacggccccatgtt

SEQ ID NO: 342087 - DNA, 25 bp, Homo sapien
tagtatttcctttgaacctggccac

SEQ ID NO: 342088 - DNA, 25 bp, Homo sapien
gccctgtcagaaaggagttgaacct

SEQ ID NO: 342089 - DNA, 25 bp, Homo sapien
gttgaacctaaatgccaccaggcca

SEQ ID NO: 342090 - DNA, 25 bp, Homo sapien
tccctcctaaggaagctctgaaagt

SEQ ID NO: 342091 - DNA, 25 bp, Homo sapien
tctgaaagtcttacccaagtctgta

SEQ ID NO: 342092 - DNA, 25 bp, Homo sapien
agtctgtaactcagactgccccagc

SEQ ID NO: 342093 - DNA, 25 bp, Homo sapien
agttttgttttcacgcatgggagcc

SEQ ID NO: 342094 - DNA, 25 bp, Homo sapien
aaacaaagactcctcccagagtgct

SEQ ID NO: 342095 - DNA, 25 bp, Homo sapien
ctcctgaaggaacagagtgtggtca

SEQ ID NO: 342096 - DNA, 25 bp, Homo sapien
ttggaccacgcctctttggaaagtg

SEQ ID NO: 342097 - DNA, 25 bp, Homo sapien
gcctctttggaaagtgcttccacag

SEQ ID NO: 342098 - DNA, 25 bp, Homo sapien
gtggaggttctgcaagcacctttca

SEQ ID NO: 342099 - DNA, 25 bp, Homo sapien
tctgcaagcacctttcatcctgagg

SEQ ID NO: 342100 - DNA, 25 bp, Homo sapien
tcatcctgagggagggctgactttc

SEQ ID NO: 342101 - DNA, 25 bp, Homo sapien
ggagggctgactttcctaccacagg

SEQ ID NO: 342102 - DNA, 25 bp, Homo sapien
atctgcttcagagacacggtttttg

SEQ ID NO: 342103 - DNA, 25 bp, Homo sapien
gacacggtttttgaattgcaagagt

SEQ ID NO: 342104 - DNA, 25 bp, Homo sapien
attgcaagagtgacagaagaccaga

SEQ ID NO: 342105 - DNA, 25 bp, Homo sapien
gatgatctgatacaaactcctaatt

SEQ ID NO: 342106 - DNA, 25 bp, Homo sapien
ataaatgatgaccaagatgcttaaa

SEQ ID NO: 342107 - DNA, 25 bp, Homo sapien
acacttcgttaatgacatagcttag

SEQ ID NO: 342108 - DNA, 25 bp, Homo sapien
ataacctatatcttcagttcctgaa

SEQ ID NO: 342109 - DNA, 25 bp, Homo sapien
aaatattatgttctaattaccttga

SEQ ID NO: 342110 - DNA, 25 bp, Homo sapien
tattatgttctaattaccttgaaag

SEQ ID NO: 342111 - DNA, 25 bp, Homo sapien
tatgttctaattaccttgaaagagg

SEQ ID NO: 342112 - DNA, 25 bp, Homo sapien
tgttctaattaccttgaaagaggaa

SEQ ID NO: 342113 - DNA, 25 bp, Homo sapien
gaaaggcttgaattgatcaatacca

SEQ ID NO: 342114 - DNA, 25 bp, Homo sapien
aaggcttgaattgatcaataccagt

SEQ ID NO: 342115 - DNA, 25 bp, Homo sapien
ggcttgaattgatcaataccagttt

SEQ ID NO: 342116 - DNA, 25 bp, Homo sapien
gcttgaattgatcaataccagtttg

SEQ ID NO: 342117 - DNA, 25 bp, Homo sapien
gaattgatcaataccagtttgaata

SEQ ID NO: 342118 - DNA, 25 bp, Homo sapien
gatcaataccagtttgaataagata

SEQ ID NO: 342119 - DNA, 25 bp, Homo sapien
aataccagtttgaataagatactta

SEQ ID NO: 342120 - DNA, 25 bp, Homo sapien
tgggcagagctcttcagtcactcct

SEQ ID NO: 342121 - DNA, 25 bp, Homo sapien
gaagtcctggatgggagttaatgca

SEQ ID NO: 342122 - DNA, 25 bp, Homo sapien
gagttaatgcagtgggcttcagaac

SEQ ID NO: 342123 - DNA, 25 bp, Homo sapien
gtggatgggttcactgtcacgctct

SEQ ID NO: 342124 - DNA, 25 bp, Homo sapien
atgggttcactgtcacgctctgtgt

SEQ ID NO: 342125 - DNA, 25 bp, Homo sapien
ctaggcaaactcacatcagactctt

SEQ ID NO: 342126 - DNA, 25 bp, Homo sapien
tcacatcagactcttgtttcctttt

SEQ ID NO: 342127 - DNA, 25 bp, Homo sapien
gtgtggtgcctttccttatttgtgc

SEQ ID NO: 342128 - DNA, 25 bp, Homo sapien
aggaggtttcacagatgcataggaa

SEQ ID NO: 342129 - DNA, 25 bp, Homo sapien
ataggaaaggcctgtctcctgtgcc

SEQ ID NO: 342130 - DNA, 25 bp, Homo sapien
tgtctcctgtgcctttttaactgcc

SEQ ID NO: 342131 - DNA, 25 bp, Homo sapien
aatttttctctaatagttattggca

SEQ ID NO: 342132 - DNA, 25 bp, Homo sapien
ttcaaagtcctttaagaaacactga

SEQ ID NO: 342133 - DNA, 25 bp, Homo sapien
gtcctttaagaaacactgaaaactg

SEQ ID NO: 342134 - DNA, 25 bp, Homo sapien
gaaaatggcagttctgcagggctca

SEQ ID NO: 342135 - DNA, 25 bp, Homo sapien
aatggcagttctgcagggctcaggt

SEQ ID NO: 342136 - DNA, 25 bp, Homo sapien
gctgttgggacaggtttgacagact

SEQ ID NO: 342137 - DNA, 25 bp, Homo sapien
gacaggtttgacagactgtcctaat

SEQ ID NO: 342138 - DNA, 25 bp, Homo sapien
gactgtcctaatacaaggagcgcct

SEQ ID NO: 342139 - DNA, 25 bp, Homo sapien
ggagcgccttttcccagatcagcag

SEQ ID NO: 342140 - DNA, 25 bp, Homo sapien
cagatcagcagctctagagggtggc

SEQ ID NO: 342141 - DNA, 25 bp, Homo sapien
gctggatagcaggtggttacaaaat

SEQ ID NO: 342142 - DNA, 25 bp, Homo sapien
agacagtacctgtttcatcgaaaaa

SEQ ID NO: 342143 - DNA, 25 bp, Homo sapien
gctgttacgattagcatatttgaac

SEQ ID NO: 342144 - DNA, 25 bp, Homo sapien
gaaaagtatgctttaccgtgtgcaa

SEQ ID NO: 342145 - DNA, 25 bp, Homo sapien
gctttaccgtgtgcaacaattgtga

SEQ ID NO: 342146 - DNA, 25 bp, Homo sapien
accgtgtgcaacaattgtgaaagtt

SEQ ID NO: 342147 - DNA, 25 bp, Homo sapien
tgtttcatcgaaaaagtgcctaata

SEQ ID NO: 342148 - DNA, 25 bp, Homo sapien
aataacacacttttggagacacttt

SEQ ID NO: 342149 - DNA, 25 bp, Homo sapien
acacttttggagacacttttcagac

SEQ ID NO: 342150 - DNA, 25 bp, Homo sapien
cacttttcagacagagcgtttccag

SEQ ID NO: 342151 - DNA, 25 bp, Homo sapien
ttcagacagagcgtttccagcatct

SEQ ID NO: 342152 - DNA, 25 bp, Homo sapien
agacagagcgtttccagcatcttcc

SEQ ID NO: 342153 - DNA, 25 bp, Homo sapien
ggctgcccaaagagcacgcggccag

SEQ ID NO: 342154 - DNA, 25 bp, Homo sapien
cggccagcctgtgccgctgttatga

SEQ ID NO: 342155 - DNA, 25 bp, Homo sapien
tgtgccgctgttatgaggagaagca

SEQ ID NO: 342156 - DNA, 25 bp, Homo sapien
gaggagaagcaaagccccttgcaga

SEQ ID NO: 342157 - DNA, 25 bp, Homo sapien
gaagcaaagccccttgcagaagcac

SEQ ID NO: 342158 - DNA, 25 bp, Homo sapien
aaagccccttgcagaagcacttgcg

SEQ ID NO: 342159 - DNA, 25 bp, Homo sapien
agccccttgcagaagcacttgcggg

SEQ ID NO: 342160 - DNA, 25 bp, Homo sapien
ccttgcagaagcacttgcgggtctg

SEQ ID NO: 342161 - DNA, 25 bp, Homo sapien
gcagaagcacttgcgggtctgcagc

SEQ ID NO: 342162 - DNA, 25 bp, Homo sapien
aagcacttgcgggtctgcagcctac

SEQ ID NO: 342163 - DNA, 25 bp, Homo sapien
cacttgcgggtctgcagcctacgca

SEQ ID NO: 342164 - DNA, 25 bp, Homo sapien
gttcttgaatgtatacgggacttga

SEQ ID NO: 342165 - DNA, 25 bp, Homo sapien
aatgtatacgggacttgactcagac

SEQ ID NO: 342166 - DNA, 25 bp, Homo sapien
atacgggacttgactcagaccacta

SEQ ID NO: 342167 - DNA, 25 bp, Homo sapien
ggacttgactcagaccactaaaatg

SEQ ID NO: 342168 - DNA, 25 bp, Homo sapien
agaccactaaaatgacagtgtcctg

SEQ ID NO: 342169 - DNA, 25 bp, Homo sapien
gacagtgtcctggaaatgaggatga

SEQ ID NO: 342170 - DNA, 25 bp, Homo sapien
ggaagactctggcaaaaccccccag

SEQ ID NO: 342171 - DNA, 25 bp, Homo sapien
gggcagtgtggcaactcccactcca

SEQ ID NO: 342172 - DNA, 25 bp, Homo sapien
ctttcactctttgccacttcaataa

SEQ ID NO: 342173 - DNA, 25 bp, Homo sapien
actctttgccacttcaataaagttt

SEQ ID NO: 342174 - DNA, 25 bp, Homo sapien
ggccaatcaagtcacccaatgtaag

SEQ ID NO: 342175 - DNA, 25 bp, Homo sapien
tccttagaaatggacctcttcatgt

SEQ ID NO: 342176 - DNA, 25 bp, Homo sapien
ggcaagctttggacacagatatgat

SEQ ID NO: 342177 - DNA, 25 bp, Homo sapien
gataggtgcatcagcttcggaagag

SEQ ID NO: 342178 - DNA, 25 bp, Homo sapien
gttaggaagacatccgggctgctga

SEQ ID NO: 342179 - DNA, 25 bp, Homo sapien
tccgggctgctgagactcgggatta

SEQ ID NO: 342180 - DNA, 25 bp, Homo sapien
taaagtgggtcctggaatcttttag

SEQ ID NO: 342181 - DNA, 25 bp, Homo sapien
atcttttaggacttctgctgtagga

SEQ ID NO: 342182 - DNA, 25 bp, Homo sapien
tgctgtaggacaaacagctgccttt

SEQ ID NO: 342183 - DNA, 25 bp, Homo sapien
ttggtgttttaatgtctcccaaagt

SEQ ID NO: 342184 - DNA, 25 bp, Homo sapien
caaagtacccttcagccaataaata

SEQ ID NO: 342185 - DNA, 25 bp, Homo sapien
ttcagccaataaataccatctgttg

SEQ ID NO: 342186 - DNA, 25 bp, Homo sapien
ggaggaaccacggactacacagtca

SEQ ID NO: 342187 - DNA, 25 bp, Homo sapien
aacaagatacttcctgaagcttaaa

SEQ ID NO: 342188 - DNA, 25 bp, Homo sapien
ttgaattttcatccatacctccgtt

SEQ ID NO: 342189 - DNA, 25 bp, Homo sapien
atacctccgttattcttactctact

SEQ ID NO: 342190 - DNA, 25 bp, Homo sapien
ttattcttactctactcgctcaaca

SEQ ID NO: 342191 - DNA, 25 bp, Homo sapien
tactcgctcaacaacaggttctgat

SEQ ID NO: 342192 - DNA, 25 bp, Homo sapien
tatttccagttccacaaccctgctt

SEQ ID NO: 342193 - DNA, 25 bp, Homo sapien
acaaccctgcttaggctattgtcat

SEQ ID NO: 342194 - DNA, 25 bp, Homo sapien
cttaggctattgtcattcgtggaac

SEQ ID NO: 342195 - DNA, 25 bp, Homo sapien
ggacagattcccatgtgcaaggctc

SEQ ID NO: 342196 - DNA, 25 bp, Homo sapien
tacttaagcatgacctgcagtttaa

SEQ ID NO: 342197 - DNA, 25 bp, Homo sapien
tgggcaatgcagtgcagcatgggaa

SEQ ID NO: 342198 - DNA, 25 bp, Homo sapien
gtgcagcatgggaaaggaataaggg

SEQ ID NO: 342199 - DNA, 25 bp, Homo sapien
cagagatggcttccttgtttatggg

SEQ ID NO: 342200 - DNA, 25 bp, Homo sapien
gatggcttccttgtttatggggctc

SEQ ID NO: 342201 - DNA, 25 bp, Homo sapien
gcttccttgtttatggggctctcac

SEQ ID NO: 342202 - DNA, 25 bp, Homo sapien
ttgtttatggggctctcacagatac

SEQ ID NO: 342203 - DNA, 25 bp, Homo sapien
tttatggggctctcacagataccca

SEQ ID NO: 342204 - DNA, 25 bp, Homo sapien
ggctctcacagatacccatccaact

SEQ ID NO: 342205 - DNA, 25 bp, Homo sapien
atccaactcctctagtcagcactag

SEQ ID NO: 342206 - DNA, 25 bp, Homo sapien
tccaactcctctagtcagcactaga

SEQ ID NO: 342207 - DNA, 25 bp, Homo sapien
caactcctctagtcagcactagatc

SEQ ID NO: 342208 - DNA, 25 bp, Homo sapien
tgaaccttggtttctctgttttaag

SEQ ID NO: 342209 - DNA, 25 bp, Homo sapien
ggtttctctgttttaaggatatacg

SEQ ID NO: 342210 - DNA, 25 bp, Homo sapien
ggatatacgagatagtgttggttga

SEQ ID NO: 342211 - DNA, 25 bp, Homo sapien
tggttgaggactgtgatggttcatt

SEQ ID NO: 342212 - DNA, 25 bp, Homo sapien
gggccacaggatacccagatcctgg

SEQ ID NO: 342213 - DNA, 25 bp, Homo sapien
aggatacccagatcctggtaagata

SEQ ID NO: 342214 - DNA, 25 bp, Homo sapien
acccagatcctggtaagatattatt

SEQ ID NO: 342215 - DNA, 25 bp, Homo sapien
agatattatttctgactgtgtctgt

SEQ ID NO: 342216 - DNA, 25 bp, Homo sapien
cccttatccatttgggcagatattg

SEQ ID NO: 342217 - DNA, 25 bp, Homo sapien
atttgggcagatattgtccatcctt

SEQ ID NO: 342218 - DNA, 25 bp, Homo sapien
gggcagatattgtccatcctttggg

SEQ ID NO: 342219 - DNA, 25 bp, Homo sapien
agctctgtcatttcctggctgggtg

SEQ ID NO: 342220 - DNA, 25 bp, Homo sapien
acctagtcaccctttttgagtcttg

SEQ ID NO: 342221 - DNA, 25 bp, Homo sapien
gagtcttgttttctcagattatgaa

SEQ ID NO: 342222 - DNA, 25 bp, Homo sapien
gaaaaatttccttcctcgtgagata

SEQ ID NO: 342223 - DNA, 25 bp, Homo sapien
gagataagcacgtgccattagctat

SEQ ID NO: 342224 - DNA, 25 bp, Homo sapien
tgtgaatccacacatgccattccat

SEQ ID NO: 342225 - DNA, 25 bp, Homo sapien
gatcatgtggatctttggtgccttc

SEQ ID NO: 342226 - DNA, 25 bp, Homo sapien
tctgtgagggtcagacctgtcctga

SEQ ID NO: 342227 - DNA, 25 bp, Homo sapien
agacctgtcctgaggcttttacaaa

SEQ ID NO: 342228 - DNA, 25 bp, Homo sapien
gaggcttttacaaattggcccagaa

SEQ ID NO: 342229 - DNA, 25 bp, Homo sapien
tggcccagaactcatttaaccacag

SEQ ID NO: 342230 - DNA, 25 bp, Homo sapien
tatgctgaaattgcagagaagggaa

SEQ ID NO: 342231 - DNA, 25 bp, Homo sapien
gggaataaaaattaccaccatctat

SEQ ID NO: 342232 - DNA, 25 bp, Homo sapien
accaccatctattaattgtatcagt

SEQ ID NO: 342233 - DNA, 25 bp, Homo sapien
aattgtatcagtgtttgggtatatg

SEQ ID NO: 342234 - DNA, 25 bp, Homo sapien
tttgggtatatggtgatgtgagatc

SEQ ID NO: 342235 - DNA, 25 bp, Homo sapien
tgatgtgagatcagggatgcataaa

SEQ ID NO: 342236 - DNA, 25 bp, Homo sapien
gagatcagggatgcataaagcgaac

SEQ ID NO: 342237 - DNA, 25 bp, Homo sapien
gggatgcataaagcgaacaaattca

SEQ ID NO: 342238 - DNA, 25 bp, Homo sapien
aaagcgaacaaattcaactgaggat

SEQ ID NO: 342239 - DNA, 25 bp, Homo sapien
gcgaacaaattcaactgaggattaa

SEQ ID NO: 342240 - DNA, 25 bp, Homo sapien
gtgctgacctggacccagcctgaga

SEQ ID NO: 342241 - DNA, 25 bp, Homo sapien
attttgtttataattggcctggtgt

SEQ ID NO: 342242 - DNA, 25 bp, Homo sapien
ttttgtttataattggcctggtgtg

SEQ ID NO: 342243 - DNA, 25 bp, Homo sapien
tttgtttataattggcctggtgtgg

SEQ ID NO: 342244 - DNA, 25 bp, Homo sapien
ttgtttataattggcctggtgtggt

SEQ ID NO: 342245 - DNA, 25 bp, Homo sapien
tgtttataattggcctggtgtggtg

SEQ ID NO: 342246 - DNA, 25 bp, Homo sapien
gtttataattggcctggtgtggtgg

SEQ ID NO: 342247 - DNA, 25 bp, Homo sapien
tttataattggcctggtgtggtggc

SEQ ID NO: 342248 - DNA, 25 bp, Homo sapien
agtgacccgagatcgagatcacacc

SEQ ID NO: 342249 - DNA, 25 bp, Homo sapien
gtgacccgagatcgagatcacacca

SEQ ID NO: 342250 - DNA, 25 bp, Homo sapien
tgacccgagatcgagatcacaccac

SEQ ID NO: 342251 - DNA, 25 bp, Homo sapien
gacccgagatcgagatcacaccact

SEQ ID NO: 342252 - DNA, 25 bp, Homo sapien
tctggctttagtgcccaccacagta

SEQ ID NO: 342253 - DNA, 25 bp, Homo sapien
tagtgcccaccacagtacaagaagg

SEQ ID NO: 342254 - DNA, 25 bp, Homo sapien
tacaagaaggcgtggcttccaaccc

SEQ ID NO: 342255 - DNA, 25 bp, Homo sapien
agcatgtgcaccaagctgttggact

SEQ ID NO: 342256 - DNA, 25 bp, Homo sapien
agctgttggactaccatactcactg

SEQ ID NO: 342257 - DNA, 25 bp, Homo sapien
ggactaccatactcactgtaactga

SEQ ID NO: 342258 - DNA, 25 bp, Homo sapien
aattacaagcggatttgcccatgaa

SEQ ID NO: 342259 - DNA, 25 bp, Homo sapien
tgcccatgaaatgaatgagccattc

SEQ ID NO: 342260 - DNA, 25 bp, Homo sapien
tgagccattcttaaacctcacatcc

SEQ ID NO: 342261 - DNA, 25 bp, Homo sapien
ttaaacctcacatccctgtaagact

SEQ ID NO: 342262 - DNA, 25 bp, Homo sapien
aagactcagaaactgcccatgtcag

SEQ ID NO: 342263 - DNA, 25 bp, Homo sapien
tctacaattttctgatctctctctc

SEQ ID NO: 342264 - DNA, 25 bp, Homo sapien
tctctctctccttgtttaatatata

SEQ ID NO: 342265 - DNA, 25 bp, Homo sapien
accattgatttttctggagtttaat

SEQ ID NO: 342266 - DNA, 25 bp, Homo sapien
atataagccctaatttctgtgtatg

SEQ ID NO: 342267 - DNA, 25 bp, Homo sapien
gtgtatgtgagtaaaactgcagcct

SEQ ID NO: 342268 - DNA, 25 bp, Homo sapien
gtgagtaaaactgcagcctgagtca

SEQ ID NO: 342269 - DNA, 25 bp, Homo sapien
gcagcctgagtcatttaggaagtaa

SEQ ID NO: 342270 - DNA, 25 bp, Homo sapien
ataaaacagcactccctaacaatta

SEQ ID NO: 342271 - DNA, 25 bp, Homo sapien
ggagtttaattacattattaccatg

SEQ ID NO: 342272 - DNA, 25 bp, Homo sapien
attaccatgtattcttattggcctg

SEQ ID NO: 342273 - DNA, 25 bp, Homo sapien
tgtattcttattggcctgtagagga

SEQ ID NO: 342274 - DNA, 25 bp, Homo sapien
ttcccttgttatgcctcctcaattg

SEQ ID NO: 342275 - DNA, 25 bp, Homo sapien
ccttgttatgcctcctcaattggag

SEQ ID NO: 342276 - DNA, 25 bp, Homo sapien
gagagctgaataggaaggacttgcc

SEQ ID NO: 342277 - DNA, 25 bp, Homo sapien
aggacttgccattacctaaggccat

SEQ ID NO: 342278 - DNA, 25 bp, Homo sapien
ttgccattacctaaggccatgtgtg

SEQ ID NO: 342279 - DNA, 25 bp, Homo sapien
ggccaaggcctgtcgctcactcatt

SEQ ID NO: 342280 - DNA, 25 bp, Homo sapien
acctaaggccatgtgtgacagcctc

SEQ ID NO: 342281 - DNA, 25 bp, Homo sapien
tcactcattcacaacagtcgatgtg

SEQ ID NO: 342282 - DNA, 25 bp, Homo sapien
ggaggagcctttacacctgtggaga

SEQ ID NO: 342283 - DNA, 25 bp, Homo sapien
gagcctttacacctgtggagacagt

SEQ ID NO: 342284 - DNA, 25 bp, Homo sapien
tggagacagtgatagctttggagca

SEQ ID NO: 342285 - DNA, 25 bp, Homo sapien
gataaatgccctccaacaggtgtga

SEQ ID NO: 342286 - DNA, 25 bp, Homo sapien
aatgccctccaacaggtgtgagatg

SEQ ID NO: 342287 - DNA, 25 bp, Homo sapien
atattcattatggttgtaatttgca

SEQ ID NO: 342288 - DNA, 25 bp, Homo sapien
aatgctttaatgttgagaactgact

SEQ ID NO: 342289 - DNA, 25 bp, Homo sapien
gagaactgacttaacattgggacac

SEQ ID NO: 342290 - DNA, 25 bp, Homo sapien
ttaacattgggacacattcgaagca

SEQ ID NO: 342291 - DNA, 25 bp, Homo sapien
ggacacattcgaagcaatagggtaa

SEQ ID NO: 342292 - DNA, 25 bp, Homo sapien
gggtaaaagcaaaacaatgtcattc

SEQ ID NO: 342293 - DNA, 25 bp, Homo sapien
gtcattcaaacaagatatcagattt

SEQ ID NO: 342294 - DNA, 25 bp, Homo sapien
ttatctctaacatatcattcacctt

SEQ ID NO: 342295 - DNA, 25 bp, Homo sapien
tatcattcaccttttgataaatgcc

SEQ ID NO: 342296 - DNA, 25 bp, Homo sapien
aaaccagaccttgtatgttctcact

SEQ ID NO: 342297 - DNA, 25 bp, Homo sapien
accagaccttgtatgttctcactta

SEQ ID NO: 342298 - DNA, 25 bp, Homo sapien
ataagcgggagctaagcaaaggcat

SEQ ID NO: 342299 - DNA, 25 bp, Homo sapien
taagcgggagctaagcaaaggcata

SEQ ID NO: 342300 - DNA, 25 bp, Homo sapien
gcattcacaaggcaacgctggatgg

SEQ ID NO: 342301 - DNA, 25 bp, Homo sapien
cattcacaaggcaacgctggatgga

SEQ ID NO: 342302 - DNA, 25 bp, Homo sapien
attcacaaggcaacgctggatggag

SEQ ID NO: 342303 - DNA, 25 bp, Homo sapien
ttcacaaggcaacgctggatggagg

SEQ ID NO: 342304 - DNA, 25 bp, Homo sapien
tcacaaggcaacgctggatggaggt

SEQ ID NO: 342305 - DNA, 25 bp, Homo sapien
cacaaggcaacgctggatggaggtt

SEQ ID NO: 342306 - DNA, 25 bp, Homo sapien
caaggcaacgctggatggaggttgg

SEQ ID NO: 342307 - DNA, 25 bp, Homo sapien
gggattcttccggtagtacttgatc

SEQ ID NO: 342308 - DNA, 25 bp, Homo sapien
gatctatggctaacagtccgggtat

SEQ ID NO: 342309 - DNA, 25 bp, Homo sapien
gtccgggtatattgctcagatctgt

SEQ ID NO: 342310 - DNA, 25 bp, Homo sapien
tcagatctgttctagccacaatagg

SEQ ID NO: 342311 - DNA, 25 bp, Homo sapien
taggactggcagtagcttgatcaga

SEQ ID NO: 342312 - DNA, 25 bp, Homo sapien
gatcagagagttcttttcctttgga

SEQ ID NO: 342313 - DNA, 25 bp, Homo sapien
gtcatcttcaagctgtagtactttc

SEQ ID NO: 342314 - DNA, 25 bp, Homo sapien
gtactttctgactctcctcaataat

SEQ ID NO: 342315 - DNA, 25 bp, Homo sapien
atcttgtttcaattcttgtacaggg

SEQ ID NO: 342316 - DNA, 25 bp, Homo sapien
tccaactttgtatgcagtgttctct

SEQ ID NO: 342317 - DNA, 25 bp, Homo sapien
tgttctctgtttccttgaatgttga

SEQ ID NO: 342318 - DNA, 25 bp, Homo sapien
tgctcacagctcacggttcaccaga

SEQ ID NO: 342319 - DNA, 25 bp, Homo sapien
gctcacggttcaccagaatccaggg

SEQ ID NO: 342320 - DNA, 25 bp, Homo sapien
ggcttggtcggcctaggaatccaca

SEQ ID NO: 342321 - DNA, 25 bp, Homo sapien
gtcggcctaggaatccacaatgctg

SEQ ID NO: 342322 - DNA, 25 bp, Homo sapien
gaatccacaatgctggatattttca

SEQ ID NO: 342323 - DNA, 25 bp, Homo sapien
tcctgatgttctttgccatcatagg

SEQ ID NO: 342324 - DNA, 25 bp, Homo sapien
tgttctttgccatcataggcctggt

SEQ ID NO: 342325 - DNA, 25 bp, Homo sapien
ctggtcattctgtcctacattatct

SEQ ID NO: 342326 - DNA, 25 bp, Homo sapien
tctgtcctacattatctatctgctc

SEQ ID NO: 342327 - DNA, 25 bp, Homo sapien
acattatctatctgctctagtggcc

SEQ ID NO: 342328 - DNA, 25 bp, Homo sapien
gagcctgctggagaacagctcagaa

SEQ ID NO: 342329 - DNA, 25 bp, Homo sapien
atgaattcctccctgtatgttttgt

SEQ ID NO: 342330 - DNA, 25 bp, Homo sapien
attcctccctgtatgttttgttctt

SEQ ID NO: 342331 - DNA, 25 bp, Homo sapien
gctttacttttcaccttgcaaagag

SEQ ID NO: 342332 - DNA, 25 bp, Homo sapien
ttttcaccttgcaaagagatccagt

SEQ ID NO: 342333 - DNA, 25 bp, Homo sapien
gagatccagtacctagtattggaag

SEQ ID NO: 342334 - DNA, 25 bp, Homo sapien
ttggaagatccaccttaacgaccgt

SEQ ID NO: 342335 - DNA, 25 bp, Homo sapien
ttaacgaccgtgcatatgaaaacca

SEQ ID NO: 342336 - DNA, 25 bp, Homo sapien
gaaaaccacagtctaaggaagtgac

SEQ ID NO: 342337 - DNA, 25 bp, Homo sapien
tgcagaaagctcacagcgaccctgg

SEQ ID NO: 342338 - DNA, 25 bp, Homo sapien
tcccctgtggcctctttgagtgtct

SEQ ID NO: 342339 - DNA, 25 bp, Homo sapien
cagccctggacttccagacttctat

SEQ ID NO: 342340 - DNA, 25 bp, Homo sapien
gggagcctagtttcagttaagcctg

SEQ ID NO: 342341 - DNA, 25 bp, Homo sapien
gcctagtttcagttaagcctggaag

SEQ ID NO: 342342 - DNA, 25 bp, Homo sapien
gaaaataaccattccttgaagagat

SEQ ID NO: 342343 - DNA, 25 bp, Homo sapien
ataaccattccttgaagagatagag

SEQ ID NO: 342344 - DNA, 25 bp, Homo sapien
attacagtggaaaggtttggacaga

SEQ ID NO: 342345 - DNA, 25 bp, Homo sapien
gaagctgtaggaagctgattctaga

SEQ ID NO: 342346 - DNA, 25 bp, Homo sapien
gaagctgattctagaaagggaacat

SEQ ID NO: 342347 - DNA, 25 bp, Homo sapien
gggagaaggcagataacagatgact

SEQ ID NO: 342348 - DNA, 25 bp, Homo sapien
aacagatgactgaaaagcttactaa

SEQ ID NO: 342349 - DNA, 25 bp, Homo sapien
gtacagtagagagttaaacattcat

SEQ ID NO: 342350 - DNA, 25 bp, Homo sapien
ttaaacattcattggaaggagctga

SEQ ID NO: 342351 - DNA, 25 bp, Homo sapien
aggacgagctcttcaactactgggt

SEQ ID NO: 342352 - DNA, 25 bp, Homo sapien
aactactgggtcttcgtccaagcca

SEQ ID NO: 342353 - DNA, 25 bp, Homo sapien
caagccatcgcccatggtgtgacca

SEQ ID NO: 342354 - DNA, 25 bp, Homo sapien
atggtgtgaccacctctctggtcaa

SEQ ID NO: 342355 - DNA, 25 bp, Homo sapien
ctggtcaacttcttcatgacactgt

SEQ ID NO: 342356 - DNA, 25 bp, Homo sapien
atgacactgtggatcagccgcgaca

SEQ ID NO: 342357 - DNA, 25 bp, Homo sapien
agcttcagcgaccaccagtcctttg

SEQ ID NO: 342358 - DNA, 25 bp, Homo sapien
agtcctttgcggtcgtggtggccct

SEQ ID NO: 342359 - DNA, 25 bp, Homo sapien
ttatcatcaagtactggaccgccct

SEQ ID NO: 342360 - DNA, 25 bp, Homo sapien
tcagccttggtttctacgccatcat

SEQ ID NO: 342361 - DNA, 25 bp, Homo sapien
ggtttctacgccatcatgactacca

SEQ ID NO: 342362 - DNA, 25 bp, Homo sapien
gaaaaacaagacaaccagcctccct

SEQ ID NO: 342363 - DNA, 25 bp, Homo sapien
catctccctctatccattaaagaaa

SEQ ID NO: 342364 - DNA, 25 bp, Homo sapien
cctctatccattaaagaaacttcag

SEQ ID NO: 342365 - DNA, 25 bp, Homo sapien
agctatttgtgatattactaggaat

SEQ ID NO: 342366 - DNA, 25 bp, Homo sapien
atagaagagaacagaccacatccat

SEQ ID NO: 342367 - DNA, 25 bp, Homo sapien
aatgcaaatcagctcatttcaggta

SEQ ID NO: 342368 - DNA, 25 bp, Homo sapien
gcaaatcagctcatttcaggtaatg

SEQ ID NO: 342369 - DNA, 25 bp, Homo sapien
aatcagctcatttcaggtaatgaaa

SEQ ID NO: 342370 - DNA, 25 bp, Homo sapien
tcaggtaatgaaaatatttcccaga

SEQ ID NO: 342371 - DNA, 25 bp, Homo sapien
tcccagaaaatcagtcacaaagcag

SEQ ID NO: 342372 - DNA, 25 bp, Homo sapien
aaattaaggatcttgcggaaatgaa

SEQ ID NO: 342373 - DNA, 25 bp, Homo sapien
gggagtcaatgtgccatagtgttca

SEQ ID NO: 342374 - DNA, 25 bp, Homo sapien
atgtgccatagtgttcagagccagg

SEQ ID NO: 342375 - DNA, 25 bp, Homo sapien
tcagagccaggctgtctgccttcac

SEQ ID NO: 342376 - DNA, 25 bp, Homo sapien
agctctagcacttagttgctctgtg

SEQ ID NO: 342377 - DNA, 25 bp, Homo sapien
ttgctctgtggcattggacaagtta

SEQ ID NO: 342378 - DNA, 25 bp, Homo sapien
agatgggaattttgccatcctcctc

SEQ ID NO: 342379 - DNA, 25 bp, Homo sapien
gcctacatttgcacatttgggaatc

SEQ ID NO: 342380 - DNA, 25 bp, Homo sapien
tttgggaatcctccttggcatctaa

SEQ ID NO: 342381 - DNA, 25 bp, Homo sapien
cttggcatctaatctgtagggttgt

SEQ ID NO: 342382 - DNA, 25 bp, Homo sapien
tccctccatctttccattaaagttc

SEQ ID NO: 342383 - DNA, 25 bp, Homo sapien
taaagttctctcattgggagtcaat

SEQ ID NO: 342384 - DNA, 25 bp, Homo sapien
ggctgcacaatgactctgtgctgct

SEQ ID NO: 342385 - DNA, 25 bp, Homo sapien
aatgactctgtgctgctcacggtgg

SEQ ID NO: 342386 - DNA, 25 bp, Homo sapien
agtcagacaccgacgtggaagagga

SEQ ID NO: 342387 - DNA, 25 bp, Homo sapien
ggaggctatgacagcgatgttgcta

SEQ ID NO: 342388 - DNA, 25 bp, Homo sapien
gcgatgttgctagagaaaaggccat

SEQ ID NO: 342389 - DNA, 25 bp, Homo sapien
aaaaggccattgactacaccaccaa

SEQ ID NO: 342390 - DNA, 25 bp, Homo sapien
acaccaccaagatttatgctgtgag

SEQ ID NO: 342391 - DNA, 25 bp, Homo sapien
atgctgtgagcatcagggaaatgga

SEQ ID NO: 342392 - DNA, 25 bp, Homo sapien
accaagccacaccagcagctgaagg

SEQ ID NO: 342393 - DNA, 25 bp, Homo sapien
agcagctgaaggaagtttccgtgga

SEQ ID NO: 342394 - DNA, 25 bp, Homo sapien
gaagaaagaccacccgttagccgag

SEQ ID NO: 342395 - DNA, 25 bp, Homo sapien
tccttcatcggaaaattctggtttg

SEQ ID NO: 342396 - DNA, 25 bp, Homo sapien
catcggaaaattctggtttggacaa

SEQ ID NO: 342397 - DNA, 25 bp, Homo sapien
tctggtttggacaaactgtcagtga

SEQ ID NO: 342398 - DNA, 25 bp, Homo sapien
gaactaagcagtgtgctgggtgata

SEQ ID NO: 342399 - DNA, 25 bp, Homo sapien
cagtgtgctgggtgatataggtaat

SEQ ID NO: 342400 - DNA, 25 bp, Homo sapien
tataggtaatttacagcctggtaca

SEQ ID NO: 342401 - DNA, 25 bp, Homo sapien
taatttacagcctggtacaagcccc

SEQ ID NO: 342402 - DNA, 25 bp, Homo sapien
gtgggtcactaacagttcacagact

SEQ ID NO: 342403 - DNA, 25 bp, Homo sapien
tggcccaagagctgtggaccacact

SEQ ID NO: 342404 - DNA, 25 bp, Homo sapien
gtggaccacactgatattgatacta

SEQ ID NO: 342405 - DNA, 25 bp, Homo sapien
acactgatattgatactaaaccatt

SEQ ID NO: 342406 - DNA, 25 bp, Homo sapien
gaagtgcacttctaggtcatcaggt

SEQ ID NO: 342407 - DNA, 25 bp, Homo sapien
gcacttctaggtcatcaggtgacat

SEQ ID NO: 342408 - DNA, 25 bp, Homo sapien
tcaggtgacatgattggcgccaaca

SEQ ID NO: 342409 - DNA, 25 bp, Homo sapien
tggcgccaacacatggtactcttga

SEQ ID NO: 342410 - DNA, 25 bp, Homo sapien
gtactcttgatttagcacatctcag

SEQ ID NO: 342411 - DNA, 25 bp, Homo sapien
gctgaggcacctcattgatatttgt

SEQ ID NO: 342412 - DNA, 25 bp, Homo sapien
gcccagtacctcacgcagacataag

SEQ ID NO: 342413 - DNA, 25 bp, Homo sapien
cctcacgcagacataagtgctcagt

SEQ ID NO: 342414 - DNA, 25 bp, Homo sapien
gctcagtaaatgttgtccgtggtgg

SEQ ID NO: 342415 - DNA, 25 bp, Homo sapien
gggatggttgtcaccaacatctgaa

SEQ ID NO: 342416 - DNA, 25 bp, Homo sapien
tgtcaccaacatctgaagtgcactt

SEQ ID NO: 342417 - DNA, 25 bp, Homo sapien
tatggtcagtgaactagaagatctc

SEQ ID NO: 342418 - DNA, 25 bp, Homo sapien
ggacattttgaaggagtatttctac

SEQ ID NO: 342419 - DNA, 25 bp, Homo sapien
gatggcactcatcagcagcatggat

SEQ ID NO: 342420 - DNA, 25 bp, Homo sapien
actcatcagcagcatggattcctct

SEQ ID NO: 342421 - DNA, 25 bp, Homo sapien
attcctctctctgacatacacaaaa

SEQ ID NO: 342422 - DNA, 25 bp, Homo sapien
gctgtaacaaaaaatgtccgccaca

SEQ ID NO: 342423 - DNA, 25 bp, Homo sapien
gtccgccacaagttaacatcaagaa

SEQ ID NO: 342424 - DNA, 25 bp, Homo sapien
tctcagtgcttccatagatgtccag

SEQ ID NO: 342425 - DNA, 25 bp, Homo sapien
gcttccatagatgtccaggatgtat

SEQ ID NO: 342426 - DNA, 25 bp, Homo sapien
gatgtccaggatgtatataccaaag

SEQ ID NO: 342427 - DNA, 25 bp, Homo sapien
gagagtttcaatattgatcactata

SEQ ID NO: 342428 - DNA, 25 bp, Homo sapien
aattgagcccaatcttttgtcatca

SEQ ID NO: 342429 - DNA, 25 bp, Homo sapien
tgagcccaatcttttgtcatcaaga

SEQ ID NO: 342430 - DNA, 25 bp, Homo sapien
cttttgtcatcaagattgcctctgt

SEQ ID NO: 342431 - DNA, 25 bp, Homo sapien
gtcatcaagattgcctctgtatgag

SEQ ID NO: 342432 - DNA, 25 bp, Homo sapien
gagagagcctgaacttgagcaaaat

SEQ ID NO: 342433 - DNA, 25 bp, Homo sapien
gggtatgcagctttattctgatttc

SEQ ID NO: 342434 - DNA, 25 bp, Homo sapien
gcagctttattctgatttctttctg

SEQ ID NO: 342435 - DNA, 25 bp, Homo sapien
tttctttctggagtgatcaaaatac

SEQ ID NO: 342436 - DNA, 25 bp, Homo sapien
agatacactgcaagtgattgttgct

SEQ ID NO: 342437 - DNA, 25 bp, Homo sapien
gattgttgcttggagatctatgaaa

SEQ ID NO: 342438 - DNA, 25 bp, Homo sapien
attttacttgccaagtagtcactaa

SEQ ID NO: 342439 - DNA, 25 bp, Homo sapien
agactgccagacgatgaccagcatg

SEQ ID NO: 342440 - DNA, 25 bp, Homo sapien
tgaggatccccacgcagcacacgag

SEQ ID NO: 342441 - DNA, 25 bp, Homo sapien
gcagcacacgaggacagcatacaca

SEQ ID NO: 342442 - DNA, 25 bp, Homo sapien
ggatgactcttcagaagctttgagg

SEQ ID NO: 342443 - DNA, 25 bp, Homo sapien
aaatgactctcatttccgtggctga

SEQ ID NO: 342444 - DNA, 25 bp, Homo sapien
tctcatttccgtggctgaggagcca

SEQ ID NO: 342445 - DNA, 25 bp, Homo sapien
tgaggagccattggaccaggccgtc

SEQ ID NO: 342446 - DNA, 25 bp, Homo sapien
tgtgcctgctgatttcctggactct

SEQ ID NO: 342447 - DNA, 25 bp, Homo sapien
tggactctgcagacgtaatgccctt

SEQ ID NO: 342448 - DNA, 25 bp, Homo sapien
taatgcccttgatcggagggctgca

SEQ ID NO: 342449 - DNA, 25 bp, Homo sapien
gctgcagtgtcaagacggagagcct

SEQ ID NO: 342450 - DNA, 25 bp, Homo sapien
gattgatgaaagtgcaggtgtgtaa

SEQ ID NO: 342451 - DNA, 25 bp, Homo sapien
aatagaacagtctgctgggagtcag

SEQ ID NO: 342452 - DNA, 25 bp, Homo sapien
gggagtcagacctggaattctgatt

SEQ ID NO: 342453 - DNA, 25 bp, Homo sapien
gaattctgattccaaactctttatt

SEQ ID NO: 342454 - DNA, 25 bp, Homo sapien
ctgattccaaactctttattacttt

SEQ ID NO: 342455 - DNA, 25 bp, Homo sapien
atctccagggtgacggaacccagtg

SEQ ID NO: 342456 - DNA, 25 bp, Homo sapien
gtgacggaacccagtgtattacctg

SEQ ID NO: 342457 - DNA, 25 bp, Homo sapien
gtgtattacctgctggaaccaagga

SEQ ID NO: 342458 - DNA, 25 bp, Homo sapien
gtaggttactagtgaataccccaat

SEQ ID NO: 342459 - DNA, 25 bp, Homo sapien
gaataccccaatggtttctccaatt

SEQ ID NO: 342460 - DNA, 25 bp, Homo sapien
aatggtttctccaattatgcccatg

SEQ ID NO: 342461 - DNA, 25 bp, Homo sapien
aaaccagaccttgtatgttctcact

SEQ ID NO: 342462 - DNA, 25 bp, Homo sapien
accagaccttgtatgttctcactta

SEQ ID NO: 342463 - DNA, 25 bp, Homo sapien
ataagcgggagctaagcaaaggcat

SEQ ID NO: 342464 - DNA, 25 bp, Homo sapien
taagcgggagctaagcaaaggcata

SEQ ID NO: 342465 - DNA, 25 bp, Homo sapien
cgggagctaagcaaaggcataagaa

SEQ ID NO: 342466 - DNA, 25 bp, Homo sapien
aatcaccactgaagaacttacctgt

SEQ ID NO: 342467 - DNA, 25 bp, Homo sapien
gcattcacaaggcaacgctggatgg

SEQ ID NO: 342468 - DNA, 25 bp, Homo sapien
cattcacaaggcaacgctggatgga

SEQ ID NO: 342469 - DNA, 25 bp, Homo sapien
attcacaaggcaacgctggatggag

SEQ ID NO: 342470 - DNA, 25 bp, Homo sapien
cacaaggcaacgctggatggaggtt

SEQ ID NO: 342471 - DNA, 25 bp, Homo sapien
caaggcaacgctggatggaggttgg

SEQ ID NO: 342472 - DNA, 25 bp, Homo sapien
gggatacggatgtgaaccggcccaa

SEQ ID NO: 342473 - DNA, 25 bp, Homo sapien
tacggatgtgaaccggcccaagtgc

SEQ ID NO: 342474 - DNA, 25 bp, Homo sapien
tgtgaaccggcccaagtgctcgccg

SEQ ID NO: 342475 - DNA, 25 bp, Homo sapien
aagtgctcgccggtccgtcaagacg

SEQ ID NO: 342476 - DNA, 25 bp, Homo sapien
tgctcccgtgtccaactcgggctgt

SEQ ID NO: 342477 - DNA, 25 bp, Homo sapien
aactcgggctgtgtccgcccaggcg

SEQ ID NO: 342478 - DNA, 25 bp, Homo sapien
tgtgcgcggaggtcctaccgctgca

SEQ ID NO: 342479 - DNA, 25 bp, Homo sapien
acccgggcagccaacgtgcaggagg

SEQ ID NO: 342480 - DNA, 25 bp, Homo sapien
tcgccgcagcgttagcttttaccta

SEQ ID NO: 342481 - DNA, 25 bp, Homo sapien
cagcgttagcttttacctacgtggg

SEQ ID NO: 342482 - DNA, 25 bp, Homo sapien
gggaatttgcgaccgccagcccagt

SEQ ID NO: 342483 - DNA, 25 bp, Homo sapien
caggccgaatcagggtgttgacctt

SEQ ID NO: 342484 - DNA, 25 bp, Homo sapien
gaccttggccacatcaatgtcatac

SEQ ID NO: 342485 - DNA, 25 bp, Homo sapien
aatgtcatacagcttcttcacagcc

SEQ ID NO: 342486 - DNA, 25 bp, Homo sapien
ggcagctggactcagtttagatgat

SEQ ID NO: 342487 - DNA, 25 bp, Homo sapien
ttcttcatggcagactcagtggtca

SEQ ID NO: 342488 - DNA, 25 bp, Homo sapien
gactcagtggtcagcggaaacttga

SEQ ID NO: 342489 - DNA, 25 bp, Homo sapien
gtcagcggaaacttgatgatagcat

SEQ ID NO: 342490 - DNA, 25 bp, Homo sapien
gatagcatagtggtcaagcttgttt

SEQ ID NO: 342491 - DNA, 25 bp, Homo sapien
aattttgttggcaacatccaaagca

SEQ ID NO: 342492 - DNA, 25 bp, Homo sapien
aaagcatcgtaatcaggagccagtc

SEQ ID NO: 342493 - DNA, 25 bp, Homo sapien
gagccagtcgaacatatgccttctt

SEQ ID NO: 342494 - DNA, 25 bp, Homo sapien
ggcaagcagctatggtgacaaggtc

SEQ ID NO: 342495 - DNA, 25 bp, Homo sapien
aaggtcaggtccagggtctctactg

SEQ ID NO: 342496 - DNA, 25 bp, Homo sapien
tactgttctcctggccttttctcat

SEQ ID NO: 342497 - DNA, 25 bp, Homo sapien
ttctcatgctggctacttcaggatt

SEQ ID NO: 342498 - DNA, 25 bp, Homo sapien
gatttgagtgtctactacacctgta

SEQ ID NO: 342499 - DNA, 25 bp, Homo sapien
acacctgtaggtctcatattttcaa

SEQ ID NO: 342500 - DNA, 25 bp, Homo sapien
gggatgatattacccgtgtctgtcc

SEQ ID NO: 342501 - DNA, 25 bp, Homo sapien
tgtctgtccctttttatcaggaaaa

SEQ ID NO: 342502 - DNA, 25 bp, Homo sapien
aatgtttctccagaaactcccctat

SEQ ID NO: 342503 - DNA, 25 bp, Homo sapien
cagaaactcccctatgagaccgggt

SEQ ID NO: 342504 - DNA, 25 bp, Homo sapien
tccccagcagctgatcataattggc

SEQ ID NO: 342505 - DNA, 25 bp, Homo sapien
gaatgggagttcaatctgtactgaa

SEQ ID NO: 342506 - DNA, 25 bp, Homo sapien
gtactgaattatctttcatctagca

SEQ ID NO: 342507 - DNA, 25 bp, Homo sapien
tttcatctagcaattgtgcaattcc

SEQ ID NO: 342508 - DNA, 25 bp, Homo sapien
gcaattccaaatgcaggtgaggttg

SEQ ID NO: 342509 - DNA, 25 bp, Homo sapien
gggaaagcgggcatcccctcacatc

SEQ ID NO: 342510 - DNA, 25 bp, Homo sapien
acatccatgggatctatgtgtgggt

SEQ ID NO: 342511 - DNA, 25 bp, Homo sapien
gtgtgggttgtatcaagagtctcaa

SEQ ID NO: 342512 - DNA, 25 bp, Homo sapien
aaaaatgctcatattctccggtcct

SEQ ID NO: 342513 - DNA, 25 bp, Homo sapien
ttctccggtcctagaattgggtcta

SEQ ID NO: 342514 - DNA, 25 bp, Homo sapien
cagcttctcctcttagaatttcctg

SEQ ID NO: 342515 - DNA, 25 bp, Homo sapien
tagaatttcctgctgatccatccca

SEQ ID NO: 342516 - DNA, 25 bp, Homo sapien
gaatgaattgctctattagtctttc

SEQ ID NO: 342517 - DNA, 25 bp, Homo sapien
tattagtctttcattctcttcttcc

SEQ ID NO: 342518 - DNA, 25 bp, Homo sapien
cttggtatgccaaagggacattact

SEQ ID NO: 342519 - DNA, 25 bp, Homo sapien
gccaaagggacattactattttcag

SEQ ID NO: 342520 - DNA, 25 bp, Homo sapien
gggacattactattttcagtcaaat

SEQ ID NO: 342521 - DNA, 25 bp, Homo sapien
ttttcagtcaaatccacacggctta

SEQ ID NO: 342522 - DNA, 25 bp, Homo sapien
gtcaaatccacacggcttatggaga

SEQ ID NO: 342523 - DNA, 25 bp, Homo sapien
cacacggcttatggagaagacttat

SEQ ID NO: 342524 - DNA, 25 bp, Homo sapien
agaagacttatctcccaagaattgt

SEQ ID NO: 342525 - DNA, 25 bp, Homo sapien
atctcccaagaattgttttggtttg

SEQ ID NO: 342526 - DNA, 25 bp, Homo sapien
ttggtttgttgtaaccacttagaga

SEQ ID NO: 342527 - DNA, 25 bp, Homo sapien
tggtttttgcagactcagcctcaca

SEQ ID NO: 342528 - DNA, 25 bp, Homo sapien
aggacacaaacctgaaacgcagttg

SEQ ID NO: 342529 - DNA, 25 bp, Homo sapien
tgaaacgcagttgctcacaccctgt

SEQ ID NO: 342530 - DNA, 25 bp, Homo sapien
gctcacaccctgtgtttacttttat

SEQ ID NO: 342531 - DNA, 25 bp, Homo sapien
ttacttttatttccagccacatctg

SEQ ID NO: 342532 - DNA, 25 bp, Homo sapien
attcataagtttgttgccaagcctt

SEQ ID NO: 342533 - DNA, 25 bp, Homo sapien
tgccaagccttacaacagtttactg

SEQ ID NO: 342534 - DNA, 25 bp, Homo sapien
cagtttactgagtttgtacgttaag

SEQ ID NO: 342535 - DNA, 25 bp, Homo sapien
aaaaaatgctctcctgacttgtcga

SEQ ID NO: 342536 - DNA, 25 bp, Homo sapien
gctctcctgacttgtcgagtgtaaa

SEQ ID NO: 342537 - DNA, 25 bp, Homo sapien
tgtttattaacatctgcggcctgcc

SEQ ID NO: 342538 - DNA, 25 bp, Homo sapien
aagatgttacttactgttccagtaa

SEQ ID NO: 342539 - DNA, 25 bp, Homo sapien
tactgttccagtaactcatgtcctc

SEQ ID NO: 342540 - DNA, 25 bp, Homo sapien
agtaactcatgtcctccagaggtga

SEQ ID NO: 342541 - DNA, 25 bp, Homo sapien
gattattcttccctattaaattatg

SEQ ID NO: 342542 - DNA, 25 bp, Homo sapien
gaggtgatttttgaagagtgcgtat

SEQ ID NO: 342543 - DNA, 25 bp, Homo sapien
gagtgcgtatttttggcagttactt

SEQ ID NO: 342544 - DNA, 25 bp, Homo sapien
ggcagttactttccatggcagttca

SEQ ID NO: 342545 - DNA, 25 bp, Homo sapien
ttccatggcagttcagttacttcat

SEQ ID NO: 342546 - DNA, 25 bp, Homo sapien
ttaatttccctgactactggttgtc

SEQ ID NO: 342547 - DNA, 25 bp, Homo sapien
ccctgactactggttgtcattttaa

SEQ ID NO: 342548 - DNA, 25 bp, Homo sapien
gaggattccaaagatgttacttact

SEQ ID NO: 342549 - DNA, 25 bp, Homo sapien
tagttctgctactctagtgaagggc

SEQ ID NO: 342550 - DNA, 25 bp, Homo sapien
gaggtagttctaatgcctgtgctcc

SEQ ID NO: 342551 - DNA, 25 bp, Homo sapien
aatgcctgtgctcctgggaacctaa

SEQ ID NO: 342552 - DNA, 25 bp, Homo sapien
tcctgggaacctaactgaagccctg

SEQ ID NO: 342553 - DNA, 25 bp, Homo sapien
atttgtctcccctttctaaaatcat

SEQ ID NO: 342554 - DNA, 25 bp, Homo sapien
ctaaaatcatctattactccagcct

SEQ ID NO: 342555 - DNA, 25 bp, Homo sapien
gggtgaacagggtttctctaccaat

SEQ ID NO: 342556 - DNA, 25 bp, Homo sapien
gaagttaaattgtccagcaccctcc

SEQ ID NO: 342557 - DNA, 25 bp, Homo sapien
tcctcctcctatgtggtcatgtgac

SEQ ID NO: 342558 - DNA, 25 bp, Homo sapien
gagattccaactcaggcactcttag

SEQ ID NO: 342559 - DNA, 25 bp, Homo sapien
aggcactcttagttctgctactcta

SEQ ID NO: 342560 - DNA, 25 bp, Homo sapien
taagttaacagccagagacagacac

SEQ ID NO: 342561 - DNA, 25 bp, Homo sapien
agacagacactgtgcaggcattgca

SEQ ID NO: 342562 - DNA, 25 bp, Homo sapien
atgtgctcaatgtatttgcctgctt

SEQ ID NO: 342563 - DNA, 25 bp, Homo sapien
atttgcctgcttacaacactgggag

SEQ ID NO: 342564 - DNA, 25 bp, Homo sapien
caacactgggagatgtgtttgccag

SEQ ID NO: 342565 - DNA, 25 bp, Homo sapien
gtttgccagtaagttgctcatcaca

SEQ ID NO: 342566 - DNA, 25 bp, Homo sapien
gctcatcacaagagcaccagacttg

SEQ ID NO: 342567 - DNA, 25 bp, Homo sapien
tgtaatctccggcaacttgcatgcc

SEQ ID NO: 342568 - DNA, 25 bp, Homo sapien
aacttgcatgccctctgaaagaagg

SEQ ID NO: 342569 - DNA, 25 bp, Homo sapien
atagaactatactttgccatgcacg

SEQ ID NO: 342570 - DNA, 25 bp, Homo sapien
catgcacgactgttcctgcaattga

SEQ ID NO: 342571 - DNA, 25 bp, Homo sapien
caatgggatctacttagtggtgaat

SEQ ID NO: 342572 - DNA, 25 bp, Homo sapien
ggtaaaagttgctggtctgaccaca

SEQ ID NO: 342573 - DNA, 25 bp, Homo sapien
aaagttgctggtctgaccacaccac

SEQ ID NO: 342574 - DNA, 25 bp, Homo sapien
gctggtctgaccacaccacagcatg

SEQ ID NO: 342575 - DNA, 25 bp, Homo sapien
ttccccacaaatgtttgcttctttc

SEQ ID NO: 342576 - DNA, 25 bp, Homo sapien
aaatgtttgcttctttcccagtcaa

SEQ ID NO: 342577 - DNA, 25 bp, Homo sapien
gtttgcttctttcccagtcaagagg

SEQ ID NO: 342578 - DNA, 25 bp, Homo sapien
agtggaggtcgtgagcttgcacccc

SEQ ID NO: 342579 - DNA, 25 bp, Homo sapien
cgcctggctgtgtagatcgactgta

SEQ ID NO: 342580 - DNA, 25 bp, Homo sapien
ggctgtgtagatcgactgtatagat

SEQ ID NO: 342581 - DNA, 25 bp, Homo sapien
ggccaaggggctattactgctgttg

SEQ ID NO: 342582 - DNA, 25 bp, Homo sapien
cattgctggttttcccattttcttt

SEQ ID NO: 342583 - DNA, 25 bp, Homo sapien
ctcttctccatgtggataccgttga

SEQ ID NO: 342584 - DNA, 25 bp, Homo sapien
tggataccgttgatacacttttagg

SEQ ID NO: 342585 - DNA, 25 bp, Homo sapien
cgttgatacacttttaggtttgaat

SEQ ID NO: 342586 - DNA, 25 bp, Homo sapien
ggtttgaatatcaccttccttttag

SEQ ID NO: 342587 - DNA, 25 bp, Homo sapien
cttccttttagaatgttccatacct

SEQ ID NO: 342588 - DNA, 25 bp, Homo sapien
atgttccatacctttaagcatttga

SEQ ID NO: 342589 - DNA, 25 bp, Homo sapien
tttgataaaagctatggtggtttcc

SEQ ID NO: 342590 - DNA, 25 bp, Homo sapien
gtttccccagaaaaatgttcaacag

SEQ ID NO: 342591 - DNA, 25 bp, Homo sapien
gttcaacaggaagttttgcctacat

SEQ ID NO: 342592 - DNA, 25 bp, Homo sapien
attttcccattgctggttttcccat

SEQ ID NO: 342593 - DNA, 25 bp, Homo sapien
gagagaaaaggtctgggcaccacaa

SEQ ID NO: 342594 - DNA, 25 bp, Homo sapien
ggcaccacaaacttgtacttgtgct

SEQ ID NO: 342595 - DNA, 25 bp, Homo sapien
acttgtgctagaaatgtaggtgcct

SEQ ID NO: 342596 - DNA, 25 bp, Homo sapien
atgtaggtgccttttcatttgccca

SEQ ID NO: 342597 - DNA, 25 bp, Homo sapien
ttcatttgcccagcagggctagttt

SEQ ID NO: 342598 - DNA, 25 bp, Homo sapien
tagtttaacagccagggtatcttct

SEQ ID NO: 342599 - DNA, 25 bp, Homo sapien
gtatcttctgggactcttccccaaa

SEQ ID NO: 342600 - DNA, 25 bp, Homo sapien
caaatcttgctctaccgctgactag

SEQ ID NO: 342601 - DNA, 25 bp, Homo sapien
tctaccgctgactagctatgtgatc

SEQ ID NO: 342602 - DNA, 25 bp, Homo sapien
ttgacttggttccatttacctccca

SEQ ID NO: 342603 - DNA, 25 bp, Homo sapien
ttacctcccagaatcagcatacagt

SEQ ID NO: 342604 - DNA, 25 bp, Homo sapien
tgcatgcatctgcagtgtacactgg

SEQ ID NO: 342605 - DNA, 25 bp, Homo sapien
gtgtacactggcaaacaaaaggttt

SEQ ID NO: 342606 - DNA, 25 bp, Homo sapien
tcattcccgttgtcctgttgtgctt

SEQ ID NO: 342607 - DNA, 25 bp, Homo sapien
atgcaggtgtagtcttgtgccagtc

SEQ ID NO: 342608 - DNA, 25 bp, Homo sapien
gtagtcttgtgccagtctgtgacat

SEQ ID NO: 342609 - DNA, 25 bp, Homo sapien
gtgccagtctgtgacataacacctg

SEQ ID NO: 342610 - DNA, 25 bp, Homo sapien
gtgacataacacctgaacaatttct

SEQ ID NO: 342611 - DNA, 25 bp, Homo sapien
aacaatttctatggtatcctaccca

SEQ ID NO: 342612 - DNA, 25 bp, Homo sapien
atcctacccatttgctcagattcaa

SEQ ID NO: 342613 - DNA, 25 bp, Homo sapien
tcatataatatgttgctgcttttgg

SEQ ID NO: 342614 - DNA, 25 bp, Homo sapien
gagtaccagagaggtctgcatgcat

SEQ ID NO: 342615 - DNA, 25 bp, Homo sapien
aataatatgcagtctatttttaaat

SEQ ID NO: 342616 - DNA, 25 bp, Homo sapien
gtgaacttagcttttcaattcaaca

SEQ ID NO: 342617 - DNA, 25 bp, Homo sapien
aatgaagtgttcttatgccagtaac

SEQ ID NO: 342618 - DNA, 25 bp, Homo sapien
tgccagtaactttaagctattccct

SEQ ID NO: 342619 - DNA, 25 bp, Homo sapien
gccagtaactttaagctattccctt

SEQ ID NO: 342620 - DNA, 25 bp, Homo sapien
taactttaagctattcccttactca

SEQ ID NO: 342621 - DNA, 25 bp, Homo sapien
ctttaagctattcccttactcaagg

SEQ ID NO: 342622 - DNA, 25 bp, Homo sapien
aagctattcccttactcaaggatgt

SEQ ID NO: 342623 - DNA, 25 bp, Homo sapien
tattcccttactcaaggatgtaggt

SEQ ID NO: 342624 - DNA, 25 bp, Homo sapien
ttgccagtggctttaaattgccaat

SEQ ID NO: 342625 - DNA, 25 bp, Homo sapien
agaatattgttcctatgggttaaat

SEQ ID NO: 342626 - DNA, 25 bp, Homo sapien
ctgcggcggcactgcaacatccatg

SEQ ID NO: 342627 - DNA, 25 bp, Homo sapien
ggcggcactgcaacatccatgccgg

SEQ ID NO: 342628 - DNA, 25 bp, Homo sapien
gggagcgcccgtaccagtgccccat

SEQ ID NO: 342629 - DNA, 25 bp, Homo sapien
tgcgctttacagaggccaacacgct

SEQ ID NO: 342630 - DNA, 25 bp, Homo sapien
ttacagaggccaacacgctccggcg

SEQ ID NO: 342631 - DNA, 25 bp, Homo sapien
gctccggcgccatgcgaagcgcaag

SEQ ID NO: 342632 - DNA, 25 bp, Homo sapien
catgcgaagcgcaagcacccggagg

SEQ ID NO: 342633 - DNA, 25 bp, Homo sapien
tgcaccagatccagggtctgaaccg

SEQ ID NO: 342634 - DNA, 25 bp, Homo sapien
agatccagggtctgaaccgccgtgg

SEQ ID NO: 342635 - DNA, 25 bp, Homo sapien
tccagggtctgaaccgccgtgggac

SEQ ID NO: 342636 - DNA, 25 bp, Homo sapien
aaccgccgtgggacgaggagggcat

SEQ ID NO: 342637 - DNA, 25 bp, Homo sapien
tggcaatttcactaagcagctggat

SEQ ID NO: 342638 - DNA, 25 bp, Homo sapien
agcagctggatgtaatctgtatttg

SEQ ID NO: 342639 - DNA, 25 bp, Homo sapien
ggaatactaaggaggcttcttttca

SEQ ID NO: 342640 - DNA, 25 bp, Homo sapien
ggaggcttcttttcagtaagttgat

SEQ ID NO: 342641 - DNA, 25 bp, Homo sapien
cagtaagttgatcttttcaccagga

SEQ ID NO: 342642 - DNA, 25 bp, Homo sapien
aatgccaagtacatcctaaagaatg

SEQ ID NO: 342643 - DNA, 25 bp, Homo sapien
gaatgtcctactacatttgtctgaa

SEQ ID NO: 342644 - DNA, 25 bp, Homo sapien
tagactcttgactaggactgggttc

SEQ ID NO: 342645 - DNA, 25 bp, Homo sapien
gactaggactgggttccaacacccg

SEQ ID NO: 342646 - DNA, 25 bp, Homo sapien
ccaacacccgtaccagtatcattaa

SEQ ID NO: 342647 - DNA, 25 bp, Homo sapien
agtacttattaagcactcacattta

SEQ ID NO: 342648 - DNA, 25 bp, Homo sapien
gtcagccccatttttcagacctgga

SEQ ID NO: 342649 - DNA, 25 bp, Homo sapien
ccatttttcagacctggacacggag

SEQ ID NO: 342650 - DNA, 25 bp, Homo sapien
cacagggtgctggtgtgacttgccc

SEQ ID NO: 342651 - DNA, 25 bp, Homo sapien
gtgacttgcccacagttattagtgt

SEQ ID NO: 342652 - DNA, 25 bp, Homo sapien
tgaggtgatgggttttgtcccgtcc

SEQ ID NO: 342653 - DNA, 25 bp, Homo sapien
tgatgggttttgtcccgtcccagct

SEQ ID NO: 342654 - DNA, 25 bp, Homo sapien
acagcagcatcactgagccgagctg

SEQ ID NO: 342655 - DNA, 25 bp, Homo sapien
gggcaagtttcaccagattcgctta

SEQ ID NO: 342656 - DNA, 25 bp, Homo sapien
agattcgcttacctgatccttgcat

SEQ ID NO: 342657 - DNA, 25 bp, Homo sapien
gatccttgcatcaacctcaatgcag

SEQ ID NO: 342658 - DNA, 25 bp, Homo sapien
tcaatgcagttgtcagccccatttt

SEQ ID NO: 342659 - DNA, 25 bp, Homo sapien
aagaaggattctcctcattcctctc

SEQ ID NO: 342660 - DNA, 25 bp, Homo sapien
cctcattcctctcttgacttgagaa

SEQ ID NO: 342661 - DNA, 25 bp, Homo sapien
ttcctctcttgacttgagaatgatc

SEQ ID NO: 342662 - DNA, 25 bp, Homo sapien
gagaatgatcagtcaataggccctg

SEQ ID NO: 342663 - DNA, 25 bp, Homo sapien
tcaataggccctgaagtctgaattt

SEQ ID NO: 342664 - DNA, 25 bp, Homo sapien
ggccctgaagtctgaatttgtgaaa

SEQ ID NO: 342665 - DNA, 25 bp, Homo sapien
tgaaaatttccttgggtgacaaact

SEQ ID NO: 342666 - DNA, 25 bp, Homo sapien
tttccttgggtgacaaacttgtttg

SEQ ID NO: 342667 - DNA, 25 bp, Homo sapien
gattactctatttagtgtatcccaa

SEQ ID NO: 342668 - DNA, 25 bp, Homo sapien
agtgtatcccaaagttattaccaca

SEQ ID NO: 342669 - DNA, 25 bp, Homo sapien
atagggtgggtatagatgcatagat

SEQ ID NO: 342670 - DNA, 25 bp, Homo sapien
gaacactaagtcatcatctgcaact

SEQ ID NO: 342671 - DNA, 25 bp, Homo sapien
gtcatcatctgcaactgagtttttg

SEQ ID NO: 342672 - DNA, 25 bp, Homo sapien
tgcaactgagtttttgactcatgac

SEQ ID NO: 342673 - DNA, 25 bp, Homo sapien
gactcatgacttttgatttcggaat

SEQ ID NO: 342674 - DNA, 25 bp, Homo sapien
gatttcggaattaggctgttttcac

SEQ ID NO: 342675 - DNA, 25 bp, Homo sapien
tcggaattaggctgttttcactttt

SEQ ID NO: 342676 - DNA, 25 bp, Homo sapien
gacatgtaacatgcgtatagacaag

SEQ ID NO: 342677 - DNA, 25 bp, Homo sapien
gtaacatgcgtatagacaagtgtac

SEQ ID NO: 342678 - DNA, 25 bp, Homo sapien
gacaagtgtacatacagatcctgag

SEQ ID NO: 342679 - DNA, 25 bp, Homo sapien
cagatcctgagtgtgtggccaatgg

SEQ ID NO: 342680 - DNA, 25 bp, Homo sapien
gtgtggccaatggatatccttcctc

SEQ ID NO: 342681 - DNA, 25 bp, Homo sapien
attctgtgtaacgtctccaaaagat

SEQ ID NO: 342682 - DNA, 25 bp, Homo sapien
tgtgtaacgtctccaaaagatgaac

SEQ ID NO: 342683 - DNA, 25 bp, Homo sapien
ttgaagagtatggacctacagggtt

SEQ ID NO: 342684 - DNA, 25 bp, Homo sapien
tacagggtttttaacaagtccagca

SEQ ID NO: 342685 - DNA, 25 bp, Homo sapien
gtccagcaaaacaaactatggccaa

SEQ ID NO: 342686 - DNA, 25 bp, Homo sapien
gaaatttttctgtcactgcgagtag

SEQ ID NO: 342687 - DNA, 25 bp, Homo sapien
ttctgtcactgcgagtagacatcat

SEQ ID NO: 342688 - DNA, 25 bp, Homo sapien
gagtagacatcataaatgcttggta

SEQ ID NO: 342689 - DNA, 25 bp, Homo sapien
atgcttggtaaaattgccagattta

SEQ ID NO: 342690 - DNA, 25 bp, Homo sapien
agcaaagaagcaatcttggcaaggt

SEQ ID NO: 342691 - DNA, 25 bp, Homo sapien
agcaatcttggcaaggtggagaagt

SEQ ID NO: 342692 - DNA, 25 bp, Homo sapien
tcgtcttggcttttccttttaaatg

SEQ ID NO: 342693 - DNA, 25 bp, Homo sapien
gggaaaatctacatgttaacattat

SEQ ID NO: 342694 - DNA, 25 bp, Homo sapien
gatttacaggagttgagagcttgct

SEQ ID NO: 342695 - DNA, 25 bp, Homo sapien
agagcttgctgagatcttagggatc

SEQ ID NO: 342696 - DNA, 25 bp, Homo sapien
ttagggatcatttaagccaatgcct

SEQ ID NO: 342697 - DNA, 25 bp, Homo sapien
aagccaatgccttgtcttatagcgg

SEQ ID NO: 342698 - DNA, 25 bp, Homo sapien
aatgccttgtcttatagcggagaaa

SEQ ID NO: 342699 - DNA, 25 bp, Homo sapien
aacagagcacctaggcaatttgcct

SEQ ID NO: 342700 - DNA, 25 bp, Homo sapien
tactcactctcttcccttagttaaa

SEQ ID NO: 342701 - DNA, 25 bp, Homo sapien
ttttttgcacacaatccaggacttg

SEQ ID NO: 342702 - DNA, 25 bp, Homo sapien
aaatgtttcaatttcgtcttggctt

SEQ ID NO: 342703 - DNA, 25 bp, Homo sapien
tggttactggttcctagagatgaaa

SEQ ID NO: 342704 - DNA, 25 bp, Homo sapien
tttcagtaggcaaggtagtttaaat

SEQ ID NO: 342705 - DNA, 25 bp, Homo sapien
ggtagtttaaatgcagaaattctgc

SEQ ID NO: 342706 - DNA, 25 bp, Homo sapien
gcgatatatgaatattgtgacatca

SEQ ID NO: 342707 - DNA, 25 bp, Homo sapien
ttgtgacatcaagaacagcttcatt

SEQ ID NO: 342708 - DNA, 25 bp, Homo sapien
gaacagcttcattggcatattcttt

SEQ ID NO: 342709 - DNA, 25 bp, Homo sapien
tcattggcatattctttgggaaaga

SEQ ID NO: 342710 - DNA, 25 bp, Homo sapien
attttcagcttatgagtgttgttac

SEQ ID NO: 342711 - DNA, 25 bp, Homo sapien
gcttatgagtgttgttactgcttca

SEQ ID NO: 342712 - DNA, 25 bp, Homo sapien
gagtgttgttactgcttcaaattgt

SEQ ID NO: 342713 - DNA, 25 bp, Homo sapien
gttgttactgcttcaaattgtgttt

SEQ ID NO: 342714 - DNA, 25 bp, Homo sapien
agggtcggaagtcctcctttagcag

SEQ ID NO: 342715 - DNA, 25 bp, Homo sapien
gtcctcctttagcagctgggttaaa

SEQ ID NO: 342716 - DNA, 25 bp, Homo sapien
gctgggttaaacctaagcaagctaa

SEQ ID NO: 342717 - DNA, 25 bp, Homo sapien
gaggatgttccttagcttgatataa

SEQ ID NO: 342718 - DNA, 25 bp, Homo sapien
ttgacggataacatcatggcacaat

SEQ ID NO: 342719 - DNA, 25 bp, Homo sapien
gatataatgttactttccttagatt

SEQ ID NO: 342720 - DNA, 25 bp, Homo sapien
ttgatacaatgttaggagccccgcg

SEQ ID NO: 342721 - DNA, 25 bp, Homo sapien
ggagccccgcgaaataagcaaggaa

SEQ ID NO: 342722 - DNA, 25 bp, Homo sapien
atgatgttagatttcagcaatgtaa

SEQ ID NO: 342723 - DNA, 25 bp, Homo sapien
caaaaacaagcctcctttgctgcca

SEQ ID NO: 342724 - DNA, 25 bp, Homo sapien
tccatcactgcctgaggaccaggga

SEQ ID NO: 342725 - DNA, 25 bp, Homo sapien
ggcggacagggcaagggcaccgaac

SEQ ID NO: 342726 - DNA, 25 bp, Homo sapien
agcccagggcgtaggctctttggcc

SEQ ID NO: 342727 - DNA, 25 bp, Homo sapien
ggcgtaggctctttggccgccgcca

SEQ ID NO: 342728 - DNA, 25 bp, Homo sapien
cgccacgagagagcccgtctgaatg

SEQ ID NO: 342729 - DNA, 25 bp, Homo sapien
agagagcccgtctgaatgggcagca

SEQ ID NO: 342730 - DNA, 25 bp, Homo sapien
agagcccgtctgaatgggcagcacc

SEQ ID NO: 342731 - DNA, 25 bp, Homo sapien
gtctgaatgggcagcaccgcctgat

SEQ ID NO: 342732 - DNA, 25 bp, Homo sapien
tgaatgggcagcaccgcctgatact

SEQ ID NO: 342733 - DNA, 25 bp, Homo sapien
gaatgggcagcaccgcctgatactt

SEQ ID NO: 342734 - DNA, 25 bp, Homo sapien
ggcagcaccgcctgatacttgggcc

SEQ ID NO: 342735 - DNA, 25 bp, Homo sapien
agcaccgcctgatacttgggccggg

SEQ ID NO: 342736 - DNA, 25 bp, Homo sapien
gaattgagggtgttgggcctagtct

SEQ ID NO: 342737 - DNA, 25 bp, Homo sapien
gccaaggagacaggacttaagtact

SEQ ID NO: 342738 - DNA, 25 bp, Homo sapien
acaggacttaagtacttagaaacag

SEQ ID NO: 342739 - DNA, 25 bp, Homo sapien
aaggtaataaagagtcagggaggct

SEQ ID NO: 342740 - DNA, 25 bp, Homo sapien
cagagattgtggtagatacttccct

SEQ ID NO: 342741 - DNA, 25 bp, Homo sapien
gattgtggtagatacttccctggcc

SEQ ID NO: 342742 - DNA, 25 bp, Homo sapien
tgtggtagatacttccctggcctta

SEQ ID NO: 342743 - DNA, 25 bp, Homo sapien
ttccctggccttagagaaagagagt

SEQ ID NO: 342744 - DNA, 25 bp, Homo sapien
agagagttgcttttgccctctttgg

SEQ ID NO: 342745 - DNA, 25 bp, Homo sapien
ttgcttttgccctctttggagccag

SEQ ID NO: 342746 - DNA, 25 bp, Homo sapien
ctctttggagccagggtgaattgag

SEQ ID NO: 342747 - DNA, 25 bp, Homo sapien
tggtcattatgatggccctaaagcc

SEQ ID NO: 342748 - DNA, 25 bp, Homo sapien
tgatggccctaaagcctggctctga

SEQ ID NO: 342749 - DNA, 25 bp, Homo sapien
taaagcctggctctgacccctgctt

SEQ ID NO: 342750 - DNA, 25 bp, Homo sapien
ggatagttttgctgaaatcactcta

SEQ ID NO: 342751 - DNA, 25 bp, Homo sapien
tgaaatcactctatcccttgggtca

SEQ ID NO: 342752 - DNA, 25 bp, Homo sapien
tatcccttgggtcatatacactgca

SEQ ID NO: 342753 - DNA, 25 bp, Homo sapien
ggtcatatacactgcatcacacttt

SEQ ID NO: 342754 - DNA, 25 bp, Homo sapien
actgcatcacactttttataggaga

SEQ ID NO: 342755 - DNA, 25 bp, Homo sapien
tcccctacccttggaggtgacgtag

SEQ ID NO: 342756 - DNA, 25 bp, Homo sapien
cccttggaggtgacgtagtattgta

SEQ ID NO: 342757 - DNA, 25 bp, Homo sapien
cagagggtccatggtcattatgatg

SEQ ID NO: 342758 - DNA, 25 bp, Homo sapien
agctttcctttttgactgtcttatt

SEQ ID NO: 342759 - DNA, 25 bp, Homo sapien
gtccttattgtagtacttttcaaga

SEQ ID NO: 342760 - DNA, 25 bp, Homo sapien
ttttaaggctgaatgctatcccagt

SEQ ID NO: 342761 - DNA, 25 bp, Homo sapien
ggctgaatgctatcccagtgattgt

SEQ ID NO: 342762 - DNA, 25 bp, Homo sapien
tgctatcccagtgattgtacgtgcc

SEQ ID NO: 342763 - DNA, 25 bp, Homo sapien
atcccagtgattgtacgtgccctgt

SEQ ID NO: 342764 - DNA, 25 bp, Homo sapien
ttgtacgtgccctgtttgctgaatc

SEQ ID NO: 342765 - DNA, 25 bp, Homo sapien
tctactcatccttaagggtacattt

SEQ ID NO: 342766 - DNA, 25 bp, Homo sapien
ccttaagggtacatttgcttccagg

SEQ ID NO: 342767 - DNA, 25 bp, Homo sapien
taacatgtttgtgagtaatactaca

SEQ ID NO: 342768 - DNA, 25 bp, Homo sapien
ctacaatgtgcatatatctattcca

SEQ ID NO: 342769 - DNA, 25 bp, Homo sapien
ggctcctttccgaccttagggcaga

SEQ ID NO: 342770 - DNA, 25 bp, Homo sapien
gcagagggaactgtgcagtccccag

SEQ ID NO: 342771 - DNA, 25 bp, Homo sapien
agagggaactgtgcagtccccaggc

SEQ ID NO: 342772 - DNA, 25 bp, Homo sapien
agggaactgtgcagtccccaggccg

SEQ ID NO: 342773 - DNA, 25 bp, Homo sapien
tcctttccgaccttagggcagagtg

SEQ ID NO: 342774 - DNA, 25 bp, Homo sapien
ctttccgaccttagggcagagtggt

SEQ ID NO: 342775 - DNA, 25 bp, Homo sapien
accttagggcagagtggtgacctcc

SEQ ID NO: 342776 - DNA, 25 bp, Homo sapien
tagggcagagtggtgacctccacca

SEQ ID NO: 342777 - DNA, 25 bp, Homo sapien
ggcagagtggtgacctccaccacca

SEQ ID NO: 342778 - DNA, 25 bp, Homo sapien
ctccccactgggtccgtgcgaggta

SEQ ID NO: 342779 - DNA, 25 bp, Homo sapien
gggtccgtgcgaggtagtgcagaat

SEQ ID NO: 342780 - DNA, 25 bp, Homo sapien
acaattccttcaggcatggactgga

SEQ ID NO: 342781 - DNA, 25 bp, Homo sapien
tttcctcctctaggccgggccctgc

SEQ ID NO: 342782 - DNA, 25 bp, Homo sapien
aaccccaactcactggcactcaagc

SEQ ID NO: 342783 - DNA, 25 bp, Homo sapien
cccctgcagtgcctttcacttcttt

SEQ ID NO: 342784 - DNA, 25 bp, Homo sapien
gggttggtagggatgagtcctgtca

SEQ ID NO: 342785 - DNA, 25 bp, Homo sapien
gttggtagggatgagtcctgtcaag

SEQ ID NO: 342786 - DNA, 25 bp, Homo sapien
tggtagggatgagtcctgtcaaggg

SEQ ID NO: 342787 - DNA, 25 bp, Homo sapien
gatgagtcctgtcaagggggccaca

SEQ ID NO: 342788 - DNA, 25 bp, Homo sapien
gaggggacaggctctcaggaatcct

SEQ ID NO: 342789 - DNA, 25 bp, Homo sapien
ggggacaggctctcaggaatccttt

SEQ ID NO: 342790 - DNA, 25 bp, Homo sapien
ataataatactaacaaacagttggg

SEQ ID NO: 342791 - DNA, 25 bp, Homo sapien
atactttcaagcttctggtttggga

SEQ ID NO: 342792 - DNA, 25 bp, Homo sapien
caagcttctggtttgggagtttaga

SEQ ID NO: 342793 - DNA, 25 bp, Homo sapien
gattgctaaatttggtcagatttct

SEQ ID NO: 342794 - DNA, 25 bp, Homo sapien
tcagatttctcctgactggctgttc

SEQ ID NO: 342795 - DNA, 25 bp, Homo sapien
tttctcctgactggctgttcctaaa

SEQ ID NO: 342796 - DNA, 25 bp, Homo sapien
tgactggctgttcctaaattcttag

SEQ ID NO: 342797 - DNA, 25 bp, Homo sapien
aaattcttaggatatgtcccagtaa

SEQ ID NO: 342798 - DNA, 25 bp, Homo sapien
gtcatatgtgtaattgttgcatttt

SEQ ID NO: 342799 - DNA, 25 bp, Homo sapien
tttggatgtacctaatttgataatt

SEQ ID NO: 342800 - DNA, 25 bp, Homo sapien
ctgtttgcaggtcagaaaatgagaa

SEQ ID NO: 342801 - DNA, 25 bp, Homo sapien
aatgtaattgtgtaatgctctgaaa

SEQ ID NO: 342802 - DNA, 25 bp, Homo sapien
ttggaaacacaatatggtactacat

SEQ ID NO: 342803 - DNA, 25 bp, Homo sapien
tatggtactacatagcaagggctgt

SEQ ID NO: 342804 - DNA, 25 bp, Homo sapien
ggtactacatagcaagggctgtaaa

SEQ ID NO: 342805 - DNA, 25 bp, Homo sapien
tagcaagggctgtaaaaatgaccat

SEQ ID NO: 342806 - DNA, 25 bp, Homo sapien
gcaagggctgtaaaaatgaccatat

SEQ ID NO: 342807 - DNA, 25 bp, Homo sapien
taaaaatgaccatatcctttgcccc

SEQ ID NO: 342808 - DNA, 25 bp, Homo sapien
tatcctttgccccataaattctact

SEQ ID NO: 342809 - DNA, 25 bp, Homo sapien
ctttgccccataaattctacttcta

SEQ ID NO: 342810 - DNA, 25 bp, Homo sapien
gccccataaattctacttctatact

SEQ ID NO: 342811 - DNA, 25 bp, Homo sapien
gcatgaagacatttatgtctgcatt

SEQ ID NO: 342812 - DNA, 25 bp, Homo sapien
gtctgcattctttataataacaaaa

SEQ ID NO: 342813 - DNA, 25 bp, Homo sapien
cctgcaaaccgttcctttgtgggat

SEQ ID NO: 342814 - DNA, 25 bp, Homo sapien
gcaaaccgttcctttgtgggattag

SEQ ID NO: 342815 - DNA, 25 bp, Homo sapien
gttcctttgtgggattaggaccaag

SEQ ID NO: 342816 - DNA, 25 bp, Homo sapien
taggaccaagggatcctgcgggcat

SEQ ID NO: 342817 - DNA, 25 bp, Homo sapien
accaagggatcctgcgggcatttat

SEQ ID NO: 342818 - DNA, 25 bp, Homo sapien
gatcctgcgggcatttatcaggcac

SEQ ID NO: 342819 - DNA, 25 bp, Homo sapien
gcgggcatttatcaggcacagtcct

SEQ ID NO: 342820 - DNA, 25 bp, Homo sapien
atcaggcacagtcctggtatctggg

SEQ ID NO: 342821 - DNA, 25 bp, Homo sapien
atctgggatagcaaaggtcttcttc

SEQ ID NO: 342822 - DNA, 25 bp, Homo sapien
gagtgaacaagaacacccctgccga

SEQ ID NO: 342823 - DNA, 25 bp, Homo sapien
aaaacacatagacgcacacactcag

SEQ ID NO: 342824 - DNA, 25 bp, Homo sapien
cgccaacctctacccaaggttaatg

SEQ ID NO: 342825 - DNA, 25 bp, Homo sapien
aacctctacccaaggttaatgctgg

SEQ ID NO: 342826 - DNA, 25 bp, Homo sapien
acctctacccaaggttaatgctggg

SEQ ID NO: 342827 - DNA, 25 bp, Homo sapien
aagagggtgacagctccagggtgcc

SEQ ID NO: 342828 - DNA, 25 bp, Homo sapien
ggtgacagctccagggtgcctgctc

SEQ ID NO: 342829 - DNA, 25 bp, Homo sapien
gtgacagctccagggtgcctgctca

SEQ ID NO: 342830 - DNA, 25 bp, Homo sapien
gacagctccagggtgcctgctcaag

SEQ ID NO: 342831 - DNA, 25 bp, Homo sapien
acagctccagggtgcctgctcaagc

SEQ ID NO: 342832 - DNA, 25 bp, Homo sapien
ccagggtgcctgctcaagctccagg

SEQ ID NO: 342833 - DNA, 25 bp, Homo sapien
agggtgcctgctcaagctccaggcc

SEQ ID NO: 342834 - DNA, 25 bp, Homo sapien
gggtgcctgctcaagctccaggcct

SEQ ID NO: 342835 - DNA, 25 bp, Homo sapien
gacaaccattatgacttttgcctca

SEQ ID NO: 342836 - DNA, 25 bp, Homo sapien
atgacttttgcctcataccttgaat

SEQ ID NO: 342837 - DNA, 25 bp, Homo sapien
aaagttttcgctgaggttaatgtga

SEQ ID NO: 342838 - DNA, 25 bp, Homo sapien
gaggttaatgtgaacactgctttac

SEQ ID NO: 342839 - DNA, 25 bp, Homo sapien
gaacactgctttacaagcttgtatt

SEQ ID NO: 342840 - DNA, 25 bp, Homo sapien
gtgatttactttttctgtaagcctt

SEQ ID NO: 342841 - DNA, 25 bp, Homo sapien
gtttacacttaccagtttctaatgg

SEQ ID NO: 342842 - DNA, 25 bp, Homo sapien
ctaattgaatattgttttgtctcag

SEQ ID NO: 342843 - DNA, 25 bp, Homo sapien
tttgtctcagcctaaaagttacggt

SEQ ID NO: 342844 - DNA, 25 bp, Homo sapien
aaaagttacggtcagcatggcaatt

SEQ ID NO: 342845 - DNA, 25 bp, Homo sapien
gtcagcatggcaattcacctatttt

SEQ ID NO: 342846 - DNA, 25 bp, Homo sapien
tgacaaaagcaaatccactttttct

SEQ ID NO: 342847 - DNA, 25 bp, Homo sapien
aagcttaattctgcaatcatttgtc

SEQ ID NO: 342848 - DNA, 25 bp, Homo sapien
gcttaattctgcaatcatttgtctt

SEQ ID NO: 342849 - DNA, 25 bp, Homo sapien
ttaattctgcaatcatttgtctttt

SEQ ID NO: 342850 - DNA, 25 bp, Homo sapien
tgtcttttataaaccgtaaagctct

SEQ ID NO: 342851 - DNA, 25 bp, Homo sapien
taaaccgtaaagctctatacaaggg

SEQ ID NO: 342852 - DNA, 25 bp, Homo sapien
taaagctctatacaagggacactat

SEQ ID NO: 342853 - DNA, 25 bp, Homo sapien
agctctatacaagggacactataaa

SEQ ID NO: 342854 - DNA, 25 bp, Homo sapien
ggacactataaataagactccatgt

SEQ ID NO: 342855 - DNA, 25 bp, Homo sapien
cactataaataagactccatgtttt

SEQ ID NO: 342856 - DNA, 25 bp, Homo sapien
aagaatgaagtggtgatatttacaa

SEQ ID NO: 342857 - DNA, 25 bp, Homo sapien
acatgtgataccttctatgtgtatt

SEQ ID NO: 342858 - DNA, 25 bp, Homo sapien
tctgtgattctgtagttaccgcaga

SEQ ID NO: 342859 - DNA, 25 bp, Homo sapien
atcagtacacgcacatggagttcat

SEQ ID NO: 342860 - DNA, 25 bp, Homo sapien
gcacatggagttcatctggatggct

SEQ ID NO: 342861 - DNA, 25 bp, Homo sapien
gatggctgtatagtactgtgttgta

SEQ ID NO: 342862 - DNA, 25 bp, Homo sapien
gtatgaataacccactctgcagctg

SEQ ID NO: 342863 - DNA, 25 bp, Homo sapien
ctctctcatgcagggctgcagtgga

SEQ ID NO: 342864 - DNA, 25 bp, Homo sapien
gttaccgcagacagatgtgtgcaca

SEQ ID NO: 342865 - DNA, 25 bp, Homo sapien
gacagatgtgtgcacaaacggcata

SEQ ID NO: 342866 - DNA, 25 bp, Homo sapien
aattttgcaggaagatgagcgcaac

SEQ ID NO: 342867 - DNA, 25 bp, Homo sapien
gagcgcaacatgtgataccttctat

SEQ ID NO: 342868 - DNA, 25 bp, Homo sapien
aaaaatgcactattgagagcgaaca

SEQ ID NO: 342869 - DNA, 25 bp, Homo sapien
gagcgaacaacagactggatgccat

SEQ ID NO: 342870 - DNA, 25 bp, Homo sapien
gaacaacagactggatgccataatt

SEQ ID NO: 342871 - DNA, 25 bp, Homo sapien
ggatgccataattttatagtcaagt

SEQ ID NO: 342872 - DNA, 25 bp, Homo sapien
ttatagtcaagtttgggacaagttt

SEQ ID NO: 342873 - DNA, 25 bp, Homo sapien
gaaactgtgttacaattcagagaaa

SEQ ID NO: 342874 - DNA, 25 bp, Homo sapien
aagacagttggtgagcatattaaga

SEQ ID NO: 342875 - DNA, 25 bp, Homo sapien
agggaacagatttagatgatccaat

SEQ ID NO: 342876 - DNA, 25 bp, Homo sapien
gatgatccaatatgcttattatcag

SEQ ID NO: 342877 - DNA, 25 bp, Homo sapien
atatgcttattatcagaattccaga

SEQ ID NO: 342878 - DNA, 25 bp, Homo sapien
aagaagacagaataccaggcaaaat

SEQ ID NO: 342879 - DNA, 25 bp, Homo sapien
cagcactacccttcttgcaagacag

SEQ ID NO: 342880 - DNA, 25 bp, Homo sapien
tgggaccattggctgggacccctca

SEQ ID NO: 342881 - DNA, 25 bp, Homo sapien
cattggctgggacccctcattaacc

SEQ ID NO: 342882 - DNA, 25 bp, Homo sapien
caagcacttgtacctccctggcata

SEQ ID NO: 342883 - DNA, 25 bp, Homo sapien
ctggcatactgggaattcctgggtc

SEQ ID NO: 342884 - DNA, 25 bp, Homo sapien
actgggaattcctgggtccaatcaa

SEQ ID NO: 342885 - DNA, 25 bp, Homo sapien
tcctgggtccaatcaaaggccctga

SEQ ID NO: 342886 - DNA, 25 bp, Homo sapien
ttcaggttctagaaactaccagaag

SEQ ID NO: 342887 - DNA, 25 bp, Homo sapien
aagaagcttcttccatcttatctac

SEQ ID NO: 342888 - DNA, 25 bp, Homo sapien
tcttatctacctactgcagctgctg

SEQ ID NO: 342889 - DNA, 25 bp, Homo sapien
ccatcctggagaagaattcttgccc

SEQ ID NO: 342890 - DNA, 25 bp, Homo sapien
ttgccagatttctctgtaaaggtga

SEQ ID NO: 342891 - DNA, 25 bp, Homo sapien
ggaacattcaggaacttcttcatgg

SEQ ID NO: 342892 - DNA, 25 bp, Homo sapien
aacttcttcatggtcatggtcaccc

SEQ ID NO: 342893 - DNA, 25 bp, Homo sapien
aagccaggctgtctgattccaggat

SEQ ID NO: 342894 - DNA, 25 bp, Homo sapien
gtctgattccaggatctgtgttctt

SEQ ID NO: 342895 - DNA, 25 bp, Homo sapien
gatctgtgttcttaatcctatacat

SEQ ID NO: 342896 - DNA, 25 bp, Homo sapien
ggaagccataatgagtcaaccacta

SEQ ID NO: 342897 - DNA, 25 bp, Homo sapien
aagattcacagatgttcgggtccaa

SEQ ID NO: 342898 - DNA, 25 bp, Homo sapien
gatgttcgggtccaattcaccagaa

SEQ ID NO: 342899 - DNA, 25 bp, Homo sapien
aattcaccagaatgccaagttatac

SEQ ID NO: 342900 - DNA, 25 bp, Homo sapien
gtcatatcaagagcacacactaaca

SEQ ID NO: 342901 - DNA, 25 bp, Homo sapien
acgtgagcaaaatcccagtgagcac

SEQ ID NO: 342902 - DNA, 25 bp, Homo sapien
accagctgttctaaaggtctcttcc

SEQ ID NO: 342903 - DNA, 25 bp, Homo sapien
gagcaaaatcccagtgagcactgat

SEQ ID NO: 342904 - DNA, 25 bp, Homo sapien
agcactgatgaacacctccacttgc

SEQ ID NO: 342905 - DNA, 25 bp, Homo sapien
agctgttctaaaggtctcttccaac

SEQ ID NO: 342906 - DNA, 25 bp, Homo sapien
ttctaaaggtctcttccaacctttg

SEQ ID NO: 342907 - DNA, 25 bp, Homo sapien
actagggcccccatagaatgcagaa

SEQ ID NO: 342908 - DNA, 25 bp, Homo sapien
cctttttctttgctgcggccaattt

SEQ ID NO: 342909 - DNA, 25 bp, Homo sapien
tgctgcggccaatttgctctgttga

SEQ ID NO: 342910 - DNA, 25 bp, Homo sapien
gcggccaatttgctctgttgagttt

SEQ ID NO: 342911 - DNA, 25 bp, Homo sapien
atttgctctgttgagtttcttctgc

SEQ ID NO: 342912 - DNA, 25 bp, Homo sapien
ggatgggtttatgtcccaataaatc

SEQ ID NO: 342913 - DNA, 25 bp, Homo sapien
tgtcccaataaatccaccataagtt

SEQ ID NO: 342914 - DNA, 25 bp, Homo sapien
tgcatgaaatacacataccctactg

SEQ ID NO: 342915 - DNA, 25 bp, Homo sapien
gaaatacacataccctactgaatat

SEQ ID NO: 342916 - DNA, 25 bp, Homo sapien
accctactgaatatcatagcttagc

SEQ ID NO: 342917 - DNA, 25 bp, Homo sapien
aatgtgctcagaacactgatgttaa

SEQ ID NO: 342918 - DNA, 25 bp, Homo sapien
gaacactgatgttaacctacagttg

SEQ ID NO: 342919 - DNA, 25 bp, Homo sapien
gaaaaatcatcttacacaaacccta

SEQ ID NO: 342920 - DNA, 25 bp, Homo sapien
gtttaagcattataagttggcgata

SEQ ID NO: 342921 - DNA, 25 bp, Homo sapien
agttggcgatagtctgtaattgtta

SEQ ID NO: 342922 - DNA, 25 bp, Homo sapien
ggcgatagtctgtaattgttaattt

SEQ ID NO: 342923 - DNA, 25 bp, Homo sapien
caggcctctgcaagggaggagtcca

SEQ ID NO: 342924 - DNA, 25 bp, Homo sapien
gaggagtccaggtcagagctgtcag

SEQ ID NO: 342925 - DNA, 25 bp, Homo sapien
gctgtcagggaggactacacggaca

SEQ ID NO: 342926 - DNA, 25 bp, Homo sapien
tacacggacagacggctccagtgtg

SEQ ID NO: 342927 - DNA, 25 bp, Homo sapien
tccagtgtgggaggtaccttttcca

SEQ ID NO: 342928 - DNA, 25 bp, Homo sapien
gaaagcccaaagtggattaccagca

SEQ ID NO: 342929 - DNA, 25 bp, Homo sapien
ttaccagcaggtattcactcgacac

SEQ ID NO: 342930 - DNA, 25 bp, Homo sapien
ggtattcactcgacacataaatcag

SEQ ID NO: 342931 - DNA, 25 bp, Homo sapien
aatcagattttcattcgaggcgaga

SEQ ID NO: 342932 - DNA, 25 bp, Homo sapien
gaggcgagaatgtcctgctggttca

SEQ ID NO: 342933 - DNA, 25 bp, Homo sapien
tgctggttcatcttgcacagtgacc

SEQ ID NO: 342934 - DNA, 25 bp, Homo sapien
aagtccctccacttgtaagacaaca

SEQ ID NO: 342935 - DNA, 25 bp, Homo sapien
aataggttggaaccaatgtggccaa

SEQ ID NO: 342936 - DNA, 25 bp, Homo sapien
tggaaccaatgtggccaactagagt

SEQ ID NO: 342937 - DNA, 25 bp, Homo sapien
tagagtctgtgcagtacctgcttgc

SEQ ID NO: 342938 - DNA, 25 bp, Homo sapien
gtgcagtacctgcttgctgacatca

SEQ ID NO: 342939 - DNA, 25 bp, Homo sapien
atttccactgcgtgtttcatactca

SEQ ID NO: 342940 - DNA, 25 bp, Homo sapien
gtgtgaaagcgaaactgtgccccaa

SEQ ID NO: 342941 - DNA, 25 bp, Homo sapien
tccactgcgtgtttcatactcactc

SEQ ID NO: 342942 - DNA, 25 bp, Homo sapien
cgtacctgcccatgtgatctatgag

SEQ ID NO: 342943 - DNA, 25 bp, Homo sapien
gcccatgtgatctatgaggtgtcat

SEQ ID NO: 342944 - DNA, 25 bp, Homo sapien
tgtgccccaaacagttaaagacacc

SEQ ID NO: 342945 - DNA, 25 bp, Homo sapien
tttgagtggctgctaagtggcaatc

SEQ ID NO: 342946 - DNA, 25 bp, Homo sapien
gtggctgctaagtggcaatcattcc

SEQ ID NO: 342947 - DNA, 25 bp, Homo sapien
tggcaatcattccacaaggtatttt

SEQ ID NO: 342948 - DNA, 25 bp, Homo sapien
acatttgttacttcacttaatcctt

SEQ ID NO: 342949 - DNA, 25 bp, Homo sapien
tacttcacttaatcctttcaacaat

SEQ ID NO: 342950 - DNA, 25 bp, Homo sapien
aatcctgagaggtaagcatttgctt

SEQ ID NO: 342951 - DNA, 25 bp, Homo sapien
atttgctttacttaacagaggagga

SEQ ID NO: 342952 - DNA, 25 bp, Homo sapien
gacggagactcaaggaacttaaatc

SEQ ID NO: 342953 - DNA, 25 bp, Homo sapien
taacaggtactttcaccacatcagc

SEQ ID NO: 342954 - DNA, 25 bp, Homo sapien
gtactttcaccacatcagcttgtaa

SEQ ID NO: 342955 - DNA, 25 bp, Homo sapien
ctttcaccacatcagcttgtaagat

SEQ ID NO: 342956 - DNA, 25 bp, Homo sapien
ccactctgccttagaagttaatttt

SEQ ID NO: 342957 - DNA, 25 bp, Homo sapien
gtacattacaaatctctgaggccat

SEQ ID NO: 342958 - DNA, 25 bp, Homo sapien
tgtggtttgtctttgaaattacggt

SEQ ID NO: 342959 - DNA, 25 bp, Homo sapien
tacttttagacagtaagtccggctg

SEQ ID NO: 342960 - DNA, 25 bp, Homo sapien
aagtccggctggttgcagggctatt

SEQ ID NO: 342961 - DNA, 25 bp, Homo sapien
gttgcagggctatttgccccgacag

SEQ ID NO: 342962 - DNA, 25 bp, Homo sapien
ccgacagcatcagcctgtaacattt

SEQ ID NO: 342963 - DNA, 25 bp, Homo sapien
cactgagtcgttccctggccagagg

SEQ ID NO: 342964 - DNA, 25 bp, Homo sapien
ctggccagaggacataaatggtgct

SEQ ID NO: 342965 - DNA, 25 bp, Homo sapien
tagcagatataggtgcagggtgcct

SEQ ID NO: 342966 - DNA, 25 bp, Homo sapien
agggtgcctgtcattcactgtgtta

SEQ ID NO: 342967 - DNA, 25 bp, Homo sapien
tcccctatgcagaccattgtcagtg

SEQ ID NO: 342968 - DNA, 25 bp, Homo sapien
tgcagaccattgtcagtgctccggt

SEQ ID NO: 342969 - DNA, 25 bp, Homo sapien
cacggtgtggcgactggcagcagct

SEQ ID NO: 342970 - DNA, 25 bp, Homo sapien
agcagctctcccgttgcgagtagtc

SEQ ID NO: 342971 - DNA, 25 bp, Homo sapien
ttgcgagtagtcacagcgctgtccc

SEQ ID NO: 342972 - DNA, 25 bp, Homo sapien
ctgcttttgcatcagagccgagggc

SEQ ID NO: 342973 - DNA, 25 bp, Homo sapien
ttttgcatcagagccgagggctgca

SEQ ID NO: 342974 - DNA, 25 bp, Homo sapien
agggctgcaccaggtgtaacttcca

SEQ ID NO: 342975 - DNA, 25 bp, Homo sapien
gtgtaacttccaccccttgacctat

SEQ ID NO: 342976 - DNA, 25 bp, Homo sapien
gcagcggatctagggcgcaacagaa

SEQ ID NO: 342977 - DNA, 25 bp, Homo sapien
agggcgcaacagaagcttctctccg

SEQ ID NO: 342978 - DNA, 25 bp, Homo sapien
gatggctaatgcatatttctttcct

SEQ ID NO: 342979 - DNA, 25 bp, Homo sapien
atggctaatgcatatttctttcctg

SEQ ID NO: 342980 - DNA, 25 bp, Homo sapien
tggctaatgcatatttctttcctga

SEQ ID NO: 342981 - DNA, 25 bp, Homo sapien
ggctaatgcatatttctttcctgat

SEQ ID NO: 342982 - DNA, 25 bp, Homo sapien
gctttttcctacgttcttccacact

SEQ ID NO: 342983 - DNA, 25 bp, Homo sapien
ctacgttcttccacactcctgtatg

SEQ ID NO: 342984 - DNA, 25 bp, Homo sapien
gacattgactctaaatgtgcccgag

SEQ ID NO: 342985 - DNA, 25 bp, Homo sapien
taaatgtgcccgaggttgtcatccc

SEQ ID NO: 342986 - DNA, 25 bp, Homo sapien
gcctaataccgtacctaggaaagtg

SEQ ID NO: 342987 - DNA, 25 bp, Homo sapien
ctaataccgtacctaggaaagtgag

SEQ ID NO: 342988 - DNA, 25 bp, Homo sapien
taataccgtacctaggaaagtgaga

SEQ ID NO: 342989 - DNA, 25 bp, Homo sapien
atacacaaaattttcctatgtcaga

SEQ ID NO: 342990 - DNA, 25 bp, Homo sapien
cctatgtcagaatgtggtggagcat

SEQ ID NO: 342991 - DNA, 25 bp, Homo sapien
taaaactttgcttctcctgatcccg

SEQ ID NO: 342992 - DNA, 25 bp, Homo sapien
ctcctgatcccggtgaagtgtacat

SEQ ID NO: 342993 - DNA, 25 bp, Homo sapien
gatcccggtgaagtgtacatcataa

SEQ ID NO: 342994 - DNA, 25 bp, Homo sapien
agtgtacatcataagaatccatagt

SEQ ID NO: 342995 - DNA, 25 bp, Homo sapien
tactttgaagtaccattgcaccaag

SEQ ID NO: 342996 - DNA, 25 bp, Homo sapien
gtaccattgcaccaagatgtctgac

SEQ ID NO: 342997 - DNA, 25 bp, Homo sapien
attgcaccaagatgtctgactgaat

SEQ ID NO: 342998 - DNA, 25 bp, Homo sapien
gtctgactgaattcatagtcacact

SEQ ID NO: 342999 - DNA, 25 bp, Homo sapien
ctaaaactcttgttgttagatacaa

SEQ ID NO: 343000 - DNA, 25 bp, Homo sapien
tggccccaagagatcctcacatctt

SEQ ID NO: 343001 - DNA, 25 bp, Homo sapien
aataagacttgttgtgtatcctaac

SEQ ID NO: 343002 - DNA, 25 bp, Homo sapien
agtagtttacatgtctgttaagcct

SEQ ID NO: 343003 - DNA, 25 bp, Homo sapien
tgtctgttaagcctagtttatctat

SEQ ID NO: 343004 - DNA, 25 bp, Homo sapien
gcctagtttatctatggtacaacct

SEQ ID NO: 343005 - DNA, 25 bp, Homo sapien
ggtacaacctgaatgttcacgttcc

SEQ ID NO: 343006 - DNA, 25 bp, Homo sapien
tgaatgttcacgttccccaaacatc

SEQ ID NO: 343007 - DNA, 25 bp, Homo sapien
gttccccaaacatcatgctgcaacg

SEQ ID NO: 343008 - DNA, 25 bp, Homo sapien
atgctgcaacgcagtcctcaatgtt

SEQ ID NO: 343009 - DNA, 25 bp, Homo sapien
aacgcagtcctcaatgttggatgca

SEQ ID NO: 343010 - DNA, 25 bp, Homo sapien
agtcctcaatgttggatgcagaacc

SEQ ID NO: 343011 - DNA, 25 bp, Homo sapien
gattctgtattttcacgagaaccag

SEQ ID NO: 343012 - DNA, 25 bp, Homo sapien
gaaccagttgatatatcctgtcaag

SEQ ID NO: 343013 - DNA, 25 bp, Homo sapien
aaatgtcaggagagggatttccaat

SEQ ID NO: 343014 - DNA, 25 bp, Homo sapien
caaattctttcatgcctggtggctg

SEQ ID NO: 343015 - DNA, 25 bp, Homo sapien
cctggtggctgatgtggttgtattc

SEQ ID NO: 343016 - DNA, 25 bp, Homo sapien
gaatcatttctcacttccattggaa

SEQ ID NO: 343017 - DNA, 25 bp, Homo sapien
gaagctgattcctgatcacagaccc

SEQ ID NO: 343018 - DNA, 25 bp, Homo sapien
gacccaaggatctggaaagcatcat

SEQ ID NO: 343019 - DNA, 25 bp, Homo sapien
agcatcatcagacccaagtgccaag

SEQ ID NO: 343020 - DNA, 25 bp, Homo sapien
gtgccaagttatttactttcccatc

SEQ ID NO: 343021 - DNA, 25 bp, Homo sapien
atgtgagcagattcatgcccaagca

SEQ ID NO: 343022 - DNA, 25 bp, Homo sapien
tgcggagtgtgaattactgacccca

SEQ ID NO: 343023 - DNA, 25 bp, Homo sapien
accggaccaccaagagagccagggc

SEQ ID NO: 343024 - DNA, 25 bp, Homo sapien
accaagagagccagggctgctgttt

SEQ ID NO: 343025 - DNA, 25 bp, Homo sapien
agggctgctgtttcgcgactcacca

SEQ ID NO: 343026 - DNA, 25 bp, Homo sapien
ttcgcgactcaccagcacagatttg

SEQ ID NO: 343027 - DNA, 25 bp, Homo sapien
acagatttgctcagaaactctgccc

SEQ ID NO: 343028 - DNA, 25 bp, Homo sapien
ctcagaaactctgcccaagattggg

SEQ ID NO: 343029 - DNA, 25 bp, Homo sapien
caagattgggcagaagttactttaa

SEQ ID NO: 343030 - DNA, 25 bp, Homo sapien
aaaagacttggttcagctggtcacg

SEQ ID NO: 343031 - DNA, 25 bp, Homo sapien
ggccaagccagatggatcatgaagc

SEQ ID NO: 343032 - DNA, 25 bp, Homo sapien
tacaaaaattaacagcagagcgaga

SEQ ID NO: 343033 - DNA, 25 bp, Homo sapien
ttaatagtgcgcctgttactaatgg

SEQ ID NO: 343034 - DNA, 25 bp, Homo sapien
atagtgcgcctgttactaatggaat

SEQ ID NO: 343035 - DNA, 25 bp, Homo sapien
gtgcgcctgttactaatggaattta

SEQ ID NO: 343036 - DNA, 25 bp, Homo sapien
gcctgttactaatggaatttactta

SEQ ID NO: 343037 - DNA, 25 bp, Homo sapien
aagtaagtttgccatatgaaagggt

SEQ ID NO: 343038 - DNA, 25 bp, Homo sapien
gtttgccatatgaaagggtattaat

SEQ ID NO: 343039 - DNA, 25 bp, Homo sapien
gggtattaatatccttttcaagcat

SEQ ID NO: 343040 - DNA, 25 bp, Homo sapien
ccttttcaagcataacatacaaatg

SEQ ID NO: 343041 - DNA, 25 bp, Homo sapien
gataagaaaacagatgctaggccta

SEQ ID NO: 343042 - DNA, 25 bp, Homo sapien
gctaggcctaaagatatttgctaca

SEQ ID NO: 343043 - DNA, 25 bp, Homo sapien
taaaaaatttgtctggggtgcctgt

SEQ ID NO: 343044 - DNA, 25 bp, Homo sapien
tagtcctctgcgtgccctcctggga

SEQ ID NO: 343045 - DNA, 25 bp, Homo sapien
gagtcctcccctagcgggctggtct

SEQ ID NO: 343046 - DNA, 25 bp, Homo sapien
agcgggctggtctcggcgcggagtc

SEQ ID NO: 343047 - DNA, 25 bp, Homo sapien
gagtcggcgccgaacccgagctgct

SEQ ID NO: 343048 - DNA, 25 bp, Homo sapien
gggcgtgtgcctagggcgcagggct

SEQ ID NO: 343049 - DNA, 25 bp, Homo sapien
gctccgctgaggtctctaggaaagg

SEQ ID NO: 343050 - DNA, 25 bp, Homo sapien
gcgatttgagggttccgccgtgacc

SEQ ID NO: 343051 - DNA, 25 bp, Homo sapien
gtgaccgcttccaacggcggacacg

SEQ ID NO: 343052 - DNA, 25 bp, Homo sapien
ggacacgcgcgctctggaccagagc

SEQ ID NO: 343053 - DNA, 25 bp, Homo sapien
tctggaccagagccgttgcccgctg

SEQ ID NO: 343054 - DNA, 25 bp, Homo sapien
agtgtggctcggtagtcctctgcgt

SEQ ID NO: 343055 - DNA, 25 bp, Homo sapien
tgatataacctttttgttagcagaa

SEQ ID NO: 343056 - DNA, 25 bp, Homo sapien
tagtcactgcttaggttttaagtct

SEQ ID NO: 343057 - DNA, 25 bp, Homo sapien
taagtctgccaaactgggactaagt

SEQ ID NO: 343058 - DNA, 25 bp, Homo sapien
aactgggactaagtatgctttaaat

SEQ ID NO: 343059 - DNA, 25 bp, Homo sapien
ggtatagattcttcggtttcttaga

SEQ ID NO: 343060 - DNA, 25 bp, Homo sapien
gattcttcggtttcttagaattcta

SEQ ID NO: 343061 - DNA, 25 bp, Homo sapien
gaattctagatccatgatgtacttt

SEQ ID NO: 343062 - DNA, 25 bp, Homo sapien
caaaagtccatttgtcctgctactc

SEQ ID NO: 343063 - DNA, 25 bp, Homo sapien
atttgtcctgctactcctttggtga

SEQ ID NO: 343064 - DNA, 25 bp, Homo sapien
gctactcctttggtgacacacaggt

SEQ ID NO: 343065 - DNA, 25 bp, Homo sapien
acacaggtagtgtcaactggaacat

SEQ ID NO: 343066 - DNA, 25 bp, Homo sapien
ctcatttctaaacatctggatctgg

SEQ ID NO: 343067 - DNA, 25 bp, Homo sapien
caaaattggtttttccatggtgtag

SEQ ID NO: 343068 - DNA, 25 bp, Homo sapien
ggtgtagtctaattttgccaaatca

SEQ ID NO: 343069 - DNA, 25 bp, Homo sapien
aattttgccaaatcacccaagaaag

SEQ ID NO: 343070 - DNA, 25 bp, Homo sapien
aagtatatgacgtgtggagtttgca

SEQ ID NO: 343071 - DNA, 25 bp, Homo sapien
gtttgcatttcttggatgggaccta

SEQ ID NO: 343072 - DNA, 25 bp, Homo sapien
ggatgggacctatcgggtcacccag

SEQ ID NO: 343073 - DNA, 25 bp, Homo sapien
cagcccagtcttacagtcataaatt

SEQ ID NO: 343074 - DNA, 25 bp, Homo sapien
ataaattcctacctcttagttcctg

SEQ ID NO: 343075 - DNA, 25 bp, Homo sapien
agcctctgtgtgcacacttattgaa

SEQ ID NO: 343076 - DNA, 25 bp, Homo sapien
gaatgctttgcctaaagtttggcct

SEQ ID NO: 343077 - DNA, 25 bp, Homo sapien
aattttgtacaataacctgctagac

SEQ ID NO: 343078 - DNA, 25 bp, Homo sapien
ttttgtacaataacctgctagacac

SEQ ID NO: 343079 - DNA, 25 bp, Homo sapien
tgtacaataacctgctagacacatt

SEQ ID NO: 343080 - DNA, 25 bp, Homo sapien
gtacaataacctgctagacacattt

SEQ ID NO: 343081 - DNA, 25 bp, Homo sapien
tacaataacctgctagacacatttt

SEQ ID NO: 343082 - DNA, 25 bp, Homo sapien
caataacctgctagacacattttta

SEQ ID NO: 343083 - DNA, 25 bp, Homo sapien
ataacctgctagacacatttttaaa

SEQ ID NO: 343084 - DNA, 25 bp, Homo sapien
aaatgcaacatgtgtacttaatttc

SEQ ID NO: 343085 - DNA, 25 bp, Homo sapien
gcaacatgtgtacttaatttcttta

SEQ ID NO: 343086 - DNA, 25 bp, Homo sapien
caacatgtgtacttaatttctttat

SEQ ID NO: 343087 - DNA, 25 bp, Homo sapien
acatgtgtacttaatttctttatgt

SEQ ID NO: 343088 - DNA, 25 bp, Homo sapien
agcacagagtctttgctgctcttta

SEQ ID NO: 343089 - DNA, 25 bp, Homo sapien
gagtctttgctgctctttaagcgat

SEQ ID NO: 343090 - DNA, 25 bp, Homo sapien
gctctttaagcgattagtgcactga

SEQ ID NO: 343091 - DNA, 25 bp, Homo sapien
attagtgcactgaagcagcaataat

SEQ ID NO: 343092 - DNA, 25 bp, Homo sapien
cgcctgctgcattaggagctgggta

SEQ ID NO: 343093 - DNA, 25 bp, Homo sapien
gcatttacagtaaagtcatgttcag

SEQ ID NO: 343094 - DNA, 25 bp, Homo sapien
aggagctgggtattcctcttgacat

SEQ ID NO: 343095 - DNA, 25 bp, Homo sapien
ggtattcctcttgacatctggatgt

SEQ ID NO: 343096 - DNA, 25 bp, Homo sapien
tctggatgttgctgggtcacgatgc

SEQ ID NO: 343097 - DNA, 25 bp, Homo sapien
gctgggtcacgatgcctgcctcagg

SEQ ID NO: 343098 - DNA, 25 bp, Homo sapien
aggccaggagtctgcgggaactgtg

SEQ ID NO: 343099 - DNA, 25 bp, Homo sapien
gagtacagacacaggcatttagtat

SEQ ID NO: 343100 - DNA, 25 bp, Homo sapien
agaatagtaaggtccagtatctggc

SEQ ID NO: 343101 - DNA, 25 bp, Homo sapien
tccagtatctggcaatgggaatagg

SEQ ID NO: 343102 - DNA, 25 bp, Homo sapien
aaacaaggtgtaggtgatgactgct

SEQ ID NO: 343103 - DNA, 25 bp, Homo sapien
gtaggtgatgactgctggaactgat

SEQ ID NO: 343104 - DNA, 25 bp, Homo sapien
gaggtgacaatgttgccaagacatt

SEQ ID NO: 343105 - DNA, 25 bp, Homo sapien
gttgccaagacattatatccagaca

SEQ ID NO: 343106 - DNA, 25 bp, Homo sapien
caagacattatatccagacactcag

SEQ ID NO: 343107 - DNA, 25 bp, Homo sapien
gattgccaaagataatacagacatg

SEQ ID NO: 343108 - DNA, 25 bp, Homo sapien
taagaaagagttggtcaaatttcct

SEQ ID NO: 343109 - DNA, 25 bp, Homo sapien
tgggtgaatgaccaagatatcaatt

SEQ ID NO: 343110 - DNA, 25 bp, Homo sapien
gcggtttcagcttcacttaaaacat

SEQ ID NO: 343111 - DNA, 25 bp, Homo sapien
tttcagcttcacttaaaacatgcaa

SEQ ID NO: 343112 - DNA, 25 bp, Homo sapien
agcttcacttaaaacatgcaaattc

SEQ ID NO: 343113 - DNA, 25 bp, Homo sapien
aaaacttccgaagagttctatctga

SEQ ID NO: 343114 - DNA, 25 bp, Homo sapien
acttccgaagagttctatctgaata

SEQ ID NO: 343115 - DNA, 25 bp, Homo sapien
gaagagttctatctgaataaatcca

SEQ ID NO: 343116 - DNA, 25 bp, Homo sapien
aatccaaatccattgggagtcgctt

SEQ ID NO: 343117 - DNA, 25 bp, Homo sapien
tccaaatccattgggagtcgctttg

SEQ ID NO: 343118 - DNA, 25 bp, Homo sapien
aaatccattgggagtcgctttgagg

SEQ ID NO: 343119 - DNA, 25 bp, Homo sapien
atccattgggagtcgctttgaggag

SEQ ID NO: 343120 - DNA, 25 bp, Homo sapien
attgggagtcgctttgaggagacaa

SEQ ID NO: 343121 - DNA, 25 bp, Homo sapien
gggatagtgttaattgccctaccta

SEQ ID NO: 343122 - DNA, 25 bp, Homo sapien
gatagtgttaattgccctacctacc

SEQ ID NO: 343123 - DNA, 25 bp, Homo sapien
gagacaatgaattcaaagcaagttg

SEQ ID NO: 343124 - DNA, 25 bp, Homo sapien
caagttgacaagtaagtgctatgca

SEQ ID NO: 343125 - DNA, 25 bp, Homo sapien
agcaatggaatggacattggcagaa

SEQ ID NO: 343126 - DNA, 25 bp, Homo sapien
ctttctctgtgtggcttaaacccag

SEQ ID NO: 343127 - DNA, 25 bp, Homo sapien
tctgtgtggcttaaacccaggtcgc

SEQ ID NO: 343128 - DNA, 25 bp, Homo sapien
gtgtggcttaaacccaggtcgccat

SEQ ID NO: 343129 - DNA, 25 bp, Homo sapien
ttaaacccaggtcgccattgcttta

SEQ ID NO: 343130 - DNA, 25 bp, Homo sapien
caggtcgccattgctttatacattt

SEQ ID NO: 343131 - DNA, 25 bp, Homo sapien
tcacttagcacagatttgtaattat

SEQ ID NO: 343132 - DNA, 25 bp, Homo sapien
gtagtgccataccagtccactacat

SEQ ID NO: 343133 - DNA, 25 bp, Homo sapien
ataccagtccactacatctacaact

SEQ ID NO: 343134 - DNA, 25 bp, Homo sapien
tacatctacaactcctaacacattc

SEQ ID NO: 343135 - DNA, 25 bp, Homo sapien
ctaacacattcgctgcgggcagtga

SEQ ID NO: 343136 - DNA, 25 bp, Homo sapien
cgggcagtgatatccgctaatcctg

SEQ ID NO: 343137 - DNA, 25 bp, Homo sapien
atccgctaatcctggatgaggcagc

SEQ ID NO: 343138 - DNA, 25 bp, Homo sapien
atgaggcagcggagggcccccaaac

SEQ ID NO: 343139 - DNA, 25 bp, Homo sapien
cccctatccaggacttagtaaagct

SEQ ID NO: 343140 - DNA, 25 bp, Homo sapien
cttagtaaagctggcgttcaaagtt

SEQ ID NO: 343141 - DNA, 25 bp, Homo sapien
tgaggtacaacgacaggcaagactg

SEQ ID NO: 343142 - DNA, 25 bp, Homo sapien
tgaaacaaaaagttcagctccaaac

SEQ ID NO: 343143 - DNA, 25 bp, Homo sapien
ataaaatcagatgtgggaatccagg

SEQ ID NO: 343144 - DNA, 25 bp, Homo sapien
gggaaagtgcaaacgaagcaagatt

SEQ ID NO: 343145 - DNA, 25 bp, Homo sapien
acgaagcaagattgagaaaattctc

SEQ ID NO: 343146 - DNA, 25 bp, Homo sapien
caagtttttataaacagttctcaca

SEQ ID NO: 343147 - DNA, 25 bp, Homo sapien
gttctcacactctgccagttccttg

SEQ ID NO: 343148 - DNA, 25 bp, Homo sapien
ctcattcaggataattggttattct

SEQ ID NO: 343149 - DNA, 25 bp, Homo sapien
aaatacagtcatttctaaaattatg

SEQ ID NO: 343150 - DNA, 25 bp, Homo sapien
aattatgaagtgttcaggacctttg

SEQ ID NO: 343151 - DNA, 25 bp, Homo sapien
tgaagtgttcaggacctttgggagt

SEQ ID NO: 343152 - DNA, 25 bp, Homo sapien
gtgttcaggacctttgggagtgaaa

SEQ ID NO: 343153 - DNA, 25 bp, Homo sapien
cctttgggagtgaaagaatttgcta

SEQ ID NO: 343154 - DNA, 25 bp, Homo sapien
ggatagccaaggagatgccagattt

SEQ ID NO: 343155 - DNA, 25 bp, Homo sapien
gagatgccagatttagacccacaga

SEQ ID NO: 343156 - DNA, 25 bp, Homo sapien
gatttagacccacagaaccgcagaa

SEQ ID NO: 343157 - DNA, 25 bp, Homo sapien
aatcccacccctttgtatctaaatg

SEQ ID NO: 343158 - DNA, 25 bp, Homo sapien
tgtatctaaatggagcctgcatgct

SEQ ID NO: 343159 - DNA, 25 bp, Homo sapien
cctgcatgctctggatgtaggagga

SEQ ID NO: 343160 - DNA, 25 bp, Homo sapien
gaggagataggatcctacccagctc

SEQ ID NO: 343161 - DNA, 25 bp, Homo sapien
aagagtgaatcctcctgactgcctt

SEQ ID NO: 343162 - DNA, 25 bp, Homo sapien
tgactgccttcttcgcgtttcctct

SEQ ID NO: 343163 - DNA, 25 bp, Homo sapien
cacacctcgggcagattatctcaga

SEQ ID NO: 343164 - DNA, 25 bp, Homo sapien
atctcagaaaaatcatggttgggta

SEQ ID NO: 343165 - DNA, 25 bp, Homo sapien
acagcaaggtcaacactactacgcc

SEQ ID NO: 343166 - DNA, 25 bp, Homo sapien
gcaaggtcaacactactacgcctta

SEQ ID NO: 343167 - DNA, 25 bp, Homo sapien
ggtcaacactactacgccttagcca

SEQ ID NO: 343168 - DNA, 25 bp, Homo sapien
tgccccaagggctttgggcagggac

SEQ ID NO: 343169 - DNA, 25 bp, Homo sapien
tgctgactgcgacttccctctgcag

SEQ ID NO: 343170 - DNA, 25 bp, Homo sapien
agggcaggcagccacctatgcccca

SEQ ID NO: 343171 - DNA, 25 bp, Homo sapien
tgccccacaagacggaacccgggag

SEQ ID NO: 343172 - DNA, 25 bp, Homo sapien
tagagggcaccagggaatgctgtga

SEQ ID NO: 343173 - DNA, 25 bp, Homo sapien
gcaaatgcagaagggagccagtgtc

SEQ ID NO: 343174 - DNA, 25 bp, Homo sapien
gggaaagagtcctggatccatctct

SEQ ID NO: 343175 - DNA, 25 bp, Homo sapien
tggatccatctctagccaaatcaca

SEQ ID NO: 343176 - DNA, 25 bp, Homo sapien
cttcctactctcagaatctctggac

SEQ ID NO: 343177 - DNA, 25 bp, Homo sapien
cagaatctctggactataaacgctg

SEQ ID NO: 343178 - DNA, 25 bp, Homo sapien
agaatctctggactataaacgctgg

SEQ ID NO: 343179 - DNA, 25 bp, Homo sapien
gaatctctggactataaacgctggg

SEQ ID NO: 343180 - DNA, 25 bp, Homo sapien
ctaagactccagttagaagattttt

SEQ ID NO: 343181 - DNA, 25 bp, Homo sapien
taagactccagttagaagatttttg

SEQ ID NO: 343182 - DNA, 25 bp, Homo sapien
aagactccagttagaagatttttga

SEQ ID NO: 343183 - DNA, 25 bp, Homo sapien
agactccagttagaagatttttgaa

SEQ ID NO: 343184 - DNA, 25 bp, Homo sapien
gactccagttagaagatttttgaaa

SEQ ID NO: 343185 - DNA, 25 bp, Homo sapien
ctccagttagaagatttttgaaaat

SEQ ID NO: 343186 - DNA, 25 bp, Homo sapien
acaggcatatgaataggtattaatc

SEQ ID NO: 343187 - DNA, 25 bp, Homo sapien
gggcaaatgaaatatccatcaactc

SEQ ID NO: 343188 - DNA, 25 bp, Homo sapien
gcaaatgaaatatccatcaactcca

SEQ ID NO: 343189 - DNA, 25 bp, Homo sapien
catttgtattacaaaccgattctac

SEQ ID NO: 343190 - DNA, 25 bp, Homo sapien
tacaaaccgattctacacttttagt

SEQ ID NO: 343191 - DNA, 25 bp, Homo sapien
gtacaagtaaattgctattgactat

SEQ ID NO: 343192 - DNA, 25 bp, Homo sapien
gtaaattgctattgactatagggtc

SEQ ID NO: 343193 - DNA, 25 bp, Homo sapien
gactatagggtcattttcatgggta

SEQ ID NO: 343194 - DNA, 25 bp, Homo sapien
ctatagggtcattttcatgggtata

SEQ ID NO: 343195 - DNA, 25 bp, Homo sapien
atagggtcattttcatgggtataat

SEQ ID NO: 343196 - DNA, 25 bp, Homo sapien
gggtcattttcatgggtataataaa

SEQ ID NO: 343197 - DNA, 25 bp, Homo sapien
accttacatttgaataggacctttg

SEQ ID NO: 343198 - DNA, 25 bp, Homo sapien
cttacatttgaataggacctttgct

SEQ ID NO: 343199 - DNA, 25 bp, Homo sapien
tttaaaagtgccctgactggctagg

SEQ ID NO: 343200 - DNA, 25 bp, Homo sapien
ttaaaagtgccctgactggctaggt

SEQ ID NO: 343201 - DNA, 25 bp, Homo sapien
taaaagtgccctgactggctaggtg

SEQ ID NO: 343202 - DNA, 25 bp, Homo sapien
aaaagtgccctgactggctaggtgc

SEQ ID NO: 343203 - DNA, 25 bp, Homo sapien
aaagtgccctgactggctaggtgca

SEQ ID NO: 343204 - DNA, 25 bp, Homo sapien
aagtgccctgactggctaggtgcag

SEQ ID NO: 343205 - DNA, 25 bp, Homo sapien
agtgccctgactggctaggtgcagt

SEQ ID NO: 343206 - DNA, 25 bp, Homo sapien
aattatccggacacggtggcgggca

SEQ ID NO: 343207 - DNA, 25 bp, Homo sapien
attatccggacacggtggcgggcac

SEQ ID NO: 343208 - DNA, 25 bp, Homo sapien
tgtctagagctagcatagtgtataa

SEQ ID NO: 343209 - DNA, 25 bp, Homo sapien
ctcatctgaagcacgcaagtcaaat

SEQ ID NO: 343210 - DNA, 25 bp, Homo sapien
gtgtataacatagccatcatttcca

SEQ ID NO: 343211 - DNA, 25 bp, Homo sapien
tcatttccaggatgtagatactcta

SEQ ID NO: 343212 - DNA, 25 bp, Homo sapien
gtagatactctatttccattaactg

SEQ ID NO: 343213 - DNA, 25 bp, Homo sapien
gaagcacgcaagtcaaatgatctgt

SEQ ID NO: 343214 - DNA, 25 bp, Homo sapien
attatttcagactttaccctgcttt

SEQ ID NO: 343215 - DNA, 25 bp, Homo sapien
tttaccctgctttctctatagggtt

SEQ ID NO: 343216 - DNA, 25 bp, Homo sapien
ctgctttctctatagggtttttgta

SEQ ID NO: 343217 - DNA, 25 bp, Homo sapien
ctgttcatatggttgtattgaagct

SEQ ID NO: 343218 - DNA, 25 bp, Homo sapien
gaagctaatttcatccacatacaag

SEQ ID NO: 343219 - DNA, 25 bp, Homo sapien
tggtgcccctttcctgaaggctaac

SEQ ID NO: 343220 - DNA, 25 bp, Homo sapien
ttcctgaaggctaacaatgcagttc

SEQ ID NO: 343221 - DNA, 25 bp, Homo sapien
gaaggctaacaatgcagttcaaatt

SEQ ID NO: 343222 - DNA, 25 bp, Homo sapien
cagttcaaattatatgcttatgcat

SEQ ID NO: 343223 - DNA, 25 bp, Homo sapien
tatgcttatgcatgttcagaacaca

SEQ ID NO: 343224 - DNA, 25 bp, Homo sapien
aacacagtagacatcatgtgtcggt

SEQ ID NO: 343225 - DNA, 25 bp, Homo sapien
tagacatcatgtgtcggtgggtgtt

SEQ ID NO: 343226 - DNA, 25 bp, Homo sapien
gttgctcttaaggagtgatacagcc

SEQ ID NO: 343227 - DNA, 25 bp, Homo sapien
taaggagtgatacagccatcctccc

SEQ ID NO: 343228 - DNA, 25 bp, Homo sapien
tgaagatgaactttcctttcccagc

SEQ ID NO: 343229 - DNA, 25 bp, Homo sapien
agagggaggctgagctcagtagctc

SEQ ID NO: 343230 - DNA, 25 bp, Homo sapien
gccccaaaacgctttttcagcataa

SEQ ID NO: 343231 - DNA, 25 bp, Homo sapien
aaacgctttttcagcataagaatta

SEQ ID NO: 343232 - DNA, 25 bp, Homo sapien
gatgggcctggcttggaaacacctg

SEQ ID NO: 343233 - DNA, 25 bp, Homo sapien
ggcctggcttggaaacacctgccca

SEQ ID NO: 343234 - DNA, 25 bp, Homo sapien
agccagtggacgacctctgcgatgg

SEQ ID NO: 343235 - DNA, 25 bp, Homo sapien
atgggcaacaactttcacagaacag

SEQ ID NO: 343236 - DNA, 25 bp, Homo sapien
ttcacagaacaggatagttgcaatg

SEQ ID NO: 343237 - DNA, 25 bp, Homo sapien
gggagcgcccctcagaggaggtgag

SEQ ID NO: 343238 - DNA, 25 bp, Homo sapien
aggtgagggtactgatcagaacaat

SEQ ID NO: 343239 - DNA, 25 bp, Homo sapien
gatcagaacaatagctgtccctgca

SEQ ID NO: 343240 - DNA, 25 bp, Homo sapien
gaacaatagctgtccctgcactggg

SEQ ID NO: 343241 - DNA, 25 bp, Homo sapien
ttttcctacattcaccacactcatg

SEQ ID NO: 343242 - DNA, 25 bp, Homo sapien
actcctccagtgtgacgtctctggt

SEQ ID NO: 343243 - DNA, 25 bp, Homo sapien
gacgtctctggtggtgaatgaattc

SEQ ID NO: 343244 - DNA, 25 bp, Homo sapien
ggataaaggctttctcacgatcact

SEQ ID NO: 343245 - DNA, 25 bp, Homo sapien
tttctcacgatcactgcattcataa

SEQ ID NO: 343246 - DNA, 25 bp, Homo sapien
tctccagtgtgaattatcttgtgta

SEQ ID NO: 343247 - DNA, 25 bp, Homo sapien
agattaggtggcactttttgctaaa

SEQ ID NO: 343248 - DNA, 25 bp, Homo sapien
tgctaaaggattcctcacattcact

SEQ ID NO: 343249 - DNA, 25 bp, Homo sapien
tcacattcactacactcaaacatct

SEQ ID NO: 343250 - DNA, 25 bp, Homo sapien
ctcaaacatcttttgtccagtgtga

SEQ ID NO: 343251 - DNA, 25 bp, Homo sapien
agtgtgttcttgcaagtgaaggctt

SEQ ID NO: 343252 - DNA, 25 bp, Homo sapien
gtgataggcctagattgaattttaa

SEQ ID NO: 343253 - DNA, 25 bp, Homo sapien
tttaaggttgtcttgagtctttcaa

SEQ ID NO: 343254 - DNA, 25 bp, Homo sapien
gagagttgaggcctgatcttgctta

SEQ ID NO: 343255 - DNA, 25 bp, Homo sapien
gaggcctgatcttgcttagagtcta

SEQ ID NO: 343256 - DNA, 25 bp, Homo sapien
gaacactccattatttctccaaatt

SEQ ID NO: 343257 - DNA, 25 bp, Homo sapien
gaccagtatgcaaataagccagtgt

SEQ ID NO: 343258 - DNA, 25 bp, Homo sapien
gccagtgtgtgaacatatatttttc

SEQ ID NO: 343259 - DNA, 25 bp, Homo sapien
gttccttacttggaagccaccttat

SEQ ID NO: 343260 - DNA, 25 bp, Homo sapien
ggaagccaccttataaaattttgtg

SEQ ID NO: 343261 - DNA, 25 bp, Homo sapien
aattttgtgtcccagattagtaaca

SEQ ID NO: 343262 - DNA, 25 bp, Homo sapien
gattagtaacaccactgtatgtgta

SEQ ID NO: 343263 - DNA, 25 bp, Homo sapien
gaaacttgctcagcaatgcaaggaa

SEQ ID NO: 343264 - DNA, 25 bp, Homo sapien
ctgccagtgcgtgctggtgaatgca

SEQ ID NO: 343265 - DNA, 25 bp, Homo sapien
gtgcgtgctggtgaatgcagcccat

SEQ ID NO: 343266 - DNA, 25 bp, Homo sapien
tttcaaggcctttaaaccatcaccg

SEQ ID NO: 343267 - DNA, 25 bp, Homo sapien
taaaccatcaccgtgctgtggtcat

SEQ ID NO: 343268 - DNA, 25 bp, Homo sapien
atcaccgtgctgtggtcatcgggct

SEQ ID NO: 343269 - DNA, 25 bp, Homo sapien
tggtcatcgggctttctcttcagca

SEQ ID NO: 343270 - DNA, 25 bp, Homo sapien
ttcagcatccctcctaattatctgg

SEQ ID NO: 343271 - DNA, 25 bp, Homo sapien
taattatctggcctttcccacgtgc

SEQ ID NO: 343272 - DNA, 25 bp, Homo sapien
gagagctgagcctaactgaatgata

SEQ ID NO: 343273 - DNA, 25 bp, Homo sapien
actgaatgatatgggaaacttgctc

SEQ ID NO: 343274 - DNA, 25 bp, Homo sapien
gctttttcctacgttcttccacact

SEQ ID NO: 343275 - DNA, 25 bp, Homo sapien
ttttcctacgttcttccacactcct

SEQ ID NO: 343276 - DNA, 25 bp, Homo sapien
tttcctacgttcttccacactcctg

SEQ ID NO: 343277 - DNA, 25 bp, Homo sapien
ttcctacgttcttccacactcctgt

SEQ ID NO: 343278 - DNA, 25 bp, Homo sapien
tcctacgttcttccacactcctgta

SEQ ID NO: 343279 - DNA, 25 bp, Homo sapien
cctacgttcttccacactcctgtat

SEQ ID NO: 343280 - DNA, 25 bp, Homo sapien
ctacgttcttccacactcctgtatg

SEQ ID NO: 343281 - DNA, 25 bp, Homo sapien
taaatgtgcccgaggttgtcatccc

SEQ ID NO: 343282 - DNA, 25 bp, Homo sapien
gcctaataccgtacctaggaaagtg

SEQ ID NO: 343283 - DNA, 25 bp, Homo sapien
ctaataccgtacctaggaaagtgag

SEQ ID NO: 343284 - DNA, 25 bp, Homo sapien
taataccgtacctaggaaagtgaga

SEQ ID NO: 343285 - DNA, 25 bp, Homo sapien
aatgactgtgattcccaagctagcc

SEQ ID NO: 343286 - DNA, 25 bp, Homo sapien
gattcccaagctagcctcaatcata

SEQ ID NO: 343287 - DNA, 25 bp, Homo sapien
tagcctcaatcatacctctctagtg

SEQ ID NO: 343288 - DNA, 25 bp, Homo sapien
ctctagtgccctctacgggaaattt

SEQ ID NO: 343289 - DNA, 25 bp, Homo sapien
ggaaaactatcttgggaatgtattt

SEQ ID NO: 343290 - DNA, 25 bp, Homo sapien
gaatgtatttttccagtcccagaga

SEQ ID NO: 343291 - DNA, 25 bp, Homo sapien
gtatttttccagtcccagagagtgt

SEQ ID NO: 343292 - DNA, 25 bp, Homo sapien
tccagtcccagagagtgttaaattg

SEQ ID NO: 343293 - DNA, 25 bp, Homo sapien
gtgagtttggaattcttaggatgct

SEQ ID NO: 343294 - DNA, 25 bp, Homo sapien
ggaattcttaggatgctttttcttt

SEQ ID NO: 343295 - DNA, 25 bp, Homo sapien
aataaatgccacatatttaaccgtg

SEQ ID NO: 343296 - DNA, 25 bp, Homo sapien
gtgatatcctgggtttcaactcttc

SEQ ID NO: 343297 - DNA, 25 bp, Homo sapien
atatcctgggtttcaactcttctac

SEQ ID NO: 343298 - DNA, 25 bp, Homo sapien
ctgggtttcaactcttctacaaggt

SEQ ID NO: 343299 - DNA, 25 bp, Homo sapien
gatacagttgttctgtgatttggga

SEQ ID NO: 343300 - DNA, 25 bp, Homo sapien
taagtgacattgtagtaccatataa

SEQ ID NO: 343301 - DNA, 25 bp, Homo sapien
aatattttagatcttgacttaggca

SEQ ID NO: 343302 - DNA, 25 bp, Homo sapien
gatcttgacttaggcatatacaaag

SEQ ID NO: 343303 - DNA, 25 bp, Homo sapien
ctgcaaagcagtattcctcagcctt

SEQ ID NO: 343304 - DNA, 25 bp, Homo sapien
aaagcagtattcctcagcctttggt

SEQ ID NO: 343305 - DNA, 25 bp, Homo sapien
gcagtattcctcagcctttggttgg

SEQ ID NO: 343306 - DNA, 25 bp, Homo sapien
atatgtggtgatatcctgggtttca

SEQ ID NO: 343307 - DNA, 25 bp, Homo sapien
acctactctagtaacgcaacaactt

SEQ ID NO: 343308 - DNA, 25 bp, Homo sapien
tttgtttacttagacctcgggagat

SEQ ID NO: 343309 - DNA, 25 bp, Homo sapien
ggagataaaattaatcgacctcttt

SEQ ID NO: 343310 - DNA, 25 bp, Homo sapien
taatcgacctctttaaatacatgga

SEQ ID NO: 343311 - DNA, 25 bp, Homo sapien
tttctcgtttttgaagggagacact

SEQ ID NO: 343312 - DNA, 25 bp, Homo sapien
taacgcaacaacttgcccctctgtt

SEQ ID NO: 343313 - DNA, 25 bp, Homo sapien
gtggtttagatagcccatgacagtt

SEQ ID NO: 343314 - DNA, 25 bp, Homo sapien
gcccctctgttcttttgagttctgg

SEQ ID NO: 343315 - DNA, 25 bp, Homo sapien
tgagttctggcttctgattgtttct

SEQ ID NO: 343316 - DNA, 25 bp, Homo sapien
tgtttctcaccacattgtcaactcc

SEQ ID NO: 343317 - DNA, 25 bp, Homo sapien
aactccttgggaaagtactctgtat

SEQ ID NO: 343318 - DNA, 25 bp, Homo sapien
gacacgaagccaggtcgtcagctgc

SEQ ID NO: 343319 - DNA, 25 bp, Homo sapien
aggtcgtcagctgcttggtactggc

SEQ ID NO: 343320 - DNA, 25 bp, Homo sapien
agctgcttggtactggctttccctg

SEQ ID NO: 343321 - DNA, 25 bp, Homo sapien
gcccctgttcatgcccaagagattt

SEQ ID NO: 343322 - DNA, 25 bp, Homo sapien
cttttcaggcaggagtttccttgaa

SEQ ID NO: 343323 - DNA, 25 bp, Homo sapien
aagggaagtgatggccccaagcctc

SEQ ID NO: 343324 - DNA, 25 bp, Homo sapien
caagcctcttaatcagaagcccagg

SEQ ID NO: 343325 - DNA, 25 bp, Homo sapien
gcccaggtaggcagcttctctcttt

SEQ ID NO: 343326 - DNA, 25 bp, Homo sapien
tgcccaagagatttattcacttatt

SEQ ID NO: 343327 - DNA, 25 bp, Homo sapien
agccactgcttcagaacgctgactg

SEQ ID NO: 343328 - DNA, 25 bp, Homo sapien
gcttcagaacgctgactgcgtggtg

SEQ ID NO: 343329 - DNA, 25 bp, Homo sapien
gtagtaatattctatagggatttgg

SEQ ID NO: 343330 - DNA, 25 bp, Homo sapien
ggttatgagaacacttaattcctct

SEQ ID NO: 343331 - DNA, 25 bp, Homo sapien
ttttttcctctttatgtatgtatgt

SEQ ID NO: 343332 - DNA, 25 bp, Homo sapien
gagaacacttaattcctctaaaagt

SEQ ID NO: 343333 - DNA, 25 bp, Homo sapien
aattcctctaaaagttccaagcatg

SEQ ID NO: 343334 - DNA, 25 bp, Homo sapien
tctaaaagttccaagcatgatgcta

SEQ ID NO: 343335 - DNA, 25 bp, Homo sapien
gcatgatgctaatgacaactggtaa

SEQ ID NO: 343336 - DNA, 25 bp, Homo sapien
tgctaatgacaactggtaagacctg

SEQ ID NO: 343337 - DNA, 25 bp, Homo sapien
gacaactggtaagacctgggtagat

SEQ ID NO: 343338 - DNA, 25 bp, Homo sapien
aactggtaagacctgggtagatgat

SEQ ID NO: 343339 - DNA, 25 bp, Homo sapien
acctgggtagatgatggtaggaaaa

SEQ ID NO: 343340 - DNA, 25 bp, Homo sapien
cgtgcagaagaggatccctgcggct

SEQ ID NO: 343341 - DNA, 25 bp, Homo sapien
gatccctgcggctgcgggctctttt

SEQ ID NO: 343342 - DNA, 25 bp, Homo sapien
ggctcttttccaggcccaaggacaa

SEQ ID NO: 343343 - DNA, 25 bp, Homo sapien
tccaggcccaaggacaaggcggtgt

SEQ ID NO: 343344 - DNA, 25 bp, Homo sapien
tgccgggttgatctgcactgcttta

SEQ ID NO: 343345 - DNA, 25 bp, Homo sapien
agagacaaaccgctccaacgccaaa

SEQ ID NO: 343346 - DNA, 25 bp, Homo sapien
tgccctcgcaattccaatcgcaaag

SEQ ID NO: 343347 - DNA, 25 bp, Homo sapien
aattccaatcgcaaaggcaggctag

SEQ ID NO: 343348 - DNA, 25 bp, Homo sapien
aaaggcaggctagggccacagttca

SEQ ID NO: 343349 - DNA, 25 bp, Homo sapien
ggctagggccacagttcaaacccaa

SEQ ID NO: 343350 - DNA, 25 bp, Homo sapien
gaaagctggaaatgcagttggtctt

SEQ ID NO: 343351 - DNA, 25 bp, Homo sapien
attacctcggctcggatccagccga

SEQ ID NO: 343352 - DNA, 25 bp, Homo sapien
ggatccagccgaacgtgttcttctg

SEQ ID NO: 343353 - DNA, 25 bp, Homo sapien
ccgaacgtgttcttctgggtggcgt

SEQ ID NO: 343354 - DNA, 25 bp, Homo sapien
gctgcatctcgtgcggctcgatgaa

SEQ ID NO: 343355 - DNA, 25 bp, Homo sapien
cagcacgtccgacagcatgtggaag

SEQ ID NO: 343356 - DNA, 25 bp, Homo sapien
agtcggagagcatcgccagcgacga

SEQ ID NO: 343357 - DNA, 25 bp, Homo sapien
cgtgcggctcgatgaagcgctcgat

SEQ ID NO: 343358 - DNA, 25 bp, Homo sapien
gagagcatcgccagcgacgaggtca

SEQ ID NO: 343359 - DNA, 25 bp, Homo sapien
tgaacatgaaggtcagcgccagcat

SEQ ID NO: 343360 - DNA, 25 bp, Homo sapien
gatgaagcgctcgatggcctccagc

SEQ ID NO: 343361 - DNA, 25 bp, Homo sapien
tggcctccagcaggatggcgaaaca

SEQ ID NO: 343362 - DNA, 25 bp, Homo sapien
gttttatattctctactgagtattt

SEQ ID NO: 343363 - DNA, 25 bp, Homo sapien
ttccattttcatagggctaatgtca

SEQ ID NO: 343364 - DNA, 25 bp, Homo sapien
tagggctaatgtcattttcagttgt

SEQ ID NO: 343365 - DNA, 25 bp, Homo sapien
ttcagttgtaataatcgattggcat

SEQ ID NO: 343366 - DNA, 25 bp, Homo sapien
atcgattggcatagtgtcaatggaa

SEQ ID NO: 343367 - DNA, 25 bp, Homo sapien
gtttgtagtgagcagacttttggaa

SEQ ID NO: 343368 - DNA, 25 bp, Homo sapien
atccaatggatgctcaaagtaatac

SEQ ID NO: 343369 - DNA, 25 bp, Homo sapien
tacagaggaggaatctcctttcaaa

SEQ ID NO: 343370 - DNA, 25 bp, Homo sapien
gacaagtgctgaagtacatttttcc

SEQ ID NO: 343371 - DNA, 25 bp, Homo sapien
tccttccagtactttgactcagata

SEQ ID NO: 343372 - DNA, 25 bp, Homo sapien
ataccacttcatattagacaaatgt

SEQ ID NO: 343373 - DNA, 25 bp, Homo sapien
gccttccaggtaaagcaaatgaaat

SEQ ID NO: 343374 - DNA, 25 bp, Homo sapien
aatgaaattgaaggactcgcgcatc

SEQ ID NO: 343375 - DNA, 25 bp, Homo sapien
atgaaattgaaggactcgcgcatca

SEQ ID NO: 343376 - DNA, 25 bp, Homo sapien
gaaattgaaggactcgcgcatcaag

SEQ ID NO: 343377 - DNA, 25 bp, Homo sapien
aattgaaggactcgcgcatcaagct

SEQ ID NO: 343378 - DNA, 25 bp, Homo sapien
gaaggactcgcgcatcaagctgatg

SEQ ID NO: 343379 - DNA, 25 bp, Homo sapien
aaggactcgcgcatcaagctgatga

SEQ ID NO: 343380 - DNA, 25 bp, Homo sapien
ggactcgcgcatcaagctgatgagt

SEQ ID NO: 343381 - DNA, 25 bp, Homo sapien
actcgcgcatcaagctgatgagtga

SEQ ID NO: 343382 - DNA, 25 bp, Homo sapien
catcaagctgatgagtgagatcctg

SEQ ID NO: 343383 - DNA, 25 bp, Homo sapien
agctgctgcgcacggcggcctacct

SEQ ID NO: 343384 - DNA, 25 bp, Homo sapien
tcttcagtgcagagctctgtcccca

SEQ ID NO: 343385 - DNA, 25 bp, Homo sapien
ttcagtgcagagctctgtccccatg

SEQ ID NO: 343386 - DNA, 25 bp, Homo sapien
tcagtgcagagctctgtccccatga

SEQ ID NO: 343387 - DNA, 25 bp, Homo sapien
agtgcagagctctgtccccatgagg

SEQ ID NO: 343388 - DNA, 25 bp, Homo sapien
gtgcagagctctgtccccatgagga

SEQ ID NO: 343389 - DNA, 25 bp, Homo sapien
tgcagagctctgtccccatgaggag

SEQ ID NO: 343390 - DNA, 25 bp, Homo sapien
gcagagctctgtccccatgaggagg

SEQ ID NO: 343391 - DNA, 25 bp, Homo sapien
ccaagggtgactgaggctgcagctg

SEQ ID NO: 343392 - DNA, 25 bp, Homo sapien
gctgcagctgctatcacatgctgaa

SEQ ID NO: 343393 - DNA, 25 bp, Homo sapien
gtgacaaattgtctggatttcttta

SEQ ID NO: 343394 - DNA, 25 bp, Homo sapien
attaaaaccagctattggtatggca

SEQ ID NO: 343395 - DNA, 25 bp, Homo sapien
agcatcaccactcggcttttagcag

SEQ ID NO: 343396 - DNA, 25 bp, Homo sapien
atcaccactcggcttttagcagact

SEQ ID NO: 343397 - DNA, 25 bp, Homo sapien
tcaccactcggcttttagcagactg

SEQ ID NO: 343398 - DNA, 25 bp, Homo sapien
accactcggcttttagcagactgaa

SEQ ID NO: 343399 - DNA, 25 bp, Homo sapien
cactcggcttttagcagactgaagc

SEQ ID NO: 343400 - DNA, 25 bp, Homo sapien
tagttttgtctctagtgatgagcag

SEQ ID NO: 343401 - DNA, 25 bp, Homo sapien
aggctttactggtccaaccagaaag

SEQ ID NO: 343402 - DNA, 25 bp, Homo sapien
tggtccaaccagaaagagaagctaa

SEQ ID NO: 343403 - DNA, 25 bp, Homo sapien
gtccaaccagaaagagaagctaaga

SEQ ID NO: 343404 - DNA, 25 bp, Homo sapien
cttggacaccccacagaccaatatc

SEQ ID NO: 343405 - DNA, 25 bp, Homo sapien
accttccaggagaagacccttccag

SEQ ID NO: 343406 - DNA, 25 bp, Homo sapien
ttcactttcccacccatttagggag

SEQ ID NO: 343407 - DNA, 25 bp, Homo sapien
acccatttagggagacaatcaagct

SEQ ID NO: 343408 - DNA, 25 bp, Homo sapien
gctcttagttataggtggctcccag

SEQ ID NO: 343409 - DNA, 25 bp, Homo sapien
tcccagggtctaattggaggcacct

SEQ ID NO: 343410 - DNA, 25 bp, Homo sapien
cctagacttgcctaaaagagctctc

SEQ ID NO: 343411 - DNA, 25 bp, Homo sapien
tcttacgatgccctggtgtctttct

SEQ ID NO: 343412 - DNA, 25 bp, Homo sapien
ctgggcttctatccctgtgaggaga

SEQ ID NO: 343413 - DNA, 25 bp, Homo sapien
tatccctgtgaggagaggtgctgtc

SEQ ID NO: 343414 - DNA, 25 bp, Homo sapien
ggtgctgtctgctggagcctctagt

SEQ ID NO: 343415 - DNA, 25 bp, Homo sapien
tccagtggtcactcttgagtcacat

SEQ ID NO: 343416 - DNA, 25 bp, Homo sapien
actcttgagtcacatctgtcactta

SEQ ID NO: 343417 - DNA, 25 bp, Homo sapien
acatccttgttgtttgccaaagaaa

SEQ ID NO: 343418 - DNA, 25 bp, Homo sapien
agaaatttcatttggctgtgaatat

SEQ ID NO: 343419 - DNA, 25 bp, Homo sapien
tgaatattctatttgcttgcagtat

SEQ ID NO: 343420 - DNA, 25 bp, Homo sapien
tctatttgcttgcagtatctgtttc

SEQ ID NO: 343421 - DNA, 25 bp, Homo sapien
tttctcttcctaggctcaagttggt

SEQ ID NO: 343422 - DNA, 25 bp, Homo sapien
tcctaggctcaagttggtgacccaa

SEQ ID NO: 343423 - DNA, 25 bp, Homo sapien
gttggtgacccaagcctattgtaaa

SEQ ID NO: 343424 - DNA, 25 bp, Homo sapien
gacccaagcctattgtaaacaagtg

SEQ ID NO: 343425 - DNA, 25 bp, Homo sapien
gatgccaatggagtaacaatttgtt

SEQ ID NO: 343426 - DNA, 25 bp, Homo sapien
tgttaaccttacgttttctgtctgt

SEQ ID NO: 343427 - DNA, 25 bp, Homo sapien
aaccttacgttttctgtctgtatat

SEQ ID NO: 343428 - DNA, 25 bp, Homo sapien
ctgaaggcagatctgtatcagacag

SEQ ID NO: 343429 - DNA, 25 bp, Homo sapien
gtaggtaaggtgctgtaatagttta

SEQ ID NO: 343430 - DNA, 25 bp, Homo sapien
ggtagaattctaggcaggaactaat

SEQ ID NO: 343431 - DNA, 25 bp, Homo sapien
gaactaatacaaactgcattcaggg

SEQ ID NO: 343432 - DNA, 25 bp, Homo sapien
tagttgtttagttccaaagcccatg

SEQ ID NO: 343433 - DNA, 25 bp, Homo sapien
ggtagcatcagaggacttagcaatc

SEQ ID NO: 343434 - DNA, 25 bp, Homo sapien
gacttagcaatcgtctagatatggg

SEQ ID NO: 343435 - DNA, 25 bp, Homo sapien
aaagcccatgctcattctgttgcac

SEQ ID NO: 343436 - DNA, 25 bp, Homo sapien
tgctcattctgttgcaccaggaagt

SEQ ID NO: 343437 - DNA, 25 bp, Homo sapien
agtgacttggttaggaatgtgcacc

SEQ ID NO: 343438 - DNA, 25 bp, Homo sapien
gaatgtgcaccaagatggatctgaa

SEQ ID NO: 343439 - DNA, 25 bp, Homo sapien
gactgactcggcagtgtgcagtggt

SEQ ID NO: 343440 - DNA, 25 bp, Homo sapien
tgcagtggtgcatgcactgtctcag

SEQ ID NO: 343441 - DNA, 25 bp, Homo sapien
tggtgcatgcactgtctcagccaac

SEQ ID NO: 343442 - DNA, 25 bp, Homo sapien
caggaactgagccagaaacgcagat

SEQ ID NO: 343443 - DNA, 25 bp, Homo sapien
actgagccagaaacgcagattgggc

SEQ ID NO: 343444 - DNA, 25 bp, Homo sapien
aaacgcagattgggctggctctgaa

SEQ ID NO: 343445 - DNA, 25 bp, Homo sapien
ctgaagccaagcctcttcttacttc

SEQ ID NO: 343446 - DNA, 25 bp, Homo sapien
ggctcctcatttttacgggtaacag

SEQ ID NO: 343447 - DNA, 25 bp, Homo sapien
tttttacgggtaacagtgaggctgg

SEQ ID NO: 343448 - DNA, 25 bp, Homo sapien
acagaccaggaagctcggtgagtga

SEQ ID NO: 343449 - DNA, 25 bp, Homo sapien
aagctcggtgagtgatggcagaacg

SEQ ID NO: 343450 - DNA, 25 bp, Homo sapien
ttcccctcagtagcctatttatact

SEQ ID NO: 343451 - DNA, 25 bp, Homo sapien
attttcacttgtgacaccaccacag

SEQ ID NO: 343452 - DNA, 25 bp, Homo sapien
ttatactgagcattttccacatgga

SEQ ID NO: 343453 - DNA, 25 bp, Homo sapien
cacatggatacccttgaaaaaagta

SEQ ID NO: 343454 - DNA, 25 bp, Homo sapien
cacttgtgacaccaccacagagaca

SEQ ID NO: 343455 - DNA, 25 bp, Homo sapien
cggcggcggctctttggtatcgtat

SEQ ID NO: 343456 - DNA, 25 bp, Homo sapien
ggctctttggtatcgtattgtttgt

SEQ ID NO: 343457 - DNA, 25 bp, Homo sapien
cacagagacagccactgcttgcatg

SEQ ID NO: 343458 - DNA, 25 bp, Homo sapien
actgcttgcatggtgtttctctgca

SEQ ID NO: 343459 - DNA, 25 bp, Homo sapien
tggtgtttctctgcagtcttcttcc

SEQ ID NO: 343460 - DNA, 25 bp, Homo sapien
gtcttcttcctgtgcatataggaag

SEQ ID NO: 343461 - DNA, 25 bp, Homo sapien
agtaagaagcagaccactattaggg

SEQ ID NO: 343462 - DNA, 25 bp, Homo sapien
gaagcagaccactattagggtgagt

SEQ ID NO: 343463 - DNA, 25 bp, Homo sapien
taaggtgaagtaagccattcctaaa

SEQ ID NO: 343464 - DNA, 25 bp, Homo sapien
gtaagccattcctaaaataattggg

SEQ ID NO: 343465 - DNA, 25 bp, Homo sapien
ataattggaagcatttgctgaccct

SEQ ID NO: 343466 - DNA, 25 bp, Homo sapien
tgaccctttccacctcatggttgta

SEQ ID NO: 343467 - DNA, 25 bp, Homo sapien
ttccacctcatggttgtaggatatt

SEQ ID NO: 343468 - DNA, 25 bp, Homo sapien
ggatattacaagtatgttttcttta

SEQ ID NO: 343469 - DNA, 25 bp, Homo sapien
tgctcaataagccaacatagataaa

SEQ ID NO: 343470 - DNA, 25 bp, Homo sapien
aatcagaaccagtattataggtctc

SEQ ID NO: 343471 - DNA, 25 bp, Homo sapien
ataggtctcatctactgaacatttc

SEQ ID NO: 343472 - DNA, 25 bp, Homo sapien
aggccacctcgagcagaagtattgt

SEQ ID NO: 343473 - DNA, 25 bp, Homo sapien
gtattgtccatggagcctgaacgct

SEQ ID NO: 343474 - DNA, 25 bp, Homo sapien
agcctgaacgctcccgggcagagat

SEQ ID NO: 343475 - DNA, 25 bp, Homo sapien
gagatgccagggtgtggatactcta

SEQ ID NO: 343476 - DNA, 25 bp, Homo sapien
cagggtgtggatactctaggatgct

SEQ ID NO: 343477 - DNA, 25 bp, Homo sapien
ctaggatgctagaactggtggagaa

SEQ ID NO: 343478 - DNA, 25 bp, Homo sapien
aaagagctgtaagccgagtctctct

SEQ ID NO: 343479 - DNA, 25 bp, Homo sapien
aagccgagtctctcttgttatggaa

SEQ ID NO: 343480 - DNA, 25 bp, Homo sapien
gtctctcttgttatggaagtggctg

SEQ ID NO: 343481 - DNA, 25 bp, Homo sapien
actggtcagcgtccgccttagataa

SEQ ID NO: 343482 - DNA, 25 bp, Homo sapien
gtccgccttagataagcatggtcat

SEQ ID NO: 343483 - DNA, 25 bp, Homo sapien
ggctatgaactcaagcttgagcaaa

SEQ ID NO: 343484 - DNA, 25 bp, Homo sapien
caagcttgagcaaactttgggtcaa

SEQ ID NO: 343485 - DNA, 25 bp, Homo sapien
agcaaactttgggtcaatcccagtt

SEQ ID NO: 343486 - DNA, 25 bp, Homo sapien
attaattggcatgaagagtacagat

SEQ ID NO: 343487 - DNA, 25 bp, Homo sapien
gtacagatgtaatcacaagtaatgc

SEQ ID NO: 343488 - DNA, 25 bp, Homo sapien
aagtaatgcaagactcactgaggaa

SEQ ID NO: 343489 - DNA, 25 bp, Homo sapien
gactcactgaggaatacaagccaag

SEQ ID NO: 343490 - DNA, 25 bp, Homo sapien
caagccaagctgatgaggcagtaca

SEQ ID NO: 343491 - DNA, 25 bp, Homo sapien
ttggagagaatcaaagccttgtcac

SEQ ID NO: 343492 - DNA, 25 bp, Homo sapien
aaagccttgtcacatggatcctctg

SEQ ID NO: 343493 - DNA, 25 bp, Homo sapien
aatgagattttattatccctctcta

SEQ ID NO: 343494 - DNA, 25 bp, Homo sapien
tgacatcatcatggattccatcagg

SEQ ID NO: 343495 - DNA, 25 bp, Homo sapien
atcatcatggattccatcaggcaaa

SEQ ID NO: 343496 - DNA, 25 bp, Homo sapien
atcatggattccatcaggcaaaagg

SEQ ID NO: 343497 - DNA, 25 bp, Homo sapien
atcaggcaaaaggaccccaaagcca

SEQ ID NO: 343498 - DNA, 25 bp, Homo sapien
ggctgtggaccctgcacatcagccc

SEQ ID NO: 343499 - DNA, 25 bp, Homo sapien
gccccaagcagtttgtggtagattt

SEQ ID NO: 343500 - DNA, 25 bp, Homo sapien
cagtttgtggtagatttgctggcca

SEQ ID NO: 343501 - DNA, 25 bp, Homo sapien
gtttgtggtagatttgctggccatc

SEQ ID NO: 343502 - DNA, 25 bp, Homo sapien
ttgtggtagatttgctggccatcac

SEQ ID NO: 343503 - DNA, 25 bp, Homo sapien
gtggtagatttgctggccatcaccg

SEQ ID NO: 343504 - DNA, 25 bp, Homo sapien
tggtagatttgctggccatcaccgg

SEQ ID NO: 343505 - DNA, 25 bp, Homo sapien
atttttattgtggtgaactcagaac

SEQ ID NO: 343506 - DNA, 25 bp, Homo sapien
atcttgatgcgggttgtgtctctca

SEQ ID NO: 343507 - DNA, 25 bp, Homo sapien
gggttgtgtctctcatgcatgataa

SEQ ID NO: 343508 - DNA, 25 bp, Homo sapien
gcatgataactcagaggacaggctc

SEQ ID NO: 343509 - DNA, 25 bp, Homo sapien
tcggtagtgcggtagtgctaactct

SEQ ID NO: 343510 - DNA, 25 bp, Homo sapien
gtgctaactctgtgaagtttcttca

SEQ ID NO: 343511 - DNA, 25 bp, Homo sapien
tctgtgaagtttcttcaccctcctt

SEQ ID NO: 343512 - DNA, 25 bp, Homo sapien
ttcatagctcctgttccaaaggcat

SEQ ID NO: 343513 - DNA, 25 bp, Homo sapien
gttccaaaggcattcagcagccatt

SEQ ID NO: 343514 - DNA, 25 bp, Homo sapien
ttcagcagccattcgacctgggaaa

SEQ ID NO: 343515 - DNA, 25 bp, Homo sapien
agccattcgacctgggaaagaaaca

SEQ ID NO: 343516 - DNA, 25 bp, Homo sapien
gaatgtaaattctggtaattggtta

SEQ ID NO: 343517 - DNA, 25 bp, Homo sapien
gtaaattctggtaattggttacagg

SEQ ID NO: 343518 - DNA, 25 bp, Homo sapien
taaattctggtaattggttacagga

SEQ ID NO: 343519 - DNA, 25 bp, Homo sapien
attctggtaattggttacaggaaat

SEQ ID NO: 343520 - DNA, 25 bp, Homo sapien
tctggtaattggttacaggaaattg

SEQ ID NO: 343521 - DNA, 25 bp, Homo sapien
ggaaattggaagtcaccaaagccaa

SEQ ID NO: 343522 - DNA, 25 bp, Homo sapien
gtcaccaaagccaagccttcccaag

SEQ ID NO: 343523 - DNA, 25 bp, Homo sapien
tcaccaaagccaagccttcccaaga

SEQ ID NO: 343524 - DNA, 25 bp, Homo sapien
aagccaagccttcccaagacatctt

SEQ ID NO: 343525 - DNA, 25 bp, Homo sapien
aagacatcttgacctctgcctgtca

SEQ ID NO: 343526 - DNA, 25 bp, Homo sapien
agacatcttgacctctgcctgtcag

SEQ ID NO: 343527 - DNA, 25 bp, Homo sapien
gggtcattatgttcgtgctgcaagt

SEQ ID NO: 343528 - DNA, 25 bp, Homo sapien
gttcgtgctgcaagtgatctgtaat

SEQ ID NO: 343529 - DNA, 25 bp, Homo sapien
gctgcaagtgatctgtaatccctat

SEQ ID NO: 343530 - DNA, 25 bp, Homo sapien
attattttttcatcgtaatgcaggg

SEQ ID NO: 343531 - DNA, 25 bp, Homo sapien
ttcatcgtaatgcagggtaactatt

SEQ ID NO: 343532 - DNA, 25 bp, Homo sapien
gggtaactattattgcgcattttca

SEQ ID NO: 343533 - DNA, 25 bp, Homo sapien
attattgcgcattttcatttgggtc

SEQ ID NO: 343534 - DNA, 25 bp, Homo sapien
ttgggtcttaacttattggaactgt

SEQ ID NO: 343535 - DNA, 25 bp, Homo sapien
tggaactgtagagcatccatccatc

SEQ ID NO: 343536 - DNA, 25 bp, Homo sapien
atgtctttcctaacacaaaaggtct

SEQ ID NO: 343537 - DNA, 25 bp, Homo sapien
aaaaggtctatgtgtgtggttagtc

SEQ ID NO: 343538 - DNA, 25 bp, Homo sapien
gtcaagggtttgtagtaatgtattc

SEQ ID NO: 343539 - DNA, 25 bp, Homo sapien
aatgtattcagtgccacttcttgcc

SEQ ID NO: 343540 - DNA, 25 bp, Homo sapien
acttcttgccatcactttgcaatta

SEQ ID NO: 343541 - DNA, 25 bp, Homo sapien
gctttcatgggagatggagccacat

SEQ ID NO: 343542 - DNA, 25 bp, Homo sapien
tttgtgttctgggtgggatcactag

SEQ ID NO: 343543 - DNA, 25 bp, Homo sapien
ggatcactagtgcaggagaacatta

SEQ ID NO: 343544 - DNA, 25 bp, Homo sapien
ggagaacattacattttcttctgaa

SEQ ID NO: 343545 - DNA, 25 bp, Homo sapien
gcaaaatgcttgtaggttttgcctc

SEQ ID NO: 343546 - DNA, 25 bp, Homo sapien
aaaattgcacttgttcacctaccag

SEQ ID NO: 343547 - DNA, 25 bp, Homo sapien
cacctaccagtgtttacgaaatcct

SEQ ID NO: 343548 - DNA, 25 bp, Homo sapien
cctgtatttgggatgctttttctat

SEQ ID NO: 343549 - DNA, 25 bp, Homo sapien
tggtccagagcctcatcagaacctc

SEQ ID NO: 343550 - DNA, 25 bp, Homo sapien
gagcctcatcagaacctcttcctgt

SEQ ID NO: 343551 - DNA, 25 bp, Homo sapien
tgcctcatactcatactcatactca

SEQ ID NO: 343552 - DNA, 25 bp, Homo sapien
tactcatactcaagccctttttcct

SEQ ID NO: 343553 - DNA, 25 bp, Homo sapien
acaagcaacagtcacagcaccagtt

SEQ ID NO: 343554 - DNA, 25 bp, Homo sapien
agctgccttccgactgggaggcctt

SEQ ID NO: 343555 - DNA, 25 bp, Homo sapien
tgggaggcctttgatactagcctgt

SEQ ID NO: 343556 - DNA, 25 bp, Homo sapien
gcctttgatactagcctgtggtctg

SEQ ID NO: 343557 - DNA, 25 bp, Homo sapien
tgatactagcctgtggtctgatggg

SEQ ID NO: 343558 - DNA, 25 bp, Homo sapien
tcttatttctctggaaccacgaacc

SEQ ID NO: 343559 - DNA, 25 bp, Homo sapien
tggaaccacgaacccctggtccaga

SEQ ID NO: 343560 - DNA, 25 bp, Homo sapien
tgggatctgctctgtggcctaggat

SEQ ID NO: 343561 - DNA, 25 bp, Homo sapien
ggatgtggctgttttatctgccgta

SEQ ID NO: 343562 - DNA, 25 bp, Homo sapien
atctgccgtataatgtacatcgtgc

SEQ ID NO: 343563 - DNA, 25 bp, Homo sapien
gtacatcgtgctgacaatgccttgg

SEQ ID NO: 343564 - DNA, 25 bp, Homo sapien
atgccttggttttgtctgaaacatt

SEQ ID NO: 343565 - DNA, 25 bp, Homo sapien
acttctattttccaccagtgttctt

SEQ ID NO: 343566 - DNA, 25 bp, Homo sapien
accagtgttctttagaattgtttct

SEQ ID NO: 343567 - DNA, 25 bp, Homo sapien
aacgtttgttggcatacagtccctt

SEQ ID NO: 343568 - DNA, 25 bp, Homo sapien
cagtcccttcaccacaaataattgt

SEQ ID NO: 343569 - DNA, 25 bp, Homo sapien
aattgtcttgcactgtctacaaagc

SEQ ID NO: 343570 - DNA, 25 bp, Homo sapien
aaagcaaggatcagttacctcactt

SEQ ID NO: 343571 - DNA, 25 bp, Homo sapien
gccagatttgtttatctttgtacag

SEQ ID NO: 343572 - DNA, 25 bp, Homo sapien
gaagctttgatgaagtgtcttgtat

SEQ ID NO: 343573 - DNA, 25 bp, Homo sapien
gtgtcttgtatttaacacccttatt

SEQ ID NO: 343574 - DNA, 25 bp, Homo sapien
atttggtttggcctgcactacgatg

SEQ ID NO: 343575 - DNA, 25 bp, Homo sapien
tttggcctgcactacgatgagggat

SEQ ID NO: 343576 - DNA, 25 bp, Homo sapien
gaagagactgagcttgcacagatca

SEQ ID NO: 343577 - DNA, 25 bp, Homo sapien
gagcttgcacagatcagaccgagaa

SEQ ID NO: 343578 - DNA, 25 bp, Homo sapien
aagcagggtgagagattctaacgac

SEQ ID NO: 343579 - DNA, 25 bp, Homo sapien
agattctaacgactggatgctgcta

SEQ ID NO: 343580 - DNA, 25 bp, Homo sapien
ggatgctgctagtaacacattgttt

SEQ ID NO: 343581 - DNA, 25 bp, Homo sapien
attgtttgtattgctttaccatttt

SEQ ID NO: 343582 - DNA, 25 bp, Homo sapien
ggagaccatttgtctttaactgaag

SEQ ID NO: 343583 - DNA, 25 bp, Homo sapien
gtttaagatcatagtctaccctagt

SEQ ID NO: 343584 - DNA, 25 bp, Homo sapien
catagtctaccctagtatggtgctt

SEQ ID NO: 343585 - DNA, 25 bp, Homo sapien
accctagtatggtgctttgccacaa

SEQ ID NO: 343586 - DNA, 25 bp, Homo sapien
atgacttcatatgatcattgtttca

SEQ ID NO: 343587 - DNA, 25 bp, Homo sapien
cattgtttcatgttacttgccacaa

SEQ ID NO: 343588 - DNA, 25 bp, Homo sapien
gttacttgccacaaataactttaat

SEQ ID NO: 343589 - DNA, 25 bp, Homo sapien
gtttgtttctcatattagctacttc

SEQ ID NO: 343590 - DNA, 25 bp, Homo sapien
tagctacttctctattaggagcaca

SEQ ID NO: 343591 - DNA, 25 bp, Homo sapien
ggagcacaagaaccatagttaaatg

SEQ ID NO: 343592 - DNA, 25 bp, Homo sapien
catagttaaatgcaacatgagctac

SEQ ID NO: 343593 - DNA, 25 bp, Homo sapien
tacttggagcaaatgtcactggcaa

SEQ ID NO: 343594 - DNA, 25 bp, Homo sapien
atgtcactggcaaaaatggcatata

SEQ ID NO: 343595 - DNA, 25 bp, Homo sapien
atggcatatatgctgggatgttcat

SEQ ID NO: 343596 - DNA, 25 bp, Homo sapien
gttaaatattgttggtcctttcgca

SEQ ID NO: 343597 - DNA, 25 bp, Homo sapien
tattgttggtcctttcgcatataga

SEQ ID NO: 343598 - DNA, 25 bp, Homo sapien
gtcctttcgcatatagaatctcggt

SEQ ID NO: 343599 - DNA, 25 bp, Homo sapien
atagtaaactgaaactctatttctg

SEQ ID NO: 343600 - DNA, 25 bp, Homo sapien
gaaagggaccattctacagcttagt

SEQ ID NO: 343601 - DNA, 25 bp, Homo sapien
tacagcttagtccagaacaccttga

SEQ ID NO: 343602 - DNA, 25 bp, Homo sapien
agtccagaacaccttgaacacacag

SEQ ID NO: 343603 - DNA, 25 bp, Homo sapien
gaatcttgactgtaatacttggagc

SEQ ID NO: 343604 - DNA, 25 bp, Homo sapien
tgcagcccctgtttcgtggcagaca

SEQ ID NO: 343605 - DNA, 25 bp, Homo sapien
gtttcgtggcagacagcaggtgcct

SEQ ID NO: 343606 - DNA, 25 bp, Homo sapien
ttgcagctggtgatggtcaagaact

SEQ ID NO: 343607 - DNA, 25 bp, Homo sapien
ggtgatggtcaagaactgactacaa

SEQ ID NO: 343608 - DNA, 25 bp, Homo sapien
tccttccatatctgttcctctgttc

SEQ ID NO: 343609 - DNA, 25 bp, Homo sapien
gtggctttttgggtccacccagcca

SEQ ID NO: 343610 - DNA, 25 bp, Homo sapien
ctttttgggtccacccagccaggat

SEQ ID NO: 343611 - DNA, 25 bp, Homo sapien
tgcaggccaagctgggtgtggtatt

SEQ ID NO: 343612 - DNA, 25 bp, Homo sapien
gtgtggtatttagggcagctcagca

SEQ ID NO: 343613 - DNA, 25 bp, Homo sapien
aacttgtccccatggtcagaggaga

SEQ ID NO: 343614 - DNA, 25 bp, Homo sapien
cccatggtcagaggagacccagctg

SEQ ID NO: 343615 - DNA, 25 bp, Homo sapien
tgctgtgtgagcattacaatcgcgt

SEQ ID NO: 343616 - DNA, 25 bp, Homo sapien
ctgtgtgagcattacaatcgcgtta

SEQ ID NO: 343617 - DNA, 25 bp, Homo sapien
gtgagcattacaatcgcgttaccat

SEQ ID NO: 343618 - DNA, 25 bp, Homo sapien
gagcattacaatcgcgttaccatat

SEQ ID NO: 343619 - DNA, 25 bp, Homo sapien
attacaatcgcgttaccatatcaag

SEQ ID NO: 343620 - DNA, 25 bp, Homo sapien
ttacaatcgcgttaccatatcaagc

SEQ ID NO: 343621 - DNA, 25 bp, Homo sapien
gaatatgttttttctctgaatctgc

SEQ ID NO: 343622 - DNA, 25 bp, Homo sapien
aatatgttttttctctgaatctgct

SEQ ID NO: 343623 - DNA, 25 bp, Homo sapien
gaatctgctatgaacacgtcagttg

SEQ ID NO: 343624 - DNA, 25 bp, Homo sapien
tctgctatgaacacgtcagttgggt

SEQ ID NO: 343625 - DNA, 25 bp, Homo sapien
tgaacacgtcagttgggtgggttca

SEQ ID NO: 343626 - DNA, 25 bp, Homo sapien
gcaaatggtttcttgtacagaggaa

SEQ ID NO: 343627 - DNA, 25 bp, Homo sapien
gcttctacaagtgtgccacatcaat

SEQ ID NO: 343628 - DNA, 25 bp, Homo sapien
aagtgtgccacatcaatccggtaat

SEQ ID NO: 343629 - DNA, 25 bp, Homo sapien
tcaatccggtaatgccccagtgtta

SEQ ID NO: 343630 - DNA, 25 bp, Homo sapien
tgccccagtgttattcacagacaga

SEQ ID NO: 343631 - DNA, 25 bp, Homo sapien
gtgattttaaaataccgcgtctgtt

SEQ ID NO: 343632 - DNA, 25 bp, Homo sapien
ttaaaataccgcgtctgttcctcca

SEQ ID NO: 343633 - DNA, 25 bp, Homo sapien
aataccgcgtctgttcctccatgga

SEQ ID NO: 343634 - DNA, 25 bp, Homo sapien
ctccatggaccagagtaattggcac

SEQ ID NO: 343635 - DNA, 25 bp, Homo sapien
ggaccagagtaattggcacatttta

SEQ ID NO: 343636 - DNA, 25 bp, Homo sapien
ggcacattttaatgcataagctggg

SEQ ID NO: 343637 - DNA, 25 bp, Homo sapien
aaacatctttctgtttccctgatag

SEQ ID NO: 343638 - DNA, 25 bp, Homo sapien
ctttctgtttccctgatagtcacat

SEQ ID NO: 343639 - DNA, 25 bp, Homo sapien
gtttccctgatagtcacataattca

SEQ ID NO: 343640 - DNA, 25 bp, Homo sapien
gggcccatagggacctgcacaaaat

SEQ ID NO: 343641 - DNA, 25 bp, Homo sapien
atgaggaatccaagttaccgtaaga

SEQ ID NO: 343642 - DNA, 25 bp, Homo sapien
taccgtaagatttgaacttgcttca

SEQ ID NO: 343643 - DNA, 25 bp, Homo sapien
gaacttgcttcatattaattaatag

SEQ ID NO: 343644 - DNA, 25 bp, Homo sapien
aatagttcaaatcactgacaacaca

SEQ ID NO: 343645 - DNA, 25 bp, Homo sapien
aaatacaacagccactaatccagga

SEQ ID NO: 343646 - DNA, 25 bp, Homo sapien
aacagccactaatccaggaacagaa

SEQ ID NO: 343647 - DNA, 25 bp, Homo sapien
gactgtggtgcagaaactgagacac

SEQ ID NO: 343648 - DNA, 25 bp, Homo sapien
gatcactaatgttttcagaaatgct

SEQ ID NO: 343649 - DNA, 25 bp, Homo sapien
cagaaatgctctgcaagtcatgtaa

SEQ ID NO: 343650 - DNA, 25 bp, Homo sapien
gctctgcaagtcatgtaaaggctaa

SEQ ID NO: 343651 - DNA, 25 bp, Homo sapien
agaagaagattccattgataggcat

SEQ ID NO: 343652 - DNA, 25 bp, Homo sapien
gataggcatggtttagctgtgaaaa

SEQ ID NO: 343653 - DNA, 25 bp, Homo sapien
aacaccgaaaacaagtcagtcagga

SEQ ID NO: 343654 - DNA, 25 bp, Homo sapien
aacatctaagtttgtagttacgctg

SEQ ID NO: 343655 - DNA, 25 bp, Homo sapien
tcttcatgaaaaggaactacttctg

SEQ ID NO: 343656 - DNA, 25 bp, Homo sapien
gaaaactagatttcatgacccaaga

SEQ ID NO: 343657 - DNA, 25 bp, Homo sapien
tgacccaagaagcaagatagcccta

SEQ ID NO: 343658 - DNA, 25 bp, Homo sapien
gatagccctagagatcactaatgtt

SEQ ID NO: 343659 - DNA, 25 bp, Homo sapien
taaacagttccatacctggattggg

SEQ ID NO: 343660 - DNA, 25 bp, Homo sapien
gttccatacctggattgggtgtttg

SEQ ID NO: 343661 - DNA, 25 bp, Homo sapien
gattgggtgtttgtaatggttacca

SEQ ID NO: 343662 - DNA, 25 bp, Homo sapien
ggtgacatgcttttatcactacttt

SEQ ID NO: 343663 - DNA, 25 bp, Homo sapien
atccattgggatttggtttggctaa

SEQ ID NO: 343664 - DNA, 25 bp, Homo sapien
gatttggtttggctaacctgttaat

SEQ ID NO: 343665 - DNA, 25 bp, Homo sapien
atatgggaccattatccttttaaca

SEQ ID NO: 343666 - DNA, 25 bp, Homo sapien
ggaccattatccttttaacaaggct

SEQ ID NO: 343667 - DNA, 25 bp, Homo sapien
taacaaggctagaatgtcatttttt

SEQ ID NO: 343668 - DNA, 25 bp, Homo sapien
ctgatatttggtggccgcacattct

SEQ ID NO: 343669 - DNA, 25 bp, Homo sapien
ggccgcacattctggatgcattatt

SEQ ID NO: 343670 - DNA, 25 bp, Homo sapien
ttgttttcatttctagcagccttac

SEQ ID NO: 343671 - DNA, 25 bp, Homo sapien
tttctagcagccttacattgtgtat

SEQ ID NO: 343672 - DNA, 25 bp, Homo sapien
tttctttctcattcccaaaattcta

SEQ ID NO: 343673 - DNA, 25 bp, Homo sapien
ttctaatctgcattactacccattc

SEQ ID NO: 343674 - DNA, 25 bp, Homo sapien
tactacccattcaatgccatttacc

SEQ ID NO: 343675 - DNA, 25 bp, Homo sapien
aatgttgaatgctcctttatctttg

SEQ ID NO: 343676 - DNA, 25 bp, Homo sapien
tgaatgctcctttatctttgttatc

SEQ ID NO: 343677 - DNA, 25 bp, Homo sapien
ctttgttatctggtttctaatcctt

SEQ ID NO: 343678 - DNA, 25 bp, Homo sapien
ggtttctaatccttatcacaactga

SEQ ID NO: 343679 - DNA, 25 bp, Homo sapien
atttctgttttaggtgttattactg

SEQ ID NO: 343680 - DNA, 25 bp, Homo sapien
tccctctgcattgtgtgagagagtt

SEQ ID NO: 343681 - DNA, 25 bp, Homo sapien
gatgatggacctacagctcttaaga

SEQ ID NO: 343682 - DNA, 25 bp, Homo sapien
tacagctcttaagaatttccgtgtg

SEQ ID NO: 343683 - DNA, 25 bp, Homo sapien
aaaaaatgatttctcatctatccaa

SEQ ID NO: 343684 - DNA, 25 bp, Homo sapien
tataataccaaaacagcaacagcag

SEQ ID NO: 343685 - DNA, 25 bp, Homo sapien
cagccaatgctgtcttaggtaccca

SEQ ID NO: 343686 - DNA, 25 bp, Homo sapien
tgctgtcttaggtacccaggaaggt

SEQ ID NO: 343687 - DNA, 25 bp, Homo sapien
gtacccaggaaggtgaactagtgaa

SEQ ID NO: 343688 - DNA, 25 bp, Homo sapien
ctagtgaaaatcatttgtactcagg

SEQ ID NO: 343689 - DNA, 25 bp, Homo sapien
aggctgaagtccagtggcgctattt

SEQ ID NO: 343690 - DNA, 25 bp, Homo sapien
cttttcttctcatatagcacttaag

SEQ ID NO: 343691 - DNA, 25 bp, Homo sapien
agcacttaagtccttggatgatgga

SEQ ID NO: 343692 - DNA, 25 bp, Homo sapien
gctaaagacaatggattatctctga

SEQ ID NO: 343693 - DNA, 25 bp, Homo sapien
gattatctctgagtttcagtcccta

SEQ ID NO: 343694 - DNA, 25 bp, Homo sapien
tatctctgagtttcagtccctacgt

SEQ ID NO: 343695 - DNA, 25 bp, Homo sapien
tttcagtccctacgtccagaagaga

SEQ ID NO: 343696 - DNA, 25 bp, Homo sapien
cagtccctacgtccagaagagaaaa

SEQ ID NO: 343697 - DNA, 25 bp, Homo sapien
tgccccagtggaaggtgttccctct

SEQ ID NO: 343698 - DNA, 25 bp, Homo sapien
gaaggtgttccctctttaaacgcag

SEQ ID NO: 343699 - DNA, 25 bp, Homo sapien
tctttaaacgcagccctgtgattca

SEQ ID NO: 343700 - DNA, 25 bp, Homo sapien
aaacgcagccctgtgattcacacat

SEQ ID NO: 343701 - DNA, 25 bp, Homo sapien
tgtgattcacacatcctcccaggtc

SEQ ID NO: 343702 - DNA, 25 bp, Homo sapien
tcctcccaggtctttcaatgctaaa

SEQ ID NO: 343703 - DNA, 25 bp, Homo sapien
ggcagttctgttcacgtccattgcc

SEQ ID NO: 343704 - DNA, 25 bp, Homo sapien
ttctgttcacgtccattgccggcaa

SEQ ID NO: 343705 - DNA, 25 bp, Homo sapien
attgccggcaatggatgtctttgtg

SEQ ID NO: 343706 - DNA, 25 bp, Homo sapien
atgtctttgtggtgatgatccttca

SEQ ID NO: 343707 - DNA, 25 bp, Homo sapien
ttgtggtgatgatccttcagaaaag

SEQ ID NO: 343708 - DNA, 25 bp, Homo sapien
tcagaaaaggatgcctctgtttaaa

SEQ ID NO: 343709 - DNA, 25 bp, Homo sapien
gaagttattaatacctgaagcttta

SEQ ID NO: 343710 - DNA, 25 bp, Homo sapien
gctttaagttaagtgcattgatcat

SEQ ID NO: 343711 - DNA, 25 bp, Homo sapien
tgtggaagtttaaagcctcttttag

SEQ ID NO: 343712 - DNA, 25 bp, Homo sapien
taaagcctcttttagtccattgaga

SEQ ID NO: 343713 - DNA, 25 bp, Homo sapien
gcctcttttagtccattgagaatgt

SEQ ID NO: 343714 - DNA, 25 bp, Homo sapien
aaagccaagaactctcccaggctaa

SEQ ID NO: 343715 - DNA, 25 bp, Homo sapien
aaaccccaattttgaggctcgcttg

SEQ ID NO: 343716 - DNA, 25 bp, Homo sapien
tcgcttgccctgcatcgatttcatt

SEQ ID NO: 343717 - DNA, 25 bp, Homo sapien
attcctaataacttgccccttgcaa

SEQ ID NO: 343718 - DNA, 25 bp, Homo sapien
ataacttgccccttgcaacacacag

SEQ ID NO: 343719 - DNA, 25 bp, Homo sapien
ttgcaacacacagagggccctgtgc

SEQ ID NO: 343720 - DNA, 25 bp, Homo sapien
agggccctgtgcagcatcaaaaggg

SEQ ID NO: 343721 - DNA, 25 bp, Homo sapien
gtgcagcatcaaaagggctaccttt

SEQ ID NO: 343722 - DNA, 25 bp, Homo sapien
aagggctacctttaattgaacatca

SEQ ID NO: 343723 - DNA, 25 bp, Homo sapien
tttaattgaacatcagccaagactg

SEQ ID NO: 343724 - DNA, 25 bp, Homo sapien
aagactggaaggtaaatcatctatt

SEQ ID NO: 343725 - DNA, 25 bp, Homo sapien
ccaggttccagtaaaattcttctga

SEQ ID NO: 343726 - DNA, 25 bp, Homo sapien
attcttctgaccgaaaccaatgtgg

SEQ ID NO: 343727 - DNA, 25 bp, Homo sapien
gaccgaaaccaatgtgggtgttaga

SEQ ID NO: 343728 - DNA, 25 bp, Homo sapien
taccataggctaaaactaaggcttt

SEQ ID NO: 343729 - DNA, 25 bp, Homo sapien
actaaggctttcactctagaatgca

SEQ ID NO: 343730 - DNA, 25 bp, Homo sapien
ttcactctagaatgcaaagctgttt

SEQ ID NO: 343731 - DNA, 25 bp, Homo sapien
aaagctgttttgcagctgttttccc

SEQ ID NO: 343732 - DNA, 25 bp, Homo sapien
ttgcagctgttttcccttaaagatg

SEQ ID NO: 343733 - DNA, 25 bp, Homo sapien
gctgttttcccttaaagatgtcctg

SEQ ID NO: 343734 - DNA, 25 bp, Homo sapien
agatgtcctgttgctttagtgatat

SEQ ID NO: 343735 - DNA, 25 bp, Homo sapien
tagtgatatttagacccctctcagt

SEQ ID NO: 343736 - DNA, 25 bp, Homo sapien
atcttgtcaagtggttctggttact

SEQ ID NO: 343737 - DNA, 25 bp, Homo sapien
ggttctggttacttacaatctcata

SEQ ID NO: 343738 - DNA, 25 bp, Homo sapien
aaatgtgcctgtgacactcaagggt

SEQ ID NO: 343739 - DNA, 25 bp, Homo sapien
ctgtgacactcaagggtactggtta

SEQ ID NO: 343740 - DNA, 25 bp, Homo sapien
gtactggttagttttacagtggtct

SEQ ID NO: 343741 - DNA, 25 bp, Homo sapien
acagtggtctttacctaccatctga

SEQ ID NO: 343742 - DNA, 25 bp, Homo sapien
gtctttacctaccatctgagattaa

SEQ ID NO: 343743 - DNA, 25 bp, Homo sapien
taagaattggtccaagctttctgtt

SEQ ID NO: 343744 - DNA, 25 bp, Homo sapien
ttccttacaaatgtacttgcctcat

SEQ ID NO: 343745 - DNA, 25 bp, Homo sapien
aaatgtacttgcctcatcttttccc

SEQ ID NO: 343746 - DNA, 25 bp, Homo sapien
ctcatcttttccctatcaatttcat

SEQ ID NO: 343747 - DNA, 25 bp, Homo sapien
gcatcatgacatcattgagctactg

SEQ ID NO: 343748 - DNA, 25 bp, Homo sapien
gagctactgaatcaaccttccctag

SEQ ID NO: 343749 - DNA, 25 bp, Homo sapien
aatcaaccttccctagaactggctt

SEQ ID NO: 343750 - DNA, 25 bp, Homo sapien
ctagaactggcttccaggactttgg

SEQ ID NO: 343751 - DNA, 25 bp, Homo sapien
actttgggtcatatgagtcatgtga

SEQ ID NO: 343752 - DNA, 25 bp, Homo sapien
aatattctcctctacctttttctga

SEQ ID NO: 343753 - DNA, 25 bp, Homo sapien
ttttctgagttaggcctcatgctgc

SEQ ID NO: 343754 - DNA, 25 bp, Homo sapien
gaaaacatcctgttacacctcggtt

SEQ ID NO: 343755 - DNA, 25 bp, Homo sapien
tgtggctctctaacccagtttgaaa

SEQ ID NO: 343756 - DNA, 25 bp, Homo sapien
gtttgaaacgttttgctctccatag

SEQ ID NO: 343757 - DNA, 25 bp, Homo sapien
gctctccatagaattgtgtaccagg

SEQ ID NO: 343758 - DNA, 25 bp, Homo sapien
gaatgtaaattctggtaattggtta

SEQ ID NO: 343759 - DNA, 25 bp, Homo sapien
gtaaattctggtaattggttacagg

SEQ ID NO: 343760 - DNA, 25 bp, Homo sapien
taaattctggtaattggttacagga

SEQ ID NO: 343761 - DNA, 25 bp, Homo sapien
attctggtaattggttacaggaaat

SEQ ID NO: 343762 - DNA, 25 bp, Homo sapien
tctggtaattggttacaggaaattg

SEQ ID NO: 343763 - DNA, 25 bp, Homo sapien
gtcaccaaagccaagccttcccaag

SEQ ID NO: 343764 - DNA, 25 bp, Homo sapien
tcaccaaagccaagccttcccaaga

SEQ ID NO: 343765 - DNA, 25 bp, Homo sapien
gccttcccaagacatcttgacctct

SEQ ID NO: 343766 - DNA, 25 bp, Homo sapien
cttcccaagacatcttgacctctgc

SEQ ID NO: 343767 - DNA, 25 bp, Homo sapien
ttcccaagacatcttgacctctgcc

SEQ ID NO: 343768 - DNA, 25 bp, Homo sapien
ccaagacatcttgacctctgcctgt

SEQ ID NO: 343769 - DNA, 25 bp, Homo sapien
taagagcagccgttactctttcaca

SEQ ID NO: 343770 - DNA, 25 bp, Homo sapien
gccgttactctttcacaccagaaat

SEQ ID NO: 343771 - DNA, 25 bp, Homo sapien
accagaaatgtgaagcaataccaag

SEQ ID NO: 343772 - DNA, 25 bp, Homo sapien
gaaatactgtgtgggtgaatcctat

SEQ ID NO: 343773 - DNA, 25 bp, Homo sapien
gtgtgggtgaatcctattttagaaa

SEQ ID NO: 343774 - DNA, 25 bp, Homo sapien
aactagatcccttttagattacaga

SEQ ID NO: 343775 - DNA, 25 bp, Homo sapien
ttcctttaatacacttaccttcgat

SEQ ID NO: 343776 - DNA, 25 bp, Homo sapien
atacacttaccttcgattcatactt

SEQ ID NO: 343777 - DNA, 25 bp, Homo sapien
gattcatactttacaagatgggtgt

SEQ ID NO: 343778 - DNA, 25 bp, Homo sapien
taaagttcagtatttacgttgcaaa

SEQ ID NO: 343779 - DNA, 25 bp, Homo sapien
caaacagttgtaagagcagccgtta

SEQ ID NO: 343780 - DNA, 25 bp, Homo sapien
gacattgtaagggttaattagatca

SEQ ID NO: 343781 - DNA, 25 bp, Homo sapien
aaagttgggcagtaatcttaattat

SEQ ID NO: 343782 - DNA, 25 bp, Homo sapien
tagtttgttttacaactagaacctg

SEQ ID NO: 343783 - DNA, 25 bp, Homo sapien
aatgttgaatatcttcctagcaaga

SEQ ID NO: 343784 - DNA, 25 bp, Homo sapien
cttcctagcaagaaacagtctgtca

SEQ ID NO: 343785 - DNA, 25 bp, Homo sapien
acagtctgtcattttacttacacga

SEQ ID NO: 343786 - DNA, 25 bp, Homo sapien
gtcattttacttacacgatgtctaa

SEQ ID NO: 343787 - DNA, 25 bp, Homo sapien
ttacacgatgtctaaccaaaccata

SEQ ID NO: 343788 - DNA, 25 bp, Homo sapien
gatgtctaaccaaaccataacttta

SEQ ID NO: 343789 - DNA, 25 bp, Homo sapien
tacataaactagtcgtttcggtcaa

SEQ ID NO: 343790 - DNA, 25 bp, Homo sapien
taaactagtcgtttcggtcaaatag

SEQ ID NO: 343791 - DNA, 25 bp, Homo sapien
tcaggactcatctgggcatgccagc

SEQ ID NO: 343792 - DNA, 25 bp, Homo sapien
gggtggcaatcggttccatctcgat

SEQ ID NO: 343793 - DNA, 25 bp, Homo sapien
ggttccatctcgattgattggtgat

SEQ ID NO: 343794 - DNA, 25 bp, Homo sapien
gattggtgatggctacccagagcac

SEQ ID NO: 343795 - DNA, 25 bp, Homo sapien
ccagagcaccgcattgagcgtctaa

SEQ ID NO: 343796 - DNA, 25 bp, Homo sapien
cattgagcgtctaaggccactgtgc

SEQ ID NO: 343797 - DNA, 25 bp, Homo sapien
gccactgtgctgtggttgattagca

SEQ ID NO: 343798 - DNA, 25 bp, Homo sapien
attagcaatgtctgccactggctcc

SEQ ID NO: 343799 - DNA, 25 bp, Homo sapien
gaatgccggtgatttgctgttcctg

SEQ ID NO: 343800 - DNA, 25 bp, Homo sapien
tgctcctcactttggccagtttgtc

SEQ ID NO: 343801 - DNA, 25 bp, Homo sapien
gtttgtctccagaaggagttcctca

SEQ ID NO: 343802 - DNA, 25 bp, Homo sapien
taacagtagcatttacagaaagttt

SEQ ID NO: 343803 - DNA, 25 bp, Homo sapien
aggtaagactcaatatatggataag

SEQ ID NO: 343804 - DNA, 25 bp, Homo sapien
aagttttgtgatgtgatctttatgt

SEQ ID NO: 343805 - DNA, 25 bp, Homo sapien
tggataagtctgtgtgcatgcgccc

SEQ ID NO: 343806 - DNA, 25 bp, Homo sapien
gataagtctgtgtgcatgcgccctt

SEQ ID NO: 343807 - DNA, 25 bp, Homo sapien
aagtctgtgtgcatgcgcccttaaa

SEQ ID NO: 343808 - DNA, 25 bp, Homo sapien
tgtgcatgcgcccttaaactatcac

SEQ ID NO: 343809 - DNA, 25 bp, Homo sapien
catgcgcccttaaactatcacagta

SEQ ID NO: 343810 - DNA, 25 bp, Homo sapien
gcgcccttaaactatcacagtagat

SEQ ID NO: 343811 - DNA, 25 bp, Homo sapien
gtagatttatagtttatcctgtaat

SEQ ID NO: 343812 - DNA, 25 bp, Homo sapien
atcctgtaataacagtagcatttac

SEQ ID NO: 343813 - DNA, 25 bp, Homo sapien
aaattgagcctgtatatttctcttc

SEQ ID NO: 343814 - DNA, 25 bp, Homo sapien
attgagcctgtatatttctcttccc

SEQ ID NO: 343815 - DNA, 25 bp, Homo sapien
ttccctgctggtatttgctaccaat

SEQ ID NO: 343816 - DNA, 25 bp, Homo sapien
ccctgctggtatttgctaccaataa

SEQ ID NO: 343817 - DNA, 25 bp, Homo sapien
tggtatttgctaccaataaattgct

SEQ ID NO: 343818 - DNA, 25 bp, Homo sapien
taaaaaacattgtccgaggccagcg

SEQ ID NO: 343819 - DNA, 25 bp, Homo sapien
aaaacattgtccgaggccagcggat

SEQ ID NO: 343820 - DNA, 25 bp, Homo sapien
aacattgtccgaggccagcggatca

SEQ ID NO: 343821 - DNA, 25 bp, Homo sapien
ttgtccgaggccagcggatcatgag

SEQ ID NO: 343822 - DNA, 25 bp, Homo sapien
acattgtatctgttcataattgtgt

SEQ ID NO: 343823 - DNA, 25 bp, Homo sapien
ttgtatctgttcataattgtgtatt

SEQ ID NO: 343824 - DNA, 25 bp, Homo sapien
gaatgtaggtcaggatccatctgat

SEQ ID NO: 343825 - DNA, 25 bp, Homo sapien
gatccatctgattgaccttgtgttc

SEQ ID NO: 343826 - DNA, 25 bp, Homo sapien
ttgaccttgtgttcagaagcgcgtc

SEQ ID NO: 343827 - DNA, 25 bp, Homo sapien
tctctatgacctctctatgcaatgg

SEQ ID NO: 343828 - DNA, 25 bp, Homo sapien
tttctaggccctccactggtgtctt

SEQ ID NO: 343829 - DNA, 25 bp, Homo sapien
tggtgtcttccctgctgcaaagaga

SEQ ID NO: 343830 - DNA, 25 bp, Homo sapien
tccctgctgcaaagagagggcttct

SEQ ID NO: 343831 - DNA, 25 bp, Homo sapien
gcttgaggcaagaggtcatgtgttt

SEQ ID NO: 343832 - DNA, 25 bp, Homo sapien
tcatgtgtttgagcctgagatgtca

SEQ ID NO: 343833 - DNA, 25 bp, Homo sapien
tatgcaatggtgtggcactgctttt

SEQ ID NO: 343834 - DNA, 25 bp, Homo sapien
gctgtacatggcagtgaccagttct

SEQ ID NO: 343835 - DNA, 25 bp, Homo sapien
tacatattgtaccttttgttggtgg

SEQ ID NO: 343836 - DNA, 25 bp, Homo sapien
tttgttggtggttaaatcgcatcag

SEQ ID NO: 343837 - DNA, 25 bp, Homo sapien
atcgcatcagatgcttggcattgct

SEQ ID NO: 343838 - DNA, 25 bp, Homo sapien
gatgcttggcattgctgccataatt

SEQ ID NO: 343839 - DNA, 25 bp, Homo sapien
gttttacttaagagtctaatctggg

SEQ ID NO: 343840 - DNA, 25 bp, Homo sapien
agagtctaatctgggaagttttcaa

SEQ ID NO: 343841 - DNA, 25 bp, Homo sapien
gggaagttttcaaatcatactatta

SEQ ID NO: 343842 - DNA, 25 bp, Homo sapien
ttaatgtgtaatctaagctcttcag

SEQ ID NO: 343843 - DNA, 25 bp, Homo sapien
ctaagctcttcagatgtatccatga

SEQ ID NO: 343844 - DNA, 25 bp, Homo sapien
gatgtatccatgaataatcctggaa

SEQ ID NO: 343845 - DNA, 25 bp, Homo sapien
atattgcttgtattcctgtcataga

SEQ ID NO: 343846 - DNA, 25 bp, Homo sapien
cccattgttcaaccctgtagcaaga

SEQ ID NO: 343847 - DNA, 25 bp, Homo sapien
aagcgatgccattctatatttacac

SEQ ID NO: 343848 - DNA, 25 bp, Homo sapien
acacagcgactctgtttttctggaa

SEQ ID NO: 343849 - DNA, 25 bp, Homo sapien
gtttttctggaactgatgacccaaa

SEQ ID NO: 343850 - DNA, 25 bp, Homo sapien
aagactccagactatatctccacag

SEQ ID NO: 343851 - DNA, 25 bp, Homo sapien
atgttcacgaggcttatttttctga

SEQ ID NO: 343852 - DNA, 25 bp, Homo sapien
tttctgaccaccatcactattttgt

SEQ ID NO: 343853 - DNA, 25 bp, Homo sapien
gtcttggcaatcttaaactgcttga

SEQ ID NO: 343854 - DNA, 25 bp, Homo sapien
gaccacttcagtatgatctaccaag

SEQ ID NO: 343855 - DNA, 25 bp, Homo sapien
ggagttttcctgtatatacatccca

SEQ ID NO: 343856 - DNA, 25 bp, Homo sapien
atcccatattttgatacgcccattg

SEQ ID NO: 343857 - DNA, 25 bp, Homo sapien
aagtggacatttagcttttgaaaat

SEQ ID NO: 343858 - DNA, 25 bp, Homo sapien
gaaaatgatccttcataacaactga

SEQ ID NO: 343859 - DNA, 25 bp, Homo sapien
tgtatacagtattgtgattcaccaa

SEQ ID NO: 343860 - DNA, 25 bp, Homo sapien
gattcaccaaaccatatataggaca

SEQ ID NO: 343861 - DNA, 25 bp, Homo sapien
atataggacaatgcttactcttctg

SEQ ID NO: 343862 - DNA, 25 bp, Homo sapien
gcttactcttctgcaaagggttcat

SEQ ID NO: 343863 - DNA, 25 bp, Homo sapien
gcaaagggttcattctagagtccta

SEQ ID NO: 343864 - DNA, 25 bp, Homo sapien
tagagtcctagttttggtggcccta

SEQ ID NO: 343865 - DNA, 25 bp, Homo sapien
tggccctactctttgatgggaggtc

SEQ ID NO: 343866 - DNA, 25 bp, Homo sapien
gggaggctggtaaaatgcacaaatt

SEQ ID NO: 343867 - DNA, 25 bp, Homo sapien
aatgcacaaattagaaggccttgaa

SEQ ID NO: 343868 - DNA, 25 bp, Homo sapien
gatgaacctgaaactgttccagcct

SEQ ID NO: 343869 - DNA, 25 bp, Homo sapien
gaaactgttccagcctgtgctgaaa

SEQ ID NO: 343870 - DNA, 25 bp, Homo sapien
tgtgctgaaatactcccacaccatg

SEQ ID NO: 343871 - DNA, 25 bp, Homo sapien
tactcccacaccatgttgttggaat

SEQ ID NO: 343872 - DNA, 25 bp, Homo sapien
tgttggaatagatgtaagcactctt

SEQ ID NO: 343873 - DNA, 25 bp, Homo sapien
atccatgccagaaagttcttcccat

SEQ ID NO: 343874 - DNA, 25 bp, Homo sapien
gaagtttttgccatcagattaagag

SEQ ID NO: 343875 - DNA, 25 bp, Homo sapien
ggaggaaattcccatctgttcagag

SEQ ID NO: 343876 - DNA, 25 bp, Homo sapien
gagttgagactttagctttactttt

SEQ ID NO: 343877 - DNA, 25 bp, Homo sapien
gctttacttttctatgagtctttat

SEQ ID NO: 343878 - DNA, 25 bp, Homo sapien
tatcaaaggtattctcaggaggtaa

SEQ ID NO: 343879 - DNA, 25 bp, Homo sapien
tgcactgggtggttttcctgagcct

SEQ ID NO: 343880 - DNA, 25 bp, Homo sapien
gcatgaatcccaggtatctgccgat

SEQ ID NO: 343881 - DNA, 25 bp, Homo sapien
gtatctgccgatctgtatgtaacaa

SEQ ID NO: 343882 - DNA, 25 bp, Homo sapien
cgtcccatgcatccctgaagcataa

SEQ ID NO: 343883 - DNA, 25 bp, Homo sapien
catgtaacttactgtgtgtccgtga

SEQ ID NO: 343884 - DNA, 25 bp, Homo sapien
actgtgtgtccgtgagattatctct

SEQ ID NO: 343885 - DNA, 25 bp, Homo sapien
gagattatctctcactcaactcaga

SEQ ID NO: 343886 - DNA, 25 bp, Homo sapien
ttggcaaccagtgtgcagtgaacct

SEQ ID NO: 343887 - DNA, 25 bp, Homo sapien
tgaacctgcttcacaagcaaggatg

SEQ ID NO: 343888 - DNA, 25 bp, Homo sapien
gaagcataaacccaggatggccgcc

SEQ ID NO: 343889 - DNA, 25 bp, Homo sapien
aacctcccacagctgtgatgcaagt

SEQ ID NO: 343890 - DNA, 25 bp, Homo sapien
ttctcaaatgcagattgttctttaa

SEQ ID NO: 343891 - DNA, 25 bp, Homo sapien
taaattcacttaacttggattgccc

SEQ ID NO: 343892 - DNA, 25 bp, Homo sapien
ccccaagtcagaacagtcattcgct

SEQ ID NO: 343893 - DNA, 25 bp, Homo sapien
acagtcattcgctaagtctttcaga

SEQ ID NO: 343894 - DNA, 25 bp, Homo sapien
gtcattcgctaagtctttcagattg

SEQ ID NO: 343895 - DNA, 25 bp, Homo sapien
gatgaatgattggtcccagtaccaa

SEQ ID NO: 343896 - DNA, 25 bp, Homo sapien
gattggtcccagtaccaaaaatgtc

SEQ ID NO: 343897 - DNA, 25 bp, Homo sapien
taattgtttgtatttgatagcttga

SEQ ID NO: 343898 - DNA, 25 bp, Homo sapien
tgagcccaggctctatattgtctta

SEQ ID NO: 343899 - DNA, 25 bp, Homo sapien
gcccaggctctatattgtcttacaa

SEQ ID NO: 343900 - DNA, 25 bp, Homo sapien
caggctctatattgtcttacaagaa

SEQ ID NO: 343901 - DNA, 25 bp, Homo sapien
gggtttgtttttccttgcacgacat

SEQ ID NO: 343902 - DNA, 25 bp, Homo sapien
acatggttcgtttgcacagtggttc

SEQ ID NO: 343903 - DNA, 25 bp, Homo sapien
agtggttccagcaagggccaggctc

SEQ ID NO: 343904 - DNA, 25 bp, Homo sapien
ggtcatcctatccataataattcct

SEQ ID NO: 343905 - DNA, 25 bp, Homo sapien
ttctaagcagcaagtggttctcacg

SEQ ID NO: 343906 - DNA, 25 bp, Homo sapien
tggttctcacggttactgaatggct

SEQ ID NO: 343907 - DNA, 25 bp, Homo sapien
ttactgaatggctgtcaaggcttga

SEQ ID NO: 343908 - DNA, 25 bp, Homo sapien
caaggcttgaagtcattgtgtccat

SEQ ID NO: 343909 - DNA, 25 bp, Homo sapien
ttgtgtccattgcatttgagtcagg

SEQ ID NO: 343910 - DNA, 25 bp, Homo sapien
gatactgttgtgttcctattgttgt

SEQ ID NO: 343911 - DNA, 25 bp, Homo sapien
gataggaacattttcacctgcaagt

SEQ ID NO: 343912 - DNA, 25 bp, Homo sapien
cctgccacgtcatgcagttgtcttg

SEQ ID NO: 343913 - DNA, 25 bp, Homo sapien
aacatcccaagttgcaccattctaa

SEQ ID NO: 343914 - DNA, 25 bp, Homo sapien
tcccaagttgcaccattctaagaaa

SEQ ID NO: 343915 - DNA, 25 bp, Homo sapien
gttaattcaacattatggcttaaga

SEQ ID NO: 343916 - DNA, 25 bp, Homo sapien
gaattatatttcctggacctcacgt

SEQ ID NO: 343917 - DNA, 25 bp, Homo sapien
tcctggacctcacgtgtacttaaaa

SEQ ID NO: 343918 - DNA, 25 bp, Homo sapien
ggacctcacgtgtacttaaaagttg

SEQ ID NO: 343919 - DNA, 25 bp, Homo sapien
gaatcgatcaaattttattgcttcc

SEQ ID NO: 343920 - DNA, 25 bp, Homo sapien
tattgcttccttttcccttagagca

SEQ ID NO: 343921 - DNA, 25 bp, Homo sapien
ttttcccttagagcagcacgttgag

SEQ ID NO: 343922 - DNA, 25 bp, Homo sapien
gcagcacgttgagagtgatggtttt

SEQ ID NO: 343923 - DNA, 25 bp, Homo sapien
aaaaatcaagcccagatcctgcaag

SEQ ID NO: 343924 - DNA, 25 bp, Homo sapien
tcaagcccagatcctgcaagacatt

SEQ ID NO: 343925 - DNA, 25 bp, Homo sapien
gatcctgcaagacattatggctccc

SEQ ID NO: 343926 - DNA, 25 bp, Homo sapien
tgcaagacattatggctccccacca

SEQ ID NO: 343927 - DNA, 25 bp, Homo sapien
gacattatggctccccaccagaagg

SEQ ID NO: 343928 - DNA, 25 bp, Homo sapien
agcccagcagatgttaggtcagaat

SEQ ID NO: 343929 - DNA, 25 bp, Homo sapien
atgttaggtcagaatgcgtcccctc

SEQ ID NO: 343930 - DNA, 25 bp, Homo sapien
ttaggtcagaatgcgtcccctcact

SEQ ID NO: 343931 - DNA, 25 bp, Homo sapien
agaatgcgtcccctcacttgactaa

SEQ ID NO: 343932 - DNA, 25 bp, Homo sapien
gcgtcccctcacttgactaaaggtt

SEQ ID NO: 343933 - DNA, 25 bp, Homo sapien
gactaaaggtttacagccagcaggg

SEQ ID NO: 343934 - DNA, 25 bp, Homo sapien
ggacgcccggactcggagacacgat

SEQ ID NO: 343935 - DNA, 25 bp, Homo sapien
ggactcggagacacgatccgctgaa

SEQ ID NO: 343936 - DNA, 25 bp, Homo sapien
cgatccgctgaacgcccgcaataag

SEQ ID NO: 343937 - DNA, 25 bp, Homo sapien
gctgaacgcccgcaataagaaagaa

SEQ ID NO: 343938 - DNA, 25 bp, Homo sapien
acctcaacgaggtccggaatgggag

SEQ ID NO: 343939 - DNA, 25 bp, Homo sapien
gcgcgctgacgtctcgccggcttaa

SEQ ID NO: 343940 - DNA, 25 bp, Homo sapien
gggtgcggttctcgtccaagttcta

SEQ ID NO: 343941 - DNA, 25 bp, Homo sapien
aagttctaccccatttgctttgtgg

SEQ ID NO: 343942 - DNA, 25 bp, Homo sapien
ctaccccatttgctttgtggctgca

SEQ ID NO: 343943 - DNA, 25 bp, Homo sapien
ggcttaacctgttgctctcgagact

SEQ ID NO: 343944 - DNA, 25 bp, Homo sapien
tgttgctctcgagactgcgtcggag

SEQ ID NO: 343945 - DNA, 25 bp, Homo sapien
atatgcctcagtcagtcattcagtg

SEQ ID NO: 343946 - DNA, 25 bp, Homo sapien
cagtcattcagtgattgatccaaaa

SEQ ID NO: 343947 - DNA, 25 bp, Homo sapien
tgagtgcctacctactctgcgccag

SEQ ID NO: 343948 - DNA, 25 bp, Homo sapien
agaatgtttacagccagtgccagca

SEQ ID NO: 343949 - DNA, 25 bp, Homo sapien
agtgccagcacaaggtagtaatcta

SEQ ID NO: 343950 - DNA, 25 bp, Homo sapien
atctagtgacagagaacagggtgtt

SEQ ID NO: 343951 - DNA, 25 bp, Homo sapien
gagcatatgagaggccatctatccc

SEQ ID NO: 343952 - DNA, 25 bp, Homo sapien
tcccaagccttttataaaactgcag

SEQ ID NO: 343953 - DNA, 25 bp, Homo sapien
ttataaaactgcaggaacactgtgg

SEQ ID NO: 343954 - DNA, 25 bp, Homo sapien
aacactgtggagatggttcctatct

SEQ ID NO: 343955 - DNA, 25 bp, Homo sapien
gggacatatgcctcagtcagtcatt

SEQ ID NO: 343956 - DNA, 25 bp, Homo sapien
gaatataccagatccccaaaatgga

SEQ ID NO: 343957 - DNA, 25 bp, Homo sapien
tcaggcacttggctgcgtaaccatg

SEQ ID NO: 343958 - DNA, 25 bp, Homo sapien
gctgcgtaaccatgctttctggatt

SEQ ID NO: 343959 - DNA, 25 bp, Homo sapien
gttgaaagtgccatcctgtgtgctc

SEQ ID NO: 343960 - DNA, 25 bp, Homo sapien
ctgtgtgctctctccggatggctgt

SEQ ID NO: 343961 - DNA, 25 bp, Homo sapien
tctccggatggctgtcacgtacttg

SEQ ID NO: 343962 - DNA, 25 bp, Homo sapien
tcacgtacttgcgtctgagaacagt

SEQ ID NO: 343963 - DNA, 25 bp, Homo sapien
gagaacagtgtatggacctgcatga

SEQ ID NO: 343964 - DNA, 25 bp, Homo sapien
gacctgcatgagcactaatcagtct

SEQ ID NO: 343965 - DNA, 25 bp, Homo sapien
aagtcttaaccatttgtcccttctg

SEQ ID NO: 343966 - DNA, 25 bp, Homo sapien
gtaccctctttcattgaaatccatg

SEQ ID NO: 343967 - DNA, 25 bp, Homo sapien
agagcaaagcatcctgactccagga

SEQ ID NO: 343968 - DNA, 25 bp, Homo sapien
gaaagaagcgtcaccttcagcatcc

SEQ ID NO: 343969 - DNA, 25 bp, Homo sapien
tagatctcgccctgtaagtttctcc

SEQ ID NO: 343970 - DNA, 25 bp, Homo sapien
gctttgagccatgtggtatcaactc

SEQ ID NO: 343971 - DNA, 25 bp, Homo sapien
aagtttctccttttggctgattctg

SEQ ID NO: 343972 - DNA, 25 bp, Homo sapien
gattctgatttacatcctttggcta

SEQ ID NO: 343973 - DNA, 25 bp, Homo sapien
tttggctataataacactgtcatcg

SEQ ID NO: 343974 - DNA, 25 bp, Homo sapien
tgtcatcgtaagtacagctgctccc

SEQ ID NO: 343975 - DNA, 25 bp, Homo sapien
gtggtatcaactcaacctctgggaa

SEQ ID NO: 343976 - DNA, 25 bp, Homo sapien
gaaccatgggcaatcattcaattga

SEQ ID NO: 343977 - DNA, 25 bp, Homo sapien
attgatcacgagagcaaagcatcct

SEQ ID NO: 343978 - DNA, 25 bp, Homo sapien
caactttgcctatgtgccactgtat

SEQ ID NO: 343979 - DNA, 25 bp, Homo sapien
cctatgtgccactgtatataagaaa

SEQ ID NO: 343980 - DNA, 25 bp, Homo sapien
tttgggaacagttcacagtaaacct

SEQ ID NO: 343981 - DNA, 25 bp, Homo sapien
gtttgcaaactgaggtacctgcaga

SEQ ID NO: 343982 - DNA, 25 bp, Homo sapien
aggtacctgcagaaaccatagctac

SEQ ID NO: 343983 - DNA, 25 bp, Homo sapien
tagctactcaccaaaatacacagat

SEQ ID NO: 343984 - DNA, 25 bp, Homo sapien
acacagattaggtgcatggtatcgt

SEQ ID NO: 343985 - DNA, 25 bp, Homo sapien
gtgcatggtatcgtggaaattattt

SEQ ID NO: 343986 - DNA, 25 bp, Homo sapien
aggaatatctacaggtgcagctttg

SEQ ID NO: 343987 - DNA, 25 bp, Homo sapien
acaggtgcagctttgattttgaaca

SEQ ID NO: 343988 - DNA, 25 bp, Homo sapien
gcagctttgattttgaacagaattc

SEQ ID NO: 343989 - DNA, 25 bp, Homo sapien
tgacccctagtaactacctttctag

SEQ ID NO: 343990 - DNA, 25 bp, Homo sapien
tctgcttctgtgaggttattccaaa

SEQ ID NO: 343991 - DNA, 25 bp, Homo sapien
tatagtcaccgtactctgcattggg

SEQ ID NO: 343992 - DNA, 25 bp, Homo sapien
tatacagaatagtcactggtcttgg

SEQ ID NO: 343993 - DNA, 25 bp, Homo sapien
tgggctaaatggtgacttcaagtgt

SEQ ID NO: 343994 - DNA, 25 bp, Homo sapien
cttcaagtgtagtggctgcatagtc

SEQ ID NO: 343995 - DNA, 25 bp, Homo sapien
gtactctgcattgggttaccagaac

SEQ ID NO: 343996 - DNA, 25 bp, Homo sapien
cagaacttactcctaactgcatctt

SEQ ID NO: 343997 - DNA, 25 bp, Homo sapien
gcatcttactcctaagtttgcatcc

SEQ ID NO: 343998 - DNA, 25 bp, Homo sapien
aagtttgcatcctctcactaagatc

SEQ ID NO: 343999 - DNA, 25 bp, Homo sapien
actaagatctccagattcctctcac

SEQ ID NO: 344000 - DNA, 25 bp, Homo sapien
tatctctggcttttgatggactgtc

SEQ ID NO: 344001 - DNA, 25 bp, Homo sapien
tctggcttttgatggactgtccttg

SEQ ID NO: 344002 - DNA, 25 bp, Homo sapien
ttttgatggactgtccttgcagtta

SEQ ID NO: 344003 - DNA, 25 bp, Homo sapien
cttgcagttaggatgtgtaggaaat

SEQ ID NO: 344004 - DNA, 25 bp, Homo sapien
ggaaatcctcagttctgtttcttta

SEQ ID NO: 344005 - DNA, 25 bp, Homo sapien
aaatcctcagttctgtttctttagt

SEQ ID NO: 344006 - DNA, 25 bp, Homo sapien
ttctttagtcccaagcatgctcatg

SEQ ID NO: 344007 - DNA, 25 bp, Homo sapien
agtcccaagcatgctcatgttttct

SEQ ID NO: 344008 - DNA, 25 bp, Homo sapien
aagcatgctcatgttttcttagctt

SEQ ID NO: 344009 - DNA, 25 bp, Homo sapien
ttagcttttggcatgattgattcag

SEQ ID NO: 344010 - DNA, 25 bp, Homo sapien
gattgattcagcatgagagaggcaa

SEQ ID NO: 344011 - DNA, 25 bp, Homo sapien
tgtctgcaaagggacgttggagaac

SEQ ID NO: 344012 - DNA, 25 bp, Homo sapien
gtctgcaaagggacgttggagaact

SEQ ID NO: 344013 - DNA, 25 bp, Homo sapien
gattttttttcaatacgatactgag

SEQ ID NO: 344014 - DNA, 25 bp, Homo sapien
attttttttcaatacgatactgagc

SEQ ID NO: 344015 - DNA, 25 bp, Homo sapien
ttttttttcaatacgatactgagcc

SEQ ID NO: 344016 - DNA, 25 bp, Homo sapien
ttttttcaatacgatactgagccat

SEQ ID NO: 344017 - DNA, 25 bp, Homo sapien
tttttcaatacgatactgagccatt

SEQ ID NO: 344018 - DNA, 25 bp, Homo sapien
ttttcaatacgatactgagccattt

SEQ ID NO: 344019 - DNA, 25 bp, Homo sapien
tttcaatacgatactgagccatttg

SEQ ID NO: 344020 - DNA, 25 bp, Homo sapien
ttcaatacgatactgagccatttgc

SEQ ID NO: 344021 - DNA, 25 bp, Homo sapien
tcaatacgatactgagccatttgct

SEQ ID NO: 344022 - DNA, 25 bp, Homo sapien
agaagcagtctgtggcttcagtctt

SEQ ID NO: 344023 - DNA, 25 bp, Homo sapien
agcagtctgtggcttcagtcttatc

SEQ ID NO: 344024 - DNA, 25 bp, Homo sapien
caaggagtaaggatacttccctggt

SEQ ID NO: 344025 - DNA, 25 bp, Homo sapien
gtaaggatacttccctggtcccagg

SEQ ID NO: 344026 - DNA, 25 bp, Homo sapien
tggtcccaggctgcatgacgttgga

SEQ ID NO: 344027 - DNA, 25 bp, Homo sapien
ctgcatgacgttggagggagattat

SEQ ID NO: 344028 - DNA, 25 bp, Homo sapien
cgttggagggagattatttgttcat

SEQ ID NO: 344029 - DNA, 25 bp, Homo sapien
aatctggccagtaatgcagtggaga

SEQ ID NO: 344030 - DNA, 25 bp, Homo sapien
tctgttctgtctccccagctagaga

SEQ ID NO: 344031 - DNA, 25 bp, Homo sapien
tgtctccccagctagagagcaccat

SEQ ID NO: 344032 - DNA, 25 bp, Homo sapien
gctagagagcaccatccctttaggg

SEQ ID NO: 344033 - DNA, 25 bp, Homo sapien
gggtcatcgaatctgcatgcatccc

SEQ ID NO: 344034 - DNA, 25 bp, Homo sapien
catgcatccctcatacatctggaga

SEQ ID NO: 344035 - DNA, 25 bp, Homo sapien
ctcatacatctggagacttcgtgaa

SEQ ID NO: 344036 - DNA, 25 bp, Homo sapien
acttcgtgaaggttccagagttact

SEQ ID NO: 344037 - DNA, 25 bp, Homo sapien
gaaggttccagagttactgactgag

SEQ ID NO: 344038 - DNA, 25 bp, Homo sapien
actgactgagatttctgagcttttt

SEQ ID NO: 344039 - DNA, 25 bp, Homo sapien
cttttctgtttggtttcagagtgga

SEQ ID NO: 344040 - DNA, 25 bp, Homo sapien
cagagtggagagcagcccaaaaata

SEQ ID NO: 344041 - DNA, 25 bp, Homo sapien
gagagcagcccaaaaatatgcaggt

SEQ ID NO: 344042 - DNA, 25 bp, Homo sapien
atatgcaggtaactgaagccaggaa

SEQ ID NO: 344043 - DNA, 25 bp, Homo sapien
aagccaggaaactgatttgtgtttt

SEQ ID NO: 344044 - DNA, 25 bp, Homo sapien
acggcgaggcgcgtcccttagcaga

SEQ ID NO: 344045 - DNA, 25 bp, Homo sapien
tgtctctgcggcagcctatcgacgc

SEQ ID NO: 344046 - DNA, 25 bp, Homo sapien
acagcgggcgtttcctcaagccacg

SEQ ID NO: 344047 - DNA, 25 bp, Homo sapien
acgcctgcgcaggtcgtcggtaagt

SEQ ID NO: 344048 - DNA, 25 bp, Homo sapien
taagtggcccgggttagcttcctca

SEQ ID NO: 344049 - DNA, 25 bp, Homo sapien
ggttagcttcctcataaggcatcgt

SEQ ID NO: 344050 - DNA, 25 bp, Homo sapien
cataaggcatcgtttccgtgggtgg

SEQ ID NO: 344051 - DNA, 25 bp, Homo sapien
cacgcgacgcgaagctcgaaacagc

SEQ ID NO: 344052 - DNA, 25 bp, Homo sapien
gcgaagctcgaaacagcgttccttc

SEQ ID NO: 344053 - DNA, 25 bp, Homo sapien
agcgttccttccctcttgtagaggc

SEQ ID NO: 344054 - DNA, 25 bp, Homo sapien
ccctcttgtagaggctcaggcgcag

SEQ ID NO: 344055 - DNA, 25 bp, Homo sapien
taaacagctgtaatgttcagaggct

SEQ ID NO: 344056 - DNA, 25 bp, Homo sapien
cagctgtaatgttcagaggcttgca

SEQ ID NO: 344057 - DNA, 25 bp, Homo sapien
ctgtaatgttcagaggcttgcagga

SEQ ID NO: 344058 - DNA, 25 bp, Homo sapien
agagcatacttcagattgtactcca

SEQ ID NO: 344059 - DNA, 25 bp, Homo sapien
gcatacttcagattgtactccattt

SEQ ID NO: 344060 - DNA, 25 bp, Homo sapien
cttcagattgtactccatttacctt

SEQ ID NO: 344061 - DNA, 25 bp, Homo sapien
cagattgtactccatttaccttaac

SEQ ID NO: 344062 - DNA, 25 bp, Homo sapien
ttatgtgcaatgtgttacacccttt

SEQ ID NO: 344063 - DNA, 25 bp, Homo sapien
gtgcaatgtgttacaccctttcaaa

SEQ ID NO: 344064 - DNA, 25 bp, Homo sapien
caatgtgttacaccctttcaaatgt

SEQ ID NO: 344065 - DNA, 25 bp, Homo sapien
gtgttacaccctttcaaatgtaata

SEQ ID NO: 344066 - DNA, 25 bp, Homo sapien
aaaatcaagggcatgagactcattc

SEQ ID NO: 344067 - DNA, 25 bp, Homo sapien
gcatgagactcattcgtctctgggt

SEQ ID NO: 344068 - DNA, 25 bp, Homo sapien
gactcattcgtctctgggtatgaaa

SEQ ID NO: 344069 - DNA, 25 bp, Homo sapien
tcgtctctgggtatgaaaaaggatt

SEQ ID NO: 344070 - DNA, 25 bp, Homo sapien
aaaagttgagatcaggtgcggtcat

SEQ ID NO: 344071 - DNA, 25 bp, Homo sapien
gtaacaataagtacattctgtattc

SEQ ID NO: 344072 - DNA, 25 bp, Homo sapien
gtgtgtccattgaaatagtgccctt

SEQ ID NO: 344073 - DNA, 25 bp, Homo sapien
gaaatagtgccctttcatctcccca

SEQ ID NO: 344074 - DNA, 25 bp, Homo sapien
agatcaggtgcggtcatggtggtat

SEQ ID NO: 344075 - DNA, 25 bp, Homo sapien
ggctgtcgacattaaccaaaacaga

SEQ ID NO: 344076 - DNA, 25 bp, Homo sapien
gaaacagcaattaatatacttcaaa

SEQ ID NO: 344077 - DNA, 25 bp, Homo sapien
gtgctactcctccatgaattgatta

SEQ ID NO: 344078 - DNA, 25 bp, Homo sapien
acctatgacctcattcacagtaagt

SEQ ID NO: 344079 - DNA, 25 bp, Homo sapien
gagtaaaaggcacctactcctgttc

SEQ ID NO: 344080 - DNA, 25 bp, Homo sapien
ctgttccctgatgtagcccagtaga

SEQ ID NO: 344081 - DNA, 25 bp, Homo sapien
tgatgtagcccagtagagcctgcac

SEQ ID NO: 344082 - DNA, 25 bp, Homo sapien
tagagcctgcaccaatacggctgtg

SEQ ID NO: 344083 - DNA, 25 bp, Homo sapien
accaatacggctgtggcctgaccag

SEQ ID NO: 344084 - DNA, 25 bp, Homo sapien
gtggcctgaccagtcactatatgat

SEQ ID NO: 344085 - DNA, 25 bp, Homo sapien
gtgagctggttttaagccagcaact

SEQ ID NO: 344086 - DNA, 25 bp, Homo sapien
agccagcaactctgattttcacttg

SEQ ID NO: 344087 - DNA, 25 bp, Homo sapien
ctgattttcacttgtgctactcctc

SEQ ID NO: 344088 - DNA, 25 bp, Homo sapien
agcctgccaaacatttcccattcag

SEQ ID NO: 344089 - DNA, 25 bp, Homo sapien
caggatgcctttgggatctcagtaa

SEQ ID NO: 344090 - DNA, 25 bp, Homo sapien
tcagtaatgctttgcagtgccccta

SEQ ID NO: 344091 - DNA, 25 bp, Homo sapien
ttgcagtgcccctaaactaaaagaa

SEQ ID NO: 344092 - DNA, 25 bp, Homo sapien
gtccaaacaactcaacacctggtat

SEQ ID NO: 344093 - DNA, 25 bp, Homo sapien
caacacctggtatctgacagatgcc

SEQ ID NO: 344094 - DNA, 25 bp, Homo sapien
tctttggcagttctgtgagcttgct

SEQ ID NO: 344095 - DNA, 25 bp, Homo sapien
gtgtagaagagatgtccgtgcacag

SEQ ID NO: 344096 - DNA, 25 bp, Homo sapien
gcacaggtgtgcttccgcgtggcca

SEQ ID NO: 344097 - DNA, 25 bp, Homo sapien
cgcgtggccatccaattgtggacat

SEQ ID NO: 344098 - DNA, 25 bp, Homo sapien
tggtgatggtgcactgagccccaga

SEQ ID NO: 344099 - DNA, 25 bp, Homo sapien
gccttctatcatgattgtgagttct

SEQ ID NO: 344100 - DNA, 25 bp, Homo sapien
ttctatcatgattgtgagttctccc

SEQ ID NO: 344101 - DNA, 25 bp, Homo sapien
tctatcatgattgtgagttctcccc

SEQ ID NO: 344102 - DNA, 25 bp, Homo sapien
ttttttctatattttggccagattg

SEQ ID NO: 344103 - DNA, 25 bp, Homo sapien
tttctatattttggccagattgtat

SEQ ID NO: 344104 - DNA, 25 bp, Homo sapien
atattttggccagattgtatagttt

SEQ ID NO: 344105 - DNA, 25 bp, Homo sapien
attttggccagattgtatagttttt

SEQ ID NO: 344106 - DNA, 25 bp, Homo sapien
tttggccagattgtatagtttttta

SEQ ID NO: 344107 - DNA, 25 bp, Homo sapien
tggccagattgtatagttttttatg

SEQ ID NO: 344108 - DNA, 25 bp, Homo sapien
cagattgtatagttttttatggtgg

SEQ ID NO: 344109 - DNA, 25 bp, Homo sapien
atggtgggagggtgaatctgacaca

SEQ ID NO: 344110 - DNA, 25 bp, Homo sapien
catttgtccctgtgtcttctcctat

SEQ ID NO: 344111 - DNA, 25 bp, Homo sapien
tgtgtcttctcctatctcactggcc

SEQ ID NO: 344112 - DNA, 25 bp, Homo sapien
tatctccacagcctagtccatggag

SEQ ID NO: 344113 - DNA, 25 bp, Homo sapien
cagcctagtccatggagttgcttta

SEQ ID NO: 344114 - DNA, 25 bp, Homo sapien
atgtagcaaattctccgtttggagc

SEQ ID NO: 344115 - DNA, 25 bp, Homo sapien
tctccgtttggagcttttaaaatag

SEQ ID NO: 344116 - DNA, 25 bp, Homo sapien
ggattatttgccagaactgcattta

SEQ ID NO: 344117 - DNA, 25 bp, Homo sapien
aattcactggcagctagggtgccta

SEQ ID NO: 344118 - DNA, 25 bp, Homo sapien
gtgtgctaggcataaagctgcttct

SEQ ID NO: 344119 - DNA, 25 bp, Homo sapien
agctgcttctgaacccactaaaagt

SEQ ID NO: 344120 - DNA, 25 bp, Homo sapien
gaacccactaaaagttcatcccaga

SEQ ID NO: 344121 - DNA, 25 bp, Homo sapien
catggcttttatccccaaagtcttc

SEQ ID NO: 344122 - DNA, 25 bp, Homo sapien
aaagtcttcctcatcagacaggtaa

SEQ ID NO: 344123 - DNA, 25 bp, Homo sapien
ctcatcagacaggtaatatcataag

SEQ ID NO: 344124 - DNA, 25 bp, Homo sapien
taggaaattcttcacacacacagac

SEQ ID NO: 344125 - DNA, 25 bp, Homo sapien
acacacccaaagtctcattaaatat

SEQ ID NO: 344126 - DNA, 25 bp, Homo sapien
ttttatatcagagcttgttacaagg

SEQ ID NO: 344127 - DNA, 25 bp, Homo sapien
tcacataggacaaatctcggacagc

SEQ ID NO: 344128 - DNA, 25 bp, Homo sapien
gacaaatctcggacagcatcctgaa

SEQ ID NO: 344129 - DNA, 25 bp, Homo sapien
tcggacagcatcctgaatgaccatg

SEQ ID NO: 344130 - DNA, 25 bp, Homo sapien
gaatgaccatggcttttatccccaa

SEQ ID NO: 344131 - DNA, 25 bp, Homo sapien
tgaccatggcttttatccccaaagt

SEQ ID NO: 344132 - DNA, 25 bp, Homo sapien
aaatctcacatcttggcaatcgtgt

SEQ ID NO: 344133 - DNA, 25 bp, Homo sapien
aatcgtgtgcaaaactgcgcgcctg

SEQ ID NO: 344134 - DNA, 25 bp, Homo sapien
gcctgacatccctattgcacaggga

SEQ ID NO: 344135 - DNA, 25 bp, Homo sapien
agggaagcccatctagtacttgcac

SEQ ID NO: 344136 - DNA, 25 bp, Homo sapien
gtacttgcactgaggtttaaaacct

SEQ ID NO: 344137 - DNA, 25 bp, Homo sapien
ctgaggacccggaaagcacttttga

SEQ ID NO: 344138 - DNA, 25 bp, Homo sapien
ttgaacaactagatgcgaatgctgc

SEQ ID NO: 344139 - DNA, 25 bp, Homo sapien
gaggtgatctaagtctcggtatcca

SEQ ID NO: 344140 - DNA, 25 bp, Homo sapien
cggtatccatgtttatgaccccagg

SEQ ID NO: 344141 - DNA, 25 bp, Homo sapien
ccaggaagcctgtttaaggtttcag

SEQ ID NO: 344142 - DNA, 25 bp, Homo sapien
gtttaaggtttcagtagggctgcca

SEQ ID NO: 344143 - DNA, 25 bp, Homo sapien
gttttccttgatttacatcccatca

SEQ ID NO: 344144 - DNA, 25 bp, Homo sapien
gtcatgttttgtgattaacttccat

SEQ ID NO: 344145 - DNA, 25 bp, Homo sapien
gattaacttccatcatagtactgat

SEQ ID NO: 344146 - DNA, 25 bp, Homo sapien
gtactgatcataattactctgtaat

SEQ ID NO: 344147 - DNA, 25 bp, Homo sapien
gcccaccatctgaaatgctcttctt

SEQ ID NO: 344148 - DNA, 25 bp, Homo sapien
tataggttgtttgctacaggaaggc

SEQ ID NO: 344149 - DNA, 25 bp, Homo sapien
ggcagaggctgtttcataatatcct

SEQ ID NO: 344150 - DNA, 25 bp, Homo sapien
acagggatcatacctcagaggctct

SEQ ID NO: 344151 - DNA, 25 bp, Homo sapien
acctccagtataacttctgtccagg

SEQ ID NO: 344152 - DNA, 25 bp, Homo sapien
gtataacttctgtccaggctgagaa

SEQ ID NO: 344153 - DNA, 25 bp, Homo sapien
ttctgtccaggctgagaaaattcaa

SEQ ID NO: 344154 - DNA, 25 bp, Homo sapien
aacgcagcctgttgacccttcctgg

SEQ ID NO: 344155 - DNA, 25 bp, Homo sapien
cttcctggccatcacatgaaaatca

SEQ ID NO: 344156 - DNA, 25 bp, Homo sapien
acatgaaaatcagcgactcttcctt

SEQ ID NO: 344157 - DNA, 25 bp, Homo sapien
ccttcttacaaaactcggagcttct

SEQ ID NO: 344158 - DNA, 25 bp, Homo sapien
agcttctcaggataacttggtgaaa

SEQ ID NO: 344159 - DNA, 25 bp, Homo sapien
ctcagtgagcccacctgtaatatac

SEQ ID NO: 344160 - DNA, 25 bp, Homo sapien
gaagaccagaaaagctcagtcagag

SEQ ID NO: 344161 - DNA, 25 bp, Homo sapien
agtcagagtgacactgacccctgaa

SEQ ID NO: 344162 - DNA, 25 bp, Homo sapien
tgacccctgaaatgatgggcacaat

SEQ ID NO: 344163 - DNA, 25 bp, Homo sapien
gagtgtgtggcttttcctgtaggac

SEQ ID NO: 344164 - DNA, 25 bp, Homo sapien
ggattccagtcctccgaaaaacagg

SEQ ID NO: 344165 - DNA, 25 bp, Homo sapien
tgctggagacaatacatggactttc

SEQ ID NO: 344166 - DNA, 25 bp, Homo sapien
ggactttctctttcaatggtgagga

SEQ ID NO: 344167 - DNA, 25 bp, Homo sapien
acaagatacaagaaccacagcatgg

SEQ ID NO: 344168 - DNA, 25 bp, Homo sapien
accacagcatggaatatgttttctt

SEQ ID NO: 344169 - DNA, 25 bp, Homo sapien
gttttcttttacatccaatggccag

SEQ ID NO: 344170 - DNA, 25 bp, Homo sapien
atggccaggtcataaaggatgcctt

SEQ ID NO: 344171 - DNA, 25 bp, Homo sapien
taaaggatgccttgagacctccacc

SEQ ID NO: 344172 - DNA, 25 bp, Homo sapien
acagcgctttgggacaggatgacta

SEQ ID NO: 344173 - DNA, 25 bp, Homo sapien
atgtgcaatcaagtcccgggaagaa

SEQ ID NO: 344174 - DNA, 25 bp, Homo sapien
ggctcaactaccgatgggcatcagt

SEQ ID NO: 344175 - DNA, 25 bp, Homo sapien
gcatcagtaatccatcccagtataa

SEQ ID NO: 344176 - DNA, 25 bp, Homo sapien
catggcaacatattattcatttttc

SEQ ID NO: 344177 - DNA, 25 bp, Homo sapien
atgccagtgataggaatacacagta

SEQ ID NO: 344178 - DNA, 25 bp, Homo sapien
gtaacattggcttaacactggtata

SEQ ID NO: 344179 - DNA, 25 bp, Homo sapien
acattggcttaacactggtatatag

SEQ ID NO: 344180 - DNA, 25 bp, Homo sapien
ggcttaacactggtatatagttcag

SEQ ID NO: 344181 - DNA, 25 bp, Homo sapien
atagttcagtatgacttctctcccc

SEQ ID NO: 344182 - DNA, 25 bp, Homo sapien
ttcagtatgacttctctcccctcaa

SEQ ID NO: 344183 - DNA, 25 bp, Homo sapien
ctcccctcaacctctggaataggtt

SEQ ID NO: 344184 - DNA, 25 bp, Homo sapien
ctctggaataggttcaaattgatga

SEQ ID NO: 344185 - DNA, 25 bp, Homo sapien
gagaatttctgattagagcccttaa

SEQ ID NO: 344186 - DNA, 25 bp, Homo sapien
atttctgattagagcccttaatgtt

SEQ ID NO: 344187 - DNA, 25 bp, Homo sapien
ggaaagtggaatgaaccgtttgacg

SEQ ID NO: 344188 - DNA, 25 bp, Homo sapien
gaaagtggaatgaaccgtttgacga

SEQ ID NO: 344189 - DNA, 25 bp, Homo sapien
gtggaatgaaccgtttgacgaaaca

SEQ ID NO: 344190 - DNA, 25 bp, Homo sapien
ggaatgaaccgtttgacgaaacata

SEQ ID NO: 344191 - DNA, 25 bp, Homo sapien
gaatgaaccgtttgacgaaacatac

SEQ ID NO: 344192 - DNA, 25 bp, Homo sapien
atgaaccgtttgacgaaacatacac

SEQ ID NO: 344193 - DNA, 25 bp, Homo sapien
gaaccgtttgacgaaacatacacaa

SEQ ID NO: 344194 - DNA, 25 bp, Homo sapien
accgtttgacgaaacatacacaagg

SEQ ID NO: 344195 - DNA, 25 bp, Homo sapien
gtttgacgaaacatacacaagggaa

SEQ ID NO: 344196 - DNA, 25 bp, Homo sapien
gaaacatacacaagggaaatgccct

SEQ ID NO: 344197 - DNA, 25 bp, Homo sapien
catacacaagggaaatgccctttaa

SEQ ID NO: 344198 - DNA, 25 bp, Homo sapien
ccatctcaggcatttaaggatctat

SEQ ID NO: 344199 - DNA, 25 bp, Homo sapien
ggatctatcctatttttgaagtctc

SEQ ID NO: 344200 - DNA, 25 bp, Homo sapien
gtctccaaaaaggatcccttggtct

SEQ ID NO: 344201 - DNA, 25 bp, Homo sapien
aatgtcataaactctgtaagtcagg

SEQ ID NO: 344202 - DNA, 25 bp, Homo sapien
gagcaagctcagattctttctatgg

SEQ ID NO: 344203 - DNA, 25 bp, Homo sapien
gctcagattctttctatggttcaaa

SEQ ID NO: 344204 - DNA, 25 bp, Homo sapien
gaccattttctttggcaatcatcct

SEQ ID NO: 344205 - DNA, 25 bp, Homo sapien
ttggcaatcatcctctctctgagta

SEQ ID NO: 344206 - DNA, 25 bp, Homo sapien
ctctgagtacccttcatgtatttga

SEQ ID NO: 344207 - DNA, 25 bp, Homo sapien
tcttctccccaggtggaataatttc

SEQ ID NO: 344208 - DNA, 25 bp, Homo sapien
tcagttctagtcacttgaattcaga

SEQ ID NO: 344209 - DNA, 25 bp, Homo sapien
ttttgtgtttctgcggatgccataa

SEQ ID NO: 344210 - DNA, 25 bp, Homo sapien
ttgaatggcaccaaagagactttta

SEQ ID NO: 344211 - DNA, 25 bp, Homo sapien
gagacttttatcagctattttccgt

SEQ ID NO: 344212 - DNA, 25 bp, Homo sapien
atcagctattttccgtgttacatgt

SEQ ID NO: 344213 - DNA, 25 bp, Homo sapien
gttacatgtgttagcagttcctttc

SEQ ID NO: 344214 - DNA, 25 bp, Homo sapien
agcagttcctttctgtgggttgaat

SEQ ID NO: 344215 - DNA, 25 bp, Homo sapien
atacttcattctgtagttactttac

SEQ ID NO: 344216 - DNA, 25 bp, Homo sapien
gttactttacacatgtttttctaag

SEQ ID NO: 344217 - DNA, 25 bp, Homo sapien
ttgtcgtttattactgcaattctag

SEQ ID NO: 344218 - DNA, 25 bp, Homo sapien
caattctagagagttgcttgatttc

SEQ ID NO: 344219 - DNA, 25 bp, Homo sapien
aaggttatttggatctggttggtca

SEQ ID NO: 344220 - DNA, 25 bp, Homo sapien
aagggcagcagataccctgtttgcc

SEQ ID NO: 344221 - DNA, 25 bp, Homo sapien
gtttgcctccctgagtgcagaggtc

SEQ ID NO: 344222 - DNA, 25 bp, Homo sapien
aggtcctgagcccaccctagttggg

SEQ ID NO: 344223 - DNA, 25 bp, Homo sapien
ccctagttgggctgactcaactgga

SEQ ID NO: 344224 - DNA, 25 bp, Homo sapien
gggctgactcaactggaaatttggt

SEQ ID NO: 344225 - DNA, 25 bp, Homo sapien
ctggaaatttggttgtgacagtggc

SEQ ID NO: 344226 - DNA, 25 bp, Homo sapien
ggctgggtgattgtattctgtgtac

SEQ ID NO: 344227 - DNA, 25 bp, Homo sapien
gattgtattctgtgtactgcccagc

SEQ ID NO: 344228 - DNA, 25 bp, Homo sapien
tttttggcctaaccctggaagcctg

SEQ ID NO: 344229 - DNA, 25 bp, Homo sapien
gcctaaccctggaagcctggaaagt

SEQ ID NO: 344230 - DNA, 25 bp, Homo sapien
gcctggaaagttgcccacttttctc

SEQ ID NO: 344231 - DNA, 25 bp, Homo sapien
attaaaatgccatgaatcaagccag

SEQ ID NO: 344232 - DNA, 25 bp, Homo sapien
aatgccatgaatcaagccagggccg

SEQ ID NO: 344233 - DNA, 25 bp, Homo sapien
atgccatgaatcaagccagggccgt

SEQ ID NO: 344234 - DNA, 25 bp, Homo sapien
tgccatgaatcaagccagggccgtt

SEQ ID NO: 344235 - DNA, 25 bp, Homo sapien
gccatgaatcaagccagggccgttg

SEQ ID NO: 344236 - DNA, 25 bp, Homo sapien
ccatgaatcaagccagggccgttgg

SEQ ID NO: 344237 - DNA, 25 bp, Homo sapien
actttgcaggccgaggtagacagat

SEQ ID NO: 344238 - DNA, 25 bp, Homo sapien
ctttgcaggccgaggtagacagatg

SEQ ID NO: 344239 - DNA, 25 bp, Homo sapien
tttgcaggccgaggtagacagatgg

SEQ ID NO: 344240 - DNA, 25 bp, Homo sapien
ccgaggtagacagatggcttgagct

SEQ ID NO: 344241 - DNA, 25 bp, Homo sapien
agctgtgtttcgccactgcacacca

SEQ ID NO: 344242 - DNA, 25 bp, Homo sapien
cgaccaaatcgcccacactttgttg

SEQ ID NO: 344243 - DNA, 25 bp, Homo sapien
ttggaaaggcagtgtcccaccctcc

SEQ ID NO: 344244 - DNA, 25 bp, Homo sapien
ggaaaggcagtgtcccaccctccag

SEQ ID NO: 344245 - DNA, 25 bp, Homo sapien
ccagttacccttataaccacatcta

SEQ ID NO: 344246 - DNA, 25 bp, Homo sapien
gttacccttataaccacatctacca

SEQ ID NO: 344247 - DNA, 25 bp, Homo sapien
tataaccacatctaccactggagct

SEQ ID NO: 344248 - DNA, 25 bp, Homo sapien
cacatctaccactggagctccatag

SEQ ID NO: 344249 - DNA, 25 bp, Homo sapien
atctaccactggagctccatagcct

SEQ ID NO: 344250 - DNA, 25 bp, Homo sapien
tggagctccatagccttccagtcaa

SEQ ID NO: 344251 - DNA, 25 bp, Homo sapien
gagctccatagccttccagtcaaaa

SEQ ID NO: 344252 - DNA, 25 bp, Homo sapien
agctccatagccttccagtcaaaac

SEQ ID NO: 344253 - DNA, 25 bp, Homo sapien
ggctgttccccgatagcatcttctg

SEQ ID NO: 344254 - DNA, 25 bp, Homo sapien
ccccgatagcatcttctgggaagaa

SEQ ID NO: 344255 - DNA, 25 bp, Homo sapien
gggaagaatccaaccaagatacaaa

SEQ ID NO: 344256 - DNA, 25 bp, Homo sapien
gatacaaagcagatgatggtggatc

SEQ ID NO: 344257 - DNA, 25 bp, Homo sapien
atggtggatcggcaaactcttttct

SEQ ID NO: 344258 - DNA, 25 bp, Homo sapien
ggatcggcaaactcttttctatgaa

SEQ ID NO: 344259 - DNA, 25 bp, Homo sapien
gaaaaaccagatataccagggactg

SEQ ID NO: 344260 - DNA, 25 bp, Homo sapien
agggactggaaagcacctgcttgaa

SEQ ID NO: 344261 - DNA, 25 bp, Homo sapien
gagcatgtctgaatttttcccttat

SEQ ID NO: 344262 - DNA, 25 bp, Homo sapien
ccttataagagcctgagtattgtaa

SEQ ID NO: 344263 - DNA, 25 bp, Homo sapien
tattgtaacaggtctcttgcacagg

SEQ ID NO: 344264 - DNA, 25 bp, Homo sapien
atctgctaactttttgccttagtta

SEQ ID NO: 344265 - DNA, 25 bp, Homo sapien
ctgctaactttttgccttagttatt

SEQ ID NO: 344266 - DNA, 25 bp, Homo sapien
tgccttagttattaaaccctcctgc

SEQ ID NO: 344267 - DNA, 25 bp, Homo sapien
gtaggctctttgataaagtaagctt

SEQ ID NO: 344268 - DNA, 25 bp, Homo sapien
ggctctttgataaagtaagctttct

SEQ ID NO: 344269 - DNA, 25 bp, Homo sapien
tttgaattaaggctcatccagggaa

SEQ ID NO: 344270 - DNA, 25 bp, Homo sapien
gaattaaggctcatccagggaagtc

SEQ ID NO: 344271 - DNA, 25 bp, Homo sapien
ttaaggctcatccagggaagtctat

SEQ ID NO: 344272 - DNA, 25 bp, Homo sapien
aaggctcatccagggaagtctattg

SEQ ID NO: 344273 - DNA, 25 bp, Homo sapien
ggctcatccagggaagtctattgat

SEQ ID NO: 344274 - DNA, 25 bp, Homo sapien
ctcatccagggaagtctattgatgt

SEQ ID NO: 344275 - DNA, 25 bp, Homo sapien
gtgtagtggtatatgatgcaggaaa

SEQ ID NO: 344276 - DNA, 25 bp, Homo sapien
aaagaaaacagatcagtgcctgata

SEQ ID NO: 344277 - DNA, 25 bp, Homo sapien
gatcagtgcctgatatgaattatac

SEQ ID NO: 344278 - DNA, 25 bp, Homo sapien
gatatgaattatacactgggccaaa

SEQ ID NO: 344279 - DNA, 25 bp, Homo sapien
gggccaaaagtttttcatatttgct

SEQ ID NO: 344280 - DNA, 25 bp, Homo sapien
atttaatttccatatagccatgcaa

SEQ ID NO: 344281 - DNA, 25 bp, Homo sapien
atatagccatgcaaaataggtgttt

SEQ ID NO: 344282 - DNA, 25 bp, Homo sapien
aacagtctcagagagttttactaat

SEQ ID NO: 344283 - DNA, 25 bp, Homo sapien
acaaaagtacattgtatggcttggg

SEQ ID NO: 344284 - DNA, 25 bp, Homo sapien
aataaagtagtctagagtggctcta

SEQ ID NO: 344285 - DNA, 25 bp, Homo sapien
gagtggctctattaataaggtttgt

SEQ ID NO: 344286 - DNA, 25 bp, Homo sapien
ctgcttggagggtgaggacctgact

SEQ ID NO: 344287 - DNA, 25 bp, Homo sapien
ggtgcctttttactgctttcggtgc

SEQ ID NO: 344288 - DNA, 25 bp, Homo sapien
gcctttttactgctttcggtgcaga

SEQ ID NO: 344289 - DNA, 25 bp, Homo sapien
tactgctttcggtgcagaatccaga

SEQ ID NO: 344290 - DNA, 25 bp, Homo sapien
gcagaatccagatggctactacttg

SEQ ID NO: 344291 - DNA, 25 bp, Homo sapien
atccagatggctactacttggttct

SEQ ID NO: 344292 - DNA, 25 bp, Homo sapien
agatggctactacttggttctgacc

SEQ ID NO: 344293 - DNA, 25 bp, Homo sapien
ggctactacttggttctgacctagg

SEQ ID NO: 344294 - DNA, 25 bp, Homo sapien
caggggaactccactgctcaagaga

SEQ ID NO: 344295 - DNA, 25 bp, Homo sapien
tgctcaagagactgatagcttgtct

SEQ ID NO: 344296 - DNA, 25 bp, Homo sapien
gactgatagcttgtcttcaccagaa

SEQ ID NO: 344297 - DNA, 25 bp, Homo sapien
tcagtccttgcttataagacttttt

SEQ ID NO: 344298 - DNA, 25 bp, Homo sapien
tcccctacagctttgtccattgaca

SEQ ID NO: 344299 - DNA, 25 bp, Homo sapien
atcagtgaggttgagtatgtctcat

SEQ ID NO: 344300 - DNA, 25 bp, Homo sapien
gtatgtctcatatgcttgtgaccaa

SEQ ID NO: 344301 - DNA, 25 bp, Homo sapien
gcttgtgaccaagtgtattcttttt

SEQ ID NO: 344302 - DNA, 25 bp, Homo sapien
agtttctttgataaggtcctttgca

SEQ ID NO: 344303 - DNA, 25 bp, Homo sapien
gataaggtcctttgcatattgagaa

SEQ ID NO: 344304 - DNA, 25 bp, Homo sapien
gtccattgacatgtctgcagagcac

SEQ ID NO: 344305 - DNA, 25 bp, Homo sapien
cagagcacaatgacagtgactgttc

SEQ ID NO: 344306 - DNA, 25 bp, Homo sapien
gtgactgttccccagaccttaccat

SEQ ID NO: 344307 - DNA, 25 bp, Homo sapien
ttaccaaacttttcagtccttgctt

SEQ ID NO: 344308 - DNA, 25 bp, Homo sapien
gaaagattccaaaaaccatcagctt

SEQ ID NO: 344309 - DNA, 25 bp, Homo sapien
aaaaccatcagcttttccaattctc

SEQ ID NO: 344310 - DNA, 25 bp, Homo sapien
ccttaagccatagcaaggcaaagtg

SEQ ID NO: 344311 - DNA, 25 bp, Homo sapien
gcttttccaattctcttggtattcg

SEQ ID NO: 344312 - DNA, 25 bp, Homo sapien
acaagtgtatactctttctcttctt

SEQ ID NO: 344313 - DNA, 25 bp, Homo sapien
ttggcctcattatgttcaaggaagt

SEQ ID NO: 344314 - DNA, 25 bp, Homo sapien
ggaagtaccctcttgttagttcagc

SEQ ID NO: 344315 - DNA, 25 bp, Homo sapien
taccctcttgttagttcagcactga

SEQ ID NO: 344316 - DNA, 25 bp, Homo sapien
gttagttcagcactgaggaacctca

SEQ ID NO: 344317 - DNA, 25 bp, Homo sapien
aacaatgaaagctctgtgcggcccc

SEQ ID NO: 344318 - DNA, 25 bp, Homo sapien
atacaaaaacgcatccaggcacaga

SEQ ID NO: 344319 - DNA, 25 bp, Homo sapien
ttgggaccaaatctggtcctctcaa

SEQ ID NO: 344320 - DNA, 25 bp, Homo sapien
gaagtaagaagaaccccaatgtctt

SEQ ID NO: 344321 - DNA, 25 bp, Homo sapien
aaaggatgactttcttgctgcatgt

SEQ ID NO: 344322 - DNA, 25 bp, Homo sapien
aatgtctttcttcttccagctaatt

SEQ ID NO: 344323 - DNA, 25 bp, Homo sapien
gtagtcctagttattcaggaagcta

SEQ ID NO: 344324 - DNA, 25 bp, Homo sapien
aggaactccaggctagtgcactata

SEQ ID NO: 344325 - DNA, 25 bp, Homo sapien
gctagtgcactataactgcacctat

SEQ ID NO: 344326 - DNA, 25 bp, Homo sapien
cttgctgcatgtaactagtatgtga

SEQ ID NO: 344327 - DNA, 25 bp, Homo sapien
tagtatgtgactgcttctgcattcc

SEQ ID NO: 344328 - DNA, 25 bp, Homo sapien
tgcattcccttcgatctatccttgg

SEQ ID NO: 344329 - DNA, 25 bp, Homo sapien
tatccttggctttctcaatgtgaat

SEQ ID NO: 344330 - DNA, 25 bp, Homo sapien
ctggaccatgtgcatttcactgggc

SEQ ID NO: 344331 - DNA, 25 bp, Homo sapien
ttcactgggccatgggatctacatc

SEQ ID NO: 344332 - DNA, 25 bp, Homo sapien
agaagcatggcctacagaatgaaga

SEQ ID NO: 344333 - DNA, 25 bp, Homo sapien
ctgggccatgggatctacatctcct

SEQ ID NO: 344334 - DNA, 25 bp, Homo sapien
tgctcatggtcttcaggtggcctga

SEQ ID NO: 344335 - DNA, 25 bp, Homo sapien
aggagttaggcattaccttctggga

SEQ ID NO: 344336 - DNA, 25 bp, Homo sapien
taccttctgggagtgaaccctgact

SEQ ID NO: 344337 - DNA, 25 bp, Homo sapien
accttctgggagtgaaccctgactc

SEQ ID NO: 344338 - DNA, 25 bp, Homo sapien
gaacccctgtgggagaggcttagac

SEQ ID NO: 344339 - DNA, 25 bp, Homo sapien
cctgtgggagaggcttagacctgaa

SEQ ID NO: 344340 - DNA, 25 bp, Homo sapien
tcctgccttggctgactgggttcct

SEQ ID NO: 344341 - DNA, 25 bp, Homo sapien
aaatcgcccacactttgttgctctt

SEQ ID NO: 344342 - DNA, 25 bp, Homo sapien
gttgctcttggaaaggcagtgtccc

SEQ ID NO: 344343 - DNA, 25 bp, Homo sapien
ttggaaaggcagtgtcccaccctcc

SEQ ID NO: 344344 - DNA, 25 bp, Homo sapien
ggaaaggcagtgtcccaccctccag

SEQ ID NO: 344345 - DNA, 25 bp, Homo sapien
ccagttacccttataaccacatcta

SEQ ID NO: 344346 - DNA, 25 bp, Homo sapien
gttacccttataaccacatctacca

SEQ ID NO: 344347 - DNA, 25 bp, Homo sapien
tataaccacatctaccactggagct

SEQ ID NO: 344348 - DNA, 25 bp, Homo sapien
cacatctaccactggagctccatag

SEQ ID NO: 344349 - DNA, 25 bp, Homo sapien
atctaccactggagctccatagcct

SEQ ID NO: 344350 - DNA, 25 bp, Homo sapien
tggagctccatagccttccagtcaa

SEQ ID NO: 344351 - DNA, 25 bp, Homo sapien
agctccatagccttccagtcaaaac

SEQ ID NO: 344352 - DNA, 25 bp, Homo sapien
cttttcctttgccttctatcatgat

SEQ ID NO: 344353 - DNA, 25 bp, Homo sapien
gccttctatcatgattgtgagttct

SEQ ID NO: 344354 - DNA, 25 bp, Homo sapien
tctatcatgattgtgagttctcccc

SEQ ID NO: 344355 - DNA, 25 bp, Homo sapien
ccgtgagttcactaaacctctttct

SEQ ID NO: 344356 - DNA, 25 bp, Homo sapien
gactaatacacctgccaagaatttt

SEQ ID NO: 344357 - DNA, 25 bp, Homo sapien
ttttttctatattttggccagattg

SEQ ID NO: 344358 - DNA, 25 bp, Homo sapien
tttctatattttggccagattgtat

SEQ ID NO: 344359 - DNA, 25 bp, Homo sapien
tattttggccagattgtatagtttt

SEQ ID NO: 344360 - DNA, 25 bp, Homo sapien
tggccagattgtatagttttttatg

SEQ ID NO: 344361 - DNA, 25 bp, Homo sapien
cagattgtatagttttttatggtgg

SEQ ID NO: 344362 - DNA, 25 bp, Homo sapien
atggtgggagggtgaatctgacaca

SEQ ID NO: 344363 - DNA, 25 bp, Homo sapien
aaagcggcacaattctttataccac

SEQ ID NO: 344364 - DNA, 25 bp, Homo sapien
aagcggcacaattctttataccact

SEQ ID NO: 344365 - DNA, 25 bp, Homo sapien
agcggcacaattctttataccactg

SEQ ID NO: 344366 - DNA, 25 bp, Homo sapien
gcggcacaattctttataccactgg

SEQ ID NO: 344367 - DNA, 25 bp, Homo sapien
cggcacaattctttataccactgga

SEQ ID NO: 344368 - DNA, 25 bp, Homo sapien
caggttacaaacatttacacatgca

SEQ ID NO: 344369 - DNA, 25 bp, Homo sapien
ggttacaaacatttacacatgcata

SEQ ID NO: 344370 - DNA, 25 bp, Homo sapien
gttacaaacatttacacatgcatag

SEQ ID NO: 344371 - DNA, 25 bp, Homo sapien
caaacatttacacatgcatagtgag

SEQ ID NO: 344372 - DNA, 25 bp, Homo sapien
tgagcacaacccctaaaaattttct

SEQ ID NO: 344373 - DNA, 25 bp, Homo sapien
gaattttactaaattcacgcatttt

SEQ ID NO: 344374 - DNA, 25 bp, Homo sapien
gttcccccggcttttgctggagact

SEQ ID NO: 344375 - DNA, 25 bp, Homo sapien
tgctggagactcatcgctttgggaa

SEQ ID NO: 344376 - DNA, 25 bp, Homo sapien
ctggagactcatcgctttgggaagt

SEQ ID NO: 344377 - DNA, 25 bp, Homo sapien
gagactcatcgctttgggaagtgca

SEQ ID NO: 344378 - DNA, 25 bp, Homo sapien
agactcatcgctttgggaagtgcat

SEQ ID NO: 344379 - DNA, 25 bp, Homo sapien
gagcctgctgaatcctgtcctcgcg

SEQ ID NO: 344380 - DNA, 25 bp, Homo sapien
tgaatcctgtcctcgcggctcggga

SEQ ID NO: 344381 - DNA, 25 bp, Homo sapien
tcactctctctgagcgcgtctcgct

SEQ ID NO: 344382 - DNA, 25 bp, Homo sapien
ccaggagcgctcaggatcccgagcg

SEQ ID NO: 344383 - DNA, 25 bp, Homo sapien
tcaggatcccgagcgccgcgaaaaa

SEQ ID NO: 344384 - DNA, 25 bp, Homo sapien
gatcccgagcgccgcgaaaaagttc

SEQ ID NO: 344385 - DNA, 25 bp, Homo sapien
atcactgaactaaagaaatgggcaa

SEQ ID NO: 344386 - DNA, 25 bp, Homo sapien
caaggctgacttccgtaatataggt

SEQ ID NO: 344387 - DNA, 25 bp, Homo sapien
gacttccgtaatataggttctacct

SEQ ID NO: 344388 - DNA, 25 bp, Homo sapien
aggttctacctaaccatctctaaca

SEQ ID NO: 344389 - DNA, 25 bp, Homo sapien
tctctaacaccgctgtcaaggagga

SEQ ID NO: 344390 - DNA, 25 bp, Homo sapien
gtacattactaacaaccacacaaat

SEQ ID NO: 344391 - DNA, 25 bp, Homo sapien
gaacactcttagcagcctatggtac

SEQ ID NO: 344392 - DNA, 25 bp, Homo sapien
cttagcagcctatggtactttgaaa

SEQ ID NO: 344393 - DNA, 25 bp, Homo sapien
aatgtgaatacaacaggaatcctgt

SEQ ID NO: 344394 - DNA, 25 bp, Homo sapien
ggaatcctgttggtattctatttat

SEQ ID NO: 344395 - DNA, 25 bp, Homo sapien
tgtaagcagcagttcaattgttttg

SEQ ID NO: 344396 - DNA, 25 bp, Homo sapien
ggaaagtggaatgaaccgtttgacg

SEQ ID NO: 344397 - DNA, 25 bp, Homo sapien
agtatttctgaatgaatttcttaac

SEQ ID NO: 344398 - DNA, 25 bp, Homo sapien
ctgaatgaatttcttaactcagtag

SEQ ID NO: 344399 - DNA, 25 bp, Homo sapien
aaggagtaaaagatatttgctgcat

SEQ ID NO: 344400 - DNA, 25 bp, Homo sapien
gagtaaaagatatttgctgcatata

SEQ ID NO: 344401 - DNA, 25 bp, Homo sapien
aagatatttgctgcatatatatatt

SEQ ID NO: 344402 - DNA, 25 bp, Homo sapien
gaaccgtttgacgaaacatacacaa

SEQ ID NO: 344403 - DNA, 25 bp, Homo sapien
ttaaaatcctgctagtttgatgaag

SEQ ID NO: 344404 - DNA, 25 bp, Homo sapien
aaaatcctgctagtttgatgaagaa

SEQ ID NO: 344405 - DNA, 25 bp, Homo sapien
aatcctgctagtttgatgaagaagt

SEQ ID NO: 344406 - DNA, 25 bp, Homo sapien
tcctgctagtttgatgaagaagttg

SEQ ID NO: 344407 - DNA, 25 bp, Homo sapien
tcccatctcatcttggaaagtttca

SEQ ID NO: 344408 - DNA, 25 bp, Homo sapien
catctcatcttggaaagtttcaaac

SEQ ID NO: 344409 - DNA, 25 bp, Homo sapien
ttcaaacagatcttccatcagctca

SEQ ID NO: 344410 - DNA, 25 bp, Homo sapien
aacagatcttccatcagctcatttg

SEQ ID NO: 344411 - DNA, 25 bp, Homo sapien
agatcttccatcagctcatttgctt

SEQ ID NO: 344412 - DNA, 25 bp, Homo sapien
agctcatttgcttccttttcgtgtc

SEQ ID NO: 344413 - DNA, 25 bp, Homo sapien
tcatttgcttccttttcgtgtcgga

SEQ ID NO: 344414 - DNA, 25 bp, Homo sapien
atttgcttccttttcgtgtcggagg

SEQ ID NO: 344415 - DNA, 25 bp, Homo sapien
gcttccttttcgtgtcggaggccga

SEQ ID NO: 344416 - DNA, 25 bp, Homo sapien
gcggccagcgggtaagccgacttca

SEQ ID NO: 344417 - DNA, 25 bp, Homo sapien
gccagcgggtaagccgacttcagcg

SEQ ID NO: 344418 - DNA, 25 bp, Homo sapien
gacaatagctctctagtgtggacat

SEQ ID NO: 344419 - DNA, 25 bp, Homo sapien
atatttctaagacattgacaggacg

SEQ ID NO: 344420 - DNA, 25 bp, Homo sapien
cattgacaggacgaagaagttgcac

SEQ ID NO: 344421 - DNA, 25 bp, Homo sapien
gaagttgcacagtaaccacgcactc

SEQ ID NO: 344422 - DNA, 25 bp, Homo sapien
cacgcactcctgtttacatttgtat

SEQ ID NO: 344423 - DNA, 25 bp, Homo sapien
acttgtttacctatacgtagcatat

SEQ ID NO: 344424 - DNA, 25 bp, Homo sapien
atatatgcgtgtgtgcaccctagaa

SEQ ID NO: 344425 - DNA, 25 bp, Homo sapien
gtgtgcaccctagaaaagagtctgt

SEQ ID NO: 344426 - DNA, 25 bp, Homo sapien
acatatcaagctattgacagcggtt

SEQ ID NO: 344427 - DNA, 25 bp, Homo sapien
gacagcggttttgtctgctgaagga

SEQ ID NO: 344428 - DNA, 25 bp, Homo sapien
ttttactccatttaattctaggttg

SEQ ID NO: 344429 - DNA, 25 bp, Homo sapien
taagtagcagtgagcgattgtgaat

SEQ ID NO: 344430 - DNA, 25 bp, Homo sapien
taagttattcactagggagccagtc

SEQ ID NO: 344431 - DNA, 25 bp, Homo sapien
ggagccagtcgtagttctttgtaat

SEQ ID NO: 344432 - DNA, 25 bp, Homo sapien
ttctttgtaatcctctttcttccaa

SEQ ID NO: 344433 - DNA, 25 bp, Homo sapien
tttcttccaaacctgctttgctgaa

SEQ ID NO: 344434 - DNA, 25 bp, Homo sapien
aacagaacccttcagggtgggtcag

SEQ ID NO: 344435 - DNA, 25 bp, Homo sapien
tgggtcagaggacgccatccacagt

SEQ ID NO: 344436 - DNA, 25 bp, Homo sapien
agaggacgccatccacagtggattc

SEQ ID NO: 344437 - DNA, 25 bp, Homo sapien
cacagtggattcgtgttcgtttgca

SEQ ID NO: 344438 - DNA, 25 bp, Homo sapien
gattcgtgttcgtttgcaggtggaa

SEQ ID NO: 344439 - DNA, 25 bp, Homo sapien
ggaagcagtgatttttaggacccac

SEQ ID NO: 344440 - DNA, 25 bp, Homo sapien
agaaaaccaatacaactgagtctaa

SEQ ID NO: 344441 - DNA, 25 bp, Homo sapien
atgagcctaaccacacagcactggg

SEQ ID NO: 344442 - DNA, 25 bp, Homo sapien
agcctaaccacacagcactgggttt

SEQ ID NO: 344443 - DNA, 25 bp, Homo sapien
gtcagtgggaataaagctgccaggc

SEQ ID NO: 344444 - DNA, 25 bp, Homo sapien
tgggaataaagctgccaggcactga

SEQ ID NO: 344445 - DNA, 25 bp, Homo sapien
gaagcttttgaggaagcacctttgc

SEQ ID NO: 344446 - DNA, 25 bp, Homo sapien
aaaagggcaagctgatgccttagga

SEQ ID NO: 344447 - DNA, 25 bp, Homo sapien
gcaagctgatgccttaggaaattga

SEQ ID NO: 344448 - DNA, 25 bp, Homo sapien
gaaaattcaactgttcttagcatgt

SEQ ID NO: 344449 - DNA, 25 bp, Homo sapien
tgttcttagcatgtgaaggtaacct

SEQ ID NO: 344450 - DNA, 25 bp, Homo sapien
tgaaggtaacctaatgcagaaagtt

SEQ ID NO: 344451 - DNA, 25 bp, Homo sapien
ttccgaagcctgaacacaatagatg

SEQ ID NO: 344452 - DNA, 25 bp, Homo sapien
agctcgctccaaatgccagcagttg

SEQ ID NO: 344453 - DNA, 25 bp, Homo sapien
gccagcagttgcaggagtatgagct

SEQ ID NO: 344454 - DNA, 25 bp, Homo sapien
agctgcaacagctcggcacgactag

SEQ ID NO: 344455 - DNA, 25 bp, Homo sapien
agctcggcacgactagtccaaagac

SEQ ID NO: 344456 - DNA, 25 bp, Homo sapien
ggcacgactagtccaaagacgagca

SEQ ID NO: 344457 - DNA, 25 bp, Homo sapien
aagaaaatggtcctggcgcatccta

SEQ ID NO: 344458 - DNA, 25 bp, Homo sapien
caaacaagtcagttacccggctggt

SEQ ID NO: 344459 - DNA, 25 bp, Homo sapien
aaacaagtcctatgagcggaggtcg

SEQ ID NO: 344460 - DNA, 25 bp, Homo sapien
gagcggaggtcggagcaacctcttt

SEQ ID NO: 344461 - DNA, 25 bp, Homo sapien
agcaacctcttttccgaagcctgaa

SEQ ID NO: 344462 - DNA, 25 bp, Homo sapien
ccagtccactgaagacgtcgctgtg

SEQ ID NO: 344463 - DNA, 25 bp, Homo sapien
tgaagacgtcgctgtgccactgtcc

SEQ ID NO: 344464 - DNA, 25 bp, Homo sapien
gctgtgccactgtcccttgtaggtg

SEQ ID NO: 344465 - DNA, 25 bp, Homo sapien
actgtcccttgtaggtggagccgtc

SEQ ID NO: 344466 - DNA, 25 bp, Homo sapien
agtcgccgtcgtacttgtcaccgtt

SEQ ID NO: 344467 - DNA, 25 bp, Homo sapien
gtcgtacttgtcaccgttctgaaag

SEQ ID NO: 344468 - DNA, 25 bp, Homo sapien
gtacttgtcaccgttctgaaagagc

SEQ ID NO: 344469 - DNA, 25 bp, Homo sapien
tgtcaccgttctgaaagagcatctg

SEQ ID NO: 344470 - DNA, 25 bp, Homo sapien
ggccgtgcctcttgttgtcatggaa

SEQ ID NO: 344471 - DNA, 25 bp, Homo sapien
gaaggagccctggtacacttgtcca

SEQ ID NO: 344472 - DNA, 25 bp, Homo sapien
tgtccttcccgcatgccgtgggaga

SEQ ID NO: 344473 - DNA, 25 bp, Homo sapien
gttcccaggtcttatgctgttatca

SEQ ID NO: 344474 - DNA, 25 bp, Homo sapien
gattacaagttgcacagtcagcagg

SEQ ID NO: 344475 - DNA, 25 bp, Homo sapien
tttccagcaaatatcctgagtttcc

SEQ ID NO: 344476 - DNA, 25 bp, Homo sapien
tgagtttccagttagccatgcaggg

SEQ ID NO: 344477 - DNA, 25 bp, Homo sapien
acacagtcattttcatagtattcac

SEQ ID NO: 344478 - DNA, 25 bp, Homo sapien
agtattcactgtggtggctttcctc

SEQ ID NO: 344479 - DNA, 25 bp, Homo sapien
tttcctctggatcacatcccaggct

SEQ ID NO: 344480 - DNA, 25 bp, Homo sapien
cctgttggtatttgtggcggtcatc

SEQ ID NO: 344481 - DNA, 25 bp, Homo sapien
ggcggtcatcccagagtccaaggtt

SEQ ID NO: 344482 - DNA, 25 bp, Homo sapien
gtccaaggtttcttcttcgtcagaa

SEQ ID NO: 344483 - DNA, 25 bp, Homo sapien
tcgtcagaaagccttggttcctgtt

SEQ ID NO: 344484 - DNA, 25 bp, Homo sapien
cgactacggtggacaagggatgatt

SEQ ID NO: 344485 - DNA, 25 bp, Homo sapien
ttaattttcatccaaaaatctttgg

SEQ ID NO: 344486 - DNA, 25 bp, Homo sapien
atctttggtggattcccccggctct

SEQ ID NO: 344487 - DNA, 25 bp, Homo sapien
tccagctcaccagtctaacagtagt

SEQ ID NO: 344488 - DNA, 25 bp, Homo sapien
gctcaccagtctaacagtagtttaa

SEQ ID NO: 344489 - DNA, 25 bp, Homo sapien
acagaagatcagcaacgtttggaga

SEQ ID NO: 344490 - DNA, 25 bp, Homo sapien
gatcagcaacgtttggagagttttt

SEQ ID NO: 344491 - DNA, 25 bp, Homo sapien
gatttattcaattctattctgaggt

SEQ ID NO: 344492 - DNA, 25 bp, Homo sapien
tctattctgaggttgtctttctata

SEQ ID NO: 344493 - DNA, 25 bp, Homo sapien
tttgctttatacctcttggacactc

SEQ ID NO: 344494 - DNA, 25 bp, Homo sapien
ttggacactccttcgaaggactgga

SEQ ID NO: 344495 - DNA, 25 bp, Homo sapien
gatgaaatctgcaggtagacctaat

SEQ ID NO: 344496 - DNA, 25 bp, Homo sapien
atctgcaggtagacctaatttcaat

SEQ ID NO: 344497 - DNA, 25 bp, Homo sapien
ctaatttcaataggtgcaggataat

SEQ ID NO: 344498 - DNA, 25 bp, Homo sapien
gcaggataatataagctgaagccaa

SEQ ID NO: 344499 - DNA, 25 bp, Homo sapien
gaaaagaatattccggcagagctta

SEQ ID NO: 344500 - DNA, 25 bp, Homo sapien
gaatattccggcagagcttaggtct

SEQ ID NO: 344501 - DNA, 25 bp, Homo sapien
attccggcagagcttaggtctgtac

SEQ ID NO: 344502 - DNA, 25 bp, Homo sapien
agagcttaggtctgtacttcctgtg

SEQ ID NO: 344503 - DNA, 25 bp, Homo sapien
gtctgtacttcctgtgtctgggaaa

SEQ ID NO: 344504 - DNA, 25 bp, Homo sapien
aaatgtccagtgaacaaagaaacaa

SEQ ID NO: 344505 - DNA, 25 bp, Homo sapien
agcccagtgtggcagaaacttcatg

SEQ ID NO: 344506 - DNA, 25 bp, Homo sapien
agaatctctatttatgtctgacccc

SEQ ID NO: 344507 - DNA, 25 bp, Homo sapien
ctttaagctgcttatcagaggtgca

SEQ ID NO: 344508 - DNA, 25 bp, Homo sapien
tatcagaggtgcatgctgagagcat

SEQ ID NO: 344509 - DNA, 25 bp, Homo sapien
gaagatggagtcttccatccgctgg

SEQ ID NO: 344510 - DNA, 25 bp, Homo sapien
gtcttccatccgctggtaaaatctg

SEQ ID NO: 344511 - DNA, 25 bp, Homo sapien
ggtaaaatctggaatctgctctcat

SEQ ID NO: 344512 - DNA, 25 bp, Homo sapien
tggaatctgctctcatttcattttc

SEQ ID NO: 344513 - DNA, 25 bp, Homo sapien
aataaggtaacagaccctcaggtct

SEQ ID NO: 344514 - DNA, 25 bp, Homo sapien
agaccctcaggtctacctataagta

SEQ ID NO: 344515 - DNA, 25 bp, Homo sapien
tataagtaccttccaactgttccac

SEQ ID NO: 344516 - DNA, 25 bp, Homo sapien
catatgctgaaattcctatatcccc

SEQ ID NO: 344517 - DNA, 25 bp, Homo sapien
ttcactgggccatgggatctacatc

SEQ ID NO: 344518 - DNA, 25 bp, Homo sapien
tcactgggccatgggatctacatct

SEQ ID NO: 344519 - DNA, 25 bp, Homo sapien
actgggccatgggatctacatctcc

SEQ ID NO: 344520 - DNA, 25 bp, Homo sapien
ctgggccatgggatctacatctcct

SEQ ID NO: 344521 - DNA, 25 bp, Homo sapien
taaggagttaggcattaccttctgg

SEQ ID NO: 344522 - DNA, 25 bp, Homo sapien
aggagttaggcattaccttctggga

SEQ ID NO: 344523 - DNA, 25 bp, Homo sapien
ggagttaggcattaccttctgggag

SEQ ID NO: 344524 - DNA, 25 bp, Homo sapien
taccttctgggagtgaaccctgact

SEQ ID NO: 344525 - DNA, 25 bp, Homo sapien
accttctgggagtgaaccctgactc

SEQ ID NO: 344526 - DNA, 25 bp, Homo sapien
gaacccctgtgggagaggcttagac

SEQ ID NO: 344527 - DNA, 25 bp, Homo sapien
cctgtgggagaggcttagacctgaa

SEQ ID NO: 344528 - DNA, 25 bp, Homo sapien
ttcagtgacaacaatctccctgcta

SEQ ID NO: 344529 - DNA, 25 bp, Homo sapien
tgctacttcttgcatccttcacatc

SEQ ID NO: 344530 - DNA, 25 bp, Homo sapien
acatccctgtcttgtgtgtggtact

SEQ ID NO: 344531 - DNA, 25 bp, Homo sapien
gtgtggtacttcatgttttcttgcc

SEQ ID NO: 344532 - DNA, 25 bp, Homo sapien
tttcttgccaagactgtgttgatct

SEQ ID NO: 344533 - DNA, 25 bp, Homo sapien
gtgttgatcttcagatactctcttt

SEQ ID NO: 344534 - DNA, 25 bp, Homo sapien
agaaattcctgcagacatcctactc

SEQ ID NO: 344535 - DNA, 25 bp, Homo sapien
tcggccagcggtttacctgatagat

SEQ ID NO: 344536 - DNA, 25 bp, Homo sapien
agagaagagcctaggagcacagcga

SEQ ID NO: 344537 - DNA, 25 bp, Homo sapien
gggaatgaaccttacttgcacttta

SEQ ID NO: 344538 - DNA, 25 bp, Homo sapien
ttgcactttatgtatacttcctgat

SEQ ID NO: 344539 - DNA, 25 bp, Homo sapien
gaaggtacagaaacacttcttgctg

SEQ ID NO: 344540 - DNA, 25 bp, Homo sapien
aggtacagaaacacttcttgctggg

SEQ ID NO: 344541 - DNA, 25 bp, Homo sapien
ggtacagaaacacttcttgctgggt

SEQ ID NO: 344542 - DNA, 25 bp, Homo sapien
gtacagaaacacttcttgctgggta

SEQ ID NO: 344543 - DNA, 25 bp, Homo sapien
acagaaacacttcttgctgggtaga

SEQ ID NO: 344544 - DNA, 25 bp, Homo sapien
cagaaacacttcttgctgggtagag

SEQ ID NO: 344545 - DNA, 25 bp, Homo sapien
agaaacacttcttgctgggtagaga

SEQ ID NO: 344546 - DNA, 25 bp, Homo sapien
gaaacacttcttgctgggtagagac

SEQ ID NO: 344547 - DNA, 25 bp, Homo sapien
atgtatgttttggccagctgcagtg

SEQ ID NO: 344548 - DNA, 25 bp, Homo sapien
catggtagtgcggagctgtagtccc

SEQ ID NO: 344549 - DNA, 25 bp, Homo sapien
atggtagtgcggagctgtagtccca

SEQ ID NO: 344550 - DNA, 25 bp, Homo sapien
atacatatgtgagtctgaggcccaa

SEQ ID NO: 344551 - DNA, 25 bp, Homo sapien
gaggcccaaggatagaatactgtct

SEQ ID NO: 344552 - DNA, 25 bp, Homo sapien
gatagaatactgtctccaaccttag

SEQ ID NO: 344553 - DNA, 25 bp, Homo sapien
ccaaccttagccagctgtggccata

SEQ ID NO: 344554 - DNA, 25 bp, Homo sapien
agggaagtttccatgcttcttcagc

SEQ ID NO: 344555 - DNA, 25 bp, Homo sapien
tttccatgcttcttcagctgctttt

SEQ ID NO: 344556 - DNA, 25 bp, Homo sapien
tcagctgcttttctgaattaccaaa

SEQ ID NO: 344557 - DNA, 25 bp, Homo sapien
ttaccaaatcactcctgacaacaca

SEQ ID NO: 344558 - DNA, 25 bp, Homo sapien
gacaacacatattctgccacatgaa

SEQ ID NO: 344559 - DNA, 25 bp, Homo sapien
ctgccacatgaagacgaactagaat

SEQ ID NO: 344560 - DNA, 25 bp, Homo sapien
gaagacgaactagaatcaatctgat

SEQ ID NO: 344561 - DNA, 25 bp, Homo sapien
ggatggttacatccgtattgaacat

SEQ ID NO: 344562 - DNA, 25 bp, Homo sapien
acatccgtattgaacatgtacagac

SEQ ID NO: 344563 - DNA, 25 bp, Homo sapien
tctctgaacaatacaagaactcttt

SEQ ID NO: 344564 - DNA, 25 bp, Homo sapien
acaagaactctttatgtagcattta

SEQ ID NO: 344565 - DNA, 25 bp, Homo sapien
agttatatgcaaattctgtaccatt

SEQ ID NO: 344566 - DNA, 25 bp, Homo sapien
gtatcagggaattgagcatcttcag

SEQ ID NO: 344567 - DNA, 25 bp, Homo sapien
tgagcatcttcagatgttggtatct

SEQ ID NO: 344568 - DNA, 25 bp, Homo sapien
agatgttggtatctgcagggatcct

SEQ ID NO: 344569 - DNA, 25 bp, Homo sapien
ggatcctggaaccaaacccctgcag

SEQ ID NO: 344570 - DNA, 25 bp, Homo sapien
aacccctgcagatactaagggctga

SEQ ID NO: 344571 - DNA, 25 bp, Homo sapien
taagggctgacgatctaggtaagac

SEQ ID NO: 344572 - DNA, 25 bp, Homo sapien
ccctgcacttagttgctactcaata

SEQ ID NO: 344573 - DNA, 25 bp, Homo sapien
tttgcagagggacagattgacacat

SEQ ID NO: 344574 - DNA, 25 bp, Homo sapien
gtaaatgttaccagctctctgcaat

SEQ ID NO: 344575 - DNA, 25 bp, Homo sapien
gttaccagctctctgcaatgcagca

SEQ ID NO: 344576 - DNA, 25 bp, Homo sapien
aatgcagcacattgaccttccctag

SEQ ID NO: 344577 - DNA, 25 bp, Homo sapien
atactttgcatatctctgttaccca

SEQ ID NO: 344578 - DNA, 25 bp, Homo sapien
tgcatatctctgttacccaggtaac

SEQ ID NO: 344579 - DNA, 25 bp, Homo sapien
ctttgtatttgacatccctgcaaac

SEQ ID NO: 344580 - DNA, 25 bp, Homo sapien
acatccctgcaaacttgggtgggca

SEQ ID NO: 344581 - DNA, 25 bp, Homo sapien
ttcactgaagtatttctatgtctag

SEQ ID NO: 344582 - DNA, 25 bp, Homo sapien
tatgtctagaattgtgccctgcact

SEQ ID NO: 344583 - DNA, 25 bp, Homo sapien
gcccacggctgtgtctgcaaaggga

SEQ ID NO: 344584 - DNA, 25 bp, Homo sapien
gtctgcaaagggacgttggagaact

SEQ ID NO: 344585 - DNA, 25 bp, Homo sapien
aaagggacgttggagaactgcagct

SEQ ID NO: 344586 - DNA, 25 bp, Homo sapien
cgttggagaactgcagctgctgtgc

SEQ ID NO: 344587 - DNA, 25 bp, Homo sapien
tgcctgatgtgggaacagctcttct

SEQ ID NO: 344588 - DNA, 25 bp, Homo sapien
aacagctcttctcccagatgttaat

SEQ ID NO: 344589 - DNA, 25 bp, Homo sapien
gaacaagctgcacaacctggatttt

SEQ ID NO: 344590 - DNA, 25 bp, Homo sapien
tttttcaatacgatactgagccatt

SEQ ID NO: 344591 - DNA, 25 bp, Homo sapien
tttcaatacgatactgagccatttg

SEQ ID NO: 344592 - DNA, 25 bp, Homo sapien
ttcaatacgatactgagccatttgc

SEQ ID NO: 344593 - DNA, 25 bp, Homo sapien
tcaatacgatactgagccatttgct

SEQ ID NO: 344594 - DNA, 25 bp, Homo sapien
gtagaaaggttctggtgaagaagct

SEQ ID NO: 344595 - DNA, 25 bp, Homo sapien
gaaggagatataactttgccctatt

SEQ ID NO: 344596 - DNA, 25 bp, Homo sapien
tggaggacttttacaggcagtagag

SEQ ID NO: 344597 - DNA, 25 bp, Homo sapien
caggcagtagagatgtttccatagc

SEQ ID NO: 344598 - DNA, 25 bp, Homo sapien
gtttccatagctggatttctgagcc

SEQ ID NO: 344599 - DNA, 25 bp, Homo sapien
gatttctgagccattacgttgtggt

SEQ ID NO: 344600 - DNA, 25 bp, Homo sapien
gccattacgttgtggttgggaacct

SEQ ID NO: 344601 - DNA, 25 bp, Homo sapien
ggaacctttcttttgtagtatactg

SEQ ID NO: 344602 - DNA, 25 bp, Homo sapien
gaagataagctgtgtttctctactg

SEQ ID NO: 344603 - DNA, 25 bp, Homo sapien
ataagctgtgtttctctactgggct

SEQ ID NO: 344604 - DNA, 25 bp, Homo sapien
tctctactgggctggcaaaaatatt

SEQ ID NO: 344605 - DNA, 25 bp, Homo sapien
aattttgtaatatggattagtggcc

SEQ ID NO: 344606 - DNA, 25 bp, Homo sapien
attttgtaatatggattagtggccg

SEQ ID NO: 344607 - DNA, 25 bp, Homo sapien
ttttgtaatatggattagtggccgg

SEQ ID NO: 344608 - DNA, 25 bp, Homo sapien
tttgtaatatggattagtggccggg

SEQ ID NO: 344609 - DNA, 25 bp, Homo sapien
ttgtaatatggattagtggccgggc

SEQ ID NO: 344610 - DNA, 25 bp, Homo sapien
tgtaatatggattagtggccgggcg

SEQ ID NO: 344611 - DNA, 25 bp, Homo sapien
gtaatatggattagtggccgggcgc

SEQ ID NO: 344612 - DNA, 25 bp, Homo sapien
taatatggattagtggccgggcgca

SEQ ID NO: 344613 - DNA, 25 bp, Homo sapien
aatatggattagtggccgggcgcag

SEQ ID NO: 344614 - DNA, 25 bp, Homo sapien
atatggattagtggccgggcgcagt

SEQ ID NO: 344615 - DNA, 25 bp, Homo sapien
tatggattagtggccgggcgcagtg

SEQ ID NO: 344616 - DNA, 25 bp, Homo sapien
aggccctccaaatgattttgctgca

SEQ ID NO: 344617 - DNA, 25 bp, Homo sapien
attactgctttagaattttgtcatc

SEQ ID NO: 344618 - DNA, 25 bp, Homo sapien
atgacaaagttctcagtgtgatttc

SEQ ID NO: 344619 - DNA, 25 bp, Homo sapien
gtgtgatttctgctataagctattt

SEQ ID NO: 344620 - DNA, 25 bp, Homo sapien
aatattaatagttcatcagctggga

SEQ ID NO: 344621 - DNA, 25 bp, Homo sapien
tcagctgggaagactaggactacgg

SEQ ID NO: 344622 - DNA, 25 bp, Homo sapien
ggactacggttacctaacatcctga

SEQ ID NO: 344623 - DNA, 25 bp, Homo sapien
acggttacctaacatcctgagatgt

SEQ ID NO: 344624 - DNA, 25 bp, Homo sapien
acttgaatttccctctggtcagagt

SEQ ID NO: 344625 - DNA, 25 bp, Homo sapien
gagtttttgactctgtggtttctga

SEQ ID NO: 344626 - DNA, 25 bp, Homo sapien
ggtttctgagaatggctgtttaaaa

SEQ ID NO: 344627 - DNA, 25 bp, Homo sapien
agatgttggtatctgcagggatcct

SEQ ID NO: 344628 - DNA, 25 bp, Homo sapien
ggatcctggaaccaaacccctgcag

SEQ ID NO: 344629 - DNA, 25 bp, Homo sapien
atcctggaaccaaacccctgcagat

SEQ ID NO: 344630 - DNA, 25 bp, Homo sapien
ggaaccaaacccctgcagatactaa

SEQ ID NO: 344631 - DNA, 25 bp, Homo sapien
gaaccaaacccctgcagatactaag

SEQ ID NO: 344632 - DNA, 25 bp, Homo sapien
aaacccctgcagatactaagggctg

SEQ ID NO: 344633 - DNA, 25 bp, Homo sapien
ctgcagatactaagggctgacgatc

SEQ ID NO: 344634 - DNA, 25 bp, Homo sapien
gatactaagggctgacgatctaggt

SEQ ID NO: 344635 - DNA, 25 bp, Homo sapien
tactaagggctgacgatctaggtaa

SEQ ID NO: 344636 - DNA, 25 bp, Homo sapien
taagggctgacgatctaggtaagac

SEQ ID NO: 344637 - DNA, 25 bp, Homo sapien
aagggctgacgatctaggtaagact

SEQ ID NO: 344638 - DNA, 25 bp, Homo sapien
gttcccccggcttttgctggagact

SEQ ID NO: 344639 - DNA, 25 bp, Homo sapien
tgctggagactcatcgctttgggaa

SEQ ID NO: 344640 - DNA, 25 bp, Homo sapien
ctggagactcatcgctttgggaagt

SEQ ID NO: 344641 - DNA, 25 bp, Homo sapien
agactcatcgctttgggaagtgcat

SEQ ID NO: 344642 - DNA, 25 bp, Homo sapien
atcgctttgggaagtgcatttgctt

SEQ ID NO: 344643 - DNA, 25 bp, Homo sapien
gctttgggaagtgcatttgcttcgt

SEQ ID NO: 344644 - DNA, 25 bp, Homo sapien
acagtcactctctctgagcgcgtct

SEQ ID NO: 344645 - DNA, 25 bp, Homo sapien
gagcctgctgaatcctgtcctcgcg

SEQ ID NO: 344646 - DNA, 25 bp, Homo sapien
tgaatcctgtcctcgcggctcggga

SEQ ID NO: 344647 - DNA, 25 bp, Homo sapien
ccggagcccaggagcgctcaggatc

SEQ ID NO: 344648 - DNA, 25 bp, Homo sapien
tcaggatcccgagcgccgcgaaaaa

SEQ ID NO: 344649 - DNA, 25 bp, Homo sapien
tcagcccgtcctccagtgttttcat

SEQ ID NO: 344650 - DNA, 25 bp, Homo sapien
gcccgatttggttcaattaaagttg

SEQ ID NO: 344651 - DNA, 25 bp, Homo sapien
tgaccagtatttgttccgagcttag

SEQ ID NO: 344652 - DNA, 25 bp, Homo sapien
tccgagcttaggaagtacttggcca

SEQ ID NO: 344653 - DNA, 25 bp, Homo sapien
agtacttggccaggccatgcgaggc

SEQ ID NO: 344654 - DNA, 25 bp, Homo sapien
gccatgcgaggcctatatgagaaga

SEQ ID NO: 344655 - DNA, 25 bp, Homo sapien
gaatgctaagttcatctgcaagaca

SEQ ID NO: 344656 - DNA, 25 bp, Homo sapien
aagacagacatacagcatctactct

SEQ ID NO: 344657 - DNA, 25 bp, Homo sapien
cagcctcttggcgttttgtctgacg

SEQ ID NO: 344658 - DNA, 25 bp, Homo sapien
tgtctgacgcctcttttgtgtcgga

SEQ ID NO: 344659 - DNA, 25 bp, Homo sapien
ttgtgtcggactcgacgctttcagc

SEQ ID NO: 344660 - DNA, 25 bp, Homo sapien
gtcttcagtgcagagctctgtcccc

SEQ ID NO: 344661 - DNA, 25 bp, Homo sapien
tcttcagtgcagagctctgtcccca

SEQ ID NO: 344662 - DNA, 25 bp, Homo sapien
cttcagtgcagagctctgtccccat

SEQ ID NO: 344663 - DNA, 25 bp, Homo sapien
ttcagtgcagagctctgtccccatg

SEQ ID NO: 344664 - DNA, 25 bp, Homo sapien
tcagtgcagagctctgtccccatga

SEQ ID NO: 344665 - DNA, 25 bp, Homo sapien
cagtgcagagctctgtccccatgag

SEQ ID NO: 344666 - DNA, 25 bp, Homo sapien
agtgcagagctctgtccccatgagg

SEQ ID NO: 344667 - DNA, 25 bp, Homo sapien
gtgcagagctctgtccccatgagga

SEQ ID NO: 344668 - DNA, 25 bp, Homo sapien
tgcagagctctgtccccatgaggag

SEQ ID NO: 344669 - DNA, 25 bp, Homo sapien
gcagagctctgtccccatgaggagg

SEQ ID NO: 344670 - DNA, 25 bp, Homo sapien
ccaagggtgactgaggctgcagctg

SEQ ID NO: 344671 - DNA, 25 bp, Homo sapien
agcaatttaccatagtttgggcttt

SEQ ID NO: 344672 - DNA, 25 bp, Homo sapien
tttaccatagtttgggctttagtat

SEQ ID NO: 344673 - DNA, 25 bp, Homo sapien
ttggatgtacagtagttttatttcc

SEQ ID NO: 344674 - DNA, 25 bp, Homo sapien
ttccacagccacattaccatagcaa

SEQ ID NO: 344675 - DNA, 25 bp, Homo sapien
acagccacattaccatagcaataag

SEQ ID NO: 344676 - DNA, 25 bp, Homo sapien
aaggaggcatagtacatagttggaa

SEQ ID NO: 344677 - DNA, 25 bp, Homo sapien
tacatagttggaaaagctttgtggg

SEQ ID NO: 344678 - DNA, 25 bp, Homo sapien
gcactgttgtgtttaacactagttc

SEQ ID NO: 344679 - DNA, 25 bp, Homo sapien
acactagttcagatgcagttacctt

SEQ ID NO: 344680 - DNA, 25 bp, Homo sapien
gttcagatgcagttaccttagagac

SEQ ID NO: 344681 - DNA, 25 bp, Homo sapien
gatgcagttaccttagagacttatt

SEQ ID NO: 344682 - DNA, 25 bp, Homo sapien
ccagtccactgaagacgtcgctgtg

SEQ ID NO: 344683 - DNA, 25 bp, Homo sapien
gtccactgaagacgtcgctgtgcca

SEQ ID NO: 344684 - DNA, 25 bp, Homo sapien
tgaagacgtcgctgtgccactgtcc

SEQ ID NO: 344685 - DNA, 25 bp, Homo sapien
gctgtgccactgtcccttgtaggtg

SEQ ID NO: 344686 - DNA, 25 bp, Homo sapien
cactgtcccttgtaggtggagccgt

SEQ ID NO: 344687 - DNA, 25 bp, Homo sapien
ctgtcccttgtaggtggagccgtcg

SEQ ID NO: 344688 - DNA, 25 bp, Homo sapien
aggtggagccgtcggcgcagcgcag

SEQ ID NO: 344689 - DNA, 25 bp, Homo sapien
agtcgccgtcgtacttgtcaccgtt

SEQ ID NO: 344690 - DNA, 25 bp, Homo sapien
gtcgtacttgtcaccgttctgaaag

SEQ ID NO: 344691 - DNA, 25 bp, Homo sapien
gtacttgtcaccgttctgaaagagc

SEQ ID NO: 344692 - DNA, 25 bp, Homo sapien
tgtcaccgttctgaaagagcatctg

SEQ ID NO: 344693 - DNA, 25 bp, Homo sapien
gctacaatcagtggaaatgcttagt

SEQ ID NO: 344694 - DNA, 25 bp, Homo sapien
caatcagtggaaatgcttagtaact

SEQ ID NO: 344695 - DNA, 25 bp, Homo sapien
cagtggaaatgcttagtaactatat

SEQ ID NO: 344696 - DNA, 25 bp, Homo sapien
gtaactatattacatatcctttaaa

SEQ ID NO: 344697 - DNA, 25 bp, Homo sapien
tacatatcctttaaaatacctctaa

SEQ ID NO: 344698 - DNA, 25 bp, Homo sapien
taaaatacctctaaagtcatttgag

SEQ ID NO: 344699 - DNA, 25 bp, Homo sapien
gtaatagacattagaaaatccttca

SEQ ID NO: 344700 - DNA, 25 bp, Homo sapien
aaaatccttcagctacaatcagtgg

SEQ ID NO: 344701 - DNA, 25 bp, Homo sapien
aatccttcagctacaatcagtggaa

SEQ ID NO: 344702 - DNA, 25 bp, Homo sapien
tccttcagctacaatcagtggaaat

SEQ ID NO: 344703 - DNA, 25 bp, Homo sapien
cttcagctacaatcagtggaaatgc

SEQ ID NO: 344704 - DNA, 25 bp, Homo sapien
cagagatggtttcccctgacttaga

SEQ ID NO: 344705 - DNA, 25 bp, Homo sapien
gtttcccctgacttagacaattgtg

SEQ ID NO: 344706 - DNA, 25 bp, Homo sapien
gattgagtctcagaattgttcttta

SEQ ID NO: 344707 - DNA, 25 bp, Homo sapien
gttctttaatcctcagtatttccat

SEQ ID NO: 344708 - DNA, 25 bp, Homo sapien
aagagcttctatcaagtgcttcaaa

SEQ ID NO: 344709 - DNA, 25 bp, Homo sapien
gactccctgctggtgagcgaagtgt

SEQ ID NO: 344710 - DNA, 25 bp, Homo sapien
gaagtgtggaggacacaggtccctc

SEQ ID NO: 344711 - DNA, 25 bp, Homo sapien
tggatgctgcactgtttggcctgag

SEQ ID NO: 344712 - DNA, 25 bp, Homo sapien
ttggcctgagccaacatgggcagaa

SEQ ID NO: 344713 - DNA, 25 bp, Homo sapien
aatacaggcggcagcataagcagat

SEQ ID NO: 344714 - DNA, 25 bp, Homo sapien
aagaacctgtcttgcttctactgtt

SEQ ID NO: 344715 - DNA, 25 bp, Homo sapien
agggcacacgcactctgcgtctgaa

SEQ ID NO: 344716 - DNA, 25 bp, Homo sapien
caaagcccagcagagacgtgggcgc

SEQ ID NO: 344717 - DNA, 25 bp, Homo sapien
gtgggcgcgcgtttatctggaggag

SEQ ID NO: 344718 - DNA, 25 bp, Homo sapien
tatctggaggagaccaggcgcgcca

SEQ ID NO: 344719 - DNA, 25 bp, Homo sapien
accaggcgcgccatggttggctctg

SEQ ID NO: 344720 - DNA, 25 bp, Homo sapien
ggccaccccaagtcaccaaaagagg

SEQ ID NO: 344721 - DNA, 25 bp, Homo sapien
gtgtccagattcaaatgtactgttt

SEQ ID NO: 344722 - DNA, 25 bp, Homo sapien
tttaaactacattagcactttctgc

SEQ ID NO: 344723 - DNA, 25 bp, Homo sapien
gccctgtggcctgcaatgattgtgc

SEQ ID NO: 344724 - DNA, 25 bp, Homo sapien
gtggcctgcaatgattgtgctgtga

SEQ ID NO: 344725 - DNA, 25 bp, Homo sapien
gcaatgattgtgctgtgattattca

SEQ ID NO: 344726 - DNA, 25 bp, Homo sapien
tattttgctctattacaagttgtgt

SEQ ID NO: 344727 - DNA, 25 bp, Homo sapien
tacaagttgtgtagtcttcaataat

SEQ ID NO: 344728 - DNA, 25 bp, Homo sapien
gtgtagtcttcaataatttacttgt

SEQ ID NO: 344729 - DNA, 25 bp, Homo sapien
aatttacttgttccttttggtgatg

SEQ ID NO: 344730 - DNA, 25 bp, Homo sapien
ttccttttggtgatgaacattgaat

SEQ ID NO: 344731 - DNA, 25 bp, Homo sapien
attgaattcattcctactctttttt

SEQ ID NO: 344732 - DNA, 25 bp, Homo sapien
gaaaggaactgtagcatctgaagat

SEQ ID NO: 344733 - DNA, 25 bp, Homo sapien
agggccagtgtgacatagtgaaaag

SEQ ID NO: 344734 - DNA, 25 bp, Homo sapien
agtgagttgaatgtaagaagaccca

SEQ ID NO: 344735 - DNA, 25 bp, Homo sapien
gacccacatgttaagtcttattttg

SEQ ID NO: 344736 - DNA, 25 bp, Homo sapien
aagtcttattttgctctattacaag

SEQ ID NO: 344737 - DNA, 25 bp, Homo sapien
gaggaccaggtcattgttttaacac

SEQ ID NO: 344738 - DNA, 25 bp, Homo sapien
gcaaatgttctgcagttaattgggc

SEQ ID NO: 344739 - DNA, 25 bp, Homo sapien
aattgggcactatcactttgaaacc

SEQ ID NO: 344740 - DNA, 25 bp, Homo sapien
ggcagcagcacagattcttctgtct

SEQ ID NO: 344741 - DNA, 25 bp, Homo sapien
aaagcaccagcatggaagtgtacaa

SEQ ID NO: 344742 - DNA, 25 bp, Homo sapien
gtgtacaagtttattctagtgttgc

SEQ ID NO: 344743 - DNA, 25 bp, Homo sapien
tctagtgttgctgggttattgtgga

SEQ ID NO: 344744 - DNA, 25 bp, Homo sapien
aaatgtgcctcacttgggagaattt

SEQ ID NO: 344745 - DNA, 25 bp, Homo sapien
attcttctgtcttttatccacagca

SEQ ID NO: 344746 - DNA, 25 bp, Homo sapien
aaaaatacccagcagtgacaacatc

SEQ ID NO: 344747 - DNA, 25 bp, Homo sapien
aacatccagtgctgatgggcaggca

SEQ ID NO: 344748 - DNA, 25 bp, Homo sapien
gtattgtgtgcttttccttactaaa

SEQ ID NO: 344749 - DNA, 25 bp, Homo sapien
tgagtagggccagatgagctgtata

SEQ ID NO: 344750 - DNA, 25 bp, Homo sapien
atagtgtttatgatagagagaccaa

SEQ ID NO: 344751 - DNA, 25 bp, Homo sapien
gtaagcacttaatagctttccttat

SEQ ID NO: 344752 - DNA, 25 bp, Homo sapien
atagctttccttatttacaagtcag

SEQ ID NO: 344753 - DNA, 25 bp, Homo sapien
tacaagtcagattcatctaagggat

SEQ ID NO: 344754 - DNA, 25 bp, Homo sapien
gtcagattcatctaagggatatttt

SEQ ID NO: 344755 - DNA, 25 bp, Homo sapien
ttcttttatttttctggtgcttgaa

SEQ ID NO: 344756 - DNA, 25 bp, Homo sapien
gaggatacacagtgacacaaaattt

SEQ ID NO: 344757 - DNA, 25 bp, Homo sapien
gcagagtggattaagcttttctttt

SEQ ID NO: 344758 - DNA, 25 bp, Homo sapien
ttttctttttcaaggctctgcaaca

SEQ ID NO: 344759 - DNA, 25 bp, Homo sapien
aaatgtccaggagccataatctaga

SEQ ID NO: 344760 - DNA, 25 bp, Homo sapien
taatctagaacatccaagtccttga

SEQ ID NO: 344761 - DNA, 25 bp, Homo sapien
caagtccttgaccaacagtttcctt

SEQ ID NO: 344762 - DNA, 25 bp, Homo sapien
gtttccttaagtacagtgagcctca

SEQ ID NO: 344763 - DNA, 25 bp, Homo sapien
gtgagcctcagctagacagatcctg

SEQ ID NO: 344764 - DNA, 25 bp, Homo sapien
gaacaagctcaggaaattctccttt

SEQ ID NO: 344765 - DNA, 25 bp, Homo sapien
tcaggaaattctcctttctttacca

SEQ ID NO: 344766 - DNA, 25 bp, Homo sapien
ttctttaccacccaaggctttgccg

SEQ ID NO: 344767 - DNA, 25 bp, Homo sapien
gcaaagttcccagtattcttgtcac

SEQ ID NO: 344768 - DNA, 25 bp, Homo sapien
gtattcttgtcactaatttctttcc

SEQ ID NO: 344769 - DNA, 25 bp, Homo sapien
agttataggcttggctgttctctgt

SEQ ID NO: 344770 - DNA, 25 bp, Homo sapien
aaccatccattgtatctctcgcttt

SEQ ID NO: 344771 - DNA, 25 bp, Homo sapien
gtatctctcgcttttactgttctgc

SEQ ID NO: 344772 - DNA, 25 bp, Homo sapien
agttgtcacaaatcacctgcagatg

SEQ ID NO: 344773 - DNA, 25 bp, Homo sapien
tgtgtactgtacgttcctggtgcta

SEQ ID NO: 344774 - DNA, 25 bp, Homo sapien
aacaggcttgttgttttcagcgctt

SEQ ID NO: 344775 - DNA, 25 bp, Homo sapien
gcgctttgcctctggtgtgtaggac

SEQ ID NO: 344776 - DNA, 25 bp, Homo sapien
ggacggcaacacacaaccagtttgt

SEQ ID NO: 344777 - DNA, 25 bp, Homo sapien
atgtgctaggacgtcttccattgat

SEQ ID NO: 344778 - DNA, 25 bp, Homo sapien
attgattatggtgtgcgtgggctcc

SEQ ID NO: 344779 - DNA, 25 bp, Homo sapien
tcccgcacctgtgagtttcaggtag

SEQ ID NO: 344780 - DNA, 25 bp, Homo sapien
tcaggtagacgttcatattttcact

SEQ ID NO: 344781 - DNA, 25 bp, Homo sapien
gttgactctccactaaacagtatta

SEQ ID NO: 344782 - DNA, 25 bp, Homo sapien
agtattataacgatcagctgaagaa

SEQ ID NO: 344783 - DNA, 25 bp, Homo sapien
aagttttcagctattgcccaatgca

SEQ ID NO: 344784 - DNA, 25 bp, Homo sapien
attttaatccccaaatagcagtata

SEQ ID NO: 344785 - DNA, 25 bp, Homo sapien
aatttcctgatgataacattttcat

SEQ ID NO: 344786 - DNA, 25 bp, Homo sapien
tagttaatcatctcctgaacaggtt

SEQ ID NO: 344787 - DNA, 25 bp, Homo sapien
tcctgaacaggttggttcccagaaa

SEQ ID NO: 344788 - DNA, 25 bp, Homo sapien
ccactcagtgttgttgtagatctca

SEQ ID NO: 344789 - DNA, 25 bp, Homo sapien
atgaaaatccatccctaagtaatag

SEQ ID NO: 344790 - DNA, 25 bp, Homo sapien
gattatcagtcagttgactctccac

SEQ ID NO: 344791 - DNA, 25 bp, Homo sapien
gtcagttgactctccactaaacagt

SEQ ID NO: 344792 - DNA, 25 bp, Homo sapien
aactgcatcaaaataatccagggag

SEQ ID NO: 344793 - DNA, 25 bp, Homo sapien
gaactaataatctggtgtggcaata

SEQ ID NO: 344794 - DNA, 25 bp, Homo sapien
aatctggtgtggcaatagaccgaat

SEQ ID NO: 344795 - DNA, 25 bp, Homo sapien
gaccgaataatattaaccatagttg

SEQ ID NO: 344796 - DNA, 25 bp, Homo sapien
ttgaagttggatgatgggtccatac

SEQ ID NO: 344797 - DNA, 25 bp, Homo sapien
tgatgggtccatacagttctctcaa

SEQ ID NO: 344798 - DNA, 25 bp, Homo sapien
ggtccatacagttctctcaacttaa

SEQ ID NO: 344799 - DNA, 25 bp, Homo sapien
gttctctcaacttaattctaggtta

SEQ ID NO: 344800 - DNA, 25 bp, Homo sapien
gattgtaacaatatgcgagagccaa

SEQ ID NO: 344801 - DNA, 25 bp, Homo sapien
gaggtgtatgaaaccttctctacat

SEQ ID NO: 344802 - DNA, 25 bp, Homo sapien
aataatatgatgtccagaaactgca

SEQ ID NO: 344803 - DNA, 25 bp, Homo sapien
ctcaatttagatcaagggttatttc

SEQ ID NO: 344804 - DNA, 25 bp, Homo sapien
gaaaagattttaactccgagacagg

SEQ ID NO: 344805 - DNA, 25 bp, Homo sapien
gagacaggagtctttcagtgctgaa

SEQ ID NO: 344806 - DNA, 25 bp, Homo sapien
agtgctgaatttttagactgtaaat

SEQ ID NO: 344807 - DNA, 25 bp, Homo sapien
gactgtaaatgagttcttcttaact

SEQ ID NO: 344808 - DNA, 25 bp, Homo sapien
ttcttcttaacttagctgtttccct

SEQ ID NO: 344809 - DNA, 25 bp, Homo sapien
tgtgacttctgtgttagccatctta

SEQ ID NO: 344810 - DNA, 25 bp, Homo sapien
tctgtgttagccatcttatttcttt

SEQ ID NO: 344811 - DNA, 25 bp, Homo sapien
tctcaaatgctgtcatgcggaaacg

SEQ ID NO: 344812 - DNA, 25 bp, Homo sapien
gctgtcatgcggaaacgtatgaaac

SEQ ID NO: 344813 - DNA, 25 bp, Homo sapien
aaacagatgaagaatgactgaccca

SEQ ID NO: 344814 - DNA, 25 bp, Homo sapien
actgactcacagtatccgactatat

SEQ ID NO: 344815 - DNA, 25 bp, Homo sapien
taaagtcgagtgctctcatgccagg

SEQ ID NO: 344816 - DNA, 25 bp, Homo sapien
tcatgccaggaagctgatacagttc

SEQ ID NO: 344817 - DNA, 25 bp, Homo sapien
gatacagttcatgaaacctcagtca

SEQ ID NO: 344818 - DNA, 25 bp, Homo sapien
aaacctcagtcattctttcgtatta

SEQ ID NO: 344819 - DNA, 25 bp, Homo sapien
tttcgtattactcctgtcttctctt

SEQ ID NO: 344820 - DNA, 25 bp, Homo sapien
aatctcatgaatttggtcttgacgc

SEQ ID NO: 344821 - DNA, 25 bp, Homo sapien
aatttggtcttgacgctgacttaac

SEQ ID NO: 344822 - DNA, 25 bp, Homo sapien
gacgctgacttaacatcccaggaaa

SEQ ID NO: 344823 - DNA, 25 bp, Homo sapien
gacttaaatgtaatatggctctggc

SEQ ID NO: 344824 - DNA, 25 bp, Homo sapien
ggctctggcaaattctgagatgcta

SEQ ID NO: 344825 - DNA, 25 bp, Homo sapien
attaaaatgccatgaatcaagccag

SEQ ID NO: 344826 - DNA, 25 bp, Homo sapien
aatgccatgaatcaagccagggccg

SEQ ID NO: 344827 - DNA, 25 bp, Homo sapien
atgccatgaatcaagccagggccgt

SEQ ID NO: 344828 - DNA, 25 bp, Homo sapien
tgccatgaatcaagccagggccgtt

SEQ ID NO: 344829 - DNA, 25 bp, Homo sapien
gccatgaatcaagccagggccgttg

SEQ ID NO: 344830 - DNA, 25 bp, Homo sapien
ccatgaatcaagccagggccgttgg

SEQ ID NO: 344831 - DNA, 25 bp, Homo sapien
actttgcaggccgaggtagacagat

SEQ ID NO: 344832 - DNA, 25 bp, Homo sapien
ctttgcaggccgaggtagacagatg

SEQ ID NO: 344833 - DNA, 25 bp, Homo sapien
ccgaggtagacagatggcttgagct

SEQ ID NO: 344834 - DNA, 25 bp, Homo sapien
gagcccaggaggattacttcaacct

SEQ ID NO: 344835 - DNA, 25 bp, Homo sapien
agctgtgtttcgccactgcacacca

SEQ ID NO: 344836 - DNA, 25 bp, Homo sapien
tgtatactggtgattacccttgagt

SEQ ID NO: 344837 - DNA, 25 bp, Homo sapien
gtatactggtgattacccttgagtt

SEQ ID NO: 344838 - DNA, 25 bp, Homo sapien
atactggtgattacccttgagtttt

SEQ ID NO: 344839 - DNA, 25 bp, Homo sapien
ctggtgattacccttgagttttaca

SEQ ID NO: 344840 - DNA, 25 bp, Homo sapien
tggtgattacccttgagttttacat

SEQ ID NO: 344841 - DNA, 25 bp, Homo sapien
ggtgattacccttgagttttacatt

SEQ ID NO: 344842 - DNA, 25 bp, Homo sapien
gtgattacccttgagttttacatta

SEQ ID NO: 344843 - DNA, 25 bp, Homo sapien
gattacccttgagttttacattaag

SEQ ID NO: 344844 - DNA, 25 bp, Homo sapien
tacccttgagttttacattaagact

SEQ ID NO: 344845 - DNA, 25 bp, Homo sapien
cattaagacttgaaacaggccgggt

SEQ ID NO: 344846 - DNA, 25 bp, Homo sapien
aaacaggccgggtgtagcggctcat

SEQ ID NO: 344847 - DNA, 25 bp, Homo sapien
gcagacaaagggtcacctcccagtt

SEQ ID NO: 344848 - DNA, 25 bp, Homo sapien
cccagacagcctcaagactttgttc

SEQ ID NO: 344849 - DNA, 25 bp, Homo sapien
aagactttgttctcccagaactcga

SEQ ID NO: 344850 - DNA, 25 bp, Homo sapien
gttctcccagaactcgatgacaggg

SEQ ID NO: 344851 - DNA, 25 bp, Homo sapien
tcagcaagctggtcacaggtgaggt

SEQ ID NO: 344852 - DNA, 25 bp, Homo sapien
gcattggcacagtcttcatggcgga

SEQ ID NO: 344853 - DNA, 25 bp, Homo sapien
tcatggcggaagatctccacgcagt

SEQ ID NO: 344854 - DNA, 25 bp, Homo sapien
ccacgcagtcgggagtgttccaggt

SEQ ID NO: 344855 - DNA, 25 bp, Homo sapien
cagcgtggtggtaaaggacttgacc

SEQ ID NO: 344856 - DNA, 25 bp, Homo sapien
accaggtaatagaagccccaggcca

SEQ ID NO: 344857 - DNA, 25 bp, Homo sapien
ccaggccagcaccatgatgtagtag

SEQ ID NO: 344858 - DNA, 25 bp, Homo sapien
gccccaggcagagtacaagctcatt

SEQ ID NO: 344859 - DNA, 25 bp, Homo sapien
caagctcatttttctcggtggttat

SEQ ID NO: 344860 - DNA, 25 bp, Homo sapien
ggttattctgatatcccattttggt

SEQ ID NO: 344861 - DNA, 25 bp, Homo sapien
ggtgtgtcataatacttcaaactgg

SEQ ID NO: 344862 - DNA, 25 bp, Homo sapien
aaagtcacctggtcgagtctaggga

SEQ ID NO: 344863 - DNA, 25 bp, Homo sapien
tggaagggtctctgcttctgtacaa

SEQ ID NO: 344864 - DNA, 25 bp, Homo sapien
aaaatgtaacctgccttccttcaat

SEQ ID NO: 344865 - DNA, 25 bp, Homo sapien
ccttccttcaatcccatatttggta

SEQ ID NO: 344866 - DNA, 25 bp, Homo sapien
acatgtttggtgttctctgacctgt

SEQ ID NO: 344867 - DNA, 25 bp, Homo sapien
gggattcctggtctgtaacttgaat

SEQ ID NO: 344868 - DNA, 25 bp, Homo sapien
gtttcttccacatgttcttaagtac

SEQ ID NO: 344869 - DNA, 25 bp, Homo sapien
gggattgtactagggtttcttctgg

SEQ ID NO: 344870 - DNA, 25 bp, Homo sapien
cacctagcacaatacctgacataga

SEQ ID NO: 344871 - DNA, 25 bp, Homo sapien
gtttactaatagattcccagaggat

SEQ ID NO: 344872 - DNA, 25 bp, Homo sapien
ccagaggataccttgatctcaccaa

SEQ ID NO: 344873 - DNA, 25 bp, Homo sapien
ttgatctcaccaagctatttgccag

SEQ ID NO: 344874 - DNA, 25 bp, Homo sapien
gctatttgccagaatgtctcctgat

SEQ ID NO: 344875 - DNA, 25 bp, Homo sapien
atgtctcctgatggcctcattgaag

SEQ ID NO: 344876 - DNA, 25 bp, Homo sapien
tatgagccagatgctggtgccctga

SEQ ID NO: 344877 - DNA, 25 bp, Homo sapien
gctggtgccctgaagatttgtagtt

SEQ ID NO: 344878 - DNA, 25 bp, Homo sapien
gaatgagtcggcatgaaccgtactt

SEQ ID NO: 344879 - DNA, 25 bp, Homo sapien
tgaaccgtactttccttggcagggt

SEQ ID NO: 344880 - DNA, 25 bp, Homo sapien
tgtacgtacacaggtgctggtcgat

SEQ ID NO: 344881 - DNA, 25 bp, Homo sapien
acaggtgctggtcgatgtccacttt

SEQ ID NO: 344882 - DNA, 25 bp, Homo sapien
gtcgatgtccactttctgcttttct

SEQ ID NO: 344883 - DNA, 25 bp, Homo sapien
gtaaaatacactgactcctgagtaa

SEQ ID NO: 344884 - DNA, 25 bp, Homo sapien
gggagtctgacaagtgaaaccaatt

SEQ ID NO: 344885 - DNA, 25 bp, Homo sapien
tcaaatggtttctctgtgctatttt

SEQ ID NO: 344886 - DNA, 25 bp, Homo sapien
tggtttctctgtgctattttttgga

SEQ ID NO: 344887 - DNA, 25 bp, Homo sapien
attctttcagattccagagatatct

SEQ ID NO: 344888 - DNA, 25 bp, Homo sapien
gattccagagatatcttacgtcttt

SEQ ID NO: 344889 - DNA, 25 bp, Homo sapien
gagatatcttacgtctttgattcaa

SEQ ID NO: 344890 - DNA, 25 bp, Homo sapien
tagaaataatgtattgtgtctgtgc

SEQ ID NO: 344891 - DNA, 25 bp, Homo sapien
taacgccactgtctccaagatggat

SEQ ID NO: 344892 - DNA, 25 bp, Homo sapien
aagatggatggctcccagtcgggta

SEQ ID NO: 344893 - DNA, 25 bp, Homo sapien
ctcccagtcgggtatcagtgcagat

SEQ ID NO: 344894 - DNA, 25 bp, Homo sapien
aaaccaagtgctactgacggcgttc

SEQ ID NO: 344895 - DNA, 25 bp, Homo sapien
actgacggcgttcccaaacaccagt

SEQ ID NO: 344896 - DNA, 25 bp, Homo sapien
ccagtttcctcacttcctggaagaa

SEQ ID NO: 344897 - DNA, 25 bp, Homo sapien
attgcggtcagctaagggagaactt

SEQ ID NO: 344898 - DNA, 25 bp, Homo sapien
ggagcaatgcagacacagtgaaatc

SEQ ID NO: 344899 - DNA, 25 bp, Homo sapien
ttttgtaagaactcatctcctcctg

SEQ ID NO: 344900 - DNA, 25 bp, Homo sapien
atgtttactacgttggttgtgacca

SEQ ID NO: 344901 - DNA, 25 bp, Homo sapien
cacaacctcaggcaagtgctacaat

SEQ ID NO: 344902 - DNA, 25 bp, Homo sapien
tctttctggcccacagatgagggct

SEQ ID NO: 344903 - DNA, 25 bp, Homo sapien
agggctcctgattgtggaaggccac

SEQ ID NO: 344904 - DNA, 25 bp, Homo sapien
gaaggccacggaagggacctgaaca

SEQ ID NO: 344905 - DNA, 25 bp, Homo sapien
ggacctgaacacgatggcacgagac

SEQ ID NO: 344906 - DNA, 25 bp, Homo sapien
tggcacgagacaagttatctcctgt

SEQ ID NO: 344907 - DNA, 25 bp, Homo sapien
aaccctcagctcaggctagactttc

SEQ ID NO: 344908 - DNA, 25 bp, Homo sapien
gaatgccctgccctgtgtggaagcc

SEQ ID NO: 344909 - DNA, 25 bp, Homo sapien
ctgtgtggaagcctgatgcatttag

SEQ ID NO: 344910 - DNA, 25 bp, Homo sapien
tgtgctgggcacatgggacagccat

SEQ ID NO: 344911 - DNA, 25 bp, Homo sapien
agccatggcactgagactttggaag

SEQ ID NO: 344912 - DNA, 25 bp, Homo sapien
ggaagtggccttgccagcgctgtcc

SEQ ID NO: 344913 - DNA, 25 bp, Homo sapien
tgagtagggccagatgagctgtata

SEQ ID NO: 344914 - DNA, 25 bp, Homo sapien
atagtgtttatgatagagagaccaa

SEQ ID NO: 344915 - DNA, 25 bp, Homo sapien
gtaagcacttaatagctttccttat

SEQ ID NO: 344916 - DNA, 25 bp, Homo sapien
atagctttccttatttacaagtcag

SEQ ID NO: 344917 - DNA, 25 bp, Homo sapien
tacaagtcagattcatctaagggat

SEQ ID NO: 344918 - DNA, 25 bp, Homo sapien
gtcagattcatctaagggatatttt

SEQ ID NO: 344919 - DNA, 25 bp, Homo sapien
ttcttttatttttctggtgcttgaa

SEQ ID NO: 344920 - DNA, 25 bp, Homo sapien
gaaatgttcctttaaaatagattat

SEQ ID NO: 344921 - DNA, 25 bp, Homo sapien
cagaggatacacagtgacacaaaat

SEQ ID NO: 344922 - DNA, 25 bp, Homo sapien
acagtgacacaaaatttgttgcttg

SEQ ID NO: 344923 - DNA, 25 bp, Homo sapien
gcagagtggattaagcttttctttt

SEQ ID NO: 344924 - DNA, 25 bp, Homo sapien
accagttaagagaaccgcgagcaga

SEQ ID NO: 344925 - DNA, 25 bp, Homo sapien
agcagagcgcgctggactagcacca

SEQ ID NO: 344926 - DNA, 25 bp, Homo sapien
ggactagcaccaacagacgtgagtt

SEQ ID NO: 344927 - DNA, 25 bp, Homo sapien
ggctggaagacacccgcagaaaccg

SEQ ID NO: 344928 - DNA, 25 bp, Homo sapien
agacgtgagttcgagaccgtcctgc

SEQ ID NO: 344929 - DNA, 25 bp, Homo sapien
attttttaagtctgtgagcctcgca

SEQ ID NO: 344930 - DNA, 25 bp, Homo sapien
ctcgcagtgttctcattcctgaaaa

SEQ ID NO: 344931 - DNA, 25 bp, Homo sapien
cccatctccggactgcagtgagaac

SEQ ID NO: 344932 - DNA, 25 bp, Homo sapien
gactatgaacatgactttttgccac

SEQ ID NO: 344933 - DNA, 25 bp, Homo sapien
agagcaagtgcagctttaatctcca

SEQ ID NO: 344934 - DNA, 25 bp, Homo sapien
aaagcagcctgaagaccagttaaga

SEQ ID NO: 344935 - DNA, 25 bp, Homo sapien
agtatttctgaatgaatttcttaac

SEQ ID NO: 344936 - DNA, 25 bp, Homo sapien
atttctgaatgaatttcttaactca

SEQ ID NO: 344937 - DNA, 25 bp, Homo sapien
ctgaatgaatttcttaactcagtag

SEQ ID NO: 344938 - DNA, 25 bp, Homo sapien
aaggagtaaaagatatttgctgcat

SEQ ID NO: 344939 - DNA, 25 bp, Homo sapien
gagtaaaagatatttgctgcatata

SEQ ID NO: 344940 - DNA, 25 bp, Homo sapien
aagatatttgctgcatatatatatt

SEQ ID NO: 344941 - DNA, 25 bp, Homo sapien
ttaaaatcctgctagtttgatgaag

SEQ ID NO: 344942 - DNA, 25 bp, Homo sapien
aaaatcctgctagtttgatgaagaa

SEQ ID NO: 344943 - DNA, 25 bp, Homo sapien
aaatcctgctagtttgatgaagaag

SEQ ID NO: 344944 - DNA, 25 bp, Homo sapien
aatcctgctagtttgatgaagaagt

SEQ ID NO: 344945 - DNA, 25 bp, Homo sapien
tcctgctagtttgatgaagaagttg

SEQ ID NO: 344946 - DNA, 25 bp, Homo sapien
aagagtagacacatacataggcaat

SEQ ID NO: 344947 - DNA, 25 bp, Homo sapien
gacacatacataggcaatggagaat

SEQ ID NO: 344948 - DNA, 25 bp, Homo sapien
aaaatgaatttgttagcagacgcac

SEQ ID NO: 344949 - DNA, 25 bp, Homo sapien
gaatttgttagcagacgcacagctg

SEQ ID NO: 344950 - DNA, 25 bp, Homo sapien
gtgtgggattaggtgtgtcttaact

SEQ ID NO: 344951 - DNA, 25 bp, Homo sapien
gtgtgtcttaactggacaagatttg

SEQ ID NO: 344952 - DNA, 25 bp, Homo sapien
ctggacaagatttgtttgcagtaat

SEQ ID NO: 344953 - DNA, 25 bp, Homo sapien
gtcaaagattttatattaggcatta

SEQ ID NO: 344954 - DNA, 25 bp, Homo sapien
tgtttgcagtaatatcagtattctt

SEQ ID NO: 344955 - DNA, 25 bp, Homo sapien
tactaaaaggtgtagtcccctgtag

SEQ ID NO: 344956 - DNA, 25 bp, Homo sapien
ggtgtagtcccctgtagaatcagat

SEQ ID NO: 344957 - DNA, 25 bp, Homo sapien
ttgtgtattcctacatggctgggtt

SEQ ID NO: 344958 - DNA, 25 bp, Homo sapien
gcatccatctagagtctctcacaga

SEQ ID NO: 344959 - DNA, 25 bp, Homo sapien
atgccaagttgtgttgtgctcaaat

SEQ ID NO: 344960 - DNA, 25 bp, Homo sapien
gtgttgtgctcaaattgttccttta

SEQ ID NO: 344961 - DNA, 25 bp, Homo sapien
tgttcctttaacgtacaaatcatgt

SEQ ID NO: 344962 - DNA, 25 bp, Homo sapien
tgttgaaacagttccagcaagcgtt

SEQ ID NO: 344963 - DNA, 25 bp, Homo sapien
aaaagttgtatcaccagatgaggat

SEQ ID NO: 344964 - DNA, 25 bp, Homo sapien
ttccagcaagcgttatagcagaact

SEQ ID NO: 344965 - DNA, 25 bp, Homo sapien
gcagaactgatgattctcttgatct

SEQ ID NO: 344966 - DNA, 25 bp, Homo sapien
gaactgaagtagctggtacatgttt

SEQ ID NO: 344967 - DNA, 25 bp, Homo sapien
gtacatgtttgaggtgtgtgcagat

SEQ ID NO: 344968 - DNA, 25 bp, Homo sapien
atggctcagacatcactattatgct

SEQ ID NO: 344969 - DNA, 25 bp, Homo sapien
aatatccacagggtcttctaaaatt

SEQ ID NO: 344970 - DNA, 25 bp, Homo sapien
atacaccaagtccatctcatttctt

SEQ ID NO: 344971 - DNA, 25 bp, Homo sapien
tttcatttttgccagatcaccagtt

SEQ ID NO: 344972 - DNA, 25 bp, Homo sapien
gccagatcaccagttgctgttctaa

SEQ ID NO: 344973 - DNA, 25 bp, Homo sapien
tgctgttctaaaaagtctcccttcc

SEQ ID NO: 344974 - DNA, 25 bp, Homo sapien
tctcccttccgttttgcagagtaag

SEQ ID NO: 344975 - DNA, 25 bp, Homo sapien
gtagccagctgtcaaacttttcaaa

SEQ ID NO: 344976 - DNA, 25 bp, Homo sapien
gaagtctctaagcaagcacctaagt

SEQ ID NO: 344977 - DNA, 25 bp, Homo sapien
gcacctaagtggctcgtctttgaga

SEQ ID NO: 344978 - DNA, 25 bp, Homo sapien
ttttggcagcccaagaacactctgg

SEQ ID NO: 344979 - DNA, 25 bp, Homo sapien
gggacttcttagatagctgcttcct

SEQ ID NO: 344980 - DNA, 25 bp, Homo sapien
atagctgcttccttagggcatggca

SEQ ID NO: 344981 - DNA, 25 bp, Homo sapien
agtggagtggagatttctcatcctt

SEQ ID NO: 344982 - DNA, 25 bp, Homo sapien
gatttctcatcctttcctgttaatt

SEQ ID NO: 344983 - DNA, 25 bp, Homo sapien
ttaatttatgacatcctcctgccta

SEQ ID NO: 344984 - DNA, 25 bp, Homo sapien
ctgcctatgagtccttgactctgga

SEQ ID NO: 344985 - DNA, 25 bp, Homo sapien
gagtccttgactctggagttttaca

SEQ ID NO: 344986 - DNA, 25 bp, Homo sapien
gagttttacaaagcagtcacatttc

SEQ ID NO: 344987 - DNA, 25 bp, Homo sapien
gcaacacatcatcgccaacttttaa

SEQ ID NO: 344988 - DNA, 25 bp, Homo sapien
gaatagaaaattgcagtcccttact

SEQ ID NO: 344989 - DNA, 25 bp, Homo sapien
aattgcagtcccttactgtttaaag

SEQ ID NO: 344990 - DNA, 25 bp, Homo sapien
gaagacctgtttggatggacacctg

SEQ ID NO: 344991 - DNA, 25 bp, Homo sapien
gatggacacctggtttcaaaagtca

SEQ ID NO: 344992 - DNA, 25 bp, Homo sapien
agactgttaaatgggagggcctcat

SEQ ID NO: 344993 - DNA, 25 bp, Homo sapien
ggagggcctcatccataaatgattt

SEQ ID NO: 344994 - DNA, 25 bp, Homo sapien
aatgatttctggcaacgtcttcttc

SEQ ID NO: 344995 - DNA, 25 bp, Homo sapien
aacgtcttcttcaggtggagcttga

SEQ ID NO: 344996 - DNA, 25 bp, Homo sapien
ggagcttgacgtctttttaatgtta

SEQ ID NO: 344997 - DNA, 25 bp, Homo sapien
agggagtgctcattaagggatgcca

SEQ ID NO: 344998 - DNA, 25 bp, Homo sapien
attaagggatgccagggccagctct

SEQ ID NO: 344999 - DNA, 25 bp, Homo sapien
gcttctgcatgtcatgaggcagcag

SEQ ID NO: 345000 - DNA, 25 bp, Homo sapien
tgaggcagcaggaaggtttcccctg

SEQ ID NO: 345001 - DNA, 25 bp, Homo sapien
atatgtaataaacagcgtcacgtaa

SEQ ID NO: 345002 - DNA, 25 bp, Homo sapien
cagcgtcacgtaaatacatatatgc

SEQ ID NO: 345003 - DNA, 25 bp, Homo sapien
tgcagtgcttgttgtccaaatagaa

SEQ ID NO: 345004 - DNA, 25 bp, Homo sapien
caactttttacttccatcatccttt

SEQ ID NO: 345005 - DNA, 25 bp, Homo sapien
ttttttagcctgttgcttcagagag

SEQ ID NO: 345006 - DNA, 25 bp, Homo sapien
gcctgttgcttcagagagacacaaa

SEQ ID NO: 345007 - DNA, 25 bp, Homo sapien
cacactggtgtgaatgtcgctctct

SEQ ID NO: 345008 - DNA, 25 bp, Homo sapien
aatgtcgctctctgtgtgcttgtgt

SEQ ID NO: 345009 - DNA, 25 bp, Homo sapien
gtgcttgtgtttgtaatgaaagtct

SEQ ID NO: 345010 - DNA, 25 bp, Homo sapien
atgaaagtctacagccaattttact

SEQ ID NO: 345011 - DNA, 25 bp, Homo sapien
cagccaattttacttgtctaccacc

SEQ ID NO: 345012 - DNA, 25 bp, Homo sapien
ttcagagagctcagatacagaggac

SEQ ID NO: 345013 - DNA, 25 bp, Homo sapien
gagctcagatacagaggacagtgct

SEQ ID NO: 345014 - DNA, 25 bp, Homo sapien
ttgggcgtttccaagtgacttcatc

SEQ ID NO: 345015 - DNA, 25 bp, Homo sapien
cagaggacagtgctggaggcgggcc

SEQ ID NO: 345016 - DNA, 25 bp, Homo sapien
ggcgtttccaagtgacttcatccaa

SEQ ID NO: 345017 - DNA, 25 bp, Homo sapien
gtttccaagtgacttcatccaagga

SEQ ID NO: 345018 - DNA, 25 bp, Homo sapien
gtgacttcatccaaggaaccggctg

SEQ ID NO: 345019 - DNA, 25 bp, Homo sapien
gacttcatccaaggaaccggctgag

SEQ ID NO: 345020 - DNA, 25 bp, Homo sapien
ttcatccaaggaaccggctgagcct

SEQ ID NO: 345021 - DNA, 25 bp, Homo sapien
aggaaccggctgagcctcttccctt

SEQ ID NO: 345022 - DNA, 25 bp, Homo sapien
actctctctggttctccaaaacctt

SEQ ID NO: 345023 - DNA, 25 bp, Homo sapien
gaaaaacttagcatatccaagcaac

SEQ ID NO: 345024 - DNA, 25 bp, Homo sapien
atccaagcaactattcagcctgaag

SEQ ID NO: 345025 - DNA, 25 bp, Homo sapien
tattcagcctgaagcttcttgaaat

SEQ ID NO: 345026 - DNA, 25 bp, Homo sapien
agaatgatctggcatttccttcccc

SEQ ID NO: 345027 - DNA, 25 bp, Homo sapien
tcagtgagcctcataactccatggt

SEQ ID NO: 345028 - DNA, 25 bp, Homo sapien
aactccatggtctctgcacaggttt

SEQ ID NO: 345029 - DNA, 25 bp, Homo sapien
gtctctgcacaggtttacaccttta

SEQ ID NO: 345030 - DNA, 25 bp, Homo sapien
tttatcaacctttctctggtgagga

SEQ ID NO: 345031 - DNA, 25 bp, Homo sapien
gaaggctttattctgtgcagccctc

SEQ ID NO: 345032 - DNA, 25 bp, Homo sapien
gccctcctgttaatctcaaacgtga

SEQ ID NO: 345033 - DNA, 25 bp, Homo sapien
acgtgaatcttttgcaccttgttct

SEQ ID NO: 345034 - DNA, 25 bp, Homo sapien
aaatacatcactaaccagtggtcat

SEQ ID NO: 345035 - DNA, 25 bp, Homo sapien
gccatggccattagaaagttcaagc

SEQ ID NO: 345036 - DNA, 25 bp, Homo sapien
gccattagaaagttcaagctccagg

SEQ ID NO: 345037 - DNA, 25 bp, Homo sapien
agggcagtagtcaccttcagctttc

SEQ ID NO: 345038 - DNA, 25 bp, Homo sapien
acctaattctcattattgctgtgtc

SEQ ID NO: 345039 - DNA, 25 bp, Homo sapien
atgtcagatgattgttttccctcag

SEQ ID NO: 345040 - DNA, 25 bp, Homo sapien
gattgttttccctcagtttttccag

SEQ ID NO: 345041 - DNA, 25 bp, Homo sapien
tcagtttttccagcgctgtttgtta

SEQ ID NO: 345042 - DNA, 25 bp, Homo sapien
agcgctgtttgttacccttattact

SEQ ID NO: 345043 - DNA, 25 bp, Homo sapien
ctgtttgttacccttattactatgc

SEQ ID NO: 345044 - DNA, 25 bp, Homo sapien
ttactatgcagtgtttaaatggatg

SEQ ID NO: 345045 - DNA, 25 bp, Homo sapien
agatttagcaaaaacgcggcgtctt

SEQ ID NO: 345046 - DNA, 25 bp, Homo sapien
acgcggcgtctttgaaagttaacag

SEQ ID NO: 345047 - DNA, 25 bp, Homo sapien
cctgtgtgttggagctcagttagga

SEQ ID NO: 345048 - DNA, 25 bp, Homo sapien
gagttgaagttttctgcacctgtga

SEQ ID NO: 345049 - DNA, 25 bp, Homo sapien
gcacctgtgataacaagcccaccag

SEQ ID NO: 345050 - DNA, 25 bp, Homo sapien
ttcttcctgccactgtgactcggtg

SEQ ID NO: 345051 - DNA, 25 bp, Homo sapien
tggctgtagagccacatggcatttg

SEQ ID NO: 345052 - DNA, 25 bp, Homo sapien
gcatttgtcagccaatctgtttcaa

SEQ ID NO: 345053 - DNA, 25 bp, Homo sapien
cagccaatctgtttcaagtcttttc

SEQ ID NO: 345054 - DNA, 25 bp, Homo sapien
aatagctttcttacagattttcttg

SEQ ID NO: 345055 - DNA, 25 bp, Homo sapien
cattacctagattgtcccttcagta

SEQ ID NO: 345056 - DNA, 25 bp, Homo sapien
gagggttctgtaaatgttacccatt

SEQ ID NO: 345057 - DNA, 25 bp, Homo sapien
tttccctgcaacacccagtagtctg

SEQ ID NO: 345058 - DNA, 25 bp, Homo sapien
gcaacacccagtagtctggcttcta

SEQ ID NO: 345059 - DNA, 25 bp, Homo sapien
agtagtctggcttctatcctgacaa

SEQ ID NO: 345060 - DNA, 25 bp, Homo sapien
tctggcttctatcctgacaatgtta

SEQ ID NO: 345061 - DNA, 25 bp, Homo sapien
gcttctatcctgacaatgttagtga

SEQ ID NO: 345062 - DNA, 25 bp, Homo sapien
atgttagtgaagttgcttgcttgaa

SEQ ID NO: 345063 - DNA, 25 bp, Homo sapien
gcttgcttgaaatttaccaggccag

SEQ ID NO: 345064 - DNA, 25 bp, Homo sapien
tgaaatttaccaggccaggcttatg

SEQ ID NO: 345065 - DNA, 25 bp, Homo sapien
gagggatatccatgagataatatgt

SEQ ID NO: 345066 - DNA, 25 bp, Homo sapien
gtatgaagaacctagcacactgttt

SEQ ID NO: 345067 - DNA, 25 bp, Homo sapien
ccccatggcacagagtgattctcag

SEQ ID NO: 345068 - DNA, 25 bp, Homo sapien
acagagtgattctcagctgtttaac

SEQ ID NO: 345069 - DNA, 25 bp, Homo sapien
ttaaccagcttctggtgactgaggg

SEQ ID NO: 345070 - DNA, 25 bp, Homo sapien
atgaccctgcccactgagatgaagg

SEQ ID NO: 345071 - DNA, 25 bp, Homo sapien
aggcagccagtgaaatggccagagc

SEQ ID NO: 345072 - DNA, 25 bp, Homo sapien
agctccctggatcagcatgtggcag

SEQ ID NO: 345073 - DNA, 25 bp, Homo sapien
cctggatcagcatgtggcagcggtc

SEQ ID NO: 345074 - DNA, 25 bp, Homo sapien
gtggccactgtgcagatatccagct

SEQ ID NO: 345075 - DNA, 25 bp, Homo sapien
gtgcagatatccagcttggacacaa

SEQ ID NO: 345076 - DNA, 25 bp, Homo sapien
ttggacacaaacctgcagctttcag

SEQ ID NO: 345077 - DNA, 25 bp, Homo sapien
gaggccgagcccaccaagacaagga

SEQ ID NO: 345078 - DNA, 25 bp, Homo sapien
cacctgcaacaggtcaggtctgtta

SEQ ID NO: 345079 - DNA, 25 bp, Homo sapien
ggatcaggaagaggattgctactaa

SEQ ID NO: 345080 - DNA, 25 bp, Homo sapien
gagaaaccaatgaagccttttgcca

SEQ ID NO: 345081 - DNA, 25 bp, Homo sapien
caatgaagccttttgccatctcaca

SEQ ID NO: 345082 - DNA, 25 bp, Homo sapien
agccttttgccatctcacactggaa

SEQ ID NO: 345083 - DNA, 25 bp, Homo sapien
aagtcatagaggcttgatttttata

SEQ ID NO: 345084 - DNA, 25 bp, Homo sapien
agtgagaaactgacctcgatacttt

SEQ ID NO: 345085 - DNA, 25 bp, Homo sapien
actgacctcgatactttgttggact

SEQ ID NO: 345086 - DNA, 25 bp, Homo sapien
cgatactttgttggacttgcctaaa

SEQ ID NO: 345087 - DNA, 25 bp, Homo sapien
aagacatttgctgaattctcgggct

SEQ ID NO: 345088 - DNA, 25 bp, Homo sapien
tttgctgaattctcgggctgtgctg

SEQ ID NO: 345089 - DNA, 25 bp, Homo sapien
agcaacttctacatctggcctgctg

SEQ ID NO: 345090 - DNA, 25 bp, Homo sapien
gcttagtcctgggacctgaggtcaa

SEQ ID NO: 345091 - DNA, 25 bp, Homo sapien
gggacctgaggtcaaaatcttagaa

SEQ ID NO: 345092 - DNA, 25 bp, Homo sapien
agccatgtgagatgcattccctggc

SEQ ID NO: 345093 - DNA, 25 bp, Homo sapien
ttggatgctgtcagcaacactcctt

SEQ ID NO: 345094 - DNA, 25 bp, Homo sapien
acactccttgagtttttacccacat

SEQ ID NO: 345095 - DNA, 25 bp, Homo sapien
tttacccacataataacactttcct

SEQ ID NO: 345096 - DNA, 25 bp, Homo sapien
ctttcctcagcatggatgtggaggt

SEQ ID NO: 345097 - DNA, 25 bp, Homo sapien
tctatttttccttcgatggttacgc

SEQ ID NO: 345098 - DNA, 25 bp, Homo sapien
ttttccttcgatggttacgccctca

SEQ ID NO: 345099 - DNA, 25 bp, Homo sapien
ctcaccctaccaactcagtaaaagg

SEQ ID NO: 345100 - DNA, 25 bp, Homo sapien
atgtgactgcagatgactcctgtgt

SEQ ID NO: 345101 - DNA, 25 bp, Homo sapien
atcactgggctacaggcatttttct

SEQ ID NO: 345102 - DNA, 25 bp, Homo sapien
atgactcctgtgttatgccatccaa

SEQ ID NO: 345103 - DNA, 25 bp, Homo sapien
ctcctgtgttatgccatccaagatt

SEQ ID NO: 345104 - DNA, 25 bp, Homo sapien
atccaagattaagcaccctagaata

SEQ ID NO: 345105 - DNA, 25 bp, Homo sapien
agagaaattccagaagtaccttgat

SEQ ID NO: 345106 - DNA, 25 bp, Homo sapien
agaagtaccttgattggccacatag

SEQ ID NO: 345107 - DNA, 25 bp, Homo sapien
gattggccacataggacccaagaat

SEQ ID NO: 345108 - DNA, 25 bp, Homo sapien
gacccaagaatgtgatgtgcctact

SEQ ID NO: 345109 - DNA, 25 bp, Homo sapien
ctagctaggcagatagggtacttga

SEQ ID NO: 345110 - DNA, 25 bp, Homo sapien
tttctgctccattatgtgtaatgtt

SEQ ID NO: 345111 - DNA, 25 bp, Homo sapien
ccctctgtcatcatggccaatgcag

SEQ ID NO: 345112 - DNA, 25 bp, Homo sapien
ggccaatgcagagatgattgtcaaa

SEQ ID NO: 345113 - DNA, 25 bp, Homo sapien
actgtggtggcttagatccacccca

SEQ ID NO: 345114 - DNA, 25 bp, Homo sapien
cactgctgctgagatcagagtctat

SEQ ID NO: 345115 - DNA, 25 bp, Homo sapien
gagtctattttggagctctaggcag

SEQ ID NO: 345116 - DNA, 25 bp, Homo sapien
attttggagctctaggcaggttcta

SEQ ID NO: 345117 - DNA, 25 bp, Homo sapien
tgccagacacgttacagccctgctg

SEQ ID NO: 345118 - DNA, 25 bp, Homo sapien
agccctgctgcatgctgttaggcta

SEQ ID NO: 345119 - DNA, 25 bp, Homo sapien
tgctgcatgctgttaggctaccaca

SEQ ID NO: 345120 - DNA, 25 bp, Homo sapien
atgctgttaggctaccacacactaa

SEQ ID NO: 345121 - DNA, 25 bp, Homo sapien
aggctaccacacactaattatcctt

SEQ ID NO: 345122 - DNA, 25 bp, Homo sapien
ataattgcctcactggatggatgat

SEQ ID NO: 345123 - DNA, 25 bp, Homo sapien
actgaggccacagtgtcgtgacctt

SEQ ID NO: 345124 - DNA, 25 bp, Homo sapien
cacagtgtcgtgaccttctggaggt

SEQ ID NO: 345125 - DNA, 25 bp, Homo sapien
cttctggaggtctcgtagtgaacca

SEQ ID NO: 345126 - DNA, 25 bp, Homo sapien
accagggttcccttgggaagcatga

SEQ ID NO: 345127 - DNA, 25 bp, Homo sapien
agtcatgactagaccctgggcccct

SEQ ID NO: 345128 - DNA, 25 bp, Homo sapien
aaaatatacaccctgttctcaagag

SEQ ID NO: 345129 - DNA, 25 bp, Homo sapien
tatacaccctgttctcaagaggttt

SEQ ID NO: 345130 - DNA, 25 bp, Homo sapien
tttccttgaatttcttcatggagtc

SEQ ID NO: 345131 - DNA, 25 bp, Homo sapien
tcccatcccccaataacattaggag

SEQ ID NO: 345132 - DNA, 25 bp, Homo sapien
gggtgcataattgcctcactggatg

SEQ ID NO: 345133 - DNA, 25 bp, Homo sapien
ggtggcctttggaactcttgcccac

SEQ ID NO: 345134 - DNA, 25 bp, Homo sapien
tttggaactcttgcccactgaactg

SEQ ID NO: 345135 - DNA, 25 bp, Homo sapien
aactcttgcccactgaactgtggtg

SEQ ID NO: 345136 - DNA, 25 bp, Homo sapien
tgcccactgaactgtggtgagcaat

SEQ ID NO: 345137 - DNA, 25 bp, Homo sapien
ggtgagcaattccaagttgtctctg

SEQ ID NO: 345138 - DNA, 25 bp, Homo sapien
aattccaagttgtctctgggccaaa

SEQ ID NO: 345139 - DNA, 25 bp, Homo sapien
ccaagttgtctctgggccaaataga

SEQ ID NO: 345140 - DNA, 25 bp, Homo sapien
ggaagatttcaattctgccaaaaag

SEQ ID NO: 345141 - DNA, 25 bp, Homo sapien
aaaagaaccatgaacaccagacccg

SEQ ID NO: 345142 - DNA, 25 bp, Homo sapien
acaccagacccgcaatcagtaggag

SEQ ID NO: 345143 - DNA, 25 bp, Homo sapien
acccgcaatcagtaggagtacccgc

SEQ ID NO: 345144 - DNA, 25 bp, Homo sapien
cctttgactctggacgggaggaagt

SEQ ID NO: 345145 - DNA, 25 bp, Homo sapien
agtgcgagcggatccaaagggtcga

SEQ ID NO: 345146 - DNA, 25 bp, Homo sapien
gagcggatccaaagggtcgagcgga

SEQ ID NO: 345147 - DNA, 25 bp, Homo sapien
gccctgacgcccaagagcaaatgga

SEQ ID NO: 345148 - DNA, 25 bp, Homo sapien
tgacgcccaagagcaaatggaagag

SEQ ID NO: 345149 - DNA, 25 bp, Homo sapien
ggagaaaccggcgtttcctagtctg

SEQ ID NO: 345150 - DNA, 25 bp, Homo sapien
gaaaccggcgtttcctagtctgtcg

SEQ ID NO: 345151 - DNA, 25 bp, Homo sapien
ggcgtttcctagtctgtcgctcagt

SEQ ID NO: 345152 - DNA, 25 bp, Homo sapien
tttcctagtctgtcgctcagtccct

SEQ ID NO: 345153 - DNA, 25 bp, Homo sapien
tagtctgtcgctcagtccctgcttc

SEQ ID NO: 345154 - DNA, 25 bp, Homo sapien
tccggcttccgacgcgcaacagctg

SEQ ID NO: 345155 - DNA, 25 bp, Homo sapien
ctgctttcttgatcttgaggacatt

SEQ ID NO: 345156 - DNA, 25 bp, Homo sapien
ggacatttgaaaatcatcataccaa

SEQ ID NO: 345157 - DNA, 25 bp, Homo sapien
cataccaatatttactgatgtggga

SEQ ID NO: 345158 - DNA, 25 bp, Homo sapien
ttactttgtgtatctgcttaacagc

SEQ ID NO: 345159 - DNA, 25 bp, Homo sapien
ttaatgctttgctgaaatggacttc

SEQ ID NO: 345160 - DNA, 25 bp, Homo sapien
atggacttctttatgcaacattgga

SEQ ID NO: 345161 - DNA, 25 bp, Homo sapien
tgttttccaagctttaccttctgca

SEQ ID NO: 345162 - DNA, 25 bp, Homo sapien
ttaccttctgcaccgttgttgattc

SEQ ID NO: 345163 - DNA, 25 bp, Homo sapien
ttgttgattctggtgtgaccccagg

SEQ ID NO: 345164 - DNA, 25 bp, Homo sapien
ggtgtgaccccaggcggtctctcaa

SEQ ID NO: 345165 - DNA, 25 bp, Homo sapien
gtctctcaaccactgctttcttgat

SEQ ID NO: 345166 - DNA, 25 bp, Homo sapien
gtcaagttacacaagctaatccctg

SEQ ID NO: 345167 - DNA, 25 bp, Homo sapien
taatccctgaaacgtgagccccacg

SEQ ID NO: 345168 - DNA, 25 bp, Homo sapien
atataatccccacaacaacgagctg

SEQ ID NO: 345169 - DNA, 25 bp, Homo sapien
tgcgtgccaggtccccgacaaatgc

SEQ ID NO: 345170 - DNA, 25 bp, Homo sapien
ctccatggcagctgcgatgacttcc

SEQ ID NO: 345171 - DNA, 25 bp, Homo sapien
gatgacttccctcgagaagtgccag

SEQ ID NO: 345172 - DNA, 25 bp, Homo sapien
gagaagtgccagtccgcagggcaat

SEQ ID NO: 345173 - DNA, 25 bp, Homo sapien
agtccgcagggcaatctcgaggtcc

SEQ ID NO: 345174 - DNA, 25 bp, Homo sapien
ctcgaggtcctcgtgcgggtgacca

SEQ ID NO: 345175 - DNA, 25 bp, Homo sapien
aacgagctgcagaaggttgtttctc

SEQ ID NO: 345176 - DNA, 25 bp, Homo sapien
tctgcatattctctgtacttgtaga

SEQ ID NO: 345177 - DNA, 25 bp, Homo sapien
ctggcagtcagagggccttttggaa

SEQ ID NO: 345178 - DNA, 25 bp, Homo sapien
gagtcagacctgatccataagtccc

SEQ ID NO: 345179 - DNA, 25 bp, Homo sapien
gacctgatccataagtccctggaaa

SEQ ID NO: 345180 - DNA, 25 bp, Homo sapien
tgcccagggagcaaatgccactgtg

SEQ ID NO: 345181 - DNA, 25 bp, Homo sapien
actgtggccttgactgaggcttcag

SEQ ID NO: 345182 - DNA, 25 bp, Homo sapien
ggctgatccatgtcctctaaatgta

SEQ ID NO: 345183 - DNA, 25 bp, Homo sapien
gtttgggagctgcaattcatccaca

SEQ ID NO: 345184 - DNA, 25 bp, Homo sapien
tccacacacgcattcattttcaagt

SEQ ID NO: 345185 - DNA, 25 bp, Homo sapien
agtagtggtttgcagttcaggcttt

SEQ ID NO: 345186 - DNA, 25 bp, Homo sapien
ctctaaatgtaggacttcaaagctc

SEQ ID NO: 345187 - DNA, 25 bp, Homo sapien
aaatgctctctgacccctctgggag

SEQ ID NO: 345188 - DNA, 25 bp, Homo sapien
ataaatcctcatattatgcctgcca

SEQ ID NO: 345189 - DNA, 25 bp, Homo sapien
atcctcatattatgcctgccatgtt

SEQ ID NO: 345190 - DNA, 25 bp, Homo sapien
ttatgcctgccatgttcagaacctg

SEQ ID NO: 345191 - DNA, 25 bp, Homo sapien
tgcctgccatgttcagaacctgcaa

SEQ ID NO: 345192 - DNA, 25 bp, Homo sapien
tccctactaggccaacctctaacgt

SEQ ID NO: 345193 - DNA, 25 bp, Homo sapien
gtatctaatgatcttgattcttcaa

SEQ ID NO: 345194 - DNA, 25 bp, Homo sapien
gagacaatatggtttcttgtagtaa

SEQ ID NO: 345195 - DNA, 25 bp, Homo sapien
ggtttcttgtagtaactgtgtatag

SEQ ID NO: 345196 - DNA, 25 bp, Homo sapien
gtaactgtgtatagagaagtactgt

SEQ ID NO: 345197 - DNA, 25 bp, Homo sapien
atatgaagtgccttataattctaca

SEQ ID NO: 345198 - DNA, 25 bp, Homo sapien
agtgccttataattctacacttttc

SEQ ID NO: 345199 - DNA, 25 bp, Homo sapien
aaatgttccctctttgctataaact

SEQ ID NO: 345200 - DNA, 25 bp, Homo sapien
gttccctctttgctataaacttgtt

SEQ ID NO: 345201 - DNA, 25 bp, Homo sapien
taatttaaatactaggagactccat

SEQ ID NO: 345202 - DNA, 25 bp, Homo sapien
ggagactccattcgttataaaacag

SEQ ID NO: 345203 - DNA, 25 bp, Homo sapien
taaaacagttattcaaagcctacaa

SEQ ID NO: 345204 - DNA, 25 bp, Homo sapien
tacaatgcgtaggaaccaaatactg

SEQ ID NO: 345205 - DNA, 25 bp, Homo sapien
ccaaatactgagactatgttagtga

SEQ ID NO: 345206 - DNA, 25 bp, Homo sapien
gtgagtaaaactagccgtgatggag

SEQ ID NO: 345207 - DNA, 25 bp, Homo sapien
agccgtgatggagcttatatccaat

SEQ ID NO: 345208 - DNA, 25 bp, Homo sapien
tatccaatagaagagatcgacacta

SEQ ID NO: 345209 - DNA, 25 bp, Homo sapien
gagatcgacactaatcaagtaatca

SEQ ID NO: 345210 - DNA, 25 bp, Homo sapien
gggaatgattgttcatcatactact

SEQ ID NO: 345211 - DNA, 25 bp, Homo sapien
ctacttttccattagtgaggctaca

SEQ ID NO: 345212 - DNA, 25 bp, Homo sapien
tagtgaggctacagttatgttttaa

SEQ ID NO: 345213 - DNA, 25 bp, Homo sapien
gtgcgattacagagatggcatctga

SEQ ID NO: 345214 - DNA, 25 bp, Homo sapien
atctgaacataaactgatggctcga

SEQ ID NO: 345215 - DNA, 25 bp, Homo sapien
ggaaatgtagcagccatatactgct

SEQ ID NO: 345216 - DNA, 25 bp, Homo sapien
tactgctaactttggatctgttcct

SEQ ID NO: 345217 - DNA, 25 bp, Homo sapien
ggatctgttcctgaattcaaaacta

SEQ ID NO: 345218 - DNA, 25 bp, Homo sapien
cagttaaatactgttgctccctaaa

SEQ ID NO: 345219 - DNA, 25 bp, Homo sapien
gttgctccctaaaacccttacattg

SEQ ID NO: 345220 - DNA, 25 bp, Homo sapien
ccttacattgtacaccattgggaat

SEQ ID NO: 345221 - DNA, 25 bp, Homo sapien
gtcatcaatcctttgcatgtggcta

SEQ ID NO: 345222 - DNA, 25 bp, Homo sapien
aatcctttgcatgtggctattttaa

SEQ ID NO: 345223 - DNA, 25 bp, Homo sapien
gtggctattttaagcttctcagctt

SEQ ID NO: 345224 - DNA, 25 bp, Homo sapien
ctcagctttcttttgggaggcttca

SEQ ID NO: 345225 - DNA, 25 bp, Homo sapien
tcttttgggaggcttcatgtgtaac

SEQ ID NO: 345226 - DNA, 25 bp, Homo sapien
ggaggcttcatgtgtaacttattat

SEQ ID NO: 345227 - DNA, 25 bp, Homo sapien
aatgttactgaaaagctgcctaaac

SEQ ID NO: 345228 - DNA, 25 bp, Homo sapien
gtaatactgttgtaaatccatcttc

SEQ ID NO: 345229 - DNA, 25 bp, Homo sapien
ctgttgtaaatccatcttcaagatg

SEQ ID NO: 345230 - DNA, 25 bp, Homo sapien
ggaatacaccttacgtttttatcag

SEQ ID NO: 345231 - DNA, 25 bp, Homo sapien
tacaccttacgtttttatcagtata

SEQ ID NO: 345232 - DNA, 25 bp, Homo sapien
tttttgttgtagcaagtcctcttaa

SEQ ID NO: 345233 - DNA, 25 bp, Homo sapien
gcaagtcctcttaaaatccactttt

SEQ ID NO: 345234 - DNA, 25 bp, Homo sapien
cacaaagtaagaacccattttcttg

SEQ ID NO: 345235 - DNA, 25 bp, Homo sapien
aatccacttttagacacttcagcaa

SEQ ID NO: 345236 - DNA, 25 bp, Homo sapien
ttagacacttcagcaatacagacct

SEQ ID NO: 345237 - DNA, 25 bp, Homo sapien
gacctgaagtccaaacctagagcta

SEQ ID NO: 345238 - DNA, 25 bp, Homo sapien
gagctagcagcagggcaacaaactg

SEQ ID NO: 345239 - DNA, 25 bp, Homo sapien
caaactgcccttatttgccaagaca

SEQ ID NO: 345240 - DNA, 25 bp, Homo sapien
ggctttcctgggacataagactatc

SEQ ID NO: 345241 - DNA, 25 bp, Homo sapien
gggacataagactatcggtgctaaa

SEQ ID NO: 345242 - DNA, 25 bp, Homo sapien
atcggtgctaaaactgggagaatcc

SEQ ID NO: 345243 - DNA, 25 bp, Homo sapien
agcagcaagatcagtggccagagct

SEQ ID NO: 345244 - DNA, 25 bp, Homo sapien
agtggccagagctgccccggaatag

SEQ ID NO: 345245 - DNA, 25 bp, Homo sapien
acttgcaaaagaaaatccttcagat

SEQ ID NO: 345246 - DNA, 25 bp, Homo sapien
gaacagacagtactgagaaggccac

SEQ ID NO: 345247 - DNA, 25 bp, Homo sapien
aaagaatgacatccccgtttagaag

SEQ ID NO: 345248 - DNA, 25 bp, Homo sapien
gacatccccgtttagaagacttagg

SEQ ID NO: 345249 - DNA, 25 bp, Homo sapien
atgctttcaagggagagactagtca

SEQ ID NO: 345250 - DNA, 25 bp, Homo sapien
gagagactagtcaacagccaaaaag

SEQ ID NO: 345251 - DNA, 25 bp, Homo sapien
gaggacacagatcacaatcaagcta

SEQ ID NO: 345252 - DNA, 25 bp, Homo sapien
atcaagctacagaaagctgtgagaa

SEQ ID NO: 345253 - DNA, 25 bp, Homo sapien
gaaagtgaaggatgttggaagcaac

SEQ ID NO: 345254 - DNA, 25 bp, Homo sapien
atgaactaaactgagcttccagcag

SEQ ID NO: 345255 - DNA, 25 bp, Homo sapien
actaaactgagcttccagcagtgat

SEQ ID NO: 345256 - DNA, 25 bp, Homo sapien
aactgagcttccagcagtgatggga

SEQ ID NO: 345257 - DNA, 25 bp, Homo sapien
actcagcatcgccattctgcacagc

SEQ ID NO: 345258 - DNA, 25 bp, Homo sapien
accatcatttcccaccaaacaaatg

SEQ ID NO: 345259 - DNA, 25 bp, Homo sapien
aaagagtgcggccttcagttcagtc

SEQ ID NO: 345260 - DNA, 25 bp, Homo sapien
agagtgcggccttcagttcagtctt

SEQ ID NO: 345261 - DNA, 25 bp, Homo sapien
tgcggccttcagttcagtcttcaat

SEQ ID NO: 345262 - DNA, 25 bp, Homo sapien
ggccttcagttcagtcttcaatgtg

SEQ ID NO: 345263 - DNA, 25 bp, Homo sapien
gccttcagttcagtcttcaatgtgt

SEQ ID NO: 345264 - DNA, 25 bp, Homo sapien
ttcagttcagtcttcaatgtgtctt

SEQ ID NO: 345265 - DNA, 25 bp, Homo sapien
tgcagaagtgtgtggtagctatgcc

SEQ ID NO: 345266 - DNA, 25 bp, Homo sapien
aaaggtgctaccatttccaagaagg

SEQ ID NO: 345267 - DNA, 25 bp, Homo sapien
ggtgctaccatttccaagaagggct

SEQ ID NO: 345268 - DNA, 25 bp, Homo sapien
ttaagaaagctgtcgttaagaccca

SEQ ID NO: 345269 - DNA, 25 bp, Homo sapien
ggaaggcaaaaagcgcaagaggacc

SEQ ID NO: 345270 - DNA, 25 bp, Homo sapien
gagttattctatttacatctacaaa

SEQ ID NO: 345271 - DNA, 25 bp, Homo sapien
ctgaggtcatttggagctgtttaat

SEQ ID NO: 345272 - DNA, 25 bp, Homo sapien
tacatctacaaagtgctaaagcagg

SEQ ID NO: 345273 - DNA, 25 bp, Homo sapien
actgaagagctgttgagcactggaa

SEQ ID NO: 345274 - DNA, 25 bp, Homo sapien
ctggaaagtgctgtgtaaccctgga

SEQ ID NO: 345275 - DNA, 25 bp, Homo sapien
aagaaccgtgtaacgctgcagaagt

SEQ ID NO: 345276 - DNA, 25 bp, Homo sapien
gactgttggcccacgtagctttttc

SEQ ID NO: 345277 - DNA, 25 bp, Homo sapien
aggctggcagccatgactaccctgg

SEQ ID NO: 345278 - DNA, 25 bp, Homo sapien
ggcagccatgactaccctggtgagg

SEQ ID NO: 345279 - DNA, 25 bp, Homo sapien
atgactaccctggtgagggcatcta

SEQ ID NO: 345280 - DNA, 25 bp, Homo sapien
tgctgcgcaacaagactctctactt

SEQ ID NO: 345281 - DNA, 25 bp, Homo sapien
aagactctctacttccacatctact

SEQ ID NO: 345282 - DNA, 25 bp, Homo sapien
acatctactacaccagctgaaggac

SEQ ID NO: 345283 - DNA, 25 bp, Homo sapien
gcaggctgtatttgctggctgaagc

SEQ ID NO: 345284 - DNA, 25 bp, Homo sapien
gctgtatttgctggctgaagcaggc

SEQ ID NO: 345285 - DNA, 25 bp, Homo sapien
tgcctcttgtttgggataggcaaga

SEQ ID NO: 345286 - DNA, 25 bp, Homo sapien
tgtctggcatgcctgactgttggcc

SEQ ID NO: 345287 - DNA, 25 bp, Homo sapien
tgtcttcacagcgtccctaaggaag

SEQ ID NO: 345288 - DNA, 25 bp, Homo sapien
cgtccctaaggaagatttttgcagc

SEQ ID NO: 345289 - DNA, 25 bp, Homo sapien
agatttttgcagcactctctggagc

SEQ ID NO: 345290 - DNA, 25 bp, Homo sapien
ttttgcagcactctctggagctgag

SEQ ID NO: 345291 - DNA, 25 bp, Homo sapien
ctgtttccttttctcgaggtggatg

SEQ ID NO: 345292 - DNA, 25 bp, Homo sapien
ttccttttctcgaggtggatgtcct

SEQ ID NO: 345293 - DNA, 25 bp, Homo sapien
tggatgtcctcaggcttccttcaca

SEQ ID NO: 345294 - DNA, 25 bp, Homo sapien
gtttggtctgagacaggtacacagc

SEQ ID NO: 345295 - DNA, 25 bp, Homo sapien
caggtacacagcagataccatccca

SEQ ID NO: 345296 - DNA, 25 bp, Homo sapien
accttcctctctaaagaacaggcca

SEQ ID NO: 345297 - DNA, 25 bp, Homo sapien
aaagaacaggccagccacacatata

SEQ ID NO: 345298 - DNA, 25 bp, Homo sapien
gtcatccagagttataatggcccat

SEQ ID NO: 345299 - DNA, 25 bp, Homo sapien
aatggcccattatctaatggtcaga

SEQ ID NO: 345300 - DNA, 25 bp, Homo sapien
ggtcagagtttacttaggctttcac

SEQ ID NO: 345301 - DNA, 25 bp, Homo sapien
ttacttaggctttcactacttccac

SEQ ID NO: 345302 - DNA, 25 bp, Homo sapien
ttccactgcccacttgaaacaggga

SEQ ID NO: 345303 - DNA, 25 bp, Homo sapien
cccgcgctgtgagtgtgctatttag

SEQ ID NO: 345304 - DNA, 25 bp, Homo sapien
gtgctatttagagctgaccacaagc

SEQ ID NO: 345305 - DNA, 25 bp, Homo sapien
aggatggctcggatgctgcatttcc

SEQ ID NO: 345306 - DNA, 25 bp, Homo sapien
gatgctgcatttccactgagaacac

SEQ ID NO: 345307 - DNA, 25 bp, Homo sapien
tctgctgcccagcaagcacttcagg

SEQ ID NO: 345308 - DNA, 25 bp, Homo sapien
aagcacttcaggctcacaccatttt

SEQ ID NO: 345309 - DNA, 25 bp, Homo sapien
gactgactcggcagtgtgcagtggt

SEQ ID NO: 345310 - DNA, 25 bp, Homo sapien
tgcagtggtgcatgcactgtctcag

SEQ ID NO: 345311 - DNA, 25 bp, Homo sapien
tggtgcatgcactgtctcagccaac

SEQ ID NO: 345312 - DNA, 25 bp, Homo sapien
ttcgcacccctacttcacagaggaa

SEQ ID NO: 345313 - DNA, 25 bp, Homo sapien
caggaactgagccagaaacgcagat

SEQ ID NO: 345314 - DNA, 25 bp, Homo sapien
gaaacgcagattgggctggctctga

SEQ ID NO: 345315 - DNA, 25 bp, Homo sapien
ctgaagccaagcctcttcttacttc

SEQ ID NO: 345316 - DNA, 25 bp, Homo sapien
ggctcctcatttttacgggtaacag

SEQ ID NO: 345317 - DNA, 25 bp, Homo sapien
tttttacgggtaacagtgaggctgg

SEQ ID NO: 345318 - DNA, 25 bp, Homo sapien
acagaccaggaagctcggtgagtga

SEQ ID NO: 345319 - DNA, 25 bp, Homo sapien
aagctcggtgagtgatggcagaacg

SEQ ID NO: 345320 - DNA, 25 bp, Homo sapien
ctgtgtcctcctgtaattttttgag

SEQ ID NO: 345321 - DNA, 25 bp, Homo sapien
tctactttattcctcaacttctttg

SEQ ID NO: 345322 - DNA, 25 bp, Homo sapien
aacttctttgatgaatgtaacccaa

SEQ ID NO: 345323 - DNA, 25 bp, Homo sapien
aagtctcaattcaagctggattagc

SEQ ID NO: 345324 - DNA, 25 bp, Homo sapien
ctggattagccagctcagcataatc

SEQ ID NO: 345325 - DNA, 25 bp, Homo sapien
gctcagcataatcaactagacagtg

SEQ ID NO: 345326 - DNA, 25 bp, Homo sapien
aatttagcagcatacttcgttccca

SEQ ID NO: 345327 - DNA, 25 bp, Homo sapien
cagcatacttcgttcccattctaat

SEQ ID NO: 345328 - DNA, 25 bp, Homo sapien
aagtcatgagttcttgaatcccaga

SEQ ID NO: 345329 - DNA, 25 bp, Homo sapien
gaatcccagagaaataatgcttagg

SEQ ID NO: 345330 - DNA, 25 bp, Homo sapien
ttaggaacttctctcaatctgcttg

SEQ ID NO: 345331 - DNA, 25 bp, Homo sapien
tgggaggaatccgtttttgctccac

SEQ ID NO: 345332 - DNA, 25 bp, Homo sapien
tttgctccacctctttttgagtgaa

SEQ ID NO: 345333 - DNA, 25 bp, Homo sapien
aacagaggacaaaccttgggtcaca

SEQ ID NO: 345334 - DNA, 25 bp, Homo sapien
acaaaccttgggtcacagggcaagt

SEQ ID NO: 345335 - DNA, 25 bp, Homo sapien
cagggcaagtagatcatggaccaca

SEQ ID NO: 345336 - DNA, 25 bp, Homo sapien
tagatcatggaccacagaacagcag

SEQ ID NO: 345337 - DNA, 25 bp, Homo sapien
agtgaaattctggtctcagacacca

SEQ ID NO: 345338 - DNA, 25 bp, Homo sapien
tcagacaccaggagaccagagtctc

SEQ ID NO: 345339 - DNA, 25 bp, Homo sapien
tgaggatgaagtttcctacccctat

SEQ ID NO: 345340 - DNA, 25 bp, Homo sapien
tgaagtttcctacccctatttgtag

SEQ ID NO: 345341 - DNA, 25 bp, Homo sapien
ggaaaactcaaatcccaggccctgg

SEQ ID NO: 345342 - DNA, 25 bp, Homo sapien
acagctttgtacagtagtcattcta

SEQ ID NO: 345343 - DNA, 25 bp, Homo sapien
aatagttttaagcagcattttgtat

SEQ ID NO: 345344 - DNA, 25 bp, Homo sapien
ttatataagacaccatcctgctcga

SEQ ID NO: 345345 - DNA, 25 bp, Homo sapien
gggcacaaagctcacacctggttta

SEQ ID NO: 345346 - DNA, 25 bp, Homo sapien
ctggtttacccttttcagagaggag

SEQ ID NO: 345347 - DNA, 25 bp, Homo sapien
ggtgagtcacggaggtagccataat

SEQ ID NO: 345348 - DNA, 25 bp, Homo sapien
gttagaaaagagtgcctcctgcttc

SEQ ID NO: 345349 - DNA, 25 bp, Homo sapien
cctgcttcagctgaggaagacattt

SEQ ID NO: 345350 - DNA, 25 bp, Homo sapien
tccttttgtcctttaattcacgtct

SEQ ID NO: 345351 - DNA, 25 bp, Homo sapien
attcacgtctttgacatttggaaag

SEQ ID NO: 345352 - DNA, 25 bp, Homo sapien
tttggaaagccaaaactacagacca

SEQ ID NO: 345353 - DNA, 25 bp, Homo sapien
cataatatttttactcaggctggag

SEQ ID NO: 345354 - DNA, 25 bp, Homo sapien
gagtgagacagctctacgtacagat

SEQ ID NO: 345355 - DNA, 25 bp, Homo sapien
acgtacagattgactttgcagccat

SEQ ID NO: 345356 - DNA, 25 bp, Homo sapien
tgactttgcagccatgtagtgaatg

SEQ ID NO: 345357 - DNA, 25 bp, Homo sapien
aagaaattatgcaccttttatggac

SEQ ID NO: 345358 - DNA, 25 bp, Homo sapien
gaccaaatttttctggtactgtacg

SEQ ID NO: 345359 - DNA, 25 bp, Homo sapien
ggtactgtacgatccaaaacattgt

SEQ ID NO: 345360 - DNA, 25 bp, Homo sapien
gaaattatcactacaactcccgagc

SEQ ID NO: 345361 - DNA, 25 bp, Homo sapien
acaactcccgagcactaagtagacg

SEQ ID NO: 345362 - DNA, 25 bp, Homo sapien
ctgatgctgatgctaggtggatttt

SEQ ID NO: 345363 - DNA, 25 bp, Homo sapien
ggtggattttaagccaaacacataa

SEQ ID NO: 345364 - DNA, 25 bp, Homo sapien
ccagacaacccaggcctggattgat

SEQ ID NO: 345365 - DNA, 25 bp, Homo sapien
acccaggcctggattgattttttct

SEQ ID NO: 345366 - DNA, 25 bp, Homo sapien
tgttggagattgacagttcacactg

SEQ ID NO: 345367 - DNA, 25 bp, Homo sapien
agattgacagttcacactggcctgc

SEQ ID NO: 345368 - DNA, 25 bp, Homo sapien
acactggcctgcctcagaatgttgg

SEQ ID NO: 345369 - DNA, 25 bp, Homo sapien
tggcctgcctcagaatgttggcact

SEQ ID NO: 345370 - DNA, 25 bp, Homo sapien
gcctcagaatgttggcactgccact

SEQ ID NO: 345371 - DNA, 25 bp, Homo sapien
gaatgttggcactgccactgactaa

SEQ ID NO: 345372 - DNA, 25 bp, Homo sapien
ttggcactgccactgactaattctg

SEQ ID NO: 345373 - DNA, 25 bp, Homo sapien
gcactgccactgactaattctgtga

SEQ ID NO: 345374 - DNA, 25 bp, Homo sapien
tgactggggcaccttttatagcctc

SEQ ID NO: 345375 - DNA, 25 bp, Homo sapien
gcgagctcttgggttactgcaacct

SEQ ID NO: 345376 - DNA, 25 bp, Homo sapien
tgagccaccacgtttagctgagtat

SEQ ID NO: 345377 - DNA, 25 bp, Homo sapien
gagccaccacgtttagctgagtata

SEQ ID NO: 345378 - DNA, 25 bp, Homo sapien
agccaccacgtttagctgagtataa

SEQ ID NO: 345379 - DNA, 25 bp, Homo sapien
gagtataattttaaatagccctatg

SEQ ID NO: 345380 - DNA, 25 bp, Homo sapien
taattttaaatagccctatgtgaca

SEQ ID NO: 345381 - DNA, 25 bp, Homo sapien
ttaaatagccctatgtgacaagtgg

SEQ ID NO: 345382 - DNA, 25 bp, Homo sapien
aaatagccctatgtgacaagtggct

SEQ ID NO: 345383 - DNA, 25 bp, Homo sapien
agccctatgtgacaagtggctactt

SEQ ID NO: 345384 - DNA, 25 bp, Homo sapien
ccctatgtgacaagtggctacttta

SEQ ID NO: 345385 - DNA, 25 bp, Homo sapien
acaagtggctactttattggacagt

SEQ ID NO: 345386 - DNA, 25 bp, Homo sapien
agcatcaccactcggcttttagcag

SEQ ID NO: 345387 - DNA, 25 bp, Homo sapien
atcaccactcggcttttagcagact

SEQ ID NO: 345388 - DNA, 25 bp, Homo sapien
accactcggcttttagcagactgaa

SEQ ID NO: 345389 - DNA, 25 bp, Homo sapien
cactcggcttttagcagactgaagc

SEQ ID NO: 345390 - DNA, 25 bp, Homo sapien
gttacttgggtgagttggctcccca

SEQ ID NO: 345391 - DNA, 25 bp, Homo sapien
tagttttgtctctagtgatgagcag

SEQ ID NO: 345392 - DNA, 25 bp, Homo sapien
aggctttactggtccaaccagaaag

SEQ ID NO: 345393 - DNA, 25 bp, Homo sapien
tggtccaaccagaaagagaagctaa

SEQ ID NO: 345394 - DNA, 25 bp, Homo sapien
cttggacaccccacagaccaatatc

SEQ ID NO: 345395 - DNA, 25 bp, Homo sapien
accttccaggagaagacccttccag

SEQ ID NO: 345396 - DNA, 25 bp, Homo sapien
gagaagacccttccagctcttgctt

SEQ ID NO: 345397 - DNA, 25 bp, Homo sapien
gagctgcttgtacatctttagaatg

SEQ ID NO: 345398 - DNA, 25 bp, Homo sapien
cttgtacatctttagaatggcagac

SEQ ID NO: 345399 - DNA, 25 bp, Homo sapien
atggcagaccatatgtgtcactgtg

SEQ ID NO: 345400 - DNA, 25 bp, Homo sapien
agaccatatgtgtcactgtgagtgt

SEQ ID NO: 345401 - DNA, 25 bp, Homo sapien
gtgtcactgtgagtgtcagaaatac

SEQ ID NO: 345402 - DNA, 25 bp, Homo sapien
tgcatgagctcattttcaccaactg

SEQ ID NO: 345403 - DNA, 25 bp, Homo sapien
catgagctcattttcaccaactggg

SEQ ID NO: 345404 - DNA, 25 bp, Homo sapien
gtaatgtttctattgatggtataat

SEQ ID NO: 345405 - DNA, 25 bp, Homo sapien
gacactataataagttcagccattt

SEQ ID NO: 345406 - DNA, 25 bp, Homo sapien
ggattaattgttaattcagcattta

SEQ ID NO: 345407 - DNA, 25 bp, Homo sapien
ttcagcatttaatggctaacttaaa

SEQ ID NO: 345408 - DNA, 25 bp, Homo sapien
gggcttctgatcctggctaaaacta

SEQ ID NO: 345409 - DNA, 25 bp, Homo sapien
ccttggtggccagcgggatgataaa

SEQ ID NO: 345410 - DNA, 25 bp, Homo sapien
acagttctgccatcggtgttattgc

SEQ ID NO: 345411 - DNA, 25 bp, Homo sapien
gtgttattgccatctcagtcttagc

SEQ ID NO: 345412 - DNA, 25 bp, Homo sapien
agtcttagcgccacgatgatagcca

SEQ ID NO: 345413 - DNA, 25 bp, Homo sapien
atgatagccacgcagtcctttcgag

SEQ ID NO: 345414 - DNA, 25 bp, Homo sapien
cagtcctttcgagctgtttcaaaaa

SEQ ID NO: 345415 - DNA, 25 bp, Homo sapien
ctggcacctgcgtgaagtatcccta

SEQ ID NO: 345416 - DNA, 25 bp, Homo sapien
gtgaagtatccctactcatctttca

SEQ ID NO: 345417 - DNA, 25 bp, Homo sapien
gttgataggctttcgcagtttttcg

SEQ ID NO: 345418 - DNA, 25 bp, Homo sapien
cgcagtttttcgtccgtgaagttgg

SEQ ID NO: 345419 - DNA, 25 bp, Homo sapien
ctgggatataggctttaaaggatac

SEQ ID NO: 345420 - DNA, 25 bp, Homo sapien
taaaggatacaaaaacagcagcatt

SEQ ID NO: 345421 - DNA, 25 bp, Homo sapien
aggccagatgtgaagattctattaa

SEQ ID NO: 345422 - DNA, 25 bp, Homo sapien
tgaagattctattaatcactgtttc

SEQ ID NO: 345423 - DNA, 25 bp, Homo sapien
gtttcagagaacattaattcttgta

SEQ ID NO: 345424 - DNA, 25 bp, Homo sapien
aaattgcttattatctgtgactacc

SEQ ID NO: 345425 - DNA, 25 bp, Homo sapien
gcttattatctgtgactaccttgca

SEQ ID NO: 345426 - DNA, 25 bp, Homo sapien
gtgactaccttgcagagaacatctc

SEQ ID NO: 345427 - DNA, 25 bp, Homo sapien
gagaacatctcaacagtgcagtaaa

SEQ ID NO: 345428 - DNA, 25 bp, Homo sapien
tgcagtaaaatagctctcctagact

SEQ ID NO: 345429 - DNA, 25 bp, Homo sapien
gtaaaatagctctcctagacttgag

SEQ ID NO: 345430 - DNA, 25 bp, Homo sapien
tgagccaccacgtttagctgagtat

SEQ ID NO: 345431 - DNA, 25 bp, Homo sapien
gagccaccacgtttagctgagtata

SEQ ID NO: 345432 - DNA, 25 bp, Homo sapien
agccaccacgtttagctgagtataa

SEQ ID NO: 345433 - DNA, 25 bp, Homo sapien
gagtataattttaaatagccctatg

SEQ ID NO: 345434 - DNA, 25 bp, Homo sapien
taattttaaatagccctatgtgaca

SEQ ID NO: 345435 - DNA, 25 bp, Homo sapien
ttaaatagccctatgtgacaagtgg

SEQ ID NO: 345436 - DNA, 25 bp, Homo sapien
aaatagccctatgtgacaagtggct

SEQ ID NO: 345437 - DNA, 25 bp, Homo sapien
atagccctatgtgacaagtggctac

SEQ ID NO: 345438 - DNA, 25 bp, Homo sapien
agccctatgtgacaagtggctactt

SEQ ID NO: 345439 - DNA, 25 bp, Homo sapien
gccctatgtgacaagtggctacttt

SEQ ID NO: 345440 - DNA, 25 bp, Homo sapien
ccctatgtgacaagtggctacttta

SEQ ID NO: 345441 - DNA, 25 bp, Homo sapien
ggttacacaaacatatcttcctact

SEQ ID NO: 345442 - DNA, 25 bp, Homo sapien
acacaaacatatcttcctactcagc

SEQ ID NO: 345443 - DNA, 25 bp, Homo sapien
tcttcctactcagccttggtttata

SEQ ID NO: 345444 - DNA, 25 bp, Homo sapien
cctactcagccttggtttataattt

SEQ ID NO: 345445 - DNA, 25 bp, Homo sapien
tcacctgtgctttcggtgtctcttc

SEQ ID NO: 345446 - DNA, 25 bp, Homo sapien
gccttggtttataatttactgttgc

SEQ ID NO: 345447 - DNA, 25 bp, Homo sapien
ttactgttgccctaagaatttcaga

SEQ ID NO: 345448 - DNA, 25 bp, Homo sapien
aggctcttggggtcttgatgtgcaa

SEQ ID NO: 345449 - DNA, 25 bp, Homo sapien
gctttcggtgtctcttctctttttt

SEQ ID NO: 345450 - DNA, 25 bp, Homo sapien
gaaatgctgttgtgaatacaaagaa

SEQ ID NO: 345451 - DNA, 25 bp, Homo sapien
gtgcttgctctttaattcatcttca

SEQ ID NO: 345452 - DNA, 25 bp, Homo sapien
cttcctggctgacatcatcatggat

SEQ ID NO: 345453 - DNA, 25 bp, Homo sapien
gacatcatcatggattccatcaggc

SEQ ID NO: 345454 - DNA, 25 bp, Homo sapien
atcatggattccatcaggcaaaagg

SEQ ID NO: 345455 - DNA, 25 bp, Homo sapien
atcaggcaaaaggaccccaaagcca

SEQ ID NO: 345456 - DNA, 25 bp, Homo sapien
aaagccatcacagccaaggtggtct

SEQ ID NO: 345457 - DNA, 25 bp, Homo sapien
tggccaatcggctgtggaccctgca

SEQ ID NO: 345458 - DNA, 25 bp, Homo sapien
atcggctgtggaccctgcacatcag

SEQ ID NO: 345459 - DNA, 25 bp, Homo sapien
acatcagccccaagcagtttgtggt

SEQ ID NO: 345460 - DNA, 25 bp, Homo sapien
gccccaagcagtttgtggtagattt

SEQ ID NO: 345461 - DNA, 25 bp, Homo sapien
gtttgtggtagatttgctggccatc

SEQ ID NO: 345462 - DNA, 25 bp, Homo sapien
tggtagatttgctggccatcaccgg

SEQ ID NO: 345463 - DNA, 25 bp, Homo sapien
atgaactaaactgagcttccagcag

SEQ ID NO: 345464 - DNA, 25 bp, Homo sapien
aactgagcttccagcagtgatggga

SEQ ID NO: 345465 - DNA, 25 bp, Homo sapien
ttccagcagtgatgggacccactca

SEQ ID NO: 345466 - DNA, 25 bp, Homo sapien
actcagcatcgccattctgcacagc

SEQ ID NO: 345467 - DNA, 25 bp, Homo sapien
gacaggaacctgcaagctcatccat

SEQ ID NO: 345468 - DNA, 25 bp, Homo sapien
accatcatttcccaccaaacaaatg

SEQ ID NO: 345469 - DNA, 25 bp, Homo sapien
aaagagtgcggccttcagttcagtc

SEQ ID NO: 345470 - DNA, 25 bp, Homo sapien
ggccttcagttcagtcttcaatgtg

SEQ ID NO: 345471 - DNA, 25 bp, Homo sapien
ttcagttcagtcttcaatgtgtctt

SEQ ID NO: 345472 - DNA, 25 bp, Homo sapien
gtcttcatttgtttgcaaccgctga

SEQ ID NO: 345473 - DNA, 25 bp, Homo sapien
ggccccgtgcattcaacaacaaaat

SEQ ID NO: 345474 - DNA, 25 bp, Homo sapien
cgacaaggaagagccgtccagcgcg

SEQ ID NO: 345475 - DNA, 25 bp, Homo sapien
aaggaagagccgtccagcgcgcgtc

SEQ ID NO: 345476 - DNA, 25 bp, Homo sapien
tccgtcctgagcgtgggcctagaac

SEQ ID NO: 345477 - DNA, 25 bp, Homo sapien
gagcgtgggcctagaaccaattaca

SEQ ID NO: 345478 - DNA, 25 bp, Homo sapien
gggcctagaaccaattacagagtca

SEQ ID NO: 345479 - DNA, 25 bp, Homo sapien
gaaccaattacagagtcaaacccaa

SEQ ID NO: 345480 - DNA, 25 bp, Homo sapien
gtcaaacccaagagccgaagaaagt

SEQ ID NO: 345481 - DNA, 25 bp, Homo sapien
aaagtgaagactcgcagcttgccgc

SEQ ID NO: 345482 - DNA, 25 bp, Homo sapien
gtgaagactcgcagcttgccgcagc

SEQ ID NO: 345483 - DNA, 25 bp, Homo sapien
cattgagggcgtcctgatttaaacg

SEQ ID NO: 345484 - DNA, 25 bp, Homo sapien
gcgtcctgatttaaacgcgtgcctc

SEQ ID NO: 345485 - DNA, 25 bp, Homo sapien
gaagtttggttcacatttgtaggca

SEQ ID NO: 345486 - DNA, 25 bp, Homo sapien
ggttcacatttgtaggcacttcaga

SEQ ID NO: 345487 - DNA, 25 bp, Homo sapien
ttgtaggcacttcagaaatatcatc

SEQ ID NO: 345488 - DNA, 25 bp, Homo sapien
cacacttaagttcagtgagaacata

SEQ ID NO: 345489 - DNA, 25 bp, Homo sapien
gcaatgatttaaacttctatgtatg

SEQ ID NO: 345490 - DNA, 25 bp, Homo sapien
tctatgtatgtttcagtctgcctca

SEQ ID NO: 345491 - DNA, 25 bp, Homo sapien
atgtatgtttcagtctgcctcagtg

SEQ ID NO: 345492 - DNA, 25 bp, Homo sapien
tatgtttcagtctgcctcagtgtta

SEQ ID NO: 345493 - DNA, 25 bp, Homo sapien
gtttcagtctgcctcagtgttagca

SEQ ID NO: 345494 - DNA, 25 bp, Homo sapien
agtctgcctcagtgttagcagcagg

SEQ ID NO: 345495 - DNA, 25 bp, Homo sapien
tgcctcagtgttagcagcaggaaaa

SEQ ID NO: 345496 - DNA, 25 bp, Homo sapien
ttcaatctccagctaccattcattt

SEQ ID NO: 345497 - DNA, 25 bp, Homo sapien
atttcatttataggtcttaccaggc

SEQ ID NO: 345498 - DNA, 25 bp, Homo sapien
gtcttaccaggcaagaaggccaagc

SEQ ID NO: 345499 - DNA, 25 bp, Homo sapien
aggccaagcagaaggaacctacatc

SEQ ID NO: 345500 - DNA, 25 bp, Homo sapien
aaggaacctacatcagggaagtgct

SEQ ID NO: 345501 - DNA, 25 bp, Homo sapien
gaacacaggtttcttagtttcctga

SEQ ID NO: 345502 - DNA, 25 bp, Homo sapien
aagtaattgagcttgttgccttaac

SEQ ID NO: 345503 - DNA, 25 bp, Homo sapien
gttaaaacactgatcgtgctttact

SEQ ID NO: 345504 - DNA, 25 bp, Homo sapien
tgatcgtgctttacttttaactgag

SEQ ID NO: 345505 - DNA, 25 bp, Homo sapien
ttaactgagcattgagacctcttat

SEQ ID NO: 345506 - DNA, 25 bp, Homo sapien
tgagacctcttataatattccataa

SEQ ID NO: 345507 - DNA, 25 bp, Homo sapien
gtgaaagtggtacactcccgtttct

SEQ ID NO: 345508 - DNA, 25 bp, Homo sapien
tcccgtttctatcttcagagagtgt

SEQ ID NO: 345509 - DNA, 25 bp, Homo sapien
tattttatcctgaatgacatgctcc

SEQ ID NO: 345510 - DNA, 25 bp, Homo sapien
gaatgacatgctcctaagttaaaat

SEQ ID NO: 345511 - DNA, 25 bp, Homo sapien
acgcagggtaactgggagagctctc

SEQ ID NO: 345512 - DNA, 25 bp, Homo sapien
gaaaacggtacactggaaacaatat

SEQ ID NO: 345513 - DNA, 25 bp, Homo sapien
ggaaacaatatgaatcgtgcaacaa

SEQ ID NO: 345514 - DNA, 25 bp, Homo sapien
cgtgcaacaaaagcgagtgaactct

SEQ ID NO: 345515 - DNA, 25 bp, Homo sapien
ctgggagagctctcaatatcaacag

SEQ ID NO: 345516 - DNA, 25 bp, Homo sapien
tcaacagcagctcatcttactgata

SEQ ID NO: 345517 - DNA, 25 bp, Homo sapien
gaagcagatggtttctaggcacaga

SEQ ID NO: 345518 - DNA, 25 bp, Homo sapien
ggttgtctttttaactgctggcaaa

SEQ ID NO: 345519 - DNA, 25 bp, Homo sapien
gttgtctttttaactgctggcaaaa

SEQ ID NO: 345520 - DNA, 25 bp, Homo sapien
ttgtctttttaactgctggcaaaat

SEQ ID NO: 345521 - DNA, 25 bp, Homo sapien
tgtctttttaactgctggcaaaatg

SEQ ID NO: 345522 - DNA, 25 bp, Homo sapien
gtctttttaactgctggcaaaatgt

SEQ ID NO: 345523 - DNA, 25 bp, Homo sapien
taactgctggcaaaatgttgatttt

SEQ ID NO: 345524 - DNA, 25 bp, Homo sapien
attccccagaaattagtagtaagtg

SEQ ID NO: 345525 - DNA, 25 bp, Homo sapien
tgggaagtagttttaatgtagaaag

SEQ ID NO: 345526 - DNA, 25 bp, Homo sapien
aacaatgacatggttaatctggaac

SEQ ID NO: 345527 - DNA, 25 bp, Homo sapien
caatgacatggttaatctggaactt

SEQ ID NO: 345528 - DNA, 25 bp, Homo sapien
aatgacatggttaatctggaactta

SEQ ID NO: 345529 - DNA, 25 bp, Homo sapien
tttcctttacgtctctttctgatga

SEQ ID NO: 345530 - DNA, 25 bp, Homo sapien
ttacgtctctttctgatgacaccag

SEQ ID NO: 345531 - DNA, 25 bp, Homo sapien
tctttctgatgacaccagcacagcg

SEQ ID NO: 345532 - DNA, 25 bp, Homo sapien
acatctctgctcagaactatgtgat

SEQ ID NO: 345533 - DNA, 25 bp, Homo sapien
gctcagaactatgtgatcatctaaa

SEQ ID NO: 345534 - DNA, 25 bp, Homo sapien
ggattcggaacaagatttcagacat

SEQ ID NO: 345535 - DNA, 25 bp, Homo sapien
atctgcatgagtgacaaactttctg

SEQ ID NO: 345536 - DNA, 25 bp, Homo sapien
caccaataatacttatcagcatcat

SEQ ID NO: 345537 - DNA, 25 bp, Homo sapien
tatcagcatcataaagtatctctta

SEQ ID NO: 345538 - DNA, 25 bp, Homo sapien
gtatctcttaaacactgatcttggc

SEQ ID NO: 345539 - DNA, 25 bp, Homo sapien
cttaaacactgatcttggcagggac

SEQ ID NO: 345540 - DNA, 25 bp, Homo sapien
ctagctcaatggtagtgtcctgtcc

SEQ ID NO: 345541 - DNA, 25 bp, Homo sapien
aatggtagtgtcctgtcccaagtct

SEQ ID NO: 345542 - DNA, 25 bp, Homo sapien
gtcccaagtctgtactcagattttc

SEQ ID NO: 345543 - DNA, 25 bp, Homo sapien
gattttcaggtctagaattggttct

SEQ ID NO: 345544 - DNA, 25 bp, Homo sapien
gaattggttctgtttgcacatccaa

SEQ ID NO: 345545 - DNA, 25 bp, Homo sapien
gcacatccaaatttgactgggctga

SEQ ID NO: 345546 - DNA, 25 bp, Homo sapien
gattgatgtaaaaactggtatgcca

SEQ ID NO: 345547 - DNA, 25 bp, Homo sapien
ctggtatgccaattccgtagttata

SEQ ID NO: 345548 - DNA, 25 bp, Homo sapien
taaagcagaggtgttagagaagcca

SEQ ID NO: 345549 - DNA, 25 bp, Homo sapien
aagccagatggctgccaacagaggt

SEQ ID NO: 345550 - DNA, 25 bp, Homo sapien
gctgccaacagaggtctagctcaat

SEQ ID NO: 345551 - DNA, 25 bp, Homo sapien
ggctctgcagctgctctatttccag

SEQ ID NO: 345552 - DNA, 25 bp, Homo sapien
gctctgcagctgctctatttccagg

SEQ ID NO: 345553 - DNA, 25 bp, Homo sapien
tgcagctgctctatttccaggcatg

SEQ ID NO: 345554 - DNA, 25 bp, Homo sapien
gcagctgctctatttccaggcatgt

SEQ ID NO: 345555 - DNA, 25 bp, Homo sapien
cagctgctctatttccaggcatgtg

SEQ ID NO: 345556 - DNA, 25 bp, Homo sapien
agctgctctatttccaggcatgtga

SEQ ID NO: 345557 - DNA, 25 bp, Homo sapien
gctgctctatttccaggcatgtgat

SEQ ID NO: 345558 - DNA, 25 bp, Homo sapien
ctgctctatttccaggcatgtgatc

SEQ ID NO: 345559 - DNA, 25 bp, Homo sapien
gctctatttccaggcatgtgatcgc

SEQ ID NO: 345560 - DNA, 25 bp, Homo sapien
tctatttccaggcatgtgatcgccc

SEQ ID NO: 345561 - DNA, 25 bp, Homo sapien
ctatttccaggcatgtgatcgcccc

SEQ ID NO: 345562 - DNA, 25 bp, Homo sapien
aaactctataattaccaagttgcaa

SEQ ID NO: 345563 - DNA, 25 bp, Homo sapien
aattctatttcacaggttagtgcca

SEQ ID NO: 345564 - DNA, 25 bp, Homo sapien
caggttagtgccaaaatgtcttcat

SEQ ID NO: 345565 - DNA, 25 bp, Homo sapien
gtgccaaaatgtcttcatagagtag

SEQ ID NO: 345566 - DNA, 25 bp, Homo sapien
cattattgtttatcaaagctctttt

SEQ ID NO: 345567 - DNA, 25 bp, Homo sapien
tatccaattgatggttatctacaca

SEQ ID NO: 345568 - DNA, 25 bp, Homo sapien
gatggttatctacacatatcactta

SEQ ID NO: 345569 - DNA, 25 bp, Homo sapien
ggttatctacacatatcacttataa

SEQ ID NO: 345570 - DNA, 25 bp, Homo sapien
agctagtatgtctttttctcgtatt

SEQ ID NO: 345571 - DNA, 25 bp, Homo sapien
agtatgtctttttctcgtatttgga

SEQ ID NO: 345572 - DNA, 25 bp, Homo sapien
tctcgtatttggaatgaaagtaccc

SEQ ID NO: 345573 - DNA, 25 bp, Homo sapien
gaaacactcttgaaagcccttgagc

SEQ ID NO: 345574 - DNA, 25 bp, Homo sapien
ctgtgaacagaaaggtttgagattc

SEQ ID NO: 345575 - DNA, 25 bp, Homo sapien
gcaagttcagagttggatggtctaa

SEQ ID NO: 345576 - DNA, 25 bp, Homo sapien
gatggtctaagaatggaaaagccct

SEQ ID NO: 345577 - DNA, 25 bp, Homo sapien
gagccaggtagcaatttctggttat

SEQ ID NO: 345578 - DNA, 25 bp, Homo sapien
ttatggaaccagaagctctcaggct

SEQ ID NO: 345579 - DNA, 25 bp, Homo sapien
agctctcaggcttcaaataaaacag

SEQ ID NO: 345580 - DNA, 25 bp, Homo sapien
aaaacagcatcacttgtactcttat

SEQ ID NO: 345581 - DNA, 25 bp, Homo sapien
cagcatcacttgtactcttataaaa

SEQ ID NO: 345582 - DNA, 25 bp, Homo sapien
aaaccgtatctacatctgtcctata

SEQ ID NO: 345583 - DNA, 25 bp, Homo sapien
gtatctacatctgtcctataaggca

SEQ ID NO: 345584 - DNA, 25 bp, Homo sapien
atgagatcctacagcaatgccctgg

SEQ ID NO: 345585 - DNA, 25 bp, Homo sapien
tctctccctcttatgtcacttgtca

SEQ ID NO: 345586 - DNA, 25 bp, Homo sapien
acttgtcacacctgctctaggtaat

SEQ ID NO: 345587 - DNA, 25 bp, Homo sapien
aatcattttcctccagatgagaggt

SEQ ID NO: 345588 - DNA, 25 bp, Homo sapien
aggacctgatgccagcaaggaaaaa

SEQ ID NO: 345589 - DNA, 25 bp, Homo sapien
ggaattggtaacatgctctttgttt

SEQ ID NO: 345590 - DNA, 25 bp, Homo sapien
tgtttacctaaaatctgtccccaca

SEQ ID NO: 345591 - DNA, 25 bp, Homo sapien
aagaatgtaacttccttcgaggcag

SEQ ID NO: 345592 - DNA, 25 bp, Homo sapien
cttccttcgaggcagaaattcaatt

SEQ ID NO: 345593 - DNA, 25 bp, Homo sapien
aggcccactcaagagcaagttctgt

SEQ ID NO: 345594 - DNA, 25 bp, Homo sapien
aggtgcttaactaatacaggttctt

SEQ ID NO: 345595 - DNA, 25 bp, Homo sapien
ccttgtgaagcaggatcgttgaagt

SEQ ID NO: 345596 - DNA, 25 bp, Homo sapien
aagcaggatcgttgaagttttaagt

SEQ ID NO: 345597 - DNA, 25 bp, Homo sapien
aacttaggatccctctgacacccca

SEQ ID NO: 345598 - DNA, 25 bp, Homo sapien
ggacacagcagtggctagggcatca

SEQ ID NO: 345599 - DNA, 25 bp, Homo sapien
acacagcagtggctagggcatcagc

SEQ ID NO: 345600 - DNA, 25 bp, Homo sapien
ggctagggcatcagccacagaactg

SEQ ID NO: 345601 - DNA, 25 bp, Homo sapien
gccacagaactgagcgggaaatgcc

SEQ ID NO: 345602 - DNA, 25 bp, Homo sapien
gaactgagcgggaaatgccacttgt

SEQ ID NO: 345603 - DNA, 25 bp, Homo sapien
ctgagcgggaaatgccacttgtatt

SEQ ID NO: 345604 - DNA, 25 bp, Homo sapien
gaaatgccacttgtattggctgtaa

SEQ ID NO: 345605 - DNA, 25 bp, Homo sapien
acttgtattggctgtaaagaaatcc

SEQ ID NO: 345606 - DNA, 25 bp, Homo sapien
ttaggtgcatgatcttcatttacat

SEQ ID NO: 345607 - DNA, 25 bp, Homo sapien
ggtgcatgatcttcatttacataga

SEQ ID NO: 345608 - DNA, 25 bp, Homo sapien
tttacatagaatacttgggtctcag

SEQ ID NO: 345609 - DNA, 25 bp, Homo sapien
catagaatacttgggtctcagaatt

SEQ ID NO: 345610 - DNA, 25 bp, Homo sapien
atacttgggtctcagaattgatgca

SEQ ID NO: 345611 - DNA, 25 bp, Homo sapien
attgatgcaacataagcaggttttt

SEQ ID NO: 345612 - DNA, 25 bp, Homo sapien
ttttttggtgacttacaagagcaat

SEQ ID NO: 345613 - DNA, 25 bp, Homo sapien
ttgcaacctgtgaggtagagcataa

SEQ ID NO: 345614 - DNA, 25 bp, Homo sapien
aacctgtgaggtagagcataaactc

SEQ ID NO: 345615 - DNA, 25 bp, Homo sapien
gagcataaactcaagaaaatagcct

SEQ ID NO: 345616 - DNA, 25 bp, Homo sapien
caaagtgtgaagagagccccaggca

SEQ ID NO: 345617 - DNA, 25 bp, Homo sapien
agatggttctgtgagtccttggcag

SEQ ID NO: 345618 - DNA, 25 bp, Homo sapien
gggtcaaagggcacatctccttgaa

SEQ ID NO: 345619 - DNA, 25 bp, Homo sapien
aaagggcacatctccttgaacctag

SEQ ID NO: 345620 - DNA, 25 bp, Homo sapien
ttgaacctagaaagccccctacact

SEQ ID NO: 345621 - DNA, 25 bp, Homo sapien
aaggtgtcgggagccagcagagcat

SEQ ID NO: 345622 - DNA, 25 bp, Homo sapien
aggagatgccactggccctccgtgc

SEQ ID NO: 345623 - DNA, 25 bp, Homo sapien
gctgtccttgctctctgcagaggcc

SEQ ID NO: 345624 - DNA, 25 bp, Homo sapien
cttgctctctgcagaggccgctctg

SEQ ID NO: 345625 - DNA, 25 bp, Homo sapien
tgcaggatcctcgtgtcgcgcgtga

SEQ ID NO: 345626 - DNA, 25 bp, Homo sapien
aggatcctcgtgtcgcgcgtgatgt

SEQ ID NO: 345627 - DNA, 25 bp, Homo sapien
gtcgcgcgtgatgtgtggtggcaca

SEQ ID NO: 345628 - DNA, 25 bp, Homo sapien
taacaagccaattccttagtcattt

SEQ ID NO: 345629 - DNA, 25 bp, Homo sapien
cagagatctagagagcttttggatt

SEQ ID NO: 345630 - DNA, 25 bp, Homo sapien
atttccttggtgattttggatgcaa

SEQ ID NO: 345631 - DNA, 25 bp, Homo sapien
caaacctgatttctgtgttcacacc

SEQ ID NO: 345632 - DNA, 25 bp, Homo sapien
tcacaccatggccagagatgggact

SEQ ID NO: 345633 - DNA, 25 bp, Homo sapien
tgggactgttagcaccacctgcttc

SEQ ID NO: 345634 - DNA, 25 bp, Homo sapien
acctgcttctttaatgtcgtccata

SEQ ID NO: 345635 - DNA, 25 bp, Homo sapien
atgtcgtccatatgatcagcatcag

SEQ ID NO: 345636 - DNA, 25 bp, Homo sapien
cagaaactccaggtgtcccaaactt

SEQ ID NO: 345637 - DNA, 25 bp, Homo sapien
tccaggtgtcccaaacttaaagtga

SEQ ID NO: 345638 - DNA, 25 bp, Homo sapien
ttctgtgctggttctagaacatgct

SEQ ID NO: 345639 - DNA, 25 bp, Homo sapien
agggttgaggactctctaagtagct

SEQ ID NO: 345640 - DNA, 25 bp, Homo sapien
ttgaggactctctaagtagctgaaa

SEQ ID NO: 345641 - DNA, 25 bp, Homo sapien
ggactctctaagtagctgaaatttt

SEQ ID NO: 345642 - DNA, 25 bp, Homo sapien
tgaaattttaagaacccaggaagag

SEQ ID NO: 345643 - DNA, 25 bp, Homo sapien
atggattggaattactgttccttcc

SEQ ID NO: 345644 - DNA, 25 bp, Homo sapien
aattactgttccttccaaatgtaca

SEQ ID NO: 345645 - DNA, 25 bp, Homo sapien
ttactgttccttccaaatgtacaag

SEQ ID NO: 345646 - DNA, 25 bp, Homo sapien
ataacacagttattggttcccaaat

SEQ ID NO: 345647 - DNA, 25 bp, Homo sapien
ggttcccaaatgcaggtaagcacca

SEQ ID NO: 345648 - DNA, 25 bp, Homo sapien
aaatgcaggtaagcaccaaagggtt

SEQ ID NO: 345649 - DNA, 25 bp, Homo sapien
gcaccaaagggttgaggactctcta

SEQ ID NO: 345650 - DNA, 25 bp, Homo sapien
gagcaagttcagagttggatggtct

SEQ ID NO: 345651 - DNA, 25 bp, Homo sapien
gcaagttcagagttggatggtctaa

SEQ ID NO: 345652 - DNA, 25 bp, Homo sapien
gttcagagttggatggtctaagaat

SEQ ID NO: 345653 - DNA, 25 bp, Homo sapien
tggatggtctaagaatggaaaagcc

SEQ ID NO: 345654 - DNA, 25 bp, Homo sapien
agcaatttctggttatggaaccaga

SEQ ID NO: 345655 - DNA, 25 bp, Homo sapien
ttatggaaccagaagctctcaggct

SEQ ID NO: 345656 - DNA, 25 bp, Homo sapien
ggaaccagaagctctcaggcttcaa

SEQ ID NO: 345657 - DNA, 25 bp, Homo sapien
agctctcaggcttcaaataaaacag

SEQ ID NO: 345658 - DNA, 25 bp, Homo sapien
tctcaggcttcaaataaaacagcat

SEQ ID NO: 345659 - DNA, 25 bp, Homo sapien
aaaacagcatcacttgtactcttat

SEQ ID NO: 345660 - DNA, 25 bp, Homo sapien
cagcatcacttgtactcttataaaa

SEQ ID NO: 345661 - DNA, 25 bp, Homo sapien
agctgcttctgtccatggagtgatc

SEQ ID NO: 345662 - DNA, 25 bp, Homo sapien
atggagtgatcaaccccagtgtgtg

SEQ ID NO: 345663 - DNA, 25 bp, Homo sapien
tctcttcactgactgctgctgcagc

SEQ ID NO: 345664 - DNA, 25 bp, Homo sapien
tgctgctgcagctgttatgccaccc

SEQ ID NO: 345665 - DNA, 25 bp, Homo sapien
acccctgcctcttatgtgggaagtt

SEQ ID NO: 345666 - DNA, 25 bp, Homo sapien
tttactgtctttggaatcaatcacc

SEQ ID NO: 345667 - DNA, 25 bp, Homo sapien
ggaatcaatcaccaaatcttgtaga

SEQ ID NO: 345668 - DNA, 25 bp, Homo sapien
attcaagcagcttaatatcgtttgt

SEQ ID NO: 345669 - DNA, 25 bp, Homo sapien
atatcgtttgtatgtatcccttttc

SEQ ID NO: 345670 - DNA, 25 bp, Homo sapien
gtatgtatcccttttctgaataatt

SEQ ID NO: 345671 - DNA, 25 bp, Homo sapien
gcttcacatgtattaactcaattat

SEQ ID NO: 345672 - DNA, 25 bp, Homo sapien
tgacaggactttcccctttctctga

SEQ ID NO: 345673 - DNA, 25 bp, Homo sapien
ctttcccctttctctgagatgacaa

SEQ ID NO: 345674 - DNA, 25 bp, Homo sapien
gagatgacaatcaggccgctttgct

SEQ ID NO: 345675 - DNA, 25 bp, Homo sapien
aatcaggccgctttgctttgcactg

SEQ ID NO: 345676 - DNA, 25 bp, Homo sapien
aagtcaagtgtgagctcttgagtca

SEQ ID NO: 345677 - DNA, 25 bp, Homo sapien
gctcttgagtcaaaatgcttggatt

SEQ ID NO: 345678 - DNA, 25 bp, Homo sapien
tctctgtacctctatgtcatcatct

SEQ ID NO: 345679 - DNA, 25 bp, Homo sapien
cgggctcgcggttgaggctgattga

SEQ ID NO: 345680 - DNA, 25 bp, Homo sapien
tgtacctctatgtcatcatctttaa

SEQ ID NO: 345681 - DNA, 25 bp, Homo sapien
gcctgcctggcacacggtcagagtc

SEQ ID NO: 345682 - DNA, 25 bp, Homo sapien
tggcacacggtcagagtcccctgac

SEQ ID NO: 345683 - DNA, 25 bp, Homo sapien
gaaccaagcgcctcactggtggtgt

SEQ ID NO: 345684 - DNA, 25 bp, Homo sapien
gcctcactggtggtgtggaagaact

SEQ ID NO: 345685 - DNA, 25 bp, Homo sapien
gaaattcctgggagtctcgaaccac

SEQ ID NO: 345686 - DNA, 25 bp, Homo sapien
gggagtctcgaaccacatattttcc

SEQ ID NO: 345687 - DNA, 25 bp, Homo sapien
acatattttccatcgactacatcca

SEQ ID NO: 345688 - DNA, 25 bp, Homo sapien
tcgactacatccaaagctctgcaaa

SEQ ID NO: 345689 - DNA, 25 bp, Homo sapien
aagctctgcaaagaacggaaccaca

SEQ ID NO: 345690 - DNA, 25 bp, Homo sapien
accacagtcatgtcaatacactatg

SEQ ID NO: 345691 - DNA, 25 bp, Homo sapien
aacccaaaggcatatttctccatgt

SEQ ID NO: 345692 - DNA, 25 bp, Homo sapien
aaggcatatttctccatgtattaat

SEQ ID NO: 345693 - DNA, 25 bp, Homo sapien
ggatgtagcctccagaattactcta

SEQ ID NO: 345694 - DNA, 25 bp, Homo sapien
gctgtggacttcaatttcttcacct

SEQ ID NO: 345695 - DNA, 25 bp, Homo sapien
tgctgagctcactaccaggttcaaa

SEQ ID NO: 345696 - DNA, 25 bp, Homo sapien
actaccaggttcaaagttcaatgac

SEQ ID NO: 345697 - DNA, 25 bp, Homo sapien
gttcaatgacaaactcagtttactg

SEQ ID NO: 345698 - DNA, 25 bp, Homo sapien
tttactgaggtttgagagaacatcc

SEQ ID NO: 345699 - DNA, 25 bp, Homo sapien
gggagctgctctcccagtctaagca

SEQ ID NO: 345700 - DNA, 25 bp, Homo sapien
gctctcccagtctaagcatgtagat

SEQ ID NO: 345701 - DNA, 25 bp, Homo sapien
gtagatatcatcgtttgccttttgt

SEQ ID NO: 345702 - DNA, 25 bp, Homo sapien
atcatcgtttgccttttgtgtgtgt

SEQ ID NO: 345703 - DNA, 25 bp, Homo sapien
ttttttaagcactcacttgtaattt

SEQ ID NO: 345704 - DNA, 25 bp, Homo sapien
agcactcacttgtaattttagtttt

SEQ ID NO: 345705 - DNA, 25 bp, Homo sapien
agtagggtatcttaattatgctcat

SEQ ID NO: 345706 - DNA, 25 bp, Homo sapien
agggtatcttaattatgctcatttc

SEQ ID NO: 345707 - DNA, 25 bp, Homo sapien
acattatctatatgattggaccctt

SEQ ID NO: 345708 - DNA, 25 bp, Homo sapien
ctatatgattggaccctttagtgaa

SEQ ID NO: 345709 - DNA, 25 bp, Homo sapien
ttggaccctttagtgaaatcagaaa

SEQ ID NO: 345710 - DNA, 25 bp, Homo sapien
gcatgaataaatgttcaggacacac

SEQ ID NO: 345711 - DNA, 25 bp, Homo sapien
acatcacagtatcaactctttcagt

SEQ ID NO: 345712 - DNA, 25 bp, Homo sapien
gtagaatacatttcagaggcagaag

SEQ ID NO: 345713 - DNA, 25 bp, Homo sapien
ggcagaagtccctcggattattttt

SEQ ID NO: 345714 - DNA, 25 bp, Homo sapien
atggatattagtggtcaagcagctt

SEQ ID NO: 345715 - DNA, 25 bp, Homo sapien
agtggtcaagcagcttattatttaa

SEQ ID NO: 345716 - DNA, 25 bp, Homo sapien
gattttgattatacttctctgcctc

SEQ ID NO: 345717 - DNA, 25 bp, Homo sapien
acttctctgcctcattgagatctgt

SEQ ID NO: 345718 - DNA, 25 bp, Homo sapien
gagatctgttgtcaccgaaggtcat

SEQ ID NO: 345719 - DNA, 25 bp, Homo sapien
gtcaccgaaggtcattacaagaaga

SEQ ID NO: 345720 - DNA, 25 bp, Homo sapien
aagaaggattctcaagggacagcga

SEQ ID NO: 345721 - DNA, 25 bp, Homo sapien
aagggacagcgaagccccaacggag

SEQ ID NO: 345722 - DNA, 25 bp, Homo sapien
aagagaagtcgcttgagttcacaaa

SEQ ID NO: 345723 - DNA, 25 bp, Homo sapien
aagccctgccataggaggagaaccc

SEQ ID NO: 345724 - DNA, 25 bp, Homo sapien
atacatagcgtaaacaacggccatc

SEQ ID NO: 345725 - DNA, 25 bp, Homo sapien
acaacggccatcaaaaaagcaggac

SEQ ID NO: 345726 - DNA, 25 bp, Homo sapien
aaaaaactcatcttggcgttaattg

SEQ ID NO: 345727 - DNA, 25 bp, Homo sapien
aaatagccgggcgtcatggctcttg

SEQ ID NO: 345728 - DNA, 25 bp, Homo sapien
aatagccgggcgtcatggctcttgc

SEQ ID NO: 345729 - DNA, 25 bp, Homo sapien
atagccgggcgtcatggctcttgcc

SEQ ID NO: 345730 - DNA, 25 bp, Homo sapien
tagccgggcgtcatggctcttgcct

SEQ ID NO: 345731 - DNA, 25 bp, Homo sapien
agccgggcgtcatggctcttgcctg

SEQ ID NO: 345732 - DNA, 25 bp, Homo sapien
ggaggcattgaagcgggagaatcac

SEQ ID NO: 345733 - DNA, 25 bp, Homo sapien
aggcattgaagcgggagaatcactt

SEQ ID NO: 345734 - DNA, 25 bp, Homo sapien
aaatatacaggtcacctttgtatgc

SEQ ID NO: 345735 - DNA, 25 bp, Homo sapien
aatatacaggtcacctttgtatgcc

SEQ ID NO: 345736 - DNA, 25 bp, Homo sapien
atatacaggtcacctttgtatgcct

SEQ ID NO: 345737 - DNA, 25 bp, Homo sapien
tatacaggtcacctttgtatgcctt

SEQ ID NO: 345738 - DNA, 25 bp, Homo sapien
gaaattagttcatcatgattggcca

SEQ ID NO: 345739 - DNA, 25 bp, Homo sapien
tgattggccaagtgagctctgcagt

SEQ ID NO: 345740 - DNA, 25 bp, Homo sapien
ccaagtgagctctgcagtgaatgca

SEQ ID NO: 345741 - DNA, 25 bp, Homo sapien
ataaaagaatgaactgcctgagccc

SEQ ID NO: 345742 - DNA, 25 bp, Homo sapien
tgaatgcagctgtaggtccggtggc

SEQ ID NO: 345743 - DNA, 25 bp, Homo sapien
gatatgcctggaaagtcttcgatct

SEQ ID NO: 345744 - DNA, 25 bp, Homo sapien
aagtcttcgatcttgtcatcttcac

SEQ ID NO: 345745 - DNA, 25 bp, Homo sapien
tcgatcttgtcatcttcaccattgg

SEQ ID NO: 345746 - DNA, 25 bp, Homo sapien
ttcaccattggtgctgctgagtgtg

SEQ ID NO: 345747 - DNA, 25 bp, Homo sapien
acgaggcactcccacaggatgggtc

SEQ ID NO: 345748 - DNA, 25 bp, Homo sapien
ccacaggatgggtcgcacgggaaac

SEQ ID NO: 345749 - DNA, 25 bp, Homo sapien
aagtaatttgcccatggtctcacat

SEQ ID NO: 345750 - DNA, 25 bp, Homo sapien
tggtctcacatagaagcctgtcttc

SEQ ID NO: 345751 - DNA, 25 bp, Homo sapien
ggaacacagcactcagaatcgtctc

SEQ ID NO: 345752 - DNA, 25 bp, Homo sapien
gcataagcctgcatgagcctgggct

SEQ ID NO: 345753 - DNA, 25 bp, Homo sapien
gggacccatcctggtgcatcattcg

SEQ ID NO: 345754 - DNA, 25 bp, Homo sapien
gcatcattcgttggctctgtgacaa

SEQ ID NO: 345755 - DNA, 25 bp, Homo sapien
tgacaatgggcacatcgtttaacct

SEQ ID NO: 345756 - DNA, 25 bp, Homo sapien
gacagagaacacctgaaattgcttc

SEQ ID NO: 345757 - DNA, 25 bp, Homo sapien
aattgcttcagggtcatatgtcaca

SEQ ID NO: 345758 - DNA, 25 bp, Homo sapien
atttcatttgggtatctatcatcat

SEQ ID NO: 345759 - DNA, 25 bp, Homo sapien
tctatcatcattcccattctgcaat

SEQ ID NO: 345760 - DNA, 25 bp, Homo sapien
acgctgatgtgacctcttttctgca

SEQ ID NO: 345761 - DNA, 25 bp, Homo sapien
ctgcccaacagctaggtgtctgagt

SEQ ID NO: 345762 - DNA, 25 bp, Homo sapien
aggtgtctgagtagctttgtctttc

SEQ ID NO: 345763 - DNA, 25 bp, Homo sapien
agtagctttgtctttcatgcatgaa

SEQ ID NO: 345764 - DNA, 25 bp, Homo sapien
tgaacatgaggatcccgtggccact

SEQ ID NO: 345765 - DNA, 25 bp, Homo sapien
cactgtcctgtgaggtaaggtcctg

SEQ ID NO: 345766 - DNA, 25 bp, Homo sapien
gtaaggtcctgttattgtatccaaa

SEQ ID NO: 345767 - DNA, 25 bp, Homo sapien
ggaggttcgccttattgtactagag

SEQ ID NO: 345768 - DNA, 25 bp, Homo sapien
agaggtccgaacttgctgagatttt

SEQ ID NO: 345769 - DNA, 25 bp, Homo sapien
tgagattttgccttgtccgctctgc

SEQ ID NO: 345770 - DNA, 25 bp, Homo sapien
gggctccgtctctcaggtgagctgc

SEQ ID NO: 345771 - DNA, 25 bp, Homo sapien
agagctgccactgctcctcataccc

SEQ ID NO: 345772 - DNA, 25 bp, Homo sapien
gggtgatggctatccatgcttgaac

SEQ ID NO: 345773 - DNA, 25 bp, Homo sapien
ggtgatggctatccatgcttgaaca

SEQ ID NO: 345774 - DNA, 25 bp, Homo sapien
gtgatggctatccatgcttgaacat

SEQ ID NO: 345775 - DNA, 25 bp, Homo sapien
tgatggctatccatgcttgaacatt

SEQ ID NO: 345776 - DNA, 25 bp, Homo sapien
gctcagagaaatgaaggtcatgttc

SEQ ID NO: 345777 - DNA, 25 bp, Homo sapien
gagaaatgaaggtcatgttcaggga

SEQ ID NO: 345778 - DNA, 25 bp, Homo sapien
tgttcagggaacagtgaggtcagaa

SEQ ID NO: 345779 - DNA, 25 bp, Homo sapien
ttcagggaacagtgaggtcagaata

SEQ ID NO: 345780 - DNA, 25 bp, Homo sapien
cagggaacagtgaggtcagaataaa

SEQ ID NO: 345781 - DNA, 25 bp, Homo sapien
cagtgaggtcagaataaaattggga

SEQ ID NO: 345782 - DNA, 25 bp, Homo sapien
gcccagcctgggattttctagaaaa

SEQ ID NO: 345783 - DNA, 25 bp, Homo sapien
tgaagttaaattctacaacactgtc

SEQ ID NO: 345784 - DNA, 25 bp, Homo sapien
aagcaggagctgacttccgagacgt

SEQ ID NO: 345785 - DNA, 25 bp, Homo sapien
tgacttccgagacgtagcagcctac

SEQ ID NO: 345786 - DNA, 25 bp, Homo sapien
gctaagcagccccaagatcttgatg

SEQ ID NO: 345787 - DNA, 25 bp, Homo sapien
agcctacacttctctcaagggcaaa

SEQ ID NO: 345788 - DNA, 25 bp, Homo sapien
caagggcaaaggctcatcatgaaga

SEQ ID NO: 345789 - DNA, 25 bp, Homo sapien
tcatgaagacacaaagggctcctag

SEQ ID NO: 345790 - DNA, 25 bp, Homo sapien
agggctcctaggtagcctttggcaa

SEQ ID NO: 345791 - DNA, 25 bp, Homo sapien
gaatttgtttcattctggtccacac

SEQ ID NO: 345792 - DNA, 25 bp, Homo sapien
gtttcattctggtccacactggaga

SEQ ID NO: 345793 - DNA, 25 bp, Homo sapien
tagacatgtaaagacacaccagaag

SEQ ID NO: 345794 - DNA, 25 bp, Homo sapien
gacacaccagaaggaaaccctatga

SEQ ID NO: 345795 - DNA, 25 bp, Homo sapien
aaaagctttcacttcttccagttct

SEQ ID NO: 345796 - DNA, 25 bp, Homo sapien
gaaagccgtcagatcagcctcaaga

SEQ ID NO: 345797 - DNA, 25 bp, Homo sapien
gtcagatcagcctcaagacttcaaa

SEQ ID NO: 345798 - DNA, 25 bp, Homo sapien
tcagcctcaagacttcaaatgcatg

SEQ ID NO: 345799 - DNA, 25 bp, Homo sapien
gcatggaagcactcacacttggcag

SEQ ID NO: 345800 - DNA, 25 bp, Homo sapien
aggactcatacgagagagaatccgt

SEQ ID NO: 345801 - DNA, 25 bp, Homo sapien
gcattcagcttgcttaattgctttc

SEQ ID NO: 345802 - DNA, 25 bp, Homo sapien
gcttgcttaattgctttcatagaca

SEQ ID NO: 345803 - DNA, 25 bp, Homo sapien
gcttaattgctttcatagacatgta

SEQ ID NO: 345804 - DNA, 25 bp, Homo sapien
agagagatcaaagacagctggactg

SEQ ID NO: 345805 - DNA, 25 bp, Homo sapien
agctggactgtacctgtttgtgtaa

SEQ ID NO: 345806 - DNA, 25 bp, Homo sapien
ggactgtacctgtttgtgtaattat

SEQ ID NO: 345807 - DNA, 25 bp, Homo sapien
acctgtttgtgtaattatttctgat

SEQ ID NO: 345808 - DNA, 25 bp, Homo sapien
gagactgttaaactctgttcatgat

SEQ ID NO: 345809 - DNA, 25 bp, Homo sapien
aactctgttcatgataaactccata

SEQ ID NO: 345810 - DNA, 25 bp, Homo sapien
gttcatgataaactccatattacat

SEQ ID NO: 345811 - DNA, 25 bp, Homo sapien
ggtgaacagattaattccctccatg

SEQ ID NO: 345812 - DNA, 25 bp, Homo sapien
gattaattccctccatgtaactaag

SEQ ID NO: 345813 - DNA, 25 bp, Homo sapien
attccctccatgtaactaagatact

SEQ ID NO: 345814 - DNA, 25 bp, Homo sapien
actaagatactctatttacattatt

SEQ ID NO: 345815 - DNA, 25 bp, Homo sapien
gtgctccagacaatgtattagaggt

SEQ ID NO: 345816 - DNA, 25 bp, Homo sapien
tattagaggtgacagcccgtgccat

SEQ ID NO: 345817 - DNA, 25 bp, Homo sapien
aggtgacagcccgtgccataacata

SEQ ID NO: 345818 - DNA, 25 bp, Homo sapien
cgtgccataacatactacctggatg

SEQ ID NO: 345819 - DNA, 25 bp, Homo sapien
tactacctggatgtatctgcggaat

SEQ ID NO: 345820 - DNA, 25 bp, Homo sapien
ctgcggaatgtacccgaaggattgt

SEQ ID NO: 345821 - DNA, 25 bp, Homo sapien
aacttaacaacaggactagcagaga

SEQ ID NO: 345822 - DNA, 25 bp, Homo sapien
taagtattacttattggctcattac

SEQ ID NO: 345823 - DNA, 25 bp, Homo sapien
cttattggctcattacttatttttc

SEQ ID NO: 345824 - DNA, 25 bp, Homo sapien
ttatttttctcagacctctcaggga

SEQ ID NO: 345825 - DNA, 25 bp, Homo sapien
cctctcagggatgagtattggctca

SEQ ID NO: 345826 - DNA, 25 bp, Homo sapien
gggtaaggaactctccctgcagctc

SEQ ID NO: 345827 - DNA, 25 bp, Homo sapien
gcagctctgaggatacttaaatcta

SEQ ID NO: 345828 - DNA, 25 bp, Homo sapien
tctaggatcctagtcttagtctccc

SEQ ID NO: 345829 - DNA, 25 bp, Homo sapien
aaaagtccttctcccacagattgaa

SEQ ID NO: 345830 - DNA, 25 bp, Homo sapien
aagctgaatatagtcttccttggga

SEQ ID NO: 345831 - DNA, 25 bp, Homo sapien
gtcttccttgggacaaatgcatttg

SEQ ID NO: 345832 - DNA, 25 bp, Homo sapien
ttgtccataggactctttcccgaga

SEQ ID NO: 345833 - DNA, 25 bp, Homo sapien
tttcccgagattgttttaggcccat

SEQ ID NO: 345834 - DNA, 25 bp, Homo sapien
gttttaggcccatttctgtacctct

SEQ ID NO: 345835 - DNA, 25 bp, Homo sapien
agactgttagccacagacccttagt

SEQ ID NO: 345836 - DNA, 25 bp, Homo sapien
gacccttagtcattgcaaagttact

SEQ ID NO: 345837 - DNA, 25 bp, Homo sapien
caaatcagtgtatgcctgtgtaact

SEQ ID NO: 345838 - DNA, 25 bp, Homo sapien
tgccgcatctgccatataaaggaga

SEQ ID NO: 345839 - DNA, 25 bp, Homo sapien
gtatgcctgtgtaactggtaaatag

SEQ ID NO: 345840 - DNA, 25 bp, Homo sapien
agggtaattatttcatgtgcttcta

SEQ ID NO: 345841 - DNA, 25 bp, Homo sapien
ttatttcatgtgcttctaactcaga

SEQ ID NO: 345842 - DNA, 25 bp, Homo sapien
aacagcggttttctgaagatccagt

SEQ ID NO: 345843 - DNA, 25 bp, Homo sapien
gttggacaattttcattttcatcat

SEQ ID NO: 345844 - DNA, 25 bp, Homo sapien
ataatggacatttatctcctacctg

SEQ ID NO: 345845 - DNA, 25 bp, Homo sapien
attatccactgtcttccctcggaga

SEQ ID NO: 345846 - DNA, 25 bp, Homo sapien
ccattttcaaaggatcttcggctct

SEQ ID NO: 345847 - DNA, 25 bp, Homo sapien
atcttcggctctacttttcaagcaa

SEQ ID NO: 345848 - DNA, 25 bp, Homo sapien
tgacacgaatgtactaccgaaggaa

SEQ ID NO: 345849 - DNA, 25 bp, Homo sapien
ggttgggtatgaaactttctcttct

SEQ ID NO: 345850 - DNA, 25 bp, Homo sapien
tctcttctccagacctggacttgaa

SEQ ID NO: 345851 - DNA, 25 bp, Homo sapien
tggacttgaacctcaaagcctaagg

SEQ ID NO: 345852 - DNA, 25 bp, Homo sapien
gaaaggatgctgtactcattagaat

SEQ ID NO: 345853 - DNA, 25 bp, Homo sapien
atacaagattcctttactgtccctc

SEQ ID NO: 345854 - DNA, 25 bp, Homo sapien
accttgaccaaatgggaagcattcc

SEQ ID NO: 345855 - DNA, 25 bp, Homo sapien
ttgtcaacacaagctggcagataca

SEQ ID NO: 345856 - DNA, 25 bp, Homo sapien
ggcagatacatttgactctacagat

SEQ ID NO: 345857 - DNA, 25 bp, Homo sapien
gactctacagatgaaggtgaacaat

SEQ ID NO: 345858 - DNA, 25 bp, Homo sapien
ggatcttgcctggaaggtgttttaa

SEQ ID NO: 345859 - DNA, 25 bp, Homo sapien
agcgccatacggttgctatcaccca

SEQ ID NO: 345860 - DNA, 25 bp, Homo sapien
atacggttgctatcacccaacatgg

SEQ ID NO: 345861 - DNA, 25 bp, Homo sapien
cggttgctatcacccaacatggtga

SEQ ID NO: 345862 - DNA, 25 bp, Homo sapien
cccaacatggtgaaagggtgatgga

SEQ ID NO: 345863 - DNA, 25 bp, Homo sapien
agggtgatggatttcactgtgaata

SEQ ID NO: 345864 - DNA, 25 bp, Homo sapien
gaatatgccaaggacacctctaaac

SEQ ID NO: 345865 - DNA, 25 bp, Homo sapien
atgccaaggacacctctaaacttcc

SEQ ID NO: 345866 - DNA, 25 bp, Homo sapien
taaacttcccccatgtcagtcagat

SEQ ID NO: 345867 - DNA, 25 bp, Homo sapien
ccccatgtcagtcagatgaagttac

SEQ ID NO: 345868 - DNA, 25 bp, Homo sapien
ccatgtcagtcagatgaagttacta

SEQ ID NO: 345869 - DNA, 25 bp, Homo sapien
gttactactatatttcaccaccctg

SEQ ID NO: 345870 - DNA, 25 bp, Homo sapien
aggagccccgtctgtagctgtgagt

SEQ ID NO: 345871 - DNA, 25 bp, Homo sapien
agctgtgagtcagcatcaccatgtc

SEQ ID NO: 345872 - DNA, 25 bp, Homo sapien
atgtccaaaacaaagtccacgagtg

SEQ ID NO: 345873 - DNA, 25 bp, Homo sapien
tccacgagtggccaaaacccaacag

SEQ ID NO: 345874 - DNA, 25 bp, Homo sapien
aaagttaatcagacccagccagaag

SEQ ID NO: 345875 - DNA, 25 bp, Homo sapien
tgcagctctgcggaagacttcgacc

SEQ ID NO: 345876 - DNA, 25 bp, Homo sapien
gacttcgaccaccacgggagagttt

SEQ ID NO: 345877 - DNA, 25 bp, Homo sapien
gagagtttctcttggaagtgatcga

SEQ ID NO: 345878 - DNA, 25 bp, Homo sapien
gaagtgatcgattagtcccgagaga

SEQ ID NO: 345879 - DNA, 25 bp, Homo sapien
ggttttgccagcttcagagttgtca

SEQ ID NO: 345880 - DNA, 25 bp, Homo sapien
gacactagtggccagcaaaaacctc

SEQ ID NO: 345881 - DNA, 25 bp, Homo sapien
gagccgggagcgcaggtcagattca

SEQ ID NO: 345882 - DNA, 25 bp, Homo sapien
gattcagaggaagagcggtggcagc

SEQ ID NO: 345883 - DNA, 25 bp, Homo sapien
cggtggcagcgctcagggatgcgaa

SEQ ID NO: 345884 - DNA, 25 bp, Homo sapien
ctcagggatgcgaagccggagcccc

SEQ ID NO: 345885 - DNA, 25 bp, Homo sapien
cgcggcccaagtggcactcaagaga

SEQ ID NO: 345886 - DNA, 25 bp, Homo sapien
ggcactcaagagatgggtcctctca

SEQ ID NO: 345887 - DNA, 25 bp, Homo sapien
aagagatgggtcctctcagtcggac

SEQ ID NO: 345888 - DNA, 25 bp, Homo sapien
tctcagtcggactcaggagaggagc

SEQ ID NO: 345889 - DNA, 25 bp, Homo sapien
cgaaggcggcagagtcagagcggga

SEQ ID NO: 345890 - DNA, 25 bp, Homo sapien
agccgaagtcggagcaggagccatg

SEQ ID NO: 345891 - DNA, 25 bp, Homo sapien
agcaggagccatgggcggcgaaacc

SEQ ID NO: 345892 - DNA, 25 bp, Homo sapien
tgggaaagggccgtcagtcactctg

SEQ ID NO: 345893 - DNA, 25 bp, Homo sapien
agtcactctggctgctttctcctaa

SEQ ID NO: 345894 - DNA, 25 bp, Homo sapien
gctttctcctaactgggcgtagtgg

SEQ ID NO: 345895 - DNA, 25 bp, Homo sapien
tttgcagctgtctgagtgtactcac

SEQ ID NO: 345896 - DNA, 25 bp, Homo sapien
agtgtactcacgcaagccaggctga

SEQ ID NO: 345897 - DNA, 25 bp, Homo sapien
gcaagccaggctgaggttccaaggc

SEQ ID NO: 345898 - DNA, 25 bp, Homo sapien
aaggcttcatgacaaaggtgttagt

SEQ ID NO: 345899 - DNA, 25 bp, Homo sapien
aggtgttagtattctcatctatggt

SEQ ID NO: 345900 - DNA, 25 bp, Homo sapien
ctcatctatggttttagtacagcat

SEQ ID NO: 345901 - DNA, 25 bp, Homo sapien
agtacagcatttaagtggacattta

SEQ ID NO: 345902 - DNA, 25 bp, Homo sapien
taaggagtgcaaattccagttaagc

SEQ ID NO: 345903 - DNA, 25 bp, Homo sapien
gagtccgttgctgcagtctccttgg

SEQ ID NO: 345904 - DNA, 25 bp, Homo sapien
gggctgctggaaaactcaatcaaac

SEQ ID NO: 345905 - DNA, 25 bp, Homo sapien
tttgaggagcagtttaggtacatac

SEQ ID NO: 345906 - DNA, 25 bp, Homo sapien
taggtacatactgccttttgtttag

SEQ ID NO: 345907 - DNA, 25 bp, Homo sapien
tgttttccttactcagtctaactga

SEQ ID NO: 345908 - DNA, 25 bp, Homo sapien
aactgaggctaattttgcaacttca

SEQ ID NO: 345909 - DNA, 25 bp, Homo sapien
ttgcaacttcaataacacttcggag

SEQ ID NO: 345910 - DNA, 25 bp, Homo sapien
ggttagttaagacaaagccctcatt

SEQ ID NO: 345911 - DNA, 25 bp, Homo sapien
aagccctcattaacgtttgctgcag

SEQ ID NO: 345912 - DNA, 25 bp, Homo sapien
cattaacgtttgctgcaggacttaa

SEQ ID NO: 345913 - DNA, 25 bp, Homo sapien
tttacctcccaactaacaaacatag

SEQ ID NO: 345914 - DNA, 25 bp, Homo sapien
aaggctgtgctggataaggctgaac

SEQ ID NO: 345915 - DNA, 25 bp, Homo sapien
aaggctgaaccttcctcataagcaa

SEQ ID NO: 345916 - DNA, 25 bp, Homo sapien
gcaacaccaactgctttattccagg

SEQ ID NO: 345917 - DNA, 25 bp, Homo sapien
ttattccaggtcagggccaactctt

SEQ ID NO: 345918 - DNA, 25 bp, Homo sapien
aactcttccgccatgatacatacat

SEQ ID NO: 345919 - DNA, 25 bp, Homo sapien
atacatacatggtccctggcgggca

SEQ ID NO: 345920 - DNA, 25 bp, Homo sapien
cctggcgggcactgtccttactggg

SEQ ID NO: 345921 - DNA, 25 bp, Homo sapien
ggtgatggcccagttgtagttcttc

SEQ ID NO: 345922 - DNA, 25 bp, Homo sapien
cagttgtagttcttccgggagtcca

SEQ ID NO: 345923 - DNA, 25 bp, Homo sapien
ttccgggagtccaatgctgcttcca

SEQ ID NO: 345924 - DNA, 25 bp, Homo sapien
ctccaggttctctcgggtgatgaag

SEQ ID NO: 345925 - DNA, 25 bp, Homo sapien
ttgcaaatggactataaacagggac

SEQ ID NO: 345926 - DNA, 25 bp, Homo sapien
aacagggacattatattcttacact

SEQ ID NO: 345927 - DNA, 25 bp, Homo sapien
tcttacactaaaaatccttgcattt

SEQ ID NO: 345928 - DNA, 25 bp, Homo sapien
atttaagcttggacagttttcagag

SEQ ID NO: 345929 - DNA, 25 bp, Homo sapien
tactcttttcacatggctgaatcga

SEQ ID NO: 345930 - DNA, 25 bp, Homo sapien
tggctgaatcgaaacatgtgtaatg

SEQ ID NO: 345931 - DNA, 25 bp, Homo sapien
atgtaaaaccaatcacagctgtgaa

SEQ ID NO: 345932 - DNA, 25 bp, Homo sapien
gctgtgaactgcatgaaatgtattg

SEQ ID NO: 345933 - DNA, 25 bp, Homo sapien
gaacacaagattaagctttgtcagg

SEQ ID NO: 345934 - DNA, 25 bp, Homo sapien
ctttgtcaggttaatgtagcatgtt

SEQ ID NO: 345935 - DNA, 25 bp, Homo sapien
gtagcatgttaaggactctagaaaa

SEQ ID NO: 345936 - DNA, 25 bp, Homo sapien
ctttttctagcatttttgcatttac

SEQ ID NO: 345937 - DNA, 25 bp, Homo sapien
ttttgcatttacctgttaattgaag

SEQ ID NO: 345938 - DNA, 25 bp, Homo sapien
gttaattgaagtataccccaccaca

SEQ ID NO: 345939 - DNA, 25 bp, Homo sapien
gaagtataccccaccacatataaaa

SEQ ID NO: 345940 - DNA, 25 bp, Homo sapien
ccaccacatataaaagttcctctta

SEQ ID NO: 345941 - DNA, 25 bp, Homo sapien
cctcttaaagacactggactcttcc

SEQ ID NO: 345942 - DNA, 25 bp, Homo sapien
aaattttttattggcctctgatgtt

SEQ ID NO: 345943 - DNA, 25 bp, Homo sapien
ttattggcctctgatgttctgttta

SEQ ID NO: 345944 - DNA, 25 bp, Homo sapien
gttagtaccctaagtatatctgaaa

SEQ ID NO: 345945 - DNA, 25 bp, Homo sapien
ttgagagaagattttggcattccag

SEQ ID NO: 345946 - DNA, 25 bp, Homo sapien
ggcattccagatggtatagtctata

SEQ ID NO: 345947 - DNA, 25 bp, Homo sapien
gagagcgttgcattaaatgcgatga

SEQ ID NO: 345948 - DNA, 25 bp, Homo sapien
tgcattaaatgcgatgagtgggttt

SEQ ID NO: 345949 - DNA, 25 bp, Homo sapien
cagtccgccgtagggattcggctaa

SEQ ID NO: 345950 - DNA, 25 bp, Homo sapien
tccgccgtagggattcggctaacta

SEQ ID NO: 345951 - DNA, 25 bp, Homo sapien
tcctggaagtgtcccgaagccttct

SEQ ID NO: 345952 - DNA, 25 bp, Homo sapien
gaagtgtcccgaagccttctttaat

SEQ ID NO: 345953 - DNA, 25 bp, Homo sapien
gtgtcccgaagccttctttaatgaa

SEQ ID NO: 345954 - DNA, 25 bp, Homo sapien
gaagccttctttaatgaaaatctag

SEQ ID NO: 345955 - DNA, 25 bp, Homo sapien
agggattcggctaactagagcccga

SEQ ID NO: 345956 - DNA, 25 bp, Homo sapien
ttcggctaactagagcccgaggtcg

SEQ ID NO: 345957 - DNA, 25 bp, Homo sapien
tagagcccgaggtcggcacccctga

SEQ ID NO: 345958 - DNA, 25 bp, Homo sapien
gatggccatattcactggctgacga

SEQ ID NO: 345959 - DNA, 25 bp, Homo sapien
aagcttcccgagagcaggtaatttt

SEQ ID NO: 345960 - DNA, 25 bp, Homo sapien
gtagagagtcagtgaaaaccctcaa

SEQ ID NO: 345961 - DNA, 25 bp, Homo sapien
gttgtttcctttgcatatactgcat

SEQ ID NO: 345962 - DNA, 25 bp, Homo sapien
gcatatactgcatctctatgtctac

SEQ ID NO: 345963 - DNA, 25 bp, Homo sapien
ctatgtctacattgtctgaggtctg

SEQ ID NO: 345964 - DNA, 25 bp, Homo sapien
cattgtctgaggtctgactgtggac

SEQ ID NO: 345965 - DNA, 25 bp, Homo sapien
tgtggacccctttcccaatgtgaca

SEQ ID NO: 345966 - DNA, 25 bp, Homo sapien
gtggccatgggattcggacgttgct

SEQ ID NO: 345967 - DNA, 25 bp, Homo sapien
gtccagccacctaatgtatgcacag

SEQ ID NO: 345968 - DNA, 25 bp, Homo sapien
caggagaggttgacagaggatccac

SEQ ID NO: 345969 - DNA, 25 bp, Homo sapien
agcccatccgcctcagtggagtaga

SEQ ID NO: 345970 - DNA, 25 bp, Homo sapien
agtggagtagattctgtctttggca

SEQ ID NO: 345971 - DNA, 25 bp, Homo sapien
gtctttggcagggttatcacagctc

SEQ ID NO: 345972 - DNA, 25 bp, Homo sapien
tatcacagctcagccaccaaagtgg

SEQ ID NO: 345973 - DNA, 25 bp, Homo sapien
gtggaccgggactttcagagtttca

SEQ ID NO: 345974 - DNA, 25 bp, Homo sapien
gagtttcagacaagtcagccttttg

SEQ ID NO: 345975 - DNA, 25 bp, Homo sapien
atcattagcagggagcaccagtggc

SEQ ID NO: 345976 - DNA, 25 bp, Homo sapien
gcaccagtggcccattggactgaag

SEQ ID NO: 345977 - DNA, 25 bp, Homo sapien
tggagtgagtcccaagttaccctgc

SEQ ID NO: 345978 - DNA, 25 bp, Homo sapien
cacacatcagagttgcgcacgatga

SEQ ID NO: 345979 - DNA, 25 bp, Homo sapien
acaaaggactggtcaggaagcccca

SEQ ID NO: 345980 - DNA, 25 bp, Homo sapien
gatggtacatgtcagtgttggtcat

SEQ ID NO: 345981 - DNA, 25 bp, Homo sapien
ggtgtgcgttggacatgcacatgaa

SEQ ID NO: 345982 - DNA, 25 bp, Homo sapien
aaagattgaatacaccaagggacaa

SEQ ID NO: 345983 - DNA, 25 bp, Homo sapien
aatagaactgtgacccaggatctgc

SEQ ID NO: 345984 - DNA, 25 bp, Homo sapien
gtgacccaggatctgcatcaaccag

SEQ ID NO: 345985 - DNA, 25 bp, Homo sapien
atcaaccagcccagtaaactaacct

SEQ ID NO: 345986 - DNA, 25 bp, Homo sapien
ggacatgcacatgaactgatcaagc

SEQ ID NO: 345987 - DNA, 25 bp, Homo sapien
aactaacctgttatctagccatgcc

SEQ ID NO: 345988 - DNA, 25 bp, Homo sapien
gttatctagccatgccagacttgta

SEQ ID NO: 345989 - DNA, 25 bp, Homo sapien
ctgatcaagcttgatttcttcctct

SEQ ID NO: 345990 - DNA, 25 bp, Homo sapien
ggaattctcaaagcttcatattggg

SEQ ID NO: 345991 - DNA, 25 bp, Homo sapien
gagaggaagagaacaaatgtgacaa

SEQ ID NO: 345992 - DNA, 25 bp, Homo sapien
gaaaatcggtaaacctgtaggccag

SEQ ID NO: 345993 - DNA, 25 bp, Homo sapien
aaatcggtaaacctgtaggccagct

SEQ ID NO: 345994 - DNA, 25 bp, Homo sapien
aatcggtaaacctgtaggccagctg

SEQ ID NO: 345995 - DNA, 25 bp, Homo sapien
atcggtaaacctgtaggccagctgc

SEQ ID NO: 345996 - DNA, 25 bp, Homo sapien
tcggtaaacctgtaggccagctgca

SEQ ID NO: 345997 - DNA, 25 bp, Homo sapien
cggtaaacctgtaggccagctgcag

SEQ ID NO: 345998 - DNA, 25 bp, Homo sapien
ggtaaacctgtaggccagctgcagt

SEQ ID NO: 345999 - DNA, 25 bp, Homo sapien
tctctacaaaattaggaggttgagg

SEQ ID NO: 346000 - DNA, 25 bp, Homo sapien
ggatgatttgagtctaggaggcgga

SEQ ID NO: 346001 - DNA, 25 bp, Homo sapien
acaccaatgcagttcagcctgggcg

SEQ ID NO: 346002 - DNA, 25 bp, Homo sapien
tggattccatatcctggatggaggg

SEQ ID NO: 346003 - DNA, 25 bp, Homo sapien
ttaaaataaaattagcagctcttcc

SEQ ID NO: 346004 - DNA, 25 bp, Homo sapien
tgaggttgtggaaaacccaaattca

SEQ ID NO: 346005 - DNA, 25 bp, Homo sapien
tgtggaaaacccaaattcaaggaca

SEQ ID NO: 346006 - DNA, 25 bp, Homo sapien
aattcaaggacaatttggctagcta

SEQ ID NO: 346007 - DNA, 25 bp, Homo sapien
ggacaatttggctagctaaagacag

SEQ ID NO: 346008 - DNA, 25 bp, Homo sapien
atttggctagctaaagacagaatac

SEQ ID NO: 346009 - DNA, 25 bp, Homo sapien
aagacagaatacaagactgggtggc

SEQ ID NO: 346010 - DNA, 25 bp, Homo sapien
tggcaagaactgctctatttaataa

SEQ ID NO: 346011 - DNA, 25 bp, Homo sapien
agaactgctctatttaataagcatt

SEQ ID NO: 346012 - DNA, 25 bp, Homo sapien
gaagatttttaatatgttagcaaac

SEQ ID NO: 346013 - DNA, 25 bp, Homo sapien
gaagagcagctggtaggatattaaa

SEQ ID NO: 346014 - DNA, 25 bp, Homo sapien
tatctgggaggttgcctctttgttc

SEQ ID NO: 346015 - DNA, 25 bp, Homo sapien
gagtggcagagtgatgttctactac

SEQ ID NO: 346016 - DNA, 25 bp, Homo sapien
gtgatgttctactactgggtctgaa

SEQ ID NO: 346017 - DNA, 25 bp, Homo sapien
tctactactgggtctgaaatacttc

SEQ ID NO: 346018 - DNA, 25 bp, Homo sapien
gaaatacttcataattcagcagtcc

SEQ ID NO: 346019 - DNA, 25 bp, Homo sapien
aattcagcagtccattagccctgtt

SEQ ID NO: 346020 - DNA, 25 bp, Homo sapien
tagccctgtttttcgttactgttgc

SEQ ID NO: 346021 - DNA, 25 bp, Homo sapien
ttgcctctttgttcgctgaaggtta

SEQ ID NO: 346022 - DNA, 25 bp, Homo sapien
tctcctccaccccaatgaggttaag

SEQ ID NO: 346023 - DNA, 25 bp, Homo sapien
cctgtgtttcaaagatgcaatctgg

SEQ ID NO: 346024 - DNA, 25 bp, Homo sapien
aagtttatctgaatgcattgagagg

SEQ ID NO: 346025 - DNA, 25 bp, Homo sapien
ggaaaagtccagacctaggactagt

SEQ ID NO: 346026 - DNA, 25 bp, Homo sapien
gacctaggactagttatggcagttg

SEQ ID NO: 346027 - DNA, 25 bp, Homo sapien
aaatatgccattgactatcttaact

SEQ ID NO: 346028 - DNA, 25 bp, Homo sapien
gccattgactatcttaactactgta

SEQ ID NO: 346029 - DNA, 25 bp, Homo sapien
gggactagaacaaactgtgaattca

SEQ ID NO: 346030 - DNA, 25 bp, Homo sapien
tcactttcagcaaccagagggcgct

SEQ ID NO: 346031 - DNA, 25 bp, Homo sapien
agagggcgctaatccacacccacat

SEQ ID NO: 346032 - DNA, 25 bp, Homo sapien
gattgggccaaaatactgtgataaa

SEQ ID NO: 346033 - DNA, 25 bp, Homo sapien
tgtgataaaatagcaggcctgctga

SEQ ID NO: 346034 - DNA, 25 bp, Homo sapien
gcaggcctgctgataaaagtttatc

SEQ ID NO: 346035 - DNA, 25 bp, Homo sapien
aggctaccccttctatgggtgcgca

SEQ ID NO: 346036 - DNA, 25 bp, Homo sapien
ccttctatgggtgcgcatggtgctg

SEQ ID NO: 346037 - DNA, 25 bp, Homo sapien
tgcgcatggtgctgctgttggttct

SEQ ID NO: 346038 - DNA, 25 bp, Homo sapien
actctgatggttccaccctgggaaa

SEQ ID NO: 346039 - DNA, 25 bp, Homo sapien
gttccaccctgggaaagctggcctt

SEQ ID NO: 346040 - DNA, 25 bp, Homo sapien
aagcctctgtagatcttcattctgg

SEQ ID NO: 346041 - DNA, 25 bp, Homo sapien
gtagatcttcattctgggttcttgt

SEQ ID NO: 346042 - DNA, 25 bp, Homo sapien
gtaacttgtctatgaaagaacctga

SEQ ID NO: 346043 - DNA, 25 bp, Homo sapien
aagaacctgaggtgtagccacatgt

SEQ ID NO: 346044 - DNA, 25 bp, Homo sapien
tgaggtgtagccacatgtccagctg

SEQ ID NO: 346045 - DNA, 25 bp, Homo sapien
gtgtagccacatgtccagctgcctt

SEQ ID NO: 346046 - DNA, 25 bp, Homo sapien
cagtcaaggatttccagttatcttg

SEQ ID NO: 346047 - DNA, 25 bp, Homo sapien
ggatttccagttatcttgggtactc

SEQ ID NO: 346048 - DNA, 25 bp, Homo sapien
tttccagttatcttgggtactcact

SEQ ID NO: 346049 - DNA, 25 bp, Homo sapien
tccagttatcttgggtactcactta

SEQ ID NO: 346050 - DNA, 25 bp, Homo sapien
gttatcttgggtactcacttaccct

SEQ ID NO: 346051 - DNA, 25 bp, Homo sapien
tgggtactcacttacccttctttat

SEQ ID NO: 346052 - DNA, 25 bp, Homo sapien
tactcacttacccttctttattcat

SEQ ID NO: 346053 - DNA, 25 bp, Homo sapien
ctcacttacccttctttattcatgg

SEQ ID NO: 346054 - DNA, 25 bp, Homo sapien
tctagcaccaaagagataccggata

SEQ ID NO: 346055 - DNA, 25 bp, Homo sapien
gagataccggatacttttggtgact

SEQ ID NO: 346056 - DNA, 25 bp, Homo sapien
cggatacttttggtgactgtgctgt

SEQ ID NO: 346057 - DNA, 25 bp, Homo sapien
aattttgctctcctcttctatgcat

SEQ ID NO: 346058 - DNA, 25 bp, Homo sapien
agggtagagctcatctgttgtgatc

SEQ ID NO: 346059 - DNA, 25 bp, Homo sapien
agccagctcatagtgaaaagacaag

SEQ ID NO: 346060 - DNA, 25 bp, Homo sapien
cgcagtgcggacagcggagcctatt

SEQ ID NO: 346061 - DNA, 25 bp, Homo sapien
gctcatctgttgtgatcatagtaac

SEQ ID NO: 346062 - DNA, 25 bp, Homo sapien
ggagcctattgatgatggagcacta

SEQ ID NO: 346063 - DNA, 25 bp, Homo sapien
agcactagactcactctttgcacat

SEQ ID NO: 346064 - DNA, 25 bp, Homo sapien
acatccctgtcgctaacaggtggga

SEQ ID NO: 346065 - DNA, 25 bp, Homo sapien
atagtaactactgcaacctccctga

SEQ ID NO: 346066 - DNA, 25 bp, Homo sapien
agtttagttctacgtctctcctgga

SEQ ID NO: 346067 - DNA, 25 bp, Homo sapien
tctctcctggattttgggttctttt

SEQ ID NO: 346068 - DNA, 25 bp, Homo sapien
ttgagccatatagtttggtccaaat

SEQ ID NO: 346069 - DNA, 25 bp, Homo sapien
tggtccaaatagttcttgtctgagg

SEQ ID NO: 346070 - DNA, 25 bp, Homo sapien
actttgaaatcagctttgctcttcc

SEQ ID NO: 346071 - DNA, 25 bp, Homo sapien
aagccttacgcttttttcagtgatt

SEQ ID NO: 346072 - DNA, 25 bp, Homo sapien
cagtgattgctcttgtaggtgaaat

SEQ ID NO: 346073 - DNA, 25 bp, Homo sapien
atagagtacggagctgacagtgtca

SEQ ID NO: 346074 - DNA, 25 bp, Homo sapien
ccaaaacttgtgtaggctcctatcc

SEQ ID NO: 346075 - DNA, 25 bp, Homo sapien
aggctcctatcctaagaggcccagg

SEQ ID NO: 346076 - DNA, 25 bp, Homo sapien
ttcctgcctgcttgtattctcttta

SEQ ID NO: 346077 - DNA, 25 bp, Homo sapien
tgtattctctttatgacagggtata

SEQ ID NO: 346078 - DNA, 25 bp, Homo sapien
gcaagaagaaccttgggtctctttt

SEQ ID NO: 346079 - DNA, 25 bp, Homo sapien
gcggtcatgggctcatgggattctc

SEQ ID NO: 346080 - DNA, 25 bp, Homo sapien
cggtcatgggctcatgggattctcc

SEQ ID NO: 346081 - DNA, 25 bp, Homo sapien
ggtcatgggctcatgggattctcct

SEQ ID NO: 346082 - DNA, 25 bp, Homo sapien
gtcatgggctcatgggattctccta

SEQ ID NO: 346083 - DNA, 25 bp, Homo sapien
tcatgggctcatgggattctcctac

SEQ ID NO: 346084 - DNA, 25 bp, Homo sapien
gggagggctgtctgctttttgtaac

SEQ ID NO: 346085 - DNA, 25 bp, Homo sapien
ggagggctgtctgctttttgtaact

SEQ ID NO: 346086 - DNA, 25 bp, Homo sapien
gagggctgtctgctttttgtaactt

SEQ ID NO: 346087 - DNA, 25 bp, Homo sapien
agggctgtctgctttttgtaacttg

SEQ ID NO: 346088 - DNA, 25 bp, Homo sapien
gggctgtctgctttttgtaacttga

SEQ ID NO: 346089 - DNA, 25 bp, Homo sapien
ggctgtctgctttttgtaacttgaa

SEQ ID NO: 346090 - DNA, 25 bp, Homo sapien
tacacttgttaagtagaaccttctt

SEQ ID NO: 346091 - DNA, 25 bp, Homo sapien
gaatagcctttctgctggattctag

SEQ ID NO: 346092 - DNA, 25 bp, Homo sapien
taaaatcccagtgggcaaactccca

SEQ ID NO: 346093 - DNA, 25 bp, Homo sapien
aactcccaggcggtggtgatcacta

SEQ ID NO: 346094 - DNA, 25 bp, Homo sapien
cggtggtgatcactaaaatctgtca

SEQ ID NO: 346095 - DNA, 25 bp, Homo sapien
aaatctgtcacagtcttcagtgaac

SEQ ID NO: 346096 - DNA, 25 bp, Homo sapien
acaaaccccacttgctgttcctggg

SEQ ID NO: 346097 - DNA, 25 bp, Homo sapien
atccccgcttatttaaagaactgct

SEQ ID NO: 346098 - DNA, 25 bp, Homo sapien
ctgctgtgaaaaatcagttccagtt

SEQ ID NO: 346099 - DNA, 25 bp, Homo sapien
ttgttaaaacccacggcactactgg

SEQ ID NO: 346100 - DNA, 25 bp, Homo sapien
ggcactactggtgcattctgagtta

SEQ ID NO: 346101 - DNA, 25 bp, Homo sapien
tttttagctatacaaacattgatgt

SEQ ID NO: 346102 - DNA, 25 bp, Homo sapien
ttttagctatacaaacattgatgtg

SEQ ID NO: 346103 - DNA, 25 bp, Homo sapien
tttagctatacaaacattgatgtgt

SEQ ID NO: 346104 - DNA, 25 bp, Homo sapien
ttagctatacaaacattgatgtgtt

SEQ ID NO: 346105 - DNA, 25 bp, Homo sapien
tagctatacaaacattgatgtgttt

SEQ ID NO: 346106 - DNA, 25 bp, Homo sapien
agctatacaaacattgatgtgtttt

SEQ ID NO: 346107 - DNA, 25 bp, Homo sapien
gctatacaaacattgatgtgttttt

SEQ ID NO: 346108 - DNA, 25 bp, Homo sapien
ctatacaaacattgatgtgtttttt

SEQ ID NO: 346109 - DNA, 25 bp, Homo sapien
acaaacattgatgtgttttttttga

SEQ ID NO: 346110 - DNA, 25 bp, Homo sapien
caaacattgatgtgttttttttgag

SEQ ID NO: 346111 - DNA, 25 bp, Homo sapien
tggacatctatgttatatgtactca

SEQ ID NO: 346112 - DNA, 25 bp, Homo sapien
atctcttcccaactcaaaagtctca

SEQ ID NO: 346113 - DNA, 25 bp, Homo sapien
ctcaaaagtctcactttgggctgaa

SEQ ID NO: 346114 - DNA, 25 bp, Homo sapien
cactttgggctgaaagtacacagga

SEQ ID NO: 346115 - DNA, 25 bp, Homo sapien
acacaggaagaaagtagacttctaa

SEQ ID NO: 346116 - DNA, 25 bp, Homo sapien
gtagacttctaagaagagtctgaat

SEQ ID NO: 346117 - DNA, 25 bp, Homo sapien
cttctaagaagagtctgaataagcc

SEQ ID NO: 346118 - DNA, 25 bp, Homo sapien
aacttctggagtccctttctcaatt

SEQ ID NO: 346119 - DNA, 25 bp, Homo sapien
ccctttctcaatttctgttggcagt

SEQ ID NO: 346120 - DNA, 25 bp, Homo sapien
atagctcagtttaacctggattgtg

SEQ ID NO: 346121 - DNA, 25 bp, Homo sapien
attgcattggccaaatctcgacaat

SEQ ID NO: 346122 - DNA, 25 bp, Homo sapien
ttgcattggccaaatctcgacaatt

SEQ ID NO: 346123 - DNA, 25 bp, Homo sapien
ataaatggtcgagcctttgtctctt

SEQ ID NO: 346124 - DNA, 25 bp, Homo sapien
acctctgtcattaaccagcgataga

SEQ ID NO: 346125 - DNA, 25 bp, Homo sapien
cagcgatagatttagaatgggtttc

SEQ ID NO: 346126 - DNA, 25 bp, Homo sapien
attcttggcagtttcatataacttt

SEQ ID NO: 346127 - DNA, 25 bp, Homo sapien
taatcagaccactaaattctgtgtg

SEQ ID NO: 346128 - DNA, 25 bp, Homo sapien
ctctctgttccctgtatcctaataa

SEQ ID NO: 346129 - DNA, 25 bp, Homo sapien
gttccctgtatcctaataacatctg

SEQ ID NO: 346130 - DNA, 25 bp, Homo sapien
taacatctgtggaaattccctttac

SEQ ID NO: 346131 - DNA, 25 bp, Homo sapien
ttgggttaccggtaaggctcatctt

SEQ ID NO: 346132 - DNA, 25 bp, Homo sapien
gtaaggctcatctttctgtgagatt

SEQ ID NO: 346133 - DNA, 25 bp, Homo sapien
tgtgagattgtttccataaatggtc

SEQ ID NO: 346134 - DNA, 25 bp, Homo sapien
aagctcgagaccttgcttggtgaca

SEQ ID NO: 346135 - DNA, 25 bp, Homo sapien
agaccttgcttggtgacatgtgcca

SEQ ID NO: 346136 - DNA, 25 bp, Homo sapien
tgacatgtgccactttggccaccac

SEQ ID NO: 346137 - DNA, 25 bp, Homo sapien
agtctgtcaccacgtggcttgggaa

SEQ ID NO: 346138 - DNA, 25 bp, Homo sapien
caccacgtggcttgggaacttctgg

SEQ ID NO: 346139 - DNA, 25 bp, Homo sapien
tgccgacgagcttgtctctgcagcc

SEQ ID NO: 346140 - DNA, 25 bp, Homo sapien
tggtcagtctgtccatcctcggcaa

SEQ ID NO: 346141 - DNA, 25 bp, Homo sapien
gtccatcctcggcaaggacacaaca

SEQ ID NO: 346142 - DNA, 25 bp, Homo sapien
aaggacacaacactgccccagaggg

SEQ ID NO: 346143 - DNA, 25 bp, Homo sapien
ccagagggtgggaccactgcaagct

SEQ ID NO: 346144 - DNA, 25 bp, Homo sapien
gaccactgcaagctcgagaccttgc

SEQ ID NO: 346145 - DNA, 25 bp, Homo sapien
tcagccatctcttctacaccatgta

SEQ ID NO: 346146 - DNA, 25 bp, Homo sapien
cctgctgcattctttactcttttat

SEQ ID NO: 346147 - DNA, 25 bp, Homo sapien
gatattcctacagaaatacacacat

SEQ ID NO: 346148 - DNA, 25 bp, Homo sapien
aactgaagacacctaggcaaccaat

SEQ ID NO: 346149 - DNA, 25 bp, Homo sapien
ggcaaccaatgcctagatcaagagg

SEQ ID NO: 346150 - DNA, 25 bp, Homo sapien
tcaagaggcaaaacattaccagcac

SEQ ID NO: 346151 - DNA, 25 bp, Homo sapien
agaacaatctgtgggatagtacgca

SEQ ID NO: 346152 - DNA, 25 bp, Homo sapien
gatagtacgcacatcagggagccca

SEQ ID NO: 346153 - DNA, 25 bp, Homo sapien
cccagagagtgaactccagggctgt

SEQ ID NO: 346154 - DNA, 25 bp, Homo sapien
cagggctgtgggtaatctttcccag

SEQ ID NO: 346155 - DNA, 25 bp, Homo sapien
tttcccagtgaaaatcagccatctc

SEQ ID NO: 346156 - DNA, 25 bp, Homo sapien
gaagaatcatccagaaccgcatcct

SEQ ID NO: 346157 - DNA, 25 bp, Homo sapien
gcatcctgctcgtcatcctagggat

SEQ ID NO: 346158 - DNA, 25 bp, Homo sapien
catcctagggatcatcgtggtcatc

SEQ ID NO: 346159 - DNA, 25 bp, Homo sapien
gtcatcaccatcctgatggcgatca

SEQ ID NO: 346160 - DNA, 25 bp, Homo sapien
atggcgatcactttttctgtcagaa

SEQ ID NO: 346161 - DNA, 25 bp, Homo sapien
gaagacactgatgtatctgctctcc

SEQ ID NO: 346162 - DNA, 25 bp, Homo sapien
tatctgctctcccttgataaacagc

SEQ ID NO: 346163 - DNA, 25 bp, Homo sapien
aacagcaacaacagcttgttctgag

SEQ ID NO: 346164 - DNA, 25 bp, Homo sapien
caacagcttgttctgagtaattaag

SEQ ID NO: 346165 - DNA, 25 bp, Homo sapien
acatgaatcattctgttgcgctgac

SEQ ID NO: 346166 - DNA, 25 bp, Homo sapien
aatcattctgttgcgctgacaggcc

SEQ ID NO: 346167 - DNA, 25 bp, Homo sapien
tctttcctcttctcacaagctggaa

SEQ ID NO: 346168 - DNA, 25 bp, Homo sapien
aagctggaatgtgcatgtgctccca

SEQ ID NO: 346169 - DNA, 25 bp, Homo sapien
ggaatgtgcatgtgctcccacccag

SEQ ID NO: 346170 - DNA, 25 bp, Homo sapien
ggccttgtggccaagcacagaacgt

SEQ ID NO: 346171 - DNA, 25 bp, Homo sapien
gaaaacagtactctgcagtctggca

SEQ ID NO: 346172 - DNA, 25 bp, Homo sapien
cagtctggcagagcaacaaggtgga

SEQ ID NO: 346173 - DNA, 25 bp, Homo sapien
ggcctgggtccttgagtgacgtcat

SEQ ID NO: 346174 - DNA, 25 bp, Homo sapien
ttgagtgacgtcatgagccctctca

SEQ ID NO: 346175 - DNA, 25 bp, Homo sapien
cactgtcccgactttgggactgtta

SEQ ID NO: 346176 - DNA, 25 bp, Homo sapien
cccgactttgggactgttatatgat

SEQ ID NO: 346177 - DNA, 25 bp, Homo sapien
taggtcgtccccagcatggaaaatg

SEQ ID NO: 346178 - DNA, 25 bp, Homo sapien
atttatggtcataatccacagtcat

SEQ ID NO: 346179 - DNA, 25 bp, Homo sapien
tggtcataatccacagtcatatagg

SEQ ID NO: 346180 - DNA, 25 bp, Homo sapien
cacagtcatataggatagtggtcct

SEQ ID NO: 346181 - DNA, 25 bp, Homo sapien
tattcaggacagtagcatgccatgc

SEQ ID NO: 346182 - DNA, 25 bp, Homo sapien
gcatgccatgcaagtttgtagccta

SEQ ID NO: 346183 - DNA, 25 bp, Homo sapien
cttcttgaccaaagctgagttctgc

SEQ ID NO: 346184 - DNA, 25 bp, Homo sapien
gaccaaagctgagttctgcaccaat

SEQ ID NO: 346185 - DNA, 25 bp, Homo sapien
aagctgagttctgcaccaatgctga

SEQ ID NO: 346186 - DNA, 25 bp, Homo sapien
gagttctgcaccaatgctgagtctt

SEQ ID NO: 346187 - DNA, 25 bp, Homo sapien
gcaccaatgctgagtcttctcattt

SEQ ID NO: 346188 - DNA, 25 bp, Homo sapien
aatgctgagtcttctcattttgtaa

SEQ ID NO: 346189 - DNA, 25 bp, Homo sapien
tccaggctccacaatacccaataaa

SEQ ID NO: 346190 - DNA, 25 bp, Homo sapien
tgcctttagcccacttcaagctgca

SEQ ID NO: 346191 - DNA, 25 bp, Homo sapien
acttcaagctgcacttcttacatgg

SEQ ID NO: 346192 - DNA, 25 bp, Homo sapien
gctgcacttcttacatggaacccaa

SEQ ID NO: 346193 - DNA, 25 bp, Homo sapien
tgaacagctatgattctccattccc

SEQ ID NO: 346194 - DNA, 25 bp, Homo sapien
tggccaggcagggagcctttccatc

SEQ ID NO: 346195 - DNA, 25 bp, Homo sapien
caccctcgtgagactgcttgtaaca

SEQ ID NO: 346196 - DNA, 25 bp, Homo sapien
ggaaaccgactccaaggctcagtaa

SEQ ID NO: 346197 - DNA, 25 bp, Homo sapien
ggctcagtaacccacccaaggtcag

SEQ ID NO: 346198 - DNA, 25 bp, Homo sapien
ccaaggtcagaaccacggagtggca

SEQ ID NO: 346199 - DNA, 25 bp, Homo sapien
agtggcagggcctgtgagccacaaa

SEQ ID NO: 346200 - DNA, 25 bp, Homo sapien
tctgcctgagcctgagctaatctta

SEQ ID NO: 346201 - DNA, 25 bp, Homo sapien
gctaatcttagccatccattgtgtc

SEQ ID NO: 346202 - DNA, 25 bp, Homo sapien
agccatccattgtgtctcaaaactg

SEQ ID NO: 346203 - DNA, 25 bp, Homo sapien
atggagaaccttttgctctcccatc

SEQ ID NO: 346204 - DNA, 25 bp, Homo sapien
ttttgctctcccatccagaagggca

SEQ ID NO: 346205 - DNA, 25 bp, Homo sapien
gaagggcacctaaccaggcccctgg

SEQ ID NO: 346206 - DNA, 25 bp, Homo sapien
ggaagtcaatcacttcgatcccagt

SEQ ID NO: 346207 - DNA, 25 bp, Homo sapien
tcacttcgatcccagttctctgaag

SEQ ID NO: 346208 - DNA, 25 bp, Homo sapien
ggttcggaggcctagtagagaattt

SEQ ID NO: 346209 - DNA, 25 bp, Homo sapien
gagaatttggattccaccaagttct

SEQ ID NO: 346210 - DNA, 25 bp, Homo sapien
aagtaaacggtccagagcagacaaa

SEQ ID NO: 346211 - DNA, 25 bp, Homo sapien
tgtaaagacacaccagaaggaaacc

SEQ ID NO: 346212 - DNA, 25 bp, Homo sapien
gaaagccgtcagatcagcctcaaga

SEQ ID NO: 346213 - DNA, 25 bp, Homo sapien
agccgtcagatcagcctcaagactt

SEQ ID NO: 346214 - DNA, 25 bp, Homo sapien
gtcagatcagcctcaagacttcaaa

SEQ ID NO: 346215 - DNA, 25 bp, Homo sapien
tcagcctcaagacttcaaatgcatg

SEQ ID NO: 346216 - DNA, 25 bp, Homo sapien
atgcatggaagcactcacacttggc

SEQ ID NO: 346217 - DNA, 25 bp, Homo sapien
gcatggaagcactcacacttggcag

SEQ ID NO: 346218 - DNA, 25 bp, Homo sapien
aggactcatacgagagagaatccgt

SEQ ID NO: 346219 - DNA, 25 bp, Homo sapien
gcattcagcttgcttaattgctttc

SEQ ID NO: 346220 - DNA, 25 bp, Homo sapien
gcttgcttaattgctttcatagaca

SEQ ID NO: 346221 - DNA, 25 bp, Homo sapien
gcttaattgctttcatagacatgta

SEQ ID NO: 346222 - DNA, 25 bp, Homo sapien
gaatttaaactccacactgtccaca

SEQ ID NO: 346223 - DNA, 25 bp, Homo sapien
aaactcagcctctatgttctcagtg

SEQ ID NO: 346224 - DNA, 25 bp, Homo sapien
tgttctcagtgacccttttgtattc

SEQ ID NO: 346225 - DNA, 25 bp, Homo sapien
tttgtattcactgctggttcctcta

SEQ ID NO: 346226 - DNA, 25 bp, Homo sapien
acttccttcccatcaaagtaagagg

SEQ ID NO: 346227 - DNA, 25 bp, Homo sapien
ataaaccttccttaggatgctgccc

SEQ ID NO: 346228 - DNA, 25 bp, Homo sapien
agaggaccccaagccttggctttga

SEQ ID NO: 346229 - DNA, 25 bp, Homo sapien
gctttgagcaaggaggtcttattta

SEQ ID NO: 346230 - DNA, 25 bp, Homo sapien
ttatttatttgctccattccccaac

SEQ ID NO: 346231 - DNA, 25 bp, Homo sapien
tccttaggatgctgcccactgggag

SEQ ID NO: 346232 - DNA, 25 bp, Homo sapien
ctgctcagttccacaagttgtcgaa

SEQ ID NO: 346233 - DNA, 25 bp, Homo sapien
aaaatatttcatactgatggctttt

SEQ ID NO: 346234 - DNA, 25 bp, Homo sapien
acaaggttttctactgagaataaat

SEQ ID NO: 346235 - DNA, 25 bp, Homo sapien
gaaaaaccaaacctgaaatagtcat

SEQ ID NO: 346236 - DNA, 25 bp, Homo sapien
accaaacctgaaatagtcattgcaa

SEQ ID NO: 346237 - DNA, 25 bp, Homo sapien
gattcacatctatatctaaaattaa

SEQ ID NO: 346238 - DNA, 25 bp, Homo sapien
gagtggactacagaaatgtaccatg

SEQ ID NO: 346239 - DNA, 25 bp, Homo sapien
gaaatgtaccatgaatcctatgtag

SEQ ID NO: 346240 - DNA, 25 bp, Homo sapien
gtaccatgaatcctatgtagtgctg

SEQ ID NO: 346241 - DNA, 25 bp, Homo sapien
gaatcctatgtagtgctgaggacct

SEQ ID NO: 346242 - DNA, 25 bp, Homo sapien
cctatgtagtgctgaggacctgtga

SEQ ID NO: 346243 - DNA, 25 bp, Homo sapien
taaagtgtttctacatctgataaag

SEQ ID NO: 346244 - DNA, 25 bp, Homo sapien
cacggtggcttgtgcctgtagcccc

SEQ ID NO: 346245 - DNA, 25 bp, Homo sapien
acggtggcttgtgcctgtagcccca

SEQ ID NO: 346246 - DNA, 25 bp, Homo sapien
cggtggcttgtgcctgtagccccag

SEQ ID NO: 346247 - DNA, 25 bp, Homo sapien
ggtggcttgtgcctgtagccccagc

SEQ ID NO: 346248 - DNA, 25 bp, Homo sapien
agcctggtgacaaagcaagactccg

SEQ ID NO: 346249 - DNA, 25 bp, Homo sapien
gcctggtgacaaagcaagactccgt

SEQ ID NO: 346250 - DNA, 25 bp, Homo sapien
cctggtgacaaagcaagactccgtc

SEQ ID NO: 346251 - DNA, 25 bp, Homo sapien
ctggtgacaaagcaagactccgtct

SEQ ID NO: 346252 - DNA, 25 bp, Homo sapien
gtaagaacggcttaaaaatggactg

SEQ ID NO: 346253 - DNA, 25 bp, Homo sapien
taagaacggcttaaaaatggactgt

SEQ ID NO: 346254 - DNA, 25 bp, Homo sapien
tggactgttttcttttcctatgtgg

SEQ ID NO: 346255 - DNA, 25 bp, Homo sapien
ttgcttctaaaaatttgtgtttcgt

SEQ ID NO: 346256 - DNA, 25 bp, Homo sapien
atttgtgtttcgtgttgtagttata

SEQ ID NO: 346257 - DNA, 25 bp, Homo sapien
taacttttctattgtactgattgac

SEQ ID NO: 346258 - DNA, 25 bp, Homo sapien
actgattgacagatttggcacagac

SEQ ID NO: 346259 - DNA, 25 bp, Homo sapien
acagacatcctctcattgtgaatat

SEQ ID NO: 346260 - DNA, 25 bp, Homo sapien
gacatcctctcattgtgaatatata

SEQ ID NO: 346261 - DNA, 25 bp, Homo sapien
atatatcagagttttggactctggg

SEQ ID NO: 346262 - DNA, 25 bp, Homo sapien
caagggttgccttacatttagagtg

SEQ ID NO: 346263 - DNA, 25 bp, Homo sapien
tgaaagcattgataaccacactggt

SEQ ID NO: 346264 - DNA, 25 bp, Homo sapien
gttgccttacatttagagtgggaaa

SEQ ID NO: 346265 - DNA, 25 bp, Homo sapien
gaaaatgagttagcagaggagcagc

SEQ ID NO: 346266 - DNA, 25 bp, Homo sapien
aactttcctctgcacacctgtggct

SEQ ID NO: 346267 - DNA, 25 bp, Homo sapien
acctgtggctacctggtgtttgtct

SEQ ID NO: 346268 - DNA, 25 bp, Homo sapien
ctacctggtgtttgtctcttgattc

SEQ ID NO: 346269 - DNA, 25 bp, Homo sapien
ggtgtttgtctcttgattccctcca

SEQ ID NO: 346270 - DNA, 25 bp, Homo sapien
gtcgggattttccacctacaccatt

SEQ ID NO: 346271 - DNA, 25 bp, Homo sapien
cacctacaccattcaaaaggaacat

SEQ ID NO: 346272 - DNA, 25 bp, Homo sapien
tcaaaaggaacataggagagggcat

SEQ ID NO: 346273 - DNA, 25 bp, Homo sapien
gggctaggctgaagcactctgatga

SEQ ID NO: 346274 - DNA, 25 bp, Homo sapien
aggctgaagcactctgatgactggg

SEQ ID NO: 346275 - DNA, 25 bp, Homo sapien
gccaatttgtggctgaaaatgaata

SEQ ID NO: 346276 - DNA, 25 bp, Homo sapien
ttgccacccacactgataccagagg

SEQ ID NO: 346277 - DNA, 25 bp, Homo sapien
tggattccatatcctggatggaggg

SEQ ID NO: 346278 - DNA, 25 bp, Homo sapien
gttggcatgttttcacaactttgtt

SEQ ID NO: 346279 - DNA, 25 bp, Homo sapien
ttaaaataaaattagcagctcttcc

SEQ ID NO: 346280 - DNA, 25 bp, Homo sapien
tgaggttgtggaaaacccaaattca

SEQ ID NO: 346281 - DNA, 25 bp, Homo sapien
tgtggaaaacccaaattcaaggaca

SEQ ID NO: 346282 - DNA, 25 bp, Homo sapien
aattcaaggacaatttggctagcta

SEQ ID NO: 346283 - DNA, 25 bp, Homo sapien
gacaatttggctagctaaagacaga

SEQ ID NO: 346284 - DNA, 25 bp, Homo sapien
aagacagaatacaagactgggtggc

SEQ ID NO: 346285 - DNA, 25 bp, Homo sapien
agactgggtggcaagaactgctcta

SEQ ID NO: 346286 - DNA, 25 bp, Homo sapien
ggcaagaactgctctatttaataag

SEQ ID NO: 346287 - DNA, 25 bp, Homo sapien
gaagatttttaatatgttagcaaac

SEQ ID NO: 346288 - DNA, 25 bp, Homo sapien
gcaatgcctatcaaaaggtcacagc

SEQ ID NO: 346289 - DNA, 25 bp, Homo sapien
aggcatatctttgaatctgctagca

SEQ ID NO: 346290 - DNA, 25 bp, Homo sapien
ctcattcccaaccacagtattagac

SEQ ID NO: 346291 - DNA, 25 bp, Homo sapien
aaccacagtattagacctcttgctc

SEQ ID NO: 346292 - DNA, 25 bp, Homo sapien
acagtattagacctcttgctcacac

SEQ ID NO: 346293 - DNA, 25 bp, Homo sapien
ttgctcacaccaacactcagtaatg

SEQ ID NO: 346294 - DNA, 25 bp, Homo sapien
accaacactcagtaatgcctggtgt

SEQ ID NO: 346295 - DNA, 25 bp, Homo sapien
gtaatgcctggtgtaacccatcaaa

SEQ ID NO: 346296 - DNA, 25 bp, Homo sapien
ggtgtaacccatcaaatatgaaaca

SEQ ID NO: 346297 - DNA, 25 bp, Homo sapien
aatgtccttaatatccccaatgctg

SEQ ID NO: 346298 - DNA, 25 bp, Homo sapien
tgtccttaatatccccaatgctggg

SEQ ID NO: 346299 - DNA, 25 bp, Homo sapien
ggtgtctctggtagcatccttaaac

SEQ ID NO: 346300 - DNA, 25 bp, Homo sapien
tctctggtagcatccttaaactagg

SEQ ID NO: 346301 - DNA, 25 bp, Homo sapien
gggctctcagaggaattgtgtgctt

SEQ ID NO: 346302 - DNA, 25 bp, Homo sapien
cagaggaattgtgtgcttggcttcc

SEQ ID NO: 346303 - DNA, 25 bp, Homo sapien
ttggcttccctagggcctgtgagcc

SEQ ID NO: 346304 - DNA, 25 bp, Homo sapien
agagtttggacttaggccggcagct

SEQ ID NO: 346305 - DNA, 25 bp, Homo sapien
gccggcagctggtagggaacatcta

SEQ ID NO: 346306 - DNA, 25 bp, Homo sapien
gtagggaacatctatccttgcactc

SEQ ID NO: 346307 - DNA, 25 bp, Homo sapien
taatcatttctgtcatttcctgggt

SEQ ID NO: 346308 - DNA, 25 bp, Homo sapien
atttctgtcatttcctgggtgtctc

SEQ ID NO: 346309 - DNA, 25 bp, Homo sapien
atttcctgggtgtctctggtagcat

SEQ ID NO: 346310 - DNA, 25 bp, Homo sapien
cagttggctgtgagtgagatgacct

SEQ ID NO: 346311 - DNA, 25 bp, Homo sapien
tagccagacaggcactgacatgaat

SEQ ID NO: 346312 - DNA, 25 bp, Homo sapien
gaatgtcataggcatgctccagggc

SEQ ID NO: 346313 - DNA, 25 bp, Homo sapien
ccagggccttctgagaaatggaaat

SEQ ID NO: 346314 - DNA, 25 bp, Homo sapien
ggatggaatgacctttatgcaacaa

SEQ ID NO: 346315 - DNA, 25 bp, Homo sapien
agaagtctcctcaacaggcattgaa

SEQ ID NO: 346316 - DNA, 25 bp, Homo sapien
aggcattgaatattagtgctcgtca

SEQ ID NO: 346317 - DNA, 25 bp, Homo sapien
ttagtgctcgtcaagattcaaaaga

SEQ ID NO: 346318 - DNA, 25 bp, Homo sapien
tagaataattcctcaccacatatat

SEQ ID NO: 346319 - DNA, 25 bp, Homo sapien
gaggttctggagtgattcatcctac

SEQ ID NO: 346320 - DNA, 25 bp, Homo sapien
attcatcctaccctcatacataaat

SEQ ID NO: 346321 - DNA, 25 bp, Homo sapien
agtaaatatcagatgtggacgaaag

SEQ ID NO: 346322 - DNA, 25 bp, Homo sapien
cctggcaaagtacacatacatgttg

SEQ ID NO: 346323 - DNA, 25 bp, Homo sapien
ggcaaagtacacatacatgttgatg

SEQ ID NO: 346324 - DNA, 25 bp, Homo sapien
agctctctgtggcacctatggtcta

SEQ ID NO: 346325 - DNA, 25 bp, Homo sapien
tctctgtggcacctatggtctagta

SEQ ID NO: 346326 - DNA, 25 bp, Homo sapien
ctgtggcacctatggtctagtatat

SEQ ID NO: 346327 - DNA, 25 bp, Homo sapien
tggcacctatggtctagtatattag

SEQ ID NO: 346328 - DNA, 25 bp, Homo sapien
ctatggtctagtatattaggcacat

SEQ ID NO: 346329 - DNA, 25 bp, Homo sapien
gtctagtatattaggcacattctgg

SEQ ID NO: 346330 - DNA, 25 bp, Homo sapien
attacatagtcatttcattgtttgt

SEQ ID NO: 346331 - DNA, 25 bp, Homo sapien
tcattgtttgttaaatacctgtctc

SEQ ID NO: 346332 - DNA, 25 bp, Homo sapien
agaaagctgtatccccagtcagtcc

SEQ ID NO: 346333 - DNA, 25 bp, Homo sapien
gaaagctgtatccccagtcagtccc

SEQ ID NO: 346334 - DNA, 25 bp, Homo sapien
aaagctgtatccccagtcagtcccc

SEQ ID NO: 346335 - DNA, 25 bp, Homo sapien
tgtatccccagtcagtccccctcag

SEQ ID NO: 346336 - DNA, 25 bp, Homo sapien
ccaagaaaaaattcactctatgtag

SEQ ID NO: 346337 - DNA, 25 bp, Homo sapien
caagaaaaaattcactctatgtaga

SEQ ID NO: 346338 - DNA, 25 bp, Homo sapien
aagaaaaaattcactctatgtagag

SEQ ID NO: 346339 - DNA, 25 bp, Homo sapien
aacaatgagcaatggggcctgcgac

SEQ ID NO: 346340 - DNA, 25 bp, Homo sapien
acaatgagcaatggggcctgcgaca

SEQ ID NO: 346341 - DNA, 25 bp, Homo sapien
agcaatggggcctgcgacatcccca

SEQ ID NO: 346342 - DNA, 25 bp, Homo sapien
gcaatggggcctgcgacatccccaa

SEQ ID NO: 346343 - DNA, 25 bp, Homo sapien
cttgctatcaattgctgctgcttaa

SEQ ID NO: 346344 - DNA, 25 bp, Homo sapien
tgctgcttaaatggcaggccaactg

SEQ ID NO: 346345 - DNA, 25 bp, Homo sapien
ggtcagctgctgatcagggtgtcta

SEQ ID NO: 346346 - DNA, 25 bp, Homo sapien
tgctgatcagggtgtctaggctgaa

SEQ ID NO: 346347 - DNA, 25 bp, Homo sapien
ctgaaggagttggagaccttgtgct

SEQ ID NO: 346348 - DNA, 25 bp, Homo sapien
gaccttgtgctaggtaggtgaacca

SEQ ID NO: 346349 - DNA, 25 bp, Homo sapien
gtctttcaccctttctacagaaact

SEQ ID NO: 346350 - DNA, 25 bp, Homo sapien
acagaaactacctcggtctggatct

SEQ ID NO: 346351 - DNA, 25 bp, Homo sapien
cagcagcctgtgcaatatttattgg

SEQ ID NO: 346352 - DNA, 25 bp, Homo sapien
tattggtctatcaatttctcccgtc

SEQ ID NO: 346353 - DNA, 25 bp, Homo sapien
cgtctcctgtcccaaagtaataaat

SEQ ID NO: 346354 - DNA, 25 bp, Homo sapien
ccgaaagatcttccttgaacttaag

SEQ ID NO: 346355 - DNA, 25 bp, Homo sapien
taagattcgttctttcatcgcttcc

SEQ ID NO: 346356 - DNA, 25 bp, Homo sapien
ttctttcatcgcttcccattaaaat

SEQ ID NO: 346357 - DNA, 25 bp, Homo sapien
agaccggacctttcagttcatatta

SEQ ID NO: 346358 - DNA, 25 bp, Homo sapien
caccagtggtttggtcttagaactt

SEQ ID NO: 346359 - DNA, 25 bp, Homo sapien
gcacagggtgtggtcacggcaaata

SEQ ID NO: 346360 - DNA, 25 bp, Homo sapien
acggcaaataggatgtgtctggact

SEQ ID NO: 346361 - DNA, 25 bp, Homo sapien
gttcatattaaatggcccccgtagt

SEQ ID NO: 346362 - DNA, 25 bp, Homo sapien
ccgtagtcaccttactttcatgtag

SEQ ID NO: 346363 - DNA, 25 bp, Homo sapien
tttgcagcctgaatctaatcacctt

SEQ ID NO: 346364 - DNA, 25 bp, Homo sapien
tctaatcacctttttctaagaccga

SEQ ID NO: 346365 - DNA, 25 bp, Homo sapien
acctgacgggttttcatgtgcctag

SEQ ID NO: 346366 - DNA, 25 bp, Homo sapien
ttttcatgtgcctagctgggtggtg

SEQ ID NO: 346367 - DNA, 25 bp, Homo sapien
acttggagaggcacagggacagctt

SEQ ID NO: 346368 - DNA, 25 bp, Homo sapien
atgcagcttaggattagcaaggtca

SEQ ID NO: 346369 - DNA, 25 bp, Homo sapien
gtatggatttcactgagcctcgatt

SEQ ID NO: 346370 - DNA, 25 bp, Homo sapien
cgattgctgccccttttcatggcat

SEQ ID NO: 346371 - DNA, 25 bp, Homo sapien
tcatggcattttgttctgggatttt

SEQ ID NO: 346372 - DNA, 25 bp, Homo sapien
gttctgggattttgctttgaaagtt

SEQ ID NO: 346373 - DNA, 25 bp, Homo sapien
tctttcagccttgtggtgagcagtg

SEQ ID NO: 346374 - DNA, 25 bp, Homo sapien
gtgagcagtgaattgtcctcgtcct

SEQ ID NO: 346375 - DNA, 25 bp, Homo sapien
tgcttcactttccagattttgccca

SEQ ID NO: 346376 - DNA, 25 bp, Homo sapien
gagtacatccaattgttgacatagt

SEQ ID NO: 346377 - DNA, 25 bp, Homo sapien
ttttgggtggagaaattttgctatt

SEQ ID NO: 346378 - DNA, 25 bp, Homo sapien
attttgctattatatcgacttctta

SEQ ID NO: 346379 - DNA, 25 bp, Homo sapien
cgacttcttaaaatagtctagtggg

SEQ ID NO: 346380 - DNA, 25 bp, Homo sapien
gtctagtgggattaacttggtttca

SEQ ID NO: 346381 - DNA, 25 bp, Homo sapien
cttggtttcaattcacagagatctg

SEQ ID NO: 346382 - DNA, 25 bp, Homo sapien
atctggaagcgaggatcttttaaaa

SEQ ID NO: 346383 - DNA, 25 bp, Homo sapien
tccttcctctccagggtgatgacaa

SEQ ID NO: 346384 - DNA, 25 bp, Homo sapien
gggtggagattatacctctctcatc

SEQ ID NO: 346385 - DNA, 25 bp, Homo sapien
tctctcatcatttcagcaccaagga

SEQ ID NO: 346386 - DNA, 25 bp, Homo sapien
taagggtgacttgatgagtacatcc

SEQ ID NO: 346387 - DNA, 25 bp, Homo sapien
tcaaaactaataacttcaggccatt

SEQ ID NO: 346388 - DNA, 25 bp, Homo sapien
taggtgatttaaagcagtgcaatgc

SEQ ID NO: 346389 - DNA, 25 bp, Homo sapien
taaaacccttcttaatgctcaaaat

SEQ ID NO: 346390 - DNA, 25 bp, Homo sapien
gaaataatgcaaatgccgcagattt

SEQ ID NO: 346391 - DNA, 25 bp, Homo sapien
caaatgccgcagatttgtttttagc

SEQ ID NO: 346392 - DNA, 25 bp, Homo sapien
agcctgaattatacactgcactgat

SEQ ID NO: 346393 - DNA, 25 bp, Homo sapien
tgcactgatagtatggccacacggt

SEQ ID NO: 346394 - DNA, 25 bp, Homo sapien
atggccacacggtggcattgccgtg

SEQ ID NO: 346395 - DNA, 25 bp, Homo sapien
ataaggcaagtatttttcgaggaat

SEQ ID NO: 346396 - DNA, 25 bp, Homo sapien
atatagcctaaagagccagaacaaa

SEQ ID NO: 346397 - DNA, 25 bp, Homo sapien
agagccagaacaaacacctaaaatt

SEQ ID NO: 346398 - DNA, 25 bp, Homo sapien
ggaaataaattagtggcagagtaag

SEQ ID NO: 346399 - DNA, 25 bp, Homo sapien
gaaataaattagtggcagagtaagg

SEQ ID NO: 346400 - DNA, 25 bp, Homo sapien
aaataaattagtggcagagtaaggg

SEQ ID NO: 346401 - DNA, 25 bp, Homo sapien
aataaattagtggcagagtaagggt

SEQ ID NO: 346402 - DNA, 25 bp, Homo sapien
ataaattagtggcagagtaagggtg

SEQ ID NO: 346403 - DNA, 25 bp, Homo sapien
taaattagtggcagagtaagggtga

SEQ ID NO: 346404 - DNA, 25 bp, Homo sapien
aaattagtggcagagtaagggtgac

SEQ ID NO: 346405 - DNA, 25 bp, Homo sapien
aattagtggcagagtaagggtgact

SEQ ID NO: 346406 - DNA, 25 bp, Homo sapien
attagtggcagagtaagggtgactt

SEQ ID NO: 346407 - DNA, 25 bp, Homo sapien
ttagtggcagagtaagggtgacttg

SEQ ID NO: 346408 - DNA, 25 bp, Homo sapien
tagtggcagagtaagggtgacttga

SEQ ID NO: 346409 - DNA, 25 bp, Homo sapien
aaagagtggttgatggctgatattc

SEQ ID NO: 346410 - DNA, 25 bp, Homo sapien
tcatttatactagctactcagtctc

SEQ ID NO: 346411 - DNA, 25 bp, Homo sapien
agctactcagtctctactttttcta

SEQ ID NO: 346412 - DNA, 25 bp, Homo sapien
actcagtctctactttttctagaag

SEQ ID NO: 346413 - DNA, 25 bp, Homo sapien
tctactttttctagaagtccccagt

SEQ ID NO: 346414 - DNA, 25 bp, Homo sapien
tctagaagtccccagtaaccaaagc

SEQ ID NO: 346415 - DNA, 25 bp, Homo sapien
gtaaccaaagcccaacacatttggt

SEQ ID NO: 346416 - DNA, 25 bp, Homo sapien
agcccaacacatttggtatcgttga

SEQ ID NO: 346417 - DNA, 25 bp, Homo sapien
acatttggtatcgttgattccttcc

SEQ ID NO: 346418 - DNA, 25 bp, Homo sapien
gtatcgttgattccttccattgttt

SEQ ID NO: 346419 - DNA, 25 bp, Homo sapien
cgttgattccttccattgtttgctt

SEQ ID NO: 346420 - DNA, 25 bp, Homo sapien
actcgagcttgcgtcagaatcacct

SEQ ID NO: 346421 - DNA, 25 bp, Homo sapien
gtaatgatgttgttctgggtaccac

SEQ ID NO: 346422 - DNA, 25 bp, Homo sapien
gggtaccacatcttagaaccactgg

SEQ ID NO: 346423 - DNA, 25 bp, Homo sapien
gaaccactggttaagatgtagtcat

SEQ ID NO: 346424 - DNA, 25 bp, Homo sapien
gcttgcgtcagaatcacctacagga

SEQ ID NO: 346425 - DNA, 25 bp, Homo sapien
aatacccatcaacaaaatctggtgg

SEQ ID NO: 346426 - DNA, 25 bp, Homo sapien
gaaatcacgatcgatatacacaatg

SEQ ID NO: 346427 - DNA, 25 bp, Homo sapien
tacacaatggaattctatgcaacta

SEQ ID NO: 346428 - DNA, 25 bp, Homo sapien
acctacaggacgtatggtgcagatt

SEQ ID NO: 346429 - DNA, 25 bp, Homo sapien
ctgggcctcacttcagagtatctga

SEQ ID NO: 346430 - DNA, 25 bp, Homo sapien
gggcttccacccaataattttcatt

SEQ ID NO: 346431 - DNA, 25 bp, Homo sapien
tataactacggaattggcataccag

SEQ ID NO: 346432 - DNA, 25 bp, Homo sapien
ggcataccagtttttacatcaatcc

SEQ ID NO: 346433 - DNA, 25 bp, Homo sapien
ttatttgctgttatctctcagccca

SEQ ID NO: 346434 - DNA, 25 bp, Homo sapien
agcccagtcaaatttggatgtgcaa

SEQ ID NO: 346435 - DNA, 25 bp, Homo sapien
ggatgtgcaaacagaaccaattcta

SEQ ID NO: 346436 - DNA, 25 bp, Homo sapien
tgagtacagacttgggacaggacac

SEQ ID NO: 346437 - DNA, 25 bp, Homo sapien
gggacaggacactaccattgagcta

SEQ ID NO: 346438 - DNA, 25 bp, Homo sapien
taccattgagctagacctctgttgg

SEQ ID NO: 346439 - DNA, 25 bp, Homo sapien
gttggcagccatctggcttctctaa

SEQ ID NO: 346440 - DNA, 25 bp, Homo sapien
tggcttctctaacacctctgcttta

SEQ ID NO: 346441 - DNA, 25 bp, Homo sapien
acctctgctttacctcttgaaattg

SEQ ID NO: 346442 - DNA, 25 bp, Homo sapien
tctgtgggtcatccctctgcagaaa

SEQ ID NO: 346443 - DNA, 25 bp, Homo sapien
gcagaaacaccaaacaccttgacag

SEQ ID NO: 346444 - DNA, 25 bp, Homo sapien
gaatttagcttatcaaaactctgga

SEQ ID NO: 346445 - DNA, 25 bp, Homo sapien
gacaagatgtttagccttattggta

SEQ ID NO: 346446 - DNA, 25 bp, Homo sapien
aaaggtttacagcagccaagcaaat

SEQ ID NO: 346447 - DNA, 25 bp, Homo sapien
gcagccaagcaaatacttcgccaga

SEQ ID NO: 346448 - DNA, 25 bp, Homo sapien
atacttcgccagaagaaagggcact

SEQ ID NO: 346449 - DNA, 25 bp, Homo sapien
caaggtaagagatctttgtggcatt

SEQ ID NO: 346450 - DNA, 25 bp, Homo sapien
ttgtggcattttagcttaccctagc

SEQ ID NO: 346451 - DNA, 25 bp, Homo sapien
agccttattggtatattcgtatcag

SEQ ID NO: 346452 - DNA, 25 bp, Homo sapien
aaatggtagagtaggacttctgtgg

SEQ ID NO: 346453 - DNA, 25 bp, Homo sapien
ccttgaagatatactctggcaaaat

SEQ ID NO: 346454 - DNA, 25 bp, Homo sapien
gaagatatactctggcaaaatgaaa

SEQ ID NO: 346455 - DNA, 25 bp, Homo sapien
gagggagacaatagattcaaaaatt

SEQ ID NO: 346456 - DNA, 25 bp, Homo sapien
ttatagaattaacccagaagaacaa

SEQ ID NO: 346457 - DNA, 25 bp, Homo sapien
atactagtaggacagttgtgcagct

SEQ ID NO: 346458 - DNA, 25 bp, Homo sapien
aggacagttgtgcagctgacctaat

SEQ ID NO: 346459 - DNA, 25 bp, Homo sapien
gttgtgcagctgacctaataagcaa

SEQ ID NO: 346460 - DNA, 25 bp, Homo sapien
gtgcagctgacctaataagcaatta

SEQ ID NO: 346461 - DNA, 25 bp, Homo sapien
atctcttatacaagtgtgaaggcat

SEQ ID NO: 346462 - DNA, 25 bp, Homo sapien
gaaggcatagtaaagacacatttag

SEQ ID NO: 346463 - DNA, 25 bp, Homo sapien
gacacatttagaggttcaaggattt

SEQ ID NO: 346464 - DNA, 25 bp, Homo sapien
aaatgagaccctgtcgaccgggcgc

SEQ ID NO: 346465 - DNA, 25 bp, Homo sapien
aatgagaccctgtcgaccgggcgcg

SEQ ID NO: 346466 - DNA, 25 bp, Homo sapien
atgagaccctgtcgaccgggcgcgc

SEQ ID NO: 346467 - DNA, 25 bp, Homo sapien
tgagaccctgtcgaccgggcgcgct

SEQ ID NO: 346468 - DNA, 25 bp, Homo sapien
gagaccctgtcgaccgggcgcgctg

SEQ ID NO: 346469 - DNA, 25 bp, Homo sapien
agaccctgtcgaccgggcgcgctgg

SEQ ID NO: 346470 - DNA, 25 bp, Homo sapien
accctgtcgaccgggcgcgctggct

SEQ ID NO: 346471 - DNA, 25 bp, Homo sapien
ccctgtcgaccgggcgcgctggctc

SEQ ID NO: 346472 - DNA, 25 bp, Homo sapien
cctgtcgaccgggcgcgctggctca

SEQ ID NO: 346473 - DNA, 25 bp, Homo sapien
tgtcgaccgggcgcgctggctcacg

SEQ ID NO: 346474 - DNA, 25 bp, Homo sapien
gtcgaccgggcgcgctggctcacgc

SEQ ID NO: 346475 - DNA, 25 bp, Homo sapien
gaggaaggtgaattagactccaaaa

SEQ ID NO: 346476 - DNA, 25 bp, Homo sapien
agactccaaaagatgaccctgctgt

SEQ ID NO: 346477 - DNA, 25 bp, Homo sapien
tccaaaagatgaccctgctgtagct

SEQ ID NO: 346478 - DNA, 25 bp, Homo sapien
aagatgaccctgctgtagctgggcc

SEQ ID NO: 346479 - DNA, 25 bp, Homo sapien
tgtagctgggccctgacactgtcac

SEQ ID NO: 346480 - DNA, 25 bp, Homo sapien
ctttgttttctcaggatggattttt

SEQ ID NO: 346481 - DNA, 25 bp, Homo sapien
tgttttctcaggatggatttttgct

SEQ ID NO: 346482 - DNA, 25 bp, Homo sapien
ggatttttgctgttttggctctcag

SEQ ID NO: 346483 - DNA, 25 bp, Homo sapien
tttttgctgttttggctctcagcac

SEQ ID NO: 346484 - DNA, 25 bp, Homo sapien
agcacctacctcagccggaatgaat

SEQ ID NO: 346485 - DNA, 25 bp, Homo sapien
ttaccccacagagcccgaatgcact

SEQ ID NO: 346486 - DNA, 25 bp, Homo sapien
tcatgactttatacaggaatcggag

SEQ ID NO: 346487 - DNA, 25 bp, Homo sapien
ggaatcggagacatccaaggccatt

SEQ ID NO: 346488 - DNA, 25 bp, Homo sapien
caaggccattccatttctaaatcac

SEQ ID NO: 346489 - DNA, 25 bp, Homo sapien
ggccattccatttctaaatcacact

SEQ ID NO: 346490 - DNA, 25 bp, Homo sapien
catttctaaatcacacttatccctc

SEQ ID NO: 346491 - DNA, 25 bp, Homo sapien
aaatcacacttatccctcaatcaag

SEQ ID NO: 346492 - DNA, 25 bp, Homo sapien
cctgctttgcatcagtgagttggac

SEQ ID NO: 346493 - DNA, 25 bp, Homo sapien
gctttgcatcagtgagttggactat

SEQ ID NO: 346494 - DNA, 25 bp, Homo sapien
gcatcagtgagttggactatggatc

SEQ ID NO: 346495 - DNA, 25 bp, Homo sapien
gttggactatggatcaggtactgtg

SEQ ID NO: 346496 - DNA, 25 bp, Homo sapien
tggatcaggtactgtgctcagcatc

SEQ ID NO: 346497 - DNA, 25 bp, Homo sapien
aaatagccgggcgtcatggctcttg

SEQ ID NO: 346498 - DNA, 25 bp, Homo sapien
aatagccgggcgtcatggctcttgc

SEQ ID NO: 346499 - DNA, 25 bp, Homo sapien
atagccgggcgtcatggctcttgcc

SEQ ID NO: 346500 - DNA, 25 bp, Homo sapien
tagccgggcgtcatggctcttgcct

SEQ ID NO: 346501 - DNA, 25 bp, Homo sapien
agccgggcgtcatggctcttgcctg

SEQ ID NO: 346502 - DNA, 25 bp, Homo sapien
ggcgtcatggctcttgcctgtactc

SEQ ID NO: 346503 - DNA, 25 bp, Homo sapien
aggcattgaagcgggagaatcactt

SEQ ID NO: 346504 - DNA, 25 bp, Homo sapien
aatatacaggtcacctttgtatgcc

SEQ ID NO: 346505 - DNA, 25 bp, Homo sapien
atatacaggtcacctttgtatgcct

SEQ ID NO: 346506 - DNA, 25 bp, Homo sapien
tatacaggtcacctttgtatgcctt

SEQ ID NO: 346507 - DNA, 25 bp, Homo sapien
caggtcacctttgtatgccttttaa

SEQ ID NO: 346508 - DNA, 25 bp, Homo sapien
tgtgccttggcctgccgtgtttcat

SEQ ID NO: 346509 - DNA, 25 bp, Homo sapien
catggctgtcctcagtgatgtgcat

SEQ ID NO: 346510 - DNA, 25 bp, Homo sapien
gtgatgtgcatggtcactgctccct

SEQ ID NO: 346511 - DNA, 25 bp, Homo sapien
ttcaccactgagaagacgggcacag

SEQ ID NO: 346512 - DNA, 25 bp, Homo sapien
atgtgtccaaggtcccacagcagga

SEQ ID NO: 346513 - DNA, 25 bp, Homo sapien
atgtggtctgagaggctggatatac

SEQ ID NO: 346514 - DNA, 25 bp, Homo sapien
cattccagccaaggtagcacggagt

SEQ ID NO: 346515 - DNA, 25 bp, Homo sapien
caatggcatgaccatctgtacaaat

SEQ ID NO: 346516 - DNA, 25 bp, Homo sapien
gagagctgggcttttctgaactact

SEQ ID NO: 346517 - DNA, 25 bp, Homo sapien
tgaactacttcagtacaccttgctg

SEQ ID NO: 346518 - DNA, 25 bp, Homo sapien
ttcagtacaccttgctgtgccttgg

SEQ ID NO: 346519 - DNA, 25 bp, Homo sapien
aaaatcacagaatctgccaataggt

SEQ ID NO: 346520 - DNA, 25 bp, Homo sapien
acaaaagagctagttagtgggttat

SEQ ID NO: 346521 - DNA, 25 bp, Homo sapien
tagttagtgggttattttagatctt

SEQ ID NO: 346522 - DNA, 25 bp, Homo sapien
gggttcaggtcacatagcttaactt

SEQ ID NO: 346523 - DNA, 25 bp, Homo sapien
ggtcacatagcttaactttgttcaa

SEQ ID NO: 346524 - DNA, 25 bp, Homo sapien
tagcttaactttgttcaacttttat

SEQ ID NO: 346525 - DNA, 25 bp, Homo sapien
gatagattactctagtgcactacat

SEQ ID NO: 346526 - DNA, 25 bp, Homo sapien
gattactctagtgcactacatcaac

SEQ ID NO: 346527 - DNA, 25 bp, Homo sapien
agtgcactacatcaacatatttata

SEQ ID NO: 346528 - DNA, 25 bp, Homo sapien
cctgagaagcagttccttttattta

SEQ ID NO: 346529 - DNA, 25 bp, Homo sapien
gaagcagttccttttatttacctat

SEQ ID NO: 346530 - DNA, 25 bp, Homo sapien
agaaagctgtatccccagtcagtcc

SEQ ID NO: 346531 - DNA, 25 bp, Homo sapien
tcagcaccggccgaagacacccagt

SEQ ID NO: 346532 - DNA, 25 bp, Homo sapien
cactgaccaaggcactgtctttttc

SEQ ID NO: 346533 - DNA, 25 bp, Homo sapien
tgaccaaggcactgtctttttcagg

SEQ ID NO: 346534 - DNA, 25 bp, Homo sapien
accaaggcactgtctttttcaggga

SEQ ID NO: 346535 - DNA, 25 bp, Homo sapien
tttcagggaggtatctaatttggtc

SEQ ID NO: 346536 - DNA, 25 bp, Homo sapien
ttcagggaggtatctaatttggtca

SEQ ID NO: 346537 - DNA, 25 bp, Homo sapien
cagggaggtatctaatttggtcagt

SEQ ID NO: 346538 - DNA, 25 bp, Homo sapien
ttttctctcatgttagtacacgcag

SEQ ID NO: 346539 - DNA, 25 bp, Homo sapien
gtagcccttgaaaagtgtccggtgc

SEQ ID NO: 346540 - DNA, 25 bp, Homo sapien
gtgtccggtgcaacaatgagcaatg

SEQ ID NO: 346541 - DNA, 25 bp, Homo sapien
tcctgccgcacaacacagggagcag

SEQ ID NO: 346542 - DNA, 25 bp, Homo sapien
ggagcagctggcctctgttagcaac

SEQ ID NO: 346543 - DNA, 25 bp, Homo sapien
gcctctgttagcaacacggctccag

SEQ ID NO: 346544 - DNA, 25 bp, Homo sapien
ggcatcaccatctctgccttgactt

SEQ ID NO: 346545 - DNA, 25 bp, Homo sapien
agggccggactcaatcccagggagc

SEQ ID NO: 346546 - DNA, 25 bp, Homo sapien
cagggagcaggaatatggcgacaaa

SEQ ID NO: 346547 - DNA, 25 bp, Homo sapien
tggcgacaaaacatggctcttacac

SEQ ID NO: 346548 - DNA, 25 bp, Homo sapien
gctcttacacattcccatggtaggg

SEQ ID NO: 346549 - DNA, 25 bp, Homo sapien
caaccaagccctcggtaagtcagag

SEQ ID NO: 346550 - DNA, 25 bp, Homo sapien
aagccctcggtaagtcagagctaag

SEQ ID NO: 346551 - DNA, 25 bp, Homo sapien
tcagagctaagcagccgtcagcctc

SEQ ID NO: 346552 - DNA, 25 bp, Homo sapien
aaccactaacttgagtaatacagtt

SEQ ID NO: 346553 - DNA, 25 bp, Homo sapien
cagttcttaagtaaatgttatgcta

SEQ ID NO: 346554 - DNA, 25 bp, Homo sapien
gctaaacttcagagtcagatcctca

SEQ ID NO: 346555 - DNA, 25 bp, Homo sapien
tcagatcctcaccagctctaacaga

SEQ ID NO: 346556 - DNA, 25 bp, Homo sapien
tcctcaccagctctaacagacttgt

SEQ ID NO: 346557 - DNA, 25 bp, Homo sapien
aacaaacaatgacagtccgacagaa

SEQ ID NO: 346558 - DNA, 25 bp, Homo sapien
gacagtccgacagaagacagtcata

SEQ ID NO: 346559 - DNA, 25 bp, Homo sapien
gtcataaatgtgcaattcaaagggt

SEQ ID NO: 346560 - DNA, 25 bp, Homo sapien
gaatgaatcacttacgtcttgaact

SEQ ID NO: 346561 - DNA, 25 bp, Homo sapien
atcacttacgtcttgaactcataat

SEQ ID NO: 346562 - DNA, 25 bp, Homo sapien
aaaccaaccttgaatgttatattag

SEQ ID NO: 346563 - DNA, 25 bp, Homo sapien
agatggttctgtgagtccttggcag

SEQ ID NO: 346564 - DNA, 25 bp, Homo sapien
gggtcaaagggcacatctccttgaa

SEQ ID NO: 346565 - DNA, 25 bp, Homo sapien
aaagggcacatctccttgaacctag

SEQ ID NO: 346566 - DNA, 25 bp, Homo sapien
acatctccttgaacctagaaagccc

SEQ ID NO: 346567 - DNA, 25 bp, Homo sapien
aaggtgtcgggagccagcagagcat

SEQ ID NO: 346568 - DNA, 25 bp, Homo sapien
cagcagagcatggtgcgtgctgcca

SEQ ID NO: 346569 - DNA, 25 bp, Homo sapien
aggagatgccactggccctccgtgc

SEQ ID NO: 346570 - DNA, 25 bp, Homo sapien
tcttaaccgaggctgtccttgctct

SEQ ID NO: 346571 - DNA, 25 bp, Homo sapien
gtccttgctctctgcagaggccgct

SEQ ID NO: 346572 - DNA, 25 bp, Homo sapien
agaggccgctctgcaggatcctcgt

SEQ ID NO: 346573 - DNA, 25 bp, Homo sapien
aggatcctcgtgtcgcgcgtgatgt

SEQ ID NO: 346574 - DNA, 25 bp, Homo sapien
cccctggagcgtggcttcgtgtttg

SEQ ID NO: 346575 - DNA, 25 bp, Homo sapien
ccaagtcctgctcactggagaccag

SEQ ID NO: 346576 - DNA, 25 bp, Homo sapien
aagtcctgctcactggagaccagcc

SEQ ID NO: 346577 - DNA, 25 bp, Homo sapien
tgctcactggagaccagccacttgg

SEQ ID NO: 346578 - DNA, 25 bp, Homo sapien
cactggagaccagccacttggtgct

SEQ ID NO: 346579 - DNA, 25 bp, Homo sapien
aggacagtgcctgataagggttcat

SEQ ID NO: 346580 - DNA, 25 bp, Homo sapien
gacagtgcctgataagggttcatca

SEQ ID NO: 346581 - DNA, 25 bp, Homo sapien
cttcgtgtttgatgagtgcggccca

SEQ ID NO: 346582 - DNA, 25 bp, Homo sapien
tcgtgtttgatgagtgcggcccacc

SEQ ID NO: 346583 - DNA, 25 bp, Homo sapien
tgtttgatgagtgcggcccaccctg

SEQ ID NO: 346584 - DNA, 25 bp, Homo sapien
tgcttcaatcagcatatccccctgg

SEQ ID NO: 346585 - DNA, 25 bp, Homo sapien
aggacaactcccacaacgaagatat

SEQ ID NO: 346586 - DNA, 25 bp, Homo sapien
gaagatatatctagcccaaaatgtc

SEQ ID NO: 346587 - DNA, 25 bp, Homo sapien
catctttttaggatgtatgtgctct

SEQ ID NO: 346588 - DNA, 25 bp, Homo sapien
gtatgtgctcttgtaagctaaccca

SEQ ID NO: 346589 - DNA, 25 bp, Homo sapien
tgtaagctaacccaagtcctttacg

SEQ ID NO: 346590 - DNA, 25 bp, Homo sapien
gagcaacaatatacttcgtgttaga

SEQ ID NO: 346591 - DNA, 25 bp, Homo sapien
cttcgtgttagatgcagttattttc

SEQ ID NO: 346592 - DNA, 25 bp, Homo sapien
agccagtaaactgtgattcttagag

SEQ ID NO: 346593 - DNA, 25 bp, Homo sapien
gtgaatcaaactcatatctaccaaa

SEQ ID NO: 346594 - DNA, 25 bp, Homo sapien
gaaaacataaccctgaagtatatat

SEQ ID NO: 346595 - DNA, 25 bp, Homo sapien
ctaggcatggtacaatgcacaggac

SEQ ID NO: 346596 - DNA, 25 bp, Homo sapien
gtcgaaagcattataactgtaacgt

SEQ ID NO: 346597 - DNA, 25 bp, Homo sapien
taactgtaacgttctttgagtttgt

SEQ ID NO: 346598 - DNA, 25 bp, Homo sapien
tgagtttgtgattgatccacatttt

SEQ ID NO: 346599 - DNA, 25 bp, Homo sapien
ccctgcattatggaaaatgtctctc

SEQ ID NO: 346600 - DNA, 25 bp, Homo sapien
gaacttggttgcgataagtttatca

SEQ ID NO: 346601 - DNA, 25 bp, Homo sapien
atgtggtgacactacttcaagagaa

SEQ ID NO: 346602 - DNA, 25 bp, Homo sapien
cttcaagagaacctctgcattccag

SEQ ID NO: 346603 - DNA, 25 bp, Homo sapien
tctgcattccagtcataccaatcct

SEQ ID NO: 346604 - DNA, 25 bp, Homo sapien
agtcataccaatcctgcaacttgat

SEQ ID NO: 346605 - DNA, 25 bp, Homo sapien
tcagaagtcaagagtatatcgcgat

SEQ ID NO: 346606 - DNA, 25 bp, Homo sapien
gtatatcgcgataagacagtgcaca

SEQ ID NO: 346607 - DNA, 25 bp, Homo sapien
aagttgctgggtaattgaagcactg

SEQ ID NO: 346608 - DNA, 25 bp, Homo sapien
aattgaagcactgagaccacagagg

SEQ ID NO: 346609 - DNA, 25 bp, Homo sapien
aaactgcccatgagatgagatgtgc

SEQ ID NO: 346610 - DNA, 25 bp, Homo sapien
gcccatgagatgagatgtgcctctc

SEQ ID NO: 346611 - DNA, 25 bp, Homo sapien
ggagatgccccccatggaatccagc

SEQ ID NO: 346612 - DNA, 25 bp, Homo sapien
tgtgaggaatccaagcagctacata

SEQ ID NO: 346613 - DNA, 25 bp, Homo sapien
gcagctacatagaaaggccacaact

SEQ ID NO: 346614 - DNA, 25 bp, Homo sapien
agtcgaggcagtaatcgggaaccca

SEQ ID NO: 346615 - DNA, 25 bp, Homo sapien
aggccacaactagatattccagctg

SEQ ID NO: 346616 - DNA, 25 bp, Homo sapien
tataccttacgaataaagctggcac

SEQ ID NO: 346617 - DNA, 25 bp, Homo sapien
ttacgaataaagctggcacgtttcc

SEQ ID NO: 346618 - DNA, 25 bp, Homo sapien
taaccgagcagctacggtccctcat

SEQ ID NO: 346619 - DNA, 25 bp, Homo sapien
tccctcatccccaacgaggatgtga

SEQ ID NO: 346620 - DNA, 25 bp, Homo sapien
tcatccccaacgaggatgtgagaaa

SEQ ID NO: 346621 - DNA, 25 bp, Homo sapien
tccccaacgaggatgtgagaaagtt

SEQ ID NO: 346622 - DNA, 25 bp, Homo sapien
cgaggatgtgagaaagttcatgtct

SEQ ID NO: 346623 - DNA, 25 bp, Homo sapien
atgtgagaaagttcatgtctcatgt

SEQ ID NO: 346624 - DNA, 25 bp, Homo sapien
ggaatgttcagaaacacatgtgcaa

SEQ ID NO: 346625 - DNA, 25 bp, Homo sapien
atgttcagaaacacatgtgcaaggg

SEQ ID NO: 346626 - DNA, 25 bp, Homo sapien
agaaacacatgtgcaagggagctgt

SEQ ID NO: 346627 - DNA, 25 bp, Homo sapien
acatgtgcaagggagctgtgccaag

SEQ ID NO: 346628 - DNA, 25 bp, Homo sapien
caagggagctgtgccaagctcatgt

SEQ ID NO: 346629 - DNA, 25 bp, Homo sapien
tgcaacctcaacttatcttgcctca

SEQ ID NO: 346630 - DNA, 25 bp, Homo sapien
gtacctgggacagtaggtgtgtacc

SEQ ID NO: 346631 - DNA, 25 bp, Homo sapien
ggtgtgtaccactgggcatggctaa

SEQ ID NO: 346632 - DNA, 25 bp, Homo sapien
actgggcatggctaagatttatata

SEQ ID NO: 346633 - DNA, 25 bp, Homo sapien
ataaaatatccttccacctccgtct

SEQ ID NO: 346634 - DNA, 25 bp, Homo sapien
taatattgtgttgcgagttgtgtaa

SEQ ID NO: 346635 - DNA, 25 bp, Homo sapien
ttgcgagttgtgtaaatggtgccag

SEQ ID NO: 346636 - DNA, 25 bp, Homo sapien
aatggtgccaggatacaatttctaa

SEQ ID NO: 346637 - DNA, 25 bp, Homo sapien
gatacaatttctaatccccttactc

SEQ ID NO: 346638 - DNA, 25 bp, Homo sapien
taatccccttactcactaaatcatc

SEQ ID NO: 346639 - DNA, 25 bp, Homo sapien
ttatccagattggagtgtagtggca

SEQ ID NO: 346640 - DNA, 25 bp, Homo sapien
gtgaatgacttacttctggctgagg

SEQ ID NO: 346641 - DNA, 25 bp, Homo sapien
ctgagggtggctactggtgccttac

SEQ ID NO: 346642 - DNA, 25 bp, Homo sapien
ggtgccttactgctgaatgttctag

SEQ ID NO: 346643 - DNA, 25 bp, Homo sapien
tgctgaatgttctagggcctgtttt

SEQ ID NO: 346644 - DNA, 25 bp, Homo sapien
tctagggcctgttttgggtagcaaa

SEQ ID NO: 346645 - DNA, 25 bp, Homo sapien
caaagtacctggtccatgggaggat

SEQ ID NO: 346646 - DNA, 25 bp, Homo sapien
ttgtccttatctttgtcagcagatt

SEQ ID NO: 346647 - DNA, 25 bp, Homo sapien
ttatctttgtcagcagatttcccaa

SEQ ID NO: 346648 - DNA, 25 bp, Homo sapien
gatcaagacagaaaataggcctttt

SEQ ID NO: 346649 - DNA, 25 bp, Homo sapien
tggtgatctactgcccggactatat

SEQ ID NO: 346650 - DNA, 25 bp, Homo sapien
actgcccggactatattaagccatt

SEQ ID NO: 346651 - DNA, 25 bp, Homo sapien
gaaaatgttagcctctgtgctggac

SEQ ID NO: 346652 - DNA, 25 bp, Homo sapien
aatgttagcctctgtgctggactga

SEQ ID NO: 346653 - DNA, 25 bp, Homo sapien
gttagcctctgtgctggactgattt

SEQ ID NO: 346654 - DNA, 25 bp, Homo sapien
gctggactgatttcatattttaccc

SEQ ID NO: 346655 - DNA, 25 bp, Homo sapien
atattttaccccaagtggttcatgt

SEQ ID NO: 346656 - DNA, 25 bp, Homo sapien
ttaccccaagtggttcatgtaacta

SEQ ID NO: 346657 - DNA, 25 bp, Homo sapien
gggagttttgcttcacactattaaa

SEQ ID NO: 346658 - DNA, 25 bp, Homo sapien
tgcttcacactattaaatccacttt

SEQ ID NO: 346659 - DNA, 25 bp, Homo sapien
agaattagtattcatgaagcactta

SEQ ID NO: 346660 - DNA, 25 bp, Homo sapien
tagtaagcactatgtgtttgtaaaa

SEQ ID NO: 346661 - DNA, 25 bp, Homo sapien
atttttatgagaataatgcagctct

SEQ ID NO: 346662 - DNA, 25 bp, Homo sapien
gtgcataaaccggtaatacttacta

SEQ ID NO: 346663 - DNA, 25 bp, Homo sapien
gtactgtacgtaagtgtataaccta

SEQ ID NO: 346664 - DNA, 25 bp, Homo sapien
gtataacctagactttttacagctc

SEQ ID NO: 346665 - DNA, 25 bp, Homo sapien
gactttttacagctcagtaggtttg

SEQ ID NO: 346666 - DNA, 25 bp, Homo sapien
gtttacaccagtataatcacagaca

SEQ ID NO: 346667 - DNA, 25 bp, Homo sapien
aatgtgttgtgctacaatgttacaa

SEQ ID NO: 346668 - DNA, 25 bp, Homo sapien
gttacaattgttctgtcactaggca

SEQ ID NO: 346669 - DNA, 25 bp, Homo sapien
taggcagtagtaatttttctgctcc

SEQ ID NO: 346670 - DNA, 25 bp, Homo sapien
ccactgtggtatatgaggtctatca

SEQ ID NO: 346671 - DNA, 25 bp, Homo sapien
gtatatgaggtctatcactgaccaa

SEQ ID NO: 346672 - DNA, 25 bp, Homo sapien
tggtgcatgactgtatttgaaactc

SEQ ID NO: 346673 - DNA, 25 bp, Homo sapien
gtattctcagaacgcacatgggata

SEQ ID NO: 346674 - DNA, 25 bp, Homo sapien
ggataatcaccatcctggtgtgtcc

SEQ ID NO: 346675 - DNA, 25 bp, Homo sapien
tgggaacaggctcttcctcgtggct

SEQ ID NO: 346676 - DNA, 25 bp, Homo sapien
gtggctttcacatgagtttcctggt

SEQ ID NO: 346677 - DNA, 25 bp, Homo sapien
gagtttcctggtgggctatgtagtc

SEQ ID NO: 346678 - DNA, 25 bp, Homo sapien
ggctatgtagtcacttttctgcatc

SEQ ID NO: 346679 - DNA, 25 bp, Homo sapien
tcttttaaaggctcatgaatgtcaa

SEQ ID NO: 346680 - DNA, 25 bp, Homo sapien
gaatgtcaaagtaacacagaccctg

SEQ ID NO: 346681 - DNA, 25 bp, Homo sapien
ctaagttggtctaaaagtgcatatc

SEQ ID NO: 346682 - DNA, 25 bp, Homo sapien
agtgcatatcttggtaaggctctgt

SEQ ID NO: 346683 - DNA, 25 bp, Homo sapien
aatgacctaatctggagagaagctg

SEQ ID NO: 346684 - DNA, 25 bp, Homo sapien
aagctcagcgctcggcaaccatagg

SEQ ID NO: 346685 - DNA, 25 bp, Homo sapien
gcaaccataggcacccaacaacggg

SEQ ID NO: 346686 - DNA, 25 bp, Homo sapien
ccatcagtaacaacggcagctccaa

SEQ ID NO: 346687 - DNA, 25 bp, Homo sapien
aacgcccagagaactcacggagcag

SEQ ID NO: 346688 - DNA, 25 bp, Homo sapien
tcacggagcagacacacatcagatg

SEQ ID NO: 346689 - DNA, 25 bp, Homo sapien
acatcagatgaagacgcggaggcct

SEQ ID NO: 346690 - DNA, 25 bp, Homo sapien
gaatgccccggcttagtcagtctgg

SEQ ID NO: 346691 - DNA, 25 bp, Homo sapien
tcagtctgggatgcggccttggaca

SEQ ID NO: 346692 - DNA, 25 bp, Homo sapien
atgcggccttggacaccgggcttta

SEQ ID NO: 346693 - DNA, 25 bp, Homo sapien
gacaccgggctttatgcagctctga

SEQ ID NO: 346694 - DNA, 25 bp, Homo sapien
agctctgaagtgatcccagcacaca

SEQ ID NO: 346695 - DNA, 25 bp, Homo sapien
agttttcattcctatcttgtggttt

SEQ ID NO: 346696 - DNA, 25 bp, Homo sapien
tggttttatgacaactcccactcca

SEQ ID NO: 346697 - DNA, 25 bp, Homo sapien
caacttttctctacaatgcaggcca

SEQ ID NO: 346698 - DNA, 25 bp, Homo sapien
aatgcaggccagtcctatgcaacag

SEQ ID NO: 346699 - DNA, 25 bp, Homo sapien
agcatcctgaactacatccatactt

SEQ ID NO: 346700 - DNA, 25 bp, Homo sapien
atccatacttggatttccactgatg

SEQ ID NO: 346701 - DNA, 25 bp, Homo sapien
gatggctcattaaaaagtccctaac

SEQ ID NO: 346702 - DNA, 25 bp, Homo sapien
ttattgacaccattatctacccagt

SEQ ID NO: 346703 - DNA, 25 bp, Homo sapien
atctacccagtcacttaagccagta

SEQ ID NO: 346704 - DNA, 25 bp, Homo sapien
aagccagtagcccaagatccaatct

SEQ ID NO: 346705 - DNA, 25 bp, Homo sapien
aatctagctttctgtcatctgcaac

SEQ ID NO: 346706 - DNA, 25 bp, Homo sapien
tatagccaagtatcttaaactctgc

SEQ ID NO: 346707 - DNA, 25 bp, Homo sapien
gaatttttaatcctcgtgtatatcc

SEQ ID NO: 346708 - DNA, 25 bp, Homo sapien
ttaatcctcgtgtatatccattatg

SEQ ID NO: 346709 - DNA, 25 bp, Homo sapien
tatttctattagttccagtttgagg

SEQ ID NO: 346710 - DNA, 25 bp, Homo sapien
gttccagtttgaggttggtgatgat

SEQ ID NO: 346711 - DNA, 25 bp, Homo sapien
gatattgtcatagaagctttgtcag

SEQ ID NO: 346712 - DNA, 25 bp, Homo sapien
gggcatatccttgttcaatgtgact

SEQ ID NO: 346713 - DNA, 25 bp, Homo sapien
atccttgttcaatgtgactacttta

SEQ ID NO: 346714 - DNA, 25 bp, Homo sapien
gtgactactttagttgcctgtccaa

SEQ ID NO: 346715 - DNA, 25 bp, Homo sapien
actttagttgcctgtccaatatgaa

SEQ ID NO: 346716 - DNA, 25 bp, Homo sapien
ttgcctgtccaatatgaagtagaaa

SEQ ID NO: 346717 - DNA, 25 bp, Homo sapien
gcacatccagtcctcctactgtaaa

SEQ ID NO: 346718 - DNA, 25 bp, Homo sapien
tggctcaggcttcatcaccattgct

SEQ ID NO: 346719 - DNA, 25 bp, Homo sapien
cctccagtaggtccctcacatggtt

SEQ ID NO: 346720 - DNA, 25 bp, Homo sapien
ccagtcctcctactgtaaacagctg

SEQ ID NO: 346721 - DNA, 25 bp, Homo sapien
tcacatggttccagagggatctttt

SEQ ID NO: 346722 - DNA, 25 bp, Homo sapien
tccagagggatctttttaagcccgg

SEQ ID NO: 346723 - DNA, 25 bp, Homo sapien
gtgaataaggtgtcaccctgaggca

SEQ ID NO: 346724 - DNA, 25 bp, Homo sapien
gaggcagacggatggctcagctcct

SEQ ID NO: 346725 - DNA, 25 bp, Homo sapien
agacggatggctcagctccttacca

SEQ ID NO: 346726 - DNA, 25 bp, Homo sapien
tcagctccttaccacatggatggct

SEQ ID NO: 346727 - DNA, 25 bp, Homo sapien
gctccttaccacatggatggctcct

SEQ ID NO: 346728 - DNA, 25 bp, Homo sapien
ggccggatccatccaagcatggaca

SEQ ID NO: 346729 - DNA, 25 bp, Homo sapien
caagcatggacaggaaaacgggact

SEQ ID NO: 346730 - DNA, 25 bp, Homo sapien
agggtggtgcagacgggccgcagac

SEQ ID NO: 346731 - DNA, 25 bp, Homo sapien
gagaagccggaaactagggagtcat

SEQ ID NO: 346732 - DNA, 25 bp, Homo sapien
gaaactagggagtcatgtgcagtta

SEQ ID NO: 346733 - DNA, 25 bp, Homo sapien
gtcatgtgcagttagaatcctcttg

SEQ ID NO: 346734 - DNA, 25 bp, Homo sapien
agaatcctcttggaagactagtagg

SEQ ID NO: 346735 - DNA, 25 bp, Homo sapien
gaccagaaaattcccttgtcttgcc

SEQ ID NO: 346736 - DNA, 25 bp, Homo sapien
ctaactatgagtttcctccgcgcat

SEQ ID NO: 346737 - DNA, 25 bp, Homo sapien
tgctctggcccctaaagtacagcag

SEQ ID NO: 346738 - DNA, 25 bp, Homo sapien
tctggcccctaaagtacagcagtaa

SEQ ID NO: 346739 - DNA, 25 bp, Homo sapien
gaggctgggaaacttaaccacattt

SEQ ID NO: 346740 - DNA, 25 bp, Homo sapien
gtttctgatggcatggaaatcctgc

SEQ ID NO: 346741 - DNA, 25 bp, Homo sapien
ggcatggaaatcctgccattgaatg

SEQ ID NO: 346742 - DNA, 25 bp, Homo sapien
ctgccattgaatgcaaacgcacaag

SEQ ID NO: 346743 - DNA, 25 bp, Homo sapien
atgcaaacgcacaagactagaattt

SEQ ID NO: 346744 - DNA, 25 bp, Homo sapien
actagaatttggaactgagtttcgt

SEQ ID NO: 346745 - DNA, 25 bp, Homo sapien
gcatccattttgctgtgtggatggt

SEQ ID NO: 346746 - DNA, 25 bp, Homo sapien
gaggtccttccccttcaaagcctgt

SEQ ID NO: 346747 - DNA, 25 bp, Homo sapien
ggcagccactaaatggccccaagat

SEQ ID NO: 346748 - DNA, 25 bp, Homo sapien
taaatggccccaagatcccatggac

SEQ ID NO: 346749 - DNA, 25 bp, Homo sapien
gccccaagatcccatggactcaagg

SEQ ID NO: 346750 - DNA, 25 bp, Homo sapien
gccctcagacagcagtggcatcaac

SEQ ID NO: 346751 - DNA, 25 bp, Homo sapien
cctcagacagcagtggcatcaactt

SEQ ID NO: 346752 - DNA, 25 bp, Homo sapien
tcagacagcagtggcatcaacttgt

SEQ ID NO: 346753 - DNA, 25 bp, Homo sapien
agacagcagtggcatcaacttgtca

SEQ ID NO: 346754 - DNA, 25 bp, Homo sapien
acagcagtggcatcaacttgtcagg

SEQ ID NO: 346755 - DNA, 25 bp, Homo sapien
cagcagtggcatcaacttgtcaggc

SEQ ID NO: 346756 - DNA, 25 bp, Homo sapien
gcagtggcatcaacttgtcaggctt

SEQ ID NO: 346757 - DNA, 25 bp, Homo sapien
cagtggcatcaacttgtcaggcttt

SEQ ID NO: 346758 - DNA, 25 bp, Homo sapien
agtggcatcaacttgtcaggctttg

SEQ ID NO: 346759 - DNA, 25 bp, Homo sapien
gtggcatcaacttgtcaggctttgg

SEQ ID NO: 346760 - DNA, 25 bp, Homo sapien
tggcatcaacttgtcaggctttggg

SEQ ID NO: 346761 - DNA, 25 bp, Homo sapien
gggttgccagggtgatgacaactcc

SEQ ID NO: 346762 - DNA, 25 bp, Homo sapien
tgccagggtgatgacaactccgtga

SEQ ID NO: 346763 - DNA, 25 bp, Homo sapien
acttgagatctcttggaagcgagga

SEQ ID NO: 346764 - DNA, 25 bp, Homo sapien
gatctcttggaagcgaggatccttt

SEQ ID NO: 346765 - DNA, 25 bp, Homo sapien
tctcttggaagcgaggatcctttaa

SEQ ID NO: 346766 - DNA, 25 bp, Homo sapien
tcttggaagcgaggatcctttaaaa

SEQ ID NO: 346767 - DNA, 25 bp, Homo sapien
aaaatcctggaatatacactgcagt

SEQ ID NO: 346768 - DNA, 25 bp, Homo sapien
aatcctggaatatacactgcagtaa

SEQ ID NO: 346769 - DNA, 25 bp, Homo sapien
cctggaatatacactgcagtaaaag

SEQ ID NO: 346770 - DNA, 25 bp, Homo sapien
gcatacctcagccttaaacgactga

SEQ ID NO: 346771 - DNA, 25 bp, Homo sapien
catacctcagccttaaacgactgaa

SEQ ID NO: 346772 - DNA, 25 bp, Homo sapien
tgtgaagacaggctcagcatctccc

SEQ ID NO: 346773 - DNA, 25 bp, Homo sapien
agcatctcccttcagctcttcatag

SEQ ID NO: 346774 - DNA, 25 bp, Homo sapien
tcttcatagcagctccctcctaaga

SEQ ID NO: 346775 - DNA, 25 bp, Homo sapien
cctcctaagactcgtgccaaagtga

SEQ ID NO: 346776 - DNA, 25 bp, Homo sapien
atggctggaaattcctaaggaactc

SEQ ID NO: 346777 - DNA, 25 bp, Homo sapien
aactcactccaaaagcagttctgct

SEQ ID NO: 346778 - DNA, 25 bp, Homo sapien
agttctgctcagagatctgccatct

SEQ ID NO: 346779 - DNA, 25 bp, Homo sapien
ggttttaattgtctgcactcaagtg

SEQ ID NO: 346780 - DNA, 25 bp, Homo sapien
tcaagtgccctccatttgcacaaat

SEQ ID NO: 346781 - DNA, 25 bp, Homo sapien
ttgcacaaataatggacagctgact

SEQ ID NO: 346782 - DNA, 25 bp, Homo sapien
gacagctgactgtatatcttatatt

SEQ ID NO: 346783 - DNA, 25 bp, Homo sapien
tctggttacactactccacgaactc

SEQ ID NO: 346784 - DNA, 25 bp, Homo sapien
actcctccaaagatccgttattcaa

SEQ ID NO: 346785 - DNA, 25 bp, Homo sapien
gcctagaaaatgtttccatctcctc

SEQ ID NO: 346786 - DNA, 25 bp, Homo sapien
catctcctctaaatccctgtgttct

SEQ ID NO: 346787 - DNA, 25 bp, Homo sapien
cctgtgttctcctctgtggaaatga

SEQ ID NO: 346788 - DNA, 25 bp, Homo sapien
aagaagcacctgaggccttggttca

SEQ ID NO: 346789 - DNA, 25 bp, Homo sapien
ggttcatgcagtgttctcttttgac

SEQ ID NO: 346790 - DNA, 25 bp, Homo sapien
ttgactaaatcacctaggttccttt

SEQ ID NO: 346791 - DNA, 25 bp, Homo sapien
gctactcgggtggtttacacaggag

SEQ ID NO: 346792 - DNA, 25 bp, Homo sapien
ttacacaggaggatggctttgggcc

SEQ ID NO: 346793 - DNA, 25 bp, Homo sapien
gctttgggcctagtagttcgagtcc

SEQ ID NO: 346794 - DNA, 25 bp, Homo sapien
cctgctcttgaccatggtgaacttg

SEQ ID NO: 346795 - DNA, 25 bp, Homo sapien
aggtgccttagaccttcttcggtga

SEQ ID NO: 346796 - DNA, 25 bp, Homo sapien
atggattacatcaatatgctacgtg

SEQ ID NO: 346797 - DNA, 25 bp, Homo sapien
atgctacgtgccctgtggattctgg

SEQ ID NO: 346798 - DNA, 25 bp, Homo sapien
tggattctggctggatatgggcaat

SEQ ID NO: 346799 - DNA, 25 bp, Homo sapien
ggcaatggcgagttccagcaggaaa

SEQ ID NO: 346800 - DNA, 25 bp, Homo sapien
ttagaccttcttcggtgatcgaccg

SEQ ID NO: 346801 - DNA, 25 bp, Homo sapien
ggtcagagaatttaatctcctgcct

SEQ ID NO: 346802 - DNA, 25 bp, Homo sapien
cctatgaggtcaccccagctggtga

SEQ ID NO: 346803 - DNA, 25 bp, Homo sapien
ctagatgagcacaagggcagtctgt

SEQ ID NO: 346804 - DNA, 25 bp, Homo sapien
tgtgtgtgggatcccttcccattca

SEQ ID NO: 346805 - DNA, 25 bp, Homo sapien
tggttttgtaacaagtgccactttt

SEQ ID NO: 346806 - DNA, 25 bp, Homo sapien
gtgccacttttatagtcacaataat

SEQ ID NO: 346807 - DNA, 25 bp, Homo sapien
accccaaagctactgatcagacact

SEQ ID NO: 346808 - DNA, 25 bp, Homo sapien
gctactgatcagacactctagaggt

SEQ ID NO: 346809 - DNA, 25 bp, Homo sapien
gaggcaggcgcagtctagttcaagc

SEQ ID NO: 346810 - DNA, 25 bp, Homo sapien
aggcgcagtctagttcaagctcaca

SEQ ID NO: 346811 - DNA, 25 bp, Homo sapien
tagttcaagctcacactgacctgtt

SEQ ID NO: 346812 - DNA, 25 bp, Homo sapien
ttcaagctcacactgacctgttctg

SEQ ID NO: 346813 - DNA, 25 bp, Homo sapien
gggcagatgattctgatagatgcaa

SEQ ID NO: 346814 - DNA, 25 bp, Homo sapien
gcaagtttgagaacacggttctaga

SEQ ID NO: 346815 - DNA, 25 bp, Homo sapien
ggttctagatcacagaaactggttt

SEQ ID NO: 346816 - DNA, 25 bp, Homo sapien
gatgaataactacagctgcatggct

SEQ ID NO: 346817 - DNA, 25 bp, Homo sapien
ctgcatggctaacccattggttgtg

SEQ ID NO: 346818 - DNA, 25 bp, Homo sapien
tatgggttatcatgttttgtctaaa

SEQ ID NO: 346819 - DNA, 25 bp, Homo sapien
gcaaaatctagcctgttttgtggca

SEQ ID NO: 346820 - DNA, 25 bp, Homo sapien
gttttgtggcattaggatcatcatt

SEQ ID NO: 346821 - DNA, 25 bp, Homo sapien
atacttacgctatgtcccgaatgtt

SEQ ID NO: 346822 - DNA, 25 bp, Homo sapien
atgtcccgaatgtttttaaggccag

SEQ ID NO: 346823 - DNA, 25 bp, Homo sapien
acagtagagtacttgcctgaatgca

SEQ ID NO: 346824 - DNA, 25 bp, Homo sapien
caatactgtaccaggatttagacaa

SEQ ID NO: 346825 - DNA, 25 bp, Homo sapien
gacaatttagcaaaatgcacgaggc

SEQ ID NO: 346826 - DNA, 25 bp, Homo sapien
tgcacgaggcagtactttggatgat

SEQ ID NO: 346827 - DNA, 25 bp, Homo sapien
gatctttctggtaagggttttgtat

SEQ ID NO: 346828 - DNA, 25 bp, Homo sapien
taagggttttgtattactcttgctt

SEQ ID NO: 346829 - DNA, 25 bp, Homo sapien
ggatatgtatgtcttccacacacgg

SEQ ID NO: 346830 - DNA, 25 bp, Homo sapien
tccacacacggactttatgccaaag

SEQ ID NO: 346831 - DNA, 25 bp, Homo sapien
ttatgccaaagtaagagaagcccac

SEQ ID NO: 346832 - DNA, 25 bp, Homo sapien
gtaagagaagcccactgacaacagt

SEQ ID NO: 346833 - DNA, 25 bp, Homo sapien
gaagcccactgacaacagtagacta

SEQ ID NO: 346834 - DNA, 25 bp, Homo sapien
gactaagctgtactgaaaaggttct

SEQ ID NO: 346835 - DNA, 25 bp, Homo sapien
agcaagatttctgtggtagagttat

SEQ ID NO: 346836 - DNA, 25 bp, Homo sapien
gggtgtcatttcctttcactacgtc

SEQ ID NO: 346837 - DNA, 25 bp, Homo sapien
tcatttcctttcactacgtcttaag

SEQ ID NO: 346838 - DNA, 25 bp, Homo sapien
taggcatgggaatgtcacctccttt

SEQ ID NO: 346839 - DNA, 25 bp, Homo sapien
atgggaatgtcacctcctttgccac

SEQ ID NO: 346840 - DNA, 25 bp, Homo sapien
tgtaccccatcaagcttactctgaa

SEQ ID NO: 346841 - DNA, 25 bp, Homo sapien
gcttactctgaatcaaaggttttgt

SEQ ID NO: 346842 - DNA, 25 bp, Homo sapien
gtgaagagaggttcgtacttctcat

SEQ ID NO: 346843 - DNA, 25 bp, Homo sapien
ggttcgtacttctcataattggtat

SEQ ID NO: 346844 - DNA, 25 bp, Homo sapien
ctgtttgtacatcgtttttttccat

SEQ ID NO: 346845 - DNA, 25 bp, Homo sapien
tttccattaaacttttctagagaag

SEQ ID NO: 346846 - DNA, 25 bp, Homo sapien
agacaaaagcttacactggtgacat

SEQ ID NO: 346847 - DNA, 25 bp, Homo sapien
aagcttacactggtgacatggataa

SEQ ID NO: 346848 - DNA, 25 bp, Homo sapien
tgagatggtgtctaacgagcagtgc

SEQ ID NO: 346849 - DNA, 25 bp, Homo sapien
agattatttctgctagtcacttttt

SEQ ID NO: 346850 - DNA, 25 bp, Homo sapien
ttttatttcttgagagctgccactc

SEQ ID NO: 346851 - DNA, 25 bp, Homo sapien
gagctgccactcatttaatatttct

SEQ ID NO: 346852 - DNA, 25 bp, Homo sapien
gagaagagacttgactgatttagat

SEQ ID NO: 346853 - DNA, 25 bp, Homo sapien
gaaaacctttgaacgtgagtagaca

SEQ ID NO: 346854 - DNA, 25 bp, Homo sapien
tgagtagacaagcttcatatatctg

SEQ ID NO: 346855 - DNA, 25 bp, Homo sapien
atggtagcttgagtcattcgtactt

SEQ ID NO: 346856 - DNA, 25 bp, Homo sapien
gagtcattcgtacttatcacagaaa

SEQ ID NO: 346857 - DNA, 25 bp, Homo sapien
gaattgaactcccagtcatacacct

SEQ ID NO: 346858 - DNA, 25 bp, Homo sapien
ctcccagtcatacacctgtaactga

SEQ ID NO: 346859 - DNA, 25 bp, Homo sapien
gtaactgaaataccaaactgtctta

SEQ ID NO: 346860 - DNA, 25 bp, Homo sapien
gttcctgatctatctaactgtcacc

SEQ ID NO: 346861 - DNA, 25 bp, Homo sapien
accatcacaatcgtgtttctgtttt

SEQ ID NO: 346862 - DNA, 25 bp, Homo sapien
caatgaggcagatactttctgggaa

SEQ ID NO: 346863 - DNA, 25 bp, Homo sapien
gggtctatcttattaggtcaggttt

SEQ ID NO: 346864 - DNA, 25 bp, Homo sapien
ggtcaggtttttgagacagacacat

SEQ ID NO: 346865 - DNA, 25 bp, Homo sapien
ggcttggtacagaaacgctggctat

SEQ ID NO: 346866 - DNA, 25 bp, Homo sapien
aaattagggcaccttggcatccagt

SEQ ID NO: 346867 - DNA, 25 bp, Homo sapien
ttctgttttggccttaccagtgaaa

SEQ ID NO: 346868 - DNA, 25 bp, Homo sapien
tggccttaccagtgaaacatgtttc

SEQ ID NO: 346869 - DNA, 25 bp, Homo sapien
aacatgtttcgcagaacagccaggt

SEQ ID NO: 346870 - DNA, 25 bp, Homo sapien
aacagccaggtttttggagtgagat

SEQ ID NO: 346871 - DNA, 25 bp, Homo sapien
gttcactagaatgtggccatgctca

SEQ ID NO: 346872 - DNA, 25 bp, Homo sapien
gtaatctgtggtagtttttgtgcta

SEQ ID NO: 346873 - DNA, 25 bp, Homo sapien
ttttgtgctactgtggcagaattga

SEQ ID NO: 346874 - DNA, 25 bp, Homo sapien
tgcagtggaacttgaatgggctaca

SEQ ID NO: 346875 - DNA, 25 bp, Homo sapien
ggtgtatttagtacctggcccttca

SEQ ID NO: 346876 - DNA, 25 bp, Homo sapien
aaagtttgctgacctgattgaatgt

SEQ ID NO: 346877 - DNA, 25 bp, Homo sapien
acctgattgaatgtgcttgtgtgta

SEQ ID NO: 346878 - DNA, 25 bp, Homo sapien
gtgtgtatcacaggaagctcaccag

SEQ ID NO: 346879 - DNA, 25 bp, Homo sapien
aggaagctcaccaggactcttggta

SEQ ID NO: 346880 - DNA, 25 bp, Homo sapien
ggactcttggtatgtagcctctagc

SEQ ID NO: 346881 - DNA, 25 bp, Homo sapien
gtatgtagcctctagctcccaaagg

SEQ ID NO: 346882 - DNA, 25 bp, Homo sapien
gggtggccaggctcttgcccatgcc

SEQ ID NO: 346883 - DNA, 25 bp, Homo sapien
aggctcttgcccatgccttgcagac

SEQ ID NO: 346884 - DNA, 25 bp, Homo sapien
tggctaacaaccaggtgcgtgcacc

SEQ ID NO: 346885 - DNA, 25 bp, Homo sapien
atgccttgcagaccaacaagtgcct

SEQ ID NO: 346886 - DNA, 25 bp, Homo sapien
ctgcacctcggtggcaatgagctgt

SEQ ID NO: 346887 - DNA, 25 bp, Homo sapien
acctcggtggcaatgagctgtctga

SEQ ID NO: 346888 - DNA, 25 bp, Homo sapien
ggcaatgagctgtctgagcccaccg

SEQ ID NO: 346889 - DNA, 25 bp, Homo sapien
tgtcacaggtgctcgccatcaacac

SEQ ID NO: 346890 - DNA, 25 bp, Homo sapien
tgtcctgcaaccacatcgggctgga

SEQ ID NO: 346891 - DNA, 25 bp, Homo sapien
tcaacctacgtctcaactgcatcga

SEQ ID NO: 346892 - DNA, 25 bp, Homo sapien
tacgtctcaactgcatcgaggatga

SEQ ID NO: 346893 - DNA, 25 bp, Homo sapien
gagaggaagagaacaaatgtgacaa

SEQ ID NO: 346894 - DNA, 25 bp, Homo sapien
gaaaatcggtaaacctgtaggccag

SEQ ID NO: 346895 - DNA, 25 bp, Homo sapien
aaatcggtaaacctgtaggccagct

SEQ ID NO: 346896 - DNA, 25 bp, Homo sapien
aatcggtaaacctgtaggccagctg

SEQ ID NO: 346897 - DNA, 25 bp, Homo sapien
atcggtaaacctgtaggccagctgc

SEQ ID NO: 346898 - DNA, 25 bp, Homo sapien
tcggtaaacctgtaggccagctgca

SEQ ID NO: 346899 - DNA, 25 bp, Homo sapien
cggtaaacctgtaggccagctgcag

SEQ ID NO: 346900 - DNA, 25 bp, Homo sapien
ggtaaacctgtaggccagctgcagt

SEQ ID NO: 346901 - DNA, 25 bp, Homo sapien
gtaaacctgtaggccagctgcagtg

SEQ ID NO: 346902 - DNA, 25 bp, Homo sapien
tctctacaaaattaggaggttgagg

SEQ ID NO: 346903 - DNA, 25 bp, Homo sapien
ggatgatttgagtctaggaggcgga

SEQ ID NO: 346904 - DNA, 25 bp, Homo sapien
gtaaagtgactgatgcccttccaga

SEQ ID NO: 346905 - DNA, 25 bp, Homo sapien
gactgatgcccttccagagccagaa

SEQ ID NO: 346906 - DNA, 25 bp, Homo sapien
tctggaggccatgcagtcccggctg

SEQ ID NO: 346907 - DNA, 25 bp, Homo sapien
ggctggccacactccgcagctaggg

SEQ ID NO: 346908 - DNA, 25 bp, Homo sapien
tcctctcaagagctgccattttatg

SEQ ID NO: 346909 - DNA, 25 bp, Homo sapien
tttatgtgtctcttgcactacacct

SEQ ID NO: 346910 - DNA, 25 bp, Homo sapien
ttgcactacacctctgttgtgagga

SEQ ID NO: 346911 - DNA, 25 bp, Homo sapien
gttgtgaggactaccattttggaga

SEQ ID NO: 346912 - DNA, 25 bp, Homo sapien
tgtctcttttcattctctgcccagg

SEQ ID NO: 346913 - DNA, 25 bp, Homo sapien
ctctgcccaggttttgggatcgcaa

SEQ ID NO: 346914 - DNA, 25 bp, Homo sapien
ggatcgcaaagggattgttcttata

SEQ ID NO: 346915 - DNA, 25 bp, Homo sapien
gatcatatgtgacctgacaagccta

SEQ ID NO: 346916 - DNA, 25 bp, Homo sapien
gtgacctgacaagcctaaaatactc

SEQ ID NO: 346917 - DNA, 25 bp, Homo sapien
gacaagcctaaaatactcactatct

SEQ ID NO: 346918 - DNA, 25 bp, Homo sapien
ttttaaagggtcatctctctctctc

SEQ ID NO: 346919 - DNA, 25 bp, Homo sapien
tctggtcctttataggaaatgctta

SEQ ID NO: 346920 - DNA, 25 bp, Homo sapien
tctggtctaaacactgagaggtaag

SEQ ID NO: 346921 - DNA, 25 bp, Homo sapien
aggtaagggacctctgctgcaccgc

SEQ ID NO: 346922 - DNA, 25 bp, Homo sapien
gccctggagggatttttgatcccta

SEQ ID NO: 346923 - DNA, 25 bp, Homo sapien
tcctggcctgaatgtgcttctgaga

SEQ ID NO: 346924 - DNA, 25 bp, Homo sapien
gaatgtgcttctgagaggcagtcaa

SEQ ID NO: 346925 - DNA, 25 bp, Homo sapien
gctgcagagatcatatgtgacctga

SEQ ID NO: 346926 - DNA, 25 bp, Homo sapien
agagctgccactgctcctcataccc

SEQ ID NO: 346927 - DNA, 25 bp, Homo sapien
gggtgatggctatccatgcttgaac

SEQ ID NO: 346928 - DNA, 25 bp, Homo sapien
ggtgatggctatccatgcttgaaca

SEQ ID NO: 346929 - DNA, 25 bp, Homo sapien
gtgatggctatccatgcttgaacat

SEQ ID NO: 346930 - DNA, 25 bp, Homo sapien
tgatggctatccatgcttgaacatt

SEQ ID NO: 346931 - DNA, 25 bp, Homo sapien
aatgttctccaagcaaaagctcaga

SEQ ID NO: 346932 - DNA, 25 bp, Homo sapien
gctcagagaaatgaaggtcatgttc

SEQ ID NO: 346933 - DNA, 25 bp, Homo sapien
gagaaatgaaggtcatgttcaggga

SEQ ID NO: 346934 - DNA, 25 bp, Homo sapien
tgttcagggaacagtgaggtcagaa

SEQ ID NO: 346935 - DNA, 25 bp, Homo sapien
tcagggaacagtgaggtcagaataa

SEQ ID NO: 346936 - DNA, 25 bp, Homo sapien
cagtgaggtcagaataaaattggga

SEQ ID NO: 346937 - DNA, 25 bp, Homo sapien
tgaggtttcctcatgtctcgtcatc

SEQ ID NO: 346938 - DNA, 25 bp, Homo sapien
tcgtcatctagtggccctacaaata

SEQ ID NO: 346939 - DNA, 25 bp, Homo sapien
tagtggccctacaaataaacctctt

SEQ ID NO: 346940 - DNA, 25 bp, Homo sapien
tactgcaacccagtgtctgtgcata

SEQ ID NO: 346941 - DNA, 25 bp, Homo sapien
gtgtctgtgcatattgacttgctgt

SEQ ID NO: 346942 - DNA, 25 bp, Homo sapien
ggcaataaacctatgacggctgcat

SEQ ID NO: 346943 - DNA, 25 bp, Homo sapien
gacggctgcatgcataagcttctgt

SEQ ID NO: 346944 - DNA, 25 bp, Homo sapien
gaatgcatggctcacaatggaacaa

SEQ ID NO: 346945 - DNA, 25 bp, Homo sapien
aatggaacaatcacatggctataca

SEQ ID NO: 346946 - DNA, 25 bp, Homo sapien
ggtggttattcctgagcaaacagcc

SEQ ID NO: 346947 - DNA, 25 bp, Homo sapien
ggactagataaaaggctcccctgag

SEQ ID NO: 346948 - DNA, 25 bp, Homo sapien
agtatctctccgctggctgatagct

SEQ ID NO: 346949 - DNA, 25 bp, Homo sapien
tggctgatagctccccgggcaaaaa

SEQ ID NO: 346950 - DNA, 25 bp, Homo sapien
agaagtcacacggatcacgactctt

SEQ ID NO: 346951 - DNA, 25 bp, Homo sapien
acacggatcacgactcttcagaagt

SEQ ID NO: 346952 - DNA, 25 bp, Homo sapien
tcacgactcttcagaagtccacaga

SEQ ID NO: 346953 - DNA, 25 bp, Homo sapien
ccgtggactgacctagctatcatat

SEQ ID NO: 346954 - DNA, 25 bp, Homo sapien
tgacctagctatcatatctgtatca

SEQ ID NO: 346955 - DNA, 25 bp, Homo sapien
tgccggctgacctcacctgctggtt

SEQ ID NO: 346956 - DNA, 25 bp, Homo sapien
agtgcgcgcccacgaaaccggcaaa

SEQ ID NO: 346957 - DNA, 25 bp, Homo sapien
gaaaccggcaaaatgtcccaactgc

SEQ ID NO: 346958 - DNA, 25 bp, Homo sapien
aaatgtcccaactgcagtatctctc

SEQ ID NO: 346959 - DNA, 25 bp, Homo sapien
atatgcagttttttgagcccacgaa

SEQ ID NO: 346960 - DNA, 25 bp, Homo sapien
gcagttttttgagcccacgaatagt

SEQ ID NO: 346961 - DNA, 25 bp, Homo sapien
tgagcccacgaatagttgtcatttc

SEQ ID NO: 346962 - DNA, 25 bp, Homo sapien
atgtgcctgttagtaaaaagtagta

SEQ ID NO: 346963 - DNA, 25 bp, Homo sapien
aagtagtattgtgtatttgctcagt

SEQ ID NO: 346964 - DNA, 25 bp, Homo sapien
ttgtgtatttgctcagtatctgaac

SEQ ID NO: 346965 - DNA, 25 bp, Homo sapien
cagtatctgaactataagcccattt

SEQ ID NO: 346966 - DNA, 25 bp, Homo sapien
aagcccatttatactgttccataca

SEQ ID NO: 346967 - DNA, 25 bp, Homo sapien
actgttccatacaaaagctattttt

SEQ ID NO: 346968 - DNA, 25 bp, Homo sapien
cctcacccaggctaaacttgatact

SEQ ID NO: 346969 - DNA, 25 bp, Homo sapien
ccaggctaaacttgatactgtatta

SEQ ID NO: 346970 - DNA, 25 bp, Homo sapien
gatgagtacatccaattgttgacat

SEQ ID NO: 346971 - DNA, 25 bp, Homo sapien
gtacatccaattgttgacatagttt

SEQ ID NO: 346972 - DNA, 25 bp, Homo sapien
ttttgggtggagaaattttgctatt

SEQ ID NO: 346973 - DNA, 25 bp, Homo sapien
attttgctattatatcgacttctta

SEQ ID NO: 346974 - DNA, 25 bp, Homo sapien
cgacttcttaaaatagtctagtggg

SEQ ID NO: 346975 - DNA, 25 bp, Homo sapien
gtctagtgggattaacttggtttca

SEQ ID NO: 346976 - DNA, 25 bp, Homo sapien
gggattaacttggtttcaattcaca

SEQ ID NO: 346977 - DNA, 25 bp, Homo sapien
cttggtttcaattcacagagatctg

SEQ ID NO: 346978 - DNA, 25 bp, Homo sapien
ttcacagagatctggaagcgaggat

SEQ ID NO: 346979 - DNA, 25 bp, Homo sapien
atctggaagcgaggatcttttaaaa

SEQ ID NO: 346980 - DNA, 25 bp, Homo sapien
taagggtgacttgatgagtacatcc

SEQ ID NO: 346981 - DNA, 25 bp, Homo sapien
gtctaatatttgaaaagcgattgtt

SEQ ID NO: 346982 - DNA, 25 bp, Homo sapien
caggcttctatttgaaaacaggtat

SEQ ID NO: 346983 - DNA, 25 bp, Homo sapien
gagatgatatgatacaaccctatag

SEQ ID NO: 346984 - DNA, 25 bp, Homo sapien
gatacaaccctatagataatgtttt

SEQ ID NO: 346985 - DNA, 25 bp, Homo sapien
ataatgttttttgcttgattgactt

SEQ ID NO: 346986 - DNA, 25 bp, Homo sapien
gttttttgcttgattgacttatata

SEQ ID NO: 346987 - DNA, 25 bp, Homo sapien
cactgtttcatgattactgcttttg

SEQ ID NO: 346988 - DNA, 25 bp, Homo sapien
ctgtttcatgattactgcttttgga

SEQ ID NO: 346989 - DNA, 25 bp, Homo sapien
ggaagttttgtgaaatgctggcctt

SEQ ID NO: 346990 - DNA, 25 bp, Homo sapien
ttgtgaaatgctggccttgtgtata

SEQ ID NO: 346991 - DNA, 25 bp, Homo sapien
cttgtgtatatcttagaatgcaaat

SEQ ID NO: 346992 - DNA, 25 bp, Homo sapien
tatcgtagccccatcacagaagatg

SEQ ID NO: 346993 - DNA, 25 bp, Homo sapien
gtagccccatcacagaagatgcgac

SEQ ID NO: 346994 - DNA, 25 bp, Homo sapien
atcacagaagatgcgacatggaaaa

SEQ ID NO: 346995 - DNA, 25 bp, Homo sapien
actgtgtccaccctagttcttaaat

SEQ ID NO: 346996 - DNA, 25 bp, Homo sapien
tgtgtccaccctagttcttaaattt

SEQ ID NO: 346997 - DNA, 25 bp, Homo sapien
gttaagagtttttcaaatttgccag

SEQ ID NO: 346998 - DNA, 25 bp, Homo sapien
agagtttttcaaatttgccagattg

SEQ ID NO: 346999 - DNA, 25 bp, Homo sapien
gtatgatagcagtttctggataaac

SEQ ID NO: 347000 - DNA, 25 bp, Homo sapien
gataaacattacttgaggtcctaaa

SEQ ID NO: 347001 - DNA, 25 bp, Homo sapien
ttgtcagatgcctactttgctttca

SEQ ID NO: 347002 - DNA, 25 bp, Homo sapien
atgcctactttgctttcatttcatc

SEQ ID NO: 347003 - DNA, 25 bp, Homo sapien
gagtttctgtgtgcctgtgagagac

SEQ ID NO: 347004 - DNA, 25 bp, Homo sapien
ctgtgtgcctgtgagagactgtgtg

SEQ ID NO: 347005 - DNA, 25 bp, Homo sapien
tgatgaatgaacagggttgtgtatt

SEQ ID NO: 347006 - DNA, 25 bp, Homo sapien
gtgtgtgcgttagacaaatgaacag

SEQ ID NO: 347007 - DNA, 25 bp, Homo sapien
tgaacagtgttgtgtacctgtgtga

SEQ ID NO: 347008 - DNA, 25 bp, Homo sapien
gaatagtcactgtgactccaggctc

SEQ ID NO: 347009 - DNA, 25 bp, Homo sapien
caggctctaggctctgcagattcct

SEQ ID NO: 347010 - DNA, 25 bp, Homo sapien
tctaggctctgcagattcctcagcc

SEQ ID NO: 347011 - DNA, 25 bp, Homo sapien
ctatcgcctcacagacacttgggat

SEQ ID NO: 347012 - DNA, 25 bp, Homo sapien
acagacacttgggatgtagcagaca

SEQ ID NO: 347013 - DNA, 25 bp, Homo sapien
cttgggatgtagcagacaggtcaaa

SEQ ID NO: 347014 - DNA, 25 bp, Homo sapien
tgcatttgcggtgctttgccctccc

SEQ ID NO: 347015 - DNA, 25 bp, Homo sapien
agtgaggggccaagggatctcctca

SEQ ID NO: 347016 - DNA, 25 bp, Homo sapien
aagggatctcctcaatcctgtctcc

SEQ ID NO: 347017 - DNA, 25 bp, Homo sapien
tgtctccccagcggctctgtttcct

SEQ ID NO: 347018 - DNA, 25 bp, Homo sapien
ctctgtcctttgctgacttcctctt

SEQ ID NO: 347019 - DNA, 25 bp, Homo sapien
tctgtcctttgctgacttcctcttc

SEQ ID NO: 347020 - DNA, 25 bp, Homo sapien
ttcctcttccttacccagcagaact

SEQ ID NO: 347021 - DNA, 25 bp, Homo sapien
ctcttccttacccagcagaactcac

SEQ ID NO: 347022 - DNA, 25 bp, Homo sapien
tggggaggggcctatccactgctct

SEQ ID NO: 347023 - DNA, 25 bp, Homo sapien
agtccttggcagctggcctaggtgg

SEQ ID NO: 347024 - DNA, 25 bp, Homo sapien
gcctaggtgggcagactataggagg

SEQ ID NO: 347025 - DNA, 25 bp, Homo sapien
tatgataaaatggagaacttctttt

SEQ ID NO: 347026 - DNA, 25 bp, Homo sapien
aaggtagtaatcacctgtggtccca

SEQ ID NO: 347027 - DNA, 25 bp, Homo sapien
aatgacctatgattgtgcctgggca

SEQ ID NO: 347028 - DNA, 25 bp, Homo sapien
agaaaaagtgtgatagtcttggttt

SEQ ID NO: 347029 - DNA, 25 bp, Homo sapien
gatagtcttggtttgtatttcctca

SEQ ID NO: 347030 - DNA, 25 bp, Homo sapien
gtatttcctcatcattaaatatttg

SEQ ID NO: 347031 - DNA, 25 bp, Homo sapien
aagttattgtgagcactttcacagg

SEQ ID NO: 347032 - DNA, 25 bp, Homo sapien
attgtgagcactttcacaggtcctc

SEQ ID NO: 347033 - DNA, 25 bp, Homo sapien
gtgagcactttcacaggtcctccct

SEQ ID NO: 347034 - DNA, 25 bp, Homo sapien
tttcacaggtcctccctcaggctgt

SEQ ID NO: 347035 - DNA, 25 bp, Homo sapien
cacaggtcctccctcaggctgtggg

SEQ ID NO: 347036 - DNA, 25 bp, Homo sapien
tggtatgatagcagtttctggataa

SEQ ID NO: 347037 - DNA, 25 bp, Homo sapien
gtatgatagcagtttctggataaac

SEQ ID NO: 347038 - DNA, 25 bp, Homo sapien
gatagcagtttctggataaacatta

SEQ ID NO: 347039 - DNA, 25 bp, Homo sapien
gcagtttctggataaacattacttg

SEQ ID NO: 347040 - DNA, 25 bp, Homo sapien
ttctggataaacattacttgaggtc

SEQ ID NO: 347041 - DNA, 25 bp, Homo sapien
gataaacattacttgaggtcctaaa

SEQ ID NO: 347042 - DNA, 25 bp, Homo sapien
taaacattacttgaggtcctaaaat

SEQ ID NO: 347043 - DNA, 25 bp, Homo sapien
cattacttgaggtcctaaaatgcag

SEQ ID NO: 347044 - DNA, 25 bp, Homo sapien
ttacttgaggtcctaaaatgcagaa

SEQ ID NO: 347045 - DNA, 25 bp, Homo sapien
acttgaggtcctaaaatgcagaagg

SEQ ID NO: 347046 - DNA, 25 bp, Homo sapien
gaggtcctaaaatgcagaagggaaa

SEQ ID NO: 347047 - DNA, 25 bp, Homo sapien
gaagcaaatctcctttcgtacattc

SEQ ID NO: 347048 - DNA, 25 bp, Homo sapien
tcgtacattcacattcacaggctgc

SEQ ID NO: 347049 - DNA, 25 bp, Homo sapien
gaagggcttgcttagttggaccctt

SEQ ID NO: 347050 - DNA, 25 bp, Homo sapien
agaagttttgcagttcactttcctg

SEQ ID NO: 347051 - DNA, 25 bp, Homo sapien
gttcactttcctgggctagtggaaa

SEQ ID NO: 347052 - DNA, 25 bp, Homo sapien
agatagttaggcctcggaacccaga

SEQ ID NO: 347053 - DNA, 25 bp, Homo sapien
taggcctcggaacccagaattcact

SEQ ID NO: 347054 - DNA, 25 bp, Homo sapien
actcttgcccctgacatggaattgg

SEQ ID NO: 347055 - DNA, 25 bp, Homo sapien
gccttggcctgggagaaatttcaag

SEQ ID NO: 347056 - DNA, 25 bp, Homo sapien
aaatttcaagccaggtcagagggaa

SEQ ID NO: 347057 - DNA, 25 bp, Homo sapien
aaggactgcaccaggacaggctgtt

SEQ ID NO: 347058 - DNA, 25 bp, Homo sapien
gctgtaaaattgactttcctttcct

SEQ ID NO: 347059 - DNA, 25 bp, Homo sapien
tcctttccttccatcttaagagatt

SEQ ID NO: 347060 - DNA, 25 bp, Homo sapien
aagagattctgcttcatttcaaaag

SEQ ID NO: 347061 - DNA, 25 bp, Homo sapien
aggattagaaataccagccattgtc

SEQ ID NO: 347062 - DNA, 25 bp, Homo sapien
gaaataccagccattgtcctgtctt

SEQ ID NO: 347063 - DNA, 25 bp, Homo sapien
cagccattgtcctgtcttgataagg

SEQ ID NO: 347064 - DNA, 25 bp, Homo sapien
ggacagactgaaggacacgttacgt

SEQ ID NO: 347065 - DNA, 25 bp, Homo sapien
tgaacaaggctctcaggatgcctat

SEQ ID NO: 347066 - DNA, 25 bp, Homo sapien
ggctctcaggatgcctataagatgt

SEQ ID NO: 347067 - DNA, 25 bp, Homo sapien
agatgtgcaaggaatgaccatttca

SEQ ID NO: 347068 - DNA, 25 bp, Homo sapien
ctttcctacctctggctgtaaaatt

SEQ ID NO: 347069 - DNA, 25 bp, Homo sapien
tggctatgtggtatcatccccatga

SEQ ID NO: 347070 - DNA, 25 bp, Homo sapien
tcatccccatgatctatgccgttga

SEQ ID NO: 347071 - DNA, 25 bp, Homo sapien
atgccgttgatcttctttagagcca

SEQ ID NO: 347072 - DNA, 25 bp, Homo sapien
tgatcttctttagagccatgccagg

SEQ ID NO: 347073 - DNA, 25 bp, Homo sapien
gccaggcactttacgttgagacttc

SEQ ID NO: 347074 - DNA, 25 bp, Homo sapien
gagacttcaccatctagttggagga

SEQ ID NO: 347075 - DNA, 25 bp, Homo sapien
ggaggaatccctatcttcagatctt

SEQ ID NO: 347076 - DNA, 25 bp, Homo sapien
agataatccttgaatctggccacct

SEQ ID NO: 347077 - DNA, 25 bp, Homo sapien
tctggccacctcacttgacaggtga

SEQ ID NO: 347078 - DNA, 25 bp, Homo sapien
ggtggagccagagattacaagactt

SEQ ID NO: 347079 - DNA, 25 bp, Homo sapien
ttacaagacttgctcaagctcacaa

SEQ ID NO: 347080 - DNA, 25 bp, Homo sapien
agcactgctgcactacctttttgga

SEQ ID NO: 347081 - DNA, 25 bp, Homo sapien
aatgctgatttctgaggagactccc

SEQ ID NO: 347082 - DNA, 25 bp, Homo sapien
tgaggagactccctttgacagctct

SEQ ID NO: 347083 - DNA, 25 bp, Homo sapien
tttgacagctcttgactggtgccct

SEQ ID NO: 347084 - DNA, 25 bp, Homo sapien
ttgactggtgcccttcaagcagtat

SEQ ID NO: 347085 - DNA, 25 bp, Homo sapien
caagcagtatgggagccagctaaca

SEQ ID NO: 347086 - DNA, 25 bp, Homo sapien
aacagtgtggaggtcactggcacca

SEQ ID NO: 347087 - DNA, 25 bp, Homo sapien
actggcaccaagctgttctgatgag

SEQ ID NO: 347088 - DNA, 25 bp, Homo sapien
gaaaattttcttctgtccatttcag

SEQ ID NO: 347089 - DNA, 25 bp, Homo sapien
aaggccctgtaaagcgtcgtcttca

SEQ ID NO: 347090 - DNA, 25 bp, Homo sapien
cacattcactgctgctcggaaacag

SEQ ID NO: 347091 - DNA, 25 bp, Homo sapien
aatgagtcatatttgcactgcacaa

SEQ ID NO: 347092 - DNA, 25 bp, Homo sapien
catcttttccttttgtacccctcat

SEQ ID NO: 347093 - DNA, 25 bp, Homo sapien
ttcctcagattacacacacgtgcac

SEQ ID NO: 347094 - DNA, 25 bp, Homo sapien
gtacccctcatcactgcgaatttga

SEQ ID NO: 347095 - DNA, 25 bp, Homo sapien
cactgcgaatttgatagaaccctta

SEQ ID NO: 347096 - DNA, 25 bp, Homo sapien
gatagaacccttagtaaatgaccag

SEQ ID NO: 347097 - DNA, 25 bp, Homo sapien
ttttttctctcccacaacgtaacat

SEQ ID NO: 347098 - DNA, 25 bp, Homo sapien
ctctcccacaacgtaacatgggttt

SEQ ID NO: 347099 - DNA, 25 bp, Homo sapien
acgtgcacacgtgtttatatcaggt

SEQ ID NO: 347100 - DNA, 25 bp, Homo sapien
acacgtgtttatatcaggtgctgaa

SEQ ID NO: 347101 - DNA, 25 bp, Homo sapien
ttagatatttaccaggaattctttc

SEQ ID NO: 347102 - DNA, 25 bp, Homo sapien
gctattttcacatcaagtttatgct

SEQ ID NO: 347103 - DNA, 25 bp, Homo sapien
gtgataaaatccaggcagctaccaa

SEQ ID NO: 347104 - DNA, 25 bp, Homo sapien
gcagctaccaaaaggagagctccca

SEQ ID NO: 347105 - DNA, 25 bp, Homo sapien
gagctcccaagtgatcttactactg

SEQ ID NO: 347106 - DNA, 25 bp, Homo sapien
gtgatcttactactgggtttccgta

SEQ ID NO: 347107 - DNA, 25 bp, Homo sapien
gggtttccgtagtacagacattcag

SEQ ID NO: 347108 - DNA, 25 bp, Homo sapien
ccgtagtacagacattcaggatcct

SEQ ID NO: 347109 - DNA, 25 bp, Homo sapien
attcaggatcctggacccgctgaag

SEQ ID NO: 347110 - DNA, 25 bp, Homo sapien
gcgccgtgatggttaagtgtgtcca

SEQ ID NO: 347111 - DNA, 25 bp, Homo sapien
tggttggtttgtttgactgcctcaa

SEQ ID NO: 347112 - DNA, 25 bp, Homo sapien
ttgactgcctcaaatcctcggtggt

SEQ ID NO: 347113 - DNA, 25 bp, Homo sapien
gagggtctcccttcattcatgtcac

SEQ ID NO: 347114 - DNA, 25 bp, Homo sapien
gtgacaattcatagtactttctctg

SEQ ID NO: 347115 - DNA, 25 bp, Homo sapien
gttttttactccacttagaatctgt

SEQ ID NO: 347116 - DNA, 25 bp, Homo sapien
tatttaaccttctcttggcctctct

SEQ ID NO: 347117 - DNA, 25 bp, Homo sapien
ctcttggcctctctttataccaaat

SEQ ID NO: 347118 - DNA, 25 bp, Homo sapien
catagtactttctctgctacacagc

SEQ ID NO: 347119 - DNA, 25 bp, Homo sapien
tgctacacagcaagatgatacatgt

SEQ ID NO: 347120 - DNA, 25 bp, Homo sapien
aagatgatacatgtgcactgtgcat

SEQ ID NO: 347121 - DNA, 25 bp, Homo sapien
gtgcactgtgcatgaacaagggaca

SEQ ID NO: 347122 - DNA, 25 bp, Homo sapien
ggacagaaggcagcattccccttta

SEQ ID NO: 347123 - DNA, 25 bp, Homo sapien
gaaggcagcattcccctttaggaca

SEQ ID NO: 347124 - DNA, 25 bp, Homo sapien
gcaagtctctccaagtactatggaa

SEQ ID NO: 347125 - DNA, 25 bp, Homo sapien
aagtctctccaagtactatggaaac

SEQ ID NO: 347126 - DNA, 25 bp, Homo sapien
gtctctccaagtactatggaaacaa

SEQ ID NO: 347127 - DNA, 25 bp, Homo sapien
aggtctgagtagtccaagggacacg

SEQ ID NO: 347128 - DNA, 25 bp, Homo sapien
tctgagtagtccaagggacacggga

SEQ ID NO: 347129 - DNA, 25 bp, Homo sapien
gacacgggaggccagttgggaagac

SEQ ID NO: 347130 - DNA, 25 bp, Homo sapien
gaggccagttgggaagaccgcccgg

SEQ ID NO: 347131 - DNA, 25 bp, Homo sapien
accgcccgggcgagaccaggaagat

SEQ ID NO: 347132 - DNA, 25 bp, Homo sapien
cgcccgggcgagaccaggaagatca

SEQ ID NO: 347133 - DNA, 25 bp, Homo sapien
aattgatttccaaggcttgagtgtg

SEQ ID NO: 347134 - DNA, 25 bp, Homo sapien
attgatttccaaggcttgagtgtga

SEQ ID NO: 347135 - DNA, 25 bp, Homo sapien
aagtcagagagtattccatggccct

SEQ ID NO: 347136 - DNA, 25 bp, Homo sapien
cctgcatcagggaacttgggtttat

SEQ ID NO: 347137 - DNA, 25 bp, Homo sapien
ttgggtttatccttcatgttctcac

SEQ ID NO: 347138 - DNA, 25 bp, Homo sapien
catgttctcaccaactcttgtatta

SEQ ID NO: 347139 - DNA, 25 bp, Homo sapien
caccaactcttgtattagctttttt

SEQ ID NO: 347140 - DNA, 25 bp, Homo sapien
ttggcaacaagtaatatctcattct

SEQ ID NO: 347141 - DNA, 25 bp, Homo sapien
tgccactataaacaactcttctact

SEQ ID NO: 347142 - DNA, 25 bp, Homo sapien
gattcaggagtctttcacatggata

SEQ ID NO: 347143 - DNA, 25 bp, Homo sapien
gaagttgaccaaacatctctttagg

SEQ ID NO: 347144 - DNA, 25 bp, Homo sapien
tctttaggatcaattccctgggtta

SEQ ID NO: 347145 - DNA, 25 bp, Homo sapien
tccctgggttaggatttacaagtca

SEQ ID NO: 347146 - DNA, 25 bp, Homo sapien
tatgataaaatggagaacttctttt

SEQ ID NO: 347147 - DNA, 25 bp, Homo sapien
gaaggtagtaatcacctgtggtccc

SEQ ID NO: 347148 - DNA, 25 bp, Homo sapien
aaggtagtaatcacctgtggtccca

SEQ ID NO: 347149 - DNA, 25 bp, Homo sapien
agaaaaagtgtgatagtcttggttt

SEQ ID NO: 347150 - DNA, 25 bp, Homo sapien
gtatttcctcatcattaaatatttg

SEQ ID NO: 347151 - DNA, 25 bp, Homo sapien
aagttattgtgagcactttcacagg

SEQ ID NO: 347152 - DNA, 25 bp, Homo sapien
tattgtgagcactttcacaggtcct

SEQ ID NO: 347153 - DNA, 25 bp, Homo sapien
ttgtgagcactttcacaggtcctcc

SEQ ID NO: 347154 - DNA, 25 bp, Homo sapien
gtgagcactttcacaggtcctccct

SEQ ID NO: 347155 - DNA, 25 bp, Homo sapien
tttcacaggtcctccctcaggctgt

SEQ ID NO: 347156 - DNA, 25 bp, Homo sapien
cacaggtcctccctcaggctgtggg

SEQ ID NO: 347157 - DNA, 25 bp, Homo sapien
caaagggttgaggactctctaagta

SEQ ID NO: 347158 - DNA, 25 bp, Homo sapien
ggttgaggactctctaagtagctga

SEQ ID NO: 347159 - DNA, 25 bp, Homo sapien
tgaggactctctaagtagctgaaat

SEQ ID NO: 347160 - DNA, 25 bp, Homo sapien
ggactctctaagtagctgaaatttt

SEQ ID NO: 347161 - DNA, 25 bp, Homo sapien
ctctctaagtagctgaaattttaag

SEQ ID NO: 347162 - DNA, 25 bp, Homo sapien
atggattggaattactgttccttcc

SEQ ID NO: 347163 - DNA, 25 bp, Homo sapien
aattactgttccttccaaatgtaca

SEQ ID NO: 347164 - DNA, 25 bp, Homo sapien
ttactgttccttccaaatgtacaag

SEQ ID NO: 347165 - DNA, 25 bp, Homo sapien
ggttcccaaatgcaggtaagcacca

SEQ ID NO: 347166 - DNA, 25 bp, Homo sapien
aaatgcaggtaagcaccaaagggtt

SEQ ID NO: 347167 - DNA, 25 bp, Homo sapien
gcaccaaagggttgaggactctcta

SEQ ID NO: 347168 - DNA, 25 bp, Homo sapien
ttcatgtcagttcaggcctaaaatc

SEQ ID NO: 347169 - DNA, 25 bp, Homo sapien
tataggctggtcacaattaacaatg

SEQ ID NO: 347170 - DNA, 25 bp, Homo sapien
tggcagcacttcttggatggatacc

SEQ ID NO: 347171 - DNA, 25 bp, Homo sapien
cagcacttcttggatggataccttt

SEQ ID NO: 347172 - DNA, 25 bp, Homo sapien
ggtggttttgtatgggctcctgttt

SEQ ID NO: 347173 - DNA, 25 bp, Homo sapien
aatagcagagtcagttgctgaggac

SEQ ID NO: 347174 - DNA, 25 bp, Homo sapien
gttgctgaggacaatgaccttcctt

SEQ ID NO: 347175 - DNA, 25 bp, Homo sapien
tgaccttccttataacatttagttt

SEQ ID NO: 347176 - DNA, 25 bp, Homo sapien
catttagtttcatacccatattagg

SEQ ID NO: 347177 - DNA, 25 bp, Homo sapien
catacccatattaggtcttgtcttg

SEQ ID NO: 347178 - DNA, 25 bp, Homo sapien
gtcttgtcttgaggaccctttatat

SEQ ID NO: 347179 - DNA, 25 bp, Homo sapien
aagagcccctcagtggagtcaagga

SEQ ID NO: 347180 - DNA, 25 bp, Homo sapien
caagtgtccatgagtaccagtatac

SEQ ID NO: 347181 - DNA, 25 bp, Homo sapien
gagatgagggtttgggccctcacca

SEQ ID NO: 347182 - DNA, 25 bp, Homo sapien
gtttgggccctcaccacagttctga

SEQ ID NO: 347183 - DNA, 25 bp, Homo sapien
ccccagtgagtttctgaacccaagt

SEQ ID NO: 347184 - DNA, 25 bp, Homo sapien
gagcatctgaacatgcacaggactg

SEQ ID NO: 347185 - DNA, 25 bp, Homo sapien
tgagtaccagtataccctccggtgt

SEQ ID NO: 347186 - DNA, 25 bp, Homo sapien
atttccagacctacagctttactac

SEQ ID NO: 347187 - DNA, 25 bp, Homo sapien
gctttactactccatgttctgacat

SEQ ID NO: 347188 - DNA, 25 bp, Homo sapien
tctgacattggatctagaagcatct

SEQ ID NO: 347189 - DNA, 25 bp, Homo sapien
agcacatcttcactggaagccaact

SEQ ID NO: 347190 - DNA, 25 bp, Homo sapien
tcatagatcagaatccagcctcctt

SEQ ID NO: 347191 - DNA, 25 bp, Homo sapien
agaatccagcctccttgaaaaagta

SEQ ID NO: 347192 - DNA, 25 bp, Homo sapien
aaggcctaggtagtaacttgctcaa

SEQ ID NO: 347193 - DNA, 25 bp, Homo sapien
taacttgctcaacattacactgcca

SEQ ID NO: 347194 - DNA, 25 bp, Homo sapien
tacactgccagtttttgatagaatt

SEQ ID NO: 347195 - DNA, 25 bp, Homo sapien
tagaattgagactaacacccgaatc

SEQ ID NO: 347196 - DNA, 25 bp, Homo sapien
taacacccgaatctcttcattctaa

SEQ ID NO: 347197 - DNA, 25 bp, Homo sapien
ttcattctaacaatgctttgtagct

SEQ ID NO: 347198 - DNA, 25 bp, Homo sapien
gtagcttctaaatgatcccacacgg

SEQ ID NO: 347199 - DNA, 25 bp, Homo sapien
atcttttctgaactcacagcatttg

SEQ ID NO: 347200 - DNA, 25 bp, Homo sapien
atgtaccatgttaggaattattttt

SEQ ID NO: 347201 - DNA, 25 bp, Homo sapien
agtgtttctagatatgcgtgtttca

SEQ ID NO: 347202 - DNA, 25 bp, Homo sapien
atgcgtgtttcatatagtgtttcat

SEQ ID NO: 347203 - DNA, 25 bp, Homo sapien
tatagtgtttcatagcgaggctggt

SEQ ID NO: 347204 - DNA, 25 bp, Homo sapien
gagcctgccttacaggagttggaaa

SEQ ID NO: 347205 - DNA, 25 bp, Homo sapien
ctctgtgcccacgagatgatttata

SEQ ID NO: 347206 - DNA, 25 bp, Homo sapien
gttatcatgaccaggttgtctccag

SEQ ID NO: 347207 - DNA, 25 bp, Homo sapien
agtgggcatctgagcgctcagcgat

SEQ ID NO: 347208 - DNA, 25 bp, Homo sapien
gcgctcagcgatggagaaacctcct

SEQ ID NO: 347209 - DNA, 25 bp, Homo sapien
gatggagaaacctccttctgcctgt

SEQ ID NO: 347210 - DNA, 25 bp, Homo sapien
tctgcctgtctcttctgagaagtca

SEQ ID NO: 347211 - DNA, 25 bp, Homo sapien
aaggtatgaccatgcctgagcctga

SEQ ID NO: 347212 - DNA, 25 bp, Homo sapien
tttcttccccgactgaaagatggct

SEQ ID NO: 347213 - DNA, 25 bp, Homo sapien
gaaagatggctttgtccgttgagtt

SEQ ID NO: 347214 - DNA, 25 bp, Homo sapien
agatggctttgtccgttgagttgaa

SEQ ID NO: 347215 - DNA, 25 bp, Homo sapien
gctttgtccgttgagttgaaaacta

SEQ ID NO: 347216 - DNA, 25 bp, Homo sapien
taagtcctgccttcctcacttttca

SEQ ID NO: 347217 - DNA, 25 bp, Homo sapien
tcacttttcatcacgtggcttctgt

SEQ ID NO: 347218 - DNA, 25 bp, Homo sapien
tcatcacgtggcttctgtttttgaa

SEQ ID NO: 347219 - DNA, 25 bp, Homo sapien
cgtggcttctgtttttgaattcctt

SEQ ID NO: 347220 - DNA, 25 bp, Homo sapien
atgtgggaatttcaagccagcagct

SEQ ID NO: 347221 - DNA, 25 bp, Homo sapien
atgggaactgaaaggacatagcaca

SEQ ID NO: 347222 - DNA, 25 bp, Homo sapien
aaaggacatagcacagtaagactgg

SEQ ID NO: 347223 - DNA, 25 bp, Homo sapien
tcaaatcaaacccctcttagtggtc

SEQ ID NO: 347224 - DNA, 25 bp, Homo sapien
acagctttttatgtaactgcctcag

SEQ ID NO: 347225 - DNA, 25 bp, Homo sapien
actgcctcagttttcttagggtaat

SEQ ID NO: 347226 - DNA, 25 bp, Homo sapien
gaaaatcagagatgccaaggataga

SEQ ID NO: 347227 - DNA, 25 bp, Homo sapien
tagagtggttgagagaggcccatat

SEQ ID NO: 347228 - DNA, 25 bp, Homo sapien
gaggcccatattgaaataggcacac

SEQ ID NO: 347229 - DNA, 25 bp, Homo sapien
ataggcacacgattgtcaccatttc

SEQ ID NO: 347230 - DNA, 25 bp, Homo sapien
acgattgtcaccatttctcacttta

SEQ ID NO: 347231 - DNA, 25 bp, Homo sapien
tcaccatttctcactttacaagctg

SEQ ID NO: 347232 - DNA, 25 bp, Homo sapien
tcttagtggtcctcctgtttttaat

SEQ ID NO: 347233 - DNA, 25 bp, Homo sapien
attctcgatgtcaacagtatgagca

SEQ ID NO: 347234 - DNA, 25 bp, Homo sapien
acacaggaagaaagtagacttctaa

SEQ ID NO: 347235 - DNA, 25 bp, Homo sapien
caggaagaaagtagacttctaagaa

SEQ ID NO: 347236 - DNA, 25 bp, Homo sapien
ggaagaaagtagacttctaagaaga

SEQ ID NO: 347237 - DNA, 25 bp, Homo sapien
gaaagtagacttctaagaagagtct

SEQ ID NO: 347238 - DNA, 25 bp, Homo sapien
aagtagacttctaagaagagtctga

SEQ ID NO: 347239 - DNA, 25 bp, Homo sapien
agtagacttctaagaagagtctgaa

SEQ ID NO: 347240 - DNA, 25 bp, Homo sapien
gtagacttctaagaagagtctgaat

SEQ ID NO: 347241 - DNA, 25 bp, Homo sapien
acttctaagaagagtctgaataagc

SEQ ID NO: 347242 - DNA, 25 bp, Homo sapien
cttctaagaagagtctgaataagcc

SEQ ID NO: 347243 - DNA, 25 bp, Homo sapien
attgcattggccaaatctcgacaat

SEQ ID NO: 347244 - DNA, 25 bp, Homo sapien
ttgcattggccaaatctcgacaatt

SEQ ID NO: 347245 - DNA, 25 bp, Homo sapien
gataggattattattgacacacaag

SEQ ID NO: 347246 - DNA, 25 bp, Homo sapien
ttattgacacacaaggagctccaaa

SEQ ID NO: 347247 - DNA, 25 bp, Homo sapien
ggagctccaaaagagatcgtatttt

SEQ ID NO: 347248 - DNA, 25 bp, Homo sapien
tttttattagagacaagccagttgg

SEQ ID NO: 347249 - DNA, 25 bp, Homo sapien
agagacaagccagttgggattgaaa

SEQ ID NO: 347250 - DNA, 25 bp, Homo sapien
gggtatagccctgtgtatgttgcac

SEQ ID NO: 347251 - DNA, 25 bp, Homo sapien
tagccctgtgtatgttgcacagaaa

SEQ ID NO: 347252 - DNA, 25 bp, Homo sapien
tatctgaatgataaaggcctaagtg

SEQ ID NO: 347253 - DNA, 25 bp, Homo sapien
aaggcctaagtgataactctggaca

SEQ ID NO: 347254 - DNA, 25 bp, Homo sapien
aactctggacaagggatttggattt

SEQ ID NO: 347255 - DNA, 25 bp, Homo sapien
cagaggtagaggcatttttgtgatt

SEQ ID NO: 347256 - DNA, 25 bp, Homo sapien
cctatacgttttagttcaggtctag

SEQ ID NO: 347257 - DNA, 25 bp, Homo sapien
aagttagcagagttattttggccct

SEQ ID NO: 347258 - DNA, 25 bp, Homo sapien
cagagttattttggccctgagaggc

SEQ ID NO: 347259 - DNA, 25 bp, Homo sapien
attttggccctgagaggctgtgatt

SEQ ID NO: 347260 - DNA, 25 bp, Homo sapien
gatttggcttcaacttgaattccct

SEQ ID NO: 347261 - DNA, 25 bp, Homo sapien
gcttcaacttgaattccctatgtaa

SEQ ID NO: 347262 - DNA, 25 bp, Homo sapien
aattgcagggaattcaagggactct

SEQ ID NO: 347263 - DNA, 25 bp, Homo sapien
caagggactctgaattcaattcagg

SEQ ID NO: 347264 - DNA, 25 bp, Homo sapien
tctttgcctttgagctagttttccc

SEQ ID NO: 347265 - DNA, 25 bp, Homo sapien
ccctaggcttttcttagcctgcaaa

SEQ ID NO: 347266 - DNA, 25 bp, Homo sapien
aggcttttcttagcctgcaaaaatc

SEQ ID NO: 347267 - DNA, 25 bp, Homo sapien
tgttgcttatgaggaaggttcagcc

SEQ ID NO: 347268 - DNA, 25 bp, Homo sapien
ttatccagcacagccttcacgtttt

SEQ ID NO: 347269 - DNA, 25 bp, Homo sapien
agaaacttccaaacgcagtgccctg

SEQ ID NO: 347270 - DNA, 25 bp, Homo sapien
agtgccctgttctgccggtgtgtac

SEQ ID NO: 347271 - DNA, 25 bp, Homo sapien
gttctgccggtgtgtacagcctcag

SEQ ID NO: 347272 - DNA, 25 bp, Homo sapien
tgtacagcctcagcgcaccaggaga

SEQ ID NO: 347273 - DNA, 25 bp, Homo sapien
agaccctagagtggtttccatctca

SEQ ID NO: 347274 - DNA, 25 bp, Homo sapien
caggcagccaggtcatctgagtatc

SEQ ID NO: 347275 - DNA, 25 bp, Homo sapien
gccaggtcatctgagtatcattaag

SEQ ID NO: 347276 - DNA, 25 bp, Homo sapien
ggaagattacagtctgagggccaaa

SEQ ID NO: 347277 - DNA, 25 bp, Homo sapien
gtctgagggccaaacgtgcctgctt

SEQ ID NO: 347278 - DNA, 25 bp, Homo sapien
gactgcaaaattcacctgttcaaaa

SEQ ID NO: 347279 - DNA, 25 bp, Homo sapien
gacatgtaatttcttacaaacccca

SEQ ID NO: 347280 - DNA, 25 bp, Homo sapien
gtagttttctgcagggcgatgacat

SEQ ID NO: 347281 - DNA, 25 bp, Homo sapien
gggcgatgacatatcctgcagcgaa

SEQ ID NO: 347282 - DNA, 25 bp, Homo sapien
ctgcagcgaagtctcagaaaccctg

SEQ ID NO: 347283 - DNA, 25 bp, Homo sapien
gaagtctcagaaaccctgctctggg

SEQ ID NO: 347284 - DNA, 25 bp, Homo sapien
tgctctgggcagtccatctatttgt

SEQ ID NO: 347285 - DNA, 25 bp, Homo sapien
atctatttgtccactcatgttctta

SEQ ID NO: 347286 - DNA, 25 bp, Homo sapien
tcatgttcttagacacatcccaggg

SEQ ID NO: 347287 - DNA, 25 bp, Homo sapien
tggccctgagctactgggatgactg

SEQ ID NO: 347288 - DNA, 25 bp, Homo sapien
gggagtgactcccacacagcaggta

SEQ ID NO: 347289 - DNA, 25 bp, Homo sapien
atgaaccagttcgaattgcctatga

SEQ ID NO: 347290 - DNA, 25 bp, Homo sapien
tgaaccagttcgaattgcctatgac

SEQ ID NO: 347291 - DNA, 25 bp, Homo sapien
aggacttggacttcgcccagcagaa

SEQ ID NO: 347292 - DNA, 25 bp, Homo sapien
ggacttggacttcgcccagcagaag

SEQ ID NO: 347293 - DNA, 25 bp, Homo sapien
gggaagggttgggtgctgacgggca

SEQ ID NO: 347294 - DNA, 25 bp, Homo sapien
tgctgacgggcaggagcacaaagaa

SEQ ID NO: 347295 - DNA, 25 bp, Homo sapien
ggcaggagcacaaagaagacacatt

SEQ ID NO: 347296 - DNA, 25 bp, Homo sapien
ggagcacaaagaagacacattcgat

SEQ ID NO: 347297 - DNA, 25 bp, Homo sapien
gaagacacattcgatgtgttccgac

SEQ ID NO: 347298 - DNA, 25 bp, Homo sapien
cacattcgatgtgttccgacagagg

SEQ ID NO: 347299 - DNA, 25 bp, Homo sapien
cattcgatgtgttccgacagaggat

SEQ ID NO: 347300 - DNA, 25 bp, Homo sapien
ggacgcaaggcgtttctgatgaagc

SEQ ID NO: 347301 - DNA, 25 bp, Homo sapien
gcgtttctgatgaagccgatacatt

SEQ ID NO: 347302 - DNA, 25 bp, Homo sapien
ataatgcccttttcaggctagtgaa

SEQ ID NO: 347303 - DNA, 25 bp, Homo sapien
gagactggattgagcttttgtttaa

SEQ ID NO: 347304 - DNA, 25 bp, Homo sapien
tttgtttaagatttcccacctgcgt

SEQ ID NO: 347305 - DNA, 25 bp, Homo sapien
ttaagatttcccacctgcgtaaaat

SEQ ID NO: 347306 - DNA, 25 bp, Homo sapien
tgcgtaaaattcctttcagcccata

SEQ ID NO: 347307 - DNA, 25 bp, Homo sapien
tcctttcagcccataggattcttga

SEQ ID NO: 347308 - DNA, 25 bp, Homo sapien
gtgggctctgccatagcaggcgcca

SEQ ID NO: 347309 - DNA, 25 bp, Homo sapien
tagcaggcgccataagctggaattt

SEQ ID NO: 347310 - DNA, 25 bp, Homo sapien
taagctggaatttgtgcctccaggc

SEQ ID NO: 347311 - DNA, 25 bp, Homo sapien
ggtgtgttcaaagatgtgcccattg

SEQ ID NO: 347312 - DNA, 25 bp, Homo sapien
agggcaacgctagactctcaggttc

SEQ ID NO: 347313 - DNA, 25 bp, Homo sapien
tagactctcaggttctgcggaagtt

SEQ ID NO: 347314 - DNA, 25 bp, Homo sapien
aggttctgcggaagttcgctctgct

SEQ ID NO: 347315 - DNA, 25 bp, Homo sapien
ctcccgtgactgaggatcggctgga

SEQ ID NO: 347316 - DNA, 25 bp, Homo sapien
tggacagaaggacttccacggcgct

SEQ ID NO: 347317 - DNA, 25 bp, Homo sapien
ccgccacagcccttgaggatgagct

SEQ ID NO: 347318 - DNA, 25 bp, Homo sapien
aggatgagctcaagcaccgttggct

SEQ ID NO: 347319 - DNA, 25 bp, Homo sapien
tcaagcaccgttggcttctggttgg

SEQ ID NO: 347320 - DNA, 25 bp, Homo sapien
ttttaacacttcaagcggcggtctg

SEQ ID NO: 347321 - DNA, 25 bp, Homo sapien
gcggtctgttggctttcaagctgaa

SEQ ID NO: 347322 - DNA, 25 bp, Homo sapien
atattaattctgtaatccttgacca

SEQ ID NO: 347323 - DNA, 25 bp, Homo sapien
tattaattctgtaatccttgaccag

SEQ ID NO: 347324 - DNA, 25 bp, Homo sapien
attaattctgtaatccttgaccagg

SEQ ID NO: 347325 - DNA, 25 bp, Homo sapien
ttaattctgtaatccttgaccaggc

SEQ ID NO: 347326 - DNA, 25 bp, Homo sapien
taattctgtaatccttgaccaggca

SEQ ID NO: 347327 - DNA, 25 bp, Homo sapien
aattctgtaatccttgaccaggcat

SEQ ID NO: 347328 - DNA, 25 bp, Homo sapien
attctgtaatccttgaccaggcatg

SEQ ID NO: 347329 - DNA, 25 bp, Homo sapien
ttctgtaatccttgaccaggcatgg

SEQ ID NO: 347330 - DNA, 25 bp, Homo sapien
tctgtaatccttgaccaggcatggt

SEQ ID NO: 347331 - DNA, 25 bp, Homo sapien
cttaaagcagctgtacagtactaga

SEQ ID NO: 347332 - DNA, 25 bp, Homo sapien
ctgtacagtactagagaaagcctcg

SEQ ID NO: 347333 - DNA, 25 bp, Homo sapien
actagagaaagcctcgatctgtcag

SEQ ID NO: 347334 - DNA, 25 bp, Homo sapien
gaaagcctcgatctgtcaggcacgt

SEQ ID NO: 347335 - DNA, 25 bp, Homo sapien
gcctcgatctgtcaggcacgtcagg

SEQ ID NO: 347336 - DNA, 25 bp, Homo sapien
acgtcaggcctgagtgcctccttgt

SEQ ID NO: 347337 - DNA, 25 bp, Homo sapien
ggcctgagtgcctccttgttgatga

SEQ ID NO: 347338 - DNA, 25 bp, Homo sapien
tgagtgcctccttgttgatgactgg

SEQ ID NO: 347339 - DNA, 25 bp, Homo sapien
agtgcctccttgttgatgactggcc

SEQ ID NO: 347340 - DNA, 25 bp, Homo sapien
cctccttgttgatgactggcccggt

SEQ ID NO: 347341 - DNA, 25 bp, Homo sapien
ttgttgatgactggcccggtccctt

SEQ ID NO: 347342 - DNA, 25 bp, Homo sapien
tatcgtagccccatcacagaagatg

SEQ ID NO: 347343 - DNA, 25 bp, Homo sapien
tcgtagccccatcacagaagatgcg

SEQ ID NO: 347344 - DNA, 25 bp, Homo sapien
gtagccccatcacagaagatgcgac

SEQ ID NO: 347345 - DNA, 25 bp, Homo sapien
gccccatcacagaagatgcgacatg

SEQ ID NO: 347346 - DNA, 25 bp, Homo sapien
atcacagaagatgcgacatggaaaa

SEQ ID NO: 347347 - DNA, 25 bp, Homo sapien
actgtgtccaccctagttcttaaat

SEQ ID NO: 347348 - DNA, 25 bp, Homo sapien
ctgtgtccaccctagttcttaaatt

SEQ ID NO: 347349 - DNA, 25 bp, Homo sapien
tgtgtccaccctagttcttaaattt

SEQ ID NO: 347350 - DNA, 25 bp, Homo sapien
ggtgtatgttaagagtttttcaaat

SEQ ID NO: 347351 - DNA, 25 bp, Homo sapien
gttaagagtttttcaaatttgccag

SEQ ID NO: 347352 - DNA, 25 bp, Homo sapien
agagtttttcaaatttgccagattg

SEQ ID NO: 347353 - DNA, 25 bp, Homo sapien
aaacggaacaggagattagctgaga

SEQ ID NO: 347354 - DNA, 25 bp, Homo sapien
ataacactgataggcctcagccaag

SEQ ID NO: 347355 - DNA, 25 bp, Homo sapien
taggcctcagccaagtctaatacag

SEQ ID NO: 347356 - DNA, 25 bp, Homo sapien
tcagccaagtctaatacagcatggg

SEQ ID NO: 347357 - DNA, 25 bp, Homo sapien
accaggagggccatgctagggcaat

SEQ ID NO: 347358 - DNA, 25 bp, Homo sapien
aaagaaacaattgtccatcccagga

SEQ ID NO: 347359 - DNA, 25 bp, Homo sapien
gaaaaacagccaggctttactgaga

SEQ ID NO: 347360 - DNA, 25 bp, Homo sapien
gccaggctttactgagaaagggaac

SEQ ID NO: 347361 - DNA, 25 bp, Homo sapien
aaagggaaccatcagccttagtaca

SEQ ID NO: 347362 - DNA, 25 bp, Homo sapien
atgctagggcaatcgtgacagtcaa

SEQ ID NO: 347363 - DNA, 25 bp, Homo sapien
ctgagcaagatggtggagagtcctt

SEQ ID NO: 347364 - DNA, 25 bp, Homo sapien
ggccccgtagcagcattggaggcca

SEQ ID NO: 347365 - DNA, 25 bp, Homo sapien
ccccgtagcagcattggaggccaga

SEQ ID NO: 347366 - DNA, 25 bp, Homo sapien
gtagcagcattggaggccagagccc

SEQ ID NO: 347367 - DNA, 25 bp, Homo sapien
gaggccagagcccaagccagttccg

SEQ ID NO: 347368 - DNA, 25 bp, Homo sapien
agagcccaagccagttccggagtca

SEQ ID NO: 347369 - DNA, 25 bp, Homo sapien
agttccggagtcacacccaacggcg

SEQ ID NO: 347370 - DNA, 25 bp, Homo sapien
ttccggagtcacacccaacggcgga

SEQ ID NO: 347371 - DNA, 25 bp, Homo sapien
ggcggagggagaacctacccatctc

SEQ ID NO: 347372 - DNA, 25 bp, Homo sapien
ggagggagaacctacccatctccca

SEQ ID NO: 347373 - DNA, 25 bp, Homo sapien
gggaggcatgctctgggcctctgga

SEQ ID NO: 347374 - DNA, 25 bp, Homo sapien
tgcaccctcggacttggcctggcca

SEQ ID NO: 347375 - DNA, 25 bp, Homo sapien
ctgcattgctgatagtaataggtaa

SEQ ID NO: 347376 - DNA, 25 bp, Homo sapien
tgtgtatctgccatgtgtaatggga

SEQ ID NO: 347377 - DNA, 25 bp, Homo sapien
ggtaatgttaaagcctttgtctttg

SEQ ID NO: 347378 - DNA, 25 bp, Homo sapien
gagtgatcctgtaaggtgtatacct

SEQ ID NO: 347379 - DNA, 25 bp, Homo sapien
aaggtgtatacctatcatatctaag

SEQ ID NO: 347380 - DNA, 25 bp, Homo sapien
ctatcatatctaaggcatacacaca

SEQ ID NO: 347381 - DNA, 25 bp, Homo sapien
tttttctccctgactctcttacgag

SEQ ID NO: 347382 - DNA, 25 bp, Homo sapien
tgactctcttacgagtgctcctaaa

SEQ ID NO: 347383 - DNA, 25 bp, Homo sapien
tgtaatgggatgtttctacagagta

SEQ ID NO: 347384 - DNA, 25 bp, Homo sapien
gctcctaaactcataagcatttctc

SEQ ID NO: 347385 - DNA, 25 bp, Homo sapien
gatagacctttcaaagtggctataa

SEQ ID NO: 347386 - DNA, 25 bp, Homo sapien
ttttgaataataagcaactctgtct

SEQ ID NO: 347387 - DNA, 25 bp, Homo sapien
ctttatataagtagccaagcattat

SEQ ID NO: 347388 - DNA, 25 bp, Homo sapien
atataagtagccaagcattattaat

SEQ ID NO: 347389 - DNA, 25 bp, Homo sapien
attcaagctatgtggacataaaagc

SEQ ID NO: 347390 - DNA, 25 bp, Homo sapien
gctatgtggacataaaagcagtcac

SEQ ID NO: 347391 - DNA, 25 bp, Homo sapien
ctatgtggacataaaagcagtcaca

SEQ ID NO: 347392 - DNA, 25 bp, Homo sapien
atgtggacataaaagcagtcacatt

SEQ ID NO: 347393 - DNA, 25 bp, Homo sapien
agttggtgctaataaacctaatcta

SEQ ID NO: 347394 - DNA, 25 bp, Homo sapien
gttggtgctaataaacctaatctac

SEQ ID NO: 347395 - DNA, 25 bp, Homo sapien
ttggtgctaataaacctaatctaca

SEQ ID NO: 347396 - DNA, 25 bp, Homo sapien
tggtgctaataaacctaatctacag

SEQ ID NO: 347397 - DNA, 25 bp, Homo sapien
tgggcttccagagtctgtggcaaca

SEQ ID NO: 347398 - DNA, 25 bp, Homo sapien
aagtgaggtgcttgctcagagactc

SEQ ID NO: 347399 - DNA, 25 bp, Homo sapien
ttgctcagagactcgccagctgtga

SEQ ID NO: 347400 - DNA, 25 bp, Homo sapien
agactcgccagctgtgactggccag

SEQ ID NO: 347401 - DNA, 25 bp, Homo sapien
gggtttgatcccagtcatttctgct

SEQ ID NO: 347402 - DNA, 25 bp, Homo sapien
tgatcccagtcatttctgctctgtg

SEQ ID NO: 347403 - DNA, 25 bp, Homo sapien
agaggtgagctcagtagaaccaaga

SEQ ID NO: 347404 - DNA, 25 bp, Homo sapien
gcagcaagggagcttccccaccaaa

SEQ ID NO: 347405 - DNA, 25 bp, Homo sapien
aagcaggagatctggctctcagcat

SEQ ID NO: 347406 - DNA, 25 bp, Homo sapien
tggctctcagcattcactttacttt

SEQ ID NO: 347407 - DNA, 25 bp, Homo sapien
ttcactttactttcctgtgtgacct

SEQ ID NO: 347408 - DNA, 25 bp, Homo sapien
gcattgaatggattagctggtacct

SEQ ID NO: 347409 - DNA, 25 bp, Homo sapien
ggcggcacatgagcctgtagagtca

SEQ ID NO: 347410 - DNA, 25 bp, Homo sapien
tagagtcagtccctttgcagccaag

SEQ ID NO: 347411 - DNA, 25 bp, Homo sapien
agacccacttgccaacattgaacat

SEQ ID NO: 347412 - DNA, 25 bp, Homo sapien
aacattgaacatgccgagcttggtg

SEQ ID NO: 347413 - DNA, 25 bp, Homo sapien
gagcttggtggcgatgaatcctaat

SEQ ID NO: 347414 - DNA, 25 bp, Homo sapien
gtacttactggctgtctaccgatgg

SEQ ID NO: 347415 - DNA, 25 bp, Homo sapien
tagatagttggtgactgccctgtgt

SEQ ID NO: 347416 - DNA, 25 bp, Homo sapien
gtctaccgatggctttcctttcatt

SEQ ID NO: 347417 - DNA, 25 bp, Homo sapien
attttttggttgacttctgtgagct

SEQ ID NO: 347418 - DNA, 25 bp, Homo sapien
gagctgtgagtcatcggtggtaaca

SEQ ID NO: 347419 - DNA, 25 bp, Homo sapien
gatactttgcaatgtgctttacaga

SEQ ID NO: 347420 - DNA, 25 bp, Homo sapien
aattgagtccagaattaagttcaga

SEQ ID NO: 347421 - DNA, 25 bp, Homo sapien
tgcttgcttttctttacataactgc

SEQ ID NO: 347422 - DNA, 25 bp, Homo sapien
tttgcccaaagccatagagttttca

SEQ ID NO: 347423 - DNA, 25 bp, Homo sapien
agccatagagttttcaagtcataaa

SEQ ID NO: 347424 - DNA, 25 bp, Homo sapien
gtcataaatttgatcttagaccttt

SEQ ID NO: 347425 - DNA, 25 bp, Homo sapien
gatcttagacctttctagttgccaa

SEQ ID NO: 347426 - DNA, 25 bp, Homo sapien
agacctttctagttgccaaggcctt

SEQ ID NO: 347427 - DNA, 25 bp, Homo sapien
acataactgcagttcagttggagga

SEQ ID NO: 347428 - DNA, 25 bp, Homo sapien
tatttacagagagtacctactatgt

SEQ ID NO: 347429 - DNA, 25 bp, Homo sapien
tactatgtgtcagatactttgcaat

SEQ ID NO: 347430 - DNA, 25 bp, Homo sapien
gacctggcactaagctatagcactt

SEQ ID NO: 347431 - DNA, 25 bp, Homo sapien
agcacttagcacctctgatcttgtt

SEQ ID NO: 347432 - DNA, 25 bp, Homo sapien
ttttgaataataagcaactctgtct

SEQ ID NO: 347433 - DNA, 25 bp, Homo sapien
ctttatataagtagccaagcattat

SEQ ID NO: 347434 - DNA, 25 bp, Homo sapien
aagcattattaattatccaccccat

SEQ ID NO: 347435 - DNA, 25 bp, Homo sapien
tatccaccccatatcactggtagat

SEQ ID NO: 347436 - DNA, 25 bp, Homo sapien
actggtagatacctgtattcaagct

SEQ ID NO: 347437 - DNA, 25 bp, Homo sapien
atacctgtattcaagctatgtggac

SEQ ID NO: 347438 - DNA, 25 bp, Homo sapien
gctatgtggacataaaagcagtcac

SEQ ID NO: 347439 - DNA, 25 bp, Homo sapien
agcagtcacattttagaagtcatga

SEQ ID NO: 347440 - DNA, 25 bp, Homo sapien
gttggtgctaataaacctaatctac

SEQ ID NO: 347441 - DNA, 25 bp, Homo sapien
acagaaaagttgctgctagatacac

SEQ ID NO: 347442 - DNA, 25 bp, Homo sapien
tacactaatttggtgcttcctgtgg

SEQ ID NO: 347443 - DNA, 25 bp, Homo sapien
cttcctgtggtagaggtgcttttcc

SEQ ID NO: 347444 - DNA, 25 bp, Homo sapien
ggtgcttttccctctgaaatagttt

SEQ ID NO: 347445 - DNA, 25 bp, Homo sapien
gtggtaggtcctgaaggattctcta

SEQ ID NO: 347446 - DNA, 25 bp, Homo sapien
gattctctagataaggatgggcatt

SEQ ID NO: 347447 - DNA, 25 bp, Homo sapien
ggaaaagggtctctcctgcattata

SEQ ID NO: 347448 - DNA, 25 bp, Homo sapien
tctcctgcattatagaggtggacaa

SEQ ID NO: 347449 - DNA, 25 bp, Homo sapien
gtggacaagaatataccgaaactat

SEQ ID NO: 347450 - DNA, 25 bp, Homo sapien
attttagggaggctgtcaactttca

SEQ ID NO: 347451 - DNA, 25 bp, Homo sapien
gaggctgtcaactttcattggagaa

SEQ ID NO: 347452 - DNA, 25 bp, Homo sapien
atccatgaacaagtggacctgccca

SEQ ID NO: 347453 - DNA, 25 bp, Homo sapien
ccatgaacaagtggacctgcccagt

SEQ ID NO: 347454 - DNA, 25 bp, Homo sapien
catgaacaagtggacctgcccagtt

SEQ ID NO: 347455 - DNA, 25 bp, Homo sapien
atgaacaagtggacctgcccagttc

SEQ ID NO: 347456 - DNA, 25 bp, Homo sapien
gaacaagtggacctgcccagttcaa

SEQ ID NO: 347457 - DNA, 25 bp, Homo sapien
aacaagtggacctgcccagttcaaa

SEQ ID NO: 347458 - DNA, 25 bp, Homo sapien
acaagtggacctgcccagttcaaat

SEQ ID NO: 347459 - DNA, 25 bp, Homo sapien
agtggacctgcccagttcaaatcat

SEQ ID NO: 347460 - DNA, 25 bp, Homo sapien
gtggacctgcccagttcaaatcatt

SEQ ID NO: 347461 - DNA, 25 bp, Homo sapien
tggacctgcccagttcaaatcattg

SEQ ID NO: 347462 - DNA, 25 bp, Homo sapien
tcggcacgaggcaaggtgtggtggt

SEQ ID NO: 347463 - DNA, 25 bp, Homo sapien
gtattgatcccaaacgcgcagaggc

SEQ ID NO: 347464 - DNA, 25 bp, Homo sapien
cgcgcagaggcgttgcttgaacgtt

SEQ ID NO: 347465 - DNA, 25 bp, Homo sapien
gaacgttgtttgaactcctaggcat

SEQ ID NO: 347466 - DNA, 25 bp, Homo sapien
gtttgaactcctaggcattccaggg

SEQ ID NO: 347467 - DNA, 25 bp, Homo sapien
ggcaaaagcacctcggcaaaaacgt

SEQ ID NO: 347468 - DNA, 25 bp, Homo sapien
tcggcaaaaacgtgcaggactgcat

SEQ ID NO: 347469 - DNA, 25 bp, Homo sapien
aggactgcatgttactttggttcgc

SEQ ID NO: 347470 - DNA, 25 bp, Homo sapien
gttactttggttcgcggctgacacg

SEQ ID NO: 347471 - DNA, 25 bp, Homo sapien
gtcaatcaccgggagcagcaacagg

SEQ ID NO: 347472 - DNA, 25 bp, Homo sapien
aacagggagcacatggcaacgggct

SEQ ID NO: 347473 - DNA, 25 bp, Homo sapien
ggccgaaatcccgagtaaagcttgg

SEQ ID NO: 347474 - DNA, 25 bp, Homo sapien
gacacagcagcatggacagagtgaa

SEQ ID NO: 347475 - DNA, 25 bp, Homo sapien
tgcatacagaaatagcctctcacat

SEQ ID NO: 347476 - DNA, 25 bp, Homo sapien
cctctcacatatttactggctcatt

SEQ ID NO: 347477 - DNA, 25 bp, Homo sapien
tactggctcattgtttagctgaggg

SEQ ID NO: 347478 - DNA, 25 bp, Homo sapien
aaagctgagactgctctttcgtctt

SEQ ID NO: 347479 - DNA, 25 bp, Homo sapien
gctctttcgtcttccatttagtgaa

SEQ ID NO: 347480 - DNA, 25 bp, Homo sapien
atttagtgaagatatcctactcccc

SEQ ID NO: 347481 - DNA, 25 bp, Homo sapien
gattttatttctccaaacaattcct

SEQ ID NO: 347482 - DNA, 25 bp, Homo sapien
aacaattcctttccatagatgtgat

SEQ ID NO: 347483 - DNA, 25 bp, Homo sapien
tggtggtaagaagcctatcagtctt

SEQ ID NO: 347484 - DNA, 25 bp, Homo sapien
ctatcagtcttctacctcagtgatt

SEQ ID NO: 347485 - DNA, 25 bp, Homo sapien
gcaagtctctccaagtactatggaa

SEQ ID NO: 347486 - DNA, 25 bp, Homo sapien
gtctctccaagtactatggaaacaa

SEQ ID NO: 347487 - DNA, 25 bp, Homo sapien
aggtctgagtagtccaagggacacg

SEQ ID NO: 347488 - DNA, 25 bp, Homo sapien
tctgagtagtccaagggacacggga

SEQ ID NO: 347489 - DNA, 25 bp, Homo sapien
gacacgggaggccagttgggaagac

SEQ ID NO: 347490 - DNA, 25 bp, Homo sapien
gaggccagttgggaagaccgcccgg

SEQ ID NO: 347491 - DNA, 25 bp, Homo sapien
accgcccgggcgagaccaggaagat

SEQ ID NO: 347492 - DNA, 25 bp, Homo sapien
cgcccgggcgagaccaggaagatca

SEQ ID NO: 347493 - DNA, 25 bp, Homo sapien
cgagaccaggaagatcaaggccaca

SEQ ID NO: 347494 - DNA, 25 bp, Homo sapien
aggccacagtgaatcacgatcccat

SEQ ID NO: 347495 - DNA, 25 bp, Homo sapien
attgatttccaaggcttgagtgtga

SEQ ID NO: 347496 - DNA, 25 bp, Homo sapien
agcacttagcacctctgatcttgtt

SEQ ID NO: 347497 - DNA, 25 bp, Homo sapien
gcacttagcacctctgatcttgttt

SEQ ID NO: 347498 - DNA, 25 bp, Homo sapien
atcactggtagatacctgtattcaa

SEQ ID NO: 347499 - DNA, 25 bp, Homo sapien
tcactggtagatacctgtattcaag

SEQ ID NO: 347500 - DNA, 25 bp, Homo sapien
cactggtagatacctgtattcaagc

SEQ ID NO: 347501 - DNA, 25 bp, Homo sapien
actggtagatacctgtattcaagct

SEQ ID NO: 347502 - DNA, 25 bp, Homo sapien
ctggtagatacctgtattcaagcta

SEQ ID NO: 347503 - DNA, 25 bp, Homo sapien
tggtagatacctgtattcaagctat

SEQ ID NO: 347504 - DNA, 25 bp, Homo sapien
agtcacattttagaagtcatgaagt

SEQ ID NO: 347505 - DNA, 25 bp, Homo sapien
gtcacattttagaagtcatgaagtt

SEQ ID NO: 347506 - DNA, 25 bp, Homo sapien
tcacattttagaagtcatgaagttg

SEQ ID NO: 347507 - DNA, 25 bp, Homo sapien
aagccaagaggaactggatccgtgc

SEQ ID NO: 347508 - DNA, 25 bp, Homo sapien
ccaagaggaactggatccgtgctca

SEQ ID NO: 347509 - DNA, 25 bp, Homo sapien
tggatccgtgctcagtgcaacacct

SEQ ID NO: 347510 - DNA, 25 bp, Homo sapien
gtgctcagtgcaacacctcagggct

SEQ ID NO: 347511 - DNA, 25 bp, Homo sapien
agtgcaacacctcagggctcaacat

SEQ ID NO: 347512 - DNA, 25 bp, Homo sapien
tccgcctgggataagcatatctctc

SEQ ID NO: 347513 - DNA, 25 bp, Homo sapien
tcccgagactgaagagagcctccaa

SEQ ID NO: 347514 - DNA, 25 bp, Homo sapien
ccgagactgaagagagcctccaagc

SEQ ID NO: 347515 - DNA, 25 bp, Homo sapien
gtatacaaagcccagctccctaaat

SEQ ID NO: 347516 - DNA, 25 bp, Homo sapien
cagctccctaaatcccaaattcagg

SEQ ID NO: 347517 - DNA, 25 bp, Homo sapien
tccctaaatcccaaattcaggagaa

SEQ ID NO: 347518 - DNA, 25 bp, Homo sapien
gcagattctgagaacaataactcca

SEQ ID NO: 347519 - DNA, 25 bp, Homo sapien
aataactccacaatggcgtcggcct

SEQ ID NO: 347520 - DNA, 25 bp, Homo sapien
tccacaatggcgtcggcctcggagg

SEQ ID NO: 347521 - DNA, 25 bp, Homo sapien
gcccgtgcttgttcccgggctcaga

SEQ ID NO: 347522 - DNA, 25 bp, Homo sapien
gacagttggcaagaaaaccccgagg

SEQ ID NO: 347523 - DNA, 25 bp, Homo sapien
gaggagccctgttccaaagcctcct

SEQ ID NO: 347524 - DNA, 25 bp, Homo sapien
tggtagatgctgctgtagacctcat

SEQ ID NO: 347525 - DNA, 25 bp, Homo sapien
ctgctgtagacctcatatccgatga

SEQ ID NO: 347526 - DNA, 25 bp, Homo sapien
gacctcatatccgatgaatgggaag

SEQ ID NO: 347527 - DNA, 25 bp, Homo sapien
atgggaagctgctaatgccataccc

SEQ ID NO: 347528 - DNA, 25 bp, Homo sapien
gaagcaggatgcagccccgcttgag

SEQ ID NO: 347529 - DNA, 25 bp, Homo sapien
tctgatggcatggaaatcctgccat

SEQ ID NO: 347530 - DNA, 25 bp, Homo sapien
ggcatggaaatcctgccattgaatg

SEQ ID NO: 347531 - DNA, 25 bp, Homo sapien
catggaaatcctgccattgaatgca

SEQ ID NO: 347532 - DNA, 25 bp, Homo sapien
ctgccattgaatgcaaacgcacaag

SEQ ID NO: 347533 - DNA, 25 bp, Homo sapien
atgcaaacgcacaagactagaattt

SEQ ID NO: 347534 - DNA, 25 bp, Homo sapien
actagaatttggaactgagtttcgt

SEQ ID NO: 347535 - DNA, 25 bp, Homo sapien
gaggtccttccccttcaaagcctgt

SEQ ID NO: 347536 - DNA, 25 bp, Homo sapien
ggcagccactaaatggccccaagat

SEQ ID NO: 347537 - DNA, 25 bp, Homo sapien
actaaatggccccaagatcccatgg

SEQ ID NO: 347538 - DNA, 25 bp, Homo sapien
aaatggccccaagatcccatggact

SEQ ID NO: 347539 - DNA, 25 bp, Homo sapien
gccccaagatcccatggactcaagg

SEQ ID NO: 347540 - DNA, 25 bp, Homo sapien
accccgaagagctgtggagaccaaa

SEQ ID NO: 347541 - DNA, 25 bp, Homo sapien
gagaccaaaccaagactacgctaca

SEQ ID NO: 347542 - DNA, 25 bp, Homo sapien
aaaccaagactacgctacacacaga

SEQ ID NO: 347543 - DNA, 25 bp, Homo sapien
aagactacgctacacacagaacgcc

SEQ ID NO: 347544 - DNA, 25 bp, Homo sapien
tacgctacacacagaacgccgagaa

SEQ ID NO: 347545 - DNA, 25 bp, Homo sapien
gctacacacagaacgccgagaagat

SEQ ID NO: 347546 - DNA, 25 bp, Homo sapien
acagaacgccgagaagataaaccaa

SEQ ID NO: 347547 - DNA, 25 bp, Homo sapien
gataaaccaagctttacacgagcag

SEQ ID NO: 347548 - DNA, 25 bp, Homo sapien
accaagctttacacgagcaggatgg

SEQ ID NO: 347549 - DNA, 25 bp, Homo sapien
ctgtgaccgaggagcagggtcccca

SEQ ID NO: 347550 - DNA, 25 bp, Homo sapien
agctcccacggagcgggcttgaaca

SEQ ID NO: 347551 - DNA, 25 bp, Homo sapien
aattggattgtctgtaacataagga

SEQ ID NO: 347552 - DNA, 25 bp, Homo sapien
taacataaggaagggatacaggctt

SEQ ID NO: 347553 - DNA, 25 bp, Homo sapien
gatacaggcttgaggtgatggacac

SEQ ID NO: 347554 - DNA, 25 bp, Homo sapien
gtgatggacaccctatttactctaa

SEQ ID NO: 347555 - DNA, 25 bp, Homo sapien
gatggacaccctatttactctaata

SEQ ID NO: 347556 - DNA, 25 bp, Homo sapien
ggacaccctatttactctaatatga

SEQ ID NO: 347557 - DNA, 25 bp, Homo sapien
caccctatttactctaatatgatta

SEQ ID NO: 347558 - DNA, 25 bp, Homo sapien
gtaccccataagtatatatactacg

SEQ ID NO: 347559 - DNA, 25 bp, Homo sapien
aagtatatatactacgtacccacaa

SEQ ID NO: 347560 - DNA, 25 bp, Homo sapien
tatatactacgtacccacaaaaatt

SEQ ID NO: 347561 - DNA, 25 bp, Homo sapien
taacaatgtagttacagtcaataat

SEQ ID NO: 347562 - DNA, 25 bp, Homo sapien
tgtgccagcgcctgcgtcttggcca

SEQ ID NO: 347563 - DNA, 25 bp, Homo sapien
tcgatgctcctcagtgctgtcgtgt

SEQ ID NO: 347564 - DNA, 25 bp, Homo sapien
tcagtgctgtcgtgtgctgtatttc

SEQ ID NO: 347565 - DNA, 25 bp, Homo sapien
gtgctgtatttccagggcctgtagc

SEQ ID NO: 347566 - DNA, 25 bp, Homo sapien
atttccagggcctgtagcaggctgc

SEQ ID NO: 347567 - DNA, 25 bp, Homo sapien
agcaggctgctgaacttgccggaga

SEQ ID NO: 347568 - DNA, 25 bp, Homo sapien
ctgaacttgccggagacccaggagg

SEQ ID NO: 347569 - DNA, 25 bp, Homo sapien
tgccggagacccaggaggccaagat

SEQ ID NO: 347570 - DNA, 25 bp, Homo sapien
aagatgcaggccgagttctggatct

SEQ ID NO: 347571 - DNA, 25 bp, Homo sapien
atgcaggccgagttctggatctggc

SEQ ID NO: 347572 - DNA, 25 bp, Homo sapien
ggccgagttctggatctggctgctt

SEQ ID NO: 347573 - DNA, 25 bp, Homo sapien
ataacagtggtaacagtgcgtgggc

SEQ ID NO: 347574 - DNA, 25 bp, Homo sapien
taggatgtttcctagaccatttggg

SEQ ID NO: 347575 - DNA, 25 bp, Homo sapien
gggcctcgagaaggagtcactcaga

SEQ ID NO: 347576 - DNA, 25 bp, Homo sapien
gaaggagtcactcagacaagccata

SEQ ID NO: 347577 - DNA, 25 bp, Homo sapien
agtcactcagacaagccatattttt

SEQ ID NO: 347578 - DNA, 25 bp, Homo sapien
actcagacaagccatatttttagaa

SEQ ID NO: 347579 - DNA, 25 bp, Homo sapien
aagtagtctactgatgggagcaaca

SEQ ID NO: 347580 - DNA, 25 bp, Homo sapien
tctactgatgggagcaacagttatg

SEQ ID NO: 347581 - DNA, 25 bp, Homo sapien
gcaagacagcactggtaaggactct

SEQ ID NO: 347582 - DNA, 25 bp, Homo sapien
agcactggtaaggactcttagctga

SEQ ID NO: 347583 - DNA, 25 bp, Homo sapien
gactcttagctgaggttcgggatat

SEQ ID NO: 347584 - DNA, 25 bp, Homo sapien
gagatctgttgtcaccgaaggtcat

SEQ ID NO: 347585 - DNA, 25 bp, Homo sapien
gatctgttgtcaccgaaggtcatta

SEQ ID NO: 347586 - DNA, 25 bp, Homo sapien
ctgttgtcaccgaaggtcattacaa

SEQ ID NO: 347587 - DNA, 25 bp, Homo sapien
gtcaccgaaggtcattacaagaaga

SEQ ID NO: 347588 - DNA, 25 bp, Homo sapien
aagaaggattctcaagggacagcga

SEQ ID NO: 347589 - DNA, 25 bp, Homo sapien
ttctcaagggacagcgaagccccaa

SEQ ID NO: 347590 - DNA, 25 bp, Homo sapien
aagggacagcgaagccccaacggag

SEQ ID NO: 347591 - DNA, 25 bp, Homo sapien
aagccctgccataggaggagaaccc

SEQ ID NO: 347592 - DNA, 25 bp, Homo sapien
atacatagcgtaaacaacggccatc

SEQ ID NO: 347593 - DNA, 25 bp, Homo sapien
acaacggccatcaaaaaagcaggac

SEQ ID NO: 347594 - DNA, 25 bp, Homo sapien
aaaaaactcatcttggcgttaattg

SEQ ID NO: 347595 - DNA, 25 bp, Homo sapien
acagcaagactttatttcttcccca

SEQ ID NO: 347596 - DNA, 25 bp, Homo sapien
tatttcttccccagaggtgacgtct

SEQ ID NO: 347597 - DNA, 25 bp, Homo sapien
ggtgacgtctgatggttctgtataa

SEQ ID NO: 347598 - DNA, 25 bp, Homo sapien
tcacaccacctttcttatgctgaat

SEQ ID NO: 347599 - DNA, 25 bp, Homo sapien
ttatgctgaattgatgctgctgacc

SEQ ID NO: 347600 - DNA, 25 bp, Homo sapien
tgctgacctgctgttagtaggacat

SEQ ID NO: 347601 - DNA, 25 bp, Homo sapien
gacatgcacttttatggcgtttcca

SEQ ID NO: 347602 - DNA, 25 bp, Homo sapien
gtgtgttgctgagctcatctaatct

SEQ ID NO: 347603 - DNA, 25 bp, Homo sapien
gctttgagcaaaggcaatcctctat

SEQ ID NO: 347604 - DNA, 25 bp, Homo sapien
gatttagtgaccctctttcaaaagg

SEQ ID NO: 347605 - DNA, 25 bp, Homo sapien
ggtggatcacaagcttagaggcatt

SEQ ID NO: 347606 - DNA, 25 bp, Homo sapien
tgccagggtgatgacaactccgtga

SEQ ID NO: 347607 - DNA, 25 bp, Homo sapien
tgacaactccgtgagggtggagatt

SEQ ID NO: 347608 - DNA, 25 bp, Homo sapien
gggtggagattatacatctctcatc

SEQ ID NO: 347609 - DNA, 25 bp, Homo sapien
acatctctcatcatttcagcaacaa

SEQ ID NO: 347610 - DNA, 25 bp, Homo sapien
aaattagtggcagagtaagggtgac

SEQ ID NO: 347611 - DNA, 25 bp, Homo sapien
gtaagggtgacttgagatctcttgg

SEQ ID NO: 347612 - DNA, 25 bp, Homo sapien
acttgagatctcttggaagcgagga

SEQ ID NO: 347613 - DNA, 25 bp, Homo sapien
tctcttggaagcgaggatcctttaa

SEQ ID NO: 347614 - DNA, 25 bp, Homo sapien
gcgaggatcctttaaaaatcctgga

SEQ ID NO: 347615 - DNA, 25 bp, Homo sapien
aatcctggaatatacactgcagtaa

SEQ ID NO: 347616 - DNA, 25 bp, Homo sapien
gcatacctcagccttaaacgactga

SEQ ID NO: 347617 - DNA, 25 bp, Homo sapien
ggccccgtagcagcattggaggcca

SEQ ID NO: 347618 - DNA, 25 bp, Homo sapien
ccccgtagcagcattggaggccaga

SEQ ID NO: 347619 - DNA, 25 bp, Homo sapien
cccgtagcagcattggaggccagag

SEQ ID NO: 347620 - DNA, 25 bp, Homo sapien
ccgtagcagcattggaggccagagc

SEQ ID NO: 347621 - DNA, 25 bp, Homo sapien
gtagcagcattggaggccagagccc

SEQ ID NO: 347622 - DNA, 25 bp, Homo sapien
agttccggagtcacacccaacggcg

SEQ ID NO: 347623 - DNA, 25 bp, Homo sapien
ttccggagtcacacccaacggcgga

SEQ ID NO: 347624 - DNA, 25 bp, Homo sapien
cggcggagggagaacctacccatct

SEQ ID NO: 347625 - DNA, 25 bp, Homo sapien
ggcggagggagaacctacccatctc

SEQ ID NO: 347626 - DNA, 25 bp, Homo sapien
ggagggagaacctacccatctccca

SEQ ID NO: 347627 - DNA, 25 bp, Homo sapien
tgcaccctcggacttggcctggcca

SEQ ID NO: 347628 - DNA, 25 bp, Homo sapien
ttgaacttagatttaccagccatgt

SEQ ID NO: 347629 - DNA, 25 bp, Homo sapien
taccagccatgtgaggttatttttt

SEQ ID NO: 347630 - DNA, 25 bp, Homo sapien
tttttgtactgcattgtctcttctg

SEQ ID NO: 347631 - DNA, 25 bp, Homo sapien
actgcattgtctcttctggtccttt

SEQ ID NO: 347632 - DNA, 25 bp, Homo sapien
tggtcctttgccagattacctactg

SEQ ID NO: 347633 - DNA, 25 bp, Homo sapien
gggtcttagtgttgaatccgaagtg

SEQ ID NO: 347634 - DNA, 25 bp, Homo sapien
gttgaatccgaagtgaattttttgg

SEQ ID NO: 347635 - DNA, 25 bp, Homo sapien
gatcactttgtaatctttgctattt

SEQ ID NO: 347636 - DNA, 25 bp, Homo sapien
ctttgctattttggtaggcagaaac

SEQ ID NO: 347637 - DNA, 25 bp, Homo sapien
ttttggtaggcagaaacaatcttat

SEQ ID NO: 347638 - DNA, 25 bp, Homo sapien
atttgcatttctttggttactagat

SEQ ID NO: 347639 - DNA, 25 bp, Homo sapien
atattaattctgtaatccttgacca

SEQ ID NO: 347640 - DNA, 25 bp, Homo sapien
tattaattctgtaatccttgaccag

SEQ ID NO: 347641 - DNA, 25 bp, Homo sapien
attaattctgtaatccttgaccagg

SEQ ID NO: 347642 - DNA, 25 bp, Homo sapien
ttaattctgtaatccttgaccaggc

SEQ ID NO: 347643 - DNA, 25 bp, Homo sapien
taattctgtaatccttgaccaggca

SEQ ID NO: 347644 - DNA, 25 bp, Homo sapien
aattctgtaatccttgaccaggcat

SEQ ID NO: 347645 - DNA, 25 bp, Homo sapien
attctgtaatccttgaccaggcatg

SEQ ID NO: 347646 - DNA, 25 bp, Homo sapien
ttctgtaatccttgaccaggcatgg

SEQ ID NO: 347647 - DNA, 25 bp, Homo sapien
tctgtaatccttgaccaggcatggt

SEQ ID NO: 347648 - DNA, 25 bp, Homo sapien
ctgtaatccttgaccaggcatggtg

SEQ ID NO: 347649 - DNA, 25 bp, Homo sapien
tgtaatccttgaccaggcatggtgg

SEQ ID NO: 347650 - DNA, 25 bp, Homo sapien
ggaaataaattagtggcagagtaag

SEQ ID NO: 347651 - DNA, 25 bp, Homo sapien
gaaataaattagtggcagagtaagg

SEQ ID NO: 347652 - DNA, 25 bp, Homo sapien
aaataaattagtggcagagtaaggg

SEQ ID NO: 347653 - DNA, 25 bp, Homo sapien
aataaattagtggcagagtaagggt

SEQ ID NO: 347654 - DNA, 25 bp, Homo sapien
ataaattagtggcagagtaagggtg

SEQ ID NO: 347655 - DNA, 25 bp, Homo sapien
taaattagtggcagagtaagggtga

SEQ ID NO: 347656 - DNA, 25 bp, Homo sapien
aaattagtggcagagtaagggtgac

SEQ ID NO: 347657 - DNA, 25 bp, Homo sapien
aattagtggcagagtaagggtgact

SEQ ID NO: 347658 - DNA, 25 bp, Homo sapien
attagtggcagagtaagggtgactt

SEQ ID NO: 347659 - DNA, 25 bp, Homo sapien
ttagtggcagagtaagggtgacttg

SEQ ID NO: 347660 - DNA, 25 bp, Homo sapien
tagtggcagagtaagggtgacttga

SEQ ID NO: 347661 - DNA, 25 bp, Homo sapien
ttcaaacagagatcattacacagat

SEQ ID NO: 347662 - DNA, 25 bp, Homo sapien
aaaaggattgcctaatgatggtaga

SEQ ID NO: 347663 - DNA, 25 bp, Homo sapien
tagaaggttaatttcatcagcaagt

SEQ ID NO: 347664 - DNA, 25 bp, Homo sapien
gagaaattcaaaacactacccttag

SEQ ID NO: 347665 - DNA, 25 bp, Homo sapien
caaaacactacccttagtctggaag

SEQ ID NO: 347666 - DNA, 25 bp, Homo sapien
gtctggaagccctcttctctcaaga

SEQ ID NO: 347667 - DNA, 25 bp, Homo sapien
ggctaaaagatacaccaggcgaata

SEQ ID NO: 347668 - DNA, 25 bp, Homo sapien
caccaggcgaataataaccaggcga

SEQ ID NO: 347669 - DNA, 25 bp, Homo sapien
taaccaggcgaataataaccagagt

SEQ ID NO: 347670 - DNA, 25 bp, Homo sapien
aaccagagtagctacactgactttt

SEQ ID NO: 347671 - DNA, 25 bp, Homo sapien
gtagctacactgacttttgataaga

SEQ ID NO: 347672 - DNA, 25 bp, Homo sapien
tatggcccaatgtgatgagtatgca

SEQ ID NO: 347673 - DNA, 25 bp, Homo sapien
gagtatgcagggatctgagtgccta

SEQ ID NO: 347674 - DNA, 25 bp, Homo sapien
ggatctgagtgcctaaactcgctgt

SEQ ID NO: 347675 - DNA, 25 bp, Homo sapien
ctgagtgcctaaactcgctgtggtg

SEQ ID NO: 347676 - DNA, 25 bp, Homo sapien
tgtggtggcacctcaacacagttga

SEQ ID NO: 347677 - DNA, 25 bp, Homo sapien
ggcacctcaacacagttgactcaga

SEQ ID NO: 347678 - DNA, 25 bp, Homo sapien
tgtctcctgctaaaagtatatacta

SEQ ID NO: 347679 - DNA, 25 bp, Homo sapien
gatggacttccaatagtgtccagca

SEQ ID NO: 347680 - DNA, 25 bp, Homo sapien
cagcaggttgagactctggtttctt

SEQ ID NO: 347681 - DNA, 25 bp, Homo sapien
tgagactctggtttctttcttcgtt

SEQ ID NO: 347682 - DNA, 25 bp, Homo sapien
acaaatggaatttgccactattttt

SEQ ID NO: 347683 - DNA, 25 bp, Homo sapien
aaatgagaccctgtcgaccgggcgc

SEQ ID NO: 347684 - DNA, 25 bp, Homo sapien
aatgagaccctgtcgaccgggcgcg

SEQ ID NO: 347685 - DNA, 25 bp, Homo sapien
atgagaccctgtcgaccgggcgcgc

SEQ ID NO: 347686 - DNA, 25 bp, Homo sapien
tgagaccctgtcgaccgggcgcgct

SEQ ID NO: 347687 - DNA, 25 bp, Homo sapien
gagaccctgtcgaccgggcgcgctg

SEQ ID NO: 347688 - DNA, 25 bp, Homo sapien
agaccctgtcgaccgggcgcgctgg

SEQ ID NO: 347689 - DNA, 25 bp, Homo sapien
gaccctgtcgaccgggcgcgctggc

SEQ ID NO: 347690 - DNA, 25 bp, Homo sapien
accctgtcgaccgggcgcgctggct

SEQ ID NO: 347691 - DNA, 25 bp, Homo sapien
aactgaaactcaattaccgctgccg

SEQ ID NO: 347692 - DNA, 25 bp, Homo sapien
ctgaaactcaattaccgctgccgct

SEQ ID NO: 347693 - DNA, 25 bp, Homo sapien
gaaactcaattaccgctgccgctca

SEQ ID NO: 347694 - DNA, 25 bp, Homo sapien
aattaccgctgccgctcactcggtt

SEQ ID NO: 347695 - DNA, 25 bp, Homo sapien
ggttccatccccctgagtttagata

SEQ ID NO: 347696 - DNA, 25 bp, Homo sapien
tccatccccctgagtttagatagct

SEQ ID NO: 347697 - DNA, 25 bp, Homo sapien
agaactcccctgtctgttctctttg

SEQ ID NO: 347698 - DNA, 25 bp, Homo sapien
tgtctgttctctttgctctatccca

SEQ ID NO: 347699 - DNA, 25 bp, Homo sapien
ctgttctctttgctctatcccaggg

SEQ ID NO: 347700 - DNA, 25 bp, Homo sapien
ggtgagcctgcgagagccagccaac

SEQ ID NO: 347701 - DNA, 25 bp, Homo sapien
tgagcctgcgagagccagccaacta

SEQ ID NO: 347702 - DNA, 25 bp, Homo sapien
gacacacaaagagggcccagggagt

SEQ ID NO: 347703 - DNA, 25 bp, Homo sapien
ggtgagctcagaggcctcgtcgtcc

SEQ ID NO: 347704 - DNA, 25 bp, Homo sapien
cctcaggcgccgaagatatcgactt

SEQ ID NO: 347705 - DNA, 25 bp, Homo sapien
aagatatcgacttgaactccccgga

SEQ ID NO: 347706 - DNA, 25 bp, Homo sapien
ggaccatccgaatcacaagtcgaac

SEQ ID NO: 347707 - DNA, 25 bp, Homo sapien
caagtcgaacgaaagccttctgatt

SEQ ID NO: 347708 - DNA, 25 bp, Homo sapien
aaagccttctgattaccgtgctgtg

SEQ ID NO: 347709 - DNA, 25 bp, Homo sapien
attaccgtgctgtggcggcgactat

SEQ ID NO: 347710 - DNA, 25 bp, Homo sapien
cgactatccacgttcggtcgtcggg

SEQ ID NO: 347711 - DNA, 25 bp, Homo sapien
ttgagatgtctgatgagcagtccaa

SEQ ID NO: 347712 - DNA, 25 bp, Homo sapien
gaagatgagaccacagacacacaaa

SEQ ID NO: 347713 - DNA, 25 bp, Homo sapien
gaaagtaactattatgaacactgaa

SEQ ID NO: 347714 - DNA, 25 bp, Homo sapien
tgacacaacctcaagtgagaatatt

SEQ ID NO: 347715 - DNA, 25 bp, Homo sapien
gtaaaggaacaatcattttctcatg

SEQ ID NO: 347716 - DNA, 25 bp, Homo sapien
ggaacaatcattttctcatgattat

SEQ ID NO: 347717 - DNA, 25 bp, Homo sapien
cctcaagtgagaatattgtgtagac

SEQ ID NO: 347718 - DNA, 25 bp, Homo sapien
gtaatagatttcaaaatgtccattt

SEQ ID NO: 347719 - DNA, 25 bp, Homo sapien
ttgtgtagacaagattggaaaccac

SEQ ID NO: 347720 - DNA, 25 bp, Homo sapien
aaaccactgatttagatatagaaac

SEQ ID NO: 347721 - DNA, 25 bp, Homo sapien
gaaacaaaggctaatcaactgtgag

SEQ ID NO: 347722 - DNA, 25 bp, Homo sapien
aaggctaatcaactgtgagaattat

SEQ ID NO: 347723 - DNA, 25 bp, Homo sapien
gagaattatggtcacagaatagaaa

SEQ ID NO: 347724 - DNA, 25 bp, Homo sapien
tctcgcacaggccattctgggtctg

SEQ ID NO: 347725 - DNA, 25 bp, Homo sapien
cacaggccattctgggtctggtggt

SEQ ID NO: 347726 - DNA, 25 bp, Homo sapien
ggccattctgggtctggtggtgcca

SEQ ID NO: 347727 - DNA, 25 bp, Homo sapien
ctggtggtgccaggtgccgtgacac

SEQ ID NO: 347728 - DNA, 25 bp, Homo sapien
tgccaggtgccgtgacacgccgtgc

SEQ ID NO: 347729 - DNA, 25 bp, Homo sapien
ccgtgacacgccgtgctgggcttgt

SEQ ID NO: 347730 - DNA, 25 bp, Homo sapien
tggtgtggccctcattctcatgttc

SEQ ID NO: 347731 - DNA, 25 bp, Homo sapien
gctgcgtgtgctgccgtggatctcc

SEQ ID NO: 347732 - DNA, 25 bp, Homo sapien
gtgtgctgccgtggatctcctgcat

SEQ ID NO: 347733 - DNA, 25 bp, Homo sapien
tgccgtggatctcctgcatcccttg

SEQ ID NO: 347734 - DNA, 25 bp, Homo sapien
gacccctcccgccatcagaggaaag

SEQ ID NO: 347735 - DNA, 25 bp, Homo sapien
aacgtaggagtgcttttctgtgtaa

SEQ ID NO: 347736 - DNA, 25 bp, Homo sapien
acgtaggagtgcttttctgtgtaac

SEQ ID NO: 347737 - DNA, 25 bp, Homo sapien
gtaggagtgcttttctgtgtaactc

SEQ ID NO: 347738 - DNA, 25 bp, Homo sapien
gagtgcttttctgtgtaactccctt

SEQ ID NO: 347739 - DNA, 25 bp, Homo sapien
agtgcttttctgtgtaactcccttc

SEQ ID NO: 347740 - DNA, 25 bp, Homo sapien
tgcttttctgtgtaactcccttctt

SEQ ID NO: 347741 - DNA, 25 bp, Homo sapien
gcttttctgtgtaactcccttcttt

SEQ ID NO: 347742 - DNA, 25 bp, Homo sapien
tttctgtgtaactcccttctttcca

SEQ ID NO: 347743 - DNA, 25 bp, Homo sapien
tgtgtaactcccttctttccagatc

SEQ ID NO: 347744 - DNA, 25 bp, Homo sapien
gtaactcccttctttccagatctct

SEQ ID NO: 347745 - DNA, 25 bp, Homo sapien
aagccagaatgatggtatagagttg

SEQ ID NO: 347746 - DNA, 25 bp, Homo sapien
aacatcttttcctatatcgtcagta

SEQ ID NO: 347747 - DNA, 25 bp, Homo sapien
gaagtaacttgtttaggcaaagcac

SEQ ID NO: 347748 - DNA, 25 bp, Homo sapien
aggcaaagcacgttatggctttttc

SEQ ID NO: 347749 - DNA, 25 bp, Homo sapien
gcctagtttaggtctgtgcttaatg

SEQ ID NO: 347750 - DNA, 25 bp, Homo sapien
taacatcctgataacatttgggagg

SEQ ID NO: 347751 - DNA, 25 bp, Homo sapien
gaaatgcaataatctttaaaccagg

SEQ ID NO: 347752 - DNA, 25 bp, Homo sapien
accaggaatcatcagtttgctaata

SEQ ID NO: 347753 - DNA, 25 bp, Homo sapien
gctaataaaaggtatatggctccaa

SEQ ID NO: 347754 - DNA, 25 bp, Homo sapien
atggctccaagttacgtattttgtc

SEQ ID NO: 347755 - DNA, 25 bp, Homo sapien
gttacgtattttgtcagggtcctct

SEQ ID NO: 347756 - DNA, 25 bp, Homo sapien
cgtattttgtcagggtcctctggca

SEQ ID NO: 347757 - DNA, 25 bp, Homo sapien
aatccattctgaacatcaactgggt

SEQ ID NO: 347758 - DNA, 25 bp, Homo sapien
ttctgaacatcaactgggttctagt

SEQ ID NO: 347759 - DNA, 25 bp, Homo sapien
acaaaattcagctgtgtctgttctt

SEQ ID NO: 347760 - DNA, 25 bp, Homo sapien
taaaatccttgcttggcttcacatt

SEQ ID NO: 347761 - DNA, 25 bp, Homo sapien
ttgcttggcttcacattgctttttt

SEQ ID NO: 347762 - DNA, 25 bp, Homo sapien
gcttggcttcacattgcttttttcc

SEQ ID NO: 347763 - DNA, 25 bp, Homo sapien
tgcttttttcctatatatcaacaat

SEQ ID NO: 347764 - DNA, 25 bp, Homo sapien
catgcaagaaattacatacttaggt

SEQ ID NO: 347765 - DNA, 25 bp, Homo sapien
tatgaggaaaacgacaaaactgatt

SEQ ID NO: 347766 - DNA, 25 bp, Homo sapien
taaagaagtcacagaagtcaatgga

SEQ ID NO: 347767 - DNA, 25 bp, Homo sapien
ggagaaatattccaagttcatggat

SEQ ID NO: 347768 - DNA, 25 bp, Homo sapien
aacgtaggagtgcttttctgtgtaa

SEQ ID NO: 347769 - DNA, 25 bp, Homo sapien
cgtaggagtgcttttctgtgtaact

SEQ ID NO: 347770 - DNA, 25 bp, Homo sapien
gagtgcttttctgtgtaactccctt

SEQ ID NO: 347771 - DNA, 25 bp, Homo sapien
tgcttttctgtgtaactcccttctt

SEQ ID NO: 347772 - DNA, 25 bp, Homo sapien
tttctgtgtaactcccttctttcca

SEQ ID NO: 347773 - DNA, 25 bp, Homo sapien
tgtgtaactcccttctttccagatc

SEQ ID NO: 347774 - DNA, 25 bp, Homo sapien
gtaactcccttctttccagatctct

SEQ ID NO: 347775 - DNA, 25 bp, Homo sapien
ttctttccagatctctgcccaacat

SEQ ID NO: 347776 - DNA, 25 bp, Homo sapien
gcagccactttcttccaggcagaaa

SEQ ID NO: 347777 - DNA, 25 bp, Homo sapien
ccttactggttgctttatatatttt

SEQ ID NO: 347778 - DNA, 25 bp, Homo sapien
tgtccagttttttagttgtacagtg

SEQ ID NO: 347779 - DNA, 25 bp, Homo sapien
acatgactggctcaggatggcctgt

SEQ ID NO: 347780 - DNA, 25 bp, Homo sapien
catgactggctcaggatggcctgtc

SEQ ID NO: 347781 - DNA, 25 bp, Homo sapien
cagtgcagtaggttttggtaagtgc

SEQ ID NO: 347782 - DNA, 25 bp, Homo sapien
agtgcagtaggttttggtaagtgca

SEQ ID NO: 347783 - DNA, 25 bp, Homo sapien
gtgcagtaggttttggtaagtgcac

SEQ ID NO: 347784 - DNA, 25 bp, Homo sapien
tgcagtaggttttggtaagtgcaca

SEQ ID NO: 347785 - DNA, 25 bp, Homo sapien
gcagtaggttttggtaagtgcacac

SEQ ID NO: 347786 - DNA, 25 bp, Homo sapien
cagtaggttttggtaagtgcacacg

SEQ ID NO: 347787 - DNA, 25 bp, Homo sapien
tgtgtacctgcccttccaaacctca

SEQ ID NO: 347788 - DNA, 25 bp, Homo sapien
aacgtctttgtttaattccctgcag

SEQ ID NO: 347789 - DNA, 25 bp, Homo sapien
gcagcaccaccttgcatgtaatcag

SEQ ID NO: 347790 - DNA, 25 bp, Homo sapien
ctggtctgggctttgtatcttgtaa

SEQ ID NO: 347791 - DNA, 25 bp, Homo sapien
gcatgtaatcagctccatctgcaaa

SEQ ID NO: 347792 - DNA, 25 bp, Homo sapien
ggcaaaatcaacattcttctccttc

SEQ ID NO: 347793 - DNA, 25 bp, Homo sapien
tgactttttccacattgtgcccaga

SEQ ID NO: 347794 - DNA, 25 bp, Homo sapien
ccagagccactaggagccttgtatt

SEQ ID NO: 347795 - DNA, 25 bp, Homo sapien
aaaagtcagcgcattttgtgtgtgt

SEQ ID NO: 347796 - DNA, 25 bp, Homo sapien
aaggccacaggtttacatgtttcat

SEQ ID NO: 347797 - DNA, 25 bp, Homo sapien
gtacctggcatgattgcagcacctg

SEQ ID NO: 347798 - DNA, 25 bp, Homo sapien
acctgagcctgcaaacgtctttgtt

SEQ ID NO: 347799 - DNA, 25 bp, Homo sapien
gcaggtcactttctggggaacaaca

SEQ ID NO: 347800 - DNA, 25 bp, Homo sapien
gggaacaacacagtcatcgacatcc

SEQ ID NO: 347801 - DNA, 25 bp, Homo sapien
gaacaacacagtcatcgacatcctg

SEQ ID NO: 347802 - DNA, 25 bp, Homo sapien
aacaacacagtcatcgacatcctgc

SEQ ID NO: 347803 - DNA, 25 bp, Homo sapien
caacacagtcatcgacatcctgcgg

SEQ ID NO: 347804 - DNA, 25 bp, Homo sapien
acagtcatcgacatcctgcggcagg

SEQ ID NO: 347805 - DNA, 25 bp, Homo sapien
gtcatcgacatcctgcggcaggcag

SEQ ID NO: 347806 - DNA, 25 bp, Homo sapien
acatcctgcggcaggcagggctgga

SEQ ID NO: 347807 - DNA, 25 bp, Homo sapien
tggaggtggaccacacacccgccgg

SEQ ID NO: 347808 - DNA, 25 bp, Homo sapien
gccgggcaggccatacacagccctg

SEQ ID NO: 347809 - DNA, 25 bp, Homo sapien
agaggatgaggatccagccctgtcc

SEQ ID NO: 347810 - DNA, 25 bp, Homo sapien
aagaaatcccaaatgaacaatagag

SEQ ID NO: 347811 - DNA, 25 bp, Homo sapien
gaaggattcaggaactactttcagt

SEQ ID NO: 347812 - DNA, 25 bp, Homo sapien
ttcaggaactactttcagtcttttt

SEQ ID NO: 347813 - DNA, 25 bp, Homo sapien
gacttctttttgatcatcaaagtta

SEQ ID NO: 347814 - DNA, 25 bp, Homo sapien
gttactttcatctttgtagtgacaa

SEQ ID NO: 347815 - DNA, 25 bp, Homo sapien
gtagtgacaatagctttttagaata

SEQ ID NO: 347816 - DNA, 25 bp, Homo sapien
tttcttacactaattcctgatatct

SEQ ID NO: 347817 - DNA, 25 bp, Homo sapien
cctgatatcttctattaggctacag

SEQ ID NO: 347818 - DNA, 25 bp, Homo sapien
cttctctagtttgtggtaaaatatg

SEQ ID NO: 347819 - DNA, 25 bp, Homo sapien
ggtaaaacttttgttgacatcaatt

SEQ ID NO: 347820 - DNA, 25 bp, Homo sapien
aattcatggcaaaacttcacacaga

SEQ ID NO: 347821 - DNA, 25 bp, Homo sapien
aaagctaagccgtcctaccagcaat

SEQ ID NO: 347822 - DNA, 25 bp, Homo sapien
atgccttctcaagacctgatgaaag

SEQ ID NO: 347823 - DNA, 25 bp, Homo sapien
tcagttgcttacagttttggccgct

SEQ ID NO: 347824 - DNA, 25 bp, Homo sapien
agttttggccgctttgtagcactat

SEQ ID NO: 347825 - DNA, 25 bp, Homo sapien
taaacagcccaaatttatggccttg

SEQ ID NO: 347826 - DNA, 25 bp, Homo sapien
atttatggccttggacttactgcat

SEQ ID NO: 347827 - DNA, 25 bp, Homo sapien
ggccttggacttactgcatgacaca

SEQ ID NO: 347828 - DNA, 25 bp, Homo sapien
tgcatgacacatggcctggttacct

SEQ ID NO: 347829 - DNA, 25 bp, Homo sapien
atggcctggttacctgtcatggaat

SEQ ID NO: 347830 - DNA, 25 bp, Homo sapien
gttacctgtcatggaatgctgcagt

SEQ ID NO: 347831 - DNA, 25 bp, Homo sapien
atgctgcagtggtggtttgccaagc

SEQ ID NO: 347832 - DNA, 25 bp, Homo sapien
tctgttggccgggaggtttctcagt

SEQ ID NO: 347833 - DNA, 25 bp, Homo sapien
aggtttctcagtgatgtcgccacgt

SEQ ID NO: 347834 - DNA, 25 bp, Homo sapien
tcgccacgtgttttctgcgtggaaa

SEQ ID NO: 347835 - DNA, 25 bp, Homo sapien
aactgatgtttattaggcgtcttct

SEQ ID NO: 347836 - DNA, 25 bp, Homo sapien
taggcgtcttctaagacctaggtct

SEQ ID NO: 347837 - DNA, 25 bp, Homo sapien
agacctaggtctgggcacgcaaaaa

SEQ ID NO: 347838 - DNA, 25 bp, Homo sapien
aaaagacatgatccctgacctcaag

SEQ ID NO: 347839 - DNA, 25 bp, Homo sapien
gtatattttagtgctttaagacctc

SEQ ID NO: 347840 - DNA, 25 bp, Homo sapien
ctgaacttcagccaaaggacggaag

SEQ ID NO: 347841 - DNA, 25 bp, Homo sapien
ggccccactgcgctgaaatggacgt

SEQ ID NO: 347842 - DNA, 25 bp, Homo sapien
tgaaatggacgtcgcgccctctgtt

SEQ ID NO: 347843 - DNA, 25 bp, Homo sapien
caggacacacttactgttcccttgc

SEQ ID NO: 347844 - DNA, 25 bp, Homo sapien
agacgccagccggaccctgtgtgtg

SEQ ID NO: 347845 - DNA, 25 bp, Homo sapien
tgctgctctttgcagctgcctgcaa

SEQ ID NO: 347846 - DNA, 25 bp, Homo sapien
gttcctgcgaagaccagcaccttgg

SEQ ID NO: 347847 - DNA, 25 bp, Homo sapien
agagcctgcggctgaacttgaactc

SEQ ID NO: 347848 - DNA, 25 bp, Homo sapien
tgaacttgaactcgcagctacctga

SEQ ID NO: 347849 - DNA, 25 bp, Homo sapien
tgaactcgcagctacctgagtcaga

SEQ ID NO: 347850 - DNA, 25 bp, Homo sapien
ctgagtcagacctgtgctttttcac

SEQ ID NO: 347851 - DNA, 25 bp, Homo sapien
gtgctttttcacctctacggaagat

SEQ ID NO: 347852 - DNA, 25 bp, Homo sapien
gaagatgtcagagcgtttccctagc

SEQ ID NO: 347853 - DNA, 25 bp, Homo sapien
agagcgtttccctagcaatgtttta

SEQ ID NO: 347854 - DNA, 25 bp, Homo sapien
aaatcttgaactatgatgcgaggct

SEQ ID NO: 347855 - DNA, 25 bp, Homo sapien
actatgatgcgaggctaagctggga

SEQ ID NO: 347856 - DNA, 25 bp, Homo sapien
ggctaagctgggaacaattactgga

SEQ ID NO: 347857 - DNA, 25 bp, Homo sapien
ctgggaacaattactggaaacctga

SEQ ID NO: 347858 - DNA, 25 bp, Homo sapien
gtacctctcgcctaaccaagaggaa

SEQ ID NO: 347859 - DNA, 25 bp, Homo sapien
aataaaccaatacacctagcaaagc

SEQ ID NO: 347860 - DNA, 25 bp, Homo sapien
tacacctagcaaagcagacgccttg

SEQ ID NO: 347861 - DNA, 25 bp, Homo sapien
caaagcagacgccttgttttccaga

SEQ ID NO: 347862 - DNA, 25 bp, Homo sapien
agaacctcggactccggcagaaaga

SEQ ID NO: 347863 - DNA, 25 bp, Homo sapien
aaagaggtagagtaaaagtgctgct

SEQ ID NO: 347864 - DNA, 25 bp, Homo sapien
gtgctgctagattcagcttcacctt

SEQ ID NO: 347865 - DNA, 25 bp, Homo sapien
gctttttattcactcatcacttccc

SEQ ID NO: 347866 - DNA, 25 bp, Homo sapien
tttttattcactcatcacttcccat

SEQ ID NO: 347867 - DNA, 25 bp, Homo sapien
tttattcactcatcacttcccatca

SEQ ID NO: 347868 - DNA, 25 bp, Homo sapien
tcatcacttcccatcactatgctga

SEQ ID NO: 347869 - DNA, 25 bp, Homo sapien
cacttcccatcactatgctgaccag

SEQ ID NO: 347870 - DNA, 25 bp, Homo sapien
caggagagccacttctcagcgaaaa

SEQ ID NO: 347871 - DNA, 25 bp, Homo sapien
ggagagccacttctcagcgaaaaat

SEQ ID NO: 347872 - DNA, 25 bp, Homo sapien
gagccacttctcagcgaaaaatgac

SEQ ID NO: 347873 - DNA, 25 bp, Homo sapien
agccacttctcagcgaaaaatgaca

SEQ ID NO: 347874 - DNA, 25 bp, Homo sapien
ttctcagcgaaaaatgacacactca

SEQ ID NO: 347875 - DNA, 25 bp, Homo sapien
gcgaaaaatgacacactcaaagtat

SEQ ID NO: 347876 - DNA, 25 bp, Homo sapien
tctggttatgcaacccgcattttgt

SEQ ID NO: 347877 - DNA, 25 bp, Homo sapien
gcaacccgcattttgtagagggctt

SEQ ID NO: 347878 - DNA, 25 bp, Homo sapien
ttgtagagggcttgacagtttccag

SEQ ID NO: 347879 - DNA, 25 bp, Homo sapien
tcacgcagcgtttgatcctctgtgg

SEQ ID NO: 347880 - DNA, 25 bp, Homo sapien
ttgatcctctgtggcggccctggga

SEQ ID NO: 347881 - DNA, 25 bp, Homo sapien
gccctgggaggtttgcttgtttagt

SEQ ID NO: 347882 - DNA, 25 bp, Homo sapien
gcttgtttagttataccctgctgga

SEQ ID NO: 347883 - DNA, 25 bp, Homo sapien
ctgctggaggcagctaacaggaaac

SEQ ID NO: 347884 - DNA, 25 bp, Homo sapien
cgagtacccactctgagggtgactt

SEQ ID NO: 347885 - DNA, 25 bp, Homo sapien
actctgagggtgacttgctctggtt

SEQ ID NO: 347886 - DNA, 25 bp, Homo sapien
gtgacttgctctggttatgcaaccc

SEQ ID NO: 347887 - DNA, 25 bp, Homo sapien
ctgggcatgttctgttctgtgcatc

SEQ ID NO: 347888 - DNA, 25 bp, Homo sapien
gcatgttctgttctgtgcatcagat

SEQ ID NO: 347889 - DNA, 25 bp, Homo sapien
tgcatcagatgttttctgcctgcct

SEQ ID NO: 347890 - DNA, 25 bp, Homo sapien
ttgccaggcctctggactcagtgct

SEQ ID NO: 347891 - DNA, 25 bp, Homo sapien
gactcagtgcttcctgtcccaagga

SEQ ID NO: 347892 - DNA, 25 bp, Homo sapien
gtcccaaggacctgttgtgtgccca

SEQ ID NO: 347893 - DNA, 25 bp, Homo sapien
ttgtgtgcccagcttggaagacagt

SEQ ID NO: 347894 - DNA, 25 bp, Homo sapien
gaagacagtggccactcacatccag

SEQ ID NO: 347895 - DNA, 25 bp, Homo sapien
atccaggtctctgcctggctatttg

SEQ ID NO: 347896 - DNA, 25 bp, Homo sapien
ctctgcctggctatttgctccatga

SEQ ID NO: 347897 - DNA, 25 bp, Homo sapien
ttgctccatgaacccatctcagatg

SEQ ID NO: 347898 - DNA, 25 bp, Homo sapien
actgcctcacacagcaaatcgggac

SEQ ID NO: 347899 - DNA, 25 bp, Homo sapien
tcacacagcaaatcgggacctgggc

SEQ ID NO: 347900 - DNA, 25 bp, Homo sapien
gggacctgggcctggtagacaggat

SEQ ID NO: 347901 - DNA, 25 bp, Homo sapien
gaagatttttgagcctgagatcctc

SEQ ID NO: 347902 - DNA, 25 bp, Homo sapien
tgagatcctccttttctacactttc

SEQ ID NO: 347903 - DNA, 25 bp, Homo sapien
ccttttctacactttcaacatgtcc

SEQ ID NO: 347904 - DNA, 25 bp, Homo sapien
cactttcaacatgtcctgaattgat

SEQ ID NO: 347905 - DNA, 25 bp, Homo sapien
gaagtaatgataccattccaactat

SEQ ID NO: 347906 - DNA, 25 bp, Homo sapien
gataccattccaactataaccagac

SEQ ID NO: 347907 - DNA, 25 bp, Homo sapien
aaccagacattttattcccagtggg

SEQ ID NO: 347908 - DNA, 25 bp, Homo sapien
tcccagtgggaaaatgtgtacatga

SEQ ID NO: 347909 - DNA, 25 bp, Homo sapien
agaagttggcgtgaacgtggcgttt

SEQ ID NO: 347910 - DNA, 25 bp, Homo sapien
aagttggcgtgaacgtggcgtttgt

SEQ ID NO: 347911 - DNA, 25 bp, Homo sapien
gttggcgtgaacgtggcgtttgtgg

SEQ ID NO: 347912 - DNA, 25 bp, Homo sapien
gaacgtggcgtttgtgggagtgtca

SEQ ID NO: 347913 - DNA, 25 bp, Homo sapien
aacgtggcgtttgtgggagtgtcac

SEQ ID NO: 347914 - DNA, 25 bp, Homo sapien
acgtggcgtttgtgggagtgtcact

SEQ ID NO: 347915 - DNA, 25 bp, Homo sapien
cgtggcgtttgtgggagtgtcactg

SEQ ID NO: 347916 - DNA, 25 bp, Homo sapien
ggcgtttgtgggagtgtcactgaga

SEQ ID NO: 347917 - DNA, 25 bp, Homo sapien
cgtttgtgggagtgtcactgagatg

SEQ ID NO: 347918 - DNA, 25 bp, Homo sapien
agatggcccgtgtgccgcccacccc

SEQ ID NO: 347919 - DNA, 25 bp, Homo sapien
gtgtgccgcccaccccgaggcaccg

SEQ ID NO: 347920 - DNA, 25 bp, Homo sapien
ctataataacgaagacagcctggta

SEQ ID NO: 347921 - DNA, 25 bp, Homo sapien
aagacagcctggtattagggtgcca

SEQ ID NO: 347922 - DNA, 25 bp, Homo sapien
ttagggtgccagtgtagttacagac

SEQ ID NO: 347923 - DNA, 25 bp, Homo sapien
gtagttacagacaaagagaccaatg

SEQ ID NO: 347924 - DNA, 25 bp, Homo sapien
atatgcacacttgacttacaatgga

SEQ ID NO: 347925 - DNA, 25 bp, Homo sapien
aatggaaggagtattgcagatcagt

SEQ ID NO: 347926 - DNA, 25 bp, Homo sapien
gggagagactgaactaatcaataaa

SEQ ID NO: 347927 - DNA, 25 bp, Homo sapien
gcagttacaagatcatacatgtgga

SEQ ID NO: 347928 - DNA, 25 bp, Homo sapien
tagagatgggctgtcttgccttaga

SEQ ID NO: 347929 - DNA, 25 bp, Homo sapien
ggctgtcttgccttagagacattaa

SEQ ID NO: 347930 - DNA, 25 bp, Homo sapien
gacattaaggtctgttataaagcta

SEQ ID NO: 347931 - DNA, 25 bp, Homo sapien
aatgctttactctgactatgtgcta

SEQ ID NO: 347932 - DNA, 25 bp, Homo sapien
gtgctattgggttttatttccagaa

SEQ ID NO: 347933 - DNA, 25 bp, Homo sapien
atatagttctccttttttctgcatg

SEQ ID NO: 347934 - DNA, 25 bp, Homo sapien
tgaaggatacatcgtggtgccacat

SEQ ID NO: 347935 - DNA, 25 bp, Homo sapien
cgtggtgccacatgctttaagcaat

SEQ ID NO: 347936 - DNA, 25 bp, Homo sapien
aagaggaaaatgcaaccaccacatc

SEQ ID NO: 347937 - DNA, 25 bp, Homo sapien
aatgcaaccaccacatctgacttgc

SEQ ID NO: 347938 - DNA, 25 bp, Homo sapien
tgacttgcccaatgtagactttcct

SEQ ID NO: 347939 - DNA, 25 bp, Homo sapien
gtagactttcctctattagattgaa

SEQ ID NO: 347940 - DNA, 25 bp, Homo sapien
gattgaagtacacaacctaatatga

SEQ ID NO: 347941 - DNA, 25 bp, Homo sapien
attttgtagtatctcagactttgta

SEQ ID NO: 347942 - DNA, 25 bp, Homo sapien
caagaattccaccatgactgccact

SEQ ID NO: 347943 - DNA, 25 bp, Homo sapien
ccccatgggtgtcagaatctgtcat

SEQ ID NO: 347944 - DNA, 25 bp, Homo sapien
gaatctgtcataatggttggatgtt

SEQ ID NO: 347945 - DNA, 25 bp, Homo sapien
tcttttggcggtcatttctcccact

SEQ ID NO: 347946 - DNA, 25 bp, Homo sapien
gagttaggcagggagtcaatagaat

SEQ ID NO: 347947 - DNA, 25 bp, Homo sapien
gagtcaatagaatatgtgcagtctt

SEQ ID NO: 347948 - DNA, 25 bp, Homo sapien
tgtgagccaggcttgagaatctagg

SEQ ID NO: 347949 - DNA, 25 bp, Homo sapien
ggcttgagaatctaggcagatgtca

SEQ ID NO: 347950 - DNA, 25 bp, Homo sapien
gcagatgtcagaggtctgtccctat

SEQ ID NO: 347951 - DNA, 25 bp, Homo sapien
agaggtctgtccctatgtttctttc

SEQ ID NO: 347952 - DNA, 25 bp, Homo sapien
gtttctttcaagctggcaagaattc

SEQ ID NO: 347953 - DNA, 25 bp, Homo sapien
gatacttcttacatctcagttctgt

SEQ ID NO: 347954 - DNA, 25 bp, Homo sapien
gaagaaactcaaacccattgtgtaa

SEQ ID NO: 347955 - DNA, 25 bp, Homo sapien
acccattgtgtaattctttcacttg

SEQ ID NO: 347956 - DNA, 25 bp, Homo sapien
atagtcatggtcatcagctcattct

SEQ ID NO: 347957 - DNA, 25 bp, Homo sapien
gctcattctgagcaggagtgctaat

SEQ ID NO: 347958 - DNA, 25 bp, Homo sapien
gaaggatgtgtgtctgtcaagtcca

SEQ ID NO: 347959 - DNA, 25 bp, Homo sapien
aagtccaggctgcttcatacaactc

SEQ ID NO: 347960 - DNA, 25 bp, Homo sapien
ttcatacaactcttgtgcactccac

SEQ ID NO: 347961 - DNA, 25 bp, Homo sapien
gacctgaaattcttatacgctccaa

SEQ ID NO: 347962 - DNA, 25 bp, Homo sapien
aattcttatacgctccaaggagatg

SEQ ID NO: 347963 - DNA, 25 bp, Homo sapien
gaggttcagagccagtctaatttga

SEQ ID NO: 347964 - DNA, 25 bp, Homo sapien
gggcaagacatgactggctcaggat

SEQ ID NO: 347965 - DNA, 25 bp, Homo sapien
tcaggatggcctgtcacccaagttg

SEQ ID NO: 347966 - DNA, 25 bp, Homo sapien
tgtcacccaagttgcctcaaagaag

SEQ ID NO: 347967 - DNA, 25 bp, Homo sapien
agggacatcagtgcagtcggatgca

SEQ ID NO: 347968 - DNA, 25 bp, Homo sapien
gtaggttttggtaagtgcacacgtg

SEQ ID NO: 347969 - DNA, 25 bp, Homo sapien
tgcacacgtgtgtgtacctgccctt

SEQ ID NO: 347970 - DNA, 25 bp, Homo sapien
acctcacaggagagaccaacccaca

SEQ ID NO: 347971 - DNA, 25 bp, Homo sapien
cctgtaactctacccactgtgggtt

SEQ ID NO: 347972 - DNA, 25 bp, Homo sapien
tgtaactctacccactgtgggtttc

SEQ ID NO: 347973 - DNA, 25 bp, Homo sapien
taactctacccactgtgggtttcct

SEQ ID NO: 347974 - DNA, 25 bp, Homo sapien
tgtgggtttcctccttgccaccctt

SEQ ID NO: 347975 - DNA, 25 bp, Homo sapien
ttacaacaataattttgccccattg

SEQ ID NO: 347976 - DNA, 25 bp, Homo sapien
gataggaacaaagttggcatgtcaa

SEQ ID NO: 347977 - DNA, 25 bp, Homo sapien
tagttacctaaattgtggtttcatt

SEQ ID NO: 347978 - DNA, 25 bp, Homo sapien
gtttcattttactcaccagaccata

SEQ ID NO: 347979 - DNA, 25 bp, Homo sapien
tactcaccagaccatattaagctgt

SEQ ID NO: 347980 - DNA, 25 bp, Homo sapien
gaaattggtgacagacaacactgat

SEQ ID NO: 347981 - DNA, 25 bp, Homo sapien
acactgataagtgggcattggcagc

SEQ ID NO: 347982 - DNA, 25 bp, Homo sapien
gtgggcattggcagcactaatagtt

SEQ ID NO: 347983 - DNA, 25 bp, Homo sapien
gcactaatagttatttgttgctgac

SEQ ID NO: 347984 - DNA, 25 bp, Homo sapien
aacatctgcatattcctaaagtact

SEQ ID NO: 347985 - DNA, 25 bp, Homo sapien
acttgtttcttgagattagtcaaca

SEQ ID NO: 347986 - DNA, 25 bp, Homo sapien
tgaaaagtctcccactcctgtctct

SEQ ID NO: 347987 - DNA, 25 bp, Homo sapien
tataattttttaggcagtcccttat

SEQ ID NO: 347988 - DNA, 25 bp, Homo sapien
ggcagtcccttatttgtgaacatgt

SEQ ID NO: 347989 - DNA, 25 bp, Homo sapien
gaacatgtaggttgttcctaatctt

SEQ ID NO: 347990 - DNA, 25 bp, Homo sapien
gatacctattttgcacatttgtgag

SEQ ID NO: 347991 - DNA, 25 bp, Homo sapien
gcacatttgtgagtatacctgtaga

SEQ ID NO: 347992 - DNA, 25 bp, Homo sapien
tcctgtctcttagccactcagtttt

SEQ ID NO: 347993 - DNA, 25 bp, Homo sapien
tcttagccactcagttttccctctt

SEQ ID NO: 347994 - DNA, 25 bp, Homo sapien
tccctcttgaatgtagccaaggtta

SEQ ID NO: 347995 - DNA, 25 bp, Homo sapien
gtagccaaggttactaatgcataga

SEQ ID NO: 347996 - DNA, 25 bp, Homo sapien
atgttatgcgtatacaaggatgtac

SEQ ID NO: 347997 - DNA, 25 bp, Homo sapien
tagaattaacacgagcatgtcagaa

SEQ ID NO: 347998 - DNA, 25 bp, Homo sapien
gaattaacacgagcatgtcagaagc

SEQ ID NO: 347999 - DNA, 25 bp, Homo sapien
ttaacacgagcatgtcagaagcaat

SEQ ID NO: 348000 - DNA, 25 bp, Homo sapien
aacacgagcatgtcagaagcaatat

SEQ ID NO: 348001 - DNA, 25 bp, Homo sapien
cgagcatgtcagaagcaatatgagc

SEQ ID NO: 348002 - DNA, 25 bp, Homo sapien
tgtcagaagcaatatgagctggaac

SEQ ID NO: 348003 - DNA, 25 bp, Homo sapien
gagctggaacaggaattggcctttt

SEQ ID NO: 348004 - DNA, 25 bp, Homo sapien
gctggaacaggaattggccttttat

SEQ ID NO: 348005 - DNA, 25 bp, Homo sapien
tggaacaggaattggccttttataa

SEQ ID NO: 348006 - DNA, 25 bp, Homo sapien
ggccttttataaaattgatgctaaa

SEQ ID NO: 348007 - DNA, 25 bp, Homo sapien
aattgatgctaaatttgagccacta

SEQ ID NO: 348008 - DNA, 25 bp, Homo sapien
cacagctgggcctgcgttactgcgg

SEQ ID NO: 348009 - DNA, 25 bp, Homo sapien
gttactgcggccgagtttcagcagc

SEQ ID NO: 348010 - DNA, 25 bp, Homo sapien
tcagcagctgtgatgtgggtgctaa

SEQ ID NO: 348011 - DNA, 25 bp, Homo sapien
gggctcacccctgacaaaggagcat

SEQ ID NO: 348012 - DNA, 25 bp, Homo sapien
gcaaacattgcagtttagtaactag

SEQ ID NO: 348013 - DNA, 25 bp, Homo sapien
ctaatagttttctcagtgctgcttg

SEQ ID NO: 348014 - DNA, 25 bp, Homo sapien
gtgctgcttgcgcaaagctggtaat

SEQ ID NO: 348015 - DNA, 25 bp, Homo sapien
catgatgctggcaattgggtattga

SEQ ID NO: 348016 - DNA, 25 bp, Homo sapien
gcagagagctggcactcagccagat

SEQ ID NO: 348017 - DNA, 25 bp, Homo sapien
agccagatgggcttcacttgggcag

SEQ ID NO: 348018 - DNA, 25 bp, Homo sapien
tcacttgggcaggaaagacacccac

SEQ ID NO: 348019 - DNA, 25 bp, Homo sapien
ttatgtctactttaaatagttcttt

SEQ ID NO: 348020 - DNA, 25 bp, Homo sapien
tagttcttttctatgtagcaggcat

SEQ ID NO: 348021 - DNA, 25 bp, Homo sapien
gcatagagaactttatccaaactga

SEQ ID NO: 348022 - DNA, 25 bp, Homo sapien
gaactttatccaaactgaatcttgt

SEQ ID NO: 348023 - DNA, 25 bp, Homo sapien
tccaaactgaatcttgtatgtacat

SEQ ID NO: 348024 - DNA, 25 bp, Homo sapien
gtatgcatttggctgtggattcttc

SEQ ID NO: 348025 - DNA, 25 bp, Homo sapien
gcatttggctgtggattcttcataa

SEQ ID NO: 348026 - DNA, 25 bp, Homo sapien
ggctgtggattcttcataattaatg

SEQ ID NO: 348027 - DNA, 25 bp, Homo sapien
tggagacaacccaaatgtaaaaagt

SEQ ID NO: 348028 - DNA, 25 bp, Homo sapien
atgcaaaaagtgtagtaggctggta

SEQ ID NO: 348029 - DNA, 25 bp, Homo sapien
aggctggtatttttgacctaagcaa

SEQ ID NO: 348030 - DNA, 25 bp, Homo sapien
ggaaatacccgggacccacaggcag

SEQ ID NO: 348031 - DNA, 25 bp, Homo sapien
gggacccacaggcagctgtgataac

SEQ ID NO: 348032 - DNA, 25 bp, Homo sapien
caggcagctgtgataactgatgtta

SEQ ID NO: 348033 - DNA, 25 bp, Homo sapien
ttaagagaaccgcaacaggcagtgt

SEQ ID NO: 348034 - DNA, 25 bp, Homo sapien
aacaggcagtgtgtgagctccggca

SEQ ID NO: 348035 - DNA, 25 bp, Homo sapien
gtgagctccggcacgtacttctcag

SEQ ID NO: 348036 - DNA, 25 bp, Homo sapien
ctcagcctcatgtaagtggcccata

SEQ ID NO: 348037 - DNA, 25 bp, Homo sapien
gtggcccataataactacagcttca

SEQ ID NO: 348038 - DNA, 25 bp, Homo sapien
tacagcttcagcagacaactaaaga

SEQ ID NO: 348039 - DNA, 25 bp, Homo sapien
taaggtgatttctctggctataaag

SEQ ID NO: 348040 - DNA, 25 bp, Homo sapien
ggctataaagagagcccggcctgca

SEQ ID NO: 348041 - DNA, 25 bp, Homo sapien
agggaatggcaaaggcccagtgcaa

SEQ ID NO: 348042 - DNA, 25 bp, Homo sapien
gcaaaccccaccttgcctgtaaagg

SEQ ID NO: 348043 - DNA, 25 bp, Homo sapien
tgtaaaggtggtcccttacccacag

SEQ ID NO: 348044 - DNA, 25 bp, Homo sapien
tcttaccttacattacccttccatt

SEQ ID NO: 348045 - DNA, 25 bp, Homo sapien
agccagaactgggacgtggatttca

SEQ ID NO: 348046 - DNA, 25 bp, Homo sapien
acgtggatttcaaagcctatgccct

SEQ ID NO: 348047 - DNA, 25 bp, Homo sapien
aaagcctatgccctttccacggctt

SEQ ID NO: 348048 - DNA, 25 bp, Homo sapien
acggctttcccaggttgtggtcatg

SEQ ID NO: 348049 - DNA, 25 bp, Homo sapien
tggtcatgtaccactctttatgcat

SEQ ID NO: 348050 - DNA, 25 bp, Homo sapien
tatgccactggaactaggaaagaaa

SEQ ID NO: 348051 - DNA, 25 bp, Homo sapien
gaaaggctctccataattcctaggt

SEQ ID NO: 348052 - DNA, 25 bp, Homo sapien
gtcgtcttgtgtttgaatcttctgc

SEQ ID NO: 348053 - DNA, 25 bp, Homo sapien
gtttgaatcttctgcaggacacgtt

SEQ ID NO: 348054 - DNA, 25 bp, Homo sapien
gaatcttctgcaggacacgttagcg

SEQ ID NO: 348055 - DNA, 25 bp, Homo sapien
ggcatctacagcaggtataacggtc

SEQ ID NO: 348056 - DNA, 25 bp, Homo sapien
ggtataacggtcagcatgtccttgt

SEQ ID NO: 348057 - DNA, 25 bp, Homo sapien
aacggtcagcatgtccttgtgtgca

SEQ ID NO: 348058 - DNA, 25 bp, Homo sapien
gtgcaaagggcagccttgctcttaa

SEQ ID NO: 348059 - DNA, 25 bp, Homo sapien
agccttgctcttaagctttccaaaa

SEQ ID NO: 348060 - DNA, 25 bp, Homo sapien
aaaagaatttccacagctgagggaa

SEQ ID NO: 348061 - DNA, 25 bp, Homo sapien
cagcgctgccctctagtgatctcag

SEQ ID NO: 348062 - DNA, 25 bp, Homo sapien
agtgatctcagctcagcatatgcac

SEQ ID NO: 348063 - DNA, 25 bp, Homo sapien
ggtgctatcctctccaagagaaact

SEQ ID NO: 348064 - DNA, 25 bp, Homo sapien
gttgcccaacttcttagttatttca

SEQ ID NO: 348065 - DNA, 25 bp, Homo sapien
agttatttcacgctgtaatacagat

SEQ ID NO: 348066 - DNA, 25 bp, Homo sapien
tcatcttcatcatctgctgttccat

SEQ ID NO: 348067 - DNA, 25 bp, Homo sapien
catcatctgctgttccatctattga

SEQ ID NO: 348068 - DNA, 25 bp, Homo sapien
catgtagtactgacgctggaataaa

SEQ ID NO: 348069 - DNA, 25 bp, Homo sapien
gttccatctattgatttgttcactt

SEQ ID NO: 348070 - DNA, 25 bp, Homo sapien
gttcacttgtttaataagagcactg

SEQ ID NO: 348071 - DNA, 25 bp, Homo sapien
ataagagcactgatagattcggtat

SEQ ID NO: 348072 - DNA, 25 bp, Homo sapien
gattcggtatctatgtgcacaggtg

SEQ ID NO: 348073 - DNA, 25 bp, Homo sapien
tgtgcacaggtgctatcctctccaa

SEQ ID NO: 348074 - DNA, 25 bp, Homo sapien
tgagcgctgcgtttgggaaactgca

SEQ ID NO: 348075 - DNA, 25 bp, Homo sapien
attccagggcagcaagactggtgcc

SEQ ID NO: 348076 - DNA, 25 bp, Homo sapien
agcaagactggtgccaagacggagt

SEQ ID NO: 348077 - DNA, 25 bp, Homo sapien
agacggagtcgtggcaaaagcatcc

SEQ ID NO: 348078 - DNA, 25 bp, Homo sapien
aaagcatccggaggtcttccttaat

SEQ ID NO: 348079 - DNA, 25 bp, Homo sapien
ggtcttccttaatatatgtcagcag

SEQ ID NO: 348080 - DNA, 25 bp, Homo sapien
gggtgatgtcacaaccatataacgc

SEQ ID NO: 348081 - DNA, 25 bp, Homo sapien
aatacagaccgagaacaaggccatg

SEQ ID NO: 348082 - DNA, 25 bp, Homo sapien
aggcagagactgaagttgtaccacc

SEQ ID NO: 348083 - DNA, 25 bp, Homo sapien
atataacgcagctccttcagccgac

SEQ ID NO: 348084 - DNA, 25 bp, Homo sapien
cgcaagaactgagacctgacggata

SEQ ID NO: 348085 - DNA, 25 bp, Homo sapien
gaaccaagtggccaaagaaactctt

SEQ ID NO: 348086 - DNA, 25 bp, Homo sapien
gaaactctttctaactttggcaaca

SEQ ID NO: 348087 - DNA, 25 bp, Homo sapien
gcaacatcagaacttgccacatgta

SEQ ID NO: 348088 - DNA, 25 bp, Homo sapien
gaaggtgctggtcattccatttctt

SEQ ID NO: 348089 - DNA, 25 bp, Homo sapien
ggtcattccatttcttttgtttgaa

SEQ ID NO: 348090 - DNA, 25 bp, Homo sapien
gctaaagagatgtgtagctcacagg

SEQ ID NO: 348091 - DNA, 25 bp, Homo sapien
gggctaccttaccagtataaagagc

SEQ ID NO: 348092 - DNA, 25 bp, Homo sapien
aagagctgataacagtactcagaag

SEQ ID NO: 348093 - DNA, 25 bp, Homo sapien
gaaaatgggttcaatgtagactgcc

SEQ ID NO: 348094 - DNA, 25 bp, Homo sapien
actgccattatgtgtggtcttccca

SEQ ID NO: 348095 - DNA, 25 bp, Homo sapien
atgtgtggtcttcccattaaatgtg

SEQ ID NO: 348096 - DNA, 25 bp, Homo sapien
agaggctggagcttcccttgagcgt

SEQ ID NO: 348097 - DNA, 25 bp, Homo sapien
tcccttgagcgtaggaagcccagtt

SEQ ID NO: 348098 - DNA, 25 bp, Homo sapien
gaagcccagttttgcatttgatgaa

SEQ ID NO: 348099 - DNA, 25 bp, Homo sapien
cacaggaagacagtggtgacccatc

SEQ ID NO: 348100 - DNA, 25 bp, Homo sapien
tcacatgtcacaaaggccgggaggt

SEQ ID NO: 348101 - DNA, 25 bp, Homo sapien
gggctgaagaccctcaaagccctgt

SEQ ID NO: 348102 - DNA, 25 bp, Homo sapien
cctgttatttcaaggcaatctgctg

SEQ ID NO: 348103 - DNA, 25 bp, Homo sapien
tgcaagcagggccacgttcagaaat

SEQ ID NO: 348104 - DNA, 25 bp, Homo sapien
cagaaatcatctttccatcctttgg

SEQ ID NO: 348105 - DNA, 25 bp, Homo sapien
tgtctgccaatcactggctcttgtg

SEQ ID NO: 348106 - DNA, 25 bp, Homo sapien
aagtggtcagcatatcgggagcccc

SEQ ID NO: 348107 - DNA, 25 bp, Homo sapien
tctcgcacaggccattctgggtctg

SEQ ID NO: 348108 - DNA, 25 bp, Homo sapien
cacaggccattctgggtctggtggt

SEQ ID NO: 348109 - DNA, 25 bp, Homo sapien
tgccaggtgccgtgacacgccgtgc

SEQ ID NO: 348110 - DNA, 25 bp, Homo sapien
ccgtgacacgccgtgctgggcttgt

SEQ ID NO: 348111 - DNA, 25 bp, Homo sapien
tggtgtggccctcattctcatgttc

SEQ ID NO: 348112 - DNA, 25 bp, Homo sapien
gctgcgtgtgctgccgtggatctcc

SEQ ID NO: 348113 - DNA, 25 bp, Homo sapien
gtgtgctgccgtggatctcctgcat

SEQ ID NO: 348114 - DNA, 25 bp, Homo sapien
tgccgtggatctcctgcatcccttg

SEQ ID NO: 348115 - DNA, 25 bp, Homo sapien
tcccgccatcagaggaaaggctgct

SEQ ID NO: 348116 - DNA, 25 bp, Homo sapien
tcagtgtggcactcctcgtcaaaga

SEQ ID NO: 348117 - DNA, 25 bp, Homo sapien
gtgtggcactcctcgtcaaagaaaa

SEQ ID NO: 348118 - DNA, 25 bp, Homo sapien
gaaaccaaagcgttcacagttagat

SEQ ID NO: 348119 - DNA, 25 bp, Homo sapien
gttagattttcaccttgtgccactc

SEQ ID NO: 348120 - DNA, 25 bp, Homo sapien
tagattttcaccttgtgccactctc

SEQ ID NO: 348121 - DNA, 25 bp, Homo sapien
ttttcaccttgtgccactctctttt

SEQ ID NO: 348122 - DNA, 25 bp, Homo sapien
ttgagcatctatgggcagccacagc

SEQ ID NO: 348123 - DNA, 25 bp, Homo sapien
atgggcagccacagcgaccagtcta

SEQ ID NO: 348124 - DNA, 25 bp, Homo sapien
agcgaccagtctagtcccagacagc

SEQ ID NO: 348125 - DNA, 25 bp, Homo sapien
cacaggtcaagcagcgtgggactgt

SEQ ID NO: 348126 - DNA, 25 bp, Homo sapien
tggtgctgcccccttagcccagaag

SEQ ID NO: 348127 - DNA, 25 bp, Homo sapien
agaagccctgccaggtccagtggcc

SEQ ID NO: 348128 - DNA, 25 bp, Homo sapien
gggtcccactgctgagggcacctgc

SEQ ID NO: 348129 - DNA, 25 bp, Homo sapien
attatgaatcgggtttagtctctcc

SEQ ID NO: 348130 - DNA, 25 bp, Homo sapien
tgaatcgggtttagtctctcccaag

SEQ ID NO: 348131 - DNA, 25 bp, Homo sapien
ggtttagtctctcccaaggcaggaa

SEQ ID NO: 348132 - DNA, 25 bp, Homo sapien
agtctctcccaaggcaggaagtttt

SEQ ID NO: 348133 - DNA, 25 bp, Homo sapien
ggcaggaagttttcaagtattacat

SEQ ID NO: 348134 - DNA, 25 bp, Homo sapien
tacattttttaatacacagcaggtg

SEQ ID NO: 348135 - DNA, 25 bp, Homo sapien
acacagcaggtggattttgtctgaa

SEQ ID NO: 348136 - DNA, 25 bp, Homo sapien
gaaagatagttttatgccaggatat

SEQ ID NO: 348137 - DNA, 25 bp, Homo sapien
ttatgccaggatattgtacttgttt

SEQ ID NO: 348138 - DNA, 25 bp, Homo sapien
gtacttgtttcactattgaactaca

SEQ ID NO: 348139 - DNA, 25 bp, Homo sapien
tcactattgaactacagaaccttag

SEQ ID NO: 348140 - DNA, 25 bp, Homo sapien
gacagaaatgactaatacaggtatt

SEQ ID NO: 348141 - DNA, 25 bp, Homo sapien
ctaatacaggtatttggcctcaagg

SEQ ID NO: 348142 - DNA, 25 bp, Homo sapien
ctagcaattctggtaagcagtatgt

SEQ ID NO: 348143 - DNA, 25 bp, Homo sapien
gagcacttaacttcatcagagagca

SEQ ID NO: 348144 - DNA, 25 bp, Homo sapien
cagagagcatggttgaaggtgtatc

SEQ ID NO: 348145 - DNA, 25 bp, Homo sapien
atggttgaaggtgtatctgtgtgta

SEQ ID NO: 348146 - DNA, 25 bp, Homo sapien
gttggtgataattagaaggcttccc

SEQ ID NO: 348147 - DNA, 25 bp, Homo sapien
taattagaaggcttccctaaagagg

SEQ ID NO: 348148 - DNA, 25 bp, Homo sapien
gggttgagccataaagatcaagtag

SEQ ID NO: 348149 - DNA, 25 bp, Homo sapien
caagtagatacaagtgggcatgaag

SEQ ID NO: 348150 - DNA, 25 bp, Homo sapien
tgaagctagtattttgctgccagtc

SEQ ID NO: 348151 - DNA, 25 bp, Homo sapien
cgaggcaccgcttccctgtgcggcg

SEQ ID NO: 348152 - DNA, 25 bp, Homo sapien
gaggcaccgcttccctgtgcggcgc

SEQ ID NO: 348153 - DNA, 25 bp, Homo sapien
gcaccgcttccctgtgcggcgctgc

SEQ ID NO: 348154 - DNA, 25 bp, Homo sapien
caccgcttccctgtgcggcgctgca

SEQ ID NO: 348155 - DNA, 25 bp, Homo sapien
cttccctgtgcggcgctgcagaggg

SEQ ID NO: 348156 - DNA, 25 bp, Homo sapien
cctcagtgtggcactcctcgtcaaa

SEQ ID NO: 348157 - DNA, 25 bp, Homo sapien
ctcagtgtggcactcctcgtcaaag

SEQ ID NO: 348158 - DNA, 25 bp, Homo sapien
tcagtgtggcactcctcgtcaaaga

SEQ ID NO: 348159 - DNA, 25 bp, Homo sapien
cagtgtggcactcctcgtcaaagaa

SEQ ID NO: 348160 - DNA, 25 bp, Homo sapien
agtgtggcactcctcgtcaaagaaa

SEQ ID NO: 348161 - DNA, 25 bp, Homo sapien
gtgtggcactcctcgtcaaagaaaa

SEQ ID NO: 348162 - DNA, 25 bp, Homo sapien
tactatattgtattgcaacttggca

SEQ ID NO: 348163 - DNA, 25 bp, Homo sapien
tgtattgcaacttggcattttcaaa

SEQ ID NO: 348164 - DNA, 25 bp, Homo sapien
atatcacagtatttttccatacgta

SEQ ID NO: 348165 - DNA, 25 bp, Homo sapien
cacagtatttttccatacgtatttt

SEQ ID NO: 348166 - DNA, 25 bp, Homo sapien
tatttttaagcgtaacttctcttat

SEQ ID NO: 348167 - DNA, 25 bp, Homo sapien
acccagccatttttccatattcatg

SEQ ID NO: 348168 - DNA, 25 bp, Homo sapien
agccatttttccatattcatgtgaa

SEQ ID NO: 348169 - DNA, 25 bp, Homo sapien
atattcatgtgaacagacctgccac

SEQ ID NO: 348170 - DNA, 25 bp, Homo sapien
gtgaacagacctgccacactaagtg

SEQ ID NO: 348171 - DNA, 25 bp, Homo sapien
aacagacctgccacactaagtgttt

SEQ ID NO: 348172 - DNA, 25 bp, Homo sapien
agacctgccacactaagtgttttaa

SEQ ID NO: 348173 - DNA, 25 bp, Homo sapien
ttctaatcgtagttctctgcaagtg

SEQ ID NO: 348174 - DNA, 25 bp, Homo sapien
gtagttctctgcaagtgtacttaag

SEQ ID NO: 348175 - DNA, 25 bp, Homo sapien
gtacttaagttattgctccacttga

SEQ ID NO: 348176 - DNA, 25 bp, Homo sapien
aagttattgctccacttgaaataaa

SEQ ID NO: 348177 - DNA, 25 bp, Homo sapien
ggtgatgaattatgggtccctttta

SEQ ID NO: 348178 - DNA, 25 bp, Homo sapien
tatgggtcccttttatgtaagaaag

SEQ ID NO: 348179 - DNA, 25 bp, Homo sapien
gacaaggaaatctaatctgctgagt

SEQ ID NO: 348180 - DNA, 25 bp, Homo sapien
ctaatctgctgagttatactaaaat

SEQ ID NO: 348181 - DNA, 25 bp, Homo sapien
atattttatgatttcctgatataac

SEQ ID NO: 348182 - DNA, 25 bp, Homo sapien
gtgttgataaaagcacccaatactg

SEQ ID NO: 348183 - DNA, 25 bp, Homo sapien
aagcacccaatactgattctaatga

SEQ ID NO: 348184 - DNA, 25 bp, Homo sapien
tctgttttgcatttgtgtgcaggtt

SEQ ID NO: 348185 - DNA, 25 bp, Homo sapien
cctgtcctctttgctctagagatga

SEQ ID NO: 348186 - DNA, 25 bp, Homo sapien
catttgtgtgcaggttaattcccta

SEQ ID NO: 348187 - DNA, 25 bp, Homo sapien
aaagtggcacagcaagtaggcagca

SEQ ID NO: 348188 - DNA, 25 bp, Homo sapien
tggcacagcaagtaggcagcagagc

SEQ ID NO: 348189 - DNA, 25 bp, Homo sapien
agagctggagctagaaaccatttcc

SEQ ID NO: 348190 - DNA, 25 bp, Homo sapien
tagaaaccatttccagcttcgagtc

SEQ ID NO: 348191 - DNA, 25 bp, Homo sapien
accatttccagcttcgagtccaggg

SEQ ID NO: 348192 - DNA, 25 bp, Homo sapien
agcttcgagtccagggctgttccta

SEQ ID NO: 348193 - DNA, 25 bp, Homo sapien
ggctgttcctaaaccccactggact

SEQ ID NO: 348194 - DNA, 25 bp, Homo sapien
gggtacgagaaagaggacccagaca

SEQ ID NO: 348195 - DNA, 25 bp, Homo sapien
tcatgcgcacaatcattgagtttct

SEQ ID NO: 348196 - DNA, 25 bp, Homo sapien
cgcacaatcattgagtttctgtctt

SEQ ID NO: 348197 - DNA, 25 bp, Homo sapien
caatcattgagtttctgtctttctt

SEQ ID NO: 348198 - DNA, 25 bp, Homo sapien
atcattgagtttctgtctttcttgc

SEQ ID NO: 348199 - DNA, 25 bp, Homo sapien
attgagtttctgtctttcttgcatc

SEQ ID NO: 348200 - DNA, 25 bp, Homo sapien
gagtttctgtctttcttgcatctca

SEQ ID NO: 348201 - DNA, 25 bp, Homo sapien
gtttctgtctttcttgcatctcaaa

SEQ ID NO: 348202 - DNA, 25 bp, Homo sapien
tctgtctttcttgcatctcaaagag

SEQ ID NO: 348203 - DNA, 25 bp, Homo sapien
tttcttgcatctcaaagaggccggt

SEQ ID NO: 348204 - DNA, 25 bp, Homo sapien
tcttgcatctcaaagaggccggtgc

SEQ ID NO: 348205 - DNA, 25 bp, Homo sapien
tgcatctcaaagaggccggtgccct

SEQ ID NO: 348206 - DNA, 25 bp, Homo sapien
agtgatctctggaagcgctaaagct

SEQ ID NO: 348207 - DNA, 25 bp, Homo sapien
ttctgttcttgaaacacttcagctt

SEQ ID NO: 348208 - DNA, 25 bp, Homo sapien
atgataaacactactcagtccacca

SEQ ID NO: 348209 - DNA, 25 bp, Homo sapien
tactcagtccaccaacaacaaacgt

SEQ ID NO: 348210 - DNA, 25 bp, Homo sapien
acgtgtttgaattcaccttaccaat

SEQ ID NO: 348211 - DNA, 25 bp, Homo sapien
caccttaccaatattaatcccagcg

SEQ ID NO: 348212 - DNA, 25 bp, Homo sapien
attaatcccagcgtgtgtaaaacag

SEQ ID NO: 348213 - DNA, 25 bp, Homo sapien
gaacagtaactctatgtgaccccag

SEQ ID NO: 348214 - DNA, 25 bp, Homo sapien
gtgaccccagataacattttgtaac

SEQ ID NO: 348215 - DNA, 25 bp, Homo sapien
attttgtaacattgtgcttccttgt

SEQ ID NO: 348216 - DNA, 25 bp, Homo sapien
cattgtgcttccttgtagtttgtaa

SEQ ID NO: 348217 - DNA, 25 bp, Homo sapien
gaaaattctgacactggctacagca

SEQ ID NO: 348218 - DNA, 25 bp, Homo sapien
ttctgacactggctacagcatgaat

SEQ ID NO: 348219 - DNA, 25 bp, Homo sapien
ctggctacagcatgaatgaaccttg

SEQ ID NO: 348220 - DNA, 25 bp, Homo sapien
ccttgaggacgttatgcagttttac

SEQ ID NO: 348221 - DNA, 25 bp, Homo sapien
gacgttatgcagttttacaggatga

SEQ ID NO: 348222 - DNA, 25 bp, Homo sapien
gttttacaggatgagttatggagct

SEQ ID NO: 348223 - DNA, 25 bp, Homo sapien
gatggtggcacattaaggatgtatt

SEQ ID NO: 348224 - DNA, 25 bp, Homo sapien
aatactgttcttaaatggtacactt

SEQ ID NO: 348225 - DNA, 25 bp, Homo sapien
aaacatagaagcagcccaatcggcc

SEQ ID NO: 348226 - DNA, 25 bp, Homo sapien
agcccaatcggccatcagtagatga

SEQ ID NO: 348227 - DNA, 25 bp, Homo sapien
atcggccatcagtagatgaatggat

SEQ ID NO: 348228 - DNA, 25 bp, Homo sapien
ttggcaaaacctgaagggtgtgttc

SEQ ID NO: 348229 - DNA, 25 bp, Homo sapien
tggcaaaacctgaagggtgtgttcg

SEQ ID NO: 348230 - DNA, 25 bp, Homo sapien
ggcaaaacctgaagggtgtgttcgt

SEQ ID NO: 348231 - DNA, 25 bp, Homo sapien
gcaaaacctgaagggtgtgttcgtg

SEQ ID NO: 348232 - DNA, 25 bp, Homo sapien
caaaacctgaagggtgtgttcgtgg

SEQ ID NO: 348233 - DNA, 25 bp, Homo sapien
cctgaagggtgtgttcgtggggtga

SEQ ID NO: 348234 - DNA, 25 bp, Homo sapien
ctgaagggtgtgttcgtggggtgat

SEQ ID NO: 348235 - DNA, 25 bp, Homo sapien
gaagggtgtgttcgtggggtgatga

SEQ ID NO: 348236 - DNA, 25 bp, Homo sapien
aagggtgtgttcgtggggtgatgag

SEQ ID NO: 348237 - DNA, 25 bp, Homo sapien
agggtgtgttcgtggggtgatgagg

SEQ ID NO: 348238 - DNA, 25 bp, Homo sapien
acctgtgatctgtgcatctggccag

SEQ ID NO: 348239 - DNA, 25 bp, Homo sapien
gccagtgggagaatgcttgccttgc

SEQ ID NO: 348240 - DNA, 25 bp, Homo sapien
ttgccttgcatttgcacatccagaa

SEQ ID NO: 348241 - DNA, 25 bp, Homo sapien
gcatttgcacatccagaatgactaa

SEQ ID NO: 348242 - DNA, 25 bp, Homo sapien
gaatagccaccgagatgctcagaga

SEQ ID NO: 348243 - DNA, 25 bp, Homo sapien
gaaaatgagtttgtcaacgccctct

SEQ ID NO: 348244 - DNA, 25 bp, Homo sapien
tttgtcaacgccctctcttttctat

SEQ ID NO: 348245 - DNA, 25 bp, Homo sapien
ttctatccctttacctttgaggtca

SEQ ID NO: 348246 - DNA, 25 bp, Homo sapien
cagggacagggcatattactgacac

SEQ ID NO: 348247 - DNA, 25 bp, Homo sapien
atattactgacaccccactggctat

SEQ ID NO: 348248 - DNA, 25 bp, Homo sapien
tggctattgccctatacctgccaat

SEQ ID NO: 348249 - DNA, 25 bp, Homo sapien
gaaagctcaattcactgtagcaact

SEQ ID NO: 348250 - DNA, 25 bp, Homo sapien
attatgctgaacatttagggccagt

SEQ ID NO: 348251 - DNA, 25 bp, Homo sapien
tagggccagtatgtgtaactgacat

SEQ ID NO: 348252 - DNA, 25 bp, Homo sapien
ggacagttgtactcacttttgctgg

SEQ ID NO: 348253 - DNA, 25 bp, Homo sapien
gcctcgggtctcagtcctggagcta

SEQ ID NO: 348254 - DNA, 25 bp, Homo sapien
gtctcagtcctggagctatctacag

SEQ ID NO: 348255 - DNA, 25 bp, Homo sapien
gtcctggagctatctacagtatgtt

SEQ ID NO: 348256 - DNA, 25 bp, Homo sapien
ggagctatctacagtatgttaccag

SEQ ID NO: 348257 - DNA, 25 bp, Homo sapien
atctacagtatgttaccagcgagta

SEQ ID NO: 348258 - DNA, 25 bp, Homo sapien
cagtatgttaccagcgagtaagaat

SEQ ID NO: 348259 - DNA, 25 bp, Homo sapien
attatttggacccaaagaagcatag

SEQ ID NO: 348260 - DNA, 25 bp, Homo sapien
gaataatagcttctacttgcttttc

SEQ ID NO: 348261 - DNA, 25 bp, Homo sapien
gcatgctgagcaaaatgcttacgcc

SEQ ID NO: 348262 - DNA, 25 bp, Homo sapien
aaatgcttacgccaagcctgttttt

SEQ ID NO: 348263 - DNA, 25 bp, Homo sapien
cttacgccaagcctgtttttctctg

SEQ ID NO: 348264 - DNA, 25 bp, Homo sapien
caagcctgtttttctctgcagagta

SEQ ID NO: 348265 - DNA, 25 bp, Homo sapien
ttctctgcagagtaaacaggatgtt

SEQ ID NO: 348266 - DNA, 25 bp, Homo sapien
atgttttcagcagacttggctctaa

SEQ ID NO: 348267 - DNA, 25 bp, Homo sapien
tttcagcagacttggctctaatagc

SEQ ID NO: 348268 - DNA, 25 bp, Homo sapien
ggctctaatagccatctctaagatt

SEQ ID NO: 348269 - DNA, 25 bp, Homo sapien
atagccatctctaagattagggaac

SEQ ID NO: 348270 - DNA, 25 bp, Homo sapien
gattagggaacaattgagtctttat

SEQ ID NO: 348271 - DNA, 25 bp, Homo sapien
tatattctgccatcttgactcttct

SEQ ID NO: 348272 - DNA, 25 bp, Homo sapien
taggatacagtctacaccttgcttt

SEQ ID NO: 348273 - DNA, 25 bp, Homo sapien
ccttgcttttttcagtgtcttggag

SEQ ID NO: 348274 - DNA, 25 bp, Homo sapien
cagtgtcttggagatggctttctat

SEQ ID NO: 348275 - DNA, 25 bp, Homo sapien
gatggctttctattagcctgtaaga

SEQ ID NO: 348276 - DNA, 25 bp, Homo sapien
gcctgtaagatctacctcatttttt

SEQ ID NO: 348277 - DNA, 25 bp, Homo sapien
cactgctttgtgatatccattgtat

SEQ ID NO: 348278 - DNA, 25 bp, Homo sapien
gaatgtaccataattcatacagtcc

SEQ ID NO: 348279 - DNA, 25 bp, Homo sapien
tgttgatgggcctctaggttctttt

SEQ ID NO: 348280 - DNA, 25 bp, Homo sapien
tgtgccaaatatccccgcacactgt

SEQ ID NO: 348281 - DNA, 25 bp, Homo sapien
acactgtccctggataaattgatga

SEQ ID NO: 348282 - DNA, 25 bp, Homo sapien
agcatttacaacgttatgtatcccc

SEQ ID NO: 348283 - DNA, 25 bp, Homo sapien
atcacattagattatccctcagggt

SEQ ID NO: 348284 - DNA, 25 bp, Homo sapien
gattatccctcagggtgacaccaaa

SEQ ID NO: 348285 - DNA, 25 bp, Homo sapien
gacaccaaagcacccagacagattt

SEQ ID NO: 348286 - DNA, 25 bp, Homo sapien
gtcaaatgtaaaccctggaacctga

SEQ ID NO: 348287 - DNA, 25 bp, Homo sapien
tggaacctgagtcccaagaaatggt

SEQ ID NO: 348288 - DNA, 25 bp, Homo sapien
gggtaaaccacagtctacataggga

SEQ ID NO: 348289 - DNA, 25 bp, Homo sapien
tagggaaggactctttccttagcct

SEQ ID NO: 348290 - DNA, 25 bp, Homo sapien
ccttagccttctcttattgattgga

SEQ ID NO: 348291 - DNA, 25 bp, Homo sapien
aggagttcagagatccctgtgtcct

SEQ ID NO: 348292 - DNA, 25 bp, Homo sapien
cctgcctgcctatggaatggagctg

SEQ ID NO: 348293 - DNA, 25 bp, Homo sapien
agctgggttcatctcatcacattag

SEQ ID NO: 348294 - DNA, 25 bp, Homo sapien
aggcctccttactccatcttccaga

SEQ ID NO: 348295 - DNA, 25 bp, Homo sapien
tggatgccgcgggaatgcgttcccc

SEQ ID NO: 348296 - DNA, 25 bp, Homo sapien
atgccgcgggaatgcgttccccttg

SEQ ID NO: 348297 - DNA, 25 bp, Homo sapien
tccctcagaggtccccaaagatgga

SEQ ID NO: 348298 - DNA, 25 bp, Homo sapien
tcagaggtccccaaagatggacaca

SEQ ID NO: 348299 - DNA, 25 bp, Homo sapien
gaggtccccaaagatggacacacaa

SEQ ID NO: 348300 - DNA, 25 bp, Homo sapien
ggtccccaaagatggacacacaacc

SEQ ID NO: 348301 - DNA, 25 bp, Homo sapien
cgggaatgcgttccccttgccctgg

SEQ ID NO: 348302 - DNA, 25 bp, Homo sapien
ggcctccgaccgcagattccgcttc

SEQ ID NO: 348303 - DNA, 25 bp, Homo sapien
ccagcggcgcggaagtggtaaccca

SEQ ID NO: 348304 - DNA, 25 bp, Homo sapien
gcggaagtggtaacccagacccctg

SEQ ID NO: 348305 - DNA, 25 bp, Homo sapien
ttttctcctatttcttctgcaccca

SEQ ID NO: 348306 - DNA, 25 bp, Homo sapien
tctgcacccaactttctccttgtat

SEQ ID NO: 348307 - DNA, 25 bp, Homo sapien
tttctccttgtatttcaaaggccag

SEQ ID NO: 348308 - DNA, 25 bp, Homo sapien
ggccatgtacactaacgtccttgaa

SEQ ID NO: 348309 - DNA, 25 bp, Homo sapien
aacgtccttgaaatttgcagttctg

SEQ ID NO: 348310 - DNA, 25 bp, Homo sapien
gcctgtgttgtcatttccatgggaa

SEQ ID NO: 348311 - DNA, 25 bp, Homo sapien
aagaactctttccacgagatctgct

SEQ ID NO: 348312 - DNA, 25 bp, Homo sapien
tttccacgagatctgctagttccag

SEQ ID NO: 348313 - DNA, 25 bp, Homo sapien
ctagttccaggcctctaagacagga

SEQ ID NO: 348314 - DNA, 25 bp, Homo sapien
atgtgccataagtgggtctacttca

SEQ ID NO: 348315 - DNA, 25 bp, Homo sapien
taagtgggtctacttcacagactca

SEQ ID NO: 348316 - DNA, 25 bp, Homo sapien
aagttttgggaatggtcatatctaa

SEQ ID NO: 348317 - DNA, 25 bp, Homo sapien
taggaggcacagtcaactttgacag

SEQ ID NO: 348318 - DNA, 25 bp, Homo sapien
actttgacagttctaagaggcttga

SEQ ID NO: 348319 - DNA, 25 bp, Homo sapien
ttgtaatacctcttccagggaacac

SEQ ID NO: 348320 - DNA, 25 bp, Homo sapien
cagggaacacaatagtaaaccactt

SEQ ID NO: 348321 - DNA, 25 bp, Homo sapien
tagtaaaccacttaggaaccagtag

SEQ ID NO: 348322 - DNA, 25 bp, Homo sapien
gaaccagtagaaggattgctaagca

SEQ ID NO: 348323 - DNA, 25 bp, Homo sapien
tgctaagcagtattaggaagcctgt

SEQ ID NO: 348324 - DNA, 25 bp, Homo sapien
taggaagcctgtgtagcatatggcc

SEQ ID NO: 348325 - DNA, 25 bp, Homo sapien
aaaccaagggacaaagccaagctca

SEQ ID NO: 348326 - DNA, 25 bp, Homo sapien
aagccaagctcaagtcccataaaac

SEQ ID NO: 348327 - DNA, 25 bp, Homo sapien
tggcattgcttttttgcaaggaaaa

SEQ ID NO: 348328 - DNA, 25 bp, Homo sapien
aaagtgaccctgtggttctgtagtc

SEQ ID NO: 348329 - DNA, 25 bp, Homo sapien
ctgtggttctgtagtcccagggtgc

SEQ ID NO: 348330 - DNA, 25 bp, Homo sapien
tagtcccagggtgctgcgcatggct

SEQ ID NO: 348331 - DNA, 25 bp, Homo sapien
tcagtgggctgtggcatagcacgcc

SEQ ID NO: 348332 - DNA, 25 bp, Homo sapien
gggacccagcccttggcgatgtgac

SEQ ID NO: 348333 - DNA, 25 bp, Homo sapien
agcccttggcgatgtgacaggtcac

SEQ ID NO: 348334 - DNA, 25 bp, Homo sapien
tgtgacaggtcactctcatgcccag

SEQ ID NO: 348335 - DNA, 25 bp, Homo sapien
ggacatggagaggacttctgtgctt

SEQ ID NO: 348336 - DNA, 25 bp, Homo sapien
gacttctgtgcttggtactctttaa

SEQ ID NO: 348337 - DNA, 25 bp, Homo sapien
ctgtgcttggtactctttaattctg

SEQ ID NO: 348338 - DNA, 25 bp, Homo sapien
cgtgcctggcctgcttgttgttttc

SEQ ID NO: 348339 - DNA, 25 bp, Homo sapien
gtgcctggcctgcttgttgttttca

SEQ ID NO: 348340 - DNA, 25 bp, Homo sapien
tgcctggcctgcttgttgttttcat

SEQ ID NO: 348341 - DNA, 25 bp, Homo sapien
gcctggcctgcttgttgttttcatc

SEQ ID NO: 348342 - DNA, 25 bp, Homo sapien
cctggcctgcttgttgttttcatct

SEQ ID NO: 348343 - DNA, 25 bp, Homo sapien
ctggcctgcttgttgttttcatctc

SEQ ID NO: 348344 - DNA, 25 bp, Homo sapien
gttgttttcatctcatcctgatttc

SEQ ID NO: 348345 - DNA, 25 bp, Homo sapien
cagtgtcattcttggcaaaacctga

SEQ ID NO: 348346 - DNA, 25 bp, Homo sapien
agtgtcattcttggcaaaacctgaa

SEQ ID NO: 348347 - DNA, 25 bp, Homo sapien
gaaatattatttaccctaatgcctt

SEQ ID NO: 348348 - DNA, 25 bp, Homo sapien
attatttaccctaatgcctttgtat

SEQ ID NO: 348349 - DNA, 25 bp, Homo sapien
aatgcctttgtattagaggaatctt

SEQ ID NO: 348350 - DNA, 25 bp, Homo sapien
agaggaatcttattctcatctccca

SEQ ID NO: 348351 - DNA, 25 bp, Homo sapien
attctcatctcccatatgttgtttg

SEQ ID NO: 348352 - DNA, 25 bp, Homo sapien
catctcccatatgttgtttgtatgt

SEQ ID NO: 348353 - DNA, 25 bp, Homo sapien
tctcacaactaataatagtgggctg

SEQ ID NO: 348354 - DNA, 25 bp, Homo sapien
agcgattacccccagggattctggt

SEQ ID NO: 348355 - DNA, 25 bp, Homo sapien
ccagggattctggtcttggtgaata

SEQ ID NO: 348356 - DNA, 25 bp, Homo sapien
atgcctgctgtctagcacctgaaat

SEQ ID NO: 348357 - DNA, 25 bp, Homo sapien
gctgtctagcacctgaaatattatt

SEQ ID NO: 348358 - DNA, 25 bp, Homo sapien
agtcaggtatgatagctcacttctg

SEQ ID NO: 348359 - DNA, 25 bp, Homo sapien
gtcaggtatgatagctcacttctgt

SEQ ID NO: 348360 - DNA, 25 bp, Homo sapien
tcaggtatgatagctcacttctgta

SEQ ID NO: 348361 - DNA, 25 bp, Homo sapien
caggtatgatagctcacttctgtaa

SEQ ID NO: 348362 - DNA, 25 bp, Homo sapien
gccccagagttcaaggccacagtga

SEQ ID NO: 348363 - DNA, 25 bp, Homo sapien
aggtatgatagctcacttctgtaat

SEQ ID NO: 348364 - DNA, 25 bp, Homo sapien
cacttctgtaatcctgatgcttttg

SEQ ID NO: 348365 - DNA, 25 bp, Homo sapien
acttctgtaatcctgatgcttttgg

SEQ ID NO: 348366 - DNA, 25 bp, Homo sapien
cttctgtaatcctgatgcttttgga

SEQ ID NO: 348367 - DNA, 25 bp, Homo sapien
taatcctgatgcttttggaggccaa

SEQ ID NO: 348368 - DNA, 25 bp, Homo sapien
aatcctgatgcttttggaggccaag

SEQ ID NO: 348369 - DNA, 25 bp, Homo sapien
gaatgggaaacttgactgaaatgat

SEQ ID NO: 348370 - DNA, 25 bp, Homo sapien
ggacaggcctgatagaggctccttt

SEQ ID NO: 348371 - DNA, 25 bp, Homo sapien
atagaggctcctttatgtaatgtaa

SEQ ID NO: 348372 - DNA, 25 bp, Homo sapien
tagacgtattagttattcatatgtt

SEQ ID NO: 348373 - DNA, 25 bp, Homo sapien
catagcatgaggttgtaaggagaca

SEQ ID NO: 348374 - DNA, 25 bp, Homo sapien
gacaatagataggaaggtgcagact

SEQ ID NO: 348375 - DNA, 25 bp, Homo sapien
atgttggtactgtccttagattttt

SEQ ID NO: 348376 - DNA, 25 bp, Homo sapien
tttggagagagctttcttgccttca

SEQ ID NO: 348377 - DNA, 25 bp, Homo sapien
tttcttgccttcaacatctagctga

SEQ ID NO: 348378 - DNA, 25 bp, Homo sapien
atctagctgagttttgtcccactga

SEQ ID NO: 348379 - DNA, 25 bp, Homo sapien
gctgagttttgtcccactgagagaa

SEQ ID NO: 348380 - DNA, 25 bp, Homo sapien
gcatgctgagcaaaatgcttacgcc

SEQ ID NO: 348381 - DNA, 25 bp, Homo sapien
aaatgcttacgccaagcctgttttt

SEQ ID NO: 348382 - DNA, 25 bp, Homo sapien
cttacgccaagcctgtttttctctg

SEQ ID NO: 348383 - DNA, 25 bp, Homo sapien
tgtttttctctgcagagtaaacagg

SEQ ID NO: 348384 - DNA, 25 bp, Homo sapien
ttctctgcagagtaaacaggatgtt

SEQ ID NO: 348385 - DNA, 25 bp, Homo sapien
atgttttcagcagacttggctctaa

SEQ ID NO: 348386 - DNA, 25 bp, Homo sapien
tttcagcagacttggctctaatagc

SEQ ID NO: 348387 - DNA, 25 bp, Homo sapien
ggctctaatagccatctctaagatt

SEQ ID NO: 348388 - DNA, 25 bp, Homo sapien
atagccatctctaagattagggaac

SEQ ID NO: 348389 - DNA, 25 bp, Homo sapien
gattagggaacaattgagtctttat

SEQ ID NO: 348390 - DNA, 25 bp, Homo sapien
ggaacaattgagtctttatgtagaa

SEQ ID NO: 348391 - DNA, 25 bp, Homo sapien
tttgcctacaactggcacagacagt

SEQ ID NO: 348392 - DNA, 25 bp, Homo sapien
acagacagtgctactacctagttca

SEQ ID NO: 348393 - DNA, 25 bp, Homo sapien
gctactacctagttcaagcttcagt

SEQ ID NO: 348394 - DNA, 25 bp, Homo sapien
tgcatttccctagtctcctcggtag

SEQ ID NO: 348395 - DNA, 25 bp, Homo sapien
tagtctcctcggtagctcctatctg

SEQ ID NO: 348396 - DNA, 25 bp, Homo sapien
ggtagctcctatctgtcatctactc

SEQ ID NO: 348397 - DNA, 25 bp, Homo sapien
gtcatctactcccaattctaagtca

SEQ ID NO: 348398 - DNA, 25 bp, Homo sapien
cccaattctaagtcatttccgcaaa

SEQ ID NO: 348399 - DNA, 25 bp, Homo sapien
aagatatgctagtccttccaagtat

SEQ ID NO: 348400 - DNA, 25 bp, Homo sapien
atgctagtccttccaagtatgtaaa

SEQ ID NO: 348401 - DNA, 25 bp, Homo sapien
tttcttttactcaattagtagctga

SEQ ID NO: 348402 - DNA, 25 bp, Homo sapien
tttgccccaagctgacagcacaagg

SEQ ID NO: 348403 - DNA, 25 bp, Homo sapien
accctaacccagaggcctcatgtgt

SEQ ID NO: 348404 - DNA, 25 bp, Homo sapien
agaggcctcatgtgtcccagttcaa

SEQ ID NO: 348405 - DNA, 25 bp, Homo sapien
tcatgtgtcccagttcaaaggttgc

SEQ ID NO: 348406 - DNA, 25 bp, Homo sapien
gtcccagttcaaaggttgcagtccc

SEQ ID NO: 348407 - DNA, 25 bp, Homo sapien
gttcaaaggttgcagtccccatggg

SEQ ID NO: 348408 - DNA, 25 bp, Homo sapien
gggattgtcttctctcccgtgtcgg

SEQ ID NO: 348409 - DNA, 25 bp, Homo sapien
tcccgtgtcggttgggcccatgaga

SEQ ID NO: 348410 - DNA, 25 bp, Homo sapien
ggttgggcccatgagacacagagat

SEQ ID NO: 348411 - DNA, 25 bp, Homo sapien
tgggcccatgagacacagagatacc

SEQ ID NO: 348412 - DNA, 25 bp, Homo sapien
gggagctccttgcacatgctaaatt

SEQ ID NO: 348413 - DNA, 25 bp, Homo sapien
aagtcagcgcacttaacttggactc

SEQ ID NO: 348414 - DNA, 25 bp, Homo sapien
agcgcacttaacttggactcaccac

SEQ ID NO: 348415 - DNA, 25 bp, Homo sapien
tcaccacctatcaagtgctcgacag

SEQ ID NO: 348416 - DNA, 25 bp, Homo sapien
gccacgtgtgcagtggttcctacgt

SEQ ID NO: 348417 - DNA, 25 bp, Homo sapien
ggttcctacgtggagcagcatacat

SEQ ID NO: 348418 - DNA, 25 bp, Homo sapien
ggagcagcatacatccagagatgca

SEQ ID NO: 348419 - DNA, 25 bp, Homo sapien
gagttgctgagcaatctatgtcccc

SEQ ID NO: 348420 - DNA, 25 bp, Homo sapien
gaagaaacagaactccacaaggtag

SEQ ID NO: 348421 - DNA, 25 bp, Homo sapien
acagaactccacaaggtagcagtgt

SEQ ID NO: 348422 - DNA, 25 bp, Homo sapien
tgccttccaatcagaagatttggtg

SEQ ID NO: 348423 - DNA, 25 bp, Homo sapien
agaagatttggtgattctttctgag

SEQ ID NO: 348424 - DNA, 25 bp, Homo sapien
gcctgaatttggagtctcagccagt

SEQ ID NO: 348425 - DNA, 25 bp, Homo sapien
aatttggagtctcagccagtcctgg

SEQ ID NO: 348426 - DNA, 25 bp, Homo sapien
tgctcttcagacaaggcaggcagag

SEQ ID NO: 348427 - DNA, 25 bp, Homo sapien
acaaggcaggcagagccttgtccaa

SEQ ID NO: 348428 - DNA, 25 bp, Homo sapien
gcccagccagaatgggcaagagctt

SEQ ID NO: 348429 - DNA, 25 bp, Homo sapien
ccagaatgggcaagagcttggcctg

SEQ ID NO: 348430 - DNA, 25 bp, Homo sapien
gctggtggaggcacatggccttttc

SEQ ID NO: 348431 - DNA, 25 bp, Homo sapien
tctttctatgtctgatgtaccaggt

SEQ ID NO: 348432 - DNA, 25 bp, Homo sapien
gtctgatgtaccaggtgacagcctc

SEQ ID NO: 348433 - DNA, 25 bp, Homo sapien
ctgatgtaccaggtgacagcctcct

SEQ ID NO: 348434 - DNA, 25 bp, Homo sapien
cagcctcctgcccagataataagtg

SEQ ID NO: 348435 - DNA, 25 bp, Homo sapien
cgcgcccagccgctataacttttaa

SEQ ID NO: 348436 - DNA, 25 bp, Homo sapien
acaattcccatatgtcctttattcc

SEQ ID NO: 348437 - DNA, 25 bp, Homo sapien
tcccatatgtcctttattccactaa

SEQ ID NO: 348438 - DNA, 25 bp, Homo sapien
atgtcctttattccactaagatgag

SEQ ID NO: 348439 - DNA, 25 bp, Homo sapien
tttattccactaagatgagtgcagt

SEQ ID NO: 348440 - DNA, 25 bp, Homo sapien
atgagtgcagtatatatttccatct

SEQ ID NO: 348441 - DNA, 25 bp, Homo sapien
atttccatctgtccaaggcttccta

SEQ ID NO: 348442 - DNA, 25 bp, Homo sapien
ttccatctgtccaaggcttcctaaa

SEQ ID NO: 348443 - DNA, 25 bp, Homo sapien
gccaagccaacaccagtcacatgat

SEQ ID NO: 348444 - DNA, 25 bp, Homo sapien
ccaggctgtgattcagggaagttcc

SEQ ID NO: 348445 - DNA, 25 bp, Homo sapien
ggctgtgattcagggaagttccaag

SEQ ID NO: 348446 - DNA, 25 bp, Homo sapien
cccgaggcaccgcttccctgtgcgg

SEQ ID NO: 348447 - DNA, 25 bp, Homo sapien
ccgaggcaccgcttccctgtgcggc

SEQ ID NO: 348448 - DNA, 25 bp, Homo sapien
cgaggcaccgcttccctgtgcggcg

SEQ ID NO: 348449 - DNA, 25 bp, Homo sapien
gaggcaccgcttccctgtgcggcgc

SEQ ID NO: 348450 - DNA, 25 bp, Homo sapien
aggcaccgcttccctgtgcggcgct

SEQ ID NO: 348451 - DNA, 25 bp, Homo sapien
ggcaccgcttccctgtgcggcgctg

SEQ ID NO: 348452 - DNA, 25 bp, Homo sapien
gcaccgcttccctgtgcggcgctgc

SEQ ID NO: 348453 - DNA, 25 bp, Homo sapien
caccgcttccctgtgcggcgctgca

SEQ ID NO: 348454 - DNA, 25 bp, Homo sapien
cttccctgtgcggcgctgcagaggg

SEQ ID NO: 348455 - DNA, 25 bp, Homo sapien
gcgctgcagaggggccctcagtgtg

SEQ ID NO: 348456 - DNA, 25 bp, Homo sapien
gtgcctggcctgcttgttgttttca

SEQ ID NO: 348457 - DNA, 25 bp, Homo sapien
tgttttcatctcatcctgatttcca

SEQ ID NO: 348458 - DNA, 25 bp, Homo sapien
tgatttccaaatacaggagagaagc

SEQ ID NO: 348459 - DNA, 25 bp, Homo sapien
gagagaagctgaattggtgttcact

SEQ ID NO: 348460 - DNA, 25 bp, Homo sapien
gtgttcactaacaagcacaggagct

SEQ ID NO: 348461 - DNA, 25 bp, Homo sapien
gttttgatcagggtgtctcgaactc

SEQ ID NO: 348462 - DNA, 25 bp, Homo sapien
ttggcaaaacctgaagggtgtgttc

SEQ ID NO: 348463 - DNA, 25 bp, Homo sapien
ggcaaaacctgaagggtgtgttcgt

SEQ ID NO: 348464 - DNA, 25 bp, Homo sapien
gcaaaacctgaagggtgtgttcgtg

SEQ ID NO: 348465 - DNA, 25 bp, Homo sapien
acctgtgatctgtgcatctggccag

SEQ ID NO: 348466 - DNA, 25 bp, Homo sapien
atctggccagcactgtggtgacatc

SEQ ID NO: 348467 - DNA, 25 bp, Homo sapien
atgtgagttgctgctcatgcctgtc

SEQ ID NO: 348468 - DNA, 25 bp, Homo sapien
gctcatgcctgtctcctgcatggga

SEQ ID NO: 348469 - DNA, 25 bp, Homo sapien
actgagccctgtgggtgcaggaacc

SEQ ID NO: 348470 - DNA, 25 bp, Homo sapien
caggaaccacatggctcctctgtta

SEQ ID NO: 348471 - DNA, 25 bp, Homo sapien
tgttattccccagcgccttactggg

SEQ ID NO: 348472 - DNA, 25 bp, Homo sapien
gcacctgatgtgtgtgggcagtcac

SEQ ID NO: 348473 - DNA, 25 bp, Homo sapien
ggcagtcaccaaacagtggcaggta

SEQ ID NO: 348474 - DNA, 25 bp, Homo sapien
ttgaccaaggtgtaggttcccggca

SEQ ID NO: 348475 - DNA, 25 bp, Homo sapien
gggaggttgagggatcaatcaccaa

SEQ ID NO: 348476 - DNA, 25 bp, Homo sapien
ttagctgaattgtcgcctcttgtcc

SEQ ID NO: 348477 - DNA, 25 bp, Homo sapien
gggtcctagtcacattgcatgtgag

SEQ ID NO: 348478 - DNA, 25 bp, Homo sapien
gttatgacatacttggagcggcatg

SEQ ID NO: 348479 - DNA, 25 bp, Homo sapien
ttggagcggcatgatttcaagaagc

SEQ ID NO: 348480 - DNA, 25 bp, Homo sapien
gccattccaaattcttatagctcct

SEQ ID NO: 348481 - DNA, 25 bp, Homo sapien
atagctccttagctctggttttact

SEQ ID NO: 348482 - DNA, 25 bp, Homo sapien
gtggaactcatgaaaatagggactt

SEQ ID NO: 348483 - DNA, 25 bp, Homo sapien
atagggacttttgatatctctttaa

SEQ ID NO: 348484 - DNA, 25 bp, Homo sapien
tctttaaatattccctgactcacgg

SEQ ID NO: 348485 - DNA, 25 bp, Homo sapien
tgactcacggaaaagatgtcctctt

SEQ ID NO: 348486 - DNA, 25 bp, Homo sapien
gtcctcttttggtgtatacattgtg

SEQ ID NO: 348487 - DNA, 25 bp, Homo sapien
gaaaatctacccatttatctctctc

SEQ ID NO: 348488 - DNA, 25 bp, Homo sapien
aattatctgataaggccggcaaggt

SEQ ID NO: 348489 - DNA, 25 bp, Homo sapien
actgctgggcttaagtgatggttgg

SEQ ID NO: 348490 - DNA, 25 bp, Homo sapien
ctgctgggcttaagtgatggttggc

SEQ ID NO: 348491 - DNA, 25 bp, Homo sapien
tgctgggcttaagtgatggttggcc

SEQ ID NO: 348492 - DNA, 25 bp, Homo sapien
aggcacatgcaaccgtgcctgacta

SEQ ID NO: 348493 - DNA, 25 bp, Homo sapien
gcacatgcaaccgtgcctgactaat

SEQ ID NO: 348494 - DNA, 25 bp, Homo sapien
cacatgcaaccgtgcctgactaatt

SEQ ID NO: 348495 - DNA, 25 bp, Homo sapien
ttacagggcataaggcattgcactc

SEQ ID NO: 348496 - DNA, 25 bp, Homo sapien
tacagggcataaggcattgcactca

SEQ ID NO: 348497 - DNA, 25 bp, Homo sapien
cagggcataaggcattgcactcagc

SEQ ID NO: 348498 - DNA, 25 bp, Homo sapien
agggcataaggcattgcactcagcc

SEQ ID NO: 348499 - DNA, 25 bp, Homo sapien
gggcataaggcattgcactcagcca

SEQ ID NO: 348500 - DNA, 25 bp, Homo sapien
tcatgtggtaggttctttctcagga

SEQ ID NO: 348501 - DNA, 25 bp, Homo sapien
gaaaagcttctactggcacaattta

SEQ ID NO: 348502 - DNA, 25 bp, Homo sapien
taaagattcctgtgtactggtttac

SEQ ID NO: 348503 - DNA, 25 bp, Homo sapien
actggtttacatttgtgtgagtggc

SEQ ID NO: 348504 - DNA, 25 bp, Homo sapien
gtgagtggcatactcaagtctgctg

SEQ ID NO: 348505 - DNA, 25 bp, Homo sapien
gtgcctgtcgtcgtgactgtcagta

SEQ ID NO: 348506 - DNA, 25 bp, Homo sapien
gactgtcagtattctcgctatttta

SEQ ID NO: 348507 - DNA, 25 bp, Homo sapien
gctattttatagtcgtgccatgttg

SEQ ID NO: 348508 - DNA, 25 bp, Homo sapien
agtcgtgccatgttgttactcacag

SEQ ID NO: 348509 - DNA, 25 bp, Homo sapien
ttgttactcacagcgctctgacata

SEQ ID NO: 348510 - DNA, 25 bp, Homo sapien
gcgctctgacatactttcatgtggt

SEQ ID NO: 348511 - DNA, 25 bp, Homo sapien
ataaggtttgagttggagctagtct

SEQ ID NO: 348512 - DNA, 25 bp, Homo sapien
aaggtttgagttggagctagtctga

SEQ ID NO: 348513 - DNA, 25 bp, Homo sapien
aggtttgagttggagctagtctgat

SEQ ID NO: 348514 - DNA, 25 bp, Homo sapien
gtttgagttggagctagtctgatgc

SEQ ID NO: 348515 - DNA, 25 bp, Homo sapien
tttgagttggagctagtctgatgca

SEQ ID NO: 348516 - DNA, 25 bp, Homo sapien
ttgagttggagctagtctgatgcag

SEQ ID NO: 348517 - DNA, 25 bp, Homo sapien
tgagttggagctagtctgatgcagc

SEQ ID NO: 348518 - DNA, 25 bp, Homo sapien
gagttggagctagtctgatgcagca

SEQ ID NO: 348519 - DNA, 25 bp, Homo sapien
agttggagctagtctgatgcagcag

SEQ ID NO: 348520 - DNA, 25 bp, Homo sapien
agctagtctgatgcagcagggagcc

SEQ ID NO: 348521 - DNA, 25 bp, Homo sapien
ctagtctgatgcagcagggagccct

SEQ ID NO: 348522 - DNA, 25 bp, Homo sapien
aattgaatccacactaatatatcta

SEQ ID NO: 348523 - DNA, 25 bp, Homo sapien
ttattaagctagaggtcatggtcac

SEQ ID NO: 348524 - DNA, 25 bp, Homo sapien
attaagctagaggtcatggtcactg

SEQ ID NO: 348525 - DNA, 25 bp, Homo sapien
ttaagctagaggtcatggtcactga

SEQ ID NO: 348526 - DNA, 25 bp, Homo sapien
taagctagaggtcatggtcactgaa

SEQ ID NO: 348527 - DNA, 25 bp, Homo sapien
aagctagaggtcatggtcactgaaa

SEQ ID NO: 348528 - DNA, 25 bp, Homo sapien
gctagaggtcatggtcactgaaatt

SEQ ID NO: 348529 - DNA, 25 bp, Homo sapien
tagaggtcatggtcactgaaattac

SEQ ID NO: 348530 - DNA, 25 bp, Homo sapien
gaggtcatggtcactgaaattactt

SEQ ID NO: 348531 - DNA, 25 bp, Homo sapien
aggtcatggtcactgaaattacttt

SEQ ID NO: 348532 - DNA, 25 bp, Homo sapien
catggtcactgaaattactttccaa

SEQ ID NO: 348533 - DNA, 25 bp, Homo sapien
gtgggcagatttacaaactagaatt

SEQ ID NO: 348534 - DNA, 25 bp, Homo sapien
gaattcatactggactatggatcct

SEQ ID NO: 348535 - DNA, 25 bp, Homo sapien
ggactatggatcctttaatcattaa

SEQ ID NO: 348536 - DNA, 25 bp, Homo sapien
gatcctttaatcattaatagagcct

SEQ ID NO: 348537 - DNA, 25 bp, Homo sapien
taatagagccttattaaacttttca

SEQ ID NO: 348538 - DNA, 25 bp, Homo sapien
ttgtattttttatgtcctgctcaga

SEQ ID NO: 348539 - DNA, 25 bp, Homo sapien
ttatgtcctgctcagatttgatctg

SEQ ID NO: 348540 - DNA, 25 bp, Homo sapien
agatttgatctgagttgggaactaa

SEQ ID NO: 348541 - DNA, 25 bp, Homo sapien
ctaatatgtcctcttcattttctgg

SEQ ID NO: 348542 - DNA, 25 bp, Homo sapien
atatgtcctcttcattttctggatt

SEQ ID NO: 348543 - DNA, 25 bp, Homo sapien
ttgttttgaaaacctgtccctgtct

SEQ ID NO: 348544 - DNA, 25 bp, Homo sapien
cggagacaggcctgcggccagcttc

SEQ ID NO: 348545 - DNA, 25 bp, Homo sapien
agcgcccgggtacgagtctgtaaat

SEQ ID NO: 348546 - DNA, 25 bp, Homo sapien
gagtctgtaaatcagcctgcgctgc

SEQ ID NO: 348547 - DNA, 25 bp, Homo sapien
aatcagcctgcgctgcatggcgtct

SEQ ID NO: 348548 - DNA, 25 bp, Homo sapien
gctcactcctcagctagttcattag

SEQ ID NO: 348549 - DNA, 25 bp, Homo sapien
tagttcattagctcacacgctggaa

SEQ ID NO: 348550 - DNA, 25 bp, Homo sapien
agctcacacgctggaaaaataaaac

SEQ ID NO: 348551 - DNA, 25 bp, Homo sapien
attcccaagaacaggcggctactcc

SEQ ID NO: 348552 - DNA, 25 bp, Homo sapien
ggcagccaacattccagggagcctg

SEQ ID NO: 348553 - DNA, 25 bp, Homo sapien
attccagggagcctgtgtaacccgc

SEQ ID NO: 348554 - DNA, 25 bp, Homo sapien
tgtgtaacccgctccgtcctcaggg

SEQ ID NO: 348555 - DNA, 25 bp, Homo sapien
acatacttttttgacattcatatag

SEQ ID NO: 348556 - DNA, 25 bp, Homo sapien
gacattcatatagattgttcttatt

SEQ ID NO: 348557 - DNA, 25 bp, Homo sapien
gttcttattacaatcatccattcat

SEQ ID NO: 348558 - DNA, 25 bp, Homo sapien
tacaatcatccattcatccgtttgc

SEQ ID NO: 348559 - DNA, 25 bp, Homo sapien
cattcatccgtttgcccaacaaaca

SEQ ID NO: 348560 - DNA, 25 bp, Homo sapien
ttattgaccacctacattgtatctt

SEQ ID NO: 348561 - DNA, 25 bp, Homo sapien
gaaagtatgtgagcatttgtctacg

SEQ ID NO: 348562 - DNA, 25 bp, Homo sapien
tatgtgagcatttgtctacgggagt

SEQ ID NO: 348563 - DNA, 25 bp, Homo sapien
gagcatttgtctacgggagtgtttt

SEQ ID NO: 348564 - DNA, 25 bp, Homo sapien
tgtctacgggagtgttttgacttta

SEQ ID NO: 348565 - DNA, 25 bp, Homo sapien
agcccccaagtggtttatctgtact

SEQ ID NO: 348566 - DNA, 25 bp, Homo sapien
aagccgcggaaggaggagagaccta

SEQ ID NO: 348567 - DNA, 25 bp, Homo sapien
aggagagacctaagaaagagaggcc

SEQ ID NO: 348568 - DNA, 25 bp, Homo sapien
aagaggagaggccacgggccgccag

SEQ ID NO: 348569 - DNA, 25 bp, Homo sapien
aagccctaccccagcgctgggagtc

SEQ ID NO: 348570 - DNA, 25 bp, Homo sapien
ccagcgctgggagtcacgcgaaggg

SEQ ID NO: 348571 - DNA, 25 bp, Homo sapien
ggccaccggccgtgggcacgggact

SEQ ID NO: 348572 - DNA, 25 bp, Homo sapien
gggactccagggacgccgagcccag

SEQ ID NO: 348573 - DNA, 25 bp, Homo sapien
aagcaggcctgggtgtccccgaggc

SEQ ID NO: 348574 - DNA, 25 bp, Homo sapien
gtccccgaggcgtcccgacgaggag

SEQ ID NO: 348575 - DNA, 25 bp, Homo sapien
aggagcagcggcctgggagtcgcca

SEQ ID NO: 348576 - DNA, 25 bp, Homo sapien
gagcagcggcctgggagtcgccaga

SEQ ID NO: 348577 - DNA, 25 bp, Homo sapien
catctcctgtctccgtcagagcagt

SEQ ID NO: 348578 - DNA, 25 bp, Homo sapien
cagtctcttccaggttactggaagg

SEQ ID NO: 348579 - DNA, 25 bp, Homo sapien
actggaaggtcagtttctgtcaggc

SEQ ID NO: 348580 - DNA, 25 bp, Homo sapien
cctcacttccttcttatcagagggt

SEQ ID NO: 348581 - DNA, 25 bp, Homo sapien
gtccctgcactggtatctatttaga

SEQ ID NO: 348582 - DNA, 25 bp, Homo sapien
tatttagaaatgtacatggagcccc

SEQ ID NO: 348583 - DNA, 25 bp, Homo sapien
ccccagcgaaatgtgcctacattgt

SEQ ID NO: 348584 - DNA, 25 bp, Homo sapien
ctacattgtgtgttccagaaccgga

SEQ ID NO: 348585 - DNA, 25 bp, Homo sapien
ggtacccttaccttctagatatgtg

SEQ ID NO: 348586 - DNA, 25 bp, Homo sapien
atgtgatgacatggctctcacgtca

SEQ ID NO: 348587 - DNA, 25 bp, Homo sapien
atggctctcacgtcaggcagactgc

SEQ ID NO: 348588 - DNA, 25 bp, Homo sapien
gccaggcatgacaaatctcttccca

SEQ ID NO: 348589 - DNA, 25 bp, Homo sapien
aaatctcttcccacagtgggcccaa

SEQ ID NO: 348590 - DNA, 25 bp, Homo sapien
gggcccaacagggaggcagatggta

SEQ ID NO: 348591 - DNA, 25 bp, Homo sapien
caggtgccaggtgcacgtggctctt

SEQ ID NO: 348592 - DNA, 25 bp, Homo sapien
aggtgcacgtggctcttcatcctgg

SEQ ID NO: 348593 - DNA, 25 bp, Homo sapien
acacctggagagctgagtgcttttc

SEQ ID NO: 348594 - DNA, 25 bp, Homo sapien
agtgcttttcctgaggtcacgcaga

SEQ ID NO: 348595 - DNA, 25 bp, Homo sapien
ttttcctgaggtcacgcagaaggtg

SEQ ID NO: 348596 - DNA, 25 bp, Homo sapien
atgtatccttggaggtccagtccta

SEQ ID NO: 348597 - DNA, 25 bp, Homo sapien
tggaggtccagtcctaatgtccctg

SEQ ID NO: 348598 - DNA, 25 bp, Homo sapien
taatgtccctgcctccgataagacc

SEQ ID NO: 348599 - DNA, 25 bp, Homo sapien
tctgtcacttccatacactttatct

SEQ ID NO: 348600 - DNA, 25 bp, Homo sapien
cacttccatacactttatcttgctt

SEQ ID NO: 348601 - DNA, 25 bp, Homo sapien
actttatcttgcttggtatacacca

SEQ ID NO: 348602 - DNA, 25 bp, Homo sapien
ttggtatacaccattctgttcttgt

SEQ ID NO: 348603 - DNA, 25 bp, Homo sapien
ttggcatctctttgggatagattcc

SEQ ID NO: 348604 - DNA, 25 bp, Homo sapien
agttctggctcacaggttggcccct

SEQ ID NO: 348605 - DNA, 25 bp, Homo sapien
ggctcacaggttggcccctctgaag

SEQ ID NO: 348606 - DNA, 25 bp, Homo sapien
gggatagattccaaaatctttggtg

SEQ ID NO: 348607 - DNA, 25 bp, Homo sapien
aatctttggtgtgggacctgaggcc

SEQ ID NO: 348608 - DNA, 25 bp, Homo sapien
ggacctgaggcccttcacaggcaga

SEQ ID NO: 348609 - DNA, 25 bp, Homo sapien
taagcccccttcagggtgccagttc

SEQ ID NO: 348610 - DNA, 25 bp, Homo sapien
agacataagctcttggacttggtcc

SEQ ID NO: 348611 - DNA, 25 bp, Homo sapien
gacttggtccattttattctcaccc

SEQ ID NO: 348612 - DNA, 25 bp, Homo sapien
tcacccgcacttctagaacctaaaa

SEQ ID NO: 348613 - DNA, 25 bp, Homo sapien
tctagaacctaaaacccatcgtggt

SEQ ID NO: 348614 - DNA, 25 bp, Homo sapien
acccatcgtggtacttgagaggaac

SEQ ID NO: 348615 - DNA, 25 bp, Homo sapien
gtggatcacagctcagttttggaaa

SEQ ID NO: 348616 - DNA, 25 bp, Homo sapien
cagccatctctcctcagataatatt

SEQ ID NO: 348617 - DNA, 25 bp, Homo sapien
ccacaccatgtttgccatgttcaat

SEQ ID NO: 348618 - DNA, 25 bp, Homo sapien
ttgaaggctcagtacagtggcgcgc

SEQ ID NO: 348619 - DNA, 25 bp, Homo sapien
tttgccatgttcaatctccagcgag

SEQ ID NO: 348620 - DNA, 25 bp, Homo sapien
tgcactcctcatcagacataagctc

SEQ ID NO: 348621 - DNA, 25 bp, Homo sapien
actaatagattagctgggtgggatg

SEQ ID NO: 348622 - DNA, 25 bp, Homo sapien
aatagattagctgggtgggatggcc

SEQ ID NO: 348623 - DNA, 25 bp, Homo sapien
ccctttcttgggaagctatcggaga

SEQ ID NO: 348624 - DNA, 25 bp, Homo sapien
cctttcttgggaagctatcggagaa

SEQ ID NO: 348625 - DNA, 25 bp, Homo sapien
ctttcttgggaagctatcggagaaa

SEQ ID NO: 348626 - DNA, 25 bp, Homo sapien
cttgggaagctatcggagaaaatac

SEQ ID NO: 348627 - DNA, 25 bp, Homo sapien
gaatgacgtggatccagcaaatagt

SEQ ID NO: 348628 - DNA, 25 bp, Homo sapien
aatgacgtggatccagcaaatagta

SEQ ID NO: 348629 - DNA, 25 bp, Homo sapien
tgacgtggatccagcaaatagtatc

SEQ ID NO: 348630 - DNA, 25 bp, Homo sapien
gacgtggatccagcaaatagtatcc

SEQ ID NO: 348631 - DNA, 25 bp, Homo sapien
gtggatccagcaaatagtatccaac

SEQ ID NO: 348632 - DNA, 25 bp, Homo sapien
caccgcactcagctgatttgcaaaa

SEQ ID NO: 348633 - DNA, 25 bp, Homo sapien
gcaaaaactttcttccatactgttg

SEQ ID NO: 348634 - DNA, 25 bp, Homo sapien
catactgttgtttcactttctggat

SEQ ID NO: 348635 - DNA, 25 bp, Homo sapien
tgtttcactttctggatagtgtcct

SEQ ID NO: 348636 - DNA, 25 bp, Homo sapien
gtcacatttcagaagccatcaccta

SEQ ID NO: 348637 - DNA, 25 bp, Homo sapien
gaagccatcacctaatccaagatca

SEQ ID NO: 348638 - DNA, 25 bp, Homo sapien
cagagatttacacctagtttctaat

SEQ ID NO: 348639 - DNA, 25 bp, Homo sapien
taatttcagctcttatgtgtagatc

SEQ ID NO: 348640 - DNA, 25 bp, Homo sapien
gctcttatgtgtagatctttgatcc

SEQ ID NO: 348641 - DNA, 25 bp, Homo sapien
agatctttgatccattgtgaattaa

SEQ ID NO: 348642 - DNA, 25 bp, Homo sapien
agttttgtgtgtggtgtaagagccc

SEQ ID NO: 348643 - DNA, 25 bp, Homo sapien
gaacaagacttgttgactcttcctt

SEQ ID NO: 348644 - DNA, 25 bp, Homo sapien
attagttccatgcatttggatcaca

SEQ ID NO: 348645 - DNA, 25 bp, Homo sapien
tgtccatattccatacctgattctc

SEQ ID NO: 348646 - DNA, 25 bp, Homo sapien
atacctgattctcatggcgtagcct

SEQ ID NO: 348647 - DNA, 25 bp, Homo sapien
atggcgtagcctgcagaccagtctc

SEQ ID NO: 348648 - DNA, 25 bp, Homo sapien
gcagaccagtctccttcagtgtatt

SEQ ID NO: 348649 - DNA, 25 bp, Homo sapien
tcagtgtattccctttctaatgctc

SEQ ID NO: 348650 - DNA, 25 bp, Homo sapien
ttctaatgctctctcacttgacaaa

SEQ ID NO: 348651 - DNA, 25 bp, Homo sapien
gattatagttctaaagcagtgcttt

SEQ ID NO: 348652 - DNA, 25 bp, Homo sapien
aaagcagtgcttttgtcatgtgaca

SEQ ID NO: 348653 - DNA, 25 bp, Homo sapien
gtcatgtgacagctacagaatttta

SEQ ID NO: 348654 - DNA, 25 bp, Homo sapien
atcacagatatctccacaggacctt

SEQ ID NO: 348655 - DNA, 25 bp, Homo sapien
ggctctgaactctaccattcagctg

SEQ ID NO: 348656 - DNA, 25 bp, Homo sapien
ccattcagctgccattcataatcat

SEQ ID NO: 348657 - DNA, 25 bp, Homo sapien
aaaaacagtcatagattgcagcatc

SEQ ID NO: 348658 - DNA, 25 bp, Homo sapien
ttgcagcatctccagtgacaagttt

SEQ ID NO: 348659 - DNA, 25 bp, Homo sapien
gacaacacctttgagatccatgatg

SEQ ID NO: 348660 - DNA, 25 bp, Homo sapien
actaaagcggatgggaatgtcgttt

SEQ ID NO: 348661 - DNA, 25 bp, Homo sapien
tggagtcaggcaaatgctctctgga

SEQ ID NO: 348662 - DNA, 25 bp, Homo sapien
tgctctctggaggatctgaaacttg

SEQ ID NO: 348663 - DNA, 25 bp, Homo sapien
gaaacttgcgaaatccctggtgcca

SEQ ID NO: 348664 - DNA, 25 bp, Homo sapien
gaaatccctggtgccaaaggcttta

SEQ ID NO: 348665 - DNA, 25 bp, Homo sapien
tcccaatgagccaaccttttgcact

SEQ ID NO: 348666 - DNA, 25 bp, Homo sapien
ccaatgagccaaccttttgcacttc

SEQ ID NO: 348667 - DNA, 25 bp, Homo sapien
aatgagccaaccttttgcacttcca

SEQ ID NO: 348668 - DNA, 25 bp, Homo sapien
tgagccaaccttttgcacttccact

SEQ ID NO: 348669 - DNA, 25 bp, Homo sapien
caaccttttgcacttccactagaat

SEQ ID NO: 348670 - DNA, 25 bp, Homo sapien
aaccttttgcacttccactagaatg

SEQ ID NO: 348671 - DNA, 25 bp, Homo sapien
accttttgcacttccactagaatgc

SEQ ID NO: 348672 - DNA, 25 bp, Homo sapien
ttttgcacttccactagaatgccag

SEQ ID NO: 348673 - DNA, 25 bp, Homo sapien
ttgcacttccactagaatgccaggc

SEQ ID NO: 348674 - DNA, 25 bp, Homo sapien
gcacttccactagaatgccaggcag

SEQ ID NO: 348675 - DNA, 25 bp, Homo sapien
cacttccactagaatgccaggcagg

SEQ ID NO: 348676 - DNA, 25 bp, Homo sapien
gagaaatccccgtgggacctgagcc

SEQ ID NO: 348677 - DNA, 25 bp, Homo sapien
cttaccatcgtaccgtccaggattg

SEQ ID NO: 348678 - DNA, 25 bp, Homo sapien
atcgtaccgtccaggattgtccttg

SEQ ID NO: 348679 - DNA, 25 bp, Homo sapien
tttgttgtctcagccagaccttggt

SEQ ID NO: 348680 - DNA, 25 bp, Homo sapien
cagccagaccttggttttcagtaaa

SEQ ID NO: 348681 - DNA, 25 bp, Homo sapien
tcagtaaagccccagtttctacttc

SEQ ID NO: 348682 - DNA, 25 bp, Homo sapien
agtttctacttcctgcatgccactg

SEQ ID NO: 348683 - DNA, 25 bp, Homo sapien
tgtgcaaggccactcatcactgttc

SEQ ID NO: 348684 - DNA, 25 bp, Homo sapien
atcactgttcctgcagaagcctctg

SEQ ID NO: 348685 - DNA, 25 bp, Homo sapien
catgtaaatattggtttggttcggt

SEQ ID NO: 348686 - DNA, 25 bp, Homo sapien
gcattttacttggtaactggttgtt

SEQ ID NO: 348687 - DNA, 25 bp, Homo sapien
tagtcctcggatgttgggcgtcatt

SEQ ID NO: 348688 - DNA, 25 bp, Homo sapien
atgttgggcgtcattttccgtgggc

SEQ ID NO: 348689 - DNA, 25 bp, Homo sapien
tttccgtgggcagttgggagtcact

SEQ ID NO: 348690 - DNA, 25 bp, Homo sapien
gagtcactgtgcttctcccacaaaa

SEQ ID NO: 348691 - DNA, 25 bp, Homo sapien
aaaactcttctcacagtccaacttg

SEQ ID NO: 348692 - DNA, 25 bp, Homo sapien
acttgtatacaaacccatcagactg

SEQ ID NO: 348693 - DNA, 25 bp, Homo sapien
gctcatccccggagaagacagaagc

SEQ ID NO: 348694 - DNA, 25 bp, Homo sapien
aagacagaagcccatcacctggtac

SEQ ID NO: 348695 - DNA, 25 bp, Homo sapien
ccatcacctggtacacttcagagga

SEQ ID NO: 348696 - DNA, 25 bp, Homo sapien
tacacttcagaggaacacgcacctg

SEQ ID NO: 348697 - DNA, 25 bp, Homo sapien
acacgcacctgacagccaaggagaa

SEQ ID NO: 348698 - DNA, 25 bp, Homo sapien
atttagatgttatgagttgctggcc

SEQ ID NO: 348699 - DNA, 25 bp, Homo sapien
agatgttatgagttgctggccagag

SEQ ID NO: 348700 - DNA, 25 bp, Homo sapien
atgttatgagttgctggccagagat

SEQ ID NO: 348701 - DNA, 25 bp, Homo sapien
ttatgagttgctggccagagattcc

SEQ ID NO: 348702 - DNA, 25 bp, Homo sapien
gagttgctggccagagattcctcag

SEQ ID NO: 348703 - DNA, 25 bp, Homo sapien
gttgctggccagagattcctcagat

SEQ ID NO: 348704 - DNA, 25 bp, Homo sapien
ttgctggccagagattcctcagata

SEQ ID NO: 348705 - DNA, 25 bp, Homo sapien
gctggccagagattcctcagataaa

SEQ ID NO: 348706 - DNA, 25 bp, Homo sapien
ctggccagagattcctcagataaaa

SEQ ID NO: 348707 - DNA, 25 bp, Homo sapien
ttcctcagataaaagagcctagaaa

SEQ ID NO: 348708 - DNA, 25 bp, Homo sapien
aaattgagttttgagcgggcatggt

SEQ ID NO: 348709 - DNA, 25 bp, Homo sapien
tgtgactttcatacacacccagtac

SEQ ID NO: 348710 - DNA, 25 bp, Homo sapien
atacacacccagtacatctcaaagg

SEQ ID NO: 348711 - DNA, 25 bp, Homo sapien
aaaggatgctaagggacattttctg

SEQ ID NO: 348712 - DNA, 25 bp, Homo sapien
ttttctgccagtagagttctccccc

SEQ ID NO: 348713 - DNA, 25 bp, Homo sapien
attatgttcacatctaactccagag

SEQ ID NO: 348714 - DNA, 25 bp, Homo sapien
taactccagagcttacttcctgtgg

SEQ ID NO: 348715 - DNA, 25 bp, Homo sapien
ccagagcttacttcctgtggtgcca

SEQ ID NO: 348716 - DNA, 25 bp, Homo sapien
cctgtggtgccaatgtatttgttgc

SEQ ID NO: 348717 - DNA, 25 bp, Homo sapien
ttataggtgccattaaactcaggtc

SEQ ID NO: 348718 - DNA, 25 bp, Homo sapien
ggtgccattaaactcaggtctttca

SEQ ID NO: 348719 - DNA, 25 bp, Homo sapien
taaactcaggtctttcaaatgaaag

SEQ ID NO: 348720 - DNA, 25 bp, Homo sapien
tttgcttaagttactttgagttggg

SEQ ID NO: 348721 - DNA, 25 bp, Homo sapien
gttgggtttctgttacttgaaattg

SEQ ID NO: 348722 - DNA, 25 bp, Homo sapien
gaatccacactaatatatctaccaa

SEQ ID NO: 348723 - DNA, 25 bp, Homo sapien
atctaccaacattgagacttgacag

SEQ ID NO: 348724 - DNA, 25 bp, Homo sapien
attaagctagaggtcatggtcactg

SEQ ID NO: 348725 - DNA, 25 bp, Homo sapien
tggtcactgaaattactttccaaag

SEQ ID NO: 348726 - DNA, 25 bp, Homo sapien
aacaggaactgagggaatatttaag

SEQ ID NO: 348727 - DNA, 25 bp, Homo sapien
gaatatttaagatcccacagaagcg

SEQ ID NO: 348728 - DNA, 25 bp, Homo sapien
tatttaagatcccacagaagcgtaa

SEQ ID NO: 348729 - DNA, 25 bp, Homo sapien
atttaagatcccacagaagcgtaaa

SEQ ID NO: 348730 - DNA, 25 bp, Homo sapien
atgtctgtcattaaaggataggtta

SEQ ID NO: 348731 - DNA, 25 bp, Homo sapien
gatgcctacgtcatagggttggtgt

SEQ ID NO: 348732 - DNA, 25 bp, Homo sapien
agattgcttgtagcactgttgttct

SEQ ID NO: 348733 - DNA, 25 bp, Homo sapien
cttgtagcactgttgttctttgggt

SEQ ID NO: 348734 - DNA, 25 bp, Homo sapien
gttgttctttgggtcagccctgttc

SEQ ID NO: 348735 - DNA, 25 bp, Homo sapien
tttgggtcagccctgttctaggaat

SEQ ID NO: 348736 - DNA, 25 bp, Homo sapien
gggtcagccctgttctaggaatgac

SEQ ID NO: 348737 - DNA, 25 bp, Homo sapien
agccctgttctaggaatgacaatct

SEQ ID NO: 348738 - DNA, 25 bp, Homo sapien
cctgttctaggaatgacaatctctg

SEQ ID NO: 348739 - DNA, 25 bp, Homo sapien
atataataacatgtccatcacggat

SEQ ID NO: 348740 - DNA, 25 bp, Homo sapien
ataacatgtccatcacggatcttgg

SEQ ID NO: 348741 - DNA, 25 bp, Homo sapien
acatgtccatcacggatcttggtcc

SEQ ID NO: 348742 - DNA, 25 bp, Homo sapien
gctggtttgcagatcccttgcagtg

SEQ ID NO: 348743 - DNA, 25 bp, Homo sapien
ggcaatgtcttgcagaaattcctct

SEQ ID NO: 348744 - DNA, 25 bp, Homo sapien
tttagtattccagtctgtgggctct

SEQ ID NO: 348745 - DNA, 25 bp, Homo sapien
gtctgtgggctctggcagaagtaat

SEQ ID NO: 348746 - DNA, 25 bp, Homo sapien
ctgctgcaaacagatcactcttttt

SEQ ID NO: 348747 - DNA, 25 bp, Homo sapien
gtttgcaaagtcttcgtaccagctg

SEQ ID NO: 348748 - DNA, 25 bp, Homo sapien
gatcccttgcagtgactctacagct

SEQ ID NO: 348749 - DNA, 25 bp, Homo sapien
gctgaatcacagcttgcttttcact

SEQ ID NO: 348750 - DNA, 25 bp, Homo sapien
gcttttcacttttcgtaacaccttg

SEQ ID NO: 348751 - DNA, 25 bp, Homo sapien
tttcgtaacaccttgcaacatcgca

SEQ ID NO: 348752 - DNA, 25 bp, Homo sapien
tgaaacctaccaggccaaacaattt

SEQ ID NO: 348753 - DNA, 25 bp, Homo sapien
aaaaactggttggttcacgctcctg

SEQ ID NO: 348754 - DNA, 25 bp, Homo sapien
cacgctcctgtatgaaattcgatta

SEQ ID NO: 348755 - DNA, 25 bp, Homo sapien
ttaaaacccgagaaagcagctgagt

SEQ ID NO: 348756 - DNA, 25 bp, Homo sapien
gaaagcagctgagtgggagatccat

SEQ ID NO: 348757 - DNA, 25 bp, Homo sapien
gggagatccattttgctgggcagca

SEQ ID NO: 348758 - DNA, 25 bp, Homo sapien
acagagtttaagattctcagcctac

SEQ ID NO: 348759 - DNA, 25 bp, Homo sapien
ttctcagcctacatccaggacagaa

SEQ ID NO: 348760 - DNA, 25 bp, Homo sapien
aaataccttgtccaggttcgctgca

SEQ ID NO: 348761 - DNA, 25 bp, Homo sapien
gttcgctgcaaaccagaccatggat

SEQ ID NO: 348762 - DNA, 25 bp, Homo sapien
ggagtgcatggagtccagcgacctt

SEQ ID NO: 348763 - DNA, 25 bp, Homo sapien
gcgaccttcattcagatacctagtg

SEQ ID NO: 348764 - DNA, 25 bp, Homo sapien
ggccccacggcgctggaggagatgc

SEQ ID NO: 348765 - DNA, 25 bp, Homo sapien
gatgccgcggccgtacgtggactac

SEQ ID NO: 348766 - DNA, 25 bp, Homo sapien
acccaagggctacggtgccagcgta

SEQ ID NO: 348767 - DNA, 25 bp, Homo sapien
tcatgccaaccccagtgacgcggag

SEQ ID NO: 348768 - DNA, 25 bp, Homo sapien
cgcggaggcccagcttcgaaggaac

SEQ ID NO: 348769 - DNA, 25 bp, Homo sapien
gcccagcttcgaaggaaccggcgat

SEQ ID NO: 348770 - DNA, 25 bp, Homo sapien
gaaggaaccggcgattcgtttgcgt

SEQ ID NO: 348771 - DNA, 25 bp, Homo sapien
gaaccggcgattcgtttgcgtccta

SEQ ID NO: 348772 - DNA, 25 bp, Homo sapien
gattcgtttgcgtcctaccaccagc

SEQ ID NO: 348773 - DNA, 25 bp, Homo sapien
gcgtcctaccaccagctgagcggta

SEQ ID NO: 348774 - DNA, 25 bp, Homo sapien
acgagggcccaagcttcggcgctga

SEQ ID NO: 348775 - DNA, 25 bp, Homo sapien
aatgggtggctcagcaccaccagat

SEQ ID NO: 348776 - DNA, 25 bp, Homo sapien
tcagcaccaccagatagcagctgga

SEQ ID NO: 348777 - DNA, 25 bp, Homo sapien
aatgttggacctggctttactggaa

SEQ ID NO: 348778 - DNA, 25 bp, Homo sapien
aaagtcaagatgcacatccactcta

SEQ ID NO: 348779 - DNA, 25 bp, Homo sapien
tgcacatccactctaccaatgaagt

SEQ ID NO: 348780 - DNA, 25 bp, Homo sapien
caatgtgataggtactctcagagga

SEQ ID NO: 348781 - DNA, 25 bp, Homo sapien
ggaaccagacagatatgtcattctg

SEQ ID NO: 348782 - DNA, 25 bp, Homo sapien
tcaccgggactcatgggtgtttggt

SEQ ID NO: 348783 - DNA, 25 bp, Homo sapien
ggtgtttggtggtattgaccctcag

SEQ ID NO: 348784 - DNA, 25 bp, Homo sapien
ttgaccctcagagtggagcagctgt

SEQ ID NO: 348785 - DNA, 25 bp, Homo sapien
agtggagcagctgttgttcatgaaa

SEQ ID NO: 348786 - DNA, 25 bp, Homo sapien
ttcagtgtcacctaagggaggcccc

SEQ ID NO: 348787 - DNA, 25 bp, Homo sapien
gtccagttcatttcctctacaggac

SEQ ID NO: 348788 - DNA, 25 bp, Homo sapien
aagagcatcctgtcccatcagacct

SEQ ID NO: 348789 - DNA, 25 bp, Homo sapien
tcttgtttcctgttggccatctgtc

SEQ ID NO: 348790 - DNA, 25 bp, Homo sapien
gaggcataccctctatggtgcaaag

SEQ ID NO: 348791 - DNA, 25 bp, Homo sapien
aaagagctcaactaccctggtgatc

SEQ ID NO: 348792 - DNA, 25 bp, Homo sapien
aagcacagatgtatccattggacac

SEQ ID NO: 348793 - DNA, 25 bp, Homo sapien
acacatgagttagtacctggtcccc

SEQ ID NO: 348794 - DNA, 25 bp, Homo sapien
ctctggtgggctggtcatcctagga

SEQ ID NO: 348795 - DNA, 25 bp, Homo sapien
gtcatcctaggattttcacatggca

SEQ ID NO: 348796 - DNA, 25 bp, Homo sapien
ctcccaggctacagcttcagtgtca

SEQ ID NO: 348797 - DNA, 25 bp, Homo sapien
cgaattcatactccgtaattcccct

SEQ ID NO: 348798 - DNA, 25 bp, Homo sapien
taattcccctcgcacatttgtggtg

SEQ ID NO: 348799 - DNA, 25 bp, Homo sapien
caattctcatatacacagtggtctg

SEQ ID NO: 348800 - DNA, 25 bp, Homo sapien
acagtggtctgtttctgatcgctct

SEQ ID NO: 348801 - DNA, 25 bp, Homo sapien
gtttctgatcgctctgttgtgtttc

SEQ ID NO: 348802 - DNA, 25 bp, Homo sapien
tgttgtgtttctcaggtatttttgt

SEQ ID NO: 348803 - DNA, 25 bp, Homo sapien
ttttgtttctgtgcccgaactgata

SEQ ID NO: 348804 - DNA, 25 bp, Homo sapien
gaactgataccgttctcactgttgt

SEQ ID NO: 348805 - DNA, 25 bp, Homo sapien
gctttgcagcctatcttaatatctg

SEQ ID NO: 348806 - DNA, 25 bp, Homo sapien
taatatctggcagggtcggcctttc

SEQ ID NO: 348807 - DNA, 25 bp, Homo sapien
tcggcctttcctctttgctcttatt

SEQ ID NO: 348808 - DNA, 25 bp, Homo sapien
aattcaaattctcttctggccagga

SEQ ID NO: 348809 - DNA, 25 bp, Homo sapien
caaattctcttctggccaggaggaa

SEQ ID NO: 348810 - DNA, 25 bp, Homo sapien
gaggaagggcagatgctccctcctt

SEQ ID NO: 348811 - DNA, 25 bp, Homo sapien
aagcctccctggctcattgatccat

SEQ ID NO: 348812 - DNA, 25 bp, Homo sapien
aagttgagaccagattgcttcagtt

SEQ ID NO: 348813 - DNA, 25 bp, Homo sapien
tctgctctgttcagtttgctgttgt

SEQ ID NO: 348814 - DNA, 25 bp, Homo sapien
ctctgttcagtttgctgttgtgttt

SEQ ID NO: 348815 - DNA, 25 bp, Homo sapien
taaaatgctttctcccaggccccta

SEQ ID NO: 348816 - DNA, 25 bp, Homo sapien
agcctcaaagctgctgacagtcatg

SEQ ID NO: 348817 - DNA, 25 bp, Homo sapien
agctgctgacagtcatgaactgcac

SEQ ID NO: 348818 - DNA, 25 bp, Homo sapien
agccctgcccataagctactcaaag

SEQ ID NO: 348819 - DNA, 25 bp, Homo sapien
aacatgttttctggccaggcacctg

SEQ ID NO: 348820 - DNA, 25 bp, Homo sapien
atgttttctggccaggcacctgtaa

SEQ ID NO: 348821 - DNA, 25 bp, Homo sapien
tgttttctggccaggcacctgtaat

SEQ ID NO: 348822 - DNA, 25 bp, Homo sapien
gaaatttataaatatgcttcttgaa

SEQ ID NO: 348823 - DNA, 25 bp, Homo sapien
gcttcttgaataatacacattttgg

SEQ ID NO: 348824 - DNA, 25 bp, Homo sapien
ttcttgaataatacacattttggga

SEQ ID NO: 348825 - DNA, 25 bp, Homo sapien
atgtctgttcaaaaagtaaaggtct

SEQ ID NO: 348826 - DNA, 25 bp, Homo sapien
gtctgttcaaaaagtaaaggtctct

SEQ ID NO: 348827 - DNA, 25 bp, Homo sapien
gaattggaatatgaatatggactta

SEQ ID NO: 348828 - DNA, 25 bp, Homo sapien
atatggacttataatatgttttctc

SEQ ID NO: 348829 - DNA, 25 bp, Homo sapien
aaacatgttttctggccaggcacct

SEQ ID NO: 348830 - DNA, 25 bp, Homo sapien
ggtgacctcccagaatgacatatct

SEQ ID NO: 348831 - DNA, 25 bp, Homo sapien
tgacatatctgtctggttccactgc

SEQ ID NO: 348832 - DNA, 25 bp, Homo sapien
ctcctctgagagtacctatcacatt

SEQ ID NO: 348833 - DNA, 25 bp, Homo sapien
gtaaattcttgtcacttcattggta

SEQ ID NO: 348834 - DNA, 25 bp, Homo sapien
gatgtgcatcttgactttttgtgta

SEQ ID NO: 348835 - DNA, 25 bp, Homo sapien
gtttccagtaaagccaggtccaaca

SEQ ID NO: 348836 - DNA, 25 bp, Homo sapien
caggtccaacattgtagggcacttt

SEQ ID NO: 348837 - DNA, 25 bp, Homo sapien
gtagggcactttgagacttcctctc

SEQ ID NO: 348838 - DNA, 25 bp, Homo sapien
tttttcagtgttccaaagctcctca

SEQ ID NO: 348839 - DNA, 25 bp, Homo sapien
aaagctcctcacaatttcatgaaca

SEQ ID NO: 348840 - DNA, 25 bp, Homo sapien
agctgctccactctgagggtcaata

SEQ ID NO: 348841 - DNA, 25 bp, Homo sapien
gggaccactgctttatacagtgttt

SEQ ID NO: 348842 - DNA, 25 bp, Homo sapien
tatacagtgtttgaagtaggcacac

SEQ ID NO: 348843 - DNA, 25 bp, Homo sapien
gtaggcacacttacagttactattt

SEQ ID NO: 348844 - DNA, 25 bp, Homo sapien
gttactatttctggttctttatgac

SEQ ID NO: 348845 - DNA, 25 bp, Homo sapien
tctggttctttatgactgttgaggg

SEQ ID NO: 348846 - DNA, 25 bp, Homo sapien
ttgattcacagtaaaacttttcatg

SEQ ID NO: 348847 - DNA, 25 bp, Homo sapien
gtaaaacttttcatgaatcattgag

SEQ ID NO: 348848 - DNA, 25 bp, Homo sapien
gaatcattgagggttaactgttatc

SEQ ID NO: 348849 - DNA, 25 bp, Homo sapien
gggttaactgttatcacttgccaat

SEQ ID NO: 348850 - DNA, 25 bp, Homo sapien
taactgttatcacttgccaatggaa

SEQ ID NO: 348851 - DNA, 25 bp, Homo sapien
ctgttatcacttgccaatggaaact

SEQ ID NO: 348852 - DNA, 25 bp, Homo sapien
ttgtcgttgaaggtaggacccgcct

SEQ ID NO: 348853 - DNA, 25 bp, Homo sapien
ggacccgcctgaaacctaggataat

SEQ ID NO: 348854 - DNA, 25 bp, Homo sapien
aatctcattttgatatccttagttt

SEQ ID NO: 348855 - DNA, 25 bp, Homo sapien
tttaattacatgtgcaaaggccctt

SEQ ID NO: 348856 - DNA, 25 bp, Homo sapien
aaggcccttttatcaagtgaggtca

SEQ ID NO: 348857 - DNA, 25 bp, Homo sapien
tcacagattccagggcttagagggt

SEQ ID NO: 348858 - DNA, 25 bp, Homo sapien
gtggaggtatcattttgcgtgcccc

SEQ ID NO: 348859 - DNA, 25 bp, Homo sapien
atctggacatgcagtgtcctctccc

SEQ ID NO: 348860 - DNA, 25 bp, Homo sapien
tagccgtcttcccagaacgtaatgt

SEQ ID NO: 348861 - DNA, 25 bp, Homo sapien
gtcttcccagaacgtaatgtgtctt

SEQ ID NO: 348862 - DNA, 25 bp, Homo sapien
atgtgtcttaaatccgtcatgctga

SEQ ID NO: 348863 - DNA, 25 bp, Homo sapien
tcttctacctctttatatggaatat

SEQ ID NO: 348864 - DNA, 25 bp, Homo sapien
gaagcatttgcactaaatcatctct

SEQ ID NO: 348865 - DNA, 25 bp, Homo sapien
caaactcccaggtttctatatgcca

SEQ ID NO: 348866 - DNA, 25 bp, Homo sapien
gcactaaatcatctctcttgaggaa

SEQ ID NO: 348867 - DNA, 25 bp, Homo sapien
atctctcttgaggaaatttagtaac

SEQ ID NO: 348868 - DNA, 25 bp, Homo sapien
aactcccaggtttctatatgccagc

SEQ ID NO: 348869 - DNA, 25 bp, Homo sapien
gtaacaaccagaacgttttgagaat

SEQ ID NO: 348870 - DNA, 25 bp, Homo sapien
gaacgttttgagaatgacttgaaca

SEQ ID NO: 348871 - DNA, 25 bp, Homo sapien
tgacttgaacagtgtaactgggttt

SEQ ID NO: 348872 - DNA, 25 bp, Homo sapien
gagtttattcacttagacatatttt

SEQ ID NO: 348873 - DNA, 25 bp, Homo sapien
tatgccagccaagaggtgactttgt

SEQ ID NO: 348874 - DNA, 25 bp, Homo sapien
tgaaatcaggctggcaccgcgggaa

SEQ ID NO: 348875 - DNA, 25 bp, Homo sapien
accgcgggaagaggctagagtcact

SEQ ID NO: 348876 - DNA, 25 bp, Homo sapien
tagagtcactaaatcaccttgtcct

SEQ ID NO: 348877 - DNA, 25 bp, Homo sapien
aaatcaccttgtcctcttgaggctg

SEQ ID NO: 348878 - DNA, 25 bp, Homo sapien
cacgatggcgcgtccctctcagaaa

SEQ ID NO: 348879 - DNA, 25 bp, Homo sapien
tgctgtccgtatgcagcgacattct

SEQ ID NO: 348880 - DNA, 25 bp, Homo sapien
gacattctgcccgttagaggactca

SEQ ID NO: 348881 - DNA, 25 bp, Homo sapien
tcagggcctggtacgctcaagatct

SEQ ID NO: 348882 - DNA, 25 bp, Homo sapien
gcctggtacgctcaagatctgttag

SEQ ID NO: 348883 - DNA, 25 bp, Homo sapien
agatctgttagctaccagcaccatc

SEQ ID NO: 348884 - DNA, 25 bp, Homo sapien
cctgcgttaggacccgatactggct

SEQ ID NO: 348885 - DNA, 25 bp, Homo sapien
gatgaaatcttaggctgtcccactt

SEQ ID NO: 348886 - DNA, 25 bp, Homo sapien
acttcgtctcgcctgggatgtgaat

SEQ ID NO: 348887 - DNA, 25 bp, Homo sapien
tcgcctgggatgtgaattgtccttt

SEQ ID NO: 348888 - DNA, 25 bp, Homo sapien
ttttgtcctgcttatgcacgctgta

SEQ ID NO: 348889 - DNA, 25 bp, Homo sapien
atgcacgctgtatatgttacccacc

SEQ ID NO: 348890 - DNA, 25 bp, Homo sapien
tgttacccaccgtttagtcacttag

SEQ ID NO: 348891 - DNA, 25 bp, Homo sapien
tagtcacttagcagccatctggatt

SEQ ID NO: 348892 - DNA, 25 bp, Homo sapien
agcagccatctggattctcagattg

SEQ ID NO: 348893 - DNA, 25 bp, Homo sapien
agggttctgttctatcaaatgtttc

SEQ ID NO: 348894 - DNA, 25 bp, Homo sapien
tttccatggtttcagctacccatag

SEQ ID NO: 348895 - DNA, 25 bp, Homo sapien
agctacccatagtcaatcacaatat

SEQ ID NO: 348896 - DNA, 25 bp, Homo sapien
tggtgtgtgtcttcccagatgttgt

SEQ ID NO: 348897 - DNA, 25 bp, Homo sapien
tatatgaatacccacacatttgtat

SEQ ID NO: 348898 - DNA, 25 bp, Homo sapien
tttcactttgcattgtattctggac

SEQ ID NO: 348899 - DNA, 25 bp, Homo sapien
tttgcattgtattctggacctcctc

SEQ ID NO: 348900 - DNA, 25 bp, Homo sapien
tattctggacctcctcttgcattaa

SEQ ID NO: 348901 - DNA, 25 bp, Homo sapien
ggacctcctcttgcattaatacatg

SEQ ID NO: 348902 - DNA, 25 bp, Homo sapien
ctgcataacatttcatggtatggtt

SEQ ID NO: 348903 - DNA, 25 bp, Homo sapien
catttcatggtatggttgtatcaca

SEQ ID NO: 348904 - DNA, 25 bp, Homo sapien
gtatcacaatttaatgattcaccta

SEQ ID NO: 348905 - DNA, 25 bp, Homo sapien
gattcacctattgatgcaaatttgt

SEQ ID NO: 348906 - DNA, 25 bp, Homo sapien
gatgcaaatttgtctccaatcattc

SEQ ID NO: 348907 - DNA, 25 bp, Homo sapien
gaaattaagtagcattgaagatcaa

SEQ ID NO: 348908 - DNA, 25 bp, Homo sapien
ttatagatgaggtatcaggatccat

SEQ ID NO: 348909 - DNA, 25 bp, Homo sapien
gaggtatcaggatccattataggtt

SEQ ID NO: 348910 - DNA, 25 bp, Homo sapien
gtatcaggatccattataggttgta

SEQ ID NO: 348911 - DNA, 25 bp, Homo sapien
tcaggatccattataggttgtaaaa

SEQ ID NO: 348912 - DNA, 25 bp, Homo sapien
attcatgttcttcatagattgagtc

SEQ ID NO: 348913 - DNA, 25 bp, Homo sapien
catgttcttcatagattgagtctaa

SEQ ID NO: 348914 - DNA, 25 bp, Homo sapien
aaagctctagttttttgcttgttgg

SEQ ID NO: 348915 - DNA, 25 bp, Homo sapien
gctctagttttttgcttgttggtat

SEQ ID NO: 348916 - DNA, 25 bp, Homo sapien
gttttttgcttgttggtatatgtaa

SEQ ID NO: 348917 - DNA, 25 bp, Homo sapien
ttgcttgttggtatatgtaaatttg

SEQ ID NO: 348918 - DNA, 25 bp, Homo sapien
gcaccttgggcttgtctgtcccaca

SEQ ID NO: 348919 - DNA, 25 bp, Homo sapien
tgtcccacatcatcagtggcattaa

SEQ ID NO: 348920 - DNA, 25 bp, Homo sapien
ggcattaagcacaagagataccatc

SEQ ID NO: 348921 - DNA, 25 bp, Homo sapien
gataccatcttagcacaatcctttt

SEQ ID NO: 348922 - DNA, 25 bp, Homo sapien
gggaactgcaggaagcgtctagctc

SEQ ID NO: 348923 - DNA, 25 bp, Homo sapien
gcgtctagctcataggcataggcct

SEQ ID NO: 348924 - DNA, 25 bp, Homo sapien
taggcctttcagtaaaggtcaccca

SEQ ID NO: 348925 - DNA, 25 bp, Homo sapien
aggtcacccatccagggatccagga

SEQ ID NO: 348926 - DNA, 25 bp, Homo sapien
atccaggatgtagctggttccaggt

SEQ ID NO: 348927 - DNA, 25 bp, Homo sapien
ggttccaggtgatgaaatcttccca

SEQ ID NO: 348928 - DNA, 25 bp, Homo sapien
gaaatcttcccaccttatgactggg

SEQ ID NO: 348929 - DNA, 25 bp, Homo sapien
aattattatccatcagagtatgctg

SEQ ID NO: 348930 - DNA, 25 bp, Homo sapien
gtatgctgaaattgataaagcccca

SEQ ID NO: 348931 - DNA, 25 bp, Homo sapien
gataaagccccagatgaaagccctt

SEQ ID NO: 348932 - DNA, 25 bp, Homo sapien
gccccagatgaaagcccttacattg

SEQ ID NO: 348933 - DNA, 25 bp, Homo sapien
gaaagcccttacattggcaaatcca

SEQ ID NO: 348934 - DNA, 25 bp, Homo sapien
tgtttgccacagagagttatattat

SEQ ID NO: 348935 - DNA, 25 bp, Homo sapien
atattattgacagtgctcaggcagt

SEQ ID NO: 348936 - DNA, 25 bp, Homo sapien
agtgctcaggcagtacagatcaaga

SEQ ID NO: 348937 - DNA, 25 bp, Homo sapien
tcaggcagtacagatcaagaagatg

SEQ ID NO: 348938 - DNA, 25 bp, Homo sapien
gatggagccagatgaacaacttaga

SEQ ID NO: 348939 - DNA, 25 bp, Homo sapien
tgaacaacttagaaatgatcacatg

SEQ ID NO: 348940 - DNA, 25 bp, Homo sapien
tatatggcctgactaagtgcctgcc

SEQ ID NO: 348941 - DNA, 25 bp, Homo sapien
ctgactaagtgcctgccattcgaca

SEQ ID NO: 348942 - DNA, 25 bp, Homo sapien
taagtgcctgccattcgacaccttc

SEQ ID NO: 348943 - DNA, 25 bp, Homo sapien
attcgacaccttcctcttagtacca

SEQ ID NO: 348944 - DNA, 25 bp, Homo sapien
acaccttcctcttagtaccatgcat

SEQ ID NO: 348945 - DNA, 25 bp, Homo sapien
taccatgcatccttatgacagcact

SEQ ID NO: 348946 - DNA, 25 bp, Homo sapien
catccttatgacagcactgcagtat

SEQ ID NO: 348947 - DNA, 25 bp, Homo sapien
gacagcactgcagtatacaggttat

SEQ ID NO: 348948 - DNA, 25 bp, Homo sapien
gtatacaggttattatctagggcaa

SEQ ID NO: 348949 - DNA, 25 bp, Homo sapien
agttacagtcagagctgggcacagt

SEQ ID NO: 348950 - DNA, 25 bp, Homo sapien
tagaatcccagcttacttagggggc

SEQ ID NO: 348951 - DNA, 25 bp, Homo sapien
tagctaggaatctctgacaaggacc

SEQ ID NO: 348952 - DNA, 25 bp, Homo sapien
gaccagaacttgcatcctcagatat

SEQ ID NO: 348953 - DNA, 25 bp, Homo sapien
ttgcatcctcagatatcttcagtgt

SEQ ID NO: 348954 - DNA, 25 bp, Homo sapien
atcttcagtgttgtgggtcttcagc

SEQ ID NO: 348955 - DNA, 25 bp, Homo sapien
gcacagccttgaagataattcctaa

SEQ ID NO: 348956 - DNA, 25 bp, Homo sapien
ggctcagtccacaaaaatatcacca

SEQ ID NO: 348957 - DNA, 25 bp, Homo sapien
acatcacatcattattgctcaggaa

SEQ ID NO: 348958 - DNA, 25 bp, Homo sapien
tgctcaggaacaaatgcttcagata

SEQ ID NO: 348959 - DNA, 25 bp, Homo sapien
tctttgccagcctcaaaaataaggt

SEQ ID NO: 348960 - DNA, 25 bp, Homo sapien
aacagtctctcggtttacagttgga

SEQ ID NO: 348961 - DNA, 25 bp, Homo sapien
acagttggacagttgtagcctcaag

SEQ ID NO: 348962 - DNA, 25 bp, Homo sapien
aacatgttttctggccaggcacctg

SEQ ID NO: 348963 - DNA, 25 bp, Homo sapien
atgttttctggccaggcacctgtaa

SEQ ID NO: 348964 - DNA, 25 bp, Homo sapien
tgttttctggccaggcacctgtaat

SEQ ID NO: 348965 - DNA, 25 bp, Homo sapien
gcacctggccgatattttctttaat

SEQ ID NO: 348966 - DNA, 25 bp, Homo sapien
gaaatttataaatatgcttcttgaa

SEQ ID NO: 348967 - DNA, 25 bp, Homo sapien
gcttcttgaataatacacattttgg

SEQ ID NO: 348968 - DNA, 25 bp, Homo sapien
ttcttgaataatacacattttggga

SEQ ID NO: 348969 - DNA, 25 bp, Homo sapien
atgtctgttcaaaaagtaaaggtct

SEQ ID NO: 348970 - DNA, 25 bp, Homo sapien
gtctgttcaaaaagtaaaggtctct

SEQ ID NO: 348971 - DNA, 25 bp, Homo sapien
atatggacttataatatgttttctc

SEQ ID NO: 348972 - DNA, 25 bp, Homo sapien
aaacatgttttctggccaggcacct

SEQ ID NO: 348973 - DNA, 25 bp, Homo sapien
cctagaggagctgtggattcaagtg

SEQ ID NO: 348974 - DNA, 25 bp, Homo sapien
gggttaagggcagcttacattacta

SEQ ID NO: 348975 - DNA, 25 bp, Homo sapien
ccatctgcccgtggaaaccaaggga

SEQ ID NO: 348976 - DNA, 25 bp, Homo sapien
gggcagcttacattactatagctcc

SEQ ID NO: 348977 - DNA, 25 bp, Homo sapien
accaagggaaccaaatgcatcgtac

SEQ ID NO: 348978 - DNA, 25 bp, Homo sapien
gggaaccaaatgcatcgtactgggt

SEQ ID NO: 348979 - DNA, 25 bp, Homo sapien
atgcatcgtactgggttgcaggcct

SEQ ID NO: 348980 - DNA, 25 bp, Homo sapien
tcgtactgggttgcaggccttaatc

SEQ ID NO: 348981 - DNA, 25 bp, Homo sapien
cattactatagctccaagtcttggt

SEQ ID NO: 348982 - DNA, 25 bp, Homo sapien
tatagctccaagtcttggttgcccc

SEQ ID NO: 348983 - DNA, 25 bp, Homo sapien
caagtcttggttgcccccagagaga

SEQ ID NO: 348984 - DNA, 25 bp, Homo sapien
gcaggtcactttctggggaacaaca

SEQ ID NO: 348985 - DNA, 25 bp, Homo sapien
gggaacaacacagtcatcgacatcc

SEQ ID NO: 348986 - DNA, 25 bp, Homo sapien
ggaacaacacagtcatcgacatcct

SEQ ID NO: 348987 - DNA, 25 bp, Homo sapien
gaacaacacagtcatcgacatcctg

SEQ ID NO: 348988 - DNA, 25 bp, Homo sapien
aacaacacagtcatcgacatcctgc

SEQ ID NO: 348989 - DNA, 25 bp, Homo sapien
acaacacagtcatcgacatcctgcg

SEQ ID NO: 348990 - DNA, 25 bp, Homo sapien
caacacagtcatcgacatcctgcgg

SEQ ID NO: 348991 - DNA, 25 bp, Homo sapien
acatcctgcggcaggcagggctgga

SEQ ID NO: 348992 - DNA, 25 bp, Homo sapien
tggaggtggaccacacacccgccgg

SEQ ID NO: 348993 - DNA, 25 bp, Homo sapien
ggtggaccacacacccgccgggcag

SEQ ID NO: 348994 - DNA, 25 bp, Homo sapien
gccgggcaggccatacacagccctg

SEQ ID NO: 348995 - DNA, 25 bp, Homo sapien
ggaggaattagactgcgtaaacatc

SEQ ID NO: 348996 - DNA, 25 bp, Homo sapien
gactgcgtaaacatctcaaaacagg

SEQ ID NO: 348997 - DNA, 25 bp, Homo sapien
gctaggaagcataaatgccccagtg

SEQ ID NO: 348998 - DNA, 25 bp, Homo sapien
gatggctgcaactaggtctcttaac

SEQ ID NO: 348999 - DNA, 25 bp, Homo sapien
ctaggtctcttaacttattgtaatc

SEQ ID NO: 349000 - DNA, 25 bp, Homo sapien
tattgtaatctaaaccttgggtgag

SEQ ID NO: 349001 - DNA, 25 bp, Homo sapien
gctttttaaagtccactgaagactt

SEQ ID NO: 349002 - DNA, 25 bp, Homo sapien
tgaagacttcagatgtggcaaaaat

SEQ ID NO: 349003 - DNA, 25 bp, Homo sapien
tctggccatgagaaattgtctgagt

SEQ ID NO: 349004 - DNA, 25 bp, Homo sapien
ggaaaatttcatccttatcaggaag

SEQ ID NO: 349005 - DNA, 25 bp, Homo sapien
ttatgtggaacttccaggtggttac

SEQ ID NO: 349006 - DNA, 25 bp, Homo sapien
tccctttccctcgagatcttgaaaa

SEQ ID NO: 349007 - DNA, 25 bp, Homo sapien
gaagacttcacttggcagtaacggt

SEQ ID NO: 349008 - DNA, 25 bp, Homo sapien
gttgtcattttatgcacacatggaa

SEQ ID NO: 349009 - DNA, 25 bp, Homo sapien
accacgtggtgtcattgctggtcct

SEQ ID NO: 349010 - DNA, 25 bp, Homo sapien
aatatcctacatactggactcctca

SEQ ID NO: 349011 - DNA, 25 bp, Homo sapien
tggactcctcattagtcctctgagt

SEQ ID NO: 349012 - DNA, 25 bp, Homo sapien
attagtcctctgagtcttctgttcc

SEQ ID NO: 349013 - DNA, 25 bp, Homo sapien
aacacactgcattgggatcaaactg

SEQ ID NO: 349014 - DNA, 25 bp, Homo sapien
tgtcattgctggtcctgccatagct

SEQ ID NO: 349015 - DNA, 25 bp, Homo sapien
tgccatagctcccaggaccaatgct

SEQ ID NO: 349016 - DNA, 25 bp, Homo sapien
gctacataaatacatccggtccctt

SEQ ID NO: 349017 - DNA, 25 bp, Homo sapien
cacgcgtccggttatctaaatcaca

SEQ ID NO: 349018 - DNA, 25 bp, Homo sapien
gcgtccggttatctaaatcacattt

SEQ ID NO: 349019 - DNA, 25 bp, Homo sapien
gtccggttatctaaatcacattttg

SEQ ID NO: 349020 - DNA, 25 bp, Homo sapien
ttatctgtaaaactgttagctgagc

SEQ ID NO: 349021 - DNA, 25 bp, Homo sapien
tgtaaaactgttagctgagcaaaat

SEQ ID NO: 349022 - DNA, 25 bp, Homo sapien
ttagctgagcaaaataactagtgtt

SEQ ID NO: 349023 - DNA, 25 bp, Homo sapien
tagtgttgccagataaaagcaagct

SEQ ID NO: 349024 - DNA, 25 bp, Homo sapien
gccagataaaagcaagctaccgata

SEQ ID NO: 349025 - DNA, 25 bp, Homo sapien
gcagttagatgtagtaagtctctta

SEQ ID NO: 349026 - DNA, 25 bp, Homo sapien
tattaactcactagaaacagccaag

SEQ ID NO: 349027 - DNA, 25 bp, Homo sapien
tcactagaaacagccaagttatcaa

SEQ ID NO: 349028 - DNA, 25 bp, Homo sapien
tcttccaaagataaggcggatgctc

SEQ ID NO: 349029 - DNA, 25 bp, Homo sapien
aaggcggatgctcaaatatgtgtaa

SEQ ID NO: 349030 - DNA, 25 bp, Homo sapien
gcaactgttaacagagactgtgctg

SEQ ID NO: 349031 - DNA, 25 bp, Homo sapien
gagactgtgctgtaaggagtactta

SEQ ID NO: 349032 - DNA, 25 bp, Homo sapien
ggagtacttatgtcctatagtaatt

SEQ ID NO: 349033 - DNA, 25 bp, Homo sapien
acaaatacatgtatgtctccttttg

SEQ ID NO: 349034 - DNA, 25 bp, Homo sapien
gtatgtctccttttgatgtgtacag

SEQ ID NO: 349035 - DNA, 25 bp, Homo sapien
tatactgtttaatctgaagaagctg

SEQ ID NO: 349036 - DNA, 25 bp, Homo sapien
gttacatgtttatgaaactctaaga

SEQ ID NO: 349037 - DNA, 25 bp, Homo sapien
ctgggataaatttgttagcctggga

SEQ ID NO: 349038 - DNA, 25 bp, Homo sapien
gttagcctgggatatcttccaaaga

SEQ ID NO: 349039 - DNA, 25 bp, Homo sapien
tggtatctccaatttagaaaggtag

SEQ ID NO: 349040 - DNA, 25 bp, Homo sapien
atgatgggtacagtgtttttacggg

SEQ ID NO: 349041 - DNA, 25 bp, Homo sapien
aatgcattcatgtttgtctactctt

SEQ ID NO: 349042 - DNA, 25 bp, Homo sapien
tgtctactcttaaaacccagctgtc

SEQ ID NO: 349043 - DNA, 25 bp, Homo sapien
gctgtccaagaacgattccccaagg

SEQ ID NO: 349044 - DNA, 25 bp, Homo sapien
tttctctttctatccttgaagcgca

SEQ ID NO: 349045 - DNA, 25 bp, Homo sapien
atccttgaagcgcagtgtctgacac

SEQ ID NO: 349046 - DNA, 25 bp, Homo sapien
tgtctgacacataggatgtgctcat

SEQ ID NO: 349047 - DNA, 25 bp, Homo sapien
gatgtgctcattgatgccagatgat

SEQ ID NO: 349048 - DNA, 25 bp, Homo sapien
tgatgccagatgatgaaacttgaat

SEQ ID NO: 349049 - DNA, 25 bp, Homo sapien
tatggtgacactgaacactcatgaa

SEQ ID NO: 349050 - DNA, 25 bp, Homo sapien
atgagtagtgatataactgtggact

SEQ ID NO: 349051 - DNA, 25 bp, Homo sapien
ttatactcattgtagaactgtgctt

SEQ ID NO: 349052 - DNA, 25 bp, Homo sapien
gatgacatagttgcatgctcgtact

SEQ ID NO: 349053 - DNA, 25 bp, Homo sapien
agttgcatgctcgtactatgttgtt

SEQ ID NO: 349054 - DNA, 25 bp, Homo sapien
catgctcgtactatgttgttgggta

SEQ ID NO: 349055 - DNA, 25 bp, Homo sapien
tgttgggtacaagggctaggttaca

SEQ ID NO: 349056 - DNA, 25 bp, Homo sapien
gtgctttcattcataatacagtttg

SEQ ID NO: 349057 - DNA, 25 bp, Homo sapien
attcataatacagtttgcttccacc

SEQ ID NO: 349058 - DNA, 25 bp, Homo sapien
agtttgcttccaccatttgcatatc

SEQ ID NO: 349059 - DNA, 25 bp, Homo sapien
ttgcatatcccacttcattgttagc

SEQ ID NO: 349060 - DNA, 25 bp, Homo sapien
cttcattgttagctaagtgtgtaaa

SEQ ID NO: 349061 - DNA, 25 bp, Homo sapien
aagttatggttttatctctagagaa

SEQ ID NO: 349062 - DNA, 25 bp, Homo sapien
gttatggttttatctctagagaaaa

SEQ ID NO: 349063 - DNA, 25 bp, Homo sapien
gaaaaagcaatgatgacttctaaat

SEQ ID NO: 349064 - DNA, 25 bp, Homo sapien
ttgagactcttagatggatggaaaa

SEQ ID NO: 349065 - DNA, 25 bp, Homo sapien
ggcatcaatttgaataacgcatagt

SEQ ID NO: 349066 - DNA, 25 bp, Homo sapien
taacgcatagtttaagaagcttgta

SEQ ID NO: 349067 - DNA, 25 bp, Homo sapien
gcatagtttaagaagcttgtagcat

SEQ ID NO: 349068 - DNA, 25 bp, Homo sapien
catttgaaatagaacatgtcccaat

SEQ ID NO: 349069 - DNA, 25 bp, Homo sapien
gaacatgtcccaatattgtttctca

SEQ ID NO: 349070 - DNA, 25 bp, Homo sapien
aacatgtcccaatattgtttctcat

SEQ ID NO: 349071 - DNA, 25 bp, Homo sapien
ttctcatatttgatagtggatgttt

SEQ ID NO: 349072 - DNA, 25 bp, Homo sapien
ttttgcttaagttactttgagttgg

SEQ ID NO: 349073 - DNA, 25 bp, Homo sapien
tttgcttaagttactttgagttggg

SEQ ID NO: 349074 - DNA, 25 bp, Homo sapien
aacaggaactgagggaatatttaag

SEQ ID NO: 349075 - DNA, 25 bp, Homo sapien
caggaactgagggaatatttaagat

SEQ ID NO: 349076 - DNA, 25 bp, Homo sapien
aggaactgagggaatatttaagatc

SEQ ID NO: 349077 - DNA, 25 bp, Homo sapien
gaatatttaagatcccacagaagcg

SEQ ID NO: 349078 - DNA, 25 bp, Homo sapien
aatatttaagatcccacagaagcgt

SEQ ID NO: 349079 - DNA, 25 bp, Homo sapien
tatttaagatcccacagaagcgtaa

SEQ ID NO: 349080 - DNA, 25 bp, Homo sapien
atttaagatcccacagaagcgtaaa

SEQ ID NO: 349081 - DNA, 25 bp, Homo sapien
aatgtctgtcattaaaggataggtt

SEQ ID NO: 349082 - DNA, 25 bp, Homo sapien
atgtctgtcattaaaggataggtta

SEQ ID NO: 349083 - DNA, 25 bp, Homo sapien
aggtggtgagctgtgactctcctta

SEQ ID NO: 349084 - DNA, 25 bp, Homo sapien
ggtgagctgtgactctccttagagc

SEQ ID NO: 349085 - DNA, 25 bp, Homo sapien
agctgtgactctccttagagcctgg

SEQ ID NO: 349086 - DNA, 25 bp, Homo sapien
agagcctggcgaggccgaggtcctc

SEQ ID NO: 349087 - DNA, 25 bp, Homo sapien
cagtggtcctggaaaagcccccagt

SEQ ID NO: 349088 - DNA, 25 bp, Homo sapien
caatcctcacaaacccaattaccca

SEQ ID NO: 349089 - DNA, 25 bp, Homo sapien
ccagtccacattttctcagaatctg

SEQ ID NO: 349090 - DNA, 25 bp, Homo sapien
gtccacattttctcagaatctgtcc

SEQ ID NO: 349091 - DNA, 25 bp, Homo sapien
attttctcagaatctgtcctagccc

SEQ ID NO: 349092 - DNA, 25 bp, Homo sapien
tttctcagaatctgtcctagccctt

SEQ ID NO: 349093 - DNA, 25 bp, Homo sapien
tagcccttcagtctcccaggcatga

SEQ ID NO: 349094 - DNA, 25 bp, Homo sapien
tggatcaaactgtgtgtttaagaac

SEQ ID NO: 349095 - DNA, 25 bp, Homo sapien
gtgtttaagaacagctccaaaaggg

SEQ ID NO: 349096 - DNA, 25 bp, Homo sapien
aacagctccaaaagggactcttctg

SEQ ID NO: 349097 - DNA, 25 bp, Homo sapien
gaaatattctgagcctcgagcctag

SEQ ID NO: 349098 - DNA, 25 bp, Homo sapien
ttctgagcctcgagcctaggaagga

SEQ ID NO: 349099 - DNA, 25 bp, Homo sapien
aggaaggaggccaacagcagctctc

SEQ ID NO: 349100 - DNA, 25 bp, Homo sapien
catcaccactacaggaaccctgggt

SEQ ID NO: 349101 - DNA, 25 bp, Homo sapien
tttctctctctagtttttgaaactg

SEQ ID NO: 349102 - DNA, 25 bp, Homo sapien
gacagaagacatttcagggttgttg

SEQ ID NO: 349103 - DNA, 25 bp, Homo sapien
ttccccccagttctaaaatggtcat

SEQ ID NO: 349104 - DNA, 25 bp, Homo sapien
aaaatggtcattgatagtgtcgatc

SEQ ID NO: 349105 - DNA, 25 bp, Homo sapien
tgccccttgctatgctgaactctgt

SEQ ID NO: 349106 - DNA, 25 bp, Homo sapien
tgaactctgttggattacctctgcg

SEQ ID NO: 349107 - DNA, 25 bp, Homo sapien
ttggattacctctgcgagtctcaca

SEQ ID NO: 349108 - DNA, 25 bp, Homo sapien
gagtctcacacgtatggtttcacag

SEQ ID NO: 349109 - DNA, 25 bp, Homo sapien
attattaccacatagcacacttgag

SEQ ID NO: 349110 - DNA, 25 bp, Homo sapien
aaaatacttggcaaacctcttgact

SEQ ID NO: 349111 - DNA, 25 bp, Homo sapien
gcacacttgagaaagcctcagggat

SEQ ID NO: 349112 - DNA, 25 bp, Homo sapien
gaaagcctcagggatgcgaaacacc

SEQ ID NO: 349113 - DNA, 25 bp, Homo sapien
gggatgcgaaacaccttgcctgaag

SEQ ID NO: 349114 - DNA, 25 bp, Homo sapien
accttgcctgaagtgacatactttg

SEQ ID NO: 349115 - DNA, 25 bp, Homo sapien
acatactttgtaaacgggagggcag

SEQ ID NO: 349116 - DNA, 25 bp, Homo sapien
gggaatgtcctgaaagatttatgtg

SEQ ID NO: 349117 - DNA, 25 bp, Homo sapien
gttttctatccagcctgtccaaact

SEQ ID NO: 349118 - DNA, 25 bp, Homo sapien
tgtttcatttacattcagtggaagt

SEQ ID NO: 349119 - DNA, 25 bp, Homo sapien
ttcagtggaagtagctcttcttccc

SEQ ID NO: 349120 - DNA, 25 bp, Homo sapien
ctatccagcctgtccaaactgtcat

SEQ ID NO: 349121 - DNA, 25 bp, Homo sapien
aacagtttgtctactagttgtcctt

SEQ ID NO: 349122 - DNA, 25 bp, Homo sapien
tactagttgtccttcctctataagt

SEQ ID NO: 349123 - DNA, 25 bp, Homo sapien
tttctggaatagtgctgaaaagctt

SEQ ID NO: 349124 - DNA, 25 bp, Homo sapien
agtaattctaatctgctttgaccat

SEQ ID NO: 349125 - DNA, 25 bp, Homo sapien
taatctgctttgaccattgacctgg

SEQ ID NO: 349126 - DNA, 25 bp, Homo sapien
ctgctttgaccattgacctgggaat

SEQ ID NO: 349127 - DNA, 25 bp, Homo sapien
agcctcctctcttgcatgatgatca

SEQ ID NO: 349128 - DNA, 25 bp, Homo sapien
tcctctcttgcatgatgatcaccac

SEQ ID NO: 349129 - DNA, 25 bp, Homo sapien
ctctccccagtctcgggtgtggctg

SEQ ID NO: 349130 - DNA, 25 bp, Homo sapien
ataaggtttgagttggagctagtct

SEQ ID NO: 349131 - DNA, 25 bp, Homo sapien
aggtttgagttggagctagtctgat

SEQ ID NO: 349132 - DNA, 25 bp, Homo sapien
tttgagttggagctagtctgatgca

SEQ ID NO: 349133 - DNA, 25 bp, Homo sapien
agttggagctagtctgatgcagcag

SEQ ID NO: 349134 - DNA, 25 bp, Homo sapien
agctagtctgatgcagcagggagcc

SEQ ID NO: 349135 - DNA, 25 bp, Homo sapien
ctagtctgatgcagcagggagccct

SEQ ID NO: 349136 - DNA, 25 bp, Homo sapien
agggagccctgttttcatcaccacc

SEQ ID NO: 349137 - DNA, 25 bp, Homo sapien
tctccccagtctcaggtgtggctga

SEQ ID NO: 349138 - DNA, 25 bp, Homo sapien
agaaatccaccgatcctctcatata

SEQ ID NO: 349139 - DNA, 25 bp, Homo sapien
tatgcagtgtttgtccgtgagcatg

SEQ ID NO: 349140 - DNA, 25 bp, Homo sapien
gctggattagcagagcaaaggtcac

SEQ ID NO: 349141 - DNA, 25 bp, Homo sapien
cagtgtttgtccgtgagcatggaat

SEQ ID NO: 349142 - DNA, 25 bp, Homo sapien
gaacgttttcctgaatcggattctg

SEQ ID NO: 349143 - DNA, 25 bp, Homo sapien
atcggattctgggttaaagctgcca

SEQ ID NO: 349144 - DNA, 25 bp, Homo sapien
agctgccagtaggaagaattcacat

SEQ ID NO: 349145 - DNA, 25 bp, Homo sapien
tggaatgactcatactggcctcaga

SEQ ID NO: 349146 - DNA, 25 bp, Homo sapien
ctggcctcagagttagggactcact

SEQ ID NO: 349147 - DNA, 25 bp, Homo sapien
ggatgcagtagtgggcacatgacta

SEQ ID NO: 349148 - DNA, 25 bp, Homo sapien
gggcacatgactaagaaatccaccg

SEQ ID NO: 349149 - DNA, 25 bp, Homo sapien
atttatctctgttgtatgaatttgg

SEQ ID NO: 349150 - DNA, 25 bp, Homo sapien
agctttttccaaataactcttcatt

SEQ ID NO: 349151 - DNA, 25 bp, Homo sapien
cttcattgagagtaggctaatgctt

SEQ ID NO: 349152 - DNA, 25 bp, Homo sapien
tgagttcaggtttaatttctcaagt

SEQ ID NO: 349153 - DNA, 25 bp, Homo sapien
aaaagatgggttttggcctgccagc

SEQ ID NO: 349154 - DNA, 25 bp, Homo sapien
ttttggcctgccagcaccatgagtg

SEQ ID NO: 349155 - DNA, 25 bp, Homo sapien
accatgagtgcaggtgaaccaattt

SEQ ID NO: 349156 - DNA, 25 bp, Homo sapien
caatttagtacttggagtcccgttg

SEQ ID NO: 349157 - DNA, 25 bp, Homo sapien
acttggagtcccgttgctatatgtg

SEQ ID NO: 349158 - DNA, 25 bp, Homo sapien
cccgttgctatatgtgggagaatat

SEQ ID NO: 349159 - DNA, 25 bp, Homo sapien
tgaacttgatcttaccttaggtgga

SEQ ID NO: 349160 - DNA, 25 bp, Homo sapien
gttagattttcaccttgtgccactc

SEQ ID NO: 349161 - DNA, 25 bp, Homo sapien
ttagattttcaccttgtgccactct

SEQ ID NO: 349162 - DNA, 25 bp, Homo sapien
agattttcaccttgtgccactctct

SEQ ID NO: 349163 - DNA, 25 bp, Homo sapien
ttttcaccttgtgccactctctttt

SEQ ID NO: 349164 - DNA, 25 bp, Homo sapien
ttgtgccactctcttttggggtctg

SEQ ID NO: 349165 - DNA, 25 bp, Homo sapien
cttgagcatctatgggcagccacag

SEQ ID NO: 349166 - DNA, 25 bp, Homo sapien
ttgagcatctatgggcagccacagc

SEQ ID NO: 349167 - DNA, 25 bp, Homo sapien
agcgaccagtctagtcccagacagc

SEQ ID NO: 349168 - DNA, 25 bp, Homo sapien
gcacaggtcaagcagcgtgggactg

SEQ ID NO: 349169 - DNA, 25 bp, Homo sapien
tggtgctgcccccttagcccagaag

SEQ ID NO: 349170 - DNA, 25 bp, Homo sapien
ggtcccactgctgagggcacctgcc

SEQ ID NO: 349171 - DNA, 25 bp, Homo sapien
taacactaaagcttccagaaaccct

SEQ ID NO: 349172 - DNA, 25 bp, Homo sapien
cactaaagcttccagaaacccttgg

SEQ ID NO: 349173 - DNA, 25 bp, Homo sapien
cttgggaaacggctagcaactactt

SEQ ID NO: 349174 - DNA, 25 bp, Homo sapien
tgggaaacggctagcaactacttgg

SEQ ID NO: 349175 - DNA, 25 bp, Homo sapien
ggaaacggctagcaactacttggga

SEQ ID NO: 349176 - DNA, 25 bp, Homo sapien
aaacggctagcaactacttgggagg

SEQ ID NO: 349177 - DNA, 25 bp, Homo sapien
aactggagtcagagaatgaaagcaa

SEQ ID NO: 349178 - DNA, 25 bp, Homo sapien
gtcagagaatgaaagcaagtcaagc

SEQ ID NO: 349179 - DNA, 25 bp, Homo sapien
gcaagtcaagcaaattacttctcac

SEQ ID NO: 349180 - DNA, 25 bp, Homo sapien
gtcaagcaaattacttctcacaact

SEQ ID NO: 349181 - DNA, 25 bp, Homo sapien
aagcaaattacttctcacaactaat

SEQ ID NO: 349182 - DNA, 25 bp, Homo sapien
ttccttccatctaacactgtgtgat

SEQ ID NO: 349183 - DNA, 25 bp, Homo sapien
gaaagaagccaagccatgcagcgag

SEQ ID NO: 349184 - DNA, 25 bp, Homo sapien
gggatcgccgcctggtgatctcagc

SEQ ID NO: 349185 - DNA, 25 bp, Homo sapien
ctccaagtgggctgtgaagtgtcta

SEQ ID NO: 349186 - DNA, 25 bp, Homo sapien
gtgaagtgtctaatccaggctttca

SEQ ID NO: 349187 - DNA, 25 bp, Homo sapien
ggcacgggagctgatagaccagact

SEQ ID NO: 349188 - DNA, 25 bp, Homo sapien
ctgatagaccagactcaagagttct

SEQ ID NO: 349189 - DNA, 25 bp, Homo sapien
aagagttctactcctgacttctaga

SEQ ID NO: 349190 - DNA, 25 bp, Homo sapien
actcctgacttctagattgttccac

SEQ ID NO: 349191 - DNA, 25 bp, Homo sapien
ttctagattgttccacctccatatg

SEQ ID NO: 349192 - DNA, 25 bp, Homo sapien
acctccatatggaatatgttccttc

SEQ ID NO: 349193 - DNA, 25 bp, Homo sapien
tatgattaaacccattcctacctgc

SEQ ID NO: 349194 - DNA, 25 bp, Homo sapien
cattcctacctgctgtttactaggg

SEQ ID NO: 349195 - DNA, 25 bp, Homo sapien
gagaggctgttgtttatttttggca

SEQ ID NO: 349196 - DNA, 25 bp, Homo sapien
ttggcagagcaaacgaacacagtga

SEQ ID NO: 349197 - DNA, 25 bp, Homo sapien
gagactcacttgaagacaggcggat

SEQ ID NO: 349198 - DNA, 25 bp, Homo sapien
tgcatctaagaggtggtgttgccca

SEQ ID NO: 349199 - DNA, 25 bp, Homo sapien
gtgttgcccacactgcaaattgtgc

SEQ ID NO: 349200 - DNA, 25 bp, Homo sapien
aaattgtgcttgtgtctgtctaaac

SEQ ID NO: 349201 - DNA, 25 bp, Homo sapien
aactggccaggttcatagtaccctt

SEQ ID NO: 349202 - DNA, 25 bp, Homo sapien
taccctttcaaagtggagttctcta

SEQ ID NO: 349203 - DNA, 25 bp, Homo sapien
aaactaggacagttcccaggctgct

SEQ ID NO: 349204 - DNA, 25 bp, Homo sapien
gcttctaaagaggtccataggaaat

SEQ ID NO: 349205 - DNA, 25 bp, Homo sapien
gaggtccataggaaatgtatgtcag

SEQ ID NO: 349206 - DNA, 25 bp, Homo sapien
acacattctttcttattcagcattg

SEQ ID NO: 349207 - DNA, 25 bp, Homo sapien
tcagcattgtttaaatcatcatgat

SEQ ID NO: 349208 - DNA, 25 bp, Homo sapien
aatcatcatgattgaaacttctgta

SEQ ID NO: 349209 - DNA, 25 bp, Homo sapien
aaacttctgtaacttcagtacacca

SEQ ID NO: 349210 - DNA, 25 bp, Homo sapien
taacttcagtacaccatgcagcctt

SEQ ID NO: 349211 - DNA, 25 bp, Homo sapien
agtacaccatgcagccttctatgtg

SEQ ID NO: 349212 - DNA, 25 bp, Homo sapien
catgcagccttctatgtggtatgga

SEQ ID NO: 349213 - DNA, 25 bp, Homo sapien
gccttctatgtggtatggatttcta

SEQ ID NO: 349214 - DNA, 25 bp, Homo sapien
gtagttaggcgagcacaggactttt

SEQ ID NO: 349215 - DNA, 25 bp, Homo sapien
aagccgcggaaggaggagagaccta

SEQ ID NO: 349216 - DNA, 25 bp, Homo sapien
gacctaagaaagagaggccgcggaa

SEQ ID NO: 349217 - DNA, 25 bp, Homo sapien
aagaggagaggccacgggccgccag

SEQ ID NO: 349218 - DNA, 25 bp, Homo sapien
aagccctaccccagcgctgggagtc

SEQ ID NO: 349219 - DNA, 25 bp, Homo sapien
ccagcgctgggagtcacgcgaaggg

SEQ ID NO: 349220 - DNA, 25 bp, Homo sapien
ggccaccggccgtgggcacgggact

SEQ ID NO: 349221 - DNA, 25 bp, Homo sapien
gggactccagggacgccgagcccag

SEQ ID NO: 349222 - DNA, 25 bp, Homo sapien
ccagggacgccgagcccaggaagaa

SEQ ID NO: 349223 - DNA, 25 bp, Homo sapien
aagcaggcctgggtgtccccgaggc

SEQ ID NO: 349224 - DNA, 25 bp, Homo sapien
gtccccgaggcgtcccgacgaggag

SEQ ID NO: 349225 - DNA, 25 bp, Homo sapien
aggagcagcggcctgggagtcgcca

SEQ ID NO: 349226 - DNA, 25 bp, Homo sapien
gaggcagcctgacctcaaagttcat

SEQ ID NO: 349227 - DNA, 25 bp, Homo sapien
ggcagcctgacctcaaagttcatcg

SEQ ID NO: 349228 - DNA, 25 bp, Homo sapien
cagcctgacctcaaagttcatcggt

SEQ ID NO: 349229 - DNA, 25 bp, Homo sapien
gcctgacctcaaagttcatcggtct

SEQ ID NO: 349230 - DNA, 25 bp, Homo sapien
acctcaaagttcatcggtctttttg

SEQ ID NO: 349231 - DNA, 25 bp, Homo sapien
caaagttcatcggtctttttgtttg

SEQ ID NO: 349232 - DNA, 25 bp, Homo sapien
agctcctgagctgaaggaatcctcc

SEQ ID NO: 349233 - DNA, 25 bp, Homo sapien
aagagcacataatttatgggaccag

SEQ ID NO: 349234 - DNA, 25 bp, Homo sapien
gcacataatttatgggaccaggatt

SEQ ID NO: 349235 - DNA, 25 bp, Homo sapien
ttatgggaccaggatttgaagcgag

SEQ ID NO: 349236 - DNA, 25 bp, Homo sapien
accaggatttgaagcgaggcagcct

SEQ ID NO: 349237 - DNA, 25 bp, Homo sapien
tgtgcatcatttcaaccgtctgcag

SEQ ID NO: 349238 - DNA, 25 bp, Homo sapien
caaccgtctgcagtgacaagttttt

SEQ ID NO: 349239 - DNA, 25 bp, Homo sapien
tttagagcctctttgtttcatttag

SEQ ID NO: 349240 - DNA, 25 bp, Homo sapien
tgtttcatttagtacccaggccttg

SEQ ID NO: 349241 - DNA, 25 bp, Homo sapien
ccagtggcaccttttatttagggat

SEQ ID NO: 349242 - DNA, 25 bp, Homo sapien
ttttatttagggatcgctggctcgc

SEQ ID NO: 349243 - DNA, 25 bp, Homo sapien
tccacctgacatcctgggacagttg

SEQ ID NO: 349244 - DNA, 25 bp, Homo sapien
tgggacagttggcagaccttccctc

SEQ ID NO: 349245 - DNA, 25 bp, Homo sapien
gttaagtcacttctacatctctgcg

SEQ ID NO: 349246 - DNA, 25 bp, Homo sapien
ttctacatctctgcgtggccgtcat

SEQ ID NO: 349247 - DNA, 25 bp, Homo sapien
gtcatcgctgctattctgcacatgt

SEQ ID NO: 349248 - DNA, 25 bp, Homo sapien
gtcaatagcagatacatggtacagt

SEQ ID NO: 349249 - DNA, 25 bp, Homo sapien
agcagatacatggtacagtaagtta

SEQ ID NO: 349250 - DNA, 25 bp, Homo sapien
atgaggtttcatatcttctagtttc

SEQ ID NO: 349251 - DNA, 25 bp, Homo sapien
ggtttcatatcttctagtttcctaa

SEQ ID NO: 349252 - DNA, 25 bp, Homo sapien
tatcttctagtttcctaattaaaag

SEQ ID NO: 349253 - DNA, 25 bp, Homo sapien
taattaaaaggagcccattctgggt

SEQ ID NO: 349254 - DNA, 25 bp, Homo sapien
ccattctgggttggaagaaagtgtc

SEQ ID NO: 349255 - DNA, 25 bp, Homo sapien
gtgtcagtaagatcatttctcctat

SEQ ID NO: 349256 - DNA, 25 bp, Homo sapien
cagtaagatcatttctcctatttga

SEQ ID NO: 349257 - DNA, 25 bp, Homo sapien
gaaatctgaaatgcttatggttcca

SEQ ID NO: 349258 - DNA, 25 bp, Homo sapien
ctgaaatgcttatggttccaagcat

SEQ ID NO: 349259 - DNA, 25 bp, Homo sapien
ccatacttgtgtttgggagactgga

SEQ ID NO: 349260 - DNA, 25 bp, Homo sapien
tgccccccattagatgccttagaaa

SEQ ID NO: 349261 - DNA, 25 bp, Homo sapien
attcttgttcaagtcaaatgctgaa

SEQ ID NO: 349262 - DNA, 25 bp, Homo sapien
caagtcaaatgctgaattgtgtagt

SEQ ID NO: 349263 - DNA, 25 bp, Homo sapien
gcacagcctatgctaccagggtagg

SEQ ID NO: 349264 - DNA, 25 bp, Homo sapien
ctaccagggtaggactacatagctt

SEQ ID NO: 349265 - DNA, 25 bp, Homo sapien
agggtaggactacatagctttacct

SEQ ID NO: 349266 - DNA, 25 bp, Homo sapien
agctcagtgtgatcagaggcgcaga

SEQ ID NO: 349267 - DNA, 25 bp, Homo sapien
gaacaagcattttgaattcttatga

SEQ ID NO: 349268 - DNA, 25 bp, Homo sapien
ttcttatgaagaaggcagtgtggaa

SEQ ID NO: 349269 - DNA, 25 bp, Homo sapien
cacagtgtgataaataaattcctaa

SEQ ID NO: 349270 - DNA, 25 bp, Homo sapien
tagccatggttgagagccagtgttc

SEQ ID NO: 349271 - DNA, 25 bp, Homo sapien
agtgttctaaatgccttgctcctta

SEQ ID NO: 349272 - DNA, 25 bp, Homo sapien
ttgctccttaccattagtgcttgta

SEQ ID NO: 349273 - DNA, 25 bp, Homo sapien
gtgcttgtatagtctttccatcatc

SEQ ID NO: 349274 - DNA, 25 bp, Homo sapien
agtggtgactcagtctctacccaaa

SEQ ID NO: 349275 - DNA, 25 bp, Homo sapien
tacccaaacacacctagcattagct

SEQ ID NO: 349276 - DNA, 25 bp, Homo sapien
ctagcattagctttgactgtcgatc

SEQ ID NO: 349277 - DNA, 25 bp, Homo sapien
actgtcgatcaagttcttaggtcaa

SEQ ID NO: 349278 - DNA, 25 bp, Homo sapien
attccaaatctgtcacttttctctt

SEQ ID NO: 349279 - DNA, 25 bp, Homo sapien
tggctgcaccttataccaattaagt

SEQ ID NO: 349280 - DNA, 25 bp, Homo sapien
ggaagtggtaccaacacatggcaat

SEQ ID NO: 349281 - DNA, 25 bp, Homo sapien
cagccccaaactgctgggcttaagt

SEQ ID NO: 349282 - DNA, 25 bp, Homo sapien
aaactgctgggcttaagtgatggtt

SEQ ID NO: 349283 - DNA, 25 bp, Homo sapien
gtgatggttggcctcaggctcccaa

SEQ ID NO: 349284 - DNA, 25 bp, Homo sapien
aggcacatgcaaccgtgcctgacta

SEQ ID NO: 349285 - DNA, 25 bp, Homo sapien
gcacatgcaaccgtgcctgactaat

SEQ ID NO: 349286 - DNA, 25 bp, Homo sapien
cacatgcaaccgtgcctgactaatt

SEQ ID NO: 349287 - DNA, 25 bp, Homo sapien
ttacagggcataaggcattgcactc

SEQ ID NO: 349288 - DNA, 25 bp, Homo sapien
tacagggcataaggcattgcactca

SEQ ID NO: 349289 - DNA, 25 bp, Homo sapien
cagggcataaggcattgcactcagc

SEQ ID NO: 349290 - DNA, 25 bp, Homo sapien
gggcataaggcattgcactcagcca

SEQ ID NO: 349291 - DNA, 25 bp, Homo sapien
aaggcattgcactcagccaaaatga

SEQ ID NO: 349292 - DNA, 25 bp, Homo sapien
tcacttgagcccaccatgagagatc

SEQ ID NO: 349293 - DNA, 25 bp, Homo sapien
acttgagcccaccatgagagatcga

SEQ ID NO: 349294 - DNA, 25 bp, Homo sapien
cttgagcccaccatgagagatcgag

SEQ ID NO: 349295 - DNA, 25 bp, Homo sapien
ttgagcccaccatgagagatcgagg

SEQ ID NO: 349296 - DNA, 25 bp, Homo sapien
gcccaccatgagagatcgaggctgc

SEQ ID NO: 349297 - DNA, 25 bp, Homo sapien
tcactttcagtctattaagaattct

SEQ ID NO: 349298 - DNA, 25 bp, Homo sapien
gtctattaagaattctcagccgagt

SEQ ID NO: 349299 - DNA, 25 bp, Homo sapien
tattaagaattctcagccgagtgca

SEQ ID NO: 349300 - DNA, 25 bp, Homo sapien
taagaattctcagccgagtgcagtg

SEQ ID NO: 349301 - DNA, 25 bp, Homo sapien
gaattctcagccgagtgcagtgact

SEQ ID NO: 349302 - DNA, 25 bp, Homo sapien
attctcagccgagtgcagtgactca

SEQ ID NO: 349303 - DNA, 25 bp, Homo sapien
ggaatcgttcttggacagctgggtt

SEQ ID NO: 349304 - DNA, 25 bp, Homo sapien
tcgttcttggacagctgggttttaa

SEQ ID NO: 349305 - DNA, 25 bp, Homo sapien
taaaaacactgtacccatcatcact

SEQ ID NO: 349306 - DNA, 25 bp, Homo sapien
tacccatcatcactacctttctaaa

SEQ ID NO: 349307 - DNA, 25 bp, Homo sapien
tcatcactacctttctaaattggag

SEQ ID NO: 349308 - DNA, 25 bp, Homo sapien
tcaatgctaacttttcatgagtgtt

SEQ ID NO: 349309 - DNA, 25 bp, Homo sapien
gtcaccataatgaaaaccagtaact

SEQ ID NO: 349310 - DNA, 25 bp, Homo sapien
aaccagtaactgatgagacgtgctg

SEQ ID NO: 349311 - DNA, 25 bp, Homo sapien
gagacgtgctgtgatctcattacag

SEQ ID NO: 349312 - DNA, 25 bp, Homo sapien
gatctcattacagaggaggctgcgt

SEQ ID NO: 349313 - DNA, 25 bp, Homo sapien
gaggctgcgtgtgatctgacactga

SEQ ID NO: 349314 - DNA, 25 bp, Homo sapien
tccaggctgctgtacgatgtgttca

SEQ ID NO: 349315 - DNA, 25 bp, Homo sapien
gctgctgtacgatgtgttcaactga

SEQ ID NO: 349316 - DNA, 25 bp, Homo sapien
acgatgtgttcaactgagtcaggct

SEQ ID NO: 349317 - DNA, 25 bp, Homo sapien
ttcaactgagtcaggctggactggg

SEQ ID NO: 349318 - DNA, 25 bp, Homo sapien
gttgggggacagctctctatctaaa

SEQ ID NO: 349319 - DNA, 25 bp, Homo sapien
tcaagtgtttggagctggcagggtc

SEQ ID NO: 349320 - DNA, 25 bp, Homo sapien
gtcctcctggaggttggagctgact

SEQ ID NO: 349321 - DNA, 25 bp, Homo sapien
tggagctgactggatgggtcacccc

SEQ ID NO: 349322 - DNA, 25 bp, Homo sapien
gggacccatgggaccctcattttga

SEQ ID NO: 349323 - DNA, 25 bp, Homo sapien
cagttcagagaatgccagtccagct

SEQ ID NO: 349324 - DNA, 25 bp, Homo sapien
gagaatgccagtccagctgcctacc

SEQ ID NO: 349325 - DNA, 25 bp, Homo sapien
ctccttggcccttcaagtgggctga

SEQ ID NO: 349326 - DNA, 25 bp, Homo sapien
aagtgggctgaagcccttggaaagt

SEQ ID NO: 349327 - DNA, 25 bp, Homo sapien
gtgacataggaagtccccagatctt

SEQ ID NO: 349328 - DNA, 25 bp, Homo sapien
taggaagtccccagatcttgccctt

SEQ ID NO: 349329 - DNA, 25 bp, Homo sapien
ttctcactccagaggctagtggtca

SEQ ID NO: 349330 - DNA, 25 bp, Homo sapien
actccagaggctagtggtcacagac

SEQ ID NO: 349331 - DNA, 25 bp, Homo sapien
agaggctagtggtcacagacagctg

SEQ ID NO: 349332 - DNA, 25 bp, Homo sapien
gacagctgggaatggcagccacaga

SEQ ID NO: 349333 - DNA, 25 bp, Homo sapien
tgggagaaacagcttcaccccagcc

SEQ ID NO: 349334 - DNA, 25 bp, Homo sapien
taagccagtattctttgttcctgct

SEQ ID NO: 349335 - DNA, 25 bp, Homo sapien
ttgttcctgcttgtaataaaacttc

SEQ ID NO: 349336 - DNA, 25 bp, Homo sapien
agtatatataccctcgtacgcctta

SEQ ID NO: 349337 - DNA, 25 bp, Homo sapien
tacgccttatggctggatgcgttac

SEQ ID NO: 349338 - DNA, 25 bp, Homo sapien
atgcgttacagccatttccatgtag

SEQ ID NO: 349339 - DNA, 25 bp, Homo sapien
gatgtctgtgcatacgttcacacgc

SEQ ID NO: 349340 - DNA, 25 bp, Homo sapien
aaaactctccgcagttttggagatc

SEQ ID NO: 349341 - DNA, 25 bp, Homo sapien
ttggagatctccgtgttcagtcgta

SEQ ID NO: 349342 - DNA, 25 bp, Homo sapien
tgttcagtcgtacctcacgtgatct

SEQ ID NO: 349343 - DNA, 25 bp, Homo sapien
cacgtgatcttgcactgccaacatt

SEQ ID NO: 349344 - DNA, 25 bp, Homo sapien
agaaccctggccttagactatgcat

SEQ ID NO: 349345 - DNA, 25 bp, Homo sapien
gactatgcatctcccaaacttaatt

SEQ ID NO: 349346 - DNA, 25 bp, Homo sapien
gtcttcccaggctgtcatataactc

SEQ ID NO: 349347 - DNA, 25 bp, Homo sapien
ttcatcattaccactccataaacac

SEQ ID NO: 349348 - DNA, 25 bp, Homo sapien
tccataaacacaaactctgcaaagt

SEQ ID NO: 349349 - DNA, 25 bp, Homo sapien
cattggctttggctgtcagttatct

SEQ ID NO: 349350 - DNA, 25 bp, Homo sapien
aaactttgcccttgaacataaggca

SEQ ID NO: 349351 - DNA, 25 bp, Homo sapien
gcccttgaacataaggcagcttgtt

SEQ ID NO: 349352 - DNA, 25 bp, Homo sapien
tacaggctaatggaacctccattgg

SEQ ID NO: 349353 - DNA, 25 bp, Homo sapien
tggctgtcagttatctctagtgctt

SEQ ID NO: 349354 - DNA, 25 bp, Homo sapien
tttttcagcctggaagaaccttaag

SEQ ID NO: 349355 - DNA, 25 bp, Homo sapien
gaagaaccttaagctttgtcattcc

SEQ ID NO: 349356 - DNA, 25 bp, Homo sapien
tagtgcttggtatattgcctggccc

SEQ ID NO: 349357 - DNA, 25 bp, Homo sapien
gcttggtatattgcctggcccacag

SEQ ID NO: 349358 - DNA, 25 bp, Homo sapien
tgatccttgttgatgagtgactcat

SEQ ID NO: 349359 - DNA, 25 bp, Homo sapien
gactcatacatataatcccaactgc

SEQ ID NO: 349360 - DNA, 25 bp, Homo sapien
acatataatcccaactgcttaggag

SEQ ID NO: 349361 - DNA, 25 bp, Homo sapien
gagacaggacaatcactggagtcca

SEQ ID NO: 349362 - DNA, 25 bp, Homo sapien
cactgctttccagccagggtgataa

SEQ ID NO: 349363 - DNA, 25 bp, Homo sapien
agattgttgacccatttcctttaag

SEQ ID NO: 349364 - DNA, 25 bp, Homo sapien
ttgttgacccatttcctttaagcgg

SEQ ID NO: 349365 - DNA, 25 bp, Homo sapien
cccatttcctttaagcgggtcatgt

SEQ ID NO: 349366 - DNA, 25 bp, Homo sapien
agcgggtcatgtcaaaatcttctaa

SEQ ID NO: 349367 - DNA, 25 bp, Homo sapien
aatcttctaaaccaaagtcaggtgt

SEQ ID NO: 349368 - DNA, 25 bp, Homo sapien
gtaatctgggctattcaggaggcat

SEQ ID NO: 349369 - DNA, 25 bp, Homo sapien
tgatgttcaggattcttcctgcctg

SEQ ID NO: 349370 - DNA, 25 bp, Homo sapien
tgttcaggattcttcctgcctgcct

SEQ ID NO: 349371 - DNA, 25 bp, Homo sapien
gcctccctccttgcagaagaaaaga

SEQ ID NO: 349372 - DNA, 25 bp, Homo sapien
ggtaaaggtatgtataagcaggtat

SEQ ID NO: 349373 - DNA, 25 bp, Homo sapien
ataagcaggtataattcaaaaggta

SEQ ID NO: 349374 - DNA, 25 bp, Homo sapien
aggtatatgaagtacagcgaagtca

SEQ ID NO: 349375 - DNA, 25 bp, Homo sapien
gaagtacagcgaagtcattgtgtta

SEQ ID NO: 349376 - DNA, 25 bp, Homo sapien
cagcgaagtcattgtgttagataaa

SEQ ID NO: 349377 - DNA, 25 bp, Homo sapien
cattggggtccctttaaagattcag

SEQ ID NO: 349378 - DNA, 25 bp, Homo sapien
aaagattcaggtggaatgttttcct

SEQ ID NO: 349379 - DNA, 25 bp, Homo sapien
ggtggaatgttttcctgatgttcag

SEQ ID NO: 349380 - DNA, 25 bp, Homo sapien
gagctcagcatcaagtacttccagg

SEQ ID NO: 349381 - DNA, 25 bp, Homo sapien
atcaagtacttccaggagaagcttc

SEQ ID NO: 349382 - DNA, 25 bp, Homo sapien
gtagaggatacagccctcataccac

SEQ ID NO: 349383 - DNA, 25 bp, Homo sapien
ataccaccgtgctgtatgtccatct

SEQ ID NO: 349384 - DNA, 25 bp, Homo sapien
agtcctggtggtgcccgcagagttt

SEQ ID NO: 349385 - DNA, 25 bp, Homo sapien
agagtttgaagggaagccactgctt

SEQ ID NO: 349386 - DNA, 25 bp, Homo sapien
agccactgcttcagagataccaggt

SEQ ID NO: 349387 - DNA, 25 bp, Homo sapien
ataccaggtggtaaatgcatgccta

SEQ ID NO: 349388 - DNA, 25 bp, Homo sapien
gcatgcctagtggaagtgtgctcct

SEQ ID NO: 349389 - DNA, 25 bp, Homo sapien
aagtgtgctcctctgcatctatgcc

SEQ ID NO: 349390 - DNA, 25 bp, Homo sapien
atgaggaccctactgggctgccatc

SEQ ID NO: 349391 - DNA, 25 bp, Homo sapien
cccagggcaggtacctacctatctt

SEQ ID NO: 349392 - DNA, 25 bp, Homo sapien
agggcaggtacctacctatcttcct

SEQ ID NO: 349393 - DNA, 25 bp, Homo sapien
ggcaggtacctacctatcttcctgt

SEQ ID NO: 349394 - DNA, 25 bp, Homo sapien
gcaggtacctacctatcttcctgtc

SEQ ID NO: 349395 - DNA, 25 bp, Homo sapien
ctatcttcctgtcccagtactgagg

SEQ ID NO: 349396 - DNA, 25 bp, Homo sapien
actgaggggctcaataactattgtt

SEQ ID NO: 349397 - DNA, 25 bp, Homo sapien
aactattgttaacctgaagacaccg

SEQ ID NO: 349398 - DNA, 25 bp, Homo sapien
tattgttaacctgaagacaccgaaa

SEQ ID NO: 349399 - DNA, 25 bp, Homo sapien
taacctgaagacaccgaaaaccttg

SEQ ID NO: 349400 - DNA, 25 bp, Homo sapien
gaagacaccgaaaaccttgacagcg

SEQ ID NO: 349401 - DNA, 25 bp, Homo sapien
agacaccgaaaaccttgacagcgct

SEQ ID NO: 349402 - DNA, 25 bp, Homo sapien
aggccatgggaattacattgggaat

SEQ ID NO: 349403 - DNA, 25 bp, Homo sapien
gaatgtgcccttctggtattgcatt

SEQ ID NO: 349404 - DNA, 25 bp, Homo sapien
attgcatttatgaccctggcaggcc

SEQ ID NO: 349405 - DNA, 25 bp, Homo sapien
attcgagactggcatatcctccagc

SEQ ID NO: 349406 - DNA, 25 bp, Homo sapien
atatcctccagctggtggtgtctgt

SEQ ID NO: 349407 - DNA, 25 bp, Homo sapien
ggtgtctgtaccatactttgtgatc

SEQ ID NO: 349408 - DNA, 25 bp, Homo sapien
tactttgtgatctttctgacctcaa

SEQ ID NO: 349409 - DNA, 25 bp, Homo sapien
tttctgacctcaagttggctgctag

SEQ ID NO: 349410 - DNA, 25 bp, Homo sapien
aagttggctgctagagtctgctcgg

SEQ ID NO: 349411 - DNA, 25 bp, Homo sapien
agaatgccagagacaccctaaccct

SEQ ID NO: 349412 - DNA, 25 bp, Homo sapien
gacaccctaaccctggagattttga

SEQ ID NO: 349413 - DNA, 25 bp, Homo sapien
gttgctgtggagagagtctcgcctc

SEQ ID NO: 349414 - DNA, 25 bp, Homo sapien
ctgtggagagagtctcgcctctgtg

SEQ ID NO: 349415 - DNA, 25 bp, Homo sapien
gagggtctgctcaggtgtggcctct

SEQ ID NO: 349416 - DNA, 25 bp, Homo sapien
ggagggcatcccattggctgtgaca

SEQ ID NO: 349417 - DNA, 25 bp, Homo sapien
gggcatcccattggctgtgacagaa

SEQ ID NO: 349418 - DNA, 25 bp, Homo sapien
gcatcccattggctgtgacagaagg

SEQ ID NO: 349419 - DNA, 25 bp, Homo sapien
tcccattggctgtgacagaagggcc

SEQ ID NO: 349420 - DNA, 25 bp, Homo sapien
gctgtgacagaagggccttggtggc

SEQ ID NO: 349421 - DNA, 25 bp, Homo sapien
gctttcaggctgtgataagaacgct

SEQ ID NO: 349422 - DNA, 25 bp, Homo sapien
tgataagaacgctggtttctccctc

SEQ ID NO: 349423 - DNA, 25 bp, Homo sapien
taagaacgctggtttctccctccag

SEQ ID NO: 349424 - DNA, 25 bp, Homo sapien
ggatttgtttaggtgcccattgcat

SEQ ID NO: 349425 - DNA, 25 bp, Homo sapien
gtgcccattgcatctttttgtgcta

SEQ ID NO: 349426 - DNA, 25 bp, Homo sapien
acattaagcatgaccgaacgagaga

SEQ ID NO: 349427 - DNA, 25 bp, Homo sapien
gagacaatactatttcccacaggag

SEQ ID NO: 349428 - DNA, 25 bp, Homo sapien
ggagtccattgggttcagctttgaa

SEQ ID NO: 349429 - DNA, 25 bp, Homo sapien
aatcgaggctcctttgaccatcaaa

SEQ ID NO: 349430 - DNA, 25 bp, Homo sapien
atgtggtacccaatgccagaatgta

SEQ ID NO: 349431 - DNA, 25 bp, Homo sapien
ttgtgctgctattcattaaaacttg

SEQ ID NO: 349432 - DNA, 25 bp, Homo sapien
aaacttgtattccagtcttgccagc

SEQ ID NO: 349433 - DNA, 25 bp, Homo sapien
agtcttgccagcttaaggagatcaa

SEQ ID NO: 349434 - DNA, 25 bp, Homo sapien
ggtatccttgatttattttccagta

SEQ ID NO: 349435 - DNA, 25 bp, Homo sapien
ttcacttacttctgcatgatttatt

SEQ ID NO: 349436 - DNA, 25 bp, Homo sapien
gaagggagtcacagaggctagcaaa

SEQ ID NO: 349437 - DNA, 25 bp, Homo sapien
aggctagcaaattccccacagtatg

SEQ ID NO: 349438 - DNA, 25 bp, Homo sapien
ccacagtatgcccacagacgatatt

SEQ ID NO: 349439 - DNA, 25 bp, Homo sapien
gtatgcccacagacgatattttgaa

SEQ ID NO: 349440 - DNA, 25 bp, Homo sapien
gaaatgcatctaatgatcatattgt

SEQ ID NO: 349441 - DNA, 25 bp, Homo sapien
gatcatattgtaatctcaaacatgc

SEQ ID NO: 349442 - DNA, 25 bp, Homo sapien
gccaaaagatgatgttccttatcct

SEQ ID NO: 349443 - DNA, 25 bp, Homo sapien
gttccttatcctaacacactaacac

SEQ ID NO: 349444 - DNA, 25 bp, Homo sapien
acacactaacactaataccttcttc

SEQ ID NO: 349445 - DNA, 25 bp, Homo sapien
taacactaataccttcttccaacta

SEQ ID NO: 349446 - DNA, 25 bp, Homo sapien
gtggaatcaagtatacccctttagt

SEQ ID NO: 349447 - DNA, 25 bp, Homo sapien
agaagttgcaggtgctttcgcagat

SEQ ID NO: 349448 - DNA, 25 bp, Homo sapien
gtgctttcgcagatgagcctcaggt

SEQ ID NO: 349449 - DNA, 25 bp, Homo sapien
gggatctctgcaaatatgctggtga

SEQ ID NO: 349450 - DNA, 25 bp, Homo sapien
gatttcagatcaacgctgtccagta

SEQ ID NO: 349451 - DNA, 25 bp, Homo sapien
agtatggtagccaccggacacacat

SEQ ID NO: 349452 - DNA, 25 bp, Homo sapien
gccaccggacacacatggttattta

SEQ ID NO: 349453 - DNA, 25 bp, Homo sapien
acccctttagtaagtgctttctctg

SEQ ID NO: 349454 - DNA, 25 bp, Homo sapien
gtgctttctctgaaggtgcctgcaa

SEQ ID NO: 349455 - DNA, 25 bp, Homo sapien
tatttaggcattggcctgtgagcta

SEQ ID NO: 349456 - DNA, 25 bp, Homo sapien
agctatgggtgtgtttgcagatgac

SEQ ID NO: 349457 - DNA, 25 bp, Homo sapien
agtttggagctcacagttctgaggg

SEQ ID NO: 349458 - DNA, 25 bp, Homo sapien
gatccctttatgggagggctttgtc

SEQ ID NO: 349459 - DNA, 25 bp, Homo sapien
agggatcacccccattatttgctga

SEQ ID NO: 349460 - DNA, 25 bp, Homo sapien
ggaggagtcaaaatccaaagagcag

SEQ ID NO: 349461 - DNA, 25 bp, Homo sapien
cagggtccccgcattgccctggttt

SEQ ID NO: 349462 - DNA, 25 bp, Homo sapien
ttctttttcacaccaggataccaag

SEQ ID NO: 349463 - DNA, 25 bp, Homo sapien
tcacaccaggataccaagggtttgg

SEQ ID NO: 349464 - DNA, 25 bp, Homo sapien
gggctttgtcaccaggtgacctgat

SEQ ID NO: 349465 - DNA, 25 bp, Homo sapien
ccaggtgacctgatatagcttgaga

SEQ ID NO: 349466 - DNA, 25 bp, Homo sapien
gcttgagaaagcctatgacctgaga

SEQ ID NO: 349467 - DNA, 25 bp, Homo sapien
cagggatcctaaagagtttggagct

SEQ ID NO: 349468 - DNA, 25 bp, Homo sapien
ttttccttgatctctgcccacgtgt

SEQ ID NO: 349469 - DNA, 25 bp, Homo sapien
acttgggctgcggtctgggtaccat

SEQ ID NO: 349470 - DNA, 25 bp, Homo sapien
gggctgcggtctgggtaccatccac

SEQ ID NO: 349471 - DNA, 25 bp, Homo sapien
atccactccctcattaagcaggagc

SEQ ID NO: 349472 - DNA, 25 bp, Homo sapien
gttgccgagggcctgattggtgcca

SEQ ID NO: 349473 - DNA, 25 bp, Homo sapien
agggcctgattggtgccaggcactg

SEQ ID NO: 349474 - DNA, 25 bp, Homo sapien
aagagtgcatcccacagctcaggca

SEQ ID NO: 349475 - DNA, 25 bp, Homo sapien
acagctcaggcagttccagacttga

SEQ ID NO: 349476 - DNA, 25 bp, Homo sapien
tcaggcagttccagacttgagcttg

SEQ ID NO: 349477 - DNA, 25 bp, Homo sapien
gcagttccagacttgagcttgacgg

SEQ ID NO: 349478 - DNA, 25 bp, Homo sapien
caggttcttttccttgatctctgcc

SEQ ID NO: 349479 - DNA, 25 bp, Homo sapien
gaatggcccctagtgaagggtactt

SEQ ID NO: 349480 - DNA, 25 bp, Homo sapien
aggtggctgtaacataccccaggac

SEQ ID NO: 349481 - DNA, 25 bp, Homo sapien
caaccacccttcagactcagaggag

SEQ ID NO: 349482 - DNA, 25 bp, Homo sapien
gaggagctctctgtgaagtcaattt

SEQ ID NO: 349483 - DNA, 25 bp, Homo sapien
taaccaacagtagagagtcagagta

SEQ ID NO: 349484 - DNA, 25 bp, Homo sapien
gagtagtgcataacagggagattct

SEQ ID NO: 349485 - DNA, 25 bp, Homo sapien
taccttggagagtaacaaatcgtac

SEQ ID NO: 349486 - DNA, 25 bp, Homo sapien
aatcgtacatttacttgttggctta

SEQ ID NO: 349487 - DNA, 25 bp, Homo sapien
cttgttggcttaggtgagtaaatcc

SEQ ID NO: 349488 - DNA, 25 bp, Homo sapien
gagtaaatccatctaaatcacccat

SEQ ID NO: 349489 - DNA, 25 bp, Homo sapien
taaatcacccatgccagctatgaag

SEQ ID NO: 349490 - DNA, 25 bp, Homo sapien
aaagcattgctgtcagtgaggcagt

SEQ ID NO: 349491 - DNA, 25 bp, Homo sapien
atagtgtagtgattgcaagctctgg

SEQ ID NO: 349492 - DNA, 25 bp, Homo sapien
gcaagctctggaagtatactgccaa

SEQ ID NO: 349493 - DNA, 25 bp, Homo sapien
agtatactgccaaggtgtgcatcat

SEQ ID NO: 349494 - DNA, 25 bp, Homo sapien
aaggtgtgcatcattcctctgtact

SEQ ID NO: 349495 - DNA, 25 bp, Homo sapien
gcatcattcctctgtactgtgtaga

SEQ ID NO: 349496 - DNA, 25 bp, Homo sapien
gaatggcaaaagcaaccttaagagg

SEQ ID NO: 349497 - DNA, 25 bp, Homo sapien
ggtagactgtatctttatgtagcaa

SEQ ID NO: 349498 - DNA, 25 bp, Homo sapien
gatatactttgcgttatgtctaaca

SEQ ID NO: 349499 - DNA, 25 bp, Homo sapien
cactgtgtacagtctttctaagata

SEQ ID NO: 349500 - DNA, 25 bp, Homo sapien
ggatattgtttagttctgattgttt

SEQ ID NO: 349501 - DNA, 25 bp, Homo sapien
tcagttttgggactcaggctttcct

SEQ ID NO: 349502 - DNA, 25 bp, Homo sapien
caggctttccttacttctcaactgg

SEQ ID NO: 349503 - DNA, 25 bp, Homo sapien
gggacctagtgattgttctttcagt

SEQ ID NO: 349504 - DNA, 25 bp, Homo sapien
gggaagcctcacgatcatggaaaaa

SEQ ID NO: 349505 - DNA, 25 bp, Homo sapien
aaggaggagcaaatcatgtcttgca

SEQ ID NO: 349506 - DNA, 25 bp, Homo sapien
atgtcttgcatggatgtcaacagtc

SEQ ID NO: 349507 - DNA, 25 bp, Homo sapien
ggatgtcaacagtcaaagagagctt

SEQ ID NO: 349508 - DNA, 25 bp, Homo sapien
ggagcacaacactggcaatgccttg

SEQ ID NO: 349509 - DNA, 25 bp, Homo sapien
aacactggcaatgccttgctttcct

SEQ ID NO: 349510 - DNA, 25 bp, Homo sapien
cctgctgttgaacatgagattcctt

SEQ ID NO: 349511 - DNA, 25 bp, Homo sapien
gagattccttgttcttcagttttgg

SEQ ID NO: 349512 - DNA, 25 bp, Homo sapien
tttcagaccagctacaacagcagga

SEQ ID NO: 349513 - DNA, 25 bp, Homo sapien
agctacaacagcaggacccgccagg

SEQ ID NO: 349514 - DNA, 25 bp, Homo sapien
tgcttcctgctgcatagccttgggc

SEQ ID NO: 349515 - DNA, 25 bp, Homo sapien
gctgcatagccttgggccctcctga

SEQ ID NO: 349516 - DNA, 25 bp, Homo sapien
aggcagggcacctgtgtacgtcaat

SEQ ID NO: 349517 - DNA, 25 bp, Homo sapien
agggcacctgtgtacgtcaatgact

SEQ ID NO: 349518 - DNA, 25 bp, Homo sapien
ggcacctgtgtacgtcaatgactga

SEQ ID NO: 349519 - DNA, 25 bp, Homo sapien
tgtgtacgtcaatgactgaccaccc

SEQ ID NO: 349520 - DNA, 25 bp, Homo sapien
gtcaatgactgaccaccccatggta

SEQ ID NO: 349521 - DNA, 25 bp, Homo sapien
gatctatctccccaaaacactattc

SEQ ID NO: 349522 - DNA, 25 bp, Homo sapien
aacactattctttctgcctgggacc

SEQ ID NO: 349523 - DNA, 25 bp, Homo sapien
cagggctgagtgaggctcaggtatg

SEQ ID NO: 349524 - DNA, 25 bp, Homo sapien
tcaggtatgtgttttgccagctgtg

SEQ ID NO: 349525 - DNA, 25 bp, Homo sapien
aggtatgtgttttgccagctgtgga

SEQ ID NO: 349526 - DNA, 25 bp, Homo sapien
tatgtgttttgccagctgtggatat

SEQ ID NO: 349527 - DNA, 25 bp, Homo sapien
gtgttttgccagctgtggatatatc

SEQ ID NO: 349528 - DNA, 25 bp, Homo sapien
ttttgccagctgtggatatatccag

SEQ ID NO: 349529 - DNA, 25 bp, Homo sapien
gctgtggatatatccagctggccaa

SEQ ID NO: 349530 - DNA, 25 bp, Homo sapien
ggcatcccctttttcaagtgccacc

SEQ ID NO: 349531 - DNA, 25 bp, Homo sapien
ctggccaagcagcactgaaaaaatc

SEQ ID NO: 349532 - DNA, 25 bp, Homo sapien
atttccccttgttgggatgccaacg

SEQ ID NO: 349533 - DNA, 25 bp, Homo sapien
ccttgttgggatgccaacgcacagg

SEQ ID NO: 349534 - DNA, 25 bp, Homo sapien
gattataaacataagacatgctcat

SEQ ID NO: 349535 - DNA, 25 bp, Homo sapien
ttcatattttttcctacgtatacac

SEQ ID NO: 349536 - DNA, 25 bp, Homo sapien
catattttttcctacgtatacacaa

SEQ ID NO: 349537 - DNA, 25 bp, Homo sapien
ttttttcctacgtatacacaaacat

SEQ ID NO: 349538 - DNA, 25 bp, Homo sapien
ttttcctacgtatacacaaacattt

SEQ ID NO: 349539 - DNA, 25 bp, Homo sapien
aatccacactatatgtactgttctg

SEQ ID NO: 349540 - DNA, 25 bp, Homo sapien
atccacactatatgtactgttctgt

SEQ ID NO: 349541 - DNA, 25 bp, Homo sapien
gaacaataatcatcttttcctgaca

SEQ ID NO: 349542 - DNA, 25 bp, Homo sapien
aataatcatcttttcctgacaataa

SEQ ID NO: 349543 - DNA, 25 bp, Homo sapien
tcatcttttcctgacaataaatatc

SEQ ID NO: 349544 - DNA, 25 bp, Homo sapien
ataaatatcaatctctatcatcaaa

SEQ ID NO: 349545 - DNA, 25 bp, Homo sapien
tcaaccgcactaaatcaaccaaatc

SEQ ID NO: 349546 - DNA, 25 bp, Homo sapien
taaatcaaccaaatcccaagtctaa

SEQ ID NO: 349547 - DNA, 25 bp, Homo sapien
tccttaaacctaacctagcccaatg

SEQ ID NO: 349548 - DNA, 25 bp, Homo sapien
ctaacctagcccaatgccaattata

SEQ ID NO: 349549 - DNA, 25 bp, Homo sapien
aatgccaattatatctaccctagcc

SEQ ID NO: 349550 - DNA, 25 bp, Homo sapien
tatatctaccctagccaaaccctaa

SEQ ID NO: 349551 - DNA, 25 bp, Homo sapien
aaagtgtccactgaatcctcacctt

SEQ ID NO: 349552 - DNA, 25 bp, Homo sapien
tcaccttggtcctcacttaaaatcc

SEQ ID NO: 349553 - DNA, 25 bp, Homo sapien
tctggactcctggtatcctgggatg

SEQ ID NO: 349554 - DNA, 25 bp, Homo sapien
tatcctgggatgtccaaactctgca

SEQ ID NO: 349555 - DNA, 25 bp, Homo sapien
tctgcagtgccatcagccaacaagc

SEQ ID NO: 349556 - DNA, 25 bp, Homo sapien
ttcacggctctgaagggacctgtag

SEQ ID NO: 349557 - DNA, 25 bp, Homo sapien
taatgaggaggagagccggccccac

SEQ ID NO: 349558 - DNA, 25 bp, Homo sapien
gaaaaaacctatctgtgtaaccact

SEQ ID NO: 349559 - DNA, 25 bp, Homo sapien
gtgtaaccactgagccaggtagggt

SEQ ID NO: 349560 - DNA, 25 bp, Homo sapien
gtagggtgtgactggccacttaaca

SEQ ID NO: 349561 - DNA, 25 bp, Homo sapien
cttcagatcctcagttataaaccag

SEQ ID NO: 349562 - DNA, 25 bp, Homo sapien
agatgaggtggtcactaggtcccct

SEQ ID NO: 349563 - DNA, 25 bp, Homo sapien
taggtcccctcatggccctagtatt

SEQ ID NO: 349564 - DNA, 25 bp, Homo sapien
atggccctagtattctgtgcttctg

SEQ ID NO: 349565 - DNA, 25 bp, Homo sapien
taaattttcaccgtgtgccctctag

SEQ ID NO: 349566 - DNA, 25 bp, Homo sapien
tctagctgtccctggtgacccaaca

SEQ ID NO: 349567 - DNA, 25 bp, Homo sapien
ccaatttaggctatcccaggccagc

SEQ ID NO: 349568 - DNA, 25 bp, Homo sapien
aggctgaacgtctcctcggaaccta

SEQ ID NO: 349569 - DNA, 25 bp, Homo sapien
gaacctactgtgtggtccagggcag

SEQ ID NO: 349570 - DNA, 25 bp, Homo sapien
ggtccagggcagatgtctgaatcac

SEQ ID NO: 349571 - DNA, 25 bp, Homo sapien
cagatgtctgaatcacaagggcctc

SEQ ID NO: 349572 - DNA, 25 bp, Homo sapien
acaagggcctctttagggcacactt

SEQ ID NO: 349573 - DNA, 25 bp, Homo sapien
agggcacacttttagctctaagtct

SEQ ID NO: 349574 - DNA, 25 bp, Homo sapien
tttagctctaagtctctcagggctc

SEQ ID NO: 349575 - DNA, 25 bp, Homo sapien
ggaacactgctttatgtctccttga

SEQ ID NO: 349576 - DNA, 25 bp, Homo sapien
tatgtctccttgaccagttccgtgt

SEQ ID NO: 349577 - DNA, 25 bp, Homo sapien
ggacccttttaagttgccaagcact

SEQ ID NO: 349578 - DNA, 25 bp, Homo sapien
ggagtggaagatccagcccattctt

SEQ ID NO: 349579 - DNA, 25 bp, Homo sapien
attcttcgtggtgcctgccgcagag

SEQ ID NO: 349580 - DNA, 25 bp, Homo sapien
cgcagagcctgcaagcctgcagaaa

SEQ ID NO: 349581 - DNA, 25 bp, Homo sapien
aggtttgcagggaacacagttttca

SEQ ID NO: 349582 - DNA, 25 bp, Homo sapien
agacagggagtagccacgtctttct

SEQ ID NO: 349583 - DNA, 25 bp, Homo sapien
tagccacgtctttctgtagttcaca

SEQ ID NO: 349584 - DNA, 25 bp, Homo sapien
ctttctgtagttcacacctgtgtgt

SEQ ID NO: 349585 - DNA, 25 bp, Homo sapien
tgtgtgtctccccacctgataatcc

SEQ ID NO: 349586 - DNA, 25 bp, Homo sapien
tcagcacttctgtttgccttgcatg

SEQ ID NO: 349587 - DNA, 25 bp, Homo sapien
aagctcagtgcaggtgctaggtcat

SEQ ID NO: 349588 - DNA, 25 bp, Homo sapien
ttttttgtcacactgggatcctgcg

SEQ ID NO: 349589 - DNA, 25 bp, Homo sapien
agggatgtgaacttggctttgaaga

SEQ ID NO: 349590 - DNA, 25 bp, Homo sapien
gtgagtttaacaggttggccctcct

SEQ ID NO: 349591 - DNA, 25 bp, Homo sapien
tgagtttaacaggttggccctcctt

SEQ ID NO: 349592 - DNA, 25 bp, Homo sapien
ttggccctccttcccatgtgggagg

SEQ ID NO: 349593 - DNA, 25 bp, Homo sapien
gaggtaagatttgttaggactttct

SEQ ID NO: 349594 - DNA, 25 bp, Homo sapien
agatttgttaggactttctaggaag

SEQ ID NO: 349595 - DNA, 25 bp, Homo sapien
gtgaacttggctttgaagaatgggt

SEQ ID NO: 349596 - DNA, 25 bp, Homo sapien
ttgttaggactttctaggaagggtg

SEQ ID NO: 349597 - DNA, 25 bp, Homo sapien
gttaaaattaccagttgctgtagtt

SEQ ID NO: 349598 - DNA, 25 bp, Homo sapien
ccagttgctgtagtttgaggtttaa

SEQ ID NO: 349599 - DNA, 25 bp, Homo sapien
ctgtagtttgaggtttaaatactga

SEQ ID NO: 349600 - DNA, 25 bp, Homo sapien
aaaacaaactgctctgattcctgaa

SEQ ID NO: 349601 - DNA, 25 bp, Homo sapien
tcctgaagcccaaacaaacataact

SEQ ID NO: 349602 - DNA, 25 bp, Homo sapien
acataactttccatcttctaacaac

SEQ ID NO: 349603 - DNA, 25 bp, Homo sapien
gttcaactctgatttgatatcagtc

SEQ ID NO: 349604 - DNA, 25 bp, Homo sapien
gatatcagtctctcttatgcctaat

SEQ ID NO: 349605 - DNA, 25 bp, Homo sapien
tcttatgcctaatcagctgtcctga

SEQ ID NO: 349606 - DNA, 25 bp, Homo sapien
tcagctgtcctgattatgtgactca

SEQ ID NO: 349607 - DNA, 25 bp, Homo sapien
ctcaggactctgagaaatatcctca

SEQ ID NO: 349608 - DNA, 25 bp, Homo sapien
aagcatgacagtgtgcagaagaact

SEQ ID NO: 349609 - DNA, 25 bp, Homo sapien
gaactagacaggtcacaatggaatg

SEQ ID NO: 349610 - DNA, 25 bp, Homo sapien
gaagtagatagacctgcctatgcct

SEQ ID NO: 349611 - DNA, 25 bp, Homo sapien
acctcacaggagagaccaacccaca

SEQ ID NO: 349612 - DNA, 25 bp, Homo sapien
cctcacaggagagaccaacccacac

SEQ ID NO: 349613 - DNA, 25 bp, Homo sapien
ctcacaggagagaccaacccacacc

SEQ ID NO: 349614 - DNA, 25 bp, Homo sapien
tcacaggagagaccaacccacaccc

SEQ ID NO: 349615 - DNA, 25 bp, Homo sapien
gcccccacttctgacccctgtaact

SEQ ID NO: 349616 - DNA, 25 bp, Homo sapien
ccctgtaactctacccactgtgggt

SEQ ID NO: 349617 - DNA, 25 bp, Homo sapien
cctgtaactctacccactgtgggtt

SEQ ID NO: 349618 - DNA, 25 bp, Homo sapien
ctgtaactctacccactgtgggttt

SEQ ID NO: 349619 - DNA, 25 bp, Homo sapien
tgtaactctacccactgtgggtttc

SEQ ID NO: 349620 - DNA, 25 bp, Homo sapien
taactctacccactgtgggtttcct

SEQ ID NO: 349621 - DNA, 25 bp, Homo sapien
gaggcagcctgacctcaaagttcat

SEQ ID NO: 349622 - DNA, 25 bp, Homo sapien
ggcagcctgacctcaaagttcatcg

SEQ ID NO: 349623 - DNA, 25 bp, Homo sapien
cagcctgacctcaaagttcatcggt

SEQ ID NO: 349624 - DNA, 25 bp, Homo sapien
gcctgacctcaaagttcatcggtct

SEQ ID NO: 349625 - DNA, 25 bp, Homo sapien
ctgacctcaaagttcatcggtcttt

SEQ ID NO: 349626 - DNA, 25 bp, Homo sapien
acctcaaagttcatcggtctttttg

SEQ ID NO: 349627 - DNA, 25 bp, Homo sapien
caaagttcatcggtctttttgtttg

SEQ ID NO: 349628 - DNA, 25 bp, Homo sapien
aagagcacataatttatgggaccag

SEQ ID NO: 349629 - DNA, 25 bp, Homo sapien
gcacataatttatgggaccaggatt

SEQ ID NO: 349630 - DNA, 25 bp, Homo sapien
ttatgggaccaggatttgaagcgag

SEQ ID NO: 349631 - DNA, 25 bp, Homo sapien
ggaccaggatttgaagcgaggcagc

SEQ ID NO: 349632 - DNA, 25 bp, Homo sapien
tgctgtcctgctgcgagtctctgac

SEQ ID NO: 349633 - DNA, 25 bp, Homo sapien
gcgagtctctgacctggcccaggct

SEQ ID NO: 349634 - DNA, 25 bp, Homo sapien
aggctcttgctcagccatgtggttc

SEQ ID NO: 349635 - DNA, 25 bp, Homo sapien
atgtggttcctacctcctacctcat

SEQ ID NO: 349636 - DNA, 25 bp, Homo sapien
tccctgcatgttgacgctcttctaa

SEQ ID NO: 349637 - DNA, 25 bp, Homo sapien
cagcttgcctgagccgacgagggtc

SEQ ID NO: 349638 - DNA, 25 bp, Homo sapien
gacgagggtccagcctggagcatca

SEQ ID NO: 349639 - DNA, 25 bp, Homo sapien
cctggagcatcaggctctggaagcc

SEQ ID NO: 349640 - DNA, 25 bp, Homo sapien
agccgagcttgtatgtaggttttca

SEQ ID NO: 349641 - DNA, 25 bp, Homo sapien
taggttttcacactgtccgggagtc

SEQ ID NO: 349642 - DNA, 25 bp, Homo sapien
tccgggagtcaagacacagtgggtt

SEQ ID NO: 349643 - DNA, 25 bp, Homo sapien
gagactttgaagacctcgaggagca

SEQ ID NO: 349644 - DNA, 25 bp, Homo sapien
atggtggcgcggctatgccatcact

SEQ ID NO: 349645 - DNA, 25 bp, Homo sapien
tatgccatcactgatttctgcctac

SEQ ID NO: 349646 - DNA, 25 bp, Homo sapien
taagtctcacttgctactactctca

SEQ ID NO: 349647 - DNA, 25 bp, Homo sapien
ctactactctcaatttcctacttaa

SEQ ID NO: 349648 - DNA, 25 bp, Homo sapien
atttcctacttaatgcttcggagag

SEQ ID NO: 349649 - DNA, 25 bp, Homo sapien
cttcggagagcaccagtcctgagaa

SEQ ID NO: 349650 - DNA, 25 bp, Homo sapien
ggatgttcactctctgggagttgag

SEQ ID NO: 349651 - DNA, 25 bp, Homo sapien
agatggaacccaggcagttagaaaa

SEQ ID NO: 349652 - DNA, 25 bp, Homo sapien
agaaaaagtgccacagccacgtgcc

SEQ ID NO: 349653 - DNA, 25 bp, Homo sapien
gtgccgagcctactacttgtcagga

SEQ ID NO: 349654 - DNA, 25 bp, Homo sapien
tctccaaggagagctcatggcagac

SEQ ID NO: 349655 - DNA, 25 bp, Homo sapien
aggcaagtttgcctctccaaagagg

SEQ ID NO: 349656 - DNA, 25 bp, Homo sapien
gggaaggctggataagttttgacaa

SEQ ID NO: 349657 - DNA, 25 bp, Homo sapien
gacaagagaggagcgtgtttgcaaa

SEQ ID NO: 349658 - DNA, 25 bp, Homo sapien
tgcaaaagaattgtgccctcagcag

SEQ ID NO: 349659 - DNA, 25 bp, Homo sapien
gccctcagcagagcagtgctaagga

SEQ ID NO: 349660 - DNA, 25 bp, Homo sapien
acccctgcactattgtcttctcttt

SEQ ID NO: 349661 - DNA, 25 bp, Homo sapien
ggtggtgtctgtacacggtcttctc

SEQ ID NO: 349662 - DNA, 25 bp, Homo sapien
tctgtacacggtcttctcttattct

SEQ ID NO: 349663 - DNA, 25 bp, Homo sapien
ttctcttttgccacatgccctgctg

SEQ ID NO: 349664 - DNA, 25 bp, Homo sapien
aaggtaagcaaacaggctcctctcc

SEQ ID NO: 349665 - DNA, 25 bp, Homo sapien
tttaaaaatagggccaccactcacg

SEQ ID NO: 349666 - DNA, 25 bp, Homo sapien
ttaaaaatagggccaccactcacgc

SEQ ID NO: 349667 - DNA, 25 bp, Homo sapien
taaaaatagggccaccactcacgcc

SEQ ID NO: 349668 - DNA, 25 bp, Homo sapien
aaaaatagggccaccactcacgcct

SEQ ID NO: 349669 - DNA, 25 bp, Homo sapien
aaaatagggccaccactcacgcctg

SEQ ID NO: 349670 - DNA, 25 bp, Homo sapien
aaatagggccaccactcacgcctgt

SEQ ID NO: 349671 - DNA, 25 bp, Homo sapien
aatagggccaccactcacgcctgta

SEQ ID NO: 349672 - DNA, 25 bp, Homo sapien
atagggccaccactcacgcctgtaa

SEQ ID NO: 349673 - DNA, 25 bp, Homo sapien
tagggccaccactcacgcctgtaat

SEQ ID NO: 349674 - DNA, 25 bp, Homo sapien
agggccaccactcacgcctgtaatc

SEQ ID NO: 349675 - DNA, 25 bp, Homo sapien
ctttggttcaagacgtaggagcagc

SEQ ID NO: 349676 - DNA, 25 bp, Homo sapien
gctccctcttggcattcagtatagt

SEQ ID NO: 349677 - DNA, 25 bp, Homo sapien
gcattcagtatagtgtagatctacc

SEQ ID NO: 349678 - DNA, 25 bp, Homo sapien
taattctctgtttctttgaggagct

SEQ ID NO: 349679 - DNA, 25 bp, Homo sapien
gaggagctgtgaaaccaagggacat

SEQ ID NO: 349680 - DNA, 25 bp, Homo sapien
aaaccaagggacatatacaactgct

SEQ ID NO: 349681 - DNA, 25 bp, Homo sapien
tccctgtttctacctgcagctttgt

SEQ ID NO: 349682 - DNA, 25 bp, Homo sapien
tagacatcgtgtctccaaacactca

SEQ ID NO: 349683 - DNA, 25 bp, Homo sapien
gtctccaaacactcaggtctccaaa

SEQ ID NO: 349684 - DNA, 25 bp, Homo sapien
ggtctccaaacccaagttagtgtct

SEQ ID NO: 349685 - DNA, 25 bp, Homo sapien
aacccaagttagtgtctgagaacag

SEQ ID NO: 349686 - DNA, 25 bp, Homo sapien
gggattcttcctgctgccttcaaac

SEQ ID NO: 349687 - DNA, 25 bp, Homo sapien
ccttcaaactgagcctcatttttgg

SEQ ID NO: 349688 - DNA, 25 bp, Homo sapien
ttcaaactgagcctcatttttggag

SEQ ID NO: 349689 - DNA, 25 bp, Homo sapien
caaactgagcctcatttttggaggt

SEQ ID NO: 349690 - DNA, 25 bp, Homo sapien
ctgagcctcatttttggaggtggta

SEQ ID NO: 349691 - DNA, 25 bp, Homo sapien
tgagcctcatttttggaggtggtag

SEQ ID NO: 349692 - DNA, 25 bp, Homo sapien
cctcatttttggaggtggtagggat

SEQ ID NO: 349693 - DNA, 25 bp, Homo sapien
tgtgaggacttgtgatggagtttca

SEQ ID NO: 349694 - DNA, 25 bp, Homo sapien
tgaggacttgtgatggagtttcaga

SEQ ID NO: 349695 - DNA, 25 bp, Homo sapien
ggacttgtgatggagtttcagagtt

SEQ ID NO: 349696 - DNA, 25 bp, Homo sapien
acttgtgatggagtttcagagttgg

SEQ ID NO: 349697 - DNA, 25 bp, Homo sapien
taggagggttgaatctacaggaaac

SEQ ID NO: 349698 - DNA, 25 bp, Homo sapien
tgaatctacaggaaacctggtgatc

SEQ ID NO: 349699 - DNA, 25 bp, Homo sapien
gaagcagcaaggaaagatgtccatg

SEQ ID NO: 349700 - DNA, 25 bp, Homo sapien
gatgtccatgtttctgatttaggtg

SEQ ID NO: 349701 - DNA, 25 bp, Homo sapien
atgtttctgatttaggtggatggct

SEQ ID NO: 349702 - DNA, 25 bp, Homo sapien
ctgatttaggtggatggctgtgaaa

SEQ ID NO: 349703 - DNA, 25 bp, Homo sapien
aaacatgttgaggttaaggtgccta

SEQ ID NO: 349704 - DNA, 25 bp, Homo sapien
ttgaggttaaggtgcctaggagata

SEQ ID NO: 349705 - DNA, 25 bp, Homo sapien
gataagtagaggtgtctgttagtct

SEQ ID NO: 349706 - DNA, 25 bp, Homo sapien
aggcttggtctagagagctgaagat

SEQ ID NO: 349707 - DNA, 25 bp, Homo sapien
gagctgaagatgattcatttattca

SEQ ID NO: 349708 - DNA, 25 bp, Homo sapien
atggcctcgaagtagagtgtgagtc

SEQ ID NO: 349709 - DNA, 25 bp, Homo sapien
agtagagtgtgagtcatccaggaag

SEQ ID NO: 349710 - DNA, 25 bp, Homo sapien
atatgcccccacttagatggatgct

SEQ ID NO: 349711 - DNA, 25 bp, Homo sapien
agatggatgcttgtacagacgtttc

SEQ ID NO: 349712 - DNA, 25 bp, Homo sapien
ttgtacagacgtttccaaggatatc

SEQ ID NO: 349713 - DNA, 25 bp, Homo sapien
tttccaaggatatcatctgctggct

SEQ ID NO: 349714 - DNA, 25 bp, Homo sapien
agggagagcagtagttcccctctgc

SEQ ID NO: 349715 - DNA, 25 bp, Homo sapien
gtagttcccctctgctaatgctgga

SEQ ID NO: 349716 - DNA, 25 bp, Homo sapien
ttcccctctgctaatgctggacaaa

SEQ ID NO: 349717 - DNA, 25 bp, Homo sapien
gctggacaaagcaattagtgcattt

SEQ ID NO: 349718 - DNA, 25 bp, Homo sapien
agtgcatttcttatgactagttaat

SEQ ID NO: 349719 - DNA, 25 bp, Homo sapien
aggtggtgagctgtgactctcctta

SEQ ID NO: 349720 - DNA, 25 bp, Homo sapien
ggtgagctgtgactctccttagagc

SEQ ID NO: 349721 - DNA, 25 bp, Homo sapien
agctgtgactctccttagagcctgg

SEQ ID NO: 349722 - DNA, 25 bp, Homo sapien
agagcctggcgaggccgaggtcctc

SEQ ID NO: 349723 - DNA, 25 bp, Homo sapien
cagtggtcctggaaaagcccccagt

SEQ ID NO: 349724 - DNA, 25 bp, Homo sapien
ctggactcccgggagaacctggaat

SEQ ID NO: 349725 - DNA, 25 bp, Homo sapien
atctccagtccacattttctcagaa

SEQ ID NO: 349726 - DNA, 25 bp, Homo sapien
cagtccacattttctcagaatctgt

SEQ ID NO: 349727 - DNA, 25 bp, Homo sapien
attttctcagaatctgtcctagccc

SEQ ID NO: 349728 - DNA, 25 bp, Homo sapien
tttctcagaatctgtcctagccctt

SEQ ID NO: 349729 - DNA, 25 bp, Homo sapien
tagcccttcagtctcccaggcatga

SEQ ID NO: 349730 - DNA, 25 bp, Homo sapien
agttctgtgcttcccgcgcctacga

SEQ ID NO: 349731 - DNA, 25 bp, Homo sapien
gcctacgagagcagccgcgcagatg

SEQ ID NO: 349732 - DNA, 25 bp, Homo sapien
agccgcgcagatgagctgtccgtgc

SEQ ID NO: 349733 - DNA, 25 bp, Homo sapien
gcgcagatgagctgtccgtgcccgc

SEQ ID NO: 349734 - DNA, 25 bp, Homo sapien
gtgcgcgtgttggaaacgtcagacc

SEQ ID NO: 349735 - DNA, 25 bp, Homo sapien
gtgttggaaacgtcagaccgcggct

SEQ ID NO: 349736 - DNA, 25 bp, Homo sapien
ttggaaacgtcagaccgcggctggt

SEQ ID NO: 349737 - DNA, 25 bp, Homo sapien
tcagaccgcggctggtggctatgca

SEQ ID NO: 349738 - DNA, 25 bp, Homo sapien
tggctatgcaggtacggcgaccggg

SEQ ID NO: 349739 - DNA, 25 bp, Homo sapien
aagggctgggcgctctcctgagcgg

SEQ ID NO: 349740 - DNA, 25 bp, Homo sapien
gtggaggagacgacccggcgggtga

SEQ ID NO: 349741 - DNA, 25 bp, Homo sapien
ggacctgaggtttgcactcacattt

SEQ ID NO: 349742 - DNA, 25 bp, Homo sapien
ttgcactcacatttccatctggcgg

SEQ ID NO: 349743 - DNA, 25 bp, Homo sapien
atctggcggccccataagcaatctg

SEQ ID NO: 349744 - DNA, 25 bp, Homo sapien
ctacagataactcgtcctacacaaa

SEQ ID NO: 349745 - DNA, 25 bp, Homo sapien
tagtctcttttcagctcagctctct

SEQ ID NO: 349746 - DNA, 25 bp, Homo sapien
tcagctctctcactctcaattatat

SEQ ID NO: 349747 - DNA, 25 bp, Homo sapien
ctcaattatatctccttacttccat

SEQ ID NO: 349748 - DNA, 25 bp, Homo sapien
gtacactcatttactcagagccaga

SEQ ID NO: 349749 - DNA, 25 bp, Homo sapien
aaacgtcagcgtcatcttggatttt

SEQ ID NO: 349750 - DNA, 25 bp, Homo sapien
ttggatttttcttatgctctttctc

SEQ ID NO: 349751 - DNA, 25 bp, Homo sapien
taaactggtgtctctggacctgagg

SEQ ID NO: 349752 - DNA, 25 bp, Homo sapien
tggccacgtgactcctgcttagtgt

SEQ ID NO: 349753 - DNA, 25 bp, Homo sapien
cacgtgactcctgcttagtgttagt

SEQ ID NO: 349754 - DNA, 25 bp, Homo sapien
ttagtatgtttcctggttcctcacc

SEQ ID NO: 349755 - DNA, 25 bp, Homo sapien
tggttcctcacctatggctgtcatg

SEQ ID NO: 349756 - DNA, 25 bp, Homo sapien
ttcctcacctatggctgtcatgcga

SEQ ID NO: 349757 - DNA, 25 bp, Homo sapien
gctgtcatgcgaggaaagacttaaa

SEQ ID NO: 349758 - DNA, 25 bp, Homo sapien
gaggaaagacttaaaatctcgagtt

SEQ ID NO: 349759 - DNA, 25 bp, Homo sapien
aatctcgagttttagtacacttgga

SEQ ID NO: 349760 - DNA, 25 bp, Homo sapien
acacacatactcataaaggcacttt

SEQ ID NO: 349761 - DNA, 25 bp, Homo sapien
aaggcacttttagccaggactcctt

SEQ ID NO: 349762 - DNA, 25 bp, Homo sapien
tgtgtatgtgcatcctgcctgctag

SEQ ID NO: 349763 - DNA, 25 bp, Homo sapien
tccctcaagttcatgtggacatctg

SEQ ID NO: 349764 - DNA, 25 bp, Homo sapien
tggacatctgcctaggtcctactat

SEQ ID NO: 349765 - DNA, 25 bp, Homo sapien
ggtcctactatcctagaattcgcat

SEQ ID NO: 349766 - DNA, 25 bp, Homo sapien
gaattcgcatgtcttatcacacaaa

SEQ ID NO: 349767 - DNA, 25 bp, Homo sapien
ataactgattcttccatatcttata

SEQ ID NO: 349768 - DNA, 25 bp, Homo sapien
gtcacatgttgtgtaatagctcgaa

SEQ ID NO: 349769 - DNA, 25 bp, Homo sapien
atagctcgaagaagccctttttgtc

SEQ ID NO: 349770 - DNA, 25 bp, Homo sapien
aagaagccctttttgtccacagttg

SEQ ID NO: 349771 - DNA, 25 bp, Homo sapien
ttgtccacagttgccagagcttttg

SEQ ID NO: 349772 - DNA, 25 bp, Homo sapien
gagcttttggagaacagtccttatg

SEQ ID NO: 349773 - DNA, 25 bp, Homo sapien
gtattagctatttggtctattttgt

SEQ ID NO: 349774 - DNA, 25 bp, Homo sapien
aatggagagacatcgttgctgtgtt

SEQ ID NO: 349775 - DNA, 25 bp, Homo sapien
gttgctgtgttgaaagtccaggcag

SEQ ID NO: 349776 - DNA, 25 bp, Homo sapien
agagggcttgtgagccagtcagtcc

SEQ ID NO: 349777 - DNA, 25 bp, Homo sapien
gtcagtcccagttgcttgaggagca

SEQ ID NO: 349778 - DNA, 25 bp, Homo sapien
ggaaggtcaatagctattttgcaaa

SEQ ID NO: 349779 - DNA, 25 bp, Homo sapien
attccaggagccagaagtatcccag

SEQ ID NO: 349780 - DNA, 25 bp, Homo sapien
cttccctcttgattttccattagtt

SEQ ID NO: 349781 - DNA, 25 bp, Homo sapien
atgctagctgattgctcccgagata

SEQ ID NO: 349782 - DNA, 25 bp, Homo sapien
attgctcccgagataagggtcctag

SEQ ID NO: 349783 - DNA, 25 bp, Homo sapien
gtgaaagtcaatcatctctctccta

SEQ ID NO: 349784 - DNA, 25 bp, Homo sapien
atctctctcctatggtatgggtaga

SEQ ID NO: 349785 - DNA, 25 bp, Homo sapien
tgaatgctcctccacgatttactgc

SEQ ID NO: 349786 - DNA, 25 bp, Homo sapien
atttactgcttctccatctttgctt

SEQ ID NO: 349787 - DNA, 25 bp, Homo sapien
tatgctatttctctgcctggagtga

SEQ ID NO: 349788 - DNA, 25 bp, Homo sapien
gcctggagtgaaaactacccctgac

SEQ ID NO: 349789 - DNA, 25 bp, Homo sapien
gagtgaaaactacccctgacacatc

SEQ ID NO: 349790 - DNA, 25 bp, Homo sapien
cagctggctggcgtagtggagaaag

SEQ ID NO: 349791 - DNA, 25 bp, Homo sapien
ggctttgcagtcagaaacctgggtt

SEQ ID NO: 349792 - DNA, 25 bp, Homo sapien
agaaacctgggttcggatcctggct

SEQ ID NO: 349793 - DNA, 25 bp, Homo sapien
ggatcctggcttcacaacttattat

SEQ ID NO: 349794 - DNA, 25 bp, Homo sapien
tcctggcttcacaacttattatttg

SEQ ID NO: 349795 - DNA, 25 bp, Homo sapien
aggcagcgcaggtacccctgtgctt

SEQ ID NO: 349796 - DNA, 25 bp, Homo sapien
ttaaatcctaccctgtgggagttgc

SEQ ID NO: 349797 - DNA, 25 bp, Homo sapien
aaatcctaccctgtgggagttgcaa

SEQ ID NO: 349798 - DNA, 25 bp, Homo sapien
atcctaccctgtgggagttgcaata

SEQ ID NO: 349799 - DNA, 25 bp, Homo sapien
atacagttgtattggaatgctttct

SEQ ID NO: 349800 - DNA, 25 bp, Homo sapien
ggaatgctttcttgtacaaacataa

SEQ ID NO: 349801 - DNA, 25 bp, Homo sapien
gctttcttgtacaaacataagtttt

SEQ ID NO: 349802 - DNA, 25 bp, Homo sapien
ttacttttcccttctcctggactct

SEQ ID NO: 349803 - DNA, 25 bp, Homo sapien
tggactctccagtcaactgacggtt

SEQ ID NO: 349804 - DNA, 25 bp, Homo sapien
gactctccagtcaactgacggttgg

SEQ ID NO: 349805 - DNA, 25 bp, Homo sapien
tctccagtcaactgacggttgggtt

SEQ ID NO: 349806 - DNA, 25 bp, Homo sapien
tcaactgacggttgggttacttctt

SEQ ID NO: 349807 - DNA, 25 bp, Homo sapien
ttttaggaaatcactgttggcctcc

SEQ ID NO: 349808 - DNA, 25 bp, Homo sapien
gaaatcactgttggcctccttttgt

SEQ ID NO: 349809 - DNA, 25 bp, Homo sapien
tttgtgtatcatagtgcaaaacagt

SEQ ID NO: 349810 - DNA, 25 bp, Homo sapien
gaaaatgcgtctgggcgtggtagct

SEQ ID NO: 349811 - DNA, 25 bp, Homo sapien
tgcctcactccttagcagctagtgt

SEQ ID NO: 349812 - DNA, 25 bp, Homo sapien
gagtccaaggcgaatggatctgctt

SEQ ID NO: 349813 - DNA, 25 bp, Homo sapien
aatggatctgcttaagtccaggagt

SEQ ID NO: 349814 - DNA, 25 bp, Homo sapien
ccttagcagctagtgtgaacgtgaa

SEQ ID NO: 349815 - DNA, 25 bp, Homo sapien
atagtgatcacatcagtgtgtattc

SEQ ID NO: 349816 - DNA, 25 bp, Homo sapien
gtgtgtattcattctggtcagcaaa

SEQ ID NO: 349817 - DNA, 25 bp, Homo sapien
tattcattctggtcagcaaactagg

SEQ ID NO: 349818 - DNA, 25 bp, Homo sapien
acagcattatattcattttggattc

SEQ ID NO: 349819 - DNA, 25 bp, Homo sapien
aggtatttgagaaatttgaccactc

SEQ ID NO: 349820 - DNA, 25 bp, Homo sapien
ttgaccactcaataacttagtaaag

SEQ ID NO: 349821 - DNA, 25 bp, Homo sapien
gggctatttatcaaacctttggcaa

SEQ ID NO: 349822 - DNA, 25 bp, Homo sapien
gtgaatatttagcagccttaccatt

SEQ ID NO: 349823 - DNA, 25 bp, Homo sapien
atttagcagccttaccattaatggt

SEQ ID NO: 349824 - DNA, 25 bp, Homo sapien
gggcagacccatgctcagtaattca

SEQ ID NO: 349825 - DNA, 25 bp, Homo sapien
gacccatgctcagtaattcagaaat

SEQ ID NO: 349826 - DNA, 25 bp, Homo sapien
ggagaaatacatcatgaccaagtag

SEQ ID NO: 349827 - DNA, 25 bp, Homo sapien
gaccaagtagggtgtattcccagaa

SEQ ID NO: 349828 - DNA, 25 bp, Homo sapien
aatctatcattgcagtgtacacgtg

SEQ ID NO: 349829 - DNA, 25 bp, Homo sapien
ttcaagaccatttgagtgggtcctt

SEQ ID NO: 349830 - DNA, 25 bp, Homo sapien
catttgagtgggtccttgggtgcca

SEQ ID NO: 349831 - DNA, 25 bp, Homo sapien
tgggtgccatggacagaaatcttgt

SEQ ID NO: 349832 - DNA, 25 bp, Homo sapien
aggactgtcaagaccagggccttgg

SEQ ID NO: 349833 - DNA, 25 bp, Homo sapien
aagggcagccgagcttcacattgtc

SEQ ID NO: 349834 - DNA, 25 bp, Homo sapien
cgagcttcacattgtccccacttag

SEQ ID NO: 349835 - DNA, 25 bp, Homo sapien
ccacttagccacttgtcagggttgc

SEQ ID NO: 349836 - DNA, 25 bp, Homo sapien
tagccacttgtcagggttgctgtga

SEQ ID NO: 349837 - DNA, 25 bp, Homo sapien
accgtggcccacagaaatgacacat

SEQ ID NO: 349838 - DNA, 25 bp, Homo sapien
agaaatgacacatgagattcttttc

SEQ ID NO: 349839 - DNA, 25 bp, Homo sapien
ttttccttggtcgtaggatactggg

SEQ ID NO: 349840 - DNA, 25 bp, Homo sapien
gaaacaatttctctggtgctaaggt

SEQ ID NO: 349841 - DNA, 25 bp, Homo sapien
ttctctggtgctaaggtaggttttt

SEQ ID NO: 349842 - DNA, 25 bp, Homo sapien
tatttacgtcctcacaaaagggaca

SEQ ID NO: 349843 - DNA, 25 bp, Homo sapien
aataatgtcttccacatattgtgaa

SEQ ID NO: 349844 - DNA, 25 bp, Homo sapien
gtaaccatgttttcataggatttgt

SEQ ID NO: 349845 - DNA, 25 bp, Homo sapien
ttttcataggatttgtggattctgt

SEQ ID NO: 349846 - DNA, 25 bp, Homo sapien
agcagttctgctcaggataaatgca

SEQ ID NO: 349847 - DNA, 25 bp, Homo sapien
ggataaatgcaagttttcagtgttt

SEQ ID NO: 349848 - DNA, 25 bp, Homo sapien
tattggggtccttatttaactctca

SEQ ID NO: 349849 - DNA, 25 bp, Homo sapien
gtaaatagcagattcaactatccat

SEQ ID NO: 349850 - DNA, 25 bp, Homo sapien
cagattcaactatccattgaagcca

SEQ ID NO: 349851 - DNA, 25 bp, Homo sapien
caggagcacgtgtatcttaaatatg

SEQ ID NO: 349852 - DNA, 25 bp, Homo sapien
tggtaaacacccagtcttattttct

SEQ ID NO: 349853 - DNA, 25 bp, Homo sapien
acccagtcttattttctgggacaca

SEQ ID NO: 349854 - DNA, 25 bp, Homo sapien
gaagtgtgtttaagctgtcagctcc

SEQ ID NO: 349855 - DNA, 25 bp, Homo sapien
aagctgtcagctccaaaaacccttt

SEQ ID NO: 349856 - DNA, 25 bp, Homo sapien
aaaaggttgtcagctaccactgcat

SEQ ID NO: 349857 - DNA, 25 bp, Homo sapien
ctaccactgcatcccagatgttaga

SEQ ID NO: 349858 - DNA, 25 bp, Homo sapien
ttcaggactgcctagaattgtttcc

SEQ ID NO: 349859 - DNA, 25 bp, Homo sapien
gcctagaattgtttcctgtcatcgg

SEQ ID NO: 349860 - DNA, 25 bp, Homo sapien
ggtagtaaatgtgttctcaggagca

SEQ ID NO: 349861 - DNA, 25 bp, Homo sapien
tgttctcaggagcacgtgtatctta

SEQ ID NO: 349862 - DNA, 25 bp, Homo sapien
ggaggcagcatagctgcatccgcca

SEQ ID NO: 349863 - DNA, 25 bp, Homo sapien
ggcagcatagctgcatccgccaggg

SEQ ID NO: 349864 - DNA, 25 bp, Homo sapien
cagcgaacggcatcaaaactccaaa

SEQ ID NO: 349865 - DNA, 25 bp, Homo sapien
cagcatccgtctgtcctctttagtg

SEQ ID NO: 349866 - DNA, 25 bp, Homo sapien
gtctgtcctctttagtgccatattt

SEQ ID NO: 349867 - DNA, 25 bp, Homo sapien
tttagtgccatatttcaccctcagc

SEQ ID NO: 349868 - DNA, 25 bp, Homo sapien
ggcatcaaaactccaaacactttta

SEQ ID NO: 349869 - DNA, 25 bp, Homo sapien
gggcacgcctgttccagttgcattt

SEQ ID NO: 349870 - DNA, 25 bp, Homo sapien
acgcctgttccagttgcatttggat

SEQ ID NO: 349871 - DNA, 25 bp, Homo sapien
ctgttccagttgcatttggatactt

SEQ ID NO: 349872 - DNA, 25 bp, Homo sapien
aagatttctccccagagtgcccggg

SEQ ID NO: 349873 - DNA, 25 bp, Homo sapien
tataaggattggagtttgacccacc

SEQ ID NO: 349874 - DNA, 25 bp, Homo sapien
gatattggttttctcaggtggcata

SEQ ID NO: 349875 - DNA, 25 bp, Homo sapien
aggtggcatatgactctccggcttg

SEQ ID NO: 349876 - DNA, 25 bp, Homo sapien
atgactctccggcttggattgcctc

SEQ ID NO: 349877 - DNA, 25 bp, Homo sapien
gggacaaaaggttttgccctgagca

SEQ ID NO: 349878 - DNA, 25 bp, Homo sapien
ttccagtgcctggttaggttgctcc

SEQ ID NO: 349879 - DNA, 25 bp, Homo sapien
ggacagtctgactactctcaaaact

SEQ ID NO: 349880 - DNA, 25 bp, Homo sapien
tactctcaaaactcctcgtgacagg

SEQ ID NO: 349881 - DNA, 25 bp, Homo sapien
gaccaatcatctaaagagcgcccga

SEQ ID NO: 349882 - DNA, 25 bp, Homo sapien
taaagagcgcccgaagcactagcag

SEQ ID NO: 349883 - DNA, 25 bp, Homo sapien
gggacccataagacagggcttctag

SEQ ID NO: 349884 - DNA, 25 bp, Homo sapien
gggtacagatacctgagaatcagca

SEQ ID NO: 349885 - DNA, 25 bp, Homo sapien
atcagcaaaatccagctcaatcttt

SEQ ID NO: 349886 - DNA, 25 bp, Homo sapien
agcaaaatccagctcaatcttttct

SEQ ID NO: 349887 - DNA, 25 bp, Homo sapien
taaaataatcttgtactaaatccca

SEQ ID NO: 349888 - DNA, 25 bp, Homo sapien
gcaagcgaacccatgaattgattat

SEQ ID NO: 349889 - DNA, 25 bp, Homo sapien
gaattgattattcactgctgccatt

SEQ ID NO: 349890 - DNA, 25 bp, Homo sapien
tcagtttaaaagcaggacggctctg

SEQ ID NO: 349891 - DNA, 25 bp, Homo sapien
tttaaaagcaggacggctctgaggg

SEQ ID NO: 349892 - DNA, 25 bp, Homo sapien
ggctctgagggcaggtattaaagaa

SEQ ID NO: 349893 - DNA, 25 bp, Homo sapien
gattgggccaatctcagggttgacc

SEQ ID NO: 349894 - DNA, 25 bp, Homo sapien
tgggccaatctcagggttgaccctg

SEQ ID NO: 349895 - DNA, 25 bp, Homo sapien
tgagaataagttcatgtaattgtct

SEQ ID NO: 349896 - DNA, 25 bp, Homo sapien
gagaataagttcatgtaattgtctt

SEQ ID NO: 349897 - DNA, 25 bp, Homo sapien
agaataagttcatgtaattgtctta

SEQ ID NO: 349898 - DNA, 25 bp, Homo sapien
gaataagttcatgtaattgtcttaa

SEQ ID NO: 349899 - DNA, 25 bp, Homo sapien
aataagttcatgtaattgtcttaag

SEQ ID NO: 349900 - DNA, 25 bp, Homo sapien
ataagttcatgtaattgtcttaagt

SEQ ID NO: 349901 - DNA, 25 bp, Homo sapien
taagttcatgtaattgtcttaagtt

SEQ ID NO: 349902 - DNA, 25 bp, Homo sapien
aagttcatgtaattgtcttaagttt

SEQ ID NO: 349903 - DNA, 25 bp, Homo sapien
agttcatgtaattgtcttaagtttt

SEQ ID NO: 349904 - DNA, 25 bp, Homo sapien
gactacttaattctatcttttacca

SEQ ID NO: 349905 - DNA, 25 bp, Homo sapien
ttaccatttaattgcatctataatc

SEQ ID NO: 349906 - DNA, 25 bp, Homo sapien
gatattgcaatgatgttatacaact

SEQ ID NO: 349907 - DNA, 25 bp, Homo sapien
catcttttttctatccattctcttg

SEQ ID NO: 349908 - DNA, 25 bp, Homo sapien
ttttctatccattctcttgaacttt

SEQ ID NO: 349909 - DNA, 25 bp, Homo sapien
gggtattaacctagcacaactcctt

SEQ ID NO: 349910 - DNA, 25 bp, Homo sapien
tagcacaactcctttctgggtcatt

SEQ ID NO: 349911 - DNA, 25 bp, Homo sapien
ttctgggtcattgcacatcccggta

SEQ ID NO: 349912 - DNA, 25 bp, Homo sapien
gtcattgcacatcccggtagtatca

SEQ ID NO: 349913 - DNA, 25 bp, Homo sapien
gcacatcccggtagtatcattaaga

SEQ ID NO: 349914 - DNA, 25 bp, Homo sapien
catcccggtagtatcattaagagtt

SEQ ID NO: 349915 - DNA, 25 bp, Homo sapien
tctccacttggctggcatggataga

SEQ ID NO: 349916 - DNA, 25 bp, Homo sapien
acttggctggcatggatagacgtga

SEQ ID NO: 349917 - DNA, 25 bp, Homo sapien
ggctggcatggatagacgtgaattc

SEQ ID NO: 349918 - DNA, 25 bp, Homo sapien
agacgtgaattcagacagtcccaga

SEQ ID NO: 349919 - DNA, 25 bp, Homo sapien
tgaattcagacagtcccagagccca

SEQ ID NO: 349920 - DNA, 25 bp, Homo sapien
ttccgcctaggaaacccagaagaag

SEQ ID NO: 349921 - DNA, 25 bp, Homo sapien
gcctaggaaacccagaagaaggtca

SEQ ID NO: 349922 - DNA, 25 bp, Homo sapien
gaaggtcaaagaatgcgactatcct

SEQ ID NO: 349923 - DNA, 25 bp, Homo sapien
agagggaccacgcttgacaggttta

SEQ ID NO: 349924 - DNA, 25 bp, Homo sapien
ggaccacgcttgacaggtttaccat

SEQ ID NO: 349925 - DNA, 25 bp, Homo sapien
accacgcttgacaggtttaccatcg

SEQ ID NO: 349926 - DNA, 25 bp, Homo sapien
cgcccagcctggaaattaatgtgta

SEQ ID NO: 349927 - DNA, 25 bp, Homo sapien
gcccagcctggaaattaatgtgtag

SEQ ID NO: 349928 - DNA, 25 bp, Homo sapien
ccagcctggaaattaatgtgtagac

SEQ ID NO: 349929 - DNA, 25 bp, Homo sapien
gcctggaaattaatgtgtagacaag

SEQ ID NO: 349930 - DNA, 25 bp, Homo sapien
gtagacaagtacacagaaaatgcac

SEQ ID NO: 349931 - DNA, 25 bp, Homo sapien
gtacacagaaaatgcacatggcttt

SEQ ID NO: 349932 - DNA, 25 bp, Homo sapien
acacagaaaatgcacatggcttttt

SEQ ID NO: 349933 - DNA, 25 bp, Homo sapien
gaaaatgcacatggctttttataca

SEQ ID NO: 349934 - DNA, 25 bp, Homo sapien
tttttatacaaataggatccaccct

SEQ ID NO: 349935 - DNA, 25 bp, Homo sapien
tatacaaataggatccacccttttt

SEQ ID NO: 349936 - DNA, 25 bp, Homo sapien
taaaacaaatggtgggctgagtgca

SEQ ID NO: 349937 - DNA, 25 bp, Homo sapien
caaagctgttctgggctgcattaga

SEQ ID NO: 349938 - DNA, 25 bp, Homo sapien
tgttctgggctgcattagacccgtg

SEQ ID NO: 349939 - DNA, 25 bp, Homo sapien
tgggctgcattagacccgtgggcta

SEQ ID NO: 349940 - DNA, 25 bp, Homo sapien
agacccgtgggctagagttggacaa

SEQ ID NO: 349941 - DNA, 25 bp, Homo sapien
ccgtgggctagagttggacaagctt

SEQ ID NO: 349942 - DNA, 25 bp, Homo sapien
gacaagcttgtagatgatttcaggt

SEQ ID NO: 349943 - DNA, 25 bp, Homo sapien
aaggagtaagtcatcaatataaata

SEQ ID NO: 349944 - DNA, 25 bp, Homo sapien
gcaaacgagatattgctacatctct

SEQ ID NO: 349945 - DNA, 25 bp, Homo sapien
gatattgctacatctctatttaaag

SEQ ID NO: 349946 - DNA, 25 bp, Homo sapien
ttaaagttcctgaaaccatagccat

SEQ ID NO: 349947 - DNA, 25 bp, Homo sapien
gttcctgaaaccatagccatatttt

SEQ ID NO: 349948 - DNA, 25 bp, Homo sapien
cagtgtattagtattcaattccata

SEQ ID NO: 349949 - DNA, 25 bp, Homo sapien
gtattcaattccatatattcttgct

SEQ ID NO: 349950 - DNA, 25 bp, Homo sapien
atattcttgctagtgatttgtcatc

SEQ ID NO: 349951 - DNA, 25 bp, Homo sapien
atttgtcatctttagcttgttggga

SEQ ID NO: 349952 - DNA, 25 bp, Homo sapien
ttctttttcagcatcaggacttact

SEQ ID NO: 349953 - DNA, 25 bp, Homo sapien
caggacttacttccatagcttaact

SEQ ID NO: 349954 - DNA, 25 bp, Homo sapien
ttacttccatagcttaactcttcgg

SEQ ID NO: 349955 - DNA, 25 bp, Homo sapien
catagcttaactcttcggagggagc

SEQ ID NO: 349956 - DNA, 25 bp, Homo sapien
gattattaggtcaaacggtacgtgt

SEQ ID NO: 349957 - DNA, 25 bp, Homo sapien
tttagatatactcaagatgcccttt

SEQ ID NO: 349958 - DNA, 25 bp, Homo sapien
tatactcaagatgccctttagatag

SEQ ID NO: 349959 - DNA, 25 bp, Homo sapien
aaaaatgctgaagagggagtcaaag

SEQ ID NO: 349960 - DNA, 25 bp, Homo sapien
gaaaacagagtcatctaagatacca

SEQ ID NO: 349961 - DNA, 25 bp, Homo sapien
cagagtcatctaagataccaacttt

SEQ ID NO: 349962 - DNA, 25 bp, Homo sapien
gataccaactttacttaacgtggat

SEQ ID NO: 349963 - DNA, 25 bp, Homo sapien
aagatgacaactcttcccgttttat

SEQ ID NO: 349964 - DNA, 25 bp, Homo sapien
gatgacaactcttcccgttttattt

SEQ ID NO: 349965 - DNA, 25 bp, Homo sapien
ttcccgttttatttatctacaatag

SEQ ID NO: 349966 - DNA, 25 bp, Homo sapien
gaagtgtgatgtgagttgttgttaa

SEQ ID NO: 349967 - DNA, 25 bp, Homo sapien
agacagccatccatgtgcatgagca

SEQ ID NO: 349968 - DNA, 25 bp, Homo sapien
gagcatcatccagctttttttgtta

SEQ ID NO: 349969 - DNA, 25 bp, Homo sapien
catccagctttttttgttagcaaaa

SEQ ID NO: 349970 - DNA, 25 bp, Homo sapien
ttttttcagtcaggtgctagggaat

SEQ ID NO: 349971 - DNA, 25 bp, Homo sapien
caggtgctagggaattctccttttc

SEQ ID NO: 349972 - DNA, 25 bp, Homo sapien
tctccttttcttactatgtcatggc

SEQ ID NO: 349973 - DNA, 25 bp, Homo sapien
ttcttactatgtcatggctgtcctc

SEQ ID NO: 349974 - DNA, 25 bp, Homo sapien
gggctttcagaaagacaggtagaac

SEQ ID NO: 349975 - DNA, 25 bp, Homo sapien
ctagagagaccttgggtgtcaccca

SEQ ID NO: 349976 - DNA, 25 bp, Homo sapien
ttgaggctccatctgggcttgaaag

SEQ ID NO: 349977 - DNA, 25 bp, Homo sapien
ttgaaagagccctcacctgcagtaa

SEQ ID NO: 349978 - DNA, 25 bp, Homo sapien
aagagccctcacctgcagtaaaggt

SEQ ID NO: 349979 - DNA, 25 bp, Homo sapien
tgcagtaaaggtgcctctgaggcca

SEQ ID NO: 349980 - DNA, 25 bp, Homo sapien
aattatggcataagaagggaacacc

SEQ ID NO: 349981 - DNA, 25 bp, Homo sapien
aaatttgttgagtatctctgtgaca

SEQ ID NO: 349982 - DNA, 25 bp, Homo sapien
atctctgtgacaggcctataaagct

SEQ ID NO: 349983 - DNA, 25 bp, Homo sapien
gtgacaggcctataaagctaggact

SEQ ID NO: 349984 - DNA, 25 bp, Homo sapien
aaagctaggactacagtgccagtta

SEQ ID NO: 349985 - DNA, 25 bp, Homo sapien
ggactacagtgccagttagagttta

SEQ ID NO: 349986 - DNA, 25 bp, Homo sapien
acagtgccagttagagtttaggcca

SEQ ID NO: 349987 - DNA, 25 bp, Homo sapien
ccaggctcactgatgtatgcctgta

SEQ ID NO: 349988 - DNA, 25 bp, Homo sapien
gagagaatacaaccaatatgctaat

SEQ ID NO: 349989 - DNA, 25 bp, Homo sapien
atgctaatataatatcacttgagcc

SEQ ID NO: 349990 - DNA, 25 bp, Homo sapien
ttgacgctgcagtgaaccacaatca

SEQ ID NO: 349991 - DNA, 25 bp, Homo sapien
gacgctgcagtgaaccacaatcacc

SEQ ID NO: 349992 - DNA, 25 bp, Homo sapien
aaatcttttggtggaggtgccttca

SEQ ID NO: 349993 - DNA, 25 bp, Homo sapien
tcagggaaagttttcttcaccctca

SEQ ID NO: 349994 - DNA, 25 bp, Homo sapien
tcaccctcactcttcagttcaagaa

SEQ ID NO: 349995 - DNA, 25 bp, Homo sapien
gatgtcttcttgttgcgctgagaac

SEQ ID NO: 349996 - DNA, 25 bp, Homo sapien
tgttgcgctgagaacaccatatgtt

SEQ ID NO: 349997 - DNA, 25 bp, Homo sapien
atgttcatgacgagattcctggcac

SEQ ID NO: 349998 - DNA, 25 bp, Homo sapien
tgacgagattcctggcaccatgtca

SEQ ID NO: 349999 - DNA, 25 bp, Homo sapien
atgtcagccggcttgtagtcatgag

SEQ ID NO: 350000 - DNA, 25 bp, Homo sapien
gtagtcatgaggacaaccctttttg

SEQ ID NO: 350001 - DNA, 25 bp, Homo sapien
tgaggacaaccctttttggtgaggt

SEQ ID NO: 350002 - DNA, 25 bp, Homo sapien
aagcactcacttaagcattcctgga

SEQ ID NO: 350003 - DNA, 25 bp, Homo sapien
ttgtgtctataagtcgaggttccag

SEQ ID NO: 350004 - DNA, 25 bp, Homo sapien
gtgaatgcaactgtgatgatactag

SEQ ID NO: 350005 - DNA, 25 bp, Homo sapien
acggaagacactcacttggctttgg

SEQ ID NO: 350006 - DNA, 25 bp, Homo sapien
gctttggctaggtgtagtgttgact

SEQ ID NO: 350007 - DNA, 25 bp, Homo sapien
agggccggcctgttagagctctttt

SEQ ID NO: 350008 - DNA, 25 bp, Homo sapien
gagctcttttggctgtggaagctaa

SEQ ID NO: 350009 - DNA, 25 bp, Homo sapien
aatttgtgctgaatgtggtgcctac

SEQ ID NO: 350010 - DNA, 25 bp, Homo sapien
gtggtgcctacagaaaaacccttca

SEQ ID NO: 350011 - DNA, 25 bp, Homo sapien
gaaaaacccttcagaggtcatacag

SEQ ID NO: 350012 - DNA, 25 bp, Homo sapien
atacagtgtgtactctttctgccgg

SEQ ID NO: 350013 - DNA, 25 bp, Homo sapien
gtgtactctttctgccggtcagttg

SEQ ID NO: 350014 - DNA, 25 bp, Homo sapien
ggcatatctactgctcttgtatctc

SEQ ID NO: 350015 - DNA, 25 bp, Homo sapien
tttctggtgcctctaaagatcccca

SEQ ID NO: 350016 - DNA, 25 bp, Homo sapien
ctaaagatccccattcctagcaagt

SEQ ID NO: 350017 - DNA, 25 bp, Homo sapien
gactagctgatctgaatagctcagg

SEQ ID NO: 350018 - DNA, 25 bp, Homo sapien
atagctcaggtctctagattagtcc

SEQ ID NO: 350019 - DNA, 25 bp, Homo sapien
gagtggcccttcagacttctggttc

SEQ ID NO: 350020 - DNA, 25 bp, Homo sapien
agattagtcctcatttggtgtcccc

SEQ ID NO: 350021 - DNA, 25 bp, Homo sapien
ctggatcccattccttatgggtagt

SEQ ID NO: 350022 - DNA, 25 bp, Homo sapien
tcagacttctggttctaagcctttc

SEQ ID NO: 350023 - DNA, 25 bp, Homo sapien
taagcctttcctaaccatctggttc

SEQ ID NO: 350024 - DNA, 25 bp, Homo sapien
aaccatctggttcatcctgaatgcc

SEQ ID NO: 350025 - DNA, 25 bp, Homo sapien
gaaagagccccaggtcggccgagca

SEQ ID NO: 350026 - DNA, 25 bp, Homo sapien
aaagagccccaggtcggccgagcac

SEQ ID NO: 350027 - DNA, 25 bp, Homo sapien
aagagccccaggtcggccgagcacg

SEQ ID NO: 350028 - DNA, 25 bp, Homo sapien
agagccccaggtcggccgagcacgg

SEQ ID NO: 350029 - DNA, 25 bp, Homo sapien
gagccccaggtcggccgagcacggt

SEQ ID NO: 350030 - DNA, 25 bp, Homo sapien
agccccaggtcggccgagcacggtg

SEQ ID NO: 350031 - DNA, 25 bp, Homo sapien
gccccaggtcggccgagcacggtgg

SEQ ID NO: 350032 - DNA, 25 bp, Homo sapien
aattagcgggcttggtggcagatgc

SEQ ID NO: 350033 - DNA, 25 bp, Homo sapien
attagcgggcttggtggcagatgcc

SEQ ID NO: 350034 - DNA, 25 bp, Homo sapien
ttagcgggcttggtggcagatgcct

SEQ ID NO: 350035 - DNA, 25 bp, Homo sapien
tagcgggcttggtggcagatgcctg

SEQ ID NO: 350036 - DNA, 25 bp, Homo sapien
atgggtaatacacaacattccaaga

SEQ ID NO: 350037 - DNA, 25 bp, Homo sapien
acacaacattccaagatagattctg

SEQ ID NO: 350038 - DNA, 25 bp, Homo sapien
atagattctggtatcttgagccaac

SEQ ID NO: 350039 - DNA, 25 bp, Homo sapien
gtatcttgagccaacatatcaggag

SEQ ID NO: 350040 - DNA, 25 bp, Homo sapien
aaaactgaacattaccagcccctct

SEQ ID NO: 350041 - DNA, 25 bp, Homo sapien
cctctaccttagctaactgcaaaat

SEQ ID NO: 350042 - DNA, 25 bp, Homo sapien
tgctgctactctcccacaaaatgaa

SEQ ID NO: 350043 - DNA, 25 bp, Homo sapien
gtagaatagtacagctaagcacaag

SEQ ID NO: 350044 - DNA, 25 bp, Homo sapien
tttgccccagtgtgaaagtctctct

SEQ ID NO: 350045 - DNA, 25 bp, Homo sapien
cccagtgtgaaagtctctctcagaa

SEQ ID NO: 350046 - DNA, 25 bp, Homo sapien
cagaagattggtaactaatgggtaa

SEQ ID NO: 350047 - DNA, 25 bp, Homo sapien
atccttgttacactgcttttcttca

SEQ ID NO: 350048 - DNA, 25 bp, Homo sapien
tgttacactgcttttcttcatctct

SEQ ID NO: 350049 - DNA, 25 bp, Homo sapien
ttcttcatctcttgccctttccttt

SEQ ID NO: 350050 - DNA, 25 bp, Homo sapien
gccctttcctttcacatacattttt

SEQ ID NO: 350051 - DNA, 25 bp, Homo sapien
tcttctcattattacctgtctttca

SEQ ID NO: 350052 - DNA, 25 bp, Homo sapien
tgtctttcaaacactgtattctgcc

SEQ ID NO: 350053 - DNA, 25 bp, Homo sapien
gcctttgcaacactgagatccaaat

SEQ ID NO: 350054 - DNA, 25 bp, Homo sapien
gagatccaaatacccacaagtggtt

SEQ ID NO: 350055 - DNA, 25 bp, Homo sapien
tgtgtcatcacaagatctataaggt

SEQ ID NO: 350056 - DNA, 25 bp, Homo sapien
caataccctgaatatccaaatagag

SEQ ID NO: 350057 - DNA, 25 bp, Homo sapien
ggagacagaatcacttatccttgtt

SEQ ID NO: 350058 - DNA, 25 bp, Homo sapien
cggcgcggcgacagcgtggacggcc

SEQ ID NO: 350059 - DNA, 25 bp, Homo sapien
ggctcgggcctgtgcgtcctaccat

SEQ ID NO: 350060 - DNA, 25 bp, Homo sapien
tgtgcgtcctaccatccgggtcggt

SEQ ID NO: 350061 - DNA, 25 bp, Homo sapien
taccatccgggtcggtgctggacaa

SEQ ID NO: 350062 - DNA, 25 bp, Homo sapien
gctggacaagctggcggctggcctc

SEQ ID NO: 350063 - DNA, 25 bp, Homo sapien
gcggctggcctcgacgagagactct

SEQ ID NO: 350064 - DNA, 25 bp, Homo sapien
ggctggcctcgacgagagactcttt

SEQ ID NO: 350065 - DNA, 25 bp, Homo sapien
tggcctcgacgagagactctttccg

SEQ ID NO: 350066 - DNA, 25 bp, Homo sapien
ggcctcgacgagagactctttccgc

SEQ ID NO: 350067 - DNA, 25 bp, Homo sapien
tcgacgagagactctttccgccgcg

SEQ ID NO: 350068 - DNA, 25 bp, Homo sapien
cgtcgtggcgactcccgcgttggtc

SEQ ID NO: 350069 - DNA, 25 bp, Homo sapien
atctagttttatgtttgcttgaaac

SEQ ID NO: 350070 - DNA, 25 bp, Homo sapien
agttttatgtttgcttgaaacaaca

SEQ ID NO: 350071 - DNA, 25 bp, Homo sapien
ttttttcatttagactgatctcaca

SEQ ID NO: 350072 - DNA, 25 bp, Homo sapien
tttttcatttagactgatctcacaa

SEQ ID NO: 350073 - DNA, 25 bp, Homo sapien
atgatttgctcagggtaagtaatga

SEQ ID NO: 350074 - DNA, 25 bp, Homo sapien
tgctcagggtaagtaatgagtcata

SEQ ID NO: 350075 - DNA, 25 bp, Homo sapien
aaattatttggcaacagtcaaactg

SEQ ID NO: 350076 - DNA, 25 bp, Homo sapien
cagtcaaactgttcagaaaatactt

SEQ ID NO: 350077 - DNA, 25 bp, Homo sapien
aaaaaatctgtagctaggccaggcg

SEQ ID NO: 350078 - DNA, 25 bp, Homo sapien
aaaatctgtagctaggccaggcgca

SEQ ID NO: 350079 - DNA, 25 bp, Homo sapien
aaatctgtagctaggccaggcgcag

SEQ ID NO: 350080 - DNA, 25 bp, Homo sapien
agcttaacacttaattggcagccat

SEQ ID NO: 350081 - DNA, 25 bp, Homo sapien
taaacaggacagttccatgcaggga

SEQ ID NO: 350082 - DNA, 25 bp, Homo sapien
gggaacgatggctgctaacacctat

SEQ ID NO: 350083 - DNA, 25 bp, Homo sapien
gctaacacctatccaggacctagtt

SEQ ID NO: 350084 - DNA, 25 bp, Homo sapien
ggacctagtttccatgaccatgcat

SEQ ID NO: 350085 - DNA, 25 bp, Homo sapien
ttcctttgcccacttcttaaatgtt

SEQ ID NO: 350086 - DNA, 25 bp, Homo sapien
agttaagtttcagcccttttctcat

SEQ ID NO: 350087 - DNA, 25 bp, Homo sapien
agcccttttctcattgtccatgtga

SEQ ID NO: 350088 - DNA, 25 bp, Homo sapien
ttatgtagtcttatccactgccacg

SEQ ID NO: 350089 - DNA, 25 bp, Homo sapien
ctcaggttccatctctagttctcaa

SEQ ID NO: 350090 - DNA, 25 bp, Homo sapien
atattcttagcctagatcaggagtt

SEQ ID NO: 350091 - DNA, 25 bp, Homo sapien
ctcctcctggtctgaaacgcaaggt

SEQ ID NO: 350092 - DNA, 25 bp, Homo sapien
gaaacgcaaggtttggcaatctcaa

SEQ ID NO: 350093 - DNA, 25 bp, Homo sapien
ggcaatctcaaaaagtactgtccct

SEQ ID NO: 350094 - DNA, 25 bp, Homo sapien
tcaaaaagtactgtccctgtctcca

SEQ ID NO: 350095 - DNA, 25 bp, Homo sapien
tccctgtctccaaatctcgaatttt

SEQ ID NO: 350096 - DNA, 25 bp, Homo sapien
aatctcgaattttgaagcgggtgaa

SEQ ID NO: 350097 - DNA, 25 bp, Homo sapien
aagcgggtgaaatcaatactgtaga

SEQ ID NO: 350098 - DNA, 25 bp, Homo sapien
acataaataattctcggtgacccgg

SEQ ID NO: 350099 - DNA, 25 bp, Homo sapien
taattctcggtgacccggctgaggc

SEQ ID NO: 350100 - DNA, 25 bp, Homo sapien
ggctgaggcgcaggacgtgctcggg

SEQ ID NO: 350101 - DNA, 25 bp, Homo sapien
ggatggtgtccagcgccagcagctc

SEQ ID NO: 350102 - DNA, 25 bp, Homo sapien
atcttgtgcttttcagacgatccca

SEQ ID NO: 350103 - DNA, 25 bp, Homo sapien
gacgatcccactaattgtccatatc

SEQ ID NO: 350104 - DNA, 25 bp, Homo sapien
tgtccatatctgttccaaagccaaa

SEQ ID NO: 350105 - DNA, 25 bp, Homo sapien
acaagagcaaaatctgtcctctcat

SEQ ID NO: 350106 - DNA, 25 bp, Homo sapien
gtcctctcatattattcatggtcct

SEQ ID NO: 350107 - DNA, 25 bp, Homo sapien
attcatggtcctgcgtggatcataa

SEQ ID NO: 350108 - DNA, 25 bp, Homo sapien
taaatggcatgctgactgtctgatg

SEQ ID NO: 350109 - DNA, 25 bp, Homo sapien
gctgactgtctgatggagacttact

SEQ ID NO: 350110 - DNA, 25 bp, Homo sapien
gacagaggctgtattttactgaagt

SEQ ID NO: 350111 - DNA, 25 bp, Homo sapien
ggtgaatgcaaatgcctagggccta

SEQ ID NO: 350112 - DNA, 25 bp, Homo sapien
tgcctagggcctaagtatacaggaa

SEQ ID NO: 350113 - DNA, 25 bp, Homo sapien
gaagttacatgtcaacctaaagtcc

SEQ ID NO: 350114 - DNA, 25 bp, Homo sapien
ttacatgtcaacctaaagtccatct

SEQ ID NO: 350115 - DNA, 25 bp, Homo sapien
ctggctagctgtgggacattgggca

SEQ ID NO: 350116 - DNA, 25 bp, Homo sapien
ctacaacctctgtagtcttggtttc

SEQ ID NO: 350117 - DNA, 25 bp, Homo sapien
aagaagagcagtttcaagaagatat

SEQ ID NO: 350118 - DNA, 25 bp, Homo sapien
aagtaataatagtacccattctgtg

SEQ ID NO: 350119 - DNA, 25 bp, Homo sapien
gtacccattctgtgggatagttggg

SEQ ID NO: 350120 - DNA, 25 bp, Homo sapien
tatactcagagaacacattgcgaaa

SEQ ID NO: 350121 - DNA, 25 bp, Homo sapien
aacacattgcgaaagcagaagctga

SEQ ID NO: 350122 - DNA, 25 bp, Homo sapien
gaagctgaagtatgggctcaggtaa

SEQ ID NO: 350123 - DNA, 25 bp, Homo sapien
tgggctcaggtaaaagaagttacat

SEQ ID NO: 350124 - DNA, 25 bp, Homo sapien
gctgtggccaccatgtcctcaaagc

SEQ ID NO: 350125 - DNA, 25 bp, Homo sapien
ggaatgtagtctgagactgccagga

SEQ ID NO: 350126 - DNA, 25 bp, Homo sapien
gagaaacactaactagtcttccttt

SEQ ID NO: 350127 - DNA, 25 bp, Homo sapien
ctagtcttcctttataacccattca

SEQ ID NO: 350128 - DNA, 25 bp, Homo sapien
ttataacccattcatactctctggc

SEQ ID NO: 350129 - DNA, 25 bp, Homo sapien
attcatactctctggctgtccccaa

SEQ ID NO: 350130 - DNA, 25 bp, Homo sapien
tggctgtccccaaccttcatagtct

SEQ ID NO: 350131 - DNA, 25 bp, Homo sapien
ttcatagtctcctgcatccaaatgt

SEQ ID NO: 350132 - DNA, 25 bp, Homo sapien
catccaaatgtcctctttggctcaa

SEQ ID NO: 350133 - DNA, 25 bp, Homo sapien
gtcctctttggctcaaaaagtaggc

SEQ ID NO: 350134 - DNA, 25 bp, Homo sapien
ttgggcaacacagcgcaatctcgtc

SEQ ID NO: 350135 - DNA, 25 bp, Homo sapien
gggattagatgctctatctcctgtc

SEQ ID NO: 350136 - DNA, 25 bp, Homo sapien
ggaagaatgtaatcaccagcgtgac

SEQ ID NO: 350137 - DNA, 25 bp, Homo sapien
tcaccagcgtgactccagtgatgga

SEQ ID NO: 350138 - DNA, 25 bp, Homo sapien
gtcaactcagttatcatcttggcgg

SEQ ID NO: 350139 - DNA, 25 bp, Homo sapien
tcagttatcatcttggcggccgggc

SEQ ID NO: 350140 - DNA, 25 bp, Homo sapien
aatttcactgccttccagcaattaa

SEQ ID NO: 350141 - DNA, 25 bp, Homo sapien
tcacagaagccacctgatccggaaa

SEQ ID NO: 350142 - DNA, 25 bp, Homo sapien
gaagccacctgatccggaaaagatt

SEQ ID NO: 350143 - DNA, 25 bp, Homo sapien
ggaaaagatttccaaagcctgctgg

SEQ ID NO: 350144 - DNA, 25 bp, Homo sapien
agtagccttggtggtctgcaacgac

SEQ ID NO: 350145 - DNA, 25 bp, Homo sapien
ggtctgcaacgacatttcagggatt

SEQ ID NO: 350146 - DNA, 25 bp, Homo sapien
acacacttgtgcacagtcttgaatg

SEQ ID NO: 350147 - DNA, 25 bp, Homo sapien
acagtcttgaatgtgtgcccacaca

SEQ ID NO: 350148 - DNA, 25 bp, Homo sapien
acatctgcctgcacacactcatgtg

SEQ ID NO: 350149 - DNA, 25 bp, Homo sapien
atgtgcccacatgtgaatcacttgg

SEQ ID NO: 350150 - DNA, 25 bp, Homo sapien
agtgtacacaaaaccaaacccacag

SEQ ID NO: 350151 - DNA, 25 bp, Homo sapien
acagatgggcagacaggtgagcctc

SEQ ID NO: 350152 - DNA, 25 bp, Homo sapien
gtgagcctcgtgcagcatgtgacac

SEQ ID NO: 350153 - DNA, 25 bp, Homo sapien
atgtgacactcccacatgcacaaga

SEQ ID NO: 350154 - DNA, 25 bp, Homo sapien
agacatgtgtgcagaggcatatcac

SEQ ID NO: 350155 - DNA, 25 bp, Homo sapien
ggcatatcacacacgcagaagcact

SEQ ID NO: 350156 - DNA, 25 bp, Homo sapien
gaagcactcccgagaactgccttct

SEQ ID NO: 350157 - DNA, 25 bp, Homo sapien
gcagaagctctaaaccagggctttt

SEQ ID NO: 350158 - DNA, 25 bp, Homo sapien
tgagagaactgattcccagcacacc

SEQ ID NO: 350159 - DNA, 25 bp, Homo sapien
cagcactcctctaaagggcgggaat

SEQ ID NO: 350160 - DNA, 25 bp, Homo sapien
gaagggtacaacttcacactggttg

SEQ ID NO: 350161 - DNA, 25 bp, Homo sapien
acaacttcacactggttgctgaact

SEQ ID NO: 350162 - DNA, 25 bp, Homo sapien
gatattacatctctgccaagggccg

SEQ ID NO: 350163 - DNA, 25 bp, Homo sapien
caagggccgtgtcattcatcctggc

SEQ ID NO: 350164 - DNA, 25 bp, Homo sapien
tggcccttgtctgctgtactcgtgt

SEQ ID NO: 350165 - DNA, 25 bp, Homo sapien
ccaagttggcagatgggtctgttct

SEQ ID NO: 350166 - DNA, 25 bp, Homo sapien
gatgggtctgttctccttagtaggt

SEQ ID NO: 350167 - DNA, 25 bp, Homo sapien
ttctccttagtaggtggtctgcaag

SEQ ID NO: 350168 - DNA, 25 bp, Homo sapien
gtagtagttccacagttccatagat

SEQ ID NO: 350169 - DNA, 25 bp, Homo sapien
gttccacagttccatagattacatt

SEQ ID NO: 350170 - DNA, 25 bp, Homo sapien
tacatttttccttggagcatcctat

SEQ ID NO: 350171 - DNA, 25 bp, Homo sapien
ccttggagcatcctatatgcagcat

SEQ ID NO: 350172 - DNA, 25 bp, Homo sapien
atatgcagcatagtttagtggttaa

SEQ ID NO: 350173 - DNA, 25 bp, Homo sapien
tacttcctgaatttaaatcctggct

SEQ ID NO: 350174 - DNA, 25 bp, Homo sapien
gggcaagatatttactcactttata

SEQ ID NO: 350175 - DNA, 25 bp, Homo sapien
cactttatacctaagttcctcgtat

SEQ ID NO: 350176 - DNA, 25 bp, Homo sapien
gcaacagagggctttgtaatcttac

SEQ ID NO: 350177 - DNA, 25 bp, Homo sapien
gtaatcttacatcccttgataaaag

SEQ ID NO: 350178 - DNA, 25 bp, Homo sapien
agtcaatctcctgtagtagttccac

SEQ ID NO: 350179 - DNA, 25 bp, Homo sapien
gtgcacctgtctggcttcaaaatct

SEQ ID NO: 350180 - DNA, 25 bp, Homo sapien
tggcttcaaaatctctctgatcctc

SEQ ID NO: 350181 - DNA, 25 bp, Homo sapien
agcctcgttgagtcctctcaggtga

SEQ ID NO: 350182 - DNA, 25 bp, Homo sapien
cgttgagtcctctcaggtgaaagtc

SEQ ID NO: 350183 - DNA, 25 bp, Homo sapien
gtgaaagtcatgagccgatctgtct

SEQ ID NO: 350184 - DNA, 25 bp, Homo sapien
agtcatgagccgatctgtctcttgt

SEQ ID NO: 350185 - DNA, 25 bp, Homo sapien
ttctctttgcttcaactctttagta

SEQ ID NO: 350186 - DNA, 25 bp, Homo sapien
aactctttagtagcaatctcttgtc

SEQ ID NO: 350187 - DNA, 25 bp, Homo sapien
agcaatctcttgtcttagagcccgg

SEQ ID NO: 350188 - DNA, 25 bp, Homo sapien
tcttagagcccggtgttggctgaca

SEQ ID NO: 350189 - DNA, 25 bp, Homo sapien
gagcccggtgttggctgacaccaga

SEQ ID NO: 350190 - DNA, 25 bp, Homo sapien
aaaacgggaggtgctcgtgctggcc

SEQ ID NO: 350191 - DNA, 25 bp, Homo sapien
gtgagaccccggtgagatggaccat

SEQ ID NO: 350192 - DNA, 25 bp, Homo sapien
gaccccggtgagatggaccatcctg

SEQ ID NO: 350193 - DNA, 25 bp, Homo sapien
cccacatccgtgctgtgtcattgtt

SEQ ID NO: 350194 - DNA, 25 bp, Homo sapien
tcattgttgctctgcttcctttcaa

SEQ ID NO: 350195 - DNA, 25 bp, Homo sapien
tgctctgcttcctttcaatgtgtca

SEQ ID NO: 350196 - DNA, 25 bp, Homo sapien
tgcttcctttcaatgtgtcagtgcc

SEQ ID NO: 350197 - DNA, 25 bp, Homo sapien
tcctttcaatgtgtcagtgcctggg

SEQ ID NO: 350198 - DNA, 25 bp, Homo sapien
gaacctgaccaaaagccatggctgt

SEQ ID NO: 350199 - DNA, 25 bp, Homo sapien
tgctcccccctttgtatgatgcaaa

SEQ ID NO: 350200 - DNA, 25 bp, Homo sapien
gatgcaaatgctgaaatgtacaaaa

SEQ ID NO: 350201 - DNA, 25 bp, Homo sapien
tgtagctcaattcttttaaagtact

SEQ ID NO: 350202 - DNA, 25 bp, Homo sapien
agtacttatgtagccaaaaagcatt

SEQ ID NO: 350203 - DNA, 25 bp, Homo sapien
gaaagtatatgtagccatctccaca

SEQ ID NO: 350204 - DNA, 25 bp, Homo sapien
gccatctccacatcactcattatga

SEQ ID NO: 350205 - DNA, 25 bp, Homo sapien
tatgaccccttcttttataatgctt

SEQ ID NO: 350206 - DNA, 25 bp, Homo sapien
ttcctgaagaggaacaccactgttc

SEQ ID NO: 350207 - DNA, 25 bp, Homo sapien
ggaacaccactgttccaccttcatt

SEQ ID NO: 350208 - DNA, 25 bp, Homo sapien
cttcattctcccttctaataactgt

SEQ ID NO: 350209 - DNA, 25 bp, Homo sapien
ggaaattctgataatgtaactggga

SEQ ID NO: 350210 - DNA, 25 bp, Homo sapien
actgggaagcagtaattcatttcat

SEQ ID NO: 350211 - DNA, 25 bp, Homo sapien
gtaattcatttcattccataccggg

SEQ ID NO: 350212 - DNA, 25 bp, Homo sapien
gattggttaccctgatcaaggcctt

SEQ ID NO: 350213 - DNA, 25 bp, Homo sapien
gaaaatacatcagatgcctttctgt

SEQ ID NO: 350214 - DNA, 25 bp, Homo sapien
gatgcctttctgtaaattggttttt

SEQ ID NO: 350215 - DNA, 25 bp, Homo sapien
agtttatggacatctcactttccca

SEQ ID NO: 350216 - DNA, 25 bp, Homo sapien
ttcccacgtgcttccttctttgctt

SEQ ID NO: 350217 - DNA, 25 bp, Homo sapien
tcctgacccattacatgcacatgta

SEQ ID NO: 350218 - DNA, 25 bp, Homo sapien
atgcacatgtactcacatactccct

SEQ ID NO: 350219 - DNA, 25 bp, Homo sapien
cctcttccttctcgatggagttaag

SEQ ID NO: 350220 - DNA, 25 bp, Homo sapien
gaaagcctgaaagtaccttaataat

SEQ ID NO: 350221 - DNA, 25 bp, Homo sapien
gaattctgaatagttccatgtcata

SEQ ID NO: 350222 - DNA, 25 bp, Homo sapien
gttccatgtcatacaatattctaga

SEQ ID NO: 350223 - DNA, 25 bp, Homo sapien
aaggaagcatgtttcattcgcagtt

SEQ ID NO: 350224 - DNA, 25 bp, Homo sapien
attcgcagttgttggcagcagcatc

SEQ ID NO: 350225 - DNA, 25 bp, Homo sapien
gaacaggcagccaacagacctctct

SEQ ID NO: 350226 - DNA, 25 bp, Homo sapien
agacctctctttgctgagttccagg

SEQ ID NO: 350227 - DNA, 25 bp, Homo sapien
caggtgtccctgatcggcttaaaca

SEQ ID NO: 350228 - DNA, 25 bp, Homo sapien
atcggcttaaacactgggtcatata

SEQ ID NO: 350229 - DNA, 25 bp, Homo sapien
ggtcatataatgttctttggtaaaa

SEQ ID NO: 350230 - DNA, 25 bp, Homo sapien
ggtcatgtagacctaaggatcgttc

SEQ ID NO: 350231 - DNA, 25 bp, Homo sapien
ggatcgttcttatccgtgatacgaa

SEQ ID NO: 350232 - DNA, 25 bp, Homo sapien
ccatgaaccagacgccgtgtcaaag

SEQ ID NO: 350233 - DNA, 25 bp, Homo sapien
cgccgtgtcaaagagtggatgccaa

SEQ ID NO: 350234 - DNA, 25 bp, Homo sapien
aggagctcagcccttgttcagcatc

SEQ ID NO: 350235 - DNA, 25 bp, Homo sapien
gggatgaagcttatatatgtaatga

SEQ ID NO: 350236 - DNA, 25 bp, Homo sapien
gctttcaggcacagatcggtcctta

SEQ ID NO: 350237 - DNA, 25 bp, Homo sapien
tcaggcacagatcggtccttatgcg

SEQ ID NO: 350238 - DNA, 25 bp, Homo sapien
agatcggtccttatgcgccatcaaa

SEQ ID NO: 350239 - DNA, 25 bp, Homo sapien
gtccttatgcgccatcaaagagtcc

SEQ ID NO: 350240 - DNA, 25 bp, Homo sapien
ccttatgcgccatcaaagagtccac

SEQ ID NO: 350241 - DNA, 25 bp, Homo sapien
gagtccacactataaagtaatttgt

SEQ ID NO: 350242 - DNA, 25 bp, Homo sapien
taaatacttcagtcagatttttaag

SEQ ID NO: 350243 - DNA, 25 bp, Homo sapien
cttcagtcagatttttaagtttgtt

SEQ ID NO: 350244 - DNA, 25 bp, Homo sapien
gtcaaaagagtttactttggagcaa

SEQ ID NO: 350245 - DNA, 25 bp, Homo sapien
tttctccattggtgatccccaaatt

SEQ ID NO: 350246 - DNA, 25 bp, Homo sapien
aggtaaaactgctcttgcaaagggc

SEQ ID NO: 350247 - DNA, 25 bp, Homo sapien
attcaagagccagttcaatttccta

SEQ ID NO: 350248 - DNA, 25 bp, Homo sapien
gccagttcaatttcctatttctcat

SEQ ID NO: 350249 - DNA, 25 bp, Homo sapien
atttcctatttctcattaagtggta

SEQ ID NO: 350250 - DNA, 25 bp, Homo sapien
tagtaatgccaagaccacatcccag

SEQ ID NO: 350251 - DNA, 25 bp, Homo sapien
aagaccacatcccagaatctccagg

SEQ ID NO: 350252 - DNA, 25 bp, Homo sapien
gaatctccagggtaacagaggccca

SEQ ID NO: 350253 - DNA, 25 bp, Homo sapien
cagaggcccaacgaagggctgcaga

SEQ ID NO: 350254 - DNA, 25 bp, Homo sapien
agggctgcagagaaacttgaaagta

SEQ ID NO: 350255 - DNA, 25 bp, Homo sapien
cttgaaagtaaactggcttagttct

SEQ ID NO: 350256 - DNA, 25 bp, Homo sapien
tgtaggccctgctcctggatatagg

SEQ ID NO: 350257 - DNA, 25 bp, Homo sapien
atatagggccgcatggtgctgacga

SEQ ID NO: 350258 - DNA, 25 bp, Homo sapien
gccgcatggtgctgacgatctggtc

SEQ ID NO: 350259 - DNA, 25 bp, Homo sapien
gtgctgacgatctggtcctgctcgt

SEQ ID NO: 350260 - DNA, 25 bp, Homo sapien
tggtcctgctcgtccgcagtataca

SEQ ID NO: 350261 - DNA, 25 bp, Homo sapien
gctcgtccgcagtatacagattggg

SEQ ID NO: 350262 - DNA, 25 bp, Homo sapien
gaatgtcaccagagtttaggacgtt

SEQ ID NO: 350263 - DNA, 25 bp, Homo sapien
caccagagtttaggacgttgttgat

SEQ ID NO: 350264 - DNA, 25 bp, Homo sapien
gacgttgttgatatcttccaggaag

SEQ ID NO: 350265 - DNA, 25 bp, Homo sapien
tccaggaaggattcgttcttgatct

SEQ ID NO: 350266 - DNA, 25 bp, Homo sapien
caggaaggattcgttcttgatctgg

SEQ ID NO: 350267 - DNA, 25 bp, Homo sapien
caaggaagagaagtccaaaggtcag

SEQ ID NO: 350268 - DNA, 25 bp, Homo sapien
aggaagagaagtccaaaggtcagaa

SEQ ID NO: 350269 - DNA, 25 bp, Homo sapien
aaggtcagaagaaggctgacagtat

SEQ ID NO: 350270 - DNA, 25 bp, Homo sapien
ctgacagtatggaggctaaaggtgt

SEQ ID NO: 350271 - DNA, 25 bp, Homo sapien
ggaaccaggaggagatgagtataca

SEQ ID NO: 350272 - DNA, 25 bp, Homo sapien
ggaagcccaggtagaagctggaagg

SEQ ID NO: 350273 - DNA, 25 bp, Homo sapien
gaagctggaagggacgtagagcaag

SEQ ID NO: 350274 - DNA, 25 bp, Homo sapien
aggaagatcaagttgctgaggagaa

SEQ ID NO: 350275 - DNA, 25 bp, Homo sapien
gaagttgtacagaaacaagaggctg

SEQ ID NO: 350276 - DNA, 25 bp, Homo sapien
agttgtacagaaacaagaggctgag

SEQ ID NO: 350277 - DNA, 25 bp, Homo sapien
acagaaacaagaggctgagggagtc

SEQ ID NO: 350278 - DNA, 25 bp, Homo sapien
atgaactggcagtcgcttcaggaaa

SEQ ID NO: 350279 - DNA, 25 bp, Homo sapien
tcgcttcaggaaagggacacatggt

SEQ ID NO: 350280 - DNA, 25 bp, Homo sapien
gatttgaggtacaccccaagtgcct

SEQ ID NO: 350281 - DNA, 25 bp, Homo sapien
gacacatggtgagtcctgatgatgg

SEQ ID NO: 350282 - DNA, 25 bp, Homo sapien
ggcactagtagggtacaccatatca

SEQ ID NO: 350283 - DNA, 25 bp, Homo sapien
gtacaccatatcaggccaggaggaa

SEQ ID NO: 350284 - DNA, 25 bp, Homo sapien
aagtgcctggcagctaaacacattg

SEQ ID NO: 350285 - DNA, 25 bp, Homo sapien
aaacacattgccattagtgccacat

SEQ ID NO: 350286 - DNA, 25 bp, Homo sapien
attagtgccacatcatttagcttaa

SEQ ID NO: 350287 - DNA, 25 bp, Homo sapien
tagcttaaggctctactaagtcagt

SEQ ID NO: 350288 - DNA, 25 bp, Homo sapien
gtcagtaattactttagtggcatta

SEQ ID NO: 350289 - DNA, 25 bp, Homo sapien
caagagctggccctttataccactt

SEQ ID NO: 350290 - DNA, 25 bp, Homo sapien
gctccttgacatttgtggacagggc

SEQ ID NO: 350291 - DNA, 25 bp, Homo sapien
tttataccacttccgatgttcctcc

SEQ ID NO: 350292 - DNA, 25 bp, Homo sapien
atgttcctcccatgttactgggcat

SEQ ID NO: 350293 - DNA, 25 bp, Homo sapien
gggcatttttcaaacgttcatttca

SEQ ID NO: 350294 - DNA, 25 bp, Homo sapien
ccaaatgtttagtgagggactcaat

SEQ ID NO: 350295 - DNA, 25 bp, Homo sapien
catttgtggacagggctctgggttc

SEQ ID NO: 350296 - DNA, 25 bp, Homo sapien
agatgtctgggcacacagtgtgaag

SEQ ID NO: 350297 - DNA, 25 bp, Homo sapien
tgggttcacctctgtcccagcatgt

SEQ ID NO: 350298 - DNA, 25 bp, Homo sapien
agcatgtctgtcctgccactgagct

SEQ ID NO: 350299 - DNA, 25 bp, Homo sapien
actgagctggcaggcatttccgagg

SEQ ID NO: 350300 - DNA, 25 bp, Homo sapien
aagacctacatccagactgaactgc

SEQ ID NO: 350301 - DNA, 25 bp, Homo sapien
tccagactgaactgcccttcaaggc

SEQ ID NO: 350302 - DNA, 25 bp, Homo sapien
gcccttcaaggcaaagacccttcat

SEQ ID NO: 350303 - DNA, 25 bp, Homo sapien
agacccttcatgagaagacctccca

SEQ ID NO: 350304 - DNA, 25 bp, Homo sapien
gctgtgtggcctttactttgaaaac

SEQ ID NO: 350305 - DNA, 25 bp, Homo sapien
tgtggcctttactttgaaaaccgca

SEQ ID NO: 350306 - DNA, 25 bp, Homo sapien
tttgaaaaccgcaaggccctggcca

SEQ ID NO: 350307 - DNA, 25 bp, Homo sapien
acgcacgggcacacctgcggcagtt

SEQ ID NO: 350308 - DNA, 25 bp, Homo sapien
acctgcggcagttcggcgtgaccga

SEQ ID NO: 350309 - DNA, 25 bp, Homo sapien
tggctcgcccatcgagacactgagc

SEQ ID NO: 350310 - DNA, 25 bp, Homo sapien
ccatcgagacactgagcgagtggat

SEQ ID NO: 350311 - DNA, 25 bp, Homo sapien
ggctctatccgcgaggtgccagtag

SEQ ID NO: 350312 - DNA, 25 bp, Homo sapien
tatccgcgaggtgccagtagcgtgt

SEQ ID NO: 350313 - DNA, 25 bp, Homo sapien
gtgccagtagcgtgtgcaggtacat

SEQ ID NO: 350314 - DNA, 25 bp, Homo sapien
ccagtagcgtgtgcaggtacataca

SEQ ID NO: 350315 - DNA, 25 bp, Homo sapien
tgtgcaggtacatacacgtgcgtgc

SEQ ID NO: 350316 - DNA, 25 bp, Homo sapien
gcaggtacatacacgtgcgtgcaca

SEQ ID NO: 350317 - DNA, 25 bp, Homo sapien
atacacgtgcgtgcacactgtgatg

SEQ ID NO: 350318 - DNA, 25 bp, Homo sapien
cacccggaaatgtctcaggatgttg

SEQ ID NO: 350319 - DNA, 25 bp, Homo sapien
cccagttgagaatctgccccagagg

SEQ ID NO: 350320 - DNA, 25 bp, Homo sapien
gttgatcaagttccaaggaaaagga

SEQ ID NO: 350321 - DNA, 25 bp, Homo sapien
gaaaaggaacatctcagccgggcgt

SEQ ID NO: 350322 - DNA, 25 bp, Homo sapien
aaagagctggagataaagtgtgcat

SEQ ID NO: 350323 - DNA, 25 bp, Homo sapien
tggctgaaagtgagacagtctaatg

SEQ ID NO: 350324 - DNA, 25 bp, Homo sapien
gagacagtctaatgggtagatacaa

SEQ ID NO: 350325 - DNA, 25 bp, Homo sapien
gggtagatacaaattgtgttcaaag

SEQ ID NO: 350326 - DNA, 25 bp, Homo sapien
gaagtatcatattaagcagtaggtc

SEQ ID NO: 350327 - DNA, 25 bp, Homo sapien
aagtgtgcatagtattgtagggagc

SEQ ID NO: 350328 - DNA, 25 bp, Homo sapien
gtattgtagggagcaacacctgagt

SEQ ID NO: 350329 - DNA, 25 bp, Homo sapien
tagggagcaacacctgagtgctgct

SEQ ID NO: 350330 - DNA, 25 bp, Homo sapien
gcaacacctgagtgctgctcaaagg

SEQ ID NO: 350331 - DNA, 25 bp, Homo sapien
ggagcctagcaggaatgctggcagt

SEQ ID NO: 350332 - DNA, 25 bp, Homo sapien
gctggcagtggtgacttggattgga

SEQ ID NO: 350333 - DNA, 25 bp, Homo sapien
atggccaatgtatgcttttactctg

SEQ ID NO: 350334 - DNA, 25 bp, Homo sapien
atgcttttactctggtttggttaat

SEQ ID NO: 350335 - DNA, 25 bp, Homo sapien
cctttactcagcagggtatacacta

SEQ ID NO: 350336 - DNA, 25 bp, Homo sapien
gatcctagtgtaagtattcccaagt

SEQ ID NO: 350337 - DNA, 25 bp, Homo sapien
attcccaagtttacataagccaggt

SEQ ID NO: 350338 - DNA, 25 bp, Homo sapien
gccaggtgactgtagattttccatg

SEQ ID NO: 350339 - DNA, 25 bp, Homo sapien
aagaacccaagcatattcagtcatg

SEQ ID NO: 350340 - DNA, 25 bp, Homo sapien
tcagtcatggcctctagcgggtaga

SEQ ID NO: 350341 - DNA, 25 bp, Homo sapien
ggcattgggccattgataacttaca

SEQ ID NO: 350342 - DNA, 25 bp, Homo sapien
gggtatacactacttgctgcatgaa

SEQ ID NO: 350343 - DNA, 25 bp, Homo sapien
gaaatctttttcacagcagggtaag

SEQ ID NO: 350344 - DNA, 25 bp, Homo sapien
gcgcacgcacgccttgagcagtcag

SEQ ID NO: 350345 - DNA, 25 bp, Homo sapien
gagcagtcagcattgcacctgctat

SEQ ID NO: 350346 - DNA, 25 bp, Homo sapien
cagcattgcacctgctatggagaag

SEQ ID NO: 350347 - DNA, 25 bp, Homo sapien
tggatttgctttcagttggttttca

SEQ ID NO: 350348 - DNA, 25 bp, Homo sapien
ggttttcaatttgctcactggccag

SEQ ID NO: 350349 - DNA, 25 bp, Homo sapien
aatttgctcactggccagagacatt

SEQ ID NO: 350350 - DNA, 25 bp, Homo sapien
ccagagacattgatggcagttctta

SEQ ID NO: 350351 - DNA, 25 bp, Homo sapien
ggcagttcttatctgcatcactaat

SEQ ID NO: 350352 - DNA, 25 bp, Homo sapien
aatggtttgaaacaactactggaat

SEQ ID NO: 350353 - DNA, 25 bp, Homo sapien
ggaatattgtccacaataagctgga

SEQ ID NO: 350354 - DNA, 25 bp, Homo sapien
ggaagtttgttgtagtatgcctcaa

SEQ ID NO: 350355 - DNA, 25 bp, Homo sapien
agaaaactctctagactctagcttt

SEQ ID NO: 350356 - DNA, 25 bp, Homo sapien
tctagactctagcttttgcaggccg

SEQ ID NO: 350357 - DNA, 25 bp, Homo sapien
tagactctagcttttgcaggccgac

SEQ ID NO: 350358 - DNA, 25 bp, Homo sapien
actctagcttttgcaggccgactga

SEQ ID NO: 350359 - DNA, 25 bp, Homo sapien
ctagcttttgcaggccgactgagca

SEQ ID NO: 350360 - DNA, 25 bp, Homo sapien
gaaatgtgcaaagtgcctttcccca

SEQ ID NO: 350361 - DNA, 25 bp, Homo sapien
gcctttccccagacagttagaatgt

SEQ ID NO: 350362 - DNA, 25 bp, Homo sapien
ctttccccagacagttagaatgtgt

SEQ ID NO: 350363 - DNA, 25 bp, Homo sapien
tgaatccccaaacccagactgatct

SEQ ID NO: 350364 - DNA, 25 bp, Homo sapien
caaacccagactgatctctcttctc

SEQ ID NO: 350365 - DNA, 25 bp, Homo sapien
gtaagctggcaagatttaaaaaact

SEQ ID NO: 350366 - DNA, 25 bp, Homo sapien
tccttgtgaccaaataccatatttg

SEQ ID NO: 350367 - DNA, 25 bp, Homo sapien
ataccatatttgtcccaaacctcca

SEQ ID NO: 350368 - DNA, 25 bp, Homo sapien
tgatgatttagtcccagagccctcc

SEQ ID NO: 350369 - DNA, 25 bp, Homo sapien
cctccgccactctatgatttagact

SEQ ID NO: 350370 - DNA, 25 bp, Homo sapien
tcttccatctgatcggattctcatt

SEQ ID NO: 350371 - DNA, 25 bp, Homo sapien
atctgatcggattctcattgtgaga

SEQ ID NO: 350372 - DNA, 25 bp, Homo sapien
ctcattgtgagatgtggtgactttc

SEQ ID NO: 350373 - DNA, 25 bp, Homo sapien
gatgtggtgactttcatgttagatc

SEQ ID NO: 350374 - DNA, 25 bp, Homo sapien
gttagatcttcttcattgatgcctt

SEQ ID NO: 350375 - DNA, 25 bp, Homo sapien
tcttcttcattgatgccttggtttt

SEQ ID NO: 350376 - DNA, 25 bp, Homo sapien
gtctgttgattaaagcattcgaaat

SEQ ID NO: 350377 - DNA, 25 bp, Homo sapien
aagggagccaggatcaagaagcagt

SEQ ID NO: 350378 - DNA, 25 bp, Homo sapien
tatcaaaggcaggagctaccagcga

SEQ ID NO: 350379 - DNA, 25 bp, Homo sapien
ctaccagcgagggtgtcagggaccc

SEQ ID NO: 350380 - DNA, 25 bp, Homo sapien
tgtcagggacccgttgggagcattt

SEQ ID NO: 350381 - DNA, 25 bp, Homo sapien
ttgtagagagctggaactcacctgc

SEQ ID NO: 350382 - DNA, 25 bp, Homo sapien
aatacatgtgacttctagtgagaca

SEQ ID NO: 350383 - DNA, 25 bp, Homo sapien
tctagtgagacacatgcacccctga

SEQ ID NO: 350384 - DNA, 25 bp, Homo sapien
acccctgacccaaggaacatgcggg

SEQ ID NO: 350385 - DNA, 25 bp, Homo sapien
actggctcctttgcgatgttattta

SEQ ID NO: 350386 - DNA, 25 bp, Homo sapien
gttatttattttctcgctctgcaaa

SEQ ID NO: 350387 - DNA, 25 bp, Homo sapien
ttctcgctctgcaaatgtttattga

SEQ ID NO: 350388 - DNA, 25 bp, Homo sapien
caccggcagtggctaccatttattg

SEQ ID NO: 350389 - DNA, 25 bp, Homo sapien
tattgagtgctgatggtgtcacctg

SEQ ID NO: 350390 - DNA, 25 bp, Homo sapien
attgacttagtggtctctggcgcta

SEQ ID NO: 350391 - DNA, 25 bp, Homo sapien
tctggcgctagttccgaagttgatt

SEQ ID NO: 350392 - DNA, 25 bp, Homo sapien
aagttgattctgtctggagagctta

SEQ ID NO: 350393 - DNA, 25 bp, Homo sapien
aatgcagtgttcagacctcagggtc

SEQ ID NO: 350394 - DNA, 25 bp, Homo sapien
tcagggtccgaacctgagggtcacc

SEQ ID NO: 350395 - DNA, 25 bp, Homo sapien
atgagtgggacatagctgtgtgacc

SEQ ID NO: 350396 - DNA, 25 bp, Homo sapien
tgtgacctcggctgagtgctttcac

SEQ ID NO: 350397 - DNA, 25 bp, Homo sapien
tcatggcaccttcacgtggtgtgat

SEQ ID NO: 350398 - DNA, 25 bp, Homo sapien
gaagggatcgatgccttgcaagtag

SEQ ID NO: 350399 - DNA, 25 bp, Homo sapien
ctgaatacacctatagtttactatg

SEQ ID NO: 350400 - DNA, 25 bp, Homo sapien
gaatacacctatagtttactatgac

SEQ ID NO: 350401 - DNA, 25 bp, Homo sapien
atacacctatagtttactatgacac

SEQ ID NO: 350402 - DNA, 25 bp, Homo sapien
acacctatagtttactatgacacca

SEQ ID NO: 350403 - DNA, 25 bp, Homo sapien
cacctatagtttactatgacaccat

SEQ ID NO: 350404 - DNA, 25 bp, Homo sapien
ctatagtttactatgacaccatatt

SEQ ID NO: 350405 - DNA, 25 bp, Homo sapien
atagtttactatgacaccatattct

SEQ ID NO: 350406 - DNA, 25 bp, Homo sapien
agtttactatgacaccatattctac

SEQ ID NO: 350407 - DNA, 25 bp, Homo sapien
gtttactatgacaccatattctaca

SEQ ID NO: 350408 - DNA, 25 bp, Homo sapien
tttactatgacaccatattctacat

SEQ ID NO: 350409 - DNA, 25 bp, Homo sapien
tactatgacaccatattctacattg

SEQ ID NO: 350410 - DNA, 25 bp, Homo sapien
ttcattaaaaaacagataccctaga

SEQ ID NO: 350411 - DNA, 25 bp, Homo sapien
tcattaaaaaacagataccctagac

SEQ ID NO: 350412 - DNA, 25 bp, Homo sapien
ttaaaaaacagataccctagaccag

SEQ ID NO: 350413 - DNA, 25 bp, Homo sapien
taaaaaacagataccctagaccagg

SEQ ID NO: 350414 - DNA, 25 bp, Homo sapien
aaaaacagataccctagaccaggtg

SEQ ID NO: 350415 - DNA, 25 bp, Homo sapien
aaaacagataccctagaccaggtga

SEQ ID NO: 350416 - DNA, 25 bp, Homo sapien
aaacagataccctagaccaggtgag

SEQ ID NO: 350417 - DNA, 25 bp, Homo sapien
aacagataccctagaccaggtgagg

SEQ ID NO: 350418 - DNA, 25 bp, Homo sapien
acagataccctagaccaggtgaggt

SEQ ID NO: 350419 - DNA, 25 bp, Homo sapien
gggctgacttctgcctttgtagttg

SEQ ID NO: 350420 - DNA, 25 bp, Homo sapien
tctatctttgctttgtctgaaaaat

SEQ ID NO: 350421 - DNA, 25 bp, Homo sapien
tctgctggtggcttcgtgaaacaac

SEQ ID NO: 350422 - DNA, 25 bp, Homo sapien
ctctttctctagagctcctgaatgt

SEQ ID NO: 350423 - DNA, 25 bp, Homo sapien
gctcctgaatgtccacatgcaatgt

SEQ ID NO: 350424 - DNA, 25 bp, Homo sapien
gcaatgtctacaaaggctctgggcc

SEQ ID NO: 350425 - DNA, 25 bp, Homo sapien
ctctgggcccgggaaatgtggatcc

SEQ ID NO: 350426 - DNA, 25 bp, Homo sapien
cgggaaatgtggatccatgcggctt

SEQ ID NO: 350427 - DNA, 25 bp, Homo sapien
ggcttgccgccatggaatgtttttc

SEQ ID NO: 350428 - DNA, 25 bp, Homo sapien
ataaggtctacggatctatgggtct

SEQ ID NO: 350429 - DNA, 25 bp, Homo sapien
ctatgggtctttgaccacacttggg

SEQ ID NO: 350430 - DNA, 25 bp, Homo sapien
gggagccatcaccacggaacaaaga

SEQ ID NO: 350431 - DNA, 25 bp, Homo sapien
acggaacaaagaactgaccctgcaa

SEQ ID NO: 350432 - DNA, 25 bp, Homo sapien
aagaactgaccctgcaaacagccag

SEQ ID NO: 350433 - DNA, 25 bp, Homo sapien
gaccctgcaaacagccagaaggcat

SEQ ID NO: 350434 - DNA, 25 bp, Homo sapien
cagccagaaggcatcacccaaaaag

SEQ ID NO: 350435 - DNA, 25 bp, Homo sapien
tcacccaaaaagatgcccaagtcag

SEQ ID NO: 350436 - DNA, 25 bp, Homo sapien
gagttctgcgggaagcattttacca

SEQ ID NO: 350437 - DNA, 25 bp, Homo sapien
tctgcgggaagcattttaccaacag

SEQ ID NO: 350438 - DNA, 25 bp, Homo sapien
gggagcgcccctacacctgtgagtt

SEQ ID NO: 350439 - DNA, 25 bp, Homo sapien
cctacacctgtgagttctgcaacta

SEQ ID NO: 350440 - DNA, 25 bp, Homo sapien
acctgtgagttctgcaactacgcct

SEQ ID NO: 350441 - DNA, 25 bp, Homo sapien
gagagcctggataggactccccggt

SEQ ID NO: 350442 - DNA, 25 bp, Homo sapien
aaaggtgaatgaccctccagtctgg

SEQ ID NO: 350443 - DNA, 25 bp, Homo sapien
agtctggccttccttgaggtcatat

SEQ ID NO: 350444 - DNA, 25 bp, Homo sapien
cttgaggtcatatggagcaggcagt

SEQ ID NO: 350445 - DNA, 25 bp, Homo sapien
tgctctgaggcagggagtttcagaa

SEQ ID NO: 350446 - DNA, 25 bp, Homo sapien
ggagtttcagaacccgggttcagat

SEQ ID NO: 350447 - DNA, 25 bp, Homo sapien
gaacccgggttcagatgtcacagct

SEQ ID NO: 350448 - DNA, 25 bp, Homo sapien
tggcttgggacatctagctgggcac

SEQ ID NO: 350449 - DNA, 25 bp, Homo sapien
tctagctgggcacataaacttcttg

SEQ ID NO: 350450 - DNA, 25 bp, Homo sapien
acataaacttcttgtgcttcccctg

SEQ ID NO: 350451 - DNA, 25 bp, Homo sapien
ggtcatgatacccttaaaaagcaaa

SEQ ID NO: 350452 - DNA, 25 bp, Homo sapien
atgtgattatacttctctttgactt

SEQ ID NO: 350453 - DNA, 25 bp, Homo sapien
gtgattatacttctctttgacttgt

SEQ ID NO: 350454 - DNA, 25 bp, Homo sapien
gattatacttctctttgacttgtca

SEQ ID NO: 350455 - DNA, 25 bp, Homo sapien
attatacttctctttgacttgtcag

SEQ ID NO: 350456 - DNA, 25 bp, Homo sapien
tatacttctctttgacttgtcagct

SEQ ID NO: 350457 - DNA, 25 bp, Homo sapien
acttctctttgacttgtcagcttag

SEQ ID NO: 350458 - DNA, 25 bp, Homo sapien
tctctttgacttgtcagcttagctt

SEQ ID NO: 350459 - DNA, 25 bp, Homo sapien
agttattctctgtcatcttggctgg

SEQ ID NO: 350460 - DNA, 25 bp, Homo sapien
ggtgcccaactattattgtatcagt

SEQ ID NO: 350461 - DNA, 25 bp, Homo sapien
gcccaactattattgtatcagtgaa

SEQ ID NO: 350462 - DNA, 25 bp, Homo sapien
caactattattgtatcagtgaactt

SEQ ID NO: 350463 - DNA, 25 bp, Homo sapien
acaagggcgaagatgcgctctcctc

SEQ ID NO: 350464 - DNA, 25 bp, Homo sapien
tacagttcagcacaaacctcaggcg

SEQ ID NO: 350465 - DNA, 25 bp, Homo sapien
cgacccacgcgtttaaaggcctctg

SEQ ID NO: 350466 - DNA, 25 bp, Homo sapien
ttaaaggcctctgcggcaacgttta

SEQ ID NO: 350467 - DNA, 25 bp, Homo sapien
ggcctctgcggcaacgtttagggac

SEQ ID NO: 350468 - DNA, 25 bp, Homo sapien
gcaacgtttagggacgcgaactagg

SEQ ID NO: 350469 - DNA, 25 bp, Homo sapien
agcacaaacctcaggcgggcgattt

SEQ ID NO: 350470 - DNA, 25 bp, Homo sapien
gaagcgagagcagtctgcgcccaag

SEQ ID NO: 350471 - DNA, 25 bp, Homo sapien
agtctgcgcccaagaccgcgcaaga

SEQ ID NO: 350472 - DNA, 25 bp, Homo sapien
caggcagccgggtaacctactgggt

SEQ ID NO: 350473 - DNA, 25 bp, Homo sapien
aacctactgggtcccagtgggtgct

SEQ ID NO: 350474 - DNA, 25 bp, Homo sapien
taacagcacaagacgcactcacagg

SEQ ID NO: 350475 - DNA, 25 bp, Homo sapien
gcactcacagggtggcggaatcttc

SEQ ID NO: 350476 - DNA, 25 bp, Homo sapien
gaatcttccggaaaactctctataa

SEQ ID NO: 350477 - DNA, 25 bp, Homo sapien
aaaactctctataagctcagctccc

SEQ ID NO: 350478 - DNA, 25 bp, Homo sapien
cactctagcgttttgtcacgtctta

SEQ ID NO: 350479 - DNA, 25 bp, Homo sapien
gtcacgtcttacattttagcagtat

SEQ ID NO: 350480 - DNA, 25 bp, Homo sapien
ttttctgtaacgcaccaagtcttag

SEQ ID NO: 350481 - DNA, 25 bp, Homo sapien
agatctttctagagcttgtttgttc

SEQ ID NO: 350482 - DNA, 25 bp, Homo sapien
gtttgttcatcctcacaatcacaga

SEQ ID NO: 350483 - DNA, 25 bp, Homo sapien
ttttttctccaatcctcacagagac

SEQ ID NO: 350484 - DNA, 25 bp, Homo sapien
caatcctcacagagacccaattgac

SEQ ID NO: 350485 - DNA, 25 bp, Homo sapien
attcaaattgcagtacacgctatgg

SEQ ID NO: 350486 - DNA, 25 bp, Homo sapien
aaattgcagtacacgctatggaaga

SEQ ID NO: 350487 - DNA, 25 bp, Homo sapien
tgcagtacacgctatggaagaaatg

SEQ ID NO: 350488 - DNA, 25 bp, Homo sapien
caggagttgggatggaactgcttca

SEQ ID NO: 350489 - DNA, 25 bp, Homo sapien
tgggatggaactgcttcagaaggaa

SEQ ID NO: 350490 - DNA, 25 bp, Homo sapien
agaggtgtggtgtggctcagaacaa

SEQ ID NO: 350491 - DNA, 25 bp, Homo sapien
tcagaacaaagggtgagcgcttcca

SEQ ID NO: 350492 - DNA, 25 bp, Homo sapien
aacaaagggtgagcgcttccaggaa

SEQ ID NO: 350493 - DNA, 25 bp, Homo sapien
ggctcagtgctgaggaatcagtcac

SEQ ID NO: 350494 - DNA, 25 bp, Homo sapien
tgaggaatcagtcacatgcacaggt

SEQ ID NO: 350495 - DNA, 25 bp, Homo sapien
atgcacaggtgttgggagtctctct

SEQ ID NO: 350496 - DNA, 25 bp, Homo sapien
aaaccaagagaatgggccgggtgca

SEQ ID NO: 350497 - DNA, 25 bp, Homo sapien
aaccaagagaatgggccgggtgcac

SEQ ID NO: 350498 - DNA, 25 bp, Homo sapien
accaagagaatgggccgggtgcact

SEQ ID NO: 350499 - DNA, 25 bp, Homo sapien
ccaagagaatgggccgggtgcactg

SEQ ID NO: 350500 - DNA, 25 bp, Homo sapien
caagagaatgggccgggtgcactgg

SEQ ID NO: 350501 - DNA, 25 bp, Homo sapien
aagagaatgggccgggtgcactggc

SEQ ID NO: 350502 - DNA, 25 bp, Homo sapien
agagaatgggccgggtgcactggct

SEQ ID NO: 350503 - DNA, 25 bp, Homo sapien
agaatgggccgggtgcactggctca

SEQ ID NO: 350504 - DNA, 25 bp, Homo sapien
ggaggccgaagacagcggatcatct

SEQ ID NO: 350505 - DNA, 25 bp, Homo sapien
gccgaagacagcggatcatctgagg

SEQ ID NO: 350506 - DNA, 25 bp, Homo sapien
aaataggaacaattagccaggcatg

SEQ ID NO: 350507 - DNA, 25 bp, Homo sapien
agtggtgttgtatttccctctgagt

SEQ ID NO: 350508 - DNA, 25 bp, Homo sapien
tatttccctctgagtcaggacccaa

SEQ ID NO: 350509 - DNA, 25 bp, Homo sapien
ctctgggtggttctggcagtcacct

SEQ ID NO: 350510 - DNA, 25 bp, Homo sapien
aagccccttaattaggtgactgtga

SEQ ID NO: 350511 - DNA, 25 bp, Homo sapien
agagctgccatcatgttcttctcgc

SEQ ID NO: 350512 - DNA, 25 bp, Homo sapien
gttcttctcgcaagagagctgtgct

SEQ ID NO: 350513 - DNA, 25 bp, Homo sapien
atgaagtatttcagtgacgggtgaa

SEQ ID NO: 350514 - DNA, 25 bp, Homo sapien
acgggtgaagtcagttttcttctgc

SEQ ID NO: 350515 - DNA, 25 bp, Homo sapien
tttccccgtgggagagcatcttaac

SEQ ID NO: 350516 - DNA, 25 bp, Homo sapien
cccgtgggagagcatcttaaccttg

SEQ ID NO: 350517 - DNA, 25 bp, Homo sapien
agtcacctgttctcatatgtctact

SEQ ID NO: 350518 - DNA, 25 bp, Homo sapien
atttcctcataagccatcagcccca

SEQ ID NO: 350519 - DNA, 25 bp, Homo sapien
tttcctcataagccatcagccccag

SEQ ID NO: 350520 - DNA, 25 bp, Homo sapien
tcagccccaggtgctaatgagagaa

SEQ ID NO: 350521 - DNA, 25 bp, Homo sapien
ttacctactaaaagactataacaat

SEQ ID NO: 350522 - DNA, 25 bp, Homo sapien
tacctactaaaagactataacaatt

SEQ ID NO: 350523 - DNA, 25 bp, Homo sapien
ctaaaagactataacaatttcctca

SEQ ID NO: 350524 - DNA, 25 bp, Homo sapien
taaaagactataacaatttcctcat

SEQ ID NO: 350525 - DNA, 25 bp, Homo sapien
aacaatttcctcataagccatcagc

SEQ ID NO: 350526 - DNA, 25 bp, Homo sapien
acaatttcctcataagccatcagcc

SEQ ID NO: 350527 - DNA, 25 bp, Homo sapien
caatttcctcataagccatcagccc

SEQ ID NO: 350528 - DNA, 25 bp, Homo sapien
aatttcctcataagccatcagcccc

SEQ ID NO: 350529 - DNA, 25 bp, Homo sapien
ccctccttgagcttatattctattt

SEQ ID NO: 350530 - DNA, 25 bp, Homo sapien
tgatgtgtcatagttacttctgtta

SEQ ID NO: 350531 - DNA, 25 bp, Homo sapien
tgctgagatactctgtgacaaaaca

SEQ ID NO: 350532 - DNA, 25 bp, Homo sapien
cagatcccatcgacatcatttttac

SEQ ID NO: 350533 - DNA, 25 bp, Homo sapien
ataagaccagatgtcctttagcctt

SEQ ID NO: 350534 - DNA, 25 bp, Homo sapien
agccttgtcaacaggcttgggccat

SEQ ID NO: 350535 - DNA, 25 bp, Homo sapien
gcttgggccatggtgaacaatgtct

SEQ ID NO: 350536 - DNA, 25 bp, Homo sapien
tggtgaacaatgtctgcctctgaag

SEQ ID NO: 350537 - DNA, 25 bp, Homo sapien
acccctcccatcaattcatgtgttg

SEQ ID NO: 350538 - DNA, 25 bp, Homo sapien
atgagcgtccttgtgaacgtggcac

SEQ ID NO: 350539 - DNA, 25 bp, Homo sapien
aacgtggcacagttccgagtgcagt

SEQ ID NO: 350540 - DNA, 25 bp, Homo sapien
gaatatgttaatgttgcctaagtga

SEQ ID NO: 350541 - DNA, 25 bp, Homo sapien
gttgcctaagtgatacatctcttca

SEQ ID NO: 350542 - DNA, 25 bp, Homo sapien
tctcttcatctgtatgcatgtgatt

SEQ ID NO: 350543 - DNA, 25 bp, Homo sapien
ttaatataacctgaccaccttacgc

SEQ ID NO: 350544 - DNA, 25 bp, Homo sapien
gggctgaaaccattgcaacaatgat

SEQ ID NO: 350545 - DNA, 25 bp, Homo sapien
atttctgaataatatatgccccact

SEQ ID NO: 350546 - DNA, 25 bp, Homo sapien
tatatgccccactagaaatcgtttc

SEQ ID NO: 350547 - DNA, 25 bp, Homo sapien
tcccacgattaatcatttcagatat

SEQ ID NO: 350548 - DNA, 25 bp, Homo sapien
ttattttatagcttccctgtctaat

SEQ ID NO: 350549 - DNA, 25 bp, Homo sapien
cctgtctaattctcaaagtttttat

SEQ ID NO: 350550 - DNA, 25 bp, Homo sapien
atgtatataaagttgcctactatgc

SEQ ID NO: 350551 - DNA, 25 bp, Homo sapien
gagggtggtttacatatttgttata

SEQ ID NO: 350552 - DNA, 25 bp, Homo sapien
acatatttgttatatctacctttta

SEQ ID NO: 350553 - DNA, 25 bp, Homo sapien
aaaagtcaagaattcaaccagcaat

SEQ ID NO: 350554 - DNA, 25 bp, Homo sapien
gtcaagaattcaaccagcaattaaa

SEQ ID NO: 350555 - DNA, 25 bp, Homo sapien
aataattcctgtggtaaagcacttt

SEQ ID NO: 350556 - DNA, 25 bp, Homo sapien
cccttctatattgattttctttatg

SEQ ID NO: 350557 - DNA, 25 bp, Homo sapien
attgattttctttatgacctgtttt

SEQ ID NO: 350558 - DNA, 25 bp, Homo sapien
acatttctgttttccagaacccaat

SEQ ID NO: 350559 - DNA, 25 bp, Homo sapien
tgttttccagaacccaatgtataaa

SEQ ID NO: 350560 - DNA, 25 bp, Homo sapien
acattgattgaaaagcctgttgctg

SEQ ID NO: 350561 - DNA, 25 bp, Homo sapien
gtttggctttgagggtggtttacat

SEQ ID NO: 350562 - DNA, 25 bp, Homo sapien
ggctctatccgcgaggtgccagtag

SEQ ID NO: 350563 - DNA, 25 bp, Homo sapien
tctatccgcgaggtgccagtagcgt

SEQ ID NO: 350564 - DNA, 25 bp, Homo sapien
tatccgcgaggtgccagtagcgtgt

SEQ ID NO: 350565 - DNA, 25 bp, Homo sapien
gtgccagtagcgtgtgcaggtacat

SEQ ID NO: 350566 - DNA, 25 bp, Homo sapien
gccagtagcgtgtgcaggtacatac

SEQ ID NO: 350567 - DNA, 25 bp, Homo sapien
cagtagcgtgtgcaggtacatacac

SEQ ID NO: 350568 - DNA, 25 bp, Homo sapien
tgtgcaggtacatacacgtgcgtgc

SEQ ID NO: 350569 - DNA, 25 bp, Homo sapien
gcaggtacatacacgtgcgtgcaca

SEQ ID NO: 350570 - DNA, 25 bp, Homo sapien
atacacgtgcgtgcacactgtgatg

SEQ ID NO: 350571 - DNA, 25 bp, Homo sapien
gttgatcaagttccaaggaaaagga

SEQ ID NO: 350572 - DNA, 25 bp, Homo sapien
gaaaaggaacatctcagccgggcgt

SEQ ID NO: 350573 - DNA, 25 bp, Homo sapien
tgaaggccaactcccctgttcatgt

SEQ ID NO: 350574 - DNA, 25 bp, Homo sapien
ctctcagggatcacactcgtgttca

SEQ ID NO: 350575 - DNA, 25 bp, Homo sapien
agggatcacactcgtgttcacgctg

SEQ ID NO: 350576 - DNA, 25 bp, Homo sapien
ggatcacactcgtgttcacgctggg

SEQ ID NO: 350577 - DNA, 25 bp, Homo sapien
ggttcagggcctgaaactgttcttc

SEQ ID NO: 350578 - DNA, 25 bp, Homo sapien
gaaactgttcttcatgtattttgtc

SEQ ID NO: 350579 - DNA, 25 bp, Homo sapien
attgagtcatctgggagagtaaatc

SEQ ID NO: 350580 - DNA, 25 bp, Homo sapien
agagtaaatctagtccatcatggcc

SEQ ID NO: 350581 - DNA, 25 bp, Homo sapien
aaatctagtccatcatggccagaag

SEQ ID NO: 350582 - DNA, 25 bp, Homo sapien
gtccatcatggccagaagcaaaagt

SEQ ID NO: 350583 - DNA, 25 bp, Homo sapien
agaagcaaaagtccaagcaaatttt

SEQ ID NO: 350584 - DNA, 25 bp, Homo sapien
aagactgcgttacccttcaatcgtt

SEQ ID NO: 350585 - DNA, 25 bp, Homo sapien
gactgcgttacccttcaatcgtttt

SEQ ID NO: 350586 - DNA, 25 bp, Homo sapien
tttacccaacaaaagtagacagcca

SEQ ID NO: 350587 - DNA, 25 bp, Homo sapien
aaagtagacagccatcctatgtacc

SEQ ID NO: 350588 - DNA, 25 bp, Homo sapien
agtagacagccatcctatgtaccag

SEQ ID NO: 350589 - DNA, 25 bp, Homo sapien
tagacagccatcctatgtaccagca

SEQ ID NO: 350590 - DNA, 25 bp, Homo sapien
agacagccatcctatgtaccagcac

SEQ ID NO: 350591 - DNA, 25 bp, Homo sapien
atcctatgtaccagcacctctgaga

SEQ ID NO: 350592 - DNA, 25 bp, Homo sapien
cagacaaacatgaggataacagaag

SEQ ID NO: 350593 - DNA, 25 bp, Homo sapien
aagcccggtttatacagaagcagat

SEQ ID NO: 350594 - DNA, 25 bp, Homo sapien
gcccggtttatacagaagcagatgg

SEQ ID NO: 350595 - DNA, 25 bp, Homo sapien
tcctccctctggtttgtgacttcat

SEQ ID NO: 350596 - DNA, 25 bp, Homo sapien
ttgtgacttcatcaaagggcaaggc

SEQ ID NO: 350597 - DNA, 25 bp, Homo sapien
gacttcatcaaagggcaaggcagaa

SEQ ID NO: 350598 - DNA, 25 bp, Homo sapien
gcaaggcagaacacagaggccgcag

SEQ ID NO: 350599 - DNA, 25 bp, Homo sapien
gcagaacacagaggccgcagggcag

SEQ ID NO: 350600 - DNA, 25 bp, Homo sapien
gacccttcggtcctctgtccgggag

SEQ ID NO: 350601 - DNA, 25 bp, Homo sapien
tttccctcagacatcgacgccttgg

SEQ ID NO: 350602 - DNA, 25 bp, Homo sapien
ctcagacatcgacgccttgggcttg

SEQ ID NO: 350603 - DNA, 25 bp, Homo sapien
acgccttgggcttggggtcagaaca

SEQ ID NO: 350604 - DNA, 25 bp, Homo sapien
agaacacgtggcagaggcctggacc

SEQ ID NO: 350605 - DNA, 25 bp, Homo sapien
aacacgtggcagaggcctggaccac

SEQ ID NO: 350606 - DNA, 25 bp, Homo sapien
gtatattaaacctgaagagcccgaa

SEQ ID NO: 350607 - DNA, 25 bp, Homo sapien
ccgaacctgaaccacagcctgaaga

SEQ ID NO: 350608 - DNA, 25 bp, Homo sapien
ccacagcctgaagaaataccagtaa

SEQ ID NO: 350609 - DNA, 25 bp, Homo sapien
acctgaacctgaaaaggttattgag

SEQ ID NO: 350610 - DNA, 25 bp, Homo sapien
tccacctgctccacctaaggaagat

SEQ ID NO: 350611 - DNA, 25 bp, Homo sapien
ctgctccacctaaggaagatgtgaa

SEQ ID NO: 350612 - DNA, 25 bp, Homo sapien
gagaaaatattccaacttaaagcta

SEQ ID NO: 350613 - DNA, 25 bp, Homo sapien
atattccaacttaaagctattccaa

SEQ ID NO: 350614 - DNA, 25 bp, Homo sapien
gaaaaagcatctataaccattggta

SEQ ID NO: 350615 - DNA, 25 bp, Homo sapien
aaagcatctataaccattggtagaa

SEQ ID NO: 350616 - DNA, 25 bp, Homo sapien
cattggtagaaaagagactccccct

SEQ ID NO: 350617 - DNA, 25 bp, Homo sapien
attgccttctaccacctgggcgact

SEQ ID NO: 350618 - DNA, 25 bp, Homo sapien
ttgccttctaccacctgggcgacta

SEQ ID NO: 350619 - DNA, 25 bp, Homo sapien
tgccttctaccacctgggcgactac

SEQ ID NO: 350620 - DNA, 25 bp, Homo sapien
gccttctaccacctgggcgactacg

SEQ ID NO: 350621 - DNA, 25 bp, Homo sapien
ccttctaccacctgggcgactacgc

SEQ ID NO: 350622 - DNA, 25 bp, Homo sapien
cttctaccacctgggcgactacgca

SEQ ID NO: 350623 - DNA, 25 bp, Homo sapien
ttctaccacctgggcgactacgcac

SEQ ID NO: 350624 - DNA, 25 bp, Homo sapien
tctaccacctgggcgactacgcacg

SEQ ID NO: 350625 - DNA, 25 bp, Homo sapien
acctgggcgactacgcacgcgcgct

SEQ ID NO: 350626 - DNA, 25 bp, Homo sapien
gcgactacgcacgcgcgctgcgcta

SEQ ID NO: 350627 - DNA, 25 bp, Homo sapien
cgactacgcacgcgcgctgcgctac

SEQ ID NO: 350628 - DNA, 25 bp, Homo sapien
ctgtgtgagcgagctgctggatact

SEQ ID NO: 350629 - DNA, 25 bp, Homo sapien
gtgtgagcgagctgctggatacttc

SEQ ID NO: 350630 - DNA, 25 bp, Homo sapien
tgagcgagctgctggatacttcgga

SEQ ID NO: 350631 - DNA, 25 bp, Homo sapien
cgagctgctggatacttcggagaat

SEQ ID NO: 350632 - DNA, 25 bp, Homo sapien
gagctgctggatacttcggagaatg

SEQ ID NO: 350633 - DNA, 25 bp, Homo sapien
gaggtgtggaagtcacctgctgccc

SEQ ID NO: 350634 - DNA, 25 bp, Homo sapien
ggtgtggaagtcacctgctgccccg

SEQ ID NO: 350635 - DNA, 25 bp, Homo sapien
tgctgccccgggacacccagatgat

SEQ ID NO: 350636 - DNA, 25 bp, Homo sapien
gctgccccgggacacccagatgatg

SEQ ID NO: 350637 - DNA, 25 bp, Homo sapien
aatgtgctccgctacatccagctga

SEQ ID NO: 350638 - DNA, 25 bp, Homo sapien
gaagatgaatcgttgcagcctccag

SEQ ID NO: 350639 - DNA, 25 bp, Homo sapien
tcttcatgttgactttctctaccag

SEQ ID NO: 350640 - DNA, 25 bp, Homo sapien
ggagagtccggtggagtccttcata

SEQ ID NO: 350641 - DNA, 25 bp, Homo sapien
gtccttcatagcctttctacttatt

SEQ ID NO: 350642 - DNA, 25 bp, Homo sapien
gagttggcttgtggattatactttc

SEQ ID NO: 350643 - DNA, 25 bp, Homo sapien
attatactttcccagcatgagcttc

SEQ ID NO: 350644 - DNA, 25 bp, Homo sapien
ccagcatgagcttcctacggagaaa

SEQ ID NO: 350645 - DNA, 25 bp, Homo sapien
aaaggtgatccctgagacagagcag

SEQ ID NO: 350646 - DNA, 25 bp, Homo sapien
gacagagcaggctggtgtactcaac

SEQ ID NO: 350647 - DNA, 25 bp, Homo sapien
tggtgtactcaactggttccgggta

SEQ ID NO: 350648 - DNA, 25 bp, Homo sapien
aactggttccgggtacctctgcact

SEQ ID NO: 350649 - DNA, 25 bp, Homo sapien
tgcactcactggcttgcctagggct

SEQ ID NO: 350650 - DNA, 25 bp, Homo sapien
tgcacccagcctgagtatggtctat

SEQ ID NO: 350651 - DNA, 25 bp, Homo sapien
cacccagcctgagtatggtctatat

SEQ ID NO: 350652 - DNA, 25 bp, Homo sapien
cagcctgagtatggtctatatttct

SEQ ID NO: 350653 - DNA, 25 bp, Homo sapien
gcctgagtatggtctatatttctgt

SEQ ID NO: 350654 - DNA, 25 bp, Homo sapien
gtatggtctatatttctgttggtta

SEQ ID NO: 350655 - DNA, 25 bp, Homo sapien
ggtctatatttctgttggttaagat

SEQ ID NO: 350656 - DNA, 25 bp, Homo sapien
attcagtgatgttaaaacttattac

SEQ ID NO: 350657 - DNA, 25 bp, Homo sapien
ccagcctttctcgtagctaaaactg

SEQ ID NO: 350658 - DNA, 25 bp, Homo sapien
gcctttctcgtagctaaaactgcag

SEQ ID NO: 350659 - DNA, 25 bp, Homo sapien
tttctcgtagctaaaactgcaggca

SEQ ID NO: 350660 - DNA, 25 bp, Homo sapien
cgtagctaaaactgcaggcacgtgc

SEQ ID NO: 350661 - DNA, 25 bp, Homo sapien
agagaccattcagcaagacacattg

SEQ ID NO: 350662 - DNA, 25 bp, Homo sapien
agacacattgaagtggcacggagct

SEQ ID NO: 350663 - DNA, 25 bp, Homo sapien
aagtggcacggagctgcttttgttt

SEQ ID NO: 350664 - DNA, 25 bp, Homo sapien
cggaaagcacttaaatagatgacta

SEQ ID NO: 350665 - DNA, 25 bp, Homo sapien
gactatgtgtaaaagctctgtgcaa

SEQ ID NO: 350666 - DNA, 25 bp, Homo sapien
gtaaaagctctgtgcaattgaaatc

SEQ ID NO: 350667 - DNA, 25 bp, Homo sapien
gtgcaattgaaatcatttttcttca

SEQ ID NO: 350668 - DNA, 25 bp, Homo sapien
aaataacgtattgcacaccaaatga

SEQ ID NO: 350669 - DNA, 25 bp, Homo sapien
aagtaagctttagaccaggacgatt

SEQ ID NO: 350670 - DNA, 25 bp, Homo sapien
agaccaggacgattcaggttatgaa

SEQ ID NO: 350671 - DNA, 25 bp, Homo sapien
caggttatgaatgagtttgttcact

SEQ ID NO: 350672 - DNA, 25 bp, Homo sapien
agaactgaggtttggtagagcacca

SEQ ID NO: 350673 - DNA, 25 bp, Homo sapien
ggtagagcaccaagtttcattgttt

SEQ ID NO: 350674 - DNA, 25 bp, Homo sapien
ttcattgtttttgtcaggccagatt

SEQ ID NO: 350675 - DNA, 25 bp, Homo sapien
gtcaggccagattttggatgtgaaa

SEQ ID NO: 350676 - DNA, 25 bp, Homo sapien
aggatagtgacagttcagagtagct

SEQ ID NO: 350677 - DNA, 25 bp, Homo sapien
gctggagttgcttacactatataac

SEQ ID NO: 350678 - DNA, 25 bp, Homo sapien
agagttgtttatctaccactttagc

SEQ ID NO: 350679 - DNA, 25 bp, Homo sapien
accactttagcattttggtgataca

SEQ ID NO: 350680 - DNA, 25 bp, Homo sapien
aaaatccttagctcctatgtatttc

SEQ ID NO: 350681 - DNA, 25 bp, Homo sapien
tccacaccctttacagtaacaatgg

SEQ ID NO: 350682 - DNA, 25 bp, Homo sapien
gtaacaatggcagcttagtcaaaca

SEQ ID NO: 350683 - DNA, 25 bp, Homo sapien
aaaattgcaagaaaaatctcatgtt

SEQ ID NO: 350684 - DNA, 25 bp, Homo sapien
tgagaataagttcatgtaattgtct

SEQ ID NO: 350685 - DNA, 25 bp, Homo sapien
gagaataagttcatgtaattgtctt

SEQ ID NO: 350686 - DNA, 25 bp, Homo sapien
gaataagttcatgtaattgtcttaa

SEQ ID NO: 350687 - DNA, 25 bp, Homo sapien
aataagttcatgtaattgtcttaag

SEQ ID NO: 350688 - DNA, 25 bp, Homo sapien
aagttcatgtaattgtcttaagttt

SEQ ID NO: 350689 - DNA, 25 bp, Homo sapien
agttcatgtaattgtcttaagtttt

SEQ ID NO: 350690 - DNA, 25 bp, Homo sapien
tttttatgcctttatatacttagct

SEQ ID NO: 350691 - DNA, 25 bp, Homo sapien
aatatgtagatcaaggatgtccaat

SEQ ID NO: 350692 - DNA, 25 bp, Homo sapien
ttcttttgacataaccatctttttg

SEQ ID NO: 350693 - DNA, 25 bp, Homo sapien
aagcaatattatactgacagaggtt

SEQ ID NO: 350694 - DNA, 25 bp, Homo sapien
gcatgctagcatattgttgtctttg

SEQ ID NO: 350695 - DNA, 25 bp, Homo sapien
tgttgtctttgagagcaccgtatca

SEQ ID NO: 350696 - DNA, 25 bp, Homo sapien
gagagcaccgtatcaactttttgat

SEQ ID NO: 350697 - DNA, 25 bp, Homo sapien
agaagccacattcgatactctgcga

SEQ ID NO: 350698 - DNA, 25 bp, Homo sapien
gatactctgcgactctggttaataa

SEQ ID NO: 350699 - DNA, 25 bp, Homo sapien
tggttaataatcctgctgtgtgctt

SEQ ID NO: 350700 - DNA, 25 bp, Homo sapien
tgctttgcggttggccatgatgcgt

SEQ ID NO: 350701 - DNA, 25 bp, Homo sapien
gttggccatgatgcgtagtcacctg

SEQ ID NO: 350702 - DNA, 25 bp, Homo sapien
gcgtagtcacctgcaagcttattta

SEQ ID NO: 350703 - DNA, 25 bp, Homo sapien
gggcgaataagcacggttgagctac

SEQ ID NO: 350704 - DNA, 25 bp, Homo sapien
gcacggttgagctacagaaaatggt

SEQ ID NO: 350705 - DNA, 25 bp, Homo sapien
aaaccattgggtaacttgagtcata

SEQ ID NO: 350706 - DNA, 25 bp, Homo sapien
gggtaacttgagtcatattttcaga

SEQ ID NO: 350707 - DNA, 25 bp, Homo sapien
gacaaatgatgaagcatgcactaag

SEQ ID NO: 350708 - DNA, 25 bp, Homo sapien
tgactccggctaaacaccagaatga

SEQ ID NO: 350709 - DNA, 25 bp, Homo sapien
ggctaaacaccagaatgacagagaa

SEQ ID NO: 350710 - DNA, 25 bp, Homo sapien
gaagtggcagaaaccatatgtttgt

SEQ ID NO: 350711 - DNA, 25 bp, Homo sapien
atgtttgtactcacatctggccaca

SEQ ID NO: 350712 - DNA, 25 bp, Homo sapien
tggccacaaaaccagaaatactgta

SEQ ID NO: 350713 - DNA, 25 bp, Homo sapien
gtacattatgtaaagaggtctggtg

SEQ ID NO: 350714 - DNA, 25 bp, Homo sapien
tctggtgtggtgtgacatcctgtat

SEQ ID NO: 350715 - DNA, 25 bp, Homo sapien
gacatcctgtataagaatatcatca

SEQ ID NO: 350716 - DNA, 25 bp, Homo sapien
ataattatggttctgttagtcctga

SEQ ID NO: 350717 - DNA, 25 bp, Homo sapien
aattatggttctgttagtcctgata

SEQ ID NO: 350718 - DNA, 25 bp, Homo sapien
atggttctgttagtcctgataatct

SEQ ID NO: 350719 - DNA, 25 bp, Homo sapien
gttctgttagtcctgataatctcat

SEQ ID NO: 350720 - DNA, 25 bp, Homo sapien
gttagtcctgataatctcatgtttt

SEQ ID NO: 350721 - DNA, 25 bp, Homo sapien
agtcctgataatctcatgttttatc

SEQ ID NO: 350722 - DNA, 25 bp, Homo sapien
gttttatctacacatttacacctac

SEQ ID NO: 350723 - DNA, 25 bp, Homo sapien
tatctacacatttacacctacttct

SEQ ID NO: 350724 - DNA, 25 bp, Homo sapien
atctacacatttacacctacttcta

SEQ ID NO: 350725 - DNA, 25 bp, Homo sapien
atttacacctacttctaaaagcagt

SEQ ID NO: 350726 - DNA, 25 bp, Homo sapien
cttctaaaagcagtggatatatttc

SEQ ID NO: 350727 - DNA, 25 bp, Homo sapien
tgagcaaaaatgaaggagcctggac

SEQ ID NO: 350728 - DNA, 25 bp, Homo sapien
aaatgaaggagcctggacccaactt

SEQ ID NO: 350729 - DNA, 25 bp, Homo sapien
aatgaaggagcctggacccaacttt

SEQ ID NO: 350730 - DNA, 25 bp, Homo sapien
atgaaggagcctggacccaactttg

SEQ ID NO: 350731 - DNA, 25 bp, Homo sapien
gaaggagcctggacccaactttgtt

SEQ ID NO: 350732 - DNA, 25 bp, Homo sapien
ggagcctggacccaactttgttact

SEQ ID NO: 350733 - DNA, 25 bp, Homo sapien
gagcctggacccaactttgttactg

SEQ ID NO: 350734 - DNA, 25 bp, Homo sapien
tttgttactgtgagaaagggtcttc

SEQ ID NO: 350735 - DNA, 25 bp, Homo sapien
gttactgtgagaaagggtcttcatt

SEQ ID NO: 350736 - DNA, 25 bp, Homo sapien
tactgtgagaaagggtcttcattca

SEQ ID NO: 350737 - DNA, 25 bp, Homo sapien
tgtgagaaagggtcttcattcattc

SEQ ID NO: 350738 - DNA, 25 bp, Homo sapien
gcatcttccgggagtacctgagcga

SEQ ID NO: 350739 - DNA, 25 bp, Homo sapien
tcttccgggagtacctgagcgagaa

SEQ ID NO: 350740 - DNA, 25 bp, Homo sapien
acctgagcgagaaggcgcagagccc

SEQ ID NO: 350741 - DNA, 25 bp, Homo sapien
agagcccggacttcgagaccatgga

SEQ ID NO: 350742 - DNA, 25 bp, Homo sapien
ccggacttcgagaccatggacaagg

SEQ ID NO: 350743 - DNA, 25 bp, Homo sapien
gtgctgcgctccttctatgccgagg

SEQ ID NO: 350744 - DNA, 25 bp, Homo sapien
tatgccgaggcccgctccaaaagcg

SEQ ID NO: 350745 - DNA, 25 bp, Homo sapien
aaaagcggccagctctacagcaagt

SEQ ID NO: 350746 - DNA, 25 bp, Homo sapien
agctctacagcaagtcgtcgctcat

SEQ ID NO: 350747 - DNA, 25 bp, Homo sapien
acagcaagtcgtcgctcatcagcat

SEQ ID NO: 350748 - DNA, 25 bp, Homo sapien
agtcgtcgctcatcagcatccgcag

SEQ ID NO: 350749 - DNA, 25 bp, Homo sapien
gttatctgcctaaaaaatctagtgc

SEQ ID NO: 350750 - DNA, 25 bp, Homo sapien
gtccactaaaggcaaggtgccccta

SEQ ID NO: 350751 - DNA, 25 bp, Homo sapien
aatatactctgttgtctcttgtctt

SEQ ID NO: 350752 - DNA, 25 bp, Homo sapien
tgttgtctcttgtcttttattcccg

SEQ ID NO: 350753 - DNA, 25 bp, Homo sapien
ttgtcttttattcccgtgttgcccg

SEQ ID NO: 350754 - DNA, 25 bp, Homo sapien
tttgttcagtccagtaggtccccaa

SEQ ID NO: 350755 - DNA, 25 bp, Homo sapien
gtccccaacaatgtcctgagggtat

SEQ ID NO: 350756 - DNA, 25 bp, Homo sapien
aaatctagtgcctattgtccaaaaa

SEQ ID NO: 350757 - DNA, 25 bp, Homo sapien
atgtcctgagggtatgaatcctgaa

SEQ ID NO: 350758 - DNA, 25 bp, Homo sapien
aagattactgtgaaccaaacggcag

SEQ ID NO: 350759 - DNA, 25 bp, Homo sapien
gaaccaaacggcagactgacaatca

SEQ ID NO: 350760 - DNA, 25 bp, Homo sapien
atgggtcagaaacctccagggacat

SEQ ID NO: 350761 - DNA, 25 bp, Homo sapien
agggacatccctcagctggtaactc

SEQ ID NO: 350762 - DNA, 25 bp, Homo sapien
gtaactctgctgttgtccggagggt

SEQ ID NO: 350763 - DNA, 25 bp, Homo sapien
agggttcaggcttggtgtgccttct

SEQ ID NO: 350764 - DNA, 25 bp, Homo sapien
gtgtgccttcttctgtttgtctgac

SEQ ID NO: 350765 - DNA, 25 bp, Homo sapien
tggctcctatggttcatctcctgcc

SEQ ID NO: 350766 - DNA, 25 bp, Homo sapien
acagcttctccaatgtaccagtcat

SEQ ID NO: 350767 - DNA, 25 bp, Homo sapien
atgtaccagtcattgaggccagcgc

SEQ ID NO: 350768 - DNA, 25 bp, Homo sapien
gccagcgcgcagcacttttaatgtt

SEQ ID NO: 350769 - DNA, 25 bp, Homo sapien
gctagtaactgtgttttaactctcc

SEQ ID NO: 350770 - DNA, 25 bp, Homo sapien
tgtgttttaactctccaggaataag

SEQ ID NO: 350771 - DNA, 25 bp, Homo sapien
attacagactgcgaacaacggcttt

SEQ ID NO: 350772 - DNA, 25 bp, Homo sapien
gactgcgaacaacggctttcagaat

SEQ ID NO: 350773 - DNA, 25 bp, Homo sapien
gctttcagaatgagggacttccatc

SEQ ID NO: 350774 - DNA, 25 bp, Homo sapien
agggacttccatcagactctaatga

SEQ ID NO: 350775 - DNA, 25 bp, Homo sapien
gtagcacaaattgaaaacttcccca

SEQ ID NO: 350776 - DNA, 25 bp, Homo sapien
aacttccccaaagctttcacagaat

SEQ ID NO: 350777 - DNA, 25 bp, Homo sapien
ttcagggaaccaagcaactctattt

SEQ ID NO: 350778 - DNA, 25 bp, Homo sapien
gtactgacatgcattattttcactg

SEQ ID NO: 350779 - DNA, 25 bp, Homo sapien
ctgtgaattcacttttttattgcat

SEQ ID NO: 350780 - DNA, 25 bp, Homo sapien
tgcatgttcagatgtccctctttgt

SEQ ID NO: 350781 - DNA, 25 bp, Homo sapien
gcaatgatgttcttcctggaattca

SEQ ID NO: 350782 - DNA, 25 bp, Homo sapien
cattttgccccatccacaaaatgaa

SEQ ID NO: 350783 - DNA, 25 bp, Homo sapien
gcaatgaatttaacctgccaggaga

SEQ ID NO: 350784 - DNA, 25 bp, Homo sapien
gccaggagagggagtttaacaccaa

SEQ ID NO: 350785 - DNA, 25 bp, Homo sapien
gagtttaacaccaagcttccagaaa

SEQ ID NO: 350786 - DNA, 25 bp, Homo sapien
agcttccagaaacaggctgcgtggt

SEQ ID NO: 350787 - DNA, 25 bp, Homo sapien
aaacaggctgcgtggtagctacaac

SEQ ID NO: 350788 - DNA, 25 bp, Homo sapien
gtagctacaacgtccagaaacccag

SEQ ID NO: 350789 - DNA, 25 bp, Homo sapien
gtccagaaacccaggtttcaacgcg

SEQ ID NO: 350790 - DNA, 25 bp, Homo sapien
ggccctgcttcaagacccaaaggaa

SEQ ID NO: 350791 - DNA, 25 bp, Homo sapien
acatagagcggcatcacgttgcccc

SEQ ID NO: 350792 - DNA, 25 bp, Homo sapien
cgttgccccaagaaaatcacatctc

SEQ ID NO: 350793 - DNA, 25 bp, Homo sapien
ccccaaacacttgaatcttggtcgt

SEQ ID NO: 350794 - DNA, 25 bp, Homo sapien
gaatcttggtcgttggtatgtaatc

SEQ ID NO: 350795 - DNA, 25 bp, Homo sapien
ggtatgtaatccactctctagagtc

SEQ ID NO: 350796 - DNA, 25 bp, Homo sapien
atccactctctagagtccagtgtac

SEQ ID NO: 350797 - DNA, 25 bp, Homo sapien
gagtccagtgtactttagacttcat

SEQ ID NO: 350798 - DNA, 25 bp, Homo sapien
ctttagacttcatctgagtccaata

SEQ ID NO: 350799 - DNA, 25 bp, Homo sapien
tcagatgggtgatttaagtgagtca

SEQ ID NO: 350800 - DNA, 25 bp, Homo sapien
gagtcacaagtcacaaaactttgct

SEQ ID NO: 350801 - DNA, 25 bp, Homo sapien
aactttgctattcatagttaatcaa

SEQ ID NO: 350802 - DNA, 25 bp, Homo sapien
gaagttctgttctataactgctctg

SEQ ID NO: 350803 - DNA, 25 bp, Homo sapien
tgttctataactgctctgttaacat

SEQ ID NO: 350804 - DNA, 25 bp, Homo sapien
aaaagggacacagatcatccacacc

SEQ ID NO: 350805 - DNA, 25 bp, Homo sapien
caccgtggccgaatgtgtgacatct

SEQ ID NO: 350806 - DNA, 25 bp, Homo sapien
taatccaaaagctgtctaaaccact

SEQ ID NO: 350807 - DNA, 25 bp, Homo sapien
taggcgtgtgaaccctgccacaaac

SEQ ID NO: 350808 - DNA, 25 bp, Homo sapien
cacaaacatcggtgctcttcctgca

SEQ ID NO: 350809 - DNA, 25 bp, Homo sapien
ctgggaccaaccgtggccaggacat

SEQ ID NO: 350810 - DNA, 25 bp, Homo sapien
gtctaaaccactaaggccacatgtt

SEQ ID NO: 350811 - DNA, 25 bp, Homo sapien
acatcagctgctggaagccgagaga

SEQ ID NO: 350812 - DNA, 25 bp, Homo sapien
ccacatgttggacggaggcactttc

SEQ ID NO: 350813 - DNA, 25 bp, Homo sapien
gcactttcctgctggaatccgataa

SEQ ID NO: 350814 - DNA, 25 bp, Homo sapien
atccgataaatcaccacacccaaat

SEQ ID NO: 350815 - DNA, 25 bp, Homo sapien
ataactcccctgaaagtgaacacaa

SEQ ID NO: 350816 - DNA, 25 bp, Homo sapien
cacaaaattgcatgtaggtgcacaa

SEQ ID NO: 350817 - DNA, 25 bp, Homo sapien
aggtgcacaatgcattttttgggca

SEQ ID NO: 350818 - DNA, 25 bp, Homo sapien
ttttgggcagagagggctttttatt

SEQ ID NO: 350819 - DNA, 25 bp, Homo sapien
aaaagtccaagaaccctgcactagt

SEQ ID NO: 350820 - DNA, 25 bp, Homo sapien
aaagatttgttcacaccttcacagt

SEQ ID NO: 350821 - DNA, 25 bp, Homo sapien
tgcactagtctatgctgccctaggg

SEQ ID NO: 350822 - DNA, 25 bp, Homo sapien
ctgccctagggctatctggaataat

SEQ ID NO: 350823 - DNA, 25 bp, Homo sapien
tcacaccttcacagtaattggcatg

SEQ ID NO: 350824 - DNA, 25 bp, Homo sapien
tagacatttgatcagtagttggtat

SEQ ID NO: 350825 - DNA, 25 bp, Homo sapien
agagtcctcagatgtataactcccc

SEQ ID NO: 350826 - DNA, 25 bp, Homo sapien
cctgtattggatctcgcctgcagtt

SEQ ID NO: 350827 - DNA, 25 bp, Homo sapien
tgtattggatctcgcctgcagttgc

SEQ ID NO: 350828 - DNA, 25 bp, Homo sapien
attggatctcgcctgcagttgctgt

SEQ ID NO: 350829 - DNA, 25 bp, Homo sapien
tggatctcgcctgcagttgctgtat

SEQ ID NO: 350830 - DNA, 25 bp, Homo sapien
atctcgcctgcagttgctgtattga

SEQ ID NO: 350831 - DNA, 25 bp, Homo sapien
ctcgcctgcagttgctgtattgatt

SEQ ID NO: 350832 - DNA, 25 bp, Homo sapien
cgcctgcagttgctgtattgatttg

SEQ ID NO: 350833 - DNA, 25 bp, Homo sapien
gcagttgctgtattgatttgggccc

SEQ ID NO: 350834 - DNA, 25 bp, Homo sapien
ttgatttgggcccaggcagtgtttt

SEQ ID NO: 350835 - DNA, 25 bp, Homo sapien
gatctaaagggatattttgcaccaa

SEQ ID NO: 350836 - DNA, 25 bp, Homo sapien
tctaaagggatattttgcaccaaaa

SEQ ID NO: 350837 - DNA, 25 bp, Homo sapien
agggcttgccccttgaaataggccg

SEQ ID NO: 350838 - DNA, 25 bp, Homo sapien
cttgccccttgaaataggccgcctg

SEQ ID NO: 350839 - DNA, 25 bp, Homo sapien
tggggttgcaccttgaaacaggccg

SEQ ID NO: 350840 - DNA, 25 bp, Homo sapien
ggagcttgcaccttgtaataggccg

SEQ ID NO: 350841 - DNA, 25 bp, Homo sapien
agcttgcaccttgtaataggccgcc

SEQ ID NO: 350842 - DNA, 25 bp, Homo sapien
gcaccttgtaataggccgcccggga

SEQ ID NO: 350843 - DNA, 25 bp, Homo sapien
ttccaccttgaaataggccgcccag

SEQ ID NO: 350844 - DNA, 25 bp, Homo sapien
ccaccttgaaataggccgcccagga

SEQ ID NO: 350845 - DNA, 25 bp, Homo sapien
gcaccttgaaatagactgcccagga

SEQ ID NO: 350846 - DNA, 25 bp, Homo sapien
ctgggaggcagagctcgcaccttga

SEQ ID NO: 350847 - DNA, 25 bp, Homo sapien
ggcagagctcgcaccttgatatacg

SEQ ID NO: 350848 - DNA, 25 bp, Homo sapien
gaaagctcaggaggctctccacttg

SEQ ID NO: 350849 - DNA, 25 bp, Homo sapien
tctccacttggctggcatggataga

SEQ ID NO: 350850 - DNA, 25 bp, Homo sapien
ggctggcatggatagacgtgaattc

SEQ ID NO: 350851 - DNA, 25 bp, Homo sapien
agacgtgaattcagacagtcccaga

SEQ ID NO: 350852 - DNA, 25 bp, Homo sapien
tgaattcagacagtcccagagccca

SEQ ID NO: 350853 - DNA, 25 bp, Homo sapien
ttccgcctaggaaacccagaagaag

SEQ ID NO: 350854 - DNA, 25 bp, Homo sapien
gaaggtcaaagaatgcgactatcct

SEQ ID NO: 350855 - DNA, 25 bp, Homo sapien
acaggcccaggacttcagcattttg

SEQ ID NO: 350856 - DNA, 25 bp, Homo sapien
gaaaagatccagtttgctccacaag

SEQ ID NO: 350857 - DNA, 25 bp, Homo sapien
agagggaccacgcttgacaggttta

SEQ ID NO: 350858 - DNA, 25 bp, Homo sapien
accacgcttgacaggtttaccatcg

SEQ ID NO: 350859 - DNA, 25 bp, Homo sapien
agttacatttgcacagtgccaacac

SEQ ID NO: 350860 - DNA, 25 bp, Homo sapien
gtgccaacaccctattacttattta

SEQ ID NO: 350861 - DNA, 25 bp, Homo sapien
taacattctacaatacactgctccc

SEQ ID NO: 350862 - DNA, 25 bp, Homo sapien
actgctccctcacaatgatttctac

SEQ ID NO: 350863 - DNA, 25 bp, Homo sapien
gatttctactcaagaacctgcattt

SEQ ID NO: 350864 - DNA, 25 bp, Homo sapien
tctactatcccaaatttactctcag

SEQ ID NO: 350865 - DNA, 25 bp, Homo sapien
ttagaagtcaggagcaccagggtga

SEQ ID NO: 350866 - DNA, 25 bp, Homo sapien
aaggagcccggactgagtgcacact

SEQ ID NO: 350867 - DNA, 25 bp, Homo sapien
cacagggctttaggacacagagaga

SEQ ID NO: 350868 - DNA, 25 bp, Homo sapien
gagagtgtctcagaggatgctaact

SEQ ID NO: 350869 - DNA, 25 bp, Homo sapien
ggatgctaactcaacaaccaggctg

SEQ ID NO: 350870 - DNA, 25 bp, Homo sapien
caaccaactgtttccagacattgcc

SEQ ID NO: 350871 - DNA, 25 bp, Homo sapien
ggtgaacagaattgcctcccagctg

SEQ ID NO: 350872 - DNA, 25 bp, Homo sapien
gggctgctggactaatcaacaagaa

SEQ ID NO: 350873 - DNA, 25 bp, Homo sapien
ggagactgttctgtgcactgtagga

SEQ ID NO: 350874 - DNA, 25 bp, Homo sapien
gcaaggactgcaggcaaattgcctc

SEQ ID NO: 350875 - DNA, 25 bp, Homo sapien
gcaaattgcctcagcacttagattt

SEQ ID NO: 350876 - DNA, 25 bp, Homo sapien
cttagatttagcactgcaaggccac

SEQ ID NO: 350877 - DNA, 25 bp, Homo sapien
tgcaaggccacttcgacaggtggta

SEQ ID NO: 350878 - DNA, 25 bp, Homo sapien
gtagtgatttgtgcgtctcatttcc

SEQ ID NO: 350879 - DNA, 25 bp, Homo sapien
gcgtctcatttcctattcttgattg

SEQ ID NO: 350880 - DNA, 25 bp, Homo sapien
tttccccaagtggtgacaaccaact

SEQ ID NO: 350881 - DNA, 25 bp, Homo sapien
taaggatgaagtctctctatgttgc

SEQ ID NO: 350882 - DNA, 25 bp, Homo sapien
actgggccgccatgctgtatttagg

SEQ ID NO: 350883 - DNA, 25 bp, Homo sapien
ggccgccatgctgtatttaggatta

SEQ ID NO: 350884 - DNA, 25 bp, Homo sapien
gctgtatttaggattaggcatccag

SEQ ID NO: 350885 - DNA, 25 bp, Homo sapien
attaggcatccagagttctcagcat

SEQ ID NO: 350886 - DNA, 25 bp, Homo sapien
gagttctcagcataagagactagca

SEQ ID NO: 350887 - DNA, 25 bp, Homo sapien
cagcataagagactagcaggtgaat

SEQ ID NO: 350888 - DNA, 25 bp, Homo sapien
gcaggtgaatagctaacgtttactt

SEQ ID NO: 350889 - DNA, 25 bp, Homo sapien
tagctaacgtttacttggtgcctgc

SEQ ID NO: 350890 - DNA, 25 bp, Homo sapien
taacgtttacttggtgcctgctatg

SEQ ID NO: 350891 - DNA, 25 bp, Homo sapien
cgtttacttggtgcctgctatgtgc

SEQ ID NO: 350892 - DNA, 25 bp, Homo sapien
ttaataccgttggtttctctcctca

SEQ ID NO: 350893 - DNA, 25 bp, Homo sapien
cagaagcagcagttaccactagaac

SEQ ID NO: 350894 - DNA, 25 bp, Homo sapien
attatgacttctggcttgtcttaac

SEQ ID NO: 350895 - DNA, 25 bp, Homo sapien
ctggcttgtcttaacaatctagaaa

SEQ ID NO: 350896 - DNA, 25 bp, Homo sapien
gcttgtcttaacaatctagaaaggt

SEQ ID NO: 350897 - DNA, 25 bp, Homo sapien
tatttatgagggaatttccaggagc

SEQ ID NO: 350898 - DNA, 25 bp, Homo sapien
gaatttccaggagctataattttag

SEQ ID NO: 350899 - DNA, 25 bp, Homo sapien
ataattttagctagcagttcaaacc

SEQ ID NO: 350900 - DNA, 25 bp, Homo sapien
attttagctagcagttcaaaccaaa

SEQ ID NO: 350901 - DNA, 25 bp, Homo sapien
agctagcagttcaaaccaaatttat

SEQ ID NO: 350902 - DNA, 25 bp, Homo sapien
tatctacacatttacacctacttct

SEQ ID NO: 350903 - DNA, 25 bp, Homo sapien
ttattactttctaatgctgctaatt

SEQ ID NO: 350904 - DNA, 25 bp, Homo sapien
ttactttctaatgctgctaatttca

SEQ ID NO: 350905 - DNA, 25 bp, Homo sapien
gctgctaatttcagcattgtgagat

SEQ ID NO: 350906 - DNA, 25 bp, Homo sapien
gctaatttcagcattgtgagatcag

SEQ ID NO: 350907 - DNA, 25 bp, Homo sapien
atttcagcattgtgagatcagtcta

SEQ ID NO: 350908 - DNA, 25 bp, Homo sapien
tcagcattgtgagatcagtctaaat

SEQ ID NO: 350909 - DNA, 25 bp, Homo sapien
agcattgtgagatcagtctaaatga

SEQ ID NO: 350910 - DNA, 25 bp, Homo sapien
aagttattttattatctccattata

SEQ ID NO: 350911 - DNA, 25 bp, Homo sapien
tatatatgttgtttcaagcaaacat

SEQ ID NO: 350912 - DNA, 25 bp, Homo sapien
ctagattttactccaaattcaaaag

SEQ ID NO: 350913 - DNA, 25 bp, Homo sapien
agtgaatctcaaaaagtttgtcgac

SEQ ID NO: 350914 - DNA, 25 bp, Homo sapien
gacaagcaagtcagcatctggagga

SEQ ID NO: 350915 - DNA, 25 bp, Homo sapien
aatggaggcagcactgtgttgcatg

SEQ ID NO: 350916 - DNA, 25 bp, Homo sapien
cactgtgttgcatggctccagagaa

SEQ ID NO: 350917 - DNA, 25 bp, Homo sapien
accactctctttgtgttctatgcaa

SEQ ID NO: 350918 - DNA, 25 bp, Homo sapien
tgttctatgcaacatgcccacgagt

SEQ ID NO: 350919 - DNA, 25 bp, Homo sapien
gcccacgagttatgcattgcagcac

SEQ ID NO: 350920 - DNA, 25 bp, Homo sapien
gcagcacctggccataaatcatcac

SEQ ID NO: 350921 - DNA, 25 bp, Homo sapien
taaatcatcaccaaccctatggatg

SEQ ID NO: 350922 - DNA, 25 bp, Homo sapien
atggatgaagcaacaccccagggag

SEQ ID NO: 350923 - DNA, 25 bp, Homo sapien
tattatgcagttgggttctctacct

SEQ ID NO: 350924 - DNA, 25 bp, Homo sapien
agttgggttctctacctggctgacg

SEQ ID NO: 350925 - DNA, 25 bp, Homo sapien
taccatctcatccttctatcggagg

SEQ ID NO: 350926 - DNA, 25 bp, Homo sapien
gggcaaactatgtacacctgtgtcc

SEQ ID NO: 350927 - DNA, 25 bp, Homo sapien
tacacctgtgtcctttattccagca

SEQ ID NO: 350928 - DNA, 25 bp, Homo sapien
attccagcaccgttggttagagaca

SEQ ID NO: 350929 - DNA, 25 bp, Homo sapien
gttagagacatgtaacgcacctccc

SEQ ID NO: 350930 - DNA, 25 bp, Homo sapien
aaggcacgtagtgctccgaagccat

SEQ ID NO: 350931 - DNA, 25 bp, Homo sapien
aggcctctggtcatttctctgtgga

SEQ ID NO: 350932 - DNA, 25 bp, Homo sapien
ctctgtggagctggttcgcggttac

SEQ ID NO: 350933 - DNA, 25 bp, Homo sapien
ttcgcggttacgcaggctttggcct

SEQ ID NO: 350934 - DNA, 25 bp, Homo sapien
caggctttggcctcaccttaggtgg

SEQ ID NO: 350935 - DNA, 25 bp, Homo sapien
ggctgctgaaggatggcccagcaca

SEQ ID NO: 350936 - DNA, 25 bp, Homo sapien
aggacctggtgacatgacataaact

SEQ ID NO: 350937 - DNA, 25 bp, Homo sapien
gtgacatgacataaactccaagaca

SEQ ID NO: 350938 - DNA, 25 bp, Homo sapien
ataaactccaagacagaacctcagt

SEQ ID NO: 350939 - DNA, 25 bp, Homo sapien
aagacagaacctcagtttacagcac

SEQ ID NO: 350940 - DNA, 25 bp, Homo sapien
agaacctcagtttacagcacacgaa

SEQ ID NO: 350941 - DNA, 25 bp, Homo sapien
acctcagtttacagcacacgaaaaa

SEQ ID NO: 350942 - DNA, 25 bp, Homo sapien
acacgaaaaaaatatcttgccaaca

SEQ ID NO: 350943 - DNA, 25 bp, Homo sapien
aatgacaaaataaattcccgtgaag

SEQ ID NO: 350944 - DNA, 25 bp, Homo sapien
aattcccgtgaagttccacaaccag

SEQ ID NO: 350945 - DNA, 25 bp, Homo sapien
tgaagttccacaaccaggccgggca

SEQ ID NO: 350946 - DNA, 25 bp, Homo sapien
agttccacaaccaggccgggcatgg

SEQ ID NO: 350947 - DNA, 25 bp, Homo sapien
tctcatccttctatcggaggcctcc

SEQ ID NO: 350948 - DNA, 25 bp, Homo sapien
tgcctcagggcaaactatgtacacc

SEQ ID NO: 350949 - DNA, 25 bp, Homo sapien
gggcaaactatgtacacctgtgtcc

SEQ ID NO: 350950 - DNA, 25 bp, Homo sapien
atgtacacctgtgtcctttattcca

SEQ ID NO: 350951 - DNA, 25 bp, Homo sapien
tacacctgtgtcctttattccagca

SEQ ID NO: 350952 - DNA, 25 bp, Homo sapien
tgtgtcctttattccagcaccgttg

SEQ ID NO: 350953 - DNA, 25 bp, Homo sapien
ctttattccagcaccgttggttaga

SEQ ID NO: 350954 - DNA, 25 bp, Homo sapien
attccagcaccgttggttagagaca

SEQ ID NO: 350955 - DNA, 25 bp, Homo sapien
agcaccgttggttagagacatgtaa

SEQ ID NO: 350956 - DNA, 25 bp, Homo sapien
gttagagacatgtaacgcacctccc

SEQ ID NO: 350957 - DNA, 25 bp, Homo sapien
atgtaacgcacctccccaattgatc

SEQ ID NO: 350958 - DNA, 25 bp, Homo sapien
aataggttctggtagcttctgtgcc

SEQ ID NO: 350959 - DNA, 25 bp, Homo sapien
ggtgagaaagcctcacattctctca

SEQ ID NO: 350960 - DNA, 25 bp, Homo sapien
cattctctcaagacagttgctctag

SEQ ID NO: 350961 - DNA, 25 bp, Homo sapien
gctctaggagctgagttgctggttt

SEQ ID NO: 350962 - DNA, 25 bp, Homo sapien
gtgtggagattgcatttctggcttc

SEQ ID NO: 350963 - DNA, 25 bp, Homo sapien
atttctggcttctctcaatggcttg

SEQ ID NO: 350964 - DNA, 25 bp, Homo sapien
caatggcttgtgttgaggactctgg

SEQ ID NO: 350965 - DNA, 25 bp, Homo sapien
tcctggccctaattgtgcaccctga

SEQ ID NO: 350966 - DNA, 25 bp, Homo sapien
tgatccccgtgcttggagctaggcc

SEQ ID NO: 350967 - DNA, 25 bp, Homo sapien
tggcgtgctctagccctctcagtta

SEQ ID NO: 350968 - DNA, 25 bp, Homo sapien
ctcagttaccagctctttggagaag

SEQ ID NO: 350969 - DNA, 25 bp, Homo sapien
acacgcagtttgcaagcacgccctg

SEQ ID NO: 350970 - DNA, 25 bp, Homo sapien
tgtctctatgcctgttgacagaaac

SEQ ID NO: 350971 - DNA, 25 bp, Homo sapien
gaaaccttctgggagctttgtcgct

SEQ ID NO: 350972 - DNA, 25 bp, Homo sapien
tttgtcgctgcctgtatctgaaaca

SEQ ID NO: 350973 - DNA, 25 bp, Homo sapien
agaaaactctctagactctagcttt

SEQ ID NO: 350974 - DNA, 25 bp, Homo sapien
tagactctagcttttgcaggccgac

SEQ ID NO: 350975 - DNA, 25 bp, Homo sapien
ctagcttttgcaggccgactgagca

SEQ ID NO: 350976 - DNA, 25 bp, Homo sapien
ggccgactgagcaggctaaagcaga

SEQ ID NO: 350977 - DNA, 25 bp, Homo sapien
gaaatgtgcaaagtgcctttcccca

SEQ ID NO: 350978 - DNA, 25 bp, Homo sapien
gcctttccccagacagttagaatgt

SEQ ID NO: 350979 - DNA, 25 bp, Homo sapien
tgaatccccaaacccagactgatct

SEQ ID NO: 350980 - DNA, 25 bp, Homo sapien
atctttgatggttagcgccttcagc

SEQ ID NO: 350981 - DNA, 25 bp, Homo sapien
caacccctagaagccgtggagtcag

SEQ ID NO: 350982 - DNA, 25 bp, Homo sapien
agaagccgtggagtcagaccggcca

SEQ ID NO: 350983 - DNA, 25 bp, Homo sapien
ttttaactcgggttctggctacaca

SEQ ID NO: 350984 - DNA, 25 bp, Homo sapien
tcgggttctggctacacacgctgcg

SEQ ID NO: 350985 - DNA, 25 bp, Homo sapien
acgctgcgcctccatacagtttgtc

SEQ ID NO: 350986 - DNA, 25 bp, Homo sapien
agcaggccggctaccttcaggaatt

SEQ ID NO: 350987 - DNA, 25 bp, Homo sapien
accttcaggaattctttgctttggc

SEQ ID NO: 350988 - DNA, 25 bp, Homo sapien
ttgctttggcttctgtctgttcctg

SEQ ID NO: 350989 - DNA, 25 bp, Homo sapien
tctgttcctgtctgttgggcaagtt

SEQ ID NO: 350990 - DNA, 25 bp, Homo sapien
agtttctagctaccccactgagaga

SEQ ID NO: 350991 - DNA, 25 bp, Homo sapien
gatcacaatttgagtatttagtcta

SEQ ID NO: 350992 - DNA, 25 bp, Homo sapien
gactattacttaaagctgtgcagaa

SEQ ID NO: 350993 - DNA, 25 bp, Homo sapien
agacatggtcttaggaaacagatcc

SEQ ID NO: 350994 - DNA, 25 bp, Homo sapien
ggaaacagatccagactcttctagt

SEQ ID NO: 350995 - DNA, 25 bp, Homo sapien
agatccagactcttctagttgtagg

SEQ ID NO: 350996 - DNA, 25 bp, Homo sapien
gactcttctagttgtaggtgtcaga

SEQ ID NO: 350997 - DNA, 25 bp, Homo sapien
aggtgtcagagccttaacttgaatt

SEQ ID NO: 350998 - DNA, 25 bp, Homo sapien
aacattcagacaatcgcagaccctt

SEQ ID NO: 350999 - DNA, 25 bp, Homo sapien
gacaatcgcagacccttaagaacta

SEQ ID NO: 351000 - DNA, 25 bp, Homo sapien
gacccttaagaactagcttgtctaa

SEQ ID NO: 351001 - DNA, 25 bp, Homo sapien
agaactagcttgtctaatttaaaga

SEQ ID NO: 351002 - DNA, 25 bp, Homo sapien
tgtgttctatatagtgagttttacc

SEQ ID NO: 351003 - DNA, 25 bp, Homo sapien
gttttaccagtaaatgtggcttaat

SEQ ID NO: 351004 - DNA, 25 bp, Homo sapien
atgtgtcttctctacgtgatgtgac

SEQ ID NO: 351005 - DNA, 25 bp, Homo sapien
gtgatgtgactaaattctgttttgt

SEQ ID NO: 351006 - DNA, 25 bp, Homo sapien
tggaatgactagcacaggccgactc

SEQ ID NO: 351007 - DNA, 25 bp, Homo sapien
aagaccaatgagctgttaatcgagc

SEQ ID NO: 351008 - DNA, 25 bp, Homo sapien
gttaatcgagctgttatctccatgg

SEQ ID NO: 351009 - DNA, 25 bp, Homo sapien
gttatctccatggtattacttgcta

SEQ ID NO: 351010 - DNA, 25 bp, Homo sapien
attacttgctaaatgcactgatttc

SEQ ID NO: 351011 - DNA, 25 bp, Homo sapien
aatgcactgatttcataagtatgtg

SEQ ID NO: 351012 - DNA, 25 bp, Homo sapien
gtatgtggaatccttttccttttga

SEQ ID NO: 351013 - DNA, 25 bp, Homo sapien
actttcctaacctggcaaccactga

SEQ ID NO: 351014 - DNA, 25 bp, Homo sapien
tttccaagcatagccttggtgcaag

SEQ ID NO: 351015 - DNA, 25 bp, Homo sapien
gcatagccttggtgcaagggcagaa

SEQ ID NO: 351016 - DNA, 25 bp, Homo sapien
tgcaagggcagaaatctgggctagt

SEQ ID NO: 351017 - DNA, 25 bp, Homo sapien
acatgtctgaaactttgggttaagt

SEQ ID NO: 351018 - DNA, 25 bp, Homo sapien
aagtgttttcccagaagcttatctt

SEQ ID NO: 351019 - DNA, 25 bp, Homo sapien
gttttcccagaagcttatctttcct

SEQ ID NO: 351020 - DNA, 25 bp, Homo sapien
ataaaaggagttaatcacccatgct

SEQ ID NO: 351021 - DNA, 25 bp, Homo sapien
aggagttaatcacccatgcttcttt

SEQ ID NO: 351022 - DNA, 25 bp, Homo sapien
agttaatcacccatgcttcttttcc

SEQ ID NO: 351023 - DNA, 25 bp, Homo sapien
ggatagcatgttaattgagatttct

SEQ ID NO: 351024 - DNA, 25 bp, Homo sapien
aggagactagccagagaggctcatt

SEQ ID NO: 351025 - DNA, 25 bp, Homo sapien
gactagccagagaggctcattagct

SEQ ID NO: 351026 - DNA, 25 bp, Homo sapien
agccagagaggctcattagctcccc

SEQ ID NO: 351027 - DNA, 25 bp, Homo sapien
cagagaggctcattagctccccagc

SEQ ID NO: 351028 - DNA, 25 bp, Homo sapien
gaggctcattagctccccagccttg

SEQ ID NO: 351029 - DNA, 25 bp, Homo sapien
gggccagggcagagccgactccttc

SEQ ID NO: 351030 - DNA, 25 bp, Homo sapien
agggcagagccgactccttcccgat

SEQ ID NO: 351031 - DNA, 25 bp, Homo sapien
gactccttcccgatccaggccaggg

SEQ ID NO: 351032 - DNA, 25 bp, Homo sapien
cagctccaatatggcggatccctct

SEQ ID NO: 351033 - DNA, 25 bp, Homo sapien
cggccctgcacggagcgaggtagac

SEQ ID NO: 351034 - DNA, 25 bp, Homo sapien
cacggagcgaggtagacccgggctg

SEQ ID NO: 351035 - DNA, 25 bp, Homo sapien
ctgtgtgagcgagctgctggatact

SEQ ID NO: 351036 - DNA, 25 bp, Homo sapien
gtgtgagcgagctgctggatacttc

SEQ ID NO: 351037 - DNA, 25 bp, Homo sapien
tgtgagcgagctgctggatacttcg

SEQ ID NO: 351038 - DNA, 25 bp, Homo sapien
tgagcgagctgctggatacttcgga

SEQ ID NO: 351039 - DNA, 25 bp, Homo sapien
cgagctgctggatacttcggagaat

SEQ ID NO: 351040 - DNA, 25 bp, Homo sapien
gagctgctggatacttcggagaatg

SEQ ID NO: 351041 - DNA, 25 bp, Homo sapien
gctgctggatacttcggagaatggg

SEQ ID NO: 351042 - DNA, 25 bp, Homo sapien
gaggtgtggaagtcacctgctgccc

SEQ ID NO: 351043 - DNA, 25 bp, Homo sapien
ggtgtggaagtcacctgctgccccg

SEQ ID NO: 351044 - DNA, 25 bp, Homo sapien
tgctgccccgggacacccagatgat

SEQ ID NO: 351045 - DNA, 25 bp, Homo sapien
gctgccccgggacacccagatgatg

SEQ ID NO: 351046 - DNA, 25 bp, Homo sapien
gggacagactgtctctcccctgcga

SEQ ID NO: 351047 - DNA, 25 bp, Homo sapien
actggagtccttggcctggttacct

SEQ ID NO: 351048 - DNA, 25 bp, Homo sapien
gagtccttggcctggttaccttcag

SEQ ID NO: 351049 - DNA, 25 bp, Homo sapien
cttggcctggttaccttcagcattt

SEQ ID NO: 351050 - DNA, 25 bp, Homo sapien
ttcagcatttatagccctccagtga

SEQ ID NO: 351051 - DNA, 25 bp, Homo sapien
gcatttatagccctccagtgagtta

SEQ ID NO: 351052 - DNA, 25 bp, Homo sapien
tatagccctccagtgagttattcct

SEQ ID NO: 351053 - DNA, 25 bp, Homo sapien
agttattcctcggagttctcacaga

SEQ ID NO: 351054 - DNA, 25 bp, Homo sapien
attcctcggagttctcacagagcag

SEQ ID NO: 351055 - DNA, 25 bp, Homo sapien
ctcggagttctcacagagcagcatg

SEQ ID NO: 351056 - DNA, 25 bp, Homo sapien
gttctcacagagcagcatgcgcctg

SEQ ID NO: 351057 - DNA, 25 bp, Homo sapien
acacgcagtttgcaagcacgccctg

SEQ ID NO: 351058 - DNA, 25 bp, Homo sapien
acgcagtttgcaagcacgccctgtc

SEQ ID NO: 351059 - DNA, 25 bp, Homo sapien
gcagtttgcaagcacgccctgtctc

SEQ ID NO: 351060 - DNA, 25 bp, Homo sapien
agtttgcaagcacgccctgtctcta

SEQ ID NO: 351061 - DNA, 25 bp, Homo sapien
aagcacgccctgtctctatgcctgt

SEQ ID NO: 351062 - DNA, 25 bp, Homo sapien
cacgccctgtctctatgcctgttga

SEQ ID NO: 351063 - DNA, 25 bp, Homo sapien
gccctgtctctatgcctgttgacag

SEQ ID NO: 351064 - DNA, 25 bp, Homo sapien
ccctgtctctatgcctgttgacaga

SEQ ID NO: 351065 - DNA, 25 bp, Homo sapien
tgtctctatgcctgttgacagaaac

SEQ ID NO: 351066 - DNA, 25 bp, Homo sapien
gtctctatgcctgttgacagaaacc

SEQ ID NO: 351067 - DNA, 25 bp, Homo sapien
ctctatgcctgttgacagaaacctt

SEQ ID NO: 351068 - DNA, 25 bp, Homo sapien
caatttgaaggctgtctgaaatatc

SEQ ID NO: 351069 - DNA, 25 bp, Homo sapien
tatccatgaactccactggtaattc

SEQ ID NO: 351070 - DNA, 25 bp, Homo sapien
ctggtaattcatggagttcaactct

SEQ ID NO: 351071 - DNA, 25 bp, Homo sapien
atggagttcaactctcttaaccacc

SEQ ID NO: 351072 - DNA, 25 bp, Homo sapien
ctgacccatgatttttaccctaaca

SEQ ID NO: 351073 - DNA, 25 bp, Homo sapien
gatttttaccctaacagccatgaga

SEQ ID NO: 351074 - DNA, 25 bp, Homo sapien
accctaacagccatgagagtttcca

SEQ ID NO: 351075 - DNA, 25 bp, Homo sapien
gccatgagagtttccaaaaatgtta

SEQ ID NO: 351076 - DNA, 25 bp, Homo sapien
tgttttacttttctagtgtatgtca

SEQ ID NO: 351077 - DNA, 25 bp, Homo sapien
tcagatgatgggtggatcatgctat

SEQ ID NO: 351078 - DNA, 25 bp, Homo sapien
gggtggatcatgctataaaatggta

SEQ ID NO: 351079 - DNA, 25 bp, Homo sapien
attatgacttctggcttgtcttaac

SEQ ID NO: 351080 - DNA, 25 bp, Homo sapien
ctggcttgtcttaacaatctagaaa

SEQ ID NO: 351081 - DNA, 25 bp, Homo sapien
ggcttgtcttaacaatctagaaagg

SEQ ID NO: 351082 - DNA, 25 bp, Homo sapien
ttgtcttaacaatctagaaaggttt

SEQ ID NO: 351083 - DNA, 25 bp, Homo sapien
tatttatgagggaatttccaggagc

SEQ ID NO: 351084 - DNA, 25 bp, Homo sapien
gaatttccaggagctataattttag

SEQ ID NO: 351085 - DNA, 25 bp, Homo sapien
ataattttagctagcagttcaaacc

SEQ ID NO: 351086 - DNA, 25 bp, Homo sapien
aattttagctagcagttcaaaccaa

SEQ ID NO: 351087 - DNA, 25 bp, Homo sapien
attttagctagcagttcaaaccaaa

SEQ ID NO: 351088 - DNA, 25 bp, Homo sapien
ttagctagcagttcaaaccaaattt

SEQ ID NO: 351089 - DNA, 25 bp, Homo sapien
agctagcagttcaaaccaaatttat

SEQ ID NO: 351090 - DNA, 25 bp, Homo sapien
gttattatacatgtttccctccaga

SEQ ID NO: 351091 - DNA, 25 bp, Homo sapien
aactcatgaaatagacctccccagt

SEQ ID NO: 351092 - DNA, 25 bp, Homo sapien
atgaaatagacctccccagtacatt

SEQ ID NO: 351093 - DNA, 25 bp, Homo sapien
atagacctccccagtacattttata

SEQ ID NO: 351094 - DNA, 25 bp, Homo sapien
aaggctagtatgatcttgatgccaa

SEQ ID NO: 351095 - DNA, 25 bp, Homo sapien
gtatgatcttgatgccaaaaccaaa

SEQ ID NO: 351096 - DNA, 25 bp, Homo sapien
tgatgccaaaaccaaagacaacttg

SEQ ID NO: 351097 - DNA, 25 bp, Homo sapien
aatttagatgcaccagtctcagtca

SEQ ID NO: 351098 - DNA, 25 bp, Homo sapien
gatgcaccagtctcagtcaaaatat

SEQ ID NO: 351099 - DNA, 25 bp, Homo sapien
atctaagggcaattatatacataca

SEQ ID NO: 351100 - DNA, 25 bp, Homo sapien
cataattggccatgtacatatatat

SEQ ID NO: 351101 - DNA, 25 bp, Homo sapien
gacgccagagcctaaacccttaact

SEQ ID NO: 351102 - DNA, 25 bp, Homo sapien
gcattttaaatgctgcttactggca

SEQ ID NO: 351103 - DNA, 25 bp, Homo sapien
aatgctgcttactggcaactttgca

SEQ ID NO: 351104 - DNA, 25 bp, Homo sapien
tactggcaactttgcatgtacctgt

SEQ ID NO: 351105 - DNA, 25 bp, Homo sapien
atgtacctgtttgtgtccctttagc

SEQ ID NO: 351106 - DNA, 25 bp, Homo sapien
acctgtttgtgtccctttagctgtt

SEQ ID NO: 351107 - DNA, 25 bp, Homo sapien
tgtgtccctttagctgttgttggca

SEQ ID NO: 351108 - DNA, 25 bp, Homo sapien
tccctttagctgttgttggcaggtt

SEQ ID NO: 351109 - DNA, 25 bp, Homo sapien
tgttgttggcaggtttctcagtttc

SEQ ID NO: 351110 - DNA, 25 bp, Homo sapien
ttggcaggtttctcagtttcctgct

SEQ ID NO: 351111 - DNA, 25 bp, Homo sapien
gcaaagaaggattggttcccatttt

SEQ ID NO: 351112 - DNA, 25 bp, Homo sapien
aatggtattaagtacaaccatcacc

SEQ ID NO: 351113 - DNA, 25 bp, Homo sapien
catcctaaactgaaaccgtacccat

SEQ ID NO: 351114 - DNA, 25 bp, Homo sapien
aggccctggtaacctctataacact

SEQ ID NO: 351115 - DNA, 25 bp, Homo sapien
cctggtaacctctataacactttct

SEQ ID NO: 351116 - DNA, 25 bp, Homo sapien
ggtaacctctataacactttctgtc

SEQ ID NO: 351117 - DNA, 25 bp, Homo sapien
tataacactttctgtccctctgaat

SEQ ID NO: 351118 - DNA, 25 bp, Homo sapien
aacactttctgtccctctgaatttg

SEQ ID NO: 351119 - DNA, 25 bp, Homo sapien
tctaggtccctcatataagtgaaga

SEQ ID NO: 351120 - DNA, 25 bp, Homo sapien
gcttaattgctttcttgcctggagg

SEQ ID NO: 351121 - DNA, 25 bp, Homo sapien
taattgctttcttgcctggaggcat

SEQ ID NO: 351122 - DNA, 25 bp, Homo sapien
ctttcttgcctggaggcatgggtcg

SEQ ID NO: 351123 - DNA, 25 bp, Homo sapien
tactgaaataatctagggccctaca

SEQ ID NO: 351124 - DNA, 25 bp, Homo sapien
atctagggccctacagtgctgatga

SEQ ID NO: 351125 - DNA, 25 bp, Homo sapien
tacagtgctgatgacgtcgtctcat

SEQ ID NO: 351126 - DNA, 25 bp, Homo sapien
gatgacgtcgtctcatggagtgtgt

SEQ ID NO: 351127 - DNA, 25 bp, Homo sapien
gtgtgtgttccatacctgttatgtc

SEQ ID NO: 351128 - DNA, 25 bp, Homo sapien
tatgtcggaaggcactctcatggca

SEQ ID NO: 351129 - DNA, 25 bp, Homo sapien
tcatggcaggcccatttggctcttt

SEQ ID NO: 351130 - DNA, 25 bp, Homo sapien
catttggctctttgactttgggaac

SEQ ID NO: 351131 - DNA, 25 bp, Homo sapien
gactttgggaactaaccaggcacat

SEQ ID NO: 351132 - DNA, 25 bp, Homo sapien
atcattactgatttctgcagtttca

SEQ ID NO: 351133 - DNA, 25 bp, Homo sapien
gcatgtttggacttagtactgtctg

SEQ ID NO: 351134 - DNA, 25 bp, Homo sapien
gatttagaaacctggcatccaccac

SEQ ID NO: 351135 - DNA, 25 bp, Homo sapien
ataaagtccgaaatgtacctctaca

SEQ ID NO: 351136 - DNA, 25 bp, Homo sapien
atgtacctctacattctcaacagga

SEQ ID NO: 351137 - DNA, 25 bp, Homo sapien
tacattctcaacaggaacagtgtgt

SEQ ID NO: 351138 - DNA, 25 bp, Homo sapien
gtgtggcagcagaaaaattcctaac

SEQ ID NO: 351139 - DNA, 25 bp, Homo sapien
attcctaaccaaaaacctgtcagat

SEQ ID NO: 351140 - DNA, 25 bp, Homo sapien
taatcaacaattcagaacaactcca

SEQ ID NO: 351141 - DNA, 25 bp, Homo sapien
tccaaggcaattatgtgggacagtt

SEQ ID NO: 351142 - DNA, 25 bp, Homo sapien
gtgggacagttaacttcctgacgtt

SEQ ID NO: 351143 - DNA, 25 bp, Homo sapien
aacttcctgacgttaatgcacacag

SEQ ID NO: 351144 - DNA, 25 bp, Homo sapien
gttaatgcacacaggtttcttgaat

SEQ ID NO: 351145 - DNA, 25 bp, Homo sapien
tagtttaaaatgtatcttgccccac

SEQ ID NO: 351146 - DNA, 25 bp, Homo sapien
atcttgccccacatactttgtgctg

SEQ ID NO: 351147 - DNA, 25 bp, Homo sapien
gtgctgcccttattactctatcttt

SEQ ID NO: 351148 - DNA, 25 bp, Homo sapien
attactctatctttttctgccacta

SEQ ID NO: 351149 - DNA, 25 bp, Homo sapien
tttttctgccactaagtgtgccaag

SEQ ID NO: 351150 - DNA, 25 bp, Homo sapien
gtgtgccaagatcagtcatttgtct

SEQ ID NO: 351151 - DNA, 25 bp, Homo sapien
gatcagtcatttgtctgcataaaag

SEQ ID NO: 351152 - DNA, 25 bp, Homo sapien
atgtattagcagtgatcccatactt

SEQ ID NO: 351153 - DNA, 25 bp, Homo sapien
atactttatcacaagcttacgtgta

SEQ ID NO: 351154 - DNA, 25 bp, Homo sapien
acgtgtaagaaagtaggccattgtt

SEQ ID NO: 351155 - DNA, 25 bp, Homo sapien
gtcggtgaaattgtgcaatgtattc

SEQ ID NO: 351156 - DNA, 25 bp, Homo sapien
gtttgatatctcagcccttgagtga

SEQ ID NO: 351157 - DNA, 25 bp, Homo sapien
gatatctcagcccttgagtgaggca

SEQ ID NO: 351158 - DNA, 25 bp, Homo sapien
gagtacttttccttcataaaagcca

SEQ ID NO: 351159 - DNA, 25 bp, Homo sapien
aaagccacatgaattgaacaagact

SEQ ID NO: 351160 - DNA, 25 bp, Homo sapien
gaactacatcaagttcttgggtcat

SEQ ID NO: 351161 - DNA, 25 bp, Homo sapien
gcaaatatgtgcaagactctggaat

SEQ ID NO: 351162 - DNA, 25 bp, Homo sapien
gactctggaatcttcctttggcaga

SEQ ID NO: 351163 - DNA, 25 bp, Homo sapien
gatgaatatttccaggtgcttgcct

SEQ ID NO: 351164 - DNA, 25 bp, Homo sapien
tatttccaggtgcttgccttcagca

SEQ ID NO: 351165 - DNA, 25 bp, Homo sapien
tcagcaccagcacatgtacattcta

SEQ ID NO: 351166 - DNA, 25 bp, Homo sapien
catgtacattctagtactcttggcc

SEQ ID NO: 351167 - DNA, 25 bp, Homo sapien
ggcagagttcctgagccagaggact

SEQ ID NO: 351168 - DNA, 25 bp, Homo sapien
gagccagaggacttactgtccagct

SEQ ID NO: 351169 - DNA, 25 bp, Homo sapien
tactgtccagctttgagaacctctc

SEQ ID NO: 351170 - DNA, 25 bp, Homo sapien
gaacctctccagagtatatgcactg

SEQ ID NO: 351171 - DNA, 25 bp, Homo sapien
atatgcactgggtactgctcttttt

SEQ ID NO: 351172 - DNA, 25 bp, Homo sapien
actgggtactgctctttttcgaaga

SEQ ID NO: 351173 - DNA, 25 bp, Homo sapien
gtgaatgtgtgcatccatggagtat

SEQ ID NO: 351174 - DNA, 25 bp, Homo sapien
gcatccatggagtatttcccaggta

SEQ ID NO: 351175 - DNA, 25 bp, Homo sapien
atttcccaggtaaatactagtactg

SEQ ID NO: 351176 - DNA, 25 bp, Homo sapien
ctccatgtccatgtttaacaaccta

SEQ ID NO: 351177 - DNA, 25 bp, Homo sapien
taacaacctaatgccagccaggtgc

SEQ ID NO: 351178 - DNA, 25 bp, Homo sapien
gactacttaattctatcttttacca

SEQ ID NO: 351179 - DNA, 25 bp, Homo sapien
ttaccatttaattgcatctataatc

SEQ ID NO: 351180 - DNA, 25 bp, Homo sapien
gatattgcaatgatgttatacaact

SEQ ID NO: 351181 - DNA, 25 bp, Homo sapien
catcttttttctatccattctcttg

SEQ ID NO: 351182 - DNA, 25 bp, Homo sapien
ttttctatccattctcttgaacttt

SEQ ID NO: 351183 - DNA, 25 bp, Homo sapien
tcctttctgggtcattgcacatccc

SEQ ID NO: 351184 - DNA, 25 bp, Homo sapien
ttctgggtcattgcacatcccggta

SEQ ID NO: 351185 - DNA, 25 bp, Homo sapien
tgggtcattgcacatcccggtagta

SEQ ID NO: 351186 - DNA, 25 bp, Homo sapien
gtcattgcacatcccggtagtatca

SEQ ID NO: 351187 - DNA, 25 bp, Homo sapien
gcacatcccggtagtatcattaaga

SEQ ID NO: 351188 - DNA, 25 bp, Homo sapien
catcccggtagtatcattaagagtt

SEQ ID NO: 351189 - DNA, 25 bp, Homo sapien
aaaagcaagcatctacaattttttt

SEQ ID NO: 351190 - DNA, 25 bp, Homo sapien
aaagactttttatgccaggaatgga

SEQ ID NO: 351191 - DNA, 25 bp, Homo sapien
gactttttatgccaggaatggatta

SEQ ID NO: 351192 - DNA, 25 bp, Homo sapien
gccaggaatggattaattaccaaca

SEQ ID NO: 351193 - DNA, 25 bp, Homo sapien
aaaatttatactaatcaggctgatg

SEQ ID NO: 351194 - DNA, 25 bp, Homo sapien
taatcaggctgatgtcaatctattt

SEQ ID NO: 351195 - DNA, 25 bp, Homo sapien
tcaggctgatgtcaatctatttttg

SEQ ID NO: 351196 - DNA, 25 bp, Homo sapien
ttttcctttgatgcaaacagctaga

SEQ ID NO: 351197 - DNA, 25 bp, Homo sapien
ttgatgcaaacagctagaacacctt

SEQ ID NO: 351198 - DNA, 25 bp, Homo sapien
gatgcaaacagctagaacacctttt

SEQ ID NO: 351199 - DNA, 25 bp, Homo sapien
caaacagctagaacacctttttctt

SEQ ID NO: 351200 - DNA, 25 bp, Homo sapien
aaaagactcgtttctgcctaaacat

SEQ ID NO: 351201 - DNA, 25 bp, Homo sapien
agactcgtttctgcctaaacatagg

SEQ ID NO: 351202 - DNA, 25 bp, Homo sapien
tcgtttctgcctaaacatagggaag

SEQ ID NO: 351203 - DNA, 25 bp, Homo sapien
aaaagctcaagttacctttgtgatg

SEQ ID NO: 351204 - DNA, 25 bp, Homo sapien
tacctttgtgatgatgaggcgggca

SEQ ID NO: 351205 - DNA, 25 bp, Homo sapien
gatgaggcgggcagttaacgcgaaa

SEQ ID NO: 351206 - DNA, 25 bp, Homo sapien
ccagtgtggcacagcggcaaggtat

SEQ ID NO: 351207 - DNA, 25 bp, Homo sapien
cggcaaggtatgtgctgggcaaaat

SEQ ID NO: 351208 - DNA, 25 bp, Homo sapien
tgctgggcaaaatgataggtgtctt

SEQ ID NO: 351209 - DNA, 25 bp, Homo sapien
taggtgtcttgggagaccaggcaaa

SEQ ID NO: 351210 - DNA, 25 bp, Homo sapien
cttgggagaccaggcaaagagagct

SEQ ID NO: 351211 - DNA, 25 bp, Homo sapien
ttttttctcatatcagattctactt

SEQ ID NO: 351212 - DNA, 25 bp, Homo sapien
tttttctcatatcagattctacttt

SEQ ID NO: 351213 - DNA, 25 bp, Homo sapien
cacccctctctgtctcaatgtccga

SEQ ID NO: 351214 - DNA, 25 bp, Homo sapien
aattgaaagctgaattaccttatga

SEQ ID NO: 351215 - DNA, 25 bp, Homo sapien
gaaagctgaattaccttatgaacag

SEQ ID NO: 351216 - DNA, 25 bp, Homo sapien
tgaattaccttatgaacagctgctt

SEQ ID NO: 351217 - DNA, 25 bp, Homo sapien
gaattaccttatgaacagctgcttt

SEQ ID NO: 351218 - DNA, 25 bp, Homo sapien
aattaccttatgaacagctgcttta

SEQ ID NO: 351219 - DNA, 25 bp, Homo sapien
attaccttatgaacagctgctttac

SEQ ID NO: 351220 - DNA, 25 bp, Homo sapien
ttaccttatgaacagctgctttacc

SEQ ID NO: 351221 - DNA, 25 bp, Homo sapien
accttatgaacagctgctttaccca

SEQ ID NO: 351222 - DNA, 25 bp, Homo sapien
aatattctcttcagagattctgcaa

SEQ ID NO: 351223 - DNA, 25 bp, Homo sapien
gagattctgcaaatgcgacaagcct

SEQ ID NO: 351224 - DNA, 25 bp, Homo sapien
gattctgcaaatgcgacaagcctcc

SEQ ID NO: 351225 - DNA, 25 bp, Homo sapien
tctgcaaatgcgacaagcctcccag

SEQ ID NO: 351226 - DNA, 25 bp, Homo sapien
acgccttggacagaatccaggagtc

SEQ ID NO: 351227 - DNA, 25 bp, Homo sapien
caggagtcctccagctgagaacgag

SEQ ID NO: 351228 - DNA, 25 bp, Homo sapien
tccagctgagaacgaggtgtccacc

SEQ ID NO: 351229 - DNA, 25 bp, Homo sapien
cagctgagaacgaggtgtccacccc

SEQ ID NO: 351230 - DNA, 25 bp, Homo sapien
gaacgaggtgtccacccccatgcag

SEQ ID NO: 351231 - DNA, 25 bp, Homo sapien
ccccatgcaggcacttactactaat

SEQ ID NO: 351232 - DNA, 25 bp, Homo sapien
tactactaataaagacgatgataat

SEQ ID NO: 351233 - DNA, 25 bp, Homo sapien
gggccctgtaaaatagtgttactgt

SEQ ID NO: 351234 - DNA, 25 bp, Homo sapien
actgtaatactctgttttgcctcct

SEQ ID NO: 351235 - DNA, 25 bp, Homo sapien
tgcctcctgccttgtttacattaaa

SEQ ID NO: 351236 - DNA, 25 bp, Homo sapien
gttactgacagtgttaccagcgtct

SEQ ID NO: 351237 - DNA, 25 bp, Homo sapien
taccagcgtctggaattcttggtcc

SEQ ID NO: 351238 - DNA, 25 bp, Homo sapien
ggaattcttggtccctccgtggaga

SEQ ID NO: 351239 - DNA, 25 bp, Homo sapien
tccctccgtggagaaactcttcaga

SEQ ID NO: 351240 - DNA, 25 bp, Homo sapien
gaaactcttcagatggtcattgtgt

SEQ ID NO: 351241 - DNA, 25 bp, Homo sapien
atggtcattgtgtacctactctctc

SEQ ID NO: 351242 - DNA, 25 bp, Homo sapien
aactttttgtgctaacaatgcatgc

SEQ ID NO: 351243 - DNA, 25 bp, Homo sapien
caatgcatgcaggactaagagggat

SEQ ID NO: 351244 - DNA, 25 bp, Homo sapien
ccgcccggctactcgcggtagtgca

SEQ ID NO: 351245 - DNA, 25 bp, Homo sapien
cgcaggcgccacacgcgaagggctt

SEQ ID NO: 351246 - DNA, 25 bp, Homo sapien
tcaaaaagaatttattccggacacg

SEQ ID NO: 351247 - DNA, 25 bp, Homo sapien
gaatttattccggacacgtggcatg

SEQ ID NO: 351248 - DNA, 25 bp, Homo sapien
aatttattccggacacgtggcatgc

SEQ ID NO: 351249 - DNA, 25 bp, Homo sapien
atttattccggacacgtggcatgcg

SEQ ID NO: 351250 - DNA, 25 bp, Homo sapien
tttattccggacacgtggcatgcgg

SEQ ID NO: 351251 - DNA, 25 bp, Homo sapien
ttattccggacacgtggcatgcggt

SEQ ID NO: 351252 - DNA, 25 bp, Homo sapien
tattccggacacgtggcatgcggtg

SEQ ID NO: 351253 - DNA, 25 bp, Homo sapien
attccggacacgtggcatgcggtgc

SEQ ID NO: 351254 - DNA, 25 bp, Homo sapien
ttccggacacgtggcatgcggtgct

SEQ ID NO: 351255 - DNA, 25 bp, Homo sapien
atatccccactgtccttagatgggt

SEQ ID NO: 351256 - DNA, 25 bp, Homo sapien
gtccttagatgggtggcccctggaa

SEQ ID NO: 351257 - DNA, 25 bp, Homo sapien
acagtctcattgtggctggaccacc

SEQ ID NO: 351258 - DNA, 25 bp, Homo sapien
attgtggctggaccacctgtacata

SEQ ID NO: 351259 - DNA, 25 bp, Homo sapien
tatgcacacttaagttaccgtatgg

SEQ ID NO: 351260 - DNA, 25 bp, Homo sapien
taccgtatgggtgttgtcgagcatt

SEQ ID NO: 351261 - DNA, 25 bp, Homo sapien
gggtgttgtcgagcattttccctgg

SEQ ID NO: 351262 - DNA, 25 bp, Homo sapien
gcaaggcaggcctcgcagctgaaac

SEQ ID NO: 351263 - DNA, 25 bp, Homo sapien
ggcctcgcagctgaaactttatatc

SEQ ID NO: 351264 - DNA, 25 bp, Homo sapien
agggccactgctggctgcggagtga

SEQ ID NO: 351265 - DNA, 25 bp, Homo sapien
gcggagtgaggacgcatatccccac

SEQ ID NO: 351266 - DNA, 25 bp, Homo sapien
gggaggatccattccagacttctct

SEQ ID NO: 351267 - DNA, 25 bp, Homo sapien
gacaggttagtaagattagggccca

SEQ ID NO: 351268 - DNA, 25 bp, Homo sapien
tatgacctcgttttaacttctataa

SEQ ID NO: 351269 - DNA, 25 bp, Homo sapien
acttctataatgatctagtttccaa

SEQ ID NO: 351270 - DNA, 25 bp, Homo sapien
tagtttccaaataagttacaccctg

SEQ ID NO: 351271 - DNA, 25 bp, Homo sapien
taagttacaccctgaagtactaaag

SEQ ID NO: 351272 - DNA, 25 bp, Homo sapien
tacaccctgaagtactaaaggttag

SEQ ID NO: 351273 - DNA, 25 bp, Homo sapien
caacatgtgaattgtggagggatac

SEQ ID NO: 351274 - DNA, 25 bp, Homo sapien
tgtggagggatacaactcagcttgt

SEQ ID NO: 351275 - DNA, 25 bp, Homo sapien
caactcagcttgtaactcatcatat

SEQ ID NO: 351276 - DNA, 25 bp, Homo sapien
gcttgtaactcatcatatccattgt

SEQ ID NO: 351277 - DNA, 25 bp, Homo sapien
aggaagagaagtccaaaggtcagaa

SEQ ID NO: 351278 - DNA, 25 bp, Homo sapien
aaggtcagaagaaggctgacagtat

SEQ ID NO: 351279 - DNA, 25 bp, Homo sapien
ctgacagtatggaggctaaaggtgt

SEQ ID NO: 351280 - DNA, 25 bp, Homo sapien
ggaaccaggaggagatgagtataca

SEQ ID NO: 351281 - DNA, 25 bp, Homo sapien
acaaagagaggaagcccaggtagaa

SEQ ID NO: 351282 - DNA, 25 bp, Homo sapien
aagcccaggtagaagctggaaggga

SEQ ID NO: 351283 - DNA, 25 bp, Homo sapien
gaagctggaagggacgtagagcaag

SEQ ID NO: 351284 - DNA, 25 bp, Homo sapien
gggcccaggaagatcaagttgctga

SEQ ID NO: 351285 - DNA, 25 bp, Homo sapien
aggaagatcaagttgctgaggagaa

SEQ ID NO: 351286 - DNA, 25 bp, Homo sapien
gaagttgtacagaaacaagaggctg

SEQ ID NO: 351287 - DNA, 25 bp, Homo sapien
acagaaacaagaggctgagggagtc

SEQ ID NO: 351288 - DNA, 25 bp, Homo sapien
atttcctcataagccatcagcccca

SEQ ID NO: 351289 - DNA, 25 bp, Homo sapien
tttcctcataagccatcagccccag

SEQ ID NO: 351290 - DNA, 25 bp, Homo sapien
tcagccccaggtgctaatgagagaa

SEQ ID NO: 351291 - DNA, 25 bp, Homo sapien
aagattaagaaagaggttacagtga

SEQ ID NO: 351292 - DNA, 25 bp, Homo sapien
ttacctactaaaagactataacaat

SEQ ID NO: 351293 - DNA, 25 bp, Homo sapien
tacctactaaaagactataacaatt

SEQ ID NO: 351294 - DNA, 25 bp, Homo sapien
taaaagactataacaatttcctcat

SEQ ID NO: 351295 - DNA, 25 bp, Homo sapien
aacaatttcctcataagccatcagc

SEQ ID NO: 351296 - DNA, 25 bp, Homo sapien
acaatttcctcataagccatcagcc

SEQ ID NO: 351297 - DNA, 25 bp, Homo sapien
caatttcctcataagccatcagccc

SEQ ID NO: 351298 - DNA, 25 bp, Homo sapien
aatttcctcataagccatcagcccc

SEQ ID NO: 351299 - DNA, 25 bp, Homo sapien
tggccttcattgtctttttgctgca

SEQ ID NO: 351300 - DNA, 25 bp, Homo sapien
tgaccctgtattggatctcgcctgc

SEQ ID NO: 351301 - DNA, 25 bp, Homo sapien
tgtattggatctcgcctgcagttgc

SEQ ID NO: 351302 - DNA, 25 bp, Homo sapien
ttggatctcgcctgcagttgctgta

SEQ ID NO: 351303 - DNA, 25 bp, Homo sapien
atctcgcctgcagttgctgtattga

SEQ ID NO: 351304 - DNA, 25 bp, Homo sapien
ctcgcctgcagttgctgtattgatt

SEQ ID NO: 351305 - DNA, 25 bp, Homo sapien
cgcctgcagttgctgtattgatttg

SEQ ID NO: 351306 - DNA, 25 bp, Homo sapien
gcagttgctgtattgatttgggccc

SEQ ID NO: 351307 - DNA, 25 bp, Homo sapien
ttgatttgggcccaggcagtgtttt

SEQ ID NO: 351308 - DNA, 25 bp, Homo sapien
gatctaaagggatattttgcaccaa

SEQ ID NO: 351309 - DNA, 25 bp, Homo sapien
tctaaagggatattttgcaccaaaa

SEQ ID NO: 351310 - DNA, 25 bp, Homo sapien
ccccaggtttcatgttcaaggtaca

SEQ ID NO: 351311 - DNA, 25 bp, Homo sapien
ggtttcatgttcaaggtacaggccc

SEQ ID NO: 351312 - DNA, 25 bp, Homo sapien
aaggtacaggcccagcacgactaca

SEQ ID NO: 351313 - DNA, 25 bp, Homo sapien
gtacaggcccagcacgactacacgg

SEQ ID NO: 351314 - DNA, 25 bp, Homo sapien
ggccactgacacagacgagctgcag

SEQ ID NO: 351315 - DNA, 25 bp, Homo sapien
tggtgctggtgatccccttccagaa

SEQ ID NO: 351316 - DNA, 25 bp, Homo sapien
aagagcaggatgaaggctggctcat

SEQ ID NO: 351317 - DNA, 25 bp, Homo sapien
tgaaggctggctcatgggcgtgaag

SEQ ID NO: 351318 - DNA, 25 bp, Homo sapien
tggagaagtgccgtggcgtcttccc

SEQ ID NO: 351319 - DNA, 25 bp, Homo sapien
gtcttccccgagaacttcactgaga

SEQ ID NO: 351320 - DNA, 25 bp, Homo sapien
gaacttcactgagagggtcccatga

SEQ ID NO: 351321 - DNA, 25 bp, Homo sapien
aggcacactcagtagtcagtaaaca

SEQ ID NO: 351322 - DNA, 25 bp, Homo sapien
ggaaaggtgttgtgtcatcatgcca

SEQ ID NO: 351323 - DNA, 25 bp, Homo sapien
gtgtcatcatgccacatattcatac

SEQ ID NO: 351324 - DNA, 25 bp, Homo sapien
tattcatactttccttgggttggaa

SEQ ID NO: 351325 - DNA, 25 bp, Homo sapien
cttgccaatgcaattgttaacctac

SEQ ID NO: 351326 - DNA, 25 bp, Homo sapien
gttaacctacaaccataatatacct

SEQ ID NO: 351327 - DNA, 25 bp, Homo sapien
ataccttaagtatatttttgcacat

SEQ ID NO: 351328 - DNA, 25 bp, Homo sapien
cacataagtataacattgcgattta

SEQ ID NO: 351329 - DNA, 25 bp, Homo sapien
accagattgagattctaaggagcat

SEQ ID NO: 351330 - DNA, 25 bp, Homo sapien
taccatggctttaaacaggattacc

SEQ ID NO: 351331 - DNA, 25 bp, Homo sapien
caggattaccaaaggcacactcagt

SEQ ID NO: 351332 - DNA, 25 bp, Homo sapien
ctgagcactttgtggagtgtgtcct

SEQ ID NO: 351333 - DNA, 25 bp, Homo sapien
ggagtgtgtccttgctcaggctttt

SEQ ID NO: 351334 - DNA, 25 bp, Homo sapien
ttttgccttgggattgaaccgaagc

SEQ ID NO: 351335 - DNA, 25 bp, Homo sapien
gggattgaaccgaagctgctcagtt

SEQ ID NO: 351336 - DNA, 25 bp, Homo sapien
gaagctgctcagttccttccactta

SEQ ID NO: 351337 - DNA, 25 bp, Homo sapien
tttcccagagcctcagtgcttgatg

SEQ ID NO: 351338 - DNA, 25 bp, Homo sapien
gctcagtgctcaggagatgtccttt

SEQ ID NO: 351339 - DNA, 25 bp, Homo sapien
atgtcctttgctccatccttcagag

SEQ ID NO: 351340 - DNA, 25 bp, Homo sapien
agactcaggcagaaactcagagctc

SEQ ID NO: 351341 - DNA, 25 bp, Homo sapien
tgtagttatgctgccgggtgagcac

SEQ ID NO: 351342 - DNA, 25 bp, Homo sapien
agctctcagggctttgctgtgctgt

SEQ ID NO: 351343 - DNA, 25 bp, Homo sapien
ttcctagcatcacattacctgcgtg

SEQ ID NO: 351344 - DNA, 25 bp, Homo sapien
tagcatcacattacctgcgtgtttc

SEQ ID NO: 351345 - DNA, 25 bp, Homo sapien
attacctgcgtgtttccccagacaa

SEQ ID NO: 351346 - DNA, 25 bp, Homo sapien
gcgtgtttccccagacaaaagcact

SEQ ID NO: 351347 - DNA, 25 bp, Homo sapien
ttgaaccttgcctaccctgggctga

SEQ ID NO: 351348 - DNA, 25 bp, Homo sapien
cctgggctgagctgacggcaataga

SEQ ID NO: 351349 - DNA, 25 bp, Homo sapien
ctgagctgacggcaatagatttaat

SEQ ID NO: 351350 - DNA, 25 bp, Homo sapien
gacggcaatagatttaatgacagtg

SEQ ID NO: 351351 - DNA, 25 bp, Homo sapien
gtgactttgcgccttaataagaaca

SEQ ID NO: 351352 - DNA, 25 bp, Homo sapien
gaattggtgacctaggaaaactgtt

SEQ ID NO: 351353 - DNA, 25 bp, Homo sapien
ggtgacctaggaaaactgttgaatt

SEQ ID NO: 351354 - DNA, 25 bp, Homo sapien
tgtttccccgaatttctcgaggaca

SEQ ID NO: 351355 - DNA, 25 bp, Homo sapien
gaatttctcgaggacaaagaatctg

SEQ ID NO: 351356 - DNA, 25 bp, Homo sapien
gttcacgtaaaagatcaggatccct

SEQ ID NO: 351357 - DNA, 25 bp, Homo sapien
gactcctttgagagtaaagtttcct

SEQ ID NO: 351358 - DNA, 25 bp, Homo sapien
aaaagatcaggatccctctcgttgc

SEQ ID NO: 351359 - DNA, 25 bp, Homo sapien
gtctccttccggttaaactgacaag

SEQ ID NO: 351360 - DNA, 25 bp, Homo sapien
gacaagtatcacaatcctttctccc

SEQ ID NO: 351361 - DNA, 25 bp, Homo sapien
ttccggctgggaacaataccctcag

SEQ ID NO: 351362 - DNA, 25 bp, Homo sapien
gctgggaacaataccctcagggtca

SEQ ID NO: 351363 - DNA, 25 bp, Homo sapien
ggatccctctcgttgccagaggaca

SEQ ID NO: 351364 - DNA, 25 bp, Homo sapien
ttcagaaaggaggtcctcaacccca

SEQ ID NO: 351365 - DNA, 25 bp, Homo sapien
ttgcggcgcggcgacagcgtggacg

SEQ ID NO: 351366 - DNA, 25 bp, Homo sapien
cgccatccccgtcatcgaggaggag

SEQ ID NO: 351367 - DNA, 25 bp, Homo sapien
ggctcgggcctgtgcgtcctaccat

SEQ ID NO: 351368 - DNA, 25 bp, Homo sapien
tgtgcgtcctaccatccgggtcggt

SEQ ID NO: 351369 - DNA, 25 bp, Homo sapien
taccatccgggtcggtgctggacaa

SEQ ID NO: 351370 - DNA, 25 bp, Homo sapien
catccgggtcggtgctggacaagct

SEQ ID NO: 351371 - DNA, 25 bp, Homo sapien
gctggacaagctggcggctggcctc

SEQ ID NO: 351372 - DNA, 25 bp, Homo sapien
ggctggcctcgacgagagactcttt

SEQ ID NO: 351373 - DNA, 25 bp, Homo sapien
tggcctcgacgagagactctttccg

SEQ ID NO: 351374 - DNA, 25 bp, Homo sapien
tcgacgagagactctttccgccgcg

SEQ ID NO: 351375 - DNA, 25 bp, Homo sapien
cgtcgtggcgactcccgcgttggtc

SEQ ID NO: 351376 - DNA, 25 bp, Homo sapien
aacagccatattttagcatacaatt

SEQ ID NO: 351377 - DNA, 25 bp, Homo sapien
atacgggaaatgctacaggccctgg

SEQ ID NO: 351378 - DNA, 25 bp, Homo sapien
ggacctctttttgaaggcaaggcta

SEQ ID NO: 351379 - DNA, 25 bp, Homo sapien
gaaactctattccatttgttcacta

SEQ ID NO: 351380 - DNA, 25 bp, Homo sapien
ggctaagtgttaacatgaattcatc

SEQ ID NO: 351381 - DNA, 25 bp, Homo sapien
tattccatttgttcactaacctgat

SEQ ID NO: 351382 - DNA, 25 bp, Homo sapien
ctaacctgatatcatggattgcaca

SEQ ID NO: 351383 - DNA, 25 bp, Homo sapien
catggattgcacatctcctgtctct

SEQ ID NO: 351384 - DNA, 25 bp, Homo sapien
gaattcatcaaacattacctactag

SEQ ID NO: 351385 - DNA, 25 bp, Homo sapien
cattacctactagtacttgctatta

SEQ ID NO: 351386 - DNA, 25 bp, Homo sapien
cccagtgggtttataatttagcaag

SEQ ID NO: 351387 - DNA, 25 bp, Homo sapien
atcaggtcgggaattggaaacatct

SEQ ID NO: 351388 - DNA, 25 bp, Homo sapien
atctgagggctcaattcaacctggc

SEQ ID NO: 351389 - DNA, 25 bp, Homo sapien
ggctcaattcaacctggcttctaaa

SEQ ID NO: 351390 - DNA, 25 bp, Homo sapien
ctggcttctaaaacgaacatggtga

SEQ ID NO: 351391 - DNA, 25 bp, Homo sapien
ctactgaacttcttttaacctctgg

SEQ ID NO: 351392 - DNA, 25 bp, Homo sapien
tgaacttcttttaacctctggcatc

SEQ ID NO: 351393 - DNA, 25 bp, Homo sapien
ctctggcatcctatctgtgaattgt

SEQ ID NO: 351394 - DNA, 25 bp, Homo sapien
gaggaaacagggtccacccgctgct

SEQ ID NO: 351395 - DNA, 25 bp, Homo sapien
gggtgtgtgcagaccgtcaccttgt

SEQ ID NO: 351396 - DNA, 25 bp, Homo sapien
gtcaccttgtgtctgctgtagcagg

SEQ ID NO: 351397 - DNA, 25 bp, Homo sapien
ggattcactgcaattgttccttgag

SEQ ID NO: 351398 - DNA, 25 bp, Homo sapien
gatcacatggtgaggatgcacctgt

SEQ ID NO: 351399 - DNA, 25 bp, Homo sapien
tgaggatgcacctgtaccccgcgga

SEQ ID NO: 351400 - DNA, 25 bp, Homo sapien
gcggacttccggtttgataagccaa

SEQ ID NO: 351401 - DNA, 25 bp, Homo sapien
ggaggccatggaaatctgctctgag

SEQ ID NO: 351402 - DNA, 25 bp, Homo sapien
ccatggaaatctgctctgagcctgt

SEQ ID NO: 351403 - DNA, 25 bp, Homo sapien
gagaggcggatctacagacatagaa

SEQ ID NO: 351404 - DNA, 25 bp, Homo sapien
agacatagaataccctctaccatct

SEQ ID NO: 351405 - DNA, 25 bp, Homo sapien
atagaataccctctaccatctgctt

SEQ ID NO: 351406 - DNA, 25 bp, Homo sapien
tctgctttggtcagggtgccgctcg

SEQ ID NO: 351407 - DNA, 25 bp, Homo sapien
tcagggtgccgctcgaggatttaaa

SEQ ID NO: 351408 - DNA, 25 bp, Homo sapien
aaaccaaacaatgctgatagactca

SEQ ID NO: 351409 - DNA, 25 bp, Homo sapien
agcatggacgtgtgtgtgctcctgt

SEQ ID NO: 351410 - DNA, 25 bp, Homo sapien
gtgtgtgctcctgtgcaaatatcaa

SEQ ID NO: 351411 - DNA, 25 bp, Homo sapien
taacaattcacattccaggcaccac

SEQ ID NO: 351412 - DNA, 25 bp, Homo sapien
accactgtggcaatgaaatgctcca

SEQ ID NO: 351413 - DNA, 25 bp, Homo sapien
tgctccacataaccgtattttccaa

SEQ ID NO: 351414 - DNA, 25 bp, Homo sapien
atttgttgtgttctttaggcccttg

SEQ ID NO: 351415 - DNA, 25 bp, Homo sapien
taggcccttggtttcttaaacagag

SEQ ID NO: 351416 - DNA, 25 bp, Homo sapien
gaaggcctgtcctcctaggtttcca

SEQ ID NO: 351417 - DNA, 25 bp, Homo sapien
tccagacttccccagttggtggtag

SEQ ID NO: 351418 - DNA, 25 bp, Homo sapien
gttggtggtagagatcgccatcttc

SEQ ID NO: 351419 - DNA, 25 bp, Homo sapien
gccatcttcccatagctgtttggga

SEQ ID NO: 351420 - DNA, 25 bp, Homo sapien
tcagggtgtaacttatttggaaact

SEQ ID NO: 351421 - DNA, 25 bp, Homo sapien
gtaacttatttggaaactagatcat

SEQ ID NO: 351422 - DNA, 25 bp, Homo sapien
tcagaaggaaccaagccagccagcc

SEQ ID NO: 351423 - DNA, 25 bp, Homo sapien
cagcctctcaatctcacacttttag

SEQ ID NO: 351424 - DNA, 25 bp, Homo sapien
tcaatctcacacttttagcctccag

SEQ ID NO: 351425 - DNA, 25 bp, Homo sapien
tctgtgagacaataagtttatgttg

SEQ ID NO: 351426 - DNA, 25 bp, Homo sapien
tagaagttaaaacgaggtcataagg

SEQ ID NO: 351427 - DNA, 25 bp, Homo sapien
ggtgggccctaatcttactaacctg

SEQ ID NO: 351428 - DNA, 25 bp, Homo sapien
tgggccctaatcttactaacctgtc

SEQ ID NO: 351429 - DNA, 25 bp, Homo sapien
taatcttactaacctgtccctataa

SEQ ID NO: 351430 - DNA, 25 bp, Homo sapien
tcttactaacctgtccctataaaag

SEQ ID NO: 351431 - DNA, 25 bp, Homo sapien
ggtgctgcagagactttttcctcct

SEQ ID NO: 351432 - DNA, 25 bp, Homo sapien
ttcctcctgttccaagtggccaagg

SEQ ID NO: 351433 - DNA, 25 bp, Homo sapien
agagggaaccccagacgctggccgt

SEQ ID NO: 351434 - DNA, 25 bp, Homo sapien
tggccgtccaaaatccaccaaagaa

SEQ ID NO: 351435 - DNA, 25 bp, Homo sapien
aaatccaccaaagaaagtgacctct

SEQ ID NO: 351436 - DNA, 25 bp, Homo sapien
agtgacctctgagaaagtgagccag

SEQ ID NO: 351437 - DNA, 25 bp, Homo sapien
agaaacatgctgagcctttgacaga

SEQ ID NO: 351438 - DNA, 25 bp, Homo sapien
gcctttgacagacactggctctgag

SEQ ID NO: 351439 - DNA, 25 bp, Homo sapien
gcagggtcccgcatggcgcagcaca

SEQ ID NO: 351440 - DNA, 25 bp, Homo sapien
gcatggcgcagcacaggaagcacgt

SEQ ID NO: 351441 - DNA, 25 bp, Homo sapien
cgcagcacaggaagcacgtgtttgt

SEQ ID NO: 351442 - DNA, 25 bp, Homo sapien
ttttttctcatatcagattctactt

SEQ ID NO: 351443 - DNA, 25 bp, Homo sapien
gattctactttacccctcagtgaca

SEQ ID NO: 351444 - DNA, 25 bp, Homo sapien
gagggcctatgtaaattttgcaatt

SEQ ID NO: 351445 - DNA, 25 bp, Homo sapien
cacccctctctgtctcaatgtccga

SEQ ID NO: 351446 - DNA, 25 bp, Homo sapien
aattgaaagctgaattaccttatga

SEQ ID NO: 351447 - DNA, 25 bp, Homo sapien
tgaattaccttatgaacagctgctt

SEQ ID NO: 351448 - DNA, 25 bp, Homo sapien
gaattaccttatgaacagctgcttt

SEQ ID NO: 351449 - DNA, 25 bp, Homo sapien
ttaccttatgaacagctgctttacc

SEQ ID NO: 351450 - DNA, 25 bp, Homo sapien
accttatgaacagctgctttaccca

SEQ ID NO: 351451 - DNA, 25 bp, Homo sapien
ttatgaacagctgctttacccagga

SEQ ID NO: 351452 - DNA, 25 bp, Homo sapien
tgaacagctgctttacccaggaaca

SEQ ID NO: 351453 - DNA, 25 bp, Homo sapien
gatgcctcctgaccatgccagagta

SEQ ID NO: 351454 - DNA, 25 bp, Homo sapien
tcctgaccatgccagagtaatctca

SEQ ID NO: 351455 - DNA, 25 bp, Homo sapien
atgccagagtaatctcagctttctt

SEQ ID NO: 351456 - DNA, 25 bp, Homo sapien
cagagtaatctcagctttctttagt

SEQ ID NO: 351457 - DNA, 25 bp, Homo sapien
gctttctttagttactggatcacac

SEQ ID NO: 351458 - DNA, 25 bp, Homo sapien
ctttagttactggatcacacatatc

SEQ ID NO: 351459 - DNA, 25 bp, Homo sapien
agcagtgactaaaatggaatatctc

SEQ ID NO: 351460 - DNA, 25 bp, Homo sapien
gacaaatgtgagatgggcttagagt

SEQ ID NO: 351461 - DNA, 25 bp, Homo sapien
ggcttagagttagttctctgggaac

SEQ ID NO: 351462 - DNA, 25 bp, Homo sapien
tagttctctgggaacttgaaagaca

SEQ ID NO: 351463 - DNA, 25 bp, Homo sapien
cttgaaagacatttatgccatatta

SEQ ID NO: 351464 - DNA, 25 bp, Homo sapien
aatgttgttgcaaatctaacactaa

SEQ ID NO: 351465 - DNA, 25 bp, Homo sapien
atgttgttgcaaatctaacactaaa

SEQ ID NO: 351466 - DNA, 25 bp, Homo sapien
tgttgttgcaaatctaacactaaaa

SEQ ID NO: 351467 - DNA, 25 bp, Homo sapien
gttgttgcaaatctaacactaaaaa

SEQ ID NO: 351468 - DNA, 25 bp, Homo sapien
ttgttgcaaatctaacactaaaaaa

SEQ ID NO: 351469 - DNA, 25 bp, Homo sapien
tgttgcaaatctaacactaaaaaat

SEQ ID NO: 351470 - DNA, 25 bp, Homo sapien
gttgcaaatctaacactaaaaaatt

SEQ ID NO: 351471 - DNA, 25 bp, Homo sapien
ttgcaaatctaacactaaaaaattt

SEQ ID NO: 351472 - DNA, 25 bp, Homo sapien
aggcagggaattgcttgaagcaagg

SEQ ID NO: 351473 - DNA, 25 bp, Homo sapien
ggcagggaattgcttgaagcaagga

SEQ ID NO: 351474 - DNA, 25 bp, Homo sapien
gcagggaattgcttgaagcaaggag

SEQ ID NO: 351475 - DNA, 25 bp, Homo sapien
atggccccacggtttctcctcctga

SEQ ID NO: 351476 - DNA, 25 bp, Homo sapien
tgagcgccgcgctgaggatcccaac

SEQ ID NO: 351477 - DNA, 25 bp, Homo sapien
agcgccgcgctgaggatcccaacga

SEQ ID NO: 351478 - DNA, 25 bp, Homo sapien
cgcgctgaggatcccaacgaccaga

SEQ ID NO: 351479 - DNA, 25 bp, Homo sapien
cgctgaggatcccaacgaccagatc

SEQ ID NO: 351480 - DNA, 25 bp, Homo sapien
tgaggatcccaacgaccagatcccg

SEQ ID NO: 351481 - DNA, 25 bp, Homo sapien
gatcccaacgaccagatcccgggtt

SEQ ID NO: 351482 - DNA, 25 bp, Homo sapien
gccctggctagtgcccagcgaggaa

SEQ ID NO: 351483 - DNA, 25 bp, Homo sapien
tagtgcccagcgaggaacggctctc

SEQ ID NO: 351484 - DNA, 25 bp, Homo sapien
agtgcccagcgaggaacggctctcg

SEQ ID NO: 351485 - DNA, 25 bp, Homo sapien
aggaacggctctcgcgggccctagg

SEQ ID NO: 351486 - DNA, 25 bp, Homo sapien
gaaattaaaatttgacccatcttgg

SEQ ID NO: 351487 - DNA, 25 bp, Homo sapien
gacccatcttggaattttggcccct

SEQ ID NO: 351488 - DNA, 25 bp, Homo sapien
attgccttaaaccagttgtgccctt

SEQ ID NO: 351489 - DNA, 25 bp, Homo sapien
cagttgtgccctttatacccacttt

SEQ ID NO: 351490 - DNA, 25 bp, Homo sapien
ttatacccacttttggcatccctaa

SEQ ID NO: 351491 - DNA, 25 bp, Homo sapien
ggcatccctaaacacttagtgcttg

SEQ ID NO: 351492 - DNA, 25 bp, Homo sapien
tgcttgccaaaaacctatcaccatg

SEQ ID NO: 351493 - DNA, 25 bp, Homo sapien
ggctatggattgtagattttcccaa

SEQ ID NO: 351494 - DNA, 25 bp, Homo sapien
cccaattccattaatgcctatcact

SEQ ID NO: 351495 - DNA, 25 bp, Homo sapien
cctatcactagttgggcatttctat

SEQ ID NO: 351496 - DNA, 25 bp, Homo sapien
gtagctccatcaatactttaagctc

SEQ ID NO: 351497 - DNA, 25 bp, Homo sapien
ttcagcctggctcttgagctattgc

SEQ ID NO: 351498 - DNA, 25 bp, Homo sapien
gagctattgctgtattaattttaaa

SEQ ID NO: 351499 - DNA, 25 bp, Homo sapien
tcagcctttcatttctgatatttgg

SEQ ID NO: 351500 - DNA, 25 bp, Homo sapien
gatggaagcctgcagagatctcact

SEQ ID NO: 351501 - DNA, 25 bp, Homo sapien
gcctgcagagatctcactttgaaat

SEQ ID NO: 351502 - DNA, 25 bp, Homo sapien
gaaatggtgatacattacatgggaa

SEQ ID NO: 351503 - DNA, 25 bp, Homo sapien
gagaggtgttttatactgcacatcg

SEQ ID NO: 351504 - DNA, 25 bp, Homo sapien
ttatactgcacatcggtgaggccta

SEQ ID NO: 351505 - DNA, 25 bp, Homo sapien
gcacatcggtgaggcctaataagaa

SEQ ID NO: 351506 - DNA, 25 bp, Homo sapien
tctgatatttggtctttgaagagga

SEQ ID NO: 351507 - DNA, 25 bp, Homo sapien
tagtggagggttctttcctcacatc

SEQ ID NO: 351508 - DNA, 25 bp, Homo sapien
ggacaagcaggccttcgcactatca

SEQ ID NO: 351509 - DNA, 25 bp, Homo sapien
tcctctgggacgacaatcgtttctc

SEQ ID NO: 351510 - DNA, 25 bp, Homo sapien
tgggacgacaatcgtttctcctctg

SEQ ID NO: 351511 - DNA, 25 bp, Homo sapien
tgcagatcctaacctaccagctgtg

SEQ ID NO: 351512 - DNA, 25 bp, Homo sapien
agatcctaacctaccagctgtgtca

SEQ ID NO: 351513 - DNA, 25 bp, Homo sapien
tgtgtcacacctacgtgcgctgcac

SEQ ID NO: 351514 - DNA, 25 bp, Homo sapien
tacgtgcgctgcacacgctccgtgt

SEQ ID NO: 351515 - DNA, 25 bp, Homo sapien
agcatactacgctcacctggtggcc

SEQ ID NO: 351516 - DNA, 25 bp, Homo sapien
ggaagccatacctctgggcagagta

SEQ ID NO: 351517 - DNA, 25 bp, Homo sapien
gagtaacgggcgagaccaccaagca

SEQ ID NO: 351518 - DNA, 25 bp, Homo sapien
gagaccaccaagcactggccaaggc

SEQ ID NO: 351519 - DNA, 25 bp, Homo sapien
ttggaccccaagattttacttagag

SEQ ID NO: 351520 - DNA, 25 bp, Homo sapien
aaatttttgtcctccctgctagtgt

SEQ ID NO: 351521 - DNA, 25 bp, Homo sapien
tagtgtccctcatgtgctgtaattt

SEQ ID NO: 351522 - DNA, 25 bp, Homo sapien
aatttctagtttcatactcccctgg

SEQ ID NO: 351523 - DNA, 25 bp, Homo sapien
atactcccctggttgcaaggtaata

SEQ ID NO: 351524 - DNA, 25 bp, Homo sapien
ggtaatattcagtgccgaccacagt

SEQ ID NO: 351525 - DNA, 25 bp, Homo sapien
tttcagatgttatccgacagtgcag

SEQ ID NO: 351526 - DNA, 25 bp, Homo sapien
gggccatgtgttgtcttgatttttc

SEQ ID NO: 351527 - DNA, 25 bp, Homo sapien
tgccatttctattgatgcagtgtag

SEQ ID NO: 351528 - DNA, 25 bp, Homo sapien
atactttgacctttcttgagcctta

SEQ ID NO: 351529 - DNA, 25 bp, Homo sapien
gaattctgctgtagcgatacctcaa

SEQ ID NO: 351530 - DNA, 25 bp, Homo sapien
tttccttcaaaagctttaatcctga

SEQ ID NO: 351531 - DNA, 25 bp, Homo sapien
gctttaatcctgacagcatctcttg

SEQ ID NO: 351532 - DNA, 25 bp, Homo sapien
atcctgacagcatctcttgaaatat

SEQ ID NO: 351533 - DNA, 25 bp, Homo sapien
ttctttgaggatactactgttgctt

SEQ ID NO: 351534 - DNA, 25 bp, Homo sapien
tttgctgccctctacagtcatctaa

SEQ ID NO: 351535 - DNA, 25 bp, Homo sapien
tgccctctacagtcatctaaaatag

SEQ ID NO: 351536 - DNA, 25 bp, Homo sapien
aatagtcactctagatttttctcca

SEQ ID NO: 351537 - DNA, 25 bp, Homo sapien
tagaatactttttccctgacctgtg

SEQ ID NO: 351538 - DNA, 25 bp, Homo sapien
ttccctgacctgtgtatgagcttta

SEQ ID NO: 351539 - DNA, 25 bp, Homo sapien
gacctgtgtatgagctttatatttc

SEQ ID NO: 351540 - DNA, 25 bp, Homo sapien
gagctttatatttcaggaatgggtt

SEQ ID NO: 351541 - DNA, 25 bp, Homo sapien
caggatgtgcttctcttcatggtaa

SEQ ID NO: 351542 - DNA, 25 bp, Homo sapien
tctactttgatttctgccccgtttt

SEQ ID NO: 351543 - DNA, 25 bp, Homo sapien
ctgccccgttttaatgtccatataa

SEQ ID NO: 351544 - DNA, 25 bp, Homo sapien
gagtccactgatgtagaagttctga

SEQ ID NO: 351545 - DNA, 25 bp, Homo sapien
gacttgtaaaccattcatcctgctt

SEQ ID NO: 351546 - DNA, 25 bp, Homo sapien
aaccattcatcctgctttagtcata

SEQ ID NO: 351547 - DNA, 25 bp, Homo sapien
agtaccgatgcaattagctcctctc

SEQ ID NO: 351548 - DNA, 25 bp, Homo sapien
tctccctgagatgaggtgtgctttg

SEQ ID NO: 351549 - DNA, 25 bp, Homo sapien
aggtgtgctttgaccagctgcatgt

SEQ ID NO: 351550 - DNA, 25 bp, Homo sapien
gaatccggattgaaaccagcatcct

SEQ ID NO: 351551 - DNA, 25 bp, Homo sapien
agcatcctatatacagctccacagg

SEQ ID NO: 351552 - DNA, 25 bp, Homo sapien
ccttacctacacccaaagtggagca

SEQ ID NO: 351553 - DNA, 25 bp, Homo sapien
ttctccaggagggagatccaagcct

SEQ ID NO: 351554 - DNA, 25 bp, Homo sapien
ggtggagtccactctgggcttactt

SEQ ID NO: 351555 - DNA, 25 bp, Homo sapien
ggagtccactctgggcttactttga

SEQ ID NO: 351556 - DNA, 25 bp, Homo sapien
actctgggcttactttgaggcctgt

SEQ ID NO: 351557 - DNA, 25 bp, Homo sapien
ctgggcttactttgaggcctgttct

SEQ ID NO: 351558 - DNA, 25 bp, Homo sapien
gcctgttctgtggattggtgagcca

SEQ ID NO: 351559 - DNA, 25 bp, Homo sapien
gattggtgagccaagctggcactcc

SEQ ID NO: 351560 - DNA, 25 bp, Homo sapien
aagctggcactccttgccctggtct

SEQ ID NO: 351561 - DNA, 25 bp, Homo sapien
tgtggggccggaatctgtatttatc

SEQ ID NO: 351562 - DNA, 25 bp, Homo sapien
cttctttatagaagtccctgtccta

SEQ ID NO: 351563 - DNA, 25 bp, Homo sapien
ttcttctaataaacgtggtccacag

SEQ ID NO: 351564 - DNA, 25 bp, Homo sapien
aacgtggtccacaggttataagttg

SEQ ID NO: 351565 - DNA, 25 bp, Homo sapien
gtccacaggttataagttgagatac

SEQ ID NO: 351566 - DNA, 25 bp, Homo sapien
gaaaatttgaagtttcctgcctagc

SEQ ID NO: 351567 - DNA, 25 bp, Homo sapien
gaaacatatctctttccagacatat

SEQ ID NO: 351568 - DNA, 25 bp, Homo sapien
ctctttccagacatattaatacctt

SEQ ID NO: 351569 - DNA, 25 bp, Homo sapien
ttaataccttttatacagttgactc

SEQ ID NO: 351570 - DNA, 25 bp, Homo sapien
attagtttgaactgcgtgagtacac

SEQ ID NO: 351571 - DNA, 25 bp, Homo sapien
gaactgcgtgagtacacttatatgt

SEQ ID NO: 351572 - DNA, 25 bp, Homo sapien
atggaatatttttggcgatggcaac

SEQ ID NO: 351573 - DNA, 25 bp, Homo sapien
tttggcgatggcaacaattttgtga

SEQ ID NO: 351574 - DNA, 25 bp, Homo sapien
agcgagtgatgggttcccagccctc

SEQ ID NO: 351575 - DNA, 25 bp, Homo sapien
ccagccagatggaatcgtcgggaac

SEQ ID NO: 351576 - DNA, 25 bp, Homo sapien
cgtcgggaacagagtgcaccttaat

SEQ ID NO: 351577 - DNA, 25 bp, Homo sapien
gtgcaccttaatttctgcgaagacc

SEQ ID NO: 351578 - DNA, 25 bp, Homo sapien
atttctgcgaagaccaatgcaaatt

SEQ ID NO: 351579 - DNA, 25 bp, Homo sapien
aagactgagatgcaggctgtttgat

SEQ ID NO: 351580 - DNA, 25 bp, Homo sapien
aacagctgtgacttactgagcacca

SEQ ID NO: 351581 - DNA, 25 bp, Homo sapien
tactgagcaccaactgtgtacccgg

SEQ ID NO: 351582 - DNA, 25 bp, Homo sapien
ggcctcacactgttctcatacacaa

SEQ ID NO: 351583 - DNA, 25 bp, Homo sapien
ttctcatacacaacagctccacggg

SEQ ID NO: 351584 - DNA, 25 bp, Homo sapien
gggaaggcattctcaccgagattca

SEQ ID NO: 351585 - DNA, 25 bp, Homo sapien
gcaatcttctgcctttttggtcaaa

SEQ ID NO: 351586 - DNA, 25 bp, Homo sapien
ttctttcattgagggtgcacggaag

SEQ ID NO: 351587 - DNA, 25 bp, Homo sapien
gagggtgcacggaagtaatagatta

SEQ ID NO: 351588 - DNA, 25 bp, Homo sapien
gagggaatgatattgggttttacac

SEQ ID NO: 351589 - DNA, 25 bp, Homo sapien
gatattgggttttacaccaccattt

SEQ ID NO: 351590 - DNA, 25 bp, Homo sapien
ttttattataccatgaactctccag

SEQ ID NO: 351591 - DNA, 25 bp, Homo sapien
ccatgaactctccaggttggtttca

SEQ ID NO: 351592 - DNA, 25 bp, Homo sapien
actctccaggttggtttcatttgct

SEQ ID NO: 351593 - DNA, 25 bp, Homo sapien
gtctgaacacagacagattgttata

SEQ ID NO: 351594 - DNA, 25 bp, Homo sapien
cagacagattgttataggccagcac

SEQ ID NO: 351595 - DNA, 25 bp, Homo sapien
cagattgttataggccagcacagca

SEQ ID NO: 351596 - DNA, 25 bp, Homo sapien
gagggaaccccagacgctggccgtc

SEQ ID NO: 351597 - DNA, 25 bp, Homo sapien
tggccgtccaaaatccaccaaagaa

SEQ ID NO: 351598 - DNA, 25 bp, Homo sapien
aaatccaccaaagaaagtgacctct

SEQ ID NO: 351599 - DNA, 25 bp, Homo sapien
aagtgacctctgagaaagtgagcca

SEQ ID NO: 351600 - DNA, 25 bp, Homo sapien
gagaaagtgagccagaaacatgctg

SEQ ID NO: 351601 - DNA, 25 bp, Homo sapien
agaaacatgctgagcctttgacaga

SEQ ID NO: 351602 - DNA, 25 bp, Homo sapien
gcctttgacagacactggctctgag

SEQ ID NO: 351603 - DNA, 25 bp, Homo sapien
gcagggtcccgcatggcgcagcaca

SEQ ID NO: 351604 - DNA, 25 bp, Homo sapien
gcatggcgcagcacaggaagcacgt

SEQ ID NO: 351605 - DNA, 25 bp, Homo sapien
cgcagcacaggaagcacgtgtttgt

SEQ ID NO: 351606 - DNA, 25 bp, Homo sapien
acaggaagcacgtgtttgtggagaa

SEQ ID NO: 351607 - DNA, 25 bp, Homo sapien
agttaagagactttgttgtttccat

SEQ ID NO: 351608 - DNA, 25 bp, Homo sapien
cctatagtatttcaacgttttggag

SEQ ID NO: 351609 - DNA, 25 bp, Homo sapien
ggagttccttcctctattaatatat

SEQ ID NO: 351610 - DNA, 25 bp, Homo sapien
taactaacttttgtaaatgcccaat

SEQ ID NO: 351611 - DNA, 25 bp, Homo sapien
aatgcccaattagcactgaaaggta

SEQ ID NO: 351612 - DNA, 25 bp, Homo sapien
atttcttttttccaagagtatcagt

SEQ ID NO: 351613 - DNA, 25 bp, Homo sapien
accaaaagactggacaaccctgtct

SEQ ID NO: 351614 - DNA, 25 bp, Homo sapien
agagtatcagttcttcttaaccctt

SEQ ID NO: 351615 - DNA, 25 bp, Homo sapien
ggacaaccctgtcttaaagtttgat

SEQ ID NO: 351616 - DNA, 25 bp, Homo sapien
ccctgtcttaaagtttgatttctct

SEQ ID NO: 351617 - DNA, 25 bp, Homo sapien
aatccaggattttttagcatatgta

SEQ ID NO: 351618 - DNA, 25 bp, Homo sapien
gagctcatctgcactaaaggattag

SEQ ID NO: 351619 - DNA, 25 bp, Homo sapien
atagaatctaccctacgatccaagc

SEQ ID NO: 351620 - DNA, 25 bp, Homo sapien
taccctacgatccaagctcaaagga

SEQ ID NO: 351621 - DNA, 25 bp, Homo sapien
ggtcactgagaccagcagatccttc

SEQ ID NO: 351622 - DNA, 25 bp, Homo sapien
gcagatccttctaggctttgctgaa

SEQ ID NO: 351623 - DNA, 25 bp, Homo sapien
ggctttgctgaacctggctggtaat

SEQ ID NO: 351624 - DNA, 25 bp, Homo sapien
ggctggtaataactatctgaccctt

SEQ ID NO: 351625 - DNA, 25 bp, Homo sapien
tatctgacccttcaattcttccata

SEQ ID NO: 351626 - DNA, 25 bp, Homo sapien
ttcttccatacactgaactcgttgc

SEQ ID NO: 351627 - DNA, 25 bp, Homo sapien
actgaactcgttgctccagtgaatc

SEQ ID NO: 351628 - DNA, 25 bp, Homo sapien
aactcgttgctccagtgaatccctt

SEQ ID NO: 351629 - DNA, 25 bp, Homo sapien
gttctcaacagtcagacacttcttc

SEQ ID NO: 351630 - DNA, 25 bp, Homo sapien
tcaacagtcagacacttcttctaat

SEQ ID NO: 351631 - DNA, 25 bp, Homo sapien
cttctaattggttgatgctgggctg

SEQ ID NO: 351632 - DNA, 25 bp, Homo sapien
tctaattggttgatgctgggctgta

SEQ ID NO: 351633 - DNA, 25 bp, Homo sapien
taattggttgatgctgggctgtact

SEQ ID NO: 351634 - DNA, 25 bp, Homo sapien
tgctgggctgtactggttgctaaat

SEQ ID NO: 351635 - DNA, 25 bp, Homo sapien
tgggctgtactggttgctaaatatt

SEQ ID NO: 351636 - DNA, 25 bp, Homo sapien
gtactggttgctaaatattgcacat

SEQ ID NO: 351637 - DNA, 25 bp, Homo sapien
ggttgctaaatattgcacatcattt

SEQ ID NO: 351638 - DNA, 25 bp, Homo sapien
tttaaaactatttgagatgcacttt

SEQ ID NO: 351639 - DNA, 25 bp, Homo sapien
gagatgcacttttgtactcaggagg

SEQ ID NO: 351640 - DNA, 25 bp, Homo sapien
gagaacttcactgagagggtcccat

SEQ ID NO: 351641 - DNA, 25 bp, Homo sapien
gaacttcactgagagggtcccatga

SEQ ID NO: 351642 - DNA, 25 bp, Homo sapien
tcactgagagggtcccatgacggcg

SEQ ID NO: 351643 - DNA, 25 bp, Homo sapien
cagcctccgggcgtgtgaagaacac

SEQ ID NO: 351644 - DNA, 25 bp, Homo sapien
tccgggcgtgtgaagaacacctcct

SEQ ID NO: 351645 - DNA, 25 bp, Homo sapien
agaacacctcctcccgaaaaatgtg

SEQ ID NO: 351646 - DNA, 25 bp, Homo sapien
ctcctcccgaaaaatgtgtggttct

SEQ ID NO: 351647 - DNA, 25 bp, Homo sapien
tgttttcgtttttcatcttttgaag

SEQ ID NO: 351648 - DNA, 25 bp, Homo sapien
gaaatcaagaggagacccccaggca

SEQ ID NO: 351649 - DNA, 25 bp, Homo sapien
cttggcttggtggttccttcttagt

SEQ ID NO: 351650 - DNA, 25 bp, Homo sapien
cttggtggttccttcttagttggag

SEQ ID NO: 351651 - DNA, 25 bp, Homo sapien
tgaactctggctcttgttaatcagg

SEQ ID NO: 351652 - DNA, 25 bp, Homo sapien
actctggctcttgttaatcaggtga

SEQ ID NO: 351653 - DNA, 25 bp, Homo sapien
aatcaggtgactacagttttgtcct

SEQ ID NO: 351654 - DNA, 25 bp, Homo sapien
ggtgactacagttttgtccttacat

SEQ ID NO: 351655 - DNA, 25 bp, Homo sapien
actacagttttgtccttacatttgt

SEQ ID NO: 351656 - DNA, 25 bp, Homo sapien
catttgtatgtatgtcatgagtggt

SEQ ID NO: 351657 - DNA, 25 bp, Homo sapien
tatgggcaggaggtaaacaacgcac

SEQ ID NO: 351658 - DNA, 25 bp, Homo sapien
ggcaggaggtaaacaacgcacattt

SEQ ID NO: 351659 - DNA, 25 bp, Homo sapien
ggaggtaaacaacgcacatttaaat

SEQ ID NO: 351660 - DNA, 25 bp, Homo sapien
ggttaaacattcctaatctgaaatc

SEQ ID NO: 351661 - DNA, 25 bp, Homo sapien
aatccaaaaatgctctaaaattcga

SEQ ID NO: 351662 - DNA, 25 bp, Homo sapien
gttcaaaaaccactgatctcatcca

SEQ ID NO: 351663 - DNA, 25 bp, Homo sapien
catccagccttcttactttagagac

SEQ ID NO: 351664 - DNA, 25 bp, Homo sapien
agacgaagaaactgtggcctagaga

SEQ ID NO: 351665 - DNA, 25 bp, Homo sapien
tagagagggcatgcgatttgtccca

SEQ ID NO: 351666 - DNA, 25 bp, Homo sapien
atttgtcccaggtcacacagtgagc

SEQ ID NO: 351667 - DNA, 25 bp, Homo sapien
tttccccatcttcatcgcgaaaaat

SEQ ID NO: 351668 - DNA, 25 bp, Homo sapien
aaatcacccgggatgcagaaagctt

SEQ ID NO: 351669 - DNA, 25 bp, Homo sapien
agcttgctgaaatacagacgcccag

SEQ ID NO: 351670 - DNA, 25 bp, Homo sapien
tccctgggattccactttaggaggc

SEQ ID NO: 351671 - DNA, 25 bp, Homo sapien
tgtgtttagtgcttttcatccctta

SEQ ID NO: 351672 - DNA, 25 bp, Homo sapien
tcatcccttacttatggtgtgcaga

SEQ ID NO: 351673 - DNA, 25 bp, Homo sapien
gaagaagcagttagccgttctccgt

SEQ ID NO: 351674 - DNA, 25 bp, Homo sapien
tagccgttctccgtaaagggtctgc

SEQ ID NO: 351675 - DNA, 25 bp, Homo sapien
taaagggtctgccaatcctggtttt

SEQ ID NO: 351676 - DNA, 25 bp, Homo sapien
ccatgacttagctatgactgccgat

SEQ ID NO: 351677 - DNA, 25 bp, Homo sapien
gctatgactgccgatgaattctcaa

SEQ ID NO: 351678 - DNA, 25 bp, Homo sapien
atgaattctcaatgctcgtcacttc

SEQ ID NO: 351679 - DNA, 25 bp, Homo sapien
gactgtgttgagacgcattcatcct

SEQ ID NO: 351680 - DNA, 25 bp, Homo sapien
tgagacgcattcatccttaagcaaa

SEQ ID NO: 351681 - DNA, 25 bp, Homo sapien
caaaagctgagagcctgcaaatgct

SEQ ID NO: 351682 - DNA, 25 bp, Homo sapien
atgctggatgaaagctacaaccttt

SEQ ID NO: 351683 - DNA, 25 bp, Homo sapien
gagcatccaacaaagtagaatcctg

SEQ ID NO: 351684 - DNA, 25 bp, Homo sapien
ggctgatggccgagtacaaacaatt

SEQ ID NO: 351685 - DNA, 25 bp, Homo sapien
aattaacactgaatcctccggaagg

SEQ ID NO: 351686 - DNA, 25 bp, Homo sapien
aggaattgtagcaggccccatgaat

SEQ ID NO: 351687 - DNA, 25 bp, Homo sapien
gcaggccccatgaatgaagagaact

SEQ ID NO: 351688 - DNA, 25 bp, Homo sapien
gaggcattgatcatgggcccagaag

SEQ ID NO: 351689 - DNA, 25 bp, Homo sapien
agaagacacctgctttgagtttggt

SEQ ID NO: 351690 - DNA, 25 bp, Homo sapien
tgagtttcccacttgattacccgtt

SEQ ID NO: 351691 - DNA, 25 bp, Homo sapien
ccccaaagatgagatttacctgtga

SEQ ID NO: 351692 - DNA, 25 bp, Homo sapien
ttacctgtgagatgtttcatcccaa

SEQ ID NO: 351693 - DNA, 25 bp, Homo sapien
atcccaacatctaccctgatgggag

SEQ ID NO: 351694 - DNA, 25 bp, Homo sapien
atgggagagtctgcatttccatcct

SEQ ID NO: 351695 - DNA, 25 bp, Homo sapien
gctgtgtaagtgtctgatcattcct

SEQ ID NO: 351696 - DNA, 25 bp, Homo sapien
aaggacactcacatttggagaggac

SEQ ID NO: 351697 - DNA, 25 bp, Homo sapien
aataaaaactcctccatcagtctct

SEQ ID NO: 351698 - DNA, 25 bp, Homo sapien
atcagtctcttactgcgcatgcact

SEQ ID NO: 351699 - DNA, 25 bp, Homo sapien
tgcgcatgcactgtagggccacaaa

SEQ ID NO: 351700 - DNA, 25 bp, Homo sapien
gcactgtagggccacaaagtcacaa

SEQ ID NO: 351701 - DNA, 25 bp, Homo sapien
aagtcacaaagtcctggtacttcat

SEQ ID NO: 351702 - DNA, 25 bp, Homo sapien
cctggtacttcatccctgagagatt

SEQ ID NO: 351703 - DNA, 25 bp, Homo sapien
ccacctcagagcctaataactttta

SEQ ID NO: 351704 - DNA, 25 bp, Homo sapien
aattctaatcagcttggttaccttg

SEQ ID NO: 351705 - DNA, 25 bp, Homo sapien
ggttaccttgattcataactcatag

SEQ ID NO: 351706 - DNA, 25 bp, Homo sapien
ttgcgattgaggaagtagcatgatc

SEQ ID NO: 351707 - DNA, 25 bp, Homo sapien
gcatgatcctaaatgtgttgctgaa

SEQ ID NO: 351708 - DNA, 25 bp, Homo sapien
gtgttgctgaaatcaggcagcccga

SEQ ID NO: 351709 - DNA, 25 bp, Homo sapien
tgaaatcaggcagcccgagcctctg

SEQ ID NO: 351710 - DNA, 25 bp, Homo sapien
agagcccgtcttcacatttctctat

SEQ ID NO: 351711 - DNA, 25 bp, Homo sapien
agcactcacccgaaactgaacagat

SEQ ID NO: 351712 - DNA, 25 bp, Homo sapien
gggagtggtcttgattgtcaagata

SEQ ID NO: 351713 - DNA, 25 bp, Homo sapien
aaagctaaatgctgagaaactgagc

SEQ ID NO: 351714 - DNA, 25 bp, Homo sapien
gaaactgagcatctattgtcgtgtt

SEQ ID NO: 351715 - DNA, 25 bp, Homo sapien
gcatctattgtcgtgtttaagctta

SEQ ID NO: 351716 - DNA, 25 bp, Homo sapien
gtcgtgtttaagcttagctgggtcc

SEQ ID NO: 351717 - DNA, 25 bp, Homo sapien
aggtcgtcgattccctgtccaaatg

SEQ ID NO: 351718 - DNA, 25 bp, Homo sapien
tgtccaaatgcgtgcagtgggccga

SEQ ID NO: 351719 - DNA, 25 bp, Homo sapien
ggccgagggttttctgctggtctat

SEQ ID NO: 351720 - DNA, 25 bp, Homo sapien
ttctgctggtctattccatcacaga

SEQ ID NO: 351721 - DNA, 25 bp, Homo sapien
tatgacagctacttgtccatccgac

SEQ ID NO: 351722 - DNA, 25 bp, Homo sapien
ttatcagcacatccggaaggtccac

SEQ ID NO: 351723 - DNA, 25 bp, Homo sapien
ggaaggtccaccctgactctaaagc

SEQ ID NO: 351724 - DNA, 25 bp, Homo sapien
tctaaagcccctgtcatcatcgtgg

SEQ ID NO: 351725 - DNA, 25 bp, Homo sapien
atgcccggcaggtgcagacacagga

SEQ ID NO: 351726 - DNA, 25 bp, Homo sapien
acaggacggtattcagctagccaat

SEQ ID NO: 351727 - DNA, 25 bp, Homo sapien
ggcagcctgttccttgaaatttcca

SEQ ID NO: 351728 - DNA, 25 bp, Homo sapien
agatgtggtgcttggccgcaatcgt

SEQ ID NO: 351729 - DNA, 25 bp, Homo sapien
gtgcttggccgcaatcgtgaatcgg

SEQ ID NO: 351730 - DNA, 25 bp, Homo sapien
cgcaatcgtgaatcggccctggagg

SEQ ID NO: 351731 - DNA, 25 bp, Homo sapien
gaaggggctgcctgcgactcatgac

SEQ ID NO: 351732 - DNA, 25 bp, Homo sapien
tgctgacctatgacccttcaagttc

SEQ ID NO: 351733 - DNA, 25 bp, Homo sapien
tgacctatgacccttcaagttccca

SEQ ID NO: 351734 - DNA, 25 bp, Homo sapien
tcagccacgcctgtgaggagggtct

SEQ ID NO: 351735 - DNA, 25 bp, Homo sapien
acgcctgtgaggagggtcttgtttt

SEQ ID NO: 351736 - DNA, 25 bp, Homo sapien
aagaactaggaccccagatccccat

SEQ ID NO: 351737 - DNA, 25 bp, Homo sapien
gatccccatggacaaggcacttgca

SEQ ID NO: 351738 - DNA, 25 bp, Homo sapien
ccatggacaaggcacttgcatgaat

SEQ ID NO: 351739 - DNA, 25 bp, Homo sapien
gtgtctgtaggtctcagtttccaca

SEQ ID NO: 351740 - DNA, 25 bp, Homo sapien
gtttccacattcatacagtgagggt

SEQ ID NO: 351741 - DNA, 25 bp, Homo sapien
tacagtgagggtgttaagtcaggta

SEQ ID NO: 351742 - DNA, 25 bp, Homo sapien
gtcaggtagctggagacttcccatc

SEQ ID NO: 351743 - DNA, 25 bp, Homo sapien
ggtagctggagacttcccatcgcct

SEQ ID NO: 351744 - DNA, 25 bp, Homo sapien
atcgcctctgacacttttggaggtg

SEQ ID NO: 351745 - DNA, 25 bp, Homo sapien
tttggaggtgatatgatacagcccc

SEQ ID NO: 351746 - DNA, 25 bp, Homo sapien
agacacaagtggcaggattcagatg

SEQ ID NO: 351747 - DNA, 25 bp, Homo sapien
ttcagatggaagcttcgcaaggctg

SEQ ID NO: 351748 - DNA, 25 bp, Homo sapien
tctttcccagccctagttctgggtt

SEQ ID NO: 351749 - DNA, 25 bp, Homo sapien
agccctagttctgggttccccagtg

SEQ ID NO: 351750 - DNA, 25 bp, Homo sapien
tcaagctactagttgttactactag

SEQ ID NO: 351751 - DNA, 25 bp, Homo sapien
gttgttactatgtgacatggtccca

SEQ ID NO: 351752 - DNA, 25 bp, Homo sapien
gtgacatggtcccaagagaggatat

SEQ ID NO: 351753 - DNA, 25 bp, Homo sapien
aaagctgagcatatgggtataggaa

SEQ ID NO: 351754 - DNA, 25 bp, Homo sapien
caaaaaagtcctctcagctattccc

SEQ ID NO: 351755 - DNA, 25 bp, Homo sapien
agctattccccagaggattttccac

SEQ ID NO: 351756 - DNA, 25 bp, Homo sapien
ttccacaacgtttcaagatagccaa

SEQ ID NO: 351757 - DNA, 25 bp, Homo sapien
acgtttcaagatagccaagttggca

SEQ ID NO: 351758 - DNA, 25 bp, Homo sapien
ggccgcccaggttcaccgcggagtt

SEQ ID NO: 351759 - DNA, 25 bp, Homo sapien
tctgtgaaccactagggtacggtca

SEQ ID NO: 351760 - DNA, 25 bp, Homo sapien
ggtacggtcagagccaaacacagcc

SEQ ID NO: 351761 - DNA, 25 bp, Homo sapien
aatgtgctccgctacatccagctga

SEQ ID NO: 351762 - DNA, 25 bp, Homo sapien
atgtgctccgctacatccagctgac

SEQ ID NO: 351763 - DNA, 25 bp, Homo sapien
tgtgctccgctacatccagctgact

SEQ ID NO: 351764 - DNA, 25 bp, Homo sapien
gtgctccgctacatccagctgactc

SEQ ID NO: 351765 - DNA, 25 bp, Homo sapien
tgctccgctacatccagctgactca

SEQ ID NO: 351766 - DNA, 25 bp, Homo sapien
gctccgctacatccagctgactcag

SEQ ID NO: 351767 - DNA, 25 bp, Homo sapien
ctccgctacatccagctgactcagc

SEQ ID NO: 351768 - DNA, 25 bp, Homo sapien
tccgctacatccagctgactcagct

SEQ ID NO: 351769 - DNA, 25 bp, Homo sapien
ccgctacatccagctgactcagctg

SEQ ID NO: 351770 - DNA, 25 bp, Homo sapien
cgctacatccagctgactcagctga

SEQ ID NO: 351771 - DNA, 25 bp, Homo sapien
gctacatccagctgactcagctgaa

SEQ ID NO: 351772 - DNA, 25 bp, Homo sapien
gaacaggtatcaagaactttcttta

SEQ ID NO: 351773 - DNA, 25 bp, Homo sapien
gtatccattgaagtttagtgcctgt

SEQ ID NO: 351774 - DNA, 25 bp, Homo sapien
ttagtgcctgtaggactgagccagt

SEQ ID NO: 351775 - DNA, 25 bp, Homo sapien
ggactgagccagtgctttatcaacc

SEQ ID NO: 351776 - DNA, 25 bp, Homo sapien
gagccagtgctttatcaacccaaca

SEQ ID NO: 351777 - DNA, 25 bp, Homo sapien
gctttatcaacccaacacatcatca

SEQ ID NO: 351778 - DNA, 25 bp, Homo sapien
atcatcaccatgtgcatactctaga

SEQ ID NO: 351779 - DNA, 25 bp, Homo sapien
ttccttaaaagttacagaggctctt

SEQ ID NO: 351780 - DNA, 25 bp, Homo sapien
gttacagaggctcttaacgtgttaa

SEQ ID NO: 351781 - DNA, 25 bp, Homo sapien
gatttcaaatatgttctacggcctt

SEQ ID NO: 351782 - DNA, 25 bp, Homo sapien
tcaaatatgttctacggccttactg

SEQ ID NO: 351783 - DNA, 25 bp, Homo sapien
ccctaagggtttcagatagtctttg

SEQ ID NO: 351784 - DNA, 25 bp, Homo sapien
gggtttcagatagtctttgatcaat

SEQ ID NO: 351785 - DNA, 25 bp, Homo sapien
gatagtctttgatcaatgggattaa

SEQ ID NO: 351786 - DNA, 25 bp, Homo sapien
tgctcaaaatagtaagtcggttctt

SEQ ID NO: 351787 - DNA, 25 bp, Homo sapien
tggaacttttctcctacctagcaca

SEQ ID NO: 351788 - DNA, 25 bp, Homo sapien
ctacctagcacaccaggatatttgt

SEQ ID NO: 351789 - DNA, 25 bp, Homo sapien
caggatatttgtatttgaagtggca

SEQ ID NO: 351790 - DNA, 25 bp, Homo sapien
tgaagtggcagtgcttcttatgagg

SEQ ID NO: 351791 - DNA, 25 bp, Homo sapien
gttatgtcagaatctatgaggagcc

SEQ ID NO: 351792 - DNA, 25 bp, Homo sapien
tcagaatctatgaggagccaagtgt

SEQ ID NO: 351793 - DNA, 25 bp, Homo sapien
gaggtgggaatatcacttaggccca

SEQ ID NO: 351794 - DNA, 25 bp, Homo sapien
tctcatccctgcctgtcccagtaga

SEQ ID NO: 351795 - DNA, 25 bp, Homo sapien
gggtgggtaagtgctcccgtgaagg

SEQ ID NO: 351796 - DNA, 25 bp, Homo sapien
ccaggtgattctgggtctggccctg

SEQ ID NO: 351797 - DNA, 25 bp, Homo sapien
tgattctgggtctggccctgtgtct

SEQ ID NO: 351798 - DNA, 25 bp, Homo sapien
ctcagtcctgccctgtggggagcaa

SEQ ID NO: 351799 - DNA, 25 bp, Homo sapien
tgtggacagaaacacttatcgaggt

SEQ ID NO: 351800 - DNA, 25 bp, Homo sapien
acacttatcgaggtggggatgcccc

SEQ ID NO: 351801 - DNA, 25 bp, Homo sapien
gagcaagagtacacggctggattcc

SEQ ID NO: 351802 - DNA, 25 bp, Homo sapien
aagagtacacggctggattccagag

SEQ ID NO: 351803 - DNA, 25 bp, Homo sapien
acacggctggattccagagctgcca

SEQ ID NO: 351804 - DNA, 25 bp, Homo sapien
ggctggattccagagctgccagcag

SEQ ID NO: 351805 - DNA, 25 bp, Homo sapien
tctcatccctgcctgtcccagtaga

SEQ ID NO: 351806 - DNA, 25 bp, Homo sapien
gggtgggtaagtgctcccgtgaagg

SEQ ID NO: 351807 - DNA, 25 bp, Homo sapien
ctcagtcctgccctgtggggagcaa

SEQ ID NO: 351808 - DNA, 25 bp, Homo sapien
acacttatcgaggtggggatgcccc

SEQ ID NO: 351809 - DNA, 25 bp, Homo sapien
gagcaagagtacacggctggattcc

SEQ ID NO: 351810 - DNA, 25 bp, Homo sapien
agcaagagtacacggctggattcca

SEQ ID NO: 351811 - DNA, 25 bp, Homo sapien
aagagtacacggctggattccagag

SEQ ID NO: 351812 - DNA, 25 bp, Homo sapien
agagtacacggctggattccagagc

SEQ ID NO: 351813 - DNA, 25 bp, Homo sapien
gagtacacggctggattccagagct

SEQ ID NO: 351814 - DNA, 25 bp, Homo sapien
gtacacggctggattccagagctgc

SEQ ID NO: 351815 - DNA, 25 bp, Homo sapien
acacggctggattccagagctgcca

SEQ ID NO: 351816 - DNA, 25 bp, Homo sapien
acacagaacttacacagggcatttt

SEQ ID NO: 351817 - DNA, 25 bp, Homo sapien
acacagggcattttatgccaagcta

SEQ ID NO: 351818 - DNA, 25 bp, Homo sapien
ggcattttatgccaagctatattga

SEQ ID NO: 351819 - DNA, 25 bp, Homo sapien
agctatattgaatatctatatccct

SEQ ID NO: 351820 - DNA, 25 bp, Homo sapien
tacctgcccgtcaatgtcatgaata

SEQ ID NO: 351821 - DNA, 25 bp, Homo sapien
attgacaattcactctagaccctgc

SEQ ID NO: 351822 - DNA, 25 bp, Homo sapien
aattcactctagaccctgctagaag

SEQ ID NO: 351823 - DNA, 25 bp, Homo sapien
agaccctgctagaagaatccaaaga

SEQ ID NO: 351824 - DNA, 25 bp, Homo sapien
gttataatagtaagtggctaccaag

SEQ ID NO: 351825 - DNA, 25 bp, Homo sapien
gtggctaccaagtagaaagtggtca

SEQ ID NO: 351826 - DNA, 25 bp, Homo sapien
ggacacacagaacttacacagggca

SEQ ID NO: 351827 - DNA, 25 bp, Homo sapien
actgagcccacaatgccacggaaat

SEQ ID NO: 351828 - DNA, 25 bp, Homo sapien
agcccacaatgccacggaaatcctt

SEQ ID NO: 351829 - DNA, 25 bp, Homo sapien
acaatgccacggaaatccttgttgg

SEQ ID NO: 351830 - DNA, 25 bp, Homo sapien
aatgccacggaaatccttgttggct

SEQ ID NO: 351831 - DNA, 25 bp, Homo sapien
cagctgggaagagctcagagctgac

SEQ ID NO: 351832 - DNA, 25 bp, Homo sapien
tcactgttgctttctatgtatagct

SEQ ID NO: 351833 - DNA, 25 bp, Homo sapien
gttgctttctatgtatagctcccta

SEQ ID NO: 351834 - DNA, 25 bp, Homo sapien
gctttctatgtatagctccctagac

SEQ ID NO: 351835 - DNA, 25 bp, Homo sapien
ttctatgtatagctccctagacctt

SEQ ID NO: 351836 - DNA, 25 bp, Homo sapien
ctatgtatagctccctagacctttc

SEQ ID NO: 351837 - DNA, 25 bp, Homo sapien
tgtatagctccctagacctttcact

SEQ ID NO: 351838 - DNA, 25 bp, Homo sapien
ttctctttctctcattagcacctgg

SEQ ID NO: 351839 - DNA, 25 bp, Homo sapien
tctctttctctcattagcacctggg

SEQ ID NO: 351840 - DNA, 25 bp, Homo sapien
ctttctctcattagcacctggggct

SEQ ID NO: 351841 - DNA, 25 bp, Homo sapien
ggctgatggcttatgaggaaattgt

SEQ ID NO: 351842 - DNA, 25 bp, Homo sapien
gctgatggcttatgaggaaattgtt

SEQ ID NO: 351843 - DNA, 25 bp, Homo sapien
gaggaaattgttatagtcttttagt

SEQ ID NO: 351844 - DNA, 25 bp, Homo sapien
ggaaattgttatagtcttttagtag

SEQ ID NO: 351845 - DNA, 25 bp, Homo sapien
gaaattgttatagtcttttagtagg

SEQ ID NO: 351846 - DNA, 25 bp, Homo sapien
ttgttatagtcttttagtaggtaag

SEQ ID NO: 351847 - DNA, 25 bp, Homo sapien
tagtaggtaagttttgtccctatag

SEQ ID NO: 351848 - DNA, 25 bp, Homo sapien
ttttgtccctatagtccccttctgt

SEQ ID NO: 351849 - DNA, 25 bp, Homo sapien
aatctgttaaattccttcagtggac

SEQ ID NO: 351850 - DNA, 25 bp, Homo sapien
cagtggacttgacttttcctcttaa

SEQ ID NO: 351851 - DNA, 25 bp, Homo sapien
aaatactaaagatgttggtgctgac

SEQ ID NO: 351852 - DNA, 25 bp, Homo sapien
gctgacattgtgaaggcacatactc

SEQ ID NO: 351853 - DNA, 25 bp, Homo sapien
agctggtatctgtaaggtaactttt

SEQ ID NO: 351854 - DNA, 25 bp, Homo sapien
aaaggctctgatttatttctgtggt

SEQ ID NO: 351855 - DNA, 25 bp, Homo sapien
aatgtgccgtggctaggtttttcct

SEQ ID NO: 351856 - DNA, 25 bp, Homo sapien
ggtttttcctcctcatatttgtagg

SEQ ID NO: 351857 - DNA, 25 bp, Homo sapien
gtaggctttcatgtgaagctccctt

SEQ ID NO: 351858 - DNA, 25 bp, Homo sapien
gaagctcccttagctcagcattggt

SEQ ID NO: 351859 - DNA, 25 bp, Homo sapien
gctcagcattggtcaaaacatgttt

SEQ ID NO: 351860 - DNA, 25 bp, Homo sapien
aacgcgggtgacagaaaccagctct

SEQ ID NO: 351861 - DNA, 25 bp, Homo sapien
aaaccagctctgtgtctgtgagcct

SEQ ID NO: 351862 - DNA, 25 bp, Homo sapien
gggatggcacagtattgctccaaga

SEQ ID NO: 351863 - DNA, 25 bp, Homo sapien
ttgctccaagacatgcaaacagctg

SEQ ID NO: 351864 - DNA, 25 bp, Homo sapien
gcagcagagacagtgaggcaaccct

SEQ ID NO: 351865 - DNA, 25 bp, Homo sapien
tcaggcatgcggagaaagcacccct

SEQ ID NO: 351866 - DNA, 25 bp, Homo sapien
agaaagcaccccttcatctgtgcaa

SEQ ID NO: 351867 - DNA, 25 bp, Homo sapien
cttcatctgtgcaaggaatcctcaa

SEQ ID NO: 351868 - DNA, 25 bp, Homo sapien
aattcatgcactgttaattcagatg

SEQ ID NO: 351869 - DNA, 25 bp, Homo sapien
gatgttacagtcacatccagtgcta

SEQ ID NO: 351870 - DNA, 25 bp, Homo sapien
acatccagtgctaagggctgtcctt

SEQ ID NO: 351871 - DNA, 25 bp, Homo sapien
cagcctgggtgacactccagcctgg

SEQ ID NO: 351872 - DNA, 25 bp, Homo sapien
agcctgggtgacactccagcctggg

SEQ ID NO: 351873 - DNA, 25 bp, Homo sapien
tgggtgacaaaggagaccccgtcaa

SEQ ID NO: 351874 - DNA, 25 bp, Homo sapien
tttgtttcctagcttagaatttata

SEQ ID NO: 351875 - DNA, 25 bp, Homo sapien
ttgtttcctagcttagaatttataa

SEQ ID NO: 351876 - DNA, 25 bp, Homo sapien
tgtttcctagcttagaatttataat

SEQ ID NO: 351877 - DNA, 25 bp, Homo sapien
gtttcctagcttagaatttataatc

SEQ ID NO: 351878 - DNA, 25 bp, Homo sapien
ttcctagcttagaatttataatcag

SEQ ID NO: 351879 - DNA, 25 bp, Homo sapien
tcctagcttagaatttataatcaga

SEQ ID NO: 351880 - DNA, 25 bp, Homo sapien
cctagcttagaatttataatcagat

SEQ ID NO: 351881 - DNA, 25 bp, Homo sapien
gcttagaatttataatcagattagg

SEQ ID NO: 351882 - DNA, 25 bp, Homo sapien
cttctcttccttttgccaataaata

SEQ ID NO: 351883 - DNA, 25 bp, Homo sapien
aattgaggacatcaactctgctcct

SEQ ID NO: 351884 - DNA, 25 bp, Homo sapien
atcaactctgctcctgtcaaaaaga

SEQ ID NO: 351885 - DNA, 25 bp, Homo sapien
agacaatccgtctaacttcctattt

SEQ ID NO: 351886 - DNA, 25 bp, Homo sapien
atccgtctaacttcctatttctatg

SEQ ID NO: 351887 - DNA, 25 bp, Homo sapien
tggaaaataaatagcgcatcacgat

SEQ ID NO: 351888 - DNA, 25 bp, Homo sapien
atcacgatgccatctctcggaagaa

SEQ ID NO: 351889 - DNA, 25 bp, Homo sapien
atctctcggaagaacgctcattctg

SEQ ID NO: 351890 - DNA, 25 bp, Homo sapien
aacgctcattctgctgttttgtttt

SEQ ID NO: 351891 - DNA, 25 bp, Homo sapien
cagtagtttgtgcttctgttgtaca

SEQ ID NO: 351892 - DNA, 25 bp, Homo sapien
gtgcttctgttgtacatacccaaaa

SEQ ID NO: 351893 - DNA, 25 bp, Homo sapien
ttctctttctctcattagcacctgg

SEQ ID NO: 351894 - DNA, 25 bp, Homo sapien
tctctttctctcattagcacctggg

SEQ ID NO: 351895 - DNA, 25 bp, Homo sapien
tctttctctcattagcacctggggc

SEQ ID NO: 351896 - DNA, 25 bp, Homo sapien
ctttctctcattagcacctggggct

SEQ ID NO: 351897 - DNA, 25 bp, Homo sapien
ggctgatggcttatgaggaaattgt

SEQ ID NO: 351898 - DNA, 25 bp, Homo sapien
gctgatggcttatgaggaaattgtt

SEQ ID NO: 351899 - DNA, 25 bp, Homo sapien
gaggaaattgttatagtcttttagt

SEQ ID NO: 351900 - DNA, 25 bp, Homo sapien
ggaaattgttatagtcttttagtag

SEQ ID NO: 351901 - DNA, 25 bp, Homo sapien
gaaattgttatagtcttttagtagg

SEQ ID NO: 351902 - DNA, 25 bp, Homo sapien
ttgttatagtcttttagtaggtaag

SEQ ID NO: 351903 - DNA, 25 bp, Homo sapien
tagtaggtaagttttgtccctatag

SEQ ID NO: 351904 - DNA, 25 bp, Homo sapien
actctgccacctgccaaagggtaga

SEQ ID NO: 351905 - DNA, 25 bp, Homo sapien
agggtagaccccaacatgccatgtg

SEQ ID NO: 351906 - DNA, 25 bp, Homo sapien
atgtgtttctccagtgggcatcctt

SEQ ID NO: 351907 - DNA, 25 bp, Homo sapien
agtgggcatccttgggttccctggc

SEQ ID NO: 351908 - DNA, 25 bp, Homo sapien
agctcctgcagagccaagagccgtg

SEQ ID NO: 351909 - DNA, 25 bp, Homo sapien
gagccgtgagccgatcctccaaaaa

SEQ ID NO: 351910 - DNA, 25 bp, Homo sapien
gatcctccaaaaaccagacccatag

SEQ ID NO: 351911 - DNA, 25 bp, Homo sapien
agacccataggacaagaggccagga

SEQ ID NO: 351912 - DNA, 25 bp, Homo sapien
gaggccctaccccatttcagctggg

SEQ ID NO: 351913 - DNA, 25 bp, Homo sapien
agagctgggcaaattcagacctaga

SEQ ID NO: 351914 - DNA, 25 bp, Homo sapien
agagtggatttcaactctgccacct

SEQ ID NO: 351915 - DNA, 25 bp, Homo sapien
attgccttctaccacctgggcgact

SEQ ID NO: 351916 - DNA, 25 bp, Homo sapien
ttgccttctaccacctgggcgacta

SEQ ID NO: 351917 - DNA, 25 bp, Homo sapien
cttctaccacctgggcgactacgca

SEQ ID NO: 351918 - DNA, 25 bp, Homo sapien
acctgggcgactacgcacgcgcgct

SEQ ID NO: 351919 - DNA, 25 bp, Homo sapien
agccgggaacccacagacaccaatg

SEQ ID NO: 351920 - DNA, 25 bp, Homo sapien
aatgtgctccgctacatccagctga

SEQ ID NO: 351921 - DNA, 25 bp, Homo sapien
gctgactcagctgaagatgaatcgt

SEQ ID NO: 351922 - DNA, 25 bp, Homo sapien
gaagatgaatcgttgcagcctccag

SEQ ID NO: 351923 - DNA, 25 bp, Homo sapien
ctgggtcccagactcgggatgtaat

SEQ ID NO: 351924 - DNA, 25 bp, Homo sapien
gttggtaaaacacttgtcactggtg

SEQ ID NO: 351925 - DNA, 25 bp, Homo sapien
ggtaaaacacttgtcactggtgatc

SEQ ID NO: 351926 - DNA, 25 bp, Homo sapien
tgtcagagacacttcccagataaag

SEQ ID NO: 351927 - DNA, 25 bp, Homo sapien
gagacacttcccagataaagtaaga

SEQ ID NO: 351928 - DNA, 25 bp, Homo sapien
gataaagtaagagttaaccctgcac

SEQ ID NO: 351929 - DNA, 25 bp, Homo sapien
ttaaccctgcacctcaggtgtgata

SEQ ID NO: 351930 - DNA, 25 bp, Homo sapien
accctgcacctcaggtgtgatagtg

SEQ ID NO: 351931 - DNA, 25 bp, Homo sapien
gggtcagtggtatgtgatccaggct

SEQ ID NO: 351932 - DNA, 25 bp, Homo sapien
gggagcaggtgccaactccacatcc

SEQ ID NO: 351933 - DNA, 25 bp, Homo sapien
gagcaggtgccaactccacatcctt

SEQ ID NO: 351934 - DNA, 25 bp, Homo sapien
tctcctcccttgtcggtttttggcg

SEQ ID NO: 351935 - DNA, 25 bp, Homo sapien
ctcagccttcgctgtggagggacga

SEQ ID NO: 351936 - DNA, 25 bp, Homo sapien
gtggagggacgagagcacagagctc

SEQ ID NO: 351937 - DNA, 25 bp, Homo sapien
aaagcccttatcatagtctacaaga

SEQ ID NO: 351938 - DNA, 25 bp, Homo sapien
aagatcctaaatgtgcacctctcca

SEQ ID NO: 351939 - DNA, 25 bp, Homo sapien
ccaccccactcctgattaaagaatt

SEQ ID NO: 351940 - DNA, 25 bp, Homo sapien
aaagaattttgctcctaatggccca

SEQ ID NO: 351941 - DNA, 25 bp, Homo sapien
attttgctcctaatggcccactatg

SEQ ID NO: 351942 - DNA, 25 bp, Homo sapien
ggcccactatgggaatactctttcc

SEQ ID NO: 351943 - DNA, 25 bp, Homo sapien
atactctttccccagatagccacat

SEQ ID NO: 351944 - DNA, 25 bp, Homo sapien
agatagccacatgcttcaattgccc

SEQ ID NO: 351945 - DNA, 25 bp, Homo sapien
acatgcttcaattgcccacttcctg

SEQ ID NO: 351946 - DNA, 25 bp, Homo sapien
atctgtaaaatagtcccaccactat

SEQ ID NO: 351947 - DNA, 25 bp, Homo sapien
agagcaaatccaaagcccttatcat

SEQ ID NO: 351948 - DNA, 25 bp, Homo sapien
gactaattgtggatcctgggtgccc

SEQ ID NO: 351949 - DNA, 25 bp, Homo sapien
aagtaacccttgtcatcatttatgc

SEQ ID NO: 351950 - DNA, 25 bp, Homo sapien
agatgatacccttctggcagtttgc

SEQ ID NO: 351951 - DNA, 25 bp, Homo sapien
ggcagtttgccacagtacaattcag

SEQ ID NO: 351952 - DNA, 25 bp, Homo sapien
tcagatgcatctgcttttaaccctt

SEQ ID NO: 351953 - DNA, 25 bp, Homo sapien
ttggaagtctgacagtgcgctgcat

SEQ ID NO: 351954 - DNA, 25 bp, Homo sapien
tgcgctgcataaacaccttgagtac

SEQ ID NO: 351955 - DNA, 25 bp, Homo sapien
cttgagtaccacagcattccgtaat

SEQ ID NO: 351956 - DNA, 25 bp, Homo sapien
gaagcctctttctaatagtagtgtg

SEQ ID NO: 351957 - DNA, 25 bp, Homo sapien
gtggccggtgcttattaatcatcta

SEQ ID NO: 351958 - DNA, 25 bp, Homo sapien
aatcatctagctactgagttactgt

SEQ ID NO: 351959 - DNA, 25 bp, Homo sapien
gaaagagccccaggtcggccgagca

SEQ ID NO: 351960 - DNA, 25 bp, Homo sapien
aaagagccccaggtcggccgagcac

SEQ ID NO: 351961 - DNA, 25 bp, Homo sapien
aagagccccaggtcggccgagcacg

SEQ ID NO: 351962 - DNA, 25 bp, Homo sapien
agagccccaggtcggccgagcacgg

SEQ ID NO: 351963 - DNA, 25 bp, Homo sapien
gagccccaggtcggccgagcacggt

SEQ ID NO: 351964 - DNA, 25 bp, Homo sapien
agccccaggtcggccgagcacggtg

SEQ ID NO: 351965 - DNA, 25 bp, Homo sapien
gccccaggtcggccgagcacggtgg

SEQ ID NO: 351966 - DNA, 25 bp, Homo sapien
aattagcgggcttggtggcagatgc

SEQ ID NO: 351967 - DNA, 25 bp, Homo sapien
attagcgggcttggtggcagatgcc

SEQ ID NO: 351968 - DNA, 25 bp, Homo sapien
ttagcgggcttggtggcagatgcct

SEQ ID NO: 351969 - DNA, 25 bp, Homo sapien
atttatacctatttcaacatcatga

SEQ ID NO: 351970 - DNA, 25 bp, Homo sapien
atttttccatcagcattttcttgca

SEQ ID NO: 351971 - DNA, 25 bp, Homo sapien
atcagcattttcttgcaactttaaa

SEQ ID NO: 351972 - DNA, 25 bp, Homo sapien
gatacaggatctataatttattggc

SEQ ID NO: 351973 - DNA, 25 bp, Homo sapien
gtaaaatcaatcaggctttctcgta

SEQ ID NO: 351974 - DNA, 25 bp, Homo sapien
tcaggctttctcgtaagttatttcc

SEQ ID NO: 351975 - DNA, 25 bp, Homo sapien
atccatgataaatacaacaaggctt

SEQ ID NO: 351976 - DNA, 25 bp, Homo sapien
tacaacaaggcttggcgaaacctca

SEQ ID NO: 351977 - DNA, 25 bp, Homo sapien
gcgaaacctcattactcttggaagt

SEQ ID NO: 351978 - DNA, 25 bp, Homo sapien
ctcattactcttggaagtcttcaga

SEQ ID NO: 351979 - DNA, 25 bp, Homo sapien
tggaagtcttcagaggttattatac

SEQ ID NO: 351980 - DNA, 25 bp, Homo sapien
atcccgtcacagtgctgcaggatta

SEQ ID NO: 351981 - DNA, 25 bp, Homo sapien
gattagggaggattgcttccagctg

SEQ ID NO: 351982 - DNA, 25 bp, Homo sapien
ggattgcttccagctgaaagagatg

SEQ ID NO: 351983 - DNA, 25 bp, Homo sapien
tgggaggccataaaggctctttctt

SEQ ID NO: 351984 - DNA, 25 bp, Homo sapien
aaggctctttcttctggatgacgtt

SEQ ID NO: 351985 - DNA, 25 bp, Homo sapien
aatgcttatgtctccacacgtagcc

SEQ ID NO: 351986 - DNA, 25 bp, Homo sapien
taaaaataacctgctgactcactgg

SEQ ID NO: 351987 - DNA, 25 bp, Homo sapien
tgggcaaccctggacagtctctgtc

SEQ ID NO: 351988 - DNA, 25 bp, Homo sapien
gtctctgtctgccaaggtgatcatt

SEQ ID NO: 351989 - DNA, 25 bp, Homo sapien
cctgctgactcactggtttgtaatg

SEQ ID NO: 351990 - DNA, 25 bp, Homo sapien
ttcgtgcctgtctcccaaggcacat

SEQ ID NO: 351991 - DNA, 25 bp, Homo sapien
ccgccgcatgcaagcagcgaggcga

SEQ ID NO: 351992 - DNA, 25 bp, Homo sapien
aagcagcgaggcgaggtcgcgctga

SEQ ID NO: 351993 - DNA, 25 bp, Homo sapien
gcgaggtcgcgctgaggcctggcca

SEQ ID NO: 351994 - DNA, 25 bp, Homo sapien
gaggcctggccatgccacggacggc

SEQ ID NO: 351995 - DNA, 25 bp, Homo sapien
cacacctgggtaccctgggtcctga

SEQ ID NO: 351996 - DNA, 25 bp, Homo sapien
gtaccctgggtcctgactcagggca

SEQ ID NO: 351997 - DNA, 25 bp, Homo sapien
cagctgggtgagaagctaacggcct

SEQ ID NO: 351998 - DNA, 25 bp, Homo sapien
tgagaagctaacggcctgaaggaac

SEQ ID NO: 351999 - DNA, 25 bp, Homo sapien
aacggcctgaaggaacagggctaca

SEQ ID NO: 352000 - DNA, 25 bp, Homo sapien
ctgttagcccgaccggcttcgaagc

SEQ ID NO: 352001 - DNA, 25 bp, Homo sapien
ttcgaagcccgcgccggttgcggat

SEQ ID NO: 352002 - DNA, 25 bp, Homo sapien
tcacacactgaatgcctcgagtact

SEQ ID NO: 352003 - DNA, 25 bp, Homo sapien
ctgaatgcctcgagtactcacattt

SEQ ID NO: 352004 - DNA, 25 bp, Homo sapien
gggacttgataacctctggactttt

SEQ ID NO: 352005 - DNA, 25 bp, Homo sapien
aacctctggacttttgacggtgcag

SEQ ID NO: 352006 - DNA, 25 bp, Homo sapien
acttttgacggtgcagtttccttgc

SEQ ID NO: 352007 - DNA, 25 bp, Homo sapien
aatgtccgcaagaatttcttcccaa

SEQ ID NO: 352008 - DNA, 25 bp, Homo sapien
cagttgccaaattccagactccttt

SEQ ID NO: 352009 - DNA, 25 bp, Homo sapien
atttcttcccaatttaatcagtgta

SEQ ID NO: 352010 - DNA, 25 bp, Homo sapien
acctcgatgaaggtagagcactaag

SEQ ID NO: 352011 - DNA, 25 bp, Homo sapien
taaagcccagcctgatgggttcctg

SEQ ID NO: 352012 - DNA, 25 bp, Homo sapien
ttcttcctgtgcctcacacactgaa

SEQ ID NO: 352013 - DNA, 25 bp, Homo sapien
tttgtctgggtcttttaacttattg

SEQ ID NO: 352014 - DNA, 25 bp, Homo sapien
atcgacaaatagcattaccttcccc

SEQ ID NO: 352015 - DNA, 25 bp, Homo sapien
ttttttcagatgagggcctgttacc

SEQ ID NO: 352016 - DNA, 25 bp, Homo sapien
gagggcctgttaccatgctctcaaa

SEQ ID NO: 352017 - DNA, 25 bp, Homo sapien
ttatttttctaggtaagtcccattg

SEQ ID NO: 352018 - DNA, 25 bp, Homo sapien
gggaataattcttatgaccttgtag

SEQ ID NO: 352019 - DNA, 25 bp, Homo sapien
gagacttaattgacaagcagacact

SEQ ID NO: 352020 - DNA, 25 bp, Homo sapien
attaccttcccctcagaaatcactt

SEQ ID NO: 352021 - DNA, 25 bp, Homo sapien
taacaatttatgatcactgctcaaa

SEQ ID NO: 352022 - DNA, 25 bp, Homo sapien
aaatcacttccacagattgctgtaa

SEQ ID NO: 352023 - DNA, 25 bp, Homo sapien
gtagcataacaatttgtctgggtct

SEQ ID NO: 352024 - DNA, 25 bp, Homo sapien
gttcaaatggtagattatggttatt

SEQ ID NO: 352025 - DNA, 25 bp, Homo sapien
atggttattacatatgagttttcaa

SEQ ID NO: 352026 - DNA, 25 bp, Homo sapien
aaatgttgagtctttctggaaagat

SEQ ID NO: 352027 - DNA, 25 bp, Homo sapien
ggaaagatttattcttcagtatctg

SEQ ID NO: 352028 - DNA, 25 bp, Homo sapien
tcttcagtatctgtgcaaagtttga

SEQ ID NO: 352029 - DNA, 25 bp, Homo sapien
tgtctttgccatttggtttgtattt

SEQ ID NO: 352030 - DNA, 25 bp, Homo sapien
tacataaatacatactcaagtctgg

SEQ ID NO: 352031 - DNA, 25 bp, Homo sapien
atactcaagtctggagatggtttca

SEQ ID NO: 352032 - DNA, 25 bp, Homo sapien
gagttatggcattggtcttctggca

SEQ ID NO: 352033 - DNA, 25 bp, Homo sapien
ttctggcaagggaagacttaattta

SEQ ID NO: 352034 - DNA, 25 bp, Homo sapien
taactggtaaacttatagactattc

SEQ ID NO: 352035 - DNA, 25 bp, Homo sapien
aagtacactgtgtggaatttgttcc

SEQ ID NO: 352036 - DNA, 25 bp, Homo sapien
tattatattttggttcagcttatga

SEQ ID NO: 352037 - DNA, 25 bp, Homo sapien
ttatgatgatacacctaccagtcca

SEQ ID NO: 352038 - DNA, 25 bp, Homo sapien
acagtaactgccataaagcagggat

SEQ ID NO: 352039 - DNA, 25 bp, Homo sapien
cagggatatgaagattggttacggc

SEQ ID NO: 352040 - DNA, 25 bp, Homo sapien
gattggttacggcataactcagata

SEQ ID NO: 352041 - DNA, 25 bp, Homo sapien
gttacggcataactcagataatgaa

SEQ ID NO: 352042 - DNA, 25 bp, Homo sapien
atggagctcctgtttatgttgttcg

SEQ ID NO: 352043 - DNA, 25 bp, Homo sapien
gctcctgtttatgttgttcgaagtg

SEQ ID NO: 352044 - DNA, 25 bp, Homo sapien
gttgttcgaagtggtggccttgtaa

SEQ ID NO: 352045 - DNA, 25 bp, Homo sapien
acattcgggtgggtgatattgttcg

SEQ ID NO: 352046 - DNA, 25 bp, Homo sapien
ccgccgcatgcaagcagcgaggcga

SEQ ID NO: 352047 - DNA, 25 bp, Homo sapien
aagcagcgaggcgaggtcgcgctga

SEQ ID NO: 352048 - DNA, 25 bp, Homo sapien
gcgaggtcgcgctgaggcctggcca

SEQ ID NO: 352049 - DNA, 25 bp, Homo sapien
gaggcctggccatgccacggacggc

SEQ ID NO: 352050 - DNA, 25 bp, Homo sapien
ccatgccacggacggccgggcctca

SEQ ID NO: 352051 - DNA, 25 bp, Homo sapien
ggtaccctgggtcctgactcagggc

SEQ ID NO: 352052 - DNA, 25 bp, Homo sapien
cagctgggtgagaagctaacggcct

SEQ ID NO: 352053 - DNA, 25 bp, Homo sapien
tgagaagctaacggcctgaaggaac

SEQ ID NO: 352054 - DNA, 25 bp, Homo sapien
gcctgaaggaacagggctacaaggg

SEQ ID NO: 352055 - DNA, 25 bp, Homo sapien
ctgttagcccgaccggcttcgaagc

SEQ ID NO: 352056 - DNA, 25 bp, Homo sapien
ttcgaagcccgcgccggttgcggat

SEQ ID NO: 352057 - DNA, 25 bp, Homo sapien
gcctgaggtaggcttcatagagttc

SEQ ID NO: 352058 - DNA, 25 bp, Homo sapien
tcatagagttctaggacttccgtgt

SEQ ID NO: 352059 - DNA, 25 bp, Homo sapien
tctaggacttccgtgtgcgttgcca

SEQ ID NO: 352060 - DNA, 25 bp, Homo sapien
gtgtgcgttgccaccagatcctgcc

SEQ ID NO: 352061 - DNA, 25 bp, Homo sapien
tggcctttcccttctaaggtcatta

SEQ ID NO: 352062 - DNA, 25 bp, Homo sapien
aaggtcattagattcagccaaaagc

SEQ ID NO: 352063 - DNA, 25 bp, Homo sapien
gattcagccaaaagcgacctcttct

SEQ ID NO: 352064 - DNA, 25 bp, Homo sapien
ctcttctctagtccggtgttacgaa

SEQ ID NO: 352065 - DNA, 25 bp, Homo sapien
tagtccggtgttacgaacagaagtt

SEQ ID NO: 352066 - DNA, 25 bp, Homo sapien
gagttgtgctacaaaagtagttcca

SEQ ID NO: 352067 - DNA, 25 bp, Homo sapien
agtagttccatctttttggtgtaat

SEQ ID NO: 352068 - DNA, 25 bp, Homo sapien
aatgttgttgcaaatctaacactaa

SEQ ID NO: 352069 - DNA, 25 bp, Homo sapien
atgttgttgcaaatctaacactaaa

SEQ ID NO: 352070 - DNA, 25 bp, Homo sapien
tgttgttgcaaatctaacactaaaa

SEQ ID NO: 352071 - DNA, 25 bp, Homo sapien
gttgttgcaaatctaacactaaaaa

SEQ ID NO: 352072 - DNA, 25 bp, Homo sapien
ttgttgcaaatctaacactaaaaaa

SEQ ID NO: 352073 - DNA, 25 bp, Homo sapien
gttgcaaatctaacactaaaaaatt

SEQ ID NO: 352074 - DNA, 25 bp, Homo sapien
ctaaaaaatttttgactgggtgcag

SEQ ID NO: 352075 - DNA, 25 bp, Homo sapien
taaaaaatttttgactgggtgcagt

SEQ ID NO: 352076 - DNA, 25 bp, Homo sapien
aggcagggaattgcttgaagcaagg

SEQ ID NO: 352077 - DNA, 25 bp, Homo sapien
ggcagggaattgcttgaagcaagga

SEQ ID NO: 352078 - DNA, 25 bp, Homo sapien
gcagggaattgcttgaagcaaggag

SEQ ID NO: 352079 - DNA, 25 bp, Homo sapien
tactttggtcctcccaatacacaca

SEQ ID NO: 352080 - DNA, 25 bp, Homo sapien
actcacacacacacggctagatcat

SEQ ID NO: 352081 - DNA, 25 bp, Homo sapien
acacacggctagatcatttagtttt

SEQ ID NO: 352082 - DNA, 25 bp, Homo sapien
ctccatcatctcctctttggtaata

SEQ ID NO: 352083 - DNA, 25 bp, Homo sapien
atctcctctttggtaatagtcgcag

SEQ ID NO: 352084 - DNA, 25 bp, Homo sapien
gtaatagtcgcagaggttgccataa

SEQ ID NO: 352085 - DNA, 25 bp, Homo sapien
gaggttgccataatgagtcatttgt

SEQ ID NO: 352086 - DNA, 25 bp, Homo sapien
acttggcttgtatttagggactact

SEQ ID NO: 352087 - DNA, 25 bp, Homo sapien
ggctgatttttgagtgtgagagtct

SEQ ID NO: 352088 - DNA, 25 bp, Homo sapien
gagagtctttgtaagatctactttg

SEQ ID NO: 352089 - DNA, 25 bp, Homo sapien
gtaagatctactttggtcctcccaa

SEQ ID NO: 352090 - DNA, 25 bp, Homo sapien
aaatgcatccaactagttcccgcct

SEQ ID NO: 352091 - DNA, 25 bp, Homo sapien
tagttcccgcctctgggactcagat

SEQ ID NO: 352092 - DNA, 25 bp, Homo sapien
gcctctgggactcagatgcttgctg

SEQ ID NO: 352093 - DNA, 25 bp, Homo sapien
tctgggactcagatgcttgctgctc

SEQ ID NO: 352094 - DNA, 25 bp, Homo sapien
ggactcagatgcttgctgctcctgc

SEQ ID NO: 352095 - DNA, 25 bp, Homo sapien
tgctcctgcctggaaaactgcaccc

SEQ ID NO: 352096 - DNA, 25 bp, Homo sapien
agctctttcagacagactagcccct

SEQ ID NO: 352097 - DNA, 25 bp, Homo sapien
ttcagacagactagcccctgtgggt

SEQ ID NO: 352098 - DNA, 25 bp, Homo sapien
gtgggtccctcaaatgcatccaact

SEQ ID NO: 352099 - DNA, 25 bp, Homo sapien
gtccctcaaatgcatccaactagtt

SEQ ID NO: 352100 - DNA, 25 bp, Homo sapien
ctcaaatgcatccaactagttcccg

SEQ ID NO: 352101 - DNA, 25 bp, Homo sapien
ggattgagcaaaggccttggcacca

SEQ ID NO: 352102 - DNA, 25 bp, Homo sapien
tgagcaaaggccttggcaccagaca

SEQ ID NO: 352103 - DNA, 25 bp, Homo sapien
gcctttcaatgtagatgccctcttt

SEQ ID NO: 352104 - DNA, 25 bp, Homo sapien
gcaagttgcttaaccctgctgagcc

SEQ ID NO: 352105 - DNA, 25 bp, Homo sapien
ctcagtttcctcagaaggagtctgt

SEQ ID NO: 352106 - DNA, 25 bp, Homo sapien
gaaggagtctgtataagcaagggaa

SEQ ID NO: 352107 - DNA, 25 bp, Homo sapien
agatgccctcttttgagcttcctaa

SEQ ID NO: 352108 - DNA, 25 bp, Homo sapien
gagcttcctaacaaaggagctggta

SEQ ID NO: 352109 - DNA, 25 bp, Homo sapien
ggagctggtattagaccccatttta

SEQ ID NO: 352110 - DNA, 25 bp, Homo sapien
tagaccccattttacagtgtgcctg

SEQ ID NO: 352111 - DNA, 25 bp, Homo sapien
ttacagtgtgcctgggtagggaaaa

SEQ ID NO: 352112 - DNA, 25 bp, Homo sapien
gactggactaaaagcatatgttgga

SEQ ID NO: 352113 - DNA, 25 bp, Homo sapien
ggcaaatatatgatctgagactggt

SEQ ID NO: 352114 - DNA, 25 bp, Homo sapien
gatctgagactggtgattaatttac

SEQ ID NO: 352115 - DNA, 25 bp, Homo sapien
gattaatttacagtattggcaccta

SEQ ID NO: 352116 - DNA, 25 bp, Homo sapien
tacagtattggcacctaaagagata

SEQ ID NO: 352117 - DNA, 25 bp, Homo sapien
gagatactgagatgaataacttatt

SEQ ID NO: 352118 - DNA, 25 bp, Homo sapien
tgaataacttattaatttccttctt

SEQ ID NO: 352119 - DNA, 25 bp, Homo sapien
acctgcattttataatggtggaaat

SEQ ID NO: 352120 - DNA, 25 bp, Homo sapien
ggttgggatcagctcttctgatgcc

SEQ ID NO: 352121 - DNA, 25 bp, Homo sapien
tgatgcctggttctgtgacaattac

SEQ ID NO: 352122 - DNA, 25 bp, Homo sapien
tgcctggttctgtgacaattacaaa

SEQ ID NO: 352123 - DNA, 25 bp, Homo sapien
cagtgaccgggtcgcacgtgtcctc

SEQ ID NO: 352124 - DNA, 25 bp, Homo sapien
acgtgtcctcgtggcagctgcaggc

SEQ ID NO: 352125 - DNA, 25 bp, Homo sapien
aggcctgagcacagtccgcgccgtg

SEQ ID NO: 352126 - DNA, 25 bp, Homo sapien
gtccgggcgggcacgtcacgttaca

SEQ ID NO: 352127 - DNA, 25 bp, Homo sapien
ggcagcgccccgactggaagtcgca

SEQ ID NO: 352128 - DNA, 25 bp, Homo sapien
gaagtcgcagtgtccgctgccgcag

SEQ ID NO: 352129 - DNA, 25 bp, Homo sapien
cagtcggcgcacacgaaggcgcagt

SEQ ID NO: 352130 - DNA, 25 bp, Homo sapien
gcagtcctcgccgtaagtgccattg

SEQ ID NO: 352131 - DNA, 25 bp, Homo sapien
aagtgccattgctacacttggtctc

SEQ ID NO: 352132 - DNA, 25 bp, Homo sapien
ttgctacacttggtctcgcaccggt

SEQ ID NO: 352133 - DNA, 25 bp, Homo sapien
catcacgcccttgcgctggttggtt

SEQ ID NO: 352134 - DNA, 25 bp, Homo sapien
ttttatgaggtgaagtgcatcaaac

SEQ ID NO: 352135 - DNA, 25 bp, Homo sapien
tatgaggtgaagtgcatcaaacttg

SEQ ID NO: 352136 - DNA, 25 bp, Homo sapien
ccactccttgaagaaagatatgaga

SEQ ID NO: 352137 - DNA, 25 bp, Homo sapien
gagacatttagaagtgattcctgct

SEQ ID NO: 352138 - DNA, 25 bp, Homo sapien
atttagaagtgattcctgctttcag

SEQ ID NO: 352139 - DNA, 25 bp, Homo sapien
agaagtgattcctgctttcagaagg

SEQ ID NO: 352140 - DNA, 25 bp, Homo sapien
aagtgattcctgctttcagaaggag

SEQ ID NO: 352141 - DNA, 25 bp, Homo sapien
aaggaggtggattcaaatacatcaa

SEQ ID NO: 352142 - DNA, 25 bp, Homo sapien
aatacatcaaaagtcccttcctctg

SEQ ID NO: 352143 - DNA, 25 bp, Homo sapien
tcccttcctctgctaagtgtttata

SEQ ID NO: 352144 - DNA, 25 bp, Homo sapien
ccttcctctgctaagtgtttatagt

SEQ ID NO: 352145 - DNA, 25 bp, Homo sapien
caaagagcaagtacaggagctgttc

SEQ ID NO: 352146 - DNA, 25 bp, Homo sapien
gtacaggagctgttcaagatcatgt

SEQ ID NO: 352147 - DNA, 25 bp, Homo sapien
gcaaaatataatgctctgctataga

SEQ ID NO: 352148 - DNA, 25 bp, Homo sapien
tgaaatgtgacttgtaccgactgct

SEQ ID NO: 352149 - DNA, 25 bp, Homo sapien
aatgtgacttgtaccgactgctgaa

SEQ ID NO: 352150 - DNA, 25 bp, Homo sapien
gacttgtaccgactgctgaagttgt

SEQ ID NO: 352151 - DNA, 25 bp, Homo sapien
taccgactgctgaagttgtcttgat

SEQ ID NO: 352152 - DNA, 25 bp, Homo sapien
gctgaagttgtcttgatgtttgaga

SEQ ID NO: 352153 - DNA, 25 bp, Homo sapien
aaatagtagtagtctttaagtgtag

SEQ ID NO: 352154 - DNA, 25 bp, Homo sapien
aacacaaacatgtaaatggcttaat

SEQ ID NO: 352155 - DNA, 25 bp, Homo sapien
gattcttttagccaattgtttacaa

SEQ ID NO: 352156 - DNA, 25 bp, Homo sapien
aacatctgccaagacatcatctgga

SEQ ID NO: 352157 - DNA, 25 bp, Homo sapien
ggatccaggattcctccatctgtat

SEQ ID NO: 352158 - DNA, 25 bp, Homo sapien
gattcctccatctgtatattctaag

SEQ ID NO: 352159 - DNA, 25 bp, Homo sapien
tgaatcttcacccagtaaccaggac

SEQ ID NO: 352160 - DNA, 25 bp, Homo sapien
tgctgggtgagctcgccgacgcgca

SEQ ID NO: 352161 - DNA, 25 bp, Homo sapien
gtcctgccgaagcacacggtcactt

SEQ ID NO: 352162 - DNA, 25 bp, Homo sapien
gggctctcaatcttgtggagtggtt

SEQ ID NO: 352163 - DNA, 25 bp, Homo sapien
ggttcttgttcttcaaacacagcaa

SEQ ID NO: 352164 - DNA, 25 bp, Homo sapien
gttcttcaaacacagcaatcagctt

SEQ ID NO: 352165 - DNA, 25 bp, Homo sapien
cagcaatcagcttgtctttatcttc

SEQ ID NO: 352166 - DNA, 25 bp, Homo sapien
gtctttatcttcaacaacatctgcc

SEQ ID NO: 352167 - DNA, 25 bp, Homo sapien
aataagtaatacatttctgcccaag

SEQ ID NO: 352168 - DNA, 25 bp, Homo sapien
ataagtaatacatttctgcccaagt

SEQ ID NO: 352169 - DNA, 25 bp, Homo sapien
taagtaatacatttctgcccaagta

SEQ ID NO: 352170 - DNA, 25 bp, Homo sapien
agtaatacatttctgcccaagtaag

SEQ ID NO: 352171 - DNA, 25 bp, Homo sapien
gtaatacatttctgcccaagtaaga

SEQ ID NO: 352172 - DNA, 25 bp, Homo sapien
taatacatttctgcccaagtaagag

SEQ ID NO: 352173 - DNA, 25 bp, Homo sapien
tacatttctgcccaagtaagagcct

SEQ ID NO: 352174 - DNA, 25 bp, Homo sapien
acatttctgcccaagtaagagcctt

SEQ ID NO: 352175 - DNA, 25 bp, Homo sapien
atttctgcccaagtaagagccttcc

SEQ ID NO: 352176 - DNA, 25 bp, Homo sapien
tttctgcccaagtaagagccttccc

SEQ ID NO: 352177 - DNA, 25 bp, Homo sapien
tctgcccaagtaagagccttccctt

SEQ ID NO: 352178 - DNA, 25 bp, Homo sapien
aaaatccttaattcagggccgacat

SEQ ID NO: 352179 - DNA, 25 bp, Homo sapien
aattcagggccgacattatctactt

SEQ ID NO: 352180 - DNA, 25 bp, Homo sapien
gggccgacattatctacttaaacaa

SEQ ID NO: 352181 - DNA, 25 bp, Homo sapien
aacaactttgagatatggtcttaat

SEQ ID NO: 352182 - DNA, 25 bp, Homo sapien
gagactatataggtcatttagtata

SEQ ID NO: 352183 - DNA, 25 bp, Homo sapien
attcttcattagtttacgaaccaca

SEQ ID NO: 352184 - DNA, 25 bp, Homo sapien
tagtttacgaaccacaaaattgcaa

SEQ ID NO: 352185 - DNA, 25 bp, Homo sapien
agctatgaactttgatgtacactat

SEQ ID NO: 352186 - DNA, 25 bp, Homo sapien
gatgtacactataaatctccttaat

SEQ ID NO: 352187 - DNA, 25 bp, Homo sapien
ataaatttgtgtctgtaacctgaat

SEQ ID NO: 352188 - DNA, 25 bp, Homo sapien
gtgtctgtaacctgaatagtttgaa

SEQ ID NO: 352189 - DNA, 25 bp, Homo sapien
aggcatggagaccaaacacagccca

SEQ ID NO: 352190 - DNA, 25 bp, Homo sapien
acacagcccactagaggttggcagt

SEQ ID NO: 352191 - DNA, 25 bp, Homo sapien
gttggcagtgagagttctgaagacc

SEQ ID NO: 352192 - DNA, 25 bp, Homo sapien
ctgaagaccagtatgatgacttgta

SEQ ID NO: 352193 - DNA, 25 bp, Homo sapien
gacttgtatgtgttcattcctggtg

SEQ ID NO: 352194 - DNA, 25 bp, Homo sapien
gttcattcctggtgctgatccagaa

SEQ ID NO: 352195 - DNA, 25 bp, Homo sapien
aagagccactcatgagcagcagacc

SEQ ID NO: 352196 - DNA, 25 bp, Homo sapien
gcgacctgtagctaatgccttccaa

SEQ ID NO: 352197 - DNA, 25 bp, Homo sapien
gtagctaatgccttccaactggaaa

SEQ ID NO: 352198 - DNA, 25 bp, Homo sapien
aactggaaagacctcacttcacctt

SEQ ID NO: 352199 - DNA, 25 bp, Homo sapien
gggtcatcctggtgttagacaagaa

SEQ ID NO: 352200 - DNA, 25 bp, Homo sapien
accaaaactctcaagatagtgtgtg

SEQ ID NO: 352201 - DNA, 25 bp, Homo sapien
agtgtgtgaggtcttatcatgtgac

SEQ ID NO: 352202 - DNA, 25 bp, Homo sapien
ccttccagtttctctacacgtatat

SEQ ID NO: 352203 - DNA, 25 bp, Homo sapien
catcacatgtcagcaggatgctaaa

SEQ ID NO: 352204 - DNA, 25 bp, Homo sapien
atgtcagcaggatgctaaactacat

SEQ ID NO: 352205 - DNA, 25 bp, Homo sapien
aatgtgggtcgcttcacggaggaga

SEQ ID NO: 352206 - DNA, 25 bp, Homo sapien
aggagatcgagtggctgaagttttt

SEQ ID NO: 352207 - DNA, 25 bp, Homo sapien
ctgaagtttttagcccttgcttgca

SEQ ID NO: 352208 - DNA, 25 bp, Homo sapien
aagtttttagcccttgcttgcagcg

SEQ ID NO: 352209 - DNA, 25 bp, Homo sapien
gcttgcagcgctctgggagttacta

SEQ ID NO: 352210 - DNA, 25 bp, Homo sapien
gcgctctgggagttactattaccaa

SEQ ID NO: 352211 - DNA, 25 bp, Homo sapien
tgtagttgcgggtccctcgcgaaag

SEQ ID NO: 352212 - DNA, 25 bp, Homo sapien
gggtccctcgcgaaagctcatcatg

SEQ ID NO: 352213 - DNA, 25 bp, Homo sapien
gggtcttttggcaccagccgcaaga

SEQ ID NO: 352214 - DNA, 25 bp, Homo sapien
cagccgcaagacataagaccagtat

SEQ ID NO: 352215 - DNA, 25 bp, Homo sapien
gaccagtatccttggaatagcgcag

SEQ ID NO: 352216 - DNA, 25 bp, Homo sapien
aatagcgcagccagggaaagtcctt

SEQ ID NO: 352217 - DNA, 25 bp, Homo sapien
gaaagtccttgagccaggaggtctg

SEQ ID NO: 352218 - DNA, 25 bp, Homo sapien
cattggagcttctgcattagagact

SEQ ID NO: 352219 - DNA, 25 bp, Homo sapien
cccctcttctgatggtatttctaac

SEQ ID NO: 352220 - DNA, 25 bp, Homo sapien
ttctgatggtatttctaactctggg

SEQ ID NO: 352221 - DNA, 25 bp, Homo sapien
cgttggcttcgtggagtttgtgctc

SEQ ID NO: 352222 - DNA, 25 bp, Homo sapien
agactctagattaaattcctcccgc

SEQ ID NO: 352223 - DNA, 25 bp, Homo sapien
gactctagattaaattcctcccgcg

SEQ ID NO: 352224 - DNA, 25 bp, Homo sapien
gggactcagtggagtcagccacaca

SEQ ID NO: 352225 - DNA, 25 bp, Homo sapien
gtcagccacacaagttaaactctag

SEQ ID NO: 352226 - DNA, 25 bp, Homo sapien
gggacagccacacaagttaaactct

SEQ ID NO: 352227 - DNA, 25 bp, Homo sapien
agccacacaagttaaactctagatt

SEQ ID NO: 352228 - DNA, 25 bp, Homo sapien
actctagattaaattcctcccgcgg

SEQ ID NO: 352229 - DNA, 25 bp, Homo sapien
tctagattaaattcctcccgcggtt

SEQ ID NO: 352230 - DNA, 25 bp, Homo sapien
tagattaaattcctcccgcggttag

SEQ ID NO: 352231 - DNA, 25 bp, Homo sapien
gcccgggactcagtggagtcagcca

SEQ ID NO: 352232 - DNA, 25 bp, Homo sapien
tagactctagattaaattcctcccg

SEQ ID NO: 352233 - DNA, 25 bp, Homo sapien
ggttaatgtgtacattgttctctaa

SEQ ID NO: 352234 - DNA, 25 bp, Homo sapien
gtgtacattgttctctaaaaactag

SEQ ID NO: 352235 - DNA, 25 bp, Homo sapien
aaaaactagatgtcaaggcccacct

SEQ ID NO: 352236 - DNA, 25 bp, Homo sapien
aactagatgtcaaggcccacctgtt

SEQ ID NO: 352237 - DNA, 25 bp, Homo sapien
aatcaagccctcaagcatgtccatt

SEQ ID NO: 352238 - DNA, 25 bp, Homo sapien
aagccctcaagcatgtccatttgcc

SEQ ID NO: 352239 - DNA, 25 bp, Homo sapien
tcaaatactttgactgtacccacct

SEQ ID NO: 352240 - DNA, 25 bp, Homo sapien
ttgactgtacccacctactaaaatc

SEQ ID NO: 352241 - DNA, 25 bp, Homo sapien
tacccacctactaaaatctctctgt

SEQ ID NO: 352242 - DNA, 25 bp, Homo sapien
aaaatctctctgtatgttatcaaat

SEQ ID NO: 352243 - DNA, 25 bp, Homo sapien
gaacacatagagatgctttaaaatt

SEQ ID NO: 352244 - DNA, 25 bp, Homo sapien
gaatttcccacataagggctactca

SEQ ID NO: 352245 - DNA, 25 bp, Homo sapien
agggctactcacttcttaaaagaca

SEQ ID NO: 352246 - DNA, 25 bp, Homo sapien
ttaaaagacaactcatgaatcaagc

SEQ ID NO: 352247 - DNA, 25 bp, Homo sapien
gtctttggcgggttatgaaaatgtc

SEQ ID NO: 352248 - DNA, 25 bp, Homo sapien
atgtcctggaattcgataatggtgt

SEQ ID NO: 352249 - DNA, 25 bp, Homo sapien
aatggtgttggttgcagagtgtttt

SEQ ID NO: 352250 - DNA, 25 bp, Homo sapien
gtttttgcaacatcagttcctggcc

SEQ ID NO: 352251 - DNA, 25 bp, Homo sapien
gttcctggcccagttactgaaggtg

SEQ ID NO: 352252 - DNA, 25 bp, Homo sapien
ggaggagttaagatctaggcaatta

SEQ ID NO: 352253 - DNA, 25 bp, Homo sapien
gaatgaaaggcacccattcatggga

SEQ ID NO: 352254 - DNA, 25 bp, Homo sapien
ggcacccattcatgggaaggcctca

SEQ ID NO: 352255 - DNA, 25 bp, Homo sapien
aatccagggtcatgtctgattccca

SEQ ID NO: 352256 - DNA, 25 bp, Homo sapien
tcatgtctgattcccaggccggtta

SEQ ID NO: 352257 - DNA, 25 bp, Homo sapien
agatgtctcacctgtcgaatgggta

SEQ ID NO: 352258 - DNA, 25 bp, Homo sapien
tctcacctgtcgaatgggtacattc

SEQ ID NO: 352259 - DNA, 25 bp, Homo sapien
aagccaccatgaggacgaaagagaa

SEQ ID NO: 352260 - DNA, 25 bp, Homo sapien
agcaggtttttttcagctctgagca

SEQ ID NO: 352261 - DNA, 25 bp, Homo sapien
tgagcagctctcctttttcagctct

SEQ ID NO: 352262 - DNA, 25 bp, Homo sapien
ttttcagctcttgccgcatctcgga

SEQ ID NO: 352263 - DNA, 25 bp, Homo sapien
acaagacaagttcatgttgtccagt

SEQ ID NO: 352264 - DNA, 25 bp, Homo sapien
ttcatgttgtccagttttgaggtct

SEQ ID NO: 352265 - DNA, 25 bp, Homo sapien
ggctgagagcagaatccagggtcat

SEQ ID NO: 352266 - DNA, 25 bp, Homo sapien
cctgtgtttattgagaagctccaaa

SEQ ID NO: 352267 - DNA, 25 bp, Homo sapien
ttgctgatgggtacccagtgcggct

SEQ ID NO: 352268 - DNA, 25 bp, Homo sapien
cagtgcggctggaatgtcgtgtatt

SEQ ID NO: 352269 - DNA, 25 bp, Homo sapien
gtcgtgtattgggagtgccaccacc

SEQ ID NO: 352270 - DNA, 25 bp, Homo sapien
gtgccaccacctcagatattttgga

SEQ ID NO: 352271 - DNA, 25 bp, Homo sapien
cactgaccgagtgagcatgcaccag

SEQ ID NO: 352272 - DNA, 25 bp, Homo sapien
tgagcatgcaccaggacaaccacgg

SEQ ID NO: 352273 - DNA, 25 bp, Homo sapien
ggacaaccacggctacatctgcctg

SEQ ID NO: 352274 - DNA, 25 bp, Homo sapien
tacatctgcctgctcattcagggag

SEQ ID NO: 352275 - DNA, 25 bp, Homo sapien
gcctgctcattcagggagccacaaa

SEQ ID NO: 352276 - DNA, 25 bp, Homo sapien
gtactgccaggctggacgtttacac

SEQ ID NO: 352277 - DNA, 25 bp, Homo sapien
attatgctgagaatgccaggataac

SEQ ID NO: 352278 - DNA, 25 bp, Homo sapien
gacttcaccaggattgtggtctaca

SEQ ID NO: 352279 - DNA, 25 bp, Homo sapien
tgtggtctacatttacaggcctagt

SEQ ID NO: 352280 - DNA, 25 bp, Homo sapien
acatttacaggcctagtactagaac

SEQ ID NO: 352281 - DNA, 25 bp, Homo sapien
gtactagaactagaccggcttagag

SEQ ID NO: 352282 - DNA, 25 bp, Homo sapien
accggcttagagagtgggagatatc

SEQ ID NO: 352283 - DNA, 25 bp, Homo sapien
tgggagatatccctctgttgtccat

SEQ ID NO: 352284 - DNA, 25 bp, Homo sapien
atccctctgttgtccatcgaaagat

SEQ ID NO: 352285 - DNA, 25 bp, Homo sapien
aatacaggctttcagccgggtgcag

SEQ ID NO: 352286 - DNA, 25 bp, Homo sapien
catagtgagagacctccatcttaag

SEQ ID NO: 352287 - DNA, 25 bp, Homo sapien
gagagacctccatcttaagggaata

SEQ ID NO: 352288 - DNA, 25 bp, Homo sapien
cgtgcctggcctaagcagaaaattt

SEQ ID NO: 352289 - DNA, 25 bp, Homo sapien
ctggcctaagcagaaaatttttatt

SEQ ID NO: 352290 - DNA, 25 bp, Homo sapien
gaaagctatctggtagctcactaaa

SEQ ID NO: 352291 - DNA, 25 bp, Homo sapien
ggtagctcactaaatggacaggaaa

SEQ ID NO: 352292 - DNA, 25 bp, Homo sapien
taagatgttatgattcctccgctgc

SEQ ID NO: 352293 - DNA, 25 bp, Homo sapien
tgttatgattcctccgctgctgtta

SEQ ID NO: 352294 - DNA, 25 bp, Homo sapien
attcctccgctgctgttagactgat

SEQ ID NO: 352295 - DNA, 25 bp, Homo sapien
tccgctgctgttagactgatttctt

SEQ ID NO: 352296 - DNA, 25 bp, Homo sapien
actgatttcttgattgtccctgtgt

SEQ ID NO: 352297 - DNA, 25 bp, Homo sapien
tcttgattgtccctgtgtctgtgag

SEQ ID NO: 352298 - DNA, 25 bp, Homo sapien
ctgtgagtcaccacacttaagatgc

SEQ ID NO: 352299 - DNA, 25 bp, Homo sapien
gttaaggatgttacacttcaaaaga

SEQ ID NO: 352300 - DNA, 25 bp, Homo sapien
ctgtggatttacagggtactgtatg

SEQ ID NO: 352301 - DNA, 25 bp, Homo sapien
gatacatgtgattaaaccaggctaa

SEQ ID NO: 352302 - DNA, 25 bp, Homo sapien
atatccatcacttcactttttggtg

SEQ ID NO: 352303 - DNA, 25 bp, Homo sapien
atcacttcactttttggtggtatga

SEQ ID NO: 352304 - DNA, 25 bp, Homo sapien
cactttttggtggtatgaatattta

SEQ ID NO: 352305 - DNA, 25 bp, Homo sapien
aatctctctctgcaattttcaaata

SEQ ID NO: 352306 - DNA, 25 bp, Homo sapien
aaatatacaatacagttggccctct

SEQ ID NO: 352307 - DNA, 25 bp, Homo sapien
atacaatacagttggccctctatat

SEQ ID NO: 352308 - DNA, 25 bp, Homo sapien
ttggccctctatatctgtgggtttc

SEQ ID NO: 352309 - DNA, 25 bp, Homo sapien
tgggtttcacatcctctcattcatt

SEQ ID NO: 352310 - DNA, 25 bp, Homo sapien
gaggatccagaactacagccggtcc

SEQ ID NO: 352311 - DNA, 25 bp, Homo sapien
aactacagccggtcctcgctgggct

SEQ ID NO: 352312 - DNA, 25 bp, Homo sapien
tacagccggtcctcgctgggctgtt

SEQ ID NO: 352313 - DNA, 25 bp, Homo sapien
gtggacatccaatctcacagcagtc

SEQ ID NO: 352314 - DNA, 25 bp, Homo sapien
tggacatccaatctcacagcagtca

SEQ ID NO: 352315 - DNA, 25 bp, Homo sapien
ggacatccaatctcacagcagtcat

SEQ ID NO: 352316 - DNA, 25 bp, Homo sapien
gacatccaatctcacagcagtcatc

SEQ ID NO: 352317 - DNA, 25 bp, Homo sapien
acatccaatctcacagcagtcatct

SEQ ID NO: 352318 - DNA, 25 bp, Homo sapien
acagcagtcatctcctatgcgggct

SEQ ID NO: 352319 - DNA, 25 bp, Homo sapien
cagcagtcatctcctatgcgggctg

SEQ ID NO: 352320 - DNA, 25 bp, Homo sapien
agatgtctcaatattcctcgtccta

SEQ ID NO: 352321 - DNA, 25 bp, Homo sapien
ggctacttccaatattttcaagctt

SEQ ID NO: 352322 - DNA, 25 bp, Homo sapien
tttcaagcttgggtgatggttgcag

SEQ ID NO: 352323 - DNA, 25 bp, Homo sapien
gatggttgcagttttccaactcgcc

SEQ ID NO: 352324 - DNA, 25 bp, Homo sapien
gcagttttccaactcgccttgtggg

SEQ ID NO: 352325 - DNA, 25 bp, Homo sapien
acaaaccagaatgagtatgccagaa

SEQ ID NO: 352326 - DNA, 25 bp, Homo sapien
gtatgccagaagatctaaactgcag

SEQ ID NO: 352327 - DNA, 25 bp, Homo sapien
acttggcaaatgacagtagtggctc

SEQ ID NO: 352328 - DNA, 25 bp, Homo sapien
gacagtagtggctcaaatcaacctt

SEQ ID NO: 352329 - DNA, 25 bp, Homo sapien
aaaaccgcttgttggacagtgaatc

SEQ ID NO: 352330 - DNA, 25 bp, Homo sapien
ttggacagtgaatctcagtggctgg

SEQ ID NO: 352331 - DNA, 25 bp, Homo sapien
gaaggcatcgtcaaatcaggtgtat

SEQ ID NO: 352332 - DNA, 25 bp, Homo sapien
accttcttttattagtgaactatca

SEQ ID NO: 352333 - DNA, 25 bp, Homo sapien
gtgaactatcaattaactagaactt

SEQ ID NO: 352334 - DNA, 25 bp, Homo sapien
aactagaacttaattgtcacccagc

SEQ ID NO: 352335 - DNA, 25 bp, Homo sapien
agaacttaattgtcacccagcaaat

SEQ ID NO: 352336 - DNA, 25 bp, Homo sapien
aattgtcacccagcaaataggcttg

SEQ ID NO: 352337 - DNA, 25 bp, Homo sapien
tgtcacccagcaaataggcttgccg

SEQ ID NO: 352338 - DNA, 25 bp, Homo sapien
aaggtttaactgatttccatatact

SEQ ID NO: 352339 - DNA, 25 bp, Homo sapien
ccatatactttcctatctttcaaaa

SEQ ID NO: 352340 - DNA, 25 bp, Homo sapien
cccattataatgttctatcaataac

SEQ ID NO: 352341 - DNA, 25 bp, Homo sapien
aataacatttcatagatatctgcat

SEQ ID NO: 352342 - DNA, 25 bp, Homo sapien
tttcatagatatctgcattttttgc

SEQ ID NO: 352343 - DNA, 25 bp, Homo sapien
gtacccggcaacattctgtcttaaa

SEQ ID NO: 352344 - DNA, 25 bp, Homo sapien
ggcgaatcacgagacagatcacctg

SEQ ID NO: 352345 - DNA, 25 bp, Homo sapien
acgagacagatcacctgggcaagag

SEQ ID NO: 352346 - DNA, 25 bp, Homo sapien
gagtcttcttactcctcataggtga

SEQ ID NO: 352347 - DNA, 25 bp, Homo sapien
cttactcctcataggtgaccactgt

SEQ ID NO: 352348 - DNA, 25 bp, Homo sapien
aggtgaccactgttcagtctaccgt

SEQ ID NO: 352349 - DNA, 25 bp, Homo sapien
cagtctaccgtttcttcccagaaat

SEQ ID NO: 352350 - DNA, 25 bp, Homo sapien
atgtgcacatacaagcatatacata

SEQ ID NO: 352351 - DNA, 25 bp, Homo sapien
atatacatatgtctactctttgctt

SEQ ID NO: 352352 - DNA, 25 bp, Homo sapien
atatgtctactctttgcttagcaaa

SEQ ID NO: 352353 - DNA, 25 bp, Homo sapien
gtctactctttgcttagcaaaccat

SEQ ID NO: 352354 - DNA, 25 bp, Homo sapien
agaaatttacctgctgtggcacagc

SEQ ID NO: 352355 - DNA, 25 bp, Homo sapien
gctgctcagcaagtggtcagggcca

SEQ ID NO: 352356 - DNA, 25 bp, Homo sapien
agggctgcaagtgaattctttttaa

SEQ ID NO: 352357 - DNA, 25 bp, Homo sapien
aactatctttctgtctgttccttag

SEQ ID NO: 352358 - DNA, 25 bp, Homo sapien
gtctgttccttagcttactttcagg

SEQ ID NO: 352359 - DNA, 25 bp, Homo sapien
actttcaggtttagattgactttgc

SEQ ID NO: 352360 - DNA, 25 bp, Homo sapien
aatggctcacacacataaaggtcag

SEQ ID NO: 352361 - DNA, 25 bp, Homo sapien
ggtcagacatgatggagccctttcc

SEQ ID NO: 352362 - DNA, 25 bp, Homo sapien
tggagccctttcctcgttttagaat

SEQ ID NO: 352363 - DNA, 25 bp, Homo sapien
agaatttggtccttgttacagccct

SEQ ID NO: 352364 - DNA, 25 bp, Homo sapien
tacagccctgtgaagatagtgacat

SEQ ID NO: 352365 - DNA, 25 bp, Homo sapien
gtaaaagtaaaatcagtcaatcaat

SEQ ID NO: 352366 - DNA, 25 bp, Homo sapien
caattttatcttccatttaaacagg

SEQ ID NO: 352367 - DNA, 25 bp, Homo sapien
tattgcaaatttctgtcctttactg

SEQ ID NO: 352368 - DNA, 25 bp, Homo sapien
aaatttctgtcctttactgatggca

SEQ ID NO: 352369 - DNA, 25 bp, Homo sapien
tctgtcctttactgatggcaactat

SEQ ID NO: 352370 - DNA, 25 bp, Homo sapien
gtcctttactgatggcaactatgca

SEQ ID NO: 352371 - DNA, 25 bp, Homo sapien
ttttaagacatgtaagatccacaca

SEQ ID NO: 352372 - DNA, 25 bp, Homo sapien
gtaagatccacacatgattataata

SEQ ID NO: 352373 - DNA, 25 bp, Homo sapien
taaaaacctgtgagggccacatcat

SEQ ID NO: 352374 - DNA, 25 bp, Homo sapien
tgtgagggccacatcataaccgtac

SEQ ID NO: 352375 - DNA, 25 bp, Homo sapien
gggccacatcataaccgtacgtatg

SEQ ID NO: 352376 - DNA, 25 bp, Homo sapien
tcagaatcagaagaactgctggaag

SEQ ID NO: 352377 - DNA, 25 bp, Homo sapien
aactgctggaagaatcagagcttga

SEQ ID NO: 352378 - DNA, 25 bp, Homo sapien
aagaagatgaatacctaccagattt

SEQ ID NO: 352379 - DNA, 25 bp, Homo sapien
gatgaatacctaccagatttcttct

SEQ ID NO: 352380 - DNA, 25 bp, Homo sapien
tgaatacctaccagatttcttcttt

SEQ ID NO: 352381 - DNA, 25 bp, Homo sapien
ttttttggatgagctctcacttcca

SEQ ID NO: 352382 - DNA, 25 bp, Homo sapien
ttttggatgagctctcacttccact

SEQ ID NO: 352383 - DNA, 25 bp, Homo sapien
gagctctcacttccacttaacaatt

SEQ ID NO: 352384 - DNA, 25 bp, Homo sapien
tgtgtttttccagttctttcttcca

SEQ ID NO: 352385 - DNA, 25 bp, Homo sapien
ctttcttccagttctcattcatttt

SEQ ID NO: 352386 - DNA, 25 bp, Homo sapien
aagccttggagcctgttgtaatgtg

SEQ ID NO: 352387 - DNA, 25 bp, Homo sapien
ggaaggcggcacagcctgttaaaaa

SEQ ID NO: 352388 - DNA, 25 bp, Homo sapien
ggcggcacagcctgttaaaaaagtt

SEQ ID NO: 352389 - DNA, 25 bp, Homo sapien
gcacagcctgttaaaaaagtttgcc

SEQ ID NO: 352390 - DNA, 25 bp, Homo sapien
atgcttccaaaggaggttacagttc

SEQ ID NO: 352391 - DNA, 25 bp, Homo sapien
ggaggttacagttcctgctgcaata

SEQ ID NO: 352392 - DNA, 25 bp, Homo sapien
ggttacagttcctgctgcaatatat

SEQ ID NO: 352393 - DNA, 25 bp, Homo sapien
gttcctgctgcaatatatcagtctt

SEQ ID NO: 352394 - DNA, 25 bp, Homo sapien
tgctgcaatatatcagtcttagaac

SEQ ID NO: 352395 - DNA, 25 bp, Homo sapien
gtcttagaacatgaacaacttgtaa

SEQ ID NO: 352396 - DNA, 25 bp, Homo sapien
tatagttttcacaggaaggcggcac

SEQ ID NO: 352397 - DNA, 25 bp, Homo sapien
gttttcacaggaaggcggcacagcc

SEQ ID NO: 352398 - DNA, 25 bp, Homo sapien
tcaccccaaaggtgcatgggcaggc

SEQ ID NO: 352399 - DNA, 25 bp, Homo sapien
gggaatcggctactccccagagctt

SEQ ID NO: 352400 - DNA, 25 bp, Homo sapien
tcggctactccccagagcttggcgt

SEQ ID NO: 352401 - DNA, 25 bp, Homo sapien
tcacgctggtactcactgcagctgg

SEQ ID NO: 352402 - DNA, 25 bp, Homo sapien
ggacatctgcactaggaagacagga

SEQ ID NO: 352403 - DNA, 25 bp, Homo sapien
ctaggaagacaggacacggcatgga

SEQ ID NO: 352404 - DNA, 25 bp, Homo sapien
gacacggcatggaagctggcctctg

SEQ ID NO: 352405 - DNA, 25 bp, Homo sapien
tctgcccagaagccatgacattctg

SEQ ID NO: 352406 - DNA, 25 bp, Homo sapien
agcctgatgctataaaacgagtgtc

SEQ ID NO: 352407 - DNA, 25 bp, Homo sapien
tttatagctgattgccttttgggag

SEQ ID NO: 352408 - DNA, 25 bp, Homo sapien
tgtctcatgagtcaccccaaaggtg

SEQ ID NO: 352409 - DNA, 25 bp, Homo sapien
gggcgctggccctgcctaggccttt

SEQ ID NO: 352410 - DNA, 25 bp, Homo sapien
tggccctgcctaggcctttttactg

SEQ ID NO: 352411 - DNA, 25 bp, Homo sapien
cctgcctaggcctttttactgcctg

SEQ ID NO: 352412 - DNA, 25 bp, Homo sapien
taggcctttttactgcctgccaccg

SEQ ID NO: 352413 - DNA, 25 bp, Homo sapien
aggcctttttactgcctgccaccgt

SEQ ID NO: 352414 - DNA, 25 bp, Homo sapien
caagatggagggactgcaggctctt

SEQ ID NO: 352415 - DNA, 25 bp, Homo sapien
ggagggactgcaggctcttggagct

SEQ ID NO: 352416 - DNA, 25 bp, Homo sapien
ggactgcaggctcttggagctgggc

SEQ ID NO: 352417 - DNA, 25 bp, Homo sapien
agcagaatcagggacagatggcgcc

SEQ ID NO: 352418 - DNA, 25 bp, Homo sapien
gcagaatcagggacagatggcgccc

SEQ ID NO: 352419 - DNA, 25 bp, Homo sapien
tcttggagctgggctctcgcgggtt

SEQ ID NO: 352420 - DNA, 25 bp, Homo sapien
tttttcttaccttatcagcaaatgt

SEQ ID NO: 352421 - DNA, 25 bp, Homo sapien
tttcttaccttatcagcaaatgtta

SEQ ID NO: 352422 - DNA, 25 bp, Homo sapien
gcaaatgttactttatctgtgatca

SEQ ID NO: 352423 - DNA, 25 bp, Homo sapien
gttactttatctgtgatcaggtcag

SEQ ID NO: 352424 - DNA, 25 bp, Homo sapien
tactttatctgtgatcaggtcagaa

SEQ ID NO: 352425 - DNA, 25 bp, Homo sapien
gatcaggtcagaagtgtaggaagat

SEQ ID NO: 352426 - DNA, 25 bp, Homo sapien
gtgtaggaagattgacttagaacaa

SEQ ID NO: 352427 - DNA, 25 bp, Homo sapien
aatgccaggtggtgtaatagtccct

SEQ ID NO: 352428 - DNA, 25 bp, Homo sapien
aggtggtgtaatagtccctggagta

SEQ ID NO: 352429 - DNA, 25 bp, Homo sapien
tggtgtaatagtccctggagtagat

SEQ ID NO: 352430 - DNA, 25 bp, Homo sapien
atagtccctggagtagattgatttg

SEQ ID NO: 352431 - DNA, 25 bp, Homo sapien
ttgcatttggataacttaggagaac

SEQ ID NO: 352432 - DNA, 25 bp, Homo sapien
gataacttaggagaacctgtcttcc

SEQ ID NO: 352433 - DNA, 25 bp, Homo sapien
agaacctgtcttccccggtttgctg

SEQ ID NO: 352434 - DNA, 25 bp, Homo sapien
tgtcttccccggtttgctgacggaa

SEQ ID NO: 352435 - DNA, 25 bp, Homo sapien
tccccggtttgctgacggaaagtca

SEQ ID NO: 352436 - DNA, 25 bp, Homo sapien
cccggtttgctgacggaaagtcaat

SEQ ID NO: 352437 - DNA, 25 bp, Homo sapien
acggaaagtcaattgtctgaagtac

SEQ ID NO: 352438 - DNA, 25 bp, Homo sapien
gtcaattgtctgaagtactaagctg

SEQ ID NO: 352439 - DNA, 25 bp, Homo sapien
gtctgaagtactaagctgacattct

SEQ ID NO: 352440 - DNA, 25 bp, Homo sapien
gaagtactaagctgacattctcagt

SEQ ID NO: 352441 - DNA, 25 bp, Homo sapien
ctaagctgacattctcagtttttgc

SEQ ID NO: 352442 - DNA, 25 bp, Homo sapien
gacggtggctggttggagtcgtgct

SEQ ID NO: 352443 - DNA, 25 bp, Homo sapien
ggtctgaggtcccttagcaagattg

SEQ ID NO: 352444 - DNA, 25 bp, Homo sapien
gaggtcccttagcaagattgtgtcc

SEQ ID NO: 352445 - DNA, 25 bp, Homo sapien
ggtcccttagcaagattgtgtccag

SEQ ID NO: 352446 - DNA, 25 bp, Homo sapien
ttagcaagattgtgtccagggccat

SEQ ID NO: 352447 - DNA, 25 bp, Homo sapien
agcaagattgtgtccagggccatct

SEQ ID NO: 352448 - DNA, 25 bp, Homo sapien
aagattgtgtccagggccatctctg

SEQ ID NO: 352449 - DNA, 25 bp, Homo sapien
ggctggctgtaaaagtccccagcca

SEQ ID NO: 352450 - DNA, 25 bp, Homo sapien
tggctgtaaaagtccccagccagcc

SEQ ID NO: 352451 - DNA, 25 bp, Homo sapien
tagccagcctgtatccatccctgag

SEQ ID NO: 352452 - DNA, 25 bp, Homo sapien
gccagcctgtatccatccctgagaa

SEQ ID NO: 352453 - DNA, 25 bp, Homo sapien
gggccggcaccatttcccaggagga

SEQ ID NO: 352454 - DNA, 25 bp, Homo sapien
gctgagatcagccttcactgtagga

SEQ ID NO: 352455 - DNA, 25 bp, Homo sapien
gatcagccttcactgtaggaagccc

SEQ ID NO: 352456 - DNA, 25 bp, Homo sapien
taggaagcccctacctggacacaga

SEQ ID NO: 352457 - DNA, 25 bp, Homo sapien
ggctctacctatcgccatcatggca

SEQ ID NO: 352458 - DNA, 25 bp, Homo sapien
atcatggcagcctacatggcattac

SEQ ID NO: 352459 - DNA, 25 bp, Homo sapien
agcctacatggcattacttgtgacc

SEQ ID NO: 352460 - DNA, 25 bp, Homo sapien
attacttgtgaccagggtgccccat

SEQ ID NO: 352461 - DNA, 25 bp, Homo sapien
accagggtgccccatccaggtcggt

SEQ ID NO: 352462 - DNA, 25 bp, Homo sapien
atccaggtcggtctgccctggctgc

SEQ ID NO: 352463 - DNA, 25 bp, Homo sapien
gccaccctctctttgactgcttgtg

SEQ ID NO: 352464 - DNA, 25 bp, Homo sapien
aaccaggcctcaattttgctttggt

SEQ ID NO: 352465 - DNA, 25 bp, Homo sapien
ggcctcaattttgctttggttgaac

SEQ ID NO: 352466 - DNA, 25 bp, Homo sapien
tttgctttggttgaacaggcttggt

SEQ ID NO: 352467 - DNA, 25 bp, Homo sapien
gaacaggcttggttgaagagctttt

SEQ ID NO: 352468 - DNA, 25 bp, Homo sapien
ggttgaagagcttttaatcctattc

SEQ ID NO: 352469 - DNA, 25 bp, Homo sapien
ggtgtacgatccatagcagaatttt

SEQ ID NO: 352470 - DNA, 25 bp, Homo sapien
agtctaagtcagaagagacccagga

SEQ ID NO: 352471 - DNA, 25 bp, Homo sapien
gttctgttggattctttggtccacg

SEQ ID NO: 352472 - DNA, 25 bp, Homo sapien
ttggattctttggtccacggcaatc

SEQ ID NO: 352473 - DNA, 25 bp, Homo sapien
ggtccacggcaatcccaagtaccaa

SEQ ID NO: 352474 - DNA, 25 bp, Homo sapien
aaggtctaatagctttgctgccctg

SEQ ID NO: 352475 - DNA, 25 bp, Homo sapien
gtcctagctacttgcaagcctaagg

SEQ ID NO: 352476 - DNA, 25 bp, Homo sapien
tcctagctacttgcaagcctaaggt

SEQ ID NO: 352477 - DNA, 25 bp, Homo sapien
ctagctacttgcaagcctaaggtgg

SEQ ID NO: 352478 - DNA, 25 bp, Homo sapien
tagctacttgcaagcctaaggtggg

SEQ ID NO: 352479 - DNA, 25 bp, Homo sapien
agctacttgcaagcctaaggtggga

SEQ ID NO: 352480 - DNA, 25 bp, Homo sapien
tacttgcaagcctaaggtgggagga

SEQ ID NO: 352481 - DNA, 25 bp, Homo sapien
agtgagctgtgatgttgccgctaca

SEQ ID NO: 352482 - DNA, 25 bp, Homo sapien
gtgagctgtgatgttgccgctacac

SEQ ID NO: 352483 - DNA, 25 bp, Homo sapien
tgagctgtgatgttgccgctacact

SEQ ID NO: 352484 - DNA, 25 bp, Homo sapien
gagctgtgatgttgccgctacactc

SEQ ID NO: 352485 - DNA, 25 bp, Homo sapien
agctgtgatgttgccgctacactcc

SEQ ID NO: 352486 - DNA, 25 bp, Homo sapien
atgcacgtgcttatttctataccct

SEQ ID NO: 352487 - DNA, 25 bp, Homo sapien
gtgcttatttctatacccttaggaa

SEQ ID NO: 352488 - DNA, 25 bp, Homo sapien
gaaattgtataaaaccacaggacaa

SEQ ID NO: 352489 - DNA, 25 bp, Homo sapien
taggcagagtccaagaacactggca

SEQ ID NO: 352490 - DNA, 25 bp, Homo sapien
acactggcagccaagcgtcttcatt

SEQ ID NO: 352491 - DNA, 25 bp, Homo sapien
caagcgtcttcattccaatctgtac

SEQ ID NO: 352492 - DNA, 25 bp, Homo sapien
cttcattccaatctgtaccctagaa

SEQ ID NO: 352493 - DNA, 25 bp, Homo sapien
atctgtaccctagaagtaggaggct

SEQ ID NO: 352494 - DNA, 25 bp, Homo sapien
taggaggctggtgaaaatgattttt

SEQ ID NO: 352495 - DNA, 25 bp, Homo sapien
gtaagtgcattttagattccaagat

SEQ ID NO: 352496 - DNA, 25 bp, Homo sapien
ataatagatttaatgcacgtgctta

SEQ ID NO: 352497 - DNA, 25 bp, Homo sapien
aagacatccgctccagcggccggaa

SEQ ID NO: 352498 - DNA, 25 bp, Homo sapien
agcgctgccagtacctccagcaatg

SEQ ID NO: 352499 - DNA, 25 bp, Homo sapien
gcaatgacagtaaagcagagacagt

SEQ ID NO: 352500 - DNA, 25 bp, Homo sapien
agacagtgaagaagtcggccaagaa

SEQ ID NO: 352501 - DNA, 25 bp, Homo sapien
ttaagagtaacaaacgccagcggga

SEQ ID NO: 352502 - DNA, 25 bp, Homo sapien
cctctgatacggaggaggctgacag

SEQ ID NO: 352503 - DNA, 25 bp, Homo sapien
aaacgcaggagatcagcaggcccaa

SEQ ID NO: 352504 - DNA, 25 bp, Homo sapien
gcaggagatcagcaggcccaactcg

SEQ ID NO: 352505 - DNA, 25 bp, Homo sapien
gcccaactcgccatctgaaggtgag

SEQ ID NO: 352506 - DNA, 25 bp, Homo sapien
gagttcagacagtcgcagcgtcaac

SEQ ID NO: 352507 - DNA, 25 bp, Homo sapien
cagcgtcaacgatgagggtagcagt

SEQ ID NO: 352508 - DNA, 25 bp, Homo sapien
gggcgctggccctgcctaggccttt

SEQ ID NO: 352509 - DNA, 25 bp, Homo sapien
tggccctgcctaggcctttttactg

SEQ ID NO: 352510 - DNA, 25 bp, Homo sapien
cctgcctaggcctttttactgcctg

SEQ ID NO: 352511 - DNA, 25 bp, Homo sapien
aggcctttttactgcctgccaccgt

SEQ ID NO: 352512 - DNA, 25 bp, Homo sapien
caagatggagggactgcaggctctt

SEQ ID NO: 352513 - DNA, 25 bp, Homo sapien
accgtctcctggtccggaatggttg

SEQ ID NO: 352514 - DNA, 25 bp, Homo sapien
gatggagactccatggaggctccct

SEQ ID NO: 352515 - DNA, 25 bp, Homo sapien
ggagggactgcaggctcttggagct

SEQ ID NO: 352516 - DNA, 25 bp, Homo sapien
agcagaatcagggacagatggcgcc

SEQ ID NO: 352517 - DNA, 25 bp, Homo sapien
gcagaatcagggacagatggcgccc

SEQ ID NO: 352518 - DNA, 25 bp, Homo sapien
caggctcttggagctgggctctcgc

SEQ ID NO: 352519 - DNA, 25 bp, Homo sapien
gtacatacgtagcagtacaagtgca

SEQ ID NO: 352520 - DNA, 25 bp, Homo sapien
catacgtagcagtacaagtgcatat

SEQ ID NO: 352521 - DNA, 25 bp, Homo sapien
tacgtagcagtacaagtgcatataa

SEQ ID NO: 352522 - DNA, 25 bp, Homo sapien
cagtacaagtgcatataaatcctgt

SEQ ID NO: 352523 - DNA, 25 bp, Homo sapien
caagtgcatataaatcctgtaagag

SEQ ID NO: 352524 - DNA, 25 bp, Homo sapien
gtgcatataaatcctgtaagagtat

SEQ ID NO: 352525 - DNA, 25 bp, Homo sapien
aatcctgtaagagtataaatcctat

SEQ ID NO: 352526 - DNA, 25 bp, Homo sapien
tggaatttcaaggtagaaccaaaat

SEQ ID NO: 352527 - DNA, 25 bp, Homo sapien
atttcaaggtagaaccaaaatgtgt

SEQ ID NO: 352528 - DNA, 25 bp, Homo sapien
caaggtagaaccaaaatgtgtggaa

SEQ ID NO: 352529 - DNA, 25 bp, Homo sapien
atgtgtggaatgaatatttcaatga

SEQ ID NO: 352530 - DNA, 25 bp, Homo sapien
ggtggtttctagatagccaggccca

SEQ ID NO: 352531 - DNA, 25 bp, Homo sapien
tagccaggcccaccaagagatattg

SEQ ID NO: 352532 - DNA, 25 bp, Homo sapien
gagatattgccccttgatgagagtc

SEQ ID NO: 352533 - DNA, 25 bp, Homo sapien
cttgatgagagtcaaacaccctgcc

SEQ ID NO: 352534 - DNA, 25 bp, Homo sapien
gaggaaaattggcacctcatctttt

SEQ ID NO: 352535 - DNA, 25 bp, Homo sapien
ggcacctcatcttttaaaggcagta

SEQ ID NO: 352536 - DNA, 25 bp, Homo sapien
atggaattgattttcagtaactgaa

SEQ ID NO: 352537 - DNA, 25 bp, Homo sapien
tcagtaactgaatttgtgcacaaaa

SEQ ID NO: 352538 - DNA, 25 bp, Homo sapien
atttgtgcacaaaacattctaaaca

SEQ ID NO: 352539 - DNA, 25 bp, Homo sapien
attctaaacactagtgaagcctgtt

SEQ ID NO: 352540 - DNA, 25 bp, Homo sapien
ttacgatttcgtttgtttggattca

SEQ ID NO: 352541 - DNA, 25 bp, Homo sapien
ggacacctccaaagatgtctgccaa

SEQ ID NO: 352542 - DNA, 25 bp, Homo sapien
gagaccctcccctaatggcaggaga

SEQ ID NO: 352543 - DNA, 25 bp, Homo sapien
gcaggagatggaccgcagtacctct

SEQ ID NO: 352544 - DNA, 25 bp, Homo sapien
cagtacctctttccccaaggatatg

SEQ ID NO: 352545 - DNA, 25 bp, Homo sapien
caaggatatgggttcggctcgacat

SEQ ID NO: 352546 - DNA, 25 bp, Homo sapien
gctcgacatccggagggcccttgat

SEQ ID NO: 352547 - DNA, 25 bp, Homo sapien
acagcccctatttttcttccagtgg

SEQ ID NO: 352548 - DNA, 25 bp, Homo sapien
ggcataaacttttagatctcctctt

SEQ ID NO: 352549 - DNA, 25 bp, Homo sapien
ccttagcccttggatcaggactagg

SEQ ID NO: 352550 - DNA, 25 bp, Homo sapien
tgctgagctacatcccttttgtcca

SEQ ID NO: 352551 - DNA, 25 bp, Homo sapien
ttttgtccagcccaattatccctac

SEQ ID NO: 352552 - DNA, 25 bp, Homo sapien
cggacggggagcagagacacaataa

SEQ ID NO: 352553 - DNA, 25 bp, Homo sapien
tggggtaaccaaactaaatcgcttg

SEQ ID NO: 352554 - DNA, 25 bp, Homo sapien
gtaaccaaactaaatcgcttggaag

SEQ ID NO: 352555 - DNA, 25 bp, Homo sapien
taaccaaactaaatcgcttggaaga

SEQ ID NO: 352556 - DNA, 25 bp, Homo sapien
ctagcctatccggactgtgcgggag

SEQ ID NO: 352557 - DNA, 25 bp, Homo sapien
tagcctatccggactgtgcgggagg

SEQ ID NO: 352558 - DNA, 25 bp, Homo sapien
agcctatccggactgtgcgggaggc

SEQ ID NO: 352559 - DNA, 25 bp, Homo sapien
gcctatccggactgtgcgggaggcg

SEQ ID NO: 352560 - DNA, 25 bp, Homo sapien
ctatccggactgtgcgggaggcgga

SEQ ID NO: 352561 - DNA, 25 bp, Homo sapien
tatccggactgtgcgggaggcggac

SEQ ID NO: 352562 - DNA, 25 bp, Homo sapien
tccggactgtgcgggaggcggacgg

SEQ ID NO: 352563 - DNA, 25 bp, Homo sapien
caggtttctaacatgcaaattattt

SEQ ID NO: 352564 - DNA, 25 bp, Homo sapien
gtttctaacatgcaaattatttcat

SEQ ID NO: 352565 - DNA, 25 bp, Homo sapien
tctaacatgcaaattatttcataag

SEQ ID NO: 352566 - DNA, 25 bp, Homo sapien
aacatgcaaattatttcataagatg

SEQ ID NO: 352567 - DNA, 25 bp, Homo sapien
aaataagcaggccaggcactgtagc

SEQ ID NO: 352568 - DNA, 25 bp, Homo sapien
aataagcaggccaggcactgtagcc

SEQ ID NO: 352569 - DNA, 25 bp, Homo sapien
ataagcaggccaggcactgtagccc

SEQ ID NO: 352570 - DNA, 25 bp, Homo sapien
aagcaggccaggcactgtagcccat

SEQ ID NO: 352571 - DNA, 25 bp, Homo sapien
agcaggccaggcactgtagcccatg

SEQ ID NO: 352572 - DNA, 25 bp, Homo sapien
gcaggccaggcactgtagcccatgc

SEQ ID NO: 352573 - DNA, 25 bp, Homo sapien
caggccaggcactgtagcccatgcc

SEQ ID NO: 352574 - DNA, 25 bp, Homo sapien
tctccacagtttacttcagcactta

SEQ ID NO: 352575 - DNA, 25 bp, Homo sapien
ttacttcagcacttaaatccccgag

SEQ ID NO: 352576 - DNA, 25 bp, Homo sapien
ttcagcacttaaatccccgaggagt

SEQ ID NO: 352577 - DNA, 25 bp, Homo sapien
ttaaatccccgaggagtctgccctg

SEQ ID NO: 352578 - DNA, 25 bp, Homo sapien
aggagtctgccctgcctagagaagg

SEQ ID NO: 352579 - DNA, 25 bp, Homo sapien
agtctgccctgcctagagaagggcc

SEQ ID NO: 352580 - DNA, 25 bp, Homo sapien
tgccctgcctagagaagggcctctc

SEQ ID NO: 352581 - DNA, 25 bp, Homo sapien
gtgtgtgtccccctgtaaatagcca

SEQ ID NO: 352582 - DNA, 25 bp, Homo sapien
tatatatatttggtctgtttgtagt

SEQ ID NO: 352583 - DNA, 25 bp, Homo sapien
agggccaggcctgacacactgcttt

SEQ ID NO: 352584 - DNA, 25 bp, Homo sapien
aggcctgacacactgctttcttgtt

SEQ ID NO: 352585 - DNA, 25 bp, Homo sapien
cccctatgatctggtttcacagtgt

SEQ ID NO: 352586 - DNA, 25 bp, Homo sapien
actgtacccggcctattatatgctt

SEQ ID NO: 352587 - DNA, 25 bp, Homo sapien
gtacccggcctattatatgcttttt

SEQ ID NO: 352588 - DNA, 25 bp, Homo sapien
acccggcctattatatgctttttat

SEQ ID NO: 352589 - DNA, 25 bp, Homo sapien
ccggcctattatatgctttttatga

SEQ ID NO: 352590 - DNA, 25 bp, Homo sapien
tgctttttatgaagtgattattcac

SEQ ID NO: 352591 - DNA, 25 bp, Homo sapien
gtttcacagtgtaaccctgattgga

SEQ ID NO: 352592 - DNA, 25 bp, Homo sapien
taaccctgattggatgatatacttc

SEQ ID NO: 352593 - DNA, 25 bp, Homo sapien
atatacttcaggcaggtgagaatat

SEQ ID NO: 352594 - DNA, 25 bp, Homo sapien
caggcaggtgagaatataacgtttt

SEQ ID NO: 352595 - DNA, 25 bp, Homo sapien
gagaatataacgtttttcaacttag

SEQ ID NO: 352596 - DNA, 25 bp, Homo sapien
acagatgaggcagtgtgacacagtc

SEQ ID NO: 352597 - DNA, 25 bp, Homo sapien
gacacagtcaagtcacccacaagaa

SEQ ID NO: 352598 - DNA, 25 bp, Homo sapien
aacagccccaggctaggaggacctg

SEQ ID NO: 352599 - DNA, 25 bp, Homo sapien
gtcacccacaagaacgtggcatttt

SEQ ID NO: 352600 - DNA, 25 bp, Homo sapien
aacgtggcatttttgtggtgtttga

SEQ ID NO: 352601 - DNA, 25 bp, Homo sapien
gaaacatttcagctagataagccta

SEQ ID NO: 352602 - DNA, 25 bp, Homo sapien
gcctaaattggcttcctttatagca

SEQ ID NO: 352603 - DNA, 25 bp, Homo sapien
tatagcaaaactacctgccactcat

SEQ ID NO: 352604 - DNA, 25 bp, Homo sapien
cctgccactcattatattcatgcca

SEQ ID NO: 352605 - DNA, 25 bp, Homo sapien
ttcatgccaatatcaggttcctcat

SEQ ID NO: 352606 - DNA, 25 bp, Homo sapien
aactattcttcaaagccagttgtga

SEQ ID NO: 352607 - DNA, 25 bp, Homo sapien
gggatatcagtgaactatgttgtat

SEQ ID NO: 352608 - DNA, 25 bp, Homo sapien
tttccaacagaagtaacaccacagt

SEQ ID NO: 352609 - DNA, 25 bp, Homo sapien
gtaacaccacagttgctttgtttct

SEQ ID NO: 352610 - DNA, 25 bp, Homo sapien
tttctttttatagcttacctgaggt

SEQ ID NO: 352611 - DNA, 25 bp, Homo sapien
atagcttacctgaggttcagttctt

SEQ ID NO: 352612 - DNA, 25 bp, Homo sapien
ctttgtgaacctgtgagtactccac

SEQ ID NO: 352613 - DNA, 25 bp, Homo sapien
tgtgagtactccacagtttactggg

SEQ ID NO: 352614 - DNA, 25 bp, Homo sapien
aaaggcttcagtaaagcagaggcta

SEQ ID NO: 352615 - DNA, 25 bp, Homo sapien
gcagaggctagaattacagtattta

SEQ ID NO: 352616 - DNA, 25 bp, Homo sapien
ttatacatagcaacttttcataaag

SEQ ID NO: 352617 - DNA, 25 bp, Homo sapien
aaggaagctgtctcaatttgagaat

SEQ ID NO: 352618 - DNA, 25 bp, Homo sapien
gaaagaacttgactacacagtatgg

SEQ ID NO: 352619 - DNA, 25 bp, Homo sapien
aagaacttgactacacagtatggct

SEQ ID NO: 352620 - DNA, 25 bp, Homo sapien
gaacttgactacacagtatggctca

SEQ ID NO: 352621 - DNA, 25 bp, Homo sapien
aacttgactacacagtatggctcat

SEQ ID NO: 352622 - DNA, 25 bp, Homo sapien
acttgactacacagtatggctcatg

SEQ ID NO: 352623 - DNA, 25 bp, Homo sapien
ttgactacacagtatggctcatgcc

SEQ ID NO: 352624 - DNA, 25 bp, Homo sapien
tgactacacagtatggctcatgcct

SEQ ID NO: 352625 - DNA, 25 bp, Homo sapien
tgaaccagaatcaagccacttacgc

SEQ ID NO: 352626 - DNA, 25 bp, Homo sapien
gaaccagaatcaagccacttacgct

SEQ ID NO: 352627 - DNA, 25 bp, Homo sapien
cagaatcaagccacttacgctccag

SEQ ID NO: 352628 - DNA, 25 bp, Homo sapien
agaatcaagccacttacgctccagc

SEQ ID NO: 352629 - DNA, 25 bp, Homo sapien
cttaaatccccgaggagtctgccct

SEQ ID NO: 352630 - DNA, 25 bp, Homo sapien
ttaaatccccgaggagtctgccctg

SEQ ID NO: 352631 - DNA, 25 bp, Homo sapien
aggagtctgccctgcctagagaagg

SEQ ID NO: 352632 - DNA, 25 bp, Homo sapien
agtctgccctgcctagagaagggcc

SEQ ID NO: 352633 - DNA, 25 bp, Homo sapien
gtctgccctgcctagagaagggcct

SEQ ID NO: 352634 - DNA, 25 bp, Homo sapien
tctgccctgcctagagaagggcctc

SEQ ID NO: 352635 - DNA, 25 bp, Homo sapien
tgccctgcctagagaagggcctctc

SEQ ID NO: 352636 - DNA, 25 bp, Homo sapien
cctgcctagagaagggcctctcccc

SEQ ID NO: 352637 - DNA, 25 bp, Homo sapien
gtgtgtgtccccctgtaaatagcca

SEQ ID NO: 352638 - DNA, 25 bp, Homo sapien
gtgtgtccccctgtaaatagccagc

SEQ ID NO: 352639 - DNA, 25 bp, Homo sapien
tatatatatttggtctgtttgtagt

SEQ ID NO: 352640 - DNA, 25 bp, Homo sapien
gaccttgtcttgaaacaaacacaaa

SEQ ID NO: 352641 - DNA, 25 bp, Homo sapien
ggatggagtcaactgtgccccagac

SEQ ID NO: 352642 - DNA, 25 bp, Homo sapien
gatggagtcaactgtgccccagaca

SEQ ID NO: 352643 - DNA, 25 bp, Homo sapien
tggagtcaactgtgccccagacatt

SEQ ID NO: 352644 - DNA, 25 bp, Homo sapien
tcaactgtgccccagacattaagcg

SEQ ID NO: 352645 - DNA, 25 bp, Homo sapien
caactgtgccccagacattaagcgc

SEQ ID NO: 352646 - DNA, 25 bp, Homo sapien
tgtgccccagacattaagcgccctt

SEQ ID NO: 352647 - DNA, 25 bp, Homo sapien
ccagacattaagcgcccttcagtga

SEQ ID NO: 352648 - DNA, 25 bp, Homo sapien
tgtgtggcccacaggagtcagaact

SEQ ID NO: 352649 - DNA, 25 bp, Homo sapien
gtgtggcccacaggagtcagaactc

SEQ ID NO: 352650 - DNA, 25 bp, Homo sapien
tgtggcccacaggagtcagaactcg

SEQ ID NO: 352651 - DNA, 25 bp, Homo sapien
aactacagccggtcctcgctgggct

SEQ ID NO: 352652 - DNA, 25 bp, Homo sapien
actacagccggtcctcgctgggctg

SEQ ID NO: 352653 - DNA, 25 bp, Homo sapien
tacagccggtcctcgctgggctgtt

SEQ ID NO: 352654 - DNA, 25 bp, Homo sapien
acagccggtcctcgctgggctgttc

SEQ ID NO: 352655 - DNA, 25 bp, Homo sapien
gtggacatccaatctcacagcagtc

SEQ ID NO: 352656 - DNA, 25 bp, Homo sapien
tggacatccaatctcacagcagtca

SEQ ID NO: 352657 - DNA, 25 bp, Homo sapien
ggacatccaatctcacagcagtcat

SEQ ID NO: 352658 - DNA, 25 bp, Homo sapien
gacatccaatctcacagcagtcatc

SEQ ID NO: 352659 - DNA, 25 bp, Homo sapien
acatccaatctcacagcagtcatct

SEQ ID NO: 352660 - DNA, 25 bp, Homo sapien
acagcagtcatctcctatgcgggct

SEQ ID NO: 352661 - DNA, 25 bp, Homo sapien
cagcagtcatctcctatgcgggctg

SEQ ID NO: 352662 - DNA, 25 bp, Homo sapien
aggactgtccatgtgatggctcttc

SEQ ID NO: 352663 - DNA, 25 bp, Homo sapien
tcttcccgtggctccatttctaagc

SEQ ID NO: 352664 - DNA, 25 bp, Homo sapien
atttctaagcgcctccgaggacctc

SEQ ID NO: 352665 - DNA, 25 bp, Homo sapien
cgaggacctcatcgtggcccaggac

SEQ ID NO: 352666 - DNA, 25 bp, Homo sapien
tgagcactggcctcttatttacccg

SEQ ID NO: 352667 - DNA, 25 bp, Homo sapien
tggcctcttatttacccgtctttgt

SEQ ID NO: 352668 - DNA, 25 bp, Homo sapien
cgtctttgtctctggcttgttggta

SEQ ID NO: 352669 - DNA, 25 bp, Homo sapien
ggcttgttggtatctgtcccttgtc

SEQ ID NO: 352670 - DNA, 25 bp, Homo sapien
ccttgtctgattagggaacgcctga

SEQ ID NO: 352671 - DNA, 25 bp, Homo sapien
aggtcaggatctttgcctccccaat

SEQ ID NO: 352672 - DNA, 25 bp, Homo sapien
tctttgcctccccaatcagattgtc

SEQ ID NO: 352673 - DNA, 25 bp, Homo sapien
gaaacttaaagcaacaccaaccaca

SEQ ID NO: 352674 - DNA, 25 bp, Homo sapien
accaaccacacccaaaagtcaagtg

SEQ ID NO: 352675 - DNA, 25 bp, Homo sapien
aagtcaagtgatatccagacagcaa

SEQ ID NO: 352676 - DNA, 25 bp, Homo sapien
gtgatatccagacagcaacagtaga

SEQ ID NO: 352677 - DNA, 25 bp, Homo sapien
agacagcaacagtagagcattaact

SEQ ID NO: 352678 - DNA, 25 bp, Homo sapien
cattaactgagtgcagggccgtggt

SEQ ID NO: 352679 - DNA, 25 bp, Homo sapien
agggccgtggtgactcctcgacact

SEQ ID NO: 352680 - DNA, 25 bp, Homo sapien
gtggtgactcctcgacactccaggc

SEQ ID NO: 352681 - DNA, 25 bp, Homo sapien
tcctgctggtaacctcccattggca

SEQ ID NO: 352682 - DNA, 25 bp, Homo sapien
actcacgacttcagagcagctagga

SEQ ID NO: 352683 - DNA, 25 bp, Homo sapien
gcaagagtcacttcttaagcttttg

SEQ ID NO: 352684 - DNA, 25 bp, Homo sapien
gggactggcacttagcctgtggtct

SEQ ID NO: 352685 - DNA, 25 bp, Homo sapien
gcctgtggtctccaagtttaaatca

SEQ ID NO: 352686 - DNA, 25 bp, Homo sapien
gtctccaagtttaaatcaggcagtg

SEQ ID NO: 352687 - DNA, 25 bp, Homo sapien
gtgattgcgatagcaccagctggca

SEQ ID NO: 352688 - DNA, 25 bp, Homo sapien
tgcgatagcaccagctggcatggcc

SEQ ID NO: 352689 - DNA, 25 bp, Homo sapien
tgagcagggtgctctgcgctccgtg

SEQ ID NO: 352690 - DNA, 25 bp, Homo sapien
gccaagcatttgtgcgtggctgctc

SEQ ID NO: 352691 - DNA, 25 bp, Homo sapien
aagcatttgtgcgtggctgctcccc

SEQ ID NO: 352692 - DNA, 25 bp, Homo sapien
cttctggccatgctgtgaggtgctc

SEQ ID NO: 352693 - DNA, 25 bp, Homo sapien
tgtgaggtgctcttctccgagcaaa

SEQ ID NO: 352694 - DNA, 25 bp, Homo sapien
tcttctccgagcaaaggcagctgag

SEQ ID NO: 352695 - DNA, 25 bp, Homo sapien
gctcaagcatccctcaaaactaaac

SEQ ID NO: 352696 - DNA, 25 bp, Homo sapien
caaaactaaacctatccacacaatc

SEQ ID NO: 352697 - DNA, 25 bp, Homo sapien
atcataaggaaacgagcccctccct

SEQ ID NO: 352698 - DNA, 25 bp, Homo sapien
tccctgcaacaatgacttctgtcga

SEQ ID NO: 352699 - DNA, 25 bp, Homo sapien
acttctgtcgactgggttgtgtatg

SEQ ID NO: 352700 - DNA, 25 bp, Homo sapien
gttgtgtatgttccagtctagcttt

SEQ ID NO: 352701 - DNA, 25 bp, Homo sapien
gtctagctttggagaagcgccaacc

SEQ ID NO: 352702 - DNA, 25 bp, Homo sapien
gccgccgaccagactgcatgtttgg

SEQ ID NO: 352703 - DNA, 25 bp, Homo sapien
gcatgtttggttgtacttgtttgaa

SEQ ID NO: 352704 - DNA, 25 bp, Homo sapien
gcattttcagaggaaggctgctcat

SEQ ID NO: 352705 - DNA, 25 bp, Homo sapien
gctgctcatcgagatccagtatttt

SEQ ID NO: 352706 - DNA, 25 bp, Homo sapien
ggagctcttcagcagtctgaagaag

SEQ ID NO: 352707 - DNA, 25 bp, Homo sapien
gcccagctgtctcttctgcaagaga

SEQ ID NO: 352708 - DNA, 25 bp, Homo sapien
ttctgcaagagagccgtctgcactt

SEQ ID NO: 352709 - DNA, 25 bp, Homo sapien
gtctgcacttcctgtagcataaaga

SEQ ID NO: 352710 - DNA, 25 bp, Homo sapien
agaaatttggacacatccctgtcta

SEQ ID NO: 352711 - DNA, 25 bp, Homo sapien
tccctgtctacacactgggctttga

SEQ ID NO: 352712 - DNA, 25 bp, Homo sapien
agagtcctcagagggtatcagctgc

SEQ ID NO: 352713 - DNA, 25 bp, Homo sapien
gtatcagctgccaaaaccgcgccaa

SEQ ID NO: 352714 - DNA, 25 bp, Homo sapien
aaaccgcgccaatccagagaagaga

SEQ ID NO: 352715 - DNA, 25 bp, Homo sapien
gacatctttcagtctctgcaagggc

SEQ ID NO: 352716 - DNA, 25 bp, Homo sapien
ttcagtctctgcaagggccacagtg

SEQ ID NO: 352717 - DNA, 25 bp, Homo sapien
gtagtcacatacactgctgtggtga

SEQ ID NO: 352718 - DNA, 25 bp, Homo sapien
tcacatacactgctgtggtgatggt

SEQ ID NO: 352719 - DNA, 25 bp, Homo sapien
gctgtggtgatggttccatttacaa

SEQ ID NO: 352720 - DNA, 25 bp, Homo sapien
ggttccatttacaaataaagtctgt

SEQ ID NO: 352721 - DNA, 25 bp, Homo sapien
tttttcttaaagagatgtggcctgt

SEQ ID NO: 352722 - DNA, 25 bp, Homo sapien
ctccatggtaacagtgtaaggtgaa

SEQ ID NO: 352723 - DNA, 25 bp, Homo sapien
ttttgtccagctgtgaatatatttg

SEQ ID NO: 352724 - DNA, 25 bp, Homo sapien
gaagtatttttgtgaagatctctaa

SEQ ID NO: 352725 - DNA, 25 bp, Homo sapien
tctttctttgtttcaagtcattgta

SEQ ID NO: 352726 - DNA, 25 bp, Homo sapien
gtttcaagtcattgtagtcacatac

SEQ ID NO: 352727 - DNA, 25 bp, Homo sapien
gtcattgtagtcacatacactgctg

SEQ ID NO: 352728 - DNA, 25 bp, Homo sapien
gggcttctggtagtgcctcatcaca

SEQ ID NO: 352729 - DNA, 25 bp, Homo sapien
agtgcctcatcacaacccatgatgg

SEQ ID NO: 352730 - DNA, 25 bp, Homo sapien
ccatgatggctgttcatgtttcacc

SEQ ID NO: 352731 - DNA, 25 bp, Homo sapien
ttccttcagcagaggccaggctatg

SEQ ID NO: 352732 - DNA, 25 bp, Homo sapien
aggctatggagcagggccactgaat

SEQ ID NO: 352733 - DNA, 25 bp, Homo sapien
gggccactgaatttgctgtaatctg

SEQ ID NO: 352734 - DNA, 25 bp, Homo sapien
gaatttgctgtaatctggagatgct

SEQ ID NO: 352735 - DNA, 25 bp, Homo sapien
ggagatgctttttactttcaaccat

SEQ ID NO: 352736 - DNA, 25 bp, Homo sapien
ggagtctgggcaagcaaagcataga

SEQ ID NO: 352737 - DNA, 25 bp, Homo sapien
gaaacttgttggtataattgtcata

SEQ ID NO: 352738 - DNA, 25 bp, Homo sapien
gtataattgtcataggacttgccta

SEQ ID NO: 352739 - DNA, 25 bp, Homo sapien
gctagggctgccatcaaaaagtaca

SEQ ID NO: 352740 - DNA, 25 bp, Homo sapien
tcaaaaagtacaggccttcctcgtt

SEQ ID NO: 352741 - DNA, 25 bp, Homo sapien
gtacttcgcagatgttatgcttttt

SEQ ID NO: 352742 - DNA, 25 bp, Homo sapien
gaacgcttgtgggaacgctgtgtaa

SEQ ID NO: 352743 - DNA, 25 bp, Homo sapien
gtgtaagcatgttcgtcggcatcat

SEQ ID NO: 352744 - DNA, 25 bp, Homo sapien
gtcggcatcatttatccaacagcgt

SEQ ID NO: 352745 - DNA, 25 bp, Homo sapien
aacagcgtgtgttgacttcgtgtct

SEQ ID NO: 352746 - DNA, 25 bp, Homo sapien
ttcgtgtctctgtgtagcattttga

SEQ ID NO: 352747 - DNA, 25 bp, Homo sapien
ttgattattctcacagtatcccaga

SEQ ID NO: 352748 - DNA, 25 bp, Homo sapien
atgtctgtgatagtgatctgtcatc

SEQ ID NO: 352749 - DNA, 25 bp, Homo sapien
cctacgaactgcacccatataagac

SEQ ID NO: 352750 - DNA, 25 bp, Homo sapien
gccagatactcctctatgaagttaa

SEQ ID NO: 352751 - DNA, 25 bp, Homo sapien
cagtgttaacactgctagtgagcga

SEQ ID NO: 352752 - DNA, 25 bp, Homo sapien
aacactgctagtgagcgacagagat

SEQ ID NO: 352753 - DNA, 25 bp, Homo sapien
gatggaatttgaacgcacacctgtc

SEQ ID NO: 352754 - DNA, 25 bp, Homo sapien
aatttgaacgcacacctgtctgact

SEQ ID NO: 352755 - DNA, 25 bp, Homo sapien
tgtctgactccacctcgtgttcctt

SEQ ID NO: 352756 - DNA, 25 bp, Homo sapien
gtgttccttccacatggccagcaag

SEQ ID NO: 352757 - DNA, 25 bp, Homo sapien
gtcccacctcgcacttctgggaggt

SEQ ID NO: 352758 - DNA, 25 bp, Homo sapien
tctgggaggtggctactccctcttt

SEQ ID NO: 352759 - DNA, 25 bp, Homo sapien
tcttgacaagggattctaccctgcc

SEQ ID NO: 352760 - DNA, 25 bp, Homo sapien
ggcatactttggacctacatcatgt

SEQ ID NO: 352761 - DNA, 25 bp, Homo sapien
aaaacttctggttatatgtgtcaag

SEQ ID NO: 352762 - DNA, 25 bp, Homo sapien
ataagtaaagcatcatgttcaggaa

SEQ ID NO: 352763 - DNA, 25 bp, Homo sapien
catgttcaggaaagtaagtgttgca

SEQ ID NO: 352764 - DNA, 25 bp, Homo sapien
gcaatgatatggtctgatgtcctct

SEQ ID NO: 352765 - DNA, 25 bp, Homo sapien
tgatatggtctgatgtcctctacat

SEQ ID NO: 352766 - DNA, 25 bp, Homo sapien
tatggtctgatgtcctctacatttg

SEQ ID NO: 352767 - DNA, 25 bp, Homo sapien
ggtctgatgtcctctacatttgata

SEQ ID NO: 352768 - DNA, 25 bp, Homo sapien
gatgtcctctacatttgatatatac

SEQ ID NO: 352769 - DNA, 25 bp, Homo sapien
atatatagtatgtatctgattgtag

SEQ ID NO: 352770 - DNA, 25 bp, Homo sapien
cctctgccacatacctaaattaatc

SEQ ID NO: 352771 - DNA, 25 bp, Homo sapien
agttaataatgccctgaattgactt

SEQ ID NO: 352772 - DNA, 25 bp, Homo sapien
atcagagctactcgtgagcccctgg

SEQ ID NO: 352773 - DNA, 25 bp, Homo sapien
agagctactcgtgagcccctgggtc

SEQ ID NO: 352774 - DNA, 25 bp, Homo sapien
gggagcccttagcttccttccatcc

SEQ ID NO: 352775 - DNA, 25 bp, Homo sapien
tccatcccaagatacggaacctact

SEQ ID NO: 352776 - DNA, 25 bp, Homo sapien
aagatacggaacctactgtggctgg

SEQ ID NO: 352777 - DNA, 25 bp, Homo sapien
gatacggaacctactgtggctggga

SEQ ID NO: 352778 - DNA, 25 bp, Homo sapien
tacggaacctactgtggctgggatc

SEQ ID NO: 352779 - DNA, 25 bp, Homo sapien
ggaacctactgtggctgggatccct

SEQ ID NO: 352780 - DNA, 25 bp, Homo sapien
acctactgtggctgggatccctcag

SEQ ID NO: 352781 - DNA, 25 bp, Homo sapien
tggctgggatccctcagcccactta

SEQ ID NO: 352782 - DNA, 25 bp, Homo sapien
cttacctgggcccttgcctctgcaa

SEQ ID NO: 352783 - DNA, 25 bp, Homo sapien
ttgttctttaaggtttcatcatgaa

SEQ ID NO: 352784 - DNA, 25 bp, Homo sapien
gaatatgtttcaggctcctacactt

SEQ ID NO: 352785 - DNA, 25 bp, Homo sapien
ctcctacacttcctgatatttctga

SEQ ID NO: 352786 - DNA, 25 bp, Homo sapien
agcccagtttcaaagtaataactat

SEQ ID NO: 352787 - DNA, 25 bp, Homo sapien
aaagctactaagtgcatagcattat

SEQ ID NO: 352788 - DNA, 25 bp, Homo sapien
gcatagcattataggtggttatcac

SEQ ID NO: 352789 - DNA, 25 bp, Homo sapien
attatttaagaggtgaccctgccct

SEQ ID NO: 352790 - DNA, 25 bp, Homo sapien
gtgaccctgcccttgattagcttgt

SEQ ID NO: 352791 - DNA, 25 bp, Homo sapien
ctgcccttgattagcttgtcacata

SEQ ID NO: 352792 - DNA, 25 bp, Homo sapien
tagcttgtcacataaaggcagggaa

SEQ ID NO: 352793 - DNA, 25 bp, Homo sapien
agacagttcttgacaaggtactcaa

SEQ ID NO: 352794 - DNA, 25 bp, Homo sapien
catatcctccaatgcaaatgttata

SEQ ID NO: 352795 - DNA, 25 bp, Homo sapien
tatcctccaatgcaaatgttataaa

SEQ ID NO: 352796 - DNA, 25 bp, Homo sapien
taaatcagcctataagtggaggtct

SEQ ID NO: 352797 - DNA, 25 bp, Homo sapien
cagcctataagtggaggtctattct

SEQ ID NO: 352798 - DNA, 25 bp, Homo sapien
gtggaggtctattcttaaactaaca

SEQ ID NO: 352799 - DNA, 25 bp, Homo sapien
ggtctattcttaaactaacatctca

SEQ ID NO: 352800 - DNA, 25 bp, Homo sapien
ctaacatctcatttgtttgagctaa

SEQ ID NO: 352801 - DNA, 25 bp, Homo sapien
gtttgagctaaaagccaaatacttt

SEQ ID NO: 352802 - DNA, 25 bp, Homo sapien
aaatactttaactcatttacccatg

SEQ ID NO: 352803 - DNA, 25 bp, Homo sapien
actcatttacccatgaaaatttttg

SEQ ID NO: 352804 - DNA, 25 bp, Homo sapien
acacaggggcaaacctttataacat

SEQ ID NO: 352805 - DNA, 25 bp, Homo sapien
aagggcatgaggactccatgttctc

SEQ ID NO: 352806 - DNA, 25 bp, Homo sapien
ggcatgaggactccatgttctcagc

SEQ ID NO: 352807 - DNA, 25 bp, Homo sapien
gaggactccatgttctcagccgctg

SEQ ID NO: 352808 - DNA, 25 bp, Homo sapien
tcagccgctgcgaaggtggccaaaa

SEQ ID NO: 352809 - DNA, 25 bp, Homo sapien
agggtgctccaaggcccaatctcgt

SEQ ID NO: 352810 - DNA, 25 bp, Homo sapien
aatctcgtcctgctcagaagctggt

SEQ ID NO: 352811 - DNA, 25 bp, Homo sapien
tcgtcctgctcagaagctggtgggc

SEQ ID NO: 352812 - DNA, 25 bp, Homo sapien
gtgggcccagccttcttggatggtc

SEQ ID NO: 352813 - DNA, 25 bp, Homo sapien
agaagcccagccttacagagtctag

SEQ ID NO: 352814 - DNA, 25 bp, Homo sapien
ttttctgcagcatattaaccccaag

SEQ ID NO: 352815 - DNA, 25 bp, Homo sapien
ttctgcagcatattaaccccaagac

SEQ ID NO: 352816 - DNA, 25 bp, Homo sapien
actgtacccggcctattatatgctt

SEQ ID NO: 352817 - DNA, 25 bp, Homo sapien
ctgtacccggcctattatatgcttt

SEQ ID NO: 352818 - DNA, 25 bp, Homo sapien
tgtacccggcctattatatgctttt

SEQ ID NO: 352819 - DNA, 25 bp, Homo sapien
gtacccggcctattatatgcttttt

SEQ ID NO: 352820 - DNA, 25 bp, Homo sapien
tacccggcctattatatgcttttta

SEQ ID NO: 352821 - DNA, 25 bp, Homo sapien
acccggcctattatatgctttttat

SEQ ID NO: 352822 - DNA, 25 bp, Homo sapien
ccggcctattatatgctttttatga

SEQ ID NO: 352823 - DNA, 25 bp, Homo sapien
tgctttttatgaagtgattattcac

SEQ ID NO: 352824 - DNA, 25 bp, Homo sapien
atatacttcaggcaggtgagaatat

SEQ ID NO: 352825 - DNA, 25 bp, Homo sapien
caggcaggtgagaatataacgtttt

SEQ ID NO: 352826 - DNA, 25 bp, Homo sapien
gagaatataacgtttttcaacttag

SEQ ID NO: 352827 - DNA, 25 bp, Homo sapien
gtagccttcaggactgtcgctgctg

SEQ ID NO: 352828 - DNA, 25 bp, Homo sapien
cttcaggactgtcgctgctgcagcc

SEQ ID NO: 352829 - DNA, 25 bp, Homo sapien
ccatcctgggctaagagcttttgct

SEQ ID NO: 352830 - DNA, 25 bp, Homo sapien
tgggctaagagcttttgctggcctc

SEQ ID NO: 352831 - DNA, 25 bp, Homo sapien
aagagcttttgctggcctcgggttc

SEQ ID NO: 352832 - DNA, 25 bp, Homo sapien
tggcctcgggttctactgagcaaga

SEQ ID NO: 352833 - DNA, 25 bp, Homo sapien
cgggttctactgagcaagagtcccc

SEQ ID NO: 352834 - DNA, 25 bp, Homo sapien
ggcccagcgggctcagtgcagcagg

SEQ ID NO: 352835 - DNA, 25 bp, Homo sapien
gtgggagctgcgcttttaaaataag

SEQ ID NO: 352836 - DNA, 25 bp, Homo sapien
tgttccctttccaggtgtctctgta

SEQ ID NO: 352837 - DNA, 25 bp, Homo sapien
tttccaggtgtctctgtagccttca

SEQ ID NO: 352838 - DNA, 25 bp, Homo sapien
attgagtcaaaatgtcgaatcgaac

SEQ ID NO: 352839 - DNA, 25 bp, Homo sapien
tgtcgaatcgaacattttgaatgaa

SEQ ID NO: 352840 - DNA, 25 bp, Homo sapien
attgcctgatgtttagcagtttgta

SEQ ID NO: 352841 - DNA, 25 bp, Homo sapien
tagcagtttgtattctctaaagctt

SEQ ID NO: 352842 - DNA, 25 bp, Homo sapien
aagttcaggctttctacttactggg

SEQ ID NO: 352843 - DNA, 25 bp, Homo sapien
caggctttctacttactgggaagtt

SEQ ID NO: 352844 - DNA, 25 bp, Homo sapien
tgggaagttggtggtcctcttagtc

SEQ ID NO: 352845 - DNA, 25 bp, Homo sapien
ggtcctcttagtccctgataaatca

SEQ ID NO: 352846 - DNA, 25 bp, Homo sapien
attgtgtaaccgcatagatatgtca

SEQ ID NO: 352847 - DNA, 25 bp, Homo sapien
aaatcaaggcaatcacattcatgtg

SEQ ID NO: 352848 - DNA, 25 bp, Homo sapien
atcacattcatgtgagctggatgaa

SEQ ID NO: 352849 - DNA, 25 bp, Homo sapien
atgtggacttttcatattatgtggt

SEQ ID NO: 352850 - DNA, 25 bp, Homo sapien
tcaagagtgattatggagctagatt

SEQ ID NO: 352851 - DNA, 25 bp, Homo sapien
ttatggagctagatttttaaaaaca

SEQ ID NO: 352852 - DNA, 25 bp, Homo sapien
aaatactaaatgattccttctgttg

SEQ ID NO: 352853 - DNA, 25 bp, Homo sapien
ctaaatgattccttctgttgtaagt

SEQ ID NO: 352854 - DNA, 25 bp, Homo sapien
tatatttgtaacctttgtgaaattg

SEQ ID NO: 352855 - DNA, 25 bp, Homo sapien
gaaaatgtcagctcaaattcttggg

SEQ ID NO: 352856 - DNA, 25 bp, Homo sapien
gtcagctcaaattcttgggagaaca

SEQ ID NO: 352857 - DNA, 25 bp, Homo sapien
gctcaaattcttgggagaacattaa

SEQ ID NO: 352858 - DNA, 25 bp, Homo sapien
tactattaggtgactatgcatttcc

SEQ ID NO: 352859 - DNA, 25 bp, Homo sapien
taggtgactatgcatttccagagaa

SEQ ID NO: 352860 - DNA, 25 bp, Homo sapien
agtgacgacaggaccgtcaccagga

SEQ ID NO: 352861 - DNA, 25 bp, Homo sapien
gaccccagagaagagctggtgttca

SEQ ID NO: 352862 - DNA, 25 bp, Homo sapien
tcactcctgaccccatgcttatttt

SEQ ID NO: 352863 - DNA, 25 bp, Homo sapien
tttacatacgagttggttaccagct

SEQ ID NO: 352864 - DNA, 25 bp, Homo sapien
gagttggttaccagcttttcttgct

SEQ ID NO: 352865 - DNA, 25 bp, Homo sapien
ttttcttgctgtttccttggtatta

SEQ ID NO: 352866 - DNA, 25 bp, Homo sapien
gctgtttccttggtattaaaacaca

SEQ ID NO: 352867 - DNA, 25 bp, Homo sapien
aacacagtagggtagggtacagcca

SEQ ID NO: 352868 - DNA, 25 bp, Homo sapien
tagggtacagccagataaagagcgt

SEQ ID NO: 352869 - DNA, 25 bp, Homo sapien
gataaagagcgttgaggaccctatg

SEQ ID NO: 352870 - DNA, 25 bp, Homo sapien
aaagagcgttgaggaccctatggag

SEQ ID NO: 352871 - DNA, 25 bp, Homo sapien
ggttccctccattacaatattccag

SEQ ID NO: 352872 - DNA, 25 bp, Homo sapien
attccagctcaatcagcagcgtggt

SEQ ID NO: 352873 - DNA, 25 bp, Homo sapien
ggtattgtccatgaagtgattgtag

SEQ ID NO: 352874 - DNA, 25 bp, Homo sapien
ggcaataatgttgtcgtgctgcagc

SEQ ID NO: 352875 - DNA, 25 bp, Homo sapien
gcagtgccagaataactatctcatt

SEQ ID NO: 352876 - DNA, 25 bp, Homo sapien
tctcattcaaggcatcacgacgttc

SEQ ID NO: 352877 - DNA, 25 bp, Homo sapien
gacgttccttctcagacagccgggt

SEQ ID NO: 352878 - DNA, 25 bp, Homo sapien
acagccgggtcaaatcgacttcctt

SEQ ID NO: 352879 - DNA, 25 bp, Homo sapien
ttccacacaaccagtgagtcatcct

SEQ ID NO: 352880 - DNA, 25 bp, Homo sapien
gagtcatcctcggtgcggcggtaca

SEQ ID NO: 352881 - DNA, 25 bp, Homo sapien
gattttgtcatacaggttccctcca

SEQ ID NO: 352882 - DNA, 25 bp, Homo sapien
gaaatgttgcttgaatgactcatga

SEQ ID NO: 352883 - DNA, 25 bp, Homo sapien
aatgtcccaaagtcttctcattctg

SEQ ID NO: 352884 - DNA, 25 bp, Homo sapien
tcttacttctgtagactctagcaga

SEQ ID NO: 352885 - DNA, 25 bp, Homo sapien
gactctagcagagatggcatcctgg

SEQ ID NO: 352886 - DNA, 25 bp, Homo sapien
agagatctgatgcagtggcatgctc

SEQ ID NO: 352887 - DNA, 25 bp, Homo sapien
tcatcccaacctcttatctggtcgt

SEQ ID NO: 352888 - DNA, 25 bp, Homo sapien
tatctggtcgtcttcttcacagaag

SEQ ID NO: 352889 - DNA, 25 bp, Homo sapien
aagagagtctccactggtagagtca

SEQ ID NO: 352890 - DNA, 25 bp, Homo sapien
tctggcaccccgaatgtacgcaggt

SEQ ID NO: 352891 - DNA, 25 bp, Homo sapien
gaatgtacgcaggtctctcgagatc

SEQ ID NO: 352892 - DNA, 25 bp, Homo sapien
aggtctctcgagatcacacgtcaga

SEQ ID NO: 352893 - DNA, 25 bp, Homo sapien
gtagtcacatacactgctgtggtga

SEQ ID NO: 352894 - DNA, 25 bp, Homo sapien
gctgtggtgatggttccatttacaa

SEQ ID NO: 352895 - DNA, 25 bp, Homo sapien
ggttccatttacaaataaagtctgt

SEQ ID NO: 352896 - DNA, 25 bp, Homo sapien
tttttcttaaagagatgtggcctgt

SEQ ID NO: 352897 - DNA, 25 bp, Homo sapien
gtggcctgtctatgtggaattgacc

SEQ ID NO: 352898 - DNA, 25 bp, Homo sapien
ggctgcgatttcattgtcagtgcta

SEQ ID NO: 352899 - DNA, 25 bp, Homo sapien
ctccatggtaacagtgtaaggtgaa

SEQ ID NO: 352900 - DNA, 25 bp, Homo sapien
ttttgtccagctgtgaatatatttg

SEQ ID NO: 352901 - DNA, 25 bp, Homo sapien
gaagtatttttgtgaagatctctaa

SEQ ID NO: 352902 - DNA, 25 bp, Homo sapien
ctttctttgtttcaagtcattgtag

SEQ ID NO: 352903 - DNA, 25 bp, Homo sapien
gtcattgtagtcacatacactgctg

SEQ ID NO: 352904 - DNA, 25 bp, Homo sapien
aataaagattcaagctaaggtaggg

SEQ ID NO: 352905 - DNA, 25 bp, Homo sapien
tcaagctaaggtagggggcccggca

SEQ ID NO: 352906 - DNA, 25 bp, Homo sapien
gcctgaccaacatgaggttgaagcg

SEQ ID NO: 352907 - DNA, 25 bp, Homo sapien
cctgaccaacatgaggttgaagcgg

SEQ ID NO: 352908 - DNA, 25 bp, Homo sapien
ctgaccaacatgaggttgaagcggg

SEQ ID NO: 352909 - DNA, 25 bp, Homo sapien
tgaccaacatgaggttgaagcgggc

SEQ ID NO: 352910 - DNA, 25 bp, Homo sapien
gaccaacatgaggttgaagcgggca

SEQ ID NO: 352911 - DNA, 25 bp, Homo sapien
accaacatgaggttgaagcgggcag

SEQ ID NO: 352912 - DNA, 25 bp, Homo sapien
ccaacatgaggttgaagcgggcaga

SEQ ID NO: 352913 - DNA, 25 bp, Homo sapien
caacatgaggttgaagcgggcagat

SEQ ID NO: 352914 - DNA, 25 bp, Homo sapien
aacatgaggttgaagcgggcagatc

SEQ ID NO: 352915 - DNA, 25 bp, Homo sapien
gggcaaaagctccagcgttctggac

SEQ ID NO: 352916 - DNA, 25 bp, Homo sapien
gcgttctggacaagtgctgagcaat

SEQ ID NO: 352917 - DNA, 25 bp, Homo sapien
cagcatgctgttccctctgggctgt

SEQ ID NO: 352918 - DNA, 25 bp, Homo sapien
tgagcaatgtgtgacccagacgtac

SEQ ID NO: 352919 - DNA, 25 bp, Homo sapien
gtgacccagacgtacagagaggatt

SEQ ID NO: 352920 - DNA, 25 bp, Homo sapien
gcctgttatgtccatcattgcatgc

SEQ ID NO: 352921 - DNA, 25 bp, Homo sapien
atgtccatcattgcatgcgtccata

SEQ ID NO: 352922 - DNA, 25 bp, Homo sapien
atgcgtccataccagggctgcaggc

SEQ ID NO: 352923 - DNA, 25 bp, Homo sapien
aggagaaccttaaagccctcactgc

SEQ ID NO: 352924 - DNA, 25 bp, Homo sapien
gccagaaaatgtatcgggaatccca

SEQ ID NO: 352925 - DNA, 25 bp, Homo sapien
gaatcccaggaggacggcccgactg

SEQ ID NO: 352926 - DNA, 25 bp, Homo sapien
gctcccactgggaacattggagtcc

SEQ ID NO: 352927 - DNA, 25 bp, Homo sapien
attggagtcccagttgcgaaagcga

SEQ ID NO: 352928 - DNA, 25 bp, Homo sapien
agttgcgaaagcgacccgcctagct

SEQ ID NO: 352929 - DNA, 25 bp, Homo sapien
tagcttccgagggacttctctgcga

SEQ ID NO: 352930 - DNA, 25 bp, Homo sapien
gagggacttctctgcgagcaccgca

SEQ ID NO: 352931 - DNA, 25 bp, Homo sapien
gcaggcgtgtgcatttcttcgaatc

SEQ ID NO: 352932 - DNA, 25 bp, Homo sapien
ttcttcgaatctgagaattccagcg

SEQ ID NO: 352933 - DNA, 25 bp, Homo sapien
agaattccagcgaactcgggctcta

SEQ ID NO: 352934 - DNA, 25 bp, Homo sapien
gaactcgggctctaccagagtttaa

SEQ ID NO: 352935 - DNA, 25 bp, Homo sapien
tctaccagagtttaagtcggcccct

SEQ ID NO: 352936 - DNA, 25 bp, Homo sapien
gcgcgggcggaaatcccggaatctc

SEQ ID NO: 352937 - DNA, 25 bp, Homo sapien
gtcagagacgactgttattttattt

SEQ ID NO: 352938 - DNA, 25 bp, Homo sapien
aattatgtctgttctgtttgatcac

SEQ ID NO: 352939 - DNA, 25 bp, Homo sapien
attatgtctgttctgtttgatcaca

SEQ ID NO: 352940 - DNA, 25 bp, Homo sapien
ttatgtctgttctgtttgatcacag

SEQ ID NO: 352941 - DNA, 25 bp, Homo sapien
tatgtctgttctgtttgatcacaga

SEQ ID NO: 352942 - DNA, 25 bp, Homo sapien
atgtctgttctgtttgatcacagag

SEQ ID NO: 352943 - DNA, 25 bp, Homo sapien
tgtctgttctgtttgatcacagagt

SEQ ID NO: 352944 - DNA, 25 bp, Homo sapien
gtctgttctgtttgatcacagagtt

SEQ ID NO: 352945 - DNA, 25 bp, Homo sapien
ctgttctgtttgatcacagagttgc

SEQ ID NO: 352946 - DNA, 25 bp, Homo sapien
gttctgtttgatcacagagttgcaa

SEQ ID NO: 352947 - DNA, 25 bp, Homo sapien
ctgtttgatcacagagttgcaacaa

SEQ ID NO: 352948 - DNA, 25 bp, Homo sapien
ggttcagtcatctgactcgtcagga

SEQ ID NO: 352949 - DNA, 25 bp, Homo sapien
atctgactcgtcaggatgaccagca

SEQ ID NO: 352950 - DNA, 25 bp, Homo sapien
ggatgaccagcagtgctccctgtaa

SEQ ID NO: 352951 - DNA, 25 bp, Homo sapien
tgtaactcgccattatctgaccaat

SEQ ID NO: 352952 - DNA, 25 bp, Homo sapien
tctgaccaattactggagctacttt

SEQ ID NO: 352953 - DNA, 25 bp, Homo sapien
gaggcttctggagctactttataat

SEQ ID NO: 352954 - DNA, 25 bp, Homo sapien
gagtttggaattgtggcttcttgcc

SEQ ID NO: 352955 - DNA, 25 bp, Homo sapien
ggcttcttgcctaacaccaatgaga

SEQ ID NO: 352956 - DNA, 25 bp, Homo sapien
agccaggagtgttttgaggcctagt

SEQ ID NO: 352957 - DNA, 25 bp, Homo sapien
gcctgtgaaacttcgagtgccattc

SEQ ID NO: 352958 - DNA, 25 bp, Homo sapien
gtgccattcatgctcggttcagtca

SEQ ID NO: 352959 - DNA, 25 bp, Homo sapien
gttgaaacatcagacactgttctgg

SEQ ID NO: 352960 - DNA, 25 bp, Homo sapien
ttgaaacatcagacactgttctggt

SEQ ID NO: 352961 - DNA, 25 bp, Homo sapien
gaaacatcagacactgttctggtta

SEQ ID NO: 352962 - DNA, 25 bp, Homo sapien
aacatcagacactgttctggttatg

SEQ ID NO: 352963 - DNA, 25 bp, Homo sapien
acatcagacactgttctggttatga

SEQ ID NO: 352964 - DNA, 25 bp, Homo sapien
atcagacactgttctggttatgatg

SEQ ID NO: 352965 - DNA, 25 bp, Homo sapien
agacactgttctggttatgatggac

SEQ ID NO: 352966 - DNA, 25 bp, Homo sapien
gacactgttctggttatgatggaca

SEQ ID NO: 352967 - DNA, 25 bp, Homo sapien
ccacagtgaaagagacctggtccct

SEQ ID NO: 352968 - DNA, 25 bp, Homo sapien
cacagtgaaagagacctggtccctg

SEQ ID NO: 352969 - DNA, 25 bp, Homo sapien
acagtgaaagagacctggtccctgc

SEQ ID NO: 352970 - DNA, 25 bp, Homo sapien
ctattgtatgcctttgggcaatata

SEQ ID NO: 352971 - DNA, 25 bp, Homo sapien
atgcctttgggcaatatattttttt

SEQ ID NO: 352972 - DNA, 25 bp, Homo sapien
tgcctttgggcaatatattttttta

SEQ ID NO: 352973 - DNA, 25 bp, Homo sapien
catgccctgtctggatttttaaagg

SEQ ID NO: 352974 - DNA, 25 bp, Homo sapien
ttttttaaaatgcagccaaatgcag

SEQ ID NO: 352975 - DNA, 25 bp, Homo sapien
tttttaaaatgcagccaaatgcagt

SEQ ID NO: 352976 - DNA, 25 bp, Homo sapien
aggaaattggctctgtccgtttatt

SEQ ID NO: 352977 - DNA, 25 bp, Homo sapien
ggaaattggctctgtccgtttattt

SEQ ID NO: 352978 - DNA, 25 bp, Homo sapien
gaaattggctctgtccgtttattta

SEQ ID NO: 352979 - DNA, 25 bp, Homo sapien
aaattggctctgtccgtttatttat

SEQ ID NO: 352980 - DNA, 25 bp, Homo sapien
aattggctctgtccgtttatttata

SEQ ID NO: 352981 - DNA, 25 bp, Homo sapien
aagggcatgaggactccatgttctc

SEQ ID NO: 352982 - DNA, 25 bp, Homo sapien
gggcatgaggactccatgttctcag

SEQ ID NO: 352983 - DNA, 25 bp, Homo sapien
gcatgaggactccatgttctcagcc

SEQ ID NO: 352984 - DNA, 25 bp, Homo sapien
atgaggactccatgttctcagccgc

SEQ ID NO: 352985 - DNA, 25 bp, Homo sapien
gaggactccatgttctcagccgctg

SEQ ID NO: 352986 - DNA, 25 bp, Homo sapien
tccatgttctcagccgctgcgaagg

SEQ ID NO: 352987 - DNA, 25 bp, Homo sapien
ttctcagccgctgcgaaggtggcca

SEQ ID NO: 352988 - DNA, 25 bp, Homo sapien
tcagccgctgcgaaggtggccaaaa

SEQ ID NO: 352989 - DNA, 25 bp, Homo sapien
cagccgctgcgaaggtggccaaaac

SEQ ID NO: 352990 - DNA, 25 bp, Homo sapien
ttttctgcagcatattaaccccaag

SEQ ID NO: 352991 - DNA, 25 bp, Homo sapien
ttctgcagcatattaaccccaagac

SEQ ID NO: 352992 - DNA, 25 bp, Homo sapien
aaagccttattagcactgcacctga

SEQ ID NO: 352993 - DNA, 25 bp, Homo sapien
attagcactgcacctgaataatagg

SEQ ID NO: 352994 - DNA, 25 bp, Homo sapien
aataggtcattttgcctcactcatt

SEQ ID NO: 352995 - DNA, 25 bp, Homo sapien
ttgcctcactcatttgccaaagtag

SEQ ID NO: 352996 - DNA, 25 bp, Homo sapien
gccaaagtagccatttctaagttaa

SEQ ID NO: 352997 - DNA, 25 bp, Homo sapien
gaagtttttagataggctcatagcc

SEQ ID NO: 352998 - DNA, 25 bp, Homo sapien
ggctcatagccttgtatttcgtttt

SEQ ID NO: 352999 - DNA, 25 bp, Homo sapien
agctcaatggcagggatactatatt

SEQ ID NO: 353000 - DNA, 25 bp, Homo sapien
gttttcatatagcaaccaccacagt

SEQ ID NO: 353001 - DNA, 25 bp, Homo sapien
tagcaaccaccacagtatattcttg

SEQ ID NO: 353002 - DNA, 25 bp, Homo sapien
cacagtatattcttggtgcttaata

SEQ ID NO: 353003 - DNA, 25 bp, Homo sapien
gtatgaattttgtttaggctgcaat

SEQ ID NO: 353004 - DNA, 25 bp, Homo sapien
gtttaggctgcaatgtttagctttt

SEQ ID NO: 353005 - DNA, 25 bp, Homo sapien
tttagcttttgttaactcctcactc

SEQ ID NO: 353006 - DNA, 25 bp, Homo sapien
tcactcttgctgtcttaagttcatt

SEQ ID NO: 353007 - DNA, 25 bp, Homo sapien
gctgtcttaagttcattactatgtt

SEQ ID NO: 353008 - DNA, 25 bp, Homo sapien
ttactatgtttaatggcctacttgc

SEQ ID NO: 353009 - DNA, 25 bp, Homo sapien
gtttaatggcctacttgccaagata

SEQ ID NO: 353010 - DNA, 25 bp, Homo sapien
ttcatattgaagctgagacttacaa

SEQ ID NO: 353011 - DNA, 25 bp, Homo sapien
taacaagttgagtggcaagcctggt

SEQ ID NO: 353012 - DNA, 25 bp, Homo sapien
aagcctggtatgctgtgtcttattg

SEQ ID NO: 353013 - DNA, 25 bp, Homo sapien
atgctgtgtcttattgccagaatct

SEQ ID NO: 353014 - DNA, 25 bp, Homo sapien
aaaatacccagagggcagagcatga

SEQ ID NO: 353015 - DNA, 25 bp, Homo sapien
aggtcaaggatctattggctgagtc

SEQ ID NO: 353016 - DNA, 25 bp, Homo sapien
aggatctattggctgagtcacggtt

SEQ ID NO: 353017 - DNA, 25 bp, Homo sapien
attggctgagtcacggttgagatac

SEQ ID NO: 353018 - DNA, 25 bp, Homo sapien
agcctcgaccagtactgcgaacaga

SEQ ID NO: 353019 - DNA, 25 bp, Homo sapien
gtactgcgaacagatgtggcacagg

SEQ ID NO: 353020 - DNA, 25 bp, Homo sapien
gaaacgaaatcgaagacatcacaga

SEQ ID NO: 353021 - DNA, 25 bp, Homo sapien
atcgaagacatcacagagacctgga

SEQ ID NO: 353022 - DNA, 25 bp, Homo sapien
cctggatgagctccctagagctgta

SEQ ID NO: 353023 - DNA, 25 bp, Homo sapien
agctccctagagctgtagccacgta

SEQ ID NO: 353024 - DNA, 25 bp, Homo sapien
agagctgtagccacgtagttttcta

SEQ ID NO: 353025 - DNA, 25 bp, Homo sapien
tctctccggtgaatggccgagggct

SEQ ID NO: 353026 - DNA, 25 bp, Homo sapien
cacacatacacatgccttccaaatg

SEQ ID NO: 353027 - DNA, 25 bp, Homo sapien
aatgtgcatggcttgggattcgcgt

SEQ ID NO: 353028 - DNA, 25 bp, Homo sapien
ggattcgcgtatttgtttaagagac

SEQ ID NO: 353029 - DNA, 25 bp, Homo sapien
gtttaagagacgacggccacatcct

SEQ ID NO: 353030 - DNA, 25 bp, Homo sapien
agagacgacggccacatccttttgt

SEQ ID NO: 353031 - DNA, 25 bp, Homo sapien
acatccttttgttcggcgttcagca

SEQ ID NO: 353032 - DNA, 25 bp, Homo sapien
tttgttcggcgttcagcagactcct

SEQ ID NO: 353033 - DNA, 25 bp, Homo sapien
cagactcctccgagttccgggattt

SEQ ID NO: 353034 - DNA, 25 bp, Homo sapien
gggatttctcccgactgaggcgtct

SEQ ID NO: 353035 - DNA, 25 bp, Homo sapien
gatgaagcccgtctaactgctgcgc

SEQ ID NO: 353036 - DNA, 25 bp, Homo sapien
tcgccccaagcaagccagtgagcag

SEQ ID NO: 353037 - DNA, 25 bp, Homo sapien
agcaagccagtgagcagccctgcca

SEQ ID NO: 353038 - DNA, 25 bp, Homo sapien
ctgccagactactgccagactgaga

SEQ ID NO: 353039 - DNA, 25 bp, Homo sapien
actgccagactgagaaacccagaag

SEQ ID NO: 353040 - DNA, 25 bp, Homo sapien
agctggtagtcatgtgggcttgcct

SEQ ID NO: 353041 - DNA, 25 bp, Homo sapien
atgtgggcttgccttctctgccaaa

SEQ ID NO: 353042 - DNA, 25 bp, Homo sapien
ccttctctgccaaacgactgggaaa

SEQ ID NO: 353043 - DNA, 25 bp, Homo sapien
ggaaaccaaaatgagcccaccttgt

SEQ ID NO: 353044 - DNA, 25 bp, Homo sapien
aaaatgagcccaccttgtgttcttc

SEQ ID NO: 353045 - DNA, 25 bp, Homo sapien
tgctatagttcccagctgctgtaac

SEQ ID NO: 353046 - DNA, 25 bp, Homo sapien
gttcccagctgctgtaacggagcca

SEQ ID NO: 353047 - DNA, 25 bp, Homo sapien
ctcttctgcccaacaatgcaaagaa

SEQ ID NO: 353048 - DNA, 25 bp, Homo sapien
gctgggagccaaacccaggctggac

SEQ ID NO: 353049 - DNA, 25 bp, Homo sapien
caggctggactcttaaccagctgat

SEQ ID NO: 353050 - DNA, 25 bp, Homo sapien
caaggattctgctgaccgggtgctg

SEQ ID NO: 353051 - DNA, 25 bp, Homo sapien
tggactcttaaccagctgatctaag

SEQ ID NO: 353052 - DNA, 25 bp, Homo sapien
taaccagctgatctaagagaggaag

SEQ ID NO: 353053 - DNA, 25 bp, Homo sapien
ggaagggagaagctcccacttctgc

SEQ ID NO: 353054 - DNA, 25 bp, Homo sapien
ccacttctgccccataatgcaaaga

SEQ ID NO: 353055 - DNA, 25 bp, Homo sapien
ctggagctgggaaccacagtcaggc

SEQ ID NO: 353056 - DNA, 25 bp, Homo sapien
ctgggaaccacagtcaggctgggcc

SEQ ID NO: 353057 - DNA, 25 bp, Homo sapien
tcaggctgggcccgagttttaacca

SEQ ID NO: 353058 - DNA, 25 bp, Homo sapien
atctgcgcccctgagaataatgagg

SEQ ID NO: 353059 - DNA, 25 bp, Homo sapien
tgcgcccctgagaataatgaggaaa

SEQ ID NO: 353060 - DNA, 25 bp, Homo sapien
gaaagtgcacacttggaggagagca

SEQ ID NO: 353061 - DNA, 25 bp, Homo sapien
tgcacacttggaggagagcagtccc

SEQ ID NO: 353062 - DNA, 25 bp, Homo sapien
tggcacccagcatcactacctgcct

SEQ ID NO: 353063 - DNA, 25 bp, Homo sapien
ctgctgctcagaaggtgggctctaa

SEQ ID NO: 353064 - DNA, 25 bp, Homo sapien
tgctgctcagaaggtgggctctaat

SEQ ID NO: 353065 - DNA, 25 bp, Homo sapien
ctgctcagaaggtgggctctaatgg

SEQ ID NO: 353066 - DNA, 25 bp, Homo sapien
ggaacccagggtccaacgtgcagac

SEQ ID NO: 353067 - DNA, 25 bp, Homo sapien
agggtccaacgtgcagacccacggg

SEQ ID NO: 353068 - DNA, 25 bp, Homo sapien
gcttgaaaagaagggactgttagtt

SEQ ID NO: 353069 - DNA, 25 bp, Homo sapien
actgtcctaggatacttctcttgag

SEQ ID NO: 353070 - DNA, 25 bp, Homo sapien
ggatacttctcttgaggctttggaa

SEQ ID NO: 353071 - DNA, 25 bp, Homo sapien
aaatttgcatatccactccagttct

SEQ ID NO: 353072 - DNA, 25 bp, Homo sapien
actccagttctgtcaccaaagattt

SEQ ID NO: 353073 - DNA, 25 bp, Homo sapien
atcttcagatcgcaatttcctctct

SEQ ID NO: 353074 - DNA, 25 bp, Homo sapien
tcaagggatatgctttggtggtcaa

SEQ ID NO: 353075 - DNA, 25 bp, Homo sapien
gattacactatggttttccttctgt

SEQ ID NO: 353076 - DNA, 25 bp, Homo sapien
ttccttctgttcacaatggtattta

SEQ ID NO: 353077 - DNA, 25 bp, Homo sapien
ggtatttacaggagaccttgtcatc

SEQ ID NO: 353078 - DNA, 25 bp, Homo sapien
gagaccttgtcatcagaggacgtac

SEQ ID NO: 353079 - DNA, 25 bp, Homo sapien
gaggacgtactgaactatctttatg

SEQ ID NO: 353080 - DNA, 25 bp, Homo sapien
tggcccttcagtcgctgtcagaaac

SEQ ID NO: 353081 - DNA, 25 bp, Homo sapien
agaaaccccatctcatgctcggatg

SEQ ID NO: 353082 - DNA, 25 bp, Homo sapien
tcggatgccccgagtgactgtggct

SEQ ID NO: 353083 - DNA, 25 bp, Homo sapien
aacattggaaatctctcctctacgc

SEQ ID NO: 353084 - DNA, 25 bp, Homo sapien
gaaaccacaggagctcgggacacac

SEQ ID NO: 353085 - DNA, 25 bp, Homo sapien
gacacacgtgctttcgggagagaat

SEQ ID NO: 353086 - DNA, 25 bp, Homo sapien
gaatgctgagagtctcttgccgact

SEQ ID NO: 353087 - DNA, 25 bp, Homo sapien
ttgccgactctctcttgacttgagt

SEQ ID NO: 353088 - DNA, 25 bp, Homo sapien
tgacttgagttcttcgtgggtgcgt

SEQ ID NO: 353089 - DNA, 25 bp, Homo sapien
gacgtagtgagaccagatgtattaa

SEQ ID NO: 353090 - DNA, 25 bp, Homo sapien
gatgtattaactcaggccgggtgct

SEQ ID NO: 353091 - DNA, 25 bp, Homo sapien
ggctgtaacttcacaatcctaatac

SEQ ID NO: 353092 - DNA, 25 bp, Homo sapien
gtaacttcacaatcctaatacagta

SEQ ID NO: 353093 - DNA, 25 bp, Homo sapien
acagtaaatgttttgcatcttccat

SEQ ID NO: 353094 - DNA, 25 bp, Homo sapien
gtaaatgttttgcatcttccatgtt

SEQ ID NO: 353095 - DNA, 25 bp, Homo sapien
tgttttgcatcttccatgttttatg

SEQ ID NO: 353096 - DNA, 25 bp, Homo sapien
aataattgtgccctagactgaaggt

SEQ ID NO: 353097 - DNA, 25 bp, Homo sapien
aattgtgccctagactgaaggttaa

SEQ ID NO: 353098 - DNA, 25 bp, Homo sapien
gtgccctagactgaaggttaatgtt

SEQ ID NO: 353099 - DNA, 25 bp, Homo sapien
tttttggaaaggaaggatacatatt

SEQ ID NO: 353100 - DNA, 25 bp, Homo sapien
gaatgcattttattggtacaagact

SEQ ID NO: 353101 - DNA, 25 bp, Homo sapien
gcattttattggtacaagactgttt

SEQ ID NO: 353102 - DNA, 25 bp, Homo sapien
gaaggaaaatgcaaccagcatgatt

SEQ ID NO: 353103 - DNA, 25 bp, Homo sapien
ctttggttttcttcaaacataggtg

SEQ ID NO: 353104 - DNA, 25 bp, Homo sapien
aaacactgccattcacaagtcaagg

SEQ ID NO: 353105 - DNA, 25 bp, Homo sapien
tcacaagtcaaggaacccagggcca

SEQ ID NO: 353106 - DNA, 25 bp, Homo sapien
tgtggagcacacatgctgtggagca

SEQ ID NO: 353107 - DNA, 25 bp, Homo sapien
agcacacatgctgtggagcacacat

SEQ ID NO: 353108 - DNA, 25 bp, Homo sapien
agcacacatgctgtggagattgcag

SEQ ID NO: 353109 - DNA, 25 bp, Homo sapien
atgctgtggagattgcagtgtgtct

SEQ ID NO: 353110 - DNA, 25 bp, Homo sapien
cagtgtgtctgaggtttgtgtagta

SEQ ID NO: 353111 - DNA, 25 bp, Homo sapien
ggaagattttaggtatgtagagcaa

SEQ ID NO: 353112 - DNA, 25 bp, Homo sapien
aaaatggattgagactgcatggtgg

SEQ ID NO: 353113 - DNA, 25 bp, Homo sapien
ttatgttcatgtcagggtgctctca

SEQ ID NO: 353114 - DNA, 25 bp, Homo sapien
atgtcagggtgctctcaggaaaatg

SEQ ID NO: 353115 - DNA, 25 bp, Homo sapien
gctctcaggaaaatgcttagcatct

SEQ ID NO: 353116 - DNA, 25 bp, Homo sapien
aaatgcttagcatcttgtaaaactg

SEQ ID NO: 353117 - DNA, 25 bp, Homo sapien
actgcaaatgttagatatcatcaac

SEQ ID NO: 353118 - DNA, 25 bp, Homo sapien
atctccctgaaacaattcaaattgg

SEQ ID NO: 353119 - DNA, 25 bp, Homo sapien
caagcagagtgcaagtctaggactt

SEQ ID NO: 353120 - DNA, 25 bp, Homo sapien
taggacttatttggagtctcaccaa

SEQ ID NO: 353121 - DNA, 25 bp, Homo sapien
gggcactggacactttcctatattc

SEQ ID NO: 353122 - DNA, 25 bp, Homo sapien
ggacactttcctatattcttctatc

SEQ ID NO: 353123 - DNA, 25 bp, Homo sapien
cactttcctatattcttctatcctg

SEQ ID NO: 353124 - DNA, 25 bp, Homo sapien
tacatacgtagcagtacaagtgcat

SEQ ID NO: 353125 - DNA, 25 bp, Homo sapien
atacgtagcagtacaagtgcatata

SEQ ID NO: 353126 - DNA, 25 bp, Homo sapien
cagtacaagtgcatataaatcctgt

SEQ ID NO: 353127 - DNA, 25 bp, Homo sapien
caagtgcatataaatcctgtaagag

SEQ ID NO: 353128 - DNA, 25 bp, Homo sapien
gtgcatataaatcctgtaagagtat

SEQ ID NO: 353129 - DNA, 25 bp, Homo sapien
aatcctgtaagagtataaatcctat

SEQ ID NO: 353130 - DNA, 25 bp, Homo sapien
aattatgtctgttctgtttgatcac

SEQ ID NO: 353131 - DNA, 25 bp, Homo sapien
gagttgcaacaaataggcctcattt

SEQ ID NO: 353132 - DNA, 25 bp, Homo sapien
aataggcctcatttcctaagttgag

SEQ ID NO: 353133 - DNA, 25 bp, Homo sapien
tggaatttcaaggtagaaccaaaat

SEQ ID NO: 353134 - DNA, 25 bp, Homo sapien
caaggtagaaccaaaatgtgtggaa

SEQ ID NO: 353135 - DNA, 25 bp, Homo sapien
acatttgtaacttcagtgctatttt

SEQ ID NO: 353136 - DNA, 25 bp, Homo sapien
ttttaagctccattgttttctaaat

SEQ ID NO: 353137 - DNA, 25 bp, Homo sapien
gaagtactgacaccataatctcatt

SEQ ID NO: 353138 - DNA, 25 bp, Homo sapien
tgcactgtggcaaagggtagtagat

SEQ ID NO: 353139 - DNA, 25 bp, Homo sapien
atgtgtgttcaggattatttgctct

SEQ ID NO: 353140 - DNA, 25 bp, Homo sapien
tatttgctctgtcagtagtgcccag

SEQ ID NO: 353141 - DNA, 25 bp, Homo sapien
gtcagtagtgcccagggtgccactc

SEQ ID NO: 353142 - DNA, 25 bp, Homo sapien
ggtgccactccatgactaaccgaaa

SEQ ID NO: 353143 - DNA, 25 bp, Homo sapien
gtgactcactaagatgttcaattca

SEQ ID NO: 353144 - DNA, 25 bp, Homo sapien
gttcaattcattagtattttctggt

SEQ ID NO: 353145 - DNA, 25 bp, Homo sapien
ttctggttactcaaagtgtactcta

SEQ ID NO: 353146 - DNA, 25 bp, Homo sapien
ccacctgggagagaaccacccgagg

SEQ ID NO: 353147 - DNA, 25 bp, Homo sapien
aggacattttctcggggccctgcag

SEQ ID NO: 353148 - DNA, 25 bp, Homo sapien
agtacccggctctgacgggtggtca

SEQ ID NO: 353149 - DNA, 25 bp, Homo sapien
cggctctgacgggtggtcatgttct

SEQ ID NO: 353150 - DNA, 25 bp, Homo sapien
tcccatttgtgtggtctggagcaca

SEQ ID NO: 353151 - DNA, 25 bp, Homo sapien
catttgtgtggtctggagcacatcc

SEQ ID NO: 353152 - DNA, 25 bp, Homo sapien
tttgcaagtatgtcttagggttcag

SEQ ID NO: 353153 - DNA, 25 bp, Homo sapien
caagtatgtcttagggttcagtaac

SEQ ID NO: 353154 - DNA, 25 bp, Homo sapien
gtcttagggttcagtaacagtaact

SEQ ID NO: 353155 - DNA, 25 bp, Homo sapien
taacagtaactgactggcccactga

SEQ ID NO: 353156 - DNA, 25 bp, Homo sapien
acagtaactgactggcccactgagc

SEQ ID NO: 353157 - DNA, 25 bp, Homo sapien
cggcgtttgccaccttaagaattgg

SEQ ID NO: 353158 - DNA, 25 bp, Homo sapien
gggccaaagccactgatgtttattt

SEQ ID NO: 353159 - DNA, 25 bp, Homo sapien
tgtttatttgacagtgacactgcac

SEQ ID NO: 353160 - DNA, 25 bp, Homo sapien
gtgacactgcactgggtacttaaag

SEQ ID NO: 353161 - DNA, 25 bp, Homo sapien
gaaagaatcaagtttgccacccaaa

SEQ ID NO: 353162 - DNA, 25 bp, Homo sapien
atcaagtttgccacccaaatgctac

SEQ ID NO: 353163 - DNA, 25 bp, Homo sapien
aaatgctaccactgttaatcttttg

SEQ ID NO: 353164 - DNA, 25 bp, Homo sapien
tggtgttaaatgttccccctagaca

SEQ ID NO: 353165 - DNA, 25 bp, Homo sapien
cccctagacatttctgtgcatagat

SEQ ID NO: 353166 - DNA, 25 bp, Homo sapien
gcatagatttttggtgtgtttacat

SEQ ID NO: 353167 - DNA, 25 bp, Homo sapien
gtgtgtttacatagtcgttattctg

SEQ ID NO: 353168 - DNA, 25 bp, Homo sapien
tatgcctttgggcaatatatttttt

SEQ ID NO: 353169 - DNA, 25 bp, Homo sapien
atgcctttgggcaatatattttttt

SEQ ID NO: 353170 - DNA, 25 bp, Homo sapien
tgcctttgggcaatatattttttta

SEQ ID NO: 353171 - DNA, 25 bp, Homo sapien
aggaaattggctctgtccgtttatt

SEQ ID NO: 353172 - DNA, 25 bp, Homo sapien
ggaaattggctctgtccgtttattt

SEQ ID NO: 353173 - DNA, 25 bp, Homo sapien
gaaattggctctgtccgtttattta

SEQ ID NO: 353174 - DNA, 25 bp, Homo sapien
aaattggctctgtccgtttatttat

SEQ ID NO: 353175 - DNA, 25 bp, Homo sapien
aattggctctgtccgtttatttata

SEQ ID NO: 353176 - DNA, 25 bp, Homo sapien
tctgctgccttttcatatttcccca

SEQ ID NO: 353177 - DNA, 25 bp, Homo sapien
tgccttttcatatttccccatctgc

SEQ ID NO: 353178 - DNA, 25 bp, Homo sapien
ccccatctgctttatggatcaactc

SEQ ID NO: 353179 - DNA, 25 bp, Homo sapien
tctgctttatggatcaactctcaac

SEQ ID NO: 353180 - DNA, 25 bp, Homo sapien
gctttatggatcaactctcaacagt

SEQ ID NO: 353181 - DNA, 25 bp, Homo sapien
ggatcaactctcaacagtacacttt

SEQ ID NO: 353182 - DNA, 25 bp, Homo sapien
actctcaacagtacactttttcttt

SEQ ID NO: 353183 - DNA, 25 bp, Homo sapien
tttagtttttgagatcgtgtctcgc

SEQ ID NO: 353184 - DNA, 25 bp, Homo sapien
ttttgagatcgtgtctcgctcctgt

SEQ ID NO: 353185 - DNA, 25 bp, Homo sapien
gagatcgtgtctcgctcctgttgcg

SEQ ID NO: 353186 - DNA, 25 bp, Homo sapien
tcgtgtctcgctcctgttgcgcagg

SEQ ID NO: 353187 - DNA, 25 bp, Homo sapien
tgaagtgtatgagaaatagctggaa

SEQ ID NO: 353188 - DNA, 25 bp, Homo sapien
gctggaaaattcatcatccatgact

SEQ ID NO: 353189 - DNA, 25 bp, Homo sapien
gaaaattcatcatccatgacttgaa

SEQ ID NO: 353190 - DNA, 25 bp, Homo sapien
tgacgttttacaagttatattttcg

SEQ ID NO: 353191 - DNA, 25 bp, Homo sapien
gcactttcaagatccttctctgaga

SEQ ID NO: 353192 - DNA, 25 bp, Homo sapien
cactttcaagatccttctctgagac

SEQ ID NO: 353193 - DNA, 25 bp, Homo sapien
gagacctgcaccaataagactatac

SEQ ID NO: 353194 - DNA, 25 bp, Homo sapien
gcaccaataagactataccaatgtt

SEQ ID NO: 353195 - DNA, 25 bp, Homo sapien
gactataccaatgttcagttgaaac

SEQ ID NO: 353196 - DNA, 25 bp, Homo sapien
cgttggcttcccttccatctaaagg

SEQ ID NO: 353197 - DNA, 25 bp, Homo sapien
tggcttcccttccatctaaaggcct

SEQ ID NO: 353198 - DNA, 25 bp, Homo sapien
ttggtcattatagtatatgcctaaa

SEQ ID NO: 353199 - DNA, 25 bp, Homo sapien
agtatatgcctaaaatgtatgcact

SEQ ID NO: 353200 - DNA, 25 bp, Homo sapien
aaatgtatgcacttaggaatgctaa

SEQ ID NO: 353201 - DNA, 25 bp, Homo sapien
gtatgcacttaggaatgctaaaaat

SEQ ID NO: 353202 - DNA, 25 bp, Homo sapien
aatatggtctaaagcaaataaaagc

SEQ ID NO: 353203 - DNA, 25 bp, Homo sapien
aagaaagccagtatattggtttgaa

SEQ ID NO: 353204 - DNA, 25 bp, Homo sapien
caagtattttaattgcaccttaatg

SEQ ID NO: 353205 - DNA, 25 bp, Homo sapien
gcaccttaatgaaattatctatttt

SEQ ID NO: 353206 - DNA, 25 bp, Homo sapien
agtactattgaatgtattactttac

SEQ ID NO: 353207 - DNA, 25 bp, Homo sapien
ctttactgttacctgaatttattat

SEQ ID NO: 353208 - DNA, 25 bp, Homo sapien
actgttacctgaatttattataaag

SEQ ID NO: 353209 - DNA, 25 bp, Homo sapien
gaaaattctgtatcttcccagcctg

SEQ ID NO: 353210 - DNA, 25 bp, Homo sapien
aattctgtatcttcccagcctgagg

SEQ ID NO: 353211 - DNA, 25 bp, Homo sapien
ggaacagactgaacctcctacacag

SEQ ID NO: 353212 - DNA, 25 bp, Homo sapien
tcctacacagctctgctgccaggaa

SEQ ID NO: 353213 - DNA, 25 bp, Homo sapien
tgccaggaaaccaaaccgtctcatg

SEQ ID NO: 353214 - DNA, 25 bp, Homo sapien
aaaccgtctcatgcccatggtgggt

SEQ ID NO: 353215 - DNA, 25 bp, Homo sapien
ctcatgcccatggtgggtggtagca

SEQ ID NO: 353216 - DNA, 25 bp, Homo sapien
tgctcagcttttatagttcttcccc

SEQ ID NO: 353217 - DNA, 25 bp, Homo sapien
ccagtccagctggagagttgggata

SEQ ID NO: 353218 - DNA, 25 bp, Homo sapien
tgggataaggccaggaggattcttc

SEQ ID NO: 353219 - DNA, 25 bp, Homo sapien
aggattcttcccatcttacagagag

SEQ ID NO: 353220 - DNA, 25 bp, Homo sapien
cccacggtagatttacaattttctg

SEQ ID NO: 353221 - DNA, 25 bp, Homo sapien
ccacggtagatttacaattttctgt

SEQ ID NO: 353222 - DNA, 25 bp, Homo sapien
cggtagatttacaattttctgtagt

SEQ ID NO: 353223 - DNA, 25 bp, Homo sapien
ttttctgtagtattgagttgtgttc

SEQ ID NO: 353224 - DNA, 25 bp, Homo sapien
tagtattgagttgtgttcatttaga

SEQ ID NO: 353225 - DNA, 25 bp, Homo sapien
gtgttcatttagaattttgtaatat

SEQ ID NO: 353226 - DNA, 25 bp, Homo sapien
attatagctggtacatagggatgcc

SEQ ID NO: 353227 - DNA, 25 bp, Homo sapien
ttatagctggtacatagggatgcca

SEQ ID NO: 353228 - DNA, 25 bp, Homo sapien
agctggtacatagggatgccagaag

SEQ ID NO: 353229 - DNA, 25 bp, Homo sapien
tatgcagatgtagactccttttata

SEQ ID NO: 353230 - DNA, 25 bp, Homo sapien
atgcagatgtagactccttttataa

SEQ ID NO: 353231 - DNA, 25 bp, Homo sapien
tcagaatcagaagaactgctggaag

SEQ ID NO: 353232 - DNA, 25 bp, Homo sapien
cagaagaactgctggaagaatcaga

SEQ ID NO: 353233 - DNA, 25 bp, Homo sapien
aagaagatgaatacctaccagattt

SEQ ID NO: 353234 - DNA, 25 bp, Homo sapien
gaagatgaatacctaccagatttct

SEQ ID NO: 353235 - DNA, 25 bp, Homo sapien
gatgaatacctaccagatttcttct

SEQ ID NO: 353236 - DNA, 25 bp, Homo sapien
tgaatacctaccagatttcttcttt

SEQ ID NO: 353237 - DNA, 25 bp, Homo sapien
tctgtctttttttggatgagctctc

SEQ ID NO: 353238 - DNA, 25 bp, Homo sapien
ttttttggatgagctctcacttcca

SEQ ID NO: 353239 - DNA, 25 bp, Homo sapien
tttttggatgagctctcacttccac

SEQ ID NO: 353240 - DNA, 25 bp, Homo sapien
ttttggatgagctctcacttccact

SEQ ID NO: 353241 - DNA, 25 bp, Homo sapien
aagccttggagcctgttgtaatgtg

SEQ ID NO: 353242 - DNA, 25 bp, Homo sapien
tttagcccttccaaattctttctct

SEQ ID NO: 353243 - DNA, 25 bp, Homo sapien
ttagcccttccaaattctttctcta

SEQ ID NO: 353244 - DNA, 25 bp, Homo sapien
tagcccttccaaattctttctctag

SEQ ID NO: 353245 - DNA, 25 bp, Homo sapien
agcccttccaaattctttctctaga

SEQ ID NO: 353246 - DNA, 25 bp, Homo sapien
gcccttccaaattctttctctagaa

SEQ ID NO: 353247 - DNA, 25 bp, Homo sapien
cccttccaaattctttctctagaat

SEQ ID NO: 353248 - DNA, 25 bp, Homo sapien
ctagaatttagagaggatggctcac

SEQ ID NO: 353249 - DNA, 25 bp, Homo sapien
cctgagcttcagaggttgaggctgt

SEQ ID NO: 353250 - DNA, 25 bp, Homo sapien
ctgtggtgagccatgttggtgtcac

SEQ ID NO: 353251 - DNA, 25 bp, Homo sapien
tgtggtgagccatgttggtgtcact

SEQ ID NO: 353252 - DNA, 25 bp, Homo sapien
tggtgagccatgttggtgtcactgc

SEQ ID NO: 353253 - DNA, 25 bp, Homo sapien
acctgatttcaaaggcagctagtgt

SEQ ID NO: 353254 - DNA, 25 bp, Homo sapien
agctagtgtagaagactggtcacaa

SEQ ID NO: 353255 - DNA, 25 bp, Homo sapien
ttcagttacaggctgcaagtgacct

SEQ ID NO: 353256 - DNA, 25 bp, Homo sapien
gcaagtgacctaaaattcccctact

SEQ ID NO: 353257 - DNA, 25 bp, Homo sapien
ctactctagctcagcagccatcagt

SEQ ID NO: 353258 - DNA, 25 bp, Homo sapien
gcagccatcagtcagtatagcatca

SEQ ID NO: 353259 - DNA, 25 bp, Homo sapien
agtatagcatcagccacaggtcact

SEQ ID NO: 353260 - DNA, 25 bp, Homo sapien
acaggtcactgctctgcatacagtt

SEQ ID NO: 353261 - DNA, 25 bp, Homo sapien
gctctgcatacagttccttttcaac

SEQ ID NO: 353262 - DNA, 25 bp, Homo sapien
ttttcaacccttacaagacctgctt

SEQ ID NO: 353263 - DNA, 25 bp, Homo sapien
gaccacccattttcatgtactttaa

SEQ ID NO: 353264 - DNA, 25 bp, Homo sapien
agtgacgacaggaccgtcaccagga

SEQ ID NO: 353265 - DNA, 25 bp, Homo sapien
tcactcctgaccccatgcttatttt

SEQ ID NO: 353266 - DNA, 25 bp, Homo sapien
tttacatacgagttggttaccagct

SEQ ID NO: 353267 - DNA, 25 bp, Homo sapien
atacgagttggttaccagcttttct

SEQ ID NO: 353268 - DNA, 25 bp, Homo sapien
agttggttaccagcttttcttgctg

SEQ ID NO: 353269 - DNA, 25 bp, Homo sapien
tgctgtttccttggtattaaaacac

SEQ ID NO: 353270 - DNA, 25 bp, Homo sapien
aacacagtagggtagggtacagcca

SEQ ID NO: 353271 - DNA, 25 bp, Homo sapien
cagtagggtagggtacagccagata

SEQ ID NO: 353272 - DNA, 25 bp, Homo sapien
gtacagccagataaagagcgttgag

SEQ ID NO: 353273 - DNA, 25 bp, Homo sapien
gataaagagcgttgaggaccctatg

SEQ ID NO: 353274 - DNA, 25 bp, Homo sapien
aaagagcgttgaggaccctatggag

SEQ ID NO: 353275 - DNA, 25 bp, Homo sapien
caggcaggactcttgggtgactcct

SEQ ID NO: 353276 - DNA, 25 bp, Homo sapien
ggactcttgggtgactcctgaaagg

SEQ ID NO: 353277 - DNA, 25 bp, Homo sapien
ctcttgggtgactcctgaaaggtta

SEQ ID NO: 353278 - DNA, 25 bp, Homo sapien
gggtgactcctgaaaggttaagaag

SEQ ID NO: 353279 - DNA, 25 bp, Homo sapien
agaaggactgttgagtttcatgtgg

SEQ ID NO: 353280 - DNA, 25 bp, Homo sapien
ccggagggtgacagtgaacccttca

SEQ ID NO: 353281 - DNA, 25 bp, Homo sapien
ggtgacagtgaacccttcaggatca

SEQ ID NO: 353282 - DNA, 25 bp, Homo sapien
agtgaacccttcaggatcacccttg

SEQ ID NO: 353283 - DNA, 25 bp, Homo sapien
aacccttcaggatcacccttgggag

SEQ ID NO: 353284 - DNA, 25 bp, Homo sapien
caggatcacccttgggagtggattc

SEQ ID NO: 353285 - DNA, 25 bp, Homo sapien
acccttgggagtggattctgagacc

SEQ ID NO: 353286 - DNA, 25 bp, Homo sapien
ttgccgactgcaaatggtatttaaa

SEQ ID NO: 353287 - DNA, 25 bp, Homo sapien
aacgataccgaactttattcataag

SEQ ID NO: 353288 - DNA, 25 bp, Homo sapien
gaactttattcataagcatcgcata

SEQ ID NO: 353289 - DNA, 25 bp, Homo sapien
agcatcgcataaatcaacctacact

SEQ ID NO: 353290 - DNA, 25 bp, Homo sapien
caacctacactgagatacatttccc

SEQ ID NO: 353291 - DNA, 25 bp, Homo sapien
acatttcccatgtatcagattggta

SEQ ID NO: 353292 - DNA, 25 bp, Homo sapien
aacaacacatcctattagcaaggtt

SEQ ID NO: 353293 - DNA, 25 bp, Homo sapien
agggcgttctctacttctcccttga

SEQ ID NO: 353294 - DNA, 25 bp, Homo sapien
ttctcccttgagttctattgaattc

SEQ ID NO: 353295 - DNA, 25 bp, Homo sapien
aattcagtgtggtattcttattccg

SEQ ID NO: 353296 - DNA, 25 bp, Homo sapien
tcttattccggaatactttctagct

SEQ ID NO: 353297 - DNA, 25 bp, Homo sapien
agcagagatgcatccatccacactt

SEQ ID NO: 353298 - DNA, 25 bp, Homo sapien
cacagaaggacctcagagggcccaa

SEQ ID NO: 353299 - DNA, 25 bp, Homo sapien
ctcgagctcctggatgcactgctat

SEQ ID NO: 353300 - DNA, 25 bp, Homo sapien
gaaggacctcagagggcccaagtcc

SEQ ID NO: 353301 - DNA, 25 bp, Homo sapien
tggatgcactgctatcaagaacaat

SEQ ID NO: 353302 - DNA, 25 bp, Homo sapien
gcactgctatcaagaacaatgaggg

SEQ ID NO: 353303 - DNA, 25 bp, Homo sapien
ggatggccagcctatgttgctgact

SEQ ID NO: 353304 - DNA, 25 bp, Homo sapien
tatgttgctgactccatcatcctaa

SEQ ID NO: 353305 - DNA, 25 bp, Homo sapien
tgttgctgactccatcatcctaacc

SEQ ID NO: 353306 - DNA, 25 bp, Homo sapien
agtcctcagacccacacagaacagg

SEQ ID NO: 353307 - DNA, 25 bp, Homo sapien
cagctgtcctccttacactgagatg

SEQ ID NO: 353308 - DNA, 25 bp, Homo sapien
gggtaatttttgcatgccaaacagc

SEQ ID NO: 353309 - DNA, 25 bp, Homo sapien
ttttgcatgccaaacagcgtactgc

SEQ ID NO: 353310 - DNA, 25 bp, Homo sapien
aacagcgtactgcatatttacatgt

SEQ ID NO: 353311 - DNA, 25 bp, Homo sapien
tttacatgttaaatcattcctttta

SEQ ID NO: 353312 - DNA, 25 bp, Homo sapien
gaatctgctaagataaagaagccta

SEQ ID NO: 353313 - DNA, 25 bp, Homo sapien
taaagaagcctaggccaggaactgt

SEQ ID NO: 353314 - DNA, 25 bp, Homo sapien
cctcagcacactgggacgccaagga

SEQ ID NO: 353315 - DNA, 25 bp, Homo sapien
acgccaaggagggagaatagcttga

SEQ ID NO: 353316 - DNA, 25 bp, Homo sapien
cctgggcaaaacagcctagtttcta

SEQ ID NO: 353317 - DNA, 25 bp, Homo sapien
ggcaaaacagcctagtttctacaaa

SEQ ID NO: 353318 - DNA, 25 bp, Homo sapien
ttctacaaaacaacccagtctctac

SEQ ID NO: 353319 - DNA, 25 bp, Homo sapien
cgcgggttggtctcagccggatcct

SEQ ID NO: 353320 - DNA, 25 bp, Homo sapien
gggttggtctcagccggatcctgca

SEQ ID NO: 353321 - DNA, 25 bp, Homo sapien
gatcctgcagccctcatcgagcaaa

SEQ ID NO: 353322 - DNA, 25 bp, Homo sapien
tcctgcagccctcatcgagcaaagg

SEQ ID NO: 353323 - DNA, 25 bp, Homo sapien
ctgcagccctcatcgagcaaaggct

SEQ ID NO: 353324 - DNA, 25 bp, Homo sapien
gaggctgggaggacgcaacaggccc

SEQ ID NO: 353325 - DNA, 25 bp, Homo sapien
tgggaggacgcaacaggcccaggct

SEQ ID NO: 353326 - DNA, 25 bp, Homo sapien
aggacgcaacaggcccaggctgtgc

SEQ ID NO: 353327 - DNA, 25 bp, Homo sapien
aacaggcccaggctgtgccgggcgg

SEQ ID NO: 353328 - DNA, 25 bp, Homo sapien
gggctggcgagtgagggaaaacaga

SEQ ID NO: 353329 - DNA, 25 bp, Homo sapien
gcgcccaccatcagcgtctgtgcag

SEQ ID NO: 353330 - DNA, 25 bp, Homo sapien
ctttgttgtgtacaggtggtatctc

SEQ ID NO: 353331 - DNA, 25 bp, Homo sapien
tgttgtgtacaggtggtatctcact

SEQ ID NO: 353332 - DNA, 25 bp, Homo sapien
gttgtgtacaggtggtatctcactg

SEQ ID NO: 353333 - DNA, 25 bp, Homo sapien
ttgtgtacaggtggtatctcactgt

SEQ ID NO: 353334 - DNA, 25 bp, Homo sapien
cactgtgttatccagactggactca

SEQ ID NO: 353335 - DNA, 25 bp, Homo sapien
ccatgcccaggacctgaggacaaag

SEQ ID NO: 353336 - DNA, 25 bp, Homo sapien
atgcccaggacctgaggacaaaggt

SEQ ID NO: 353337 - DNA, 25 bp, Homo sapien
gcccaggacctgaggacaaaggtct

SEQ ID NO: 353338 - DNA, 25 bp, Homo sapien
acctgaggacaaaggtctagcgatt

SEQ ID NO: 353339 - DNA, 25 bp, Homo sapien
ctgaggacaaaggtctagcgattgt

SEQ ID NO: 353340 - DNA, 25 bp, Homo sapien
gacaaaggtctagcgattgtccatc

SEQ ID NO: 353341 - DNA, 25 bp, Homo sapien
tgtctttcaccacctcaggagcaac

SEQ ID NO: 353342 - DNA, 25 bp, Homo sapien
cagcagttaggtgttcagatgtgaa

SEQ ID NO: 353343 - DNA, 25 bp, Homo sapien
gaagagcaaaagtttcctctactga

SEQ ID NO: 353344 - DNA, 25 bp, Homo sapien
aaagctaaagatgctggctgtcccc

SEQ ID NO: 353345 - DNA, 25 bp, Homo sapien
aatagtgacacctagggtaacctgg

SEQ ID NO: 353346 - DNA, 25 bp, Homo sapien
ggtaacctggagaaatggtccacag

SEQ ID NO: 353347 - DNA, 25 bp, Homo sapien
ggtccacagagaatagtccatgatc

SEQ ID NO: 353348 - DNA, 25 bp, Homo sapien
agtccatgatctgtacaaacatcca

SEQ ID NO: 353349 - DNA, 25 bp, Homo sapien
acaaacatccagagagctgctttct

SEQ ID NO: 353350 - DNA, 25 bp, Homo sapien
tcccacaggtctgactgccagagag

SEQ ID NO: 353351 - DNA, 25 bp, Homo sapien
acaggtctgactgccagagagtaga

SEQ ID NO: 353352 - DNA, 25 bp, Homo sapien
gagggacacacccaggacattttct

SEQ ID NO: 353353 - DNA, 25 bp, Homo sapien
gacacacccaggacattttctcggg

SEQ ID NO: 353354 - DNA, 25 bp, Homo sapien
agtacccggctctgacgggtggtca

SEQ ID NO: 353355 - DNA, 25 bp, Homo sapien
cggctctgacgggtggtcatgttct

SEQ ID NO: 353356 - DNA, 25 bp, Homo sapien
tcccatttgtgtggtctggagcaca

SEQ ID NO: 353357 - DNA, 25 bp, Homo sapien
catttgtgtggtctggagcacatcc

SEQ ID NO: 353358 - DNA, 25 bp, Homo sapien
gtctggagcacatcctgtaggagtt

SEQ ID NO: 353359 - DNA, 25 bp, Homo sapien
tttgcaagtatgtcttagggttcag

SEQ ID NO: 353360 - DNA, 25 bp, Homo sapien
caagtatgtcttagggttcagtaac

SEQ ID NO: 353361 - DNA, 25 bp, Homo sapien
gtcttagggttcagtaacagtaact

SEQ ID NO: 353362 - DNA, 25 bp, Homo sapien
aacagtaactgactggcccactgag

SEQ ID NO: 353363 - DNA, 25 bp, Homo sapien
actgcctggtccacatcccggaggg

SEQ ID NO: 353364 - DNA, 25 bp, Homo sapien
atcccggaggggtctctgcgcctca

SEQ ID NO: 353365 - DNA, 25 bp, Homo sapien
tcggcatcgcagctgatggtgaaac

SEQ ID NO: 353366 - DNA, 25 bp, Homo sapien
ggcatcgcagctgatggtgaaactt

SEQ ID NO: 353367 - DNA, 25 bp, Homo sapien
atcgcagctgatggtgaaacttttg

SEQ ID NO: 353368 - DNA, 25 bp, Homo sapien
cgcagctgatggtgaaacttttggt

SEQ ID NO: 353369 - DNA, 25 bp, Homo sapien
cagctgatggtgaaacttttggtgt

SEQ ID NO: 353370 - DNA, 25 bp, Homo sapien
tgatggtgaaacttttggtgtggca

SEQ ID NO: 353371 - DNA, 25 bp, Homo sapien
tggtgaaacttttggtgtggcagaa

SEQ ID NO: 353372 - DNA, 25 bp, Homo sapien
gtgaaacttttggtgtggcagaaga

SEQ ID NO: 353373 - DNA, 25 bp, Homo sapien
gagaactttggatgtggaacgtgga

SEQ ID NO: 353374 - DNA, 25 bp, Homo sapien
aaaaccactgggaactgctcttcaa

SEQ ID NO: 353375 - DNA, 25 bp, Homo sapien
tgctcttcaaagactgggacagtga

SEQ ID NO: 353376 - DNA, 25 bp, Homo sapien
gggacagtgatacgaagtgtaccct

SEQ ID NO: 353377 - DNA, 25 bp, Homo sapien
atacgaagtgtaccctgaaagtcag

SEQ ID NO: 353378 - DNA, 25 bp, Homo sapien
tattggatgaatttccagttgttac

SEQ ID NO: 353379 - DNA, 25 bp, Homo sapien
aaactgtactgactcctagatggag

SEQ ID NO: 353380 - DNA, 25 bp, Homo sapien
ttgtgtcccaaaggaaatgtgcctg

SEQ ID NO: 353381 - DNA, 25 bp, Homo sapien
tagatggagcaagagcataggccac

SEQ ID NO: 353382 - DNA, 25 bp, Homo sapien
gccactattggcgaaggactctatg

SEQ ID NO: 353383 - DNA, 25 bp, Homo sapien
aaggactctatgtagctctaagcta

SEQ ID NO: 353384 - DNA, 25 bp, Homo sapien
ctaagctacatagagactccttgat

SEQ ID NO: 353385 - DNA, 25 bp, Homo sapien
gagcgccattctcttgctgcctcat

SEQ ID NO: 353386 - DNA, 25 bp, Homo sapien
tgctgcctcatctattctggttagg

SEQ ID NO: 353387 - DNA, 25 bp, Homo sapien
tctggttaggtacttactgagcatc

SEQ ID NO: 353388 - DNA, 25 bp, Homo sapien
ttactgagcatcaggtgctaggcaa

SEQ ID NO: 353389 - DNA, 25 bp, Homo sapien
acgtttaatgactcagtctccgcct

SEQ ID NO: 353390 - DNA, 25 bp, Homo sapien
cctgcacagagcctttgagtctaga

SEQ ID NO: 353391 - DNA, 25 bp, Homo sapien
cagacttactgacaggctgggttgt

SEQ ID NO: 353392 - DNA, 25 bp, Homo sapien
acaggctgggttgtgtaataagtgc

SEQ ID NO: 353393 - DNA, 25 bp, Homo sapien
gaaaagctgagagtgtctgagaatt

SEQ ID NO: 353394 - DNA, 25 bp, Homo sapien
gagatgtgtgtctcatcagacttgg

SEQ ID NO: 353395 - DNA, 25 bp, Homo sapien
gtgtctcatcagacttgggcatcaa

SEQ ID NO: 353396 - DNA, 25 bp, Homo sapien
tagcgctgtgctggacgcttctctg

SEQ ID NO: 353397 - DNA, 25 bp, Homo sapien
tgtgctggacgcttctctgtgagga

SEQ ID NO: 353398 - DNA, 25 bp, Homo sapien
ctgtgaggagagtccctcgcccctt

SEQ ID NO: 353399 - DNA, 25 bp, Homo sapien
cgccccttcttcagatttgggaatg

SEQ ID NO: 353400 - DNA, 25 bp, Homo sapien
atttgggaatggactctcgggcacc

SEQ ID NO: 353401 - DNA, 25 bp, Homo sapien
gggaatggactctcgggcacctgaa

SEQ ID NO: 353402 - DNA, 25 bp, Homo sapien
tcgggcacctgaagcgcctgctcag

SEQ ID NO: 353403 - DNA, 25 bp, Homo sapien
aagcgcctgctcaggatcaggccgg

SEQ ID NO: 353404 - DNA, 25 bp, Homo sapien
atcaggccggcacctggacatgaat

SEQ ID NO: 353405 - DNA, 25 bp, Homo sapien
tgtctgattacaatatggccacgca

SEQ ID NO: 353406 - DNA, 25 bp, Homo sapien
acaatatggccacgcagctttttct

SEQ ID NO: 353407 - DNA, 25 bp, Homo sapien
acgcagaagagatggccacatttca

SEQ ID NO: 353408 - DNA, 25 bp, Homo sapien
gatggccacatttcaggaccagaaa

SEQ ID NO: 353409 - DNA, 25 bp, Homo sapien
gaactgaaggttccaggtatttcct

SEQ ID NO: 353410 - DNA, 25 bp, Homo sapien
tttccttcaatggaatgaatggctg

SEQ ID NO: 353411 - DNA, 25 bp, Homo sapien
aatgaatggctgatggttggtctaa

SEQ ID NO: 353412 - DNA, 25 bp, Homo sapien
tggctgatggttggtctaagaagtc

SEQ ID NO: 353413 - DNA, 25 bp, Homo sapien
aagtcagagctttagattccctccc

SEQ ID NO: 353414 - DNA, 25 bp, Homo sapien
catgctgcgggtcaacagcctgaca

SEQ ID NO: 353415 - DNA, 25 bp, Homo sapien
acagcctgacagaaggttcagtcta

SEQ ID NO: 353416 - DNA, 25 bp, Homo sapien
gttcagtctatggaggagtttggat

SEQ ID NO: 353417 - DNA, 25 bp, Homo sapien
tggaaacaccagtcacaaggacaga

SEQ ID NO: 353418 - DNA, 25 bp, Homo sapien
ctggactggattaggatgtagcttt

SEQ ID NO: 353419 - DNA, 25 bp, Homo sapien
aaaataagccagtggtgctcataaa

SEQ ID NO: 353420 - DNA, 25 bp, Homo sapien
gttgctttgcctagtaatgagccct

SEQ ID NO: 353421 - DNA, 25 bp, Homo sapien
aatgagccctgtttagttctccatt

SEQ ID NO: 353422 - DNA, 25 bp, Homo sapien
atatattgcctctaagattgaactt

SEQ ID NO: 353423 - DNA, 25 bp, Homo sapien
gattgaactttagcttcagaagact

SEQ ID NO: 353424 - DNA, 25 bp, Homo sapien
agacagactttatcttatacgttag

SEQ ID NO: 353425 - DNA, 25 bp, Homo sapien
tatacgttagtttcaaacccatttg

SEQ ID NO: 353426 - DNA, 25 bp, Homo sapien
acccatttgattgttcttgtgctgc

SEQ ID NO: 353427 - DNA, 25 bp, Homo sapien
tcttgtgctgccgttttatagtaag

SEQ ID NO: 353428 - DNA, 25 bp, Homo sapien
cattgcttagtattgtccctgacat

SEQ ID NO: 353429 - DNA, 25 bp, Homo sapien
gactacttttacatctgttaactca

SEQ ID NO: 353430 - DNA, 25 bp, Homo sapien
atctgttaactcatcgtatcaatca

SEQ ID NO: 353431 - DNA, 25 bp, Homo sapien
aatggaaatttgttcaagctgagta

SEQ ID NO: 353432 - DNA, 25 bp, Homo sapien
aagctgagtaacactgatcccctga

SEQ ID NO: 353433 - DNA, 25 bp, Homo sapien
gagtaacactgatcccctgaatatt

SEQ ID NO: 353434 - DNA, 25 bp, Homo sapien
tgatcccctgaatatttccccaaat

SEQ ID NO: 353435 - DNA, 25 bp, Homo sapien
ccctgaatatttccccaaatgccat

SEQ ID NO: 353436 - DNA, 25 bp, Homo sapien
ccatctactttcaccatccagaata

SEQ ID NO: 353437 - DNA, 25 bp, Homo sapien
ttagtttccctctttctcattagca

SEQ ID NO: 353438 - DNA, 25 bp, Homo sapien
aaataccaatggtacaccaggcgat

SEQ ID NO: 353439 - DNA, 25 bp, Homo sapien
aatggtacaccaggcgataacatgg

SEQ ID NO: 353440 - DNA, 25 bp, Homo sapien
gctctgtagcctttaggacttctag

SEQ ID NO: 353441 - DNA, 25 bp, Homo sapien
ctttaggacttctagaatcaggctt

SEQ ID NO: 353442 - DNA, 25 bp, Homo sapien
tagaatcaggcttctgggccacctt

SEQ ID NO: 353443 - DNA, 25 bp, Homo sapien
tgggccaccttcttagcaggtgtat

SEQ ID NO: 353444 - DNA, 25 bp, Homo sapien
gcaggtgtatacctctttgttccag

SEQ ID NO: 353445 - DNA, 25 bp, Homo sapien
ttctgtctcacaatatcttcactat

SEQ ID NO: 353446 - DNA, 25 bp, Homo sapien
tcttcactatttccacagttgcagc

SEQ ID NO: 353447 - DNA, 25 bp, Homo sapien
cacagttgcagccaagacaggaaac

SEQ ID NO: 353448 - DNA, 25 bp, Homo sapien
gggaaaattgagtgtcactttggaa

SEQ ID NO: 353449 - DNA, 25 bp, Homo sapien
gggcccccatctaaggattgctgcc

SEQ ID NO: 353450 - DNA, 25 bp, Homo sapien
aaacagcagctcattaactcttaaa

SEQ ID NO: 353451 - DNA, 25 bp, Homo sapien
taggaccagctacagagacgtttct

SEQ ID NO: 353452 - DNA, 25 bp, Homo sapien
atcaaactatcttcttctccttagc

SEQ ID NO: 353453 - DNA, 25 bp, Homo sapien
ttcttctccttagccgttcaaatag

SEQ ID NO: 353454 - DNA, 25 bp, Homo sapien
atacacaggcctcttttcgttttat

SEQ ID NO: 353455 - DNA, 25 bp, Homo sapien
ttcgttttattcctgttcaaacaga

SEQ ID NO: 353456 - DNA, 25 bp, Homo sapien
gcacatcatgcctaggttgctttga

SEQ ID NO: 353457 - DNA, 25 bp, Homo sapien
tttgagcttgatcacttcctcctaa

SEQ ID NO: 353458 - DNA, 25 bp, Homo sapien
ttcctcctaaagcagtcttacgctg

SEQ ID NO: 353459 - DNA, 25 bp, Homo sapien
cagtcttacgctgtgttgattttaa

SEQ ID NO: 353460 - DNA, 25 bp, Homo sapien
attgcaacttaggtgttctagaaca

SEQ ID NO: 353461 - DNA, 25 bp, Homo sapien
ttctgagagcatagtcatagtctgt

SEQ ID NO: 353462 - DNA, 25 bp, Homo sapien
ttttatgtgctatgctttgtctttc

SEQ ID NO: 353463 - DNA, 25 bp, Homo sapien
gaaatgtaagtcctttgagtacaga

SEQ ID NO: 353464 - DNA, 25 bp, Homo sapien
gtaagtcctttgagtacagagatca

SEQ ID NO: 353465 - DNA, 25 bp, Homo sapien
gtcctttgagtacagagatcatgaa

SEQ ID NO: 353466 - DNA, 25 bp, Homo sapien
agagatcatgaattacgaaggtgta

SEQ ID NO: 353467 - DNA, 25 bp, Homo sapien
cttggttgtcttcatgggagcattt

SEQ ID NO: 353468 - DNA, 25 bp, Homo sapien
ttgtcttcatgggagcatttcacca

SEQ ID NO: 353469 - DNA, 25 bp, Homo sapien
ttcatgggagcatttcaccatcctc

SEQ ID NO: 353470 - DNA, 25 bp, Homo sapien
catgggagcatttcaccatcctctg

SEQ ID NO: 353471 - DNA, 25 bp, Homo sapien
tatgactgacatactaaaagcttta

SEQ ID NO: 353472 - DNA, 25 bp, Homo sapien
taaaagctttaggtatttaacatat

SEQ ID NO: 353473 - DNA, 25 bp, Homo sapien
gttcctaaaaagtgccaatcattat

SEQ ID NO: 353474 - DNA, 25 bp, Homo sapien
tgaaagttcaatggatggcgcacgg

SEQ ID NO: 353475 - DNA, 25 bp, Homo sapien
tcccagcactgcatcgtgaggttgt

SEQ ID NO: 353476 - DNA, 25 bp, Homo sapien
gtgaggttgtgtgccttcagaaaac

SEQ ID NO: 353477 - DNA, 25 bp, Homo sapien
aaaccacatgttatctgcggctcag

SEQ ID NO: 353478 - DNA, 25 bp, Homo sapien
tatctgcggctcagttttgtaatgc

SEQ ID NO: 353479 - DNA, 25 bp, Homo sapien
gtaatgccacatttaacaaggatgt

SEQ ID NO: 353480 - DNA, 25 bp, Homo sapien
atattcagaagagaccaaccaggga

SEQ ID NO: 353481 - DNA, 25 bp, Homo sapien
caaccagggaggataatgacgtcaa

SEQ ID NO: 353482 - DNA, 25 bp, Homo sapien
atgacgtcaaactatgtcacttaaa

SEQ ID NO: 353483 - DNA, 25 bp, Homo sapien
ttaagcctcacagaagtcaggaatt

SEQ ID NO: 353484 - DNA, 25 bp, Homo sapien
acattgtcacccagaggcagggcaa

SEQ ID NO: 353485 - DNA, 25 bp, Homo sapien
cttcaggttccatatagtcttgaaa

SEQ ID NO: 353486 - DNA, 25 bp, Homo sapien
aatctttcacaaacttccgttccag

SEQ ID NO: 353487 - DNA, 25 bp, Homo sapien
tcattttatcaatgtgctcacgtaa

SEQ ID NO: 353488 - DNA, 25 bp, Homo sapien
gtgctcacgtaaaacactagcccat

SEQ ID NO: 353489 - DNA, 25 bp, Homo sapien
aaaacactagcccatttctgcagag

SEQ ID NO: 353490 - DNA, 25 bp, Homo sapien
tagcccatttctgcagagattccat

SEQ ID NO: 353491 - DNA, 25 bp, Homo sapien
ttccatcacagtccaaggtctagac

SEQ ID NO: 353492 - DNA, 25 bp, Homo sapien
gtccaaggtctagacatgtctgcaa

SEQ ID NO: 353493 - DNA, 25 bp, Homo sapien
atgacgagggtctctggcaaggatt

SEQ ID NO: 353494 - DNA, 25 bp, Homo sapien
ggcaaggattcagcagaaactgcaa

SEQ ID NO: 353495 - DNA, 25 bp, Homo sapien
ggaaagacctgcctttgttgtgtac

SEQ ID NO: 353496 - DNA, 25 bp, Homo sapien
gttgtgtacaggtggtatctcactg

SEQ ID NO: 353497 - DNA, 25 bp, Homo sapien
aggccccagatcacagggctggtga

SEQ ID NO: 353498 - DNA, 25 bp, Homo sapien
gccccagatcacagggctggtgaga

SEQ ID NO: 353499 - DNA, 25 bp, Homo sapien
ggctggtgagaagaacgtgatatct

SEQ ID NO: 353500 - DNA, 25 bp, Homo sapien
agaagaacgtgatatctccagagct

SEQ ID NO: 353501 - DNA, 25 bp, Homo sapien
gaagaacgtgatatctccagagcta

SEQ ID NO: 353502 - DNA, 25 bp, Homo sapien
aagaacgtgatatctccagagctaa

SEQ ID NO: 353503 - DNA, 25 bp, Homo sapien
agaacgtgatatctccagagctaac

SEQ ID NO: 353504 - DNA, 25 bp, Homo sapien
gaacgtgatatctccagagctaaca

SEQ ID NO: 353505 - DNA, 25 bp, Homo sapien
gacaaaggtctagcgattgtccatc

SEQ ID NO: 353506 - DNA, 25 bp, Homo sapien
tgttgtgaacagcttgccccaggga

SEQ ID NO: 353507 - DNA, 25 bp, Homo sapien
gacaaggctaagacaatttcagggc

SEQ ID NO: 353508 - DNA, 25 bp, Homo sapien
ggctaagacaatttcagggcttcct

SEQ ID NO: 353509 - DNA, 25 bp, Homo sapien
aagacaatttcagggcttccttggg

SEQ ID NO: 353510 - DNA, 25 bp, Homo sapien
gacaatttcagggcttccttgggaa

SEQ ID NO: 353511 - DNA, 25 bp, Homo sapien
actgaggtttggaggtattcctctg

SEQ ID NO: 353512 - DNA, 25 bp, Homo sapien
gtttggaggtattcctctggagttt

SEQ ID NO: 353513 - DNA, 25 bp, Homo sapien
attcctctggagttttcacttatac

SEQ ID NO: 353514 - DNA, 25 bp, Homo sapien
tcctctggagttttcacttatacca

SEQ ID NO: 353515 - DNA, 25 bp, Homo sapien
tttcacttataccattctctcatgc

SEQ ID NO: 353516 - DNA, 25 bp, Homo sapien
ataccattctctcatgcccaggaag

SEQ ID NO: 353517 - DNA, 25 bp, Homo sapien
tgtcaaggccgcctaaccacagtca

SEQ ID NO: 353518 - DNA, 25 bp, Homo sapien
tcgggatcacaaccaccgcacagga

SEQ ID NO: 353519 - DNA, 25 bp, Homo sapien
ggatcacaaccaccgcacaggagca

SEQ ID NO: 353520 - DNA, 25 bp, Homo sapien
accgcacaggagcaccacacatggc

SEQ ID NO: 353521 - DNA, 25 bp, Homo sapien
aaggccgcctaaccacagtcacagt

SEQ ID NO: 353522 - DNA, 25 bp, Homo sapien
agtcacagtgagagccaccagacgc

SEQ ID NO: 353523 - DNA, 25 bp, Homo sapien
acagtgagagccaccagacgctgga

SEQ ID NO: 353524 - DNA, 25 bp, Homo sapien
agtgagagccaccagacgctggatc

SEQ ID NO: 353525 - DNA, 25 bp, Homo sapien
gagagccaccagacgctggatccgg

SEQ ID NO: 353526 - DNA, 25 bp, Homo sapien
accagacgctggatccgggcagcaa

SEQ ID NO: 353527 - DNA, 25 bp, Homo sapien
cagacgctggatccgggcagcaact

SEQ ID NO: 353528 - DNA, 25 bp, Homo sapien
aaagcagagatgcatccatccacac

SEQ ID NO: 353529 - DNA, 25 bp, Homo sapien
agcagagatgcatccatccacactt

SEQ ID NO: 353530 - DNA, 25 bp, Homo sapien
cacagaaggacctcagagggcccaa

SEQ ID NO: 353531 - DNA, 25 bp, Homo sapien
ctcgagctcctggatgcactgctat

SEQ ID NO: 353532 - DNA, 25 bp, Homo sapien
tcctggatgcactgctatcaagaac

SEQ ID NO: 353533 - DNA, 25 bp, Homo sapien
ggatgcactgctatcaagaacaatg

SEQ ID NO: 353534 - DNA, 25 bp, Homo sapien
gcactgctatcaagaacaatgaggg

SEQ ID NO: 353535 - DNA, 25 bp, Homo sapien
gggatggccagcctatgttgctgac

SEQ ID NO: 353536 - DNA, 25 bp, Homo sapien
tatgttgctgactccatcatcctaa

SEQ ID NO: 353537 - DNA, 25 bp, Homo sapien
tgttgctgactccatcatcctaacc

SEQ ID NO: 353538 - DNA, 25 bp, Homo sapien
agagggcccaagtcctcagacccac

SEQ ID NO: 353539 - DNA, 25 bp, Homo sapien
ccccgctgaagctgatgatagttcc

SEQ ID NO: 353540 - DNA, 25 bp, Homo sapien
gatagttccggaatgcaaaacccct

SEQ ID NO: 353541 - DNA, 25 bp, Homo sapien
ccggaatgcaaaaccccttaatgat

SEQ ID NO: 353542 - DNA, 25 bp, Homo sapien
gattcccccattgatcaaagtcttc

SEQ ID NO: 353543 - DNA, 25 bp, Homo sapien
ccacatgctttcaaggtccttggtg

SEQ ID NO: 353544 - DNA, 25 bp, Homo sapien
ttggtgatccaggacctgccgcctt

SEQ ID NO: 353545 - DNA, 25 bp, Homo sapien
agtctccctactgatgccatagttt

SEQ ID NO: 353546 - DNA, 25 bp, Homo sapien
atgccatagttttggcttctggcct

SEQ ID NO: 353547 - DNA, 25 bp, Homo sapien
tggcttctggcctcatatgtcccgg

SEQ ID NO: 353548 - DNA, 25 bp, Homo sapien
atatgtcccgggtcatttctctggt

SEQ ID NO: 353549 - DNA, 25 bp, Homo sapien
atctcttgcctggaccctgcgagaa

SEQ ID NO: 353550 - DNA, 25 bp, Homo sapien
tcaaggtatttgcatccattcccac

SEQ ID NO: 353551 - DNA, 25 bp, Homo sapien
tttgcatccattcccaccctgttag

SEQ ID NO: 353552 - DNA, 25 bp, Homo sapien
ggaggagggaaatcaattccaacca

SEQ ID NO: 353553 - DNA, 25 bp, Homo sapien
aatcaattccaaccatactttcctg

SEQ ID NO: 353554 - DNA, 25 bp, Homo sapien
caaccatactttcctgtgatggaag

SEQ ID NO: 353555 - DNA, 25 bp, Homo sapien
gtgatggaagatgtttcctcttgaa

SEQ ID NO: 353556 - DNA, 25 bp, Homo sapien
gttttccaaatgcactttgtaagtt

SEQ ID NO: 353557 - DNA, 25 bp, Homo sapien
atgcactttgtaagtttttgctttt

SEQ ID NO: 353558 - DNA, 25 bp, Homo sapien
tgtacttaatttttgttctcatcta

SEQ ID NO: 353559 - DNA, 25 bp, Homo sapien
gcattttctgactgtatagaagaag

SEQ ID NO: 353560 - DNA, 25 bp, Homo sapien
gaagaagctttggtatgtaatttaa

SEQ ID NO: 353561 - DNA, 25 bp, Homo sapien
aaagtatttaactctgtagaccaca

SEQ ID NO: 353562 - DNA, 25 bp, Homo sapien
gtagaccacaattatagaaagctca

SEQ ID NO: 353563 - DNA, 25 bp, Homo sapien
gaaagctcagtaatgctgctaatga

SEQ ID NO: 353564 - DNA, 25 bp, Homo sapien
tttttatatttcactgggagaggca

SEQ ID NO: 353565 - DNA, 25 bp, Homo sapien
gagaggcagtagagacatcatagtt

SEQ ID NO: 353566 - DNA, 25 bp, Homo sapien
gacatcatagttgtactttagtgca

SEQ ID NO: 353567 - DNA, 25 bp, Homo sapien
gggaacactccaaatagcctagagt

SEQ ID NO: 353568 - DNA, 25 bp, Homo sapien
gtatagtaaggtacaaagcttcaat

SEQ ID NO: 353569 - DNA, 25 bp, Homo sapien
attactgatgtaatcttgctgccat

SEQ ID NO: 353570 - DNA, 25 bp, Homo sapien
gatgtaatcttgctgccatgctatg

SEQ ID NO: 353571 - DNA, 25 bp, Homo sapien
cttgctgccatgctatgtatcaata

SEQ ID NO: 353572 - DNA, 25 bp, Homo sapien
ctgggaccctggaccaccatgagga

SEQ ID NO: 353573 - DNA, 25 bp, Homo sapien
ggaccaccatgaggagagcttgcag

SEQ ID NO: 353574 - DNA, 25 bp, Homo sapien
gagcttgcagtcctcacaagtgcag

SEQ ID NO: 353575 - DNA, 25 bp, Homo sapien
agggacaccgcctgcaaggacacac

SEQ ID NO: 353576 - DNA, 25 bp, Homo sapien
acacatggctcctgtagccaagtgg

SEQ ID NO: 353577 - DNA, 25 bp, Homo sapien
caagtggccctgtgtggcctacaaa

SEQ ID NO: 353578 - DNA, 25 bp, Homo sapien
cctgtgtggcctacaaagatctgct

SEQ ID NO: 353579 - DNA, 25 bp, Homo sapien
gatctgctgagtggagaccagccag

SEQ ID NO: 353580 - DNA, 25 bp, Homo sapien
agatgctggaatacgggttctcgct

SEQ ID NO: 353581 - DNA, 25 bp, Homo sapien
acgggttctcgctgcaagtgtgttt

SEQ ID NO: 353582 - DNA, 25 bp, Homo sapien
aagtgtgtttgagccttggagccag

SEQ ID NO: 353583 - DNA, 25 bp, Homo sapien
ctattcaggtttgagttcactctat

SEQ ID NO: 353584 - DNA, 25 bp, Homo sapien
gagttcactctatcacctaatggca

SEQ ID NO: 353585 - DNA, 25 bp, Homo sapien
actctatcacctaatggcacatttc

SEQ ID NO: 353586 - DNA, 25 bp, Homo sapien
atggcacatttctcagagtgcatcc

SEQ ID NO: 353587 - DNA, 25 bp, Homo sapien
atttctcagagtgcatccccatggc

SEQ ID NO: 353588 - DNA, 25 bp, Homo sapien
atccccatggctaactgacgcatga

SEQ ID NO: 353589 - DNA, 25 bp, Homo sapien
ggctaactgacgcatgactatggtt

SEQ ID NO: 353590 - DNA, 25 bp, Homo sapien
catgactatggttgcgctcttatat

SEQ ID NO: 353591 - DNA, 25 bp, Homo sapien
ggttgcgctcttatatttagttcag

SEQ ID NO: 353592 - DNA, 25 bp, Homo sapien
tcagaattcagaacctctgcttccc

SEQ ID NO: 353593 - DNA, 25 bp, Homo sapien
catctctgactgtgccaactcaaaa

SEQ ID NO: 353594 - DNA, 25 bp, Homo sapien
gttcttgaactagacttctgatgct

SEQ ID NO: 353595 - DNA, 25 bp, Homo sapien
tcttgaactagacttctgatgcttc

SEQ ID NO: 353596 - DNA, 25 bp, Homo sapien
aatgactttcaggataacatctagt

SEQ ID NO: 353597 - DNA, 25 bp, Homo sapien
gactttcaggataacatctagttgt

SEQ ID NO: 353598 - DNA, 25 bp, Homo sapien
acatctagttgttcagacttcaccc

SEQ ID NO: 353599 - DNA, 25 bp, Homo sapien
atctagttgttcagacttcaccctt

SEQ ID NO: 353600 - DNA, 25 bp, Homo sapien
tagttgttcagacttcacccttcac

SEQ ID NO: 353601 - DNA, 25 bp, Homo sapien
gttgttcagacttcacccttcacag

SEQ ID NO: 353602 - DNA, 25 bp, Homo sapien
aaagactgaaatgaactacttggtt

SEQ ID NO: 353603 - DNA, 25 bp, Homo sapien
gacattgtttggaggcataatattc

SEQ ID NO: 353604 - DNA, 25 bp, Homo sapien
gaggcataatattctttatatggaa

SEQ ID NO: 353605 - DNA, 25 bp, Homo sapien
ggacttccaaggcaaagatttcttt

SEQ ID NO: 353606 - DNA, 25 bp, Homo sapien
gttttacaaagttggcctctggatt

SEQ ID NO: 353607 - DNA, 25 bp, Homo sapien
tggattcccttttcccaaagctaat

SEQ ID NO: 353608 - DNA, 25 bp, Homo sapien
aagctaattcaccacaaaggcaccc

SEQ ID NO: 353609 - DNA, 25 bp, Homo sapien
aaaggcacccctcaagtcaaggagc

SEQ ID NO: 353610 - DNA, 25 bp, Homo sapien
ggagctggactttcatacacctgca

SEQ ID NO: 353611 - DNA, 25 bp, Homo sapien
acctgcacctgtcaatcatgggtaa

SEQ ID NO: 353612 - DNA, 25 bp, Homo sapien
ggtgctgtgggattgacataaactc

SEQ ID NO: 353613 - DNA, 25 bp, Homo sapien
aactcccaggtattgccagctctga

SEQ ID NO: 353614 - DNA, 25 bp, Homo sapien
gcctcaggcaagcttgtgactaaat

SEQ ID NO: 353615 - DNA, 25 bp, Homo sapien
tccagtagtctgaggacagtcctta

SEQ ID NO: 353616 - DNA, 25 bp, Homo sapien
tccaggtgcctgagggagatcccct

SEQ ID NO: 353617 - DNA, 25 bp, Homo sapien
gggagatcccctgcaggcagacgca

SEQ ID NO: 353618 - DNA, 25 bp, Homo sapien
gcaggcagacgcaggactcaggact

SEQ ID NO: 353619 - DNA, 25 bp, Homo sapien
caggactcaggactgggctttccag

SEQ ID NO: 353620 - DNA, 25 bp, Homo sapien
actcttcactccattgcaagctagg

SEQ ID NO: 353621 - DNA, 25 bp, Homo sapien
ttcactccattgcaagctaggcaga

SEQ ID NO: 353622 - DNA, 25 bp, Homo sapien
aagctaggcagaatacggcctcgat

SEQ ID NO: 353623 - DNA, 25 bp, Homo sapien
agtgcccacaggagtttggcggacc

SEQ ID NO: 353624 - DNA, 25 bp, Homo sapien
agtttggcggaccagagccatctgt

SEQ ID NO: 353625 - DNA, 25 bp, Homo sapien
gcggaccagagccatctgtccatgt

SEQ ID NO: 353626 - DNA, 25 bp, Homo sapien
aagtatgcacttaggagtcagttgt

SEQ ID NO: 353627 - DNA, 25 bp, Homo sapien
gaaagaacttgactacacagtatgg

SEQ ID NO: 353628 - DNA, 25 bp, Homo sapien
gaacttgactacacagtatggctca

SEQ ID NO: 353629 - DNA, 25 bp, Homo sapien
acttgactacacagtatggctcatg

SEQ ID NO: 353630 - DNA, 25 bp, Homo sapien
ttgactacacagtatggctcatgcc

SEQ ID NO: 353631 - DNA, 25 bp, Homo sapien
tgactacacagtatggctcatgcct

SEQ ID NO: 353632 - DNA, 25 bp, Homo sapien
tagccgggcatgttgctgggcactt

SEQ ID NO: 353633 - DNA, 25 bp, Homo sapien
gggcatgttgctgggcacttgtaat

SEQ ID NO: 353634 - DNA, 25 bp, Homo sapien
tgaaccagaatcaagccacttacgc

SEQ ID NO: 353635 - DNA, 25 bp, Homo sapien
gaaccagaatcaagccacttacgct

SEQ ID NO: 353636 - DNA, 25 bp, Homo sapien
cagaatcaagccacttacgctccag

SEQ ID NO: 353637 - DNA, 25 bp, Homo sapien
agaatcaagccacttacgctccagc

SEQ ID NO: 353638 - DNA, 25 bp, Homo sapien
gggacagtcctcttcacagtcagaa

SEQ ID NO: 353639 - DNA, 25 bp, Homo sapien
tcacagtcagaatccgccacgtagt

SEQ ID NO: 353640 - DNA, 25 bp, Homo sapien
gccacgtagtaagtgccgcttccaa

SEQ ID NO: 353641 - DNA, 25 bp, Homo sapien
gtgccgcttccaaccaatcaagagg

SEQ ID NO: 353642 - DNA, 25 bp, Homo sapien
caagaggcagttagcgcagaccttt

SEQ ID NO: 353643 - DNA, 25 bp, Homo sapien
gcagacctttgagggacatccactt

SEQ ID NO: 353644 - DNA, 25 bp, Homo sapien
gacatccacttccaccaatgatctt

SEQ ID NO: 353645 - DNA, 25 bp, Homo sapien
ccaatgatcttcaagtcttctccag

SEQ ID NO: 353646 - DNA, 25 bp, Homo sapien
accgcgatggccaatctgttgtagg

SEQ ID NO: 353647 - DNA, 25 bp, Homo sapien
gaagagctacaataccagctccttt

SEQ ID NO: 353648 - DNA, 25 bp, Homo sapien
ataccagctcctttaaggtcgacct

SEQ ID NO: 353649 - DNA, 25 bp, Homo sapien
agcacatatatctgaacctgaagat

SEQ ID NO: 353650 - DNA, 25 bp, Homo sapien
gaccatgttgaggttgaaactgcca

SEQ ID NO: 353651 - DNA, 25 bp, Homo sapien
actggaatcctagaaattcttcaga

SEQ ID NO: 353652 - DNA, 25 bp, Homo sapien
cagaactttctggattagtaaatac

SEQ ID NO: 353653 - DNA, 25 bp, Homo sapien
tttaaagtcgctatgtgaacacagt

SEQ ID NO: 353654 - DNA, 25 bp, Homo sapien
gaacacagtactgctttagacagct

SEQ ID NO: 353655 - DNA, 25 bp, Homo sapien
tactgctttagacagcttggaaata

SEQ ID NO: 353656 - DNA, 25 bp, Homo sapien
aagaaaaatactgtctttcagcaag

SEQ ID NO: 353657 - DNA, 25 bp, Homo sapien
ttccaattctttgttttacccactg

SEQ ID NO: 353658 - DNA, 25 bp, Homo sapien
ttacccactgggaaaaaagcatctt

SEQ ID NO: 353659 - DNA, 25 bp, Homo sapien
aagcatcttatttccaaagacacag

SEQ ID NO: 353660 - DNA, 25 bp, Homo sapien
agcctctgaggtctcagcggtctgt

SEQ ID NO: 353661 - DNA, 25 bp, Homo sapien
gaggtctcagcggtctgttcctgag

SEQ ID NO: 353662 - DNA, 25 bp, Homo sapien
catagggacgacaggagccaggacc

SEQ ID NO: 353663 - DNA, 25 bp, Homo sapien
agcggtctgttcctgaggcattttc

SEQ ID NO: 353664 - DNA, 25 bp, Homo sapien
gtctgttcctgaggcattttccgcc

SEQ ID NO: 353665 - DNA, 25 bp, Homo sapien
tggaactctcgcagccactttccgg

SEQ ID NO: 353666 - DNA, 25 bp, Homo sapien
cactttccggcctggtggatgacta

SEQ ID NO: 353667 - DNA, 25 bp, Homo sapien
tttccggcctggtggatgactatgg

SEQ ID NO: 353668 - DNA, 25 bp, Homo sapien
ccggcctggtggatgactatggcat

SEQ ID NO: 353669 - DNA, 25 bp, Homo sapien
ggtggatgactatggcatcctcccc

SEQ ID NO: 353670 - DNA, 25 bp, Homo sapien
tgtctagggcccagcagcgcaagcg

SEQ ID NO: 353671 - DNA, 25 bp, Homo sapien
tctttgctcttttgtctgtactgga

SEQ ID NO: 353672 - DNA, 25 bp, Homo sapien
tcttttgtctgtactggatttttca

SEQ ID NO: 353673 - DNA, 25 bp, Homo sapien
gtatttctaagaattgttgcaacca

SEQ ID NO: 353674 - DNA, 25 bp, Homo sapien
gttgcaaccatacagggcagccatg

SEQ ID NO: 353675 - DNA, 25 bp, Homo sapien
gccaggttttatgaattaactcttg

SEQ ID NO: 353676 - DNA, 25 bp, Homo sapien
agggcagccatggagctgactctac

SEQ ID NO: 353677 - DNA, 25 bp, Homo sapien
ggagctgactctacattttgtttta

SEQ ID NO: 353678 - DNA, 25 bp, Homo sapien
gttttatacctgcactatttattta

SEQ ID NO: 353679 - DNA, 25 bp, Homo sapien
ttaggagggtcctcttggtagctct

SEQ ID NO: 353680 - DNA, 25 bp, Homo sapien
tcctcttggtagctctttaacccat

SEQ ID NO: 353681 - DNA, 25 bp, Homo sapien
ggaaatgattctttgctcttttgtc

SEQ ID NO: 353682 - DNA, 25 bp, Homo sapien
agagcccagaatccttgcatacatt

SEQ ID NO: 353683 - DNA, 25 bp, Homo sapien
gaatccttgcatacattttctcatt

SEQ ID NO: 353684 - DNA, 25 bp, Homo sapien
tgctaaaagctagaactccggcctc

SEQ ID NO: 353685 - DNA, 25 bp, Homo sapien
ggcctccttttacagacagttacta

SEQ ID NO: 353686 - DNA, 25 bp, Homo sapien
ggcttagaaacatccttcagctttt

SEQ ID NO: 353687 - DNA, 25 bp, Homo sapien
tcagcttttcagaggttgcaacata

SEQ ID NO: 353688 - DNA, 25 bp, Homo sapien
tgcaacatacaactggtctttttcc

SEQ ID NO: 353689 - DNA, 25 bp, Homo sapien
agcccagttctctttcactgatagg

SEQ ID NO: 353690 - DNA, 25 bp, Homo sapien
tctttcactgatagggccgttcatc

SEQ ID NO: 353691 - DNA, 25 bp, Homo sapien
gccgttcatcttttcctattcctta

SEQ ID NO: 353692 - DNA, 25 bp, Homo sapien
taacctcttgttctagtattctagt

SEQ ID NO: 353693 - DNA, 25 bp, Homo sapien
ttggattgagcccaccctgtaggga

SEQ ID NO: 353694 - DNA, 25 bp, Homo sapien
caccctgtagggagtgggaagccca

SEQ ID NO: 353695 - DNA, 25 bp, Homo sapien
aggcttgagaagcaaactcgcgttt

SEQ ID NO: 353696 - DNA, 25 bp, Homo sapien
caaactcgcgtttattgaccaccta

SEQ ID NO: 353697 - DNA, 25 bp, Homo sapien
taagtgctaaatacctccgcatttg

SEQ ID NO: 353698 - DNA, 25 bp, Homo sapien
cctccgcatttgttctcactttgaa

SEQ ID NO: 353699 - DNA, 25 bp, Homo sapien
gaagagtaaaggctacccctgccag

SEQ ID NO: 353700 - DNA, 25 bp, Homo sapien
ctgccaggtttccagtcttgggctg

SEQ ID NO: 353701 - DNA, 25 bp, Homo sapien
agggcctaggctttgaagcgctttt

SEQ ID NO: 353702 - DNA, 25 bp, Homo sapien
agcgcttttaaattgtcctctggcc

SEQ ID NO: 353703 - DNA, 25 bp, Homo sapien
gattaaccctgaaagtggcgccgag

SEQ ID NO: 353704 - DNA, 25 bp, Homo sapien
tatttgcttaccatttgcaagctaa

SEQ ID NO: 353705 - DNA, 25 bp, Homo sapien
ggctgttaaacacatctggcaccta

SEQ ID NO: 353706 - DNA, 25 bp, Homo sapien
catctggcacctagtttttccatta

SEQ ID NO: 353707 - DNA, 25 bp, Homo sapien
agtttttccattaagagcattgcta

SEQ ID NO: 353708 - DNA, 25 bp, Homo sapien
gagcattgctattttccctttttat

SEQ ID NO: 353709 - DNA, 25 bp, Homo sapien
gtagcttctgctgtcaaggttaaca

SEQ ID NO: 353710 - DNA, 25 bp, Homo sapien
aacaattctatatgctttaggaagc

SEQ ID NO: 353711 - DNA, 25 bp, Homo sapien
gctaagttctaatttccttttgtga

SEQ ID NO: 353712 - DNA, 25 bp, Homo sapien
taaccagtatgttaccacagacatc

SEQ ID NO: 353713 - DNA, 25 bp, Homo sapien
cagacatcagttgcaaagctacgat

SEQ ID NO: 353714 - DNA, 25 bp, Homo sapien
gatgatagtgtgattcttagccgaa

SEQ ID NO: 353715 - DNA, 25 bp, Homo sapien
cagccacgcaagttagactctagat

SEQ ID NO: 353716 - DNA, 25 bp, Homo sapien
agccacgcaagttagactctagatt

SEQ ID NO: 353717 - DNA, 25 bp, Homo sapien
gccacgcaagttagactctagatta

SEQ ID NO: 353718 - DNA, 25 bp, Homo sapien
ccacgcaagttagactctagattaa

SEQ ID NO: 353719 - DNA, 25 bp, Homo sapien
agactctagattaaattcctcccgc

SEQ ID NO: 353720 - DNA, 25 bp, Homo sapien
gactctagattaaattcctcccgcg

SEQ ID NO: 353721 - DNA, 25 bp, Homo sapien
actctagattaaattcctcccgcgg

SEQ ID NO: 353722 - DNA, 25 bp, Homo sapien
ctctagattaaattcctcccgcggt

SEQ ID NO: 353723 - DNA, 25 bp, Homo sapien
tctagattaaattcctcccgcggtt

SEQ ID NO: 353724 - DNA, 25 bp, Homo sapien
tagattaaattcctcccgcggttag

SEQ ID NO: 353725 - DNA, 25 bp, Homo sapien
ttaaattcctcccgcggttagcctg

SEQ ID NO: 353726 - DNA, 25 bp, Homo sapien
ttctaaatgtgggttgattgactgt

SEQ ID NO: 353727 - DNA, 25 bp, Homo sapien
tgtgggttgattgactgttaattga

SEQ ID NO: 353728 - DNA, 25 bp, Homo sapien
tgttaattgattcagggtaccctta

SEQ ID NO: 353729 - DNA, 25 bp, Homo sapien
gttttcccattgtgaaccttaaatg

SEQ ID NO: 353730 - DNA, 25 bp, Homo sapien
gtgaaccttaaatgatcagagaagt

SEQ ID NO: 353731 - DNA, 25 bp, Homo sapien
tctgttgggagaacaaaacttttct

SEQ ID NO: 353732 - DNA, 25 bp, Homo sapien
tcaaagggccttgattggtggttgt

SEQ ID NO: 353733 - DNA, 25 bp, Homo sapien
ttggtggttgtgtctcggttaaaat

SEQ ID NO: 353734 - DNA, 25 bp, Homo sapien
aaaatttatgggactttgctatgta

SEQ ID NO: 353735 - DNA, 25 bp, Homo sapien
gggactttgctatgtagttggcatt

SEQ ID NO: 353736 - DNA, 25 bp, Homo sapien
tgtagttggcatttataaaatctga

SEQ ID NO: 353737 - DNA, 25 bp, Homo sapien
gtctcactgtgagctgatcacagat

SEQ ID NO: 353738 - DNA, 25 bp, Homo sapien
cagatgatggaattcgtcacctggg

SEQ ID NO: 353739 - DNA, 25 bp, Homo sapien
aaagatggacctggaagagtgtgtc

SEQ ID NO: 353740 - DNA, 25 bp, Homo sapien
ggcctgcgcccatgaccagctggag

SEQ ID NO: 353741 - DNA, 25 bp, Homo sapien
gtccagattacagatagcacattaa

SEQ ID NO: 353742 - DNA, 25 bp, Homo sapien
agcacattaacccactttctaaaca

SEQ ID NO: 353743 - DNA, 25 bp, Homo sapien
cattaacccactttctaaacactgt

SEQ ID NO: 353744 - DNA, 25 bp, Homo sapien
tctaaacactgtcctggacttcaag

SEQ ID NO: 353745 - DNA, 25 bp, Homo sapien
cactgtcctggacttcaagtattga

SEQ ID NO: 353746 - DNA, 25 bp, Homo sapien
gacttcaagtattgagtctgtctca

SEQ ID NO: 353747 - DNA, 25 bp, Homo sapien
agtctgtctcactgtgagctgatca

SEQ ID NO: 353748 - DNA, 25 bp, Homo sapien
atgccattgcactccgactctgggc

SEQ ID NO: 353749 - DNA, 25 bp, Homo sapien
agtgtgctttgtcaagagaagcacc

SEQ ID NO: 353750 - DNA, 25 bp, Homo sapien
gtgtgctttgtcaagagaagcacca

SEQ ID NO: 353751 - DNA, 25 bp, Homo sapien
tgctttgtcaagagaagcaccagca

SEQ ID NO: 353752 - DNA, 25 bp, Homo sapien
gctttgtcaagagaagcaccagcag

SEQ ID NO: 353753 - DNA, 25 bp, Homo sapien
ctttgtcaagagaagcaccagcaga

SEQ ID NO: 353754 - DNA, 25 bp, Homo sapien
ttgtcaagagaagcaccagcagacc

SEQ ID NO: 353755 - DNA, 25 bp, Homo sapien
tgtcaagagaagcaccagcagacct

SEQ ID NO: 353756 - DNA, 25 bp, Homo sapien
gtcaagagaagcaccagcagacctc

SEQ ID NO: 353757 - DNA, 25 bp, Homo sapien
gaagcaccagcagacctctaagaac

SEQ ID NO: 353758 - DNA, 25 bp, Homo sapien
agacctctaagaactgctctctaag

SEQ ID NO: 353759 - DNA, 25 bp, Homo sapien
gggagttggaatgtcactagagaac

SEQ ID NO: 353760 - DNA, 25 bp, Homo sapien
gtcactagagaacaaaaggccggaa

SEQ ID NO: 353761 - DNA, 25 bp, Homo sapien
acaaaaggccggaaatgtttccatg

SEQ ID NO: 353762 - DNA, 25 bp, Homo sapien
aatcccaggagttctgttgtcttga

SEQ ID NO: 353763 - DNA, 25 bp, Homo sapien
agttctgttgtcttgaaagtcatag

SEQ ID NO: 353764 - DNA, 25 bp, Homo sapien
atggttaggtgttacggctttctcg

SEQ ID NO: 353765 - DNA, 25 bp, Homo sapien
tgttacggctttctcgtcgttttgc

SEQ ID NO: 353766 - DNA, 25 bp, Homo sapien
tcgtcgttttgcttccgtatgttaa

SEQ ID NO: 353767 - DNA, 25 bp, Homo sapien
gttttgcttccgtatgttaaacata

SEQ ID NO: 353768 - DNA, 25 bp, Homo sapien
ttaaacatacagcactcaccaacgt

SEQ ID NO: 353769 - DNA, 25 bp, Homo sapien
tacagcactcaccaacgttgaaatg

SEQ ID NO: 353770 - DNA, 25 bp, Homo sapien
agaaaggccagcaaccgagtgaagg

SEQ ID NO: 353771 - DNA, 25 bp, Homo sapien
ccagcaaccgagtgaaggcagcatt

SEQ ID NO: 353772 - DNA, 25 bp, Homo sapien
gcaaccgagtgaaggcagcatttca

SEQ ID NO: 353773 - DNA, 25 bp, Homo sapien
agtgaaggcagcatttcacttcctc

SEQ ID NO: 353774 - DNA, 25 bp, Homo sapien
atttcaaatcctgtaaaccagaaga

SEQ ID NO: 353775 - DNA, 25 bp, Homo sapien
gaaacaccaaaaggaatccgcaggt

SEQ ID NO: 353776 - DNA, 25 bp, Homo sapien
aggaatccgcaggtatattgtctct

SEQ ID NO: 353777 - DNA, 25 bp, Homo sapien
gaatccgcaggtatattgtctctga

SEQ ID NO: 353778 - DNA, 25 bp, Homo sapien
atccgcaggtatattgtctctgaca

SEQ ID NO: 353779 - DNA, 25 bp, Homo sapien
gtctctgacaatactatacttgaag

SEQ ID NO: 353780 - DNA, 25 bp, Homo sapien
attctcaaaggaaatgtagctcatt

SEQ ID NO: 353781 - DNA, 25 bp, Homo sapien
ttgttctttaaggtttcatcatgaa

SEQ ID NO: 353782 - DNA, 25 bp, Homo sapien
agcccagtttcaaagtaataactat

SEQ ID NO: 353783 - DNA, 25 bp, Homo sapien
aaagctactaagtgcatagcattat

SEQ ID NO: 353784 - DNA, 25 bp, Homo sapien
gcatagcattataggtggttatcac

SEQ ID NO: 353785 - DNA, 25 bp, Homo sapien
gcattataggtggttatcacagaaa

SEQ ID NO: 353786 - DNA, 25 bp, Homo sapien
gtgaccctgcccttgattagcttgt

SEQ ID NO: 353787 - DNA, 25 bp, Homo sapien
ctgcccttgattagcttgtcacata

SEQ ID NO: 353788 - DNA, 25 bp, Homo sapien
gcccttgattagcttgtcacataaa

SEQ ID NO: 353789 - DNA, 25 bp, Homo sapien
gattagcttgtcacataaaggcagg

SEQ ID NO: 353790 - DNA, 25 bp, Homo sapien
agcttgtcacataaaggcagggaat

SEQ ID NO: 353791 - DNA, 25 bp, Homo sapien
agacagttcttgacaaggtactcaa

SEQ ID NO: 353792 - DNA, 25 bp, Homo sapien
aggacaaggctaagacaatttcagg

SEQ ID NO: 353793 - DNA, 25 bp, Homo sapien
acaaggctaagacaatttcagggct

SEQ ID NO: 353794 - DNA, 25 bp, Homo sapien
ggctaagacaatttcagggcttcct

SEQ ID NO: 353795 - DNA, 25 bp, Homo sapien
gctaagacaatttcagggcttcctt

SEQ ID NO: 353796 - DNA, 25 bp, Homo sapien
aagacaatttcagggcttccttggg

SEQ ID NO: 353797 - DNA, 25 bp, Homo sapien
gacaatttcagggcttccttgggaa

SEQ ID NO: 353798 - DNA, 25 bp, Homo sapien
actgaggtttggaggtattcctctg

SEQ ID NO: 353799 - DNA, 25 bp, Homo sapien
aggtttggaggtattcctctggagt

SEQ ID NO: 353800 - DNA, 25 bp, Homo sapien
gtttggaggtattcctctggagttt

SEQ ID NO: 353801 - DNA, 25 bp, Homo sapien
attcctctggagttttcacttatac

SEQ ID NO: 353802 - DNA, 25 bp, Homo sapien
tcctctggagttttcacttatacca

SEQ ID NO: 353803 - DNA, 25 bp, Homo sapien
gggacaaatgttactttactcttgc

SEQ ID NO: 353804 - DNA, 25 bp, Homo sapien
ttactcttgcacagaacttggacag

SEQ ID NO: 353805 - DNA, 25 bp, Homo sapien
acttggacagtcacttttaatatct

SEQ ID NO: 353806 - DNA, 25 bp, Homo sapien
ttttcattactgataccctctgccc

SEQ ID NO: 353807 - DNA, 25 bp, Homo sapien
gatgcatccatagcacctagtgaag

SEQ ID NO: 353808 - DNA, 25 bp, Homo sapien
cccttctttctgactaaaactctca

SEQ ID NO: 353809 - DNA, 25 bp, Homo sapien
gtgaaggctcaccatatggtcagaa

SEQ ID NO: 353810 - DNA, 25 bp, Homo sapien
atggtcagaatactcgatgcacact

SEQ ID NO: 353811 - DNA, 25 bp, Homo sapien
gatgcacactgatacaactctctac

SEQ ID NO: 353812 - DNA, 25 bp, Homo sapien
ctgatacaactctctacatccatct

SEQ ID NO: 353813 - DNA, 25 bp, Homo sapien
atccatctctgtgttagggacaaat

SEQ ID NO: 353814 - DNA, 25 bp, Homo sapien
aaaacctcacttggggaattctgct

SEQ ID NO: 353815 - DNA, 25 bp, Homo sapien
cacttggggaattctgctataagca

SEQ ID NO: 353816 - DNA, 25 bp, Homo sapien
tgctataagcagtgaaacaccatgg

SEQ ID NO: 353817 - DNA, 25 bp, Homo sapien
gcagtgaaacaccatggaaggattc

SEQ ID NO: 353818 - DNA, 25 bp, Homo sapien
agtgaaacaccatggaaggattctg

SEQ ID NO: 353819 - DNA, 25 bp, Homo sapien
atggaaggattctgagctgttgaca

SEQ ID NO: 353820 - DNA, 25 bp, Homo sapien
gaaggattctgagctgttgacaaca

SEQ ID NO: 353821 - DNA, 25 bp, Homo sapien
aaggattctgagctgttgacaacag

SEQ ID NO: 353822 - DNA, 25 bp, Homo sapien
ggattctgagctgttgacaacagat

SEQ ID NO: 353823 - DNA, 25 bp, Homo sapien
ctgagctgttgacaacagattttca

SEQ ID NO: 353824 - DNA, 25 bp, Homo sapien
agaaattcattctgcaaaatacaaa

SEQ ID NO: 353825 - DNA, 25 bp, Homo sapien
tagtctgattagtccagtctcttca

SEQ ID NO: 353826 - DNA, 25 bp, Homo sapien
attagtccagtctcttcactttagt

SEQ ID NO: 353827 - DNA, 25 bp, Homo sapien
gtctcttcactttagtcctgcataa

SEQ ID NO: 353828 - DNA, 25 bp, Homo sapien
ataaagacataaacaattggccagg

SEQ ID NO: 353829 - DNA, 25 bp, Homo sapien
tgcctataatcctactgaaatccta

SEQ ID NO: 353830 - DNA, 25 bp, Homo sapien
tgaaatcctaaagctctgggagcct

SEQ ID NO: 353831 - DNA, 25 bp, Homo sapien
tcctaaagctctgggagcctgagtt

SEQ ID NO: 353832 - DNA, 25 bp, Homo sapien
tggctgatgggcctctttgataatc

SEQ ID NO: 353833 - DNA, 25 bp, Homo sapien
gatgggcctctttgataatcagatg

SEQ ID NO: 353834 - DNA, 25 bp, Homo sapien
cagatggaagctttagacccacttt

SEQ ID NO: 353835 - DNA, 25 bp, Homo sapien
gcaaattcttcatgtgtatgcagaa

SEQ ID NO: 353836 - DNA, 25 bp, Homo sapien
agtgcacccccttaagggtaagcag

SEQ ID NO: 353837 - DNA, 25 bp, Homo sapien
atctagagtctgatagtctgtgtgt

SEQ ID NO: 353838 - DNA, 25 bp, Homo sapien
gtctagaagtctgtggaaacgccct

SEQ ID NO: 353839 - DNA, 25 bp, Homo sapien
gaagtctgtggaaacgccctgaaac

SEQ ID NO: 353840 - DNA, 25 bp, Homo sapien
gtattatcttaactaccctcttatg

SEQ ID NO: 353841 - DNA, 25 bp, Homo sapien
taccctcttatgttaaggtttacat

SEQ ID NO: 353842 - DNA, 25 bp, Homo sapien
ttcttttggaataagctgtggaaat

SEQ ID NO: 353843 - DNA, 25 bp, Homo sapien
gctgtggaaattttgttacaacctg

SEQ ID NO: 353844 - DNA, 25 bp, Homo sapien
gttacaacctggttgagatcaacct

SEQ ID NO: 353845 - DNA, 25 bp, Homo sapien
gttgagatcaacctctttacaatga

SEQ ID NO: 353846 - DNA, 25 bp, Homo sapien
gatcaacctctttacaatgacacaa

SEQ ID NO: 353847 - DNA, 25 bp, Homo sapien
ccagcagcacaaagagatgaagggc

SEQ ID NO: 353848 - DNA, 25 bp, Homo sapien
atgcagcaggcaaagttaacattgt

SEQ ID NO: 353849 - DNA, 25 bp, Homo sapien
atttgtgagtacagttgaggataaa

SEQ ID NO: 353850 - DNA, 25 bp, Homo sapien
ggatgaaatccacggtgaggaccat

SEQ ID NO: 353851 - DNA, 25 bp, Homo sapien
gaaatccacggtgaggaccatcatg

SEQ ID NO: 353852 - DNA, 25 bp, Homo sapien
atccacggtgaggaccatcatggtg

SEQ ID NO: 353853 - DNA, 25 bp, Homo sapien
aatagtttattctaatggattcaag

SEQ ID NO: 353854 - DNA, 25 bp, Homo sapien
ggattcaagagctttggagaccaaa

SEQ ID NO: 353855 - DNA, 25 bp, Homo sapien
tttggagaccaaactaacacattta

SEQ ID NO: 353856 - DNA, 25 bp, Homo sapien
tatgtgcagttaaagtcatagaaac

SEQ ID NO: 353857 - DNA, 25 bp, Homo sapien
tattttcaagaaagctggatctgtt

SEQ ID NO: 353858 - DNA, 25 bp, Homo sapien
gtgttatctttacttcaccacatag

SEQ ID NO: 353859 - DNA, 25 bp, Homo sapien
ttatctttacttcaccacatagcct

SEQ ID NO: 353860 - DNA, 25 bp, Homo sapien
cacatagcctctcctgaattggtgg

SEQ ID NO: 353861 - DNA, 25 bp, Homo sapien
agcctctcctgaattggtggacctg

SEQ ID NO: 353862 - DNA, 25 bp, Homo sapien
ctgaattggtggacctggattccta

SEQ ID NO: 353863 - DNA, 25 bp, Homo sapien
tggattcctagcttggctcagtccc

SEQ ID NO: 353864 - DNA, 25 bp, Homo sapien
gtgtggcctttagcatcacctagat

SEQ ID NO: 353865 - DNA, 25 bp, Homo sapien
ggcctttagcatcacctagattcta

SEQ ID NO: 353866 - DNA, 25 bp, Homo sapien
ttgttttacacatgtcaatctgcct

SEQ ID NO: 353867 - DNA, 25 bp, Homo sapien
tacacatgtcaatctgcctatccat

SEQ ID NO: 353868 - DNA, 25 bp, Homo sapien
ccctctatccattcatttatccatt

SEQ ID NO: 353869 - DNA, 25 bp, Homo sapien
gacacagacggaaccaccagtgggt

SEQ ID NO: 353870 - DNA, 25 bp, Homo sapien
accaccagtgggttcgccttttctg

SEQ ID NO: 353871 - DNA, 25 bp, Homo sapien
gggttcgccttttctgctgcccaga

SEQ ID NO: 353872 - DNA, 25 bp, Homo sapien
aacttgcttaccaaggtatggaaca

SEQ ID NO: 353873 - DNA, 25 bp, Homo sapien
gaaacccaaatctaaatacacttct

SEQ ID NO: 353874 - DNA, 25 bp, Homo sapien
ataaatctccctaactggttccaag

SEQ ID NO: 353875 - DNA, 25 bp, Homo sapien
aactggttccaagcttgtacgagtg

SEQ ID NO: 353876 - DNA, 25 bp, Homo sapien
caagcttgtacgagtggaataattt

SEQ ID NO: 353877 - DNA, 25 bp, Homo sapien
tttggtggaatgttggtttctggtt

SEQ ID NO: 353878 - DNA, 25 bp, Homo sapien
gtttctggttagtagtggaacactt

SEQ ID NO: 353879 - DNA, 25 bp, Homo sapien
acagaggtaaggacacagacggaac

SEQ ID NO: 353880 - DNA, 25 bp, Homo sapien
ccagagcagaaatcctagggtttta

SEQ ID NO: 353881 - DNA, 25 bp, Homo sapien
gaaatcctagggttttaggaagcag

SEQ ID NO: 353882 - DNA, 25 bp, Homo sapien
acagggttggactgcctgggcctca

SEQ ID NO: 353883 - DNA, 25 bp, Homo sapien
agggaccagggtctctggccttcaa

SEQ ID NO: 353884 - DNA, 25 bp, Homo sapien
ttcaaccccctgttaggagctgcta

SEQ ID NO: 353885 - DNA, 25 bp, Homo sapien
ctctgtgacatctaaagttatcggg

SEQ ID NO: 353886 - DNA, 25 bp, Homo sapien
agggtctgccctgttgctgggattc

SEQ ID NO: 353887 - DNA, 25 bp, Homo sapien
tgttgctgggattcctcaccagagt

SEQ ID NO: 353888 - DNA, 25 bp, Homo sapien
ggattcctcaccagagttcttgcct

SEQ ID NO: 353889 - DNA, 25 bp, Homo sapien
agttcttgcctcctcttcgggcagt

SEQ ID NO: 353890 - DNA, 25 bp, Homo sapien
tcttcgggcagtggcctgcagcagc

SEQ ID NO: 353891 - DNA, 25 bp, Homo sapien
cgtagctgtctcaatcagagatttt

SEQ ID NO: 353892 - DNA, 25 bp, Homo sapien
gtcgctggctcccagtccaagggat

SEQ ID NO: 353893 - DNA, 25 bp, Homo sapien
ctggctcccagtccaagggatggat

SEQ ID NO: 353894 - DNA, 25 bp, Homo sapien
ctcccagtccaagggatggatcctt

SEQ ID NO: 353895 - DNA, 25 bp, Homo sapien
tggatccttggattgggtgagccaa

SEQ ID NO: 353896 - DNA, 25 bp, Homo sapien
tgagccaaggtcatgtgcctgtgtt

SEQ ID NO: 353897 - DNA, 25 bp, Homo sapien
agccaaggtcatgtgcctgtgttct

SEQ ID NO: 353898 - DNA, 25 bp, Homo sapien
tgcttcccaccaagattcctaagcc

SEQ ID NO: 353899 - DNA, 25 bp, Homo sapien
aaaggggttcatatgctggacagca

SEQ ID NO: 353900 - DNA, 25 bp, Homo sapien
agcaacccccacaaaggacaaatgt

SEQ ID NO: 353901 - DNA, 25 bp, Homo sapien
tagcagctagctagggccaaggtca

SEQ ID NO: 353902 - DNA, 25 bp, Homo sapien
gattgagatagtcccataacttcag

SEQ ID NO: 353903 - DNA, 25 bp, Homo sapien
gtcccataacttcagatttcacttt

SEQ ID NO: 353904 - DNA, 25 bp, Homo sapien
aatcacctgttagtatcttgaatag

SEQ ID NO: 353905 - DNA, 25 bp, Homo sapien
tgaatagatcttgcctacttcttcc

SEQ ID NO: 353906 - DNA, 25 bp, Homo sapien
ctacttcttccaactctagacataa

SEQ ID NO: 353907 - DNA, 25 bp, Homo sapien
agatttcattctgctttcccaatct

SEQ ID NO: 353908 - DNA, 25 bp, Homo sapien
attctgctttcccaatctactgctg

SEQ ID NO: 353909 - DNA, 25 bp, Homo sapien
ctgggagtcatcagggcagctgcat

SEQ ID NO: 353910 - DNA, 25 bp, Homo sapien
ggcagctgcatcctaaagtccaaag

SEQ ID NO: 353911 - DNA, 25 bp, Homo sapien
cagaacgcaacccaatcttaaattt

SEQ ID NO: 353912 - DNA, 25 bp, Homo sapien
actgtcacttgcctgtgtaaagtat

SEQ ID NO: 353913 - DNA, 25 bp, Homo sapien
gtttctatgccgtcattaagtttta

SEQ ID NO: 353914 - DNA, 25 bp, Homo sapien
ggcatgcgaccggaagcagcttttt

SEQ ID NO: 353915 - DNA, 25 bp, Homo sapien
aagcagctttttcagaaatctccag

SEQ ID NO: 353916 - DNA, 25 bp, Homo sapien
agaaatctccagtcaaggttcgtct

SEQ ID NO: 353917 - DNA, 25 bp, Homo sapien
agttcaacatcaagcccttgccctg

SEQ ID NO: 353918 - DNA, 25 bp, Homo sapien
tgccctgaacagttccaaatgccaa

SEQ ID NO: 353919 - DNA, 25 bp, Homo sapien
atgggtgttccaaaaggatcatcaa

SEQ ID NO: 353920 - DNA, 25 bp, Homo sapien
aaaaggatcatcaagcttcaggagc

SEQ ID NO: 353921 - DNA, 25 bp, Homo sapien
caagcttcaggagctttctgacctt

SEQ ID NO: 353922 - DNA, 25 bp, Homo sapien
aagatagcatggtgccacttccgaa

SEQ ID NO: 353923 - DNA, 25 bp, Homo sapien
gtgccacttccgaagcaaagcctga

SEQ ID NO: 353924 - DNA, 25 bp, Homo sapien
tacattcccagcttgatctcccatg

SEQ ID NO: 353925 - DNA, 25 bp, Homo sapien
tgtgctcctgccaaaccgactactt

SEQ ID NO: 353926 - DNA, 25 bp, Homo sapien
gactacttgccagcctcatacttgt

SEQ ID NO: 353927 - DNA, 25 bp, Homo sapien
agctttatgattcacattccccaac

SEQ ID NO: 353928 - DNA, 25 bp, Homo sapien
aatcagttcttcaaggtccactctc

SEQ ID NO: 353929 - DNA, 25 bp, Homo sapien
agtcctctcccttgagcagaaccga

SEQ ID NO: 353930 - DNA, 25 bp, Homo sapien
agaaccgattcctcacctctgttac

SEQ ID NO: 353931 - DNA, 25 bp, Homo sapien
gttactccagtagcacttctacaac

SEQ ID NO: 353932 - DNA, 25 bp, Homo sapien
tacaactcagatgttgccttaccat

SEQ ID NO: 353933 - DNA, 25 bp, Homo sapien
gatgttgccttaccatattctacgt

SEQ ID NO: 353934 - DNA, 25 bp, Homo sapien
ttctacgtaatgcacaactacacga

SEQ ID NO: 353935 - DNA, 25 bp, Homo sapien
gtctcaagcccctaggctcgggtga

SEQ ID NO: 353936 - DNA, 25 bp, Homo sapien
gtgcctggccagactttgtaatgta

SEQ ID NO: 353937 - DNA, 25 bp, Homo sapien
agaaagtgttgcctagatcctccat

SEQ ID NO: 353938 - DNA, 25 bp, Homo sapien
agtgttgcctagatcctccatggac

SEQ ID NO: 353939 - DNA, 25 bp, Homo sapien
tgcctagatcctccatggactccag

SEQ ID NO: 353940 - DNA, 25 bp, Homo sapien
ctgtctagattattcctgctcttca

SEQ ID NO: 353941 - DNA, 25 bp, Homo sapien
gattattcctgctcttcagtgatta

SEQ ID NO: 353942 - DNA, 25 bp, Homo sapien
attcctgctcttcagtgattagagt

SEQ ID NO: 353943 - DNA, 25 bp, Homo sapien
gattagagtggtttctaggcttctt

SEQ ID NO: 353944 - DNA, 25 bp, Homo sapien
gtttctaggcttcttgatggcgcaa

SEQ ID NO: 353945 - DNA, 25 bp, Homo sapien
ttcttgatggcgcaaggatcacaaa

SEQ ID NO: 353946 - DNA, 25 bp, Homo sapien
gccttggcacagaactgatggcaaa

SEQ ID NO: 353947 - DNA, 25 bp, Homo sapien
gttttcagcttctgggacccgagga

SEQ ID NO: 353948 - DNA, 25 bp, Homo sapien
atcagactggttaggaggcatccca

SEQ ID NO: 353949 - DNA, 25 bp, Homo sapien
atgcccaggtttcagccctaaaggt

SEQ ID NO: 353950 - DNA, 25 bp, Homo sapien
cagccctaaaggtaatgattgtctt

SEQ ID NO: 353951 - DNA, 25 bp, Homo sapien
aatgattgtcttgactctgccttgg

SEQ ID NO: 353952 - DNA, 25 bp, Homo sapien
tctgccttggcatttcgctcggaat

SEQ ID NO: 353953 - DNA, 25 bp, Homo sapien
atttcgctcggaatcacggcagact

SEQ ID NO: 353954 - DNA, 25 bp, Homo sapien
gaatcacggcagacttggagtgttt

SEQ ID NO: 353955 - DNA, 25 bp, Homo sapien
gtgtttcttcaaggcaggcatctgc

SEQ ID NO: 353956 - DNA, 25 bp, Homo sapien
catctgcttatgagcaaggtcaaag

SEQ ID NO: 353957 - DNA, 25 bp, Homo sapien
tggacagcctgcgatgtacggtaca

SEQ ID NO: 353958 - DNA, 25 bp, Homo sapien
gtacggtacactctcatatagggaa

SEQ ID NO: 353959 - DNA, 25 bp, Homo sapien
gaactggttcatacgtcacacaact

SEQ ID NO: 353960 - DNA, 25 bp, Homo sapien
caactttctaaagagctgccaggca

SEQ ID NO: 353961 - DNA, 25 bp, Homo sapien
cagaccttgagttctcttttccaaa

SEQ ID NO: 353962 - DNA, 25 bp, Homo sapien
aaaacatggcttgagcacctccttg

SEQ ID NO: 353963 - DNA, 25 bp, Homo sapien
tcctcatgtctcttatcttgttcta

SEQ ID NO: 353964 - DNA, 25 bp, Homo sapien
atcttgttctaatcatcccatggct

SEQ ID NO: 353965 - DNA, 25 bp, Homo sapien
tagcgtaagtagcacagatcccatc

SEQ ID NO: 353966 - DNA, 25 bp, Homo sapien
agatcccatctgcattccagctata

SEQ ID NO: 353967 - DNA, 25 bp, Homo sapien
agctatatgtgttcctgttgtttct

SEQ ID NO: 353968 - DNA, 25 bp, Homo sapien
ttagatgtgcccatcagaaatgagt

SEQ ID NO: 353969 - DNA, 25 bp, Homo sapien
catcagaaatgagtgtatggcatga

SEQ ID NO: 353970 - DNA, 25 bp, Homo sapien
gtatggcatgaaaaagttgcagatg

SEQ ID NO: 353971 - DNA, 25 bp, Homo sapien
gatggtaggccgcagtgaactccaa

SEQ ID NO: 353972 - DNA, 25 bp, Homo sapien
ggtaggccgcagtgaactccaattg

SEQ ID NO: 353973 - DNA, 25 bp, Homo sapien
aggccgcagtgaactccaattgttt

SEQ ID NO: 353974 - DNA, 25 bp, Homo sapien
gccgcagtgaactccaattgtttgg

SEQ ID NO: 353975 - DNA, 25 bp, Homo sapien
ccaattgtttggaaggcttaacttg

SEQ ID NO: 353976 - DNA, 25 bp, Homo sapien
ggcttaacttgaaccttcctaggct

SEQ ID NO: 353977 - DNA, 25 bp, Homo sapien
taacttgaaccttcctaggctagag

SEQ ID NO: 353978 - DNA, 25 bp, Homo sapien
ttgaaccttcctaggctagagaatt

SEQ ID NO: 353979 - DNA, 25 bp, Homo sapien
taggaactcagtatagtgccaaccc

SEQ ID NO: 353980 - DNA, 25 bp, Homo sapien
ggaactcagtatagtgccaacccac

SEQ ID NO: 353981 - DNA, 25 bp, Homo sapien
tcagtatagtgccaacccacctgtt

SEQ ID NO: 353982 - DNA, 25 bp, Homo sapien
gtatagtgccaacccacctgttaca

SEQ ID NO: 353983 - DNA, 25 bp, Homo sapien
tagtgccaacccacctgttacaatt

SEQ ID NO: 353984 - DNA, 25 bp, Homo sapien
gccaacccacctgttacaattgatg

SEQ ID NO: 353985 - DNA, 25 bp, Homo sapien
aacccacctgttacaattgatgtac

SEQ ID NO: 353986 - DNA, 25 bp, Homo sapien
atggggcatagccagttgaccacca

SEQ ID NO: 353987 - DNA, 25 bp, Homo sapien
acctgcccagtcacctgaagatcgt

SEQ ID NO: 353988 - DNA, 25 bp, Homo sapien
ttcacctactagttcacttcacgag

SEQ ID NO: 353989 - DNA, 25 bp, Homo sapien
tcacctactagttcacttcacgagg

SEQ ID NO: 353990 - DNA, 25 bp, Homo sapien
tcaatcaagatacggctcattccac

SEQ ID NO: 353991 - DNA, 25 bp, Homo sapien
gctcattccacccttgggcaggagg

SEQ ID NO: 353992 - DNA, 25 bp, Homo sapien
cacccttgggcaggagggcaatgct

SEQ ID NO: 353993 - DNA, 25 bp, Homo sapien
tgctgatgaggctgtttatagcttc

SEQ ID NO: 353994 - DNA, 25 bp, Homo sapien
ctgtttatagcttcggtgcctgcgc

SEQ ID NO: 353995 - DNA, 25 bp, Homo sapien
tgttatttagttgttgttcctccgc

SEQ ID NO: 353996 - DNA, 25 bp, Homo sapien
atttagttgttgttcctccgctgtt

SEQ ID NO: 353997 - DNA, 25 bp, Homo sapien
tgttcctccgctgtttccaaacaag

SEQ ID NO: 353998 - DNA, 25 bp, Homo sapien
tttccaaacaagcagtctgtccaaa

SEQ ID NO: 353999 - DNA, 25 bp, Homo sapien
aaatactccaaatggcggaaacagg

SEQ ID NO: 354000 - DNA, 25 bp, Homo sapien
atatacaccattcattttcagaaag

SEQ ID NO: 354001 - DNA, 25 bp, Homo sapien
gtaagtaagaaatccaagacctgag

SEQ ID NO: 354002 - DNA, 25 bp, Homo sapien
gacctgagatttaaatagggccaac

SEQ ID NO: 354003 - DNA, 25 bp, Homo sapien
aaccagatttttgcaaggaccttga

SEQ ID NO: 354004 - DNA, 25 bp, Homo sapien
aaggaccttgatagtggcattggca

SEQ ID NO: 354005 - DNA, 25 bp, Homo sapien
gtggcattggcaagactgagtcagt

SEQ ID NO: 354006 - DNA, 25 bp, Homo sapien
gaccctgccaacagaggaggttgag

SEQ ID NO: 354007 - DNA, 25 bp, Homo sapien
ggaacgcactgctgtcacggtaaag

SEQ ID NO: 354008 - DNA, 25 bp, Homo sapien
tgctgtcacggtaaagccccgttac

SEQ ID NO: 354009 - DNA, 25 bp, Homo sapien
taaagccccgttacctgctctctgt

SEQ ID NO: 354010 - DNA, 25 bp, Homo sapien
ggcacaacccactctattacctaag

SEQ ID NO: 354011 - DNA, 25 bp, Homo sapien
tacctaagcccctgcttatgtaagt

SEQ ID NO: 354012 - DNA, 25 bp, Homo sapien
ttgtttaaggccaaagcacacacca

SEQ ID NO: 354013 - DNA, 25 bp, Homo sapien
catggcgtccggagctgtctcctct

SEQ ID NO: 354014 - DNA, 25 bp, Homo sapien
aagcacaaaggccagctccagagat

SEQ ID NO: 354015 - DNA, 25 bp, Homo sapien
cacaaaggccagctccagagatgct

SEQ ID NO: 354016 - DNA, 25 bp, Homo sapien
ctccagagatgctgtgcagagagct

SEQ ID NO: 354017 - DNA, 25 bp, Homo sapien
tgtctgacctctccagcgtcagggc

SEQ ID NO: 354018 - DNA, 25 bp, Homo sapien
agggccccctgaaaagtgcagcata

SEQ ID NO: 354019 - DNA, 25 bp, Homo sapien
gcagcataacccttagtaggacaga

SEQ ID NO: 354020 - DNA, 25 bp, Homo sapien
acccttagtaggacagaaagaccat

SEQ ID NO: 354021 - DNA, 25 bp, Homo sapien
gaaagaccattgtcttctgccaacc

SEQ ID NO: 354022 - DNA, 25 bp, Homo sapien
gtcttctgccaaccattacaaagtg

SEQ ID NO: 354023 - DNA, 25 bp, Homo sapien
agctctctgatctgtaccacaagga

SEQ ID NO: 354024 - DNA, 25 bp, Homo sapien
gagctgccactaacacctgtgtcag

SEQ ID NO: 354025 - DNA, 25 bp, Homo sapien
tcagaactactgtaaggaccctttc

SEQ ID NO: 354026 - DNA, 25 bp, Homo sapien
accctttcctcctgcgagaggagaa

SEQ ID NO: 354027 - DNA, 25 bp, Homo sapien
gtgctaaacctgtctgaacgtgata

SEQ ID NO: 354028 - DNA, 25 bp, Homo sapien
tagacatgctacaaactgccaaccc

SEQ ID NO: 354029 - DNA, 25 bp, Homo sapien
ctgccaaccctttaggctataaact

SEQ ID NO: 354030 - DNA, 25 bp, Homo sapien
taaactgctcacacatgggccaagt

SEQ ID NO: 354031 - DNA, 25 bp, Homo sapien
atgggccaagtgtcactctcataag

SEQ ID NO: 354032 - DNA, 25 bp, Homo sapien
tttttaagctgccagcagccttgaa

SEQ ID NO: 354033 - DNA, 25 bp, Homo sapien
agccttgaagccacctgggactgca

SEQ ID NO: 354034 - DNA, 25 bp, Homo sapien
aatttttcctagatacccatccact

SEQ ID NO: 354035 - DNA, 25 bp, Homo sapien
atacccatccacttaagggccagag

SEQ ID NO: 354036 - DNA, 25 bp, Homo sapien
gggccagagaaatccttattcattt

SEQ ID NO: 354037 - DNA, 25 bp, Homo sapien
cttattcatttaactctggtgggca

SEQ ID NO: 354038 - DNA, 25 bp, Homo sapien
actctggtgggcatttatgtaacat

SEQ ID NO: 354039 - DNA, 25 bp, Homo sapien
taaacagccacaatcgcattcagtc

SEQ ID NO: 354040 - DNA, 25 bp, Homo sapien
aatcgcattcagtcaacttggcact

SEQ ID NO: 354041 - DNA, 25 bp, Homo sapien
aacttggcactgaatgtagcttcta

SEQ ID NO: 354042 - DNA, 25 bp, Homo sapien
atgtagcttctaaaatcagttctct

SEQ ID NO: 354043 - DNA, 25 bp, Homo sapien
cagttctctaccctacgaatggaat

SEQ ID NO: 354044 - DNA, 25 bp, Homo sapien
taccctacgaatggaatgttctacc

SEQ ID NO: 354045 - DNA, 25 bp, Homo sapien
aggattagcctagcatttgtcctct

SEQ ID NO: 354046 - DNA, 25 bp, Homo sapien
attagcctagcatttgtcctcttta

SEQ ID NO: 354047 - DNA, 25 bp, Homo sapien
gcctagcatttgtcctctttatata

SEQ ID NO: 354048 - DNA, 25 bp, Homo sapien
tagcatttgtcctctttatataaag

SEQ ID NO: 354049 - DNA, 25 bp, Homo sapien
ataaaggacttcttatagcctgatt

SEQ ID NO: 354050 - DNA, 25 bp, Homo sapien
ggacttcttatagcctgattcctaa

SEQ ID NO: 354051 - DNA, 25 bp, Homo sapien
agcctgattcctaatgcagagttca

SEQ ID NO: 354052 - DNA, 25 bp, Homo sapien
ttatttggtaacagcttttgagaaa

SEQ ID NO: 354053 - DNA, 25 bp, Homo sapien
atacttggcagtttattcttccagt

SEQ ID NO: 354054 - DNA, 25 bp, Homo sapien
acttggcagtttattcttccagtta

SEQ ID NO: 354055 - DNA, 25 bp, Homo sapien
gtttactaatagttactgatttgtt

SEQ ID NO: 354056 - DNA, 25 bp, Homo sapien
caagttcttactatgctttacccac

SEQ ID NO: 354057 - DNA, 25 bp, Homo sapien
tatgctttacccacctgatatcaag

SEQ ID NO: 354058 - DNA, 25 bp, Homo sapien
agaggagcatattcccttttcactg

SEQ ID NO: 354059 - DNA, 25 bp, Homo sapien
tattcccttttcactgctgacaaca

SEQ ID NO: 354060 - DNA, 25 bp, Homo sapien
cactgctgacaacacttaatgaaat

SEQ ID NO: 354061 - DNA, 25 bp, Homo sapien
aaattcagagtgtctgaggtcacca

SEQ ID NO: 354062 - DNA, 25 bp, Homo sapien
agctcatgaatcactcaacacacac

SEQ ID NO: 354063 - DNA, 25 bp, Homo sapien
aacacacacatttgttggccaggca

SEQ ID NO: 354064 - DNA, 25 bp, Homo sapien
aagcagatctgtgctcagccctgtg

SEQ ID NO: 354065 - DNA, 25 bp, Homo sapien
gaagatctagagctggtaccaggcc

SEQ ID NO: 354066 - DNA, 25 bp, Homo sapien
gccagagagggaatgctctttatca

SEQ ID NO: 354067 - DNA, 25 bp, Homo sapien
aatagccttcatcccacagtttggg

SEQ ID NO: 354068 - DNA, 25 bp, Homo sapien
tagccttcatcccacagtttgggct

SEQ ID NO: 354069 - DNA, 25 bp, Homo sapien
ttgggcttcagctattaacacataa

SEQ ID NO: 354070 - DNA, 25 bp, Homo sapien
gggcttcagctattaacacataaag

SEQ ID NO: 354071 - DNA, 25 bp, Homo sapien
gcttcagctattaacacataaagat

SEQ ID NO: 354072 - DNA, 25 bp, Homo sapien
aaagataaccagttgcagctaggct

SEQ ID NO: 354073 - DNA, 25 bp, Homo sapien
agataaccagttgcagctaggctcg

SEQ ID NO: 354074 - DNA, 25 bp, Homo sapien
gataaccagttgcagctaggctcgg

SEQ ID NO: 354075 - DNA, 25 bp, Homo sapien
taaccagttgcagctaggctcggtg

SEQ ID NO: 354076 - DNA, 25 bp, Homo sapien
accagttgcagctaggctcggtggc

SEQ ID NO: 354077 - DNA, 25 bp, Homo sapien
cagttgcagctaggctcggtggctc

SEQ ID NO: 354078 - DNA, 25 bp, Homo sapien
gttggagatgagaaacccacgtttt

SEQ ID NO: 354079 - DNA, 25 bp, Homo sapien
gggaaaacctggcaagtgacaactt

SEQ ID NO: 354080 - DNA, 25 bp, Homo sapien
gaaagtagctccacactcatgggat

SEQ ID NO: 354081 - DNA, 25 bp, Homo sapien
aaatctacaagcgtgcatgcccggc

SEQ ID NO: 354082 - DNA, 25 bp, Homo sapien
ggcaaatgcctctccaatgcactgg

SEQ ID NO: 354083 - DNA, 25 bp, Homo sapien
tccaatgcactggagcgttttaagt

SEQ ID NO: 354084 - DNA, 25 bp, Homo sapien
agtggaaaccactagaatctctgtg

SEQ ID NO: 354085 - DNA, 25 bp, Homo sapien
gaatctctgtgtagtctccggaagt

SEQ ID NO: 354086 - DNA, 25 bp, Homo sapien
tgagggctgcattatctctgcacag

SEQ ID NO: 354087 - DNA, 25 bp, Homo sapien
tctgcacagcttcctcttggtgggc

SEQ ID NO: 354088 - DNA, 25 bp, Homo sapien
gggcccagctgtgatctttatggat

SEQ ID NO: 354089 - DNA, 25 bp, Homo sapien
ggctggtgagaagaacgtgatatct

SEQ ID NO: 354090 - DNA, 25 bp, Homo sapien
gctggtgagaagaacgtgatatctc

SEQ ID NO: 354091 - DNA, 25 bp, Homo sapien
tggtgagaagaacgtgatatctcca

SEQ ID NO: 354092 - DNA, 25 bp, Homo sapien
ggtgagaagaacgtgatatctccag

SEQ ID NO: 354093 - DNA, 25 bp, Homo sapien
gtgagaagaacgtgatatctccaga

SEQ ID NO: 354094 - DNA, 25 bp, Homo sapien
gagaagaacgtgatatctccagagc

SEQ ID NO: 354095 - DNA, 25 bp, Homo sapien
agaagaacgtgatatctccagagct

SEQ ID NO: 354096 - DNA, 25 bp, Homo sapien
gaagaacgtgatatctccagagcta

SEQ ID NO: 354097 - DNA, 25 bp, Homo sapien
aagaacgtgatatctccagagctaa

SEQ ID NO: 354098 - DNA, 25 bp, Homo sapien
agaacgtgatatctccagagctaac

SEQ ID NO: 354099 - DNA, 25 bp, Homo sapien
gaacgtgatatctccagagctaaca

SEQ ID NO: 354100 - DNA, 25 bp, Homo sapien
gggtagatgtattttccctattcat

SEQ ID NO: 354101 - DNA, 25 bp, Homo sapien
atgtattttccctattcatctctgg

SEQ ID NO: 354102 - DNA, 25 bp, Homo sapien
gtattttccctattcatctctggaa

SEQ ID NO: 354103 - DNA, 25 bp, Homo sapien
agatgatgtattctctagggaactt

SEQ ID NO: 354104 - DNA, 25 bp, Homo sapien
acttggaaccaaggaatcaacatgg

SEQ ID NO: 354105 - DNA, 25 bp, Homo sapien
atcaacatggaggtaagttccctgt

SEQ ID NO: 354106 - DNA, 25 bp, Homo sapien
tggaggtaagttccctgtgttttct

SEQ ID NO: 354107 - DNA, 25 bp, Homo sapien
ctttttgctgcatacatcctagacc

SEQ ID NO: 354108 - DNA, 25 bp, Homo sapien
ttgctgcatacatcctagaccagat

SEQ ID NO: 354109 - DNA, 25 bp, Homo sapien
tacatcctagaccagatgctagaga

SEQ ID NO: 354110 - DNA, 25 bp, Homo sapien
agagaaactggcaaactggaaacac

SEQ ID NO: 354111 - DNA, 25 bp, Homo sapien
gttaaggatgttacacttcaaaaga

SEQ ID NO: 354112 - DNA, 25 bp, Homo sapien
ctgtggatttacagggtactgtatg

SEQ ID NO: 354113 - DNA, 25 bp, Homo sapien
gatacatgtgattaaaccaggctaa

SEQ ID NO: 354114 - DNA, 25 bp, Homo sapien
atgtgattaaaccaggctaattaac

SEQ ID NO: 354115 - DNA, 25 bp, Homo sapien
atatccatcacttcactttttggtg

SEQ ID NO: 354116 - DNA, 25 bp, Homo sapien
ccatcacttcactttttggtggtat

SEQ ID NO: 354117 - DNA, 25 bp, Homo sapien
tcacttcactttttggtggtatgaa

SEQ ID NO: 354118 - DNA, 25 bp, Homo sapien
ggaagaagagagtccttaagttaat

SEQ ID NO: 354119 - DNA, 25 bp, Homo sapien
cactttttggtggtatgaatattta

SEQ ID NO: 354120 - DNA, 25 bp, Homo sapien
gagagtccttaagttaatagggtga

SEQ ID NO: 354121 - DNA, 25 bp, Homo sapien
aatagggtgaatcaactgagttaat

SEQ ID NO: 354122 - DNA, 25 bp, Homo sapien
aataatgtaggtctgctctgcccat

SEQ ID NO: 354123 - DNA, 25 bp, Homo sapien
aaatctctgcaaacccatgatgtcc

SEQ ID NO: 354124 - DNA, 25 bp, Homo sapien
tttaataggttgcttcttcaagtgg

SEQ ID NO: 354125 - DNA, 25 bp, Homo sapien
gcaaacccatgatgtccaacagaca

SEQ ID NO: 354126 - DNA, 25 bp, Homo sapien
cagacatagctcatattggtcacag

SEQ ID NO: 354127 - DNA, 25 bp, Homo sapien
ctacctaaccaagttgggcctatct

SEQ ID NO: 354128 - DNA, 25 bp, Homo sapien
agttgggcctatctaactggctaag

SEQ ID NO: 354129 - DNA, 25 bp, Homo sapien
gaaaaccaataacttctgggacttg

SEQ ID NO: 354130 - DNA, 25 bp, Homo sapien
aacttctgggacttggtcaaaatga

SEQ ID NO: 354131 - DNA, 25 bp, Homo sapien
aaaatgatgcattgtcttgcaagag

SEQ ID NO: 354132 - DNA, 25 bp, Homo sapien
gaatcctagttccatctttctgtaa

SEQ ID NO: 354133 - DNA, 25 bp, Homo sapien
atctgaatatccagattttctaaat

SEQ ID NO: 354134 - DNA, 25 bp, Homo sapien
ggaatattatacaggcagttataag

SEQ ID NO: 354135 - DNA, 25 bp, Homo sapien
atctgtatagaacaacatagctctt

SEQ ID NO: 354136 - DNA, 25 bp, Homo sapien
atagaacaacatagctctttttaaa

SEQ ID NO: 354137 - DNA, 25 bp, Homo sapien
agatataagacatgcactatttttt

SEQ ID NO: 354138 - DNA, 25 bp, Homo sapien
cataaaattttattgtatcaggctt

SEQ ID NO: 354139 - DNA, 25 bp, Homo sapien
tcaggcttgactgatgggactatca

SEQ ID NO: 354140 - DNA, 25 bp, Homo sapien
ggcttgactgatgggactatcaaat

SEQ ID NO: 354141 - DNA, 25 bp, Homo sapien
gactgatgggactatcaaataatat

SEQ ID NO: 354142 - DNA, 25 bp, Homo sapien
aatatattaggcagcattctttgta

SEQ ID NO: 354143 - DNA, 25 bp, Homo sapien
tatattaggcagcattctttgtaat

SEQ ID NO: 354144 - DNA, 25 bp, Homo sapien
agaagacattgtttcctgcttccta

SEQ ID NO: 354145 - DNA, 25 bp, Homo sapien
aagacattgtttcctgcttcctatt

SEQ ID NO: 354146 - DNA, 25 bp, Homo sapien
acattgtttcctgcttcctattcac

SEQ ID NO: 354147 - DNA, 25 bp, Homo sapien
gttttcaaaaacaggatacacagtg

SEQ ID NO: 354148 - DNA, 25 bp, Homo sapien
tacacagtgagaaatgctgggcgct

SEQ ID NO: 354149 - DNA, 25 bp, Homo sapien
agtgagaaatgctgggcgctcccca

SEQ ID NO: 354150 - DNA, 25 bp, Homo sapien
atctacgatgagttatgacgggtta

SEQ ID NO: 354151 - DNA, 25 bp, Homo sapien
gacgggttaattataactgcaggga

SEQ ID NO: 354152 - DNA, 25 bp, Homo sapien
tgcttcctattcacccggagaagag

SEQ ID NO: 354153 - DNA, 25 bp, Homo sapien
tattcacccggagaagaggagcaag

SEQ ID NO: 354154 - DNA, 25 bp, Homo sapien
ccctgtcactacctgttagtaatgt

SEQ ID NO: 354155 - DNA, 25 bp, Homo sapien
ggagaaccacaaacttggaggactc

SEQ ID NO: 354156 - DNA, 25 bp, Homo sapien
aacttggaggactcaactcttctcc

SEQ ID NO: 354157 - DNA, 25 bp, Homo sapien
tggaggactcaactcttctccccta

SEQ ID NO: 354158 - DNA, 25 bp, Homo sapien
tggaatttgccagattgaccaaaaa

SEQ ID NO: 354159 - DNA, 25 bp, Homo sapien
aggtgcctttaaactaggaattgtg

SEQ ID NO: 354160 - DNA, 25 bp, Homo sapien
tgcctttaaactaggaattgtgtaa

SEQ ID NO: 354161 - DNA, 25 bp, Homo sapien
ggaattgtgtaaaatatcctcacat

SEQ ID NO: 354162 - DNA, 25 bp, Homo sapien
gtaaaatatcctcacatcacaaaat

SEQ ID NO: 354163 - DNA, 25 bp, Homo sapien
aaatatcctcacatcacaaaataaa

SEQ ID NO: 354164 - DNA, 25 bp, Homo sapien
gaattttcatacaaatcaatggagg

SEQ ID NO: 354165 - DNA, 25 bp, Homo sapien
caatggagggaaataccaccttcac

SEQ ID NO: 354166 - DNA, 25 bp, Homo sapien
aataagtaatacatttctgcccaag

SEQ ID NO: 354167 - DNA, 25 bp, Homo sapien
ataagtaatacatttctgcccaagt

SEQ ID NO: 354168 - DNA, 25 bp, Homo sapien
aagtaatacatttctgcccaagtaa

SEQ ID NO: 354169 - DNA, 25 bp, Homo sapien
gtaatacatttctgcccaagtaaga

SEQ ID NO: 354170 - DNA, 25 bp, Homo sapien
taatacatttctgcccaagtaagag

SEQ ID NO: 354171 - DNA, 25 bp, Homo sapien
tacatttctgcccaagtaagagcct

SEQ ID NO: 354172 - DNA, 25 bp, Homo sapien
acatttctgcccaagtaagagcctt

SEQ ID NO: 354173 - DNA, 25 bp, Homo sapien
atttctgcccaagtaagagccttcc

SEQ ID NO: 354174 - DNA, 25 bp, Homo sapien
tttctgcccaagtaagagccttccc

SEQ ID NO: 354175 - DNA, 25 bp, Homo sapien
tctgcccaagtaagagccttccctt

SEQ ID NO: 354176 - DNA, 25 bp, Homo sapien
gcccaagtaagagccttcccttttg

SEQ ID NO: 354177 - DNA, 25 bp, Homo sapien
caatgacagacatgacatctggctt

SEQ ID NO: 354178 - DNA, 25 bp, Homo sapien
ctgagttcccagctgggtttgagcc

SEQ ID NO: 354179 - DNA, 25 bp, Homo sapien
tgagttcccagctgggtttgagcct

SEQ ID NO: 354180 - DNA, 25 bp, Homo sapien
gagttcccagctgggtttgagccta

SEQ ID NO: 354181 - DNA, 25 bp, Homo sapien
gttcccagctgggtttgagcctagg

SEQ ID NO: 354182 - DNA, 25 bp, Homo sapien
ttcccagctgggtttgagcctaggg

SEQ ID NO: 354183 - DNA, 25 bp, Homo sapien
atttccggaggcaacttcccagcca

SEQ ID NO: 354184 - DNA, 25 bp, Homo sapien
tttccggaggcaacttcccagccag

SEQ ID NO: 354185 - DNA, 25 bp, Homo sapien
ttccggaggcaacttcccagccaga

SEQ ID NO: 354186 - DNA, 25 bp, Homo sapien
tccggaggcaacttcccagccagaa

SEQ ID NO: 354187 - DNA, 25 bp, Homo sapien
ccggaggcaacttcccagccagaag

SEQ ID NO: 354188 - DNA, 25 bp, Homo sapien
tttagcccttccaaattctttctct

SEQ ID NO: 354189 - DNA, 25 bp, Homo sapien
ttagcccttccaaattctttctcta

SEQ ID NO: 354190 - DNA, 25 bp, Homo sapien
tagcccttccaaattctttctctag

SEQ ID NO: 354191 - DNA, 25 bp, Homo sapien
agcccttccaaattctttctctaga

SEQ ID NO: 354192 - DNA, 25 bp, Homo sapien
gcccttccaaattctttctctagaa

SEQ ID NO: 354193 - DNA, 25 bp, Homo sapien
cccttccaaattctttctctagaat

SEQ ID NO: 354194 - DNA, 25 bp, Homo sapien
ttctctagaatttagagaggatggc

SEQ ID NO: 354195 - DNA, 25 bp, Homo sapien
ctctagaatttagagaggatggctc

SEQ ID NO: 354196 - DNA, 25 bp, Homo sapien
tctagaatttagagaggatggctca

SEQ ID NO: 354197 - DNA, 25 bp, Homo sapien
ctagaatttagagaggatggctcac

SEQ ID NO: 354198 - DNA, 25 bp, Homo sapien
gaaaccttgtttctcaagtcttgat

SEQ ID NO: 354199 - DNA, 25 bp, Homo sapien
caagtcttgatttagctacaggcag

SEQ ID NO: 354200 - DNA, 25 bp, Homo sapien
caacattcttgcctcaaccagtaat

SEQ ID NO: 354201 - DNA, 25 bp, Homo sapien
ttgcctcaaccagtaatgcactttg

SEQ ID NO: 354202 - DNA, 25 bp, Homo sapien
gcactttggaaatactttctctgag

SEQ ID NO: 354203 - DNA, 25 bp, Homo sapien
tgagaaacttactccatcagtttga

SEQ ID NO: 354204 - DNA, 25 bp, Homo sapien
ttgaggctgtcacattgagaaacat

SEQ ID NO: 354205 - DNA, 25 bp, Homo sapien
gagaaacatgcaatttcggtttttt

SEQ ID NO: 354206 - DNA, 25 bp, Homo sapien
tttcctgttatttttcccgtgccat

SEQ ID NO: 354207 - DNA, 25 bp, Homo sapien
aaaactgagcagctacctctgtaaa

SEQ ID NO: 354208 - DNA, 25 bp, Homo sapien
gctacctctgtaaatgcagcggttc

SEQ ID NO: 354209 - DNA, 25 bp, Homo sapien
gagtaggaactcctcaaagtacaaa

SEQ ID NO: 354210 - DNA, 25 bp, Homo sapien
aagcagaagagccactgaaagcaga

SEQ ID NO: 354211 - DNA, 25 bp, Homo sapien
tgtttcaaagagtcagccggtaact

SEQ ID NO: 354212 - DNA, 25 bp, Homo sapien
gagtcagccggtaactcctgaaaaa

SEQ ID NO: 354213 - DNA, 25 bp, Homo sapien
acaggcatggctttgggaagaagac

SEQ ID NO: 354214 - DNA, 25 bp, Homo sapien
gaatttgagatctggcgtgaggaaa

SEQ ID NO: 354215 - DNA, 25 bp, Homo sapien
gagggaaactggtctaaaatactgt

SEQ ID NO: 354216 - DNA, 25 bp, Homo sapien
tgcattataaattcaacaaccggac

SEQ ID NO: 354217 - DNA, 25 bp, Homo sapien
acaaccggacaagtgtcatgttaaa

SEQ ID NO: 354218 - DNA, 25 bp, Homo sapien
tgttaaaagacagatggaggaccat

SEQ ID NO: 354219 - DNA, 25 bp, Homo sapien
aagaaactaaaactgatttcctcag

SEQ ID NO: 354220 - DNA, 25 bp, Homo sapien
ctgttggcctttgacgtctgattta

SEQ ID NO: 354221 - DNA, 25 bp, Homo sapien
ttggcctttgacgtctgatttatga

SEQ ID NO: 354222 - DNA, 25 bp, Homo sapien
gacgtctgatttatgaccagcgttt

SEQ ID NO: 354223 - DNA, 25 bp, Homo sapien
gatttatgaccagcgtttgtgtgaa

SEQ ID NO: 354224 - DNA, 25 bp, Homo sapien
ttatgaccagcgtttgtgtgaatgt

SEQ ID NO: 354225 - DNA, 25 bp, Homo sapien
ccagcgtttgtgtgaatgtctgtgt

SEQ ID NO: 354226 - DNA, 25 bp, Homo sapien
gacagtcatttggaaacagtcactt

SEQ ID NO: 354227 - DNA, 25 bp, Homo sapien
agtcatttggaaacagtcacttttg

SEQ ID NO: 354228 - DNA, 25 bp, Homo sapien
ttgtgttttgccttggcacatgcac

SEQ ID NO: 354229 - DNA, 25 bp, Homo sapien
ttttgccttggcacatgcacatggg

SEQ ID NO: 354230 - DNA, 25 bp, Homo sapien
tgcacatgggcaattagtcatgaga

SEQ ID NO: 354231 - DNA, 25 bp, Homo sapien
gtttctaacatgcaaattatttcat

SEQ ID NO: 354232 - DNA, 25 bp, Homo sapien
tttctaacatgcaaattatttcata

SEQ ID NO: 354233 - DNA, 25 bp, Homo sapien
tctaacatgcaaattatttcataag

SEQ ID NO: 354234 - DNA, 25 bp, Homo sapien
ctaacatgcaaattatttcataaga

SEQ ID NO: 354235 - DNA, 25 bp, Homo sapien
taacatgcaaattatttcataagat

SEQ ID NO: 354236 - DNA, 25 bp, Homo sapien
aacatgcaaattatttcataagatg

SEQ ID NO: 354237 - DNA, 25 bp, Homo sapien
aaataagcaggccaggcactgtagc

SEQ ID NO: 354238 - DNA, 25 bp, Homo sapien
aataagcaggccaggcactgtagcc

SEQ ID NO: 354239 - DNA, 25 bp, Homo sapien
ataagcaggccaggcactgtagccc

SEQ ID NO: 354240 - DNA, 25 bp, Homo sapien
aagcaggccaggcactgtagcccat

SEQ ID NO: 354241 - DNA, 25 bp, Homo sapien
caggccaggcactgtagcccatgcc

SEQ ID NO: 354242 - DNA, 25 bp, Homo sapien
gcggacggggagcagagacacaata

SEQ ID NO: 354243 - DNA, 25 bp, Homo sapien
cggacggggagcagagacacaataa

SEQ ID NO: 354244 - DNA, 25 bp, Homo sapien
ctagcctatccggactgtgcgggag

SEQ ID NO: 354245 - DNA, 25 bp, Homo sapien
tagcctatccggactgtgcgggagg

SEQ ID NO: 354246 - DNA, 25 bp, Homo sapien
agcctatccggactgtgcgggaggc

SEQ ID NO: 354247 - DNA, 25 bp, Homo sapien
gcctatccggactgtgcgggaggcg

SEQ ID NO: 354248 - DNA, 25 bp, Homo sapien
cctatccggactgtgcgggaggcgg

SEQ ID NO: 354249 - DNA, 25 bp, Homo sapien
ctatccggactgtgcgggaggcgga

SEQ ID NO: 354250 - DNA, 25 bp, Homo sapien
tatccggactgtgcgggaggcggac

SEQ ID NO: 354251 - DNA, 25 bp, Homo sapien
atccggactgtgcgggaggcggacg

SEQ ID NO: 354252 - DNA, 25 bp, Homo sapien
tccggactgtgcgggaggcggacgg

SEQ ID NO: 354253 - DNA, 25 bp, Homo sapien
ggctgctctctagtggaaatgctgt

SEQ ID NO: 354254 - DNA, 25 bp, Homo sapien
ttggcttagacctactgtttaaaag

SEQ ID NO: 354255 - DNA, 25 bp, Homo sapien
ttgatgcttacaatggccgtacctt

SEQ ID NO: 354256 - DNA, 25 bp, Homo sapien
aatggccgtaccttcatactgggat

SEQ ID NO: 354257 - DNA, 25 bp, Homo sapien
gtaccttcatactgggattctttgg

SEQ ID NO: 354258 - DNA, 25 bp, Homo sapien
gttgcttcatatcacattgttcata

SEQ ID NO: 354259 - DNA, 25 bp, Homo sapien
gttcatagtaatctcactctctggg

SEQ ID NO: 354260 - DNA, 25 bp, Homo sapien
atctcactctctgggagagtcattt

SEQ ID NO: 354261 - DNA, 25 bp, Homo sapien
ctgtttaaaagttcgtagtagcata

SEQ ID NO: 354262 - DNA, 25 bp, Homo sapien
gtagtagcatagacacaacagtgat

SEQ ID NO: 354263 - DNA, 25 bp, Homo sapien
gagaatcttactaggagctgtgttg

SEQ ID NO: 354264 - DNA, 25 bp, Homo sapien
aatttactatagaattatctctcta

SEQ ID NO: 354265 - DNA, 25 bp, Homo sapien
gaattatctctctaattatcataat

SEQ ID NO: 354266 - DNA, 25 bp, Homo sapien
cataattgggttacaatttaagctc

SEQ ID NO: 354267 - DNA, 25 bp, Homo sapien
gtagaaatgcaacaattcccagttt

SEQ ID NO: 354268 - DNA, 25 bp, Homo sapien
ttggataggttctaaatttctgaga

SEQ ID NO: 354269 - DNA, 25 bp, Homo sapien
atttctgagatttgattcatggcag

SEQ ID NO: 354270 - DNA, 25 bp, Homo sapien
gttgttttagatgggctcattacat

SEQ ID NO: 354271 - DNA, 25 bp, Homo sapien
acataacgagttaattgtcactagt

SEQ ID NO: 354272 - DNA, 25 bp, Homo sapien
ttgtcactagtaggagactgtgaag

SEQ ID NO: 354273 - DNA, 25 bp, Homo sapien
gactgtgaaggaattttgttatact

SEQ ID NO: 354274 - DNA, 25 bp, Homo sapien
atactttcaaaaatgttactgtgat

SEQ ID NO: 354275 - DNA, 25 bp, Homo sapien
cctgttcagaggtttatgcatgagc

SEQ ID NO: 354276 - DNA, 25 bp, Homo sapien
gagcatatttcttttaggccgtggt

SEQ ID NO: 354277 - DNA, 25 bp, Homo sapien
tgaagttgataaaccacccctgctt

SEQ ID NO: 354278 - DNA, 25 bp, Homo sapien
gataaaccacccctgctttgtaaca

SEQ ID NO: 354279 - DNA, 25 bp, Homo sapien
ggaattatctagtccccagattgat

SEQ ID NO: 354280 - DNA, 25 bp, Homo sapien
agattgatcatctcccctggcaacg

SEQ ID NO: 354281 - DNA, 25 bp, Homo sapien
ggcaacgtgactctgttttttgtgt

SEQ ID NO: 354282 - DNA, 25 bp, Homo sapien
tgtgtgtttccatgctgactagtcc

SEQ ID NO: 354283 - DNA, 25 bp, Homo sapien
ctgactagtcccctactgttaatat

SEQ ID NO: 354284 - DNA, 25 bp, Homo sapien
ttaggctataaccaggtctttcctg

SEQ ID NO: 354285 - DNA, 25 bp, Homo sapien
atgacctttgttttaatctcattca

SEQ ID NO: 354286 - DNA, 25 bp, Homo sapien
gacacacacatgctaaaatatcaag

SEQ ID NO: 354287 - DNA, 25 bp, Homo sapien
atgctaaaatatcaaggttccagat

SEQ ID NO: 354288 - DNA, 25 bp, Homo sapien
aaggttccagatatgtcttgagagg

SEQ ID NO: 354289 - DNA, 25 bp, Homo sapien
aaaggtcaggaatacttattgaatc

SEQ ID NO: 354290 - DNA, 25 bp, Homo sapien
cagctgcaaaggagaagtgtatagt

SEQ ID NO: 354291 - DNA, 25 bp, Homo sapien
gatgcatgtgcagtttgttctattt

SEQ ID NO: 354292 - DNA, 25 bp, Homo sapien
tgcagtttgttctattttaaggcaa

SEQ ID NO: 354293 - DNA, 25 bp, Homo sapien
ttttttcttagaaaggtgttgcaga

SEQ ID NO: 354294 - DNA, 25 bp, Homo sapien
gtgttgcagagatgtctggtaccta

SEQ ID NO: 354295 - DNA, 25 bp, Homo sapien
cagagatgtctggtacctagtttaa

SEQ ID NO: 354296 - DNA, 25 bp, Homo sapien
gtctggtacctagtttaaaaatgat

SEQ ID NO: 354297 - DNA, 25 bp, Homo sapien
tggcaatccaactatgtttttattg

SEQ ID NO: 354298 - DNA, 25 bp, Homo sapien
gcaatccaactatgtttttattgaa

SEQ ID NO: 354299 - DNA, 25 bp, Homo sapien
tccacatgatgtctattacaggttc

SEQ ID NO: 354300 - DNA, 25 bp, Homo sapien
acatgatgtctattacaggttcagt

SEQ ID NO: 354301 - DNA, 25 bp, Homo sapien
gatgtctattacaggttcagtatcc

SEQ ID NO: 354302 - DNA, 25 bp, Homo sapien
tgtctattacaggttcagtatccct

SEQ ID NO: 354303 - DNA, 25 bp, Homo sapien
ttacaggttcagtatccctgatcag

SEQ ID NO: 354304 - DNA, 25 bp, Homo sapien
caggttcagtatccctgatcagaat

SEQ ID NO: 354305 - DNA, 25 bp, Homo sapien
ggttcagtatccctgatcagaatgt

SEQ ID NO: 354306 - DNA, 25 bp, Homo sapien
ccctgatcagaatgttggaaatcca

SEQ ID NO: 354307 - DNA, 25 bp, Homo sapien
aaaatgcccccatatgtgaaacttg

SEQ ID NO: 354308 - DNA, 25 bp, Homo sapien
actgagtggtgggttcaagcatgcc

SEQ ID NO: 354309 - DNA, 25 bp, Homo sapien
gccaggagaatgtggttgccctcac

SEQ ID NO: 354310 - DNA, 25 bp, Homo sapien
gttgccctcacggtgtattaaccag

SEQ ID NO: 354311 - DNA, 25 bp, Homo sapien
tctgctaaaggacccaacactcatt

SEQ ID NO: 354312 - DNA, 25 bp, Homo sapien
taaccagacctcatttgctagacat

SEQ ID NO: 354313 - DNA, 25 bp, Homo sapien
taattacatcccattggtgcccagg

SEQ ID NO: 354314 - DNA, 25 bp, Homo sapien
ccaggttccctattatccaacaatg

SEQ ID NO: 354315 - DNA, 25 bp, Homo sapien
tccaacaatgaggactccttggttt

SEQ ID NO: 354316 - DNA, 25 bp, Homo sapien
aacactcattgagtccctggcagag

SEQ ID NO: 354317 - DNA, 25 bp, Homo sapien
gtccctggcagagttagtgcttaaa

SEQ ID NO: 354318 - DNA, 25 bp, Homo sapien
aatataccacactgagtaaggcatg

SEQ ID NO: 354319 - DNA, 25 bp, Homo sapien
agtccccgtacgagcatctcacttt

SEQ ID NO: 354320 - DNA, 25 bp, Homo sapien
gagcatctcactttcccttccatgg

SEQ ID NO: 354321 - DNA, 25 bp, Homo sapien
ggtggccgggagaccatatgtccca

SEQ ID NO: 354322 - DNA, 25 bp, Homo sapien
gagaccatatgtcccagccatagtg

SEQ ID NO: 354323 - DNA, 25 bp, Homo sapien
agccatagtggcagatgctctccag

SEQ ID NO: 354324 - DNA, 25 bp, Homo sapien
ggacaccggccctcatggcaggtga

SEQ ID NO: 354325 - DNA, 25 bp, Homo sapien
caggtgaggaggcagtgcactgttt

SEQ ID NO: 354326 - DNA, 25 bp, Homo sapien
aggagtttctgggagaatggtcaaa

SEQ ID NO: 354327 - DNA, 25 bp, Homo sapien
ggagaatggtcaaatccccaatgta

SEQ ID NO: 354328 - DNA, 25 bp, Homo sapien
aaatccccaatgtatcaactcagct

SEQ ID NO: 354329 - DNA, 25 bp, Homo sapien
ccccaatgtatcaactcagctttat

SEQ ID NO: 354330 - DNA, 25 bp, Homo sapien
ctgagaggcccattctgcaagtgga

SEQ ID NO: 354331 - DNA, 25 bp, Homo sapien
ggcccattctgcaagtggacagctg

SEQ ID NO: 354332 - DNA, 25 bp, Homo sapien
gcaagtggacagctgtgtctttgct

SEQ ID NO: 354333 - DNA, 25 bp, Homo sapien
ctctagggacctgtgttatatttga

SEQ ID NO: 354334 - DNA, 25 bp, Homo sapien
aatgttgaacatgctgatacagaag

SEQ ID NO: 354335 - DNA, 25 bp, Homo sapien
gccatacaatgaagaagctcagcat

SEQ ID NO: 354336 - DNA, 25 bp, Homo sapien
agctcagcatgacaagaactctcct

SEQ ID NO: 354337 - DNA, 25 bp, Homo sapien
gcatgacaagaactctcctgacaga

SEQ ID NO: 354338 - DNA, 25 bp, Homo sapien
taatgatttctcctatcgacccaac

SEQ ID NO: 354339 - DNA, 25 bp, Homo sapien
ctcctatcgacccaacatgatttgt

SEQ ID NO: 354340 - DNA, 25 bp, Homo sapien
gacccaacatgatttgtaactttct

SEQ ID NO: 354341 - DNA, 25 bp, Homo sapien
gatagatttatccaaaacagttatg

SEQ ID NO: 354342 - DNA, 25 bp, Homo sapien
caaaacagttatgaattcagatcct

SEQ ID NO: 354343 - DNA, 25 bp, Homo sapien
gaattcagatcctaccaatctgata

SEQ ID NO: 354344 - DNA, 25 bp, Homo sapien
gatcctaccaatctgatattacaag

SEQ ID NO: 354345 - DNA, 25 bp, Homo sapien
tgatattacaagagctcacataggg

SEQ ID NO: 354346 - DNA, 25 bp, Homo sapien
cagtcacagagggaagtagaggcca

SEQ ID NO: 354347 - DNA, 25 bp, Homo sapien
ggccaggcagcctgcgaatgatcaa

SEQ ID NO: 354348 - DNA, 25 bp, Homo sapien
gcagcctgcgaatgatcaatgtggt

SEQ ID NO: 354349 - DNA, 25 bp, Homo sapien
aatgatcaatgtggtacagggctcc

SEQ ID NO: 354350 - DNA, 25 bp, Homo sapien
tatggccacctctcaagttgttctt

SEQ ID NO: 354351 - DNA, 25 bp, Homo sapien
tggccacctctcaagttgttctttc

SEQ ID NO: 354352 - DNA, 25 bp, Homo sapien
atggcactgcattacataaccttcc

SEQ ID NO: 354353 - DNA, 25 bp, Homo sapien
ggcactgcattacataaccttccgt

SEQ ID NO: 354354 - DNA, 25 bp, Homo sapien
ctgcattacataaccttccgtgttt

SEQ ID NO: 354355 - DNA, 25 bp, Homo sapien
gcattacataaccttccgtgtttaa

SEQ ID NO: 354356 - DNA, 25 bp, Homo sapien
aatcagccttccaccgtgtagtgta

SEQ ID NO: 354357 - DNA, 25 bp, Homo sapien
atcagccttccaccgtgtagtgtaa

SEQ ID NO: 354358 - DNA, 25 bp, Homo sapien
cagccttccaccgtgtagtgtaatg

SEQ ID NO: 354359 - DNA, 25 bp, Homo sapien
gccttccaccgtgtagtgtaatgcc

SEQ ID NO: 354360 - DNA, 25 bp, Homo sapien
ttccaccgtgtagtgtaatgcctca

SEQ ID NO: 354361 - DNA, 25 bp, Homo sapien
gtgtaatgcctcagagtggatattt

SEQ ID NO: 354362 - DNA, 25 bp, Homo sapien
tttggaaatggcactgcattacata

SEQ ID NO: 354363 - DNA, 25 bp, Homo sapien
aggccaccggagcaagctagagcca

SEQ ID NO: 354364 - DNA, 25 bp, Homo sapien
agctagagccaacccagtggcctgg

SEQ ID NO: 354365 - DNA, 25 bp, Homo sapien
tttggtgtgaactgcagcgtgagca

SEQ ID NO: 354366 - DNA, 25 bp, Homo sapien
agtcactcaggacgcatctgtgtta

SEQ ID NO: 354367 - DNA, 25 bp, Homo sapien
tcaggacgcatctgtgttaaggaga

SEQ ID NO: 354368 - DNA, 25 bp, Homo sapien
aggaagtgacgtgactgtccctcag

SEQ ID NO: 354369 - DNA, 25 bp, Homo sapien
agtggttttctgagcatgttgtgaa

SEQ ID NO: 354370 - DNA, 25 bp, Homo sapien
agtgacgtgactgtccctcagcagg

SEQ ID NO: 354371 - DNA, 25 bp, Homo sapien
gaagaacggacagaacatgcatact

SEQ ID NO: 354372 - DNA, 25 bp, Homo sapien
acatgcatactgtgagatgctatga

SEQ ID NO: 354373 - DNA, 25 bp, Homo sapien
agatgctatgaagccaggccaccgg

SEQ ID NO: 354374 - DNA, 25 bp, Homo sapien
gtatccctagactccatgttaaaaa

SEQ ID NO: 354375 - DNA, 25 bp, Homo sapien
caatcgtcatgagccttgaaatatt

SEQ ID NO: 354376 - DNA, 25 bp, Homo sapien
tttctttaactttacaatacttcat

SEQ ID NO: 354377 - DNA, 25 bp, Homo sapien
aacactgtgtattagaaattatctg

SEQ ID NO: 354378 - DNA, 25 bp, Homo sapien
aaattatctggatggctcacagctg

SEQ ID NO: 354379 - DNA, 25 bp, Homo sapien
ggattctatcctaaattgatctcaa

SEQ ID NO: 354380 - DNA, 25 bp, Homo sapien
tcactgaaatctgtttagatcactc

SEQ ID NO: 354381 - DNA, 25 bp, Homo sapien
gaaatatttctgacataccctcaaa

SEQ ID NO: 354382 - DNA, 25 bp, Homo sapien
gacataccctcaaatgaccgattaa

SEQ ID NO: 354383 - DNA, 25 bp, Homo sapien
caaatgaccgattaatactgttttt

SEQ ID NO: 354384 - DNA, 25 bp, Homo sapien
ttattccagtatccctagactccat

SEQ ID NO: 354385 - DNA, 25 bp, Homo sapien
ctgagcaaggcctacgtaggccaga

SEQ ID NO: 354386 - DNA, 25 bp, Homo sapien
gcctacgtaggccagaagagcagct

SEQ ID NO: 354387 - DNA, 25 bp, Homo sapien
agaagagcagcttcacagtagactg

SEQ ID NO: 354388 - DNA, 25 bp, Homo sapien
gcagcttcacagtagactgcagcaa

SEQ ID NO: 354389 - DNA, 25 bp, Homo sapien
gcttcacagtagactgcagcaaagc

SEQ ID NO: 354390 - DNA, 25 bp, Homo sapien
aaagcaggcaacaacatgctgctgg

SEQ ID NO: 354391 - DNA, 25 bp, Homo sapien
tacagcgtgtcctacctgctcaagg

SEQ ID NO: 354392 - DNA, 25 bp, Homo sapien
gtgtcctacctgctcaaggacaagg

SEQ ID NO: 354393 - DNA, 25 bp, Homo sapien
gggagtacacactggtggtcaaatg

SEQ ID NO: 354394 - DNA, 25 bp, Homo sapien
caggcagcccctaccgcgttgtggt

SEQ ID NO: 354395 - DNA, 25 bp, Homo sapien
cctaccgcgttgtggtgccctgagt

SEQ ID NO: 354396 - DNA, 25 bp, Homo sapien
aatgagccccattcaaactgttatt

SEQ ID NO: 354397 - DNA, 25 bp, Homo sapien
ggaactttggattacctagcaacta

SEQ ID NO: 354398 - DNA, 25 bp, Homo sapien
gctaatctgattgagggttgccctc

SEQ ID NO: 354399 - DNA, 25 bp, Homo sapien
ttgccctctttgctgggcagatcat

SEQ ID NO: 354400 - DNA, 25 bp, Homo sapien
ggcagatcatggctaatctcagctt

SEQ ID NO: 354401 - DNA, 25 bp, Homo sapien
atctcagcttcacatgagtcttgtg

SEQ ID NO: 354402 - DNA, 25 bp, Homo sapien
agtcttgtgaaccatctagttgttt

SEQ ID NO: 354403 - DNA, 25 bp, Homo sapien
ttaatgtaaccttctttcccagtgc

SEQ ID NO: 354404 - DNA, 25 bp, Homo sapien
ttctttcccagtgcaggatgacttg

SEQ ID NO: 354405 - DNA, 25 bp, Homo sapien
gcaggatgacttgtaatcaccttga

SEQ ID NO: 354406 - DNA, 25 bp, Homo sapien
ggttcttcgtattcaggtagggtat

SEQ ID NO: 354407 - DNA, 25 bp, Homo sapien
ttttttacttcataggccaggcttg

SEQ ID NO: 354408 - DNA, 25 bp, Homo sapien
ttttacttcataggccaggcttgaa

SEQ ID NO: 354409 - DNA, 25 bp, Homo sapien
aggccaggcttgaagttctgaacac

SEQ ID NO: 354410 - DNA, 25 bp, Homo sapien
gccaggcttgaagttctgaacactt

SEQ ID NO: 354411 - DNA, 25 bp, Homo sapien
aggcttgaagttctgaacactttga

SEQ ID NO: 354412 - DNA, 25 bp, Homo sapien
gaagttctgaacactttgaagtctc

SEQ ID NO: 354413 - DNA, 25 bp, Homo sapien
gttctgaacactttgaagtctccaa

SEQ ID NO: 354414 - DNA, 25 bp, Homo sapien
tctgaacactttgaagtctccaatt

SEQ ID NO: 354415 - DNA, 25 bp, Homo sapien
gaacactttgaagtctccaattatg

SEQ ID NO: 354416 - DNA, 25 bp, Homo sapien
acactttgaagtctccaattatgag

SEQ ID NO: 354417 - DNA, 25 bp, Homo sapien
gaagtctccaattatgagagatcca

SEQ ID NO: 354418 - DNA, 25 bp, Homo sapien
gtgtgcctggcatctgcgtgctgca

SEQ ID NO: 354419 - DNA, 25 bp, Homo sapien
gggctgacagagtgtgtcaacttga

SEQ ID NO: 354420 - DNA, 25 bp, Homo sapien
tgtcaacttgagctctggctgtgca

SEQ ID NO: 354421 - DNA, 25 bp, Homo sapien
accgctgctgcgtgagcctgttatt

SEQ ID NO: 354422 - DNA, 25 bp, Homo sapien
gtgagcctgttattccattctggat

SEQ ID NO: 354423 - DNA, 25 bp, Homo sapien
ttccattctggattgctattttgat

SEQ ID NO: 354424 - DNA, 25 bp, Homo sapien
ggattgctattttgatacccagatt

SEQ ID NO: 354425 - DNA, 25 bp, Homo sapien
gatacccagattgcatcattcttcc

SEQ ID NO: 354426 - DNA, 25 bp, Homo sapien
gattgcatcattcttcctacgtata

SEQ ID NO: 354427 - DNA, 25 bp, Homo sapien
gcatcattcttcctacgtataaaca

SEQ ID NO: 354428 - DNA, 25 bp, Homo sapien
agggtcctgcagctactcacttcac

SEQ ID NO: 354429 - DNA, 25 bp, Homo sapien
atcatctacccgctgtgtgagaaca

SEQ ID NO: 354430 - DNA, 25 bp, Homo sapien
agaacaacgtctacatgctgtctcc

SEQ ID NO: 354431 - DNA, 25 bp, Homo sapien
atgctgtctcccaatgccagcgtat

SEQ ID NO: 354432 - DNA, 25 bp, Homo sapien
aatgccagcgtatgtctgtactccc

SEQ ID NO: 354433 - DNA, 25 bp, Homo sapien
atgacctgccgtccgttcttgccaa

SEQ ID NO: 354434 - DNA, 25 bp, Homo sapien
ttcttgccaagttctccttgccggt

SEQ ID NO: 354435 - DNA, 25 bp, Homo sapien
ttgccggtctccttgtcagaattta

SEQ ID NO: 354436 - DNA, 25 bp, Homo sapien
tcagaatttaggaatcccctggccc

SEQ ID NO: 354437 - DNA, 25 bp, Homo sapien
gctgtgcaggagacccagctcatcc

SEQ ID NO: 354438 - DNA, 25 bp, Homo sapien
ttctcatccagctgcacacctatgt

SEQ ID NO: 354439 - DNA, 25 bp, Homo sapien
tgcacacctatgtctgcctgatggc

SEQ ID NO: 354440 - DNA, 25 bp, Homo sapien
tgagcagtgaactacactcctacct

SEQ ID NO: 354441 - DNA, 25 bp, Homo sapien
tcctaccttctctagtactgattga

SEQ ID NO: 354442 - DNA, 25 bp, Homo sapien
tctagtactgattgagctgggattc

SEQ ID NO: 354443 - DNA, 25 bp, Homo sapien
gctgggattcaaaagctggactcca

SEQ ID NO: 354444 - DNA, 25 bp, Homo sapien
gctggactccaaaacctatgctttt

SEQ ID NO: 354445 - DNA, 25 bp, Homo sapien
tatgcttttaactactttgcctcaa

SEQ ID NO: 354446 - DNA, 25 bp, Homo sapien
tatctcctactatgggtctccagta

SEQ ID NO: 354447 - DNA, 25 bp, Homo sapien
tactatgggtctccagtacctggaa

SEQ ID NO: 354448 - DNA, 25 bp, Homo sapien
gaatacctgctatgtaggtgttcaa

SEQ ID NO: 354449 - DNA, 25 bp, Homo sapien
agtgtgtttctaaaagccattcctt

SEQ ID NO: 354450 - DNA, 25 bp, Homo sapien
agtttagcagactctcttctaccta

SEQ ID NO: 354451 - DNA, 25 bp, Homo sapien
aggacctccggccttgtccatttcg

SEQ ID NO: 354452 - DNA, 25 bp, Homo sapien
gacctccggccttgtccatttcggg

SEQ ID NO: 354453 - DNA, 25 bp, Homo sapien
agcccagaacggaccggacgcctgt

SEQ ID NO: 354454 - DNA, 25 bp, Homo sapien
agaacggaccggacgcctgtgcacc

SEQ ID NO: 354455 - DNA, 25 bp, Homo sapien
ccccttggactagagcggctgggca

SEQ ID NO: 354456 - DNA, 25 bp, Homo sapien
ccttggactagagcggctgggcaga

SEQ ID NO: 354457 - DNA, 25 bp, Homo sapien
tcctctgccagcctgtgggcatggc

SEQ ID NO: 354458 - DNA, 25 bp, Homo sapien
tgtgggcatggcagtcattcctgga

SEQ ID NO: 354459 - DNA, 25 bp, Homo sapien
gtgggcatggcagtcattcctggaa

SEQ ID NO: 354460 - DNA, 25 bp, Homo sapien
tgggcatggcagtcattcctggaag

SEQ ID NO: 354461 - DNA, 25 bp, Homo sapien
ggcatggcagtcattcctggaaggg

SEQ ID NO: 354462 - DNA, 25 bp, Homo sapien
aagcctgaatggctgtcagtgtcag

SEQ ID NO: 354463 - DNA, 25 bp, Homo sapien
cctgaatggctgtcagtgtcagaga

SEQ ID NO: 354464 - DNA, 25 bp, Homo sapien
tggaccataccttctctgctggcag

SEQ ID NO: 354465 - DNA, 25 bp, Homo sapien
ataccttctctgctggcagcttact

SEQ ID NO: 354466 - DNA, 25 bp, Homo sapien
tgctggcagcttactgtgactgcac

SEQ ID NO: 354467 - DNA, 25 bp, Homo sapien
agcttactgtgactgcaccatccaa

SEQ ID NO: 354468 - DNA, 25 bp, Homo sapien
gtgactgcaccatccaaaatttggt

SEQ ID NO: 354469 - DNA, 25 bp, Homo sapien
aatttgaccaatatttcttagaagg

SEQ ID NO: 354470 - DNA, 25 bp, Homo sapien
tcaaagcaggaagatactacacaga

SEQ ID NO: 354471 - DNA, 25 bp, Homo sapien
aagaagcagtgagaggacaccatct

SEQ ID NO: 354472 - DNA, 25 bp, Homo sapien
atgctggctgcaccaagaagcctga

SEQ ID NO: 354473 - DNA, 25 bp, Homo sapien
gggcaggtggccgtgctccgaagag

SEQ ID NO: 354474 - DNA, 25 bp, Homo sapien
agagcgccctgccacccatgaggtg

SEQ ID NO: 354475 - DNA, 25 bp, Homo sapien
gcgtcgctagccttcccagctgggt

SEQ ID NO: 354476 - DNA, 25 bp, Homo sapien
gggtgtcctcatccggagacacaaa

SEQ ID NO: 354477 - DNA, 25 bp, Homo sapien
aacacctgcctcaggattaaagcga

SEQ ID NO: 354478 - DNA, 25 bp, Homo sapien
aaagcgaggagctgtatttcagacc

SEQ ID NO: 354479 - DNA, 25 bp, Homo sapien
ggagctgtatttcagaccgtctcag

SEQ ID NO: 354480 - DNA, 25 bp, Homo sapien
gctgtatttcagaccgtctcaggag

SEQ ID NO: 354481 - DNA, 25 bp, Homo sapien
atttcagaccgtctcaggagaaata

SEQ ID NO: 354482 - DNA, 25 bp, Homo sapien
atagcaagaggctgcctcactcctt

SEQ ID NO: 354483 - DNA, 25 bp, Homo sapien
gcccctgtcagagcaacatgacttg

SEQ ID NO: 354484 - DNA, 25 bp, Homo sapien
ttcgctcctgaagaaaaccgggctc

SEQ ID NO: 354485 - DNA, 25 bp, Homo sapien
tcgctcctgaagaaaaccgggctcg

SEQ ID NO: 354486 - DNA, 25 bp, Homo sapien
cgctcctgaagaaaaccgggctcgg

SEQ ID NO: 354487 - DNA, 25 bp, Homo sapien
gctcctgaagaaaaccgggctcgga

SEQ ID NO: 354488 - DNA, 25 bp, Homo sapien
accgggctcggaaaagcggcgcgtg

SEQ ID NO: 354489 - DNA, 25 bp, Homo sapien
cgggctcggaaaagcggcgcgtgtg

SEQ ID NO: 354490 - DNA, 25 bp, Homo sapien
cctgcagcgggcctttcaacggcga

SEQ ID NO: 354491 - DNA, 25 bp, Homo sapien
tgcagcgggcctttcaacggcgaca

SEQ ID NO: 354492 - DNA, 25 bp, Homo sapien
gcagcgggcctttcaacggcgacag

SEQ ID NO: 354493 - DNA, 25 bp, Homo sapien
agcgggcctttcaacggcgacaggg

SEQ ID NO: 354494 - DNA, 25 bp, Homo sapien
gcgggcctttcaacggcgacagggc

SEQ ID NO: 354495 - DNA, 25 bp, Homo sapien
aggagtattaaaaagctgcgttggt

SEQ ID NO: 354496 - DNA, 25 bp, Homo sapien
gtttttcatggaaccaagatttgac

SEQ ID NO: 354497 - DNA, 25 bp, Homo sapien
aagatttgacaaaggcatctcttat

SEQ ID NO: 354498 - DNA, 25 bp, Homo sapien
ggcatctcttatccttggttttaaa

SEQ ID NO: 354499 - DNA, 25 bp, Homo sapien
gttttaaattcctgctgggagcaag

SEQ ID NO: 354500 - DNA, 25 bp, Homo sapien
agcaaggcctggtatgagcgccctg

SEQ ID NO: 354501 - DNA, 25 bp, Homo sapien
gagcgccctgggtcttgtttttggt

SEQ ID NO: 354502 - DNA, 25 bp, Homo sapien
ttgtttttggtgtttcgcttttctg

SEQ ID NO: 354503 - DNA, 25 bp, Homo sapien
ggtgtttcgcttttctgtaaggatt

SEQ ID NO: 354504 - DNA, 25 bp, Homo sapien
gggcctcactttagaatgaatgagt

SEQ ID NO: 354505 - DNA, 25 bp, Homo sapien
gaatgagtcaccttgtgatttttaa

SEQ ID NO: 354506 - DNA, 25 bp, Homo sapien
ccacttgggtggatttgcacatggc

SEQ ID NO: 354507 - DNA, 25 bp, Homo sapien
atggccatcctgtacatgtgccctt

SEQ ID NO: 354508 - DNA, 25 bp, Homo sapien
aggcattggctctaggcagcctcag

SEQ ID NO: 354509 - DNA, 25 bp, Homo sapien
cttttccttggaagtgcatcagcag

SEQ ID NO: 354510 - DNA, 25 bp, Homo sapien
tctatcctcaacctaatggaaagca

SEQ ID NO: 354511 - DNA, 25 bp, Homo sapien
taatggaaagcagacgtccccgcac

SEQ ID NO: 354512 - DNA, 25 bp, Homo sapien
agacgtccccgcacgcagaggagca

SEQ ID NO: 354513 - DNA, 25 bp, Homo sapien
gccttgcagggtttttctggaatag

SEQ ID NO: 354514 - DNA, 25 bp, Homo sapien
gtcaccacggactctgtttaatgtc

SEQ ID NO: 354515 - DNA, 25 bp, Homo sapien
tttaatgtctcagctggacttggct

SEQ ID NO: 354516 - DNA, 25 bp, Homo sapien
ttgcagggaatatggctggtccact

SEQ ID NO: 354517 - DNA, 25 bp, Homo sapien
ttcctgcaagaagttctcaagcctt

SEQ ID NO: 354518 - DNA, 25 bp, Homo sapien
aaagtacagctttgcataagagtga

SEQ ID NO: 354519 - DNA, 25 bp, Homo sapien
aaattgggctagcttaaatggatcc

SEQ ID NO: 354520 - DNA, 25 bp, Homo sapien
aatggatccataaactttcttctaa

SEQ ID NO: 354521 - DNA, 25 bp, Homo sapien
acacctgttaaatttaatgtagcag

SEQ ID NO: 354522 - DNA, 25 bp, Homo sapien
aatgtagcagtctgagaatctaaaa

SEQ ID NO: 354523 - DNA, 25 bp, Homo sapien
gaatctaaaattatgtaccactcgt

SEQ ID NO: 354524 - DNA, 25 bp, Homo sapien
gtaccactcgtttatttgttcattc

SEQ ID NO: 354525 - DNA, 25 bp, Homo sapien
ttcatttgtttatccagctagtttt

SEQ ID NO: 354526 - DNA, 25 bp, Homo sapien
tgtttatccagctagttttattaac

SEQ ID NO: 354527 - DNA, 25 bp, Homo sapien
aactgttttaatccaggcattggga

SEQ ID NO: 354528 - DNA, 25 bp, Homo sapien
ggcagctgggaatattctggaagaa

SEQ ID NO: 354529 - DNA, 25 bp, Homo sapien
tggaagaagggacagcacgggcaaa

SEQ ID NO: 354530 - DNA, 25 bp, Homo sapien
tgggaacctggcactctggaggaac

SEQ ID NO: 354531 - DNA, 25 bp, Homo sapien
aacctggcactctggaggaacccag

SEQ ID NO: 354532 - DNA, 25 bp, Homo sapien
gaagggagacacaagtggccaccag

SEQ ID NO: 354533 - DNA, 25 bp, Homo sapien
caagtggccaccagagaggtcagta

SEQ ID NO: 354534 - DNA, 25 bp, Homo sapien
accagagaggtcagtagccctgggc

SEQ ID NO: 354535 - DNA, 25 bp, Homo sapien
gacttcctgggaatggatggttaag

SEQ ID NO: 354536 - DNA, 25 bp, Homo sapien
ggaatggatggttaagctaaggcca

SEQ ID NO: 354537 - DNA, 25 bp, Homo sapien
gggaaatgaaacaggccaggtaaag

SEQ ID NO: 354538 - DNA, 25 bp, Homo sapien
aaacaggccaggtaaagcattggga

SEQ ID NO: 354539 - DNA, 25 bp, Homo sapien
tcgtcctgtctcctcaaactcattt

SEQ ID NO: 354540 - DNA, 25 bp, Homo sapien
tcatttccttccacagagcaaacta

SEQ ID NO: 354541 - DNA, 25 bp, Homo sapien
ctaaaaaccagtcctataaagcgtg

SEQ ID NO: 354542 - DNA, 25 bp, Homo sapien
taaagcgtggttttgcaagcagcag

SEQ ID NO: 354543 - DNA, 25 bp, Homo sapien
gcaagcagcagatgactcggttttc

SEQ ID NO: 354544 - DNA, 25 bp, Homo sapien
gatgactcggttttctagcaaagga

SEQ ID NO: 354545 - DNA, 25 bp, Homo sapien
ggagctgctaggctcgcactaagta

SEQ ID NO: 354546 - DNA, 25 bp, Homo sapien
ggctcgcactaagtatcagaattta

SEQ ID NO: 354547 - DNA, 25 bp, Homo sapien
agaatttactgttcgctttgcctct

SEQ ID NO: 354548 - DNA, 25 bp, Homo sapien
tttgcctctgcgcttcattttgcaa

SEQ ID NO: 354549 - DNA, 25 bp, Homo sapien
gcgcttcattttgcaaccttgtgca

SEQ ID NO: 354550 - DNA, 25 bp, Homo sapien
attcttccccagacttggactctgg

SEQ ID NO: 354551 - DNA, 25 bp, Homo sapien
agacttggactctgggtcagaggaa

SEQ ID NO: 354552 - DNA, 25 bp, Homo sapien
ttcaggaagaaaatcacatttgtac

SEQ ID NO: 354553 - DNA, 25 bp, Homo sapien
tcacatttgtacctttaaacagact

SEQ ID NO: 354554 - DNA, 25 bp, Homo sapien
tagaaaactacaggactccaaattt

SEQ ID NO: 354555 - DNA, 25 bp, Homo sapien
attttcagtcttatgacttggacac

SEQ ID NO: 354556 - DNA, 25 bp, Homo sapien
tgacttggacacatagactgaatga

SEQ ID NO: 354557 - DNA, 25 bp, Homo sapien
ggacacatagactgaatgagaccaa

SEQ ID NO: 354558 - DNA, 25 bp, Homo sapien
ggaaaagcttaacatactacctcaa

SEQ ID NO: 354559 - DNA, 25 bp, Homo sapien
acatactacctcaagtgaactttta

SEQ ID NO: 354560 - DNA, 25 bp, Homo sapien
gagagagaatcttatgttttttaaa

SEQ ID NO: 354561 - DNA, 25 bp, Homo sapien
cctggtggcatcctgggtcaccttg

SEQ ID NO: 354562 - DNA, 25 bp, Homo sapien
gtgaaagtttgggaactctggcact

SEQ ID NO: 354563 - DNA, 25 bp, Homo sapien
aactctggcactagcccctggaaaa

SEQ ID NO: 354564 - DNA, 25 bp, Homo sapien
ggagctgaaacaacctttaaggaga

SEQ ID NO: 354565 - DNA, 25 bp, Homo sapien
gtataaacagatatgacccacattc

SEQ ID NO: 354566 - DNA, 25 bp, Homo sapien
gatatgacccacattctcatggagc

SEQ ID NO: 354567 - DNA, 25 bp, Homo sapien
tgacccacattctcatggagcctgg

SEQ ID NO: 354568 - DNA, 25 bp, Homo sapien
gacaggtctatgaaggaaatcacaa

SEQ ID NO: 354569 - DNA, 25 bp, Homo sapien
atcacaatgaatcgtcagcaccacc

SEQ ID NO: 354570 - DNA, 25 bp, Homo sapien
gggaggactcactgaaggtcatgca

SEQ ID NO: 354571 - DNA, 25 bp, Homo sapien
cactgaaggtcatgcaatgcacccc

SEQ ID NO: 354572 - DNA, 25 bp, Homo sapien
agctctctcaggacctatttccagg

SEQ ID NO: 354573 - DNA, 25 bp, Homo sapien
ggacctatttccaggacctgggact

SEQ ID NO: 354574 - DNA, 25 bp, Homo sapien
tgcagagagtctgttgctggccaac

SEQ ID NO: 354575 - DNA, 25 bp, Homo sapien
gagccaactcctctagtgcactgat

SEQ ID NO: 354576 - DNA, 25 bp, Homo sapien
gttgctggccaacagttgccctgag

SEQ ID NO: 354577 - DNA, 25 bp, Homo sapien
cagttgccctgagcagagatgagga

SEQ ID NO: 354578 - DNA, 25 bp, Homo sapien
aaaaaaccagcgtgagctcccctat

SEQ ID NO: 354579 - DNA, 25 bp, Homo sapien
agctcccctatgtctgctgcatcag

SEQ ID NO: 354580 - DNA, 25 bp, Homo sapien
gggttatgagtcagcaacctgagat

SEQ ID NO: 354581 - DNA, 25 bp, Homo sapien
agatgtgaggttgagactctccata

SEQ ID NO: 354582 - DNA, 25 bp, Homo sapien
agactctccataggcctggttcagt

SEQ ID NO: 354583 - DNA, 25 bp, Homo sapien
gatctagattatcagagagccttga

SEQ ID NO: 354584 - DNA, 25 bp, Homo sapien
atcagagagccttgatcattgaaga

SEQ ID NO: 354585 - DNA, 25 bp, Homo sapien
aatgataagtgtggctgttatgcaa

SEQ ID NO: 354586 - DNA, 25 bp, Homo sapien
gccagcatgggtgtgacctcaacag

SEQ ID NO: 354587 - DNA, 25 bp, Homo sapien
gtgacctcaacagaggatgcagcaa

SEQ ID NO: 354588 - DNA, 25 bp, Homo sapien
gatgcagcaagaaggattcattttg

SEQ ID NO: 354589 - DNA, 25 bp, Homo sapien
aaaatccaatctgatggcatcttga

SEQ ID NO: 354590 - DNA, 25 bp, Homo sapien
atcttgatcttgacttcctaccctc

SEQ ID NO: 354591 - DNA, 25 bp, Homo sapien
gtgagcatcatctggacaactaggt

SEQ ID NO: 354592 - DNA, 25 bp, Homo sapien
gacaactaggtcttcatcatgggaa

SEQ ID NO: 354593 - DNA, 25 bp, Homo sapien
ggtcttcatcatgggaagatctaga

SEQ ID NO: 354594 - DNA, 25 bp, Homo sapien
tttggacccaattctgattacttac

SEQ ID NO: 354595 - DNA, 25 bp, Homo sapien
ggacccaattctgattacttacaga

SEQ ID NO: 354596 - DNA, 25 bp, Homo sapien
gattacttacagaagaaggactgat

SEQ ID NO: 354597 - DNA, 25 bp, Homo sapien
atgaggcaatgtcagtattatctga

SEQ ID NO: 354598 - DNA, 25 bp, Homo sapien
tcagtattatctgacatctttcttt

SEQ ID NO: 354599 - DNA, 25 bp, Homo sapien
gacatctttcttttcaggtcatgtg

SEQ ID NO: 354600 - DNA, 25 bp, Homo sapien
tttcttttcaggtcatgtgtccctg

SEQ ID NO: 354601 - DNA, 25 bp, Homo sapien
ggtcatgtgtccctgaaaagttaaa

SEQ ID NO: 354602 - DNA, 25 bp, Homo sapien
tgtgtccctgaaaagttaaatgtaa

SEQ ID NO: 354603 - DNA, 25 bp, Homo sapien
gattttggtaaatcccatctttcag

SEQ ID NO: 354604 - DNA, 25 bp, Homo sapien
ctagaaggactctgagaagttggta

SEQ ID NO: 354605 - DNA, 25 bp, Homo sapien
caggagccctttgctgtgtgctctg

SEQ ID NO: 354606 - DNA, 25 bp, Homo sapien
gtgtgctctgtccagtgtcatgaga

SEQ ID NO: 354607 - DNA, 25 bp, Homo sapien
tgctctgtccagtgtcatgagacgg

SEQ ID NO: 354608 - DNA, 25 bp, Homo sapien
cagtgtcatgagacgggagcccttt

SEQ ID NO: 354609 - DNA, 25 bp, Homo sapien
agacgggagccctttgctgtgtgct

SEQ ID NO: 354610 - DNA, 25 bp, Homo sapien
ttgctgtgtgctctgtccagtgtca

SEQ ID NO: 354611 - DNA, 25 bp, Homo sapien
tgtgtgctctgtccagtgtcatgag

SEQ ID NO: 354612 - DNA, 25 bp, Homo sapien
tgctctgtccagtgtcatgaggcag

SEQ ID NO: 354613 - DNA, 25 bp, Homo sapien
gtccagtgtcatgaggcaggtgttt

SEQ ID NO: 354614 - DNA, 25 bp, Homo sapien
gtcatgaggcaggtgtttgcaaagc

SEQ ID NO: 354615 - DNA, 25 bp, Homo sapien
tccgatggggtattgctgacctact

SEQ ID NO: 354616 - DNA, 25 bp, Homo sapien
gtataaatcctgatacagcctccat

SEQ ID NO: 354617 - DNA, 25 bp, Homo sapien
tgatacagcctccatcggttcaatt

SEQ ID NO: 354618 - DNA, 25 bp, Homo sapien
cctccatcggttcaattccatatga

SEQ ID NO: 354619 - DNA, 25 bp, Homo sapien
ccatatgagatgtttttcagctgca

SEQ ID NO: 354620 - DNA, 25 bp, Homo sapien
agctgcattgttcccctgagtcctg

SEQ ID NO: 354621 - DNA, 25 bp, Homo sapien
cctgagtcctgaacatacgctgaga

SEQ ID NO: 354622 - DNA, 25 bp, Homo sapien
gaacatacgctgagagtcacaagag

SEQ ID NO: 354623 - DNA, 25 bp, Homo sapien
aaggtccccattgcaatattcagtg

SEQ ID NO: 354624 - DNA, 25 bp, Homo sapien
gtgaaatcgcattctttaccaactg

SEQ ID NO: 354625 - DNA, 25 bp, Homo sapien
ttctttaccaactgatttcctacaa

SEQ ID NO: 354626 - DNA, 25 bp, Homo sapien
gaactttttctgacttgatactctg

SEQ ID NO: 354627 - DNA, 25 bp, Homo sapien
gctccagctccctgtgttgtgtgtg

SEQ ID NO: 354628 - DNA, 25 bp, Homo sapien
catccatgggcttgggtgtcagttt

SEQ ID NO: 354629 - DNA, 25 bp, Homo sapien
gggtgtcagtttgtcacaggtatct

SEQ ID NO: 354630 - DNA, 25 bp, Homo sapien
ggtatctgccagcattcaaggtttt

SEQ ID NO: 354631 - DNA, 25 bp, Homo sapien
gatctttcctttgactgggtgctgt

SEQ ID NO: 354632 - DNA, 25 bp, Homo sapien
gagattatctccctactgtgtaggt

SEQ ID NO: 354633 - DNA, 25 bp, Homo sapien
tgctgtgaggacacacctgggtctg

SEQ ID NO: 354634 - DNA, 25 bp, Homo sapien
ttaagggcagtctcgacttttcctt

SEQ ID NO: 354635 - DNA, 25 bp, Homo sapien
tttccttttttgagtcctgtgtggc

SEQ ID NO: 354636 - DNA, 25 bp, Homo sapien
cctgtgtggctctttgaatcagcgt

SEQ ID NO: 354637 - DNA, 25 bp, Homo sapien
gaatcagcgtgaaactgaggctcca

SEQ ID NO: 354638 - DNA, 25 bp, Homo sapien
ttgggttggtggtctttgtccagaa

SEQ ID NO: 354639 - DNA, 25 bp, Homo sapien
taaccctcccttctgagagtttcca

SEQ ID NO: 354640 - DNA, 25 bp, Homo sapien
tcccttctgagagtttccaggagga

SEQ ID NO: 354641 - DNA, 25 bp, Homo sapien
ctgagagtttccaggaggagtccga

SEQ ID NO: 354642 - DNA, 25 bp, Homo sapien
aggagtccgagggtctagcttttct

SEQ ID NO: 354643 - DNA, 25 bp, Homo sapien
ccgagggtctagcttttctggtgaa

SEQ ID NO: 354644 - DNA, 25 bp, Homo sapien
gcttttctggtgaagccagttcctg

SEQ ID NO: 354645 - DNA, 25 bp, Homo sapien
tggtgaagccagttcctgttcctgc

SEQ ID NO: 354646 - DNA, 25 bp, Homo sapien
tttcctaagggcctgctcgctctgg

SEQ ID NO: 354647 - DNA, 25 bp, Homo sapien
gggagggattgctgtgttacatagc

SEQ ID NO: 354648 - DNA, 25 bp, Homo sapien
tgtcatcccaagcttatgctgtttt

SEQ ID NO: 354649 - DNA, 25 bp, Homo sapien
gaaactgtctgagtactgaaccgga

SEQ ID NO: 354650 - DNA, 25 bp, Homo sapien
ctgagtactgaaccggaggtgacaa

SEQ ID NO: 354651 - DNA, 25 bp, Homo sapien
ctaagtctgccatttttatgttaat

SEQ ID NO: 354652 - DNA, 25 bp, Homo sapien
gaaactacagatttgtgccctgctg

SEQ ID NO: 354653 - DNA, 25 bp, Homo sapien
tgtgccctgctgtaggcaacagtaa

SEQ ID NO: 354654 - DNA, 25 bp, Homo sapien
gatacttgagggaagcagcctgact

SEQ ID NO: 354655 - DNA, 25 bp, Homo sapien
agcagcctgactaccttggttgtaa

SEQ ID NO: 354656 - DNA, 25 bp, Homo sapien
ggattgaagccggatagagatttaa

SEQ ID NO: 354657 - DNA, 25 bp, Homo sapien
gttaatctagcctatatcaagttgg

SEQ ID NO: 354658 - DNA, 25 bp, Homo sapien
aagttggcaaattcacatgctaaga

SEQ ID NO: 354659 - DNA, 25 bp, Homo sapien
gggtgggcagatagtacaattaagt

SEQ ID NO: 354660 - DNA, 25 bp, Homo sapien
gagcggacggcgcgcaccacgaggg

SEQ ID NO: 354661 - DNA, 25 bp, Homo sapien
gcggacggcgcgcaccacgaggggc

SEQ ID NO: 354662 - DNA, 25 bp, Homo sapien
agcggtacggggcacggcgcggacg

SEQ ID NO: 354663 - DNA, 25 bp, Homo sapien
gggctgcgggctccaccgactgagg

SEQ ID NO: 354664 - DNA, 25 bp, Homo sapien
ggctgcgggctccaccgactgaggg

SEQ ID NO: 354665 - DNA, 25 bp, Homo sapien
ctgcgggctccaccgactgaggggc

SEQ ID NO: 354666 - DNA, 25 bp, Homo sapien
gagacgggctgagccgtaccaagct

SEQ ID NO: 354667 - DNA, 25 bp, Homo sapien
agacgggctgagccgtaccaagctc

SEQ ID NO: 354668 - DNA, 25 bp, Homo sapien
acgggctgagccgtaccaagctcgg

SEQ ID NO: 354669 - DNA, 25 bp, Homo sapien
cgggctgagccgtaccaagctcggg

SEQ ID NO: 354670 - DNA, 25 bp, Homo sapien
gggctgagccgtaccaagctcgggg

SEQ ID NO: 354671 - DNA, 25 bp, Homo sapien
tgctcgtctggtgggttttaaggaa

SEQ ID NO: 354672 - DNA, 25 bp, Homo sapien
gggttttaaggaatcggcacatgca

SEQ ID NO: 354673 - DNA, 25 bp, Homo sapien
aggaatcggcacatgcagcatcaag

SEQ ID NO: 354674 - DNA, 25 bp, Homo sapien
acatgcagcatcaagggaggtctct

SEQ ID NO: 354675 - DNA, 25 bp, Homo sapien
gcatcaagggaggtctctgctgcac

SEQ ID NO: 354676 - DNA, 25 bp, Homo sapien
aggcccatagacacttcccactgag

SEQ ID NO: 354677 - DNA, 25 bp, Homo sapien
agacacttcccactgagccacaggg

SEQ ID NO: 354678 - DNA, 25 bp, Homo sapien
gctcaggagcctggatacccaaaaa

SEQ ID NO: 354679 - DNA, 25 bp, Homo sapien
tggatacccaaaaagccacctgcca

SEQ ID NO: 354680 - DNA, 25 bp, Homo sapien
ttcaacaggtcacggaccttccctg

SEQ ID NO: 354681 - DNA, 25 bp, Homo sapien
atatcacactgttgcaaggactaag

SEQ ID NO: 354682 - DNA, 25 bp, Homo sapien
accgggctcggaaaagcggcgcgtg

SEQ ID NO: 354683 - DNA, 25 bp, Homo sapien
cgggctcggaaaagcggcgcgtgtg

SEQ ID NO: 354684 - DNA, 25 bp, Homo sapien
aaaagcggcgcgtgtggggcctgcc

SEQ ID NO: 354685 - DNA, 25 bp, Homo sapien
tgtggggcctgcctccgcagtctgc

SEQ ID NO: 354686 - DNA, 25 bp, Homo sapien
gagatggcccgcggccccgatcacc

SEQ ID NO: 354687 - DNA, 25 bp, Homo sapien
cctgcagcgggcctttcaacggcga

SEQ ID NO: 354688 - DNA, 25 bp, Homo sapien
ctgcagcgggcctttcaacggcgac

SEQ ID NO: 354689 - DNA, 25 bp, Homo sapien
tgcagcgggcctttcaacggcgaca

SEQ ID NO: 354690 - DNA, 25 bp, Homo sapien
gcagcgggcctttcaacggcgacag

SEQ ID NO: 354691 - DNA, 25 bp, Homo sapien
agcgggcctttcaacggcgacaggg

SEQ ID NO: 354692 - DNA, 25 bp, Homo sapien
gcgggcctttcaacggcgacagggc

SEQ ID NO: 354693 - DNA, 25 bp, Homo sapien
gggaacatgctagctgatgccatct

SEQ ID NO: 354694 - DNA, 25 bp, Homo sapien
gctagctgatgccatcttggaccat

SEQ ID NO: 354695 - DNA, 25 bp, Homo sapien
agaagactgagaatggaaacccgca

SEQ ID NO: 354696 - DNA, 25 bp, Homo sapien
atggaaacccgcaatgccctaagaa

SEQ ID NO: 354697 - DNA, 25 bp, Homo sapien
gcaatgccctaagaacagcagagaa

SEQ ID NO: 354698 - DNA, 25 bp, Homo sapien
gtctctgtctagctcctcaagactt

SEQ ID NO: 354699 - DNA, 25 bp, Homo sapien
taatggagaaatacgcccctagctt

SEQ ID NO: 354700 - DNA, 25 bp, Homo sapien
acaataaacactcaatgcctccttc

SEQ ID NO: 354701 - DNA, 25 bp, Homo sapien
taaacactcaatgcctccttctgat

SEQ ID NO: 354702 - DNA, 25 bp, Homo sapien
agccccttaaaaccagaagtcagca

SEQ ID NO: 354703 - DNA, 25 bp, Homo sapien
ctccccttcttgcttcctaaaatgg

SEQ ID NO: 354704 - DNA, 25 bp, Homo sapien
gggtttgaattttaatcagtgcttt

SEQ ID NO: 354705 - DNA, 25 bp, Homo sapien
gaattttaatcagtgcttttgtggg

SEQ ID NO: 354706 - DNA, 25 bp, Homo sapien
gagtgggggtcaactatcttaatga

SEQ ID NO: 354707 - DNA, 25 bp, Homo sapien
tggaaattgggtggtcttaaaaatg

SEQ ID NO: 354708 - DNA, 25 bp, Homo sapien
aactcaatcattactttataactgc

SEQ ID NO: 354709 - DNA, 25 bp, Homo sapien
gaactaaggtgagagacctcatcct

SEQ ID NO: 354710 - DNA, 25 bp, Homo sapien
agagacctcatcctgagaaaggttg

SEQ ID NO: 354711 - DNA, 25 bp, Homo sapien
gacctcatcctgagaaaggttgagt

SEQ ID NO: 354712 - DNA, 25 bp, Homo sapien
ataagtggtggtaatcttgaatact

SEQ ID NO: 354713 - DNA, 25 bp, Homo sapien
ggtaatcttgaatacttttcccatt

SEQ ID NO: 354714 - DNA, 25 bp, Homo sapien
taatcttgaatacttttcccattaa

SEQ ID NO: 354715 - DNA, 25 bp, Homo sapien
tttctatagtcttggagttcatttg

SEQ ID NO: 354716 - DNA, 25 bp, Homo sapien
agtcttggagttcatttgtaaggca

SEQ ID NO: 354717 - DNA, 25 bp, Homo sapien
gtaaggcagtgtcttgacttggaaa

SEQ ID NO: 354718 - DNA, 25 bp, Homo sapien
cagtgtcttgacttggaaaggatgt

SEQ ID NO: 354719 - DNA, 25 bp, Homo sapien
gggtgactttgtagcatggtatgtt

SEQ ID NO: 354720 - DNA, 25 bp, Homo sapien
agcatggtatgttgtcttgagttaa

SEQ ID NO: 354721 - DNA, 25 bp, Homo sapien
ttgtcttgagttaactgtagtgggt

SEQ ID NO: 354722 - DNA, 25 bp, Homo sapien
aatgcccttcatctcctgtgttgtc

SEQ ID NO: 354723 - DNA, 25 bp, Homo sapien
tgtgttgtcctgtaccctgctcagc

SEQ ID NO: 354724 - DNA, 25 bp, Homo sapien
gttcagggaaggcacacttcccagc

SEQ ID NO: 354725 - DNA, 25 bp, Homo sapien
tcccagcccagctgtgttttatgta

SEQ ID NO: 354726 - DNA, 25 bp, Homo sapien
ggaagactcatgcaacttgttttct

SEQ ID NO: 354727 - DNA, 25 bp, Homo sapien
catgcaacttgttttctggcaatga

SEQ ID NO: 354728 - DNA, 25 bp, Homo sapien
gcagcaaattagaaaatgagtccaa

SEQ ID NO: 354729 - DNA, 25 bp, Homo sapien
agtccaaactattgtcattaaacac

SEQ ID NO: 354730 - DNA, 25 bp, Homo sapien
ctgataaaactttatgtcaacctaa

SEQ ID NO: 354731 - DNA, 25 bp, Homo sapien
gtcaacctaatgagcataataatcg

SEQ ID NO: 354732 - DNA, 25 bp, Homo sapien
ataataatcgaattgaagcccagga

SEQ ID NO: 354733 - DNA, 25 bp, Homo sapien
attgaagcccaggaaaattatattc

SEQ ID NO: 354734 - DNA, 25 bp, Homo sapien
attatattccagatcatggtggagg

SEQ ID NO: 354735 - DNA, 25 bp, Homo sapien
ggaggtgaggattcttgtgccaaaa

SEQ ID NO: 354736 - DNA, 25 bp, Homo sapien
gaggattcttgtgccaaaacagaca

SEQ ID NO: 354737 - DNA, 25 bp, Homo sapien
tgaggtgcgccccactctgtacaga

SEQ ID NO: 354738 - DNA, 25 bp, Homo sapien
actctgtacagaggctgtttgggca

SEQ ID NO: 354739 - DNA, 25 bp, Homo sapien
gtttgggcagccttgcctccagaga

SEQ ID NO: 354740 - DNA, 25 bp, Homo sapien
agccttgcctccagagagcagattc

SEQ ID NO: 354741 - DNA, 25 bp, Homo sapien
ggaagcccctggtctaacttgggat

SEQ ID NO: 354742 - DNA, 25 bp, Homo sapien
ccctggtctaacttgggatctggga

SEQ ID NO: 354743 - DNA, 25 bp, Homo sapien
gaatggaaggtgctcccatcggagg

SEQ ID NO: 354744 - DNA, 25 bp, Homo sapien
tgggcctgctgccactgtaagccaa

SEQ ID NO: 354745 - DNA, 25 bp, Homo sapien
tgctgccactgtaagccaaaaggtg

SEQ ID NO: 354746 - DNA, 25 bp, Homo sapien
agcccagaccctcactgggaggtga

SEQ ID NO: 354747 - DNA, 25 bp, Homo sapien
tgggaggtgagctcagctgcccttt

SEQ ID NO: 354748 - DNA, 25 bp, Homo sapien
acctttctgttctgtgacgggctgt

SEQ ID NO: 354749 - DNA, 25 bp, Homo sapien
tctgtgacgggctgtccctgcttgt

SEQ ID NO: 354750 - DNA, 25 bp, Homo sapien
cctgcttgtcctgctttaggaggta

SEQ ID NO: 354751 - DNA, 25 bp, Homo sapien
taggaggtaggtacccagtggctcc

SEQ ID NO: 354752 - DNA, 25 bp, Homo sapien
gctctccccacgttggtctgtgtga

SEQ ID NO: 354753 - DNA, 25 bp, Homo sapien
ttggtctgtgtgagctccgctgtgt

SEQ ID NO: 354754 - DNA, 25 bp, Homo sapien
gtgagctccgctgtgtggctgccat

SEQ ID NO: 354755 - DNA, 25 bp, Homo sapien
tgtggctgccattcatccgatccat

SEQ ID NO: 354756 - DNA, 25 bp, Homo sapien
attcatccgatccatctgtggactt

SEQ ID NO: 354757 - DNA, 25 bp, Homo sapien
atccgatccatctgtggacttgctg

SEQ ID NO: 354758 - DNA, 25 bp, Homo sapien
ccgtgcacggtgtggtgaatgctac

SEQ ID NO: 354759 - DNA, 25 bp, Homo sapien
gtgaggaattcattccaggaaccat

SEQ ID NO: 354760 - DNA, 25 bp, Homo sapien
ggaattcattccaggaaccattccc

SEQ ID NO: 354761 - DNA, 25 bp, Homo sapien
taaaaaatccatatactcggccggg

SEQ ID NO: 354762 - DNA, 25 bp, Homo sapien
aaaatccatatactcggccgggcgt

SEQ ID NO: 354763 - DNA, 25 bp, Homo sapien
aatccatatactcggccgggcgtgg

SEQ ID NO: 354764 - DNA, 25 bp, Homo sapien
ccgaagtgggagatcatctgcggtc

SEQ ID NO: 354765 - DNA, 25 bp, Homo sapien
agatcatctgcggtcgagagtttga

SEQ ID NO: 354766 - DNA, 25 bp, Homo sapien
gatcatctgcggtcgagagtttgag

SEQ ID NO: 354767 - DNA, 25 bp, Homo sapien
agcttgaccaacgtggggaggcctc

SEQ ID NO: 354768 - DNA, 25 bp, Homo sapien
gggaggcctcgtttctactgaaaat

SEQ ID NO: 354769 - DNA, 25 bp, Homo sapien
gaggcctcgtttctactgaaaatac

SEQ ID NO: 354770 - DNA, 25 bp, Homo sapien
actgcctctgtggagttgaagacta

SEQ ID NO: 354771 - DNA, 25 bp, Homo sapien
gcctctgtggagttgaagactaaat

SEQ ID NO: 354772 - DNA, 25 bp, Homo sapien
ttttcagccataaatgagcatgcta

SEQ ID NO: 354773 - DNA, 25 bp, Homo sapien
gagcatgctaacaaagatcttggaa

SEQ ID NO: 354774 - DNA, 25 bp, Homo sapien
ttgtgatcttgaaccttaggttcat

SEQ ID NO: 354775 - DNA, 25 bp, Homo sapien
gctttacatgcattctcattgaggc

SEQ ID NO: 354776 - DNA, 25 bp, Homo sapien
cattgaggcatatgagattcttaaa

SEQ ID NO: 354777 - DNA, 25 bp, Homo sapien
ttttgttcttgttcctgcctcaaat

SEQ ID NO: 354778 - DNA, 25 bp, Homo sapien
tgcctcaaatccaccaatgactttt

SEQ ID NO: 354779 - DNA, 25 bp, Homo sapien
cctcaaatccaccaatgacttttca

SEQ ID NO: 354780 - DNA, 25 bp, Homo sapien
atgacttttcattgacgttagaatg

SEQ ID NO: 354781 - DNA, 25 bp, Homo sapien
actaaaatgcaatcttcgcctgtgg

SEQ ID NO: 354782 - DNA, 25 bp, Homo sapien
ccttcttacaagagctttttatggg

SEQ ID NO: 354783 - DNA, 25 bp, Homo sapien
gttgtatgtatatcctttagcctat

SEQ ID NO: 354784 - DNA, 25 bp, Homo sapien
gtatatcctttagcctatcttgaac

SEQ ID NO: 354785 - DNA, 25 bp, Homo sapien
ctttagcctatcttgaactattctg

SEQ ID NO: 354786 - DNA, 25 bp, Homo sapien
gaactattctgtagcttctaaacac

SEQ ID NO: 354787 - DNA, 25 bp, Homo sapien
tattctgtagcttctaaacaccttc

SEQ ID NO: 354788 - DNA, 25 bp, Homo sapien
aaacaccttccttgataaagagtat

SEQ ID NO: 354789 - DNA, 25 bp, Homo sapien
tatctgattttcttgtgtcttttga

SEQ ID NO: 354790 - DNA, 25 bp, Homo sapien
atggtcaatggacttctgaattctg

SEQ ID NO: 354791 - DNA, 25 bp, Homo sapien
ggacttctgaattctggtgcagagt

SEQ ID NO: 354792 - DNA, 25 bp, Homo sapien
aggccttgcagggtgctttcaatgg

SEQ ID NO: 354793 - DNA, 25 bp, Homo sapien
tgcagggtgctttcaatgggcaaga

SEQ ID NO: 354794 - DNA, 25 bp, Homo sapien
caatgggcaagaggacacgatgaca

SEQ ID NO: 354795 - DNA, 25 bp, Homo sapien
agaggacacgatgacaggtgccgac

SEQ ID NO: 354796 - DNA, 25 bp, Homo sapien
acgatgacaggtgccgacgaggtat

SEQ ID NO: 354797 - DNA, 25 bp, Homo sapien
gacaggtgccgacgaggtattcctc

SEQ ID NO: 354798 - DNA, 25 bp, Homo sapien
ggtgccgacgaggtattcctctcca

SEQ ID NO: 354799 - DNA, 25 bp, Homo sapien
ggtattcctctccacttcctgggaa

SEQ ID NO: 354800 - DNA, 25 bp, Homo sapien
gaaagagggcaagcctgtaacaggt

SEQ ID NO: 354801 - DNA, 25 bp, Homo sapien
gcaagcctgtaacaggtgcagtcat

SEQ ID NO: 354802 - DNA, 25 bp, Homo sapien
ggatgaaaacaatcagagccccttt

SEQ ID NO: 354803 - DNA, 25 bp, Homo sapien
aggcccagcaggaggcgctaccaca

SEQ ID NO: 354804 - DNA, 25 bp, Homo sapien
aggaggcgctaccacaggctctgac

SEQ ID NO: 354805 - DNA, 25 bp, Homo sapien
acaggctctgactggcgtccctact

SEQ ID NO: 354806 - DNA, 25 bp, Homo sapien
cttcgggtctacagtcggaatatat

SEQ ID NO: 354807 - DNA, 25 bp, Homo sapien
gtcggaatatatcattctccccatt

SEQ ID NO: 354808 - DNA, 25 bp, Homo sapien
attctccccattttaacctgagctg

SEQ ID NO: 354809 - DNA, 25 bp, Homo sapien
ttaacctgagctgcctgacacacgg

SEQ ID NO: 354810 - DNA, 25 bp, Homo sapien
ctgagctgcctgacacacggagggt

SEQ ID NO: 354811 - DNA, 25 bp, Homo sapien
gagccagggttgaatcatggatcct

SEQ ID NO: 354812 - DNA, 25 bp, Homo sapien
acacaggaagggttgtcacctctct

SEQ ID NO: 354813 - DNA, 25 bp, Homo sapien
aagggttgtcacctctctgtggagc

SEQ ID NO: 354814 - DNA, 25 bp, Homo sapien
ggtttgagaactttctccctgttct

SEQ ID NO: 354815 - DNA, 25 bp, Homo sapien
tccttgctcagcaggcctgtgatta

SEQ ID NO: 354816 - DNA, 25 bp, Homo sapien
aatcatctgttccagtttcccagaa

SEQ ID NO: 354817 - DNA, 25 bp, Homo sapien
caggcctgtgattattacattcttt

SEQ ID NO: 354818 - DNA, 25 bp, Homo sapien
ttgttgcaactcctgctggtctcat

SEQ ID NO: 354819 - DNA, 25 bp, Homo sapien
tcctgctggtctcattagtcttttt

SEQ ID NO: 354820 - DNA, 25 bp, Homo sapien
ttagtcttttttcagggcagtggga

SEQ ID NO: 354821 - DNA, 25 bp, Homo sapien
gaagaacccatcaggctgcgacatt

SEQ ID NO: 354822 - DNA, 25 bp, Homo sapien
ggctgcgacattgttccattaaact

SEQ ID NO: 354823 - DNA, 25 bp, Homo sapien
aacttgatactagatttttgacata

SEQ ID NO: 354824 - DNA, 25 bp, Homo sapien
cccagaaccctgctgggaaagtact

SEQ ID NO: 354825 - DNA, 25 bp, Homo sapien
cacaggctgtttgcttgattcttaa

SEQ ID NO: 354826 - DNA, 25 bp, Homo sapien
ggctgtttgcttgattcttaagaac

SEQ ID NO: 354827 - DNA, 25 bp, Homo sapien
gaacgtatagggatccagctgtaca

SEQ ID NO: 354828 - DNA, 25 bp, Homo sapien
gggatccagctgtacagagctttct

SEQ ID NO: 354829 - DNA, 25 bp, Homo sapien
acagagctttctgcagtcttttgta

SEQ ID NO: 354830 - DNA, 25 bp, Homo sapien
agctttctgcagtcttttgtaatag

SEQ ID NO: 354831 - DNA, 25 bp, Homo sapien
aattgtacttattacatgagcatca

SEQ ID NO: 354832 - DNA, 25 bp, Homo sapien
acatgagcatcaaagaccttggaat

SEQ ID NO: 354833 - DNA, 25 bp, Homo sapien
aagaccttggaataaagctattcct

SEQ ID NO: 354834 - DNA, 25 bp, Homo sapien
gaccccatttctatagacagataaa

SEQ ID NO: 354835 - DNA, 25 bp, Homo sapien
atagacagataaaatcaccatgcct

SEQ ID NO: 354836 - DNA, 25 bp, Homo sapien
aaactgctttgctgatttgatctgg

SEQ ID NO: 354837 - DNA, 25 bp, Homo sapien
ccaacatcctgtgatagcggctgat

SEQ ID NO: 354838 - DNA, 25 bp, Homo sapien
gatagcggctgattgttgatgcctg

SEQ ID NO: 354839 - DNA, 25 bp, Homo sapien
ttgatgcctgggaggatacagcagt

SEQ ID NO: 354840 - DNA, 25 bp, Homo sapien
gatacagcagtgacgatccaaattt

SEQ ID NO: 354841 - DNA, 25 bp, Homo sapien
gacgatccaaatttacaagactcaa

SEQ ID NO: 354842 - DNA, 25 bp, Homo sapien
caagactcaacatggttttcaaaac

SEQ ID NO: 354843 - DNA, 25 bp, Homo sapien
gatgttcctgagttctggaatctga

SEQ ID NO: 354844 - DNA, 25 bp, Homo sapien
tgtcagctgtgaccctcgaaggaaa

SEQ ID NO: 354845 - DNA, 25 bp, Homo sapien
ggaaagggatcaccctctttctgac

SEQ ID NO: 354846 - DNA, 25 bp, Homo sapien
ccctataccaccttcagcagggatg

SEQ ID NO: 354847 - DNA, 25 bp, Homo sapien
gaactgagtggttaggcaagcgcca

SEQ ID NO: 354848 - DNA, 25 bp, Homo sapien
gcgccagaaatttagcatgcacaca

SEQ ID NO: 354849 - DNA, 25 bp, Homo sapien
ttagcatgcacacaataaaccttag

SEQ ID NO: 354850 - DNA, 25 bp, Homo sapien
gttaaacattgtacagggccataaa

SEQ ID NO: 354851 - DNA, 25 bp, Homo sapien
actggactaattaaactctttggca

SEQ ID NO: 354852 - DNA, 25 bp, Homo sapien
ggcaatgtagaaactggagcccaca

SEQ ID NO: 354853 - DNA, 25 bp, Homo sapien
gagcccacagatcagaatcccttga

SEQ ID NO: 354854 - DNA, 25 bp, Homo sapien
agaatcccttgattcctaccctatg

SEQ ID NO: 354855 - DNA, 25 bp, Homo sapien
ttgattcctaccctatgtcactgct

SEQ ID NO: 354856 - DNA, 25 bp, Homo sapien
aacagtacctatctcatggttatca

SEQ ID NO: 354857 - DNA, 25 bp, Homo sapien
catggttatcatgaagcttaaacga

SEQ ID NO: 354858 - DNA, 25 bp, Homo sapien
ataaccaggtattagatctattact

SEQ ID NO: 354859 - DNA, 25 bp, Homo sapien
ggtattagatctattactttatcat

SEQ ID NO: 354860 - DNA, 25 bp, Homo sapien
atcatttttctatctgctaatacat

SEQ ID NO: 354861 - DNA, 25 bp, Homo sapien
gctaatacatagttgcttgctttat

SEQ ID NO: 354862 - DNA, 25 bp, Homo sapien
gaacagctacccaagtcaaaagtcc

SEQ ID NO: 354863 - DNA, 25 bp, Homo sapien
agctacccaagtcaaaagtccacct

SEQ ID NO: 354864 - DNA, 25 bp, Homo sapien
tacccaagtcaaaagtccacctcat

SEQ ID NO: 354865 - DNA, 25 bp, Homo sapien
caagtcaaaagtccacctcatgtcc

SEQ ID NO: 354866 - DNA, 25 bp, Homo sapien
gtcaaaagtccacctcatgtccctg

SEQ ID NO: 354867 - DNA, 25 bp, Homo sapien
ttttattctgctttaaatcagccag

SEQ ID NO: 354868 - DNA, 25 bp, Homo sapien
aatcagccagaagtttatctattta

SEQ ID NO: 354869 - DNA, 25 bp, Homo sapien
gcttgatttttcttacaagctaaga

SEQ ID NO: 354870 - DNA, 25 bp, Homo sapien
atttttcttacaagctaagaggagt

SEQ ID NO: 354871 - DNA, 25 bp, Homo sapien
cttacaagctaagaggagtgaggca

SEQ ID NO: 354872 - DNA, 25 bp, Homo sapien
acatctagagatcctggccaacgcg

SEQ ID NO: 354873 - DNA, 25 bp, Homo sapien
tctagagatcctggccaacgcggtg

SEQ ID NO: 354874 - DNA, 25 bp, Homo sapien
gaggttgtactgagctgagaccttg

SEQ ID NO: 354875 - DNA, 25 bp, Homo sapien
aggttgtactgagctgagaccttgc

SEQ ID NO: 354876 - DNA, 25 bp, Homo sapien
ggttgtactgagctgagaccttgcc

SEQ ID NO: 354877 - DNA, 25 bp, Homo sapien
gttgtactgagctgagaccttgcca

SEQ ID NO: 354878 - DNA, 25 bp, Homo sapien
ttgtactgagctgagaccttgccac

SEQ ID NO: 354879 - DNA, 25 bp, Homo sapien
tgtactgagctgagaccttgccact

SEQ ID NO: 354880 - DNA, 25 bp, Homo sapien
ggcagtcattccaccaagtgttgga

SEQ ID NO: 354881 - DNA, 25 bp, Homo sapien
ttggaaactggttagcctggagaca

SEQ ID NO: 354882 - DNA, 25 bp, Homo sapien
gggccacagctcagggatgtgtatt

SEQ ID NO: 354883 - DNA, 25 bp, Homo sapien
tctctaggctgccacagcaacattt

SEQ ID NO: 354884 - DNA, 25 bp, Homo sapien
ttgggagccatacctgaactgtttc

SEQ ID NO: 354885 - DNA, 25 bp, Homo sapien
tgaactgtttcctccaaggcgggaa

SEQ ID NO: 354886 - DNA, 25 bp, Homo sapien
ggcgggaactccagagagcctgcca

SEQ ID NO: 354887 - DNA, 25 bp, Homo sapien
gagcctgccaagtctggagcaagct

SEQ ID NO: 354888 - DNA, 25 bp, Homo sapien
accatgagacttgaaggcttctagc

SEQ ID NO: 354889 - DNA, 25 bp, Homo sapien
ggcttctagctgtcctacgacacga

SEQ ID NO: 354890 - DNA, 25 bp, Homo sapien
tgtcctacgacacgagccacggtgg

SEQ ID NO: 354891 - DNA, 25 bp, Homo sapien
gaagcggtgaacatccaacactgaa

SEQ ID NO: 354892 - DNA, 25 bp, Homo sapien
aacactgaaatttgagctggctctt

SEQ ID NO: 354893 - DNA, 25 bp, Homo sapien
ttcctcagaaaggtttcagcggctt

SEQ ID NO: 354894 - DNA, 25 bp, Homo sapien
cagcggcttaatctcatgcaatctt

SEQ ID NO: 354895 - DNA, 25 bp, Homo sapien
atgcaatcttgcaacattcctgaat

SEQ ID NO: 354896 - DNA, 25 bp, Homo sapien
aacattcctgaattcaaacccatga

SEQ ID NO: 354897 - DNA, 25 bp, Homo sapien
aagtagagagtcagcccgagaccct

SEQ ID NO: 354898 - DNA, 25 bp, Homo sapien
agaatccaccgagtctgctgggcag

SEQ ID NO: 354899 - DNA, 25 bp, Homo sapien
agcttgttgagttgtcctgctgcaa

SEQ ID NO: 354900 - DNA, 25 bp, Homo sapien
gaaacctattacttgatttactggg

SEQ ID NO: 354901 - DNA, 25 bp, Homo sapien
tactgggagtggtagaaccctaaag

SEQ ID NO: 354902 - DNA, 25 bp, Homo sapien
cagccgaccttaaagtagggagatg

SEQ ID NO: 354903 - DNA, 25 bp, Homo sapien
ggagatgatcctgaatgagacaaaa

SEQ ID NO: 354904 - DNA, 25 bp, Homo sapien
aagagagaaccagtcatggtgtcat

SEQ ID NO: 354905 - DNA, 25 bp, Homo sapien
gaaccagtcatggtgtcatgagaag

SEQ ID NO: 354906 - DNA, 25 bp, Homo sapien
ggactcaaaatgcaactgctgactt

SEQ ID NO: 354907 - DNA, 25 bp, Homo sapien
caaaatgcaactgctgactttgaag

SEQ ID NO: 354908 - DNA, 25 bp, Homo sapien
caaggaacgtggtagtctctggaaa

SEQ ID NO: 354909 - DNA, 25 bp, Homo sapien
agccctgtcaacaccctaattttag

SEQ ID NO: 354910 - DNA, 25 bp, Homo sapien
gtcaacaccctaattttagcccagt

SEQ ID NO: 354911 - DNA, 25 bp, Homo sapien
agtgaggcctgtgctggacttctga

SEQ ID NO: 354912 - DNA, 25 bp, Homo sapien
tgaggcctgtgctggacttctgacc

SEQ ID NO: 354913 - DNA, 25 bp, Homo sapien
gctccagggcatagggagcaccact

SEQ ID NO: 354914 - DNA, 25 bp, Homo sapien
ggcatagggagcaccactcccacag

SEQ ID NO: 354915 - DNA, 25 bp, Homo sapien
acctttaagggctctagtggcacac

SEQ ID NO: 354916 - DNA, 25 bp, Homo sapien
tttaagggctctagtggcacacaca

SEQ ID NO: 354917 - DNA, 25 bp, Homo sapien
taagggctctagtggcacacacatc

SEQ ID NO: 354918 - DNA, 25 bp, Homo sapien
agtggcacacacatccacgagccta

SEQ ID NO: 354919 - DNA, 25 bp, Homo sapien
gtttttgtctgtgttgccatcccag

SEQ ID NO: 354920 - DNA, 25 bp, Homo sapien
ttttgtctgtgttgccatcccaggt

SEQ ID NO: 354921 - DNA, 25 bp, Homo sapien
tgtctgtgttgccatcccaggtctg

SEQ ID NO: 354922 - DNA, 25 bp, Homo sapien
ttgccatcccaggtctgccataggg

SEQ ID NO: 354923 - DNA, 25 bp, Homo sapien
gtgtctggggattccttcccaccta

SEQ ID NO: 354924 - DNA, 25 bp, Homo sapien
gagaaacctgggaagtgtctgtaca

SEQ ID NO: 354925 - DNA, 25 bp, Homo sapien
atttgcccaaatgtggtgttggtca

SEQ ID NO: 354926 - DNA, 25 bp, Homo sapien
gtggtgttggtcacattcatgtaaa

SEQ ID NO: 354927 - DNA, 25 bp, Homo sapien
aaagttttcactcttggttgcctgg

SEQ ID NO: 354928 - DNA, 25 bp, Homo sapien
ttgcctggtggctcagagcattgtt

SEQ ID NO: 354929 - DNA, 25 bp, Homo sapien
agcattgtttttccctaacccagca

SEQ ID NO: 354930 - DNA, 25 bp, Homo sapien
taacccagcaggaccaaaaggtgct

SEQ ID NO: 354931 - DNA, 25 bp, Homo sapien
aaggtgctgcttcttttgcagatcc

SEQ ID NO: 354932 - DNA, 25 bp, Homo sapien
ttttgcagatcctgtaaccaccacc

SEQ ID NO: 354933 - DNA, 25 bp, Homo sapien
acctgtgacaggtggctgccttctg

SEQ ID NO: 354934 - DNA, 25 bp, Homo sapien
tgccttctgcaaggtcctatgactc

SEQ ID NO: 354935 - DNA, 25 bp, Homo sapien
tggactcagtcagggcgatacaggc

SEQ ID NO: 354936 - DNA, 25 bp, Homo sapien
gatacaggcagctggcccttgggtt

SEQ ID NO: 354937 - DNA, 25 bp, Homo sapien
aggacctgacccaggaagccctgtt

SEQ ID NO: 354938 - DNA, 25 bp, Homo sapien
gtttacacccaggtgttctgccatg

SEQ ID NO: 354939 - DNA, 25 bp, Homo sapien
atgctctgcacatcatggccatgct

SEQ ID NO: 354940 - DNA, 25 bp, Homo sapien
atgctccacccggaggtctgtgagc

SEQ ID NO: 354941 - DNA, 25 bp, Homo sapien
tgtgagccactctacgttttagcct

SEQ ID NO: 354942 - DNA, 25 bp, Homo sapien
ttttagccttggaaaccctcacctg

SEQ ID NO: 354943 - DNA, 25 bp, Homo sapien
accctcacctgctatgagactttga

SEQ ID NO: 354944 - DNA, 25 bp, Homo sapien
agctccttgctccagagggcacacg

SEQ ID NO: 354945 - DNA, 25 bp, Homo sapien
tcttaaagtccattgctgagggcat

SEQ ID NO: 354946 - DNA, 25 bp, Homo sapien
tttggtaaaatctagatcctatcta

SEQ ID NO: 354947 - DNA, 25 bp, Homo sapien
aaacattctgtggatatttgtgaat

SEQ ID NO: 354948 - DNA, 25 bp, Homo sapien
aataaggtagttgctatggtccgaa

SEQ ID NO: 354949 - DNA, 25 bp, Homo sapien
tgctatggtccgaatatctgggcct

SEQ ID NO: 354950 - DNA, 25 bp, Homo sapien
atggtccgaatatctgggcctgccc

SEQ ID NO: 354951 - DNA, 25 bp, Homo sapien
caaattatgctgaaacctaatcacc

SEQ ID NO: 354952 - DNA, 25 bp, Homo sapien
acctaatcaccagtgtgatggtaat

SEQ ID NO: 354953 - DNA, 25 bp, Homo sapien
aggtgggactgagctctgatgaatg

SEQ ID NO: 354954 - DNA, 25 bp, Homo sapien
aatgttaggcagtatggaatgttct

SEQ ID NO: 354955 - DNA, 25 bp, Homo sapien
ggaatgttcttatttagcttatcat

SEQ ID NO: 354956 - DNA, 25 bp, Homo sapien
taatctactttgtaaaacatgctga

SEQ ID NO: 354957 - DNA, 25 bp, Homo sapien
aattcagatagtagcttttggctga

SEQ ID NO: 354958 - DNA, 25 bp, Homo sapien
gcttttggctgagaaaaggaatcca

SEQ ID NO: 354959 - DNA, 25 bp, Homo sapien
atttagatctcaaaaccactatttt

SEQ ID NO: 354960 - DNA, 25 bp, Homo sapien
gatctcaaaaccactatttttatta

SEQ ID NO: 354961 - DNA, 25 bp, Homo sapien
ttcattatttttcagaggccttaaa

SEQ ID NO: 354962 - DNA, 25 bp, Homo sapien
tttttcagaggccttaaaattctgg

SEQ ID NO: 354963 - DNA, 25 bp, Homo sapien
ggaggaaaatactcagagtacttga

SEQ ID NO: 354964 - DNA, 25 bp, Homo sapien
gccttagttaagagtagtgtagaaa

SEQ ID NO: 354965 - DNA, 25 bp, Homo sapien
gtgtagaaatgcatgaacttcatcc

SEQ ID NO: 354966 - DNA, 25 bp, Homo sapien
tgcatgaacttcatcctaataagga

SEQ ID NO: 354967 - DNA, 25 bp, Homo sapien
aataaaccatgaaggtgtacacatc

SEQ ID NO: 354968 - DNA, 25 bp, Homo sapien
aaggaggtaaccagggcattcagga

SEQ ID NO: 354969 - DNA, 25 bp, Homo sapien
ggtaaccagggcattcaggagattg

SEQ ID NO: 354970 - DNA, 25 bp, Homo sapien
aaccagggcattcaggagattgctg

SEQ ID NO: 354971 - DNA, 25 bp, Homo sapien
ctcacacaaagctgagggagagctg

SEQ ID NO: 354972 - DNA, 25 bp, Homo sapien
gggagagctgcttaatgtgctttaa

SEQ ID NO: 354973 - DNA, 25 bp, Homo sapien
gagagctgcttaatgtgctttaaaa

SEQ ID NO: 354974 - DNA, 25 bp, Homo sapien
gagaggagattctatgtgcttttat

SEQ ID NO: 354975 - DNA, 25 bp, Homo sapien
ggagattctatgtgcttttatcaga

SEQ ID NO: 354976 - DNA, 25 bp, Homo sapien
gattctatgtgcttttatcagaaag

SEQ ID NO: 354977 - DNA, 25 bp, Homo sapien
ttcttcacacccattacattgtggg

SEQ ID NO: 354978 - DNA, 25 bp, Homo sapien
acacccattacattgtgggaatgga

SEQ ID NO: 354979 - DNA, 25 bp, Homo sapien
ctggcaggccaggagcgcgagcgga

SEQ ID NO: 354980 - DNA, 25 bp, Homo sapien
tggcaggccaggagcgcgagcggac

SEQ ID NO: 354981 - DNA, 25 bp, Homo sapien
ggcaggccaggagcgcgagcggacg

SEQ ID NO: 354982 - DNA, 25 bp, Homo sapien
gccaggagcgcgagcggacggcgcg

SEQ ID NO: 354983 - DNA, 25 bp, Homo sapien
gagcggacggcgcgcaccacgaggg

SEQ ID NO: 354984 - DNA, 25 bp, Homo sapien
gggctgcgggctccaccgactgagg

SEQ ID NO: 354985 - DNA, 25 bp, Homo sapien
ggctgcgggctccaccgactgaggg

SEQ ID NO: 354986 - DNA, 25 bp, Homo sapien
gagacgggctgagccgtaccaagct

SEQ ID NO: 354987 - DNA, 25 bp, Homo sapien
agacgggctgagccgtaccaagctc

SEQ ID NO: 354988 - DNA, 25 bp, Homo sapien
acgggctgagccgtaccaagctcgg

SEQ ID NO: 354989 - DNA, 25 bp, Homo sapien
cgggctgagccgtaccaagctcggg

SEQ ID NO: 354990 - DNA, 25 bp, Homo sapien
caatgtccaaagtgtgaaaagtgtt

SEQ ID NO: 354991 - DNA, 25 bp, Homo sapien
aaaagtgttttgaatcagagcagat

SEQ ID NO: 354992 - DNA, 25 bp, Homo sapien
caatgaacacagctgttttgctgct

SEQ ID NO: 354993 - DNA, 25 bp, Homo sapien
agtggcaaaattccaagcaggttca

SEQ ID NO: 354994 - DNA, 25 bp, Homo sapien
aattccaagcaggttcaaaagaagc

SEQ ID NO: 354995 - DNA, 25 bp, Homo sapien
aaaatcttggccaagcttaagcgtg

SEQ ID NO: 354996 - DNA, 25 bp, Homo sapien
caagcttaagcgtgctaggagtaaa

SEQ ID NO: 354997 - DNA, 25 bp, Homo sapien
gtttcttgagaaattgtgatcttat

SEQ ID NO: 354998 - DNA, 25 bp, Homo sapien
tgatcttatttctggtgagcagagc

SEQ ID NO: 354999 - DNA, 25 bp, Homo sapien
gaacaaacccagagaacatttgtgg

SEQ ID NO: 355000 - DNA, 25 bp, Homo sapien
gtgggttctcttggcaaacatggaa

SEQ ID NO: 355001 - DNA, 25 bp, Homo sapien
tcatttaactgtactctgcacaata

SEQ ID NO: 355002 - DNA, 25 bp, Homo sapien
tactctgcacaatagctaggatgac

SEQ ID NO: 355003 - DNA, 25 bp, Homo sapien
gactaagagaacattgcttcaagaa

SEQ ID NO: 355004 - DNA, 25 bp, Homo sapien
gaacattgcttcaagaaactggtgg

SEQ ID NO: 355005 - DNA, 25 bp, Homo sapien
gaaactggtggatttggatttccaa

SEQ ID NO: 355006 - DNA, 25 bp, Homo sapien
aagatccatgttgaacatttgcaaa

SEQ ID NO: 355007 - DNA, 25 bp, Homo sapien
aaacagatgtggtgataaacccaaa

SEQ ID NO: 355008 - DNA, 25 bp, Homo sapien
ttattttccactaaacacagacaca

SEQ ID NO: 355009 - DNA, 25 bp, Homo sapien
gaaagtttagctagcccactatttg

SEQ ID NO: 355010 - DNA, 25 bp, Homo sapien
gtttagctagcccactatttgttgt

SEQ ID NO: 355011 - DNA, 25 bp, Homo sapien
gctagcccactatttgttgtaaatt

SEQ ID NO: 355012 - DNA, 25 bp, Homo sapien
gcaataggcaaacagtcttccacat

SEQ ID NO: 355013 - DNA, 25 bp, Homo sapien
caaacagtcttccacatatcacagt

SEQ ID NO: 355014 - DNA, 25 bp, Homo sapien
attcagcttaaaggaaggcatcatc

SEQ ID NO: 355015 - DNA, 25 bp, Homo sapien
gaaagcccatcctttagtcctaaga

SEQ ID NO: 355016 - DNA, 25 bp, Homo sapien
aaaacatccatgctccactgcattc

SEQ ID NO: 355017 - DNA, 25 bp, Homo sapien
tgctccactgcattctgaaaggatg

SEQ ID NO: 355018 - DNA, 25 bp, Homo sapien
ttttatttcacaaatggaaccccat

SEQ ID NO: 355019 - DNA, 25 bp, Homo sapien
agtcctaagagaggctctgaccaac

SEQ ID NO: 355020 - DNA, 25 bp, Homo sapien
gctctgaccaacaccttgcaggaaa

SEQ ID NO: 355021 - DNA, 25 bp, Homo sapien
agggagaattctgcttccttcatag

SEQ ID NO: 355022 - DNA, 25 bp, Homo sapien
tgcttccttcatagcctgcaatagg

SEQ ID NO: 355023 - DNA, 25 bp, Homo sapien
gataaatctgaatccctccatttta

SEQ ID NO: 355024 - DNA, 25 bp, Homo sapien
gaatccctccattttatttgggtgg

SEQ ID NO: 355025 - DNA, 25 bp, Homo sapien
ttttatttgggtggaaccatgacca

SEQ ID NO: 355026 - DNA, 25 bp, Homo sapien
aaggccagaaagagactttgccaga

SEQ ID NO: 355027 - DNA, 25 bp, Homo sapien
tgggtgtctatctttggcatgtttc

SEQ ID NO: 355028 - DNA, 25 bp, Homo sapien
ttgccagagagttcacggagttttc

SEQ ID NO: 355029 - DNA, 25 bp, Homo sapien
ttcacggagttttcttaccccgcat

SEQ ID NO: 355030 - DNA, 25 bp, Homo sapien
ttaccccgcatgctgactaaagaaa

SEQ ID NO: 355031 - DNA, 25 bp, Homo sapien
tgggcttttctgaaaccagcttcaa

SEQ ID NO: 355032 - DNA, 25 bp, Homo sapien
ggcatgtttcctgttatgtgagcat

SEQ ID NO: 355033 - DNA, 25 bp, Homo sapien
tggtgggacttaggcatttgcagac

SEQ ID NO: 355034 - DNA, 25 bp, Homo sapien
agatgcctacgcgtgcggcaaggac

SEQ ID NO: 355035 - DNA, 25 bp, Homo sapien
gactggagggaagcgtaggaacaca

SEQ ID NO: 355036 - DNA, 25 bp, Homo sapien
gagggtctgagaaacgcacagccca

SEQ ID NO: 355037 - DNA, 25 bp, Homo sapien
ggctctgcaggcttcactgggccac

SEQ ID NO: 355038 - DNA, 25 bp, Homo sapien
tgcaggcttcactgggccacggcca

SEQ ID NO: 355039 - DNA, 25 bp, Homo sapien
tgagaaacgcacagcccacatgggc

SEQ ID NO: 355040 - DNA, 25 bp, Homo sapien
cacagcccacatgggccttgaagga

SEQ ID NO: 355041 - DNA, 25 bp, Homo sapien
gggccttgaaggatgcggcctcacc

SEQ ID NO: 355042 - DNA, 25 bp, Homo sapien
gaaggatgcggcctcacccagagac

SEQ ID NO: 355043 - DNA, 25 bp, Homo sapien
tgcggcctcacccagagacaggagt

SEQ ID NO: 355044 - DNA, 25 bp, Homo sapien
ggcctcacccagagacaggagtcct

SEQ ID NO: 355045 - DNA, 25 bp, Homo sapien
cagggtcgtcccagattgtgaatcg

SEQ ID NO: 355046 - DNA, 25 bp, Homo sapien
gaatcgagaggtccaagccatcgtc

SEQ ID NO: 355047 - DNA, 25 bp, Homo sapien
gagctggtgactaacctgatgcaca

SEQ ID NO: 355048 - DNA, 25 bp, Homo sapien
tgcacacaagtgctgaagcctcctt

SEQ ID NO: 355049 - DNA, 25 bp, Homo sapien
ttacaccagcctttcttctcgtaga

SEQ ID NO: 355050 - DNA, 25 bp, Homo sapien
cttctcgtagagactgcccgtgggc

SEQ ID NO: 355051 - DNA, 25 bp, Homo sapien
ggtactggcatctcacggttagcgt

SEQ ID NO: 355052 - DNA, 25 bp, Homo sapien
cctgccacactttgaagtacctgag

SEQ ID NO: 355053 - DNA, 25 bp, Homo sapien
agtacctgagccttggattgtgcct

SEQ ID NO: 355054 - DNA, 25 bp, Homo sapien
agccttggattgtgcctgagagcct

SEQ ID NO: 355055 - DNA, 25 bp, Homo sapien
aggccatgtggtccttttcctgtgc

SEQ ID NO: 355056 - DNA, 25 bp, Homo sapien
ggagaggtccataggagtagccaat

SEQ ID NO: 355057 - DNA, 25 bp, Homo sapien
ggtccataggagtagccaataaatt

SEQ ID NO: 355058 - DNA, 25 bp, Homo sapien
gaatatttggacaattgcctctctc

SEQ ID NO: 355059 - DNA, 25 bp, Homo sapien
atatttggacaattgcctctctcta

SEQ ID NO: 355060 - DNA, 25 bp, Homo sapien
atttggacaattgcctctctctaag

SEQ ID NO: 355061 - DNA, 25 bp, Homo sapien
ttggacaattgcctctctctaagtg

SEQ ID NO: 355062 - DNA, 25 bp, Homo sapien
ggacaattgcctctctctaagtgct

SEQ ID NO: 355063 - DNA, 25 bp, Homo sapien
aattgcctctctctaagtgctctag

SEQ ID NO: 355064 - DNA, 25 bp, Homo sapien
tgcctctctctaagtgctctagaag

SEQ ID NO: 355065 - DNA, 25 bp, Homo sapien
ctctctctaagtgctctagaagctt

SEQ ID NO: 355066 - DNA, 25 bp, Homo sapien
ctctaagtgctctagaagcttctag

SEQ ID NO: 355067 - DNA, 25 bp, Homo sapien
atttttcttacaagctaagaggagt

SEQ ID NO: 355068 - DNA, 25 bp, Homo sapien
tttttcttacaagctaagaggagtg

SEQ ID NO: 355069 - DNA, 25 bp, Homo sapien
ttttcttacaagctaagaggagtga

SEQ ID NO: 355070 - DNA, 25 bp, Homo sapien
tttcttacaagctaagaggagtgag

SEQ ID NO: 355071 - DNA, 25 bp, Homo sapien
cttacaagctaagaggagtgaggca

SEQ ID NO: 355072 - DNA, 25 bp, Homo sapien
gaggttgtactgagctgagaccttg

SEQ ID NO: 355073 - DNA, 25 bp, Homo sapien
aggttgtactgagctgagaccttgc

SEQ ID NO: 355074 - DNA, 25 bp, Homo sapien
ggttgtactgagctgagaccttgcc

SEQ ID NO: 355075 - DNA, 25 bp, Homo sapien
gttgtactgagctgagaccttgcca

SEQ ID NO: 355076 - DNA, 25 bp, Homo sapien
ttgtactgagctgagaccttgccac

SEQ ID NO: 355077 - DNA, 25 bp, Homo sapien
tgtactgagctgagaccttgccact

SEQ ID NO: 355078 - DNA, 25 bp, Homo sapien
aaaccgctgccttgttttgagctgc

SEQ ID NO: 355079 - DNA, 25 bp, Homo sapien
ctgccctatggagagtctcagtggc

SEQ ID NO: 355080 - DNA, 25 bp, Homo sapien
gacttctgtacggacctgaggtcat

SEQ ID NO: 355081 - DNA, 25 bp, Homo sapien
tgaggtcatcattccaacaacacat

SEQ ID NO: 355082 - DNA, 25 bp, Homo sapien
cacatgaagagctgaatcctgacaa

SEQ ID NO: 355083 - DNA, 25 bp, Homo sapien
gaatcctgacaacaacttcattggt

SEQ ID NO: 355084 - DNA, 25 bp, Homo sapien
aacaacttcattggtaagcttggaa

SEQ ID NO: 355085 - DNA, 25 bp, Homo sapien
agttatgcagccaaccagagggtga

SEQ ID NO: 355086 - DNA, 25 bp, Homo sapien
aaacaggccttgaggtgaccacagc

SEQ ID NO: 355087 - DNA, 25 bp, Homo sapien
aatggcagaagagctctccacagag

SEQ ID NO: 355088 - DNA, 25 bp, Homo sapien
acagagagggttcccaaaccgctgc

SEQ ID NO: 355089 - DNA, 25 bp, Homo sapien
gatccgtgtgcctccggtggtgccc

SEQ ID NO: 355090 - DNA, 25 bp, Homo sapien
tggtgcccgcgcagacagtgcgaca

SEQ ID NO: 355091 - DNA, 25 bp, Homo sapien
acagtgcgacagctggtagagttcc

SEQ ID NO: 355092 - DNA, 25 bp, Homo sapien
gtagagttcctgtacagcggttcgc

SEQ ID NO: 355093 - DNA, 25 bp, Homo sapien
acagcggttcgctcgttgtggcgca

SEQ ID NO: 355094 - DNA, 25 bp, Homo sapien
tcgttgtggcgcagggtgaagccct

SEQ ID NO: 355095 - DNA, 25 bp, Homo sapien
ctgcaggtgctcacggccgcgtcag

SEQ ID NO: 355096 - DNA, 25 bp, Homo sapien
gcgtcagtgcttcgcatacagacag

SEQ ID NO: 355097 - DNA, 25 bp, Homo sapien
gtgcttcgcatacagacagttatcg

SEQ ID NO: 355098 - DNA, 25 bp, Homo sapien
agttatcgacgaatgcacgcagatt

SEQ ID NO: 355099 - DNA, 25 bp, Homo sapien
gaatgcacgcagattatcgcccgcg

SEQ ID NO: 355100 - DNA, 25 bp, Homo sapien
tgggcctggtcactacacagtggaa

SEQ ID NO: 355101 - DNA, 25 bp, Homo sapien
gtggaaaacagacaagcggcccctt

SEQ ID NO: 355102 - DNA, 25 bp, Homo sapien
aaatcccaagagtgtcttgctgctt

SEQ ID NO: 355103 - DNA, 25 bp, Homo sapien
tgtcttgctgcttggtgggtgctca

SEQ ID NO: 355104 - DNA, 25 bp, Homo sapien
gggtgctcatcgcaatgttctgaag

SEQ ID NO: 355105 - DNA, 25 bp, Homo sapien
gctccagggccactttgtttgtaag

SEQ ID NO: 355106 - DNA, 25 bp, Homo sapien
tgtttgtaagtatgatctgggcctc

SEQ ID NO: 355107 - DNA, 25 bp, Homo sapien
gatctgggcctcaaaataccatagt

SEQ ID NO: 355108 - DNA, 25 bp, Homo sapien
gtaaacactattacagtcaccagtg

SEQ ID NO: 355109 - DNA, 25 bp, Homo sapien
caccagtgtgtgaagactcttgagt

SEQ ID NO: 355110 - DNA, 25 bp, Homo sapien
gactcttgagtctggttctcatatc

SEQ ID NO: 355111 - DNA, 25 bp, Homo sapien
gcgtctgacgtcagacgctgaacta

SEQ ID NO: 355112 - DNA, 25 bp, Homo sapien
aactatgtggtcatgaggatgccca

SEQ ID NO: 355113 - DNA, 25 bp, Homo sapien
gtggtcatgaggatgcccagaatca

SEQ ID NO: 355114 - DNA, 25 bp, Homo sapien
cccagaatcagggcccagatgttca

SEQ ID NO: 355115 - DNA, 25 bp, Homo sapien
gttcaggcacttggcggtggaggca

SEQ ID NO: 355116 - DNA, 25 bp, Homo sapien
tcctgtccctagacttcacggagta

SEQ ID NO: 355117 - DNA, 25 bp, Homo sapien
gacttcacggagtaggcgaatgcta

SEQ ID NO: 355118 - DNA, 25 bp, Homo sapien
gcgaatgctatgaagcccaggcagc

SEQ ID NO: 355119 - DNA, 25 bp, Homo sapien
gtgttgaacagggaccagacgacat

SEQ ID NO: 355120 - DNA, 25 bp, Homo sapien
accagacgacatggtcgggcacgga

SEQ ID NO: 355121 - DNA, 25 bp, Homo sapien
tctcgctgcggatgtggatcacggt

SEQ ID NO: 355122 - DNA, 25 bp, Homo sapien
caatgtccaaagtgtgaaaagtgtt

SEQ ID NO: 355123 - DNA, 25 bp, Homo sapien
gaaaagtgttttgaatcagagcaga

SEQ ID NO: 355124 - DNA, 25 bp, Homo sapien
tttgaatcagagcagattctcaatg

SEQ ID NO: 355125 - DNA, 25 bp, Homo sapien
agtggcaaaattccaagcaggttca

SEQ ID NO: 355126 - DNA, 25 bp, Homo sapien
aattccaagcaggttcaaaagaagc

SEQ ID NO: 355127 - DNA, 25 bp, Homo sapien
aaaatcttggccaagcttaagcgtg

SEQ ID NO: 355128 - DNA, 25 bp, Homo sapien
caagcttaagcgtgctaggagtaaa

SEQ ID NO: 355129 - DNA, 25 bp, Homo sapien
cttaagcgtgctaggagtaaaaaat

SEQ ID NO: 355130 - DNA, 25 bp, Homo sapien
gtttcttgagaaattgtgatcttat

SEQ ID NO: 355131 - DNA, 25 bp, Homo sapien
gaacaaacccagagaacatttgtgg

SEQ ID NO: 355132 - DNA, 25 bp, Homo sapien
acccagagaacatttgtgggttctc

SEQ ID NO: 355133 - DNA, 25 bp, Homo sapien
atgatgctgccagtcatgattctga

SEQ ID NO: 355134 - DNA, 25 bp, Homo sapien
gtcatgattctgattactgtcttaa

SEQ ID NO: 355135 - DNA, 25 bp, Homo sapien
attactgtcttaaaatgctgcacgt

SEQ ID NO: 355136 - DNA, 25 bp, Homo sapien
gctgcacgtaagtaattaaatttcc

SEQ ID NO: 355137 - DNA, 25 bp, Homo sapien
ttaaatttccttgtgaactgggaag

SEQ ID NO: 355138 - DNA, 25 bp, Homo sapien
gtgaactgggaagtttcatcagact

SEQ ID NO: 355139 - DNA, 25 bp, Homo sapien
gtttcatcagacttctatcataact

SEQ ID NO: 355140 - DNA, 25 bp, Homo sapien
ataactattgtttccatcatccaca

SEQ ID NO: 355141 - DNA, 25 bp, Homo sapien
atcatccacagttactattttgaat

SEQ ID NO: 355142 - DNA, 25 bp, Homo sapien
cagttactattttgaattcttctct

SEQ ID NO: 355143 - DNA, 25 bp, Homo sapien
gtaattggcaatagtccaaattttc

SEQ ID NO: 355144 - DNA, 25 bp, Homo sapien
tgtcactccggtccagatggcaggc

SEQ ID NO: 355145 - DNA, 25 bp, Homo sapien
actccggtccagatggcaggcaaga

SEQ ID NO: 355146 - DNA, 25 bp, Homo sapien
tccggtccagatggcaggcaagaag

SEQ ID NO: 355147 - DNA, 25 bp, Homo sapien
ggcaagaaggactaccctgcactgc

SEQ ID NO: 355148 - DNA, 25 bp, Homo sapien
gggccaggcaaccaacaaaaccagc

SEQ ID NO: 355149 - DNA, 25 bp, Homo sapien
acaaaaccagcaactgcgtggtgct

SEQ ID NO: 355150 - DNA, 25 bp, Homo sapien
aaaccagcaactgcgtggtgctgaa

SEQ ID NO: 355151 - DNA, 25 bp, Homo sapien
aagtgccatcagacaagatcagttg

SEQ ID NO: 355152 - DNA, 25 bp, Homo sapien
gatcagaacagaaagctagctcgga

SEQ ID NO: 355153 - DNA, 25 bp, Homo sapien
gctagctcggaaaatcctacaagag

SEQ ID NO: 355154 - DNA, 25 bp, Homo sapien
acagtcctgttcacaaagaaaaacg

SEQ ID NO: 355155 - DNA, 25 bp, Homo sapien
aggctcggcagaacatgcggttgtc

SEQ ID NO: 355156 - DNA, 25 bp, Homo sapien
aggttcagggcttcctcccagagtg

SEQ ID NO: 355157 - DNA, 25 bp, Homo sapien
cccgtcccctgatgttgggtctggg

SEQ ID NO: 355158 - DNA, 25 bp, Homo sapien
aggagcgctgcgaccctcctaggct

SEQ ID NO: 355159 - DNA, 25 bp, Homo sapien
gaccctcctaggctattgactgtta

SEQ ID NO: 355160 - DNA, 25 bp, Homo sapien
tgactgttaagtcctcaggtttggc

SEQ ID NO: 355161 - DNA, 25 bp, Homo sapien
tcaggtttggcccagattccagttc

SEQ ID NO: 355162 - DNA, 25 bp, Homo sapien
agattccagttcgtgcctctgaggt

SEQ ID NO: 355163 - DNA, 25 bp, Homo sapien
agttcgtgcctctgaggtccaccag

SEQ ID NO: 355164 - DNA, 25 bp, Homo sapien
tgaggtccaccagagggcgcatgaa

SEQ ID NO: 355165 - DNA, 25 bp, Homo sapien
ccagagggcgcatgaagcccaggct

SEQ ID NO: 355166 - DNA, 25 bp, Homo sapien
gcaacttatagcctaggtggctctt

SEQ ID NO: 355167 - DNA, 25 bp, Homo sapien
gaggtgaacgtctttgtggctatgt

SEQ ID NO: 355168 - DNA, 25 bp, Homo sapien
gtggctatgtgagcagcatggaatt

SEQ ID NO: 355169 - DNA, 25 bp, Homo sapien
gcatggaattgtctacgccttttga

SEQ ID NO: 355170 - DNA, 25 bp, Homo sapien
acgccttttgattggaatgcactcc

SEQ ID NO: 355171 - DNA, 25 bp, Homo sapien
gaaagggaatctatgtcttttttct

SEQ ID NO: 355172 - DNA, 25 bp, Homo sapien
gtcttttttctacatgcagttatat

SEQ ID NO: 355173 - DNA, 25 bp, Homo sapien
agaatcaccattctttcccataagg

SEQ ID NO: 355174 - DNA, 25 bp, Homo sapien
attctttcccataaggcttgtacat

SEQ ID NO: 355175 - DNA, 25 bp, Homo sapien
tgtacataagccctaccttttgtcc

SEQ ID NO: 355176 - DNA, 25 bp, Homo sapien
gtgaaagtcggcctgtgagtaacat

SEQ ID NO: 355177 - DNA, 25 bp, Homo sapien
actttcagctcaataaccacgacac

SEQ ID NO: 355178 - DNA, 25 bp, Homo sapien
agcattccagtcagctgcggcttca

SEQ ID NO: 355179 - DNA, 25 bp, Homo sapien
tcactctgtgtacactgcacactaa

SEQ ID NO: 355180 - DNA, 25 bp, Homo sapien
tgcacactaaatcaggactacagga

SEQ ID NO: 355181 - DNA, 25 bp, Homo sapien
gactacaggaactatcctaagccaa

SEQ ID NO: 355182 - DNA, 25 bp, Homo sapien
agagccctccgacactgagatctga

SEQ ID NO: 355183 - DNA, 25 bp, Homo sapien
acaatcgcttcaaaggcaggcccca

SEQ ID NO: 355184 - DNA, 25 bp, Homo sapien
cactgagatctgaaaagccctggct

SEQ ID NO: 355185 - DNA, 25 bp, Homo sapien
ctggctgggacactgcagactgaca

SEQ ID NO: 355186 - DNA, 25 bp, Homo sapien
cagactgacagtgcggtagaaacaa

SEQ ID NO: 355187 - DNA, 25 bp, Homo sapien
agagcttttctggtttactttcagc

SEQ ID NO: 355188 - DNA, 25 bp, Homo sapien
gagatttgacacttatattggactg

SEQ ID NO: 355189 - DNA, 25 bp, Homo sapien
acttatattggactgtatgtaggca

SEQ ID NO: 355190 - DNA, 25 bp, Homo sapien
tgtaggcagttacagataaccgtct

SEQ ID NO: 355191 - DNA, 25 bp, Homo sapien
cagataaccgtctgtcaagctaggc

SEQ ID NO: 355192 - DNA, 25 bp, Homo sapien
tgctgcataccaagctttttacatg

SEQ ID NO: 355193 - DNA, 25 bp, Homo sapien
ttacatgtgcatctcatacaacccc

SEQ ID NO: 355194 - DNA, 25 bp, Homo sapien
gagatggattcatgtttgtggacat

SEQ ID NO: 355195 - DNA, 25 bp, Homo sapien
acattgatatttgtctgtgccctag

SEQ ID NO: 355196 - DNA, 25 bp, Homo sapien
ttgtctgtgccctagatactaagta

SEQ ID NO: 355197 - DNA, 25 bp, Homo sapien
tactaagtaacatccatgtcctgct

SEQ ID NO: 355198 - DNA, 25 bp, Homo sapien
atccatgtcctgcttaggagatttg

SEQ ID NO: 355199 - DNA, 25 bp, Homo sapien
gagtcttagctggatgaccttctgt

SEQ ID NO: 355200 - DNA, 25 bp, Homo sapien
gatgaccttctgtttcctcattata

SEQ ID NO: 355201 - DNA, 25 bp, Homo sapien
atgggcagaaaaccctctttggagg

SEQ ID NO: 355202 - DNA, 25 bp, Homo sapien
gaaaaccctctttggaggctgctgt

SEQ ID NO: 355203 - DNA, 25 bp, Homo sapien
gaggctgctgtatcagacatcatat

SEQ ID NO: 355204 - DNA, 25 bp, Homo sapien
cagacatcatatgttcaagtggctg

SEQ ID NO: 355205 - DNA, 25 bp, Homo sapien
ctggtccatgatgggcactcaactt

SEQ ID NO: 355206 - DNA, 25 bp, Homo sapien
gggcactcaacttttaattatcata

SEQ ID NO: 355207 - DNA, 25 bp, Homo sapien
tattatataatgcatcccaaagcca

SEQ ID NO: 355208 - DNA, 25 bp, Homo sapien
gcatcccaaagccagtgcagtggtg

SEQ ID NO: 355209 - DNA, 25 bp, Homo sapien
cagtgcagtggtgtgtatctgtagt

SEQ ID NO: 355210 - DNA, 25 bp, Homo sapien
ggctgaagttgttgtccatctagat

SEQ ID NO: 355211 - DNA, 25 bp, Homo sapien
cttatgggtggtctacaactttact

SEQ ID NO: 355212 - DNA, 25 bp, Homo sapien
ggtggtctacaactttactatcatt

SEQ ID NO: 355213 - DNA, 25 bp, Homo sapien
acaactttactatcattttagtgga

SEQ ID NO: 355214 - DNA, 25 bp, Homo sapien
gtggagataaacacgtgttcagcct

SEQ ID NO: 355215 - DNA, 25 bp, Homo sapien
tgctgtgaatctctgcagtggctat

SEQ ID NO: 355216 - DNA, 25 bp, Homo sapien
tctctgcagtggctatgttgtttct

SEQ ID NO: 355217 - DNA, 25 bp, Homo sapien
gcagtggctatgttgtttcttaaac

SEQ ID NO: 355218 - DNA, 25 bp, Homo sapien
ttccagatggacttctgcagcccaa

SEQ ID NO: 355219 - DNA, 25 bp, Homo sapien
gatggacttctgcagcccaaagctg

SEQ ID NO: 355220 - DNA, 25 bp, Homo sapien
aaagctgcgtgctccccgtgcaggc

SEQ ID NO: 355221 - DNA, 25 bp, Homo sapien
tgaaaatcgagtgcaagacactggc

SEQ ID NO: 355222 - DNA, 25 bp, Homo sapien
ctgtgctggagttgaggaaagtttt

SEQ ID NO: 355223 - DNA, 25 bp, Homo sapien
gaggaaagttttgctggagacctgc

SEQ ID NO: 355224 - DNA, 25 bp, Homo sapien
tggagacctgcttgcaccatatgtc

SEQ ID NO: 355225 - DNA, 25 bp, Homo sapien
tgcaccatatgtctggtcactgata

SEQ ID NO: 355226 - DNA, 25 bp, Homo sapien
gtcactgatagatgaggactggcca

SEQ ID NO: 355227 - DNA, 25 bp, Homo sapien
gccaggtcaggacagctgacacttg

SEQ ID NO: 355228 - DNA, 25 bp, Homo sapien
caggagggcatgacagactctggaa

SEQ ID NO: 355229 - DNA, 25 bp, Homo sapien
gtcggagtattaaactggctgggaa

SEQ ID NO: 355230 - DNA, 25 bp, Homo sapien
tggctgggaatgagaggcctccaat

SEQ ID NO: 355231 - DNA, 25 bp, Homo sapien
ggcctccaatcttttcgcaggaaaa

SEQ ID NO: 355232 - DNA, 25 bp, Homo sapien
tgagccaggaaggttgaggttgcag

SEQ ID NO: 355233 - DNA, 25 bp, Homo sapien
gaccctgtctaaaaactatatatat

SEQ ID NO: 355234 - DNA, 25 bp, Homo sapien
accctgtctaaaaactatatatata

SEQ ID NO: 355235 - DNA, 25 bp, Homo sapien
ccctgtctaaaaactatatatatat

SEQ ID NO: 355236 - DNA, 25 bp, Homo sapien
cctgtctaaaaactatatatatata

SEQ ID NO: 355237 - DNA, 25 bp, Homo sapien
tatatacgtgtatatatgtgtgtat

SEQ ID NO: 355238 - DNA, 25 bp, Homo sapien
atacgtgtatatatatatgatgttt

SEQ ID NO: 355239 - DNA, 25 bp, Homo sapien
ccagctagccggtaggctgaggtgg

SEQ ID NO: 355240 - DNA, 25 bp, Homo sapien
cagctagccggtaggctgaggtggg

SEQ ID NO: 355241 - DNA, 25 bp, Homo sapien
agctagccggtaggctgaggtggga

SEQ ID NO: 355242 - DNA, 25 bp, Homo sapien
gctagccggtaggctgaggtgggag

SEQ ID NO: 355243 - DNA, 25 bp, Homo sapien
gttattactctaattcaaaatgctt

SEQ ID NO: 355244 - DNA, 25 bp, Homo sapien
gaattttccaaggaatacaagccat

SEQ ID NO: 355245 - DNA, 25 bp, Homo sapien
caaggaatacaagccatctggttgg

SEQ ID NO: 355246 - DNA, 25 bp, Homo sapien
ccatctggttggtgttagttatagc

SEQ ID NO: 355247 - DNA, 25 bp, Homo sapien
cagtgatttcattagagtgtacatt

SEQ ID NO: 355248 - DNA, 25 bp, Homo sapien
gaattagaaccagagctcctatcag

SEQ ID NO: 355249 - DNA, 25 bp, Homo sapien
gaaccagagctcctatcagtatata

SEQ ID NO: 355250 - DNA, 25 bp, Homo sapien
gattgtgtaaaagttcaagcccgtt

SEQ ID NO: 355251 - DNA, 25 bp, Homo sapien
caagcccgttttagaaagccaacat

SEQ ID NO: 355252 - DNA, 25 bp, Homo sapien
gaaagccaacattttatgttataat

SEQ ID NO: 355253 - DNA, 25 bp, Homo sapien
aatatgctgttaatcaggactttat

SEQ ID NO: 355254 - DNA, 25 bp, Homo sapien
tgttctctcggagttggtgggcacc

SEQ ID NO: 355255 - DNA, 25 bp, Homo sapien
ataaattgtaaacgtctctggtcag

SEQ ID NO: 355256 - DNA, 25 bp, Homo sapien
catttcgttcttttgctttgtctgt

SEQ ID NO: 355257 - DNA, 25 bp, Homo sapien
ttgctttgtctgtgtattagctctt

SEQ ID NO: 355258 - DNA, 25 bp, Homo sapien
agttaactcgcgtggactctgcagt

SEQ ID NO: 355259 - DNA, 25 bp, Homo sapien
tctgcagtgcgagtagtgaccccag

SEQ ID NO: 355260 - DNA, 25 bp, Homo sapien
gagtagtgaccccagcataccttgt

SEQ ID NO: 355261 - DNA, 25 bp, Homo sapien
tctgcttctgggtgcatggtagact

SEQ ID NO: 355262 - DNA, 25 bp, Homo sapien
ggtagactttgtggcatttgataca

SEQ ID NO: 355263 - DNA, 25 bp, Homo sapien
gtggcatttgatacaacttggacaa

SEQ ID NO: 355264 - DNA, 25 bp, Homo sapien
aacttggacaatacctagtttggag

SEQ ID NO: 355265 - DNA, 25 bp, Homo sapien
gtaaatatgatcttgcctcctaatt

SEQ ID NO: 355266 - DNA, 25 bp, Homo sapien
gtgagtcaccaaaagttcttgatac

SEQ ID NO: 355267 - DNA, 25 bp, Homo sapien
tcctaatttaccttcgcttcctagt

SEQ ID NO: 355268 - DNA, 25 bp, Homo sapien
gcttcctagtcacagtcactgtttt

SEQ ID NO: 355269 - DNA, 25 bp, Homo sapien
gtcactgttttggaggctacttgcc

SEQ ID NO: 355270 - DNA, 25 bp, Homo sapien
ttggaggctacttgccatggcataa

SEQ ID NO: 355271 - DNA, 25 bp, Homo sapien
aaatattgccaggaattcattgtat

SEQ ID NO: 355272 - DNA, 25 bp, Homo sapien
ggattctgatacttgtctaagctca

SEQ ID NO: 355273 - DNA, 25 bp, Homo sapien
cttgtctaagctcatgattcatcag

SEQ ID NO: 355274 - DNA, 25 bp, Homo sapien
aaccatttatgagtaccttctgtgt

SEQ ID NO: 355275 - DNA, 25 bp, Homo sapien
aaagcactttactaaggataccaag

SEQ ID NO: 355276 - DNA, 25 bp, Homo sapien
tcttctgggtatctactccaggtga

SEQ ID NO: 355277 - DNA, 25 bp, Homo sapien
gggtatctactccaggtgaagtgat

SEQ ID NO: 355278 - DNA, 25 bp, Homo sapien
ctactccaggtgaagtgatattttt

SEQ ID NO: 355279 - DNA, 25 bp, Homo sapien
tggtctggccactaacattgatatg

SEQ ID NO: 355280 - DNA, 25 bp, Homo sapien
ctaacattgatatgatcttgggcaa

SEQ ID NO: 355281 - DNA, 25 bp, Homo sapien
gcctgggtttcattacctttaactg

SEQ ID NO: 355282 - DNA, 25 bp, Homo sapien
ttacctttaactgaggagggtggat

SEQ ID NO: 355283 - DNA, 25 bp, Homo sapien
gatgatttctcatgtctcttctact

SEQ ID NO: 355284 - DNA, 25 bp, Homo sapien
gtctcttctactcctaaattctatg

SEQ ID NO: 355285 - DNA, 25 bp, Homo sapien
attctatgattgtagggagttccta

SEQ ID NO: 355286 - DNA, 25 bp, Homo sapien
agggagttcctattgacgataagag

SEQ ID NO: 355287 - DNA, 25 bp, Homo sapien
tcagagtcaccgtgcaaggtgcagt

SEQ ID NO: 355288 - DNA, 25 bp, Homo sapien
gtgggcctgcaagcatgagtcagtt

SEQ ID NO: 355289 - DNA, 25 bp, Homo sapien
agtcagttgcactcaaggaagaact

SEQ ID NO: 355290 - DNA, 25 bp, Homo sapien
gaagaactaagatgcgtgtgatacg

SEQ ID NO: 355291 - DNA, 25 bp, Homo sapien
gatgcgtgtgatacgttctaacaca

SEQ ID NO: 355292 - DNA, 25 bp, Homo sapien
gatacgttctaacacagcgaacaca

SEQ ID NO: 355293 - DNA, 25 bp, Homo sapien
agcgaacacaaagtgaatgcccttt

SEQ ID NO: 355294 - DNA, 25 bp, Homo sapien
gggaaatgcctccaggcacagctgc

SEQ ID NO: 355295 - DNA, 25 bp, Homo sapien
atgcatcctggcagatactcgctga

SEQ ID NO: 355296 - DNA, 25 bp, Homo sapien
agatactcgctgagcacctactacg

SEQ ID NO: 355297 - DNA, 25 bp, Homo sapien
tactacgtcagagtcaccgtgcaag

SEQ ID NO: 355298 - DNA, 25 bp, Homo sapien
ctgttttagcatgctccagggtggg

SEQ ID NO: 355299 - DNA, 25 bp, Homo sapien
ggtcagagggcctggcgtcaactct

SEQ ID NO: 355300 - DNA, 25 bp, Homo sapien
agagggcctggcgtcaactcttcca

SEQ ID NO: 355301 - DNA, 25 bp, Homo sapien
tcaactcttccagggctctcagatt

SEQ ID NO: 355302 - DNA, 25 bp, Homo sapien
ttccagggctctcagatttcatcct

SEQ ID NO: 355303 - DNA, 25 bp, Homo sapien
ggtgaaaaaggaagccgtatgtttg

SEQ ID NO: 355304 - DNA, 25 bp, Homo sapien
atcttactggtaaaacagtcagata

SEQ ID NO: 355305 - DNA, 25 bp, Homo sapien
tgtattcacacacagaagaaacact

SEQ ID NO: 355306 - DNA, 25 bp, Homo sapien
gagtaattgcagaaggtcttggact

SEQ ID NO: 355307 - DNA, 25 bp, Homo sapien
ggtcttggactgttttagcatgctc

SEQ ID NO: 355308 - DNA, 25 bp, Homo sapien
ggactgttttagcatgctccagggt

SEQ ID NO: 355309 - DNA, 25 bp, Homo sapien
tgatgaattctatagcatgctactg

SEQ ID NO: 355310 - DNA, 25 bp, Homo sapien
tgctactgaaatgccaaattcagct

SEQ ID NO: 355311 - DNA, 25 bp, Homo sapien
aagtttcagttttccatatcagatg

SEQ ID NO: 355312 - DNA, 25 bp, Homo sapien
ataacacaatcctatcactgacagt

SEQ ID NO: 355313 - DNA, 25 bp, Homo sapien
atcactgacagtaatcctcagtcac

SEQ ID NO: 355314 - DNA, 25 bp, Homo sapien
taaataatcagtgctcacagtgctg

SEQ ID NO: 355315 - DNA, 25 bp, Homo sapien
gcttacagttcatttagttggcaca

SEQ ID NO: 355316 - DNA, 25 bp, Homo sapien
gttggcacatataaacctgtaccca

SEQ ID NO: 355317 - DNA, 25 bp, Homo sapien
taaacctgtacccacacaagactga

SEQ ID NO: 355318 - DNA, 25 bp, Homo sapien
gtacccacacaagactgaccaaaaa

SEQ ID NO: 355319 - DNA, 25 bp, Homo sapien
gtgatacagctattgcccataattt

SEQ ID NO: 355320 - DNA, 25 bp, Homo sapien
agtatcctgaaaacaccctgagctg

SEQ ID NO: 355321 - DNA, 25 bp, Homo sapien
gctgcttgacttccattctcaaaga

SEQ ID NO: 355322 - DNA, 25 bp, Homo sapien
ttggtttccacagttgtctccacaa

SEQ ID NO: 355323 - DNA, 25 bp, Homo sapien
aagctccgcatcaaagatccacgta

SEQ ID NO: 355324 - DNA, 25 bp, Homo sapien
tttggattttccttctagccttcat

SEQ ID NO: 355325 - DNA, 25 bp, Homo sapien
tagccttcatgtgtggcccaagcat

SEQ ID NO: 355326 - DNA, 25 bp, Homo sapien
ggcccaagcatctatttcagactgt

SEQ ID NO: 355327 - DNA, 25 bp, Homo sapien
catggttggcattgttctctgaggt

SEQ ID NO: 355328 - DNA, 25 bp, Homo sapien
ttctgtcttccctttgtgtttctat

SEQ ID NO: 355329 - DNA, 25 bp, Homo sapien
tgttctgttaatgccactagggact

SEQ ID NO: 355330 - DNA, 25 bp, Homo sapien
actatgtattcctgattccaccatg

SEQ ID NO: 355331 - DNA, 25 bp, Homo sapien
aaagcgtgaatttgttattaagcat

SEQ ID NO: 355332 - DNA, 25 bp, Homo sapien
agaaatattttagctctgaaggatt

SEQ ID NO: 355333 - DNA, 25 bp, Homo sapien
gctctgaaggatttagtagattctg

SEQ ID NO: 355334 - DNA, 25 bp, Homo sapien
gattctgttagattagggaggcctt

SEQ ID NO: 355335 - DNA, 25 bp, Homo sapien
tagggaggccttacagactgacttt

SEQ ID NO: 355336 - DNA, 25 bp, Homo sapien
ccttacagactgactttacttaaag

SEQ ID NO: 355337 - DNA, 25 bp, Homo sapien
tacttaaagaggacgcgtcactcgc

SEQ ID NO: 355338 - DNA, 25 bp, Homo sapien
aaagaggacgcgtcactcgctgtca

SEQ ID NO: 355339 - DNA, 25 bp, Homo sapien
acgcgtcactcgctgtcagtgtggt

SEQ ID NO: 355340 - DNA, 25 bp, Homo sapien
ccttcatttgtatagtacgtctcac

SEQ ID NO: 355341 - DNA, 25 bp, Homo sapien
atagtacgtctcacttgaaattgct

SEQ ID NO: 355342 - DNA, 25 bp, Homo sapien
gacactcccaagtccatgtgggact

SEQ ID NO: 355343 - DNA, 25 bp, Homo sapien
gtcatcttccttggagcaggaccaa

SEQ ID NO: 355344 - DNA, 25 bp, Homo sapien
acaatttctcatccttcttcactca

SEQ ID NO: 355345 - DNA, 25 bp, Homo sapien
atccttcttcactcaacttttcttt

SEQ ID NO: 355346 - DNA, 25 bp, Homo sapien
gaatacagcagttccaaggacaagg

SEQ ID NO: 355347 - DNA, 25 bp, Homo sapien
ggacaagggattcgtaccactgctc

SEQ ID NO: 355348 - DNA, 25 bp, Homo sapien
cactgctcctcactcagtaaatagc

SEQ ID NO: 355349 - DNA, 25 bp, Homo sapien
agaaagcaccgccactccagtggga

SEQ ID NO: 355350 - DNA, 25 bp, Homo sapien
gtgggaacggacacgcgtgcacaca

SEQ ID NO: 355351 - DNA, 25 bp, Homo sapien
gtgcacacagccacgaatggtgatg

SEQ ID NO: 355352 - DNA, 25 bp, Homo sapien
aatggtgatgacactcccaagtcca

SEQ ID NO: 355353 - DNA, 25 bp, Homo sapien
atagttacttgcatgccatggttgt

SEQ ID NO: 355354 - DNA, 25 bp, Homo sapien
ttgcatgccatggttgtacagtagc

SEQ ID NO: 355355 - DNA, 25 bp, Homo sapien
gtacagtagcagactatgaccctat

SEQ ID NO: 355356 - DNA, 25 bp, Homo sapien
agcagactatgaccctattgtgata

SEQ ID NO: 355357 - DNA, 25 bp, Homo sapien
gaccctattgtgatattaagtgttt

SEQ ID NO: 355358 - DNA, 25 bp, Homo sapien
agtgtttatttcataatgccattta

SEQ ID NO: 355359 - DNA, 25 bp, Homo sapien
catacaatatgtagttgcatcttat

SEQ ID NO: 355360 - DNA, 25 bp, Homo sapien
aagatttctaggttgcatctaacca

SEQ ID NO: 355361 - DNA, 25 bp, Homo sapien
gttgcatctaaccatgactatgtca

SEQ ID NO: 355362 - DNA, 25 bp, Homo sapien
agtatatattcctcatgttggcatg

SEQ ID NO: 355363 - DNA, 25 bp, Homo sapien
gataattttgctattttccatgcat

SEQ ID NO: 355364 - DNA, 25 bp, Homo sapien
ggaaggagcagctttgtttcccacc

SEQ ID NO: 355365 - DNA, 25 bp, Homo sapien
aggagcagctttgtttcccaccagc

SEQ ID NO: 355366 - DNA, 25 bp, Homo sapien
cgccgccagtgatccatagcgtgag

SEQ ID NO: 355367 - DNA, 25 bp, Homo sapien
gccagtgatccatagcgtgagcagg

SEQ ID NO: 355368 - DNA, 25 bp, Homo sapien
atccatagcgtgagcaggacgacca

SEQ ID NO: 355369 - DNA, 25 bp, Homo sapien
tagcgtgagcaggacgaccagcgcc

SEQ ID NO: 355370 - DNA, 25 bp, Homo sapien
ttttacagctgagggcaagggcact

SEQ ID NO: 355371 - DNA, 25 bp, Homo sapien
agcgcccccacgaagccggtgagga

SEQ ID NO: 355372 - DNA, 25 bp, Homo sapien
tgagggagaatctggcccatctgca

SEQ ID NO: 355373 - DNA, 25 bp, Homo sapien
gagaatctggcccatctgcagccca

SEQ ID NO: 355374 - DNA, 25 bp, Homo sapien
gcgcgccgctctttaggaaggagca

SEQ ID NO: 355375 - DNA, 25 bp, Homo sapien
ccatagagctttcagatgaagtgac

SEQ ID NO: 355376 - DNA, 25 bp, Homo sapien
tgaggtttcttctgactccttcata

SEQ ID NO: 355377 - DNA, 25 bp, Homo sapien
tcttctgactccttcatatttctaa

SEQ ID NO: 355378 - DNA, 25 bp, Homo sapien
tagaatactgctagtctcccaagtc

SEQ ID NO: 355379 - DNA, 25 bp, Homo sapien
ccaagtcctgttccttgtaattctc

SEQ ID NO: 355380 - DNA, 25 bp, Homo sapien
ttgtaattctcccactgttctcagt

SEQ ID NO: 355381 - DNA, 25 bp, Homo sapien
agtggccctaaccatctctataggt

SEQ ID NO: 355382 - DNA, 25 bp, Homo sapien
atctctataggttcctgacagggaa

SEQ ID NO: 355383 - DNA, 25 bp, Homo sapien
tcctgacagggaagcagatcattta

SEQ ID NO: 355384 - DNA, 25 bp, Homo sapien
ttaatttatgttcagtctcccacct

SEQ ID NO: 355385 - DNA, 25 bp, Homo sapien
aggccttgtgggtcctatggaaagt

SEQ ID NO: 355386 - DNA, 25 bp, Homo sapien
gaatattgtgaagaaccacccataa

SEQ ID NO: 355387 - DNA, 25 bp, Homo sapien
gaaccacccataaatcaggcctgaa

SEQ ID NO: 355388 - DNA, 25 bp, Homo sapien
tcttccgtggttaccaagttatcgg

SEQ ID NO: 355389 - DNA, 25 bp, Homo sapien
aagttatcggaactccccacaagat

SEQ ID NO: 355390 - DNA, 25 bp, Homo sapien
tccccacaagatcctcagtgtggac

SEQ ID NO: 355391 - DNA, 25 bp, Homo sapien
ctactatagataactgagccacttg

SEQ ID NO: 355392 - DNA, 25 bp, Homo sapien
gagccacttgagcatgcagcttagt

SEQ ID NO: 355393 - DNA, 25 bp, Homo sapien
gagcatgcagcttagttgtaccttt

SEQ ID NO: 355394 - DNA, 25 bp, Homo sapien
tagttgtacctttgggacccacttg

SEQ ID NO: 355395 - DNA, 25 bp, Homo sapien
tttgggacccacttgtgcctgatct

SEQ ID NO: 355396 - DNA, 25 bp, Homo sapien
gctcagagacactccacatttgagt

SEQ ID NO: 355397 - DNA, 25 bp, Homo sapien
ctcagggcatgatcacagggcattt

SEQ ID NO: 355398 - DNA, 25 bp, Homo sapien
gatcacagggcatttccttagcatt

SEQ ID NO: 355399 - DNA, 25 bp, Homo sapien
ggcatttccttagcattcctccttt

SEQ ID NO: 355400 - DNA, 25 bp, Homo sapien
gtgtgttctactccgtgtgtgtgtc

SEQ ID NO: 355401 - DNA, 25 bp, Homo sapien
tccgtgtgtgtgtcatcctcctctg

SEQ ID NO: 355402 - DNA, 25 bp, Homo sapien
actgcagcacctagcatcacctagg

SEQ ID NO: 355403 - DNA, 25 bp, Homo sapien
gggcctggaaaacctgcacctgaaa

SEQ ID NO: 355404 - DNA, 25 bp, Homo sapien
aaacctgcacctgaaagccgtaact

SEQ ID NO: 355405 - DNA, 25 bp, Homo sapien
taactccccggcacctggctggttg

SEQ ID NO: 355406 - DNA, 25 bp, Homo sapien
ggcacctggctggttgacttcttcc

SEQ ID NO: 355407 - DNA, 25 bp, Homo sapien
taaccccatttactttgaggatgga

SEQ ID NO: 355408 - DNA, 25 bp, Homo sapien
gtttgatagtgcaaagggtcccact

SEQ ID NO: 355409 - DNA, 25 bp, Homo sapien
tgatagtgcaaagggtcccactaaa

SEQ ID NO: 355410 - DNA, 25 bp, Homo sapien
agtgcaaagggtcccactaaaattg

SEQ ID NO: 355411 - DNA, 25 bp, Homo sapien
caaagggtcccactaaaattgcctg

SEQ ID NO: 355412 - DNA, 25 bp, Homo sapien
aactgtttatctgtcatcttatgaa

SEQ ID NO: 355413 - DNA, 25 bp, Homo sapien
gtttatctgtcatcttatgaatgcc

SEQ ID NO: 355414 - DNA, 25 bp, Homo sapien
ttatctgtcatcttatgaatgcctt

SEQ ID NO: 355415 - DNA, 25 bp, Homo sapien
atctgtcatcttatgaatgccttag

SEQ ID NO: 355416 - DNA, 25 bp, Homo sapien
tctgtcatcttatgaatgccttaga

SEQ ID NO: 355417 - DNA, 25 bp, Homo sapien
gggagtgtcataattgacatatctc

SEQ ID NO: 355418 - DNA, 25 bp, Homo sapien
gagtgtcataattgacatatctctt

SEQ ID NO: 355419 - DNA, 25 bp, Homo sapien
ctttgtgagtgtggacggcagacca

SEQ ID NO: 355420 - DNA, 25 bp, Homo sapien
gaccagggtagtatcagcaatgctt

SEQ ID NO: 355421 - DNA, 25 bp, Homo sapien
tggttttgtgtgatggtttgctctc

SEQ ID NO: 355422 - DNA, 25 bp, Homo sapien
ggtttgctctcaattggcaagccag

SEQ ID NO: 355423 - DNA, 25 bp, Homo sapien
tggcaagccagcaatacaccttcat

SEQ ID NO: 355424 - DNA, 25 bp, Homo sapien
tcaggaatatatcaaccctccagcc

SEQ ID NO: 355425 - DNA, 25 bp, Homo sapien
cctccagccctgttataatttagtt

SEQ ID NO: 355426 - DNA, 25 bp, Homo sapien
tttgcaggcatcttgatcacctttt

SEQ ID NO: 355427 - DNA, 25 bp, Homo sapien
tttcattttcacaaagccctgagat

SEQ ID NO: 355428 - DNA, 25 bp, Homo sapien
aaagccctgagattcagcattcccc

SEQ ID NO: 355429 - DNA, 25 bp, Homo sapien
gcattcccctgctttgtgagtgtgg

SEQ ID NO: 355430 - DNA, 25 bp, Homo sapien
aattcactgacatgctggactgaca

SEQ ID NO: 355431 - DNA, 25 bp, Homo sapien
ctggactgacatgctggctgctgtt

SEQ ID NO: 355432 - DNA, 25 bp, Homo sapien
gcaactctgttgtcaaggtactgtg

SEQ ID NO: 355433 - DNA, 25 bp, Homo sapien
ggtactgtgctttggttcctatagc

SEQ ID NO: 355434 - DNA, 25 bp, Homo sapien
ggttcctatagcaacactgggtgtg

SEQ ID NO: 355435 - DNA, 25 bp, Homo sapien
tgggtgtggcccttgaattgctaag

SEQ ID NO: 355436 - DNA, 25 bp, Homo sapien
gggcatttaatacatcctggagcaa

SEQ ID NO: 355437 - DNA, 25 bp, Homo sapien
tacatcctggagcaaattttaactg

SEQ ID NO: 355438 - DNA, 25 bp, Homo sapien
ataatgcaggtacctacttggccca

SEQ ID NO: 355439 - DNA, 25 bp, Homo sapien
tacttggcccatggctggtaactat

SEQ ID NO: 355440 - DNA, 25 bp, Homo sapien
atggctggtaactatttgggcaatt

SEQ ID NO: 355441 - DNA, 25 bp, Homo sapien
ggtttgcaaccaggactgagtgtct

SEQ ID NO: 355442 - DNA, 25 bp, Homo sapien
ggactgagtgtctgattctttgatt

SEQ ID NO: 355443 - DNA, 25 bp, Homo sapien
tctttgattttctagagacattcct

SEQ ID NO: 355444 - DNA, 25 bp, Homo sapien
gagacattcctaatttcatccctaa

SEQ ID NO: 355445 - DNA, 25 bp, Homo sapien
ctaactctccccagataaattctca

SEQ ID NO: 355446 - DNA, 25 bp, Homo sapien
aaattctcatctcttatcaaaaaca

SEQ ID NO: 355447 - DNA, 25 bp, Homo sapien
acaaggtccctggaatggaaagtca

SEQ ID NO: 355448 - DNA, 25 bp, Homo sapien
gagtgtttagctgtattctcagtca

SEQ ID NO: 355449 - DNA, 25 bp, Homo sapien
gtattctcagtcatgtaggttttgt

SEQ ID NO: 355450 - DNA, 25 bp, Homo sapien
gcagaggcaaggttggcagctaact

SEQ ID NO: 355451 - DNA, 25 bp, Homo sapien
agctaactggtttggtgtgatttca

SEQ ID NO: 355452 - DNA, 25 bp, Homo sapien
ctatcctggtgtatgttggcacctt

SEQ ID NO: 355453 - DNA, 25 bp, Homo sapien
tttttcctttttgcacaaggtgctt

SEQ ID NO: 355454 - DNA, 25 bp, Homo sapien
ctttttgcacaaggtgctttcctga

SEQ ID NO: 355455 - DNA, 25 bp, Homo sapien
tttatgctcatttacctcaagactg

SEQ ID NO: 355456 - DNA, 25 bp, Homo sapien
atgctcatttacctcaagactgtcc

SEQ ID NO: 355457 - DNA, 25 bp, Homo sapien
tcatttacctcaagactgtcctctc

SEQ ID NO: 355458 - DNA, 25 bp, Homo sapien
tagttgtcatcactccatcttttgt

SEQ ID NO: 355459 - DNA, 25 bp, Homo sapien
tgtcatcactccatcttttgtactg

SEQ ID NO: 355460 - DNA, 25 bp, Homo sapien
actccatcttttgtactgctgttga

SEQ ID NO: 355461 - DNA, 25 bp, Homo sapien
ccatcttttgtactgctgttgacac

SEQ ID NO: 355462 - DNA, 25 bp, Homo sapien
actgctgttgacacttacaaattaa

SEQ ID NO: 355463 - DNA, 25 bp, Homo sapien
ggcaccttctggacatggatgagca

SEQ ID NO: 355464 - DNA, 25 bp, Homo sapien
agtcagcctcaattatttaccagca

SEQ ID NO: 355465 - DNA, 25 bp, Homo sapien
ttaccagcacaatccaatcaacatg

SEQ ID NO: 355466 - DNA, 25 bp, Homo sapien
catgatctgccagaatggacccaac

SEQ ID NO: 355467 - DNA, 25 bp, Homo sapien
ggacccaacagctggatttccattg

SEQ ID NO: 355468 - DNA, 25 bp, Homo sapien
atttccattgcaaactccgaagcca

SEQ ID NO: 355469 - DNA, 25 bp, Homo sapien
aagccatccagattggacacgggaa

SEQ ID NO: 355470 - DNA, 25 bp, Homo sapien
ggacacgggaacatcattacaagac

SEQ ID NO: 355471 - DNA, 25 bp, Homo sapien
aagacagacagtctccagggaggac

SEQ ID NO: 355472 - DNA, 25 bp, Homo sapien
atgtgaaccgagacttgtacaggat

SEQ ID NO: 355473 - DNA, 25 bp, Homo sapien
tgaagagcaggcaccttctggacat

SEQ ID NO: 355474 - DNA, 25 bp, Homo sapien
gttagaaatacttaagacagctaca

SEQ ID NO: 355475 - DNA, 25 bp, Homo sapien
gacagctacaaagttgaaggcatcc

SEQ ID NO: 355476 - DNA, 25 bp, Homo sapien
ctacaaagttgaaggcatccatcat

SEQ ID NO: 355477 - DNA, 25 bp, Homo sapien
catccatcatgcctttgaggagaat

SEQ ID NO: 355478 - DNA, 25 bp, Homo sapien
atgcctttgaggagaatggagtttt

SEQ ID NO: 355479 - DNA, 25 bp, Homo sapien
atggagttttgattgtctaaagtag

SEQ ID NO: 355480 - DNA, 25 bp, Homo sapien
gaagacataccttgtacatgactga

SEQ ID NO: 355481 - DNA, 25 bp, Homo sapien
gacataccttgtacatgactgaaaa

SEQ ID NO: 355482 - DNA, 25 bp, Homo sapien
taggaaaagacaccccctaggtcag

SEQ ID NO: 355483 - DNA, 25 bp, Homo sapien
ccctaggtcagctccaagagatcat

SEQ ID NO: 355484 - DNA, 25 bp, Homo sapien
gctccaagagatcattagattcagt

SEQ ID NO: 355485 - DNA, 25 bp, Homo sapien
tttaaccattgccattgtgaaaagg

SEQ ID NO: 355486 - DNA, 25 bp, Homo sapien
aagggatataatcctccttactgcc

SEQ ID NO: 355487 - DNA, 25 bp, Homo sapien
ttactgccaaccaaagcaaggagca

SEQ ID NO: 355488 - DNA, 25 bp, Homo sapien
gatgatggacgcttagtaccaccaa

SEQ ID NO: 355489 - DNA, 25 bp, Homo sapien
gacgcttagtaccaccaactgagag

SEQ ID NO: 355490 - DNA, 25 bp, Homo sapien
ggagggaagataggccacttttcaa

SEQ ID NO: 355491 - DNA, 25 bp, Homo sapien
tcaaaaacaacggtttcaactcatt

SEQ ID NO: 355492 - DNA, 25 bp, Homo sapien
tttctacatttctctacctgtgctt

SEQ ID NO: 355493 - DNA, 25 bp, Homo sapien
tctctacctgtgcttcttattacta

SEQ ID NO: 355494 - DNA, 25 bp, Homo sapien
gtgcttcttattactactgccattt

SEQ ID NO: 355495 - DNA, 25 bp, Homo sapien
aaaatgaaagtgagagctctgtgtc

SEQ ID NO: 355496 - DNA, 25 bp, Homo sapien
tgacctttgccatttcccagtactt

SEQ ID NO: 355497 - DNA, 25 bp, Homo sapien
tttacagtctgcagcctataaacag

SEQ ID NO: 355498 - DNA, 25 bp, Homo sapien
aacagtggtgtctcaaagcaaagga

SEQ ID NO: 355499 - DNA, 25 bp, Homo sapien
aaggaaacctccacaagtgctgcaa

SEQ ID NO: 355500 - DNA, 25 bp, Homo sapien
gtgctgcaacagtgcattagttttt

SEQ ID NO: 355501 - DNA, 25 bp, Homo sapien
atcccataatgcatgaccttcctaa

SEQ ID NO: 355502 - DNA, 25 bp, Homo sapien
agcctccataggcaaggtgagcttt

SEQ ID NO: 355503 - DNA, 25 bp, Homo sapien
aaggtgagctttctgtgctacccac

SEQ ID NO: 355504 - DNA, 25 bp, Homo sapien
ggattctgatccatgtcattaacga

SEQ ID NO: 355505 - DNA, 25 bp, Homo sapien
cattaacgaccatcccagggtgtga

SEQ ID NO: 355506 - DNA, 25 bp, Homo sapien
gagggcctgattaaagcttatcgaa

SEQ ID NO: 355507 - DNA, 25 bp, Homo sapien
gaccagtagaaaccagcacaacttt

SEQ ID NO: 355508 - DNA, 25 bp, Homo sapien
ttggtttgcaagtccatcctcaaga

SEQ ID NO: 355509 - DNA, 25 bp, Homo sapien
atcctcaagaggcttctgctaatta

SEQ ID NO: 355510 - DNA, 25 bp, Homo sapien
gctgttttcagctagtaatttttgt

SEQ ID NO: 355511 - DNA, 25 bp, Homo sapien
aaggccaactgatacacatacccct

SEQ ID NO: 355512 - DNA, 25 bp, Homo sapien
ctggcctctatttctaatgtctagg

SEQ ID NO: 355513 - DNA, 25 bp, Homo sapien
atgtctaggcagcaactgttgttgt

SEQ ID NO: 355514 - DNA, 25 bp, Homo sapien
gttcctgttacatagtcttattacc

SEQ ID NO: 355515 - DNA, 25 bp, Homo sapien
gtcttattacccatttgatacaaag

SEQ ID NO: 355516 - DNA, 25 bp, Homo sapien
gattgattgttcctgttcgtattcc

SEQ ID NO: 355517 - DNA, 25 bp, Homo sapien
tttccctctatctttgttgattttt

SEQ ID NO: 355518 - DNA, 25 bp, Homo sapien
gttgattcagacaatacacagtgag

SEQ ID NO: 355519 - DNA, 25 bp, Homo sapien
aatacacagtgagaaaagacttcca

SEQ ID NO: 355520 - DNA, 25 bp, Homo sapien
catattaaatcactgtactggcaat

SEQ ID NO: 355521 - DNA, 25 bp, Homo sapien
tcactgtactggcaatacataatgt

SEQ ID NO: 355522 - DNA, 25 bp, Homo sapien
ataatgtacacatagcttgccgagc

SEQ ID NO: 355523 - DNA, 25 bp, Homo sapien
gcttgccgagctctatattatgatg

SEQ ID NO: 355524 - DNA, 25 bp, Homo sapien
tattatgatgccaggtaacccacag

SEQ ID NO: 355525 - DNA, 25 bp, Homo sapien
gatgccaggtaacccacagtgtgga

SEQ ID NO: 355526 - DNA, 25 bp, Homo sapien
cccacagtgtggactccactgtata

SEQ ID NO: 355527 - DNA, 25 bp, Homo sapien
ggactccactgtatatatgaacatc

SEQ ID NO: 355528 - DNA, 25 bp, Homo sapien
gttaagcacagatagcacatatgga

SEQ ID NO: 355529 - DNA, 25 bp, Homo sapien
gaaacattttatcacagtcctaaga

SEQ ID NO: 355530 - DNA, 25 bp, Homo sapien
gtcctaagagaagcctacatgtctg

SEQ ID NO: 355531 - DNA, 25 bp, Homo sapien
ctcagttttaattgtgacatgtgct

SEQ ID NO: 355532 - DNA, 25 bp, Homo sapien
gacatgtgctttagttacctggaaa

SEQ ID NO: 355533 - DNA, 25 bp, Homo sapien
tttagttacctggaaaatcactgcc

SEQ ID NO: 355534 - DNA, 25 bp, Homo sapien
atattttaaaaagatgccaccacca

SEQ ID NO: 355535 - DNA, 25 bp, Homo sapien
aaaaagatgccaccaccatctctac

SEQ ID NO: 355536 - DNA, 25 bp, Homo sapien
gaacagaagggatttagctagaact

SEQ ID NO: 355537 - DNA, 25 bp, Homo sapien
aaatagaacaatcctggctgctgat

SEQ ID NO: 355538 - DNA, 25 bp, Homo sapien
gaacaatcctggctgctgattttat

SEQ ID NO: 355539 - DNA, 25 bp, Homo sapien
tcctggctgctgattttataaaatg

SEQ ID NO: 355540 - DNA, 25 bp, Homo sapien
gttggccagtctgctttcctcctaa

SEQ ID NO: 355541 - DNA, 25 bp, Homo sapien
gagccgcctgcctcgaagatgcttt

SEQ ID NO: 355542 - DNA, 25 bp, Homo sapien
gccgcctgcctcgaagatgctttat

SEQ ID NO: 355543 - DNA, 25 bp, Homo sapien
gcctgcctcgaagatgctttattta

SEQ ID NO: 355544 - DNA, 25 bp, Homo sapien
cctgcctcgaagatgctttatttat

SEQ ID NO: 355545 - DNA, 25 bp, Homo sapien
ctttatttataagcgctttggacac

SEQ ID NO: 355546 - DNA, 25 bp, Homo sapien
tttataagcgctttggacacacttt

SEQ ID NO: 355547 - DNA, 25 bp, Homo sapien
tataagcgctttggacacactttaa

SEQ ID NO: 355548 - DNA, 25 bp, Homo sapien
taagcgctttggacacactttaata

SEQ ID NO: 355549 - DNA, 25 bp, Homo sapien
ctttggacacactttaataaatgct

SEQ ID NO: 355550 - DNA, 25 bp, Homo sapien
tggacacactttaataaatgctcta

SEQ ID NO: 355551 - DNA, 25 bp, Homo sapien
gggatgttgatcttctctgtgcaca

SEQ ID NO: 355552 - DNA, 25 bp, Homo sapien
agttcagactctctggccaggcaaa

SEQ ID NO: 355553 - DNA, 25 bp, Homo sapien
aagtttgaccaaatgctcccacaaa

SEQ ID NO: 355554 - DNA, 25 bp, Homo sapien
aatgctcccacaaagctgagttgaa

SEQ ID NO: 355555 - DNA, 25 bp, Homo sapien
tgcttccaggcaatctaggtatcta

SEQ ID NO: 355556 - DNA, 25 bp, Homo sapien
taaaccaacctatcgggagtctgtc

SEQ ID NO: 355557 - DNA, 25 bp, Homo sapien
atcgggagtctgtctgtttactctg

SEQ ID NO: 355558 - DNA, 25 bp, Homo sapien
ggccaggcaaatccaaattccttca

SEQ ID NO: 355559 - DNA, 25 bp, Homo sapien
aattccttcaggacgggttcacagc

SEQ ID NO: 355560 - DNA, 25 bp, Homo sapien
ggttcacagcgtctcttgactgaaa

SEQ ID NO: 355561 - DNA, 25 bp, Homo sapien
ttgactgaaagacacatgccgccgc

SEQ ID NO: 355562 - DNA, 25 bp, Homo sapien
tgcgctcgcagctggtgccggtgcg

SEQ ID NO: 355563 - DNA, 25 bp, Homo sapien
gctccgacgagctggtgcgtttccg

SEQ ID NO: 355564 - DNA, 25 bp, Homo sapien
acgagctggtgcgtttccgcttctg

SEQ ID NO: 355565 - DNA, 25 bp, Homo sapien
tgctgccgacccacgcgctacgaag

SEQ ID NO: 355566 - DNA, 25 bp, Homo sapien
gctacgaagcggtctccttcatgga

SEQ ID NO: 355567 - DNA, 25 bp, Homo sapien
tacgaagcggtctccttcatggacg

SEQ ID NO: 355568 - DNA, 25 bp, Homo sapien
aagcggtctccttcatggacgtcaa

SEQ ID NO: 355569 - DNA, 25 bp, Homo sapien
gtctccttcatggacgtcaacagca

SEQ ID NO: 355570 - DNA, 25 bp, Homo sapien
cttcatggacgtcaacagcacctgg

SEQ ID NO: 355571 - DNA, 25 bp, Homo sapien
cagcacctggagaaccgtggaccgc

SEQ ID NO: 355572 - DNA, 25 bp, Homo sapien
gcacctggagaaccgtggaccgcct

SEQ ID NO: 355573 - DNA, 25 bp, Homo sapien
aagtattcagtggtacctggaggtc

SEQ ID NO: 355574 - DNA, 25 bp, Homo sapien
tcagtggtacctggaggtctggaca

SEQ ID NO: 355575 - DNA, 25 bp, Homo sapien
ggtctggacagttatactgtaacct

SEQ ID NO: 355576 - DNA, 25 bp, Homo sapien
aatgtgctaaatatatcttgtatga

SEQ ID NO: 355577 - DNA, 25 bp, Homo sapien
gagattatgattctgtaaagctgtg

SEQ ID NO: 355578 - DNA, 25 bp, Homo sapien
atgattctgtaaagctgtggaatga

SEQ ID NO: 355579 - DNA, 25 bp, Homo sapien
agatttagagaacattggcttctga

SEQ ID NO: 355580 - DNA, 25 bp, Homo sapien
ttagagaacattggcttctgaaaaa

SEQ ID NO: 355581 - DNA, 25 bp, Homo sapien
gagtgaagatagtactagcaagtat

SEQ ID NO: 355582 - DNA, 25 bp, Homo sapien
ttttaaaacaggctagaatctcatg

SEQ ID NO: 355583 - DNA, 25 bp, Homo sapien
aacaggctagaatctcatgttttat

SEQ ID NO: 355584 - DNA, 25 bp, Homo sapien
atcctgaggaccgagcagtggccaa

SEQ ID NO: 355585 - DNA, 25 bp, Homo sapien
gaagctgtacatgcagctcatcccg

SEQ ID NO: 355586 - DNA, 25 bp, Homo sapien
tagtgccgctgttccggaactcgcg

SEQ ID NO: 355587 - DNA, 25 bp, Homo sapien
ttcaccaaggacctggagacactga

SEQ ID NO: 355588 - DNA, 25 bp, Homo sapien
agacactgaagagcctgtgccggat

SEQ ID NO: 355589 - DNA, 25 bp, Homo sapien
gagcctgtgccggatcatggacaat

SEQ ID NO: 355590 - DNA, 25 bp, Homo sapien
gatcatggacaatggcttcgccggc

SEQ ID NO: 355591 - DNA, 25 bp, Homo sapien
cggctgcgtgcacttttcctacaaa

SEQ ID NO: 355592 - DNA, 25 bp, Homo sapien
acaaagcatcgtgtgagatccgcgt

SEQ ID NO: 355593 - DNA, 25 bp, Homo sapien
agatccgcgtgcttatgctcctgta

SEQ ID NO: 355594 - DNA, 25 bp, Homo sapien
cttatgctcctgtactcttcagaga

SEQ ID NO: 355595 - DNA, 25 bp, Homo sapien
ctgaggtggagcctttcttatcctg

SEQ ID NO: 355596 - DNA, 25 bp, Homo sapien
ctttcttatcctggcccaagatcca

SEQ ID NO: 355597 - DNA, 25 bp, Homo sapien
ctgtgctttggagtcctgggagtcc

SEQ ID NO: 355598 - DNA, 25 bp, Homo sapien
tcctgggagtcctcttcatggccgt

SEQ ID NO: 355599 - DNA, 25 bp, Homo sapien
ttcatggccgtcagtctaggcttta

SEQ ID NO: 355600 - DNA, 25 bp, Homo sapien
tggccgtcagtctaggctttatgtt

SEQ ID NO: 355601 - DNA, 25 bp, Homo sapien
ggctttatgtttgccaactgggcca

SEQ ID NO: 355602 - DNA, 25 bp, Homo sapien
ttatgtttgccaactgggccacagg

SEQ ID NO: 355603 - DNA, 25 bp, Homo sapien
atgtttgccaactgggccacaggcc

SEQ ID NO: 355604 - DNA, 25 bp, Homo sapien
gagccgcatgtctggacactgatca

SEQ ID NO: 355605 - DNA, 25 bp, Homo sapien
ctggacactgatcaggccctgctgg

SEQ ID NO: 355606 - DNA, 25 bp, Homo sapien
acagagcaactctacattgatacat

SEQ ID NO: 355607 - DNA, 25 bp, Homo sapien
aactctacattgatacattggcaca

SEQ ID NO: 355608 - DNA, 25 bp, Homo sapien
tacattggcacaaacaggaagagca

SEQ ID NO: 355609 - DNA, 25 bp, Homo sapien
aagagcaaatgcatcacccaggcct

SEQ ID NO: 355610 - DNA, 25 bp, Homo sapien
atcacccaggcctaaatgtccacag

SEQ ID NO: 355611 - DNA, 25 bp, Homo sapien
taaatgtccacaggccacttttgta

SEQ ID NO: 355612 - DNA, 25 bp, Homo sapien
ggccacttttgtacatgctctttta

SEQ ID NO: 355613 - DNA, 25 bp, Homo sapien
tgtacatgctcttttagaaacacca

SEQ ID NO: 355614 - DNA, 25 bp, Homo sapien
gaaacaccactctgaaaagatcttg

SEQ ID NO: 355615 - DNA, 25 bp, Homo sapien
gaaaagatcttgttcgctaggtaag

SEQ ID NO: 355616 - DNA, 25 bp, Homo sapien
aaatgcacactgatcatgactttat

SEQ ID NO: 355617 - DNA, 25 bp, Homo sapien
aaaggcttaatgctcgtgctgtgga

SEQ ID NO: 355618 - DNA, 25 bp, Homo sapien
aaggcttaatgctcgtgctgtggaa

SEQ ID NO: 355619 - DNA, 25 bp, Homo sapien
ggcttaatgctcgtgctgtggaagt

SEQ ID NO: 355620 - DNA, 25 bp, Homo sapien
cttaatgctcgtgctgtggaagtca

SEQ ID NO: 355621 - DNA, 25 bp, Homo sapien
taatgctcgtgctgtggaagtcaga

SEQ ID NO: 355622 - DNA, 25 bp, Homo sapien
atgctcgtgctgtggaagtcagaat

SEQ ID NO: 355623 - DNA, 25 bp, Homo sapien
ctcgtgctgtggaagtcagaatgga

SEQ ID NO: 355624 - DNA, 25 bp, Homo sapien
tgtggaagtcagaatggagcaaagt

SEQ ID NO: 355625 - DNA, 25 bp, Homo sapien
ggagcaaagtgggttctgtctgtct

SEQ ID NO: 355626 - DNA, 25 bp, Homo sapien
agcaaagtgggttctgtctgtcttg

SEQ ID NO: 355627 - DNA, 25 bp, Homo sapien
aaagtgggttctgtctgtcttgctg

SEQ ID NO: 355628 - DNA, 25 bp, Homo sapien
attttccattcctgaggccagtggg

SEQ ID NO: 355629 - DNA, 25 bp, Homo sapien
tgcacccagccattgtgacaactta

SEQ ID NO: 355630 - DNA, 25 bp, Homo sapien
aaatcacacttaatcctcagatagt

SEQ ID NO: 355631 - DNA, 25 bp, Homo sapien
atcctcagatagtggttaattctca

SEQ ID NO: 355632 - DNA, 25 bp, Homo sapien
aaccaggtgtatttcaatttggctt

SEQ ID NO: 355633 - DNA, 25 bp, Homo sapien
gggttgacaagcatttcagttttta

SEQ ID NO: 355634 - DNA, 25 bp, Homo sapien
gtgacaacttagtgatttttccctt

SEQ ID NO: 355635 - DNA, 25 bp, Homo sapien
ttagtgatttttcccttagtggctc

SEQ ID NO: 355636 - DNA, 25 bp, Homo sapien
atttttcccttagtggctctgacac

SEQ ID NO: 355637 - DNA, 25 bp, Homo sapien
ttcccttagtggctctgacacaaga

SEQ ID NO: 355638 - DNA, 25 bp, Homo sapien
ttagtggctctgacacaagaagcag

SEQ ID NO: 355639 - DNA, 25 bp, Homo sapien
gatagggtcctacagggacttgaac

SEQ ID NO: 355640 - DNA, 25 bp, Homo sapien
ttgaacgaggaagatctgctggaaa

SEQ ID NO: 355641 - DNA, 25 bp, Homo sapien
aaagaactacaaccaaccagatgaa

SEQ ID NO: 355642 - DNA, 25 bp, Homo sapien
gactagccgagattagcaaagacca

SEQ ID NO: 355643 - DNA, 25 bp, Homo sapien
aaccctgttacaagtctgctggcag

SEQ ID NO: 355644 - DNA, 25 bp, Homo sapien
ctgctggcagcaacataagtgacac

SEQ ID NO: 355645 - DNA, 25 bp, Homo sapien
gtgacacaaagtgaaccgggttcta

SEQ ID NO: 355646 - DNA, 25 bp, Homo sapien
gaaccgggttctataaattaccatg

SEQ ID NO: 355647 - DNA, 25 bp, Homo sapien
tttggcagaacaaaaccctgaggat

SEQ ID NO: 355648 - DNA, 25 bp, Homo sapien
gcaaagaccagcaaggactagcaga

SEQ ID NO: 355649 - DNA, 25 bp, Homo sapien
agactagcagaaacttgcagggaca

SEQ ID NO: 355650 - DNA, 25 bp, Homo sapien
atattctttgtgcatgtgatttttt

SEQ ID NO: 355651 - DNA, 25 bp, Homo sapien
gttgaattgaaagctctcaggataa

SEQ ID NO: 355652 - DNA, 25 bp, Homo sapien
aattaatcctaaatattgtcgcatg

SEQ ID NO: 355653 - DNA, 25 bp, Homo sapien
tattgtcgcatgttgacctacgtta

SEQ ID NO: 355654 - DNA, 25 bp, Homo sapien
cgcatgttgacctacgttaaaagat

SEQ ID NO: 355655 - DNA, 25 bp, Homo sapien
gaataggtctagagccgtgatttca

SEQ ID NO: 355656 - DNA, 25 bp, Homo sapien
gccgtgatttcaagctattttcctg

SEQ ID NO: 355657 - DNA, 25 bp, Homo sapien
tgaaatgcttcagggattccataaa

SEQ ID NO: 355658 - DNA, 25 bp, Homo sapien
gagatatatactacaagtgctaaga

SEQ ID NO: 355659 - DNA, 25 bp, Homo sapien
agtgctaagaatatagtaccttgta

SEQ ID NO: 355660 - DNA, 25 bp, Homo sapien
tatagtaccttgtatttttgttgat

SEQ ID NO: 355661 - DNA, 25 bp, Homo sapien
gatgcacgtgagatggtcactgcca

SEQ ID NO: 355662 - DNA, 25 bp, Homo sapien
caagatgctgctaatgtatactgga

SEQ ID NO: 355663 - DNA, 25 bp, Homo sapien
gtatactggaatagccccatggttt

SEQ ID NO: 355664 - DNA, 25 bp, Homo sapien
aatagccccatggtttacctgtgat

SEQ ID NO: 355665 - DNA, 25 bp, Homo sapien
ggtttacctgtgattggcatccatc

SEQ ID NO: 355666 - DNA, 25 bp, Homo sapien
tggcatccatcctgactggtctgtg

SEQ ID NO: 355667 - DNA, 25 bp, Homo sapien
tgtgcctatgctctcacttgttata

SEQ ID NO: 355668 - DNA, 25 bp, Homo sapien
atatcatctctgtcaacttccagtg

SEQ ID NO: 355669 - DNA, 25 bp, Homo sapien
gtcaacttccagtgaaaacgttagg

SEQ ID NO: 355670 - DNA, 25 bp, Homo sapien
gtgggaacgggatgcaaagtacaaa

SEQ ID NO: 355671 - DNA, 25 bp, Homo sapien
aaatggacacgcttttactgagaag

SEQ ID NO: 355672 - DNA, 25 bp, Homo sapien
catgtgttcattgtgcgtatgtgtg

SEQ ID NO: 355673 - DNA, 25 bp, Homo sapien
gcatgtgtgcgcgtattacgcttgc

SEQ ID NO: 355674 - DNA, 25 bp, Homo sapien
gcgcgtattacgcttgctaaaattt

SEQ ID NO: 355675 - DNA, 25 bp, Homo sapien
tacgcttgctaaaatttgttctgaa

SEQ ID NO: 355676 - DNA, 25 bp, Homo sapien
aacatcagggaatctactattcaga

SEQ ID NO: 355677 - DNA, 25 bp, Homo sapien
ggtcgtataaaacccttgacactgt

SEQ ID NO: 355678 - DNA, 25 bp, Homo sapien
gacactgtctagaccattttctgat

SEQ ID NO: 355679 - DNA, 25 bp, Homo sapien
gtctagaccattttctgatgtgaat

SEQ ID NO: 355680 - DNA, 25 bp, Homo sapien
gatgtgaatacttttgagaggatca

SEQ ID NO: 355681 - DNA, 25 bp, Homo sapien
gagaggatcaactattggctcatta

SEQ ID NO: 355682 - DNA, 25 bp, Homo sapien
ttggctcattaatgatatcagtatc

SEQ ID NO: 355683 - DNA, 25 bp, Homo sapien
cagctaccaccctgtgctttaaaaa

SEQ ID NO: 355684 - DNA, 25 bp, Homo sapien
acactcaaccctctttagcttggag

SEQ ID NO: 355685 - DNA, 25 bp, Homo sapien
tttagcttggagctcagctttttgc

SEQ ID NO: 355686 - DNA, 25 bp, Homo sapien
tattctgattgctacctgatggcca

SEQ ID NO: 355687 - DNA, 25 bp, Homo sapien
gatggccattcttacttagtttcat

SEQ ID NO: 355688 - DNA, 25 bp, Homo sapien
atgtgctttaactatgatcctttga

SEQ ID NO: 355689 - DNA, 25 bp, Homo sapien
tatgatcctttgaagctcacccctt

SEQ ID NO: 355690 - DNA, 25 bp, Homo sapien
ctcaccccttggagagcctacagaa

SEQ ID NO: 355691 - DNA, 25 bp, Homo sapien
agaacctcaggctgatagctttgaa

SEQ ID NO: 355692 - DNA, 25 bp, Homo sapien
gaagactgccaaacagcccagaagg

SEQ ID NO: 355693 - DNA, 25 bp, Homo sapien
atctgcataatcaggagggttgtat

SEQ ID NO: 355694 - DNA, 25 bp, Homo sapien
ccattcctgaggccagtgggatgaa

SEQ ID NO: 355695 - DNA, 25 bp, Homo sapien
aacaaatcacacttaatcctcagat

SEQ ID NO: 355696 - DNA, 25 bp, Homo sapien
aaatcacacttaatcctcagatagt

SEQ ID NO: 355697 - DNA, 25 bp, Homo sapien
atcacacttaatcctcagatagtgg

SEQ ID NO: 355698 - DNA, 25 bp, Homo sapien
cacttaatcctcagatagtggttaa

SEQ ID NO: 355699 - DNA, 25 bp, Homo sapien
aatcctcagatagtggttaattctc

SEQ ID NO: 355700 - DNA, 25 bp, Homo sapien
tcctcagatagtggttaattctcat

SEQ ID NO: 355701 - DNA, 25 bp, Homo sapien
ctcagatagtggttaattctcataa

SEQ ID NO: 355702 - DNA, 25 bp, Homo sapien
cagatagtggttaattctcataatt

SEQ ID NO: 355703 - DNA, 25 bp, Homo sapien
tcaatttggctttttcgagatgggg

SEQ ID NO: 355704 - DNA, 25 bp, Homo sapien
gggttgacaagcatttcagttttta

SEQ ID NO: 355705 - DNA, 25 bp, Homo sapien
aagtgagagacttactctgggccaa

SEQ ID NO: 355706 - DNA, 25 bp, Homo sapien
gtgatcatgagaatgctgcctttaa

SEQ ID NO: 355707 - DNA, 25 bp, Homo sapien
tctgggccaagtttaccaactctga

SEQ ID NO: 355708 - DNA, 25 bp, Homo sapien
tcaaccacatggactcagacaaatt

SEQ ID NO: 355709 - DNA, 25 bp, Homo sapien
ggctgtggagccgaatttcacacct

SEQ ID NO: 355710 - DNA, 25 bp, Homo sapien
gaatttcacacctggtactgccagt

SEQ ID NO: 355711 - DNA, 25 bp, Homo sapien
tgccagtccagccaatcttagatgc

SEQ ID NO: 355712 - DNA, 25 bp, Homo sapien
gttacatccacaaaaccagtgttgc

SEQ ID NO: 355713 - DNA, 25 bp, Homo sapien
accagtgttgccttgtataactatt

SEQ ID NO: 355714 - DNA, 25 bp, Homo sapien
aaagatgtggccctggtcctgactg

SEQ ID NO: 355715 - DNA, 25 bp, Homo sapien
tggtcctgactgttctgctagagga

SEQ ID NO: 355716 - DNA, 25 bp, Homo sapien
attttgcacaagtggcactagcccc

SEQ ID NO: 355717 - DNA, 25 bp, Homo sapien
tgcacaagtggcactagccccaggg

SEQ ID NO: 355718 - DNA, 25 bp, Homo sapien
acaagtggcactagccccagggcca

SEQ ID NO: 355719 - DNA, 25 bp, Homo sapien
gagtcggaaggcgaagagcctacca

SEQ ID NO: 355720 - DNA, 25 bp, Homo sapien
aggcgaagagcctaccaccaggtct

SEQ ID NO: 355721 - DNA, 25 bp, Homo sapien
ggaccatatttattgcatgcgcccc

SEQ ID NO: 355722 - DNA, 25 bp, Homo sapien
atatttattgcatgcgccccggcgg

SEQ ID NO: 355723 - DNA, 25 bp, Homo sapien
acccaccccgggactgataatgtga

SEQ ID NO: 355724 - DNA, 25 bp, Homo sapien
accccgggactgataatgtgaagtt

SEQ ID NO: 355725 - DNA, 25 bp, Homo sapien
gataatgtgaagttcctcattttgc

SEQ ID NO: 355726 - DNA, 25 bp, Homo sapien
gttcctcattttgcacaagtggcac

SEQ ID NO: 355727 - DNA, 25 bp, Homo sapien
agcccttcttgtgtatgttctgata

SEQ ID NO: 355728 - DNA, 25 bp, Homo sapien
tatgttctgatatccctttgctcta

SEQ ID NO: 355729 - DNA, 25 bp, Homo sapien
atccctttgctctacttttagagga

SEQ ID NO: 355730 - DNA, 25 bp, Homo sapien
ataggatggtagcagcattcttgtt

SEQ ID NO: 355731 - DNA, 25 bp, Homo sapien
ctttatatctctcctctgtgattgt

SEQ ID NO: 355732 - DNA, 25 bp, Homo sapien
tctcctctgtgattgtataccgttt

SEQ ID NO: 355733 - DNA, 25 bp, Homo sapien
tgattgtataccgttttttcaactt

SEQ ID NO: 355734 - DNA, 25 bp, Homo sapien
gcaacttcagctggaaatatgtaga

SEQ ID NO: 355735 - DNA, 25 bp, Homo sapien
ttggccaaggtgaactaaatagtct

SEQ ID NO: 355736 - DNA, 25 bp, Homo sapien
tcaagcaacgtgagcatggtagcaa

SEQ ID NO: 355737 - DNA, 25 bp, Homo sapien
aagcactaactgaagccagtgattt

SEQ ID NO: 355738 - DNA, 25 bp, Homo sapien
tccactctgaggcattacactacac

SEQ ID NO: 355739 - DNA, 25 bp, Homo sapien
cactctgaggcattacactacacgg

SEQ ID NO: 355740 - DNA, 25 bp, Homo sapien
ctctgaggcattacactacacggtg

SEQ ID NO: 355741 - DNA, 25 bp, Homo sapien
tgaggcattacactacacggtggaa

SEQ ID NO: 355742 - DNA, 25 bp, Homo sapien
gcattacactacacggtggaaggct

SEQ ID NO: 355743 - DNA, 25 bp, Homo sapien
tacactacacggtggaaggctgatt

SEQ ID NO: 355744 - DNA, 25 bp, Homo sapien
aaacacggaaggttatgtaatgcag

SEQ ID NO: 355745 - DNA, 25 bp, Homo sapien
cggaaggttatgtaatgcagtgcca

SEQ ID NO: 355746 - DNA, 25 bp, Homo sapien
gttatgtaatgcagtgccatttcca

SEQ ID NO: 355747 - DNA, 25 bp, Homo sapien
aaaatatccactctgaggcattaca

SEQ ID NO: 355748 - DNA, 25 bp, Homo sapien
atatccactctgaggcattacacta

SEQ ID NO: 355749 - DNA, 25 bp, Homo sapien
atcgtgcaaggatgttgatgttacc

SEQ ID NO: 355750 - DNA, 25 bp, Homo sapien
gatgttgatgttaccagggagacaa

SEQ ID NO: 355751 - DNA, 25 bp, Homo sapien
gtggaagcgcaggatcaggttcctt

SEQ ID NO: 355752 - DNA, 25 bp, Homo sapien
gcaggatcaggttccttagagggta

SEQ ID NO: 355753 - DNA, 25 bp, Homo sapien
ccttagagggtagctcgcggcagaa

SEQ ID NO: 355754 - DNA, 25 bp, Homo sapien
gtagctcgcggcagaagtgtgcaaa

SEQ ID NO: 355755 - DNA, 25 bp, Homo sapien
aagcccctgaggatgaattgtggag

SEQ ID NO: 355756 - DNA, 25 bp, Homo sapien
aggatgaattgtggaggactgctca

SEQ ID NO: 355757 - DNA, 25 bp, Homo sapien
ggactgctcagggtgtcctgctgtc

SEQ ID NO: 355758 - DNA, 25 bp, Homo sapien
agggcgtgtcactgcctagtggctc

SEQ ID NO: 355759 - DNA, 25 bp, Homo sapien
gcctagtggctcatcgtgcaaggat

SEQ ID NO: 355760 - DNA, 25 bp, Homo sapien
tgctgagacccacctctgatccatg

SEQ ID NO: 355761 - DNA, 25 bp, Homo sapien
tgagacccacctctgatccatgatt

SEQ ID NO: 355762 - DNA, 25 bp, Homo sapien
gagacccacctctgatccatgattc

SEQ ID NO: 355763 - DNA, 25 bp, Homo sapien
tctgatccatgattccccttcattg

SEQ ID NO: 355764 - DNA, 25 bp, Homo sapien
tgatccatgattccccttcattgcc

SEQ ID NO: 355765 - DNA, 25 bp, Homo sapien
caggcccaatttcccagccgcttgc

SEQ ID NO: 355766 - DNA, 25 bp, Homo sapien
ttgcccctcagatcggatgcttggc

SEQ ID NO: 355767 - DNA, 25 bp, Homo sapien
tgcccctcagatcggatgcttggcc

SEQ ID NO: 355768 - DNA, 25 bp, Homo sapien
tcagatcggatgcttggcccccaga

SEQ ID NO: 355769 - DNA, 25 bp, Homo sapien
gtgctgtacggtgctgtgggatctg

SEQ ID NO: 355770 - DNA, 25 bp, Homo sapien
ctgtgggatctgcagatgaagcggt

SEQ ID NO: 355771 - DNA, 25 bp, Homo sapien
ggagtgaaaggtgcacccgcgacct

SEQ ID NO: 355772 - DNA, 25 bp, Homo sapien
gaccttgccttgctggctggctctg

SEQ ID NO: 355773 - DNA, 25 bp, Homo sapien
gctggctctgggactctgcgataag

SEQ ID NO: 355774 - DNA, 25 bp, Homo sapien
gataagccgccctccggttgtctgc

SEQ ID NO: 355775 - DNA, 25 bp, Homo sapien
ggttgtctgcgatagctcctgaagc

SEQ ID NO: 355776 - DNA, 25 bp, Homo sapien
tgaagcaggagagtgtctttcccac

SEQ ID NO: 355777 - DNA, 25 bp, Homo sapien
taacaggcggtatctgacccttcca

SEQ ID NO: 355778 - DNA, 25 bp, Homo sapien
aaggacgaagcttcccggcagagaa

SEQ ID NO: 355779 - DNA, 25 bp, Homo sapien
gaaacacctaaagccctcaaaatgg

SEQ ID NO: 355780 - DNA, 25 bp, Homo sapien
aaacgttgcgtggtgcagtcccaga

SEQ ID NO: 355781 - DNA, 25 bp, Homo sapien
cagacccaagcttctgggagtgaaa

SEQ ID NO: 355782 - DNA, 25 bp, Homo sapien
ggttcatacactccggggcaagatg

SEQ ID NO: 355783 - DNA, 25 bp, Homo sapien
ggcaagatgctacggccccgggcgg

SEQ ID NO: 355784 - DNA, 25 bp, Homo sapien
gagtcggcggcaaggcgagggaccc

SEQ ID NO: 355785 - DNA, 25 bp, Homo sapien
gcaaggcgagggacccggccggctc

SEQ ID NO: 355786 - DNA, 25 bp, Homo sapien
ctcccgcatgtgtcgctgcggctgg

SEQ ID NO: 355787 - DNA, 25 bp, Homo sapien
gcatgtgtcgctgcggctgggaccc

SEQ ID NO: 355788 - DNA, 25 bp, Homo sapien
acgccccacgggacgaggcagaagc

SEQ ID NO: 355789 - DNA, 25 bp, Homo sapien
cccacgggacgaggcagaagctctg

SEQ ID NO: 355790 - DNA, 25 bp, Homo sapien
ggcagaagctctggcgcctcctcag

SEQ ID NO: 355791 - DNA, 25 bp, Homo sapien
gaagctctggcgcctcctcagcgtt

SEQ ID NO: 355792 - DNA, 25 bp, Homo sapien
ttggggccccggttcatacactccg

SEQ ID NO: 355793 - DNA, 25 bp, Homo sapien
gtgaatgctaatccatgcacataca

SEQ ID NO: 355794 - DNA, 25 bp, Homo sapien
aatccatgcacatacatgtctataa

SEQ ID NO: 355795 - DNA, 25 bp, Homo sapien
ggaaccatctgtgtctatgtcaagc

SEQ ID NO: 355796 - DNA, 25 bp, Homo sapien
tgctattttaaaggcctagatgaga

SEQ ID NO: 355797 - DNA, 25 bp, Homo sapien
tgtgtctatgtcaagctaaactggg

SEQ ID NO: 355798 - DNA, 25 bp, Homo sapien
ttcataccagggtctccaaccatag

SEQ ID NO: 355799 - DNA, 25 bp, Homo sapien
agctcactcggcttctggatgtacg

SEQ ID NO: 355800 - DNA, 25 bp, Homo sapien
tggatgtacgactcccacaggtgga

SEQ ID NO: 355801 - DNA, 25 bp, Homo sapien
tgtacgactcccacaggtggaggaa

SEQ ID NO: 355802 - DNA, 25 bp, Homo sapien
aagtctgctgaaaattgttattcat

SEQ ID NO: 355803 - DNA, 25 bp, Homo sapien
caagggaatgtgtgtgaatgctaat

SEQ ID NO: 355804 - DNA, 25 bp, Homo sapien
gaagctaactttgatccaggtctta

SEQ ID NO: 355805 - DNA, 25 bp, Homo sapien
tagtttatagcttcaacctaatcat

SEQ ID NO: 355806 - DNA, 25 bp, Homo sapien
ttaaggccacttaagccactgtgct

SEQ ID NO: 355807 - DNA, 25 bp, Homo sapien
acttaagccactgtgctcagactgt

SEQ ID NO: 355808 - DNA, 25 bp, Homo sapien
gctcagactgtcaagatatttagtt

SEQ ID NO: 355809 - DNA, 25 bp, Homo sapien
aagatatttagtttctcaaagcaga

SEQ ID NO: 355810 - DNA, 25 bp, Homo sapien
tactcttgtcaattcaacatatggg

SEQ ID NO: 355811 - DNA, 25 bp, Homo sapien
atggtttatcaactgcagaatattc

SEQ ID NO: 355812 - DNA, 25 bp, Homo sapien
gtggaactgaatggtaactactgac

SEQ ID NO: 355813 - DNA, 25 bp, Homo sapien
tggtaactactgacaacatagctca

SEQ ID NO: 355814 - DNA, 25 bp, Homo sapien
aaggacgtgctaaaacatgctggat

SEQ ID NO: 355815 - DNA, 25 bp, Homo sapien
ttcatggacacaagctgtatatatc

SEQ ID NO: 355816 - DNA, 25 bp, Homo sapien
ggacacaagctgtatatatcagttt

SEQ ID NO: 355817 - DNA, 25 bp, Homo sapien
tatcagtttaccatggttttcagtg

SEQ ID NO: 355818 - DNA, 25 bp, Homo sapien
cagtttaccatggttttcagtgtaa

SEQ ID NO: 355819 - DNA, 25 bp, Homo sapien
aaaagcaacttatgtccttcagtgt

SEQ ID NO: 355820 - DNA, 25 bp, Homo sapien
atgtccttcagtgtcagtttattga

SEQ ID NO: 355821 - DNA, 25 bp, Homo sapien
gtgtcagtttattgagctcttcagt

SEQ ID NO: 355822 - DNA, 25 bp, Homo sapien
ttattgagctcttcagtgcagcctc

SEQ ID NO: 355823 - DNA, 25 bp, Homo sapien
tgagctcttcagtgcagcctcataa

SEQ ID NO: 355824 - DNA, 25 bp, Homo sapien
ttcagtgcagcctcataacttatat

SEQ ID NO: 355825 - DNA, 25 bp, Homo sapien
gtgcagcctcataacttatattaat

SEQ ID NO: 355826 - DNA, 25 bp, Homo sapien
tggtgaccacccacgaggaccctgt

SEQ ID NO: 355827 - DNA, 25 bp, Homo sapien
acgaggaccctgtcattgccgtctt

SEQ ID NO: 355828 - DNA, 25 bp, Homo sapien
tcattgccgtcttccaggctctgct

SEQ ID NO: 355829 - DNA, 25 bp, Homo sapien
ctggaggagattatgtacaacgaga

SEQ ID NO: 355830 - DNA, 25 bp, Homo sapien
atgtacaacgagaacacgcggcgct

SEQ ID NO: 355831 - DNA, 25 bp, Homo sapien
gtacaacgagaacacgcggcgctcc

SEQ ID NO: 355832 - DNA, 25 bp, Homo sapien
tgctcatgctgtttgacaagttccg

SEQ ID NO: 355833 - DNA, 25 bp, Homo sapien
tcatgctgtttgacaagttccgcag

SEQ ID NO: 355834 - DNA, 25 bp, Homo sapien
tgtttgacaagttccgcagcgtgct

SEQ ID NO: 355835 - DNA, 25 bp, Homo sapien
acaagttccgcagcgtgctggtggt

SEQ ID NO: 355836 - DNA, 25 bp, Homo sapien
gcgtgctggtggtgaccacccacga

SEQ ID NO: 355837 - DNA, 25 bp, Homo sapien
gagacctggcagactaaagtctcta

SEQ ID NO: 355838 - DNA, 25 bp, Homo sapien
aaagtctctagtgtttgtttgctca

SEQ ID NO: 355839 - DNA, 25 bp, Homo sapien
gtttgctcacatttgctgagtgaca

SEQ ID NO: 355840 - DNA, 25 bp, Homo sapien
acagctatgtgccagactgcataaa

SEQ ID NO: 355841 - DNA, 25 bp, Homo sapien
atgtgttccaggcattcttctaagt

SEQ ID NO: 355842 - DNA, 25 bp, Homo sapien
caggcattcttctaagtggtttaca

SEQ ID NO: 355843 - DNA, 25 bp, Homo sapien
gtggtttacatgcactgtctcattt

SEQ ID NO: 355844 - DNA, 25 bp, Homo sapien
aaggatacttaagcccaaactatat

SEQ ID NO: 355845 - DNA, 25 bp, Homo sapien
tatatctaaacccaaatctcacttg

SEQ ID NO: 355846 - DNA, 25 bp, Homo sapien
aatctcacttggctggaaacatcaa

SEQ ID NO: 355847 - DNA, 25 bp, Homo sapien
ggaaacatcaatcttaaccatttat

SEQ ID NO: 355848 - DNA, 25 bp, Homo sapien
gataaatttgagttcagaaggcaat

SEQ ID NO: 355849 - DNA, 25 bp, Homo sapien
actcagtttattgctggggaaccaa

SEQ ID NO: 355850 - DNA, 25 bp, Homo sapien
aatatttgggtgtttcagtgattca

SEQ ID NO: 355851 - DNA, 25 bp, Homo sapien
gttaatatttgtcaagccaccctgt

SEQ ID NO: 355852 - DNA, 25 bp, Homo sapien
gccaccctgtgtaaaaaactgtaat

SEQ ID NO: 355853 - DNA, 25 bp, Homo sapien
gaagttttctcttttgagaagctta

SEQ ID NO: 355854 - DNA, 25 bp, Homo sapien
ggtgtttcagtgattcagaatattc

SEQ ID NO: 355855 - DNA, 25 bp, Homo sapien
gacatctactgcaaaataggactac

SEQ ID NO: 355856 - DNA, 25 bp, Homo sapien
taggactactaaatacatatacttt

SEQ ID NO: 355857 - DNA, 25 bp, Homo sapien
gattcagaatattcaactttaagca

SEQ ID NO: 355858 - DNA, 25 bp, Homo sapien
gcagaatttgtcttacagaatgtta

SEQ ID NO: 355859 - DNA, 25 bp, Homo sapien
gttttctgaactgagaagcccatat

SEQ ID NO: 355860 - DNA, 25 bp, Homo sapien
actgagaagcccatatcaatgcaca

SEQ ID NO: 355861 - DNA, 25 bp, Homo sapien
gaaaggacggttcgagctatgaaat

SEQ ID NO: 355862 - DNA, 25 bp, Homo sapien
gccttgggtgttttgaacctgatct

SEQ ID NO: 355863 - DNA, 25 bp, Homo sapien
gaaatgttgaggacacctacacgtg

SEQ ID NO: 355864 - DNA, 25 bp, Homo sapien
ggacacctacacgtgattctggagc

SEQ ID NO: 355865 - DNA, 25 bp, Homo sapien
gattctggagcctttctcatcataa

SEQ ID NO: 355866 - DNA, 25 bp, Homo sapien
gagcctttctcatcataagactgtg

SEQ ID NO: 355867 - DNA, 25 bp, Homo sapien
gtggaaaatacacagtcgtttaagt

SEQ ID NO: 355868 - DNA, 25 bp, Homo sapien
gaacctgatctgcataaaaccatat

SEQ ID NO: 355869 - DNA, 25 bp, Homo sapien
gtattcaaatgctgtatctttcatg

SEQ ID NO: 355870 - DNA, 25 bp, Homo sapien
tgcgtgtcttcatgcttataccgac

SEQ ID NO: 355871 - DNA, 25 bp, Homo sapien
atggctatcgcctcttctcctacag

SEQ ID NO: 355872 - DNA, 25 bp, Homo sapien
ctacagcatccagaccaagagcaat

SEQ ID NO: 355873 - DNA, 25 bp, Homo sapien
aagtctcaagtttggtaagagccag

SEQ ID NO: 355874 - DNA, 25 bp, Homo sapien
tggtaagagccagtccattgtggga

SEQ ID NO: 355875 - DNA, 25 bp, Homo sapien
gctgtccccagaagaaatctggttt

SEQ ID NO: 355876 - DNA, 25 bp, Homo sapien
ctggtttgtgtatcaaggtatctac

SEQ ID NO: 355877 - DNA, 25 bp, Homo sapien
gaatctaatagtgctcacgtgagct

SEQ ID NO: 355878 - DNA, 25 bp, Homo sapien
gctcacgtgagcttgatcacacagc

SEQ ID NO: 355879 - DNA, 25 bp, Homo sapien
gatcacacagctggagaaatctaca

SEQ ID NO: 355880 - DNA, 25 bp, Homo sapien
atctacagaacttcactgcgtgtct

SEQ ID NO: 355881 - DNA, 25 bp, Homo sapien
gtgaaagagaactgtatctacttgc

SEQ ID NO: 355882 - DNA, 25 bp, Homo sapien
gtatctacttgcagagttcaaactt

SEQ ID NO: 355883 - DNA, 25 bp, Homo sapien
tgcagagttcaaacttttcaggttt

SEQ ID NO: 355884 - DNA, 25 bp, Homo sapien
tcaggtttgttttaggtaagcctat

SEQ ID NO: 355885 - DNA, 25 bp, Homo sapien
taggtaagcctattttatattagaa

SEQ ID NO: 355886 - DNA, 25 bp, Homo sapien
gtggtgattatcttatatttaacat

SEQ ID NO: 355887 - DNA, 25 bp, Homo sapien
taaggatttaccttgtcatttgttt

SEQ ID NO: 355888 - DNA, 25 bp, Homo sapien
aaatgtattgactgtatgactcaag

SEQ ID NO: 355889 - DNA, 25 bp, Homo sapien
gtatgactcaagttataacggacag

SEQ ID NO: 355890 - DNA, 25 bp, Homo sapien
gaagtacatcttcatttaaacgaag

SEQ ID NO: 355891 - DNA, 25 bp, Homo sapien
taaacgaagtacattgtctaaagag

SEQ ID NO: 355892 - DNA, 25 bp, Homo sapien
attccagctcccagttttatcctat

SEQ ID NO: 355893 - DNA, 25 bp, Homo sapien
ccagttttatcctatgttgctcata

SEQ ID NO: 355894 - DNA, 25 bp, Homo sapien
agtatactgcattatcttgagattt

SEQ ID NO: 355895 - DNA, 25 bp, Homo sapien
agatttgaagatatggtgcccacgg

SEQ ID NO: 355896 - DNA, 25 bp, Homo sapien
tctggcctaggtgttgtattttaag

SEQ ID NO: 355897 - DNA, 25 bp, Homo sapien
ggtgttgtattttaagagactctat

SEQ ID NO: 355898 - DNA, 25 bp, Homo sapien
gagactctatcttaggagagcttaa

SEQ ID NO: 355899 - DNA, 25 bp, Homo sapien
agcttaagtgattgggctgcaggaa

SEQ ID NO: 355900 - DNA, 25 bp, Homo sapien
tactgtgttgctattctgttttatg

SEQ ID NO: 355901 - DNA, 25 bp, Homo sapien
aaacttctgtctatgcatttgaact

SEQ ID NO: 355902 - DNA, 25 bp, Homo sapien
actaagtttcagcaaattcaatcta

SEQ ID NO: 355903 - DNA, 25 bp, Homo sapien
cctgcaccacggcatagcttaggtg

SEQ ID NO: 355904 - DNA, 25 bp, Homo sapien
ggcatagcttaggtgcgccgtcctg

SEQ ID NO: 355905 - DNA, 25 bp, Homo sapien
catagcttaggtgcgccgtcctggg

SEQ ID NO: 355906 - DNA, 25 bp, Homo sapien
gtcgctgccgagagcgcctggactt

SEQ ID NO: 355907 - DNA, 25 bp, Homo sapien
tggacttcgacgtcccaccagcggg

SEQ ID NO: 355908 - DNA, 25 bp, Homo sapien
gggaacactgctgtcgtgtgaagtc

SEQ ID NO: 355909 - DNA, 25 bp, Homo sapien
aacactgctgtcgtgtgaagtcaca

SEQ ID NO: 355910 - DNA, 25 bp, Homo sapien
tgaagtcacagtggccttgttggtg

SEQ ID NO: 355911 - DNA, 25 bp, Homo sapien
acagtggccttgttggtgcccacag

SEQ ID NO: 355912 - DNA, 25 bp, Homo sapien
tggccttgttggtgcccacagggct

SEQ ID NO: 355913 - DNA, 25 bp, Homo sapien
ttggtgcccacagggctgtgtggat

SEQ ID NO: 355914 - DNA, 25 bp, Homo sapien
agagacccagccttattcatctcta

SEQ ID NO: 355915 - DNA, 25 bp, Homo sapien
ttcatctctacttcctgatgtccat

SEQ ID NO: 355916 - DNA, 25 bp, Homo sapien
gatgtccatagtggtgtgtcatgaa

SEQ ID NO: 355917 - DNA, 25 bp, Homo sapien
tgaggagagatggttttctcctgct

SEQ ID NO: 355918 - DNA, 25 bp, Homo sapien
tcctgctcagctcttacacagtgat

SEQ ID NO: 355919 - DNA, 25 bp, Homo sapien
tgctcagctcttacacagtgatagg

SEQ ID NO: 355920 - DNA, 25 bp, Homo sapien
gtgataggtttgttccatgggactt

SEQ ID NO: 355921 - DNA, 25 bp, Homo sapien
gttccatgggacttatcataggcct

SEQ ID NO: 355922 - DNA, 25 bp, Homo sapien
gaaagagcatttttcatgactcaaa

SEQ ID NO: 355923 - DNA, 25 bp, Homo sapien
aggtgcggcgtcatgcacctatagt

SEQ ID NO: 355924 - DNA, 25 bp, Homo sapien
ggctaaggcagaaagaccattcaag

SEQ ID NO: 355925 - DNA, 25 bp, Homo sapien
gtttgcagggacagttagagtcaat

SEQ ID NO: 355926 - DNA, 25 bp, Homo sapien
gaattctcagaataagcactgccag

SEQ ID NO: 355927 - DNA, 25 bp, Homo sapien
aataagtcactgtaatccaatataa

SEQ ID NO: 355928 - DNA, 25 bp, Homo sapien
aagcactgccagatagtccggaagc

SEQ ID NO: 355929 - DNA, 25 bp, Homo sapien
gatagtccggaagccctttacaagg

SEQ ID NO: 355930 - DNA, 25 bp, Homo sapien
ggaaagtgacatttttgctgtgttt

SEQ ID NO: 355931 - DNA, 25 bp, Homo sapien
aaaggatatcactagcagaagaaat

SEQ ID NO: 355932 - DNA, 25 bp, Homo sapien
aaatgcctctttgtaaaaccataga

SEQ ID NO: 355933 - DNA, 25 bp, Homo sapien
ataactctgagttgccatataggac

SEQ ID NO: 355934 - DNA, 25 bp, Homo sapien
gatactatcatactaatttttctgg

SEQ ID NO: 355935 - DNA, 25 bp, Homo sapien
tattttttccagagtttgcagggac

SEQ ID NO: 355936 - DNA, 25 bp, Homo sapien
tatggacatccatctactctacaca

SEQ ID NO: 355937 - DNA, 25 bp, Homo sapien
ctttcttttcccattgaattgcgtg

SEQ ID NO: 355938 - DNA, 25 bp, Homo sapien
gaatggtcatatatttgggtctgtt

SEQ ID NO: 355939 - DNA, 25 bp, Homo sapien
actctgttctttccacttggactaa

SEQ ID NO: 355940 - DNA, 25 bp, Homo sapien
ggactaattatccattcttgcatca

SEQ ID NO: 355941 - DNA, 25 bp, Homo sapien
ccattcttgcatcagtaccatactt

SEQ ID NO: 355942 - DNA, 25 bp, Homo sapien
actgtagtttatggtaagtcttgac

SEQ ID NO: 355943 - DNA, 25 bp, Homo sapien
gacatggtattgtaaaccctccagt

SEQ ID NO: 355944 - DNA, 25 bp, Homo sapien
tggtattgtaaaccctccagttttg

SEQ ID NO: 355945 - DNA, 25 bp, Homo sapien
gttttgactatttaagtgctttaca

SEQ ID NO: 355946 - DNA, 25 bp, Homo sapien
ttaagtgctttacatttccatataa

SEQ ID NO: 355947 - DNA, 25 bp, Homo sapien
gggtgctgaacaactcaaataatat

SEQ ID NO: 355948 - DNA, 25 bp, Homo sapien
taatatctgacctcaaatgactcgt

SEQ ID NO: 355949 - DNA, 25 bp, Homo sapien
caaatgactcgtcatgcctagtcaa

SEQ ID NO: 355950 - DNA, 25 bp, Homo sapien
taggaagatcatgcccttcggattc

SEQ ID NO: 355951 - DNA, 25 bp, Homo sapien
tcggattcactcgaagggcattttt

SEQ ID NO: 355952 - DNA, 25 bp, Homo sapien
aagggcatttttgcctgaggcccgt

SEQ ID NO: 355953 - DNA, 25 bp, Homo sapien
aggcccgtgcctcagcctaaagcta

SEQ ID NO: 355954 - DNA, 25 bp, Homo sapien
aagctacccacatatttgccaaatc

SEQ ID NO: 355955 - DNA, 25 bp, Homo sapien
atcactacttgttatacaaccctcc

SEQ ID NO: 355956 - DNA, 25 bp, Homo sapien
ttatacaaccctcctgattatgcag

SEQ ID NO: 355957 - DNA, 25 bp, Homo sapien
gaaaatttcccaggagaatgcctac

SEQ ID NO: 355958 - DNA, 25 bp, Homo sapien
ttgctaggattttttctgctatcag

SEQ ID NO: 355959 - DNA, 25 bp, Homo sapien
tctgctatcagatgtgttttcactc

SEQ ID NO: 355960 - DNA, 25 bp, Homo sapien
gtgttttcactctaaacctagtctt

SEQ ID NO: 355961 - DNA, 25 bp, Homo sapien
taaacctagtcttttatgacatgaa

SEQ ID NO: 355962 - DNA, 25 bp, Homo sapien
tgacatgaattgattacttcctgtt

SEQ ID NO: 355963 - DNA, 25 bp, Homo sapien
tcctgttaattttctatcctccctt

SEQ ID NO: 355964 - DNA, 25 bp, Homo sapien
ttaattttctatcctcccttactat

SEQ ID NO: 355965 - DNA, 25 bp, Homo sapien
gtattcagtatttcagtattctaga

SEQ ID NO: 355966 - DNA, 25 bp, Homo sapien
cagtatttcagtattctagagtaga

SEQ ID NO: 355967 - DNA, 25 bp, Homo sapien
aattcttacatcatcttttgcaaca

SEQ ID NO: 355968 - DNA, 25 bp, Homo sapien
catatgttcatatgcccctatgttt

SEQ ID NO: 355969 - DNA, 25 bp, Homo sapien
tgtggccagaaatagcccctgacgt

SEQ ID NO: 355970 - DNA, 25 bp, Homo sapien
gtgaccttcgaggaacagcgttctt

SEQ ID NO: 355971 - DNA, 25 bp, Homo sapien
gaacagcgttcttttttccattcgt

SEQ ID NO: 355972 - DNA, 25 bp, Homo sapien
ttccattcgtcagaattcctgccaa

SEQ ID NO: 355973 - DNA, 25 bp, Homo sapien
agatcaacacacaagctggtcggaa

SEQ ID NO: 355974 - DNA, 25 bp, Homo sapien
gaaagcgtggtttcctgatttgaaa

SEQ ID NO: 355975 - DNA, 25 bp, Homo sapien
aaggtcgacctccttcttcaggtca

SEQ ID NO: 355976 - DNA, 25 bp, Homo sapien
gacaagccagcatttgcacaaactc

SEQ ID NO: 355977 - DNA, 25 bp, Homo sapien
acaggagctgctgatttccagagaa

SEQ ID NO: 355978 - DNA, 25 bp, Homo sapien
ttcttcaggtcatggctgcaacagg

SEQ ID NO: 355979 - DNA, 25 bp, Homo sapien
aggatattttcatgcaagcctgcaa

SEQ ID NO: 355980 - DNA, 25 bp, Homo sapien
tactgtgttgtgtttatctaaatac

SEQ ID NO: 355981 - DNA, 25 bp, Homo sapien
tctaaatacgtaaactcaagctccc

SEQ ID NO: 355982 - DNA, 25 bp, Homo sapien
agatattccaatttgcatcagtctt

SEQ ID NO: 355983 - DNA, 25 bp, Homo sapien
attccaatttgcatcagtctttctg

SEQ ID NO: 355984 - DNA, 25 bp, Homo sapien
atttgcatcagtctttctgtggctc

SEQ ID NO: 355985 - DNA, 25 bp, Homo sapien
gcatcagtctttctgtggctcaaat

SEQ ID NO: 355986 - DNA, 25 bp, Homo sapien
tcagtctttctgtggctcaaataat

SEQ ID NO: 355987 - DNA, 25 bp, Homo sapien
gtctttctgtggctcaaataatgat

SEQ ID NO: 355988 - DNA, 25 bp, Homo sapien
ccctacttgtgaataattagctttc

SEQ ID NO: 355989 - DNA, 25 bp, Homo sapien
ataattagctttctcaaatgtaggc

SEQ ID NO: 355990 - DNA, 25 bp, Homo sapien
gctttctcaaatgtaggctttttac

SEQ ID NO: 355991 - DNA, 25 bp, Homo sapien
agggaaagtaaatcctcatgaggaa

SEQ ID NO: 355992 - DNA, 25 bp, Homo sapien
atcctcatgaggaaaagtacaaatg

SEQ ID NO: 355993 - DNA, 25 bp, Homo sapien
tggaaatcgtattaatttgtgaggc

SEQ ID NO: 355994 - DNA, 25 bp, Homo sapien
gtgaggcagggagttattttagatt

SEQ ID NO: 355995 - DNA, 25 bp, Homo sapien
aaacatgtactgagatgaatctaat

SEQ ID NO: 355996 - DNA, 25 bp, Homo sapien
tctaatttttagattgccctgtatt

SEQ ID NO: 355997 - DNA, 25 bp, Homo sapien
taatttttagattgccctgtatttt

SEQ ID NO: 355998 - DNA, 25 bp, Homo sapien
atatatgtacaacagtgtgtttgta

SEQ ID NO: 355999 - DNA, 25 bp, Homo sapien
gtaaatatataggaacgtttctgaa

SEQ ID NO: 356000 - DNA, 25 bp, Homo sapien
gaacagggtctgtgctatgtgtaaa

SEQ ID NO: 356001 - DNA, 25 bp, Homo sapien
gtctgtgctatgtgtaaaggtttgt

SEQ ID NO: 356002 - DNA, 25 bp, Homo sapien
tgcaccgacagcaccaaggtcacgg

SEQ ID NO: 356003 - DNA, 25 bp, Homo sapien
aaggtcacggcgcatcgcaagcacc

SEQ ID NO: 356004 - DNA, 25 bp, Homo sapien
agcaccacggcaaacaggacgtgat

SEQ ID NO: 356005 - DNA, 25 bp, Homo sapien
aaacaggacgtgatcagcgccgcgg

SEQ ID NO: 356006 - DNA, 25 bp, Homo sapien
agcgccgcgggcttctgccagttca

SEQ ID NO: 356007 - DNA, 25 bp, Homo sapien
ggcttctgccagttcagctccagcg

SEQ ID NO: 356008 - DNA, 25 bp, Homo sapien
agtacaagctcaagtgctcgcactt

SEQ ID NO: 356009 - DNA, 25 bp, Homo sapien
accgcgtggacaacctggtgctgga

SEQ ID NO: 356010 - DNA, 25 bp, Homo sapien
tggtgctggacgacttcaagcgctt

SEQ ID NO: 356011 - DNA, 25 bp, Homo sapien
tggacgacttcaagcgcttcaaggc

SEQ ID NO: 356012 - DNA, 25 bp, Homo sapien
acttcaagcgcttcaaggcctcact

SEQ ID NO: 356013 - DNA, 25 bp, Homo sapien
acccatggcttaaggtacatgagca

SEQ ID NO: 356014 - DNA, 25 bp, Homo sapien
gtacatgagcattcacaggtcacct

SEQ ID NO: 356015 - DNA, 25 bp, Homo sapien
atgagcattcacaggtcaccttcta

SEQ ID NO: 356016 - DNA, 25 bp, Homo sapien
ggtcaccttctacactttgtctgaa

SEQ ID NO: 356017 - DNA, 25 bp, Homo sapien
ccttctacactttgtctgaacactt

SEQ ID NO: 356018 - DNA, 25 bp, Homo sapien
ctgaacacttccagtgacaggaatg

SEQ ID NO: 356019 - DNA, 25 bp, Homo sapien
ccagtgacaggaatgcgttgctcta

SEQ ID NO: 356020 - DNA, 25 bp, Homo sapien
acaggaatgcgttgctctatgagat

SEQ ID NO: 356021 - DNA, 25 bp, Homo sapien
tatgagatggtcctttttacctttt

SEQ ID NO: 356022 - DNA, 25 bp, Homo sapien
ttcttttttctgagcagttttcatt

SEQ ID NO: 356023 - DNA, 25 bp, Homo sapien
tctgagcagttttcattagtttttt

SEQ ID NO: 356024 - DNA, 25 bp, Homo sapien
ttttttcccttcatgcccttgttat

SEQ ID NO: 356025 - DNA, 25 bp, Homo sapien
tcatgcccttgttatagttgacagt

SEQ ID NO: 356026 - DNA, 25 bp, Homo sapien
agttgacagtggttattctttcctg

SEQ ID NO: 356027 - DNA, 25 bp, Homo sapien
attctttcctgttacactgatgttg

SEQ ID NO: 356028 - DNA, 25 bp, Homo sapien
gttacactgatgttggccctggtca

SEQ ID NO: 356029 - DNA, 25 bp, Homo sapien
acatgtctgaccagaggccttcggt

SEQ ID NO: 356030 - DNA, 25 bp, Homo sapien
gccttcggtgttcttgtgtaatttt

SEQ ID NO: 356031 - DNA, 25 bp, Homo sapien
gtgtaatttttcttggcctcttata

SEQ ID NO: 356032 - DNA, 25 bp, Homo sapien
ggcctcttatactcttgctgtgaga

SEQ ID NO: 356033 - DNA, 25 bp, Homo sapien
atttataaataatcccagcactggt

SEQ ID NO: 356034 - DNA, 25 bp, Homo sapien
cagcactggtactttggacctgaaa

SEQ ID NO: 356035 - DNA, 25 bp, Homo sapien
tcacacacaaaagcttctccggtgg

SEQ ID NO: 356036 - DNA, 25 bp, Homo sapien
gcttctccggtggactcttggaaaa

SEQ ID NO: 356037 - DNA, 25 bp, Homo sapien
ctagtatgtctagtccctctgacat

SEQ ID NO: 356038 - DNA, 25 bp, Homo sapien
taggaccagttccacgtttccgtca

SEQ ID NO: 356039 - DNA, 25 bp, Homo sapien
ccacgtttccgtcagtatataccat

SEQ ID NO: 356040 - DNA, 25 bp, Homo sapien
atgatatctcggtcaacactgtaga

SEQ ID NO: 356041 - DNA, 25 bp, Homo sapien
aaacactgtcatggttgcttcggcc

SEQ ID NO: 356042 - DNA, 25 bp, Homo sapien
gtccctctgacatagactcattttc

SEQ ID NO: 356043 - DNA, 25 bp, Homo sapien
gtacagccaacagtgtcccagaatg

SEQ ID NO: 356044 - DNA, 25 bp, Homo sapien
taatgtcacttctcagttacctgga

SEQ ID NO: 356045 - DNA, 25 bp, Homo sapien
gatttccaaaatatccctcacacac

SEQ ID NO: 356046 - DNA, 25 bp, Homo sapien
gaatcttcacaatcttcaccttgag

SEQ ID NO: 356047 - DNA, 25 bp, Homo sapien
ttcaccttgagcattttctccttcc

SEQ ID NO: 356048 - DNA, 25 bp, Homo sapien
cttctcccacagcatatttggtcat

SEQ ID NO: 356049 - DNA, 25 bp, Homo sapien
gtcatgatctccaaccaagcagtat

SEQ ID NO: 356050 - DNA, 25 bp, Homo sapien
gcagtatctactaacttctctaagg

SEQ ID NO: 356051 - DNA, 25 bp, Homo sapien
aaggaggctgtgttatggtgaacca

SEQ ID NO: 356052 - DNA, 25 bp, Homo sapien
tggtgaaccatttccagaacaagct

SEQ ID NO: 356053 - DNA, 25 bp, Homo sapien
agaacaagcttctcataccaggcag

SEQ ID NO: 356054 - DNA, 25 bp, Homo sapien
aggcaggaaactcctccttcaaaag

SEQ ID NO: 356055 - DNA, 25 bp, Homo sapien
ttgtgtgttagctgactgcttccag

SEQ ID NO: 356056 - DNA, 25 bp, Homo sapien
agtactcttgcacgtccaaatgcgc

SEQ ID NO: 356057 - DNA, 25 bp, Homo sapien
ggacccagaatgttcccacactcag

SEQ ID NO: 356058 - DNA, 25 bp, Homo sapien
aatgttcccacactcagcaggcctt

SEQ ID NO: 356059 - DNA, 25 bp, Homo sapien
agcaggccttgccagtgagccctca

SEQ ID NO: 356060 - DNA, 25 bp, Homo sapien
aggctactgaactcacccggtgaga

SEQ ID NO: 356061 - DNA, 25 bp, Homo sapien
gaactcacccggtgagatgctgtgg

SEQ ID NO: 356062 - DNA, 25 bp, Homo sapien
agcacttcgggtgtcctggcaggtt

SEQ ID NO: 356063 - DNA, 25 bp, Homo sapien
cccaggagccctctgggtgacttaa

SEQ ID NO: 356064 - DNA, 25 bp, Homo sapien
agggcctgggcccatggtccccata

SEQ ID NO: 356065 - DNA, 25 bp, Homo sapien
atggtccccatagactccgtagctg

SEQ ID NO: 356066 - DNA, 25 bp, Homo sapien
catagactccgtagctgtcagtgag

SEQ ID NO: 356067 - DNA, 25 bp, Homo sapien
tgtcagtgagattagcaggcaggcc

SEQ ID NO: 356068 - DNA, 25 bp, Homo sapien
agatggtctccccactctgtgaata

SEQ ID NO: 356069 - DNA, 25 bp, Homo sapien
tgtgaatacacaagctcctgcgtcg

SEQ ID NO: 356070 - DNA, 25 bp, Homo sapien
tgcgtcgcacacctggtgaattgta

SEQ ID NO: 356071 - DNA, 25 bp, Homo sapien
gtagggcacacgaatctcactgaaa

SEQ ID NO: 356072 - DNA, 25 bp, Homo sapien
cccagatcagctctcagcaaatcag

SEQ ID NO: 356073 - DNA, 25 bp, Homo sapien
aggccgtctgccatgggttacacat

SEQ ID NO: 356074 - DNA, 25 bp, Homo sapien
gtggcctagcggttctgtctctgga

SEQ ID NO: 356075 - DNA, 25 bp, Homo sapien
tgtctctggaacacgtgcataccgg

SEQ ID NO: 356076 - DNA, 25 bp, Homo sapien
tgcataccggttccatgtctaggga

SEQ ID NO: 356077 - DNA, 25 bp, Homo sapien
gtctagggatatctgtagccccgtt

SEQ ID NO: 356078 - DNA, 25 bp, Homo sapien
tgtagccccgtttgttgtagtggaa

SEQ ID NO: 356079 - DNA, 25 bp, Homo sapien
ccccagtgtgatgcaagttgcatga

SEQ ID NO: 356080 - DNA, 25 bp, Homo sapien
gcatgatgctctttgctgtagtgcc

SEQ ID NO: 356081 - DNA, 25 bp, Homo sapien
tgctctttgctgtagtgccttttaa

SEQ ID NO: 356082 - DNA, 25 bp, Homo sapien
tgctgtagtgccttttaatggcata

SEQ ID NO: 356083 - DNA, 25 bp, Homo sapien
tttaatggcatagctttggcaggtt

SEQ ID NO: 356084 - DNA, 25 bp, Homo sapien
ttggcaggtttggagatgttcagaa

SEQ ID NO: 356085 - DNA, 25 bp, Homo sapien
tcctgtggtggatttgtggttgtct

SEQ ID NO: 356086 - DNA, 25 bp, Homo sapien
atttgtggttgtctaaggccctggt

SEQ ID NO: 356087 - DNA, 25 bp, Homo sapien
agcatggcatatttgtgtaatgcca

SEQ ID NO: 356088 - DNA, 25 bp, Homo sapien
gtgtaatgccatttgcatgacccac

SEQ ID NO: 356089 - DNA, 25 bp, Homo sapien
atgccatttgcatgacccacatggt

SEQ ID NO: 356090 - DNA, 25 bp, Homo sapien
cagaatttctgacattgtacatcaa

SEQ ID NO: 356091 - DNA, 25 bp, Homo sapien
ataccttatttcgaatgtcttttgg

SEQ ID NO: 356092 - DNA, 25 bp, Homo sapien
taattcctattgttgttgcatgtcg

SEQ ID NO: 356093 - DNA, 25 bp, Homo sapien
cctattgttgttgcatgtcgtacga

SEQ ID NO: 356094 - DNA, 25 bp, Homo sapien
ttgttgttgcatgtcgtacgaatga

SEQ ID NO: 356095 - DNA, 25 bp, Homo sapien
tattctcttaatacggttgactgtt

SEQ ID NO: 356096 - DNA, 25 bp, Homo sapien
atacggttgactgttgagcatggaa

SEQ ID NO: 356097 - DNA, 25 bp, Homo sapien
gctgaagttgcccatatacttttta

SEQ ID NO: 356098 - DNA, 25 bp, Homo sapien
aattgttaacagtacttgtcttggt

SEQ ID NO: 356099 - DNA, 25 bp, Homo sapien
acagtacttgtcttggtttagcaaa

SEQ ID NO: 356100 - DNA, 25 bp, Homo sapien
tcttgattttccaagtttttcagaa

SEQ ID NO: 356101 - DNA, 25 bp, Homo sapien
ttctaattattcctagcgatccctc

SEQ ID NO: 356102 - DNA, 25 bp, Homo sapien
caagctattcagatggaggtgcaag

SEQ ID NO: 356103 - DNA, 25 bp, Homo sapien
atggaggtgcaagactacatgttga

SEQ ID NO: 356104 - DNA, 25 bp, Homo sapien
aaaaactagctcagcacttaccaac

SEQ ID NO: 356105 - DNA, 25 bp, Homo sapien
ttaccaacccagttttcttctcatg

SEQ ID NO: 356106 - DNA, 25 bp, Homo sapien
cagttttcttctcatgcactcagaa

SEQ ID NO: 356107 - DNA, 25 bp, Homo sapien
ttctcatgcactcagaagctgtaag

SEQ ID NO: 356108 - DNA, 25 bp, Homo sapien
ctagcgatccctctacttgaaatgt

SEQ ID NO: 356109 - DNA, 25 bp, Homo sapien
gatccctctacttgaaatgtcctta

SEQ ID NO: 356110 - DNA, 25 bp, Homo sapien
gaaatgtccttacagtgatttttag

SEQ ID NO: 356111 - DNA, 25 bp, Homo sapien
gactttagcaagtaggaaaatcact

SEQ ID NO: 356112 - DNA, 25 bp, Homo sapien
cactgaggtacaacatggactgaag

SEQ ID NO: 356113 - DNA, 25 bp, Homo sapien
tggactgaagaggagcatgtgttaa

SEQ ID NO: 356114 - DNA, 25 bp, Homo sapien
gtgaattatttatcctgtagtatct

SEQ ID NO: 356115 - DNA, 25 bp, Homo sapien
tatcctgtagtatcttactgatgtt

SEQ ID NO: 356116 - DNA, 25 bp, Homo sapien
tgtagtatcttactgatgttcagat

SEQ ID NO: 356117 - DNA, 25 bp, Homo sapien
ggtcaggttcatgtgtatagttgca

SEQ ID NO: 356118 - DNA, 25 bp, Homo sapien
ggttcatgtgtatagttgcatttaa

SEQ ID NO: 356119 - DNA, 25 bp, Homo sapien
aattgtattacgattctgggttgtt

SEQ ID NO: 356120 - DNA, 25 bp, Homo sapien
gtattacgattctgggttgttgatg

SEQ ID NO: 356121 - DNA, 25 bp, Homo sapien
aacatttcttcagactttggcaaat

SEQ ID NO: 356122 - DNA, 25 bp, Homo sapien
actttggcaaatttcatctgtgggg

SEQ ID NO: 356123 - DNA, 25 bp, Homo sapien
ccttgagcagttcccgggtctcagc

SEQ ID NO: 356124 - DNA, 25 bp, Homo sapien
tgccacacatctcatagccggtgat

SEQ ID NO: 356125 - DNA, 25 bp, Homo sapien
acacatctcatagccggtgatgctg

SEQ ID NO: 356126 - DNA, 25 bp, Homo sapien
gggaagcttacgcagtcacagtact

SEQ ID NO: 356127 - DNA, 25 bp, Homo sapien
gcagtcacagtactggcttcttcct

SEQ ID NO: 356128 - DNA, 25 bp, Homo sapien
ttttctttccatacaagtggcttag

SEQ ID NO: 356129 - DNA, 25 bp, Homo sapien
gagtagttgacttatttggatgaaa

SEQ ID NO: 356130 - DNA, 25 bp, Homo sapien
ggatgaaaaccactatcttctgtca

SEQ ID NO: 356131 - DNA, 25 bp, Homo sapien
gaaaaacaaccagacaagtgcccaa

SEQ ID NO: 356132 - DNA, 25 bp, Homo sapien
gtgcccaacgacacttaaaaaggtg

SEQ ID NO: 356133 - DNA, 25 bp, Homo sapien
aaaaaggtgatttattatcttgcca

SEQ ID NO: 356134 - DNA, 25 bp, Homo sapien
agatgcttatctagctctttatctt

SEQ ID NO: 356135 - DNA, 25 bp, Homo sapien
tggtggctccaagggagtgatttta

SEQ ID NO: 356136 - DNA, 25 bp, Homo sapien
tgattttaggatggactgggacaga

SEQ ID NO: 356137 - DNA, 25 bp, Homo sapien
cagaggccattaatttagggagttc

SEQ ID NO: 356138 - DNA, 25 bp, Homo sapien
aggtccaggaggttgacggcatcta

SEQ ID NO: 356139 - DNA, 25 bp, Homo sapien
tgacggcatctaggcctgtggcaga

SEQ ID NO: 356140 - DNA, 25 bp, Homo sapien
gtggcagagtgcactcctgctttgg

SEQ ID NO: 356141 - DNA, 25 bp, Homo sapien
gaatgtatgggcagcttcttgcctg

SEQ ID NO: 356142 - DNA, 25 bp, Homo sapien
ttcttgcctgtagttggagggttag

SEQ ID NO: 356143 - DNA, 25 bp, Homo sapien
gagagggatcaataatttcatggtt

SEQ ID NO: 356144 - DNA, 25 bp, Homo sapien
tcatggttggacttgagtttggagc

SEQ ID NO: 356145 - DNA, 25 bp, Homo sapien
ggagccagtcattgagggtattgca

SEQ ID NO: 356146 - DNA, 25 bp, Homo sapien
gccagtcattgagggtattgcagag

SEQ ID NO: 356147 - DNA, 25 bp, Homo sapien
agggtattgcagagaccatcttcct

SEQ ID NO: 356148 - DNA, 25 bp, Homo sapien
acaggttccactatctgaccctcgt

SEQ ID NO: 356149 - DNA, 25 bp, Homo sapien
aggttccactatctgaccctcgttc

SEQ ID NO: 356150 - DNA, 25 bp, Homo sapien
ttcccatggccgaggacacctgtga

SEQ ID NO: 356151 - DNA, 25 bp, Homo sapien
ggccgaggacacctgtgacctccag

SEQ ID NO: 356152 - DNA, 25 bp, Homo sapien
taatccaggtgcctgagaccatgga

SEQ ID NO: 356153 - DNA, 25 bp, Homo sapien
caggtgcctgagaccatggagatgc

SEQ ID NO: 356154 - DNA, 25 bp, Homo sapien
tgcctgagaccatggagatgctggt

SEQ ID NO: 356155 - DNA, 25 bp, Homo sapien
ggtccttaatggcaccattgtctca

SEQ ID NO: 356156 - DNA, 25 bp, Homo sapien
gaggcgtaaagtaggatgctcacta

SEQ ID NO: 356157 - DNA, 25 bp, Homo sapien
tgctcactacaaccataggtggggt

SEQ ID NO: 356158 - DNA, 25 bp, Homo sapien
gtggggtttcagctcatatcttaaa

SEQ ID NO: 356159 - DNA, 25 bp, Homo sapien
ggtactattatataacctatacaca

SEQ ID NO: 356160 - DNA, 25 bp, Homo sapien
ataacctatacacaagatacaggag

SEQ ID NO: 356161 - DNA, 25 bp, Homo sapien
gatacaggagaaaatatgcttgatt

SEQ ID NO: 356162 - DNA, 25 bp, Homo sapien
caaaaaaggccatgagtaaatctct

SEQ ID NO: 356163 - DNA, 25 bp, Homo sapien
aaaggccatgagtaaatctctatat

SEQ ID NO: 356164 - DNA, 25 bp, Homo sapien
aaatctctatattaacattactatt

SEQ ID NO: 356165 - DNA, 25 bp, Homo sapien
tattttgttttggaactgggacatg

SEQ ID NO: 356166 - DNA, 25 bp, Homo sapien
tttggaactgggacatgattctatt

SEQ ID NO: 356167 - DNA, 25 bp, Homo sapien
gcctggaggactgtcggctccagaa

SEQ ID NO: 356168 - DNA, 25 bp, Homo sapien
gaggactgtcggctccagaaagaac

SEQ ID NO: 356169 - DNA, 25 bp, Homo sapien
gactgtcggctccagaaagaacacc

SEQ ID NO: 356170 - DNA, 25 bp, Homo sapien
cggctccagaaagaacaccgagttc

SEQ ID NO: 356171 - DNA, 25 bp, Homo sapien
aagaacaccgagttcgggtgtgccg

SEQ ID NO: 356172 - DNA, 25 bp, Homo sapien
tcgggtgtgccggaagagcgtggac

SEQ ID NO: 356173 - DNA, 25 bp, Homo sapien
gaagagcgtggaccgtagctgcccc

SEQ ID NO: 356174 - DNA, 25 bp, Homo sapien
ccctgtcggtgcagaacacggcgga

SEQ ID NO: 356175 - DNA, 25 bp, Homo sapien
cagaacacggcggagagcagattcg

SEQ ID NO: 356176 - DNA, 25 bp, Homo sapien
gagagcagattcggcttccgcttcc

SEQ ID NO: 356177 - DNA, 25 bp, Homo sapien
gggaagctcttccacgcgcgggagg

SEQ ID NO: 356178 - DNA, 25 bp, Homo sapien
ttgggaggcaggaccttggctttcc

SEQ ID NO: 356179 - DNA, 25 bp, Homo sapien
gaccttggctttcctcagaatcagg

SEQ ID NO: 356180 - DNA, 25 bp, Homo sapien
ttccagggcatggagctagtcctgt

SEQ ID NO: 356181 - DNA, 25 bp, Homo sapien
gcatggagctagtcctgtgtctaaa

SEQ ID NO: 356182 - DNA, 25 bp, Homo sapien
agtcctgtgtctaaaggagtcggca

SEQ ID NO: 356183 - DNA, 25 bp, Homo sapien
tggtgagaatgagtgctccgctgcc

SEQ ID NO: 356184 - DNA, 25 bp, Homo sapien
tgagaatgagtgctccgctgccgca

SEQ ID NO: 356185 - DNA, 25 bp, Homo sapien
cgccgagtgcctggacccgattaag

SEQ ID NO: 356186 - DNA, 25 bp, Homo sapien
accgcgatttcgactgcaaagcttt

SEQ ID NO: 356187 - DNA, 25 bp, Homo sapien
tcgactgcaaagctttccaacacaa

SEQ ID NO: 356188 - DNA, 25 bp, Homo sapien
tccaacacaaggtccactgcgcggg

SEQ ID NO: 356189 - DNA, 25 bp, Homo sapien
gggacggtcaaagacttcataaata

SEQ ID NO: 356190 - DNA, 25 bp, Homo sapien
cttcataaataagaggcgggtccca

SEQ ID NO: 356191 - DNA, 25 bp, Homo sapien
taagaggcgggtcccagacccgcaa

SEQ ID NO: 356192 - DNA, 25 bp, Homo sapien
gacccgcaatttgtcaacatgtctt

SEQ ID NO: 356193 - DNA, 25 bp, Homo sapien
agaatcactttgcatagcaatggtg

SEQ ID NO: 356194 - DNA, 25 bp, Homo sapien
aataatactaccactaacccgacag

SEQ ID NO: 356195 - DNA, 25 bp, Homo sapien
tgcagtgatgtgactgggtcttctt

SEQ ID NO: 356196 - DNA, 25 bp, Homo sapien
gactgggtcttcttgtcccaagggc

SEQ ID NO: 356197 - DNA, 25 bp, Homo sapien
acccgacagctgactggtttataca

SEQ ID NO: 356198 - DNA, 25 bp, Homo sapien
gtttatacagtactacacgccaggt

SEQ ID NO: 356199 - DNA, 25 bp, Homo sapien
tatacagtactacacgccaggtggg

SEQ ID NO: 356200 - DNA, 25 bp, Homo sapien
acaagtgcaaacattcttttaggcc

SEQ ID NO: 356201 - DNA, 25 bp, Homo sapien
gcaaacattcttttaggccacttcc

SEQ ID NO: 356202 - DNA, 25 bp, Homo sapien
aaacattcttttaggccacttcctg

SEQ ID NO: 356203 - DNA, 25 bp, Homo sapien
attcttttaggccacttcctgctca

SEQ ID NO: 356204 - DNA, 25 bp, Homo sapien
gaacatcaggtgttggtgcagatgt

SEQ ID NO: 356205 - DNA, 25 bp, Homo sapien
attggaacccttgtgtagtgcttgt

SEQ ID NO: 356206 - DNA, 25 bp, Homo sapien
tggaacccttgtgtagtgcttgtgg

SEQ ID NO: 356207 - DNA, 25 bp, Homo sapien
acccttgtgtagtgcttgtgggaag

SEQ ID NO: 356208 - DNA, 25 bp, Homo sapien
gtgggaaggtaaaatcatgcattgc

SEQ ID NO: 356209 - DNA, 25 bp, Homo sapien
gaaggtaaaatcatgcattgctgtg

SEQ ID NO: 356210 - DNA, 25 bp, Homo sapien
ggtaaaatcatgcattgctgtggaa

SEQ ID NO: 356211 - DNA, 25 bp, Homo sapien
ttccagtatttcgagttcctgggtt

SEQ ID NO: 356212 - DNA, 25 bp, Homo sapien
ggaggttagaattcttgcacgcaga

SEQ ID NO: 356213 - DNA, 25 bp, Homo sapien
ggcctggctccgaaggtctcagaat

SEQ ID NO: 356214 - DNA, 25 bp, Homo sapien
gaaggtctcagaatccgagcctcca

SEQ ID NO: 356215 - DNA, 25 bp, Homo sapien
aatccgagcctccaggccagatttt

SEQ ID NO: 356216 - DNA, 25 bp, Homo sapien
agattttccctctagccattcctgg

SEQ ID NO: 356217 - DNA, 25 bp, Homo sapien
gcggagccgcgagcacacagaaaag

SEQ ID NO: 356218 - DNA, 25 bp, Homo sapien
aaaggatgtcttcatcgccaaccgg

SEQ ID NO: 356219 - DNA, 25 bp, Homo sapien
gtagtggaaaaccaggagccaaatg

SEQ ID NO: 356220 - DNA, 25 bp, Homo sapien
ggagccaaatgaatatgcttcttat

SEQ ID NO: 356221 - DNA, 25 bp, Homo sapien
aaaatttgaacagagcagcgggtgg

SEQ ID NO: 356222 - DNA, 25 bp, Homo sapien
tcccaggccagagaattcaaattgt

SEQ ID NO: 356223 - DNA, 25 bp, Homo sapien
caggccagagaattcaaattgttaa

SEQ ID NO: 356224 - DNA, 25 bp, Homo sapien
aacattggcatttgaagaggagaac

SEQ ID NO: 356225 - DNA, 25 bp, Homo sapien
tgtagcatgatgtatttaaagtaag

SEQ ID NO: 356226 - DNA, 25 bp, Homo sapien
aggcctttagtaatgaatgtaatga

SEQ ID NO: 356227 - DNA, 25 bp, Homo sapien
tccttttggtaacccgattattgtg

SEQ ID NO: 356228 - DNA, 25 bp, Homo sapien
tttggtaacccgattattgtgtatt

SEQ ID NO: 356229 - DNA, 25 bp, Homo sapien
taacccgattattgtgtattacctt

SEQ ID NO: 356230 - DNA, 25 bp, Homo sapien
aaatatttcacatcctgtaagtgct

SEQ ID NO: 356231 - DNA, 25 bp, Homo sapien
tcacatcctgtaagtgcttaatcat

SEQ ID NO: 356232 - DNA, 25 bp, Homo sapien
gtaagtgcttaatcatatcttttaa

SEQ ID NO: 356233 - DNA, 25 bp, Homo sapien
cctattcacagttagcaattagcct

SEQ ID NO: 356234 - DNA, 25 bp, Homo sapien
gcaattagcctaagacacattattt

SEQ ID NO: 356235 - DNA, 25 bp, Homo sapien
tttaccttagtttgtgtcaagcata

SEQ ID NO: 356236 - DNA, 25 bp, Homo sapien
gtcatgctgtttcaccagttagtac

SEQ ID NO: 356237 - DNA, 25 bp, Homo sapien
gtcaagcatagacagttgtggtttt

SEQ ID NO: 356238 - DNA, 25 bp, Homo sapien
gattttactgtgagcagcaatgcaa

SEQ ID NO: 356239 - DNA, 25 bp, Homo sapien
gagcagcaatgcaacataacccaat

SEQ ID NO: 356240 - DNA, 25 bp, Homo sapien
accagttagtacctctgctgagtcc

SEQ ID NO: 356241 - DNA, 25 bp, Homo sapien
tgagtccattctttctgcctggaat

SEQ ID NO: 356242 - DNA, 25 bp, Homo sapien
tcttctatgccaggttatctcctat

SEQ ID NO: 356243 - DNA, 25 bp, Homo sapien
ggttatctcctattcacagttagca

SEQ ID NO: 356244 - DNA, 25 bp, Homo sapien
tggtagtctgaagcctagctctggt

SEQ ID NO: 356245 - DNA, 25 bp, Homo sapien
tagctctggtctgcagacatgtttt

SEQ ID NO: 356246 - DNA, 25 bp, Homo sapien
gacatgttttatttggactccacag

SEQ ID NO: 356247 - DNA, 25 bp, Homo sapien
atcagagtcacttcactttaatgag

SEQ ID NO: 356248 - DNA, 25 bp, Homo sapien
atgtgacaagactagactctcgtgt

SEQ ID NO: 356249 - DNA, 25 bp, Homo sapien
agactctcgtgtggcatggatcctt

SEQ ID NO: 356250 - DNA, 25 bp, Homo sapien
tactgcttcactttaaaacaccggg

SEQ ID NO: 356251 - DNA, 25 bp, Homo sapien
atggatccttcttcgtatgacagtg

SEQ ID NO: 356252 - DNA, 25 bp, Homo sapien
gcttcccagatattatcgtttccca

SEQ ID NO: 356253 - DNA, 25 bp, Homo sapien
atcgtttcccatggcaggttctaaa

SEQ ID NO: 356254 - DNA, 25 bp, Homo sapien
ggcaggttctaaactggtagtctga

SEQ ID NO: 356255 - DNA, 25 bp, Homo sapien
cagtccaccccggtaaaagagctgt

SEQ ID NO: 356256 - DNA, 25 bp, Homo sapien
tcctgtccctgtcagcctttgctgt

SEQ ID NO: 356257 - DNA, 25 bp, Homo sapien
cctgccatcgtgtgcttcacgtggc

SEQ ID NO: 356258 - DNA, 25 bp, Homo sapien
tgtgcttcacgtggccccatgcatg

SEQ ID NO: 356259 - DNA, 25 bp, Homo sapien
ctctctgcatggtctcttgggaaaa

SEQ ID NO: 356260 - DNA, 25 bp, Homo sapien
aaaagagagatgtgtcgcctccgcc

SEQ ID NO: 356261 - DNA, 25 bp, Homo sapien
agagagatgtgtcgcctccgccagt

SEQ ID NO: 356262 - DNA, 25 bp, Homo sapien
agatgtgtcgcctccgccagtccga

SEQ ID NO: 356263 - DNA, 25 bp, Homo sapien
cccacatgtgaccactgcaacgaag

SEQ ID NO: 356264 - DNA, 25 bp, Homo sapien
tgaccactgcaacgaagacactcct

SEQ ID NO: 356265 - DNA, 25 bp, Homo sapien
tgcaacgaagacactccttctgtcc

SEQ ID NO: 356266 - DNA, 25 bp, Homo sapien
taaccctcccttctgagagtttcca

SEQ ID NO: 356267 - DNA, 25 bp, Homo sapien
tcccttctgagagtttccaggagga

SEQ ID NO: 356268 - DNA, 25 bp, Homo sapien
ctgagagtttccaggaggagtccga

SEQ ID NO: 356269 - DNA, 25 bp, Homo sapien
aggagtccgagggtctagcttttct

SEQ ID NO: 356270 - DNA, 25 bp, Homo sapien
agtccgagggtctagcttttctggt

SEQ ID NO: 356271 - DNA, 25 bp, Homo sapien
ccgagggtctagcttttctggtgaa

SEQ ID NO: 356272 - DNA, 25 bp, Homo sapien
gggtctagcttttctggtgaagcca

SEQ ID NO: 356273 - DNA, 25 bp, Homo sapien
gcttttctggtgaagccagttcctg

SEQ ID NO: 356274 - DNA, 25 bp, Homo sapien
ttctggtgaagccagttcctgttcc

SEQ ID NO: 356275 - DNA, 25 bp, Homo sapien
tttcctaagggcctgctcgctctgg

SEQ ID NO: 356276 - DNA, 25 bp, Homo sapien
gggagggattgctgtgttacatagc

SEQ ID NO: 356277 - DNA, 25 bp, Homo sapien
gaggcgtaaagtaggatgctcacta

SEQ ID NO: 356278 - DNA, 25 bp, Homo sapien
gatgctcactacaaccataggtggg

SEQ ID NO: 356279 - DNA, 25 bp, Homo sapien
ataggtggggtttcagctcatatct

SEQ ID NO: 356280 - DNA, 25 bp, Homo sapien
gggtttcagctcatatcttaaagat

SEQ ID NO: 356281 - DNA, 25 bp, Homo sapien
ggtactattatataacctatacaca

SEQ ID NO: 356282 - DNA, 25 bp, Homo sapien
ataacctatacacaagatacaggag

SEQ ID NO: 356283 - DNA, 25 bp, Homo sapien
gatacaggagaaaatatgcttgatt

SEQ ID NO: 356284 - DNA, 25 bp, Homo sapien
aaaggccatgagtaaatctctatat

SEQ ID NO: 356285 - DNA, 25 bp, Homo sapien
aaatctctatattaacattactatt

SEQ ID NO: 356286 - DNA, 25 bp, Homo sapien
tattttgttttggaactgggacatg

SEQ ID NO: 356287 - DNA, 25 bp, Homo sapien
tttggaactgggacatgattctatt

SEQ ID NO: 356288 - DNA, 25 bp, Homo sapien
gaggatcgattgaacacaggaatta

SEQ ID NO: 356289 - DNA, 25 bp, Homo sapien
aggatcgattgaacacaggaattag

SEQ ID NO: 356290 - DNA, 25 bp, Homo sapien
gcagtgcagctatgattgcaccact

SEQ ID NO: 356291 - DNA, 25 bp, Homo sapien
cagtgcagctatgattgcaccactg

SEQ ID NO: 356292 - DNA, 25 bp, Homo sapien
agtgcagctatgattgcaccactgt

SEQ ID NO: 356293 - DNA, 25 bp, Homo sapien
gtgcagctatgattgcaccactgtc

SEQ ID NO: 356294 - DNA, 25 bp, Homo sapien
gtgacagagaaagactgtcttaaaa

SEQ ID NO: 356295 - DNA, 25 bp, Homo sapien
gctcacatctgtaaacccccccact

SEQ ID NO: 356296 - DNA, 25 bp, Homo sapien
ctcacatctgtaaacccccccactt

SEQ ID NO: 356297 - DNA, 25 bp, Homo sapien
tcacatctgtaaacccccccacttt

SEQ ID NO: 356298 - DNA, 25 bp, Homo sapien
cacatctgtaaacccccccactttg

SEQ ID NO: 356299 - DNA, 25 bp, Homo sapien
agaaccgaggttgggatcgactcct

SEQ ID NO: 356300 - DNA, 25 bp, Homo sapien
ggatcgactcctctggccatgcttg

SEQ ID NO: 356301 - DNA, 25 bp, Homo sapien
atgcttgccgctacctgtaataaga

SEQ ID NO: 356302 - DNA, 25 bp, Homo sapien
gtggtgcttgctcccgaatcagacg

SEQ ID NO: 356303 - DNA, 25 bp, Homo sapien
tgtaataagataggcagccccagcc

SEQ ID NO: 356304 - DNA, 25 bp, Homo sapien
ttcttccttcggcaaaggcttccac

SEQ ID NO: 356305 - DNA, 25 bp, Homo sapien
ttccgccagctgcaacgtagtgggt

SEQ ID NO: 356306 - DNA, 25 bp, Homo sapien
aacgtagtgggttccagtctctcaa

SEQ ID NO: 356307 - DNA, 25 bp, Homo sapien
tccagtctctcaagcttcggcgtgt

SEQ ID NO: 356308 - DNA, 25 bp, Homo sapien
atcagacgccggcagccaaacttgt

SEQ ID NO: 356309 - DNA, 25 bp, Homo sapien
aaacttgtcccctcctgtagagtag

SEQ ID NO: 356310 - DNA, 25 bp, Homo sapien
ggccatgtttcagttagtgctatga

SEQ ID NO: 356311 - DNA, 25 bp, Homo sapien
agggcacttctcaacattaattttg

SEQ ID NO: 356312 - DNA, 25 bp, Homo sapien
tgaagcagtgttctcttagtagcct

SEQ ID NO: 356313 - DNA, 25 bp, Homo sapien
gtagcctgaacacttctcaaagcga

SEQ ID NO: 356314 - DNA, 25 bp, Homo sapien
agcgacttatcactagcggctttaa

SEQ ID NO: 356315 - DNA, 25 bp, Homo sapien
gagcttctatatcgttgtgtccacc

SEQ ID NO: 356316 - DNA, 25 bp, Homo sapien
gtccacctcactttttaaggctgtt

SEQ ID NO: 356317 - DNA, 25 bp, Homo sapien
ggctgttcatacctggcaatattca

SEQ ID NO: 356318 - DNA, 25 bp, Homo sapien
ggcaatattcacttactctgctatt

SEQ ID NO: 356319 - DNA, 25 bp, Homo sapien
actgctctttttcattactgtagat

SEQ ID NO: 356320 - DNA, 25 bp, Homo sapien
aactgagagttagctgttctaggaa

SEQ ID NO: 356321 - DNA, 25 bp, Homo sapien
cacgctcaaggtgagcaccatcaag

SEQ ID NO: 356322 - DNA, 25 bp, Homo sapien
tcaaggtgagcaccatcaagcgcca

SEQ ID NO: 356323 - DNA, 25 bp, Homo sapien
ttctccatggacttcacgcctgagg

SEQ ID NO: 356324 - DNA, 25 bp, Homo sapien
tggacttcacgcctgaggagcgcca

SEQ ID NO: 356325 - DNA, 25 bp, Homo sapien
tcacgcctgaggagcgccagactat

SEQ ID NO: 356326 - DNA, 25 bp, Homo sapien
tgaggagcgccagactatcctggag

SEQ ID NO: 356327 - DNA, 25 bp, Homo sapien
agactatcctggaggcctacgagga

SEQ ID NO: 356328 - DNA, 25 bp, Homo sapien
gagcagcggcggaactaccagccgc

SEQ ID NO: 356329 - DNA, 25 bp, Homo sapien
tgcgctgctacggccacgagggctt

SEQ ID NO: 356330 - DNA, 25 bp, Homo sapien
tgacggcggcgcggacctcaagtct

SEQ ID NO: 356331 - DNA, 25 bp, Homo sapien
tgatggactacgacggcagccggcg

SEQ ID NO: 356332 - DNA, 25 bp, Homo sapien
gaggaagcccttgtttaggtggcct

SEQ ID NO: 356333 - DNA, 25 bp, Homo sapien
ttaggtggccttgacatggctgctg

SEQ ID NO: 356334 - DNA, 25 bp, Homo sapien
ctcctccttgtgttaaatccaggta

SEQ ID NO: 356335 - DNA, 25 bp, Homo sapien
tttgccagacgacatcagatttcca

SEQ ID NO: 356336 - DNA, 25 bp, Homo sapien
gatttccagagctcatctctgggct

SEQ ID NO: 356337 - DNA, 25 bp, Homo sapien
ggaggcagaacttcggcatcaaagt

SEQ ID NO: 356338 - DNA, 25 bp, Homo sapien
atggtcttgccactctgcgggctga

SEQ ID NO: 356339 - DNA, 25 bp, Homo sapien
aatccaggtagacttcctagcggca

SEQ ID NO: 356340 - DNA, 25 bp, Homo sapien
agcctgtgtccagcaggaaaagctc

SEQ ID NO: 356341 - DNA, 25 bp, Homo sapien
aggaaaagctctgcccttttgctaa

SEQ ID NO: 356342 - DNA, 25 bp, Homo sapien
ctgcccttttgctaaggaggttggg

SEQ ID NO: 356343 - DNA, 25 bp, Homo sapien
ggttcacctgcagatgaacagggca

SEQ ID NO: 356344 - DNA, 25 bp, Homo sapien
tgttcctgaatttggtaggcagcat

SEQ ID NO: 356345 - DNA, 25 bp, Homo sapien
tgcatgtaaggcttgaagtgggttt

SEQ ID NO: 356346 - DNA, 25 bp, Homo sapien
cttgaagtgggtttggccagagcat

SEQ ID NO: 356347 - DNA, 25 bp, Homo sapien
actgcagcttcagctatgacctgga

SEQ ID NO: 356348 - DNA, 25 bp, Homo sapien
agagcatgggctggagtgcttccac

SEQ ID NO: 356349 - DNA, 25 bp, Homo sapien
tgcagcttcagctatgacctggagt

SEQ ID NO: 356350 - DNA, 25 bp, Homo sapien
tggagtgcttccaccctgctacacg

SEQ ID NO: 356351 - DNA, 25 bp, Homo sapien
gggcaccagtctgtatgctccattt

SEQ ID NO: 356352 - DNA, 25 bp, Homo sapien
caccagtctgtatgctccattttag

SEQ ID NO: 356353 - DNA, 25 bp, Homo sapien
cagtctgtatgctccattttagata

SEQ ID NO: 356354 - DNA, 25 bp, Homo sapien
aatcagccttcttctggatgcctcc

SEQ ID NO: 356355 - DNA, 25 bp, Homo sapien
agcctttgctatcatctgcctagga

SEQ ID NO: 356356 - DNA, 25 bp, Homo sapien
tcatctgcctaggaggttggaagtt

SEQ ID NO: 356357 - DNA, 25 bp, Homo sapien
gttggaagttactcaagcggctcaa

SEQ ID NO: 356358 - DNA, 25 bp, Homo sapien
aagcggctcaaggaaaagtccctat

SEQ ID NO: 356359 - DNA, 25 bp, Homo sapien
aaagtccctatttctgttgcagttg

SEQ ID NO: 356360 - DNA, 25 bp, Homo sapien
atgtgtagcccatcagaagtaagca

SEQ ID NO: 356361 - DNA, 25 bp, Homo sapien
gaaagggaagtctgcagctcagttg

SEQ ID NO: 356362 - DNA, 25 bp, Homo sapien
gccgttttctgtcctggaaataaca

SEQ ID NO: 356363 - DNA, 25 bp, Homo sapien
ttggccacctctgcataacaaatac

SEQ ID NO: 356364 - DNA, 25 bp, Homo sapien
accgagagcactgcaagtggagctt

SEQ ID NO: 356365 - DNA, 25 bp, Homo sapien
gaagactttgcaaattcctagaaag

SEQ ID NO: 356366 - DNA, 25 bp, Homo sapien
gaaaggaaaacacctcattcaaata

SEQ ID NO: 356367 - DNA, 25 bp, Homo sapien
ctcattcaaataatcagctcccttc

SEQ ID NO: 356368 - DNA, 25 bp, Homo sapien
aaataatcagctcccttctgcttca

SEQ ID NO: 356369 - DNA, 25 bp, Homo sapien
tgcttcaccatgaagccctgcgtaa

SEQ ID NO: 356370 - DNA, 25 bp, Homo sapien
gaaaactaaggctgtcattttctga

SEQ ID NO: 356371 - DNA, 25 bp, Homo sapien
atgccttcacacacaaatcactttg

SEQ ID NO: 356372 - DNA, 25 bp, Homo sapien
cactttgacaaagggtgggagatgt

SEQ ID NO: 356373 - DNA, 25 bp, Homo sapien
gtacaggcaagagatttagggaaat

SEQ ID NO: 356374 - DNA, 25 bp, Homo sapien
aactggaaaacatacgcagctttga

SEQ ID NO: 356375 - DNA, 25 bp, Homo sapien
gaaaacatacgcagctttgaaaagc

SEQ ID NO: 356376 - DNA, 25 bp, Homo sapien
ttttttctgccactatgtacattta

SEQ ID NO: 356377 - DNA, 25 bp, Homo sapien
ggaagagcacccttcattgaggtct

SEQ ID NO: 356378 - DNA, 25 bp, Homo sapien
cacccttcattgaggtctgggcagg

SEQ ID NO: 356379 - DNA, 25 bp, Homo sapien
aaagtggccagtccttagtagaggt

SEQ ID NO: 356380 - DNA, 25 bp, Homo sapien
tagtagaggtgcacctgctcaggtt

SEQ ID NO: 356381 - DNA, 25 bp, Homo sapien
tttggtgtgccaagtcaaatggact

SEQ ID NO: 356382 - DNA, 25 bp, Homo sapien
tcaaatggactggtgttctgccttt

SEQ ID NO: 356383 - DNA, 25 bp, Homo sapien
gccttttggcagataactgttgtct

SEQ ID NO: 356384 - DNA, 25 bp, Homo sapien
ggcttgaaagccttagcagatggct

SEQ ID NO: 356385 - DNA, 25 bp, Homo sapien
agatggctttaggagttgcctatcc

SEQ ID NO: 356386 - DNA, 25 bp, Homo sapien
gttgcctatccgttgttggatgtca

SEQ ID NO: 356387 - DNA, 25 bp, Homo sapien
tgcacccagccattgtgacaactta

SEQ ID NO: 356388 - DNA, 25 bp, Homo sapien
acccagccattgtgacaacttagtg

SEQ ID NO: 356389 - DNA, 25 bp, Homo sapien
ccagccattgtgacaacttagtgat

SEQ ID NO: 356390 - DNA, 25 bp, Homo sapien
gtgacaacttagtgatttttccctt

SEQ ID NO: 356391 - DNA, 25 bp, Homo sapien
caacttagtgatttttcccttagtg

SEQ ID NO: 356392 - DNA, 25 bp, Homo sapien
ttagtgatttttcccttagtggctc

SEQ ID NO: 356393 - DNA, 25 bp, Homo sapien
atttttcccttagtggctctgacac

SEQ ID NO: 356394 - DNA, 25 bp, Homo sapien
ttttcccttagtggctctgacacaa

SEQ ID NO: 356395 - DNA, 25 bp, Homo sapien
ttcccttagtggctctgacacaaga

SEQ ID NO: 356396 - DNA, 25 bp, Homo sapien
ttagtggctctgacacaagaagcag

SEQ ID NO: 356397 - DNA, 25 bp, Homo sapien
agtggctctgacacaagaagcagac

SEQ ID NO: 356398 - DNA, 25 bp, Homo sapien
ctgttctcagttttttacatgtgaa

SEQ ID NO: 356399 - DNA, 25 bp, Homo sapien
aaaacattgggctgactccattctg

SEQ ID NO: 356400 - DNA, 25 bp, Homo sapien
tccattctggttccgcagagctaaa

SEQ ID NO: 356401 - DNA, 25 bp, Homo sapien
gttccgcagagctaaaatgtgcctt

SEQ ID NO: 356402 - DNA, 25 bp, Homo sapien
aatgtgccttgatgactgttgttgt

SEQ ID NO: 356403 - DNA, 25 bp, Homo sapien
gaggatcagggcttgatgagccaaa

SEQ ID NO: 356404 - DNA, 25 bp, Homo sapien
ggcttgatgagccaaaggattctga

SEQ ID NO: 356405 - DNA, 25 bp, Homo sapien
aaaactgtgagggagttgcaactgt

SEQ ID NO: 356406 - DNA, 25 bp, Homo sapien
ggtgaacagctgtggttcttgtcaa

SEQ ID NO: 356407 - DNA, 25 bp, Homo sapien
gtggttcttgtcaaacacaaactct

SEQ ID NO: 356408 - DNA, 25 bp, Homo sapien
gaccagagacttatgcagagctaaa

SEQ ID NO: 356409 - DNA, 25 bp, Homo sapien
aagcagccttacatcactaaggcag

SEQ ID NO: 356410 - DNA, 25 bp, Homo sapien
atcactaaggcagcagacctgaagg

SEQ ID NO: 356411 - DNA, 25 bp, Homo sapien
gtttgatagtgcaaagggtcccact

SEQ ID NO: 356412 - DNA, 25 bp, Homo sapien
tgatagtgcaaagggtcccactaaa

SEQ ID NO: 356413 - DNA, 25 bp, Homo sapien
agtgcaaagggtcccactaaaattg

SEQ ID NO: 356414 - DNA, 25 bp, Homo sapien
caaagggtcccactaaaattgcctg

SEQ ID NO: 356415 - DNA, 25 bp, Homo sapien
aactgtttatctgtcatcttatgaa

SEQ ID NO: 356416 - DNA, 25 bp, Homo sapien
gtttatctgtcatcttatgaatgcc

SEQ ID NO: 356417 - DNA, 25 bp, Homo sapien
atctgtcatcttatgaatgccttag

SEQ ID NO: 356418 - DNA, 25 bp, Homo sapien
tctgtcatcttatgaatgccttaga

SEQ ID NO: 356419 - DNA, 25 bp, Homo sapien
gggagtgtcataattgacatatctc

SEQ ID NO: 356420 - DNA, 25 bp, Homo sapien
gttttatttgtagacatggactgtg

SEQ ID NO: 356421 - DNA, 25 bp, Homo sapien
gacatggactgtgaaataaacccaa

SEQ ID NO: 356422 - DNA, 25 bp, Homo sapien
gtgaaataaacccaacacatcagtt

SEQ ID NO: 356423 - DNA, 25 bp, Homo sapien
ccaacacatcagtttttaagttctt

SEQ ID NO: 356424 - DNA, 25 bp, Homo sapien
aagttcttattggtgtggtatcctc

SEQ ID NO: 356425 - DNA, 25 bp, Homo sapien
cttattggtgtggtatcctctaaat

SEQ ID NO: 356426 - DNA, 25 bp, Homo sapien
aaatctaaattgtatgtcatgcatg

SEQ ID NO: 356427 - DNA, 25 bp, Homo sapien
gtcatgcatgttttgagaatggtga

SEQ ID NO: 356428 - DNA, 25 bp, Homo sapien
gaatggtgaatgtttaatgctcatg

SEQ ID NO: 356429 - DNA, 25 bp, Homo sapien
ggttctattaacacaaagcttctga

SEQ ID NO: 356430 - DNA, 25 bp, Homo sapien
ttaacacaaagcttctgagatattt

SEQ ID NO: 356431 - DNA, 25 bp, Homo sapien
caagggaagttcacgggctcggcac

SEQ ID NO: 356432 - DNA, 25 bp, Homo sapien
cggatgtaaggatattgcccgttag

SEQ ID NO: 356433 - DNA, 25 bp, Homo sapien
gccccaagtccacaactcatgtttg

SEQ ID NO: 356434 - DNA, 25 bp, Homo sapien
gtttgtgagcttaaccttgtcctat

SEQ ID NO: 356435 - DNA, 25 bp, Homo sapien
aaccttgtcctataaagcactttgg

SEQ ID NO: 356436 - DNA, 25 bp, Homo sapien
gcactttggaacaggcccaggttct

SEQ ID NO: 356437 - DNA, 25 bp, Homo sapien
aggttctcccaccatgtacagctgc

SEQ ID NO: 356438 - DNA, 25 bp, Homo sapien
gtacagctgccattgacctggacag

SEQ ID NO: 356439 - DNA, 25 bp, Homo sapien
tggacagtcccgcaaggtccttcag

SEQ ID NO: 356440 - DNA, 25 bp, Homo sapien
aacggagccagcacagctatttgtc

SEQ ID NO: 356441 - DNA, 25 bp, Homo sapien
agctatttgtctccaaccacaggcc

SEQ ID NO: 356442 - DNA, 25 bp, Homo sapien
ggaacctttgacctgatctaaagtg

SEQ ID NO: 356443 - DNA, 25 bp, Homo sapien
ttgacctgatctaaagtggactttg

SEQ ID NO: 356444 - DNA, 25 bp, Homo sapien
aaagtggactttgtagcaacaagag

SEQ ID NO: 356445 - DNA, 25 bp, Homo sapien
gcaacaagaggagcatcagcgggtc

SEQ ID NO: 356446 - DNA, 25 bp, Homo sapien
ctttgtggattttctttgcctttgt

SEQ ID NO: 356447 - DNA, 25 bp, Homo sapien
tctttgcctttgtgtttgatgccgt

SEQ ID NO: 356448 - DNA, 25 bp, Homo sapien
gatgccgtcgtgtgggaaaagtcaa

SEQ ID NO: 356449 - DNA, 25 bp, Homo sapien
gaaaagtcaactccgatgccaccat

SEQ ID NO: 356450 - DNA, 25 bp, Homo sapien
cgggccggacgaaggatgctttctt

SEQ ID NO: 356451 - DNA, 25 bp, Homo sapien
aaggatgctttcttcctagaggctc

SEQ ID NO: 356452 - DNA, 25 bp, Homo sapien
tttcttcctagaggctccgagctga

SEQ ID NO: 356453 - DNA, 25 bp, Homo sapien
aggttgacggcgttgcacgctctcg

SEQ ID NO: 356454 - DNA, 25 bp, Homo sapien
ggcaccgagggttgtagttctgatt

SEQ ID NO: 356455 - DNA, 25 bp, Homo sapien
agttctgattcgttttctttcctct

SEQ ID NO: 356456 - DNA, 25 bp, Homo sapien
gttgcagttttcaggactacgtggg

SEQ ID NO: 356457 - DNA, 25 bp, Homo sapien
gagggaatagctttttgttgaacgg

SEQ ID NO: 356458 - DNA, 25 bp, Homo sapien
gttgaacggtttaagacgctgacct

SEQ ID NO: 356459 - DNA, 25 bp, Homo sapien
aagacgctgacctgtgcaactggac

SEQ ID NO: 356460 - DNA, 25 bp, Homo sapien
actggaccacgcctggttcctgtgt

SEQ ID NO: 356461 - DNA, 25 bp, Homo sapien
ctgtgtctcttaccaaaccgtgacc

SEQ ID NO: 356462 - DNA, 25 bp, Homo sapien
agacaccggcctttcaatatccgtc

SEQ ID NO: 356463 - DNA, 25 bp, Homo sapien
aatatccgtctcttccctgcaggtt

SEQ ID NO: 356464 - DNA, 25 bp, Homo sapien
ttgccacaccagagctcctagaaac

SEQ ID NO: 356465 - DNA, 25 bp, Homo sapien
acagcccaggctttggagcggaccc

SEQ ID NO: 356466 - DNA, 25 bp, Homo sapien
acgtatgtcttgtcagatatgctca

SEQ ID NO: 356467 - DNA, 25 bp, Homo sapien
gaaaattgtgtgactgcttaggcca

SEQ ID NO: 356468 - DNA, 25 bp, Homo sapien
tgcctagactgaccttggactccca

SEQ ID NO: 356469 - DNA, 25 bp, Homo sapien
gactcccagcctgccagagaatgaa

SEQ ID NO: 356470 - DNA, 25 bp, Homo sapien
acaacgcacagtacttttgaagctt

SEQ ID NO: 356471 - DNA, 25 bp, Homo sapien
tttgaagcttcgtatttttcttggt

SEQ ID NO: 356472 - DNA, 25 bp, Homo sapien
ttggtttcacactcagctacatgtg

SEQ ID NO: 356473 - DNA, 25 bp, Homo sapien
agctacatgtgacctccagcttggt

SEQ ID NO: 356474 - DNA, 25 bp, Homo sapien
ctccagcttggtgaggttgcctgaa

SEQ ID NO: 356475 - DNA, 25 bp, Homo sapien
ggcagcgcccgcactcgagtctggg

SEQ ID NO: 356476 - DNA, 25 bp, Homo sapien
tgactccaggagtgtgctccggcag

SEQ ID NO: 356477 - DNA, 25 bp, Homo sapien
tgtgctccggcaggacagaggcctc

SEQ ID NO: 356478 - DNA, 25 bp, Homo sapien
aggcctccgggtggatgcctcggca

SEQ ID NO: 356479 - DNA, 25 bp, Homo sapien
atgcctcggcaggaagaagacacac

SEQ ID NO: 356480 - DNA, 25 bp, Homo sapien
ggaagaagacacacgccaggccctt

SEQ ID NO: 356481 - DNA, 25 bp, Homo sapien
ttccacccgggacttgcacctgaac

SEQ ID NO: 356482 - DNA, 25 bp, Homo sapien
ggccgtgtgggctccagcaaagctg

SEQ ID NO: 356483 - DNA, 25 bp, Homo sapien
ggctccagcaaagctgggcggcttc

SEQ ID NO: 356484 - DNA, 25 bp, Homo sapien
gagttgaggtgaccgggcagatgtc

SEQ ID NO: 356485 - DNA, 25 bp, Homo sapien
agatgtcgaggagctgctcagggca

SEQ ID NO: 356486 - DNA, 25 bp, Homo sapien
tgaagagctgaaccaatgggaaaac

SEQ ID NO: 356487 - DNA, 25 bp, Homo sapien
gaaccaatgggaaaactgatgctca

SEQ ID NO: 356488 - DNA, 25 bp, Homo sapien
aactgatgctcagaggcttgagcaa

SEQ ID NO: 356489 - DNA, 25 bp, Homo sapien
tcagaggcttgagcaacctaggcca

SEQ ID NO: 356490 - DNA, 25 bp, Homo sapien
gaggcttgagcaacctaggccagga

SEQ ID NO: 356491 - DNA, 25 bp, Homo sapien
cttgagcaacctaggccaggacctg

SEQ ID NO: 356492 - DNA, 25 bp, Homo sapien
aggccaggacctgtccttagaggca

SEQ ID NO: 356493 - DNA, 25 bp, Homo sapien
caggacctgtccttagaggcagaag

SEQ ID NO: 356494 - DNA, 25 bp, Homo sapien
aggaagagcaccctgaccacaaagc

SEQ ID NO: 356495 - DNA, 25 bp, Homo sapien
ccacaaagccccagggtccagaaag

SEQ ID NO: 356496 - DNA, 25 bp, Homo sapien
gggtccagaaagactcagccactgg

SEQ ID NO: 356497 - DNA, 25 bp, Homo sapien
gaacgaaaaggctctcctaggctaa

SEQ ID NO: 356498 - DNA, 25 bp, Homo sapien
gaaaaggctctcctaggctaagaaa

SEQ ID NO: 356499 - DNA, 25 bp, Homo sapien
aaggctctcctaggctaagaaacag

SEQ ID NO: 356500 - DNA, 25 bp, Homo sapien
gctctcctaggctaagaaacagcat

SEQ ID NO: 356501 - DNA, 25 bp, Homo sapien
taggctaagaaacagcatacacagt

SEQ ID NO: 356502 - DNA, 25 bp, Homo sapien
aattcaaggaagatagcaacaacga

SEQ ID NO: 356503 - DNA, 25 bp, Homo sapien
tagcaacaacgaaaacatcagaagg

SEQ ID NO: 356504 - DNA, 25 bp, Homo sapien
tcagaaggaacactaaagtagtcaa

SEQ ID NO: 356505 - DNA, 25 bp, Homo sapien
ttgcacagctaaatggaaatgactt

SEQ ID NO: 356506 - DNA, 25 bp, Homo sapien
gacttttgaattatctgctttggaa

SEQ ID NO: 356507 - DNA, 25 bp, Homo sapien
gctttggaagattatccatgacact

SEQ ID NO: 356508 - DNA, 25 bp, Homo sapien
ggagcaggcaccacttggctgacat

SEQ ID NO: 356509 - DNA, 25 bp, Homo sapien
gagaatattaccgaggtgcctgcaa

SEQ ID NO: 356510 - DNA, 25 bp, Homo sapien
gtgcctgcaaagttcaatcttcctt

SEQ ID NO: 356511 - DNA, 25 bp, Homo sapien
actaagggccaggttcaggcacaga

SEQ ID NO: 356512 - DNA, 25 bp, Homo sapien
gaaggagcacctacaagctttagct

SEQ ID NO: 356513 - DNA, 25 bp, Homo sapien
agctttagctttgatttggtcttaa

SEQ ID NO: 356514 - DNA, 25 bp, Homo sapien
gatttggtcttaatgcacgcgtatg

SEQ ID NO: 356515 - DNA, 25 bp, Homo sapien
taatgcacgcgtatgtcgccgtcga

SEQ ID NO: 356516 - DNA, 25 bp, Homo sapien
gtcgccgtcgagatttacatatttc

SEQ ID NO: 356517 - DNA, 25 bp, Homo sapien
aaaggccttaacagttgatgtctga

SEQ ID NO: 356518 - DNA, 25 bp, Homo sapien
ggtgaccacctgaaaagaggacctt

SEQ ID NO: 356519 - DNA, 25 bp, Homo sapien
ttcccctcaagcctgggctcatgga

SEQ ID NO: 356520 - DNA, 25 bp, Homo sapien
aagcctgggctcatggagcccctgc

SEQ ID NO: 356521 - DNA, 25 bp, Homo sapien
tcaggtgggcggaaagtccatcccc

SEQ ID NO: 356522 - DNA, 25 bp, Homo sapien
ttcaggaaggatgctcccgtgtgca

SEQ ID NO: 356523 - DNA, 25 bp, Homo sapien
actcacctgtgaggccggtgtggct

SEQ ID NO: 356524 - DNA, 25 bp, Homo sapien
tcccttgtaaatagttgttctctgg

SEQ ID NO: 356525 - DNA, 25 bp, Homo sapien
gttgttctctggtaagaagccaaat

SEQ ID NO: 356526 - DNA, 25 bp, Homo sapien
aatatttaagctcacttcttcccag

SEQ ID NO: 356527 - DNA, 25 bp, Homo sapien
ttaagctcacttcttcccagagaga

SEQ ID NO: 356528 - DNA, 25 bp, Homo sapien
gagagaggaagctctgctcaggcct

SEQ ID NO: 356529 - DNA, 25 bp, Homo sapien
aggcctccagcgttggctggccatg

SEQ ID NO: 356530 - DNA, 25 bp, Homo sapien
aattatcaactctacaaagtgcccc

SEQ ID NO: 356531 - DNA, 25 bp, Homo sapien
tgcagccagcctccagtatctctga

SEQ ID NO: 356532 - DNA, 25 bp, Homo sapien
tgaccacacaccttggcttatgcct

SEQ ID NO: 356533 - DNA, 25 bp, Homo sapien
tttttgcctgcttccactgctccta

SEQ ID NO: 356534 - DNA, 25 bp, Homo sapien
ctatgcaagggaagcgaaaatctat

SEQ ID NO: 356535 - DNA, 25 bp, Homo sapien
tattttgcgagaaccgacatttagg

SEQ ID NO: 356536 - DNA, 25 bp, Homo sapien
agaaccgacatttaggtggacttct

SEQ ID NO: 356537 - DNA, 25 bp, Homo sapien
ttaggtggacttctttaaagcattc

SEQ ID NO: 356538 - DNA, 25 bp, Homo sapien
taaagcattctaggtcagagccaca

SEQ ID NO: 356539 - DNA, 25 bp, Homo sapien
taggtcagagccacaatacttttcc

SEQ ID NO: 356540 - DNA, 25 bp, Homo sapien
agccacaatacttttcctcagcaaa

SEQ ID NO: 356541 - DNA, 25 bp, Homo sapien
aaagttgacactgatactgcccctg

SEQ ID NO: 356542 - DNA, 25 bp, Homo sapien
gtacaggagccagacttgagcatga

SEQ ID NO: 356543 - DNA, 25 bp, Homo sapien
atagcagccagcatttagcgggtac

SEQ ID NO: 356544 - DNA, 25 bp, Homo sapien
tagcgggtacttacgtggcaggcat

SEQ ID NO: 356545 - DNA, 25 bp, Homo sapien
tggcaggcatcgttccaagtccttt

SEQ ID NO: 356546 - DNA, 25 bp, Homo sapien
aagtcctttgcagagattaacccat

SEQ ID NO: 356547 - DNA, 25 bp, Homo sapien
ttgcagagattaacccattcagtcc

SEQ ID NO: 356548 - DNA, 25 bp, Homo sapien
attcagtcctttcagtaccctttgt

SEQ ID NO: 356549 - DNA, 25 bp, Homo sapien
gacttacctccgtgtccacagcatt

SEQ ID NO: 356550 - DNA, 25 bp, Homo sapien
acagcattacctagcgcagggcctg

SEQ ID NO: 356551 - DNA, 25 bp, Homo sapien
cagggtgggcaaaaccagggtcaca

SEQ ID NO: 356552 - DNA, 25 bp, Homo sapien
atgaaggcccgctaaaacgctcctg

SEQ ID NO: 356553 - DNA, 25 bp, Homo sapien
gctaaaacgctcctgtctatggact

SEQ ID NO: 356554 - DNA, 25 bp, Homo sapien
aaaacgctcctgtctatggactcag

SEQ ID NO: 356555 - DNA, 25 bp, Homo sapien
cgctcctgtctatggactcaggtat

SEQ ID NO: 356556 - DNA, 25 bp, Homo sapien
gactcaggtatggtgcttcagcccc

SEQ ID NO: 356557 - DNA, 25 bp, Homo sapien
tcaggtatggtgcttcagccccaca

SEQ ID NO: 356558 - DNA, 25 bp, Homo sapien
gtatggtgcttcagccccacatgga

SEQ ID NO: 356559 - DNA, 25 bp, Homo sapien
gtgcttcagccccacatggaattaa

SEQ ID NO: 356560 - DNA, 25 bp, Homo sapien
gcttcagccccacatggaattaaat

SEQ ID NO: 356561 - DNA, 25 bp, Homo sapien
cagccccacatggaattaaattcag

SEQ ID NO: 356562 - DNA, 25 bp, Homo sapien
cacatggaattaaattcagccttct

SEQ ID NO: 356563 - DNA, 25 bp, Homo sapien
gttaagatctatttatacaaacact

SEQ ID NO: 356564 - DNA, 25 bp, Homo sapien
gatctatttatacaaacacttcaca

SEQ ID NO: 356565 - DNA, 25 bp, Homo sapien
ctatttatacaaacacttcacattt

SEQ ID NO: 356566 - DNA, 25 bp, Homo sapien
aacacttcacatttacagataagtt

SEQ ID NO: 356567 - DNA, 25 bp, Homo sapien
cacatttacagataagtttcagcag

SEQ ID NO: 356568 - DNA, 25 bp, Homo sapien
gtttcagcagaaatgtatcttgaca

SEQ ID NO: 356569 - DNA, 25 bp, Homo sapien
ttcagcagaaatgtatcttgacaaa

SEQ ID NO: 356570 - DNA, 25 bp, Homo sapien
gaaatgtatcttgacaaagtatgga

SEQ ID NO: 356571 - DNA, 25 bp, Homo sapien
gtatcttgacaaagtatggaaaagt

SEQ ID NO: 356572 - DNA, 25 bp, Homo sapien
aagttaatttgaggcttcaatttca

SEQ ID NO: 356573 - DNA, 25 bp, Homo sapien
taatttgaggcttcaatttcatttt

SEQ ID NO: 356574 - DNA, 25 bp, Homo sapien
gcatgctgcacgctcactgtatttg

SEQ ID NO: 356575 - DNA, 25 bp, Homo sapien
atgctgcacgctcactgtatttgtg

SEQ ID NO: 356576 - DNA, 25 bp, Homo sapien
cacgctcactgtatttgtgcagatc

SEQ ID NO: 356577 - DNA, 25 bp, Homo sapien
actgtatttgtgcagatcctggcca

SEQ ID NO: 356578 - DNA, 25 bp, Homo sapien
gtatttgtgcagatcctggccagta

SEQ ID NO: 356579 - DNA, 25 bp, Homo sapien
ttgtgcagatcctggccagtacaaa

SEQ ID NO: 356580 - DNA, 25 bp, Homo sapien
tggccagtacaaagtcgttgctctt

SEQ ID NO: 356581 - DNA, 25 bp, Homo sapien
acaaagtcgttgctcttgtcttatc

SEQ ID NO: 356582 - DNA, 25 bp, Homo sapien
gctcttgtcttatcttctcttacag

SEQ ID NO: 356583 - DNA, 25 bp, Homo sapien
cttgtcttatcttctcttacagagt

SEQ ID NO: 356584 - DNA, 25 bp, Homo sapien
ttatcttctcttacagagtctccct

SEQ ID NO: 356585 - DNA, 25 bp, Homo sapien
gccctgctccaggagtggacatgtg

SEQ ID NO: 356586 - DNA, 25 bp, Homo sapien
gtggcctttattccccacagtggag

SEQ ID NO: 356587 - DNA, 25 bp, Homo sapien
tattccccacagtggagggatggaa

SEQ ID NO: 356588 - DNA, 25 bp, Homo sapien
gatggaaaccaaagaggtccgcgaa

SEQ ID NO: 356589 - DNA, 25 bp, Homo sapien
aaagaggtccgcgaagcccagacag

SEQ ID NO: 356590 - DNA, 25 bp, Homo sapien
tccagcttcagcttctggtgtttat

SEQ ID NO: 356591 - DNA, 25 bp, Homo sapien
ttcagcttctggtgtttattgctgc

SEQ ID NO: 356592 - DNA, 25 bp, Homo sapien
ggacatgtgactctggactggccaa

SEQ ID NO: 356593 - DNA, 25 bp, Homo sapien
tggactggccaatcagaactccacc

SEQ ID NO: 356594 - DNA, 25 bp, Homo sapien
ctgtgattggttcaggtgagccaat

SEQ ID NO: 356595 - DNA, 25 bp, Homo sapien
gagccaatcagattcagggaaataa

SEQ ID NO: 356596 - DNA, 25 bp, Homo sapien
cagtaacttcgatataaggcagcaa

SEQ ID NO: 356597 - DNA, 25 bp, Homo sapien
ggtgcagatccacttacacacagtg

SEQ ID NO: 356598 - DNA, 25 bp, Homo sapien
acacacagtggttcagggaggcctc

SEQ ID NO: 356599 - DNA, 25 bp, Homo sapien
gattatgctacatgtaccttattgt

SEQ ID NO: 356600 - DNA, 25 bp, Homo sapien
atgtaccttattgtgaacccaggag

SEQ ID NO: 356601 - DNA, 25 bp, Homo sapien
gaacccaggaggatttggcctctgt

SEQ ID NO: 356602 - DNA, 25 bp, Homo sapien
ggaggatttggcctctgtcataaaa

SEQ ID NO: 356603 - DNA, 25 bp, Homo sapien
cccctgtgggttcataaacctcaat

SEQ ID NO: 356604 - DNA, 25 bp, Homo sapien
ggttcataaacctcaatttacaaat

SEQ ID NO: 356605 - DNA, 25 bp, Homo sapien
aattgtgctttatatatcagttcct

SEQ ID NO: 356606 - DNA, 25 bp, Homo sapien
atatcagttccttataagtttggtt

SEQ ID NO: 356607 - DNA, 25 bp, Homo sapien
aatgcagtatagaactatgctaacc

SEQ ID NO: 356608 - DNA, 25 bp, Homo sapien
gtatagaactatgctaaccaaaatt

SEQ ID NO: 356609 - DNA, 25 bp, Homo sapien
agaactatgctaaccaaaattaata

SEQ ID NO: 356610 - DNA, 25 bp, Homo sapien
ttattttaaatcctgtagtaattgg

SEQ ID NO: 356611 - DNA, 25 bp, Homo sapien
tacatgagttcattaagatcagaaa

SEQ ID NO: 356612 - DNA, 25 bp, Homo sapien
acaaaatgtcctgtattttgcagtt

SEQ ID NO: 356613 - DNA, 25 bp, Homo sapien
ttgttaagtcttccattcgttttag

SEQ ID NO: 356614 - DNA, 25 bp, Homo sapien
tgttaagtcttccattcgttttagg

SEQ ID NO: 356615 - DNA, 25 bp, Homo sapien
taagtcttccattcgttttaggatt

SEQ ID NO: 356616 - DNA, 25 bp, Homo sapien
gtcttccattcgttttaggattagt

SEQ ID NO: 356617 - DNA, 25 bp, Homo sapien
tccattcgttttaggattagtctgc

SEQ ID NO: 356618 - DNA, 25 bp, Homo sapien
tacttaacattcatatcataccttc

SEQ ID NO: 356619 - DNA, 25 bp, Homo sapien
acattcatatcataccttcccaaat

SEQ ID NO: 356620 - DNA, 25 bp, Homo sapien
gtacttaacaacttaatatagggag

SEQ ID NO: 356621 - DNA, 25 bp, Homo sapien
tacttaacaacttaatatagggagg

SEQ ID NO: 356622 - DNA, 25 bp, Homo sapien
tatagggaggaaaggtgtaaacagt

SEQ ID NO: 356623 - DNA, 25 bp, Homo sapien
gagcaaaactattttatggtaattt

SEQ ID NO: 356624 - DNA, 25 bp, Homo sapien
ggtaattttatggtagtatcagctt

SEQ ID NO: 356625 - DNA, 25 bp, Homo sapien
gtaattttatggtagtatcagcttg

SEQ ID NO: 356626 - DNA, 25 bp, Homo sapien
taattttatggtagtatcagcttgt

SEQ ID NO: 356627 - DNA, 25 bp, Homo sapien
aattttatggtagtatcagcttgta

SEQ ID NO: 356628 - DNA, 25 bp, Homo sapien
taggataacctggtttccaagcctt

SEQ ID NO: 356629 - DNA, 25 bp, Homo sapien
aatacacacatttgcatacacagga

SEQ ID NO: 356630 - DNA, 25 bp, Homo sapien
acacatttgcatacacaggaaatca

SEQ ID NO: 356631 - DNA, 25 bp, Homo sapien
tgggacatgaaagccgtcatcctgg

SEQ ID NO: 356632 - DNA, 25 bp, Homo sapien
aaagccgtcatcctggctatgcaga

SEQ ID NO: 356633 - DNA, 25 bp, Homo sapien
gccagcacagcatctcctttactgt

SEQ ID NO: 356634 - DNA, 25 bp, Homo sapien
tctctgatctttcccaaaggccagt

SEQ ID NO: 356635 - DNA, 25 bp, Homo sapien
gatctttcccaaaggccagttcaca

SEQ ID NO: 356636 - DNA, 25 bp, Homo sapien
cagttcacacagagtcaccagcaat

SEQ ID NO: 356637 - DNA, 25 bp, Homo sapien
acacagagtcaccagcaataggata

SEQ ID NO: 356638 - DNA, 25 bp, Homo sapien
ttaaaggcaaaaatacagttctgtt

SEQ ID NO: 356639 - DNA, 25 bp, Homo sapien
acagccccctacacaatggtaaata

SEQ ID NO: 356640 - DNA, 25 bp, Homo sapien
gaaaaaattacactctgccctgctt

SEQ ID NO: 356641 - DNA, 25 bp, Homo sapien
aaaaattacactctgccctgcttct

SEQ ID NO: 356642 - DNA, 25 bp, Homo sapien
ttcttcctgcccattcatgatagac

SEQ ID NO: 356643 - DNA, 25 bp, Homo sapien
tgcccattcatgatagacaatgttt

SEQ ID NO: 356644 - DNA, 25 bp, Homo sapien
atgtttatcttcacagcactcttca

SEQ ID NO: 356645 - DNA, 25 bp, Homo sapien
ttatcttcacagcactcttcaacct

SEQ ID NO: 356646 - DNA, 25 bp, Homo sapien
tctacccatcagtaagtaagacgcc

SEQ ID NO: 356647 - DNA, 25 bp, Homo sapien
gtaagacgccaaagatctcggccat

SEQ ID NO: 356648 - DNA, 25 bp, Homo sapien
aaagatctcggccattcgttcaatg

SEQ ID NO: 356649 - DNA, 25 bp, Homo sapien
atctcggccattcgttcaatgcatg

SEQ ID NO: 356650 - DNA, 25 bp, Homo sapien
cggccattcgttcaatgcatgtaaa

SEQ ID NO: 356651 - DNA, 25 bp, Homo sapien
ggctaccaaattgtatctgttgcct

SEQ ID NO: 356652 - DNA, 25 bp, Homo sapien
ccctgcccaaaatgggtagtgtcta

SEQ ID NO: 356653 - DNA, 25 bp, Homo sapien
aatgggtagtgtctacacgtccccg

SEQ ID NO: 356654 - DNA, 25 bp, Homo sapien
cagccctgggctgacctgagaggaa

SEQ ID NO: 356655 - DNA, 25 bp, Homo sapien
ggctgacctgagaggaaggctcctt

SEQ ID NO: 356656 - DNA, 25 bp, Homo sapien
agaggaaggctccttcctggactgc

SEQ ID NO: 356657 - DNA, 25 bp, Homo sapien
ttcctggactgccctctgaaatgtg

SEQ ID NO: 356658 - DNA, 25 bp, Homo sapien
gtaaaaagccttagcccagtgccaa

SEQ ID NO: 356659 - DNA, 25 bp, Homo sapien
gaatgatgaccagcacctcagaaac

SEQ ID NO: 356660 - DNA, 25 bp, Homo sapien
tgatgaccagcacctcagaaacttc

SEQ ID NO: 356661 - DNA, 25 bp, Homo sapien
ctcagaaacttccagagggaggaga

SEQ ID NO: 356662 - DNA, 25 bp, Homo sapien
gaacttcctttacctacgccttgat

SEQ ID NO: 356663 - DNA, 25 bp, Homo sapien
tttacctacgccttgatggcaccac

SEQ ID NO: 356664 - DNA, 25 bp, Homo sapien
tgatggcaccaccaagtctgaagat

SEQ ID NO: 356665 - DNA, 25 bp, Homo sapien
ccaagtctgaagatcgtgctgcttt

SEQ ID NO: 356666 - DNA, 25 bp, Homo sapien
tgaagatcgtgctgctttgctgaag

SEQ ID NO: 356667 - DNA, 25 bp, Homo sapien
aaattcaatgaacctggatcccagt

SEQ ID NO: 356668 - DNA, 25 bp, Homo sapien
tggatcccagtatttcattttcttg

SEQ ID NO: 356669 - DNA, 25 bp, Homo sapien
tttcttgctgagcacaagagctggt

SEQ ID NO: 356670 - DNA, 25 bp, Homo sapien
cctgggcttaaatcttcaggcagct

SEQ ID NO: 356671 - DNA, 25 bp, Homo sapien
agtggtcatctttgacagcgactgg

SEQ ID NO: 356672 - DNA, 25 bp, Homo sapien
ggaatcctcatcaggatctgcaggc

SEQ ID NO: 356673 - DNA, 25 bp, Homo sapien
cgcctggagggcctacagtcagaaa

SEQ ID NO: 356674 - DNA, 25 bp, Homo sapien
gtcagaaaaccatcgcctgcgaatg

SEQ ID NO: 356675 - DNA, 25 bp, Homo sapien
aagacttggaagaggtcaccatgca

SEQ ID NO: 356676 - DNA, 25 bp, Homo sapien
gaaaagaccacctacattaaacaga

SEQ ID NO: 356677 - DNA, 25 bp, Homo sapien
acagaaccactaccaagagctcaat

SEQ ID NO: 356678 - DNA, 25 bp, Homo sapien
ctcaatgacatcctcaacctgggaa

SEQ ID NO: 356679 - DNA, 25 bp, Homo sapien
cctgggaaacttcactgagagcaca

SEQ ID NO: 356680 - DNA, 25 bp, Homo sapien
aaatcacctcgatcaaaatccccag

SEQ ID NO: 356681 - DNA, 25 bp, Homo sapien
aaatccccagctacagtggaacaca

SEQ ID NO: 356682 - DNA, 25 bp, Homo sapien
agtggaacacaacagagccctctcg

SEQ ID NO: 356683 - DNA, 25 bp, Homo sapien
agagccctctcgaacatgcaaagat

SEQ ID NO: 356684 - DNA, 25 bp, Homo sapien
gagcatgcatgaatacaggattctt

SEQ ID NO: 356685 - DNA, 25 bp, Homo sapien
acaggattcttgattcatcagtgag

SEQ ID NO: 356686 - DNA, 25 bp, Homo sapien
tagcctctatagtcactcaaccaca

SEQ ID NO: 356687 - DNA, 25 bp, Homo sapien
ttggaggcaacacatcagactcttg

SEQ ID NO: 356688 - DNA, 25 bp, Homo sapien
acatcagactcttgctcatcttttt

SEQ ID NO: 356689 - DNA, 25 bp, Homo sapien
tttttctgccccttcagatatgtca

SEQ ID NO: 356690 - DNA, 25 bp, Homo sapien
tgccccttcagatatgtcaaagaga

SEQ ID NO: 356691 - DNA, 25 bp, Homo sapien
aacttttagatctgctacatctggg

SEQ ID NO: 356692 - DNA, 25 bp, Homo sapien
tacatctgggttcacagcctgactc

SEQ ID NO: 356693 - DNA, 25 bp, Homo sapien
tcaaccacacttctattgcactgtc

SEQ ID NO: 356694 - DNA, 25 bp, Homo sapien
gggactacaaagagcatgcatgaat

SEQ ID NO: 356695 - DNA, 25 bp, Homo sapien
atagggaatctctccgtcgtactaa

SEQ ID NO: 356696 - DNA, 25 bp, Homo sapien
gaatctctccgtcgtactaaaaatg

SEQ ID NO: 356697 - DNA, 25 bp, Homo sapien
tggatggaccacagtacgacgttaa

SEQ ID NO: 356698 - DNA, 25 bp, Homo sapien
gaccacagtacgacgttaagtctca

SEQ ID NO: 356699 - DNA, 25 bp, Homo sapien
actggtgtcttaaataggtttgatc

SEQ ID NO: 356700 - DNA, 25 bp, Homo sapien
ggtttgatcacattcaaggattatt

SEQ ID NO: 356701 - DNA, 25 bp, Homo sapien
aggattattatacttgtgcttcaac

SEQ ID NO: 356702 - DNA, 25 bp, Homo sapien
atacttgtgcttcaaccaatctaaa

SEQ ID NO: 356703 - DNA, 25 bp, Homo sapien
taatgttgtttcaccataacacaaa

SEQ ID NO: 356704 - DNA, 25 bp, Homo sapien
gatcatgcaccatatccacaggagg

SEQ ID NO: 356705 - DNA, 25 bp, Homo sapien
gttggaaaaacccatgccattttct

SEQ ID NO: 356706 - DNA, 25 bp, Homo sapien
gattcttctgccgattctggtacca

SEQ ID NO: 356707 - DNA, 25 bp, Homo sapien
atacgcccgcaaacagggtcactta

SEQ ID NO: 356708 - DNA, 25 bp, Homo sapien
ccgcaaacagggtcacttagaaaat

SEQ ID NO: 356709 - DNA, 25 bp, Homo sapien
ggaacttcataatagattctctggg

SEQ ID NO: 356710 - DNA, 25 bp, Homo sapien
taatagattctctgggagcagacga

SEQ ID NO: 356711 - DNA, 25 bp, Homo sapien
ggagcagacgagaagcatcatctta

SEQ ID NO: 356712 - DNA, 25 bp, Homo sapien
aaaccacagctcttgccagtacatt

SEQ ID NO: 356713 - DNA, 25 bp, Homo sapien
acagctcttgccagtacatttttct

SEQ ID NO: 356714 - DNA, 25 bp, Homo sapien
aactgtttttggtacaactgcactg

SEQ ID NO: 356715 - DNA, 25 bp, Homo sapien
tgcactgaagtgttatttttgatgt

SEQ ID NO: 356716 - DNA, 25 bp, Homo sapien
tttttgatgttgagctttcttcttt

SEQ ID NO: 356717 - DNA, 25 bp, Homo sapien
tatttactatgcaggatctattaca

SEQ ID NO: 356718 - DNA, 25 bp, Homo sapien
tactatgcaggatctattacaactc

SEQ ID NO: 356719 - DNA, 25 bp, Homo sapien
tatgcaggatctattacaactcatt

SEQ ID NO: 356720 - DNA, 25 bp, Homo sapien
gcaggatctattacaactcattaaa

SEQ ID NO: 356721 - DNA, 25 bp, Homo sapien
ggatctattacaactcattaaaatc

SEQ ID NO: 356722 - DNA, 25 bp, Homo sapien
ctcattaaaatcaaccctacttcca

SEQ ID NO: 356723 - DNA, 25 bp, Homo sapien
ttaaaatcaaccctacttccagtct

SEQ ID NO: 356724 - DNA, 25 bp, Homo sapien
taaaatcaaccctacttccagtctc

SEQ ID NO: 356725 - DNA, 25 bp, Homo sapien
ctacttccagtctctacaaatcact

SEQ ID NO: 356726 - DNA, 25 bp, Homo sapien
tacttccagtctctacaaatcactg

SEQ ID NO: 356727 - DNA, 25 bp, Homo sapien
cagtctctacaaatcactggtttca

SEQ ID NO: 356728 - DNA, 25 bp, Homo sapien
gagcaattaaggagcctcttttggg

SEQ ID NO: 356729 - DNA, 25 bp, Homo sapien
gacaggggctttgcaacagtctttc

SEQ ID NO: 356730 - DNA, 25 bp, Homo sapien
aacagtctttcatgagtggccgaaa

SEQ ID NO: 356731 - DNA, 25 bp, Homo sapien
tctttcatgagtggccgaaatcccc

SEQ ID NO: 356732 - DNA, 25 bp, Homo sapien
cactgcaaatgtgcttctcaaagat

SEQ ID NO: 356733 - DNA, 25 bp, Homo sapien
gcttctcaaagatgcaggatttttt

SEQ ID NO: 356734 - DNA, 25 bp, Homo sapien
attatgttgtaattccactccaaag

SEQ ID NO: 356735 - DNA, 25 bp, Homo sapien
tgttgtaattccactccaaaggcat

SEQ ID NO: 356736 - DNA, 25 bp, Homo sapien
atccaccagccctaagtggtcatca

SEQ ID NO: 356737 - DNA, 25 bp, Homo sapien
gtggtcatcacatgatcagaagtca

SEQ ID NO: 356738 - DNA, 25 bp, Homo sapien
atcacatgatcagaagtcagctggg

SEQ ID NO: 356739 - DNA, 25 bp, Homo sapien
agagtatcagcatggctgggcatca

SEQ ID NO: 356740 - DNA, 25 bp, Homo sapien
ggaaaccaagtcactgtgcatccct

SEQ ID NO: 356741 - DNA, 25 bp, Homo sapien
tttagccaacgctgcttcactttta

SEQ ID NO: 356742 - DNA, 25 bp, Homo sapien
acttttactgccttatattgtgaag

SEQ ID NO: 356743 - DNA, 25 bp, Homo sapien
attaaaatccactcataagccagca

SEQ ID NO: 356744 - DNA, 25 bp, Homo sapien
tagaaagtcgagtcagtacccagct

SEQ ID NO: 356745 - DNA, 25 bp, Homo sapien
ctgggcatcagcattctacaagtta

SEQ ID NO: 356746 - DNA, 25 bp, Homo sapien
agtacccagctgaatcgtgaccacc

SEQ ID NO: 356747 - DNA, 25 bp, Homo sapien
gagggagcttgcagacatcgaacca

SEQ ID NO: 356748 - DNA, 25 bp, Homo sapien
tggatttaatccacatcctcagagg

SEQ ID NO: 356749 - DNA, 25 bp, Homo sapien
catcctcagaggcttaggctttctg

SEQ ID NO: 356750 - DNA, 25 bp, Homo sapien
gacgttaagtctcaagataatggat

SEQ ID NO: 356751 - DNA, 25 bp, Homo sapien
gatcacattcaaggattattatact

SEQ ID NO: 356752 - DNA, 25 bp, Homo sapien
aggattattatacttgtgcttcaac

SEQ ID NO: 356753 - DNA, 25 bp, Homo sapien
gattattatacttgtgcttcaacca

SEQ ID NO: 356754 - DNA, 25 bp, Homo sapien
attatacttgtgcttcaaccaatct

SEQ ID NO: 356755 - DNA, 25 bp, Homo sapien
atacttgtgcttcaaccaatctaaa

SEQ ID NO: 356756 - DNA, 25 bp, Homo sapien
atgttgtttcaccataacacaaaaa

SEQ ID NO: 356757 - DNA, 25 bp, Homo sapien
gtttcaccataacacaaaaagcatg

SEQ ID NO: 356758 - DNA, 25 bp, Homo sapien
tgaacttgtattaatcctatataat

SEQ ID NO: 356759 - DNA, 25 bp, Homo sapien
tgatcatgcaccatatccacaggag

SEQ ID NO: 356760 - DNA, 25 bp, Homo sapien
gatcatgcaccatatccacaggagg

SEQ ID NO: 356761 - DNA, 25 bp, Homo sapien
attaaagatgtgttgttggtttcca

SEQ ID NO: 356762 - DNA, 25 bp, Homo sapien
gaatgtttatgttctcagaatcagg

SEQ ID NO: 356763 - DNA, 25 bp, Homo sapien
gaatcaggttgacagtcccttgctg

SEQ ID NO: 356764 - DNA, 25 bp, Homo sapien
ggttgacagtcccttgctgacatgg

SEQ ID NO: 356765 - DNA, 25 bp, Homo sapien
acagtcccttgctgacatggctttg

SEQ ID NO: 356766 - DNA, 25 bp, Homo sapien
gctgacatggctttgctttgtgtaa

SEQ ID NO: 356767 - DNA, 25 bp, Homo sapien
aatacagtggatctcaatcttcggg

SEQ ID NO: 356768 - DNA, 25 bp, Homo sapien
gaatagcgaatcatctcaaatcctt

SEQ ID NO: 356769 - DNA, 25 bp, Homo sapien
aaatccttgagcactcagtctagtg

SEQ ID NO: 356770 - DNA, 25 bp, Homo sapien
ctcagtctagtgaagatgttgtcat

SEQ ID NO: 356771 - DNA, 25 bp, Homo sapien
gatgttgtcattatgtacaatacat

SEQ ID NO: 356772 - DNA, 25 bp, Homo sapien
ggtgggtcaactgtatcacatgcca

SEQ ID NO: 356773 - DNA, 25 bp, Homo sapien
acctgagacgagtgagtaatgggat

SEQ ID NO: 356774 - DNA, 25 bp, Homo sapien
gataatttgtaataccacaggcccc

SEQ ID NO: 356775 - DNA, 25 bp, Homo sapien
taatttgtaataccacaggcccctt

SEQ ID NO: 356776 - DNA, 25 bp, Homo sapien
cacaggccccttttcaagggaccag

SEQ ID NO: 356777 - DNA, 25 bp, Homo sapien
ggtcaactgtatcacatgccacaga

SEQ ID NO: 356778 - DNA, 25 bp, Homo sapien
tttcaagggaccagtaatcaaaaca

SEQ ID NO: 356779 - DNA, 25 bp, Homo sapien
gtatcacatgccacagagaagccaa

SEQ ID NO: 356780 - DNA, 25 bp, Homo sapien
acatgccacagagaagccaagtgaa

SEQ ID NO: 356781 - DNA, 25 bp, Homo sapien
gaagccaagtgaagataagcttaca

SEQ ID NO: 356782 - DNA, 25 bp, Homo sapien
gcttacaaaagtgtgaatcatggca

SEQ ID NO: 356783 - DNA, 25 bp, Homo sapien
cttcaaggctgatgtacggcatgga

SEQ ID NO: 356784 - DNA, 25 bp, Homo sapien
tgtacggcatggagctagacgacat

SEQ ID NO: 356785 - DNA, 25 bp, Homo sapien
gcatggagctagacgacatggatga

SEQ ID NO: 356786 - DNA, 25 bp, Homo sapien
acatggatgaggtcgaattcttacg

SEQ ID NO: 356787 - DNA, 25 bp, Homo sapien
gaggtcgaattcttacggataaaat

SEQ ID NO: 356788 - DNA, 25 bp, Homo sapien
ttacggataaaatactgggacagga

SEQ ID NO: 356789 - DNA, 25 bp, Homo sapien
ggcggcaccgcattcttatagtgca

SEQ ID NO: 356790 - DNA, 25 bp, Homo sapien
cattcttatagtgcacagcgtggga

SEQ ID NO: 356791 - DNA, 25 bp, Homo sapien
gtatggaccatggtacttcgagcct

SEQ ID NO: 356792 - DNA, 25 bp, Homo sapien
gaccatggtacttcgagcctaagtt

SEQ ID NO: 356793 - DNA, 25 bp, Homo sapien
caaacgagtgtgcttcaaggctgat

SEQ ID NO: 356794 - DNA, 25 bp, Homo sapien
ccaggaactccaagacatcaagatt

SEQ ID NO: 356795 - DNA, 25 bp, Homo sapien
taagacgtcaagatgctagcatgct

SEQ ID NO: 356796 - DNA, 25 bp, Homo sapien
ctagcatgctaacaccatcacggtt

SEQ ID NO: 356797 - DNA, 25 bp, Homo sapien
aacaccatcacggttctagaacttt

SEQ ID NO: 356798 - DNA, 25 bp, Homo sapien
aaaatggcgcaaatgcaccccatct

SEQ ID NO: 356799 - DNA, 25 bp, Homo sapien
ggtgtcaagattctaaagccttctg

SEQ ID NO: 356800 - DNA, 25 bp, Homo sapien
aaagccttctggattctagaatcct

SEQ ID NO: 356801 - DNA, 25 bp, Homo sapien
gaatcctgtagatgtcagcattcta

SEQ ID NO: 356802 - DNA, 25 bp, Homo sapien
gtcagcattctaaagtaccatcagg

SEQ ID NO: 356803 - DNA, 25 bp, Homo sapien
ggttctttatttactggattcatta

SEQ ID NO: 356804 - DNA, 25 bp, Homo sapien
gggaaatggcgcaaatgcaccccat

SEQ ID NO: 356805 - DNA, 25 bp, Homo sapien
gccaggaacaaaaatcaggagtgtg

SEQ ID NO: 356806 - DNA, 25 bp, Homo sapien
ggattagtgaaagtctcctcaggaa

SEQ ID NO: 356807 - DNA, 25 bp, Homo sapien
tcaggaaatctgaagtctgtatatt

SEQ ID NO: 356808 - DNA, 25 bp, Homo sapien
gtctgtatattgattgagactatct

SEQ ID NO: 356809 - DNA, 25 bp, Homo sapien
gagactatctaaactcatacctgta

SEQ ID NO: 356810 - DNA, 25 bp, Homo sapien
aattaagctgtaaggcctgtagctc

SEQ ID NO: 356811 - DNA, 25 bp, Homo sapien
agctgtaaggcctgtagctctggtt

SEQ ID NO: 356812 - DNA, 25 bp, Homo sapien
gtagctctggttgtatacttttgct

SEQ ID NO: 356813 - DNA, 25 bp, Homo sapien
ctggttgtatacttttgcttttcaa

SEQ ID NO: 356814 - DNA, 25 bp, Homo sapien
tatagtttatcttctgtataactga

SEQ ID NO: 356815 - DNA, 25 bp, Homo sapien
cattttttaatactcattgtcaatt

SEQ ID NO: 356816 - DNA, 25 bp, Homo sapien
catatttccggtcatctctggtggt

SEQ ID NO: 356817 - DNA, 25 bp, Homo sapien
atttccggtcatctctggtggtgag

SEQ ID NO: 356818 - DNA, 25 bp, Homo sapien
gttctgttttgaggatatcccttta

SEQ ID NO: 356819 - DNA, 25 bp, Homo sapien
aaatctcccaaatgactgtctctat

SEQ ID NO: 356820 - DNA, 25 bp, Homo sapien
tctatcttcatgagtgtgacttgag

SEQ ID NO: 356821 - DNA, 25 bp, Homo sapien
atgggtgagggagcttctctaaaga

SEQ ID NO: 356822 - DNA, 25 bp, Homo sapien
aagtgagtggattaacccctgcttc

SEQ ID NO: 356823 - DNA, 25 bp, Homo sapien
tggattaacccctgcttctcttctt

SEQ ID NO: 356824 - DNA, 25 bp, Homo sapien
ttctcttcttgttccctgttatcat

SEQ ID NO: 356825 - DNA, 25 bp, Homo sapien
ttcttgttccctgttatcattcctc

SEQ ID NO: 356826 - DNA, 25 bp, Homo sapien
atgctctctacccagggcagctggt

SEQ ID NO: 356827 - DNA, 25 bp, Homo sapien
gtttacttagagcagagacacctcc

SEQ ID NO: 356828 - DNA, 25 bp, Homo sapien
gagacacctccaaaatactgaacat

SEQ ID NO: 356829 - DNA, 25 bp, Homo sapien
gcgagatatagacatgcctctaaaa

SEQ ID NO: 356830 - DNA, 25 bp, Homo sapien
cataaggtaggctgaatccaaactt

SEQ ID NO: 356831 - DNA, 25 bp, Homo sapien
tatccattgcaacggaaatgtgccg

SEQ ID NO: 356832 - DNA, 25 bp, Homo sapien
gtgaaaaacacctgtacgcattatg

SEQ ID NO: 356833 - DNA, 25 bp, Homo sapien
gtacgcattatggtcattcattgga

SEQ ID NO: 356834 - DNA, 25 bp, Homo sapien
ttcattggaatgaggtccacgtcac

SEQ ID NO: 356835 - DNA, 25 bp, Homo sapien
gaggtccacgtcactaaacacaaag

SEQ ID NO: 356836 - DNA, 25 bp, Homo sapien
ggtgtagtcatagtccttcaaggct

SEQ ID NO: 356837 - DNA, 25 bp, Homo sapien
aaaaatgtcatcatcttctcctccc

SEQ ID NO: 356838 - DNA, 25 bp, Homo sapien
aggaaactgggcactgacaaaggga

SEQ ID NO: 356839 - DNA, 25 bp, Homo sapien
gggattggctcaaattcgaccccag

SEQ ID NO: 356840 - DNA, 25 bp, Homo sapien
ggctcaaattcgaccccagagtcag

SEQ ID NO: 356841 - DNA, 25 bp, Homo sapien
gaatccaatcgtgaaaaccataagg

SEQ ID NO: 356842 - DNA, 25 bp, Homo sapien
agagcgcacagagccctgcaggttc

SEQ ID NO: 356843 - DNA, 25 bp, Homo sapien
catcttgcccagatgtctcccattt

SEQ ID NO: 356844 - DNA, 25 bp, Homo sapien
tgcccagatgtctcccatttcacag

SEQ ID NO: 356845 - DNA, 25 bp, Homo sapien
actgaggttttgagagcttcccctg

SEQ ID NO: 356846 - DNA, 25 bp, Homo sapien
ggttttgagagcttcccctgaggac

SEQ ID NO: 356847 - DNA, 25 bp, Homo sapien
aggcacagagattctggcagcaagg

SEQ ID NO: 356848 - DNA, 25 bp, Homo sapien
gagattctggcagcaaggttcagaa

SEQ ID NO: 356849 - DNA, 25 bp, Homo sapien
ataatcataacttctacattacagg

SEQ ID NO: 356850 - DNA, 25 bp, Homo sapien
gagatatatagcaccatgcttctta

SEQ ID NO: 356851 - DNA, 25 bp, Homo sapien
gcaccatgcttcttaatgcttcata

SEQ ID NO: 356852 - DNA, 25 bp, Homo sapien
catgcttcttaatgcttcatacttt

SEQ ID NO: 356853 - DNA, 25 bp, Homo sapien
tataaaacttcatctatggtcaaag

SEQ ID NO: 356854 - DNA, 25 bp, Homo sapien
catctatggtcaaagtaaacactgt

SEQ ID NO: 356855 - DNA, 25 bp, Homo sapien
aacactgttacatttaaattgcttt

SEQ ID NO: 356856 - DNA, 25 bp, Homo sapien
aaaacaattgcgatctaaaaagtca

SEQ ID NO: 356857 - DNA, 25 bp, Homo sapien
gagacttacactgaatataatgttc

SEQ ID NO: 356858 - DNA, 25 bp, Homo sapien
tcatttagaagttgctgtggtccac

SEQ ID NO: 356859 - DNA, 25 bp, Homo sapien
aagttgctgtggtccacttcattta

SEQ ID NO: 356860 - DNA, 25 bp, Homo sapien
gaatccgccggaggtctgtctgttg

SEQ ID NO: 356861 - DNA, 25 bp, Homo sapien
gtctgttggcatcgtgcgtgacaat

SEQ ID NO: 356862 - DNA, 25 bp, Homo sapien
gcgtgacaattaacctttctgcctt

SEQ ID NO: 356863 - DNA, 25 bp, Homo sapien
aattaacctttctgccttggcagga

SEQ ID NO: 356864 - DNA, 25 bp, Homo sapien
ttggcaggatgtgccgacagcttgc

SEQ ID NO: 356865 - DNA, 25 bp, Homo sapien
ggagcctcaggcgtgatctcacaca

SEQ ID NO: 356866 - DNA, 25 bp, Homo sapien
gatctcacacactggcgtgcacata

SEQ ID NO: 356867 - DNA, 25 bp, Homo sapien
tgcacatacacgcaggcctgcaact

SEQ ID NO: 356868 - DNA, 25 bp, Homo sapien
gagacacacaggctactctgttggt

SEQ ID NO: 356869 - DNA, 25 bp, Homo sapien
gctactctgttggtcttggtcctgg

SEQ ID NO: 356870 - DNA, 25 bp, Homo sapien
tggcacagctcctgacacgtggact

SEQ ID NO: 356871 - DNA, 25 bp, Homo sapien
acacgtgctgcaagagggtccccga

SEQ ID NO: 356872 - DNA, 25 bp, Homo sapien
gtccagaccctgcacgcatgatggg

SEQ ID NO: 356873 - DNA, 25 bp, Homo sapien
agctccgcggagagaagctgacact

SEQ ID NO: 356874 - DNA, 25 bp, Homo sapien
agagaagctgacactgccaggctgg

SEQ ID NO: 356875 - DNA, 25 bp, Homo sapien
gccaggctggaaccttccattccgg

SEQ ID NO: 356876 - DNA, 25 bp, Homo sapien
cctcgctgtgccgaggagggatcta

SEQ ID NO: 356877 - DNA, 25 bp, Homo sapien
gactttccagagagggttagcgtgc

SEQ ID NO: 356878 - DNA, 25 bp, Homo sapien
gggagcaggcgcatcctgcacagaa

SEQ ID NO: 356879 - DNA, 25 bp, Homo sapien
atcctgcacagaacgctctagagcg

SEQ ID NO: 356880 - DNA, 25 bp, Homo sapien
aggccaaagcaccaggctgctcctg

SEQ ID NO: 356881 - DNA, 25 bp, Homo sapien
gctgctcctgacacgtgctgcaaga

SEQ ID NO: 356882 - DNA, 25 bp, Homo sapien
gatggatttccttgctgatttctaa

SEQ ID NO: 356883 - DNA, 25 bp, Homo sapien
aaatgacagggctcagcactgccct

SEQ ID NO: 356884 - DNA, 25 bp, Homo sapien
agcactgccctacagtaccaagaat

SEQ ID NO: 356885 - DNA, 25 bp, Homo sapien
caaatgtttccatgaagtcttcaaa

SEQ ID NO: 356886 - DNA, 25 bp, Homo sapien
ggcatttgtaaaattcaggctgtaa

SEQ ID NO: 356887 - DNA, 25 bp, Homo sapien
gtgattagttagttcattctgcact

SEQ ID NO: 356888 - DNA, 25 bp, Homo sapien
cattctgcacttatttattaactgt

SEQ ID NO: 356889 - DNA, 25 bp, Homo sapien
tgtatattcagttccaggctctagg

SEQ ID NO: 356890 - DNA, 25 bp, Homo sapien
ttcagttccaggctctagggtagag

SEQ ID NO: 356891 - DNA, 25 bp, Homo sapien
atagatgaagtttttgccctcacag

SEQ ID NO: 356892 - DNA, 25 bp, Homo sapien
agccaataattaaagctatcactgg

SEQ ID NO: 356893 - DNA, 25 bp, Homo sapien
ccaggaccaggtctgggccaaagag

SEQ ID NO: 356894 - DNA, 25 bp, Homo sapien
agtcacggttggcttccagtgccta

SEQ ID NO: 356895 - DNA, 25 bp, Homo sapien
ggcttggctgtcttcaccctggagg

SEQ ID NO: 356896 - DNA, 25 bp, Homo sapien
gtttatgaacagatgttcgcatcca

SEQ ID NO: 356897 - DNA, 25 bp, Homo sapien
agatgttcgcatccaaggtgagcat

SEQ ID NO: 356898 - DNA, 25 bp, Homo sapien
ttcgcatccaaggtgagcatgggaa

SEQ ID NO: 356899 - DNA, 25 bp, Homo sapien
ttggcttccagtgcctagcatggaa

SEQ ID NO: 356900 - DNA, 25 bp, Homo sapien
atcttcttccatgctcatcacaatt

SEQ ID NO: 356901 - DNA, 25 bp, Homo sapien
atgctcatcacaattcctctctggt

SEQ ID NO: 356902 - DNA, 25 bp, Homo sapien
tccagtgcctagcatggaagcatag

SEQ ID NO: 356903 - DNA, 25 bp, Homo sapien
tgaatggatgacatgctgtgttgca

SEQ ID NO: 356904 - DNA, 25 bp, Homo sapien
aatatttaccgacattccttataca

SEQ ID NO: 356905 - DNA, 25 bp, Homo sapien
ttccttatacatgacagacacttgg

SEQ ID NO: 356906 - DNA, 25 bp, Homo sapien
tgacagacacttggctacatgggaa

SEQ ID NO: 356907 - DNA, 25 bp, Homo sapien
gacaccagctgacaatttcttggtt

SEQ ID NO: 356908 - DNA, 25 bp, Homo sapien
caatttcttggttttactgtcaata

SEQ ID NO: 356909 - DNA, 25 bp, Homo sapien
gtaccatgtgatcaattactgtcct

SEQ ID NO: 356910 - DNA, 25 bp, Homo sapien
gatcaattactgtcctcacttagaa

SEQ ID NO: 356911 - DNA, 25 bp, Homo sapien
tagaacaaagcctgagtccgagaat

SEQ ID NO: 356912 - DNA, 25 bp, Homo sapien
gcctgagtccgagaatatttatatt

SEQ ID NO: 356913 - DNA, 25 bp, Homo sapien
ttaccaatatatgcctgttacaaga

SEQ ID NO: 356914 - DNA, 25 bp, Homo sapien
gaattcagagtttatttatcgaggg

SEQ ID NO: 356915 - DNA, 25 bp, Homo sapien
cggaccagttgtggtgctagtgcaa

SEQ ID NO: 356916 - DNA, 25 bp, Homo sapien
gaccagttgtggtgctagtgcaact

SEQ ID NO: 356917 - DNA, 25 bp, Homo sapien
gaggaggaagtcacgggcccagtta

SEQ ID NO: 356918 - DNA, 25 bp, Homo sapien
acgggcccagttattgcacctctct

SEQ ID NO: 356919 - DNA, 25 bp, Homo sapien
tattgcacctctcttcccacagaaa

SEQ ID NO: 356920 - DNA, 25 bp, Homo sapien
tgtgattggagacgccaagtccaac

SEQ ID NO: 356921 - DNA, 25 bp, Homo sapien
caggtggccgccacaataccctgta

SEQ ID NO: 356922 - DNA, 25 bp, Homo sapien
gccacaataccctgtacttcatgag

SEQ ID NO: 356923 - DNA, 25 bp, Homo sapien
ccacaataccctgtacttcatgagt

SEQ ID NO: 356924 - DNA, 25 bp, Homo sapien
gtgaccaggagtataagttcagtgt

SEQ ID NO: 356925 - DNA, 25 bp, Homo sapien
gagtataagttcagtgtggatgtga

SEQ ID NO: 356926 - DNA, 25 bp, Homo sapien
ggacgaggacagttgacaggtttct

SEQ ID NO: 356927 - DNA, 25 bp, Homo sapien
acaggtttctgtgcaagcgcgtttc

SEQ ID NO: 356928 - DNA, 25 bp, Homo sapien
gcgcgtttccgatcgcgcaaggtaa

SEQ ID NO: 356929 - DNA, 25 bp, Homo sapien
tgaggctgcaggtaccaaagctgtc

SEQ ID NO: 356930 - DNA, 25 bp, Homo sapien
ggtaacagcttcattactcagtgat

SEQ ID NO: 356931 - DNA, 25 bp, Homo sapien
gatgagtgacccatatttcctaaca

SEQ ID NO: 356932 - DNA, 25 bp, Homo sapien
atttcctaacatgatttccctgctg

SEQ ID NO: 356933 - DNA, 25 bp, Homo sapien
catgatttccctgctgtaactcaaa

SEQ ID NO: 356934 - DNA, 25 bp, Homo sapien
aggtaccaaagctgtccctgctcaa

SEQ ID NO: 356935 - DNA, 25 bp, Homo sapien
tttttgtgggcgactccattgttaa

SEQ ID NO: 356936 - DNA, 25 bp, Homo sapien
aaaagccagccctacaatgggacga

SEQ ID NO: 356937 - DNA, 25 bp, Homo sapien
gttaagatctatttatacaaacact

SEQ ID NO: 356938 - DNA, 25 bp, Homo sapien
gatctatttatacaaacacttcaca

SEQ ID NO: 356939 - DNA, 25 bp, Homo sapien
ctatttatacaaacacttcacattt

SEQ ID NO: 356940 - DNA, 25 bp, Homo sapien
aacacttcacatttacagataagtt

SEQ ID NO: 356941 - DNA, 25 bp, Homo sapien
tacagataagtttcagcagaaatgt

SEQ ID NO: 356942 - DNA, 25 bp, Homo sapien
gtttcagcagaaatgtatcttgaca

SEQ ID NO: 356943 - DNA, 25 bp, Homo sapien
ttcagcagaaatgtatcttgacaaa

SEQ ID NO: 356944 - DNA, 25 bp, Homo sapien
gaaatgtatcttgacaaagtatgga

SEQ ID NO: 356945 - DNA, 25 bp, Homo sapien
gtatcttgacaaagtatggaaaagt

SEQ ID NO: 356946 - DNA, 25 bp, Homo sapien
aagttaatttgaggcttcaatttca

SEQ ID NO: 356947 - DNA, 25 bp, Homo sapien
taatttgaggcttcaatttcatttt

SEQ ID NO: 356948 - DNA, 25 bp, Homo sapien
tctgctgtctcctgcaagaactggc

SEQ ID NO: 356949 - DNA, 25 bp, Homo sapien
tgctgtctcctgcaagaactggctc

SEQ ID NO: 356950 - DNA, 25 bp, Homo sapien
tgtctcctgcaagaactggctcaag

SEQ ID NO: 356951 - DNA, 25 bp, Homo sapien
gtctcctgcaagaactggctcaaga

SEQ ID NO: 356952 - DNA, 25 bp, Homo sapien
ctcctgcaagaactggctcaagaaa

SEQ ID NO: 356953 - DNA, 25 bp, Homo sapien
ggccctgttccgtagccgcgatgct

SEQ ID NO: 356954 - DNA, 25 bp, Homo sapien
ttccgtagccgcgatgctgcgctat

SEQ ID NO: 356955 - DNA, 25 bp, Homo sapien
gtagccgcgatgctgcgctatttcc

SEQ ID NO: 356956 - DNA, 25 bp, Homo sapien
agccgcgatgctgcgctatttccag

SEQ ID NO: 356957 - DNA, 25 bp, Homo sapien
gcgatgctgcgctatttccaggctg

SEQ ID NO: 356958 - DNA, 25 bp, Homo sapien
cgatgctgcgctatttccaggctgc

SEQ ID NO: 356959 - DNA, 25 bp, Homo sapien
gctatgtctccaatgggtctgtcta

SEQ ID NO: 356960 - DNA, 25 bp, Homo sapien
tctccaatgggtctgtctactttga

SEQ ID NO: 356961 - DNA, 25 bp, Homo sapien
tctgtctactttgatacagcgaagt

SEQ ID NO: 356962 - DNA, 25 bp, Homo sapien
gatacagcgaagtttgcttctagcg

SEQ ID NO: 356963 - DNA, 25 bp, Homo sapien
cagcgaagtttgcttctagcgagaa

SEQ ID NO: 356964 - DNA, 25 bp, Homo sapien
ttctagcgagaagcactcctatggg

SEQ ID NO: 356965 - DNA, 25 bp, Homo sapien
gcgagaagcactcctatgggaagct

SEQ ID NO: 356966 - DNA, 25 bp, Homo sapien
actcctatgggaagctggtgcctga

SEQ ID NO: 356967 - DNA, 25 bp, Homo sapien
tgcctgaggccgttggagatcagaa

SEQ ID NO: 356968 - DNA, 25 bp, Homo sapien
gccgttggagatcagaaagcccttc

SEQ ID NO: 356969 - DNA, 25 bp, Homo sapien
ggagatcagaaagcccttcaagaag

SEQ ID NO: 356970 - DNA, 25 bp, Homo sapien
ggaagggaaggtgcatcgccatcta

SEQ ID NO: 356971 - DNA, 25 bp, Homo sapien
gaagggaaggtgcatcgccatctac

SEQ ID NO: 356972 - DNA, 25 bp, Homo sapien
aagggaaggtgcatcgccatctaca

SEQ ID NO: 356973 - DNA, 25 bp, Homo sapien
agggaaggtgcatcgccatctacag

SEQ ID NO: 356974 - DNA, 25 bp, Homo sapien
aaggtgcatcgccatctacaggagc

SEQ ID NO: 356975 - DNA, 25 bp, Homo sapien
aggtgcatcgccatctacaggagca

SEQ ID NO: 356976 - DNA, 25 bp, Homo sapien
ggtgcatcgccatctacaggagcag

SEQ ID NO: 356977 - DNA, 25 bp, Homo sapien
gtgcatcgccatctacaggagcaga

SEQ ID NO: 356978 - DNA, 25 bp, Homo sapien
tgcatcgccatctacaggagcagaa

SEQ ID NO: 356979 - DNA, 25 bp, Homo sapien
gcatcgccatctacaggagcagaag

SEQ ID NO: 356980 - DNA, 25 bp, Homo sapien
catcgccatctacaggagcagaaga

SEQ ID NO: 356981 - DNA, 25 bp, Homo sapien
gggtcccctaggctgaccctgaatc

SEQ ID NO: 356982 - DNA, 25 bp, Homo sapien
gaggatgaagccagcgggaccacat

SEQ ID NO: 356983 - DNA, 25 bp, Homo sapien
aggatgaagccagcgggaccacatg

SEQ ID NO: 356984 - DNA, 25 bp, Homo sapien
gaagccagcgggaccacatggcttg

SEQ ID NO: 356985 - DNA, 25 bp, Homo sapien
gaccacatggcttggtggcttggac

SEQ ID NO: 356986 - DNA, 25 bp, Homo sapien
acatggcttggtggcttggacaaac

SEQ ID NO: 356987 - DNA, 25 bp, Homo sapien
atggcttggtggcttggacaaacaa

SEQ ID NO: 356988 - DNA, 25 bp, Homo sapien
ttggtggcttggacaaacaagctca

SEQ ID NO: 356989 - DNA, 25 bp, Homo sapien
agaggaatgcaaccctgttgggcac

SEQ ID NO: 356990 - DNA, 25 bp, Homo sapien
ctgttgggcacagaccatgcaatct

SEQ ID NO: 356991 - DNA, 25 bp, Homo sapien
caaccagaggaaacccatttactag

SEQ ID NO: 356992 - DNA, 25 bp, Homo sapien
ttgacctcggcccactaggatcatg

SEQ ID NO: 356993 - DNA, 25 bp, Homo sapien
ttgctcagcgtacctttcccatggc

SEQ ID NO: 356994 - DNA, 25 bp, Homo sapien
tttcccatggcactctgacgtactg

SEQ ID NO: 356995 - DNA, 25 bp, Homo sapien
atggcactctgacgtactggatgtt

SEQ ID NO: 356996 - DNA, 25 bp, Homo sapien
tctgacgtactggatgtttggtttc

SEQ ID NO: 356997 - DNA, 25 bp, Homo sapien
ggtttctgaagttactggctgttta

SEQ ID NO: 356998 - DNA, 25 bp, Homo sapien
tgaagttactggctgtttaccctgc

SEQ ID NO: 356999 - DNA, 25 bp, Homo sapien
ggctgtttaccctgccgggatgtaa

SEQ ID NO: 357000 - DNA, 25 bp, Homo sapien
gcttgtctcgtgttcagtgctgcat

SEQ ID NO: 357001 - DNA, 25 bp, Homo sapien
cgtgttcagtgctgcatcccagctg

SEQ ID NO: 357002 - DNA, 25 bp, Homo sapien
ctggtccatggcgttcaataaataa

SEQ ID NO: 357003 - DNA, 25 bp, Homo sapien
ttttctgctctggaattcctgctta

SEQ ID NO: 357004 - DNA, 25 bp, Homo sapien
tcctgcttatttgagttgccactgc

SEQ ID NO: 357005 - DNA, 25 bp, Homo sapien
ggaacttctgcttgtctttgtaccc

SEQ ID NO: 357006 - DNA, 25 bp, Homo sapien
tttgtaccccacagtgcctagattc

SEQ ID NO: 357007 - DNA, 25 bp, Homo sapien
gattcctcaactctaaccaaagctt

SEQ ID NO: 357008 - DNA, 25 bp, Homo sapien
ttggcagagtgttagctctggcctc

SEQ ID NO: 357009 - DNA, 25 bp, Homo sapien
gcctgagactcagcatttctagaca

SEQ ID NO: 357010 - DNA, 25 bp, Homo sapien
ctcagcatttctagacagctccagg

SEQ ID NO: 357011 - DNA, 25 bp, Homo sapien
gagacgctgatgctactgatccaag

SEQ ID NO: 357012 - DNA, 25 bp, Homo sapien
gctactgatccaagacacactgtga

SEQ ID NO: 357013 - DNA, 25 bp, Homo sapien
gacacactgtgagtagccagaaagt

SEQ ID NO: 357014 - DNA, 25 bp, Homo sapien
gagcaaggaccggacgagacgctac

SEQ ID NO: 357015 - DNA, 25 bp, Homo sapien
ggaccggacgagacgctacgcctga

SEQ ID NO: 357016 - DNA, 25 bp, Homo sapien
gacgagacgctacgcctgaaaacag

SEQ ID NO: 357017 - DNA, 25 bp, Homo sapien
gagggacgaggcttaccacggcacc

SEQ ID NO: 357018 - DNA, 25 bp, Homo sapien
ggacgaggcttaccacggcaccacg

SEQ ID NO: 357019 - DNA, 25 bp, Homo sapien
accacggcaccacgcgagtggaaag

SEQ ID NO: 357020 - DNA, 25 bp, Homo sapien
accacgcgagtggaaagggtcgtct

SEQ ID NO: 357021 - DNA, 25 bp, Homo sapien
cgagtggaaagggtcgtctccgcta

SEQ ID NO: 357022 - DNA, 25 bp, Homo sapien
aaagggtcgtctccgctagcggcgg

SEQ ID NO: 357023 - DNA, 25 bp, Homo sapien
ggcagcaaccggaaccggaactcgt

SEQ ID NO: 357024 - DNA, 25 bp, Homo sapien
ggccaccaccactgagcgctgcggg

SEQ ID NO: 357025 - DNA, 25 bp, Homo sapien
actggaccatcctgtcttatggtga

SEQ ID NO: 357026 - DNA, 25 bp, Homo sapien
ataacattagtgtatttctcctgtg

SEQ ID NO: 357027 - DNA, 25 bp, Homo sapien
gccttctgaagtggcacaaacctgt

SEQ ID NO: 357028 - DNA, 25 bp, Homo sapien
ggcacaaacctgtgtttatatattt

SEQ ID NO: 357029 - DNA, 25 bp, Homo sapien
gatactctaggatgatcacttgtgc

SEQ ID NO: 357030 - DNA, 25 bp, Homo sapien
gatgatcacttgtgcttagcttagc

SEQ ID NO: 357031 - DNA, 25 bp, Homo sapien
tagcttagcattgtaactctttaag

SEQ ID NO: 357032 - DNA, 25 bp, Homo sapien
actctttaagtctatattttcctca

SEQ ID NO: 357033 - DNA, 25 bp, Homo sapien
attttcctcagtgcgtttctttaca

SEQ ID NO: 357034 - DNA, 25 bp, Homo sapien
tttacaatttcaaatgttaccctga

SEQ ID NO: 357035 - DNA, 25 bp, Homo sapien
gaatgtagaacaccttgacatttct

SEQ ID NO: 357036 - DNA, 25 bp, Homo sapien
attctcttccacatgtagccagagg

SEQ ID NO: 357037 - DNA, 25 bp, Homo sapien
tcttccacatgtagccagagggacc

SEQ ID NO: 357038 - DNA, 25 bp, Homo sapien
cacatgtagccagagggacctttct

SEQ ID NO: 357039 - DNA, 25 bp, Homo sapien
tgtagccagagggacctttctaaaa

SEQ ID NO: 357040 - DNA, 25 bp, Homo sapien
gagggacctttctaaaacgcacatc

SEQ ID NO: 357041 - DNA, 25 bp, Homo sapien
ggacctttctaaaacgcacatctgg

SEQ ID NO: 357042 - DNA, 25 bp, Homo sapien
ttctaaaacgcacatctggctactt

SEQ ID NO: 357043 - DNA, 25 bp, Homo sapien
aaaacgcacatctggctacttccct

SEQ ID NO: 357044 - DNA, 25 bp, Homo sapien
aatccttcgggacgccctgtggcct

SEQ ID NO: 357045 - DNA, 25 bp, Homo sapien
aagccccacctctgcgggagtggcg

SEQ ID NO: 357046 - DNA, 25 bp, Homo sapien
ggagtggcgtgtgaggctcttcacc

SEQ ID NO: 357047 - DNA, 25 bp, Homo sapien
tgtaagagatattcagaatgctcac

SEQ ID NO: 357048 - DNA, 25 bp, Homo sapien
tcagaatgctcacactgaaaatgcc

SEQ ID NO: 357049 - DNA, 25 bp, Homo sapien
tcacactgaaaatgcctcaactttt

SEQ ID NO: 357050 - DNA, 25 bp, Homo sapien
cactgaaaatgcctcaactttttaa

SEQ ID NO: 357051 - DNA, 25 bp, Homo sapien
atgcctcaactttttaaagtgtaag

SEQ ID NO: 357052 - DNA, 25 bp, Homo sapien
aagtgtaagaaaccaccatgagtgg

SEQ ID NO: 357053 - DNA, 25 bp, Homo sapien
aatgaagaatcatgatacagtttgg

SEQ ID NO: 357054 - DNA, 25 bp, Homo sapien
acagtttggattaagtatcttggac

SEQ ID NO: 357055 - DNA, 25 bp, Homo sapien
gattaagtatcttggactggtttta

SEQ ID NO: 357056 - DNA, 25 bp, Homo sapien
cttggactggttttaaacagtgctt

SEQ ID NO: 357057 - DNA, 25 bp, Homo sapien
aaacagtgctttgtaccggatctgc

SEQ ID NO: 357058 - DNA, 25 bp, Homo sapien
acacgcagtctttgcagtatctgac

SEQ ID NO: 357059 - DNA, 25 bp, Homo sapien
gagaactcacaggaagttacttcaa

SEQ ID NO: 357060 - DNA, 25 bp, Homo sapien
gcacttgccagtactatgatattca

SEQ ID NO: 357061 - DNA, 25 bp, Homo sapien
tcaagtaccttgcagcatttctctg

SEQ ID NO: 357062 - DNA, 25 bp, Homo sapien
cagcatttctctgccattgctttca

SEQ ID NO: 357063 - DNA, 25 bp, Homo sapien
ttgctttcaatgaggccagaggcat

SEQ ID NO: 357064 - DNA, 25 bp, Homo sapien
aagtgcgttcatatacatgtgaggt

SEQ ID NO: 357065 - DNA, 25 bp, Homo sapien
tatacatgtgaggttttcttttgct

SEQ ID NO: 357066 - DNA, 25 bp, Homo sapien
gttttcttttgcttgagtggacagt

SEQ ID NO: 357067 - DNA, 25 bp, Homo sapien
gtagcacctgtatcattgaactcat

SEQ ID NO: 357068 - DNA, 25 bp, Homo sapien
gagcaattttgcttgcagaaagcta

SEQ ID NO: 357069 - DNA, 25 bp, Homo sapien
actcttcaacctcataccagtggga

SEQ ID NO: 357070 - DNA, 25 bp, Homo sapien
cttcaacctcataccagtgggacta

SEQ ID NO: 357071 - DNA, 25 bp, Homo sapien
aacctcataccagtgggactacgtg

SEQ ID NO: 357072 - DNA, 25 bp, Homo sapien
tcataccagtgggactacgtgttgt

SEQ ID NO: 357073 - DNA, 25 bp, Homo sapien
accagtgggactacgtgttgttgcc

SEQ ID NO: 357074 - DNA, 25 bp, Homo sapien
tgggactacgtgttgttgccatcca

SEQ ID NO: 357075 - DNA, 25 bp, Homo sapien
gactacgtgttgttgccatccaggg

SEQ ID NO: 357076 - DNA, 25 bp, Homo sapien
ctacgtgttgttgccatccagggag

SEQ ID NO: 357077 - DNA, 25 bp, Homo sapien
catccagggagtgaaaacagggttg

SEQ ID NO: 357078 - DNA, 25 bp, Homo sapien
aacagggttgtatatagccatgaat

SEQ ID NO: 357079 - DNA, 25 bp, Homo sapien
tagccatgaatggagaaggttacct

SEQ ID NO: 357080 - DNA, 25 bp, Homo sapien
aaaggatgttgaccggacagatcgc

SEQ ID NO: 357081 - DNA, 25 bp, Homo sapien
gttgaccggacagatcgcaaaagag

SEQ ID NO: 357082 - DNA, 25 bp, Homo sapien
gtccccataaagagccccaattcat

SEQ ID NO: 357083 - DNA, 25 bp, Homo sapien
aaagagccccaattcatgctgcagt

SEQ ID NO: 357084 - DNA, 25 bp, Homo sapien
aattcatgctgcagtccaagccaag

SEQ ID NO: 357085 - DNA, 25 bp, Homo sapien
gctgcagtccaagccaaggatgctt

SEQ ID NO: 357086 - DNA, 25 bp, Homo sapien
gccaaggatgcttgaggactcagat

SEQ ID NO: 357087 - DNA, 25 bp, Homo sapien
atgcttgaggactcagatgagcaac

SEQ ID NO: 357088 - DNA, 25 bp, Homo sapien
gatgagcaactggattatactgtac

SEQ ID NO: 357089 - DNA, 25 bp, Homo sapien
ctggattatactgtactgcccatga

SEQ ID NO: 357090 - DNA, 25 bp, Homo sapien
tgtactgcccatgaaaaaggatgtt

SEQ ID NO: 357091 - DNA, 25 bp, Homo sapien
tgcgaagtgcacctcccttgctcaa

SEQ ID NO: 357092 - DNA, 25 bp, Homo sapien
gcacctcccttgctcaaatcggagg

SEQ ID NO: 357093 - DNA, 25 bp, Homo sapien
gggtctggtcctcactgaacagccc

SEQ ID NO: 357094 - DNA, 25 bp, Homo sapien
atctcggtgtcctctcacatacaca

SEQ ID NO: 357095 - DNA, 25 bp, Homo sapien
gggtttccagagcatcgcacctctt

SEQ ID NO: 357096 - DNA, 25 bp, Homo sapien
gaactgagacatccacctgctgcgt

SEQ ID NO: 357097 - DNA, 25 bp, Homo sapien
acccgtgcgcaacttcagagctttc

SEQ ID NO: 357098 - DNA, 25 bp, Homo sapien
ggctgtggctccttcgtgaaaatgt

SEQ ID NO: 357099 - DNA, 25 bp, Homo sapien
gtgaaaatgtcaccgtctgcagcgc

SEQ ID NO: 357100 - DNA, 25 bp, Homo sapien
ctgcagcgcctttcttgtgatatag

SEQ ID NO: 357101 - DNA, 25 bp, Homo sapien
cttgtgatatagaacttgacgggtt

SEQ ID NO: 357102 - DNA, 25 bp, Homo sapien
aaaaggaaacagaatagtcaatgga

SEQ ID NO: 357103 - DNA, 25 bp, Homo sapien
tcctgcaaaacatccttccttgaag

SEQ ID NO: 357104 - DNA, 25 bp, Homo sapien
tgcaaaacatccttccttgaagcct

SEQ ID NO: 357105 - DNA, 25 bp, Homo sapien
caaaacatccttccttgaagcctag

SEQ ID NO: 357106 - DNA, 25 bp, Homo sapien
aaaacatccttccttgaagcctagc

SEQ ID NO: 357107 - DNA, 25 bp, Homo sapien
aaacatccttccttgaagcctagca

SEQ ID NO: 357108 - DNA, 25 bp, Homo sapien
aacatccttccttgaagcctagcac

SEQ ID NO: 357109 - DNA, 25 bp, Homo sapien
atccttccttgaagcctagcactga

SEQ ID NO: 357110 - DNA, 25 bp, Homo sapien
tccttccttgaagcctagcactgaa

SEQ ID NO: 357111 - DNA, 25 bp, Homo sapien
gctgtgaaaggagcagtacaaagaa

SEQ ID NO: 357112 - DNA, 25 bp, Homo sapien
gaatgtacagacattgagagcagaa

SEQ ID NO: 357113 - DNA, 25 bp, Homo sapien
gcttgctgtgctggctttgcaacaa

SEQ ID NO: 357114 - DNA, 25 bp, Homo sapien
ggctttgcaacaagacagactgtcc

SEQ ID NO: 357115 - DNA, 25 bp, Homo sapien
aagacagactgtccccaagagttcc

SEQ ID NO: 357116 - DNA, 25 bp, Homo sapien
ctgggcttccctagatgtcactgga

SEQ ID NO: 357117 - DNA, 25 bp, Homo sapien
atcctactcaggtctctggagctcc

SEQ ID NO: 357118 - DNA, 25 bp, Homo sapien
gagattctggatcttgacatgccca

SEQ ID NO: 357119 - DNA, 25 bp, Homo sapien
tctggatcttgacatgcccatctta

SEQ ID NO: 357120 - DNA, 25 bp, Homo sapien
catgcccatcttagaagccagtcaa

SEQ ID NO: 357121 - DNA, 25 bp, Homo sapien
gaagccagtcaagctatggaactaa

SEQ ID NO: 357122 - DNA, 25 bp, Homo sapien
tatggaactaatgcggaggctgctt

SEQ ID NO: 357123 - DNA, 25 bp, Homo sapien
taatgcggaggctgcttgctgtgct

SEQ ID NO: 357124 - DNA, 25 bp, Homo sapien
ggtgacatataaccttggctgtgtt

SEQ ID NO: 357125 - DNA, 25 bp, Homo sapien
tggctgtgttgatccattggactct

SEQ ID NO: 357126 - DNA, 25 bp, Homo sapien
tgaggtggtcgcataccagtgccct

SEQ ID NO: 357127 - DNA, 25 bp, Homo sapien
gtgcccttcatggatccacaatgga

SEQ ID NO: 357128 - DNA, 25 bp, Homo sapien
ggatgtcttctacaatccccttgtc

SEQ ID NO: 357129 - DNA, 25 bp, Homo sapien
atccccttgtcatgtataccatcga

SEQ ID NO: 357130 - DNA, 25 bp, Homo sapien
gtataccatcgatgggcttatgcat

SEQ ID NO: 357131 - DNA, 25 bp, Homo sapien
tatgcatttgatgcatgccttcctg

SEQ ID NO: 357132 - DNA, 25 bp, Homo sapien
ttcctgtgggaagtctgtggacccc

SEQ ID NO: 357133 - DNA, 25 bp, Homo sapien
ggagacacttggaggtccaggactt

SEQ ID NO: 357134 - DNA, 25 bp, Homo sapien
catcatgctgtggacggaacctggg

SEQ ID NO: 357135 - DNA, 25 bp, Homo sapien
gcaaggttataggatgccagattaa

SEQ ID NO: 357136 - DNA, 25 bp, Homo sapien
tataaaagtcagtcgctccttccat

SEQ ID NO: 357137 - DNA, 25 bp, Homo sapien
ctccttccataccagcaatgaacaa

SEQ ID NO: 357138 - DNA, 25 bp, Homo sapien
caactggaatgtgaaactgaaagca

SEQ ID NO: 357139 - DNA, 25 bp, Homo sapien
gaaagcacagtaccatttacattag

SEQ ID NO: 357140 - DNA, 25 bp, Homo sapien
agtaccatttacattagcatcaaaa

SEQ ID NO: 357141 - DNA, 25 bp, Homo sapien
tacattagcatcaaaaatctccaaa

SEQ ID NO: 357142 - DNA, 25 bp, Homo sapien
gagaggtctagttcatgtacatgga

SEQ ID NO: 357143 - DNA, 25 bp, Homo sapien
atgtacatggatagaaaaactcact

SEQ ID NO: 357144 - DNA, 25 bp, Homo sapien
gaaaaactcactattggcaagatgt

SEQ ID NO: 357145 - DNA, 25 bp, Homo sapien
actcactattggcaagatgtcattt

SEQ ID NO: 357146 - DNA, 25 bp, Homo sapien
aagggagataaactcaactcttcct

SEQ ID NO: 357147 - DNA, 25 bp, Homo sapien
actcaactcttccttaagaaaggtg

SEQ ID NO: 357148 - DNA, 25 bp, Homo sapien
agaggcaagattaagccacacatgc

SEQ ID NO: 357149 - DNA, 25 bp, Homo sapien
ccacacatgccggtatcaatttttt

SEQ ID NO: 357150 - DNA, 25 bp, Homo sapien
aaagccagctgactgttccagcagg

SEQ ID NO: 357151 - DNA, 25 bp, Homo sapien
cacctatagcaccacaggctacagt

SEQ ID NO: 357152 - DNA, 25 bp, Homo sapien
agcaccacaggctacagtatggacc

SEQ ID NO: 357153 - DNA, 25 bp, Homo sapien
acagtatggaccctgtcacaggcta

SEQ ID NO: 357154 - DNA, 25 bp, Homo sapien
ctgtcacaggctaccaatatgggca

SEQ ID NO: 357155 - DNA, 25 bp, Homo sapien
ggctaccaatatgggcagtatggac

SEQ ID NO: 357156 - DNA, 25 bp, Homo sapien
agtatggacaaagtaagccttggac

SEQ ID NO: 357157 - DNA, 25 bp, Homo sapien
tataatgatggttttgtctgttcct

SEQ ID NO: 357158 - DNA, 25 bp, Homo sapien
atggcgagttatctgtgctatgtga

SEQ ID NO: 357159 - DNA, 25 bp, Homo sapien
atctgtgctatgtgaaagctgtgaa

SEQ ID NO: 357160 - DNA, 25 bp, Homo sapien
gtgctctaagagttgtcaagagctg

SEQ ID NO: 357161 - DNA, 25 bp, Homo sapien
cctcattgcaaatttagtgactttc

SEQ ID NO: 357162 - DNA, 25 bp, Homo sapien
gtgactttctacacactatatggaa

SEQ ID NO: 357163 - DNA, 25 bp, Homo sapien
aatcccgagttaacccaggtctgca

SEQ ID NO: 357164 - DNA, 25 bp, Homo sapien
gttaacccaggtctgcaataacacc

SEQ ID NO: 357165 - DNA, 25 bp, Homo sapien
caggtctgcaataacaccatgttaa

SEQ ID NO: 357166 - DNA, 25 bp, Homo sapien
aaaggtgcagatagagacttggctc

SEQ ID NO: 357167 - DNA, 25 bp, Homo sapien
gagacttggctcaaaaaggcttgga

SEQ ID NO: 357168 - DNA, 25 bp, Homo sapien
ccccagcggctacaaaggaccaatt

SEQ ID NO: 357169 - DNA, 25 bp, Homo sapien
tgtccgtctagctcatgcagactga

SEQ ID NO: 357170 - DNA, 25 bp, Homo sapien
gggtggactgcggttctcaagatca

SEQ ID NO: 357171 - DNA, 25 bp, Homo sapien
gtggactgcggttctcaagatcagg

SEQ ID NO: 357172 - DNA, 25 bp, Homo sapien
ccgtctagctcatgcagactgagat

SEQ ID NO: 357173 - DNA, 25 bp, Homo sapien
ctctaagcattagccgccctgaatt

SEQ ID NO: 357174 - DNA, 25 bp, Homo sapien
gcattagccgccctgaattaacgtt

SEQ ID NO: 357175 - DNA, 25 bp, Homo sapien
cattagccgccctgaattaacgttt

SEQ ID NO: 357176 - DNA, 25 bp, Homo sapien
tagccgccctgaattaacgttttca

SEQ ID NO: 357177 - DNA, 25 bp, Homo sapien
gccgccctgaattaacgttttcacg

SEQ ID NO: 357178 - DNA, 25 bp, Homo sapien
tgaattaacgttttcacgggcagcc

SEQ ID NO: 357179 - DNA, 25 bp, Homo sapien
acagctggggccatatccgggctgc

SEQ ID NO: 357180 - DNA, 25 bp, Homo sapien
agctggggccatatccgggctgccc

SEQ ID NO: 357181 - DNA, 25 bp, Homo sapien
ctgcccgtggctgtccagtgaccgc

SEQ ID NO: 357182 - DNA, 25 bp, Homo sapien
tgcccgtggctgtccagtgaccgcc

SEQ ID NO: 357183 - DNA, 25 bp, Homo sapien
actgctccgggacacttctccctgg

SEQ ID NO: 357184 - DNA, 25 bp, Homo sapien
ctgctccgggacacttctccctggg

SEQ ID NO: 357185 - DNA, 25 bp, Homo sapien
tccgggacacttctccctggggcag

SEQ ID NO: 357186 - DNA, 25 bp, Homo sapien
ccgggacacttctccctggggcagt

SEQ ID NO: 357187 - DNA, 25 bp, Homo sapien
ttctccctggggcagtgctgccagc

SEQ ID NO: 357188 - DNA, 25 bp, Homo sapien
gcctgcccagcctgacgctgactct

SEQ ID NO: 357189 - DNA, 25 bp, Homo sapien
cagcctgacgctgactctccatgca

SEQ ID NO: 357190 - DNA, 25 bp, Homo sapien
agtcctcatatctgcagagaaccca

SEQ ID NO: 357191 - DNA, 25 bp, Homo sapien
agagaacccattgatcaccttgtgc

SEQ ID NO: 357192 - DNA, 25 bp, Homo sapien
gggcagcctgttgaaactgaagcac

SEQ ID NO: 357193 - DNA, 25 bp, Homo sapien
tgaagcacagtctgaccactcacga

SEQ ID NO: 357194 - DNA, 25 bp, Homo sapien
gaccactcacgataaagcagatttt

SEQ ID NO: 357195 - DNA, 25 bp, Homo sapien
tgcctctgccacaaggtttcagagt

SEQ ID NO: 357196 - DNA, 25 bp, Homo sapien
ggtttcagagtagtgtagtccaagt

SEQ ID NO: 357197 - DNA, 25 bp, Homo sapien
ttttctcgccgcaagaagcccattc

SEQ ID NO: 357198 - DNA, 25 bp, Homo sapien
gaagcccattcctatggaagtctag

SEQ ID NO: 357199 - DNA, 25 bp, Homo sapien
agcaaagcaatacgactcagcccag

SEQ ID NO: 357200 - DNA, 25 bp, Homo sapien
tgccccaggactcatggctctgctg

SEQ ID NO: 357201 - DNA, 25 bp, Homo sapien
aaaaagtggcgacctttcgactcat

SEQ ID NO: 357202 - DNA, 25 bp, Homo sapien
acctttcgactcatgttgctggaga

SEQ ID NO: 357203 - DNA, 25 bp, Homo sapien
agaggccagcggtcacggagactca

SEQ ID NO: 357204 - DNA, 25 bp, Homo sapien
tcacggagactcaccagttggcaga

SEQ ID NO: 357205 - DNA, 25 bp, Homo sapien
agaatgaaagactccgtgctgcctt

SEQ ID NO: 357206 - DNA, 25 bp, Homo sapien
tccgtgctgcctttggcatcagtga

SEQ ID NO: 357207 - DNA, 25 bp, Homo sapien
tggcatcagtgattcttacgtagat

SEQ ID NO: 357208 - DNA, 25 bp, Homo sapien
gattcttacgtagatggcagctctt

SEQ ID NO: 357209 - DNA, 25 bp, Homo sapien
tgatcctcagcgtcgtgcccgagaa

SEQ ID NO: 357210 - DNA, 25 bp, Homo sapien
agcgtcgtgcccgagaagctaaaca

SEQ ID NO: 357211 - DNA, 25 bp, Homo sapien
gaagctaaacaaccagctcctgagc

SEQ ID NO: 357212 - DNA, 25 bp, Homo sapien
ggagacgtcactgcggcgctgcctg

SEQ ID NO: 357213 - DNA, 25 bp, Homo sapien
tgggtggcatggtgggctcgggtct

SEQ ID NO: 357214 - DNA, 25 bp, Homo sapien
tgggctcgggtctctacgtgctcac

SEQ ID NO: 357215 - DNA, 25 bp, Homo sapien
gctcgggtctctacgtgctcacagg

SEQ ID NO: 357216 - DNA, 25 bp, Homo sapien
acgtgctcacaggtgccgtggccaa

SEQ ID NO: 357217 - DNA, 25 bp, Homo sapien
tcacaggtgccgtggccaaggaggt

SEQ ID NO: 357218 - DNA, 25 bp, Homo sapien
ttgtccttcggtgtggccgctgtgg

SEQ ID NO: 357219 - DNA, 25 bp, Homo sapien
gcagccctatgctatgcagaatttg

SEQ ID NO: 357220 - DNA, 25 bp, Homo sapien
ggcacgtgtgccacgcacgggctct

SEQ ID NO: 357221 - DNA, 25 bp, Homo sapien
tgcctacctgttcacctacgtatcc

SEQ ID NO: 357222 - DNA, 25 bp, Homo sapien
acagcccaagggatccataataata

SEQ ID NO: 357223 - DNA, 25 bp, Homo sapien
tgccaaattttcagcacacctgcca

SEQ ID NO: 357224 - DNA, 25 bp, Homo sapien
taagcgaaggtttccctacaagagg

SEQ ID NO: 357225 - DNA, 25 bp, Homo sapien
aaaaacggcacagctatctccaaac

SEQ ID NO: 357226 - DNA, 25 bp, Homo sapien
tccaaacacatctgagttcatttca

SEQ ID NO: 357227 - DNA, 25 bp, Homo sapien
gtgaccaagggaatctccgcacaaa

SEQ ID NO: 357228 - DNA, 25 bp, Homo sapien
gtgatgggtcattcccaagaatccc

SEQ ID NO: 357229 - DNA, 25 bp, Homo sapien
gggcatcccaaatccctgaggagta

SEQ ID NO: 357230 - DNA, 25 bp, Homo sapien
aacctggtcagttctcagtgagagc

SEQ ID NO: 357231 - DNA, 25 bp, Homo sapien
gagagccagctcacttatagctttg

SEQ ID NO: 357232 - DNA, 25 bp, Homo sapien
agctttgctgctagaacctgttgtg

SEQ ID NO: 357233 - DNA, 25 bp, Homo sapien
gctgctagaacctgttgtggctgca

SEQ ID NO: 357234 - DNA, 25 bp, Homo sapien
gaaggtagttgacaagctgtgaacc

SEQ ID NO: 357235 - DNA, 25 bp, Homo sapien
tgtgaacctgcattgcattctagtg

SEQ ID NO: 357236 - DNA, 25 bp, Homo sapien
aacctgcattgcattctagtgatgg

SEQ ID NO: 357237 - DNA, 25 bp, Homo sapien
ctgcattgcattctagtgatgggac

SEQ ID NO: 357238 - DNA, 25 bp, Homo sapien
gcattgcattctagtgatgggacac

SEQ ID NO: 357239 - DNA, 25 bp, Homo sapien
ttgcattctagtgatgggacacgtg

SEQ ID NO: 357240 - DNA, 25 bp, Homo sapien
cattctagtgatgggacacgtggaa

SEQ ID NO: 357241 - DNA, 25 bp, Homo sapien
gttgaagggtggatggtagcagcca

SEQ ID NO: 357242 - DNA, 25 bp, Homo sapien
tggtagcagccacagggagtgagat

SEQ ID NO: 357243 - DNA, 25 bp, Homo sapien
agatgggctcgtttctggagctgtt

SEQ ID NO: 357244 - DNA, 25 bp, Homo sapien
ttctggagctgttgggagagaaaaa

SEQ ID NO: 357245 - DNA, 25 bp, Homo sapien
gctgctctaatttttaggctataaa

SEQ ID NO: 357246 - DNA, 25 bp, Homo sapien
aaattttgtaatagagcttatcaga

SEQ ID NO: 357247 - DNA, 25 bp, Homo sapien
gagcttatcagatcgcaaatttcct

SEQ ID NO: 357248 - DNA, 25 bp, Homo sapien
agatcgcaaatttcctttgtttaca

SEQ ID NO: 357249 - DNA, 25 bp, Homo sapien
ctttgtttacaatctcatgtagtag

SEQ ID NO: 357250 - DNA, 25 bp, Homo sapien
acaatctcatgtagtagggctcaga

SEQ ID NO: 357251 - DNA, 25 bp, Homo sapien
gtagggctcagataatttcttagct

SEQ ID NO: 357252 - DNA, 25 bp, Homo sapien
taaaccttttctcccactctcatat

SEQ ID NO: 357253 - DNA, 25 bp, Homo sapien
tttctcccactctcatattgtttca

SEQ ID NO: 357254 - DNA, 25 bp, Homo sapien
ctcccactctcatattgtttcattt

SEQ ID NO: 357255 - DNA, 25 bp, Homo sapien
taagctaagcctaaaaattgaaatc

SEQ ID NO: 357256 - DNA, 25 bp, Homo sapien
aagaccacgattgcctgtgtttctg

SEQ ID NO: 357257 - DNA, 25 bp, Homo sapien
gcctgtgtttctgagatgcgtccat

SEQ ID NO: 357258 - DNA, 25 bp, Homo sapien
gtgtttctgagatgcgtccatggaa

SEQ ID NO: 357259 - DNA, 25 bp, Homo sapien
tgtggtgcgttgacttgctggaacc

SEQ ID NO: 357260 - DNA, 25 bp, Homo sapien
ttgacttgctggaacccttcctaag

SEQ ID NO: 357261 - DNA, 25 bp, Homo sapien
aacccttcctaagccgcagtgaaag

SEQ ID NO: 357262 - DNA, 25 bp, Homo sapien
gggctagatctgtgtgtgttcatgc

SEQ ID NO: 357263 - DNA, 25 bp, Homo sapien
gatctgtgtgtgttcatgcagctca

SEQ ID NO: 357264 - DNA, 25 bp, Homo sapien
gctgaacggataagcaaggccatct

SEQ ID NO: 357265 - DNA, 25 bp, Homo sapien
ataagcaaggccatctacatacaaa

SEQ ID NO: 357266 - DNA, 25 bp, Homo sapien
ggccatctacatacaaaagtacaca

SEQ ID NO: 357267 - DNA, 25 bp, Homo sapien
taatggcgtttccagtgcatggtct

SEQ ID NO: 357268 - DNA, 25 bp, Homo sapien
gcatggtcttgcaaactaacctcca

SEQ ID NO: 357269 - DNA, 25 bp, Homo sapien
aaactaacctccagtcagatcgttc

SEQ ID NO: 357270 - DNA, 25 bp, Homo sapien
agtcagatcgttctgagccagctgc

SEQ ID NO: 357271 - DNA, 25 bp, Homo sapien
tgctgttttgtgtggctctaaccct

SEQ ID NO: 357272 - DNA, 25 bp, Homo sapien
taggagcactcagactgggccggaa

SEQ ID NO: 357273 - DNA, 25 bp, Homo sapien
tgggccggaaagtcctccgattctg

SEQ ID NO: 357274 - DNA, 25 bp, Homo sapien
gaagaggtcccacagaaggtccctt

SEQ ID NO: 357275 - DNA, 25 bp, Homo sapien
gttcagtcccgctttaatgctgtaa

SEQ ID NO: 357276 - DNA, 25 bp, Homo sapien
gaagcactctacacacacgaacatg

SEQ ID NO: 357277 - DNA, 25 bp, Homo sapien
gaccgttgtttaatggcgtttccag

SEQ ID NO: 357278 - DNA, 25 bp, Homo sapien
actttttatgtcttgaatacctgca

SEQ ID NO: 357279 - DNA, 25 bp, Homo sapien
tctccaagtctttacgcaaatataa

SEQ ID NO: 357280 - DNA, 25 bp, Homo sapien
ctcactggcagggaataattcttac

SEQ ID NO: 357281 - DNA, 25 bp, Homo sapien
taattcttacaaggctgtgtggcaa

SEQ ID NO: 357282 - DNA, 25 bp, Homo sapien
atgtcttgaatacctgcattcccag

SEQ ID NO: 357283 - DNA, 25 bp, Homo sapien
aagtcattcaaggaactgtttctga

SEQ ID NO: 357284 - DNA, 25 bp, Homo sapien
gaatacctgcattcccagacccaaa

SEQ ID NO: 357285 - DNA, 25 bp, Homo sapien
ggaactgtttctgaaggcactactt

SEQ ID NO: 357286 - DNA, 25 bp, Homo sapien
ttctgaaggcactactttggagttt

SEQ ID NO: 357287 - DNA, 25 bp, Homo sapien
acacctggttctagtgccttttccg

SEQ ID NO: 357288 - DNA, 25 bp, Homo sapien
ctagtgccttttccgctgcccaggg

SEQ ID NO: 357289 - DNA, 25 bp, Homo sapien
gacaagcagcacagcagtgtgtccc

SEQ ID NO: 357290 - DNA, 25 bp, Homo sapien
aagcagcacagcagtgtgtccccaa

SEQ ID NO: 357291 - DNA, 25 bp, Homo sapien
gcagcacagcagtgtgtccccaaga

SEQ ID NO: 357292 - DNA, 25 bp, Homo sapien
cacagcagtgtgtccccaagaaagt

SEQ ID NO: 357293 - DNA, 25 bp, Homo sapien
gcagtgtgtccccaagaaagtgtca

SEQ ID NO: 357294 - DNA, 25 bp, Homo sapien
gtcagagcctttacgtggaccttcc

SEQ ID NO: 357295 - DNA, 25 bp, Homo sapien
gcctttacgtggaccttcccatgga

SEQ ID NO: 357296 - DNA, 25 bp, Homo sapien
agaaggacctcctgcaaaacatcct

SEQ ID NO: 357297 - DNA, 25 bp, Homo sapien
cttccttgaagcctagcactgaaat

SEQ ID NO: 357298 - DNA, 25 bp, Homo sapien
ctgaaatggaagatcctgctgtgaa

SEQ ID NO: 357299 - DNA, 25 bp, Homo sapien
agatccacaaggcagctgtcaaggg

SEQ ID NO: 357300 - DNA, 25 bp, Homo sapien
gcagattctcaaatatgaccttcct

SEQ ID NO: 357301 - DNA, 25 bp, Homo sapien
caaatatgaccttcctttgcatgta

SEQ ID NO: 357302 - DNA, 25 bp, Homo sapien
tacgtgattagctcagtcaggttgc

SEQ ID NO: 357303 - DNA, 25 bp, Homo sapien
gggctttccctgatgatcaaagctg

SEQ ID NO: 357304 - DNA, 25 bp, Homo sapien
tgatgatcaaagctgctcgtgtccc

SEQ ID NO: 357305 - DNA, 25 bp, Homo sapien
gtgtcccttggccagtcaaatttct

SEQ ID NO: 357306 - DNA, 25 bp, Homo sapien
gtcaaatttctggatgccatcaggg

SEQ ID NO: 357307 - DNA, 25 bp, Homo sapien
atgccatcagggaggtcagtatgac

SEQ ID NO: 357308 - DNA, 25 bp, Homo sapien
agttaggttcatgtacccggtgcac

SEQ ID NO: 357309 - DNA, 25 bp, Homo sapien
tgtacccggtgcacagtaagccaaa

SEQ ID NO: 357310 - DNA, 25 bp, Homo sapien
gtaagccaaacactgacacattaat

SEQ ID NO: 357311 - DNA, 25 bp, Homo sapien
tagtaaatgggtttcctctggttgg

SEQ ID NO: 357312 - DNA, 25 bp, Homo sapien
atggtctgtgcccaacagggttgca

SEQ ID NO: 357313 - DNA, 25 bp, Homo sapien
aacagggttgcattcctctgcagcc

SEQ ID NO: 357314 - DNA, 25 bp, Homo sapien
tgagcttgtttgtccaagccaccaa

SEQ ID NO: 357315 - DNA, 25 bp, Homo sapien
gagcttgtttgtccaagccaccaag

SEQ ID NO: 357316 - DNA, 25 bp, Homo sapien
ttgtttgtccaagccaccaagccat

SEQ ID NO: 357317 - DNA, 25 bp, Homo sapien
tttgtccaagccaccaagccatgtg

SEQ ID NO: 357318 - DNA, 25 bp, Homo sapien
tgtccaagccaccaagccatgtggt

SEQ ID NO: 357319 - DNA, 25 bp, Homo sapien
aagccatgtggtcccgctggcttca

SEQ ID NO: 357320 - DNA, 25 bp, Homo sapien
atgtggtcccgctggcttcatcctc

SEQ ID NO: 357321 - DNA, 25 bp, Homo sapien
gaagaggattcagggtcagcctagg

SEQ ID NO: 357322 - DNA, 25 bp, Homo sapien
gaaagagcttgaaatttgctttatt

SEQ ID NO: 357323 - DNA, 25 bp, Homo sapien
gctttattagcatagttataatctt

SEQ ID NO: 357324 - DNA, 25 bp, Homo sapien
ttaatctgaaggatgtttcttaatt

SEQ ID NO: 357325 - DNA, 25 bp, Homo sapien
tttcatattcagaaacatatcctaa

SEQ ID NO: 357326 - DNA, 25 bp, Homo sapien
atcctaatttatcatttaaacactg

SEQ ID NO: 357327 - DNA, 25 bp, Homo sapien
taaaaatatgtctacttagtaacct

SEQ ID NO: 357328 - DNA, 25 bp, Homo sapien
tatgtctacttagtaacctattttt

SEQ ID NO: 357329 - DNA, 25 bp, Homo sapien
agatattttatccttttgaccttga

SEQ ID NO: 357330 - DNA, 25 bp, Homo sapien
attttatccttttgaccttgatatg

SEQ ID NO: 357331 - DNA, 25 bp, Homo sapien
tccttttgaccttgatatgtttata

SEQ ID NO: 357332 - DNA, 25 bp, Homo sapien
gaccttgatatgtttatagtaattt

SEQ ID NO: 357333 - DNA, 25 bp, Homo sapien
gaggcccaacgagaattccagtgct

SEQ ID NO: 357334 - DNA, 25 bp, Homo sapien
attccagtgctgacatctcaggtaa

SEQ ID NO: 357335 - DNA, 25 bp, Homo sapien
ggtaaaacaagtcccagttctgcca

SEQ ID NO: 357336 - DNA, 25 bp, Homo sapien
gttctgccaagcctagcaactgtgt

SEQ ID NO: 357337 - DNA, 25 bp, Homo sapien
aagcctagcaactgtgtgatttcct

SEQ ID NO: 357338 - DNA, 25 bp, Homo sapien
tgtgtgatttcctgagctgcgggat

SEQ ID NO: 357339 - DNA, 25 bp, Homo sapien
tggagagcgcaggtcgcacactgca

SEQ ID NO: 357340 - DNA, 25 bp, Homo sapien
acactgcaccagtttgcacatcaga

SEQ ID NO: 357341 - DNA, 25 bp, Homo sapien
agtttgcacatcagacgccaactgg

SEQ ID NO: 357342 - DNA, 25 bp, Homo sapien
ctcagggacgctggatcccaaatga

SEQ ID NO: 357343 - DNA, 25 bp, Homo sapien
tcccaaatgagagggtccgaagcat

SEQ ID NO: 357344 - DNA, 25 bp, Homo sapien
tccgtgcccggctaaggtttcgagt

SEQ ID NO: 357345 - DNA, 25 bp, Homo sapien
ggctaaggtttcgagttttgctact

SEQ ID NO: 357346 - DNA, 25 bp, Homo sapien
tattgcacaggctggcctgcctcag

SEQ ID NO: 357347 - DNA, 25 bp, Homo sapien
gagttttgctactatattttgtcat

SEQ ID NO: 357348 - DNA, 25 bp, Homo sapien
ggaacactaataccattccgatgtt

SEQ ID NO: 357349 - DNA, 25 bp, Homo sapien
gatgttcatcacgtgtttctctgta

SEQ ID NO: 357350 - DNA, 25 bp, Homo sapien
acgtgtttctctgtatagcactaac

SEQ ID NO: 357351 - DNA, 25 bp, Homo sapien
gtatagcactaactaagcagcaggg

SEQ ID NO: 357352 - DNA, 25 bp, Homo sapien
ggcctgcctcagcaacatagtaacg

SEQ ID NO: 357353 - DNA, 25 bp, Homo sapien
gcattaatcgctgctttgtatgtca

SEQ ID NO: 357354 - DNA, 25 bp, Homo sapien
taacgcatctactggctcaagcaat

SEQ ID NO: 357355 - DNA, 25 bp, Homo sapien
aatttatttggacagaatacagtct

SEQ ID NO: 357356 - DNA, 25 bp, Homo sapien
aatacagtctgtacaagcttagaga

SEQ ID NO: 357357 - DNA, 25 bp, Homo sapien
gaggagttcaatttggaccaggaaa

SEQ ID NO: 357358 - DNA, 25 bp, Homo sapien
atttcattgatgaggcgagatttgc

SEQ ID NO: 357359 - DNA, 25 bp, Homo sapien
gatgaggcgagatttgcattaaacc

SEQ ID NO: 357360 - DNA, 25 bp, Homo sapien
ggtaatagaattagccatccttaaa

SEQ ID NO: 357361 - DNA, 25 bp, Homo sapien
gattttaatccaatactgaactgtt

SEQ ID NO: 357362 - DNA, 25 bp, Homo sapien
aaatgctttctctattgtaatgtac

SEQ ID NO: 357363 - DNA, 25 bp, Homo sapien
gtatatactgctattttctgtctgt

SEQ ID NO: 357364 - DNA, 25 bp, Homo sapien
actgctattttctgtctgttcattg

SEQ ID NO: 357365 - DNA, 25 bp, Homo sapien
gtctgttcattgttgtgaacttctt

SEQ ID NO: 357366 - DNA, 25 bp, Homo sapien
gcgccaggggttcaatgagcctcca

SEQ ID NO: 357367 - DNA, 25 bp, Homo sapien
accagatctctgtctcggagttcat

SEQ ID NO: 357368 - DNA, 25 bp, Homo sapien
agatctctgtctcggagttcatcgc

SEQ ID NO: 357369 - DNA, 25 bp, Homo sapien
tctgtctcggagttcatcgccgaga

SEQ ID NO: 357370 - DNA, 25 bp, Homo sapien
agttcatcgccgagaccaccgagga

SEQ ID NO: 357371 - DNA, 25 bp, Homo sapien
gaggactacaactcgcccaccacgt

SEQ ID NO: 357372 - DNA, 25 bp, Homo sapien
caggaacaccgtcacgctgctggag

SEQ ID NO: 357373 - DNA, 25 bp, Homo sapien
gctgctggaggaggctctagaccaa

SEQ ID NO: 357374 - DNA, 25 bp, Homo sapien
gctggaggaggctctagaccaagat

SEQ ID NO: 357375 - DNA, 25 bp, Homo sapien
gaggctctagaccaagatagaacag

SEQ ID NO: 357376 - DNA, 25 bp, Homo sapien
gatagaacagcccttcagaaagtga

SEQ ID NO: 357377 - DNA, 25 bp, Homo sapien
cgcctgccccaactggtcggagtct

SEQ ID NO: 357378 - DNA, 25 bp, Homo sapien
aactggtcggagtctccacaccgct

SEQ ID NO: 357379 - DNA, 25 bp, Homo sapien
tggtcggagtctccacaccgctgca

SEQ ID NO: 357380 - DNA, 25 bp, Homo sapien
tcggagtctccacaccgctgcaggg

SEQ ID NO: 357381 - DNA, 25 bp, Homo sapien
gtggcgactccagcccagtcgtgga

SEQ ID NO: 357382 - DNA, 25 bp, Homo sapien
gcgactccagcccagtcgtggattc

SEQ ID NO: 357383 - DNA, 25 bp, Homo sapien
actccagcccagtcgtggattctgg

SEQ ID NO: 357384 - DNA, 25 bp, Homo sapien
ctccagcccagtcgtggattctggc

SEQ ID NO: 357385 - DNA, 25 bp, Homo sapien
gctagcaacttgacctcggtcccag

SEQ ID NO: 357386 - DNA, 25 bp, Homo sapien
tagcaacttgacctcggtcccagtg

SEQ ID NO: 357387 - DNA, 25 bp, Homo sapien
agcaacttgacctcggtcccagtgc

SEQ ID NO: 357388 - DNA, 25 bp, Homo sapien
acaagcttccaatgactgacaagag

SEQ ID NO: 357389 - DNA, 25 bp, Homo sapien
gacaagagggttgccagcctcctaa

SEQ ID NO: 357390 - DNA, 25 bp, Homo sapien
aaaggccaaagctcagctctgcaag

SEQ ID NO: 357391 - DNA, 25 bp, Homo sapien
taaacaaaccgaccagcccaaagca

SEQ ID NO: 357392 - DNA, 25 bp, Homo sapien
aagtgactcatcagagacctctgtg

SEQ ID NO: 357393 - DNA, 25 bp, Homo sapien
gcgaggaccccggattaaacatgtc

SEQ ID NO: 357394 - DNA, 25 bp, Homo sapien
ctgcagaagagcagctgttgccctt

SEQ ID NO: 357395 - DNA, 25 bp, Homo sapien
ttgcccttggccgaaaacgagctgt

SEQ ID NO: 357396 - DNA, 25 bp, Homo sapien
aacgagctgtgtttcctgatgacat

SEQ ID NO: 357397 - DNA, 25 bp, Homo sapien
tgatgacatgcccaccctgagtgcc

SEQ ID NO: 357398 - DNA, 25 bp, Homo sapien
cctgagtgccttaccatgggaagaa

SEQ ID NO: 357399 - DNA, 25 bp, Homo sapien
gatgttcatagccagtattcagtat

SEQ ID NO: 357400 - DNA, 25 bp, Homo sapien
gggaaaatgtctgttaaggctaatc

SEQ ID NO: 357401 - DNA, 25 bp, Homo sapien
ctgttaaggctaatcatctgagtga

SEQ ID NO: 357402 - DNA, 25 bp, Homo sapien
gtgatttgagtagcaattaaaccaa

SEQ ID NO: 357403 - DNA, 25 bp, Homo sapien
taagccctggtttatggctagttcc

SEQ ID NO: 357404 - DNA, 25 bp, Homo sapien
ttatggctagttcccttttgctcag

SEQ ID NO: 357405 - DNA, 25 bp, Homo sapien
gctagttcccttttgctcaggaaaa

SEQ ID NO: 357406 - DNA, 25 bp, Homo sapien
atagtactactttatggtttatgaa

SEQ ID NO: 357407 - DNA, 25 bp, Homo sapien
tatgatttatgttgcatcttccggg

SEQ ID NO: 357408 - DNA, 25 bp, Homo sapien
ggaaggtttaacagtacaaggagct

SEQ ID NO: 357409 - DNA, 25 bp, Homo sapien
gagctgaatcctacctgaaattatt

SEQ ID NO: 357410 - DNA, 25 bp, Homo sapien
gtttggtacatgtaaagtctttgaa

SEQ ID NO: 357411 - DNA, 25 bp, Homo sapien
aagtctttgaaagtgtaactggaat

SEQ ID NO: 357412 - DNA, 25 bp, Homo sapien
tggcatctgtggaataaccctgcta

SEQ ID NO: 357413 - DNA, 25 bp, Homo sapien
ataaccctgctaatgtaacacgtga

SEQ ID NO: 357414 - DNA, 25 bp, Homo sapien
gtaacacgtgagaaagcctttggtc

SEQ ID NO: 357415 - DNA, 25 bp, Homo sapien
agaaagcctttggtcatgccaccca

SEQ ID NO: 357416 - DNA, 25 bp, Homo sapien
tccctgtgagacactgggccaaagg

SEQ ID NO: 357417 - DNA, 25 bp, Homo sapien
tgtccagcacacagacactatgtgc

SEQ ID NO: 357418 - DNA, 25 bp, Homo sapien
taatcacatctacctgagactgcta

SEQ ID NO: 357419 - DNA, 25 bp, Homo sapien
acatctacctgagactgctatcatg

SEQ ID NO: 357420 - DNA, 25 bp, Homo sapien
gactgctatcatggaaattaaatgt

SEQ ID NO: 357421 - DNA, 25 bp, Homo sapien
tgtctatatttacacacagcacata

SEQ ID NO: 357422 - DNA, 25 bp, Homo sapien
atatgcacaaaatagcctgcccttc

SEQ ID NO: 357423 - DNA, 25 bp, Homo sapien
cacatgtctccctaaccttttattt

SEQ ID NO: 357424 - DNA, 25 bp, Homo sapien
ggaaattgcaaatatcagatccttc

SEQ ID NO: 357425 - DNA, 25 bp, Homo sapien
tcagatccttcagacctaaacatgt

SEQ ID NO: 357426 - DNA, 25 bp, Homo sapien
aacatgtcagtggatatgtcctaat

SEQ ID NO: 357427 - DNA, 25 bp, Homo sapien
gtgtatgttttctgcgtaaccacaa

SEQ ID NO: 357428 - DNA, 25 bp, Homo sapien
gcgtaaccacaatataatggccata

SEQ ID NO: 357429 - DNA, 25 bp, Homo sapien
tttagtctatagtcgtaagtcctca

SEQ ID NO: 357430 - DNA, 25 bp, Homo sapien
cgtaagtcctcaattgtcccaataa

SEQ ID NO: 357431 - DNA, 25 bp, Homo sapien
aataatgccctttatagctacccca

SEQ ID NO: 357432 - DNA, 25 bp, Homo sapien
tgcctgttcctgtagtttacagatt

SEQ ID NO: 357433 - DNA, 25 bp, Homo sapien
agattatatgcttcagaactgacga

SEQ ID NO: 357434 - DNA, 25 bp, Homo sapien
gacgatatatatttaggctgctttt

SEQ ID NO: 357435 - DNA, 25 bp, Homo sapien
gctgcttttctgtgtggcacattta

SEQ ID NO: 357436 - DNA, 25 bp, Homo sapien
atttcaactatttccgaggcagtcg

SEQ ID NO: 357437 - DNA, 25 bp, Homo sapien
gagccaccatggttgctaggcaata

SEQ ID NO: 357438 - DNA, 25 bp, Homo sapien
agcgggttgatagagcacggtatta

SEQ ID NO: 357439 - DNA, 25 bp, Homo sapien
gcacggtattaaactgaacccacat

SEQ ID NO: 357440 - DNA, 25 bp, Homo sapien
tgaacccacattggtgttttactta

SEQ ID NO: 357441 - DNA, 25 bp, Homo sapien
ccgaggcagtcgttcagaatttgaa

SEQ ID NO: 357442 - DNA, 25 bp, Homo sapien
gaatataattacactctttgggtga

SEQ ID NO: 357443 - DNA, 25 bp, Homo sapien
tggaccctggagaatctggactgga

SEQ ID NO: 357444 - DNA, 25 bp, Homo sapien
ctggactggaggagctctggctcct

SEQ ID NO: 357445 - DNA, 25 bp, Homo sapien
ctcccctgtgccagcaggtaaaggg

SEQ ID NO: 357446 - DNA, 25 bp, Homo sapien
tgcctggggccagggtctttgtacc

SEQ ID NO: 357447 - DNA, 25 bp, Homo sapien
ggctgtccttgcagaggcaaactgt

SEQ ID NO: 357448 - DNA, 25 bp, Homo sapien
tgtccttgcagaggcaaactgtcct

SEQ ID NO: 357449 - DNA, 25 bp, Homo sapien
tgatagagtcagagccttgaggact

SEQ ID NO: 357450 - DNA, 25 bp, Homo sapien
gatagagtcagagccttgaggactg

SEQ ID NO: 357451 - DNA, 25 bp, Homo sapien
gccagcaggtaaagggcctgggcct

SEQ ID NO: 357452 - DNA, 25 bp, Homo sapien
ggctcagtttgccttgtgaggagct

SEQ ID NO: 357453 - DNA, 25 bp, Homo sapien
gaagggtgggttttgcctggctcct

SEQ ID NO: 357454 - DNA, 25 bp, Homo sapien
gattttaatccaatactgaactgtt

SEQ ID NO: 357455 - DNA, 25 bp, Homo sapien
atactgaactgtttataaaatgctt

SEQ ID NO: 357456 - DNA, 25 bp, Homo sapien
taaaatgctttctctattgtaatgt

SEQ ID NO: 357457 - DNA, 25 bp, Homo sapien
aatgctttctctattgtaatgtact

SEQ ID NO: 357458 - DNA, 25 bp, Homo sapien
gtactgtaagtagtgaaattctgta

SEQ ID NO: 357459 - DNA, 25 bp, Homo sapien
gaaattctgtatatactgctatttt

SEQ ID NO: 357460 - DNA, 25 bp, Homo sapien
gtatatactgctattttctgtctgt

SEQ ID NO: 357461 - DNA, 25 bp, Homo sapien
atatactgctattttctgtctgttc

SEQ ID NO: 357462 - DNA, 25 bp, Homo sapien
tatactgctattttctgtctgttca

SEQ ID NO: 357463 - DNA, 25 bp, Homo sapien
gtctgttcattgttgtgaacttctt

SEQ ID NO: 357464 - DNA, 25 bp, Homo sapien
ctgttcattgttgtgaacttcttat

SEQ ID NO: 357465 - DNA, 25 bp, Homo sapien
ctttactcagtaataccaggccctc

SEQ ID NO: 357466 - DNA, 25 bp, Homo sapien
tagaaacttacccaccgaacagctt

SEQ ID NO: 357467 - DNA, 25 bp, Homo sapien
accgaacagcttcacatggcatgat

SEQ ID NO: 357468 - DNA, 25 bp, Homo sapien
gatgaatcgctttttagtttcccat

SEQ ID NO: 357469 - DNA, 25 bp, Homo sapien
ttagtttcccattccggacaaatat

SEQ ID NO: 357470 - DNA, 25 bp, Homo sapien
tgtattaacgcatgtcaagactctc

SEQ ID NO: 357471 - DNA, 25 bp, Homo sapien
caagactctcacttctctgtagaaa

SEQ ID NO: 357472 - DNA, 25 bp, Homo sapien
tcgattgttggttttctgtagactt

SEQ ID NO: 357473 - DNA, 25 bp, Homo sapien
gtagacttgtgatcacgcccaggaa

SEQ ID NO: 357474 - DNA, 25 bp, Homo sapien
ggaactgtcattttccagttaccag

SEQ ID NO: 357475 - DNA, 25 bp, Homo sapien
gaatcattgtctaatgtgccacgta

SEQ ID NO: 357476 - DNA, 25 bp, Homo sapien
agatgataaacggtgttgtttttgt

SEQ ID NO: 357477 - DNA, 25 bp, Homo sapien
aatggcagggatggctggcggcctc

SEQ ID NO: 357478 - DNA, 25 bp, Homo sapien
gagccttcagccagcctgcgggaga

SEQ ID NO: 357479 - DNA, 25 bp, Homo sapien
agccttcagccagcctgcgggagag

SEQ ID NO: 357480 - DNA, 25 bp, Homo sapien
ccttcagccagcctgcgggagagaa

SEQ ID NO: 357481 - DNA, 25 bp, Homo sapien
cttcagccagcctgcgggagagaaa

SEQ ID NO: 357482 - DNA, 25 bp, Homo sapien
ttcagccagcctgcgggagagaaag

SEQ ID NO: 357483 - DNA, 25 bp, Homo sapien
ccagcctgcgggagagaaagatgat

SEQ ID NO: 357484 - DNA, 25 bp, Homo sapien
cagcctgcgggagagaaagatgata

SEQ ID NO: 357485 - DNA, 25 bp, Homo sapien
cctgcgggagagaaagatgataaac

SEQ ID NO: 357486 - DNA, 25 bp, Homo sapien
gagaaagatgataaacggtgttgtt

SEQ ID NO: 357487 - DNA, 25 bp, Homo sapien
tatgcacatgcattcaaaaataggc

SEQ ID NO: 357488 - DNA, 25 bp, Homo sapien
aggcatttggtacaatggtgatctt

SEQ ID NO: 357489 - DNA, 25 bp, Homo sapien
gtgatcttgtacctgatgggctgaa

SEQ ID NO: 357490 - DNA, 25 bp, Homo sapien
tacctgatgggctgaaaccagctta

SEQ ID NO: 357491 - DNA, 25 bp, Homo sapien
gctgaaaccagcttaagaacaaatt

SEQ ID NO: 357492 - DNA, 25 bp, Homo sapien
acaaatttgttcttcctgatatgat

SEQ ID NO: 357493 - DNA, 25 bp, Homo sapien
tgatatgataactaggtctccaaga

SEQ ID NO: 357494 - DNA, 25 bp, Homo sapien
aaggctgctttagtgccttacgctt

SEQ ID NO: 357495 - DNA, 25 bp, Homo sapien
tagtgccttacgcttactaaattta

SEQ ID NO: 357496 - DNA, 25 bp, Homo sapien
tatttacctgggtttgagcctacag

SEQ ID NO: 357497 - DNA, 25 bp, Homo sapien
gggtttgagcctacagtctatttat

SEQ ID NO: 357498 - DNA, 25 bp, Homo sapien
tgtagagtccacacggccggggaga

SEQ ID NO: 357499 - DNA, 25 bp, Homo sapien
gggagacgctctgctgccagttgca

SEQ ID NO: 357500 - DNA, 25 bp, Homo sapien
gagacgctctgctgccagttgcagt

SEQ ID NO: 357501 - DNA, 25 bp, Homo sapien
cctaccaaaacacggctccctctct

SEQ ID NO: 357502 - DNA, 25 bp, Homo sapien
aaacacggctccctctctcacgcgg

SEQ ID NO: 357503 - DNA, 25 bp, Homo sapien
gggaataaatgctcccgcccggctg

SEQ ID NO: 357504 - DNA, 25 bp, Homo sapien
ggaataaatgctcccgcccggctgg

SEQ ID NO: 357505 - DNA, 25 bp, Homo sapien
gaataaatgctcccgcccggctggg

SEQ ID NO: 357506 - DNA, 25 bp, Homo sapien
caagtcccaaagattcagccccagg

SEQ ID NO: 357507 - DNA, 25 bp, Homo sapien
aagtcccaaagattcagccccaggg

SEQ ID NO: 357508 - DNA, 25 bp, Homo sapien
gtcccaaagattcagccccaggggg

SEQ ID NO: 357509 - DNA, 25 bp, Homo sapien
gttattttgcactttcttatgtata

SEQ ID NO: 357510 - DNA, 25 bp, Homo sapien
tttaatttcagcaagtttggttact

SEQ ID NO: 357511 - DNA, 25 bp, Homo sapien
gtttggttacttgttgcatgactct

SEQ ID NO: 357512 - DNA, 25 bp, Homo sapien
tggttacttgttgcatgactcttaa

SEQ ID NO: 357513 - DNA, 25 bp, Homo sapien
gttgcatgactcttaacacagctga

SEQ ID NO: 357514 - DNA, 25 bp, Homo sapien
gactcttaacacagctgactttttg

SEQ ID NO: 357515 - DNA, 25 bp, Homo sapien
gactttttgtgtcagtgcaatgtat

SEQ ID NO: 357516 - DNA, 25 bp, Homo sapien
gtgtcagtgcaatgtatattttttg

SEQ ID NO: 357517 - DNA, 25 bp, Homo sapien
gtcctgttattaacttgtaagccct

SEQ ID NO: 357518 - DNA, 25 bp, Homo sapien
gtaagccctagtaatggccaattat

SEQ ID NO: 357519 - DNA, 25 bp, Homo sapien
ggccaattatttgtacagcaacaga

SEQ ID NO: 357520 - DNA, 25 bp, Homo sapien
tgagcttgtttgtccaagccaccaa

SEQ ID NO: 357521 - DNA, 25 bp, Homo sapien
gagcttgtttgtccaagccaccaag

SEQ ID NO: 357522 - DNA, 25 bp, Homo sapien
agcttgtttgtccaagccaccaagc

SEQ ID NO: 357523 - DNA, 25 bp, Homo sapien
ttgtttgtccaagccaccaagccat

SEQ ID NO: 357524 - DNA, 25 bp, Homo sapien
gtttgtccaagccaccaagccatgt

SEQ ID NO: 357525 - DNA, 25 bp, Homo sapien
tttgtccaagccaccaagccatgtg

SEQ ID NO: 357526 - DNA, 25 bp, Homo sapien
tgtccaagccaccaagccatgtggt

SEQ ID NO: 357527 - DNA, 25 bp, Homo sapien
gtccaagccaccaagccatgtggtc

SEQ ID NO: 357528 - DNA, 25 bp, Homo sapien
aagccatgtggtcccgctggcttca

SEQ ID NO: 357529 - DNA, 25 bp, Homo sapien
atgtggtcccgctggcttcatcctc

SEQ ID NO: 357530 - DNA, 25 bp, Homo sapien
gaagaggattcagggtcagcctagg

SEQ ID NO: 357531 - DNA, 25 bp, Homo sapien
tggcttttttgcctccaccttttag

SEQ ID NO: 357532 - DNA, 25 bp, Homo sapien
accttttagcccacatcatttaact

SEQ ID NO: 357533 - DNA, 25 bp, Homo sapien
ccttttagcccacatcatttaactc

SEQ ID NO: 357534 - DNA, 25 bp, Homo sapien
atttaactccactactgtgaaagct

SEQ ID NO: 357535 - DNA, 25 bp, Homo sapien
aactccactactgtgaaagcttgct

SEQ ID NO: 357536 - DNA, 25 bp, Homo sapien
tccactactgtgaaagcttgcttaa

SEQ ID NO: 357537 - DNA, 25 bp, Homo sapien
aagcttgcttaaagaaaatccctct

SEQ ID NO: 357538 - DNA, 25 bp, Homo sapien
agaaaatccctcttggccgggtgtg

SEQ ID NO: 357539 - DNA, 25 bp, Homo sapien
gagattttcactctcctgcaaatga

SEQ ID NO: 357540 - DNA, 25 bp, Homo sapien
gatcgttctcacactcatattagct

SEQ ID NO: 357541 - DNA, 25 bp, Homo sapien
atgttggaatttcccatcctgccat

SEQ ID NO: 357542 - DNA, 25 bp, Homo sapien
atagccagaaacaaggaataaacgt

SEQ ID NO: 357543 - DNA, 25 bp, Homo sapien
tagccagaaacaaggaataaacgtg

SEQ ID NO: 357544 - DNA, 25 bp, Homo sapien
agccagaaacaaggaataaacgtga

SEQ ID NO: 357545 - DNA, 25 bp, Homo sapien
gccagaaacaaggaataaacgtgat

SEQ ID NO: 357546 - DNA, 25 bp, Homo sapien
ccagaaacaaggaataaacgtgatt

SEQ ID NO: 357547 - DNA, 25 bp, Homo sapien
cagaaacaaggaataaacgtgattt

SEQ ID NO: 357548 - DNA, 25 bp, Homo sapien
gaaacaaggaataaacgtgatttca

SEQ ID NO: 357549 - DNA, 25 bp, Homo sapien
aaacaaggaataaacgtgatttcag

SEQ ID NO: 357550 - DNA, 25 bp, Homo sapien
aacaaggaataaacgtgatttcagt

SEQ ID NO: 357551 - DNA, 25 bp, Homo sapien
acaaggaataaacgtgatttcagtt

SEQ ID NO: 357552 - DNA, 25 bp, Homo sapien
caaggaataaacgtgatttcagttt

SEQ ID NO: 357553 - DNA, 25 bp, Homo sapien
gaggctccggtctgagcctggcctc

SEQ ID NO: 357554 - DNA, 25 bp, Homo sapien
acacgtgcctggaggccgtctcagg

SEQ ID NO: 357555 - DNA, 25 bp, Homo sapien
tggaggccgtctcaggcctggagag

SEQ ID NO: 357556 - DNA, 25 bp, Homo sapien
agcaacagcagggtcttcacgctac

SEQ ID NO: 357557 - DNA, 25 bp, Homo sapien
aacagcagggtcttcacgctacagg

SEQ ID NO: 357558 - DNA, 25 bp, Homo sapien
gcagggtcttcacgctacaggtgca

SEQ ID NO: 357559 - DNA, 25 bp, Homo sapien
ctgagcctggcctcgggtcggttca

SEQ ID NO: 357560 - DNA, 25 bp, Homo sapien
ctgcaggctggacagtacgcttctg

SEQ ID NO: 357561 - DNA, 25 bp, Homo sapien
aggctggacagtacgcttctgtgtt

SEQ ID NO: 357562 - DNA, 25 bp, Homo sapien
tacgcttctgtgtttgtggacaatg

SEQ ID NO: 357563 - DNA, 25 bp, Homo sapien
ctgtgtttgtggacaatggctccgg

SEQ ID NO: 357564 - DNA, 25 bp, Homo sapien
gatacagtctgtaaatgtttattga

SEQ ID NO: 357565 - DNA, 25 bp, Homo sapien
gtttattgagaacatcttgcacaca

SEQ ID NO: 357566 - DNA, 25 bp, Homo sapien
gaacatcttgcacacaatttgaatt

SEQ ID NO: 357567 - DNA, 25 bp, Homo sapien
gtagaatgtcaatcaagtttttgta

SEQ ID NO: 357568 - DNA, 25 bp, Homo sapien
caagttatctctgccaagtgctctt

SEQ ID NO: 357569 - DNA, 25 bp, Homo sapien
tatctctgccaagtgctcttgataa

SEQ ID NO: 357570 - DNA, 25 bp, Homo sapien
aagtgctcttgataatttcttcaga

SEQ ID NO: 357571 - DNA, 25 bp, Homo sapien
atataaatgcaatccatgctttttt

SEQ ID NO: 357572 - DNA, 25 bp, Homo sapien
acattgccagagtatgcttgttcta

SEQ ID NO: 357573 - DNA, 25 bp, Homo sapien
tgccagagtatgcttgttctaacaa

SEQ ID NO: 357574 - DNA, 25 bp, Homo sapien
taaaatatctcacccaagacttaaa

SEQ ID NO: 357575 - DNA, 25 bp, Homo sapien
gaggagctggaatatggcttctgaa

SEQ ID NO: 357576 - DNA, 25 bp, Homo sapien
ggcttctgaagttacagtcccttgt

SEQ ID NO: 357577 - DNA, 25 bp, Homo sapien
tacagtcccttgtcatagtggtaca

SEQ ID NO: 357578 - DNA, 25 bp, Homo sapien
gtcatagtggtacaaagatgtcttc

SEQ ID NO: 357579 - DNA, 25 bp, Homo sapien
tcattcatctgttggcacatgtact

SEQ ID NO: 357580 - DNA, 25 bp, Homo sapien
tctgttggcacatgtactctgggta

SEQ ID NO: 357581 - DNA, 25 bp, Homo sapien
tgtactctgggtaaactgccggcaa

SEQ ID NO: 357582 - DNA, 25 bp, Homo sapien
aactgccggcaaggccaaagtgatg

SEQ ID NO: 357583 - DNA, 25 bp, Homo sapien
aagttagactggcttcactttccaa

SEQ ID NO: 357584 - DNA, 25 bp, Homo sapien
ccatttgcagacttttgggtggtct

SEQ ID NO: 357585 - DNA, 25 bp, Homo sapien
tctcccatgcagcagtgcacggctg

SEQ ID NO: 357586 - DNA, 25 bp, Homo sapien
atctttcttcttgatcttatctcca

SEQ ID NO: 357587 - DNA, 25 bp, Homo sapien
gatcttatctccagatttggtctct

SEQ ID NO: 357588 - DNA, 25 bp, Homo sapien
ttccctttggtaactctgaaatgtc

SEQ ID NO: 357589 - DNA, 25 bp, Homo sapien
agatttggtctctgatttatttaga

SEQ ID NO: 357590 - DNA, 25 bp, Homo sapien
gctgaatttcggtcagagccacttc

SEQ ID NO: 357591 - DNA, 25 bp, Homo sapien
agagccacttctaggtctcccacga

SEQ ID NO: 357592 - DNA, 25 bp, Homo sapien
tctcccacgaggttttcgaggacta

SEQ ID NO: 357593 - DNA, 25 bp, Homo sapien
agaccttgtgggacttcgcactctg

SEQ ID NO: 357594 - DNA, 25 bp, Homo sapien
gtgggacttcgcactctgacttctt

SEQ ID NO: 357595 - DNA, 25 bp, Homo sapien
ctgacttcttcatctgagccaaaac

SEQ ID NO: 357596 - DNA, 25 bp, Homo sapien
gaaggtgggaggtcttcctctcttc

SEQ ID NO: 357597 - DNA, 25 bp, Homo sapien
gcctcaatctaaaagcagtgccaca

SEQ ID NO: 357598 - DNA, 25 bp, Homo sapien
agcagtgccacaccctccaaagtgg

SEQ ID NO: 357599 - DNA, 25 bp, Homo sapien
agaagttcatgagtaagggctgcaa

SEQ ID NO: 357600 - DNA, 25 bp, Homo sapien
ggctgcaaggaattcttatcctggc

SEQ ID NO: 357601 - DNA, 25 bp, Homo sapien
ggaattcttatcctggccacatgtc

SEQ ID NO: 357602 - DNA, 25 bp, Homo sapien
cacccaatggagttaaccttggaag

SEQ ID NO: 357603 - DNA, 25 bp, Homo sapien
gagttaaccttggaagttgactatt

SEQ ID NO: 357604 - DNA, 25 bp, Homo sapien
ttaatgtctgccaggagttctaatc

SEQ ID NO: 357605 - DNA, 25 bp, Homo sapien
aggagttctaatcctgcctctgttc

SEQ ID NO: 357606 - DNA, 25 bp, Homo sapien
tttctctccttgaaagtccagcaca

SEQ ID NO: 357607 - DNA, 25 bp, Homo sapien
tgaaagtccagcacaccattcttgt

SEQ ID NO: 357608 - DNA, 25 bp, Homo sapien
tcagctttggaggatcttggaatgt

SEQ ID NO: 357609 - DNA, 25 bp, Homo sapien
cttggaatgtggtcataaggactca

SEQ ID NO: 357610 - DNA, 25 bp, Homo sapien
taaggactcaaggtgccaggcaggt

SEQ ID NO: 357611 - DNA, 25 bp, Homo sapien
gagggttctcaggaagttgccacac

SEQ ID NO: 357612 - DNA, 25 bp, Homo sapien
caggaagttgccacacaggtgagca

SEQ ID NO: 357613 - DNA, 25 bp, Homo sapien
tgatgttgggcgagtcactgcgtct

SEQ ID NO: 357614 - DNA, 25 bp, Homo sapien
agtcactgcgtctcgggcattggtg

SEQ ID NO: 357615 - DNA, 25 bp, Homo sapien
cgggcattggtgtcctgtcagtaaa

SEQ ID NO: 357616 - DNA, 25 bp, Homo sapien
gataataatggctgtacctcgcggg

SEQ ID NO: 357617 - DNA, 25 bp, Homo sapien
aggaccagcatggagctggcacaca

SEQ ID NO: 357618 - DNA, 25 bp, Homo sapien
tggcacacaggacatgttgaataaa

SEQ ID NO: 357619 - DNA, 25 bp, Homo sapien
atcctcacttattaactctcttttc

SEQ ID NO: 357620 - DNA, 25 bp, Homo sapien
ttaactctcttttcttgcatctcat

SEQ ID NO: 357621 - DNA, 25 bp, Homo sapien
ctcttttcttgcatctcatttttat

SEQ ID NO: 357622 - DNA, 25 bp, Homo sapien
tttatagagctactcatccttattt

SEQ ID NO: 357623 - DNA, 25 bp, Homo sapien
ggttgtaaatctgacttctttgcaa

SEQ ID NO: 357624 - DNA, 25 bp, Homo sapien
gacttctttgcaagtaactatgtat

SEQ ID NO: 357625 - DNA, 25 bp, Homo sapien
aaggacttaactgcctgtaacatga

SEQ ID NO: 357626 - DNA, 25 bp, Homo sapien
catgaaacttcaaactaaaccacta

SEQ ID NO: 357627 - DNA, 25 bp, Homo sapien
taaaccactaactcaatgaactact

SEQ ID NO: 357628 - DNA, 25 bp, Homo sapien
tgaactacttatggtttgtctgaca

SEQ ID NO: 357629 - DNA, 25 bp, Homo sapien
atccctcacttaccaattaattata

SEQ ID NO: 357630 - DNA, 25 bp, Homo sapien
gagtattaagattaccacctataga

SEQ ID NO: 357631 - DNA, 25 bp, Homo sapien
taccacctatagactgtaactatgg

SEQ ID NO: 357632 - DNA, 25 bp, Homo sapien
ggcagtagagtttgatacctgttac

SEQ ID NO: 357633 - DNA, 25 bp, Homo sapien
gatacctgttacaccaatggattgt

SEQ ID NO: 357634 - DNA, 25 bp, Homo sapien
gattgtaatactggtttgtctccac

SEQ ID NO: 357635 - DNA, 25 bp, Homo sapien
tggtttgtctccactagatgtcgct

SEQ ID NO: 357636 - DNA, 25 bp, Homo sapien
tagatgtcgctgtacattaccagaa

SEQ ID NO: 357637 - DNA, 25 bp, Homo sapien
gtcgctgtacattaccagaaacgtt

SEQ ID NO: 357638 - DNA, 25 bp, Homo sapien
gaaaacatgtttcccccttgacttg

SEQ ID NO: 357639 - DNA, 25 bp, Homo sapien
ccttgacttgctattagggcataat

SEQ ID NO: 357640 - DNA, 25 bp, Homo sapien
gggcataatttttggtttaggccat

SEQ ID NO: 357641 - DNA, 25 bp, Homo sapien
tgaagagctgaaccaatgggaaaac

SEQ ID NO: 357642 - DNA, 25 bp, Homo sapien
aagagctgaaccaatgggaaaactg

SEQ ID NO: 357643 - DNA, 25 bp, Homo sapien
aactgatgctcagaggcttgagcaa

SEQ ID NO: 357644 - DNA, 25 bp, Homo sapien
gatgctcagaggcttgagcaaccta

SEQ ID NO: 357645 - DNA, 25 bp, Homo sapien
tcagaggcttgagcaacctaggcca

SEQ ID NO: 357646 - DNA, 25 bp, Homo sapien
agaggcttgagcaacctaggccagg

SEQ ID NO: 357647 - DNA, 25 bp, Homo sapien
gaggcttgagcaacctaggccagga

SEQ ID NO: 357648 - DNA, 25 bp, Homo sapien
aggcttgagcaacctaggccaggac

SEQ ID NO: 357649 - DNA, 25 bp, Homo sapien
gcttgagcaacctaggccaggacct

SEQ ID NO: 357650 - DNA, 25 bp, Homo sapien
cttgagcaacctaggccaggacctg

SEQ ID NO: 357651 - DNA, 25 bp, Homo sapien
aggccaggacctgtccttagaggca

SEQ ID NO: 357652 - DNA, 25 bp, Homo sapien
tggtcccaggaagcccattttacag

SEQ ID NO: 357653 - DNA, 25 bp, Homo sapien
gaggcccaaaggcacgaagcgacct

SEQ ID NO: 357654 - DNA, 25 bp, Homo sapien
ggcccaaaggcacgaagcgacctct

SEQ ID NO: 357655 - DNA, 25 bp, Homo sapien
tcagcctcaccaagagcactggaag

SEQ ID NO: 357656 - DNA, 25 bp, Homo sapien
ctcaccaagagcactggaaggtggt

SEQ ID NO: 357657 - DNA, 25 bp, Homo sapien
cctcagaagcctcccagagtgacag

SEQ ID NO: 357658 - DNA, 25 bp, Homo sapien
gccaggatctggcaatttcctatcc

SEQ ID NO: 357659 - DNA, 25 bp, Homo sapien
acagcttgtgcagcctgcttaggag

SEQ ID NO: 357660 - DNA, 25 bp, Homo sapien
cttgtgcagcctgcttaggagcttg

SEQ ID NO: 357661 - DNA, 25 bp, Homo sapien
gcagcctgcttaggagcttgggaaa

SEQ ID NO: 357662 - DNA, 25 bp, Homo sapien
ggagcttgggaaatgactgtcatct

SEQ ID NO: 357663 - DNA, 25 bp, Homo sapien
gaattttgacagtgacattaccaat

SEQ ID NO: 357664 - DNA, 25 bp, Homo sapien
taccaattatgtggacttacgcaag

SEQ ID NO: 357665 - DNA, 25 bp, Homo sapien
gtggacttacgcaagtaacttaact

SEQ ID NO: 357666 - DNA, 25 bp, Homo sapien
gcaagtaacttaacttctgtaagtc

SEQ ID NO: 357667 - DNA, 25 bp, Homo sapien
atacactggtatctacacttataaa

SEQ ID NO: 357668 - DNA, 25 bp, Homo sapien
ggtatctacacttataaaccttata

SEQ ID NO: 357669 - DNA, 25 bp, Homo sapien
gaattacatgaagcatggtgccaca

SEQ ID NO: 357670 - DNA, 25 bp, Homo sapien
gcatggtgccacataatactacaca

SEQ ID NO: 357671 - DNA, 25 bp, Homo sapien
tactacacatgtactctgctagctc

SEQ ID NO: 357672 - DNA, 25 bp, Homo sapien
acatgtactctgctagctcttgtct

SEQ ID NO: 357673 - DNA, 25 bp, Homo sapien
tgtactctgctagctcttgtctcct

SEQ ID NO: 357674 - DNA, 25 bp, Homo sapien
ggaggcctgtgggtgacgtgttcaa

SEQ ID NO: 357675 - DNA, 25 bp, Homo sapien
tgggtgacgtgttcaagacggctca

SEQ ID NO: 357676 - DNA, 25 bp, Homo sapien
ggtgacgtgttcaagacggctcagc

SEQ ID NO: 357677 - DNA, 25 bp, Homo sapien
tgacgtgttcaagacggctcagcaa

SEQ ID NO: 357678 - DNA, 25 bp, Homo sapien
tacacactggctactctgccggagg

SEQ ID NO: 357679 - DNA, 25 bp, Homo sapien
acacactggctactctgccggaggg

SEQ ID NO: 357680 - DNA, 25 bp, Homo sapien
gggcacgcttttcacaacgtggaga

SEQ ID NO: 357681 - DNA, 25 bp, Homo sapien
acgcttttcacaacgtggagatgca

SEQ ID NO: 357682 - DNA, 25 bp, Homo sapien
ttttcacaacgtggagatgcagggt

SEQ ID NO: 357683 - DNA, 25 bp, Homo sapien
atgcagggtcatgggctgcctgcta

SEQ ID NO: 357684 - DNA, 25 bp, Homo sapien
agggtcatgggctgcctgctaccac

SEQ ID NO: 357685 - DNA, 25 bp, Homo sapien
acaatgaacttactgggacaaaatc

SEQ ID NO: 357686 - DNA, 25 bp, Homo sapien
tgggacaaaatctacagacttaaag

SEQ ID NO: 357687 - DNA, 25 bp, Homo sapien
tgcaaacccattcaacatcctgtaa

SEQ ID NO: 357688 - DNA, 25 bp, Homo sapien
attcaacatcctgtaaacatcagca

SEQ ID NO: 357689 - DNA, 25 bp, Homo sapien
caaggccaccagaagggcaaatgtg

SEQ ID NO: 357690 - DNA, 25 bp, Homo sapien
gaaacatggttcagtttgtggctta

SEQ ID NO: 357691 - DNA, 25 bp, Homo sapien
acatcaattttggttggccatgact

SEQ ID NO: 357692 - DNA, 25 bp, Homo sapien
attggccaagtgaaaacttcatcac

SEQ ID NO: 357693 - DNA, 25 bp, Homo sapien
gttggccatgactgcctatgtaaca

SEQ ID NO: 357694 - DNA, 25 bp, Homo sapien
gccatgactgcctatgtaacagata

SEQ ID NO: 357695 - DNA, 25 bp, Homo sapien
agccatataatcattatgcagatga

SEQ ID NO: 357696 - DNA, 25 bp, Homo sapien
accaatgaggttcctgaggtcacag

SEQ ID NO: 357697 - DNA, 25 bp, Homo sapien
tcctgaggtcacagtgttttccaag

SEQ ID NO: 357698 - DNA, 25 bp, Homo sapien
tgtcttgtggacaacatctttcctc

SEQ ID NO: 357699 - DNA, 25 bp, Homo sapien
atctttcctcctgtggtcaacatca

SEQ ID NO: 357700 - DNA, 25 bp, Homo sapien
tgtttctgagaccagcttcctctcc

SEQ ID NO: 357701 - DNA, 25 bp, Homo sapien
agaccagcttcctctccaagagtga

SEQ ID NO: 357702 - DNA, 25 bp, Homo sapien
ctctccaagagtgatcattccttct

SEQ ID NO: 357703 - DNA, 25 bp, Homo sapien
agagtgatcattccttcttcaagat

SEQ ID NO: 357704 - DNA, 25 bp, Homo sapien
cttcaagatcagttacctcaccttc

SEQ ID NO: 357705 - DNA, 25 bp, Homo sapien
atgagatttatgactgcaaggtgga

SEQ ID NO: 357706 - DNA, 25 bp, Homo sapien
cctcttctgaaacactgggagcctg

SEQ ID NO: 357707 - DNA, 25 bp, Homo sapien
atggaatgggctcagccaaggctcc

SEQ ID NO: 357708 - DNA, 25 bp, Homo sapien
tgccgctcccagttgtggtcgcatt

SEQ ID NO: 357709 - DNA, 25 bp, Homo sapien
cagttgtggtcgcattctcaagagc

SEQ ID NO: 357710 - DNA, 25 bp, Homo sapien
gcattctcaagagcggctgactgcg

SEQ ID NO: 357711 - DNA, 25 bp, Homo sapien
tgactgcgccgtggaccatcacttt

SEQ ID NO: 357712 - DNA, 25 bp, Homo sapien
gtggaccatcactttcgcttctgcc

SEQ ID NO: 357713 - DNA, 25 bp, Homo sapien
gctcttgcgcctattgcggcaacta

SEQ ID NO: 357714 - DNA, 25 bp, Homo sapien
tattgcggcaactactcacgctcct

SEQ ID NO: 357715 - DNA, 25 bp, Homo sapien
tactcacgctcctacgggacgagga

SEQ ID NO: 357716 - DNA, 25 bp, Homo sapien
gaggtgaatccgtggcagagaaaaa

SEQ ID NO: 357717 - DNA, 25 bp, Homo sapien
aatagtagtctagtcattcaagtga

SEQ ID NO: 357718 - DNA, 25 bp, Homo sapien
tagagggccacaaaggtggtcactc

SEQ ID NO: 357719 - DNA, 25 bp, Homo sapien
agggccacaaaggtggtcactccac

SEQ ID NO: 357720 - DNA, 25 bp, Homo sapien
acaaaggtggtcactccaccggcca

SEQ ID NO: 357721 - DNA, 25 bp, Homo sapien
aaggtggtcactccaccggccagcg

SEQ ID NO: 357722 - DNA, 25 bp, Homo sapien
gagttgaagcctccgaacagcttgg

SEQ ID NO: 357723 - DNA, 25 bp, Homo sapien
gttgaagcctccgaacagcttgggc

SEQ ID NO: 357724 - DNA, 25 bp, Homo sapien
aagcctccgaacagcttgggctcgg

SEQ ID NO: 357725 - DNA, 25 bp, Homo sapien
ctccgaacagcttgggctcggcggc

SEQ ID NO: 357726 - DNA, 25 bp, Homo sapien
ttgggcttgctcttgttgctaccca

SEQ ID NO: 357727 - DNA, 25 bp, Homo sapien
gcttgctcttgttgctacccatggt

SEQ ID NO: 357728 - DNA, 25 bp, Homo sapien
tgctcttgttgctacccatggtcct

SEQ ID NO: 357729 - DNA, 25 bp, Homo sapien
tttctcgcatggtggcctgtctttg

SEQ ID NO: 357730 - DNA, 25 bp, Homo sapien
ctgtctttggtgagcctgtttctgc

SEQ ID NO: 357731 - DNA, 25 bp, Homo sapien
tggtgagcctgtttctgcctctctg

SEQ ID NO: 357732 - DNA, 25 bp, Homo sapien
tgcctctctgcctgggtcatgagac

SEQ ID NO: 357733 - DNA, 25 bp, Homo sapien
gtcatgagaccggttgtcaatcctt

SEQ ID NO: 357734 - DNA, 25 bp, Homo sapien
gagaccggttgtcaatccttttcgc

SEQ ID NO: 357735 - DNA, 25 bp, Homo sapien
ttgtcaatccttttcgccgacgcgg

SEQ ID NO: 357736 - DNA, 25 bp, Homo sapien
ttcgccgacgcggttccgctttggg

SEQ ID NO: 357737 - DNA, 25 bp, Homo sapien
ttccgctttgggtgtgtgaaggcct

SEQ ID NO: 357738 - DNA, 25 bp, Homo sapien
aggagctctttgtcccgccggagac

SEQ ID NO: 357739 - DNA, 25 bp, Homo sapien
ccagcggacccacgtcagagaagat

SEQ ID NO: 357740 - DNA, 25 bp, Homo sapien
tggtcagcctccaatctcctttgag

SEQ ID NO: 357741 - DNA, 25 bp, Homo sapien
gcctccaatctcctttgagcaagag

SEQ ID NO: 357742 - DNA, 25 bp, Homo sapien
tccaatctcctttgagcaagagatg

SEQ ID NO: 357743 - DNA, 25 bp, Homo sapien
acatgaatcctacacgagctaggag

SEQ ID NO: 357744 - DNA, 25 bp, Homo sapien
gaatcctacacgagctaggagtgaa

SEQ ID NO: 357745 - DNA, 25 bp, Homo sapien
tacacgagctaggagtgaatccaga

SEQ ID NO: 357746 - DNA, 25 bp, Homo sapien
agctaggagtgaatccagaagcaga

SEQ ID NO: 357747 - DNA, 25 bp, Homo sapien
gagaggagggtcactcttggacaca

SEQ ID NO: 357748 - DNA, 25 bp, Homo sapien
ggagggtcactcttggacacaggac

SEQ ID NO: 357749 - DNA, 25 bp, Homo sapien
agggtcactcttggacacaggacct

SEQ ID NO: 357750 - DNA, 25 bp, Homo sapien
tcaacatggagaggagtggtttcca

SEQ ID NO: 357751 - DNA, 25 bp, Homo sapien
aagcagaagtgcgataaggccacaa

SEQ ID NO: 357752 - DNA, 25 bp, Homo sapien
tgcgataaggccacaagctcaagga

SEQ ID NO: 357753 - DNA, 25 bp, Homo sapien
gccacaagctcaaggaaggcaggca

SEQ ID NO: 357754 - DNA, 25 bp, Homo sapien
agagaacaggagtagattctaccct

SEQ ID NO: 357755 - DNA, 25 bp, Homo sapien
ggagtagattctaccctggagcctc

SEQ ID NO: 357756 - DNA, 25 bp, Homo sapien
ctcagaaggaagcatgatcctgcct

SEQ ID NO: 357757 - DNA, 25 bp, Homo sapien
aaactgatttcggacttcttgcttc

SEQ ID NO: 357758 - DNA, 25 bp, Homo sapien
atttcggacttcttgcttccagaat

SEQ ID NO: 357759 - DNA, 25 bp, Homo sapien
taatagattatccagatgggctcta

SEQ ID NO: 357760 - DNA, 25 bp, Homo sapien
agattatccagatgggctctaaatg

SEQ ID NO: 357761 - DNA, 25 bp, Homo sapien
gaggcagaggaaaagtagacacaga

SEQ ID NO: 357762 - DNA, 25 bp, Homo sapien
cgtgcgtgtgcccaaagagaacatg

SEQ ID NO: 357763 - DNA, 25 bp, Homo sapien
gtgcccaaagagaacatggtcctgg

SEQ ID NO: 357764 - DNA, 25 bp, Homo sapien
tggccgaggctttgagatcgcccag

SEQ ID NO: 357765 - DNA, 25 bp, Homo sapien
cgaggctttgagatcgcccagggca

SEQ ID NO: 357766 - DNA, 25 bp, Homo sapien
aggatccatcactgcatgaggctga

SEQ ID NO: 357767 - DNA, 25 bp, Homo sapien
cactgcatgaggctgatcgggttct

SEQ ID NO: 357768 - DNA, 25 bp, Homo sapien
gcatgaggctgatcgggttctcaga

SEQ ID NO: 357769 - DNA, 25 bp, Homo sapien
ggttctcagagagggccctggcact

SEQ ID NO: 357770 - DNA, 25 bp, Homo sapien
atggtgaagtccgatttgagcacgt

SEQ ID NO: 357771 - DNA, 25 bp, Homo sapien
aagtccgatttgagcacgtgcgtgt

SEQ ID NO: 357772 - DNA, 25 bp, Homo sapien
atttgagcacgtgcgtgtgcccaaa

SEQ ID NO: 357773 - DNA, 25 bp, Homo sapien
attatacagttgtgggcataataca

SEQ ID NO: 357774 - DNA, 25 bp, Homo sapien
gttgtgggcataatacaagcatcat

SEQ ID NO: 357775 - DNA, 25 bp, Homo sapien
gggcataatacaagcatcatttgga

SEQ ID NO: 357776 - DNA, 25 bp, Homo sapien
aagcatcatttggaaaagaacagag

SEQ ID NO: 357777 - DNA, 25 bp, Homo sapien
ccgtactgcaggaaaaaattatcaa

SEQ ID NO: 357778 - DNA, 25 bp, Homo sapien
aaaattatcaactccagtgatatta

SEQ ID NO: 357779 - DNA, 25 bp, Homo sapien
taaatacaacctaacgacacttctg

SEQ ID NO: 357780 - DNA, 25 bp, Homo sapien
atacaacctaacgacacttctgaag

SEQ ID NO: 357781 - DNA, 25 bp, Homo sapien
acaacctaacgacacttctgaagct

SEQ ID NO: 357782 - DNA, 25 bp, Homo sapien
aacctaacgacacttctgaagctga

SEQ ID NO: 357783 - DNA, 25 bp, Homo sapien
ctaacgacacttctgaagctgaaga

SEQ ID NO: 357784 - DNA, 25 bp, Homo sapien
taaagagctataataggctgggcac

SEQ ID NO: 357785 - DNA, 25 bp, Homo sapien
aaagagctataataggctgggcaca

SEQ ID NO: 357786 - DNA, 25 bp, Homo sapien
aaaattatccctgttcagtggtgtg

SEQ ID NO: 357787 - DNA, 25 bp, Homo sapien
aaattatccctgttcagtggtgtgc

SEQ ID NO: 357788 - DNA, 25 bp, Homo sapien
aattatccctgttcagtggtgtgcg

SEQ ID NO: 357789 - DNA, 25 bp, Homo sapien
attatccctgttcagtggtgtgcgc

SEQ ID NO: 357790 - DNA, 25 bp, Homo sapien
ttatccctgttcagtggtgtgcgcc

SEQ ID NO: 357791 - DNA, 25 bp, Homo sapien
tatccctgttcagtggtgtgcgcct

SEQ ID NO: 357792 - DNA, 25 bp, Homo sapien
atccctgttcagtggtgtgcgcctg

SEQ ID NO: 357793 - DNA, 25 bp, Homo sapien
ctgaggcgagaggagtgctcaaggt

SEQ ID NO: 357794 - DNA, 25 bp, Homo sapien
agtgctcaaggtgggaggtggagat

SEQ ID NO: 357795 - DNA, 25 bp, Homo sapien
tcccaaagccactggacttgctgtc

SEQ ID NO: 357796 - DNA, 25 bp, Homo sapien
tgccacgctgctccgccgagagaag

SEQ ID NO: 357797 - DNA, 25 bp, Homo sapien
gagaagctgctgacaaatcgctccg

SEQ ID NO: 357798 - DNA, 25 bp, Homo sapien
tgacaaatcgctccgcaatgacgct

SEQ ID NO: 357799 - DNA, 25 bp, Homo sapien
tccgcaatgacgctggcctggtcca

SEQ ID NO: 357800 - DNA, 25 bp, Homo sapien
tcctcgctgctcagggccttaaggt

SEQ ID NO: 357801 - DNA, 25 bp, Homo sapien
tgctcagggccttaaggtcctcagt

SEQ ID NO: 357802 - DNA, 25 bp, Homo sapien
cttaaggtcctcagtgctctcagct

SEQ ID NO: 357803 - DNA, 25 bp, Homo sapien
agtgctctcagctgccacgaagtcc

SEQ ID NO: 357804 - DNA, 25 bp, Homo sapien
cacgaagtccaccatgtcacctggg

SEQ ID NO: 357805 - DNA, 25 bp, Homo sapien
aaggccctggtgggcatcaagctgt

SEQ ID NO: 357806 - DNA, 25 bp, Homo sapien
gtttctaaccatcaatggatttcct

SEQ ID NO: 357807 - DNA, 25 bp, Homo sapien
acagattagtttttagaggcatgtc

SEQ ID NO: 357808 - DNA, 25 bp, Homo sapien
tagaggcatgtctatatctcgccca

SEQ ID NO: 357809 - DNA, 25 bp, Homo sapien
atgtctatatctcgcccaaatgctg

SEQ ID NO: 357810 - DNA, 25 bp, Homo sapien
gtgtcgcatgatccgccactcaaga

SEQ ID NO: 357811 - DNA, 25 bp, Homo sapien
aatgaacccaatcctcagaggtttg

SEQ ID NO: 357812 - DNA, 25 bp, Homo sapien
gaggtttgaccgaattgcacacaca

SEQ ID NO: 357813 - DNA, 25 bp, Homo sapien
aggagacaatgctctctgatggttt

SEQ ID NO: 357814 - DNA, 25 bp, Homo sapien
gctctctgatggtttgaactcactc

SEQ ID NO: 357815 - DNA, 25 bp, Homo sapien
ctggatgtacagagatacccattgt

SEQ ID NO: 357816 - DNA, 25 bp, Homo sapien
acagagatacccattgtatacccaa

SEQ ID NO: 357817 - DNA, 25 bp, Homo sapien
gggcagggcggactgcaggctccgc

SEQ ID NO: 357818 - DNA, 25 bp, Homo sapien
tcaatcagcgggtgtcccacttccg

SEQ ID NO: 357819 - DNA, 25 bp, Homo sapien
aatgaggttgataacagtgcctatc

SEQ ID NO: 357820 - DNA, 25 bp, Homo sapien
atgaggttgataacagtgcctatct

SEQ ID NO: 357821 - DNA, 25 bp, Homo sapien
aacagtgcctatctcgcggagttgt

SEQ ID NO: 357822 - DNA, 25 bp, Homo sapien
acagtgcctatctcgcggagttgtg

SEQ ID NO: 357823 - DNA, 25 bp, Homo sapien
cagtgcctatctcgcggagttgtga

SEQ ID NO: 357824 - DNA, 25 bp, Homo sapien
gcctatctcgcggagttgtgataat

SEQ ID NO: 357825 - DNA, 25 bp, Homo sapien
cctatctcgcggagttgtgataatt

SEQ ID NO: 357826 - DNA, 25 bp, Homo sapien
ctatctcgcggagttgtgataatta

SEQ ID NO: 357827 - DNA, 25 bp, Homo sapien
atctcgcggagttgtgataattaaa

SEQ ID NO: 357828 - DNA, 25 bp, Homo sapien
agagtttaaagtgggcaggacatac

SEQ ID NO: 357829 - DNA, 25 bp, Homo sapien
ggcaggacatactagggtttagcat

SEQ ID NO: 357830 - DNA, 25 bp, Homo sapien
actagggtttagcattttagccaat

SEQ ID NO: 357831 - DNA, 25 bp, Homo sapien
attttagccaatgtcttcctaggtg

SEQ ID NO: 357832 - DNA, 25 bp, Homo sapien
gaagggaactccactgtgtgacagt

SEQ ID NO: 357833 - DNA, 25 bp, Homo sapien
gtgtgacagtcctttcaatctgccc

SEQ ID NO: 357834 - DNA, 25 bp, Homo sapien
ttttcagccctacttttggcattcc

SEQ ID NO: 357835 - DNA, 25 bp, Homo sapien
tacttttggcattccttgggagcct

SEQ ID NO: 357836 - DNA, 25 bp, Homo sapien
ttgggagcctcagttgttgttcaag

SEQ ID NO: 357837 - DNA, 25 bp, Homo sapien
gcattattgaagcactttagctgaa

SEQ ID NO: 357838 - DNA, 25 bp, Homo sapien
ggaccacaaacacttctccttggaa

SEQ ID NO: 357839 - DNA, 25 bp, Homo sapien
tatacttaacattcatatcatacct

SEQ ID NO: 357840 - DNA, 25 bp, Homo sapien
atacttaacattcatatcatacctt

SEQ ID NO: 357841 - DNA, 25 bp, Homo sapien
tacttaacattcatatcataccttc

SEQ ID NO: 357842 - DNA, 25 bp, Homo sapien
gtacttaacaacttaatatagggag

SEQ ID NO: 357843 - DNA, 25 bp, Homo sapien
tacttaacaacttaatatagggagg

SEQ ID NO: 357844 - DNA, 25 bp, Homo sapien
tatagggaggaaaggtgtaaacagt

SEQ ID NO: 357845 - DNA, 25 bp, Homo sapien
ggtaattttatggtagtatcagctt

SEQ ID NO: 357846 - DNA, 25 bp, Homo sapien
gtaattttatggtagtatcagcttg

SEQ ID NO: 357847 - DNA, 25 bp, Homo sapien
taattttatggtagtatcagcttgt

SEQ ID NO: 357848 - DNA, 25 bp, Homo sapien
aattttatggtagtatcagcttgta

SEQ ID NO: 357849 - DNA, 25 bp, Homo sapien
taggataacctggtttccaagcctt

SEQ ID NO: 357850 - DNA, 25 bp, Homo sapien
ggactcctgggtattccgatggcaa

SEQ ID NO: 357851 - DNA, 25 bp, Homo sapien
gggtattccgatggcaactatattc

SEQ ID NO: 357852 - DNA, 25 bp, Homo sapien
gcaactatattcgaggacttctgta

SEQ ID NO: 357853 - DNA, 25 bp, Homo sapien
gttttcttatgctggcttctagagt

SEQ ID NO: 357854 - DNA, 25 bp, Homo sapien
gtggacgtagcaacatccgcagaca

SEQ ID NO: 357855 - DNA, 25 bp, Homo sapien
gcagacacctacatgaaccctagga

SEQ ID NO: 357856 - DNA, 25 bp, Homo sapien
ttagtagattaaagacccacctgct

SEQ ID NO: 357857 - DNA, 25 bp, Homo sapien
agacccacctgctatcgaagatgat

SEQ ID NO: 357858 - DNA, 25 bp, Homo sapien
gcttttgggatcagctggttcccca

SEQ ID NO: 357859 - DNA, 25 bp, Homo sapien
tggttccccacttggcgtgaatggc

SEQ ID NO: 357860 - DNA, 25 bp, Homo sapien
aatggctattaggaggtatcacaga

SEQ ID NO: 357861 - DNA, 25 bp, Homo sapien
gtctgactgcgcagaagcagcatga

SEQ ID NO: 357862 - DNA, 25 bp, Homo sapien
gcagaagcagcatgagggaactctt

SEQ ID NO: 357863 - DNA, 25 bp, Homo sapien
gtagaactggttgtggtgactcaaa

SEQ ID NO: 357864 - DNA, 25 bp, Homo sapien
tgtggtgactcaaatctatgcattt

SEQ ID NO: 357865 - DNA, 25 bp, Homo sapien
ttgcccatcaaaagggtgagattta

SEQ ID NO: 357866 - DNA, 25 bp, Homo sapien
gattcaaaatgctgcgtgatgccat

SEQ ID NO: 357867 - DNA, 25 bp, Homo sapien
catgaccattggacagatctgtgat

SEQ ID NO: 357868 - DNA, 25 bp, Homo sapien
gctgcgtgatgccatttatagaaca

SEQ ID NO: 357869 - DNA, 25 bp, Homo sapien
ttatagaacattctggaacagtcag

SEQ ID NO: 357870 - DNA, 25 bp, Homo sapien
gaacagtcagaatgctcgtggttgc

SEQ ID NO: 357871 - DNA, 25 bp, Homo sapien
aatgctcgtggttgcaaggagttga

SEQ ID NO: 357872 - DNA, 25 bp, Homo sapien
ccactgggtctttgtttggatttag

SEQ ID NO: 357873 - DNA, 25 bp, Homo sapien
ggatttagttttaatgcacctttga

SEQ ID NO: 357874 - DNA, 25 bp, Homo sapien
gaaactagttcagtagcccagagtg

SEQ ID NO: 357875 - DNA, 25 bp, Homo sapien
actagttcagtagcccagagtggat

SEQ ID NO: 357876 - DNA, 25 bp, Homo sapien
agttcagtagcccagagtggatctg

SEQ ID NO: 357877 - DNA, 25 bp, Homo sapien
agtagcccagagtggatctgaaagc

SEQ ID NO: 357878 - DNA, 25 bp, Homo sapien
gtggaacctaaaaaatgtgaactgt

SEQ ID NO: 357879 - DNA, 25 bp, Homo sapien
atgtgaactgtcaaagaactctgat

SEQ ID NO: 357880 - DNA, 25 bp, Homo sapien
gtcaaagaactctgatatcgaacag

SEQ ID NO: 357881 - DNA, 25 bp, Homo sapien
tgcttcctttccaacggaagaatct

SEQ ID NO: 357882 - DNA, 25 bp, Homo sapien
cctttccaacggaagaatcttcaat

SEQ ID NO: 357883 - DNA, 25 bp, Homo sapien
acagatttgtcaatgcccataaaaa

SEQ ID NO: 357884 - DNA, 25 bp, Homo sapien
taaaaactaggcatttagtccaact

SEQ ID NO: 357885 - DNA, 25 bp, Homo sapien
ttagtccaacttttgacagcgtttt

SEQ ID NO: 357886 - DNA, 25 bp, Homo sapien
acttttgacagcgttttacagctac

SEQ ID NO: 357887 - DNA, 25 bp, Homo sapien
gcgttttacagctacaagttcacat

SEQ ID NO: 357888 - DNA, 25 bp, Homo sapien
acagctacaagttcacattaaacaa

SEQ ID NO: 357889 - DNA, 25 bp, Homo sapien
cattaaacaaactattttcgcggag

SEQ ID NO: 357890 - DNA, 25 bp, Homo sapien
gggcacttcctttgtgtcagtgaca

SEQ ID NO: 357891 - DNA, 25 bp, Homo sapien
gtgtcagtgacaagtgggttatgtt

SEQ ID NO: 357892 - DNA, 25 bp, Homo sapien
gtgggttatgttgaagactctttcc

SEQ ID NO: 357893 - DNA, 25 bp, Homo sapien
ttatgttgaagactctttcctctcc

SEQ ID NO: 357894 - DNA, 25 bp, Homo sapien
tcgcctctggcggagcagcagccac

SEQ ID NO: 357895 - DNA, 25 bp, Homo sapien
gagcagcagccactcgcgcgcggag

SEQ ID NO: 357896 - DNA, 25 bp, Homo sapien
gggctcgcagggacgtttcctccct

SEQ ID NO: 357897 - DNA, 25 bp, Homo sapien
gagtgccgcgctcttgccctagcgg

SEQ ID NO: 357898 - DNA, 25 bp, Homo sapien
cccagcgcgccgaggatgtgagtcc

SEQ ID NO: 357899 - DNA, 25 bp, Homo sapien
cgcgccgaggatgtgagtcctgctc

SEQ ID NO: 357900 - DNA, 25 bp, Homo sapien
gccgaggatgtgagtcctgctcgcc

SEQ ID NO: 357901 - DNA, 25 bp, Homo sapien
gaggatgtgagtcctgctcgcctct

SEQ ID NO: 357902 - DNA, 25 bp, Homo sapien
ggatgtgagtcctgctcgcctctgg

SEQ ID NO: 357903 - DNA, 25 bp, Homo sapien
atgtgagtcctgctcgcctctggcg

SEQ ID NO: 357904 - DNA, 25 bp, Homo sapien
agtcctgctcgcctctggcggagca

SEQ ID NO: 357905 - DNA, 25 bp, Homo sapien
caactgtggccgagaaagcagggta

SEQ ID NO: 357906 - DNA, 25 bp, Homo sapien
aaagcagggtagacgtggccaagtc

SEQ ID NO: 357907 - DNA, 25 bp, Homo sapien
gtagacgtggccaagtcggtcacct

SEQ ID NO: 357908 - DNA, 25 bp, Homo sapien
aagtcggtcacctcaggcctgggct

SEQ ID NO: 357909 - DNA, 25 bp, Homo sapien
tcaggcctgggctacatgcactgct

SEQ ID NO: 357910 - DNA, 25 bp, Homo sapien
tgggctacatgcactgctgcctcaa

SEQ ID NO: 357911 - DNA, 25 bp, Homo sapien
gatgtggatgctgctcttgcgcctg

SEQ ID NO: 357912 - DNA, 25 bp, Homo sapien
gatgctgctcttgcgcctgggctgc

SEQ ID NO: 357913 - DNA, 25 bp, Homo sapien
ccccaaccagagagggctccagagg

SEQ ID NO: 357914 - DNA, 25 bp, Homo sapien
ccgccgggattcatcctggtctgag

SEQ ID NO: 357915 - DNA, 25 bp, Homo sapien
ggacctgggcgctttggcccgcaac

SEQ ID NO: 357916 - DNA, 25 bp, Homo sapien
tgtcggcggccgaacacttctccat

SEQ ID NO: 357917 - DNA, 25 bp, Homo sapien
atcatccgcgccacgcgcagcaagg

SEQ ID NO: 357918 - DNA, 25 bp, Homo sapien
gacagaccaccatccaggtgcgcgt

SEQ ID NO: 357919 - DNA, 25 bp, Homo sapien
tccaggtgcgcgtgccctaccgggt

SEQ ID NO: 357920 - DNA, 25 bp, Homo sapien
aagggcgccaccatcaagcgcatcc

SEQ ID NO: 357921 - DNA, 25 bp, Homo sapien
acctacatcaagaccccagtgcggg

SEQ ID NO: 357922 - DNA, 25 bp, Homo sapien
gcgaggagccggtcttcatcgtgac

SEQ ID NO: 357923 - DNA, 25 bp, Homo sapien
gaggagccggtcttcatcgtgaccg

SEQ ID NO: 357924 - DNA, 25 bp, Homo sapien
ggtcttcatcgtgaccggccggaag

SEQ ID NO: 357925 - DNA, 25 bp, Homo sapien
tcttcatcgtgaccggccggaagga

SEQ ID NO: 357926 - DNA, 25 bp, Homo sapien
cggaaggaggacgtggagatggcca

SEQ ID NO: 357927 - DNA, 25 bp, Homo sapien
tttctgttttccagctatgtctcca

SEQ ID NO: 357928 - DNA, 25 bp, Homo sapien
ctgttttccagctatgtctccaatg

SEQ ID NO: 357929 - DNA, 25 bp, Homo sapien
ctggcccagcctgggttgtgttgac

SEQ ID NO: 357930 - DNA, 25 bp, Homo sapien
tattttgttactgtcatcctgctga

SEQ ID NO: 357931 - DNA, 25 bp, Homo sapien
ttgttactgtcatcctgctgacaca

SEQ ID NO: 357932 - DNA, 25 bp, Homo sapien
ttactgtcatcctgctgacacactt

SEQ ID NO: 357933 - DNA, 25 bp, Homo sapien
tcatcctgctgacacactttcgggt

SEQ ID NO: 357934 - DNA, 25 bp, Homo sapien
cctgctgacacactttcgggtctgt

SEQ ID NO: 357935 - DNA, 25 bp, Homo sapien
acacactttcgggtctgttagatgc

SEQ ID NO: 357936 - DNA, 25 bp, Homo sapien
acactttcgggtctgttagatgcac

SEQ ID NO: 357937 - DNA, 25 bp, Homo sapien
tttcgggtctgttagatgcacccac

SEQ ID NO: 357938 - DNA, 25 bp, Homo sapien
tgcctcgaaaaccaagtaatgcggc

SEQ ID NO: 357939 - DNA, 25 bp, Homo sapien
ctcgaaaaccaagtaatgcggcggg

SEQ ID NO: 357940 - DNA, 25 bp, Homo sapien
gggcggtgtccctgggcgcggtatt

SEQ ID NO: 357941 - DNA, 25 bp, Homo sapien
tccctgggcgcggtattccctaggg

SEQ ID NO: 357942 - DNA, 25 bp, Homo sapien
gtgtccccgggttgcggtgtccgct

SEQ ID NO: 357943 - DNA, 25 bp, Homo sapien
cgggttgcggtgtccgctcatccgc

SEQ ID NO: 357944 - DNA, 25 bp, Homo sapien
ttgcggtgtccgctcatccgcgttc

SEQ ID NO: 357945 - DNA, 25 bp, Homo sapien
cggtgtccgctcatccgcgttcttg

SEQ ID NO: 357946 - DNA, 25 bp, Homo sapien
gtgtccgctcatccgcgttcttgcg

SEQ ID NO: 357947 - DNA, 25 bp, Homo sapien
ttcttgcgcccatgcggcctagctc

SEQ ID NO: 357948 - DNA, 25 bp, Homo sapien
atgcggcctagctcgccagttcctg

SEQ ID NO: 357949 - DNA, 25 bp, Homo sapien
attatttgtgatcatgttgtctttc

SEQ ID NO: 357950 - DNA, 25 bp, Homo sapien
tcatgttgtctttcaatacaggcat

SEQ ID NO: 357951 - DNA, 25 bp, Homo sapien
atacaggcataaaccttccactctt

SEQ ID NO: 357952 - DNA, 25 bp, Homo sapien
ggcataaaccttccactcttgaaca

SEQ ID NO: 357953 - DNA, 25 bp, Homo sapien
caaagcagctgctttttaaaagcgg

SEQ ID NO: 357954 - DNA, 25 bp, Homo sapien
actttaaagtgttgtctattgcata

SEQ ID NO: 357955 - DNA, 25 bp, Homo sapien
gcataaaacagttgacactcactta

SEQ ID NO: 357956 - DNA, 25 bp, Homo sapien
cagttgacactcacttattgtaaag

SEQ ID NO: 357957 - DNA, 25 bp, Homo sapien
gattgttctactgcatgtgaagtgg

SEQ ID NO: 357958 - DNA, 25 bp, Homo sapien
tctactgcatgtgaagtggaccatg

SEQ ID NO: 357959 - DNA, 25 bp, Homo sapien
ttctcagtatgcatcactagataat

SEQ ID NO: 357960 - DNA, 25 bp, Homo sapien
cgctccatccagactgacaagcggg

SEQ ID NO: 357961 - DNA, 25 bp, Homo sapien
attacgacagcaagggcattggttg

SEQ ID NO: 357962 - DNA, 25 bp, Homo sapien
gcattggttgctatatgttccgaat

SEQ ID NO: 357963 - DNA, 25 bp, Homo sapien
gactcagaggtagtggatgccacca

SEQ ID NO: 357964 - DNA, 25 bp, Homo sapien
acgcttcatcaatcactcgtgtgag

SEQ ID NO: 357965 - DNA, 25 bp, Homo sapien
tcactcgtgtgagcctaactgctat

SEQ ID NO: 357966 - DNA, 25 bp, Homo sapien
taactgctattctcgggtcatcaat

SEQ ID NO: 357967 - DNA, 25 bp, Homo sapien
attgatgggcagaagcacattgtca

SEQ ID NO: 357968 - DNA, 25 bp, Homo sapien
aagcacattgtcatctttgccatgc

SEQ ID NO: 357969 - DNA, 25 bp, Homo sapien
tttgccatgcgtaagatctaccgag

SEQ ID NO: 357970 - DNA, 25 bp, Homo sapien
ggagaggaactcacttacgactata

SEQ ID NO: 357971 - DNA, 25 bp, Homo sapien
tttctcgcatggtggcctgtctttg

SEQ ID NO: 357972 - DNA, 25 bp, Homo sapien
ctgtctttggtgagcctgtttctgc

SEQ ID NO: 357973 - DNA, 25 bp, Homo sapien
ttggtgagcctgtttctgcctctct

SEQ ID NO: 357974 - DNA, 25 bp, Homo sapien
ctgcctctctgcctgggtcatgaga

SEQ ID NO: 357975 - DNA, 25 bp, Homo sapien
tctgcctgggtcatgagaccggttg

SEQ ID NO: 357976 - DNA, 25 bp, Homo sapien
gtcatgagaccggttgtcaatcctt

SEQ ID NO: 357977 - DNA, 25 bp, Homo sapien
gagaccggttgtcaatccttttcgc

SEQ ID NO: 357978 - DNA, 25 bp, Homo sapien
ggttgtcaatccttttcgccgacgc

SEQ ID NO: 357979 - DNA, 25 bp, Homo sapien
gtcaatccttttcgccgacgcggtt

SEQ ID NO: 357980 - DNA, 25 bp, Homo sapien
ttcgccgacgcggttccgctttggg

SEQ ID NO: 357981 - DNA, 25 bp, Homo sapien
cgcggttccgctttgggtgtgtgaa

SEQ ID NO: 357982 - DNA, 25 bp, Homo sapien
cagatactatcttttcattcttcac

SEQ ID NO: 357983 - DNA, 25 bp, Homo sapien
tttcattcttcactcccagtcttaa

SEQ ID NO: 357984 - DNA, 25 bp, Homo sapien
ttcactcccagtcttaatttctttc

SEQ ID NO: 357985 - DNA, 25 bp, Homo sapien
gtcactgtattttatgtcacttcac

SEQ ID NO: 357986 - DNA, 25 bp, Homo sapien
gtcacttcacattgtgttaaacagg

SEQ ID NO: 357987 - DNA, 25 bp, Homo sapien
aacagggtaaatagagatcctcagt

SEQ ID NO: 357988 - DNA, 25 bp, Homo sapien
agatcctcagtatctcagtgctgtg

SEQ ID NO: 357989 - DNA, 25 bp, Homo sapien
tcagtgctgtggcatagctccaata

SEQ ID NO: 357990 - DNA, 25 bp, Homo sapien
agctccaataggtgtgctgtggtgc

SEQ ID NO: 357991 - DNA, 25 bp, Homo sapien
tgcactgcagtgatgtatttgcata

SEQ ID NO: 357992 - DNA, 25 bp, Homo sapien
tttttcggttcaagtgttttgtgat

SEQ ID NO: 357993 - DNA, 25 bp, Homo sapien
aaatgttttccagttattctgatag

SEQ ID NO: 357994 - DNA, 25 bp, Homo sapien
gtcattatggcatccttaatttttc

SEQ ID NO: 357995 - DNA, 25 bp, Homo sapien
ctgtatatagggtaagggactgttc

SEQ ID NO: 357996 - DNA, 25 bp, Homo sapien
gggactgttctgaagaacctttcca

SEQ ID NO: 357997 - DNA, 25 bp, Homo sapien
gaacctttccatttagtgatcaaga

SEQ ID NO: 357998 - DNA, 25 bp, Homo sapien
ggaagctgatttctgaaaatgctca

SEQ ID NO: 357999 - DNA, 25 bp, Homo sapien
gaaaatgctcagtgtgtactctaat

SEQ ID NO: 358000 - DNA, 25 bp, Homo sapien
cagtgtgtactctaattatttatgg

SEQ ID NO: 358001 - DNA, 25 bp, Homo sapien
tatggtaccatttgaattgtaactt

SEQ ID NO: 358002 - DNA, 25 bp, Homo sapien
gcatgtttctaattgacttactggg

SEQ ID NO: 358003 - DNA, 25 bp, Homo sapien
ctaattgacttactgggaaactgaa

SEQ ID NO: 358004 - DNA, 25 bp, Homo sapien
ttggaagactagaaggacgaacgtt

SEQ ID NO: 358005 - DNA, 25 bp, Homo sapien
taaaagtatacgacctccaaggttg

SEQ ID NO: 358006 - DNA, 25 bp, Homo sapien
acgacctccaaggttgtgactctgg

SEQ ID NO: 358007 - DNA, 25 bp, Homo sapien
gtgactctggtagaattctttggtt

SEQ ID NO: 358008 - DNA, 25 bp, Homo sapien
gaattctttggttagagatcctgaa

SEQ ID NO: 358009 - DNA, 25 bp, Homo sapien
tcctgaaggacagcatcctagggat

SEQ ID NO: 358010 - DNA, 25 bp, Homo sapien
gttgaactggctattcagtcggctt

SEQ ID NO: 358011 - DNA, 25 bp, Homo sapien
gcatcctagggataatggtgaaaca

SEQ ID NO: 358012 - DNA, 25 bp, Homo sapien
gaagtagaccattcacatagagtgt

SEQ ID NO: 358013 - DNA, 25 bp, Homo sapien
ttggaagtggactaaggtgacctta

SEQ ID NO: 358014 - DNA, 25 bp, Homo sapien
tattcagtcggcttttgctgtgaag

SEQ ID NO: 358015 - DNA, 25 bp, Homo sapien
cttgcgcaaggccagcgcccccaac

SEQ ID NO: 358016 - DNA, 25 bp, Homo sapien
ttgcgcaaggccagcgcccccaacc

SEQ ID NO: 358017 - DNA, 25 bp, Homo sapien
tgcgcaaggccagcgcccccaaccc

SEQ ID NO: 358018 - DNA, 25 bp, Homo sapien
ccaacccgaacaagctggccgcctg

SEQ ID NO: 358019 - DNA, 25 bp, Homo sapien
caacccgaacaagctggccgcctgc

SEQ ID NO: 358020 - DNA, 25 bp, Homo sapien
tggccgcctgccaccccggtgcctt

SEQ ID NO: 358021 - DNA, 25 bp, Homo sapien
ggccgcctgccaccccggtgccttc

SEQ ID NO: 358022 - DNA, 25 bp, Homo sapien
ctgccaccccggtgccttccgcagc

SEQ ID NO: 358023 - DNA, 25 bp, Homo sapien
gcagcgcgcgctggacctgctgcct

SEQ ID NO: 358024 - DNA, 25 bp, Homo sapien
ctgctgcctccaggctgagcgctca

SEQ ID NO: 358025 - DNA, 25 bp, Homo sapien
tgctgcctccaggctgagcgctcag

SEQ ID NO: 358026 - DNA, 25 bp, Homo sapien
atctctaacccacctgagagggcac

SEQ ID NO: 358027 - DNA, 25 bp, Homo sapien
agagggcacccagccacttggtgtg

SEQ ID NO: 358028 - DNA, 25 bp, Homo sapien
caccaagaggagtccacgtcttcaa

SEQ ID NO: 358029 - DNA, 25 bp, Homo sapien
gaggagtccacgtcttcaaaacgaa

SEQ ID NO: 358030 - DNA, 25 bp, Homo sapien
aaagaagccactgtgcacagaggca

SEQ ID NO: 358031 - DNA, 25 bp, Homo sapien
ttctccagtctgtgtgcccgtctgt

SEQ ID NO: 358032 - DNA, 25 bp, Homo sapien
gcccgtctgtggtcttagccatgga

SEQ ID NO: 358033 - DNA, 25 bp, Homo sapien
ctggaggtgcctcccctcagagctg

SEQ ID NO: 358034 - DNA, 25 bp, Homo sapien
gttcagggatcaggcaggctatgct

SEQ ID NO: 358035 - DNA, 25 bp, Homo sapien
ggcaggctatgctgagaggtcctca

SEQ ID NO: 358036 - DNA, 25 bp, Homo sapien
tgagaggtcctcagggctcctcagg

SEQ ID NO: 358037 - DNA, 25 bp, Homo sapien
agcacagtgatgtgaatttcaccgg

SEQ ID NO: 358038 - DNA, 25 bp, Homo sapien
gaatttcaccggagaatcaccagag

SEQ ID NO: 358039 - DNA, 25 bp, Homo sapien
accggagaatcaccagagggttaga

SEQ ID NO: 358040 - DNA, 25 bp, Homo sapien
ggcccaagggaaaggctgcccagga

SEQ ID NO: 358041 - DNA, 25 bp, Homo sapien
gggtcaggaccagcaagatacgaga

SEQ ID NO: 358042 - DNA, 25 bp, Homo sapien
gaccagcaagatacgagaggagtga

SEQ ID NO: 358043 - DNA, 25 bp, Homo sapien
gtggcctatggctgtattctatgtt

SEQ ID NO: 358044 - DNA, 25 bp, Homo sapien
gcccctaaggctgggtccaaacgag

SEQ ID NO: 358045 - DNA, 25 bp, Homo sapien
attctatgttacttgtcggtccacc

SEQ ID NO: 358046 - DNA, 25 bp, Homo sapien
tatgttacttgtcggtccacctctt

SEQ ID NO: 358047 - DNA, 25 bp, Homo sapien
ttgccagggtccagcacagtgatgt

SEQ ID NO: 358048 - DNA, 25 bp, Homo sapien
tccaagcttctggttagagaaaaag

SEQ ID NO: 358049 - DNA, 25 bp, Homo sapien
ggaaaatgtgtctaaagtccatcag

SEQ ID NO: 358050 - DNA, 25 bp, Homo sapien
aaatgtgtctaaagtccatcagtgt

SEQ ID NO: 358051 - DNA, 25 bp, Homo sapien
gtccatcagtgttaactccctgtga

SEQ ID NO: 358052 - DNA, 25 bp, Homo sapien
atcagtgttaactccctgtgacagg

SEQ ID NO: 358053 - DNA, 25 bp, Homo sapien
tcagtgttaactccctgtgacaggg

SEQ ID NO: 358054 - DNA, 25 bp, Homo sapien
gttaactccctgtgacagggatgaa

SEQ ID NO: 358055 - DNA, 25 bp, Homo sapien
taataatgctgaaagctctctacga

SEQ ID NO: 358056 - DNA, 25 bp, Homo sapien
aatgctgaaagctctctacgaaaga

SEQ ID NO: 358057 - DNA, 25 bp, Homo sapien
tgctgaaagctctctacgaaagact

SEQ ID NO: 358058 - DNA, 25 bp, Homo sapien
agctctctacgaaagactgaatgta

SEQ ID NO: 358059 - DNA, 25 bp, Homo sapien
agatgataaacggtgttgtttttgt

SEQ ID NO: 358060 - DNA, 25 bp, Homo sapien
aatggcagggatggctggcggcctc

SEQ ID NO: 358061 - DNA, 25 bp, Homo sapien
atggctggcggcctccacagggctg

SEQ ID NO: 358062 - DNA, 25 bp, Homo sapien
gagccttcagccagcctgcgggaga

SEQ ID NO: 358063 - DNA, 25 bp, Homo sapien
agccttcagccagcctgcgggagag

SEQ ID NO: 358064 - DNA, 25 bp, Homo sapien
ccttcagccagcctgcgggagagaa

SEQ ID NO: 358065 - DNA, 25 bp, Homo sapien
cttcagccagcctgcgggagagaaa

SEQ ID NO: 358066 - DNA, 25 bp, Homo sapien
ttcagccagcctgcgggagagaaag

SEQ ID NO: 358067 - DNA, 25 bp, Homo sapien
ccagcctgcgggagagaaagatgat

SEQ ID NO: 358068 - DNA, 25 bp, Homo sapien
gcctgcgggagagaaagatgataaa

SEQ ID NO: 358069 - DNA, 25 bp, Homo sapien
gagaaagatgataaacggtgttgtt

SEQ ID NO: 358070 - DNA, 25 bp, Homo sapien
gctcccatgagtttactgatgcaca

SEQ ID NO: 358071 - DNA, 25 bp, Homo sapien
tgagtttactgatgcacagaaacaa

SEQ ID NO: 358072 - DNA, 25 bp, Homo sapien
tgctgaatggaattaagcactttct

SEQ ID NO: 358073 - DNA, 25 bp, Homo sapien
agtttgatgattttcgggcgcggtc

SEQ ID NO: 358074 - DNA, 25 bp, Homo sapien
ggtcttgtggatgcgagtcctctca

SEQ ID NO: 358075 - DNA, 25 bp, Homo sapien
ggatgcgagtcctctcagggtcgtt

SEQ ID NO: 358076 - DNA, 25 bp, Homo sapien
tctcagggtcgttcgtgaggcccca

SEQ ID NO: 358077 - DNA, 25 bp, Homo sapien
gaggacgccatgttggacggaacca

SEQ ID NO: 358078 - DNA, 25 bp, Homo sapien
atgttggacggaaccatctgctgcc

SEQ ID NO: 358079 - DNA, 25 bp, Homo sapien
ttggacggaaccatctgctgccaca

SEQ ID NO: 358080 - DNA, 25 bp, Homo sapien
ggtggtcaatgctcccatgagttta

SEQ ID NO: 358081 - DNA, 25 bp, Homo sapien
tgcccagctcctagtcgaagtcaaa

SEQ ID NO: 358082 - DNA, 25 bp, Homo sapien
tagtcgaagtcaaagtggccataca

SEQ ID NO: 358083 - DNA, 25 bp, Homo sapien
gtggccatacaggatcccaacaaaa

SEQ ID NO: 358084 - DNA, 25 bp, Homo sapien
cttcatttcactttcagcaaacatg

SEQ ID NO: 358085 - DNA, 25 bp, Homo sapien
agcaaacatgttcccaattcttcca

SEQ ID NO: 358086 - DNA, 25 bp, Homo sapien
aacatgttcccaattcttccagctg

SEQ ID NO: 358087 - DNA, 25 bp, Homo sapien
ttgggcatccactaaacacccatga

SEQ ID NO: 358088 - DNA, 25 bp, Homo sapien
agaacccagttagctttgcctcaaa

SEQ ID NO: 358089 - DNA, 25 bp, Homo sapien
ttgcctcaaacactatagtaccagt

SEQ ID NO: 358090 - DNA, 25 bp, Homo sapien
gtaccagtcacagagcaatgatcaa

SEQ ID NO: 358091 - DNA, 25 bp, Homo sapien
tcaaggaaggagagatcagtgaccc

SEQ ID NO: 358092 - DNA, 25 bp, Homo sapien
ggtgtgccaactcttcaccttcttt

SEQ ID NO: 358093 - DNA, 25 bp, Homo sapien
gtgtgccaactcttcaccttctttc

SEQ ID NO: 358094 - DNA, 25 bp, Homo sapien
tcaccttctttcctcagctacggtt

SEQ ID NO: 358095 - DNA, 25 bp, Homo sapien
caccttctttcctcagctacggttt

SEQ ID NO: 358096 - DNA, 25 bp, Homo sapien
catggtggtcttggctatttgctta

SEQ ID NO: 358097 - DNA, 25 bp, Homo sapien
gtggtcttggctatttgcttacctt

SEQ ID NO: 358098 - DNA, 25 bp, Homo sapien
tggtcttggctatttgcttaccttc

SEQ ID NO: 358099 - DNA, 25 bp, Homo sapien
gtcttggctatttgcttaccttccc

SEQ ID NO: 358100 - DNA, 25 bp, Homo sapien
cttggctatttgcttaccttcccgt

SEQ ID NO: 358101 - DNA, 25 bp, Homo sapien
ttttttgtacatgtaccacctccct

SEQ ID NO: 358102 - DNA, 25 bp, Homo sapien
tttgtacatgtaccacctccctttc

SEQ ID NO: 358103 - DNA, 25 bp, Homo sapien
gccaaggaccagttggaggttcaag

SEQ ID NO: 358104 - DNA, 25 bp, Homo sapien
ggaggttcaagttatggccgcccag

SEQ ID NO: 358105 - DNA, 25 bp, Homo sapien
ggttcaagttatggccgcccaggaa

SEQ ID NO: 358106 - DNA, 25 bp, Homo sapien
tatggccgcccaggaaatggagctt

SEQ ID NO: 358107 - DNA, 25 bp, Homo sapien
tggccgcccaggaaatggagcttgc

SEQ ID NO: 358108 - DNA, 25 bp, Homo sapien
gaaaggatccagtaagtcatgagca

SEQ ID NO: 358109 - DNA, 25 bp, Homo sapien
ggatccagtaagtcatgagcatgag

SEQ ID NO: 358110 - DNA, 25 bp, Homo sapien
aaacctgttacagagacaaaggagg

SEQ ID NO: 358111 - DNA, 25 bp, Homo sapien
gcagctgacattaaagagcatcttg

SEQ ID NO: 358112 - DNA, 25 bp, Homo sapien
aaagagcatcttgctgcaaagagaa

SEQ ID NO: 358113 - DNA, 25 bp, Homo sapien
aagattgcaaaagcttgcagcgaaa

SEQ ID NO: 358114 - DNA, 25 bp, Homo sapien
agagtccggagaaggcagcatggaa

SEQ ID NO: 358115 - DNA, 25 bp, Homo sapien
gagtccggagaaggcagcatggaat

SEQ ID NO: 358116 - DNA, 25 bp, Homo sapien
agtccggagaaggcagcatggaatc

SEQ ID NO: 358117 - DNA, 25 bp, Homo sapien
gtccggagaaggcagcatggaatcc

SEQ ID NO: 358118 - DNA, 25 bp, Homo sapien
tccggagaaggcagcatggaatccc

SEQ ID NO: 358119 - DNA, 25 bp, Homo sapien
ccggagaaggcagcatggaatccct

SEQ ID NO: 358120 - DNA, 25 bp, Homo sapien
cggagaaggcagcatggaatccctc

SEQ ID NO: 358121 - DNA, 25 bp, Homo sapien
ggagaaggcagcatggaatccctcc

SEQ ID NO: 358122 - DNA, 25 bp, Homo sapien
tgtacctaaatagcaaagccctgtg

SEQ ID NO: 358123 - DNA, 25 bp, Homo sapien
atagcaaagccctgtgtagattctg

SEQ ID NO: 358124 - DNA, 25 bp, Homo sapien
aaagccctgtgtagattctggtaat

SEQ ID NO: 358125 - DNA, 25 bp, Homo sapien
gattctggtaatgatctgtctcagg

SEQ ID NO: 358126 - DNA, 25 bp, Homo sapien
aatgatctgtctcagggtatgtgta

SEQ ID NO: 358127 - DNA, 25 bp, Homo sapien
gaagagtgttatgtccttagtttta

SEQ ID NO: 358128 - DNA, 25 bp, Homo sapien
gttacaagcaacagtaccaacttat

SEQ ID NO: 358129 - DNA, 25 bp, Homo sapien
agtaccaacttatgtgacccctgag

SEQ ID NO: 358130 - DNA, 25 bp, Homo sapien
gggctgtgagctcttaatttgtttt

SEQ ID NO: 358131 - DNA, 25 bp, Homo sapien
ggagttagagattgagcctttcatc

SEQ ID NO: 358132 - DNA, 25 bp, Homo sapien
tagagattgagcctttcatcttctt

SEQ ID NO: 358133 - DNA, 25 bp, Homo sapien
ccccagccgtggacctaagatgggt

SEQ ID NO: 358134 - DNA, 25 bp, Homo sapien
taagatgggtagagaaaacactttc

SEQ ID NO: 358135 - DNA, 25 bp, Homo sapien
tctacagccctcaggtggcgggtag

SEQ ID NO: 358136 - DNA, 25 bp, Homo sapien
cagccctcaggtggcgggtagctca

SEQ ID NO: 358137 - DNA, 25 bp, Homo sapien
cgggtagctcaaggtaatggtgtca

SEQ ID NO: 358138 - DNA, 25 bp, Homo sapien
ctcaaggtaatggtgtcaacaggca

SEQ ID NO: 358139 - DNA, 25 bp, Homo sapien
taatggtgtcaacaggcacaagaac

SEQ ID NO: 358140 - DNA, 25 bp, Homo sapien
acaatgatggaatggagtgagacac

SEQ ID NO: 358141 - DNA, 25 bp, Homo sapien
ggagtgagacaccagcaatgcctgc

SEQ ID NO: 358142 - DNA, 25 bp, Homo sapien
aatgcctgcatcagccactcatgag

SEQ ID NO: 358143 - DNA, 25 bp, Homo sapien
ctgcatcagccactcatgagcaatt

SEQ ID NO: 358144 - DNA, 25 bp, Homo sapien
ctggtaccccagtgtgaaaaggatg

SEQ ID NO: 358145 - DNA, 25 bp, Homo sapien
aaaacagaatccagccgcttaggct

SEQ ID NO: 358146 - DNA, 25 bp, Homo sapien
gagtgccagatttctcagaagctct

SEQ ID NO: 358147 - DNA, 25 bp, Homo sapien
gcttaggctttgatgaactcccagg

SEQ ID NO: 358148 - DNA, 25 bp, Homo sapien
gatgaactcccaggccaaaatgagg

SEQ ID NO: 358149 - DNA, 25 bp, Homo sapien
cattgatacttttgtctttctgtga

SEQ ID NO: 358150 - DNA, 25 bp, Homo sapien
gctttattatgctaacagtctactt

SEQ ID NO: 358151 - DNA, 25 bp, Homo sapien
agaagctctacattcctcgaagtac

SEQ ID NO: 358152 - DNA, 25 bp, Homo sapien
aagtacagccactgctgccttaggt

SEQ ID NO: 358153 - DNA, 25 bp, Homo sapien
tgccttaggtgctgccgcacggtta

SEQ ID NO: 358154 - DNA, 25 bp, Homo sapien
gcacggttagctacatccaggagcc

SEQ ID NO: 358155 - DNA, 25 bp, Homo sapien
ggtgtgaacagaatattccagtcca

SEQ ID NO: 358156 - DNA, 25 bp, Homo sapien
attccagtccagtgtcctctgtggt

SEQ ID NO: 358157 - DNA, 25 bp, Homo sapien
tccagtgtcctctgtggtagggatg

SEQ ID NO: 358158 - DNA, 25 bp, Homo sapien
agaggccctcctgttcctggcagga

SEQ ID NO: 358159 - DNA, 25 bp, Homo sapien
gagttaaaagtgaggtcaaggccca

SEQ ID NO: 358160 - DNA, 25 bp, Homo sapien
ggtcaaggcccagtgcgatggctca

SEQ ID NO: 358161 - DNA, 25 bp, Homo sapien
agtcctagcacttcgcggagctgag

SEQ ID NO: 358162 - DNA, 25 bp, Homo sapien
gaggtggatcaccagaacccagtag

SEQ ID NO: 358163 - DNA, 25 bp, Homo sapien
tggatcaccagaacccagtagttca

SEQ ID NO: 358164 - DNA, 25 bp, Homo sapien
accttgatccctgcctgtagcattt

SEQ ID NO: 358165 - DNA, 25 bp, Homo sapien
tgatccctgcctgtagcatttgggc

SEQ ID NO: 358166 - DNA, 25 bp, Homo sapien
gcgacctgagcgctgccttcagaca

SEQ ID NO: 358167 - DNA, 25 bp, Homo sapien
ttcagacacctctctgctggcgtgt

SEQ ID NO: 358168 - DNA, 25 bp, Homo sapien
gcgtgttcctgggtccatgatggaa

SEQ ID NO: 358169 - DNA, 25 bp, Homo sapien
aagacaatctgaagctcatactgtg

SEQ ID NO: 358170 - DNA, 25 bp, Homo sapien
tgaagctcatactgtgactgcaaca

SEQ ID NO: 358171 - DNA, 25 bp, Homo sapien
gcaacataaaatgtgttcacctgag

SEQ ID NO: 358172 - DNA, 25 bp, Homo sapien
gttcacctgaggagactgctttcat

SEQ ID NO: 358173 - DNA, 25 bp, Homo sapien
tgctttcatcgccagtgtgtcacag

SEQ ID NO: 358174 - DNA, 25 bp, Homo sapien
cagtgtgtcacagggcagctgatcc

SEQ ID NO: 358175 - DNA, 25 bp, Homo sapien
agggcagctgatccaggaccgtcca

SEQ ID NO: 358176 - DNA, 25 bp, Homo sapien
gggctggtgacagccagatcctcat

SEQ ID NO: 358177 - DNA, 25 bp, Homo sapien
attatggagttgtttgcattaatac

SEQ ID NO: 358178 - DNA, 25 bp, Homo sapien
gagttgtttgcattaatacaagtgt

SEQ ID NO: 358179 - DNA, 25 bp, Homo sapien
tttcctgtgattggtaatgcacctt

SEQ ID NO: 358180 - DNA, 25 bp, Homo sapien
gtgattggtaatgcacctttattgt

SEQ ID NO: 358181 - DNA, 25 bp, Homo sapien
agcacagacagacccaggtaggttg

SEQ ID NO: 358182 - DNA, 25 bp, Homo sapien
gacagacccaggtaggttggtgatc

SEQ ID NO: 358183 - DNA, 25 bp, Homo sapien
acccaggtaggttggtgatcgataa

SEQ ID NO: 358184 - DNA, 25 bp, Homo sapien
gtaggttggtgatcgataatcaatt

SEQ ID NO: 358185 - DNA, 25 bp, Homo sapien
gggcatacctgctgtgtaggaataa

SEQ ID NO: 358186 - DNA, 25 bp, Homo sapien
ctgctgtgtaggaataagggctaac

SEQ ID NO: 358187 - DNA, 25 bp, Homo sapien
aggaataagggctaacctgtgtagt

SEQ ID NO: 358188 - DNA, 25 bp, Homo sapien
gactttgcatctcattagttgtcca

SEQ ID NO: 358189 - DNA, 25 bp, Homo sapien
tagttgtccatagtgactaccagga

SEQ ID NO: 358190 - DNA, 25 bp, Homo sapien
ccatagtgactaccaggaggtggct

SEQ ID NO: 358191 - DNA, 25 bp, Homo sapien
ggctggcatctataacgtgtgggac

SEQ ID NO: 358192 - DNA, 25 bp, Homo sapien
agacactgaccatagattgacttat

SEQ ID NO: 358193 - DNA, 25 bp, Homo sapien
gaccatagattgacttatactttta

SEQ ID NO: 358194 - DNA, 25 bp, Homo sapien
gggtactatgaaaggactgttcctt

SEQ ID NO: 358195 - DNA, 25 bp, Homo sapien
aggactgttccttgagtggctacga

SEQ ID NO: 358196 - DNA, 25 bp, Homo sapien
tgttccttgagtggctacgattaga

SEQ ID NO: 358197 - DNA, 25 bp, Homo sapien
tagaaaatcaggactaacaaacttt

SEQ ID NO: 358198 - DNA, 25 bp, Homo sapien
aacttttctttgtctggaagcatat

SEQ ID NO: 358199 - DNA, 25 bp, Homo sapien
aggccttgcccaaacctgcaagccc

SEQ ID NO: 358200 - DNA, 25 bp, Homo sapien
ggccttgcccaaacctgcaagcccc

SEQ ID NO: 358201 - DNA, 25 bp, Homo sapien
ttgcccaaacctgcaagccccaaga

SEQ ID NO: 358202 - DNA, 25 bp, Homo sapien
tgcccaaacctgcaagccccaagaa

SEQ ID NO: 358203 - DNA, 25 bp, Homo sapien
gcccaaacctgcaagccccaagaag

SEQ ID NO: 358204 - DNA, 25 bp, Homo sapien
cccaaacctgcaagccccaagaagc

SEQ ID NO: 358205 - DNA, 25 bp, Homo sapien
ccaaacctgcaagccccaagaagcc

SEQ ID NO: 358206 - DNA, 25 bp, Homo sapien
caaacctgcaagccccaagaagcca

SEQ ID NO: 358207 - DNA, 25 bp, Homo sapien
aaacctgcaagccccaagaagccac

SEQ ID NO: 358208 - DNA, 25 bp, Homo sapien
aagaagccaccccctggcgagcgga

SEQ ID NO: 358209 - DNA, 25 bp, Homo sapien
agaagccaccccctggcgagcggag

SEQ ID NO: 358210 - DNA, 25 bp, Homo sapien
agatcaggccctgattctgtcattc

SEQ ID NO: 358211 - DNA, 25 bp, Homo sapien
ctctgtcctcagcaattgatgacat

SEQ ID NO: 358212 - DNA, 25 bp, Homo sapien
gtgtctttgcaatgcacgtggtatc

SEQ ID NO: 358213 - DNA, 25 bp, Homo sapien
acgtggtatcaagggctttacatcc

SEQ ID NO: 358214 - DNA, 25 bp, Homo sapien
acggcatccaccatgatcttaagac

SEQ ID NO: 358215 - DNA, 25 bp, Homo sapien
ttaagacacatcctagtcctgtctc

SEQ ID NO: 358216 - DNA, 25 bp, Homo sapien
aatgttgagccgtgtgacagagtca

SEQ ID NO: 358217 - DNA, 25 bp, Homo sapien
gacagagtcacaactagaccccgag

SEQ ID NO: 358218 - DNA, 25 bp, Homo sapien
agaccccgaggtctgctggattcca

SEQ ID NO: 358219 - DNA, 25 bp, Homo sapien
tgctggattccagagaccaagttct

SEQ ID NO: 358220 - DNA, 25 bp, Homo sapien
accaagttctgtgcgggtgtgtgat

SEQ ID NO: 358221 - DNA, 25 bp, Homo sapien
ggaaaatctaagtctaatatttgga

SEQ ID NO: 358222 - DNA, 25 bp, Homo sapien
tgatttatgataaagctcagaatgt

SEQ ID NO: 358223 - DNA, 25 bp, Homo sapien
ttcctttctaaacagaaactgcatt

SEQ ID NO: 358224 - DNA, 25 bp, Homo sapien
aaacagaaactgcatttaattccaa

SEQ ID NO: 358225 - DNA, 25 bp, Homo sapien
attatttaaccctttgctgctgcta

SEQ ID NO: 358226 - DNA, 25 bp, Homo sapien
ttatttaaccctttgctgctgctaa

SEQ ID NO: 358227 - DNA, 25 bp, Homo sapien
atttaaccctttgctgctgctaaaa

SEQ ID NO: 358228 - DNA, 25 bp, Homo sapien
tgctgctaaaatgtgcacatattca

SEQ ID NO: 358229 - DNA, 25 bp, Homo sapien
aatgtgcacatattcaggctttagt

SEQ ID NO: 358230 - DNA, 25 bp, Homo sapien
tattaaacatttgaccacagggaag

SEQ ID NO: 358231 - DNA, 25 bp, Homo sapien
tgaccacagggaagaatcaagtttc

SEQ ID NO: 358232 - DNA, 25 bp, Homo sapien
ccttgaaccagggactccaaagaat

SEQ ID NO: 358233 - DNA, 25 bp, Homo sapien
gggactccaaagaataagattcatg

SEQ ID NO: 358234 - DNA, 25 bp, Homo sapien
ggcaaggagttaatgtattctgtct

SEQ ID NO: 358235 - DNA, 25 bp, Homo sapien
aatgtattctgtctgtggccagcca

SEQ ID NO: 358236 - DNA, 25 bp, Homo sapien
tattctgtctgtggccagccatctt

SEQ ID NO: 358237 - DNA, 25 bp, Homo sapien
atcttccctggtacatcttcttttc

SEQ ID NO: 358238 - DNA, 25 bp, Homo sapien
tacatcttcttttctcagttcaaac

SEQ ID NO: 358239 - DNA, 25 bp, Homo sapien
ttggaactggagtctttctcttccc

SEQ ID NO: 358240 - DNA, 25 bp, Homo sapien
gaactggagtctttctcttccccta

SEQ ID NO: 358241 - DNA, 25 bp, Homo sapien
tcttcccctattttcctctgaaaga

SEQ ID NO: 358242 - DNA, 25 bp, Homo sapien
tcccctattttcctctgaaagagtt

SEQ ID NO: 358243 - DNA, 25 bp, Homo sapien
gggggccagaaccattgcaaatctt

SEQ ID NO: 358244 - DNA, 25 bp, Homo sapien
tcccttgtgctcacttgactttgcc

SEQ ID NO: 358245 - DNA, 25 bp, Homo sapien
cccctttgcatgtagcagaggcctc

SEQ ID NO: 358246 - DNA, 25 bp, Homo sapien
ctttgcatgtagcagaggcctcggt

SEQ ID NO: 358247 - DNA, 25 bp, Homo sapien
ttgcatgtagcagaggcctcggttc

SEQ ID NO: 358248 - DNA, 25 bp, Homo sapien
gcatgtagcagaggcctcggttccc

SEQ ID NO: 358249 - DNA, 25 bp, Homo sapien
agaggcctcggttcccagcttgttt

SEQ ID NO: 358250 - DNA, 25 bp, Homo sapien
tcggttcccagcttgtttccattgc

SEQ ID NO: 358251 - DNA, 25 bp, Homo sapien
gttcccagcttgtttccattgcttc

SEQ ID NO: 358252 - DNA, 25 bp, Homo sapien
tttccattgcttccccagatcagga

SEQ ID NO: 358253 - DNA, 25 bp, Homo sapien
attgcttccccagatcaggacctgg

SEQ ID NO: 358254 - DNA, 25 bp, Homo sapien
gtctattgccttttctcatgacaga

SEQ ID NO: 358255 - DNA, 25 bp, Homo sapien
ttgccttttctcatgacagattcaa

SEQ ID NO: 358256 - DNA, 25 bp, Homo sapien
ttctcatgacagattcaaagtttga

SEQ ID NO: 358257 - DNA, 25 bp, Homo sapien
ccatatgggcaatgcctcccttctg

SEQ ID NO: 358258 - DNA, 25 bp, Homo sapien
caaccctggtaattggtagggagca

SEQ ID NO: 358259 - DNA, 25 bp, Homo sapien
taattggtagggagcagctcttccc

SEQ ID NO: 358260 - DNA, 25 bp, Homo sapien
tggtgatgttctccaccccagcctg

SEQ ID NO: 358261 - DNA, 25 bp, Homo sapien
cagcctgctcttgatagagcactat

SEQ ID NO: 358262 - DNA, 25 bp, Homo sapien
gatagagcactatagcagaaaatat

SEQ ID NO: 358263 - DNA, 25 bp, Homo sapien
gaaagtagaccctgaattctgttct

SEQ ID NO: 358264 - DNA, 25 bp, Homo sapien
agtagaccctgaattctgttctaga

SEQ ID NO: 358265 - DNA, 25 bp, Homo sapien
gcgttgcgggcgtggcacacgtaga

SEQ ID NO: 358266 - DNA, 25 bp, Homo sapien
gcgtggcacacgtagacgccggaat

SEQ ID NO: 358267 - DNA, 25 bp, Homo sapien
gtggcacacgtagacgccggaatcc

SEQ ID NO: 358268 - DNA, 25 bp, Homo sapien
tggcacacgtagacgccggaatccg

SEQ ID NO: 358269 - DNA, 25 bp, Homo sapien
gtagacgccggaatccggcagccga

SEQ ID NO: 358270 - DNA, 25 bp, Homo sapien
tagacgccggaatccggcagccgag

SEQ ID NO: 358271 - DNA, 25 bp, Homo sapien
tgtcccacacttcgtccagggccat

SEQ ID NO: 358272 - DNA, 25 bp, Homo sapien
cgtccttctcccagtacagtgtggg

SEQ ID NO: 358273 - DNA, 25 bp, Homo sapien
tccttctcccagtacagtgtgggct

SEQ ID NO: 358274 - DNA, 25 bp, Homo sapien
ttctcccagtacagtgtgggctcgg

SEQ ID NO: 358275 - DNA, 25 bp, Homo sapien
tctcccagtacagtgtgggctcggg

SEQ ID NO: 358276 - DNA, 25 bp, Homo sapien
gatgcttcatattagcagaggctgc

SEQ ID NO: 358277 - DNA, 25 bp, Homo sapien
cagaggctgcagatctgtgccgagt

SEQ ID NO: 358278 - DNA, 25 bp, Homo sapien
tgcctgcctagcaatctgccagcaa

SEQ ID NO: 358279 - DNA, 25 bp, Homo sapien
gcacacaatgtggtcatgggcgagt

SEQ ID NO: 358280 - DNA, 25 bp, Homo sapien
cacagccagctcaattcacaagctt

SEQ ID NO: 358281 - DNA, 25 bp, Homo sapien
atgggcgagtgtgccctccaggcca

SEQ ID NO: 358282 - DNA, 25 bp, Homo sapien
acggtaggcccagaccaagggacat

SEQ ID NO: 358283 - DNA, 25 bp, Homo sapien
gtaggcccagaccaagggacatgcc

SEQ ID NO: 358284 - DNA, 25 bp, Homo sapien
tgctcagcagcatccacaccagaag

SEQ ID NO: 358285 - DNA, 25 bp, Homo sapien
attcacaagcttgggttacaagtct

SEQ ID NO: 358286 - DNA, 25 bp, Homo sapien
gttacaagtctttgggaggcaaaca

SEQ ID NO: 358287 - DNA, 25 bp, Homo sapien
attaagcagtagatccaggatgcaa

SEQ ID NO: 358288 - DNA, 25 bp, Homo sapien
ttcctgtgcatgtgctcttattgta

SEQ ID NO: 358289 - DNA, 25 bp, Homo sapien
ctgtgcatgtgctcttattgtaagg

SEQ ID NO: 358290 - DNA, 25 bp, Homo sapien
gtgctcttattgtaaggtgccaaga

SEQ ID NO: 358291 - DNA, 25 bp, Homo sapien
ctgatttaagttacagcccttgttt

SEQ ID NO: 358292 - DNA, 25 bp, Homo sapien
tgcactgaatcaagtctaaccccaa

SEQ ID NO: 358293 - DNA, 25 bp, Homo sapien
gaatcaagtctaaccccaacagcca

SEQ ID NO: 358294 - DNA, 25 bp, Homo sapien
atcctcctatacctagacatctcat

SEQ ID NO: 358295 - DNA, 25 bp, Homo sapien
atacctagacatctcatctcaggaa

SEQ ID NO: 358296 - DNA, 25 bp, Homo sapien
acatctcatctcaggaagtggtggt

SEQ ID NO: 358297 - DNA, 25 bp, Homo sapien
aaaagaaactgagccttaaagagat

SEQ ID NO: 358298 - DNA, 25 bp, Homo sapien
gtgcctttggacctcttctcctgaa

SEQ ID NO: 358299 - DNA, 25 bp, Homo sapien
tcctgaacctgcagggagaggcgca

SEQ ID NO: 358300 - DNA, 25 bp, Homo sapien
gtccaggttttcagggtggttgcta

SEQ ID NO: 358301 - DNA, 25 bp, Homo sapien
ttgctaaaccccaaaagaccgatag

SEQ ID NO: 358302 - DNA, 25 bp, Homo sapien
atagcttcgggcaaaagactgcaga

SEQ ID NO: 358303 - DNA, 25 bp, Homo sapien
gaacagctttacatttttacggaag

SEQ ID NO: 358304 - DNA, 25 bp, Homo sapien
gaaatataccctgtaagccttgaaa

SEQ ID NO: 358305 - DNA, 25 bp, Homo sapien
tgaaaaattcccgaagggattcctg

SEQ ID NO: 358306 - DNA, 25 bp, Homo sapien
tgttcattcctgtggatcctaatgg

SEQ ID NO: 358307 - DNA, 25 bp, Homo sapien
tcctgtggatcctaatgggccagca

SEQ ID NO: 358308 - DNA, 25 bp, Homo sapien
atgggccagcatagacctgttagtc

SEQ ID NO: 358309 - DNA, 25 bp, Homo sapien
gggtcccctaggctgaccctgaatc

SEQ ID NO: 358310 - DNA, 25 bp, Homo sapien
gaggatgaagccagcgggaccacat

SEQ ID NO: 358311 - DNA, 25 bp, Homo sapien
aggatgaagccagcgggaccacatg

SEQ ID NO: 358312 - DNA, 25 bp, Homo sapien
tgaagccagcgggaccacatggctt

SEQ ID NO: 358313 - DNA, 25 bp, Homo sapien
gaagccagcgggaccacatggcttg

SEQ ID NO: 358314 - DNA, 25 bp, Homo sapien
gaccacatggcttggtggcttggac

SEQ ID NO: 358315 - DNA, 25 bp, Homo sapien
accacatggcttggtggcttggaca

SEQ ID NO: 358316 - DNA, 25 bp, Homo sapien
cacatggcttggtggcttggacaaa

SEQ ID NO: 358317 - DNA, 25 bp, Homo sapien
acatggcttggtggcttggacaaac

SEQ ID NO: 358318 - DNA, 25 bp, Homo sapien
atggcttggtggcttggacaaacaa

SEQ ID NO: 358319 - DNA, 25 bp, Homo sapien
ttggtggcttggacaaacaagctca

SEQ ID NO: 358320 - DNA, 25 bp, Homo sapien
tcagcctttgcactcaggaggttct

SEQ ID NO: 358321 - DNA, 25 bp, Homo sapien
ggaggttctgctccagcatgagctc

SEQ ID NO: 358322 - DNA, 25 bp, Homo sapien
cagcatgagctcttgtacttacata

SEQ ID NO: 358323 - DNA, 25 bp, Homo sapien
aataaatgctcccacatagcctttc

SEQ ID NO: 358324 - DNA, 25 bp, Homo sapien
gcttctctcctctgaagtgtgagtt

SEQ ID NO: 358325 - DNA, 25 bp, Homo sapien
ggtttgtaacatggctatttcctag

SEQ ID NO: 358326 - DNA, 25 bp, Homo sapien
atttcctagttgtaaagttctgcat

SEQ ID NO: 358327 - DNA, 25 bp, Homo sapien
gcatttataagtgccattgttgtaa

SEQ ID NO: 358328 - DNA, 25 bp, Homo sapien
gccattgttgtaaggtggtgtttcc

SEQ ID NO: 358329 - DNA, 25 bp, Homo sapien
tggtgtttcctagaccttccctgat

SEQ ID NO: 358330 - DNA, 25 bp, Homo sapien
ttccctgatgcgattttacctttgt

SEQ ID NO: 358331 - DNA, 25 bp, Homo sapien
cagccatccagttggtgggatattc

SEQ ID NO: 358332 - DNA, 25 bp, Homo sapien
gatattcaatctcactcctcagtag

SEQ ID NO: 358333 - DNA, 25 bp, Homo sapien
agtagggttctctacctcctcaggt

SEQ ID NO: 358334 - DNA, 25 bp, Homo sapien
ggagaagagtcctctagacctctgt

SEQ ID NO: 358335 - DNA, 25 bp, Homo sapien
ccatgctggtctctgttaagttcac

SEQ ID NO: 358336 - DNA, 25 bp, Homo sapien
gtctctgttaagttcaccatccctg

SEQ ID NO: 358337 - DNA, 25 bp, Homo sapien
tgcccacatggtcttctgacggtag

SEQ ID NO: 358338 - DNA, 25 bp, Homo sapien
gatatctgtgccattgctcccagga

SEQ ID NO: 358339 - DNA, 25 bp, Homo sapien
attgctcccaggactatattcttgg

SEQ ID NO: 358340 - DNA, 25 bp, Homo sapien
actatattcttggagtccaccagcc

SEQ ID NO: 358341 - DNA, 25 bp, Homo sapien
agtccaccagcctgagactgtgcaa

SEQ ID NO: 358342 - DNA, 25 bp, Homo sapien
cactggtttgagcaaagcacagaag

SEQ ID NO: 358343 - DNA, 25 bp, Homo sapien
gcacagaagacaagagtctctgcat

SEQ ID NO: 358344 - DNA, 25 bp, Homo sapien
gagtctctgcatttacagaagccgc

SEQ ID NO: 358345 - DNA, 25 bp, Homo sapien
gcatttacagaagccgcaaagtacg

SEQ ID NO: 358346 - DNA, 25 bp, Homo sapien
aagtacggcgtatgcatcagatgtt

SEQ ID NO: 358347 - DNA, 25 bp, Homo sapien
gtatgcatcagatgtttgcaactgg

SEQ ID NO: 358348 - DNA, 25 bp, Homo sapien
gcaactggccagtcgggtcattttt

SEQ ID NO: 358349 - DNA, 25 bp, Homo sapien
ggtcatttttcccataagcagcgtt

SEQ ID NO: 358350 - DNA, 25 bp, Homo sapien
aagcagcgttgcttagcagtgtcgc

SEQ ID NO: 358351 - DNA, 25 bp, Homo sapien
gttgcttagcagtgtcgctgacgtc

SEQ ID NO: 358352 - DNA, 25 bp, Homo sapien
tgtcgctgacgtcgtcccattagtt

SEQ ID NO: 358353 - DNA, 25 bp, Homo sapien
tcgatggcccttagccactgcttct

SEQ ID NO: 358354 - DNA, 25 bp, Homo sapien
actgcttctccgtgagggcgtcact

SEQ ID NO: 358355 - DNA, 25 bp, Homo sapien
gagggcgtcactgtagtccacgtca

SEQ ID NO: 358356 - DNA, 25 bp, Homo sapien
actgtagtccacgtcacggcgctgg

SEQ ID NO: 358357 - DNA, 25 bp, Homo sapien
tcacaggtgagcctttctacttcag

SEQ ID NO: 358358 - DNA, 25 bp, Homo sapien
ttctacttcagcgtcatccttaatg

SEQ ID NO: 358359 - DNA, 25 bp, Homo sapien
tctttatccacatttcttcgtcttt

SEQ ID NO: 358360 - DNA, 25 bp, Homo sapien
ttcttcgtctttttcgcttcttaag

SEQ ID NO: 358361 - DNA, 25 bp, Homo sapien
tctttttcgcttcttaagccgtact

SEQ ID NO: 358362 - DNA, 25 bp, Homo sapien
atttcctccaaattgccgtcttcga

SEQ ID NO: 358363 - DNA, 25 bp, Homo sapien
aaattgccgtcttcgatggccctta

SEQ ID NO: 358364 - DNA, 25 bp, Homo sapien
aagaatctcatagcttgtcagctca

SEQ ID NO: 358365 - DNA, 25 bp, Homo sapien
gcagcttacatttttggtttcttcc

SEQ ID NO: 358366 - DNA, 25 bp, Homo sapien
gcttacatttttggtttcttccaca

SEQ ID NO: 358367 - DNA, 25 bp, Homo sapien
aatgataagccatcaccaaactcag

SEQ ID NO: 358368 - DNA, 25 bp, Homo sapien
aattctgttaccctggaagtcctgc

SEQ ID NO: 358369 - DNA, 25 bp, Homo sapien
aagtcctgcttgtgaaagtttgcca

SEQ ID NO: 358370 - DNA, 25 bp, Homo sapien
ggatgtatgttgtccaataaggcaa

SEQ ID NO: 358371 - DNA, 25 bp, Homo sapien
gttcccacaggtaaaaagcaggtgc

SEQ ID NO: 358372 - DNA, 25 bp, Homo sapien
agcaggtgcctttgaatcctgacct

SEQ ID NO: 358373 - DNA, 25 bp, Homo sapien
tgacctcaatcaaacaaaacctgga

SEQ ID NO: 358374 - DNA, 25 bp, Homo sapien
cccgtcccttgcagtttccagtaat

SEQ ID NO: 358375 - DNA, 25 bp, Homo sapien
gcaagaatctcatagcttgtcagct

SEQ ID NO: 358376 - DNA, 25 bp, Homo sapien
aagaatctcatagcttgtcagctca

SEQ ID NO: 358377 - DNA, 25 bp, Homo sapien
tcttccacaaaaatgataagccatc

SEQ ID NO: 358378 - DNA, 25 bp, Homo sapien
aatgataagccatcaccaaactcag

SEQ ID NO: 358379 - DNA, 25 bp, Homo sapien
gaacaaaattctgttaccctggaag

SEQ ID NO: 358380 - DNA, 25 bp, Homo sapien
ctggaagtcctgcttgtgaaagttt

SEQ ID NO: 358381 - DNA, 25 bp, Homo sapien
aagtcctgcttgtgaaagtttgcca

SEQ ID NO: 358382 - DNA, 25 bp, Homo sapien
gtcctgcttgtgaaagtttgccaca

SEQ ID NO: 358383 - DNA, 25 bp, Homo sapien
agttcccacaggtaaaaagcaggtg

SEQ ID NO: 358384 - DNA, 25 bp, Homo sapien
tcccacaggtaaaaagcaggtgcct

SEQ ID NO: 358385 - DNA, 25 bp, Homo sapien
cccgtcccttgcagtttccagtaat

SEQ ID NO: 358386 - DNA, 25 bp, Homo sapien
agaagagagaccaggtgtggtggct

SEQ ID NO: 358387 - DNA, 25 bp, Homo sapien
cctaggcaacacgagcaaaacttcc

SEQ ID NO: 358388 - DNA, 25 bp, Homo sapien
ctaggcaacacgagcaaaacttcct

SEQ ID NO: 358389 - DNA, 25 bp, Homo sapien
taggcaacacgagcaaaacttcctc

SEQ ID NO: 358390 - DNA, 25 bp, Homo sapien
aggcaacacgagcaaaacttcctct

SEQ ID NO: 358391 - DNA, 25 bp, Homo sapien
ggcaacacgagcaaaacttcctctc

SEQ ID NO: 358392 - DNA, 25 bp, Homo sapien
gcaacacgagcaaaacttcctctca

SEQ ID NO: 358393 - DNA, 25 bp, Homo sapien
caacacgagcaaaacttcctctcaa

SEQ ID NO: 358394 - DNA, 25 bp, Homo sapien
aacacgagcaaaacttcctctcaaa

SEQ ID NO: 358395 - DNA, 25 bp, Homo sapien
acacgagcaaaacttcctctcaaaa

SEQ ID NO: 358396 - DNA, 25 bp, Homo sapien
cacgagcaaaacttcctctcaaaaa

SEQ ID NO: 358397 - DNA, 25 bp, Homo sapien
gaaccttaggatcctctcccacatg

SEQ ID NO: 358398 - DNA, 25 bp, Homo sapien
ctctcccacatgtcgtagaatcttg

SEQ ID NO: 358399 - DNA, 25 bp, Homo sapien
ttggaatcatgacagctagaagcgt

SEQ ID NO: 358400 - DNA, 25 bp, Homo sapien
gctagaagcgtgaagctccctcaat

SEQ ID NO: 358401 - DNA, 25 bp, Homo sapien
agctccctcaattccacatactggg

SEQ ID NO: 358402 - DNA, 25 bp, Homo sapien
gtctctgggcttgcaccagcgggta

SEQ ID NO: 358403 - DNA, 25 bp, Homo sapien
aagggcagagagtgcaaatctctct

SEQ ID NO: 358404 - DNA, 25 bp, Homo sapien
ctgggctggctctcactgggtttat

SEQ ID NO: 358405 - DNA, 25 bp, Homo sapien
ctctcactgggtttattggagcacc

SEQ ID NO: 358406 - DNA, 25 bp, Homo sapien
ttggagcacctaggcttagaacctc

SEQ ID NO: 358407 - DNA, 25 bp, Homo sapien
gcacctaggcttagaacctcggatt

SEQ ID NO: 358408 - DNA, 25 bp, Homo sapien
gagctcttggtagtggttctgttta

SEQ ID NO: 358409 - DNA, 25 bp, Homo sapien
gtaggtggtcttttctggtgtgtcc

SEQ ID NO: 358410 - DNA, 25 bp, Homo sapien
gtgtgtcctgcagctgcatggtgac

SEQ ID NO: 358411 - DNA, 25 bp, Homo sapien
caagtctttatccagctctgtgatc

SEQ ID NO: 358412 - DNA, 25 bp, Homo sapien
tctgtgatcttcattcgcaggcgat

SEQ ID NO: 358413 - DNA, 25 bp, Homo sapien
gatggttttctgactgtaggccctc

SEQ ID NO: 358414 - DNA, 25 bp, Homo sapien
tgctggcttggttcacactggtgac

SEQ ID NO: 358415 - DNA, 25 bp, Homo sapien
gaccgaggtggacgttttagaatct

SEQ ID NO: 358416 - DNA, 25 bp, Homo sapien
ttctgagtgaactggaatcgcctgt

SEQ ID NO: 358417 - DNA, 25 bp, Homo sapien
aatcgcctgttctgcgttgctgcat

SEQ ID NO: 358418 - DNA, 25 bp, Homo sapien
gcatctgggtttgttctcagggtga

SEQ ID NO: 358419 - DNA, 25 bp, Homo sapien
agtcactgattcaaaggaactttat

SEQ ID NO: 358420 - DNA, 25 bp, Homo sapien
ggaactttattctactggtgggcac

SEQ ID NO: 358421 - DNA, 25 bp, Homo sapien
actggtgggcacaaaatggcagcta

SEQ ID NO: 358422 - DNA, 25 bp, Homo sapien
ggtaacattggctgctttactgaaa

SEQ ID NO: 358423 - DNA, 25 bp, Homo sapien
gactattttagacacggcggtcggt

SEQ ID NO: 358424 - DNA, 25 bp, Homo sapien
ggtcggtaaaatccgcctcaaggtg

SEQ ID NO: 358425 - DNA, 25 bp, Homo sapien
aaatccgcctcaaggtggaggcatt

SEQ ID NO: 358426 - DNA, 25 bp, Homo sapien
ggtggaggcattagaaccaagacct

SEQ ID NO: 358427 - DNA, 25 bp, Homo sapien
tttctcaacacgtatggaacccctg

SEQ ID NO: 358428 - DNA, 25 bp, Homo sapien
aggcagcactgtcctagctggaaac

SEQ ID NO: 358429 - DNA, 25 bp, Homo sapien
ctgtcctagctggaaacatgagtag

SEQ ID NO: 358430 - DNA, 25 bp, Homo sapien
ctggactggaggagctctggctcct

SEQ ID NO: 358431 - DNA, 25 bp, Homo sapien
tgcctggggccagggtctttgtacc

SEQ ID NO: 358432 - DNA, 25 bp, Homo sapien
ggctgtccttgcagaggcaaactgt

SEQ ID NO: 358433 - DNA, 25 bp, Homo sapien
gctgtccttgcagaggcaaactgtc

SEQ ID NO: 358434 - DNA, 25 bp, Homo sapien
tgtccttgcagaggcaaactgtcct

SEQ ID NO: 358435 - DNA, 25 bp, Homo sapien
tgatagagtcagagccttgaggact

SEQ ID NO: 358436 - DNA, 25 bp, Homo sapien
gatagagtcagagccttgaggactg

SEQ ID NO: 358437 - DNA, 25 bp, Homo sapien
gccagcaggtaaagggcctgggcct

SEQ ID NO: 358438 - DNA, 25 bp, Homo sapien
ggctcagtttgccttgtgaggagct

SEQ ID NO: 358439 - DNA, 25 bp, Homo sapien
gccgaagggtgggttttgcctggct

SEQ ID NO: 358440 - DNA, 25 bp, Homo sapien
gaagggtgggttttgcctggctcct

SEQ ID NO: 358441 - DNA, 25 bp, Homo sapien
tttcacagaggatagcaagctccag

SEQ ID NO: 358442 - DNA, 25 bp, Homo sapien
gcaagctccagaaggttctattacc

SEQ ID NO: 358443 - DNA, 25 bp, Homo sapien
gggtgccctaagaccagtctgaact

SEQ ID NO: 358444 - DNA, 25 bp, Homo sapien
gtctgaactcacactgtctgaaagg

SEQ ID NO: 358445 - DNA, 25 bp, Homo sapien
gtctgaaaggccacccaggatccaa

SEQ ID NO: 358446 - DNA, 25 bp, Homo sapien
ccaggatccaaatcgggccatcttc

SEQ ID NO: 358447 - DNA, 25 bp, Homo sapien
atcttcattgccatgagtgttcgga

SEQ ID NO: 358448 - DNA, 25 bp, Homo sapien
atgagtgttcggacaggctctgcgt

SEQ ID NO: 358449 - DNA, 25 bp, Homo sapien
acaggctctgcgtgccaggcaacag

SEQ ID NO: 358450 - DNA, 25 bp, Homo sapien
acagtgggcagacaaagggctccct

SEQ ID NO: 358451 - DNA, 25 bp, Homo sapien
agaaccatcctgtgaaaatcatttc

SEQ ID NO: 358452 - DNA, 25 bp, Homo sapien
ggtgcacagaagtcactggttcata

SEQ ID NO: 358453 - DNA, 25 bp, Homo sapien
aagtcactggttcatagcaattctg

SEQ ID NO: 358454 - DNA, 25 bp, Homo sapien
ctgaaatccatttgagtacaggttt

SEQ ID NO: 358455 - DNA, 25 bp, Homo sapien
gtacaggtttgcagttctacactca

SEQ ID NO: 358456 - DNA, 25 bp, Homo sapien
gcagttctacactcaaagcctggga

SEQ ID NO: 358457 - DNA, 25 bp, Homo sapien
gggaataactccctatggcttttgg

SEQ ID NO: 358458 - DNA, 25 bp, Homo sapien
tccctatggcttttggttccacctt

SEQ ID NO: 358459 - DNA, 25 bp, Homo sapien
caccttctgggctcttggttttatc

SEQ ID NO: 358460 - DNA, 25 bp, Homo sapien
ggttttatcctctaagtcatccttt

SEQ ID NO: 358461 - DNA, 25 bp, Homo sapien
gcttttcaatctgaagttctgcgaa

SEQ ID NO: 358462 - DNA, 25 bp, Homo sapien
aaaaggtcatatgctcctttcccca

SEQ ID NO: 358463 - DNA, 25 bp, Homo sapien
tgcgaagggaatcccatccacacat

SEQ ID NO: 358464 - DNA, 25 bp, Homo sapien
acagctggggccatatccgggctgc

SEQ ID NO: 358465 - DNA, 25 bp, Homo sapien
tgcccgtggctgtccagtgaccgcc

SEQ ID NO: 358466 - DNA, 25 bp, Homo sapien
actgctccgggacacttctccctgg

SEQ ID NO: 358467 - DNA, 25 bp, Homo sapien
agtgctgccagccttcaggaatgct

SEQ ID NO: 358468 - DNA, 25 bp, Homo sapien
cagcctgacgctgactctccatgca

SEQ ID NO: 358469 - DNA, 25 bp, Homo sapien
atgtggcctgccagggctttgccta

SEQ ID NO: 358470 - DNA, 25 bp, Homo sapien
gctttgcctaccacacagctcagag

SEQ ID NO: 358471 - DNA, 25 bp, Homo sapien
acagctcagagcacgggttccctgt

SEQ ID NO: 358472 - DNA, 25 bp, Homo sapien
ggttccctgtcgctaacaaccgttg

SEQ ID NO: 358473 - DNA, 25 bp, Homo sapien
acaaccgttgcgaagggaatcccat

SEQ ID NO: 358474 - DNA, 25 bp, Homo sapien
cagggcagactggagtctgtctcat

SEQ ID NO: 358475 - DNA, 25 bp, Homo sapien
gagtctgtctcattatgtgattcct

SEQ ID NO: 358476 - DNA, 25 bp, Homo sapien
ttatgtgattcctggagcctgtgcc

SEQ ID NO: 358477 - DNA, 25 bp, Homo sapien
attcctggagcctgtgcctatgtca

SEQ ID NO: 358478 - DNA, 25 bp, Homo sapien
gtgcctatgtcactgcaattttcag

SEQ ID NO: 358479 - DNA, 25 bp, Homo sapien
gagacatattcaactcctctgctct

SEQ ID NO: 358480 - DNA, 25 bp, Homo sapien
tctgctcttccaaacctggtgtcta

SEQ ID NO: 358481 - DNA, 25 bp, Homo sapien
aaacctggtgtctatccggcagagg

SEQ ID NO: 358482 - DNA, 25 bp, Homo sapien
gcagtttctggccagaagcaccagc

SEQ ID NO: 358483 - DNA, 25 bp, Homo sapien
agcccctcataggaggcccaggagg

SEQ ID NO: 358484 - DNA, 25 bp, Homo sapien
caggagaagcggtgcccaccagctt

SEQ ID NO: 358485 - DNA, 25 bp, Homo sapien
attggttagattgtgtcaagctgca

SEQ ID NO: 358486 - DNA, 25 bp, Homo sapien
ttgtgtcaagctgcaaaatttgcct

SEQ ID NO: 358487 - DNA, 25 bp, Homo sapien
aaatttgccttaacatggctgtggc

SEQ ID NO: 358488 - DNA, 25 bp, Homo sapien
gccttaacatggctgtggcattctc

SEQ ID NO: 358489 - DNA, 25 bp, Homo sapien
taacatggctgtggcattctcaggg

SEQ ID NO: 358490 - DNA, 25 bp, Homo sapien
catggctgtggcattctcagggaaa

SEQ ID NO: 358491 - DNA, 25 bp, Homo sapien
gaaacatcagcaaagtgactgttaa

SEQ ID NO: 358492 - DNA, 25 bp, Homo sapien
gcaaagtgactgttaagccaaataa

SEQ ID NO: 358493 - DNA, 25 bp, Homo sapien
tgggatttagatagcatgtggttga

SEQ ID NO: 358494 - DNA, 25 bp, Homo sapien
gatagcatgtggttgaggagtaaat

SEQ ID NO: 358495 - DNA, 25 bp, Homo sapien
tcttcttttaagatgtttggttgag

SEQ ID NO: 358496 - DNA, 25 bp, Homo sapien
ttccctcagacctttagtgaaacac

SEQ ID NO: 358497 - DNA, 25 bp, Homo sapien
tagttttcactctatgacagtataa

SEQ ID NO: 358498 - DNA, 25 bp, Homo sapien
gacagtataaacaactcaaatctat

SEQ ID NO: 358499 - DNA, 25 bp, Homo sapien
actcaaatctatactgtttgttaag

SEQ ID NO: 358500 - DNA, 25 bp, Homo sapien
atagtgatccaagttttcacccaac

SEQ ID NO: 358501 - DNA, 25 bp, Homo sapien
agtgctttagcgttatgatgtattg

SEQ ID NO: 358502 - DNA, 25 bp, Homo sapien
gatgtattgacatgtttgagcttca

SEQ ID NO: 358503 - DNA, 25 bp, Homo sapien
ttgacatgtttgagcttcagttggg

SEQ ID NO: 358504 - DNA, 25 bp, Homo sapien
tcaaaacaaccccaacgaggtgaat

SEQ ID NO: 358505 - DNA, 25 bp, Homo sapien
ccccaacgaggtgaataatgcatat

SEQ ID NO: 358506 - DNA, 25 bp, Homo sapien
ttttgagccaaatgccttctgaaat

SEQ ID NO: 358507 - DNA, 25 bp, Homo sapien
ctcccgtccattccagtcaaatctg

SEQ ID NO: 358508 - DNA, 25 bp, Homo sapien
tcaaatctgggctcactcaccccag

SEQ ID NO: 358509 - DNA, 25 bp, Homo sapien
agcgagctctcaaatccctctccaa

SEQ ID NO: 358510 - DNA, 25 bp, Homo sapien
tctccaactgcctaaggccctttgt

SEQ ID NO: 358511 - DNA, 25 bp, Homo sapien
ctgcctaaggccctttgtgtaaggt

SEQ ID NO: 358512 - DNA, 25 bp, Homo sapien
taaggccctttgtgtaaggtgtctt

SEQ ID NO: 358513 - DNA, 25 bp, Homo sapien
gtgtaaggtgtcttaatactgtcct

SEQ ID NO: 358514 - DNA, 25 bp, Homo sapien
taaggtgtcttaatactgtcctttt

SEQ ID NO: 358515 - DNA, 25 bp, Homo sapien
gtagatttcagatgactatgcagag

SEQ ID NO: 358516 - DNA, 25 bp, Homo sapien
atttcagatgactatgcagaggcct

SEQ ID NO: 358517 - DNA, 25 bp, Homo sapien
tcagatgactatgcagaggcctggg

SEQ ID NO: 358518 - DNA, 25 bp, Homo sapien
gtgatgcatcagactttgacatttc

SEQ ID NO: 358519 - DNA, 25 bp, Homo sapien
atgcatcagactttgacatttcaga

SEQ ID NO: 358520 - DNA, 25 bp, Homo sapien
tcagaaatccagtccgtgtgctcag

SEQ ID NO: 358521 - DNA, 25 bp, Homo sapien
aaatccagtccgtgtgctcagatgt

SEQ ID NO: 358522 - DNA, 25 bp, Homo sapien
cagtccgtgtgctcagatgtggaaa

SEQ ID NO: 358523 - DNA, 25 bp, Homo sapien
gtgctcagatgtggaaactgtcccc

SEQ ID NO: 358524 - DNA, 25 bp, Homo sapien
agatgtggaaactgtcccccagaca

SEQ ID NO: 358525 - DNA, 25 bp, Homo sapien
aggttctcggccatccacagcgaag

SEQ ID NO: 358526 - DNA, 25 bp, Homo sapien
gccagcaaattggacaagtcctcaa

SEQ ID NO: 358527 - DNA, 25 bp, Homo sapien
gacaagtcctcaaagagatagtgca

SEQ ID NO: 358528 - DNA, 25 bp, Homo sapien
gaaatattgcaagaggcgagtttaa

SEQ ID NO: 358529 - DNA, 25 bp, Homo sapien
gaactcatccaagaggaccggccat

SEQ ID NO: 358530 - DNA, 25 bp, Homo sapien
ggaccggccatgttgggttacagaa

SEQ ID NO: 358531 - DNA, 25 bp, Homo sapien
gacacagcctgagtctgttaaagtt

SEQ ID NO: 358532 - DNA, 25 bp, Homo sapien
agttggtgacaatccacctcagtct

SEQ ID NO: 358533 - DNA, 25 bp, Homo sapien
acctcagtctctcaatgtgtgctat

SEQ ID NO: 358534 - DNA, 25 bp, Homo sapien
gtgtgctattaatgaggcctctgag

SEQ ID NO: 358535 - DNA, 25 bp, Homo sapien
tgagcttcctatccagcagtggtga

SEQ ID NO: 358536 - DNA, 25 bp, Homo sapien
tactggccttgtccagaggctcact

SEQ ID NO: 358537 - DNA, 25 bp, Homo sapien
gctcactggagtggttctctgctaa

SEQ ID NO: 358538 - DNA, 25 bp, Homo sapien
gttctctgctaatgagctgtacaac

SEQ ID NO: 358539 - DNA, 25 bp, Homo sapien
aaagccattgtctagttctcctggg

SEQ ID NO: 358540 - DNA, 25 bp, Homo sapien
atttgaattctttgcactaattgtt

SEQ ID NO: 358541 - DNA, 25 bp, Homo sapien
ttgcactaattgtttaaaagaccat

SEQ ID NO: 358542 - DNA, 25 bp, Homo sapien
agaccataggaacctcagaccatcc

SEQ ID NO: 358543 - DNA, 25 bp, Homo sapien
agaccatccctcttcatggtctcaa

SEQ ID NO: 358544 - DNA, 25 bp, Homo sapien
ctcttcatggtctcaagagctccca

SEQ ID NO: 358545 - DNA, 25 bp, Homo sapien
aagagctcccagaatcatcctcttg

SEQ ID NO: 358546 - DNA, 25 bp, Homo sapien
gaatcatcctcttggtaagctaagt

SEQ ID NO: 358547 - DNA, 25 bp, Homo sapien
tagttattagtaaggcccagggaca

SEQ ID NO: 358548 - DNA, 25 bp, Homo sapien
gagaagtaacatcttctatttttta

SEQ ID NO: 358549 - DNA, 25 bp, Homo sapien
cttcagcttagggttttttcaattg

SEQ ID NO: 358550 - DNA, 25 bp, Homo sapien
tactgagcttcagttaaggctatga

SEQ ID NO: 358551 - DNA, 25 bp, Homo sapien
gcacttgaaccagattatagattta

SEQ ID NO: 358552 - DNA, 25 bp, Homo sapien
aaaactagaatagccagtatttatg

SEQ ID NO: 358553 - DNA, 25 bp, Homo sapien
ttttttataaaactgtgcaatacga

SEQ ID NO: 358554 - DNA, 25 bp, Homo sapien
gtgcaatacgaattatgcaatcaca

SEQ ID NO: 358555 - DNA, 25 bp, Homo sapien
aatacatttgtagctcccgagtgtc

SEQ ID NO: 358556 - DNA, 25 bp, Homo sapien
ttgtagctcccgagtgtcctaaagg

SEQ ID NO: 358557 - DNA, 25 bp, Homo sapien
gtgtcctaaagggagtgcacttctt

SEQ ID NO: 358558 - DNA, 25 bp, Homo sapien
cctaaagggagtgcacttctttgaa

SEQ ID NO: 358559 - DNA, 25 bp, Homo sapien
acttctttgaagctggtgtgttaat

SEQ ID NO: 358560 - DNA, 25 bp, Homo sapien
gaagctggtgtgttaatactatgta

SEQ ID NO: 358561 - DNA, 25 bp, Homo sapien
taactttcaaatgatgctgctgcca

SEQ ID NO: 358562 - DNA, 25 bp, Homo sapien
gacgaggacacgagccccacaggag

SEQ ID NO: 358563 - DNA, 25 bp, Homo sapien
cccgacgcagagtccggagaaggca

SEQ ID NO: 358564 - DNA, 25 bp, Homo sapien
ggagaccagcggacccacgtcagag

SEQ ID NO: 358565 - DNA, 25 bp, Homo sapien
ccagcggacccacgtcagagaagat

SEQ ID NO: 358566 - DNA, 25 bp, Homo sapien
cggacccacgtcagagaagatgctt

SEQ ID NO: 358567 - DNA, 25 bp, Homo sapien
ccacaccacaatacggtctggaaga

SEQ ID NO: 358568 - DNA, 25 bp, Homo sapien
accacaatacggtctggaagaggaa

SEQ ID NO: 358569 - DNA, 25 bp, Homo sapien
tccggagaaggcagcatggaatccc

SEQ ID NO: 358570 - DNA, 25 bp, Homo sapien
ggagaaggcagcatggaatccctcc

SEQ ID NO: 358571 - DNA, 25 bp, Homo sapien
cctcaggcctctctggacggtgttg

SEQ ID NO: 358572 - DNA, 25 bp, Homo sapien
gaacacactgcagacgaggacacga

SEQ ID NO: 358573 - DNA, 25 bp, Homo sapien
gtgctgctctgctaagagatgtcca

SEQ ID NO: 358574 - DNA, 25 bp, Homo sapien
tgtcagagccccaagccctttagac

SEQ ID NO: 358575 - DNA, 25 bp, Homo sapien
caaggaccatgcctttgggacatta

SEQ ID NO: 358576 - DNA, 25 bp, Homo sapien
ctttgggacattaggactgcagcct

SEQ ID NO: 358577 - DNA, 25 bp, Homo sapien
actgcagcctttgcttctgtgtatt

SEQ ID NO: 358578 - DNA, 25 bp, Homo sapien
gtgacttttgtcacctggacacact

SEQ ID NO: 358579 - DNA, 25 bp, Homo sapien
ttgttagccatagtgggttcccttg

SEQ ID NO: 358580 - DNA, 25 bp, Homo sapien
gttcccttggtcagcaacagtgcat

SEQ ID NO: 358581 - DNA, 25 bp, Homo sapien
agtgcatgtacctctggatgtcatc

SEQ ID NO: 358582 - DNA, 25 bp, Homo sapien
ggatgtcatctgaggtgagaccacc

SEQ ID NO: 358583 - DNA, 25 bp, Homo sapien
gaggtgagaccaccgaggccttttc

SEQ ID NO: 358584 - DNA, 25 bp, Homo sapien
gaaagtggattcactactggcacat

SEQ ID NO: 358585 - DNA, 25 bp, Homo sapien
ggattcactactggcacattaacaa

SEQ ID NO: 358586 - DNA, 25 bp, Homo sapien
ggcacattaacaagcaccaataggt

SEQ ID NO: 358587 - DNA, 25 bp, Homo sapien
taggtttttattccaactccgagca

SEQ ID NO: 358588 - DNA, 25 bp, Homo sapien
tattccaactccgagcactgtggtt

SEQ ID NO: 358589 - DNA, 25 bp, Homo sapien
ccgagcactgtggttgagtaacatc

SEQ ID NO: 358590 - DNA, 25 bp, Homo sapien
gagtaacatcacctcaattttttat

SEQ ID NO: 358591 - DNA, 25 bp, Homo sapien
aaaggatcaatgctgctgtaaatac

SEQ ID NO: 358592 - DNA, 25 bp, Homo sapien
ttaaaatttcattccaccaccatca

SEQ ID NO: 358593 - DNA, 25 bp, Homo sapien
caccatcagatgcagttccctattt

SEQ ID NO: 358594 - DNA, 25 bp, Homo sapien
taagctttctaatggtgtcttcaga

SEQ ID NO: 358595 - DNA, 25 bp, Homo sapien
tggcttttttgcctccaccttttag

SEQ ID NO: 358596 - DNA, 25 bp, Homo sapien
accttttagcccacatcatttaact

SEQ ID NO: 358597 - DNA, 25 bp, Homo sapien
ccttttagcccacatcatttaactc

SEQ ID NO: 358598 - DNA, 25 bp, Homo sapien
atttaactccactactgtgaaagct

SEQ ID NO: 358599 - DNA, 25 bp, Homo sapien
ttaactccactactgtgaaagcttg

SEQ ID NO: 358600 - DNA, 25 bp, Homo sapien
aactccactactgtgaaagcttgct

SEQ ID NO: 358601 - DNA, 25 bp, Homo sapien
actccactactgtgaaagcttgctt

SEQ ID NO: 358602 - DNA, 25 bp, Homo sapien
tccactactgtgaaagcttgcttaa

SEQ ID NO: 358603 - DNA, 25 bp, Homo sapien
ccactactgtgaaagcttgcttaaa

SEQ ID NO: 358604 - DNA, 25 bp, Homo sapien
gaaagcttgcttaaagaaaatccct

SEQ ID NO: 358605 - DNA, 25 bp, Homo sapien
aagcttgcttaaagaaaatccctct

SEQ ID NO: 358606 - DNA, 25 bp, Homo sapien
ggagaccagcggacccacgtcagag

SEQ ID NO: 358607 - DNA, 25 bp, Homo sapien
gagaccagcggacccacgtcagaga

SEQ ID NO: 358608 - DNA, 25 bp, Homo sapien
agaccagcggacccacgtcagagaa

SEQ ID NO: 358609 - DNA, 25 bp, Homo sapien
gaccagcggacccacgtcagagaag

SEQ ID NO: 358610 - DNA, 25 bp, Homo sapien
accagcggacccacgtcagagaaga

SEQ ID NO: 358611 - DNA, 25 bp, Homo sapien
ccagcggacccacgtcagagaagat

SEQ ID NO: 358612 - DNA, 25 bp, Homo sapien
ccacaccacaatacggtctggaaga

SEQ ID NO: 358613 - DNA, 25 bp, Homo sapien
cacaccacaatacggtctggaagag

SEQ ID NO: 358614 - DNA, 25 bp, Homo sapien
caccacaatacggtctggaagagga

SEQ ID NO: 358615 - DNA, 25 bp, Homo sapien
accacaatacggtctggaagaggaa

SEQ ID NO: 358616 - DNA, 25 bp, Homo sapien
ccacaatacggtctggaagaggaag

SEQ ID NO: 358617 - DNA, 25 bp, Homo sapien
cagcgcccgacccaaagtgttcttt

SEQ ID NO: 358618 - DNA, 25 bp, Homo sapien
ttccttgaaaagaagtacagatttt

SEQ ID NO: 358619 - DNA, 25 bp, Homo sapien
aaagctaatattgctgtgattcaac

SEQ ID NO: 358620 - DNA, 25 bp, Homo sapien
aatattgctgtgattcaactctcaa

SEQ ID NO: 358621 - DNA, 25 bp, Homo sapien
tattgctgtgattcaactctcaagt

SEQ ID NO: 358622 - DNA, 25 bp, Homo sapien
actctcaagttacttgatgctattt

SEQ ID NO: 358623 - DNA, 25 bp, Homo sapien
agcatgtgatcagttgtcacggcat

SEQ ID NO: 358624 - DNA, 25 bp, Homo sapien
atgtgatcagttgtcacggcatcaa

SEQ ID NO: 358625 - DNA, 25 bp, Homo sapien
gatcagttgtcacggcatcaaagat

SEQ ID NO: 358626 - DNA, 25 bp, Homo sapien
agttgtcacggcatcaaagatagga

SEQ ID NO: 358627 - DNA, 25 bp, Homo sapien
cggcatcaaagataggagagtttct

SEQ ID NO: 358628 - DNA, 25 bp, Homo sapien
ggcgcaattatagaatacatgtatt

SEQ ID NO: 358629 - DNA, 25 bp, Homo sapien
tgtattatggccacgtagcaatgac

SEQ ID NO: 358630 - DNA, 25 bp, Homo sapien
attatggccacgtagcaatgactgt

SEQ ID NO: 358631 - DNA, 25 bp, Homo sapien
ccacgtagcaatgactgtattaggg

SEQ ID NO: 358632 - DNA, 25 bp, Homo sapien
gctagttctgtaataaatagacccg

SEQ ID NO: 358633 - DNA, 25 bp, Homo sapien
cgtttttgcttccataatattgggc

SEQ ID NO: 358634 - DNA, 25 bp, Homo sapien
gcagccgttatgcaggcaggcatca

SEQ ID NO: 358635 - DNA, 25 bp, Homo sapien
cgttatgcaggcaggcatcagagca

SEQ ID NO: 358636 - DNA, 25 bp, Homo sapien
tctccatcccgcctgaagtaggcgg

SEQ ID NO: 358637 - DNA, 25 bp, Homo sapien
caggtgtggaagtggcaccccttat

SEQ ID NO: 358638 - DNA, 25 bp, Homo sapien
tgtggaagtggcaccccttatgtcc

SEQ ID NO: 358639 - DNA, 25 bp, Homo sapien
tctgttagccaatctccacttgaag

SEQ ID NO: 358640 - DNA, 25 bp, Homo sapien
agccaatctccacttgaagcacagt

SEQ ID NO: 358641 - DNA, 25 bp, Homo sapien
gtgagggctgccatgtccactgtgt

SEQ ID NO: 358642 - DNA, 25 bp, Homo sapien
gggtgggctgcttcttcgacccctg

SEQ ID NO: 358643 - DNA, 25 bp, Homo sapien
tgctgcctccacctaggagatatgt

SEQ ID NO: 358644 - DNA, 25 bp, Homo sapien
aggagatatgtctaccaagagccag

SEQ ID NO: 358645 - DNA, 25 bp, Homo sapien
gagccagttgtgtttgctatcatgc

SEQ ID NO: 358646 - DNA, 25 bp, Homo sapien
gttgtgtttgctatcatgcatgttt

SEQ ID NO: 358647 - DNA, 25 bp, Homo sapien
tcatgcatgtttatgtgtttgtgct

SEQ ID NO: 358648 - DNA, 25 bp, Homo sapien
tatacctggataaattactgttacc

SEQ ID NO: 358649 - DNA, 25 bp, Homo sapien
ggaaggtctgttagccaatctccac

SEQ ID NO: 358650 - DNA, 25 bp, Homo sapien
tgattgtggtgctgaaggtaacccc

SEQ ID NO: 358651 - DNA, 25 bp, Homo sapien
gggtacagccaatagtattcttaga

SEQ ID NO: 358652 - DNA, 25 bp, Homo sapien
gttaatcaattctgtaacgggttga

SEQ ID NO: 358653 - DNA, 25 bp, Homo sapien
tgttttggtctcatttttagtccga

SEQ ID NO: 358654 - DNA, 25 bp, Homo sapien
tttagtccgaggtgccctgatgctg

SEQ ID NO: 358655 - DNA, 25 bp, Homo sapien
ggagtcagtggcttgttatgaataa

SEQ ID NO: 358656 - DNA, 25 bp, Homo sapien
aataagaggacacatgagctgaatc

SEQ ID NO: 358657 - DNA, 25 bp, Homo sapien
gattttatctggttaggccgtgtaa

SEQ ID NO: 358658 - DNA, 25 bp, Homo sapien
tctggttaggccgtgtaatcaaaca

SEQ ID NO: 358659 - DNA, 25 bp, Homo sapien
taatcaaacacgtgggcaggaaagt

SEQ ID NO: 358660 - DNA, 25 bp, Homo sapien
gtggatccattatgttgtactcatg

SEQ ID NO: 358661 - DNA, 25 bp, Homo sapien
atctaggcgaggtgggctcgggcgt

SEQ ID NO: 358662 - DNA, 25 bp, Homo sapien
caggccctccttagaaaagccgtct

SEQ ID NO: 358663 - DNA, 25 bp, Homo sapien
ttagaaaagccgtctctctcgagtg

SEQ ID NO: 358664 - DNA, 25 bp, Homo sapien
agaaaagccgtctctctcgagtgca

SEQ ID NO: 358665 - DNA, 25 bp, Homo sapien
aaaagccgtctctctcgagtgcagt

SEQ ID NO: 358666 - DNA, 25 bp, Homo sapien
aagccgtctctctcgagtgcagtgg

SEQ ID NO: 358667 - DNA, 25 bp, Homo sapien
tgcccaccccatattaactgtaatt

SEQ ID NO: 358668 - DNA, 25 bp, Homo sapien
gaagagtgacttgttggtttaataa

SEQ ID NO: 358669 - DNA, 25 bp, Homo sapien
ataatttattggctgccataatgta

SEQ ID NO: 358670 - DNA, 25 bp, Homo sapien
taatgtatttattagtcgcctaccg

SEQ ID NO: 358671 - DNA, 25 bp, Homo sapien
tgtatttattagtcgcctaccgtta

SEQ ID NO: 358672 - DNA, 25 bp, Homo sapien
tatccaaccccgttttgtagctgtg

SEQ ID NO: 358673 - DNA, 25 bp, Homo sapien
gttttgtagctgtgcccacaatcac

SEQ ID NO: 358674 - DNA, 25 bp, Homo sapien
attaccttccccaagcaaatgtggc

SEQ ID NO: 358675 - DNA, 25 bp, Homo sapien
tccccaagcaaatgtggcacgtgat

SEQ ID NO: 358676 - DNA, 25 bp, Homo sapien
gcgcccagatgaatccattaatcac

SEQ ID NO: 358677 - DNA, 25 bp, Homo sapien
ggcagagtgagcgacaatgtaacat

SEQ ID NO: 358678 - DNA, 25 bp, Homo sapien
aatgtaacattctgcacggtctgag

SEQ ID NO: 358679 - DNA, 25 bp, Homo sapien
acattctgcacggtctgagccatgg

SEQ ID NO: 358680 - DNA, 25 bp, Homo sapien
tgagccatggcagcgttcagaatcc

SEQ ID NO: 358681 - DNA, 25 bp, Homo sapien
aatccattaatcacggtgcgctacc

SEQ ID NO: 358682 - DNA, 25 bp, Homo sapien
ggcctcccatcaagaacgcgggtta

SEQ ID NO: 358683 - DNA, 25 bp, Homo sapien
ggccccatcagtgcacctgattgga

SEQ ID NO: 358684 - DNA, 25 bp, Homo sapien
tgcacctgattggaacacactagat

SEQ ID NO: 358685 - DNA, 25 bp, Homo sapien
aacacactagatttcaggtcctgga

SEQ ID NO: 358686 - DNA, 25 bp, Homo sapien
ttcaggtcctggaaactgggcgcta

SEQ ID NO: 358687 - DNA, 25 bp, Homo sapien
cctacagctgcacttctagaaggtc

SEQ ID NO: 358688 - DNA, 25 bp, Homo sapien
gaaactgggcgctaggatccgtttc

SEQ ID NO: 358689 - DNA, 25 bp, Homo sapien
taggatccgtttccctggctgcaga

SEQ ID NO: 358690 - DNA, 25 bp, Homo sapien
ggtgtgatgtggaatatcccttctc

SEQ ID NO: 358691 - DNA, 25 bp, Homo sapien
tgatgtggaatatcccttctcccag

SEQ ID NO: 358692 - DNA, 25 bp, Homo sapien
ttctagaaggtcagcctgtccgatt

SEQ ID NO: 358693 - DNA, 25 bp, Homo sapien
aggtcagcctgtccgattcttgtaa

SEQ ID NO: 358694 - DNA, 25 bp, Homo sapien
ttacctcagttcttttactgtgctg

SEQ ID NO: 358695 - DNA, 25 bp, Homo sapien
tactgtgctgttgtacttgtaaact

SEQ ID NO: 358696 - DNA, 25 bp, Homo sapien
tacttgtaaactctttctcccaact

SEQ ID NO: 358697 - DNA, 25 bp, Homo sapien
ttttctcctgaaaaatcagaggact

SEQ ID NO: 358698 - DNA, 25 bp, Homo sapien
tcagaggacttttcttctccacaaa

SEQ ID NO: 358699 - DNA, 25 bp, Homo sapien
ctccacaaaagattattgatgtttc

SEQ ID NO: 358700 - DNA, 25 bp, Homo sapien
gatgtttcaaatctaaatgacacag

SEQ ID NO: 358701 - DNA, 25 bp, Homo sapien
gcaagaccaggtagtgatatttaag

SEQ ID NO: 358702 - DNA, 25 bp, Homo sapien
attggaatcattcttgaatttcttt

SEQ ID NO: 358703 - DNA, 25 bp, Homo sapien
gtgacatttcaacacttggactaaa

SEQ ID NO: 358704 - DNA, 25 bp, Homo sapien
tttaagggaatgtttgagggctaag

SEQ ID NO: 358705 - DNA, 25 bp, Homo sapien
ggcgggcaaagactcccgcttcact

SEQ ID NO: 358706 - DNA, 25 bp, Homo sapien
gcttcactctgggacacaactggga

SEQ ID NO: 358707 - DNA, 25 bp, Homo sapien
ttcactctgggacacaactgggacg

SEQ ID NO: 358708 - DNA, 25 bp, Homo sapien
actctgggacacaactgggacggcg

SEQ ID NO: 358709 - DNA, 25 bp, Homo sapien
ctgggacacaactgggacggcgctt

SEQ ID NO: 358710 - DNA, 25 bp, Homo sapien
ggacacaactgggacggcgcttcaa

SEQ ID NO: 358711 - DNA, 25 bp, Homo sapien
acacaactgggacggcgcttcaacc

SEQ ID NO: 358712 - DNA, 25 bp, Homo sapien
tgggacggcgcttcaacctctgcct

SEQ ID NO: 358713 - DNA, 25 bp, Homo sapien
cccacgtctcgttctggaccaggaa

SEQ ID NO: 358714 - DNA, 25 bp, Homo sapien
cacgtctcgttctggaccaggaacc

SEQ ID NO: 358715 - DNA, 25 bp, Homo sapien
aactggagtggagctcgaagtggct

SEQ ID NO: 358716 - DNA, 25 bp, Homo sapien
gtgggcacgggagcccttctccctg

SEQ ID NO: 358717 - DNA, 25 bp, Homo sapien
agacccctctctaggaccaagtcac

SEQ ID NO: 358718 - DNA, 25 bp, Homo sapien
tggaagccctccctccacttaagtt

SEQ ID NO: 358719 - DNA, 25 bp, Homo sapien
gccctccctccacttaagttattgt

SEQ ID NO: 358720 - DNA, 25 bp, Homo sapien
aaccaaagtttacagtgtctgttgg

SEQ ID NO: 358721 - DNA, 25 bp, Homo sapien
aagtttacagtgtctgttggtggcc

SEQ ID NO: 358722 - DNA, 25 bp, Homo sapien
gtttacagtgtctgttggtggccaa

SEQ ID NO: 358723 - DNA, 25 bp, Homo sapien
ttacagtgtctgttggtggccaaga

SEQ ID NO: 358724 - DNA, 25 bp, Homo sapien
tacagtgtctgttggtggccaagac

SEQ ID NO: 358725 - DNA, 25 bp, Homo sapien
cagtgtctgttggtggccaagacct

SEQ ID NO: 358726 - DNA, 25 bp, Homo sapien
caccccctcaggagtgggcacggga

SEQ ID NO: 358727 - DNA, 25 bp, Homo sapien
atctgtcactcgctagaccctagta

SEQ ID NO: 358728 - DNA, 25 bp, Homo sapien
agaccctagtacagtgcgtgacacg

SEQ ID NO: 358729 - DNA, 25 bp, Homo sapien
tgcgtgacacgggattaagcacttt

SEQ ID NO: 358730 - DNA, 25 bp, Homo sapien
aatgaattctaccacgtgctagaga

SEQ ID NO: 358731 - DNA, 25 bp, Homo sapien
tacagactccaatcacagtttttac

SEQ ID NO: 358732 - DNA, 25 bp, Homo sapien
gtttttacttttgcaccagagcgat

SEQ ID NO: 358733 - DNA, 25 bp, Homo sapien
ccagagcgattgtgcgtttgtttcc

SEQ ID NO: 358734 - DNA, 25 bp, Homo sapien
gtgtagccggctgaaaactgcagaa

SEQ ID NO: 358735 - DNA, 25 bp, Homo sapien
attttctttataagctcctggaggg

SEQ ID NO: 358736 - DNA, 25 bp, Homo sapien
tggagggcagcgacccactgagatc

SEQ ID NO: 358737 - DNA, 25 bp, Homo sapien
gagatctctgtaccgtgacatctgt

SEQ ID NO: 358738 - DNA, 25 bp, Homo sapien
cccagtgtctggcatcgagtaggct

SEQ ID NO: 358739 - DNA, 25 bp, Homo sapien
atatctctggagtgcatagtaacag

SEQ ID NO: 358740 - DNA, 25 bp, Homo sapien
gatgcccttccaaggttgagaccta

SEQ ID NO: 358741 - DNA, 25 bp, Homo sapien
atagcagctagccattgattgaaga

SEQ ID NO: 358742 - DNA, 25 bp, Homo sapien
gattgaagacctcttgtgtgccggt

SEQ ID NO: 358743 - DNA, 25 bp, Homo sapien
gtgccggtctctgcgttaaacattt

SEQ ID NO: 358744 - DNA, 25 bp, Homo sapien
aaacatttctggaggcttaactcat

SEQ ID NO: 358745 - DNA, 25 bp, Homo sapien
tcatttaaggagctaccccagccat

SEQ ID NO: 358746 - DNA, 25 bp, Homo sapien
agacctagtctctactctgatgtca

SEQ ID NO: 358747 - DNA, 25 bp, Homo sapien
tctgatgtcagctctccgagagaca

SEQ ID NO: 358748 - DNA, 25 bp, Homo sapien
gagagacactctggcctgctttgtt

SEQ ID NO: 358749 - DNA, 25 bp, Homo sapien
atggaagcttccaagatccagagga

SEQ ID NO: 358750 - DNA, 25 bp, Homo sapien
agaggcaacagcactgagagtcata

SEQ ID NO: 358751 - DNA, 25 bp, Homo sapien
gagagtcataggtagaagaatcatc

SEQ ID NO: 358752 - DNA, 25 bp, Homo sapien
gaagaatcatcacagccctgctaac

SEQ ID NO: 358753 - DNA, 25 bp, Homo sapien
agccctgctaaccaggcagctgatg

SEQ ID NO: 358754 - DNA, 25 bp, Homo sapien
tgctaaccaggcagctgatgcccct

SEQ ID NO: 358755 - DNA, 25 bp, Homo sapien
caggggcatctgttggctgaactca

SEQ ID NO: 358756 - DNA, 25 bp, Homo sapien
gctgaactcaacctgaagccaaaga

SEQ ID NO: 358757 - DNA, 25 bp, Homo sapien
aggcaacatttatagagctcaggtt

SEQ ID NO: 358758 - DNA, 25 bp, Homo sapien
tagagctcaggtttctagggctgga

SEQ ID NO: 358759 - DNA, 25 bp, Homo sapien
acacacaggagacacctggcataac

SEQ ID NO: 358760 - DNA, 25 bp, Homo sapien
ttatctattaaaaacctgtggcagc

SEQ ID NO: 358761 - DNA, 25 bp, Homo sapien
aaaaacctgtggcagctcatggtat

SEQ ID NO: 358762 - DNA, 25 bp, Homo sapien
cctgtggcagctcatggtattattg

SEQ ID NO: 358763 - DNA, 25 bp, Homo sapien
ggtattattgaccatatgttctagt

SEQ ID NO: 358764 - DNA, 25 bp, Homo sapien
catatgttctagtgtcttcttgcag

SEQ ID NO: 358765 - DNA, 25 bp, Homo sapien
tctagtgtcttcttgcagatttaaa

SEQ ID NO: 358766 - DNA, 25 bp, Homo sapien
gtgtgatacatctttggataatctg

SEQ ID NO: 358767 - DNA, 25 bp, Homo sapien
ttttttcttccttgatacgtatgag

SEQ ID NO: 358768 - DNA, 25 bp, Homo sapien
cttgatacgtatgagattcaccagt

SEQ ID NO: 358769 - DNA, 25 bp, Homo sapien
ttctcttgtggtggcatatagttga

SEQ ID NO: 358770 - DNA, 25 bp, Homo sapien
tgtggtggcatatagttgattgtca

SEQ ID NO: 358771 - DNA, 25 bp, Homo sapien
tgacaagtcaaagagcacagctgga

SEQ ID NO: 358772 - DNA, 25 bp, Homo sapien
agagcacagctggaatgcaagtcaa

SEQ ID NO: 358773 - DNA, 25 bp, Homo sapien
gaattacgtactgcctttctaggag

SEQ ID NO: 358774 - DNA, 25 bp, Homo sapien
attagtttgaagtagggatccagat

SEQ ID NO: 358775 - DNA, 25 bp, Homo sapien
ggatccagattagtggttttccaca

SEQ ID NO: 358776 - DNA, 25 bp, Homo sapien
gtggttttccacatgtaggtaaatt

SEQ ID NO: 358777 - DNA, 25 bp, Homo sapien
agcaacaagccaaaggaccctagat

SEQ ID NO: 358778 - DNA, 25 bp, Homo sapien
aaaggaccctagatttctcctgtgg

SEQ ID NO: 358779 - DNA, 25 bp, Homo sapien
tagatttctcctgtggcttcttaaa

SEQ ID NO: 358780 - DNA, 25 bp, Homo sapien
gtggcttcttaaatacctggaatgt

SEQ ID NO: 358781 - DNA, 25 bp, Homo sapien
agtctttctcgcatccatttccagg

SEQ ID NO: 358782 - DNA, 25 bp, Homo sapien
agccaaggggttgtctgggcctcac

SEQ ID NO: 358783 - DNA, 25 bp, Homo sapien
cggcctcgagcgtggcgagctgcag

SEQ ID NO: 358784 - DNA, 25 bp, Homo sapien
gtacagggagcgtccgtctggccac

SEQ ID NO: 358785 - DNA, 25 bp, Homo sapien
gagcgtccgtctggccacggatgta

SEQ ID NO: 358786 - DNA, 25 bp, Homo sapien
gggcagctgcacatctcagtctggt

SEQ ID NO: 358787 - DNA, 25 bp, Homo sapien
ggcagctgcacatctcagtctggtc

SEQ ID NO: 358788 - DNA, 25 bp, Homo sapien
agctgcacatctcagtctggtcctg

SEQ ID NO: 358789 - DNA, 25 bp, Homo sapien
tgcacatctcagtctggtcctgaca

SEQ ID NO: 358790 - DNA, 25 bp, Homo sapien
gcacatctcagtctggtcctgacag

SEQ ID NO: 358791 - DNA, 25 bp, Homo sapien
acatctcagtctggtcctgacagct

SEQ ID NO: 358792 - DNA, 25 bp, Homo sapien
catctcagtctggtcctgacagctg

SEQ ID NO: 358793 - DNA, 25 bp, Homo sapien
taactccctacaggctacagctaga

SEQ ID NO: 358794 - DNA, 25 bp, Homo sapien
tccctacaggctacagctagagagt

SEQ ID NO: 358795 - DNA, 25 bp, Homo sapien
gctacagctagagagttgactcctc

SEQ ID NO: 358796 - DNA, 25 bp, Homo sapien
agagttgactcctctatttgaggta

SEQ ID NO: 358797 - DNA, 25 bp, Homo sapien
ctatttgaggtaagagtgtctggat

SEQ ID NO: 358798 - DNA, 25 bp, Homo sapien
gtaagagtgtctggatttgggataa

SEQ ID NO: 358799 - DNA, 25 bp, Homo sapien
ctggatttgggataaggtgacctca

SEQ ID NO: 358800 - DNA, 25 bp, Homo sapien
gataaggtgacctcagtttgcaggt

SEQ ID NO: 358801 - DNA, 25 bp, Homo sapien
ggtgacctcagtttgcaggtctcat

SEQ ID NO: 358802 - DNA, 25 bp, Homo sapien
gacctcagtttgcaggtctcatggg

SEQ ID NO: 358803 - DNA, 25 bp, Homo sapien
ccacagtgagcaaaggaatttgtct

SEQ ID NO: 358804 - DNA, 25 bp, Homo sapien
aaatttacatgtggactttgctaca

SEQ ID NO: 358805 - DNA, 25 bp, Homo sapien
tggactttgctacacacctgggatg

SEQ ID NO: 358806 - DNA, 25 bp, Homo sapien
gagttttgttccattgcagtacatc

SEQ ID NO: 358807 - DNA, 25 bp, Homo sapien
ttgttccattgcagtacatctgatg

SEQ ID NO: 358808 - DNA, 25 bp, Homo sapien
acatctgatgaccagaattctatca

SEQ ID NO: 358809 - DNA, 25 bp, Homo sapien
gttaatgaacgaaaagcctgagctt

SEQ ID NO: 358810 - DNA, 25 bp, Homo sapien
ttaccttggacataagctaagcttt

SEQ ID NO: 358811 - DNA, 25 bp, Homo sapien
gctaagctttaagtttgttgtttat

SEQ ID NO: 358812 - DNA, 25 bp, Homo sapien
ttgttgtttataacttcaaagagag

SEQ ID NO: 358813 - DNA, 25 bp, Homo sapien
gagagacaagggacagtgacttaag

SEQ ID NO: 358814 - DNA, 25 bp, Homo sapien
gggacagtgacttaagaatattcta

SEQ ID NO: 358815 - DNA, 25 bp, Homo sapien
ctgcttccgaggagccggagtcagt

SEQ ID NO: 358816 - DNA, 25 bp, Homo sapien
agtcagtggccggataagcagagcc

SEQ ID NO: 358817 - DNA, 25 bp, Homo sapien
cggataagcagagccactcgggagt

SEQ ID NO: 358818 - DNA, 25 bp, Homo sapien
ataagcagagccactcgggagtggt

SEQ ID NO: 358819 - DNA, 25 bp, Homo sapien
cagaggagctctggcccgcagggtg

SEQ ID NO: 358820 - DNA, 25 bp, Homo sapien
tcgggcgaggcaaagtgcaaagcat

SEQ ID NO: 358821 - DNA, 25 bp, Homo sapien
ggccagggacctgcagtgactcgct

SEQ ID NO: 358822 - DNA, 25 bp, Homo sapien
tcctccctgtgtttggccttagtgt

SEQ ID NO: 358823 - DNA, 25 bp, Homo sapien
gtgtttggccttagtgtccacagga

SEQ ID NO: 358824 - DNA, 25 bp, Homo sapien
ggccttagtgtccacaggatgaaat

SEQ ID NO: 358825 - DNA, 25 bp, Homo sapien
gaaatgtccgagtcaggccagtcct

SEQ ID NO: 358826 - DNA, 25 bp, Homo sapien
gaagcagctcctgttggggtcatca

SEQ ID NO: 358827 - DNA, 25 bp, Homo sapien
gatttttaatctggctcagcaaagc

SEQ ID NO: 358828 - DNA, 25 bp, Homo sapien
gcaaagccatggctgtccagcctta

SEQ ID NO: 358829 - DNA, 25 bp, Homo sapien
gcacagctgggcctcgagaactcag

SEQ ID NO: 358830 - DNA, 25 bp, Homo sapien
gcctcgagaactcagggccagcctt

SEQ ID NO: 358831 - DNA, 25 bp, Homo sapien
agccttcccagcttgggtcctgttt

SEQ ID NO: 358832 - DNA, 25 bp, Homo sapien
tcccagcttgggtcctgtttcggag

SEQ ID NO: 358833 - DNA, 25 bp, Homo sapien
tacagcaggccacgcgatccactgg

SEQ ID NO: 358834 - DNA, 25 bp, Homo sapien
aggccacgcgatccactgggcttct

SEQ ID NO: 358835 - DNA, 25 bp, Homo sapien
gcttctgggcacagaagtgcctcaa

SEQ ID NO: 358836 - DNA, 25 bp, Homo sapien
gggcacagaagtgcctcaacaggca

SEQ ID NO: 358837 - DNA, 25 bp, Homo sapien
acctgagaccccaaaacaactgcgt

SEQ ID NO: 358838 - DNA, 25 bp, Homo sapien
caaaacaactgcgtctggcccaggg

SEQ ID NO: 358839 - DNA, 25 bp, Homo sapien
gggagtgggcaaaaattccaacagg

SEQ ID NO: 358840 - DNA, 25 bp, Homo sapien
aattccaacagggagagaccgtctc

SEQ ID NO: 358841 - DNA, 25 bp, Homo sapien
ggagagaccgtctctggcttattta

SEQ ID NO: 358842 - DNA, 25 bp, Homo sapien
aagctattagtgctccatgtaaaca

SEQ ID NO: 358843 - DNA, 25 bp, Homo sapien
gctccatgtaaacaagcacgcccaa

SEQ ID NO: 358844 - DNA, 25 bp, Homo sapien
acaagcacgcccaattcaagttgga

SEQ ID NO: 358845 - DNA, 25 bp, Homo sapien
gcccaattcaagttggaactcttta

SEQ ID NO: 358846 - DNA, 25 bp, Homo sapien
agcaggcacgggatgtgggctgtcc

SEQ ID NO: 358847 - DNA, 25 bp, Homo sapien
ccctccagcacagtgcgggaaggtg

SEQ ID NO: 358848 - DNA, 25 bp, Homo sapien
ctgcttgggtggagaggatggccta

SEQ ID NO: 358849 - DNA, 25 bp, Homo sapien
gaggatggcctaactggatgtttat

SEQ ID NO: 358850 - DNA, 25 bp, Homo sapien
tggatgtttatcctagcgtcaaccc

SEQ ID NO: 358851 - DNA, 25 bp, Homo sapien
gatgtttatcctagcgtcaacccac

SEQ ID NO: 358852 - DNA, 25 bp, Homo sapien
tagcgtcaacccaccaaagatttgg

SEQ ID NO: 358853 - DNA, 25 bp, Homo sapien
catgtgagtcacattctctgggaca

SEQ ID NO: 358854 - DNA, 25 bp, Homo sapien
gtgagtcacattctctgggacattc

SEQ ID NO: 358855 - DNA, 25 bp, Homo sapien
gtcacattctctgggacattctact

SEQ ID NO: 358856 - DNA, 25 bp, Homo sapien
ggacattctactcccctttgatttt

SEQ ID NO: 358857 - DNA, 25 bp, Homo sapien
actcccctttgattttgcatttcca

SEQ ID NO: 358858 - DNA, 25 bp, Homo sapien
tccagacatttcagtggctaccaca

SEQ ID NO: 358859 - DNA, 25 bp, Homo sapien
tatccctaggatacgtgctaaagga

SEQ ID NO: 358860 - DNA, 25 bp, Homo sapien
ggatacgtgctaaaggaaaactgtc

SEQ ID NO: 358861 - DNA, 25 bp, Homo sapien
gaaaactgtcctgtaattcctgtta

SEQ ID NO: 358862 - DNA, 25 bp, Homo sapien
actgtcctgtaattcctgttaatat

SEQ ID NO: 358863 - DNA, 25 bp, Homo sapien
ttacatctgtcaagtggttccatac

SEQ ID NO: 358864 - DNA, 25 bp, Homo sapien
atatattgttaatgtcagacgtgat

SEQ ID NO: 358865 - DNA, 25 bp, Homo sapien
agtggttccatacttcttgtaaaag

SEQ ID NO: 358866 - DNA, 25 bp, Homo sapien
aagtttgggtattgtttgctgtatc

SEQ ID NO: 358867 - DNA, 25 bp, Homo sapien
ttgtttgctgtatcaatatgatggc

SEQ ID NO: 358868 - DNA, 25 bp, Homo sapien
gctttccatgcattgtctcattatc

SEQ ID NO: 358869 - DNA, 25 bp, Homo sapien
gcattgtctcattatccctaggata

SEQ ID NO: 358870 - DNA, 25 bp, Homo sapien
attttacaatacagagccccagtca

SEQ ID NO: 358871 - DNA, 25 bp, Homo sapien
cccagtcaattccacaatctcaatt

SEQ ID NO: 358872 - DNA, 25 bp, Homo sapien
cacaatctcaatttcatacatggga

SEQ ID NO: 358873 - DNA, 25 bp, Homo sapien
catggagaaacttgtgaggctgtta

SEQ ID NO: 358874 - DNA, 25 bp, Homo sapien
ggctttaatgaattggcctgtgaaa

SEQ ID NO: 358875 - DNA, 25 bp, Homo sapien
aattggcctgtgaaaatgagctcta

SEQ ID NO: 358876 - DNA, 25 bp, Homo sapien
aaatgagctctaaatttcctcccac

SEQ ID NO: 358877 - DNA, 25 bp, Homo sapien
taaatttcctcccacgtacactcaa

SEQ ID NO: 358878 - DNA, 25 bp, Homo sapien
gaggctgttacacattctacacacc

SEQ ID NO: 358879 - DNA, 25 bp, Homo sapien
acattctacacacctaacattattt

SEQ ID NO: 358880 - DNA, 25 bp, Homo sapien
gcttgacttttaccaaagatcactg

SEQ ID NO: 358881 - DNA, 25 bp, Homo sapien
gaggctcccacttatgcctcggtgg

SEQ ID NO: 358882 - DNA, 25 bp, Homo sapien
gggcaggatgactcttgaaggtgga

SEQ ID NO: 358883 - DNA, 25 bp, Homo sapien
tgaaggtggagacaggccctggaca

SEQ ID NO: 358884 - DNA, 25 bp, Homo sapien
tcccacttatgcctcggtgggctct

SEQ ID NO: 358885 - DNA, 25 bp, Homo sapien
cctggacagctctgggacccttaat

SEQ ID NO: 358886 - DNA, 25 bp, Homo sapien
gacagctctgggacccttaatggtg

SEQ ID NO: 358887 - DNA, 25 bp, Homo sapien
gctctgggacccttaatggtggcag

SEQ ID NO: 358888 - DNA, 25 bp, Homo sapien
ctgggacccttaatggtggcagcag

SEQ ID NO: 358889 - DNA, 25 bp, Homo sapien
ccagtcataggcctcattgtgtggg

SEQ ID NO: 358890 - DNA, 25 bp, Homo sapien
acctgcgtcacaccctggctagtga

SEQ ID NO: 358891 - DNA, 25 bp, Homo sapien
caccctggctagtgacccagtcaga

SEQ ID NO: 358892 - DNA, 25 bp, Homo sapien
aagaatcatgtcctcatggctctgc

SEQ ID NO: 358893 - DNA, 25 bp, Homo sapien
catggctctgcagcgaggtccagga

SEQ ID NO: 358894 - DNA, 25 bp, Homo sapien
ggtccaggagatgcttcatctgctg

SEQ ID NO: 358895 - DNA, 25 bp, Homo sapien
tgcctgctacccagtgagccatggc

SEQ ID NO: 358896 - DNA, 25 bp, Homo sapien
tggctgctatctcacctccatggga

SEQ ID NO: 358897 - DNA, 25 bp, Homo sapien
gagcttgagcttggtcagcaactac

SEQ ID NO: 358898 - DNA, 25 bp, Homo sapien
atttttcagaccctcgtacgtgctg

SEQ ID NO: 358899 - DNA, 25 bp, Homo sapien
accctcgtacgtgctgggcaatgtg

SEQ ID NO: 358900 - DNA, 25 bp, Homo sapien
gcaatgtgcaggtagacaccgggct

SEQ ID NO: 358901 - DNA, 25 bp, Homo sapien
acaccgggctgtgaggcgcttgaac

SEQ ID NO: 358902 - DNA, 25 bp, Homo sapien
ggcgcttgaacccaacaccaagaat

SEQ ID NO: 358903 - DNA, 25 bp, Homo sapien
aacactgagctcttagaactaacca

SEQ ID NO: 358904 - DNA, 25 bp, Homo sapien
gaactaaccacaaaaaccattgaag

SEQ ID NO: 358905 - DNA, 25 bp, Homo sapien
gatcaagctgcagagaccattgaag

SEQ ID NO: 358906 - DNA, 25 bp, Homo sapien
aaattgctgcatgagtttcctaaaa

SEQ ID NO: 358907 - DNA, 25 bp, Homo sapien
gagtttcctaaaagtactagaagct

SEQ ID NO: 358908 - DNA, 25 bp, Homo sapien
gagaccattgaagctctgcatgcag

SEQ ID NO: 358909 - DNA, 25 bp, Homo sapien
ttgaagctctgcatgcagcaggcct

SEQ ID NO: 358910 - DNA, 25 bp, Homo sapien
agctctgcatgcagcaggcctgaaa

SEQ ID NO: 358911 - DNA, 25 bp, Homo sapien
ctgcatgcagcaggcctgaaagtct

SEQ ID NO: 358912 - DNA, 25 bp, Homo sapien
aggcctgaaagtctgggtgctcact

SEQ ID NO: 358913 - DNA, 25 bp, Homo sapien
ggagacagctaaatccacatgctat

SEQ ID NO: 358914 - DNA, 25 bp, Homo sapien
tgttcattattgttctcaacttggg

SEQ ID NO: 358915 - DNA, 25 bp, Homo sapien
tgcttacttatcaggtctccacata

SEQ ID NO: 358916 - DNA, 25 bp, Homo sapien
ttatcaggtctccacataaaggtgt

SEQ ID NO: 358917 - DNA, 25 bp, Homo sapien
taaaggtgtggaaacttcattcatt

SEQ ID NO: 358918 - DNA, 25 bp, Homo sapien
cattcattcatatcttcaacacaaa

SEQ ID NO: 358919 - DNA, 25 bp, Homo sapien
tcaacaaatatttagtccaagccac

SEQ ID NO: 358920 - DNA, 25 bp, Homo sapien
gtccaagccactattacttactacc

SEQ ID NO: 358921 - DNA, 25 bp, Homo sapien
attacttactaccttctctactatt

SEQ ID NO: 358922 - DNA, 25 bp, Homo sapien
accttctctactattgtatggactt

SEQ ID NO: 358923 - DNA, 25 bp, Homo sapien
ggacttttaactatctctgacacta

SEQ ID NO: 358924 - DNA, 25 bp, Homo sapien
ctctgacactattcactattcttcc

SEQ ID NO: 358925 - DNA, 25 bp, Homo sapien
acatcccgttcttcggtttgccatg

SEQ ID NO: 358926 - DNA, 25 bp, Homo sapien
gttcttcggtttgccatgagacgat

SEQ ID NO: 358927 - DNA, 25 bp, Homo sapien
ttcggtttgccatgagacgatgtgg

SEQ ID NO: 358928 - DNA, 25 bp, Homo sapien
actgtgtgtctgtcatcacctcttt

SEQ ID NO: 358929 - DNA, 25 bp, Homo sapien
ctgtcatcacctctttgtctttttt

SEQ ID NO: 358930 - DNA, 25 bp, Homo sapien
tttttcctaaccctgatctcatact

SEQ ID NO: 358931 - DNA, 25 bp, Homo sapien
aaccctgatctcatacttgtataga

SEQ ID NO: 358932 - DNA, 25 bp, Homo sapien
taacaacagttgtacttccaccaaa

SEQ ID NO: 358933 - DNA, 25 bp, Homo sapien
cagttgtacttccaccaaaggcatg

SEQ ID NO: 358934 - DNA, 25 bp, Homo sapien
accaaaggcatgtggcatatttacc

SEQ ID NO: 358935 - DNA, 25 bp, Homo sapien
gtggcatatttaccaatgtcatgta

SEQ ID NO: 358936 - DNA, 25 bp, Homo sapien
agaaatcaaagtctgccagcagcag

SEQ ID NO: 358937 - DNA, 25 bp, Homo sapien
agcagcagcctaaactatatctatg

SEQ ID NO: 358938 - DNA, 25 bp, Homo sapien
aatctcaccgagattgtcaagcaaa

SEQ ID NO: 358939 - DNA, 25 bp, Homo sapien
atatgctgttctacctactgtggga

SEQ ID NO: 358940 - DNA, 25 bp, Homo sapien
acctactgtgggaatgtttgcatga

SEQ ID NO: 358941 - DNA, 25 bp, Homo sapien
gtttgcatgagcatcctgtgagtgg

SEQ ID NO: 358942 - DNA, 25 bp, Homo sapien
ggacctcaagtcaccagcataagaa

SEQ ID NO: 358943 - DNA, 25 bp, Homo sapien
gtcaccagcataagaacatcaacag

SEQ ID NO: 358944 - DNA, 25 bp, Homo sapien
aatgccgccctctctactgtctgaa

SEQ ID NO: 358945 - DNA, 25 bp, Homo sapien
atgcagaaaacacagctatccccag

SEQ ID NO: 358946 - DNA, 25 bp, Homo sapien
aaacacagctatccccagaaatcaa

SEQ ID NO: 358947 - DNA, 25 bp, Homo sapien
gaacataccgtttaatcagtggtgt

SEQ ID NO: 358948 - DNA, 25 bp, Homo sapien
aaaatggacctgtacagtcagcaat

SEQ ID NO: 358949 - DNA, 25 bp, Homo sapien
gtacagtcagcaatagctaggccaa

SEQ ID NO: 358950 - DNA, 25 bp, Homo sapien
tggccttcgtggagtgttttttgga

SEQ ID NO: 358951 - DNA, 25 bp, Homo sapien
ggccaaaatcgattggctattttta

SEQ ID NO: 358952 - DNA, 25 bp, Homo sapien
tagaaaattgctcttttaatctagg

SEQ ID NO: 358953 - DNA, 25 bp, Homo sapien
aaatcaaatcgtgcctgcttgcttt

SEQ ID NO: 358954 - DNA, 25 bp, Homo sapien
ttccacctgtagctaagtgtaggca

SEQ ID NO: 358955 - DNA, 25 bp, Homo sapien
agtgttttttggagctctcgcctgt

SEQ ID NO: 358956 - DNA, 25 bp, Homo sapien
gtgtaggcaagagcattctgattga

SEQ ID NO: 358957 - DNA, 25 bp, Homo sapien
tgccttcagccatgaacataccgtt

SEQ ID NO: 358958 - DNA, 25 bp, Homo sapien
gtttatcttcgtttgaccgaattgg

SEQ ID NO: 358959 - DNA, 25 bp, Homo sapien
gaccgaattggtttcaccgaaatat

SEQ ID NO: 358960 - DNA, 25 bp, Homo sapien
tgcagggtggctaccttcatttggc

SEQ ID NO: 358961 - DNA, 25 bp, Homo sapien
gccccagggtcgtatttatgtttat

SEQ ID NO: 358962 - DNA, 25 bp, Homo sapien
tatgtttatcctcgtttaaccaagt

SEQ ID NO: 358963 - DNA, 25 bp, Homo sapien
taaccaagttgatttcaccgaaatg

SEQ ID NO: 358964 - DNA, 25 bp, Homo sapien
aatgatgcctggatgatgccggagt

SEQ ID NO: 358965 - DNA, 25 bp, Homo sapien
gggctagcttcaatttggccctgac

SEQ ID NO: 358966 - DNA, 25 bp, Homo sapien
agggtcgtatctatgtttgtcttca

SEQ ID NO: 358967 - DNA, 25 bp, Homo sapien
ttgtcttcatttgaccgagttcctg

SEQ ID NO: 358968 - DNA, 25 bp, Homo sapien
accgagttcctgttatcgaaatctg

SEQ ID NO: 358969 - DNA, 25 bp, Homo sapien
gtgcagggctgtcttacgacactta

SEQ ID NO: 358970 - DNA, 25 bp, Homo sapien
acagcagtgggcatctgccttgtgg

SEQ ID NO: 358971 - DNA, 25 bp, Homo sapien
tgggactgcttccttgacgccttag

SEQ ID NO: 358972 - DNA, 25 bp, Homo sapien
ggagccccgttatgaggtgagccaa

SEQ ID NO: 358973 - DNA, 25 bp, Homo sapien
gtgagccaaggctgactctcgcaag

SEQ ID NO: 358974 - DNA, 25 bp, Homo sapien
aggactgagcttccctcggaaagac

SEQ ID NO: 358975 - DNA, 25 bp, Homo sapien
cggaaagacctttgagtggcaccat

SEQ ID NO: 358976 - DNA, 25 bp, Homo sapien
tggcaccattcacctaagttagctt

SEQ ID NO: 358977 - DNA, 25 bp, Homo sapien
acctaagttagcttttctggtcgct

SEQ ID NO: 358978 - DNA, 25 bp, Homo sapien
tctggtcgctattgtttttatcccc

SEQ ID NO: 358979 - DNA, 25 bp, Homo sapien
ccctttgctttgttgtttctgtgaa

SEQ ID NO: 358980 - DNA, 25 bp, Homo sapien
ttcttcaaattcttcctgaggcgga

SEQ ID NO: 358981 - DNA, 25 bp, Homo sapien
gtcaggatgattataccagccggtt

SEQ ID NO: 358982 - DNA, 25 bp, Homo sapien
ttataccagccggttctctgtgtcg

SEQ ID NO: 358983 - DNA, 25 bp, Homo sapien
aacgagttggctcctgatggccttg

SEQ ID NO: 358984 - DNA, 25 bp, Homo sapien
tggccttggactggtcccaattaag

SEQ ID NO: 358985 - DNA, 25 bp, Homo sapien
ggtcccaattaagtcttcagaagtt

SEQ ID NO: 358986 - DNA, 25 bp, Homo sapien
agagttattccttcttcaatctgca

SEQ ID NO: 358987 - DNA, 25 bp, Homo sapien
aatctgcaggttcctcaactgtaca

SEQ ID NO: 358988 - DNA, 25 bp, Homo sapien
gagatatcagccattctctgtccac

SEQ ID NO: 358989 - DNA, 25 bp, Homo sapien
tctctgtccacaagtcttcaacaag

SEQ ID NO: 358990 - DNA, 25 bp, Homo sapien
aagttacagacctcaaaagcttgcc

SEQ ID NO: 358991 - DNA, 25 bp, Homo sapien
tcataattaaacaacccatattggg

SEQ ID NO: 358992 - DNA, 25 bp, Homo sapien
cccctgtgactagtagcagctggaa

SEQ ID NO: 358993 - DNA, 25 bp, Homo sapien
ctgtgactagtagcagctggaaaat

SEQ ID NO: 358994 - DNA, 25 bp, Homo sapien
tggcgtggaaccaaaccatgagaaa

SEQ ID NO: 358995 - DNA, 25 bp, Homo sapien
gtggaaccaaaccatgagaaaactc

SEQ ID NO: 358996 - DNA, 25 bp, Homo sapien
gccatcctggagttgatattcacca

SEQ ID NO: 358997 - DNA, 25 bp, Homo sapien
catcctggagttgatattcaccatt

SEQ ID NO: 358998 - DNA, 25 bp, Homo sapien
cctggagttgatattcaccatttgt

SEQ ID NO: 358999 - DNA, 25 bp, Homo sapien
tggagttgatattcaccatttgtga

SEQ ID NO: 359000 - DNA, 25 bp, Homo sapien
agttgatattcaccatttgtgagga

SEQ ID NO: 359001 - DNA, 25 bp, Homo sapien
gatttgtgagcggataccattttca

SEQ ID NO: 359002 - DNA, 25 bp, Homo sapien
tgggatgtatatatatcattgctgt

SEQ ID NO: 359003 - DNA, 25 bp, Homo sapien
gggatgtatatatatcattgctgtt

SEQ ID NO: 359004 - DNA, 25 bp, Homo sapien
ggatgtatatatatcattgctgtta

SEQ ID NO: 359005 - DNA, 25 bp, Homo sapien
tgtatatatatcattgctgttagag

SEQ ID NO: 359006 - DNA, 25 bp, Homo sapien
gtatatatatcattgctgttagaga

SEQ ID NO: 359007 - DNA, 25 bp, Homo sapien
tatatatatcattgctgttagagaa

SEQ ID NO: 359008 - DNA, 25 bp, Homo sapien
tatatatcattgctgttagagaaat

SEQ ID NO: 359009 - DNA, 25 bp, Homo sapien
atatatcattgctgttagagaaatg

SEQ ID NO: 359010 - DNA, 25 bp, Homo sapien
tatatcattgctgttagagaaatga

SEQ ID NO: 359011 - DNA, 25 bp, Homo sapien
atatcattgctgttagagaaatgaa

SEQ ID NO: 359012 - DNA, 25 bp, Homo sapien
tatcattgctgttagagaaatgaaa

SEQ ID NO: 359013 - DNA, 25 bp, Homo sapien
atcagtttctgaaccaacatcaggg

SEQ ID NO: 359014 - DNA, 25 bp, Homo sapien
atcatttctctatgcaagactggca

SEQ ID NO: 359015 - DNA, 25 bp, Homo sapien
gactggcatcctgggactgcacgat

SEQ ID NO: 359016 - DNA, 25 bp, Homo sapien
ggactgcacgatgaactattggagc

SEQ ID NO: 359017 - DNA, 25 bp, Homo sapien
gcatacagtactgcggtgtgtctcc

SEQ ID NO: 359018 - DNA, 25 bp, Homo sapien
gagggtatactcacccgatcattga

SEQ ID NO: 359019 - DNA, 25 bp, Homo sapien
tcacccgatcattgatttgcatccc

SEQ ID NO: 359020 - DNA, 25 bp, Homo sapien
atccccatggcatttgcttcattta

SEQ ID NO: 359021 - DNA, 25 bp, Homo sapien
attgcttttgcccatgcattcaata

SEQ ID NO: 359022 - DNA, 25 bp, Homo sapien
tattgatcagctcagcacttccatg

SEQ ID NO: 359023 - DNA, 25 bp, Homo sapien
acttccatgggccatagccggtatg

SEQ ID NO: 359024 - DNA, 25 bp, Homo sapien
ttgtcccttataaataggctttatt

SEQ ID NO: 359025 - DNA, 25 bp, Homo sapien
gccttaactgtctaagattttactt

SEQ ID NO: 359026 - DNA, 25 bp, Homo sapien
ttaaagaagcattatagggaacagc

SEQ ID NO: 359027 - DNA, 25 bp, Homo sapien
ttttttcatgcacttatggtaaata

SEQ ID NO: 359028 - DNA, 25 bp, Homo sapien
tcatgacaactgaatttgggaaagg

SEQ ID NO: 359029 - DNA, 25 bp, Homo sapien
gacaactgaatttgggaaaggtaat

SEQ ID NO: 359030 - DNA, 25 bp, Homo sapien
ttttttctaatcagtgtgaagtgac

SEQ ID NO: 359031 - DNA, 25 bp, Homo sapien
ttctaatcagtgtgaagtgacacag

SEQ ID NO: 359032 - DNA, 25 bp, Homo sapien
aatcagtgtgaagtgacacaggaaa

SEQ ID NO: 359033 - DNA, 25 bp, Homo sapien
gacacaggaaagtaaaattgtccct

SEQ ID NO: 359034 - DNA, 25 bp, Homo sapien
taaaattgtcccttataaataggct

SEQ ID NO: 359035 - DNA, 25 bp, Homo sapien
ctcttataactaggtttagggacat

SEQ ID NO: 359036 - DNA, 25 bp, Homo sapien
tgagtgatgtagaatctccttctgg

SEQ ID NO: 359037 - DNA, 25 bp, Homo sapien
gaatctccttctggtaaaaaggtca

SEQ ID NO: 359038 - DNA, 25 bp, Homo sapien
gattgcaacactcacacatattttt

SEQ ID NO: 359039 - DNA, 25 bp, Homo sapien
catattttttaacacccttgtgttg

SEQ ID NO: 359040 - DNA, 25 bp, Homo sapien
gagggtgtcacaaagcacctagcac

SEQ ID NO: 359041 - DNA, 25 bp, Homo sapien
aagcacctagcacacagaataaatt

SEQ ID NO: 359042 - DNA, 25 bp, Homo sapien
tgagtattgtatgcacacccagctg

SEQ ID NO: 359043 - DNA, 25 bp, Homo sapien
cccagctgacagcaaggaatttcac

SEQ ID NO: 359044 - DNA, 25 bp, Homo sapien
ggaatttcaccatcacaggtggatg

SEQ ID NO: 359045 - DNA, 25 bp, Homo sapien
ggtattctaaatctaatccccagaa

SEQ ID NO: 359046 - DNA, 25 bp, Homo sapien
tggccagaaggctgcggacacaact

SEQ ID NO: 359047 - DNA, 25 bp, Homo sapien
cagaaggctgcggacacaactgacc

SEQ ID NO: 359048 - DNA, 25 bp, Homo sapien
tgtaaacgccaagactgaatgtgag

SEQ ID NO: 359049 - DNA, 25 bp, Homo sapien
cgccaagactgaatgtgagaggtgt

SEQ ID NO: 359050 - DNA, 25 bp, Homo sapien
gccttaagtctgagcagatccatct

SEQ ID NO: 359051 - DNA, 25 bp, Homo sapien
aagtctgagcagatccatctggaat

SEQ ID NO: 359052 - DNA, 25 bp, Homo sapien
ctgagcagatccatctggaatgttc

SEQ ID NO: 359053 - DNA, 25 bp, Homo sapien
gtctggatgtggtgcgctaaaaaca

SEQ ID NO: 359054 - DNA, 25 bp, Homo sapien
gatgtggtgcgctaaaaacacggaa

SEQ ID NO: 359055 - DNA, 25 bp, Homo sapien
tgtggtgcgctaaaaacacggaata

SEQ ID NO: 359056 - DNA, 25 bp, Homo sapien
aaaacacggaataaagatcagtgac

SEQ ID NO: 359057 - DNA, 25 bp, Homo sapien
gaggacattatccacgctagtctct

SEQ ID NO: 359058 - DNA, 25 bp, Homo sapien
acagatcgtttctttgctcaaggga

SEQ ID NO: 359059 - DNA, 25 bp, Homo sapien
gctagtctctttcatctgggccgag

SEQ ID NO: 359060 - DNA, 25 bp, Homo sapien
tcatctgggccgaggtgggtaattt

SEQ ID NO: 359061 - DNA, 25 bp, Homo sapien
gtgggtaattttccttagagtcaag

SEQ ID NO: 359062 - DNA, 25 bp, Homo sapien
taagagctggtacattgccctcttg

SEQ ID NO: 359063 - DNA, 25 bp, Homo sapien
attgccctcttgtgaatgagagcca

SEQ ID NO: 359064 - DNA, 25 bp, Homo sapien
gagagccatgtatgtgaccacaaca

SEQ ID NO: 359065 - DNA, 25 bp, Homo sapien
acaccctttcagttgaccactaaga

SEQ ID NO: 359066 - DNA, 25 bp, Homo sapien
ctcaagggagtgtggatttcagtgc

SEQ ID NO: 359067 - DNA, 25 bp, Homo sapien
agggtgaccaccttggatcttcctg

SEQ ID NO: 359068 - DNA, 25 bp, Homo sapien
tacagttatgggtccagaggcattt

SEQ ID NO: 359069 - DNA, 25 bp, Homo sapien
gacatggttcagagacagattcttg

SEQ ID NO: 359070 - DNA, 25 bp, Homo sapien
gattcttgatctgttggctgttaac

SEQ ID NO: 359071 - DNA, 25 bp, Homo sapien
ggctgttaacactgtactaaccttc

SEQ ID NO: 359072 - DNA, 25 bp, Homo sapien
actaaccttcatgtcttgttcagcc

SEQ ID NO: 359073 - DNA, 25 bp, Homo sapien
ttgttcagccttcaacgcagcctgg

SEQ ID NO: 359074 - DNA, 25 bp, Homo sapien
agcctgggcctgattacctctgact

SEQ ID NO: 359075 - DNA, 25 bp, Homo sapien
ctctgactccagatagtgatccaca

SEQ ID NO: 359076 - DNA, 25 bp, Homo sapien
gatagtgatccacaaggacccctgg

SEQ ID NO: 359077 - DNA, 25 bp, Homo sapien
cccctggctacatgtggcaaacgag

SEQ ID NO: 359078 - DNA, 25 bp, Homo sapien
aagtagttagcttggttaagtctgc

SEQ ID NO: 359079 - DNA, 25 bp, Homo sapien
ttaaggagactggactgaatgaaca

SEQ ID NO: 359080 - DNA, 25 bp, Homo sapien
gaatgaacagcgactctaagagcct

SEQ ID NO: 359081 - DNA, 25 bp, Homo sapien
ctctaagagccttgaaagtctggta

SEQ ID NO: 359082 - DNA, 25 bp, Homo sapien
aagggacatttccagtctttgatag

SEQ ID NO: 359083 - DNA, 25 bp, Homo sapien
cagtctttgatagtaatcctttcta

SEQ ID NO: 359084 - DNA, 25 bp, Homo sapien
gagtaaggttaattttgctcaactt

SEQ ID NO: 359085 - DNA, 25 bp, Homo sapien
attttgctcaactttggaagggatt

SEQ ID NO: 359086 - DNA, 25 bp, Homo sapien
gaaattcaggatctggtctcaggca

SEQ ID NO: 359087 - DNA, 25 bp, Homo sapien
tctggtctcaggcatcacatgatta

SEQ ID NO: 359088 - DNA, 25 bp, Homo sapien
gcatcacatgattacaggaacttaa

SEQ ID NO: 359089 - DNA, 25 bp, Homo sapien
acttaagaaatagacctggatggtt

SEQ ID NO: 359090 - DNA, 25 bp, Homo sapien
gatggtagcctcatagaagtattgt

SEQ ID NO: 359091 - DNA, 25 bp, Homo sapien
gaagtattgtgaagtgcatagcatc

SEQ ID NO: 359092 - DNA, 25 bp, Homo sapien
agatgtcagtatacttaaccccaga

SEQ ID NO: 359093 - DNA, 25 bp, Homo sapien
ttaaccccagacaaacacatgcaat

SEQ ID NO: 359094 - DNA, 25 bp, Homo sapien
catgcaatagcccttaaacttttag

SEQ ID NO: 359095 - DNA, 25 bp, Homo sapien
aaacttttagattgggcacttgtca

SEQ ID NO: 359096 - DNA, 25 bp, Homo sapien
tagattgggcacttgtcagtttcct

SEQ ID NO: 359097 - DNA, 25 bp, Homo sapien
cctctttctgcagtataacctggag

SEQ ID NO: 359098 - DNA, 25 bp, Homo sapien
taacctggagtaaatttctctactt

SEQ ID NO: 359099 - DNA, 25 bp, Homo sapien
tttctctacttctttgagactcgat

SEQ ID NO: 359100 - DNA, 25 bp, Homo sapien
ttgagactcgatattctcatatgta

SEQ ID NO: 359101 - DNA, 25 bp, Homo sapien
gaacatcttgggaactatccgcttt

SEQ ID NO: 359102 - DNA, 25 bp, Homo sapien
ggaactatccgcttttggaacttat

SEQ ID NO: 359103 - DNA, 25 bp, Homo sapien
atccgcttttggaacttatcccatg

SEQ ID NO: 359104 - DNA, 25 bp, Homo sapien
ggaacttatcccatgctggaacatt

SEQ ID NO: 359105 - DNA, 25 bp, Homo sapien
tatcccatgctggaacattgccctg

SEQ ID NO: 359106 - DNA, 25 bp, Homo sapien
gacagacatccatgaagaagcctgg

SEQ ID NO: 359107 - DNA, 25 bp, Homo sapien
acatgatgtggtgctggtagtcaac

SEQ ID NO: 359108 - DNA, 25 bp, Homo sapien
ggtagtcaacgcaagctggcacggc

SEQ ID NO: 359109 - DNA, 25 bp, Homo sapien
tggcacggcctcagccagaagactg

SEQ ID NO: 359110 - DNA, 25 bp, Homo sapien
gaagactggagctaggagcaagcaa

SEQ ID NO: 359111 - DNA, 25 bp, Homo sapien
gagcaagcaaagcaccaagtaaatg

SEQ ID NO: 359112 - DNA, 25 bp, Homo sapien
aaataactcaaatttcttccatgaa

SEQ ID NO: 359113 - DNA, 25 bp, Homo sapien
atgctacttcaagcctggaaacttt

SEQ ID NO: 359114 - DNA, 25 bp, Homo sapien
gaacattaagcatataaatggccca

SEQ ID NO: 359115 - DNA, 25 bp, Homo sapien
taaatggcccagctctagaatacat

SEQ ID NO: 359116 - DNA, 25 bp, Homo sapien
ggcccagctctagaatacatgtaag

SEQ ID NO: 359117 - DNA, 25 bp, Homo sapien
gtaagttgaaaagctaacctgaagt

SEQ ID NO: 359118 - DNA, 25 bp, Homo sapien
gctaacctgaagtgggaagcgcagt

SEQ ID NO: 359119 - DNA, 25 bp, Homo sapien
ggaagcgcagtatatacctaagact

SEQ ID NO: 359120 - DNA, 25 bp, Homo sapien
tacctaagacttactctgcactgaa

SEQ ID NO: 359121 - DNA, 25 bp, Homo sapien
gacttactctgcactgaaagtttgc

SEQ ID NO: 359122 - DNA, 25 bp, Homo sapien
gcactgaaagtttgctttgtcacta

SEQ ID NO: 359123 - DNA, 25 bp, Homo sapien
gggatggtcctaacagggtcagtca

SEQ ID NO: 359124 - DNA, 25 bp, Homo sapien
atggtcctaacagggtcagtcacct

SEQ ID NO: 359125 - DNA, 25 bp, Homo sapien
taacagggtcagtcacctccgagca

SEQ ID NO: 359126 - DNA, 25 bp, Homo sapien
gggtcagtcacctccgagcagtttg

SEQ ID NO: 359127 - DNA, 25 bp, Homo sapien
gcagtttgggaacccagtttcttgt

SEQ ID NO: 359128 - DNA, 25 bp, Homo sapien
gtttcttgtcctgggccctcaggtc

SEQ ID NO: 359129 - DNA, 25 bp, Homo sapien
tcagcctggctgaattaggaccctt

SEQ ID NO: 359130 - DNA, 25 bp, Homo sapien
tggctgaattaggacccttccttgg

SEQ ID NO: 359131 - DNA, 25 bp, Homo sapien
ggaacgcttggcattatggagggct

SEQ ID NO: 359132 - DNA, 25 bp, Homo sapien
aaaagaggtcttggagcctgggact

SEQ ID NO: 359133 - DNA, 25 bp, Homo sapien
gagcctgggactgatggtggataag

SEQ ID NO: 359134 - DNA, 25 bp, Homo sapien
aaaacatcaacacttgtggagccaa

SEQ ID NO: 359135 - DNA, 25 bp, Homo sapien
cttgtggagccaagtaacaccagct

SEQ ID NO: 359136 - DNA, 25 bp, Homo sapien
cagctggccttgtccaagggacaga

SEQ ID NO: 359137 - DNA, 25 bp, Homo sapien
ggacagagccttctattctgagaat

SEQ ID NO: 359138 - DNA, 25 bp, Homo sapien
cagaccctgcctgatgctatatgca

SEQ ID NO: 359139 - DNA, 25 bp, Homo sapien
ctgatgctatatgcagaggcccagg

SEQ ID NO: 359140 - DNA, 25 bp, Homo sapien
agaaccaagacaggcatccctgggt

SEQ ID NO: 359141 - DNA, 25 bp, Homo sapien
agctgacccagcagaattctctgtg

SEQ ID NO: 359142 - DNA, 25 bp, Homo sapien
attctctgtgtaggaagcatcggac

SEQ ID NO: 359143 - DNA, 25 bp, Homo sapien
gaagcatcggactttgtccattgaa

SEQ ID NO: 359144 - DNA, 25 bp, Homo sapien
ccattgaatatgtagcggctgccag

SEQ ID NO: 359145 - DNA, 25 bp, Homo sapien
tgatgcatgcgtgtaatcctaacta

SEQ ID NO: 359146 - DNA, 25 bp, Homo sapien
gatgcatgcgtgtaatcctaactac

SEQ ID NO: 359147 - DNA, 25 bp, Homo sapien
atgcatgcgtgtaatcctaactact

SEQ ID NO: 359148 - DNA, 25 bp, Homo sapien
tgcatgcgtgtaatcctaactactc

SEQ ID NO: 359149 - DNA, 25 bp, Homo sapien
gcatgcgtgtaatcctaactactcg

SEQ ID NO: 359150 - DNA, 25 bp, Homo sapien
catgcgtgtaatcctaactactcgg

SEQ ID NO: 359151 - DNA, 25 bp, Homo sapien
atgcgtgtaatcctaactactcggg

SEQ ID NO: 359152 - DNA, 25 bp, Homo sapien
tgacaggagccaaactccgtctcaa

SEQ ID NO: 359153 - DNA, 25 bp, Homo sapien
gacaggagccaaactccgtctcaaa

SEQ ID NO: 359154 - DNA, 25 bp, Homo sapien
aggcgtggtggtagccgcctgttgt

SEQ ID NO: 359155 - DNA, 25 bp, Homo sapien
tggtagccgcctgttgtcccagctg

SEQ ID NO: 359156 - DNA, 25 bp, Homo sapien
ggctgagacagcaggcccacggatg

SEQ ID NO: 359157 - DNA, 25 bp, Homo sapien
catcaggtgagacccatgtctgtag

SEQ ID NO: 359158 - DNA, 25 bp, Homo sapien
agacccatgtctgtagccactgagg

SEQ ID NO: 359159 - DNA, 25 bp, Homo sapien
tttcaagtcttttagcaaatccatg

SEQ ID NO: 359160 - DNA, 25 bp, Homo sapien
aattggtgtttttgtggagatatga

SEQ ID NO: 359161 - DNA, 25 bp, Homo sapien
atgtctgtagccactgaggttcctg

SEQ ID NO: 359162 - DNA, 25 bp, Homo sapien
tcagtaaaagagtcaccgaatcata

SEQ ID NO: 359163 - DNA, 25 bp, Homo sapien
gccactgaggttcctgttgcaacag

SEQ ID NO: 359164 - DNA, 25 bp, Homo sapien
aacaggtgagatgtgatcttcccaa

SEQ ID NO: 359165 - DNA, 25 bp, Homo sapien
agatgtgatcttcccaaagccccag

SEQ ID NO: 359166 - DNA, 25 bp, Homo sapien
aaagccccagcttcttccgcaggag

SEQ ID NO: 359167 - DNA, 25 bp, Homo sapien
tggccagaaggctgcggacacaact

SEQ ID NO: 359168 - DNA, 25 bp, Homo sapien
cagaaggctgcggacacaactgacc

SEQ ID NO: 359169 - DNA, 25 bp, Homo sapien
acaactgacctgcttctcgaggtgg

SEQ ID NO: 359170 - DNA, 25 bp, Homo sapien
agctccacggagttcagccctgtgt

SEQ ID NO: 359171 - DNA, 25 bp, Homo sapien
tgtaaacgccaagactgaatgtgag

SEQ ID NO: 359172 - DNA, 25 bp, Homo sapien
cgccaagactgaatgtgagaggtgt

SEQ ID NO: 359173 - DNA, 25 bp, Homo sapien
gccttaagtctgagcagatccatct

SEQ ID NO: 359174 - DNA, 25 bp, Homo sapien
aagtctgagcagatccatctggaat

SEQ ID NO: 359175 - DNA, 25 bp, Homo sapien
ctgagcagatccatctggaatgttc

SEQ ID NO: 359176 - DNA, 25 bp, Homo sapien
gtctggatgtggtgcgctaaaaaca

SEQ ID NO: 359177 - DNA, 25 bp, Homo sapien
tgtggtgcgctaaaaacacggaata

SEQ ID NO: 359178 - DNA, 25 bp, Homo sapien
ctgcttccgaggagccggagtcagt

SEQ ID NO: 359179 - DNA, 25 bp, Homo sapien
agtcagtggccggataagcagagcc

SEQ ID NO: 359180 - DNA, 25 bp, Homo sapien
cggataagcagagccactcgggagt

SEQ ID NO: 359181 - DNA, 25 bp, Homo sapien
ataagcagagccactcgggagtggt

SEQ ID NO: 359182 - DNA, 25 bp, Homo sapien
cagaggagctctggcccgcagggtg

SEQ ID NO: 359183 - DNA, 25 bp, Homo sapien
ggtgtcgggcgaggcaaagtgcaaa

SEQ ID NO: 359184 - DNA, 25 bp, Homo sapien
caaagcattggtgcgcggggcctca

SEQ ID NO: 359185 - DNA, 25 bp, Homo sapien
acggcggagccgcaggccagggacc

SEQ ID NO: 359186 - DNA, 25 bp, Homo sapien
ggccagggacctgcagtgactcgct

SEQ ID NO: 359187 - DNA, 25 bp, Homo sapien
tcctccctgtgtttggccttagtgt

SEQ ID NO: 359188 - DNA, 25 bp, Homo sapien
gtgtttggccttagtgtccacagga

SEQ ID NO: 359189 - DNA, 25 bp, Homo sapien
atgagtgggcttttttgtgctgacc

SEQ ID NO: 359190 - DNA, 25 bp, Homo sapien
ttttgtgctgaccatttctttgaag

SEQ ID NO: 359191 - DNA, 25 bp, Homo sapien
aaaaatgggatccttcaccgctcag

SEQ ID NO: 359192 - DNA, 25 bp, Homo sapien
tcaccgctcagttttggctgagcaa

SEQ ID NO: 359193 - DNA, 25 bp, Homo sapien
gcaacaagtgccagttactcctata

SEQ ID NO: 359194 - DNA, 25 bp, Homo sapien
aaggttcaagaccaccaaagcaggt

SEQ ID NO: 359195 - DNA, 25 bp, Homo sapien
aaagcaggtcttgcaaagcaactgt

SEQ ID NO: 359196 - DNA, 25 bp, Homo sapien
gaaaccagtgtatgactttcagtct

SEQ ID NO: 359197 - DNA, 25 bp, Homo sapien
aaaacagctcttcattctctaggga

SEQ ID NO: 359198 - DNA, 25 bp, Homo sapien
gaatgtgcaggagctataccatgct

SEQ ID NO: 359199 - DNA, 25 bp, Homo sapien
ataccatgcttactgactgtcttat

SEQ ID NO: 359200 - DNA, 25 bp, Homo sapien
acagtgagcaagtgagcaggacctt

SEQ ID NO: 359201 - DNA, 25 bp, Homo sapien
agggactggggcacactgaagaaaa

SEQ ID NO: 359202 - DNA, 25 bp, Homo sapien
aaggtgtatgaagggagctgcgagc

SEQ ID NO: 359203 - DNA, 25 bp, Homo sapien
gagctgcgagctgaggtctgacttt

SEQ ID NO: 359204 - DNA, 25 bp, Homo sapien
gctgcgagctgaggtctgactttga

SEQ ID NO: 359205 - DNA, 25 bp, Homo sapien
tgcgagctgaggtctgactttgatt

SEQ ID NO: 359206 - DNA, 25 bp, Homo sapien
gccacagtaaccaaggcggtcatta

SEQ ID NO: 359207 - DNA, 25 bp, Homo sapien
aaccaaggcggtcattaagaggaga

SEQ ID NO: 359208 - DNA, 25 bp, Homo sapien
caaggcggtcattaagaggagaaac

SEQ ID NO: 359209 - DNA, 25 bp, Homo sapien
aacagcaaactaagcctttctccaa

SEQ ID NO: 359210 - DNA, 25 bp, Homo sapien
caaactaagcctttctccaacctgg

SEQ ID NO: 359211 - DNA, 25 bp, Homo sapien
tagtttgtcttgctagactgtaagc

SEQ ID NO: 359212 - DNA, 25 bp, Homo sapien
accgtgtctgcttgttgagtgggct

SEQ ID NO: 359213 - DNA, 25 bp, Homo sapien
gtctgcttgttgagtgggctttccc

SEQ ID NO: 359214 - DNA, 25 bp, Homo sapien
ctgcttgttgagtgggctttcccct

SEQ ID NO: 359215 - DNA, 25 bp, Homo sapien
atgcctggcatctagcaggtcttct

SEQ ID NO: 359216 - DNA, 25 bp, Homo sapien
cctggcatctagcaggtcttctgta

SEQ ID NO: 359217 - DNA, 25 bp, Homo sapien
tcttctgtaaagatgggatgagttt

SEQ ID NO: 359218 - DNA, 25 bp, Homo sapien
gatgggatgagtttgtaaaccctcc

SEQ ID NO: 359219 - DNA, 25 bp, Homo sapien
gatgagtttgtaaaccctccagcct

SEQ ID NO: 359220 - DNA, 25 bp, Homo sapien
gtttgtaaaccctccagcctcagga

SEQ ID NO: 359221 - DNA, 25 bp, Homo sapien
ctccagcctcaggagtggctccatc

SEQ ID NO: 359222 - DNA, 25 bp, Homo sapien
gtttggtgtttactacatgactttc

SEQ ID NO: 359223 - DNA, 25 bp, Homo sapien
actacatgactttcactgtgctagg

SEQ ID NO: 359224 - DNA, 25 bp, Homo sapien
actttcactgtgctagggatacaaa

SEQ ID NO: 359225 - DNA, 25 bp, Homo sapien
ccaaagagttgttgaagctgagcag

SEQ ID NO: 359226 - DNA, 25 bp, Homo sapien
ttcctactggaattttgagcagtct

SEQ ID NO: 359227 - DNA, 25 bp, Homo sapien
agcagtcttagtatttcctcagtgt

SEQ ID NO: 359228 - DNA, 25 bp, Homo sapien
ttcctcagtgtgtttgttccaaacc

SEQ ID NO: 359229 - DNA, 25 bp, Homo sapien
gtttgttccaaaccagaagcattat

SEQ ID NO: 359230 - DNA, 25 bp, Homo sapien
agcattattgcttccttttatatag

SEQ ID NO: 359231 - DNA, 25 bp, Homo sapien
tctggctgggcctaggtatggaaga

SEQ ID NO: 359232 - DNA, 25 bp, Homo sapien
gttttagttggctttttttcatcat

SEQ ID NO: 359233 - DNA, 25 bp, Homo sapien
ttctcttccaaaaatcttctggctt

SEQ ID NO: 359234 - DNA, 25 bp, Homo sapien
aatcttctggcttctgaactcttcc

SEQ ID NO: 359235 - DNA, 25 bp, Homo sapien
gtggtaggagacttattaagccagt

SEQ ID NO: 359236 - DNA, 25 bp, Homo sapien
ttaagccagtcaccaagcttggtct

SEQ ID NO: 359237 - DNA, 25 bp, Homo sapien
aagcttggtctgtcagcctgtcttc

SEQ ID NO: 359238 - DNA, 25 bp, Homo sapien
gcctgtcttctaacacctcaaagat

SEQ ID NO: 359239 - DNA, 25 bp, Homo sapien
aacacctcaaagatcttgtgccctg

SEQ ID NO: 359240 - DNA, 25 bp, Homo sapien
caaagatcttgtgccctgtgctgtc

SEQ ID NO: 359241 - DNA, 25 bp, Homo sapien
ctgtccctcccttgtaattatgaaa

SEQ ID NO: 359242 - DNA, 25 bp, Homo sapien
tacccatgtataatgaggaattctc

SEQ ID NO: 359243 - DNA, 25 bp, Homo sapien
ggaattctctcataaccttttttgt

SEQ ID NO: 359244 - DNA, 25 bp, Homo sapien
gaagaaagaagcatacaagtacgat

SEQ ID NO: 359245 - DNA, 25 bp, Homo sapien
acgataagggaagatgagcttgctt

SEQ ID NO: 359246 - DNA, 25 bp, Homo sapien
tgagcttgctttgggaatgataatt

SEQ ID NO: 359247 - DNA, 25 bp, Homo sapien
gtgtaggtttggaagttatccacaa

SEQ ID NO: 359248 - DNA, 25 bp, Homo sapien
agagctgagggcagaatcttctcga

SEQ ID NO: 359249 - DNA, 25 bp, Homo sapien
ggcagaatcttctcgactatacctt

SEQ ID NO: 359250 - DNA, 25 bp, Homo sapien
aatcttctcgactatacctttatgg

SEQ ID NO: 359251 - DNA, 25 bp, Homo sapien
tctcgactatacctttatggcagct

SEQ ID NO: 359252 - DNA, 25 bp, Homo sapien
gcagcttgctttccataaacgtaga

SEQ ID NO: 359253 - DNA, 25 bp, Homo sapien
cttgctttccataaacgtagatcat

SEQ ID NO: 359254 - DNA, 25 bp, Homo sapien
gatcatggcagcataaaaaccagca

SEQ ID NO: 359255 - DNA, 25 bp, Homo sapien
gggagaaaatgtttatccattgaat

SEQ ID NO: 359256 - DNA, 25 bp, Homo sapien
gtttatccattgaatctcaacagga

SEQ ID NO: 359257 - DNA, 25 bp, Homo sapien
atccattgaatctcaacaggaggag

SEQ ID NO: 359258 - DNA, 25 bp, Homo sapien
atctcaacaggaggagtttcatatt

SEQ ID NO: 359259 - DNA, 25 bp, Homo sapien
caggaggagtttcatatttgttgct

SEQ ID NO: 359260 - DNA, 25 bp, Homo sapien
ggaggagtttcatatttgttgctaa

SEQ ID NO: 359261 - DNA, 25 bp, Homo sapien
ttcatatttgttgctaagaggaatt

SEQ ID NO: 359262 - DNA, 25 bp, Homo sapien
aatgaggacccttgatgagatctac

SEQ ID NO: 359263 - DNA, 25 bp, Homo sapien
gaggacccttgatgagatctacaaa

SEQ ID NO: 359264 - DNA, 25 bp, Homo sapien
gacccttgatgagatctacaaatag

SEQ ID NO: 359265 - DNA, 25 bp, Homo sapien
aatcaaggtccaaagaatgtaaatt

SEQ ID NO: 359266 - DNA, 25 bp, Homo sapien
atgcccggtccaaaatgtccagcga

SEQ ID NO: 359267 - DNA, 25 bp, Homo sapien
aaatgtccagcgactccatgctgag

SEQ ID NO: 359268 - DNA, 25 bp, Homo sapien
gagcagggcccaggctttaatttag

SEQ ID NO: 359269 - DNA, 25 bp, Homo sapien
taagtgtgttactgtgtcatttgac

SEQ ID NO: 359270 - DNA, 25 bp, Homo sapien
ggcttggatatgttcatctctggtt

SEQ ID NO: 359271 - DNA, 25 bp, Homo sapien
catctctggtttaagtggacatcat

SEQ ID NO: 359272 - DNA, 25 bp, Homo sapien
atatgtatctacaggagtccattaa

SEQ ID NO: 359273 - DNA, 25 bp, Homo sapien
agatgtgttctggagcggcatgcca

SEQ ID NO: 359274 - DNA, 25 bp, Homo sapien
gcatgccagccagtgcaagggagca

SEQ ID NO: 359275 - DNA, 25 bp, Homo sapien
tccattcgtgcgagaggcagctgca

SEQ ID NO: 359276 - DNA, 25 bp, Homo sapien
aggcagctgcaatggatgcccggtc

SEQ ID NO: 359277 - DNA, 25 bp, Homo sapien
aaggcagtacatactcaggtctcat

SEQ ID NO: 359278 - DNA, 25 bp, Homo sapien
gtacatactcaggtctcatagcttg

SEQ ID NO: 359279 - DNA, 25 bp, Homo sapien
actcaggtctcatagcttgtaaaac

SEQ ID NO: 359280 - DNA, 25 bp, Homo sapien
atgaaaagtcaccatcatcccagca

SEQ ID NO: 359281 - DNA, 25 bp, Homo sapien
agtcaccatcatcccagcaaaatgt

SEQ ID NO: 359282 - DNA, 25 bp, Homo sapien
agcaaaatgtaaggctcccctgctg

SEQ ID NO: 359283 - DNA, 25 bp, Homo sapien
ctgcccagattggaatgtgctcggg

SEQ ID NO: 359284 - DNA, 25 bp, Homo sapien
attggaatgtgctcgggagggccct

SEQ ID NO: 359285 - DNA, 25 bp, Homo sapien
ctcccagggcgtgtggatgcaactc

SEQ ID NO: 359286 - DNA, 25 bp, Homo sapien
ggatgcaactcctcagggtcacact

SEQ ID NO: 359287 - DNA, 25 bp, Homo sapien
ggaagggcagccaccaccgttgctg

SEQ ID NO: 359288 - DNA, 25 bp, Homo sapien
acccactggttgttattctgtaaca

SEQ ID NO: 359289 - DNA, 25 bp, Homo sapien
actggttgttattctgtaacagttt

SEQ ID NO: 359290 - DNA, 25 bp, Homo sapien
tgaatgtgttgttattttacctaga

SEQ ID NO: 359291 - DNA, 25 bp, Homo sapien
tgtgttgttattttacctagatgta

SEQ ID NO: 359292 - DNA, 25 bp, Homo sapien
tacctagatgtaaaattccacatgt

SEQ ID NO: 359293 - DNA, 25 bp, Homo sapien
gaatctgttttgtattgtgacaaat

SEQ ID NO: 359294 - DNA, 25 bp, Homo sapien
atctgttttgtattgtgacaaattc

SEQ ID NO: 359295 - DNA, 25 bp, Homo sapien
ctgttttgtattgtgacaaattcat

SEQ ID NO: 359296 - DNA, 25 bp, Homo sapien
gtgacaaattcataagataacattg

SEQ ID NO: 359297 - DNA, 25 bp, Homo sapien
aagataacattgatattttgatttg

SEQ ID NO: 359298 - DNA, 25 bp, Homo sapien
ttttaaagtcaaatcttttgtagat

SEQ ID NO: 359299 - DNA, 25 bp, Homo sapien
agacttgggatacctggcagctata

SEQ ID NO: 359300 - DNA, 25 bp, Homo sapien
ttcttccattcctcaggacttgcaa

SEQ ID NO: 359301 - DNA, 25 bp, Homo sapien
caaaaacgggtctcagcatgccttc

SEQ ID NO: 359302 - DNA, 25 bp, Homo sapien
agagccatgaggtgtttctttgccc

SEQ ID NO: 359303 - DNA, 25 bp, Homo sapien
aggtgtttctttgcccattcattga

SEQ ID NO: 359304 - DNA, 25 bp, Homo sapien
ggagtttaaatcaacctctgttctg

SEQ ID NO: 359305 - DNA, 25 bp, Homo sapien
ctctgttctgtgctagttaaggtaa

SEQ ID NO: 359306 - DNA, 25 bp, Homo sapien
aaggtaataaagttgctgcagtcca

SEQ ID NO: 359307 - DNA, 25 bp, Homo sapien
aggtacctgtggacggctctgcgaa

SEQ ID NO: 359308 - DNA, 25 bp, Homo sapien
ctgcgaataggacagttgcatttct

SEQ ID NO: 359309 - DNA, 25 bp, Homo sapien
gaatcaagtgcatccctaggctggc

SEQ ID NO: 359310 - DNA, 25 bp, Homo sapien
tttccttaagggtcagcccaacaat

SEQ ID NO: 359311 - DNA, 25 bp, Homo sapien
tcagcccaacaatgactttcagtca

SEQ ID NO: 359312 - DNA, 25 bp, Homo sapien
gttgtaaacagatcatcctaggcga

SEQ ID NO: 359313 - DNA, 25 bp, Homo sapien
aaatcttagtcttccacatttctag

SEQ ID NO: 359314 - DNA, 25 bp, Homo sapien
agtcttccacatttctagaggccac

SEQ ID NO: 359315 - DNA, 25 bp, Homo sapien
agaggccacctgacacaagtccctg

SEQ ID NO: 359316 - DNA, 25 bp, Homo sapien
aagtccctgtatctgaagtctagca

SEQ ID NO: 359317 - DNA, 25 bp, Homo sapien
gaagtctagcatctcaaggctgatc

SEQ ID NO: 359318 - DNA, 25 bp, Homo sapien
ctcaaggctgatctggaagtgtgct

SEQ ID NO: 359319 - DNA, 25 bp, Homo sapien
gaagtgtgctagtatgctccctagt

SEQ ID NO: 359320 - DNA, 25 bp, Homo sapien
gtatgctccctagtggataacttaa

SEQ ID NO: 359321 - DNA, 25 bp, Homo sapien
actggttgttattctgtaacagttt

SEQ ID NO: 359322 - DNA, 25 bp, Homo sapien
gaatctgttttgtattgtgacaaat

SEQ ID NO: 359323 - DNA, 25 bp, Homo sapien
aatctgttttgtattgtgacaaatt

SEQ ID NO: 359324 - DNA, 25 bp, Homo sapien
atctgttttgtattgtgacaaattc

SEQ ID NO: 359325 - DNA, 25 bp, Homo sapien
tctgttttgtattgtgacaaattca

SEQ ID NO: 359326 - DNA, 25 bp, Homo sapien
ctgttttgtattgtgacaaattcat

SEQ ID NO: 359327 - DNA, 25 bp, Homo sapien
tgtattgtgacaaattcataagata

SEQ ID NO: 359328 - DNA, 25 bp, Homo sapien
gtgacaaattcataagataacattg

SEQ ID NO: 359329 - DNA, 25 bp, Homo sapien
aagataacattgatattttgatttg

SEQ ID NO: 359330 - DNA, 25 bp, Homo sapien
gtaatatttctaattggtagattta

SEQ ID NO: 359331 - DNA, 25 bp, Homo sapien
ttttaaagtcaaatcttttgtagat

SEQ ID NO: 359332 - DNA, 25 bp, Homo sapien
ttgttttgtttcatcctgtccgtaa

SEQ ID NO: 359333 - DNA, 25 bp, Homo sapien
agcgctcttgctttgctcttttcaa

SEQ ID NO: 359334 - DNA, 25 bp, Homo sapien
ctcacctatgatatcttggatcaga

SEQ ID NO: 359335 - DNA, 25 bp, Homo sapien
gatcagaaccgtatatttgacccca

SEQ ID NO: 359336 - DNA, 25 bp, Homo sapien
tatatttgaccccaagtgcctggat

SEQ ID NO: 359337 - DNA, 25 bp, Homo sapien
agtgcctggatgagttcccaaacct

SEQ ID NO: 359338 - DNA, 25 bp, Homo sapien
tcccaaacctgaaggctttcatgtg

SEQ ID NO: 359339 - DNA, 25 bp, Homo sapien
ctttcatgtgccgttttgaggcttt

SEQ ID NO: 359340 - DNA, 25 bp, Homo sapien
gctttggagaaaatcgctgcctact

SEQ ID NO: 359341 - DNA, 25 bp, Homo sapien
gctgcctacttacagtctgatcagt

SEQ ID NO: 359342 - DNA, 25 bp, Homo sapien
atcaacaacaagatggcccagtggg

SEQ ID NO: 359343 - DNA, 25 bp, Homo sapien
ttccggtgaactttctgagcagact

SEQ ID NO: 359344 - DNA, 25 bp, Homo sapien
gactgagtaggaggcacaaggacta

SEQ ID NO: 359345 - DNA, 25 bp, Homo sapien
aagtatcctttcatggtagagagag

SEQ ID NO: 359346 - DNA, 25 bp, Homo sapien
ttatatcaagtcttccagcgtcagc

SEQ ID NO: 359347 - DNA, 25 bp, Homo sapien
aagtcttccagcgtcagcttttggg

SEQ ID NO: 359348 - DNA, 25 bp, Homo sapien
aatggcaggttttagttctttgtca

SEQ ID NO: 359349 - DNA, 25 bp, Homo sapien
agttctttgtcatgccaactcaggg

SEQ ID NO: 359350 - DNA, 25 bp, Homo sapien
atgttagcttggagcgtcgtagcca

SEQ ID NO: 359351 - DNA, 25 bp, Homo sapien
gcagctggccagtgaattccatagt

SEQ ID NO: 359352 - DNA, 25 bp, Homo sapien
ttagatgtctttggtgatggcactg

SEQ ID NO: 359353 - DNA, 25 bp, Homo sapien
atggcactgggtgttccggtgaact

SEQ ID NO: 359354 - DNA, 25 bp, Homo sapien
taacaagtgcccaggtgactcaggt

SEQ ID NO: 359355 - DNA, 25 bp, Homo sapien
gtgactcaggtaagcgaggaaacca

SEQ ID NO: 359356 - DNA, 25 bp, Homo sapien
gaaaccagatcgaggttctcttgcg

SEQ ID NO: 359357 - DNA, 25 bp, Homo sapien
aggttctcttgcgtgggacaggtta

SEQ ID NO: 359358 - DNA, 25 bp, Homo sapien
gtgggacaggttaaactctgaccaa

SEQ ID NO: 359359 - DNA, 25 bp, Homo sapien
tgaccaaaccacagctgagccggga

SEQ ID NO: 359360 - DNA, 25 bp, Homo sapien
acgccttcctgtctaaagtccaaag

SEQ ID NO: 359361 - DNA, 25 bp, Homo sapien
gtccaaagtccggacgtggttggca

SEQ ID NO: 359362 - DNA, 25 bp, Homo sapien
atttgggtaactggccgctaatgga

SEQ ID NO: 359363 - DNA, 25 bp, Homo sapien
ctggccgctaatggaactgaagaca

SEQ ID NO: 359364 - DNA, 25 bp, Homo sapien
aactgaagacagctgggcctaacaa

SEQ ID NO: 359365 - DNA, 25 bp, Homo sapien
ttggcttccttctcacatttcttta

SEQ ID NO: 359366 - DNA, 25 bp, Homo sapien
tccttctcacatttctttagctttg

SEQ ID NO: 359367 - DNA, 25 bp, Homo sapien
ttttttctcatctgggaatttgaaa

SEQ ID NO: 359368 - DNA, 25 bp, Homo sapien
gaatttgaaatctcggtgcttactg

SEQ ID NO: 359369 - DNA, 25 bp, Homo sapien
tgaaatctcggtgcttactgttaca

SEQ ID NO: 359370 - DNA, 25 bp, Homo sapien
atctcggtgcttactgttacaccaa

SEQ ID NO: 359371 - DNA, 25 bp, Homo sapien
gcttactgttacaccaatttgtcca

SEQ ID NO: 359372 - DNA, 25 bp, Homo sapien
gttacaccaatttgtccaaagagtt

SEQ ID NO: 359373 - DNA, 25 bp, Homo sapien
tataacatcgttaacgggtaccatt

SEQ ID NO: 359374 - DNA, 25 bp, Homo sapien
aacgggtaccattaaatattctgag

SEQ ID NO: 359375 - DNA, 25 bp, Homo sapien
gggtaccattaaatattctgagagg

SEQ ID NO: 359376 - DNA, 25 bp, Homo sapien
catagagcgtttggtgaagaaaagc

SEQ ID NO: 359377 - DNA, 25 bp, Homo sapien
gattggttcagaagactcttccgac

SEQ ID NO: 359378 - DNA, 25 bp, Homo sapien
gatctccatcaatgtggccaatctg

SEQ ID NO: 359379 - DNA, 25 bp, Homo sapien
gactcttccgacaaggaattactta

SEQ ID NO: 359380 - DNA, 25 bp, Homo sapien
ctccatcaatgtggccaatctgaaa

SEQ ID NO: 359381 - DNA, 25 bp, Homo sapien
atttcaaatagtgcaggcctctccc

SEQ ID NO: 359382 - DNA, 25 bp, Homo sapien
aggcctctcccgtgtaaggagctct

SEQ ID NO: 359383 - DNA, 25 bp, Homo sapien
tcttcccagccatgtcccagatgtt

SEQ ID NO: 359384 - DNA, 25 bp, Homo sapien
catgtcccagatgttcgctcgtggg

SEQ ID NO: 359385 - DNA, 25 bp, Homo sapien
gaaactttgaagagcattacataga

SEQ ID NO: 359386 - DNA, 25 bp, Homo sapien
gagcattacatagagcgtttggtga

SEQ ID NO: 359387 - DNA, 25 bp, Homo sapien
aagacaaaagactgcaccaactcac

SEQ ID NO: 359388 - DNA, 25 bp, Homo sapien
aactcaccctgacacagttacatag

SEQ ID NO: 359389 - DNA, 25 bp, Homo sapien
gaagatgggacagcccacatgctgc

SEQ ID NO: 359390 - DNA, 25 bp, Homo sapien
ccacatgctgcataagatgggcctt

SEQ ID NO: 359391 - DNA, 25 bp, Homo sapien
gatgggccttatgcagcaggcccag

SEQ ID NO: 359392 - DNA, 25 bp, Homo sapien
gtcattaaggagtgacccctttcct

SEQ ID NO: 359393 - DNA, 25 bp, Homo sapien
ccctttcctgtaacctgcactttgg

SEQ ID NO: 359394 - DNA, 25 bp, Homo sapien
tagaagtttctttacctgctgacag

SEQ ID NO: 359395 - DNA, 25 bp, Homo sapien
acctgctgacaggtttggtggcact

SEQ ID NO: 359396 - DNA, 25 bp, Homo sapien
tggtggcactgctggttacccctgg

SEQ ID NO: 359397 - DNA, 25 bp, Homo sapien
ccctgggccctgaatggagctaaaa

SEQ ID NO: 359398 - DNA, 25 bp, Homo sapien
gggagcgtctggtcagcgacccggc

SEQ ID NO: 359399 - DNA, 25 bp, Homo sapien
aggtcggccgcgtgcaggacttcct

SEQ ID NO: 359400 - DNA, 25 bp, Homo sapien
gtcggccgcgtgcaggacttcctgg

SEQ ID NO: 359401 - DNA, 25 bp, Homo sapien
ttcctgggcctgaaacgggtcgtca

SEQ ID NO: 359402 - DNA, 25 bp, Homo sapien
tcctgggcctgaaacgggtcgtcac

SEQ ID NO: 359403 - DNA, 25 bp, Homo sapien
cctgggcctgaaacgggtcgtcacg

SEQ ID NO: 359404 - DNA, 25 bp, Homo sapien
tcaagaaggcccagggcggcagccg

SEQ ID NO: 359405 - DNA, 25 bp, Homo sapien
agccgtccccgctgcctgggcaagt

SEQ ID NO: 359406 - DNA, 25 bp, Homo sapien
tgggcaagtccaagggccggccaca

SEQ ID NO: 359407 - DNA, 25 bp, Homo sapien
tgtcccacttcctgttcgtcagcgg

SEQ ID NO: 359408 - DNA, 25 bp, Homo sapien
ttcctgttcgtcagcggggagcgtc

SEQ ID NO: 359409 - DNA, 25 bp, Homo sapien
tcttctcacatcagcgggtccaggc

SEQ ID NO: 359410 - DNA, 25 bp, Homo sapien
gtccaggcccaaccgacagactatg

SEQ ID NO: 359411 - DNA, 25 bp, Homo sapien
atcaccctgttcatggacctgcagg

SEQ ID NO: 359412 - DNA, 25 bp, Homo sapien
tgttcatggacctgcaggcggtgct

SEQ ID NO: 359413 - DNA, 25 bp, Homo sapien
gagctctacccagtcgagtttagaa

SEQ ID NO: 359414 - DNA, 25 bp, Homo sapien
gaaacctgctgaagtggtatgctaa

SEQ ID NO: 359415 - DNA, 25 bp, Homo sapien
tgctaaggagttcaaagacccactg

SEQ ID NO: 359416 - DNA, 25 bp, Homo sapien
gttcaaagacccactgctacaggag

SEQ ID NO: 359417 - DNA, 25 bp, Homo sapien
cagcctggtttaagtcctttctgtt

SEQ ID NO: 359418 - DNA, 25 bp, Homo sapien
tcctttctgttttgcgagcttgtgt

SEQ ID NO: 359419 - DNA, 25 bp, Homo sapien
gaaggcgcgcggatttggcccctct

SEQ ID NO: 359420 - DNA, 25 bp, Homo sapien
gaggcccgtgcgaccaagctgaaac

SEQ ID NO: 359421 - DNA, 25 bp, Homo sapien
gtgcgaccaagctgaaaccgcttat

SEQ ID NO: 359422 - DNA, 25 bp, Homo sapien
aagctgaaaccgcttattctccgga

SEQ ID NO: 359423 - DNA, 25 bp, Homo sapien
gctgaaaccgcttattctccggagc

SEQ ID NO: 359424 - DNA, 25 bp, Homo sapien
tgaaaccgcttattctccggagccc

SEQ ID NO: 359425 - DNA, 25 bp, Homo sapien
gcttattctccggagcccctatgac

SEQ ID NO: 359426 - DNA, 25 bp, Homo sapien
tccggactccagttcgccgggactg

SEQ ID NO: 359427 - DNA, 25 bp, Homo sapien
ttcgccgggactgggcgacaccaga

SEQ ID NO: 359428 - DNA, 25 bp, Homo sapien
tagtgtgagtgaaacaaacgggaaa

SEQ ID NO: 359429 - DNA, 25 bp, Homo sapien
caaacgggaaatttgctctggcccg

SEQ ID NO: 359430 - DNA, 25 bp, Homo sapien
cgggaaatttgctctggcccgcctg

SEQ ID NO: 359431 - DNA, 25 bp, Homo sapien
tcacaaccatttctgccttcagtct

SEQ ID NO: 359432 - DNA, 25 bp, Homo sapien
ccatttctgccttcagtctccagtg

SEQ ID NO: 359433 - DNA, 25 bp, Homo sapien
gaaagcaattgtatttgtgcaaagc

SEQ ID NO: 359434 - DNA, 25 bp, Homo sapien
tataggaaagtttatcacagataca

SEQ ID NO: 359435 - DNA, 25 bp, Homo sapien
atcacagatacagtagctattacag

SEQ ID NO: 359436 - DNA, 25 bp, Homo sapien
gtagctattacagaaatttggaatt

SEQ ID NO: 359437 - DNA, 25 bp, Homo sapien
tttggaattcagcagatgttttaag

SEQ ID NO: 359438 - DNA, 25 bp, Homo sapien
ttctgtgtaacagatgaatttgcaa

SEQ ID NO: 359439 - DNA, 25 bp, Homo sapien
aagtggatgacttggcatttgaaga

SEQ ID NO: 359440 - DNA, 25 bp, Homo sapien
actgtcacaaccatttctgccttca

SEQ ID NO: 359441 - DNA, 25 bp, Homo sapien
tgtcacaaccatttctgccttcagt

SEQ ID NO: 359442 - DNA, 25 bp, Homo sapien
ctgcaagaactccttgactgagatg

SEQ ID NO: 359443 - DNA, 25 bp, Homo sapien
cttgactgagatggagctggactgt

SEQ ID NO: 359444 - DNA, 25 bp, Homo sapien
aaatcatcaacctatgtatcccctc

SEQ ID NO: 359445 - DNA, 25 bp, Homo sapien
caccagaaagcccatgatattgaca

SEQ ID NO: 359446 - DNA, 25 bp, Homo sapien
gaaagcccatgatattgacacaaaa

SEQ ID NO: 359447 - DNA, 25 bp, Homo sapien
cacaaaacttttgctgcgttgggcc

SEQ ID NO: 359448 - DNA, 25 bp, Homo sapien
caaaacttttgctgcgttgggccct

SEQ ID NO: 359449 - DNA, 25 bp, Homo sapien
acttttgctgcgttgggcccttgct

SEQ ID NO: 359450 - DNA, 25 bp, Homo sapien
ggcccttgctcctatctactttctt

SEQ ID NO: 359451 - DNA, 25 bp, Homo sapien
accgaggaagcacaggcgagctctt

SEQ ID NO: 359452 - DNA, 25 bp, Homo sapien
tcttcccatcatgcgctcactagtc

SEQ ID NO: 359453 - DNA, 25 bp, Homo sapien
ctgcgcctggccgacaaaggctttg

SEQ ID NO: 359454 - DNA, 25 bp, Homo sapien
gcctggccgacaaaggctttgatat

SEQ ID NO: 359455 - DNA, 25 bp, Homo sapien
caaaggctttgatatcagaatgaac

SEQ ID NO: 359456 - DNA, 25 bp, Homo sapien
cagaatgaactgtcaagggaggtgc

SEQ ID NO: 359457 - DNA, 25 bp, Homo sapien
tgctggagagggattaacctgtgct

SEQ ID NO: 359458 - DNA, 25 bp, Homo sapien
ggagagggattaacctgtgctgcct

SEQ ID NO: 359459 - DNA, 25 bp, Homo sapien
agggattaacctgtgctgcctggga

SEQ ID NO: 359460 - DNA, 25 bp, Homo sapien
tgctgcctgggaccctcagggtctt

SEQ ID NO: 359461 - DNA, 25 bp, Homo sapien
tgcctgggaccctcagggtcttagg

SEQ ID NO: 359462 - DNA, 25 bp, Homo sapien
gagtgtgaataggagtttgcagatg

SEQ ID NO: 359463 - DNA, 25 bp, Homo sapien
agatggagaataggaagggcattcc

SEQ ID NO: 359464 - DNA, 25 bp, Homo sapien
aaatgagccccaaactgcctgtctt

SEQ ID NO: 359465 - DNA, 25 bp, Homo sapien
aaactgcctgtcttcagctttgcct

SEQ ID NO: 359466 - DNA, 25 bp, Homo sapien
gggagctgctacctttgctcttcta

SEQ ID NO: 359467 - DNA, 25 bp, Homo sapien
tttgctcttctagcatcttctaggt

SEQ ID NO: 359468 - DNA, 25 bp, Homo sapien
tagcatcttctaggtaccaaggata

SEQ ID NO: 359469 - DNA, 25 bp, Homo sapien
taggtaccaaggatattagccactt

SEQ ID NO: 359470 - DNA, 25 bp, Homo sapien
ttagccacttgagggtgttgggcat

SEQ ID NO: 359471 - DNA, 25 bp, Homo sapien
gggcatatttgtttcattgtaggca

SEQ ID NO: 359472 - DNA, 25 bp, Homo sapien
gtaggcaaaatcctcttgtggtttc

SEQ ID NO: 359473 - DNA, 25 bp, Homo sapien
agtcaggagcactgtgaggcacaga

SEQ ID NO: 359474 - DNA, 25 bp, Homo sapien
gtgaggcacagaacatctcccagaa

SEQ ID NO: 359475 - DNA, 25 bp, Homo sapien
cttgggtggagaggatggcctaact

SEQ ID NO: 359476 - DNA, 25 bp, Homo sapien
tggatgtttatcctagcgtcaaccc

SEQ ID NO: 359477 - DNA, 25 bp, Homo sapien
gatgtttatcctagcgtcaacccac

SEQ ID NO: 359478 - DNA, 25 bp, Homo sapien
ctagcgtcaacccaccaaagatttg

SEQ ID NO: 359479 - DNA, 25 bp, Homo sapien
agcgtcaacccaccaaagatttggg

SEQ ID NO: 359480 - DNA, 25 bp, Homo sapien
catgtgagtcacattctctgggaca

SEQ ID NO: 359481 - DNA, 25 bp, Homo sapien
gtgagtcacattctctgggacattc

SEQ ID NO: 359482 - DNA, 25 bp, Homo sapien
gtcacattctctgggacattctact

SEQ ID NO: 359483 - DNA, 25 bp, Homo sapien
ggacattctactcccctttgatttt

SEQ ID NO: 359484 - DNA, 25 bp, Homo sapien
ttccagacatttcagtggctaccac

SEQ ID NO: 359485 - DNA, 25 bp, Homo sapien
ccagacatttcagtggctaccacaa

SEQ ID NO: 359486 - DNA, 25 bp, Homo sapien
gaaaacatgctgactcttgctctct

SEQ ID NO: 359487 - DNA, 25 bp, Homo sapien
atgctgactcttgctctcttggcgc

SEQ ID NO: 359488 - DNA, 25 bp, Homo sapien
tcttggcgcctaccgtctggtgatg

SEQ ID NO: 359489 - DNA, 25 bp, Homo sapien
ggtccaaggtgcttcactgactgga

SEQ ID NO: 359490 - DNA, 25 bp, Homo sapien
gtgcttcactgactggaccaaaagt

SEQ ID NO: 359491 - DNA, 25 bp, Homo sapien
ttttttcttatttgtggcaggcact

SEQ ID NO: 359492 - DNA, 25 bp, Homo sapien
ggcaggcactgtgttatgcccagaa

SEQ ID NO: 359493 - DNA, 25 bp, Homo sapien
ttcacctatttattgggcgcctact

SEQ ID NO: 359494 - DNA, 25 bp, Homo sapien
ttattgggcgcctactttgtaccag

SEQ ID NO: 359495 - DNA, 25 bp, Homo sapien
tactttgtaccaggcatcgtgctaa

SEQ ID NO: 359496 - DNA, 25 bp, Homo sapien
aggcatcgtgctaatctctggttag

SEQ ID NO: 359497 - DNA, 25 bp, Homo sapien
aaagggctgagctgaatgactcata

SEQ ID NO: 359498 - DNA, 25 bp, Homo sapien
taggaaatttaaagtctccagctga

SEQ ID NO: 359499 - DNA, 25 bp, Homo sapien
tccagctgagtgacagaaaacacct

SEQ ID NO: 359500 - DNA, 25 bp, Homo sapien
gaaaacaccttaaaaagctcaagag

SEQ ID NO: 359501 - DNA, 25 bp, Homo sapien
aagcattgaaagaagccgtgctcaa

SEQ ID NO: 359502 - DNA, 25 bp, Homo sapien
acatctctcaccctccagttaaaat

SEQ ID NO: 359503 - DNA, 25 bp, Homo sapien
cctccagttaaaatctcgccagttg

SEQ ID NO: 359504 - DNA, 25 bp, Homo sapien
tcgccagttgagtctgcccatgaaa

SEQ ID NO: 359505 - DNA, 25 bp, Homo sapien
gagtctgcccatgaaagtaggcgct

SEQ ID NO: 359506 - DNA, 25 bp, Homo sapien
aagtaggcgctgaactgcccaataa

SEQ ID NO: 359507 - DNA, 25 bp, Homo sapien
gaactgcccaataaatccacaagta

SEQ ID NO: 359508 - DNA, 25 bp, Homo sapien
taatttctttgctgtcattcgaaag

SEQ ID NO: 359509 - DNA, 25 bp, Homo sapien
ctttgctgtcattcgaaagacaaac

SEQ ID NO: 359510 - DNA, 25 bp, Homo sapien
aaagacaaactgatagggtcagcaa

SEQ ID NO: 359511 - DNA, 25 bp, Homo sapien
ggtcagcaaactaccttaaacatgt

SEQ ID NO: 359512 - DNA, 25 bp, Homo sapien
agcaaactaccttaaacatgttctc

SEQ ID NO: 359513 - DNA, 25 bp, Homo sapien
aaacacagctcctatagccagacgt

SEQ ID NO: 359514 - DNA, 25 bp, Homo sapien
acagctcctatagccagacgtggtg

SEQ ID NO: 359515 - DNA, 25 bp, Homo sapien
aagatccattttgtaaattgtgtca

SEQ ID NO: 359516 - DNA, 25 bp, Homo sapien
aattgtgtcaagcagatgtcgacca

SEQ ID NO: 359517 - DNA, 25 bp, Homo sapien
gtgtcaagcagatgtcgaccattta

SEQ ID NO: 359518 - DNA, 25 bp, Homo sapien
gcagatgtcgaccatttataataaa

SEQ ID NO: 359519 - DNA, 25 bp, Homo sapien
attcaggaggcaccgatctgccagt

SEQ ID NO: 359520 - DNA, 25 bp, Homo sapien
ctgggccgtcgcttgctgtctgagc

SEQ ID NO: 359521 - DNA, 25 bp, Homo sapien
gagcttccatccacgaatggtgtgg

SEQ ID NO: 359522 - DNA, 25 bp, Homo sapien
gggagttcgggatcttcccagacat

SEQ ID NO: 359523 - DNA, 25 bp, Homo sapien
cagacattctttcttcacctttggg

SEQ ID NO: 359524 - DNA, 25 bp, Homo sapien
gacggtggtggcatcccttgcagtc

SEQ ID NO: 359525 - DNA, 25 bp, Homo sapien
tgtgctgcgctgacactttggagaa

SEQ ID NO: 359526 - DNA, 25 bp, Homo sapien
atctgccagtgagggtttctaggaa

SEQ ID NO: 359527 - DNA, 25 bp, Homo sapien
aagtgtctcccatctgtagagcaga

SEQ ID NO: 359528 - DNA, 25 bp, Homo sapien
ggttagtcaggacgtggatccccac

SEQ ID NO: 359529 - DNA, 25 bp, Homo sapien
tggatccccacagtggacacgactg

SEQ ID NO: 359530 - DNA, 25 bp, Homo sapien
gaggctcccacttatgcctcggtgg

SEQ ID NO: 359531 - DNA, 25 bp, Homo sapien
gaagcagggcaggatgactcttgaa

SEQ ID NO: 359532 - DNA, 25 bp, Homo sapien
ttgaaggtggagacaggccctggac

SEQ ID NO: 359533 - DNA, 25 bp, Homo sapien
cctggacagctctgggacccttaat

SEQ ID NO: 359534 - DNA, 25 bp, Homo sapien
gacagctctgggacccttaatggtg

SEQ ID NO: 359535 - DNA, 25 bp, Homo sapien
ctgggacccttaatggtggcagcag

SEQ ID NO: 359536 - DNA, 25 bp, Homo sapien
ccagtcataggcctcattgtgtggg

SEQ ID NO: 359537 - DNA, 25 bp, Homo sapien
ataggcctcattgtgtgggcagcct

SEQ ID NO: 359538 - DNA, 25 bp, Homo sapien
acctgcgtcacaccctggctagtga

SEQ ID NO: 359539 - DNA, 25 bp, Homo sapien
caccctggctagtgacccagtcaga

SEQ ID NO: 359540 - DNA, 25 bp, Homo sapien
ctagtgacccagtcagacgtgctgg

SEQ ID NO: 359541 - DNA, 25 bp, Homo sapien
ctgaccacagaggtgactataatgt

SEQ ID NO: 359542 - DNA, 25 bp, Homo sapien
caaaagcagaggcattgaaggatat

SEQ ID NO: 359543 - DNA, 25 bp, Homo sapien
gaaggatatgccaaagtcagacatg

SEQ ID NO: 359544 - DNA, 25 bp, Homo sapien
gtcagacatggcaagtcatgctgtg

SEQ ID NO: 359545 - DNA, 25 bp, Homo sapien
aagtcatgctgtgacgattcaccag

SEQ ID NO: 359546 - DNA, 25 bp, Homo sapien
atgctgtgacgattcaccagaaagg

SEQ ID NO: 359547 - DNA, 25 bp, Homo sapien
gactataatgtactcttgcactcat

SEQ ID NO: 359548 - DNA, 25 bp, Homo sapien
tgtactcttgcactcatagacctta

SEQ ID NO: 359549 - DNA, 25 bp, Homo sapien
cttgcactcatagaccttaccatga

SEQ ID NO: 359550 - DNA, 25 bp, Homo sapien
gaccttaccatgaattagacagaca

SEQ ID NO: 359551 - DNA, 25 bp, Homo sapien
gacagacatccatgattcaagtgtg

SEQ ID NO: 359552 - DNA, 25 bp, Homo sapien
gtggcagagatatgtcttcttaact

SEQ ID NO: 359553 - DNA, 25 bp, Homo sapien
aagaggtgactcctattgtgaagta

SEQ ID NO: 359554 - DNA, 25 bp, Homo sapien
gaagtaggttaatatgtcactcttt

SEQ ID NO: 359555 - DNA, 25 bp, Homo sapien
gtttttgagtcataactcctttgag

SEQ ID NO: 359556 - DNA, 25 bp, Homo sapien
tggtgaaagctattgactttgcccc

SEQ ID NO: 359557 - DNA, 25 bp, Homo sapien
ccccagaaagttcatgtacttatca

SEQ ID NO: 359558 - DNA, 25 bp, Homo sapien
ggatggtacttgttggccctagaaa

SEQ ID NO: 359559 - DNA, 25 bp, Homo sapien
gttggccctagaaatgggaacttca

SEQ ID NO: 359560 - DNA, 25 bp, Homo sapien
aatgggaacttcaaagatctgtgtt

SEQ ID NO: 359561 - DNA, 25 bp, Homo sapien
gatctgtgtttatctagccgtgaat

SEQ ID NO: 359562 - DNA, 25 bp, Homo sapien
tagccgtgaatgacagtagacagtg

SEQ ID NO: 359563 - DNA, 25 bp, Homo sapien
agaggttcccatagcttcagtcttc

SEQ ID NO: 359564 - DNA, 25 bp, Homo sapien
acttcctcccatttctttgggtcag

SEQ ID NO: 359565 - DNA, 25 bp, Homo sapien
gggtcaggaatctggcttttgtttt

SEQ ID NO: 359566 - DNA, 25 bp, Homo sapien
gatcggtgtgtgtctgttttcatag

SEQ ID NO: 359567 - DNA, 25 bp, Homo sapien
atatttctttttcccaagacattgg

SEQ ID NO: 359568 - DNA, 25 bp, Homo sapien
ttgggaggcatctggtgaacaacac

SEQ ID NO: 359569 - DNA, 25 bp, Homo sapien
atccaggtcacttctctaactcatt

SEQ ID NO: 359570 - DNA, 25 bp, Homo sapien
gttttcatagatccactacatcaga

SEQ ID NO: 359571 - DNA, 25 bp, Homo sapien
agaagtatctttacatctctgtatc

SEQ ID NO: 359572 - DNA, 25 bp, Homo sapien
gtatctttacatcccaaggtcaagg

SEQ ID NO: 359573 - DNA, 25 bp, Homo sapien
aaggccctggcaacctcagaggttc

SEQ ID NO: 359574 - DNA, 25 bp, Homo sapien
gtgccggaagtgtccacaggtctta

SEQ ID NO: 359575 - DNA, 25 bp, Homo sapien
aagtgtccacaggtcttagattccc

SEQ ID NO: 359576 - DNA, 25 bp, Homo sapien
gtcttagattccctgttcagacgaa

SEQ ID NO: 359577 - DNA, 25 bp, Homo sapien
gttcagacgaaaagatttgtgcctt

SEQ ID NO: 359578 - DNA, 25 bp, Homo sapien
gagtcaaaaattcaagccatgggta

SEQ ID NO: 359579 - DNA, 25 bp, Homo sapien
aaaatgcaagtaaaatccctgccct

SEQ ID NO: 359580 - DNA, 25 bp, Homo sapien
tactacacagagatgtcctctcgag

SEQ ID NO: 359581 - DNA, 25 bp, Homo sapien
agatgtcctctcgagtttcctagac

SEQ ID NO: 359582 - DNA, 25 bp, Homo sapien
ctcactctggaaatttctgtataca

SEQ ID NO: 359583 - DNA, 25 bp, Homo sapien
tacacacagaagcttgtgcctctgc

SEQ ID NO: 359584 - DNA, 25 bp, Homo sapien
aagcttgtgcctctgctcgtgaagg

SEQ ID NO: 359585 - DNA, 25 bp, Homo sapien
tgcgggcataggtacggactcattt

SEQ ID NO: 359586 - DNA, 25 bp, Homo sapien
gagaacctttccctagagctgctgt

SEQ ID NO: 359587 - DNA, 25 bp, Homo sapien
gagctgctgttgtaggtccaattta

SEQ ID NO: 359588 - DNA, 25 bp, Homo sapien
aggtgattctcaaacatctgacccc

SEQ ID NO: 359589 - DNA, 25 bp, Homo sapien
caagccctgggatgtcttcgtttgc

SEQ ID NO: 359590 - DNA, 25 bp, Homo sapien
ctccgaggcaaacctatatccttag

SEQ ID NO: 359591 - DNA, 25 bp, Homo sapien
tatccttagggcctgtgtccacagt

SEQ ID NO: 359592 - DNA, 25 bp, Homo sapien
tgtccacagtccattccatactaat

SEQ ID NO: 359593 - DNA, 25 bp, Homo sapien
aagagactgtgatagcccaggaaat

SEQ ID NO: 359594 - DNA, 25 bp, Homo sapien
gaaatacacatccagtcacagaatg

SEQ ID NO: 359595 - DNA, 25 bp, Homo sapien
agtcacctgcccaacagaaatgcgg

SEQ ID NO: 359596 - DNA, 25 bp, Homo sapien
aacatgccaatataggtccaatcaa

SEQ ID NO: 359597 - DNA, 25 bp, Homo sapien
gaagctggactaacgcagatgactt

SEQ ID NO: 359598 - DNA, 25 bp, Homo sapien
cagatgacttgaggctccacacagg

SEQ ID NO: 359599 - DNA, 25 bp, Homo sapien
gggcttgcacacaactggagtctac

SEQ ID NO: 359600 - DNA, 25 bp, Homo sapien
ataaatccactcctttgagcaaagc

SEQ ID NO: 359601 - DNA, 25 bp, Homo sapien
tggagtctacagatatcatttggct

SEQ ID NO: 359602 - DNA, 25 bp, Homo sapien
aattgtattgcctctagaccttcag

SEQ ID NO: 359603 - DNA, 25 bp, Homo sapien
tgagcaaagcactctatcctgagaa

SEQ ID NO: 359604 - DNA, 25 bp, Homo sapien
atcctgagaaggagtcatctgcaaa

SEQ ID NO: 359605 - DNA, 25 bp, Homo sapien
atgcttttataaaggccaggccacc

SEQ ID NO: 359606 - DNA, 25 bp, Homo sapien
ccaggccaccatcaaacattaacat

SEQ ID NO: 359607 - DNA, 25 bp, Homo sapien
gtcaagccacctgctaaggctcatg

SEQ ID NO: 359608 - DNA, 25 bp, Homo sapien
gctaaggctcatggtctttcagact

SEQ ID NO: 359609 - DNA, 25 bp, Homo sapien
ggtctttcagactagcttcaacatt

SEQ ID NO: 359610 - DNA, 25 bp, Homo sapien
gcttcaacattccaaatcaggcaat

SEQ ID NO: 359611 - DNA, 25 bp, Homo sapien
caggcaatagctacaacggaaagat

SEQ ID NO: 359612 - DNA, 25 bp, Homo sapien
ggctttgtctcttgtagcaggattt

SEQ ID NO: 359613 - DNA, 25 bp, Homo sapien
gaatctttcaaccttagtggtcacc

SEQ ID NO: 359614 - DNA, 25 bp, Homo sapien
tcaaccttagtggtcaccaacttga

SEQ ID NO: 359615 - DNA, 25 bp, Homo sapien
accaacttgactccattccttatat

SEQ ID NO: 359616 - DNA, 25 bp, Homo sapien
attccttatatcaagccttgtcctg

SEQ ID NO: 359617 - DNA, 25 bp, Homo sapien
tcctgtcaattctcccttaaatgtt

SEQ ID NO: 359618 - DNA, 25 bp, Homo sapien
agcaggcaggccttctagcttaggc

SEQ ID NO: 359619 - DNA, 25 bp, Homo sapien
gcaggccttctagcttaggcagctt

SEQ ID NO: 359620 - DNA, 25 bp, Homo sapien
ttaggcagcttccttctgtccgaaa

SEQ ID NO: 359621 - DNA, 25 bp, Homo sapien
ccttctgtccgaaaggcacccaatg

SEQ ID NO: 359622 - DNA, 25 bp, Homo sapien
cccctgctgtctgacttggaaacat

SEQ ID NO: 359623 - DNA, 25 bp, Homo sapien
gacttggaaacatgagcttccctaa

SEQ ID NO: 359624 - DNA, 25 bp, Homo sapien
ggcagggaagttcctaccccatcca

SEQ ID NO: 359625 - DNA, 25 bp, Homo sapien
ttcctaccccatccagaagagttag

SEQ ID NO: 359626 - DNA, 25 bp, Homo sapien
aacacataggaaaggcaccctgcct

SEQ ID NO: 359627 - DNA, 25 bp, Homo sapien
ctgccttgcagctggacctatagtc

SEQ ID NO: 359628 - DNA, 25 bp, Homo sapien
gacctatagtccaagaaaacaactt

SEQ ID NO: 359629 - DNA, 25 bp, Homo sapien
gtggtctcgttagaagtccagcaac

SEQ ID NO: 359630 - DNA, 25 bp, Homo sapien
agaagtccagcaacactgctcatgg

SEQ ID NO: 359631 - DNA, 25 bp, Homo sapien
gcaacactgctcatggctataccag

SEQ ID NO: 359632 - DNA, 25 bp, Homo sapien
gctcatggctataccagaaggcaga

SEQ ID NO: 359633 - DNA, 25 bp, Homo sapien
gtcatccagtccacggcgagatcga

SEQ ID NO: 359634 - DNA, 25 bp, Homo sapien
gcgagatcgatgaccccagccaagg

SEQ ID NO: 359635 - DNA, 25 bp, Homo sapien
aaggtgcccgccagcaggccgatga

SEQ ID NO: 359636 - DNA, 25 bp, Homo sapien
atccagcaggctcttgatgaactcc

SEQ ID NO: 359637 - DNA, 25 bp, Homo sapien
gatgaactcccatatggactccttg

SEQ ID NO: 359638 - DNA, 25 bp, Homo sapien
acttgtctctgtcctcaaaagtggt

SEQ ID NO: 359639 - DNA, 25 bp, Homo sapien
tctgtcctcaaaagtggtctcgtta

SEQ ID NO: 359640 - DNA, 25 bp, Homo sapien
gtgatgagaacattctccctgttgt

SEQ ID NO: 359641 - DNA, 25 bp, Homo sapien
ttgcgtggtccagttgagcgagcca

SEQ ID NO: 359642 - DNA, 25 bp, Homo sapien
gagccagtgatgagcaccctcttgt

SEQ ID NO: 359643 - DNA, 25 bp, Homo sapien
tcttgtccacgatggcaaacttgtg

SEQ ID NO: 359644 - DNA, 25 bp, Homo sapien
acttgtgatgcatgtagcctgggtc

SEQ ID NO: 359645 - DNA, 25 bp, Homo sapien
tagcctgggtcttgatcgtgccgga

SEQ ID NO: 359646 - DNA, 25 bp, Homo sapien
agcagaccgatttgcgagccgttga

SEQ ID NO: 359647 - DNA, 25 bp, Homo sapien
cgttgagggccatgtagtcgcagtc

SEQ ID NO: 359648 - DNA, 25 bp, Homo sapien
ggttaaactgttcccagatgcgctc

SEQ ID NO: 359649 - DNA, 25 bp, Homo sapien
ccagatgcgctcaaattcttccaaa

SEQ ID NO: 359650 - DNA, 25 bp, Homo sapien
gtactcgtcgtcctccgtgatgaga

SEQ ID NO: 359651 - DNA, 25 bp, Homo sapien
aagtaggtggttacagcttgagtca

SEQ ID NO: 359652 - DNA, 25 bp, Homo sapien
ggttacagcttgagtcacattgctt

SEQ ID NO: 359653 - DNA, 25 bp, Homo sapien
agcttgagtcacattgcttctttaa

SEQ ID NO: 359654 - DNA, 25 bp, Homo sapien
gttgaggtgaatctcatagcctctg

SEQ ID NO: 359655 - DNA, 25 bp, Homo sapien
aggtgaatctcatagcctctggctc

SEQ ID NO: 359656 - DNA, 25 bp, Homo sapien
atctcatagcctctggctccatttt

SEQ ID NO: 359657 - DNA, 25 bp, Homo sapien
ttttcctacctgtaaactaagatga

SEQ ID NO: 359658 - DNA, 25 bp, Homo sapien
aataagcttgtgatctttgaagtac

SEQ ID NO: 359659 - DNA, 25 bp, Homo sapien
gtgatctttgaagtacagaagtgca

SEQ ID NO: 359660 - DNA, 25 bp, Homo sapien
aaagcatgcaatatgcctagtacat

SEQ ID NO: 359661 - DNA, 25 bp, Homo sapien
gcaatatgcctagtacataagcatt

SEQ ID NO: 359662 - DNA, 25 bp, Homo sapien
tcacttagcaaatctcctggccatt

SEQ ID NO: 359663 - DNA, 25 bp, Homo sapien
acacttcctgtctgtaaatgggttt

SEQ ID NO: 359664 - DNA, 25 bp, Homo sapien
gggtttatcaccactcattcaagtc

SEQ ID NO: 359665 - DNA, 25 bp, Homo sapien
gtcctaattattaccagcgctgaga

SEQ ID NO: 359666 - DNA, 25 bp, Homo sapien
accagcgctgagaaaccaatacttt

SEQ ID NO: 359667 - DNA, 25 bp, Homo sapien
ttctttttccatctcgcttgtgtaa

SEQ ID NO: 359668 - DNA, 25 bp, Homo sapien
tcgcttgtgtaatttcttcggagaa

SEQ ID NO: 359669 - DNA, 25 bp, Homo sapien
ggtctgaaccatttttaccctgaga

SEQ ID NO: 359670 - DNA, 25 bp, Homo sapien
tcactaggcttagggagctgggctc

SEQ ID NO: 359671 - DNA, 25 bp, Homo sapien
gaggccagaggcctgatcttgatct

SEQ ID NO: 359672 - DNA, 25 bp, Homo sapien
tgatcttgatcttgtcatcacttag

SEQ ID NO: 359673 - DNA, 25 bp, Homo sapien
ggccatgagcctctgtaatggaaac

SEQ ID NO: 359674 - DNA, 25 bp, Homo sapien
gaaactagctgtcctgaatcttcca

SEQ ID NO: 359675 - DNA, 25 bp, Homo sapien
tagctgtcctgaatcttccagccag

SEQ ID NO: 359676 - DNA, 25 bp, Homo sapien
ttccagccaggagcccagagaaatc

SEQ ID NO: 359677 - DNA, 25 bp, Homo sapien
aggagcccagagaaatcacccgtgg

SEQ ID NO: 359678 - DNA, 25 bp, Homo sapien
tttctcaagctccttaagggtggat

SEQ ID NO: 359679 - DNA, 25 bp, Homo sapien
agggtggatccaaaattcaacagga

SEQ ID NO: 359680 - DNA, 25 bp, Homo sapien
ggaatgtttgaacagctatgctgtc

SEQ ID NO: 359681 - DNA, 25 bp, Homo sapien
tatgctgtcactttgcctgcatgac

SEQ ID NO: 359682 - DNA, 25 bp, Homo sapien
ctttcccacatagtcgtgtacctgg

SEQ ID NO: 359683 - DNA, 25 bp, Homo sapien
atagtcgtgtacctgggccatgagc

SEQ ID NO: 359684 - DNA, 25 bp, Homo sapien
gtgtaactggactttaatcaatata

SEQ ID NO: 359685 - DNA, 25 bp, Homo sapien
aacagtgattgtcgtttctcgttaa

SEQ ID NO: 359686 - DNA, 25 bp, Homo sapien
gtgattgtcgtttctcgttaaacgt

SEQ ID NO: 359687 - DNA, 25 bp, Homo sapien
tagatcatacccctaagcgttcaat

SEQ ID NO: 359688 - DNA, 25 bp, Homo sapien
gagtttctttcccatttcaactccg

SEQ ID NO: 359689 - DNA, 25 bp, Homo sapien
ttctttcccatttcaactccgacag

SEQ ID NO: 359690 - DNA, 25 bp, Homo sapien
tacccctaagcgttcaatacaatct

SEQ ID NO: 359691 - DNA, 25 bp, Homo sapien
caatacaatcttttacttacttaca

SEQ ID NO: 359692 - DNA, 25 bp, Homo sapien
acttacttacacagtctccaacaag

SEQ ID NO: 359693 - DNA, 25 bp, Homo sapien
acacagtctccaacaagtctgcatt

SEQ ID NO: 359694 - DNA, 25 bp, Homo sapien
gtctccaacaagtctgcattaaaag

SEQ ID NO: 359695 - DNA, 25 bp, Homo sapien
gtagagtgggtgtagtgagtgtata

SEQ ID NO: 359696 - DNA, 25 bp, Homo sapien
tatataatgtgatttggccctgtgt

SEQ ID NO: 359697 - DNA, 25 bp, Homo sapien
atataatgtgatttggccctgtgta

SEQ ID NO: 359698 - DNA, 25 bp, Homo sapien
tataatgtgatttggccctgtgtat

SEQ ID NO: 359699 - DNA, 25 bp, Homo sapien
ataatgtgatttggccctgtgtatt

SEQ ID NO: 359700 - DNA, 25 bp, Homo sapien
tgtgatttggccctgtgtattatga

SEQ ID NO: 359701 - DNA, 25 bp, Homo sapien
tgatttggccctgtgtattatgata

SEQ ID NO: 359702 - DNA, 25 bp, Homo sapien
gatttggccctgtgtattatgatat

SEQ ID NO: 359703 - DNA, 25 bp, Homo sapien
atttggccctgtgtattatgatatt

SEQ ID NO: 359704 - DNA, 25 bp, Homo sapien
tttggccctgtgtattatgatattt

SEQ ID NO: 359705 - DNA, 25 bp, Homo sapien
tggccctgtgtattatgatattttg

SEQ ID NO: 359706 - DNA, 25 bp, Homo sapien
atttgaacctaatgctactagatgc

SEQ ID NO: 359707 - DNA, 25 bp, Homo sapien
atgctactagatgcagtggctgaac

SEQ ID NO: 359708 - DNA, 25 bp, Homo sapien
acatgtgggactatgagggcattaa

SEQ ID NO: 359709 - DNA, 25 bp, Homo sapien
agggcattaaggagtcaacaggtga

SEQ ID NO: 359710 - DNA, 25 bp, Homo sapien
acaggtgacttccaatggactgtac

SEQ ID NO: 359711 - DNA, 25 bp, Homo sapien
gcagcagccacatttatacgcacta

SEQ ID NO: 359712 - DNA, 25 bp, Homo sapien
tgcgtagcaatctcggtttccattt

SEQ ID NO: 359713 - DNA, 25 bp, Homo sapien
agcaatctcggtttccattttaata

SEQ ID NO: 359714 - DNA, 25 bp, Homo sapien
gaaggtaagttcagttgatggacac

SEQ ID NO: 359715 - DNA, 25 bp, Homo sapien
aacagcatgcacttgtctcatggtg

SEQ ID NO: 359716 - DNA, 25 bp, Homo sapien
tcatggtggagctctaggcactcag

SEQ ID NO: 359717 - DNA, 25 bp, Homo sapien
gtttgaattatagttcctctcacag

SEQ ID NO: 359718 - DNA, 25 bp, Homo sapien
agctgggatgtatatattcctgcaa

SEQ ID NO: 359719 - DNA, 25 bp, Homo sapien
aagcaagtatcagaggagtcatcca

SEQ ID NO: 359720 - DNA, 25 bp, Homo sapien
ggagtcatccattcaaaacacagtt

SEQ ID NO: 359721 - DNA, 25 bp, Homo sapien
agttcttccactgcagtatccgata

SEQ ID NO: 359722 - DNA, 25 bp, Homo sapien
atccgatatgttttgtatgtgcgct

SEQ ID NO: 359723 - DNA, 25 bp, Homo sapien
gtatgtgcgctaggctgtcttttca

SEQ ID NO: 359724 - DNA, 25 bp, Homo sapien
tcagtctacaatacagttcaccagt

SEQ ID NO: 359725 - DNA, 25 bp, Homo sapien
aatggcttcacattgctggatggga

SEQ ID NO: 359726 - DNA, 25 bp, Homo sapien
atgggagcagtatgtgtgttgtttc

SEQ ID NO: 359727 - DNA, 25 bp, Homo sapien
tgggtataatcttcctagctgcact

SEQ ID NO: 359728 - DNA, 25 bp, Homo sapien
tttatgggctgccacacttgtgtat

SEQ ID NO: 359729 - DNA, 25 bp, Homo sapien
tgggctgccacacttgtgtatccct

SEQ ID NO: 359730 - DNA, 25 bp, Homo sapien
tcccttcttccttgaatttaaccag

SEQ ID NO: 359731 - DNA, 25 bp, Homo sapien
ttcttccttgaatttaaccaggagt

SEQ ID NO: 359732 - DNA, 25 bp, Homo sapien
aaccaggagtgagcagtggacagct

SEQ ID NO: 359733 - DNA, 25 bp, Homo sapien
agtgagcagtggacagcttcttccc

SEQ ID NO: 359734 - DNA, 25 bp, Homo sapien
agtggacagcttcttccctatgaga

SEQ ID NO: 359735 - DNA, 25 bp, Homo sapien
ggacagcttcttccctatgagaagg

SEQ ID NO: 359736 - DNA, 25 bp, Homo sapien
gaagcaggacctgaaatcccgtgct

SEQ ID NO: 359737 - DNA, 25 bp, Homo sapien
aggacctgaaatcccgtgctcagct

SEQ ID NO: 359738 - DNA, 25 bp, Homo sapien
cctgttcttccagcatggatctgaa

SEQ ID NO: 359739 - DNA, 25 bp, Homo sapien
atataaaaagcactcccaacccaag

SEQ ID NO: 359740 - DNA, 25 bp, Homo sapien
tgtgtccatatattcccttctaatc

SEQ ID NO: 359741 - DNA, 25 bp, Homo sapien
atattcccttctaatcattgtcctc

SEQ ID NO: 359742 - DNA, 25 bp, Homo sapien
ttctaatcattgtcctcatgcaaga

SEQ ID NO: 359743 - DNA, 25 bp, Homo sapien
agatgatctgctacataattttata

SEQ ID NO: 359744 - DNA, 25 bp, Homo sapien
atatcatactctttctcctaacatt

SEQ ID NO: 359745 - DNA, 25 bp, Homo sapien
atactctttctcctaacattacatc

SEQ ID NO: 359746 - DNA, 25 bp, Homo sapien
aagtatactttcatgttgctgctac

SEQ ID NO: 359747 - DNA, 25 bp, Homo sapien
atgttgctgctacattcttcacact

SEQ ID NO: 359748 - DNA, 25 bp, Homo sapien
cacacttgtcattttaatggccata

SEQ ID NO: 359749 - DNA, 25 bp, Homo sapien
aattatgtagactcctattattaaa

SEQ ID NO: 359750 - DNA, 25 bp, Homo sapien
aaatcaggagtgaggacttgttgaa

SEQ ID NO: 359751 - DNA, 25 bp, Homo sapien
tccctgtcggctagctcgggtctgg

SEQ ID NO: 359752 - DNA, 25 bp, Homo sapien
gaaataggaaggaatcagatcacat

SEQ ID NO: 359753 - DNA, 25 bp, Homo sapien
agatcacataaatgctggccccaaa

SEQ ID NO: 359754 - DNA, 25 bp, Homo sapien
gctggccccaaatgtttgcatcata

SEQ ID NO: 359755 - DNA, 25 bp, Homo sapien
gtttgcatcataaacccattgccta

SEQ ID NO: 359756 - DNA, 25 bp, Homo sapien
aacccattgcctaattttacagttg

SEQ ID NO: 359757 - DNA, 25 bp, Homo sapien
tagctcgggtctggcccacggtgac

SEQ ID NO: 359758 - DNA, 25 bp, Homo sapien
ggcccacggtgactgttacccctgg

SEQ ID NO: 359759 - DNA, 25 bp, Homo sapien
gggcagctctgatccatccaacgct

SEQ ID NO: 359760 - DNA, 25 bp, Homo sapien
tgatccatccaacgctgctgcactg

SEQ ID NO: 359761 - DNA, 25 bp, Homo sapien
gtgtgtgcccatgtgaaaccgtgta

SEQ ID NO: 359762 - DNA, 25 bp, Homo sapien
gtgcccatgtgaaaccgtgtacttg

SEQ ID NO: 359763 - DNA, 25 bp, Homo sapien
accgtgtacttgagtgtgtgtctgt

SEQ ID NO: 359764 - DNA, 25 bp, Homo sapien
tgtgtctgtgtgcagcctatgcctg

SEQ ID NO: 359765 - DNA, 25 bp, Homo sapien
tgtgcagcctatgcctgctgctcag

SEQ ID NO: 359766 - DNA, 25 bp, Homo sapien
tgctgctcagagcacggtggccacc

SEQ ID NO: 359767 - DNA, 25 bp, Homo sapien
gccaccgttgggaggcccctgtacg

SEQ ID NO: 359768 - DNA, 25 bp, Homo sapien
tgtctgccctgcgtgagggcataga

SEQ ID NO: 359769 - DNA, 25 bp, Homo sapien
gcgtgagggcatagaatgtcaaatt

SEQ ID NO: 359770 - DNA, 25 bp, Homo sapien
aactggagagttttcatgttatttt

SEQ ID NO: 359771 - DNA, 25 bp, Homo sapien
agcagtatctaaagacgtaggcgat

SEQ ID NO: 359772 - DNA, 25 bp, Homo sapien
gaagaaccttggtggttccaacata

SEQ ID NO: 359773 - DNA, 25 bp, Homo sapien
aaccttggtggttccaacatagtat

SEQ ID NO: 359774 - DNA, 25 bp, Homo sapien
ggtggttccaacatagtatggccat

SEQ ID NO: 359775 - DNA, 25 bp, Homo sapien
ggttccaacatagtatggccattgt

SEQ ID NO: 359776 - DNA, 25 bp, Homo sapien
gtatggccattgttttatactcaaa

SEQ ID NO: 359777 - DNA, 25 bp, Homo sapien
atggccattgttttatactcaaaat

SEQ ID NO: 359778 - DNA, 25 bp, Homo sapien
tatagaaagacaacctcagaataag

SEQ ID NO: 359779 - DNA, 25 bp, Homo sapien
cccaatcctgattcctgtttacaaa

SEQ ID NO: 359780 - DNA, 25 bp, Homo sapien
caatcctgattcctgtttacaaaga

SEQ ID NO: 359781 - DNA, 25 bp, Homo sapien
gattcctgtttacaaagaatgttga

SEQ ID NO: 359782 - DNA, 25 bp, Homo sapien
ttgctcaggaaattctcagattata

SEQ ID NO: 359783 - DNA, 25 bp, Homo sapien
cacgccactttctctggtgtggcca

SEQ ID NO: 359784 - DNA, 25 bp, Homo sapien
tggtgtggccacaccatcgtccaca

SEQ ID NO: 359785 - DNA, 25 bp, Homo sapien
tcgtccacacgatgaaaagcagagg

SEQ ID NO: 359786 - DNA, 25 bp, Homo sapien
gggaggagcaaagccagccctgaat

SEQ ID NO: 359787 - DNA, 25 bp, Homo sapien
gaatcccaggtctcctaatgattaa

SEQ ID NO: 359788 - DNA, 25 bp, Homo sapien
attccagttggtgttctgggcagaa

SEQ ID NO: 359789 - DNA, 25 bp, Homo sapien
atgattaatccagaacgccttccac

SEQ ID NO: 359790 - DNA, 25 bp, Homo sapien
ttccacttctcttttctgccacatg

SEQ ID NO: 359791 - DNA, 25 bp, Homo sapien
tgccacatggccttaaaacagaaga

SEQ ID NO: 359792 - DNA, 25 bp, Homo sapien
gaagacaaagcagcttctccccttt

SEQ ID NO: 359793 - DNA, 25 bp, Homo sapien
ttctcccctttcctttgcactgagg

SEQ ID NO: 359794 - DNA, 25 bp, Homo sapien
tgaataatacgagcagacattctct

SEQ ID NO: 359795 - DNA, 25 bp, Homo sapien
agcagacattctctgtagaaggtaa

SEQ ID NO: 359796 - DNA, 25 bp, Homo sapien
ttctctgtagaaggtaatggtctga

SEQ ID NO: 359797 - DNA, 25 bp, Homo sapien
agtattaacccttcatctgttcttg

SEQ ID NO: 359798 - DNA, 25 bp, Homo sapien
gggcaccaatgcagaacactgcact

SEQ ID NO: 359799 - DNA, 25 bp, Homo sapien
gaacactgcactgagtcctaaagga

SEQ ID NO: 359800 - DNA, 25 bp, Homo sapien
aggagccttataggcaatgccccag

SEQ ID NO: 359801 - DNA, 25 bp, Homo sapien
taggcaatgccccagactgacttgt

SEQ ID NO: 359802 - DNA, 25 bp, Homo sapien
atgccccagactgacttgtgagtgg

SEQ ID NO: 359803 - DNA, 25 bp, Homo sapien
tcatctgttcttgaaactggttggg

SEQ ID NO: 359804 - DNA, 25 bp, Homo sapien
ctgagggcagagtctctgggtttca

SEQ ID NO: 359805 - DNA, 25 bp, Homo sapien
tttctggcggatgcttactgatcta

SEQ ID NO: 359806 - DNA, 25 bp, Homo sapien
ggatgcttactgatctaacaactgg

SEQ ID NO: 359807 - DNA, 25 bp, Homo sapien
taacaactggatgactgaggaatgc

SEQ ID NO: 359808 - DNA, 25 bp, Homo sapien
gaatgcggtcctaagtgaccccggg

SEQ ID NO: 359809 - DNA, 25 bp, Homo sapien
gagttgatctttgagcacagcgaca

SEQ ID NO: 359810 - DNA, 25 bp, Homo sapien
aacagcgtgcgggatctgactaaca

SEQ ID NO: 359811 - DNA, 25 bp, Homo sapien
gactaacagcgtgtggcagccgagc

SEQ ID NO: 359812 - DNA, 25 bp, Homo sapien
ttgagcacagcgacagggatttttt

SEQ ID NO: 359813 - DNA, 25 bp, Homo sapien
ggattttttgtacatcgtgccttac

SEQ ID NO: 359814 - DNA, 25 bp, Homo sapien
atcgtgccttacagagcgagcgctg

SEQ ID NO: 359815 - DNA, 25 bp, Homo sapien
gaggaatcatcaccctgctgagaag

SEQ ID NO: 359816 - DNA, 25 bp, Homo sapien
aagggtggcctctgggtctgcatct

SEQ ID NO: 359817 - DNA, 25 bp, Homo sapien
gaaaagcctggtccctaggcacggt

SEQ ID NO: 359818 - DNA, 25 bp, Homo sapien
aggcacggtcgtggttcgagctttt

SEQ ID NO: 359819 - DNA, 25 bp, Homo sapien
ggttcgagcttttcgttctctcgca

SEQ ID NO: 359820 - DNA, 25 bp, Homo sapien
tcgttctctcgcacattgaggtatt

SEQ ID NO: 359821 - DNA, 25 bp, Homo sapien
acattgaggtattcgctcagcccac

SEQ ID NO: 359822 - DNA, 25 bp, Homo sapien
gttattaggccccagtcacaagccc

SEQ ID NO: 359823 - DNA, 25 bp, Homo sapien
gtcacaagccctatgatgttttcag

SEQ ID NO: 359824 - DNA, 25 bp, Homo sapien
atgttttcagacttcccaggtggag

SEQ ID NO: 359825 - DNA, 25 bp, Homo sapien
tactatttctgcagaacttctgttg

SEQ ID NO: 359826 - DNA, 25 bp, Homo sapien
gtatttagcaacttctgtgtagatc

SEQ ID NO: 359827 - DNA, 25 bp, Homo sapien
gataataatgcatgtttggcctcag

SEQ ID NO: 359828 - DNA, 25 bp, Homo sapien
aagaaactacctgcctcacagatga

SEQ ID NO: 359829 - DNA, 25 bp, Homo sapien
cacagatgagcacgcacgggtgcat

SEQ ID NO: 359830 - DNA, 25 bp, Homo sapien
acgcacgggtgcattgtcaaagtct

SEQ ID NO: 359831 - DNA, 25 bp, Homo sapien
ccatttctaagctaccatggagaag

SEQ ID NO: 359832 - DNA, 25 bp, Homo sapien
gagaagtatatgctcctcgagacca

SEQ ID NO: 359833 - DNA, 25 bp, Homo sapien
gtatatgctcctcgagaccagagac

SEQ ID NO: 359834 - DNA, 25 bp, Homo sapien
agagactgtgacttctgcatctttg

SEQ ID NO: 359835 - DNA, 25 bp, Homo sapien
tgcatctttgattccagcgacatat

SEQ ID NO: 359836 - DNA, 25 bp, Homo sapien
gttttgcacatagttgaatccagcg

SEQ ID NO: 359837 - DNA, 25 bp, Homo sapien
gttgaatccagcgttgatacatgaa

SEQ ID NO: 359838 - DNA, 25 bp, Homo sapien
aaagggtagcgtgagcttcatgcct

SEQ ID NO: 359839 - DNA, 25 bp, Homo sapien
gtagcgtgagcttcatgccttcggc

SEQ ID NO: 359840 - DNA, 25 bp, Homo sapien
ggccggccgtgttatactcgttaga

SEQ ID NO: 359841 - DNA, 25 bp, Homo sapien
gccgtgttatactcgttagacccaa

SEQ ID NO: 359842 - DNA, 25 bp, Homo sapien
ttatactcgttagacccaattcacc

SEQ ID NO: 359843 - DNA, 25 bp, Homo sapien
gagacagtgattgcagcctctcccg

SEQ ID NO: 359844 - DNA, 25 bp, Homo sapien
ctcgttagacccaattcaccatgaa

SEQ ID NO: 359845 - DNA, 25 bp, Homo sapien
gtaaaggaattctccaagcaccacc

SEQ ID NO: 359846 - DNA, 25 bp, Homo sapien
ttctccaagcaccacctcatgatta

SEQ ID NO: 359847 - DNA, 25 bp, Homo sapien
attgcagcctctcccggcgcaggtg

SEQ ID NO: 359848 - DNA, 25 bp, Homo sapien
gtgaggttgggaggactgcctaact

SEQ ID NO: 359849 - DNA, 25 bp, Homo sapien
agggctcctctttctgcaaactttg

SEQ ID NO: 359850 - DNA, 25 bp, Homo sapien
agcccaatgcagatgactccaggtg

SEQ ID NO: 359851 - DNA, 25 bp, Homo sapien
cacagtgtggagctaaatcgaggca

SEQ ID NO: 359852 - DNA, 25 bp, Homo sapien
aatgtcctctattggagaaccacag

SEQ ID NO: 359853 - DNA, 25 bp, Homo sapien
gagaaccacagccttctcagtatgg

SEQ ID NO: 359854 - DNA, 25 bp, Homo sapien
tatggaccaaagtacccaagcctgt

SEQ ID NO: 359855 - DNA, 25 bp, Homo sapien
gtacccaagcctgtgctggtgagaa

SEQ ID NO: 359856 - DNA, 25 bp, Homo sapien
ggtgagaaacattgccataacaggg

SEQ ID NO: 359857 - DNA, 25 bp, Homo sapien
ggtggcctacacttcagaatgcttc

SEQ ID NO: 359858 - DNA, 25 bp, Homo sapien
gcaaacctggcacgtatgcagacaa

SEQ ID NO: 359859 - DNA, 25 bp, Homo sapien
cgtatgcagacaagcagggctcctc

SEQ ID NO: 359860 - DNA, 25 bp, Homo sapien
aggacatcttcctaaagccagagaa

SEQ ID NO: 359861 - DNA, 25 bp, Homo sapien
agagaaaattgtctgcgcttcccca

SEQ ID NO: 359862 - DNA, 25 bp, Homo sapien
gagggcgtcacaaggtcttttgtaa

SEQ ID NO: 359863 - DNA, 25 bp, Homo sapien
ggtcttttgtaaatcactattgtgt

SEQ ID NO: 359864 - DNA, 25 bp, Homo sapien
tgtgtttgtcacagcactgggcgga

SEQ ID NO: 359865 - DNA, 25 bp, Homo sapien
cactgggcggagagctggatccaca

SEQ ID NO: 359866 - DNA, 25 bp, Homo sapien
tggatccacagagctctcagttttt

SEQ ID NO: 359867 - DNA, 25 bp, Homo sapien
ctgtcctgtaatgtgctaatgtctg

SEQ ID NO: 359868 - DNA, 25 bp, Homo sapien
aacctttgtatggagatgattttat

SEQ ID NO: 359869 - DNA, 25 bp, Homo sapien
ggagatgattttataaccatgcact

SEQ ID NO: 359870 - DNA, 25 bp, Homo sapien
tataaccatgcacttttgtaactgt

SEQ ID NO: 359871 - DNA, 25 bp, Homo sapien
gtaattccctggcaccatgatagca

SEQ ID NO: 359872 - DNA, 25 bp, Homo sapien
tccctggcaccatgatagcattatt

SEQ ID NO: 359873 - DNA, 25 bp, Homo sapien
gatagcattattgtggtagtactgc

SEQ ID NO: 359874 - DNA, 25 bp, Homo sapien
tagtactgctaggtgagggaatggt

SEQ ID NO: 359875 - DNA, 25 bp, Homo sapien
ggaatggtatgttaagtctgttttt

SEQ ID NO: 359876 - DNA, 25 bp, Homo sapien
gaatacgagttcacaatcacgaaat

SEQ ID NO: 359877 - DNA, 25 bp, Homo sapien
gagttcacaatcacgaaatacagat

SEQ ID NO: 359878 - DNA, 25 bp, Homo sapien
tacatggagcaagttgctgtcataa

SEQ ID NO: 359879 - DNA, 25 bp, Homo sapien
caagttgctgtcataaaagctgcct

SEQ ID NO: 359880 - DNA, 25 bp, Homo sapien
caagtaagtcagtgttgatacatga

SEQ ID NO: 359881 - DNA, 25 bp, Homo sapien
gtcagtgttgatacatgagttttga

SEQ ID NO: 359882 - DNA, 25 bp, Homo sapien
agcctccaaaactactcctgcaaga

SEQ ID NO: 359883 - DNA, 25 bp, Homo sapien
ctccaaaactactcctgcaagatga

SEQ ID NO: 359884 - DNA, 25 bp, Homo sapien
ctgcaagatgagtagtcagtgactt

SEQ ID NO: 359885 - DNA, 25 bp, Homo sapien
agatgagtagtcagtgacttcctga

SEQ ID NO: 359886 - DNA, 25 bp, Homo sapien
cagtgacttcctgagtagaaatcaa

SEQ ID NO: 359887 - DNA, 25 bp, Homo sapien
gacttcctgagtagaaatcaaatga

SEQ ID NO: 359888 - DNA, 25 bp, Homo sapien
aatcaaatgatctacaatggtttta

SEQ ID NO: 359889 - DNA, 25 bp, Homo sapien
aaatactttgtcactggccaggtac

SEQ ID NO: 359890 - DNA, 25 bp, Homo sapien
atactttgtcactggccaggtactc

SEQ ID NO: 359891 - DNA, 25 bp, Homo sapien
actggccaggtactccctttagaag

SEQ ID NO: 359892 - DNA, 25 bp, Homo sapien
gccaggtactccctttagaagcagg

SEQ ID NO: 359893 - DNA, 25 bp, Homo sapien
ggctctgcgctccatcgggctcaaa

SEQ ID NO: 359894 - DNA, 25 bp, Homo sapien
tccatcgggctcaaatgcctggaac

SEQ ID NO: 359895 - DNA, 25 bp, Homo sapien
ggctcaaatgcctggaacatctctt

SEQ ID NO: 359896 - DNA, 25 bp, Homo sapien
ggaggcgccgcaccaaatgacttag

SEQ ID NO: 359897 - DNA, 25 bp, Homo sapien
caccaaatgacttaggcctgcgggc

SEQ ID NO: 359898 - DNA, 25 bp, Homo sapien
aatgacttaggcctgcgggcccatc

SEQ ID NO: 359899 - DNA, 25 bp, Homo sapien
cctggacgccagctgttcttctcag

SEQ ID NO: 359900 - DNA, 25 bp, Homo sapien
tgtttggactttggggcacagcctg

SEQ ID NO: 359901 - DNA, 25 bp, Homo sapien
agcctgtcactgctctgcctaagag

SEQ ID NO: 359902 - DNA, 25 bp, Homo sapien
tgtcactgctctgcctaagagatgt

SEQ ID NO: 359903 - DNA, 25 bp, Homo sapien
ctgctctgcctaagagatgtgttgt

SEQ ID NO: 359904 - DNA, 25 bp, Homo sapien
ggaagctccgtaattcacagtgatt

SEQ ID NO: 359905 - DNA, 25 bp, Homo sapien
gggtcatcactctgtaggagctata

SEQ ID NO: 359906 - DNA, 25 bp, Homo sapien
gagactctgtccatgatttccaaaa

SEQ ID NO: 359907 - DNA, 25 bp, Homo sapien
atttccaaaaggtcatccaccccag

SEQ ID NO: 359908 - DNA, 25 bp, Homo sapien
gcaaatctttttcattaattggctt

SEQ ID NO: 359909 - DNA, 25 bp, Homo sapien
ctttcagcttcaaatggaggtctct

SEQ ID NO: 359910 - DNA, 25 bp, Homo sapien
atggaggtctctaagggtccttggc

SEQ ID NO: 359911 - DNA, 25 bp, Homo sapien
aagggtccttggctggcacatcaag

SEQ ID NO: 359912 - DNA, 25 bp, Homo sapien
cattgttaccattgtcgctgttcta

SEQ ID NO: 359913 - DNA, 25 bp, Homo sapien
gtcgctgttctatatgctgaatctt

SEQ ID NO: 359914 - DNA, 25 bp, Homo sapien
aatcttgtttaatttggaagctccg

SEQ ID NO: 359915 - DNA, 25 bp, Homo sapien
agctggaataattggttgttgatac

SEQ ID NO: 359916 - DNA, 25 bp, Homo sapien
ggttgttgatacagaagtgaccaaa

SEQ ID NO: 359917 - DNA, 25 bp, Homo sapien
gataaacacattccttttgagctta

SEQ ID NO: 359918 - DNA, 25 bp, Homo sapien
aacacattccttttgagcttataat

SEQ ID NO: 359919 - DNA, 25 bp, Homo sapien
attccttttgagcttataatgacaa

SEQ ID NO: 359920 - DNA, 25 bp, Homo sapien
gaataagacccattaagtcagtgaa

SEQ ID NO: 359921 - DNA, 25 bp, Homo sapien
gacccattaagtcagtgaattttag

SEQ ID NO: 359922 - DNA, 25 bp, Homo sapien
gatggaatcctaatgtgatcacaga

SEQ ID NO: 359923 - DNA, 25 bp, Homo sapien
tgatcacagatcattccggtgagga

SEQ ID NO: 359924 - DNA, 25 bp, Homo sapien
cagatcattccggtgaggaagcaaa

SEQ ID NO: 359925 - DNA, 25 bp, Homo sapien
cacagaaattctttgataagctcta

SEQ ID NO: 359926 - DNA, 25 bp, Homo sapien
gagccggcacatgaaggtcaagcat

SEQ ID NO: 359927 - DNA, 25 bp, Homo sapien
aaggtcaagcatggcgtcatggaca

SEQ ID NO: 359928 - DNA, 25 bp, Homo sapien
gcgtcatggacatcggcctggacag

SEQ ID NO: 359929 - DNA, 25 bp, Homo sapien
tgggccaagcgcaatggacagagca

SEQ ID NO: 359930 - DNA, 25 bp, Homo sapien
gacagagcaggaatgataccaacat

SEQ ID NO: 359931 - DNA, 25 bp, Homo sapien
gataccaacatgacgcactcaggag

SEQ ID NO: 359932 - DNA, 25 bp, Homo sapien
acatgacgcactcaggagcctcctg

SEQ ID NO: 359933 - DNA, 25 bp, Homo sapien
ctggccaaggctgagacttcgttgg

SEQ ID NO: 359934 - DNA, 25 bp, Homo sapien
aagtgcccctactgctccagcaagt

SEQ ID NO: 359935 - DNA, 25 bp, Homo sapien
tgctccagcaagtttaatctcaagg

SEQ ID NO: 359936 - DNA, 25 bp, Homo sapien
aatctcaagggcaacctgagccggc

SEQ ID NO: 359937 - DNA, 25 bp, Homo sapien
gatgtaaaaagattcccaaacgtgg

SEQ ID NO: 359938 - DNA, 25 bp, Homo sapien
aacgtggttacattagccattcatg

SEQ ID NO: 359939 - DNA, 25 bp, Homo sapien
gccattcatgtatgtcagaagtgca

SEQ ID NO: 359940 - DNA, 25 bp, Homo sapien
gggcacttaatggtcaccttgtaac

SEQ ID NO: 359941 - DNA, 25 bp, Homo sapien
aatggtcaccttgtaacagttttgt

SEQ ID NO: 359942 - DNA, 25 bp, Homo sapien
gttttgtgtaactcccagtgatgct

SEQ ID NO: 359943 - DNA, 25 bp, Homo sapien
taactcccagtgatgctgtacacat

SEQ ID NO: 359944 - DNA, 25 bp, Homo sapien
gctgtacacatatttgaagggtctt

SEQ ID NO: 359945 - DNA, 25 bp, Homo sapien
gctcagtgtttttgtgaattgcttg

SEQ ID NO: 359946 - DNA, 25 bp, Homo sapien
attctgagcctgatattgatatggt

SEQ ID NO: 359947 - DNA, 25 bp, Homo sapien
aagaagcagttgtaccaagtgaaat

SEQ ID NO: 359948 - DNA, 25 bp, Homo sapien
aaaccaaattgacacagctggcccc

SEQ ID NO: 359949 - DNA, 25 bp, Homo sapien
gttcccacctgctgagagttcagaa

SEQ ID NO: 359950 - DNA, 25 bp, Homo sapien
agttcagaactcagaccgtaggtgt

SEQ ID NO: 359951 - DNA, 25 bp, Homo sapien
actcagaccgtaggtgtgggcttat

SEQ ID NO: 359952 - DNA, 25 bp, Homo sapien
tgtgggcttatgagactgtgcttca

SEQ ID NO: 359953 - DNA, 25 bp, Homo sapien
ggcttatgagactgtgcttcatgaa

SEQ ID NO: 359954 - DNA, 25 bp, Homo sapien
aaattcaaactgttggagtgagcca

SEQ ID NO: 359955 - DNA, 25 bp, Homo sapien
gtgagccaagtggacagaccctcca

SEQ ID NO: 359956 - DNA, 25 bp, Homo sapien
agtggacagaccctccatgagtgca

SEQ ID NO: 359957 - DNA, 25 bp, Homo sapien
agaccctccatgagtgcactttctt

SEQ ID NO: 359958 - DNA, 25 bp, Homo sapien
ccatgagtgcactttcttccaagaa

SEQ ID NO: 359959 - DNA, 25 bp, Homo sapien
gaagaaccttggtggttccaacata

SEQ ID NO: 359960 - DNA, 25 bp, Homo sapien
ggtggttccaacatagtatggccat

SEQ ID NO: 359961 - DNA, 25 bp, Homo sapien
ggttccaacatagtatggccattgt

SEQ ID NO: 359962 - DNA, 25 bp, Homo sapien
gtatggccattgttttatactcaaa

SEQ ID NO: 359963 - DNA, 25 bp, Homo sapien
tatagaaagacaacctcagaataag

SEQ ID NO: 359964 - DNA, 25 bp, Homo sapien
cccaatcctgattcctgtttacaaa

SEQ ID NO: 359965 - DNA, 25 bp, Homo sapien
caatcctgattcctgtttacaaaga

SEQ ID NO: 359966 - DNA, 25 bp, Homo sapien
gattcctgtttacaaagaatgttga

SEQ ID NO: 359967 - DNA, 25 bp, Homo sapien
gaattatgtataacagttcccagtt

SEQ ID NO: 359968 - DNA, 25 bp, Homo sapien
ataacagttcccagtttgctcagga

SEQ ID NO: 359969 - DNA, 25 bp, Homo sapien
ttgctcaggaaattctcagattata

SEQ ID NO: 359970 - DNA, 25 bp, Homo sapien
tgcgggatccccacgatggagcaag

SEQ ID NO: 359971 - DNA, 25 bp, Homo sapien
gcaatgacaatatcagctgtggcta

SEQ ID NO: 359972 - DNA, 25 bp, Homo sapien
ctccagtggtagctgcagtgataat

SEQ ID NO: 359973 - DNA, 25 bp, Homo sapien
ttctcacggtggcagcttcaaggac

SEQ ID NO: 359974 - DNA, 25 bp, Homo sapien
tagtgatggtccaatggcgcccaga

SEQ ID NO: 359975 - DNA, 25 bp, Homo sapien
ggcgcccagacctagaaatgcacat

SEQ ID NO: 359976 - DNA, 25 bp, Homo sapien
gaaatgcacatttcctcagcaccgg

SEQ ID NO: 359977 - DNA, 25 bp, Homo sapien
agcaccggctccagatgctgagctt

SEQ ID NO: 359978 - DNA, 25 bp, Homo sapien
ataatgctgcagtgccgacagttct

SEQ ID NO: 359979 - DNA, 25 bp, Homo sapien
ggagcaacaacagtgatttcagcag

SEQ ID NO: 359980 - DNA, 25 bp, Homo sapien
gcagcagcagtattgcgggatcccc

SEQ ID NO: 359981 - DNA, 25 bp, Homo sapien
ttattacatgcggttatttccctaa

SEQ ID NO: 359982 - DNA, 25 bp, Homo sapien
atttccctaacgatgtgctattcac

SEQ ID NO: 359983 - DNA, 25 bp, Homo sapien
tgtgctattcacgttcatcttcaaa

SEQ ID NO: 359984 - DNA, 25 bp, Homo sapien
ttcaaactcattttccatcagccag

SEQ ID NO: 359985 - DNA, 25 bp, Homo sapien
ttttccatcagccagtgtctactat

SEQ ID NO: 359986 - DNA, 25 bp, Homo sapien
gtgtctactatttagtgccctggct

SEQ ID NO: 359987 - DNA, 25 bp, Homo sapien
tatttagtgccctggctctatttcg

SEQ ID NO: 359988 - DNA, 25 bp, Homo sapien
tttattctctccattggctgctgct

SEQ ID NO: 359989 - DNA, 25 bp, Homo sapien
gaggtgtgacctcactagcgttgac

SEQ ID NO: 359990 - DNA, 25 bp, Homo sapien
ctagcgttgactgagcgagtctgtt

SEQ ID NO: 359991 - DNA, 25 bp, Homo sapien
gcgagtctgttgtggagaagaactt

SEQ ID NO: 359992 - DNA, 25 bp, Homo sapien
ggattcagtcattttgtacaagtta

SEQ ID NO: 359993 - DNA, 25 bp, Homo sapien
tacctcattaggaactcaaagttgc

SEQ ID NO: 359994 - DNA, 25 bp, Homo sapien
aaagttgctaagatgctgcttccgt

SEQ ID NO: 359995 - DNA, 25 bp, Homo sapien
gatgctgcttccgttgtctgtagac

SEQ ID NO: 359996 - DNA, 25 bp, Homo sapien
ttgtctgtagaccttctggtccata

SEQ ID NO: 359997 - DNA, 25 bp, Homo sapien
gaccttctggtccatataaccattt

SEQ ID NO: 359998 - DNA, 25 bp, Homo sapien
ccatttatgtgtagtcagtcttaaa

SEQ ID NO: 359999 - DNA, 25 bp, Homo sapien
gaaggcttagggacactttataaga

SEQ ID NO: 360000 - DNA, 25 bp, Homo sapien
tataagacaagatcctctaggtgct

SEQ ID NO: 360001 - DNA, 25 bp, Homo sapien
agatcctctaggtgctagtcacttc

SEQ ID NO: 360002 - DNA, 25 bp, Homo sapien
cctctaggtgctagtcacttcttaa

SEQ ID NO: 360003 - DNA, 25 bp, Homo sapien
taaataagctctccccaaacttgct

SEQ ID NO: 360004 - DNA, 25 bp, Homo sapien
ccaaacttgctttatgccttcttat

SEQ ID NO: 360005 - DNA, 25 bp, Homo sapien
aacttgctttatgccttcttattgc

SEQ ID NO: 360006 - DNA, 25 bp, Homo sapien
gccttcttattgcttttatgatata

SEQ ID NO: 360007 - DNA, 25 bp, Homo sapien
gatatatatatgcttggctaactat

SEQ ID NO: 360008 - DNA, 25 bp, Homo sapien
gcttggctaactatatttgcttttt

SEQ ID NO: 360009 - DNA, 25 bp, Homo sapien
ggctaactatatttgctttttgcta

SEQ ID NO: 360010 - DNA, 25 bp, Homo sapien
tatttgctttttgctaacaatgctc

SEQ ID NO: 360011 - DNA, 25 bp, Homo sapien
gggtctttttatgcatttgcatttg

SEQ ID NO: 360012 - DNA, 25 bp, Homo sapien
atttgcatttgctctttcatctctg

SEQ ID NO: 360013 - DNA, 25 bp, Homo sapien
ctttcatctctgcttggattatttt

SEQ ID NO: 360014 - DNA, 25 bp, Homo sapien
gaaacccaacttagggggcttgcag

SEQ ID NO: 360015 - DNA, 25 bp, Homo sapien
gggcttgcagaacataattcctttt

SEQ ID NO: 360016 - DNA, 25 bp, Homo sapien
aacaggggccgcatttatcaaactt

SEQ ID NO: 360017 - DNA, 25 bp, Homo sapien
aggggccgcatttatcaaacttgcc

SEQ ID NO: 360018 - DNA, 25 bp, Homo sapien
tatcaaacttgccaacaggaaaaca

SEQ ID NO: 360019 - DNA, 25 bp, Homo sapien
caaacttgccaacaggaaaacacct

SEQ ID NO: 360020 - DNA, 25 bp, Homo sapien
aacttgccaacaggaaaacaccttg

SEQ ID NO: 360021 - DNA, 25 bp, Homo sapien
acttgccaacaggaaaacaccttga

SEQ ID NO: 360022 - DNA, 25 bp, Homo sapien
cttgccaacaggaaaacaccttgaa

SEQ ID NO: 360023 - DNA, 25 bp, Homo sapien
ttgccaacaggaaaacaccttgaat

SEQ ID NO: 360024 - DNA, 25 bp, Homo sapien
tgccaacaggaaaacaccttgaatg

SEQ ID NO: 360025 - DNA, 25 bp, Homo sapien
ttctctagctctgacctctgggtga

SEQ ID NO: 360026 - DNA, 25 bp, Homo sapien
ccctcagttgttgattgctctcact

SEQ ID NO: 360027 - DNA, 25 bp, Homo sapien
agttgttgattgctctcactcccct

SEQ ID NO: 360028 - DNA, 25 bp, Homo sapien
actccccttggctgttgtgcttcat

SEQ ID NO: 360029 - DNA, 25 bp, Homo sapien
gttgtgcttcatggccagcactctt

SEQ ID NO: 360030 - DNA, 25 bp, Homo sapien
cttgatgagggtcttggtctataaa

SEQ ID NO: 360031 - DNA, 25 bp, Homo sapien
gggtcttggtctataaacaggcata

SEQ ID NO: 360032 - DNA, 25 bp, Homo sapien
aacaggcatagatagctagaacata

SEQ ID NO: 360033 - DNA, 25 bp, Homo sapien
ccttctacttctctatacatttcag

SEQ ID NO: 360034 - DNA, 25 bp, Homo sapien
tacatttcagattctctacagtaag

SEQ ID NO: 360035 - DNA, 25 bp, Homo sapien
agattctctacagtaagcatgtgtt

SEQ ID NO: 360036 - DNA, 25 bp, Homo sapien
gctttggtctatattgagattttct

SEQ ID NO: 360037 - DNA, 25 bp, Homo sapien
gtctaatttatgttgctaagtgttc

SEQ ID NO: 360038 - DNA, 25 bp, Homo sapien
tttgaaatgccctttggattcttgg

SEQ ID NO: 360039 - DNA, 25 bp, Homo sapien
aatgccctttggattcttgggaagg

SEQ ID NO: 360040 - DNA, 25 bp, Homo sapien
aaagtgtatctttgtagtctgttta

SEQ ID NO: 360041 - DNA, 25 bp, Homo sapien
agtgtatctttgtagtctgtttata

SEQ ID NO: 360042 - DNA, 25 bp, Homo sapien
atgttgctaagtgttctggaattat

SEQ ID NO: 360043 - DNA, 25 bp, Homo sapien
attattttgatttctgtggtccaac

SEQ ID NO: 360044 - DNA, 25 bp, Homo sapien
attttgatttctgtggtccaacaat

SEQ ID NO: 360045 - DNA, 25 bp, Homo sapien
tgatttctgtggtccaacaatttgg

SEQ ID NO: 360046 - DNA, 25 bp, Homo sapien
ttctgtggtccaacaatttggaatg

SEQ ID NO: 360047 - DNA, 25 bp, Homo sapien
cttgagacaggtttattagttaatt

SEQ ID NO: 360048 - DNA, 25 bp, Homo sapien
tattagttaattagtgatttcacag

SEQ ID NO: 360049 - DNA, 25 bp, Homo sapien
tagtgatttcacagtatcctttcgc

SEQ ID NO: 360050 - DNA, 25 bp, Homo sapien
agtgatttcacagtatcctttcgca

SEQ ID NO: 360051 - DNA, 25 bp, Homo sapien
gtgatttcacagtatcctttcgcag

SEQ ID NO: 360052 - DNA, 25 bp, Homo sapien
tgatttcacagtatcctttcgcagg

SEQ ID NO: 360053 - DNA, 25 bp, Homo sapien
gatttcacagtatcctttcgcaggc

SEQ ID NO: 360054 - DNA, 25 bp, Homo sapien
atttcacagtatcctttcgcaggcc

SEQ ID NO: 360055 - DNA, 25 bp, Homo sapien
ttcacagtatcctttcgcaggccga

SEQ ID NO: 360056 - DNA, 25 bp, Homo sapien
tcacagtatcctttcgcaggccgat

SEQ ID NO: 360057 - DNA, 25 bp, Homo sapien
acagtatcctttcgcaggccgatcc

SEQ ID NO: 360058 - DNA, 25 bp, Homo sapien
ggccaatctggaatagagacatttt

SEQ ID NO: 360059 - DNA, 25 bp, Homo sapien
gagacattttatttggttagtgcaa

SEQ ID NO: 360060 - DNA, 25 bp, Homo sapien
gagtgaaagctagcatttgttaacc

SEQ ID NO: 360061 - DNA, 25 bp, Homo sapien
atttatctgtgtacaattgtttttg

SEQ ID NO: 360062 - DNA, 25 bp, Homo sapien
tgtttttgcttctggtaatgaatta

SEQ ID NO: 360063 - DNA, 25 bp, Homo sapien
caggtttactgtgtaaatctgcatt

SEQ ID NO: 360064 - DNA, 25 bp, Homo sapien
gtgtaaatctgcatttttggtggta

SEQ ID NO: 360065 - DNA, 25 bp, Homo sapien
gcatttttggtggtaaatccctttg

SEQ ID NO: 360066 - DNA, 25 bp, Homo sapien
gtaaatccctttgccacagattcag

SEQ ID NO: 360067 - DNA, 25 bp, Homo sapien
tttgccacagattcagtagcttttg

SEQ ID NO: 360068 - DNA, 25 bp, Homo sapien
gtagcttttggtaaacttcactgtt

SEQ ID NO: 360069 - DNA, 25 bp, Homo sapien
atctgagcaattgttcattgatcga

SEQ ID NO: 360070 - DNA, 25 bp, Homo sapien
cagagattttgttggaagtttccat

SEQ ID NO: 360071 - DNA, 25 bp, Homo sapien
tgatcgataatctatgttcttacat

SEQ ID NO: 360072 - DNA, 25 bp, Homo sapien
aactggctattttgttcttacttag

SEQ ID NO: 360073 - DNA, 25 bp, Homo sapien
cttagttttatgtgtatgtccaggc

SEQ ID NO: 360074 - DNA, 25 bp, Homo sapien
gtatgtccaggcatttgccactgct

SEQ ID NO: 360075 - DNA, 25 bp, Homo sapien
atttgccactgctcctaaatagctc

SEQ ID NO: 360076 - DNA, 25 bp, Homo sapien
tcctaaatagctctccctgaagtct

SEQ ID NO: 360077 - DNA, 25 bp, Homo sapien
ccctgaagtcttctggtcatgagtt

SEQ ID NO: 360078 - DNA, 25 bp, Homo sapien
cttctggtcatgagttaggtttctt

SEQ ID NO: 360079 - DNA, 25 bp, Homo sapien
gtgacaggaatttgaggactaacat

SEQ ID NO: 360080 - DNA, 25 bp, Homo sapien
ctgtgtggagaggaccattcccgtt

SEQ ID NO: 360081 - DNA, 25 bp, Homo sapien
gagaggaccattcccgttttgctca

SEQ ID NO: 360082 - DNA, 25 bp, Homo sapien
ccgttttgctcaccagaactggaga

SEQ ID NO: 360083 - DNA, 25 bp, Homo sapien
agaactggagattcttctgcccgcc

SEQ ID NO: 360084 - DNA, 25 bp, Homo sapien
aattttattcaggaaatggccttgt

SEQ ID NO: 360085 - DNA, 25 bp, Homo sapien
aagtctctccaaattattccatcct

SEQ ID NO: 360086 - DNA, 25 bp, Homo sapien
aaattattccatcctacctggtgca

SEQ ID NO: 360087 - DNA, 25 bp, Homo sapien
atcctacctggtgcagccattgaaa

SEQ ID NO: 360088 - DNA, 25 bp, Homo sapien
aaactcttcagttcacctggcaatg

SEQ ID NO: 360089 - DNA, 25 bp, Homo sapien
ttcagttcacctggcaatgagtcag

SEQ ID NO: 360090 - DNA, 25 bp, Homo sapien
aatgagtcagatgggcctcctggcc

SEQ ID NO: 360091 - DNA, 25 bp, Homo sapien
tgttgagctccaagcatggaacact

SEQ ID NO: 360092 - DNA, 25 bp, Homo sapien
aacactggagttggttcattttgac

SEQ ID NO: 360093 - DNA, 25 bp, Homo sapien
ttcattttgaccagcaagcctctaa

SEQ ID NO: 360094 - DNA, 25 bp, Homo sapien
gcctctaaatgggtgccttgattac

SEQ ID NO: 360095 - DNA, 25 bp, Homo sapien
cttgattacccaccgcaaggagagg

SEQ ID NO: 360096 - DNA, 25 bp, Homo sapien
atgacatgttaattccagccaggtg

SEQ ID NO: 360097 - DNA, 25 bp, Homo sapien
caggtgagtcaccaggtagctctca

SEQ ID NO: 360098 - DNA, 25 bp, Homo sapien
gggcaggcacctagtcacatgggta

SEQ ID NO: 360099 - DNA, 25 bp, Homo sapien
gcctgtcggtttggcattgtcagat

SEQ ID NO: 360100 - DNA, 25 bp, Homo sapien
actggctttggctccagggccagag

SEQ ID NO: 360101 - DNA, 25 bp, Homo sapien
cagtctgacttagtgttgagctcca

SEQ ID NO: 360102 - DNA, 25 bp, Homo sapien
cattgggcttatgagaattagtctt

SEQ ID NO: 360103 - DNA, 25 bp, Homo sapien
atttaatatcctgacatgagcttac

SEQ ID NO: 360104 - DNA, 25 bp, Homo sapien
aggtatcttaacatgctgacaaatt

SEQ ID NO: 360105 - DNA, 25 bp, Homo sapien
attttgcttgccttgctaatggtga

SEQ ID NO: 360106 - DNA, 25 bp, Homo sapien
atggtgagcactacaagaggaaaac

SEQ ID NO: 360107 - DNA, 25 bp, Homo sapien
accagtatgtggtcatcgtcatagt

SEQ ID NO: 360108 - DNA, 25 bp, Homo sapien
attacagtaaattctcctccctaag

SEQ ID NO: 360109 - DNA, 25 bp, Homo sapien
gatttgagacgtttctgatggtgta

SEQ ID NO: 360110 - DNA, 25 bp, Homo sapien
ggcaaagtcacttaatttccacatg

SEQ ID NO: 360111 - DNA, 25 bp, Homo sapien
aatttccacatgcagtcatgcctag

SEQ ID NO: 360112 - DNA, 25 bp, Homo sapien
atgcagtcatgcctagagatgtgct

SEQ ID NO: 360113 - DNA, 25 bp, Homo sapien
ggcctcacgctctttgcagtctatg

SEQ ID NO: 360114 - DNA, 25 bp, Homo sapien
tttgcagtctatgcgtccaacgtgc

SEQ ID NO: 360115 - DNA, 25 bp, Homo sapien
tatgcgtccaacgtgctcttttgcg

SEQ ID NO: 360116 - DNA, 25 bp, Homo sapien
tcttttgcgcgctgcccaacatggg

SEQ ID NO: 360117 - DNA, 25 bp, Homo sapien
ccaacatgggtctcggtagctcgcg

SEQ ID NO: 360118 - DNA, 25 bp, Homo sapien
gtagctcgcggctgcagtacccaga

SEQ ID NO: 360119 - DNA, 25 bp, Homo sapien
agacacctggtgcttcatcgactgg

SEQ ID NO: 360120 - DNA, 25 bp, Homo sapien
tactcctacatgtacgcgggcttca

SEQ ID NO: 360121 - DNA, 25 bp, Homo sapien
gtcctctgcaacgtgcttgtgtgcg

SEQ ID NO: 360122 - DNA, 25 bp, Homo sapien
tggccatcaaccatgcctatttcta

SEQ ID NO: 360123 - DNA, 25 bp, Homo sapien
tggacaagcgattggcgggcctcac

SEQ ID NO: 360124 - DNA, 25 bp, Homo sapien
gaggtagcactttttttgatccagg

SEQ ID NO: 360125 - DNA, 25 bp, Homo sapien
gttggaacgtgtttccctccatatt

SEQ ID NO: 360126 - DNA, 25 bp, Homo sapien
tccatattcctcacgtctattttag

SEQ ID NO: 360127 - DNA, 25 bp, Homo sapien
tcacgtctattttagcttttccttc

SEQ ID NO: 360128 - DNA, 25 bp, Homo sapien
ttccttccatttgtttcttactctt

SEQ ID NO: 360129 - DNA, 25 bp, Homo sapien
tctttctaacattctctgctagtgt

SEQ ID NO: 360130 - DNA, 25 bp, Homo sapien
aacattctctgctagtgtttgaaga

SEQ ID NO: 360131 - DNA, 25 bp, Homo sapien
cctaataaccttcctgccagatttt

SEQ ID NO: 360132 - DNA, 25 bp, Homo sapien
gtttagaaactagaccaggagctga

SEQ ID NO: 360133 - DNA, 25 bp, Homo sapien
ggaagcagtcaaaaactctccatga

SEQ ID NO: 360134 - DNA, 25 bp, Homo sapien
aactctccatgagtgaagaggtagc

SEQ ID NO: 360135 - DNA, 25 bp, Homo sapien
ccagagtttcaatgacactgaagga

SEQ ID NO: 360136 - DNA, 25 bp, Homo sapien
tgaaggaaaacagtcttctgcagcc

SEQ ID NO: 360137 - DNA, 25 bp, Homo sapien
atgttgctgcggtctccctggagtc

SEQ ID NO: 360138 - DNA, 25 bp, Homo sapien
ttcctgctggctcagctcactgaat

SEQ ID NO: 360139 - DNA, 25 bp, Homo sapien
catccagggagctgtcaggacgtca

SEQ ID NO: 360140 - DNA, 25 bp, Homo sapien
ctgtcaggacgtcagcaggttagct

SEQ ID NO: 360141 - DNA, 25 bp, Homo sapien
gacgtcagcaggttagctgggccat

SEQ ID NO: 360142 - DNA, 25 bp, Homo sapien
tgggccatggcaggaacgctaccat

SEQ ID NO: 360143 - DNA, 25 bp, Homo sapien
gaacgctaccattgtttgggcctaa

SEQ ID NO: 360144 - DNA, 25 bp, Homo sapien
tttgggcctaatgccagtgtagagg

SEQ ID NO: 360145 - DNA, 25 bp, Homo sapien
cagtttttcttccaactctcctaag

SEQ ID NO: 360146 - DNA, 25 bp, Homo sapien
gttgaacaactttgcaatgcccttt

SEQ ID NO: 360147 - DNA, 25 bp, Homo sapien
aacaactttgcaatgccctttcatc

SEQ ID NO: 360148 - DNA, 25 bp, Homo sapien
atgccctttcatcttccattaaatt

SEQ ID NO: 360149 - DNA, 25 bp, Homo sapien
ggataggaatgttcattacccgctt

SEQ ID NO: 360150 - DNA, 25 bp, Homo sapien
taggaatgttcattacccgctttta

SEQ ID NO: 360151 - DNA, 25 bp, Homo sapien
tacccgcttttaccccaagatgact

SEQ ID NO: 360152 - DNA, 25 bp, Homo sapien
gatgactagaatacccgttttttgt

SEQ ID NO: 360153 - DNA, 25 bp, Homo sapien
taaagtgtggcctgagcctatctac

SEQ ID NO: 360154 - DNA, 25 bp, Homo sapien
tggcctgagcctatctacctcgaat

SEQ ID NO: 360155 - DNA, 25 bp, Homo sapien
tgagcctatctacctcgaatccttc

SEQ ID NO: 360156 - DNA, 25 bp, Homo sapien
gagcaccatgtttgtgcaattttga

SEQ ID NO: 360157 - DNA, 25 bp, Homo sapien
aagtgcaccctggtccgcgcccaga

SEQ ID NO: 360158 - DNA, 25 bp, Homo sapien
ctggtccgcgcccagagctctctgg

SEQ ID NO: 360159 - DNA, 25 bp, Homo sapien
gaggccaaacgcaagggccctcctg

SEQ ID NO: 360160 - DNA, 25 bp, Homo sapien
aggccaaacgcaagggccctcctgg

SEQ ID NO: 360161 - DNA, 25 bp, Homo sapien
tggagtccccagccctacttcggag

SEQ ID NO: 360162 - DNA, 25 bp, Homo sapien
ccaagtgagagaaattgggcacccc

SEQ ID NO: 360163 - DNA, 25 bp, Homo sapien
gtgagagaaattgggcacccccgcc

SEQ ID NO: 360164 - DNA, 25 bp, Homo sapien
gagaggtccccgcacacccgctctg

SEQ ID NO: 360165 - DNA, 25 bp, Homo sapien
ggccgcacgccgtactgcgggcgtg

SEQ ID NO: 360166 - DNA, 25 bp, Homo sapien
tactgcgggcgtggaggcgcaagcc

SEQ ID NO: 360167 - DNA, 25 bp, Homo sapien
ggcgtggaggcgcaagcccggcggc

SEQ ID NO: 360168 - DNA, 25 bp, Homo sapien
ggccagtgtaaggtcgatcccagag

SEQ ID NO: 360169 - DNA, 25 bp, Homo sapien
gtgtaaggtcgatcccagaggctga

SEQ ID NO: 360170 - DNA, 25 bp, Homo sapien
taaggtcgatcccagaggctgatct

SEQ ID NO: 360171 - DNA, 25 bp, Homo sapien
ggctgatctgcaaatcaagctacat

SEQ ID NO: 360172 - DNA, 25 bp, Homo sapien
aatcaagctacatgtatttgtgtat

SEQ ID NO: 360173 - DNA, 25 bp, Homo sapien
atttgtgtataagaccctgtgttca

SEQ ID NO: 360174 - DNA, 25 bp, Homo sapien
gtataagaccctgtgttcaggactg

SEQ ID NO: 360175 - DNA, 25 bp, Homo sapien
gtgttcaggactgggtgacttttct

SEQ ID NO: 360176 - DNA, 25 bp, Homo sapien
tgggtttggcttccttctcacattt

SEQ ID NO: 360177 - DNA, 25 bp, Homo sapien
ttggcttccttctcacatttcttta

SEQ ID NO: 360178 - DNA, 25 bp, Homo sapien
tccttctcacatttctttagctttg

SEQ ID NO: 360179 - DNA, 25 bp, Homo sapien
acacctatgtcatttcatttcctat

SEQ ID NO: 360180 - DNA, 25 bp, Homo sapien
aaccctgggacgtggctagtcataa

SEQ ID NO: 360181 - DNA, 25 bp, Homo sapien
gggacgtggctagtcataaccttac

SEQ ID NO: 360182 - DNA, 25 bp, Homo sapien
ggctagtcataaccttaccagattt

SEQ ID NO: 360183 - DNA, 25 bp, Homo sapien
aaccttaccagatttttacacatgt

SEQ ID NO: 360184 - DNA, 25 bp, Homo sapien
gtatctatgcattttctggacccgt

SEQ ID NO: 360185 - DNA, 25 bp, Homo sapien
gcattttctggacccgttcaacttt

SEQ ID NO: 360186 - DNA, 25 bp, Homo sapien
ttttcctttgaatcctctctctgtg

SEQ ID NO: 360187 - DNA, 25 bp, Homo sapien
tcctttgaatcctctctctgtgtta

SEQ ID NO: 360188 - DNA, 25 bp, Homo sapien
tgttacccagtaactcatctgtcac

SEQ ID NO: 360189 - DNA, 25 bp, Homo sapien
acccagtaactcatctgtcaccaag

SEQ ID NO: 360190 - DNA, 25 bp, Homo sapien
gggagaaaatgtttatccattgaat

SEQ ID NO: 360191 - DNA, 25 bp, Homo sapien
gtttatccattgaatctcaacagga

SEQ ID NO: 360192 - DNA, 25 bp, Homo sapien
atctcaacaggaggagtttcatatt

SEQ ID NO: 360193 - DNA, 25 bp, Homo sapien
ggaggagtttcatatttgttgctaa

SEQ ID NO: 360194 - DNA, 25 bp, Homo sapien
ttcatatttgttgctaagaggaatt

SEQ ID NO: 360195 - DNA, 25 bp, Homo sapien
aatgaggacccttgatgagatctac

SEQ ID NO: 360196 - DNA, 25 bp, Homo sapien
gaggacccttgatgagatctacaaa

SEQ ID NO: 360197 - DNA, 25 bp, Homo sapien
gacccttgatgagatctacaaatag

SEQ ID NO: 360198 - DNA, 25 bp, Homo sapien
aatcaaggtccaaagaatgtaaatt

SEQ ID NO: 360199 - DNA, 25 bp, Homo sapien
ataactttttctccatcctggaagt

SEQ ID NO: 360200 - DNA, 25 bp, Homo sapien
ctccatcctggaagttttttctagg

SEQ ID NO: 360201 - DNA, 25 bp, Homo sapien
atattattggcagacattgttgaag

SEQ ID NO: 360202 - DNA, 25 bp, Homo sapien
agccagacaaacaactacataaaat

SEQ ID NO: 360203 - DNA, 25 bp, Homo sapien
ttctatttagatgaagtggcaaact

SEQ ID NO: 360204 - DNA, 25 bp, Homo sapien
gtggcaaactaatctgtagtgttaa

SEQ ID NO: 360205 - DNA, 25 bp, Homo sapien
ttagtgattgcctgggccaagtggc

SEQ ID NO: 360206 - DNA, 25 bp, Homo sapien
gaggaaactttctccaatagatgag

SEQ ID NO: 360207 - DNA, 25 bp, Homo sapien
gatgagaattttccgtatcttgatc

SEQ ID NO: 360208 - DNA, 25 bp, Homo sapien
gaattttccgtatcttgatctgagt

SEQ ID NO: 360209 - DNA, 25 bp, Homo sapien
tccgtatcttgatctgagtggcaaa

SEQ ID NO: 360210 - DNA, 25 bp, Homo sapien
gatctgagtggcaaattgtaaactt

SEQ ID NO: 360211 - DNA, 25 bp, Homo sapien
gaaaattaagcctcaataaacgtga

SEQ ID NO: 360212 - DNA, 25 bp, Homo sapien
agtcatgtcccgtctgcaggtcgcg

SEQ ID NO: 360213 - DNA, 25 bp, Homo sapien
gtgtggagcatgtccagcacgtcta

SEQ ID NO: 360214 - DNA, 25 bp, Homo sapien
atgtccagcacgtctatctgccaac

SEQ ID NO: 360215 - DNA, 25 bp, Homo sapien
aacgcacaccagtcttctcaatctg

SEQ ID NO: 360216 - DNA, 25 bp, Homo sapien
gtcttctcaatctgactgtaatcta

SEQ ID NO: 360217 - DNA, 25 bp, Homo sapien
gactgtaatctaatctgttgtgctt

SEQ ID NO: 360218 - DNA, 25 bp, Homo sapien
atctgttgtgcttttgttggacttg

SEQ ID NO: 360219 - DNA, 25 bp, Homo sapien
gcttttgttggacttggcatgtttc

SEQ ID NO: 360220 - DNA, 25 bp, Homo sapien
tggacttggcatgtttccatgaact

SEQ ID NO: 360221 - DNA, 25 bp, Homo sapien
gtttccatgaactgcactattataa

SEQ ID NO: 360222 - DNA, 25 bp, Homo sapien
agtaattattccaacacccatctgc

SEQ ID NO: 360223 - DNA, 25 bp, Homo sapien
agagctccttggcacagagctcctc

SEQ ID NO: 360224 - DNA, 25 bp, Homo sapien
ggccaggagggcactgagttccact

SEQ ID NO: 360225 - DNA, 25 bp, Homo sapien
actgagttccactgcctgctctggg

SEQ ID NO: 360226 - DNA, 25 bp, Homo sapien
aagagggcctccttgatgtgcaaga

SEQ ID NO: 360227 - DNA, 25 bp, Homo sapien
agaaaaagatatgcctagtctgctc

SEQ ID NO: 360228 - DNA, 25 bp, Homo sapien
tgcctagtctgctcctgtaagatga

SEQ ID NO: 360229 - DNA, 25 bp, Homo sapien
gatgaggctccacgaagaacttgac

SEQ ID NO: 360230 - DNA, 25 bp, Homo sapien
ggctccacgaagaacttgactctaa

SEQ ID NO: 360231 - DNA, 25 bp, Homo sapien
ttgactctaagtttaagcctgtaag

SEQ ID NO: 360232 - DNA, 25 bp, Homo sapien
ctagcccatccatctgctgggagat

SEQ ID NO: 360233 - DNA, 25 bp, Homo sapien
tgggagatccggtttctcaggttta

SEQ ID NO: 360234 - DNA, 25 bp, Homo sapien
gttgtgtggcatttcatgtaggttt

SEQ ID NO: 360235 - DNA, 25 bp, Homo sapien
ttcatgtaggtttgtgctctgtgtg

SEQ ID NO: 360236 - DNA, 25 bp, Homo sapien
ctgtgtgtgttattagattgtcttc

SEQ ID NO: 360237 - DNA, 25 bp, Homo sapien
tattagattgtcttccagtcagaat

SEQ ID NO: 360238 - DNA, 25 bp, Homo sapien
cagaattcctggctgttaaactatt

SEQ ID NO: 360239 - DNA, 25 bp, Homo sapien
tgttaaactatttcatcagcaggag

SEQ ID NO: 360240 - DNA, 25 bp, Homo sapien
tcagcaggagttacatccctatgtt

SEQ ID NO: 360241 - DNA, 25 bp, Homo sapien
agttacatccctatgttgtaagggt

SEQ ID NO: 360242 - DNA, 25 bp, Homo sapien
aggtgataagtcgaattttttagct

SEQ ID NO: 360243 - DNA, 25 bp, Homo sapien
gtaagtgaggcgttacttttcgaca

SEQ ID NO: 360244 - DNA, 25 bp, Homo sapien
gaggcgttacttttcgacattttct

SEQ ID NO: 360245 - DNA, 25 bp, Homo sapien
ttgttttctctttcaggcttttcat

SEQ ID NO: 360246 - DNA, 25 bp, Homo sapien
gggttttctgtattccatgtactgg

SEQ ID NO: 360247 - DNA, 25 bp, Homo sapien
gtattccatgtactggccattcatg

SEQ ID NO: 360248 - DNA, 25 bp, Homo sapien
atgtactggccattcatgaatattt

SEQ ID NO: 360249 - DNA, 25 bp, Homo sapien
cattttgaccactaattattgacag

SEQ ID NO: 360250 - DNA, 25 bp, Homo sapien
gcttaaaatcacgatccatcctcga

SEQ ID NO: 360251 - DNA, 25 bp, Homo sapien
atccatcctcgatttcctaacagga

SEQ ID NO: 360252 - DNA, 25 bp, Homo sapien
catctttgaaagtcccaatcaccac

SEQ ID NO: 360253 - DNA, 25 bp, Homo sapien
tcccaatcaccaccgaattaacaaa

SEQ ID NO: 360254 - DNA, 25 bp, Homo sapien
cagcacagaactctcacagaactct

SEQ ID NO: 360255 - DNA, 25 bp, Homo sapien
ctctcacagaactctgcttttcatt

SEQ ID NO: 360256 - DNA, 25 bp, Homo sapien
acagatcaaggcacttcaactcatt

SEQ ID NO: 360257 - DNA, 25 bp, Homo sapien
cagatcaaggcacttcaactcattt

SEQ ID NO: 360258 - DNA, 25 bp, Homo sapien
agatcaaggcacttcaactcatttg

SEQ ID NO: 360259 - DNA, 25 bp, Homo sapien
gatcaaggcacttcaactcatttgg

SEQ ID NO: 360260 - DNA, 25 bp, Homo sapien
actcatttggaaaatgtgaacactg

SEQ ID NO: 360261 - DNA, 25 bp, Homo sapien
aatgggagccgctgccgtctttgaa

SEQ ID NO: 360262 - DNA, 25 bp, Homo sapien
atgggagccgctgccgtctttgaat

SEQ ID NO: 360263 - DNA, 25 bp, Homo sapien
ggagccgctgccgtctttgaatacc

SEQ ID NO: 360264 - DNA, 25 bp, Homo sapien
gagccgctgccgtctttgaataccc

SEQ ID NO: 360265 - DNA, 25 bp, Homo sapien
agccgctgccgtctttgaataccct

SEQ ID NO: 360266 - DNA, 25 bp, Homo sapien
gccgctgccgtctttgaataccctg

SEQ ID NO: 360267 - DNA, 25 bp, Homo sapien
tggctaatgcggtgaaacctcatct

SEQ ID NO: 360268 - DNA, 25 bp, Homo sapien
tggtgacagatcactgcagcctcca

SEQ ID NO: 360269 - DNA, 25 bp, Homo sapien
ggtgacagatcactgcagcctccaa

SEQ ID NO: 360270 - DNA, 25 bp, Homo sapien
gtgacagatcactgcagcctccaac

SEQ ID NO: 360271 - DNA, 25 bp, Homo sapien
tgacagatcactgcagcctccaact

SEQ ID NO: 360272 - DNA, 25 bp, Homo sapien
gacagatcactgcagcctccaactc

SEQ ID NO: 360273 - DNA, 25 bp, Homo sapien
acagatcactgcagcctccaactcc

SEQ ID NO: 360274 - DNA, 25 bp, Homo sapien
cagatcactgcagcctccaactcct

SEQ ID NO: 360275 - DNA, 25 bp, Homo sapien
agtgatcctcccactcagctcctaa

SEQ ID NO: 360276 - DNA, 25 bp, Homo sapien
atcctcccactcagctcctaagtaa

SEQ ID NO: 360277 - DNA, 25 bp, Homo sapien
tcctcccactcagctcctaagtaac

SEQ ID NO: 360278 - DNA, 25 bp, Homo sapien
ctcatggtgtggcaatggactgaac

SEQ ID NO: 360279 - DNA, 25 bp, Homo sapien
gtgtggcaatggactgaactgtaat

SEQ ID NO: 360280 - DNA, 25 bp, Homo sapien
ggcaatggactgaactgtaatgaaa

SEQ ID NO: 360281 - DNA, 25 bp, Homo sapien
tttgatacttgaatgactttccctt

SEQ ID NO: 360282 - DNA, 25 bp, Homo sapien
gaattataaacactttgaggtacca

SEQ ID NO: 360283 - DNA, 25 bp, Homo sapien
taaacactttgaggtaccaaacata

SEQ ID NO: 360284 - DNA, 25 bp, Homo sapien
gtaccaaacataaccaatctgtgca

SEQ ID NO: 360285 - DNA, 25 bp, Homo sapien
aaacataaccaatctgtgcaacaac

SEQ ID NO: 360286 - DNA, 25 bp, Homo sapien
atagactgacctcagtacccaagag

SEQ ID NO: 360287 - DNA, 25 bp, Homo sapien
gactgacctcagtacccaagagagt

SEQ ID NO: 360288 - DNA, 25 bp, Homo sapien
gacctcagtacccaagagagtgtaa

SEQ ID NO: 360289 - DNA, 25 bp, Homo sapien
gtgtgtacgctgtggtcagatttct

SEQ ID NO: 360290 - DNA, 25 bp, Homo sapien
gtcagatttctgaatgctgtagagc

SEQ ID NO: 360291 - DNA, 25 bp, Homo sapien
gctgtagagcacttaccagctctga

SEQ ID NO: 360292 - DNA, 25 bp, Homo sapien
ttaccagctctgaccgtgtcttgct

SEQ ID NO: 360293 - DNA, 25 bp, Homo sapien
gccagctgtctcagggctgatatgt

SEQ ID NO: 360294 - DNA, 25 bp, Homo sapien
ctcagggctgatatgtagacgtgta

SEQ ID NO: 360295 - DNA, 25 bp, Homo sapien
atatgtagacgtgtattctgtttac

SEQ ID NO: 360296 - DNA, 25 bp, Homo sapien
ttacaattagttccccaactctgtg

SEQ ID NO: 360297 - DNA, 25 bp, Homo sapien
caatgagggtcagggcgcgtggtcc

SEQ ID NO: 360298 - DNA, 25 bp, Homo sapien
ggtcttcagggcaagacccatggcc

SEQ ID NO: 360299 - DNA, 25 bp, Homo sapien
ctggaactgtgctccccagggcgtg

SEQ ID NO: 360300 - DNA, 25 bp, Homo sapien
gagctaatgaaaatgcgcccagatt

SEQ ID NO: 360301 - DNA, 25 bp, Homo sapien
aatgcgcccagattagttaactagt

SEQ ID NO: 360302 - DNA, 25 bp, Homo sapien
ccagccagtctgagggattgtgcaa

SEQ ID NO: 360303 - DNA, 25 bp, Homo sapien
gttaactagtctatcagaggcctgt

SEQ ID NO: 360304 - DNA, 25 bp, Homo sapien
agaggcctgtttctctctacattat

SEQ ID NO: 360305 - DNA, 25 bp, Homo sapien
cctgtttctctctacattatgcaga

SEQ ID NO: 360306 - DNA, 25 bp, Homo sapien
gagggattgtgcaaaggtgttcatt

SEQ ID NO: 360307 - DNA, 25 bp, Homo sapien
ggtgttcattgctagcctgcaaact

SEQ ID NO: 360308 - DNA, 25 bp, Homo sapien
agcctgcaaactaggtggtaagcaa

SEQ ID NO: 360309 - DNA, 25 bp, Homo sapien
tacagctgccactcaacttgagcta

SEQ ID NO: 360310 - DNA, 25 bp, Homo sapien
gctgccactcaacttgagctaatga

SEQ ID NO: 360311 - DNA, 25 bp, Homo sapien
agccagacaaacaactacataaaat

SEQ ID NO: 360312 - DNA, 25 bp, Homo sapien
ttctatttagatgaagtggcaaact

SEQ ID NO: 360313 - DNA, 25 bp, Homo sapien
gtggcaaactaatctgtagtgttaa

SEQ ID NO: 360314 - DNA, 25 bp, Homo sapien
gattgcctgggccaagtggcaggtt

SEQ ID NO: 360315 - DNA, 25 bp, Homo sapien
gaaactttctccaatagatgagaat

SEQ ID NO: 360316 - DNA, 25 bp, Homo sapien
gatgagaattttccgtatcttgatc

SEQ ID NO: 360317 - DNA, 25 bp, Homo sapien
gaattttccgtatcttgatctgagt

SEQ ID NO: 360318 - DNA, 25 bp, Homo sapien
tttccgtatcttgatctgagtggca

SEQ ID NO: 360319 - DNA, 25 bp, Homo sapien
ccgtatcttgatctgagtggcaaat

SEQ ID NO: 360320 - DNA, 25 bp, Homo sapien
gatctgagtggcaaattgtaaactt

SEQ ID NO: 360321 - DNA, 25 bp, Homo sapien
gaaaattaagcctcaataaacgtga

SEQ ID NO: 360322 - DNA, 25 bp, Homo sapien
tgggcgtgggtccagcggtcccttc

SEQ ID NO: 360323 - DNA, 25 bp, Homo sapien
gttcctggtgagtggagctgccgaa

SEQ ID NO: 360324 - DNA, 25 bp, Homo sapien
agccatccaagtccctaaaactttg

SEQ ID NO: 360325 - DNA, 25 bp, Homo sapien
gtccctaaaactttgaggtgtcaga

SEQ ID NO: 360326 - DNA, 25 bp, Homo sapien
aggtgtcagagagtgtgcgtttcca

SEQ ID NO: 360327 - DNA, 25 bp, Homo sapien
agagagtgtgcgtttccagagcttc

SEQ ID NO: 360328 - DNA, 25 bp, Homo sapien
gagtgtgcgtttccagagcttctta

SEQ ID NO: 360329 - DNA, 25 bp, Homo sapien
gcgtttccagagcttcttattgtgt

SEQ ID NO: 360330 - DNA, 25 bp, Homo sapien
tccagagcttcttattgtgtgccgc

SEQ ID NO: 360331 - DNA, 25 bp, Homo sapien
agagcttcttattgtgtgccgcgcc

SEQ ID NO: 360332 - DNA, 25 bp, Homo sapien
ccatttcccccttgaggattgccga

SEQ ID NO: 360333 - DNA, 25 bp, Homo sapien
tgccatcaagcagtcccgctaaagt

SEQ ID NO: 360334 - DNA, 25 bp, Homo sapien
cagtcccgctaaagtcaagctgctg

SEQ ID NO: 360335 - DNA, 25 bp, Homo sapien
aagctgctgctctccgactcagact

SEQ ID NO: 360336 - DNA, 25 bp, Homo sapien
gactcagactgcagtctccgacgtg

SEQ ID NO: 360337 - DNA, 25 bp, Homo sapien
tgcagtctccgacgtgcagctgctt

SEQ ID NO: 360338 - DNA, 25 bp, Homo sapien
aaacaggaatgtaaagttctcactt

SEQ ID NO: 360339 - DNA, 25 bp, Homo sapien
ctcactttgggcttgagagtgggtc

SEQ ID NO: 360340 - DNA, 25 bp, Homo sapien
agagtgggtcttggccagggaccct

SEQ ID NO: 360341 - DNA, 25 bp, Homo sapien
gagtgggaacgtattcttcccctga

SEQ ID NO: 360342 - DNA, 25 bp, Homo sapien
gaacgtattcttcccctgaagtact

SEQ ID NO: 360343 - DNA, 25 bp, Homo sapien
ttcccctgaagtactgccatcaagc

SEQ ID NO: 360344 - DNA, 25 bp, Homo sapien
gaacttccatttactcattaagaga

SEQ ID NO: 360345 - DNA, 25 bp, Homo sapien
gatcaagtatctttgaacctccgtt

SEQ ID NO: 360346 - DNA, 25 bp, Homo sapien
atctttgaacctccgtttacacatt

SEQ ID NO: 360347 - DNA, 25 bp, Homo sapien
gtttacacatttatactttcagacc

SEQ ID NO: 360348 - DNA, 25 bp, Homo sapien
acatttatactttcagaccattttt

SEQ ID NO: 360349 - DNA, 25 bp, Homo sapien
gaagactgtgacgattaaatgagag

SEQ ID NO: 360350 - DNA, 25 bp, Homo sapien
atgagagaacatacatgcagtaaat

SEQ ID NO: 360351 - DNA, 25 bp, Homo sapien
gctaatatgtagagtgaaaccagga

SEQ ID NO: 360352 - DNA, 25 bp, Homo sapien
tgaaaccaggatgaatcacacagtg

SEQ ID NO: 360353 - DNA, 25 bp, Homo sapien
cacagtggttgaggtgtatatggac

SEQ ID NO: 360354 - DNA, 25 bp, Homo sapien
agggatatgggctggaacctgcact

SEQ ID NO: 360355 - DNA, 25 bp, Homo sapien
tgggtcctgagcaccgaattcggct

SEQ ID NO: 360356 - DNA, 25 bp, Homo sapien
caccgaattcggcttttgaggacag

SEQ ID NO: 360357 - DNA, 25 bp, Homo sapien
attcggcttttgaggacagagtctg

SEQ ID NO: 360358 - DNA, 25 bp, Homo sapien
acagagtctggcgtgatttcaggga

SEQ ID NO: 360359 - DNA, 25 bp, Homo sapien
aaaacggcaggagtgctgcctaata

SEQ ID NO: 360360 - DNA, 25 bp, Homo sapien
ctgcctaataaagccagctgctgga

SEQ ID NO: 360361 - DNA, 25 bp, Homo sapien
agccagctgctggaccagggaaaac

SEQ ID NO: 360362 - DNA, 25 bp, Homo sapien
tggaccagggaaaacagccctttga

SEQ ID NO: 360363 - DNA, 25 bp, Homo sapien
gcaatggagacctcacagggcaagc

SEQ ID NO: 360364 - DNA, 25 bp, Homo sapien
ggagacctcacagggcaagcactct

SEQ ID NO: 360365 - DNA, 25 bp, Homo sapien
acatccctgaggctcaagcgtggag

SEQ ID NO: 360366 - DNA, 25 bp, Homo sapien
gagcctactatctagctaggcctta

SEQ ID NO: 360367 - DNA, 25 bp, Homo sapien
tctagctaggccttaaagaagacta

SEQ ID NO: 360368 - DNA, 25 bp, Homo sapien
gtatagactttcatgtacttttcac

SEQ ID NO: 360369 - DNA, 25 bp, Homo sapien
gtacttttcacaaaccttaactcat

SEQ ID NO: 360370 - DNA, 25 bp, Homo sapien
taactcatggttacaataacctcat

SEQ ID NO: 360371 - DNA, 25 bp, Homo sapien
aacctcataggcattgttatcctta

SEQ ID NO: 360372 - DNA, 25 bp, Homo sapien
agtaaaggttagacaggtaagctga

SEQ ID NO: 360373 - DNA, 25 bp, Homo sapien
atgatgaattcatcctcactccagg

SEQ ID NO: 360374 - DNA, 25 bp, Homo sapien
ctcactccaggcactaagaatatac

SEQ ID NO: 360375 - DNA, 25 bp, Homo sapien
gacatggtgactgttcttaaagagc

SEQ ID NO: 360376 - DNA, 25 bp, Homo sapien
gtgactgttcttaaagagcctacta

SEQ ID NO: 360377 - DNA, 25 bp, Homo sapien
aacttctgtgtgtcaacagacacaa

SEQ ID NO: 360378 - DNA, 25 bp, Homo sapien
tgtcaacagacacaatcacaaaagt

SEQ ID NO: 360379 - DNA, 25 bp, Homo sapien
tttgcaaaccatttacatgataagg

SEQ ID NO: 360380 - DNA, 25 bp, Homo sapien
gcaaaccatttacatgataagggta

SEQ ID NO: 360381 - DNA, 25 bp, Homo sapien
atgataagggtatgatatccagaac

SEQ ID NO: 360382 - DNA, 25 bp, Homo sapien
gggtatgatatccagaacatataaa

SEQ ID NO: 360383 - DNA, 25 bp, Homo sapien
gggcaaatgttctgaacatttctct

SEQ ID NO: 360384 - DNA, 25 bp, Homo sapien
gttctgaacatttctctaaagacgt

SEQ ID NO: 360385 - DNA, 25 bp, Homo sapien
gaacatttctctaaagacgtatgaa

SEQ ID NO: 360386 - DNA, 25 bp, Homo sapien
tctctaaagacgtatgaatgaccta

SEQ ID NO: 360387 - DNA, 25 bp, Homo sapien
taaagacgtatgaatgacctaaaaa

SEQ ID NO: 360388 - DNA, 25 bp, Homo sapien
tgtttgagcaccctcagtatctgta

SEQ ID NO: 360389 - DNA, 25 bp, Homo sapien
gagcaccctcagtatctgtaactaa

SEQ ID NO: 360390 - DNA, 25 bp, Homo sapien
tctgtaactaaaaccctgaaatgcg

SEQ ID NO: 360391 - DNA, 25 bp, Homo sapien
cctgaaatgcggtctcgctgattga

SEQ ID NO: 360392 - DNA, 25 bp, Homo sapien
gcggtctcgctgattgagttgctac

SEQ ID NO: 360393 - DNA, 25 bp, Homo sapien
gctgattgagttgctaccctctggg

SEQ ID NO: 360394 - DNA, 25 bp, Homo sapien
tgctggactgggtctggtcccttta

SEQ ID NO: 360395 - DNA, 25 bp, Homo sapien
ggtccctttaggagggtctgtgctt

SEQ ID NO: 360396 - DNA, 25 bp, Homo sapien
ggtctgtgcttggtagaaagtaatc

SEQ ID NO: 360397 - DNA, 25 bp, Homo sapien
agtaatcgtgtttcttccaggcaga

SEQ ID NO: 360398 - DNA, 25 bp, Homo sapien
atttaataagagacgtgtgtcctga

SEQ ID NO: 360399 - DNA, 25 bp, Homo sapien
caatgtcctgggtcattccagaatt

SEQ ID NO: 360400 - DNA, 25 bp, Homo sapien
ggctgttagagaaacgctagcatcc

SEQ ID NO: 360401 - DNA, 25 bp, Homo sapien
gctagcatccagaatagtgctgttt

SEQ ID NO: 360402 - DNA, 25 bp, Homo sapien
ctgtttgggacctcagctctgattc

SEQ ID NO: 360403 - DNA, 25 bp, Homo sapien
ctctgattcctgaagtcttcaccta

SEQ ID NO: 360404 - DNA, 25 bp, Homo sapien
gaaaaacccagggtcattgtggatt

SEQ ID NO: 360405 - DNA, 25 bp, Homo sapien
gaaactgtcttgtactgtcctggca

SEQ ID NO: 360406 - DNA, 25 bp, Homo sapien
gtactgtcctggcaatgggactgat

SEQ ID NO: 360407 - DNA, 25 bp, Homo sapien
atgggactgatggtgccattttctt

SEQ ID NO: 360408 - DNA, 25 bp, Homo sapien
attttcttttagtatatttccacag

SEQ ID NO: 360409 - DNA, 25 bp, Homo sapien
ccacagattggacagatacagtact

SEQ ID NO: 360410 - DNA, 25 bp, Homo sapien
taggctggctgcaagcaaggccttt

SEQ ID NO: 360411 - DNA, 25 bp, Homo sapien
ggctgcaagcaaggcctttggagca

SEQ ID NO: 360412 - DNA, 25 bp, Homo sapien
ctggttgcggctctagctgtgggac

SEQ ID NO: 360413 - DNA, 25 bp, Homo sapien
gagcaagtcattggatttctctgat

SEQ ID NO: 360414 - DNA, 25 bp, Homo sapien
gtcattggatttctctgatcctgtt

SEQ ID NO: 360415 - DNA, 25 bp, Homo sapien
gtggttagtatgacctacatatcgt

SEQ ID NO: 360416 - DNA, 25 bp, Homo sapien
aagtgaaatgtctgtctcatgctca

SEQ ID NO: 360417 - DNA, 25 bp, Homo sapien
gtctgtctcatgctcagggctaaca

SEQ ID NO: 360418 - DNA, 25 bp, Homo sapien
gctcagggctaacagcacacaacaa

SEQ ID NO: 360419 - DNA, 25 bp, Homo sapien
acctacatatcgtcacagctgcttt

SEQ ID NO: 360420 - DNA, 25 bp, Homo sapien
agtggccgcgtagaaaagcaagcaa

SEQ ID NO: 360421 - DNA, 25 bp, Homo sapien
cacagctgctggtccgggccacgat

SEQ ID NO: 360422 - DNA, 25 bp, Homo sapien
tccgggccacgatggctgaagagca

SEQ ID NO: 360423 - DNA, 25 bp, Homo sapien
ggctgaagagcaactttctgagcta

SEQ ID NO: 360424 - DNA, 25 bp, Homo sapien
gagcaactttctgagctacaggagt

SEQ ID NO: 360425 - DNA, 25 bp, Homo sapien
ttctgagctacaggagtacgtggac

SEQ ID NO: 360426 - DNA, 25 bp, Homo sapien
gcacctgggcaggtacaagcacgaa

SEQ ID NO: 360427 - DNA, 25 bp, Homo sapien
gtacaagcacgaaatcctgaggctg

SEQ ID NO: 360428 - DNA, 25 bp, Homo sapien
agcacgaaatcctgaggctgaggaa

SEQ ID NO: 360429 - DNA, 25 bp, Homo sapien
agccacagggcctggacgctgcatc

SEQ ID NO: 360430 - DNA, 25 bp, Homo sapien
aagccccagcatccaaggaccggca

SEQ ID NO: 360431 - DNA, 25 bp, Homo sapien
ctggacgctgcatcctgggcccaga

SEQ ID NO: 360432 - DNA, 25 bp, Homo sapien
tgcagtatttactatctatctgata

SEQ ID NO: 360433 - DNA, 25 bp, Homo sapien
tttgcatttatttgtacaggcccta

SEQ ID NO: 360434 - DNA, 25 bp, Homo sapien
ttgtacaggccctacaactgccttg

SEQ ID NO: 360435 - DNA, 25 bp, Homo sapien
aactgccttggcatttggctggcaa

SEQ ID NO: 360436 - DNA, 25 bp, Homo sapien
ttggctggcaaaatctacataagca

SEQ ID NO: 360437 - DNA, 25 bp, Homo sapien
tacataagcagtcccatcacattca

SEQ ID NO: 360438 - DNA, 25 bp, Homo sapien
atcacattcagttgttgctctttgc

SEQ ID NO: 360439 - DNA, 25 bp, Homo sapien
gttgctctttgcaaatactctgctt

SEQ ID NO: 360440 - DNA, 25 bp, Homo sapien
tactctgcttgaaccaaagttggac

SEQ ID NO: 360441 - DNA, 25 bp, Homo sapien
aaagttggacttcagtggattaatc

SEQ ID NO: 360442 - DNA, 25 bp, Homo sapien
gagtgaaaactatagcacatcaagc

SEQ ID NO: 360443 - DNA, 25 bp, Homo sapien
ttactgccactactgtaacttggaa

SEQ ID NO: 360444 - DNA, 25 bp, Homo sapien
tgttctttctagtgagcctgctcca

SEQ ID NO: 360445 - DNA, 25 bp, Homo sapien
tccatctcagcttagccttcacaag

SEQ ID NO: 360446 - DNA, 25 bp, Homo sapien
gtggaacttcctgaaatgcgcctac

SEQ ID NO: 360447 - DNA, 25 bp, Homo sapien
tcccaggcattctaacctctgaaga

SEQ ID NO: 360448 - DNA, 25 bp, Homo sapien
tgaagaaagctctctgtcccctgga

SEQ ID NO: 360449 - DNA, 25 bp, Homo sapien
tgtcccctggactgcctgtgtggag

SEQ ID NO: 360450 - DNA, 25 bp, Homo sapien
gtcctttaaggaatggcacctgggt

SEQ ID NO: 360451 - DNA, 25 bp, Homo sapien
aatgcgcctacatggtgatgaccta

SEQ ID NO: 360452 - DNA, 25 bp, Homo sapien
tacctcttcgtatcctacaacaaag

SEQ ID NO: 360453 - DNA, 25 bp, Homo sapien
tttttcctcccaagtgttactgcca

SEQ ID NO: 360454 - DNA, 25 bp, Homo sapien
aagccaagcctgagtgtctcctgag

SEQ ID NO: 360455 - DNA, 25 bp, Homo sapien
aggaaggaggatgacctcacaggct

SEQ ID NO: 360456 - DNA, 25 bp, Homo sapien
agggatgaggttccttactggtcca

SEQ ID NO: 360457 - DNA, 25 bp, Homo sapien
tccttactggtccacagcgatggag

SEQ ID NO: 360458 - DNA, 25 bp, Homo sapien
agcgatggagactgcctcagggctc

SEQ ID NO: 360459 - DNA, 25 bp, Homo sapien
ttcagcactgactgttggtccactg

SEQ ID NO: 360460 - DNA, 25 bp, Homo sapien
tgactgttggtccactgggcgcaca

SEQ ID NO: 360461 - DNA, 25 bp, Homo sapien
acacccttggcctgcctttgggaca

SEQ ID NO: 360462 - DNA, 25 bp, Homo sapien
ggcatccaggtgagtgcgcagccac

SEQ ID NO: 360463 - DNA, 25 bp, Homo sapien
aggtgagtgcgcagccacacgtgca

SEQ ID NO: 360464 - DNA, 25 bp, Homo sapien
cacacgtgcatgaagccaagcctga

SEQ ID NO: 360465 - DNA, 25 bp, Homo sapien
gtttctctttctgagaacgtaactt

SEQ ID NO: 360466 - DNA, 25 bp, Homo sapien
tctgagaacgtaacttgaaacacta

SEQ ID NO: 360467 - DNA, 25 bp, Homo sapien
ttgaaacactacagagccaataatc

SEQ ID NO: 360468 - DNA, 25 bp, Homo sapien
ataaaaagtgtatccgtaaacgctg

SEQ ID NO: 360469 - DNA, 25 bp, Homo sapien
aaagtgtatccgtaaacgctgtaca

SEQ ID NO: 360470 - DNA, 25 bp, Homo sapien
gtgtatccgtaaacgctgtacagtt

SEQ ID NO: 360471 - DNA, 25 bp, Homo sapien
atccgtaaacgctgtacagttttat

SEQ ID NO: 360472 - DNA, 25 bp, Homo sapien
tacagttttatataccttcacaatg

SEQ ID NO: 360473 - DNA, 25 bp, Homo sapien
gttttatataccttcacaatgtact

SEQ ID NO: 360474 - DNA, 25 bp, Homo sapien
gcaacacattactgcacagttgtaa

SEQ ID NO: 360475 - DNA, 25 bp, Homo sapien
actgcacagttgtaaataacttatg

SEQ ID NO: 360476 - DNA, 25 bp, Homo sapien
tccagttcctggtgagtggagctgc

SEQ ID NO: 360477 - DNA, 25 bp, Homo sapien
cccagaaaatccctttgccaatatt

SEQ ID NO: 360478 - DNA, 25 bp, Homo sapien
agccatccaagtccctaaaactttg

SEQ ID NO: 360479 - DNA, 25 bp, Homo sapien
gtccctaaaactttgaggtgtcaga

SEQ ID NO: 360480 - DNA, 25 bp, Homo sapien
aggtgtcagagagtgtgcgtttcca

SEQ ID NO: 360481 - DNA, 25 bp, Homo sapien
agagagtgtgcgtttccagagcttc

SEQ ID NO: 360482 - DNA, 25 bp, Homo sapien
gagtgtgcgtttccagagcttctta

SEQ ID NO: 360483 - DNA, 25 bp, Homo sapien
gcgtttccagagcttcttattgtgt

SEQ ID NO: 360484 - DNA, 25 bp, Homo sapien
tccagagcttcttattgtgtgccgc

SEQ ID NO: 360485 - DNA, 25 bp, Homo sapien
agagcttcttattgtgtgccgcgcc

SEQ ID NO: 360486 - DNA, 25 bp, Homo sapien
ccatttcccccttgaggattgccga

SEQ ID NO: 360487 - DNA, 25 bp, Homo sapien
aaatccgtatcatctgtgctggctg

SEQ ID NO: 360488 - DNA, 25 bp, Homo sapien
gtgctggctgtaattccatgcagtt

SEQ ID NO: 360489 - DNA, 25 bp, Homo sapien
taattccatgcagttacggccaaag

SEQ ID NO: 360490 - DNA, 25 bp, Homo sapien
gttacggccaaaggcgtgcaacctg

SEQ ID NO: 360491 - DNA, 25 bp, Homo sapien
catgagtcatcacggcacggcttca

SEQ ID NO: 360492 - DNA, 25 bp, Homo sapien
gcacggcttcattgcattttctgat

SEQ ID NO: 360493 - DNA, 25 bp, Homo sapien
gttagtttaatgtgcatctgacctg

SEQ ID NO: 360494 - DNA, 25 bp, Homo sapien
gtgcatctgacctgtgaaatcattg

SEQ ID NO: 360495 - DNA, 25 bp, Homo sapien
agctacctgcagactaaactattgt

SEQ ID NO: 360496 - DNA, 25 bp, Homo sapien
gtcaacaagtgatgttttgctgttt

SEQ ID NO: 360497 - DNA, 25 bp, Homo sapien
gaagttctgtctatgaaaatccgta

SEQ ID NO: 360498 - DNA, 25 bp, Homo sapien
aacccttggcaacccttggatattg

SEQ ID NO: 360499 - DNA, 25 bp, Homo sapien
ccttggcaacccttggatattggca

SEQ ID NO: 360500 - DNA, 25 bp, Homo sapien
ggcaacccttggatattggcagtta

SEQ ID NO: 360501 - DNA, 25 bp, Homo sapien
acccttggatattggcagttatacc

SEQ ID NO: 360502 - DNA, 25 bp, Homo sapien
tggcagttataccaataaccaaggt

SEQ ID NO: 360503 - DNA, 25 bp, Homo sapien
actgatacctgcaaggaaagccgga

SEQ ID NO: 360504 - DNA, 25 bp, Homo sapien
atacctgcaaggaaagccggaaatt

SEQ ID NO: 360505 - DNA, 25 bp, Homo sapien
gccggaaattgtatgtgaatcacct

SEQ ID NO: 360506 - DNA, 25 bp, Homo sapien
gtgaatcacctaaatgaactccagt

SEQ ID NO: 360507 - DNA, 25 bp, Homo sapien
aatgaactccagttgccagctgatt

SEQ ID NO: 360508 - DNA, 25 bp, Homo sapien
tgaactccagttgccagctgatttg

SEQ ID NO: 360509 - DNA, 25 bp, Homo sapien
gtctctggctaatagtatacactgg

SEQ ID NO: 360510 - DNA, 25 bp, Homo sapien
tacactggttaactgagaatagccc

SEQ ID NO: 360511 - DNA, 25 bp, Homo sapien
aatagcccattccttttagtctcgt

SEQ ID NO: 360512 - DNA, 25 bp, Homo sapien
ttagtctcgttctcctacagttgaa

SEQ ID NO: 360513 - DNA, 25 bp, Homo sapien
gaagatgcacaaatcctgtcccgtg

SEQ ID NO: 360514 - DNA, 25 bp, Homo sapien
tcccgtgccttagcggagcttatta

SEQ ID NO: 360515 - DNA, 25 bp, Homo sapien
gagcttattagtatccctttctgag

SEQ ID NO: 360516 - DNA, 25 bp, Homo sapien
tatccctttctgaggaggccataag

SEQ ID NO: 360517 - DNA, 25 bp, Homo sapien
aggtattatcggcaggcaccatagg

SEQ ID NO: 360518 - DNA, 25 bp, Homo sapien
tcggcaggcaccataggtaggctgt

SEQ ID NO: 360519 - DNA, 25 bp, Homo sapien
aagggcgagtcagttctgtctcttc

SEQ ID NO: 360520 - DNA, 25 bp, Homo sapien
tgtctcctcctcagggccccaggtg

SEQ ID NO: 360521 - DNA, 25 bp, Homo sapien
aggtgtctcctcccatcctgggctg

SEQ ID NO: 360522 - DNA, 25 bp, Homo sapien
tgggccccatcctgggatccaccca

SEQ ID NO: 360523 - DNA, 25 bp, Homo sapien
catcctgggatccacccacactcag

SEQ ID NO: 360524 - DNA, 25 bp, Homo sapien
ccacactcagccctggaagatgagg

SEQ ID NO: 360525 - DNA, 25 bp, Homo sapien
tcagccctggaagatgagggtcctg

SEQ ID NO: 360526 - DNA, 25 bp, Homo sapien
tgtggcggcgccaggactttaggcc

SEQ ID NO: 360527 - DNA, 25 bp, Homo sapien
gcggcgccaggactttaggccaggg

SEQ ID NO: 360528 - DNA, 25 bp, Homo sapien
ccgtggccagaccatcaccctctgc

SEQ ID NO: 360529 - DNA, 25 bp, Homo sapien
aggccgcctcgaagcctgtgctggc

SEQ ID NO: 360530 - DNA, 25 bp, Homo sapien
cgcctcgaagcctgtgctggcccag

SEQ ID NO: 360531 - DNA, 25 bp, Homo sapien
ggtactttagattgattgccgagcg

SEQ ID NO: 360532 - DNA, 25 bp, Homo sapien
ggcagttttgtgagccttcatctga

SEQ ID NO: 360533 - DNA, 25 bp, Homo sapien
gagccttcatctgaagccttcagtt

SEQ ID NO: 360534 - DNA, 25 bp, Homo sapien
tctgcacaggcctcagctttgaaga

SEQ ID NO: 360535 - DNA, 25 bp, Homo sapien
gaacggagtctttgcacttacacac

SEQ ID NO: 360536 - DNA, 25 bp, Homo sapien
tctgccttcacctatgccgggataa

SEQ ID NO: 360537 - DNA, 25 bp, Homo sapien
tgccgggataagcagagatctcatc

SEQ ID NO: 360538 - DNA, 25 bp, Homo sapien
gatctcatcaattagctcttctctg

SEQ ID NO: 360539 - DNA, 25 bp, Homo sapien
aaggtcttccactatttctgtctgt

SEQ ID NO: 360540 - DNA, 25 bp, Homo sapien
cagctgctgctgcttagagcagaga

SEQ ID NO: 360541 - DNA, 25 bp, Homo sapien
gtgttctgcataagtggcttcctga

SEQ ID NO: 360542 - DNA, 25 bp, Homo sapien
tggagctgtggttgaaggctttccc

SEQ ID NO: 360543 - DNA, 25 bp, Homo sapien
tatggcttctctccggtgtggagtc

SEQ ID NO: 360544 - DNA, 25 bp, Homo sapien
ggagtctctggtgggagctgaggcc

SEQ ID NO: 360545 - DNA, 25 bp, Homo sapien
agctgaggcccgcatgctgactgaa

SEQ ID NO: 360546 - DNA, 25 bp, Homo sapien
ggcccgcatgctgactgaagctctt

SEQ ID NO: 360547 - DNA, 25 bp, Homo sapien
gtttggaaagattggacttgctaca

SEQ ID NO: 360548 - DNA, 25 bp, Homo sapien
tggacttgctacagaaggtctttcc

SEQ ID NO: 360549 - DNA, 25 bp, Homo sapien
tctttccacagtgatgacaccagta

SEQ ID NO: 360550 - DNA, 25 bp, Homo sapien
tgatgacaccagtagggcttttccc

SEQ ID NO: 360551 - DNA, 25 bp, Homo sapien
ggcttttccccggtgtggattctgt

SEQ ID NO: 360552 - DNA, 25 bp, Homo sapien
gtggattctgtggtgtttattgaag

SEQ ID NO: 360553 - DNA, 25 bp, Homo sapien
aaaatgttcatcttgcaacaaagag

SEQ ID NO: 360554 - DNA, 25 bp, Homo sapien
agatccaagtggtgaggtcttcatt

SEQ ID NO: 360555 - DNA, 25 bp, Homo sapien
caagtggtgaggtcttcattaatta

SEQ ID NO: 360556 - DNA, 25 bp, Homo sapien
agcaggcaggagatggcaaacccac

SEQ ID NO: 360557 - DNA, 25 bp, Homo sapien
gatggcaaacccacaagggtccatt

SEQ ID NO: 360558 - DNA, 25 bp, Homo sapien
cacaagggtccattggcgtttctgg

SEQ ID NO: 360559 - DNA, 25 bp, Homo sapien
ggtccattggcgtttctggagtaaa

SEQ ID NO: 360560 - DNA, 25 bp, Homo sapien
gagtaaaatggtttgctaggttatt

SEQ ID NO: 360561 - DNA, 25 bp, Homo sapien
gggctttgtgatagtaaagtctgaa

SEQ ID NO: 360562 - DNA, 25 bp, Homo sapien
gtacagaggttgaattattgccaca

SEQ ID NO: 360563 - DNA, 25 bp, Homo sapien
tgaattattgccacatgttaggaat

SEQ ID NO: 360564 - DNA, 25 bp, Homo sapien
actatacagcctctatacaaaattg

SEQ ID NO: 360565 - DNA, 25 bp, Homo sapien
tatacagcctctatacaaaattgag

SEQ ID NO: 360566 - DNA, 25 bp, Homo sapien
atacagcctctatacaaaattgaga

SEQ ID NO: 360567 - DNA, 25 bp, Homo sapien
acagcctctatacaaaattgagatg

SEQ ID NO: 360568 - DNA, 25 bp, Homo sapien
agcctctatacaaaattgagatggg

SEQ ID NO: 360569 - DNA, 25 bp, Homo sapien
gtgtggcatagcacacacctgtggt

SEQ ID NO: 360570 - DNA, 25 bp, Homo sapien
cttgaactcaggagcagccttggtg

SEQ ID NO: 360571 - DNA, 25 bp, Homo sapien
ttgaactcaggagcagccttggtga

SEQ ID NO: 360572 - DNA, 25 bp, Homo sapien
tgaactcaggagcagccttggtgac

SEQ ID NO: 360573 - DNA, 25 bp, Homo sapien
gaactcaggagcagccttggtgaca

SEQ ID NO: 360574 - DNA, 25 bp, Homo sapien
aactcaggagcagccttggtgacag

SEQ ID NO: 360575 - DNA, 25 bp, Homo sapien
aaagttacacgcagttccgtggttg

SEQ ID NO: 360576 - DNA, 25 bp, Homo sapien
acgcagttccgtggttgaatatatt

SEQ ID NO: 360577 - DNA, 25 bp, Homo sapien
gaatatatttgagatggtaccttag

SEQ ID NO: 360578 - DNA, 25 bp, Homo sapien
aagtttcacgcagatccttggttga

SEQ ID NO: 360579 - DNA, 25 bp, Homo sapien
agggagcgtagtattgacaattctt

SEQ ID NO: 360580 - DNA, 25 bp, Homo sapien
gacaattcttcatgtaggaaacctg

SEQ ID NO: 360581 - DNA, 25 bp, Homo sapien
aaacattgtcctgtttgttgcaaca

SEQ ID NO: 360582 - DNA, 25 bp, Homo sapien
gttgcaacagaaaactcggatagtt

SEQ ID NO: 360583 - DNA, 25 bp, Homo sapien
caggaaacacttgtaggacttcctt

SEQ ID NO: 360584 - DNA, 25 bp, Homo sapien
taggacttcctttaccaacatactt

SEQ ID NO: 360585 - DNA, 25 bp, Homo sapien
atgttttgctattggttccatattt

SEQ ID NO: 360586 - DNA, 25 bp, Homo sapien
ccggtcgtgagaccctggtgcaaaa

SEQ ID NO: 360587 - DNA, 25 bp, Homo sapien
cgtgagaccctggtgcaaaatgcaa

SEQ ID NO: 360588 - DNA, 25 bp, Homo sapien
cctgcgcgcttctcccagaggaggg

SEQ ID NO: 360589 - DNA, 25 bp, Homo sapien
gccgagtccagcaagtctgtcaatc

SEQ ID NO: 360590 - DNA, 25 bp, Homo sapien
gctttagaaacccatggacaacagg

SEQ ID NO: 360591 - DNA, 25 bp, Homo sapien
gcaagtctgtcaatcggacgtgaac

SEQ ID NO: 360592 - DNA, 25 bp, Homo sapien
ggacgtgaacgtcccgacgagacaa

SEQ ID NO: 360593 - DNA, 25 bp, Homo sapien
gaacgtcccgacgagacaacttgaa

SEQ ID NO: 360594 - DNA, 25 bp, Homo sapien
cccgacgagacaacttgaacctcag

SEQ ID NO: 360595 - DNA, 25 bp, Homo sapien
cccatggacaacaggaaggaagctt

SEQ ID NO: 360596 - DNA, 25 bp, Homo sapien
tcttctccccggtggagaatcagct

SEQ ID NO: 360597 - DNA, 25 bp, Homo sapien
taaggaatttaggactccctggagt

SEQ ID NO: 360598 - DNA, 25 bp, Homo sapien
ggactccctggagttaacagatgaa

SEQ ID NO: 360599 - DNA, 25 bp, Homo sapien
gggcataattacttcacccaaagtc

SEQ ID NO: 360600 - DNA, 25 bp, Homo sapien
tcacccaaagtctagaagccttggc

SEQ ID NO: 360601 - DNA, 25 bp, Homo sapien
ggagggacatggaccttcaggacta

SEQ ID NO: 360602 - DNA, 25 bp, Homo sapien
cctcccagaagcgtttgggctggta

SEQ ID NO: 360603 - DNA, 25 bp, Homo sapien
cttcctacctgctgagtgatgtcat

SEQ ID NO: 360604 - DNA, 25 bp, Homo sapien
cctgctgagtgatgtcatttcctgc

SEQ ID NO: 360605 - DNA, 25 bp, Homo sapien
gccaggatgggtagccctttgtacg

SEQ ID NO: 360606 - DNA, 25 bp, Homo sapien
ttgtacgggtccttggatggtagta

SEQ ID NO: 360607 - DNA, 25 bp, Homo sapien
gtccttggatggtagtaggtcatat

SEQ ID NO: 360608 - DNA, 25 bp, Homo sapien
aaagcattcagacttcctgcttctg

SEQ ID NO: 360609 - DNA, 25 bp, Homo sapien
tgcttctgtacaccttttggctaca

SEQ ID NO: 360610 - DNA, 25 bp, Homo sapien
tacaccttttggctacagattgttt

SEQ ID NO: 360611 - DNA, 25 bp, Homo sapien
tacattgttttgtgctaacatctca

SEQ ID NO: 360612 - DNA, 25 bp, Homo sapien
gttgattctgccataatggcattgt

SEQ ID NO: 360613 - DNA, 25 bp, Homo sapien
aatggcattgtaaatcctggatcct

SEQ ID NO: 360614 - DNA, 25 bp, Homo sapien
tggatcctccttcacattcagttca

SEQ ID NO: 360615 - DNA, 25 bp, Homo sapien
cttcacattcagttcaatcctttgc

SEQ ID NO: 360616 - DNA, 25 bp, Homo sapien
cagttcaatcctttgcatgagaaaa

SEQ ID NO: 360617 - DNA, 25 bp, Homo sapien
gagaaaagagttcttgtacctagaa

SEQ ID NO: 360618 - DNA, 25 bp, Homo sapien
tttgtagcagcagaacgatgaatat

SEQ ID NO: 360619 - DNA, 25 bp, Homo sapien
tagctgtgactaaaggtgcacgccg

SEQ ID NO: 360620 - DNA, 25 bp, Homo sapien
agctgtgactaaaggtgcacgccgc

SEQ ID NO: 360621 - DNA, 25 bp, Homo sapien
gctgtgactaaaggtgcacgccgcc

SEQ ID NO: 360622 - DNA, 25 bp, Homo sapien
ctgtgactaaaggtgcacgccgcca

SEQ ID NO: 360623 - DNA, 25 bp, Homo sapien
tgtgactaaaggtgcacgccgccat

SEQ ID NO: 360624 - DNA, 25 bp, Homo sapien
gtgactaaaggtgcacgccgccatg

SEQ ID NO: 360625 - DNA, 25 bp, Homo sapien
tgactaaaggtgcacgccgccatgc

SEQ ID NO: 360626 - DNA, 25 bp, Homo sapien
taaaggtgcacgccgccatgcccag

SEQ ID NO: 360627 - DNA, 25 bp, Homo sapien
aaaggtgcacgccgccatgcccagc

SEQ ID NO: 360628 - DNA, 25 bp, Homo sapien
taggattacagacgtaagccgccga

SEQ ID NO: 360629 - DNA, 25 bp, Homo sapien
aggattacagacgtaagccgccgag

SEQ ID NO: 360630 - DNA, 25 bp, Homo sapien
gggcttgcagaacataattcctttt

SEQ ID NO: 360631 - DNA, 25 bp, Homo sapien
aacaggggccgcatttatcaaactt

SEQ ID NO: 360632 - DNA, 25 bp, Homo sapien
aggggccgcatttatcaaacttgcc

SEQ ID NO: 360633 - DNA, 25 bp, Homo sapien
tatcaaacttgccaacaggaaaaca

SEQ ID NO: 360634 - DNA, 25 bp, Homo sapien
atcaaacttgccaacaggaaaacac

SEQ ID NO: 360635 - DNA, 25 bp, Homo sapien
caaacttgccaacaggaaaacacct

SEQ ID NO: 360636 - DNA, 25 bp, Homo sapien
aacttgccaacaggaaaacaccttg

SEQ ID NO: 360637 - DNA, 25 bp, Homo sapien
acttgccaacaggaaaacaccttga

SEQ ID NO: 360638 - DNA, 25 bp, Homo sapien
cttgccaacaggaaaacaccttgaa

SEQ ID NO: 360639 - DNA, 25 bp, Homo sapien
ttgccaacaggaaaacaccttgaat

SEQ ID NO: 360640 - DNA, 25 bp, Homo sapien
tgccaacaggaaaacaccttgaatg

SEQ ID NO: 360641 - DNA, 25 bp, Homo sapien
gaagctcatgtttccaagtcagaca

SEQ ID NO: 360642 - DNA, 25 bp, Homo sapien
gcattgggtgcctttcggacagaag

SEQ ID NO: 360643 - DNA, 25 bp, Homo sapien
agctgcctaagctagaaggcctgcc

SEQ ID NO: 360644 - DNA, 25 bp, Homo sapien
gaatttacccagagggtggctgaga

SEQ ID NO: 360645 - DNA, 25 bp, Homo sapien
gagattgaggctttgggagccccaa

SEQ ID NO: 360646 - DNA, 25 bp, Homo sapien
agccccaagaagctgcttggtttta

SEQ ID NO: 360647 - DNA, 25 bp, Homo sapien
gcttggttttaatgtgctgccttat

SEQ ID NO: 360648 - DNA, 25 bp, Homo sapien
gctgccttatagctgagcctgttgt

SEQ ID NO: 360649 - DNA, 25 bp, Homo sapien
ctcagggcaagtagtaggatgttcc

SEQ ID NO: 360650 - DNA, 25 bp, Homo sapien
ctgggatgtgcaaggttctctcaag

SEQ ID NO: 360651 - DNA, 25 bp, Homo sapien
caagcagacatgagcctccatcact

SEQ ID NO: 360652 - DNA, 25 bp, Homo sapien
ttgtgtctttttcatctactcttcc

SEQ ID NO: 360653 - DNA, 25 bp, Homo sapien
tctttttcatctactcttccattta

SEQ ID NO: 360654 - DNA, 25 bp, Homo sapien
ggtaactcagcagtaattgagccat

SEQ ID NO: 360655 - DNA, 25 bp, Homo sapien
ttgagccatactacccgaactccta

SEQ ID NO: 360656 - DNA, 25 bp, Homo sapien
tactacccgaactcctactcttagg

SEQ ID NO: 360657 - DNA, 25 bp, Homo sapien
actcttaggtttccatgtgtggtag

SEQ ID NO: 360658 - DNA, 25 bp, Homo sapien
taggtttccatgtgtggtagtgacc

SEQ ID NO: 360659 - DNA, 25 bp, Homo sapien
aaggatgtgcttgtttaattctatg

SEQ ID NO: 360660 - DNA, 25 bp, Homo sapien
gtgcttgtttaattctatgagttta

SEQ ID NO: 360661 - DNA, 25 bp, Homo sapien
attctatgagtttatagtccaagag

SEQ ID NO: 360662 - DNA, 25 bp, Homo sapien
gtttatgggttatcaggttttacat

SEQ ID NO: 360663 - DNA, 25 bp, Homo sapien
gggtgatttttaattacgacatatt

SEQ ID NO: 360664 - DNA, 25 bp, Homo sapien
aattacgacatattgtttgactgaa

SEQ ID NO: 360665 - DNA, 25 bp, Homo sapien
acgacatattgtttgactgaaaatg

SEQ ID NO: 360666 - DNA, 25 bp, Homo sapien
attttttatgggacatatcgtggtt

SEQ ID NO: 360667 - DNA, 25 bp, Homo sapien
caaaacttactgtaggtatgaacat

SEQ ID NO: 360668 - DNA, 25 bp, Homo sapien
cttactgtaggtatgaacatttttt

SEQ ID NO: 360669 - DNA, 25 bp, Homo sapien
tttatgggacatatcgtggttgaat

SEQ ID NO: 360670 - DNA, 25 bp, Homo sapien
atgggacatatcgtggttgaataca

SEQ ID NO: 360671 - DNA, 25 bp, Homo sapien
gggacatatcgtggttgaatacaga

SEQ ID NO: 360672 - DNA, 25 bp, Homo sapien
catatcgtggttgaatacagatttc

SEQ ID NO: 360673 - DNA, 25 bp, Homo sapien
acagatttcctgtggataagaagtc

SEQ ID NO: 360674 - DNA, 25 bp, Homo sapien
ttccttgacagccatgctaaaatac

SEQ ID NO: 360675 - DNA, 25 bp, Homo sapien
gacagccatgctaaaatacttacct

SEQ ID NO: 360676 - DNA, 25 bp, Homo sapien
gccatgctaaaatacttaccttgga

SEQ ID NO: 360677 - DNA, 25 bp, Homo sapien
ttaagactgagattggtaccacggg

SEQ ID NO: 360678 - DNA, 25 bp, Homo sapien
aagactgagattggtaccacgggta

SEQ ID NO: 360679 - DNA, 25 bp, Homo sapien
gactgagattggtaccacgggtagt

SEQ ID NO: 360680 - DNA, 25 bp, Homo sapien
ttggtaccacgggtagtcatggcca

SEQ ID NO: 360681 - DNA, 25 bp, Homo sapien
gtaccacgggtagtcatggccacct

SEQ ID NO: 360682 - DNA, 25 bp, Homo sapien
accacgggtagtcatggccacctgc

SEQ ID NO: 360683 - DNA, 25 bp, Homo sapien
cacctgctggcagcgtagggtactg

SEQ ID NO: 360684 - DNA, 25 bp, Homo sapien
cctgctggcagcgtagggtactgca

SEQ ID NO: 360685 - DNA, 25 bp, Homo sapien
tgcccagcctccaacctaatttgag

SEQ ID NO: 360686 - DNA, 25 bp, Homo sapien
gcctccaacctaatttgagtttcat

SEQ ID NO: 360687 - DNA, 25 bp, Homo sapien
ttttcatcaccttacatgtgttaac

SEQ ID NO: 360688 - DNA, 25 bp, Homo sapien
acagctgtttcaacataaactccat

SEQ ID NO: 360689 - DNA, 25 bp, Homo sapien
tctatatacatttaaagaccgtgtt

SEQ ID NO: 360690 - DNA, 25 bp, Homo sapien
agaccgtgtttacataatctcttct

SEQ ID NO: 360691 - DNA, 25 bp, Homo sapien
tacttaacctttgcattggtccctt

SEQ ID NO: 360692 - DNA, 25 bp, Homo sapien
taacctttgcattggtccctttcag

SEQ ID NO: 360693 - DNA, 25 bp, Homo sapien
attggtccctttcaggcttgaacaa

SEQ ID NO: 360694 - DNA, 25 bp, Homo sapien
ttcaggcttgaacaacagtggctgt

SEQ ID NO: 360695 - DNA, 25 bp, Homo sapien
cttgaacaacagtggctgtatctgc

SEQ ID NO: 360696 - DNA, 25 bp, Homo sapien
gtcccttgctgaatacagtttcagt

SEQ ID NO: 360697 - DNA, 25 bp, Homo sapien
agattgtttatagtagtttcaggaa

SEQ ID NO: 360698 - DNA, 25 bp, Homo sapien
aaagttttgcttggttctgttctag

SEQ ID NO: 360699 - DNA, 25 bp, Homo sapien
ggttctgttctagatgttttcttct

SEQ ID NO: 360700 - DNA, 25 bp, Homo sapien
acaaaggctctttatgctgaataat

SEQ ID NO: 360701 - DNA, 25 bp, Homo sapien
tgctgaataattgtgatgcttgaag

SEQ ID NO: 360702 - DNA, 25 bp, Homo sapien
gatgcttgaagttgctaatctgctt

SEQ ID NO: 360703 - DNA, 25 bp, Homo sapien
agttgctaatctgctttaagtggat

SEQ ID NO: 360704 - DNA, 25 bp, Homo sapien
tcaggcaattctagacagttttttc

SEQ ID NO: 360705 - DNA, 25 bp, Homo sapien
gtgaacatggccttgaggtaaatct

SEQ ID NO: 360706 - DNA, 25 bp, Homo sapien
gaggtaaatctgtcccttgctgaat

SEQ ID NO: 360707 - DNA, 25 bp, Homo sapien
aggtagtactcactgaacgctcttc

SEQ ID NO: 360708 - DNA, 25 bp, Homo sapien
cttcctgcctctcataagaaccaaa

SEQ ID NO: 360709 - DNA, 25 bp, Homo sapien
aaatagcggtttcccgcagatgctc

SEQ ID NO: 360710 - DNA, 25 bp, Homo sapien
agaagcaaagtctacctaccacaca

SEQ ID NO: 360711 - DNA, 25 bp, Homo sapien
taccacacacacaatatgcagaagg

SEQ ID NO: 360712 - DNA, 25 bp, Homo sapien
agtcgtgactcatggaggctgtcct

SEQ ID NO: 360713 - DNA, 25 bp, Homo sapien
tccacccctgccaagtataagaaat

SEQ ID NO: 360714 - DNA, 25 bp, Homo sapien
aagaaatgatttctacccacccact

SEQ ID NO: 360715 - DNA, 25 bp, Homo sapien
cccacccacttctctaaggagatgg

SEQ ID NO: 360716 - DNA, 25 bp, Homo sapien
taaggagatggtccctcattcctct

SEQ ID NO: 360717 - DNA, 25 bp, Homo sapien
tcatagagatgaagccctagtcatt

SEQ ID NO: 360718 - DNA, 25 bp, Homo sapien
gaaagggcccgttgtgctgaaatcc

SEQ ID NO: 360719 - DNA, 25 bp, Homo sapien
gttgtgctgaaatcctatcatcatg

SEQ ID NO: 360720 - DNA, 25 bp, Homo sapien
atcatcatggtggatttgatcttca

SEQ ID NO: 360721 - DNA, 25 bp, Homo sapien
aattcttaactgaactggtgggtgg

SEQ ID NO: 360722 - DNA, 25 bp, Homo sapien
agtatatggcggtcattcctggtgc

SEQ ID NO: 360723 - DNA, 25 bp, Homo sapien
tatcggtgtgacatgagccctggag

SEQ ID NO: 360724 - DNA, 25 bp, Homo sapien
atgagccctggagtgtgtcgtccct

SEQ ID NO: 360725 - DNA, 25 bp, Homo sapien
cagtgactgggaccctactctagaa

SEQ ID NO: 360726 - DNA, 25 bp, Homo sapien
gggaccctactctagaactgtgtac

SEQ ID NO: 360727 - DNA, 25 bp, Homo sapien
agaactgtgtaccatccaattcgcc

SEQ ID NO: 360728 - DNA, 25 bp, Homo sapien
taccatccaattcgccatcataaag

SEQ ID NO: 360729 - DNA, 25 bp, Homo sapien
ggaaaagagacctcacaggccccgg

SEQ ID NO: 360730 - DNA, 25 bp, Homo sapien
ttcctgcgttatgggaatcatgttc

SEQ ID NO: 360731 - DNA, 25 bp, Homo sapien
aaccaactccagcaattcagtagtt

SEQ ID NO: 360732 - DNA, 25 bp, Homo sapien
gcaattcagtagttaagttcggccc

SEQ ID NO: 360733 - DNA, 25 bp, Homo sapien
attggcctacgcgaatgcctgcgct

SEQ ID NO: 360734 - DNA, 25 bp, Homo sapien
gaatgcctgcgctagcgctctattt

SEQ ID NO: 360735 - DNA, 25 bp, Homo sapien
tagcgctctatttgctcctgcggat

SEQ ID NO: 360736 - DNA, 25 bp, Homo sapien
tgcggatgcccatcatgtcaagccc

SEQ ID NO: 360737 - DNA, 25 bp, Homo sapien
aatcatgttccgacagacacactgg

SEQ ID NO: 360738 - DNA, 25 bp, Homo sapien
agacacactggtacaaccacagaaa

SEQ ID NO: 360739 - DNA, 25 bp, Homo sapien
agaagttctgatcccgtcagcgaag

SEQ ID NO: 360740 - DNA, 25 bp, Homo sapien
tgtctcctcctcagggccccaggtg

SEQ ID NO: 360741 - DNA, 25 bp, Homo sapien
tcctcagggccccaggtgtctcctc

SEQ ID NO: 360742 - DNA, 25 bp, Homo sapien
tgggccccatcctgggatccaccca

SEQ ID NO: 360743 - DNA, 25 bp, Homo sapien
atccacccacactcagccctggaag

SEQ ID NO: 360744 - DNA, 25 bp, Homo sapien
gatgagggtcctggaaacctggggg

SEQ ID NO: 360745 - DNA, 25 bp, Homo sapien
tgtggcggcgccaggactttaggcc

SEQ ID NO: 360746 - DNA, 25 bp, Homo sapien
ggcggcgccaggactttaggccagg

SEQ ID NO: 360747 - DNA, 25 bp, Homo sapien
gcggcgccaggactttaggccaggg

SEQ ID NO: 360748 - DNA, 25 bp, Homo sapien
ccgtggccagaccatcaccctctgc

SEQ ID NO: 360749 - DNA, 25 bp, Homo sapien
aggccgcctcgaagcctgtgctggc

SEQ ID NO: 360750 - DNA, 25 bp, Homo sapien
cgcctcgaagcctgtgctggcccag

SEQ ID NO: 360751 - DNA, 25 bp, Homo sapien
tcttaaccagaattcctacaactaa

SEQ ID NO: 360752 - DNA, 25 bp, Homo sapien
aaactgctatttctaactcttcatg
